United States Patent 7,250,496 (BIOINFORMATICALLY DETECTABLE GROUP OF NOVEL REGULATORY GENES AND USES THEREOF) - sequence listing, part 27

SEQ ID NO: 1150489 - RNA, 18 nt, Human
aaaaaaaaaaaaauuagc

SEQ ID NO: 1150490 - RNA, 23 nt, Human
aaaaagccagaauacgggugugc

SEQ ID NO: 1150491 - RNA, 18 nt, Human
aaaaggaagggggccugg

SEQ ID NO: 1150492 - RNA, 20 nt, Human
aacauggugaaaccucgucu

SEQ ID NO: 1150493 - RNA, 21 nt, Human
aacauggugaaaccucgucuc

SEQ ID NO: 1150494 - RNA, 20 nt, Human
aaggagaugguuuuauucaa

SEQ ID NO: 1150495 - RNA, 20 nt, Human
aaggucucccacccauucug

SEQ ID NO: 1150496 - RNA, 21 nt, Human
aagugcuggcugcccuuauga

SEQ ID NO: 1150497 - RNA, 26 nt, Human
aagugggcagaucaccuaaggucagg

SEQ ID NO: 1150498 - RNA, 22 nt, Human
aauacaaaaaaaaaaaaauuag

SEQ ID NO: 1150499 - RNA, 24 nt, Human
aaucgcuugaacccaggaggcaga

SEQ ID NO: 1150500 - RNA, 24 nt, Human
aaucgcuugaaccugggaggugga

SEQ ID NO: 1150501 - RNA, 24 nt, Human
acagagcaagacucugucucaaaa

SEQ ID NO: 1150502 - RNA, 24 nt, Human
acagagccagacucugucucaaaa

SEQ ID NO: 1150503 - RNA, 21 nt, Human
accaagaaugaugucauccac

SEQ ID NO: 1150504 - RNA, 18 nt, Human
accacagagguccuugac

SEQ ID NO: 1150505 - RNA, 24 nt, Human
accacgccacuacacuccagccug

SEQ ID NO: 1150506 - RNA, 20 nt, Human
accagauaccagcugcaagc

SEQ ID NO: 1150507 - RNA, 24 nt, Human
accucgucucuacuaaaaauacaa

SEQ ID NO: 1150508 - RNA, 22 nt, Human
accucucauugaaccuccccca

SEQ ID NO: 1150509 - RNA, 23 nt, Human
accucucauugaaccucccccac

SEQ ID NO: 1150510 - RNA, 22 nt, Human
acgccacuacacuccagccugg

SEQ ID NO: 1150511 - RNA, 24 nt, Human
acgccacuacacuccagccugggc

SEQ ID NO: 1150512 - RNA, 18 nt, Human
acuacacuccagccuggg

SEQ ID NO: 1150513 - RNA, 24 nt, Human
acuacacuccagccugggccacag

SEQ ID NO: 1150514 - RNA, 19 nt, Human
acuccagccugggccacag

SEQ ID NO: 1150515 - RNA, 24 nt, Human
acuccagccugggccacagagcaa

SEQ ID NO: 1150516 - RNA, 24 nt, Human
acugcacuccagccuggaugacag

SEQ ID NO: 1150517 - RNA, 26 nt, Human
acugcacuccagccuggaugacagag

SEQ ID NO: 1150518 - RNA, 24 nt, Human
acuuugggaggccgaagugggcag

SEQ ID NO: 1150519 - RNA, 24 nt, Human
agacgaaauucacuugacgauuaa

SEQ ID NO: 1150520 - RNA, 18 nt, Human
agacgaagguaaaagagg

SEQ ID NO: 1150521 - RNA, 18 nt, Human
agagcaagacucugucuc

SEQ ID NO: 1150522 - RNA, 22 nt, Human
agagguugcagugagcugagau

SEQ ID NO: 1150523 - RNA, 24 nt, Human
agagguugcagugagcugagauug

SEQ ID NO: 1150524 - RNA, 24 nt, Human
agcacuuugggaggccgaaguggg

SEQ ID NO: 1150525 - RNA, 23 nt, Human
agccagcaggcacugccuggggu

SEQ ID NO: 1150526 - RNA, 24 nt, Human
agccuggaugacagagccagacuc

SEQ ID NO: 1150527 - RNA, 23 nt, Human
agccuggccaacauggugaaacc

SEQ ID NO: 1150528 - RNA, 25 nt, Human
agccuggccaacauggugaaaccuc

SEQ ID NO: 1150529 - RNA, 24 nt, Human
agccugggccacagagcaagacuc

SEQ ID NO: 1150530 - RNA, 19 nt, Human
agcuaggcaugguggugca

SEQ ID NO: 1150531 - RNA, 23 nt, Human
agcuaggcaugguggugcaugcc

SEQ ID NO: 1150532 - RNA, 18 nt, Human
aggaauccaaacucaacc

SEQ ID NO: 1150533 - RNA, 19 nt, Human
aggaucugacuaccugugg

SEQ ID NO: 1150534 - RNA, 20 nt, Human
aggaugucagggagucuucu

SEQ ID NO: 1150535 - RNA, 20 nt, Human
aggcagagguugcagugagc

SEQ ID NO: 1150536 - RNA, 24 nt, Human
aggcagagguugcagugagcugag

SEQ ID NO: 1150537 - RNA, 22 nt, Human
aggcaggagaaucgcuugaacc

SEQ ID NO: 1150538 - RNA, 23 nt, Human
aggcaggagaaucgcuugaaccc

SEQ ID NO: 1150539 - RNA, 24 nt, Human
aggcaggagaaucgcuugaaccca

SEQ ID NO: 1150540 - RNA, 24 nt, Human
aggcaggagaaucgcuugaaccug

SEQ ID NO: 1150541 - RNA, 21 nt, Human
aggccgaagugggcagaucac

SEQ ID NO: 1150542 - RNA, 24 nt, Human
aggcgcgguggcucaugccuguaa

SEQ ID NO: 1150543 - RNA, 24 nt, Human
aggcuaaggcaggagaaucgcuug

SEQ ID NO: 1150544 - RNA, 20 nt, Human
aggcugaggcaggagaaucg

SEQ ID NO: 1150545 - RNA, 24 nt, Human
aggcugaggcaggagaaucgcuug

SEQ ID NO: 1150546 - RNA, 20 nt, Human
agggauuugggcagucgggg

SEQ ID NO: 1150547 - RNA, 24 nt, Human
agguggagguugcagugagccaag

SEQ ID NO: 1150548 - RNA, 23 nt, Human
aguauggacagacagcacagaug

SEQ ID NO: 1150549 - RNA, 19 nt, Human
augccuguaaucccagcac

SEQ ID NO: 1150550 - RNA, 24 nt, Human
auugcgccacugcacuccagccug

SEQ ID NO: 1150551 - RNA, 24 nt, Human
auuggccaggcgcgguggcucaug

SEQ ID NO: 1150552 - RNA, 18 nt, Human
caaaaaaaaaaagaggga

SEQ ID NO: 1150553 - RNA, 20 nt, Human
caaacucaacccucugcccu

SEQ ID NO: 1150554 - RNA, 24 nt, Human
caacauggugaaaccucgucucua

SEQ ID NO: 1150555 - RNA, 26 nt, Human
caaugccuaccacagccgucccuaga

SEQ ID NO: 1150556 - RNA, 31 nt, Human
cacacacacccacacauucaccuaugugcag

SEQ ID NO: 1150557 - RNA, 24 nt, Human
cacagagcaagacucugucucaaa

SEQ ID NO: 1150558 - RNA, 20 nt, Human
caccagcauaaccagauacc

SEQ ID NO: 1150559 - RNA, 25 nt, Human
caccccacugcuccuggccccccua

SEQ ID NO: 1150560 - RNA, 22 nt, Human
caccuccccccagcacacauac

SEQ ID NO: 1150561 - RNA, 24 nt, Human
cacuacacuccagccugggccaca

SEQ ID NO: 1150562 - RNA, 23 nt, Human
cacuccagccuggaugacagagc

SEQ ID NO: 1150563 - RNA, 23 nt, Human
cacuccagccugggccacagagc

SEQ ID NO: 1150564 - RNA, 18 nt, Human
cacugcacuccagccugg

SEQ ID NO: 1150565 - RNA, 19 nt, Human
cacugcacuccagccugga

SEQ ID NO: 1150566 - RNA, 19 nt, Human
cacugcacuccagccugga

SEQ ID NO: 1150567 - RNA, 22 nt, Human
cacugcacuccagccuggauga

SEQ ID NO: 1150568 - RNA, 24 nt, Human
cacugcacuccagccuggaugaca

SEQ ID NO: 1150569 - RNA, 27 nt, Human
cagaucaccuaaggucaggaguuugaa

SEQ ID NO: 1150570 - RNA, 24 nt, Human
cagcacuuugggaggccgaagugg

SEQ ID NO: 1150571 - RNA, 20 nt, Human
caggaauccaaacucaaccc

SEQ ID NO: 1150572 - RNA, 23 nt, Human
cagggagucuucugaacucaggg

SEQ ID NO: 1150573 - RNA, 28 nt, Human
caguaggcuuccuauacaaguauucugg

SEQ ID NO: 1150574 - RNA, 19 nt, Human
cauaaccacagagguccuu

SEQ ID NO: 1150575 - RNA, 25 nt, Human
cauaaccagauaccagcugcaagcc

SEQ ID NO: 1150576 - RNA, 21 nt, Human
cauacccacucacacacaccc

SEQ ID NO: 1150577 - RNA, 24 nt, Human
caugccuguaaucccagcacuuug

SEQ ID NO: 1150578 - RNA, 20 nt, Human
cauuuugaccccuccagcaa

SEQ ID NO: 1150579 - RNA, 18 nt, Human
ccaagaccacgccacuac

SEQ ID NO: 1150580 - RNA, 19 nt, Human
ccaaugccuaccacagccg

SEQ ID NO: 1150581 - RNA, 20 nt, Human
ccacuacacuccagccuggg

SEQ ID NO: 1150582 - RNA, 21 nt, Human
ccacuacacuccagccugggc

SEQ ID NO: 1150583 - RNA, 23 nt, Human
ccacuacacuccagccugggcca

SEQ ID NO: 1150584 - RNA, 24 nt, Human
ccacuacacuccagccugggccac

SEQ ID NO: 1150585 - RNA, 18 nt, Human
ccacugcacuccagccug

SEQ ID NO: 1150586 - RNA, 19 nt, Human
ccacugcacuccagccugg

SEQ ID NO: 1150587 - RNA, 20 nt, Human
ccacugcacuccagccugga

SEQ ID NO: 1150588 - RNA, 21 nt, Human
ccacugcacuccagccuggau

SEQ ID NO: 1150589 - RNA, 24 nt, Human
ccacugcacuccagccuggaugac

SEQ ID NO: 1150590 - RNA, 22 nt, Human
ccagauaccagcugcaagccaa

SEQ ID NO: 1150591 - RNA, 23 nt, Human
ccagcacacauacucaccaguca

SEQ ID NO: 1150592 - RNA, 21 nt, Human
ccagcacuuugggaggccgaa

SEQ ID NO: 1150593 - RNA, 19 nt, Human
ccagccagcaggcacugcc

SEQ ID NO: 1150594 - RNA, 22 nt, Human
ccagccuggaugacagagccag

SEQ ID NO: 1150595 - RNA, 22 nt, Human
ccaggaggcagagguugcagug

SEQ ID NO: 1150596 - RNA, 26 nt, Human
cccacacauucaccuaugugcaccuc

SEQ ID NO: 1150597 - RNA, 22 nt, Human
cccacugcuccuggccccccua

SEQ ID NO: 1150598 - RNA, 24 nt, Human
cccauucugcagggauuccaaaag

SEQ ID NO: 1150599 - RNA, 18 nt, Human
ccccucccaaccaccaag

SEQ ID NO: 1150600 - RNA, 22 nt, Human
cccucugcccuaagaccuaagg

SEQ ID NO: 1150601 - RNA, 22 nt, Human
ccuaaggucaggaguuugaaac

SEQ ID NO: 1150602 - RNA, 18 nt, Human
ccuauuccccucccaacc

SEQ ID NO: 1150603 - RNA, 21 nt, Human
ccuggccaacauggugaaacc

SEQ ID NO: 1150604 - RNA, 24 nt, Human
ccuggccaacauggugaaaccucg

SEQ ID NO: 1150605 - RNA, 21 nt, Human
ccugggagguggagguugcag

SEQ ID NO: 1150606 - RNA, 21 nt, Human
ccugggauuuugcagacgaag

SEQ ID NO: 1150607 - RNA, 22 nt, Human
ccugggccacagagcaagacuc

SEQ ID NO: 1150608 - RNA, 21 nt, Human
ccuguagucccagcuacugcg

SEQ ID NO: 1150609 - RNA, 22 nt, Human
ccuguagucccagcuacugcgg

SEQ ID NO: 1150610 - RNA, 26 nt, Human
cgaagugggcagaucaccuaagguca

SEQ ID NO: 1150611 - RNA, 26 nt, Human
cgccacugcacuccagccuggaugac

SEQ ID NO: 1150612 - RNA, 18 nt, Human
cgggugugcauucugcca

SEQ ID NO: 1150613 - RNA, 23 nt, Human
cuagacaaggucucccacccauu

SEQ ID NO: 1150614 - RNA, 24 nt, Human
cucaugccuguaaucccagcacuu

SEQ ID NO: 1150615 - RNA, 19 nt, Human
cucugucucaaaaaaaaaa

SEQ ID NO: 1150616 - RNA, 21 nt, Human
cuguaaucccagcuacucggg

SEQ ID NO: 1150617 - RNA, 19 nt, Human
cuugaaccugggaggugga

SEQ ID NO: 1150618 - RNA, 19 nt, Human
gaaaccucgucucuacuaa

SEQ ID NO: 1150619 - RNA, 23 nt, Human
gaaacuagccuggccaacauggu

SEQ ID NO: 1150620 - RNA, 22 nt, Human
gaacggggcagggggcuagcuc

SEQ ID NO: 1150621 - RNA, 21 nt, Human
gaagacuuugguuucauccuc

SEQ ID NO: 1150622 - RNA, 22 nt, Human
gaagugcuggcugcccuuauga

SEQ ID NO: 1150623 - RNA, 24 nt, Human
gacagagccagacucugucucaaa

SEQ ID NO: 1150624 - RNA, 24 nt, Human
gaccagucuucuggaagaaacugg

SEQ ID NO: 1150625 - RNA, 19 nt, Human
gaccuaaggcagaaaggau

SEQ ID NO: 1150626 - RNA, 18 nt, Human
gagaaaaggccagcugca

SEQ ID NO: 1150627 - RNA, 23 nt, Human
gagaaucgcuugaacccaggagg

SEQ ID NO: 1150628 - RNA, 23 nt, Human
gagaaucgcuugaaccugggagg

SEQ ID NO: 1150629 - RNA, 23 nt, Human
gagauugcgccacugcacuccag

SEQ ID NO: 1150630 - RNA, 22 nt, Human
gagcaaucuuaaaauccaccag

SEQ ID NO: 1150631 - RNA, 26 nt, Human
gagggacaucucaaagaaaaggaagg

SEQ ID NO: 1150632 - RNA, 19 nt, Human
gagguugcagugagccaag

SEQ ID NO: 1150633 - RNA, 24 nt, Human
gaucaccuaaggucaggaguuuga

SEQ ID NO: 1150634 - RNA, 20 nt, Human
gcaaggcaacccacaguccu

SEQ ID NO: 1150635 - RNA, 24 nt, Human
gcacuccagccuggaugacagagc

SEQ ID NO: 1150636 - RNA, 20 nt, Human
gcacuugucacgaaagggca

SEQ ID NO: 1150637 - RNA, 19 nt, Human
gcagagaacggggcagggg

SEQ ID NO: 1150638 - RNA, 22 nt, Human
gcaggagaaucgcuugaaccca

SEQ ID NO: 1150639 - RNA, 24 nt, Human
gccaacauggugaaaccucgucuc

SEQ ID NO: 1150640 - RNA, 20 nt, Human
gccaagaccacgccacuaca

SEQ ID NO: 1150641 - RNA, 22 nt, Human
gccacuacacuccagccugggc

SEQ ID NO: 1150642 - RNA, 20 nt, Human
gcccuaagaccuaaggcaga

SEQ ID NO: 1150643 - RNA, 25 nt, Human
ggacagacagcacagaugagucccu

SEQ ID NO: 1150644 - RNA, 22 nt, Human
ggaggcagagguugcagugagc

SEQ ID NO: 1150645 - RNA, 19 nt, Human
ggagggcaguguggccuuu

SEQ ID NO: 1150646 - RNA, 18 nt, Human
ggagguugcagugagcca

SEQ ID NO: 1150647 - RNA, 20 nt, Human
ggagguugcagugagccaag

SEQ ID NO: 1150648 - RNA, 25 nt, Human
ggcagaucaccuaaggucaggaguu

SEQ ID NO: 1150649 - RNA, 25 nt, Human
gggacaucucaaagaaaaggaaggg

SEQ ID NO: 1150650 - RNA, 22 nt, Human
gggauuuugcagacgaagguaa

SEQ ID NO: 1150651 - RNA, 24 nt, Human
ggugccccauuggugccaagagca

SEQ ID NO: 1150652 - RNA, 23 nt, Human
gguggcucaugccuguaauccca

SEQ ID NO: 1150653 - RNA, 24 nt, Human
gguggcucaugccuguaaucccag

SEQ ID NO: 1150654 - RNA, 19 nt, Human
guagaacuccuucagauuc

SEQ ID NO: 1150655 - RNA, 21 nt, Human
guagaacuccuucagauucug

SEQ ID NO: 1150656 - RNA, 19 nt, Human
gucccuagacaaggucucc

SEQ ID NO: 1150657 - RNA, 21 nt, Human
guugcagugagcugagauugc

SEQ ID NO: 1150658 - RNA, 23 nt, Human
uaaggagaugguuuuauucaagc

SEQ ID NO: 1150659 - RNA, 23 nt, Human
uaaggagaugguuuuauucaagc

SEQ ID NO: 1150660 - RNA, 20 nt, Human
uaaggcaggagaaucgcuug

SEQ ID NO: 1150661 - RNA, 24 nt, Human
uaaggcaggagaaucgcuugaacc

SEQ ID NO: 1150662 - RNA, 19 nt, Human
uacccacucacacacaccu

SEQ ID NO: 1150663 - RNA, 22 nt, Human
uagaugaacagggcagaagaug

SEQ ID NO: 1150664 - RNA, 24 nt, Human
uagccuggccaacauggugaaacc

SEQ ID NO: 1150665 - RNA, 21 nt, Human
ucaaaaaaaaaaagagggagg

SEQ ID NO: 1150666 - RNA, 18 nt, Human
ucaacccucugcccuaag

SEQ ID NO: 1150667 - RNA, 19 nt, Human
ucauccaccaggaauccaa

SEQ ID NO: 1150668 - RNA, 22 nt, Human
ucaugccuguaaucccagcacu

SEQ ID NO: 1150669 - RNA, 21 nt, Human
uccaagagguuagcagaagaa

SEQ ID NO: 1150670 - RNA, 24 nt, Human
uccagccuggaugacagagccaga

SEQ ID NO: 1150671 - RNA, 23 nt, Human
uccccccagcacacauacucacc

SEQ ID NO: 1150672 - RNA, 24 nt, Human
ucgcuugaaccugggagguggagg

SEQ ID NO: 1150673 - RNA, 22 nt, Human
ucucuacuaaaaauacaaaaaa

SEQ ID NO: 1150674 - RNA, 19 nt, Human
ucugucucaaaaaaaaaaa

SEQ ID NO: 1150675 - RNA, 22 nt, Human
ucuucuggcaagacauacucag

SEQ ID NO: 1150676 - RNA, 21 nt, Human
ugaaacaguuaucacugagca

SEQ ID NO: 1150677 - RNA, 27 nt, Human
ugaaccucccccacauuuacacaucau

SEQ ID NO: 1150678 - RNA, 24 nt, Human
ugaaccugggagguggagguugca

SEQ ID NO: 1150679 - RNA, 19 nt, Human
ugaccagcccagccagcag

SEQ ID NO: 1150680 - RNA, 18 nt, Human
ugacuuccugaccagccc

SEQ ID NO: 1150681 - RNA, 22 nt, Human
ugagcugagauugcgccacugc

SEQ ID NO: 1150682 - RNA, 20 nt, Human
ugaggcaggagaaucgcuug

SEQ ID NO: 1150683 - RNA, 24 nt, Human
ugaggcaggagaaucgcuugaacc

SEQ ID NO: 1150684 - RNA, 25 nt, Human
ugaggcaggagaaucgcuugaaccc

SEQ ID NO: 1150685 - RNA, 21 nt, Human
ugcaacccuugcuggacaccc

SEQ ID NO: 1150686 - RNA, 21 nt, Human
ugcagagaacggggcaggggg

SEQ ID NO: 1150687 - RNA, 22 nt, Human
ugcagagaacggggcagggggc

SEQ ID NO: 1150688 - RNA, 18 nt, Human
ugccugggguggucagua

SEQ ID NO: 1150689 - RNA, 19 nt, Human
ugccugggguggucaguag

SEQ ID NO: 1150690 - RNA, 23 nt, Human
ugccuguaaucccagcacuuugg

SEQ ID NO: 1150691 - RNA, 23 nt, Human
ugccuguaaucccagcacuuugg

SEQ ID NO: 1150692 - RNA, 24 nt, Human
ugccuguaaucccagcacuuuggg

SEQ ID NO: 1150693 - RNA, 24 nt, Human
ugccuguagucccagcuacugcgg

SEQ ID NO: 1150694 - RNA, 24 nt, Human
ugcuccuuuccuauuccccuccca

SEQ ID NO: 1150695 - RNA, 24 nt, Human
uggccaacauggugaaaccucguc

SEQ ID NO: 1150696 - RNA, 24 nt, Human
uggccaggcgcgguggcucaugcc

SEQ ID NO: 1150697 - RNA, 22 nt, Human
uggcucaugccuguaaucccag

SEQ ID NO: 1150698 - RNA, 24 nt, Human
uggcucaugccuguaaucccagca

SEQ ID NO: 1150699 - RNA, 20 nt, Human
ugggaggccgaagugggcag

SEQ ID NO: 1150700 - RNA, 24 nt, Human
ugggaggccgaagugggcagauca

SEQ ID NO: 1150701 - RNA, 20 nt, Human
ugggagggcaguguggccuu

SEQ ID NO: 1150702 - RNA, 21 nt, Human
ugggagggcaguguggccuuu

SEQ ID NO: 1150703 - RNA, 18 nt, Human
ugggagguggagguugca

SEQ ID NO: 1150704 - RNA, 29 nt, Human
ugggagguggagguugcagugacaacggu

SEQ ID NO: 1150705 - RNA, 24 nt, Human
ugggagguggagguugcagugagc

SEQ ID NO: 1150706 - RNA, 24 nt, Human
ugggcagaucaccuaaggucagga

SEQ ID NO: 1150707 - RNA, 18 nt, Human
uggugcaugccuguaguc

SEQ ID NO: 1150708 - RNA, 24 nt, Human
ugguggugcaugccuguaguccca

SEQ ID NO: 1150709 - RNA, 26 nt, Human
ugucagggagucuucugaacucaggg

SEQ ID NO: 1150710 - RNA, 24 nt, Human
uguccgagggaugagccacaggag

SEQ ID NO: 1150711 - RNA, 24 nt, Human
uuaaaguaaaagccaguaguugaa

SEQ ID NO: 1150712 - RNA, 21 nt, Human
uuagauuacaggaugucaggg

SEQ ID NO: 1150713 - RNA, 20 nt, Human
uuagcuaggcaugguggugc

SEQ ID NO: 1150714 - RNA, 24 nt, Human
uuagcuaggcaugguggugcaugc

SEQ ID NO: 1150715 - RNA, 18 nt, Human
uuccugaccagcccagcc

SEQ ID NO: 1150716 - RNA, 21 nt, Human
uucugggagaaaaggccagcu

SEQ ID NO: 1150717 - RNA, 26 nt, Human
uucugggccaccucucauugaaccuc

SEQ ID NO: 1150718 - RNA, 24 nt, Human
uugaaccugggagguggagguugc

SEQ ID NO: 1150719 - RNA, 20 nt, Human
uugcagugagccaagaccac

SEQ ID NO: 1150720 - RNA, 22 nt, Human
uugcagugagcugagauugcgc

SEQ ID NO: 1150721 - RNA, 23 nt, Human
uugcuggacaccccacugcuccu

SEQ ID NO: 1150722 - RNA, 23 nt, Human
uuuuugaguuucuuaaagcuguc

SEQ ID NO: 1150723 - RNA, 22 nt, Human
aaacauccacugagacucccca

SEQ ID NO: 1150724 - RNA, 24 nt, Human
aacccucgcugcccacagcagccc

SEQ ID NO: 1150725 - RNA, 21 nt, Human
aagcaaaagucaaacauccac

SEQ ID NO: 1150726 - RNA, 21 nt, Human
aagucaaacauccacugagac

SEQ ID NO: 1150727 - RNA, 22 nt, Human
accgcaggcgccgacacgcugg

SEQ ID NO: 1150728 - RNA, 25 nt, Human
aucacuacccccaccagaauucaga

SEQ ID NO: 1150729 - RNA, 25 nt, Human
cagaacacacaugagucuauaaccc

SEQ ID NO: 1150730 - RNA, 20 nt, Human
cagcccgaagaaaaccgcag

SEQ ID NO: 1150731 - RNA, 22 nt, Human
caucuucuaccuccuuugggga

SEQ ID NO: 1150732 - RNA, 24 nt, Human
ccacugagacuccccaucaaugag

SEQ ID NO: 1150733 - RNA, 23 nt, Human
ccaucaaugaggcccaucccgaa

SEQ ID NO: 1150734 - RNA, 24 nt, Human
cccacagcagcccuugucccuaac

SEQ ID NO: 1150735 - RNA, 23 nt, Human
cccuaacagguuuuccuuuaagg

SEQ ID NO: 1150736 - RNA, 20 nt, Human
ccucgcugcccacagcagcc

SEQ ID NO: 1150737 - RNA, 19 nt, Human
cuugaccuuuuuuccugca

SEQ ID NO: 1150738 - RNA, 21 nt, Human
gcgcgugacggacgcgggcac

SEQ ID NO: 1150739 - RNA, 19 nt, Human
guagaaagcaaaagucaaa

SEQ ID NO: 1150740 - RNA, 24 nt, Human
uaacagguuuuccuuuaaggcugu

SEQ ID NO: 1150741 - RNA, 20 nt, Human
uacccccaccagaauucaga

SEQ ID NO: 1150742 - RNA, 22 nt, Human
uacccccaccagaauucagaac

SEQ ID NO: 1150743 - RNA, 28 nt, Human
uaccuuuacuucgccagucagauaauuc

SEQ ID NO: 1150744 - RNA, 22 nt, Human
ucacuacccccaccagaauuca

SEQ ID NO: 1150745 - RNA, 18 nt, Human
uccacugagacuccccau

SEQ ID NO: 1150746 - RNA, 19 nt, Human
uccccaucaaugaggccca

SEQ ID NO: 1150747 - RNA, 26 nt, Human
ucccgaagaaucagccgaccauuggg

SEQ ID NO: 1150748 - RNA, 26 nt, Human
ucccgaagaaucagccgggaauugcc

SEQ ID NO: 1150749 - RNA, 19 nt, Human
ucgcugcccacagcagccc

SEQ ID NO: 1150750 - RNA, 23 nt, Human
ucuuccccaucuucuaccuccuu

SEQ ID NO: 1150751 - RNA, 23 nt, Human
ugaggcccaucccgaagaaucag

SEQ ID NO: 1150752 - RNA, 18 nt, Human
ugcaagccaccgcgcgug

SEQ ID NO: 1150753 - RNA, 21 nt, Human
ugcaauucaaguaccuuuacu

SEQ ID NO: 1150754 - RNA, 19 nt, Human
ugccaaggcaguuuucaga

SEQ ID NO: 1150755 - RNA, 22 nt, Human
uuccccaucuucuaccuccuuu

SEQ ID NO: 1150756 - RNA, 25 nt, Human
aaggagcccagucccauuucuuggc

SEQ ID NO: 1150757 - RNA, 21 nt, Human
agaaggucauaaauccaagga

SEQ ID NO: 1150758 - RNA, 20 nt, Human
agucaauucuucugcagucu

SEQ ID NO: 1150759 - RNA, 24 nt, Human
cacaggugggaggcuggcgugcga

SEQ ID NO: 1150760 - RNA, 23 nt, Human
cacugcugccagccuucccuuuc

SEQ ID NO: 1150761 - RNA, 21 nt, Human
cagggcuggggagggagaggg

SEQ ID NO: 1150762 - RNA, 18 nt, Human
ccaaggagcccaguccca

SEQ ID NO: 1150763 - RNA, 21 nt, Human
ccaggcuggacguggcuucca

SEQ ID NO: 1150764 - RNA, 25 nt, Human
ccucacugcugccagccuucccuuu

SEQ ID NO: 1150765 - RNA, 21 nt, Human
ccuuugucucacaggugggag

SEQ ID NO: 1150766 - RNA, 20 nt, Human
cggggccaggcuggacgugg

SEQ ID NO: 1150767 - RNA, 23 nt, Human
cuggagcagucauuggguggagg

SEQ ID NO: 1150768 - RNA, 21 nt, Human
cuuggccuucagggcugggga

SEQ ID NO: 1150769 - RNA, 19 nt, Human
gccaggaacgaucagacug

SEQ ID NO: 1150770 - RNA, 21 nt, Human
ggaacauugccaaggucaaaa

SEQ ID NO: 1150771 - RNA, 19 nt, Human
ucauaaauccaaggagccc

SEQ ID NO: 1150772 - RNA, 21 nt, Human
ugccaaggucaaaaaaccuca

SEQ ID NO: 1150773 - RNA, 18 nt, Human
uuccagugacagggcccu

SEQ ID NO: 1150774 - RNA, 22 nt, Human
uuucccaucaguccuccguuag

SEQ ID NO: 1150775 - RNA, 21 nt, Human
aaaaaugcuucaaaaauccua

SEQ ID NO: 1150776 - RNA, 19 nt, Human
aagcaaagccaucaaauau

SEQ ID NO: 1150777 - RNA, 20 nt, Human
aaguucuccugugacuuuuc

SEQ ID NO: 1150778 - RNA, 22 nt, Human
ucaaauaucuauaaaaugugac

SEQ ID NO: 1150779 - RNA, 21 nt, Human
ugccauauugcucuucuacuc

SEQ ID NO: 1150780 - RNA, 19 nt, Human
uuuaugccauauugcucuu

SEQ ID NO: 1150781 - RNA, 21 nt, Human
uuuuaugccauauugcucuuc

SEQ ID NO: 1150782 - RNA, 27 nt, Human
acaaaguagcaagugucaugucagaac

SEQ ID NO: 1150783 - RNA, 22 nt, Human
acuucagucuuuucuucaauau

SEQ ID NO: 1150784 - RNA, 22 nt, Human
acuuugagacuacuuugcaguu

SEQ ID NO: 1150785 - RNA, 20 nt, Human
agaaggaaccgucagaagca

SEQ ID NO: 1150786 - RNA, 19 nt, Human
agcuguaaaauugcaaaca

SEQ ID NO: 1150787 - RNA, 22 nt, Human
caaaaagaacauuuuacagaaa

SEQ ID NO: 1150788 - RNA, 19 nt, Human
caaguacaaacuaaaccuu

SEQ ID NO: 1150789 - RNA, 20 nt, Human
cagaaagggaaccguaacau

SEQ ID NO: 1150790 - RNA, 21 nt, Human
cagaacaccaugcuagaugga

SEQ ID NO: 1150791 - RNA, 22 nt, Human
cagcuucaucaagagaaugaaa

SEQ ID NO: 1150792 - RNA, 27 nt, Human
cauccuugucuucacuacugucagagg

SEQ ID NO: 1150793 - RNA, 19 nt, Human
cauuuuacagaaagggaac

SEQ ID NO: 1150794 - RNA, 27 nt, Human
ccaccaccuuguuaauuuuuuaccugg

SEQ ID NO: 1150795 - RNA, 18 nt, Human
ccucuaaaauacuuugag

SEQ ID NO: 1150796 - RNA, 19 nt, Human
ccuuuuuguuugaagcucc

SEQ ID NO: 1150797 - RNA, 21 nt, Human
cuggaacucagaacaccaugc

SEQ ID NO: 1150798 - RNA, 18 nt, Human
cuuuuuguuugaagcucc

SEQ ID NO: 1150799 - RNA, 23 nt, Human
gaaccguaacauuacacaaaaaa

SEQ ID NO: 1150800 - RNA, 24 nt, Human
gcaaugcuuucuuuagaucaccaa

SEQ ID NO: 1150801 - RNA, 18 nt, Human
ggugggcacuuuguuuug

SEQ ID NO: 1150802 - RNA, 23 nt, Human
uaaugcuaacaaauaacgaaaca

SEQ ID NO: 1150803 - RNA, 20 nt, Human
uacagaaagggaaccguaac

SEQ ID NO: 1150804 - RNA, 22 nt, Human
uaccugccaucacagauggccu

SEQ ID NO: 1150805 - RNA, 20 nt, Human
uagaucaccaaaaagaacau

SEQ ID NO: 1150806 - RNA, 22 nt, Human
uagcuguaaaauugcaaacaag

SEQ ID NO: 1150807 - RNA, 21 nt, Human
uauuuuuucauccuugucuuc

SEQ ID NO: 1150808 - RNA, 19 nt, Human
ucaauauggauucccucua

SEQ ID NO: 1150809 - RNA, 23 nt, Human
ucaggcaccuaggaaauaauucu

SEQ ID NO: 1150810 - RNA, 22 nt, Human
ucaugucagaacacuuucaggc

SEQ ID NO: 1150811 - RNA, 18 nt, Human
ugaagcuccgguucuucu

SEQ ID NO: 1150812 - RNA, 21 nt, Human
ugcaaacaagaaaggcaaugc

SEQ ID NO: 1150813 - RNA, 20 nt, Human
uggccuaaccuauguacacu

SEQ ID NO: 1150814 - RNA, 21 nt, Human
uuaaugcuaacaaauaacgaa

SEQ ID NO: 1150815 - RNA, 19 nt, Human
uucacagagaaggaaccgu

SEQ ID NO: 1150816 - RNA, 24 nt, Human
uugugcucuggauaaaaacccacc

SEQ ID NO: 1150817 - RNA, 18 nt, Human
uuucacagagaaggaacc

SEQ ID NO: 1150818 - RNA, 23 nt, Human
aaauaaguugaggccagagccag

SEQ ID NO: 1150819 - RNA, 20 nt, Human
aacaaagugucggaccaaaa

SEQ ID NO: 1150820 - RNA, 21 nt, Human
aacugagccuggaggggccca

SEQ ID NO: 1150821 - RNA, 21 nt, Human
aagcaccccuacaacagagga

SEQ ID NO: 1150822 - RNA, 25 nt, Human
aagcaucacagucugagguacaagc

SEQ ID NO: 1150823 - RNA, 21 nt, Human
aaucagucccucaacaugaag

SEQ ID NO: 1150824 - RNA, 23 nt, Human
acaacagaggagucagcugugga

SEQ ID NO: 1150825 - RNA, 18 nt, Human
acauugcaaacacaauca

SEQ ID NO: 1150826 - RNA, 24 nt, Human
acgcacuucagguuguccuuaacc

SEQ ID NO: 1150827 - RNA, 23 nt, Human
agaccacuggcugcagcagagaa

SEQ ID NO: 1150828 - RNA, 23 nt, Human
agagaggaaggaggagcuccugg

SEQ ID NO: 1150829 - RNA, 22 nt, Human
agaggaaggaggagcuccuggc

SEQ ID NO: 1150830 - RNA, 19 nt, Human
agaggcgcguccugcagga

SEQ ID NO: 1150831 - RNA, 19 nt, Human
agaugcuggaggcagguga

SEQ ID NO: 1150832 - RNA, 20 nt, Human
agcaggaggcacagccaagg

SEQ ID NO: 1150833 - RNA, 18 nt, Human
agccgaacaggcuccagg

SEQ ID NO: 1150834 - RNA, 22 nt, Human
agcugcuggaagaacagcucac

SEQ ID NO: 1150835 - RNA, 22 nt, Human
aggcagaugcccugaggccagg

SEQ ID NO: 1150836 - RNA, 18 nt, Human
aggccaggguuucccugc

SEQ ID NO: 1150837 - RNA, 22 nt, Human
aggccgcagaggcucagcggcg

SEQ ID NO: 1150838 - RNA, 24 nt, Human
aggcggagaggcgcguccugcagg

SEQ ID NO: 1150839 - RNA, 19 nt, Human
agggugaccaggagggcag

SEQ ID NO: 1150840 - RNA, 27 nt, Human
aguaacaaagugucggaccaaaaaaaa

SEQ ID NO: 1150841 - RNA, 18 nt, Human
caaauuccauaaaagcug

SEQ ID NO: 1150842 - RNA, 20 nt, Human
caacgcacuucagguugucc

SEQ ID NO: 1150843 - RNA, 24 nt, Human
caccucaggcuuuaucccaagggc

SEQ ID NO: 1150844 - RNA, 19 nt, Human
cacgcuagaccagaccccc

SEQ ID NO: 1150845 - RNA, 21 nt, Human
cacgcuagaccagacccccag

SEQ ID NO: 1150846 - RNA, 22 nt, Human
cagaggagucagcuguggacac

SEQ ID NO: 1150847 - RNA, 18 nt, Human
cagagugggcacacggcc

SEQ ID NO: 1150848 - RNA, 20 nt, Human
cagcagagaaccugccaagc

SEQ ID NO: 1150849 - RNA, 22 nt, Human
cagcagagaaccugccaagccc

SEQ ID NO: 1150850 - RNA, 25 nt, Human
cagcccacgggguggccucacaccg

SEQ ID NO: 1150851 - RNA, 24 nt, Human
cagggccucccacccccagugucu

SEQ ID NO: 1150852 - RNA, 18 nt, Human
ccaagcccaagucuuugc

SEQ ID NO: 1150853 - RNA, 21 nt, Human
ccaagggcaguaggagccacc

SEQ ID NO: 1150854 - RNA, 30 nt, Human
ccaaugacggacgccuugcaaucuccuucu

SEQ ID NO: 1150855 - RNA, 22 nt, Human
ccacccccagugucuccaggug

SEQ ID NO: 1150856 - RNA, 27 nt, Human
ccacgcccagcgucuucggcccaggug

SEQ ID NO: 1150857 - RNA, 20 nt, Human
ccacgggguggccucacacc

SEQ ID NO: 1150858 - RNA, 25 nt, Human
ccagaaggagcuggccauuucuccc

SEQ ID NO: 1150859 - RNA, 21 nt, Human
ccagaaggcugagguaucgcc

SEQ ID NO: 1150860 - RNA, 23 nt, Human
ccagacggucuaggcagaugccc

SEQ ID NO: 1150861 - RNA, 22 nt, Human
ccagagccagccuuagauggaa

SEQ ID NO: 1150862 - RNA, 22 nt, Human
cccaagggcaguaggagccacc

SEQ ID NO: 1150863 - RNA, 24 nt, Human
cccaaucccuggcccacgcccagc

SEQ ID NO: 1150864 - RNA, 27 nt, Human
cccccagugucuccagguggacccugu

SEQ ID NO: 1150865 - RNA, 18 nt, Human
ccggccucucaagcuguc

SEQ ID NO: 1150866 - RNA, 20 nt, Human
ccucacaccgaucccucuuu

SEQ ID NO: 1150867 - RNA, 21 nt, Human
ccucaggaaggugcaagggcu

SEQ ID NO: 1150868 - RNA, 19 nt, Human
ccucugagaccacuggcug

SEQ ID NO: 1150869 - RNA, 21 nt, Human
ccugcagggccucccaccccc

SEQ ID NO: 1150870 - RNA, 18 nt, Human
cgcaugcuucuguguccu

SEQ ID NO: 1150871 - RNA, 25 nt, Human
cgcccagcgucuucggcccaggugc

SEQ ID NO: 1150872 - RNA, 18 nt, Human
cggccgaggcgcaggcgg

SEQ ID NO: 1150873 - RNA, 19 nt, Human
cggcgggcaggaggcggcc

SEQ ID NO: 1150874 - RNA, 22 nt, Human
cucaggcuuccuggggguccac

SEQ ID NO: 1150875 - RNA, 24 nt, Human
cucccaaucccuggcccacgccca

SEQ ID NO: 1150876 - RNA, 20 nt, Human
cucucaagcugucugcacag

SEQ ID NO: 1150877 - RNA, 18 nt, Human
cucuccuugaugccggcc

SEQ ID NO: 1150878 - RNA, 20 nt, Human
cuggcccacgcaugcuucug

SEQ ID NO: 1150879 - RNA, 24 nt, Human
cuugcaaucuccuucacacgucug

SEQ ID NO: 1150880 - RNA, 27 nt, Human
cuuggggagggucaccucaggcuuuau

SEQ ID NO: 1150881 - RNA, 22 nt, Human
cuuugagguuacauugcaaaca

SEQ ID NO: 1150882 - RNA, 19 nt, Human
gacccaggcaccauccagu

SEQ ID NO: 1150883 - RNA, 26 nt, Human
gacuuucgucucaggcuuccuggggg

SEQ ID NO: 1150884 - RNA, 20 nt, Human
gagccagccuuagauggaac

SEQ ID NO: 1150885 - RNA, 21 nt, Human
gaggcggccgaggcgcaggcg

SEQ ID NO: 1150886 - RNA, 23 nt, Human
gcacacggccccagcccacgggg

SEQ ID NO: 1150887 - RNA, 21 nt, Human
gcagagacccaggcaccaucc

SEQ ID NO: 1150888 - RNA, 21 nt, Human
gcagagugggcacacggcccc

SEQ ID NO: 1150889 - RNA, 19 nt, Human
gcaggugagggcagagugg

SEQ ID NO: 1150890 - RNA, 22 nt, Human
gcccacgcuagaccagaccccc

SEQ ID NO: 1150891 - RNA, 24 nt, Human
gcgacaggugagggugaccaggag

SEQ ID NO: 1150892 - RNA, 23 nt, Human
gcggugguccuuagagaggaagg

SEQ ID NO: 1150893 - RNA, 24 nt, Human
ggaaacugagccuggaggggccca

SEQ ID NO: 1150894 - RNA, 27 nt, Human
ggccugagccgaacaggcuccaggagc

SEQ ID NO: 1150895 - RNA, 21 nt, Human
gggagggucaccucaggcuuu

SEQ ID NO: 1150896 - RNA, 18 nt, Human
gggcaggaggcggccgag

SEQ ID NO: 1150897 - RNA, 26 nt, Human
gggccugagccgaacaggcuccagga

SEQ ID NO: 1150898 - RNA, 20 nt, Human
gucggaccaaaaaaaaaagu

SEQ ID NO: 1150899 - RNA, 19 nt, Human
gugaagcaucacagucuga

SEQ ID NO: 1150900 - RNA, 19 nt, Human
uaacaaagugucggaccaa

SEQ ID NO: 1150901 - RNA, 24 nt, Human
uagagaggaaggaggagcuccugg

SEQ ID NO: 1150902 - RNA, 21 nt, Human
uaggagccaccaaggcuggag

SEQ ID NO: 1150903 - RNA, 23 nt, Human
ucaucaagaccugaccaggccaa

SEQ ID NO: 1150904 - RNA, 22 nt, Human
ucccccgcugacagauggggaa

SEQ ID NO: 1150905 - RNA, 22 nt, Human
uccucaccuggcaggugagggc

SEQ ID NO: 1150906 - RNA, 24 nt, Human
uccuggggguccacaccuuugagg

SEQ ID NO: 1150907 - RNA, 25 nt, Human
ucggaccaaaaaaaaaaguguuuuc

SEQ ID NO: 1150908 - RNA, 19 nt, Human
ucucaaggcccaacagcug

SEQ ID NO: 1150909 - RNA, 24 nt, Human
ucucagaaacucgggcccucccaa

SEQ ID NO: 1150910 - RNA, 18 nt, Human
ucuccagggcuucagggc

SEQ ID NO: 1150911 - RNA, 20 nt, Human
ucuccagggcuucagggcuc

SEQ ID NO: 1150912 - RNA, 21 nt, Human
ucuccagggcuucagggcugg

SEQ ID NO: 1150913 - RNA, 19 nt, Human
ucuccagguggacccugug

SEQ ID NO: 1150914 - RNA, 18 nt, Human
ucucccacaaaacccuca

SEQ ID NO: 1150915 - RNA, 22 nt, Human
ucucccacaaaacccucaggaa

SEQ ID NO: 1150916 - RNA, 22 nt, Human
ugaagagagcaggaggcacagc

SEQ ID NO: 1150917 - RNA, 18 nt, Human
ugaagcaucacagucuga

SEQ ID NO: 1150918 - RNA, 25 nt, Human
ugagccuggaggggcccacagggag

SEQ ID NO: 1150919 - RNA, 21 nt, Human
ugagggcagagugggcacacg

SEQ ID NO: 1150920 - RNA, 22 nt, Human
ugagggcagagugggcacacgg

SEQ ID NO: 1150921 - RNA, 26 nt, Human
ugagggcagagugggcacacggcccc

SEQ ID NO: 1150922 - RNA, 24 nt, Human
ugcagggggagcucgcggcgcugc

SEQ ID NO: 1150923 - RNA, 26 nt, Human
ugccagacggucuaggcagaugcccu

SEQ ID NO: 1150924 - RNA, 22 nt, Human
uggaacgaccccgcucucagaa

SEQ ID NO: 1150925 - RNA, 23 nt, Human
uggaagaacagcucaccaacuug

SEQ ID NO: 1150926 - RNA, 19 nt, Human
uggcaggugagggcagagu

SEQ ID NO: 1150927 - RNA, 22 nt, Human
uggggaaacugagccuggaggg

SEQ ID NO: 1150928 - RNA, 18 nt, Human
ugugauggcagaaggggc

SEQ ID NO: 1150929 - RNA, 23 nt, Human
uguguccucaccuggcaggugag

SEQ ID NO: 1150930 - RNA, 19 nt, Human
uucagaauccggccacccc

SEQ ID NO: 1150931 - RNA, 22 nt, Human
uucuguucauccuccucuccuu

SEQ ID NO: 1150932 - RNA, 25 nt, Human
uuggagcacaggugccagaaggcug

SEQ ID NO: 1150933 - RNA, 20 nt, Human
uuugcagaaucaggacgagg

SEQ ID NO: 1150934 - RNA, 21 nt, Human
uuuucaaaauugcacgaaggg

SEQ ID NO: 1150935 - RNA, 22 nt, Human
aaagacccugcagcuaggaccc

SEQ ID NO: 1150936 - RNA, 18 nt, Human
aaaggcucuucagggagg

SEQ ID NO: 1150937 - RNA, 29 nt, Human
aagcaaaugacagaaagaaaagggacccc

SEQ ID NO: 1150938 - RNA, 18 nt, Human
aagcagaguggggaugac

SEQ ID NO: 1150939 - RNA, 20 nt, Human
aagcagaguggggaugacuu

SEQ ID NO: 1150940 - RNA, 22 nt, Human
aagcaggagggagcaggcgcgg

SEQ ID NO: 1150941 - RNA, 23 nt, Human
acacacacacacacacacacaca

SEQ ID NO: 1150942 - RNA, 23 nt, Human
acacacacacacacacacacaca

SEQ ID NO: 1150943 - RNA, 23 nt, Human
acacacacacacacacacacaca

SEQ ID NO: 1150944 - RNA, 23 nt, Human
acacacacacacacacacacaca

SEQ ID NO: 1150945 - RNA, 24 nt, Human
acacacacacacacacacacacag

SEQ ID NO: 1150946 - RNA, 24 nt, Human
acacacacacacacacacacacag

SEQ ID NO: 1150947 - RNA, 21 nt, Human
acacacacacacacacacgug

SEQ ID NO: 1150948 - RNA, 24 nt, Human
acacacacacacacgugcacaauc

SEQ ID NO: 1150949 - RNA, 21 nt, Human
acacacacacacgugcacaau

SEQ ID NO: 1150950 - RNA, 24 nt, Human
acagaugaggacacggaggaugug

SEQ ID NO: 1150951 - RNA, 21 nt, Human
accagccagcccacaucccaa

SEQ ID NO: 1150952 - RNA, 22 nt, Human
acccacgccaagaagagaaacc

SEQ ID NO: 1150953 - RNA, 18 nt, Human
accccgcccuccugccag

SEQ ID NO: 1150954 - RNA, 19 nt, Human
acccucccuggccuguguu

SEQ ID NO: 1150955 - RNA, 21 nt, Human
accucagcagcaacccacgcc

SEQ ID NO: 1150956 - RNA, 19 nt, Human
acuuugaguggucaaagga

SEQ ID NO: 1150957 - RNA, 26 nt, Human
agaauaacagaugaggacacggagga

SEQ ID NO: 1150958 - RNA, 19 nt, Human
agcaggagggagcaggcgc

SEQ ID NO: 1150959 - RNA, 22 nt, Human
aggcagaggaggguuccagcaa

SEQ ID NO: 1150960 - RNA, 27 nt, Human
aggcagugcuguggccuggcccggcgg

SEQ ID NO: 1150961 - RNA, 22 nt, Human
agggaggcaaaggggagagaag

SEQ ID NO: 1150962 - RNA, 20 nt, Human
auccauccuuggaccaacac

SEQ ID NO: 1150963 - RNA, 18 nt, Human
augggauuuccuggagag

SEQ ID NO: 1150964 - RNA, 21 nt, Human
caaaugacagaaagaaaauac

SEQ ID NO: 1150965 - RNA, 19 nt, Human
caacagcagcuugaugacu

SEQ ID NO: 1150966 - RNA, 24 nt, Human
caaccccccccacagcgguggguc

SEQ ID NO: 1150967 - RNA, 19 nt, Human
caacugugacccucacaaa

SEQ ID NO: 1150968 - RNA, 21 nt, Human
caagaaaggccagccucuguu

SEQ ID NO: 1150969 - RNA, 21 nt, Human
caagaagagaaacccacagag

SEQ ID NO: 1150970 - RNA, 23 nt, Human
caaugggcuucaaagcaaaugac

SEQ ID NO: 1150971 - RNA, 20 nt, Human
cacacacacacacacacaca

SEQ ID NO: 1150972 - RNA, 20 nt, Human
cacacacacacacacacaca

SEQ ID NO: 1150973 - RNA, 20 nt, Human
cacacacacacacacacaca

SEQ ID NO: 1150974 - RNA, 20 nt, Human
cacacacacacacacacaca

SEQ ID NO: 1150975 - RNA, 20 nt, Human
cacacacacacacacacaca

SEQ ID NO: 1150976 - RNA, 20 nt, Human
cacacacacacacacacaca

SEQ ID NO: 1150977 - RNA, 22 nt, Human
cacacacacacacacacacaca

SEQ ID NO: 1150978 - RNA, 26 nt, Human
cacacacacacacacacacacacaca

SEQ ID NO: 1150979 - RNA, 26 nt, Human
cacacacacacacacacacacacacg

SEQ ID NO: 1150980 - RNA, 26 nt, Human
cacacacacacacacacacacgugca

SEQ ID NO: 1150981 - RNA, 25 nt, Human
cacacacacacacacacacgugcac

SEQ ID NO: 1150982 - RNA, 19 nt, Human
cacacacauucuaaagcag

SEQ ID NO: 1150983 - RNA, 21 nt, Human
caccaauauuuaggagguuaa

SEQ ID NO: 1150984 - RNA, 22 nt, Human
caccagccagcccacaucccaa

SEQ ID NO: 1150985 - RNA, 21 nt, Human
caccccgcccuccugccagca

SEQ ID NO: 1150986 - RNA, 25 nt, Human
cacccucugcauccauccuuggacc

SEQ ID NO: 1150987 - RNA, 21 nt, Human
cagaauaacagaugaggacac

SEQ ID NO: 1150988 - RNA, 23 nt, Human
cagagcagugucggcgcaaucac

SEQ ID NO: 1150989 - RNA, 20 nt, Human
cagcagcuugaugaccaugg

SEQ ID NO: 1150990 - RNA, 19 nt, Human
cagcauaaagaaugcacag

SEQ ID NO: 1150991 - RNA, 21 nt, Human
cagcauaaagaaugcacagaa

SEQ ID NO: 1150992 - RNA, 22 nt, Human
cagcccacaucccaagaaaggc

SEQ ID NO: 1150993 - RNA, 22 nt, Human
cagcucagagaccggggaagcc

SEQ ID NO: 1150994 - RNA, 22 nt, Human
caguggaagccuccccuaccag

SEQ ID NO: 1150995 - RNA, 21 nt, Human
cauuucuagcuuccuugggag

SEQ ID NO: 1150996 - RNA, 19 nt, Human
ccaacaccagccagcccac

SEQ ID NO: 1150997 - RNA, 19 nt, Human
ccaagaaaggccagccucu

SEQ ID NO: 1150998 - RNA, 21 nt, Human
ccaagaagagaaacccacaga

SEQ ID NO: 1150999 - RNA, 18 nt, Human
ccaagcccagugaccccc

SEQ ID NO: 1151000 - RNA, 21 nt, Human
ccaagcccagugacccccaug

SEQ ID NO: 1151001 - RNA, 24 nt, Human
ccagaauaacagaugaggacacgg

SEQ ID NO: 1151002 - RNA, 21 nt, Human
ccagccagcccacaucccaag

SEQ ID NO: 1151003 - RNA, 23 nt, Human
ccauggggacccugucccucuaa

SEQ ID NO: 1151004 - RNA, 20 nt, Human
cccaagaaaggccagccucu

SEQ ID NO: 1151005 - RNA, 23 nt, Human
cccacgccaagaagagaaaccca

SEQ ID NO: 1151006 - RNA, 23 nt, Human
ccccgcccuccugccagcauccg

SEQ ID NO: 1151007 - RNA, 20 nt, Human
ccccugcagagggaggcaaa

SEQ ID NO: 1151008 - RNA, 24 nt, Human
cccuggccuguguuccagaauaac

SEQ ID NO: 1151009 - RNA, 18 nt, Human
ccucacaaagacccugca

SEQ ID NO: 1151010 - RNA, 18 nt, Human
ccucacaaagacccugca

SEQ ID NO: 1151011 - RNA, 19 nt, Human
ccuccucaccccgcccucc

SEQ ID NO: 1151012 - RNA, 20 nt, Human
ccuccugccagcauccggcc

SEQ ID NO: 1151013 - RNA, 19 nt, Human
ccucucgaagcagaguggg

SEQ ID NO: 1151014 - RNA, 18 nt, Human
ccugcugcucuccucugg

SEQ ID NO: 1151015 - RNA, 18 nt, Human
ccuggagagggaggcaga

SEQ ID NO: 1151016 - RNA, 25 nt, Human
ccuguacccucccuggccuguguuc

SEQ ID NO: 1151017 - RNA, 22 nt, Human
ccuuuguucuggaagcuccgcc

SEQ ID NO: 1151018 - RNA, 19 nt, Human
cuaaagcagguaugggauc

SEQ ID NO: 1151019 - RNA, 28 nt, Human
cucacaaagacccugcagcuaggacccc

SEQ ID NO: 1151020 - RNA, 19 nt, Human
cucaccccgcccuccugcc

SEQ ID NO: 1151021 - RNA, 20 nt, Human
cucccuggccuguguuccag

SEQ ID NO: 1151022 - RNA, 24 nt, Human
cuccuaccacaugccaggcacugg

SEQ ID NO: 1151023 - RNA, 21 nt, Human
cucuaagccagccugcucucc

SEQ ID NO: 1151024 - RNA, 19 nt, Human
cucuccucuggaaccucag

SEQ ID NO: 1151025 - RNA, 23 nt, Human
cugagcuccuaccacaugccagg

SEQ ID NO: 1151026 - RNA, 19 nt, Human
cugcagagggaggcaaagg

SEQ ID NO: 1151027 - RNA, 19 nt, Human
cugcauccauccuuggacc

SEQ ID NO: 1151028 - RNA, 22 nt, Human
cuggaaccucagcagcaaccca

SEQ ID NO: 1151029 - RNA, 23 nt, Human
cuucaaagcaaaugacagaaaga

SEQ ID NO: 1151030 - RNA, 21 nt, Human
cuuggaccaacaccagccagc

SEQ ID NO: 1151031 - RNA, 21 nt, Human
cuuuguucuggaagcuccgcc

SEQ ID NO: 1151032 - RNA, 22 nt, Human
gaaccucagcagcaacccacgc

SEQ ID NO: 1151033 - RNA, 20 nt, Human
gaagcagaguggggaugacu

SEQ ID NO: 1151034 - RNA, 23 nt, Human
gacagaaagaaaauacgauugua

SEQ ID NO: 1151035 - RNA, 24 nt, Human
gaccaacaccagccagcccacauc

SEQ ID NO: 1151036 - RNA, 21 nt, Human
gaccagacgcccaucagcuca

SEQ ID NO: 1151037 - RNA, 21 nt, Human
gacccugcagcuaggacccag

SEQ ID NO: 1151038 - RNA, 18 nt, Human
gagagggaggcagaggag

SEQ ID NO: 1151039 - RNA, 20 nt, Human
gcagcaauugaauuauuggc

SEQ ID NO: 1151040 - RNA, 24 nt, Human
gccaagaagagaaacccacagagc

SEQ ID NO: 1151041 - RNA, 22 nt, Human
ggagagaagagcaagaguugau

SEQ ID NO: 1151042 - RNA, 21 nt, Human
ggagagggaggcagaggaggg

SEQ ID NO: 1151043 - RNA, 25 nt, Human
ggccucucgaagcagaguggggaug

SEQ ID NO: 1151044 - RNA, 24 nt, Human
ggcuuugaggaccugagagugacc

SEQ ID NO: 1151045 - RNA, 19 nt, Human
ggguuccagcauaaagaau

SEQ ID NO: 1151046 - RNA, 22 nt, Human
gucaucaacagcagcuugauga

SEQ ID NO: 1151047 - RNA, 27 nt, Human
gugaggacacacacacacacacacaca

SEQ ID NO: 1151048 - RNA, 21 nt, Human
guucaguggaagccuccccua

SEQ ID NO: 1151049 - RNA, 22 nt, Human
uaagccagccugcucucccuca

SEQ ID NO: 1151050 - RNA, 25 nt, Human
uaaggcacaaugggcuucaaagcaa

SEQ ID NO: 1151051 - RNA, 19 nt, Human
uagcuuccuugggagcucu

SEQ ID NO: 1151052 - RNA, 18 nt, Human
uaggcuggccccugggcu

SEQ ID NO: 1151053 - RNA, 23 nt, Human
uaggcuggccccugggcucccca

SEQ ID NO: 1151054 - RNA, 19 nt, Human
uaugggauuuccuggagag

SEQ ID NO: 1151055 - RNA, 21 nt, Human
ucaaagacaagcauuucuagc

SEQ ID NO: 1151056 - RNA, 27 nt, Human
ucaaagcaaaugacagaaaggaguuuc

SEQ ID NO: 1151057 - RNA, 18 nt, Human
ucaccccgcccuccugcc

SEQ ID NO: 1151058 - RNA, 21 nt, Human
ucaucaacagcagcuugauga

SEQ ID NO: 1151059 - RNA, 19 nt, Human
uccagaauaacagaugagg

SEQ ID NO: 1151060 - RNA, 23 nt, Human
uccagcauaaagaaugcacagaa

SEQ ID NO: 1151061 - RNA, 21 nt, Human
ucccagagcaacugugacccu

SEQ ID NO: 1151062 - RNA, 20 nt, Human
ucccucaccugugccuguuc

SEQ ID NO: 1151063 - RNA, 18 nt, Human
ucuaaagcagguauggga

SEQ ID NO: 1151064 - RNA, 21 nt, Human
ucucacacacauucuaaagca

SEQ ID NO: 1151065 - RNA, 18 nt, Human
ugaaggaaggggaggcag

SEQ ID NO: 1151066 - RNA, 18 nt, Human
ugagcuccuaccacaugc

SEQ ID NO: 1151067 - RNA, 26 nt, Human
ugagucuuugucaucaacagcagcuu

SEQ ID NO: 1151068 - RNA, 19 nt, Human
ugcucuccucuggaaccuc

SEQ ID NO: 1151069 - RNA, 23 nt, Human
uggagagggaggcagaggagggu

SEQ ID NO: 1151070 - RNA, 26 nt, Human
uggccccugggcuccccauucuccuu

SEQ ID NO: 1151071 - RNA, 18 nt, Human
ugggcuccccauucuccu

SEQ ID NO: 1151072 - RNA, 19 nt, Human
ugucucacacacauucuaa

SEQ ID NO: 1151073 - RNA, 20 nt, Human
uuccuugggagcucuuccag

SEQ ID NO: 1151074 - RNA, 20 nt, Human
uucuccuuuguucuggaagc

SEQ ID NO: 1151075 - RNA, 22 nt, Human
uucuccuuuguucuggaagcuc

SEQ ID NO: 1151076 - RNA, 19 nt, Human
uugcccggccuugggcaag

SEQ ID NO: 1151077 - RNA, 23 nt, Human
uuucaaagacaagcauuucuagc

SEQ ID NO: 1151078 - RNA, 19 nt, Human
uuuccuggagagggaggca

SEQ ID NO: 1151079 - RNA, 19 nt, Human
agaggggacgggucggggc

SEQ ID NO: 1151080 - RNA, 21 nt, Human
ccacucugcucagggucauuu

SEQ ID NO: 1151081 - RNA, 18 nt, Human
ccccggugcccaagcucg

SEQ ID NO: 1151082 - RNA, 19 nt, Human
cccggugcccaagcucggc

SEQ ID NO: 1151083 - RNA, 18 nt, Human
ccugccacgcugccgccg

SEQ ID NO: 1151084 - RNA, 21 nt, Human
ccugccacgcugccgccgccc

SEQ ID NO: 1151085 - RNA, 25 nt, Human
ccugccacgcugccgccgccccaga

SEQ ID NO: 1151086 - RNA, 21 nt, Human
cgccccaggggcccugcucgc

SEQ ID NO: 1151087 - RNA, 23 nt, Human
cgcccgugggacgccccaggggc

SEQ ID NO: 1151088 - RNA, 23 nt, Human
cuccugccacgcugccgccgccc

SEQ ID NO: 1151089 - RNA, 18 nt, Human
gcccgugggacgccccag

SEQ ID NO: 1151090 - RNA, 20 nt, Human
ggacgccccaggggcccugc

SEQ ID NO: 1151091 - RNA, 20 nt, Human
ggcuggagccggcaggggua

SEQ ID NO: 1151092 - RNA, 20 nt, Human
gggaggaaagaaguaugaca

SEQ ID NO: 1151093 - RNA, 19 nt, Human
gugcccaagcucggcgcuc

SEQ ID NO: 1151094 - RNA, 18 nt, Human
uaaagacggugagacacg

SEQ ID NO: 1151095 - RNA, 25 nt, Human
uaacauaggacagcagccggcucuu

SEQ ID NO: 1151096 - RNA, 22 nt, Human
uacaagcacgccaacccccccg

SEQ ID NO: 1151097 - RNA, 21 nt, Human
uagugcacgggaggaaagaag

SEQ ID NO: 1151098 - RNA, 19 nt, Human
ugccacgcugccgccgccc

SEQ ID NO: 1151099 - RNA, 18 nt, Human
uguuaaauaaagacggug

SEQ ID NO: 1151100 - RNA, 22 nt, Human
aaccucacuaacaggagauaau

SEQ ID NO: 1151101 - RNA, 18 nt, Human
aacucuguccccucuucc

SEQ ID NO: 1151102 - RNA, 21 nt, Human
cucacuaacaggagauaauaa

SEQ ID NO: 1151103 - RNA, 21 nt, Human
ucacuaacaggagauaauaag

SEQ ID NO: 1151104 - RNA, 18 nt, Human
uguuggacugcuggaauu

SEQ ID NO: 1151105 - RNA, 22 nt, Human
aaacagaaaacuauacaaaacc

SEQ ID NO: 1151106 - RNA, 21 nt, Human
aaagcagcaggagggcucagg

SEQ ID NO: 1151107 - RNA, 20 nt, Human
aaguacucuugcgugacgau

SEQ ID NO: 1151108 - RNA, 18 nt, Human
aaguguggccacucugcc

SEQ ID NO: 1151109 - RNA, 18 nt, Human
acaaagcaggaccaacag

SEQ ID NO: 1151110 - RNA, 19 nt, Human
acaagauaauuugcugggg

SEQ ID NO: 1151111 - RNA, 24 nt, Human
acaauacuaggaaaagcuaaacac

SEQ ID NO: 1151112 - RNA, 21 nt, Human
acacagacauuucacugaaac

SEQ ID NO: 1151113 - RNA, 20 nt, Human
acagcacacacauacagaaa

SEQ ID NO: 1151114 - RNA, 20 nt, Human
acccacaaagcaggaccaac

SEQ ID NO: 1151115 - RNA, 24 nt, Human
accgcagcaucaccgucagacacc

SEQ ID NO: 1151116 - RNA, 24 nt, Human
accucacaauacuaggaaaagcua

SEQ ID NO: 1151117 - RNA, 24 nt, Human
agacacagacauuucacugaaacc

SEQ ID NO: 1151118 - RNA, 18 nt, Human
agaguuuagggucuuucu

SEQ ID NO: 1151119 - RNA, 24 nt, Human
agauucaaacagaaaacuauacaa

SEQ ID NO: 1151120 - RNA, 21 nt, Human
agcagaaagaguauuuacaug

SEQ ID NO: 1151121 - RNA, 23 nt, Human
agcagaaagaguauuuacaugga

SEQ ID NO: 1151122 - RNA, 21 nt, Human
aggaaaagcuaaacacagaca

SEQ ID NO: 1151123 - RNA, 18 nt, Human
agggcagcuuuggugcuc

SEQ ID NO: 1151124 - RNA, 21 nt, Human
aguagcagaaagaguauuuac

SEQ ID NO: 1151125 - RNA, 19 nt, Human
auaaauauauauauauaua

SEQ ID NO: 1151126 - RNA, 19 nt, Human
auauguguauauauauaaa

SEQ ID NO: 1151127 - RNA, 28 nt, Human
caaaauaaaagcccaagaaacuaaccac

SEQ ID NO: 1151128 - RNA, 24 nt, Human
caacaggugugagguggaguggaa

SEQ ID NO: 1151129 - RNA, 25 nt, Human
caacaggugugagguggaguggaag

SEQ ID NO: 1151130 - RNA, 18 nt, Human
cacaaagcaggaccaaca

SEQ ID NO: 1151131 - RNA, 21 nt, Human
cacaauacuaggaaaagcuaa

SEQ ID NO: 1151132 - RNA, 22 nt, Human
cacacacauacagaaauucacg

SEQ ID NO: 1151133 - RNA, 22 nt, Human
caccccacugaaguccccacac

SEQ ID NO: 1151134 - RNA, 24 nt, Human
caccccacugaaguccccacacug

SEQ ID NO: 1151135 - RNA, 21 nt, Human
cagacaccaaagcagcaggag

SEQ ID NO: 1151136 - RNA, 22 nt, Human
cagcaggagggcucaggaagug

SEQ ID NO: 1151137 - RNA, 19 nt, Human
cagccaggcgaucucaggc

SEQ ID NO: 1151138 - RNA, 18 nt, Human
cauaaauauauauauaua

SEQ ID NO: 1151139 - RNA, 19 nt, Human
cauuccuuggugaccgagc

SEQ ID NO: 1151140 - RNA, 25 nt, Human
ccaaagcagcaggagggcucaggaa

SEQ ID NO: 1151141 - RNA, 19 nt, Human
ccaagaaacuaaccaccga

SEQ ID NO: 1151142 - RNA, 25 nt, Human
ccagcuggagauucuuccuaauugu

SEQ ID NO: 1151143 - RNA, 18 nt, Human
ccuggccucuucccggag

SEQ ID NO: 1151144 - RNA, 22 nt, Human
cuauacaaaaccaacccauaaa

SEQ ID NO: 1151145 - RNA, 21 nt, Human
cucaaaaaguguuagcauaga

SEQ ID NO: 1151146 - RNA, 20 nt, Human
cucgugaaaaucaaagggca

SEQ ID NO: 1151147 - RNA, 20 nt, Human
cugauucacguuaaaagggg

SEQ ID NO: 1151148 - RNA, 21 nt, Human
gaaguccccacacugcuuccc

SEQ ID NO: 1151149 - RNA, 24 nt, Human
gagguggaguggaagugugggggu

SEQ ID NO: 1151150 - RNA, 20 nt, Human
gcgugacgauugucagacac

SEQ ID NO: 1151151 - RNA, 19 nt, Human
ggagaucuggccuuugggu

SEQ ID NO: 1151152 - RNA, 24 nt, Human
ggaguggaaguguggggguggggu

SEQ ID NO: 1151153 - RNA, 22 nt, Human
gucucuauaaaaaugaugaaag

SEQ ID NO: 1151154 - RNA, 19 nt, Human
guguuucaaguguggccac

SEQ ID NO: 1151155 - RNA, 18 nt, Human
uaaaagcccaagaaacua

SEQ ID NO: 1151156 - RNA, 18 nt, Human
uaaaaggggagaucuggc

SEQ ID NO: 1151157 - RNA, 22 nt, Human
uaaaauugcaaaauaaaagccc

SEQ ID NO: 1151158 - RNA, 23 nt, Human
uaaccaccgaucugcacgucagu

SEQ ID NO: 1151159 - RNA, 24 nt, Human
uaauuguuccuaagaugaaaagcc

SEQ ID NO: 1151160 - RNA, 19 nt, Human
uacaaaaccaacccauaaa

SEQ ID NO: 1151161 - RNA, 19 nt, Human
uacaguuauucucccacca

SEQ ID NO: 1151162 - RNA, 18 nt, Human
uagagaacacugcauucu

SEQ ID NO: 1151163 - RNA, 22 nt, Human
uagcagaaagaguauuuacaug

SEQ ID NO: 1151164 - RNA, 23 nt, Human
uagcagaaagaguauuuacaugg

SEQ ID NO: 1151165 - RNA, 22 nt, Human
uaggaaaagcuaaacacagaca

SEQ ID NO: 1151166 - RNA, 18 nt, Human
uauaauauguguauauau

SEQ ID NO: 1151167 - RNA, 23 nt, Human
uauaauguguuucaaguguggcc

SEQ ID NO: 1151168 - RNA, 19 nt, Human
uauacaaaaccaacccaua

SEQ ID NO: 1151169 - RNA, 23 nt, Human
uauauauauaauauguguauaua

SEQ ID NO: 1151170 - RNA, 22 nt, Human
uauucucccaccaccccccaaa

SEQ ID NO: 1151171 - RNA, 23 nt, Human
ucaaacagaaaacuauacaaaac

SEQ ID NO: 1151172 - RNA, 21 nt, Human
ucaagggggccggcauuucag

SEQ ID NO: 1151173 - RNA, 21 nt, Human
ucaaucaaucacccacaaagc

SEQ ID NO: 1151174 - RNA, 18 nt, Human
ucccugaaauauauuccc

SEQ ID NO: 1151175 - RNA, 22 nt, Human
ucugugggggugaugcauacuc

SEQ ID NO: 1151176 - RNA, 21 nt, Human
ucuucccggagagagcaaaca

SEQ ID NO: 1151177 - RNA, 24 nt, Human
ucuugcgugacgauugucagacac

SEQ ID NO: 1151178 - RNA, 26 nt, Human
ugaaaccucacaauacuaggaaaagc

SEQ ID NO: 1151179 - RNA, 22 nt, Human
ugaaguccccacacugcuuccc

SEQ ID NO: 1151180 - RNA, 19 nt, Human
ugagcguggcugcucauug

SEQ ID NO: 1151181 - RNA, 21 nt, Human
ugagguggaguggaagugugg

SEQ ID NO: 1151182 - RNA, 19 nt, Human
ugcucagagauucaaacag

SEQ ID NO: 1151183 - RNA, 18 nt, Human
ugcuugccugcaccccag

SEQ ID NO: 1151184 - RNA, 24 nt, Human
ugcuugccugcaccccagccaggc

SEQ ID NO: 1151185 - RNA, 18 nt, Human
uggaaaguucucgugaaa

SEQ ID NO: 1151186 - RNA, 23 nt, Human
ugggguucccugaaauauauucc

SEQ ID NO: 1151187 - RNA, 20 nt, Human
uguucucccccaccuggccu

SEQ ID NO: 1151188 - RNA, 21 nt, Human
uuaaacuaccuagagauaagc

SEQ ID NO: 1151189 - RNA, 26 nt, Human
uuagggucuuucuacaguuauucucc

SEQ ID NO: 1151190 - RNA, 18 nt, Human
uucaaguguggccacucu

SEQ ID NO: 1151191 - RNA, 23 nt, Human
uucccggagagagcaaacacuaa

SEQ ID NO: 1151192 - RNA, 21 nt, Human
uuuaaacuaccuagagauaag

SEQ ID NO: 1151193 - RNA, 21 nt, Human
cagcaugggggugaccacagu

SEQ ID NO: 1151194 - RNA, 18 nt, Human
ugacuggguagugugggg

SEQ ID NO: 1151195 - RNA, 20 nt, Human
ugacuggguaguguggggag

SEQ ID NO: 1151196 - RNA, 21 nt, Human
aagaaguuuaccuuuuuccug

SEQ ID NO: 1151197 - RNA, 20 nt, Human
acaaaaaggcuuuuauagua

SEQ ID NO: 1151198 - RNA, 24 nt, Human
accuuuuuccuguuuugcuuuuaa

SEQ ID NO: 1151199 - RNA, 18 nt, Human
agaaaaacagccugcagg

SEQ ID NO: 1151200 - RNA, 22 nt, Human
agaaaaacagccugcaggagcg

SEQ ID NO: 1151201 - RNA, 22 nt, Human
agacccagagcagagggaacag

SEQ ID NO: 1151202 - RNA, 18 nt, Human
aguaaguccauguguuuu

SEQ ID NO: 1151203 - RNA, 21 nt, Human
aguuuaccuuuuuccuguuuu

SEQ ID NO: 1151204 - RNA, 24 nt, Human
ccugcaggagcgggggcgcgcggg

SEQ ID NO: 1151205 - RNA, 23 nt, Human
cuuuuuccuguuuugcuuuuaau

SEQ ID NO: 1151206 - RNA, 19 nt, Human
gcgggcgccggcggagacc

SEQ ID NO: 1151207 - RNA, 22 nt, Human
gugccgcgcaggugaggcuggc

SEQ ID NO: 1151208 - RNA, 20 nt, Human
uaauacaauaucaacaauuu

SEQ ID NO: 1151209 - RNA, 21 nt, Human
uucaaaugagaucacugaaaa

SEQ ID NO: 1151210 - RNA, 24 nt, Human
aaaaaacaaauggaguggggccac

SEQ ID NO: 1151211 - RNA, 21 nt, Human
aaacaaauggaguggggccac

SEQ ID NO: 1151212 - RNA, 22 nt, Human
aaagcuuccaaacguuuccagg

SEQ ID NO: 1151213 - RNA, 18 nt, Human
aagaagccagggugggga

SEQ ID NO: 1151214 - RNA, 18 nt, Human
aagcucugugggcuuugc

SEQ ID NO: 1151215 - RNA, 20 nt, Human
aagggcaacuucaaggaaca

SEQ ID NO: 1151216 - RNA, 22 nt, Human
aaguagcugaggaggagaggga

SEQ ID NO: 1151217 - RNA, 18 nt, Human
acaaaaaggagggagaag

SEQ ID NO: 1151218 - RNA, 21 nt, Human
acaggaacagacagaagccaa

SEQ ID NO: 1151219 - RNA, 21 nt, Human
acccggaccccggggucacuc

SEQ ID NO: 1151220 - RNA, 20 nt, Human
acugcgacuagaagaagcca

SEQ ID NO: 1151221 - RNA, 20 nt, Human
acuucaaggaacaaaaggga

SEQ ID NO: 1151222 - RNA, 18 nt, Human
agaacccgaguuaaaacc

SEQ ID NO: 1151223 - RNA, 25 nt, Human
agacaggaacagacagaagccaaag

SEQ ID NO: 1151224 - RNA, 18 nt, Human
agcaaagcuuccaaacgu

SEQ ID NO: 1151225 - RNA, 20 nt, Human
agcagcgcggaaggcgcuca

SEQ ID NO: 1151226 - RNA, 25 nt, Human
aggaacaaaagggaagcugcaaggc

SEQ ID NO: 1151227 - RNA, 21 nt, Human
caagguggcugaagcuggcca

SEQ ID NO: 1151228 - RNA, 18 nt, Human
cacugcgucucccaaggu

SEQ ID NO: 1151229 - RNA, 26 nt, Human
caggaacaccccagcucagggcuccc

SEQ ID NO: 1151230 - RNA, 19 nt, Human
caggccuccagccuggaau

SEQ ID NO: 1151231 - RNA, 21 nt, Human
ccaaacguuuccaggccucca

SEQ ID NO: 1151232 - RNA, 20 nt, Human
cccaacagacaggaacagac

SEQ ID NO: 1151233 - RNA, 23 nt, Human
cccacccggaccccggggucacu

SEQ ID NO: 1151234 - RNA, 19 nt, Human
cccacccuggccggucuga

SEQ ID NO: 1151235 - RNA, 18 nt, Human
ccccacuccccuuccugc

SEQ ID NO: 1151236 - RNA, 23 nt, Human
ccccggggucacucgggucuccg

SEQ ID NO: 1151237 - RNA, 20 nt, Human
cccugaggaccaagucacgg

SEQ ID NO: 1151238 - RNA, 18 nt, Human
ccugaagguagccggccu

SEQ ID NO: 1151239 - RNA, 18 nt, Human
ccugccauuggggcuggg

SEQ ID NO: 1151240 - RNA, 19 nt, Human
ccugcugccaaaccuggga

SEQ ID NO: 1151241 - RNA, 18 nt, Human
ccuggcggccggggcugu

SEQ ID NO: 1151242 - RNA, 18 nt, Human
ccuggcggccggggcugu

SEQ ID NO: 1151243 - RNA, 25 nt, Human
cgaggccggagacccugaggaccaa

SEQ ID NO: 1151244 - RNA, 22 nt, Human
cuaggagugacgggauggcgug

SEQ ID NO: 1151245 - RNA, 22 nt, Human
cuccccccgcuccccgaccuuc

SEQ ID NO: 1151246 - RNA, 20 nt, Human
cucgggucuccgucugugcc

SEQ ID NO: 1151247 - RNA, 21 nt, Human
cugcacugcgucucccaaggu

SEQ ID NO: 1151248 - RNA, 22 nt, Human
cugcacugcgucucccaaggug

SEQ ID NO: 1151249 - RNA, 20 nt, Human
gaagcuguugagggcugaag

SEQ ID NO: 1151250 - RNA, 18 nt, Human
gaccucuuccaggaacac

SEQ ID NO: 1151251 - RNA, 18 nt, Human
gaccucuuccaggaacac

SEQ ID NO: 1151252 - RNA, 21 nt, Human
gaccucuuccaggaacacccc

SEQ ID NO: 1151253 - RNA, 19 nt, Human
gagcagcgcggaaggcgcu

SEQ ID NO: 1151254 - RNA, 21 nt, Human
gauggggacaaaaaggaggga

SEQ ID NO: 1151255 - RNA, 21 nt, Human
gcccaggguccuccucgugcc

SEQ ID NO: 1151256 - RNA, 18 nt, Human
gccuugaggccgagcagc

SEQ ID NO: 1151257 - RNA, 19 nt, Human
gcgcucaggccggaucugg

SEQ ID NO: 1151258 - RNA, 21 nt, Human
gcgcucaggccggaucugggg

SEQ ID NO: 1151259 - RNA, 18 nt, Human
gcgguccgggcgggcgag

SEQ ID NO: 1151260 - RNA, 22 nt, Human
ggaagcugcaaggcaccagcuc

SEQ ID NO: 1151261 - RNA, 20 nt, Human
ggaccccggggucacucggg

SEQ ID NO: 1151262 - RNA, 18 nt, Human
ggagagggagcugaugug

SEQ ID NO: 1151263 - RNA, 21 nt, Human
ggagagggagcugauguggag

SEQ ID NO: 1151264 - RNA, 19 nt, Human
ggaggcgcagcguguguag

SEQ ID NO: 1151265 - RNA, 19 nt, Human
ggccggggcuguucuccag

SEQ ID NO: 1151266 - RNA, 23 nt, Human
gggauggggacaaaaaggaggga

SEQ ID NO: 1151267 - RNA, 24 nt, Human
gggccacaggaauugucagaaaug

SEQ ID NO: 1151268 - RNA, 19 nt, Human
gggcucaggggagaguaga

SEQ ID NO: 1151269 - RNA, 22 nt, Human
gggggauggggacaaaaaggag

SEQ ID NO: 1151270 - RNA, 20 nt, Human
gucccgggucuaugggucca

SEQ ID NO: 1151271 - RNA, 24 nt, Human
uaaaaaacaaauggaguggggcca

SEQ ID NO: 1151272 - RNA, 23 nt, Human
uauggaggcgcagcguguguagc

SEQ ID NO: 1151273 - RNA, 20 nt, Human
uccccacuccccuuccugcg

SEQ ID NO: 1151274 - RNA, 20 nt, Human
ucgaaaaagccgggucugaa

SEQ ID NO: 1151275 - RNA, 20 nt, Human
ugacuccacggcuucuaggg

SEQ ID NO: 1151276 - RNA, 20 nt, Human
ugaggaggagagggagcuga

SEQ ID NO: 1151277 - RNA, 23 nt, Human
ugaggaggagagggagcugaugu

SEQ ID NO: 1151278 - RNA, 18 nt, Human
ugcccaacagacaggaac

SEQ ID NO: 1151279 - RNA, 18 nt, Human
ugccgaggccggagaccc

SEQ ID NO: 1151280 - RNA, 25 nt, Human
ugccgaggccggagacccugaggac

SEQ ID NO: 1151281 - RNA, 18 nt, Human
ugcgaagcuguugagggc

SEQ ID NO: 1151282 - RNA, 18 nt, Human
ugcgacuagaagaagcca

SEQ ID NO: 1151283 - RNA, 23 nt, Human
ugcgcgaaaaguuuccuaggagu

SEQ ID NO: 1151284 - RNA, 21 nt, Human
uggccggucugacuccacggc

SEQ ID NO: 1151285 - RNA, 21 nt, Human
uggcgugggcucaggggagag

SEQ ID NO: 1151286 - RNA, 20 nt, Human
uggcugaagcuggccagcug

SEQ ID NO: 1151287 - RNA, 21 nt, Human
ugggacaaacuguauggaggc

SEQ ID NO: 1151288 - RNA, 20 nt, Human
uggggcccagccgagccuug

SEQ ID NO: 1151289 - RNA, 20 nt, Human
uggggcugggcggcagcucg

SEQ ID NO: 1151290 - RNA, 22 nt, Human
ugggguggggcccagccgagcc

SEQ ID NO: 1151291 - RNA, 19 nt, Human
uguagccagaacccgaguu

SEQ ID NO: 1151292 - RNA, 20 nt, Human
uucuaugguucucucagugg

SEQ ID NO: 1151293 - RNA, 23 nt, Human
uucuaugguucucucaguggggu

SEQ ID NO: 1151294 - RNA, 19 nt, Human
uugucagaaauggaggcuu

SEQ ID NO: 1151295 - RNA, 18 nt, Human
uuuuuuuuuuuuuuuuug

SEQ ID NO: 1151296 - RNA, 19 nt, Human
uuuuuuuuuuuuuuuuugc

SEQ ID NO: 1151297 - RNA, 20 nt, Human
cagccuuuucugucuucuuc

SEQ ID NO: 1151298 - RNA, 21 nt, Human
guaaaauacucuguaucuaca

SEQ ID NO: 1151299 - RNA, 18 nt, Human
uuuaauaacuugaaagcg

SEQ ID NO: 1151300 - RNA, 24 nt, Human
aaaguacugggauuacaggcguga

SEQ ID NO: 1151301 - RNA, 25 nt, Human
aaauguacuggagauauucugggua

SEQ ID NO: 1151302 - RNA, 22 nt, Human
aaauuuucgacauauacaggua

SEQ ID NO: 1151303 - RNA, 19 nt, Human
aaccaauccccuuggauac

SEQ ID NO: 1151304 - RNA, 20 nt, Human
aacuccaaccagaucucaca

SEQ ID NO: 1151305 - RNA, 19 nt, Human
aaguacugggauuacaggc

SEQ ID NO: 1151306 - RNA, 26 nt, Human
aaguacugggauuacaggcgugagcc

SEQ ID NO: 1151307 - RNA, 20 nt, Human
acagacccugcgcauguggu

SEQ ID NO: 1151308 - RNA, 18 nt, Human
acgggguuucgccauguu

SEQ ID NO: 1151309 - RNA, 23 nt, Human
acgggguuucgccauguuggcca

SEQ ID NO: 1151310 - RNA, 24 nt, Human
acgggguuucgccauguuggccag

SEQ ID NO: 1151311 - RNA, 20 nt, Human
agaaaauaaacccuauaggg

SEQ ID NO: 1151312 - RNA, 19 nt, Human
agaccagcaaggagaucag

SEQ ID NO: 1151313 - RNA, 22 nt, Human
agauauuggugccaccaaauaa

SEQ ID NO: 1151314 - RNA, 24 nt, Human
agccuuguaauugacauugaaggu

SEQ ID NO: 1151315 - RNA, 19 nt, Human
aggaagcuguuuauauuuc

SEQ ID NO: 1151316 - RNA, 23 nt, Human
aggaaggaccaguccacauugga

SEQ ID NO: 1151317 - RNA, 22 nt, Human
aggaguccuggaaccaaucccc

SEQ ID NO: 1151318 - RNA, 25 nt, Human
aggcuggagugcaguggcacgaucu

SEQ ID NO: 1151319 - RNA, 22 nt, Human
agggacuugaguauccucagau

SEQ ID NO: 1151320 - RNA, 21 nt, Human
aggucacccagcuaaaaacua

SEQ ID NO: 1151321 - RNA, 24 nt, Human
aggugauccaccugacucggccuc

SEQ ID NO: 1151322 - RNA, 22 nt, Human
aguagagacgggguuucgccau

SEQ ID NO: 1151323 - RNA, 18 nt, Human
aguagcugggauuacagg

SEQ ID NO: 1151324 - RNA, 18 nt, Human
agucagcuuccuaugugu

SEQ ID NO: 1151325 - RNA, 20 nt, Human
agugcaguggcacgaucucg

SEQ ID NO: 1151326 - RNA, 23 nt, Human
agugcaguggcacgaucucggcu

SEQ ID NO: 1151327 - RNA, 24 nt, Human
agugcaguggcacgaucucggcuc

SEQ ID NO: 1151328 - RNA, 22 nt, Human
auacagaaaugcauaauuugau

SEQ ID NO: 1151329 - RNA, 24 nt, Human
auaguagagacgggguuucgccau

SEQ ID NO: 1151330 - RNA, 23 nt, Human
augccaaagcauuccaguaaggc

SEQ ID NO: 1151331 - RNA, 18 nt, Human
auggcuuaggguccauag

SEQ ID NO: 1151332 - RNA, 23 nt, Human
auucauuuucucucacccuccaa

SEQ ID NO: 1151333 - RNA, 24 nt, Human
caaaguacugggauuacaggcgug

SEQ ID NO: 1151334 - RNA, 22 nt, Human
caagcgauucuccugccucagc

SEQ ID NO: 1151335 - RNA, 23 nt, Human
cacaugggaacuugcgauuauuc

SEQ ID NO: 1151336 - RNA, 23 nt, Human
caccacacugucgcccuugucca

SEQ ID NO: 1151337 - RNA, 24 nt, Human
caccacacugucgcccuuguccaa

SEQ ID NO: 1151338 - RNA, 19 nt, Human
caccauacagaaaugcaua

SEQ ID NO: 1151339 - RNA, 23 nt, Human
caccaucgugagaccaagauaaa

SEQ ID NO: 1151340 - RNA, 18 nt, Human
cacccgccaccacaccca

SEQ ID NO: 1151341 - RNA, 19 nt, Human
cagaaaaagaauuuccaag

SEQ ID NO: 1151342 - RNA, 24 nt, Human
cagcaaccucugccucccagauuc

SEQ ID NO: 1151343 - RNA, 21 nt, Human
cagcaccagaaguuuagcugu

SEQ ID NO: 1151344 - RNA, 20 nt, Human
cagccuccugaguagcuggg

SEQ ID NO: 1151345 - RNA, 26 nt, Human
caggaaauacaccauacaaccuucag

SEQ ID NO: 1151346 - RNA, 21 nt, Human
caggcagaaacguacaugaug

SEQ ID NO: 1151347 - RNA, 23 nt, Human
caggugauccaccugacucggcc

SEQ ID NO: 1151348 - RNA, 24 nt, Human
cauguuggccaggcuggucuugaa

SEQ ID NO: 1151349 - RNA, 20 nt, Human
cauuucucugcacagaagug

SEQ ID NO: 1151350 - RNA, 20 nt, Human
ccaaaguacugggauuacag

SEQ ID NO: 1151351 - RNA, 22 nt, Human
ccaaaguacugggauuacaggc

SEQ ID NO: 1151352 - RNA, 24 nt, Human
ccaaaguacugggauuacaggcgu

SEQ ID NO: 1151353 - RNA, 22 nt, Human
ccaccugacucggccucccaaa

SEQ ID NO: 1151354 - RNA, 19 nt, Human
ccauguuggccaggcuggu

SEQ ID NO: 1151355 - RNA, 21 nt, Human
ccauguuggccaggcuggucu

SEQ ID NO: 1151356 - RNA, 21 nt, Human
cccgccaccacacccaacuaa

SEQ ID NO: 1151357 - RNA, 25 nt, Human
cccucgccggccgcgaggccccgac

SEQ ID NO: 1151358 - RNA, 22 nt, Human
ccucaggugauccaccugacuc

SEQ ID NO: 1151359 - RNA, 24 nt, Human
ccucccagauucaagcgauucucc

SEQ ID NO: 1151360 - RNA, 20 nt, Human
ccugaccucaggugauccac

SEQ ID NO: 1151361 - RNA, 23 nt, Human
ccugaccucaggugauccaccug

SEQ ID NO: 1151362 - RNA, 24 nt, Human
ccugaccucaggugauccaccuga

SEQ ID NO: 1151363 - RNA, 23 nt, Human
ccugaguagcugggauuacaggc

SEQ ID NO: 1151364 - RNA, 24 nt, Human
ccugaguagcugggauuacaggca

SEQ ID NO: 1151365 - RNA, 23 nt, Human
ccugccucagccuccugaguagc

SEQ ID NO: 1151366 - RNA, 19 nt, Human
cgauuauuccacugaaguc

SEQ ID NO: 1151367 - RNA, 24 nt, Human
cgccauguuggccaggcuggucuu

SEQ ID NO: 1151368 - RNA, 27 nt, Human
cgccauguuggccaggcuggucuugaa

SEQ ID NO: 1151369 - RNA, 24 nt, Human
cgggguuucgccauguuggccagg

SEQ ID NO: 1151370 - RNA, 19 nt, Human
cuaucaggacuggcaacca

SEQ ID NO: 1151371 - RNA, 18 nt, Human
cucaaaagaagaauagcc

SEQ ID NO: 1151372 - RNA, 24 nt, Human
cucacagcaaccucugccucccag

SEQ ID NO: 1151373 - RNA, 23 nt, Human
cucagccuccugaguagcuggga

SEQ ID NO: 1151374 - RNA, 18 nt, Human
cucccgcccccagcccuc

SEQ ID NO: 1151375 - RNA, 23 nt, Human
cugaguagcugggauuacaggca

SEQ ID NO: 1151376 - RNA, 22 nt, Human
cugcagguaaauuagaauucau

SEQ ID NO: 1151377 - RNA, 23 nt, Human
cugccucagccuccugaguagcu

SEQ ID NO: 1151378 - RNA, 20 nt, Human
cuuaucaccaucccugaggu

SEQ ID NO: 1151379 - RNA, 24 nt, Human
cuugcucuguugcucaggcuggag

SEQ ID NO: 1151380 - RNA, 23 nt, Human
cuuuaauuugguuuucucuuuuu

SEQ ID NO: 1151381 - RNA, 22 nt, Human
gaagagacaacugaggcucaga

SEQ ID NO: 1151382 - RNA, 22 nt, Human
gaauaaaauugaaggcgaugcc

SEQ ID NO: 1151383 - RNA, 24 nt, Human
gaccucaggugauccaccugacuc

SEQ ID NO: 1151384 - RNA, 23 nt, Human
gagaccagcaaggagaucaggcu

SEQ ID NO: 1151385 - RNA, 24 nt, Human
gagacgggguuucgccauguuggc

SEQ ID NO: 1151386 - RNA, 21 nt, Human
gagauagagucuugcucuguu

SEQ ID NO: 1151387 - RNA, 28 nt, Human
gagcagacacaaaugugcuuaucaccau

SEQ ID NO: 1151388 - RNA, 24 nt, Human
gagccaccaugcccggccuacacc

SEQ ID NO: 1151389 - RNA, 25 nt, Human
gaguagcugggauuacaggcacccg

SEQ ID NO: 1151390 - RNA, 21 nt, Human
gaucucggcucacagcaaccu

SEQ ID NO: 1151391 - RNA, 18 nt, Human
gauuacaggcgugagcca

SEQ ID NO: 1151392 - RNA, 21 nt, Human
gauuacaggcgugagccacca

SEQ ID NO: 1151393 - RNA, 24 nt, Human
gauuacaggcgugagccaccaugc

SEQ ID NO: 1151394 - RNA, 21 nt, Human
gauucuccugccucagccucc

SEQ ID NO: 1151395 - RNA, 22 nt, Human
gcaaccucugccucccagauuc

SEQ ID NO: 1151396 - RNA, 24 nt, Human
gccauguuggccaggcuggucuug

SEQ ID NO: 1151397 - RNA, 24 nt, Human
gcgauucuccugccucagccuccu

SEQ ID NO: 1151398 - RNA, 19 nt, Human
gcgugagccaccaugcccg

SEQ ID NO: 1151399 - RNA, 23 nt, Human
gcuggucuugaacuccugaccuc

SEQ ID NO: 1151400 - RNA, 19 nt, Human
ggagaagggagcuggugcu

SEQ ID NO: 1151401 - RNA, 24 nt, Human
ggauuacaggcgugagccaccaug

SEQ ID NO: 1151402 - RNA, 24 nt, Human
ggcuggucuugaacuccugaccuc

SEQ ID NO: 1151403 - RNA, 23 nt, Human
gggguuucgccauguuggccagg

SEQ ID NO: 1151404 - RNA, 23 nt, Human
gggucauuaguggaauuaaaucc

SEQ ID NO: 1151405 - RNA, 21 nt, Human
gggugccagcugcagcagcuu

SEQ ID NO: 1151406 - RNA, 24 nt, Human
ggucauauugacugcaaugguuaa

SEQ ID NO: 1151407 - RNA, 22 nt, Human
ggucauuaguggaauuaaaucc

SEQ ID NO: 1151408 - RNA, 19 nt, Human
ggucuugaacuccugaccu

SEQ ID NO: 1151409 - RNA, 23 nt, Human
guagagacgggguuucgccaugu

SEQ ID NO: 1151410 - RNA, 18 nt, Human
guagcugggauuacaggc

SEQ ID NO: 1151411 - RNA, 21 nt, Human
guccagcuuugcuaaaucgac

SEQ ID NO: 1151412 - RNA, 24 nt, Human
gugauccaccugacucggccuccc

SEQ ID NO: 1151413 - RNA, 24 nt, Human
gugcucgcagggugccaagcaggg

SEQ ID NO: 1151414 - RNA, 19 nt, Human
uaagagauauuggugccac

SEQ ID NO: 1151415 - RNA, 20 nt, Human
uaauuuuuuguauuuuauag

SEQ ID NO: 1151416 - RNA, 25 nt, Human
uaauuuuuuguauuuuauaguagag

SEQ ID NO: 1151417 - RNA, 20 nt, Human
uacaaugaaaaauacagaag

SEQ ID NO: 1151418 - RNA, 22 nt, Human
uacaggaaauacaccauacaga

SEQ ID NO: 1151419 - RNA, 24 nt, Human
uacaggcacccgccaccacaccca

SEQ ID NO: 1151420 - RNA, 23 nt, Human
uacaggcgugagccaccaugccc

SEQ ID NO: 1151421 - RNA, 24 nt, Human
uacugggauuacaggcgugagcca

SEQ ID NO: 1151422 - RNA, 22 nt, Human
uagagacgggguuucgccaugu

SEQ ID NO: 1151423 - RNA, 23 nt, Human
uaguagagacgggguuucgccau

SEQ ID NO: 1151424 - RNA, 24 nt, Human
uaguagagacgggguuucgccaug

SEQ ID NO: 1151425 - RNA, 23 nt, Human
uaucccaaugcaaagucauuacu

SEQ ID NO: 1151426 - RNA, 18 nt, Human
ucacagcaaccucugccu

SEQ ID NO: 1151427 - RNA, 19 nt, Human
ucacagcaaccucugccuc

SEQ ID NO: 1151428 - RNA, 23 nt, Human
ucacagcaaccucugccucccag

SEQ ID NO: 1151429 - RNA, 24 nt, Human
ucacagcaaccucugccucccaga

SEQ ID NO: 1151430 - RNA, 20 nt, Human
ucagccuccugaguagcugg

SEQ ID NO: 1151431 - RNA, 21 nt, Human
uccaagaguuccaccauuucu

SEQ ID NO: 1151432 - RNA, 24 nt, Human
ucccaaaguacugggauuacaggc

SEQ ID NO: 1151433 - RNA, 21 nt, Human
ucccagauucaagcgauucuc

SEQ ID NO: 1151434 - RNA, 24 nt, Human
ucccagauucaagcgauucuccug

SEQ ID NO: 1151435 - RNA, 21 nt, Human
ucccugagguuauaauuucua

SEQ ID NO: 1151436 - RNA, 24 nt, Human
uccugaguagcugggauuacaggc

SEQ ID NO: 1151437 - RNA, 22 nt, Human
ucgccauguuggccaggcuggu

SEQ ID NO: 1151438 - RNA, 24 nt, Human
ucgccauguuggccaggcuggucu

SEQ ID NO: 1151439 - RNA, 18 nt, Human
ucgccgagcgcaaccggg

SEQ ID NO: 1151440 - RNA, 18 nt, Human
ucucacccuccaacucca

SEQ ID NO: 1151441 - RNA, 24 nt, Human
ucucacccuccaacuccaaccaga

SEQ ID NO: 1151442 - RNA, 24 nt, Human
ucucccgcccccagcccucuucgc

SEQ ID NO: 1151443 - RNA, 24 nt, Human
ucuccugccucagccuccugagua

SEQ ID NO: 1151444 - RNA, 24 nt, Human
ucuguuaacuugcccaaggucacc

SEQ ID NO: 1151445 - RNA, 24 nt, Human
ucuguugcucaggcuggagugcag

SEQ ID NO: 1151446 - RNA, 23 nt, Human
ucuugaacuccugaccucaggug

SEQ ID NO: 1151447 - RNA, 19 nt, Human
ucuugcucuguugcucagg

SEQ ID NO: 1151448 - RNA, 20 nt, Human
ucuugcucuguugcucaggc

SEQ ID NO: 1151449 - RNA, 23 nt, Human
ucuugcucuguugcucaggcugg

SEQ ID NO: 1151450 - RNA, 24 nt, Human
ucuugcucuguugcucaggcugga

SEQ ID NO: 1151451 - RNA, 22 nt, Human
ugaaaaauacagaagcuuuggc

SEQ ID NO: 1151452 - RNA, 19 nt, Human
ugaccucaggugauccacc

SEQ ID NO: 1151453 - RNA, 20 nt, Human
ugaccucaggugauccaccu

SEQ ID NO: 1151454 - RNA, 26 nt, Human
ugagugucuuuccacuuuuggauuuc

SEQ ID NO: 1151455 - RNA, 24 nt, Human
ugauauaaagcuucaacuauaggg

SEQ ID NO: 1151456 - RNA, 21 nt, Human
ugccaagcagggagaagacca

SEQ ID NO: 1151457 - RNA, 24 nt, Human
ugccucagccuccugaguagcugg

SEQ ID NO: 1151458 - RNA, 23 nt, Human
ugccucuguuaacuugcccaagg

SEQ ID NO: 1151459 - RNA, 20 nt, Human
ugcucaggcuggagugcagu

SEQ ID NO: 1151460 - RNA, 22 nt, Human
ugcucaggcuggagugcagugg

SEQ ID NO: 1151461 - RNA, 24 nt, Human
ugcucaggcuggagugcaguggca

SEQ ID NO: 1151462 - RNA, 20 nt, Human
uggaaaaagccuuguaauug

SEQ ID NO: 1151463 - RNA, 21 nt, Human
uggaaccaauccccuuggaua

SEQ ID NO: 1151464 - RNA, 18 nt, Human
uggaagugcaaaucugga

SEQ ID NO: 1151465 - RNA, 23 nt, Human
uggagugcaguggcacgaucucg

SEQ ID NO: 1151466 - RNA, 24 nt, Human
uggagugcaguggcacgaucucgg

SEQ ID NO: 1151467 - RNA, 24 nt, Human
uggccaggcuggucuugaacuccu

SEQ ID NO: 1151468 - RNA, 21 nt, Human
uggcgaggagaagggagcugg

SEQ ID NO: 1151469 - RNA, 22 nt, Human
ugggaaaggucaguaaccaggc

SEQ ID NO: 1151470 - RNA, 21 nt, Human
ugggauuacaggcacccgcca

SEQ ID NO: 1151471 - RNA, 22 nt, Human
ugggauuacaggcacccgccac

SEQ ID NO: 1151472 - RNA, 24 nt, Human
ugggauuacaggcacccgccacca

SEQ ID NO: 1151473 - RNA, 18 nt, Human
ugggauuacaggcgugag

SEQ ID NO: 1151474 - RNA, 22 nt, Human
ugggauuacaggcgugagccac

SEQ ID NO: 1151475 - RNA, 23 nt, Human
ugggauuacaggcgugagccacc

SEQ ID NO: 1151476 - RNA, 24 nt, Human
ugggauuacaggcgugagccacca

SEQ ID NO: 1151477 - RNA, 25 nt, Human
ugggauuacaggcgugagccaccau

SEQ ID NO: 1151478 - RNA, 22 nt, Human
uguaaaaucacagacccugcgc

SEQ ID NO: 1151479 - RNA, 19 nt, Human
ugugaugagaagaauuagu

SEQ ID NO: 1151480 - RNA, 19 nt, Human
uguguuuuacauacaugua

SEQ ID NO: 1151481 - RNA, 21 nt, Human
uucaagcgauucuccugccuc

SEQ ID NO: 1151482 - RNA, 23 nt, Human
uucaagcgauucuccugccucag

SEQ ID NO: 1151483 - RNA, 24 nt, Human
uucaagcgauucuccugccucagc

SEQ ID NO: 1151484 - RNA, 20 nt, Human
uuccugcuauguagccacaa

SEQ ID NO: 1151485 - RNA, 28 nt, Human
uugacugcaaugguuaaguucucugcaa

SEQ ID NO: 1151486 - RNA, 24 nt, Human
uugcucaggcuggagugcaguggc

SEQ ID NO: 1151487 - RNA, 24 nt, Human
uugcucuguugcucaggcuggagu

SEQ ID NO: 1151488 - RNA, 20 nt, Human
uuguaugguucaccacacug

SEQ ID NO: 1151489 - RNA, 19 nt, Human
uuuauaaucacaucugcuu

SEQ ID NO: 1151490 - RNA, 24 nt, Human
uuuauaguagagacgggguuucgc

SEQ ID NO: 1151491 - RNA, 24 nt, Human
uuucgccauguuggccaggcuggu

SEQ ID NO: 1151492 - RNA, 24 nt, Human
uuuuauaguagagacgggguuucg

SEQ ID NO: 1151493 - RNA, 22 nt, Human
uuuuuguauuuuauaguagaga

SEQ ID NO: 1151494 - RNA, 25 nt, Human
uuuuuuguauuuuauaguagagacg

SEQ ID NO: 1151495 - RNA, 19 nt, Human
aaacaaccuucccaaagga

SEQ ID NO: 1151496 - RNA, 22 nt, Human
aaacaagcccccagacucggca

SEQ ID NO: 1151497 - RNA, 22 nt, Human
aaacaggcuggcccaggcaggc

SEQ ID NO: 1151498 - RNA, 18 nt, Human
aaacauuggcaucuucuc

SEQ ID NO: 1151499 - RNA, 21 nt, Human
aaaccaaaacaagcccccaga

SEQ ID NO: 1151500 - RNA, 27 nt, Human
aacacggcaccuggcugagaggacaca

SEQ ID NO: 1151501 - RNA, 21 nt, Human
aacauuggcaucuucucagcg

SEQ ID NO: 1151502 - RNA, 24 nt, Human
aacuucaggggcccaaacaaccuu

SEQ ID NO: 1151503 - RNA, 23 nt, Human
aagcagcagccacccugggccug

SEQ ID NO: 1151504 - RNA, 19 nt, Human
aagugcacgcacaguacag

SEQ ID NO: 1151505 - RNA, 26 nt, Human
accccaugagcaccuccacaccagcc

SEQ ID NO: 1151506 - RNA, 23 nt, Human
accucccccacuuagcaggaagc

SEQ ID NO: 1151507 - RNA, 18 nt, Human
acucagcccacccacgcc

SEQ ID NO: 1151508 - RNA, 19 nt, Human
agaagccagguguccugac

SEQ ID NO: 1151509 - RNA, 25 nt, Human
agauggaacuucaggggcccaaaca

SEQ ID NO: 1151510 - RNA, 22 nt, Human
agcauuaaaugaaaccaucuga

SEQ ID NO: 1151511 - RNA, 18 nt, Human
agccacaaagacugcagc

SEQ ID NO: 1151512 - RNA, 20 nt, Human
agcccuccaccucacagaug

SEQ ID NO: 1151513 - RNA, 22 nt, Human
aggcagccacaaagacugcagc

SEQ ID NO: 1151514 - RNA, 26 nt, Human
aggcagcuaacguggucccuaggugg

SEQ ID NO: 1151515 - RNA, 25 nt, Human
aggcaggcagccacaaagacugcag

SEQ ID NO: 1151516 - RNA, 20 nt, Human
aggcgucgugacgucgggac

SEQ ID NO: 1151517 - RNA, 24 nt, Human
aggcgucgugacgucgggacggca

SEQ ID NO: 1151518 - RNA, 21 nt, Human
aguuucuggguccuggcuuag

SEQ ID NO: 1151519 - RNA, 18 nt, Human
caaaacaagcccccagac

SEQ ID NO: 1151520 - RNA, 21 nt, Human
caaaacaagcccccagacucg

SEQ ID NO: 1151521 - RNA, 24 nt, Human
caaaacaagcccccagacucggca

SEQ ID NO: 1151522 - RNA, 19 nt, Human
caaagacugcagccagcau

SEQ ID NO: 1151523 - RNA, 24 nt, Human
caagcaccgcaccccaugagcacc

SEQ ID NO: 1151524 - RNA, 24 nt, Human
caagcccccagacucggcaguaua

SEQ ID NO: 1151525 - RNA, 18 nt, Human
cacagccucaggcuggcu

SEQ ID NO: 1151526 - RNA, 19 nt, Human
caccccaugagcaccucca

SEQ ID NO: 1151527 - RNA, 23 nt, Human
caccccaugagcaccuccacacc

SEQ ID NO: 1151528 - RNA, 27 nt, Human
caccccaugagcaccuccacaccagcc

SEQ ID NO: 1151529 - RNA, 25 nt, Human
caccugagcccagguacgaaaaggc

SEQ ID NO: 1151530 - RNA, 19 nt, Human
cacgcacaguacaggagcc

SEQ ID NO: 1151531 - RNA, 21 nt, Human
cagaccagcguguccugcccu

SEQ ID NO: 1151532 - RNA, 23 nt, Human
cagaggucacccauggggagcac

SEQ ID NO: 1151533 - RNA, 22 nt, Human
cagccacaaagacugcagccag

SEQ ID NO: 1151534 - RNA, 21 nt, Human
cagccccugggagagccuccc

SEQ ID NO: 1151535 - RNA, 18 nt, Human
cagccgguggaugaaaca

SEQ ID NO: 1151536 - RNA, 27 nt, Human
caggagccuagggcuaacacucgggaa

SEQ ID NO: 1151537 - RNA, 20 nt, Human
caggcaccuccacucagccc

SEQ ID NO: 1151538 - RNA, 19 nt, Human
ccaaaacaagcccccagac

SEQ ID NO: 1151539 - RNA, 21 nt, Human
ccaagcaccgcaccccaugag

SEQ ID NO: 1151540 - RNA, 22 nt, Human
ccaagcaccgcaccccaugagc

SEQ ID NO: 1151541 - RNA, 23 nt, Human
ccacugccuccagaggucaccca

SEQ ID NO: 1151542 - RNA, 21 nt, Human
ccagacucggcaguauaaagc

SEQ ID NO: 1151543 - RNA, 24 nt, Human
cccacgccgcgagugcucugcagg

SEQ ID NO: 1151544 - RNA, 21 nt, Human
cccagacucggcaguauaaag

SEQ ID NO: 1151545 - RNA, 22 nt, Human
cccaggcaggcagccacaaaga

SEQ ID NO: 1151546 - RNA, 18 nt, Human
cccaugagcaccuccaca

SEQ ID NO: 1151547 - RNA, 18 nt, Human
cccauggggcucccccuc

SEQ ID NO: 1151548 - RNA, 19 nt, Human
cccaugugguguagaaggc

SEQ ID NO: 1151549 - RNA, 21 nt, Human
ccccaaaccaaaacaagcccc

SEQ ID NO: 1151550 - RNA, 24 nt, Human
cccccaaaccaaaacaagccccca

SEQ ID NO: 1151551 - RNA, 22 nt, Human
cccccaucagccccugggagag

SEQ ID NO: 1151552 - RNA, 21 nt, Human
cccugggccuggcugucuccc

SEQ ID NO: 1151553 - RNA, 19 nt, Human
ccgagcccugauucucccu

SEQ ID NO: 1151554 - RNA, 22 nt, Human
ccuccacaccagcccuccaccu

SEQ ID NO: 1151555 - RNA, 22 nt, Human
ccuccaggcagcgcuggaugcc

SEQ ID NO: 1151556 - RNA, 18 nt, Human
ccucuagccugccugggg

SEQ ID NO: 1151557 - RNA, 18 nt, Human
ccucuccuuccugccucc

SEQ ID NO: 1151558 - RNA, 18 nt, Human
cgaaaaggcgagcccaca

SEQ ID NO: 1151559 - RNA, 20 nt, Human
cucacagaacccccccauca

SEQ ID NO: 1151560 - RNA, 18 nt, Human
cucacagauguggaaacc

SEQ ID NO: 1151561 - RNA, 20 nt, Human
cuccacaccagcccuccacc

SEQ ID NO: 1151562 - RNA, 21 nt, Human
cuccacaccagcccuccaccu

SEQ ID NO: 1151563 - RNA, 22 nt, Human
cuccacaccagcccuccaccuc

SEQ ID NO: 1151564 - RNA, 24 nt, Human
cucccaggcaccuccacucagccc

SEQ ID NO: 1151565 - RNA, 22 nt, Human
cucccaggcaggggaugagggu

SEQ ID NO: 1151566 - RNA, 19 nt, Human
cucccagugggaggccuug

SEQ ID NO: 1151567 - RNA, 24 nt, Human
cugcagccagcaugggcccuggcc

SEQ ID NO: 1151568 - RNA, 21 nt, Human
cugcccccaaaccaaaacaag

SEQ ID NO: 1151569 - RNA, 18 nt, Human
cugccuucccaggcgugg

SEQ ID NO: 1151570 - RNA, 18 nt, Human
cuggagcccggcaucccc

SEQ ID NO: 1151571 - RNA, 20 nt, Human
cuggggugugcccacagcaa

SEQ ID NO: 1151572 - RNA, 21 nt, Human
cuucccgagcccugauucucc

SEQ ID NO: 1151573 - RNA, 21 nt, Human
cuucucagcgaugacucccag

SEQ ID NO: 1151574 - RNA, 22 nt, Human
gaaggcccgugcucccccacuc

SEQ ID NO: 1151575 - RNA, 22 nt, Human
gacccuuuggaggccacagccu

SEQ ID NO: 1151576 - RNA, 20 nt, Human
gagcaccuccacaccagccc

SEQ ID NO: 1151577 - RNA, 23 nt, Human
gagcccacagucccagcucccaa

SEQ ID NO: 1151578 - RNA, 22 nt, Human
gagcccugauucucccucacag

SEQ ID NO: 1151579 - RNA, 19 nt, Human
gagccgcugucucuccccc

SEQ ID NO: 1151580 - RNA, 22 nt, Human
gaggguggcgguggccacaccg

SEQ ID NO: 1151581 - RNA, 21 nt, Human
gagucggcggaggcugcagug

SEQ ID NO: 1151582 - RNA, 19 nt, Human
gagugcucugcagguuggc

SEQ ID NO: 1151583 - RNA, 21 nt, Human
gaugccggagcaggugcuucu

SEQ ID NO: 1151584 - RNA, 19 nt, Human
gccacauuuauuucuuaau

SEQ ID NO: 1151585 - RNA, 18 nt, Human
gcccugccucuccuuccu

SEQ ID NO: 1151586 - RNA, 19 nt, Human
gcccugccucuccuuccug

SEQ ID NO: 1151587 - RNA, 18 nt, Human
gccucagacaccugcgac

SEQ ID NO: 1151588 - RNA, 21 nt, Human
gccuccucucaccaucaacuc

SEQ ID NO: 1151589 - RNA, 20 nt, Human
gccuggggcccauggggcuc

SEQ ID NO: 1151590 - RNA, 20 nt, Human
gccugugccuccucuagccu

SEQ ID NO: 1151591 - RNA, 21 nt, Human
gcgcccagacccuuuggaggc

SEQ ID NO: 1151592 - RNA, 21 nt, Human
gcugcccccaaaccaaaacaa

SEQ ID NO: 1151593 - RNA, 24 nt, Human
ggacagagccucaagugcacgcag

SEQ ID NO: 1151594 - RNA, 24 nt, Human
ggcagcucccaggcaccuccacuc

SEQ ID NO: 1151595 - RNA, 21 nt, Human
ggcccgugcucccccacuccu

SEQ ID NO: 1151596 - RNA, 24 nt, Human
ggcuucccgagcccugauucuccc

SEQ ID NO: 1151597 - RNA, 19 nt, Human
ggguccuagccaaggccaa

SEQ ID NO: 1151598 - RNA, 19 nt, Human
ggguguaagacaucgggac

SEQ ID NO: 1151599 - RNA, 20 nt, Human
gguccacugccuccagaggu

SEQ ID NO: 1151600 - RNA, 19 nt, Human
ggucccuaggugguuucug

SEQ ID NO: 1151601 - RNA, 19 nt, Human
guccacugccuccagaggu

SEQ ID NO: 1151602 - RNA, 22 nt, Human
guggcgguggccacaccgcacc

SEQ ID NO: 1151603 - RNA, 19 nt, Human
gugguguagaaggcccgug

SEQ ID NO: 1151604 - RNA, 23 nt, Human
uaaaugaaaccaucugagggaga

SEQ ID NO: 1151605 - RNA, 19 nt, Human
uacaagccagggacgcggc

SEQ ID NO: 1151606 - RNA, 20 nt, Human
uaucuggagccgcagcggaa

SEQ ID NO: 1151607 - RNA, 20 nt, Human
ucagaccagcguguccugcc

SEQ ID NO: 1151608 - RNA, 19 nt, Human
ucagccccugggagagccu

SEQ ID NO: 1151609 - RNA, 20 nt, Human
ucaggggcccaaacaaccuu

SEQ ID NO: 1151610 - RNA, 20 nt, Human
uccagaggucacccaugggg

SEQ ID NO: 1151611 - RNA, 19 nt, Human
ucccagcucccaaacaggc

SEQ ID NO: 1151612 - RNA, 25 nt, Human
ucccagcucccaaacaggcuggccc

SEQ ID NO: 1151613 - RNA, 18 nt, Human
ucccgagcccugauucuc

SEQ ID NO: 1151614 - RNA, 21 nt, Human
uccucucaccaucaacucuga

SEQ ID NO: 1151615 - RNA, 20 nt, Human
ucgggacaggcgucgugacg

SEQ ID NO: 1151616 - RNA, 21 nt, Human
ucuccauggcaguggaggcuu

SEQ ID NO: 1151617 - RNA, 19 nt, Human
ucucccaagcaccgcaccc

SEQ ID NO: 1151618 - RNA, 20 nt, Human
ucucccaagcaccgcacccc

SEQ ID NO: 1151619 - RNA, 18 nt, Human
ucucccccaggcauggga

SEQ ID NO: 1151620 - RNA, 21 nt, Human
ugaaacauuggcaucuucuca

SEQ ID NO: 1151621 - RNA, 18 nt, Human
ugacauggggucuggggu

SEQ ID NO: 1151622 - RNA, 21 nt, Human
ugacauggggucuggggugug

SEQ ID NO: 1151623 - RNA, 18 nt, Human
ugagaggacacagccagg

SEQ ID NO: 1151624 - RNA, 22 nt, Human
ugagcaccuccacaccagcccu

SEQ ID NO: 1151625 - RNA, 18 nt, Human
ugaggguggcgguggcca

SEQ ID NO: 1151626 - RNA, 24 nt, Human
ugaggguggcgguggccacaccgg

SEQ ID NO: 1151627 - RNA, 19 nt, Human
ugaguuggccguggcaggg

SEQ ID NO: 1151628 - RNA, 19 nt, Human
ugcaagaagcuguucugca

SEQ ID NO: 1151629 - RNA, 23 nt, Human
ugcccccaaaccaaaacaagccc

SEQ ID NO: 1151630 - RNA, 26 nt, Human
ugcccugccucuccuuccugccucca

SEQ ID NO: 1151631 - RNA, 20 nt, Human
ugccuccagaggucacccau

SEQ ID NO: 1151632 - RNA, 21 nt, Human
uggcagggccugugccuccuc

SEQ ID NO: 1151633 - RNA, 18 nt, Human
uggcucuggguccuagcc

SEQ ID NO: 1151634 - RNA, 25 nt, Human
uggcuucccgagcccugauucuccc

SEQ ID NO: 1151635 - RNA, 20 nt, Human
ugggagagccucccaggcag

SEQ ID NO: 1151636 - RNA, 20 nt, Human
ugggaggccuuggacuuggc

SEQ ID NO: 1151637 - RNA, 21 nt, Human
uggggucuggggugugcccac

SEQ ID NO: 1151638 - RNA, 23 nt, Human
uggguccuggcuuaggcacuccu

SEQ ID NO: 1151639 - RNA, 23 nt, Human
ugggugggggaguuugugccugu

SEQ ID NO: 1151640 - RNA, 23 nt, Human
uguagaaggcccgugcuccccca

SEQ ID NO: 1151641 - RNA, 21 nt, Human
uguccugcccugccucuccuu

SEQ ID NO: 1151642 - RNA, 25 nt, Human
uguccugcccugccucuccuuccug

SEQ ID NO: 1151643 - RNA, 21 nt, Human
ugugcccacagcaaucacaua

SEQ ID NO: 1151644 - RNA, 26 nt, Human
ugugcccacagcaaucacauauguac

SEQ ID NO: 1151645 - RNA, 20 nt, Human
uguguugaguaagagccaca

SEQ ID NO: 1151646 - RNA, 20 nt, Human
uuccaaagaaagcugcugug

SEQ ID NO: 1151647 - RNA, 21 nt, Human
uucccaugugguguagaaggc

SEQ ID NO: 1151648 - RNA, 23 nt, Human
uucugguggaggauggcugcccc

SEQ ID NO: 1151649 - RNA, 23 nt, Human
uuggcaucuucucagcgaugacu

SEQ ID NO: 1151650 - RNA, 18 nt, Human
uuuuuuuuuuuuuuuuug

SEQ ID NO: 1151651 - RNA, 23 nt, Human
uuuuuuuuuuuuuuuuuuguguu

SEQ ID NO: 1151652 - RNA, 20 nt, Human
aagccccagccugguccacc

SEQ ID NO: 1151653 - RNA, 21 nt, Human
aagcccccugucccggcccag

SEQ ID NO: 1151654 - RNA, 23 nt, Human
acccggcugaggaccugcuggcg

SEQ ID NO: 1151655 - RNA, 20 nt, Human
accggcagaagcugggcgcc

SEQ ID NO: 1151656 - RNA, 21 nt, Human
agcagcccggcccgcgcgcgc

SEQ ID NO: 1151657 - RNA, 18 nt, Human
agccgcgggcgcggagga

SEQ ID NO: 1151658 - RNA, 18 nt, Human
agccgcucggccgccguc

SEQ ID NO: 1151659 - RNA, 22 nt, Human
agcuugaaggccugcugccugg

SEQ ID NO: 1151660 - RNA, 22 nt, Human
aggcaagaggguuguauauuuu

SEQ ID NO: 1151661 - RNA, 18 nt, Human
aggccgcggugcgcgccg

SEQ ID NO: 1151662 - RNA, 21 nt, Human
auagauccucagggcccaaaa

SEQ ID NO: 1151663 - RNA, 19 nt, Human
caaaauagauccucagggc

SEQ ID NO: 1151664 - RNA, 19 nt, Human
caagccccagccuggucca

SEQ ID NO: 1151665 - RNA, 20 nt, Human
caccgcguaccucaugcggc

SEQ ID NO: 1151666 - RNA, 19 nt, Human
caccuggagcccacgugcg

SEQ ID NO: 1151667 - RNA, 22 nt, Human
cacgcugugcgucaacgucucc

SEQ ID NO: 1151668 - RNA, 22 nt, Human
cagccugguccaccucggaggc

SEQ ID NO: 1151669 - RNA, 19 nt, Human
caggcccaguccugccugc

SEQ ID NO: 1151670 - RNA, 22 nt, Human
caugucauuuaugauguauaua

SEQ ID NO: 1151671 - RNA, 24 nt, Human
ccaaaagcagacucuucggcgggc

SEQ ID NO: 1151672 - RNA, 21 nt, Human
ccacaaauagacuccugggcu

SEQ ID NO: 1151673 - RNA, 19 nt, Human
ccagaaguaugaggaggcc

SEQ ID NO: 1151674 - RNA, 23 nt, Human
cccaaaauagauccucagggccc

SEQ ID NO: 1151675 - RNA, 18 nt, Human
cccaagccccagccuggu

SEQ ID NO: 1151676 - RNA, 23 nt, Human
cccacauucaccucuuuccacuu

SEQ ID NO: 1151677 - RNA, 25 nt, Human
cccacgugcgccgccauggaggccg

SEQ ID NO: 1151678 - RNA, 27 nt, Human
cccacgugcgccgccauggaggccgcg

SEQ ID NO: 1151679 - RNA, 21 nt, Human
ccccagccuuaggguugggcc

SEQ ID NO: 1151680 - RNA, 21 nt, Human
cccccagccuuaggguugggc

SEQ ID NO: 1151681 - RNA, 20 nt, Human
ccccggccccaacgagaccc

SEQ ID NO: 1151682 - RNA, 25 nt, Human
ccccggccccaacgagacccaagcc

SEQ ID NO: 1151683 - RNA, 20 nt, Human
ccuccaggcccaguccugcc

SEQ ID NO: 1151684 - RNA, 27 nt, Human
ccugagcccccaaaauagauccucagg

SEQ ID NO: 1151685 - RNA, 24 nt, Human
ccugggcgggcgccugagccccca

SEQ ID NO: 1151686 - RNA, 22 nt, Human
cgagacccaagcccccuguccc

SEQ ID NO: 1151687 - RNA, 24 nt, Human
cgagacccaagcccccugucccgg

SEQ ID NO: 1151688 - RNA, 20 nt, Human
cgccugagcccccaaaauag

SEQ ID NO: 1151689 - RNA, 19 nt, Human
cgcgggggacccaagcccc

SEQ ID NO: 1151690 - RNA, 19 nt, Human
cggcgccugccuagucuac

SEQ ID NO: 1151691 - RNA, 23 nt, Human
cggcgggcgccaugggaccggca

SEQ ID NO: 1151692 - RNA, 22 nt, Human
cggcucccacaaauagacuccu

SEQ ID NO: 1151693 - RNA, 19 nt, Human
cgucgcgcccucacucuuc

SEQ ID NO: 1151694 - RNA, 20 nt, Human
cuccaggcccaguccugccu

SEQ ID NO: 1151695 - RNA, 22 nt, Human
cuccaggcccaguccugccugc

SEQ ID NO: 1151696 - RNA, 20 nt, Human
cucccacaaauagacuccug

SEQ ID NO: 1151697 - RNA, 20 nt, Human
cuggagcccacgugcgccgc

SEQ ID NO: 1151698 - RNA, 21 nt, Human
gagcagcuggcgcgcgcggga

SEQ ID NO: 1151699 - RNA, 18 nt, Human
gaggagcagcuggcgcgc

SEQ ID NO: 1151700 - RNA, 24 nt, Human
gcccccagccuuaggguugggccc

SEQ ID NO: 1151701 - RNA, 24 nt, Human
gcccgcgggggacccaagccccag

SEQ ID NO: 1151702 - RNA, 21 nt, Human
gcgcgagccgcgggcgcggag

SEQ ID NO: 1151703 - RNA, 21 nt, Human
gcggugcgcgccggcggcgcc

SEQ ID NO: 1151704 - RNA, 20 nt, Human
ggacccgggggcgcccggcg

SEQ ID NO: 1151705 - RNA, 21 nt, Human
ggacccgggggcgcccggcgg

SEQ ID NO: 1151706 - RNA, 18 nt, Human
gucucccgccagcagccc

SEQ ID NO: 1151707 - RNA, 25 nt, Human
guuuuguguuccuuaacuauuuugu

SEQ ID NO: 1151708 - RNA, 21 nt, Human
uagcagaaccgaacccgggcu

SEQ ID NO: 1151709 - RNA, 23 nt, Human
ucauuuaugauguauauaaccuc

SEQ ID NO: 1151710 - RNA, 19 nt, Human
ucggaggccucuaggaccc

SEQ ID NO: 1151711 - RNA, 21 nt, Human
ucggaggccucuaggacccgg

SEQ ID NO: 1151712 - RNA, 20 nt, Human
ucuggcaaagccugccgugu

SEQ ID NO: 1151713 - RNA, 21 nt, Human
ucuuccucgggagcgcgcgag

SEQ ID NO: 1151714 - RNA, 21 nt, Human
ugaaucuugucauaacaguuu

SEQ ID NO: 1151715 - RNA, 19 nt, Human
ugaggaggcccuccaggcc

SEQ ID NO: 1151716 - RNA, 18 nt, Human
ugaggcuugaagcuugaa

SEQ ID NO: 1151717 - RNA, 23 nt, Human
ugccuggaggaaggaugucccug

SEQ ID NO: 1151718 - RNA, 24 nt, Human
ugccuggaggaaggaugucccugc

SEQ ID NO: 1151719 - RNA, 22 nt, Human
uggcgcaccuggagcccacgug

SEQ ID NO: 1151720 - RNA, 19 nt, Human
uggucucagcuccagaagu

SEQ ID NO: 1151721 - RNA, 24 nt, Human
uuuaaugccugaaaucauaagaau

SEQ ID NO: 1151722 - RNA, 23 nt, Human
uuuccacuuaaacgugucccaug

SEQ ID NO: 1151723 - RNA, 25 nt, Human
aaaacaaaacaaaacaaaaaguuaa

SEQ ID NO: 1151724 - RNA, 19 nt, Human
aaacaaaacaaaacaaaaa

SEQ ID NO: 1151725 - RNA, 22 nt, Human
aaacaaaacaaaacaaaacaaa

SEQ ID NO: 1151726 - RNA, 22 nt, Human
aaacaaaacaaaacaaaacaaa

SEQ ID NO: 1151727 - RNA, 22 nt, Human
aaaccagagaccaaacaauuga

SEQ ID NO: 1151728 - RNA, 26 nt, Human
aaccagagaccaaacaauugagcuuu

SEQ ID NO: 1151729 - RNA, 24 nt, Human
aacuaaaugcagaaguuucucaag

SEQ ID NO: 1151730 - RNA, 20 nt, Human
aagaaccaggacacaugaga

SEQ ID NO: 1151731 - RNA, 21 nt, Human
aagccaguccaguaugaccga

SEQ ID NO: 1151732 - RNA, 22 nt, Human
aaugaaaaggcagccauuaaaa

SEQ ID NO: 1151733 - RNA, 27 nt, Human
aaugcaaaacaaaacaaaacaaaacaa

SEQ ID NO: 1151734 - RNA, 22 nt, Human
aauggaucaauuguauaccaag

SEQ ID NO: 1151735 - RNA, 24 nt, Human
aauggcaccuucaaaaggggcgau

SEQ ID NO: 1151736 - RNA, 18 nt, Human
acaaaacaaaacaaaaag

SEQ ID NO: 1151737 - RNA, 27 nt, Human
acaaaacaaaacaaaacaaaacaaaaa

SEQ ID NO: 1151738 - RNA, 24 nt, Human
acaugacauuuuaucuacaacucc

SEQ ID NO: 1151739 - RNA, 21 nt, Human
accaaaucauauccuuaaaac

SEQ ID NO: 1151740 - RNA, 21 nt, Human
accaagaaguauuuggcucau

SEQ ID NO: 1151741 - RNA, 24 nt, Human
acccauuuguuuugccuggaaaga

SEQ ID NO: 1151742 - RNA, 22 nt, Human
acguacucaagauucauguuaa

SEQ ID NO: 1151743 - RNA, 22 nt, Human
agguagaagauaacugaaaaga

SEQ ID NO: 1151744 - RNA, 20 nt, Human
caaaacaaaacaaaaaguua

SEQ ID NO: 1151745 - RNA, 24 nt, Human
caaaacaaaacaaaacaaaaaguu

SEQ ID NO: 1151746 - RNA, 21 nt, Human
caaaacaaaacaaaacaaaac

SEQ ID NO: 1151747 - RNA, 24 nt, Human
caaaacaaaacaaaacaaaacaaa

SEQ ID NO: 1151748 - RNA, 24 nt, Human
caaaacaaaacaaaacaaaacaaa

SEQ ID NO: 1151749 - RNA, 31 nt, Human; identical to SEQ ID NO: 461509

SEQ ID NO: 1151750 - RNA, 25 nt, Human
caacuccuguuugcuuuacugaggg

SEQ ID NO: 1151751 - RNA, 23 nt, Human
caagcaaugguccacguacucaa

SEQ ID NO: 1151752 - RNA, 21 nt, Human
cagaucacuacguagaaaucu

SEQ ID NO: 1151753 - RNA, 20 nt, Human
caggagguagaagauaacug

SEQ ID NO: 1151754 - RNA, 18 nt, Human
cagggcuccgggcaugcc

SEQ ID NO: 1151755 - RNA, 23 nt, Human
caguuaaaauaaaauuugccaug

SEQ ID NO: 1151756 - RNA, 24 nt, Human
cauugcacuucauuuguuauagca

SEQ ID NO: 1151757 - RNA, 20 nt, Human
cccaaugacuacauacauag

SEQ ID NO: 1151758 - RNA, 21 nt, Human
ccucugccacauuaugauuuc

SEQ ID NO: 1151759 - RNA, 24 nt, Human
cucaacuuucuucuucccaccacc

SEQ ID NO: 1151760 - RNA, 22 nt, Human
cucuaaggaugaaaaccagaga

SEQ ID NO: 1151761 - RNA, 20 nt, Human
cugaaaagacuaaugcaaca

SEQ ID NO: 1151762 - RNA, 18 nt, Human
cuucccaccaccucugcc

SEQ ID NO: 1151763 - RNA, 24 nt, Human
cuuuuccaguuuaauuugcaaaca

SEQ ID NO: 1151764 - RNA, 18 nt, Human
gaagauguaagaaccagg

SEQ ID NO: 1151765 - RNA, 23 nt, Human
gaagccaguccaguaugaccgag

SEQ ID NO: 1151766 - RNA, 24 nt, Human
gaccuuuaacauuuucaacaauuu

SEQ ID NO: 1151767 - RNA, 19 nt, Human
gauguaagaaccaggacac

SEQ ID NO: 1151768 - RNA, 18 nt, Human
ggagguagaagauaacug

SEQ ID NO: 1151769 - RNA, 21 nt, Human
ggauaucuggaguuaaaaaug

SEQ ID NO: 1151770 - RNA, 25 nt, Human
uaaauggaucaauuguauaccaaga

SEQ ID NO: 1151771 - RNA, 23 nt, Human
uaacacaaagucuucccauaaaa

SEQ ID NO: 1151772 - RNA, 21 nt, Human
uacaguagaaaauacaggagg

SEQ ID NO: 1151773 - RNA, 19 nt, Human
uaccaagaaguauuuggcu

SEQ ID NO: 1151774 - RNA, 21 nt, Human
uagcagcaagaaaagaugaaa

SEQ ID NO: 1151775 - RNA, 18 nt, Human
uaggaagauguaagaacc

SEQ ID NO: 1151776 - RNA, 20 nt, Human
uaggauaucuggaguuaaaa

SEQ ID NO: 1151777 - RNA, 21 nt, Human
uauagcaaauacucuaagcca

SEQ ID NO: 1151778 - RNA, 23 nt, Human
uaucaaaguuacucauuuuaaca

SEQ ID NO: 1151779 - RNA, 23 nt, Human
uaucuggaguuaaaaaugcaaaa

SEQ ID NO: 1151780 - RNA, 25 nt, Human
ucaguuauaauguucuuuuuaaggg

SEQ ID NO: 1151781 - RNA, 21 nt, Human
ucauugaugagcagggcuccg

SEQ ID NO: 1151782 - RNA, 20 nt, Human
uccacucagucucugguggc

SEQ ID NO: 1151783 - RNA, 21 nt, Human
ucccaauuagaacaugcugac

SEQ ID NO: 1151784 - RNA, 20 nt, Human
ucuauagcuccuguagcuac

SEQ ID NO: 1151785 - RNA, 18 nt, Human
ugaaaagaauacccauuu

SEQ ID NO: 1151786 - RNA, 22 nt, Human
ugaaaaggcagccauuaaaaua

SEQ ID NO: 1151787 - RNA, 21 nt, Human
ugaaagcccuuauaucaugcu

SEQ ID NO: 1151788 - RNA, 21 nt, Human
ugaauacauuuugccugugca

SEQ ID NO: 1151789 - RNA, 24 nt, Human
ugacuacauacauagauggguagc

SEQ ID NO: 1151790 - RNA, 23 nt, Human
ugagacucuggauacuuuuccag

SEQ ID NO: 1151791 - RNA, 20 nt, Human
ugcaaaacaaaacaaaacaa

SEQ ID NO: 1151792 - RNA, 25 nt, Human
ugcaaaacaaaacaaaacaaaacaa

SEQ ID NO: 1151793 - RNA, 26 nt, Human
ugcaagcaaugguccacguacucaag

SEQ ID NO: 1151794 - RNA, 19 nt, Human
ugccauauuaucucacaaa

SEQ ID NO: 1151795 - RNA, 18 nt, Human
ugccuuuugagacucugg

SEQ ID NO: 1151796 - RNA, 23 nt, Human
uggauacuuuuccaguuuaauuu

SEQ ID NO: 1151797 - RNA, 21 nt, Human
uggcaauuaaaaaauggcaac

SEQ ID NO: 1151798 - RNA, 18 nt, Human
uggcucauaagaauggca

SEQ ID NO: 1151799 - RNA, 22 nt, Human
ugucauugcacuucauuuguua

SEQ ID NO: 1151800 - RNA, 25 nt, Human
ugucauugcacuucauuuguuauag

SEQ ID NO: 1151801 - RNA, 18 nt, Human
uguggcuacauuuucccc

SEQ ID NO: 1151802 - RNA, 22 nt, Human
uuaacacaaagucuucccauaa

SEQ ID NO: 1151803 - RNA, 19 nt, Human
uucaccccauucacaacaa

SEQ ID NO: 1151804 - RNA, 26 nt, Human
uucacuuuuaacacaaagucuuccca

SEQ ID NO: 1151805 - RNA, 20 nt, Human
uucccaccaccucugccaca

SEQ ID NO: 1151806 - RNA, 24 nt, Human
uuucaagucuguucuccauggcuu

SEQ ID NO: 1151807 - RNA, 25 nt, Human
uuugcaaacagaauuuuuauaacaa

SEQ ID NO: 1151808 - RNA, 24 nt, Human
aaaaagacaaacuuuugaaacagg

SEQ ID NO: 1151809 - RNA, 25 nt, Human
aaaacucaaaacaaaauccaaaucu

SEQ ID NO: 1151810 - RNA, 19 nt, Human
aaagcaguccaucaaaccc

SEQ ID NO: 1151811 - RNA, 23 nt, Human
aacaaaagcaacaucuaauuaac

SEQ ID NO: 1151812 - RNA, 19 nt, Human
aaggugcaaaauaaggagc

SEQ ID NO: 1151813 - RNA, 26 nt, Human
acaaacuuuugaaacaggacuuacug

SEQ ID NO: 1151814 - RNA, 18 nt, Human
acaccccgcaacaucccc

SEQ ID NO: 1151815 - RNA, 24 nt, Human
acagcauuugcuucuacugcccau

SEQ ID NO: 1151816 - RNA, 23 nt, Human
aggaggcaguuugugaagucaaa

SEQ ID NO: 1151817 - RNA, 21 nt, Human
aggcagcauggucccacugcu

SEQ ID NO: 1151818 - RNA, 22 nt, Human
agggagucaaauacauuugucu

SEQ ID NO: 1151819 - RNA, 21 nt, Human
agguagaagcaaaaaaagaca

SEQ ID NO: 1151820 - RNA, 18 nt, Human
aguggaaaauaguggcac

SEQ ID NO: 1151821 - RNA, 21 nt, Human
aucaaacccugaauacuucgc

SEQ ID NO: 1151822 - RNA, 20 nt, Human
caaaauccaaaucuaguucu

SEQ ID NO: 1151823 - RNA, 19 nt, Human
caacagcauuugcuucuac

SEQ ID NO: 1151824 - RNA, 18 nt, Human
cacaccccgcaacauccc

SEQ ID NO: 1151825 - RNA, 25 nt, Human
cacugaagguagaagcaaaaaaaga

SEQ ID NO: 1151826 - RNA, 31 nt, Human
caucauuauuuuguuucuccagcaauuuuaa

SEQ ID NO: 1151827 - RNA, 22 nt, Human
cgcaacauccccuuuacaaaug

SEQ ID NO: 1151828 - RNA, 21 nt, Human
cuccagcaauuuuaguggcag

SEQ ID NO: 1151829 - RNA, 22 nt, Human
cuccucaacagcaucacacccc

SEQ ID NO: 1151830 - RNA, 23 nt, Human
cugaaauauaaggaagauaaggu

SEQ ID NO: 1151831 - RNA, 20 nt, Human
gcaguggaaaauaguggcac

SEQ ID NO: 1151832 - RNA, 22 nt, Human
ggaaugccauccuccagccucc

SEQ ID NO: 1151833 - RNA, 19 nt, Human
ggcacugaagguagaagca

SEQ ID NO: 1151834 - RNA, 19 nt, Human
uaagaugaacugaacaaca

SEQ ID NO: 1151835 - RNA, 26 nt, Human
uacaacaguagaauuuaccuuuuaaa

SEQ ID NO: 1151836 - RNA, 18 nt, Human
uacauuguucucucugga

SEQ ID NO: 1151837 - RNA, 23 nt, Human
ucaaaacaaaauccaaaucuagu

SEQ ID NO: 1151838 - RNA, 26 nt, Human
ucaaauguaacaacagcauuugcuuc

SEQ ID NO: 1151839 - RNA, 18 nt, Human
uccaaacgaaaguaaagc

SEQ ID NO: 1151840 - RNA, 22 nt, Human
uccaggccuccugcaauuuccu

SEQ ID NO: 1151841 - RNA, 18 nt, Human
ucuccucaacagcaucac

SEQ ID NO: 1151842 - RNA, 21 nt, Human
ucucuggaggaggcaguuugu

SEQ ID NO: 1151843 - RNA, 24 nt, Human
ucugaaauauaaggaagauaaggu

SEQ ID NO: 1151844 - RNA, 24 nt, Human
ugaacugaacaacagcuucuuuua

SEQ ID NO: 1151845 - RNA, 23 nt, Human
ugaaggugaaucuccucaacagc

SEQ ID NO: 1151846 - RNA, 18 nt, Human
ugaagucaaaacacugca

SEQ ID NO: 1151847 - RNA, 23 nt, Human
uggaaaauaguggcacugaaggu

SEQ ID NO: 1151848 - RNA, 23 nt, Human
uggaaugccauccuccagccucc

SEQ ID NO: 1151849 - RNA, 20 nt, Human
uggugggugcuucuccuuug

SEQ ID NO: 1151850 - RNA, 19 nt, Human
ugugaagucaaaacacugc

SEQ ID NO: 1151851 - RNA, 20 nt, Human
uguugcuucuuuguucugaa

SEQ ID NO: 1151852 - RNA, 20 nt, Human
uucccagaugaagugguggg

SEQ ID NO: 1151853 - RNA, 24 nt, Human
uugggaaagcuaaguuuuaauuuc

SEQ ID NO: 1151854 - RNA, 22 nt, Human
uuuaaaaauccaaaaacucaaa

SEQ ID NO: 1151855 - RNA, 20 nt, Human
uuugaaacaggacuuacuga

SEQ ID NO: 1151856 - RNA, 22 nt, Human
cgcuggcucagcgugaccacgc

SEQ ID NO: 1151857 - RNA, 18 nt, Human
aaaccuggauaaaggcua

SEQ ID NO: 1151858 - RNA, 24 nt, Human
auaagacacuguucguauaaauaa

SEQ ID NO: 1151859 - RNA, 19 nt, Human
gacacaauauucucuuaag

SEQ ID NO: 1151860 - RNA, 20 nt, Human
gagagaaggcugcucuuugu

SEQ ID NO: 1151861 - RNA, 21 nt, Human
gggauuccuuagauaaaaacc

SEQ ID NO: 1151862 - RNA, 20 nt, Human
uaaaaaggacuuggacacaa

SEQ ID NO: 1151863 - RNA, 22 nt, Human
uaaaaaggacuuggacacaaua

SEQ ID NO: 1151864 - RNA, 21 nt, Human
uccuuagauaaaaaccuggau

SEQ ID NO: 1151865 - RNA, 19 nt, Human
uuauaagaaaauaagacac

SEQ ID NO: 1151866 - RNA, 27 nt, Human
aaaaaagagacagaaaaagggggaccc

SEQ ID NO: 1151867 - RNA, 22 nt, Human
aaaccagaaauagaaaagcggg

SEQ ID NO: 1151868 - RNA, 21 nt, Human
aaacuuuacaaagaaaccgac

SEQ ID NO: 1151869 - RNA, 18 nt, Human
aaagaaaccgacacuuga

SEQ ID NO: 1151870 - RNA, 24 nt, Human
aaaguguugggauuacaggcguga

SEQ ID NO: 1151871 - RNA, 20 nt, Human
aacaacgaccagaggggccc

SEQ ID NO: 1151872 - RNA, 21 nt, Human
aacaacgaccagaggggcccc

SEQ ID NO: 1151873 - RNA, 18 nt, Human
aaccgacacuugagcccc

SEQ ID NO: 1151874 - RNA, 21 nt, Human
aaguguugggauuacaggcgu

SEQ ID NO: 1151875 - RNA, 26 nt, Human
aaguguugggauuacaggcgugagcc

SEQ ID NO: 1151876 - RNA, 24 nt, Human
accauguuggccaggcugaucucg

SEQ ID NO: 1151877 - RNA, 18 nt, Human
acgggguuucaccauguu

SEQ ID NO: 1151878 - RNA, 23 nt, Human
acgggguuucaccauguuggcca

SEQ ID NO: 1151879 - RNA, 24 nt, Human
acgggguuucaccauguuggccag

SEQ ID NO: 1151880 - RNA, 23 nt, Human
agcgaugaaacuuuacaaagaaa

SEQ ID NO: 1151881 - RNA, 23 nt, Human
aggaucauugagcccaggaguuc

SEQ ID NO: 1151882 - RNA, 20 nt, Human
aggccgaggcgggaggauca

SEQ ID NO: 1151883 - RNA, 20 nt, Human
aggccgaggcgggaggauca

SEQ ID NO: 1151884 - RNA, 24 nt, Human
aggcgcgguggcucacuccuguaa

SEQ ID NO: 1151885 - RNA, 23 nt, Human
aggcgggaggaucauugagccca

SEQ ID NO: 1151886 - RNA, 19 nt, Human
agggggugggcgcgggggc

SEQ ID NO: 1151887 - RNA, 23 nt, Human
aguagcugggauuacaggcgcgu

SEQ ID NO: 1151888 - RNA, 20 nt, Human
agugcaauggugcaaucucg

SEQ ID NO: 1151889 - RNA, 24 nt, Human
agugcaauggugcaaucucggcuc

SEQ ID NO: 1151890 - RNA, 18 nt, Human
aguguugggauuacaggc

SEQ ID NO: 1151891 - RNA, 24 nt, Human
auuuuuguauuuuuaguagagacg

SEQ ID NO: 1151892 - RNA, 24 nt, Human
caacaacgaccagaggggccccaa

SEQ ID NO: 1151893 - RNA, 22 nt, Human
caagcaauucucuugccucagc

SEQ ID NO: 1151894 - RNA, 28 nt, Human
cacaacaacgaccagaggggccccaaac

SEQ ID NO: 1151895 - RNA, 24 nt, Human
caccaugcccggcuaauuuuugua

SEQ ID NO: 1151896 - RNA, 21 nt, Human
caccauguuggccaggcugau

SEQ ID NO: 1151897 - RNA, 24 nt, Human
caccauguuggccaggcugaucuc

SEQ ID NO: 1151898 - RNA, 27 nt, Human
caccauguuggccaggcugaucucgaa

SEQ ID NO: 1151899 - RNA, 21 nt, Human
cacugcaaccuccgccucccg

SEQ ID NO: 1151900 - RNA, 23 nt, Human
cacugcaaccuccgccucccggg

SEQ ID NO: 1151901 - RNA, 24 nt, Human
cagaacuuuaggaggccgaggcgg

SEQ ID NO: 1151902 - RNA, 20 nt, Human
cagccuccugaguagcuggg

SEQ ID NO: 1151903 - RNA, 24 nt, Human
caucuagagaagguuuucaaccau

SEQ ID NO: 1151904 - RNA, 24 nt, Human
cauguuggccaggcugaucucgaa

SEQ ID NO: 1151905 - RNA, 23 nt, Human
ccaaaaaaagagacagaaaaagg

SEQ ID NO: 1151906 - RNA, 20 nt, Human
cccggguucaagcaauucuc

SEQ ID NO: 1151907 - RNA, 19 nt, Human
ccgacacuugagccccacu

SEQ ID NO: 1151908 - RNA, 21 nt, Human
ccgcagcgagacccugucucc

SEQ ID NO: 1151909 - RNA, 27 nt, Human
ccgccucccggguucaagcaauucuuu

SEQ ID NO: 1151910 - RNA, 24 nt, Human
ccucccggguucaagcaauucucu

SEQ ID NO: 1151911 - RNA, 18 nt, Human
ccugaccucaggugaucc

SEQ ID NO: 1151912 - RNA, 22 nt, Human
ccugaccucaggugauccgucc

SEQ ID NO: 1151913 - RNA, 23 nt, Human
ccugaguagcugggauuacaggc

SEQ ID NO: 1151914 - RNA, 23 nt, Human
ccugaguagcugggauuacaggc

SEQ ID NO: 1151915 - RNA, 20 nt, Human
cgacacaacaacgaccagag

SEQ ID NO: 1151916 - RNA, 21 nt, Human
cgacuguaacgacuccgggaa

SEQ ID NO: 1151917 - RNA, 24 nt, Human
cgagacccugucuccaaaaaaaga

SEQ ID NO: 1151918 - RNA, 19 nt, Human
cgaggcgggaggaucauug

SEQ ID NO: 1151919 - RNA, 24 nt, Human
cgcucugucacccaagcuggagug

SEQ ID NO: 1151920 - RNA, 23 nt, Human
cgggggcggcaguggagcuggag

SEQ ID NO: 1151921 - RNA, 24 nt, Human
cgggguuucaccauguuggccagg

SEQ ID NO: 1151922 - RNA, 24 nt, Human
cucacuccuguaaucccagaacuu

SEQ ID NO: 1151923 - RNA, 24 nt, Human
cucacugcaaccuccgccucccgg

SEQ ID NO: 1151924 - RNA, 24 nt, Human
cucagccuccugaguagcugggau

SEQ ID NO: 1151925 - RNA, 24 nt, Human
cucccacaguaaagaguacacaaa

SEQ ID NO: 1151926 - RNA, 26 nt, Human
cuccugaccucaggugauccguccgc

SEQ ID NO: 1151927 - RNA, 24 nt, Human
cucgcucugucacccaagcuggag

SEQ ID NO: 1151928 - RNA, 22 nt, Human
cugaguagcugggauuacaggc

SEQ ID NO: 1151929 - RNA, 23 nt, Human
cugcaaccuccgccucccggguu

SEQ ID NO: 1151930 - RNA, 23 nt, Human
cuugccucagccuccugaguagc

SEQ ID NO: 1151931 - RNA, 21 nt, Human
cuuuacaaagaaaccgacacu

SEQ ID NO: 1151932 - RNA, 22 nt, Human
cuuuccggcuaauuucuucuag

SEQ ID NO: 1151933 - RNA, 24 nt, Human
gaaaaguguugggauuacaggcgu

SEQ ID NO: 1151934 - RNA, 21 nt, Human
gacacaacaacgaccagaggg

SEQ ID NO: 1151935 - RNA, 22 nt, Human
gaccucaggugauccguccgcc

SEQ ID NO: 1151936 - RNA, 24 nt, Human
gagacgggguuucaccauguuggc

SEQ ID NO: 1151937 - RNA, 21 nt, Human
gaggaucauugagcccaggag

SEQ ID NO: 1151938 - RNA, 21 nt, Human
gaguaccagcaggacugggca

SEQ ID NO: 1151939 - RNA, 26 nt, Human
gaguagcugggauuacaggcgcgugc

SEQ ID NO: 1151940 - RNA, 18 nt, Human
gauuacaggcgcgugcca

SEQ ID NO: 1151941 - RNA, 18 nt, Human
gauuacaggcgugagcca

SEQ ID NO: 1151942 - RNA, 21 nt, Human
gauuacaggcgugagccacca

SEQ ID NO: 1151943 - RNA, 22 nt, Human
gauuacaggcgugagccaccac

SEQ ID NO: 1151944 - RNA, 22 nt, Human
gcaaccuccgccucccggguuc

SEQ ID NO: 1151945 - RNA, 24 nt, Human
gccaccgcagcgagacccugucuc

SEQ ID NO: 1151946 - RNA, 22 nt, Human
gcccggcuaauuuuuguauuuu

SEQ ID NO: 1151947 - RNA, 19 nt, Human
gcggcaguggagcuggaga

SEQ ID NO: 1151948 - RNA, 27 nt, Human
gcucugucacccaagcuggagugcaau

SEQ ID NO: 1151949 - RNA, 23 nt, Human
gcugaucucgaacuccugaccuc

SEQ ID NO: 1151950 - RNA, 30 nt, Human
gcuggagugcaauggugcaaucucggcucc

SEQ ID NO: 1151951 - RNA, 22 nt, Human
ggaguuccagguugcagugagc

SEQ ID NO: 1151952 - RNA, 19 nt, Human
ggauuacaggcgugagcca

SEQ ID NO: 1151953 - RNA, 19 nt, Human
ggcggcaguggagcuggag

SEQ ID NO: 1151954 - RNA, 21 nt, Human
ggcucacuccuguaaucccag

SEQ ID NO: 1151955 - RNA, 20 nt, Human
ggggaggggggugaaacucc

SEQ ID NO: 1151956 - RNA, 23 nt, Human
ggggugggcgcgggggcggcagu

SEQ ID NO: 1151957 - RNA, 23 nt, Human
gggguuucaccauguuggccagg

SEQ ID NO: 1151958 - RNA, 23 nt, Human
gguggcucacuccuguaauccca

SEQ ID NO: 1151959 - RNA, 24 nt, Human
gguggcucacuccuguaaucccag

SEQ ID NO: 1151960 - RNA, 23 nt, Human
guagagacgggguuucaccaugu

SEQ ID NO: 1151961 - RNA, 20 nt, Human
gucaccagccuucugagggg

SEQ ID NO: 1151962 - RNA, 24 nt, Human
guugcagugagccgcgaucgugcc

SEQ ID NO: 1151963 - RNA, 18 nt, Human
uaaagaguacacaaacga

SEQ ID NO: 1151964 - RNA, 24 nt, Human
uaauuuuuguauuuuuaguagaga

SEQ ID NO: 1151965 - RNA, 27 nt, Human
uacaaagaaaccgacacuugagcccca

SEQ ID NO: 1151966 - RNA, 23 nt, Human
uacacaaacgacacaacaacgac

SEQ ID NO: 1151967 - RNA, 23 nt, Human
uacaggcgugagccaccacgccc

SEQ ID NO: 1151968 - RNA, 22 nt, Human
uagagacgggguuucaccaugu

SEQ ID NO: 1151969 - RNA, 24 nt, Human
uaggaggccgaggcgggaggauca

SEQ ID NO: 1151970 - RNA, 24 nt, Human
uaguagagacgggguuucaccaug

SEQ ID NO: 1151971 - RNA, 26 nt, Human
uaguagagacgggguuucaccauguu

SEQ ID NO: 1151972 - RNA, 21 nt, Human
ucaacagaugucaccagccuu

SEQ ID NO: 1151973 - RNA, 21 nt, Human
ucaccagccuucugagggggu

SEQ ID NO: 1151974 - RNA, 22 nt, Human
ucaccccgacuguaacgacucc

SEQ ID NO: 1151975 - RNA, 23 nt, Human
ucacugcaaccuccgccucccgg

SEQ ID NO: 1151976 - RNA, 24 nt, Human
ucacugcaaccuccgccucccggg

SEQ ID NO: 1151977 - RNA, 25 nt, Human
ucacugcaaccuccgccucccgggu

SEQ ID NO: 1151978 - RNA, 26 nt, Human
ucacugcaaccuccgccucccggguu

SEQ ID NO: 1151979 - RNA, 20 nt, Human
ucagccuccugaguagcugg

SEQ ID NO: 1151980 - RNA, 21 nt, Human
ucccggguucaagcaauucuc

SEQ ID NO: 1151981 - RNA, 21 nt, Human
ucccggguucaagcaauucuc

SEQ ID NO: 1151982 - RNA, 24 nt, Human
ucccggguucaagcaauucucuug

SEQ ID NO: 1151983 - RNA, 24 nt, Human
uccgccucccggguucaagcaauu

SEQ ID NO: 1151984 - RNA, 24 nt, Human
uccugaguagcugggauuacaggc

SEQ ID NO: 1151985 - RNA, 24 nt, Human
ucgaaaaguguugggauuacaggc

SEQ ID NO: 1151986 - RNA, 23 nt, Human
ucucgaacuccugaccucaggug

SEQ ID NO: 1151987 - RNA, 24 nt, Human
ucucgcucugucacccaagcugga

SEQ ID NO: 1151988 - RNA, 26 nt, Human
ucucgcucugucacccaagcuggagu

SEQ ID NO: 1151989 - RNA, 27 nt, Human
ucucgcucugucacccaagcuggagug

SEQ ID NO: 1151990 - RNA, 24 nt, Human
ucugucacccaagcuggagugcaa

SEQ ID NO: 1151991 - RNA, 23 nt, Human
ucuucuaggugccucaaugaaua

SEQ ID NO: 1151992 - RNA, 19 nt, Human
ugaccucaggugauccguc

SEQ ID NO: 1151993 - RNA, 24 nt, Human
ugaccucaggugauccguccgccu

SEQ ID NO: 1151994 - RNA, 22 nt, Human
ugagccgcgaucgugccaccgc

SEQ ID NO: 1151995 - RNA, 19 nt, Human
ugagggggugggcgcgggg

SEQ ID NO: 1151996 - RNA, 22 nt, Human
ugauacggagucucgcucuguc

SEQ ID NO: 1151997 - RNA, 22 nt, Human
ugcagugagccgcgaucgugcc

SEQ ID NO: 1151998 - RNA, 24 nt, Human
ugcccggcuaauuuuuguauuuuu

SEQ ID NO: 1151999 - RNA, 21 nt, Human
ugccuauaagucucucccaca

SEQ ID NO: 1152000 - RNA, 22 nt, Human
ugccucagccuccugaguagcu

SEQ ID NO: 1152001 - RNA, 24 nt, Human
ugccucagccuccugaguagcugg

SEQ ID NO: 1152002 - RNA, 20 nt, Human
ugcugaguugcuucaacaga

SEQ ID NO: 1152003 - RNA, 23 nt, Human
uggagugcaauggugcaaucucg

SEQ ID NO: 1152004 - RNA, 24 nt, Human
uggagugcaauggugcaaucucgg

SEQ ID NO: 1152005 - RNA, 24 nt, Human
uggccaggcugaucucgaacuccu

SEQ ID NO: 1152006 - RNA, 21 nt, Human
uggcucacuccuguaauccca

SEQ ID NO: 1152007 - RNA, 22 nt, Human
uggcucacuccuguaaucccag

SEQ ID NO: 1152008 - RNA, 21 nt, Human
ugggauuacaggcgcgugcca

SEQ ID NO: 1152009 - RNA, 22 nt, Human
ugggauuacaggcgcgugccac

SEQ ID NO: 1152010 - RNA, 24 nt, Human
ugggauuacaggcgcgugccacca

SEQ ID NO: 1152011 - RNA, 25 nt, Human
ugggauuacaggcgcgugccaccau

SEQ ID NO: 1152012 - RNA, 18 nt, Human
ugggauuacaggcgugag

SEQ ID NO: 1152013 - RNA, 19 nt, Human
ugggauuacaggcgugagc

SEQ ID NO: 1152014 - RNA, 22 nt, Human
ugggauuacaggcgugagccac

SEQ ID NO: 1152015 - RNA, 23 nt, Human
ugggauuacaggcgugagccacc

SEQ ID NO: 1152016 - RNA, 24 nt, Human
ugggauuacaggcgugagccacca

SEQ ID NO: 1152017 - RNA, 21 nt, Human
uguauuuuuaguagagacggg

SEQ ID NO: 1152018 - RNA, 19 nt, Human
ugucaagaccauuaaaaug

SEQ ID NO: 1152019 - RNA, 20 nt, Human
ugucacccaagcuggagugc

SEQ ID NO: 1152020 - RNA, 18 nt, Human
uuaguagagacgggguuu

SEQ ID NO: 1152021 - RNA, 22 nt, Human
uuaguagagacgggguuucacc

SEQ ID NO: 1152022 - RNA, 24 nt, Human
uuaguagagacgggguuucaccau

SEQ ID NO: 1152023 - RNA, 19 nt, Human
uucaccccgacuguaacga

SEQ ID NO: 1152024 - RNA, 22 nt, Human
uugcagugagccgcgaucgugc

SEQ ID NO: 1152025 - RNA, 24 nt, Human
uugcugaguugcuucaacagaugu

SEQ ID NO: 1152026 - RNA, 22 nt, Human
uuggagacccacuuaaaauuuu

SEQ ID NO: 1152027 - RNA, 21 nt, Human
uuucaccauguuggccaggcu

SEQ ID NO: 1152028 - RNA, 24 nt, Human
uuuuuaguagagacgggguuucac

SEQ ID NO: 1152029 - RNA, 20 nt, Human
uuuuuguauuuuuaguagag

SEQ ID NO: 1152030 - RNA, 25 nt, Human
uuuuuuuuuuuugauacggagucuc

SEQ ID NO: 1152031 - RNA, 21 nt, Human
uuuuuuuuuuuuugauacgga

SEQ ID NO: 1152032 - RNA, 18 nt, Human
aaaaagaaggccaagagg

SEQ ID NO: 1152033 - RNA, 19 nt, Human
aaaaagaggucuggcugcc

SEQ ID NO: 1152034 - RNA, 24 nt, Human
aaaacuuaucacaaugcaaguucc

SEQ ID NO: 1152035 - RNA, 22 nt, Human
aaacaaaaauucaaaggguguc

SEQ ID NO: 1152036 - RNA, 19 nt, Human
aaaccccugcugcaaggau

SEQ ID NO: 1152037 - RNA, 20 nt, Human
aaagaggucuggcugccuuu

SEQ ID NO: 1152038 - RNA, 18 nt, Human
aaggaugacaagaagaga

SEQ ID NO: 1152039 - RNA, 21 nt, Human
acugagaugggaggaugggag

SEQ ID NO: 1152040 - RNA, 19 nt, Human
agacaaaaaucagggaacc

SEQ ID NO: 1152041 - RNA, 25 nt, Human
agacaaaaaucagggaaccaacaac

SEQ ID NO: 1152042 - RNA, 20 nt, Human
agcaguccuugcuguguaau

SEQ ID NO: 1152043 - RNA, 20 nt, Human
agcuaccaagccaacuagcc

SEQ ID NO: 1152044 - RNA, 19 nt, Human
aggaauccuccaauuugcc

SEQ ID NO: 1152045 - RNA, 20 nt, Human
aggagugaucagaaccaaug

SEQ ID NO: 1152046 - RNA, 18 nt, Human
agggaugggugaggggaa

SEQ ID NO: 1152047 - RNA, 19 nt, Human
auguaugaucacccagcaa

SEQ ID NO: 1152048 - RNA, 23 nt, Human
caacaugcugagucuuuuccaca

SEQ ID NO: 1152049 - RNA, 20 nt, Human
caagacaaaaaucagggaac

SEQ ID NO: 1152050 - RNA, 19 nt, Human
caaguggcucagacaugcc

SEQ ID NO: 1152051 - RNA, 18 nt, Human
cacagccaaucacuuuaa

SEQ ID NO: 1152052 - RNA, 19 nt, Human
cacagccaaucacuuuaaa

SEQ ID NO: 1152053 - RNA, 21 nt, Human
cacucccaccauccccaaaaa

SEQ ID NO: 1152054 - RNA, 26 nt, Human
cagagauacugaaacuggucuggcca

SEQ ID NO: 1152055 - RNA, 23 nt, Human
ccaccuccugaaggaaccaucua

SEQ ID NO: 1152056 - RNA, 19 nt, Human
ccagaugugucugcacucu

SEQ ID NO: 1152057 - RNA, 19 nt, Human
ccaucuaaaccccugcugc

SEQ ID NO: 1152058 - RNA, 27 nt, Human
cccacacacagcaguccuugcugugua

SEQ ID NO: 1152059 - RNA, 24 nt, Human
ccccaaaaaagaaggccaagagga

SEQ ID NO: 1152060 - RNA, 26 nt, Human
ccccugagaagggaacugaguuucua

SEQ ID NO: 1152061 - RNA, 21 nt, Human
cccugcugcaaggauuuccug

SEQ ID NO: 1152062 - RNA, 22 nt, Human
ccucacuguccucggcuaccug

SEQ ID NO: 1152063 - RNA, 26 nt, Human
ccucagaggccaaggggcuggggaga

SEQ ID NO: 1152064 - RNA, 27 nt, Human
ccugaucugugugggugccgggcggcc

SEQ ID NO: 1152065 - RNA, 24 nt, Human
cgccauggaaccacugagauggga

SEQ ID NO: 1152066 - RNA, 21 nt, Human
cuaaaccccugcugcaaggau

SEQ ID NO: 1152067 - RNA, 23 nt, Human
cuaccugcaagcaaggggacagg

SEQ ID NO: 1152068 - RNA, 21 nt, Human
cugaagccaggagggccaucc

SEQ ID NO: 1152069 - RNA, 20 nt, Human
cugagaugggaggaugggag

SEQ ID NO: 1152070 - RNA, 20 nt, Human
cugagcccauaacagauggg

SEQ ID NO: 1152071 - RNA, 24 nt, Human
cugcaagcaaggggacagggaugg

SEQ ID NO: 1152072 - RNA, 20 nt, Human
cugcucaagacaaaaaucag

SEQ ID NO: 1152073 - RNA, 19 nt, Human
cuggcccuugugcaguagg

SEQ ID NO: 1152074 - RNA, 23 nt, Human
cuuaacucugugccaauucuacc

SEQ ID NO: 1152075 - RNA, 18 nt, Human
cuuuggggagagggacug

SEQ ID NO: 1152076 - RNA, 19 nt, Human
gacaagaagagagcagcga

SEQ ID NO: 1152077 - RNA, 19 nt, Human
gagaugcaggcuggccuuc

SEQ ID NO: 1152078 - RNA, 21 nt, Human
gagaugggaggaugggaggaa

SEQ ID NO: 1152079 - RNA, 18 nt, Human
gcaaggggacagggaugg

SEQ ID NO: 1152080 - RNA, 20 nt, Human
gcaggagaaacaagaauauu

SEQ ID NO: 1152081 - RNA, 22 nt, Human
gccaaccagacaggggucugga

SEQ ID NO: 1152082 - RNA, 23 nt, Human
gccaaggggcuggggagaaccca

SEQ ID NO: 1152083 - RNA, 20 nt, Human
gcugaagccaggagggccag

SEQ ID NO: 1152084 - RNA, 21 nt, Human
ggaaacugcugccaacagcua

SEQ ID NO: 1152085 - RNA, 19 nt, Human
ggaauccuccaauuugccc

SEQ ID NO: 1152086 - RNA, 18 nt, Human
ggagaacccaaacucaaa

SEQ ID NO: 1152087 - RNA, 19 nt, Human
ggaugggaggaagccaccc

SEQ ID NO: 1152088 - RNA, 19 nt, Human
ggcuggggagaacccaaac

SEQ ID NO: 1152089 - RNA, 24 nt, Human
gggaugggugaggggaaagugagg

SEQ ID NO: 1152090 - RNA, 19 nt, Human
gggcagcaauggaugaaaa

SEQ ID NO: 1152091 - RNA, 27 nt, Human
ggggagaggcaguucggaaacgagugu

SEQ ID NO: 1152092 - RNA, 20 nt, Human
ggggucuggaguccaaggag

SEQ ID NO: 1152093 - RNA, 24 nt, Human
uaacagauggaauugccacccucu

SEQ ID NO: 1152094 - RNA, 24 nt, Human
uaacccaucuggauucagcaaaga

SEQ ID NO: 1152095 - RNA, 19 nt, Human
uaaggccaugucaaaccaa

SEQ ID NO: 1152096 - RNA, 19 nt, Human
uaauaaauauggagucaca

SEQ ID NO: 1152097 - RNA, 23 nt, Human
uagcaaggaggccucugaccaag

SEQ ID NO: 1152098 - RNA, 20 nt, Human
uagugccaagaaaauaaaaa

SEQ ID NO: 1152099 - RNA, 23 nt, Human
uaugcugggaagaaccuaguguc

SEQ ID NO: 1152100 - RNA, 21 nt, Human
uauuauggaaccuuaacucug

SEQ ID NO: 1152101 - RNA, 18 nt, Human
ucaaaccaaaugcuaucu

SEQ ID NO: 1152102 - RNA, 18 nt, Human
ucacacaacugcagccau

SEQ ID NO: 1152103 - RNA, 18 nt, Human
ucagcaaagaugcaaugc

SEQ ID NO: 1152104 - RNA, 27 nt, Human
ucagccucagaggccaaggggcugggg

SEQ ID NO: 1152105 - RNA, 24 nt, Human
ucagcugccccucaaguggcucag

SEQ ID NO: 1152106 - RNA, 21 nt, Human
ucccaccuccugaaggaacca

SEQ ID NO: 1152107 - RNA, 21 nt, Human
ucuuuggggagaggcaguucg

SEQ ID NO: 1152108 - RNA, 28 nt, Human
ucuuuggggagagggacugacguaaacg

SEQ ID NO: 1152109 - RNA, 18 nt, Human
ugaccaagggaaacugcu

SEQ ID NO: 1152110 - RNA, 24 nt, Human
ugagaugggaggaugggaggaagc

SEQ ID NO: 1152111 - RNA, 26 nt, Human
ugagaugggaggaugggaggaagcca

SEQ ID NO: 1152112 - RNA, 19 nt, Human
ugaugcagacguugcaccc

SEQ ID NO: 1152113 - RNA, 22 nt, Human
ugcagaacaggagcuuuguuga

SEQ ID NO: 1152114 - RNA, 19 nt, Human
ugccaugacaucuucuuca

SEQ ID NO: 1152115 - RNA, 21 nt, Human
ugcuaggaaaggcaggacuca

SEQ ID NO: 1152116 - RNA, 21 nt, Human
ugcuuuuuccaucuuacacuc

SEQ ID NO: 1152117 - RNA, 20 nt, Human
uggaaacuucacugguucug

SEQ ID NO: 1152118 - RNA, 18 nt, Human
uggaacaccuaaauaguu

SEQ ID NO: 1152119 - RNA, 18 nt, Human
uggaggcuucccaccucc

SEQ ID NO: 1152120 - RNA, 22 nt, Human
uggcuagccaccaggaugaugc

SEQ ID NO: 1152121 - RNA, 23 nt, Human
uggcugccuuuccacaccccagg

SEQ ID NO: 1152122 - RNA, 24 nt, Human
ugggagugccaaccagacaggggu

SEQ ID NO: 1152123 - RNA, 18 nt, Human
ugugaaggaaugaggcug

SEQ ID NO: 1152124 - RNA, 20 nt, Human
ugugaaggaaugaggcugcu

SEQ ID NO: 1152125 - RNA, 22 nt, Human
ugugaaggaaugaggcugcucu

SEQ ID NO: 1152126 - RNA, 21 nt, Human
uguugugugcaugcuaggaaa

SEQ ID NO: 1152127 - RNA, 22 nt, Human
uguugugugcaugcuaggaaag

SEQ ID NO: 1152128 - RNA, 18 nt, Human
uguuugcuuuuuccaucu

SEQ ID NO: 1152129 - RNA, 18 nt, Human
uucacccccuucacuccc

SEQ ID NO: 1152130 - RNA, 20 nt, Human
uucagcaaagaugcaaugcu

SEQ ID NO: 1152131 - RNA, 21 nt, Human
uuccugaugaaaccacacacu

SEQ ID NO: 1152132 - RNA, 22 nt, Human
uugaauuuccaaaacuuaucac

SEQ ID NO: 1152133 - RNA, 20 nt, Human
uugagagcaggagaaacaag

SEQ ID NO: 1152134 - RNA, 19 nt, Human
aaaaggcaagaaggagagu

SEQ ID NO: 1152135 - RNA, 18 nt, Human
aaagaaauagaaaaaguc

SEQ ID NO: 1152136 - RNA, 24 nt, Human
aaagugcugggauuacagguguga

SEQ ID NO: 1152137 - RNA, 18 nt, Human
aagugcugggauuacagg

SEQ ID NO: 1152138 - RNA, 19 nt, Human
aagugcugggauuacaggu

SEQ ID NO: 1152139 - RNA, 26 nt, Human
aagugcugggauuacaggugugagcc

SEQ ID NO: 1152140 - RNA, 23 nt, Human
aauaaauggaacaccaaaagaaa

SEQ ID NO: 1152141 - RNA, 23 nt, Human
acacacaugcacgcgcauacaca

SEQ ID NO: 1152142 - RNA, 27 nt, Human
acacacaugcacgcgcauacacacaca

SEQ ID NO: 1152143 - RNA, 24 nt, Human
acacacaugcacgcgcauacacag

SEQ ID NO: 1152144 - RNA, 18 nt, Human
accucgugauccaccagc

SEQ ID NO: 1152145 - RNA, 18 nt, Human
acgagguuucacuguguu

SEQ ID NO: 1152146 - RNA, 20 nt, Human
acgagguuucacuguguuag

SEQ ID NO: 1152147 - RNA, 23 nt, Human
aggaauucaauacaaaugaaugu

SEQ ID NO: 1152148 - RNA, 24 nt, Human
aggagcuugaagaccgaaugauag

SEQ ID NO: 1152149 - RNA, 23 nt, Human
aggcaagaaggagagucaccuag

SEQ ID NO: 1152150 - RNA, 19 nt, Human
aguagagacgagguuucac

SEQ ID NO: 1152151 - RNA, 24 nt, Human
agugaaaagaaauagaaaaagucu

SEQ ID NO: 1152152 - RNA, 19 nt, Human
aguggaauuuggggcuggg

SEQ ID NO: 1152153 - RNA, 24 nt, Human
aguggcucacaccuguaaucccag

SEQ ID NO: 1152154 - RNA, 21 nt, Human
augagauagcaggaaguaaag

SEQ ID NO: 1152155 - RNA, 23 nt, Human
auggaacaccaaaagaaaaauca

SEQ ID NO: 1152156 - RNA, 24 nt, Human
caaagugcugggauuacaggugug

SEQ ID NO: 1152157 - RNA, 24 nt, Human
caacaagauuucuuugaaaacuaa

SEQ ID NO: 1152158 - RNA, 21 nt, Human
caagaccuggaccuggcacua

SEQ ID NO: 1152159 - RNA, 22 nt, Human
caagcucuuuucugugccccag

SEQ ID NO: 1152160 - RNA, 24 nt, Human
cacacaugcacgcgcauacacaca

SEQ ID NO: 1152161 - RNA, 26 nt, Human
cacaccuguaaucccagcacuuucuu

SEQ ID NO: 1152162 - RNA, 21 nt, Human
cacacuccuccagccacacug

SEQ ID NO: 1152163 - RNA, 25 nt, Human
caccaaaagaaaaaucaguaguuca

SEQ ID NO: 1152164 - RNA, 21 nt, Human
caccgugccggcccaugcagc

SEQ ID NO: 1152165 - RNA, 18 nt, Human
caccuguaaucccagcac

SEQ ID NO: 1152166 - RNA, 19 nt, Human
caccuguaaucccagcacu

SEQ ID NO: 1152167 - RNA, 21 nt, Human
cacuggauuuucuucuugcuc

SEQ ID NO: 1152168 - RNA, 22 nt, Human
cacuggauuuucuucuugcucu

SEQ ID NO: 1152169 - RNA, 21 nt, Human
cacuguguuagccaggagggu

SEQ ID NO: 1152170 - RNA, 24 nt, Human
cacuguguuagccaggagggucuc

SEQ ID NO: 1152171 - RNA, 18 nt, Human
cagcaguucuaacagccu

SEQ ID NO: 1152172 - RNA, 20 nt, Human
caggaguuguagaccagcuu

SEQ ID NO: 1152173 - RNA, 21 nt, Human
cagugcuuguuuugcaccauc

SEQ ID NO: 1152174 - RNA, 19 nt, Human
cauagcaggacccugucuc

SEQ ID NO: 1152175 - RNA, 21 nt, Human
ccaaagugcugggauuacagg

SEQ ID NO: 1152176 - RNA, 21 nt, Human
ccaaagugcugggauuacagg

SEQ ID NO: 1152177 - RNA, 24 nt, Human
ccaaagugcugggauuacaggugu

SEQ ID NO: 1152178 - RNA, 18 nt, Human
ccacauuucuacccacuc

SEQ ID NO: 1152179 - RNA, 18 nt, Human
ccccaucuauucucuaca

SEQ ID NO: 1152180 - RNA, 22 nt, Human
cccugcuuaaaagccucuauug

SEQ ID NO: 1152181 - RNA, 25 nt, Human
ccuggcacuagccccaaucacugac

SEQ ID NO: 1152182 - RNA, 24 nt, Human
cgagguuucacuguguuagccagg

SEQ ID NO: 1152183 - RNA, 21 nt, Human
cgcauacacacacacagcgua

SEQ ID NO: 1152184 - RNA, 29 nt, Human
cgcauacacacacacagcguacuguccua

SEQ ID NO: 1152185 - RNA, 23 nt, Human
cgcgcauacacacacacagcgua

SEQ ID NO: 1152186 - RNA, 23 nt, Human
cuaauccuaacugacacacaugc

SEQ ID NO: 1152187 - RNA, 24 nt, Human
cucacaccuguaaucccagcacuu

SEQ ID NO: 1152188 - RNA, 25 nt, Human
cucacaccuguaaucccagcacuuu

SEQ ID NO: 1152189 - RNA, 28 nt, Human
cuugaccucgugauccaccagccuuggc

SEQ ID NO: 1152190 - RNA, 19 nt, Human
cuuucuuuggaaggucaag

SEQ ID NO: 1152191 - RNA, 25 nt, Human
gaaauaaacuucuauuuuguguaaa

SEQ ID NO: 1152192 - RNA, 20 nt, Human
gaccucgugauccaccagcc

SEQ ID NO: 1152193 - RNA, 21 nt, Human
gaccucgugauccaccagccu

SEQ ID NO: 1152194 - RNA, 24 nt, Human
gaccucgugauccaccagccuugg

SEQ ID NO: 1152195 - RNA, 18 nt, Human
gaccuggcacuagcccca

SEQ ID NO: 1152196 - RNA, 18 nt, Human
gagccaccgugccggccc

SEQ ID NO: 1152197 - RNA, 18 nt, Human
gauuacaggugugagcca

SEQ ID NO: 1152198 - RNA, 21 nt, Human
gauuacaggugugagccaccg

SEQ ID NO: 1152199 - RNA, 24 nt, Human
gauuacaggugugagccaccgugc

SEQ ID NO: 1152200 - RNA, 22 nt, Human
gcccuuaucugcaacacacaca

SEQ ID NO: 1152201 - RNA, 22 nt, Human
gccuuggccucccaaagugcug

SEQ ID NO: 1152202 - RNA, 19 nt, Human
gcugggugcaguggcucac

SEQ ID NO: 1152203 - RNA, 21 nt, Human
ggagacccaccaagaccugga

SEQ ID NO: 1152204 - RNA, 24 nt, Human
ggaggcuagacacagugaaaagaa

SEQ ID NO: 1152205 - RNA, 18 nt, Human
ggggcugggugcaguggc

SEQ ID NO: 1152206 - RNA, 21 nt, Human
ggggcugggugcaguggcuca

SEQ ID NO: 1152207 - RNA, 23 nt, Human
ggugcaguggcucacaccuguaa

SEQ ID NO: 1152208 - RNA, 24 nt, Human
gugauccaccagccuuggccuccc

SEQ ID NO: 1152209 - RNA, 18 nt, Human
gugcaguggcucacaccu

SEQ ID NO: 1152210 - RNA, 23 nt, Human
uaaaaagcucacagaugaugcuc

SEQ ID NO: 1152211 - RNA, 23 nt, Human
uaaacaggccauccuuaucucag

SEQ ID NO: 1152212 - RNA, 19 nt, Human
uaaagcagccauccuggac

SEQ ID NO: 1152213 - RNA, 22 nt, Human
uaacagccuuucugaaaggucu

SEQ ID NO: 1152214 - RNA, 22 nt, Human
uacagaaucaauagaaagauaa

SEQ ID NO: 1152215 - RNA, 22 nt, Human
uacaggugugagccaccgugcc

SEQ ID NO: 1152216 - RNA, 22 nt, Human
uagaaagauaaauaaauggaac

SEQ ID NO: 1152217 - RNA, 20 nt, Human
uaguagagacgagguuucac

SEQ ID NO: 1152218 - RNA, 24 nt, Human
uaguagagacgagguuucacugug

SEQ ID NO: 1152219 - RNA, 25 nt, Human
uaucugcaacacacacaugcacgcg

SEQ ID NO: 1152220 - RNA, 27 nt, Human
uaucugcaacacacacaugcacgcgca

SEQ ID NO: 1152221 - RNA, 24 nt, Human
ucacuguguuagccaggagggucu

SEQ ID NO: 1152222 - RNA, 23 nt, Human
ucagcccaggaguuguagaccag

SEQ ID NO: 1152223 - RNA, 18 nt, Human
uccaaccagaaguggaau

SEQ ID NO: 1152224 - RNA, 23 nt, Human
ucccaaagugcugggauuacagg

SEQ ID NO: 1152225 - RNA, 19 nt, Human
ugacacacaugccaacagc

SEQ ID NO: 1152226 - RNA, 24 nt, Human
ugacaugagagagaaauaaacuuc

SEQ ID NO: 1152227 - RNA, 21 nt, Human
ugaggucagcuucagaaugga

SEQ ID NO: 1152228 - RNA, 19 nt, Human
ugaguaaaaggcaagaagg

SEQ ID NO: 1152229 - RNA, 22 nt, Human
ugauccaccagccuuggccucc

SEQ ID NO: 1152230 - RNA, 19 nt, Human
ugccaacagcauucagaaa

SEQ ID NO: 1152231 - RNA, 23 nt, Human
ugccggcccaugcagcaguucua

SEQ ID NO: 1152232 - RNA, 20 nt, Human
ugccuuguccacacuccucc

SEQ ID NO: 1152233 - RNA, 23 nt, Human
ugccuuguccacacuccuccagc

SEQ ID NO: 1152234 - RNA, 25 nt, Human
ugccuuguccacacuccuccagcca

SEQ ID NO: 1152235 - RNA, 24 nt, Human
ugcugggauuacaggugugagcca

SEQ ID NO: 1152236 - RNA, 28 nt, Human
uggaacaccaaaagaaaaagggaggccu

SEQ ID NO: 1152237 - RNA, 22 nt, Human
uggaacaccaaaagaaaaauca

SEQ ID NO: 1152238 - RNA, 20 nt, Human
uggaauuuggggcugggugc

SEQ ID NO: 1152239 - RNA, 24 nt, Human
uggaauuuggggcugggugcagug

SEQ ID NO: 1152240 - RNA, 21 nt, Human
uggcucacaccuguaauccca

SEQ ID NO: 1152241 - RNA, 24 nt, Human
uggcucacaccuguaaucccagca

SEQ ID NO: 1152242 - RNA, 18 nt, Human
ugggauuacaggugugag

SEQ ID NO: 1152243 - RNA, 21 nt, Human
ugggauuacaggugugagcca

SEQ ID NO: 1152244 - RNA, 22 nt, Human
ugggauuacaggugugagccac

SEQ ID NO: 1152245 - RNA, 23 nt, Human
ugggauuacaggugugagccacc

SEQ ID NO: 1152246 - RNA, 23 nt, Human
ugggauuacaggugugagccacc

SEQ ID NO: 1152247 - RNA, 24 nt, Human
ugggauuacaggugugagccaccg

SEQ ID NO: 1152248 - RNA, 19 nt, Human
uggggcugggugcaguggc

SEQ ID NO: 1152249 - RNA, 20 nt, Human
uggggcugggugcaguggcu

SEQ ID NO: 1152250 - RNA, 22 nt, Human
ugucaaacuuauaccauccuua

SEQ ID NO: 1152251 - RNA, 19 nt, Human
uguuuugcaccaucucuuc

SEQ ID NO: 1152252 - RNA, 22 nt, Human
uuagggaaauaaacaaacaaau

SEQ ID NO: 1152253 - RNA, 21 nt, Human
uuaguagagacgagguuucac

SEQ ID NO: 1152254 - RNA, 24 nt, Human
uuaguagagacgagguuucacugu

SEQ ID NO: 1152255 - RNA, 23 nt, Human
uucacuguguuagccaggagggu

SEQ ID NO: 1152256 - RNA, 24 nt, Human
uucagcugcugaguaaaaggcaag

SEQ ID NO: 1152257 - RNA, 21 nt, Human
uucucaaacuggggauucuau

SEQ ID NO: 1152258 - RNA, 18 nt, Human
uuggccucccaaagugcu

SEQ ID NO: 1152259 - RNA, 19 nt, Human
uuucacuguguuagccagg

SEQ ID NO: 1152260 - RNA, 24 nt, Human
uuuuuaguagagacgagguuucac

SEQ ID NO: 1152261 - RNA, 23 nt, Human
aaaaacguguguaucaaguauga

SEQ ID NO: 1152262 - RNA, 23 nt, Human
aacacggcagaaagguggcaccu

SEQ ID NO: 1152263 - RNA, 24 nt, Human
aaccaauucauucaccaggcggca

SEQ ID NO: 1152264 - RNA, 23 nt, Human
aagaacagaagaagacaggaagc

SEQ ID NO: 1152265 - RNA, 22 nt, Human
aagacaggaagcguuucugagc

SEQ ID NO: 1152266 - RNA, 21 nt, Human
aagugcccucuaauaagacau

SEQ ID NO: 1152267 - RNA, 20 nt, Human
agaacaguaauacucuagca

SEQ ID NO: 1152268 - RNA, 19 nt, Human
agacaugaaaauucuggcu

SEQ ID NO: 1152269 - RNA, 20 nt, Human
agagaagaaaucagggccaa

SEQ ID NO: 1152270 - RNA, 19 nt, Human
agggaagucacagaacagu

SEQ ID NO: 1152271 - RNA, 21 nt, Human
caggcuaaggaguacugcaga

SEQ ID NO: 1152272 - RNA, 24 nt, Human
caggcuaaggaguacugcagaggu

SEQ ID NO: 1152273 - RNA, 21 nt, Human
cccccaacguggacacacucg

SEQ ID NO: 1152274 - RNA, 22 nt, Human
cccgcugcagcugucacauccc

SEQ ID NO: 1152275 - RNA, 21 nt, Human
ccgaaaauagcaauuucuuug

SEQ ID NO: 1152276 - RNA, 21 nt, Human
cggcagaaagguggcaccugg

SEQ ID NO: 1152277 - RNA, 26 nt, Human
cggcagaaagguggcaccuggagacc

SEQ ID NO: 1152278 - RNA, 21 nt, Human
cggucacagaaccaauucauu

SEQ ID NO: 1152279 - RNA, 19 nt, Human
cugcagcugucacaucccu

SEQ ID NO: 1152280 - RNA, 24 nt, Human
cugcagcugucacaucccugggcu

SEQ ID NO: 1152281 - RNA, 20 nt, Human
gcagcaggugcuuuuuucaa

SEQ ID NO: 1152282 - RNA, 20 nt, Human
gcugcagcugucacaucccu

SEQ ID NO: 1152283 - RNA, 21 nt, Human
gcuuauggugcagcaggugcu

SEQ ID NO: 1152284 - RNA, 19 nt, Human
ggaaccacaaagugcccuc

SEQ ID NO: 1152285 - RNA, 19 nt, Human
ggcgugaagaacagaagaa

SEQ ID NO: 1152286 - RNA, 18 nt, Human
ggugcuuuuuucaagaca

SEQ ID NO: 1152287 - RNA, 20 nt, Human
gucacagggaagucacagaa

SEQ ID NO: 1152288 - RNA, 23 nt, Human
gugaagaacagaagaagacagga

SEQ ID NO: 1152289 - RNA, 26 nt, Human
gugaagaacagaagaagacaggaagc

SEQ ID NO: 1152290 - RNA, 22 nt, Human
uaugauguucccccaacgugga

SEQ ID NO: 1152291 - RNA, 18 nt, Human
ucuagcaggagcaugggg

SEQ ID NO: 1152292 - RNA, 20 nt, Human
ugccagcaguucugguucuu

SEQ ID NO: 1152293 - RNA, 22 nt, Human
ugucacaucccugggcuuaugg

SEQ ID NO: 1152294 - RNA, 22 nt, Human
ugugcaaauaaaaacgugugua

SEQ ID NO: 1152295 - RNA, 21 nt, Human
ugugggugcccccuuucugcc

SEQ ID NO: 1152296 - RNA, 20 nt, Human
aaaaccugagauugugaaga

SEQ ID NO: 1152297 - RNA, 19 nt, Human
aaagugcugggauuacagg

SEQ ID NO: 1152298 - RNA, 24 nt, Human
aaagugcugggauuacaggugcga

SEQ ID NO: 1152299 - RNA, 25 nt, Human
aagcgauccucccaccucagccucc

SEQ ID NO: 1152300 - RNA, 18 nt, Human
aagugcugggauuacagg

SEQ ID NO: 1152301 - RNA, 19 nt, Human
aagugcugggauuacaggu

SEQ ID NO: 1152302 - RNA, 20 nt, Human
aaguggcuguuugcacgugu

SEQ ID NO: 1152303 - RNA, 27 nt, Human
aauggaaagcggggggagggugagggg

SEQ ID NO: 1152304 - RNA, 18 nt, Human
acccagccucaacuguuu

SEQ ID NO: 1152305 - RNA, 22 nt, Human
acccucagcauugcuuuuaauc

SEQ ID NO: 1152306 - RNA, 19 nt, Human
acggagcaguaaguacaga

SEQ ID NO: 1152307 - RNA, 24 nt, Human
acuaguuccccacgacaugugugc

SEQ ID NO: 1152308 - RNA, 19 nt, Human
acugcagccucuaccuccu

SEQ ID NO: 1152309 - RNA, 21 nt, Human
acugcuuuuuuuuuuuuuuuu

SEQ ID NO: 1152310 - RNA, 25 nt, Human
agcgauccucccaccucagccuccu

SEQ ID NO: 1152311 - RNA, 19 nt, Human
agcggggggagggugaggg

SEQ ID NO: 1152312 - RNA, 21 nt, Human
aggguucagggggacugcggg

SEQ ID NO: 1152313 - RNA, 22 nt, Human
aguacagaguucuggagaggga

SEQ ID NO: 1152314 - RNA, 23 nt, Human
aguagcugagaccacaggcaugu

SEQ ID NO: 1152315 - RNA, 18 nt, Human
aguauccuuccaccaccc

SEQ ID NO: 1152316 - RNA, 20 nt, Human
agugacggagcaguaaguac

SEQ ID NO: 1152317 - RNA, 21 nt, Human
agugcagugguacgaucccag

SEQ ID NO: 1152318 - RNA, 23 nt, Human
agugcagugguacgaucccagcu

SEQ ID NO: 1152319 - RNA, 24 nt, Human
aucacuuugcaauaaaaccugagg

SEQ ID NO: 1152320 - RNA, 24 nt, Human
caaagugcugggauuacaggugcg

SEQ ID NO: 1152321 - RNA, 20 nt, Human
caagcgauccucccaccuca

SEQ ID NO: 1152322 - RNA, 24 nt, Human
caaggucuugcuauuuugcccagg

SEQ ID NO: 1152323 - RNA, 19 nt, Human
caaucucugguuucuuugc

SEQ ID NO: 1152324 - RNA, 19 nt, Human
caccacaccuggcuaauuu

SEQ ID NO: 1152325 - RNA, 24 nt, Human
cacccucagcauugcuuuuaaucu

SEQ ID NO: 1152326 - RNA, 24 nt, Human
caccucagccuccugaguagcuga

SEQ ID NO: 1152327 - RNA, 20 nt, Human
cacggaugcugcuaaacauc

SEQ ID NO: 1152328 - RNA, 21 nt, Human
cacguguggucagcaaaucca

SEQ ID NO: 1152329 - RNA, 23 nt, Human
cacugcagccucuaccuccuggg

SEQ ID NO: 1152330 - RNA, 21 nt, Human
cacuuugcaauaaaaccugag

SEQ ID NO: 1152331 - RNA, 20 nt, Human
cagccuccugaguagcugag

SEQ ID NO: 1152332 - RNA, 23 nt, Human
cagccucuaccuccuggguucaa

SEQ ID NO: 1152333 - RNA, 18 nt, Human
cagccuuucuucuaucgc

SEQ ID NO: 1152334 - RNA, 23 nt, Human
cagcucacugcagccucuaccuc

SEQ ID NO: 1152335 - RNA, 18 nt, Human
caguauccuuccaccacc

SEQ ID NO: 1152336 - RNA, 18 nt, Human
cagugcaccuguguuugg

SEQ ID NO: 1152337 - RNA, 24 nt, Human
cauuuucaauugauucauuggggg

SEQ ID NO: 1152338 - RNA, 20 nt, Human
ccaaagugcugggauuacag

SEQ ID NO: 1152339 - RNA, 21 nt, Human
ccaaagugcugggauuacagg

SEQ ID NO: 1152340 - RNA, 21 nt, Human
ccaaagugcugggauuacagg

SEQ ID NO: 1152341 - RNA, 22 nt, Human
ccaaagugcugggauuacaggu

SEQ ID NO: 1152342 - RNA, 23 nt, Human
ccaccucagccuccugaguagcu

SEQ ID NO: 1152343 - RNA, 22 nt, Human
ccauuccccacccugaucugga

SEQ ID NO: 1152344 - RNA, 23 nt, Human
cccaccucagccuccugaguagc

SEQ ID NO: 1152345 - RNA, 18 nt, Human
cccuggagagcaggaugg

SEQ ID NO: 1152346 - RNA, 20 nt, Human
ccuacaauuccccggacaac

SEQ ID NO: 1152347 - RNA, 24 nt, Human
ccuccuggguucaagcgauccucc

SEQ ID NO: 1152348 - RNA, 19 nt, Human
ccucuaccuccuggguuca

SEQ ID NO: 1152349 - RNA, 24 nt, Human
ccucuuuaagacucugcuuuguca

SEQ ID NO: 1152350 - RNA, 20 nt, Human
ccuggguucaagcgauccuc

SEQ ID NO: 1152351 - RNA, 21 nt, Human
ccuguagcugucaacucugug

SEQ ID NO: 1152352 - RNA, 20 nt, Human
cgacuggccauuccccaccc

SEQ ID NO: 1152353 - RNA, 24 nt, Human
cggggaguggggcugggaaguggc

SEQ ID NO: 1152354 - RNA, 24 nt, Human
cucacugcagccucuaccuccugg

SEQ ID NO: 1152355 - RNA, 24 nt, Human
cuccugaguagcugagaccacagg

SEQ ID NO: 1152356 - RNA, 22 nt, Human
cucucggcagcugggacuucau

SEQ ID NO: 1152357 - RNA, 23 nt, Human
cugcagccucuaccuccuggguu

SEQ ID NO: 1152358 - RNA, 20 nt, Human
cugcggggaguggggcuggg

SEQ ID NO: 1152359 - RNA, 25 nt, Human
cuucagggcuucucaaccagggggu

SEQ ID NO: 1152360 - RNA, 21 nt, Human
cuucccauuucagccugggag

SEQ ID NO: 1152361 - RNA, 23 nt, Human
cuuuucucuuucuccaccucucu

SEQ ID NO: 1152362 - RNA, 22 nt, Human
gacgggauuucuuuaguuucug

SEQ ID NO: 1152363 - RNA, 19 nt, Human
gaguaaucccaaagugcug

SEQ ID NO: 1152364 - RNA, 27 nt, Human
gaguagcugagaccacaggcauguauc

SEQ ID NO: 1152365 - RNA, 18 nt, Human
gauuacaggugcgaguca

SEQ ID NO: 1152366 - RNA, 24 nt, Human
gauuacaggugcgagucacucuac

SEQ ID NO: 1152367 - RNA, 21 nt, Human
gcacugcuucagccuuucuuc

SEQ ID NO: 1152368 - RNA, 20 nt, Human
gcagaaugagccgcucaccc

SEQ ID NO: 1152369 - RNA, 19 nt, Human
gcccaggcuggagugcagu

SEQ ID NO: 1152370 - RNA, 20 nt, Human
gcccaggcuggagugcagug

SEQ ID NO: 1152371 - RNA, 21 nt, Human
gcuaauuuuuucccuuuuucu

SEQ ID NO: 1152372 - RNA, 24 nt, Human
gcuauuuugcccaggcuggucuug

SEQ ID NO: 1152373 - RNA, 23 nt, Human
gcuggaggagguggugcuacugg

SEQ ID NO: 1152374 - RNA, 24 nt, Human
ggaaagcggggggagggugagggg

SEQ ID NO: 1152375 - RNA, 23 nt, Human
ggacugcggggaguggggcuggg

SEQ ID NO: 1152376 - RNA, 21 nt, Human
ggcaaggucuugcuauuuugc

SEQ ID NO: 1152377 - RNA, 20 nt, Human
ggcuggucuugaacuccuga

SEQ ID NO: 1152378 - RNA, 18 nt, Human
gggaguggggcugggaag

SEQ ID NO: 1152379 - RNA, 24 nt, Human
gggggagggugaggggucauucug

SEQ ID NO: 1152380 - RNA, 30 nt, Human
guacugcuuuuuuuuuuuuuuuuuuccuuu

SEQ ID NO: 1152381 - RNA, 19 nt, Human
gucucaaucucugguuucu

SEQ ID NO: 1152382 - RNA, 18 nt, Human
uaaucccaaagugcuggg

SEQ ID NO: 1152383 - RNA, 22 nt, Human
uacaauuccccggacaacuccc

SEQ ID NO: 1152384 - RNA, 21 nt, Human
uacagaguucuggagagggaa

SEQ ID NO: 1152385 - RNA, 24 nt, Human
uaccuccuggguucaagcgauccu

SEQ ID NO: 1152386 - RNA, 21 nt, Human
uacuuacaugugaucugcgua

SEQ ID NO: 1152387 - RNA, 18 nt, Human
uacuucagggcuucucaa

SEQ ID NO: 1152388 - RNA, 20 nt, Human
uagaggcaaggucuugcuau

SEQ ID NO: 1152389 - RNA, 18 nt, Human
uagcccaggcuggagugc

SEQ ID NO: 1152390 - RNA, 26 nt, Human
uaguacugcuuuuuuuuuuuuuuuuu

SEQ ID NO: 1152391 - RNA, 18 nt, Human
uaugucuuuacuucaggg

SEQ ID NO: 1152392 - RNA, 24 nt, Human
uauuuugcccaggcuggucuugaa

SEQ ID NO: 1152393 - RNA, 24 nt, Human
ucacugcagccucuaccuccuggg

SEQ ID NO: 1152394 - RNA, 25 nt, Human
ucacugcagccucuaccuccugggu

SEQ ID NO: 1152395 - RNA, 18 nt, Human
ucagcagcguugucccug

SEQ ID NO: 1152396 - RNA, 18 nt, Human
ucagcaucuuuuaacuca

SEQ ID NO: 1152397 - RNA, 23 nt, Human
ucagugcaccuguguuuggggcu

SEQ ID NO: 1152398 - RNA, 26 nt, Human
ucagugcaccuguguuuggggcuuug

SEQ ID NO: 1152399 - RNA, 23 nt, Human
ucccaaagugcugggauuacagg

SEQ ID NO: 1152400 - RNA, 20 nt, Human
ucccuuuuucuagaggcaag

SEQ ID NO: 1152401 - RNA, 26 nt, Human
uccucccaccucagccuccugaguag

SEQ ID NO: 1152402 - RNA, 24 nt, Human
uccugaguagcugagaccacaggc

SEQ ID NO: 1152403 - RNA, 20 nt, Human
uccugaguucaagcaaucuu

SEQ ID NO: 1152404 - RNA, 21 nt, Human
uccuggguucaagcgauccuc

SEQ ID NO: 1152405 - RNA, 24 nt, Human
uccuggguucaagcgauccuccca

SEQ ID NO: 1152406 - RNA, 22 nt, Human
uccuugagggaguuccuuuuuu

SEQ ID NO: 1152407 - RNA, 23 nt, Human
ucuccaaugacaguccccgauuu

SEQ ID NO: 1152408 - RNA, 23 nt, Human
ucucugguuucuuugcucagugc

SEQ ID NO: 1152409 - RNA, 19 nt, Human
ucuguagcccaggcuggag

SEQ ID NO: 1152410 - RNA, 19 nt, Human
ucuguagcccaggcuggag

SEQ ID NO: 1152411 - RNA, 24 nt, Human
ucuguagcccaggcuggagugcag

SEQ ID NO: 1152412 - RNA, 22 nt, Human
ucuucuaucgcuccucuccaau

SEQ ID NO: 1152413 - RNA, 23 nt, Human
ucuugaacuccugaguucaagca

SEQ ID NO: 1152414 - RNA, 23 nt, Human
ucuugcuauuuugcccaggcugg

SEQ ID NO: 1152415 - RNA, 24 nt, Human
ucuugcuauuuugcccaggcuggu

SEQ ID NO: 1152416 - RNA, 24 nt, Human
ugaacuccugaguucaagcaaucu

SEQ ID NO: 1152417 - RNA, 19 nt, Human
ugagaagcagauuagccaa

SEQ ID NO: 1152418 - RNA, 24 nt, Human
ugagaccacaggcauguaucacca

SEQ ID NO: 1152419 - RNA, 21 nt, Human
ugaguucaagcaaucuuccca

SEQ ID NO: 1152420 - RNA, 24 nt, Human
ugcccaggcuggucuugaacuccu

SEQ ID NO: 1152421 - RNA, 27 nt, Human
ugcccaggcuggucuugaacuccugag

SEQ ID NO: 1152422 - RNA, 19 nt, Human
ugcggggaguggggcuggg

SEQ ID NO: 1152423 - RNA, 19 nt, Human
ugcuaaacauccuacaauu

SEQ ID NO: 1152424 - RNA, 24 nt, Human
ugcuauuuugcccaggcuggucuu

SEQ ID NO: 1152425 - RNA, 24 nt, Human
ugcugggauuacaggugcgaguca

SEQ ID NO: 1152426 - RNA, 19 nt, Human
uggagugcagugguacgau

SEQ ID NO: 1152427 - RNA, 23 nt, Human
uggcuaauuuuuucccuuuuucu

SEQ ID NO: 1152428 - RNA, 23 nt, Human
uggcuuuuacuuuugauagcuuc

SEQ ID NO: 1152429 - RNA, 18 nt, Human
ugggauuacaggugcgag

SEQ ID NO: 1152430 - RNA, 18 nt, Human
ugggauuacaggugcgag

SEQ ID NO: 1152431 - RNA, 21 nt, Human
ugggauuacaggugcgaguca

SEQ ID NO: 1152432 - RNA, 22 nt, Human
ugggauuacaggugcgagucac

SEQ ID NO: 1152433 - RNA, 23 nt, Human
ugggauuacaggugcgagucacu

SEQ ID NO: 1152434 - RNA, 25 nt, Human
ugggauuacaggugcgagucacucu

SEQ ID NO: 1152435 - RNA, 19 nt, Human
uggggcugggaaguggcug

SEQ ID NO: 1152436 - RNA, 24 nt, Human
ugggucaucaguacucaagacauc

SEQ ID NO: 1152437 - RNA, 24 nt, Human
ugguacgaucccagcucacugcag

SEQ ID NO: 1152438 - RNA, 26 nt, Human
ugucaguauccuuccaccacccuggc

SEQ ID NO: 1152439 - RNA, 18 nt, Human
ugucccuggagagcagga

SEQ ID NO: 1152440 - RNA, 23 nt, Human
ugucuggagacaauuuugguugu

SEQ ID NO: 1152441 - RNA, 18 nt, Human
uguggcccuuaggcucuc

SEQ ID NO: 1152442 - RNA, 18 nt, Human
uucaagcaaucuucccau

SEQ ID NO: 1152443 - RNA, 24 nt, Human
uucaagcaaucuucccauuucagc

SEQ ID NO: 1152444 - RNA, 24 nt, Human
uucaagcgauccucccaccucagc

SEQ ID NO: 1152445 - RNA, 18 nt, Human
uucauugucauuaccagu

SEQ ID NO: 1152446 - RNA, 21 nt, Human
uucuaucgcuccucuccaaug

SEQ ID NO: 1152447 - RNA, 19 nt, Human
uugucccuggagagcagga

SEQ ID NO: 1152448 - RNA, 21 nt, Human
uuucuuuucucuuucuccacc

SEQ ID NO: 1152449 - RNA, 18 nt, Human
uuugguuguugcagcugg

SEQ ID NO: 1152450 - RNA, 21 nt, Human
uuuugguuguugcagcuggag

SEQ ID NO: 1152451 - RNA, 23 nt, Human
uuuuucagcagcguugucccugg

SEQ ID NO: 1152452 - RNA, 20 nt, Human
aaccuccaccuccugggcuc

SEQ ID NO: 1152453 - RNA, 21 nt, Human
aagcccccccagagaagcaag

SEQ ID NO: 1152454 - RNA, 24 nt, Human
aaggauucuccucccucagccucc

SEQ ID NO: 1152455 - RNA, 24 nt, Human
aaggugcugagaucacagguguga

SEQ ID NO: 1152456 - RNA, 19 nt, Human
aaguagcugggaaugcagg

SEQ ID NO: 1152457 - RNA, 24 nt, Human
accauuuuggccaggcuggucucg

SEQ ID NO: 1152458 - RNA, 22 nt, Human
accuacagguacuggaggugaa

SEQ ID NO: 1152459 - RNA, 21 nt, Human
acucuguugcccaggcuggag

SEQ ID NO: 1152460 - RNA, 25 nt, Human
acucuguugcccaggcuggagugca

SEQ ID NO: 1152461 - RNA, 18 nt, Human
agaacucaagggacagga

SEQ ID NO: 1152462 - RNA, 25 nt, Human
agacaagauggggguuuugcucuaa

SEQ ID NO: 1152463 - RNA, 19 nt, Human
agaucacaggugugagcca

SEQ ID NO: 1152464 - RNA, 20 nt, Human
agcuaugacagagaggggca

SEQ ID NO: 1152465 - RNA, 18 nt, Human
aggaaggagaugaguugg

SEQ ID NO: 1152466 - RNA, 21 nt, Human
aggaaggcagguuugggcugg

SEQ ID NO: 1152467 - RNA, 24 nt, Human
aggcagugguugaggcuguggaaa

SEQ ID NO: 1152468 - RNA, 25 nt, Human
aggcuggagugcaguggcaugaucu

SEQ ID NO: 1152469 - RNA, 22 nt, Human
aggugauccuccugccccggcc

SEQ ID NO: 1152470 - RNA, 24 nt, Human
aggugauccuccugccccggccuc

SEQ ID NO: 1152471 - RNA, 26 nt, Human
aggugcugagaucacaggugugagcc

SEQ ID NO: 1152472 - RNA, 18 nt, Human
aguaggugggauuacagg

SEQ ID NO: 1152473 - RNA, 24 nt, Human
agugauucuccugccucagccucc

SEQ ID NO: 1152474 - RNA, 18 nt, Human
agugcaguggcaugaucu

SEQ ID NO: 1152475 - RNA, 19 nt, Human
agugcaguggcaugaucuc

SEQ ID NO: 1152476 - RNA, 21 nt, Human
agugcaguggcaugaucuccg

SEQ ID NO: 1152477 - RNA, 22 nt, Human
augacagagaggggcaggguac

SEQ ID NO: 1152478 - RNA, 24 nt, Human
augggguuucaccauuuuggccag

SEQ ID NO: 1152479 - RNA, 18 nt, Human
auucuccugccucagccu

SEQ ID NO: 1152480 - RNA, 24 nt, Human
auuuuuguauuuuuaguagagaug

SEQ ID NO: 1152481 - RNA, 24 nt, Human
caaaggauucuccucccucagccu

SEQ ID NO: 1152482 - RNA, 23 nt, Human
caaccuccaccuccugggcucaa

SEQ ID NO: 1152483 - RNA, 24 nt, Human
caaccuccaccuccugggcucaag

SEQ ID NO: 1152484 - RNA, 24 nt, Human
caagauggggguuuugcucuaagc

SEQ ID NO: 1152485 - RNA, 21 nt, Human
caagcccccccagagaagcaa

SEQ ID NO: 1152486 - RNA, 22 nt, Human
caagcccccccagagaagcaag

SEQ ID NO: 1152487 - RNA, 24 nt, Human
caaggugcugagaucacaggugug

SEQ ID NO: 1152488 - RNA, 22 nt, Human
caagugauucuccugccucagc

SEQ ID NO: 1152489 - RNA, 19 nt, Human
cacagaacucaagggacag

SEQ ID NO: 1152490 - RNA, 19 nt, Human
cacaggugugagccaccac

SEQ ID NO: 1152491 - RNA, 21 nt, Human
caccauuuuggccaggcuggu

SEQ ID NO: 1152492 - RNA, 24 nt, Human
caccauuuuggccaggcuggucuc

SEQ ID NO: 1152493 - RNA, 21 nt, Human
cacugcaaccuccaccuccug

SEQ ID NO: 1152494 - RNA, 23 nt, Human
cacugcaaccuccaccuccuggg

SEQ ID NO: 1152495 - RNA, 20 nt, Human
cacuggacauuucaagcccc

SEQ ID NO: 1152496 - RNA, 24 nt, Human
caggugcccaccaacacaccuggc

SEQ ID NO: 1152497 - RNA, 19 nt, Human
cagguucaaaggauucucc

SEQ ID NO: 1152498 - RNA, 20 nt, Human
cauuguaacacagacaaagc

SEQ ID NO: 1152499 - RNA, 21 nt, Human
ccaaggugcugagaucacagg

SEQ ID NO: 1152500 - RNA, 24 nt, Human
ccaaggugcugagaucacaggugu

SEQ ID NO: 1152501 - RNA, 24 nt, Human
ccaccuccugggcucaagugauuc

SEQ ID NO: 1152502 - RNA, 21 nt, Human
ccagggggcaacgugugccag

SEQ ID NO: 1152503 - RNA, 23 nt, Human
cccaaguagcugggaaugcaggu

SEQ ID NO: 1152504 - RNA, 23 nt, Human
cccgaguaggugggauuacaggu

SEQ ID NO: 1152505 - RNA, 21 nt, Human
ccuacagguacuggaggugaa

SEQ ID NO: 1152506 - RNA, 22 nt, Human
ccuccaccuccugggcucaagu

SEQ ID NO: 1152507 - RNA, 24 nt, Human
ccucccagguucaaaggauucucc

SEQ ID NO: 1152508 - RNA, 25 nt, Human
ccuccugccccggccucccaaggug

SEQ ID NO: 1152509 - RNA, 24 nt, Human
ccuccugggcucaagugauucucc

SEQ ID NO: 1152510 - RNA, 23 nt, Human
ccugaccuaaggugauccuccug

SEQ ID NO: 1152511 - RNA, 23 nt, Human
ccugggcucaagugauucuccuc

SEQ ID NO: 1152512 - RNA, 23 nt, Human
ccugggcucaagugauucuccug

SEQ ID NO: 1152513 - RNA, 23 nt, Human
cucaagugauucuccugccucag

SEQ ID NO: 1152514 - RNA, 24 nt, Human
cucaagugauucuccugccucagc

SEQ ID NO: 1152515 - RNA, 24 nt, Human
cucacugcaaccuccaccuccugg

SEQ ID NO: 1152516 - RNA, 27 nt, Human
cucacugcaaccuccaccuccugggcu

SEQ ID NO: 1152517 - RNA, 21 nt, Human
cucccaaggugcugagaucac

SEQ ID NO: 1152518 - RNA, 23 nt, Human
cucccucagccucccaaguagcu

SEQ ID NO: 1152519 - RNA, 20 nt, Human
cuccugggcucaagugauuc

SEQ ID NO: 1152520 - RNA, 21 nt, Human
cuccugggcucaagugauucu

SEQ ID NO: 1152521 - RNA, 18 nt, Human
cugcaaccuccaccuccu

SEQ ID NO: 1152522 - RNA, 23 nt, Human
cugcaaccuccaccuccugggcu

SEQ ID NO: 1152523 - RNA, 24 nt, Human
cugcaaccuccaccuccugggcuc

SEQ ID NO: 1152524 - RNA, 21 nt, Human
cugccucagccucccgaguag

SEQ ID NO: 1152525 - RNA, 24 nt, Human
cuggacauuucaagcccccccaga

SEQ ID NO: 1152526 - RNA, 21 nt, Human
cuggaucuugauauguguuuc

SEQ ID NO: 1152527 - RNA, 24 nt, Human
cuggggaacccaccucccagguuc

SEQ ID NO: 1152528 - RNA, 21 nt, Human
cuggggacgcaucccagguag

SEQ ID NO: 1152529 - RNA, 21 nt, Human
cuuacucuguugcccaggcug

SEQ ID NO: 1152530 - RNA, 26 nt, Human
cuuacugugcugggaguacuugugga

SEQ ID NO: 1152531 - RNA, 19 nt, Human
cuuguggagugggggcugu

SEQ ID NO: 1152532 - RNA, 21 nt, Human
cuuguggagugggggcugugu

SEQ ID NO: 1152533 - RNA, 22 nt, Human
gaaggcagguuugggcuggaga

SEQ ID NO: 1152534 - RNA, 22 nt, Human
gaaucuuacucuguugcccagg

SEQ ID NO: 1152535 - RNA, 19 nt, Human
gacacagaacucaagggac

SEQ ID NO: 1152536 - RNA, 21 nt, Human
gacaggaaggagaugaguugg

SEQ ID NO: 1152537 - RNA, 19 nt, Human
gacagugucaggcaaggac

SEQ ID NO: 1152538 - RNA, 23 nt, Human
gaccauagggaaaugucuucuca

SEQ ID NO: 1152539 - RNA, 18 nt, Human
gagaugggguuucaccau

SEQ ID NO: 1152540 - RNA, 18 nt, Human
gaucacaggugugagcca

SEQ ID NO: 1152541 - RNA, 24 nt, Human
gcccaggcuggagugcaguggcau

SEQ ID NO: 1152542 - RNA, 21 nt, Human
gccugguuuggggaauauucg

SEQ ID NO: 1152543 - RNA, 25 nt, Human
gcuggagugcaguggcaugaucucc

SEQ ID NO: 1152544 - RNA, 25 nt, Human
ggacaggggucccugccagggaugc

SEQ ID NO: 1152545 - RNA, 20 nt, Human
ggagacagacaagauggggg

SEQ ID NO: 1152546 - RNA, 19 nt, Human
gggcuaggaaggcagguuu

SEQ ID NO: 1152547 - RNA, 22 nt, Human
gggcucaagugauucuccugcc

SEQ ID NO: 1152548 - RNA, 18 nt, Human
gggguuucaccauuuugg

SEQ ID NO: 1152549 - RNA, 22 nt, Human
gggguuucaccauuuuggccag

SEQ ID NO: 1152550 - RNA, 22 nt, Human
ggguuucaccauuuuggccagg

SEQ ID NO: 1152551 - RNA, 19 nt, Human
gguaggcagugguugaggc

SEQ ID NO: 1152552 - RNA, 19 nt, Human
ggucucgaacuccugaccu

SEQ ID NO: 1152553 - RNA, 21 nt, Human
ggugauccuccugccccggcc

SEQ ID NO: 1152554 - RNA, 24 nt, Human
gugauucuccugccucagccuccc

SEQ ID NO: 1152555 - RNA, 21 nt, Human
gugcugagaucacagguguga

SEQ ID NO: 1152556 - RNA, 21 nt, Human
gugugagccaccacgcugggc

SEQ ID NO: 1152557 - RNA, 23 nt, Human
uaacuguuguauuuuuaguggag

SEQ ID NO: 1152558 - RNA, 24 nt, Human
uaauuuuuguauuuuuaguagaga

SEQ ID NO: 1152559 - RNA, 21 nt, Human
uagcugggaaugcaggugugc

SEQ ID NO: 1152560 - RNA, 19 nt, Human
uaguagagaugggguuuca

SEQ ID NO: 1152561 - RNA, 23 nt, Human
uaguagagaugggguuucaccau

SEQ ID NO: 1152562 - RNA, 26 nt, Human
uaguagagaugggguuucaccauuuu

SEQ ID NO: 1152563 - RNA, 19 nt, Human
uauguguuucucaguugga

SEQ ID NO: 1152564 - RNA, 23 nt, Human
ucacugcaaccuccaccuccugg

SEQ ID NO: 1152565 - RNA, 24 nt, Human
ucacugcaaccuccaccuccuggg

SEQ ID NO: 1152566 - RNA, 25 nt, Human
ucacugcaaccuccaccuccugggc

SEQ ID NO: 1152567 - RNA, 27 nt, Human
ucacugcaaccuccaccuccugggcuc

SEQ ID NO: 1152568 - RNA, 20 nt, Human
ucagccucccaaguagcugg

SEQ ID NO: 1152569 - RNA, 23 nt, Human
ucccaaggugcugagaucacagg

SEQ ID NO: 1152570 - RNA, 23 nt, Human
ucccaaguagcugggaaugcagg

SEQ ID NO: 1152571 - RNA, 21 nt, Human
ucccagguucaaaggauucuc

SEQ ID NO: 1152572 - RNA, 23 nt, Human
ucccgaguaggugggauuacagg

SEQ ID NO: 1152573 - RNA, 24 nt, Human
ucccgaguaggugggauuacaggu

SEQ ID NO: 1152574 - RNA, 24 nt, Human
ucccucagccucccaaguagcugg

SEQ ID NO: 1152575 - RNA, 21 nt, Human
uccugggcucaagugauucuc

SEQ ID NO: 1152576 - RNA, 22 nt, Human
uccugggcucaagugauucucc

SEQ ID NO: 1152577 - RNA, 24 nt, Human
uccugggcucaagugauucuccug

SEQ ID NO: 1152578 - RNA, 21 nt, Human
ucuagacuccauccuccaucc

SEQ ID NO: 1152579 - RNA, 20 nt, Human
ucuccucccucagccuccca

SEQ ID NO: 1152580 - RNA, 19 nt, Human
ucuccugccucagccuccc

SEQ ID NO: 1152581 - RNA, 20 nt, Human
ucucgaacuccugaccuaag

SEQ ID NO: 1152582 - RNA, 18 nt, Human
ucuguugcccaggcugga

SEQ ID NO: 1152583 - RNA, 24 nt, Human
ucuguugcccaggcuggagugcag

SEQ ID NO: 1152584 - RNA, 23 nt, Human
ucuuacucuguugcccaggcugg

SEQ ID NO: 1152585 - RNA, 24 nt, Human
ucuuacucuguugcccaggcugga

SEQ ID NO: 1152586 - RNA, 19 nt, Human
ugacacagaacucaaggga

SEQ ID NO: 1152587 - RNA, 18 nt, Human
ugacagagaggggcaggg

SEQ ID NO: 1152588 - RNA, 23 nt, Human
ugaccuaaggugauccuccugcc

SEQ ID NO: 1152589 - RNA, 18 nt, Human
ugacguuggacucauugg

SEQ ID NO: 1152590 - RNA, 22 nt, Human
ugagaucacaggugugagccac

SEQ ID NO: 1152591 - RNA, 24 nt, Human
ugagaucacaggugugagccacca

SEQ ID NO: 1152592 - RNA, 23 nt, Human
ugaucuccgcucacugcaaccuc

SEQ ID NO: 1152593 - RNA, 20 nt, Human
ugcccaccaacacaccuggc

SEQ ID NO: 1152594 - RNA, 18 nt, Human
ugcccaggcuggagugca

SEQ ID NO: 1152595 - RNA, 21 nt, Human
ugcccaggcuggagugcagug

SEQ ID NO: 1152596 - RNA, 22 nt, Human
ugcccaggcuggagugcagugg

SEQ ID NO: 1152597 - RNA, 24 nt, Human
ugcccaggcuggagugcaguggca

SEQ ID NO: 1152598 - RNA, 24 nt, Human
ugccccggccucccaaggugcuga

SEQ ID NO: 1152599 - RNA, 21 nt, Human
ugcccugggcuuuaauuauuu

SEQ ID NO: 1152600 - RNA, 24 nt, Human
ugccucagccucccgaguaggugg

SEQ ID NO: 1152601 - RNA, 22 nt, Human
ugccugggaugagaguggagac

SEQ ID NO: 1152602 - RNA, 21 nt, Human
ugccugguuuggggaauauuc

SEQ ID NO: 1152603 - RNA, 24 nt, Human
ugcugagaucacaggugugagcca

SEQ ID NO: 1152604 - RNA, 24 nt, Human
uggaaucuuacucuguugcccagg

SEQ ID NO: 1152605 - RNA, 19 nt, Human
uggagugcaguggcaugau

SEQ ID NO: 1152606 - RNA, 22 nt, Human
uggagugcaguggcaugaucuc

SEQ ID NO: 1152607 - RNA, 23 nt, Human
uggagugcaguggcaugaucucc

SEQ ID NO: 1152608 - RNA, 24 nt, Human
uggagugcaguggcaugaucuccg

SEQ ID NO: 1152609 - RNA, 24 nt, Human
uggccaggcuggucucgaacuccu

SEQ ID NO: 1152610 - RNA, 24 nt, Human
ugggaaugcaggugugcgccacca

SEQ ID NO: 1152611 - RNA, 20 nt, Human
ugggaugagaguggagacag

SEQ ID NO: 1152612 - RNA, 21 nt, Human
ugggauuacaggugcccacca

SEQ ID NO: 1152613 - RNA, 18 nt, Human
ugggcucaagugauucuc

SEQ ID NO: 1152614 - RNA, 24 nt, Human
ugggcucaagugauucuccugccu

SEQ ID NO: 1152615 - RNA, 24 nt, Human
ugggguuucaccauuuuggccagg

SEQ ID NO: 1152616 - RNA, 22 nt, Human
ugugacacagaacucaagggac

SEQ ID NO: 1152617 - RNA, 24 nt, Human
uuacucuguugcccaggcuggagu

SEQ ID NO: 1152618 - RNA, 22 nt, Human
uuaguagagaugggguuucacc

SEQ ID NO: 1152619 - RNA, 24 nt, Human
uuaguagagaugggguuucaccau

SEQ ID NO: 1152620 - RNA, 18 nt, Human
uucuucuuguggccucug

SEQ ID NO: 1152621 - RNA, 19 nt, Human
uugauauguguuucucagu

SEQ ID NO: 1152622 - RNA, 24 nt, Human
uugcccaggcuggagugcaguggc

SEQ ID NO: 1152623 - RNA, 19 nt, Human
uugcuugggacccaggggg

SEQ ID NO: 1152624 - RNA, 23 nt, Human
uuguauuuuuaguagagaugggg

SEQ ID NO: 1152625 - RNA, 22 nt, Human
uuuaaagauggaaucuuacucu

SEQ ID NO: 1152626 - RNA, 24 nt, Human
uuucaccauuuuggccaggcuggu

SEQ ID NO: 1152627 - RNA, 18 nt, Human
uuuggccaggcuggucuc

SEQ ID NO: 1152628 - RNA, 24 nt, Human
uuuuuaguagagaugggguuucac

SEQ ID NO: 1152629 - RNA, 21 nt, Human
uuuuucuucuuguggccucug

SEQ ID NO: 1152630 - RNA, 20 nt, Human
uuuuuguauuuuuaguagag

SEQ ID NO: 1152631 - RNA, 21 nt, Human
aaaaacaaguaaaauaaguca

SEQ ID NO: 1152632 - RNA, 23 nt, Human
aauacaucccucaaaaauagccc

SEQ ID NO: 1152633 - RNA, 18 nt, Human
agcccaucaaugcuaaac

SEQ ID NO: 1152634 - RNA, 23 nt, Human
aggaaauaaacaaauaaaaaugc

SEQ ID NO: 1152635 - RNA, 20 nt, Human
caaccuccaaguuauucuuu

SEQ ID NO: 1152636 - RNA, 23 nt, Human
caagaaaggccgaaaaccaguca

SEQ ID NO: 1152637 - RNA, 21 nt, Human
cacaguuggcaaaggcucaga

SEQ ID NO: 1152638 - RNA, 18 nt, Human
cacuggcacucauaggug

SEQ ID NO: 1152639 - RNA, 19 nt, Human
caggaaaaacaaaucccac

SEQ ID NO: 1152640 - RNA, 22 nt, Human
cagugggcccuuggauuuaugc

SEQ ID NO: 1152641 - RNA, 23 nt, Human
ccuagaaagcacagacagagcau

SEQ ID NO: 1152642 - RNA, 23 nt, Human
ccuucaggaaaaacaaaucccac

SEQ ID NO: 1152643 - RNA, 25 nt, Human
ccuucccagauauuguuccuucaaa

SEQ ID NO: 1152644 - RNA, 18 nt, Human
cgaaaaccagucaacugc

SEQ ID NO: 1152645 - RNA, 20 nt, Human
cgacaguaucuuuucccagu

SEQ ID NO: 1152646 - RNA, 21 nt, Human
cucaaaaauagcccaucaaug

SEQ ID NO: 1152647 - RNA, 25 nt, Human
cuuuuuaaauugccaugaaugaaua

SEQ ID NO: 1152648 - RNA, 19 nt, Human
gaacauuuuaauguguggu

SEQ ID NO: 1152649 - RNA, 23 nt, Human
gcuaaaaaaaaaaaucaaaauga

SEQ ID NO: 1152650 - RNA, 22 nt, Human
ggaaaaacaaaucccacuuaaa

SEQ ID NO: 1152651 - RNA, 23 nt, Human
ggcuaaaaaaaaaaaucaaaaug

SEQ ID NO: 1152652 - RNA, 19 nt, Human
gguuggcuaaaaaaaaaaa

SEQ ID NO: 1152653 - RNA, 23 nt, Human
uaaaaaaaaaaaucaaaaugaaa

SEQ ID NO: 1152654 - RNA, 24 nt, Human
uaaaaaaaaaaaucaaaaugaaac

SEQ ID NO: 1152655 - RNA, 19 nt, Human
uaaacaaacaaaaaaagag

SEQ ID NO: 1152656 - RNA, 25 nt, Human
uaaacaaacaaaaaaagagacuugu

SEQ ID NO: 1152657 - RNA, 23 nt, Human
uaaacagaacucaacaauuuuua

SEQ ID NO: 1152658 - RNA, 18 nt, Human
uaaaugcauuuuuuuccu

SEQ ID NO: 1152659 - RNA, 19 nt, Human
uaaauuucuuucuaaaaag

SEQ ID NO: 1152660 - RNA, 22 nt, Human
uacugagauucaauguaaaaac

SEQ ID NO: 1152661 - RNA, 20 nt, Human
uagcauggaauuaaaucuuu

SEQ ID NO: 1152662 - RNA, 22 nt, Human
uagcccaucaaugcuaaaccaa

SEQ ID NO: 1152663 - RNA, 21 nt, Human
uauugcugaauggaaaaaccc

SEQ ID NO: 1152664 - RNA, 21 nt, Human
ucaagaaaggccgaaaaccag

SEQ ID NO: 1152665 - RNA, 20 nt, Human
ucugguuuuauuuuuaaauu

SEQ ID NO: 1152666 - RNA, 21 nt, Human
ucugguuuuauuuuuaaauug

SEQ ID NO: 1152667 - RNA, 20 nt, Human
ucuuauuagucaaccuccaa

SEQ ID NO: 1152668 - RNA, 20 nt, Human
ugagcuagcauggaauuaaa

SEQ ID NO: 1152669 - RNA, 20 nt, Human
ugagcuagcauggaauuaaa

SEQ ID NO: 1152670 - RNA, 20 nt, Human
ugagcuagcauggaauuaaa

SEQ ID NO: 1152671 - RNA, 23 nt, Human
ugagcuagcauggaauuaaaucu

SEQ ID NO: 1152672 - RNA, 19 nt, Human
ugauaaaagcaagauaaca

SEQ ID NO: 1152673 - RNA, 25 nt, Human
ugauaaaagcaagauaacaaaagga

SEQ ID NO: 1152674 - RNA, 24 nt, Human
ugcccuucaggaaaaacaaauccc

SEQ ID NO: 1152675 - RNA, 18 nt, Human
ugcugaauggaaaaaccc

SEQ ID NO: 1152676 - RNA, 18 nt, Human
uggaaaaacccgacagua

SEQ ID NO: 1152677 - RNA, 22 nt, Human
uucaaaacuaauugagcuagca

SEQ ID NO: 1152678 - RNA, 22 nt, Human
uucuuugggagaaaucaaagca

SEQ ID NO: 1152679 - RNA, 19 nt, Human
uuggcuaaaaaaaaaaauc

SEQ ID NO: 1152680 - RNA, 21 nt, Human
uuguauauaaccucugguucc

SEQ ID NO: 1152681 - RNA, 24 nt, Human
uuugauugaaaguuuaugccaacu

SEQ ID NO: 1152682 - RNA, 23 nt, Human
aaaaggaaaaguucaaaagagga

SEQ ID NO: 1152683 - RNA, 19 nt, Human
aaauaacccuugaucuaaa

SEQ ID NO: 1152684 - RNA, 22 nt, Human
aacaaauauucaaaaauuacgc

SEQ ID NO: 1152685 - RNA, 22 nt, Human
aacaaguuuuauaaauauguuc

SEQ ID NO: 1152686 - RNA, 22 nt, Human
aagcaaaaaaaaaauagaagua

SEQ ID NO: 1152687 - RNA, 24 nt, Human
aagcagaaagaaagugaagaauga

SEQ ID NO: 1152688 - RNA, 27 nt, Human
aagcagaaagaaagugaagagggaccc

SEQ ID NO: 1152689 - RNA, 24 nt, Human
acaaaagccguaaaaauuccaaca

SEQ ID NO: 1152690 - RNA, 24 nt, Human
accuacaugacuacacaaaagccg

SEQ ID NO: 1152691 - RNA, 21 nt, Human
agaaacuauguuuuuggcauu

SEQ ID NO: 1152692 - RNA, 20 nt, Human
agaaguaaaaauacaaugca

SEQ ID NO: 1152693 - RNA, 20 nt, Human
agacucgacuagagccggca

SEQ ID NO: 1152694 - RNA, 22 nt, Human
agcccgaagcuccugcgggaga

SEQ ID NO: 1152695 - RNA, 27 nt, Human
agccggcauccaagucggaccggcgcg

SEQ ID NO: 1152696 - RNA, 24 nt, Human
auacaaauaugaaguugcugaaau

SEQ ID NO: 1152697 - RNA, 24 nt, Human
aucuuuuuagaccccuuuaaaacc

SEQ ID NO: 1152698 - RNA, 23 nt, Human
caagcaaaagagcuccgccuccu

SEQ ID NO: 1152699 - RNA, 22 nt, Human
caaggacaaaaggaaaaguuca

SEQ ID NO: 1152700 - RNA, 23 nt, Human
caccucugcagccucgccaggag

SEQ ID NO: 1152701 - RNA, 23 nt, Human
cagccgcgcgcgcagucggugcg

SEQ ID NO: 1152702 - RNA, 22 nt, Human
caggagaagcccgaagcuccug

SEQ ID NO: 1152703 - RNA, 23 nt, Human
ccaaucaggacucagauuuuaaa

SEQ ID NO: 1152704 - RNA, 28 nt, Human
cccccuauaaaugugaaaggacagggau

SEQ ID NO: 1152705 - RNA, 25 nt, Human
ccccuuuaaaaccacuuuaauacaa

SEQ ID NO: 1152706 - RNA, 20 nt, Human
cccgcgggagccccgggagc

SEQ ID NO: 1152707 - RNA, 27 nt, Human
cgccaacaaaucuuuccauuccuuucc

SEQ ID NO: 1152708 - RNA, 19 nt, Human
cgggagaagccugaagcug

SEQ ID NO: 1152709 - RNA, 21 nt, Human
cuaagaaauaacccuugaucu

SEQ ID NO: 1152710 - RNA, 23 nt, Human
cuagaaccaaucauuucugccgu

SEQ ID NO: 1152711 - RNA, 22 nt, Human
cucacauauacaaauaugaagu

SEQ ID NO: 1152712 - RNA, 21 nt, Human
cuccgccuccugcugccccuc

SEQ ID NO: 1152713 - RNA, 24 nt, Human
cugaaagacuccugucucggaguu

SEQ ID NO: 1152714 - RNA, 22 nt, Human
cugcugccccuccaggauugaa

SEQ ID NO: 1152715 - RNA, 20 nt, Human
gaaaggacagggauaauuaa

SEQ ID NO: 1152716 - RNA, 18 nt, Human
gagaagaaaaguucccac

SEQ ID NO: 1152717 - RNA, 18 nt, Human
gcgcagucggugcgcccc

SEQ ID NO: 1152718 - RNA, 24 nt, Human
gcuaacuggaaaauggaaagcaaa

SEQ ID NO: 1152719 - RNA, 22 nt, Human
gugaaugccaccucucacagcu

SEQ ID NO: 1152720 - RNA, 23 nt, Human
uaagauggcuaacacagaaguca

SEQ ID NO: 1152721 - RNA, 19 nt, Human
uaagugaaugccaccucuc

SEQ ID NO: 1152722 - RNA, 22 nt, Human
uacacaaaagccguaaaaauuc

SEQ ID NO: 1152723 - RNA, 23 nt, Human
uaccaggagaagcccgaagcucc

SEQ ID NO: 1152724 - RNA, 18 nt, Human
uagcaguaauuuucuuca

SEQ ID NO: 1152725 - RNA, 24 nt, Human
uaggcuauaaacaacauuaaagua

SEQ ID NO: 1152726 - RNA, 18 nt, Human
uaguauguacuuuaacaa

SEQ ID NO: 1152727 - RNA, 20 nt, Human
ucaccgugccgccuccccgc

SEQ ID NO: 1152728 - RNA, 22 nt, Human
uccaaguucuuuuguaaaagca

SEQ ID NO: 1152729 - RNA, 22 nt, Human
uccccgcgggagccccgggagc

SEQ ID NO: 1152730 - RNA, 18 nt, Human
ucguagcucagaagacuc

SEQ ID NO: 1152731 - RNA, 22 nt, Human
ucuuuccauuccuuuccauucc

SEQ ID NO: 1152732 - RNA, 22 nt, Human
ugaaagacuccugucucggagu

SEQ ID NO: 1152733 - RNA, 19 nt, Human
ugaaauaaaaucacgaagc

SEQ ID NO: 1152734 - RNA, 23 nt, Human
ugacuacacaaaagccguaaaaa

SEQ ID NO: 1152735 - RNA, 21 nt, Human
ugaucuaagaaauaacccuug

SEQ ID NO: 1152736 - RNA, 22 nt, Human
ugcaagaauaaaaucaaauaac

SEQ ID NO: 1152737 - RNA, 23 nt, Human
ugccaccucucacagcucacaua

SEQ ID NO: 1152738 - RNA, 20 nt, Human
ugcccgcagccgcgcgcgca

SEQ ID NO: 1152739 - RNA, 23 nt, Human
uggaaaauggaaagcaaaaaaaa

SEQ ID NO: 1152740 - RNA, 18 nt, Human
uggaaagcaaaaaaaaaa

SEQ ID NO: 1152741 - RNA, 23 nt, Human
uggaaagcaaaaaaaaaauagaa

SEQ ID NO: 1152742 - RNA, 20 nt, Human
ugguggcuugugguuauaau

SEQ ID NO: 1152743 - RNA, 21 nt, Human
uuaauacaaggacaaaaggaa

SEQ ID NO: 1152744 - RNA, 18 nt, Human
uugaagacucugauuugc

SEQ ID NO: 1152745 - RNA, 22 nt, Human
uuucugccguuccaaaaaauua

SEQ ID NO: 1152746 - RNA, 21 nt, Human
uuugaagacucugauuugcuc

SEQ ID NO: 1152747 - RNA, 19 nt, Human
uuugagaauauguggagac

SEQ ID NO: 1152748 - RNA, 18 nt, Human
uuuggcauuucuuaauau

SEQ ID NO: 1152749 - RNA, 22 nt, Human
agggacuccaggaaggccgggg

SEQ ID NO: 1152750 - RNA, 24 nt, Human
cccgcgcacugggcccuccaggac

SEQ ID NO: 1152751 - RNA, 22 nt, Human
ccuccaggaccguaccaccguc

SEQ ID NO: 1152752 - RNA, 23 nt, Human
ccuccaggaccguaccaccgucc

SEQ ID NO: 1152753 - RNA, 24 nt, Human
cguccagaacgauaccuuggccac

SEQ ID NO: 1152754 - RNA, 22 nt, Human
cuacuucuuccucuuucaggga

SEQ ID NO: 1152755 - RNA, 18 nt, Human
cuccaggaaggccggggg

SEQ ID NO: 1152756 - RNA, 22 nt, Human
cuccugccgcaggcgcguccag

SEQ ID NO: 1152757 - RNA, 18 nt, Human
cugcaacagcuaucuucc

SEQ ID NO: 1152758 - RNA, 19 nt, Human
gagguggggcuggcggaag

SEQ ID NO: 1152759 - RNA, 26 nt, Human
gcacugggcccuccaggaccguacca

SEQ ID NO: 1152760 - RNA, 19 nt, Human
ggaaguggacgcggcgacc

SEQ ID NO: 1152761 - RNA, 19 nt, Human
ggccggggggagguggggc

SEQ ID NO: 1152762 - RNA, 21 nt, Human
ggggagguggggcuggcggaa

SEQ ID NO: 1152763 - RNA, 21 nt, Human
uccaggaaggccggggggagg

SEQ ID NO: 1152764 - RNA, 19 nt, Human
uccaggaccguaccaccgu

SEQ ID NO: 1152765 - RNA, 19 nt, Human
ucuauggcaauggcucacu

SEQ ID NO: 1152766 - RNA, 21 nt, Human
ucuauggcaauggcucacucu

SEQ ID NO: 1152767 - RNA, 21 nt, Human
ucuuccuccuccucacauuuc

SEQ ID NO: 1152768 - RNA, 18 nt, Human
ugccgcaggcgcguccag

SEQ ID NO: 1152769 - RNA, 20 nt, Human
uggggcuggcggaaguggac

SEQ ID NO: 1152770 - RNA, 22 nt, Human
aaaauacauauuccagcauaug

SEQ ID NO: 1152771 - RNA, 23 nt, Human
aaacaaacauaaacagggaagca

SEQ ID NO: 1152772 - RNA, 20 nt, Human
aagaggaaaaagauaaacag

SEQ ID NO: 1152773 - RNA, 26 nt, Human
aagcauuaaaggcuuaauagaaaacc

SEQ ID NO: 1152774 - RNA, 20 nt, Human
acacauauugagaacuuaca

SEQ ID NO: 1152775 - RNA, 20 nt, Human
acauuccuaaacaccaaaca

SEQ ID NO: 1152776 - RNA, 21 nt, Human
acuuagcugcacuuguuauau

SEQ ID NO: 1152777 - RNA, 18 nt, Human
aggaaaaagauaaacagc

SEQ ID NO: 1152778 - RNA, 22 nt, Human
aggaaaaagauaaacagcuuaa

SEQ ID NO: 1152779 - RNA, 25 nt, Human
aggaagcaagggauugguuuggagg

SEQ ID NO: 1152780 - RNA, 22 nt, Human
aggaggcacggggucccaaagc

SEQ ID NO: 1152781 - RNA, 25 nt, Human
aggagugggauccuuuccuuccacc

SEQ ID NO: 1152782 - RNA, 21 nt, Human
auagaacggcaauguuccuaa

SEQ ID NO: 1152783 - RNA, 21 nt, Human
augucugcaacuuagcugcac

SEQ ID NO: 1152784 - RNA, 23 nt, Human
auguuggcaggaggcacgggguc

SEQ ID NO: 1152785 - RNA, 24 nt, Human
caacaaccaucuucacucccaaau

SEQ ID NO: 1152786 - RNA, 21 nt, Human
caccucuggccaaguugggag

SEQ ID NO: 1152787 - RNA, 24 nt, Human
cagcauaggaaaauacauauucca

SEQ ID NO: 1152788 - RNA, 19 nt, Human
cagcguagaaccaauuuau

SEQ ID NO: 1152789 - RNA, 22 nt, Human
caggaaagggcaaauaggauua

SEQ ID NO: 1152790 - RNA, 22 nt, Human
caugucugcaacuuagcugcac

SEQ ID NO: 1152791 - RNA, 18 nt, Human
ccuacccacugaaaauuc

SEQ ID NO: 1152792 - RNA, 24 nt, Human
cuaaacaccaaacaaacauaaaca

SEQ ID NO: 1152793 - RNA, 22 nt, Human
gaaaauguauacuucuguaagc

SEQ ID NO: 1152794 - RNA, 22 nt, Human
gaacggcaauguuccuaaugaa

SEQ ID NO: 1152795 - RNA, 18 nt, Human
gcugcaauuaguuguccu

SEQ ID NO: 1152796 - RNA, 25 nt, Human
gcugcaauuaguuguccuguguuua

SEQ ID NO: 1152797 - RNA, 24 nt, Human
ggcaggaggcacggggucccaaag

SEQ ID NO: 1152798 - RNA, 18 nt, Human
gggagucaggagcuaaac

SEQ ID NO: 1152799 - RNA, 21 nt, Human
ggggucccaaagccucugugu

SEQ ID NO: 1152800 - RNA, 19 nt, Human
guauaauaagaggaaaaag

SEQ ID NO: 1152801 - RNA, 18 nt, Human
guccuuuuauuucugggu

SEQ ID NO: 1152802 - RNA, 25 nt, Human
guuuuggcucucugcaucacuuuca

SEQ ID NO: 1152803 - RNA, 19 nt, Human
uaaggaaccggaggguggc

SEQ ID NO: 1152804 - RNA, 22 nt, Human
uagguucccuuucuauggaaaa

SEQ ID NO: 1152805 - RNA, 24 nt, Human
uauauuuauuuauuuacuaguacc

SEQ ID NO: 1152806 - RNA, 21 nt, Human
ucagaacauccuacccacuga

SEQ ID NO: 1152807 - RNA, 23 nt, Human
ucuguccucugcuuucauuaagg

SEQ ID NO: 1152808 - RNA, 19 nt, Human
ugagccaggcaccaugcua

SEQ ID NO: 1152809 - RNA, 23 nt, Human
ugauguuggcaggaggcacgggg

SEQ ID NO: 1152810 - RNA, 21 nt, Human
uggaggcagaagcgagaggga

SEQ ID NO: 1152811 - RNA, 20 nt, Human
uggcaggaggcacggggucc

SEQ ID NO: 1152812 - RNA, 21 nt, Human
ugggagucaggagcuaaacug

SEQ ID NO: 1152813 - RNA, 21 nt, Human
uuaaucauauucuuucuggug

SEQ ID NO: 1152814 - RNA, 18 nt, Human
uucaccacaccucuggcc

SEQ ID NO: 1152815 - RNA, 23 nt, Human
uucacugcucagaacauccuacc

SEQ ID NO: 1152816 - RNA, 18 nt, Human
uucuggguggaaggaagc

SEQ ID NO: 1152817 - RNA, 25 nt, Human
uuucuggguggaaggaagcaaggga

SEQ ID NO: 1152818 - RNA, 20 nt, Human
aacauagugagaccccuucu

SEQ ID NO: 1152819 - RNA, 21 nt, Human
accacagcacuccagacaaca

SEQ ID NO: 1152820 - RNA, 19 nt, Human
caagugauucuguguccca

SEQ ID NO: 1152821 - RNA, 22 nt, Human
cagaaggccuccauucaaacac

SEQ ID NO: 1152822 - RNA, 25 nt, Human
cagcacuccagacaacauagugaga

SEQ ID NO: 1152823 - RNA, 21 nt, Human
cagccaggcucucucucacuu

SEQ ID NO: 1152824 - RNA, 25 nt, Human
caggaaggaugugauucauauggug

SEQ ID NO: 1152825 - RNA, 20 nt, Human
ccacuccacuccaccacagc

SEQ ID NO: 1152826 - RNA, 23 nt, Human
ccauccguaagauguucagcuac

SEQ ID NO: 1152827 - RNA, 18 nt, Human
cccagcagaacaggcucu

SEQ ID NO: 1152828 - RNA, 22 nt, Human
ccuuuggagcccugggccaucc

SEQ ID NO: 1152829 - RNA, 18 nt, Human
ccuuuguguuugucuuga

SEQ ID NO: 1152830 - RNA, 25 nt, Human
cuccacuccaccacagcacuccaga

SEQ ID NO: 1152831 - RNA, 18 nt, Human
cuucggaggcuggagaau

SEQ ID NO: 1152832 - RNA, 23 nt, Human
ggaaacgagccuuuggagcccug

SEQ ID NO: 1152833 - RNA, 21 nt, Human
gugucccagcagaacaggcuc

SEQ ID NO: 1152834 - RNA, 20 nt, Human
uacagcuucagccaggcucu

SEQ ID NO: 1152835 - RNA, 24 nt, Human
uagugagaccccuucucugggccu

SEQ ID NO: 1152836 - RNA, 19 nt, Human
uaugguguggauguuagaa

SEQ ID NO: 1152837 - RNA, 21 nt, Human
uccaccacagcacuccagaca

SEQ ID NO: 1152838 - RNA, 21 nt, Human
uccaccacagcacuccagaca

SEQ ID NO: 1152839 - RNA, 22 nt, Human
uccaccacagcacuccagacaa

SEQ ID NO: 1152840 - RNA, 18 nt, Human
uccacuccaccacagcac

SEQ ID NO: 1152841 - RNA, 19 nt, Human
uccacuccaccacagcacu

SEQ ID NO: 1152842 - RNA, 22 nt, Human
uccacuccaccacagcacucca

SEQ ID NO: 1152843 - RNA, 23 nt, Human
ucugugaauagccacuccacucu

SEQ ID NO: 1152844 - RNA, 19 nt, Human
ugcuuugagacuucggagg

SEQ ID NO: 1152845 - RNA, 22 nt, Human
uggaagguacacauacaaauua

SEQ ID NO: 1152846 - RNA, 21 nt, Human
uguuagaauuaugaaaccuau

SEQ ID NO: 1152847 - RNA, 21 nt, Human
uucagccaggcucucucucac

SEQ ID NO: 1152848 - RNA, 20 nt, Human
uuccuguccagaaggccucc

SEQ ID NO: 1152849 - RNA, 21 nt, Human
uuggaagguacacauacaaau

SEQ ID NO: 1152850 - RNA, 19 nt, Human
aacauggugaaaccccguc

SEQ ID NO: 1152851 - RNA, 20 nt, Human
aacauggugaaaccccgucu

SEQ ID NO: 1152852 - RNA, 21 nt, Human
aacauggugaaaccccgucuc

SEQ ID NO: 1152853 - RNA, 24 nt, Human
aagcacuuugggaggcuaaagugg

SEQ ID NO: 1152854 - RNA, 24 nt, Human
aaggggccugggaagacagcuggg

SEQ ID NO: 1152855 - RNA, 21 nt, Human
aaguggagguugcaggaagcc

SEQ ID NO: 1152856 - RNA, 24 nt, Human
aaguggagguugcaggaagccgag

SEQ ID NO: 1152857 - RNA, 23 nt, Human
aauaaauaaaaccccaaaaaucc

SEQ ID NO: 1152858 - RNA, 24 nt, Human
acagagcgagacuccaucucaaaa

SEQ ID NO: 1152859 - RNA, 18 nt, Human
accaucacccagcuucuc

SEQ ID NO: 1152860 - RNA, 21 nt, Human
accaucacccagcuucuccag

SEQ ID NO: 1152861 - RNA, 18 nt, Human
accccaaaaauccugagc

SEQ ID NO: 1152862 - RNA, 24 nt, Human
accccgucucuacuaaaaauacaa

SEQ ID NO: 1152863 - RNA, 21 nt, Human
accuguaauccaagcacuuug

SEQ ID NO: 1152864 - RNA, 24 nt, Human
acgccaaaggaaccaucacccagc

SEQ ID NO: 1152865 - RNA, 24 nt, Human
acuaaaaauacaaaaauuaacuga

SEQ ID NO: 1152866 - RNA, 18 nt, Human
acugcacuccagccuggg

SEQ ID NO: 1152867 - RNA, 19 nt, Human
acugcacuccagccugggc

SEQ ID NO: 1152868 - RNA, 19 nt, Human
acugcacuccagccugggc

SEQ ID NO: 1152869 - RNA, 22 nt, Human
acugcacuccagccugggcgac

SEQ ID NO: 1152870 - RNA, 24 nt, Human
acugcacuccagccugggcgacag

SEQ ID NO: 1152871 - RNA, 26 nt, Human
acugcacuccagccugggcgacagag

SEQ ID NO: 1152872 - RNA, 19 nt, Human
agaagaaaggaggccauga

SEQ ID NO: 1152873 - RNA, 20 nt, Human
agaagaaaggaggccaugag

SEQ ID NO: 1152874 - RNA, 22 nt, Human
agaagaaaggaggccaugaggg

SEQ ID NO: 1152875 - RNA, 19 nt, Human
agacucggaggccagggug

SEQ ID NO: 1152876 - RNA, 23 nt, Human
agaucaucugaggucaggaguuc

SEQ ID NO: 1152877 - RNA, 24 nt, Human
agcaauguucagguuacaagaccc

SEQ ID NO: 1152878 - RNA, 20 nt, Human
agcacuuugggaggcuaaag

SEQ ID NO: 1152879 - RNA, 24 nt, Human
agcacuuugggaggcuaaaguggg

SEQ ID NO: 1152880 - RNA, 22 nt, Human
agccuggccaacauggugaaac

SEQ ID NO: 1152881 - RNA, 24 nt, Human
agccuggccaacauggugaaaccc

SEQ ID NO: 1152882 - RNA, 24 nt, Human
agccugggcgacagagcgagacuc

SEQ ID NO: 1152883 - RNA, 25 nt, Human
aggaaaaguggaggagaccgguacc

SEQ ID NO: 1152884 - RNA, 24 nt, Human
aggcaggaggauugcuugaacccg

SEQ ID NO: 1152885 - RNA, 18 nt, Human
aggcaggugaggcucugc

SEQ ID NO: 1152886 - RNA, 19 nt, Human
aggccaugagggucaaagc

SEQ ID NO: 1152887 - RNA, 21 nt, Human
aggccaugagggucaaagcug

SEQ ID NO: 1152888 - RNA, 21 nt, Human
aggcugaggcaggaggauugc

SEQ ID NO: 1152889 - RNA, 24 nt, Human
aggcugaggcaggaggauugcuug

SEQ ID NO: 1152890 - RNA, 18 nt, Human
auaaauaaaaccccaaaa

SEQ ID NO: 1152891 - RNA, 22 nt, Human
aucugaggucaggaguucgaga

SEQ ID NO: 1152892 - RNA, 24 nt, Human
aucugaggucaggaguucgagacc

SEQ ID NO: 1152893 - RNA, 22 nt, Human
auggagccgcaggggcccucca

SEQ ID NO: 1152894 - RNA, 23 nt, Human
auugcuugaacccggaaagugga

SEQ ID NO: 1152895 - RNA, 24 nt, Human
caacauggugaaaccccgucucua

SEQ ID NO: 1152896 - RNA, 21 nt, Human
cacacccugguugggggcaga

SEQ ID NO: 1152897 - RNA, 24 nt, Human
cacaccuguaauccaagcacuuug

SEQ ID NO: 1152898 - RNA, 23 nt, Human
caccuguaauccaagcacuuugg

SEQ ID NO: 1152899 - RNA, 24 nt, Human
caccuguaauccaagcacuuuggg

SEQ ID NO: 1152900 - RNA, 24 nt, Human
cacuccagccugggcgacagagcg

SEQ ID NO: 1152901 - RNA, 24 nt, Human
cagaucaucugaggucaggaguuc

SEQ ID NO: 1152902 - RNA, 21 nt, Human
cagauggaauccaacacccca

SEQ ID NO: 1152903 - RNA, 20 nt, Human
cagccccgggucccaugccu

SEQ ID NO: 1152904 - RNA, 26 nt, Human
cagccuuggcuccagauugcagauuc

SEQ ID NO: 1152905 - RNA, 24 nt, Human
cagcuacucaggaggcugaggcag

SEQ ID NO: 1152906 - RNA, 25 nt, Human
caggggccccuccccugcugggccc

SEQ ID NO: 1152907 - RNA, 23 nt, Human
caggguggacagggaggagccga

SEQ ID NO: 1152908 - RNA, 19 nt, Human
cauccacacccugguuggg

SEQ ID NO: 1152909 - RNA, 21 nt, Human
cauccacacccugguuggggg

SEQ ID NO: 1152910 - RNA, 19 nt, Human
ccagauggaauccaacacc

SEQ ID NO: 1152911 - RNA, 26 nt, Human
ccagccccgggucccaugccucugcu

SEQ ID NO: 1152912 - RNA, 22 nt, Human
ccccaaaaauccugagcacgga

SEQ ID NO: 1152913 - RNA, 19 nt, Human
ccccagucccauccacacc

SEQ ID NO: 1152914 - RNA, 21 nt, Human
ccccgggucccaugccucugc

SEQ ID NO: 1152915 - RNA, 21 nt, Human
cccggaaaguggagguugcag

SEQ ID NO: 1152916 - RNA, 20 nt, Human
cccuccacagacaccuccuu

SEQ ID NO: 1152917 - RNA, 24 nt, Human
cccucuacagccauuaucuccggu

SEQ ID NO: 1152918 - RNA, 22 nt, Human
cccugguugggggcagaagagc

SEQ ID NO: 1152919 - RNA, 24 nt, Human
ccuacugcacuccagccugggcga

SEQ ID NO: 1152920 - RNA, 19 nt, Human
ccuccacagacaccuccuu

SEQ ID NO: 1152921 - RNA, 19 nt, Human
ccuccugcagccccgggag

SEQ ID NO: 1152922 - RNA, 19 nt, Human
ccugaccauuuggugcugu

SEQ ID NO: 1152923 - RNA, 23 nt, Human
ccuggccaacauggugaaacccc

SEQ ID NO: 1152924 - RNA, 24 nt, Human
ccuggccaacauggugaaaccccg

SEQ ID NO: 1152925 - RNA, 22 nt, Human
ccugggcgacagagcgagacuc

SEQ ID NO: 1152926 - RNA, 24 nt, Human
ccuguaauccaagcacuuugggag

SEQ ID NO: 1152927 - RNA, 21 nt, Human
ccuguaaucccagcuacucag

SEQ ID NO: 1152928 - RNA, 22 nt, Human
ccuguaaucccagcuacucagg

SEQ ID NO: 1152929 - RNA, 24 nt, Human
cgagaccagccuggccaacauggu

SEQ ID NO: 1152930 - RNA, 18 nt, Human
cgcagguccuucucccca

SEQ ID NO: 1152931 - RNA, 23 nt, Human
cgccuagagcugagggcugagac

SEQ ID NO: 1152932 - RNA, 20 nt, Human
cuacugcacuccagccuggg

SEQ ID NO: 1152933 - RNA, 21 nt, Human
cuacugcacuccagccugggc

SEQ ID NO: 1152934 - RNA, 24 nt, Human
cuacugcacuccagccugggcgac

SEQ ID NO: 1152935 - RNA, 24 nt, Human
cucacaccuguaauccaagcacuu

SEQ ID NO: 1152936 - RNA, 20 nt, Human
cuccacugaggcacccacag

SEQ ID NO: 1152937 - RNA, 22 nt, Human
cugagacggaaggaaaagugga

SEQ ID NO: 1152938 - RNA, 21 nt, Human
cugcaggggccccuccccugc

SEQ ID NO: 1152939 - RNA, 21 nt, Human
cugcccaggggagaggauaau

SEQ ID NO: 1152940 - RNA, 21 nt, Human
cugugacgcauccccaguccc

SEQ ID NO: 1152941 - RNA, 23 nt, Human
gaagacagcugggucucuggagg

SEQ ID NO: 1152942 - RNA, 20 nt, Human
gacagggaggagccgaaggu

SEQ ID NO: 1152943 - RNA, 23 nt, Human
gacgugguggcucacaccuguaa

SEQ ID NO: 1152944 - RNA, 24 nt, Human
gagaucgugccuacugcacuccag

SEQ ID NO: 1152945 - RNA, 24 nt, Human
gaucaucugaggucaggaguucga

SEQ ID NO: 1152946 - RNA, 24 nt, Human
gauugcuugaacccggaaagugga

SEQ ID NO: 1152947 - RNA, 24 nt, Human
gcacuccagccugggcgacagagc

SEQ ID NO: 1152948 - RNA, 24 nt, Human
gccaacauggugaaaccccgucuc

SEQ ID NO: 1152949 - RNA, 20 nt, Human
gccuacugcacuccagccug

SEQ ID NO: 1152950 - RNA, 22 nt, Human
gcucugagagugaugagguggg

SEQ ID NO: 1152951 - RNA, 19 nt, Human
gcuggacgugguggcucac

SEQ ID NO: 1152952 - RNA, 20 nt, Human
ggaggggcgccuagagcuga

SEQ ID NO: 1152953 - RNA, 20 nt, Human
ggagguugcaggaagccgag

SEQ ID NO: 1152954 - RNA, 24 nt, Human
ggagguugcaggaagccgagaucg

SEQ ID NO: 1152955 - RNA, 25 nt, Human
ggcagaucaucugaggucaggaguu

SEQ ID NO: 1152956 - RNA, 22 nt, Human
ggucaagggacagaagaaagga

SEQ ID NO: 1152957 - RNA, 21 nt, Human
ggugcaugccuguaaucccag

SEQ ID NO: 1152958 - RNA, 19 nt, Human
ggugccucaaaucugaggg

SEQ ID NO: 1152959 - RNA, 24 nt, Human
gguggcucacaccuguaauccaag

SEQ ID NO: 1152960 - RNA, 24 nt, Human
gguggugcaugccuguaaucccag

SEQ ID NO: 1152961 - RNA, 20 nt, Human
guggagguugcaggaagccg

SEQ ID NO: 1152962 - RNA, 19 nt, Human
uaaaccugagcaugggcug

SEQ ID NO: 1152963 - RNA, 24 nt, Human
uaaagugggcagaucaucugaggu

SEQ ID NO: 1152964 - RNA, 26 nt, Human
uaaagugggcagaucaucugagguca

SEQ ID NO: 1152965 - RNA, 20 nt, Human
uacugcacuccagccugggc

SEQ ID NO: 1152966 - RNA, 22 nt, Human
uacugcacuccagccugggcga

SEQ ID NO: 1152967 - RNA, 23 nt, Human
uacugcacuccagccugggcgac

SEQ ID NO: 1152968 - RNA, 24 nt, Human
uacugcacuccagccugggcgaca

SEQ ID NO: 1152969 - RNA, 24 nt, Human
uagcccuggccccuucucuggccu

SEQ ID NO: 1152970 - RNA, 20 nt, Human
ucaucugaggucaggaguuc

SEQ ID NO: 1152971 - RNA, 23 nt, Human
uccagccugggcgacagagcgag

SEQ ID NO: 1152972 - RNA, 24 nt, Human
uccagccugggcgacagagcgaga

SEQ ID NO: 1152973 - RNA, 23 nt, Human
uccccugcugggcccccaggggc

SEQ ID NO: 1152974 - RNA, 23 nt, Human
uccuugcugggaaggggccuggg

SEQ ID NO: 1152975 - RNA, 18 nt, Human
ucgccccugcgcaccacg

SEQ ID NO: 1152976 - RNA, 19 nt, Human
ucucaaaaauaaauaaaua

SEQ ID NO: 1152977 - RNA, 21 nt, Human
ucucuacuaaaaauacaaaaa

SEQ ID NO: 1152978 - RNA, 22 nt, Human
ucugaggucaggaguucgagac

SEQ ID NO: 1152979 - RNA, 23 nt, Human
ucugaggucaggaguucgagacc

SEQ ID NO: 1152980 - RNA, 25 nt, Human
ucugcaggggccccuccccugcugg

SEQ ID NO: 1152981 - RNA, 29 nt, Human
ucugggcuagggugccucaaaucugaggg

SEQ ID NO: 1152982 - RNA, 22 nt, Human
ugaaccgugagugugugugugg

SEQ ID NO: 1152983 - RNA, 18 nt, Human
ugacucggccuccacuga

SEQ ID NO: 1152984 - RNA, 25 nt, Human
ugagacggaaggaaaaguggaggag

SEQ ID NO: 1152985 - RNA, 24 nt, Human
ugaggcaggaggauugcuugaacc

SEQ ID NO: 1152986 - RNA, 25 nt, Human
ugaggcaggaggauugcuugaaccc

SEQ ID NO: 1152987 - RNA, 19 nt, Human
ugaggcaggugaggcucug

SEQ ID NO: 1152988 - RNA, 24 nt, Human
ugcaagcaauguucagguuacaag

SEQ ID NO: 1152989 - RNA, 24 nt, Human
ugccuguaaucccagcuacucagg

SEQ ID NO: 1152990 - RNA, 18 nt, Human
ugcugggaaggggccugg

SEQ ID NO: 1152991 - RNA, 18 nt, Human
ugcugggcccccaggggc

SEQ ID NO: 1152992 - RNA, 20 nt, Human
uggacagggaggagccgaag

SEQ ID NO: 1152993 - RNA, 24 nt, Human
uggccaacauggugaaaccccguc

SEQ ID NO: 1152994 - RNA, 19 nt, Human
uggcucacaccuguaaucc

SEQ ID NO: 1152995 - RNA, 20 nt, Human
uggcucacaccuguaaucca

SEQ ID NO: 1152996 - RNA, 20 nt, Human
ugggaggcuaaagugggcag

SEQ ID NO: 1152997 - RNA, 24 nt, Human
ugggaggcuaaagugggcagauca

SEQ ID NO: 1152998 - RNA, 18 nt, Human
ugggcagaucaucugagg

SEQ ID NO: 1152999 - RNA, 24 nt, Human
ugggcagaucaucugaggucagga

SEQ ID NO: 1153000 - RNA, 23 nt, Human
ugggggcagaagagccacuacca

SEQ ID NO: 1153001 - RNA, 21 nt, Human
uggugcaugccuguaauccca

SEQ ID NO: 1153002 - RNA, 24 nt, Human
ugguggugcaugccuguaauccca

SEQ ID NO: 1153003 - RNA, 21 nt, Human
ugguugggggcagaagagcca

SEQ ID NO: 1153004 - RNA, 25 nt, Human
ugugguucagaugaagcuaguccuu

SEQ ID NO: 1153005 - RNA, 24 nt, Human
uuaacugagugugguggugcaugc

SEQ ID NO: 1153006 - RNA, 24 nt, Human
uuccuuauguuugcaagcaauguu

SEQ ID NO: 1153007 - RNA, 24 nt, Human
uugcuugaacccggaaaguggagg

SEQ ID NO: 1153008 - RNA, 24 nt, Human
uuuagcccuggccccuucucuggc

SEQ ID NO: 1153009 - RNA, 20 nt, Human
accugauucuuuaucucugu

SEQ ID NO: 1153010 - RNA, 20 nt, Human
agacccggugguggugaugg

SEQ ID NO: 1153011 - RNA, 22 nt, Human
aggcagacccggugguggugau

SEQ ID NO: 1153012 - RNA, 21 nt, Human
aggcauuggaggggcaguggu

SEQ ID NO: 1153013 - RNA, 19 nt, Human
gcaguggugggucuggcug

SEQ ID NO: 1153014 - RNA, 20 nt, Human
ggaggggcaguggugguggc

SEQ ID NO: 1153015 - RNA, 20 nt, Human
gggcaguggugguggcagug

SEQ ID NO: 1153016 - RNA, 24 nt, Human
ggugaugguggugguaguagaggg

SEQ ID NO: 1153017 - RNA, 25 nt, Human
ggugaugguggugguaguagagggg

SEQ ID NO: 1153018 - RNA, 23 nt, Human
gugaugaugguggcagucuaauu

SEQ ID NO: 1153019 - RNA, 22 nt, Human
uagaggcaguggugggucuggc

SEQ ID NO: 1153020 - RNA, 20 nt, Human
uagagggggcaaugacggug

SEQ ID NO: 1153021 - RNA, 22 nt, Human
ucucuguggcuggauuuuuguc

SEQ ID NO: 1153022 - RNA, 21 nt, Human
ugacgguggugauggcaaagg

SEQ ID NO: 1153023 - RNA, 20 nt, Human
ugaugaugguggcagucuuu

SEQ ID NO: 1153024 - RNA, 19 nt, Human
uggaggggcagugguggug

SEQ ID NO: 1153025 - RNA, 21 nt, Human
uggaggggcaguggugguggc

SEQ ID NO: 1153026 - RNA, 19 nt, Human
uggauuuuugucacuaugu

SEQ ID NO: 1153027 - RNA, 22 nt, Human
uggcuggauuuuugucacuaug

SEQ ID NO: 1153028 - RNA, 20 nt, Human
uggugguggcagugaugaug

SEQ ID NO: 1153029 - RNA, 21 nt, Human
aaacagaauguucaguauagu

SEQ ID NO: 1153030 - RNA, 19 nt, Human
aagcugcagcccaggagag

SEQ ID NO: 1153031 - RNA, 18 nt, Human
acaggguuucaccauguu

SEQ ID NO: 1153032 - RNA, 19 nt, Human
acaggguuucaccauguua

SEQ ID NO: 1153033 - RNA, 20 nt, Human
acaggguuucaccauguuag

SEQ ID NO: 1153034 - RNA, 24 nt, Human
acaggguuucaccauguuagccag

SEQ ID NO: 1153035 - RNA, 22 nt, Human
acuacaagcucugccuccuggg

SEQ ID NO: 1153036 - RNA, 22 nt, Human
agaauccucaacaaccucacac

SEQ ID NO: 1153037 - RNA, 22 nt, Human
agacagagacagagaaaccaag

SEQ ID NO: 1153038 - RNA, 23 nt, Human
agacagagacagagaaaccaaga

SEQ ID NO: 1153039 - RNA, 21 nt, Human
agaccagaggcaagggcaagg

SEQ ID NO: 1153040 - RNA, 23 nt, Human
agcacacagggcauggagaggga

SEQ ID NO: 1153041 - RNA, 18 nt, Human
agcucugccuccuggguu

SEQ ID NO: 1153042 - RNA, 21 nt, Human
aggcaagggcaaggggaccgu

SEQ ID NO: 1153043 - RNA, 25 nt, Human
aggcuggagugcaguggcgcgaucu

SEQ ID NO: 1153044 - RNA, 18 nt, Human
aguagcugggacuacagg

SEQ ID NO: 1153045 - RNA, 21 nt, Human
agucuucagcuggugucccca

SEQ ID NO: 1153046 - RNA, 20 nt, Human
agugcaguggcgcgaucuag

SEQ ID NO: 1153047 - RNA, 24 nt, Human
agugcaguggcgcgaucuaggcuc

SEQ ID NO: 1153048 - RNA, 22 nt, Human
auaggguuuccuuucuccacuu

SEQ ID NO: 1153049 - RNA, 22 nt, Human
augagcuggccacuuacagaug

SEQ ID NO: 1153050 - RNA, 20 nt, Human
caagcccaugagggaagcug

SEQ ID NO: 1153051 - RNA, 21 nt, Human
caagcccaugagggaagcugg

SEQ ID NO: 1153052 - RNA, 19 nt, Human
caccaggcagagggcaccc

SEQ ID NO: 1153053 - RNA, 18 nt, Human
caccauguuagccaggau

SEQ ID NO: 1153054 - RNA, 22 nt, Human
caccauguuagccaggaugguc

SEQ ID NO: 1153055 - RNA, 24 nt, Human
caccauguuagccaggauggucuc

SEQ ID NO: 1153056 - RNA, 20 nt, Human
caccauuuauugaauagggu

SEQ ID NO: 1153057 - RNA, 25 nt, Human
caccccacugaugagggacggaggu

SEQ ID NO: 1153058 - RNA, 23 nt, Human
cacucucuccuuccacccuucca

SEQ ID NO: 1153059 - RNA, 19 nt, Human
cagaauccucaacaaccuc

SEQ ID NO: 1153060 - RNA, 22 nt, Human
cagaauccucaacaaccucaca

SEQ ID NO: 1153061 - RNA, 23 nt, Human
cagagcacacagggcauggagag

SEQ ID NO: 1153062 - RNA, 20 nt, Human
cagccuccugaguagcuggg

SEQ ID NO: 1153063 - RNA, 19 nt, Human
caggaaccaccaggcagag

SEQ ID NO: 1153064 - RNA, 24 nt, Human
caggguuucaccauguuagccagg

SEQ ID NO: 1153065 - RNA, 24 nt, Human
caguagagacaggguuucaccaug

SEQ ID NO: 1153066 - RNA, 26 nt, Human
caguagagacaggguuucaccauguu

SEQ ID NO: 1153067 - RNA, 22 nt, Human
cauggagagggauggcuguggu

SEQ ID NO: 1153068 - RNA, 25 nt, Human
cauuccugccucuagggagugggag

SEQ ID NO: 1153069 - RNA, 22 nt, Human
ccaagcccaugagggaagcugg

SEQ ID NO: 1153070 - RNA, 22 nt, Human
ccaauuaucccagcaccauuua

SEQ ID NO: 1153071 - RNA, 18 nt, Human
ccagaauccucaacaacc

SEQ ID NO: 1153072 - RNA, 18 nt, Human
ccagcaccauuuauugaa

SEQ ID NO: 1153073 - RNA, 19 nt, Human
cccacugaugagggacgga

SEQ ID NO: 1153074 - RNA, 23 nt, Human
cccuuccagucuucagcuggugu

SEQ ID NO: 1153075 - RNA, 19 nt, Human
ccuaccugcaacccagaau

SEQ ID NO: 1153076 - RNA, 18 nt, Human
ccucccaccacagugggg

SEQ ID NO: 1153077 - RNA, 24 nt, Human
ccuccuggguucaugccauucucc

SEQ ID NO: 1153078 - RNA, 18 nt, Human
ccugaccucgugauccgc

SEQ ID NO: 1153079 - RNA, 22 nt, Human
ccugaguagcugggacuacagg

SEQ ID NO: 1153080 - RNA, 23 nt, Human
ccugaguagcugggacuacaggu

SEQ ID NO: 1153081 - RNA, 23 nt, Human
ccugccccagccuccugaguagc

SEQ ID NO: 1153082 - RNA, 24 nt, Human
ccuggccugaggcuggcaggaacc

SEQ ID NO: 1153083 - RNA, 18 nt, Human
ccuuccacccuuccaguc

SEQ ID NO: 1153084 - RNA, 24 nt, Human
cgcccaggcuggagugcaguggcg

SEQ ID NO: 1153085 - RNA, 18 nt, Human
cuacaagcucugccuccg

SEQ ID NO: 1153086 - RNA, 21 nt, Human
cuacaagcucugccuccuggg

SEQ ID NO: 1153087 - RNA, 18 nt, Human
cucccaagcugcagccca

SEQ ID NO: 1153088 - RNA, 21 nt, Human
cuccuggguucaugccauucu

SEQ ID NO: 1153089 - RNA, 24 nt, Human
cucgcucugucgcccaggcuggag

SEQ ID NO: 1153090 - RNA, 24 nt, Human
cucuccuuccacccuuccagucuu

SEQ ID NO: 1153091 - RNA, 21 nt, Human
cucucuccuuccacccuucca

SEQ ID NO: 1153092 - RNA, 21 nt, Human
cucucugaaccccuggccuga

SEQ ID NO: 1153093 - RNA, 20 nt, Human
cucugucgcccaggcuggag

SEQ ID NO: 1153094 - RNA, 23 nt, Human
cucugucgcccaggcuggagugc

SEQ ID NO: 1153095 - RNA, 19 nt, Human
cugaggcuguacuaagugc

SEQ ID NO: 1153096 - RNA, 24 nt, Human
cugcaacccagaauccucaacaac

SEQ ID NO: 1153097 - RNA, 23 nt, Human
cugccccagccuccugaguagcu

SEQ ID NO: 1153098 - RNA, 19 nt, Human
cugugagaguccugagguu

SEQ ID NO: 1153099 - RNA, 24 nt, Human
cuugccaauuaucccagcaccauu

SEQ ID NO: 1153100 - RNA, 18 nt, Human
gaaccaagcccaugaggg

SEQ ID NO: 1153101 - RNA, 23 nt, Human
gaaccaagcccaugagggaagcu

SEQ ID NO: 1153102 - RNA, 23 nt, Human
gaauccucaacaaccucacaccc

SEQ ID NO: 1153103 - RNA, 20 nt, Human
gaccucgugauccgccuccc

SEQ ID NO: 1153104 - RNA, 22 nt, Human
gacuugcucucugaaccccuuu

SEQ ID NO: 1153105 - RNA, 20 nt, Human
gagaaccaagcccaugaggg

SEQ ID NO: 1153106 - RNA, 21 nt, Human
gagacggagucucgcucuguc

SEQ ID NO: 1153107 - RNA, 26 nt, Human
gaguagcugggacuacaggugcacac

SEQ ID NO: 1153108 - RNA, 25 nt, Human
gccacccucccaccacaguggggac

SEQ ID NO: 1153109 - RNA, 19 nt, Human
gcccaggcuggagugcagu

SEQ ID NO: 1153110 - RNA, 20 nt, Human
gcccaggcuggagugcagug

SEQ ID NO: 1153111 - RNA, 21 nt, Human
gcucacuacaagcucugccuc

SEQ ID NO: 1153112 - RNA, 24 nt, Human
gcuggagugcaguggcgcgaucua

SEQ ID NO: 1153113 - RNA, 18 nt, Human
ggaaagggcuuaaugagc

SEQ ID NO: 1153114 - RNA, 21 nt, Human
ggacggaggugguauaggccu

SEQ ID NO: 1153115 - RNA, 21 nt, Human
ggagcucucccaagcugcagc

SEQ ID NO: 1153116 - RNA, 23 nt, Human
ggagcucucccaagcugcagccc

SEQ ID NO: 1153117 - RNA, 20 nt, Human
ggcagccugggaggcugagu

SEQ ID NO: 1153118 - RNA, 22 nt, Human
ggcaggagacguagucugcaaa

SEQ ID NO: 1153119 - RNA, 19 nt, Human
ggcauggagagggauggcu

SEQ ID NO: 1153120 - RNA, 25 nt, Human
ggcauggagagggauggcugugguc

SEQ ID NO: 1153121 - RNA, 19 nt, Human
ggcuguggucguggaggag

SEQ ID NO: 1153122 - RNA, 21 nt, Human
gggcaaggggaccguggcagc

SEQ ID NO: 1153123 - RNA, 24 nt, Human
gguuucaccauguuagccaggaug

SEQ ID NO: 1153124 - RNA, 24 nt, Human
gucucgcucugucgcccaggcugg

SEQ ID NO: 1153125 - RNA, 21 nt, Human
gugguauaggccugaggcugu

SEQ ID NO: 1153126 - RNA, 22 nt, Human
uacaggugcacaccaccacgcc

SEQ ID NO: 1153127 - RNA, 23 nt, Human
uacugauccgauccuggcaggag

SEQ ID NO: 1153128 - RNA, 21 nt, Human
uagagacaggguuucaccaug

SEQ ID NO: 1153129 - RNA, 22 nt, Human
uagagacaggguuucaccaugu

SEQ ID NO: 1153130 - RNA, 20 nt, Human
uauucuguuccauuggucua

SEQ ID NO: 1153131 - RNA, 24 nt, Human
ucaccauguuagccaggauggucu

SEQ ID NO: 1153132 - RNA, 18 nt, Human
ucacuacaagcucugccu

SEQ ID NO: 1153133 - RNA, 24 nt, Human
ucacuacaagcucugccuccuggg

SEQ ID NO: 1153134 - RNA, 19 nt, Human
ucagacagagacagagaaa

SEQ ID NO: 1153135 - RNA, 24 nt, Human
ucaguagagacaggguuucaccau

SEQ ID NO: 1153136 - RNA, 25 nt, Human
ucaugccauucuccugccccagccu

SEQ ID NO: 1153137 - RNA, 18 nt, Human
uccacccuuccagucuuc

SEQ ID NO: 1153138 - RNA, 24 nt, Human
uccugaguagcugggacuacaggu

SEQ ID NO: 1153139 - RNA, 23 nt, Human
uccugccucuagggagugggagc

SEQ ID NO: 1153140 - RNA, 24 nt, Human
uccuggguucaugccauucuccug

SEQ ID NO: 1153141 - RNA, 24 nt, Human
ucgcccaggcuggagugcaguggc

SEQ ID NO: 1153142 - RNA, 24 nt, Human
ucgcucugucgcccaggcuggagu

SEQ ID NO: 1153143 - RNA, 24 nt, Human
ucuccugccccagccuccugagua

SEQ ID NO: 1153144 - RNA, 19 nt, Human
ucucgcucugucgcccagg

SEQ ID NO: 1153145 - RNA, 23 nt, Human
ucucgcucugucgcccaggcugg

SEQ ID NO: 1153146 - RNA, 24 nt, Human
ucucgcucugucgcccaggcugga

SEQ ID NO: 1153147 - RNA, 26 nt, Human
ucucgcucugucgcccaggcuggagu

SEQ ID NO: 1153148 - RNA, 24 nt, Human
ucugucgcccaggcuggagugcag

SEQ ID NO: 1153149 - RNA, 25 nt, Human
ucuuagucaggacauggccgggguc

SEQ ID NO: 1153150 - RNA, 24 nt, Human
ugccccagccuccugaguagcugg

SEQ ID NO: 1153151 - RNA, 20 nt, Human
ugcccugggucccuggggcu

SEQ ID NO: 1153152 - RNA, 25 nt, Human
ugcccugggucccuggggcuacagc

SEQ ID NO: 1153153 - RNA, 22 nt, Human
ugcccuguagggcugugagagu

SEQ ID NO: 1153154 - RNA, 19 nt, Human
ugccuccuggguucaugcc

SEQ ID NO: 1153155 - RNA, 24 nt, Human
uggagugcaguggcgcgaucuagg

SEQ ID NO: 1153156 - RNA, 26 nt, Human
uggcagcagagcacacagggcaugga

SEQ ID NO: 1153157 - RNA, 19 nt, Human
uggcaggaaccaccaggca

SEQ ID NO: 1153158 - RNA, 22 nt, Human
uggcaggagacguagucugcaa

SEQ ID NO: 1153159 - RNA, 18 nt, Human
uggcccagccaggcccug

SEQ ID NO: 1153160 - RNA, 23 nt, Human
uggcccagccaggcccugggagc

SEQ ID NO: 1153161 - RNA, 24 nt, Human
uggcgcgaucuaggcucacuacaa

SEQ ID NO: 1153162 - RNA, 25 nt, Human
uggcuccagcugcccuguagggcug

SEQ ID NO: 1153163 - RNA, 18 nt, Human
uggcuguaaguauuuggc

SEQ ID NO: 1153164 - RNA, 18 nt, Human
uggcuguggucguggagg

SEQ ID NO: 1153165 - RNA, 22 nt, Human
uggcuugccaauuaucccagca

SEQ ID NO: 1153166 - RNA, 19 nt, Human
uggcuuuauuucuggguuc

SEQ ID NO: 1153167 - RNA, 21 nt, Human
uggcuuuauuucuggguucuc

SEQ ID NO: 1153168 - RNA, 24 nt, Human
ugggacuacaggugcacaccacca

SEQ ID NO: 1153169 - RNA, 23 nt, Human
uguccccauuggugaaccagacc

SEQ ID NO: 1153170 - RNA, 24 nt, Human
uguggucguggaggaggaaacaga

SEQ ID NO: 1153171 - RNA, 19 nt, Human
uuacugauccgauccuggc

SEQ ID NO: 1153172 - RNA, 26 nt, Human
uucaugccauucuccugccccagccu

SEQ ID NO: 1153173 - RNA, 21 nt, Human
uucugagucaguuucuucauc

SEQ ID NO: 1153174 - RNA, 25 nt, Human
uucuggguucucuauucccuaaggg

SEQ ID NO: 1153175 - RNA, 23 nt, Human
uugcucucugaaccccuggccug

SEQ ID NO: 1153176 - RNA, 21 nt, Human
uuggcuuuauuucuggguucu

SEQ ID NO: 1153177 - RNA, 19 nt, Human
uuucaccauguuagccagg

SEQ ID NO: 1153178 - RNA, 20 nt, Human
uuucaccauguuagccagga

SEQ ID NO: 1153179 - RNA, 23 nt, Human
uuuuauaccaguaccaugcugcu

SEQ ID NO: 1153180 - RNA, 24 nt, Human
uuuucaguagagacaggguuucac

SEQ ID NO: 1153181 - RNA, 21 nt, Human
aagggcacagcagcugcaggc

SEQ ID NO: 1153182 - RNA, 21 nt, Human
acccugagcagcugcucaggc

SEQ ID NO: 1153183 - RNA, 21 nt, Human
agcagcugcaggccauuggca

SEQ ID NO: 1153184 - RNA, 18 nt, Human
agccaggggacccaggca

SEQ ID NO: 1153185 - RNA, 18 nt, Human
cagccaggggacccaggc

SEQ ID NO: 1153186 - RNA, 20 nt, Human
cagccaggggacccaggcag

SEQ ID NO: 1153187 - RNA, 20 nt, Human
cccgggccagggaggcuccc

SEQ ID NO: 1153188 - RNA, 24 nt, Human
cgagguggggaggaggagagacac

SEQ ID NO: 1153189 - RNA, 19 nt, Human
cgggugccgaacgucuggc

SEQ ID NO: 1153190 - RNA, 26 nt, Human
cuccagagggcccagguacugguggu

SEQ ID NO: 1153191 - RNA, 21 nt, Human
cugcaucucccuggccagcca

SEQ ID NO: 1153192 - RNA, 19 nt, Human
cugggggugugggucgacc

SEQ ID NO: 1153193 - RNA, 20 nt, Human
gaacgucuggcccgggccag

SEQ ID NO: 1153194 - RNA, 23 nt, Human
gaagauggugaguggaaagcagg

SEQ ID NO: 1153195 - RNA, 18 nt, Human
gacccugagcagcugcuc

SEQ ID NO: 1153196 - RNA, 21 nt, Human
gaccucugagagcugcaucuc

SEQ ID NO: 1153197 - RNA, 23 nt, Human
gagaccccagaaggagccaaggg

SEQ ID NO: 1153198 - RNA, 19 nt, Human
gagccaguccacggagcca

SEQ ID NO: 1153199 - RNA, 26 nt, Human
gagccaguccacggagccaaagcugg

SEQ ID NO: 1153200 - RNA, 18 nt, Human
gagcugcaucucccuggc

SEQ ID NO: 1153201 - RNA, 24 nt, Human
ggagacgucggcaggccugggggu

SEQ ID NO: 1153202 - RNA, 19 nt, Human
ggcagccaggggacccagg

SEQ ID NO: 1153203 - RNA, 23 nt, Human
ggccagaagauggugaguggaaa

SEQ ID NO: 1153204 - RNA, 21 nt, Human
ggugaguggaaagcagggggc

SEQ ID NO: 1153205 - RNA, 21 nt, Human
ucaacccagccacaguccucu

SEQ ID NO: 1153206 - RNA, 23 nt, Human
uccacggagccaaagcuggaggg

SEQ ID NO: 1153207 - RNA, 24 nt, Human
ucccgggugccgaacgucuggccc

SEQ ID NO: 1153208 - RNA, 21 nt, Human
ucccuggccagccaauuccgc

SEQ ID NO: 1153209 - RNA, 21 nt, Human
ucgacccugagcagcugcuca

SEQ ID NO: 1153210 - RNA, 18 nt, Human
ugcccaagggcacagcag

SEQ ID NO: 1153211 - RNA, 19 nt, Human
ugggaguccugcauuugcc

SEQ ID NO: 1153212 - RNA, 19 nt, Human
uggugaguggaaagcaggg

SEQ ID NO: 1153213 - RNA, 19 nt, Human
aagaagggaggaggagagg

SEQ ID NO: 1153214 - RNA, 25 nt, Human
aagcuucagagugcuggcuuccccc

SEQ ID NO: 1153215 - RNA, 26 nt, Human
agaagggaggaggagagggaacaagc

SEQ ID NO: 1153216 - RNA, 27 nt, Human
auggugauaaguuugaaaaacagauac

SEQ ID NO: 1153217 - RNA, 19 nt, Human
cgggaagaagggaggagga

SEQ ID NO: 1153218 - RNA, 19 nt, Human
cugacauggugauaaguuu

SEQ ID NO: 1153219 - RNA, 21 nt, Human
gaacaagcuucagagugcugg

SEQ ID NO: 1153220 - RNA, 23 nt, Human
gggaagaagggaggaggagaggg

SEQ ID NO: 1153221 - RNA, 22 nt, Human
ucagugggaagagacucagaaa

SEQ ID NO: 1153222 - RNA, 19 nt, Human
ucccgggaagaagggagga

SEQ ID NO: 1153223 - RNA, 23 nt, Human
uccgcagauagccagugugcuuu

SEQ ID NO: 1153224 - RNA, 18 nt, Human
ugaaaaacagauacagcc

SEQ ID NO: 1153225 - RNA, 24 nt, Human
ugaaaaacagauacagcccugaaa

SEQ ID NO: 1153226 - RNA, 19 nt, Human
uggcuuccaaaguccuucc

SEQ ID NO: 1153227 - RNA, 23 nt, Human
ugggaagagacucagaaauagug

SEQ ID NO: 1153228 - RNA, 21 nt, Human
ugugcuuccagcugcucagug

SEQ ID NO: 1153229 - RNA, 21 nt, Human
aaaaagcaggcauguucuggu

SEQ ID NO: 1153230 - RNA, 25 nt, Human
aaaaguaagcaaaucucaugggaaa

SEQ ID NO: 1153231 - RNA, 23 nt, Human
aaacacaaaaacuggcagcugga

SEQ ID NO: 1153232 - RNA, 23 nt, Human
aaccauuccaaaucugcuuccaa

SEQ ID NO: 1153233 - RNA, 21 nt, Human
aacuacauuggccaagggcac

SEQ ID NO: 1153234 - RNA, 22 nt, Human
aagaaaaagagguuuaauugga

SEQ ID NO: 1153235 - RNA, 19 nt, Human
aagcugcaguagcugggaa

SEQ ID NO: 1153236 - RNA, 20 nt, Human
aagcugcaguagcugggaac

SEQ ID NO: 1153237 - RNA, 20 nt, Human
aaugcacaaaggcuggucag

SEQ ID NO: 1153238 - RNA, 23 nt, Human
acaaagagaggacacaacagcug

SEQ ID NO: 1153239 - RNA, 18 nt, Human
acagcagcaggaggggag

SEQ ID NO: 1153240 - RNA, 21 nt, Human
accauuccaaaucugcuucca

SEQ ID NO: 1153241 - RNA, 20 nt, Human
acccagcauuuucucuaaau

SEQ ID NO: 1153242 - RNA, 18 nt, Human
acugggaagaaaaagagg

SEQ ID NO: 1153243 - RNA, 20 nt, Human
agagaggacacaacagcuga

SEQ ID NO: 1153244 - RNA, 26 nt, Human
agcaagccaggccccuaaauaauucu

SEQ ID NO: 1153245 - RNA, 23 nt, Human
agcaggaggggagagggcagggu

SEQ ID NO: 1153246 - RNA, 23 nt, Human
aggaaaaacacaaaaacuggcag

SEQ ID NO: 1153247 - RNA, 18 nt, Human
aggcaaagagagugaccc

SEQ ID NO: 1153248 - RNA, 23 nt, Human
aggccccuaaauaauucuggccc

SEQ ID NO: 1153249 - RNA, 19 nt, Human
agguggccggugaaugugg

SEQ ID NO: 1153250 - RNA, 26 nt, Human
auaauacacuauuuucuuugucuuuc

SEQ ID NO: 1153251 - RNA, 20 nt, Human
aucccuccuacccucuucca

SEQ ID NO: 1153252 - RNA, 19 nt, Human
augaaaggcacuucuuaca

SEQ ID NO: 1153253 - RNA, 20 nt, Human
caaaaguaagcaaaucucau

SEQ ID NO: 1153254 - RNA, 20 nt, Human
cacuccuuucucaaugcaaa

SEQ ID NO: 1153255 - RNA, 18 nt, Human
cagcagcaggaggggaga

SEQ ID NO: 1153256 - RNA, 20 nt, Human
cagcagcaggaggggagagg

SEQ ID NO: 1153257 - RNA, 18 nt, Human
cagcucacuccuuucuca

SEQ ID NO: 1153258 - RNA, 24 nt, Human
cagcugaugccuggaggacccuga

SEQ ID NO: 1153259 - RNA, 19 nt, Human
cagcugcagucugagacug

SEQ ID NO: 1153260 - RNA, 19 nt, Human
cagcuuacuugccagggaa

SEQ ID NO: 1153261 - RNA, 18 nt, Human
caggacagcucugucucu

SEQ ID NO: 1153262 - RNA, 20 nt, Human
caggccccuaaauaauucug

SEQ ID NO: 1153263 - RNA, 20 nt, Human
cagggaacacugugacucau

SEQ ID NO: 1153264 - RNA, 20 nt, Human
ccacuuaucaauauggguuc

SEQ ID NO: 1153265 - RNA, 27 nt, Human
ccaguaguuucccaccaaaucccaagg

SEQ ID NO: 1153266 - RNA, 21 nt, Human
cccaagcugcaguagcuggga

SEQ ID NO: 1153267 - RNA, 23 nt, Human
cccaguaguuucccaccaaaucc

SEQ ID NO: 1153268 - RNA, 20 nt, Human
cccuccuacccucuuccacc

SEQ ID NO: 1153269 - RNA, 19 nt, Human
ccuggacacugcuuuggga

SEQ ID NO: 1153270 - RNA, 18 nt, Human
cucacagggaaagaacaa

SEQ ID NO: 1153271 - RNA, 18 nt, Human
cucagaacacugccugac

SEQ ID NO: 1153272 - RNA, 26 nt, Human
cucagaaggacaaagcauucucagga

SEQ ID NO: 1153273 - RNA, 22 nt, Human
cucgcaguccccaagagcagcc

SEQ ID NO: 1153274 - RNA, 18 nt, Human
cucucugcuucucgcagu

SEQ ID NO: 1153275 - RNA, 25 nt, Human
cugcuaauggcaccagcaucccucc

SEQ ID NO: 1153276 - RNA, 20 nt, Human
gaagaugcuguuuaagggcc

SEQ ID NO: 1153277 - RNA, 22 nt, Human
gacccagcauuuucucuaaaua

SEQ ID NO: 1153278 - RNA, 18 nt, Human
gacugggaagaaaaagag

SEQ ID NO: 1153279 - RNA, 21 nt, Human
gaggagguggccggugaaugu

SEQ ID NO: 1153280 - RNA, 22 nt, Human
gcacuggguggucuguccuguc

SEQ ID NO: 1153281 - RNA, 22 nt, Human
gcaggccugcaggccacggggc

SEQ ID NO: 1153282 - RNA, 19 nt, Human
gcuaaaaaacaauaaccaa

SEQ ID NO: 1153283 - RNA, 21 nt, Human
gcugcaguagcugggaacucu

SEQ ID NO: 1153284 - RNA, 22 nt, Human
ggaaaggggcaaggaaaaacac

SEQ ID NO: 1153285 - RNA, 21 nt, Human
ggagaaaucaagacagauugc

SEQ ID NO: 1153286 - RNA, 21 nt, Human
ggcauaugggaagcuauaacc

SEQ ID NO: 1153287 - RNA, 20 nt, Human
gucccuuugcugccuccccu

SEQ ID NO: 1153288 - RNA, 22 nt, Human
guugccacaucagccccugacc

SEQ ID NO: 1153289 - RNA, 25 nt, Human
uaagggccucugggagucgagauuu

SEQ ID NO: 1153290 - RNA, 20 nt, Human
uacaaagagaggacacaaca

SEQ ID NO: 1153291 - RNA, 22 nt, Human
uacaaagagaggacacaacagc

SEQ ID NO: 1153292 - RNA, 19 nt, Human
uacaguauacaaaaguaag

SEQ ID NO: 1153293 - RNA, 19 nt, Human
uagcccucucugcuaaugg

SEQ ID NO: 1153294 - RNA, 22 nt, Human
uauacaaaaguaagcaaaucuc

SEQ ID NO: 1153295 - RNA, 21 nt, Human
uaucauuuccuucaucuacug

SEQ ID NO: 1153296 - RNA, 22 nt, Human
uauccuggacacugcuuuggga

SEQ ID NO: 1153297 - RNA, 25 nt, Human
uauggcuaaaaaacaauaaccaagg

SEQ ID NO: 1153298 - RNA, 24 nt, Human
uauuuucuuugucuuucucguagu

SEQ ID NO: 1153299 - RNA, 18 nt, Human
ucaagacagauugcagcc

SEQ ID NO: 1153300 - RNA, 23 nt, Human
ucacugauuauagaccuaagacc

SEQ ID NO: 1153301 - RNA, 20 nt, Human
ucagccccugaccacucaca

SEQ ID NO: 1153302 - RNA, 22 nt, Human
ucauauaugugacucuacagcu

SEQ ID NO: 1153303 - RNA, 19 nt, Human
uccacauggcuggggaggc

SEQ ID NO: 1153304 - RNA, 25 nt, Human
uccccuaacgugguuucuuggucac

SEQ ID NO: 1153305 - RNA, 21 nt, Human
ucccuuugcugccuccccugc

SEQ ID NO: 1153306 - RNA, 23 nt, Human
ucccuuugcugccuccccugcag

SEQ ID NO: 1153307 - RNA, 27 nt, Human
uccuggacacugcuuugggaaaacucc

SEQ ID NO: 1153308 - RNA, 18 nt, Human
ucuaaggcagcugagacc

SEQ ID NO: 1153309 - RNA, 23 nt, Human
ucucaggacagcucugucucuug

SEQ ID NO: 1153310 - RNA, 22 nt, Human
ugaaaaaucaggguaucuguug

SEQ ID NO: 1153311 - RNA, 24 nt, Human
ugaaaauggaaggaaucaugguau

SEQ ID NO: 1153312 - RNA, 25 nt, Human
ugacacauaugcuauucacuucaua

SEQ ID NO: 1153313 - RNA, 19 nt, Human
ugaccacucacaggugacg

SEQ ID NO: 1153314 - RNA, 19 nt, Human
ugacgcaguggccugucuc

SEQ ID NO: 1153315 - RNA, 21 nt, Human
ugauguggauggagauuugca

SEQ ID NO: 1153316 - RNA, 19 nt, Human
ugauuaggauaaaugcaca

SEQ ID NO: 1153317 - RNA, 18 nt, Human
ugcacaaaggcuggucag

SEQ ID NO: 1153318 - RNA, 21 nt, Human
ugcuguucaaggauggucugg

SEQ ID NO: 1153319 - RNA, 22 nt, Human
uggaaaauacaguauacaaaag

SEQ ID NO: 1153320 - RNA, 19 nt, Human
uggaaaggggcaaggaaaa

SEQ ID NO: 1153321 - RNA, 23 nt, Human
uggacacugcuuugggaaaacuc

SEQ ID NO: 1153322 - RNA, 22 nt, Human
uggaggacccugaacaggaucu

SEQ ID NO: 1153323 - RNA, 19 nt, Human
uggcaccagcaucccuccu

SEQ ID NO: 1153324 - RNA, 26 nt, Human
uggcaggagaugaaaggcacuucuua

SEQ ID NO: 1153325 - RNA, 22 nt, Human
uggcauaugggaagcuauaacc

SEQ ID NO: 1153326 - RNA, 22 nt, Human
uggcuaaaaaacaauaaccaag

SEQ ID NO: 1153327 - RNA, 23 nt, Human
uggucacguaagaugaaaaauca

SEQ ID NO: 1153328 - RNA, 21 nt, Human
ugucaaggagaagcuuauccc

SEQ ID NO: 1153329 - RNA, 20 nt, Human
uuccaguuucuuaacuacau

SEQ ID NO: 1153330 - RNA, 21 nt, Human
uucucaaugcaaacagcuuac

SEQ ID NO: 1153331 - RNA, 24 nt, Human
uucucagugcagucaaagaaaguu

SEQ ID NO: 1153332 - RNA, 18 nt, Human
uugaaaguccuuuagucu

SEQ ID NO: 1153333 - RNA, 18 nt, Human
uugucuuucucguagucc

SEQ ID NO: 1153334 - RNA, 21 nt, Human
caaaagaagcuguccaaaaug

SEQ ID NO: 1153335 - RNA, 24 nt, Human
caaaagcacccuggccagagcggu

SEQ ID NO: 1153336 - RNA, 23 nt, Human
ccuggccagagcggugaguccca

SEQ ID NO: 1153337 - RNA, 26 nt, Human
ucacugccuguauaaucaggucuuua

SEQ ID NO: 1153338 - RNA, 21 nt, Human
uccaaaagcacccuggccaga

SEQ ID NO: 1153339 - RNA, 25 nt, Human
uccaaaaugauuugaccuuuaugga

SEQ ID NO: 1153340 - RNA, 20 nt, Human
ugccuguauaaucaggucuu

SEQ ID NO: 1153341 - RNA, 19 nt, Human
aaagagaguccucagguug

SEQ ID NO: 1153342 - RNA, 18 nt, Human
aaagccucaaaguuuuac

SEQ ID NO: 1153343 - RNA, 21 nt, Human
acacgacucucuggugucccc

SEQ ID NO: 1153344 - RNA, 18 nt, Human
agacaaagaaucucucag

SEQ ID NO: 1153345 - RNA, 25 nt, Human
agaguccucagguuguucuucuugg

SEQ ID NO: 1153346 - RNA, 19 nt, Human
aggaacaaggagcucacaa

SEQ ID NO: 1153347 - RNA, 22 nt, Human
caacacaaggaccaagagucaa

SEQ ID NO: 1153348 - RNA, 19 nt, Human
caagagucaaaugcugaag

SEQ ID NO: 1153349 - RNA, 19 nt, Human
cacaacacaaggaccaaga

SEQ ID NO: 1153350 - RNA, 24 nt, Human
cacggucccacaagccucucucuu

SEQ ID NO: 1153351 - RNA, 19 nt, Human
cagaaagagaguccucagg

SEQ ID NO: 1153352 - RNA, 28 nt, Human
cagagggucuuuuucccguagaugaaau

SEQ ID NO: 1153353 - RNA, 27 nt, Human
cagcauaaaagcagcucucuaucucuu

SEQ ID NO: 1153354 - RNA, 20 nt, Human
ccccaugagagaggggcaaa

SEQ ID NO: 1153355 - RNA, 20 nt, Human
ccgaugcugagacuccaagu

SEQ ID NO: 1153356 - RNA, 21 nt, Human
ccucagguuguucuucuuggc

SEQ ID NO: 1153357 - RNA, 20 nt, Human
ccugagcaucugcugaugug

SEQ ID NO: 1153358 - RNA, 22 nt, Human
cuccucuggauuuacuaaagga

SEQ ID NO: 1153359 - RNA, 23 nt, Human
cugcuggggccgcggcaacaacg

SEQ ID NO: 1153360 - RNA, 26 nt, Human
gagaguccucagguuguucuucuugg

SEQ ID NO: 1153361 - RNA, 19 nt, Human
gagcucacaacacaaggac

SEQ ID NO: 1153362 - RNA, 18 nt, Human
gggccgcggcaacaacgg

SEQ ID NO: 1153363 - RNA, 19 nt, Human
ggucccggcucuccugcug

SEQ ID NO: 1153364 - RNA, 21 nt, Human
ggugaccccagccagcuuugc

SEQ ID NO: 1153365 - RNA, 26 nt, Human
uacuaaaggaguucaauuaccuccag

SEQ ID NO: 1153366 - RNA, 21 nt, Human
uagauacaaaagauguacuga

SEQ ID NO: 1153367 - RNA, 19 nt, Human
uaggucccggcucuccugc

SEQ ID NO: 1153368 - RNA, 23 nt, Human
uaucauagauacaaaagauguac

SEQ ID NO: 1153369 - RNA, 19 nt, Human
uauggugaccccagccagc

SEQ ID NO: 1153370 - RNA, 19 nt, Human
ucaucgagaacaugucuug

SEQ ID NO: 1153371 - RNA, 21 nt, Human
uccaaguauauuccucacacc

SEQ ID NO: 1153372 - RNA, 21 nt, Human
ucccguagaugaaaucucucu

SEQ ID NO: 1153373 - RNA, 22 nt, Human
ucccguagaugaaaucucucuu

SEQ ID NO: 1153374 - RNA, 24 nt, Human
uccucuggauuuacuaaaggaguu

SEQ ID NO: 1153375 - RNA, 23 nt, Human
ucucagauuucuccucuggauuu

SEQ ID NO: 1153376 - RNA, 23 nt, Human
ucucuaucucuuugacaggcaaa

SEQ ID NO: 1153377 - RNA, 19 nt, Human
ugaucucagauuucuccuc

SEQ ID NO: 1153378 - RNA, 26 nt, Human
ugcugagacuccaaguauauuccuca

SEQ ID NO: 1153379 - RNA, 21 nt, Human
uucauugaugaauuuuuuuuu

SEQ ID NO: 1153380 - RNA, 26 nt, Human
uugggauagagauuggagauucccua

SEQ ID NO: 1153381 - RNA, 21 nt, Human
uuucagagggucuuuuucccg

SEQ ID NO: 1153382 - RNA, 19 nt, Human
aaaaaaaaaaaaaaagcag

SEQ ID NO: 1153383 - RNA, 24 nt, Human
acuaaaaaaaaaaaaaaagcagac

SEQ ID NO: 1153384 - RNA, 24 nt, Human
cuaaaaaaaaaaaaaaagcagacu

SEQ ID NO: 1153385 - RNA, 22 nt, Human
gaacuaaaaaaaaaaaaaaagc

SEQ ID NO: 1153386 - RNA, 26 nt, Human
uauuuuuauugccuuuuauuuucaac

SEQ ID NO: 1153387 - RNA, 21 nt, Human
ugaacuaaaaaaaaaaaaaaa

SEQ ID NO: 1153388 - RNA, 24 nt, Human
ugaacuaaaaaaaaaaaaaaagca

SEQ ID NO: 1153389 - RNA, 24 nt, Human
uugaacuaaaaaaaaaaaaaaagc

SEQ ID NO: 1153390 - RNA, 21 nt, Human
aagacccugacccugcucugg

SEQ ID NO: 1153391 - RNA, 19 nt, Human
agagcuggggggaucugga

SEQ ID NO: 1153392 - RNA, 19 nt, Human
agcaagaagacccugaccc

SEQ ID NO: 1153393 - RNA, 21 nt, Human
agccacaggcccagcaggccc

SEQ ID NO: 1153394 - RNA, 23 nt, Human
aggagguaagccagccacuccag

SEQ ID NO: 1153395 - RNA, 19 nt, Human
agugguagauggugaagau

SEQ ID NO: 1153396 - RNA, 18 nt, Human
caccccugcuccagccac

SEQ ID NO: 1153397 - RNA, 19 nt, Human
caccccugcuccagccacc

SEQ ID NO: 1153398 - RNA, 24 nt, Human
caccccugcuccagccaccagggg

SEQ ID NO: 1153399 - RNA, 21 nt, Human
cacuccagccccaccgagcac

SEQ ID NO: 1153400 - RNA, 19 nt, Human
cagaaaaagaggaugaagg

SEQ ID NO: 1153401 - RNA, 21 nt, Human
cagcaggugcaccccugcucc

SEQ ID NO: 1153402 - RNA, 25 nt, Human
cagccacaggcccagcaggcccagg

SEQ ID NO: 1153403 - RNA, 19 nt, Human
cagccaccaggggcacagg

SEQ ID NO: 1153404 - RNA, 24 nt, Human
caggcccagcaggcccaggaguga

SEQ ID NO: 1153405 - RNA, 24 nt, Human
caggcccaggagugagguggcugg

SEQ ID NO: 1153406 - RNA, 19 nt, Human
cagggagcugcccacaacc

SEQ ID NO: 1153407 - RNA, 23 nt, Human
ccacaacccaaagggcggcugcc

SEQ ID NO: 1153408 - RNA, 21 nt, Human
ccacauagaggauccagcugu

SEQ ID NO: 1153409 - RNA, 23 nt, Human
ccacauagaggauccagcugugu

SEQ ID NO: 1153410 - RNA, 18 nt, Human
cgcgcucacacgcagccc

SEQ ID NO: 1153411 - RNA, 26 nt, Human
cggcggacccugggaauaggaggugc

SEQ ID NO: 1153412 - RNA, 22 nt, Human
cucggcggacccugggaauagg

SEQ ID NO: 1153413 - RNA, 18 nt, Human
gaagauggccacagccug

SEQ ID NO: 1153414 - RNA, 25 nt, Human
gaaggugagcagcaggugcaccccc

SEQ ID NO: 1153415 - RNA, 18 nt, Human
gacccugcucuggggcug

SEQ ID NO: 1153416 - RNA, 21 nt, Human
gagagcuggggggaucuggag

SEQ ID NO: 1153417 - RNA, 23 nt, Human
gagcggggccagguagcaagaag

SEQ ID NO: 1153418 - RNA, 21 nt, Human
gcacagggcguggcagccaca

SEQ ID NO: 1153419 - RNA, 23 nt, Human
gcucuggggcuggggcgcgugcu

SEQ ID NO: 1153420 - RNA, 20 nt, Human
ggcacaggggcccagaaaaa

SEQ ID NO: 1153421 - RNA, 24 nt, Human
ggggcuggggcgcgugcuaggggc

SEQ ID NO: 1153422 - RNA, 23 nt, Human
gguccgcggccgagagcuggggg

SEQ ID NO: 1153423 - RNA, 21 nt, Human
ggugaagauggccacagccug

SEQ ID NO: 1153424 - RNA, 18 nt, Human
guggcucucggcggaccc

SEQ ID NO: 1153425 - RNA, 21 nt, Human
uaagccagccacuccagcccc

SEQ ID NO: 1153426 - RNA, 18 nt, Human
uccagccccaccgagcac

SEQ ID NO: 1153427 - RNA, 19 nt, Human
ugaagauggccacagccug

SEQ ID NO: 1153428 - RNA, 18 nt, Human
ugagcagcaggugcaccc

SEQ ID NO: 1153429 - RNA, 24 nt, Human
ugaguccagucuuguucagggagc

SEQ ID NO: 1153430 - RNA, 19 nt, Human
ugcaggacccgaggcacag

SEQ ID NO: 1153431 - RNA, 20 nt, Human
uggcagccacaggcccagca

SEQ ID NO: 1153432 - RNA, 22 nt, Human
uuuucuguaaaaaaucguggcu

SEQ ID NO: 1153433 - RNA, 20 nt, Human
acaaacacaggcugugggcu

SEQ ID NO: 1153434 - RNA, 19 nt, Human
acacaggcugugggcugga

SEQ ID NO: 1153435 - RNA, 19 nt, Human
uuacaaacacaggcugugg

SEQ ID NO: 1153436 - RNA, 19 nt, Human
aacagugaagguuuuucug

SEQ ID NO: 1153437 - RNA, 23 nt, Human
agaaauugacagaugauagauaa

SEQ ID NO: 1153438 - RNA, 25 nt, Human
cauuuuauaucuguaccuuauguaa

SEQ ID NO: 1153439 - RNA, 24 nt, Human
cccaugaagagaaaacuuccugaa

SEQ ID NO: 1153440 - RNA, 25 nt, Human
gcuuuuucugcauuuuauaucugua

SEQ ID NO: 1153441 - RNA, 23 nt, Human
uauaaaauaaaauaaaaggcaga

SEQ ID NO: 1153442 - RNA, 25 nt, Human
uaucccaugaagagaaaacuuccug

SEQ ID NO: 1153443 - RNA, 18 nt, Human
ugaugcuuuuucugcauu

SEQ ID NO: 1153444 - RNA, 24 nt, Human
uuauguaacagugaagguuuuucu

SEQ ID NO: 1153445 - RNA, 27 nt, Human
uucaauauuuauuuuauuaagaauaca

SEQ ID NO: 1153446 - RNA, 23 nt, Human
aacauaaguaggagggcaguuug

SEQ ID NO: 1153447 - RNA, 23 nt, Human
caacggggucugugucacaggcu

SEQ ID NO: 1153448 - RNA, 18 nt, Human
gagcaacggggucugugu

SEQ ID NO: 1153449 - RNA, 23 nt, Human
gagccucagcuuccucuccuggu

SEQ ID NO: 1153450 - RNA, 20 nt, Human
gccauuuucagcuucuccca

SEQ ID NO: 1153451 - RNA, 19 nt, Human
uaggagggcaguuugcuuc

SEQ ID NO: 1153452 - RNA, 19 nt, Human
uaggaugggaaagucuuca

SEQ ID NO: 1153453 - RNA, 23 nt, Human
uaugugagcaacggggucugugu

SEQ ID NO: 1153454 - RNA, 19 nt, Human
ucacaggcucaccaggcac

SEQ ID NO: 1153455 - RNA, 19 nt, Human
ucaccaggcacagggcagc

SEQ ID NO: 1153456 - RNA, 22 nt, Human
ucugccauuuucagcuucuccc

SEQ ID NO: 1153457 - RNA, 18 nt, Human
ugcuucucugagccucag

SEQ ID NO: 1153458 - RNA, 25 nt, Human
ugucacaggcucaccaggcacaggg

SEQ ID NO: 1153459 - RNA, 23 nt, Human
ugugagcaacggggucuguguca

SEQ ID NO: 1153460 - RNA, 21 nt, Human
uugcaaccugccuaccaccua

SEQ ID NO: 1153461 - RNA, 22 nt, Human
uuuucagcuucucccaccuggg

SEQ ID NO: 1153462 - RNA, 19 nt, Human
aagcgcugcucaagaguga

SEQ ID NO: 1153463 - RNA, 23 nt, Human
aucuggcacagggggaccuccag

SEQ ID NO: 1153464 - RNA, 19 nt, Human
augguggcuggacucuucu

SEQ ID NO: 1153465 - RNA, 23 nt, Human
cagagggccuuucuuuagggcuu

SEQ ID NO: 1153466 - RNA, 19 nt, Human
cagcauucccagagcacac

SEQ ID NO: 1153467 - RNA, 21 nt, Human
cccuggagaguggggaccugg

SEQ ID NO: 1153468 - RNA, 22 nt, Human
ccuggagaguggggaccuggga

SEQ ID NO: 1153469 - RNA, 20 nt, Human
cucuugggaugugggcucag

SEQ ID NO: 1153470 - RNA, 23 nt, Human
cugguggugguugugguacuccu

SEQ ID NO: 1153471 - RNA, 21 nt, Human
cugguugguagccacuuucuu

SEQ ID NO: 1153472 - RNA, 18 nt, Human
cuguguaugggcucccca

SEQ ID NO: 1153473 - RNA, 22 nt, Human
gaagggaccuuaccaaccagag

SEQ ID NO: 1153474 - RNA, 19 nt, Human
gaggcuguccaggccugag

SEQ ID NO: 1153475 - RNA, 21 nt, Human
gcagggucugggggacauggc

SEQ ID NO: 1153476 - RNA, 18 nt, Human
ggagaguggggaccuggg

SEQ ID NO: 1153477 - RNA, 23 nt, Human
gggcuuugggacccugguuggua

SEQ ID NO: 1153478 - RNA, 20 nt, Human
ggggaccugggacagucagg

SEQ ID NO: 1153479 - RNA, 19 nt, Human
ggugguugugguacuccug

SEQ ID NO: 1153480 - RNA, 21 nt, Human
guagcacugguggugguugug

SEQ ID NO: 1153481 - RNA, 21 nt, Human
guagccacuuucuugaugagc

SEQ ID NO: 1153482 - RNA, 18 nt, Human
uaccaaccagaguccagc

SEQ ID NO: 1153483 - RNA, 18 nt, Human
uacuccuggauacguccu

SEQ ID NO: 1153484 - RNA, 21 nt, Human
uccagcauucccagagcacac

SEQ ID NO: 1153485 - RNA, 22 nt, Human
uccccagcucucguuccuccac

SEQ ID NO: 1153486 - RNA, 22 nt, Human
uccccgaugggcucacagaacc

SEQ ID NO: 1153487 - RNA, 21 nt, Human
ucuggcacagggggaccucca

SEQ ID NO: 1153488 - RNA, 24 nt, Human
ugagcagagggccuuucuuuaggg

SEQ ID NO: 1153489 - RNA, 24 nt, Human
ugagguugggcuuugggacccugg

SEQ ID NO: 1153490 - RNA, 20 nt, Human
ugccuuuaggcucugggccu

SEQ ID NO: 1153491 - RNA, 18 nt, Human
ugcuggaagggaccuuac

SEQ ID NO: 1153492 - RNA, 19 nt, Human
uggagaguggggaccuggg

SEQ ID NO: 1153493 - RNA, 19 nt, Human
uggcuggacucuucuucuc

SEQ ID NO: 1153494 - RNA, 23 nt, Human
ugggacccugguugguagccacu

SEQ ID NO: 1153495 - RNA, 19 nt, Human
ugggaugugggcucagugg

SEQ ID NO: 1153496 - RNA, 18 nt, Human
uggggaccugggacaguc

SEQ ID NO: 1153497 - RNA, 19 nt, Human
uggggaccugggacaguca

SEQ ID NO: 1153498 - RNA, 18 nt, Human
ugguagcacugguggugg

SEQ ID NO: 1153499 - RNA, 22 nt, Human
uggugguugugguacuccugga

SEQ ID NO: 1153500 - RNA, 23 nt, Human
uugaugagcagagggccuuucuu

SEQ ID NO: 1153501 - RNA, 21 nt, Human
uuuggcacuguccuugccuuu

SEQ ID NO: 1153502 - RNA, 18 nt, Human
aaacaaacaaaaaaaacc

SEQ ID NO: 1153503 - RNA, 20 nt, Human
aaacaaacaaaaaaaaccca

SEQ ID NO: 1153504 - RNA, 23 nt, Human
aaacaaacaaacaaaaaaaaccc

SEQ ID NO: 1153505 - RNA, 22 nt, Human
aaacccugucucuacuaaaaaa

SEQ ID NO: 1153506 - RNA, 23 nt, Human
aaacucacaacuaacugcuuuag

SEQ ID NO: 1153507 - RNA, 22 nt, Human
aaagaaggcaaauuuaaauuaa

SEQ ID NO: 1153508 - RNA, 19 nt, Human
aacacggugaaacccuguc

SEQ ID NO: 1153509 - RNA, 20 nt, Human
aacacggugaaacccugucu

SEQ ID NO: 1153510 - RNA, 21 nt, Human
aacacggugaaacccugucuc

SEQ ID NO: 1153511 - RNA, 22 nt, Human
aacuuaucuuucccucuuucug

SEQ ID NO: 1153512 - RNA, 18 nt, Human
aagugugaugauaugacc

SEQ ID NO: 1153513 - RNA, 22 nt, Human
aaguuauaguccuauuugaaac

SEQ ID NO: 1153514 - RNA, 18 nt, Human
aauuucacuagccuaaaa

SEQ ID NO: 1153515 - RNA, 23 nt, Human
acagagugagacuccaucucaaa

SEQ ID NO: 1153516 - RNA, 25 nt, Human
acccugucucuacuaaaaaauacaa

SEQ ID NO: 1153517 - RNA, 24 nt, Human
acuccagccugggugacagaguga

SEQ ID NO: 1153518 - RNA, 22 nt, Human
acuccaucucaaacaaacaaac

SEQ ID NO: 1153519 - RNA, 24 nt, Human
acugcacuccagccugggugacag

SEQ ID NO: 1153520 - RNA, 26 nt, Human
acugcacuccagccugggugacagag

SEQ ID NO: 1153521 - RNA, 24 nt, Human
agagaucauaggccuuuuggacaa

SEQ ID NO: 1153522 - RNA, 24 nt, Human
agcacuuugggaggccgaggcagg

SEQ ID NO: 1153523 - RNA, 19 nt, Human
agccauugguuuaagggcu

SEQ ID NO: 1153524 - RNA, 24 nt, Human
agccugggugacagagugagacuc

SEQ ID NO: 1153525 - RNA, 23 nt, Human
agcugggugugguggcaugugcc

SEQ ID NO: 1153526 - RNA, 18 nt, Human
aggcaggaggaucacuug

SEQ ID NO: 1153527 - RNA, 22 nt, Human
aggcaggaggaucacuugaacc

SEQ ID NO: 1153528 - RNA, 18 nt, Human
aggcagguggaucaccug

SEQ ID NO: 1153529 - RNA, 26 nt, Human
aggcagguggaucaccugaugucagg

SEQ ID NO: 1153530 - RNA, 24 nt, Human
aggcaugguggcucaugccuguaa

SEQ ID NO: 1153531 - RNA, 21 nt, Human
aggccgaggcagguggaucac

SEQ ID NO: 1153532 - RNA, 20 nt, Human
aggcggagguugcagugagc

SEQ ID NO: 1153533 - RNA, 24 nt, Human
aggcggagguugcagugagcugag

SEQ ID NO: 1153534 - RNA, 24 nt, Human
aggcugaggcaggaggaucacuug

SEQ ID NO: 1153535 - RNA, 24 nt, Human
agguggaucaccugaugucaggag

SEQ ID NO: 1153536 - RNA, 19 nt, Human
augccuguaaucccagcac

SEQ ID NO: 1153537 - RNA, 24 nt, Human
auuucgccacugcacuccagccug

SEQ ID NO: 1153538 - RNA, 22 nt, Human
caaacaaacaaaaaaaacccau

SEQ ID NO: 1153539 - RNA, 22 nt, Human
caaacaaacaaacaaaaaaaac

SEQ ID NO: 1153540 - RNA, 25 nt, Human
caaacaaacaaacaaacaaaaaaaa

SEQ ID NO: 1153541 - RNA, 24 nt, Human
caacacggugaaacccugucucua

SEQ ID NO: 1153542 - RNA, 24 nt, Human
caacagaaaucagguauuuucaug

SEQ ID NO: 1153543 - RNA, 22 nt, Human
caaugacgagugcagacaacaa

SEQ ID NO: 1153544 - RNA, 22 nt, Human
cacuccagccugggugacagag

SEQ ID NO: 1153545 - RNA, 22 nt, Human
cacuccagccugggugacagag

SEQ ID NO: 1153546 - RNA, 24 nt, Human
cacuccagccugggugacagagug

SEQ ID NO: 1153547 - RNA, 19 nt, Human
cacugcacuccagccuggg

SEQ ID NO: 1153548 - RNA, 19 nt, Human
cacugcacuccagccuggg

SEQ ID NO: 1153549 - RNA, 19 nt, Human
cacugcacuccagccuggg

SEQ ID NO: 1153550 - RNA, 22 nt, Human
cacugcacuccagccuggguga

SEQ ID NO: 1153551 - RNA, 24 nt, Human
cacugcacuccagccugggugaca

SEQ ID NO: 1153552 - RNA, 25 nt, Human
cacugcacuccagccugggugacag

SEQ ID NO: 1153553 - RNA, 24 nt, Human
cagcacuuugggaggccgaggcag

SEQ ID NO: 1153554 - RNA, 26 nt, Human
cagcacuuugggaggccgaggcaggu

SEQ ID NO: 1153555 - RNA, 24 nt, Human
cagcuacuugggaggcugaggcag

SEQ ID NO: 1153556 - RNA, 31 nt, Human
caucucaaacaaacaaacaaacaaaaaaaac

SEQ ID NO: 1153557 - RNA, 20 nt, Human
caugccuguaaucccagcac

SEQ ID NO: 1153558 - RNA, 24 nt, Human
caugccuguaaucccagcacuuug

SEQ ID NO: 1153559 - RNA, 20 nt, Human
ccacugcacuccagccuggg

SEQ ID NO: 1153560 - RNA, 20 nt, Human
ccacugcacuccagccuggg

SEQ ID NO: 1153561 - RNA, 21 nt, Human
ccacugcacuccagccugggu

SEQ ID NO: 1153562 - RNA, 21 nt, Human
ccacugcacuccagccugggu

SEQ ID NO: 1153563 - RNA, 24 nt, Human
ccacugcacuccagccugggugac

SEQ ID NO: 1153564 - RNA, 25 nt, Human
cccuuguaaccccaugcauuuccuu

SEQ ID NO: 1153565 - RNA, 22 nt, Human
ccucagaaaauauguccucucu

SEQ ID NO: 1153566 - RNA, 23 nt, Human
ccugaugucaggaguucaagauc

SEQ ID NO: 1153567 - RNA, 22 nt, Human
ccugggugacagagugagacuc

SEQ ID NO: 1153568 - RNA, 18 nt, Human
ccuguaaucccagcuacu

SEQ ID NO: 1153569 - RNA, 19 nt, Human
ccuguaaucccagcuacuu

SEQ ID NO: 1153570 - RNA, 21 nt, Human
ccuguaaucccagcuacuugg

SEQ ID NO: 1153571 - RNA, 22 nt, Human
ccuguaaucccagcuacuuggg

SEQ ID NO: 1153572 - RNA, 23 nt, Human
ccuuguguaguuaucugcaugac

SEQ ID NO: 1153573 - RNA, 20 nt, Human
cgaggcagguggaucaccug

SEQ ID NO: 1153574 - RNA, 23 nt, Human
cgccaacacggugaaacccuguc

SEQ ID NO: 1153575 - RNA, 26 nt, Human
cgccacugcacuccagccugggugac

SEQ ID NO: 1153576 - RNA, 19 nt, Human
cuaaaacuauaaaccucag

SEQ ID NO: 1153577 - RNA, 19 nt, Human
cuacuaaaaaauacaaaaa

SEQ ID NO: 1153578 - RNA, 19 nt, Human
cucaaacaaacaaacaaac

SEQ ID NO: 1153579 - RNA, 23 nt, Human
cucaugccuguaaucccagcacu

SEQ ID NO: 1153580 - RNA, 24 nt, Human
cucaugccuguaaucccagcacuu

SEQ ID NO: 1153581 - RNA, 21 nt, Human
cucgccaacacggugaaaccc

SEQ ID NO: 1153582 - RNA, 21 nt, Human
cucgccaacacggugaaaccc

SEQ ID NO: 1153583 - RNA, 18 nt, Human
gaaaauauguccucucuc

SEQ ID NO: 1153584 - RNA, 19 nt, Human
gaaacccugucucuacuaa

SEQ ID NO: 1153585 - RNA, 23 nt, Human
gaaaucauugaaaaugaaauaag

SEQ ID NO: 1153586 - RNA, 21 nt, Human
gaaguaucauuggccuuugaa

SEQ ID NO: 1153587 - RNA, 23 nt, Human
gagauuucgccacugcacuccag

SEQ ID NO: 1153588 - RNA, 25 nt, Human
gaggcagguggaucaccugauguca

SEQ ID NO: 1153589 - RNA, 22 nt, Human
gagguugcagugagcugagauu

SEQ ID NO: 1153590 - RNA, 18 nt, Human
gaucaccugaugucagga

SEQ ID NO: 1153591 - RNA, 24 nt, Human
gaucaccugaugucaggaguucaa

SEQ ID NO: 1153592 - RNA, 20 nt, Human
gcacaccuauaacuaccaca

SEQ ID NO: 1153593 - RNA, 24 nt, Human
gcacuccagccugggugacagagu

SEQ ID NO: 1153594 - RNA, 21 nt, Human
gccaacacggugaaacccugu

SEQ ID NO: 1153595 - RNA, 24 nt, Human
gccaacacggugaaacccugucuc

SEQ ID NO: 1153596 - RNA, 19 nt, Human
gccacugcacuccagccug

SEQ ID NO: 1153597 - RNA, 24 nt, Human
gccacugcacuccagccuggguga

SEQ ID NO: 1153598 - RNA, 22 nt, Human
gccaggcaugguggcucaugcc

SEQ ID NO: 1153599 - RNA, 20 nt, Human
gccuguaaucccagcuacuu

SEQ ID NO: 1153600 - RNA, 22 nt, Human
ggaggcggagguugcagugagc

SEQ ID NO: 1153601 - RNA, 18 nt, Human
ggagguugcagugagcug

SEQ ID NO: 1153602 - RNA, 22 nt, Human
ggagguugcagugagcugagau

SEQ ID NO: 1153603 - RNA, 22 nt, Human
ggagguugcagugagcugagau

SEQ ID NO: 1153604 - RNA, 25 nt, Human
ggagguugcagugagcugagauuuc

SEQ ID NO: 1153605 - RNA, 21 nt, Human
ggcucaugccuguaaucccag

SEQ ID NO: 1153606 - RNA, 24 nt, Human
gggugugguggcaugugccuguaa

SEQ ID NO: 1153607 - RNA, 20 nt, Human
ggguucuuaaccuacaauuc

SEQ ID NO: 1153608 - RNA, 24 nt, Human
gguggcaugugccuguaaucccag

SEQ ID NO: 1153609 - RNA, 24 nt, Human
gguggcucaugccuguaaucccag

SEQ ID NO: 1153610 - RNA, 18 nt, Human
gugauaaggaucugacaa

SEQ ID NO: 1153611 - RNA, 21 nt, Human
guggaucaccugaugucagga

SEQ ID NO: 1153612 - RNA, 19 nt, Human
guugcagugagcugagauu

SEQ ID NO: 1153613 - RNA, 25 nt, Human
uaaaguaucaaaggaucucugugcu

SEQ ID NO: 1153614 - RNA, 25 nt, Human
uaagauauaaucuaucaaaacaaaa

SEQ ID NO: 1153615 - RNA, 21 nt, Human
uacaauucacagaccucuaag

SEQ ID NO: 1153616 - RNA, 21 nt, Human
uagcaauuugcugccguagca

SEQ ID NO: 1153617 - RNA, 19 nt, Human
uagcaguaacuuugucaac

SEQ ID NO: 1153618 - RNA, 23 nt, Human
uagcaguaacuuugucaacagaa

SEQ ID NO: 1153619 - RNA, 20 nt, Human
uagcaguaacuuugucaacc

SEQ ID NO: 1153620 - RNA, 22 nt, Human
uagcugggugugguggcaugug

SEQ ID NO: 1153621 - RNA, 22 nt, Human
uaggaaaucauugaaaaugaaa

SEQ ID NO: 1153622 - RNA, 22 nt, Human
uaggaguaagauauaaucuauc

SEQ ID NO: 1153623 - RNA, 20 nt, Human
uauaaaguuaugagaucuuu

SEQ ID NO: 1153624 - RNA, 24 nt, Human
uaucaaaacaaaacaucacauaac

SEQ ID NO: 1153625 - RNA, 25 nt, Human
uaucaaaacaaaacaucacauaaca

SEQ ID NO: 1153626 - RNA, 19 nt, Human
uaucaaaaugcuuacaaca

SEQ ID NO: 1153627 - RNA, 23 nt, Human
ucaccugaugucaggaguucaag

SEQ ID NO: 1153628 - RNA, 24 nt, Human
ucacuagaacaggauuuuaguuau

SEQ ID NO: 1153629 - RNA, 21 nt, Human
ucacuagccuaaaacuaaaau

SEQ ID NO: 1153630 - RNA, 23 nt, Human
ucagaaaauauguccucucucag

SEQ ID NO: 1153631 - RNA, 23 nt, Human
uccagccugggugacagagugag

SEQ ID NO: 1153632 - RNA, 24 nt, Human
uccagccugggugacagagugaga

SEQ ID NO: 1153633 - RNA, 25 nt, Human
ucccuuguaaccccaugcauuuccu

SEQ ID NO: 1153634 - RNA, 24 nt, Human
ucucgccaacacggugaaacccug

SEQ ID NO: 1153635 - RNA, 22 nt, Human
ucucuacuaaaaaauacaaaaa

SEQ ID NO: 1153636 - RNA, 24 nt, Human
ucuggccaggcaugguggcucaug

SEQ ID NO: 1153637 - RNA, 20 nt, Human
ugacacaaaaaaguuaaagu

SEQ ID NO: 1153638 - RNA, 22 nt, Human
ugacaugaaaugugaauaauau

SEQ ID NO: 1153639 - RNA, 22 nt, Human
ugagcugagauuucgccacugc

SEQ ID NO: 1153640 - RNA, 20 nt, Human
ugaggcaggaggaucacuug

SEQ ID NO: 1153641 - RNA, 24 nt, Human
ugaggcaggaggaucacuugaacc

SEQ ID NO: 1153642 - RNA, 25 nt, Human
ugaggcaggaggaucacuugaaccu

SEQ ID NO: 1153643 - RNA, 26 nt, Human
ugcacaccuauaacuaccacaucaua

SEQ ID NO: 1153644 - RNA, 18 nt, Human
ugcaugacauucacuaga

SEQ ID NO: 1153645 - RNA, 22 nt, Human
ugcaugacauucacuagaacag

SEQ ID NO: 1153646 - RNA, 23 nt, Human
ugccuguaaucccagcacuuugg

SEQ ID NO: 1153647 - RNA, 24 nt, Human
ugccuguaaucccagcacuuuggg

SEQ ID NO: 1153648 - RNA, 24 nt, Human
ugccuguaaucccagcuacuuggg

SEQ ID NO: 1153649 - RNA, 21 nt, Human
ugcuaagaagagaucauaggc

SEQ ID NO: 1153650 - RNA, 27 nt, Human
ugcuuuagccauugguuuaagggcuug

SEQ ID NO: 1153651 - RNA, 24 nt, Human
uggaucaccugaugucaggaguuc

SEQ ID NO: 1153652 - RNA, 21 nt, Human
uggcaugugccuguaauccca

SEQ ID NO: 1153653 - RNA, 22 nt, Human
uggcaugugccuguaaucccag

SEQ ID NO: 1153654 - RNA, 24 nt, Human
uggcaugugccuguaaucccagcu

SEQ ID NO: 1153655 - RNA, 24 nt, Human
uggccaggcaugguggcucaugcc

SEQ ID NO: 1153656 - RNA, 22 nt, Human
uggcucaugccuguaaucccag

SEQ ID NO: 1153657 - RNA, 24 nt, Human
uggcucaugccuguaaucccagca

SEQ ID NO: 1153658 - RNA, 24 nt, Human
ugggaggccgaggcagguggauca

SEQ ID NO: 1153659 - RNA, 20 nt, Human
ugggaggcugaggcaggagg

SEQ ID NO: 1153660 - RNA, 24 nt, Human
ugggaggcugaggcaggaggauca

SEQ ID NO: 1153661 - RNA, 18 nt, Human
ugggugugguggcaugug

SEQ ID NO: 1153662 - RNA, 24 nt, Human
ugguggcaugugccuguaauccca

SEQ ID NO: 1153663 - RNA, 24 nt, Human
ugguggcucaugccuguaauccca

SEQ ID NO: 1153664 - RNA, 21 nt, Human
uguaguuaucugcaugacauu

SEQ ID NO: 1153665 - RNA, 20 nt, Human
ugucaggaguucaagaucag

SEQ ID NO: 1153666 - RNA, 19 nt, Human
ugugcuagguuggacaaau

SEQ ID NO: 1153667 - RNA, 19 nt, Human
uuagcugggugugguggca

SEQ ID NO: 1153668 - RNA, 20 nt, Human
uuagcugggugugguggcau

SEQ ID NO: 1153669 - RNA, 24 nt, Human
uuagcugggugugguggcaugugc

SEQ ID NO: 1153670 - RNA, 20 nt, Human
uuccaauaagaaacagaugg

SEQ ID NO: 1153671 - RNA, 24 nt, Human
uucugcauuuaaaaacauuauucu

SEQ ID NO: 1153672 - RNA, 25 nt, Human
uugaaccucaggaggcggagguugc

SEQ ID NO: 1153673 - RNA, 19 nt, Human
uugcagauaucuaauauau

SEQ ID NO: 1153674 - RNA, 21 nt, Human
uugcagugagcugagauuucc

SEQ ID NO: 1153675 - RNA, 21 nt, Human
uugcagugagcugagauuucg

SEQ ID NO: 1153676 - RNA, 22 nt, Human
uugcagugagcugagauuucgc

SEQ ID NO: 1153677 - RNA, 25 nt, Human
uugggaggccgaggcagguggauca

SEQ ID NO: 1153678 - RNA, 25 nt, Human
uugggaggcugaggcaggaggauca

SEQ ID NO: 1153679 - RNA, 21 nt, Human
aaaagaaaauaggcuauagaa

SEQ ID NO: 1153680 - RNA, 20 nt, Human
aagaagcagaguagcaucag

SEQ ID NO: 1153681 - RNA, 18 nt, Human
acaguccgccugcagcug

SEQ ID NO: 1153682 - RNA, 21 nt, Human
aggccucacugcuaaggcagu

SEQ ID NO: 1153683 - RNA, 20 nt, Human
caaagugugcaccggccugc

SEQ ID NO: 1153684 - RNA, 21 nt, Human
cacaauagacaguuauacaaa

SEQ ID NO: 1153685 - RNA, 18 nt, Human
cacugcuaaggcagugac

SEQ ID NO: 1153686 - RNA, 22 nt, Human
cagcgaagaagcagaguagcau

SEQ ID NO: 1153687 - RNA, 23 nt, Human
cccgcuccuacaaagugugcacc

SEQ ID NO: 1153688 - RNA, 23 nt, Human
ccgcgcgcgcacuuacaguccgc

SEQ ID NO: 1153689 - RNA, 18 nt, Human
cgaagaagcagaguagca

SEQ ID NO: 1153690 - RNA, 22 nt, Human
cggccugccgggccagcgaaga

SEQ ID NO: 1153691 - RNA, 19 nt, Human
cuaaggcagugaccgccua

SEQ ID NO: 1153692 - RNA, 22 nt, Human
cuacaaagugugcaccggccug

SEQ ID NO: 1153693 - RNA, 22 nt, Human
gaggccucacugcuaaggcagu

SEQ ID NO: 1153694 - RNA, 23 nt, Human
gaggccucacugcuaaggcagug

SEQ ID NO: 1153695 - RNA, 18 nt, Human
gccagcgaagaagcagag

SEQ ID NO: 1153696 - RNA, 23 nt, Human
ggagguccuuugucacccugccc

SEQ ID NO: 1153697 - RNA, 21 nt, Human
ggccugccgggccagcgaaga

SEQ ID NO: 1153698 - RNA, 23 nt, Human
ggcuacacgagccucggcgccag

SEQ ID NO: 1153699 - RNA, 18 nt, Human
gggcuggggcuacaaaga

SEQ ID NO: 1153700 - RNA, 23 nt, Human
gugcaccggccugccgggccagc

SEQ ID NO: 1153701 - RNA, 19 nt, Human
uaauacagucauuaucuuu

SEQ ID NO: 1153702 - RNA, 20 nt, Human
uacucuguggagguccuuug

SEQ ID NO: 1153703 - RNA, 20 nt, Human
uaugacaaagcccgcuccua

SEQ ID NO: 1153704 - RNA, 18 nt, Human
ucccgagguuugaggggc

SEQ ID NO: 1153705 - RNA, 23 nt, Human
ucuguggagguccuuugucaccc

SEQ ID NO: 1153706 - RNA, 18 nt, Human
ugcugagcuagggcuggg

SEQ ID NO: 1153707 - RNA, 25 nt, Human
uugcagggaggaguucccgagguuu

SEQ ID NO: 1153708 - RNA, 24 nt, Human
agagguggugauagugccaggccc

SEQ ID NO: 1153709 - RNA, 21 nt, Human
auagugccaggcccucugcag

SEQ ID NO: 1153710 - RNA, 20 nt, Human
caggcaaggaggcggagggc

SEQ ID NO: 1153711 - RNA, 27 nt, Human
cccucugcaggcaaggaggcggagggc

SEQ ID NO: 1153712 - RNA, 18 nt, Human
ccucugcaggcaaggagg

SEQ ID NO: 1153713 - RNA, 22 nt, Human
ccucugcaggcaaggaggcgga

SEQ ID NO: 1153714 - RNA, 23 nt, Human
ccucuggcuuaaagcagaagcug

SEQ ID NO: 1153715 - RNA, 21 nt, Human
uauuggcaugaaggcagagag

SEQ ID NO: 1153716 - RNA, 18 nt, Human
uggcaugaaggcagagag

SEQ ID NO: 1153717 - RNA, 19 nt, Human
ugugaggcauuggauaugu

SEQ ID NO: 1153718 - RNA, 26 nt, Human
aagccccccaaaaaccucuacaagaa

SEQ ID NO: 1153719 - RNA, 21 nt, Human
aaggacuuuugagagagucaa

SEQ ID NO: 1153720 - RNA, 20 nt, Human
acacacacacacgcacauau

SEQ ID NO: 1153721 - RNA, 19 nt, Human
agggagaggggagaaagga

SEQ ID NO: 1153722 - RNA, 24 nt, Human
auuccccuaaagccccccaaaaac

SEQ ID NO: 1153723 - RNA, 22 nt, Human
auuguucuguuauuuucauuca

SEQ ID NO: 1153724 - RNA, 18 nt, Human
cccccaaaaaccucuaca

SEQ ID NO: 1153725 - RNA, 20 nt, Human
cccccaaaaaccucuacaag

SEQ ID NO: 1153726 - RNA, 21 nt, Human
ccccuaaagccccccaaaaac

SEQ ID NO: 1153727 - RNA, 24 nt, Human
ccccuaaagccccccaaaaaccuc

SEQ ID NO: 1153728 - RNA, 23 nt, Human
gagagucaagucauggggcaggg

SEQ ID NO: 1153729 - RNA, 22 nt, Human
ggcaggggcgcagugggauucu

SEQ ID NO: 1153730 - RNA, 20 nt, Human
uaaagccccccaaaaaccuc

SEQ ID NO: 1153731 - RNA, 22 nt, Human
uaaagccccccaaaaaccucua

SEQ ID NO: 1153732 - RNA, 26 nt, Human
uacacacacacacgcacauauguuag

SEQ ID NO: 1153733 - RNA, 21 nt, Human
uauuaauuccccuaaagcccc

SEQ ID NO: 1153734 - RNA, 23 nt, Human
ucauggggcaggggcgcaguggg

SEQ ID NO: 1153735 - RNA, 21 nt, Human
uccccuaaagccccccaaaaa

SEQ ID NO: 1153736 - RNA, 23 nt, Human
ugaagggagaggggagaaaggac

SEQ ID NO: 1153737 - RNA, 19 nt, Human
uuccccuaaagccccccaa

SEQ ID NO: 1153738 - RNA, 24 nt, Human
uuuacacacacacacgcacauaug

SEQ ID NO: 1153739 - RNA, 24 nt, Human
acuguguugcccaggcuggucuug

SEQ ID NO: 1153740 - RNA, 25 nt, Human
acuguguugcccaggcuggucuuga

SEQ ID NO: 1153741 - RNA, 21 nt, Human
augauuuuguuuuguagauca

SEQ ID NO: 1153742 - RNA, 19 nt, Human
auuccuggcugaguuccca

SEQ ID NO: 1153743 - RNA, 23 nt, Human
caacacccugggauggaaggaga

SEQ ID NO: 1153744 - RNA, 19 nt, Human
cacuguguugcccaggcug

SEQ ID NO: 1153745 - RNA, 21 nt, Human
cacuguguugcccaggcuggu

SEQ ID NO: 1153746 - RNA, 24 nt, Human
cacuguguugcccaggcuggucuu

SEQ ID NO: 1153747 - RNA, 26 nt, Human
ccucacuguguugcccaggcuggucu

SEQ ID NO: 1153748 - RNA, 27 nt, Human
ccucacuguguugcccaggcuggucuu

SEQ ID NO: 1153749 - RNA, 18 nt, Human
cuccucuuccacuccuuc

SEQ ID NO: 1153750 - RNA, 20 nt, Human
gaggauguggguagggggcc

SEQ ID NO: 1153751 - RNA, 19 nt, Human
ggaaggagauugcggggac

SEQ ID NO: 1153752 - RNA, 22 nt, Human
gggccucacuguguugcccagg

SEQ ID NO: 1153753 - RNA, 24 nt, Human
gggggccucacuguguugcccagg

SEQ ID NO: 1153754 - RNA, 19 nt, Human
guagaucaugaggauucau

SEQ ID NO: 1153755 - RNA, 24 nt, Human
uagguuacaugaucugaaaguaca

SEQ ID NO: 1153756 - RNA, 18 nt, Human
ucacuguggaguccuagu

SEQ ID NO: 1153757 - RNA, 23 nt, Human
ucccuccuuuaguacauuguauu

SEQ ID NO: 1153758 - RNA, 24 nt, Human
ugcccaggcuggucuugaauuccu

SEQ ID NO: 1153759 - RNA, 19 nt, Human
ugcggggacggagaggaug

SEQ ID NO: 1153760 - RNA, 24 nt, Human
uggcugaguucccagacucaaguu

SEQ ID NO: 1153761 - RNA, 19 nt, Human
ugggauggaaggagauugc

SEQ ID NO: 1153762 - RNA, 27 nt, Human
uggguuuucagacauacagaaagggau

SEQ ID NO: 1153763 - RNA, 19 nt, Human
ugucuccucuuccacuccu

SEQ ID NO: 1153764 - RNA, 20 nt, Human
ugucuccucuuccacuccuu

SEQ ID NO: 1153765 - RNA, 24 nt, Human
uguguugcccaggcuggucuugaa

SEQ ID NO: 1153766 - RNA, 22 nt, Human
uguugcccaggcuggucuugaa

SEQ ID NO: 1153767 - RNA, 18 nt, Human
uuagauggggcuguguca

SEQ ID NO: 1153768 - RNA, 21 nt, Human
uuccuggcugaguucccagaa

SEQ ID NO: 1153769 - RNA, 20 nt, Human
uuuauuuuaauggguuuuca

SEQ ID NO: 1153770 - RNA, 19 nt, Human
uuuuuuuuuuuuuuuugcc

SEQ ID NO: 1153771 - RNA, 21 nt, Human
aaaaagccucugucucaaaaa

SEQ ID NO: 1153772 - RNA, 24 nt, Human
aaaaauggaccauauaccuaaaug

SEQ ID NO: 1153773 - RNA, 23 nt, Human
aaaagaccaaauaaacacauuaa

SEQ ID NO: 1153774 - RNA, 19 nt, Human
aaaagaccaaauaaacagu

SEQ ID NO: 1153775 - RNA, 24 nt, Human
aaaagccaggugugguagcucacg

SEQ ID NO: 1153776 - RNA, 21 nt, Human
aaacaaaagaaaaaaaauaga

SEQ ID NO: 1153777 - RNA, 20 nt, Human
aacacaaugagaucgacuuc

SEQ ID NO: 1153778 - RNA, 19 nt, Human
aacacagcaagaccccauc

SEQ ID NO: 1153779 - RNA, 20 nt, Human
aacacagcaagaccccaucu

SEQ ID NO: 1153780 - RNA, 21 nt, Human
aacacagcaagaccccaucuc

SEQ ID NO: 1153781 - RNA, 18 nt, Human
aacccucaaaguuaauuc

SEQ ID NO: 1153782 - RNA, 18 nt, Human
aagagaaaugaaaacaua

SEQ ID NO: 1153783 - RNA, 18 nt, Human
aagaucauuuggacccag

SEQ ID NO: 1153784 - RNA, 24 nt, Human
aagccaggugugguagcucacguc

SEQ ID NO: 1153785 - RNA, 23 nt, Human
aaguaaaucuucaaaacccuggg

SEQ ID NO: 1153786 - RNA, 22 nt, Human
aagugcugauuugucucuuggg

SEQ ID NO: 1153787 - RNA, 18 nt, Human
aagugcuggugacgacgu

SEQ ID NO: 1153788 - RNA, 22 nt, Human
aaucgccuuuucaacaaauggu

SEQ ID NO: 1153789 - RNA, 19 nt, Human
acaaaagaaaaaaaauaga

SEQ ID NO: 1153790 - RNA, 18 nt, Human
acaacccaaauguccuuc

SEQ ID NO: 1153791 - RNA, 25 nt, Human
acaggcaagugcuggugacgacgug

SEQ ID NO: 1153792 - RNA, 23 nt, Human
accauagccaaaaacuaggaaca

SEQ ID NO: 1153793 - RNA, 18 nt, Human
acccacggcaagcucuca

SEQ ID NO: 1153794 - RNA, 24 nt, Human
acccaggagguggugguuguagug

SEQ ID NO: 1153795 - RNA, 21 nt, Human
acggcggauccggaaacaggc

SEQ ID NO: 1153796 - RNA, 23 nt, Human
acuacucagaaggcugggguggg

SEQ ID NO: 1153797 - RNA, 18 nt, Human
acuggacuccagcuuggg

SEQ ID NO: 1153798 - RNA, 20 nt, Human
acuggacuccagcuugggag

SEQ ID NO: 1153799 - RNA, 24 nt, Human
acuucaauucuaaaaaaagaacaa

SEQ ID NO: 1153800 - RNA, 18 nt, Human
agaaccggaacagugcug

SEQ ID NO: 1153801 - RNA, 24 nt, Human
agacagauagcuugagcccaagca

SEQ ID NO: 1153802 - RNA, 25 nt, Human
agacauauaacacuauuuuuaaaug

SEQ ID NO: 1153803 - RNA, 23 nt, Human
agauaaaaguuuugugcugcaaa

SEQ ID NO: 1153804 - RNA, 22 nt, Human
agcaagggcuucaugccucuaa

SEQ ID NO: 1153805 - RNA, 24 nt, Human
agcagcucacgccuguagucccag

SEQ ID NO: 1153806 - RNA, 23 nt, Human
agccaaguacaucugcugcucuc

SEQ ID NO: 1153807 - RNA, 24 nt, Human
agccugggcaacacagcaagaccc

SEQ ID NO: 1153808 - RNA, 20 nt, Human
agcggccaagauggcgagcu

SEQ ID NO: 1153809 - RNA, 21 nt, Human
agcucacgccuguagucccag

SEQ ID NO: 1153810 - RNA, 24 nt, Human
aggcuggggugggaagaucauuug

SEQ ID NO: 1153811 - RNA, 21 nt, Human
agguggugguuguagugagcc

SEQ ID NO: 1153812 - RNA, 22 nt, Human
agguggugguuguagugagccg

SEQ ID NO: 1153813 - RNA, 24 nt, Human
agguguagcagcucacgccuguag

SEQ ID NO: 1153814 - RNA, 24 nt, Human
aggugugguagcucacgucuguaa

SEQ ID NO: 1153815 - RNA, 22 nt, Human
agguuucagacaaagggggacu

SEQ ID NO: 1153816 - RNA, 21 nt, Human
agugaagaugcaggcuaggug

SEQ ID NO: 1153817 - RNA, 20 nt, Human
auaaaggacuuguauccaca

SEQ ID NO: 1153818 - RNA, 28 nt, Human
auccauagcaguauuacucaccauagcc

SEQ ID NO: 1153819 - RNA, 20 nt, Human
aucugcugcucucuggaccc

SEQ ID NO: 1153820 - RNA, 25 nt, Human
augcaaaagaaugaaguugggaccc

SEQ ID NO: 1153821 - RNA, 19 nt, Human
auggcacuuugguucucua

SEQ ID NO: 1153822 - RNA, 23 nt, Human
caaaaacuaggaacaacccaaau

SEQ ID NO: 1153823 - RNA, 18 nt, Human
caaaaccacaaacaaaag

SEQ ID NO: 1153824 - RNA, 20 nt, Human
caaaaccacaaacaaaagaa

SEQ ID NO: 1153825 - RNA, 22 nt, Human
caaaaccacaaacaaaagaaaa

SEQ ID NO: 1153826 - RNA, 19 nt, Human
caaaccaucuuaacagaca

SEQ ID NO: 1153827 - RNA, 19 nt, Human
caagaaaauuuaacagaaa

SEQ ID NO: 1153828 - RNA, 22 nt, Human
caagaugauguacaaaagacca

SEQ ID NO: 1153829 - RNA, 19 nt, Human
caagcucucaggccugcaa

SEQ ID NO: 1153830 - RNA, 25 nt, Human
caaggcagacagauagcuugagccc

SEQ ID NO: 1153831 - RNA, 27 nt, Human
caagguucuggggcagcggccaagaug

SEQ ID NO: 1153832 - RNA, 20 nt, Human
caaguacaucugcugcucuc

SEQ ID NO: 1153833 - RNA, 23 nt, Human
caccauagccaaaaacuaggaac

SEQ ID NO: 1153834 - RNA, 19 nt, Human
cacgucuguaaucccagca

SEQ ID NO: 1153835 - RNA, 21 nt, Human
cagaaaaagaaucgccuuuuc

SEQ ID NO: 1153836 - RNA, 22 nt, Human
cagaaugagagaacauacuuaa

SEQ ID NO: 1153837 - RNA, 24 nt, Human
cagcucacgccuguagucccagua

SEQ ID NO: 1153838 - RNA, 21 nt, Human
caggcaaaacaaauauauggu

SEQ ID NO: 1153839 - RNA, 23 nt, Human
caggcuagguguagcagcucacg

SEQ ID NO: 1153840 - RNA, 24 nt, Human
caguacuuugggaacccaaggcag

SEQ ID NO: 1153841 - RNA, 26 nt, Human
caugcaaaagaaugaaguugggaccc

SEQ ID NO: 1153842 - RNA, 20 nt, Human
cauguaugagaaggagaagg

SEQ ID NO: 1153843 - RNA, 25 nt, Human
cauucgauauuagccugggcaacac

SEQ ID NO: 1153844 - RNA, 21 nt, Human
ccaaaaccacaaacaaaagaa

SEQ ID NO: 1153845 - RNA, 22 nt, Human
ccaaaaccacaaacaaaagaaa

SEQ ID NO: 1153846 - RNA, 19 nt, Human
ccaagauggcgagcuuugg

SEQ ID NO: 1153847 - RNA, 21 nt, Human
ccacaugcaaaagaaugaagu

SEQ ID NO: 1153848 - RNA, 23 nt, Human
ccacggcaagcucucaggccugc

SEQ ID NO: 1153849 - RNA, 20 nt, Human
ccacuggacuccagcuuggg

SEQ ID NO: 1153850 - RNA, 20 nt, Human
ccacuggacuccagcuuggg

SEQ ID NO: 1153851 - RNA, 22 nt, Human
ccacuggacuccagcuugggag

SEQ ID NO: 1153852 - RNA, 24 nt, Human
ccacuggacuccagcuugggaggu

SEQ ID NO: 1153853 - RNA, 19 nt, Human
ccauagccaaaaacuagga

SEQ ID NO: 1153854 - RNA, 30 nt, Human
cccacggcaagcucucaggccugcagaggg

SEQ ID NO: 1153855 - RNA, 24 nt, Human
ccugggcaacacagcaagacccca

SEQ ID NO: 1153856 - RNA, 21 nt, Human
ccuguagucccaguacuuugg

SEQ ID NO: 1153857 - RNA, 21 nt, Human
ccugugauaacccucaaaguu

SEQ ID NO: 1153858 - RNA, 22 nt, Human
ccuucauacacugcugguguga

SEQ ID NO: 1153859 - RNA, 23 nt, Human
cgccuguagucccaguacuuugg

SEQ ID NO: 1153860 - RNA, 24 nt, Human
cggaaacaggcaagaugcacaggc

SEQ ID NO: 1153861 - RNA, 18 nt, Human
cgucuguaaucccagcac

SEQ ID NO: 1153862 - RNA, 21 nt, Human
cguguagaugacccacagaau

SEQ ID NO: 1153863 - RNA, 26 nt, Human
cuacauaguguuccugugauaacccu

SEQ ID NO: 1153864 - RNA, 24 nt, Human
cucacgccuguagucccaguacuu

SEQ ID NO: 1153865 - RNA, 23 nt, Human
cucacgucuguaaucccagcacu

SEQ ID NO: 1153866 - RNA, 20 nt, Human
cugcucucuggacccacggc

SEQ ID NO: 1153867 - RNA, 20 nt, Human
cugcugcucucuggacccac

SEQ ID NO: 1153868 - RNA, 21 nt, Human
cuggacccacggcaagcucuc

SEQ ID NO: 1153869 - RNA, 23 nt, Human
cuuuaagaggagagcacugagug

SEQ ID NO: 1153870 - RNA, 24 nt, Human
cuuugguucucuaucuucuccuua

SEQ ID NO: 1153871 - RNA, 21 nt, Human
gagguaaacucugucucaaaa

SEQ ID NO: 1153872 - RNA, 18 nt, Human
gcaaaacaaauauauggu

SEQ ID NO: 1153873 - RNA, 19 nt, Human
ggaaaacuucacauccaca

SEQ ID NO: 1153874 - RNA, 18 nt, Human
ggacaguaacaguguguc

SEQ ID NO: 1153875 - RNA, 19 nt, Human
gguaauagaagaaccggaa

SEQ ID NO: 1153876 - RNA, 24 nt, Human
gguagcucacgucuguaaucccag

SEQ ID NO: 1153877 - RNA, 18 nt, Human
ggugguuguagugagccg

SEQ ID NO: 1153878 - RNA, 21 nt, Human
guuuccaagguucuggggcag

SEQ ID NO: 1153879 - RNA, 23 nt, Human
uaaaaccuaaaacuaugaaacuc

SEQ ID NO: 1153880 - RNA, 24 nt, Human
uaaaaccuaaaacuaugaaacucu

SEQ ID NO: 1153881 - RNA, 24 nt, Human
uaaaccaaaaccacaaacaaaaga

SEQ ID NO: 1153882 - RNA, 28 nt, Human
uaaaccaaaaccacaaacaaccccgggg

SEQ ID NO: 1153883 - RNA, 25 nt, Human
uaaagaguuuccauuugaaccagca

SEQ ID NO: 1153884 - RNA, 21 nt, Human
uacaaaagaccaaauaaacac

SEQ ID NO: 1153885 - RNA, 22 nt, Human
uacacaguaauaccucaauuaa

SEQ ID NO: 1153886 - RNA, 18 nt, Human
uacacuuugugggagaga

SEQ ID NO: 1153887 - RNA, 25 nt, Human
uagcaguauuacucaccauagccaa

SEQ ID NO: 1153888 - RNA, 22 nt, Human
uagcucacgucuguaaucccag

SEQ ID NO: 1153889 - RNA, 24 nt, Human
uagcucacgucuguaaucccagca

SEQ ID NO: 1153890 - RNA, 23 nt, Human
uauuaaucuggugaugguuacac

SEQ ID NO: 1153891 - RNA, 18 nt, Human
ucacacaaaaaccuguac

SEQ ID NO: 1153892 - RNA, 23 nt, Human
ucacauccacaugcaaaagaaug

SEQ ID NO: 1153893 - RNA, 19 nt, Human
ucagaaggcugggguggga

SEQ ID NO: 1153894 - RNA, 18 nt, Human
ucauguaugagaaggaga

SEQ ID NO: 1153895 - RNA, 18 nt, Human
uccaaacuacucagaagg

SEQ ID NO: 1153896 - RNA, 19 nt, Human
uccacaagaugauguacaa

SEQ ID NO: 1153897 - RNA, 22 nt, Human
uccacaagaugauguacaaaag

SEQ ID NO: 1153898 - RNA, 19 nt, Human
ucccaggguacuuaugaug

SEQ ID NO: 1153899 - RNA, 19 nt, Human
ucccagguauguacccaag

SEQ ID NO: 1153900 - RNA, 21 nt, Human
ucccagguauguacccaagag

SEQ ID NO: 1153901 - RNA, 24 nt, Human
uccuuaucugagcaagggcuucau

SEQ ID NO: 1153902 - RNA, 27 nt, Human
ucuaaaaaaagaacaaagguaauaaaa

SEQ ID NO: 1153903 - RNA, 24 nt, Human
ugaaaagccaggugugguagcuca

SEQ ID NO: 1153904 - RNA, 22 nt, Human
ugagagaacauacuuaaaauca

SEQ ID NO: 1153905 - RNA, 23 nt, Human
ugcaauacacaaaaaaaauggac

SEQ ID NO: 1153906 - RNA, 21 nt, Human
ugcagcaaaaucuacagcaaa

SEQ ID NO: 1153907 - RNA, 22 nt, Human
ugcauuauuacauuauuacacu

SEQ ID NO: 1153908 - RNA, 19 nt, Human
ugcuggugacgacgugaag

SEQ ID NO: 1153909 - RNA, 22 nt, Human
uggcugagaccucagauaaccu

SEQ ID NO: 1153910 - RNA, 19 nt, Human
ugggagagaaggacagcau

SEQ ID NO: 1153911 - RNA, 23 nt, Human
ugggagguaaacucugucucaaa

SEQ ID NO: 1153912 - RNA, 22 nt, Human
ugggcaacacagcaagacccca

SEQ ID NO: 1153913 - RNA, 19 nt, Human
uggggugggaagaucauuu

SEQ ID NO: 1153914 - RNA, 24 nt, Human
ugguagcucacgucuguaauccca

SEQ ID NO: 1153915 - RNA, 20 nt, Human
uguacaaaagaccaaauaaa

SEQ ID NO: 1153916 - RNA, 25 nt, Human
uguacaaaagaccaaauaaacacau

SEQ ID NO: 1153917 - RNA, 21 nt, Human
uguaugagaaggagaaggagu

SEQ ID NO: 1153918 - RNA, 18 nt, Human
ugucaagaccucugcaua

SEQ ID NO: 1153919 - RNA, 20 nt, Human
uuaaaaagccucugucucaa

SEQ ID NO: 1153920 - RNA, 19 nt, Human
uucaacacaggugccaaga

SEQ ID NO: 1153921 - RNA, 18 nt, Human
uucaugagcaggcaaaac

SEQ ID NO: 1153922 - RNA, 19 nt, Human
uuccaagguucuggggcag

SEQ ID NO: 1153923 - RNA, 22 nt, Human
uuggacccaggagguggugguu

SEQ ID NO: 1153924 - RNA, 18 nt, Human
uuguagugagccgaaauc

SEQ ID NO: 1153925 - RNA, 19 nt, Human
uuguagugagccgaaaucu

SEQ ID NO: 1153926 - RNA, 19 nt, Human
uuuuaagaacguguagaug

SEQ ID NO: 1153927 - RNA, 25 nt, Human
aaaaaaaaaaagucacaaaugagaa

SEQ ID NO: 1153928 - RNA, 25 nt, Human
aaacaaaaaaauuacuuuggacuca

SEQ ID NO: 1153929 - RNA, 22 nt, Human
aaacuaaacuuaguaugucgug

SEQ ID NO: 1153930 - RNA, 18 nt, Human
aaagaucacugagaagga

SEQ ID NO: 1153931 - RNA, 20 nt, Human
aaaugaccuagugaauggga

SEQ ID NO: 1153932 - RNA, 22 nt, Human
aacuaagaagagacacaguuca

SEQ ID NO: 1153933 - RNA, 23 nt, Human
aagaagagacacaguucagguca

SEQ ID NO: 1153934 - RNA, 21 nt, Human
aagaguuuccccaccccaaag

SEQ ID NO: 1153935 - RNA, 19 nt, Human
aaggaacaaaagaaacacc

SEQ ID NO: 1153936 - RNA, 24 nt, Human
aaggaacaaaagaaacaccaugug

SEQ ID NO: 1153937 - RNA, 23 nt, Human
aaguagcuccaaaagaaagcuga

SEQ ID NO: 1153938 - RNA, 24 nt, Human
accccaaaguagcuccaaaagaaa

SEQ ID NO: 1153939 - RNA, 21 nt, Human
accuagugaaugggaaaacuc

SEQ ID NO: 1153940 - RNA, 30 nt, Human
agaaauaauagcaagagccaucucuuggcc

SEQ ID NO: 1153941 - RNA, 23 nt, Human
agaacauccaguaucuggaaggu

SEQ ID NO: 1153942 - RNA, 18 nt, Human
agaaucuccucaagcagc

SEQ ID NO: 1153943 - RNA, 20 nt, Human
agaguuuccccaccccaaag

SEQ ID NO: 1153944 - RNA, 21 nt, Human
agcagaaguuucacaugagca

SEQ ID NO: 1153945 - RNA, 21 nt, Human
agcuccaaaagaaagcugaca

SEQ ID NO: 1153946 - RNA, 23 nt, Human
agcuuauugaagaaaagagcuac

SEQ ID NO: 1153947 - RNA, 22 nt, Human
aguggccagugcucaacaaaac

SEQ ID NO: 1153948 - RNA, 22 nt, Human
caaaguagcuccaaaagaaagc

SEQ ID NO: 1153949 - RNA, 20 nt, Human
caagauguagauaucuguug

SEQ ID NO: 1153950 - RNA, 19 nt, Human
caaguuccauggcuuaaga

SEQ ID NO: 1153951 - RNA, 22 nt, Human
cacaguucaggucagagugcag

SEQ ID NO: 1153952 - RNA, 18 nt, Human
caccccaaaguagcucca

SEQ ID NO: 1153953 - RNA, 20 nt, Human
caccucuggcuguagaaucu

SEQ ID NO: 1153954 - RNA, 21 nt, Human
cacucugcccuuacaagucuu

SEQ ID NO: 1153955 - RNA, 19 nt, Human
caguagagcaaguuccaug

SEQ ID NO: 1153956 - RNA, 20 nt, Human
cauucucacucugcccuuac

SEQ ID NO: 1153957 - RNA, 24 nt, Human
ccaucucuuggcaccucuggcugu

SEQ ID NO: 1153958 - RNA, 24 nt, Human
cccuacuuucccagugugucucaa

SEQ ID NO: 1153959 - RNA, 18 nt, Human
ccucccacauucucacuc

SEQ ID NO: 1153960 - RNA, 19 nt, Human
ccucccacauucucacucu

SEQ ID NO: 1153961 - RNA, 21 nt, Human
ccuccuucccuccuccaaucc

SEQ ID NO: 1153962 - RNA, 19 nt, Human
cuccuucccuccuccaauc

SEQ ID NO: 1153963 - RNA, 23 nt, Human
cugagaaggagcaaugauauuag

SEQ ID NO: 1153964 - RNA, 21 nt, Human
cuuuucaugcagaacauccag

SEQ ID NO: 1153965 - RNA, 19 nt, Human
gaaaaagaugucaggaagg

SEQ ID NO: 1153966 - RNA, 25 nt, Human
gaaccugccuuagagucugaacuag

SEQ ID NO: 1153967 - RNA, 22 nt, Human
gaaucuccucaagcagcaguuu

SEQ ID NO: 1153968 - RNA, 30 nt, Human
gaauguccucccacauucucacucugcccu

SEQ ID NO: 1153969 - RNA, 24 nt, Human
gaccuccuucccuccuccaauccu

SEQ ID NO: 1153970 - RNA, 19 nt, Human
gagcaaauuuagcccucca

SEQ ID NO: 1153971 - RNA, 21 nt, Human
ggaaacagaugagaagccgga

SEQ ID NO: 1153972 - RNA, 22 nt, Human
ggaaacagaugagaagccggac

SEQ ID NO: 1153973 - RNA, 21 nt, Human
ggaggggcuggagggaacuug

SEQ ID NO: 1153974 - RNA, 23 nt, Human
ggagggguggaggggcuggaggg

SEQ ID NO: 1153975 - RNA, 19 nt, Human
ggguaggggagggguggag

SEQ ID NO: 1153976 - RNA, 22 nt, Human
ggguaggggagggguggagggg

SEQ ID NO: 1153977 - RNA, 18 nt, Human
guaaaaaaaaaaaaaagu

SEQ ID NO: 1153978 - RNA, 19 nt, Human
guagaaucuccucaagcag

SEQ ID NO: 1153979 - RNA, 22 nt, Human
gucagagugcagcuaggaguga

SEQ ID NO: 1153980 - RNA, 23 nt, Human
guugauuugucacuauccaccuu

SEQ ID NO: 1153981 - RNA, 26 nt, Human
guugcugaccuccuucccuccuccaa

SEQ ID NO: 1153982 - RNA, 22 nt, Human
uaagaagagacacaguucaggu

SEQ ID NO: 1153983 - RNA, 24 nt, Human
uacaaguacucaccacaguugauu

SEQ ID NO: 1153984 - RNA, 24 nt, Human
uagaugaacuaagaagagacacag

SEQ ID NO: 1153985 - RNA, 22 nt, Human
uagcaagagccaucucuuggca

SEQ ID NO: 1153986 - RNA, 24 nt, Human
uaggggagggguggaggggcugga

SEQ ID NO: 1153987 - RNA, 18 nt, Human
uaguaaaaaaaaaaaaaa

SEQ ID NO: 1153988 - RNA, 25 nt, Human
uaguaaaaaaaaaaaaaagucacaa

SEQ ID NO: 1153989 - RNA, 24 nt, Human
uaugaacaacguuagcagaaguuu

SEQ ID NO: 1153990 - RNA, 26 nt, Human
ucuguuguaguaaaaaaaaaaaaaag

SEQ ID NO: 1153991 - RNA, 19 nt, Human
ugaaaccccuuguggcacu

SEQ ID NO: 1153992 - RNA, 21 nt, Human
ugaaaccccuuguggcacugu

SEQ ID NO: 1153993 - RNA, 21 nt, Human
ugaagaaaagagcuacaucac

SEQ ID NO: 1153994 - RNA, 18 nt, Human
ugaccuccuucccuccuc

SEQ ID NO: 1153995 - RNA, 18 nt, Human
ugagaaggagcaaugaua

SEQ ID NO: 1153996 - RNA, 23 nt, Human
ugaguucccuguugcugaccucc

SEQ ID NO: 1153997 - RNA, 18 nt, Human
uggaauauuucuacuuug

SEQ ID NO: 1153998 - RNA, 21 nt, Human
uggaggggcuggagggaacuu

SEQ ID NO: 1153999 - RNA, 24 nt, Human
uggcuguagaaucuccucaagcaa

SEQ ID NO: 1154000 - RNA, 23 nt, Human
ugggaaaacucugggaaacagau

SEQ ID NO: 1154001 - RNA, 26 nt, Human
ugggaaacagaugagaagccggacaa

SEQ ID NO: 1154002 - RNA, 22 nt, Human
ugggcucucgacuauccaguuu

SEQ ID NO: 1154003 - RNA, 19 nt, Human
uguaaaggaacaaaagaaa

SEQ ID NO: 1154004 - RNA, 23 nt, Human
uguaaaggaacaaaagaaacacc

SEQ ID NO: 1154005 - RNA, 21 nt, Human
ugucucaacucugggcucucg

SEQ ID NO: 1154006 - RNA, 25 nt, Human
uguuaagaguuuccccaccccaaag

SEQ ID NO: 1154007 - RNA, 22 nt, Human
uuacauagacuugauuucuaau

SEQ ID NO: 1154008 - RNA, 21 nt, Human
uuccaaguccuuucccugcuc

SEQ ID NO: 1154009 - RNA, 23 nt, Human
uuccccaccccaaaguagcucca

SEQ ID NO: 1154010 - RNA, 24 nt, Human
uuuccagccacuucuguuucuaac

SEQ ID NO: 1154011 - RNA, 26 nt, Human
aaaaauucucaaauugagaaauauua

SEQ ID NO: 1154012 - RNA, 25 nt, Human
aaaguaaaaauucucaaauugagaa

SEQ ID NO: 1154013 - RNA, 18 nt, Human
ccaagcacuaacaugaac

SEQ ID NO: 1154014 - RNA, 20 nt, Human
ggagucagaaacagacuuaa

SEQ ID NO: 1154015 - RNA, 20 nt, Human
ggucccuguuggagucagaa

SEQ ID NO: 1154016 - RNA, 19 nt, Human
ucuugccagucuugaguuc

SEQ ID NO: 1154017 - RNA, 18 nt, Human
uggagucagaaacagacu

SEQ ID NO: 1154018 - RNA, 22 nt, Human
uggagucagaaacagacuuaac

SEQ ID NO: 1154019 - RNA, 19 nt, Human
aagaugaaucuugaacuca

SEQ ID NO: 1154020 - RNA, 19 nt, Human
acaggauucugaagaugaa

SEQ ID NO: 1154021 - RNA, 23 nt, Human
caaggaaagccacauaauccguc

SEQ ID NO: 1154022 - RNA, 26 nt, Human
cauccuuguucuaauaagccuuucac

SEQ ID NO: 1154023 - RNA, 20 nt, Human
ccagggccccugcaacuggc

SEQ ID NO: 1154024 - RNA, 22 nt, Human
ccauccuuguucuaauaagccu

SEQ ID NO: 1154025 - RNA, 19 nt, Human
gcucugauaagggaauaaa

SEQ ID NO: 1154026 - RNA, 18 nt, Human
gguauugggggaagugga

SEQ ID NO: 1154027 - RNA, 18 nt, Human
uaagucagucuucaagga

SEQ ID NO: 1154028 - RNA, 19 nt, Human
ucaaggaaagccacauaau

SEQ ID NO: 1154029 - RNA, 22 nt, Human
ucagagugauaagucagucuuc

SEQ ID NO: 1154030 - RNA, 23 nt, Human
ucagucuggcuaacugcuguuca

SEQ ID NO: 1154031 - RNA, 23 nt, Human
ucuugugguggaaucaacuugcc

SEQ ID NO: 1154032 - RNA, 18 nt, Human
uggaaucaacuugccauc

SEQ ID NO: 1154033 - RNA, 21 nt, Human
ugggcagaaccauucuugugg

SEQ ID NO: 1154034 - RNA, 20 nt, Human
ugggggaaguggagcaggcu

SEQ ID NO: 1154035 - RNA, 18 nt, Human
uggguauugggggaagug

SEQ ID NO: 1154036 - RNA, 24 nt, Human
uuaaaggaaacauccagggccccu

SEQ ID NO: 1154037 - RNA, 24 nt, Human
aaagugcugggauuacaggcguga

SEQ ID NO: 1154038 - RNA, 19 nt, Human
aagugcugggauuacaggc

SEQ ID NO: 1154039 - RNA, 19 nt, Human
aagugcugggauuacaggc

SEQ ID NO: 1154040 - RNA, 26 nt, Human
aagugcugggauuacaggcgugagcc

SEQ ID NO: 1154041 - RNA, 24 nt, Human
aaugauucuuuggccucagccuuc

SEQ ID NO: 1154042 - RNA, 23 nt, Human
acacacacacaugcacacacaca

SEQ ID NO: 1154043 - RNA, 24 nt, Human
accauguuggccaggcuggucuug

SEQ ID NO: 1154044 - RNA, 25 nt, Human
acccgccucagccucccaaagugcu

SEQ ID NO: 1154045 - RNA, 22 nt, Human
accuagagccacacugcuggca

SEQ ID NO: 1154046 - RNA, 24 nt, Human
agaggugggguuucaccauguugg

SEQ ID NO: 1154047 - RNA, 23 nt, Human
agccuggggacaaaguuagcucc

SEQ ID NO: 1154048 - RNA, 22 nt, Human
aggcaaggccauucccugugcu

SEQ ID NO: 1154049 - RNA, 23 nt, Human
aggcucccagcagcccgcauacc

SEQ ID NO: 1154050 - RNA, 25 nt, Human
aggcuggagugcaguggcgcaaucu

SEQ ID NO: 1154051 - RNA, 24 nt, Human
aggggauagaauggggcaggggaa

SEQ ID NO: 1154052 - RNA, 23 nt, Human
aggggucagcucugacagccugg

SEQ ID NO: 1154053 - RNA, 18 nt, Human
aguagcuuggauuacagg

SEQ ID NO: 1154054 - RNA, 21 nt, Human
agugcaguggcgcaaucucag

SEQ ID NO: 1154055 - RNA, 18 nt, Human
agugcugggauuacaggc

SEQ ID NO: 1154056 - RNA, 19 nt, Human
auccacccgccucagccuc

SEQ ID NO: 1154057 - RNA, 23 nt, Human
auccucuuuagagaaauguauac

SEQ ID NO: 1154058 - RNA, 24 nt, Human
augauucuuuggccucagccuucc

SEQ ID NO: 1154059 - RNA, 23 nt, Human
caaagccuuugaucucccccaca

SEQ ID NO: 1154060 - RNA, 24 nt, Human
caaagugcugggauuacaggcgug

SEQ ID NO: 1154061 - RNA, 20 nt, Human
caaccuccgccucccggguu

SEQ ID NO: 1154062 - RNA, 23 nt, Human
cacacaugcacacacacaccaca

SEQ ID NO: 1154063 - RNA, 18 nt, Human
cacaugcacacacacacc

SEQ ID NO: 1154064 - RNA, 21 nt, Human
caccauguuggccaggcuggu

SEQ ID NO: 1154065 - RNA, 24 nt, Human
caccauguuggccaggcuggucuu

SEQ ID NO: 1154066 - RNA, 27 nt, Human
caccauguuggccaggcuggucuugaa

SEQ ID NO: 1154067 - RNA, 23 nt, Human
cacccgccucagccucccaaagu

SEQ ID NO: 1154068 - RNA, 24 nt, Human
cacgcgcauccacacgaggucaug

SEQ ID NO: 1154069 - RNA, 21 nt, Human
cacugcaaccuccgccucccg

SEQ ID NO: 1154070 - RNA, 23 nt, Human
cacugcaaccuccgccucccggg

SEQ ID NO: 1154071 - RNA, 23 nt, Human
cagaaggcuaggugaggggcaag

SEQ ID NO: 1154072 - RNA, 24 nt, Human
cagacagugcucucaggcucccag

SEQ ID NO: 1154073 - RNA, 23 nt, Human
caggcuccaggacucaggggagg

SEQ ID NO: 1154074 - RNA, 23 nt, Human
caggguggcucugggccaaugcc

SEQ ID NO: 1154075 - RNA, 24 nt, Human
cauguuggccaggcuggucuugaa

SEQ ID NO: 1154076 - RNA, 20 nt, Human
ccaaagugcugggauuacag

SEQ ID NO: 1154077 - RNA, 22 nt, Human
ccaaagugcugggauuacaggc

SEQ ID NO: 1154078 - RNA, 22 nt, Human
ccaaagugcugggauuacaggc

SEQ ID NO: 1154079 - RNA, 24 nt, Human
ccaaagugcugggauuacaggcgu

SEQ ID NO: 1154080 - RNA, 18 nt, Human
ccacacugcuggcagagu

SEQ ID NO: 1154081 - RNA, 26 nt, Human
ccacccgccucagccucccaaagugc

SEQ ID NO: 1154082 - RNA, 21 nt, Human
ccagauaauccuugaccucau

SEQ ID NO: 1154083 - RNA, 19 nt, Human
ccaguguggcccacucccc

SEQ ID NO: 1154084 - RNA, 19 nt, Human
cccacaaagccucuaccuc

SEQ ID NO: 1154085 - RNA, 24 nt, Human
cccaccucccggcuuacacacaca

SEQ ID NO: 1154086 - RNA, 21 nt, Human
cccagccugcacauccucuuu

SEQ ID NO: 1154087 - RNA, 22 nt, Human
cccagccugcacauccucuuua

SEQ ID NO: 1154088 - RNA, 19 nt, Human
ccccagagcaggggauaga

SEQ ID NO: 1154089 - RNA, 19 nt, Human
ccccagcauggcugccucc

SEQ ID NO: 1154090 - RNA, 24 nt, Human
ccccagccucucugcagggcuuug

SEQ ID NO: 1154091 - RNA, 23 nt, Human
cccccuggagcugcccugacucc

SEQ ID NO: 1154092 - RNA, 21 nt, Human
ccccuggagcugcccugacuc

SEQ ID NO: 1154093 - RNA, 22 nt, Human
ccccuggagcugcccugacucc

SEQ ID NO: 1154094 - RNA, 26 nt, Human
cccugccacgcagacacgcgcaucca

SEQ ID NO: 1154095 - RNA, 23 nt, Human
cccugugcugggccucagcuuuc

SEQ ID NO: 1154096 - RNA, 23 nt, Human
ccgccucagccucccaaagugcu

SEQ ID NO: 1154097 - RNA, 24 nt, Human
ccgccucccggguucaaaugauuc

SEQ ID NO: 1154098 - RNA, 22 nt, Human
ccucaugugauccacccgccuc

SEQ ID NO: 1154099 - RNA, 19 nt, Human
ccuccccucucuauccuca

SEQ ID NO: 1154100 - RNA, 20 nt, Human
ccuccugcagaaggcuaggu

SEQ ID NO: 1154101 - RNA, 22 nt, Human
ccuggccucaugugauccaccc

SEQ ID NO: 1154102 - RNA, 20 nt, Human
ccuguguuagcggccccagc

SEQ ID NO: 1154103 - RNA, 24 nt, Human
cgcccccuggagcugcccugacuc

SEQ ID NO: 1154104 - RNA, 24 nt, Human
cgccucagccucccaaagugcugg

SEQ ID NO: 1154105 - RNA, 24 nt, Human
cgcucuguugcccaggcuggagug

SEQ ID NO: 1154106 - RNA, 24 nt, Human
cucacugcaaccuccgccucccgg

SEQ ID NO: 1154107 - RNA, 21 nt, Human
cucaggggaggggcccuggcc

SEQ ID NO: 1154108 - RNA, 30 nt, Human
cucccggcuuacacacacacaugcacacag

SEQ ID NO: 1154109 - RNA, 19 nt, Human
cuccuccagcucagcgucc

SEQ ID NO: 1154110 - RNA, 24 nt, Human
cuccugcccugccacccauuccca

SEQ ID NO: 1154111 - RNA, 24 nt, Human
cucgcucuguugcccaggcuggag

SEQ ID NO: 1154112 - RNA, 19 nt, Human
cucucaggcucccagcagc

SEQ ID NO: 1154113 - RNA, 21 nt, Human
cucucugcagggcuuugcucu

SEQ ID NO: 1154114 - RNA, 24 nt, Human
cugcaaccuccgccucccggguuc

SEQ ID NO: 1154115 - RNA, 22 nt, Human
cugcaggugugugcaccucccu

SEQ ID NO: 1154116 - RNA, 24 nt, Human
cuggccccagagcaggggauagaa

SEQ ID NO: 1154117 - RNA, 20 nt, Human
cuuggauuacaggcaccggc

SEQ ID NO: 1154118 - RNA, 25 nt, Human
cuuuggccucagccuuccgaguagc

SEQ ID NO: 1154119 - RNA, 18 nt, Human
gacagcucagacagugcu

SEQ ID NO: 1154120 - RNA, 21 nt, Human
gagauggagucucgcucuguu

SEQ ID NO: 1154121 - RNA, 22 nt, Human
gaggggcaagcgcaacagagaa

SEQ ID NO: 1154122 - RNA, 20 nt, Human
gaggugggguuucaccaugu

SEQ ID NO: 1154123 - RNA, 24 nt, Human
gaggugggguuucaccauguuggc

SEQ ID NO: 1154124 - RNA, 18 nt, Human
gauuacaggcgugagcca

SEQ ID NO: 1154125 - RNA, 21 nt, Human
gauuacaggcgugagccacca

SEQ ID NO: 1154126 - RNA, 22 nt, Human
gauuacaggcgugagccaccac

SEQ ID NO: 1154127 - RNA, 21 nt, Human
gcccagauaauccuugaccuc

SEQ ID NO: 1154128 - RNA, 20 nt, Human
gcccagccugcacauccucu

SEQ ID NO: 1154129 - RNA, 24 nt, Human
gccuauuuuuuaguuggguuguuu

SEQ ID NO: 1154130 - RNA, 19 nt, Human
gccucagcuuucccacccg

SEQ ID NO: 1154131 - RNA, 22 nt, Human
gcucugacagccuggggacaaa

SEQ ID NO: 1154132 - RNA, 25 nt, Human
gcucuguugcccaggcuggagugca

SEQ ID NO: 1154133 - RNA, 19 nt, Human
gcuggagugcaguggcgca

SEQ ID NO: 1154134 - RNA, 23 nt, Human
gcuggucuugaacuccuggccuc

SEQ ID NO: 1154135 - RNA, 25 nt, Human
gcuuacacacacacaugcacacaca

SEQ ID NO: 1154136 - RNA, 23 nt, Human
ggagucucgcucuguugcccagg

SEQ ID NO: 1154137 - RNA, 19 nt, Human
ggauuacaggcaccggcca

SEQ ID NO: 1154138 - RNA, 20 nt, Human
ggauuacaggcaccggccau

SEQ ID NO: 1154139 - RNA, 22 nt, Human
ggauuacaggcaccggccauca

SEQ ID NO: 1154140 - RNA, 24 nt, Human
ggauuacaggcaccggccaucaug

SEQ ID NO: 1154141 - RNA, 19 nt, Human
ggauuacaggcgugagcca

SEQ ID NO: 1154142 - RNA, 24 nt, Human
ggcuggucuugaacuccuggccuc

SEQ ID NO: 1154143 - RNA, 24 nt, Human
gggccucagcuuucccacccgugg

SEQ ID NO: 1154144 - RNA, 19 nt, Human
ggggcaagcgcaacagaga

SEQ ID NO: 1154145 - RNA, 22 nt, Human
gggguuucaccauguuggccag

SEQ ID NO: 1154146 - RNA, 21 nt, Human
gguuguuuggggggugguuuu

SEQ ID NO: 1154147 - RNA, 19 nt, Human
guagaggugggguuucacc

SEQ ID NO: 1154148 - RNA, 21 nt, Human
guagaggugggguuucaccau

SEQ ID NO: 1154149 - RNA, 22 nt, Human
guagaggugggguuucaccaug

SEQ ID NO: 1154150 - RNA, 21 nt, Human
gucacucaggcaaggccauuc

SEQ ID NO: 1154151 - RNA, 24 nt, Human
gucucgcucuguugcccaggcugg

SEQ ID NO: 1154152 - RNA, 20 nt, Human
gucuugaacuccuggccuca

SEQ ID NO: 1154153 - RNA, 24 nt, Human
gugauccacccgccucagccuccc

SEQ ID NO: 1154154 - RNA, 19 nt, Human
guggcucugggccaaugcc

SEQ ID NO: 1154155 - RNA, 20 nt, Human
guggcucugggccaaugccc

SEQ ID NO: 1154156 - RNA, 18 nt, Human
gugggguuucaccauguu

SEQ ID NO: 1154157 - RNA, 23 nt, Human
gugggguuucaccauguuggcca

SEQ ID NO: 1154158 - RNA, 24 nt, Human
gugggguuucaccauguuggccag

SEQ ID NO: 1154159 - RNA, 20 nt, Human
uaacaugucacccaccuccc

SEQ ID NO: 1154160 - RNA, 22 nt, Human
uaauucuuguauuuuuguagag

SEQ ID NO: 1154161 - RNA, 23 nt, Human
uaauucuuguauuuuuguagagg

SEQ ID NO: 1154162 - RNA, 24 nt, Human
uacacacacacaugcacacacaca

SEQ ID NO: 1154163 - RNA, 27 nt, Human
uacacacacacaugcacacacacacca

SEQ ID NO: 1154164 - RNA, 24 nt, Human
uacaggcgugagccaccacgccca

SEQ ID NO: 1154165 - RNA, 18 nt, Human
uaccucugaccuagagcc

SEQ ID NO: 1154166 - RNA, 20 nt, Human
uagcggccccagcauggcug

SEQ ID NO: 1154167 - RNA, 31 nt, Human
ucacaucaagccugcgugaaucaucuccucu

SEQ ID NO: 1154168 - RNA, 20 nt, Human
ucacccaccucccggcuuac

SEQ ID NO: 1154169 - RNA, 23 nt, Human
ucacugcaaccuccgccucccgg

SEQ ID NO: 1154170 - RNA, 23 nt, Human
ucacugcaaccuccgccucccgg

SEQ ID NO: 1154171 - RNA, 24 nt, Human
ucacugcaaccuccgccucccggg

SEQ ID NO: 1154172 - RNA, 26 nt, Human
ucacugcaaccuccgccucccggguu

SEQ ID NO: 1154173 - RNA, 21 nt, Human
uccacccgccucagccuccca

SEQ ID NO: 1154174 - RNA, 24 nt, Human
ucccaaagugcugggauuacaggc

SEQ ID NO: 1154175 - RNA, 18 nt, Human
ucccagcagcccgcauac

SEQ ID NO: 1154176 - RNA, 19 nt, Human
uccccacaaagccucuacc

SEQ ID NO: 1154177 - RNA, 20 nt, Human
ucccggguucaaaugauucu

SEQ ID NO: 1154178 - RNA, 23 nt, Human
ucccggguucaaaugauucuuug

SEQ ID NO: 1154179 - RNA, 23 nt, Human
uccgaguagcuuggauuacaggc

SEQ ID NO: 1154180 - RNA, 24 nt, Human
uccgaguagcuuggauuacaggca

SEQ ID NO: 1154181 - RNA, 19 nt, Human
uccuggguccuggccugca

SEQ ID NO: 1154182 - RNA, 24 nt, Human
ucgcucuguugcccaggcuggagu

SEQ ID NO: 1154183 - RNA, 19 nt, Human
ucucgcucuguugcccagg

SEQ ID NO: 1154184 - RNA, 23 nt, Human
ucucgcucuguugcccaggcugg

SEQ ID NO: 1154185 - RNA, 24 nt, Human
ucucgcucuguugcccaggcugga

SEQ ID NO: 1154186 - RNA, 26 nt, Human
ucucgcucuguugcccaggcuggagu

SEQ ID NO: 1154187 - RNA, 27 nt, Human
ucucgcucuguugcccaggcuggagug

SEQ ID NO: 1154188 - RNA, 18 nt, Human
ucuguugcccaggcugga

SEQ ID NO: 1154189 - RNA, 21 nt, Human
ucuugaacuccuggccucaug

SEQ ID NO: 1154190 - RNA, 21 nt, Human
ugaaaaggcgcccccuggagc

SEQ ID NO: 1154191 - RNA, 19 nt, Human
ugacuccuggguccuggcc

SEQ ID NO: 1154192 - RNA, 20 nt, Human
ugacuccuggguccuggccu

SEQ ID NO: 1154193 - RNA, 18 nt, Human
ugcaccucccuccaccac

SEQ ID NO: 1154194 - RNA, 22 nt, Human
ugcaguggcgcaaucucagcuc

SEQ ID NO: 1154195 - RNA, 23 nt, Human
ugcaguggcgcaaucucagcuca

SEQ ID NO: 1154196 - RNA, 18 nt, Human
ugcccaggcuggagugca

SEQ ID NO: 1154197 - RNA, 21 nt, Human
ugcccaggcuggagugcagug

SEQ ID NO: 1154198 - RNA, 22 nt, Human
ugcccaggcuggagugcagugg

SEQ ID NO: 1154199 - RNA, 24 nt, Human
ugcccaggcuggagugcaguggcg

SEQ ID NO: 1154200 - RNA, 18 nt, Human
ugcccugacuccuggguc

SEQ ID NO: 1154201 - RNA, 19 nt, Human
ugcccugccacccauuccc

SEQ ID NO: 1154202 - RNA, 25 nt, Human
ugcgugaaucaucuccucgaggaag

SEQ ID NO: 1154203 - RNA, 21 nt, Human
ugcucucaggcucccagcagc

SEQ ID NO: 1154204 - RNA, 24 nt, Human
ugcugggauuacaggcgugagcca

SEQ ID NO: 1154205 - RNA, 24 nt, Human
uggagucucgcucuguugcccagg

SEQ ID NO: 1154206 - RNA, 18 nt, Human
uggagugcaguggcgcaa

SEQ ID NO: 1154207 - RNA, 23 nt, Human
uggagugcaguggcgcaaucuca

SEQ ID NO: 1154208 - RNA, 24 nt, Human
uggagugcaguggcgcaaucucag

SEQ ID NO: 1154209 - RNA, 19 nt, Human
uggauuacaggcaccggcc

SEQ ID NO: 1154210 - RNA, 20 nt, Human
uggauuacaggcaccggcca

SEQ ID NO: 1154211 - RNA, 20 nt, Human
uggauuacaggcaccggcca

SEQ ID NO: 1154212 - RNA, 24 nt, Human
uggccaggcuggucuugaacuccu

SEQ ID NO: 1154213 - RNA, 22 nt, Human
uggcccacuccccacucaaagc

SEQ ID NO: 1154214 - RNA, 24 nt, Human
uggccucagccuuccgaguagcuu

SEQ ID NO: 1154215 - RNA, 24 nt, Human
uggcgcaaucucagcucacugcaa

SEQ ID NO: 1154216 - RNA, 20 nt, Human
uggcucugggccaaugcccc

SEQ ID NO: 1154217 - RNA, 18 nt, Human
ugggauuacaggcgugag

SEQ ID NO: 1154218 - RNA, 19 nt, Human
ugggauuacaggcgugagc

SEQ ID NO: 1154219 - RNA, 22 nt, Human
ugggauuacaggcgugagccac

SEQ ID NO: 1154220 - RNA, 23 nt, Human
ugggauuacaggcgugagccacc

SEQ ID NO: 1154221 - RNA, 24 nt, Human
ugggauuacaggcgugagccacca

SEQ ID NO: 1154222 - RNA, 21 nt, Human
ugggguuucaccauguuggcc

SEQ ID NO: 1154223 - RNA, 24 nt, Human
ugggguuucaccauguuggccagg

SEQ ID NO: 1154224 - RNA, 22 nt, Human
uggguccuggccugcaaggugu

SEQ ID NO: 1154225 - RNA, 24 nt, Human
uguagaggugggguuucaccaugu

SEQ ID NO: 1154226 - RNA, 21 nt, Human
uguauacauacaaguccuuug

SEQ ID NO: 1154227 - RNA, 25 nt, Human
ugucacccaccucccggcuuacaca

SEQ ID NO: 1154228 - RNA, 24 nt, Human
ugugauccacccgccucagccucc

SEQ ID NO: 1154229 - RNA, 21 nt, Human
ugugcugggccucagcuuucc

SEQ ID NO: 1154230 - RNA, 21 nt, Human
uguugcccaggcuggagugca

SEQ ID NO: 1154231 - RNA, 21 nt, Human
uuaguuggguuguuugggggg

SEQ ID NO: 1154232 - RNA, 25 nt, Human
uucaaaugauucuuugggacuccgg

SEQ ID NO: 1154233 - RNA, 24 nt, Human
uugcccaggcuggagugcaguggc

SEQ ID NO: 1154234 - RNA, 22 nt, Human
uuggauuacaggcaccggccau

SEQ ID NO: 1154235 - RNA, 24 nt, Human
uuggauuacaggcaccggccauca

SEQ ID NO: 1154236 - RNA, 24 nt, Human
uuggccucagccuuccgaguagcu

SEQ ID NO: 1154237 - RNA, 18 nt, Human
uugguggacaugcaguga

SEQ ID NO: 1154238 - RNA, 24 nt, Human
uuguagaggugggguuucaccaug

SEQ ID NO: 1154239 - RNA, 24 nt, Human
uuucaccauguuggccaggcuggu

SEQ ID NO: 1154240 - RNA, 24 nt, Human
uuuguagaggugggguuucaccau

SEQ ID NO: 1154241 - RNA, 23 nt, Human
uuuuuguagaggugggguuucac

SEQ ID NO: 1154242 - RNA, 22 nt, Human
aaaaaaaaaaucaguaauagga

SEQ ID NO: 1154243 - RNA, 22 nt, Human
aaaaaacuggucucacagcuua

SEQ ID NO: 1154244 - RNA, 19 nt, Human
aaaaagggacacaacuggg

SEQ ID NO: 1154245 - RNA, 24 nt, Human
aaacauuucaaagcaauggaauuc

SEQ ID NO: 1154246 - RNA, 22 nt, Human
aaaugaggcugcaaacuacccc

SEQ ID NO: 1154247 - RNA, 18 nt, Human
aaaugcacaggacaacac

SEQ ID NO: 1154248 - RNA, 20 nt, Human
aacuaccccugaauggccac

SEQ ID NO: 1154249 - RNA, 18 nt, Human
aagcaauggaauucaaaa

SEQ ID NO: 1154250 - RNA, 26 nt, Human
caaggaaaguuaaaaaaaaaaaucag

SEQ ID NO: 1154251 - RNA, 18 nt, Human
cauuguagcugcuucugc

SEQ ID NO: 1154252 - RNA, 30 nt, Human
ccccugaauggccacgauuuccuggagcuu

SEQ ID NO: 1154253 - RNA, 20 nt, Human
ccccugacggccauuguagc

SEQ ID NO: 1154254 - RNA, 18 nt, Human
ccuccugcuguaaggaau

SEQ ID NO: 1154255 - RNA, 22 nt, Human
ccugacggccauuguagcugcu

SEQ ID NO: 1154256 - RNA, 18 nt, Human
cuuggcccuggcuauagc

SEQ ID NO: 1154257 - RNA, 27 nt, Human
gccccugacggccauuguagcugcuuc

SEQ ID NO: 1154258 - RNA, 22 nt, Human
ggcuauagcaggacccacaacc

SEQ ID NO: 1154259 - RNA, 24 nt, Human
uaaaaaaaaaaaucaguaauagga

SEQ ID NO: 1154260 - RNA, 28 nt, Human
uacaaaugaggcugcaaacuaccccuga

SEQ ID NO: 1154261 - RNA, 18 nt, Human
uaccauggguacugggua

SEQ ID NO: 1154262 - RNA, 22 nt, Human
uaccccugaauggccacgauuu

SEQ ID NO: 1154263 - RNA, 18 nt, Human
uccuggagcuuggcccug

SEQ ID NO: 1154264 - RNA, 21 nt, Human
ugcaaacuaccccugaauggc

SEQ ID NO: 1154265 - RNA, 23 nt, Human
ugcacaggacaacacaauaaugu

SEQ ID NO: 1154266 - RNA, 26 nt, Human
ugcucaggcucaagggcagccuccug

SEQ ID NO: 1154267 - RNA, 19 nt, Human
uguaaggaaucaaagcuua

SEQ ID NO: 1154268 - RNA, 23 nt, Human
uucaaagcaauggaauucaaaaa

SEQ ID NO: 1154269 - RNA, 24 nt, Human
aaaaaguacugauuuuaaaaacua

SEQ ID NO: 1154270 - RNA, 19 nt, Human
aguuguuuccauuaaaaag

SEQ ID NO: 1154271 - RNA, 21 nt, Human
aaauuaaguuuauuuuuucca

SEQ ID NO: 1154272 - RNA, 21 nt, Human
acccucuguugccccuccccu

SEQ ID NO: 1154273 - RNA, 22 nt, Human
acucaaacacaaagggacccag

SEQ ID NO: 1154274 - RNA, 22 nt, Human
agaacucgaacccucaugcccc

SEQ ID NO: 1154275 - RNA, 22 nt, Human
agacgcugggagcccuggcuuc

SEQ ID NO: 1154276 - RNA, 23 nt, Human
agagagcaagaggaaguaggaga

SEQ ID NO: 1154277 - RNA, 22 nt, Human
agagaggaaagcaauaauccag

SEQ ID NO: 1154278 - RNA, 19 nt, Human
agcaagaggaaguaggaga

SEQ ID NO: 1154279 - RNA, 21 nt, Human
agcaagaggaaguaggagaaa

SEQ ID NO: 1154280 - RNA, 19 nt, Human
aggcauccuguucccagug

SEQ ID NO: 1154281 - RNA, 21 nt, Human
aguaauaauaacaauuucaca

SEQ ID NO: 1154282 - RNA, 22 nt, Human
aguuccaaaucagcccaacuuc

SEQ ID NO: 1154283 - RNA, 19 nt, Human
aguuuggguaggaaaaaag

SEQ ID NO: 1154284 - RNA, 22 nt, Human
auggguuucuucuggagugguc

SEQ ID NO: 1154285 - RNA, 21 nt, Human
caaaauaccaugcagaucccc

SEQ ID NO: 1154286 - RNA, 18 nt, Human
caaagugggucuaccugu

SEQ ID NO: 1154287 - RNA, 22 nt, Human
caccaaacccuacccuuucugg

SEQ ID NO: 1154288 - RNA, 24 nt, Human
cacgcgcgcgcacgcugucgcggu

SEQ ID NO: 1154289 - RNA, 21 nt, Human
cacuagagaggaaagcaauaa

SEQ ID NO: 1154290 - RNA, 20 nt, Human
cacuguccuggcaggaacau

SEQ ID NO: 1154291 - RNA, 18 nt, Human
cagcagaaagcuuauucu

SEQ ID NO: 1154292 - RNA, 26 nt, Human
cagcggcagaggccgaacuagcgcag

SEQ ID NO: 1154293 - RNA, 22 nt, Human
caggaacauuuccaaagccucc

SEQ ID NO: 1154294 - RNA, 25 nt, Human
caggugucucucaccaaacccuacc

SEQ ID NO: 1154295 - RNA, 25 nt, Human
cauccuugcguuauugagcucggag

SEQ ID NO: 1154296 - RNA, 23 nt, Human
cauuccugacuacccuggagcgu

SEQ ID NO: 1154297 - RNA, 19 nt, Human
ccacgcugaaggcuugggg

SEQ ID NO: 1154298 - RNA, 24 nt, Human
cccacuccccacaauacucaaaca

SEQ ID NO: 1154299 - RNA, 26 nt, Human
cccacuccccacaauacucaaacaca

SEQ ID NO: 1154300 - RNA, 20 nt, Human
cccagugagggaaaugaaau

SEQ ID NO: 1154301 - RNA, 19 nt, Human
cccccgcugccccuuuccc

SEQ ID NO: 1154302 - RNA, 22 nt, Human
ccccuuuccccuuuuagagacc

SEQ ID NO: 1154303 - RNA, 18 nt, Human
cccgcgacauuccugacu

SEQ ID NO: 1154304 - RNA, 25 nt, Human
cccgcugccccuuuccccuuuuaga

SEQ ID NO: 1154305 - RNA, 23 nt, Human
cccggcacugaccuaggcauccu

SEQ ID NO: 1154306 - RNA, 18 nt, Human
cccucuguugccccuccc

SEQ ID NO: 1154307 - RNA, 25 nt, Human
ccgccucacuggggagccccgcgac

SEQ ID NO: 1154308 - RNA, 21 nt, Human
ccucacuggggagccccgcga

SEQ ID NO: 1154309 - RNA, 24 nt, Human
ccucuguugccccuccccuuuguu

SEQ ID NO: 1154310 - RNA, 24 nt, Human
ccuguggcggggguuuggaggaac

SEQ ID NO: 1154311 - RNA, 28 nt, Human
cgcgcgccucaggccacgcgcgcgcacg

SEQ ID NO: 1154312 - RNA, 22 nt, Human
cggcagaggccgaacuagcgca

SEQ ID NO: 1154313 - RNA, 23 nt, Human
cgggaccuaggacagaacucgaa

SEQ ID NO: 1154314 - RNA, 23 nt, Human
cuagaguaggauuggaaucuguc

SEQ ID NO: 1154315 - RNA, 22 nt, Human
cuaggacagaacucgaacccuc

SEQ ID NO: 1154316 - RNA, 23 nt, Human
cucccugcguccucagguuccac

SEQ ID NO: 1154317 - RNA, 19 nt, Human
cucucaccaaacccuaccc

SEQ ID NO: 1154318 - RNA, 18 nt, Human
cugccaggccucuguggg

SEQ ID NO: 1154319 - RNA, 21 nt, Human
cugcuuagggaaagggacaau

SEQ ID NO: 1154320 - RNA, 25 nt, Human
cuuuucgcucccgccucacugggga

SEQ ID NO: 1154321 - RNA, 22 nt, Human
gaccauuucaacuccaagacag

SEQ ID NO: 1154322 - RNA, 23 nt, Human
gcacugaccuaggcauccuguuc

SEQ ID NO: 1154323 - RNA, 19 nt, Human
gcagaguugguagcugaga

SEQ ID NO: 1154324 - RNA, 24 nt, Human
gcccacuccccacaauacucaaac

SEQ ID NO: 1154325 - RNA, 20 nt, Human
gccccggccacuuucuuccu

SEQ ID NO: 1154326 - RNA, 22 nt, Human
gcgacauuccugacuacccugg

SEQ ID NO: 1154327 - RNA, 23 nt, Human
ggauuggaaucugucggcaacca

SEQ ID NO: 1154328 - RNA, 18 nt, Human
gguagcugagaggccagc

SEQ ID NO: 1154329 - RNA, 19 nt, Human
gucaugaguagugaggggu

SEQ ID NO: 1154330 - RNA, 21 nt, Human
uaaaacacccaaaggcuguag

SEQ ID NO: 1154331 - RNA, 20 nt, Human
uaaacgacgugaccuaaggc

SEQ ID NO: 1154332 - RNA, 24 nt, Human
uaccaugcagauccccaaggacuu

SEQ ID NO: 1154333 - RNA, 20 nt, Human
uagcccacuccccacaauac

SEQ ID NO: 1154334 - RNA, 19 nt, Human
uagugacauguaaacgacg

SEQ ID NO: 1154335 - RNA, 23 nt, Human
ucaaauggaaaccgcccaguaaa

SEQ ID NO: 1154336 - RNA, 19 nt, Human
ucaaguggaaacccuagaa

SEQ ID NO: 1154337 - RNA, 20 nt, Human
ucagcgcgcgccucaggcca

SEQ ID NO: 1154338 - RNA, 22 nt, Human
ucagcgcgcgccucaggccacg

SEQ ID NO: 1154339 - RNA, 19 nt, Human
ucaggccacgcgcgcgcac

SEQ ID NO: 1154340 - RNA, 23 nt, Human
uccaaagccucccucccugcguc

SEQ ID NO: 1154341 - RNA, 25 nt, Human
uccaaagccucccucccugcguccu

SEQ ID NO: 1154342 - RNA, 21 nt, Human
ucuaccuguucaaaugaaagu

SEQ ID NO: 1154343 - RNA, 18 nt, Human
ucucuucccccgcugccc

SEQ ID NO: 1154344 - RNA, 21 nt, Human
ucuuacuaaaacacccaaagg

SEQ ID NO: 1154345 - RNA, 26 nt, Human
ugaaaugauaagcuccacaaaguggg

SEQ ID NO: 1154346 - RNA, 23 nt, Human
ugaccuaggcauccuguucccag

SEQ ID NO: 1154347 - RNA, 20 nt, Human
ugccaggccucugugggccu

SEQ ID NO: 1154348 - RNA, 20 nt, Human
ugccccggccacuuucuucc

SEQ ID NO: 1154349 - RNA, 20 nt, Human
uggaguggucccuguggcgg

SEQ ID NO: 1154350 - RNA, 18 nt, Human
uggcaggaacauuuccaa

SEQ ID NO: 1154351 - RNA, 21 nt, Human
uggcaggaacauuuccaaagc

SEQ ID NO: 1154352 - RNA, 19 nt, Human
ugggacccaggauucuuac

SEQ ID NO: 1154353 - RNA, 19 nt, Human
ugggaggcuggggaaaugc

SEQ ID NO: 1154354 - RNA, 20 nt, Human
uggguaggaaaaaaggcacu

SEQ ID NO: 1154355 - RNA, 22 nt, Human
ugguagcugagaggccagcaga

SEQ ID NO: 1154356 - RNA, 20 nt, Human
uguccuggcaggaacauuuc

SEQ ID NO: 1154357 - RNA, 23 nt, Human
uucacuagagaggaaagcaauaa

SEQ ID NO: 1154358 - RNA, 18 nt, Human
uuccaaaucagcccaacu

SEQ ID NO: 1154359 - RNA, 19 nt, Human
uuccagugggaaggaagug

SEQ ID NO: 1154360 - RNA, 21 nt, Human
uugaagaccuuagugauuaga

SEQ ID NO: 1154361 - RNA, 20 nt, Human
uuucuggucucuaggccagg

SEQ ID NO: 1154362 - RNA, 23 nt, Human
aaaaaacagaaagauagcaucac

SEQ ID NO: 1154363 - RNA, 21 nt, Human
aaaaagacaaaaacaaaauaa

SEQ ID NO: 1154364 - RNA, 23 nt, Human
aaaaaguaaacaacgaaaucaga

SEQ ID NO: 1154365 - RNA, 24 nt, Human
aaaacgcgccgaguagcagcuccg

SEQ ID NO: 1154366 - RNA, 23 nt, Human
aaaagaaaaaaaacuccaacaaa

SEQ ID NO: 1154367 - RNA, 20 nt, Human
aaacaaaauaauaaaaauaa

SEQ ID NO: 1154368 - RNA, 24 nt, Human
aaacaacgaaaucagaggcagaau

SEQ ID NO: 1154369 - RNA, 19 nt, Human
aaacaccagcuugccauga

SEQ ID NO: 1154370 - RNA, 22 nt, Human
aaacagaaagauagcaucacaa

SEQ ID NO: 1154371 - RNA, 23 nt, Human
aaacugucaaagacacccuucaa

SEQ ID NO: 1154372 - RNA, 20 nt, Human
aaagauagcaucacaaacca

SEQ ID NO: 1154373 - RNA, 23 nt, Human
aaaguaaacaacgaaaucagagg

SEQ ID NO: 1154374 - RNA, 21 nt, Human
aaauaaauacaaagacaccua

SEQ ID NO: 1154375 - RNA, 23 nt, Human
aacccuugaguuuggacauucaa

SEQ ID NO: 1154376 - RNA, 23 nt, Human
aacuccaacaaacuaaagagcau

SEQ ID NO: 1154377 - RNA, 19 nt, Human
aagacaggacaccucuaua

SEQ ID NO: 1154378 - RNA, 18 nt, Human
aagcaaaugcaaagaauc

SEQ ID NO: 1154379 - RNA, 20 nt, Human
aagcaggaccccacaacuga

SEQ ID NO: 1154380 - RNA, 20 nt, Human
aaguaacuucacucaugaag

SEQ ID NO: 1154381 - RNA, 18 nt, Human
aaugguauguucuuuaau

SEQ ID NO: 1154382 - RNA, 21 nt, Human
acccaagaucgcauaugucug

SEQ ID NO: 1154383 - RNA, 30 nt, Human
acccacccccgccccccaccccgccccccu

SEQ ID NO: 1154384 - RNA, 19 nt, Human
acccccgccccccaccccg

SEQ ID NO: 1154385 - RNA, 19 nt, Human
acuccaacaaacuaaagag

SEQ ID NO: 1154386 - RNA, 23 nt, Human
acucuggucacuggccaaaauaa

SEQ ID NO: 1154387 - RNA, 20 nt, Human
acuuugcaauucugacaaug

SEQ ID NO: 1154388 - RNA, 21 nt, Human
agaaaaaagacaaaaacaaaa

SEQ ID NO: 1154389 - RNA, 20 nt, Human
agacacccuucaaaccaccc

SEQ ID NO: 1154390 - RNA, 23 nt, Human
agcaaaugcaaagaaucauuuca

SEQ ID NO: 1154391 - RNA, 22 nt, Human
agcggcaacggcggucguagag

SEQ ID NO: 1154392 - RNA, 21 nt, Human
agcuuaccucuaugaccccaa

SEQ ID NO: 1154393 - RNA, 23 nt, Human
aggaauaucaaagagggcaaagc

SEQ ID NO: 1154394 - RNA, 20 nt, Human
aggcucccaggcuuuggccc

SEQ ID NO: 1154395 - RNA, 23 nt, Human
aguaauauacuguuucagagccu

SEQ ID NO: 1154396 - RNA, 24 nt, Human
aguggugaaagcucauaagaaaaa

SEQ ID NO: 1154397 - RNA, 22 nt, Human
augaaacagaaaaaagcaagag

SEQ ID NO: 1154398 - RNA, 20 nt, Human
augaacaaauuugcaccaag

SEQ ID NO: 1154399 - RNA, 23 nt, Human
caaaaaagcuuaccucuaugacc

SEQ ID NO: 1154400 - RNA, 21 nt, Human
caaaacgcgccgaguagcagc

SEQ ID NO: 1154401 - RNA, 20 nt, Human
caaaaugaacacguuacuug

SEQ ID NO: 1154402 - RNA, 23 nt, Human
caaaaugaacacguuacuugccc

SEQ ID NO: 1154403 - RNA, 20 nt, Human
caacuucucucaguaagaca

SEQ ID NO: 1154404 - RNA, 24 nt, Human
caaguaacuucacucaugaagaca

SEQ ID NO: 1154405 - RNA, 18 nt, Human
caccaaaacagggagcca

SEQ ID NO: 1154406 - RNA, 19 nt, Human
caccaaaacagggagccaa

SEQ ID NO: 1154407 - RNA, 22 nt, Human
cacccccgccccccaccccgcc

SEQ ID NO: 1154408 - RNA, 18 nt, Human
caccccgccccccugggc

SEQ ID NO: 1154409 - RNA, 24 nt, Human
cagaaagauagcaucacaaaccac

SEQ ID NO: 1154410 - RNA, 19 nt, Human
cagaaccaggaaacuuaaa

SEQ ID NO: 1154411 - RNA, 19 nt, Human
cagcgcggcacccaccccc

SEQ ID NO: 1154412 - RNA, 26 nt, Human
cagcgcggcacccacccccgcccccc

SEQ ID NO: 1154413 - RNA, 24 nt, Human
cagcuugccaugaguccacaccaa

SEQ ID NO: 1154414 - RNA, 24 nt, Human
caggacaccucuauaccaaggcug

SEQ ID NO: 1154415 - RNA, 19 nt, Human
caggaccccacaacugaag

SEQ ID NO: 1154416 - RNA, 20 nt, Human
caucacaaaccacacgacac

SEQ ID NO: 1154417 - RNA, 20 nt, Human
caugccaaguaguucccagg

SEQ ID NO: 1154418 - RNA, 23 nt, Human
ccaaggcugccacccacagauau

SEQ ID NO: 1154419 - RNA, 20 nt, Human
ccaaguaugaaacagaaaaa

SEQ ID NO: 1154420 - RNA, 23 nt, Human
ccacagauauuuccugggugcug

SEQ ID NO: 1154421 - RNA, 27 nt, Human
ccacccacagauauuuccugggugcug

SEQ ID NO: 1154422 - RNA, 20 nt, Human
ccagcaccuaaucaggcaag

SEQ ID NO: 1154423 - RNA, 24 nt, Human
ccagcaccuaaucaggcaaguaac

SEQ ID NO: 1154424 - RNA, 27 nt, Human
cccaaaagaaauaaauacaaagacacc

SEQ ID NO: 1154425 - RNA, 24 nt, Human
cccacaacugaaggagaacuaagc

SEQ ID NO: 1154426 - RNA, 23 nt, Human
cccacccccgccccccaccccgc

SEQ ID NO: 1154427 - RNA, 22 nt, Human
cccaccccgccccccugggccu

SEQ ID NO: 1154428 - RNA, 18 nt, Human
cccaggcuuuggccccgg

SEQ ID NO: 1154429 - RNA, 23 nt, Human
cccccaccccgccccccugggcc

SEQ ID NO: 1154430 - RNA, 26 nt, Human
cccccaccccgccccccugggccucc

SEQ ID NO: 1154431 - RNA, 19 nt, Human
cccccgccccccaccccgc

SEQ ID NO: 1154432 - RNA, 20 nt, Human
cccccgccccccaccccgcc

SEQ ID NO: 1154433 - RNA, 23 nt, Human
ccccgccccccaccccgcccccc

SEQ ID NO: 1154434 - RNA, 20 nt, Human
ccccgccccccugggccucc

SEQ ID NO: 1154435 - RNA, 20 nt, Human
ccccugggccuccuccccuc

SEQ ID NO: 1154436 - RNA, 20 nt, Human
cccgacacccuuuucuccgg

SEQ ID NO: 1154437 - RNA, 25 nt, Human
cccgccccccugggccuccuccccu

SEQ ID NO: 1154438 - RNA, 24 nt, Human
cccugcccugcccuggcccucucu

SEQ ID NO: 1154439 - RNA, 21 nt, Human
ccgcggcagcgcggcacccac

SEQ ID NO: 1154440 - RNA, 19 nt, Human
ccggcucgugggcggguug

SEQ ID NO: 1154441 - RNA, 21 nt, Human
ccuccugaccucuuaaacacc

SEQ ID NO: 1154442 - RNA, 23 nt, Human
ccucuauaccaaggcugccaccc

SEQ ID NO: 1154443 - RNA, 24 nt, Human
ccuuaaaaagaaaaaaaacuccaa

SEQ ID NO: 1154444 - RNA, 23 nt, Human
cgcggcacccacccccgcccccc

SEQ ID NO: 1154445 - RNA, 25 nt, Human
cggcacccacccccgccccccaccc

SEQ ID NO: 1154446 - RNA, 30 nt, Human
cggcagcgcggcacccacccccgccccccu

SEQ ID NO: 1154447 - RNA, 21 nt, Human
cggcucgugggcggguuggcg

SEQ ID NO: 1154448 - RNA, 22 nt, Human
cucuauaccaaggcugccaccc

SEQ ID NO: 1154449 - RNA, 19 nt, Human
cucuauagcaauaccugcu

SEQ ID NO: 1154450 - RNA, 22 nt, Human
cucuauagcaauaccugcuuuu

SEQ ID NO: 1154451 - RNA, 21 nt, Human
cuggcagcggcaacggcgguc

SEQ ID NO: 1154452 - RNA, 26 nt, Human
cuggccaaaauaaauaaauccagcua

SEQ ID NO: 1154453 - RNA, 22 nt, Human
cugggccuccuccccucgcagg

SEQ ID NO: 1154454 - RNA, 19 nt, Human
cuugccaugaguccacacc

SEQ ID NO: 1154455 - RNA, 25 nt, Human
gaaaaaagcaagaggauucaugggc

SEQ ID NO: 1154456 - RNA, 18 nt, Human
gacaauggcaaagauuag

SEQ ID NO: 1154457 - RNA, 23 nt, Human
gagccaauaccuuccagcaccua

SEQ ID NO: 1154458 - RNA, 22 nt, Human
gcagcgcggcacccacccccgc

SEQ ID NO: 1154459 - RNA, 22 nt, Human
gcaucagaaagagauuuguuuc

SEQ ID NO: 1154460 - RNA, 24 nt, Human
gccccccaccccgccccccugggc

SEQ ID NO: 1154461 - RNA, 26 nt, Human
gccccgacacccuuuucuccggcccc

SEQ ID NO: 1154462 - RNA, 23 nt, Human
ggcaaagcaggaccccacaacug

SEQ ID NO: 1154463 - RNA, 21 nt, Human
gggaggagcuggacugcagcg

SEQ ID NO: 1154464 - RNA, 20 nt, Human
gggcggguuggcgggcgggc

SEQ ID NO: 1154465 - RNA, 26 nt, Human
guggccccgacacccuuuucuccggc

SEQ ID NO: 1154466 - RNA, 21 nt, Human
uaaaaaacagaaagauagcau

SEQ ID NO: 1154467 - RNA, 26 nt, Human
uaaaaaacagaaagauagcaucacaa

SEQ ID NO: 1154468 - RNA, 22 nt, Human
uaagacaggaaccaggaauauc

SEQ ID NO: 1154469 - RNA, 19 nt, Human
uaauaggauagaaucguua

SEQ ID NO: 1154470 - RNA, 27 nt, Human
uaauuacauaugcuaaaauuaacauuu

SEQ ID NO: 1154471 - RNA, 20 nt, Human
uacauuguuugguggaaaag

SEQ ID NO: 1154472 - RNA, 21 nt, Human
uauagcaauaccugcuuuuga

SEQ ID NO: 1154473 - RNA, 19 nt, Human
uaucaaagagggcaaagca

SEQ ID NO: 1154474 - RNA, 23 nt, Human
uaucaaagagggcaaagcaggac

SEQ ID NO: 1154475 - RNA, 27 nt, Human
uaugaccccaaaagaaauaaauacaaa

SEQ ID NO: 1154476 - RNA, 18 nt, Human
uauggcuuaagaucuccu

SEQ ID NO: 1154477 - RNA, 19 nt, Human
uauggcuuaagaucuccuu

SEQ ID NO: 1154478 - RNA, 19 nt, Human
uauguaaaaaacagaaaga

SEQ ID NO: 1154479 - RNA, 25 nt, Human
uaugucugauuucaauuggccaaaa

SEQ ID NO: 1154480 - RNA, 22 nt, Human
ucaaagacacccuucaaaccac

SEQ ID NO: 1154481 - RNA, 21 nt, Human
ucccagguucauaugauucuc

SEQ ID NO: 1154482 - RNA, 19 nt, Human
ucgcaggcucccaggcuuu

SEQ ID NO: 1154483 - RNA, 20 nt, Human
ucgcaggcucccaggcuuuc

SEQ ID NO: 1154484 - RNA, 23 nt, Human
ucuauagcaauaccugcuuuuga

SEQ ID NO: 1154485 - RNA, 20 nt, Human
ucucucaguaagacaggaac

SEQ ID NO: 1154486 - RNA, 22 nt, Human
ucucuggcagcggcaacggcgg

SEQ ID NO: 1154487 - RNA, 23 nt, Human
ugaaacagaaaaaagcaagagga

SEQ ID NO: 1154488 - RNA, 21 nt, Human
ugaaauaguaauauacuguuu

SEQ ID NO: 1154489 - RNA, 25 nt, Human
ugaacaaauuugcaccaaguaugaa

SEQ ID NO: 1154490 - RNA, 28 nt, Human
ugaacagacgugguaucuucuauuuggg

SEQ ID NO: 1154491 - RNA, 19 nt, Human
ugaguagacaucaugggug

SEQ ID NO: 1154492 - RNA, 19 nt, Human
ugcaaaaacccaagaucgc

SEQ ID NO: 1154493 - RNA, 19 nt, Human
ugcaccaaguaugaaacag

SEQ ID NO: 1154494 - RNA, 21 nt, Human
ugccaugaguccacaccaaaa

SEQ ID NO: 1154495 - RNA, 22 nt, Human
ugcccugcccuggcccucucug

SEQ ID NO: 1154496 - RNA, 24 nt, Human
ugcugcgcgucccugcccugcccu

SEQ ID NO: 1154497 - RNA, 19 nt, Human
uggcagcggcaacggcggu

SEQ ID NO: 1154498 - RNA, 22 nt, Human
ugggcauuuucaucuauggcuu

SEQ ID NO: 1154499 - RNA, 21 nt, Human
ugggcggguuggcgggcgggc

SEQ ID NO: 1154500 - RNA, 19 nt, Human
uguaaaaaacagaaagaua

SEQ ID NO: 1154501 - RNA, 20 nt, Human
uguaaaaaacagaaagauag

SEQ ID NO: 1154502 - RNA, 23 nt, Human
uuaauucugcuuggaaaacuguc

SEQ ID NO: 1154503 - RNA, 21 nt, Human
uucacugauagaaaugggcaa

SEQ ID NO: 1154504 - RNA, 26 nt, Human
uuuccaugcaaaaacccaagaucgca

SEQ ID NO: 1154505 - RNA, 19 nt, Human
aacauggugaaaccccguc

SEQ ID NO: 1154506 - RNA, 20 nt, Human
aacauggugaaaccccgucu

SEQ ID NO: 1154507 - RNA, 21 nt, Human
aacauggugaaaccccgucuc

SEQ ID NO: 1154508 - RNA, 18 nt, Human
aacuguagagacagaaga

SEQ ID NO: 1154509 - RNA, 18 nt, Human
aagaaacaaauacugugu

SEQ ID NO: 1154510 - RNA, 19 nt, Human
aagaggccaggcgcggugg

SEQ ID NO: 1154511 - RNA, 18 nt, Human
aagauggcacaacuguag

SEQ ID NO: 1154512 - RNA, 19 nt, Human
aagcagcgcacagcugugg

SEQ ID NO: 1154513 - RNA, 19 nt, Human
aauacacucugcugacaac

SEQ ID NO: 1154514 - RNA, 23 nt, Human
acaacuguagagacagaagaaga

SEQ ID NO: 1154515 - RNA, 20 nt, Human
acacagcugcacagagaggu

SEQ ID NO: 1154516 - RNA, 21 nt, Human
acacaucaccaccaucacaca

SEQ ID NO: 1154517 - RNA, 21 nt, Human
acagaagaagaguccucccuu

SEQ ID NO: 1154518 - RNA, 20 nt, Human
acaucaccaccaucacacau

SEQ ID NO: 1154519 - RNA, 25 nt, Human
acaucaccaccaucacacaugugcu

SEQ ID NO: 1154520 - RNA, 27 nt, Human
acaugugcucacacacacacacccugc

SEQ ID NO: 1154521 - RNA, 25 nt, Human
accaucacacaugugcucacacaca

SEQ ID NO: 1154522 - RNA, 18 nt, Human
accccgucucuacuaaaa

SEQ ID NO: 1154523 - RNA, 24 nt, Human
acugcauuccagcuugggcaacag

SEQ ID NO: 1154524 - RNA, 24 nt, Human
acugugccacugcauuccagcuug

SEQ ID NO: 1154525 - RNA, 21 nt, Human
agacugccucccacgacauca

SEQ ID NO: 1154526 - RNA, 24 nt, Human
agcacuuugggaggccgagguggg

SEQ ID NO: 1154527 - RNA, 21 nt, Human
aggccgaggugggcagaucau

SEQ ID NO: 1154528 - RNA, 24 nt, Human
aggcgcggugucucacgccuauaa

SEQ ID NO: 1154529 - RNA, 23 nt, Human
aggcuacagugagcagugacugu

SEQ ID NO: 1154530 - RNA, 24 nt, Human
aggugggcagaucaugaggucagg

SEQ ID NO: 1154531 - RNA, 19 nt, Human
aucagaacaggugaggucc

SEQ ID NO: 1154532 - RNA, 21 nt, Human
augugcucacacacacacagu

SEQ ID NO: 1154533 - RNA, 21 nt, Human
cacacacacccugcuggacuc

SEQ ID NO: 1154534 - RNA, 21 nt, Human
cacacacccugcuggacuccc

SEQ ID NO: 1154535 - RNA, 19 nt, Human
cacagcuguggccugcuuc

SEQ ID NO: 1154536 - RNA, 26 nt, Human
cacaucaccaccaucacacaugugcu

SEQ ID NO: 1154537 - RNA, 20 nt, Human
cacaugugcucacacacaca

SEQ ID NO: 1154538 - RNA, 24 nt, Human
cacgccuauaaucccagcacuuug

SEQ ID NO: 1154539 - RNA, 21 nt, Human
cacuagccgagaccacccuag

SEQ ID NO: 1154540 - RNA, 23 nt, Human
cacugcauuccagcuugggcaac

SEQ ID NO: 1154541 - RNA, 24 nt, Human
cacugcauuccagcuugggcaaca

SEQ ID NO: 1154542 - RNA, 21 nt, Human
cagaaggagaagaggccaggc

SEQ ID NO: 1154543 - RNA, 22 nt, Human
cagaaggggcagaaaugggagc

SEQ ID NO: 1154544 - RNA, 24 nt, Human
cagcacuuugggaggccgaggugg

SEQ ID NO: 1154545 - RNA, 22 nt, Human
cagcaggacgauagcaaagaga

SEQ ID NO: 1154546 - RNA, 18 nt, Human
caggugaggucccaccau

SEQ ID NO: 1154547 - RNA, 23 nt, Human
cagguuccaagcccagacugccu

SEQ ID NO: 1154548 - RNA, 18 nt, Human
caucacagcugccauucu

SEQ ID NO: 1154549 - RNA, 20 nt, Human
ccacugcauuccagcuuggg

SEQ ID NO: 1154550 - RNA, 21 nt, Human
ccacugcauuccagcuugggc

SEQ ID NO: 1154551 - RNA, 23 nt, Human
ccacugcauuccagcuugggcaa

SEQ ID NO: 1154552 - RNA, 24 nt, Human
ccacugcauuccagcuugggcaac

SEQ ID NO: 1154553 - RNA, 21 nt, Human
ccacuuggcccacacugggcu

SEQ ID NO: 1154554 - RNA, 20 nt, Human
cccccucucucacacacaca

SEQ ID NO: 1154555 - RNA, 22 nt, Human
ccuagguaacauggugaaaccc

SEQ ID NO: 1154556 - RNA, 23 nt, Human
ccuagguaacauggugaaacccc

SEQ ID NO: 1154557 - RNA, 24 nt, Human
ccuagguaacauggugaaaccccg

SEQ ID NO: 1154558 - RNA, 22 nt, Human
ccuauaaucccagcacuuuggg

SEQ ID NO: 1154559 - RNA, 26 nt, Human
ccuccagaaggggcagaaaugggagc

SEQ ID NO: 1154560 - RNA, 23 nt, Human
ccugcuggacucccggcuuugcu

SEQ ID NO: 1154561 - RNA, 24 nt, Human
cgagaccacccuagguaacauggu

SEQ ID NO: 1154562 - RNA, 24 nt, Human
cgaggugggcagaucaugagguca

SEQ ID NO: 1154563 - RNA, 22 nt, Human
cgauagcaaagagauuguccac

SEQ ID NO: 1154564 - RNA, 20 nt, Human
cuacagugagcagugacugu

SEQ ID NO: 1154565 - RNA, 22 nt, Human
cucacgccuauaaucccagcac

SEQ ID NO: 1154566 - RNA, 24 nt, Human
cucacgccuauaaucccagcacuu

SEQ ID NO: 1154567 - RNA, 19 nt, Human
cucucacacacacaucacc

SEQ ID NO: 1154568 - RNA, 22 nt, Human
cugcugaggucacacagcugca

SEQ ID NO: 1154569 - RNA, 23 nt, Human
cugcugaggucacacagcugcac

SEQ ID NO: 1154570 - RNA, 23 nt, Human
cuuugggaggccgaggugggcag

SEQ ID NO: 1154571 - RNA, 19 nt, Human
gaccuuuguggagcugaag

SEQ ID NO: 1154572 - RNA, 21 nt, Human
gacugugccacugcauuccag

SEQ ID NO: 1154573 - RNA, 21 nt, Human
gagaagaggccaggcgcggug

SEQ ID NO: 1154574 - RNA, 23 nt, Human
gagcuccagagucaaggcuacag

SEQ ID NO: 1154575 - RNA, 23 nt, Human
gaggugggcagaucaugagguca

SEQ ID NO: 1154576 - RNA, 24 nt, Human
gccacugcauuccagcuugggcaa

SEQ ID NO: 1154577 - RNA, 18 nt, Human
gcugaggucacacagcug

SEQ ID NO: 1154578 - RNA, 19 nt, Human
gcuggacucccggcuuugc

SEQ ID NO: 1154579 - RNA, 21 nt, Human
ggcagaucaugaggucaggag

SEQ ID NO: 1154580 - RNA, 24 nt, Human
ggugucucacgccuauaaucccag

SEQ ID NO: 1154581 - RNA, 22 nt, Human
gucaagacccuuauuccccagg

SEQ ID NO: 1154582 - RNA, 20 nt, Human
guggagcuccagagucaagg

SEQ ID NO: 1154583 - RNA, 27 nt, Human
uaaaauacacucugcugacaacacugu

SEQ ID NO: 1154584 - RNA, 22 nt, Human
uaacauggugaaaccccgucuc

SEQ ID NO: 1154585 - RNA, 24 nt, Human
uaacauggugaaaccccgucucua

SEQ ID NO: 1154586 - RNA, 21 nt, Human
uacacucugcugacaacacug

SEQ ID NO: 1154587 - RNA, 20 nt, Human
uagguaacauggugaaaccc

SEQ ID NO: 1154588 - RNA, 21 nt, Human
ucacacacacaucaccaccau

SEQ ID NO: 1154589 - RNA, 23 nt, Human
ucacacacacaucaccaccauca

SEQ ID NO: 1154590 - RNA, 25 nt, Human
ucacacacacaucaccaccaucaca

SEQ ID NO: 1154591 - RNA, 22 nt, Human
ucacacagguugcaaggagugg

SEQ ID NO: 1154592 - RNA, 20 nt, Human
ucaggaucugcugaggucac

SEQ ID NO: 1154593 - RNA, 18 nt, Human
ucaugaggucaggagauc

SEQ ID NO: 1154594 - RNA, 24 nt, Human
ucaugaggucaggagaucgacacu

SEQ ID NO: 1154595 - RNA, 23 nt, Human
uccagcuugggcaacagucaaga

SEQ ID NO: 1154596 - RNA, 19 nt, Human
ucccggcuuugcugcucuc

SEQ ID NO: 1154597 - RNA, 18 nt, Human
ucucacacacacaucacc

SEQ ID NO: 1154598 - RNA, 25 nt, Human
ucuuccuggugcuggaggaagaugg

SEQ ID NO: 1154599 - RNA, 24 nt, Human
ugaagaaacaaauacuguguggca

SEQ ID NO: 1154600 - RNA, 21 nt, Human
ugaggucacacagcugcacag

SEQ ID NO: 1154601 - RNA, 22 nt, Human
ugaggucacacagcugcacaga

SEQ ID NO: 1154602 - RNA, 18 nt, Human
ugcacagagagguggggg

SEQ ID NO: 1154603 - RNA, 19 nt, Human
ugcugaggucacacagcug

SEQ ID NO: 1154604 - RNA, 22 nt, Human
uggacucccggcuuugcugcuc

SEQ ID NO: 1154605 - RNA, 22 nt, Human
uggcagacaagcccuucuuccu

SEQ ID NO: 1154606 - RNA, 19 nt, Human
ugggaggccgaggugggca

SEQ ID NO: 1154607 - RNA, 20 nt, Human
ugggaggccgaggugggcag

SEQ ID NO: 1154608 - RNA, 24 nt, Human
ugggaggccgaggugggcagauca

SEQ ID NO: 1154609 - RNA, 22 nt, Human
ugggcagaucaugaggucagga

SEQ ID NO: 1154610 - RNA, 22 nt, Human
uguaaaauacacucugcugaca

SEQ ID NO: 1154611 - RNA, 24 nt, Human
ugucucacgccuauaaucccagca

SEQ ID NO: 1154612 - RNA, 23 nt, Human
ugugcucacacacacacacccug

SEQ ID NO: 1154613 - RNA, 18 nt, Human
uguguggcaaauauaaga

SEQ ID NO: 1154614 - RNA, 25 nt, Human
uugggaggccgaggugggcagauca

SEQ ID NO: 1154615 - RNA, 19 nt, Human
agcggcuggccagaaaucc

SEQ ID NO: 1154616 - RNA, 18 nt, Human
ggguagcggcuggccaga

SEQ ID NO: 1154617 - RNA, 21 nt, Human
uggccagaaauccuuugccuu

SEQ ID NO: 1154618 - RNA, 21 nt, Human
aacgccuccccccaccccccc

SEQ ID NO: 1154619 - RNA, 23 nt, Human
aagccgcuaccaccaacccucca

SEQ ID NO: 1154620 - RNA, 22 nt, Human
acccccccgacgcccucccccu

SEQ ID NO: 1154621 - RNA, 20 nt, Human
accggaacgccuccccccac

SEQ ID NO: 1154622 - RNA, 24 nt, Human
ccccaagccgcuaccaccaacccu

SEQ ID NO: 1154623 - RNA, 22 nt, Human
ccccacccccccgacgcccucc

SEQ ID NO: 1154624 - RNA, 25 nt, Human
cccccacccccccgacgcccucccc

SEQ ID NO: 1154625 - RNA, 26 nt, Human
ccccccacccccccgacgcccucccc

SEQ ID NO: 1154626 - RNA, 24 nt, Human
cccccgacgcccucccccucccuc

SEQ ID NO: 1154627 - RNA, 20 nt, Human
ccgcuaccaccaacccucca

SEQ ID NO: 1154628 - RNA, 21 nt, Human
cggaacgccuccccccacccc

SEQ ID NO: 1154629 - RNA, 22 nt, Human
cggaacgccuccccccaccccc

SEQ ID NO: 1154630 - RNA, 23 nt, Human
cggaacgccuccccccacccccc

SEQ ID NO: 1154631 - RNA, 24 nt, Human
cggagucccucacagccuccgccu

SEQ ID NO: 1154632 - RNA, 22 nt, Human
cgggggaagcgugcgagagagc

SEQ ID NO: 1154633 - RNA, 23 nt, Human
cgggggggggaaacgaagggagc

SEQ ID NO: 1154634 - RNA, 23 nt, Human
cuccccccacccccccgacgccc

SEQ ID NO: 1154635 - RNA, 22 nt, Human
cucgcacacacuccggcacgca

SEQ ID NO: 1154636 - RNA, 19 nt, Human
gaagggagccgggggaagc

SEQ ID NO: 1154637 - RNA, 18 nt, Human
gaccggaacgccuccccc

SEQ ID NO: 1154638 - RNA, 24 nt, Human
gaccggaacgccuccccccacccc

SEQ ID NO: 1154639 - RNA, 23 nt, Human
gagcaccuccccaagccgcuacc

SEQ ID NO: 1154640 - RNA, 18 nt, Human
gagccgggggaagcgugc

SEQ ID NO: 1154641 - RNA, 21 nt, Human
gagccgggggaagcgugcgag

SEQ ID NO: 1154642 - RNA, 23 nt, Human
gcccucccccucccucgcacaca

SEQ ID NO: 1154643 - RNA, 18 nt, Human
gggggggaaacgaaggga

SEQ ID NO: 1154644 - RNA, 18 nt, Human
guaaaacuaaagguccau

SEQ ID NO: 1154645 - RNA, 23 nt, Human
uaaaaccagaacuguauguaaaa

SEQ ID NO: 1154646 - RNA, 18 nt, Human
uccccccacccccccgac

SEQ ID NO: 1154647 - RNA, 19 nt, Human
uccggcacgcaggcgaccg

SEQ ID NO: 1154648 - RNA, 20 nt, Human
ucucuuguaaaacuaaaggu

SEQ ID NO: 1154649 - RNA, 22 nt, Human
ucucuuguaaaacuaaaggucc

SEQ ID NO: 1154650 - RNA, 18 nt, Human
ugcgagagagcaagaccg

SEQ ID NO: 1154651 - RNA, 23 nt, Human
ugcuucucuuguaaaacuaaagg

SEQ ID NO: 1154652 - RNA, 21 nt, Human
uguaaaacuaaagguccauuu

SEQ ID NO: 1154653 - RNA, 22 nt, Human
uuggggaccggaacgccucccc

SEQ ID NO: 1154654 - RNA, 21 nt, Human
aaaagcccaggaugggggaua

SEQ ID NO: 1154655 - RNA, 18 nt, Human
aaaggaagaggcaagagg

SEQ ID NO: 1154656 - RNA, 20 nt, Human
aacuccuaaccagaccacac

SEQ ID NO: 1154657 - RNA, 22 nt, Human
aagcaaggcaaacaugaucuag

SEQ ID NO: 1154658 - RNA, 18 nt, Human
acauuagaaagacacuag

SEQ ID NO: 1154659 - RNA, 22 nt, Human
accacacgcaggaggagcucca

SEQ ID NO: 1154660 - RNA, 21 nt, Human
accccuggccacggggccuuu

SEQ ID NO: 1154661 - RNA, 19 nt, Human
acgcaggaggagcuccagg

SEQ ID NO: 1154662 - RNA, 18 nt, Human
acuugugccuaugcacaa

SEQ ID NO: 1154663 - RNA, 18 nt, Human
agaaaggaagaggcaaga

SEQ ID NO: 1154664 - RNA, 22 nt, Human
agaauaacccuggagcaaacaa

SEQ ID NO: 1154665 - RNA, 23 nt, Human
agacagaccccccaacccugccc

SEQ ID NO: 1154666 - RNA, 19 nt, Human
agcagaagacagacccccc

SEQ ID NO: 1154667 - RNA, 21 nt, Human
agcagaagacagaccccccaa

SEQ ID NO: 1154668 - RNA, 23 nt, Human
agcgggugaugcucaugugccau

SEQ ID NO: 1154669 - RNA, 18 nt, Human
agggacccccaggcacca

SEQ ID NO: 1154670 - RNA, 21 nt, Human
aguucuuucccaauagcucua

SEQ ID NO: 1154671 - RNA, 25 nt, Human
auaauaaaaucuccuguucaggcca

SEQ ID NO: 1154672 - RNA, 32 nt, Human
auccuguccacacccacauauucuccuccaac

SEQ ID NO: 1154673 - RNA, 18 nt, Human
aucugaaagguuguggaa

SEQ ID NO: 1154674 - RNA, 19 nt, Human
caacucaacuccuaaccag

SEQ ID NO: 1154675 - RNA, 24 nt, Human
cacacgcaggaggagcuccaggga

SEQ ID NO: 1154676 - RNA, 24 nt, Human
cacacucuacaaaacccugagggc

SEQ ID NO: 1154677 - RNA, 22 nt, Human
cacagggacccccaggcaccag

SEQ ID NO: 1154678 - RNA, 21 nt, Human
caccucccuccagcccuggcc

SEQ ID NO: 1154679 - RNA, 18 nt, Human
cacgugcuccuguggccc

SEQ ID NO: 1154680 - RNA, 18 nt, Human
cacgugcuccuguggccc

SEQ ID NO: 1154681 - RNA, 18 nt, Human
cacucuacaaaacccuga

SEQ ID NO: 1154682 - RNA, 20 nt, Human
cacucuacaaaacccugagg

SEQ ID NO: 1154683 - RNA, 23 nt, Human
cagaagacagaccccccaacccu

SEQ ID NO: 1154684 - RNA, 23 nt, Human
cagaccacacgcaggaggagcuc

SEQ ID NO: 1154685 - RNA, 20 nt, Human
cagaccccccaacccugccc

SEQ ID NO: 1154686 - RNA, 22 nt, Human
cagcagaagacagaccccccaa

SEQ ID NO: 1154687 - RNA, 25 nt, Human
cagcagaagacagaccccccaaccc

SEQ ID NO: 1154688 - RNA, 26 nt, Human
cagcaggccaccaucagcgggugaug

SEQ ID NO: 1154689 - RNA, 19 nt, Human
cagccagggugccccaggu

SEQ ID NO: 1154690 - RNA, 21 nt, Human
cagccauggcuuccuucccaa

SEQ ID NO: 1154691 - RNA, 21 nt, Human
caggagcacccgacaggucug

SEQ ID NO: 1154692 - RNA, 22 nt, Human
caggucugugggcaaacccaug

SEQ ID NO: 1154693 - RNA, 20 nt, Human
cauccaaccacucugauggg

SEQ ID NO: 1154694 - RNA, 26 nt, Human
ccaacccugcccaccagggcucacac

SEQ ID NO: 1154695 - RNA, 24 nt, Human
ccaccaagccauacacuaucaugu

SEQ ID NO: 1154696 - RNA, 19 nt, Human
ccaccaucagcgggugaug

SEQ ID NO: 1154697 - RNA, 22 nt, Human
ccaccucccuccagcccuggcc

SEQ ID NO: 1154698 - RNA, 19 nt, Human
ccacggggccuuugcacag

SEQ ID NO: 1154699 - RNA, 18 nt, Human
cccaaggccacugcuggc

SEQ ID NO: 1154700 - RNA, 22 nt, Human
cccaccucccuccagcccuggc

SEQ ID NO: 1154701 - RNA, 20 nt, Human
ccccagacccagugugaccc

SEQ ID NO: 1154702 - RNA, 24 nt, Human
ccccaggucucagggucucucagg

SEQ ID NO: 1154703 - RNA, 23 nt, Human
cccccagacccagugugacccau

SEQ ID NO: 1154704 - RNA, 23 nt, Human
ccguccuggcucauggggggcag

SEQ ID NO: 1154705 - RNA, 18 nt, Human
ccucaccuagggugcucc

SEQ ID NO: 1154706 - RNA, 23 nt, Human
ccuggcccacuugugccuaugca

SEQ ID NO: 1154707 - RNA, 24 nt, Human
ccuggcccacuugugguccccugg

SEQ ID NO: 1154708 - RNA, 22 nt, Human
ccuggcucauggggggcagguc

SEQ ID NO: 1154709 - RNA, 25 nt, Human
ccugggcagacguggagaccugaaa

SEQ ID NO: 1154710 - RNA, 21 nt, Human
ccuuggagacccuggggggau

SEQ ID NO: 1154711 - RNA, 19 nt, Human
ccuuggugcauguccucca

SEQ ID NO: 1154712 - RNA, 21 nt, Human
cguuacacuucguuuucaauu

SEQ ID NO: 1154713 - RNA, 24 nt, Human
cucuacaaaacccugagggccuag

SEQ ID NO: 1154714 - RNA, 21 nt, Human
cucugggucccgaguuaucuc

SEQ ID NO: 1154715 - RNA, 24 nt, Human
cucuugacucugacgggccucauc

SEQ ID NO: 1154716 - RNA, 21 nt, Human
cugacugugggaucugggggc

SEQ ID NO: 1154717 - RNA, 19 nt, Human
cugccagcugacugugaug

SEQ ID NO: 1154718 - RNA, 22 nt, Human
cuggccagccagggugccccag

SEQ ID NO: 1154719 - RNA, 19 nt, Human
cuucagaagcccccaucuc

SEQ ID NO: 1154720 - RNA, 19 nt, Human
gaaaauuaaaaacagauac

SEQ ID NO: 1154721 - RNA, 18 nt, Human
gaaguucagcugccagcu

SEQ ID NO: 1154722 - RNA, 21 nt, Human
gaaguucuuucccaauagcuc

SEQ ID NO: 1154723 - RNA, 22 nt, Human
gacaggucugugggcaaaccca

SEQ ID NO: 1154724 - RNA, 21 nt, Human
gaccccccaacccugcccacc

SEQ ID NO: 1154725 - RNA, 18 nt, Human
gagaaagacacacguugc

SEQ ID NO: 1154726 - RNA, 19 nt, Human
gagaaagacacacguugcc

SEQ ID NO: 1154727 - RNA, 21 nt, Human
gagaccugaaauucuccauuu

SEQ ID NO: 1154728 - RNA, 23 nt, Human
gagcacccgacaggucugugggc

SEQ ID NO: 1154729 - RNA, 22 nt, Human
gcccucaggucagccucuggcu

SEQ ID NO: 1154730 - RNA, 19 nt, Human
gcccuggaggaugucacag

SEQ ID NO: 1154731 - RNA, 22 nt, Human
ggaccucugcagucaggacccu

SEQ ID NO: 1154732 - RNA, 18 nt, Human
ggagacccuggggggaug

SEQ ID NO: 1154733 - RNA, 18 nt, Human
ggaggagaauaacccugg

SEQ ID NO: 1154734 - RNA, 22 nt, Human
ggccacucacaggagcacccga

SEQ ID NO: 1154735 - RNA, 21 nt, Human
ggccaguuguccagagaaaga

SEQ ID NO: 1154736 - RNA, 20 nt, Human
gggauauuugugacgcucug

SEQ ID NO: 1154737 - RNA, 21 nt, Human
gucuggagggguaugggccgg

SEQ ID NO: 1154738 - RNA, 21 nt, Human
gugcuccaaugucauggcuac

SEQ ID NO: 1154739 - RNA, 18 nt, Human
gugcuccugggugguguc

SEQ ID NO: 1154740 - RNA, 23 nt, Human
guggcuugccagcccacccucuc

SEQ ID NO: 1154741 - RNA, 24 nt, Human
guuugcaaacagcccucuggacac

SEQ ID NO: 1154742 - RNA, 24 nt, Human
uaacccuggagcaaacaacucaac

SEQ ID NO: 1154743 - RNA, 19 nt, Human
uaagagaagaagaaaccug

SEQ ID NO: 1154744 - RNA, 20 nt, Human
uaagagccgaucgggauugg

SEQ ID NO: 1154745 - RNA, 20 nt, Human
uaagagccgaucgggauugg

SEQ ID NO: 1154746 - RNA, 20 nt, Human
uacaaagugcacuaguguuu

SEQ ID NO: 1154747 - RNA, 25 nt, Human
uacaagcagcauccagcagaagaca

SEQ ID NO: 1154748 - RNA, 18 nt, Human
uaccaagugagguucuga

SEQ ID NO: 1154749 - RNA, 22 nt, Human
uacugccaggaauaccuaaggg

SEQ ID NO: 1154750 - RNA, 24 nt, Human
uagcuaaaagcuaggauacaucua

SEQ ID NO: 1154751 - RNA, 21 nt, Human
uagggugcuccuggguggugu

SEQ ID NO: 1154752 - RNA, 22 nt, Human
uauagcaggaaagccagagaag

SEQ ID NO: 1154753 - RNA, 20 nt, Human
uaucauguucccacuuuucu

SEQ ID NO: 1154754 - RNA, 23 nt, Human
ucagaagcccccaucuccucugg

SEQ ID NO: 1154755 - RNA, 24 nt, Human
ucagcuuuucuaguagcuccucag

SEQ ID NO: 1154756 - RNA, 21 nt, Human
ucagggucucucagggucucc

SEQ ID NO: 1154757 - RNA, 21 nt, Human
uccacacccacauauucuccu

SEQ ID NO: 1154758 - RNA, 25 nt, Human
uccagagaaagacacacguugccau

SEQ ID NO: 1154759 - RNA, 19 nt, Human
uccagcagaagacagaccc

SEQ ID NO: 1154760 - RNA, 19 nt, Human
ucccaccucccuccagccc

SEQ ID NO: 1154761 - RNA, 18 nt, Human
ucccauccuguccacacc

SEQ ID NO: 1154762 - RNA, 19 nt, Human
uccccggaaguggcuugcc

SEQ ID NO: 1154763 - RNA, 20 nt, Human
ucccgaguuaucucuagcug

SEQ ID NO: 1154764 - RNA, 22 nt, Human
ucccugggacagagggugaaaa

SEQ ID NO: 1154765 - RNA, 23 nt, Human
ucuacaucagcaucugaaagguu

SEQ ID NO: 1154766 - RNA, 19 nt, Human
ucuaggggugaacacaggg

SEQ ID NO: 1154767 - RNA, 24 nt, Human
ucuccauuucacuguaaacugggc

SEQ ID NO: 1154768 - RNA, 18 nt, Human
ucuccuccaccccuggcc

SEQ ID NO: 1154769 - RNA, 23 nt, Human
ucugaaguucagcugccagcuga

SEQ ID NO: 1154770 - RNA, 18 nt, Human
ucugcaaacuuccugagu

SEQ ID NO: 1154771 - RNA, 22 nt, Human
ucuggguuaagauuggcagggc

SEQ ID NO: 1154772 - RNA, 19 nt, Human
ucuuguggagcggggagcu

SEQ ID NO: 1154773 - RNA, 19 nt, Human
ucuuguggagcggggagcu

SEQ ID NO: 1154774 - RNA, 19 nt, Human
ucuuguggagcggggagcu

SEQ ID NO: 1154775 - RNA, 23 nt, Human
ugaaagguuguggaaauuguguc

SEQ ID NO: 1154776 - RNA, 24 nt, Human
ugaagggcccgcugaagaaaagga

SEQ ID NO: 1154777 - RNA, 18 nt, Human
ugaccuggccagccaggg

SEQ ID NO: 1154778 - RNA, 26 nt, Human
ugaccuggccagccagggugccccag

SEQ ID NO: 1154779 - RNA, 21 nt, Human
ugacgggccucaucucuccua

SEQ ID NO: 1154780 - RNA, 18 nt, Human
ugacugugacucgaggag

SEQ ID NO: 1154781 - RNA, 19 nt, Human
ugacuguggggggaccguc

SEQ ID NO: 1154782 - RNA, 19 nt, Human
ugagggccuagaaaucugu

SEQ ID NO: 1154783 - RNA, 21 nt, Human
ugaugagguuucccaccuccc

SEQ ID NO: 1154784 - RNA, 19 nt, Human
ugcacaaagacaucuggag

SEQ ID NO: 1154785 - RNA, 24 nt, Human
ugcacaggcugacuguggggggac

SEQ ID NO: 1154786 - RNA, 25 nt, Human
ugccagcccacccucucugaaccac

SEQ ID NO: 1154787 - RNA, 21 nt, Human
uggaaauuguguccaugaaaa

SEQ ID NO: 1154788 - RNA, 20 nt, Human
uggaagggaaaacuggucag

SEQ ID NO: 1154789 - RNA, 19 nt, Human
uggagcaaacaacucaacu

SEQ ID NO: 1154790 - RNA, 23 nt, Human
uggagucagcugaaguucuuucc

SEQ ID NO: 1154791 - RNA, 20 nt, Human
uggauuuccaaagcacaggu

SEQ ID NO: 1154792 - RNA, 23 nt, Human
uggcugcacggaccucugcaguc

SEQ ID NO: 1154793 - RNA, 21 nt, Human
uggcuucccaacaacgcagau

SEQ ID NO: 1154794 - RNA, 22 nt, Human
uggcuugccagcccacccucuc

SEQ ID NO: 1154795 - RNA, 25 nt, Human
uggggcggaaggaguuuuccccgag

SEQ ID NO: 1154796 - RNA, 21 nt, Human
ugucacaggugucuuguggag

SEQ ID NO: 1154797 - RNA, 18 nt, Human
uguuugcaaacagcccuc

SEQ ID NO: 1154798 - RNA, 20 nt, Human
uuaaaggaucucaucucuga

SEQ ID NO: 1154799 - RNA, 21 nt, Human
uuaagggauggaagaguuuau

SEQ ID NO: 1154800 - RNA, 18 nt, Human
uucagaagcccccaucuc

SEQ ID NO: 1154801 - RNA, 26 nt, Human
uucccaccucccuccagcccuggccc

SEQ ID NO: 1154802 - RNA, 20 nt, Human
uucucuaagcaaggcaaaca

SEQ ID NO: 1154803 - RNA, 26 nt, Human
uuucacuguaaacugggccaguuguc

SEQ ID NO: 1154804 - RNA, 22 nt, Human
uuuccagaucacaggugucuug

SEQ ID NO: 1154805 - RNA, 26 nt, Human
uuuccugugguuacaaagcuuuugau

SEQ ID NO: 1154806 - RNA, 24 nt, Human
aaaguguugggauuacaggcuuga

SEQ ID NO: 1154807 - RNA, 18 nt, Human
aacccuguccuuccccca

SEQ ID NO: 1154808 - RNA, 22 nt, Human
aagccacccucccacuucagcc

SEQ ID NO: 1154809 - RNA, 20 nt, Human
aagugcuugcuucccagccc

SEQ ID NO: 1154810 - RNA, 19 nt, Human
aaguguugggauuacaggc

SEQ ID NO: 1154811 - RNA, 20 nt, Human
aaguguugggauuacaggcu

SEQ ID NO: 1154812 - RNA, 20 nt, Human
accagcagugcacaggccag

SEQ ID NO: 1154813 - RNA, 19 nt, Human
accucggucucccaaagug

SEQ ID NO: 1154814 - RNA, 25 nt, Human
acucugucguccaggcuggagugca

SEQ ID NO: 1154815 - RNA, 18 nt, Human
acugugcccggccugggc

SEQ ID NO: 1154816 - RNA, 23 nt, Human
acuucagccucccaaguagccgg

SEQ ID NO: 1154817 - RNA, 19 nt, Human
agacagcaagggggacccu

SEQ ID NO: 1154818 - RNA, 24 nt, Human
agaggcagacagcaagggggaccc

SEQ ID NO: 1154819 - RNA, 18 nt, Human
agcacaagccaccacacc

SEQ ID NO: 1154820 - RNA, 23 nt, Human
agccgggacaacaagcacaagcc

SEQ ID NO: 1154821 - RNA, 22 nt, Human
aggcuugacgacugugcccggc

SEQ ID NO: 1154822 - RNA, 21 nt, Human
aguagagucuggucaccugga

SEQ ID NO: 1154823 - RNA, 24 nt, Human
agugcaguggugugaucacagcuc

SEQ ID NO: 1154824 - RNA, 23 nt, Human
aguguugggauuacaggcuugac

SEQ ID NO: 1154825 - RNA, 22 nt, Human
augggggccucccuguguuucc

SEQ ID NO: 1154826 - RNA, 18 nt, Human
caaaguguugggauuaca

SEQ ID NO: 1154827 - RNA, 25 nt, Human
caagcacaagccaccacaaucaacg

SEQ ID NO: 1154828 - RNA, 21 nt, Human
caagccaccacaccuggcuaa

SEQ ID NO: 1154829 - RNA, 23 nt, Human
caccagcagugcacaggccaguc

SEQ ID NO: 1154830 - RNA, 24 nt, Human
cacucugucguccaggcuggagug

SEQ ID NO: 1154831 - RNA, 23 nt, Human
cagcacagugaccugcccggcag

SEQ ID NO: 1154832 - RNA, 21 nt, Human
caggagaaugcgcgugcagca

SEQ ID NO: 1154833 - RNA, 19 nt, Human
caguucuccugcauguccu

SEQ ID NO: 1154834 - RNA, 21 nt, Human
ccaaaaaaggccgggucuaaa

SEQ ID NO: 1154835 - RNA, 19 nt, Human
ccaaaguguugggauuaca

SEQ ID NO: 1154836 - RNA, 22 nt, Human
ccaaaguguugggauuacaggc

SEQ ID NO: 1154837 - RNA, 23 nt, Human
ccaaaguguugggauuacaggcu

SEQ ID NO: 1154838 - RNA, 19 nt, Human
ccaagcaccagcagugcac

SEQ ID NO: 1154839 - RNA, 24 nt, Human
ccaaggaacccuguccuuccccca

SEQ ID NO: 1154840 - RNA, 18 nt, Human
ccaggcuggagugcagug

SEQ ID NO: 1154841 - RNA, 21 nt, Human
ccaggcuggagugcaguggug

SEQ ID NO: 1154842 - RNA, 24 nt, Human
cccaaaguguugggauuacaggcu

SEQ ID NO: 1154843 - RNA, 20 nt, Human
cccaaggaacccuguccuuc

SEQ ID NO: 1154844 - RNA, 19 nt, Human
cccaugcgcuacgagaccg

SEQ ID NO: 1154845 - RNA, 21 nt, Human
cccaugcgcuacgagaccgcg

SEQ ID NO: 1154846 - RNA, 26 nt, Human
cccccagaucuggaggccccgggggc

SEQ ID NO: 1154847 - RNA, 22 nt, Human
ccccgggggcaaggcacgggga

SEQ ID NO: 1154848 - RNA, 22 nt, Human
ccccuuccuucucuucaagugc

SEQ ID NO: 1154849 - RNA, 18 nt, Human
cccgacaguucuccugca

SEQ ID NO: 1154850 - RNA, 18 nt, Human
cccuuucuccccuuccuu

SEQ ID NO: 1154851 - RNA, 20 nt, Human
cccuuucuccccuuccuucu

SEQ ID NO: 1154852 - RNA, 21 nt, Human
ccggcaggaggucucagcacc

SEQ ID NO: 1154853 - RNA, 23 nt, Human
ccucccacuucagccucccaagu

SEQ ID NO: 1154854 - RNA, 26 nt, Human
ccucccacuucagccucccaaguagc

SEQ ID NO: 1154855 - RNA, 18 nt, Human
ccuggacucaagccaccc

SEQ ID NO: 1154856 - RNA, 21 nt, Human
ccuguccuucccccagaucug

SEQ ID NO: 1154857 - RNA, 18 nt, Human
cgacaguucuccugcaug

SEQ ID NO: 1154858 - RNA, 18 nt, Human
cggcgccaggcggcggcc

SEQ ID NO: 1154859 - RNA, 24 nt, Human
cguccaggcuggagugcaguggug

SEQ ID NO: 1154860 - RNA, 24 nt, Human
cucaagccacccucccacuucagc

SEQ ID NO: 1154861 - RNA, 24 nt, Human
cucacucugucguccaggcuggag

SEQ ID NO: 1154862 - RNA, 26 nt, Human
cuccccuuccuucucuucaagugcuu

SEQ ID NO: 1154863 - RNA, 21 nt, Human
cuggucccgacaguucuccug

SEQ ID NO: 1154864 - RNA, 22 nt, Human
cuuagccccggcgccaggcggc

SEQ ID NO: 1154865 - RNA, 22 nt, Human
cuuugugucgccugcucccugg

SEQ ID NO: 1154866 - RNA, 23 nt, Human
cuuuuuggaaugagucuuccugg

SEQ ID NO: 1154867 - RNA, 23 nt, Human
gaauaaaggacaaugggguucua

SEQ ID NO: 1154868 - RNA, 24 nt, Human
gagugcaguggugugaucacagcu

SEQ ID NO: 1154869 - RNA, 20 nt, Human
gauuacaggcuugacgacug

SEQ ID NO: 1154870 - RNA, 21 nt, Human
gcagcagccucccagggugag

SEQ ID NO: 1154871 - RNA, 20 nt, Human
gcaggccccaguugguccug

SEQ ID NO: 1154872 - RNA, 23 nt, Human
gccacccucccacuucagccucc

SEQ ID NO: 1154873 - RNA, 23 nt, Human
gccggcggccacuuagccccggc

SEQ ID NO: 1154874 - RNA, 19 nt, Human
gccgggacaacaagcacaa

SEQ ID NO: 1154875 - RNA, 18 nt, Human
gcggguggccucagcaca

SEQ ID NO: 1154876 - RNA, 19 nt, Human
gcgugcagcagccucccag

SEQ ID NO: 1154877 - RNA, 22 nt, Human
gcuuuuuggaaugagucuuccu

SEQ ID NO: 1154878 - RNA, 22 nt, Human
ggacaacaagcacaagccacca

SEQ ID NO: 1154879 - RNA, 22 nt, Human
ggcuggagugcaguggugugau

SEQ ID NO: 1154880 - RNA, 23 nt, Human
gggacaacaagcacaagccacca

SEQ ID NO: 1154881 - RNA, 24 nt, Human
guccaggcuggagugcaguggugu

SEQ ID NO: 1154882 - RNA, 21 nt, Human
guccuuggcggguggccucag

SEQ ID NO: 1154883 - RNA, 18 nt, Human
gucguccaggcuggagug

SEQ ID NO: 1154884 - RNA, 23 nt, Human
uacccccaccucggucucccaaa

SEQ ID NO: 1154885 - RNA, 20 nt, Human
uagccgggacaacaagcaca

SEQ ID NO: 1154886 - RNA, 18 nt, Human
uaugcaggccccaguugg

SEQ ID NO: 1154887 - RNA, 25 nt, Human
ucaagccacccucccacuucagccu

SEQ ID NO: 1154888 - RNA, 18 nt, Human
ucacaggacuucccugcg

SEQ ID NO: 1154889 - RNA, 24 nt, Human
ucacucugucguccaggcuggagu

SEQ ID NO: 1154890 - RNA, 20 nt, Human
ucagccucccaaguagccgg

SEQ ID NO: 1154891 - RNA, 21 nt, Human
ucagccucccaaguagccggg

SEQ ID NO: 1154892 - RNA, 24 nt, Human
ucccaaaguguugggauuacaggc

SEQ ID NO: 1154893 - RNA, 21 nt, Human
ucccuguguuucccaggcuga

SEQ ID NO: 1154894 - RNA, 19 nt, Human
uccuggucccgacaguucu

SEQ ID NO: 1154895 - RNA, 20 nt, Human
uccuggucccgacaguucuc

SEQ ID NO: 1154896 - RNA, 23 nt, Human
uccuggucccgacaguucuccug

SEQ ID NO: 1154897 - RNA, 24 nt, Human
ucguccaggcuggagugcaguggu

SEQ ID NO: 1154898 - RNA, 23 nt, Human
ucucacucugucguccaggcugg

SEQ ID NO: 1154899 - RNA, 24 nt, Human
ucucacucugucguccaggcugga

SEQ ID NO: 1154900 - RNA, 24 nt, Human
ucugucguccaggcuggagugcag

SEQ ID NO: 1154901 - RNA, 19 nt, Human
ugaguagagucuggucacc

SEQ ID NO: 1154902 - RNA, 27 nt, Human
ugcaggccccaguugguccugaagucc

SEQ ID NO: 1154903 - RNA, 22 nt, Human
ugcaguggugugaucacagcuc

SEQ ID NO: 1154904 - RNA, 22 nt, Human
ugcgcgugcagcagccucccag

SEQ ID NO: 1154905 - RNA, 21 nt, Human
ugcuugcuucccagcccacug

SEQ ID NO: 1154906 - RNA, 18 nt, Human
uggaagcuuagauacugg

SEQ ID NO: 1154907 - RNA, 21 nt, Human
uggaggccccgggggcaaggc

SEQ ID NO: 1154908 - RNA, 19 nt, Human
uggagugcaguggugugau

SEQ ID NO: 1154909 - RNA, 19 nt, Human
uggagugcaguggugugau

SEQ ID NO: 1154910 - RNA, 21 nt, Human
uggagugcaguggugugauca

SEQ ID NO: 1154911 - RNA, 28 nt, Human
uggagugcaguggugugauggcucuagc

SEQ ID NO: 1154912 - RNA, 23 nt, Human
ugggauuacaggcuugacgacug

SEQ ID NO: 1154913 - RNA, 25 nt, Human
ugggggccucccuguguuucccagg

SEQ ID NO: 1154914 - RNA, 22 nt, Human
ugguccugaaguccuuccucaa

SEQ ID NO: 1154915 - RNA, 20 nt, Human
ugugaucacagcucagugca

SEQ ID NO: 1154916 - RNA, 18 nt, Human
uucccagcccacuggaca

SEQ ID NO: 1154917 - RNA, 22 nt, Human
uucccccagaucuggaggcccc

SEQ ID NO: 1154918 - RNA, 19 nt, Human
uuccuggucccgacaguuc

SEQ ID NO: 1154919 - RNA, 21 nt, Human
uuggggcucgaugggugcuaa

SEQ ID NO: 1154920 - RNA, 19 nt, Human
acccagacccaagaaugaa

SEQ ID NO: 1154921 - RNA, 20 nt, Human
acccugaggauauuaaugaa

SEQ ID NO: 1154922 - RNA, 19 nt, Human
agaaggcaucucuaccucu

SEQ ID NO: 1154923 - RNA, 20 nt, Human
auuuaaacuauguaaaugug

SEQ ID NO: 1154924 - RNA, 20 nt, Human
auuuaaacuauguaaaugug

SEQ ID NO: 1154925 - RNA, 21 nt, Human
cagcaacauuuuaagaugaaa

SEQ ID NO: 1154926 - RNA, 24 nt, Human
cauacugaacuuacagagguuucc

SEQ ID NO: 1154927 - RNA, 21 nt, Human
caucucuaccucucugucuau

SEQ ID NO: 1154928 - RNA, 24 nt, Human
ccauuuguucagauuuaauuugga

SEQ ID NO: 1154929 - RNA, 19 nt, Human
cccuccuuauuucuuaguc

SEQ ID NO: 1154930 - RNA, 20 nt, Human
cuaauccaccuuauccacau

SEQ ID NO: 1154931 - RNA, 24 nt, Human
cuugcauuaaaaacgggaaaaaga

SEQ ID NO: 1154932 - RNA, 23 nt, Human
gaugaaauugcccaaagcagggu

SEQ ID NO: 1154933 - RNA, 21 nt, Human
ggagggcaacuuaccacuaca

SEQ ID NO: 1154934 - RNA, 21 nt, Human
uaagugcuuguaaggccagga

SEQ ID NO: 1154935 - RNA, 22 nt, Human
uaauccaccuuauccacauaag

SEQ ID NO: 1154936 - RNA, 18 nt, Human
uaccuugcauuaaaaacg

SEQ ID NO: 1154937 - RNA, 21 nt, Human
uccauacugaacuuacagagg

SEQ ID NO: 1154938 - RNA, 23 nt, Human
ugcuaauccaccuuauccacaua

SEQ ID NO: 1154939 - RNA, 21 nt, Human
uguguuaacuguuuuaaagug

SEQ ID NO: 1154940 - RNA, 20 nt, Human
uugaaaagcugcaaaaucug

SEQ ID NO: 1154941 - RNA, 21 nt, Human
uugaaaagcugcaaaaucugg

SEQ ID NO: 1154942 - RNA, 24 nt, Human
uugcucuuccacccugaggauauu

SEQ ID NO: 1154943 - RNA, 18 nt, Human
aaccaagcccccaccugc

SEQ ID NO: 1154944 - RNA, 20 nt, Human
caaccaagcccccaccugcc

SEQ ID NO: 1154945 - RNA, 22 nt, Human
caaccaagcccccaccugcccc

SEQ ID NO: 1154946 - RNA, 24 nt, Human
caaccaagcccccaccugccccuu

SEQ ID NO: 1154947 - RNA, 20 nt, Human
caagcccccaccugccccuu

SEQ ID NO: 1154948 - RNA, 18 nt, Human
caccacugccggcccaac

SEQ ID NO: 1154949 - RNA, 25 nt, Human
cagcaaccaagcccccaccugcccc

SEQ ID NO: 1154950 - RNA, 24 nt, Human
cagcagggugacccguuccuggcu

SEQ ID NO: 1154951 - RNA, 21 nt, Human
caggaagagcacugggccuug

SEQ ID NO: 1154952 - RNA, 25 nt, Human
cauaggaaaggcccagccaaguccc

SEQ ID NO: 1154953 - RNA, 23 nt, Human
caucaagcucugauucccucaaa

SEQ ID NO: 1154954 - RNA, 21 nt, Human
cccaccacugccggcccaacc

SEQ ID NO: 1154955 - RNA, 18 nt, Human
ccccauagggugccacug

SEQ ID NO: 1154956 - RNA, 21 nt, Human
ccccauagggugccacugcuc

SEQ ID NO: 1154957 - RNA, 21 nt, Human
ccuagagcacagagcccucug

SEQ ID NO: 1154958 - RNA, 25 nt, Human
ccuguccaguucuguacaguagcau

SEQ ID NO: 1154959 - RNA, 19 nt, Human
cucccucccaccuauccac

SEQ ID NO: 1154960 - RNA, 21 nt, Human
cuuuaaaauauacauuauaua

SEQ ID NO: 1154961 - RNA, 20 nt, Human
gaggaagaagggcgggagcc

SEQ ID NO: 1154962 - RNA, 20 nt, Human
gaggggcacacucuccagga

SEQ ID NO: 1154963 - RNA, 24 nt, Human
gcacagagcccucuggccccacca

SEQ ID NO: 1154964 - RNA, 22 nt, Human
gcucuguggggacuugggccgg

SEQ ID NO: 1154965 - RNA, 25 nt, Human
gcuggagcuacagaaggugcucugg

SEQ ID NO: 1154966 - RNA, 21 nt, Human
gggcacagagugaucuucagc

SEQ ID NO: 1154967 - RNA, 21 nt, Human
uacaguagcaucaagcucuga

SEQ ID NO: 1154968 - RNA, 18 nt, Human
uagccccauagggugcca

SEQ ID NO: 1154969 - RNA, 23 nt, Human
uagcuccuagagcacagagcccu

SEQ ID NO: 1154970 - RNA, 23 nt, Human
ucaucuucaauaugauucucuca

SEQ ID NO: 1154971 - RNA, 18 nt, Human
uccuagagcacagagccc

SEQ ID NO: 1154972 - RNA, 23 nt, Human
ucuccaggaaccaagguuagccu

SEQ ID NO: 1154973 - RNA, 23 nt, Human
ugagggcuuggcuccucccccag

SEQ ID NO: 1154974 - RNA, 18 nt, Human
ugcuggaggaagaagggc

SEQ ID NO: 1154975 - RNA, 20 nt, Human
ugcuggaggaagaagggcgg

SEQ ID NO: 1154976 - RNA, 20 nt, Human
ugcuggagggaggguggagg

SEQ ID NO: 1154977 - RNA, 23 nt, Human
uggugugaucagggcugcuggag

SEQ ID NO: 1154978 - RNA, 20 nt, Human
uugcucccucccaccuaucc

SEQ ID NO: 1154979 - RNA, 24 nt, Human
aguguguaccaguuguacaagaaa

SEQ ID NO: 1154980 - RNA, 24 nt, Human
aucauucugaaguacaaucaccuc

SEQ ID NO: 1154981 - RNA, 22 nt, Human
cagcggccgggggugacagcag

SEQ ID NO: 1154982 - RNA, 18 nt, Human
cccucaggcucgcuccca

SEQ ID NO: 1154983 - RNA, 20 nt, Human
ccuggcgccuggccucaggc

SEQ ID NO: 1154984 - RNA, 21 nt, Human
ccuuuaaaauugccaaaauug

SEQ ID NO: 1154985 - RNA, 19 nt, Human
cggccgggggugacagcag

SEQ ID NO: 1154986 - RNA, 24 nt, Human
cggcugucuggcuucaggcgacac

SEQ ID NO: 1154987 - RNA, 22 nt, Human
gagagguguggggagagaccga

SEQ ID NO: 1154988 - RNA, 24 nt, Human
gcggccgggggugacagcagcggc

SEQ ID NO: 1154989 - RNA, 21 nt, Human
ggagggcagcagcggccgggg

SEQ ID NO: 1154990 - RNA, 21 nt, Human
ggcgagagguguggggagaga

SEQ ID NO: 1154991 - RNA, 20 nt, Human
gggcagcagcggccgggggu

SEQ ID NO: 1154992 - RNA, 25 nt, Human
uaaauggcccucaggcucgcuccca

SEQ ID NO: 1154993 - RNA, 18 nt, Human
ugagauaaauggcccuca

SEQ ID NO: 1154994 - RNA, 21 nt, Human
ugggcacauguagauggcagg

SEQ ID NO: 1154995 - RNA, 20 nt, Human
ugguauauggguuuaucauu

SEQ ID NO: 1154996 - RNA, 19 nt, Human
aaaauguucacaagcucuc

SEQ ID NO: 1154997 - RNA, 23 nt, Human
aagaaaaagaacaucuaugaagu

SEQ ID NO: 1154998 - RNA, 23 nt, Human
aagaaauaaacacacgaaaaaga

SEQ ID NO: 1154999 - RNA, 24 nt, Human
aagaacacucaucaaucaaagaca

SEQ ID NO: 1155000 - RNA, 24 nt, Human
aagauuauuuaaaaugcagguccc

SEQ ID NO: 1155001 - RNA, 24 nt, Human
aagcaaauauuuguuauggaccca

SEQ ID NO: 1155002 - RNA, 22 nt, Human
aagcacagugcagaacucuggu

SEQ ID NO: 1155003 - RNA, 22 nt, Human
agaaauaaacacacgaaaaaga

SEQ ID NO: 1155004 - RNA, 24 nt, Human
agaaauacaaagcuuaaucguaga

SEQ ID NO: 1155005 - RNA, 21 nt, Human
agaggaagaaaaagaacaucu

SEQ ID NO: 1155006 - RNA, 21 nt, Human
aggaagaaaaagaacaucuau

SEQ ID NO: 1155007 - RNA, 21 nt, Human
aguagccaacucccuuagcau

SEQ ID NO: 1155008 - RNA, 21 nt, Human
agucucauuuggaaggaaagu

SEQ ID NO: 1155009 - RNA, 23 nt, Human
aguuuaugagaaguguuacacuu

SEQ ID NO: 1155010 - RNA, 19 nt, Human
aucucuauaaaacuaacac

SEQ ID NO: 1155011 - RNA, 21 nt, Human
caaagcuuaaucguagaguuu

SEQ ID NO: 1155012 - RNA, 24 nt, Human
caagcaguucacaauugccauuuu

SEQ ID NO: 1155013 - RNA, 21 nt, Human
caaggcucucugaaagcacca

SEQ ID NO: 1155014 - RNA, 18 nt, Human
caaggugcuagaaauaca

SEQ ID NO: 1155015 - RNA, 19 nt, Human
caccaggaaacaucuucag

SEQ ID NO: 1155016 - RNA, 22 nt, Human
caggaaacaucuucagaguuca

SEQ ID NO: 1155017 - RNA, 21 nt, Human
cccacuagaggaagaaaaaga

SEQ ID NO: 1155018 - RNA, 24 nt, Human
ccuauggccauaguuacuguuuug

SEQ ID NO: 1155019 - RNA, 22 nt, Human
cucucuauccucuucuuggagg

SEQ ID NO: 1155020 - RNA, 21 nt, Human
cugugcuucagucugauauca

SEQ ID NO: 1155021 - RNA, 23 nt, Human
gaggaacucuauaaugcaauuca

SEQ ID NO: 1155022 - RNA, 21 nt, Human
gauucaccaggaaacaucuuc

SEQ ID NO: 1155023 - RNA, 18 nt, Human
gccuauggccauaguuac

SEQ ID NO: 1155024 - RNA, 19 nt, Human
ggaggguggaagcggggag

SEQ ID NO: 1155025 - RNA, 22 nt, Human
gguaaugaugaacaauauggaa

SEQ ID NO: 1155026 - RNA, 26 nt, Human
ggucauggagcuuuuaaaucacagag

SEQ ID NO: 1155027 - RNA, 18 nt, Human
gguccagggucauggagc

SEQ ID NO: 1155028 - RNA, 25 nt, Human
gucugguaccaggugucaaggcucc

SEQ ID NO: 1155029 - RNA, 18 nt, Human
gugauaguagccaacucc

SEQ ID NO: 1155030 - RNA, 20 nt, Human
guucaaggggguggagguca

SEQ ID NO: 1155031 - RNA, 20 nt, Human
guucauucaccuuaagccaa

SEQ ID NO: 1155032 - RNA, 24 nt, Human
uaaaacaaaauguaaugguuccuu

SEQ ID NO: 1155033 - RNA, 22 nt, Human
uaacgucugaauaaacagccuu

SEQ ID NO: 1155034 - RNA, 22 nt, Human
uaauaggaaaacugagguucac

SEQ ID NO: 1155035 - RNA, 19 nt, Human
uacgaggaacucuauaaug

SEQ ID NO: 1155036 - RNA, 20 nt, Human
uacuaaagaaauaaacacac

SEQ ID NO: 1155037 - RNA, 21 nt, Human
uagcaagucuuugcucuaucc

SEQ ID NO: 1155038 - RNA, 21 nt, Human
uagccaaggugcuagaaauac

SEQ ID NO: 1155039 - RNA, 24 nt, Human
uaucauaauccccuuuccacagaa

SEQ ID NO: 1155040 - RNA, 28 nt, Human
uaugugcaaggucuuuacaugcagugug

SEQ ID NO: 1155041 - RNA, 23 nt, Human
uauuucaaaugcaugcaguuuau

SEQ ID NO: 1155042 - RNA, 23 nt, Human
ucaaacauuagcaagucuuugcu

SEQ ID NO: 1155043 - RNA, 27 nt, Human
ucaaagacagucuuaagagucucuccu

SEQ ID NO: 1155044 - RNA, 18 nt, Human
ucaagcaguucacaauug

SEQ ID NO: 1155045 - RNA, 21 nt, Human
ucaccaggaaacaucuucaga

SEQ ID NO: 1155046 - RNA, 20 nt, Human
uccacauauguuuauugauu

SEQ ID NO: 1155047 - RNA, 27 nt, Human
ucccagucuccauccuaagugauucug

SEQ ID NO: 1155048 - RNA, 24 nt, Human
ucuacaugucgcagccgauuuaga

SEQ ID NO: 1155049 - RNA, 19 nt, Human
ucucaaacauuagcaaguc

SEQ ID NO: 1155050 - RNA, 22 nt, Human
ucucuccuuuaucucuauaaaa

SEQ ID NO: 1155051 - RNA, 25 nt, Human
ucugaauauuugaaacucuaaaaca

SEQ ID NO: 1155052 - RNA, 23 nt, Human
ucuuuacaugcaacaucugauca

SEQ ID NO: 1155053 - RNA, 22 nt, Human
ucuuuggauucaccaggaaaca

SEQ ID NO: 1155054 - RNA, 20 nt, Human
ugaaagcaccagucaucauc

SEQ ID NO: 1155055 - RNA, 22 nt, Human
ugaauaagaaacaguauagcca

SEQ ID NO: 1155056 - RNA, 25 nt, Human
ugagguggagaccaggaaucugaau

SEQ ID NO: 1155057 - RNA, 20 nt, Human
uggaggguggaagcggggag

SEQ ID NO: 1155058 - RNA, 22 nt, Human
uggaggguggaagcggggagua

SEQ ID NO: 1155059 - RNA, 19 nt, Human
ugguaccaggugucaaggc

SEQ ID NO: 1155060 - RNA, 20 nt, Human
ugucaggggucuccuaaccu

SEQ ID NO: 1155061 - RNA, 24 nt, Human
uuaauucuauagguggucuuccuc

SEQ ID NO: 1155062 - RNA, 18 nt, Human
uucaaggggguggagguc

SEQ ID NO: 1155063 - RNA, 19 nt, Human
uucacagauguaaauacua

SEQ ID NO: 1155064 - RNA, 23 nt, Human
uucaccaggaaacaucuucagag

SEQ ID NO: 1155065 - RNA, 24 nt, Human
uugggggagguuggaggguggaag

SEQ ID NO: 1155066 - RNA, 21 nt, Human
uuuuuguccuauauuuaggaa

SEQ ID NO: 1155067 - RNA, 18 nt, Human
aggcaacugugcuggccu

SEQ ID NO: 1155068 - RNA, 23 nt, Human
cagggguuuccguuucucaucuc

SEQ ID NO: 1155069 - RNA, 27 nt, Human
ccaaagguuugcugugugggcccaagg

SEQ ID NO: 1155070 - RNA, 21 nt, Human
cccaggcaacugugcuggccu

SEQ ID NO: 1155071 - RNA, 24 nt, Human
cccaggcaacugugcuggccucca

SEQ ID NO: 1155072 - RNA, 23 nt, Human
ccccgacuccaggcugucccccu

SEQ ID NO: 1155073 - RNA, 23 nt, Human
ccuccagcugggucccccgacuc

SEQ ID NO: 1155074 - RNA, 18 nt, Human
cgaugguaaugagucagg

SEQ ID NO: 1155075 - RNA, 19 nt, Human
gaacucguugcuacccaaa

SEQ ID NO: 1155076 - RNA, 25 nt, Human
ggaaaaacaaucuggacuccuuagg

SEQ ID NO: 1155077 - RNA, 21 nt, Human
gggguuuccguuucucaucuc

SEQ ID NO: 1155078 - RNA, 18 nt, Human
uagaaagggcugccaaug

SEQ ID NO: 1155079 - RNA, 20 nt, Human
uagaacucguugcuacccaa

SEQ ID NO: 1155080 - RNA, 18 nt, Human
ucagggguuuccguuucu

SEQ ID NO: 1155081 - RNA, 24 nt, Human
ucagggguuuccguuucucaucuc

SEQ ID NO: 1155082 - RNA, 19 nt, Human
ucgcccaggcaacugugcu

SEQ ID NO: 1155083 - RNA, 23 nt, Human
ugagagacagaguuaguaugcug

SEQ ID NO: 1155084 - RNA, 25 nt, Human
ugauaguagaccuggucuacucccc

SEQ ID NO: 1155085 - RNA, 18 nt, Human
ugcugcuagauaggcaug

SEQ ID NO: 1155086 - RNA, 20 nt, Human
uggauccgucuucucuguuc

SEQ ID NO: 1155087 - RNA, 22 nt, Human
uggccuccagcugggucccccu

SEQ ID NO: 1155088 - RNA, 23 nt, Human
ugggaagaguuuuugcuaggacu

SEQ ID NO: 1155089 - RNA, 20 nt, Human
ugugcugauaguagaccugg

SEQ ID NO: 1155090 - RNA, 25 nt, Human
uuucaaggaaaaacaaucuggacua

SEQ ID NO: 1155091 - RNA, 18 nt, Human
uuugcugugugggcccaa

SEQ ID NO: 1155092 - RNA, 23 nt, Human
aaacugaagcaaaagaucagcga

SEQ ID NO: 1155093 - RNA, 21 nt, Human
aaagcccaggugagagucagg

SEQ ID NO: 1155094 - RNA, 22 nt, Human
aagaaacugaagcaaaagauca

SEQ ID NO: 1155095 - RNA, 18 nt, Human
aagaguucagggaaggga

SEQ ID NO: 1155096 - RNA, 18 nt, Human
aagcuucccuggcuugcc

SEQ ID NO: 1155097 - RNA, 25 nt, Human
aauauauaaugaaacaauuacacaa

SEQ ID NO: 1155098 - RNA, 26 nt, Human
agacacagaauccuagcuacagcuac

SEQ ID NO: 1155099 - RNA, 18 nt, Human
agacuagcccacgcuccg

SEQ ID NO: 1155100 - RNA, 21 nt, Human
agaucccucucaugccuaguu

SEQ ID NO: 1155101 - RNA, 21 nt, Human
agcuacuaaagaaaagaacac

SEQ ID NO: 1155102 - RNA, 21 nt, Human
aggcggggggaguggggaagu

SEQ ID NO: 1155103 - RNA, 21 nt, Human
aguggguugcugaaauggacc

SEQ ID NO: 1155104 - RNA, 24 nt, Human
auaaaugaggcacauaaacauuaa

SEQ ID NO: 1155105 - RNA, 21 nt, Human
augcaaaaguggguugcugaa

SEQ ID NO: 1155106 - RNA, 22 nt, Human
auggggagcagcuguaaauaca

SEQ ID NO: 1155107 - RNA, 21 nt, Human
caaagcccaggugagagucag

SEQ ID NO: 1155108 - RNA, 23 nt, Human
caacgaaaucaggcaggaccgaa

SEQ ID NO: 1155109 - RNA, 24 nt, Human
cacagccucaaggaggagggaacc

SEQ ID NO: 1155110 - RNA, 18 nt, Human
cacaguaguuccagcucc

SEQ ID NO: 1155111 - RNA, 25 nt, Human
cacuucuugcuguguagcccgguuc

SEQ ID NO: 1155112 - RNA, 21 nt, Human
cagagauucacuucuugcugu

SEQ ID NO: 1155113 - RNA, 19 nt, Human
cagcagcagcuccagcagg

SEQ ID NO: 1155114 - RNA, 23 nt, Human
cagcauauacuguuagauucuga

SEQ ID NO: 1155115 - RNA, 25 nt, Human
cagcuguaaauacagauuaagcuuc

SEQ ID NO: 1155116 - RNA, 21 nt, Human
caggacgaguguccggacuug

SEQ ID NO: 1155117 - RNA, 18 nt, Human
cauaaggagcauaaccua

SEQ ID NO: 1155118 - RNA, 25 nt, Human
ccaaggccugauaaagguuuuugaa

SEQ ID NO: 1155119 - RNA, 25 nt, Human
ccaugggcugguacccguuuguggc

SEQ ID NO: 1155120 - RNA, 19 nt, Human
cccauccuugacgcucauc

SEQ ID NO: 1155121 - RNA, 19 nt, Human
ccccgggcucucgcccuuc

SEQ ID NO: 1155122 - RNA, 20 nt, Human
ccccuucucccauccuugac

SEQ ID NO: 1155123 - RNA, 21 nt, Human
ccggggcuggauggggggccg

SEQ ID NO: 1155124 - RNA, 21 nt, Human
ccuagcuacagcuacuaaaga

SEQ ID NO: 1155125 - RNA, 18 nt, Human
ccugggucaggcugcugg

SEQ ID NO: 1155126 - RNA, 22 nt, Human
cgaggccagccaguggcacccc

SEQ ID NO: 1155127 - RNA, 19 nt, Human
cgcagggccaaagcccagg

SEQ ID NO: 1155128 - RNA, 24 nt, Human
cgcggcggcggcgacgccgacacc

SEQ ID NO: 1155129 - RNA, 19 nt, Human
cgcggcucccggggcugga

SEQ ID NO: 1155130 - RNA, 19 nt, Human
cggaagaaagagacgcggc

SEQ ID NO: 1155131 - RNA, 20 nt, Human
cggcccgcggacgaaagagg

SEQ ID NO: 1155132 - RNA, 22 nt, Human
cuacagcuacuaaagaaaagaa

SEQ ID NO: 1155133 - RNA, 25 nt, Human
cucauaaggagcauaaccuagaucc

SEQ ID NO: 1155134 - RNA, 22 nt, Human
cucaugccacagcugaucugac

SEQ ID NO: 1155135 - RNA, 22 nt, Human
cuccaaggccugauaaagguuu

SEQ ID NO: 1155136 - RNA, 20 nt, Human
cucuggaucuccccuucucc

SEQ ID NO: 1155137 - RNA, 23 nt, Human
cugcugccaucgauagaagcagc

SEQ ID NO: 1155138 - RNA, 19 nt, Human
cugcugccguugucgucgc

SEQ ID NO: 1155139 - RNA, 24 nt, Human
cuuugcggugggcccgucggcccc

SEQ ID NO: 1155140 - RNA, 18 nt, Human
gaaguucuuccgugaccu

SEQ ID NO: 1155141 - RNA, 30 nt, Human
gacuagcccacgcuccgguucugagccgcc

SEQ ID NO: 1155142 - RNA, 26 nt, Human
gagcauaaccuagaucccucucaugc

SEQ ID NO: 1155143 - RNA, 23 nt, Human
gagcuuauuuuccugcaacuaga

SEQ ID NO: 1155144 - RNA, 24 nt, Human
gagcuuauuuuccugcaacuagau

SEQ ID NO: 1155145 - RNA, 18 nt, Human
gauagaagcagcacucuc

SEQ ID NO: 1155146 - RNA, 26 nt, Human
gcaacgaaaucaggcaggaccgaacc

SEQ ID NO: 1155147 - RNA, 19 nt, Human
gcccagguguuaaggcagu

SEQ ID NO: 1155148 - RNA, 23 nt, Human
ggagacggcgaggcccggccccc

SEQ ID NO: 1155149 - RNA, 19 nt, Human
ggcccgggggcuggggaca

SEQ ID NO: 1155150 - RNA, 22 nt, Human
ggccgagcgcgcaugugcggga

SEQ ID NO: 1155151 - RNA, 18 nt, Human
ggcggugcaggucguccg

SEQ ID NO: 1155152 - RNA, 20 nt, Human
gggacccgacauugugcuug

SEQ ID NO: 1155153 - RNA, 20 nt, Human
gggccaaagcccaggugaga

SEQ ID NO: 1155154 - RNA, 23 nt, Human
gggccaaagcccaggugagaguc

SEQ ID NO: 1155155 - RNA, 20 nt, Human
ggggggccgaggccagccag

SEQ ID NO: 1155156 - RNA, 21 nt, Human
guacagcaugcaaaagugggu

SEQ ID NO: 1155157 - RNA, 24 nt, Human
guccguaacuccugaccuggauuu

SEQ ID NO: 1155158 - RNA, 18 nt, Human
uaaagcagguguccaaac

SEQ ID NO: 1155159 - RNA, 21 nt, Human
uaaagcagguguccaaacacu

SEQ ID NO: 1155160 - RNA, 27 nt, Human
uaaagcagguguccaaacacuugaggu

SEQ ID NO: 1155161 - RNA, 18 nt, Human
uaaccccuaacccgcacu

SEQ ID NO: 1155162 - RNA, 21 nt, Human
uaaccuagaucccucucaugc

SEQ ID NO: 1155163 - RNA, 18 nt, Human
uacagcaugcaaaagugg

SEQ ID NO: 1155164 - RNA, 19 nt, Human
uagaacguggagaucagca

SEQ ID NO: 1155165 - RNA, 21 nt, Human
uagggcccgcgucagguucuc

SEQ ID NO: 1155166 - RNA, 21 nt, Human
ucacuucuugcuguguagccc

SEQ ID NO: 1155167 - RNA, 18 nt, Human
uccacuaggcuguaaauu

SEQ ID NO: 1155168 - RNA, 24 nt, Human
ucccucucaugccuaguucacagu

SEQ ID NO: 1155169 - RNA, 18 nt, Human
uccguaguuagccucugu

SEQ ID NO: 1155170 - RNA, 21 nt, Human
uccuaugagaaucucaugcca

SEQ ID NO: 1155171 - RNA, 22 nt, Human
ucgcggccgggacuccccgggc

SEQ ID NO: 1155172 - RNA, 23 nt, Human
ucgcggccgggacuccccgggcu

SEQ ID NO: 1155173 - RNA, 21 nt, Human
ucgucgccgccgcggcucccg

SEQ ID NO: 1155174 - RNA, 22 nt, Human
ucucuggaucuccccuucuccc

SEQ ID NO: 1155175 - RNA, 20 nt, Human
ugaaccauggggagcagcug

SEQ ID NO: 1155176 - RNA, 19 nt, Human
ugauugcagguguuaggag

SEQ ID NO: 1155177 - RNA, 18 nt, Human
ugccagagauucacuucu

SEQ ID NO: 1155178 - RNA, 19 nt, Human
ugccaucgauagaagcagc

SEQ ID NO: 1155179 - RNA, 24 nt, Human
uggaccccuggcgccugguaucag

SEQ ID NO: 1155180 - RNA, 21 nt, Human
uggcgcacaguucaccugcug

SEQ ID NO: 1155181 - RNA, 20 nt, Human
uguaaauacagauuaagcuu

SEQ ID NO: 1155182 - RNA, 22 nt, Human
uuaggaaucugugucuuccacu

SEQ ID NO: 1155183 - RNA, 21 nt, Human
uuauuuuccugcaacuagaug

SEQ ID NO: 1155184 - RNA, 23 nt, Human
uucagggaagggaagcgggcccc

SEQ ID NO: 1155185 - RNA, 24 nt, Human
uuccagcuccuaugagaaucucau

SEQ ID NO: 1155186 - RNA, 21 nt, Human
uuccaggccccacuguggcuc

SEQ ID NO: 1155187 - RNA, 18 nt, Human
uuggaccccuggcgccug

SEQ ID NO: 1155188 - RNA, 21 nt, Human
uuucgcagggccaaagcccag

SEQ ID NO: 1155189 - RNA, 18 nt, Human
uuugcuagaacguggaga

SEQ ID NO: 1155190 - RNA, 20 nt, Human
aaccccugccucgcuuguca

SEQ ID NO: 1155191 - RNA, 21 nt, Human
aacuugcugccucgguucuuc

SEQ ID NO: 1155192 - RNA, 23 nt, Human
aacuugcugccucgguucuucuc

SEQ ID NO: 1155193 - RNA, 22 nt, Human
aagcuaaaaugcaucauagucc

SEQ ID NO: 1155194 - RNA, 20 nt, Human
aagguagaggaaaucgcgaa

SEQ ID NO: 1155195 - RNA, 20 nt, Human
aaucugcgcaaacagggcug

SEQ ID NO: 1155196 - RNA, 24 nt, Human
accagcuucugcuaccuucaugcu

SEQ ID NO: 1155197 - RNA, 19 nt, Human
accaucuggaaacacaccg

SEQ ID NO: 1155198 - RNA, 19 nt, Human
acuugcugccucgguucuu

SEQ ID NO: 1155199 - RNA, 19 nt, Human
agaaagaaaggguccaaga

SEQ ID NO: 1155200 - RNA, 23 nt, Human
agaauaacccccaaaagcucaaa

SEQ ID NO: 1155201 - RNA, 18 nt, Human
agagacucuccuaucuca

SEQ ID NO: 1155202 - RNA, 19 nt, Human
agagcagagaagcaguuuu

SEQ ID NO: 1155203 - RNA, 24 nt, Human
agcaggaagcggacucaaggucgc

SEQ ID NO: 1155204 - RNA, 18 nt, Human
agccacccagcccagggc

SEQ ID NO: 1155205 - RNA, 18 nt, Human
agcugugcuucucagagc

SEQ ID NO: 1155206 - RNA, 19 nt, Human
aggcagaaccaggauagaa

SEQ ID NO: 1155207 - RNA, 22 nt, Human
aggcaguccagugguauggaac

SEQ ID NO: 1155208 - RNA, 21 nt, Human
agugcaaccccugccucgcuu

SEQ ID NO: 1155209 - RNA, 25 nt, Human
auagccacccagcccagggccugga

SEQ ID NO: 1155210 - RNA, 24 nt, Human
augguugaggcagaaccggggucc

SEQ ID NO: 1155211 - RNA, 24 nt, Human
auuucugucacuguggugaccaac

SEQ ID NO: 1155212 - RNA, 19 nt, Human
caaagaacccagagacacu

SEQ ID NO: 1155213 - RNA, 21 nt, Human
caccccaaauuucagccugag

SEQ ID NO: 1155214 - RNA, 21 nt, Human
cacuguggugaccaacuucug

SEQ ID NO: 1155215 - RNA, 23 nt, Human
cacuguggugaccaacuucugcc

SEQ ID NO: 1155216 - RNA, 19 nt, Human
caggaccagcaagcaguga

SEQ ID NO: 1155217 - RNA, 21 nt, Human
caucuuuguacucuuugagga

SEQ ID NO: 1155218 - RNA, 22 nt, Human
ccaagguagaggaaaucgcgaa

SEQ ID NO: 1155219 - RNA, 25 nt, Human
ccagagacucuccuaucucaugguu

SEQ ID NO: 1155220 - RNA, 19 nt, Human
ccagugguauggaacuccu

SEQ ID NO: 1155221 - RNA, 22 nt, Human
ccauagccacccagcccagggc

SEQ ID NO: 1155222 - RNA, 23 nt, Human
ccaucuggaaacacaccagcuuc

SEQ ID NO: 1155223 - RNA, 21 nt, Human
ccucaacugggggaggaggac

SEQ ID NO: 1155224 - RNA, 19 nt, Human
ccuucuguaggaaugaggg

SEQ ID NO: 1155225 - RNA, 26 nt, Human
cucagagcagagaagcaguuuuaaga

SEQ ID NO: 1155226 - RNA, 24 nt, Human
cuugaacuguucaagaacugggaa

SEQ ID NO: 1155227 - RNA, 23 nt, Human
gagggcaaagaacccagagacac

SEQ ID NO: 1155228 - RNA, 19 nt, Human
gcaaagaacccagagacac

SEQ ID NO: 1155229 - RNA, 21 nt, Human
gcagcaucauucauuucuuuc

SEQ ID NO: 1155230 - RNA, 25 nt, Human
ggaaaucgcgaaaagaaccgguacc

SEQ ID NO: 1155231 - RNA, 21 nt, Human
ggaacuccuuaauguaagccu

SEQ ID NO: 1155232 - RNA, 21 nt, Human
ggagggcaaagaacccagaga

SEQ ID NO: 1155233 - RNA, 22 nt, Human
gggcagggaucccagagaaaga

SEQ ID NO: 1155234 - RNA, 26 nt, Human
guagaauaacccccaaaagcucaaag

SEQ ID NO: 1155235 - RNA, 23 nt, Human
guccagauggcagaguccacuca

SEQ ID NO: 1155236 - RNA, 23 nt, Human
gugaagggagggcaaagaaccca

SEQ ID NO: 1155237 - RNA, 23 nt, Human
guuauagcagaaccaucuggaaa

SEQ ID NO: 1155238 - RNA, 18 nt, Human
uaaaacauggcagcauca

SEQ ID NO: 1155239 - RNA, 18 nt, Human
uaaaaugcaucauagucc

SEQ ID NO: 1155240 - RNA, 24 nt, Human
uaacuucccuggaugaaggacacu

SEQ ID NO: 1155241 - RNA, 21 nt, Human
uaagagcaccaagguagagga

SEQ ID NO: 1155242 - RNA, 21 nt, Human
uaagcuuugacccagucuaca

SEQ ID NO: 1155243 - RNA, 22 nt, Human
uacagcagcuagcaccagagac

SEQ ID NO: 1155244 - RNA, 18 nt, Human
uagaauaacccccaaaag

SEQ ID NO: 1155245 - RNA, 23 nt, Human
uagaauaacccccaaaagcucaa

SEQ ID NO: 1155246 - RNA, 19 nt, Human
uagaauagagaauaaaagg

SEQ ID NO: 1155247 - RNA, 21 nt, Human
uaguccuagucggcaguucca

SEQ ID NO: 1155248 - RNA, 22 nt, Human
ucccaccccaaauuucagccug

SEQ ID NO: 1155249 - RNA, 18 nt, Human
ucccgaaagcuuaucacu

SEQ ID NO: 1155250 - RNA, 21 nt, Human
ucucccgaaagcuuaucacuu

SEQ ID NO: 1155251 - RNA, 24 nt, Human
ucuugaucugccacaggaccagca

SEQ ID NO: 1155252 - RNA, 20 nt, Human
ucuuuguacucuuugaggac

SEQ ID NO: 1155253 - RNA, 24 nt, Human
ugaaggacacugcuacagcagcua

SEQ ID NO: 1155254 - RNA, 19 nt, Human
ugacagcugacaggugauu

SEQ ID NO: 1155255 - RNA, 20 nt, Human
ugacccagucuacaugcuuc

SEQ ID NO: 1155256 - RNA, 18 nt, Human
ugaccugcuaucccaccc

SEQ ID NO: 1155257 - RNA, 19 nt, Human
ugagcaggaagcggacuca

SEQ ID NO: 1155258 - RNA, 18 nt, Human
ugagucaaaugcuugcac

SEQ ID NO: 1155259 - RNA, 24 nt, Human
ugcaaccccugccucgcuugucaa

SEQ ID NO: 1155260 - RNA, 21 nt, Human
ugccacaggaccagcaagcag

SEQ ID NO: 1155261 - RNA, 23 nt, Human
ugcuacagcagcuagcaccagag

SEQ ID NO: 1155262 - RNA, 20 nt, Human
ugcuguagggucuugaacug

SEQ ID NO: 1155263 - RNA, 19 nt, Human
uggaaugcuagauggccaa

SEQ ID NO: 1155264 - RNA, 24 nt, Human
uggaaugcuagauggccaagccuc

SEQ ID NO: 1155265 - RNA, 23 nt, Human
uggccaagccucagccuuugguc

SEQ ID NO: 1155266 - RNA, 19 nt, Human
uggugaccaacuucugccc

SEQ ID NO: 1155267 - RNA, 22 nt, Human
uucguugacagcugacagguga

SEQ ID NO: 1155268 - RNA, 22 nt, Human
uugaggcagaaccaggauagaa

SEQ ID NO: 1155269 - RNA, 22 nt, Human
uugguccagugcaaccccugcc

SEQ ID NO: 1155270 - RNA, 19 nt, Human
uuucacauaagugccaggc

SEQ ID NO: 1155271 - RNA, 19 nt, Human
uuucguugacagcugacag

SEQ ID NO: 1155272 - RNA, 23 nt, Human
agccgcuguggcccccgaggcug

SEQ ID NO: 1155273 - RNA, 18 nt, Human
aggccacacacagagccc

SEQ ID NO: 1155274 - RNA, 18 nt, Human
agguggccaauaagaagg

SEQ ID NO: 1155275 - RNA, 19 nt, Human
cagacugaagcuggccaug

SEQ ID NO: 1155276 - RNA, 21 nt, Human
cagccagaaaggacaagcugc

SEQ ID NO: 1155277 - RNA, 19 nt, Human
cagcugccacauuaccaca

SEQ ID NO: 1155278 - RNA, 20 nt, Human
ccagccagaaaggacaagcu

SEQ ID NO: 1155279 - RNA, 18 nt, Human
ccuugaauucuggcagug

SEQ ID NO: 1155280 - RNA, 19 nt, Human
cuacugcccagagccugcc

SEQ ID NO: 1155281 - RNA, 22 nt, Human
cucucagccauggcaggcagcu

SEQ ID NO: 1155282 - RNA, 25 nt, Human
cucucuggaaagacccagucccagg

SEQ ID NO: 1155283 - RNA, 20 nt, Human
cugccacauuaccacaggaa

SEQ ID NO: 1155284 - RNA, 18 nt, Human
cuggcuuaugugacgcca

SEQ ID NO: 1155285 - RNA, 20 nt, Human
gaggcuggcagggcccuggc

SEQ ID NO: 1155286 - RNA, 20 nt, Human
gccaggcagacugaagcugg

SEQ ID NO: 1155287 - RNA, 20 nt, Human
gccgcuguggcccccgaggc

SEQ ID NO: 1155288 - RNA, 24 nt, Human
ggcaggcagcuaccuugaauucug

SEQ ID NO: 1155289 - RNA, 21 nt, Human
uaagaaggccacacacagagc

SEQ ID NO: 1155290 - RNA, 22 nt, Human
uaccacaggaacagcagcccca

SEQ ID NO: 1155291 - RNA, 20 nt, Human
ucucagccauggcaggcagc

SEQ ID NO: 1155292 - RNA, 19 nt, Human
ucucuggaaagacccaguc

SEQ ID NO: 1155293 - RNA, 21 nt, Human
ucucuggaaagacccaguccc

SEQ ID NO: 1155294 - RNA, 18 nt, Human
ucucuguggcuacugccc

SEQ ID NO: 1155295 - RNA, 20 nt, Human
ucuggaaagacccaguccca

SEQ ID NO: 1155296 - RNA, 21 nt, Human
ucuguggcuacugcccagagc

SEQ ID NO: 1155297 - RNA, 19 nt, Human
ugccaaggagaagguggcc

SEQ ID NO: 1155298 - RNA, 22 nt, Human
ugcccagagcuuccagccagaa

SEQ ID NO: 1155299 - RNA, 23 nt, Human
ugcuggugugagagccgcugugg

SEQ ID NO: 1155300 - RNA, 18 nt, Human
uggggggaccacaaacca

SEQ ID NO: 1155301 - RNA, 21 nt, Human
uggguuaagcugaggcacacc

SEQ ID NO: 1155302 - RNA, 21 nt, Human
ugugagagccgcuguggcccc

SEQ ID NO: 1155303 - RNA, 22 nt, Human
uuccagccagaaaggacaagcu

SEQ ID NO: 1155304 - RNA, 24 nt, Human
ccagcugauuuuauaguaaguggu

SEQ ID NO: 1155305 - RNA, 18 nt, Human
cccaagagguugaugcaa

SEQ ID NO: 1155306 - RNA, 21 nt, Human
ucacccuuggcacuucuuaac

SEQ ID NO: 1155307 - RNA, 18 nt, Human
uucuccucuucuaaagga

SEQ ID NO: 1155308 - RNA, 18 nt, Human
uugaugcaaggcuucucc

SEQ ID NO: 1155309 - RNA, 21 nt, Human
aagauagagugauuccaaaga

SEQ ID NO: 1155310 - RNA, 19 nt, Human
agccauguaacucaaucuu

SEQ ID NO: 1155311 - RNA, 18 nt, Human
aggagauaagucuauucc

SEQ ID NO: 1155312 - RNA, 18 nt, Human
aggcaaaacaaccuuuug

SEQ ID NO: 1155313 - RNA, 19 nt, Human
aggugccacuugucugaaa

SEQ ID NO: 1155314 - RNA, 19 nt, Human
agucaagauaaaucuucuc

SEQ ID NO: 1155315 - RNA, 19 nt, Human
auaagucuauuccuuuaag

SEQ ID NO: 1155316 - RNA, 18 nt, Human
auuagcugcaaauggaug

SEQ ID NO: 1155317 - RNA, 21 nt, Human
caaagugcuaagcacuuuaca

SEQ ID NO: 1155318 - RNA, 21 nt, Human
ccugggcuuuccacuuuaccu

SEQ ID NO: 1155319 - RNA, 21 nt, Human
cguuggccagcagccggcgcc

SEQ ID NO: 1155320 - RNA, 24 nt, Human
cuagggccucaauguccucauuug

SEQ ID NO: 1155321 - RNA, 24 nt, Human
cuccgagagaucagggaagaaaag

SEQ ID NO: 1155322 - RNA, 24 nt, Human
cucuucccugguguuuguaggugg

SEQ ID NO: 1155323 - RNA, 21 nt, Human
cuuuaaacauuugccugacca

SEQ ID NO: 1155324 - RNA, 19 nt, Human
gcguuggccagcagccggc

SEQ ID NO: 1155325 - RNA, 25 nt, Human
ggaaacugaaggagaaacccacagc

SEQ ID NO: 1155326 - RNA, 27 nt, Human
ggcaaugagaggaaacugaaggagaaa

SEQ ID NO: 1155327 - RNA, 21 nt, Human
guggaguuuucucugggucuu

SEQ ID NO: 1155328 - RNA, 22 nt, Human
guggaguuuucucugggucuug

SEQ ID NO: 1155329 - RNA, 22 nt, Human
uaaacaacuguaauacccaggc

SEQ ID NO: 1155330 - RNA, 20 nt, Human
uaccaugugucacgcaaagu

SEQ ID NO: 1155331 - RNA, 18 nt, Human
uagaauguccaagaaacc

SEQ ID NO: 1155332 - RNA, 24 nt, Human
ucaaucuugcucuucccugguguu

SEQ ID NO: 1155333 - RNA, 18 nt, Human
ucagggaagaaaagcugu

SEQ ID NO: 1155334 - RNA, 21 nt, Human
ucuaaacauuucaguguagaa

SEQ ID NO: 1155335 - RNA, 22 nt, Human
ugagaggaaacugaaggagaaa

SEQ ID NO: 1155336 - RNA, 21 nt, Human
ugcccugcguuggccagcagc

SEQ ID NO: 1155337 - RNA, 22 nt, Human
ugcucgaagacacuugcaggug

SEQ ID NO: 1155338 - RNA, 21 nt, Human
ugcuggagguugaggccuugc

SEQ ID NO: 1155339 - RNA, 18 nt, Human
uggcaagagcugugcugg

SEQ ID NO: 1155340 - RNA, 21 nt, Human
uggcaagagcugugcuggagg

SEQ ID NO: 1155341 - RNA, 21 nt, Human
uggcaagagcugugcuggagg

SEQ ID NO: 1155342 - RNA, 21 nt, Human
ugggcuuuccacuuuaccuuu

SEQ ID NO: 1155343 - RNA, 20 nt, Human
ugguagaaaucacagcaggc

SEQ ID NO: 1155344 - RNA, 18 nt, Human
uguaauacccaggcaugc

SEQ ID NO: 1155345 - RNA, 24 nt, Human
uuuaaacauuugccugaccaaaga

SEQ ID NO: 1155346 - RNA, 21 nt, Human
uuuaacuuccuagggccucaa

SEQ ID NO: 1155347 - RNA, 18 nt, Human
uuuucucugggucuugcg

SEQ ID NO: 1155348 - RNA, 18 nt, Human
uuuugacaauucauucau

SEQ ID NO: 1155349 - RNA, 18 nt, Human
agaaaauacaggagaaaa

SEQ ID NO: 1155350 - RNA, 23 nt, Human
agaagaaaauacaggagaaaauc

SEQ ID NO: 1155351 - RNA, 19 nt, Human
cacuuagaagaaaauacag

SEQ ID NO: 1155352 - RNA, 22 nt, Human
cacuuagaagaaaauacaggag

SEQ ID NO: 1155353 - RNA, 19 nt, Human
cuaaaacuauaaaacacuu

SEQ ID NO: 1155354 - RNA, 23 nt, Human
cuuagaagaaaauacaggagaaa

SEQ ID NO: 1155355 - RNA, 22 nt, Human
uacaggagaaaauccuucugac

SEQ ID NO: 1155356 - RNA, 22 nt, Human
uauaaaacacuuagaagaaaau

SEQ ID NO: 1155357 - RNA, 22 nt, Human
ugaaacggcuuucccggucucc

SEQ ID NO: 1155358 - RNA, 18 nt, Human
ugagagagcuuugaagcc

SEQ ID NO: 1155359 - RNA, 20 nt, Human
agccaucgucccucaccucg

SEQ ID NO: 1155360 - RNA, 22 nt, Human
cacguauguggaccgcacuuug

SEQ ID NO: 1155361 - RNA, 19 nt, Human
ccaauuccguuucucacac

SEQ ID NO: 1155362 - RNA, 18 nt, Human
cccaggcugaggaaagcc

SEQ ID NO: 1155363 - RNA, 23 nt, Human
ggucaucccaggcugaggaaagc

SEQ ID NO: 1155364 - RNA, 22 nt, Human
ugaaacggcuuucccggucucc

SEQ ID NO: 1155365 - RNA, 18 nt, Human
ugagagagcuuugaagcc

SEQ ID NO: 1155366 - RNA, 19 nt, Human
ugaggaaagccaucguccc

SEQ ID NO: 1155367 - RNA, 22 nt, Human
ugaggaaagccaucgucccuca

SEQ ID NO: 1155368 - RNA, 22 nt, Human
ugauaaguggcugcagcuacgu

SEQ ID NO: 1155369 - RNA, 21 nt, Human
ugugaaccuccucucuaacaa

SEQ ID NO: 1155370 - RNA, 25 nt, Human
uugugaaccuccucucuaacaagau

SEQ ID NO: 1155371 - RNA, 26 nt, Human
aaaauagacuccaaaacuccagagaa

SEQ ID NO: 1155372 - RNA, 22 nt, Human
aacacuaacuuaaauaccauuu

SEQ ID NO: 1155373 - RNA, 23 nt, Human
aaccauuuaaaaauuaaggcaaa

SEQ ID NO: 1155374 - RNA, 21 nt, Human
acuccaaaacuccagagaagg

SEQ ID NO: 1155375 - RNA, 22 nt, Human
acuccaaaacuccagagaaggg

SEQ ID NO: 1155376 - RNA, 21 nt, Human
aggcaaacaagaaauauauaa

SEQ ID NO: 1155377 - RNA, 21 nt, Human
ccaugaagaaaauagacucca

SEQ ID NO: 1155378 - RNA, 23 nt, Human
ccuagcaaaauuccaugaagaaa

SEQ ID NO: 1155379 - RNA, 24 nt, Human
ccuagcaaaauuccaugaagaaaa

SEQ ID NO: 1155380 - RNA, 20 nt, Human
gcaaauauacauucucuaag

SEQ ID NO: 1155381 - RNA, 20 nt, Human
ggcaaauuucacaaaccauu

SEQ ID NO: 1155382 - RNA, 25 nt, Human
uaaauauaaagaugccaauauuuuu

SEQ ID NO: 1155383 - RNA, 18 nt, Human
uaaauuuuuaacacuaac

SEQ ID NO: 1155384 - RNA, 24 nt, Human
uaauucuaaauuuuuaacacuaac

SEQ ID NO: 1155385 - RNA, 21 nt, Human
uagacuccaaaacuccagaga

SEQ ID NO: 1155386 - RNA, 24 nt, Human
uccaaaacuccagagaagggaagu

SEQ ID NO: 1155387 - RNA, 19 nt, Human
uccauuuuugaacaaaggg

SEQ ID NO: 1155388 - RNA, 22 nt, Human
ucuuuuguuccuagcaaaauuc

SEQ ID NO: 1155389 - RNA, 24 nt, Human
ugaagaaaauagacuccaaaacuc

SEQ ID NO: 1155390 - RNA, 22 nt, Human
ugaaguagaaaguuaccgcaaa

SEQ ID NO: 1155391 - RNA, 24 nt, Human
ugagaauuauaauagcuuggccag

SEQ ID NO: 1155392 - RNA, 22 nt, Human
uuaauggaguuagacuuuucuu

SEQ ID NO: 1155393 - RNA, 21 nt, Human
uucacaaaccauuuaaaaauu

SEQ ID NO: 1155394 - RNA, 27 nt, Human
uucucuaaguuuauuagauuugaauua

SEQ ID NO: 1155395 - RNA, 22 nt, Human
uuuguuccuagcaaaauuccau

SEQ ID NO: 1155396 - RNA, 28 nt, Human
uuuuuaaaguuuuaacuuuggauaaaua

SEQ ID NO: 1155397 - RNA, 25 nt, Human
aagcaaacauauaugcuugagucca

SEQ ID NO: 1155398 - RNA, 21 nt, Human
acccguucccucuuccuuccc

SEQ ID NO: 1155399 - RNA, 22 nt, Human
agaaacacgggcccuuugcaaa

SEQ ID NO: 1155400 - RNA, 22 nt, Human
aggacuauaaaaugacuuccau

SEQ ID NO: 1155401 - RNA, 21 nt, Human
aggggaggggcuugggcucgg

SEQ ID NO: 1155402 - RNA, 20 nt, Human
aggggaguggaggggagggg

SEQ ID NO: 1155403 - RNA, 23 nt, Human
caggacccguucccucuuccuuc

SEQ ID NO: 1155404 - RNA, 23 nt, Human
cgccaggacccguucccucuucc

SEQ ID NO: 1155405 - RNA, 23 nt, Human
cgcuuggcggcuccggggcacgc

SEQ ID NO: 1155406 - RNA, 20 nt, Human
cggggcacgcaggaagggga

SEQ ID NO: 1155407 - RNA, 19 nt, Human
gacccccgggagcuucccg

SEQ ID NO: 1155408 - RNA, 19 nt, Human
gacccguucccucuuccuu

SEQ ID NO: 1155409 - RNA, 23 nt, Human
gagaagaacguagccgcuuggcg

SEQ ID NO: 1155410 - RNA, 19 nt, Human
gcaaagcaccgccaggacc

SEQ ID NO: 1155411 - RNA, 20 nt, Human
ggggaguggaggggaggggc

SEQ ID NO: 1155412 - RNA, 19 nt, Human
guaaagcaaacauauaugc

SEQ ID NO: 1155413 - RNA, 26 nt, Human
uaaagcaaacauauaugcuugagucc

SEQ ID NO: 1155414 - RNA, 22 nt, Human
ugacuuccaugaauauuagagu

SEQ ID NO: 1155415 - RNA, 19 nt, Human
ugcaaagcaccgccaggac

SEQ ID NO: 1155416 - RNA, 22 nt, Human
uggaggggaggggcuugggcuc

SEQ ID NO: 1155417 - RNA, 23 nt, Human
uggaggggaggggcuugggcucg

SEQ ID NO: 1155418 - RNA, 21 nt, Human
uuuaaggacuauaaaaugacu

SEQ ID NO: 1155419 - RNA, 23 nt, Human
aaagcuucuccaauacaaaauau

SEQ ID NO: 1155420 - RNA, 21 nt, Human
aaaguguugggauuacaggca

SEQ ID NO: 1155421 - RNA, 22 nt, Human
aaaguguugggauuacaggcaa

SEQ ID NO: 1155422 - RNA, 23 nt, Human
aaggcaugagauuuaacucgugc

SEQ ID NO: 1155423 - RNA, 18 nt, Human
aaguguugggauuacagg

SEQ ID NO: 1155424 - RNA, 18 nt, Human
aauaagagagcugaaaaa

SEQ ID NO: 1155425 - RNA, 22 nt, Human
acaaaaaaagggaaggcaugag

SEQ ID NO: 1155426 - RNA, 19 nt, Human
acaaaaggaacuucuuaca

SEQ ID NO: 1155427 - RNA, 23 nt, Human
acaauagccacccccggcccccc

SEQ ID NO: 1155428 - RNA, 18 nt, Human
acaggcaaaagccacugu

SEQ ID NO: 1155429 - RNA, 22 nt, Human
acccugccuaccuuaggaauaa

SEQ ID NO: 1155430 - RNA, 19 nt, Human
acgccucguccgccugcug

SEQ ID NO: 1155431 - RNA, 25 nt, Human
acucugucgaccaggcuggagugca

SEQ ID NO: 1155432 - RNA, 21 nt, Human
agaaagacccacggagcuccg

SEQ ID NO: 1155433 - RNA, 19 nt, Human
agagcugaaaaaguuggug

SEQ ID NO: 1155434 - RNA, 24 nt, Human
agcgaagauggcaauaacaaaagg

SEQ ID NO: 1155435 - RNA, 25 nt, Human
aggcuggagugcaguggugcgaucu

SEQ ID NO: 1155436 - RNA, 18 nt, Human
aguagcugggacuacagg

SEQ ID NO: 1155437 - RNA, 19 nt, Human
agugcaguggugcgaucuc

SEQ ID NO: 1155438 - RNA, 21 nt, Human
agugcaguggugcgaucuccg

SEQ ID NO: 1155439 - RNA, 24 nt, Human
agugcaguggugcgaucuccgcuc

SEQ ID NO: 1155440 - RNA, 24 nt, Human
aguugacccaaaagguuguggucu

SEQ ID NO: 1155441 - RNA, 19 nt, Human
auuccuggugaguggguca

SEQ ID NO: 1155442 - RNA, 23 nt, Human
caaaauauuuggucauguauuca

SEQ ID NO: 1155443 - RNA, 22 nt, Human
caaaguguugggauuacaggca

SEQ ID NO: 1155444 - RNA, 21 nt, Human
caagagaagagaaagacccac

SEQ ID NO: 1155445 - RNA, 20 nt, Human
caagcgauccuccugccuca

SEQ ID NO: 1155446 - RNA, 22 nt, Human
caagcgauccuccugccucagc

SEQ ID NO: 1155447 - RNA, 27 nt, Human
caagcgauccuccugccucagccuccc

SEQ ID NO: 1155448 - RNA, 22 nt, Human
caaggaucuauuaauuaccauc

SEQ ID NO: 1155449 - RNA, 22 nt, Human
cacccccggcccccaccagccc

SEQ ID NO: 1155450 - RNA, 22 nt, Human
cacucugucgaccaggcuggag

SEQ ID NO: 1155451 - RNA, 23 nt, Human
cacugcaaucuccacuuccuggg

SEQ ID NO: 1155452 - RNA, 23 nt, Human
cagcuucugcggggccguggcca

SEQ ID NO: 1155453 - RNA, 21 nt, Human
caggcccugcgcggucuuacg

SEQ ID NO: 1155454 - RNA, 20 nt, Human
caugguuucgccauguuggc

SEQ ID NO: 1155455 - RNA, 24 nt, Human
caugguuucgccauguuggcuggg

SEQ ID NO: 1155456 - RNA, 19 nt, Human
ccaaaguguugggauuaca

SEQ ID NO: 1155457 - RNA, 23 nt, Human
ccaaaguguugggauuacaggca

SEQ ID NO: 1155458 - RNA, 19 nt, Human
ccagcaaagcgaagauggc

SEQ ID NO: 1155459 - RNA, 19 nt, Human
ccauguuggcugggcuggu

SEQ ID NO: 1155460 - RNA, 20 nt, Human
ccauguuggcugggcugguc

SEQ ID NO: 1155461 - RNA, 24 nt, Human
cccaaaguguugggauuacaggca

SEQ ID NO: 1155462 - RNA, 24 nt, Human
cccacaauagccacccccggcccc

SEQ ID NO: 1155463 - RNA, 23 nt, Human
cccgaguagcugggacuacaggc

SEQ ID NO: 1155464 - RNA, 24 nt, Human
cccgaguagcugggacuacaggca

SEQ ID NO: 1155465 - RNA, 23 nt, Human
ccugcaugguggagaguggagaa

SEQ ID NO: 1155466 - RNA, 23 nt, Human
ccugccucagccucccgaguagc

SEQ ID NO: 1155467 - RNA, 20 nt, Human
ccuggguucaagcgauccuc

SEQ ID NO: 1155468 - RNA, 23 nt, Human
ccuggguucaagcgauccuccug

SEQ ID NO: 1155469 - RNA, 24 nt, Human
cgaccaggcuggagugcaguggug

SEQ ID NO: 1155470 - RNA, 22 nt, Human
cgccauguuggcugggcugguc

SEQ ID NO: 1155471 - RNA, 23 nt, Human
cggccacaucaccuuuagcuuuc

SEQ ID NO: 1155472 - RNA, 23 nt, Human
cggccagagaacaacuuuagaau

SEQ ID NO: 1155473 - RNA, 22 nt, Human
cucacacucaccgcccagcucc

SEQ ID NO: 1155474 - RNA, 24 nt, Human
cucacucugucgaccaggcuggag

SEQ ID NO: 1155475 - RNA, 24 nt, Human
cucacugcaaucuccacuuccugg

SEQ ID NO: 1155476 - RNA, 24 nt, Human
cucagccucccgaguagcugggac

SEQ ID NO: 1155477 - RNA, 24 nt, Human
cugccuauucucccaggaaccaaa

SEQ ID NO: 1155478 - RNA, 23 nt, Human
cugccucagccucccgaguagcu

SEQ ID NO: 1155479 - RNA, 21 nt, Human
cugcggggccguggccagucu

SEQ ID NO: 1155480 - RNA, 24 nt, Human
cuuccuggguucaagcgauccucc

SEQ ID NO: 1155481 - RNA, 20 nt, Human
cuuuuucugccuccuccagc

SEQ ID NO: 1155482 - RNA, 20 nt, Human
gaguagcugggacuacaggc

SEQ ID NO: 1155483 - RNA, 27 nt, Human
gaguagcugggacuacaggcaggcguc

SEQ ID NO: 1155484 - RNA, 22 nt, Human
gaucuccgcucacugcaaucuc

SEQ ID NO: 1155485 - RNA, 18 nt, Human
gauuacaggcaaaagcca

SEQ ID NO: 1155486 - RNA, 21 nt, Human
gauuacaggcaaaagccacug

SEQ ID NO: 1155487 - RNA, 24 nt, Human
gauuacaggcaaaagccacugugc

SEQ ID NO: 1155488 - RNA, 18 nt, Human
gcagcuuuuucugccucc

SEQ ID NO: 1155489 - RNA, 24 nt, Human
gcaugguuucgccauguuggcugg

SEQ ID NO: 1155490 - RNA, 18 nt, Human
gccauguuggcugggcug

SEQ ID NO: 1155491 - RNA, 18 nt, Human
gccggccauggcgcggag

SEQ ID NO: 1155492 - RNA, 24 nt, Human
gcgauccuccugccucagccuccc

SEQ ID NO: 1155493 - RNA, 23 nt, Human
gcuggucuggaacuccugaccuc

SEQ ID NO: 1155494 - RNA, 23 nt, Human
ggaaauaugcaaaaggacaucac

SEQ ID NO: 1155495 - RNA, 19 nt, Human
ggagaaggaccaggauucu

SEQ ID NO: 1155496 - RNA, 24 nt, Human
ggauuacaggcaaaagccacugug

SEQ ID NO: 1155497 - RNA, 25 nt, Human
ggcaauaacaaaaggaaccgguacc

SEQ ID NO: 1155498 - RNA, 20 nt, Human
ggcguuucacugccuccagg

SEQ ID NO: 1155499 - RNA, 19 nt, Human
ggcugggcuggucuggaac

SEQ ID NO: 1155500 - RNA, 24 nt, Human
ggcuggucuggaacuccugaccuc

SEQ ID NO: 1155501 - RNA, 21 nt, Human
gggaaggcaugagauuuaacu

SEQ ID NO: 1155502 - RNA, 21 nt, Human
gguuucgccauguuggcuggg

SEQ ID NO: 1155503 - RNA, 22 nt, Human
guccuguccucccaaaguguug

SEQ ID NO: 1155504 - RNA, 19 nt, Human
gucgaccaggcuggagugc

SEQ ID NO: 1155505 - RNA, 20 nt, Human
guugacugcuugagaggaug

SEQ ID NO: 1155506 - RNA, 23 nt, Human
uaagagagcugaaaaaguuggug

SEQ ID NO: 1155507 - RNA, 22 nt, Human
uaaguaaaucuucaauuugcua

SEQ ID NO: 1155508 - RNA, 23 nt, Human
uaauuuuuguauuuuuaguagag

SEQ ID NO: 1155509 - RNA, 24 nt, Human
uaauuuuuguauuuuuaguagagg

SEQ ID NO: 1155510 - RNA, 23 nt, Human
uacaggcaaaagccacugugccc

SEQ ID NO: 1155511 - RNA, 23 nt, Human
uacguugacugcuugagaggaug

SEQ ID NO: 1155512 - RNA, 22 nt, Human
uagaggcaugguuucgccaugu

SEQ ID NO: 1155513 - RNA, 24 nt, Human
uaguagaggcaugguuucgccaug

SEQ ID NO: 1155514 - RNA, 21 nt, Human
uaguuugaccaacaguugacc

SEQ ID NO: 1155515 - RNA, 19 nt, Human
ucaagcgauccuccugccu

SEQ ID NO: 1155516 - RNA, 24 nt, Human
ucacugcaaucuccacuuccuggg

SEQ ID NO: 1155517 - RNA, 23 nt, Human
ucagccucccgaguagcugggac

SEQ ID NO: 1155518 - RNA, 22 nt, Human
uccagcaaagcgaagauggcaa

SEQ ID NO: 1155519 - RNA, 26 nt, Human
uccagguagcugaggccggggccgac

SEQ ID NO: 1155520 - RNA, 24 nt, Human
ucccaaaguguugggauuacaggc

SEQ ID NO: 1155521 - RNA, 25 nt, Human
ucccaggaaccaaauggccucuguc

SEQ ID NO: 1155522 - RNA, 24 nt, Human
ucccgaguagcugggacuacaggc

SEQ ID NO: 1155523 - RNA, 21 nt, Human
ucccugaaguauggaaaugaa

SEQ ID NO: 1155524 - RNA, 26 nt, Human
uccuccugccucagccucccgaguag

SEQ ID NO: 1155525 - RNA, 21 nt, Human
uccuggguucaagcgauccuc

SEQ ID NO: 1155526 - RNA, 24 nt, Human
uccuggguucaagcgauccuccug

SEQ ID NO: 1155527 - RNA, 18 nt, Human
ucgaccaggcuggagugc

SEQ ID NO: 1155528 - RNA, 22 nt, Human
ucgccauguuggcugggcuggu

SEQ ID NO: 1155529 - RNA, 24 nt, Human
ucgccauguuggcugggcuggucu

SEQ ID NO: 1155530 - RNA, 22 nt, Human
ucucacucugucgaccaggcug

SEQ ID NO: 1155531 - RNA, 24 nt, Human
ucucacucugucgaccaggcugga

SEQ ID NO: 1155532 - RNA, 26 nt, Human
ucucgcgccgcucacacucaccgccc

SEQ ID NO: 1155533 - RNA, 18 nt, Human
ucuggcguuucacugccu

SEQ ID NO: 1155534 - RNA, 19 nt, Human
ucugucgaccaggcuggag

SEQ ID NO: 1155535 - RNA, 18 nt, Human
ugaaggaaauaugcaaaa

SEQ ID NO: 1155536 - RNA, 20 nt, Human
ugaaguauggaaaugaaguc

SEQ ID NO: 1155537 - RNA, 18 nt, Human
ugacaaaaaaagggaagg

SEQ ID NO: 1155538 - RNA, 19 nt, Human
ugaccucaagugaucuguc

SEQ ID NO: 1155539 - RNA, 20 nt, Human
ugaccucaagugaucugucc

SEQ ID NO: 1155540 - RNA, 21 nt, Human
ugaccucaagugaucuguccu

SEQ ID NO: 1155541 - RNA, 22 nt, Human
ugacuucccacaauagccaccc

SEQ ID NO: 1155542 - RNA, 24 nt, Human
ugacuucccacaauagccaccccc

SEQ ID NO: 1155543 - RNA, 20 nt, Human
ugagcccuguccaacuucuc

SEQ ID NO: 1155544 - RNA, 23 nt, Human
ugccauuugacaaaaaaagggaa

SEQ ID NO: 1155545 - RNA, 24 nt, Human
ugccucagccucccgaguagcugg

SEQ ID NO: 1155546 - RNA, 18 nt, Human
ugcggggccguggccagu

SEQ ID NO: 1155547 - RNA, 22 nt, Human
uggagugcaguggugcgaucuc

SEQ ID NO: 1155548 - RNA, 24 nt, Human
uggagugcaguggugcgaucuccg

SEQ ID NO: 1155549 - RNA, 22 nt, Human
uggauauggcugaucugaauug

SEQ ID NO: 1155550 - RNA, 24 nt, Human
uggauggaaaaucccuacccaugu

SEQ ID NO: 1155551 - RNA, 20 nt, Human
uggcgcggaggcagcggcgg

SEQ ID NO: 1155552 - RNA, 21 nt, Human
uggcguuucacugccuccagg

SEQ ID NO: 1155553 - RNA, 21 nt, Human
uggcucuggauggaaaauccc

SEQ ID NO: 1155554 - RNA, 24 nt, Human
uggcugggcuggucuggaacuccu

SEQ ID NO: 1155555 - RNA, 22 nt, Human
ugggacuacaggcaggcgucac

SEQ ID NO: 1155556 - RNA, 24 nt, Human
ugggacuacaggcaggcgucacca

SEQ ID NO: 1155557 - RNA, 22 nt, Human
ugggauuacaggcaaaagccac

SEQ ID NO: 1155558 - RNA, 22 nt, Human
ugggauuacaggcaaaagccac

SEQ ID NO: 1155559 - RNA, 24 nt, Human
ugggauuacaggcaaaagccacug

SEQ ID NO: 1155560 - RNA, 26 nt, Human
ugggauuacaggcaaaagccacugug

SEQ ID NO: 1155561 - RNA, 23 nt, Human
uggguucaagcgauccuccugcc

SEQ ID NO: 1155562 - RNA, 24 nt, Human
uggugccauuugacaaaaaaaggg

SEQ ID NO: 1155563 - RNA, 19 nt, Human
uguccugcaugguggagag

SEQ ID NO: 1155564 - RNA, 22 nt, Human
uguccuguccucccaaaguguu

SEQ ID NO: 1155565 - RNA, 24 nt, Human
uguccuguccucccaaaguguugg

SEQ ID NO: 1155566 - RNA, 21 nt, Human
ugucgaccaggcuggagugca

SEQ ID NO: 1155567 - RNA, 20 nt, Human
uguugggauuacaggcaaaa

SEQ ID NO: 1155568 - RNA, 20 nt, Human
uuaccaucuauuaauuacua

SEQ ID NO: 1155569 - RNA, 24 nt, Human
uuaguagaggcaugguuucgccau

SEQ ID NO: 1155570 - RNA, 21 nt, Human
uuauuggcucuggauggaaaa

SEQ ID NO: 1155571 - RNA, 21 nt, Human
uucaagcgauccuccugccuc

SEQ ID NO: 1155572 - RNA, 24 nt, Human
uucaagcgauccuccugccucagc

SEQ ID NO: 1155573 - RNA, 24 nt, Human
uucacugccuccagguagcugagg

SEQ ID NO: 1155574 - RNA, 22 nt, Human
uucauaauuugcuugacauuuc

SEQ ID NO: 1155575 - RNA, 25 nt, Human
uuccugagcccuguccaacuucucc

SEQ ID NO: 1155576 - RNA, 20 nt, Human
uugagucucacucugucgac

SEQ ID NO: 1155577 - RNA, 23 nt, Human
uuggugccauuugacaaaaaaag

SEQ ID NO: 1155578 - RNA, 24 nt, Human
uuucgccauguuggcugggcuggu

SEQ ID NO: 1155579 - RNA, 22 nt, Human
uuuuguauuuuuaguagaggca

SEQ ID NO: 1155580 - RNA, 22 nt, Human
uuuuuaguagaggcaugguuuc

SEQ ID NO: 1155581 - RNA, 20 nt, Human
uuuuuguauuuuuaguagag

SEQ ID NO: 1155582 - RNA, 19 nt, Human
aaguccacucaaaaugcag

SEQ ID NO: 1155583 - RNA, 25 nt, Human
aaucaaguccacucaaaaugcagca

SEQ ID NO: 1155584 - RNA, 21 nt, Human
aaugaagcccucaaguaccgc

SEQ ID NO: 1155585 - RNA, 18 nt, Human
acaaguuuuuuuuaaugu

SEQ ID NO: 1155586 - RNA, 27 nt, Human
agcagaaggcaaaggaggagggacccc

SEQ ID NO: 1155587 - RNA, 21 nt, Human
agcagcacccaauccuugggc

SEQ ID NO: 1155588 - RNA, 20 nt, Human
agcauuuucucccagcagca

SEQ ID NO: 1155589 - RNA, 19 nt, Human
aggagagcgaagguagagg

SEQ ID NO: 1155590 - RNA, 21 nt, Human
auagcggcugaaguccagaac

SEQ ID NO: 1155591 - RNA, 18 nt, Human
augaagcccucaaguacc

SEQ ID NO: 1155592 - RNA, 20 nt, Human
cacacccucuagcagcaccc

SEQ ID NO: 1155593 - RNA, 23 nt, Human
cacccucuagcagcacccaaucc

SEQ ID NO: 1155594 - RNA, 24 nt, Human
cacccucuagcagcacccaauccu

SEQ ID NO: 1155595 - RNA, 24 nt, Human
cagcagcacacugguagcucugac

SEQ ID NO: 1155596 - RNA, 27 nt, Human
caucaggaagcuuccaaugauagcaga

SEQ ID NO: 1155597 - RNA, 20 nt, Human
ccacccuccaaaagaugaau

SEQ ID NO: 1155598 - RNA, 24 nt, Human
ccagaaagaaguccugcaggcccc

SEQ ID NO: 1155599 - RNA, 25 nt, Human
ccagcacaggacccccagaaagaag

SEQ ID NO: 1155600 - RNA, 23 nt, Human
cccauggcaucuuggucuuuucc

SEQ ID NO: 1155601 - RNA, 28 nt, Human
cccccagaaagaaguccugcaggccccc

SEQ ID NO: 1155602 - RNA, 23 nt, Human
cccuccaaaagaugaauuuugca

SEQ ID NO: 1155603 - RNA, 19 nt, Human
ccucuagcagcacccaauc

SEQ ID NO: 1155604 - RNA, 18 nt, Human
cuccagcacaggaccccc

SEQ ID NO: 1155605 - RNA, 19 nt, Human
gagcaggagcaggagagcg

SEQ ID NO: 1155606 - RNA, 21 nt, Human
ggcugaaguccagaacuugaa

SEQ ID NO: 1155607 - RNA, 21 nt, Human
uaaggaaaauucuguaagaga

SEQ ID NO: 1155608 - RNA, 20 nt, Human
ugaacuucacugagaaaauu

SEQ ID NO: 1155609 - RNA, 22 nt, Human
uggcaaugaagcccucaaguac

SEQ ID NO: 1155610 - RNA, 18 nt, Human
uggccagagcaggagcag

SEQ ID NO: 1155611 - RNA, 23 nt, Human
uguucuggcaaugaagcccucaa

SEQ ID NO: 1155612 - RNA, 23 nt, Human
uguuguuguuuuuggguuuuccc

SEQ ID NO: 1155613 - RNA, 20 nt, Human
uuuuuuguuguuguuuuugg

SEQ ID NO: 1155614 - RNA, 18 nt, Human
uuuuuuuguuguuguuuu

SEQ ID NO: 1155615 - RNA, 21 nt, Human
accaaacaacuaauaauacac

SEQ ID NO: 1155616 - RNA, 19 nt, Human
agaggcucugagauguucc

SEQ ID NO: 1155617 - RNA, 20 nt, Human
auaauuacuuaaaauaugga

SEQ ID NO: 1155618 - RNA, 21 nt, Human
augaauuuuguuuuuauuugu

SEQ ID NO: 1155619 - RNA, 23 nt, Human
ccccaguaacuuuucugcuccua

SEQ ID NO: 1155620 - RNA, 18 nt, Human
cucugagauguuccacag

SEQ ID NO: 1155621 - RNA, 22 nt, Human
uacacagcacucucauaauuag

SEQ ID NO: 1155622 - RNA, 20 nt, Human
uacuuaaaauauggagaaau

SEQ ID NO: 1155623 - RNA, 19 nt, Human
ucucuggguugcccaggcc

SEQ ID NO: 1155624 - RNA, 20 nt, Human
ucucuggguugcccaggccc

SEQ ID NO: 1155625 - RNA, 20 nt, Human
ucucuggguugcccaggccu

SEQ ID NO: 1155626 - RNA, 21 nt, Human
ugagaggcucugagauguucc

SEQ ID NO: 1155627 - RNA, 21 nt, Human
uggagaaauuaaagcaugcaa

SEQ ID NO: 1155628 - RNA, 25 nt, Human
cagucuauuggaaagaagaguuuua

SEQ ID NO: 1155629 - RNA, 19 nt, Human
uccaagugaagaccccuuc

SEQ ID NO: 1155630 - RNA, 19 nt, Human
uggaaagaagaguuuuaug

SEQ ID NO: 1155631 - RNA, 22 nt, Human
uggaaagaagaguuuuauggug

SEQ ID NO: 1155632 - RNA, 18 nt, Human
ugguggaagcuacguggu

SEQ ID NO: 1155633 - RNA, 22 nt, Human
aaaaccucuacaguccaucuag

SEQ ID NO: 1155634 - RNA, 18 nt, Human
aaacaaaacaaaaaccaa

SEQ ID NO: 1155635 - RNA, 24 nt, Human
aaacaaaacaaaaaccaaauacuu

SEQ ID NO: 1155636 - RNA, 23 nt, Human
aaacaaaacaaaacaaaaaccaa

SEQ ID NO: 1155637 - RNA, 24 nt, Human
aaacaaaacaaaacaaaaaccaaa

SEQ ID NO: 1155638 - RNA, 22 nt, Human
aaacaaaacaaaacaaaacaaa

SEQ ID NO: 1155639 - RNA, 22 nt, Human
aaagaagagauggaauacaaag

SEQ ID NO: 1155640 - RNA, 21 nt, Human
aaagcaaaggcucuguccuuc

SEQ ID NO: 1155641 - RNA, 19 nt, Human
aacauggugaaacccgcuc

SEQ ID NO: 1155642 - RNA, 20 nt, Human
aacauggugaaacccgcucu

SEQ ID NO: 1155643 - RNA, 21 nt, Human
aacauggugaaacccgcucuu

SEQ ID NO: 1155644 - RNA, 23 nt, Human
aagugaucaugaauaaccaaaac

SEQ ID NO: 1155645 - RNA, 22 nt, Human
acaaaacaaaacaaaaaccaaa

SEQ ID NO: 1155646 - RNA, 23 nt, Human
acaaaacaaaacaaaaaccaaau

SEQ ID NO: 1155647 - RNA, 22 nt, Human
acaaaacaaaacaaaacaaaaa

SEQ ID NO: 1155648 - RNA, 23 nt, Human
acaaaacaaaacaaaacaaaaac

SEQ ID NO: 1155649 - RNA, 24 nt, Human
acaaaacaaaacaaaacaaaaacc

SEQ ID NO: 1155650 - RNA, 24 nt, Human
acagggcgagacuccaacucaaaa

SEQ ID NO: 1155651 - RNA, 22 nt, Human
acucaaaaaacaaaacaaaaca

SEQ ID NO: 1155652 - RNA, 21 nt, Human
acuccauaccuaacaaaaugg

SEQ ID NO: 1155653 - RNA, 23 nt, Human
acugcacuccagccugugugaca

SEQ ID NO: 1155654 - RNA, 24 nt, Human
acugcacuccagccugugugacag

SEQ ID NO: 1155655 - RNA, 24 nt, Human
acuugaggucagggguucgagacc

SEQ ID NO: 1155656 - RNA, 24 nt, Human
agaaaugcacuugaggauaaaucc

SEQ ID NO: 1155657 - RNA, 18 nt, Human
agaauacaaaaagcaaag

SEQ ID NO: 1155658 - RNA, 23 nt, Human
agacagaaaggcgggcgggccgg

SEQ ID NO: 1155659 - RNA, 22 nt, Human
agagaggagacagaaaggcggg

SEQ ID NO: 1155660 - RNA, 21 nt, Human
agcagcgccggacgcggcgca

SEQ ID NO: 1155661 - RNA, 23 nt, Human
agccggguguggugacacaugcc

SEQ ID NO: 1155662 - RNA, 22 nt, Human
agccuggccaacauggugaaac

SEQ ID NO: 1155663 - RNA, 24 nt, Human
agccuggccaacauggugaaaccc

SEQ ID NO: 1155664 - RNA, 24 nt, Human
agccugugugacagggcgagacuc

SEQ ID NO: 1155665 - RNA, 22 nt, Human
aggagaaaaaaaguaaguguag

SEQ ID NO: 1155666 - RNA, 18 nt, Human
aggcaaaagcagaggaag

SEQ ID NO: 1155667 - RNA, 20 nt, Human
aggcugaggcaggggaauug

SEQ ID NO: 1155668 - RNA, 21 nt, Human
aggcugaggcaggggaauugc

SEQ ID NO: 1155669 - RNA, 22 nt, Human
aggggaauugcuccagcccagg

SEQ ID NO: 1155670 - RNA, 22 nt, Human
agguggaucacuugaggucagg

SEQ ID NO: 1155671 - RNA, 21 nt, Human
agguggccaauauucagaagc

SEQ ID NO: 1155672 - RNA, 23 nt, Human
agguggcggagguugcagugagc

SEQ ID NO: 1155673 - RNA, 24 nt, Human
agguggcggagguugcagugagcc

SEQ ID NO: 1155674 - RNA, 19 nt, Human
aguaaaugaaaaagaagag

SEQ ID NO: 1155675 - RNA, 21 nt, Human
auagugaguccauuuucaagg

SEQ ID NO: 1155676 - RNA, 21 nt, Human
aucacuugaggucagggguuc

SEQ ID NO: 1155677 - RNA, 24 nt, Human
auugcaccacugcacuccagccug

SEQ ID NO: 1155678 - RNA, 25 nt, Human
caaaaaacaaaacaaaacaaaacaa

SEQ ID NO: 1155679 - RNA, 26 nt, Human
caaaaaacaaaacaaaacaaaacaaa

SEQ ID NO: 1155680 - RNA, 22 nt, Human
caaaacaaaaaccaaauacuug

SEQ ID NO: 1155681 - RNA, 19 nt, Human
caaaacaaaacaaaaacca

SEQ ID NO: 1155682 - RNA, 22 nt, Human
caaaacaaaacaaaacaaaaac

SEQ ID NO: 1155683 - RNA, 23 nt, Human
caaaacaaaacaaaacaaaaacc

SEQ ID NO: 1155684 - RNA, 20 nt, Human
caaaguccggccggcagggc

SEQ ID NO: 1155685 - RNA, 20 nt, Human
caacaaaaaggccacacggg

SEQ ID NO: 1155686 - RNA, 21 nt, Human
caacauggugaaacccgcucu

SEQ ID NO: 1155687 - RNA, 22 nt, Human
caacauggugaaacccgcucuu

SEQ ID NO: 1155688 - RNA, 23 nt, Human
caacucaaaaaacaaaacaaaac

SEQ ID NO: 1155689 - RNA, 20 nt, Human
caaguaaaugaaaaagaaga

SEQ ID NO: 1155690 - RNA, 27 nt, Human
caccacugcacuccagccugugugaca

SEQ ID NO: 1155691 - RNA, 24 nt, Human
cacuccagccugugugacagggcg

SEQ ID NO: 1155692 - RNA, 19 nt, Human
cacugcacuccagccugug

SEQ ID NO: 1155693 - RNA, 22 nt, Human
cacugcacuccagccuguguga

SEQ ID NO: 1155694 - RNA, 24 nt, Human
cacugcacuccagccugugugaca

SEQ ID NO: 1155695 - RNA, 19 nt, Human
cagcagcgccggacgcggc

SEQ ID NO: 1155696 - RNA, 19 nt, Human
cagcgggagacgguccccc

SEQ ID NO: 1155697 - RNA, 24 nt, Human
cagcuacuugggaggcugaggcag

SEQ ID NO: 1155698 - RNA, 19 nt, Human
cagcugccccgccgcggcc

SEQ ID NO: 1155699 - RNA, 20 nt, Human
caguacggagggagagagga

SEQ ID NO: 1155700 - RNA, 24 nt, Human
caugccuguaauuccagcuacuug

SEQ ID NO: 1155701 - RNA, 18 nt, Human
ccacugcacuccagccug

SEQ ID NO: 1155702 - RNA, 18 nt, Human
ccacugcacuccagccug

SEQ ID NO: 1155703 - RNA, 19 nt, Human
ccacugcacuccagccugu

SEQ ID NO: 1155704 - RNA, 21 nt, Human
ccacugcacuccagccugugu

SEQ ID NO: 1155705 - RNA, 24 nt, Human
ccacugcacuccagccugugugac

SEQ ID NO: 1155706 - RNA, 25 nt, Human
ccacugcacuccagccugugugaca

SEQ ID NO: 1155707 - RNA, 22 nt, Human
cccagcugccccgccgcggcca

SEQ ID NO: 1155708 - RNA, 22 nt, Human
ccccaaucgauaccaaauaucc

SEQ ID NO: 1155709 - RNA, 19 nt, Human
cccccgggcccugcccccc

SEQ ID NO: 1155710 - RNA, 20 nt, Human
cccccuccuacgggaggguc

SEQ ID NO: 1155711 - RNA, 21 nt, Human
ccccgcugugcucccgccccc

SEQ ID NO: 1155712 - RNA, 21 nt, Human
ccgcccccgggcccugccccc

SEQ ID NO: 1155713 - RNA, 21 nt, Human
ccgccugaggcuggggccccg

SEQ ID NO: 1155714 - RNA, 22 nt, Human
ccgggccagggucccgguugcc

SEQ ID NO: 1155715 - RNA, 18 nt, Human
ccuccuacgggagggucg

SEQ ID NO: 1155716 - RNA, 21 nt, Human
ccugccccccuccuacgggag

SEQ ID NO: 1155717 - RNA, 22 nt, Human
ccuggccaacauggugaaaccc

SEQ ID NO: 1155718 - RNA, 23 nt, Human
ccuggccaacauggugaaacccg

SEQ ID NO: 1155719 - RNA, 18 nt, Human
ccuguaauuccagcuacu

SEQ ID NO: 1155720 - RNA, 21 nt, Human
ccuguaauuccagcuacuugg

SEQ ID NO: 1155721 - RNA, 24 nt, Human
cgagaccagccuggccaacauggu

SEQ ID NO: 1155722 - RNA, 22 nt, Human
cgccugaggcuggggccccgcu

SEQ ID NO: 1155723 - RNA, 22 nt, Human
cgggucaccuaaaacauagucu

SEQ ID NO: 1155724 - RNA, 21 nt, Human
cuagauaccaaacuccauacc

SEQ ID NO: 1155725 - RNA, 22 nt, Human
cuagucagaauaacauauuuca

SEQ ID NO: 1155726 - RNA, 23 nt, Human
cucaaaaaacaaaacaaaacaaa

SEQ ID NO: 1155727 - RNA, 19 nt, Human
cuccaacucaaaaaacaaa

SEQ ID NO: 1155728 - RNA, 23 nt, Human
cuccaacucaaaaaacaaaacaa

SEQ ID NO: 1155729 - RNA, 18 nt, Human
cugccccccuccuacggg

SEQ ID NO: 1155730 - RNA, 21 nt, Human
cugccccccuccuacgggagg

SEQ ID NO: 1155731 - RNA, 21 nt, Human
gaacuaaauuuuugucaauaa

SEQ ID NO: 1155732 - RNA, 27 nt, Human
gagcgcagcagcagcgccggacgcggc

SEQ ID NO: 1155733 - RNA, 21 nt, Human
gagguugcagugagccaagau

SEQ ID NO: 1155734 - RNA, 23 nt, Human
gagguugcagugagccaagauug

SEQ ID NO: 1155735 - RNA, 24 nt, Human
gaucacuugaggucagggguucga

SEQ ID NO: 1155736 - RNA, 24 nt, Human
gcacuccagccugugugacagggc

SEQ ID NO: 1155737 - RNA, 21 nt, Human
gcagcgggagacgguccccga

SEQ ID NO: 1155738 - RNA, 19 nt, Human
gcagguggaucacuugagg

SEQ ID NO: 1155739 - RNA, 20 nt, Human
gccaacauggugaaacccgc

SEQ ID NO: 1155740 - RNA, 23 nt, Human
gccaacauggugaaacccgcucu

SEQ ID NO: 1155741 - RNA, 18 nt, Human
gccggacgcggcgcaaag

SEQ ID NO: 1155742 - RNA, 19 nt, Human
gccggcugggggaggggga

SEQ ID NO: 1155743 - RNA, 21 nt, Human
gccggcugggggagggggagc

SEQ ID NO: 1155744 - RNA, 20 nt, Human
gccuguaauuccagcuacuu

SEQ ID NO: 1155745 - RNA, 24 nt, Human
gcuauagugaguccauuuucaagg

SEQ ID NO: 1155746 - RNA, 22 nt, Human
ggagguugcagugagccaagau

SEQ ID NO: 1155747 - RNA, 24 nt, Human
ggagguugcagugagccaagauug

SEQ ID NO: 1155748 - RNA, 22 nt, Human
ggaucacuugaggucagggguu

SEQ ID NO: 1155749 - RNA, 18 nt, Human
ggcagggcucgcaggccg

SEQ ID NO: 1155750 - RNA, 21 nt, Human
ggccucaacaaaaaggccaca

SEQ ID NO: 1155751 - RNA, 23 nt, Human
ggcggagguugcagugagccaag

SEQ ID NO: 1155752 - RNA, 24 nt, Human
ggugacacaugccuguaauuccag

SEQ ID NO: 1155753 - RNA, 23 nt, Human
gguguggugacacaugccuguaa

SEQ ID NO: 1155754 - RNA, 22 nt, Human
guccccgaggcaccaagcuggc

SEQ ID NO: 1155755 - RNA, 19 nt, Human
gugaccaaagcagcgggag

SEQ ID NO: 1155756 - RNA, 21 nt, Human
guggcggagguugcagugagc

SEQ ID NO: 1155757 - RNA, 24 nt, Human
uagauaccaaacuccauaccuaac

SEQ ID NO: 1155758 - RNA, 23 nt, Human
uagauacuauaucccaagaagua

SEQ ID NO: 1155759 - RNA, 23 nt, Human
uauacugcccaagugaucaugaa

SEQ ID NO: 1155760 - RNA, 24 nt, Human
ucaaaauaucauacauuaaugcaa

SEQ ID NO: 1155761 - RNA, 20 nt, Human
ucacuugaggucagggguuc

SEQ ID NO: 1155762 - RNA, 23 nt, Human
ucagcgcccgcugccgccucgcu

SEQ ID NO: 1155763 - RNA, 19 nt, Human
uccaacucaaaaaacaaaa

SEQ ID NO: 1155764 - RNA, 23 nt, Human
uccagccugugugacagggcgag

SEQ ID NO: 1155765 - RNA, 24 nt, Human
uccagccugugugacagggcgaga

SEQ ID NO: 1155766 - RNA, 26 nt, Human
uccauaccuaacaaaauggcaguuua

SEQ ID NO: 1155767 - RNA, 20 nt, Human
uccccgaggcaccaagcugg

SEQ ID NO: 1155768 - RNA, 18 nt, Human
ucccuagauaccaaacuc

SEQ ID NO: 1155769 - RNA, 19 nt, Human
ucgcuguugucuccuuugu

SEQ ID NO: 1155770 - RNA, 20 nt, Human
ucgcuguugucuccuuugug

SEQ ID NO: 1155771 - RNA, 23 nt, Human
ucuuuacuaaaaauacaaaaauu

SEQ ID NO: 1155772 - RNA, 21 nt, Human
ugaaaaagaagagauggaaua

SEQ ID NO: 1155773 - RNA, 22 nt, Human
ugaccaaagcagcgggagacgg

SEQ ID NO: 1155774 - RNA, 21 nt, Human
ugacgcgccgccugaggcugg

SEQ ID NO: 1155775 - RNA, 21 nt, Human
ugaggcaggggaauugcucca

SEQ ID NO: 1155776 - RNA, 25 nt, Human
ugaggcaggggaauugcuccagccc

SEQ ID NO: 1155777 - RNA, 23 nt, Human
ugaggcuggggccccgcugugcu

SEQ ID NO: 1155778 - RNA, 24 nt, Human
ugcaaacacaggagaaaaaaagua

SEQ ID NO: 1155779 - RNA, 21 nt, Human
ugcaccacugcacuccagccu

SEQ ID NO: 1155780 - RNA, 24 nt, Human
ugccuguaauuccagcuacuuggg

SEQ ID NO: 1155781 - RNA, 19 nt, Human
ugcucccgcccccgggccc

SEQ ID NO: 1155782 - RNA, 21 nt, Human
ugcuccgcguccccggcccca

SEQ ID NO: 1155783 - RNA, 24 nt, Human
uggaucacuugaggucagggguuc

SEQ ID NO: 1155784 - RNA, 18 nt, Human
uggcauguaaaccaaaca

SEQ ID NO: 1155785 - RNA, 23 nt, Human
uggccaacauggugaaacccgcu

SEQ ID NO: 1155786 - RNA, 24 nt, Human
uggcggagguugcagugagccaag

SEQ ID NO: 1155787 - RNA, 18 nt, Human
ugggaggcugaggcaggg

SEQ ID NO: 1155788 - RNA, 20 nt, Human
ugggaggcugaggcagggga

SEQ ID NO: 1155789 - RNA, 19 nt, Human
uggggccccgcugugcucc

SEQ ID NO: 1155790 - RNA, 24 nt, Human
uggugacacaugccuguaauucca

SEQ ID NO: 1155791 - RNA, 23 nt, Human
ugucaauaaauacuaauaaaugu

SEQ ID NO: 1155792 - RNA, 20 nt, Human
uuagccggguguggugacac

SEQ ID NO: 1155793 - RNA, 24 nt, Human
uuagccggguguggugacacaugc

SEQ ID NO: 1155794 - RNA, 22 nt, Human
uuauacugcccaagugaucaug

SEQ ID NO: 1155795 - RNA, 23 nt, Human
uucuuauacugcccaagugauca

SEQ ID NO: 1155796 - RNA, 23 nt, Human
uugcaccacugcacuccagccug

SEQ ID NO: 1155797 - RNA, 22 nt, Human
uugcagugagccaagauugcac

SEQ ID NO: 1155798 - RNA, 22 nt, Human
uuggcucuacaaguaaaugaaa

SEQ ID NO: 1155799 - RNA, 23 nt, Human
uugggaggcugaggcaggggaau

SEQ ID NO: 1155800 - RNA, 18 nt, Human
uuugcuauagugagucca

SEQ ID NO: 1155801 - RNA, 21 nt, Human
aggcaagaguaaagucaugua

SEQ ID NO: 1155802 - RNA, 19 nt, Human
caaaugauuuauuacaaag

SEQ ID NO: 1155803 - RNA, 20 nt, Human
guccuuuauuuauuuuuuuu

SEQ ID NO: 1155804 - RNA, 24 nt, Human
aaaaccaauuuagucauuacagag

SEQ ID NO: 1155805 - RNA, 23 nt, Human
aaaauuaaaaagauccacacuca

SEQ ID NO: 1155806 - RNA, 19 nt, Human
aaacagaaagcuacacgug

SEQ ID NO: 1155807 - RNA, 19 nt, Human
aaagaacuuaugaaaaaga

SEQ ID NO: 1155808 - RNA, 21 nt, Human
aaagacacuuucaaaucuacu

SEQ ID NO: 1155809 - RNA, 21 nt, Human
aacaauuccaugacauaguua

SEQ ID NO: 1155810 - RNA, 25 nt, Human
aacaguuuaaaauauuuuaaagugg

SEQ ID NO: 1155811 - RNA, 19 nt, Human
aagaaaagguggauucuaa

SEQ ID NO: 1155812 - RNA, 22 nt, Human
aagaaauuuuuuuagcacucau

SEQ ID NO: 1155813 - RNA, 21 nt, Human
aagaagucuuaaaucuggaac

SEQ ID NO: 1155814 - RNA, 21 nt, Human
aaggaaaaauugcccaugaug

SEQ ID NO: 1155815 - RNA, 21 nt, Human
acaaagaacuuaugaaaaaga

SEQ ID NO: 1155816 - RNA, 19 nt, Human
acaaagacacuuucaaauc

SEQ ID NO: 1155817 - RNA, 20 nt, Human
acccaauugcuuagcauuuu

SEQ ID NO: 1155818 - RNA, 25 nt, Human
agaauucuuuagggauccuccaccu

SEQ ID NO: 1155819 - RNA, 25 nt, Human
agcaaaauuagcaauagaaaaauga

SEQ ID NO: 1155820 - RNA, 21 nt, Human
agcuguuccucacuaacuguu

SEQ ID NO: 1155821 - RNA, 22 nt, Human
aggcaaaugggucucucucaga

SEQ ID NO: 1155822 - RNA, 23 nt, Human
aggucaaucuucucuuuucauuu

SEQ ID NO: 1155823 - RNA, 23 nt, Human
aucuuauucagcccucuuaacca

SEQ ID NO: 1155824 - RNA, 22 nt, Human
augaugcugagauaauaccagu

SEQ ID NO: 1155825 - RNA, 30 nt, Human
caaaacaauuccaugacauaguuaauuaaa

SEQ ID NO: 1155826 - RNA, 19 nt, Human
caaaagaaaagguggauuc

SEQ ID NO: 1155827 - RNA, 21 nt, Human
caaaucaaacucacaaacacu

SEQ ID NO: 1155828 - RNA, 20 nt, Human
caccuccucccccacucccu

SEQ ID NO: 1155829 - RNA, 21 nt, Human
cacguggcccauaauggcacc

SEQ ID NO: 1155830 - RNA, 24 nt, Human
caucacaaagaacuuaugaaaaag

SEQ ID NO: 1155831 - RNA, 24 nt, Human
caucuuauucagcccucuuaaccu

SEQ ID NO: 1155832 - RNA, 25 nt, Human
cauuacagaguuguuuguguuggaa

SEQ ID NO: 1155833 - RNA, 20 nt, Human
ccaccuccucccccacuccc

SEQ ID NO: 1155834 - RNA, 20 nt, Human
ccucuuaaccaugguggaac

SEQ ID NO: 1155835 - RNA, 21 nt, Human
cgguauuagugaaaauucuuc

SEQ ID NO: 1155836 - RNA, 18 nt, Human
cuaaccuuacaaagcauc

SEQ ID NO: 1155837 - RNA, 23 nt, Human
cucagauuugagaaacagaaagc

SEQ ID NO: 1155838 - RNA, 19 nt, Human
cucaggguuucaagucacc

SEQ ID NO: 1155839 - RNA, 26 nt, Human
cuccaccuccucccccacucccuuuu

SEQ ID NO: 1155840 - RNA, 21 nt, Human
cugcuauuuuaaaaagcaaaa

SEQ ID NO: 1155841 - RNA, 20 nt, Human
cuuucaaaucuacugugaaa

SEQ ID NO: 1155842 - RNA, 20 nt, Human
gaaaaagauccaaguuaacc

SEQ ID NO: 1155843 - RNA, 27 nt, Human
gaaaucacuuugggaguuucagcuagg

SEQ ID NO: 1155844 - RNA, 19 nt, Human
gaacuuaugaaaaagaucc

SEQ ID NO: 1155845 - RNA, 18 nt, Human
gaagucuuaaaucuggaa

SEQ ID NO: 1155846 - RNA, 19 nt, Human
gagaaacagaaagcuacac

SEQ ID NO: 1155847 - RNA, 21 nt, Human
gcucccucuauuggugguaag

SEQ ID NO: 1155848 - RNA, 23 nt, Human
gcugacaggaaaauuagaaggaa

SEQ ID NO: 1155849 - RNA, 22 nt, Human
ggucaaucuucucuuuucauuu

SEQ ID NO: 1155850 - RNA, 18 nt, Human
guaauaaggaaaaauugc

SEQ ID NO: 1155851 - RNA, 23 nt, Human
uaaaaagcaaaauuagcaauaga

SEQ ID NO: 1155852 - RNA, 22 nt, Human
uaaaacagaucaguuuuggaca

SEQ ID NO: 1155853 - RNA, 19 nt, Human
uaagaugacuguaggacuu

SEQ ID NO: 1155854 - RNA, 20 nt, Human
uaagaugacuguaggacuug

SEQ ID NO: 1155855 - RNA, 24 nt, Human
uaauagucaguuaaccacccaagu

SEQ ID NO: 1155856 - RNA, 23 nt, Human
uacauguucuaccaaaagaaaag

SEQ ID NO: 1155857 - RNA, 18 nt, Human
uaggaagagagaguggca

SEQ ID NO: 1155858 - RNA, 20 nt, Human
uaggacuugaaacaaaaaaa

SEQ ID NO: 1155859 - RNA, 21 nt, Human
uauguuaaaauaugcccagca

SEQ ID NO: 1155860 - RNA, 20 nt, Human
ucaggcgguauuagugaaaa

SEQ ID NO: 1155861 - RNA, 18 nt, Human
ucauuacagaguuguuug

SEQ ID NO: 1155862 - RNA, 22 nt, Human
uccaaaauaucaaaacaauucc

SEQ ID NO: 1155863 - RNA, 19 nt, Human
uccuccaccuccuccccca

SEQ ID NO: 1155864 - RNA, 21 nt, Human
ucggaagcuguuccucacuaa

SEQ ID NO: 1155865 - RNA, 22 nt, Human
ucuauaaugaaaaugucucuau

SEQ ID NO: 1155866 - RNA, 22 nt, Human
ucucucagauuugagaaacaga

SEQ ID NO: 1155867 - RNA, 27 nt, Human
ucuuaaccaugguggaaacagucccgg

SEQ ID NO: 1155868 - RNA, 21 nt, Human
ugaaaaugucucuauuauaac

SEQ ID NO: 1155869 - RNA, 23 nt, Human
ugaagcaaaugucuuucccuauu

SEQ ID NO: 1155870 - RNA, 21 nt, Human
ugacaggaaaauuagaaggaa

SEQ ID NO: 1155871 - RNA, 18 nt, Human
ugagaaacagaaagcuac

SEQ ID NO: 1155872 - RNA, 24 nt, Human
ugcccagcaaugaaaucacuuugg

SEQ ID NO: 1155873 - RNA, 22 nt, Human
uggaagauuuucccucguuugc

SEQ ID NO: 1155874 - RNA, 24 nt, Human
uggaaggaaaaaaguaauuuuggc

SEQ ID NO: 1155875 - RNA, 23 nt, Human
uggcaggacuccucuuagaaauc

SEQ ID NO: 1155876 - RNA, 22 nt, Human
ugggaccaaaucaaacucacaa

SEQ ID NO: 1155877 - RNA, 19 nt, Human
ugguggucuuuugaauggu

SEQ ID NO: 1155878 - RNA, 21 nt, Human
ugucauggacuacaaugauua

SEQ ID NO: 1155879 - RNA, 18 nt, Human
uuaaaaagcaaaauuagc

SEQ ID NO: 1155880 - RNA, 26 nt, Human
uuagugguagaaaauauuauuuuuuu

SEQ ID NO: 1155881 - RNA, 19 nt, Human
uucuaccaaaagaaaaggu

SEQ ID NO: 1155882 - RNA, 20 nt, Human
aaaaaagaaagaaaaguggg

SEQ ID NO: 1155883 - RNA, 23 nt, Human
aaaaacccuuaaaauacuuaaga

SEQ ID NO: 1155884 - RNA, 23 nt, Human
aaagucagagcagggaaagggaa

SEQ ID NO: 1155885 - RNA, 24 nt, Human
aagaaaguauuaaaauacaaaacu

SEQ ID NO: 1155886 - RNA, 19 nt, Human
acagucaaaguuucauuca

SEQ ID NO: 1155887 - RNA, 23 nt, Human
acccuuuugguagcccugguccc

SEQ ID NO: 1155888 - RNA, 22 nt, Human
accucaaaaaacccugaauaaa

SEQ ID NO: 1155889 - RNA, 24 nt, Human
accucaaaaaacccugaauaaaga

SEQ ID NO: 1155890 - RNA, 18 nt, Human
acucuuaccugcuuaagc

SEQ ID NO: 1155891 - RNA, 24 nt, Human
agaaagucaaaaaauaauugcuuu

SEQ ID NO: 1155892 - RNA, 23 nt, Human
agacagaugccaccaccguucuc

SEQ ID NO: 1155893 - RNA, 19 nt, Human
aggauauaaaaacuuaaaa

SEQ ID NO: 1155894 - RNA, 19 nt, Human
caaaacacagagccgcggc

SEQ ID NO: 1155895 - RNA, 23 nt, Human
caaacucagugagacuugacuuc

SEQ ID NO: 1155896 - RNA, 20 nt, Human
cagauccaucaucucaaccu

SEQ ID NO: 1155897 - RNA, 18 nt, Human
cagcaaugacuucccaag

SEQ ID NO: 1155898 - RNA, 23 nt, Human
cagcaaugacuucccaagaaaaa

SEQ ID NO: 1155899 - RNA, 18 nt, Human
caucucaaccugccuugc

SEQ ID NO: 1155900 - RNA, 21 nt, Human
cccaaccgggcgccuggaucc

SEQ ID NO: 1155901 - RNA, 22 nt, Human
cccaggcaacagacagaugcca

SEQ ID NO: 1155902 - RNA, 19 nt, Human
cgccuggaucccaggcaac

SEQ ID NO: 1155903 - RNA, 24 nt, Human
cuccccacccuuuugguagcccug

SEQ ID NO: 1155904 - RNA, 24 nt, Human
gaaaaguggguguuacauauuccu

SEQ ID NO: 1155905 - RNA, 22 nt, Human
gagccgcggcugcgcuuccuga

SEQ ID NO: 1155906 - RNA, 23 nt, Human
guuacauauuccugaaagccaga

SEQ ID NO: 1155907 - RNA, 23 nt, Human
guuucauucacagggagcuguag

SEQ ID NO: 1155908 - RNA, 26 nt, Human
uaaauggaucaacuaagauauacuaa

SEQ ID NO: 1155909 - RNA, 19 nt, Human
uaagcaaauauaaacaaac

SEQ ID NO: 1155910 - RNA, 21 nt, Human
uaagcaaauauaaacaaacac

SEQ ID NO: 1155911 - RNA, 26 nt, Human
uaagcaaauauaaacaaacacucccu

SEQ ID NO: 1155912 - RNA, 24 nt, Human
uacauauuccugaaagccagacuc

SEQ ID NO: 1155913 - RNA, 25 nt, Human
uauacuaaaccucaaaaaacccuga

SEQ ID NO: 1155914 - RNA, 22 nt, Human
uaucugaaagaaggauauaaaa

SEQ ID NO: 1155915 - RNA, 22 nt, Human
uauuaagaacaaacucagugag

SEQ ID NO: 1155916 - RNA, 23 nt, Human
uauuaagaacaaacucagugaga

SEQ ID NO: 1155917 - RNA, 20 nt, Human
uauuaauaaaaaaaacccuu

SEQ ID NO: 1155918 - RNA, 19 nt, Human
ucaaaaaacccugaauaaa

SEQ ID NO: 1155919 - RNA, 22 nt, Human
ucaaaaaacccugaauaaagau

SEQ ID NO: 1155920 - RNA, 21 nt, Human
ucacuugauggaaaaagugau

SEQ ID NO: 1155921 - RNA, 20 nt, Human
ucccaagaaaaaagaaagaa

SEQ ID NO: 1155922 - RNA, 22 nt, Human
ucccaagaaaaaagaaagaaaa

SEQ ID NO: 1155923 - RNA, 24 nt, Human
ugaaaacuuauuugagaaagucaa

SEQ ID NO: 1155924 - RNA, 25 nt, Human
ugaaagccagacucuaaucacacag

SEQ ID NO: 1155925 - RNA, 19 nt, Human
ugagaaagucaaaaaauaa

SEQ ID NO: 1155926 - RNA, 20 nt, Human
ugccaccaccguucucccca

SEQ ID NO: 1155927 - RNA, 23 nt, Human
uguaaguuacaugcaaagcaaau

SEQ ID NO: 1155928 - RNA, 22 nt, Human
uucauuaguacuaauucacagg

SEQ ID NO: 1155929 - RNA, 18 nt, Human
uuuaacuucucuacaguc

SEQ ID NO: 1155930 - RNA, 22 nt, Human
uuuuaaggcuguauauuucacu

SEQ ID NO: 1155931 - RNA, 18 nt, Human
uuuuuuuuuuuuuuuuug

SEQ ID NO: 1155932 - RNA, 19 nt, Human
aagaauauaaaaaacauua

SEQ ID NO: 1155933 - RNA, 21 nt, Human
agaaaauaugaucuaugaaga

SEQ ID NO: 1155934 - RNA, 18 nt, Human
agaauauaaaaaacauua

SEQ ID NO: 1155935 - RNA, 24 nt, Human
agagucuuccuuuuuuuuuccuuu

SEQ ID NO: 1155936 - RNA, 23 nt, Human
auuauaagcuacaacacuuugca

SEQ ID NO: 1155937 - RNA, 20 nt, Human
auucucaauauuagcaauuu

SEQ ID NO: 1155938 - RNA, 25 nt, Human
caguuuaauuguaacaaaccacaau

SEQ ID NO: 1155939 - RNA, 22 nt, Human
ccccagggaccccggcgggucu

SEQ ID NO: 1155940 - RNA, 23 nt, Human
ccccagggaccccggcgggucug

SEQ ID NO: 1155941 - RNA, 22 nt, Human
ccuggggacacaggcgcggggg

SEQ ID NO: 1155942 - RNA, 24 nt, Human
ccuggggacacaggcgcgggggag

SEQ ID NO: 1155943 - RNA, 21 nt, Human
cucaauauuagcaauuuaucu

SEQ ID NO: 1155944 - RNA, 20 nt, Human
cuuccuuuuuuuuuccuuuu

SEQ ID NO: 1155945 - RNA, 19 nt, Human
gaagacauuaauacauuaa

SEQ ID NO: 1155946 - RNA, 21 nt, Human
gagucuuccuuuuuuuuuccu

SEQ ID NO: 1155947 - RNA, 24 nt, Human
ggcaggaggugcgagggggggacc

SEQ ID NO: 1155948 - RNA, 26 nt, Human
gggcaggaggugcgagggggggaccc

SEQ ID NO: 1155949 - RNA, 20 nt, Human
ggggaggggagcgcggcccg

SEQ ID NO: 1155950 - RNA, 18 nt, Human
gggucuggggcuggacgc

SEQ ID NO: 1155951 - RNA, 23 nt, Human
gucuuccuuuuuuuuuccuuuua

SEQ ID NO: 1155952 - RNA, 20 nt, Human
uaagauacuuaagaguucau

SEQ ID NO: 1155953 - RNA, 20 nt, Human
uagguuuacaaacuugacac

SEQ ID NO: 1155954 - RNA, 26 nt, Human
uauacauuauaccuacagcuguuuuu

SEQ ID NO: 1155955 - RNA, 22 nt, Human
ugagcaaauuuaagaauauaaa

SEQ ID NO: 1155956 - RNA, 21 nt, Human
ugcaaauaaguauccaguuua

SEQ ID NO: 1155957 - RNA, 26 nt, Human
ugccgggcuggcgcguccccagggac

SEQ ID NO: 1155958 - RNA, 18 nt, Human
uggggacacaggcgcggg

SEQ ID NO: 1155959 - RNA, 20 nt, Human
uuuacagugagagucuuccu

SEQ ID NO: 1155960 - RNA, 22 nt, Human
aaacucauggaugcugaaaacg

SEQ ID NO: 1155961 - RNA, 26 nt, Human
aacgcuuggaagaucagagucuuccc

SEQ ID NO: 1155962 - RNA, 24 nt, Human
aagcauuucuaaguuaagaaugaa

SEQ ID NO: 1155963 - RNA, 20 nt, Human
acuaaaauccauuggguguu

SEQ ID NO: 1155964 - RNA, 23 nt, Human
agcaauaaaaucagucacaggaa

SEQ ID NO: 1155965 - RNA, 20 nt, Human
aggccgaggccgugcggcgc

SEQ ID NO: 1155966 - RNA, 18 nt, Human
agucacaggaaaugaaaa

SEQ ID NO: 1155967 - RNA, 21 nt, Human
agucacaggaaaugaaaagaa

SEQ ID NO: 1155968 - RNA, 22 nt, Human
agucauuguucuugaucuuuuc

SEQ ID NO: 1155969 - RNA, 24 nt, Human
aucucgcuucuuuuuauccuccuu

SEQ ID NO: 1155970 - RNA, 19 nt, Human
cacccggucucgaucucgc

SEQ ID NO: 1155971 - RNA, 18 nt, Human
cagcagccuccguccucc

SEQ ID NO: 1155972 - RNA, 21 nt, Human
caggauggagaagucccaacg

SEQ ID NO: 1155973 - RNA, 20 nt, Human
caggcucugaauucuuuccu

SEQ ID NO: 1155974 - RNA, 20 nt, Human
ccagaguccucucucucuga

SEQ ID NO: 1155975 - RNA, 19 nt, Human
ccagauuccuucacaaugc

SEQ ID NO: 1155976 - RNA, 19 nt, Human
ccauggagaguucggugac

SEQ ID NO: 1155977 - RNA, 20 nt, Human
ccccgcgccaggccgaggcc

SEQ ID NO: 1155978 - RNA, 26 nt, Human
ccccuggaaucugcuucucuccuuuc

SEQ ID NO: 1155979 - RNA, 19 nt, Human
ccgcgccaggccgaggccg

SEQ ID NO: 1155980 - RNA, 24 nt, Human
ccuccagauuccuucacaaugcgg

SEQ ID NO: 1155981 - RNA, 26 nt, Human
ccuccuacuuugaggaccagcuucaa

SEQ ID NO: 1155982 - RNA, 21 nt, Human
ccuuuuauccucuuugaaccc

SEQ ID NO: 1155983 - RNA, 18 nt, Human
cgagcggagggcgggagc

SEQ ID NO: 1155984 - RNA, 22 nt, Human
cgccaggccgaggccgugcggc

SEQ ID NO: 1155985 - RNA, 18 nt, Human
cggcgccgcuuccggucc

SEQ ID NO: 1155986 - RNA, 18 nt, Human
cuaaucucacaggggcgu

SEQ ID NO: 1155987 - RNA, 21 nt, Human
cugugaggugucuguuccauc

SEQ ID NO: 1155988 - RNA, 23 nt, Human
cuucucuccuuucuuucucuuuu

SEQ ID NO: 1155989 - RNA, 19 nt, Human
cuucuuguuuggcuaaaga

SEQ ID NO: 1155990 - RNA, 24 nt, Human
cuugcugauauucgcaaaugugga

SEQ ID NO: 1155991 - RNA, 23 nt, Human
cuuggaagaucagagucuucccc

SEQ ID NO: 1155992 - RNA, 22 nt, Human
cuuuauaauaaauggucucugg

SEQ ID NO: 1155993 - RNA, 19 nt, Human
cuuucucuuuuuccgcuuu

SEQ ID NO: 1155994 - RNA, 23 nt, Human
cuuucuuucucuuuuuccgcuuu

SEQ ID NO: 1155995 - RNA, 19 nt, Human
gaggaccagcuucaauggc

SEQ ID NO: 1155996 - RNA, 20 nt, Human
gcggcgccgcuuccgguccg

SEQ ID NO: 1155997 - RNA, 23 nt, Human
ggauccacaggauggagaagucc

SEQ ID NO: 1155998 - RNA, 23 nt, Human
guacuaaaauccauuggguguuu

SEQ ID NO: 1155999 - RNA, 21 nt, Human
guaucuuuuucuuuuucuuug

SEQ ID NO: 1156000 - RNA, 23 nt, Human
gugcaacagcuucuuugcagcuu

SEQ ID NO: 1156001 - RNA, 23 nt, Human
guggccaaaaacucauggaugcu

SEQ ID NO: 1156002 - RNA, 19 nt, Human
uaaagagcuugugagaggc

SEQ ID NO: 1156003 - RNA, 21 nt, Human
uaaugaucauggaguagccag

SEQ ID NO: 1156004 - RNA, 20 nt, Human
uaaugcggugcauaagaacc

SEQ ID NO: 1156005 - RNA, 18 nt, Human
uacuuugaggaccagcuu

SEQ ID NO: 1156006 - RNA, 21 nt, Human
uaggguccuggaaugcccucc

SEQ ID NO: 1156007 - RNA, 22 nt, Human
uauaaucaaauaccaggcagcc

SEQ ID NO: 1156008 - RNA, 22 nt, Human
ucaagcguaucuuuuucuuuuu

SEQ ID NO: 1156009 - RNA, 24 nt, Human
ucaauggcuucucuacauacuccu

SEQ ID NO: 1156010 - RNA, 18 nt, Human
ucacaggaaaugaaaaga

SEQ ID NO: 1156011 - RNA, 23 nt, Human
ucaguugauucaaagcuucuuga

SEQ ID NO: 1156012 - RNA, 23 nt, Human
uccguuuucuccccuuuucuucc

SEQ ID NO: 1156013 - RNA, 19 nt, Human
uccuucacaaugcggucaa

SEQ ID NO: 1156014 - RNA, 24 nt, Human
ucgcuucuuuuuauccuccuuaac

SEQ ID NO: 1156015 - RNA, 24 nt, Human
ucuaaucucacaggggcgugacac

SEQ ID NO: 1156016 - RNA, 18 nt, Human
ucuccguuuucuccccuu

SEQ ID NO: 1156017 - RNA, 21 nt, Human
ucucuccuuucuuucucuuuu

SEQ ID NO: 1156018 - RNA, 18 nt, Human
ucucucuaaauuauugcu

SEQ ID NO: 1156019 - RNA, 22 nt, Human
ucugccucauucuccacccccc

SEQ ID NO: 1156020 - RNA, 18 nt, Human
ucugcuucucuccuuucu

SEQ ID NO: 1156021 - RNA, 18 nt, Human
ucuucuccguuuucuccc

SEQ ID NO: 1156022 - RNA, 18 nt, Human
ucuugugcuucuugccca

SEQ ID NO: 1156023 - RNA, 21 nt, Human
ucuuucucuuuuuccgcuuuc

SEQ ID NO: 1156024 - RNA, 20 nt, Human
ugaaaacgcuuggaagauca

SEQ ID NO: 1156025 - RNA, 21 nt, Human
ugccucauucuccacccgguc

SEQ ID NO: 1156026 - RNA, 22 nt, Human
uggaaucugcuucucuccuuuc

SEQ ID NO: 1156027 - RNA, 22 nt, Human
uggagguguuuguccgacuugu

SEQ ID NO: 1156028 - RNA, 22 nt, Human
uggcuaagaauuuucaucccug

SEQ ID NO: 1156029 - RNA, 18 nt, Human
uguuaaaacauccaguaa

SEQ ID NO: 1156030 - RNA, 23 nt, Human
uguucuacuucuuguuuggcuaa

SEQ ID NO: 1156031 - RNA, 21 nt, Human
uucccagucucacagggcagu

SEQ ID NO: 1156032 - RNA, 23 nt, Human
uuccuuuuauccucuuugaaccc

SEQ ID NO: 1156033 - RNA, 21 nt, Human
uucuuugcagcuuuauaauaa

SEQ ID NO: 1156034 - RNA, 19 nt, Human
uugaauagauuaaaucaga

SEQ ID NO: 1156035 - RNA, 22 nt, Human
uuugaggaccagcuucaauggc

SEQ ID NO: 1156036 - RNA, 23 nt, Human
uuuugucuucgaagaggcuggag

SEQ ID NO: 1156037 - RNA, 20 nt, Human
aaagagcaggcauggaggac

SEQ ID NO: 1156038 - RNA, 20 nt, Human
aaagaucuguugcacaaaug

SEQ ID NO: 1156039 - RNA, 18 nt, Human
aaagcaaagaggguccuc

SEQ ID NO: 1156040 - RNA, 18 nt, Human
aaagcaccagcuuccacc

SEQ ID NO: 1156041 - RNA, 24 nt, Human
aaauaagccaggugaaaauaccac

SEQ ID NO: 1156042 - RNA, 21 nt, Human
aaccuaaguguccaucaacag

SEQ ID NO: 1156043 - RNA, 25 nt, Human
aagaggcaggguaugguaacaaaug

SEQ ID NO: 1156044 - RNA, 23 nt, Human
aaguguccaucaacagauaaaca

SEQ ID NO: 1156045 - RNA, 24 nt, Human
aaguguuggagauugguuaagacc

SEQ ID NO: 1156046 - RNA, 18 nt, Human
aaugugguauauauacac

SEQ ID NO: 1156047 - RNA, 23 nt, Human
acaccaggcccagcaccuccagc

SEQ ID NO: 1156048 - RNA, 19 nt, Human
acgaauccgccagggaagc

SEQ ID NO: 1156049 - RNA, 19 nt, Human
acuauguaguuuacaaagc

SEQ ID NO: 1156050 - RNA, 24 nt, Human
acucacaccaggcccagcaccucc

SEQ ID NO: 1156051 - RNA, 24 nt, Human
agagguaggcucugagaaccugcc

SEQ ID NO: 1156052 - RNA, 22 nt, Human
agauaaacagauaaagaaaaug

SEQ ID NO: 1156053 - RNA, 21 nt, Human
agcaccagcuuccaccacucu

SEQ ID NO: 1156054 - RNA, 22 nt, Human
aggaagagguaggcucugagaa

SEQ ID NO: 1156055 - RNA, 19 nt, Human
aggacucagccuugcugua

SEQ ID NO: 1156056 - RNA, 18 nt, Human
aggcagcaccaauaaagc

SEQ ID NO: 1156057 - RNA, 22 nt, Human
aggcaggguaugguaacaaaug

SEQ ID NO: 1156058 - RNA, 19 nt, Human
aggcauggaggacuguggg

SEQ ID NO: 1156059 - RNA, 21 nt, Human
auaaagcaauucuccagaaag

SEQ ID NO: 1156060 - RNA, 20 nt, Human
aucaaccuaaguguccauca

SEQ ID NO: 1156061 - RNA, 23 nt, Human
cacaccaggcccagcaccuccag

SEQ ID NO: 1156062 - RNA, 26 nt, Human
caccuccagcccgugguccuuggccc

SEQ ID NO: 1156063 - RNA, 19 nt, Human
cacucacaccaggcccagc

SEQ ID NO: 1156064 - RNA, 20 nt, Human
cagauaaagaaaauguggua

SEQ ID NO: 1156065 - RNA, 26 nt, Human
cagcaccaauaaagcaauucuccaga

SEQ ID NO: 1156066 - RNA, 18 nt, Human
caggcagcaccaauaaag

SEQ ID NO: 1156067 - RNA, 25 nt, Human
caggcgcccaucaaagcgcaucugc

SEQ ID NO: 1156068 - RNA, 21 nt, Human
caggguaugguaacaaaugcc

SEQ ID NO: 1156069 - RNA, 25 nt, Human
caugccucuagccuggccccagcgc

SEQ ID NO: 1156070 - RNA, 20 nt, Human
ccacaccaucaugcagggua

SEQ ID NO: 1156071 - RNA, 21 nt, Human
ccagaaagaugggcaggccuc

SEQ ID NO: 1156072 - RNA, 26 nt, Human
ccagggccucggccagcuccagccug

SEQ ID NO: 1156073 - RNA, 23 nt, Human
cccacaccaucaugcaggguaca

SEQ ID NO: 1156074 - RNA, 22 nt, Human
cccgacacugcucuuccgcugu

SEQ ID NO: 1156075 - RNA, 18 nt, Human
ccgcuguuccgaaggccu

SEQ ID NO: 1156076 - RNA, 22 nt, Human
ccuccacagccaacagcugcuc

SEQ ID NO: 1156077 - RNA, 24 nt, Human
ccuccagcccgugguccuuggccc

SEQ ID NO: 1156078 - RNA, 19 nt, Human
ccucgcccagcaguuccag

SEQ ID NO: 1156079 - RNA, 22 nt, Human
ccucgcccagcaguuccagcag

SEQ ID NO: 1156080 - RNA, 26 nt, Human
ccuggccccagcgccagggccucggc

SEQ ID NO: 1156081 - RNA, 19 nt, Human
cggccagagagaauuccag

SEQ ID NO: 1156082 - RNA, 23 nt, Human
cucucugcaaagcaagaggcagg

SEQ ID NO: 1156083 - RNA, 23 nt, Human
cuuccuuaccccuucucaguuuc

SEQ ID NO: 1156084 - RNA, 22 nt, Human
gaaagaugggcaggccucccac

SEQ ID NO: 1156085 - RNA, 20 nt, Human
gacccuaaagagcaggcaug

SEQ ID NO: 1156086 - RNA, 24 nt, Human
gagaaauaaguucaaaagaucugu

SEQ ID NO: 1156087 - RNA, 19 nt, Human
gagaauuccaggguccggc

SEQ ID NO: 1156088 - RNA, 19 nt, Human
gcaguuccagcagaccacg

SEQ ID NO: 1156089 - RNA, 21 nt, Human
gccucgcccagcaguuccagc

SEQ ID NO: 1156090 - RNA, 19 nt, Human
gccucuagccuggccccag

SEQ ID NO: 1156091 - RNA, 19 nt, Human
gccuugauccggcgugaga

SEQ ID NO: 1156092 - RNA, 21 nt, Human
ggcaggccucccacaccauca

SEQ ID NO: 1156093 - RNA, 23 nt, Human
ggcauggaggacugugggaagga

SEQ ID NO: 1156094 - RNA, 18 nt, Human
gggguuggggguagggaa

SEQ ID NO: 1156095 - RNA, 23 nt, Human
guuucaggagaagaaaaguguug

SEQ ID NO: 1156096 - RNA, 18 nt, Human
uaagccaggugaaaauac

SEQ ID NO: 1156097 - RNA, 19 nt, Human
uaccaugaaagaugauaaa

SEQ ID NO: 1156098 - RNA, 24 nt, Human
uaccccuucucaguuucaggagaa

SEQ ID NO: 1156099 - RNA, 22 nt, Human
uagacccuaaagagcaggcaug

SEQ ID NO: 1156100 - RNA, 21 nt, Human
uagucagggcgcuccacgcgg

SEQ ID NO: 1156101 - RNA, 27 nt, Human
uaugcaugccuggggguuccggagccc

SEQ ID NO: 1156102 - RNA, 22 nt, Human
ucaaccuaaguguccaucaaca

SEQ ID NO: 1156103 - RNA, 19 nt, Human
ucaugcaggguacaggggc

SEQ ID NO: 1156104 - RNA, 19 nt, Human
uccacgcggaaggcggccg

SEQ ID NO: 1156105 - RNA, 23 nt, Human
uccaucaacagauaaacagauaa

SEQ ID NO: 1156106 - RNA, 20 nt, Human
ucccugaguccacagagggu

SEQ ID NO: 1156107 - RNA, 19 nt, Human
uccugagaaagcaccagcu

SEQ ID NO: 1156108 - RNA, 26 nt, Human
ucucuauccuucccaaaaaacauggg

SEQ ID NO: 1156109 - RNA, 23 nt, Human
ugaaagcaucauuuuguacacag

SEQ ID NO: 1156110 - RNA, 20 nt, Human
ugauccggcgugagagcugc

SEQ ID NO: 1156111 - RNA, 18 nt, Human
ugccucuagccuggcccc

SEQ ID NO: 1156112 - RNA, 19 nt, Human
ugccuggggguuaccaggc

SEQ ID NO: 1156113 - RNA, 21 nt, Human
ugccuggggguuaccaggcug

SEQ ID NO: 1156114 - RNA, 23 nt, Human
ugcuucucuauccuucccaaaaa

SEQ ID NO: 1156115 - RNA, 22 nt, Human
uggaauacuauuuggccuuaaa

SEQ ID NO: 1156116 - RNA, 24 nt, Human
uggcguagcgcagagggaggcggc

SEQ ID NO: 1156117 - RNA, 18 nt, Human
ugggaaggacucagccuu

SEQ ID NO: 1156118 - RNA, 20 nt, Human
ugggguagacccuaaagagc

SEQ ID NO: 1156119 - RNA, 18 nt, Human
uguguguggucacauugu

SEQ ID NO: 1156120 - RNA, 23 nt, Human
uucaggagaagaaaaguguugga

SEQ ID NO: 1156121 - RNA, 18 nt, Human
uucccaccaauugcugug

SEQ ID NO: 1156122 - RNA, 23 nt, Human
uuccuuaccccuucucaguuuca

SEQ ID NO: 1156123 - RNA, 19 nt, Human
uuuagccacgccacaaugu

SEQ ID NO: 1156124 - RNA, 25 nt, Human
uuuguacacaguaaacauaggcaau

SEQ ID NO: 1156125 - RNA, 20 nt, Human
aaaacacccagcacagugcc

SEQ ID NO: 1156126 - RNA, 24 nt, Human
aaacacccagcacagugccuaaca

SEQ ID NO: 1156127 - RNA, 23 nt, Human
aagaaucauuaagauaguauaaa

SEQ ID NO: 1156128 - RNA, 18 nt, Human
acacccagcaagaauucu

SEQ ID NO: 1156129 - RNA, 23 nt, Human
acaggcugcaccuuggaauguug

SEQ ID NO: 1156130 - RNA, 22 nt, Human
acuaacacuggcugucucacaa

SEQ ID NO: 1156131 - RNA, 21 nt, Human
acuacauucuaguggcaacag

SEQ ID NO: 1156132 - RNA, 26 nt, Human
agaaaaugaaaucaagaaagcaacua

SEQ ID NO: 1156133 - RNA, 28 nt, Human
aguugagaaaauggagggacgucagcuu

SEQ ID NO: 1156134 - RNA, 25 nt, Human
aucacaauuaaaauugucauuaacu

SEQ ID NO: 1156135 - RNA, 24 nt, Human
caagcucagcaaggugacaaaaca

SEQ ID NO: 1156136 - RNA, 23 nt, Human
caaggugacaaaacauaagauca

SEQ ID NO: 1156137 - RNA, 20 nt, Human
cacagugccuaacacacugg

SEQ ID NO: 1156138 - RNA, 19 nt, Human
cagcgcuacagucccuggu

SEQ ID NO: 1156139 - RNA, 20 nt, Human
caggccuuauacacaggcug

SEQ ID NO: 1156140 - RNA, 19 nt, Human
caguauauagaaaauccua

SEQ ID NO: 1156141 - RNA, 18 nt, Human
cauccgggauaccacagu

SEQ ID NO: 1156142 - RNA, 20 nt, Human
caugaaaaacacccagcaca

SEQ ID NO: 1156143 - RNA, 18 nt, Human
ccacaguaccuuuaguug

SEQ ID NO: 1156144 - RNA, 21 nt, Human
cccagcacagugccuaacaca

SEQ ID NO: 1156145 - RNA, 25 nt, Human
cccaggaucccauccgggauaccac

SEQ ID NO: 1156146 - RNA, 22 nt, Human
ccccacccuggucuugcccuuc

SEQ ID NO: 1156147 - RNA, 22 nt, Human
ccccugccucacccguccuucc

SEQ ID NO: 1156148 - RNA, 21 nt, Human
ccugcacccaguuuccucuau

SEQ ID NO: 1156149 - RNA, 20 nt, Human
ccuggccaaaccugaucccc

SEQ ID NO: 1156150 - RNA, 20 nt, Human
ccuuuaguugccaugucucc

SEQ ID NO: 1156151 - RNA, 25 nt, Human
cggccccuggcuuugagucaguacc

SEQ ID NO: 1156152 - RNA, 23 nt, Human
cguccuucccagcgcuacagucc

SEQ ID NO: 1156153 - RNA, 23 nt, Human
cuaaaaaauaacacuauucauaa

SEQ ID NO: 1156154 - RNA, 24 nt, Human
cucuucuucuccuagucuuugcug

SEQ ID NO: 1156155 - RNA, 23 nt, Human
cugagccucagucuccucaucug

SEQ ID NO: 1156156 - RNA, 23 nt, Human
cuguuaggacugauaagcaagcu

SEQ ID NO: 1156157 - RNA, 23 nt, Human
gaauccacuaaaaaacuguuagg

SEQ ID NO: 1156158 - RNA, 21 nt, Human
gacugauaagcaagcucagca

SEQ ID NO: 1156159 - RNA, 22 nt, Human
gagaaaauggagggacgucagc

SEQ ID NO: 1156160 - RNA, 23 nt, Human
gagucaguacccagaagcucuga

SEQ ID NO: 1156161 - RNA, 18 nt, Human
gcugcauagacccaaccu

SEQ ID NO: 1156162 - RNA, 19 nt, Human
gggaaggcagcaccuacua

SEQ ID NO: 1156163 - RNA, 24 nt, Human
ggugguguuggcugugaucacagc

SEQ ID NO: 1156164 - RNA, 21 nt, Human
gugcuaaaaaauaacacuauu

SEQ ID NO: 1156165 - RNA, 27 nt, Human
uaaaauaucagaaaaugaaaucaagaa

SEQ ID NO: 1156166 - RNA, 22 nt, Human
uaauacaugaaaaacacccagc

SEQ ID NO: 1156167 - RNA, 20 nt, Human
uaauuuauuuaagcccucug

SEQ ID NO: 1156168 - RNA, 18 nt, Human
uacuacauucuaguggca

SEQ ID NO: 1156169 - RNA, 23 nt, Human
uagaaaauccuaaggaauccacu

SEQ ID NO: 1156170 - RNA, 19 nt, Human
uaggucccagcaugugagc

SEQ ID NO: 1156171 - RNA, 19 nt, Human
uaguugccaugucuccuua

SEQ ID NO: 1156172 - RNA, 22 nt, Human
uaguuuaaaaugcaaguuuuag

SEQ ID NO: 1156173 - RNA, 18 nt, Human
uaucuaagaauaaauuua

SEQ ID NO: 1156174 - RNA, 25 nt, Human
uauuacuaagaauaagauaucuaag

SEQ ID NO: 1156175 - RNA, 21 nt, Human
ucagacaagccuugacucaua

SEQ ID NO: 1156176 - RNA, 24 nt, Human
ucagggagguacaggcacacccag

SEQ ID NO: 1156177 - RNA, 22 nt, Human
uccccugccucacccguccuuc

SEQ ID NO: 1156178 - RNA, 20 nt, Human
ucccugguaagccacugccc

SEQ ID NO: 1156179 - RNA, 18 nt, Human
uccuuagaucccucuugc

SEQ ID NO: 1156180 - RNA, 18 nt, Human
ucuacugcuuccugcugc

SEQ ID NO: 1156181 - RNA, 24 nt, Human
ucuccucaucuguaaaauggaggc

SEQ ID NO: 1156182 - RNA, 21 nt, Human
ucuccuggccaaaccugaucc

SEQ ID NO: 1156183 - RNA, 23 nt, Human
ucugccccuauuagcugaagacc

SEQ ID NO: 1156184 - RNA, 23 nt, Human
ugaaaaacacccagcacagugcc

SEQ ID NO: 1156185 - RNA, 19 nt, Human
ugagaaagucugagaucug

SEQ ID NO: 1156186 - RNA, 22 nt, Human
ugagccagugcuccuugucaug

SEQ ID NO: 1156187 - RNA, 23 nt, Human
ugagucaguacccagaagcucug

SEQ ID NO: 1156188 - RNA, 20 nt, Human
ugauccccacccuggucuug

SEQ ID NO: 1156189 - RNA, 23 nt, Human
ugcccucuucuucuccuagucuu

SEQ ID NO: 1156190 - RNA, 19 nt, Human
ugccucacccguccuuccc

SEQ ID NO: 1156191 - RNA, 22 nt, Human
ugccucacccguccuucccagc

SEQ ID NO: 1156192 - RNA, 23 nt, Human
uggccaggccacauugucaggga

SEQ ID NO: 1156193 - RNA, 19 nt, Human
uggcuuugagucaguaccc

SEQ ID NO: 1156194 - RNA, 26 nt, Human
uguaaaauggaggcaauaaaaucuaa

SEQ ID NO: 1156195 - RNA, 20 nt, Human
ugugaucacagcccugcaau

SEQ ID NO: 1156196 - RNA, 20 nt, Human
uucaaguuauguaggugaug

SEQ ID NO: 1156197 - RNA, 18 nt, Human
uucuaguggcaacaguug

SEQ ID NO: 1156198 - RNA, 18 nt, Human
uuuaagcccucugagccu

SEQ ID NO: 1156199 - RNA, 18 nt, Human
uuucugucccaggauccc

SEQ ID NO: 1156200 - RNA, 19 nt, Human
uuugagucaguacccagaa

SEQ ID NO: 1156201 - RNA, 20 nt, Human
aacagcuuuucacaagccga

SEQ ID NO: 1156202 - RNA, 22 nt, Human
aacucccuucuucaauugacua

SEQ ID NO: 1156203 - RNA, 19 nt, Human
acacaguuauaaaaaaugc

SEQ ID NO: 1156204 - RNA, 25 nt, Human
acccaaugaaguuuucgucugaugc

SEQ ID NO: 1156205 - RNA, 19 nt, Human
agacaaucaugaacaguau

SEQ ID NO: 1156206 - RNA, 22 nt, Human
aggauggaaagggagaagagga

SEQ ID NO: 1156207 - RNA, 21 nt, Human
auagcuuuaaaaaaaaaagua

SEQ ID NO: 1156208 - RNA, 20 nt, Human
caaacuguauccagcuuuau

SEQ ID NO: 1156209 - RNA, 21 nt, Human
caagaggaagucucucaaagc

SEQ ID NO: 1156210 - RNA, 18 nt, Human
cagcuuuauuaaagauac

SEQ ID NO: 1156211 - RNA, 21 nt, Human
caucugugucaaagucaggga

SEQ ID NO: 1156212 - RNA, 20 nt, Human
ccacagucuagaaauggaac

SEQ ID NO: 1156213 - RNA, 26 nt, Human
cccuccuccugggagccaagaggaag

SEQ ID NO: 1156214 - RNA, 20 nt, Human
cugggggucaggucccaaca

SEQ ID NO: 1156215 - RNA, 19 nt, Human
cuucaauugacuaccaaaa

SEQ ID NO: 1156216 - RNA, 21 nt, Human
gaaggauggaaagggagaaga

SEQ ID NO: 1156217 - RNA, 20 nt, Human
ggaaagguguuuuccccaca

SEQ ID NO: 1156218 - RNA, 21 nt, Human
ggcaucacuggaaaguccaga

SEQ ID NO: 1156219 - RNA, 26 nt, Human
uagaaauggaaccaccgcuguuuuga

SEQ ID NO: 1156220 - RNA, 22 nt, Human
uagcauagcuuuaaaaaaaaaa

SEQ ID NO: 1156221 - RNA, 23 nt, Human
uaugccccuucucccuaaaacaa

SEQ ID NO: 1156222 - RNA, 18 nt, Human
ucaaagcuagaagggaaa

SEQ ID NO: 1156223 - RNA, 19 nt, Human
ucacaagccgacccugagu

SEQ ID NO: 1156224 - RNA, 22 nt, Human
ucaggcaggacaugggcagaca

SEQ ID NO: 1156225 - RNA, 21 nt, Human
uccacagucuagaaauggaac

SEQ ID NO: 1156226 - RNA, 25 nt, Human
ucccaacagaugucugggcuuaagg

SEQ ID NO: 1156227 - RNA, 20 nt, Human
ugaaaauggcagaauuuauc

SEQ ID NO: 1156228 - RNA, 21 nt, Human
ugaaaauggcagaauuuaucu

SEQ ID NO: 1156229 - RNA, 25 nt, Human
ugaacaguauacaacaaauuuuaaa

SEQ ID NO: 1156230 - RNA, 19 nt, Human
ugccaaggugaccaucugu

SEQ ID NO: 1156231 - RNA, 18 nt, Human
uggcaucacuggaaaguc

SEQ ID NO: 1156232 - RNA, 19 nt, Human
uguucugugugcuaauagc

SEQ ID NO: 1156233 - RNA, 19 nt, Human
uuccccacaucaauccagc

SEQ ID NO: 1156234 - RNA, 29 nt, Human
uuuagagugaggguugacauuucacauuu

SEQ ID NO: 1156235 - RNA, 23 nt, Human
aaaauauccacauauaagggcug

SEQ ID NO: 1156236 - RNA, 23 nt, Human
aagaacauaaaaaaaaaacuuca

SEQ ID NO: 1156237 - RNA, 20 nt, Human
aaggauagaaccaugucacu

SEQ ID NO: 1156238 - RNA, 22 nt, Human
aauccuuaacaucugcauuuaa

SEQ ID NO: 1156239 - RNA, 21 nt, Human
acacuuguagacagaaaccgg

SEQ ID NO: 1156240 - RNA, 19 nt, Human
acagaauuacaaagucaag

SEQ ID NO: 1156241 - RNA, 23 nt, Human
accaaaauacagaugcuaaaaca

SEQ ID NO: 1156242 - RNA, 19 nt, Human
accuucccacccccuaaaa

SEQ ID NO: 1156243 - RNA, 21 nt, Human
accuucccacccccuaaaaac

SEQ ID NO: 1156244 - RNA, 19 nt, Human
acuacaguauuaaaagguc

SEQ ID NO: 1156245 - RNA, 23 nt, Human
agcaaaaacaaauuuauauccau

SEQ ID NO: 1156246 - RNA, 24 nt, Human
aggcugucuuaaaacggcucugcu

SEQ ID NO: 1156247 - RNA, 22 nt, Human
aucucuuuaauaaaacccaaau

SEQ ID NO: 1156248 - RNA, 21 nt, Human
caagguacuacaguauuaaaa

SEQ ID NO: 1156249 - RNA, 21 nt, Human
cacucaauaaaauuuucacaa

SEQ ID NO: 1156250 - RNA, 27 nt, Human
cacuccacauccuaccuucccaccccc

SEQ ID NO: 1156251 - RNA, 22 nt, Human
caguauguucacuguuuacacu

SEQ ID NO: 1156252 - RNA, 18 nt, Human
caguauuaaaaggucaac

SEQ ID NO: 1156253 - RNA, 23 nt, Human
caguauuaaaaggucaacuuuaa

SEQ ID NO: 1156254 - RNA, 24 nt, Human
cauccuaccuucccacccccuaaa

SEQ ID NO: 1156255 - RNA, 31 nt, Human
cauccuaccuucccacccccuaaaaacaaaa

SEQ ID NO: 1156256 - RNA, 22 nt, Human
caugaguuccggcuuuccagga

SEQ ID NO: 1156257 - RNA, 26 nt, Human
cauuaaugggugggguggaggguggg

SEQ ID NO: 1156258 - RNA, 18 nt, Human
ccacccaaauccauacua

SEQ ID NO: 1156259 - RNA, 22 nt, Human
ccacccccuaaaaacaaagcuu

SEQ ID NO: 1156260 - RNA, 20 nt, Human
cccccuaaaaacaaagcuac

SEQ ID NO: 1156261 - RNA, 21 nt, Human
ccuaccuucccacccccuaaa

SEQ ID NO: 1156262 - RNA, 22 nt, Human
cucucucccuucuauucuggca

SEQ ID NO: 1156263 - RNA, 25 nt, Human
cucuuuaauaaaacccaaaugaaua

SEQ ID NO: 1156264 - RNA, 23 nt, Human
cuucuucacaaugauaaccuucc

SEQ ID NO: 1156265 - RNA, 21 nt, Human
gacuagaauauacaguaaaug

SEQ ID NO: 1156266 - RNA, 19 nt, Human
gagcaucuggcuuuguaga

SEQ ID NO: 1156267 - RNA, 19 nt, Human
ggaaggccaucacuucuuc

SEQ ID NO: 1156268 - RNA, 18 nt, Human
ggaguccuuugagcuacu

SEQ ID NO: 1156269 - RNA, 20 nt, Human
ggcugggagagagacaucac

SEQ ID NO: 1156270 - RNA, 18 nt, Human
gggcugggagagagacau

SEQ ID NO: 1156271 - RNA, 22 nt, Human
gguggggguuccuuuguccuuu

SEQ ID NO: 1156272 - RNA, 22 nt, Human
guguacauauauacaauguaua

SEQ ID NO: 1156273 - RNA, 22 nt, Human
guguaggguguacauauauaca

SEQ ID NO: 1156274 - RNA, 22 nt, Human
uaaaugcagauacaauaguggg

SEQ ID NO: 1156275 - RNA, 26 nt, Human
uaaaugcagauacaauagugggguua

SEQ ID NO: 1156276 - RNA, 18 nt, Human
uaaccaaaauacagaugc

SEQ ID NO: 1156277 - RNA, 26 nt, Human
uaaccaaaauacagaugcuaaaacag

SEQ ID NO: 1156278 - RNA, 21 nt, Human
uaaguaaaggauagaaccaug

SEQ ID NO: 1156279 - RNA, 21 nt, Human
uaauaucuucuaaccaaaaua

SEQ ID NO: 1156280 - RNA, 24 nt, Human
uacaauagugggguuacuuaacag

SEQ ID NO: 1156281 - RNA, 24 nt, Human
uacaguaaaugucuuugauuaaua

SEQ ID NO: 1156282 - RNA, 18 nt, Human
uacccacccaaauccaua

SEQ ID NO: 1156283 - RNA, 24 nt, Human
uaccuucccacccccuaaaaacaa

SEQ ID NO: 1156284 - RNA, 22 nt, Human
uacuacaguauuaaaaggucaa

SEQ ID NO: 1156285 - RNA, 24 nt, Human
uagaaauguuuucucucucccuuc

SEQ ID NO: 1156286 - RNA, 18 nt, Human
uagaauauacagaauuac

SEQ ID NO: 1156287 - RNA, 21 nt, Human
uagaauauacaguaaaugucu

SEQ ID NO: 1156288 - RNA, 19 nt, Human
uaggguguacauauauaca

SEQ ID NO: 1156289 - RNA, 22 nt, Human
ucacacuggugaucaaagggua

SEQ ID NO: 1156290 - RNA, 29 nt, Human
uccacaugauagaauaugcuguagggcug

SEQ ID NO: 1156291 - RNA, 18 nt, Human
uccuaccuucccaccccc

SEQ ID NO: 1156292 - RNA, 18 nt, Human
uccugggcguuuaaaugc

SEQ ID NO: 1156293 - RNA, 23 nt, Human
ugaacaugaaugacugcagguca

SEQ ID NO: 1156294 - RNA, 19 nt, Human
ugaagacagagcaucuggc

SEQ ID NO: 1156295 - RNA, 18 nt, Human
ugaaugacugcaggucac

SEQ ID NO: 1156296 - RNA, 18 nt, Human
ugacugcaggucacgcug

SEQ ID NO: 1156297 - RNA, 21 nt, Human
uggaggguggggguuccuuug

SEQ ID NO: 1156298 - RNA, 21 nt, Human
uggcaguuugaaaaagaauca

SEQ ID NO: 1156299 - RNA, 19 nt, Human
uggggguuccuuuguccuu

SEQ ID NO: 1156300 - RNA, 25 nt, Human
ugggguggaggguggggguuccuuu

SEQ ID NO: 1156301 - RNA, 21 nt, Human
uggguuuuuagcaaggggucu

SEQ ID NO: 1156302 - RNA, 20 nt, Human
uguagauauauuucugaguc

SEQ ID NO: 1156303 - RNA, 23 nt, Human
uguagggcaauuagauuugaggg

SEQ ID NO: 1156304 - RNA, 18 nt, Human
uucccacccccuaaaaac

SEQ ID NO: 1156305 - RNA, 19 nt, Human
uucguaagcccuuugugac

SEQ ID NO: 1156306 - RNA, 22 nt, Human
uuguagauauauuucugagucu

SEQ ID NO: 1156307 - RNA, 24 nt, Human
uuuccaauccuuaacaucugcauu

SEQ ID NO: 1156308 - RNA, 23 nt, Human
aucacacucaugccuaucaacca

SEQ ID NO: 1156309 - RNA, 18 nt, Human
cccucgucuuccgccccg

SEQ ID NO: 1156310 - RNA, 18 nt, Human
ccgaccucgccgcccucg

SEQ ID NO: 1156311 - RNA, 21 nt, Human
ccucgccgcccucgucuuccg

SEQ ID NO: 1156312 - RNA, 22 nt, Human
cgcccggaacccgaccucgccg

SEQ ID NO: 1156313 - RNA, 25 nt, Human
cgcgcgcagugcccggaaugacccc

SEQ ID NO: 1156314 - RNA, 22 nt, Human
cggaaugaccccuccacauuga

SEQ ID NO: 1156315 - RNA, 22 nt, Human
cggccucggccccgcacagccc

SEQ ID NO: 1156316 - RNA, 24 nt, Human
cuggccuaggcucuuaugcguggg

SEQ ID NO: 1156317 - RNA, 21 nt, Human
cuuaacacaucuugccugaga

SEQ ID NO: 1156318 - RNA, 23 nt, Human
gguauucuuaacacaucuugccu

SEQ ID NO: 1156319 - RNA, 22 nt, Human
uaccuucaucucuguuaggcuu

SEQ ID NO: 1156320 - RNA, 19 nt, Human
ucccagucgggauucgaag

SEQ ID NO: 1156321 - RNA, 20 nt, Human
ucccuggaauuaacuguccu

SEQ ID NO: 1156322 - RNA, 22 nt, Human
ucgucccuggaauuaacugucc

SEQ ID NO: 1156323 - RNA, 25 nt, Human
ucuccaagcgcccggaacccgaccu

SEQ ID NO: 1156324 - RNA, 22 nt, Human
ugccuaucaaccagcucacaca

SEQ ID NO: 1156325 - RNA, 18 nt, Human
ugcgugggaugucugcag

SEQ ID NO: 1156326 - RNA, 26 nt, Human
uguagagcccggaaggaaaagcaagc

SEQ ID NO: 1156327 - RNA, 24 nt, Human
uuggcagcuguaggguugucuuuu

SEQ ID NO: 1156328 - RNA, 20 nt, Human
aaaacaaaacaaaacuaaac

SEQ ID NO: 1156329 - RNA, 23 nt, Human
aaaagaaaaagaacaaaccuaaa

SEQ ID NO: 1156330 - RNA, 23 nt, Human
aaaagaacaaaccuaaaccuaaa

SEQ ID NO: 1156331 - RNA, 20 nt, Human
aaaagcaacucaaaaggagc

SEQ ID NO: 1156332 - RNA, 23 nt, Human
aaaaugccagaaccaaaccacag

SEQ ID NO: 1156333 - RNA, 26 nt, Human
aaaaugccagaaccaaaccacagaua

SEQ ID NO: 1156334 - RNA, 23 nt, Human
aaacaaaacaaaacuaaacuaaa

SEQ ID NO: 1156335 - RNA, 19 nt, Human
aaacaagaaaaaaaaagcc

SEQ ID NO: 1156336 - RNA, 21 nt, Human
aaacauguauuuaagugagcc

SEQ ID NO: 1156337 - RNA, 28 nt, Human
aaagaacaaaccuaaaccuaaaauugca

SEQ ID NO: 1156338 - RNA, 21 nt, Human
aaaugccagaaccaaaccaca

SEQ ID NO: 1156339 - RNA, 21 nt, Human
aacagaaaagacaaaaacuac

SEQ ID NO: 1156340 - RNA, 28 nt, Human
aacaugaggccaggugcaguggcucacg

SEQ ID NO: 1156341 - RNA, 21 nt, Human
aaccacagauacuugaacaac

SEQ ID NO: 1156342 - RNA, 19 nt, Human
aacuaucgaagaagucgca

SEQ ID NO: 1156343 - RNA, 20 nt, Human
aacucaaaaggagcaagucc

SEQ ID NO: 1156344 - RNA, 21 nt, Human
aagcccagguuggaacaacaa

SEQ ID NO: 1156345 - RNA, 20 nt, Human
aagcggagguugcagugagc

SEQ ID NO: 1156346 - RNA, 24 nt, Human
aagcggagguugcagugagcugag

SEQ ID NO: 1156347 - RNA, 18 nt, Human
aaggagcuacauaauuuc

SEQ ID NO: 1156348 - RNA, 22 nt, Human
aauaauggaaauaaaaccugcc

SEQ ID NO: 1156349 - RNA, 18 nt, Human
aauauuuugacacugaca

SEQ ID NO: 1156350 - RNA, 24 nt, Human
aauugcuugaacccaggaagcgga

SEQ ID NO: 1156351 - RNA, 24 nt, Human
acaaagcccagguuggaacaacaa

SEQ ID NO: 1156352 - RNA, 19 nt, Human
acacauuucaaaauuaacc

SEQ ID NO: 1156353 - RNA, 24 nt, Human
acagagugagacucuguaucaaaa

SEQ ID NO: 1156354 - RNA, 20 nt, Human
acagauacuugaacaacacc

SEQ ID NO: 1156355 - RNA, 19 nt, Human
accaaagucacaaagccca

SEQ ID NO: 1156356 - RNA, 24 nt, Human
accacacugcugacgaccuggggc

SEQ ID NO: 1156357 - RNA, 24 nt, Human
acccaggaagcggagguugcagug

SEQ ID NO: 1156358 - RNA, 24 nt, Human
acuccagccugagugacagaguga

SEQ ID NO: 1156359 - RNA, 24 nt, Human
acucugucgcucaaguucucauag

SEQ ID NO: 1156360 - RNA, 18 nt, Human
acugcacuccagccugag

SEQ ID NO: 1156361 - RNA, 24 nt, Human
acugcacuccagccugagugacag

SEQ ID NO: 1156362 - RNA, 19 nt, Human
agaagaaaaaagaaaaaga

SEQ ID NO: 1156363 - RNA, 28 nt, Human
agagaaaagggaggggaggggagaaggg

SEQ ID NO: 1156364 - RNA, 24 nt, Human
agaggacuauuaagguaacuuuca

SEQ ID NO: 1156365 - RNA, 23 nt, Human
agcaaaauuauuuuuuauucaug

SEQ ID NO: 1156366 - RNA, 24 nt, Human
agcacuuugggaggccaagguggg

SEQ ID NO: 1156367 - RNA, 21 nt, Human
agcagaagaaaaaagaaaaag

SEQ ID NO: 1156368 - RNA, 24 nt, Human
agccugagugacagagugagacuc

SEQ ID NO: 1156369 - RNA, 24 nt, Human
agccugggcaauguggugagacuc

SEQ ID NO: 1156370 - RNA, 25 nt, Human
agccugggcaauguggugagacucu

SEQ ID NO: 1156371 - RNA, 23 nt, Human
agcugggugugguggcgggugcc

SEQ ID NO: 1156372 - RNA, 23 nt, Human
aggaagcggagguugcagugagc

SEQ ID NO: 1156373 - RNA, 21 nt, Human
aggaguuggagaccagccugg

SEQ ID NO: 1156374 - RNA, 21 nt, Human
aggauuaaugaaaaagaaaaa

SEQ ID NO: 1156375 - RNA, 18 nt, Human
aggcaugagaauugcuug

SEQ ID NO: 1156376 - RNA, 21 nt, Human
aggccaaggugggcagacugc

SEQ ID NO: 1156377 - RNA, 24 nt, Human
aggcugaggcaugagaauugcuug

SEQ ID NO: 1156378 - RNA, 19 nt, Human
agggaggggaggggagaag

SEQ ID NO: 1156379 - RNA, 24 nt, Human
agggggaaaggagggaagaaggua

SEQ ID NO: 1156380 - RNA, 22 nt, Human
aggggugaucugggcacagaaa

SEQ ID NO: 1156381 - RNA, 21 nt, Human
agguaacuaucgaagaagucg

SEQ ID NO: 1156382 - RNA, 24 nt, Human
aggugcaguggcucacgccuguaa

SEQ ID NO: 1156383 - RNA, 19 nt, Human
aguccacaauuccuucugg

SEQ ID NO: 1156384 - RNA, 24 nt, Human
aguggcucacgccuguaacugcag

SEQ ID NO: 1156385 - RNA, 24 nt, Human
auagcugggugugguggcgggugc

SEQ ID NO: 1156386 - RNA, 24 nt, Human
aucaugucacugcacuccagccug

SEQ ID NO: 1156387 - RNA, 20 nt, Human
auggcaagcaggggggaagu

SEQ ID NO: 1156388 - RNA, 22 nt, Human
augucacugcacuccagccuga

SEQ ID NO: 1156389 - RNA, 18 nt, Human
auugguagcaucuucuuu

SEQ ID NO: 1156390 - RNA, 22 nt, Human
caaaagcaacucaaaaggagca

SEQ ID NO: 1156391 - RNA, 24 nt, Human
caaaagcaacucaaaaggagcaag

SEQ ID NO: 1156392 - RNA, 27 nt, Human
caaaagcaacucaaaaggagcaagucc

SEQ ID NO: 1156393 - RNA, 20 nt, Human
caaaauacagcaguuaaugu

SEQ ID NO: 1156394 - RNA, 25 nt, Human
caaaccuaaaccuaaaauugcaaca

SEQ ID NO: 1156395 - RNA, 21 nt, Human
caaaugaucuauaaauucauc

SEQ ID NO: 1156396 - RNA, 24 nt, Human
caacaccuacuccaaaagcaaaac

SEQ ID NO: 1156397 - RNA, 18 nt, Human
caacacgcacauuucauu

SEQ ID NO: 1156398 - RNA, 18 nt, Human
caacagaaaagacaaaaa

SEQ ID NO: 1156399 - RNA, 23 nt, Human
caacucaaaaggagcaaguccag

SEQ ID NO: 1156400 - RNA, 19 nt, Human
caaugccaccgccgccaag

SEQ ID NO: 1156401 - RNA, 24 nt, Human
cacgccuguaacugcagcacuuug

SEQ ID NO: 1156402 - RNA, 22 nt, Human
cacuccagccugagugacagag

SEQ ID NO: 1156403 - RNA, 24 nt, Human
cacuccagccugagugacagagug

SEQ ID NO: 1156404 - RNA, 19 nt, Human
cacugcacuccagccugag

SEQ ID NO: 1156405 - RNA, 19 nt, Human
cacugcacuccagccugag

SEQ ID NO: 1156406 - RNA, 20 nt, Human
cacugcacuccagccugagu

SEQ ID NO: 1156407 - RNA, 21 nt, Human
cacugcacuccagccugagug

SEQ ID NO: 1156408 - RNA, 23 nt, Human
cacugcacuccagccugagugac

SEQ ID NO: 1156409 - RNA, 24 nt, Human
cacugcacuccagccugagugaca

SEQ ID NO: 1156410 - RNA, 25 nt, Human
cacugcacuccagccugagugacag

SEQ ID NO: 1156411 - RNA, 24 nt, Human
cagcacuuugggaggccaaggugg

SEQ ID NO: 1156412 - RNA, 18 nt, Human
cagcagaagaaaaaagaa

SEQ ID NO: 1156413 - RNA, 20 nt, Human
caggaagacaaucugcuuuu

SEQ ID NO: 1156414 - RNA, 19 nt, Human
caggggugaucugggcaca

SEQ ID NO: 1156415 - RNA, 18 nt, Human
caugaagacagaguugua

SEQ ID NO: 1156416 - RNA, 19 nt, Human
caugggaggggguaucugu

SEQ ID NO: 1156417 - RNA, 19 nt, Human
cauugguagcaucuucuuu

SEQ ID NO: 1156418 - RNA, 23 nt, Human
ccaaagucacaaagcccagguug

SEQ ID NO: 1156419 - RNA, 20 nt, Human
ccaacuguuuacaaagaaug

SEQ ID NO: 1156420 - RNA, 20 nt, Human
ccacuauaaaaaaccccaaa

SEQ ID NO: 1156421 - RNA, 23 nt, Human
ccaggcagucaacacaugaagac

SEQ ID NO: 1156422 - RNA, 19 nt, Human
ccauuucuaucaaaacaag

SEQ ID NO: 1156423 - RNA, 22 nt, Human
ccccaaaugaguauuaaucugg

SEQ ID NO: 1156424 - RNA, 22 nt, Human
ccugagugacagagugagacuc

SEQ ID NO: 1156425 - RNA, 19 nt, Human
ccuguggucucagcuacuc

SEQ ID NO: 1156426 - RNA, 24 nt, Human
cgcaaaagcaacucaaaaggagca

SEQ ID NO: 1156427 - RNA, 23 nt, Human
cgccuguaacugcagcacuuugg

SEQ ID NO: 1156428 - RNA, 19 nt, Human
cgcuuguuagaggcacagg

SEQ ID NO: 1156429 - RNA, 23 nt, Human
cuaaaauugcaacauauacagaa

SEQ ID NO: 1156430 - RNA, 24 nt, Human
cucacgccuguaacugcagcacuu

SEQ ID NO: 1156431 - RNA, 21 nt, Human
cucugcucaggggugaucugg

SEQ ID NO: 1156432 - RNA, 21 nt, Human
cugcagcuuucugccagaaau

SEQ ID NO: 1156433 - RNA, 21 nt, Human
cugccaguuucuccaauguau

SEQ ID NO: 1156434 - RNA, 20 nt, Human
cugccucugcugcuaguccc

SEQ ID NO: 1156435 - RNA, 19 nt, Human
gaaaggagggaagaaggua

SEQ ID NO: 1156436 - RNA, 22 nt, Human
gaagacaacagaaaagacaaaa

SEQ ID NO: 1156437 - RNA, 18 nt, Human
gaagcggagguugcagug

SEQ ID NO: 1156438 - RNA, 23 nt, Human
gaagucgcaacuacaaaucccaa

SEQ ID NO: 1156439 - RNA, 24 nt, Human
gacagagugagacucuguaucaaa

SEQ ID NO: 1156440 - RNA, 24 nt, Human
gacugccugagcucaggaguugga

SEQ ID NO: 1156441 - RNA, 23 nt, Human
gagaagagaaaagggaggggagg

SEQ ID NO: 1156442 - RNA, 28 nt, Human
gagaggaaaaaagagaagagaaaaggga

SEQ ID NO: 1156443 - RNA, 23 nt, Human
gagaucaugucacugcacuccag

SEQ ID NO: 1156444 - RNA, 24 nt, Human
gaggcaugagaauugcuugaaccc

SEQ ID NO: 1156445 - RNA, 18 nt, Human
gaggggagaagggagggc

SEQ ID NO: 1156446 - RNA, 23 nt, Human
gaggggaggggagaagggagggc

SEQ ID NO: 1156447 - RNA, 22 nt, Human
gagguugcagugagcugagauc

SEQ ID NO: 1156448 - RNA, 20 nt, Human
gaucacagucuucucaucuc

SEQ ID NO: 1156449 - RNA, 24 nt, Human
gcacuccagccugagugacagagu

SEQ ID NO: 1156450 - RNA, 21 nt, Human
gcgggugccuguggucucagc

SEQ ID NO: 1156451 - RNA, 24 nt, Human
gcuguuugcugaaagaccuaaggc

SEQ ID NO: 1156452 - RNA, 21 nt, Human
ggaacaaaaugccagaaccaa

SEQ ID NO: 1156453 - RNA, 21 nt, Human
ggaggggagaagggagggcac

SEQ ID NO: 1156454 - RNA, 23 nt, Human
ggaggggaggggagaagggaggg

SEQ ID NO: 1156455 - RNA, 21 nt, Human
ggaggggguaucugugaggug

SEQ ID NO: 1156456 - RNA, 22 nt, Human
ggagguugcagugagcugagau

SEQ ID NO: 1156457 - RNA, 23 nt, Human
ggagguugcagugagcugagauc

SEQ ID NO: 1156458 - RNA, 24 nt, Human
ggagguugcagugagcugagauca

SEQ ID NO: 1156459 - RNA, 22 nt, Human
gggaaacaggcagaagggaaga

SEQ ID NO: 1156460 - RNA, 21 nt, Human
gggaggggagaagggagggca

SEQ ID NO: 1156461 - RNA, 20 nt, Human
gggaggggaggggagaaggg

SEQ ID NO: 1156462 - RNA, 21 nt, Human
ggggaggggagaagggagggc

SEQ ID NO: 1156463 - RNA, 19 nt, Human
gucucuacuaaaaauacaa

SEQ ID NO: 1156464 - RNA, 24 nt, Human
guugcagugagcugagaucauguc

SEQ ID NO: 1156465 - RNA, 23 nt, Human
uaaaaaacagucacuucucuccu

SEQ ID NO: 1156466 - RNA, 23 nt, Human
uaaaaaacaugaaucuugauuca

SEQ ID NO: 1156467 - RNA, 22 nt, Human
uaaaaauacaaaaaaauagcug

SEQ ID NO: 1156468 - RNA, 24 nt, Human
uaaaaggcaauuauuuaaaaaaca

SEQ ID NO: 1156469 - RNA, 22 nt, Human
uaaaauaaauaaguacuauaau

SEQ ID NO: 1156470 - RNA, 23 nt, Human
uaaaauuaauaaaucacaauucu

SEQ ID NO: 1156471 - RNA, 18 nt, Human
uaaaggagaaggagagga

SEQ ID NO: 1156472 - RNA, 24 nt, Human
uaacaaaugccgaacuuacuacca

SEQ ID NO: 1156473 - RNA, 26 nt, Human
uaacucaacaucucaaaugaucuaua

SEQ ID NO: 1156474 - RNA, 23 nt, Human
uaauaauacuguccuaauaacac

SEQ ID NO: 1156475 - RNA, 21 nt, Human
uaaucuauaauauuuugacac

SEQ ID NO: 1156476 - RNA, 20 nt, Human
uacaaacauguauuuaagug

SEQ ID NO: 1156477 - RNA, 24 nt, Human
uacacuugccuaggcaugagaaac

SEQ ID NO: 1156478 - RNA, 20 nt, Human
uacauguaacaaaugccgaa

SEQ ID NO: 1156479 - RNA, 23 nt, Human
uagcugggugugguggcgggugc

SEQ ID NO: 1156480 - RNA, 18 nt, Human
uauaaaaaaccccaaaug

SEQ ID NO: 1156481 - RNA, 20 nt, Human
uauagagcuccuuugccaac

SEQ ID NO: 1156482 - RNA, 21 nt, Human
uaucaaaacaagaaaaaaaaa

SEQ ID NO: 1156483 - RNA, 26 nt, Human
uaucaaaacaagaaaaaaaaagccaa

SEQ ID NO: 1156484 - RNA, 20 nt, Human
uaugaaggagagaaagacua

SEQ ID NO: 1156485 - RNA, 21 nt, Human
ucacugcacuccagccugagu

SEQ ID NO: 1156486 - RNA, 24 nt, Human
ucacugcacuccagccugagugac

SEQ ID NO: 1156487 - RNA, 24 nt, Human
ucagaccuuuuagaaucuuuaaaa

SEQ ID NO: 1156488 - RNA, 20 nt, Human
ucaggaguuggagaccagcc

SEQ ID NO: 1156489 - RNA, 22 nt, Human
ucagugaggauggucuuugacu

SEQ ID NO: 1156490 - RNA, 23 nt, Human
ucaugucacugcacuccagccug

SEQ ID NO: 1156491 - RNA, 23 nt, Human
uccaccacagcaucuuugccaga

SEQ ID NO: 1156492 - RNA, 23 nt, Human
uccagccugagugacagagugag

SEQ ID NO: 1156493 - RNA, 24 nt, Human
uccagccugagugacagagugaga

SEQ ID NO: 1156494 - RNA, 23 nt, Human
ucccuaaaagcagcagaagaaaa

SEQ ID NO: 1156495 - RNA, 20 nt, Human
uccuucuggacccuaaagaa

SEQ ID NO: 1156496 - RNA, 20 nt, Human
ucgcaacuacaaaucccaaa

SEQ ID NO: 1156497 - RNA, 20 nt, Human
ucuacaguugauuugcuauc

SEQ ID NO: 1156498 - RNA, 23 nt, Human
ucucauagauaauaccacacugc

SEQ ID NO: 1156499 - RNA, 19 nt, Human
ucucguugguuuucuauuu

SEQ ID NO: 1156500 - RNA, 22 nt, Human
ucucuacuaaaaauacaaaaaa

SEQ ID NO: 1156501 - RNA, 18 nt, Human
ucucuuauuacuucuguu

SEQ ID NO: 1156502 - RNA, 24 nt, Human
ucugccucugucuuggcagcuuuc

SEQ ID NO: 1156503 - RNA, 23 nt, Human
ucuguauuacuuuuaagauuguu

SEQ ID NO: 1156504 - RNA, 18 nt, Human
ucuuacugccucugcugc

SEQ ID NO: 1156505 - RNA, 24 nt, Human
ucuuguagaaaauggaaaaaagag

SEQ ID NO: 1156506 - RNA, 19 nt, Human
ugaaaaaacaaaacaaaac

SEQ ID NO: 1156507 - RNA, 24 nt, Human
ugaaaaacuccaaucugccauuca

SEQ ID NO: 1156508 - RNA, 23 nt, Human
ugaaagaacaaaauuauugaaca

SEQ ID NO: 1156509 - RNA, 23 nt, Human
ugaacaacaccuacuccaaaagc

SEQ ID NO: 1156510 - RNA, 19 nt, Human
ugaagacaacagaaaagac

SEQ ID NO: 1156511 - RNA, 18 nt, Human
ugaagggggaaaggaggg

SEQ ID NO: 1156512 - RNA, 18 nt, Human
ugacgaccuggggcaaug

SEQ ID NO: 1156513 - RNA, 22 nt, Human
ugagcugagaucaugucacugc

SEQ ID NO: 1156514 - RNA, 24 nt, Human
ugaggcaugagaauugcuugaacc

SEQ ID NO: 1156515 - RNA, 21 nt, Human
ugagugacagagugagacucu

SEQ ID NO: 1156516 - RNA, 19 nt, Human
ugcagaccauuucuuuaaa

SEQ ID NO: 1156517 - RNA, 19 nt, Human
ugccagaaccaaaccacag

SEQ ID NO: 1156518 - RNA, 21 nt, Human
ugccagaguguucaaucaaug

SEQ ID NO: 1156519 - RNA, 21 nt, Human
ugccaggcagucaacacauga

SEQ ID NO: 1156520 - RNA, 21 nt, Human
ugccucugucuuggcagcuuu

SEQ ID NO: 1156521 - RNA, 19 nt, Human
ugccugagcucaggaguug

SEQ ID NO: 1156522 - RNA, 24 nt, Human
ugccuguggucucagcuacucagg

SEQ ID NO: 1156523 - RNA, 21 nt, Human
ugccuuaucaauaaaaaacag

SEQ ID NO: 1156524 - RNA, 19 nt, Human
ugcguuugcucugcucagg

SEQ ID NO: 1156525 - RNA, 21 nt, Human
uggaaaaaagcuaauuuuuaa

SEQ ID NO: 1156526 - RNA, 19 nt, Human
uggcaagcaggggggaagu

SEQ ID NO: 1156527 - RNA, 21 nt, Human
uggcucacgccuguaacugca

SEQ ID NO: 1156528 - RNA, 22 nt, Human
uggcucacgccuguaacugcag

SEQ ID NO: 1156529 - RNA, 24 nt, Human
uggcucacgccuguaacugcagca

SEQ ID NO: 1156530 - RNA, 24 nt, Human
ugggaaucuuuuucuaucucaaug

SEQ ID NO: 1156531 - RNA, 20 nt, Human
ugggaggccaaggugggcag

SEQ ID NO: 1156532 - RNA, 22 nt, Human
ugggaggccaaggugggcagac

SEQ ID NO: 1156533 - RNA, 20 nt, Human
ugggaggggguaucugugag

SEQ ID NO: 1156534 - RNA, 24 nt, Human
ugguggcgggugccuguggucuca

SEQ ID NO: 1156535 - RNA, 21 nt, Human
uguauacuacaacagcaaaau

SEQ ID NO: 1156536 - RNA, 20 nt, Human
ugugguggcgggugccugug

SEQ ID NO: 1156537 - RNA, 21 nt, Human
ugugguggcgggugccugugg

SEQ ID NO: 1156538 - RNA, 18 nt, Human
uguguguaucuauuuuuu

SEQ ID NO: 1156539 - RNA, 19 nt, Human
uuaagguaacuuucagauu

SEQ ID NO: 1156540 - RNA, 18 nt, Human
uucacaucucuuacugcc

SEQ ID NO: 1156541 - RNA, 21 nt, Human
uucacauuuguuaaaaaaggu

SEQ ID NO: 1156542 - RNA, 25 nt, Human
uucaugauuuauacuacugcaggau

SEQ ID NO: 1156543 - RNA, 21 nt, Human
uucuaucaauggaaaagcccu

SEQ ID NO: 1156544 - RNA, 23 nt, Human
uucuccaauguauacuacaacag

SEQ ID NO: 1156545 - RNA, 18 nt, Human
uugcagugagcugagauc

SEQ ID NO: 1156546 - RNA, 20 nt, Human
uugcagugagcugagaucau

SEQ ID NO: 1156547 - RNA, 21 nt, Human
uugcagugagcugagaucaug

SEQ ID NO: 1156548 - RNA, 24 nt, Human
uugcuugaacccaggaagcggagg

SEQ ID NO: 1156549 - RNA, 19 nt, Human
uuugaagacaacagaaaag

SEQ ID NO: 1156550 - RNA, 20 nt, Human
aaccuggucuuccuugccuu

SEQ ID NO: 1156551 - RNA, 21 nt, Human
aaccuggucuuccuugccuuc

SEQ ID NO: 1156552 - RNA, 18 nt, Human
accauucuguacucagca

SEQ ID NO: 1156553 - RNA, 27 nt, Human
accuugaaagaaucagacucugagaag

SEQ ID NO: 1156554 - RNA, 22 nt, Human
acucagcacuuacauucacgaa

SEQ ID NO: 1156555 - RNA, 21 nt, Human
acugugccuaacacagaguga

SEQ ID NO: 1156556 - RNA, 23 nt, Human
acuguuccaacaucaugacacca

SEQ ID NO: 1156557 - RNA, 22 nt, Human
aggauuguauucagacaagccc

SEQ ID NO: 1156558 - RNA, 22 nt, Human
cacaaccuggucuuccuugccu

SEQ ID NO: 1156559 - RNA, 20 nt, Human
cacugugccuaacacagagu

SEQ ID NO: 1156560 - RNA, 20 nt, Human
cuuccaccauuauuggagaa

SEQ ID NO: 1156561 - RNA, 22 nt, Human
uauaucuccacagcuccugcug

SEQ ID NO: 1156562 - RNA, 20 nt, Human
uccugggaguaaauucgucu

SEQ ID NO: 1156563 - RNA, 18 nt, Human
ugccuaacacagagugag

SEQ ID NO: 1156564 - RNA, 23 nt, Human
uuauuguucugucuuccaccauu

SEQ ID NO: 1156565 - RNA, 22 nt, Human
uuguuacuguuccaacaucaug

SEQ ID NO: 1156566 - RNA, 26 nt, Human
aaaaaaaaaaacuuaaacuguuguuc

SEQ ID NO: 1156567 - RNA, 18 nt, Human
aaaaggcacaaaaccagc

SEQ ID NO: 1156568 - RNA, 20 nt, Human
aaaauacuagaauuuuaaug

SEQ ID NO: 1156569 - RNA, 22 nt, Human
aaaccacaacacuuuaaaagca

SEQ ID NO: 1156570 - RNA, 21 nt, Human
aacacaauccuguauuaaacu

SEQ ID NO: 1156571 - RNA, 19 nt, Human
aaccaagggcccccacaaa

SEQ ID NO: 1156572 - RNA, 24 nt, Human
acagagcgaagcaauuuugcccaa

SEQ ID NO: 1156573 - RNA, 24 nt, Human
acagagcgagacuccauuucaaaa

SEQ ID NO: 1156574 - RNA, 28 nt, Human
acugcacucacuccagccugggcgacag

SEQ ID NO: 1156575 - RNA, 21 nt, Human
acuguggggcguugcccgggc

SEQ ID NO: 1156576 - RNA, 24 nt, Human
agaaaauuccauuggaugacacca

SEQ ID NO: 1156577 - RNA, 25 nt, Human
agaaacaugcccagagacuuuaucc

SEQ ID NO: 1156578 - RNA, 22 nt, Human
agagggggaggggggacuagaa

SEQ ID NO: 1156579 - RNA, 23 nt, Human
agccaggaaauuuacugauccag

SEQ ID NO: 1156580 - RNA, 24 nt, Human
agccugggcgacagagcgagacuc

SEQ ID NO: 1156581 - RNA, 20 nt, Human
aggagcuauuaacacaaucc

SEQ ID NO: 1156582 - RNA, 19 nt, Human
aggcggagguugcagugag

SEQ ID NO: 1156583 - RNA, 21 nt, Human
aggcggagguugcagugagcc

SEQ ID NO: 1156584 - RNA, 24 nt, Human
aggcggagguugcagugagccgag

SEQ ID NO: 1156585 - RNA, 20 nt, Human
agggguggaggagcaacucc

SEQ ID NO: 1156586 - RNA, 21 nt, Human
auaacacaaccuaaaucgaaa

SEQ ID NO: 1156587 - RNA, 26 nt, Human
aucaaauuaguugcacauuaaaaaau

SEQ ID NO: 1156588 - RNA, 21 nt, Human
aucagggggugcccacccaac

SEQ ID NO: 1156589 - RNA, 22 nt, Human
auugcgccacugcacucacucc

SEQ ID NO: 1156590 - RNA, 28 nt, Human
auugcgccacugcacucacuccagccug

SEQ ID NO: 1156591 - RNA, 20 nt, Human
caaaaggcacaaaaccagcg

SEQ ID NO: 1156592 - RNA, 19 nt, Human
caacaaaagaccucacccg

SEQ ID NO: 1156593 - RNA, 18 nt, Human
caagaaaccgcagaagac

SEQ ID NO: 1156594 - RNA, 23 nt, Human
caaucagggggugcccacccaac

SEQ ID NO: 1156595 - RNA, 20 nt, Human
cacagaucccaagcauucuu

SEQ ID NO: 1156596 - RNA, 24 nt, Human
cacagaucccaagcauucuucaag

SEQ ID NO: 1156597 - RNA, 19 nt, Human
cacucacuccagccugggc

SEQ ID NO: 1156598 - RNA, 23 nt, Human
cacuccagccugggcgacagagc

SEQ ID NO: 1156599 - RNA, 24 nt, Human
cacuccagccugggcgacagagcg

SEQ ID NO: 1156600 - RNA, 23 nt, Human
cacuccagccugggcuacagagc

SEQ ID NO: 1156601 - RNA, 24 nt, Human
cacuccagccugggcuacagagcg

SEQ ID NO: 1156602 - RNA, 19 nt, Human
cacugcacucacuccagcc

SEQ ID NO: 1156603 - RNA, 27 nt, Human
cacugcacucacuccagccugggcgac

SEQ ID NO: 1156604 - RNA, 28 nt, Human
cacugcacucacuccagccugggcgaca

SEQ ID NO: 1156605 - RNA, 19 nt, Human
cagaaacaugcccagagac

SEQ ID NO: 1156606 - RNA, 24 nt, Human
cagaaccauuuccaacacugaaga

SEQ ID NO: 1156607 - RNA, 24 nt, Human
cagaucccaagcauucuucaagaa

SEQ ID NO: 1156608 - RNA, 23 nt, Human
cagcacagacagaaccauuucca

SEQ ID NO: 1156609 - RNA, 25 nt, Human
cagcacagacagaaccauuuccaac

SEQ ID NO: 1156610 - RNA, 23 nt, Human
cagcguuggcccauugcggccaa

SEQ ID NO: 1156611 - RNA, 24 nt, Human
cagcugcucccagggagccaggaa

SEQ ID NO: 1156612 - RNA, 23 nt, Human
cauuggaugacaccauugguagc

SEQ ID NO: 1156613 - RNA, 26 nt, Human
ccacaacacuuuaaaagcacguguga

SEQ ID NO: 1156614 - RNA, 19 nt, Human
ccacccaacaaaagaccuc

SEQ ID NO: 1156615 - RNA, 23 nt, Human
ccacccaacaaaagaccucaccc

SEQ ID NO: 1156616 - RNA, 27 nt, Human
ccacugcacucacuccagccugggcga

SEQ ID NO: 1156617 - RNA, 28 nt, Human
ccacugcacucacuccagccugggcgac

SEQ ID NO: 1156618 - RNA, 20 nt, Human
ccagccugggcuacagagcg

SEQ ID NO: 1156619 - RNA, 19 nt, Human
ccaguaaauuucagaguca

SEQ ID NO: 1156620 - RNA, 19 nt, Human
ccaucucaaccagcaaggc

SEQ ID NO: 1156621 - RNA, 24 nt, Human
cccaagcauucuucaagaaaccgc

SEQ ID NO: 1156622 - RNA, 22 nt, Human
cccagcguuggcccauugcggc

SEQ ID NO: 1156623 - RNA, 20 nt, Human
cccccacaaaaggcacaaaa

SEQ ID NO: 1156624 - RNA, 21 nt, Human
cccccacaaaaggcacaaaac

SEQ ID NO: 1156625 - RNA, 22 nt, Human
ccugggcgacagagcgagacuc

SEQ ID NO: 1156626 - RNA, 23 nt, Human
cgagacuccauuucaaaaaaaaa

SEQ ID NO: 1156627 - RNA, 24 nt, Human
cuccauuucaaaaaaaaaaaaaaa

SEQ ID NO: 1156628 - RNA, 18 nt, Human
cuguuguuccucagucca

SEQ ID NO: 1156629 - RNA, 19 nt, Human
gaagagggggaggggggac

SEQ ID NO: 1156630 - RNA, 18 nt, Human
gagaauccaucucaaccg

SEQ ID NO: 1156631 - RNA, 27 nt, Human
gagauugcgccacugcacucacuccag

SEQ ID NO: 1156632 - RNA, 18 nt, Human
gagggaagagggggaggg

SEQ ID NO: 1156633 - RNA, 20 nt, Human
gagggaagagggggaggggg

SEQ ID NO: 1156634 - RNA, 23 nt, Human
gagguugcagugagccgagauug

SEQ ID NO: 1156635 - RNA, 28 nt, Human
gagucagccuccaaugagggggaaccaa

SEQ ID NO: 1156636 - RNA, 19 nt, Human
gauggagagagaaaccugu

SEQ ID NO: 1156637 - RNA, 24 nt, Human
gcacuccagccugggcuacagagc

SEQ ID NO: 1156638 - RNA, 28 nt, Human
gccacugcacucacuccagccugggcga

SEQ ID NO: 1156639 - RNA, 19 nt, Human
gccagaaacaugcccagag

SEQ ID NO: 1156640 - RNA, 22 nt, Human
gccagccugugggugccccucu

SEQ ID NO: 1156641 - RNA, 21 nt, Human
gcccaaggccugaggccucaa

SEQ ID NO: 1156642 - RNA, 25 nt, Human
ggagggaagagggggaggggggacu

SEQ ID NO: 1156643 - RNA, 22 nt, Human
ggagguugcagugagccgagau

SEQ ID NO: 1156644 - RNA, 24 nt, Human
ggagguugcagugagccgagauug

SEQ ID NO: 1156645 - RNA, 21 nt, Human
ggcugcuauccacuguggggc

SEQ ID NO: 1156646 - RNA, 20 nt, Human
gggaagagggggagggggga

SEQ ID NO: 1156647 - RNA, 21 nt, Human
gggagggaagagggggagggg

SEQ ID NO: 1156648 - RNA, 22 nt, Human
gugagguccuuuugcagggcca

SEQ ID NO: 1156649 - RNA, 19 nt, Human
guugcagugagccgagauu

SEQ ID NO: 1156650 - RNA, 22 nt, Human
uaaaaaauaaacagacaagcaa

SEQ ID NO: 1156651 - RNA, 19 nt, Human
uaaacagacaagcaaucaa

SEQ ID NO: 1156652 - RNA, 25 nt, Human
uaaacagacaagcaaucagggggug

SEQ ID NO: 1156653 - RNA, 18 nt, Human
uaaagugugcauaacaca

SEQ ID NO: 1156654 - RNA, 23 nt, Human
uaagccugggagggaagaggggg

SEQ ID NO: 1156655 - RNA, 21 nt, Human
uagccuccaagggccuagagc

SEQ ID NO: 1156656 - RNA, 26 nt, Human
uagggguggaggagcaacuccggcag

SEQ ID NO: 1156657 - RNA, 18 nt, Human
uaguugcacauuaaaaaa

SEQ ID NO: 1156658 - RNA, 23 nt, Human
uccaauauaacccaucgucugau

SEQ ID NO: 1156659 - RNA, 18 nt, Human
uccacuagcuacauuuca

SEQ ID NO: 1156660 - RNA, 20 nt, Human
uccacuagcuacauuucaaa

SEQ ID NO: 1156661 - RNA, 23 nt, Human
uccagccugggcgacagagcgag

SEQ ID NO: 1156662 - RNA, 24 nt, Human
uccagccugggcgacagagcgaga

SEQ ID NO: 1156663 - RNA, 23 nt, Human
uccagccugggcuacagagcgag

SEQ ID NO: 1156664 - RNA, 24 nt, Human
uccagccugggcuacagagcgaga

SEQ ID NO: 1156665 - RNA, 25 nt, Human
uccauuucaaaaaaaaaaaaaaaaa

SEQ ID NO: 1156666 - RNA, 23 nt, Human
ucccagggagccaggaaauuuac

SEQ ID NO: 1156667 - RNA, 20 nt, Human
ugaaggaaauucaaaucaaa

SEQ ID NO: 1156668 - RNA, 23 nt, Human
ugagauccugcaguuuuagcauc

SEQ ID NO: 1156669 - RNA, 25 nt, Human
ugagauccugcaguuuuagcaucuu

SEQ ID NO: 1156670 - RNA, 22 nt, Human
ugagccgagauugcgccacugc

SEQ ID NO: 1156671 - RNA, 18 nt, Human
ugaguuuaaaaacaauuu

SEQ ID NO: 1156672 - RNA, 21 nt, Human
ugcacucacuccagccugggc

SEQ ID NO: 1156673 - RNA, 22 nt, Human
ugcacuccagccugggcuacag

SEQ ID NO: 1156674 - RNA, 19 nt, Human
uggccccagcguuggccca

SEQ ID NO: 1156675 - RNA, 22 nt, Human
uggcugcuaugcuggacagcac

SEQ ID NO: 1156676 - RNA, 18 nt, Human
ugggagggaagaggggga

SEQ ID NO: 1156677 - RNA, 20 nt, Human
ugggagggaagagggggagg

SEQ ID NO: 1156678 - RNA, 22 nt, Human
ugggagggaagagggggagggg

SEQ ID NO: 1156679 - RNA, 20 nt, Human
uuaaacuguuguuccucagu

SEQ ID NO: 1156680 - RNA, 20 nt, Human
uuaaaugaacgcuauccuua

SEQ ID NO: 1156681 - RNA, 22 nt, Human
uucaaaucaaauuaguugcaca

SEQ ID NO: 1156682 - RNA, 22 nt, Human
uuccauuggaugacaccauugg

SEQ ID NO: 1156683 - RNA, 19 nt, Human
uuccucaguccacuagcua

SEQ ID NO: 1156684 - RNA, 18 nt, Human
uugcagugagccgagauu

SEQ ID NO: 1156685 - RNA, 19 nt, Human
uugcagugagccgagauug

SEQ ID NO: 1156686 - RNA, 20 nt, Human
uugcagugagccgagauugc

SEQ ID NO: 1156687 - RNA, 22 nt, Human
uugcagugagccgagauugcgc

SEQ ID NO: 1156688 - RNA, 24 nt, Human
uuuaaaccacaacacuuuaaaagc

SEQ ID NO: 1156689 - RNA, 25 nt, Human
uuuaaaccacaacacuuuaaaagca

SEQ ID NO: 1156690 - RNA, 21 nt, Human
aaaaagaaagagacguggaaa

SEQ ID NO: 1156691 - RNA, 27 nt, Human
aaacaagagagaaaaauugagggaccc

SEQ ID NO: 1156692 - RNA, 21 nt, Human
aaagaaagagacguggaaaac

SEQ ID NO: 1156693 - RNA, 24 nt, Human
aaagugcugggauuacagguguga

SEQ ID NO: 1156694 - RNA, 18 nt, Human
aaauuuauucugcuugag

SEQ ID NO: 1156695 - RNA, 25 nt, Human
aagcaguccuccuuccuuggccucc

SEQ ID NO: 1156696 - RNA, 18 nt, Human
aagugcugggauuacagg

SEQ ID NO: 1156697 - RNA, 19 nt, Human
aagugcugggauuacaggu

SEQ ID NO: 1156698 - RNA, 26 nt, Human
aagugcugggauuacaggugugagcc

SEQ ID NO: 1156699 - RNA, 18 nt, Human
aauuucucagacaucauc

SEQ ID NO: 1156700 - RNA, 20 nt, Human
acgcugcucaggcuggucuu

SEQ ID NO: 1156701 - RNA, 19 nt, Human
acugcucagccuugaaguu

SEQ ID NO: 1156702 - RNA, 22 nt, Human
agagagaaaaauugauuacugg

SEQ ID NO: 1156703 - RNA, 21 nt, Human
aggauuauggauauaugccac

SEQ ID NO: 1156704 - RNA, 22 nt, Human
agggauccucccacuucagccu

SEQ ID NO: 1156705 - RNA, 24 nt, Human
agggauccucccacuucagccucc

SEQ ID NO: 1156706 - RNA, 22 nt, Human
aggucuugcuacgcugcucagg

SEQ ID NO: 1156707 - RNA, 21 nt, Human
aguaauagagaaaaagaaaga

SEQ ID NO: 1156708 - RNA, 24 nt, Human
aguucugggcucaagggauccucc

SEQ ID NO: 1156709 - RNA, 23 nt, Human
aguucugggcucaaggggagagc

SEQ ID NO: 1156710 - RNA, 24 nt, Human
auaaucagagcucacugcucagcc

SEQ ID NO: 1156711 - RNA, 24 nt, Human
auccuaaauuuugaaaauguguuu

SEQ ID NO: 1156712 - RNA, 19 nt, Human
auuucauuauaagcaggaa

SEQ ID NO: 1156713 - RNA, 21 nt, Human
auuucauuauaagcaggaaua

SEQ ID NO: 1156714 - RNA, 24 nt, Human
caaagugcugggauuacaggugug

SEQ ID NO: 1156715 - RNA, 21 nt, Human
caccucuccuuccuucucucc

SEQ ID NO: 1156716 - RNA, 24 nt, Human
cacuucagccucccaagcagcuag

SEQ ID NO: 1156717 - RNA, 23 nt, Human
cagccucccaagcagcuaggauu

SEQ ID NO: 1156718 - RNA, 20 nt, Human
ccaaagugcugggauuacag

SEQ ID NO: 1156719 - RNA, 21 nt, Human
ccaaagugcugggauuacagg

SEQ ID NO: 1156720 - RNA, 21 nt, Human
ccaaagugcugggauuacagg

SEQ ID NO: 1156721 - RNA, 24 nt, Human
ccaaagugcugggauuacaggugu

SEQ ID NO: 1156722 - RNA, 19 nt, Human
cccuuuugcugcuuuguua

SEQ ID NO: 1156723 - RNA, 23 nt, Human
ccucccacuucagccucccaagc

SEQ ID NO: 1156724 - RNA, 20 nt, Human
ccuccuuccuuggccuccca

SEQ ID NO: 1156725 - RNA, 19 nt, Human
ccuggcuggaaugcacugg

SEQ ID NO: 1156726 - RNA, 21 nt, Human
ccuuugaucugacaacucaca

SEQ ID NO: 1156727 - RNA, 20 nt, Human
ccuuuugcugcuuuguuagu

SEQ ID NO: 1156728 - RNA, 24 nt, Human
cucaagggauccucccacuucagc

SEQ ID NO: 1156729 - RNA, 28 nt, Human
cucacugcucagccuugaaagguuuucc

SEQ ID NO: 1156730 - RNA, 21 nt, Human
cucuccuuccuucucuccucc

SEQ ID NO: 1156731 - RNA, 19 nt, Human
cugugcuucgcccuuuugc

SEQ ID NO: 1156732 - RNA, 24 nt, Human
cuuccuucucuccuccugaaacuc

SEQ ID NO: 1156733 - RNA, 20 nt, Human
cuuucuuucuuuuuuuuuga

SEQ ID NO: 1156734 - RNA, 19 nt, Human
gacguggaaaacaagagag

SEQ ID NO: 1156735 - RNA, 21 nt, Human
gagcucacugcucagccuuga

SEQ ID NO: 1156736 - RNA, 18 nt, Human
gauuacaggugugagcca

SEQ ID NO: 1156737 - RNA, 19 nt, Human
gauuacaggugugagccac

SEQ ID NO: 1156738 - RNA, 21 nt, Human
gauuacaggugugagccacug

SEQ ID NO: 1156739 - RNA, 22 nt, Human
gauuauggauauaugccaccau

SEQ ID NO: 1156740 - RNA, 20 nt, Human
gcucugucauccuggcugga

SEQ ID NO: 1156741 - RNA, 21 nt, Human
ggcuggucuugaacuccucac

SEQ ID NO: 1156742 - RNA, 21 nt, Human
guaauagagaaaaagaaagag

SEQ ID NO: 1156743 - RNA, 24 nt, Human
gucuugcuacgcugcucaggcugg

SEQ ID NO: 1156744 - RNA, 19 nt, Human
gugugagccacugugcuuc

SEQ ID NO: 1156745 - RNA, 25 nt, Human
guucugggcucaagggauccuccca

SEQ ID NO: 1156746 - RNA, 25 nt, Human
uaaaauuuauucugcuugagacaau

SEQ ID NO: 1156747 - RNA, 27 nt, Human
uaagcaguccuccuuccuuggccuccc

SEQ ID NO: 1156748 - RNA, 18 nt, Human
uaaguuccuggccccauu

SEQ ID NO: 1156749 - RNA, 24 nt, Human
uacaggucucaauuucuaaaauuu

SEQ ID NO: 1156750 - RNA, 21 nt, Human
uacaggugugagccacugugc

SEQ ID NO: 1156751 - RNA, 23 nt, Human
uacaggugugagccacugugcuu

SEQ ID NO: 1156752 - RNA, 20 nt, Human
uacgcugcucaggcuggucu

SEQ ID NO: 1156753 - RNA, 24 nt, Human
uacgcugcucaggcuggucuugaa

SEQ ID NO: 1156754 - RNA, 18 nt, Human
uagagaugaggucuugcu

SEQ ID NO: 1156755 - RNA, 24 nt, Human
uaggauuauggauauaugccacca

SEQ ID NO: 1156756 - RNA, 18 nt, Human
uauagaauucuaguuucu

SEQ ID NO: 1156757 - RNA, 20 nt, Human
ucagacaucaucucuggaga

SEQ ID NO: 1156758 - RNA, 18 nt, Human
ucagccucccaagcagcu

SEQ ID NO: 1156759 - RNA, 20 nt, Human
ucagccucccaagcagcuag

SEQ ID NO: 1156760 - RNA, 23 nt, Human
ucccaaagugcugggauuacagg

SEQ ID NO: 1156761 - RNA, 24 nt, Human
uccucacuuuaagcaguccuccuu

SEQ ID NO: 1156762 - RNA, 22 nt, Human
ucucuccuccugaaacucuuuu

SEQ ID NO: 1156763 - RNA, 24 nt, Human
ucucugaacuuaccuuugcugccu

SEQ ID NO: 1156764 - RNA, 25 nt, Human
ucugaaaauuucucagacaucaucu

SEQ ID NO: 1156765 - RNA, 20 nt, Human
ucugucauccuggcuggaau

SEQ ID NO: 1156766 - RNA, 24 nt, Human
ucuucugucacaacuguuggugau

SEQ ID NO: 1156767 - RNA, 24 nt, Human
ucuugaacuccucacuuuaagcag

SEQ ID NO: 1156768 - RNA, 23 nt, Human
ucuugcuacgcugcucaggcugg

SEQ ID NO: 1156769 - RNA, 19 nt, Human
ucuugcucugucauccugg

SEQ ID NO: 1156770 - RNA, 24 nt, Human
ucuugcucugucauccuggcugga

SEQ ID NO: 1156771 - RNA, 20 nt, Human
ucuuuuuuuuugagaugcag

SEQ ID NO: 1156772 - RNA, 24 nt, Human
ugaacuccucacuuuaagcagucc

SEQ ID NO: 1156773 - RNA, 18 nt, Human
ugaauaugcaccuuauuu

SEQ ID NO: 1156774 - RNA, 23 nt, Human
ugacaggaugauagucauuucuc

SEQ ID NO: 1156775 - RNA, 24 nt, Human
ugaggucuugcuacgcugcucagg

SEQ ID NO: 1156776 - RNA, 24 nt, Human
ugcucaggcuggucuugaacuccu

SEQ ID NO: 1156777 - RNA, 21 nt, Human
ugcucugucauccuggcugga

SEQ ID NO: 1156778 - RNA, 24 nt, Human
ugcugggauuacaggugugagcca

SEQ ID NO: 1156779 - RNA, 18 nt, Human
uggaaugcacuggcauaa

SEQ ID NO: 1156780 - RNA, 22 nt, Human
uggccccauuggcuucgaugau

SEQ ID NO: 1156781 - RNA, 18 nt, Human
ugggauuacaggugugag

SEQ ID NO: 1156782 - RNA, 21 nt, Human
ugggauuacaggugugagcca

SEQ ID NO: 1156783 - RNA, 22 nt, Human
ugggauuacaggugugagccac

SEQ ID NO: 1156784 - RNA, 22 nt, Human
ugggauuacaggugugagccac

SEQ ID NO: 1156785 - RNA, 22 nt, Human
ugggauuacaggugugagccac

SEQ ID NO: 1156786 - RNA, 24 nt, Human
ugggauuacaggugugagccacug

SEQ ID NO: 1156787 - RNA, 25 nt, Human
uguaguaauagagaaaaagaaagag

SEQ ID NO: 1156788 - RNA, 18 nt, Human
uuaguagagaugaggucu

SEQ ID NO: 1156789 - RNA, 24 nt, Human
uuccagccucugggucucugaacu

SEQ ID NO: 1156790 - RNA, 21 nt, Human
uuccuuggccucccaaagugc

SEQ ID NO: 1156791 - RNA, 23 nt, Human
uuccuuggccucccaaagugcug

SEQ ID NO: 1156792 - RNA, 22 nt, Human
uucucagugguaacuuuuaaca

SEQ ID NO: 1156793 - RNA, 21 nt, Human
uucucaguuuuggucucuuaa

SEQ ID NO: 1156794 - RNA, 21 nt, Human
uuuccaucaucuucugucaca

SEQ ID NO: 1156795 - RNA, 24 nt, Human
uuuuugagaugcagucuugcucug

SEQ ID NO: 1156796 - RNA, 19 nt, Human
aaacuagaagggaaaggug

SEQ ID NO: 1156797 - RNA, 19 nt, Human
aaacuguacagucaccaga

SEQ ID NO: 1156798 - RNA, 20 nt, Human
aacaacuuuucacaagccga

SEQ ID NO: 1156799 - RNA, 18 nt, Human
aagggaaagguguuuucu

SEQ ID NO: 1156800 - RNA, 21 nt, Human
aagggaaagguguuuucucca

SEQ ID NO: 1156801 - RNA, 25 nt, Human
aaucagaaagccacuauaaacccaa

SEQ ID NO: 1156802 - RNA, 23 nt, Human
agaaagccacuauaaacccaaug

SEQ ID NO: 1156803 - RNA, 22 nt, Human
agauggaaagggagaagaagaa

SEQ ID NO: 1156804 - RNA, 24 nt, Human
aucuuuauaaaacuugauaaaaaa

SEQ ID NO: 1156805 - RNA, 20 nt, Human
caaacuguauccagcuuuau

SEQ ID NO: 1156806 - RNA, 19 nt, Human
caagaggaagucucucaaa

SEQ ID NO: 1156807 - RNA, 22 nt, Human
caagccgacccugacuuucagu

SEQ ID NO: 1156808 - RNA, 24 nt, Human
cacugguaaccaacgacuaggggu

SEQ ID NO: 1156809 - RNA, 18 nt, Human
caggcaggacgugggcag

SEQ ID NO: 1156810 - RNA, 21 nt, Human
ccaagguggccauguguguca

SEQ ID NO: 1156811 - RNA, 21 nt, Human
ccacaaggcuuuugugccaag

SEQ ID NO: 1156812 - RNA, 20 nt, Human
ccacaaucuagaaauggaac

SEQ ID NO: 1156813 - RNA, 19 nt, Human
ccauaccacaaggcuuuug

SEQ ID NO: 1156814 - RNA, 26 nt, Human
cccuccuccugggagccaagaggaag

SEQ ID NO: 1156815 - RNA, 20 nt, Human
cccuuccccccaaaacaaug

SEQ ID NO: 1156816 - RNA, 21 nt, Human
ccuuuaaaaaaaaaaaaguaa

SEQ ID NO: 1156817 - RNA, 19 nt, Human
cucaccucuucuucauacu

SEQ ID NO: 1156818 - RNA, 25 nt, Human
cuuuaaaaaaaaaaaaguaaaacaa

SEQ ID NO: 1156819 - RNA, 18 nt, Human
cuuuugugccaagguggc

SEQ ID NO: 1156820 - RNA, 20 nt, Human
ggaaagguguuuucuccaca

SEQ ID NO: 1156821 - RNA, 21 nt, Human
ggcaucacuggaaaguccaga

SEQ ID NO: 1156822 - RNA, 19 nt, Human
uaagugaaaauggcagaau

SEQ ID NO: 1156823 - RNA, 22 nt, Human
uacaacaacuuucaaacucccu

SEQ ID NO: 1156824 - RNA, 20 nt, Human
uaccaaaaaucagaaagcca

SEQ ID NO: 1156825 - RNA, 22 nt, Human
uaccaaaaaucagaaagccacu

SEQ ID NO: 1156826 - RNA, 24 nt, Human
uaccaaaaaucagaaagccacuau

SEQ ID NO: 1156827 - RNA, 25 nt, Human
uagaaauggaaccacugcucuuuug

SEQ ID NO: 1156828 - RNA, 19 nt, Human
uaugccccuuccccccaaa

SEQ ID NO: 1156829 - RNA, 23 nt, Human
uaugccccuuccccccaaaacaa

SEQ ID NO: 1156830 - RNA, 22 nt, Human
ucaggcaggacgugggcagaca

SEQ ID NO: 1156831 - RNA, 25 nt, Human
ucccaacagaugucugggcuuaagg

SEQ ID NO: 1156832 - RNA, 21 nt, Human
ucucaaaacuagaagggaaag

SEQ ID NO: 1156833 - RNA, 21 nt, Human
ucugcaauggacuaccaaaaa

SEQ ID NO: 1156834 - RNA, 20 nt, Human
ugaaaauggcagaauuuauc

SEQ ID NO: 1156835 - RNA, 21 nt, Human
ugaaaauggcagaauuuaucu

SEQ ID NO: 1156836 - RNA, 20 nt, Human
ugaaagauggaaagggagaa

SEQ ID NO: 1156837 - RNA, 19 nt, Human
ugaagucuucaucuggugc

SEQ ID NO: 1156838 - RNA, 23 nt, Human
uggaaccacugcucuuuugacag

SEQ ID NO: 1156839 - RNA, 18 nt, Human
uggcaucacuggaaaguc

SEQ ID NO: 1156840 - RNA, 20 nt, Human
ugugcuaacaacauaccuuu

SEQ ID NO: 1156841 - RNA, 19 nt, Human
uguucugugugcuaacaac

SEQ ID NO: 1156842 - RNA, 23 nt, Human
uuaaaaaaaaaaaaguaaaacaa

SEQ ID NO: 1156843 - RNA, 20 nt, Human
uuaucugaagauccacaauc

SEQ ID NO: 1156844 - RNA, 25 nt, Human
uucaaacucccuucugcaauggacu

SEQ ID NO: 1156845 - RNA, 21 nt, Human
uucaguaagugaaaauggcag

SEQ ID NO: 1156846 - RNA, 29 nt, Human
uuuagagugaggguugacauuucacauuu

SEQ ID NO: 1156847 - RNA, 22 nt, Human
uuucaguaagugaaaauggcag

SEQ ID NO: 1156848 - RNA, 18 nt, Human
uuuccauaccacaaggcu

SEQ ID NO: 1156849 - RNA, 20 nt, Human
aaccuccaccuccugggcuc

SEQ ID NO: 1156850 - RNA, 24 nt, Human
aaguagcugggaaugcaggugugu

SEQ ID NO: 1156851 - RNA, 22 nt, Human
aagugcugccugcgcagguugg

SEQ ID NO: 1156852 - RNA, 23 nt, Human
acaggugccuaccaccacacccg

SEQ ID NO: 1156853 - RNA, 22 nt, Human
accauagggaaaugucuucuca

SEQ ID NO: 1156854 - RNA, 20 nt, Human
acccaguucacucccacgcu

SEQ ID NO: 1156855 - RNA, 21 nt, Human
acucuguugcccaggcuggag

SEQ ID NO: 1156856 - RNA, 27 nt, Human
acucuguugcccaggcuggagugcacu

SEQ ID NO: 1156857 - RNA, 21 nt, Human
acuggacauuucaagccccug

SEQ ID NO: 1156858 - RNA, 25 nt, Human
agacaagauggggguuuugcucuaa

SEQ ID NO: 1156859 - RNA, 18 nt, Human
aggcagggaugugggcag

SEQ ID NO: 1156860 - RNA, 24 nt, Human
aggcagggaugugggcaggcaggg

SEQ ID NO: 1156861 - RNA, 18 nt, Human
aggcuggaucuugauaug

SEQ ID NO: 1156862 - RNA, 24 nt, Human
agggauucuccugccucagccucc

SEQ ID NO: 1156863 - RNA, 24 nt, Human
aggugaucugccugccucggccuc

SEQ ID NO: 1156864 - RNA, 26 nt, Human
aggugcugagaucauaggugugagcc

SEQ ID NO: 1156865 - RNA, 21 nt, Human
aguagcugggauuacaggugc

SEQ ID NO: 1156866 - RNA, 24 nt, Human
agugauucuccugccucagccucc

SEQ ID NO: 1156867 - RNA, 21 nt, Human
auacuggacauuucaagcccc

SEQ ID NO: 1156868 - RNA, 24 nt, Human
aucccccccuggccaaaagugcug

SEQ ID NO: 1156869 - RNA, 24 nt, Human
augggguuucaccacauuggccag

SEQ ID NO: 1156870 - RNA, 18 nt, Human
auucuccugccucagccu

SEQ ID NO: 1156871 - RNA, 24 nt, Human
auuuuuguauuuuuaguagagaug

SEQ ID NO: 1156872 - RNA, 23 nt, Human
caaaagugcugccugcgcagguu

SEQ ID NO: 1156873 - RNA, 23 nt, Human
caaccuccaccuccugggcucaa

SEQ ID NO: 1156874 - RNA, 24 nt, Human
caaccuccaccuccugggcucaag

SEQ ID NO: 1156875 - RNA, 19 nt, Human
caagacaggguguuuugac

SEQ ID NO: 1156876 - RNA, 24 nt, Human
caagauggggguuuugcucuaagc

SEQ ID NO: 1156877 - RNA, 22 nt, Human
caagccccugcagagaagcaag

SEQ ID NO: 1156878 - RNA, 23 nt, Human
caagcugacaugaagacauggcc

SEQ ID NO: 1156879 - RNA, 22 nt, Human
caagggauucuccugccucagc

SEQ ID NO: 1156880 - RNA, 24 nt, Human
caaggugcugagaucauaggugug

SEQ ID NO: 1156881 - RNA, 20 nt, Human
caagugauucuccugccuca

SEQ ID NO: 1156882 - RNA, 22 nt, Human
caagugauucuccugccucagc

SEQ ID NO: 1156883 - RNA, 24 nt, Human
cacauuggccaggcuggucucaaa

SEQ ID NO: 1156884 - RNA, 24 nt, Human
caccacacccggcuaauuuuugua

SEQ ID NO: 1156885 - RNA, 18 nt, Human
caccacaucccccugguu

SEQ ID NO: 1156886 - RNA, 21 nt, Human
caccacauuggccaggcuggu

SEQ ID NO: 1156887 - RNA, 24 nt, Human
caccacauuggccaggcuggucuc

SEQ ID NO: 1156888 - RNA, 27 nt, Human
caccacauuggccaggcuggucucaaa

SEQ ID NO: 1156889 - RNA, 21 nt, Human
cacccaccuagacugcagagu

SEQ ID NO: 1156890 - RNA, 19 nt, Human
cacgcuggggaccugcaga

SEQ ID NO: 1156891 - RNA, 21 nt, Human
cacugcaaccuccaccuccug

SEQ ID NO: 1156892 - RNA, 23 nt, Human
cacugcaaccuccaccuccuggg

SEQ ID NO: 1156893 - RNA, 22 nt, Human
cagcuggacuacacaggcugaa

SEQ ID NO: 1156894 - RNA, 21 nt, Human
caggugccuaccaccacaccc

SEQ ID NO: 1156895 - RNA, 24 nt, Human
caggugccuaccaccacacccggc

SEQ ID NO: 1156896 - RNA, 21 nt, Human
ccaaggugcugagaucauagg

SEQ ID NO: 1156897 - RNA, 24 nt, Human
ccaaggugcugagaucauaggugu

SEQ ID NO: 1156898 - RNA, 24 nt, Human
ccaccuccugggcucaagugauuc

SEQ ID NO: 1156899 - RNA, 19 nt, Human
ccaggauuccaggaggcag

SEQ ID NO: 1156900 - RNA, 23 nt, Human
cccaaguagcugggaaugcaggu

SEQ ID NO: 1156901 - RNA, 19 nt, Human
cccacccaguucacuccca

SEQ ID NO: 1156902 - RNA, 21 nt, Human
cccagguucaagggauucucc

SEQ ID NO: 1156903 - RNA, 21 nt, Human
ccccuggccaaaagugcugcc

SEQ ID NO: 1156904 - RNA, 23 nt, Human
cccgaguagcugggauuacaggu

SEQ ID NO: 1156905 - RNA, 24 nt, Human
cccgaguagcugggauuacaggug

SEQ ID NO: 1156906 - RNA, 21 nt, Human
ccgaguagcugggauuacagg

SEQ ID NO: 1156907 - RNA, 22 nt, Human
ccuccaccuccugggcucaagu

SEQ ID NO: 1156908 - RNA, 24 nt, Human
ccucccagguucaagggauucucc

SEQ ID NO: 1156909 - RNA, 21 nt, Human
ccuccugggcucaagugauuc

SEQ ID NO: 1156910 - RNA, 24 nt, Human
ccuccugggcucaagugauucucc

SEQ ID NO: 1156911 - RNA, 21 nt, Human
ccugaccuaaggugaucugcc

SEQ ID NO: 1156912 - RNA, 23 nt, Human
ccugaccuaaggugaucugccug

SEQ ID NO: 1156913 - RNA, 23 nt, Human
ccugccucagccucccaaguagc

SEQ ID NO: 1156914 - RNA, 24 nt, Human
ccugccucggccucccaaggugcu

SEQ ID NO: 1156915 - RNA, 23 nt, Human
ccugggcucaagugauucuccuc

SEQ ID NO: 1156916 - RNA, 23 nt, Human
ccugggcucaagugauucuccug

SEQ ID NO: 1156917 - RNA, 18 nt, Human
ccuggguugagaguggag

SEQ ID NO: 1156918 - RNA, 23 nt, Human
cuaauuuuuguauuuuuaguaga

SEQ ID NO: 1156919 - RNA, 23 nt, Human
cucaagugauucuccugccucag

SEQ ID NO: 1156920 - RNA, 24 nt, Human
cucaagugauucuccugccucagc

SEQ ID NO: 1156921 - RNA, 24 nt, Human
cucacugcaaccuccaccuccugg

SEQ ID NO: 1156922 - RNA, 27 nt, Human
cucacugcaaccuccaccuccugggcu

SEQ ID NO: 1156923 - RNA, 23 nt, Human
cucagccucccgaguagcuggga

SEQ ID NO: 1156924 - RNA, 19 nt, Human
cucccacgcuggggaccug

SEQ ID NO: 1156925 - RNA, 26 nt, Human
cuccugaccuaaggugaucugccugc

SEQ ID NO: 1156926 - RNA, 21 nt, Human
cuccugggcucaagugauucu

SEQ ID NO: 1156927 - RNA, 24 nt, Human
cucuaagccuggggaccccaccuc

SEQ ID NO: 1156928 - RNA, 21 nt, Human
cucucaucccccccuggccaa

SEQ ID NO: 1156929 - RNA, 18 nt, Human
cugcaaccuccaccuccu

SEQ ID NO: 1156930 - RNA, 23 nt, Human
cugcaaccuccaccuccugggcu

SEQ ID NO: 1156931 - RNA, 24 nt, Human
cugcaaccuccaccuccugggcuc

SEQ ID NO: 1156932 - RNA, 23 nt, Human
cugccucagccucccaaguagcu

SEQ ID NO: 1156933 - RNA, 23 nt, Human
cugccucagccucccgaguagcu

SEQ ID NO: 1156934 - RNA, 21 nt, Human
cuggaucuugauauguguuuc

SEQ ID NO: 1156935 - RNA, 24 nt, Human
cuggggaccccaccucccagguuc

SEQ ID NO: 1156936 - RNA, 21 nt, Human
cuuacucuguugcccaggcug

SEQ ID NO: 1156937 - RNA, 26 nt, Human
cuuacugugcugggaguacuugugga

SEQ ID NO: 1156938 - RNA, 19 nt, Human
cuuguggagugggggcugu

SEQ ID NO: 1156939 - RNA, 21 nt, Human
cuuguggagugggggcugugu

SEQ ID NO: 1156940 - RNA, 20 nt, Human
cuuuuguacuuuuaguagag

SEQ ID NO: 1156941 - RNA, 21 nt, Human
gaaguucucucaucccccccu

SEQ ID NO: 1156942 - RNA, 24 nt, Human
gaccuaaggugaucugccugccuc

SEQ ID NO: 1156943 - RNA, 20 nt, Human
gagaugggguuucaccacau

SEQ ID NO: 1156944 - RNA, 24 nt, Human
gagaugggguuucaccacauuggc

SEQ ID NO: 1156945 - RNA, 22 nt, Human
gagcaggaagaagacacggagc

SEQ ID NO: 1156946 - RNA, 18 nt, Human
gaucauaggugugagcca

SEQ ID NO: 1156947 - RNA, 22 nt, Human
gauucuccugccucagccuccc

SEQ ID NO: 1156948 - RNA, 20 nt, Human
gcccaggcuggagugcacug

SEQ ID NO: 1156949 - RNA, 24 nt, Human
gcccaggcuggagugcacuggcau

SEQ ID NO: 1156950 - RNA, 20 nt, Human
gccucagccucccgaguagc

SEQ ID NO: 1156951 - RNA, 20 nt, Human
gccuguuccccaccacaucc

SEQ ID NO: 1156952 - RNA, 24 nt, Human
gcuggacuacacaggcugaagcug

SEQ ID NO: 1156953 - RNA, 20 nt, Human
ggagacagacaagauggggg

SEQ ID NO: 1156954 - RNA, 23 nt, Human
ggagucuuacucuguugcccagg

SEQ ID NO: 1156955 - RNA, 22 nt, Human
gggcucaagugauucuccugcc

SEQ ID NO: 1156956 - RNA, 18 nt, Human
gggguuucaccacauugg

SEQ ID NO: 1156957 - RNA, 22 nt, Human
gggguuucaccacauuggccag

SEQ ID NO: 1156958 - RNA, 18 nt, Human
guagcugggauuacaggu

SEQ ID NO: 1156959 - RNA, 19 nt, Human
gugaucugccugccucggc

SEQ ID NO: 1156960 - RNA, 24 nt, Human
gugauucuccugccucagccuccc

SEQ ID NO: 1156961 - RNA, 18 nt, Human
gugcugagaucauaggug

SEQ ID NO: 1156962 - RNA, 21 nt, Human
gugcugagaucauagguguga

SEQ ID NO: 1156963 - RNA, 20 nt, Human
gugcugccugcgcagguugg

SEQ ID NO: 1156964 - RNA, 22 nt, Human
uaagacggagucuuacucuguu

SEQ ID NO: 1156965 - RNA, 21 nt, Human
uaagccuggggaccccaccuc

SEQ ID NO: 1156966 - RNA, 18 nt, Human
uaaggugaucugccugcc

SEQ ID NO: 1156967 - RNA, 24 nt, Human
uaauuuuuguauuuuuaguagaga

SEQ ID NO: 1156968 - RNA, 23 nt, Human
uacaggugccuaccaccacaccc

SEQ ID NO: 1156969 - RNA, 18 nt, Human
uacuggacauuucaagcc

SEQ ID NO: 1156970 - RNA, 18 nt, Human
uagcauuguaacacagac

SEQ ID NO: 1156971 - RNA, 22 nt, Human
uagcuacgacaaagaggggcag

SEQ ID NO: 1156972 - RNA, 20 nt, Human
uagcugggaaugcaggugug

SEQ ID NO: 1156973 - RNA, 19 nt, Human
uaguagagaugggguuuca

SEQ ID NO: 1156974 - RNA, 23 nt, Human
uaguagagaugggguuucaccac

SEQ ID NO: 1156975 - RNA, 26 nt, Human
uaguagagaugggguuucaccacauu

SEQ ID NO: 1156976 - RNA, 19 nt, Human
uauguguuucucaguugga

SEQ ID NO: 1156977 - RNA, 23 nt, Human
uauuuuauuuuaagacggagucu

SEQ ID NO: 1156978 - RNA, 23 nt, Human
ucacugcaaccuccaccuccugg

SEQ ID NO: 1156979 - RNA, 24 nt, Human
ucacugcaaccuccaccuccuggg

SEQ ID NO: 1156980 - RNA, 25 nt, Human
ucacugcaaccuccaccuccugggc

SEQ ID NO: 1156981 - RNA, 27 nt, Human
ucacugcaaccuccaccuccugggcuc

SEQ ID NO: 1156982 - RNA, 20 nt, Human
ucagccucccaaguagcugg

SEQ ID NO: 1156983 - RNA, 20 nt, Human
ucagccucccgaguagcugg

SEQ ID NO: 1156984 - RNA, 18 nt, Human
ucaucccccccuggccaa

SEQ ID NO: 1156985 - RNA, 21 nt, Human
uccaagacaggguguuuugac

SEQ ID NO: 1156986 - RNA, 19 nt, Human
uccauuugagcacagcugg

SEQ ID NO: 1156987 - RNA, 23 nt, Human
ucccaaggugcugagaucauagg

SEQ ID NO: 1156988 - RNA, 23 nt, Human
ucccaaguagcugggaaugcagg

SEQ ID NO: 1156989 - RNA, 21 nt, Human
ucccagguucaagggauucuc

SEQ ID NO: 1156990 - RNA, 24 nt, Human
ucccagguucaagggauucuccug

SEQ ID NO: 1156991 - RNA, 23 nt, Human
ucccgaguagcugggauuacagg

SEQ ID NO: 1156992 - RNA, 24 nt, Human
ucccgaguagcugggauuacaggu

SEQ ID NO: 1156993 - RNA, 21 nt, Human
uccugggcucaagugauucuc

SEQ ID NO: 1156994 - RNA, 22 nt, Human
uccugggcucaagugauucucc

SEQ ID NO: 1156995 - RNA, 22 nt, Human
uccugggcucaagugauucucc

SEQ ID NO: 1156996 - RNA, 24 nt, Human
uccugggcucaagugauucuccug

SEQ ID NO: 1156997 - RNA, 18 nt, Human
ucggccucccaaggugcu

SEQ ID NO: 1156998 - RNA, 22 nt, Human
ucuagacuccauccuccauccc

SEQ ID NO: 1156999 - RNA, 18 nt, Human
ucucaggguccaggauuc

SEQ ID NO: 1157000 - RNA, 26 nt, Human
ucuccugccucagccucccaaguagc

SEQ ID NO: 1157001 - RNA, 24 nt, Human
ucuccugccucagccucccgagua

SEQ ID NO: 1157002 - RNA, 22 nt, Human
ucucucaucccccccuggccaa

SEQ ID NO: 1157003 - RNA, 18 nt, Human
ucuguugcccaggcugga

SEQ ID NO: 1157004 - RNA, 23 nt, Human
ucuuacucuguugcccaggcugg

SEQ ID NO: 1157005 - RNA, 24 nt, Human
ucuuacucuguugcccaggcugga

SEQ ID NO: 1157006 - RNA, 24 nt, Human
ugaccuaaggugaucugccugccu

SEQ ID NO: 1157007 - RNA, 21 nt, Human
ugagaucauaggugugagcca

SEQ ID NO: 1157008 - RNA, 23 nt, Human
ugaucuccgcucacugcaaccuc

SEQ ID NO: 1157009 - RNA, 18 nt, Human
ugcagaguggauuugggu

SEQ ID NO: 1157010 - RNA, 19 nt, Human
ugcccaggcuggagugcac

SEQ ID NO: 1157011 - RNA, 21 nt, Human
ugcccaggcuggagugcacug

SEQ ID NO: 1157012 - RNA, 21 nt, Human
ugcccugggcuuuaauuauuu

SEQ ID NO: 1157013 - RNA, 24 nt, Human
ugccucagccucccaaguagcugg

SEQ ID NO: 1157014 - RNA, 24 nt, Human
ugccucagccucccgaguagcugg

SEQ ID NO: 1157015 - RNA, 21 nt, Human
ugccucggccucccaaggugc

SEQ ID NO: 1157016 - RNA, 24 nt, Human
ugccucggccucccaaggugcuga

SEQ ID NO: 1157017 - RNA, 22 nt, Human
ugccuggguugagaguggagac

SEQ ID NO: 1157018 - RNA, 23 nt, Human
ugccuggguugagaguggagaca

SEQ ID NO: 1157019 - RNA, 22 nt, Human
uggagugcacuggcaugaucuc

SEQ ID NO: 1157020 - RNA, 23 nt, Human
uggauuuggguggcaucuuggcu

SEQ ID NO: 1157021 - RNA, 24 nt, Human
uggccaggcuggucucaaacuccu

SEQ ID NO: 1157022 - RNA, 24 nt, Human
ugggaaugcaggugugugccacca

SEQ ID NO: 1157023 - RNA, 19 nt, Human
ugggauuacaggugccuac

SEQ ID NO: 1157024 - RNA, 21 nt, Human
ugggauuacaggugccuacca

SEQ ID NO: 1157025 - RNA, 24 nt, Human
ugggauuacaggugccuaccacca

SEQ ID NO: 1157026 - RNA, 18 nt, Human
ugggcucaagugauucuc

SEQ ID NO: 1157027 - RNA, 24 nt, Human
ugggcucaagugauucuccugccu

SEQ ID NO: 1157028 - RNA, 19 nt, Human
uggggaccugcagagccgg

SEQ ID NO: 1157029 - RNA, 21 nt, Human
uggggaccugcagagccggcu

SEQ ID NO: 1157030 - RNA, 24 nt, Human
ugggguuucaccacauuggccagg

SEQ ID NO: 1157031 - RNA, 24 nt, Human
uuacucuguugcccaggcuggagu

SEQ ID NO: 1157032 - RNA, 18 nt, Human
uuaguagagaugggguuu

SEQ ID NO: 1157033 - RNA, 22 nt, Human
uuaguagagaugggguuucacc

SEQ ID NO: 1157034 - RNA, 25 nt, Human
uuaguagagaugggguuucaccaca

SEQ ID NO: 1157035 - RNA, 23 nt, Human
uucaagggauucuccugccucag

SEQ ID NO: 1157036 - RNA, 19 nt, Human
uugauauguguuucucagu

SEQ ID NO: 1157037 - RNA, 18 nt, Human
uugcccaggcuggagugc

SEQ ID NO: 1157038 - RNA, 24 nt, Human
uugcccaggcuggagugcacuggc

SEQ ID NO: 1157039 - RNA, 23 nt, Human
uuguauuuuuaguagagaugggg

SEQ ID NO: 1157040 - RNA, 22 nt, Human
uuugcucuaagccuggggaccc

SEQ ID NO: 1157041 - RNA, 24 nt, Human
uuuuuaguagagaugggguuucac

SEQ ID NO: 1157042 - RNA, 20 nt, Human
uuuuuguauuuuuaguagag

SEQ ID NO: 1157043 - RNA, 26 nt, Human
aacuuguuuucucuuuuuuucaccuc

SEQ ID NO: 1157044 - RNA, 22 nt, Human
acacagaaaggcacacaauaaa

SEQ ID NO: 1157045 - RNA, 23 nt, Human
acgugugugacaggcaccagggu

SEQ ID NO: 1157046 - RNA, 22 nt, Human
agaccuugacucuucagaggcc

SEQ ID NO: 1157047 - RNA, 21 nt, Human
aggauaucaaacaauugauuu

SEQ ID NO: 1157048 - RNA, 23 nt, Human
aggauaucaaacaauugauuuuu

SEQ ID NO: 1157049 - RNA, 18 nt, Human
aggcaccagggugggggg

SEQ ID NO: 1157050 - RNA, 23 nt, Human
agggagggcucugcucagacagc

SEQ ID NO: 1157051 - RNA, 21 nt, Human
auaguguugaggacugcucug

SEQ ID NO: 1157052 - RNA, 21 nt, Human
aucccuuaaggauuccauuca

SEQ ID NO: 1157053 - RNA, 20 nt, Human
auggugcuuuuuacaaaaag

SEQ ID NO: 1157054 - RNA, 24 nt, Human
auuccauucaugaagauguuggca

SEQ ID NO: 1157055 - RNA, 24 nt, Human
caacagucacccucaggaggcgau

SEQ ID NO: 1157056 - RNA, 22 nt, Human
caagugcccauagaacagccuc

SEQ ID NO: 1157057 - RNA, 22 nt, Human
cacaccagcaagccacagccag

SEQ ID NO: 1157058 - RNA, 24 nt, Human
cacagcuuagcuucuaaaagcauu

SEQ ID NO: 1157059 - RNA, 20 nt, Human
caccaggguggggggccucu

SEQ ID NO: 1157060 - RNA, 21 nt, Human
cagaggcccugcggugacguu

SEQ ID NO: 1157061 - RNA, 21 nt, Human
cagccauaccacucgucccuc

SEQ ID NO: 1157062 - RNA, 23 nt, Human
cagcgccugggccuuguaguccu

SEQ ID NO: 1157063 - RNA, 18 nt, Human
ccaaggauuaccgugugu

SEQ ID NO: 1157064 - RNA, 22 nt, Human
ccagcagaauaagcaacaguca

SEQ ID NO: 1157065 - RNA, 23 nt, Human
ccaucugccaagaccaggaauuc

SEQ ID NO: 1157066 - RNA, 18 nt, Human
cccaagugcccauagaac

SEQ ID NO: 1157067 - RNA, 22 nt, Human
cccaagugcccauagaacagcc

SEQ ID NO: 1157068 - RNA, 22 nt, Human
cccccagccucucucguaucuc

SEQ ID NO: 1157069 - RNA, 24 nt, Human
cguaaaauaauaaagugcuuucga

SEQ ID NO: 1157070 - RNA, 27 nt, Human
cguaaaauaauaaagugcuuucgauga

SEQ ID NO: 1157071 - RNA, 19 nt, Human
cucugggggaggagggacc

SEQ ID NO: 1157072 - RNA, 22 nt, Human
cuggaaaaaaaaauuccccuga

SEQ ID NO: 1157073 - RNA, 21 nt, Human
gaaaaaaaaauuccccugaaa

SEQ ID NO: 1157074 - RNA, 19 nt, Human
gagggcucugcucagacag

SEQ ID NO: 1157075 - RNA, 22 nt, Human
gcuugcacaccagcaagccacc

SEQ ID NO: 1157076 - RNA, 19 nt, Human
ggacagggcagcaacagaa

SEQ ID NO: 1157077 - RNA, 19 nt, Human
ggcaggggagugguggggc

SEQ ID NO: 1157078 - RNA, 20 nt, Human
ggcggguggggguaggggug

SEQ ID NO: 1157079 - RNA, 18 nt, Human
gggcagcaacagaauggg

SEQ ID NO: 1157080 - RNA, 21 nt, Human
ggguggcggguggggguaggg

SEQ ID NO: 1157081 - RNA, 21 nt, Human
guaacaaggaaucccaccccu

SEQ ID NO: 1157082 - RNA, 18 nt, Human
uaaaaagccuucaguaau

SEQ ID NO: 1157083 - RNA, 22 nt, Human
uaaaagaaggauagauucccau

SEQ ID NO: 1157084 - RNA, 21 nt, Human
uaaacacagaaaggcacacaa

SEQ ID NO: 1157085 - RNA, 18 nt, Human
uaaauuuuaacucacugc

SEQ ID NO: 1157086 - RNA, 18 nt, Human
uaacaaggaaucccaccc

SEQ ID NO: 1157087 - RNA, 20 nt, Human
uaacaaggaaucccaccccu

SEQ ID NO: 1157088 - RNA, 21 nt, Human
uaacaaggaaucccaccccuc

SEQ ID NO: 1157089 - RNA, 21 nt, Human
uaacaaggaaucccaccccuc

SEQ ID NO: 1157090 - RNA, 26 nt, Human
uacuaaauuuuaacucacugcggggu

SEQ ID NO: 1157091 - RNA, 18 nt, Human
uagaaaacacaaaauugg

SEQ ID NO: 1157092 - RNA, 21 nt, Human
uagcaaaaaaggucaggccuc

SEQ ID NO: 1157093 - RNA, 22 nt, Human
uaguguugaggacugcucuggg

SEQ ID NO: 1157094 - RNA, 23 nt, Human
uaugguggaaugcagccagcgcc

SEQ ID NO: 1157095 - RNA, 18 nt, Human
uauguacacccuuguuag

SEQ ID NO: 1157096 - RNA, 18 nt, Human
uauugcaguaagaguaac

SEQ ID NO: 1157097 - RNA, 21 nt, Human
ucaggccacgacuucugugcu

SEQ ID NO: 1157098 - RNA, 18 nt, Human
ucauugcugaauccaggu

SEQ ID NO: 1157099 - RNA, 19 nt, Human
ucauugcugaauccaggug

SEQ ID NO: 1157100 - RNA, 20 nt, Human
ucauugcugaauccaggugu

SEQ ID NO: 1157101 - RNA, 21 nt, Human
uccccugaaaauauuuaaugc

SEQ ID NO: 1157102 - RNA, 22 nt, Human
ucucaaaaaauaaaaagccuuc

SEQ ID NO: 1157103 - RNA, 23 nt, Human
ugagguaaacacagaaaggcaca

SEQ ID NO: 1157104 - RNA, 19 nt, Human
ugcacaccagcaagccaca

SEQ ID NO: 1157105 - RNA, 18 nt, Human
uggaaaacacagaaaagg

SEQ ID NO: 1157106 - RNA, 18 nt, Human
uggaaugcagccagcgcc

SEQ ID NO: 1157107 - RNA, 21 nt, Human
uggcaagggcaggggaguggu

SEQ ID NO: 1157108 - RNA, 18 nt, Human
uggcggguggggguaggg

SEQ ID NO: 1157109 - RNA, 19 nt, Human
uggcggguggggguagggg

SEQ ID NO: 1157110 - RNA, 24 nt, Human
uggcugcauuuccagcacugacau

SEQ ID NO: 1157111 - RNA, 21 nt, Human
uggggcgguuauagcaaaaaa

SEQ ID NO: 1157112 - RNA, 24 nt, Human
uggguggcggguggggguaggggu

SEQ ID NO: 1157113 - RNA, 22 nt, Human
ugucuaaaagaaggauagauuc

SEQ ID NO: 1157114 - RNA, 23 nt, Human
ugucuaaaagaaggauagauucc

SEQ ID NO: 1157115 - RNA, 19 nt, Human
ugugcucccucgcuguucc

SEQ ID NO: 1157116 - RNA, 25 nt, Human
uguuagaaaacugguggcacauuag

SEQ ID NO: 1157117 - RNA, 18 nt, Human
uuaaagcagaccuugacu

SEQ ID NO: 1157118 - RNA, 19 nt, Human
uucccagagccaucugcca

SEQ ID NO: 1157119 - RNA, 24 nt, Human
uuccccugaaaauauuuaaugcaa

SEQ ID NO: 1157120 - RNA, 24 nt, Human
uucucuuuuuuucaccucucaaaa

SEQ ID NO: 1157121 - RNA, 18 nt, Human
uuggcaagggcaggggag

SEQ ID NO: 1157122 - RNA, 19 nt, Human
aaaaagauucuugaccccu

SEQ ID NO: 1157123 - RNA, 25 nt, Human
aaacaagagugguaggaggcaggga

SEQ ID NO: 1157124 - RNA, 20 nt, Human
aaagucaccccacgcuuucc

SEQ ID NO: 1157125 - RNA, 22 nt, Human
aacagaaaggaaaguccagaac

SEQ ID NO: 1157126 - RNA, 18 nt, Human
aacagugggcaaacaaga

SEQ ID NO: 1157127 - RNA, 20 nt, Human
aacccccuguuucuccaaau

SEQ ID NO: 1157128 - RNA, 18 nt, Human
aagcagccauuucaacuu

SEQ ID NO: 1157129 - RNA, 19 nt, Human
aagcuguagaggaccaggc

SEQ ID NO: 1157130 - RNA, 23 nt, Human
aagggagucccuguguuccccca

SEQ ID NO: 1157131 - RNA, 19 nt, Human
aauggcacguggauuagau

SEQ ID NO: 1157132 - RNA, 22 nt, Human
aauggugcuggauaaauuggac

SEQ ID NO: 1157133 - RNA, 19 nt, Human
acaguacagugagagaggg

SEQ ID NO: 1157134 - RNA, 20 nt, Human
acaugggaauaaaaagauuc

SEQ ID NO: 1157135 - RNA, 26 nt, Human
acccaaggaacagaaaggaaaguccc

SEQ ID NO: 1157136 - RNA, 25 nt, Human
acucuaccacacauugagugaauga

SEQ ID NO: 1157137 - RNA, 23 nt, Human
acugcucuaccacccacccaggu

SEQ ID NO: 1157138 - RNA, 21 nt, Human
acuucucucagucuccucauu

SEQ ID NO: 1157139 - RNA, 22 nt, Human
acuucucucagucuccucauug

SEQ ID NO: 1157140 - RNA, 21 nt, Human
agagugaggcaagagccagug

SEQ ID NO: 1157141 - RNA, 19 nt, Human
agcagccaccagggaagau

SEQ ID NO: 1157142 - RNA, 19 nt, Human
agcaggaaggcacagguuu

SEQ ID NO: 1157143 - RNA, 19 nt, Human
aggaaaacauguuuuguug

SEQ ID NO: 1157144 - RNA, 24 nt, Human
aggaaaguccagaacuagcccaac

SEQ ID NO: 1157145 - RNA, 18 nt, Human
aggaaauaaucagcccga

SEQ ID NO: 1157146 - RNA, 24 nt, Human
aggaagccacggugaauuucagug

SEQ ID NO: 1157147 - RNA, 23 nt, Human
agggacacccagaaggaacaggg

SEQ ID NO: 1157148 - RNA, 23 nt, Human
agggacuucgugggggcucaggg

SEQ ID NO: 1157149 - RNA, 20 nt, Human
agguccaccugcugaaagac

SEQ ID NO: 1157150 - RNA, 22 nt, Human
agugguaggaggcagggaccug

SEQ ID NO: 1157151 - RNA, 24 nt, Human
auaaaaaaauagacccaaggaaca

SEQ ID NO: 1157152 - RNA, 19 nt, Human
auaaaauaaacuccagccc

SEQ ID NO: 1157153 - RNA, 20 nt, Human
auacaauaguaauuaagaca

SEQ ID NO: 1157154 - RNA, 23 nt, Human
auaguaauuaagacagggugguc

SEQ ID NO: 1157155 - RNA, 22 nt, Human
aucuuugguugugaugguuguc

SEQ ID NO: 1157156 - RNA, 18 nt, Human
caaacacaagguccaccu

SEQ ID NO: 1157157 - RNA, 26 nt, Human
caaaggccaggauuggggucagcaug

SEQ ID NO: 1157158 - RNA, 19 nt, Human
caacuccucgggaaugaac

SEQ ID NO: 1157159 - RNA, 22 nt, Human
caaggaacagaaaggaaagucc

SEQ ID NO: 1157160 - RNA, 19 nt, Human
caagucagugagaaauggc

SEQ ID NO: 1157161 - RNA, 19 nt, Human
cacccacccaggugugccu

SEQ ID NO: 1157162 - RNA, 23 nt, Human
cacccagaaggaacagggacuuc

SEQ ID NO: 1157163 - RNA, 28 nt, Human
cacugggccccacauugaggagggcccc

SEQ ID NO: 1157164 - RNA, 23 nt, Human
cacuggguuucccccagugcuug

SEQ ID NO: 1157165 - RNA, 19 nt, Human
cagcagggcacggacaggc

SEQ ID NO: 1157166 - RNA, 21 nt, Human
cagcagggcacggacaggccc

SEQ ID NO: 1157167 - RNA, 18 nt, Human
cagcauggaacagugggc

SEQ ID NO: 1157168 - RNA, 26 nt, Human
cagcccaugguaaacuaucccuucuu

SEQ ID NO: 1157169 - RNA, 22 nt, Human
cagcuuggugggaggguaagca

SEQ ID NO: 1157170 - RNA, 21 nt, Human
cagggaagauccagcccugcc

SEQ ID NO: 1157171 - RNA, 20 nt, Human
cagggaaucucaccucacug

SEQ ID NO: 1157172 - RNA, 21 nt, Human
caguaaaaaaaaucuaacauu

SEQ ID NO: 1157173 - RNA, 20 nt, Human
cagucugugccaggcugugg

SEQ ID NO: 1157174 - RNA, 21 nt, Human
cagugaccucuagaaauucuu

SEQ ID NO: 1157175 - RNA, 21 nt, Human
ccagcccaugguaaacuaucc

SEQ ID NO: 1157176 - RNA, 19 nt, Human
ccagcccggaagauccuuc

SEQ ID NO: 1157177 - RNA, 22 nt, Human
ccaggcugugagcaggagcugg

SEQ ID NO: 1157178 - RNA, 24 nt, Human
cccaaggaacagaaaggaaagucc

SEQ ID NO: 1157179 - RNA, 18 nt, Human
cccacuggguuuccccca

SEQ ID NO: 1157180 - RNA, 24 nt, Human
cccaggcuuuuaacagggccucca

SEQ ID NO: 1157181 - RNA, 19 nt, Human
ccccagcagccacagggca

SEQ ID NO: 1157182 - RNA, 23 nt, Human
ccccugcuggaaggcagcuugga

SEQ ID NO: 1157183 - RNA, 23 nt, Human
cccugugcuuggcucagaccccc

SEQ ID NO: 1157184 - RNA, 23 nt, Human
ccgacaguuaccugugugccagg

SEQ ID NO: 1157185 - RNA, 24 nt, Human
ccgcaaggggaccccuucacaccc

SEQ ID NO: 1157186 - RNA, 21 nt, Human
ccggcacccagagcagccaag

SEQ ID NO: 1157187 - RNA, 20 nt, Human
ccgugcuggagguggagcag

SEQ ID NO: 1157188 - RNA, 19 nt, Human
ccuaagcuguagaggacca

SEQ ID NO: 1157189 - RNA, 24 nt, Human
ccucacugggccugggggcaggca

SEQ ID NO: 1157190 - RNA, 23 nt, Human
ccuccuagaccccgaggcuugga

SEQ ID NO: 1157191 - RNA, 18 nt, Human
ccucgaggccaugggccc

SEQ ID NO: 1157192 - RNA, 23 nt, Human
ccucuaagcagccauuucaacuu

SEQ ID NO: 1157193 - RNA, 18 nt, Human
ccugaacccucaccuacg

SEQ ID NO: 1157194 - RNA, 23 nt, Human
ccugggggcaggcauucugucgg

SEQ ID NO: 1157195 - RNA, 22 nt, Human
ccugugcuuggcucagaccccc

SEQ ID NO: 1157196 - RNA, 24 nt, Human
ccugugcuuggcucagacccccac

SEQ ID NO: 1157197 - RNA, 20 nt, Human
ccuucccgagcugccccggc

SEQ ID NO: 1157198 - RNA, 20 nt, Human
cucaccucacugggccuggg

SEQ ID NO: 1157199 - RNA, 24 nt, Human
cuccucagaaagucaaaucaccuu

SEQ ID NO: 1157200 - RNA, 21 nt, Human
cuccucgggaaugaaccuuuu

SEQ ID NO: 1157201 - RNA, 27 nt, Human
cucguauacaugacauacauacgugca

SEQ ID NO: 1157202 - RNA, 19 nt, Human
cucugugcaugaggccccc

SEQ ID NO: 1157203 - RNA, 18 nt, Human
cugcgccuggacagcgag

SEQ ID NO: 1157204 - RNA, 20 nt, Human
cuugaggaggcccugaaccc

SEQ ID NO: 1157205 - RNA, 19 nt, Human
cuugucagggccuucccga

SEQ ID NO: 1157206 - RNA, 27 nt, Human
gaaaaagguaacauuaugagcaaacgu

SEQ ID NO: 1157207 - RNA, 22 nt, Human
gaaugaaccuuuacuucucuca

SEQ ID NO: 1157208 - RNA, 21 nt, Human
gaccuggggucagaccuuucc

SEQ ID NO: 1157209 - RNA, 20 nt, Human
gaggcugcuccugcagggac

SEQ ID NO: 1157210 - RNA, 20 nt, Human
gagguggagcagccaccagg

SEQ ID NO: 1157211 - RNA, 26 nt, Human
gcaaacaagagugguaggaggcaggg

SEQ ID NO: 1157212 - RNA, 27 nt, Human
gcaaacaagagugguaggaggcaggga

SEQ ID NO: 1157213 - RNA, 24 nt, Human
gcaaggagaagccagggguaugga

SEQ ID NO: 1157214 - RNA, 20 nt, Human
gcaauggaccggcacccaga

SEQ ID NO: 1157215 - RNA, 18 nt, Human
gcacagacugacgaggaa

SEQ ID NO: 1157216 - RNA, 18 nt, Human
gcacguggauuagaucuc

SEQ ID NO: 1157217 - RNA, 21 nt, Human
gccccccugcuggaaggcagc

SEQ ID NO: 1157218 - RNA, 18 nt, Human
gcccugugcuuggcucag

SEQ ID NO: 1157219 - RNA, 21 nt, Human
ggaaaguccagaacuagccca

SEQ ID NO: 1157220 - RNA, 23 nt, Human
ggaaugaaccuuuacuucucuca

SEQ ID NO: 1157221 - RNA, 18 nt, Human
ggacagagccccagcagc

SEQ ID NO: 1157222 - RNA, 21 nt, Human
ggagacacaacaguacaguga

SEQ ID NO: 1157223 - RNA, 18 nt, Human
ggccugggggcaggcauu

SEQ ID NO: 1157224 - RNA, 22 nt, Human
gggagcaccaguggcccaacca

SEQ ID NO: 1157225 - RNA, 23 nt, Human
ggguaagcaggaaggcacagguu

SEQ ID NO: 1157226 - RNA, 19 nt, Human
gguuguccuuuuaguaaaa

SEQ ID NO: 1157227 - RNA, 22 nt, Human
gucccuguguucccccaacccc

SEQ ID NO: 1157228 - RNA, 20 nt, Human
guggaccuuggcagugaccu

SEQ ID NO: 1157229 - RNA, 23 nt, Human
gugguaggaggcagggaccuggg

SEQ ID NO: 1157230 - RNA, 19 nt, Human
gugugucuaagcaagucuc

SEQ ID NO: 1157231 - RNA, 22 nt, Human
uaaaaaaauagacccaaggaac

SEQ ID NO: 1157232 - RNA, 24 nt, Human
uaaaaaaauagacccaaggaacag

SEQ ID NO: 1157233 - RNA, 24 nt, Human
uaaaacauuggcaacaaccuaaau

SEQ ID NO: 1157234 - RNA, 22 nt, Human
uaacaaugcucaguaaaaaaaa

SEQ ID NO: 1157235 - RNA, 22 nt, Human
uaacggccggguucuccucuga

SEQ ID NO: 1157236 - RNA, 20 nt, Human
uacaccuaauucuguuucca

SEQ ID NO: 1157237 - RNA, 26 nt, Human
uacaugacauacauacgugcagggug

SEQ ID NO: 1157238 - RNA, 21 nt, Human
uaccacccacccaggugugcc

SEQ ID NO: 1157239 - RNA, 20 nt, Human
uaggaaguuggagucaauug

SEQ ID NO: 1157240 - RNA, 25 nt, Human
uaggggagacacaacaguacaguga

SEQ ID NO: 1157241 - RNA, 18 nt, Human
uaggugccagcaaagccu

SEQ ID NO: 1157242 - RNA, 26 nt, Human
uaucuuauuucaucuuccuagugggc

SEQ ID NO: 1157243 - RNA, 19 nt, Human
ucaauuauuggaaaacaca

SEQ ID NO: 1157244 - RNA, 18 nt, Human
ucaguguguggcuccugc

SEQ ID NO: 1157245 - RNA, 21 nt, Human
ucauacaugcucguauacaug

SEQ ID NO: 1157246 - RNA, 22 nt, Human
uccagagccuuaacccccuguu

SEQ ID NO: 1157247 - RNA, 20 nt, Human
ucccagacugggccugauuc

SEQ ID NO: 1157248 - RNA, 20 nt, Human
uccccacaccugcuccccuc

SEQ ID NO: 1157249 - RNA, 23 nt, Human
ucccuagcugggcacagcagggc

SEQ ID NO: 1157250 - RNA, 18 nt, Human
uccuagugggcaugugcc

SEQ ID NO: 1157251 - RNA, 22 nt, Human
uccucgaggccaugggccccca

SEQ ID NO: 1157252 - RNA, 20 nt, Human
uccugagccucaguuuaccc

SEQ ID NO: 1157253 - RNA, 21 nt, Human
ucucaccucacugggccuggg

SEQ ID NO: 1157254 - RNA, 18 nt, Human
ucucauucaagcugcagg

SEQ ID NO: 1157255 - RNA, 19 nt, Human
ucuccaaacacaaggucca

SEQ ID NO: 1157256 - RNA, 19 nt, Human
ucuccgugcuggaggugga

SEQ ID NO: 1157257 - RNA, 21 nt, Human
ucugcaaagccagcccacaag

SEQ ID NO: 1157258 - RNA, 18 nt, Human
ucuggaaacuuccugagc

SEQ ID NO: 1157259 - RNA, 21 nt, Human
ucuggaaacuuccugagccuc

SEQ ID NO: 1157260 - RNA, 24 nt, Human
ucugugccaggcugugagcaggag

SEQ ID NO: 1157261 - RNA, 24 nt, Human
ugaaagacaugaaauccuaauuca

SEQ ID NO: 1157262 - RNA, 22 nt, Human
ugaaauuauaaagccacuucaa

SEQ ID NO: 1157263 - RNA, 28 nt, Human
ugaaccuuuacuucucucagucuccuca

SEQ ID NO: 1157264 - RNA, 21 nt, Human
ugaccccacuggguuuccccc

SEQ ID NO: 1157265 - RNA, 18 nt, Human
ugaccccuuccucacacc

SEQ ID NO: 1157266 - RNA, 21 nt, Human
ugaccucuaagcagccauuuc

SEQ ID NO: 1157267 - RNA, 18 nt, Human
ugacucaguauuacacaa

SEQ ID NO: 1157268 - RNA, 18 nt, Human
ugaggagggcccugugcu

SEQ ID NO: 1157269 - RNA, 22 nt, Human
ugaggcaagagccaguguugcu

SEQ ID NO: 1157270 - RNA, 21 nt, Human
ugaguuaaaaccaggugugug

SEQ ID NO: 1157271 - RNA, 21 nt, Human
ugcaaagccagcccacaaggg

SEQ ID NO: 1157272 - RNA, 21 nt, Human
ugcacagacugacgaggaagc

SEQ ID NO: 1157273 - RNA, 24 nt, Human
ugcacugggccccaccaauuaugu

SEQ ID NO: 1157274 - RNA, 22 nt, Human
ugcagggaaucucaccucacug

SEQ ID NO: 1157275 - RNA, 21 nt, Human
ugccaggcugugagcaggagc

SEQ ID NO: 1157276 - RNA, 22 nt, Human
ugccgggcuauguucuccgugc

SEQ ID NO: 1157277 - RNA, 21 nt, Human
ugccuagccgcaaggggaccc

SEQ ID NO: 1157278 - RNA, 23 nt, Human
ugcuggaaggcagcuuggaggcu

SEQ ID NO: 1157279 - RNA, 25 nt, Human
ugcuggggguggaaggugcuuuccc

SEQ ID NO: 1157280 - RNA, 21 nt, Human
uggacagcgagggcuggcugc

SEQ ID NO: 1157281 - RNA, 18 nt, Human
uggaccggcacccagagc

SEQ ID NO: 1157282 - RNA, 19 nt, Human
uggcagugaccuugucaac

SEQ ID NO: 1157283 - RNA, 18 nt, Human
ugggaucaggaaaacaaa

SEQ ID NO: 1157284 - RNA, 19 nt, Human
ugggaugcccugcuuuaac

SEQ ID NO: 1157285 - RNA, 18 nt, Human
ugggcccccaccacugug

SEQ ID NO: 1157286 - RNA, 18 nt, Human
uggggucagaccuuuccg

SEQ ID NO: 1157287 - RNA, 22 nt, Human
uggggucagcauggaacagugg

SEQ ID NO: 1157288 - RNA, 20 nt, Human
uggugagugguggggcuggg

SEQ ID NO: 1157289 - RNA, 22 nt, Human
ugguucagacuucaggcccuuu

SEQ ID NO: 1157290 - RNA, 23 nt, Human
uguagaggaccaggcuucggccu

SEQ ID NO: 1157291 - RNA, 21 nt, Human
ugucagggccuucccgagcug

SEQ ID NO: 1157292 - RNA, 22 nt, Human
uuaacccaaagguguggaccuu

SEQ ID NO: 1157293 - RNA, 23 nt, Human
uucacaugggaauaaaaagauuc

SEQ ID NO: 1157294 - RNA, 22 nt, Human
uucaugauccugaguccaccuc

SEQ ID NO: 1157295 - RNA, 20 nt, Human
uuccgcugcuugccagcugu

SEQ ID NO: 1157296 - RNA, 22 nt, Human
uucuccaaaugaagaaucucau

SEQ ID NO: 1157297 - RNA, 20 nt, Human
uuggcauucggaaggaggau

SEQ ID NO: 1157298 - RNA, 22 nt, Human
uuugcacugggccccaccaauu

SEQ ID NO: 1157299 - RNA, 18 nt, Human
aaaagaagguggaacaga

SEQ ID NO: 1157300 - RNA, 25 nt, Human
aaacaagcagaugaaaaccuuagag

SEQ ID NO: 1157301 - RNA, 20 nt, Human
aaagcacgcugacuuggguu

SEQ ID NO: 1157302 - RNA, 19 nt, Human
aacgagaaaacauaaagga

SEQ ID NO: 1157303 - RNA, 18 nt, Human
aagaagaaaauagagagg

SEQ ID NO: 1157304 - RNA, 19 nt, Human
aagaagaaaauagagaugg

SEQ ID NO: 1157305 - RNA, 19 nt, Human
aagaagaaaauagagaugg

SEQ ID NO: 1157306 - RNA, 20 nt, Human
aaugauaaggaagaccagga

SEQ ID NO: 1157307 - RNA, 25 nt, Human
acaaaaaaagaugaaaaaaucaaaa

SEQ ID NO: 1157308 - RNA, 25 nt, Human
acagacaacagaucagagaacaaaa

SEQ ID NO: 1157309 - RNA, 21 nt, Human
acccaccacaagcccccacag

SEQ ID NO: 1157310 - RNA, 23 nt, Human
acccaccccauccucuaccugcc

SEQ ID NO: 1157311 - RNA, 22 nt, Human
accggagccagaggcugugcca

SEQ ID NO: 1157312 - RNA, 19 nt, Human
accuacacuccugugugca

SEQ ID NO: 1157313 - RNA, 20 nt, Human
acuccugcccccgacaaccc

SEQ ID NO: 1157314 - RNA, 22 nt, Human
acuccugcccccgacaacccac

SEQ ID NO: 1157315 - RNA, 18 nt, Human
agaagaaaauagagaugg

SEQ ID NO: 1157316 - RNA, 23 nt, Human
agacuuggggcugcacaguggag

SEQ ID NO: 1157317 - RNA, 19 nt, Human
agagaacaaaacgagaaaa

SEQ ID NO: 1157318 - RNA, 19 nt, Human
agaggguugggggugggca

SEQ ID NO: 1157319 - RNA, 22 nt, Human
agaucagccgauggaccauagg

SEQ ID NO: 1157320 - RNA, 19 nt, Human
agccuaaucauucugucag

SEQ ID NO: 1157321 - RNA, 23 nt, Human
aggaaaugauaaggaagaccagg

SEQ ID NO: 1157322 - RNA, 24 nt, Human
aggagaggguugggggugggcagg

SEQ ID NO: 1157323 - RNA, 21 nt, Human
aggguucuuuuccauuccuuu

SEQ ID NO: 1157324 - RNA, 21 nt, Human
auaccuaccuggauuuacaug

SEQ ID NO: 1157325 - RNA, 23 nt, Human
aucccaccucccugucgccccca

SEQ ID NO: 1157326 - RNA, 22 nt, Human
caagcaaucuuagacaaacauc

SEQ ID NO: 1157327 - RNA, 19 nt, Human
caagcaguggaaaacugca

SEQ ID NO: 1157328 - RNA, 22 nt, Human
cacccaccccauccucuaccuu

SEQ ID NO: 1157329 - RNA, 25 nt, Human
caccggagccagaggcugugccaac

SEQ ID NO: 1157330 - RNA, 18 nt, Human
cagaucagagaacaaaac

SEQ ID NO: 1157331 - RNA, 22 nt, Human
cagcaaggaggaaaguuaugga

SEQ ID NO: 1157332 - RNA, 22 nt, Human
cagcacagagugacccagggag

SEQ ID NO: 1157333 - RNA, 23 nt, Human
cagcacagagugacccagggcag

SEQ ID NO: 1157334 - RNA, 21 nt, Human
cagccgauggaccauagguca

SEQ ID NO: 1157335 - RNA, 20 nt, Human
caggugucuuuauuccaagg

SEQ ID NO: 1157336 - RNA, 24 nt, Human
cauaaaggaaaagcgaaaggcuag

SEQ ID NO: 1157337 - RNA, 22 nt, Human
cauacgucacccacuccugccc

SEQ ID NO: 1157338 - RNA, 18 nt, Human
cauccugaauucuuacaa

SEQ ID NO: 1157339 - RNA, 20 nt, Human
caugcucggcuuccucacaa

SEQ ID NO: 1157340 - RNA, 25 nt, Human
cauucaggagccugacuuggaucag

SEQ ID NO: 1157341 - RNA, 20 nt, Human
ccacaagcccccacaguuac

SEQ ID NO: 1157342 - RNA, 21 nt, Human
ccacacauccgggagugggac

SEQ ID NO: 1157343 - RNA, 26 nt, Human
ccaccacaagcccccacaggggcccu

SEQ ID NO: 1157344 - RNA, 20 nt, Human
cccaccacaagcccccacag

SEQ ID NO: 1157345 - RNA, 24 nt, Human
cccacuccugcccccgacaaccca

SEQ ID NO: 1157346 - RNA, 21 nt, Human
cccauccucuaccugccacac

SEQ ID NO: 1157347 - RNA, 19 nt, Human
cccugaccagagccacgga

SEQ ID NO: 1157348 - RNA, 24 nt, Human
cccugucgcccccaugcucggcuu

SEQ ID NO: 1157349 - RNA, 26 nt, Human
ccucacauucaggagccugacuugga

SEQ ID NO: 1157350 - RNA, 24 nt, Human
ccucccugucgcccccaugcucgg

SEQ ID NO: 1157351 - RNA, 23 nt, Human
ccugcccccgacaacccaccaca

SEQ ID NO: 1157352 - RNA, 21 nt, Human
cgacaaaaaaagaugaaaaaa

SEQ ID NO: 1157353 - RNA, 25 nt, Human
cuagacagucuuuuuagugcccucu

SEQ ID NO: 1157354 - RNA, 19 nt, Human
cuaguaucaagcaaucuua

SEQ ID NO: 1157355 - RNA, 21 nt, Human
cucagacuuaaacacaauuga

SEQ ID NO: 1157356 - RNA, 21 nt, Human
cucuguucuccaagaggaccc

SEQ ID NO: 1157357 - RNA, 21 nt, Human
cugcccccgacaacccaccac

SEQ ID NO: 1157358 - RNA, 21 nt, Human
cugguuuuuccagcagccagg

SEQ ID NO: 1157359 - RNA, 18 nt, Human
gaaaauagagauggagau

SEQ ID NO: 1157360 - RNA, 20 nt, Human
gaacagaagaagaaaauaga

SEQ ID NO: 1157361 - RNA, 23 nt, Human
gacaaaaaaagaugaaaaaauca

SEQ ID NO: 1157362 - RNA, 19 nt, Human
gagaacaaaacgagaaaac

SEQ ID NO: 1157363 - RNA, 19 nt, Human
ggaaaugauaaggaagacc

SEQ ID NO: 1157364 - RNA, 21 nt, Human
ggaccuggucagagacugaug

SEQ ID NO: 1157365 - RNA, 20 nt, Human
ggcagugcccugaccagagc

SEQ ID NO: 1157366 - RNA, 19 nt, Human
ggggcugcacaguggagca

SEQ ID NO: 1157367 - RNA, 19 nt, Human
ggggugggcagggcuccag

SEQ ID NO: 1157368 - RNA, 27 nt, Human
guagaagugggaguuguuucccacugg

SEQ ID NO: 1157369 - RNA, 21 nt, Human
gugccuuagcggcaaugguua

SEQ ID NO: 1157370 - RNA, 21 nt, Human
uacuuugugggucagaagaga

SEQ ID NO: 1157371 - RNA, 22 nt, Human
uaucaagcaaucuuagacaaac

SEQ ID NO: 1157372 - RNA, 22 nt, Human
uaugaagacauucgggaaaaug

SEQ ID NO: 1157373 - RNA, 19 nt, Human
ucagaagagaacugguuuu

SEQ ID NO: 1157374 - RNA, 22 nt, Human
ucaguaaauguguguugaagga

SEQ ID NO: 1157375 - RNA, 23 nt, Human
ucccaccucccugucgcccccau

SEQ ID NO: 1157376 - RNA, 23 nt, Human
ucccuaggaggcacagacuucgg

SEQ ID NO: 1157377 - RNA, 21 nt, Human
ugaaaaccuuagagaugcugc

SEQ ID NO: 1157378 - RNA, 22 nt, Human
ugacagugccuuucucucccag

SEQ ID NO: 1157379 - RNA, 22 nt, Human
ugacaugauuuccuauuacaaa

SEQ ID NO: 1157380 - RNA, 19 nt, Human
ugaccagagccacggaccu

SEQ ID NO: 1157381 - RNA, 22 nt, Human
ugagaaacaagcagaugaaaac

SEQ ID NO: 1157382 - RNA, 23 nt, Human
ugagaaacaagcagaugaaaacg

SEQ ID NO: 1157383 - RNA, 22 nt, Human
ugagaugugcuuauaacccugu

SEQ ID NO: 1157384 - RNA, 21 nt, Human
ugagaugugcuuauaacccuu

SEQ ID NO: 1157385 - RNA, 22 nt, Human
ugaggauaaaguugccaguccu

SEQ ID NO: 1157386 - RNA, 24 nt, Human
ugaggcccggcaacuugguguugg

SEQ ID NO: 1157387 - RNA, 22 nt, Human
ugccaaacuucgacaaaaaaag

SEQ ID NO: 1157388 - RNA, 29 nt, Human
ugcccccgacaacccaccacaagccccca

SEQ ID NO: 1157389 - RNA, 25 nt, Human
ugcccgagacaaagaguugagaaac

SEQ ID NO: 1157390 - RNA, 19 nt, Human
ugcuggaccuggucagaga

SEQ ID NO: 1157391 - RNA, 25 nt, Human
uggaacagaagaagaaaagggaggc

SEQ ID NO: 1157392 - RNA, 19 nt, Human
uggaccuggucagagacug

SEQ ID NO: 1157393 - RNA, 20 nt, Human
ugggauagggacauaccuac

SEQ ID NO: 1157394 - RNA, 20 nt, Human
uggggcugcacaguggagca

SEQ ID NO: 1157395 - RNA, 20 nt, Human
ugggucagaagagaacuggu

SEQ ID NO: 1157396 - RNA, 20 nt, Human
ugugugcagugggcauucag

SEQ ID NO: 1157397 - RNA, 20 nt, Human
uucgacaaaaaaagaugaaa

SEQ ID NO: 1157398 - RNA, 21 nt, Human
uucgacaaaaaaagaugaaaa

SEQ ID NO: 1157399 - RNA, 20 nt, Human
uuuccuauuacaaacaagug

SEQ ID NO: 1157400 - RNA, 23 nt, Human
uuuuauucuaagugggauaggga

SEQ ID NO: 1157401 - RNA, 22 nt, Human
aaggagaguucauuguugcaaa

SEQ ID NO: 1157402 - RNA, 23 nt, Human
acagggcaagacucuguccagag

SEQ ID NO: 1157403 - RNA, 27 nt, Human
acuacuauacuccagccugggcaacag

SEQ ID NO: 1157404 - RNA, 18 nt, Human
acuauacuccagccuggg

SEQ ID NO: 1157405 - RNA, 21 nt, Human
acuauacuccagccugggcaa

SEQ ID NO: 1157406 - RNA, 22 nt, Human
acuauacuccagccugggcaac

SEQ ID NO: 1157407 - RNA, 24 nt, Human
acuauacuccagccugggcaacag

SEQ ID NO: 1157408 - RNA, 18 nt, Human
acugcuggggcugcugcu

SEQ ID NO: 1157409 - RNA, 20 nt, Human
acuugggaggcagaggaaga

SEQ ID NO: 1157410 - RNA, 22 nt, Human
agaggaagaaggauuguuugag

SEQ ID NO: 1157411 - RNA, 25 nt, Human
agaggaagaaggauuguuugagccc

SEQ ID NO: 1157412 - RNA, 24 nt, Human
agccugggcaacagggcaagacuc

SEQ ID NO: 1157413 - RNA, 24 nt, Human
aggcagaggaagaaggauuguuug

SEQ ID NO: 1157414 - RNA, 24 nt, Human
auacuccagccugggcaacagggc

SEQ ID NO: 1157415 - RNA, 27 nt, Human
cacuacuauacuccagccugggcaaca

SEQ ID NO: 1157416 - RNA, 23 nt, Human
ccacugcacuacuauacuccagc

SEQ ID NO: 1157417 - RNA, 21 nt, Human
ccucagugcuaggaggcacuc

SEQ ID NO: 1157418 - RNA, 22 nt, Human
ccugggcaacagggcaagacuc

SEQ ID NO: 1157419 - RNA, 23 nt, Human
ccuuaugcaagcaccauuuccuc

SEQ ID NO: 1157420 - RNA, 23 nt, Human
cgcugcuacuggggcugcugcug

SEQ ID NO: 1157421 - RNA, 21 nt, Human
cuacuauacuccagccugggc

SEQ ID NO: 1157422 - RNA, 24 nt, Human
cuacuauacuccagccugggcaac

SEQ ID NO: 1157423 - RNA, 22 nt, Human
cuacugcuggggcugcugcugc

SEQ ID NO: 1157424 - RNA, 25 nt, Human
cuacuggaguugcugcugcuggggc

SEQ ID NO: 1157425 - RNA, 24 nt, Human
cuaugaucacaccacugcacuacu

SEQ ID NO: 1157426 - RNA, 21 nt, Human
cucugugccaguuuccucuuc

SEQ ID NO: 1157427 - RNA, 19 nt, Human
cugcuacuggggcugcugc

SEQ ID NO: 1157428 - RNA, 19 nt, Human
cugcuacuggggcugcugc

SEQ ID NO: 1157429 - RNA, 19 nt, Human
cugcuacuggggcugcugc

SEQ ID NO: 1157430 - RNA, 19 nt, Human
cugcuacuggggcugcugc

SEQ ID NO: 1157431 - RNA, 19 nt, Human
cugcuacuggggcugcugc

SEQ ID NO: 1157432 - RNA, 22 nt, Human
cugcuacuggggcugcuggagc

SEQ ID NO: 1157433 - RNA, 22 nt, Human
cugcuacuggggcugcuggagc

SEQ ID NO: 1157434 - RNA, 20 nt, Human
cugcuacuggggcugcuggu

SEQ ID NO: 1157435 - RNA, 25 nt, Human
cugcugcugcuagagcugcuacugg

SEQ ID NO: 1157436 - RNA, 25 nt, Human
cugcugcugcuagagcugcuacugg

SEQ ID NO: 1157437 - RNA, 19 nt, Human
cugcugcugcuggagcugc

SEQ ID NO: 1157438 - RNA, 25 nt, Human
cugcugcugcuggagcugcuacugg

SEQ ID NO: 1157439 - RNA, 27 nt, Human
cugcugcugcugggacugcugcugcug

SEQ ID NO: 1157440 - RNA, 19 nt, Human
cugcugcuggagcugcuac

SEQ ID NO: 1157441 - RNA, 19 nt, Human
cugcugcuggagcugcuac

SEQ ID NO: 1157442 - RNA, 22 nt, Human
cugcugcuggagcugcugcugc

SEQ ID NO: 1157443 - RNA, 19 nt, Human
cugcugcugggacugcugc

SEQ ID NO: 1157444 - RNA, 22 nt, Human
cugcugcuggggcugcugcugc

SEQ ID NO: 1157445 - RNA, 23 nt, Human
cuggguccugcucuguaguccca

SEQ ID NO: 1157446 - RNA, 20 nt, Human
cuguagucccagcuacuugg

SEQ ID NO: 1157447 - RNA, 20 nt, Human
gcuacuggggcugcuggagc

SEQ ID NO: 1157448 - RNA, 20 nt, Human
gcuacuggggcugcuggagc

SEQ ID NO: 1157449 - RNA, 20 nt, Human
gcuacuggggcugcuggugg

SEQ ID NO: 1157450 - RNA, 24 nt, Human
gcucuguagucccagcuacuuggg

SEQ ID NO: 1157451 - RNA, 22 nt, Human
gcugcugcuagagcugcuacug

SEQ ID NO: 1157452 - RNA, 22 nt, Human
gcugcugcuagagcugcuacug

SEQ ID NO: 1157453 - RNA, 19 nt, Human
gcugcugcugcuacuacug

SEQ ID NO: 1157454 - RNA, 18 nt, Human
gcugcugcugcugcugcc

SEQ ID NO: 1157455 - RNA, 20 nt, Human
gcugcugcugcugcugcugg

SEQ ID NO: 1157456 - RNA, 20 nt, Human
gcugcugcugcugcugcugg

SEQ ID NO: 1157457 - RNA, 22 nt, Human
gcugcugcuggagcuacugcug

SEQ ID NO: 1157458 - RNA, 22 nt, Human
gcugcugcuggagcugcuacug

SEQ ID NO: 1157459 - RNA, 22 nt, Human
gcugcugcuggagcugcuacug

SEQ ID NO: 1157460 - RNA, 23 nt, Human
gcugcugcuggagcugcuacugg

SEQ ID NO: 1157461 - RNA, 20 nt, Human
gcugcugcuggggcugcugc

SEQ ID NO: 1157462 - RNA, 20 nt, Human
gcugcugcuggggcugcugc

SEQ ID NO: 1157463 - RNA, 20 nt, Human
gcugcugcuggggcugcugc

SEQ ID NO: 1157464 - RNA, 18 nt, Human
gcugcuggagcugcuacu

SEQ ID NO: 1157465 - RNA, 18 nt, Human
gcugcuggagcugcuacu

SEQ ID NO: 1157466 - RNA, 19 nt, Human
gcugcuggagcugcuacug

SEQ ID NO: 1157467 - RNA, 19 nt, Human
gcugcuggagcugcuacug

SEQ ID NO: 1157468 - RNA, 18 nt, Human
gcugcuggagcugcugcu

SEQ ID NO: 1157469 - RNA, 19 nt, Human
gcugcugggacugcugcug

SEQ ID NO: 1157470 - RNA, 18 nt, Human
gcugcuggggcugcugcu

SEQ ID NO: 1157471 - RNA, 20 nt, Human
gcuggggcugcugcugcugc

SEQ ID NO: 1157472 - RNA, 21 nt, Human
ggcugcugccgcugcuacugg

SEQ ID NO: 1157473 - RNA, 21 nt, Human
ggcugcugcugcuacuacugg

SEQ ID NO: 1157474 - RNA, 21 nt, Human
ggcugcugcugcugcuacugg

SEQ ID NO: 1157475 - RNA, 21 nt, Human
ggcugcugcugcugcugcugg

SEQ ID NO: 1157476 - RNA, 21 nt, Human
ggcugcuguugcugcuacugg

SEQ ID NO: 1157477 - RNA, 21 nt, Human
gucucuuccagcaaggagagu

SEQ ID NO: 1157478 - RNA, 24 nt, Human
uaacaggacuugugucugaaguuu

SEQ ID NO: 1157479 - RNA, 24 nt, Human
uacuacuggggcugcuguugcugc

SEQ ID NO: 1157480 - RNA, 23 nt, Human
uacuccagccugggcaacagggc

SEQ ID NO: 1157481 - RNA, 21 nt, Human
uacugcuggggcugcugcugc

SEQ ID NO: 1157482 - RNA, 25 nt, Human
uacuggaguugcugcugcuggggcu

SEQ ID NO: 1157483 - RNA, 18 nt, Human
uacuggggcugcugcugc

SEQ ID NO: 1157484 - RNA, 28 nt, Human
ugcuacuggggcugcugcugcugcugcc

SEQ ID NO: 1157485 - RNA, 18 nt, Human
ugcuaggaggcacucagc

SEQ ID NO: 1157486 - RNA, 28 nt, Human
ugcugcugcuacuggggcugcugcugcc

SEQ ID NO: 1157487 - RNA, 18 nt, Human
ugcugcugcuagagcugc

SEQ ID NO: 1157488 - RNA, 28 nt, Human
ugcugcugcugcuacuggggcugcugcc

SEQ ID NO: 1157489 - RNA, 21 nt, Human
ugcugcugcugcuagagcugc

SEQ ID NO: 1157490 - RNA, 18 nt, Human
ugcugcugcugcuggagc

SEQ ID NO: 1157491 - RNA, 26 nt, Human
ugcugcugcugcuggagcuacugcug

SEQ ID NO: 1157492 - RNA, 18 nt, Human
ugcugcugcuggagcugc

SEQ ID NO: 1157493 - RNA, 24 nt, Human
ugcugcugcuggagcugcugcugc

SEQ ID NO: 1157494 - RNA, 24 nt, Human
ugcugcugcugggacugcugcugc

SEQ ID NO: 1157495 - RNA, 21 nt, Human
ugcugcugcuggggcugcugc

SEQ ID NO: 1157496 - RNA, 18 nt, Human
ugcugcuggggcugcugc

SEQ ID NO: 1157497 - RNA, 18 nt, Human
ugcugcuggggcugcugc

SEQ ID NO: 1157498 - RNA, 28 nt, Human
ugcugcuggggcugcugcugcugcugcc

SEQ ID NO: 1157499 - RNA, 21 nt, Human
ugcuggagcugcuacuggggc

SEQ ID NO: 1157500 - RNA, 21 nt, Human
ugcuggagcugcuacuggggc

SEQ ID NO: 1157501 - RNA, 21 nt, Human
ugcuggagcugcuacuggggc

SEQ ID NO: 1157502 - RNA, 28 nt, Human
ugcuguugcugcuacuggggcugcugcc

SEQ ID NO: 1157503 - RNA, 22 nt, Human
ugggaggcagaggaagaaggau

SEQ ID NO: 1157504 - RNA, 22 nt, Human
ugggaggcagaggaagaaggau

SEQ ID NO: 1157505 - RNA, 24 nt, Human
ugggaggcagaggaagaaggauug

SEQ ID NO: 1157506 - RNA, 23 nt, Human
ugucugaaguuuccuccagcuac

SEQ ID NO: 1157507 - RNA, 22 nt, Human
uuagaggugggcggucucuucc

SEQ ID NO: 1157508 - RNA, 24 nt, Human
uugcugcuacuggggcugcugccg

SEQ ID NO: 1157509 - RNA, 24 nt, Human
uugcugcugcuggggcugcugcug

SEQ ID NO: 1157510 - RNA, 28 nt, Human
uugcugcugcuggggcugcugcugcugc

SEQ ID NO: 1157511 - RNA, 22 nt, Human
uugggaggcagaggaagaagga

SEQ ID NO: 1157512 - RNA, 24 nt, Human
uugggaggcagaggaagaaggauu

SEQ ID NO: 1157513 - RNA, 18 nt, Human
uuguuugagcccaggugg

SEQ ID NO: 1157514 - RNA, 24 nt, Human
aaagugcugggaugacaggcauga

SEQ ID NO: 1157515 - RNA, 19 nt, Human
aaccacccagggucaucca

SEQ ID NO: 1157516 - RNA, 21 nt, Human
aaccccgacccuucuggcucc

SEQ ID NO: 1157517 - RNA, 21 nt, Human
aacuuauggcgcgcgugccuc

SEQ ID NO: 1157518 - RNA, 25 nt, Human
aagaaggcguggaggugccgcugga

SEQ ID NO: 1157519 - RNA, 19 nt, Human
aagcccccugucuacacag

SEQ ID NO: 1157520 - RNA, 19 nt, Human
aaguagcugggauuacagg

SEQ ID NO: 1157521 - RNA, 26 nt, Human
aaguagcugggauuacaggugcacac

SEQ ID NO: 1157522 - RNA, 21 nt, Human
acaggcaugagccaucgugcc

SEQ ID NO: 1157523 - RNA, 18 nt, Human
acaguucauuucuucuuc

SEQ ID NO: 1157524 - RNA, 18 nt, Human
acaugccucgccucccuc

SEQ ID NO: 1157525 - RNA, 28 nt, Human
acccagggucauccaaugccguaaguac

SEQ ID NO: 1157526 - RNA, 18 nt, Human
accuccuccuccuccucc

SEQ ID NO: 1157527 - RNA, 21 nt, Human
accuccuccuccucuuccccc

SEQ ID NO: 1157528 - RNA, 26 nt, Human
acgaaugacacgccaaagguuugaaa

SEQ ID NO: 1157529 - RNA, 18 nt, Human
acgggguuucacuauguu

SEQ ID NO: 1157530 - RNA, 19 nt, Human
acgggguuucacuauguug

SEQ ID NO: 1157531 - RNA, 24 nt, Human
acgggguuucacuauguugaccag

SEQ ID NO: 1157532 - RNA, 23 nt, Human
acuccuccuccuccuccuccccc

SEQ ID NO: 1157533 - RNA, 24 nt, Human
acucuuguugcccaggcuggagug

SEQ ID NO: 1157534 - RNA, 19 nt, Human
agagacgggguuucacuau

SEQ ID NO: 1157535 - RNA, 19 nt, Human
agagccggggacccuugga

SEQ ID NO: 1157536 - RNA, 21 nt, Human
agccauaaccacccaggguca

SEQ ID NO: 1157537 - RNA, 18 nt, Human
agccugggcuugggggca

SEQ ID NO: 1157538 - RNA, 22 nt, Human
aggcaggaggaggucgcucugg

SEQ ID NO: 1157539 - RNA, 23 nt, Human
aggcaggaggaggucgcucugga

SEQ ID NO: 1157540 - RNA, 18 nt, Human
aggcccuugugucgaugu

SEQ ID NO: 1157541 - RNA, 20 nt, Human
agggagagcucuuugugaug

SEQ ID NO: 1157542 - RNA, 18 nt, Human
aggggccucccuucagug

SEQ ID NO: 1157543 - RNA, 24 nt, Human
agugcaauggcacaaucucggcuc

SEQ ID NO: 1157544 - RNA, 18 nt, Human
auccacgaacuccuccuc

SEQ ID NO: 1157545 - RNA, 18 nt, Human
auccacgaccuccuccuc

SEQ ID NO: 1157546 - RNA, 24 nt, Human
caaagugcugggaugacaggcaug

SEQ ID NO: 1157547 - RNA, 21 nt, Human
caacaaccuccuccuccucuu

SEQ ID NO: 1157548 - RNA, 20 nt, Human
caaccuccgccucccagguu

SEQ ID NO: 1157549 - RNA, 22 nt, Human
caagcaauucuccuguuucagc

SEQ ID NO: 1157550 - RNA, 24 nt, Human
cacaccaccaugccuggcuaauuu

SEQ ID NO: 1157551 - RNA, 19 nt, Human
cacauagaggcuggccacg

SEQ ID NO: 1157552 - RNA, 24 nt, Human
caccaugccuggcuaauuuuugua

SEQ ID NO: 1157553 - RNA, 19 nt, Human
cacccucccugcucagcaa

SEQ ID NO: 1157554 - RNA, 24 nt, Human
cacccucccugcucagcaauacug

SEQ ID NO: 1157555 - RNA, 26 nt, Human
cacgaacuccuccuccuccuccuccc

SEQ ID NO: 1157556 - RNA, 19 nt, Human
cacgcuccucuuccucuuc

SEQ ID NO: 1157557 - RNA, 21 nt, Human
cacgggaaggucggggaaucc

SEQ ID NO: 1157558 - RNA, 18 nt, Human
cacuauguugaccaggcu

SEQ ID NO: 1157559 - RNA, 24 nt, Human
cacuauguugaccaggcugcucuc

SEQ ID NO: 1157560 - RNA, 24 nt, Human
cacucuuguugcccaggcuggagu

SEQ ID NO: 1157561 - RNA, 21 nt, Human
cacugcaaccuccgccuccca

SEQ ID NO: 1157562 - RNA, 20 nt, Human
cagccaagccucagucaggu

SEQ ID NO: 1157563 - RNA, 20 nt, Human
cagccugggcuugggggcaa

SEQ ID NO: 1157564 - RNA, 24 nt, Human
caggagagagggagagcucuuugu

SEQ ID NO: 1157565 - RNA, 24 nt, Human
ccaaagugcugggaugacaggcau

SEQ ID NO: 1157566 - RNA, 21 nt, Human
ccaaguagcugggauuacagg

SEQ ID NO: 1157567 - RNA, 21 nt, Human
ccaggugcugaggaaccugcc

SEQ ID NO: 1157568 - RNA, 18 nt, Human
ccaguuccuccuucucag

SEQ ID NO: 1157569 - RNA, 23 nt, Human
cccaaguagcugggauuacaggu

SEQ ID NO: 1157570 - RNA, 24 nt, Human
cccaaguagcugggauuacaggug

SEQ ID NO: 1157571 - RNA, 28 nt, Human
cccacucccaucacauagaggcuggcca

SEQ ID NO: 1157572 - RNA, 19 nt, Human
cccagcaggcccacuccca

SEQ ID NO: 1157573 - RNA, 19 nt, Human
cccaggcuggagugcaaug

SEQ ID NO: 1157574 - RNA, 23 nt, Human
cccagguucaagcaauucuccug

SEQ ID NO: 1157575 - RNA, 20 nt, Human
cccccuccuccuacccggga

SEQ ID NO: 1157576 - RNA, 19 nt, Human
ccccggccaguuccuccuu

SEQ ID NO: 1157577 - RNA, 23 nt, Human
ccccuccucuuccuggcaggccc

SEQ ID NO: 1157578 - RNA, 20 nt, Human
cccgggcgccccgggagcuc

SEQ ID NO: 1157579 - RNA, 26 nt, Human
ccgccucccagguucaagcaauucuu

SEQ ID NO: 1157580 - RNA, 22 nt, Human
ccggccaguuccuccuucucag

SEQ ID NO: 1157581 - RNA, 20 nt, Human
ccggggccccucaucaagcc

SEQ ID NO: 1157582 - RNA, 24 nt, Human
ccucccagguucaagcaauucucc

SEQ ID NO: 1157583 - RNA, 19 nt, Human
ccuccccuccuccucuccu

SEQ ID NO: 1157584 - RNA, 23 nt, Human
ccuccgaugccaggugcugagga

SEQ ID NO: 1157585 - RNA, 20 nt, Human
ccuccuccuccuccccuccu

SEQ ID NO: 1157586 - RNA, 19 nt, Human
ccuccuccuccucuucccc

SEQ ID NO: 1157587 - RNA, 19 nt, Human
ccuccuccuucuccucccc

SEQ ID NO: 1157588 - RNA, 18 nt, Human
ccuccucuucccccuccu

SEQ ID NO: 1157589 - RNA, 18 nt, Human
ccuccucuucccccuccu

SEQ ID NO: 1157590 - RNA, 20 nt, Human
ccuccucuucccccuccucc

SEQ ID NO: 1157591 - RNA, 20 nt, Human
ccuccucuucccccuccucc

SEQ ID NO: 1157592 - RNA, 21 nt, Human
ccuccucuucccccuccuccu

SEQ ID NO: 1157593 - RNA, 20 nt, Human
ccuccuucuccuccccuccu

SEQ ID NO: 1157594 - RNA, 23 nt, Human
ccucuccuccuccuggcaguccc

SEQ ID NO: 1157595 - RNA, 24 nt, Human
ccucuccuccuccuggcaguccca

SEQ ID NO: 1157596 - RNA, 18 nt, Human
ccucuuuccucuuuaucc

SEQ ID NO: 1157597 - RNA, 28 nt, Human
ccugggcuugggggcaaugggggggcuu

SEQ ID NO: 1157598 - RNA, 24 nt, Human
ccuguuucagccucccaaguagcu

SEQ ID NO: 1157599 - RNA, 19 nt, Human
ccuugugucgauguucuuc

SEQ ID NO: 1157600 - RNA, 18 nt, Human
cgaaaggaggugggaugu

SEQ ID NO: 1157601 - RNA, 22 nt, Human
cgacaggugguuuuggcaacgu

SEQ ID NO: 1157602 - RNA, 22 nt, Human
cgccaaagguuugaaacaguga

SEQ ID NO: 1157603 - RNA, 20 nt, Human
cgccccgggagcuccaacuu

SEQ ID NO: 1157604 - RNA, 24 nt, Human
cgccucagcuucccaaagugcugg

SEQ ID NO: 1157605 - RNA, 20 nt, Human
cggccagggcgcggccucgc

SEQ ID NO: 1157606 - RNA, 23 nt, Human
cggccucgccaaggcugaggcgg

SEQ ID NO: 1157607 - RNA, 24 nt, Human
cgggguuucacuauguugaccagg

SEQ ID NO: 1157608 - RNA, 21 nt, Human
cggucucugacucagagcacu

SEQ ID NO: 1157609 - RNA, 20 nt, Human
cuacacagagcagccguccg

SEQ ID NO: 1157610 - RNA, 19 nt, Human
cucacucccaucacauaga

SEQ ID NO: 1157611 - RNA, 24 nt, Human
cucacucuuguugcccaggcugga

SEQ ID NO: 1157612 - RNA, 24 nt, Human
cucacugcaaccuccgccucccag

SEQ ID NO: 1157613 - RNA, 21 nt, Human
cuccagcccaaggccugccau

SEQ ID NO: 1157614 - RNA, 21 nt, Human
cuccaggccacaugccucgcc

SEQ ID NO: 1157615 - RNA, 18 nt, Human
cuccuccuccuccucccc

SEQ ID NO: 1157616 - RNA, 27 nt, Human
cuccuccuccucuucccccuccucccu

SEQ ID NO: 1157617 - RNA, 27 nt, Human
cuccuccuccucuucccccuccucccu

SEQ ID NO: 1157618 - RNA, 23 nt, Human
cuccuccuucuccuccccuccuc

SEQ ID NO: 1157619 - RNA, 26 nt, Human
cuccugaccuucggugaucugcucgc

SEQ ID NO: 1157620 - RNA, 19 nt, Human
cucucgagccuggcugagg

SEQ ID NO: 1157621 - RNA, 21 nt, Human
cucugccuccggaccccggcc

SEQ ID NO: 1157622 - RNA, 18 nt, Human
cucuuguugcccaggcug

SEQ ID NO: 1157623 - RNA, 21 nt, Human
cugacucagagcacuuuggga

SEQ ID NO: 1157624 - RNA, 24 nt, Human
cugcaaccuccgccucccagguuc

SEQ ID NO: 1157625 - RNA, 22 nt, Human
cugcagcuggggcagcaauagc

SEQ ID NO: 1157626 - RNA, 19 nt, Human
cugcccccguccuuggguu

SEQ ID NO: 1157627 - RNA, 19 nt, Human
cuggaagaccaccucucca

SEQ ID NO: 1157628 - RNA, 26 nt, Human
cuggacaccugcucuucugucccugg

SEQ ID NO: 1157629 - RNA, 19 nt, Human
cuggcuuccaggggccucc

SEQ ID NO: 1157630 - RNA, 18 nt, Human
cugguuucuuugggggca

SEQ ID NO: 1157631 - RNA, 19 nt, Human
cuucuccuccccuccuccu

SEQ ID NO: 1157632 - RNA, 18 nt, Human
cuugugguccucuccaug

SEQ ID NO: 1157633 - RNA, 24 nt, Human
cuuguugcccaggcuggagugcaa

SEQ ID NO: 1157634 - RNA, 20 nt, Human
gaaccugccucagaucuggg

SEQ ID NO: 1157635 - RNA, 20 nt, Human
gaagaaggcguggaggugcc

SEQ ID NO: 1157636 - RNA, 24 nt, Human
gacaggugguuuuggcaacgaccc

SEQ ID NO: 1157637 - RNA, 22 nt, Human
gacucagagcacuuugggacgg

SEQ ID NO: 1157638 - RNA, 24 nt, Human
gaggaggucgcucuggaagaccac

SEQ ID NO: 1157639 - RNA, 18 nt, Human
gagugggauaugggcuca

SEQ ID NO: 1157640 - RNA, 18 nt, Human
gaugacaggcaugagcca

SEQ ID NO: 1157641 - RNA, 24 nt, Human
gaugacaggcaugagccaucgugc

SEQ ID NO: 1157642 - RNA, 21 nt, Human
gauuacaggugcacaccacca

SEQ ID NO: 1157643 - RNA, 20 nt, Human
gcaguuucugggacgguuuc

SEQ ID NO: 1157644 - RNA, 19 nt, Human
gcccaggcuggagugcaau

SEQ ID NO: 1157645 - RNA, 18 nt, Human
gccucagaucugguuucu

SEQ ID NO: 1157646 - RNA, 24 nt, Human
gccucagcuucccaaagugcuggg

SEQ ID NO: 1157647 - RNA, 19 nt, Human
gccucgccaaggcugaggc

SEQ ID NO: 1157648 - RNA, 26 nt, Human
gcgcggccucgccaaggcugaggcgg

SEQ ID NO: 1157649 - RNA, 25 nt, Human
gcucccaguacacagagauggaaac

SEQ ID NO: 1157650 - RNA, 20 nt, Human
gcugcaccagcuucucuucc

SEQ ID NO: 1157651 - RNA, 19 nt, Human
gcuggagugcaauggcaca

SEQ ID NO: 1157652 - RNA, 19 nt, Human
gcuucucuuccuccucacu

SEQ ID NO: 1157653 - RNA, 18 nt, Human
ggaaggucggggaauccu

SEQ ID NO: 1157654 - RNA, 21 nt, Human
ggaccccggagccgcgcaugc

SEQ ID NO: 1157655 - RNA, 19 nt, Human
ggacgguuucuggccaccu

SEQ ID NO: 1157656 - RNA, 24 nt, Human
ggaugacaggcaugagccaucgug

SEQ ID NO: 1157657 - RNA, 23 nt, Human
ggccaaggccgagcagcacggga

SEQ ID NO: 1157658 - RNA, 24 nt, Human
ggccuccucgcuggcuuccucagc

SEQ ID NO: 1157659 - RNA, 22 nt, Human
gggaugacaggcaugagccauc

SEQ ID NO: 1157660 - RNA, 21 nt, Human
gggcagcaauagccgccgagu

SEQ ID NO: 1157661 - RNA, 23 nt, Human
gggguuucacuauguugaccagg

SEQ ID NO: 1157662 - RNA, 22 nt, Human
ggguuucacuauguugaccagg

SEQ ID NO: 1157663 - RNA, 22 nt, Human
gucugugccuucuucacccucc

SEQ ID NO: 1157664 - RNA, 23 nt, Human
gugaaggcccugggcuuugcugg

SEQ ID NO: 1157665 - RNA, 24 nt, Human
gugaucugcucgccucagcuuccc

SEQ ID NO: 1157666 - RNA, 19 nt, Human
gugccuucuucacccuccc

SEQ ID NO: 1157667 - RNA, 21 nt, Human
uaaccccgacccuucuggcuc

SEQ ID NO: 1157668 - RNA, 22 nt, Human
uaaccccgacccuucuggcucc

SEQ ID NO: 1157669 - RNA, 23 nt, Human
uaacuggaggguagagccgggga

SEQ ID NO: 1157670 - RNA, 24 nt, Human
uaauuuuuguauuuuuauuagaga

SEQ ID NO: 1157671 - RNA, 21 nt, Human
uagagacgggguuucacuaug

SEQ ID NO: 1157672 - RNA, 22 nt, Human
uagagacgggguuucacuaugu

SEQ ID NO: 1157673 - RNA, 19 nt, Human
uagccgccgaguccuuacc

SEQ ID NO: 1157674 - RNA, 18 nt, Human
uauguugaccaggcugcu

SEQ ID NO: 1157675 - RNA, 24 nt, Human
uauguugaccaggcugcucucgaa

SEQ ID NO: 1157676 - RNA, 24 nt, Human
uauuagagacgggguuucacuaug

SEQ ID NO: 1157677 - RNA, 19 nt, Human
ucacugcaaccuccgccuc

SEQ ID NO: 1157678 - RNA, 23 nt, Human
ucacugcaaccuccgccucccag

SEQ ID NO: 1157679 - RNA, 24 nt, Human
ucacugcaaccuccgccucccagg

SEQ ID NO: 1157680 - RNA, 27 nt, Human
ucacugcaaccuccgccucccagguuc

SEQ ID NO: 1157681 - RNA, 22 nt, Human
ucagcauccucucccauguccu

SEQ ID NO: 1157682 - RNA, 20 nt, Human
ucagccucccaaguagcugg

SEQ ID NO: 1157683 - RNA, 22 nt, Human
ucagccucccaaguagcuggga

SEQ ID NO: 1157684 - RNA, 25 nt, Human
ucaggggccuccucgcuggcuuccu

SEQ ID NO: 1157685 - RNA, 21 nt, Human
ucagucagguggggccccuga

SEQ ID NO: 1157686 - RNA, 19 nt, Human
ucauccacagccuccuccu

SEQ ID NO: 1157687 - RNA, 19 nt, Human
ucauccacgaccuccuccu

SEQ ID NO: 1157688 - RNA, 19 nt, Human
uccauggcuuccuccuccu

SEQ ID NO: 1157689 - RNA, 24 nt, Human
ucccaaagugcugggaugacaggc

SEQ ID NO: 1157690 - RNA, 23 nt, Human
ucccaaguagcugggauuacagg

SEQ ID NO: 1157691 - RNA, 21 nt, Human
ucccagguucaagcaauucuc

SEQ ID NO: 1157692 - RNA, 24 nt, Human
ucccagguucaagcaauucuccug

SEQ ID NO: 1157693 - RNA, 21 nt, Human
ucccccuccuccuacccggga

SEQ ID NO: 1157694 - RNA, 21 nt, Human
ucccgggcgccccgggagcuc

SEQ ID NO: 1157695 - RNA, 22 nt, Human
ucccugaggcggggcgauuugg

SEQ ID NO: 1157696 - RNA, 25 nt, Human
ucccuguguggcugcaccagcuucu

SEQ ID NO: 1157697 - RNA, 23 nt, Human
uccgcagcccucuccuugguccu

SEQ ID NO: 1157698 - RNA, 18 nt, Human
uccuccuucuccuccccu

SEQ ID NO: 1157699 - RNA, 19 nt, Human
uccuggcacagccuuccuc

SEQ ID NO: 1157700 - RNA, 21 nt, Human
ucgcuggcuuccucagcaucc

SEQ ID NO: 1157701 - RNA, 20 nt, Human
ucgcugucgaucaggagaga

SEQ ID NO: 1157702 - RNA, 21 nt, Human
ucuaaccccgacccuucuggc

SEQ ID NO: 1157703 - RNA, 24 nt, Human
ucucacucuuguugcccaggcugg

SEQ ID NO: 1157704 - RNA, 25 nt, Human
ucucacucuuguugcccaggcugga

SEQ ID NO: 1157705 - RNA, 22 nt, Human
ucucaggggccuccucgcuggc

SEQ ID NO: 1157706 - RNA, 21 nt, Human
ucuccaggccacaugccucgc

SEQ ID NO: 1157707 - RNA, 19 nt, Human
ucucuuccuccucacuucu

SEQ ID NO: 1157708 - RNA, 18 nt, Human
ucugagccauaaccaccc

SEQ ID NO: 1157709 - RNA, 26 nt, Human
ucugcagaggccucgggagacaccag

SEQ ID NO: 1157710 - RNA, 21 nt, Human
ucugcggcaccuccgaugccg

SEQ ID NO: 1157711 - RNA, 22 nt, Human
ucuuguugcccaggcuggagug

SEQ ID NO: 1157712 - RNA, 24 nt, Human
ugaaggcccugggcuuugcuggcc

SEQ ID NO: 1157713 - RNA, 24 nt, Human
ugaccaggcugcucucgaacuccu

SEQ ID NO: 1157714 - RNA, 18 nt, Human
ugagaagggagcgaggcc

SEQ ID NO: 1157715 - RNA, 19 nt, Human
ugagagugggauaugggcu

SEQ ID NO: 1157716 - RNA, 21 nt, Human
ugaggacgauguaauccucgu

SEQ ID NO: 1157717 - RNA, 19 nt, Human
ugauguguguuucugcugg

SEQ ID NO: 1157718 - RNA, 18 nt, Human
ugcaccagcuucucuucc

SEQ ID NO: 1157719 - RNA, 18 nt, Human
ugcagccugcccuccuuc

SEQ ID NO: 1157720 - RNA, 18 nt, Human
ugcccaggcuggagugca

SEQ ID NO: 1157721 - RNA, 21 nt, Human
ugcccaggcuggagugcaaug

SEQ ID NO: 1157722 - RNA, 24 nt, Human
ugcccaggcuggagugcaauggca

SEQ ID NO: 1157723 - RNA, 21 nt, Human
ugcccucuccuucacaguuca

SEQ ID NO: 1157724 - RNA, 23 nt, Human
ugccuccggaccccggccaguuc

SEQ ID NO: 1157725 - RNA, 18 nt, Human
ugccucgccucccuccuc

SEQ ID NO: 1157726 - RNA, 24 nt, Human
ugccuucuucacccucccugcuca

SEQ ID NO: 1157727 - RNA, 20 nt, Human
uggaagaaggcguggaggug

SEQ ID NO: 1157728 - RNA, 21 nt, Human
uggaaggugguuucucuggga

SEQ ID NO: 1157729 - RNA, 22 nt, Human
uggaaggugguuucucugggag

SEQ ID NO: 1157730 - RNA, 21 nt, Human
uggaaucugcaugcuucagga

SEQ ID NO: 1157731 - RNA, 23 nt, Human
uggagugcaauggcacaaucucg

SEQ ID NO: 1157732 - RNA, 24 nt, Human
uggagugcaauggcacaaucucgg

SEQ ID NO: 1157733 - RNA, 24 nt, Human
uggcaaggcccugcuggcuuccag

SEQ ID NO: 1157734 - RNA, 24 nt, Human
uggcacaaucucggcucacugcaa

SEQ ID NO: 1157735 - RNA, 19 nt, Human
uggcuuccaggggccuccc

SEQ ID NO: 1157736 - RNA, 20 nt, Human
ugggagaaacucccagacac

SEQ ID NO: 1157737 - RNA, 21 nt, Human
ugggaugacaggcaugagcca

SEQ ID NO: 1157738 - RNA, 22 nt, Human
ugggaugacaggcaugagccau

SEQ ID NO: 1157739 - RNA, 24 nt, Human
ugggaugacaggcaugagccaucg

SEQ ID NO: 1157740 - RNA, 21 nt, Human
ugggauuacaggugcacacca

SEQ ID NO: 1157741 - RNA, 22 nt, Human
ugggauuacaggugcacaccac

SEQ ID NO: 1157742 - RNA, 22 nt, Human
ugggauuacaggugcacaccac

SEQ ID NO: 1157743 - RNA, 24 nt, Human
ugggauuacaggugcacaccacca

SEQ ID NO: 1157744 - RNA, 18 nt, Human
ugucaggauccgaacccu

SEQ ID NO: 1157745 - RNA, 24 nt, Human
ugucccuggcucauccgcagcccu

SEQ ID NO: 1157746 - RNA, 20 nt, Human
uguugcccaggcuggagugc

SEQ ID NO: 1157747 - RNA, 18 nt, Human
uuagagacgggguuucac

SEQ ID NO: 1157748 - RNA, 24 nt, Human
uuauuagagacgggguuucacuau

SEQ ID NO: 1157749 - RNA, 21 nt, Human
uucacgaaugacacgccaaag

SEQ ID NO: 1157750 - RNA, 18 nt, Human
uugcccaggcuggagugc

SEQ ID NO: 1157751 - RNA, 18 nt, Human
uugggagcgacagguggu

SEQ ID NO: 1157752 - RNA, 21 nt, Human
uuucacuauguugaccaggcu

SEQ ID NO: 1157753 - RNA, 24 nt, Human
uuuuuauuagagacgggguuucac

SEQ ID NO: 1157754 - RNA, 20 nt, Human
uuuuuguauuuuuauuagag

SEQ ID NO: 1157755 - RNA, 23 nt, Human
uuuuuguauuuuuauuagagacg

SEQ ID NO: 1157756 - RNA, 21 nt, Human
aaagggggcugugcaaacccu

SEQ ID NO: 1157757 - RNA, 23 nt, Human
aaagggggcugugcaaacccuag

SEQ ID NO: 1157758 - RNA, 21 nt, Human
aacccaguguuuccauuucag

SEQ ID NO: 1157759 - RNA, 23 nt, Human
aagaggagccuuccccaggccug

SEQ ID NO: 1157760 - RNA, 23 nt, Human
aagcaagaagcaggcuggggcaa

SEQ ID NO: 1157761 - RNA, 24 nt, Human
aaucccgcuacucagcaucuccac

SEQ ID NO: 1157762 - RNA, 25 nt, Human
aaucccgcuacucagcaucuccacc

SEQ ID NO: 1157763 - RNA, 19 nt, Human
acaaagagcaggaacggga

SEQ ID NO: 1157764 - RNA, 20 nt, Human
acccugcuuccucugcccug

SEQ ID NO: 1157765 - RNA, 22 nt, Human
acugaaucucccuccacccagu

SEQ ID NO: 1157766 - RNA, 20 nt, Human
acugugacucuggggaaggc

SEQ ID NO: 1157767 - RNA, 18 nt, Human
acuuggcaagccucaugg

SEQ ID NO: 1157768 - RNA, 19 nt, Human
agagcaggaacgggaagca

SEQ ID NO: 1157769 - RNA, 21 nt, Human
agagcaggaacgggaagcaag

SEQ ID NO: 1157770 - RNA, 19 nt, Human
agaggccacccaguagagc

SEQ ID NO: 1157771 - RNA, 22 nt, Human
agcaagaagcaggcuggggcaa

SEQ ID NO: 1157772 - RNA, 21 nt, Human
agcagggaccuugccuccccc

SEQ ID NO: 1157773 - RNA, 18 nt, Human
agcuccccaccaagggcc

SEQ ID NO: 1157774 - RNA, 20 nt, Human
aggaccaaagucuggacugg

SEQ ID NO: 1157775 - RNA, 19 nt, Human
agggauggagggggugaug

SEQ ID NO: 1157776 - RNA, 22 nt, Human
agggggagcagaaagaauuggg

SEQ ID NO: 1157777 - RNA, 24 nt, Human
auacugaaucucccuccacccagu

SEQ ID NO: 1157778 - RNA, 20 nt, Human
augaccccacccacagcaaa

SEQ ID NO: 1157779 - RNA, 23 nt, Human
augcuuguacacuuaugggguac

SEQ ID NO: 1157780 - RNA, 20 nt, Human
caaccccagagagagggucc

SEQ ID NO: 1157781 - RNA, 19 nt, Human
caagagagaucggguagca

SEQ ID NO: 1157782 - RNA, 22 nt, Human
cacugcagucuucucuccaucu

SEQ ID NO: 1157783 - RNA, 22 nt, Human
cacuucccccuuccuccccacu

SEQ ID NO: 1157784 - RNA, 21 nt, Human
cagagucugugccuccaacuu

SEQ ID NO: 1157785 - RNA, 22 nt, Human
cagccacuucccaguucucugc

SEQ ID NO: 1157786 - RNA, 18 nt, Human
cagcgcuuuuccccugcc

SEQ ID NO: 1157787 - RNA, 19 nt, Human
cagcuugcugcucuccuga

SEQ ID NO: 1157788 - RNA, 24 nt, Human
caggaacgggaagcaagaagcagg

SEQ ID NO: 1157789 - RNA, 19 nt, Human
caggucccgucugccugug

SEQ ID NO: 1157790 - RNA, 23 nt, Human
cagugagaugggauucaagcccg

SEQ ID NO: 1157791 - RNA, 18 nt, Human
cauggguucacagcuacc

SEQ ID NO: 1157792 - RNA, 22 nt, Human
cauuggaagugcagcccugggu

SEQ ID NO: 1157793 - RNA, 19 nt, Human
ccaacagcuguggggagga

SEQ ID NO: 1157794 - RNA, 22 nt, Human
ccacacauugcgcauggccucu

SEQ ID NO: 1157795 - RNA, 21 nt, Human
ccagcggccccuucagguccc

SEQ ID NO: 1157796 - RNA, 24 nt, Human
cccaugcugccacgugcccagcaa

SEQ ID NO: 1157797 - RNA, 19 nt, Human
cccccaggugucaauacug

SEQ ID NO: 1157798 - RNA, 18 nt, Human
ccccccucagaggccuga

SEQ ID NO: 1157799 - RNA, 24 nt, Human
cccccuuccuccccacuccgcuca

SEQ ID NO: 1157800 - RNA, 18 nt, Human
cccccuucucagguucug

SEQ ID NO: 1157801 - RNA, 18 nt, Human
ccccuuccuccccacucc

SEQ ID NO: 1157802 - RNA, 18 nt, Human
cccgaaggccugggaacc

SEQ ID NO: 1157803 - RNA, 28 nt, Human
cccugcucuauuuuaucuuuuuuaauaa

SEQ ID NO: 1157804 - RNA, 22 nt, Human
cccuggguccgagaggccaccc

SEQ ID NO: 1157805 - RNA, 21 nt, Human
ccgcacccgcccagccacuuc

SEQ ID NO: 1157806 - RNA, 18 nt, Human
ccucccugcacagaaagg

SEQ ID NO: 1157807 - RNA, 19 nt, Human
ccucuccacacucacacug

SEQ ID NO: 1157808 - RNA, 19 nt, Human
ccucugggagugccagccc

SEQ ID NO: 1157809 - RNA, 23 nt, Human
ccucuugucuccccagugugcca

SEQ ID NO: 1157810 - RNA, 20 nt, Human
ccugacaguggaugccaaca

SEQ ID NO: 1157811 - RNA, 23 nt, Human
ccugcagcgcuuuuccccugccc

SEQ ID NO: 1157812 - RNA, 21 nt, Human
cucacugcagucuucucucca

SEQ ID NO: 1157813 - RNA, 21 nt, Human
cucacugcagucuucucucca

SEQ ID NO: 1157814 - RNA, 24 nt, Human
cucacugcagucuucucuccaucu

SEQ ID NO: 1157815 - RNA, 21 nt, Human
cuccacccagugccaguuugc

SEQ ID NO: 1157816 - RNA, 20 nt, Human
cuccaucuuuccaagguaga

SEQ ID NO: 1157817 - RNA, 20 nt, Human
cuccuggcugucuagugugg

SEQ ID NO: 1157818 - RNA, 21 nt, Human
cucugcugcuuugcgcccucc

SEQ ID NO: 1157819 - RNA, 21 nt, Human
cucuuuucuccugucuguacc

SEQ ID NO: 1157820 - RNA, 19 nt, Human
cugaaaaaguugaccccau

SEQ ID NO: 1157821 - RNA, 24 nt, Human
cugcaccgcacccgcccagccacu

SEQ ID NO: 1157822 - RNA, 24 nt, Human
cugcagucuucucuccaucuuucc

SEQ ID NO: 1157823 - RNA, 22 nt, Human
cugcugcuuugcgcccucccug

SEQ ID NO: 1157824 - RNA, 20 nt, Human
cuggagagugacagagggag

SEQ ID NO: 1157825 - RNA, 21 nt, Human
gacacugaggugcaagagaga

SEQ ID NO: 1157826 - RNA, 23 nt, Human
gacacugaggugcaagagagauc

SEQ ID NO: 1157827 - RNA, 19 nt, Human
gaccuugccucccccacag

SEQ ID NO: 1157828 - RNA, 23 nt, Human
gaccuugccucccccacagccac

SEQ ID NO: 1157829 - RNA, 18 nt, Human
gagccugcagcgcuuuuc

SEQ ID NO: 1157830 - RNA, 23 nt, Human
gagcuccccaccaagggccccuc

SEQ ID NO: 1157831 - RNA, 23 nt, Human
gaggagccuuccccaggccuggc

SEQ ID NO: 1157832 - RNA, 19 nt, Human
gaggcagguguccuggggg

SEQ ID NO: 1157833 - RNA, 19 nt, Human
gagggaaugggggguuguc

SEQ ID NO: 1157834 - RNA, 21 nt, Human
gagggucccuguggguccugu

SEQ ID NO: 1157835 - RNA, 25 nt, Human
gagugacagagggagggaauggggg

SEQ ID NO: 1157836 - RNA, 21 nt, Human
gccccgagggauggagggggu

SEQ ID NO: 1157837 - RNA, 24 nt, Human
gccuacugugacucuggggaaggc

SEQ ID NO: 1157838 - RNA, 22 nt, Human
gccucuccacacucacacugcc

SEQ ID NO: 1157839 - RNA, 21 nt, Human
gcucugagugggugcagggca

SEQ ID NO: 1157840 - RNA, 25 nt, Human
gcucugagugggugcagggcagagu

SEQ ID NO: 1157841 - RNA, 19 nt, Human
gcugaggcucugagugggu

SEQ ID NO: 1157842 - RNA, 26 nt, Human
ggaaaucccgcuacucagcaucucca

SEQ ID NO: 1157843 - RNA, 18 nt, Human
ggaacagauggcaaagau

SEQ ID NO: 1157844 - RNA, 19 nt, Human
ggcaagacacagcagcagc

SEQ ID NO: 1157845 - RNA, 24 nt, Human
ggcaagacacagcagcagccccga

SEQ ID NO: 1157846 - RNA, 23 nt, Human
ggcagacucccuagagacagccc

SEQ ID NO: 1157847 - RNA, 18 nt, Human
ggcccagggcaccaucuc

SEQ ID NO: 1157848 - RNA, 22 nt, Human
ggcgaugguagcgguggcagcc

SEQ ID NO: 1157849 - RNA, 19 nt, Human
gggaagcaagaagcaggcu

SEQ ID NO: 1157850 - RNA, 21 nt, Human
gggaagcucaaacucuaccaa

SEQ ID NO: 1157851 - RNA, 21 nt, Human
gggaccuugccucccccacag

SEQ ID NO: 1157852 - RNA, 21 nt, Human
gggguugagggucccccaggu

SEQ ID NO: 1157853 - RNA, 21 nt, Human
ggguugagggucccccaggug

SEQ ID NO: 1157854 - RNA, 19 nt, Human
ggguuuccuucgcaaacuc

SEQ ID NO: 1157855 - RNA, 19 nt, Human
gguaaggagaaggcaaaga

SEQ ID NO: 1157856 - RNA, 19 nt, Human
ggugaugggaaugggggcu

SEQ ID NO: 1157857 - RNA, 20 nt, Human
ggugaugggaaugggggcuu

SEQ ID NO: 1157858 - RNA, 20 nt, Human
gguugagggucccccaggug

SEQ ID NO: 1157859 - RNA, 20 nt, Human
guguccccucugggagugcc

SEQ ID NO: 1157860 - RNA, 24 nt, Human
guguuguggagccucuugucuccc

SEQ ID NO: 1157861 - RNA, 23 nt, Human
uaaaggaccaaagucuggacugg

SEQ ID NO: 1157862 - RNA, 18 nt, Human
uaaggcuauggcuucugg

SEQ ID NO: 1157863 - RNA, 21 nt, Human
uauccuggaguucaaccaguc

SEQ ID NO: 1157864 - RNA, 24 nt, Human
uaucuuuuuuaauaaagauggcuc

SEQ ID NO: 1157865 - RNA, 18 nt, Human
uauuaugucuuuauuagu

SEQ ID NO: 1157866 - RNA, 27 nt, Human
ucaauacugaaucucccuccacccagu

SEQ ID NO: 1157867 - RNA, 20 nt, Human
ucagagagaccaauuccaca

SEQ ID NO: 1157868 - RNA, 25 nt, Human
ucagagagaccaauuccacaugaug

SEQ ID NO: 1157869 - RNA, 18 nt, Human
ucagagugacgggggugg

SEQ ID NO: 1157870 - RNA, 24 nt, Human
uccacaugauguccuggaaguugg

SEQ ID NO: 1157871 - RNA, 18 nt, Human
ucccacacauugcgcaug

SEQ ID NO: 1157872 - RNA, 23 nt, Human
ucccaggcugcaccgcacccgcc

SEQ ID NO: 1157873 - RNA, 21 nt, Human
ucccaguucucugcuuugucc

SEQ ID NO: 1157874 - RNA, 21 nt, Human
uccccaaagugccuuaggggg

SEQ ID NO: 1157875 - RNA, 24 nt, Human
uccccaaagugccuuagggggcca

SEQ ID NO: 1157876 - RNA, 20 nt, Human
ucccgaaggccugggaacca

SEQ ID NO: 1157877 - RNA, 21 nt, Human
uccucugcccugccacuuccc

SEQ ID NO: 1157878 - RNA, 22 nt, Human
uccugcuuuacaccugucacuc

SEQ ID NO: 1157879 - RNA, 22 nt, Human
uccugggggucuggggaggguu

SEQ ID NO: 1157880 - RNA, 20 nt, Human
ucucagguucugaaaucauc

SEQ ID NO: 1157881 - RNA, 20 nt, Human
ucuccacacucacacugccu

SEQ ID NO: 1157882 - RNA, 24 nt, Human
ucuccacacucacacugccuggug

SEQ ID NO: 1157883 - RNA, 24 nt, Human
ucucgcauccaguaggcccucagu

SEQ ID NO: 1157884 - RNA, 19 nt, Human
ucuuuuuuaauaaagaugg

SEQ ID NO: 1157885 - RNA, 19 nt, Human
ugaaucucccuccacccag

SEQ ID NO: 1157886 - RNA, 20 nt, Human
ugacagagggagggaauggg

SEQ ID NO: 1157887 - RNA, 20 nt, Human
ugacagagggagggaauggg

SEQ ID NO: 1157888 - RNA, 21 nt, Human
ugacagagggagggaaugggg

SEQ ID NO: 1157889 - RNA, 24 nt, Human
ugacagagggagggaauggggggu

SEQ ID NO: 1157890 - RNA, 19 nt, Human
ugacccugcccacuacuga

SEQ ID NO: 1157891 - RNA, 23 nt, Human
ugaccucuuggacuuuauuuccc

SEQ ID NO: 1157892 - RNA, 20 nt, Human
ugagaagggcagacucccua

SEQ ID NO: 1157893 - RNA, 18 nt, Human
ugagaugggauucaagcc

SEQ ID NO: 1157894 - RNA, 18 nt, Human
ugagaugggauucaagcc

SEQ ID NO: 1157895 - RNA, 20 nt, Human
ugaggcagguguccuggggg

SEQ ID NO: 1157896 - RNA, 21 nt, Human
ugauaaaugaccguuuccugc

SEQ ID NO: 1157897 - RNA, 26 nt, Human
ugauggcaagacacagcagcagcccc

SEQ ID NO: 1157898 - RNA, 23 nt, Human
ugcaaaacaccugagagagucca

SEQ ID NO: 1157899 - RNA, 23 nt, Human
ugccagcccugugagaagaggag

SEQ ID NO: 1157900 - RNA, 20 nt, Human
ugcccagcaacguuggagcc

SEQ ID NO: 1157901 - RNA, 21 nt, Human
ugccccaacuaaggcuauggc

SEQ ID NO: 1157902 - RNA, 19 nt, Human
ugccgugccguguccccuc

SEQ ID NO: 1157903 - RNA, 21 nt, Human
ugccuuagggggccacuuguu

SEQ ID NO: 1157904 - RNA, 19 nt, Human
ugcugcucuccugaugccc

SEQ ID NO: 1157905 - RNA, 20 nt, Human
ugcugcucuccugaugcccc

SEQ ID NO: 1157906 - RNA, 22 nt, Human
ugcuggggucagagugacgggg

SEQ ID NO: 1157907 - RNA, 18 nt, Human
ugcuuugucccccuucuc

SEQ ID NO: 1157908 - RNA, 19 nt, Human
uggacuggaggaagagcuu

SEQ ID NO: 1157909 - RNA, 21 nt, Human
uggaggaagagcuuuugacau

SEQ ID NO: 1157910 - RNA, 19 nt, Human
uggaugccaacagcugugg

SEQ ID NO: 1157911 - RNA, 19 nt, Human
uggcagccaccuggcccag

SEQ ID NO: 1157912 - RNA, 24 nt, Human
uggcaggugggucacagacacucu

SEQ ID NO: 1157913 - RNA, 23 nt, Human
uggcuucuggugccugcugaccu

SEQ ID NO: 1157914 - RNA, 21 nt, Human
ugggaaccaguugugcugggg

SEQ ID NO: 1157915 - RNA, 20 nt, Human
uggggacccgcaggggcagg

SEQ ID NO: 1157916 - RNA, 20 nt, Human
ugggggucuggggaggguug

SEQ ID NO: 1157917 - RNA, 21 nt, Human
ugggguacaaugugaggauuc

SEQ ID NO: 1157918 - RNA, 21 nt, Human
uggggugucauagugacagug

SEQ ID NO: 1157919 - RNA, 23 nt, Human
ugguagcgguggcagccaccugg

SEQ ID NO: 1157920 - RNA, 19 nt, Human
uggugagacgcccaugcug

SEQ ID NO: 1157921 - RNA, 24 nt, Human
uggugccugcugaccucuuggacu

SEQ ID NO: 1157922 - RNA, 25 nt, Human
ugugcuggggucagagugacggggg

SEQ ID NO: 1157923 - RNA, 26 nt, Human
uguggaaucagugagaugggauucaa

SEQ ID NO: 1157924 - RNA, 24 nt, Human
ugugguccccaaagugccuuaggg

SEQ ID NO: 1157925 - RNA, 25 nt, Human
ugugucugcagagcauucucgucga

SEQ ID NO: 1157926 - RNA, 18 nt, Human
ugugugcaccguggaaug

SEQ ID NO: 1157927 - RNA, 21 nt, Human
uguguuaaucaugcugagagg

SEQ ID NO: 1157928 - RNA, 21 nt, Human
uucauggguuccuaaggggcc

SEQ ID NO: 1157929 - RNA, 22 nt, Human
uucccaggaggaucccgaaggc

SEQ ID NO: 1157930 - RNA, 18 nt, Human
uuccucauccaaucuugg

SEQ ID NO: 1157931 - RNA, 21 nt, Human
uuccucugcccugccacuucc

SEQ ID NO: 1157932 - RNA, 22 nt, Human
uucgauagaugugugcaccgug

SEQ ID NO: 1157933 - RNA, 23 nt, Human
uucgcaaacucaaaucagacugc

SEQ ID NO: 1157934 - RNA, 26 nt, Human
uucuccugucuguacccugcuuccuc

SEQ ID NO: 1157935 - RNA, 23 nt, Human
uugaaaccugacaguggaugcca

SEQ ID NO: 1157936 - RNA, 22 nt, Human
uugcgcauggccucuccacacu

SEQ ID NO: 1157937 - RNA, 20 nt, Human
uugcugcucuccugaugccc

SEQ ID NO: 1157938 - RNA, 19 nt, Human
uuguaguagcauuggaaaa

SEQ ID NO: 1157939 - RNA, 23 nt, Human
uuuucagaaggaccagcggcccc

SEQ ID NO: 1157940 - RNA, 21 nt, Human
aaaaaacaaacaaacagacaa

SEQ ID NO: 1157941 - RNA, 23 nt, Human
aaacagacaaacacauauucuca

SEQ ID NO: 1157942 - RNA, 24 nt, Human
aaacagacaaacacauauucucag

SEQ ID NO: 1157943 - RNA, 25 nt, Human
aaacagacaaacacauauucucaga

SEQ ID NO: 1157944 - RNA, 20 nt, Human
aaacagacaaaccggacccc

SEQ ID NO: 1157945 - RNA, 24 nt, Human
aaacaggacaagugcauuuuccaa

SEQ ID NO: 1157946 - RNA, 20 nt, Human
aacaacacauauucucggcc

SEQ ID NO: 1157947 - RNA, 24 nt, Human
aacagcccagggaugaagaacaag

SEQ ID NO: 1157948 - RNA, 23 nt, Human
aacauccuggggaggcuccaggc

SEQ ID NO: 1157949 - RNA, 21 nt, Human
aauauggugaaacccugucuc

SEQ ID NO: 1157950 - RNA, 24 nt, Human
aaucacuugaaccugagaggcaga

SEQ ID NO: 1157951 - RNA, 18 nt, Human
acaaacaaacagacaaac

SEQ ID NO: 1157952 - RNA, 24 nt, Human
acaaagugagacucugucucaaaa

SEQ ID NO: 1157953 - RNA, 23 nt, Human
acacuuugauaggccaaggcggg

SEQ ID NO: 1157954 - RNA, 24 nt, Human
acccugucucuacuaaaaacacaa

SEQ ID NO: 1157955 - RNA, 18 nt, Human
acucaggaggcugaggca

SEQ ID NO: 1157956 - RNA, 30 nt, Human
acucugucucaaaaaacaaacaaacagacc

SEQ ID NO: 1157957 - RNA, 18 nt, Human
acugcacuccagccuggg

SEQ ID NO: 1157958 - RNA, 23 nt, Human
acugcacuccagccugggugaca

SEQ ID NO: 1157959 - RNA, 21 nt, Human
agaaucacuugaaccugagag

SEQ ID NO: 1157960 - RNA, 18 nt, Human
agagcuugcagugagcug

SEQ ID NO: 1157961 - RNA, 24 nt, Human
agagcuugcagugagcugagaucg

SEQ ID NO: 1157962 - RNA, 23 nt, Human
agccaggcauaguggcaggugcc

SEQ ID NO: 1157963 - RNA, 22 nt, Human
agccuggccaauauggugaaac

SEQ ID NO: 1157964 - RNA, 24 nt, Human
agccuggccaauauggugaaaccc

SEQ ID NO: 1157965 - RNA, 25 nt, Human
agccuggccaauauggugaaacccu

SEQ ID NO: 1157966 - RNA, 24 nt, Human
agccugggugacaaagugagacuc

SEQ ID NO: 1157967 - RNA, 23 nt, Human
aggaggcugaggcaggagaauca

SEQ ID NO: 1157968 - RNA, 20 nt, Human
aggcagagcuugcagugagc

SEQ ID NO: 1157969 - RNA, 24 nt, Human
aggcagagcuugcagugagcugag

SEQ ID NO: 1157970 - RNA, 22 nt, Human
aggcaggagaaucacuugaacc

SEQ ID NO: 1157971 - RNA, 24 nt, Human
aggcaggagaaucacuugaaccug

SEQ ID NO: 1157972 - RNA, 23 nt, Human
aggccaaggcgggcagaucacga

SEQ ID NO: 1157973 - RNA, 20 nt, Human
aggccucagaggaggaguca

SEQ ID NO: 1157974 - RNA, 25 nt, Human
aggcgggcagaucacgaggucagua

SEQ ID NO: 1157975 - RNA, 24 nt, Human
aggcugaggcaggagaaucacuug

SEQ ID NO: 1157976 - RNA, 24 nt, Human
aucgugccacugcacuccagccug

SEQ ID NO: 1157977 - RNA, 20 nt, Human
auggugaaacccugucucua

SEQ ID NO: 1157978 - RNA, 26 nt, Human
auuuuugugucucuaaaagcugaggg

SEQ ID NO: 1157979 - RNA, 25 nt, Human
caaacagacaaacacauauucucag

SEQ ID NO: 1157980 - RNA, 23 nt, Human
caaagaaacugaggucccaaaaa

SEQ ID NO: 1157981 - RNA, 24 nt, Human
caacacuuugauaggccaaggcgg

SEQ ID NO: 1157982 - RNA, 19 nt, Human
caacaugacuuuucagaua

SEQ ID NO: 1157983 - RNA, 24 nt, Human
caagccuguaaucccaacacuuug

SEQ ID NO: 1157984 - RNA, 24 nt, Human
caaggcgggcagaucacgagguca

SEQ ID NO: 1157985 - RNA, 22 nt, Human
cacuccagccugggugacaaag

SEQ ID NO: 1157986 - RNA, 23 nt, Human
cacuccagccugggugacaaagu

SEQ ID NO: 1157987 - RNA, 24 nt, Human
cacuccagccugggugacaaagug

SEQ ID NO: 1157988 - RNA, 19 nt, Human
cacugcacuccagccuggg

SEQ ID NO: 1157989 - RNA, 19 nt, Human
cacugcacuccagccuggg

SEQ ID NO: 1157990 - RNA, 22 nt, Human
cacugcacuccagccuggguga

SEQ ID NO: 1157991 - RNA, 23 nt, Human
cacugcacuccagccugggugac

SEQ ID NO: 1157992 - RNA, 24 nt, Human
cacugcacuccagccugggugaca

SEQ ID NO: 1157993 - RNA, 25 nt, Human
cacugcacuccagccugggugacaa

SEQ ID NO: 1157994 - RNA, 23 nt, Human
cacuuuuuccucuuuguagagca

SEQ ID NO: 1157995 - RNA, 23 nt, Human
cagacaaacacauauucucagaa

SEQ ID NO: 1157996 - RNA, 22 nt, Human
cagugaaaugaaguuucccucc

SEQ ID NO: 1157997 - RNA, 18 nt, Human
caguggaaagccugcaga

SEQ ID NO: 1157998 - RNA, 19 nt, Human
caucaggggccaaagagcu

SEQ ID NO: 1157999 - RNA, 18 nt, Human
ccacugcacuccagccug

SEQ ID NO: 1158000 - RNA, 20 nt, Human
ccacugcacuccagccuggg

SEQ ID NO: 1158001 - RNA, 20 nt, Human
ccacugcacuccagccuggg

SEQ ID NO: 1158002 - RNA, 20 nt, Human
ccacugcacuccagccuggg

SEQ ID NO: 1158003 - RNA, 20 nt, Human
ccacugcacuccagccuggg

SEQ ID NO: 1158004 - RNA, 21 nt, Human
ccacugcacuccagccugggu

SEQ ID NO: 1158005 - RNA, 23 nt, Human
ccacugcacuccagccuggguga

SEQ ID NO: 1158006 - RNA, 24 nt, Human
ccacugcacuccagccugggugac

SEQ ID NO: 1158007 - RNA, 25 nt, Human
cccacgaugacccgcagccuuccuu

SEQ ID NO: 1158008 - RNA, 19 nt, Human
cccagaaaggaagagacuu

SEQ ID NO: 1158009 - RNA, 26 nt, Human
cccgcagccuuccuuccccauucucu

SEQ ID NO: 1158010 - RNA, 21 nt, Human
ccuacagucccaucuacucag

SEQ ID NO: 1158011 - RNA, 22 nt, Human
ccuggccaauauggugaaaccc

SEQ ID NO: 1158012 - RNA, 24 nt, Human
ccuggccaauauggugaaacccug

SEQ ID NO: 1158013 - RNA, 22 nt, Human
ccugggugacaaagugagacuc

SEQ ID NO: 1158014 - RNA, 18 nt, Human
ccuuccuuccccauucuc

SEQ ID NO: 1158015 - RNA, 24 nt, Human
cgagaccagccuggccaauauggu

SEQ ID NO: 1158016 - RNA, 22 nt, Human
cgaggucaguaguucgagacca

SEQ ID NO: 1158017 - RNA, 19 nt, Human
cucaaaaaacaaacaaaca

SEQ ID NO: 1158018 - RNA, 24 nt, Human
cucaagccuguaaucccaacacuu

SEQ ID NO: 1158019 - RNA, 25 nt, Human
cucagaauaaaagcuccauuaaaaa

SEQ ID NO: 1158020 - RNA, 21 nt, Human
cuccaggccaacacaggccuc

SEQ ID NO: 1158021 - RNA, 22 nt, Human
cucccaacagcccagggaugaa

SEQ ID NO: 1158022 - RNA, 22 nt, Human
cucugucucaaaaaacaaacaa

SEQ ID NO: 1158023 - RNA, 23 nt, Human
cugagggccuuucucucccaacu

SEQ ID NO: 1158024 - RNA, 24 nt, Human
cuggccaauauggugaaacccugu

SEQ ID NO: 1158025 - RNA, 19 nt, Human
cugggcccgugugcagggu

SEQ ID NO: 1158026 - RNA, 24 nt, Human
cuugcagugagcugagaucgugcc

SEQ ID NO: 1158027 - RNA, 19 nt, Human
gaaacccugucucuacuaa

SEQ ID NO: 1158028 - RNA, 24 nt, Human
gacaaagugagacucugucucaaa

SEQ ID NO: 1158029 - RNA, 22 nt, Human
gacuaacaaagcccagaaagga

SEQ ID NO: 1158030 - RNA, 24 nt, Human
gagaggcagagcuugcagugagcu

SEQ ID NO: 1158031 - RNA, 23 nt, Human
gagaucgugccacugcacuccag

SEQ ID NO: 1158032 - RNA, 19 nt, Human
gcagaauauucuccaucag

SEQ ID NO: 1158033 - RNA, 19 nt, Human
gcagcagaaucagacauga

SEQ ID NO: 1158034 - RNA, 22 nt, Human
gcaggagaaucacuugaaccug

SEQ ID NO: 1158035 - RNA, 22 nt, Human
gcaguggaaagccugcagagcu

SEQ ID NO: 1158036 - RNA, 20 nt, Human
gcauuuguagaaccugaggc

SEQ ID NO: 1158037 - RNA, 24 nt, Human
gccaauauggugaaacccugucuc

SEQ ID NO: 1158038 - RNA, 19 nt, Human
gccacugcacuccagccug

SEQ ID NO: 1158039 - RNA, 24 nt, Human
gccacugcacuccagccuggguga

SEQ ID NO: 1158040 - RNA, 19 nt, Human
gccucccuucccacgauga

SEQ ID NO: 1158041 - RNA, 22 nt, Human
gcucugacuaacaaagcccaga

SEQ ID NO: 1158042 - RNA, 20 nt, Human
gcugagaucgugccacugca

SEQ ID NO: 1158043 - RNA, 23 nt, Human
ggcagaucacgaggucaguaguu

SEQ ID NO: 1158044 - RNA, 25 nt, Human
gggaggcuccaggccaacacaggcc

SEQ ID NO: 1158045 - RNA, 19 nt, Human
ggggagaagugggguggca

SEQ ID NO: 1158046 - RNA, 24 nt, Human
gggugcgguggcucaagccuguaa

SEQ ID NO: 1158047 - RNA, 23 nt, Human
gguggcucaagccuguaauccca

SEQ ID NO: 1158048 - RNA, 24 nt, Human
gugacaaagugagacucugucuca

SEQ ID NO: 1158049 - RNA, 21 nt, Human
uaaaaacacaaaaauuagcca

SEQ ID NO: 1158050 - RNA, 23 nt, Human
uaaaaagaaauuacuauagauua

SEQ ID NO: 1158051 - RNA, 22 nt, Human
uaaagguaccaggcagugacug

SEQ ID NO: 1158052 - RNA, 20 nt, Human
uaacaaagcccagaaaggaa

SEQ ID NO: 1158053 - RNA, 20 nt, Human
uacaaaacaggacaagugca

SEQ ID NO: 1158054 - RNA, 21 nt, Human
uacaaagaaacugagguccca

SEQ ID NO: 1158055 - RNA, 19 nt, Human
uacaggcaguggaaagccu

SEQ ID NO: 1158056 - RNA, 19 nt, Human
uaggauauuucucccagug

SEQ ID NO: 1158057 - RNA, 18 nt, Human
ucacgaggucaguaguuc

SEQ ID NO: 1158058 - RNA, 24 nt, Human
ucacgaggucaguaguucgagacc

SEQ ID NO: 1158059 - RNA, 21 nt, Human
uccaagugcuucuauagccac

SEQ ID NO: 1158060 - RNA, 23 nt, Human
uccagccugggugacaaagugag

SEQ ID NO: 1158061 - RNA, 24 nt, Human
uccagccugggugacaaagugaga

SEQ ID NO: 1158062 - RNA, 23 nt, Human
ucccaaaaauuaaaugauugacu

SEQ ID NO: 1158063 - RNA, 19 nt, Human
uccccauucucugugggga

SEQ ID NO: 1158064 - RNA, 21 nt, Human
uccccugcucugacuaacaaa

SEQ ID NO: 1158065 - RNA, 25 nt, Human
ucggccgggugcgguggcucaagcc

SEQ ID NO: 1158066 - RNA, 23 nt, Human
ucucaaaaaacaaacaaacagac

SEQ ID NO: 1158067 - RNA, 21 nt, Human
ucucuacuaaaaacacaaaaa

SEQ ID NO: 1158068 - RNA, 20 nt, Human
ucugccucagaccuuuuucu

SEQ ID NO: 1158069 - RNA, 20 nt, Human
ugacaaagugagacucuguc

SEQ ID NO: 1158070 - RNA, 22 nt, Human
ugacccgcagccuuccuucccc

SEQ ID NO: 1158071 - RNA, 18 nt, Human
ugacuuaauuagcagcag

SEQ ID NO: 1158072 - RNA, 22 nt, Human
ugagcugagaucgugccacugc

SEQ ID NO: 1158073 - RNA, 20 nt, Human
ugaggcaggagaaucacuug

SEQ ID NO: 1158074 - RNA, 24 nt, Human
ugaggcaggagaaucacuugaacc

SEQ ID NO: 1158075 - RNA, 25 nt, Human
ugaggcaggagaaucacuugaaccu

SEQ ID NO: 1158076 - RNA, 24 nt, Human
ugauaggccaaggcgggcagauca

SEQ ID NO: 1158077 - RNA, 20 nt, Human
ugccacgaaguuucuguaac

SEQ ID NO: 1158078 - RNA, 24 nt, Human
ugccucagaccuuuuucuugaucu

SEQ ID NO: 1158079 - RNA, 18 nt, Human
uggcaggugccuacaguc

SEQ ID NO: 1158080 - RNA, 24 nt, Human
uggccaauauggugaaacccuguc

SEQ ID NO: 1158081 - RNA, 24 nt, Human
uggcucaagccuguaaucccaaca

SEQ ID NO: 1158082 - RNA, 19 nt, Human
ugucucaucuguuccuccc

SEQ ID NO: 1158083 - RNA, 20 nt, Human
ugucucuaaaagcugagggc

SEQ ID NO: 1158084 - RNA, 24 nt, Human
uguuccggucaucaggggccaaga

SEQ ID NO: 1158085 - RNA, 24 nt, Human
uuacuuacaaagaaacugaggucc

SEQ ID NO: 1158086 - RNA, 22 nt, Human
uuauauaaaaagaaauuacuau

SEQ ID NO: 1158087 - RNA, 19 nt, Human
uucuugaucugaugcucau

SEQ ID NO: 1158088 - RNA, 18 nt, Human
uugcagugagcugagauc

SEQ ID NO: 1158089 - RNA, 21 nt, Human
uugcagugagcugagaucgug

SEQ ID NO: 1158090 - RNA, 22 nt, Human
uugcagugagcugagaucgugc

SEQ ID NO: 1158091 - RNA, 22 nt, Human
uuuuacuuacaaagaaacugag

SEQ ID NO: 1158092 - RNA, 21 nt, Human
uuuuguuguguguuuccuggc

SEQ ID NO: 1158093 - RNA, 18 nt, Human
aaaaauuggugaaauaua

SEQ ID NO: 1158094 - RNA, 19 nt, Human
aaagaagagauuaacacug

SEQ ID NO: 1158095 - RNA, 18 nt, Human
aaagugcugggauuacaa

SEQ ID NO: 1158096 - RNA, 22 nt, Human
aaauacgacucucauccauacc

SEQ ID NO: 1158097 - RNA, 18 nt, Human
aaauauccagggucccuc

SEQ ID NO: 1158098 - RNA, 18 nt, Human
aacaagagaaaucaaagc

SEQ ID NO: 1158099 - RNA, 19 nt, Human
aacagcuuugacagaaugu

SEQ ID NO: 1158100 - RNA, 19 nt, Human
aaccacaaaugauccagcc

SEQ ID NO: 1158101 - RNA, 22 nt, Human
aacugugagccaauuaaaccuc

SEQ ID NO: 1158102 - RNA, 23 nt, Human
aagaaaaaaaucugcacccugcc

SEQ ID NO: 1158103 - RNA, 20 nt, Human
aagaaagaggaugucccagu

SEQ ID NO: 1158104 - RNA, 21 nt, Human
aaggaaauucacuguaguuaa

SEQ ID NO: 1158105 - RNA, 19 nt, Human
aagugcugggauuacaagc

SEQ ID NO: 1158106 - RNA, 26 nt, Human
aagugcugggauuacaagcacgagcc

SEQ ID NO: 1158107 - RNA, 23 nt, Human
acaaagaaagcgugaaaaauauc

SEQ ID NO: 1158108 - RNA, 19 nt, Human
acaagaaaagaagcaggga

SEQ ID NO: 1158109 - RNA, 21 nt, Human
acaggaacuucaagcucuucu

SEQ ID NO: 1158110 - RNA, 21 nt, Human
acaggaucugaugaucagaca

SEQ ID NO: 1158111 - RNA, 18 nt, Human
accaaacagauucacaga

SEQ ID NO: 1158112 - RNA, 24 nt, Human
accaccaaagacucaauaagaaag

SEQ ID NO: 1158113 - RNA, 24 nt, Human
acccaggcuggagugcaguggcau

SEQ ID NO: 1158114 - RNA, 19 nt, Human
acccugagaaacuuugggu

SEQ ID NO: 1158115 - RNA, 21 nt, Human
acgguaaacuuuguguuugug

SEQ ID NO: 1158116 - RNA, 20 nt, Human
acuucaagcucuucuccuuu

SEQ ID NO: 1158117 - RNA, 21 nt, Human
acuuuggugcuguucucauga

SEQ ID NO: 1158118 - RNA, 23 nt, Human
agaacagcaccuucaaccacaaa

SEQ ID NO: 1158119 - RNA, 25 nt, Human
agaacccaaguagaugucagcauca

SEQ ID NO: 1158120 - RNA, 18 nt, Human
agaagaaacaaagaaagc

SEQ ID NO: 1158121 - RNA, 18 nt, Human
agaagaaacaaagaaagc

SEQ ID NO: 1158122 - RNA, 21 nt, Human
agaccaaccaccaaagacuca

SEQ ID NO: 1158123 - RNA, 18 nt, Human
agagaagaaacaaagaaa

SEQ ID NO: 1158124 - RNA, 18 nt, Human
agcuucuauucauccuuc

SEQ ID NO: 1158125 - RNA, 23 nt, Human
aggaacaaagaaggauugcugac

SEQ ID NO: 1158126 - RNA, 23 nt, Human
aggauggaggagauggagaagga

SEQ ID NO: 1158127 - RNA, 21 nt, Human
aggcaaauauccagggucccu

SEQ ID NO: 1158128 - RNA, 25 nt, Human
aggcuggagugcaguggcaugaucu

SEQ ID NO: 1158129 - RNA, 22 nt, Human
agggaggcaccaggggagaagc

SEQ ID NO: 1158130 - RNA, 21 nt, Human
agguguuucuuuauagcagug

SEQ ID NO: 1158131 - RNA, 19 nt, Human
agucugcagguggcaugca

SEQ ID NO: 1158132 - RNA, 20 nt, Human
agugcaguggcaugaucucg

SEQ ID NO: 1158133 - RNA, 23 nt, Human
agugcaguggcaugaucucggcu

SEQ ID NO: 1158134 - RNA, 24 nt, Human
agugcaguggcaugaucucggcuc

SEQ ID NO: 1158135 - RNA, 18 nt, Human
agugcugggauuacaagc

SEQ ID NO: 1158136 - RNA, 24 nt, Human
aguggcaugaucucggcucacugc

SEQ ID NO: 1158137 - RNA, 22 nt, Human
auagaauauaugccagauuccc

SEQ ID NO: 1158138 - RNA, 20 nt, Human
aucucagacacauacuagga

SEQ ID NO: 1158139 - RNA, 18 nt, Human
augaggaacaaagaagga

SEQ ID NO: 1158140 - RNA, 23 nt, Human
auggaaggaaccaaggagagggg

SEQ ID NO: 1158141 - RNA, 23 nt, Human
augggacaagaaaagaagcaggg

SEQ ID NO: 1158142 - RNA, 24 nt, Human
augggacaagaaaagaagcaggga

SEQ ID NO: 1158143 - RNA, 25 nt, Human
augggacaagaaaagaagcagggag

SEQ ID NO: 1158144 - RNA, 24 nt, Human
augucuggagacauuuuugauugu

SEQ ID NO: 1158145 - RNA, 21 nt, Human
auucaggucagcugauccaau

SEQ ID NO: 1158146 - RNA, 21 nt, Human
auucuccugccucagccuccc

SEQ ID NO: 1158147 - RNA, 18 nt, Human
caaagccaggauaccacc

SEQ ID NO: 1158148 - RNA, 23 nt, Human
caaagugcugggauuacaagcac

SEQ ID NO: 1158149 - RNA, 24 nt, Human
caaagugcugggauuacaagcacg

SEQ ID NO: 1158150 - RNA, 19 nt, Human
caagcccggggagggagau

SEQ ID NO: 1158151 - RNA, 24 nt, Human
caagcucuucuccuuuccagccuc

SEQ ID NO: 1158152 - RNA, 20 nt, Human
cacaagggccuuggugcugc

SEQ ID NO: 1158153 - RNA, 23 nt, Human
cacccugcccaacucaucccgaa

SEQ ID NO: 1158154 - RNA, 18 nt, Human
caccguguuagccaggau

SEQ ID NO: 1158155 - RNA, 24 nt, Human
caccguguuagccaggauggucuc

SEQ ID NO: 1158156 - RNA, 20 nt, Human
caccucaaacuccucaccau

SEQ ID NO: 1158157 - RNA, 22 nt, Human
cacgccauucuccugccucagc

SEQ ID NO: 1158158 - RNA, 24 nt, Human
cacuguaguuaauacuuugaaaua

SEQ ID NO: 1158159 - RNA, 24 nt, Human
cagaaaaagagucaauucuuggca

SEQ ID NO: 1158160 - RNA, 26 nt, Human
cagaacccaaguagaugucagcauca

SEQ ID NO: 1158161 - RNA, 22 nt, Human
cagauguccucacaagggccuu

SEQ ID NO: 1158162 - RNA, 27 nt, Human
cagcuggcuaauuuuuuuguauuuuca

SEQ ID NO: 1158163 - RNA, 21 nt, Human
caggaacuucaagcucuucuc

SEQ ID NO: 1158164 - RNA, 24 nt, Human
caguagagacaguguuucaccgug

SEQ ID NO: 1158165 - RNA, 25 nt, Human
caguagagacaguguuucaccgugu

SEQ ID NO: 1158166 - RNA, 19 nt, Human
caguaugcaccccaaaacu

SEQ ID NO: 1158167 - RNA, 24 nt, Human
caguguuucaccguguuagccagg

SEQ ID NO: 1158168 - RNA, 23 nt, Human
cauuuaauaccacuaagcugcac

SEQ ID NO: 1158169 - RNA, 25 nt, Human
cauuuuugauugucacaacugggag

SEQ ID NO: 1158170 - RNA, 24 nt, Human
ccaaaacguaauaucuauguguuc

SEQ ID NO: 1158171 - RNA, 23 nt, Human
ccaaacagauucacagaaucuaa

SEQ ID NO: 1158172 - RNA, 19 nt, Human
ccaaagugcugggauuaca

SEQ ID NO: 1158173 - RNA, 20 nt, Human
ccaaccaccaaagacucaau

SEQ ID NO: 1158174 - RNA, 22 nt, Human
ccaacucaucccgaacaagccc

SEQ ID NO: 1158175 - RNA, 19 nt, Human
ccaagacaggccugaggca

SEQ ID NO: 1158176 - RNA, 22 nt, Human
ccaggauggaggagauggagaa

SEQ ID NO: 1158177 - RNA, 22 nt, Human
ccauuggcaccuagaacaccca

SEQ ID NO: 1158178 - RNA, 21 nt, Human
cccccaggggacauuuggcua

SEQ ID NO: 1158179 - RNA, 20 nt, Human
cccccucuucuuccuacucc

SEQ ID NO: 1158180 - RNA, 26 nt, Human
ccccgccccaccacacgaaggucggc

SEQ ID NO: 1158181 - RNA, 19 nt, Human
ccccucuucuuccuacucc

SEQ ID NO: 1158182 - RNA, 24 nt, Human
ccccucuucuuccuacuccugcca

SEQ ID NO: 1158183 - RNA, 24 nt, Human
cccgauuagcugggacuacaggcg

SEQ ID NO: 1158184 - RNA, 18 nt, Human
cccgccccaccacacgag

SEQ ID NO: 1158185 - RNA, 23 nt, Human
cccuuccccaggcagagcccuag

SEQ ID NO: 1158186 - RNA, 19 nt, Human
ccgauuagcugggacuaca

SEQ ID NO: 1158187 - RNA, 24 nt, Human
ccgccucagccucccaaagugcug

SEQ ID NO: 1158188 - RNA, 22 nt, Human
ccuacucaggauuuuagccacc

SEQ ID NO: 1158189 - RNA, 24 nt, Human
ccuagaacacccauugcccccagg

SEQ ID NO: 1158190 - RNA, 19 nt, Human
ccuauaaucauucauucgu

SEQ ID NO: 1158191 - RNA, 20 nt, Human
ccucacaagggccuuggugc

SEQ ID NO: 1158192 - RNA, 19 nt, Human
ccucaccauuucucaagua

SEQ ID NO: 1158193 - RNA, 20 nt, Human
ccugaccccgugaucugccc

SEQ ID NO: 1158194 - RNA, 23 nt, Human
ccugccucagccucccgauuagc

SEQ ID NO: 1158195 - RNA, 22 nt, Human
ccuuccccaggcagagcccuag

SEQ ID NO: 1158196 - RNA, 24 nt, Human
cgccucagccucccaaagugcugg

SEQ ID NO: 1158197 - RNA, 24 nt, Human
cgcucugucacccaggcuggagug

SEQ ID NO: 1158198 - RNA, 21 nt, Human
cuacuccugccauguaagaug

SEQ ID NO: 1158199 - RNA, 22 nt, Human
cuagaccaaaguggagaguaaa

SEQ ID NO: 1158200 - RNA, 22 nt, Human
cuauguuauacagaacagcacc

SEQ ID NO: 1158201 - RNA, 18 nt, Human
cucaccauuucucaagua

SEQ ID NO: 1158202 - RNA, 24 nt, Human
cuccugaccccgugaucugcccgc

SEQ ID NO: 1158203 - RNA, 25 nt, Human
cuccugccucagccucccgauuagc

SEQ ID NO: 1158204 - RNA, 21 nt, Human
cucgcucugucacccaggcug

SEQ ID NO: 1158205 - RNA, 24 nt, Human
cucgcucugucacccaggcuggag

SEQ ID NO: 1158206 - RNA, 24 nt, Human
cugacacagaccaaccaccaaaga

SEQ ID NO: 1158207 - RNA, 21 nt, Human
cugccuaagucccccuggauc

SEQ ID NO: 1158208 - RNA, 23 nt, Human
cugccucagccucccgauuagcu

SEQ ID NO: 1158209 - RNA, 24 nt, Human
cuggagugcaguggcaugaucucg

SEQ ID NO: 1158210 - RNA, 20 nt, Human
cuggcuaauuuuuuuguauu

SEQ ID NO: 1158211 - RNA, 21 nt, Human
cuugacccccuuggucccucc

SEQ ID NO: 1158212 - RNA, 20 nt, Human
cuuggcauuuuuucaaaagu

SEQ ID NO: 1158213 - RNA, 18 nt, Human
gaaccaaggagaggggga

SEQ ID NO: 1158214 - RNA, 18 nt, Human
gaaggaaccaaggagagg

SEQ ID NO: 1158215 - RNA, 23 nt, Human
gacuacaggcgcccgccacugca

SEQ ID NO: 1158216 - RNA, 26 nt, Human
gagaagaaacaaagaaagcgugaaaa

SEQ ID NO: 1158217 - RNA, 19 nt, Human
gagguaauggcaggcuagg

SEQ ID NO: 1158218 - RNA, 20 nt, Human
gauacaauuaucccaucucu

SEQ ID NO: 1158219 - RNA, 18 nt, Human
gauccagcccaaaaugcc

SEQ ID NO: 1158220 - RNA, 21 nt, Human
gcacaacccuggagggaaacc

SEQ ID NO: 1158221 - RNA, 21 nt, Human
gcacccugcccaacucauccc

SEQ ID NO: 1158222 - RNA, 23 nt, Human
gcaccuucaaccacaaaugaucc

SEQ ID NO: 1158223 - RNA, 22 nt, Human
gccaccucaaacuccucaccau

SEQ ID NO: 1158224 - RNA, 24 nt, Human
gcccaguguggugugugagcagca

SEQ ID NO: 1158225 - RNA, 21 nt, Human
gcccuagggaggcaccagggg

SEQ ID NO: 1158226 - RNA, 25 nt, Human
gcucugucacccaggcuggagugca

SEQ ID NO: 1158227 - RNA, 21 nt, Human
gcucuucuccuuuccagccuc

SEQ ID NO: 1158228 - RNA, 19 nt, Human
gcuggagugcaguggcaug

SEQ ID NO: 1158229 - RNA, 23 nt, Human
gcuggcuaauuuuuuuguauuuu

SEQ ID NO: 1158230 - RNA, 20 nt, Human
ggacaagaaaagaagcaggg

SEQ ID NO: 1158231 - RNA, 21 nt, Human
ggagagggggacacaugagga

SEQ ID NO: 1158232 - RNA, 19 nt, Human
ggggagggagaugaugagg

SEQ ID NO: 1158233 - RNA, 23 nt, Human
gguacagggaucuauaagaaaaa

SEQ ID NO: 1158234 - RNA, 20 nt, Human
guaaagcaaaguauauguag

SEQ ID NO: 1158235 - RNA, 20 nt, Human
gucaggaaugcugcuaaaca

SEQ ID NO: 1158236 - RNA, 20 nt, Human
gucaggaaugcugcuaaaca

SEQ ID NO: 1158237 - RNA, 24 nt, Human
gucucgcucugucacccaggcugg

SEQ ID NO: 1158238 - RNA, 22 nt, Human
gucuggagacauuuuugauugu

SEQ ID NO: 1158239 - RNA, 24 nt, Human
gugaucugcccgccucagccuccc

SEQ ID NO: 1158240 - RNA, 19 nt, Human
guggcacuucccccccccu

SEQ ID NO: 1158241 - RNA, 22 nt, Human
guguacagauuacugcuggcug

SEQ ID NO: 1158242 - RNA, 24 nt, Human
uaaaagauccuucuucuauaagag

SEQ ID NO: 1158243 - RNA, 21 nt, Human
uaaaccacaacagauguccuc

SEQ ID NO: 1158244 - RNA, 19 nt, Human
uaaagauuuccuagaccaa

SEQ ID NO: 1158245 - RNA, 22 nt, Human
uaagaaaaaaaucugcacccug

SEQ ID NO: 1158246 - RNA, 23 nt, Human
uaagcugcacaauuaaaaauggg

SEQ ID NO: 1158247 - RNA, 23 nt, Human
uacaagcacgagccaccgcgccc

SEQ ID NO: 1158248 - RNA, 20 nt, Human
uaccuuugcacaugcugucu

SEQ ID NO: 1158249 - RNA, 19 nt, Human
uagaacacccauugccccc

SEQ ID NO: 1158250 - RNA, 23 nt, Human
uagaacacccauugcccccaggg

SEQ ID NO: 1158251 - RNA, 20 nt, Human
uagauugaugauaaaccaca

SEQ ID NO: 1158252 - RNA, 20 nt, Human
uagccaccucaaacuccuca

SEQ ID NO: 1158253 - RNA, 21 nt, Human
uauaagaaaaaaaucugcacc

SEQ ID NO: 1158254 - RNA, 19 nt, Human
uaugcaaaguccaucacaa

SEQ ID NO: 1158255 - RNA, 19 nt, Human
uaugggacaagaaaagaag

SEQ ID NO: 1158256 - RNA, 19 nt, Human
uauucauccuucaaaaucc

SEQ ID NO: 1158257 - RNA, 19 nt, Human
ucaaaaguccuuagggagg

SEQ ID NO: 1158258 - RNA, 23 nt, Human
ucaaacuccucaccauuucucaa

SEQ ID NO: 1158259 - RNA, 22 nt, Human
ucaaauuguaauccccaguguu

SEQ ID NO: 1158260 - RNA, 18 nt, Human
ucaaccacaaaugaucca

SEQ ID NO: 1158261 - RNA, 28 nt, Human
ucaagcucuucuccuuuccagccuccuu

SEQ ID NO: 1158262 - RNA, 21 nt, Human
ucacagaaucuaagaguggag

SEQ ID NO: 1158263 - RNA, 24 nt, Human
ucacccaggcuggagugcaguggc

SEQ ID NO: 1158264 - RNA, 24 nt, Human
ucaccguguuagccaggauggucu

SEQ ID NO: 1158265 - RNA, 18 nt, Human
ucacugcaagcuccaccu

SEQ ID NO: 1158266 - RNA, 19 nt, Human
ucacugcaagcuccaccug

SEQ ID NO: 1158267 - RNA, 24 nt, Human
ucacugcaagcuccaccugccgga

SEQ ID NO: 1158268 - RNA, 19 nt, Human
ucacuguaguuaauacuuu

SEQ ID NO: 1158269 - RNA, 19 nt, Human
ucagacacauacuaggaac

SEQ ID NO: 1158270 - RNA, 22 nt, Human
ucagggauaaugcagaaaaaga

SEQ ID NO: 1158271 - RNA, 22 nt, Human
ucaguagagacaguguuucacc

SEQ ID NO: 1158272 - RNA, 24 nt, Human
ucaguagagacaguguuucaccgu

SEQ ID NO: 1158273 - RNA, 18 nt, Human
ucccaaagugcugggauu

SEQ ID NO: 1158274 - RNA, 24 nt, Human
ucccaaagugcugggauuacaagc

SEQ ID NO: 1158275 - RNA, 21 nt, Human
uccccaggggacauuuggcua

SEQ ID NO: 1158276 - RNA, 22 nt, Human
ucccgaacaagcccggggaggg

SEQ ID NO: 1158277 - RNA, 24 nt, Human
ucccgauuagcugggacuacaggc

SEQ ID NO: 1158278 - RNA, 19 nt, Human
ucccucauggcccagugug

SEQ ID NO: 1158279 - RNA, 20 nt, Human
uccuucaugaaugguuuagc

SEQ ID NO: 1158280 - RNA, 24 nt, Human
ucgcucugucacccaggcuggagu

SEQ ID NO: 1158281 - RNA, 18 nt, Human
ucuaggugccaaaaaaca

SEQ ID NO: 1158282 - RNA, 18 nt, Human
ucucaaguacccugaccc

SEQ ID NO: 1158283 - RNA, 23 nt, Human
ucucaaguacccugacccuuuug

SEQ ID NO: 1158284 - RNA, 19 nt, Human
ucucaggagaucugguugu

SEQ ID NO: 1158285 - RNA, 19 nt, Human
ucucgcucugucacccagg

SEQ ID NO: 1158286 - RNA, 23 nt, Human
ucucgcucugucacccaggcugg

SEQ ID NO: 1158287 - RNA, 24 nt, Human
ucucgcucugucacccaggcugga

SEQ ID NO: 1158288 - RNA, 26 nt, Human
ucucgcucugucacccaggcuggagu

SEQ ID NO: 1158289 - RNA, 23 nt, Human
ucugccaugauuguaaguauccu

SEQ ID NO: 1158290 - RNA, 21 nt, Human
ucugcccgccucagccuccca

SEQ ID NO: 1158291 - RNA, 24 nt, Human
ucugucacccaggcuggagugcag

SEQ ID NO: 1158292 - RNA, 22 nt, Human
ugaaacuauuuuugugucccca

SEQ ID NO: 1158293 - RNA, 23 nt, Human
ugacacagaccaaccaccaaaga

SEQ ID NO: 1158294 - RNA, 18 nt, Human
ugagaaacuuuggguugc

SEQ ID NO: 1158295 - RNA, 22 nt, Human
ugagauggagucucgcucuguc

SEQ ID NO: 1158296 - RNA, 18 nt, Human
ugauaagacuuaaguuuc

SEQ ID NO: 1158297 - RNA, 21 nt, Human
ugauccaauagagaguugcug

SEQ ID NO: 1158298 - RNA, 20 nt, Human
ugaugacaaagccaggauac

SEQ ID NO: 1158299 - RNA, 19 nt, Human
ugcaaaguccaucacaaga

SEQ ID NO: 1158300 - RNA, 21 nt, Human
ugcagaaaaagagucaauucu

SEQ ID NO: 1158301 - RNA, 27 nt, Human
ugcauggaaggaaccaaggagaggggg

SEQ ID NO: 1158302 - RNA, 23 nt, Human
ugccagauucccugcaguauucc

SEQ ID NO: 1158303 - RNA, 24 nt, Human
ugccucagccucccgauuagcugg

SEQ ID NO: 1158304 - RNA, 24 nt, Human
ugccugcuuccccuucaccuucug

SEQ ID NO: 1158305 - RNA, 19 nt, Human
ugcuaagaauucaggucag

SEQ ID NO: 1158306 - RNA, 24 nt, Human
ugcugggauuacaagcacgagcca

SEQ ID NO: 1158307 - RNA, 19 nt, Human
uggagugcaguggcaugau

SEQ ID NO: 1158308 - RNA, 24 nt, Human
uggagugcaguggcaugaucucgg

SEQ ID NO: 1158309 - RNA, 26 nt, Human
uggcacuucccccccccucuucuucc

SEQ ID NO: 1158310 - RNA, 20 nt, Human
ugggacaagaaaagaagcag

SEQ ID NO: 1158311 - RNA, 21 nt, Human
ugggacuacaggcgcccgcca

SEQ ID NO: 1158312 - RNA, 22 nt, Human
ugggacuacaggcgcccgccac

SEQ ID NO: 1158313 - RNA, 22 nt, Human
ugggacuacaggcgcccgccac

SEQ ID NO: 1158314 - RNA, 24 nt, Human
ugggacuacaggcgcccgccacug

SEQ ID NO: 1158315 - RNA, 21 nt, Human
ugggagcagggaugcuacugg

SEQ ID NO: 1158316 - RNA, 21 nt, Human
ugggauuacaagcacgagcca

SEQ ID NO: 1158317 - RNA, 22 nt, Human
ugggauuacaagcacgagccac

SEQ ID NO: 1158318 - RNA, 23 nt, Human
ugggauuacaagcacgagccacc

SEQ ID NO: 1158319 - RNA, 24 nt, Human
ugggauuacaagcacgagccaccg

SEQ ID NO: 1158320 - RNA, 24 nt, Human
ugggauuacaagcacgagccaccg

SEQ ID NO: 1158321 - RNA, 24 nt, Human
uggguaaagauuuccuagaccaaa

SEQ ID NO: 1158322 - RNA, 21 nt, Human
uggguugcacuggucccagca

SEQ ID NO: 1158323 - RNA, 21 nt, Human
uggugcuguucucaugauggu

SEQ ID NO: 1158324 - RNA, 24 nt, Human
uguaaguauccugaggucucccca

SEQ ID NO: 1158325 - RNA, 22 nt, Human
uguaugcaaaguccaucacaag

SEQ ID NO: 1158326 - RNA, 22 nt, Human
ugugaccauuggcaccuagaac

SEQ ID NO: 1158327 - RNA, 22 nt, Human
uguggggagaguagacuauggg

SEQ ID NO: 1158328 - RNA, 23 nt, Human
uuagaacugugguucucaacuag

SEQ ID NO: 1158329 - RNA, 23 nt, Human
uucauuguaaguuuccacagugc

SEQ ID NO: 1158330 - RNA, 21 nt, Human
uugaaacuucauuguaaguuu

SEQ ID NO: 1158331 - RNA, 21 nt, Human
uuggagcacaacccuggaggg

SEQ ID NO: 1158332 - RNA, 23 nt, Human
uuggagcacaacccuggagggaa

SEQ ID NO: 1158333 - RNA, 20 nt, Human
uuggucccuccucagucagg

SEQ ID NO: 1158334 - RNA, 19 nt, Human
uuucaccguguuagccagg

SEQ ID NO: 1158335 - RNA, 24 nt, Human
uuugguuguguccccgcccaaauc

SEQ ID NO: 1158336 - RNA, 24 nt, Human
uuuucaguagagacaguguuucac

SEQ ID NO: 1158337 - RNA, 21 nt, Human
uuuuuuguauuuucaguagag

SEQ ID NO: 1158338 - RNA, 24 nt, Human
uuuuuuguauuuucaguagagaca

SEQ ID NO: 1158339 - RNA, 25 nt, Human
uuuuuuuuuuuugagauggagucuc

SEQ ID NO: 1158340 - RNA, 22 nt, Human
uuuuuuuuuuuuuugagaugga

SEQ ID NO: 1158341 - RNA, 20 nt, Human
uuuuuuuuuuuuuuuuuugg

SEQ ID NO: 1158342 - RNA, 27 nt, Human
aaaaggagacagguuaaaaucauccaa

SEQ ID NO: 1158343 - RNA, 18 nt, Human
agcagcucuucuugcccu

SEQ ID NO: 1158344 - RNA, 20 nt, Human
agcucccccauccauucccc

SEQ ID NO: 1158345 - RNA, 23 nt, Human
agcucuccucccucagcuccccc

SEQ ID NO: 1158346 - RNA, 22 nt, Human
aguucagacucauuagccuucc

SEQ ID NO: 1158347 - RNA, 19 nt, Human
cagcucuucuugcccugcc

SEQ ID NO: 1158348 - RNA, 22 nt, Human
cauuccccucugcagucggaag

SEQ ID NO: 1158349 - RNA, 24 nt, Human
cauuccccucugcagucggaaguc

SEQ ID NO: 1158350 - RNA, 26 nt, Human
ccauggucuuccugcuucagcucucc

SEQ ID NO: 1158351 - RNA, 18 nt, Human
ccccauccauuccccucu

SEQ ID NO: 1158352 - RNA, 23 nt, Human
cccucagcucccccauccauucc

SEQ ID NO: 1158353 - RNA, 19 nt, Human
ccuggccacucuuugccau

SEQ ID NO: 1158354 - RNA, 19 nt, Human
ccuguuugacucucuguga

SEQ ID NO: 1158355 - RNA, 18 nt, Human
cucuucuugcccugcccc

SEQ ID NO: 1158356 - RNA, 21 nt, Human
gcagcucuucuugcccugccc

SEQ ID NO: 1158357 - RNA, 24 nt, Human
gcucuccucccucagcucccccau

SEQ ID NO: 1158358 - RNA, 22 nt, Human
ggacucacaaaaauuagaaaag

SEQ ID NO: 1158359 - RNA, 18 nt, Human
ggcuuggugacagguugg

SEQ ID NO: 1158360 - RNA, 23 nt, Human
ggggagucacuuggauagcacug

SEQ ID NO: 1158361 - RNA, 24 nt, Human
gugguguggaugacggcagcugac

SEQ ID NO: 1158362 - RNA, 26 nt, Human
uacauuugaccuuaucaugucagcuc

SEQ ID NO: 1158363 - RNA, 23 nt, Human
uagccuuccaggaaaagcagcuc

SEQ ID NO: 1158364 - RNA, 24 nt, Human
uaggucggaguccaggaagacacc

SEQ ID NO: 1158365 - RNA, 18 nt, Human
uauaacgauuaccuccag

SEQ ID NO: 1158366 - RNA, 20 nt, Human
ucacaaaaauuagaaaagcu

SEQ ID NO: 1158367 - RNA, 23 nt, Human
ucacuugagggacucacaaaaau

SEQ ID NO: 1158368 - RNA, 21 nt, Human
ucagcucuccucccucagcuc

SEQ ID NO: 1158369 - RNA, 26 nt, Human
ucagcucuccucccucagcuccccca

SEQ ID NO: 1158370 - RNA, 18 nt, Human
ucaugguuaugguucauu

SEQ ID NO: 1158371 - RNA, 21 nt, Human
ucccucagcucccccauccau

SEQ ID NO: 1158372 - RNA, 21 nt, Human
uccucccucagcucccccauc

SEQ ID NO: 1158373 - RNA, 24 nt, Human
uccugcuucagcucuccucccuca

SEQ ID NO: 1158374 - RNA, 19 nt, Human
ucggaagucuucuagaggu

SEQ ID NO: 1158375 - RNA, 22 nt, Human
ucugugaugggggucccaaaac

SEQ ID NO: 1158376 - RNA, 18 nt, Human
ugacggcagcugacaugg

SEQ ID NO: 1158377 - RNA, 23 nt, Human
ugagggacucacaaaaauuagaa

SEQ ID NO: 1158378 - RNA, 20 nt, Human
ugccccuguuugacucucug

SEQ ID NO: 1158379 - RNA, 22 nt, Human
ugguucagccaucucuuuccag

SEQ ID NO: 1158380 - RNA, 23 nt, Human
uucacucagaaggccuggccacu

SEQ ID NO: 1158381 - RNA, 24 nt, Human
uucauugcagcaaaaggagacagg

SEQ ID NO: 1158382 - RNA, 22 nt, Human
uuccaggaaaagcagcucuucu

SEQ ID NO: 1158383 - RNA, 23 nt, Human
uuugccaugucugaucuguggug

SEQ ID NO: 1158384 - RNA, 24 nt, Human
aaaaagcacuuauugguacacagu

SEQ ID NO: 1158385 - RNA, 20 nt, Human
aaacaggagagguggugggg

SEQ ID NO: 1158386 - RNA, 21 nt, Human
aaacgacaaagugcacagacc

SEQ ID NO: 1158387 - RNA, 18 nt, Human
aaagcacuacccuccuuc

SEQ ID NO: 1158388 - RNA, 22 nt, Human
aaagugcugggauuacaggcau

SEQ ID NO: 1158389 - RNA, 23 nt, Human
aaagugcugggauuacaggcaug

SEQ ID NO: 1158390 - RNA, 24 nt, Human
aaagugcugggauuacaggcauga

SEQ ID NO: 1158391 - RNA, 20 nt, Human
aaccuccaccuccugggcuc

SEQ ID NO: 1158392 - RNA, 18 nt, Human
aagacuucaagacuaacc

SEQ ID NO: 1158393 - RNA, 21 nt, Human
aagcacuacccuccuucagga

SEQ ID NO: 1158394 - RNA, 25 nt, Human
aagcaguccucccacuucggccucc

SEQ ID NO: 1158395 - RNA, 19 nt, Human
aaggaagagccacagauac

SEQ ID NO: 1158396 - RNA, 19 nt, Human
aagugcugggauuacaggc

SEQ ID NO: 1158397 - RNA, 21 nt, Human
aagugcugggauuacaggcau

SEQ ID NO: 1158398 - RNA, 26 nt, Human
aagugcugggauuacaggcaugaacc

SEQ ID NO: 1158399 - RNA, 19 nt, Human
aaugcaguggugcagucuc

SEQ ID NO: 1158400 - RNA, 26 nt, Human
acacaauccaauccauuaccaauacc

SEQ ID NO: 1158401 - RNA, 23 nt, Human
acagaggacaggcuuacagccca

SEQ ID NO: 1158402 - RNA, 25 nt, Human
accacccacauaagcacagaggaca

SEQ ID NO: 1158403 - RNA, 22 nt, Human
accauguuucccaggcuggucu

SEQ ID NO: 1158404 - RNA, 22 nt, Human
accauguuucccaggcuggucu

SEQ ID NO: 1158405 - RNA, 18 nt, Human
acccccagagcaugggaa

SEQ ID NO: 1158406 - RNA, 20 nt, Human
acgccgcaggcaggaaggcc

SEQ ID NO: 1158407 - RNA, 24 nt, Human
acugcacacagauguuugcaagug

SEQ ID NO: 1158408 - RNA, 20 nt, Human
agaaauagcugagcaaagag

SEQ ID NO: 1158409 - RNA, 22 nt, Human
agaagggcaagcgcagacuaga

SEQ ID NO: 1158410 - RNA, 21 nt, Human
agaaguaaacagaaacaguca

SEQ ID NO: 1158411 - RNA, 18 nt, Human
agaauggauggaccuugg

SEQ ID NO: 1158412 - RNA, 18 nt, Human
agacagggucuuaccaug

SEQ ID NO: 1158413 - RNA, 19 nt, Human
agaggcuaugucuagugcg

SEQ ID NO: 1158414 - RNA, 19 nt, Human
agagggagaaguaaacaga

SEQ ID NO: 1158415 - RNA, 21 nt, Human
agaggugguggggcauggcuc

SEQ ID NO: 1158416 - RNA, 18 nt, Human
agcucugggcuggccaug

SEQ ID NO: 1158417 - RNA, 22 nt, Human
agcuggccuggcgcagugaugc

SEQ ID NO: 1158418 - RNA, 18 nt, Human
aggaagcugggaagcuac

SEQ ID NO: 1158419 - RNA, 20 nt, Human
aggaaggccagagggagaag

SEQ ID NO: 1158420 - RNA, 19 nt, Human
aggcaugaaccacugcacc

SEQ ID NO: 1158421 - RNA, 19 nt, Human
aguaacagagagagcuggg

SEQ ID NO: 1158422 - RNA, 18 nt, Human
agucuccacucacugcaa

SEQ ID NO: 1158423 - RNA, 19 nt, Human
agugaucuacccaccucag

SEQ ID NO: 1158424 - RNA, 18 nt, Human
agugcugggauuacaggc

SEQ ID NO: 1158425 - RNA, 23 nt, Human
augaaccacugcaccugcccaaa

SEQ ID NO: 1158426 - RNA, 23 nt, Human
caaccuccaccuccugggcucaa

SEQ ID NO: 1158427 - RNA, 24 nt, Human
caaccuccaccuccugggcucaag

SEQ ID NO: 1158428 - RNA, 27 nt, Human
caagcaguccucccacuucggccuccu

SEQ ID NO: 1158429 - RNA, 24 nt, Human
caaggcaaacaggagagguggugg

SEQ ID NO: 1158430 - RNA, 25 nt, Human
cacauaagcacagaggacaggcuua

SEQ ID NO: 1158431 - RNA, 24 nt, Human
caccucagccuccuaaagugcugg

SEQ ID NO: 1158432 - RNA, 24 nt, Human
caccuccugggcucaagcaguccu

SEQ ID NO: 1158433 - RNA, 21 nt, Human
cacugcaaccuccaccuccug

SEQ ID NO: 1158434 - RNA, 23 nt, Human
cacugcaaccuccaccuccuggg

SEQ ID NO: 1158435 - RNA, 20 nt, Human
cacugcugggagguauggcc

SEQ ID NO: 1158436 - RNA, 22 nt, Human
cagauacaacgucauaggauca

SEQ ID NO: 1158437 - RNA, 22 nt, Human
cagcaggccgaauggagcagca

SEQ ID NO: 1158438 - RNA, 24 nt, Human
cagggucuuaccauguuucccagg

SEQ ID NO: 1158439 - RNA, 19 nt, Human
caugcccagcuaauggcua

SEQ ID NO: 1158440 - RNA, 28 nt, Human
cauggugaaauguccaaccccguggucg

SEQ ID NO: 1158441 - RNA, 24 nt, Human
cauguuucccaggcuggucuugaa

SEQ ID NO: 1158442 - RNA, 23 nt, Human
cauugcagaggcuaugucuagug

SEQ ID NO: 1158443 - RNA, 20 nt, Human
ccaaaguucuaaugccgggg

SEQ ID NO: 1158444 - RNA, 18 nt, Human
ccacugcaccugcccaaa

SEQ ID NO: 1158445 - RNA, 22 nt, Human
ccacugcaccugcccaaaugac

SEQ ID NO: 1158446 - RNA, 19 nt, Human
ccaggagcugggccucucc

SEQ ID NO: 1158447 - RNA, 21 nt, Human
ccaggagcugggccucuccug

SEQ ID NO: 1158448 - RNA, 21 nt, Human
ccaggcuggucuugaacuccu

SEQ ID NO: 1158449 - RNA, 18 nt, Human
ccccagagcaugggaacc

SEQ ID NO: 1158450 - RNA, 22 nt, Human
ccccagagcaugggaaccaagu

SEQ ID NO: 1158451 - RNA, 21 nt, Human
ccccaggagcugggccucucc

SEQ ID NO: 1158452 - RNA, 20 nt, Human
cccccaaaccucucaggugc

SEQ ID NO: 1158453 - RNA, 23 nt, Human
ccuaaagugcugggauuacaggc

SEQ ID NO: 1158454 - RNA, 24 nt, Human
ccuaaagugcugggauuacaggca

SEQ ID NO: 1158455 - RNA, 19 nt, Human
ccuccaccuccugggcuca

SEQ ID NO: 1158456 - RNA, 24 nt, Human
ccuccaccuccugggcucaagcag

SEQ ID NO: 1158457 - RNA, 24 nt, Human
ccugaguaacugggacuacaggca

SEQ ID NO: 1158458 - RNA, 18 nt, Human
ccuggacucaagugaucu

SEQ ID NO: 1158459 - RNA, 24 nt, Human
ccuggacucaagugaucuacccac

SEQ ID NO: 1158460 - RNA, 20 nt, Human
ccugggcucaagcaguccuc

SEQ ID NO: 1158461 - RNA, 18 nt, Human
ccugucugccuccucaca

SEQ ID NO: 1158462 - RNA, 22 nt, Human
ccuucaaaaggaagagaaugga

SEQ ID NO: 1158463 - RNA, 20 nt, Human
cggccuccugaguaacuggg

SEQ ID NO: 1158464 - RNA, 23 nt, Human
cuaaagugcugggauuacaggca

SEQ ID NO: 1158465 - RNA, 24 nt, Human
cuaaagugcugggauuacaggcau

SEQ ID NO: 1158466 - RNA, 24 nt, Human
cucaagcaguccucccacuucggc

SEQ ID NO: 1158467 - RNA, 24 nt, Human
cucaagugaucuacccaccucagc

SEQ ID NO: 1158468 - RNA, 24 nt, Human
cucacugcaaccuccaccuccugg

SEQ ID NO: 1158469 - RNA, 26 nt, Human
cucacugcaaccuccaccuccugggc

SEQ ID NO: 1158470 - RNA, 19 nt, Human
cucagccuucaaaaggaag

SEQ ID NO: 1158471 - RNA, 18 nt, Human
cugcaaccuccaccuccu

SEQ ID NO: 1158472 - RNA, 23 nt, Human
cugcaaccuccaccuccugggcu

SEQ ID NO: 1158473 - RNA, 20 nt, Human
cuggaaugcaguggugcagu

SEQ ID NO: 1158474 - RNA, 21 nt, Human
cuggccccaggagcugggccu

SEQ ID NO: 1158475 - RNA, 19 nt, Human
cuucccacacucccugcuu

SEQ ID NO: 1158476 - RNA, 18 nt, Human
gaaaagaaggcgcaaaca

SEQ ID NO: 1158477 - RNA, 22 nt, Human
gacacaauccaauccauuacca

SEQ ID NO: 1158478 - RNA, 21 nt, Human
gacagggucuuaccauguuuc

SEQ ID NO: 1158479 - RNA, 24 nt, Human
gacuacaggcacaugccaccaugc

SEQ ID NO: 1158480 - RNA, 23 nt, Human
gacucaagugaucuacccaccuc

SEQ ID NO: 1158481 - RNA, 21 nt, Human
gagacagggucucgcucuguu

SEQ ID NO: 1158482 - RNA, 19 nt, Human
gagcucugggcuggccaug

SEQ ID NO: 1158483 - RNA, 20 nt, Human
gagcuggggagugagaaggg

SEQ ID NO: 1158484 - RNA, 25 nt, Human
gaguaacugggacuacaggcacaug

SEQ ID NO: 1158485 - RNA, 23 nt, Human
gauuacaggcaugaaccacugca

SEQ ID NO: 1158486 - RNA, 22 nt, Human
gcaaccuccaccuccugggcuc

SEQ ID NO: 1158487 - RNA, 21 nt, Human
gcacaacucagccuucaaaag

SEQ ID NO: 1158488 - RNA, 21 nt, Human
gcacagggacgccgcaggcag

SEQ ID NO: 1158489 - RNA, 18 nt, Human
gcaccagggccagccgag

SEQ ID NO: 1158490 - RNA, 19 nt, Human
gcauggcucguggccacaa

SEQ ID NO: 1158491 - RNA, 24 nt, Human
gccacaagccccuaagcacugugc

SEQ ID NO: 1158492 - RNA, 21 nt, Human
gcccagcacaaugccaggcac

SEQ ID NO: 1158493 - RNA, 23 nt, Human
gccccaggagcugggccucuccu

SEQ ID NO: 1158494 - RNA, 18 nt, Human
ggacuugaaaaucuuuug

SEQ ID NO: 1158495 - RNA, 22 nt, Human
ggccauggugaaauguccaacc

SEQ ID NO: 1158496 - RNA, 18 nt, Human
ggcuggucuugaacuccu

SEQ ID NO: 1158497 - RNA, 23 nt, Human
gggcauggcucguggccacaagc

SEQ ID NO: 1158498 - RNA, 21 nt, Human
ggguuaggacuugaaaaucuu

SEQ ID NO: 1158499 - RNA, 22 nt, Human
guagagacagggucuuaccaug

SEQ ID NO: 1158500 - RNA, 23 nt, Human
gugaucuacccaccucagccucc

SEQ ID NO: 1158501 - RNA, 21 nt, Human
gugccugacucuggcaggccc

SEQ ID NO: 1158502 - RNA, 19 nt, Human
gugcugggauuacaggcau

SEQ ID NO: 1158503 - RNA, 22 nt, Human
guggugcagucuccacucacug

SEQ ID NO: 1158504 - RNA, 19 nt, Human
guuuccagccgagcucugg

SEQ ID NO: 1158505 - RNA, 18 nt, Human
uaaaacaguuccugcacu

SEQ ID NO: 1158506 - RNA, 25 nt, Human
uaaaauaaaacaguuccugcacuca

SEQ ID NO: 1158507 - RNA, 19 nt, Human
uacacaguguucacaggag

SEQ ID NO: 1158508 - RNA, 22 nt, Human
uacagcccaaaguucuaaugcc

SEQ ID NO: 1158509 - RNA, 24 nt, Human
uacaggcacaugccaccaugccca

SEQ ID NO: 1158510 - RNA, 22 nt, Human
uacaggcaugaaccacugcacc

SEQ ID NO: 1158511 - RNA, 21 nt, Human
uaccauguuucccaggcuggu

SEQ ID NO: 1158512 - RNA, 27 nt, Human
uaccauguuucccaggcuggucuugaa

SEQ ID NO: 1158513 - RNA, 22 nt, Human
uacccaccucagccuccuaaag

SEQ ID NO: 1158514 - RNA, 18 nt, Human
uacccccagagcauggga

SEQ ID NO: 1158515 - RNA, 22 nt, Human
uagagacagggucuuaccaugu

SEQ ID NO: 1158516 - RNA, 21 nt, Human
uaggaucaaaacgacaaagug

SEQ ID NO: 1158517 - RNA, 20 nt, Human
uagguggcacagggacgccg

SEQ ID NO: 1158518 - RNA, 23 nt, Human
uaguaaacaucuauugguguuug

SEQ ID NO: 1158519 - RNA, 20 nt, Human
ucaaaacgacaaagugcaca

SEQ ID NO: 1158520 - RNA, 24 nt, Human
ucaaccagaugcggucuaggcaca

SEQ ID NO: 1158521 - RNA, 19 nt, Human
ucacauguugucucucauc

SEQ ID NO: 1158522 - RNA, 23 nt, Human
ucacugcaaccuccaccuccugg

SEQ ID NO: 1158523 - RNA, 24 nt, Human
ucacugcaaccuccaccuccuggg

SEQ ID NO: 1158524 - RNA, 25 nt, Human
ucacugcaaccuccaccuccugggc

SEQ ID NO: 1158525 - RNA, 27 nt, Human
ucacugcaaccuccaccuccugggcuc

SEQ ID NO: 1158526 - RNA, 24 nt, Human
uccauuaccaauaccuucccccaa

SEQ ID NO: 1158527 - RNA, 24 nt, Human
uccuaaagugcugggauuacaggc

SEQ ID NO: 1158528 - RNA, 24 nt, Human
uccugaguaacugggacuacaggc

SEQ ID NO: 1158529 - RNA, 22 nt, Human
uccugggcucaagcaguccucc

SEQ ID NO: 1158530 - RNA, 24 nt, Human
uccugggcucaagcaguccuccca

SEQ ID NO: 1158531 - RNA, 22 nt, Human
ucuauugguguuugcuucuuaa

SEQ ID NO: 1158532 - RNA, 19 nt, Human
ucucgcucuguugccuagg

SEQ ID NO: 1158533 - RNA, 20 nt, Human
ucucgcucuguugccuaggc

SEQ ID NO: 1158534 - RNA, 23 nt, Human
ucucgcucuguugccuaggcugg

SEQ ID NO: 1158535 - RNA, 24 nt, Human
ucucgcucuguugccuaggcugga

SEQ ID NO: 1158536 - RNA, 24 nt, Human
ucuguugccuaggcuggaaugcag

SEQ ID NO: 1158537 - RNA, 23 nt, Human
ucuugaacuccuggacucaagug

SEQ ID NO: 1158538 - RNA, 24 nt, Human
ugaaagcacuacccuccuucagga

SEQ ID NO: 1158539 - RNA, 21 nt, Human
ugaaccacugcaccugcccaa

SEQ ID NO: 1158540 - RNA, 20 nt, Human
ugaugcugcuugcacugcug

SEQ ID NO: 1158541 - RNA, 23 nt, Human
ugcaagugcuuugugcaccaccc

SEQ ID NO: 1158542 - RNA, 20 nt, Human
ugcccuggaaggaggcccug

SEQ ID NO: 1158543 - RNA, 19 nt, Human
ugccuaggcuggaaugcag

SEQ ID NO: 1158544 - RNA, 24 nt, Human
ugccuaggcuggaaugcaguggug

SEQ ID NO: 1158545 - RNA, 25 nt, Human
ugcucagagccuggauccccagcuc

SEQ ID NO: 1158546 - RNA, 19 nt, Human
ugcugggagguauggccac

SEQ ID NO: 1158547 - RNA, 23 nt, Human
ugcugggauuacaggcaugaacc

SEQ ID NO: 1158548 - RNA, 18 nt, Human
uggaaggaggcccuggug

SEQ ID NO: 1158549 - RNA, 28 nt, Human
uggaaugcaguggugcaguccuagcacg

SEQ ID NO: 1158550 - RNA, 23 nt, Human
uggaaugcaguggugcagucucc

SEQ ID NO: 1158551 - RNA, 21 nt, Human
uggccacaagccccuaagcac

SEQ ID NO: 1158552 - RNA, 20 nt, Human
uggcccagcucugagcuggg

SEQ ID NO: 1158553 - RNA, 21 nt, Human
ugggacuacaggcacaugcca

SEQ ID NO: 1158554 - RNA, 22 nt, Human
ugggacuacaggcacaugccac

SEQ ID NO: 1158555 - RNA, 24 nt, Human
ugggacuacaggcacaugccacca

SEQ ID NO: 1158556 - RNA, 25 nt, Human
ugggacuacaggcacaugccaccau

SEQ ID NO: 1158557 - RNA, 21 nt, Human
ugggauuacaggcaugaacca

SEQ ID NO: 1158558 - RNA, 22 nt, Human
ugggauuacaggcaugaaccac

SEQ ID NO: 1158559 - RNA, 24 nt, Human
ugggauuacaggcaugaaccacug

SEQ ID NO: 1158560 - RNA, 24 nt, Human
ugggauuacaggcaugaaccacug

SEQ ID NO: 1158561 - RNA, 23 nt, Human
ugggggacacaauccaauccagc

SEQ ID NO: 1158562 - RNA, 24 nt, Human
uguagagacagggucuuaccaugu

SEQ ID NO: 1158563 - RNA, 22 nt, Human
uucccacugcagcccagcacaa

SEQ ID NO: 1158564 - RNA, 24 nt, Human
uucccaggcuggucuugaacuccu

SEQ ID NO: 1158565 - RNA, 24 nt, Human
uugccuaggcuggaaugcaguggu

SEQ ID NO: 1158566 - RNA, 19 nt, Human
uugucucucaucuguuucc

SEQ ID NO: 1158567 - RNA, 18 nt, Human
uuuguagagacagggucu

SEQ ID NO: 1158568 - RNA, 24 nt, Human
uuuguagagacagggucuuaccau

SEQ ID NO: 1158569 - RNA, 21 nt, Human
uuuuuuguauuuuuuguagag

SEQ ID NO: 1158570 - RNA, 24 nt, Human
uuuuuuguauuuuuuguagagaca

SEQ ID NO: 1158571 - RNA, 22 nt, Human
aaaccagcagccuuacaaagaa

SEQ ID NO: 1158572 - RNA, 24 nt, Human
aaaccccagcauuuauaaucagaa

SEQ ID NO: 1158573 - RNA, 22 nt, Human
aaaggagaggaaaugacaggag

SEQ ID NO: 1158574 - RNA, 24 nt, Human
aaaguguugggguuacagguguga

SEQ ID NO: 1158575 - RNA, 22 nt, Human
aacaacuaaauuguuccugcaa

SEQ ID NO: 1158576 - RNA, 21 nt, Human
aaccuuuacccugagaagugg

SEQ ID NO: 1158577 - RNA, 21 nt, Human
aagaaaaaaaggaggaaagag

SEQ ID NO: 1158578 - RNA, 23 nt, Human
aagaaaaaaaggaggaaagagaa

SEQ ID NO: 1158579 - RNA, 19 nt, Human
aagaaacacaaaggacaag

SEQ ID NO: 1158580 - RNA, 19 nt, Human
aagaacaaaaagaagaagg

SEQ ID NO: 1158581 - RNA, 22 nt, Human
aagagaaaagcaaaucaccagg

SEQ ID NO: 1158582 - RNA, 21 nt, Human
aagaggaaacagguaaacaaa

SEQ ID NO: 1158583 - RNA, 20 nt, Human
aagcagaagguggcggccuu

SEQ ID NO: 1158584 - RNA, 21 nt, Human
aagcugaagaggucuaugugg

SEQ ID NO: 1158585 - RNA, 21 nt, Human
aaggacagauggcugacuugg

SEQ ID NO: 1158586 - RNA, 20 nt, Human
aaggauggaggaacagagcu

SEQ ID NO: 1158587 - RNA, 21 nt, Human
aaguaaauaggccauuaaaua

SEQ ID NO: 1158588 - RNA, 21 nt, Human
aaguaauucucccacuucagc

SEQ ID NO: 1158589 - RNA, 25 nt, Human
aaguaauucucccacuucagccucc

SEQ ID NO: 1158590 - RNA, 24 nt, Human
aagugggaggcagcacuuucuggg

SEQ ID NO: 1158591 - RNA, 26 nt, Human
aaguguugggguuacaggugugagcc

SEQ ID NO: 1158592 - RNA, 19 nt, Human
aaucauggcucacugcagc

SEQ ID NO: 1158593 - RNA, 20 nt, Human
aaugacaggaguaggagaga

SEQ ID NO: 1158594 - RNA, 24 nt, Human
aaugacaggaguaggagagagaga

SEQ ID NO: 1158595 - RNA, 19 nt, Human
accaaagagugccccugau

SEQ ID NO: 1158596 - RNA, 19 nt, Human
accacgcccaguugguaca

SEQ ID NO: 1158597 - RNA, 24 nt, Human
accauguugcccaggcuggucucg

SEQ ID NO: 1158598 - RNA, 25 nt, Human
accauguugcccaggcuggucucga

SEQ ID NO: 1158599 - RNA, 19 nt, Human
accgggugcugucaagagc

SEQ ID NO: 1158600 - RNA, 22 nt, Human
accugaaugccugcccugcucu

SEQ ID NO: 1158601 - RNA, 18 nt, Human
acggaguuucaccauguu

SEQ ID NO: 1158602 - RNA, 19 nt, Human
acggaguuucaccauguug

SEQ ID NO: 1158603 - RNA, 24 nt, Human
acggaguuucaccauguugcccag

SEQ ID NO: 1158604 - RNA, 22 nt, Human
acucaguuuuucuaucaggauu

SEQ ID NO: 1158605 - RNA, 24 nt, Human
acugcagccucaaccucccugggc

SEQ ID NO: 1158606 - RNA, 23 nt, Human
acuucagccuccugaguugcugg

SEQ ID NO: 1158607 - RNA, 19 nt, Human
acuuuagccucucaggagu

SEQ ID NO: 1158608 - RNA, 19 nt, Human
agaaaaaaaggaggaaaga

SEQ ID NO: 1158609 - RNA, 24 nt, Human
agaaaacuacucccagccuccucc

SEQ ID NO: 1158610 - RNA, 19 nt, Human
agaaaagcaaaucaccagg

SEQ ID NO: 1158611 - RNA, 23 nt, Human
agaacaaaaagaacccuuugaag

SEQ ID NO: 1158612 - RNA, 23 nt, Human
agaagaaaaaaaggaggaaagag

SEQ ID NO: 1158613 - RNA, 19 nt, Human
agaagcuacuuccaaccug

SEQ ID NO: 1158614 - RNA, 22 nt, Human
agagaacugcuaagccaugaug

SEQ ID NO: 1158615 - RNA, 23 nt, Human
agagagagagcaagcuacaggga

SEQ ID NO: 1158616 - RNA, 19 nt, Human
agagauaaagagauggaca

SEQ ID NO: 1158617 - RNA, 22 nt, Human
agagauggacagaaggagaucc

SEQ ID NO: 1158618 - RNA, 20 nt, Human
agaggacagggugagggcug

SEQ ID NO: 1158619 - RNA, 23 nt, Human
agauggagaggacagggugaggg

SEQ ID NO: 1158620 - RNA, 24 nt, Human
agccaguuuuuuuuuuauagagcc

SEQ ID NO: 1158621 - RNA, 19 nt, Human
agccucaaccucccugggc

SEQ ID NO: 1158622 - RNA, 20 nt, Human
aggaaggcaggugcuucggu

SEQ ID NO: 1158623 - RNA, 20 nt, Human
aggagcuguggaaaaaccag

SEQ ID NO: 1158624 - RNA, 22 nt, Human
aggagcuguggaaaaaccagca

SEQ ID NO: 1158625 - RNA, 19 nt, Human
aggcaacagauacacaaac

SEQ ID NO: 1158626 - RNA, 20 nt, Human
aggcaacagauacacaaaca

SEQ ID NO: 1158627 - RNA, 21 nt, Human
aggcaaggguuaauucacaua

SEQ ID NO: 1158628 - RNA, 19 nt, Human
aggcagugugcugguagga

SEQ ID NO: 1158629 - RNA, 21 nt, Human
aggccagaacaaaaagaaccc

SEQ ID NO: 1158630 - RNA, 24 nt, Human
aggcuccuucacauaugucaccuu

SEQ ID NO: 1158631 - RNA, 22 nt, Human
agggacaagaaaaaaaaccgaa

SEQ ID NO: 1158632 - RNA, 19 nt, Human
agggacugacagggaccuc

SEQ ID NO: 1158633 - RNA, 18 nt, Human
agggaggggagaacugga

SEQ ID NO: 1158634 - RNA, 22 nt, Human
agggcuguuaaaagggauagag

SEQ ID NO: 1158635 - RNA, 21 nt, Human
agguaaacaaaucaggagguu

SEQ ID NO: 1158636 - RNA, 23 nt, Human
aguacaguggcacaaucauggcu

SEQ ID NO: 1158637 - RNA, 23 nt, Human
agugugagaggccccaggaagaa

SEQ ID NO: 1158638 - RNA, 18 nt, Human
aucaucucggagggggac

SEQ ID NO: 1158639 - RNA, 18 nt, Human
auccaccucccuguccca

SEQ ID NO: 1158640 - RNA, 19 nt, Human
aucgcuuugcaccaugaga

SEQ ID NO: 1158641 - RNA, 24 nt, Human
auggcugcuucuucgcugacccag

SEQ ID NO: 1158642 - RNA, 24 nt, Human
auggggaggaagccccacugggug

SEQ ID NO: 1158643 - RNA, 19 nt, Human
auuauauuuuacaacugca

SEQ ID NO: 1158644 - RNA, 26 nt, Human
auuucaccagcuacuacccccucacu

SEQ ID NO: 1158645 - RNA, 20 nt, Human
caacagauacacaaacaacu

SEQ ID NO: 1158646 - RNA, 21 nt, Human
caacagauacacaaacaacua

SEQ ID NO: 1158647 - RNA, 19 nt, Human
caacuaaauuguuccugca

SEQ ID NO: 1158648 - RNA, 24 nt, Human
caagaaaggcaacagauacacaaa

SEQ ID NO: 1158649 - RNA, 20 nt, Human
caagcugaacgugacaucug

SEQ ID NO: 1158650 - RNA, 20 nt, Human
caaguaccaugggcccuugg

SEQ ID NO: 1158651 - RNA, 24 nt, Human
caaugaccaguaacugccaaugcc

SEQ ID NO: 1158652 - RNA, 30 nt, Human
cacaccuguaaucuggcauuaucgcuuugg

SEQ ID NO: 1158653 - RNA, 24 nt, Human
cacagagcagacccucaaagggga

SEQ ID NO: 1158654 - RNA, 18 nt, Human
cacagcaccuucagccuc

SEQ ID NO: 1158655 - RNA, 22 nt, Human
cacaggcauaugccaccaugcc

SEQ ID NO: 1158656 - RNA, 18 nt, Human
cacaucuccaaacaaagc

SEQ ID NO: 1158657 - RNA, 23 nt, Human
cacaucuccaaacaaagccucug

SEQ ID NO: 1158658 - RNA, 21 nt, Human
caccaugagaagcuacuucca

SEQ ID NO: 1158659 - RNA, 24 nt, Human
caccaugccuggcuaauuuuugua

SEQ ID NO: 1158660 - RNA, 24 nt, Human
caccauguugcccaggcuggucuc

SEQ ID NO: 1158661 - RNA, 24 nt, Human
cacccuuugauuucaucuccaggg

SEQ ID NO: 1158662 - RNA, 24 nt, Human
caccucaacuucccaaaguguugg

SEQ ID NO: 1158663 - RNA, 25 nt, Human
cagaaaacuacucccagccuccucc

SEQ ID NO: 1158664 - RNA, 21 nt, Human
cagaaaccagcagccuuacaa

SEQ ID NO: 1158665 - RNA, 19 nt, Human
cagaacaaaaagaacccuu

SEQ ID NO: 1158666 - RNA, 19 nt, Human
cagaacaaaaagaacccuu

SEQ ID NO: 1158667 - RNA, 19 nt, Human
cagaaggagauccagaaau

SEQ ID NO: 1158668 - RNA, 22 nt, Human
cagagggcagugguaaaacccc

SEQ ID NO: 1158669 - RNA, 19 nt, Human
cagauacacaaacaacuaa

SEQ ID NO: 1158670 - RNA, 18 nt, Human
cagcaaagggacugacag

SEQ ID NO: 1158671 - RNA, 21 nt, Human
cagcccgaggagcuguggaaa

SEQ ID NO: 1158672 - RNA, 24 nt, Human
cagccucaaccucccugggcuuaa

SEQ ID NO: 1158673 - RNA, 25 nt, Human
cagccucaaccucccugggcuuaag

SEQ ID NO: 1158674 - RNA, 20 nt, Human
cagccuccugaguugcuggg

SEQ ID NO: 1158675 - RNA, 21 nt, Human
cauaugguucagauugcuugu

SEQ ID NO: 1158676 - RNA, 28 nt, Human
caucuccaaacaaagccucugcaggaca

SEQ ID NO: 1158677 - RNA, 24 nt, Human
cauguugcccaggcuggucucgaa

SEQ ID NO: 1158678 - RNA, 23 nt, Human
cauucccauuuuauagauaagga

SEQ ID NO: 1158679 - RNA, 26 nt, Human
ccaaagcucugacucaugcauucugg

SEQ ID NO: 1158680 - RNA, 20 nt, Human
ccaaaguguugggguuacag

SEQ ID NO: 1158681 - RNA, 21 nt, Human
ccaaaguguugggguuacagg

SEQ ID NO: 1158682 - RNA, 24 nt, Human
ccaaaguguugggguuacaggugu

SEQ ID NO: 1158683 - RNA, 21 nt, Human
ccacaaaagaaacacaaagga

SEQ ID NO: 1158684 - RNA, 20 nt, Human
ccacgcccaguugguacaga

SEQ ID NO: 1158685 - RNA, 21 nt, Human
cccaaauaucucccccagugc

SEQ ID NO: 1158686 - RNA, 21 nt, Human
cccagcaagcccuauucucuc

SEQ ID NO: 1158687 - RNA, 20 nt, Human
cccaggugcuuggugcaucc

SEQ ID NO: 1158688 - RNA, 19 nt, Human
cccaugccaggacuugggg

SEQ ID NO: 1158689 - RNA, 23 nt, Human
ccccaggaccucucuuggaaccc

SEQ ID NO: 1158690 - RNA, 22 nt, Human
cccccagugcccuccuagcccu

SEQ ID NO: 1158691 - RNA, 19 nt, Human
ccccuggcucgcugugugg

SEQ ID NO: 1158692 - RNA, 20 nt, Human
ccgcagcucagaugcaggcc

SEQ ID NO: 1158693 - RNA, 21 nt, Human
ccgcagcucagaugcaggccu

SEQ ID NO: 1158694 - RNA, 18 nt, Human
ccucaaggaccgacgucu

SEQ ID NO: 1158695 - RNA, 23 nt, Human
ccugaguugcugggaccacaggc

SEQ ID NO: 1158696 - RNA, 20 nt, Human
ccugauuugaccuuugaggc

SEQ ID NO: 1158697 - RNA, 18 nt, Human
ccugcuggauuccauuca

SEQ ID NO: 1158698 - RNA, 22 nt, Human
ccugggcucaagugaucugccc

SEQ ID NO: 1158699 - RNA, 24 nt, Human
ccugggcucaagugaucugcccac

SEQ ID NO: 1158700 - RNA, 23 nt, Human
ccuuguucugucacucaggcugg

SEQ ID NO: 1158701 - RNA, 24 nt, Human
ccuuguucugucacucaggcugga

SEQ ID NO: 1158702 - RNA, 23 nt, Human
cgaaguaaauaggccauuaaaua

SEQ ID NO: 1158703 - RNA, 21 nt, Human
cgaggagcuguggaaaaacca

SEQ ID NO: 1158704 - RNA, 18 nt, Human
cgcccaguugguacagaa

SEQ ID NO: 1158705 - RNA, 24 nt, Human
cggaguuucaccauguugcccagg

SEQ ID NO: 1158706 - RNA, 24 nt, Human
cucaaggaccgacgucuuguucau

SEQ ID NO: 1158707 - RNA, 24 nt, Human
cucaagugaucugcccaccucaac

SEQ ID NO: 1158708 - RNA, 21 nt, Human
cucacugcagccucaaccucc

SEQ ID NO: 1158709 - RNA, 24 nt, Human
cucaguuuuucuaucaggauuagg

SEQ ID NO: 1158710 - RNA, 19 nt, Human
cucaugcauucugggggcc

SEQ ID NO: 1158711 - RNA, 22 nt, Human
cuccaggucucuuuuuucugag

SEQ ID NO: 1158712 - RNA, 18 nt, Human
cuccugaguugcugggac

SEQ ID NO: 1158713 - RNA, 24 nt, Human
cuccugaguugcugggaccacagg

SEQ ID NO: 1158714 - RNA, 24 nt, Human
cucucucucaccacacauuuccca

SEQ ID NO: 1158715 - RNA, 20 nt, Human
cucugugucaggcccaugcc

SEQ ID NO: 1158716 - RNA, 23 nt, Human
cugacccauuagcucccucucag

SEQ ID NO: 1158717 - RNA, 21 nt, Human
cugacucaugcauucuggggg

SEQ ID NO: 1158718 - RNA, 24 nt, Human
cugaguugcugggaccacaggcau

SEQ ID NO: 1158719 - RNA, 21 nt, Human
cugaucaagcugaacgugaca

SEQ ID NO: 1158720 - RNA, 24 nt, Human
cugcagccucaaccucccugggcu

SEQ ID NO: 1158721 - RNA, 22 nt, Human
cugggcccucccgcagcucaga

SEQ ID NO: 1158722 - RNA, 20 nt, Human
cuguggaaaaaccagcaaag

SEQ ID NO: 1158723 - RNA, 21 nt, Human
cuguuccugugacccgggucu

SEQ ID NO: 1158724 - RNA, 21 nt, Human
cuuccaaccugucaagaucug

SEQ ID NO: 1158725 - RNA, 20 nt, Human
cuuggggcaugccaugaagg

SEQ ID NO: 1158726 - RNA, 24 nt, Human
cuuguucugucacucaggcuggag

SEQ ID NO: 1158727 - RNA, 20 nt, Human
cuuucucucucucucucuca

SEQ ID NO: 1158728 - RNA, 20 nt, Human
gaaaacuacucccagccucc

SEQ ID NO: 1158729 - RNA, 24 nt, Human
gaagaaaaaaaggaggaaagagaa

SEQ ID NO: 1158730 - RNA, 18 nt, Human
gacaagaaaaaaaaccga

SEQ ID NO: 1158731 - RNA, 19 nt, Human
gagaacugcuaagccauga

SEQ ID NO: 1158732 - RNA, 21 nt, Human
gagaacugcuaagccaugaug

SEQ ID NO: 1158733 - RNA, 23 nt, Human
gagagagagagagagcaagcuac

SEQ ID NO: 1158734 - RNA, 20 nt, Human
gagagggacaagaaaaaaaa

SEQ ID NO: 1158735 - RNA, 19 nt, Human
gagauccagaaauaaaaag

SEQ ID NO: 1158736 - RNA, 22 nt, Human
gaggaacagagcuugcuuucua

SEQ ID NO: 1158737 - RNA, 21 nt, Human
gagguaagaugaagcuaacaa

SEQ ID NO: 1158738 - RNA, 23 nt, Human
gaguugcugggaccacaggcaua

SEQ ID NO: 1158739 - RNA, 28 nt, Human
gauggcaagaauguaacaucacagaggu

SEQ ID NO: 1158740 - RNA, 24 nt, Human
gcccaucagcccgaggagcugugg

SEQ ID NO: 1158741 - RNA, 24 nt, Human
gcccugugguugggcugggguccc

SEQ ID NO: 1158742 - RNA, 23 nt, Human
gcuaacaagggcugcccugucuu

SEQ ID NO: 1158743 - RNA, 21 nt, Human
gcucacugcagccucaaccuc

SEQ ID NO: 1158744 - RNA, 19 nt, Human
gcuggaguacaguggcaca

SEQ ID NO: 1158745 - RNA, 20 nt, Human
gcuguggaaaaaccagcaaa

SEQ ID NO: 1158746 - RNA, 24 nt, Human
gcuguggaaaaaccagcaaaggga

SEQ ID NO: 1158747 - RNA, 23 nt, Human
ggaagaaucccuuguccccagga

SEQ ID NO: 1158748 - RNA, 21 nt, Human
ggaaggauggaggaacagagc

SEQ ID NO: 1158749 - RNA, 24 nt, Human
ggaccacaggccagaacaaaaaga

SEQ ID NO: 1158750 - RNA, 18 nt, Human
ggagaacuggaggugguc

SEQ ID NO: 1158751 - RNA, 23 nt, Human
ggagagagagagagagagagagc

SEQ ID NO: 1158752 - RNA, 23 nt, Human
ggaguuucaccauguugcccagg

SEQ ID NO: 1158753 - RNA, 20 nt, Human
ggaucccccucacucaccuu

SEQ ID NO: 1158754 - RNA, 24 nt, Human
gggauagagggaggggagaacugg

SEQ ID NO: 1158755 - RNA, 18 nt, Human
gggcucaagugaucugcc

SEQ ID NO: 1158756 - RNA, 24 nt, Human
gggcucaagugaucugcccaccuc

SEQ ID NO: 1158757 - RNA, 19 nt, Human
ggucuaugugggccagccc

SEQ ID NO: 1158758 - RNA, 18 nt, Human
gguuacaggugugagcca

SEQ ID NO: 1158759 - RNA, 24 nt, Human
guauaauuucaccagcuacuaccc

SEQ ID NO: 1158760 - RNA, 18 nt, Human
gucccacaaaagaaacac

SEQ ID NO: 1158761 - RNA, 22 nt, Human
gucuuguucaucccugugccca

SEQ ID NO: 1158762 - RNA, 24 nt, Human
gugaucugcccaccucaacuuccc

SEQ ID NO: 1158763 - RNA, 21 nt, Human
guggaggaaucuggagaaagg

SEQ ID NO: 1158764 - RNA, 24 nt, Human
guuucaccauguugcccaggcugg

SEQ ID NO: 1158765 - RNA, 22 nt, Human
uaaaaagagcaacagauggaga

SEQ ID NO: 1158766 - RNA, 20 nt, Human
uaagaggaaacagguaaaca

SEQ ID NO: 1158767 - RNA, 18 nt, Human
uaaggcggacaagguucc

SEQ ID NO: 1158768 - RNA, 20 nt, Human
uaauucucccacuucagccu

SEQ ID NO: 1158769 - RNA, 19 nt, Human
uacaaagaacaaaaagaag

SEQ ID NO: 1158770 - RNA, 20 nt, Human
uacagaguccauugauguuu

SEQ ID NO: 1158771 - RNA, 24 nt, Human
uacaggugugagccaccacgccca

SEQ ID NO: 1158772 - RNA, 23 nt, Human
uacaguggcacaaucauggcuca

SEQ ID NO: 1158773 - RNA, 20 nt, Human
uaccccccacuaauacacac

SEQ ID NO: 1158774 - RNA, 22 nt, Human
uaccgggugcugucaagagcca

SEQ ID NO: 1158775 - RNA, 22 nt, Human
uagagacggaguuucaccaugu

SEQ ID NO: 1158776 - RNA, 19 nt, Human
uaggagggaugcaaugaua

SEQ ID NO: 1158777 - RNA, 20 nt, Human
uagggagagggacaagaaaa

SEQ ID NO: 1158778 - RNA, 25 nt, Human
uaugugggccagcccugugguuggg

SEQ ID NO: 1158779 - RNA, 21 nt, Human
uauuguguucauuuuuuuucu

SEQ ID NO: 1158780 - RNA, 25 nt, Human
uauuuuacaacugcauuaguauaaa

SEQ ID NO: 1158781 - RNA, 25 nt, Human
uauuuugguuuuuuuuguagagacg

SEQ ID NO: 1158782 - RNA, 18 nt, Human
ucaccacacauuucccag

SEQ ID NO: 1158783 - RNA, 25 nt, Human
ucacugcagccucaaccucccuggg

SEQ ID NO: 1158784 - RNA, 23 nt, Human
ucagauugcuugucuacacaguc

SEQ ID NO: 1158785 - RNA, 26 nt, Human
ucagcccccaggaaggcaggugcuuc

SEQ ID NO: 1158786 - RNA, 19 nt, Human
ucaggccauggggacugga

SEQ ID NO: 1158787 - RNA, 25 nt, Human
ucaucuccagggugcccaaugcacc

SEQ ID NO: 1158788 - RNA, 21 nt, Human
uccagaaauaaaaagagcaac

SEQ ID NO: 1158789 - RNA, 23 nt, Human
uccagaaauaaaaagagcaacag

SEQ ID NO: 1158790 - RNA, 25 nt, Human
uccagaaauaaaaagagcaacagau

SEQ ID NO: 1158791 - RNA, 20 nt, Human
uccagagaagccuucugccc

SEQ ID NO: 1158792 - RNA, 23 nt, Human
ucccaaaguguugggguuacagg

SEQ ID NO: 1158793 - RNA, 22 nt, Human
ucccagaaugauuuuuccugcc

SEQ ID NO: 1158794 - RNA, 20 nt, Human
ucccagacuguggcuucuuc

SEQ ID NO: 1158795 - RNA, 21 nt, Human
ucccaggugcuuggugcaucc

SEQ ID NO: 1158796 - RNA, 21 nt, Human
ucccauggcugcuucuucgcu

SEQ ID NO: 1158797 - RNA, 22 nt, Human
ucccuagagacuaguccgacuc

SEQ ID NO: 1158798 - RNA, 20 nt, Human
ucccucugugcuucaacucc

SEQ ID NO: 1158799 - RNA, 22 nt, Human
ucccucugugcuucaacuccag

SEQ ID NO: 1158800 - RNA, 20 nt, Human
ucccugugcccaagucccag

SEQ ID NO: 1158801 - RNA, 18 nt, Human
uccuggcuucauguugcu

SEQ ID NO: 1158802 - RNA, 18 nt, Human
uccugggcucaagugauc

SEQ ID NO: 1158803 - RNA, 20 nt, Human
uccugggcucaagugaucuc

SEQ ID NO: 1158804 - RNA, 20 nt, Human
ucggcagaagaaaaaaagga

SEQ ID NO: 1158805 - RNA, 18 nt, Human
ucggucaagacaaaggag

SEQ ID NO: 1158806 - RNA, 22 nt, Human
ucucgaauuccugggcucaagu

SEQ ID NO: 1158807 - RNA, 18 nt, Human
ucucugccugauuugacc

SEQ ID NO: 1158808 - RNA, 21 nt, Human
ucucugccugauuugaccuuu

SEQ ID NO: 1158809 - RNA, 23 nt, Human
ucugcagcucacuauucugccac

SEQ ID NO: 1158810 - RNA, 21 nt, Human
ucugcccaccucaacuuccca

SEQ ID NO: 1158811 - RNA, 23 nt, Human
ucugcccaucagcccgaggagcu

SEQ ID NO: 1158812 - RNA, 18 nt, Human
ucugucacucaggcugga

SEQ ID NO: 1158813 - RNA, 22 nt, Human
ucuuauccaccucccuguccca

SEQ ID NO: 1158814 - RNA, 23 nt, Human
ucuuauggggaggaagccccacu

SEQ ID NO: 1158815 - RNA, 18 nt, Human
ucuuuuaccaguucccag

SEQ ID NO: 1158816 - RNA, 18 nt, Human
ugaaacuggcucucccag

SEQ ID NO: 1158817 - RNA, 20 nt, Human
ugaaccuuuacccugagaag

SEQ ID NO: 1158818 - RNA, 19 nt, Human
ugacaaaagucagugugag

SEQ ID NO: 1158819 - RNA, 20 nt, Human
ugacaggaguaggagagaga

SEQ ID NO: 1158820 - RNA, 20 nt, Human
ugaccuuugaggccugcugg

SEQ ID NO: 1158821 - RNA, 21 nt, Human
ugacucaaggcaguccaauga

SEQ ID NO: 1158822 - RNA, 22 nt, Human
ugagacaggaccuuguucuguc

SEQ ID NO: 1158823 - RNA, 21 nt, Human
ugaggaucugcucugugucag

SEQ ID NO: 1158824 - RNA, 22 nt, Human
ugaggugacauaucccaggagg

SEQ ID NO: 1158825 - RNA, 23 nt, Human
ugaucugcccaccucaacuuccc

SEQ ID NO: 1158826 - RNA, 24 nt, Human
ugaucugcccaccucaacuuccca

SEQ ID NO: 1158827 - RNA, 23 nt, Human
ugcaaggaaacacgggaauggga

SEQ ID NO: 1158828 - RNA, 23 nt, Human
ugcaggacacauuccucaguuca

SEQ ID NO: 1158829 - RNA, 22 nt, Human
ugcaggcacugagaguagacug

SEQ ID NO: 1158830 - RNA, 18 nt, Human
ugcaugcaaaagccccga

SEQ ID NO: 1158831 - RNA, 24 nt, Human
ugcccaggcuggucucgaauuccu

SEQ ID NO: 1158832 - RNA, 23 nt, Human
ugcccugucuuucugcaugcaaa

SEQ ID NO: 1158833 - RNA, 20 nt, Human
ugccucagauuacaugacca

SEQ ID NO: 1158834 - RNA, 20 nt, Human
ugccugcccugcucuccuga

SEQ ID NO: 1158835 - RNA, 21 nt, Human
ugccugcccugcucuccuggu

SEQ ID NO: 1158836 - RNA, 18 nt, Human
ugcugggaccacaggcau

SEQ ID NO: 1158837 - RNA, 21 nt, Human
ugcugggaccacaggcauaug

SEQ ID NO: 1158838 - RNA, 24 nt, Human
ugcugggaccacaggcauaugcca

SEQ ID NO: 1158839 - RNA, 24 nt, Human
uggaguacaguggcacaaucaugg

SEQ ID NO: 1158840 - RNA, 22 nt, Human
uggcaagaauguaacauuuaga

SEQ ID NO: 1158841 - RNA, 24 nt, Human
uggcacaaucauggcucacugcag

SEQ ID NO: 1158842 - RNA, 24 nt, Human
uggcucacugcagccucaaccucc

SEQ ID NO: 1158843 - RNA, 21 nt, Human
ugggaccacaggcauaugcca

SEQ ID NO: 1158844 - RNA, 24 nt, Human
ugggaccacaggcauaugccacca

SEQ ID NO: 1158845 - RNA, 22 nt, Human
ugggaggcagcacuuucugggg

SEQ ID NO: 1158846 - RNA, 18 nt, Human
ugggcucaagugaucugc

SEQ ID NO: 1158847 - RNA, 24 nt, Human
ugggcucaagugaucugcccaccu

SEQ ID NO: 1158848 - RNA, 19 nt, Human
ugggcugucacugcaagga

SEQ ID NO: 1158849 - RNA, 21 nt, Human
ugggcugucacugcaaggaaa

SEQ ID NO: 1158850 - RNA, 18 nt, Human
ugggguuacaggugugag

SEQ ID NO: 1158851 - RNA, 22 nt, Human
ugggguuacaggugugagccac

SEQ ID NO: 1158852 - RNA, 23 nt, Human
ugggguuacaggugugagccacc

SEQ ID NO: 1158853 - RNA, 24 nt, Human
ugggguuacaggugugagccacca

SEQ ID NO: 1158854 - RNA, 21 nt, Human
uggugacagacugggaguucc

SEQ ID NO: 1158855 - RNA, 24 nt, Human
uguagagacggaguuucaccaugu

SEQ ID NO: 1158856 - RNA, 23 nt, Human
ugucaagagcaaagaagacagau

SEQ ID NO: 1158857 - RNA, 24 nt, Human
uguccagagaagccuucugcccau

SEQ ID NO: 1158858 - RNA, 21 nt, Human
uguccccaggaucccccucac

SEQ ID NO: 1158859 - RNA, 21 nt, Human
ugucuacacaguccaguuucc

SEQ ID NO: 1158860 - RNA, 20 nt, Human
ugucucuuuuaccaguuccc

SEQ ID NO: 1158861 - RNA, 18 nt, Human
ugucuggaagggguggag

SEQ ID NO: 1158862 - RNA, 18 nt, Human
ugucuggaagggguggag

SEQ ID NO: 1158863 - RNA, 20 nt, Human
ugucuuucugcaugcaaaag

SEQ ID NO: 1158864 - RNA, 18 nt, Human
uguggaaaaaccagcaaa

SEQ ID NO: 1158865 - RNA, 22 nt, Human
uguucugucacucaggcuggag

SEQ ID NO: 1158866 - RNA, 21 nt, Human
uuacaaagaacaaaaagaaga

SEQ ID NO: 1158867 - RNA, 19 nt, Human
uuacaggugugagccacca

SEQ ID NO: 1158868 - RNA, 20 nt, Human
uuacaggugugagccaccac

SEQ ID NO: 1158869 - RNA, 24 nt, Human
uuccugcaauuuggcauucauugg

SEQ ID NO: 1158870 - RNA, 22 nt, Human
uucugccacuguuuggccaggg

SEQ ID NO: 1158871 - RNA, 19 nt, Human
uugacugucucugcagcuc

SEQ ID NO: 1158872 - RNA, 25 nt, Human
uugagacaggaccuuguucugucac

SEQ ID NO: 1158873 - RNA, 21 nt, Human
uugaggcaaggguuaauucac

SEQ ID NO: 1158874 - RNA, 21 nt, Human
uugggguuacaggugugagcc

SEQ ID NO: 1158875 - RNA, 23 nt, Human
uugguuuuuuuuguagagacgga

SEQ ID NO: 1158876 - RNA, 24 nt, Human
uuguagagacggaguuucaccaug

SEQ ID NO: 1158877 - RNA, 22 nt, Human
uuguucugucacucaggcugga

SEQ ID NO: 1158878 - RNA, 24 nt, Human
uuguucugucacucaggcuggagu

SEQ ID NO: 1158879 - RNA, 24 nt, Human
uuucaaggguccuaggcccuuuug

SEQ ID NO: 1158880 - RNA, 23 nt, Human
uuucaccauguugcccaggcugg

SEQ ID NO: 1158881 - RNA, 24 nt, Human
uuucaccauguugcccaggcuggu

SEQ ID NO: 1158882 - RNA, 24 nt, Human
uuuguagagacggaguuucaccau

SEQ ID NO: 1158883 - RNA, 24 nt, Human
uuuuuuguagagacggaguuucac

SEQ ID NO: 1158884 - RNA, 18 nt, Human
uuuuuuuguagagacgga

SEQ ID NO: 1158885 - RNA, 22 nt, Human
uuuuuuuuuuugagacaggacc

SEQ ID NO: 1158886 - RNA, 20 nt, Human
uuuuuuuuuuugagacaggg

SEQ ID NO: 1158887 - RNA, 21 nt, Human
uuuuuuuuuuuuuuuuuuugg

SEQ ID NO: 1158888 - RNA, 18 nt, Human
ccagcaccuaucagaggg

SEQ ID NO: 1158889 - RNA, 21 nt, Human
uggcaaguaucccaaaacucc

SEQ ID NO: 1158890 - RNA, 19 nt, Human
aaagcacaugcacugaccc

SEQ ID NO: 1158891 - RNA, 21 nt, Human
aaagcaucggauauuccacag

SEQ ID NO: 1158892 - RNA, 19 nt, Human
aaccccuguggcagagccu

SEQ ID NO: 1158893 - RNA, 24 nt, Human
aaccccuguggcagagccugcgua

SEQ ID NO: 1158894 - RNA, 20 nt, Human
aacuucagcauaccaucacc

SEQ ID NO: 1158895 - RNA, 22 nt, Human
aagcaucggauauuccacagcc

SEQ ID NO: 1158896 - RNA, 21 nt, Human
aagggaccccgcgcccgcacc

SEQ ID NO: 1158897 - RNA, 18 nt, Human
acagagcuuaugacugcc

SEQ ID NO: 1158898 - RNA, 19 nt, Human
acagugcaugauucaaagc

SEQ ID NO: 1158899 - RNA, 24 nt, Human
accacaccauaaagcacaugcacu

SEQ ID NO: 1158900 - RNA, 22 nt, Human
accauaaagcacaugcacugac

SEQ ID NO: 1158901 - RNA, 22 nt, Human
acuccccuuccucuuuaaagac

SEQ ID NO: 1158902 - RNA, 20 nt, Human
acuucagcauaccaucaccg

SEQ ID NO: 1158903 - RNA, 19 nt, Human
aggcuuuggggagaggggg

SEQ ID NO: 1158904 - RNA, 19 nt, Human
agggugggaauucuuugca

SEQ ID NO: 1158905 - RNA, 20 nt, Human
agucaccccacagacauucc

SEQ ID NO: 1158906 - RNA, 22 nt, Human
auaaagcacaguagagucaccc

SEQ ID NO: 1158907 - RNA, 20 nt, Human
auacccuuuuuagaacuggu

SEQ ID NO: 1158908 - RNA, 25 nt, Human
augaucuccaaagaugcaccacacc

SEQ ID NO: 1158909 - RNA, 19 nt, Human
augcaccacaccauaaagc

SEQ ID NO: 1158910 - RNA, 22 nt, Human
caaaauaccggauacccugaau

SEQ ID NO: 1158911 - RNA, 21 nt, Human
caacaagguuuccuauucccu

SEQ ID NO: 1158912 - RNA, 21 nt, Human
cagagcuuaugacugccccuc

SEQ ID NO: 1158913 - RNA, 24 nt, Human
cagcaauuuggucucacaaggcgg

SEQ ID NO: 1158914 - RNA, 21 nt, Human
cagcagcagcaagaggacgag

SEQ ID NO: 1158915 - RNA, 22 nt, Human
cagcagcagcaagaggacgaga

SEQ ID NO: 1158916 - RNA, 26 nt, Human
cagcgagagcagcagcagcaagagga

SEQ ID NO: 1158917 - RNA, 19 nt, Human
caggguucccuccacuccc

SEQ ID NO: 1158918 - RNA, 23 nt, Human
ccccgcgcccgcaccggucccgg

SEQ ID NO: 1158919 - RNA, 18 nt, Human
ccccucugaaccaaaggc

SEQ ID NO: 1158920 - RNA, 19 nt, Human
ccccuguggcagagccugc

SEQ ID NO: 1158921 - RNA, 20 nt, Human
ccgcaagggaccccgcgccc

SEQ ID NO: 1158922 - RNA, 22 nt, Human
ccggccuccuggcucccugccg

SEQ ID NO: 1158923 - RNA, 21 nt, Human
ccuccuggcucccugccgcuc

SEQ ID NO: 1158924 - RNA, 24 nt, Human
ccuguggcagagccugcguaggac

SEQ ID NO: 1158925 - RNA, 18 nt, Human
ccuuuggccauugggcag

SEQ ID NO: 1158926 - RNA, 23 nt, Human
cgagagcagcagcagcaagagga

SEQ ID NO: 1158927 - RNA, 22 nt, Human
cuagugcgggcgcagccauguu

SEQ ID NO: 1158928 - RNA, 18 nt, Human
cuccaaagaugcaccaca

SEQ ID NO: 1158929 - RNA, 23 nt, Human
cuuggaaaaacaaagugcaguac

SEQ ID NO: 1158930 - RNA, 19 nt, Human
gaaaaacaaagugcaguac

SEQ ID NO: 1158931 - RNA, 18 nt, Human
gaaacagagcuuaugacu

SEQ ID NO: 1158932 - RNA, 22 nt, Human
gagcuuaugacugccccucuga

SEQ ID NO: 1158933 - RNA, 22 nt, Human
gcagcagcagcaagaggacgag

SEQ ID NO: 1158934 - RNA, 18 nt, Human
gccgcagccgcaagaacc

SEQ ID NO: 1158935 - RNA, 20 nt, Human
gcguaggacgcgggccuccu

SEQ ID NO: 1158936 - RNA, 26 nt, Human
gcucaggguucccuccacuccccuuc

SEQ ID NO: 1158937 - RNA, 19 nt, Human
ggacuggggaagacuuucc

SEQ ID NO: 1158938 - RNA, 19 nt, Human
ggagagggggaaacagagc

SEQ ID NO: 1158939 - RNA, 20 nt, Human
ggcacuugaggcccaggaag

SEQ ID NO: 1158940 - RNA, 23 nt, Human
ggggagagggggaaacagagcuu

SEQ ID NO: 1158941 - RNA, 21 nt, Human
guaucacucaagguucacaca

SEQ ID NO: 1158942 - RNA, 25 nt, Human
uaaaagauaaagcacaguagaguca

SEQ ID NO: 1158943 - RNA, 20 nt, Human
uaaccccuguggcagagccu

SEQ ID NO: 1158944 - RNA, 19 nt, Human
uacaaaauaccggauaccc

SEQ ID NO: 1158945 - RNA, 22 nt, Human
uaucuagaauuaaacagguuuc

SEQ ID NO: 1158946 - RNA, 19 nt, Human
ucaaaaguaaaauauggug

SEQ ID NO: 1158947 - RNA, 21 nt, Human
ucaccacaccccucuuccgaa

SEQ ID NO: 1158948 - RNA, 23 nt, Human
uccaaagaugcaccacaccauaa

SEQ ID NO: 1158949 - RNA, 18 nt, Human
uccacacaccagcccuag

SEQ ID NO: 1158950 - RNA, 18 nt, Human
uccacacagcagcgagag

SEQ ID NO: 1158951 - RNA, 24 nt, Human
ucuuccgaaaauaauacauaagag

SEQ ID NO: 1158952 - RNA, 20 nt, Human
ugagaaaagcccaauguagg

SEQ ID NO: 1158953 - RNA, 25 nt, Human
ugagaaaagcccaauguaggucaga

SEQ ID NO: 1158954 - RNA, 19 nt, Human
ugauaggggagggcacuug

SEQ ID NO: 1158955 - RNA, 24 nt, Human
uggcagagccugcguaggacgcgg

SEQ ID NO: 1158956 - RNA, 21 nt, Human
uggggagagggggaaacagag

SEQ ID NO: 1158957 - RNA, 23 nt, Human
ugugggauucaucauaacaacgu

SEQ ID NO: 1158958 - RNA, 20 nt, Human
uuaaaagauaaagcacagua

SEQ ID NO: 1158959 - RNA, 21 nt, Human
uuggaaaaacaaagugcagua

SEQ ID NO: 1158960 - RNA, 22 nt, Human
uuuggggagagggggaaacaga

SEQ ID NO: 1158961 - RNA, 18 nt, Human
aaacaaagcggcgauuau

SEQ ID NO: 1158962 - RNA, 21 nt, Human
acacagguauaauucccaaca

SEQ ID NO: 1158963 - RNA, 18 nt, Human
auaaacagcaaguccuuc

SEQ ID NO: 1158964 - RNA, 21 nt, Human
ccaggaccuugugguuuguca

SEQ ID NO: 1158965 - RNA, 21 nt, Human
ccagucucuugagaaacaaag

SEQ ID NO: 1158966 - RNA, 18 nt, Human
cuccaucauuucucaaua

SEQ ID NO: 1158967 - RNA, 28 nt, Human
gaccuugugguuugucacgggacuccgu

SEQ ID NO: 1158968 - RNA, 19 nt, Human
gguguagguggccccagga

SEQ ID NO: 1158969 - RNA, 22 nt, Human
uaggaaggguauucauugaaga

SEQ ID NO: 1158970 - RNA, 23 nt, Human
ugucacgguauugguaaccacac

SEQ ID NO: 1158971 - RNA, 19 nt, Human
uuccaguaauaagauguac

SEQ ID NO: 1158972 - RNA, 21 nt, Human
aaaaaaauaaaauggacaaaa

SEQ ID NO: 1158973 - RNA, 23 nt, Human
aaaaaaauaaaauggacaaaaag

SEQ ID NO: 1158974 - RNA, 21 nt, Human
aaaaggccaggcacgccuaaa

SEQ ID NO: 1158975 - RNA, 24 nt, Human
aaaaggccaggcacgccuaaagua

SEQ ID NO: 1158976 - RNA, 18 nt, Human
aacauggugaaacccagu

SEQ ID NO: 1158977 - RNA, 19 nt, Human
aacauggugaaacccaguc

SEQ ID NO: 1158978 - RNA, 21 nt, Human
aacauggugaaacccagucgc

SEQ ID NO: 1158979 - RNA, 19 nt, Human
aacauggugacacccccuc

SEQ ID NO: 1158980 - RNA, 22 nt, Human
aagacaaauauugaauguucuc

SEQ ID NO: 1158981 - RNA, 26 nt, Human
aagcaagaaacaaagacaggggaccc

SEQ ID NO: 1158982 - RNA, 23 nt, Human
aagcaagaaacaaagacaguuau

SEQ ID NO: 1158983 - RNA, 24 nt, Human
aauugcuugaaccugggaggcgga

SEQ ID NO: 1158984 - RNA, 20 nt, Human
acacagcaagacuccaucuc

SEQ ID NO: 1158985 - RNA, 24 nt, Human
acacagcaagacuccaucucaaaa

SEQ ID NO: 1158986 - RNA, 19 nt, Human
acagaagcaagaaacaaag

SEQ ID NO: 1158987 - RNA, 21 nt, Human
acagaagcaagaaacaaagac

SEQ ID NO: 1158988 - RNA, 19 nt, Human
accacugcacuccagccug

SEQ ID NO: 1158989 - RNA, 24 nt, Human
acccccucucuacuaaaaauacaa

SEQ ID NO: 1158990 - RNA, 26 nt, Human
acuccagcucuuucucuuugggccgc

SEQ ID NO: 1158991 - RNA, 18 nt, Human
acugcacuccagccuggg

SEQ ID NO: 1158992 - RNA, 26 nt, Human
acugcacuccagccugggugacacag

SEQ ID NO: 1158993 - RNA, 20 nt, Human
agaagcaagaaacaaagaca

SEQ ID NO: 1158994 - RNA, 23 nt, Human
agaaguucaagaucacccuggcc

SEQ ID NO: 1158995 - RNA, 19 nt, Human
agaauacauuuagauacaa

SEQ ID NO: 1158996 - RNA, 21 nt, Human
agacaaauauugaauguucuc

SEQ ID NO: 1158997 - RNA, 19 nt, Human
agaggccaaggugagcggu

SEQ ID NO: 1158998 - RNA, 21 nt, Human
agcaaaaaacccauaaccuga

SEQ ID NO: 1158999 - RNA, 24 nt, Human
agcacuuugggagaccaagguggg

SEQ ID NO: 1159000 - RNA, 19 nt, Human
agccugggcaacaugguga

SEQ ID NO: 1159001 - RNA, 22 nt, Human
agccugggcaacauggugaaac

SEQ ID NO: 1159002 - RNA, 24 nt, Human
agccugggcaacauggugaaaccc

SEQ ID NO: 1159003 - RNA, 22 nt, Human
agccugggugacacagcaagac

SEQ ID NO: 1159004 - RNA, 24 nt, Human
agccugggugacacagcaagacuc

SEQ ID NO: 1159005 - RNA, 23 nt, Human
agcugagcaugguggcacucgcc

SEQ ID NO: 1159006 - RNA, 18 nt, Human
agcugggugugguggugc

SEQ ID NO: 1159007 - RNA, 23 nt, Human
aggaguucaagaccagccugggc

SEQ ID NO: 1159008 - RNA, 22 nt, Human
aggcaggagaauugcuugaacc

SEQ ID NO: 1159009 - RNA, 24 nt, Human
aggcaggagaauugcuugaaccug

SEQ ID NO: 1159010 - RNA, 19 nt, Human
aggcggagguugcacugag

SEQ ID NO: 1159011 - RNA, 24 nt, Human
aggcggagguugcacugagucgag

SEQ ID NO: 1159012 - RNA, 21 nt, Human
aggcugaggcaggagaauugc

SEQ ID NO: 1159013 - RNA, 24 nt, Human
aggcugaggcaggagaauugcuug

SEQ ID NO: 1159014 - RNA, 21 nt, Human
agggaaacagggucuucacaa

SEQ ID NO: 1159015 - RNA, 23 nt, Human
agguggguggaucacaaggucag

SEQ ID NO: 1159016 - RNA, 24 nt, Human
agguggguggaucacaaggucaga

SEQ ID NO: 1159017 - RNA, 20 nt, Human
aggugguuacaaggcuggga

SEQ ID NO: 1159018 - RNA, 23 nt, Human
aguaccugcacuuugagaggcca

SEQ ID NO: 1159019 - RNA, 24 nt, Human
aguggcucacaccuguaaucccag

SEQ ID NO: 1159020 - RNA, 25 nt, Human
auaaaauggacaaaaaggccaggca

SEQ ID NO: 1159021 - RNA, 22 nt, Human
aucccagcacuuugggagacca

SEQ ID NO: 1159022 - RNA, 24 nt, Human
aucgcaccacugcacuccagccug

SEQ ID NO: 1159023 - RNA, 22 nt, Human
aucuccuccaccucucucucuu

SEQ ID NO: 1159024 - RNA, 23 nt, Human
augugccugcuccugcuuugcuu

SEQ ID NO: 1159025 - RNA, 23 nt, Human
caaaaaacccauaaccugauuaa

SEQ ID NO: 1159026 - RNA, 20 nt, Human
caacauggugaaacccaguc

SEQ ID NO: 1159027 - RNA, 24 nt, Human
caacauggugaaacccagucgcua

SEQ ID NO: 1159028 - RNA, 21 nt, Human
caagacuccaucucaaaaaaa

SEQ ID NO: 1159029 - RNA, 18 nt, Human
caagaucacccuggccaa

SEQ ID NO: 1159030 - RNA, 24 nt, Human
caagaucacccuggccaacauggu

SEQ ID NO: 1159031 - RNA, 24 nt, Human
caagccuagaaagacaaauauuga

SEQ ID NO: 1159032 - RNA, 21 nt, Human
caaggugagcggaucacuuga

SEQ ID NO: 1159033 - RNA, 24 nt, Human
caagguggguggaucacaagguca

SEQ ID NO: 1159034 - RNA, 18 nt, Human
cacaccuguaaucccagc

SEQ ID NO: 1159035 - RNA, 24 nt, Human
cacaccuguaaucccagcacuuug

SEQ ID NO: 1159036 - RNA, 20 nt, Human
cacagcuagggaaacagggu

SEQ ID NO: 1159037 - RNA, 19 nt, Human
caccagaaaaacaggcagu

SEQ ID NO: 1159038 - RNA, 23 nt, Human
caccagaaaaacaggcagugaau

SEQ ID NO: 1159039 - RNA, 21 nt, Human
caccucucucucuugcucucu

SEQ ID NO: 1159040 - RNA, 23 nt, Human
caccuguaaucccagcacuuugg

SEQ ID NO: 1159041 - RNA, 24 nt, Human
caccuguaaucccagcacuuuggg

SEQ ID NO: 1159042 - RNA, 21 nt, Human
caccuguaaucccagcuacuc

SEQ ID NO: 1159043 - RNA, 24 nt, Human
caccuguaaucccagcuacucagg

SEQ ID NO: 1159044 - RNA, 22 nt, Human
cacuccagccugggugacacag

SEQ ID NO: 1159045 - RNA, 23 nt, Human
cacuccagccugggugacacagc

SEQ ID NO: 1159046 - RNA, 19 nt, Human
cacugcacuccagccuggg

SEQ ID NO: 1159047 - RNA, 19 nt, Human
cacugcacuccagccuggg

SEQ ID NO: 1159048 - RNA, 22 nt, Human
cacugcacuccagccuggguga

SEQ ID NO: 1159049 - RNA, 23 nt, Human
cacugcacuccagccugggugac

SEQ ID NO: 1159050 - RNA, 24 nt, Human
cacugcacuccagccugggugaca

SEQ ID NO: 1159051 - RNA, 19 nt, Human
cagaagcaagaaacaaaga

SEQ ID NO: 1159052 - RNA, 25 nt, Human
cagaagccaagcaaugcuggugcca

SEQ ID NO: 1159053 - RNA, 24 nt, Human
cagaauauauaaggaacucaaaca

SEQ ID NO: 1159054 - RNA, 24 nt, Human
cagcacuuugggagaccaaggugg

SEQ ID NO: 1159055 - RNA, 24 nt, Human
cagcuacucaggaggcugaggcag

SEQ ID NO: 1159056 - RNA, 18 nt, Human
cagcuagggaaacagggu

SEQ ID NO: 1159057 - RNA, 18 nt, Human
caggauguggaagcccag

SEQ ID NO: 1159058 - RNA, 23 nt, Human
caggcugggcgcaguggcucaca

SEQ ID NO: 1159059 - RNA, 24 nt, Human
cauauuacagaagcaagaaacaaa

SEQ ID NO: 1159060 - RNA, 20 nt, Human
ccacugcacuccagccuggg

SEQ ID NO: 1159061 - RNA, 20 nt, Human
ccacugcacuccagccuggg

SEQ ID NO: 1159062 - RNA, 20 nt, Human
ccacugcacuccagccuggg

SEQ ID NO: 1159063 - RNA, 21 nt, Human
ccacugcacuccagccugggu

SEQ ID NO: 1159064 - RNA, 21 nt, Human
ccacugcacuccagccugggu

SEQ ID NO: 1159065 - RNA, 23 nt, Human
ccacugcacuccagccuggguga

SEQ ID NO: 1159066 - RNA, 23 nt, Human
ccacugcacuccagccuggguga

SEQ ID NO: 1159067 - RNA, 24 nt, Human
ccacugcacuccagccugggugac

SEQ ID NO: 1159068 - RNA, 25 nt, Human
ccacugcacuccagccugggugaca

SEQ ID NO: 1159069 - RNA, 18 nt, Human
ccagucagauuaacaucc

SEQ ID NO: 1159070 - RNA, 21 nt, Human
ccccagaagccaagcaaugcu

SEQ ID NO: 1159071 - RNA, 19 nt, Human
ccugggaggcggagguugc

SEQ ID NO: 1159072 - RNA, 22 nt, Human
ccugggcaacauggugaaaccc

SEQ ID NO: 1159073 - RNA, 23 nt, Human
ccugggcaacauggugaaaccca

SEQ ID NO: 1159074 - RNA, 22 nt, Human
ccugggugacacagcaagacuc

SEQ ID NO: 1159075 - RNA, 24 nt, Human
ccugggugacacagcaagacucca

SEQ ID NO: 1159076 - RNA, 21 nt, Human
ccuguaaucccagcuacucag

SEQ ID NO: 1159077 - RNA, 21 nt, Human
cgcaccacugcacuccagccu

SEQ ID NO: 1159078 - RNA, 21 nt, Human
cgcuacaaaaaauacaaaaag

SEQ ID NO: 1159079 - RNA, 24 nt, Human
cggaucacuugagcacaggaguuc

SEQ ID NO: 1159080 - RNA, 24 nt, Human
cggcccagucagauuaacauccaa

SEQ ID NO: 1159081 - RNA, 20 nt, Human
cuagccaccagaaaaacagg

SEQ ID NO: 1159082 - RNA, 23 nt, Human
cucaaaaaaauaaaauggacaaa

SEQ ID NO: 1159083 - RNA, 19 nt, Human
cucaaacaauucaauagca

SEQ ID NO: 1159084 - RNA, 22 nt, Human
cucacaccuguaaucccagcac

SEQ ID NO: 1159085 - RNA, 24 nt, Human
cucacaccuguaaucccagcacuu

SEQ ID NO: 1159086 - RNA, 21 nt, Human
cuccagcucuuucucuuucuc

SEQ ID NO: 1159087 - RNA, 21 nt, Human
cugagguggaaugaucacuug

SEQ ID NO: 1159088 - RNA, 21 nt, Human
cugcuccugcuuugcuuucug

SEQ ID NO: 1159089 - RNA, 21 nt, Human
cuguaaucccagcuacucagg

SEQ ID NO: 1159090 - RNA, 23 nt, Human
cuugcagcugcacagcuagggaa

SEQ ID NO: 1159091 - RNA, 22 nt, Human
gaaacccagucgcuacaaaaaa

SEQ ID NO: 1159092 - RNA, 21 nt, Human
gaaauaagccaagccuagagg

SEQ ID NO: 1159093 - RNA, 18 nt, Human
gaagggaaggggagagua

SEQ ID NO: 1159094 - RNA, 20 nt, Human
gacacagcaagacuccaucu

SEQ ID NO: 1159095 - RNA, 20 nt, Human
gacaggcugggcgcaguggc

SEQ ID NO: 1159096 - RNA, 21 nt, Human
gacaggcugggcgcaguggcu

SEQ ID NO: 1159097 - RNA, 23 nt, Human
gagaauugcuugaaccugggagg

SEQ ID NO: 1159098 - RNA, 23 nt, Human
gagaucgcaccacugcacuccag

SEQ ID NO: 1159099 - RNA, 23 nt, Human
gagguugcacugagucgagaucg

SEQ ID NO: 1159100 - RNA, 24 nt, Human
gaucacaaggucagaaguucaaga

SEQ ID NO: 1159101 - RNA, 24 nt, Human
gaucacuugagcacaggaguucaa

SEQ ID NO: 1159102 - RNA, 22 nt, Human
gaucacuugagcccaggaugug

SEQ ID NO: 1159103 - RNA, 24 nt, Human
gaugugccugcuccugcuuugcuu

SEQ ID NO: 1159104 - RNA, 20 nt, Human
gcaccacugcacuccagccu

SEQ ID NO: 1159105 - RNA, 20 nt, Human
gcacuuugagaggccaaggu

SEQ ID NO: 1159106 - RNA, 22 nt, Human
gccaacauggugacacccccuc

SEQ ID NO: 1159107 - RNA, 25 nt, Human
gcccugaacaaagaguuaaguuagc

SEQ ID NO: 1159108 - RNA, 21 nt, Human
gcuacaaaaaauacaaaaaaa

SEQ ID NO: 1159109 - RNA, 22 nt, Human
gcuuccuguacagucugcagaa

SEQ ID NO: 1159110 - RNA, 21 nt, Human
ggacaggcugggcgcaguggc

SEQ ID NO: 1159111 - RNA, 21 nt, Human
ggacugagcccugaacaaaga

SEQ ID NO: 1159112 - RNA, 24 nt, Human
ggagguugcacugagucgagaucg

SEQ ID NO: 1159113 - RNA, 23 nt, Human
ggaucacuugagcacaggaguuc

SEQ ID NO: 1159114 - RNA, 19 nt, Human
ggcaucuccuccaccucuc

SEQ ID NO: 1159115 - RNA, 23 nt, Human
ggcgcaguggcucacaccuguaa

SEQ ID NO: 1159116 - RNA, 22 nt, Human
ggugaaacccagucgcuacaaa

SEQ ID NO: 1159117 - RNA, 23 nt, Human
gguggaucacaaggucagaaguu

SEQ ID NO: 1159118 - RNA, 24 nt, Human
gguggugcacaccuguaaucccag

SEQ ID NO: 1159119 - RNA, 23 nt, Human
ggugugguggugcacaccuguaa

SEQ ID NO: 1159120 - RNA, 21 nt, Human
gguuacaaggcugggaaggga

SEQ ID NO: 1159121 - RNA, 23 nt, Human
gugaugugccugcuccccugaag

SEQ ID NO: 1159122 - RNA, 22 nt, Human
guuagcuuuuaagcauuucgug

SEQ ID NO: 1159123 - RNA, 18 nt, Human
guugcacugagucgagau

SEQ ID NO: 1159124 - RNA, 20 nt, Human
uaaaauggacaaaaaggcca

SEQ ID NO: 1159125 - RNA, 18 nt, Human
uaaccagaauauauaagg

SEQ ID NO: 1159126 - RNA, 19 nt, Human
uaaccugauuaaaaaaugg

SEQ ID NO: 1159127 - RNA, 21 nt, Human
uaauguaagugaaauaagcca

SEQ ID NO: 1159128 - RNA, 20 nt, Human
uagaaaggugguuacaaggc

SEQ ID NO: 1159129 - RNA, 18 nt, Human
uagcugagcaugguggca

SEQ ID NO: 1159130 - RNA, 20 nt, Human
ucaagaucacccuggccaac

SEQ ID NO: 1159131 - RNA, 22 nt, Human
ucaagaucacccuggccaacau

SEQ ID NO: 1159132 - RNA, 22 nt, Human
ucacaaggucagaaguucaaga

SEQ ID NO: 1159133 - RNA, 24 nt, Human
ucacaaggucagaaguucaagauc

SEQ ID NO: 1159134 - RNA, 23 nt, Human
ucaccuccagacugggugacccc

SEQ ID NO: 1159135 - RNA, 23 nt, Human
ucacuugagcacaggaguucaag

SEQ ID NO: 1159136 - RNA, 24 nt, Human
uccagccugggugacacagcaaga

SEQ ID NO: 1159137 - RNA, 19 nt, Human
uccaucucaaaaaaauaaa

SEQ ID NO: 1159138 - RNA, 23 nt, Human
ucgcaccacugcacuccagccug

SEQ ID NO: 1159139 - RNA, 22 nt, Human
ucucuacuaaaaauacaaaaaa

SEQ ID NO: 1159140 - RNA, 18 nt, Human
ucucuugcucucuugcca

SEQ ID NO: 1159141 - RNA, 24 nt, Human
ugaaaguuccuugaggccucccca

SEQ ID NO: 1159142 - RNA, 24 nt, Human
ugaaccugggaggcggagguugca

SEQ ID NO: 1159143 - RNA, 24 nt, Human
ugagaggccaaggugagcggauca

SEQ ID NO: 1159144 - RNA, 21 nt, Human
ugagcaugguggcacucgccu

SEQ ID NO: 1159145 - RNA, 22 nt, Human
ugagcccugaacaaagaguuaa

SEQ ID NO: 1159146 - RNA, 24 nt, Human
ugagcggaucacuugagcacagga

SEQ ID NO: 1159147 - RNA, 24 nt, Human
ugaggcaggagaauugcuugaacc

SEQ ID NO: 1159148 - RNA, 25 nt, Human
ugaggcaggagaauugcuugaaccu

SEQ ID NO: 1159149 - RNA, 22 nt, Human
ugagucgagaucgcaccacugc

SEQ ID NO: 1159150 - RNA, 18 nt, Human
ugccugggaagggaggag

SEQ ID NO: 1159151 - RNA, 21 nt, Human
ugcuugaaccugggaggcgga

SEQ ID NO: 1159152 - RNA, 20 nt, Human
uggacaggcugggcgcagug

SEQ ID NO: 1159153 - RNA, 21 nt, Human
uggaggcagaguagaaaggug

SEQ ID NO: 1159154 - RNA, 21 nt, Human
uggcucacaccuguaauccca

SEQ ID NO: 1159155 - RNA, 24 nt, Human
uggcucacaccuguaaucccagca

SEQ ID NO: 1159156 - RNA, 19 nt, Human
ugggaagggaaggggagag

SEQ ID NO: 1159157 - RNA, 20 nt, Human
ugggaagggaaggggagagu

SEQ ID NO: 1159158 - RNA, 24 nt, Human
ugggagaccaagguggguggauca

SEQ ID NO: 1159159 - RNA, 19 nt, Human
ugggaggcggagguugcac

SEQ ID NO: 1159160 - RNA, 24 nt, Human
ugggaggcggagguugcacugagu

SEQ ID NO: 1159161 - RNA, 18 nt, Human
ugggucauccugaggugg

SEQ ID NO: 1159162 - RNA, 22 nt, Human
uggugcacaccuguaaucccag

SEQ ID NO: 1159163 - RNA, 24 nt, Human
ugguggugcacaccuguaauccca

SEQ ID NO: 1159164 - RNA, 24 nt, Human
ugguuacaagaauacauuuagaua

SEQ ID NO: 1159165 - RNA, 22 nt, Human
ugguuacaaggcugggaaggga

SEQ ID NO: 1159166 - RNA, 21 nt, Human
uguaagugaaauaagccaagc

SEQ ID NO: 1159167 - RNA, 18 nt, Human
uuagcugagcaugguggc

SEQ ID NO: 1159168 - RNA, 20 nt, Human
uuagcugggugugguggugc

SEQ ID NO: 1159169 - RNA, 22 nt, Human
uuagcugggugugguggugcac

SEQ ID NO: 1159170 - RNA, 21 nt, Human
uucguggggcagggggagauc

SEQ ID NO: 1159171 - RNA, 24 nt, Human
uugaaccugggaggcggagguugc

SEQ ID NO: 1159172 - RNA, 22 nt, Human
uugagcacaggaguucaagacc

SEQ ID NO: 1159173 - RNA, 24 nt, Human
uugcuugaaccugggaggcggagg

SEQ ID NO: 1159174 - RNA, 26 nt, Human
uuucaaggaaaaacauguuuugcgac

SEQ ID NO: 1159175 - RNA, 23 nt, Human
uuucguggggcagggggagaucu

SEQ ID NO: 1159176 - RNA, 26 nt, Human
uuuucuaacaacaaugaguuccugag

SEQ ID NO: 1159177 - RNA, 21 nt, Human
aaccuccuugggcucagcugc

SEQ ID NO: 1159178 - RNA, 18 nt, Human
aauuuaggauuauuccau

SEQ ID NO: 1159179 - RNA, 20 nt, Human
auccuuuuucuucacccucu

SEQ ID NO: 1159180 - RNA, 20 nt, Human
auggggcagugucuucagag

SEQ ID NO: 1159181 - RNA, 22 nt, Human
caaugaguccaaugccucuccc

SEQ ID NO: 1159182 - RNA, 22 nt, Human
cacccaugaccucauuugacuc

SEQ ID NO: 1159183 - RNA, 20 nt, Human
cagcaaacugaaacugcagu

SEQ ID NO: 1159184 - RNA, 19 nt, Human
caguuggauggcucaaggg

SEQ ID NO: 1159185 - RNA, 21 nt, Human
ccauccccugucgacuugagg

SEQ ID NO: 1159186 - RNA, 25 nt, Human
ccccccgcgggccgggccagggggc

SEQ ID NO: 1159187 - RNA, 22 nt, Human
ccuccuugggcucagcugcuuc

SEQ ID NO: 1159188 - RNA, 19 nt, Human
ccucucccacauucucugu

SEQ ID NO: 1159189 - RNA, 23 nt, Human
ccugucgccuccugacccuugcu

SEQ ID NO: 1159190 - RNA, 23 nt, Human
cgccagccucugcgcuuccgcgc

SEQ ID NO: 1159191 - RNA, 21 nt, Human
cgcucuguccgcggagacgga

SEQ ID NO: 1159192 - RNA, 22 nt, Human
cuaccugcuucuguacucugca

SEQ ID NO: 1159193 - RNA, 19 nt, Human
cuccaaccugagucaccgc

SEQ ID NO: 1159194 - RNA, 18 nt, Human
cucccggcucugcguggc

SEQ ID NO: 1159195 - RNA, 19 nt, Human
cucccggcucugcguggcc

SEQ ID NO: 1159196 - RNA, 19 nt, Human
cucggcccgcuccacccgg

SEQ ID NO: 1159197 - RNA, 19 nt, Human
cucugcguggccgcggggc

SEQ ID NO: 1159198 - RNA, 18 nt, Human
cugugggcguguuuuucc

SEQ ID NO: 1159199 - RNA, 19 nt, Human
cugugucugccugcucucc

SEQ ID NO: 1159200 - RNA, 21 nt, Human
cuuuucuucaucuggcucuuu

SEQ ID NO: 1159201 - RNA, 21 nt, Human
gaccugucgccuccugacccu

SEQ ID NO: 1159202 - RNA, 23 nt, Human
gagacggagccacucgccgcgaa

SEQ ID NO: 1159203 - RNA, 22 nt, Human
gcacuggaaccuccuugggcuc

SEQ ID NO: 1159204 - RNA, 23 nt, Human
gcacuggaaccuccuugggcuca

SEQ ID NO: 1159205 - RNA, 22 nt, Human
ggcucaaggggaguucuggucc

SEQ ID NO: 1159206 - RNA, 20 nt, Human
gggcucggcccgcuccaccc

SEQ ID NO: 1159207 - RNA, 21 nt, Human
gucauucuuuucuucaucugg

SEQ ID NO: 1159208 - RNA, 23 nt, Human
gugaauucuuucucuaaacuaug

SEQ ID NO: 1159209 - RNA, 21 nt, Human
uaucaaacauuacugagagug

SEQ ID NO: 1159210 - RNA, 27 nt, Human
ucaccgcugccucucccacauucucug

SEQ ID NO: 1159211 - RNA, 26 nt, Human
ucaccuccaccucacuggcuuuccua

SEQ ID NO: 1159212 - RNA, 25 nt, Human
uccacacaauccuucacuguguccu

SEQ ID NO: 1159213 - RNA, 19 nt, Human
uccccugucgacuugaggg

SEQ ID NO: 1159214 - RNA, 26 nt, Human
uccuugggcucagcugcuuccugguu

SEQ ID NO: 1159215 - RNA, 18 nt, Human
ucggaagucucuccauug

SEQ ID NO: 1159216 - RNA, 19 nt, Human
ucuccaaccugagucaccg

SEQ ID NO: 1159217 - RNA, 21 nt, Human
ugaaacugcaguauacugugg

SEQ ID NO: 1159218 - RNA, 24 nt, Human
ugcacuggaaccuccuugggcuca

SEQ ID NO: 1159219 - RNA, 18 nt, Human
ugcccuaaaggacaugag

SEQ ID NO: 1159220 - RNA, 19 nt, Human
ugcccuaaaggacaugagg

SEQ ID NO: 1159221 - RNA, 23 nt, Human
ugcccuaaaggacaugaggccac

SEQ ID NO: 1159222 - RNA, 20 nt, Human
ugccucucccacauucucug

SEQ ID NO: 1159223 - RNA, 18 nt, Human
uggcuuuccuaggguccc

SEQ ID NO: 1159224 - RNA, 21 nt, Human
ugucgacuugagggcauuuaa

SEQ ID NO: 1159225 - RNA, 26 nt, Human
uucagggagagaagcgcucucaagaa

SEQ ID NO: 1159226 - RNA, 21 nt, Human
uuccugcuggagaaccaggaa

SEQ ID NO: 1159227 - RNA, 19 nt, Human
uucuucaucuggcucuuuc

SEQ ID NO: 1159228 - RNA, 20 nt, Human
uugcggcgagccgggccucc

SEQ ID NO: 1159229 - RNA, 21 nt, Human
uuuccuagggucccauccccu

SEQ ID NO: 1159230 - RNA, 25 nt, Human
uuucucaguauugugcaagauuucu

SEQ ID NO: 1159231 - RNA, 18 nt, Human
uuugcggcgagccgggcc

SEQ ID NO: 1159232 - RNA, 20 nt, Human
aaaacaaacaacaaagaaca

SEQ ID NO: 1159233 - RNA, 22 nt, Human
aagaguuuggagaacagacgga

SEQ ID NO: 1159234 - RNA, 20 nt, Human
aaucagcacaaacugaugcc

SEQ ID NO: 1159235 - RNA, 22 nt, Human
aauguaccauagacugaguggc

SEQ ID NO: 1159236 - RNA, 21 nt, Human
aauuacucuucacaaauuuau

SEQ ID NO: 1159237 - RNA, 24 nt, Human
agcacuuugggaggcugaggcagg

SEQ ID NO: 1159238 - RNA, 22 nt, Human
aggccgggagugguggcucaug

SEQ ID NO: 1159239 - RNA, 22 nt, Human
aucccauucaugagggcuccac

SEQ ID NO: 1159240 - RNA, 21 nt, Human
caaaauuuacaaaaucagcac

SEQ ID NO: 1159241 - RNA, 23 nt, Human
caaacaacaaagaacacacuuuu

SEQ ID NO: 1159242 - RNA, 24 nt, Human
cagcacuuugggaggcugaggcag

SEQ ID NO: 1159243 - RNA, 26 nt, Human
cagcacuuugggaggcugaggcaggu

SEQ ID NO: 1159244 - RNA, 24 nt, Human
caugacuguaaucccagcacuuug

SEQ ID NO: 1159245 - RNA, 18 nt, Human
ccucacauggaaaacagg

SEQ ID NO: 1159246 - RNA, 25 nt, Human
cuagcaauguaagaaaauuucuuuu

SEQ ID NO: 1159247 - RNA, 22 nt, Human
cuauucauuacauuuuuggaau

SEQ ID NO: 1159248 - RNA, 24 nt, Human
cucaugacuguaaucccagcacuu

SEQ ID NO: 1159249 - RNA, 24 nt, Human
cuggaaguccgagaucaaggugcc

SEQ ID NO: 1159250 - RNA, 24 nt, Human
gaaacuuucugaaaacccaaauaa

SEQ ID NO: 1159251 - RNA, 23 nt, Human
ggagugguggcucaugacuguaa

SEQ ID NO: 1159252 - RNA, 21 nt, Human
ggcucaugacuguaaucccag

SEQ ID NO: 1159253 - RNA, 19 nt, Human
ggcucucuuccagguugca

SEQ ID NO: 1159254 - RNA, 19 nt, Human
gggauauggcaugaaggga

SEQ ID NO: 1159255 - RNA, 24 nt, Human
gguggcucaugacuguaaucccag

SEQ ID NO: 1159256 - RNA, 22 nt, Human
uaaaaaaagaugaauaaggccg

SEQ ID NO: 1159257 - RNA, 19 nt, Human
uaaaaacaaacaacaaaga

SEQ ID NO: 1159258 - RNA, 26 nt, Human
uaaaacucucuaaauaaucacccuuc

SEQ ID NO: 1159259 - RNA, 21 nt, Human
uaaggagaauuaacuuaauaa

SEQ ID NO: 1159260 - RNA, 25 nt, Human
uagaaugaauaaauuacucuucaca

SEQ ID NO: 1159261 - RNA, 23 nt, Human
uagauucauuugccuauuuaaaa

SEQ ID NO: 1159262 - RNA, 24 nt, Human
uaugggaauaagauuaguagauac

SEQ ID NO: 1159263 - RNA, 20 nt, Human
ucaaaauguguacuauucau

SEQ ID NO: 1159264 - RNA, 18 nt, Human
ucucuaaauaaucacccu

SEQ ID NO: 1159265 - RNA, 21 nt, Human
ugaauaaggccgggaguggug

SEQ ID NO: 1159266 - RNA, 20 nt, Human
ugaccuaaucauauaccaaa

SEQ ID NO: 1159267 - RNA, 23 nt, Human
ugacuguaaucccagcacuuugg

SEQ ID NO: 1159268 - RNA, 24 nt, Human
ugacuguaaucccagcacuuuggg

SEQ ID NO: 1159269 - RNA, 21 nt, Human
ugccuauuuaaaaacaaacaa

SEQ ID NO: 1159270 - RNA, 20 nt, Human
uggaaaacaggugagcgcuc

SEQ ID NO: 1159271 - RNA, 22 nt, Human
uggcucaugacuguaaucccag

SEQ ID NO: 1159272 - RNA, 24 nt, Human
uggcucaugacuguaaucccagca

SEQ ID NO: 1159273 - RNA, 24 nt, Human
uggcuuauaaacaacagaaauuuc

SEQ ID NO: 1159274 - RNA, 18 nt, Human
ugggaggcugaggcaggu

SEQ ID NO: 1159275 - RNA, 21 nt, Human
uggugaggcucucuuccaggu

SEQ ID NO: 1159276 - RNA, 24 nt, Human
ugguggcucaugacuguaauccca

SEQ ID NO: 1159277 - RNA, 18 nt, Human
uuaaaaacaaacaacaaa

SEQ ID NO: 1159278 - RNA, 19 nt, Human
uuacacgguauacaagcaa

SEQ ID NO: 1159279 - RNA, 20 nt, Human
uugguggugacugaugcuuu

SEQ ID NO: 1159280 - RNA, 23 nt, Human
uuuaaaacucucuaaauaaucac

SEQ ID NO: 1159281 - RNA, 21 nt, Human
aaggggaucuaauguuugggc

SEQ ID NO: 1159282 - RNA, 21 nt, Human
aauaccuacccccaaaucuuc

SEQ ID NO: 1159283 - RNA, 24 nt, Human
agcuagaaagggcccuggagugag

SEQ ID NO: 1159284 - RNA, 25 nt, Human
auaccagucccauucuuccuuuuca

SEQ ID NO: 1159285 - RNA, 18 nt, Human
caggaaagcaccuguccu

SEQ ID NO: 1159286 - RNA, 20 nt, Human
caugcugguuuccuuccugc

SEQ ID NO: 1159287 - RNA, 24 nt, Human
ccccaaaucuucuccuaaccacca

SEQ ID NO: 1159288 - RNA, 21 nt, Human
ccccaauuucuuugagcucac

SEQ ID NO: 1159289 - RNA, 19 nt, Human
cccucagcuuauguagcua

SEQ ID NO: 1159290 - RNA, 20 nt, Human
cuacccccaaaucuucuccu

SEQ ID NO: 1159291 - RNA, 21 nt, Human
cuggccccaugugcucaaggg

SEQ ID NO: 1159292 - RNA, 20 nt, Human
cugggcagaggcuggcccac

SEQ ID NO: 1159293 - RNA, 24 nt, Human
cugugccacucugggcaaaugcuc

SEQ ID NO: 1159294 - RNA, 23 nt, Human
gacccucucuaauccuuccacca

SEQ ID NO: 1159295 - RNA, 21 nt, Human
ggaaagcaccuguccuggcuc

SEQ ID NO: 1159296 - RNA, 20 nt, Human
ggaccagcgcagcccuggug

SEQ ID NO: 1159297 - RNA, 18 nt, Human
gugcucaguucaugcugg

SEQ ID NO: 1159298 - RNA, 18 nt, Human
gugugaagacugggacga

SEQ ID NO: 1159299 - RNA, 21 nt, Human
guucagggcucugcacucuca

SEQ ID NO: 1159300 - RNA, 18 nt, Human
guuuacauaccaguccca

SEQ ID NO: 1159301 - RNA, 21 nt, Human
uaaaagcauccugaccccaau

SEQ ID NO: 1159302 - RNA, 20 nt, Human
uacaggaaagcaccuguccu

SEQ ID NO: 1159303 - RNA, 22 nt, Human
uaccuggcacguaguaggugcu

SEQ ID NO: 1159304 - RNA, 19 nt, Human
uacuaaguccccucucccu

SEQ ID NO: 1159305 - RNA, 19 nt, Human
uagaaagggcccuggagug

SEQ ID NO: 1159306 - RNA, 20 nt, Human
uagcugugccacucugggca

SEQ ID NO: 1159307 - RNA, 22 nt, Human
uagcugugccacucugggcaaa

SEQ ID NO: 1159308 - RNA, 21 nt, Human
uaugauucugaagucuacaga

SEQ ID NO: 1159309 - RNA, 28 nt, Human
ucaauaccuacccccaaaucuucuccua

SEQ ID NO: 1159310 - RNA, 24 nt, Human
ucacgggccuuuugcugaaggucu

SEQ ID NO: 1159311 - RNA, 25 nt, Human
ucaggguguagugguguggcucucu

SEQ ID NO: 1159312 - RNA, 26 nt, Human
uccuugagccuguuuccacaccugua

SEQ ID NO: 1159313 - RNA, 24 nt, Human
ucuauucaucuggaucaugggacc

SEQ ID NO: 1159314 - RNA, 24 nt, Human
ucucuaauccuuccaccaaucaaa

SEQ ID NO: 1159315 - RNA, 21 nt, Human
ucucuggacuuaacgucacuc

SEQ ID NO: 1159316 - RNA, 21 nt, Human
ucucugggcagaggcuggccc

SEQ ID NO: 1159317 - RNA, 22 nt, Human
ucucugggcagaggcuggccca

SEQ ID NO: 1159318 - RNA, 19 nt, Human
ucuuugagcucacgggccu

SEQ ID NO: 1159319 - RNA, 19 nt, Human
ugccaaacccucagcuuau

SEQ ID NO: 1159320 - RNA, 19 nt, Human
uggccccaugugcucaagg

SEQ ID NO: 1159321 - RNA, 21 nt, Human
ugguagcagauugcaaugcuc

SEQ ID NO: 1159322 - RNA, 20 nt, Human
ugugaagacugggacgacac

SEQ ID NO: 1159323 - RNA, 21 nt, Human
uuaaaagcauccugaccccaa

SEQ ID NO: 1159324 - RNA, 21 nt, Human
uucaugcugguuuccuuccug

SEQ ID NO: 1159325 - RNA, 19 nt, Human
uucuccuaaccaccaucug

SEQ ID NO: 1159326 - RNA, 18 nt, Human
uucuuugagcucacgggc

SEQ ID NO: 1159327 - RNA, 22 nt, Human
uuuaaagcauuuuuugcuuuaa

SEQ ID NO: 1159328 - RNA, 26 nt, Human
uuuaaagcauuuuuugcuuuaaaagc

SEQ ID NO: 1159329 - RNA, 20 nt, Human
uuuacuaaguccccucuccc

SEQ ID NO: 1159330 - RNA, 18 nt, Human
aacauggccauccuucuc

SEQ ID NO: 1159331 - RNA, 23 nt, Human
aagaagauccucuugacuucuuu

SEQ ID NO: 1159332 - RNA, 21 nt, Human
aagcauucagggcuuccauca

SEQ ID NO: 1159333 - RNA, 19 nt, Human
aagucugcaauccccuuua

SEQ ID NO: 1159334 - RNA, 24 nt, Human
acagugccuuuuccaggcucaaag

SEQ ID NO: 1159335 - RNA, 21 nt, Human
acaucaaggaaaaagaagauc

SEQ ID NO: 1159336 - RNA, 18 nt, Human
accacuguguaaucuggg

SEQ ID NO: 1159337 - RNA, 18 nt, Human
accuguucccauccuucu

SEQ ID NO: 1159338 - RNA, 20 nt, Human
agaaagagauggccgugaug

SEQ ID NO: 1159339 - RNA, 22 nt, Human
agcuggucccauucgugacaca

SEQ ID NO: 1159340 - RNA, 19 nt, Human
agcuucagaacaucaagga

SEQ ID NO: 1159341 - RNA, 23 nt, Human
aggaaaaagaagauccucuugac

SEQ ID NO: 1159342 - RNA, 21 nt, Human
aggaggaaaggccccucccca

SEQ ID NO: 1159343 - RNA, 22 nt, Human
aucaaggaaaaagaagauccuc

SEQ ID NO: 1159344 - RNA, 20 nt, Human
auccugauaccaaaaccacu

SEQ ID NO: 1159345 - RNA, 23 nt, Human
aucuuguagcuucagaacaucaa

SEQ ID NO: 1159346 - RNA, 20 nt, Human
caaagaagagcuggucccau

SEQ ID NO: 1159347 - RNA, 30 nt, Human
caacucucaacaaaauaaagcgcaggacaa

SEQ ID NO: 1159348 - RNA, 27 nt, Human
cacuccuauucaacaugguauuggaag

SEQ ID NO: 1159349 - RNA, 22 nt, Human
caggaaagguggagaaagagau

SEQ ID NO: 1159350 - RNA, 23 nt, Human
cagugccuuuuccaggcucaaag

SEQ ID NO: 1159351 - RNA, 21 nt, Human
cagugcgguuucaucaacauc

SEQ ID NO: 1159352 - RNA, 18 nt, Human
caucaaggaaaaagaaga

SEQ ID NO: 1159353 - RNA, 28 nt, Human
caucaaggaaaaagaagauccucuugac

SEQ ID NO: 1159354 - RNA, 23 nt, Human
cauccugauaccaaaaccacucc

SEQ ID NO: 1159355 - RNA, 21 nt, Human
cauuccuacugaaacuauucc

SEQ ID NO: 1159356 - RNA, 21 nt, Human
ccagcaucauccugauaccaa

SEQ ID NO: 1159357 - RNA, 20 nt, Human
ccaugguuuguacuaauuua

SEQ ID NO: 1159358 - RNA, 19 nt, Human
ccccagcauccuaggaauu

SEQ ID NO: 1159359 - RNA, 18 nt, Human
cccuccccagcucauucu

SEQ ID NO: 1159360 - RNA, 19 nt, Human
ccucaccccagcauccuag

SEQ ID NO: 1159361 - RNA, 19 nt, Human
ccucugguugcuguuuccu

SEQ ID NO: 1159362 - RNA, 19 nt, Human
ccugccugcaucuuugaau

SEQ ID NO: 1159363 - RNA, 21 nt, Human
ccuggagcucuugauugccau

SEQ ID NO: 1159364 - RNA, 22 nt, Human
ccuguccauggcuuagcaacau

SEQ ID NO: 1159365 - RNA, 24 nt, Human
cuaauuuaucccaaacuuuccacc

SEQ ID NO: 1159366 - RNA, 25 nt, Human
cucaacaaaauaaagcgcaggacaa

SEQ ID NO: 1159367 - RNA, 25 nt, Human
cugauaccaaaaccacuccuauuca

SEQ ID NO: 1159368 - RNA, 23 nt, Human
cugcugccuggucauucuucugg

SEQ ID NO: 1159369 - RNA, 21 nt, Human
cuguugacuuccuugggcaac

SEQ ID NO: 1159370 - RNA, 21 nt, Human
gaacauggccauccuucuccg

SEQ ID NO: 1159371 - RNA, 20 nt, Human
gagcagugguucaggugauc

SEQ ID NO: 1159372 - RNA, 21 nt, Human
gcaggacaagaaggauccaca

SEQ ID NO: 1159373 - RNA, 22 nt, Human
gccacagugccuuuuccaggcu

SEQ ID NO: 1159374 - RNA, 24 nt, Human
ggcauauugcugugacauagccuu

SEQ ID NO: 1159375 - RNA, 19 nt, Human
ggcuuuggaggaggaggca

SEQ ID NO: 1159376 - RNA, 21 nt, Human
ggggcaggaaagguggagaaa

SEQ ID NO: 1159377 - RNA, 26 nt, Human
ggguagugcagccuguuccgggcccc

SEQ ID NO: 1159378 - RNA, 24 nt, Human
gguauuggaagucaucuuguagcu

SEQ ID NO: 1159379 - RNA, 18 nt, Human
gguggagaaagagauggc

SEQ ID NO: 1159380 - RNA, 22 nt, Human
uaugaccaggggccacagugcc

SEQ ID NO: 1159381 - RNA, 18 nt, Human
uauuccaaaaaauugagg

SEQ ID NO: 1159382 - RNA, 22 nt, Human
ucaacaucuuccauuaugcuuu

SEQ ID NO: 1159383 - RNA, 22 nt, Human
ucacaaaggcaacuaugaccag

SEQ ID NO: 1159384 - RNA, 23 nt, Human
ucccaaacuuuccaccaaaacuu

SEQ ID NO: 1159385 - RNA, 20 nt, Human
ucccuucuucccugugagga

SEQ ID NO: 1159386 - RNA, 21 nt, Human
uccuaggaauuucuuucccuu

SEQ ID NO: 1159387 - RNA, 25 nt, Human
ucuaugaggccagcaucauccugau

SEQ ID NO: 1159388 - RNA, 21 nt, Human
ugaagugaagauuuaccuguu

SEQ ID NO: 1159389 - RNA, 19 nt, Human
ugaccaggggccacagugc

SEQ ID NO: 1159390 - RNA, 23 nt, Human
ugaucaucucccucugguugcug

SEQ ID NO: 1159391 - RNA, 25 nt, Human
ugcagagccacucuggaugcuuugg

SEQ ID NO: 1159392 - RNA, 21 nt, Human
ugcagccuguucuccaugccc

SEQ ID NO: 1159393 - RNA, 23 nt, Human
ugcccaugauuagaggcuagagg

SEQ ID NO: 1159394 - RNA, 21 nt, Human
ugccuggucauucuucugggg

SEQ ID NO: 1159395 - RNA, 23 nt, Human
ugccuuuuccaggcucaaaguug

SEQ ID NO: 1159396 - RNA, 23 nt, Human
uggagaaagagauggccgugaug

SEQ ID NO: 1159397 - RNA, 24 nt, Human
uggauaaagagaaaauaccuggcu

SEQ ID NO: 1159398 - RNA, 20 nt, Human
uggcaggggcaggaaagguu

SEQ ID NO: 1159399 - RNA, 22 nt, Human
uguagcuucagaacaucaagga

SEQ ID NO: 1159400 - RNA, 21 nt, Human
ugugacauagccuuucaugca

SEQ ID NO: 1159401 - RNA, 19 nt, Human
uguugacuuccuugggcaa

SEQ ID NO: 1159402 - RNA, 20 nt, Human
uguuucaacagugcgguuuc

SEQ ID NO: 1159403 - RNA, 20 nt, Human
uuccuacugaaacuauucca

SEQ ID NO: 1159404 - RNA, 22 nt, Human
uuucauggaccgcugcaccacu

SEQ ID NO: 1159405 - RNA, 18 nt, Human
aguaccuugucagugggg

SEQ ID NO: 1159406 - RNA, 18 nt, Human
cggcaaauaugugauccc

SEQ ID NO: 1159407 - RNA, 22 nt, Human
ugcuccaauguugcaugucugc

SEQ ID NO: 1159408 - RNA, 20 nt, Human
ugcugccaguaccuugucag

SEQ ID NO: 1159409 - RNA, 18 nt, Human
aucugugaggacacagag

SEQ ID NO: 1159410 - RNA, 21 nt, Human
cacaggcuuuuauuuguuuuc

SEQ ID NO: 1159411 - RNA, 20 nt, Human
cauggucagccuuccacuuc

SEQ ID NO: 1159412 - RNA, 24 nt, Human
caugucagucaggccaguucccug

SEQ ID NO: 1159413 - RNA, 21 nt, Human
ccaccgggcgccuggccccug

SEQ ID NO: 1159414 - RNA, 20 nt, Human
cuugucccacuuccccgcuu

SEQ ID NO: 1159415 - RNA, 21 nt, Human
uauuuguuuucuucagauugc

SEQ ID NO: 1159416 - RNA, 19 nt, Human
ucccugcagagggaauucc

SEQ ID NO: 1159417 - RNA, 21 nt, Human
ugagacaaacaucugcauuua

SEQ ID NO: 1159418 - RNA, 21 nt, Human
ugcaugucagucaggccaguu

SEQ ID NO: 1159419 - RNA, 23 nt, Human
uucccagcaugaccucauucauc

SEQ ID NO: 1159420 - RNA, 24 nt, Human
uuuagacauacacauucaucuacu

SEQ ID NO: 1159421 - RNA, 25 nt, Human
uuuguuuucuucagauugcuuuuuc

SEQ ID NO: 1159422 - RNA, 24 nt, Human
aagcucagaauccaacuaugaagu

SEQ ID NO: 1159423 - RNA, 24 nt, Human
acauugagggacugggcagaggga

SEQ ID NO: 1159424 - RNA, 19 nt, Human
agaagccggcucugggcac

SEQ ID NO: 1159425 - RNA, 23 nt, Human
agaaucuggaauccagcagcugc

SEQ ID NO: 1159426 - RNA, 18 nt, Human
agaugauccuaagcucag

SEQ ID NO: 1159427 - RNA, 18 nt, Human
aggcagggagguggggcc

SEQ ID NO: 1159428 - RNA, 21 nt, Human
aggcagggagguggggcgcag

SEQ ID NO: 1159429 - RNA, 24 nt, Human
aggcagggagguggggcgcagugg

SEQ ID NO: 1159430 - RNA, 24 nt, Human
aggcagggagguggggcgcagugg

SEQ ID NO: 1159431 - RNA, 18 nt, Human
aucccaguuccccuuucc

SEQ ID NO: 1159432 - RNA, 21 nt, Human
auucagugccuuggaauauca

SEQ ID NO: 1159433 - RNA, 22 nt, Human
caacauugagggacugggcaga

SEQ ID NO: 1159434 - RNA, 22 nt, Human
cagccccuccccaaaucccagu

SEQ ID NO: 1159435 - RNA, 21 nt, Human
caggaucuagacuuggggccu

SEQ ID NO: 1159436 - RNA, 23 nt, Human
cagggauuaagggcuugggauuc

SEQ ID NO: 1159437 - RNA, 19 nt, Human
ccagccccuccccaaaucc

SEQ ID NO: 1159438 - RNA, 27 nt, Human
ccccaaaucccaguuccccuuuccaag

SEQ ID NO: 1159439 - RNA, 19 nt, Human
ccuccagccccuccccaaa

SEQ ID NO: 1159440 - RNA, 24 nt, Human
gaagauucagaucagaaaccaggg

SEQ ID NO: 1159441 - RNA, 19 nt, Human
gagcuuagaaaauuuauuc

SEQ ID NO: 1159442 - RNA, 18 nt, Human
gccaggaucuagacuugg

SEQ ID NO: 1159443 - RNA, 18 nt, Human
gcuuggguuuagggaagg

SEQ ID NO: 1159444 - RNA, 21 nt, Human
gcuuggguuuagggaagggug

SEQ ID NO: 1159445 - RNA, 22 nt, Human
ggcccugauagugcuggggugg

SEQ ID NO: 1159446 - RNA, 18 nt, Human
gggcaccagugugugugg

SEQ ID NO: 1159447 - RNA, 20 nt, Human
gguuuuuuuguuuuuguuuu

SEQ ID NO: 1159448 - RNA, 18 nt, Human
guaggggaggaggacuuu

SEQ ID NO: 1159449 - RNA, 22 nt, Human
uaagcucagaauccaacuauga

SEQ ID NO: 1159450 - RNA, 24 nt, Human
ucagaauccaacuaugaagugcag

SEQ ID NO: 1159451 - RNA, 21 nt, Human
uccccaaaucccaguuccccu

SEQ ID NO: 1159452 - RNA, 27 nt, Human
uccuccagccccuccccaaaucccagg

SEQ ID NO: 1159453 - RNA, 22 nt, Human
ucuccagaugauccuaagcucu

SEQ ID NO: 1159454 - RNA, 21 nt, Human
ucuccuggcuuucaacucugg

SEQ ID NO: 1159455 - RNA, 19 nt, Human
ugaaauaacacacacaggc

SEQ ID NO: 1159456 - RNA, 21 nt, Human
ugaauuuggggauuuggcggg

SEQ ID NO: 1159457 - RNA, 22 nt, Human
ugagggacugggcagagggauu

SEQ ID NO: 1159458 - RNA, 20 nt, Human
ugauccuaagcucagaaucc

SEQ ID NO: 1159459 - RNA, 19 nt, Human
ugcauucaagagaugaggu

SEQ ID NO: 1159460 - RNA, 22 nt, Human
ugccgauuuucuccuggcuuuc

SEQ ID NO: 1159461 - RNA, 23 nt, Human
ugccuuggaauaucagggucugc

SEQ ID NO: 1159462 - RNA, 20 nt, Human
uguuuuuuuccuuugaaaua

SEQ ID NO: 1159463 - RNA, 23 nt, Human
uuuauuccuuuuguuuuuuuccu

SEQ ID NO: 1159464 - RNA, 18 nt, Human
uuuccaagucccuccaug

SEQ ID NO: 1159465 - RNA, 23 nt, Human
acggagccccguggccugguugc

SEQ ID NO: 1159466 - RNA, 28 nt, Human
aguggcugacugacucuguguuucuaug

SEQ ID NO: 1159467 - RNA, 22 nt, Human
cagaagaacacuuggguggaag

SEQ ID NO: 1159468 - RNA, 18 nt, Human
cagagccugagaaucgcc

SEQ ID NO: 1159469 - RNA, 23 nt, Human
ccucugugaacaaggaagagggu

SEQ ID NO: 1159470 - RNA, 24 nt, Human
ccugcauuuucuuuauccauucau

SEQ ID NO: 1159471 - RNA, 20 nt, Human
cggccaucuuggcuccuccc

SEQ ID NO: 1159472 - RNA, 25 nt, Human
cguggccugguugcucggcagggug

SEQ ID NO: 1159473 - RNA, 18 nt, Human
cuccucccaccauauguc

SEQ ID NO: 1159474 - RNA, 23 nt, Human
cugcagggucagcugacugccgu

SEQ ID NO: 1159475 - RNA, 21 nt, Human
cugcgcucgccugcacacugc

SEQ ID NO: 1159476 - RNA, 18 nt, Human
cugguugcucggcagggu

SEQ ID NO: 1159477 - RNA, 20 nt, Human
gagaacucuucauuuguauc

SEQ ID NO: 1159478 - RNA, 18 nt, Human
gccugguugcucggcagg

SEQ ID NO: 1159479 - RNA, 19 nt, Human
gcgcucgccugcacacugc

SEQ ID NO: 1159480 - RNA, 21 nt, Human
uaacugccagagccugagaau

SEQ ID NO: 1159481 - RNA, 18 nt, Human
ucagauggaaaugcagaa

SEQ ID NO: 1159482 - RNA, 21 nt, Human
ucucacacacugcggagaacc

SEQ ID NO: 1159483 - RNA, 22 nt, Human
ucuucuugccucagauggaaau

SEQ ID NO: 1159484 - RNA, 23 nt, Human
ugccagagccugagaaucgcccc

SEQ ID NO: 1159485 - RNA, 23 nt, Human
ugccagagccugagaaucgcccc

SEQ ID NO: 1159486 - RNA, 20 nt, Human
ugcuccaguaucgacuguug

SEQ ID NO: 1159487 - RNA, 19 nt, Human
uggcagaagaacacuuggg

SEQ ID NO: 1159488 - RNA, 20 nt, Human
uuggcuccucccaccauaug

SEQ ID NO: 1159489 - RNA, 22 nt, Human
agguauguuuacuucauaagaa

SEQ ID NO: 1159490 - RNA, 26 nt, Human
gcuguauuuuacaauaaagagaaaaa

SEQ ID NO: 1159491 - RNA, 24 nt, Human
ucuauacacuuugcuguaugugug

SEQ ID NO: 1159492 - RNA, 19 nt, Human
ugacuggucuagguugcca

SEQ ID NO: 1159493 - RNA, 19 nt, Human
ugccgcgucccugacuggu

SEQ ID NO: 1159494 - RNA, 21 nt, Human
uucagaguuguacguacuuug

SEQ ID NO: 1159495 - RNA, 23 nt, Human
agaggagggaaaggggagugggu

SEQ ID NO: 1159496 - RNA, 21 nt, Human
cagcagaggagggaaagggga

SEQ ID NO: 1159497 - RNA, 24 nt, Human
cugaagauucuucagcagaggaag

SEQ ID NO: 1159498 - RNA, 23 nt, Human
ugucccgcaggcagcuugagaaa

SEQ ID NO: 1159499 - RNA, 25 nt, Human
uucagcagaggagggaaaggggagu

SEQ ID NO: 1159500 - RNA, 22 nt, Human
aaaacccucuucaggccuccag

SEQ ID NO: 1159501 - RNA, 22 nt, Human
aaacccaccugacuuccagagc

SEQ ID NO: 1159502 - RNA, 24 nt, Human
aaagugcugggauuacaggcguga

SEQ ID NO: 1159503 - RNA, 24 nt, Human
aaccuccuccaggcagcccuccca

SEQ ID NO: 1159504 - RNA, 20 nt, Human
aaccucuaccucccaaguuc

SEQ ID NO: 1159505 - RNA, 23 nt, Human
aacuaacucucucaggaaaccca

SEQ ID NO: 1159506 - RNA, 24 nt, Human
aagaaaaccuucucagggcaggcu

SEQ ID NO: 1159507 - RNA, 20 nt, Human
aagaggacaaacauggaggc

SEQ ID NO: 1159508 - RNA, 19 nt, Human
aagcaaaaauggaaaacag

SEQ ID NO: 1159509 - RNA, 22 nt, Human
aagcaaaaauggaaaacagcuc

SEQ ID NO: 1159510 - RNA, 24 nt, Human
aagcaaaaauggaaaacagcucug

SEQ ID NO: 1159511 - RNA, 19 nt, Human
aagugcagaggcccaagag

SEQ ID NO: 1159512 - RNA, 19 nt, Human
aagugcugggauuacaggc

SEQ ID NO: 1159513 - RNA, 19 nt, Human
aagugcugggauuacaggc

SEQ ID NO: 1159514 - RNA, 26 nt, Human
aagugcugggauuacaggcgugagcu

SEQ ID NO: 1159515 - RNA, 22 nt, Human
aauagagacaggguuucaccau

SEQ ID NO: 1159516 - RNA, 22 nt, Human
aaucaucggaaguccugaagcu

SEQ ID NO: 1159517 - RNA, 21 nt, Human
acaggcacccgccaccaugcc

SEQ ID NO: 1159518 - RNA, 18 nt, Human
acaggguuucaccauguu

SEQ ID NO: 1159519 - RNA, 19 nt, Human
acaggguuucaccauguua

SEQ ID NO: 1159520 - RNA, 20 nt, Human
acaggguuucaccauguuag

SEQ ID NO: 1159521 - RNA, 24 nt, Human
acaggguuucaccauguuagccag

SEQ ID NO: 1159522 - RNA, 22 nt, Human
accagucucccugcacaucugc

SEQ ID NO: 1159523 - RNA, 20 nt, Human
acccaccugacuuccagagc

SEQ ID NO: 1159524 - RNA, 19 nt, Human
acccucuucaggccuccag

SEQ ID NO: 1159525 - RNA, 24 nt, Human
accucgugauccgccugccuuggc

SEQ ID NO: 1159526 - RNA, 25 nt, Human
acucugucgcccaggcuggagugca

SEQ ID NO: 1159527 - RNA, 18 nt, Human
acuucaacucagccaggc

SEQ ID NO: 1159528 - RNA, 19 nt, Human
agaggaaagugggagaggc

SEQ ID NO: 1159529 - RNA, 22 nt, Human
agaggacaaacauggaggcaag

SEQ ID NO: 1159530 - RNA, 18 nt, Human
agagguggccaccugggg

SEQ ID NO: 1159531 - RNA, 21 nt, Human
agaguuccuccacucuggcuu

SEQ ID NO: 1159532 - RNA, 22 nt, Human
agccacaagcucuucuaagucc

SEQ ID NO: 1159533 - RNA, 23 nt, Human
agccagcccagaagccagggcuc

SEQ ID NO: 1159534 - RNA, 26 nt, Human
agcuugucaaggaagacucuaaccaa

SEQ ID NO: 1159535 - RNA, 21 nt, Human
aggaaaaggugagagccagaa

SEQ ID NO: 1159536 - RNA, 18 nt, Human
aggaaagugggagaggcc

SEQ ID NO: 1159537 - RNA, 18 nt, Human
aggacaaacauggaggca

SEQ ID NO: 1159538 - RNA, 18 nt, Human
aggagccugcaguaaaug

SEQ ID NO: 1159539 - RNA, 23 nt, Human
aggcaagaaagugcagaggccca

SEQ ID NO: 1159540 - RNA, 20 nt, Human
aggcagcccucccagcuucc

SEQ ID NO: 1159541 - RNA, 19 nt, Human
aggccagggaaggcaaggu

SEQ ID NO: 1159542 - RNA, 24 nt, Human
aggccuccaggcucucuaggcccc

SEQ ID NO: 1159543 - RNA, 25 nt, Human
aggcuggagugcaguagcgcgaucu

SEQ ID NO: 1159544 - RNA, 18 nt, Human
aguagcugggacuacagg

SEQ ID NO: 1159545 - RNA, 19 nt, Human
aguagcugggacuacaggc

SEQ ID NO: 1159546 - RNA, 23 nt, Human
agugcaguagcgcgaucuuggcu

SEQ ID NO: 1159547 - RNA, 24 nt, Human
agugcaguagcgcgaucuuggcuc

SEQ ID NO: 1159548 - RNA, 19 nt, Human
agugguagggagggggacg

SEQ ID NO: 1159549 - RNA, 23 nt, Human
auaaaguccccuucaggaauaag

SEQ ID NO: 1159550 - RNA, 25 nt, Human
auaaaguccccuucaggaauaagca

SEQ ID NO: 1159551 - RNA, 26 nt, Human
auaaaguccccuucaggaauaagcaa

SEQ ID NO: 1159552 - RNA, 19 nt, Human
aucaggagguguuagguau

SEQ ID NO: 1159553 - RNA, 19 nt, Human
auccgccugccuuggccuc

SEQ ID NO: 1159554 - RNA, 19 nt, Human
augggaaucauccugggcu

SEQ ID NO: 1159555 - RNA, 23 nt, Human
auggucuuuucacucaaagccuu

SEQ ID NO: 1159556 - RNA, 22 nt, Human
auuaccaaaccuaagacuguga

SEQ ID NO: 1159557 - RNA, 24 nt, Human
caaagugcugggauuacaggcgug

SEQ ID NO: 1159558 - RNA, 18 nt, Human
caacaugagaacugcucg

SEQ ID NO: 1159559 - RNA, 22 nt, Human
caagaggacaaacauggaggca

SEQ ID NO: 1159560 - RNA, 18 nt, Human
caagguggaggccccagg

SEQ ID NO: 1159561 - RNA, 18 nt, Human
caaguuuuccuuuuuccu

SEQ ID NO: 1159562 - RNA, 22 nt, Human
cacaccauucuccugccucagc

SEQ ID NO: 1159563 - RNA, 18 nt, Human
caccauguuagccaggau

SEQ ID NO: 1159564 - RNA, 22 nt, Human
caccauguuagccaggaugguc

SEQ ID NO: 1159565 - RNA, 24 nt, Human
caccauguuagccaggauggucuc

SEQ ID NO: 1159566 - RNA, 24 nt, Human
caccuggggccaaccuccccagac

SEQ ID NO: 1159567 - RNA, 18 nt, Human
cacggcauccuaaccucc

SEQ ID NO: 1159568 - RNA, 24 nt, Human
cacucugucgcccaggcuggagug

SEQ ID NO: 1159569 - RNA, 22 nt, Human
cagagcccuuuacacugaugcc

SEQ ID NO: 1159570 - RNA, 23 nt, Human
cagagcccuuuacacugaugcca

SEQ ID NO: 1159571 - RNA, 21 nt, Human
cagcaccagucucccugcaca

SEQ ID NO: 1159572 - RNA, 19 nt, Human
cagccagcccagaagccag

SEQ ID NO: 1159573 - RNA, 20 nt, Human
cagccuccugaguagcuggg

SEQ ID NO: 1159574 - RNA, 19 nt, Human
caggcagcccucccagcuu

SEQ ID NO: 1159575 - RNA, 22 nt, Human
cagggaccagcagggacugugg

SEQ ID NO: 1159576 - RNA, 24 nt, Human
caggguuucaccauguuagccagg

SEQ ID NO: 1159577 - RNA, 19 nt, Human
caguaucacucaaggagcc

SEQ ID NO: 1159578 - RNA, 23 nt, Human
caucgauaaaguccccuucagga

SEQ ID NO: 1159579 - RNA, 22 nt, Human
ccaaagugcugggauuacaggc

SEQ ID NO: 1159580 - RNA, 22 nt, Human
ccaaagugcugggauuacaggc

SEQ ID NO: 1159581 - RNA, 24 nt, Human
ccaaagugcugggauuacaggcgu

SEQ ID NO: 1159582 - RNA, 22 nt, Human
ccagggaaggcaagguggccca

SEQ ID NO: 1159583 - RNA, 20 nt, Human
ccaguuguggagcaguauca

SEQ ID NO: 1159584 - RNA, 24 nt, Human
ccccaaaccacucgcuugucacuu

SEQ ID NO: 1159585 - RNA, 19 nt, Human
ccccagaguccagggacca

SEQ ID NO: 1159586 - RNA, 20 nt, Human
ccccagaguccagggaccag

SEQ ID NO: 1159587 - RNA, 22 nt, Human
ccccagaguccagggaccagca

SEQ ID NO: 1159588 - RNA, 24 nt, Human
ccccagaguccagggaccagcagg

SEQ ID NO: 1159589 - RNA, 20 nt, Human
ccccaguaauucagcaccag

SEQ ID NO: 1159590 - RNA, 22 nt, Human
ccccuauccccugcccacuucc

SEQ ID NO: 1159591 - RNA, 19 nt, Human
cccugcacaucugcccuuc

SEQ ID NO: 1159592 - RNA, 18 nt, Human
ccuaaacccccuuucaca

SEQ ID NO: 1159593 - RNA, 19 nt, Human
ccuaaacccccuuucacac

SEQ ID NO: 1159594 - RNA, 23 nt, Human
ccuccaggcagcccucccagcuu

SEQ ID NO: 1159595 - RNA, 18 nt, Human
ccuccaggcucucuaggc

SEQ ID NO: 1159596 - RNA, 24 nt, Human
ccucccaaguucacaccauucucc

SEQ ID NO: 1159597 - RNA, 18 nt, Human
ccuccccagacccaguug

SEQ ID NO: 1159598 - RNA, 21 nt, Human
ccucugacuaucuucccucca

SEQ ID NO: 1159599 - RNA, 23 nt, Human
ccucugacuaucuucccuccaga

SEQ ID NO: 1159600 - RNA, 21 nt, Human
ccugaagcuagagccacaagc

SEQ ID NO: 1159601 - RNA, 23 nt, Human
ccugaguagcugggacuacaggc

SEQ ID NO: 1159602 - RNA, 24 nt, Human
ccugaguagcugggacuacaggca

SEQ ID NO: 1159603 - RNA, 23 nt, Human
ccugccucagccuccugaguagc

SEQ ID NO: 1159604 - RNA, 24 nt, Human
ccugccucagccuccugaguagcu

SEQ ID NO: 1159605 - RNA, 27 nt, Human
ccugccugugacugcugcaaggguugg

SEQ ID NO: 1159606 - RNA, 22 nt, Human
ccugccuuggccucccaaagug

SEQ ID NO: 1159607 - RNA, 21 nt, Human
ccuggggccaaccuccccaga

SEQ ID NO: 1159608 - RNA, 22 nt, Human
ccuguaaccucuaccucccaag

SEQ ID NO: 1159609 - RNA, 22 nt, Human
ccuucccuaaacccccuuucac

SEQ ID NO: 1159610 - RNA, 19 nt, Human
ccuucugaaaggaggccua

SEQ ID NO: 1159611 - RNA, 21 nt, Human
cucaccuggaaaacacaacug

SEQ ID NO: 1159612 - RNA, 24 nt, Human
cucacucugucgcccaggcuggag

SEQ ID NO: 1159613 - RNA, 24 nt, Human
cucagccuccugaguagcugggac

SEQ ID NO: 1159614 - RNA, 28 nt, Human
cuccuccaggcagcccucccagcuucag

SEQ ID NO: 1159615 - RNA, 24 nt, Human
cuccugaccucgugauccgccugc

SEQ ID NO: 1159616 - RNA, 19 nt, Human
cugacuuccagagcaacag

SEQ ID NO: 1159617 - RNA, 28 nt, Human
cugauggucuuuucacucaaagccuucu

SEQ ID NO: 1159618 - RNA, 23 nt, Human
cugccuuggccucccaaagugcu

SEQ ID NO: 1159619 - RNA, 19 nt, Human
cugggaaagguggccauag

SEQ ID NO: 1159620 - RNA, 24 nt, Human
cuguaaccucuaccucccaaguuc

SEQ ID NO: 1159621 - RNA, 19 nt, Human
cuuccagagcaacagaagg

SEQ ID NO: 1159622 - RNA, 22 nt, Human
cuucccuaaacccccuuucacc

SEQ ID NO: 1159623 - RNA, 22 nt, Human
cuuuacacugaugccagugccc

SEQ ID NO: 1159624 - RNA, 21 nt, Human
cuuugggcaguuguccugaga

SEQ ID NO: 1159625 - RNA, 20 nt, Human
cuuuggggaagaggaaagug

SEQ ID NO: 1159626 - RNA, 24 nt, Human
gaaaaacccucuucaggccuccag

SEQ ID NO: 1159627 - RNA, 20 nt, Human
gaccucgugauccgccugcc

SEQ ID NO: 1159628 - RNA, 21 nt, Human
gaccucgugauccgccugccu

SEQ ID NO: 1159629 - RNA, 24 nt, Human
gaccucgugauccgccugccuugg

SEQ ID NO: 1159630 - RNA, 24 nt, Human
gacuacaggcacccgccaccaugc

SEQ ID NO: 1159631 - RNA, 26 nt, Human
gagaguuccuccacucuggggcacuc

SEQ ID NO: 1159632 - RNA, 18 nt, Human
gagcauuaccaaaccuaa

SEQ ID NO: 1159633 - RNA, 25 nt, Human
gaguagcugggacuacaggcacccg

SEQ ID NO: 1159634 - RNA, 24 nt, Human
gauaaaguccccuucaggaauaag

SEQ ID NO: 1159635 - RNA, 19 nt, Human
gauuacaggcgugagcuac

SEQ ID NO: 1159636 - RNA, 22 nt, Human
gauuacaggcgugagcuaccgc

SEQ ID NO: 1159637 - RNA, 19 nt, Human
gcccaggcuggagugcagu

SEQ ID NO: 1159638 - RNA, 24 nt, Human
gccuggcuaauuuuuuuguauuuu

SEQ ID NO: 1159639 - RNA, 27 nt, Human
gccugugucaacuuucauuuuuccugg

SEQ ID NO: 1159640 - RNA, 22 nt, Human
gccuuggccucccaaagugcug

SEQ ID NO: 1159641 - RNA, 22 nt, Human
gcuauggcuuccaacaucuccu

SEQ ID NO: 1159642 - RNA, 25 nt, Human
ggaaaacagcucugcaggaaaaggu

SEQ ID NO: 1159643 - RNA, 22 nt, Human
ggaaacccaccugacuuccaga

SEQ ID NO: 1159644 - RNA, 23 nt, Human
ggaaagugggagaggcuuucccc

SEQ ID NO: 1159645 - RNA, 27 nt, Human
ggaagacucuaaccaagggugggcccu

SEQ ID NO: 1159646 - RNA, 22 nt, Human
ggacaggaggucccaggcagug

SEQ ID NO: 1159647 - RNA, 18 nt, Human
ggacagggggugcacaug

SEQ ID NO: 1159648 - RNA, 19 nt, Human
ggcaccugccugugacugc

SEQ ID NO: 1159649 - RNA, 23 nt, Human
ggcuuccaacaucuccucagccc

SEQ ID NO: 1159650 - RNA, 24 nt, Human
ggcuugaagggccucuggcuucca

SEQ ID NO: 1159651 - RNA, 20 nt, Human
ggucucaaucuccugaccuc

SEQ ID NO: 1159652 - RNA, 21 nt, Human
ggucugaaaaacccucuucag

SEQ ID NO: 1159653 - RNA, 21 nt, Human
ggucuggcaacaugagaacug

SEQ ID NO: 1159654 - RNA, 19 nt, Human
ggugcgaauggcaccugcc

SEQ ID NO: 1159655 - RNA, 21 nt, Human
ggugguucuugaugcuggcaa

SEQ ID NO: 1159656 - RNA, 21 nt, Human
ggugugagaagugaugguggu

SEQ ID NO: 1159657 - RNA, 24 nt, Human
gguuucaccauguuagccaggaug

SEQ ID NO: 1159658 - RNA, 24 nt, Human
guagggacuucaacucagccaggc

SEQ ID NO: 1159659 - RNA, 26 nt, Human
guccugagagugguagggagggggac

SEQ ID NO: 1159660 - RNA, 19 nt, Human
gucugcccugaggccgugc

SEQ ID NO: 1159661 - RNA, 23 nt, Human
uaaccccagaguccagggaccag

SEQ ID NO: 1159662 - RNA, 24 nt, Human
uaaccccagaguccagggaccagc

SEQ ID NO: 1159663 - RNA, 23 nt, Human
uaaccuccuccaggcagcccucc

SEQ ID NO: 1159664 - RNA, 26 nt, Human
uaacucucucaggaaacccaccugac

SEQ ID NO: 1159665 - RNA, 24 nt, Human
uaauagagacaggguuucaccaug

SEQ ID NO: 1159666 - RNA, 26 nt, Human
uaauagagacaggguuucaccauguu

SEQ ID NO: 1159667 - RNA, 22 nt, Human
uacaggcacccgccaccaugcc

SEQ ID NO: 1159668 - RNA, 22 nt, Human
uacaggcgugagcuaccgcgcc

SEQ ID NO: 1159669 - RNA, 23 nt, Human
uacaggcgugagcuaccgcgccu

SEQ ID NO: 1159670 - RNA, 23 nt, Human
uacauuucagaccaucuccaggg

SEQ ID NO: 1159671 - RNA, 19 nt, Human
uaccucccaaguucacacc

SEQ ID NO: 1159672 - RNA, 21 nt, Human
uagagacaggguuucaccaug

SEQ ID NO: 1159673 - RNA, 22 nt, Human
uagagacaggguuucaccaugu

SEQ ID NO: 1159674 - RNA, 21 nt, Human
ucacaccauucuccugccuca

SEQ ID NO: 1159675 - RNA, 24 nt, Human
ucaccauguuagccaggauggucu

SEQ ID NO: 1159676 - RNA, 21 nt, Human
ucaccuggaaaacacaacugg

SEQ ID NO: 1159677 - RNA, 24 nt, Human
ucacucugucgcccaggcuggagu

SEQ ID NO: 1159678 - RNA, 24 nt, Human
ucacuucucuucaguccaaggguc

SEQ ID NO: 1159679 - RNA, 18 nt, Human
ucagccaggcuauggcuu

SEQ ID NO: 1159680 - RNA, 21 nt, Human
ucagccaggcuauggcuucca

SEQ ID NO: 1159681 - RNA, 23 nt, Human
ucagccuccugaguagcugggac

SEQ ID NO: 1159682 - RNA, 24 nt, Human
ucagcugaccucugacuaucuucc

SEQ ID NO: 1159683 - RNA, 19 nt, Human
uccaagaggacaaacaugg

SEQ ID NO: 1159684 - RNA, 21 nt, Human
uccagagcaacagaaggaaga

SEQ ID NO: 1159685 - RNA, 18 nt, Human
uccaggcagcccucccag

SEQ ID NO: 1159686 - RNA, 21 nt, Human
uccauucacaggaugcagcca

SEQ ID NO: 1159687 - RNA, 24 nt, Human
ucccaaagugcugggauuacaggc

SEQ ID NO: 1159688 - RNA, 21 nt, Human
ucccaaguucacaccauucuc

SEQ ID NO: 1159689 - RNA, 24 nt, Human
ucccaaguucacaccauucuccug

SEQ ID NO: 1159690 - RNA, 22 nt, Human
ucccaggcgaagcugccccaaa

SEQ ID NO: 1159691 - RNA, 20 nt, Human
uccccuucaggaauaagcaa

SEQ ID NO: 1159692 - RNA, 18 nt, Human
ucccuccagagcguggaa

SEQ ID NO: 1159693 - RNA, 19 nt, Human
ucccuguaaccucuaccuc

SEQ ID NO: 1159694 - RNA, 20 nt, Human
uccucagccccacuccauuc

SEQ ID NO: 1159695 - RNA, 19 nt, Human
uccuccaggcagcccuccc

SEQ ID NO: 1159696 - RNA, 22 nt, Human
uccugagagugguagggagggg

SEQ ID NO: 1159697 - RNA, 24 nt, Human
uccugaguagcugggacuacaggc

SEQ ID NO: 1159698 - RNA, 20 nt, Human
uccugggcugucucugagca

SEQ ID NO: 1159699 - RNA, 19 nt, Human
ucgaagcuggguagcuggc

SEQ ID NO: 1159700 - RNA, 24 nt, Human
ucgcccaggcuggagugcaguagc

SEQ ID NO: 1159701 - RNA, 22 nt, Human
ucuaccucccaaguucacacca

SEQ ID NO: 1159702 - RNA, 22 nt, Human
ucucacucugucgcccaggcug

SEQ ID NO: 1159703 - RNA, 23 nt, Human
ucucacucugucgcccaggcugg

SEQ ID NO: 1159704 - RNA, 24 nt, Human
ucucacucugucgcccaggcugga

SEQ ID NO: 1159705 - RNA, 26 nt, Human
ucucacucugucgcccaggcuggagu

SEQ ID NO: 1159706 - RNA, 27 nt, Human
ucucacucugucgcccaggcuggagug

SEQ ID NO: 1159707 - RNA, 24 nt, Human
ucuccugccucagccuccugagua

SEQ ID NO: 1159708 - RNA, 20 nt, Human
ucucuaggccccaguaauuc

SEQ ID NO: 1159709 - RNA, 24 nt, Human
ucucugagcauccagccacagucc

SEQ ID NO: 1159710 - RNA, 22 nt, Human
ucugaaaaacccucuucaggcc

SEQ ID NO: 1159711 - RNA, 22 nt, Human
ucugggcaaccuuggacaauuc

SEQ ID NO: 1159712 - RNA, 24 nt, Human
ucugucgcccaggcuggagugcag

SEQ ID NO: 1159713 - RNA, 21 nt, Human
ucuucaggccuccaggcucuc

SEQ ID NO: 1159714 - RNA, 20 nt, Human
ucuuuucacucaaagccuuc

SEQ ID NO: 1159715 - RNA, 20 nt, Human
ugaaaggaggccuaaggaag

SEQ ID NO: 1159716 - RNA, 20 nt, Human
ugaccucugacuaucuuccc

SEQ ID NO: 1159717 - RNA, 21 nt, Human
ugaccucugacuaucuucccu

SEQ ID NO: 1159718 - RNA, 19 nt, Human
ugagcauccagccacaguc

SEQ ID NO: 1159719 - RNA, 18 nt, Human
ugagccagggguugaugg

SEQ ID NO: 1159720 - RNA, 18 nt, Human
ugaggaaccucaggucug

SEQ ID NO: 1159721 - RNA, 19 nt, Human
ugagggcuucuugaauggu

SEQ ID NO: 1159722 - RNA, 26 nt, Human
ugagggcuucuugaauggugugagaa

SEQ ID NO: 1159723 - RNA, 20 nt, Human
ugagggguucaggauccauc

SEQ ID NO: 1159724 - RNA, 19 nt, Human
ugauggggcccagagccgg

SEQ ID NO: 1159725 - RNA, 22 nt, Human
ugcaguagcgcgaucuuggcuc

SEQ ID NO: 1159726 - RNA, 19 nt, Human
ugcaugggauggggucuga

SEQ ID NO: 1159727 - RNA, 21 nt, Human
ugccacaaaaccggucaucga

SEQ ID NO: 1159728 - RNA, 24 nt, Human
ugccucagccuccugaguagcugg

SEQ ID NO: 1159729 - RNA, 25 nt, Human
ugcuccuucccuaaacccccuuuca

SEQ ID NO: 1159730 - RNA, 20 nt, Human
ugcugggauuacaggcguga

SEQ ID NO: 1159731 - RNA, 22 nt, Human
uggaaaacagcucugcaggaaa

SEQ ID NO: 1159732 - RNA, 21 nt, Human
uggaagauacuuuggggaaga

SEQ ID NO: 1159733 - RNA, 20 nt, Human
uggaggcaagaaagugcaga

SEQ ID NO: 1159734 - RNA, 18 nt, Human
uggaggccccagggaggu

SEQ ID NO: 1159735 - RNA, 18 nt, Human
uggaggccccagggaggu

SEQ ID NO: 1159736 - RNA, 24 nt, Human
uggagucucacucugucgcccagg

SEQ ID NO: 1159737 - RNA, 23 nt, Human
uggagugcaguagcgcgaucuug

SEQ ID NO: 1159738 - RNA, 24 nt, Human
uggagugcaguagcgcgaucuugg

SEQ ID NO: 1159739 - RNA, 18 nt, Human
uggcuuccaacaucuccu

SEQ ID NO: 1159740 - RNA, 21 nt, Human
ugggacuacaggcacccgcca

SEQ ID NO: 1159741 - RNA, 22 nt, Human
ugggacuacaggcacccgccac

SEQ ID NO: 1159742 - RNA, 24 nt, Human
ugggacuacaggcacccgccacca

SEQ ID NO: 1159743 - RNA, 25 nt, Human
ugggacuacaggcacccgccaccau

SEQ ID NO: 1159744 - RNA, 18 nt, Human
ugggauuacaggcgugag

SEQ ID NO: 1159745 - RNA, 19 nt, Human
ugggauuacaggcgugagc

SEQ ID NO: 1159746 - RNA, 21 nt, Human
ugggauuacaggcgugagcua

SEQ ID NO: 1159747 - RNA, 22 nt, Human
ugggauuacaggcgugagcuac

SEQ ID NO: 1159748 - RNA, 23 nt, Human
ugggauuacaggcgugagcuacc

SEQ ID NO: 1159749 - RNA, 24 nt, Human
ugggauuacaggcgugagcuaccg

SEQ ID NO: 1159750 - RNA, 27 nt, Human
uggggcccagagccgggguaaccccag

SEQ ID NO: 1159751 - RNA, 21 nt, Human
ugggugcgaauggcaccugcc

SEQ ID NO: 1159752 - RNA, 23 nt, Human
ugucaaggaagacucuaaccaag

SEQ ID NO: 1159753 - RNA, 24 nt, Human
uuaauagagacaggguuucaccau

SEQ ID NO: 1159754 - RNA, 21 nt, Human
uucacacaugcacggcauccu

SEQ ID NO: 1159755 - RNA, 21 nt, Human
uucuaaaugcagagaaaaccc

SEQ ID NO: 1159756 - RNA, 25 nt, Human
uugaauggugugagaagugauggug

SEQ ID NO: 1159757 - RNA, 22 nt, Human
uuggacaauucagcugaccucu

SEQ ID NO: 1159758 - RNA, 18 nt, Human
uuggccucccaaagugcu

SEQ ID NO: 1159759 - RNA, 21 nt, Human
uuuaagaggcugaccuucaaa

SEQ ID NO: 1159760 - RNA, 21 nt, Human
uuucacacaugcacggcaucc

SEQ ID NO: 1159761 - RNA, 19 nt, Human
uuucaccauguuagccagg

SEQ ID NO: 1159762 - RNA, 20 nt, Human
uuucaccauguuagccagga

SEQ ID NO: 1159763 - RNA, 21 nt, Human
uuuccuuuuuccuuccauugg

SEQ ID NO: 1159764 - RNA, 18 nt, Human
uuugcagaaccuggagug

SEQ ID NO: 1159765 - RNA, 24 nt, Human
uuuuuaauagagacaggguuucac

SEQ ID NO: 1159766 - RNA, 21 nt, Human
uuuuuuguauuuuuaauagag

SEQ ID NO: 1159767 - RNA, 24 nt, Human
uuuuuuguauuuuuaauagagaca

SEQ ID NO: 1159768 - RNA, 18 nt, Human
aaaguauauacccagaac

SEQ ID NO: 1159769 - RNA, 24 nt, Human
aaaguguagggaucacaggcauga

SEQ ID NO: 1159770 - RNA, 22 nt, Human
aacugucuuucucauuccuugg

SEQ ID NO: 1159771 - RNA, 20 nt, Human
acccacccugucccaggccc

SEQ ID NO: 1159772 - RNA, 19 nt, Human
accccaaaagaaaugaggu

SEQ ID NO: 1159773 - RNA, 24 nt, Human
acccugagggucacugagaggaau

SEQ ID NO: 1159774 - RNA, 19 nt, Human
agaaggaagaagugugcag

SEQ ID NO: 1159775 - RNA, 21 nt, Human
agccacugguugaaacucacc

SEQ ID NO: 1159776 - RNA, 21 nt, Human
aggaauaaaggggccaugugu

SEQ ID NO: 1159777 - RNA, 21 nt, Human
aggcugacaccaaaggggcag

SEQ ID NO: 1159778 - RNA, 24 nt, Human
agggaucacaggcaugagucauca

SEQ ID NO: 1159779 - RNA, 24 nt, Human
auccuccugcugugcccuccuaaa

SEQ ID NO: 1159780 - RNA, 19 nt, Human
auguugaccaggcuggucu

SEQ ID NO: 1159781 - RNA, 19 nt, Human
auguugaccaggcuggucu

SEQ ID NO: 1159782 - RNA, 24 nt, Human
caaaagaaaugagguuugaguaug

SEQ ID NO: 1159783 - RNA, 23 nt, Human
caacccccacauccucaccaccu

SEQ ID NO: 1159784 - RNA, 24 nt, Human
cacaggcaugagucaucacaucca

SEQ ID NO: 1159785 - RNA, 22 nt, Human
cacccugucccaggcccaugcu

SEQ ID NO: 1159786 - RNA, 20 nt, Human
caccuguuuguugcagccuc

SEQ ID NO: 1159787 - RNA, 25 nt, Human
cagacaaaaacuagcaauggucuca

SEQ ID NO: 1159788 - RNA, 22 nt, Human
cagagagagagucuugcuaugu

SEQ ID NO: 1159789 - RNA, 22 nt, Human
caggagccgccaagaaucgguc

SEQ ID NO: 1159790 - RNA, 23 nt, Human
cagugggugauggcagagauucc

SEQ ID NO: 1159791 - RNA, 25 nt, Human
cagugggugauggcagagauucccu

SEQ ID NO: 1159792 - RNA, 20 nt, Human
caguguggaagcauguugcc

SEQ ID NO: 1159793 - RNA, 23 nt, Human
cauaagccugagauaugugcagg

SEQ ID NO: 1159794 - RNA, 21 nt, Human
ccaaaggggcagaguauggca

SEQ ID NO: 1159795 - RNA, 20 nt, Human
cccacuggugaucucaccca

SEQ ID NO: 1159796 - RNA, 27 nt, Human
cccauagcaccugcugauuguccugga

SEQ ID NO: 1159797 - RNA, 21 nt, Human
cccaugagccacaacucugcc

SEQ ID NO: 1159798 - RNA, 19 nt, Human
ccccacauccucaccaccu

SEQ ID NO: 1159799 - RNA, 22 nt, Human
cccccacauccucaccaccugu

SEQ ID NO: 1159800 - RNA, 21 nt, Human
cccugucccaggcccaugcuc

SEQ ID NO: 1159801 - RNA, 18 nt, Human
ccuccuaaaguguaggga

SEQ ID NO: 1159802 - RNA, 22 nt, Human
ccuccugcugugcccuccuaaa

SEQ ID NO: 1159803 - RNA, 18 nt, Human
ccuggucccauuuugucu

SEQ ID NO: 1159804 - RNA, 19 nt, Human
ccuggucccauuuugucuc

SEQ ID NO: 1159805 - RNA, 18 nt, Human
cgaucauacaggacgaca

SEQ ID NO: 1159806 - RNA, 21 nt, Human
cggcugcagaguggcuaccau

SEQ ID NO: 1159807 - RNA, 20 nt, Human
cgucgcccccaugaccugcu

SEQ ID NO: 1159808 - RNA, 24 nt, Human
cuaaaguguagggaucacaggcau

SEQ ID NO: 1159809 - RNA, 21 nt, Human
cuaguaaacaagcaaaaggaa

SEQ ID NO: 1159810 - RNA, 18 nt, Human
cucacugggcuucuggga

SEQ ID NO: 1159811 - RNA, 23 nt, Human
cucaggcgauccuccugcugugc

SEQ ID NO: 1159812 - RNA, 19 nt, Human
cuucuuggucucagcgucc

SEQ ID NO: 1159813 - RNA, 20 nt, Human
cuugaauuccugggcucagg

SEQ ID NO: 1159814 - RNA, 21 nt, Human
cuugugauagcccccuggucc

SEQ ID NO: 1159815 - RNA, 23 nt, Human
cuuucaacccccacauccucacc

SEQ ID NO: 1159816 - RNA, 19 nt, Human
gaccuguuccucuucuugg

SEQ ID NO: 1159817 - RNA, 22 nt, Human
gaccuguuccucuucuuggucu

SEQ ID NO: 1159818 - RNA, 27 nt, Human
gagagagugugugugugugugugugug

SEQ ID NO: 1159819 - RNA, 23 nt, Human
gagcccacuggugaucucaccca

SEQ ID NO: 1159820 - RNA, 18 nt, Human
gagggucacugagaggaa

SEQ ID NO: 1159821 - RNA, 21 nt, Human
gaguauguuagaguaugccaa

SEQ ID NO: 1159822 - RNA, 18 nt, Human
gaucacaggcaugaguca

SEQ ID NO: 1159823 - RNA, 22 nt, Human
gaucacaggcaugagucaucac

SEQ ID NO: 1159824 - RNA, 20 nt, Human
gcugugggucuacaccagca

SEQ ID NO: 1159825 - RNA, 20 nt, Human
ggaaacugcuagggcucagg

SEQ ID NO: 1159826 - RNA, 18 nt, Human
ggagaucuugggagcuua

SEQ ID NO: 1159827 - RNA, 20 nt, Human
ggagaucuugggagcuuagg

SEQ ID NO: 1159828 - RNA, 19 nt, Human
ggaucacaggcaugaguca

SEQ ID NO: 1159829 - RNA, 22 nt, Human
ggcccccaugaaccuuacuccc

SEQ ID NO: 1159830 - RNA, 18 nt, Human
ggcugucccccacaaauc

SEQ ID NO: 1159831 - RNA, 20 nt, Human
gggaucacaggcaugaguca

SEQ ID NO: 1159832 - RNA, 23 nt, Human
gggaucacaggcaugagucauca

SEQ ID NO: 1159833 - RNA, 19 nt, Human
gggcucaggcgauccuccu

SEQ ID NO: 1159834 - RNA, 18 nt, Human
guaacccacccuguccca

SEQ ID NO: 1159835 - RNA, 21 nt, Human
gugucuucaggaaggagccgg

SEQ ID NO: 1159836 - RNA, 20 nt, Human
gugugugugugugugugugu

SEQ ID NO: 1159837 - RNA, 23 nt, Human
guugcagugggugauggcagaga

SEQ ID NO: 1159838 - RNA, 23 nt, Human
uaaaacugaccuuuaaggcugac

SEQ ID NO: 1159839 - RNA, 21 nt, Human
uaaacaagcaaaaggaaacug

SEQ ID NO: 1159840 - RNA, 22 nt, Human
uaaacaagcaaaaggaaacugc

SEQ ID NO: 1159841 - RNA, 20 nt, Human
uaagacuggugcagacaaaa

SEQ ID NO: 1159842 - RNA, 25 nt, Human
uaagacuggugcagacaaaaacuag

SEQ ID NO: 1159843 - RNA, 20 nt, Human
uacaccguuuccuuucaacc

SEQ ID NO: 1159844 - RNA, 21 nt, Human
uacaccguuuccuuucaaccc

SEQ ID NO: 1159845 - RNA, 21 nt, Human
uacccugagggucacugagag

SEQ ID NO: 1159846 - RNA, 21 nt, Human
uagcccccuggucccauuuug

SEQ ID NO: 1159847 - RNA, 23 nt, Human
uagcccccuggucccauuuuguc

SEQ ID NO: 1159848 - RNA, 22 nt, Human
uaguggauguucagcacgggau

SEQ ID NO: 1159849 - RNA, 23 nt, Human
uaguggauguucagcacgggauu

SEQ ID NO: 1159850 - RNA, 24 nt, Human
uauguugaccaggcuggucuugaa

SEQ ID NO: 1159851 - RNA, 18 nt, Human
uauugugugauacaagga

SEQ ID NO: 1159852 - RNA, 22 nt, Human
ucaggcagagccuccgcccucc

SEQ ID NO: 1159853 - RNA, 22 nt, Human
uccagguuguuuucccuaagac

SEQ ID NO: 1159854 - RNA, 18 nt, Human
ucccaggcccaugcucug

SEQ ID NO: 1159855 - RNA, 19 nt, Human
ucccccacaaauccucuca

SEQ ID NO: 1159856 - RNA, 20 nt, Human
ucccuaagacuggugcagac

SEQ ID NO: 1159857 - RNA, 18 nt, Human
ucccucuugggcagaaac

SEQ ID NO: 1159858 - RNA, 25 nt, Human
ucccucuugggcagaaacccuaaac

SEQ ID NO: 1159859 - RNA, 24 nt, Human
uccuaaaguguagggaucacaggc

SEQ ID NO: 1159860 - RNA, 21 nt, Human
uccugggcucaggcgauccuc

SEQ ID NO: 1159861 - RNA, 22 nt, Human
uccugggcucaggcgauccucc

SEQ ID NO: 1159862 - RNA, 24 nt, Human
uccugggcucaggcgauccuccug

SEQ ID NO: 1159863 - RNA, 18 nt, Human
ucgcccccaugaccugcu

SEQ ID NO: 1159864 - RNA, 20 nt, Human
ucugcucugucauccccaug

SEQ ID NO: 1159865 - RNA, 21 nt, Human
ucugcucugucauccccauga

SEQ ID NO: 1159866 - RNA, 23 nt, Human
ucuugcuauguugaccaggcugg

SEQ ID NO: 1159867 - RNA, 24 nt, Human
ucuugcuauguugaccaggcuggu

SEQ ID NO: 1159868 - RNA, 19 nt, Human
ucuugggcagaaacccuaa

SEQ ID NO: 1159869 - RNA, 21 nt, Human
ugaaacucaccuaaaacugac

SEQ ID NO: 1159870 - RNA, 24 nt, Human
ugaaagaugauuucugucagugug

SEQ ID NO: 1159871 - RNA, 24 nt, Human
ugaccaggcuggucuugaauuccu

SEQ ID NO: 1159872 - RNA, 24 nt, Human
ugacccugaccuguuccucuucuu

SEQ ID NO: 1159873 - RNA, 25 nt, Human
ugaccuguuccucuucuuggucuca

SEQ ID NO: 1159874 - RNA, 19 nt, Human
ugagggucacugagaggaa

SEQ ID NO: 1159875 - RNA, 20 nt, Human
ugaguugagggcucagggcu

SEQ ID NO: 1159876 - RNA, 19 nt, Human
ugcagacaaaaacuagcaa

SEQ ID NO: 1159877 - RNA, 18 nt, Human
ugccggcugcagaguggc

SEQ ID NO: 1159878 - RNA, 22 nt, Human
ugcugugcccuccuaaagugua

SEQ ID NO: 1159879 - RNA, 23 nt, Human
uggagucagacagaacugugucc

SEQ ID NO: 1159880 - RNA, 21 nt, Human
ugggcagaaacccuaaacauu

SEQ ID NO: 1159881 - RNA, 24 nt, Human
uggucuugaauuccugggcucagg

SEQ ID NO: 1159882 - RNA, 22 nt, Human
uguagggaucacaggcaugagu

SEQ ID NO: 1159883 - RNA, 22 nt, Human
ugucucucaaacugucuuucuc

SEQ ID NO: 1159884 - RNA, 18 nt, Human
ugugugugugugugugug

SEQ ID NO: 1159885 - RNA, 18 nt, Human
ugugugugugugugugug

SEQ ID NO: 1159886 - RNA, 18 nt, Human
ugugugugugugugugug

SEQ ID NO: 1159887 - RNA, 21 nt, Human
ugugugugugugugugugugu

SEQ ID NO: 1159888 - RNA, 21 nt, Human
ugugugugugugugugugugu

SEQ ID NO: 1159889 - RNA, 21 nt, Human
ugugugugugugugugugugu

SEQ ID NO: 1159890 - RNA, 21 nt, Human
ugugugugugugugugugugu

SEQ ID NO: 1159891 - RNA, 22 nt, Human
ugugugugugugugugugugug

SEQ ID NO: 1159892 - RNA, 19 nt, Human
uguguguguguguguguug

SEQ ID NO: 1159893 - RNA, 20 nt, Human
uguuucauaagccugagaua

SEQ ID NO: 1159894 - RNA, 21 nt, Human
uguuucauaagccugagauau

SEQ ID NO: 1159895 - RNA, 18 nt, Human
uguuuucccuaagacugg

SEQ ID NO: 1159896 - RNA, 20 nt, Human
uucaacccccacauccucac

SEQ ID NO: 1159897 - RNA, 24 nt, Human
uucaacccccacauccucaccacc

SEQ ID NO: 1159898 - RNA, 19 nt, Human
uucaggaaggagccggucc

SEQ ID NO: 1159899 - RNA, 21 nt, Human
uucaggaaggagccgguccug

SEQ ID NO: 1159900 - RNA, 22 nt, Human
uucaucagugacagagcuggau

SEQ ID NO: 1159901 - RNA, 18 nt, Human
uuccuuggacuccacugg

SEQ ID NO: 1159902 - RNA, 22 nt, Human
uucugcucugucauccccauga

SEQ ID NO: 1159903 - RNA, 23 nt, Human
uucugcucugucauccccaugag

SEQ ID NO: 1159904 - RNA, 24 nt, Human
uucuuggucucagcguccuucacu

SEQ ID NO: 1159905 - RNA, 23 nt, Human
uugugugauacaaggaauaucug

SEQ ID NO: 1159906 - RNA, 19 nt, Human
uuuccuuucaacccccaca

SEQ ID NO: 1159907 - RNA, 24 nt, Human
aaaaaaaaaaaaaaaaaaaaggga

SEQ ID NO: 1159908 - RNA, 23 nt, Human
aaaaaaacaaacaaauggauuag

SEQ ID NO: 1159909 - RNA, 24 nt, Human
aaaaaaacaaacaaauggauuagg

SEQ ID NO: 1159910 - RNA, 22 nt, Human
aaaaaaagggauuauuuucuau

SEQ ID NO: 1159911 - RNA, 23 nt, Human
aaaaaacaaacaaacaaacaaaa

SEQ ID NO: 1159912 - RNA, 25 nt, Human
aaaaacaaacaaauggauuaggcca

SEQ ID NO: 1159913 - RNA, 26 nt, Human
aaaacaaacaaauggauuaggccagg

SEQ ID NO: 1159914 - RNA, 21 nt, Human
aaaacugcuuuuauuuguagc

SEQ ID NO: 1159915 - RNA, 23 nt, Human
aaacaaaaaagaaaaccuuaaag

SEQ ID NO: 1159916 - RNA, 25 nt, Human
aaacaaacaaacaaacaaaaaaaca

SEQ ID NO: 1159917 - RNA, 23 nt, Human
aaacaaacugaagguggccuuca

SEQ ID NO: 1159918 - RNA, 20 nt, Human
aaacugcugggauuacaggu

SEQ ID NO: 1159919 - RNA, 24 nt, Human
aaacugcugggauuacagguguga

SEQ ID NO: 1159920 - RNA, 19 nt, Human
aaagaaaaccuuaaagucu

SEQ ID NO: 1159921 - RNA, 19 nt, Human
aaaguacugugcuuucccu

SEQ ID NO: 1159922 - RNA, 23 nt, Human
aaaucccaacaaccacaugagcu

SEQ ID NO: 1159923 - RNA, 24 nt, Human
aacaaacaaacaaacaaaaaaaca

SEQ ID NO: 1159924 - RNA, 21 nt, Human
aacacauggcaggccaacccu

SEQ ID NO: 1159925 - RNA, 21 nt, Human
aacagaucgagacuccgucuc

SEQ ID NO: 1159926 - RNA, 24 nt, Human
aacagaucgagacuccgucucaaa

SEQ ID NO: 1159927 - RNA, 19 nt, Human
aacauggugaaacccuguc

SEQ ID NO: 1159928 - RNA, 20 nt, Human
aacauggugaaacccugucu

SEQ ID NO: 1159929 - RNA, 21 nt, Human
aacauggugaaacccugucuc

SEQ ID NO: 1159930 - RNA, 19 nt, Human
aacauuuugggaggcugag

SEQ ID NO: 1159931 - RNA, 19 nt, Human
aagaaagaaauacaaagaa

SEQ ID NO: 1159932 - RNA, 33 nt, Human
aagaaagaaauacaaagaacucuaaagagaaag

SEQ ID NO: 1159933 - RNA, 23 nt, Human
aagaaauacaaagaacucuaaag

SEQ ID NO: 1159934 - RNA, 21 nt, Human
aagacaccuugucaaccauag

SEQ ID NO: 1159935 - RNA, 19 nt, Human
aagaguucaagaccagccu

SEQ ID NO: 1159936 - RNA, 22 nt, Human
aagauccugcccacuccaacac

SEQ ID NO: 1159937 - RNA, 21 nt, Human
aagaugaacagaauuuaauca

SEQ ID NO: 1159938 - RNA, 24 nt, Human
aaggaaccauagacagaaacagac

SEQ ID NO: 1159939 - RNA, 24 nt, Human
aaguagcuggaauuacaggcacgu

SEQ ID NO: 1159940 - RNA, 25 nt, Human
aaguagcuggaauuacaggcacgug

SEQ ID NO: 1159941 - RNA, 26 nt, Human
aauagcaagacuucauuucuccaaaa

SEQ ID NO: 1159942 - RNA, 18 nt, Human
aauuacaagcaugagcca

SEQ ID NO: 1159943 - RNA, 20 nt, Human
aauugcuugaacccaggagg

SEQ ID NO: 1159944 - RNA, 24 nt, Human
aauugcuugaacccaggaggcaga

SEQ ID NO: 1159945 - RNA, 23 nt, Human
acaaacaaaaaaacaaacaaaug

SEQ ID NO: 1159946 - RNA, 22 nt, Human
acaaauuaucuaccuuugucac

SEQ ID NO: 1159947 - RNA, 22 nt, Human
acaaggagggaucuccugggac

SEQ ID NO: 1159948 - RNA, 23 nt, Human
acaagguuucaucauguuggcca

SEQ ID NO: 1159949 - RNA, 24 nt, Human
acaagguuucaucauguuggccag

SEQ ID NO: 1159950 - RNA, 20 nt, Human
acacauggcaggccaacccu

SEQ ID NO: 1159951 - RNA, 18 nt, Human
acagauccaggaagucca

SEQ ID NO: 1159952 - RNA, 24 nt, Human
acagaucgagacuccgucucaaaa

SEQ ID NO: 1159953 - RNA, 24 nt, Human
acaggggaagaucccgucucaaaa

SEQ ID NO: 1159954 - RNA, 22 nt, Human
acagugcuggccuauacuaaca

SEQ ID NO: 1159955 - RNA, 23 nt, Human
accaaagauccugcccacuccaa

SEQ ID NO: 1159956 - RNA, 22 nt, Human
accacaaccucccgucucccgg

SEQ ID NO: 1159957 - RNA, 24 nt, Human
accguggcuaacauggugaaaccc

SEQ ID NO: 1159958 - RNA, 22 nt, Human
accugacaccagguacugacgc

SEQ ID NO: 1159959 - RNA, 20 nt, Human
acgggguuucuccauguugg

SEQ ID NO: 1159960 - RNA, 21 nt, Human
acgggguuucuccauguuggu

SEQ ID NO: 1159961 - RNA, 24 nt, Human
acgggguuucuccauguuggucag

SEQ ID NO: 1159962 - RNA, 23 nt, Human
acucaggcuggagugcaguggug

SEQ ID NO: 1159963 - RNA, 30 nt, Human
acuccgucucaaaaaacaaacaaacaaacc

SEQ ID NO: 1159964 - RNA, 24 nt, Human
acugcacuccagccugggcaacag

SEQ ID NO: 1159965 - RNA, 18 nt, Human
acugcugggauuacaggu

SEQ ID NO: 1159966 - RNA, 19 nt, Human
acuggagugcaauggcacg

SEQ ID NO: 1159967 - RNA, 21 nt, Human
agaaagaaauacaaagaacuc

SEQ ID NO: 1159968 - RNA, 19 nt, Human
agaauccagcaaagaccgc

SEQ ID NO: 1159969 - RNA, 23 nt, Human
agaauccagcaaagaccgcggga

SEQ ID NO: 1159970 - RNA, 20 nt, Human
agacaggagaaucauugagc

SEQ ID NO: 1159971 - RNA, 22 nt, Human
agagguugcagugacccaagau

SEQ ID NO: 1159972 - RNA, 24 nt, Human
agagguugcagugacccaagauug

SEQ ID NO: 1159973 - RNA, 19 nt, Human
agaugguuuuuggagauau

SEQ ID NO: 1159974 - RNA, 23 nt, Human
agcaccuucuaucauagagcaac

SEQ ID NO: 1159975 - RNA, 24 nt, Human
agcacuuugggaggccgaggcagg

SEQ ID NO: 1159976 - RNA, 19 nt, Human
agccaccgcacccggccca

SEQ ID NO: 1159977 - RNA, 23 nt, Human
agccagauguggugacaugugcc

SEQ ID NO: 1159978 - RNA, 24 nt, Human
agccugggcaacagaucgagacuc

SEQ ID NO: 1159979 - RNA, 23 nt, Human
agccuggguaaaauagcaagacu

SEQ ID NO: 1159980 - RNA, 24 nt, Human
agccuggguaaaauagcaagacuu

SEQ ID NO: 1159981 - RNA, 24 nt, Human
agcgauucuccugccucagccucc

SEQ ID NO: 1159982 - RNA, 18 nt, Human
aggaagcccagcccuggc

SEQ ID NO: 1159983 - RNA, 19 nt, Human
aggcagagguugcagugac

SEQ ID NO: 1159984 - RNA, 24 nt, Human
aggcagagguugcagugacccaag

SEQ ID NO: 1159985 - RNA, 23 nt, Human
aggcaggagaauugcuugaaccc

SEQ ID NO: 1159986 - RNA, 24 nt, Human
aggcagguggaucacgaggucagg

SEQ ID NO: 1159987 - RNA, 26 nt, Human
aggcagguggaucacgaggucaggag

SEQ ID NO: 1159988 - RNA, 21 nt, Human
aggccgaggcagguggaucac

SEQ ID NO: 1159989 - RNA, 24 nt, Human
aggcgcaguggcucaugccugcaa

SEQ ID NO: 1159990 - RNA, 24 nt, Human
aggcguguuggcaugcaccuguag

SEQ ID NO: 1159991 - RNA, 24 nt, Human
aggcuaaggcaggagaauugcuug

SEQ ID NO: 1159992 - RNA, 25 nt, Human
aggcuggagugcaguggugcaaucu

SEQ ID NO: 1159993 - RNA, 24 nt, Human
aggugauccgccugccuuggccuc

SEQ ID NO: 1159994 - RNA, 24 nt, Human
agguggaucacgaggucaggagau

SEQ ID NO: 1159995 - RNA, 22 nt, Human
agguuucaucauguuggccagg

SEQ ID NO: 1159996 - RNA, 18 nt, Human
aguagagacaagguuuca

SEQ ID NO: 1159997 - RNA, 21 nt, Human
aguaguugggauuacaggcau

SEQ ID NO: 1159998 - RNA, 22 nt, Human
aguauuuaaacauccccugccc

SEQ ID NO: 1159999 - RNA, 20 nt, Human
agugcaguggugcaaucucg

SEQ ID NO: 1160000 - RNA, 24 nt, Human
aguggcucacgccuguaaucccag

SEQ ID NO: 1160001 - RNA, 23 nt, Human
aguggcucaugccugcaaucuca

SEQ ID NO: 1160002 - RNA, 20 nt, Human
aucagaauccagcaaagacc

SEQ ID NO: 1160003 - RNA, 24 nt, Human
aucauguuggccaggcuggucuug

SEQ ID NO: 1160004 - RNA, 21 nt, Human
auccacccaccucggccuucc

SEQ ID NO: 1160005 - RNA, 18 nt, Human
aucccgucucaaaaaaaa

SEQ ID NO: 1160006 - RNA, 28 nt, Human
aucccgucucaaaaaaaaaaaaaaaaaa

SEQ ID NO: 1160007 - RNA, 21 nt, Human
auccugaaauucuuaauuuuu

SEQ ID NO: 1160008 - RNA, 22 nt, Human
augcaguguugucugaguguuu

SEQ ID NO: 1160009 - RNA, 24 nt, Human
auugcuccacugcacuccagccug

SEQ ID NO: 1160010 - RNA, 24 nt, Human
caaacugcugggauuacaggugug

SEQ ID NO: 1160011 - RNA, 22 nt, Human
caaaggaaccauagacagaaac

SEQ ID NO: 1160012 - RNA, 20 nt, Human
caacacuaugaagaaagaaa

SEQ ID NO: 1160013 - RNA, 18 nt, Human
caacauuuugggaggcug

SEQ ID NO: 1160014 - RNA, 24 nt, Human
caacauuuugggaggcugagacag

SEQ ID NO: 1160015 - RNA, 28 nt, Human
caacucccagguucaagcgagucuccuu

SEQ ID NO: 1160016 - RNA, 23 nt, Human
caagagcacacaaaggaaccagu

SEQ ID NO: 1160017 - RNA, 22 nt, Human
caagcgagucuccugccucagc

SEQ ID NO: 1160018 - RNA, 22 nt, Human
caagcgauucuccugccucagc

SEQ ID NO: 1160019 - RNA, 24 nt, Human
caaggaaauucacuuuaaaaaaaa

SEQ ID NO: 1160020 - RNA, 24 nt, Human
caagguuucaucauguuggccagg

SEQ ID NO: 1160021 - RNA, 19 nt, Human
caauauguuuacuuugcag

SEQ ID NO: 1160022 - RNA, 20 nt, Human
caauauguuuacuuugcagu

SEQ ID NO: 1160023 - RNA, 24 nt, Human
cacagugcuggaauuacaagcaug

SEQ ID NO: 1160024 - RNA, 24 nt, Human
caccacacccggcuaauuuuugua

SEQ ID NO: 1160025 - RNA, 23 nt, Human
cacccugccggcuaauuuuugua

SEQ ID NO: 1160026 - RNA, 18 nt, Human
caccgcacccggcccaaa

SEQ ID NO: 1160027 - RNA, 23 nt, Human
caccguauuccagccucggagac

SEQ ID NO: 1160028 - RNA, 22 nt, Human
caccgugccaagcccuccccuc

SEQ ID NO: 1160029 - RNA, 18 nt, Human
caccuguagucgcagcua

SEQ ID NO: 1160030 - RNA, 24 nt, Human
caccuguagucgcagcuacucagg

SEQ ID NO: 1160031 - RNA, 24 nt, Human
caccuugucaaccauagggagacu

SEQ ID NO: 1160032 - RNA, 24 nt, Human
cacgccuguaaucccagcacuuug

SEQ ID NO: 1160033 - RNA, 24 nt, Human
cacucaggcuggagugcaguggug

SEQ ID NO: 1160034 - RNA, 21 nt, Human
cacugcaaccuccaacuccca

SEQ ID NO: 1160035 - RNA, 19 nt, Human
cacugcacuccagccuggg

SEQ ID NO: 1160036 - RNA, 21 nt, Human
cacugcacuccagccugggca

SEQ ID NO: 1160037 - RNA, 22 nt, Human
cacugcacuccagccugggcaa

SEQ ID NO: 1160038 - RNA, 23 nt, Human
cacugcacuccagccugggcaac

SEQ ID NO: 1160039 - RNA, 24 nt, Human
cacugcacuccagccugggcaaca

SEQ ID NO: 1160040 - RNA, 24 nt, Human
cagcacuuugggaggccgaggcag

SEQ ID NO: 1160041 - RNA, 26 nt, Human
cagcacuuugggaggccgaggcaggu

SEQ ID NO: 1160042 - RNA, 18 nt, Human
cagcccccagggauccca

SEQ ID NO: 1160043 - RNA, 20 nt, Human
cagccuccugaguaguuggg

SEQ ID NO: 1160044 - RNA, 22 nt, Human
cagcuucuaaguauuucauuuc

SEQ ID NO: 1160045 - RNA, 19 nt, Human
caguagaaaggagucuaca

SEQ ID NO: 1160046 - RNA, 24 nt, Human
caguccuaucccucagucucccca

SEQ ID NO: 1160047 - RNA, 25 nt, Human
cagugcuggaauuacaagcaugagc

SEQ ID NO: 1160048 - RNA, 18 nt, Human
caguugccauccugaaau

SEQ ID NO: 1160049 - RNA, 18 nt, Human
cauagacagaaacagacu

SEQ ID NO: 1160050 - RNA, 23 nt, Human
cauagacagaaacagacuccuaa

SEQ ID NO: 1160051 - RNA, 27 nt, Human
caucauguuggccaggcuggucuugaa

SEQ ID NO: 1160052 - RNA, 19 nt, Human
caugagccaccgugccaag

SEQ ID NO: 1160053 - RNA, 24 nt, Human
caugccugcaaucucaacauuuug

SEQ ID NO: 1160054 - RNA, 18 nt, Human
cauguuggccaggcuggu

SEQ ID NO: 1160055 - RNA, 20 nt, Human
cauguuggccaggcuggucu

SEQ ID NO: 1160056 - RNA, 24 nt, Human
cauguuggccaggcuggucuugaa

SEQ ID NO: 1160057 - RNA, 24 nt, Human
cauguuggucaggcugguugugaa

SEQ ID NO: 1160058 - RNA, 19 nt, Human
cauuucaaaugccaccucc

SEQ ID NO: 1160059 - RNA, 21 nt, Human
ccaaacugcugggauuacagg

SEQ ID NO: 1160060 - RNA, 21 nt, Human
ccaaacugcugggauuacagg

SEQ ID NO: 1160061 - RNA, 24 nt, Human
ccaaacugcugggauuacaggugu

SEQ ID NO: 1160062 - RNA, 24 nt, Human
ccacaaccucccgucucccggguu

SEQ ID NO: 1160063 - RNA, 25 nt, Human
ccacaaccucccgucucccggguuc

SEQ ID NO: 1160064 - RNA, 18 nt, Human
ccacaaggaaauucacuu

SEQ ID NO: 1160065 - RNA, 24 nt, Human
ccacagugcuggaauuacaagcau

SEQ ID NO: 1160066 - RNA, 20 nt, Human
ccaccguauuccagccucgg

SEQ ID NO: 1160067 - RNA, 24 nt, Human
ccaccguauuccagccucggagac

SEQ ID NO: 1160068 - RNA, 23 nt, Human
ccaccgugccaagcccuccccuc

SEQ ID NO: 1160069 - RNA, 18 nt, Human
ccacuccaacacauggca

SEQ ID NO: 1160070 - RNA, 20 nt, Human
ccacugcacuccagccuggg

SEQ ID NO: 1160071 - RNA, 20 nt, Human
ccacugcacuccagccuggg

SEQ ID NO: 1160072 - RNA, 21 nt, Human
ccacugcacuccagccugggc

SEQ ID NO: 1160073 - RNA, 23 nt, Human
ccacugcacuccagccugggcaa

SEQ ID NO: 1160074 - RNA, 24 nt, Human
ccacugcacuccagccugggcaac

SEQ ID NO: 1160075 - RNA, 18 nt, Human
ccagcuucuaaguauuuc

SEQ ID NO: 1160076 - RNA, 22 nt, Human
ccaggaggcagagguugcagug

SEQ ID NO: 1160077 - RNA, 25 nt, Human
ccaguccuaucccucagucucccca

SEQ ID NO: 1160078 - RNA, 19 nt, Human
ccauguuggucaggcuggu

SEQ ID NO: 1160079 - RNA, 19 nt, Human
ccauguuggucaggcuggu

SEQ ID NO: 1160080 - RNA, 23 nt, Human
cccaaguagcuggaauuacaggc

SEQ ID NO: 1160081 - RNA, 24 nt, Human
cccagcccuggcuaccaucuugac

SEQ ID NO: 1160082 - RNA, 23 nt, Human
cccagguucaagcgagucucccc

SEQ ID NO: 1160083 - RNA, 23 nt, Human
cccagguucaagcgagucuccug

SEQ ID NO: 1160084 - RNA, 18 nt, Human
cccgaccucaggugaucc

SEQ ID NO: 1160085 - RNA, 21 nt, Human
cccgaccucaggugauccgcc

SEQ ID NO: 1160086 - RNA, 23 nt, Human
cccgaccucaggugauccgccug

SEQ ID NO: 1160087 - RNA, 20 nt, Human
cccggguucaagcgauucuc

SEQ ID NO: 1160088 - RNA, 23 nt, Human
cccggguucaagcgauucuccug

SEQ ID NO: 1160089 - RNA, 22 nt, Human
cccucagucuccccauaaaugc

SEQ ID NO: 1160090 - RNA, 25 nt, Human
cccuguagcauagaauacagugcug

SEQ ID NO: 1160091 - RNA, 22 nt, Human
ccgcacccggcccaaacucuua

SEQ ID NO: 1160092 - RNA, 23 nt, Human
ccgccugccuuggccucccaaac

SEQ ID NO: 1160093 - RNA, 22 nt, Human
ccuaugguccuagcuacucagg

SEQ ID NO: 1160094 - RNA, 23 nt, Human
ccugaguaguugggauuacaggc

SEQ ID NO: 1160095 - RNA, 24 nt, Human
ccugaguaguugggauuacaggca

SEQ ID NO: 1160096 - RNA, 18 nt, Human
ccugaucucccaggccag

SEQ ID NO: 1160097 - RNA, 20 nt, Human
ccugaucucccaggccagau

SEQ ID NO: 1160098 - RNA, 21 nt, Human
ccugaucucccaggccagaug

SEQ ID NO: 1160099 - RNA, 22 nt, Human
ccugcaaucucaacauuuuggg

SEQ ID NO: 1160100 - RNA, 23 nt, Human
ccugccucagccucccaaguagc

SEQ ID NO: 1160101 - RNA, 21 nt, Human
ccuggccaucaccuugacucc

SEQ ID NO: 1160102 - RNA, 25 nt, Human
ccuggccaucaccuugguccccugg

SEQ ID NO: 1160103 - RNA, 21 nt, Human
ccuggcuaaggcacugguagc

SEQ ID NO: 1160104 - RNA, 20 nt, Human
ccugggcaagucacuuaacu

SEQ ID NO: 1160105 - RNA, 18 nt, Human
ccuguagcauagaauaca

SEQ ID NO: 1160106 - RNA, 21 nt, Human
ccuguagucgcagcuacucag

SEQ ID NO: 1160107 - RNA, 18 nt, Human
cgaccucaggugauccgc

SEQ ID NO: 1160108 - RNA, 24 nt, Human
cgaccucaggugauccgccugccu

SEQ ID NO: 1160109 - RNA, 24 nt, Human
cgagaccaccguggcuaacauggu

SEQ ID NO: 1160110 - RNA, 24 nt, Human
cgaggcagguggaucacgagguca

SEQ ID NO: 1160111 - RNA, 21 nt, Human
cgcaccaccguauuccagccu

SEQ ID NO: 1160112 - RNA, 23 nt, Human
cgccuguaaucccagcacuuugg

SEQ ID NO: 1160113 - RNA, 24 nt, Human
cgccuguaaucccagcacuuuggg

SEQ ID NO: 1160114 - RNA, 31 nt, Human
cggcuaauuuuuguauuuuuaguagagacaa

SEQ ID NO: 1160115 - RNA, 24 nt, Human
cgggguuucuccauguuggucagg

SEQ ID NO: 1160116 - RNA, 25 nt, Human
cgucucaaaaaacaaacaaacaaac

SEQ ID NO: 1160117 - RNA, 24 nt, Human
cguggcuaacauggugaaacccug

SEQ ID NO: 1160118 - RNA, 23 nt, Human
cuaauuuuuguauuuuuaguaga

SEQ ID NO: 1160119 - RNA, 23 nt, Human
cucaaaaaaaaaaaaaaaaaaaa

SEQ ID NO: 1160120 - RNA, 19 nt, Human
cucacacaucaagcucccc

SEQ ID NO: 1160121 - RNA, 22 nt, Human
cucaccacaaccucccgucucc

SEQ ID NO: 1160122 - RNA, 25 nt, Human
cucaccacaaccucccgucucccgg

SEQ ID NO: 1160123 - RNA, 22 nt, Human
cucacgccuguaaucccagcac

SEQ ID NO: 1160124 - RNA, 24 nt, Human
cucacgccuguaaucccagcacuu

SEQ ID NO: 1160125 - RNA, 24 nt, Human
cucaugccugcaaucucaacauuu

SEQ ID NO: 1160126 - RNA, 22 nt, Human
cucauuagcuguaugauccugg

SEQ ID NO: 1160127 - RNA, 24 nt, Human
cuccacugcacuccagccugggca

SEQ ID NO: 1160128 - RNA, 27 nt, Human
cuccagccuugagaccccagcccuggc

SEQ ID NO: 1160129 - RNA, 22 nt, Human
cuccauguuggucaggcugguu

SEQ ID NO: 1160130 - RNA, 21 nt, Human
cucccaaacugcugggauuac

SEQ ID NO: 1160131 - RNA, 26 nt, Human
cucccgaccucaggugauccgccugc

SEQ ID NO: 1160132 - RNA, 23 nt, Human
cucccuugucugacaggccuuau

SEQ ID NO: 1160133 - RNA, 22 nt, Human
cuccgucucaaaaaacaaacaa

SEQ ID NO: 1160134 - RNA, 21 nt, Human
cugagacaggagaaucauuga

SEQ ID NO: 1160135 - RNA, 24 nt, Human
cugaguaguugggauuacaggcau

SEQ ID NO: 1160136 - RNA, 23 nt, Human
cugcaaccuccaacucccagguu

SEQ ID NO: 1160137 - RNA, 24 nt, Human
cugcaaccuccaacucccagguuc

SEQ ID NO: 1160138 - RNA, 22 nt, Human
cugcagugagcuuugaucgcac

SEQ ID NO: 1160139 - RNA, 19 nt, Human
cugccggcuaauuuuugua

SEQ ID NO: 1160140 - RNA, 23 nt, Human
cugccucagccucccaaguagcu

SEQ ID NO: 1160141 - RNA, 21 nt, Human
cugccucagccuccugaguag

SEQ ID NO: 1160142 - RNA, 21 nt, Human
cugugcuuucccuguugucgu

SEQ ID NO: 1160143 - RNA, 22 nt, Human
cuguugugcauccuuugacccc

SEQ ID NO: 1160144 - RNA, 19 nt, Human
cuuccucacucaggcugga

SEQ ID NO: 1160145 - RNA, 26 nt, Human
cuugacuccagccuugagaccccagc

SEQ ID NO: 1160146 - RNA, 24 nt, Human
cuuuaaauauugugcuuaccuuua

SEQ ID NO: 1160147 - RNA, 24 nt, Human
cuuucccuguugucguuugcggga

SEQ ID NO: 1160148 - RNA, 20 nt, Human
gaagaaagaaauacaaagaa

SEQ ID NO: 1160149 - RNA, 26 nt, Human
gaaucauugagcccaagaguucaaga

SEQ ID NO: 1160150 - RNA, 23 nt, Human
gaccucaggugauccgccugccu

SEQ ID NO: 1160151 - RNA, 23 nt, Human
gaccucaggugauccgccugccu

SEQ ID NO: 1160152 - RNA, 23 nt, Human
gagaauugcuugaacccaggagg

SEQ ID NO: 1160153 - RNA, 23 nt, Human
gagacgggguuucuccauguugg

SEQ ID NO: 1160154 - RNA, 24 nt, Human
gagacgggguuucuccauguuggu

SEQ ID NO: 1160155 - RNA, 22 nt, Human
gaguaguugggauuacaggcau

SEQ ID NO: 1160156 - RNA, 24 nt, Human
gaguaguugggauuacaggcaugc

SEQ ID NO: 1160157 - RNA, 24 nt, Human
gaucucaaguuauccacccaccuc

SEQ ID NO: 1160158 - RNA, 20 nt, Human
gaugagccuaggaguucaag

SEQ ID NO: 1160159 - RNA, 22 nt, Human
gauggacagcuaccaacuaccg

SEQ ID NO: 1160160 - RNA, 18 nt, Human
gauuacaggcaugcgcca

SEQ ID NO: 1160161 - RNA, 18 nt, Human
gauuacaggugugagcca

SEQ ID NO: 1160162 - RNA, 22 nt, Human
gauuacaggugugagccaccgc

SEQ ID NO: 1160163 - RNA, 23 nt, Human
gauuacaggugugagccaccgca

SEQ ID NO: 1160164 - RNA, 20 nt, Human
gcaaagaucuugaagcagag

SEQ ID NO: 1160165 - RNA, 20 nt, Human
gcaaagaucuugaagcagag

SEQ ID NO: 1160166 - RNA, 22 nt, Human
gcaaccuccaacucccagguuc

SEQ ID NO: 1160167 - RNA, 20 nt, Human
gcaccaccguauuccagccu

SEQ ID NO: 1160168 - RNA, 22 nt, Human
gcaggagaauugcuugaaccca

SEQ ID NO: 1160169 - RNA, 25 nt, Human
gcccagcccuggccaucaccuugac

SEQ ID NO: 1160170 - RNA, 24 nt, Human
gccuaggaguucaaggcugcagug

SEQ ID NO: 1160171 - RNA, 24 nt, Human
gcgagucuccugccucagccuccc

SEQ ID NO: 1160172 - RNA, 23 nt, Human
gcgauucuccugccucagccucc

SEQ ID NO: 1160173 - RNA, 20 nt, Human
gcgcaguggcucacgccugu

SEQ ID NO: 1160174 - RNA, 24 nt, Human
gcuaacauggugaaacccugucuc

SEQ ID NO: 1160175 - RNA, 21 nt, Human
gcuaccaucuugacugcggcc

SEQ ID NO: 1160176 - RNA, 23 nt, Human
gcugguugugaacucccgaccuc

SEQ ID NO: 1160177 - RNA, 20 nt, Human
gcuuccucacucaggcugga

SEQ ID NO: 1160178 - RNA, 24 nt, Human
ggaaacaaacugaagguggccuuc

SEQ ID NO: 1160179 - RNA, 18 nt, Human
ggagauaguucccauuug

SEQ ID NO: 1160180 - RNA, 19 nt, Human
ggauuacaggcaugcgcca

SEQ ID NO: 1160181 - RNA, 21 nt, Human
ggccgggcgcaguggcucacg

SEQ ID NO: 1160182 - RNA, 24 nt, Human
gggcgcaguggcucacgccuguaa

SEQ ID NO: 1160183 - RNA, 23 nt, Human
gggguuucuccauguuggucagg

SEQ ID NO: 1160184 - RNA, 23 nt, Human
guagagacgggguuucuccaugu

SEQ ID NO: 1160185 - RNA, 18 nt, Human
guaguugggauuacaggc

SEQ ID NO: 1160186 - RNA, 20 nt, Human
guaguugggauuacaggcau

SEQ ID NO: 1160187 - RNA, 18 nt, Human
gucucucaccaguguuuu

SEQ ID NO: 1160188 - RNA, 22 nt, Human
guuaacaagagcacacaaagga

SEQ ID NO: 1160189 - RNA, 19 nt, Human
guugucugaguguuugcau

SEQ ID NO: 1160190 - RNA, 23 nt, Human
guuuucucagcuuccugggcaca

SEQ ID NO: 1160191 - RNA, 18 nt, Human
uaaacauccccugcccaa

SEQ ID NO: 1160192 - RNA, 22 nt, Human
uaacauggugaaacccugucuc

SEQ ID NO: 1160193 - RNA, 24 nt, Human
uaacauggugaaacccugucucua

SEQ ID NO: 1160194 - RNA, 24 nt, Human
uaaggcaggagaauugcuugaacc

SEQ ID NO: 1160195 - RNA, 25 nt, Human
uaaggcaggagaauugcuugaaccc

SEQ ID NO: 1160196 - RNA, 24 nt, Human
uaauuuuuguauuuuuaguagaga

SEQ ID NO: 1160197 - RNA, 24 nt, Human
uaauuuuuguauuuuuaguagaga

SEQ ID NO: 1160198 - RNA, 23 nt, Human
uacaggcaugcgccaccacaccc

SEQ ID NO: 1160199 - RNA, 23 nt, Human
uacaggugugagccaccgcaccc

SEQ ID NO: 1160200 - RNA, 20 nt, Human
uacuguugugcauccuuuga

SEQ ID NO: 1160201 - RNA, 18 nt, Human
uagaaaggagucuacacc

SEQ ID NO: 1160202 - RNA, 19 nt, Human
uagaauacagugcuggccu

SEQ ID NO: 1160203 - RNA, 19 nt, Human
uagacucuccacugccuuc

SEQ ID NO: 1160204 - RNA, 22 nt, Human
uagagacaagguuucaucaugu

SEQ ID NO: 1160205 - RNA, 23 nt, Human
uaggaugaaauccaaaaaucuua

SEQ ID NO: 1160206 - RNA, 24 nt, Human
uaggaugaaauccaaaaaucuuau

SEQ ID NO: 1160207 - RNA, 27 nt, Human
uaggaugaaauccaaaaaucuuauaag

SEQ ID NO: 1160208 - RNA, 24 nt, Human
uaguagagacaagguuucaucaug

SEQ ID NO: 1160209 - RNA, 24 nt, Human
uaguagagacgggguuucuccaug

SEQ ID NO: 1160210 - RNA, 18 nt, Human
uaguugggauuacaggca

SEQ ID NO: 1160211 - RNA, 22 nt, Human
uauaguuaacaagagcacacaa

SEQ ID NO: 1160212 - RNA, 21 nt, Human
uaucucaaauuuacccagucc

SEQ ID NO: 1160213 - RNA, 23 nt, Human
uaugacccaguagaaaggagucu

SEQ ID NO: 1160214 - RNA, 23 nt, Human
ucaaaaaaaaaaaaaaaaaaaaa

SEQ ID NO: 1160215 - RNA, 18 nt, Human
ucaaagaggaagcccagc

SEQ ID NO: 1160216 - RNA, 19 nt, Human
ucacaccaaagauccugcc

SEQ ID NO: 1160217 - RNA, 25 nt, Human
ucaccacaaccucccgucucccggg

SEQ ID NO: 1160218 - RNA, 18 nt, Human
ucacgaggucaggagauc

SEQ ID NO: 1160219 - RNA, 24 nt, Human
ucacgaggucaggagaucgagacc

SEQ ID NO: 1160220 - RNA, 24 nt, Human
ucacucaggcuggagugcaguggu

SEQ ID NO: 1160221 - RNA, 23 nt, Human
ucacucuucuuacccagacugga

SEQ ID NO: 1160222 - RNA, 19 nt, Human
ucacugcaaccuccaacuc

SEQ ID NO: 1160223 - RNA, 20 nt, Human
ucacugcaaccuccaacucc

SEQ ID NO: 1160224 - RNA, 24 nt, Human
ucacugcaaccuccaacucccagg

SEQ ID NO: 1160225 - RNA, 20 nt, Human
ucagccucccaaguagcugg

SEQ ID NO: 1160226 - RNA, 20 nt, Human
ucagccuccugaguaguugg

SEQ ID NO: 1160227 - RNA, 25 nt, Human
ucauugagcccaagaguucaagacc

SEQ ID NO: 1160228 - RNA, 21 nt, Human
ucauuucuccaaaaaguaaga

SEQ ID NO: 1160229 - RNA, 24 nt, Human
uccaagaugaccuucuuuccacuu

SEQ ID NO: 1160230 - RNA, 21 nt, Human
uccacccaccucggccuucca

SEQ ID NO: 1160231 - RNA, 20 nt, Human
uccacugcacuccagccugg

SEQ ID NO: 1160232 - RNA, 23 nt, Human
ucccaaacugcugggauuacagg

SEQ ID NO: 1160233 - RNA, 20 nt, Human
ucccaacaaccacaugagcu

SEQ ID NO: 1160234 - RNA, 24 nt, Human
ucccaaguagcuggaauuacaggc

SEQ ID NO: 1160235 - RNA, 19 nt, Human
ucccagguucaagcgaguc

SEQ ID NO: 1160236 - RNA, 21 nt, Human
ucccagguucaagcgagucuc

SEQ ID NO: 1160237 - RNA, 24 nt, Human
ucccagguucaagcgagucuccug

SEQ ID NO: 1160238 - RNA, 22 nt, Human
uccccauaaaugcguguuacuc

SEQ ID NO: 1160239 - RNA, 21 nt, Human
ucccggguucaagcgauucuc

SEQ ID NO: 1160240 - RNA, 24 nt, Human
ucccggguucaagcgauucuccug

SEQ ID NO: 1160241 - RNA, 24 nt, Human
ucccgucucaaaaaaaaaaaaaaa

SEQ ID NO: 1160242 - RNA, 18 nt, Human
uccgcagaaaccaugaga

SEQ ID NO: 1160243 - RNA, 20 nt, Human
uccuccaaucauccaagaug

SEQ ID NO: 1160244 - RNA, 20 nt, Human
uccugaaauucuuaauuuuu

SEQ ID NO: 1160245 - RNA, 24 nt, Human
uccugaguaguugggauuacaggc

SEQ ID NO: 1160246 - RNA, 23 nt, Human
uccuggugcucacacccuugaga

SEQ ID NO: 1160247 - RNA, 24 nt, Human
ucuaccuuugucacaccaaagauc

SEQ ID NO: 1160248 - RNA, 23 nt, Human
ucucaaaaaacaaacaaacaaac

SEQ ID NO: 1160249 - RNA, 24 nt, Human
ucucccggguucaagcgauucucc

SEQ ID NO: 1160250 - RNA, 18 nt, Human
ucuccugccucagccucc

SEQ ID NO: 1160251 - RNA, 26 nt, Human
ucuccugccucagccucccaaguagc

SEQ ID NO: 1160252 - RNA, 21 nt, Human
ucuccugggaccucugucuca

SEQ ID NO: 1160253 - RNA, 24 nt, Human
ucucuauuaaaaauacaaaaaauu

SEQ ID NO: 1160254 - RNA, 21 nt, Human
ucucugccaaccucaccacaa

SEQ ID NO: 1160255 - RNA, 21 nt, Human
ucucuuugguaaaaugaagau

SEQ ID NO: 1160256 - RNA, 25 nt, Human
ucuggaauaucuauuagauggaaga

SEQ ID NO: 1160257 - RNA, 25 nt, Human
ugaagcagaggaccuagcucagcca

SEQ ID NO: 1160258 - RNA, 24 nt, Human
ugacaugugccuaugguccuagcu

SEQ ID NO: 1160259 - RNA, 20 nt, Human
ugaccccaguccuuucuggg

SEQ ID NO: 1160260 - RNA, 19 nt, Human
ugagacaggagaaucauug

SEQ ID NO: 1160261 - RNA, 23 nt, Human
ugagacaggagaaucauugagcc

SEQ ID NO: 1160262 - RNA, 22 nt, Human
ugagcaagacaccuugucaacc

SEQ ID NO: 1160263 - RNA, 23 nt, Human
ugagcaagacaccuugucaacca

SEQ ID NO: 1160264 - RNA, 19 nt, Human
ugagccaccgugccaagcc

SEQ ID NO: 1160265 - RNA, 23 nt, Human
ugagcccaagaguucaagaccag

SEQ ID NO: 1160266 - RNA, 24 nt, Human
ugagccuaggaguucaaggcugca

SEQ ID NO: 1160267 - RNA, 19 nt, Human
ugagggaagacugcaugau

SEQ ID NO: 1160268 - RNA, 19 nt, Human
ugaguaagcucuaagacag

SEQ ID NO: 1160269 - RNA, 19 nt, Human
ugagugccagucuguugaa

SEQ ID NO: 1160270 - RNA, 21 nt, Human
ugaguuuucucagcuuccugg

SEQ ID NO: 1160271 - RNA, 24 nt, Human
ugaugagccuaggaguucaaggcu

SEQ ID NO: 1160272 - RNA, 20 nt, Human
ugcaguugccauccugaaau

SEQ ID NO: 1160273 - RNA, 23 nt, Human
ugccaagcccuccccucuauucu

SEQ ID NO: 1160274 - RNA, 24 nt, Human
ugccuaugguccuagcuacucagg

SEQ ID NO: 1160275 - RNA, 24 nt, Human
ugccucagccucccaaguagcugg

SEQ ID NO: 1160276 - RNA, 24 nt, Human
ugccucagccuccugaguaguugg

SEQ ID NO: 1160277 - RNA, 21 nt, Human
ugccuuggccucccaaacugc

SEQ ID NO: 1160278 - RNA, 19 nt, Human
ugcuccacugcacuccagc

SEQ ID NO: 1160279 - RNA, 24 nt, Human
ugcuggaauuacaagcaugagcca

SEQ ID NO: 1160280 - RNA, 24 nt, Human
ugcugggauuacaggugugagcca

SEQ ID NO: 1160281 - RNA, 19 nt, Human
ugcuucagcuuuccugauc

SEQ ID NO: 1160282 - RNA, 21 nt, Human
uggaauaucuauuagauggaa

SEQ ID NO: 1160283 - RNA, 22 nt, Human
uggaaucccuguagcauagaau

SEQ ID NO: 1160284 - RNA, 22 nt, Human
uggaauuacaagcaugagccac

SEQ ID NO: 1160285 - RNA, 23 nt, Human
uggaauuacaagcaugagccacc

SEQ ID NO: 1160286 - RNA, 24 nt, Human
uggaauuacaagcaugagccaccg

SEQ ID NO: 1160287 - RNA, 26 nt, Human
uggaauuacaagcaugagccaccgug

SEQ ID NO: 1160288 - RNA, 27 nt, Human
uggaauuacaagcaugagccaccgugc

SEQ ID NO: 1160289 - RNA, 21 nt, Human
uggaauuacaggcacgugcca

SEQ ID NO: 1160290 - RNA, 22 nt, Human
uggaauuacaggcacgugccac

SEQ ID NO: 1160291 - RNA, 24 nt, Human
uggaauuacaggcacgugccaccc

SEQ ID NO: 1160292 - RNA, 26 nt, Human
uggaauuacaggcacgugccacccug

SEQ ID NO: 1160293 - RNA, 23 nt, Human
uggagugcaauggcacgaucuca

SEQ ID NO: 1160294 - RNA, 24 nt, Human
uggagugcaauggcacgaucucag

SEQ ID NO: 1160295 - RNA, 18 nt, Human
uggagugcaguggugcaa

SEQ ID NO: 1160296 - RNA, 23 nt, Human
uggagugcaguggugcaaucucg

SEQ ID NO: 1160297 - RNA, 22 nt, Human
uggauuagggccgggcgcagug

SEQ ID NO: 1160298 - RNA, 23 nt, Human
uggcaacacuaugaagaaagaaa

SEQ ID NO: 1160299 - RNA, 24 nt, Human
uggcacgaucucagcucaccacaa

SEQ ID NO: 1160300 - RNA, 24 nt, Human
uggccaggcuggucuugaacucuu

SEQ ID NO: 1160301 - RNA, 21 nt, Human
uggccaucaccuugacuccag

SEQ ID NO: 1160302 - RNA, 20 nt, Human
uggcuaacauggugaaaccc

SEQ ID NO: 1160303 - RNA, 23 nt, Human
uggcuaacauggugaaacccugu

SEQ ID NO: 1160304 - RNA, 20 nt, Human
uggcuaaggcacugguagcu

SEQ ID NO: 1160305 - RNA, 24 nt, Human
uggcuagacaaauuaucuaccuuu

SEQ ID NO: 1160306 - RNA, 22 nt, Human
uggcucacgccuguaaucccag

SEQ ID NO: 1160307 - RNA, 24 nt, Human
uggcucacgccuguaaucccagca

SEQ ID NO: 1160308 - RNA, 24 nt, Human
uggcucaugccugcaaucucaaca

SEQ ID NO: 1160309 - RNA, 24 nt, Human
ugggaggccgaggcagguggauca

SEQ ID NO: 1160310 - RNA, 24 nt, Human
ugggaggcugagacaggagaauca

SEQ ID NO: 1160311 - RNA, 18 nt, Human
ugggauuacaggcaugcg

SEQ ID NO: 1160312 - RNA, 21 nt, Human
ugggauuacaggcaugcgcca

SEQ ID NO: 1160313 - RNA, 22 nt, Human
ugggauuacaggcaugcgccac

SEQ ID NO: 1160314 - RNA, 24 nt, Human
ugggauuacaggcaugcgccacca

SEQ ID NO: 1160315 - RNA, 19 nt, Human
ugggauuacaggugugagc

SEQ ID NO: 1160316 - RNA, 21 nt, Human
ugggauuacaggugugagcca

SEQ ID NO: 1160317 - RNA, 22 nt, Human
ugggauuacaggugugagccac

SEQ ID NO: 1160318 - RNA, 23 nt, Human
ugggauuacaggugugagccacc

SEQ ID NO: 1160319 - RNA, 24 nt, Human
ugggauuacaggugugagccaccg

SEQ ID NO: 1160320 - RNA, 23 nt, Human
uggguaaaauagcaagacuucau

SEQ ID NO: 1160321 - RNA, 21 nt, Human
uggucaggcugguugugaacu

SEQ ID NO: 1160322 - RNA, 24 nt, Human
uguaugauuuuuaaguacacaucu

SEQ ID NO: 1160323 - RNA, 22 nt, Human
ugucguuugcgggauguugucc

SEQ ID NO: 1160324 - RNA, 22 nt, Human
uuaaucaccagcuucuaaguau

SEQ ID NO: 1160325 - RNA, 24 nt, Human
uuaggccaggcgcaguggcucaug

SEQ ID NO: 1160326 - RNA, 24 nt, Human
uuaguagagacaagguuucaucau

SEQ ID NO: 1160327 - RNA, 18 nt, Human
uuaguagagacgggguuu

SEQ ID NO: 1160328 - RNA, 24 nt, Human
uuaguagagacgggguuucuccau

SEQ ID NO: 1160329 - RNA, 18 nt, Human
uuauuuauuuauuuauuu

SEQ ID NO: 1160330 - RNA, 21 nt, Human
uucaagcgauucuccugccuc

SEQ ID NO: 1160331 - RNA, 23 nt, Human
uucaagcgauucuccugccucag

SEQ ID NO: 1160332 - RNA, 24 nt, Human
uucaagcgauucuccugccucagc

SEQ ID NO: 1160333 - RNA, 24 nt, Human
uucacucuucuuacccagacugga

SEQ ID NO: 1160334 - RNA, 22 nt, Human
uucauucaacaaacagugauug

SEQ ID NO: 1160335 - RNA, 24 nt, Human
uuccucacucaggcuggagugcag

SEQ ID NO: 1160336 - RNA, 20 nt, Human
uucuccaaaaaguaagaaaa

SEQ ID NO: 1160337 - RNA, 19 nt, Human
uugcuuccucacucaggcu

SEQ ID NO: 1160338 - RNA, 20 nt, Human
uugcuuccucacucaggcug

SEQ ID NO: 1160339 - RNA, 22 nt, Human
uugcuuccucacucaggcugga

SEQ ID NO: 1160340 - RNA, 24 nt, Human
uugcuugaacccaggaggcagagg

SEQ ID NO: 1160341 - RNA, 21 nt, Human
uuggcaacacuaugaagaaag

SEQ ID NO: 1160342 - RNA, 25 nt, Human
uugggaggccgaggcagguggauca

SEQ ID NO: 1160343 - RNA, 25 nt, Human
uugggaggcugagacaggagaauca

SEQ ID NO: 1160344 - RNA, 23 nt, Human
uuguauuuuuaguagagacgggg

SEQ ID NO: 1160345 - RNA, 24 nt, Human
uuucaucauguuggccaggcuggu

SEQ ID NO: 1160346 - RNA, 21 nt, Human
uuucuccauguuggucaggcu

SEQ ID NO: 1160347 - RNA, 23 nt, Human
uuugucucgcacucaccacuuuu

SEQ ID NO: 1160348 - RNA, 20 nt, Human
uuuguuuuguuuuguuuuug

SEQ ID NO: 1160349 - RNA, 31 nt, Human
uuuuaauuuuuauuuauuuauuuauuuauuu

SEQ ID NO: 1160350 - RNA, 23 nt, Human
uuuugcuuccucacucaggcugg

SEQ ID NO: 1160351 - RNA, 24 nt, Human
uuuugcuuccucacucaggcugga

SEQ ID NO: 1160352 - RNA, 21 nt, Human
uuuuguauuuuuaguagagac

SEQ ID NO: 1160353 - RNA, 23 nt, Human
uuuuuaguagagacaagguuuca

SEQ ID NO: 1160354 - RNA, 22 nt, Human
uuuuuaguagagacgggguuuc

SEQ ID NO: 1160355 - RNA, 20 nt, Human
uuuuuguauuuuuaguagag

SEQ ID NO: 1160356 - RNA, 20 nt, Human
uuuuuguauuuuuaguagag

SEQ ID NO: 1160357 - RNA, 22 nt, Human
accacaguuaugcggagcaaca

SEQ ID NO: 1160358 - RNA, 18 nt, Human
acgcggccggcgccugga

SEQ ID NO: 1160359 - RNA, 18 nt, Human
agcaacagaaagcuuccu

SEQ ID NO: 1160360 - RNA, 19 nt, Human
agggagcagagguacagcg

SEQ ID NO: 1160361 - RNA, 24 nt, Human
caacagaaagcuuccuaccccccc

SEQ ID NO: 1160362 - RNA, 19 nt, Human
caagcaacuccauaagaca

SEQ ID NO: 1160363 - RNA, 18 nt, Human
cccccgguaggcgagagc

SEQ ID NO: 1160364 - RNA, 21 nt, Human
ccuacccccccggguugaaag

SEQ ID NO: 1160365 - RNA, 21 nt, Human
cgcggccggcgccuggaagcc

SEQ ID NO: 1160366 - RNA, 19 nt, Human
cuccgaaugagggagcaga

SEQ ID NO: 1160367 - RNA, 21 nt, Human
gaaagcuuccuacccccccgg

SEQ ID NO: 1160368 - RNA, 24 nt, Human
gcaacagaaagcuuccuacccccc

SEQ ID NO: 1160369 - RNA, 23 nt, Human
gcggagcaacagaaagcuuccua

SEQ ID NO: 1160370 - RNA, 20 nt, Human
gcggccggcgccuggaagcc

SEQ ID NO: 1160371 - RNA, 19 nt, Human
gggaacaguuauuccacga

SEQ ID NO: 1160372 - RNA, 18 nt, Human
gucccggugagagaagcc

SEQ ID NO: 1160373 - RNA, 23 nt, Human
uaagacaacugucucggaaaggc

SEQ ID NO: 1160374 - RNA, 22 nt, Human
uaggccucuuauuuuacguucu

SEQ ID NO: 1160375 - RNA, 26 nt, Human
ucccgagucccggugagagaagcccc

SEQ ID NO: 1160376 - RNA, 19 nt, Human
uccuacccccccggguuga

SEQ ID NO: 1160377 - RNA, 18 nt, Human
ugagagaagcccccggua

SEQ ID NO: 1160378 - RNA, 24 nt, Human
ugagcgggaacaguuauuccacgg

SEQ ID NO: 1160379 - RNA, 19 nt, Human
ugccgcucuagcaacgggg

SEQ ID NO: 1160380 - RNA, 23 nt, Human
ugccgguccacuucccgggaguc

SEQ ID NO: 1160381 - RNA, 23 nt, Human
uuagcugaccacaguuaugcgga

SEQ ID NO: 1160382 - RNA, 22 nt, Human
uugcccgggacaucacacgcgg

SEQ ID NO: 1160383 - RNA, 24 nt, Human
aaagcccacuucucaagcuccaag

SEQ ID NO: 1160384 - RNA, 19 nt, Human
aaagugcugggauuacagg

SEQ ID NO: 1160385 - RNA, 19 nt, Human
aaagugcugggauuacagg

SEQ ID NO: 1160386 - RNA, 23 nt, Human
aaagugcugggauuacaggcaug

SEQ ID NO: 1160387 - RNA, 23 nt, Human
aaagugcugggauuacaggcgug

SEQ ID NO: 1160388 - RNA, 28 nt, Human
aaauaaaaacgaauuuuuuaugacaaaa

SEQ ID NO: 1160389 - RNA, 23 nt, Human
aaccuccugagcucaagcaaucc

SEQ ID NO: 1160390 - RNA, 25 nt, Human
aagcaauccuccugccucagccucc

SEQ ID NO: 1160391 - RNA, 21 nt, Human
aaggugugcacccugcugcug

SEQ ID NO: 1160392 - RNA, 19 nt, Human
aagugcugggauuacaggc

SEQ ID NO: 1160393 - RNA, 19 nt, Human
aagugcugggauuacaggc

SEQ ID NO: 1160394 - RNA, 23 nt, Human
aagugcugggauuacaggcaugu

SEQ ID NO: 1160395 - RNA, 23 nt, Human
aagugcugggauuacaggcgugu

SEQ ID NO: 1160396 - RNA, 21 nt, Human
aaguguugggauuacaggcgu

SEQ ID NO: 1160397 - RNA, 23 nt, Human
aaguguugggauuacaggcguga

SEQ ID NO: 1160398 - RNA, 26 nt, Human
aaguguugggauuacaggcgugagcc

SEQ ID NO: 1160399 - RNA, 24 nt, Human
acaggguuuugccaugcuucccag

SEQ ID NO: 1160400 - RNA, 21 nt, Human
accacagccucucaaagugcu

SEQ ID NO: 1160401 - RNA, 23 nt, Human
accucagccuccugaguaacugg

SEQ ID NO: 1160402 - RNA, 18 nt, Human
acgggguuucuccauguu

SEQ ID NO: 1160403 - RNA, 20 nt, Human
acgggguuucuccauguuga

SEQ ID NO: 1160404 - RNA, 23 nt, Human
acgggguuucuccauguugaggc

SEQ ID NO: 1160405 - RNA, 26 nt, Human
acgggguuucuccauguugaggcugg

SEQ ID NO: 1160406 - RNA, 19 nt, Human
acucucuccacccuucccc

SEQ ID NO: 1160407 - RNA, 18 nt, Human
acucugucacccaagcug

SEQ ID NO: 1160408 - RNA, 25 nt, Human
acucugucacccaagcuggagugca

SEQ ID NO: 1160409 - RNA, 18 nt, Human
agacaggguuuugccaug

SEQ ID NO: 1160410 - RNA, 22 nt, Human
agacaggguuuugccaugcuuc

SEQ ID NO: 1160411 - RNA, 21 nt, Human
agagagaagauagaggcaggg

SEQ ID NO: 1160412 - RNA, 21 nt, Human
agcccacuucucaagcuccaa

SEQ ID NO: 1160413 - RNA, 19 nt, Human
agccuggcccucacaaacg

SEQ ID NO: 1160414 - RNA, 24 nt, Human
agcuggagugcaguggugcaaaca

SEQ ID NO: 1160415 - RNA, 23 nt, Human
agcuucaaccuccugagcucaag

SEQ ID NO: 1160416 - RNA, 22 nt, Human
aggcagggccucuggcauugug

SEQ ID NO: 1160417 - RNA, 18 nt, Human
aggugauccucccgccuc

SEQ ID NO: 1160418 - RNA, 25 nt, Human
aggugauccucccgccucggccucc

SEQ ID NO: 1160419 - RNA, 18 nt, Human
aguaacugggauuacagg

SEQ ID NO: 1160420 - RNA, 22 nt, Human
aguagagacgggguuucuccau

SEQ ID NO: 1160421 - RNA, 21 nt, Human
aguagcugggauuacaggcau

SEQ ID NO: 1160422 - RNA, 24 nt, Human
agugcaauggcacgaucuuggcuc

SEQ ID NO: 1160423 - RNA, 20 nt, Human
agugcaguggugcaaucuug

SEQ ID NO: 1160424 - RNA, 18 nt, Human
agugcugggauuacaggc

SEQ ID NO: 1160425 - RNA, 21 nt, Human
auccuccugccucagccuccc

SEQ ID NO: 1160426 - RNA, 24 nt, Human
auggagggccagcucuugcccaca

SEQ ID NO: 1160427 - RNA, 19 nt, Human
auuacaggcgugugccacc

SEQ ID NO: 1160428 - RNA, 21 nt, Human
auucuccugccucagccuccc

SEQ ID NO: 1160429 - RNA, 23 nt, Human
caaagugcugggauuacaggcau

SEQ ID NO: 1160430 - RNA, 23 nt, Human
caaagugcugggauuacaggcau

SEQ ID NO: 1160431 - RNA, 24 nt, Human
caaagugcugggauuacaggcaug

SEQ ID NO: 1160432 - RNA, 24 nt, Human
caaagugcugggauuacaggcgug

SEQ ID NO: 1160433 - RNA, 25 nt, Human
caaccuccugagcucaagcaauccu

SEQ ID NO: 1160434 - RNA, 23 nt, Human
caagaaaccucucaggcuggaug

SEQ ID NO: 1160435 - RNA, 19 nt, Human
caagaaauuaucccaccac

SEQ ID NO: 1160436 - RNA, 22 nt, Human
caagcaauccuccugccucagc

SEQ ID NO: 1160437 - RNA, 27 nt, Human
caagcaauccuccugccucagccuccc

SEQ ID NO: 1160438 - RNA, 27 nt, Human
caagcaauccuccugccucagccuccc

SEQ ID NO: 1160439 - RNA, 22 nt, Human
caagcaauucuccugccucagc

SEQ ID NO: 1160440 - RNA, 22 nt, Human
caaguaaauacuuuauccccuc

SEQ ID NO: 1160441 - RNA, 19 nt, Human
caaugcuacacacacacuu

SEQ ID NO: 1160442 - RNA, 23 nt, Human
cacaaacgaugaugccaaagcag

SEQ ID NO: 1160443 - RNA, 18 nt, Human
caccagaacaucauuccc

SEQ ID NO: 1160444 - RNA, 21 nt, Human
caccagaacaucauuccccag

SEQ ID NO: 1160445 - RNA, 27 nt, Human
caccagaacaucauuccccagugaggu

SEQ ID NO: 1160446 - RNA, 20 nt, Human
caccagggcccuucccccuc

SEQ ID NO: 1160447 - RNA, 24 nt, Human
cacccaagcuggagugcaguggug

SEQ ID NO: 1160448 - RNA, 24 nt, Human
cacccaagcuggagugcaguggug

SEQ ID NO: 1160449 - RNA, 20 nt, Human
caccccuggcuaauuuuugu

SEQ ID NO: 1160450 - RNA, 21 nt, Human
cacccugcugcugugcaccuu

SEQ ID NO: 1160451 - RNA, 21 nt, Human
caccgcaaccuccgccuccug

SEQ ID NO: 1160452 - RNA, 24 nt, Human
caccuucuccuuguccuccucuga

SEQ ID NO: 1160453 - RNA, 23 nt, Human
cacucugucacccaagcuggagu

SEQ ID NO: 1160454 - RNA, 24 nt, Human
cacucugucacccaagcuggagug

SEQ ID NO: 1160455 - RNA, 22 nt, Human
cacugcagccucaaccucccag

SEQ ID NO: 1160456 - RNA, 19 nt, Human
cacuucucaagcuccaagu

SEQ ID NO: 1160457 - RNA, 20 nt, Human
cagccucaaccucccaggcu

SEQ ID NO: 1160458 - RNA, 23 nt, Human
cagccucaaccucccaggcucau

SEQ ID NO: 1160459 - RNA, 22 nt, Human
cagccuccccagggaaggacac

SEQ ID NO: 1160460 - RNA, 23 nt, Human
cagccuccccagggaaggacacu

SEQ ID NO: 1160461 - RNA, 20 nt, Human
cagccuccugaguaacuggg

SEQ ID NO: 1160462 - RNA, 18 nt, Human
cagccucugggggcucac

SEQ ID NO: 1160463 - RNA, 22 nt, Human
cagccucugggggcucacaccg

SEQ ID NO: 1160464 - RNA, 21 nt, Human
caggcucuagaggcccugagg

SEQ ID NO: 1160465 - RNA, 21 nt, Human
cagggaaggacacucucucca

SEQ ID NO: 1160466 - RNA, 24 nt, Human
caggguuuugccaugcuucccagg

SEQ ID NO: 1160467 - RNA, 21 nt, Human
cagugccagggccuggccaaa

SEQ ID NO: 1160468 - RNA, 24 nt, Human
caugcuucccaggcuggucucgaa

SEQ ID NO: 1160469 - RNA, 20 nt, Human
ccaaagugcugggauuacag

SEQ ID NO: 1160470 - RNA, 22 nt, Human
ccaaagugcugggauuacaggc

SEQ ID NO: 1160471 - RNA, 22 nt, Human
ccaaagugcugggauuacaggc

SEQ ID NO: 1160472 - RNA, 24 nt, Human
ccaaagugcugggauuacaggcgu

SEQ ID NO: 1160473 - RNA, 28 nt, Human
ccaaugcuacacacacacuucaaacaua

SEQ ID NO: 1160474 - RNA, 23 nt, Human
ccaccacgccuggcuaauuguau

SEQ ID NO: 1160475 - RNA, 19 nt, Human
ccaccgugcccagccacaa

SEQ ID NO: 1160476 - RNA, 24 nt, Human
ccagaagcuuggaaaagaugacug

SEQ ID NO: 1160477 - RNA, 22 nt, Human
ccagcucuugcccacaggcucu

SEQ ID NO: 1160478 - RNA, 19 nt, Human
ccaugcuucccaggcuggu

SEQ ID NO: 1160479 - RNA, 23 nt, Human
ccaugcuucccaggcuggucucg

SEQ ID NO: 1160480 - RNA, 18 nt, Human
cccagccacaaguaaaua

SEQ ID NO: 1160481 - RNA, 23 nt, Human
cccaggcucaugugauccuccca

SEQ ID NO: 1160482 - RNA, 24 nt, Human
ccccaaugcuacacacacacuuca

SEQ ID NO: 1160483 - RNA, 23 nt, Human
ccccagugagcagagccucugcc

SEQ ID NO: 1160484 - RNA, 24 nt, Human
cccgaaguguugggauuacaggcg

SEQ ID NO: 1160485 - RNA, 23 nt, Human
cccgaguagcugggauuacaggc

SEQ ID NO: 1160486 - RNA, 24 nt, Human
cccgaguagcugggauuacaggca

SEQ ID NO: 1160487 - RNA, 25 nt, Human
cccucauagaagcacacgguuuuac

SEQ ID NO: 1160488 - RNA, 24 nt, Human
ccgaaguguugggauuacaggcgu

SEQ ID NO: 1160489 - RNA, 23 nt, Human
ccgaguagcugggauuacaggca

SEQ ID NO: 1160490 - RNA, 24 nt, Human
ccgaguagcugggauuacaggcau

SEQ ID NO: 1160491 - RNA, 18 nt, Human
ccgcaaccuccgccuccu

SEQ ID NO: 1160492 - RNA, 23 nt, Human
ccgcaaccuccgccuccuggguu

SEQ ID NO: 1160493 - RNA, 24 nt, Human
ccgcaaccuccgccuccuggguuc

SEQ ID NO: 1160494 - RNA, 27 nt, Human
ccgccuccuggguucaagcaauucuuu

SEQ ID NO: 1160495 - RNA, 19 nt, Human
ccucaaccucccaggcuca

SEQ ID NO: 1160496 - RNA, 22 nt, Human
ccucacaaacgaugaugccaaa

SEQ ID NO: 1160497 - RNA, 24 nt, Human
ccucccaccucagccuccugagua

SEQ ID NO: 1160498 - RNA, 19 nt, Human
ccucccgccucggccuccc

SEQ ID NO: 1160499 - RNA, 19 nt, Human
ccuccgccuccuggguuca

SEQ ID NO: 1160500 - RNA, 24 nt, Human
ccuccuggguucaagcaauucucc

SEQ ID NO: 1160501 - RNA, 18 nt, Human
ccugaccucaggugaucc

SEQ ID NO: 1160502 - RNA, 22 nt, Human
ccugaccucaggugauccuccc

SEQ ID NO: 1160503 - RNA, 20 nt, Human
ccugagcucaagcaauccuc

SEQ ID NO: 1160504 - RNA, 19 nt, Human
ccugaguaacugggauuac

SEQ ID NO: 1160505 - RNA, 22 nt, Human
ccugaguaacugggauuacagg

SEQ ID NO: 1160506 - RNA, 24 nt, Human
ccugaguaacugggauuacaggua

SEQ ID NO: 1160507 - RNA, 23 nt, Human
ccugccucagccucccgaguagc

SEQ ID NO: 1160508 - RNA, 24 nt, Human
ccugccucagccucccgaguagcu

SEQ ID NO: 1160509 - RNA, 23 nt, Human
ccuggguucaagcaauucuccug

SEQ ID NO: 1160510 - RNA, 24 nt, Human
ccuguccccaaugcuacacacaca

SEQ ID NO: 1160511 - RNA, 24 nt, Human
cgccucggccucccgaaguguugg

SEQ ID NO: 1160512 - RNA, 24 nt, Human
cgcucugucacccaagcuggagug

SEQ ID NO: 1160513 - RNA, 24 nt, Human
cgcucuuguugcccaggcuggagu

SEQ ID NO: 1160514 - RNA, 24 nt, Human
cuaauuguauuuuuaguagagacg

SEQ ID NO: 1160515 - RNA, 24 nt, Human
cuagguggucagugccagggccug

SEQ ID NO: 1160516 - RNA, 20 nt, Human
cuagucccacuugcuguguu

SEQ ID NO: 1160517 - RNA, 24 nt, Human
cucaagcaauccuccugccucagc

SEQ ID NO: 1160518 - RNA, 24 nt, Human
cucacucugucacccaagcuggag

SEQ ID NO: 1160519 - RNA, 21 nt, Human
cucacugcagccucaaccucc

SEQ ID NO: 1160520 - RNA, 24 nt, Human
cucagccucccgaguagcugggau

SEQ ID NO: 1160521 - RNA, 18 nt, Human
cucaggugauccucccgc

SEQ ID NO: 1160522 - RNA, 24 nt, Human
cucaugugauccucccaccucagc

SEQ ID NO: 1160523 - RNA, 19 nt, Human
cucauuguagcuucaaccu

SEQ ID NO: 1160524 - RNA, 21 nt, Human
cuccuggguucaagcaauucu

SEQ ID NO: 1160525 - RNA, 24 nt, Human
cucgcucugucacccaagcuggag

SEQ ID NO: 1160526 - RNA, 18 nt, Human
cucucuccacccuucccc

SEQ ID NO: 1160527 - RNA, 21 nt, Human
cugaguaacugggauuacagg

SEQ ID NO: 1160528 - RNA, 24 nt, Human
cugaguaacugggauuacagguau

SEQ ID NO: 1160529 - RNA, 22 nt, Human
cugcagccucaaccucccaggc

SEQ ID NO: 1160530 - RNA, 23 nt, Human
cugccucagccucccaaagugcu

SEQ ID NO: 1160531 - RNA, 24 nt, Human
cugccucagccucccaaagugcug

SEQ ID NO: 1160532 - RNA, 18 nt, Human
cugcugugcaccuucucc

SEQ ID NO: 1160533 - RNA, 19 nt, Human
cugcugugcaccuucuccu

SEQ ID NO: 1160534 - RNA, 24 nt, Human
cuggaucuugcucugcagucuggg

SEQ ID NO: 1160535 - RNA, 22 nt, Human
cuugacucacugcagccucaac

SEQ ID NO: 1160536 - RNA, 24 nt, Human
cuuguugcccaggcuggagugcaa

SEQ ID NO: 1160537 - RNA, 22 nt, Human
gaacaucauucaaacaggaaau

SEQ ID NO: 1160538 - RNA, 22 nt, Human
gacaggguuuugccaugcuucc

SEQ ID NO: 1160539 - RNA, 24 nt, Human
gaccucaggugauccucccgccuc

SEQ ID NO: 1160540 - RNA, 21 nt, Human
gagaauuuacacaauggacac

SEQ ID NO: 1160541 - RNA, 20 nt, Human
gagacagggucucacucugu

SEQ ID NO: 1160542 - RNA, 21 nt, Human
gagacagggucucacucuguc

SEQ ID NO: 1160543 - RNA, 20 nt, Human
gagacgggguuucuccaugu

SEQ ID NO: 1160544 - RNA, 19 nt, Human
gaguaacugggauuacagg

SEQ ID NO: 1160545 - RNA, 24 nt, Human
gaguaacugggauuacagguaugc

SEQ ID NO: 1160546 - RNA, 24 nt, Human
gaguagcugggauuacaggcaugc

SEQ ID NO: 1160547 - RNA, 19 nt, Human
gagugcaauggcacgaucu

SEQ ID NO: 1160548 - RNA, 18 nt, Human
gauuacaggcaugugcca

SEQ ID NO: 1160549 - RNA, 19 nt, Human
gauuacaggcaugugccac

SEQ ID NO: 1160550 - RNA, 21 nt, Human
gauuacaggcaugugccacug

SEQ ID NO: 1160551 - RNA, 18 nt, Human
gauuacaggcgugagcca

SEQ ID NO: 1160552 - RNA, 21 nt, Human
gauuacaggcgugagccaccg

SEQ ID NO: 1160553 - RNA, 24 nt, Human
gauuacaggcgugagccaccgugc

SEQ ID NO: 1160554 - RNA, 18 nt, Human
gauuacaggcgugugcca

SEQ ID NO: 1160555 - RNA, 20 nt, Human
gcaccaccacgccuggcuaa

SEQ ID NO: 1160556 - RNA, 20 nt, Human
gccagagagaagauagaggc

SEQ ID NO: 1160557 - RNA, 19 nt, Human
gcccaggcuggagugcaau

SEQ ID NO: 1160558 - RNA, 22 nt, Human
gcccucaauaauuucuuuuucu

SEQ ID NO: 1160559 - RNA, 25 nt, Human
gcucugucacccaagcuggagugca

SEQ ID NO: 1160560 - RNA, 24 nt, Human
gcucuuguugcccaggcuggagug

SEQ ID NO: 1160561 - RNA, 19 nt, Human
gcuggagugcaauggcacg

SEQ ID NO: 1160562 - RNA, 23 nt, Human
gcuggucucgaacuccugaccuc

SEQ ID NO: 1160563 - RNA, 21 nt, Human
gcuuggaaaagaugacuguuc

SEQ ID NO: 1160564 - RNA, 31 nt, Human
ggacacugaacaucauucaaacaggaaaugg

SEQ ID NO: 1160565 - RNA, 22 nt, Human
ggaucuugcucugcagucuggg

SEQ ID NO: 1160566 - RNA, 20 nt, Human
ggaugcugucuuuggaaagg

SEQ ID NO: 1160567 - RNA, 24 nt, Human
ggauuacaggcaugugccacugug

SEQ ID NO: 1160568 - RNA, 18 nt, Human
ggcaugggaggaagagcc

SEQ ID NO: 1160569 - RNA, 24 nt, Human
ggcuaauuguauuuuuaguagaga

SEQ ID NO: 1160570 - RNA, 24 nt, Human
ggcuggucucgaacuccugaccuc

SEQ ID NO: 1160571 - RNA, 22 nt, Human
gggcucacaccguccucuaccc

SEQ ID NO: 1160572 - RNA, 19 nt, Human
ggucucgaacuccugaccu

SEQ ID NO: 1160573 - RNA, 21 nt, Human
ggugauccucccgccucggcc

SEQ ID NO: 1160574 - RNA, 21 nt, Human
guagagacaggguuuugccau

SEQ ID NO: 1160575 - RNA, 22 nt, Human
guagagacaggguuuugccaug

SEQ ID NO: 1160576 - RNA, 23 nt, Human
guagagacgggguuucuccaugu

SEQ ID NO: 1160577 - RNA, 18 nt, Human
guagcugggauuacaggc

SEQ ID NO: 1160578 - RNA, 20 nt, Human
guagcugggauuacaggcau

SEQ ID NO: 1160579 - RNA, 24 nt, Human
gugauccucccaccucagccuccu

SEQ ID NO: 1160580 - RNA, 24 nt, Human
gugauccucccgccucggccuccc

SEQ ID NO: 1160581 - RNA, 18 nt, Human
gugcaaucuugacucacu

SEQ ID NO: 1160582 - RNA, 25 nt, Human
uaauuuuuguguuuuuuuuguagag

SEQ ID NO: 1160583 - RNA, 26 nt, Human
uaauuuuuguguuuuuuuuguagaga

SEQ ID NO: 1160584 - RNA, 22 nt, Human
uacaggcaugcaccaccacgcc

SEQ ID NO: 1160585 - RNA, 22 nt, Human
uacaggcaugugccacugugcc

SEQ ID NO: 1160586 - RNA, 24 nt, Human
uacaggcgugagccaccgugccca

SEQ ID NO: 1160587 - RNA, 23 nt, Human
uagaagcacacgguuuuacugca

SEQ ID NO: 1160588 - RNA, 20 nt, Human
uagagacaggguuuugccau

SEQ ID NO: 1160589 - RNA, 21 nt, Human
uagagacaggguuuugccaug

SEQ ID NO: 1160590 - RNA, 24 nt, Human
uaguagagacgggguuucuccaug

SEQ ID NO: 1160591 - RNA, 21 nt, Human
uagucccacuugcuguguuuu

SEQ ID NO: 1160592 - RNA, 24 nt, Human
uagucccacuugcuguguuuuugg

SEQ ID NO: 1160593 - RNA, 23 nt, Human
ucaaagugcugggauuacaggca

SEQ ID NO: 1160594 - RNA, 24 nt, Human
ucaaagugcugggauuacaggcau

SEQ ID NO: 1160595 - RNA, 24 nt, Human
ucaagaaauuaucccaccacagcc

SEQ ID NO: 1160596 - RNA, 19 nt, Human
ucaagcaauucuccugccu

SEQ ID NO: 1160597 - RNA, 18 nt, Human
ucaccagggcccuucccc

SEQ ID NO: 1160598 - RNA, 24 nt, Human
ucaccgcaaccuccgccuccuggg

SEQ ID NO: 1160599 - RNA, 25 nt, Human
ucaccgcaaccuccgccuccugggu

SEQ ID NO: 1160600 - RNA, 27 nt, Human
ucaccgcaaccuccgccuccuggguuc

SEQ ID NO: 1160601 - RNA, 19 nt, Human
ucacugcagccucaaccuc

SEQ ID NO: 1160602 - RNA, 23 nt, Human
ucacugcagccucaaccucccag

SEQ ID NO: 1160603 - RNA, 24 nt, Human
ucacugcagccucaaccucccagg

SEQ ID NO: 1160604 - RNA, 20 nt, Human
ucagccucccgaguagcugg

SEQ ID NO: 1160605 - RNA, 21 nt, Human
ucaguagcuucuccuuuuuuu

SEQ ID NO: 1160606 - RNA, 23 nt, Human
ucaguagcuucuccuuuuuuucu

SEQ ID NO: 1160607 - RNA, 22 nt, Human
ucagugccagggccuggccaaa

SEQ ID NO: 1160608 - RNA, 22 nt, Human
ucauuguagcuucaaccuccug

SEQ ID NO: 1160609 - RNA, 22 nt, Human
uccaccagaacaucauucccca

SEQ ID NO: 1160610 - RNA, 18 nt, Human
uccaugggguguuccacc

SEQ ID NO: 1160611 - RNA, 24 nt, Human
ucccaaagugcugggauuacaggc

SEQ ID NO: 1160612 - RNA, 23 nt, Human
ucccaccacagccucucaaagug

SEQ ID NO: 1160613 - RNA, 23 nt, Human
uccccagccuggcccucacaaac

SEQ ID NO: 1160614 - RNA, 22 nt, Human
uccccagugagcagagccucug

SEQ ID NO: 1160615 - RNA, 23 nt, Human
uccccagugagcagagccucugc

SEQ ID NO: 1160616 - RNA, 24 nt, Human
ucccgaaguguugggauuacaggc

SEQ ID NO: 1160617 - RNA, 24 nt, Human
ucccgaguagcugggauuacaggc

SEQ ID NO: 1160618 - RNA, 21 nt, Human
ucccuggguucagccucccca

SEQ ID NO: 1160619 - RNA, 24 nt, Human
uccgccuccuggguucaagcaauu

SEQ ID NO: 1160620 - RNA, 27 nt, Human
uccuccugccucagccucccaaagugc

SEQ ID NO: 1160621 - RNA, 24 nt, Human
uccugaguaacugggauuacaggu

SEQ ID NO: 1160622 - RNA, 18 nt, Human
uccugggcucaagaaauu

SEQ ID NO: 1160623 - RNA, 21 nt, Human
uccuggguucaagcaauucuc

SEQ ID NO: 1160624 - RNA, 24 nt, Human
uccuggguucaagcaauucuccug

SEQ ID NO: 1160625 - RNA, 22 nt, Human
ucgcucuuguugcccaggcugg

SEQ ID NO: 1160626 - RNA, 23 nt, Human
ucgcucuuguugcccaggcugga

SEQ ID NO: 1160627 - RNA, 24 nt, Human
ucucaaagugcugggauuacaggc

SEQ ID NO: 1160628 - RNA, 24 nt, Human
ucucacucugucacccaagcugga

SEQ ID NO: 1160629 - RNA, 26 nt, Human
ucucacucugucacccaagcuggagu

SEQ ID NO: 1160630 - RNA, 27 nt, Human
ucucacucugucacccaagcuggagug

SEQ ID NO: 1160631 - RNA, 25 nt, Human
ucuccacccuuccccagccuggccc

SEQ ID NO: 1160632 - RNA, 24 nt, Human
ucuccugccucagccucccgagua

SEQ ID NO: 1160633 - RNA, 19 nt, Human
ucucgaacuccugaccuca

SEQ ID NO: 1160634 - RNA, 19 nt, Human
ucucgaacuccugggcuca

SEQ ID NO: 1160635 - RNA, 21 nt, Human
ucucgaacuccugggcucaag

SEQ ID NO: 1160636 - RNA, 24 nt, Human
ucucgcucugucacccaagcugga

SEQ ID NO: 1160637 - RNA, 26 nt, Human
ucucgcucugucacccaagcuggagu

SEQ ID NO: 1160638 - RNA, 22 nt, Human
ucugcagucugggagaacccug

SEQ ID NO: 1160639 - RNA, 24 nt, Human
ucugucacccaagcuggagugcag

SEQ ID NO: 1160640 - RNA, 24 nt, Human
ucugucacccaagcuggagugcag

SEQ ID NO: 1160641 - RNA, 18 nt, Human
ucuugcucugcagucugg

SEQ ID NO: 1160642 - RNA, 22 nt, Human
ucuuguugcccaggcuggagug

SEQ ID NO: 1160643 - RNA, 18 nt, Human
ugaccucaggugauccuc

SEQ ID NO: 1160644 - RNA, 20 nt, Human
ugaccucaggugauccuccc

SEQ ID NO: 1160645 - RNA, 21 nt, Human
ugaccucaggugauccucccg

SEQ ID NO: 1160646 - RNA, 24 nt, Human
ugaccucaggugauccucccgccu

SEQ ID NO: 1160647 - RNA, 19 nt, Human
ugacucacugcagccucaa

SEQ ID NO: 1160648 - RNA, 22 nt, Human
ugagacagggucucgcucuguc

SEQ ID NO: 1160649 - RNA, 21 nt, Human
ugagcagagccucugccuguc

SEQ ID NO: 1160650 - RNA, 24 nt, Human
ugagcucaagcaauccuccugccu

SEQ ID NO: 1160651 - RNA, 22 nt, Human
ugaggcuggucucgaacuccug

SEQ ID NO: 1160652 - RNA, 18 nt, Human
ugcagccucaaccuccca

SEQ ID NO: 1160653 - RNA, 24 nt, Human
ugccaugcuucccaggcuggucuc

SEQ ID NO: 1160654 - RNA, 27 nt, Human
ugccaugcuucccaggcuggucucgaa

SEQ ID NO: 1160655 - RNA, 18 nt, Human
ugcccaggcuggagugca

SEQ ID NO: 1160656 - RNA, 21 nt, Human
ugcccaggcuggagugcaaug

SEQ ID NO: 1160657 - RNA, 24 nt, Human
ugcccaggcuggagugcaauggca

SEQ ID NO: 1160658 - RNA, 24 nt, Human
ugccucagccucccaaagugcugg

SEQ ID NO: 1160659 - RNA, 24 nt, Human
ugccucagccucccgaguagcugg

SEQ ID NO: 1160660 - RNA, 18 nt, Human
ugccuggccccucaauaa

SEQ ID NO: 1160661 - RNA, 28 nt, Human
ugcuacacacacacuucaaacauauaca

SEQ ID NO: 1160662 - RNA, 20 nt, Human
ugcugggauuacaggcaugu

SEQ ID NO: 1160663 - RNA, 24 nt, Human
ugcugggauuacaggcgugugcca

SEQ ID NO: 1160664 - RNA, 21 nt, Human
ugcuguguuuuuggggcaugu

SEQ ID NO: 1160665 - RNA, 19 nt, Human
uggagggccagcucuugcc

SEQ ID NO: 1160666 - RNA, 24 nt, Human
uggagugcaauggcacgaucuugg

SEQ ID NO: 1160667 - RNA, 18 nt, Human
uggagugcaguggugcaa

SEQ ID NO: 1160668 - RNA, 18 nt, Human
uggagugcaguggugcaa

SEQ ID NO: 1160669 - RNA, 18 nt, Human
uggagugcaguggugcaa

SEQ ID NO: 1160670 - RNA, 23 nt, Human
uggagugcaguggugcaaucuug

SEQ ID NO: 1160671 - RNA, 19 nt, Human
uggcauggagggccagcuc

SEQ ID NO: 1160672 - RNA, 20 nt, Human
uggccccucaauaauuucuu

SEQ ID NO: 1160673 - RNA, 21 nt, Human
ugggauuacaggcaugcacca

SEQ ID NO: 1160674 - RNA, 24 nt, Human
ugggauuacaggcaugcaccacca

SEQ ID NO: 1160675 - RNA, 21 nt, Human
ugggauuacaggcaugugcca

SEQ ID NO: 1160676 - RNA, 22 nt, Human
ugggauuacaggcaugugccac

SEQ ID NO: 1160677 - RNA, 22 nt, Human
ugggauuacaggcaugugccac

SEQ ID NO: 1160678 - RNA, 23 nt, Human
ugggauuacaggcaugugccacu

SEQ ID NO: 1160679 - RNA, 24 nt, Human
ugggauuacaggcaugugccacug

SEQ ID NO: 1160680 - RNA, 18 nt, Human
ugggauuacaggcgugag

SEQ ID NO: 1160681 - RNA, 21 nt, Human
ugggauuacaggcgugagcca

SEQ ID NO: 1160682 - RNA, 22 nt, Human
ugggauuacaggcgugagccac

SEQ ID NO: 1160683 - RNA, 23 nt, Human
ugggauuacaggcgugagccacc

SEQ ID NO: 1160684 - RNA, 23 nt, Human
ugggauuacaggcgugagccacc

SEQ ID NO: 1160685 - RNA, 24 nt, Human
ugggauuacaggcgugagccaccg

SEQ ID NO: 1160686 - RNA, 18 nt, Human
ugggauuacaggcgugug

SEQ ID NO: 1160687 - RNA, 19 nt, Human
ugggauuacaggcgugugc

SEQ ID NO: 1160688 - RNA, 21 nt, Human
ugggauuacaggcgugugcca

SEQ ID NO: 1160689 - RNA, 22 nt, Human
ugggauuacaggcgugugccac

SEQ ID NO: 1160690 - RNA, 24 nt, Human
ugggauuacaggcgugugccacca

SEQ ID NO: 1160691 - RNA, 21 nt, Human
ugggauuacagguaugcacca

SEQ ID NO: 1160692 - RNA, 21 nt, Human
uggguucaagcaauucuccug

SEQ ID NO: 1160693 - RNA, 23 nt, Human
uggguucaagcaauucuccugcc

SEQ ID NO: 1160694 - RNA, 24 nt, Human
uggguucaagcaauucuccugccu

SEQ ID NO: 1160695 - RNA, 22 nt, Human
ugguuagggacucgcaccuuac

SEQ ID NO: 1160696 - RNA, 22 nt, Human
uguagagacaggguuuugccau

SEQ ID NO: 1160697 - RNA, 21 nt, Human
uguauuuuuaguagagacggg

SEQ ID NO: 1160698 - RNA, 21 nt, Human
ugucacccaagcuggagugca

SEQ ID NO: 1160699 - RNA, 24 nt, Human
ugugauccucccaccucagccucc

SEQ ID NO: 1160700 - RNA, 24 nt, Human
uguugaggcuggucucgaacuccu

SEQ ID NO: 1160701 - RNA, 20 nt, Human
uguugcccaggcuggagugc

SEQ ID NO: 1160702 - RNA, 18 nt, Human
uuacagaagaggaaccag

SEQ ID NO: 1160703 - RNA, 18 nt, Human
uuaguagagacgggguuu

SEQ ID NO: 1160704 - RNA, 24 nt, Human
uuaguagagacgggguuucuccau

SEQ ID NO: 1160705 - RNA, 21 nt, Human
uucaagcaauucuccugccuc

SEQ ID NO: 1160706 - RNA, 24 nt, Human
uucaagcaauucuccugccucagc

SEQ ID NO: 1160707 - RNA, 24 nt, Human
uucccaggcuggucucgaacuccu

SEQ ID NO: 1160708 - RNA, 24 nt, Human
uucgcucuuguugcccaggcugga

SEQ ID NO: 1160709 - RNA, 22 nt, Human
uugagacagggucucgcucugu

SEQ ID NO: 1160710 - RNA, 24 nt, Human
uuguagagacaggguuuugccaug

SEQ ID NO: 1160711 - RNA, 18 nt, Human
uuguauuuuuaguagaga

SEQ ID NO: 1160712 - RNA, 23 nt, Human
uuucgcucuuguugcccaggcug

SEQ ID NO: 1160713 - RNA, 19 nt, Human
uuuggaaaggugguuaggg

SEQ ID NO: 1160714 - RNA, 23 nt, Human
uuuguagagacaggguuuugcca

SEQ ID NO: 1160715 - RNA, 24 nt, Human
uuuguagagacaggguuuugccau

SEQ ID NO: 1160716 - RNA, 22 nt, Human
uuuuuaguagagacgggguuuc

SEQ ID NO: 1160717 - RNA, 24 nt, Human
uuuuuuguagagacaggguuuugc

SEQ ID NO: 1160718 - RNA, 18 nt, Human
uuuuuuucuugagacagg

SEQ ID NO: 1160719 - RNA, 22 nt, Human
uuuuuuuguagagacaggguuu

SEQ ID NO: 1160720 - RNA, 23 nt, Human
aacaguaucaaucgcuaccccca

SEQ ID NO: 1160721 - RNA, 21 nt, Human
aaucgcuacccccaauccaga

SEQ ID NO: 1160722 - RNA, 20 nt, Human
accaagguagaaaucacaaa

SEQ ID NO: 1160723 - RNA, 21 nt, Human
acccugucugacccuaggcug

SEQ ID NO: 1160724 - RNA, 20 nt, Human
agguauggucuaaggucaca

SEQ ID NO: 1160725 - RNA, 19 nt, Human
agguugugcagaagcaccu

SEQ ID NO: 1160726 - RNA, 23 nt, Human
auccuuggcaagaaagcuaaggg

SEQ ID NO: 1160727 - RNA, 18 nt, Human
caaucgcuacccccaauc

SEQ ID NO: 1160728 - RNA, 19 nt, Human
cacccugucugacccuagg

SEQ ID NO: 1160729 - RNA, 23 nt, Human
cagaagcaccuuccccaccuccu

SEQ ID NO: 1160730 - RNA, 26 nt, Human
caguaaauucuucucccaaggcuggg

SEQ ID NO: 1160731 - RNA, 31 nt, Human
ccaagguagaaaucacaaaugggacgcauua

SEQ ID NO: 1160732 - RNA, 20 nt, Human
ccacuuuccuccgaaggggg

SEQ ID NO: 1160733 - RNA, 23 nt, Human
cccaaggcuggggccgucaaggc

SEQ ID NO: 1160734 - RNA, 21 nt, Human
ccuccagcuucucuuuugggg

SEQ ID NO: 1160735 - RNA, 23 nt, Human
cuccugcuccuccagcuucucuu

SEQ ID NO: 1160736 - RNA, 19 nt, Human
gacccuaggcuggggcugc

SEQ ID NO: 1160737 - RNA, 22 nt, Human
ggcuggggcugcuugcucggua

SEQ ID NO: 1160738 - RNA, 21 nt, Human
ggggucacaguggagccacca

SEQ ID NO: 1160739 - RNA, 20 nt, Human
gguaggcaggaauuuacuac

SEQ ID NO: 1160740 - RNA, 23 nt, Human
ggucuaaggucacagucugggag

SEQ ID NO: 1160741 - RNA, 22 nt, Human
uaacaguaaauucuucucccaa

SEQ ID NO: 1160742 - RNA, 21 nt, Human
uaggcaggaauuuacuaccug

SEQ ID NO: 1160743 - RNA, 23 nt, Human
uaggggucacaguggagccacca

SEQ ID NO: 1160744 - RNA, 18 nt, Human
ucaaagguugugcagaag

SEQ ID NO: 1160745 - RNA, 21 nt, Human
ucaaucgcuacccccaaucca

SEQ ID NO: 1160746 - RNA, 18 nt, Human
ucacagucugggagagga

SEQ ID NO: 1160747 - RNA, 19 nt, Human
uccccaccuccugccucau

SEQ ID NO: 1160748 - RNA, 22 nt, Human
ucgcuacccccaauccagauga

SEQ ID NO: 1160749 - RNA, 18 nt, Human
ucucccaaggcuggggcc

SEQ ID NO: 1160750 - RNA, 21 nt, Human
ucucugggcucguggguuagg

SEQ ID NO: 1160751 - RNA, 24 nt, Human
ugauuuugggggagucgaggcauu

SEQ ID NO: 1160752 - RNA, 18 nt, Human
uggcaagaaagcuaaggg

SEQ ID NO: 1160753 - RNA, 21 nt, Human
ugucugacccuaggcuggggc

SEQ ID NO: 1160754 - RNA, 23 nt, Human
ugugcagaagcaccuuccccacc

SEQ ID NO: 1160755 - RNA, 22 nt, Human
uguguuaacugacaguggccug

SEQ ID NO: 1160756 - RNA, 23 nt, Human
uuugggggagucgaggcauuggg

SEQ ID NO: 1160757 - RNA, 24 nt, Human
aaagccucucuguugcagcuucca

SEQ ID NO: 1160758 - RNA, 19 nt, Human
aagugcuggggggaaguga

SEQ ID NO: 1160759 - RNA, 22 nt, Human
aagugcuggggggaagugagcu

SEQ ID NO: 1160760 - RNA, 21 nt, Human
accugcuugugguccagaugc

SEQ ID NO: 1160761 - RNA, 19 nt, Human
agcacagcucccagggucc

SEQ ID NO: 1160762 - RNA, 22 nt, Human
aggcacagugaaccucgccagg

SEQ ID NO: 1160763 - RNA, 20 nt, Human
aggcuccacugagaguccac

SEQ ID NO: 1160764 - RNA, 23 nt, Human
aucaucaucacagaugucaaagu

SEQ ID NO: 1160765 - RNA, 18 nt, Human
auggcgcagcaaaagcag

SEQ ID NO: 1160766 - RNA, 24 nt, Human
caaaguggcuguugagucaagguc

SEQ ID NO: 1160767 - RNA, 21 nt, Human
cagccgcauuaaugcuugcug

SEQ ID NO: 1160768 - RNA, 26 nt, Human
cagcuuccugccgccuucaccagaag

SEQ ID NO: 1160769 - RNA, 19 nt, Human
cagugaaccucgccaggcu

SEQ ID NO: 1160770 - RNA, 18 nt, Human
caucaagaagugcugggg

SEQ ID NO: 1160771 - RNA, 24 nt, Human
ccacguuguagaugcgcacaccug

SEQ ID NO: 1160772 - RNA, 23 nt, Human
ccaggauuguucccccugggauc

SEQ ID NO: 1160773 - RNA, 19 nt, Human
cccacugccaaggcucagc

SEQ ID NO: 1160774 - RNA, 22 nt, Human
ccccacugccaaggcucagcuc

SEQ ID NO: 1160775 - RNA, 20 nt, Human
cccccugggaucgugcucca

SEQ ID NO: 1160776 - RNA, 18 nt, Human
cccgacccaggccccagc

SEQ ID NO: 1160777 - RNA, 20 nt, Human
ccuccgcguguccccgaccc

SEQ ID NO: 1160778 - RNA, 23 nt, Human
ccugaccuccgcguguccccgac

SEQ ID NO: 1160779 - RNA, 18 nt, Human
cucccaggguccuuaaaa

SEQ ID NO: 1160780 - RNA, 26 nt, Human
cuuccugccgccuucaccagccugac

SEQ ID NO: 1160781 - RNA, 19 nt, Human
gaaagugggcaccagcccc

SEQ ID NO: 1160782 - RNA, 25 nt, Human
gaaggagcagaugcaagcugacuca

SEQ ID NO: 1160783 - RNA, 19 nt, Human
gaccgaaggagcagaugca

SEQ ID NO: 1160784 - RNA, 26 nt, Human
gagcagaugcaagcugacucagcagg

SEQ ID NO: 1160785 - RNA, 25 nt, Human
gcacagcucccaggguccuuaaaag

SEQ ID NO: 1160786 - RNA, 19 nt, Human
guccccgacccaggcccca

SEQ ID NO: 1160787 - RNA, 21 nt, Human
gucccuggcaauuuccuccag

SEQ ID NO: 1160788 - RNA, 19 nt, Human
guggaaggucccaucuaca

SEQ ID NO: 1160789 - RNA, 20 nt, Human
uagcacagcucccagggucc

SEQ ID NO: 1160790 - RNA, 24 nt, Human
uagcacagcucccaggguccuuaa

SEQ ID NO: 1160791 - RNA, 18 nt, Human
uagggaucccaagggguc

SEQ ID NO: 1160792 - RNA, 25 nt, Human
uauucaucacaucggagaucaucuc

SEQ ID NO: 1160793 - RNA, 25 nt, Human
ucaaaguacacaucgaaagccucuc

SEQ ID NO: 1160794 - RNA, 21 nt, Human
ucccaaggggucucugccuuc

SEQ ID NO: 1160795 - RNA, 18 nt, Human
ucccccugggaucgugcu

SEQ ID NO: 1160796 - RNA, 20 nt, Human
ucccccugggaucgugcucc

SEQ ID NO: 1160797 - RNA, 20 nt, Human
ucgaaagccucucuguugca

SEQ ID NO: 1160798 - RNA, 21 nt, Human
ucuccauggcgcagcaaaagc

SEQ ID NO: 1160799 - RNA, 22 nt, Human
ucucuagcacagcucccagggu

SEQ ID NO: 1160800 - RNA, 25 nt, Human
ucugcagucugccacugcaggucuc

SEQ ID NO: 1160801 - RNA, 20 nt, Human
ugacucagcaggcacaguga

SEQ ID NO: 1160802 - RNA, 21 nt, Human
ugagucaagguccaggauugu

SEQ ID NO: 1160803 - RNA, 22 nt, Human
ugagucaagguccaggauuguu

SEQ ID NO: 1160804 - RNA, 22 nt, Human
ugccccacugccaaggcucagc

SEQ ID NO: 1160805 - RNA, 22 nt, Human
ugcgaccgaaggagcagaugca

SEQ ID NO: 1160806 - RNA, 21 nt, Human
ugcugaguggaaagugggcac

SEQ ID NO: 1160807 - RNA, 21 nt, Human
uggaaguauugcgaccgaagg

SEQ ID NO: 1160808 - RNA, 19 nt, Human
uggcuaguggcuuccaagc

SEQ ID NO: 1160809 - RNA, 20 nt, Human
uggcuuccaagcaugccccu

SEQ ID NO: 1160810 - RNA, 19 nt, Human
ugggucccuggcaauuucc

SEQ ID NO: 1160811 - RNA, 22 nt, Human
uuaaaaaauccccagguuggau

SEQ ID NO: 1160812 - RNA, 21 nt, Human
uuccugccgccuucaccagcc

SEQ ID NO: 1160813 - RNA, 25 nt, Human
uuggaaguauugcgaccgaaggagc

SEQ ID NO: 1160814 - RNA, 21 nt, Human
aaaggaaggagcuggccggug

SEQ ID NO: 1160815 - RNA, 25 nt, Human
aaaggaaggagcuggccgguggagg

SEQ ID NO: 1160816 - RNA, 18 nt, Human
aacuucuuucacugaccu

SEQ ID NO: 1160817 - RNA, 23 nt, Human
aagcggccaagguagaacuggca

SEQ ID NO: 1160818 - RNA, 20 nt, Human
aaggaaggagcuggccggug

SEQ ID NO: 1160819 - RNA, 18 nt, Human
acuuguacuccaucuugu

SEQ ID NO: 1160820 - RNA, 19 nt, Human
agcuccagcugguuggccu

SEQ ID NO: 1160821 - RNA, 19 nt, Human
aggaaggagcuggccggug

SEQ ID NO: 1160822 - RNA, 25 nt, Human
aggaaggagcuggccgguggagggu

SEQ ID NO: 1160823 - RNA, 25 nt, Human
aggaaggaguguuugggugagggga

SEQ ID NO: 1160824 - RNA, 26 nt, Human
aggaaggaguguuugggugaggggau

SEQ ID NO: 1160825 - RNA, 18 nt, Human
aggaguguuugggugagg

SEQ ID NO: 1160826 - RNA, 29 nt, Human
caaagccuugagugccagguugggcucuu

SEQ ID NO: 1160827 - RNA, 21 nt, Human
cacaggcccuucuuguccucc

SEQ ID NO: 1160828 - RNA, 21 nt, Human
ccaggaaggaguguuugggug

SEQ ID NO: 1160829 - RNA, 21 nt, Human
cucccgaccaccaggagcggg

SEQ ID NO: 1160830 - RNA, 24 nt, Human
cucccgggugugcgucuccagcuc

SEQ ID NO: 1160831 - RNA, 19 nt, Human
cuugugcagguugagauug

SEQ ID NO: 1160832 - RNA, 19 nt, Human
gaaggucuggcguggggcg

SEQ ID NO: 1160833 - RNA, 21 nt, Human
gacagggccacggucugcaga

SEQ ID NO: 1160834 - RNA, 21 nt, Human
gcagagccugggaggcagaca

SEQ ID NO: 1160835 - RNA, 18 nt, Human
ggaaggaguguuugggug

SEQ ID NO: 1160836 - RNA, 18 nt, Human
ggacacaggcccuucuug

SEQ ID NO: 1160837 - RNA, 19 nt, Human
ggaggguggaaugugagau

SEQ ID NO: 1160838 - RNA, 21 nt, Human
ggccaggaaggaguguuuggg

SEQ ID NO: 1160839 - RNA, 19 nt, Human
ggccggccgguuccuuggg

SEQ ID NO: 1160840 - RNA, 24 nt, Human
ggcuggacacaggcccuucuuguc

SEQ ID NO: 1160841 - RNA, 25 nt, Human
ggggcccccgggccggccgguuccu

SEQ ID NO: 1160842 - RNA, 19 nt, Human
gguggaaugugagauccaa

SEQ ID NO: 1160843 - RNA, 18 nt, Human
guggaagggccgcucccc

SEQ ID NO: 1160844 - RNA, 22 nt, Human
uaacauugucaagggaaugaga

SEQ ID NO: 1160845 - RNA, 20 nt, Human
uagcugcacuggucacagug

SEQ ID NO: 1160846 - RNA, 22 nt, Human
uagcugcacuggucacaguggg

SEQ ID NO: 1160847 - RNA, 18 nt, Human
uauaacauugucaaggga

SEQ ID NO: 1160848 - RNA, 22 nt, Human
ucacugaccuucuuggacaaag

SEQ ID NO: 1160849 - RNA, 26 nt, Human
uccaagugguucuuggggacuccgug

SEQ ID NO: 1160850 - RNA, 23 nt, Human
uccucggggcaguccccacucug

SEQ ID NO: 1160851 - RNA, 19 nt, Human
ucucucaguccgagauagg

SEQ ID NO: 1160852 - RNA, 23 nt, Human
ucuggcguggggcgugcuucagc

SEQ ID NO: 1160853 - RNA, 19 nt, Human
ucuugugcagguugagauu

SEQ ID NO: 1160854 - RNA, 21 nt, Human
ucuugugcagguugagauugu

SEQ ID NO: 1160855 - RNA, 19 nt, Human
ugaccuucuuggacaaagc

SEQ ID NO: 1160856 - RNA, 26 nt, Human
ugagauuguccuugcgcuugcagcug

SEQ ID NO: 1160857 - RNA, 21 nt, Human
ugcagguugagauuguccuug

SEQ ID NO: 1160858 - RNA, 19 nt, Human
ugccgugggcugccgacag

SEQ ID NO: 1160859 - RNA, 20 nt, Human
ugcucuuucucucaguccga

SEQ ID NO: 1160860 - RNA, 21 nt, Human
uggaagggccgcuccccggug

SEQ ID NO: 1160861 - RNA, 22 nt, Human
uggaauaaaugcagaaugggca

SEQ ID NO: 1160862 - RNA, 23 nt, Human
uggaauaaaugcagaaugggcac

SEQ ID NO: 1160863 - RNA, 20 nt, Human
uggcagcggggcgguuggug

SEQ ID NO: 1160864 - RNA, 24 nt, Human
ugggggcuggacacaggcccuucu

SEQ ID NO: 1160865 - RNA, 21 nt, Human
uguguggucuugaacaggcac

SEQ ID NO: 1160866 - RNA, 19 nt, Human
uuccuugggggcuggacac

SEQ ID NO: 1160867 - RNA, 18 nt, Human
uuugggugaggggaugcu

SEQ ID NO: 1160868 - RNA, 25 nt, Human
aaaaagcuaggguaaccaggagaaa

SEQ ID NO: 1160869 - RNA, 19 nt, Human
aagagaccaagucacuggu

SEQ ID NO: 1160870 - RNA, 18 nt, Human
agaaauggccccuucaga

SEQ ID NO: 1160871 - RNA, 26 nt, Human
aggaagagaccaagucacugguaaaa

SEQ ID NO: 1160872 - RNA, 20 nt, Human
caggaagagaccaagucacu

SEQ ID NO: 1160873 - RNA, 24 nt, Human
caggaagagaccaagucacuggua

SEQ ID NO: 1160874 - RNA, 23 nt, Human
caggagaaauggccccuucagau

SEQ ID NO: 1160875 - RNA, 20 nt, Human
ccccuucagaugacacugga

SEQ ID NO: 1160876 - RNA, 25 nt, Human
uacaggaagagaccaagucacuggu

SEQ ID NO: 1160877 - RNA, 23 nt, Human
uaggguaaccaggagaaauggcc

SEQ ID NO: 1160878 - RNA, 21 nt, Human
ucacugguaaaaagcuagggu

SEQ ID NO: 1160879 - RNA, 19 nt, Human
ugcuagagaagcacuguuu

SEQ ID NO: 1160880 - RNA, 24 nt, Human
uucacguguguugccacuacagga

SEQ ID NO: 1160881 - RNA, 18 nt, Human
aaaaacacaaaugaagug

SEQ ID NO: 1160882 - RNA, 19 nt, Human
aaaacaucccugcuaccaa

SEQ ID NO: 1160883 - RNA, 23 nt, Human
aaaagcuuugaacagaaggguuc

SEQ ID NO: 1160884 - RNA, 21 nt, Human
aagaagaucuaucacuuccac

SEQ ID NO: 1160885 - RNA, 19 nt, Human
aagcagcaauacaaaagua

SEQ ID NO: 1160886 - RNA, 22 nt, Human
aagcagcaauacaaaaguauuc

SEQ ID NO: 1160887 - RNA, 22 nt, Human
aguuaagccagaacugggaaug

SEQ ID NO: 1160888 - RNA, 22 nt, Human
auguccaauauuuaaaaccagu

SEQ ID NO: 1160889 - RNA, 29 nt, Human
caccacgaccucgaauagguccggcgccg

SEQ ID NO: 1160890 - RNA, 23 nt, Human
caccuauauuucaaguuuggaaa

SEQ ID NO: 1160891 - RNA, 24 nt, Human
caccuuguccuccccugccgccac

SEQ ID NO: 1160892 - RNA, 24 nt, Human
cacgaaggaaccaggguugucuua

SEQ ID NO: 1160893 - RNA, 24 nt, Human
cacuuccacuaugccuaucaaauu

SEQ ID NO: 1160894 - RNA, 20 nt, Human
caucagcaccuucauuuggu

SEQ ID NO: 1160895 - RNA, 19 nt, Human
caucccugcuaccaauaca

SEQ ID NO: 1160896 - RNA, 24 nt, Human
ccaccuuguccuccccugccgcca

SEQ ID NO: 1160897 - RNA, 19 nt, Human
ccacucauccaaagucauc

SEQ ID NO: 1160898 - RNA, 18 nt, Human
ccacugcccaucagcacc

SEQ ID NO: 1160899 - RNA, 24 nt, Human
ccacugcccaucagcaccuucauu

SEQ ID NO: 1160900 - RNA, 19 nt, Human
ccaguuaagccagaacugg

SEQ ID NO: 1160901 - RNA, 21 nt, Human
cccauguccaccuuguccucc

SEQ ID NO: 1160902 - RNA, 19 nt, Human
cugaauccucagcauaagc

SEQ ID NO: 1160903 - RNA, 22 nt, Human
cuguaaugugaaaaagaagauc

SEQ ID NO: 1160904 - RNA, 20 nt, Human
cuuccaagaccaccacgacc

SEQ ID NO: 1160905 - RNA, 20 nt, Human
gaaccaggguugucuuaugg

SEQ ID NO: 1160906 - RNA, 18 nt, Human
gaacuucuaaauccuuaa

SEQ ID NO: 1160907 - RNA, 22 nt, Human
gaagugaaaaaagauuuuuccc

SEQ ID NO: 1160908 - RNA, 20 nt, Human
gacagucuuuuuuuuuuuuu

SEQ ID NO: 1160909 - RNA, 24 nt, Human
gccagaacugggaaugccucuggg

SEQ ID NO: 1160910 - RNA, 21 nt, Human
uaaaaccaguuuguaauuggg

SEQ ID NO: 1160911 - RNA, 27 nt, Human
uaaacugguacacacuguucacaccua

SEQ ID NO: 1160912 - RNA, 23 nt, Human
uaacugaauccucagcauaagcc

SEQ ID NO: 1160913 - RNA, 25 nt, Human
uauaaagauuuagcauauauauaua

SEQ ID NO: 1160914 - RNA, 23 nt, Human
ucauccaaagucaucucuuuugg

SEQ ID NO: 1160915 - RNA, 19 nt, Human
uccaagaccaccacgaccu

SEQ ID NO: 1160916 - RNA, 24 nt, Human
uccacggcccccucgaccucuucc

SEQ ID NO: 1160917 - RNA, 19 nt, Human
uccccaguugugagauccg

SEQ ID NO: 1160918 - RNA, 20 nt, Human
uccccugccgccacguccug

SEQ ID NO: 1160919 - RNA, 26 nt, Human
uccugcugccacgguuugggcgccca

SEQ ID NO: 1160920 - RNA, 22 nt, Human
uccugggcggccaaggucucca

SEQ ID NO: 1160921 - RNA, 22 nt, Human
ucugggucauccacaucaggag

SEQ ID NO: 1160922 - RNA, 22 nt, Human
ugaaaaaagauuuuuccccaaa

SEQ ID NO: 1160923 - RNA, 21 nt, Human
ugaaaacaaaucccuucuucc

SEQ ID NO: 1160924 - RNA, 26 nt, Human
ugaaaacaaaucccuucuuccacugc

SEQ ID NO: 1160925 - RNA, 20 nt, Human
ugaauaugcaaagcauguau

SEQ ID NO: 1160926 - RNA, 22 nt, Human
ugaauccucagcauaagccucu

SEQ ID NO: 1160927 - RNA, 24 nt, Human
ugaauccucagcauaagccucuuc

SEQ ID NO: 1160928 - RNA, 21 nt, Human
ugaaugacagucuuuuuuuuu

SEQ ID NO: 1160929 - RNA, 26 nt, Human
ugaaugacagucuuuuuuuuuuuuua

SEQ ID NO: 1160930 - RNA, 20 nt, Human
ugaaugguaugaaugacagu

SEQ ID NO: 1160931 - RNA, 23 nt, Human
ugauuuaugaaaacaaaucccuu

SEQ ID NO: 1160932 - RNA, 22 nt, Human
ugcaagcagcaauacaaaagua

SEQ ID NO: 1160933 - RNA, 19 nt, Human
ugcagcgggccgcgccgag

SEQ ID NO: 1160934 - RNA, 18 nt, Human
ugccacgguuugggcgcc

SEQ ID NO: 1160935 - RNA, 26 nt, Human
ugguaugaaugacagucuuuuuuuuu

SEQ ID NO: 1160936 - RNA, 20 nt, Human
uguucacaccuauauuucaa

SEQ ID NO: 1160937 - RNA, 25 nt, Human
uuccccaguugugagauccgcuacc

SEQ ID NO: 1160938 - RNA, 21 nt, Human
uuuguaauugggggaacuucu

SEQ ID NO: 1160939 - RNA, 24 nt, Human
uuuuaccucuucaacaucauucuc

SEQ ID NO: 1160940 - RNA, 20 nt, Human
uuuucagugucugccacugg

SEQ ID NO: 1160941 - RNA, 22 nt, Human
aaaaacagaagaaagucaugac

SEQ ID NO: 1160942 - RNA, 26 nt, Human
aaaacucuguccagaacaucauuucc

SEQ ID NO: 1160943 - RNA, 19 nt, Human
aaacagaagaaagucauga

SEQ ID NO: 1160944 - RNA, 21 nt, Human
aaacagaagaaagucaugacc

SEQ ID NO: 1160945 - RNA, 20 nt, Human
aaagaccaaguaaauauuac

SEQ ID NO: 1160946 - RNA, 27 nt, Human
aacaauaaaagcuaaaaugugguccag

SEQ ID NO: 1160947 - RNA, 20 nt, Human
aacuacaaaaucugaacguu

SEQ ID NO: 1160948 - RNA, 22 nt, Human
aacuucugugugugagccuccc

SEQ ID NO: 1160949 - RNA, 24 nt, Human
aauaaaacaaaaaaguaccagucu

SEQ ID NO: 1160950 - RNA, 25 nt, Human
accacuuuuaucuuaagcuuagaau

SEQ ID NO: 1160951 - RNA, 22 nt, Human
acccccuucaaauccuuagaca

SEQ ID NO: 1160952 - RNA, 19 nt, Human
acuugugcugauuaaaaca

SEQ ID NO: 1160953 - RNA, 20 nt, Human
acuugugcugauuaaaacag

SEQ ID NO: 1160954 - RNA, 22 nt, Human
agaaaggcugaagaggcuugag

SEQ ID NO: 1160955 - RNA, 18 nt, Human
agaaggccaaaacugaag

SEQ ID NO: 1160956 - RNA, 21 nt, Human
agacuggggccggccugggga

SEQ ID NO: 1160957 - RNA, 18 nt, Human
agccgagcuaaaacucug

SEQ ID NO: 1160958 - RNA, 19 nt, Human
aggaaaaaaauaaguaugg

SEQ ID NO: 1160959 - RNA, 23 nt, Human
aggaaccagcucauuaggccucc

SEQ ID NO: 1160960 - RNA, 22 nt, Human
aggccaaaacugaagauugaga

SEQ ID NO: 1160961 - RNA, 24 nt, Human
aguggcucagcugccacaauggug

SEQ ID NO: 1160962 - RNA, 21 nt, Human
auggaugacaaggguccuugg

SEQ ID NO: 1160963 - RNA, 19 nt, Human
auugcacuuaucauucugc

SEQ ID NO: 1160964 - RNA, 24 nt, Human
auuugaauaucaaaaaugaaauug

SEQ ID NO: 1160965 - RNA, 19 nt, Human
caaagaaaugagcugugga

SEQ ID NO: 1160966 - RNA, 22 nt, Human
caacuagucaguaaacuauccc

SEQ ID NO: 1160967 - RNA, 27 nt, Human
caaguagauuuacaacuauugcacuua

SEQ ID NO: 1160968 - RNA, 18 nt, Human
caccaugugcuuacaaau

SEQ ID NO: 1160969 - RNA, 21 nt, Human
cacucugaauagaaguccgag

SEQ ID NO: 1160970 - RNA, 21 nt, Human
cagaaaauucuaguguaccau

SEQ ID NO: 1160971 - RNA, 20 nt, Human
cagaagaaagucaugaccau

SEQ ID NO: 1160972 - RNA, 23 nt, Human
cagauucagaaaaugugcuuugu

SEQ ID NO: 1160973 - RNA, 23 nt, Human
cagcagagacuggggccggccug

SEQ ID NO: 1160974 - RNA, 27 nt, Human
cagcagagacuggggccggccugggga

SEQ ID NO: 1160975 - RNA, 21 nt, Human
cagcauaugaaacucuucuca

SEQ ID NO: 1160976 - RNA, 20 nt, Human
cagcauuauuauuauuugua

SEQ ID NO: 1160977 - RNA, 20 nt, Human
caugugcauguuucuauugu

SEQ ID NO: 1160978 - RNA, 24 nt, Human
cauuacuuugaggcagaucguugu

SEQ ID NO: 1160979 - RNA, 24 nt, Human
cauucugauuauauuacaaagaaa

SEQ ID NO: 1160980 - RNA, 19 nt, Human
cauuucagggaugguuuug

SEQ ID NO: 1160981 - RNA, 23 nt, Human
ccacuuuuaucuuaagcuuagaa

SEQ ID NO: 1160982 - RNA, 19 nt, Human
ccauauccuuccugcuguu

SEQ ID NO: 1160983 - RNA, 22 nt, Human
cccaugcugccaugccaccaga

SEQ ID NO: 1160984 - RNA, 22 nt, Human
ccccaugcugccaugccaccag

SEQ ID NO: 1160985 - RNA, 20 nt, Human
cccccuucaaauccuuagac

SEQ ID NO: 1160986 - RNA, 20 nt, Human
ccuguuaacauaaaguauac

SEQ ID NO: 1160987 - RNA, 19 nt, Human
cgugcaacuucugugugug

SEQ ID NO: 1160988 - RNA, 20 nt, Human
cuaaaacucuguccagaaca

SEQ ID NO: 1160989 - RNA, 22 nt, Human
cuaaagccgagcuaaaacucug

SEQ ID NO: 1160990 - RNA, 24 nt, Human
cucaaaaacagaagaaagucauga

SEQ ID NO: 1160991 - RNA, 24 nt, Human
cucauuaggccuccaagagccugc

SEQ ID NO: 1160992 - RNA, 18 nt, Human
cuccaagagccugcugca

SEQ ID NO: 1160993 - RNA, 20 nt, Human
cucgguagaauccuagcuca

SEQ ID NO: 1160994 - RNA, 20 nt, Human
cugaacguuuucugcuuuca

SEQ ID NO: 1160995 - RNA, 20 nt, Human
cugcugggcugauuuucugu

SEQ ID NO: 1160996 - RNA, 20 nt, Human
cuggaauaaugcaaagaaaa

SEQ ID NO: 1160997 - RNA, 18 nt, Human
cugggcgccuucuaucuc

SEQ ID NO: 1160998 - RNA, 22 nt, Human
cugggguuuucuggacaauucg

SEQ ID NO: 1160999 - RNA, 24 nt, Human
cuguggcugugauccuaguuacau

SEQ ID NO: 1161000 - RNA, 23 nt, Human
cugugugugagccuccccaugcu

SEQ ID NO: 1161001 - RNA, 19 nt, Human
cuucuuugcagaacuccag

SEQ ID NO: 1161002 - RNA, 20 nt, Human
gaacacagacaagcuucucc

SEQ ID NO: 1161003 - RNA, 19 nt, Human
gacugcugagaaaggcuga

SEQ ID NO: 1161004 - RNA, 23 nt, Human
gagaaaaaauaaaacaaaaaagu

SEQ ID NO: 1161005 - RNA, 19 nt, Human
gagacugcugagaaaggcu

SEQ ID NO: 1161006 - RNA, 24 nt, Human
gaggugcuagcguuguccagcaga

SEQ ID NO: 1161007 - RNA, 21 nt, Human
gcugauuuucuguugacuuug

SEQ ID NO: 1161008 - RNA, 20 nt, Human
ggaaaaaaaaaacaauaaaa

SEQ ID NO: 1161009 - RNA, 20 nt, Human
ggacaaugggaaaaaaaaaa

SEQ ID NO: 1161010 - RNA, 24 nt, Human
ggacaauucgguucuucagaaaua

SEQ ID NO: 1161011 - RNA, 20 nt, Human
ggcaggggcugauuucacca

SEQ ID NO: 1161012 - RNA, 19 nt, Human
gggggugggguuccuggaa

SEQ ID NO: 1161013 - RNA, 19 nt, Human
guacuacuauaacaagaca

SEQ ID NO: 1161014 - RNA, 19 nt, Human
gugcuagcguuguccagca

SEQ ID NO: 1161015 - RNA, 23 nt, Human
guucuuuagacuaaguaagauac

SEQ ID NO: 1161016 - RNA, 23 nt, Human
guugucuauuucuucugaaaagu

SEQ ID NO: 1161017 - RNA, 23 nt, Human
uaaaaaaaauagugcaaaaacau

SEQ ID NO: 1161018 - RNA, 23 nt, Human
uaaaggcaaagauauauaccuca

SEQ ID NO: 1161019 - RNA, 20 nt, Human
uaaaggugccacauuuguug

SEQ ID NO: 1161020 - RNA, 24 nt, Human
uaacuuguucauaagaugguggga

SEQ ID NO: 1161021 - RNA, 23 nt, Human
uaagcuagagaaaaaauaaaaca

SEQ ID NO: 1161022 - RNA, 20 nt, Human
uaauaaagauagguuuucag

SEQ ID NO: 1161023 - RNA, 23 nt, Human
uagaaguccgagaagaucucuug

SEQ ID NO: 1161024 - RNA, 19 nt, Human
uagaauauuaaauguccuc

SEQ ID NO: 1161025 - RNA, 22 nt, Human
uagaauggggagauaacuuuag

SEQ ID NO: 1161026 - RNA, 18 nt, Human
uagacaaaugggaaucac

SEQ ID NO: 1161027 - RNA, 22 nt, Human
uagcaaauuuccccacuaaucu

SEQ ID NO: 1161028 - RNA, 23 nt, Human
uagcaaauuuccccacuaaucuu

SEQ ID NO: 1161029 - RNA, 24 nt, Human
uauuacaaagaaaugagcugugga

SEQ ID NO: 1161030 - RNA, 18 nt, Human
ucaaggugauaguucaag

SEQ ID NO: 1161031 - RNA, 24 nt, Human
ucaccaugugcuuacaaaugcucc

SEQ ID NO: 1161032 - RNA, 25 nt, Human
ucaguuaaaaaaaauagugcaaaaa

SEQ ID NO: 1161033 - RNA, 19 nt, Human
ucccaguccuggggguggg

SEQ ID NO: 1161034 - RNA, 20 nt, Human
uccuagcucauggguuucca

SEQ ID NO: 1161035 - RNA, 24 nt, Human
uccugcuguuguacaguuugcugc

SEQ ID NO: 1161036 - RNA, 20 nt, Human
uccugggggugggguuccug

SEQ ID NO: 1161037 - RNA, 23 nt, Human
ucuccuacggcugcugggcugau

SEQ ID NO: 1161038 - RNA, 25 nt, Human
ucuguggcuaaagccgagcuaaaac

SEQ ID NO: 1161039 - RNA, 18 nt, Human
ucuugguuuuggcacugg

SEQ ID NO: 1161040 - RNA, 19 nt, Human
ugaaggaaggauuugcucu

SEQ ID NO: 1161041 - RNA, 21 nt, Human
ugagaaaggcugaagaggcuu

SEQ ID NO: 1161042 - RNA, 23 nt, Human
ugagaaaggcugaagaggcuuga

SEQ ID NO: 1161043 - RNA, 18 nt, Human
ugagaggugccuguagug

SEQ ID NO: 1161044 - RNA, 21 nt, Human
ugaggcagaucguugucuauu

SEQ ID NO: 1161045 - RNA, 19 nt, Human
ugauaugcucaagcuguaa

SEQ ID NO: 1161046 - RNA, 25 nt, Human
ugcagggauaagcuagagaaaaaau

SEQ ID NO: 1161047 - RNA, 19 nt, Human
ugccaaggaacacagacaa

SEQ ID NO: 1161048 - RNA, 24 nt, Human
ugccaugccaccagaugcuuuccc

SEQ ID NO: 1161049 - RNA, 23 nt, Human
ugccuguaguguugcauuacuuu

SEQ ID NO: 1161050 - RNA, 20 nt, Human
ugccuuggaguagcagcagc

SEQ ID NO: 1161051 - RNA, 24 nt, Human
ugcuaaccauguccugauaguuac

SEQ ID NO: 1161052 - RNA, 18 nt, Human
uggaaagcaggaaagugg

SEQ ID NO: 1161053 - RNA, 21 nt, Human
uggaaagcaggaaagugguuu

SEQ ID NO: 1161054 - RNA, 22 nt, Human
uggaaagcaggaaagugguuuu

SEQ ID NO: 1161055 - RNA, 22 nt, Human
ugggagcucagcaggaaccagc

SEQ ID NO: 1161056 - RNA, 21 nt, Human
uggggaugacuccucuccuac

SEQ ID NO: 1161057 - RNA, 21 nt, Human
ugggggugggguuccuggaaa

SEQ ID NO: 1161058 - RNA, 23 nt, Human
ugggguuccuggaaaccacgagg

SEQ ID NO: 1161059 - RNA, 20 nt, Human
ugggguuuucuggacaauuc

SEQ ID NO: 1161060 - RNA, 18 nt, Human
uggugaucucugggcgcc

SEQ ID NO: 1161061 - RNA, 21 nt, Human
uguacaguuugcugcaaauga

SEQ ID NO: 1161062 - RNA, 23 nt, Human
uguaguauuaacuugaacuuggu

SEQ ID NO: 1161063 - RNA, 21 nt, Human
ugucuucaaccuauuuggcuc

SEQ ID NO: 1161064 - RNA, 21 nt, Human
ugugcagggauaagcuagaga

SEQ ID NO: 1161065 - RNA, 21 nt, Human
uguggagguuuggcacuguuu

SEQ ID NO: 1161066 - RNA, 21 nt, Human
uguucugguuuauuucguucg

SEQ ID NO: 1161067 - RNA, 22 nt, Human
uguuggaagauugccagacgag

SEQ ID NO: 1161068 - RNA, 23 nt, Human
uguuuggaugauugucuucaacc

SEQ ID NO: 1161069 - RNA, 22 nt, Human
uuaacuacaaaaucugaacguu

SEQ ID NO: 1161070 - RNA, 24 nt, Human
uuaauucacuugugcugauuaaaa

SEQ ID NO: 1161071 - RNA, 22 nt, Human
uuacaaagaaaugagcugugga

SEQ ID NO: 1161072 - RNA, 20 nt, Human
uucaagugaguucuugugcc

SEQ ID NO: 1161073 - RNA, 18 nt, Human
uuccuguggcugugaucc

SEQ ID NO: 1161074 - RNA, 20 nt, Human
uuggaugauugucuucaacc

SEQ ID NO: 1161075 - RNA, 20 nt, Human
uuucuguugacuuugcucuu

SEQ ID NO: 1161076 - RNA, 21 nt, Human
uuuuccucgguagaauccuag

SEQ ID NO: 1161077 - RNA, 25 nt, Human
uuuucuguugacuuugcucuuuaau

SEQ ID NO: 1161078 - RNA, 20 nt, Human
gacacuauuugaagucugaa

SEQ ID NO: 1161079 - RNA, 23 nt, Human
aaaauuccucacuaauaaaccaa

SEQ ID NO: 1161080 - RNA, 19 nt, Human
aagauucuuccacaaacuc

SEQ ID NO: 1161081 - RNA, 23 nt, Human
aagccuuaugaaauauuuuaguu

SEQ ID NO: 1161082 - RNA, 21 nt, Human
aaguacaaggaagcccaauga

SEQ ID NO: 1161083 - RNA, 23 nt, Human
acaaggaagcccaaugaacaaaa

SEQ ID NO: 1161084 - RNA, 20 nt, Human
acuaaguacaaggaagccca

SEQ ID NO: 1161085 - RNA, 22 nt, Human
agcccaaugaacaaaaacacgg

SEQ ID NO: 1161086 - RNA, 22 nt, Human
agcugagagaauacagagauga

SEQ ID NO: 1161087 - RNA, 21 nt, Human
aguaaccaaaacauuaagaaa

SEQ ID NO: 1161088 - RNA, 19 nt, Human
caaaaacacguuacucugc

SEQ ID NO: 1161089 - RNA, 24 nt, Human
caaggaagcccaaugaacaaaaac

SEQ ID NO: 1161090 - RNA, 21 nt, Human
cauucuguccuucuaacaaca

SEQ ID NO: 1161091 - RNA, 22 nt, Human
cccaaugaacaaaaacacguua

SEQ ID NO: 1161092 - RNA, 18 nt, Human
cuaacaacagcugagaga

SEQ ID NO: 1161093 - RNA, 24 nt, Human
cuaauaaaccaauuucugaaauuu

SEQ ID NO: 1161094 - RNA, 22 nt, Human
gaaauauuucucuuacugcaga

SEQ ID NO: 1161095 - RNA, 21 nt, Human
uaauuaagauaaaguuuaaca

SEQ ID NO: 1161096 - RNA, 21 nt, Human
uaguggacucaccucauguuu

SEQ ID NO: 1161097 - RNA, 19 nt, Human
ucuuccacaaacucuuuua

SEQ ID NO: 1161098 - RNA, 25 nt, Human
ucuuccacaaacucuuuuacaagag

SEQ ID NO: 1161099 - RNA, 23 nt, Human
ugaaaaaacuaaguacaaggaag

SEQ ID NO: 1161100 - RNA, 20 nt, Human
ugaaauauuuuaguuucagu

SEQ ID NO: 1161101 - RNA, 24 nt, Human
ugcccuuucuaguauacuaauuaa

SEQ ID NO: 1161102 - RNA, 22 nt, Human
ugccuucacuuuaaaacaguau

SEQ ID NO: 1161103 - RNA, 19 nt, Human
uggcaugguaguggacuca

SEQ ID NO: 1161104 - RNA, 21 nt, Human
uuaacaacuuaucuaaaucca

SEQ ID NO: 1161105 - RNA, 19 nt, Human
acagcaaaggaaauaaacc

SEQ ID NO: 1161106 - RNA, 22 nt, Human
accaaggagaucacaguuauga

SEQ ID NO: 1161107 - RNA, 23 nt, Human
aggagaucacaguuaugaucaca

SEQ ID NO: 1161108 - RNA, 21 nt, Human
aucacaguuaugaucacagca

SEQ ID NO: 1161109 - RNA, 23 nt, Human
caaaaucagcaccaaggagauca

SEQ ID NO: 1161110 - RNA, 23 nt, Human
cagauugaaauauaaaccaauau

SEQ ID NO: 1161111 - RNA, 25 nt, Human
caguugaccccaauauacuuaauau

SEQ ID NO: 1161112 - RNA, 22 nt, Human
cucucaauuucauuuccauuuc

SEQ ID NO: 1161113 - RNA, 18 nt, Human
gaucacaguuaugaucac

SEQ ID NO: 1161114 - RNA, 19 nt, Human
gccacaaucaaaaucagca

SEQ ID NO: 1161115 - RNA, 18 nt, Human
gccccgggagcgggcuuc

SEQ ID NO: 1161116 - RNA, 20 nt, Human
gccccgggagcgggcuuccg

SEQ ID NO: 1161117 - RNA, 24 nt, Human
gggcauggauaaccaucacaguug

SEQ ID NO: 1161118 - RNA, 22 nt, Human
uaaccaucacaguugaccccaa

SEQ ID NO: 1161119 - RNA, 24 nt, Human
ucaugcaaagaugugacuuccucu

SEQ ID NO: 1161120 - RNA, 20 nt, Human
ucucucaauuucauuuccau

SEQ ID NO: 1161121 - RNA, 21 nt, Human
ugaccccaauauacuuaauau

SEQ ID NO: 1161122 - RNA, 21 nt, Human
ugcaaagaugugacuuccucu

SEQ ID NO: 1161123 - RNA, 24 nt, Human
aaaacacuacacuggaaaagaaac

SEQ ID NO: 1161124 - RNA, 20 nt, Human
aaaaucauguaagccaauaa

SEQ ID NO: 1161125 - RNA, 19 nt, Human
aaccuguaauccacucaca

SEQ ID NO: 1161126 - RNA, 23 nt, Human
aaccuguaauccacucacaagaa

SEQ ID NO: 1161127 - RNA, 24 nt, Human
aaguagcacccacaaugcugggaa

SEQ ID NO: 1161128 - RNA, 21 nt, Human
aaguauauacaauaaaaagaa

SEQ ID NO: 1161129 - RNA, 22 nt, Human
aagugccaguuucucacaaauc

SEQ ID NO: 1161130 - RNA, 25 nt, Human
accaaaaucuucuaucacuuaacau

SEQ ID NO: 1161131 - RNA, 19 nt, Human
accgcgcugccgcugcugc

SEQ ID NO: 1161132 - RNA, 19 nt, Human
acugaauucaccagguggc

SEQ ID NO: 1161133 - RNA, 19 nt, Human
agaaauagugggguauaca

SEQ ID NO: 1161134 - RNA, 23 nt, Human
auaaagcauuacucauauuaaaa

SEQ ID NO: 1161135 - RNA, 22 nt, Human
cacaaaaggcauuuugggaaua

SEQ ID NO: 1161136 - RNA, 23 nt, Human
caccuaaaauaaugauuuucccc

SEQ ID NO: 1161137 - RNA, 19 nt, Human
cagaaaccgaggaccagag

SEQ ID NO: 1161138 - RNA, 21 nt, Human
caggucccgccuccccgggga

SEQ ID NO: 1161139 - RNA, 19 nt, Human
ccaaaaacacuacacugga

SEQ ID NO: 1161140 - RNA, 24 nt, Human
cccacaaugcugggaacccccacc

SEQ ID NO: 1161141 - RNA, 21 nt, Human
cccaggucccgccuccccggg

SEQ ID NO: 1161142 - RNA, 18 nt, Human
ccgccgccgcuccccggc

SEQ ID NO: 1161143 - RNA, 18 nt, Human
ccgccgccgcuccccggc

SEQ ID NO: 1161144 - RNA, 20 nt, Human
ccgccgccgcuccccggcuc

SEQ ID NO: 1161145 - RNA, 18 nt, Human
ccgcgcugccgcugcugc

SEQ ID NO: 1161146 - RNA, 22 nt, Human
ccggagcccgcggacgcugcgc

SEQ ID NO: 1161147 - RNA, 19 nt, Human
cgcccccgccccggagccc

SEQ ID NO: 1161148 - RNA, 23 nt, Human
cuguaauccacucacaagaauuc

SEQ ID NO: 1161149 - RNA, 26 nt, Human
cuuaaacuugacaauuaacugaaaau

SEQ ID NO: 1161150 - RNA, 28 nt, Human
cuuacugcagaaguuuaaaagguuuucc

SEQ ID NO: 1161151 - RNA, 24 nt, Human
cuuuccaaguaucauaugcacaaa

SEQ ID NO: 1161152 - RNA, 20 nt, Human
gaaagaccaaagaauaagag

SEQ ID NO: 1161153 - RNA, 18 nt, Human
gcauuuugggaauaagcu

SEQ ID NO: 1161154 - RNA, 18 nt, Human
gccgccgccgcuccccgg

SEQ ID NO: 1161155 - RNA, 24 nt, Human
gccuccccggggagggggcuucgc

SEQ ID NO: 1161156 - RNA, 20 nt, Human
ggaaaaagggaaaacuaaug

SEQ ID NO: 1161157 - RNA, 22 nt, Human
ggagcucccccaggucccgccu

SEQ ID NO: 1161158 - RNA, 18 nt, Human
ggcccggcucugcgcuca

SEQ ID NO: 1161159 - RNA, 21 nt, Human
uaaaacagccauuuucaaagc

SEQ ID NO: 1161160 - RNA, 22 nt, Human
uaaaacagccauuuucaaagca

SEQ ID NO: 1161161 - RNA, 21 nt, Human
uaaaacagcucaugucaacuc

SEQ ID NO: 1161162 - RNA, 21 nt, Human
uaaaggauauaauaucugaag

SEQ ID NO: 1161163 - RNA, 24 nt, Human
uaaccuuauaagguaaaacagcca

SEQ ID NO: 1161164 - RNA, 21 nt, Human
uaacugaaaauaauuaagcac

SEQ ID NO: 1161165 - RNA, 19 nt, Human
uaauaaaaauggcuccaca

SEQ ID NO: 1161166 - RNA, 23 nt, Human
uaaugggaaucuuagaaauagug

SEQ ID NO: 1161167 - RNA, 25 nt, Human
uacacuggaaaagaaacacaacauu

SEQ ID NO: 1161168 - RNA, 19 nt, Human
uacagauccuuaaguauac

SEQ ID NO: 1161169 - RNA, 26 nt, Human
uauuucaacacuaguuucccauucau

SEQ ID NO: 1161170 - RNA, 22 nt, Human
ucaccagguggccauaccuaau

SEQ ID NO: 1161171 - RNA, 21 nt, Human
ucccccaggucccgccucccc

SEQ ID NO: 1161172 - RNA, 21 nt, Human
ugagauacuauacuagcaugg

SEQ ID NO: 1161173 - RNA, 18 nt, Human
ugauagaaaaugagaagu

SEQ ID NO: 1161174 - RNA, 20 nt, Human
ugccaguuucucacaaauca

SEQ ID NO: 1161175 - RNA, 19 nt, Human
ugcccagggcccggcucug

SEQ ID NO: 1161176 - RNA, 23 nt, Human
uguugucuaaucuuguacuuagu

SEQ ID NO: 1161177 - RNA, 22 nt, Human
uucccggccgccgccgcucccc

SEQ ID NO: 1161178 - RNA, 24 nt, Human
uucuauggccuugcaaguagcacc

SEQ ID NO: 1161179 - RNA, 22 nt, Human
uucucucaacuuacugcagaag

SEQ ID NO: 1161180 - RNA, 20 nt, Human
uugggaauaagcuucaucau

SEQ ID NO: 1161181 - RNA, 21 nt, Human
uuuacugagccuccugggggg

SEQ ID NO: 1161182 - RNA, 18 nt, Human
aaauagccacuacagagc

SEQ ID NO: 1161183 - RNA, 20 nt, Human
aaauauauagucaucaaaca

SEQ ID NO: 1161184 - RNA, 18 nt, Human
agaaaacaguucucuggu

SEQ ID NO: 1161185 - RNA, 21 nt, Human
auauuuugaauaaaaguagca

SEQ ID NO: 1161186 - RNA, 23 nt, Human
augaaaaagaaacauguagcccu

SEQ ID NO: 1161187 - RNA, 18 nt, Human
auguuugcaaaaccagaa

SEQ ID NO: 1161188 - RNA, 19 nt, Human
auuacaauuagguauuuuu

SEQ ID NO: 1161189 - RNA, 22 nt, Human
caacaauaaauagccacuacag

SEQ ID NO: 1161190 - RNA, 18 nt, Human
caaugugguaaauacauu

SEQ ID NO: 1161191 - RNA, 19 nt, Human
caguucucugguuuagccu

SEQ ID NO: 1161192 - RNA, 23 nt, Human
cauaaaaauuacaguaugacuac

SEQ ID NO: 1161193 - RNA, 22 nt, Human
cauguuugcaaaaccagaaaac

SEQ ID NO: 1161194 - RNA, 21 nt, Human
ccaaauauauagucaucaaac

SEQ ID NO: 1161195 - RNA, 20 nt, Human
ccaggaugaugaacgcaaug

SEQ ID NO: 1161196 - RNA, 24 nt, Human
ccaggaugaugaacgcaaugaaga

SEQ ID NO: 1161197 - RNA, 21 nt, Human
ccccaacuguccaacuuucac

SEQ ID NO: 1161198 - RNA, 22 nt, Human
cccuuaaguuuaccuaauaguu

SEQ ID NO: 1161199 - RNA, 19 nt, Human
ccuaucauaacucaaugaa

SEQ ID NO: 1161200 - RNA, 21 nt, Human
cuccuccaugacacugaucag

SEQ ID NO: 1161201 - RNA, 20 nt, Human
cugcaauaaauacucccucc

SEQ ID NO: 1161202 - RNA, 22 nt, Human
cugcauauuuugaauaaaagua

SEQ ID NO: 1161203 - RNA, 20 nt, Human
gaugaugaacgcaaugaaga

SEQ ID NO: 1161204 - RNA, 18 nt, Human
gcaaugggagcagggcuc

SEQ ID NO: 1161205 - RNA, 25 nt, Human
gcauguggcaaugggagcagggcuc

SEQ ID NO: 1161206 - RNA, 24 nt, Human
gcgagggcuccuugggucucaaac

SEQ ID NO: 1161207 - RNA, 19 nt, Human
gcuccuugggucucaaaca

SEQ ID NO: 1161208 - RNA, 22 nt, Human
uaaauagccacuacagagccca

SEQ ID NO: 1161209 - RNA, 19 nt, Human
uaacucaaugaacaacuua

SEQ ID NO: 1161210 - RNA, 22 nt, Human
uaagcaauauagcugaaugucc

SEQ ID NO: 1161211 - RNA, 22 nt, Human
uaagccccaacuguccaacuuu

SEQ ID NO: 1161212 - RNA, 19 nt, Human
uaccuaauaguuaauuuuu

SEQ ID NO: 1161213 - RNA, 21 nt, Human
uagauuuuucacugcccccuu

SEQ ID NO: 1161214 - RNA, 22 nt, Human
uagcugcggagugagaagcgga

SEQ ID NO: 1161215 - RNA, 24 nt, Human
uauaugaaaaagaaacauguagcc

SEQ ID NO: 1161216 - RNA, 22 nt, Human
uccaacaagauauaugcccaaa

SEQ ID NO: 1161217 - RNA, 23 nt, Human
uccaacaagauauaugcccaaau

SEQ ID NO: 1161218 - RNA, 20 nt, Human
ucugcaauaaauacucccuc

SEQ ID NO: 1161219 - RNA, 21 nt, Human
ucugugauuggagacaggaac

SEQ ID NO: 1161220 - RNA, 21 nt, Human
ugagugggggaaaugauuuua

SEQ ID NO: 1161221 - RNA, 23 nt, Human
ugagugggggaaaugauuuuaca

SEQ ID NO: 1161222 - RNA, 20 nt, Human
ugggucucaaacaggugcaa

SEQ ID NO: 1161223 - RNA, 21 nt, Human
uguuuuauuuauucuaaucca

SEQ ID NO: 1161224 - RNA, 19 nt, Human
uuaaaacuuuaaacuccuc

SEQ ID NO: 1161225 - RNA, 24 nt, Human
acaaagcuaaaaucaaaacagaaa

SEQ ID NO: 1161226 - RNA, 18 nt, Human
cauuuguguucuguugga

SEQ ID NO: 1161227 - RNA, 19 nt, Human
ccggccucuguuaccaccu

SEQ ID NO: 1161228 - RNA, 21 nt, Human
cucucugaaaccuucacacuc

SEQ ID NO: 1161229 - RNA, 21 nt, Human
gaugaaucacucucugaaacc

SEQ ID NO: 1161230 - RNA, 18 nt, Human
uaaccccacacuuguugc

SEQ ID NO: 1161231 - RNA, 22 nt, Human
uacaaagcuaaaaucaaaacag

SEQ ID NO: 1161232 - RNA, 25 nt, Human
uccccagagaaacagaucauauaca

SEQ ID NO: 1161233 - RNA, 20 nt, Human
ucccuugacaccggccucug

SEQ ID NO: 1161234 - RNA, 24 nt, Human
ucuguuggaaaacaugaggcuuga

SEQ ID NO: 1161235 - RNA, 23 nt, Human
uguuaccaccuucguucucccug

SEQ ID NO: 1161236 - RNA, 27 nt, Human
uucacacucccuugacaccggccucug

SEQ ID NO: 1161237 - RNA, 23 nt, Human
aacacaugcaggcuaccagcacu

SEQ ID NO: 1161238 - RNA, 19 nt, Human
aagaucacaaacagagggu

SEQ ID NO: 1161239 - RNA, 21 nt, Human
aaucaaaacucauacccacaa

SEQ ID NO: 1161240 - RNA, 21 nt, Human
acaguuccaaguagccuggca

SEQ ID NO: 1161241 - RNA, 21 nt, Human
acuacggugcaggaacuucuu

SEQ ID NO: 1161242 - RNA, 19 nt, Human
agcuagaacaaugcagucc

SEQ ID NO: 1161243 - RNA, 23 nt, Human
aggaagaucacaaacagaggguu

SEQ ID NO: 1161244 - RNA, 21 nt, Human
aggcuaccagcacugccccag

SEQ ID NO: 1161245 - RNA, 21 nt, Human
agugguucguuuuugcccugg

SEQ ID NO: 1161246 - RNA, 21 nt, Human
augucuaacuucucgagcaac

SEQ ID NO: 1161247 - RNA, 21 nt, Human
caagagagaaacaaagccuca

SEQ ID NO: 1161248 - RNA, 20 nt, Human
cacagcaauccaagcaaagu

SEQ ID NO: 1161249 - RNA, 21 nt, Human
cacuaccccucccuuccuugc

SEQ ID NO: 1161250 - RNA, 22 nt, Human
cacuugccaacaggcuuuuauu

SEQ ID NO: 1161251 - RNA, 21 nt, Human
caggaagaucacaaacagagg

SEQ ID NO: 1161252 - RNA, 24 nt, Human
ccaacacuugccaacaggcuuuua

SEQ ID NO: 1161253 - RNA, 18 nt, Human
ccaccuucccacuacagu

SEQ ID NO: 1161254 - RNA, 18 nt, Human
ccagcacugccccagaca

SEQ ID NO: 1161255 - RNA, 21 nt, Human
cccuccaaucaaccaccuucc

SEQ ID NO: 1161256 - RNA, 24 nt, Human
ccuggcagaccugcccagugggcc

SEQ ID NO: 1161257 - RNA, 24 nt, Human
cgagcaacuucaaauaaaaagagu

SEQ ID NO: 1161258 - RNA, 23 nt, Human
cuuaaacuuacagaaaagaaagc

SEQ ID NO: 1161259 - RNA, 21 nt, Human
cuuuuuuuuuuuuuuuuuaag

SEQ ID NO: 1161260 - RNA, 28 nt, Human
gagcaacuucaaauaaaaagggaacgcc

SEQ ID NO: 1161261 - RNA, 20 nt, Human
gccucugacacgcucccuga

SEQ ID NO: 1161262 - RNA, 22 nt, Human
gggccagcuagaacaaugcagu

SEQ ID NO: 1161263 - RNA, 24 nt, Human
gugggccagcuagaacaaugcagu

SEQ ID NO: 1161264 - RNA, 21 nt, Human
guggucggccucugacacgcu

SEQ ID NO: 1161265 - RNA, 20 nt, Human
gugguucguuuuugcccugg

SEQ ID NO: 1161266 - RNA, 23 nt, Human
guuucagagcaagagagaaacaa

SEQ ID NO: 1161267 - RNA, 20 nt, Human
uaaacuuacagaaaagaaag

SEQ ID NO: 1161268 - RNA, 19 nt, Human
uaaauggaaacgaucacua

SEQ ID NO: 1161269 - RNA, 24 nt, Human
uaaggaacaucaaauuuuccccag

SEQ ID NO: 1161270 - RNA, 22 nt, Human
uaaggauaaauggaaacgauca

SEQ ID NO: 1161271 - RNA, 26 nt, Human
ucaaaacucauacccacaaaguccac

SEQ ID NO: 1161272 - RNA, 27 nt, Human
ucagagcaagagagaaacaaagccuca

SEQ ID NO: 1161273 - RNA, 19 nt, Human
uccaaucaaccaccuuccc

SEQ ID NO: 1161274 - RNA, 21 nt, Human
ucuccacaguacacguggucg

SEQ ID NO: 1161275 - RNA, 23 nt, Human
ucucgagcaacuucaaauaaaaa

SEQ ID NO: 1161276 - RNA, 24 nt, Human
ugaacuuguagguggaaucaggaa

SEQ ID NO: 1161277 - RNA, 21 nt, Human
ugcccuggaguucuuacaaag

SEQ ID NO: 1161278 - RNA, 22 nt, Human
ugcccuggaguucuuacaaagu

SEQ ID NO: 1161279 - RNA, 21 nt, Human
ugggaccagguaucuuguacu

SEQ ID NO: 1161280 - RNA, 21 nt, Human
ugggucuagguuuuucugcua

SEQ ID NO: 1161281 - RNA, 27 nt, Human
uguucccuccucaguuauauaauccua

SEQ ID NO: 1161282 - RNA, 21 nt, Human
uuacaauuuagacucccuggg

SEQ ID NO: 1161283 - RNA, 26 nt, Human
uucagagcaagagagaaacaaagccu

SEQ ID NO: 1161284 - RNA, 24 nt, Human
uuccaaguagccuggcagaccugc

SEQ ID NO: 1161285 - RNA, 21 nt, Human
uucgcagacuugggaaacuac

SEQ ID NO: 1161286 - RNA, 21 nt, Human
uucuuuggaggggagaaaacc

SEQ ID NO: 1161287 - RNA, 19 nt, Human
uugcaauguucccuccuca

SEQ ID NO: 1161288 - RNA, 19 nt, Human
uugggcuccgggagacuuu

SEQ ID NO: 1161289 - RNA, 22 nt, Human
aaaaacagcaacgaccagccca

SEQ ID NO: 1161290 - RNA, 24 nt, Human
aaaaagcccuaucuaacauagucc

SEQ ID NO: 1161291 - RNA, 19 nt, Human
aaccugaaggucacuguag

SEQ ID NO: 1161292 - RNA, 21 nt, Human
aagaaucuguccaaaguugcu

SEQ ID NO: 1161293 - RNA, 18 nt, Human
aagucaggcacaagggga

SEQ ID NO: 1161294 - RNA, 20 nt, Human
accuggggugccuggcccag

SEQ ID NO: 1161295 - RNA, 26 nt, Human
accuugcuuuccucugguuccucagc

SEQ ID NO: 1161296 - RNA, 22 nt, Human
agaagagacaagagacagaaag

SEQ ID NO: 1161297 - RNA, 24 nt, Human
agaauccuucaugggcagcuacuc

SEQ ID NO: 1161298 - RNA, 19 nt, Human
agacaagagacagaaaggg

SEQ ID NO: 1161299 - RNA, 21 nt, Human
agaggcuugggggcccaggac

SEQ ID NO: 1161300 - RNA, 24 nt, Human
agagugcugggaaagcuguggcuc

SEQ ID NO: 1161301 - RNA, 21 nt, Human
agcagaaacugaggcugagag

SEQ ID NO: 1161302 - RNA, 19 nt, Human
agccgcugagaaggcagug

SEQ ID NO: 1161303 - RNA, 19 nt, Human
agcucgugaguccaggccc

SEQ ID NO: 1161304 - RNA, 22 nt, Human
agcucuggcuguggagaaauuc

SEQ ID NO: 1161305 - RNA, 21 nt, Human
aggaacaaagccuuguaaacg

SEQ ID NO: 1161306 - RNA, 22 nt, Human
aggauuucagcaacuccagccc

SEQ ID NO: 1161307 - RNA, 21 nt, Human
auaaagagcagcccuugcuga

SEQ ID NO: 1161308 - RNA, 23 nt, Human
caagagacagaaagggccuggug

SEQ ID NO: 1161309 - RNA, 21 nt, Human
caccugcccuucccucagccu

SEQ ID NO: 1161310 - RNA, 23 nt, Human
cagaagcagaaacugaggcugag

SEQ ID NO: 1161311 - RNA, 20 nt, Human
cagccaccgcuccccuucca

SEQ ID NO: 1161312 - RNA, 23 nt, Human
caggagaauuaaacugagccuua

SEQ ID NO: 1161313 - RNA, 21 nt, Human
caggcuccaaggggaaggagg

SEQ ID NO: 1161314 - RNA, 22 nt, Human
cauacugcagaggcuugggggc

SEQ ID NO: 1161315 - RNA, 19 nt, Human
caucuccacgaguaaccuc

SEQ ID NO: 1161316 - RNA, 20 nt, Human
caugaagcugggaagaggug

SEQ ID NO: 1161317 - RNA, 18 nt, Human
caugguguugcugaccac

SEQ ID NO: 1161318 - RNA, 23 nt, Human
cauucugugagcuccagcaguag

SEQ ID NO: 1161319 - RNA, 19 nt, Human
ccaccgcuccccuuccagg

SEQ ID NO: 1161320 - RNA, 18 nt, Human
ccagggaugaccauucug

SEQ ID NO: 1161321 - RNA, 22 nt, Human
cccugguggccaccugcccuuc

SEQ ID NO: 1161322 - RNA, 27 nt, Human
ccucucuggacaaaaucaaacaagggu

SEQ ID NO: 1161323 - RNA, 19 nt, Human
ccugcugggcacccagccc

SEQ ID NO: 1161324 - RNA, 20 nt, Human
ccuggggugccuggcccagc

SEQ ID NO: 1161325 - RNA, 24 nt, Human
ccuguacaaagaacuuguguucca

SEQ ID NO: 1161326 - RNA, 18 nt, Human
ccuuguaaacgcacuugg

SEQ ID NO: 1161327 - RNA, 23 nt, Human
ccuuuuugcccacaggacugggc

SEQ ID NO: 1161328 - RNA, 24 nt, Human
cgaguaaccucccucucuuuuucu

SEQ ID NO: 1161329 - RNA, 21 nt, Human
cgcuugaggugguuaacuuag

SEQ ID NO: 1161330 - RNA, 18 nt, Human
cuaaguaugauggggagg

SEQ ID NO: 1161331 - RNA, 30 nt, Human
cuauuggagccgguuaguauguuggccccg

SEQ ID NO: 1161332 - RNA, 21 nt, Human
cucgugaguccaggcccuuug

SEQ ID NO: 1161333 - RNA, 20 nt, Human
cucuucaccaacaaaucuga

SEQ ID NO: 1161334 - RNA, 19 nt, Human
cugcugggcacccagcccu

SEQ ID NO: 1161335 - RNA, 24 nt, Human
cugggcacccagcccuccuucuga

SEQ ID NO: 1161336 - RNA, 21 nt, Human
cugguuccucagccaccgcuc

SEQ ID NO: 1161337 - RNA, 18 nt, Human
cugugagcuccagcagua

SEQ ID NO: 1161338 - RNA, 21 nt, Human
cuguugccugcugggcaccca

SEQ ID NO: 1161339 - RNA, 20 nt, Human
gaagaccugaguuaugaagg

SEQ ID NO: 1161340 - RNA, 20 nt, Human
gacaaaaucaaacaaggguu

SEQ ID NO: 1161341 - RNA, 18 nt, Human
gagagcagcuggcagcca

SEQ ID NO: 1161342 - RNA, 20 nt, Human
gagagcagcuggcagccaug

SEQ ID NO: 1161343 - RNA, 22 nt, Human
gagcagcccuugcugagucccg

SEQ ID NO: 1161344 - RNA, 19 nt, Human
gaggccacaaaagagacag

SEQ ID NO: 1161345 - RNA, 24 nt, Human
gaguacuuuuucugacaucuccac

SEQ ID NO: 1161346 - RNA, 21 nt, Human
gccauugugaggccacaaaag

SEQ ID NO: 1161347 - RNA, 20 nt, Human
gcugggaaagcuguggcucu

SEQ ID NO: 1161348 - RNA, 20 nt, Human
ggaagaggugcucaugagag

SEQ ID NO: 1161349 - RNA, 23 nt, Human
ggaugaccauucugugagcucca

SEQ ID NO: 1161350 - RNA, 18 nt, Human
ggccugguggguuccaag

SEQ ID NO: 1161351 - RNA, 21 nt, Human
ggucacuguaguuaucucccu

SEQ ID NO: 1161352 - RNA, 24 nt, Human
gucuuugggggcucauggauguuu

SEQ ID NO: 1161353 - RNA, 19 nt, Human
uaaaaacagcaacgaccag

SEQ ID NO: 1161354 - RNA, 19 nt, Human
uaacaaaugaaaaauguaa

SEQ ID NO: 1161355 - RNA, 20 nt, Human
uaacuggaauggaaggaaga

SEQ ID NO: 1161356 - RNA, 19 nt, Human
uacauuuuccucuuuuccu

SEQ ID NO: 1161357 - RNA, 19 nt, Human
uaucucccuuuacagaagc

SEQ ID NO: 1161358 - RNA, 25 nt, Human
uaucucccuuuacagaagcagaaac

SEQ ID NO: 1161359 - RNA, 21 nt, Human
ucacuuguuucuucuauggug

SEQ ID NO: 1161360 - RNA, 20 nt, Human
ucaggcacaaggggaguacu

SEQ ID NO: 1161361 - RNA, 21 nt, Human
uccacgaguaaccucccucuc

SEQ ID NO: 1161362 - RNA, 20 nt, Human
ucccucucuuuuucucuggu

SEQ ID NO: 1161363 - RNA, 19 nt, Human
ucuaacauaguccccuuga

SEQ ID NO: 1161364 - RNA, 24 nt, Human
ucucagagaccucaagcugggagg

SEQ ID NO: 1161365 - RNA, 21 nt, Human
ucucugguugugggaccuggu

SEQ ID NO: 1161366 - RNA, 21 nt, Human
ucugccauugugaggccacaa

SEQ ID NO: 1161367 - RNA, 20 nt, Human
ucuuccucuuccuccacuuc

SEQ ID NO: 1161368 - RNA, 18 nt, Human
ucuuuuccccugcugcuc

SEQ ID NO: 1161369 - RNA, 19 nt, Human
ugaaaguccauaaacugcc

SEQ ID NO: 1161370 - RNA, 23 nt, Human
ugaagucccacagugaagccucc

SEQ ID NO: 1161371 - RNA, 26 nt, Human
ugaggcugagaguucaagaaucuguc

SEQ ID NO: 1161372 - RNA, 20 nt, Human
ugagucccgcuugagguggu

SEQ ID NO: 1161373 - RNA, 19 nt, Human
ugcaucucagagaccucaa

SEQ ID NO: 1161374 - RNA, 23 nt, Human
ugccauaaaaagcccuaucuaac

SEQ ID NO: 1161375 - RNA, 22 nt, Human
ugcuguugccugcugggcaccc

SEQ ID NO: 1161376 - RNA, 19 nt, Human
uggaaaguauguccaggaa

SEQ ID NO: 1161377 - RNA, 18 nt, Human
uggaauggaaggaagagc

SEQ ID NO: 1161378 - RNA, 18 nt, Human
uggcaguugggaucauaa

SEQ ID NO: 1161379 - RNA, 18 nt, Human
uggccuccgccuuuguga

SEQ ID NO: 1161380 - RNA, 18 nt, Human
ugggaagaggugcucaug

SEQ ID NO: 1161381 - RNA, 23 nt, Human
ugggggcccaggacuggaagauc

SEQ ID NO: 1161382 - RNA, 22 nt, Human
ugugaggccacaaaagagacag

SEQ ID NO: 1161383 - RNA, 18 nt, Human
ugugaggggucacccggg

SEQ ID NO: 1161384 - RNA, 24 nt, Human
ugugaggggucacccgggauuugu

SEQ ID NO: 1161385 - RNA, 21 nt, Human
ugugggaccuggugugcaucu

SEQ ID NO: 1161386 - RNA, 23 nt, Human
uuaaacugagccuuagagagaag

SEQ ID NO: 1161387 - RNA, 19 nt, Human
uuacacaaggagcccguau

SEQ ID NO: 1161388 - RNA, 24 nt, Human
uuagagcucuggcuguggagaaau

SEQ ID NO: 1161389 - RNA, 19 nt, Human
uucagcaacuccagcccug

SEQ ID NO: 1161390 - RNA, 19 nt, Human
uuccucagccaccgcuccc

SEQ ID NO: 1161391 - RNA, 22 nt, Human
uuccucagccaccgcuccccuu

SEQ ID NO: 1161392 - RNA, 24 nt, Human
uugcugagucccgcuugagguggu

SEQ ID NO: 1161393 - RNA, 24 nt, Human
uuggcaucuucaagauaaccugaa

SEQ ID NO: 1161394 - RNA, 22 nt, Human
uuguguugcaucucagagaccu

SEQ ID NO: 1161395 - RNA, 27 nt, Human
uuuauauuaacaaaugaaaaauguaag

SEQ ID NO: 1161396 - RNA, 20 nt, Human
uuucuuuuccccugcugcuc

SEQ ID NO: 1161397 - RNA, 24 nt, Human
uuugccaggauuucagcaacucca

SEQ ID NO: 1161398 - RNA, 24 nt, Human
uuuucucugguugugggaccuggu

SEQ ID NO: 1161399 - RNA, 19 nt, Human
acagcagauuccaucccuc

SEQ ID NO: 1161400 - RNA, 18 nt, Human
agagguugcggugagccg

SEQ ID NO: 1161401 - RNA, 23 nt, Human
agagguugcggugagccgagauc

SEQ ID NO: 1161402 - RNA, 24 nt, Human
agagguugcggugagccgagauca

SEQ ID NO: 1161403 - RNA, 24 nt, Human
aggcagagguugcggugagccgag

SEQ ID NO: 1161404 - RNA, 23 nt, Human
aucaugccacugcaugccagccu

SEQ ID NO: 1161405 - RNA, 21 nt, Human
cacugcaugccagccucuuua

SEQ ID NO: 1161406 - RNA, 23 nt, Human
cacugcaugccagccucuuuagu

SEQ ID NO: 1161407 - RNA, 24 nt, Human
cagcuacucaggaggcugaggcag

SEQ ID NO: 1161408 - RNA, 24 nt, Human
caggaggcugaggcaggauaauca

SEQ ID NO: 1161409 - RNA, 24 nt, Human
ccacugcaugccagccucuuuagu

SEQ ID NO: 1161410 - RNA, 19 nt, Human
ccaggcccuguaauccagc

SEQ ID NO: 1161411 - RNA, 22 nt, Human
cccacauacucuuguucauuua

SEQ ID NO: 1161412 - RNA, 23 nt, Human
cccuguaauccagcuacucagga

SEQ ID NO: 1161413 - RNA, 21 nt, Human
ccugggaggcagagguugcgg

SEQ ID NO: 1161414 - RNA, 24 nt, Human
cgagaucaugccacugcaugccag

SEQ ID NO: 1161415 - RNA, 24 nt, Human
cuccugccaugggccaggcccugu

SEQ ID NO: 1161416 - RNA, 25 nt, Human
cuggcccuucugggcugcaugggca

SEQ ID NO: 1161417 - RNA, 22 nt, Human
gaaacuggcccuucugggcugc

SEQ ID NO: 1161418 - RNA, 20 nt, Human
gccgagaucaugccacugca

SEQ ID NO: 1161419 - RNA, 24 nt, Human
ggcccuguaauccagcuacucagg

SEQ ID NO: 1161420 - RNA, 27 nt, Human
gggcaggaggcaggagcugaaguuuuc

SEQ ID NO: 1161421 - RNA, 25 nt, Human
gucacaauugaguuuccuuuaagag

SEQ ID NO: 1161422 - RNA, 20 nt, Human
guguuuugguucuucuucug

SEQ ID NO: 1161423 - RNA, 24 nt, Human
guugcggugagccgagaucaugcc

SEQ ID NO: 1161424 - RNA, 19 nt, Human
uaagagcagaucagaugug

SEQ ID NO: 1161425 - RNA, 19 nt, Human
uaagagcagaucagaugug

SEQ ID NO: 1161426 - RNA, 19 nt, Human
uaggaacauaacccaaaag

SEQ ID NO: 1161427 - RNA, 23 nt, Human
ugaaacuggcccuucugggcugc

SEQ ID NO: 1161428 - RNA, 22 nt, Human
ugagccgagaucaugccacugc

SEQ ID NO: 1161429 - RNA, 20 nt, Human
ugcaugggcaggaggcagga

SEQ ID NO: 1161430 - RNA, 19 nt, Human
ugccagccucuuuaguuuc

SEQ ID NO: 1161431 - RNA, 22 nt, Human
ugcuugucacaauugaguuucc

SEQ ID NO: 1161432 - RNA, 24 nt, Human
ugggaggcagagguugcggugagc

SEQ ID NO: 1161433 - RNA, 21 nt, Human
ugggcugcaugggcaggaggc

SEQ ID NO: 1161434 - RNA, 21 nt, Human
uucacugaccacccagcuguu

SEQ ID NO: 1161435 - RNA, 24 nt, Human
uugauucuucucauucccacauac

SEQ ID NO: 1161436 - RNA, 18 nt, Human
uugcggugagccgagauc

SEQ ID NO: 1161437 - RNA, 20 nt, Human
uugcggugagccgagaucau

SEQ ID NO: 1161438 - RNA, 21 nt, Human
uugcggugagccgagaucaug

SEQ ID NO: 1161439 - RNA, 26 nt, Human
uuggugagacagcagauuccaucccu

SEQ ID NO: 1161440 - RNA, 18 nt, Human
uuuaucugacauuuccug

SEQ ID NO: 1161441 - RNA, 19 nt, Human
aggccggcggguggaggcg

SEQ ID NO: 1161442 - RNA, 26 nt, Human
ccccagcacacccgcccugggaagcc

SEQ ID NO: 1161443 - RNA, 18 nt, Human
cgcccugggaagccgccu

SEQ ID NO: 1161444 - RNA, 21 nt, Human
cgcggugccgcgugggucccc

SEQ ID NO: 1161445 - RNA, 20 nt, Human
gagcgcgcagagcccccucc

SEQ ID NO: 1161446 - RNA, 20 nt, Human
gcccuggccaggcugcggga

SEQ ID NO: 1161447 - RNA, 26 nt, Human
ggguggaggcggcggauaaugccagg

SEQ ID NO: 1161448 - RNA, 20 nt, Human
uccccgcggugccgcguggg

SEQ ID NO: 1161449 - RNA, 19 nt, Human
uggccaggcugcgggaggc

SEQ ID NO: 1161450 - RNA, 18 nt, Human
aaaauuagcugggcgugg

SEQ ID NO: 1161451 - RNA, 24 nt, Human
aaaucaauuuuaguuucuucaugg

SEQ ID NO: 1161452 - RNA, 23 nt, Human
aacucuugucuuaaaaaaaaaga

SEQ ID NO: 1161453 - RNA, 21 nt, Human
aagcuuuuacaaacacagucu

SEQ ID NO: 1161454 - RNA, 19 nt, Human
aauggguuauguuacaggg

SEQ ID NO: 1161455 - RNA, 19 nt, Human
aauugcuugaacccggagg

SEQ ID NO: 1161456 - RNA, 23 nt, Human
aauuuuuauuucagauucaggga

SEQ ID NO: 1161457 - RNA, 21 nt, Human
acagacacaaaauagguuaac

SEQ ID NO: 1161458 - RNA, 24 nt, Human
accccgccucuacuaaaaauacaa

SEQ ID NO: 1161459 - RNA, 24 nt, Human
acugcacuccagccugggcaacag

SEQ ID NO: 1161460 - RNA, 24 nt, Human
acugcacuccagccugggcaacag

SEQ ID NO: 1161461 - RNA, 18 nt, Human
agagguuguagugagcug

SEQ ID NO: 1161462 - RNA, 22 nt, Human
agagguuguagugagcugaaau

SEQ ID NO: 1161463 - RNA, 24 nt, Human
agagguuguagugagcugaaauug

SEQ ID NO: 1161464 - RNA, 24 nt, Human
agcacuuugggaggccaagguggg

SEQ ID NO: 1161465 - RNA, 24 nt, Human
agccugggcaacagagagaaacuc

SEQ ID NO: 1161466 - RNA, 23 nt, Human
agcugggcgugguugugugugcc

SEQ ID NO: 1161467 - RNA, 22 nt, Human
aggcagagguuguagugagcug

SEQ ID NO: 1161468 - RNA, 24 nt, Human
aggcaggagaauugcuugaacccg

SEQ ID NO: 1161469 - RNA, 20 nt, Human
aggccaagguggguggauca

SEQ ID NO: 1161470 - RNA, 21 nt, Human
aggcugaggcaggagaauugc

SEQ ID NO: 1161471 - RNA, 24 nt, Human
aggcugaggcaggagaauugcuug

SEQ ID NO: 1161472 - RNA, 23 nt, Human
agguauguaugaucuuguuuauu

SEQ ID NO: 1161473 - RNA, 18 nt, Human
aggucagccuacagacac

SEQ ID NO: 1161474 - RNA, 24 nt, Human
aguggcucacaucuguaaucucag

SEQ ID NO: 1161475 - RNA, 21 nt, Human
aguggcucuucugcuuucuuu

SEQ ID NO: 1161476 - RNA, 24 nt, Human
auugcgccacugcacuccagccug

SEQ ID NO: 1161477 - RNA, 20 nt, Human
auuuuagaccaguuucccuc

SEQ ID NO: 1161478 - RNA, 24 nt, Human
auuuuugucaaaguuuaaacacug

SEQ ID NO: 1161479 - RNA, 18 nt, Human
caaaaugauucuugcuaa

SEQ ID NO: 1161480 - RNA, 23 nt, Human
caaauaaaaugcagagaucaaaa

SEQ ID NO: 1161481 - RNA, 22 nt, Human
caagguggguggaucaugaagu

SEQ ID NO: 1161482 - RNA, 24 nt, Human
caagguggguggaucaugaaguca

SEQ ID NO: 1161483 - RNA, 22 nt, Human
cacaaaaugauucuugcuaaua

SEQ ID NO: 1161484 - RNA, 24 nt, Human
cacaucuguaaucucagcacuuug

SEQ ID NO: 1161485 - RNA, 18 nt, Human
cacugcacuccagccugg

SEQ ID NO: 1161486 - RNA, 19 nt, Human
cacugcacuccagccuggg

SEQ ID NO: 1161487 - RNA, 21 nt, Human
cacugcacuccagccugggca

SEQ ID NO: 1161488 - RNA, 23 nt, Human
cacugcacuccagccugggcaac

SEQ ID NO: 1161489 - RNA, 24 nt, Human
cacugcacuccagccugggcaaca

SEQ ID NO: 1161490 - RNA, 18 nt, Human
cagagguuguagugagcu

SEQ ID NO: 1161491 - RNA, 24 nt, Human
cagcacuuugggaggccaaggugg

SEQ ID NO: 1161492 - RNA, 22 nt, Human
cagccugggcaacagagagaaa

SEQ ID NO: 1161493 - RNA, 24 nt, Human
cagcuacucaggaggcugaggcag

SEQ ID NO: 1161494 - RNA, 23 nt, Human
cauaaaccaagucauuaucuccu

SEQ ID NO: 1161495 - RNA, 23 nt, Human
caucuguaaucucagcacuuugg

SEQ ID NO: 1161496 - RNA, 18 nt, Human
caugguguaaccccgccu

SEQ ID NO: 1161497 - RNA, 20 nt, Human
ccacugcacuccagccuggg

SEQ ID NO: 1161498 - RNA, 20 nt, Human
ccacugcacuccagccuggg

SEQ ID NO: 1161499 - RNA, 21 nt, Human
ccacugcacuccagccugggc

SEQ ID NO: 1161500 - RNA, 23 nt, Human
ccacugcacuccagccugggcaa

SEQ ID NO: 1161501 - RNA, 24 nt, Human
ccacugcacuccagccugggcaac

SEQ ID NO: 1161502 - RNA, 19 nt, Human
cccaaagccaugccugucu

SEQ ID NO: 1161503 - RNA, 19 nt, Human
cccagugucuauuauuccc

SEQ ID NO: 1161504 - RNA, 21 nt, Human
ccccucccuaccuccccagug

SEQ ID NO: 1161505 - RNA, 20 nt, Human
cccucuccguauuuccucac

SEQ ID NO: 1161506 - RNA, 21 nt, Human
ccuguaaucccagcuacucag

SEQ ID NO: 1161507 - RNA, 24 nt, Human
cgagaccauccugaucagcauggu

SEQ ID NO: 1161508 - RNA, 24 nt, Human
cgccacugcacuccagccugggca

SEQ ID NO: 1161509 - RNA, 24 nt, Human
cucacaucuguaaucucagcacuu

SEQ ID NO: 1161510 - RNA, 20 nt, Human
cucccuaccuccccaguguc

SEQ ID NO: 1161511 - RNA, 20 nt, Human
cucuacuaaaaauacaaaaa

SEQ ID NO: 1161512 - RNA, 21 nt, Human
cuguaaucucagcacuuuggg

SEQ ID NO: 1161513 - RNA, 23 nt, Human
gacgcaguggcucacaucuguaa

SEQ ID NO: 1161514 - RNA, 23 nt, Human
gagaaucuuuuauuuaugguauc

SEQ ID NO: 1161515 - RNA, 18 nt, Human
gauacuaaauguggcagg

SEQ ID NO: 1161516 - RNA, 22 nt, Human
gaucauaguuaauaacaauuua

SEQ ID NO: 1161517 - RNA, 24 nt, Human
gaucaugaagucaagaguucgaga

SEQ ID NO: 1161518 - RNA, 22 nt, Human
gauuuggggguggggauacuaa

SEQ ID NO: 1161519 - RNA, 19 nt, Human
gccaagguggguggaucau

SEQ ID NO: 1161520 - RNA, 22 nt, Human
gccacugcacuccagccugggc

SEQ ID NO: 1161521 - RNA, 24 nt, Human
gccacugcacuccagccugggcaa

SEQ ID NO: 1161522 - RNA, 22 nt, Human
ggaggcagagguuguagugagc

SEQ ID NO: 1161523 - RNA, 20 nt, Human
gggaacacaugggcagguuu

SEQ ID NO: 1161524 - RNA, 24 nt, Human
gggcgugguugugugugccuguaa

SEQ ID NO: 1161525 - RNA, 23 nt, Human
gguggaucaugaagucaagaguu

SEQ ID NO: 1161526 - RNA, 19 nt, Human
gucacagaaaaauacugua

SEQ ID NO: 1161527 - RNA, 21 nt, Human
guggggauacuaaauguggca

SEQ ID NO: 1161528 - RNA, 20 nt, Human
gugugccuguaaucccagcu

SEQ ID NO: 1161529 - RNA, 20 nt, Human
gugugugccuguaaucccag

SEQ ID NO: 1161530 - RNA, 24 nt, Human
uaaguaaguaguauauuaaggcca

SEQ ID NO: 1161531 - RNA, 22 nt, Human
uaauaacaauuuaagcuuuaga

SEQ ID NO: 1161532 - RNA, 22 nt, Human
uaauaguacaaauuuuguccca

SEQ ID NO: 1161533 - RNA, 19 nt, Human
uacaugaaacuacugaaag

SEQ ID NO: 1161534 - RNA, 21 nt, Human
uagcugggcgugguugugugu

SEQ ID NO: 1161535 - RNA, 18 nt, Human
uaggaaggacgcaguggc

SEQ ID NO: 1161536 - RNA, 24 nt, Human
ucaugaagucaagaguucgagacc

SEQ ID NO: 1161537 - RNA, 19 nt, Human
ucaugcuuauagguuacuc

SEQ ID NO: 1161538 - RNA, 18 nt, Human
ucauuaucuccuaucaaa

SEQ ID NO: 1161539 - RNA, 23 nt, Human
uccccaguagguaguuuuucagc

SEQ ID NO: 1161540 - RNA, 21 nt, Human
uccccagugucuauuauuccc

SEQ ID NO: 1161541 - RNA, 18 nt, Human
uccugucacccagguagu

SEQ ID NO: 1161542 - RNA, 22 nt, Human
ucugagcaaaucaauuuuaguu

SEQ ID NO: 1161543 - RNA, 25 nt, Human
ucuugcuccugcuccccucccuacc

SEQ ID NO: 1161544 - RNA, 24 nt, Human
ugaaauugcgccacugcacuccag

SEQ ID NO: 1161545 - RNA, 22 nt, Human
ugagcagaguccccaguaggua

SEQ ID NO: 1161546 - RNA, 22 nt, Human
ugagcugaaauugcgccacugc

SEQ ID NO: 1161547 - RNA, 24 nt, Human
ugaggcaggagaauugcuugaacc

SEQ ID NO: 1161548 - RNA, 25 nt, Human
ugaggcaggagaauugcuugaaccc

SEQ ID NO: 1161549 - RNA, 24 nt, Human
ugccuguaaucccagcuacucagg

SEQ ID NO: 1161550 - RNA, 21 nt, Human
uggcucacaucuguaaucuca

SEQ ID NO: 1161551 - RNA, 24 nt, Human
uggcucacaucuguaaucucagca

SEQ ID NO: 1161552 - RNA, 23 nt, Human
ugggaggccaagguggguggauc

SEQ ID NO: 1161553 - RNA, 24 nt, Human
ugggaggccaagguggguggauca

SEQ ID NO: 1161554 - RNA, 23 nt, Human
uggguggaucaugaagucaagag

SEQ ID NO: 1161555 - RNA, 24 nt, Human
ugguugugugugccuguaauccca

SEQ ID NO: 1161556 - RNA, 21 nt, Human
ugucaaaguuuaaacacugga

SEQ ID NO: 1161557 - RNA, 22 nt, Human
uuaccgguugacucuuugaaac

SEQ ID NO: 1161558 - RNA, 20 nt, Human
uuagcugggcgugguugugu

SEQ ID NO: 1161559 - RNA, 24 nt, Human
uuagcugggcgugguugugugugc

SEQ ID NO: 1161560 - RNA, 24 nt, Human
uuaggaaggacgcaguggcucaca

SEQ ID NO: 1161561 - RNA, 19 nt, Human
uucaguggcucuucugcuu

SEQ ID NO: 1161562 - RNA, 18 nt, Human
uucccauggguccucagg

SEQ ID NO: 1161563 - RNA, 23 nt, Human
uugcgccacugcacuccagccug

SEQ ID NO: 1161564 - RNA, 20 nt, Human
uuguagugagcugaaauugc

SEQ ID NO: 1161565 - RNA, 19 nt, Human
uugugugugccuguaaucc

SEQ ID NO: 1161566 - RNA, 22 nt, Human
uuuaaaauacaucaaugacaca

SEQ ID NO: 1161567 - RNA, 21 nt, Human
uuuggggguggggauacuaaa

SEQ ID NO: 1161568 - RNA, 22 nt, Human
uuuuucagcucuugcuccugcu

SEQ ID NO: 1161569 - RNA, 18 nt, Human
aaaagagagaaagaacgu

SEQ ID NO: 1161570 - RNA, 22 nt, Human
aaacaacauuaaucucccugua

SEQ ID NO: 1161571 - RNA, 22 nt, Human
aaacuugcuccacacaguugcc

SEQ ID NO: 1161572 - RNA, 19 nt, Human
aaauguauuucuugaauca

SEQ ID NO: 1161573 - RNA, 22 nt, Human
aaccccucaaagucauccauga

SEQ ID NO: 1161574 - RNA, 18 nt, Human
acaggguuucaccauguu

SEQ ID NO: 1161575 - RNA, 21 nt, Human
acaggguuucaccauguuggc

SEQ ID NO: 1161576 - RNA, 24 nt, Human
acaggguuucaccauguuggccag

SEQ ID NO: 1161577 - RNA, 19 nt, Human
accauguuggccaggcuag

SEQ ID NO: 1161578 - RNA, 23 nt, Human
acucaggccacuaaaacuuucuc

SEQ ID NO: 1161579 - RNA, 22 nt, Human
acucuguggcccaggcuggagu

SEQ ID NO: 1161580 - RNA, 24 nt, Human
acucuguggcccaggcuggagugc

SEQ ID NO: 1161581 - RNA, 23 nt, Human
acugcaaccucugccuccacguu

SEQ ID NO: 1161582 - RNA, 22 nt, Human
acugcacccucugccucccagg

SEQ ID NO: 1161583 - RNA, 23 nt, Human
acuuccuccacugaagucuugaa

SEQ ID NO: 1161584 - RNA, 21 nt, Human
agaacuuuuccuuugcauuca

SEQ ID NO: 1161585 - RNA, 28 nt, Human
agaaggacagagauggcagaacaacagg

SEQ ID NO: 1161586 - RNA, 26 nt, Human
agagagaaagaacgugcuguuggaaa

SEQ ID NO: 1161587 - RNA, 24 nt, Human
agccuccagaagguuuucaauuga

SEQ ID NO: 1161588 - RNA, 23 nt, Human
agcuaggucuucuggauaacuug

SEQ ID NO: 1161589 - RNA, 24 nt, Human
aggcaaucugcccgccucggucuc

SEQ ID NO: 1161590 - RNA, 31 nt, Human
aggcuaguuuuuguauuuuuaguagagacaa

SEQ ID NO: 1161591 - RNA, 25 nt, Human
aggcuggagugcaguggcacaaucu

SEQ ID NO: 1161592 - RNA, 18 nt, Human
aguagcugggauuacagg

SEQ ID NO: 1161593 - RNA, 23 nt, Human
agugaguggcgggaucucggcuc

SEQ ID NO: 1161594 - RNA, 21 nt, Human
agugcaguggcacaaucucag

SEQ ID NO: 1161595 - RNA, 25 nt, Human
auucagaacacacacaacacuuaac

SEQ ID NO: 1161596 - RNA, 24 nt, Human
auuuuaguagagaugggguuucac

SEQ ID NO: 1161597 - RNA, 24 nt, Human
auuuuuugcauuuuaguagagaug

SEQ ID NO: 1161598 - RNA, 24 nt, Human
caaauugcugggauuacagguaug

SEQ ID NO: 1161599 - RNA, 21 nt, Human
caccauguuggccaggcuagu

SEQ ID NO: 1161600 - RNA, 23 nt, Human
caccauguuggccaggcuagucu

SEQ ID NO: 1161601 - RNA, 24 nt, Human
caccauguuggccaggcuagucuu

SEQ ID NO: 1161602 - RNA, 27 nt, Human
caccauguuggccaggcuagucuuaaa

SEQ ID NO: 1161603 - RNA, 21 nt, Human
cacccucugccucccagguuc

SEQ ID NO: 1161604 - RNA, 18 nt, Human
caccugaauacuuagaag

SEQ ID NO: 1161605 - RNA, 23 nt, Human
cacucagccuccugaguagcugg

SEQ ID NO: 1161606 - RNA, 24 nt, Human
cacucuguggcccaggcuggagug

SEQ ID NO: 1161607 - RNA, 18 nt, Human
cacugcaaccucugccuc

SEQ ID NO: 1161608 - RNA, 22 nt, Human
cagaacaacaggucaguggggc

SEQ ID NO: 1161609 - RNA, 20 nt, Human
cagccuccugaguagcuggg

SEQ ID NO: 1161610 - RNA, 24 nt, Human
caggguuucaccauguuggccagg

SEQ ID NO: 1161611 - RNA, 24 nt, Human
cauguuggccaggcuagucuuaaa

SEQ ID NO: 1161612 - RNA, 21 nt, Human
cauucagaacacacacaacac

SEQ ID NO: 1161613 - RNA, 24 nt, Human
cauuuccagaagguuuucucuuuu

SEQ ID NO: 1161614 - RNA, 21 nt, Human
ccaaauugcugggauuacagg

SEQ ID NO: 1161615 - RNA, 21 nt, Human
ccaaauugcugggauuacagg

SEQ ID NO: 1161616 - RNA, 22 nt, Human
ccaaauugcugggauuacaggu

SEQ ID NO: 1161617 - RNA, 24 nt, Human
ccaaauugcugggauuacagguau

SEQ ID NO: 1161618 - RNA, 20 nt, Human
ccaggcuggagugaguggcg

SEQ ID NO: 1161619 - RNA, 19 nt, Human
cccagguucaagcaauucu

SEQ ID NO: 1161620 - RNA, 21 nt, Human
cccaugaaauguauuucuuga

SEQ ID NO: 1161621 - RNA, 18 nt, Human
ccccaaaacaauuacaac

SEQ ID NO: 1161622 - RNA, 22 nt, Human
ccccuagauuagacguuggcuu

SEQ ID NO: 1161623 - RNA, 19 nt, Human
ccgcagcugccucaccucu

SEQ ID NO: 1161624 - RNA, 24 nt, Human
ccgccucggucucccaaagugcug

SEQ ID NO: 1161625 - RNA, 22 nt, Human
ccucccagguucaagcaauucu

SEQ ID NO: 1161626 - RNA, 23 nt, Human
ccugaguagcugggauuacaggg

SEQ ID NO: 1161627 - RNA, 22 nt, Human
ccuugccaggcuaguuuuugua

SEQ ID NO: 1161628 - RNA, 18 nt, Human
cuaaaacuuucuccaugu

SEQ ID NO: 1161629 - RNA, 23 nt, Human
cucacucagccuccugaguagcu

SEQ ID NO: 1161630 - RNA, 24 nt, Human
cucacugcaaccucugccuccacg

SEQ ID NO: 1161631 - RNA, 23 nt, Human
cucagccuccugaguagcuggga

SEQ ID NO: 1161632 - RNA, 21 nt, Human
cuccacacaguugccaaaacc

SEQ ID NO: 1161633 - RNA, 22 nt, Human
cugaaaacaacauuaaucuccc

SEQ ID NO: 1161634 - RNA, 21 nt, Human
cugaagucuugaaccccucaa

SEQ ID NO: 1161635 - RNA, 23 nt, Human
cugcaaccucugccuccacguuc

SEQ ID NO: 1161636 - RNA, 21 nt, Human
cugcacccucugccucccagg

SEQ ID NO: 1161637 - RNA, 25 nt, Human
cugcagcuucuccaucagcaguugg

SEQ ID NO: 1161638 - RNA, 20 nt, Human
cugccucaccucucucagcc

SEQ ID NO: 1161639 - RNA, 23 nt, Human
cuuaacuucgugagccagccucu

SEQ ID NO: 1161640 - RNA, 18 nt, Human
cuucuacucaggccacua

SEQ ID NO: 1161641 - RNA, 22 nt, Human
cuucuuagcuaugaaaguccag

SEQ ID NO: 1161642 - RNA, 24 nt, Human
cuuuaaagauuugaagccaggcau

SEQ ID NO: 1161643 - RNA, 19 nt, Human
gaaacauuuccagaagguu

SEQ ID NO: 1161644 - RNA, 24 nt, Human
gaagaucugcccuucucagccucc

SEQ ID NO: 1161645 - RNA, 18 nt, Human
gaaucauagugcuugaaa

SEQ ID NO: 1161646 - RNA, 22 nt, Human
gaaucucacucuguggcccagg

SEQ ID NO: 1161647 - RNA, 20 nt, Human
gagaugggguuucaccuggg

SEQ ID NO: 1161648 - RNA, 20 nt, Human
gagcacgcagccacgcccgg

SEQ ID NO: 1161649 - RNA, 21 nt, Human
gagcaguacuacuuugaaagg

SEQ ID NO: 1161650 - RNA, 24 nt, Human
gagcucaggcaaucugcccgccuc

SEQ ID NO: 1161651 - RNA, 24 nt, Human
gaguagcugggauuacaggggugc

SEQ ID NO: 1161652 - RNA, 18 nt, Human
gauuacaggggugcacca

SEQ ID NO: 1161653 - RNA, 18 nt, Human
gauuacagguaugagcca

SEQ ID NO: 1161654 - RNA, 21 nt, Human
gauuacagguaugagccacca

SEQ ID NO: 1161655 - RNA, 24 nt, Human
gauuacagguaugagccaccaugc

SEQ ID NO: 1161656 - RNA, 24 nt, Human
gcaaucugcccgccucggucuccc

SEQ ID NO: 1161657 - RNA, 22 nt, Human
gcacccucugccucccagguuc

SEQ ID NO: 1161658 - RNA, 19 nt, Human
gcccaggcuggagugcagu

SEQ ID NO: 1161659 - RNA, 23 nt, Human
gcccaggcuggagugcaguggca

SEQ ID NO: 1161660 - RNA, 19 nt, Human
gcccuucucagccucccaa

SEQ ID NO: 1161661 - RNA, 18 nt, Human
gccucagcuucccgagua

SEQ ID NO: 1161662 - RNA, 24 nt, Human
gccucggucucccaaagugcuggg

SEQ ID NO: 1161663 - RNA, 23 nt, Human
gcuagucuuaaacuccugaccuc

SEQ ID NO: 1161664 - RNA, 19 nt, Human
gcuggagugcaguggcaca

SEQ ID NO: 1161665 - RNA, 18 nt, Human
ggaaucuauauccccaug

SEQ ID NO: 1161666 - RNA, 20 nt, Human
ggagaaggacagagauggca

SEQ ID NO: 1161667 - RNA, 19 nt, Human
ggagucuugcucuuuuauc

SEQ ID NO: 1161668 - RNA, 24 nt, Human
ggauuacagguaugagccaccaug

SEQ ID NO: 1161669 - RNA, 19 nt, Human
ggcaccccaaaacaauuac

SEQ ID NO: 1161670 - RNA, 22 nt, Human
ggguuucaccauguuggccagg

SEQ ID NO: 1161671 - RNA, 23 nt, Human
ggguuucaccuggguuucccagg

SEQ ID NO: 1161672 - RNA, 18 nt, Human
guagcugggauuacaggg

SEQ ID NO: 1161673 - RNA, 20 nt, Human
guagcugggauuacaggggu

SEQ ID NO: 1161674 - RNA, 24 nt, Human
gucuugcucuuuuauccaggcugg

SEQ ID NO: 1161675 - RNA, 19 nt, Human
guggcccaggcuggagugc

SEQ ID NO: 1161676 - RNA, 22 nt, Human
gugggacuacaggagcacgcag

SEQ ID NO: 1161677 - RNA, 19 nt, Human
uaacagaggccaaaagaga

SEQ ID NO: 1161678 - RNA, 22 nt, Human
uaacuggccuaauuucaauauu

SEQ ID NO: 1161679 - RNA, 23 nt, Human
uaauuuuuugcauuuuaguagag

SEQ ID NO: 1161680 - RNA, 19 nt, Human
uacaggagcacgcagccac

SEQ ID NO: 1161681 - RNA, 24 nt, Human
uacagguaugagccaccaugccca

SEQ ID NO: 1161682 - RNA, 23 nt, Human
uacugcacccucugccucccagg

SEQ ID NO: 1161683 - RNA, 22 nt, Human
uagagacaggguuucaccaugu

SEQ ID NO: 1161684 - RNA, 22 nt, Human
uagauggaaucucacucugugg

SEQ ID NO: 1161685 - RNA, 23 nt, Human
uaggcccuuucaccaauuauuuu

SEQ ID NO: 1161686 - RNA, 23 nt, Human
uaggucucaaaagaaagcuaaaa

SEQ ID NO: 1161687 - RNA, 24 nt, Human
uaguagagacaggguuucaccaug

SEQ ID NO: 1161688 - RNA, 26 nt, Human
uaguagagacaggguuucaccauguu

SEQ ID NO: 1161689 - RNA, 21 nt, Human
uaguagagaugggguuucacc

SEQ ID NO: 1161690 - RNA, 23 nt, Human
uaguagagaugggguuucaccug

SEQ ID NO: 1161691 - RNA, 24 nt, Human
uaguagagaugggguuucaccugg

SEQ ID NO: 1161692 - RNA, 25 nt, Human
uaguagagaugggguuucaccuggg

SEQ ID NO: 1161693 - RNA, 22 nt, Human
uaguuaucuugcuauuuccaga

SEQ ID NO: 1161694 - RNA, 19 nt, Human
ucacugcaaccucugccuc

SEQ ID NO: 1161695 - RNA, 21 nt, Human
ucacugcaaccucugccucca

SEQ ID NO: 1161696 - RNA, 23 nt, Human
ucacugcaaccucugccuccacg

SEQ ID NO: 1161697 - RNA, 22 nt, Human
ucagaacacacacaacacuuaa

SEQ ID NO: 1161698 - RNA, 22 nt, Human
ucagaacacacacaacacuuaa

SEQ ID NO: 1161699 - RNA, 20 nt, Human
ucagccuccugaguagcugg

SEQ ID NO: 1161700 - RNA, 21 nt, Human
ucagccuucauagaauugaag

SEQ ID NO: 1161701 - RNA, 24 nt, Human
ucaggcucugcuucuaauucuagu

SEQ ID NO: 1161702 - RNA, 23 nt, Human
uccacguuccagcaauucuccug

SEQ ID NO: 1161703 - RNA, 23 nt, Human
ucccaaauugcugggauuacagg

SEQ ID NO: 1161704 - RNA, 24 nt, Human
ucccaaauugcugggauuacaggu

SEQ ID NO: 1161705 - RNA, 19 nt, Human
ucccagguucaagcaauuc

SEQ ID NO: 1161706 - RNA, 20 nt, Human
ucccagguucaagcaauucu

SEQ ID NO: 1161707 - RNA, 25 nt, Human
uccugaguagcugggauuacagggg

SEQ ID NO: 1161708 - RNA, 21 nt, Human
ucuauggaaucuauaucccca

SEQ ID NO: 1161709 - RNA, 23 nt, Human
ucucacucuguggcccaggcugg

SEQ ID NO: 1161710 - RNA, 24 nt, Human
ucucacucuguggcccaggcugga

SEQ ID NO: 1161711 - RNA, 23 nt, Human
ucugcccuucucagccucccaaa

SEQ ID NO: 1161712 - RNA, 22 nt, Human
ucuggauaacuugcugcagcuu

SEQ ID NO: 1161713 - RNA, 24 nt, Human
ucuguggcccaggcuggagugcag

SEQ ID NO: 1161714 - RNA, 23 nt, Human
ucuugcucuuuuauccaggcugg

SEQ ID NO: 1161715 - RNA, 24 nt, Human
ucuugcucuuuuauccaggcugga

SEQ ID NO: 1161716 - RNA, 21 nt, Human
ugaaaggaauauuauuuucug

SEQ ID NO: 1161717 - RNA, 24 nt, Human
ugaauuccugagcucaggcaaucu

SEQ ID NO: 1161718 - RNA, 20 nt, Human
ugacaugccuuccucacuga

SEQ ID NO: 1161719 - RNA, 21 nt, Human
ugcaguggcacaaucucagcu

SEQ ID NO: 1161720 - RNA, 23 nt, Human
ugccucaccucucucagccuuca

SEQ ID NO: 1161721 - RNA, 18 nt, Human
ugccucacucagccuccu

SEQ ID NO: 1161722 - RNA, 20 nt, Human
ugccucagcuucccgaguag

SEQ ID NO: 1161723 - RNA, 24 nt, Human
ugccucagcuucccgaguaggugg

SEQ ID NO: 1161724 - RNA, 18 nt, Human
ugccuugccucacucagc

SEQ ID NO: 1161725 - RNA, 20 nt, Human
ugcugggauuacagguauga

SEQ ID NO: 1161726 - RNA, 24 nt, Human
ugcugggauuacagguaugagcca

SEQ ID NO: 1161727 - RNA, 23 nt, Human
uggagucuugcucuuuuauccag

SEQ ID NO: 1161728 - RNA, 23 nt, Human
uggagugaguggcgggaucucgg

SEQ ID NO: 1161729 - RNA, 18 nt, Human
uggagugcaguggcacaa

SEQ ID NO: 1161730 - RNA, 23 nt, Human
uggagugcaguggcacaaucuca

SEQ ID NO: 1161731 - RNA, 24 nt, Human
uggagugcaguggcacaaucucag

SEQ ID NO: 1161732 - RNA, 23 nt, Human
uggcacaaucucagcuuacugca

SEQ ID NO: 1161733 - RNA, 20 nt, Human
uggcaucuuuccuuaacuuc

SEQ ID NO: 1161734 - RNA, 24 nt, Human
uggccaggcuagucuuaaacuccu

SEQ ID NO: 1161735 - RNA, 18 nt, Human
uggcccaggcuggagugc

SEQ ID NO: 1161736 - RNA, 24 nt, Human
ugggacuacaggagcacgcagcca

SEQ ID NO: 1161737 - RNA, 21 nt, Human
ugggauuacaggggugcacca

SEQ ID NO: 1161738 - RNA, 22 nt, Human
ugggauuacaggggugcaccac

SEQ ID NO: 1161739 - RNA, 18 nt, Human
ugggauuacagguaugag

SEQ ID NO: 1161740 - RNA, 22 nt, Human
ugggauuacagguaugagccac

SEQ ID NO: 1161741 - RNA, 23 nt, Human
ugggauuacagguaugagccacc

SEQ ID NO: 1161742 - RNA, 24 nt, Human
ugggauuacagguaugagccacca

SEQ ID NO: 1161743 - RNA, 25 nt, Human
ugggauuacagguaugagccaccau

SEQ ID NO: 1161744 - RNA, 19 nt, Human
ugggguuucaccuggguuu

SEQ ID NO: 1161745 - RNA, 22 nt, Human
ugggguuucaccuggguuuccc

SEQ ID NO: 1161746 - RNA, 18 nt, Human
uguaguaucugugguugu

SEQ ID NO: 1161747 - RNA, 22 nt, Human
ugugauaauaaugaacaaguuu

SEQ ID NO: 1161748 - RNA, 24 nt, Human
uuacugcacccucugccucccagg

SEQ ID NO: 1161749 - RNA, 25 nt, Human
uuacugcacccucugccucccaggu

SEQ ID NO: 1161750 - RNA, 24 nt, Human
uuaguagagacaggguuucaccau

SEQ ID NO: 1161751 - RNA, 18 nt, Human
uuaguagagaugggguuu

SEQ ID NO: 1161752 - RNA, 22 nt, Human
uuaguagagaugggguuucacc

SEQ ID NO: 1161753 - RNA, 23 nt, Human
uuaguagagaugggguuucaccu

SEQ ID NO: 1161754 - RNA, 20 nt, Human
uuauccaggcuggagugagu

SEQ ID NO: 1161755 - RNA, 23 nt, Human
uucauaauuuggcuaguuuuggu

SEQ ID NO: 1161756 - RNA, 21 nt, Human
uuccagaccaucuucaguuac

SEQ ID NO: 1161757 - RNA, 22 nt, Human
uugaagccaggcaucaacuucu

SEQ ID NO: 1161758 - RNA, 21 nt, Human
uugccaggcuaguuuuuguau

SEQ ID NO: 1161759 - RNA, 23 nt, Human
uugcugcuucaccuuacauuucu

SEQ ID NO: 1161760 - RNA, 23 nt, Human
uugugaauuccugagcucaggca

SEQ ID NO: 1161761 - RNA, 21 nt, Human
uuguucuuaaugcaauuuaga

SEQ ID NO: 1161762 - RNA, 23 nt, Human
uuuaauuuccuuccagaacuuuu

SEQ ID NO: 1161763 - RNA, 24 nt, Human
uuucaccauguuggccaggcuagu

SEQ ID NO: 1161764 - RNA, 19 nt, Human
uuucuauguuaugcagaug

SEQ ID NO: 1161765 - RNA, 20 nt, Human
uuugcauucauaauuuggcu

SEQ ID NO: 1161766 - RNA, 24 nt, Human
uuuuuaguagagacaggguuucac

SEQ ID NO: 1161767 - RNA, 20 nt, Human
uuuuugcauuuuaguagaga

SEQ ID NO: 1161768 - RNA, 20 nt, Human
uuuuuguauuuuuaguagag

SEQ ID NO: 1161769 - RNA, 21 nt, Human
uuuuuguauuuuuaguagaga

SEQ ID NO: 1161770 - RNA, 21 nt, Human
aaaaacagaggcuuccaaaca

SEQ ID NO: 1161771 - RNA, 19 nt, Human
aaaacagaggcuuccaaac

SEQ ID NO: 1161772 - RNA, 21 nt, Human
aaacagaagcagcuuccaaac

SEQ ID NO: 1161773 - RNA, 22 nt, Human
aaacagaagcagcuuccaaaca

SEQ ID NO: 1161774 - RNA, 20 nt, Human
aacacauguacacgcacaca

SEQ ID NO: 1161775 - RNA, 26 nt, Human
aagcggaucccagggucugcaagucu

SEQ ID NO: 1161776 - RNA, 22 nt, Human
aaggacacccagagcaggagag

SEQ ID NO: 1161777 - RNA, 22 nt, Human
aaguucccagccucaggccacc

SEQ ID NO: 1161778 - RNA, 31 nt, Human
acacacacacacacgcucaaacacgugcaca

SEQ ID NO: 1161779 - RNA, 29 nt, Human
acacacacgcucaaacacgugcacauggu

SEQ ID NO: 1161780 - RNA, 21 nt, Human
acacagaaaucccaggagccc

SEQ ID NO: 1161781 - RNA, 25 nt, Human
acacaugcauacgugcucaugcaua

SEQ ID NO: 1161782 - RNA, 25 nt, Human
acacgcacacaugcgcacacacacg

SEQ ID NO: 1161783 - RNA, 29 nt, Human
acacgcacaugcaugcucacgcguguaca

SEQ ID NO: 1161784 - RNA, 21 nt, Human
acagaaaucccaggagcccca

SEQ ID NO: 1161785 - RNA, 20 nt, Human
acagaagcagcuuccaaaca

SEQ ID NO: 1161786 - RNA, 24 nt, Human
acaugcacacaugcucacacuaca

SEQ ID NO: 1161787 - RNA, 28 nt, Human
acaugcgcacacacacguacaucuauac

SEQ ID NO: 1161788 - RNA, 22 nt, Human
accaggucugcagcgacucaca

SEQ ID NO: 1161789 - RNA, 22 nt, Human
acccauacaccagccacacaca

SEQ ID NO: 1161790 - RNA, 19 nt, Human
acccccagcacagcaagac

SEQ ID NO: 1161791 - RNA, 22 nt, Human
acgcauacaugcccacacacaa

SEQ ID NO: 1161792 - RNA, 19 nt, Human
acgccccccacuccaaaaa

SEQ ID NO: 1161793 - RNA, 27 nt, Human
acgugcacaugcacacacacagguaca

SEQ ID NO: 1161794 - RNA, 22 nt, Human
acuacacauauccaagaaccca

SEQ ID NO: 1161795 - RNA, 22 nt, Human
agagaaguacacaagaacauga

SEQ ID NO: 1161796 - RNA, 25 nt, Human
agagcuuccccagcaccugccacac

SEQ ID NO: 1161797 - RNA, 26 nt, Human
agccccucccgccuuccacgcccccc

SEQ ID NO: 1161798 - RNA, 21 nt, Human
aggaacacaggccuguggcca

SEQ ID NO: 1161799 - RNA, 20 nt, Human
aggaacccaaguucccagcc

SEQ ID NO: 1161800 - RNA, 18 nt, Human
aggagcccuucugggggc

SEQ ID NO: 1161801 - RNA, 19 nt, Human
aggaggaggagaugccgcc

SEQ ID NO: 1161802 - RNA, 24 nt, Human
aggccucccacccucagggaccag

SEQ ID NO: 1161803 - RNA, 22 nt, Human
aggcgccagcagagcccaggaa

SEQ ID NO: 1161804 - RNA, 29 nt, Human
aggcuuccaaacacacagaaaucccuuuu

SEQ ID NO: 1161805 - RNA, 18 nt, Human
agggccagccauccaccc

SEQ ID NO: 1161806 - RNA, 27 nt, Human
aguacacacacguacaccauaugcaua

SEQ ID NO: 1161807 - RNA, 24 nt, Human
auacacaugugcaugcucacccau

SEQ ID NO: 1161808 - RNA, 18 nt, Human
auacaugcccacacacaa

SEQ ID NO: 1161809 - RNA, 21 nt, Human
aucacgccaccucuggaagca

SEQ ID NO: 1161810 - RNA, 23 nt, Human
augcacgugcacaggcucacaca

SEQ ID NO: 1161811 - RNA, 33 nt, Human
augcauacgugcucaugcauacacacgcacagu

SEQ ID NO: 1161812 - RNA, 25 nt, Human
augcgcacacacacguacaucuaua

SEQ ID NO: 1161813 - RNA, 22 nt, Human
caaaaacagaggcuuccaaaca

SEQ ID NO: 1161814 - RNA, 22 nt, Human
caaacacacagaaaucccagga

SEQ ID NO: 1161815 - RNA, 31 nt, Human
caaacacauguacacgcacacaugcgcacag

SEQ ID NO: 1161816 - RNA, 28 nt, Human
caaacacgugcacaugcacacacacagu

SEQ ID NO: 1161817 - RNA, 21 nt, Human
caaguucccagccucaggcca

SEQ ID NO: 1161818 - RNA, 31 nt, Human
cacaaacacauguacacgcacacaugcggug

SEQ ID NO: 1161819 - RNA, 30 nt, Human
cacacacguacaccauaugcauauguaugg

SEQ ID NO: 1161820 - RNA, 22 nt, Human
cacacagguacaucccuccuuu

SEQ ID NO: 1161821 - RNA, 26 nt, Human
cacagcccugggugucccagggcagg

SEQ ID NO: 1161822 - RNA, 25 nt, Human
cacaugcacacaugcucacacuaca

SEQ ID NO: 1161823 - RNA, 26 nt, Human
cacaugcgcacacacacguacaucua

SEQ ID NO: 1161824 - RNA, 26 nt, Human
cacauguacaccuauacacguguaca

SEQ ID NO: 1161825 - RNA, 23 nt, Human
cacauguacacucuacauguaca

SEQ ID NO: 1161826 - RNA, 26 nt, Human
cacauucauacacacgugcaugcuua

SEQ ID NO: 1161827 - RNA, 19 nt, Human
caccagccggaagcaaggc

SEQ ID NO: 1161828 - RNA, 20 nt, Human
cacccccagcacagcaagac

SEQ ID NO: 1161829 - RNA, 23 nt, Human
caccuucggcccccacaaagccc

SEQ ID NO: 1161830 - RNA, 31 nt, Human
cacgcacaugcaugcucacgcguguacaugg

SEQ ID NO: 1161831 - RNA, 19 nt, Human
cacgccaccucuggaagca

SEQ ID NO: 1161832 - RNA, 18 nt, Human
cacgccccccacuccaaa

SEQ ID NO: 1161833 - RNA, 23 nt, Human
cacgccccccacuccaaaaacag

SEQ ID NO: 1161834 - RNA, 22 nt, Human
cacuacacauauccaagaaccc

SEQ ID NO: 1161835 - RNA, 29 nt, Human
cacuugcacacacacacacacgcucaaac

SEQ ID NO: 1161836 - RNA, 19 nt, Human
cagagcccaggaacccaag

SEQ ID NO: 1161837 - RNA, 19 nt, Human
cagcaccugccacacagcc

SEQ ID NO: 1161838 - RNA, 23 nt, Human
cagcagccguggcgcggaggagu

SEQ ID NO: 1161839 - RNA, 24 nt, Human
cagcaggcaacacagggugcgcga

SEQ ID NO: 1161840 - RNA, 24 nt, Human
cagcccccugcccggcggggcaac

SEQ ID NO: 1161841 - RNA, 19 nt, Human
cagccguggcgcggaggag

SEQ ID NO: 1161842 - RNA, 21 nt, Human
cagcugcccggagccucucgu

SEQ ID NO: 1161843 - RNA, 18 nt, Human
caggcacugucagccccu

SEQ ID NO: 1161844 - RNA, 23 nt, Human
caggccaccagcacagcccuggg

SEQ ID NO: 1161845 - RNA, 24 nt, Human
caggccaccagcacagcccugggu

SEQ ID NO: 1161846 - RNA, 24 nt, Human
caggccagacugacccagcccuug

SEQ ID NO: 1161847 - RNA, 22 nt, Human
cagggccucccagcccagccuu

SEQ ID NO: 1161848 - RNA, 18 nt, Human
caguggcagcugccuggg

SEQ ID NO: 1161849 - RNA, 22 nt, Human
caucuucucugagaaggacacc

SEQ ID NO: 1161850 - RNA, 20 nt, Human
caugcacacacacagguaca

SEQ ID NO: 1161851 - RNA, 25 nt, Human
caugcacauguacaccuauacacgu

SEQ ID NO: 1161852 - RNA, 24 nt, Human
caugcacgugcacaggcucacaca

SEQ ID NO: 1161853 - RNA, 31 nt, Human
caugcacgugcacaggcucacacaugcacag

SEQ ID NO: 1161854 - RNA, 25 nt, Human
caugcauacacacgcacauucauac

SEQ ID NO: 1161855 - RNA, 20 nt, Human
caugccaccagccggaagca

SEQ ID NO: 1161856 - RNA, 30 nt, Human
caugcccacacacaaaguacacacacguag

SEQ ID NO: 1161857 - RNA, 24 nt, Human
caugcucacacuacacauauccaa

SEQ ID NO: 1161858 - RNA, 20 nt, Human
cauguacacgcacacaugcg

SEQ ID NO: 1161859 - RNA, 26 nt, Human
cauguacacgcacacaugcgcacaca

SEQ ID NO: 1161860 - RNA, 22 nt, Human
caugugcaugcucacccauaca

SEQ ID NO: 1161861 - RNA, 24 nt, Human
ccaaaaacagaggcuuccaaacac

SEQ ID NO: 1161862 - RNA, 19 nt, Human
ccaccagcacagcccuggg

SEQ ID NO: 1161863 - RNA, 20 nt, Human
ccaccuucggcccccacaaa

SEQ ID NO: 1161864 - RNA, 19 nt, Human
ccacgccccccacuccaaa

SEQ ID NO: 1161865 - RNA, 22 nt, Human
ccagcacagcccuggguguccc

SEQ ID NO: 1161866 - RNA, 24 nt, Human
ccagcccuuggcccccucccuccg

SEQ ID NO: 1161867 - RNA, 21 nt, Human
ccauacaccagccacacacaa

SEQ ID NO: 1161868 - RNA, 26 nt, Human
ccauacaccagccacacacaaguacu

SEQ ID NO: 1161869 - RNA, 19 nt, Human
cccacaaagcccaggcgcc

SEQ ID NO: 1161870 - RNA, 27 nt, Human
cccacaaagcccaggcgccagcagagc

SEQ ID NO: 1161871 - RNA, 21 nt, Human
cccaccguggccccgggaggc

SEQ ID NO: 1161872 - RNA, 24 nt, Human
cccagcaccugccacacagccagg

SEQ ID NO: 1161873 - RNA, 27 nt, Human
cccagcucuggccccaggcacugucag

SEQ ID NO: 1161874 - RNA, 22 nt, Human
cccaggaccucguggccucagg

SEQ ID NO: 1161875 - RNA, 18 nt, Human
cccaggcgccagcagagc

SEQ ID NO: 1161876 - RNA, 22 nt, Human
ccccagcaccugccacacagcc

SEQ ID NO: 1161877 - RNA, 19 nt, Human
ccccagcccgucguccccu

SEQ ID NO: 1161878 - RNA, 22 nt, Human
ccccagcccgucguccccucua

SEQ ID NO: 1161879 - RNA, 21 nt, Human
ccccaggaccucguggccuca

SEQ ID NO: 1161880 - RNA, 23 nt, Human
ccccaggaccucguggccucagg

SEQ ID NO: 1161881 - RNA, 23 nt, Human
ccccaggcacugucagccccucc

SEQ ID NO: 1161882 - RNA, 20 nt, Human
cccccagcacagcaagaccc

SEQ ID NO: 1161883 - RNA, 22 nt, Human
cccccagcacagcaagacccgu

SEQ ID NO: 1161884 - RNA, 22 nt, Human
ccccccacuccaaaaacagagg

SEQ ID NO: 1161885 - RNA, 23 nt, Human
ccccccacuccaaaaacagaggc

SEQ ID NO: 1161886 - RNA, 27 nt, Human
ccccucagagaaguacacaagaacugg

SEQ ID NO: 1161887 - RNA, 21 nt, Human
cccggccccaaggcaugccac

SEQ ID NO: 1161888 - RNA, 21 nt, Human
cccuacgcucaggagcccuuc

SEQ ID NO: 1161889 - RNA, 19 nt, Human
cccuauggcccagagagcu

SEQ ID NO: 1161890 - RNA, 22 nt, Human
cccucaggccagacugacccag

SEQ ID NO: 1161891 - RNA, 21 nt, Human
cccucccgccuuccacgcccc

SEQ ID NO: 1161892 - RNA, 23 nt, Human
ccggaagcaaggcugggcauggg

SEQ ID NO: 1161893 - RNA, 23 nt, Human
ccucaggccaccagcacagcccu

SEQ ID NO: 1161894 - RNA, 19 nt, Human
ccucccagcccagccuucc

SEQ ID NO: 1161895 - RNA, 27 nt, Human
ccucccagcccagccuucccccagggc

SEQ ID NO: 1161896 - RNA, 22 nt, Human
ccucccgccuuccacgcccccc

SEQ ID NO: 1161897 - RNA, 23 nt, Human
ccugcagccuucugccaucuucu

SEQ ID NO: 1161898 - RNA, 21 nt, Human
ccugccacacagccaggaagc

SEQ ID NO: 1161899 - RNA, 24 nt, Human
ccuucggcccccacaaagcccagg

SEQ ID NO: 1161900 - RNA, 23 nt, Human
cgcacauucauacacacgugcag

SEQ ID NO: 1161901 - RNA, 24 nt, Human
cgccagcagagcccaggaacccaa

SEQ ID NO: 1161902 - RNA, 27 nt, Human
cgccccccacuccaaaaacagaggcuu

SEQ ID NO: 1161903 - RNA, 20 nt, Human
cgcucaggagcccuucuggg

SEQ ID NO: 1161904 - RNA, 22 nt, Human
cgugcacaugcacacacacagg

SEQ ID NO: 1161905 - RNA, 28 nt, Human
cguguacacgcacaugcaugcucacgcg

SEQ ID NO: 1161906 - RNA, 20 nt, Human
cguguacaugcuuaugcagu

SEQ ID NO: 1161907 - RNA, 23 nt, Human
cucacacuacacauauccaagaa

SEQ ID NO: 1161908 - RNA, 18 nt, Human
cucauacgcauacaugcc

SEQ ID NO: 1161909 - RNA, 26 nt, Human
cucaugcauacacacgcacauucaua

SEQ ID NO: 1161910 - RNA, 21 nt, Human
cucccacccucagggaccagg

SEQ ID NO: 1161911 - RNA, 25 nt, Human
cucccgccuuccacgccccccacuc

SEQ ID NO: 1161912 - RNA, 23 nt, Human
cugcagccuucugccaucuucuc

SEQ ID NO: 1161913 - RNA, 27 nt, Human
cuugcacacacacacacacgcucaaac

SEQ ID NO: 1161914 - RNA, 19 nt, Human
gaaaucccaggagccccag

SEQ ID NO: 1161915 - RNA, 19 nt, Human
gacacaaacacauguacac

SEQ ID NO: 1161916 - RNA, 18 nt, Human
gaccucguggccucaggc

SEQ ID NO: 1161917 - RNA, 24 nt, Human
gagcaggagagggguggccccagg

SEQ ID NO: 1161918 - RNA, 18 nt, Human
gaggauguccuccuucgc

SEQ ID NO: 1161919 - RNA, 21 nt, Human
gcaguguggggcaucccgagg

SEQ ID NO: 1161920 - RNA, 26 nt, Human
gcccaggaacccaaguucccagccuc

SEQ ID NO: 1161921 - RNA, 24 nt, Human
gcucacccauacaccagccacaca

SEQ ID NO: 1161922 - RNA, 19 nt, Human
gcugggcauggggcggagg

SEQ ID NO: 1161923 - RNA, 21 nt, Human
ggaacccaaguucccagccuc

SEQ ID NO: 1161924 - RNA, 20 nt, Human
ggaagguggccccacgaggg

SEQ ID NO: 1161925 - RNA, 21 nt, Human
ggcaguguggggcaucccgag

SEQ ID NO: 1161926 - RNA, 19 nt, Human
ggcauggggcggaggaagg

SEQ ID NO: 1161927 - RNA, 23 nt, Human
ggcgcaggggcaacugucccacc

SEQ ID NO: 1161928 - RNA, 23 nt, Human
gggcaguguggggcaucccgagg

SEQ ID NO: 1161929 - RNA, 24 nt, Human
gggucugcaagucuggaacucaaa

SEQ ID NO: 1161930 - RNA, 26 nt, Human
gugcacaggcucacacaugcacacag

SEQ ID NO: 1161931 - RNA, 18 nt, Human
gugcaugcucacccauac

SEQ ID NO: 1161932 - RNA, 30 nt, Human
guguacacgcacaugcaugcucacgcgugg

SEQ ID NO: 1161933 - RNA, 22 nt, Human
uaagcaagucagcaggcaacac

SEQ ID NO: 1161934 - RNA, 24 nt, Human
uacacacgugcaugcuuaugcaua

SEQ ID NO: 1161935 - RNA, 25 nt, Human
uacacgcacacaugcgcacacacac

SEQ ID NO: 1161936 - RNA, 18 nt, Human
uacacucauacauaugug

SEQ ID NO: 1161937 - RNA, 19 nt, Human
uacaugcccacacacaaag

SEQ ID NO: 1161938 - RNA, 27 nt, Human
uacaugcccacacacaaaguacacaca

SEQ ID NO: 1161939 - RNA, 23 nt, Human
uacauguacagcucacauaugca

SEQ ID NO: 1161940 - RNA, 18 nt, Human
uacccaagacacaaacac

SEQ ID NO: 1161941 - RNA, 25 nt, Human
uaugcaccuacaacaugcacgugca

SEQ ID NO: 1161942 - RNA, 18 nt, Human
ucacauaugcauccauac

SEQ ID NO: 1161943 - RNA, 27 nt, Human
ucacauaugcauccauacacaugugca

SEQ ID NO: 1161944 - RNA, 19 nt, Human
ucaccccaccguggccccg

SEQ ID NO: 1161945 - RNA, 21 nt, Human
ucagagaaguacacaagaaca

SEQ ID NO: 1161946 - RNA, 18 nt, Human
ucaggccagacugaccca

SEQ ID NO: 1161947 - RNA, 25 nt, Human
ucauacacacgugcaugcuuaugca

SEQ ID NO: 1161948 - RNA, 25 nt, Human
ucauacgcauacaugcccacacaca

SEQ ID NO: 1161949 - RNA, 20 nt, Human
uccacagggccucccagccc

SEQ ID NO: 1161950 - RNA, 22 nt, Human
uccacagggccucccagcccag

SEQ ID NO: 1161951 - RNA, 22 nt, Human
uccauacacaugugcaugcuca

SEQ ID NO: 1161952 - RNA, 18 nt, Human
ucccagccucaggccacc

SEQ ID NO: 1161953 - RNA, 22 nt, Human
ucccaggagccccaggccccug

SEQ ID NO: 1161954 - RNA, 19 nt, Human
ucccagggcaggcgggccu

SEQ ID NO: 1161955 - RNA, 21 nt, Human
ucccagggcaggcgggccucu

SEQ ID NO: 1161956 - RNA, 24 nt, Human
ucccucgggcacugacaggaaggu

SEQ ID NO: 1161957 - RNA, 21 nt, Human
ucgcccagcucuggccccagg

SEQ ID NO: 1161958 - RNA, 20 nt, Human
ucguggccucaggccugcug

SEQ ID NO: 1161959 - RNA, 28 nt, Human
ucuauacacgugcucacgcauguacaca

SEQ ID NO: 1161960 - RNA, 22 nt, Human
ucuguggccaucagcccaggaa

SEQ ID NO: 1161961 - RNA, 18 nt, Human
ugaaaaacagcagcauug

SEQ ID NO: 1161962 - RNA, 19 nt, Human
ugagaaggacacccagagc

SEQ ID NO: 1161963 - RNA, 22 nt, Human
ugagaaggacacccagagcagg

SEQ ID NO: 1161964 - RNA, 21 nt, Human
ugcacacacacagguacaucc

SEQ ID NO: 1161965 - RNA, 24 nt, Human
ugcauacacacgcacauucauaca

SEQ ID NO: 1161966 - RNA, 20 nt, Human
ugcauccauacacaugugca

SEQ ID NO: 1161967 - RNA, 27 nt, Human
ugccacacagccaggaagcucagggcg

SEQ ID NO: 1161968 - RNA, 29 nt, Human
ugcccacacacaaaguacacacacguaca

SEQ ID NO: 1161969 - RNA, 28 nt, Human
ugcgcaucacacaugcauacgugcucau

SEQ ID NO: 1161970 - RNA, 24 nt, Human
ugcucacccauacaccagccacac

SEQ ID NO: 1161971 - RNA, 25 nt, Human
ugcucacccauacaccagccacaca

SEQ ID NO: 1161972 - RNA, 22 nt, Human
uggaagcacagcagccguggcg

SEQ ID NO: 1161973 - RNA, 18 nt, Human
uggcccccucccuccggg

SEQ ID NO: 1161974 - RNA, 22 nt, Human
uggccucaggccugcuguccac

SEQ ID NO: 1161975 - RNA, 19 nt, Human
uggcgcaggggcaacuguc

SEQ ID NO: 1161976 - RNA, 18 nt, Human
uggcgcggaggaguaagc

SEQ ID NO: 1161977 - RNA, 19 nt, Human
uggcucugggcaguguggg

SEQ ID NO: 1161978 - RNA, 21 nt, Human
uggcucugggcaguguggggc

SEQ ID NO: 1161979 - RNA, 23 nt, Human
ugggcauggggcggaggaaggag

SEQ ID NO: 1161980 - RNA, 18 nt, Human
uggggccaccccaccccc

SEQ ID NO: 1161981 - RNA, 23 nt, Human
ugguuuuauugaaaaacagcagc

SEQ ID NO: 1161982 - RNA, 25 nt, Human
uguacacaacucaugcacauguaca

SEQ ID NO: 1161983 - RNA, 24 nt, Human
uguacaccuauacacguguacacg

SEQ ID NO: 1161984 - RNA, 28 nt, Human
uguaugcacucauacacucauacauaug

SEQ ID NO: 1161985 - RNA, 19 nt, Human
uuggcccccucccuccggg

SEQ ID NO: 1161986 - RNA, 19 nt, Human
uuggcccccucccuccggg

SEQ ID NO: 1161987 - RNA, 24 nt, Human
acaccgcaauucaaguguuggcua

SEQ ID NO: 1161988 - RNA, 22 nt, Human
acgcccagacugcucuaagggc

SEQ ID NO: 1161989 - RNA, 18 nt, Human
agcccagacggcggcggc

SEQ ID NO: 1161990 - RNA, 20 nt, Human
aggugcuccaagcucuccag

SEQ ID NO: 1161991 - RNA, 19 nt, Human
aguccuuacgcauuagcgg

SEQ ID NO: 1161992 - RNA, 26 nt, Human
cacaagcggccgcccuaaaugcgguc

SEQ ID NO: 1161993 - RNA, 20 nt, Human
cacgccgcgcaggccagccu

SEQ ID NO: 1161994 - RNA, 21 nt, Human
cagcuucccggauccgagccc

SEQ ID NO: 1161995 - RNA, 21 nt, Human
cagggcgucucauuccaccgg

SEQ ID NO: 1161996 - RNA, 23 nt, Human
ccaccccuuuccucucgaaaguc

SEQ ID NO: 1161997 - RNA, 18 nt, Human
ccaccgacgcacucccag

SEQ ID NO: 1161998 - RNA, 21 nt, Human
ccagccucacacaguagcgaa

SEQ ID NO: 1161999 - RNA, 18 nt, Human
cccaccgacgcacuccca

SEQ ID NO: 1162000 - RNA, 19 nt, Human
cccaggugcuccaagcucu

SEQ ID NO: 1162001 - RNA, 18 nt, Human
ccccggacagcuacugcc

SEQ ID NO: 1162002 - RNA, 23 nt, Human
cccgccaccccuuuccucucgaa

SEQ ID NO: 1162003 - RNA, 19 nt, Human
cccgccuuccucccaccug

SEQ ID NO: 1162004 - RNA, 18 nt, Human
cccgcggggcagugcguc

SEQ ID NO: 1162005 - RNA, 24 nt, Human
cccugagccucuccaccuucgaga

SEQ ID NO: 1162006 - RNA, 18 nt, Human
ccgcugccgcggcagcgc

SEQ ID NO: 1162007 - RNA, 21 nt, Human
ccggaggggcucggggcgcgg

SEQ ID NO: 1162008 - RNA, 23 nt, Human
ccggaggggcucggggcgcggcg

SEQ ID NO: 1162009 - RNA, 22 nt, Human
ccggcagccugggcgccgcgac

SEQ ID NO: 1162010 - RNA, 24 nt, Human
ccgucccggacccaccgacgcacu

SEQ ID NO: 1162011 - RNA, 18 nt, Human
ccuuaagaccccaccagg

SEQ ID NO: 1162012 - RNA, 18 nt, Human
ccuuccuucccuaccucc

SEQ ID NO: 1162013 - RNA, 19 nt, Human
ccuucgagauuggccgcag

SEQ ID NO: 1162014 - RNA, 18 nt, Human
cgagagccccugcccagc

SEQ ID NO: 1162015 - RNA, 24 nt, Human
cgagcccagacggcggcggcuccg

SEQ ID NO: 1162016 - RNA, 21 nt, Human
cgcaggccagccucacacagu

SEQ ID NO: 1162017 - RNA, 18 nt, Human
cggaggccccgccguccc

SEQ ID NO: 1162018 - RNA, 26 nt, Human
cggcagcgccgcagcuucccgaaucg

SEQ ID NO: 1162019 - RNA, 18 nt, Human
cgggauggccuggggagc

SEQ ID NO: 1162020 - RNA, 23 nt, Human
cgggcgcaugcuaaucgcaugca

SEQ ID NO: 1162021 - RNA, 19 nt, Human
cguccagaaacucuaaaac

SEQ ID NO: 1162022 - RNA, 21 nt, Human
cguucaaccuuaagaccccac

SEQ ID NO: 1162023 - RNA, 18 nt, Human
cucccagggcuuggcgcu

SEQ ID NO: 1162024 - RNA, 19 nt, Human
cuucacgcccagacugcuc

SEQ ID NO: 1162025 - RNA, 23 nt, Human
cuucgcccgccuuccucccaccu

SEQ ID NO: 1162026 - RNA, 18 nt, Human
gaaauaaauaagcuagga

SEQ ID NO: 1162027 - RNA, 21 nt, Human
gaacacagauccggagguggg

SEQ ID NO: 1162028 - RNA, 20 nt, Human
gaaucuccuucacgcgacuu

SEQ ID NO: 1162029 - RNA, 22 nt, Human
gacggcggcggcuccggcagcc

SEQ ID NO: 1162030 - RNA, 22 nt, Human
gacuuuugcaaucuuccccguu

SEQ ID NO: 1162031 - RNA, 24 nt, Human
gaggaaugcgcaugcagaugaggc

SEQ ID NO: 1162032 - RNA, 19 nt, Human
gagggccaggagcccuggc

SEQ ID NO: 1162033 - RNA, 24 nt, Human
gaucaccuccugaugaauggacua

SEQ ID NO: 1162034 - RNA, 18 nt, Human
gcagcggcgggguuaagc

SEQ ID NO: 1162035 - RNA, 19 nt, Human
gcagugcguccgagcuggu

SEQ ID NO: 1162036 - RNA, 19 nt, Human
gccgcagaugccccgacgg

SEQ ID NO: 1162037 - RNA, 21 nt, Human
gccgcagcuucccggauccga

SEQ ID NO: 1162038 - RNA, 18 nt, Human
gccgcgacccucggcggc

SEQ ID NO: 1162039 - RNA, 18 nt, Human
gcggaacacagauccgga

SEQ ID NO: 1162040 - RNA, 24 nt, Human
gcucggggcgcggcguggggagcc

SEQ ID NO: 1162041 - RNA, 23 nt, Human
ggacuggggcggaacacagaucc

SEQ ID NO: 1162042 - RNA, 22 nt, Human
ggccgcagaugccccgacggga

SEQ ID NO: 1162043 - RNA, 24 nt, Human
gggcagugcguccgagcuggugcg

SEQ ID NO: 1162044 - RNA, 21 nt, Human
gggucaaggggagggagcugg

SEQ ID NO: 1162045 - RNA, 24 nt, Human
guacaccgcaauucaaguguuggc

SEQ ID NO: 1162046 - RNA, 25 nt, Human
guagcgaaucuccuucacgcgacuu

SEQ ID NO: 1162047 - RNA, 23 nt, Human
uaagcuaggaagcaagguuuaau

SEQ ID NO: 1162048 - RNA, 20 nt, Human
ucaaacguucaaccuuaaga

SEQ ID NO: 1162049 - RNA, 19 nt, Human
ucaaccuuaagaccccacc

SEQ ID NO: 1162050 - RNA, 23 nt, Human
ucaggaaugcggcgcgaggaaug

SEQ ID NO: 1162051 - RNA, 18 nt, Human
ucccaccaccccggaccg

SEQ ID NO: 1162052 - RNA, 21 nt, Human
uccggaggagagcuccccgcc

SEQ ID NO: 1162053 - RNA, 20 nt, Human
uccuucgcccgccuuccucc

SEQ ID NO: 1162054 - RNA, 22 nt, Human
ucucauuccaccgggaacuaga

SEQ ID NO: 1162055 - RNA, 19 nt, Human
ugacuugugugaucaccuc

SEQ ID NO: 1162056 - RNA, 21 nt, Human
ugagguuuuuucuccggagga

SEQ ID NO: 1162057 - RNA, 20 nt, Human
ugccgcggcagcgccgcagc

SEQ ID NO: 1162058 - RNA, 18 nt, Human
ugccggaggggcucgggg

SEQ ID NO: 1162059 - RNA, 20 nt, Human
ugcggcgacgccggcagcgg

SEQ ID NO: 1162060 - RNA, 20 nt, Human
uggccuggggagccgaaagc

SEQ ID NO: 1162061 - RNA, 25 nt, Human
uggggucaaggggagggagcuggcc

SEQ ID NO: 1162062 - RNA, 22 nt, Human
uggggugccggaggggcucggg

SEQ ID NO: 1162063 - RNA, 23 nt, Human
ugggugccuuccuucccuaccuc

SEQ ID NO: 1162064 - RNA, 23 nt, Human
uuaguauaacaaauguuuucaag

SEQ ID NO: 1162065 - RNA, 18 nt, Human
uuccucgguguugcuauu

SEQ ID NO: 1162066 - RNA, 21 nt, Human
uugggccaauuuagggaaguc

SEQ ID NO: 1162067 - RNA, 21 nt, Human
uuugugguuucccuagaagac

SEQ ID NO: 1162068 - RNA, 26 nt, Human
acgacacagggcaggcagaaagguaa

SEQ ID NO: 1162069 - RNA, 18 nt, Human
gacuagacaucccagucu

SEQ ID NO: 1162070 - RNA, 22 nt, Human
uacgacacagggcaggcagaaa

SEQ ID NO: 1162071 - RNA, 23 nt, Human
uguucuccaccaagguggugacg

SEQ ID NO: 1162072 - RNA, 24 nt, Human
uucuccaccaagguggugacggug

SEQ ID NO: 1162073 - RNA, 22 nt, Human
aaaaaacagaaagcaaugaagc

SEQ ID NO: 1162074 - RNA, 22 nt, Human
aaacagaaagcaaugaagccua

SEQ ID NO: 1162075 - RNA, 21 nt, Human
aaagcaaugaagccuaaaccc

SEQ ID NO: 1162076 - RNA, 21 nt, Human
aaagcuuucacagugcaugcc

SEQ ID NO: 1162077 - RNA, 23 nt, Human
aacaccuguccaauaacugcccu

SEQ ID NO: 1162078 - RNA, 23 nt, Human
aacagaaagcaaugaagccuaaa

SEQ ID NO: 1162079 - RNA, 21 nt, Human
aagcuuucuuguuagcagucc

SEQ ID NO: 1162080 - RNA, 20 nt, Human
aagggcuccauuucaucacc

SEQ ID NO: 1162081 - RNA, 21 nt, Human
acacgauucaggccacagaug

SEQ ID NO: 1162082 - RNA, 18 nt, Human
acuuagucacacaacauc

SEQ ID NO: 1162083 - RNA, 19 nt, Human
agaggggagagggaauggc

SEQ ID NO: 1162084 - RNA, 18 nt, Human
auuuagaaucuuaaacua

SEQ ID NO: 1162085 - RNA, 26 nt, Human
caacaucaaggacuggugaguuccag

SEQ ID NO: 1162086 - RNA, 22 nt, Human
cacaacaucaaggacuggugag

SEQ ID NO: 1162087 - RNA, 24 nt, Human
cacaaugcaguagaaccaaacaac

SEQ ID NO: 1162088 - RNA, 21 nt, Human
cagcugggccuuucccuccuu

SEQ ID NO: 1162089 - RNA, 19 nt, Human
caguagaaccaaacaacac

SEQ ID NO: 1162090 - RNA, 24 nt, Human
cccaagcagagaaaagguuugaga

SEQ ID NO: 1162091 - RNA, 20 nt, Human
cccuuuggcaagucgaccgg

SEQ ID NO: 1162092 - RNA, 19 nt, Human
cuccacaaugcaguagaac

SEQ ID NO: 1162093 - RNA, 22 nt, Human
cuucagcugggccuuucccucc

SEQ ID NO: 1162094 - RNA, 20 nt, Human
gagaaaccaaacacgauuca

SEQ ID NO: 1162095 - RNA, 24 nt, Human
gcacuggaguagaacgagaaacca

SEQ ID NO: 1162096 - RNA, 22 nt, Human
gccaagugugaagugacacccc

SEQ ID NO: 1162097 - RNA, 21 nt, Human
ggacagguuuggucaucugca

SEQ ID NO: 1162098 - RNA, 19 nt, Human
ggucaguucucuuccccca

SEQ ID NO: 1162099 - RNA, 18 nt, Human
gguuggauagagagggga

SEQ ID NO: 1162100 - RNA, 26 nt, Human
uaaaaaacagaaagcaaugaagccua

SEQ ID NO: 1162101 - RNA, 21 nt, Human
uaaaauaauuucccaagcaga

SEQ ID NO: 1162102 - RNA, 25 nt, Human
uacaauagaauguuuaaauaacacc

SEQ ID NO: 1162103 - RNA, 21 nt, Human
uagaaccaaacaacacauuca

SEQ ID NO: 1162104 - RNA, 25 nt, Human
uagggcauuuuuaguagaacuucag

SEQ ID NO: 1162105 - RNA, 20 nt, Human
ucccaagcagagaaaagguu

SEQ ID NO: 1162106 - RNA, 23 nt, Human
ucccaagcagagaaaagguuuga

SEQ ID NO: 1162107 - RNA, 21 nt, Human
ugaagugacacccccagcaga

SEQ ID NO: 1162108 - RNA, 23 nt, Human
ugaggaaaguggcagcaggacag

SEQ ID NO: 1162109 - RNA, 23 nt, Human
ugcacaggaugcaggcaaaggag

SEQ ID NO: 1162110 - RNA, 18 nt, Human
ugcaugccaagugugaag

SEQ ID NO: 1162111 - RNA, 23 nt, Human
ugccaagugugaagugacacccc

SEQ ID NO: 1162112 - RNA, 25 nt, Human
ugccuauucuccuagggcauuuuua

SEQ ID NO: 1162113 - RNA, 24 nt, Human
ugguuaaaaaugucauguugugca

SEQ ID NO: 1162114 - RNA, 20 nt, Human
uuagcaguccuuucaugcau

SEQ ID NO: 1162115 - RNA, 22 nt, Human
uuggggaaaaguaaaaaacaga

SEQ ID NO: 1162116 - RNA, 22 nt, Human
uuuagaaucuuaaacuaaaucc

SEQ ID NO: 1162117 - RNA, 19 nt, Human
uuuuagauuggauugguua

SEQ ID NO: 1162118 - RNA, 24 nt, Human
aaaaaaaaagccuuccuuacaaaa

SEQ ID NO: 1162119 - RNA, 23 nt, Human
aaaaaagccuuccuuacaaaacc

SEQ ID NO: 1162120 - RNA, 20 nt, Human
aaaacauaacuccaaauggu

SEQ ID NO: 1162121 - RNA, 18 nt, Human
aaaaccacaacucucuca

SEQ ID NO: 1162122 - RNA, 19 nt, Human
aaaaccugccaacccugau

SEQ ID NO: 1162123 - RNA, 18 nt, Human
aaacaggucccaaggaag

SEQ ID NO: 1162124 - RNA, 24 nt, Human
aaacauaacuccaaauggucagca

SEQ ID NO: 1162125 - RNA, 19 nt, Human
aaagaacaggacagaaucu

SEQ ID NO: 1162126 - RNA, 23 nt, Human
aaagauagaauagacgaaaggga

SEQ ID NO: 1162127 - RNA, 18 nt, Human
aaaguguggaguggggag

SEQ ID NO: 1162128 - RNA, 24 nt, Human
aacaaaaagaacaggacagaaucu

SEQ ID NO: 1162129 - RNA, 22 nt, Human
aagaaacaaaaagaacaggaca

SEQ ID NO: 1162130 - RNA, 21 nt, Human
aagacaucuuccacucaaccc

SEQ ID NO: 1162131 - RNA, 23 nt, Human
aagacaucuuccacucaacccaa

SEQ ID NO: 1162132 - RNA, 19 nt, Human
aagccucagcuucucccug

SEQ ID NO: 1162133 - RNA, 18 nt, Human
aagcuccacaaaauggua

SEQ ID NO: 1162134 - RNA, 19 nt, Human
aauuaugugcauuugcauu

SEQ ID NO: 1162135 - RNA, 19 nt, Human
aauuuguugggugaaaacu

SEQ ID NO: 1162136 - RNA, 18 nt, Human
accuggguuugaaccuuc

SEQ ID NO: 1162137 - RNA, 19 nt, Human
acucaggcagcaucuggau

SEQ ID NO: 1162138 - RNA, 20 nt, Human
acuuacuauuaucucccaaa

SEQ ID NO: 1162139 - RNA, 21 nt, Human
agacauaaauagaacaguaua

SEQ ID NO: 1162140 - RNA, 18 nt, Human
agagagagugucuugaaa

SEQ ID NO: 1162141 - RNA, 22 nt, Human
agauaaccauuucuaaggugaa

SEQ ID NO: 1162142 - RNA, 18 nt, Human
agcccauccuucucccca

SEQ ID NO: 1162143 - RNA, 21 nt, Human
agcuccauagccucuugccuu

SEQ ID NO: 1162144 - RNA, 21 nt, Human
aggaagaaucuaaaaccucau

SEQ ID NO: 1162145 - RNA, 19 nt, Human
agucugcauugcucccucu

SEQ ID NO: 1162146 - RNA, 18 nt, Human
aguguguauuauggguag

SEQ ID NO: 1162147 - RNA, 26 nt, Human
aguuuuucuuuuauuuuuccuucccu

SEQ ID NO: 1162148 - RNA, 20 nt, Human
augaagaaacaaaaagaaca

SEQ ID NO: 1162149 - RNA, 21 nt, Human
auuucacucuaaaucuuacua

SEQ ID NO: 1162150 - RNA, 22 nt, Human
caaaaccugccaacccugauca

SEQ ID NO: 1162151 - RNA, 21 nt, Human
caaagauaaccauuucuaagg

SEQ ID NO: 1162152 - RNA, 20 nt, Human
caaagcaauacuacuaagac

SEQ ID NO: 1162153 - RNA, 21 nt, Human
caaauuugugacccaauccua

SEQ ID NO: 1162154 - RNA, 22 nt, Human
cacaacaguggaauaggcgaaa

SEQ ID NO: 1162155 - RNA, 19 nt, Human
cacaucacagcaagucaau

SEQ ID NO: 1162156 - RNA, 26 nt, Human
caccaaggaaugcaacugaacaugac

SEQ ID NO: 1162157 - RNA, 27 nt, Human
caccaaggaaugcaacugaacaugaca

SEQ ID NO: 1162158 - RNA, 20 nt, Human
caggacagaaucuuauucug

SEQ ID NO: 1162159 - RNA, 24 nt, Human
caguuaggaaauuucaaaucaaac

SEQ ID NO: 1162160 - RNA, 20 nt, Human
cauaaaaaccagagccuugu

SEQ ID NO: 1162161 - RNA, 25 nt, Human
cauaucugcucucuacgacacaaaa

SEQ ID NO: 1162162 - RNA, 19 nt, Human
caugaagaaacaaaaagaa

SEQ ID NO: 1162163 - RNA, 25 nt, Human
ccaaggaaugcaacugaacaugaca

SEQ ID NO: 1162164 - RNA, 23 nt, Human
ccagcucagauaaaaaaaaaaaa

SEQ ID NO: 1162165 - RNA, 26 nt, Human
ccagcucagauaaaaaaaaaaaaaag

SEQ ID NO: 1162166 - RNA, 21 nt, Human
ccauaaauucauguauuuaaa

SEQ ID NO: 1162167 - RNA, 24 nt, Human
cccaaggaagcauuuucuaaaaca

SEQ ID NO: 1162168 - RNA, 18 nt, Human
cccugccuccuccacaaa

SEQ ID NO: 1162169 - RNA, 28 nt, Human
ccugccuccuccacaaacuuuuuuuuuc

SEQ ID NO: 1162170 - RNA, 21 nt, Human
ccugugugaaauggguuuaau

SEQ ID NO: 1162171 - RNA, 22 nt, Human
cucaacccaaauguuauagaau

SEQ ID NO: 1162172 - RNA, 22 nt, Human
cuccauaacugaaagucuugcu

SEQ ID NO: 1162173 - RNA, 22 nt, Human
cugaaagucuugcucaccacug

SEQ ID NO: 1162174 - RNA, 19 nt, Human
cugccuccuccacaaacuu

SEQ ID NO: 1162175 - RNA, 19 nt, Human
cugcucugguucuaaagcc

SEQ ID NO: 1162176 - RNA, 24 nt, Human
cuuacaaaaccugccaacccugau

SEQ ID NO: 1162177 - RNA, 22 nt, Human
gaaggaaacaggucccaaggaa

SEQ ID NO: 1162178 - RNA, 22 nt, Human
gacugaguaauucaccuguggc

SEQ ID NO: 1162179 - RNA, 20 nt, Human
gagcccauccuucuccccac

SEQ ID NO: 1162180 - RNA, 21 nt, Human
gccaaauuaucaauaaaaagu

SEQ ID NO: 1162181 - RNA, 21 nt, Human
ggaaagauugauucaacccuc

SEQ ID NO: 1162182 - RNA, 21 nt, Human
ggaacacuacuuaacaaagca

SEQ ID NO: 1162183 - RNA, 24 nt, Human
ggaguggggaggucuuccuaggga

SEQ ID NO: 1162184 - RNA, 20 nt, Human
ggugacagugccaggaaaga

SEQ ID NO: 1162185 - RNA, 23 nt, Human
gguggguugaauaucagaaaacc

SEQ ID NO: 1162186 - RNA, 20 nt, Human
guaaagcacuacucagagag

SEQ ID NO: 1162187 - RNA, 18 nt, Human
guagauaauuuguugggu

SEQ ID NO: 1162188 - RNA, 18 nt, Human
gucuagacauaaauagaa

SEQ ID NO: 1162189 - RNA, 23 nt, Human
gugaagcugccuuagaaaaccac

SEQ ID NO: 1162190 - RNA, 24 nt, Human
uaaaacucauaaaaaccagagccu

SEQ ID NO: 1162191 - RNA, 24 nt, Human
uaaaauucuaaaagugaaauguca

SEQ ID NO: 1162192 - RNA, 22 nt, Human
uaagacaucuuccacucaaccc

SEQ ID NO: 1162193 - RNA, 18 nt, Human
uaaggccucugcccacac

SEQ ID NO: 1162194 - RNA, 20 nt, Human
uacauauaaaguugacacac

SEQ ID NO: 1162195 - RNA, 18 nt, Human
uacaugguaaaugcugga

SEQ ID NO: 1162196 - RNA, 24 nt, Human
uacccauaugacuuucaggaagaa

SEQ ID NO: 1162197 - RNA, 23 nt, Human
uacuaagacaucuuccacucaac

SEQ ID NO: 1162198 - RNA, 20 nt, Human
uagaaaauagaugaaaggaa

SEQ ID NO: 1162199 - RNA, 24 nt, Human
uagaauagacgaaagggaaacagu

SEQ ID NO: 1162200 - RNA, 21 nt, Human
uaggcgaaaccugguuuccug

SEQ ID NO: 1162201 - RNA, 20 nt, Human
uaguagauaauuuguugggg

SEQ ID NO: 1162202 - RNA, 19 nt, Human
uauuauggguagcacagag

SEQ ID NO: 1162203 - RNA, 20 nt, Human
ucacaggccaguaagacugu

SEQ ID NO: 1162204 - RNA, 19 nt, Human
ucacucuuaccucaguguu

SEQ ID NO: 1162205 - RNA, 22 nt, Human
ucacuguauguuacaccgggca

SEQ ID NO: 1162206 - RNA, 20 nt, Human
ucagauaaaaaaaaaaaagc

SEQ ID NO: 1162207 - RNA, 25 nt, Human
ucaugccaaacacaacaguggaaua

SEQ ID NO: 1162208 - RNA, 20 nt, Human
uccaacuucaaauuugugac

SEQ ID NO: 1162209 - RNA, 20 nt, Human
uccacaaaaugguaaagcac

SEQ ID NO: 1162210 - RNA, 19 nt, Human
uccagcucagauaaaaaaa

SEQ ID NO: 1162211 - RNA, 22 nt, Human
uccauagccucuugccuuuaau

SEQ ID NO: 1162212 - RNA, 25 nt, Human
uccauagccucuugccuuugguccc

SEQ ID NO: 1162213 - RNA, 18 nt, Human
ucccauagguacacacug

SEQ ID NO: 1162214 - RNA, 20 nt, Human
ucccauagguacacacugcc

SEQ ID NO: 1162215 - RNA, 20 nt, Human
uccugggcucauguuucaau

SEQ ID NO: 1162216 - RNA, 18 nt, Human
ucuacuauuaccuuucaa

SEQ ID NO: 1162217 - RNA, 18 nt, Human
ucugugucugcucugguu

SEQ ID NO: 1162218 - RNA, 18 nt, Human
ugaaugaauaaaugaaca

SEQ ID NO: 1162219 - RNA, 20 nt, Human
ugaaugccacuuaucuauag

SEQ ID NO: 1162220 - RNA, 22 nt, Human
ugacauaaaacucauaaaaacc

SEQ ID NO: 1162221 - RNA, 21 nt, Human
ugagagcacucucuccauaac

SEQ ID NO: 1162222 - RNA, 19 nt, Human
ugcccuugacuauccagcu

SEQ ID NO: 1162223 - RNA, 23 nt, Human
ugcuaugggguuacugcucugaa

SEQ ID NO: 1162224 - RNA, 26 nt, Human
ugcucccucuacccauaugacuuuca

SEQ ID NO: 1162225 - RNA, 22 nt, Human
uggaacacuacuuaacaaagca

SEQ ID NO: 1162226 - RNA, 21 nt, Human
uggaauaggcgaaaccugguu

SEQ ID NO: 1162227 - RNA, 20 nt, Human
uggaguggggaggucuuccu

SEQ ID NO: 1162228 - RNA, 19 nt, Human
uggccuuuaguagauaauu

SEQ ID NO: 1162229 - RNA, 20 nt, Human
ugggaggugcaagaauugau

SEQ ID NO: 1162230 - RNA, 24 nt, Human
ugggaggugcaagaauugaucuua

SEQ ID NO: 1162231 - RNA, 19 nt, Human
uguacuucaccauacuacu

SEQ ID NO: 1162232 - RNA, 24 nt, Human
uuaaaaggaaauuagaauggccug

SEQ ID NO: 1162233 - RNA, 19 nt, Human
uuaaagauucucaugcaca

SEQ ID NO: 1162234 - RNA, 25 nt, Human
uucaccuguggcugacauaauugag

SEQ ID NO: 1162235 - RNA, 19 nt, Human
uucccugccuccuccacaa

SEQ ID NO: 1162236 - RNA, 19 nt, Human
uugacuauccagcucagau

SEQ ID NO: 1162237 - RNA, 24 nt, Human
uuucaggaagaaucuaaaaccucc

SEQ ID NO: 1162238 - RNA, 18 nt, Human
aaaacccagggagaccag

SEQ ID NO: 1162239 - RNA, 24 nt, Human
aaaccaagcccucgcaggagccag

SEQ ID NO: 1162240 - RNA, 18 nt, Human
aaauuguccaauacccuc

SEQ ID NO: 1162241 - RNA, 19 nt, Human
acaagcacugguaaacucc

SEQ ID NO: 1162242 - RNA, 21 nt, Human
acagagcaacgggaggcagag

SEQ ID NO: 1162243 - RNA, 18 nt, Human
agacaggugaccaggucu

SEQ ID NO: 1162244 - RNA, 18 nt, Human
agagcugaagcccuaaac

SEQ ID NO: 1162245 - RNA, 18 nt, Human
aggucuggguuagagauc

SEQ ID NO: 1162246 - RNA, 21 nt, Human
auuugcuguguaaagacacug

SEQ ID NO: 1162247 - RNA, 19 nt, Human
cacaaaacccagggagacc

SEQ ID NO: 1162248 - RNA, 19 nt, Human
caccgaggccucccggagc

SEQ ID NO: 1162249 - RNA, 23 nt, Human
cagagagcugaagcccuaaacca

SEQ ID NO: 1162250 - RNA, 20 nt, Human
cagagcaacgggaggcagag

SEQ ID NO: 1162251 - RNA, 18 nt, Human
caggucacagagcaacgg

SEQ ID NO: 1162252 - RNA, 24 nt, Human
ccaagcccucgcaggagccagagg

SEQ ID NO: 1162253 - RNA, 18 nt, Human
cgagaacgcagagagcug

SEQ ID NO: 1162254 - RNA, 22 nt, Human
cgaggccucccggagccgagaa

SEQ ID NO: 1162255 - RNA, 20 nt, Human
cucuccagcaugaauuccug

SEQ ID NO: 1162256 - RNA, 18 nt, Human
cugaagcccuaaaccaag

SEQ ID NO: 1162257 - RNA, 21 nt, Human
cugcugggcaggguccagaca

SEQ ID NO: 1162258 - RNA, 21 nt, Human
cuguggcugaaucaccgaggc

SEQ ID NO: 1162259 - RNA, 20 nt, Human
gaauucuauggccacauccc

SEQ ID NO: 1162260 - RNA, 20 nt, Human
gagaacauauagcugggggu

SEQ ID NO: 1162261 - RNA, 18 nt, Human
gcugaaucaccgaggccu

SEQ ID NO: 1162262 - RNA, 19 nt, Human
ggagaauucuauggccaca

SEQ ID NO: 1162263 - RNA, 24 nt, Human
gggcaggguccagacauuuccacu

SEQ ID NO: 1162264 - RNA, 21 nt, Human
ggguuucucuccaguaugucu

SEQ ID NO: 1162265 - RNA, 19 nt, Human
guaaauucucauguccaca

SEQ ID NO: 1162266 - RNA, 22 nt, Human
uaaagacacuggaauuagagau

SEQ ID NO: 1162267 - RNA, 19 nt, Human
uaaaggguuucucuccagu

SEQ ID NO: 1162268 - RNA, 20 nt, Human
uacacucauucacacguuua

SEQ ID NO: 1162269 - RNA, 18 nt, Human
ucacagagcaacgggagg

SEQ ID NO: 1162270 - RNA, 22 nt, Human
ucaguauaaguuugucggaacc

SEQ ID NO: 1162271 - RNA, 23 nt, Human
ucauguccacauuucucguaucu

SEQ ID NO: 1162272 - RNA, 24 nt, Human
uccaauuuauuugcuguguaaaga

SEQ ID NO: 1162273 - RNA, 26 nt, Human
uccccugcacuggugaaaggucuugg

SEQ ID NO: 1162274 - RNA, 20 nt, Human
ucguaucuuuucaguauaag

SEQ ID NO: 1162275 - RNA, 19 nt, Human
ucuccagcaugaauuccug

SEQ ID NO: 1162276 - RNA, 20 nt, Human
ucugcaccuuacacucauuc

SEQ ID NO: 1162277 - RNA, 24 nt, Human
ugaaaggagaacauauagcugggg

SEQ ID NO: 1162278 - RNA, 21 nt, Human
ugaagcccuaaaccaagcccu

SEQ ID NO: 1162279 - RNA, 20 nt, Human
ugacauguaaaacgaucugc

SEQ ID NO: 1162280 - RNA, 21 nt, Human
ugccacauuuuucacauugua

SEQ ID NO: 1162281 - RNA, 23 nt, Human
uguaggguuucucuccagcauga

SEQ ID NO: 1162282 - RNA, 23 nt, Human
uguaggguuucucuccaguauga

SEQ ID NO: 1162283 - RNA, 20 nt, Human
uguguaggguuucucuccag

SEQ ID NO: 1162284 - RNA, 19 nt, Human
uucuccaacaucacaucuc

SEQ ID NO: 1162285 - RNA, 19 nt, Human
uugaguuaggugugacaug

SEQ ID NO: 1162286 - RNA, 19 nt, Human
uugcagggcucuuuuauuu

SEQ ID NO: 1162287 - RNA, 20 nt, Human
uuuaacacauguauuacauu

SEQ ID NO: 1162288 - RNA, 20 nt, Human
aaggagccccugccaccugc

SEQ ID NO: 1162289 - RNA, 24 nt, Human
acagaagcgccacagccggggagc

SEQ ID NO: 1162290 - RNA, 22 nt, Human
aggagcuggaggccaaggagcc

SEQ ID NO: 1162291 - RNA, 20 nt, Human
aggguucccuaacuuuuccc

SEQ ID NO: 1162292 - RNA, 22 nt, Human
aggguucccuaacuuuucccuu

SEQ ID NO: 1162293 - RNA, 21 nt, Human
agucaucuagagagcaaauac

SEQ ID NO: 1162294 - RNA, 22 nt, Human
auccacagaagcgccacagccg

SEQ ID NO: 1162295 - RNA, 23 nt, Human
augauccaucuucugagcuucuc

SEQ ID NO: 1162296 - RNA, 23 nt, Human
caacacaccuauuuacaaaggca

SEQ ID NO: 1162297 - RNA, 24 nt, Human
cacagagucugcucucugcucuga

SEQ ID NO: 1162298 - RNA, 19 nt, Human
cacuuccaaacaaauucaa

SEQ ID NO: 1162299 - RNA, 20 nt, Human
cagagcccaguuuucgaggc

SEQ ID NO: 1162300 - RNA, 27 nt, Human
cagggugcacacaccccugcaggucuc

SEQ ID NO: 1162301 - RNA, 19 nt, Human
cauguuugcagcccuaggc

SEQ ID NO: 1162302 - RNA, 19 nt, Human
ccacaguccccuccaaguc

SEQ ID NO: 1162303 - RNA, 21 nt, Human
cccacauccacagaagcgcca

SEQ ID NO: 1162304 - RNA, 24 nt, Human
ccccugcaggucucagggcuccug

SEQ ID NO: 1162305 - RNA, 18 nt, Human
cuccucagucccacaguc

SEQ ID NO: 1162306 - RNA, 18 nt, Human
cucugcucugagcuccuc

SEQ ID NO: 1162307 - RNA, 18 nt, Human
cugcucccugccuggccu

SEQ ID NO: 1162308 - RNA, 19 nt, Human
cuggcacggaagcuuuucc

SEQ ID NO: 1162309 - RNA, 19 nt, Human
cuucggagucaccgcacag

SEQ ID NO: 1162310 - RNA, 19 nt, Human
gaccauauuuacucuaucu

SEQ ID NO: 1162311 - RNA, 22 nt, Human
gagcaaauacacaguaauuccc

SEQ ID NO: 1162312 - RNA, 21 nt, Human
gaggcugaggaaagaccccga

SEQ ID NO: 1162313 - RNA, 20 nt, Human
gcagagaucccugaccacac

SEQ ID NO: 1162314 - RNA, 18 nt, Human
gcagaucccugcaucugc

SEQ ID NO: 1162315 - RNA, 19 nt, Human
ggcaacgaaucucucuggc

SEQ ID NO: 1162316 - RNA, 20 nt, Human
gggcacagcggaagggcugc

SEQ ID NO: 1162317 - RNA, 22 nt, Human
ggucaccuuuuaauuggaccau

SEQ ID NO: 1162318 - RNA, 23 nt, Human
ggugcagggcuaugccucagggu

SEQ ID NO: 1162319 - RNA, 18 nt, Human
gucacggccaugauccau

SEQ ID NO: 1162320 - RNA, 21 nt, Human
uacaaugucccucaccagaau

SEQ ID NO: 1162321 - RNA, 22 nt, Human
ucagcagagaucccugaccaca

SEQ ID NO: 1162322 - RNA, 19 nt, Human
ucaucaaggagauucuccu

SEQ ID NO: 1162323 - RNA, 19 nt, Human
ucccacaguccccuccaag

SEQ ID NO: 1162324 - RNA, 21 nt, Human
uccccuccaagucacaggagc

SEQ ID NO: 1162325 - RNA, 23 nt, Human
ucccucaccagaauucaaugagg

SEQ ID NO: 1162326 - RNA, 23 nt, Human
ucccugcaucugcucccugccug

SEQ ID NO: 1162327 - RNA, 25 nt, Human
uccuggguugcuucuggaagggccc

SEQ ID NO: 1162328 - RNA, 19 nt, Human
ucugcucccugccuggccu

SEQ ID NO: 1162329 - RNA, 20 nt, Human
ugaccacacccucauguguu

SEQ ID NO: 1162330 - RNA, 23 nt, Human
ugaccacacccucauguguuuuc

SEQ ID NO: 1162331 - RNA, 19 nt, Human
ugagaauuuuauucacuuc

SEQ ID NO: 1162332 - RNA, 23 nt, Human
ugagcuccucagucccacagucc

SEQ ID NO: 1162333 - RNA, 21 nt, Human
ugaggaaagaccccgagagcg

SEQ ID NO: 1162334 - RNA, 23 nt, Human
ugaggcagaucccugcaucugcu

SEQ ID NO: 1162335 - RNA, 22 nt, Human
ugcaccucucaggguucccuaa

SEQ ID NO: 1162336 - RNA, 24 nt, Human
uucuuccccaagguaagucuguca

SEQ ID NO: 1162337 - RNA, 23 nt, Human
uuuacaaaggcauuccagagccc

SEQ ID NO: 1162338 - RNA, 20 nt, Human
uuuuccuggcgcguuuccgg

SEQ ID NO: 1162339 - RNA, 23 nt, Human
uuuuucagggguugauuuuuggg

SEQ ID NO: 1162340 - RNA, 28 nt, Human
aaggcauuuuccacacuguuugcugaca

SEQ ID NO: 1162341 - RNA, 19 nt, Human
aguaugaauuuguuuaugu

SEQ ID NO: 1162342 - RNA, 18 nt, Human
gcauuuuccacacuguuu

SEQ ID NO: 1162343 - RNA, 22 nt, Human
ggggacaaaagauuaugaaggc

SEQ ID NO: 1162344 - RNA, 20 nt, Human
uaguaugaauuuguuuaugu

SEQ ID NO: 1162345 - RNA, 19 nt, Human
ugaguuauuguggaacugu

SEQ ID NO: 1162346 - RNA, 22 nt, Human
uugcugacauaggguuucuuuc

SEQ ID NO: 1162347 - RNA, 20 nt, Human
aaaaaauagcaacaauuugg

SEQ ID NO: 1162348 - RNA, 23 nt, Human
aaacaauguuuuagaaagauuuu

SEQ ID NO: 1162349 - RNA, 24 nt, Human
aauagcaacaauuuggggauaaaa

SEQ ID NO: 1162350 - RNA, 24 nt, Human
agccuccacaauaguauucuuuag

SEQ ID NO: 1162351 - RNA, 19 nt, Human
aggaggaagcugaauagaa

SEQ ID NO: 1162352 - RNA, 23 nt, Human
aucgaaaucccaccgggcugcaa

SEQ ID NO: 1162353 - RNA, 18 nt, Human
cacccaucugacuuccag

SEQ ID NO: 1162354 - RNA, 18 nt, Human
cagcaaaucgaaauccca

SEQ ID NO: 1162355 - RNA, 24 nt, Human
ccaagaaauuacauuucacauccc

SEQ ID NO: 1162356 - RNA, 21 nt, Human
ccuccuuguccguucagcaaa

SEQ ID NO: 1162357 - RNA, 18 nt, Human
cuuguaaagagagucauc

SEQ ID NO: 1162358 - RNA, 22 nt, Human
gaaacauugcacuuaaagcuca

SEQ ID NO: 1162359 - RNA, 21 nt, Human
gccucccauaauccgaaaguc

SEQ ID NO: 1162360 - RNA, 24 nt, Human
gcuuguaaagagagucaucaguug

SEQ ID NO: 1162361 - RNA, 18 nt, Human
uaaguaaaauccaaaacu

SEQ ID NO: 1162362 - RNA, 20 nt, Human
uacaagccugaaauauuaag

SEQ ID NO: 1162363 - RNA, 25 nt, Human
uacaagccugaaauauuaaguacaa

SEQ ID NO: 1162364 - RNA, 23 nt, Human
ucacagggguaaccacaguacgu

SEQ ID NO: 1162365 - RNA, 22 nt, Human
ucccaccgggcugcaacagcau

SEQ ID NO: 1162366 - RNA, 18 nt, Human
ucccucuggaucccgccu

SEQ ID NO: 1162367 - RNA, 19 nt, Human
ugaaacauugcacuuaaag

SEQ ID NO: 1162368 - RNA, 18 nt, Human
ugaauagaagccuccaca

SEQ ID NO: 1162369 - RNA, 19 nt, Human
ugaauagaagccuccacaa

SEQ ID NO: 1162370 - RNA, 19 nt, Human
ugacuuccagccuccuugu

SEQ ID NO: 1162371 - RNA, 23 nt, Human
ugaguugaagcuuguaaagagag

SEQ ID NO: 1162372 - RNA, 20 nt, Human
ugcuuuggugagaaaaggga

SEQ ID NO: 1162373 - RNA, 20 nt, Human
uggggauaaaaauaaguaaa

SEQ ID NO: 1162374 - RNA, 25 nt, Human
ugugguggguaucuacauucacacc

SEQ ID NO: 1162375 - RNA, 18 nt, Human
uuaaaugcucauagcuuc

SEQ ID NO: 1162376 - RNA, 21 nt, Human
uuaacagggauguggugggua

SEQ ID NO: 1162377 - RNA, 20 nt, Human
uuguuucagauccuaaaaaa

SEQ ID NO: 1162378 - RNA, 22 nt, Human
uuuugcuuuggugagaaaaggg

SEQ ID NO: 1162379 - RNA, 24 nt, Human
uuuugcuuuggugagaaaagggaa

SEQ ID NO: 1162380 - RNA, 18 nt, Human
aaaaaaaaacaggccggg

SEQ ID NO: 1162381 - RNA, 25 nt, Human
aaaaacaaaccaacaaaaaaaaaac

SEQ ID NO: 1162382 - RNA, 24 nt, Human
aaaaauacaaaaauuagccgugcg

SEQ ID NO: 1162383 - RNA, 24 nt, Human
aaacaaaccaacaaaaaaaaaaca

SEQ ID NO: 1162384 - RNA, 27 nt, Human
aaacaaaccaacaaaaaaaaaacaggc

SEQ ID NO: 1162385 - RNA, 19 nt, Human
aacauggugaaaccccguc

SEQ ID NO: 1162386 - RNA, 20 nt, Human
aacauggugaaaccccgucu

SEQ ID NO: 1162387 - RNA, 21 nt, Human
aacauggugaaaccccgucuc

SEQ ID NO: 1162388 - RNA, 18 nt, Human
aacauggugaaacccguc

SEQ ID NO: 1162389 - RNA, 19 nt, Human
aacauggugaaacccguca

SEQ ID NO: 1162390 - RNA, 19 nt, Human
aagaguaauggauggaugg

SEQ ID NO: 1162391 - RNA, 24 nt, Human
aauugcuugaacccgggaggcaga

SEQ ID NO: 1162392 - RNA, 20 nt, Human
acagagcgagacuccgucuc

SEQ ID NO: 1162393 - RNA, 23 nt, Human
acagagcgagacuccgucucaaa

SEQ ID NO: 1162394 - RNA, 24 nt, Human
acagagcgagacuccgucucaaaa

SEQ ID NO: 1162395 - RNA, 24 nt, Human
accaacauggugaaaccccgucuc

SEQ ID NO: 1162396 - RNA, 24 nt, Human
accccgucucaacuaaaaauacaa

SEQ ID NO: 1162397 - RNA, 22 nt, Human
acgccacugcauuccagccugg

SEQ ID NO: 1162398 - RNA, 24 nt, Human
acgccacugcauuccagccugggc

SEQ ID NO: 1162399 - RNA, 23 nt, Human
acuaaaaaauacaaaaaaaaaaa

SEQ ID NO: 1162400 - RNA, 24 nt, Human
acugcacuccaggcugggcgacag

SEQ ID NO: 1162401 - RNA, 26 nt, Human
acugcacuccaggcugggcgacagag

SEQ ID NO: 1162402 - RNA, 24 nt, Human
acugcauuccagccugggcgacag

SEQ ID NO: 1162403 - RNA, 26 nt, Human
acugcauuccagccugggcgacagag

SEQ ID NO: 1162404 - RNA, 24 nt, Human
agagguugcagugaucugagauca

SEQ ID NO: 1162405 - RNA, 24 nt, Human
agccugaccaacauggugaaaccc

SEQ ID NO: 1162406 - RNA, 24 nt, Human
agccugggcgacagagugagauuu

SEQ ID NO: 1162407 - RNA, 18 nt, Human
aggcagagguugcaguga

SEQ ID NO: 1162408 - RNA, 24 nt, Human
aggcagagguugcagugaucugag

SEQ ID NO: 1162409 - RNA, 24 nt, Human
aggcaggagaauugcuugaacccg

SEQ ID NO: 1162410 - RNA, 21 nt, Human
aggccgaggcgggcggaucac

SEQ ID NO: 1162411 - RNA, 23 nt, Human
aggccgaggcgggcggaucacga

SEQ ID NO: 1162412 - RNA, 24 nt, Human
aggcggagcuugcagugagcggag

SEQ ID NO: 1162413 - RNA, 24 nt, Human
aggcgggcggaucacgaggucagg

SEQ ID NO: 1162414 - RNA, 24 nt, Human
aggcgggcggaucacgaggucagg

SEQ ID NO: 1162415 - RNA, 21 nt, Human
aggcugaggcaggagaauugc

SEQ ID NO: 1162416 - RNA, 24 nt, Human
aggcugaggcaggagaauugcuug

SEQ ID NO: 1162417 - RNA, 24 nt, Human
aggcugggcgacagagcgagacuc

SEQ ID NO: 1162418 - RNA, 21 nt, Human
aucacgaggucaggaguucaa

SEQ ID NO: 1162419 - RNA, 22 nt, Human
aucacgaggucaggaguucaag

SEQ ID NO: 1162420 - RNA, 24 nt, Human
aucacgccacugcauuccagccug

SEQ ID NO: 1162421 - RNA, 20 nt, Human
aucucucagugcuuaucaau

SEQ ID NO: 1162422 - RNA, 20 nt, Human
augccuguaaaucccagcac

SEQ ID NO: 1162423 - RNA, 21 nt, Human
caaaccaacaaaaaaaaaaca

SEQ ID NO: 1162424 - RNA, 23 nt, Human
caacauggugaaaccccgucuca

SEQ ID NO: 1162425 - RNA, 18 nt, Human
caagaacagccugaccaa

SEQ ID NO: 1162426 - RNA, 23 nt, Human
caauaccgaggaucaauaggcga

SEQ ID NO: 1162427 - RNA, 22 nt, Human
caccgcccgcuguucguauguc

SEQ ID NO: 1162428 - RNA, 21 nt, Human
caccuguaaucccagcuacuc

SEQ ID NO: 1162429 - RNA, 24 nt, Human
caccuguaaucccagcuacucagg

SEQ ID NO: 1162430 - RNA, 24 nt, Human
cacgccuguaaucccagcucuuug

SEQ ID NO: 1162431 - RNA, 23 nt, Human
cacuccaggcugggcgacagagc

SEQ ID NO: 1162432 - RNA, 19 nt, Human
cacugcacuccaggcuggg

SEQ ID NO: 1162433 - RNA, 22 nt, Human
cacugcacuccaggcugggcga

SEQ ID NO: 1162434 - RNA, 23 nt, Human
cacugcacuccaggcugggcgac

SEQ ID NO: 1162435 - RNA, 24 nt, Human
cacugcacuccaggcugggcgaca

SEQ ID NO: 1162436 - RNA, 19 nt, Human
cacugcauuccagccuggg

SEQ ID NO: 1162437 - RNA, 22 nt, Human
cacugcauuccagccugggcga

SEQ ID NO: 1162438 - RNA, 23 nt, Human
cacugcauuccagccugggcgac

SEQ ID NO: 1162439 - RNA, 24 nt, Human
cacugcauuccagccugggcgaca

SEQ ID NO: 1162440 - RNA, 25 nt, Human
cagaggcgggcggaucacgagguca

SEQ ID NO: 1162441 - RNA, 24 nt, Human
cagcacucugggaggccgaggcgg

SEQ ID NO: 1162442 - RNA, 20 nt, Human
cagccugggcgacagaguga

SEQ ID NO: 1162443 - RNA, 24 nt, Human
cagcuacucaggaggcugaggcag

SEQ ID NO: 1162444 - RNA, 24 nt, Human
cagcucuuugggagacagaggcgg

SEQ ID NO: 1162445 - RNA, 23 nt, Human
caggccgggcgcgguggcucaug

SEQ ID NO: 1162446 - RNA, 20 nt, Human
caguuugggcaauaaggugc

SEQ ID NO: 1162447 - RNA, 20 nt, Human
caugacacagccuccggaga

SEQ ID NO: 1162448 - RNA, 21 nt, Human
caugccuguaaaucccagcac

SEQ ID NO: 1162449 - RNA, 24 nt, Human
cauuccagccugggcgacagagug

SEQ ID NO: 1162450 - RNA, 20 nt, Human
ccaacaaaaaaaaaacaggc

SEQ ID NO: 1162451 - RNA, 21 nt, Human
ccaacaaaaaaaaaacaggcc

SEQ ID NO: 1162452 - RNA, 20 nt, Human
ccacugcacuccaggcuggg

SEQ ID NO: 1162453 - RNA, 21 nt, Human
ccacugcacuccaggcugggc

SEQ ID NO: 1162454 - RNA, 24 nt, Human
ccacugcacuccaggcugggcgac

SEQ ID NO: 1162455 - RNA, 20 nt, Human
ccacugcauuccagccuggg

SEQ ID NO: 1162456 - RNA, 20 nt, Human
ccacugcauuccagccuggg

SEQ ID NO: 1162457 - RNA, 21 nt, Human
ccacugcauuccagccugggc

SEQ ID NO: 1162458 - RNA, 21 nt, Human
ccacugcauuccagccugggc

SEQ ID NO: 1162459 - RNA, 21 nt, Human
ccacugcauuccagccugggc

SEQ ID NO: 1162460 - RNA, 24 nt, Human
ccacugcauuccagccugggcgac

SEQ ID NO: 1162461 - RNA, 19 nt, Human
cccgcuguucguauguccg

SEQ ID NO: 1162462 - RNA, 18 nt, Human
cccgucacuacuaaaaaa

SEQ ID NO: 1162463 - RNA, 25 nt, Human
ccuccggagauccugacgacguggg

SEQ ID NO: 1162464 - RNA, 23 nt, Human
ccugaccaacauggugaaacccc

SEQ ID NO: 1162465 - RNA, 24 nt, Human
ccugaccaacauggugaaaccccg

SEQ ID NO: 1162466 - RNA, 22 nt, Human
ccuggcuaacauggugaaaccc

SEQ ID NO: 1162467 - RNA, 22 nt, Human
ccuggcuaacauggugaaaccc

SEQ ID NO: 1162468 - RNA, 23 nt, Human
ccuggcuaacauggugaaacccg

SEQ ID NO: 1162469 - RNA, 19 nt, Human
ccugggcgacagagugaga

SEQ ID NO: 1162470 - RNA, 21 nt, Human
ccuguaaucccagcuacucag

SEQ ID NO: 1162471 - RNA, 21 nt, Human
ccuguaaucccagcucuuugg

SEQ ID NO: 1162472 - RNA, 21 nt, Human
ccuguagucccagcuacacgg

SEQ ID NO: 1162473 - RNA, 22 nt, Human
ccuguagucccagcuacacggg

SEQ ID NO: 1162474 - RNA, 23 nt, Human
cgccuguaaucccagcucuuugg

SEQ ID NO: 1162475 - RNA, 24 nt, Human
cgccuguaaucccagcucuuuggg

SEQ ID NO: 1162476 - RNA, 21 nt, Human
cgccuguagucccagcuacac

SEQ ID NO: 1162477 - RNA, 23 nt, Human
cgccuguagucccagcuacacgg

SEQ ID NO: 1162478 - RNA, 23 nt, Human
cgccuguagucccagcuacacgg

SEQ ID NO: 1162479 - RNA, 22 nt, Human
cggaucacgaggucaggaguuc

SEQ ID NO: 1162480 - RNA, 20 nt, Human
cucacgccuguaaucccagc

SEQ ID NO: 1162481 - RNA, 24 nt, Human
cucacgccuguaaucccagcucuu

SEQ ID NO: 1162482 - RNA, 24 nt, Human
cucaugccuguaaaucccagcacu

SEQ ID NO: 1162483 - RNA, 24 nt, Human
cucuuugggagacagaggcgggcg

SEQ ID NO: 1162484 - RNA, 21 nt, Human
cuguaaucccagcuacucagg

SEQ ID NO: 1162485 - RNA, 19 nt, Human
gaaaccccgucucaacuaa

SEQ ID NO: 1162486 - RNA, 23 nt, Human
gagaauugcuugaacccgggagg

SEQ ID NO: 1162487 - RNA, 23 nt, Human
gaggcgggcggaucacgagguca

SEQ ID NO: 1162488 - RNA, 24 nt, Human
gaucacgaggucaggaguucaaga

SEQ ID NO: 1162489 - RNA, 24 nt, Human
gcauuccagccugggcgacagagu

SEQ ID NO: 1162490 - RNA, 19 nt, Human
gccacugcacuccaggcug

SEQ ID NO: 1162491 - RNA, 24 nt, Human
gccacugcacuccaggcugggcga

SEQ ID NO: 1162492 - RNA, 22 nt, Human
gccacugcauuccagccugggc

SEQ ID NO: 1162493 - RNA, 24 nt, Human
gccacugcauuccagccugggcga

SEQ ID NO: 1162494 - RNA, 24 nt, Human
gcccaugacacagccuccggagau

SEQ ID NO: 1162495 - RNA, 19 nt, Human
gccggacagggcgcggugu

SEQ ID NO: 1162496 - RNA, 21 nt, Human
gcuaacauggugaaacccguc

SEQ ID NO: 1162497 - RNA, 19 nt, Human
ggacagggcgcggugucuc

SEQ ID NO: 1162498 - RNA, 24 nt, Human
ggagauggugccacugcacuccag

SEQ ID NO: 1162499 - RNA, 18 nt, Human
ggagcuugcagugagcgg

SEQ ID NO: 1162500 - RNA, 24 nt, Human
ggagcuugcagugagcggagaugg

SEQ ID NO: 1162501 - RNA, 21 nt, Human
ggcacgcaccuguaaucccag

SEQ ID NO: 1162502 - RNA, 22 nt, Human
ggccccacggagccgggaacac

SEQ ID NO: 1162503 - RNA, 23 nt, Human
ggccgggcgcgguggcucaugcc

SEQ ID NO: 1162504 - RNA, 23 nt, Human
ggcgcggugucucacgccuguaa

SEQ ID NO: 1162505 - RNA, 21 nt, Human
ggcggaucacgaggucaggag

SEQ ID NO: 1162506 - RNA, 23 nt, Human
ggcggaucacgaggucaggaguu

SEQ ID NO: 1162507 - RNA, 24 nt, Human
ggcggcgggcgccuguagucccag

SEQ ID NO: 1162508 - RNA, 18 nt, Human
ggcguggcggcgggcgcc

SEQ ID NO: 1162509 - RNA, 22 nt, Human
ggcguggcggcgggcgccugua

SEQ ID NO: 1162510 - RNA, 24 nt, Human
gggcgcgguggcucaugccuguaa

SEQ ID NO: 1162511 - RNA, 24 nt, Human
gguggcucaugccuguaaauccca

SEQ ID NO: 1162512 - RNA, 25 nt, Human
gguggcucaugccuguaaaucccag

SEQ ID NO: 1162513 - RNA, 24 nt, Human
ggugucucacgccuguaaucccag

SEQ ID NO: 1162514 - RNA, 24 nt, Human
gugcgugguggcacgcaccuguaa

SEQ ID NO: 1162515 - RNA, 19 nt, Human
uaacauggugaaacccguc

SEQ ID NO: 1162516 - RNA, 22 nt, Human
uaacauggugaaacccgucacu

SEQ ID NO: 1162517 - RNA, 23 nt, Human
uaacauggugaaacccgucacua

SEQ ID NO: 1162518 - RNA, 18 nt, Human
uauuucccaaaguuaagg

SEQ ID NO: 1162519 - RNA, 22 nt, Human
ucaaaaacaaaccaacaaaaaa

SEQ ID NO: 1162520 - RNA, 24 nt, Human
ucaaaaacaaaccaacaaaaaaaa

SEQ ID NO: 1162521 - RNA, 27 nt, Human
ucaacuaaaaauacaaaaauuagccgu

SEQ ID NO: 1162522 - RNA, 19 nt, Human
ucaaucgagaaaaaugaca

SEQ ID NO: 1162523 - RNA, 24 nt, Human
ucacgaggucaggagauugagacc

SEQ ID NO: 1162524 - RNA, 24 nt, Human
ucacgaggucaggaguucaagaac

SEQ ID NO: 1162525 - RNA, 23 nt, Human
ucacgccacugcauuccagccug

SEQ ID NO: 1162526 - RNA, 27 nt, Human
ucacuacuaaaaaauacaaaaaaaaaa

SEQ ID NO: 1162527 - RNA, 23 nt, Human
ucaugccuguaaaucccagcacu

SEQ ID NO: 1162528 - RNA, 19 nt, Human
uccagccugggcgacagag

SEQ ID NO: 1162529 - RNA, 23 nt, Human
uccagccugggcgacagagugag

SEQ ID NO: 1162530 - RNA, 24 nt, Human
uccagccugggcgacagagugaga

SEQ ID NO: 1162531 - RNA, 24 nt, Human
uccaggcugggcgacagagcgaga

SEQ ID NO: 1162532 - RNA, 23 nt, Human
ucgccgggaagacggccccacgg

SEQ ID NO: 1162533 - RNA, 24 nt, Human
ugaccaacauggugaaaccccguc

SEQ ID NO: 1162534 - RNA, 24 nt, Human
ugagaccauccuggcuaacauggu

SEQ ID NO: 1162535 - RNA, 24 nt, Human
ugagaucacgccacugcauuccag

SEQ ID NO: 1162536 - RNA, 24 nt, Human
ugaggcaggagaauugcuugaacc

SEQ ID NO: 1162537 - RNA, 25 nt, Human
ugaggcaggagaauugcuugaaccc

SEQ ID NO: 1162538 - RNA, 23 nt, Human
ugcgguaggaaaauggcgugaac

SEQ ID NO: 1162539 - RNA, 22 nt, Human
uggcacgcaccuguaaucccag

SEQ ID NO: 1162540 - RNA, 24 nt, Human
uggcggcgggcgccuguaguccca

SEQ ID NO: 1162541 - RNA, 23 nt, Human
uggcucaugccuguaaaucccag

SEQ ID NO: 1162542 - RNA, 25 nt, Human
uggcucaugccuguaaaucccagca

SEQ ID NO: 1162543 - RNA, 19 nt, Human
ugggagacagaggcgggcg

SEQ ID NO: 1162544 - RNA, 20 nt, Human
ugggagacagaggcgggcgg

SEQ ID NO: 1162545 - RNA, 24 nt, Human
ugggagacagaggcgggcggauca

SEQ ID NO: 1162546 - RNA, 19 nt, Human
ugggaggccgaggcgggcg

SEQ ID NO: 1162547 - RNA, 24 nt, Human
ugggaggccgaggcgggcggauca

SEQ ID NO: 1162548 - RNA, 19 nt, Human
ugggcggcgaccgucgcgg

SEQ ID NO: 1162549 - RNA, 24 nt, Human
ugguggcacgcaccuguaauccca

SEQ ID NO: 1162550 - RNA, 22 nt, Human
ugguuguauucauuuuagggag

SEQ ID NO: 1162551 - RNA, 21 nt, Human
ugucucacgccuguaauccca

SEQ ID NO: 1162552 - RNA, 22 nt, Human
ugucucacgccuguaaucccag

SEQ ID NO: 1162553 - RNA, 26 nt, Human
uguuucgcuuuucccaagagacuuca

SEQ ID NO: 1162554 - RNA, 22 nt, Human
uuccaauggugaagaguaaugg

SEQ ID NO: 1162555 - RNA, 18 nt, Human
uugcagugagcggagaug

SEQ ID NO: 1162556 - RNA, 22 nt, Human
uugcagugagcggagauggugc

SEQ ID NO: 1162557 - RNA, 20 nt, Human
uugcagugaucugagaucac

SEQ ID NO: 1162558 - RNA, 21 nt, Human
uugcagugaucugagaucacg

SEQ ID NO: 1162559 - RNA, 18 nt, Human
uugcuugaacccgggagg

SEQ ID NO: 1162560 - RNA, 24 nt, Human
uugcuugaacccgggaggcagagg

SEQ ID NO: 1162561 - RNA, 22 nt, Human
uuucccaaaguuaaggacgccc

SEQ ID NO: 1162562 - RNA, 23 nt, Human
aaacaaggaugaauaagagggac

SEQ ID NO: 1162563 - RNA, 18 nt, Human
aaccagagacgacccccc

SEQ ID NO: 1162564 - RNA, 24 nt, Human
aagaaacauaugggaagacaaccc

SEQ ID NO: 1162565 - RNA, 20 nt, Human
acugaaaaccacaaagaaua

SEQ ID NO: 1162566 - RNA, 21 nt, Human
agaaacauaugggaagacaac

SEQ ID NO: 1162567 - RNA, 21 nt, Human
aggaagaaacauaugggaaga

SEQ ID NO: 1162568 - RNA, 22 nt, Human
ccacaaauaaguagcggggaca

SEQ ID NO: 1162569 - RNA, 21 nt, Human
cccuaccaccuaguaaaauaa

SEQ ID NO: 1162570 - RNA, 21 nt, Human
cuauuaacauuuacugaaaac

SEQ ID NO: 1162571 - RNA, 19 nt, Human
uacaaacuugcuuaccacc

SEQ ID NO: 1162572 - RNA, 22 nt, Human
ucacuaugcauaauucccuaca

SEQ ID NO: 1162573 - RNA, 23 nt, Human
ugauuuacaaacuugcuuaccac

SEQ ID NO: 1162574 - RNA, 21 nt, Human
aaaaaacagaaucacagcccc

SEQ ID NO: 1162575 - RNA, 23 nt, Human
aaaaacaaagaacaucaacaaua

SEQ ID NO: 1162576 - RNA, 20 nt, Human
aaacaauucgauaagaauac

SEQ ID NO: 1162577 - RNA, 24 nt, Human
aaagaacaucaacaauaaaagaaa

SEQ ID NO: 1162578 - RNA, 21 nt, Human
aacaauaaaagaaaaaaaaaa

SEQ ID NO: 1162579 - RNA, 24 nt, Human
aacaucaacaauaaaagaaaaaaa

SEQ ID NO: 1162580 - RNA, 18 nt, Human
aagaacaucaacaauaaa

SEQ ID NO: 1162581 - RNA, 22 nt, Human
aaugaacaguaaaacccuagag

SEQ ID NO: 1162582 - RNA, 18 nt, Human
aaugcaaaaacaggcuaa

SEQ ID NO: 1162583 - RNA, 23 nt, Human
agaaaaaaaaaacagaaucacag

SEQ ID NO: 1162584 - RNA, 18 nt, Human
agaaucacagcccagagg

SEQ ID NO: 1162585 - RNA, 26 nt, Human
agccauagcagcuaaaacaacauucc

SEQ ID NO: 1162586 - RNA, 24 nt, Human
caacuuagaaaaaaaaagcagaaa

SEQ ID NO: 1162587 - RNA, 22 nt, Human
cacaaugaacaguaaaacccua

SEQ ID NO: 1162588 - RNA, 23 nt, Human
cagaagccuuggcaguucaacaa

SEQ ID NO: 1162589 - RNA, 19 nt, Human
cagagcccaauagacccaa

SEQ ID NO: 1162590 - RNA, 18 nt, Human
cagcccagagggagugga

SEQ ID NO: 1162591 - RNA, 18 nt, Human
caggcuaaauaaaccuaa

SEQ ID NO: 1162592 - RNA, 22 nt, Human
cauucuuaauaguuggcaauga

SEQ ID NO: 1162593 - RNA, 25 nt, Human
ccaaaaacacaacuguguugcaaca

SEQ ID NO: 1162594 - RNA, 21 nt, Human
ccaauagacccaauauuacag

SEQ ID NO: 1162595 - RNA, 25 nt, Human
ccaauuaaaaaaaauaucuaaaauc

SEQ ID NO: 1162596 - RNA, 20 nt, Human
ccagagggaguggugaagcc

SEQ ID NO: 1162597 - RNA, 20 nt, Human
cccacagagcccaauagacc

SEQ ID NO: 1162598 - RNA, 19 nt, Human
cccuagagcaaauacugca

SEQ ID NO: 1162599 - RNA, 24 nt, Human
cuacuuaucuaccugccucauuua

SEQ ID NO: 1162600 - RNA, 23 nt, Human
cucuucacauaguuacuaauuuu

SEQ ID NO: 1162601 - RNA, 21 nt, Human
cuuagaaaaaaaaagcagaaa

SEQ ID NO: 1162602 - RNA, 19 nt, Human
cuugcuucucuuuucuucc

SEQ ID NO: 1162603 - RNA, 24 nt, Human
gaacacauugggggcuuagcauuu

SEQ ID NO: 1162604 - RNA, 21 nt, Human
gaguggugaagccaaaaacac

SEQ ID NO: 1162605 - RNA, 22 nt, Human
gcaacaucuggauaauccauac

SEQ ID NO: 1162606 - RNA, 19 nt, Human
gcucucuugaucuaaaauc

SEQ ID NO: 1162607 - RNA, 19 nt, Human
ggcaaugagaaagcugaga

SEQ ID NO: 1162608 - RNA, 18 nt, Human
ggucuggcuucuucuucu

SEQ ID NO: 1162609 - RNA, 18 nt, Human
uaaaacccuagagcaaau

SEQ ID NO: 1162610 - RNA, 23 nt, Human
uaaaaugcuauguucacccuguu

SEQ ID NO: 1162611 - RNA, 19 nt, Human
uaaaccucacgagaggcua

SEQ ID NO: 1162612 - RNA, 18 nt, Human
uaaauuagucguugccuc

SEQ ID NO: 1162613 - RNA, 26 nt, Human
uaauauuagucacugaccaauuuuaa

SEQ ID NO: 1162614 - RNA, 26 nt, Human
uacaaaaacguaccaacugauguaag

SEQ ID NO: 1162615 - RNA, 20 nt, Human
uagcagcuaaaacaacauuc

SEQ ID NO: 1162616 - RNA, 20 nt, Human
ucagcagugaugaucagaag

SEQ ID NO: 1162617 - RNA, 25 nt, Human
uccagcagcgauauccauuuccuuu

SEQ ID NO: 1162618 - RNA, 20 nt, Human
uccauuuccugccaugucuu

SEQ ID NO: 1162619 - RNA, 22 nt, Human
ucccacagagcccaauagaccc

SEQ ID NO: 1162620 - RNA, 23 nt, Human
ucugugauuaaggaaacuaaaac

SEQ ID NO: 1162621 - RNA, 22 nt, Human
ucuuugucuaauuucugacuug

SEQ ID NO: 1162622 - RNA, 21 nt, Human
ugaaagugguucaaaauuucc

SEQ ID NO: 1162623 - RNA, 24 nt, Human
ugacacaaugaacaguaaaacccu

SEQ ID NO: 1162624 - RNA, 19 nt, Human
ugacuccaaacaaucuuca

SEQ ID NO: 1162625 - RNA, 23 nt, Human
ugacuccaaacaaucuucagcau

SEQ ID NO: 1162626 - RNA, 20 nt, Human
ugagaaagcugagauggaag

SEQ ID NO: 1162627 - RNA, 18 nt, Human
ugccucauuuacuuuccc

SEQ ID NO: 1162628 - RNA, 19 nt, Human
uggcacaaaggaaaaaaaa

SEQ ID NO: 1162629 - RNA, 22 nt, Human
uggcacaaaggaaaaaaaaaaa

SEQ ID NO: 1162630 - RNA, 20 nt, Human
uggcuucuaagugguuuccu

SEQ ID NO: 1162631 - RNA, 21 nt, Human
uucacuuuccuggucuggcuu

SEQ ID NO: 1162632 - RNA, 22 nt, Human
uucagcagugaugaucagaagc

SEQ ID NO: 1162633 - RNA, 18 nt, Human
uucaugaaauuuugcucu

SEQ ID NO: 1162634 - RNA, 23 nt, Human
uuccagauaaaagaguaaaacag

SEQ ID NO: 1162635 - RNA, 19 nt, Human
uuggcuacugucuuuugcu

SEQ ID NO: 1162636 - RNA, 21 nt, Human
aaguggcagacaauucagaau

SEQ ID NO: 1162637 - RNA, 26 nt, Human
acccaggagguuuuuguuucguuucg

SEQ ID NO: 1162638 - RNA, 21 nt, Human
acccagugugaaacacagccu

SEQ ID NO: 1162639 - RNA, 23 nt, Human
accucauccccuucauuguccag

SEQ ID NO: 1162640 - RNA, 19 nt, Human
agagguuagaaaucauacc

SEQ ID NO: 1162641 - RNA, 25 nt, Human
agaugucagauguccccugugagcu

SEQ ID NO: 1162642 - RNA, 21 nt, Human
agcauucauguauuuuuaguu

SEQ ID NO: 1162643 - RNA, 21 nt, Human
agccuaaguaguuucauaaaa

SEQ ID NO: 1162644 - RNA, 23 nt, Human
agccuguuuuguugcuggaauga

SEQ ID NO: 1162645 - RNA, 27 nt, Human
aguugcuaaaauaaugaaagaaaaaaa

SEQ ID NO: 1162646 - RNA, 22 nt, Human
auaaagcacaaagugcucaaaa

SEQ ID NO: 1162647 - RNA, 20 nt, Human
augacuugcuguuucagaau

SEQ ID NO: 1162648 - RNA, 23 nt, Human
cacaauaaaacaaaauuugugua

SEQ ID NO: 1162649 - RNA, 18 nt, Human
cagaugucagaugucccc

SEQ ID NO: 1162650 - RNA, 21 nt, Human
cauacccagugugaaacacag

SEQ ID NO: 1162651 - RNA, 18 nt, Human
cccagugugaaacacagc

SEQ ID NO: 1162652 - RNA, 20 nt, Human
cgaauaaagcacaaagugcu

SEQ ID NO: 1162653 - RNA, 23 nt, Human
cugaaaacuaaagcaugaauccu

SEQ ID NO: 1162654 - RNA, 26 nt, Human
gguguaggauggcaugacccaggagg

SEQ ID NO: 1162655 - RNA, 19 nt, Human
ggugucuuuccaaaucgca

SEQ ID NO: 1162656 - RNA, 28 nt, Human
uaaaaauaucacuugaagaaaagauuuc

SEQ ID NO: 1162657 - RNA, 21 nt, Human
uaaaauaaugaaagaaaaaaa

SEQ ID NO: 1162658 - RNA, 24 nt, Human
uaaaucaugccucuguuuaacagg

SEQ ID NO: 1162659 - RNA, 21 nt, Human
uaacaggaauuugguguagga

SEQ ID NO: 1162660 - RNA, 22 nt, Human
uaacauuagacauauuacaguu

SEQ ID NO: 1162661 - RNA, 18 nt, Human
uaagaaaauauggucuga

SEQ ID NO: 1162662 - RNA, 20 nt, Human
uacccagugugaaacacagc

SEQ ID NO: 1162663 - RNA, 18 nt, Human
uagcugaaaacuaaagca

SEQ ID NO: 1162664 - RNA, 22 nt, Human
uagcuuucaaauaauucauccu

SEQ ID NO: 1162665 - RNA, 21 nt, Human
uaugacuugcuguuucagaau

SEQ ID NO: 1162666 - RNA, 21 nt, Human
ucacggucucacccggaaguc

SEQ ID NO: 1162667 - RNA, 21 nt, Human
ucuauagcugaaaacuaaagc

SEQ ID NO: 1162668 - RNA, 23 nt, Human
ucuucgguagcauucauguauuu

SEQ ID NO: 1162669 - RNA, 24 nt, Human
ugaaagaaaaaaacuuucuucugc

SEQ ID NO: 1162670 - RNA, 23 nt, Human
ugaagaaauagcaaggucacugg

SEQ ID NO: 1162671 - RNA, 18 nt, Human
ugccuggguggugcgaga

SEQ ID NO: 1162672 - RNA, 25 nt, Human
ugcuaaaauaaugaaagaaaaaaac

SEQ ID NO: 1162673 - RNA, 23 nt, Human
uggcaugacccaggagguuuuug

SEQ ID NO: 1162674 - RNA, 20 nt, Human
uguccagaacaaauccuaac

SEQ ID NO: 1162675 - RNA, 21 nt, Human
uguccagaacaaauccuaaca

SEQ ID NO: 1162676 - RNA, 24 nt, Human
uuaauuuaaaaugucuaacauuag

SEQ ID NO: 1162677 - RNA, 21 nt, Human
uucagguuuucagaacugcau

SEQ ID NO: 1162678 - RNA, 23 nt, Human
uuuaaaaugucuaacauuagaca

SEQ ID NO: 1162679 - RNA, 18 nt, Human
uuuccaaaucgcacugua

SEQ ID NO: 1162680 - RNA, 21 nt, Human
uuuguggugucuuuccaaauc

SEQ ID NO: 1162681 - RNA, 20 nt, Human
uuuucagguuuucagaacug

SEQ ID NO: 1162682 - RNA, 23 nt, Human
aaacuccagguggcaggggcugu

SEQ ID NO: 1162683 - RNA, 21 nt, Human
aacgugcugggguccagccug

SEQ ID NO: 1162684 - RNA, 19 nt, Human
aacucaauggacucucccc

SEQ ID NO: 1162685 - RNA, 20 nt, Human
aacuuuccccacugaaaggc

SEQ ID NO: 1162686 - RNA, 18 nt, Human
aagagacagaggcugcga

SEQ ID NO: 1162687 - RNA, 22 nt, Human
acacagcacccacaccccaccc

SEQ ID NO: 1162688 - RNA, 23 nt, Human
acacagcacccacaccccacccc

SEQ ID NO: 1162689 - RNA, 22 nt, Human
accuccccaacuuuccccacug

SEQ ID NO: 1162690 - RNA, 18 nt, Human
agaaaacagacgcugccu

SEQ ID NO: 1162691 - RNA, 21 nt, Human
agaacgugcugggguccagcc

SEQ ID NO: 1162692 - RNA, 18 nt, Human
agcggaagagacagaggc

SEQ ID NO: 1162693 - RNA, 21 nt, Human
agcgguagggaggggaagaga

SEQ ID NO: 1162694 - RNA, 19 nt, Human
agcucagcccggccugcug

SEQ ID NO: 1162695 - RNA, 21 nt, Human
agcugugucagugacccuggc

SEQ ID NO: 1162696 - RNA, 20 nt, Human
aggagaaagagauuuccaga

SEQ ID NO: 1162697 - RNA, 23 nt, Human
aggcgguggcugggggaaagagg

SEQ ID NO: 1162698 - RNA, 23 nt, Human
aggcgguggcugggggaaagagg

SEQ ID NO: 1162699 - RNA, 19 nt, Human
aggggcgggggaggagaaa

SEQ ID NO: 1162700 - RNA, 28 nt, Human
aucccgccccuccccuccccuccccagg

SEQ ID NO: 1162701 - RNA, 21 nt, Human
cacacagcacccacaccccac

SEQ ID NO: 1162702 - RNA, 18 nt, Human
caccccuccaucucacuc

SEQ ID NO: 1162703 - RNA, 21 nt, Human
caccccuccaucucacucaag

SEQ ID NO: 1162704 - RNA, 18 nt, Human
caccuccccaacuuuccc

SEQ ID NO: 1162705 - RNA, 19 nt, Human
caccuccccaacuuucccc

SEQ ID NO: 1162706 - RNA, 24 nt, Human
cacugaaaggcaaacucaauggac

SEQ ID NO: 1162707 - RNA, 18 nt, Human
cagcacccacaccccacc

SEQ ID NO: 1162708 - RNA, 21 nt, Human
cagcacccacaccccaccccg

SEQ ID NO: 1162709 - RNA, 21 nt, Human
cagcagugauucagacuucaa

SEQ ID NO: 1162710 - RNA, 23 nt, Human
cagcugccccuccagaaaacaga

SEQ ID NO: 1162711 - RNA, 23 nt, Human
caggaagaacuugcugaucagug

SEQ ID NO: 1162712 - RNA, 26 nt, Human
caugaacaucccgccccuccccuccc

SEQ ID NO: 1162713 - RNA, 20 nt, Human
cauugguucuccaccucccc

SEQ ID NO: 1162714 - RNA, 23 nt, Human
ccagucccucagcuuggucucag

SEQ ID NO: 1162715 - RNA, 22 nt, Human
cccacagagaccaagagagacg

SEQ ID NO: 1162716 - RNA, 18 nt, Human
cccagguugggguggggg

SEQ ID NO: 1162717 - RNA, 19 nt, Human
ccccgcucgcacacuccag

SEQ ID NO: 1162718 - RNA, 18 nt, Human
ccccuccccuccccaguc

SEQ ID NO: 1162719 - RNA, 20 nt, Human
ccccuccccuccccucccca

SEQ ID NO: 1162720 - RNA, 19 nt, Human
ccgccccuccccuccccuc

SEQ ID NO: 1162721 - RNA, 19 nt, Human
ccgccccuccccuccccuc

SEQ ID NO: 1162722 - RNA, 21 nt, Human
ccuccccaacuuuccccacug

SEQ ID NO: 1162723 - RNA, 23 nt, Human
ccuccccuccccuccccaguccc

SEQ ID NO: 1162724 - RNA, 23 nt, Human
cgagaccuacccacagagaccaa

SEQ ID NO: 1162725 - RNA, 23 nt, Human
cgaggaaagucaggcccaaagau

SEQ ID NO: 1162726 - RNA, 21 nt, Human
cgccccuccccuccccucccc

SEQ ID NO: 1162727 - RNA, 27 nt, Human
cgccccuccccuccccuccccaguccc

SEQ ID NO: 1162728 - RNA, 21 nt, Human
cgcucgcacacuccaguuccc

SEQ ID NO: 1162729 - RNA, 20 nt, Human
cggaagagacagaggcugcg

SEQ ID NO: 1162730 - RNA, 21 nt, Human
cucagcccggccugcugcggc

SEQ ID NO: 1162731 - RNA, 22 nt, Human
cucagcuuggucucagcugugu

SEQ ID NO: 1162732 - RNA, 22 nt, Human
cuccccuuccucucuucguacu

SEQ ID NO: 1162733 - RNA, 19 nt, Human
cuccuggguccucaggacu

SEQ ID NO: 1162734 - RNA, 19 nt, Human
cucgcacacuccaguuccc

SEQ ID NO: 1162735 - RNA, 24 nt, Human
cucguagcccugggucuguuuucu

SEQ ID NO: 1162736 - RNA, 22 nt, Human
cucuuccagcccugaagacagg

SEQ ID NO: 1162737 - RNA, 24 nt, Human
cugcauugccccgcucgcacacuc

SEQ ID NO: 1162738 - RNA, 22 nt, Human
cuggaccucuguucucuaccca

SEQ ID NO: 1162739 - RNA, 22 nt, Human
cugggucuguuuucuucucaga

SEQ ID NO: 1162740 - RNA, 21 nt, Human
cuuggucucagcugugucagu

SEQ ID NO: 1162741 - RNA, 26 nt, Human
gaacaccccuccaucucacucaaggg

SEQ ID NO: 1162742 - RNA, 30 nt, Human
gaagacagggagccagcagccaaaagagaa

SEQ ID NO: 1162743 - RNA, 19 nt, Human
gacccuggcucagaaaagu

SEQ ID NO: 1162744 - RNA, 20 nt, Human
gagcaagaggcgguggcugg

SEQ ID NO: 1162745 - RNA, 18 nt, Human
gagcacugauugagcacu

SEQ ID NO: 1162746 - RNA, 20 nt, Human
gaggaaagucaggcccaaag

SEQ ID NO: 1162747 - RNA, 19 nt, Human
gcccugaagacagggagcc

SEQ ID NO: 1162748 - RNA, 22 nt, Human
gcccugggucuguuuucuucuc

SEQ ID NO: 1162749 - RNA, 23 nt, Human
gcccugggucuguuuucuucuca

SEQ ID NO: 1162750 - RNA, 21 nt, Human
gcgagcacugauugagcacuu

SEQ ID NO: 1162751 - RNA, 22 nt, Human
gcgaggaaagucaggcccaaag

SEQ ID NO: 1162752 - RNA, 21 nt, Human
gcugggguccagccugggugc

SEQ ID NO: 1162753 - RNA, 24 nt, Human
ggaaagucaggcccaaagauacag

SEQ ID NO: 1162754 - RNA, 18 nt, Human
ggaagagacagaggcugc

SEQ ID NO: 1162755 - RNA, 23 nt, Human
ggaggaagaaccuuguccaggug

SEQ ID NO: 1162756 - RNA, 18 nt, Human
ggccuggggccacugcuc

SEQ ID NO: 1162757 - RNA, 19 nt, Human
ggcgguaagcgcaagaggg

SEQ ID NO: 1162758 - RNA, 21 nt, Human
ggguucccggugacccuuucc

SEQ ID NO: 1162759 - RNA, 20 nt, Human
gguuggggugggggcugugg

SEQ ID NO: 1162760 - RNA, 23 nt, Human
gucacacagcacccacaccccac

SEQ ID NO: 1162761 - RNA, 23 nt, Human
guccagccugggugcccugagcu

SEQ ID NO: 1162762 - RNA, 23 nt, Human
guggugagcaagaggcgguggcu

SEQ ID NO: 1162763 - RNA, 18 nt, Human
uaagcgcaagagggaaga

SEQ ID NO: 1162764 - RNA, 21 nt, Human
uaaggugaacaccccuccauc

SEQ ID NO: 1162765 - RNA, 26 nt, Human
uacccagaaaggcccuccgguaaggg

SEQ ID NO: 1162766 - RNA, 25 nt, Human
uagcaaacccagguugggguggggg

SEQ ID NO: 1162767 - RNA, 19 nt, Human
ucacacagcacccacaccc

SEQ ID NO: 1162768 - RNA, 19 nt, Human
ucacacagcacccacaccc

SEQ ID NO: 1162769 - RNA, 21 nt, Human
ucacacagcacccacacccca

SEQ ID NO: 1162770 - RNA, 18 nt, Human
ucacagcagcuucucagc

SEQ ID NO: 1162771 - RNA, 22 nt, Human
uccaccuccccaacuuucccca

SEQ ID NO: 1162772 - RNA, 21 nt, Human
uccccaacuuuccccacugaa

SEQ ID NO: 1162773 - RNA, 21 nt, Human
uccccagucccucagcuuggu

SEQ ID NO: 1162774 - RNA, 23 nt, Human
uccccagucccucagcuuggucu

SEQ ID NO: 1162775 - RNA, 21 nt, Human
ucccucagcuuggucucagcu

SEQ ID NO: 1162776 - RNA, 19 nt, Human
uccugggccggcugagguc

SEQ ID NO: 1162777 - RNA, 21 nt, Human
uccuggguccucaggacugcc

SEQ ID NO: 1162778 - RNA, 22 nt, Human
ucuccucuggaccucuguucuc

SEQ ID NO: 1162779 - RNA, 19 nt, Human
ucucuagcucagcccggcc

SEQ ID NO: 1162780 - RNA, 27 nt, Human
ucuggaccucuguucucuacccagaaa

SEQ ID NO: 1162781 - RNA, 20 nt, Human
ucuuccagcccugaagacag

SEQ ID NO: 1162782 - RNA, 22 nt, Human
ugaaaagggaggcgcggagaua

SEQ ID NO: 1162783 - RNA, 20 nt, Human
ugacagcagugauucagacu

SEQ ID NO: 1162784 - RNA, 22 nt, Human
ugagcaugaacaucccgccccu

SEQ ID NO: 1162785 - RNA, 23 nt, Human
ugagcaugaacaucccgccccuc

SEQ ID NO: 1162786 - RNA, 20 nt, Human
ugagcgguagggaggggaag

SEQ ID NO: 1162787 - RNA, 24 nt, Human
ugagcgguagggaggggaagagag

SEQ ID NO: 1162788 - RNA, 18 nt, Human
ugauucagacuucaacuu

SEQ ID NO: 1162789 - RNA, 26 nt, Human
ugcaaggaccaaaaagggucacacag

SEQ ID NO: 1162790 - RNA, 25 nt, Human
ugcccuauucuccauagcaaaccca

SEQ ID NO: 1162791 - RNA, 21 nt, Human
ugcuggagucacagcagcuuc

SEQ ID NO: 1162792 - RNA, 20 nt, Human
ugcugggguccagccugggu

SEQ ID NO: 1162793 - RNA, 22 nt, Human
uggaccucuguucucuacccag

SEQ ID NO: 1162794 - RNA, 18 nt, Human
uggcucagaaaagugcaa

SEQ ID NO: 1162795 - RNA, 18 nt, Human
uggcugggggaaagaggc

SEQ ID NO: 1162796 - RNA, 21 nt, Human
ugggcugccugcggguucccg

SEQ ID NO: 1162797 - RNA, 29 nt, Human
ugggcugccugcggguucccggugaaacg

SEQ ID NO: 1162798 - RNA, 20 nt, Human
ugggggaaagaggcaaggga

SEQ ID NO: 1162799 - RNA, 23 nt, Human
ugggggcuguggugagcaagagg

SEQ ID NO: 1162800 - RNA, 21 nt, Human
uggggugggggcuguggugag

SEQ ID NO: 1162801 - RNA, 23 nt, Human
ugugcagcgcgcgguccagaagu

SEQ ID NO: 1162802 - RNA, 20 nt, Human
uguuuuguucuccugggccu

SEQ ID NO: 1162803 - RNA, 18 nt, Human
uguuuuguuuuguucucc

SEQ ID NO: 1162804 - RNA, 20 nt, Human
uucucuacccagaaaggccc

SEQ ID NO: 1162805 - RNA, 20 nt, Human
uucuucucagagagaccuga

SEQ ID NO: 1162806 - RNA, 19 nt, Human
uuguucuccugggccuaaa

SEQ ID NO: 1162807 - RNA, 23 nt, Human
uuuguucuccugggccuaaagga

SEQ ID NO: 1162808 - RNA, 18 nt, Human
aacagccucucaaggugu

SEQ ID NO: 1162809 - RNA, 26 nt, Human
aaccaaaaagaaaauucuaaggcccc

SEQ ID NO: 1162810 - RNA, 22 nt, Human
aaccaucugaaugcauggcccc

SEQ ID NO: 1162811 - RNA, 20 nt, Human
aacuuauuagguggguccua

SEQ ID NO: 1162812 - RNA, 18 nt, Human
aagcagaagagagaauug

SEQ ID NO: 1162813 - RNA, 20 nt, Human
aagcagggccaccacacgca

SEQ ID NO: 1162814 - RNA, 23 nt, Human
aagcugggaccagucgugaggga

SEQ ID NO: 1162815 - RNA, 28 nt, Human
aaggaggagacguaguuccccuuaauag

SEQ ID NO: 1162816 - RNA, 23 nt, Human
acagaggaggagagcaggcugaa

SEQ ID NO: 1162817 - RNA, 18 nt, Human
acaucaggcccaggaguc

SEQ ID NO: 1162818 - RNA, 25 nt, Human
acccagagaggugcuucuggggagc

SEQ ID NO: 1162819 - RNA, 21 nt, Human
accccuuacucagaugggggc

SEQ ID NO: 1162820 - RNA, 21 nt, Human
acgcaauagaaaucaagcauc

SEQ ID NO: 1162821 - RNA, 19 nt, Human
agaaacagaggaaacaaag

SEQ ID NO: 1162822 - RNA, 22 nt, Human
agaagagagaauuggaagaaac

SEQ ID NO: 1162823 - RNA, 20 nt, Human
agaagcugggaccagucgug

SEQ ID NO: 1162824 - RNA, 20 nt, Human
agacagacagacagacagcc

SEQ ID NO: 1162825 - RNA, 23 nt, Human
aggagauuuaaaaggaagggaga

SEQ ID NO: 1162826 - RNA, 19 nt, Human
aggaggagagcaggcugaa

SEQ ID NO: 1162827 - RNA, 18 nt, Human
aggucuuuagauaauaac

SEQ ID NO: 1162828 - RNA, 22 nt, Human
agucaggaagucuuugaaucug

SEQ ID NO: 1162829 - RNA, 26 nt, Human
augccagguuagacagacagacagac

SEQ ID NO: 1162830 - RNA, 18 nt, Human
auguacauguuacaugua

SEQ ID NO: 1162831 - RNA, 20 nt, Human
caacuuuccagaccaaaaca

SEQ ID NO: 1162832 - RNA, 23 nt, Human
caaugggucacccuucugugagc

SEQ ID NO: 1162833 - RNA, 18 nt, Human
cacacgcauggggagaac

SEQ ID NO: 1162834 - RNA, 21 nt, Human
caccacaaagcagggccacca

SEQ ID NO: 1162835 - RNA, 20 nt, Human
cacugcaugccucaaugggu

SEQ ID NO: 1162836 - RNA, 18 nt, Human
cagagcacagacaggauu

SEQ ID NO: 1162837 - RNA, 25 nt, Human
cagcacaagacacacuauggggucu

SEQ ID NO: 1162838 - RNA, 22 nt, Human
cagcagaggcugcauugcagca

SEQ ID NO: 1162839 - RNA, 23 nt, Human
cagcaggacaguccuggaggcuc

SEQ ID NO: 1162840 - RNA, 20 nt, Human
cagccucuugauacccuccu

SEQ ID NO: 1162841 - RNA, 21 nt, Human
caggcggcuucugcauccuga

SEQ ID NO: 1162842 - RNA, 18 nt, Human
caggucaugaggggaagg

SEQ ID NO: 1162843 - RNA, 19 nt, Human
cauaacucacccggucugc

SEQ ID NO: 1162844 - RNA, 23 nt, Human
cauccugagacacccuuccugaa

SEQ ID NO: 1162845 - RNA, 24 nt, Human
ccaaaguggggagggggcagagaa

SEQ ID NO: 1162846 - RNA, 19 nt, Human
ccacaaagcagggccacca

SEQ ID NO: 1162847 - RNA, 22 nt, Human
ccagaccaaaacaauguacaug

SEQ ID NO: 1162848 - RNA, 18 nt, Human
ccagagaggugcuucugg

SEQ ID NO: 1162849 - RNA, 25 nt, Human
ccagucaggaagucuuugaaucuga

SEQ ID NO: 1162850 - RNA, 21 nt, Human
ccaucugaaugcauggccccu

SEQ ID NO: 1162851 - RNA, 19 nt, Human
cccaagaugccaggugcuu

SEQ ID NO: 1162852 - RNA, 20 nt, Human
ccccaaaugccagagaacuc

SEQ ID NO: 1162853 - RNA, 23 nt, Human
cccccuuccgguugucccaacuu

SEQ ID NO: 1162854 - RNA, 23 nt, Human
ccccgacaaaaccccuccccaaa

SEQ ID NO: 1162855 - RNA, 21 nt, Human
ccccuuaccaucacccagaca

SEQ ID NO: 1162856 - RNA, 23 nt, Human
ccucccaggacaccugugggaau

SEQ ID NO: 1162857 - RNA, 23 nt, Human
ccucuugauacccuccuuccuuu

SEQ ID NO: 1162858 - RNA, 23 nt, Human
ccucuuuaagucugaguagaaac

SEQ ID NO: 1162859 - RNA, 19 nt, Human
ccugagacacccuuccuga

SEQ ID NO: 1162860 - RNA, 18 nt, Human
ccugcagaccccaaaugc

SEQ ID NO: 1162861 - RNA, 22 nt, Human
ccugcagaccccaaaugccaga

SEQ ID NO: 1162862 - RNA, 20 nt, Human
ccugcagaccccaaaugccg

SEQ ID NO: 1162863 - RNA, 21 nt, Human
ccuuacucagaugggggcagg

SEQ ID NO: 1162864 - RNA, 27 nt, Human
ccuucugugagcaggugcuucagaggc

SEQ ID NO: 1162865 - RNA, 19 nt, Human
cgagugugugagagcagaa

SEQ ID NO: 1162866 - RNA, 22 nt, Human
cgccaauuagauggacgugguc

SEQ ID NO: 1162867 - RNA, 19 nt, Human
cucccccuuccgguugucc

SEQ ID NO: 1162868 - RNA, 19 nt, Human
cugaaggccuauccaccuc

SEQ ID NO: 1162869 - RNA, 20 nt, Human
cugcgcaaagacaaaacauc

SEQ ID NO: 1162870 - RNA, 22 nt, Human
cuggagaacaaggaggagacgu

SEQ ID NO: 1162871 - RNA, 23 nt, Human
cugggcauguucuuaaccuuggc

SEQ ID NO: 1162872 - RNA, 19 nt, Human
cuguuucacuccagcagag

SEQ ID NO: 1162873 - RNA, 20 nt, Human
cuguuucacuccagcagagg

SEQ ID NO: 1162874 - RNA, 21 nt, Human
cuguuucacuccagcagaggc

SEQ ID NO: 1162875 - RNA, 23 nt, Human
cuugcuccugcagaccccaaaug

SEQ ID NO: 1162876 - RNA, 19 nt, Human
cuugggguuuacaccccuu

SEQ ID NO: 1162877 - RNA, 18 nt, Human
gagaacaaggaggagacc

SEQ ID NO: 1162878 - RNA, 18 nt, Human
gaggccccaagaugccag

SEQ ID NO: 1162879 - RNA, 18 nt, Human
gaugaguuuguaggcgag

SEQ ID NO: 1162880 - RNA, 24 nt, Human
gcagaagagagaauuggaagaaac

SEQ ID NO: 1162881 - RNA, 21 nt, Human
gcagaccccaaaugccagaga

SEQ ID NO: 1162882 - RNA, 20 nt, Human
gcagagaagaggccccaaga

SEQ ID NO: 1162883 - RNA, 18 nt, Human
gcaggacagaggaggaga

SEQ ID NO: 1162884 - RNA, 18 nt, Human
gcaggcagugccuggcag

SEQ ID NO: 1162885 - RNA, 20 nt, Human
gcugggagagaagcugggac

SEQ ID NO: 1162886 - RNA, 22 nt, Human
ggaagaaacagaggaaacaaag

SEQ ID NO: 1162887 - RNA, 23 nt, Human
ggcuguguccugggcauguucuu

SEQ ID NO: 1162888 - RNA, 23 nt, Human
gggaaagcagaggcuaacauaac

SEQ ID NO: 1162889 - RNA, 21 nt, Human
gggaaucucccaaaaccuaga

SEQ ID NO: 1162890 - RNA, 18 nt, Human
gggagggggcagagaaga

SEQ ID NO: 1162891 - RNA, 18 nt, Human
gggcagagaagaggcccc

SEQ ID NO: 1162892 - RNA, 23 nt, Human
gggcaggcagugccuggcagcaa

SEQ ID NO: 1162893 - RNA, 21 nt, Human
ggugugugugugugugugugu

SEQ ID NO: 1162894 - RNA, 19 nt, Human
gugcugggagagaagcugg

SEQ ID NO: 1162895 - RNA, 21 nt, Human
gugugccggggcuguguguga

SEQ ID NO: 1162896 - RNA, 21 nt, Human
gugugugugugugugugugug

SEQ ID NO: 1162897 - RNA, 21 nt, Human
gugugugugugugugugugug

SEQ ID NO: 1162898 - RNA, 21 nt, Human
gugugugugugugugugugug

SEQ ID NO: 1162899 - RNA, 21 nt, Human
gugugugugugugugugugug

SEQ ID NO: 1162900 - RNA, 21 nt, Human
gugugugugugugugugugug

SEQ ID NO: 1162901 - RNA, 19 nt, Human
uaaaaggaagggagaggga

SEQ ID NO: 1162902 - RNA, 23 nt, Human
uaagccccaggagauuuaaaagg

SEQ ID NO: 1162903 - RNA, 20 nt, Human
uaagucugaguagaaacauu

SEQ ID NO: 1162904 - RNA, 20 nt, Human
uaauaacucaaucaacugcc

SEQ ID NO: 1162905 - RNA, 22 nt, Human
uagacagacagacagacagcca

SEQ ID NO: 1162906 - RNA, 24 nt, Human
uagacagacagacagacagccagg

SEQ ID NO: 1162907 - RNA, 19 nt, Human
uagguggguccuagaaauu

SEQ ID NO: 1162908 - RNA, 20 nt, Human
uauccaccucugcacgcauc

SEQ ID NO: 1162909 - RNA, 24 nt, Human
uaugaccuauucucucugaagccu

SEQ ID NO: 1162910 - RNA, 24 nt, Human
ucaccacaaagcagggccaccaca

SEQ ID NO: 1162911 - RNA, 23 nt, Human
ucacccagacauuccuuucucuu

SEQ ID NO: 1162912 - RNA, 19 nt, Human
ucaggacaggaagggaaag

SEQ ID NO: 1162913 - RNA, 21 nt, Human
ucaggacaggaagggaaagca

SEQ ID NO: 1162914 - RNA, 24 nt, Human
ucagugcacaguuauugaaagaaa

SEQ ID NO: 1162915 - RNA, 20 nt, Human
uccaaaggauggaggcugcc

SEQ ID NO: 1162916 - RNA, 22 nt, Human
uccacacugcagguguucacag

SEQ ID NO: 1162917 - RNA, 19 nt, Human
uccccaaaguggggagggg

SEQ ID NO: 1162918 - RNA, 24 nt, Human
ucccgggaaucucccaaaaccuag

SEQ ID NO: 1162919 - RNA, 22 nt, Human
ucccuaaaauguauaaaaccaa

SEQ ID NO: 1162920 - RNA, 20 nt, Human
ucccugcuguucuggguggg

SEQ ID NO: 1162921 - RNA, 19 nt, Human
uccugcagaccccaaaugc

SEQ ID NO: 1162922 - RNA, 22 nt, Human
uccuguuucacuccagcagagg

SEQ ID NO: 1162923 - RNA, 24 nt, Human
ucuacagagcuuagcacagccauu

SEQ ID NO: 1162924 - RNA, 28 nt, Human
ucucaaggugugugugugugugugugug

SEQ ID NO: 1162925 - RNA, 25 nt, Human
ucucuacaaccccuuaccaucaccc

SEQ ID NO: 1162926 - RNA, 21 nt, Human
ucucucugaagccuguuaccu

SEQ ID NO: 1162927 - RNA, 19 nt, Human
ucucuuagaccucugggca

SEQ ID NO: 1162928 - RNA, 23 nt, Human
ucuggagaacaaggaggagacgu

SEQ ID NO: 1162929 - RNA, 19 nt, Human
ugaccuggaagcucccccu

SEQ ID NO: 1162930 - RNA, 20 nt, Human
ugacgcaauagaaaucaagc

SEQ ID NO: 1162931 - RNA, 18 nt, Human
ugauggcuuaugucuccc

SEQ ID NO: 1162932 - RNA, 18 nt, Human
ugcagaccccaaaugcca

SEQ ID NO: 1162933 - RNA, 25 nt, Human
ugcccccgacaaaaccccuccccaa

SEQ ID NO: 1162934 - RNA, 20 nt, Human
uggaagaaacagaggaaaca

SEQ ID NO: 1162935 - RNA, 22 nt, Human
uggauucuaagccccaggagau

SEQ ID NO: 1162936 - RNA, 22 nt, Human
uggcagcaaucccgggaaucuc

SEQ ID NO: 1162937 - RNA, 18 nt, Human
ugugcugggagagaagcu

SEQ ID NO: 1162938 - RNA, 22 nt, Human
uguggucaggaccucccaaggc

SEQ ID NO: 1162939 - RNA, 21 nt, Human
ugugugccggggcugugugug

SEQ ID NO: 1162940 - RNA, 18 nt, Human
ugugugugugugugugug

SEQ ID NO: 1162941 - RNA, 18 nt, Human
ugugugugugugugugug

SEQ ID NO: 1162942 - RNA, 18 nt, Human
ugugugugugugugugug

SEQ ID NO: 1162943 - RNA, 18 nt, Human
ugugugugugugugugug

SEQ ID NO: 1162944 - RNA, 18 nt, Human
ugugugugugugugugug

SEQ ID NO: 1162945 - RNA, 18 nt, Human
ugugugugugugugugug

SEQ ID NO: 1162946 - RNA, 18 nt, Human
ugugugugugugugugug

SEQ ID NO: 1162947 - RNA, 18 nt, Human
ugugugugugugugugug

SEQ ID NO: 1162948 - RNA, 18 nt, Human
ugugugugugugugugug

SEQ ID NO: 1162949 - RNA, 18 nt, Human
ugugugugugugugugug

SEQ ID NO: 1162950 - RNA, 18 nt, Human
ugugugugugugugugug

SEQ ID NO: 1162951 - RNA, 18 nt, Human
ugugugugugugugugug

SEQ ID NO: 1162952 - RNA, 18 nt, Human
ugugugugugugugugug

SEQ ID NO: 1162953 - RNA, 18 nt, Human
ugugugugugugugugug

SEQ ID NO: 1162954 - RNA, 21 nt, Human
ugugugugugugugugugugu

SEQ ID NO: 1162955 - RNA, 21 nt, Human
ugugugugugugugugugugu

SEQ ID NO: 1162956 - RNA, 21 nt, Human
ugugugugugugugugugugu

SEQ ID NO: 1162957 - RNA, 21 nt, Human
ugugugugugugugugugugu

SEQ ID NO: 1162958 - RNA, 21 nt, Human
ugugugugugugugugugugu

SEQ ID NO: 1162959 - RNA, 21 nt, Human
ugugugugugugugugugugu

SEQ ID NO: 1162960 - RNA, 21 nt, Human
ugugugugugugugugugugu

SEQ ID NO: 1162961 - RNA, 21 nt, Human
ugugugugugugugugugugu

SEQ ID NO: 1162962 - RNA, 21 nt, Human
ugugugugugugugugugugu

SEQ ID NO: 1162963 - RNA, 21 nt, Human
ugugugugugugugugugugu

SEQ ID NO: 1162964 - RNA, 21 nt, Human
ugugugugugugugugugugu

SEQ ID NO: 1162965 - RNA, 21 nt, Human
ugugugugugugugugugugu

SEQ ID NO: 1162966 - RNA, 21 nt, Human
ugugugugugugugugugugu

SEQ ID NO: 1162967 - RNA, 21 nt, Human
ugugugugugugugugugugu

SEQ ID NO: 1162968 - RNA, 21 nt, Human
ugugugugugugugugugugu

SEQ ID NO: 1162969 - RNA, 21 nt, Human
ugugugugugugugugugugu

SEQ ID NO: 1162970 - RNA, 21 nt, Human
ugugugugugugugugugugu

SEQ ID NO: 1162971 - RNA, 21 nt, Human
ugugugugugugugugugugu

SEQ ID NO: 1162972 - RNA, 21 nt, Human
ugugugugugugugugugugu

SEQ ID NO: 1162973 - RNA, 21 nt, Human
ugugugugugugugugugugu

SEQ ID NO: 1162974 - RNA, 21 nt, Human
ugugugugugugugugugugu

SEQ ID NO: 1162975 - RNA, 21 nt, Human
ugugugugugugugugugugu

SEQ ID NO: 1162976 - RNA, 21 nt, Human
ugugugugugugugugugugu

SEQ ID NO: 1162977 - RNA, 21 nt, Human
ugugugugugugugugugugu

SEQ ID NO: 1162978 - RNA, 21 nt, Human
ugugugugugugugugugugu

SEQ ID NO: 1162979 - RNA, 22 nt, Human
ugugugugugugugugugugug

SEQ ID NO: 1162980 - RNA, 22 nt, Human
ugugugugugugugugugugug

SEQ ID NO: 1162981 - RNA, 22 nt, Human
ugugugugugugugugugugug

SEQ ID NO: 1162982 - RNA, 22 nt, Human
ugugugugugugugugugugug

SEQ ID NO: 1162983 - RNA, 22 nt, Human
ugugugugugugugugugugug

SEQ ID NO: 1162984 - RNA, 22 nt, Human
ugugugugugugugugugugug

SEQ ID NO: 1162985 - RNA, 22 nt, Human
ugugugugugugugugugugug

SEQ ID NO: 1162986 - RNA, 23 nt, Human
ugugugugugugugugugugugu

SEQ ID NO: 1162987 - RNA, 22 nt, Human
uuaagccccugcugugugccgg

SEQ ID NO: 1162988 - RNA, 22 nt, Human
uuccugcacccaaggaucucau

SEQ ID NO: 1162989 - RNA, 18 nt, Human
uucuaagccccaggagau

SEQ ID NO: 1162990 - RNA, 19 nt, Human
uucuggggagcgaaggccc

SEQ ID NO: 1162991 - RNA, 23 nt, Human
uuggaauuucccugcuguucugg

SEQ ID NO: 1162992 - RNA, 18 nt, Human
acaauggaugcugccuag

SEQ ID NO: 1162993 - RNA, 20 nt, Human
cacccccugaaagcagauuc

SEQ ID NO: 1162994 - RNA, 24 nt, Human
cauggaaauccccuuacacccccc

SEQ ID NO: 1162995 - RNA, 22 nt, Human
cccccugaaagcagauucaggu

SEQ ID NO: 1162996 - RNA, 22 nt, Human
ccccuuacacccccugaaagca

SEQ ID NO: 1162997 - RNA, 22 nt, Human
ccggaaggcgagaaauaggucu

SEQ ID NO: 1162998 - RNA, 18 nt, Human
ccuagucaagacguagag

SEQ ID NO: 1162999 - RNA, 19 nt, Human
ccuagucaagacguagagc

SEQ ID NO: 1163000 - RNA, 22 nt, Human
cgucacaguaucuccuacucau

SEQ ID NO: 1163001 - RNA, 24 nt, Human
gaaauccccuuacacccccugaaa

SEQ ID NO: 1163002 - RNA, 23 nt, Human
uacccaaggcagccaugcuguga

SEQ ID NO: 1163003 - RNA, 22 nt, Human
ucaaggcagguuugggacucac

SEQ ID NO: 1163004 - RNA, 20 nt, Human
ucaggugugcuagaugguau

SEQ ID NO: 1163005 - RNA, 20 nt, Human
uccccuuacacccccugaaa

SEQ ID NO: 1163006 - RNA, 21 nt, Human
uccguuuccuugagucaaggc

SEQ ID NO: 1163007 - RNA, 22 nt, Human
uccuacucaugugcuuccagaa

SEQ ID NO: 1163008 - RNA, 21 nt, Human
uggaaauccccuuacaccccc

SEQ ID NO: 1163009 - RNA, 21 nt, Human
uggaugcugccuagcuucuag

SEQ ID NO: 1163010 - RNA, 19 nt, Human
ugggacucacucacaaccc

SEQ ID NO: 1163011 - RNA, 20 nt, Human
ugucuugcuggggcauuugc

SEQ ID NO: 1163012 - RNA, 20 nt, Human
uugcuggggcauuugcucuc

SEQ ID NO: 1163013 - RNA, 21 nt, Human
uugcuggggcauuugcucucg

SEQ ID NO: 1163014 - RNA, 22 nt, Human
aauuccuacaaggcaacagucc

SEQ ID NO: 1163015 - RNA, 19 nt, Human
guccuucuggcuaugucac

SEQ ID NO: 1163016 - RNA, 20 nt, Human
aacccaauccuucaauccca

SEQ ID NO: 1163017 - RNA, 25 nt, Human
acauagaaaaauacaucucaguaac

SEQ ID NO: 1163018 - RNA, 20 nt, Human
acaugccgaagacaaaucua

SEQ ID NO: 1163019 - RNA, 21 nt, Human
acaugccgaagacaaaucuac

SEQ ID NO: 1163020 - RNA, 18 nt, Human
accuuaaggcaccagaga

SEQ ID NO: 1163021 - RNA, 22 nt, Human
agaaaacccaauccuucaaucc

SEQ ID NO: 1163022 - RNA, 26 nt, Human
agaaaacccaauccuucaaucccaag

SEQ ID NO: 1163023 - RNA, 22 nt, Human
agcaguuuuagguccaacguac

SEQ ID NO: 1163024 - RNA, 19 nt, Human
agugcuuuaagaagcgugc

SEQ ID NO: 1163025 - RNA, 20 nt, Human
aucaugcauuucauuucuuu

SEQ ID NO: 1163026 - RNA, 21 nt, Human
caaaacucacucuccuacugc

SEQ ID NO: 1163027 - RNA, 18 nt, Human
caaacaacugcacccaag

SEQ ID NO: 1163028 - RNA, 22 nt, Human
caaagccaacucauggucaaaa

SEQ ID NO: 1163029 - RNA, 21 nt, Human
cauaaagggaucaucagccca

SEQ ID NO: 1163030 - RNA, 19 nt, Human
cauagaaaaauacaucuca

SEQ ID NO: 1163031 - RNA, 21 nt, Human
cauuucuuuccuagcuaggag

SEQ ID NO: 1163032 - RNA, 22 nt, Human
ccaagagcucagcuccaggcuc

SEQ ID NO: 1163033 - RNA, 23 nt, Human
ccaaugacacucaugccucuucc

SEQ ID NO: 1163034 - RNA, 19 nt, Human
cccaaaacucacucuccua

SEQ ID NO: 1163035 - RNA, 18 nt, Human
cccacuguuuccauggag

SEQ ID NO: 1163036 - RNA, 22 nt, Human
ccccaucacuuucaauguccua

SEQ ID NO: 1163037 - RNA, 20 nt, Human
ccuccuguagacucugagga

SEQ ID NO: 1163038 - RNA, 22 nt, Human
ccuucuacaccaccuuaaggca

SEQ ID NO: 1163039 - RNA, 21 nt, Human
cgucgcgugucuggccccaaa

SEQ ID NO: 1163040 - RNA, 22 nt, Human
cuagcacagaagaaacccacaa

SEQ ID NO: 1163041 - RNA, 23 nt, Human
cuagcacagaagaaacccacaau

SEQ ID NO: 1163042 - RNA, 19 nt, Human
cucaguaacaagagaaaau

SEQ ID NO: 1163043 - RNA, 18 nt, Human
cuggccccaaaacucacu

SEQ ID NO: 1163044 - RNA, 18 nt, Human
gaccuuguccuuuuccac

SEQ ID NO: 1163045 - RNA, 23 nt, Human
gagaagaggacuaaauacauuaa

SEQ ID NO: 1163046 - RNA, 20 nt, Human
gagcucagcuccaggcucug

SEQ ID NO: 1163047 - RNA, 21 nt, Human
gaggguagaguuacaaagcca

SEQ ID NO: 1163048 - RNA, 21 nt, Human
gaucuuuuccuucuacaccac

SEQ ID NO: 1163049 - RNA, 19 nt, Human
gcacagaagaaacccacaa

SEQ ID NO: 1163050 - RNA, 24 nt, Human
ggaaaaaaacccuuuaauugugaa

SEQ ID NO: 1163051 - RNA, 23 nt, Human
ggaagaacuaaggaguccacaga

SEQ ID NO: 1163052 - RNA, 19 nt, Human
gggaaagagaaaacccaau

SEQ ID NO: 1163053 - RNA, 23 nt, Human
gggaaugggggaguggaaagaga

SEQ ID NO: 1163054 - RNA, 19 nt, Human
uaaauagcacagggaaugg

SEQ ID NO: 1163055 - RNA, 19 nt, Human
uaacaagagaaaaugccgg

SEQ ID NO: 1163056 - RNA, 24 nt, Human
uaagaaccaccagcuguuuaaaag

SEQ ID NO: 1163057 - RNA, 18 nt, Human
uaauuugucucucuccuc

SEQ ID NO: 1163058 - RNA, 22 nt, Human
uacaaagccaacucauggucaa

SEQ ID NO: 1163059 - RNA, 20 nt, Human
uaccaaagugaacuugccaa

SEQ ID NO: 1163060 - RNA, 20 nt, Human
uagcacagaagaaacccaca

SEQ ID NO: 1163061 - RNA, 20 nt, Human
uaggauagaccccagccucc

SEQ ID NO: 1163062 - RNA, 23 nt, Human
uaggauagaccccagccucccac

SEQ ID NO: 1163063 - RNA, 19 nt, Human
uaucugaacuuucauggaa

SEQ ID NO: 1163064 - RNA, 21 nt, Human
ucaccugcaaaagcugguugu

SEQ ID NO: 1163065 - RNA, 23 nt, Human
ucccaccaaaauguguuugugca

SEQ ID NO: 1163066 - RNA, 18 nt, Human
ucccaugguucuccccca

SEQ ID NO: 1163067 - RNA, 24 nt, Human
uccuguagacucugaggacacauu

SEQ ID NO: 1163068 - RNA, 20 nt, Human
ucuucacaccuuacccacug

SEQ ID NO: 1163069 - RNA, 24 nt, Human
ucuuuaaucuucacaccuuaccca

SEQ ID NO: 1163070 - RNA, 26 nt, Human
ucuuuaaucuucacaccuuacccacu

SEQ ID NO: 1163071 - RNA, 18 nt, Human
ugaaagcaguuuuagguc

SEQ ID NO: 1163072 - RNA, 18 nt, Human
ugaaagcaguuuuagguc

SEQ ID NO: 1163073 - RNA, 19 nt, Human
ugaccagucaccaagagcu

SEQ ID NO: 1163074 - RNA, 20 nt, Human
ugagguuaagagagguaggu

SEQ ID NO: 1163075 - RNA, 19 nt, Human
ugcaaacaacugcacccaa

SEQ ID NO: 1163076 - RNA, 21 nt, Human
ugcacaguuagucggcagcag

SEQ ID NO: 1163077 - RNA, 23 nt, Human
ugccaaugacacucaugccucuu

SEQ ID NO: 1163078 - RNA, 24 nt, Human
ugcccaggauucaaccuggaagaa

SEQ ID NO: 1163079 - RNA, 20 nt, Human
ugccgaagacaaaucuacuu

SEQ ID NO: 1163080 - RNA, 19 nt, Human
uggaaagagacuaugugac

SEQ ID NO: 1163081 - RNA, 23 nt, Human
uggaagaacuaaggaguccacag

SEQ ID NO: 1163082 - RNA, 23 nt, Human
uggacacagccugcugguguuuu

SEQ ID NO: 1163083 - RNA, 19 nt, Human
uggcuauaacgucacugca

SEQ ID NO: 1163084 - RNA, 21 nt, Human
ugucuggccccaaaacucacu

SEQ ID NO: 1163085 - RNA, 21 nt, Human
ugugaaaaagcauacauuuua

SEQ ID NO: 1163086 - RNA, 21 nt, Human
ugugcagagcccauuuucaaa

SEQ ID NO: 1163087 - RNA, 18 nt, Human
uguguuugugcagagccc

SEQ ID NO: 1163088 - RNA, 19 nt, Human
uguguuugugcagagccca

SEQ ID NO: 1163089 - RNA, 27 nt, Human
uuaacaaucccauuaauuugucucucu

SEQ ID NO: 1163090 - RNA, 21 nt, Human
uucaaaggggugagggaaggc

SEQ ID NO: 1163091 - RNA, 19 nt, Human
uucaaccuggaagaacuaa

SEQ ID NO: 1163092 - RNA, 18 nt, Human
uucagagacaaaaaaaaa

SEQ ID NO: 1163093 - RNA, 19 nt, Human
uucagagacaaaaaaaaau

SEQ ID NO: 1163094 - RNA, 23 nt, Human
uugucucucuccucccuuguucu

SEQ ID NO: 1163095 - RNA, 20 nt, Human
uuugucucucuccucccuuc

SEQ ID NO: 1163096 - RNA, 24 nt, Human
aagucuucuagcacgacacuguuc

SEQ ID NO: 1163097 - RNA, 22 nt, Human
aaucuggcugucaccacacaga

SEQ ID NO: 1163098 - RNA, 19 nt, Human
acaaaacauaagaguagag

SEQ ID NO: 1163099 - RNA, 27 nt, Human
accgagucccugcaaguuggcaugcgc

SEQ ID NO: 1163100 - RNA, 24 nt, Human
acuguucuguuguuccucucucaa

SEQ ID NO: 1163101 - RNA, 20 nt, Human
agaaaaucaucccuucucuc

SEQ ID NO: 1163102 - RNA, 19 nt, Human
aggaguguuuauguccuug

SEQ ID NO: 1163103 - RNA, 19 nt, Human
aggaugggguguggauugc

SEQ ID NO: 1163104 - RNA, 22 nt, Human
agggugggggucuccuccaggg

SEQ ID NO: 1163105 - RNA, 24 nt, Human
cacacagaccauagcuucugcagc

SEQ ID NO: 1163106 - RNA, 28 nt, Human
caccacacagaccauagcuucugcagca

SEQ ID NO: 1163107 - RNA, 21 nt, Human
caccggcgggcaggagaaaau

SEQ ID NO: 1163108 - RNA, 24 nt, Human
cagaggaugggguguggauugcag

SEQ ID NO: 1163109 - RNA, 23 nt, Human
caucuggaaauucaugagacaag

SEQ ID NO: 1163110 - RNA, 19 nt, Human
cccuggggagguggggcug

SEQ ID NO: 1163111 - RNA, 18 nt, Human
gagagugggccaucugga

SEQ ID NO: 1163112 - RNA, 22 nt, Human
gagguggggcugaaagaaggag

SEQ ID NO: 1163113 - RNA, 19 nt, Human
ggccaucuggaaauucaug

SEQ ID NO: 1163114 - RNA, 21 nt, Human
gggagguggggcugaaagaag

SEQ ID NO: 1163115 - RNA, 22 nt, Human
guaauaaacagcuuugugcaaa

SEQ ID NO: 1163116 - RNA, 25 nt, Human
guaauaaacagcuuugugcaaaaca

SEQ ID NO: 1163117 - RNA, 21 nt, Human
uaaacagcuuugugcaaaaca

SEQ ID NO: 1163118 - RNA, 24 nt, Human
uaacaaauacaaaacauaagagua

SEQ ID NO: 1163119 - RNA, 27 nt, Human
uagagaaucuggcugucaccacacaga

SEQ ID NO: 1163120 - RNA, 20 nt, Human
uagcacgacacuguucuguu

SEQ ID NO: 1163121 - RNA, 23 nt, Human
uagcacgacacuguucuguuguu

SEQ ID NO: 1163122 - RNA, 20 nt, Human
ucccuuuauaaaaauagaau

SEQ ID NO: 1163123 - RNA, 19 nt, Human
ugcagcagaggauggggug

SEQ ID NO: 1163124 - RNA, 20 nt, Human
ugcagggugggggucuccuc

SEQ ID NO: 1163125 - RNA, 21 nt, Human
uguucuguuguuccucucuca

SEQ ID NO: 1163126 - RNA, 22 nt, Human
uuggcaugcgcuacggggucug

SEQ ID NO: 1163127 - RNA, 20 nt, Human
uuuuccaacaagucuucuag

SEQ ID NO: 1163128 - RNA, 22 nt, Human
aaaaaaaaaaaaaauugggcag

SEQ ID NO: 1163129 - RNA, 25 nt, Human
aaaagaaaaaaaaaagucaguagaa

SEQ ID NO: 1163130 - RNA, 21 nt, Human
aaaccccaucuccacaaaaaa

SEQ ID NO: 1163131 - RNA, 24 nt, Human
aacagaccaagacucugucucaaa

SEQ ID NO: 1163132 - RNA, 19 nt, Human
aacaugaugaaaccccauc

SEQ ID NO: 1163133 - RNA, 20 nt, Human
aacaugaugaaaccccaucu

SEQ ID NO: 1163134 - RNA, 21 nt, Human
aacaugaugaaaccccaucuc

SEQ ID NO: 1163135 - RNA, 21 nt, Human
aacaugaugaaaccccaucuc

SEQ ID NO: 1163136 - RNA, 21 nt, Human
aacuguaucaucccuaacccc

SEQ ID NO: 1163137 - RNA, 24 nt, Human
aacuuucuguccccaauacacuuc

SEQ ID NO: 1163138 - RNA, 24 nt, Human
aagguugccucucuucugaaacuc

SEQ ID NO: 1163139 - RNA, 18 nt, Human
aaucguuugaaccuggga

SEQ ID NO: 1163140 - RNA, 24 nt, Human
acagaccaagacucugucucaaaa

SEQ ID NO: 1163141 - RNA, 20 nt, Human
acaugagcuacauucuacuu

SEQ ID NO: 1163142 - RNA, 27 nt, Human
accaacuuugcgaccuugagcacguca

SEQ ID NO: 1163143 - RNA, 19 nt, Human
accagaucaugccacugca

SEQ ID NO: 1163144 - RNA, 23 nt, Human
accccaucuccacaaaaaauaca

SEQ ID NO: 1163145 - RNA, 24 nt, Human
accugaggucaggaguucaagacu

SEQ ID NO: 1163146 - RNA, 21 nt, Human
acuaaacuaaggcacaugagc

SEQ ID NO: 1163147 - RNA, 24 nt, Human
acugcacuccagccuggguaacag

SEQ ID NO: 1163148 - RNA, 19 nt, Human
agaagcauauguguuucca

SEQ ID NO: 1163149 - RNA, 23 nt, Human
agaggaaaaggaaaagguggggg

SEQ ID NO: 1163150 - RNA, 19 nt, Human
agagguugcagugagacca

SEQ ID NO: 1163151 - RNA, 24 nt, Human
agagguugcagugagaccagauca

SEQ ID NO: 1163152 - RNA, 23 nt, Human
agaguuugggagaagcauaugug

SEQ ID NO: 1163153 - RNA, 22 nt, Human
agaucaugccacugcacuccag

SEQ ID NO: 1163154 - RNA, 24 nt, Human
agccuggccaacaugaugaaaccc

SEQ ID NO: 1163155 - RNA, 24 nt, Human
agccuggguaacagaccaagacuc

SEQ ID NO: 1163156 - RNA, 22 nt, Human
aggaaaaggugggggugagggg

SEQ ID NO: 1163157 - RNA, 19 nt, Human
aggagacugaggcaagaga

SEQ ID NO: 1163158 - RNA, 23 nt, Human
aggaguucaagacuagccuggcc

SEQ ID NO: 1163159 - RNA, 23 nt, Human
aggaucaccugaggucaggaguu

SEQ ID NO: 1163160 - RNA, 24 nt, Human
aggaucaccugaggucaggaguuc

SEQ ID NO: 1163161 - RNA, 22 nt, Human
aggcaagagaaucguuugaacc

SEQ ID NO: 1163162 - RNA, 24 nt, Human
aggcaagagaaucguuugaaccug

SEQ ID NO: 1163163 - RNA, 24 nt, Human
aggccgaggcgggaggaucaccug

SEQ ID NO: 1163164 - RNA, 18 nt, Human
aggcgggaggaucaccug

SEQ ID NO: 1163165 - RNA, 21 nt, Human
aggcgggaggaucaccugagg

SEQ ID NO: 1163166 - RNA, 22 nt, Human
aggcgggaggaucaccugaggu

SEQ ID NO: 1163167 - RNA, 23 nt, Human
aggcgggaggaucaccugagguc

SEQ ID NO: 1163168 - RNA, 24 nt, Human
agggaguuuaccuaaaucaguggu

SEQ ID NO: 1163169 - RNA, 18 nt, Human
agggcucacaccuagaaa

SEQ ID NO: 1163170 - RNA, 25 nt, Human
agguagagguugcagugacaacggu

SEQ ID NO: 1163171 - RNA, 19 nt, Human
agguagagguugcagugag

SEQ ID NO: 1163172 - RNA, 24 nt, Human
aucaccugaggucaggaguucaag

SEQ ID NO: 1163173 - RNA, 24 nt, Human
aucaugccacugcacuccagccug

SEQ ID NO: 1163174 - RNA, 21 nt, Human
aucuccacaaaaaauacaaaa

SEQ ID NO: 1163175 - RNA, 21 nt, Human
aucucucucucuugccuccag

SEQ ID NO: 1163176 - RNA, 22 nt, Human
augccacugcacuccagccugg

SEQ ID NO: 1163177 - RNA, 19 nt, Human
augccuguaaucccagcac

SEQ ID NO: 1163178 - RNA, 22 nt, Human
cacagguauacaugcaccaugg

SEQ ID NO: 1163179 - RNA, 24 nt, Human
caccagggcucacaccuagaaauu

SEQ ID NO: 1163180 - RNA, 22 nt, Human
caccugaagagcuuuauaaaaa

SEQ ID NO: 1163181 - RNA, 23 nt, Human
caccugaggucaggaguucaaga

SEQ ID NO: 1163182 - RNA, 22 nt, Human
cacuaaacuaaggcacaugagc

SEQ ID NO: 1163183 - RNA, 19 nt, Human
cacugcacuccagccuggg

SEQ ID NO: 1163184 - RNA, 21 nt, Human
cacugcacuccagccugggua

SEQ ID NO: 1163185 - RNA, 22 nt, Human
cacugcacuccagccuggguaa

SEQ ID NO: 1163186 - RNA, 23 nt, Human
cacugcacuccagccuggguaac

SEQ ID NO: 1163187 - RNA, 24 nt, Human
cacugcacuccagccuggguaaca

SEQ ID NO: 1163188 - RNA, 24 nt, Human
cagaauaucuccugaaaaaccucc

SEQ ID NO: 1163189 - RNA, 22 nt, Human
cagaccaagacucugucucaaa

SEQ ID NO: 1163190 - RNA, 24 nt, Human
cagcacuuugagaggccgaggcgg

SEQ ID NO: 1163191 - RNA, 20 nt, Human
caggcaugguggugcgugcc

SEQ ID NO: 1163192 - RNA, 20 nt, Human
caugccuguaaucccagcac

SEQ ID NO: 1163193 - RNA, 24 nt, Human
caugccuguaaucccagcacuuug

SEQ ID NO: 1163194 - RNA, 22 nt, Human
caugugcagaacaugcagguuu

SEQ ID NO: 1163195 - RNA, 24 nt, Human
cauuccauucaccccagacagcca

SEQ ID NO: 1163196 - RNA, 26 nt, Human
cauuccauucaccccagacagccacu

SEQ ID NO: 1163197 - RNA, 22 nt, Human
ccaauacacuuccuacaaaaca

SEQ ID NO: 1163198 - RNA, 21 nt, Human
ccacuaaacuaaggcacauga

SEQ ID NO: 1163199 - RNA, 20 nt, Human
ccacugcacuccagccuggg

SEQ ID NO: 1163200 - RNA, 20 nt, Human
ccacugcacuccagccuggg

SEQ ID NO: 1163201 - RNA, 20 nt, Human
ccacugcacuccagccuggg

SEQ ID NO: 1163202 - RNA, 21 nt, Human
ccacugcacuccagccugggu

SEQ ID NO: 1163203 - RNA, 22 nt, Human
ccacugcacuccagccugggua

SEQ ID NO: 1163204 - RNA, 24 nt, Human
ccacugcacuccagccuggguaac

SEQ ID NO: 1163205 - RNA, 20 nt, Human
ccagcucauuccauucaccc

SEQ ID NO: 1163206 - RNA, 18 nt, Human
ccaucuccacaaaaaaua

SEQ ID NO: 1163207 - RNA, 23 nt, Human
cccagacagccacuaaacuaagg

SEQ ID NO: 1163208 - RNA, 24 nt, Human
ccccagacagccacuaaacuaagg

SEQ ID NO: 1163209 - RNA, 18 nt, Human
ccccagccacugucuucu

SEQ ID NO: 1163210 - RNA, 20 nt, Human
ccuaacccccagccacuguc

SEQ ID NO: 1163211 - RNA, 22 nt, Human
ccugaaaaaccuccaagaaguc

SEQ ID NO: 1163212 - RNA, 23 nt, Human
ccugaagagcuuuauaaaaacgc

SEQ ID NO: 1163213 - RNA, 18 nt, Human
ccugagucagauaugaag

SEQ ID NO: 1163214 - RNA, 24 nt, Human
ccuggccaacaugaugaaacccca

SEQ ID NO: 1163215 - RNA, 21 nt, Human
ccuguagucucagcuacucag

SEQ ID NO: 1163216 - RNA, 22 nt, Human
ccuguagucucagcuacucagg

SEQ ID NO: 1163217 - RNA, 19 nt, Human
ccuucaagcuuuacacaac

SEQ ID NO: 1163218 - RNA, 20 nt, Human
cgaggcgggaggaucaccug

SEQ ID NO: 1163219 - RNA, 18 nt, Human
cgggaggaucaccugagg

SEQ ID NO: 1163220 - RNA, 24 nt, Human
cgggaggaucaccugaggucagga

SEQ ID NO: 1163221 - RNA, 23 nt, Human
cucaaaauaaaagaaaaaaaaaa

SEQ ID NO: 1163222 - RNA, 24 nt, Human
cucaaaauaaaagaaaaaaaaaag

SEQ ID NO: 1163223 - RNA, 24 nt, Human
cucaugccuguaaucccagcacuu

SEQ ID NO: 1163224 - RNA, 26 nt, Human
cuccaagaagucuaagaggaaaagga

SEQ ID NO: 1163225 - RNA, 21 nt, Human
cuccagcucauuccauucacc

SEQ ID NO: 1163226 - RNA, 24 nt, Human
cugcaccuaucaacccgucaucua

SEQ ID NO: 1163227 - RNA, 20 nt, Human
cuguccccaauacacuuccu

SEQ ID NO: 1163228 - RNA, 21 nt, Human
cuucauaaaugcaacauggaa

SEQ ID NO: 1163229 - RNA, 19 nt, Human
cuucuccaaagagcugaca

SEQ ID NO: 1163230 - RNA, 21 nt, Human
gaaaccccaucuccacaaaaa

SEQ ID NO: 1163231 - RNA, 23 nt, Human
gagaaucguuugaaccugggagg

SEQ ID NO: 1163232 - RNA, 25 nt, Human
gaggcgggaggaucaccugagguca

SEQ ID NO: 1163233 - RNA, 23 nt, Human
gaucaccugaggucaggaguuca

SEQ ID NO: 1163234 - RNA, 24 nt, Human
gaucaccugaggucaggaguucaa

SEQ ID NO: 1163235 - RNA, 19 nt, Human
gcagggcgcgguggcucau

SEQ ID NO: 1163236 - RNA, 24 nt, Human
gccaacaugaugaaaccccaucuc

SEQ ID NO: 1163237 - RNA, 19 nt, Human
gccacugcacuccagccug

SEQ ID NO: 1163238 - RNA, 24 nt, Human
gccacugcacuccagccuggguaa

SEQ ID NO: 1163239 - RNA, 20 nt, Human
gcgugccuguagucucagcu

SEQ ID NO: 1163240 - RNA, 23 nt, Human
ggaucaccugaggucaggaguuc

SEQ ID NO: 1163241 - RNA, 18 nt, Human
ggcagggcgcgguggcuc

SEQ ID NO: 1163242 - RNA, 21 nt, Human
ggcucaugccuguaaucccag

SEQ ID NO: 1163243 - RNA, 24 nt, Human
gggcgcgguggcucaugccuguaa

SEQ ID NO: 1163244 - RNA, 23 nt, Human
gguggcucaugccuguaauccca

SEQ ID NO: 1163245 - RNA, 24 nt, Human
gguggcucaugccuguaaucccag

SEQ ID NO: 1163246 - RNA, 24 nt, Human
guggugcgugccuguagucucagc

SEQ ID NO: 1163247 - RNA, 21 nt, Human
uaacagaccaagacucugucu

SEQ ID NO: 1163248 - RNA, 18 nt, Human
uaaccaacuuugcgaccu

SEQ ID NO: 1163249 - RNA, 19 nt, Human
uaagaggaaaaggaaaagg

SEQ ID NO: 1163250 - RNA, 24 nt, Human
uaagccccguaugcauuaguuauu

SEQ ID NO: 1163251 - RNA, 26 nt, Human
uacaaaaaaaaaaaaaaauugggcag

SEQ ID NO: 1163252 - RNA, 24 nt, Human
uagaaugaaauaagguugccucuc

SEQ ID NO: 1163253 - RNA, 24 nt, Human
uagccuggccaacaugaugaaacc

SEQ ID NO: 1163254 - RNA, 20 nt, Human
uaggggcagggcgcgguggc

SEQ ID NO: 1163255 - RNA, 18 nt, Human
uaucaacccgucaucuag

SEQ ID NO: 1163256 - RNA, 23 nt, Human
ucaugccacugcacuccagccug

SEQ ID NO: 1163257 - RNA, 22 nt, Human
ucaugccuguaaucccagcacu

SEQ ID NO: 1163258 - RNA, 23 nt, Human
ucccagucuuacccuaaccaacu

SEQ ID NO: 1163259 - RNA, 26 nt, Human
uccccaauacacuuccuacaaaacaa

SEQ ID NO: 1163260 - RNA, 18 nt, Human
ucguuugaaccugggagg

SEQ ID NO: 1163261 - RNA, 24 nt, Human
ucucaaaauaaaagaaaaaaaaaa

SEQ ID NO: 1163262 - RNA, 23 nt, Human
ucuuacccuaaccaacuuugcga

SEQ ID NO: 1163263 - RNA, 24 nt, Human
ugaaccugggagguagagguugca

SEQ ID NO: 1163264 - RNA, 24 nt, Human
ugaagauaggaaccuucucccuuc

SEQ ID NO: 1163265 - RNA, 20 nt, Human
ugagaccagaucaugccacu

SEQ ID NO: 1163266 - RNA, 20 nt, Human
ugagaggccgaggcgggagg

SEQ ID NO: 1163267 - RNA, 24 nt, Human
ugagaggccgaggcgggaggauca

SEQ ID NO: 1163268 - RNA, 20 nt, Human
ugaggcaagagaaucguuug

SEQ ID NO: 1163269 - RNA, 24 nt, Human
ugaggcaagagaaucguuugaacc

SEQ ID NO: 1163270 - RNA, 25 nt, Human
ugaggcaagagaaucguuugaaccu

SEQ ID NO: 1163271 - RNA, 22 nt, Human
ugaggggagagucccugaguca

SEQ ID NO: 1163272 - RNA, 20 nt, Human
ugcaccauggugguuugcug

SEQ ID NO: 1163273 - RNA, 18 nt, Human
ugccuguaaucccagcac

SEQ ID NO: 1163274 - RNA, 24 nt, Human
ugccuguagucucagcuacucagg

SEQ ID NO: 1163275 - RNA, 19 nt, Human
uggaaagucaguaggggca

SEQ ID NO: 1163276 - RNA, 22 nt, Human
uggcucaugccuguaaucccag

SEQ ID NO: 1163277 - RNA, 24 nt, Human
uggcucaugccuguaaucccagca

SEQ ID NO: 1163278 - RNA, 23 nt, Human
ugggagguagagguugcagugag

SEQ ID NO: 1163279 - RNA, 22 nt, Human
ugggauccaugugcagaacaug

SEQ ID NO: 1163280 - RNA, 21 nt, Human
ugggggugaggggagaguccc

SEQ ID NO: 1163281 - RNA, 18 nt, Human
uggugcgugccuguaguc

SEQ ID NO: 1163282 - RNA, 24 nt, Human
ugguggugcgugccuguagucuca

SEQ ID NO: 1163283 - RNA, 24 nt, Human
uugaaccugggagguagagguugc

SEQ ID NO: 1163284 - RNA, 20 nt, Human
uuuacacaacuuucuguccc

SEQ ID NO: 1163285 - RNA, 20 nt, Human
uuuauaaaaacgcccacacc

SEQ ID NO: 1163286 - RNA, 19 nt, Human
aaaaaaaucaauggaccca

SEQ ID NO: 1163287 - RNA, 21 nt, Human
aaaaaaaucaauggacccaaa

SEQ ID NO: 1163288 - RNA, 23 nt, Human
aaaaagaaaacaauagaaaaaaa

SEQ ID NO: 1163289 - RNA, 19 nt, Human
aaaaaggugucaugccucu

SEQ ID NO: 1163290 - RNA, 20 nt, Human
aaaaaugacaaaggaagaaa

SEQ ID NO: 1163291 - RNA, 22 nt, Human
aaaagaaccuaaaacaaggaca

SEQ ID NO: 1163292 - RNA, 23 nt, Human
aaacagaaaauccaaaagccuca

SEQ ID NO: 1163293 - RNA, 19 nt, Human
aaaccaugacagacacauc

SEQ ID NO: 1163294 - RNA, 24 nt, Human
aaagaaccuaaaacaaggacagca

SEQ ID NO: 1163295 - RNA, 26 nt, Human
aaagauccugacucaaaaaaaaagac

SEQ ID NO: 1163296 - RNA, 20 nt, Human
aaaguaaaauagcaagccag

SEQ ID NO: 1163297 - RNA, 18 nt, Human
aaagugcugggauuacaa

SEQ ID NO: 1163298 - RNA, 24 nt, Human
aaagugcugggauuacaagcguga

SEQ ID NO: 1163299 - RNA, 19 nt, Human
aaagugcugggauuccagg

SEQ ID NO: 1163300 - RNA, 24 nt, Human
aaagugcugggauuccaggcauga

SEQ ID NO: 1163301 - RNA, 20 nt, Human
aacacagcgagacccagucu

SEQ ID NO: 1163302 - RNA, 21 nt, Human
aacacagcgagacccagucuc

SEQ ID NO: 1163303 - RNA, 25 nt, Human
aaccauuaagaaaguaaaauagcaa

SEQ ID NO: 1163304 - RNA, 23 nt, Human
aaccuuuucuuuaaauuagcaga

SEQ ID NO: 1163305 - RNA, 25 nt, Human
aagaaaacacaaauggcccagagca

SEQ ID NO: 1163306 - RNA, 22 nt, Human
aagaaacagaaaauccaaaagc

SEQ ID NO: 1163307 - RNA, 24 nt, Human
aagaaaguaaaauagcaagccaga

SEQ ID NO: 1163308 - RNA, 22 nt, Human
aaguagcugggauuacaggugc

SEQ ID NO: 1163309 - RNA, 23 nt, Human
aaguagguuucuuuggggaaaau

SEQ ID NO: 1163310 - RNA, 28 nt, Human
aagugaccucaugagcaucucacuaggu

SEQ ID NO: 1163311 - RNA, 19 nt, Human
aagugcugggauuacaagc

SEQ ID NO: 1163312 - RNA, 19 nt, Human
aagugcugggauuacaagc

SEQ ID NO: 1163313 - RNA, 26 nt, Human
aagugcugggauuacaagcgugagcc

SEQ ID NO: 1163314 - RNA, 19 nt, Human
aagugcugggauuccaggc

SEQ ID NO: 1163315 - RNA, 24 nt, Human
aaucacuugagaccaggacuccga

SEQ ID NO: 1163316 - RNA, 24 nt, Human
aaugaaaaaccuaagcaaaaagaa

SEQ ID NO: 1163317 - RNA, 23 nt, Human
aaugacaaaggaagaaacagaaa

SEQ ID NO: 1163318 - RNA, 24 nt, Human
aauuuuuuauuuuuaguagagaug

SEQ ID NO: 1163319 - RNA, 18 nt, Human
acaaaggaagaaacagaa

SEQ ID NO: 1163320 - RNA, 20 nt, Human
accauggccacagggacuua

SEQ ID NO: 1163321 - RNA, 18 nt, Human
accauguuggccaggcug

SEQ ID NO: 1163322 - RNA, 23 nt, Human
acccagucucuauaaaaaaaacc

SEQ ID NO: 1163323 - RNA, 18 nt, Human
acgggguuucaccauguu

SEQ ID NO: 1163324 - RNA, 19 nt, Human
acgggguuucaccauguug

SEQ ID NO: 1163325 - RNA, 21 nt, Human
acgggguuucaccauguugac

SEQ ID NO: 1163326 - RNA, 24 nt, Human
acgggguuucaccauguugacuag

SEQ ID NO: 1163327 - RNA, 21 nt, Human
acguuggccucccaaagugcu

SEQ ID NO: 1163328 - RNA, 24 nt, Human
acuccgagaccagccugggcaaca

SEQ ID NO: 1163329 - RNA, 23 nt, Human
acugcacuccaagccugugcgag

SEQ ID NO: 1163330 - RNA, 21 nt, Human
agaaaacacaaauggcccaga

SEQ ID NO: 1163331 - RNA, 28 nt, Human
agaaaagagcaaaagucaaugaaaaaga

SEQ ID NO: 1163332 - RNA, 22 nt, Human
agaaaggaaauucauaagaaaa

SEQ ID NO: 1163333 - RNA, 23 nt, Human
agaagaaaggaaauucauaagaa

SEQ ID NO: 1163334 - RNA, 22 nt, Human
agacaaugaacauccaagccca

SEQ ID NO: 1163335 - RNA, 18 nt, Human
agccuccagaguagcugg

SEQ ID NO: 1163336 - RNA, 24 nt, Human
agccugggcaacacagcgagaccc

SEQ ID NO: 1163337 - RNA, 23 nt, Human
aggaagaaacagaaaauccaaaa

SEQ ID NO: 1163338 - RNA, 24 nt, Human
aggaagugaccucaugagcaucuc

SEQ ID NO: 1163339 - RNA, 23 nt, Human
aggacuccgagaccagccugggc

SEQ ID NO: 1163340 - RNA, 18 nt, Human
aggcaggugaaucacuug

SEQ ID NO: 1163341 - RNA, 26 nt, Human
aggcaggugaaucacuugagaccagg

SEQ ID NO: 1163342 - RNA, 20 nt, Human
aggcaugcaccaccacaccc

SEQ ID NO: 1163343 - RNA, 25 nt, Human
aggcuggagugcaguggugugaucu

SEQ ID NO: 1163344 - RNA, 24 nt, Human
aggugauccauccacguuggccuc

SEQ ID NO: 1163345 - RNA, 19 nt, Human
agguggaggcaggugaauc

SEQ ID NO: 1163346 - RNA, 23 nt, Human
aggugggaggcucgcuugagccc

SEQ ID NO: 1163347 - RNA, 22 nt, Human
aguagagaugggguuucaccau

SEQ ID NO: 1163348 - RNA, 21 nt, Human
aguagcugggauuacaggcau

SEQ ID NO: 1163349 - RNA, 23 nt, Human
aguagcugggauuacaggcaugc

SEQ ID NO: 1163350 - RNA, 19 nt, Human
agucaaugaaaaagaaaac

SEQ ID NO: 1163351 - RNA, 20 nt, Human
agugcaauggcgcgaucucg

SEQ ID NO: 1163352 - RNA, 24 nt, Human
agugcaauggcgcgaucucggcuc

SEQ ID NO: 1163353 - RNA, 19 nt, Human
agugcaguggugugaucuc

SEQ ID NO: 1163354 - RNA, 21 nt, Human
agugcaguggugugaucucag

SEQ ID NO: 1163355 - RNA, 23 nt, Human
agugcaguggugugaucucagcu

SEQ ID NO: 1163356 - RNA, 24 nt, Human
agugcaguggugugaucucagcuc

SEQ ID NO: 1163357 - RNA, 24 nt, Human
agugcugggauuacaagcgugagc

SEQ ID NO: 1163358 - RNA, 24 nt, Human
aguggugugaucucagcucacugc

SEQ ID NO: 1163359 - RNA, 20 nt, Human
aguucaagugauucuccugc

SEQ ID NO: 1163360 - RNA, 23 nt, Human
auccgcccaccuccaccucccaa

SEQ ID NO: 1163361 - RNA, 25 nt, Human
aucgcaccacugcacuccaagccug

SEQ ID NO: 1163362 - RNA, 19 nt, Human
aucuuuaaaaaaaugacaa

SEQ ID NO: 1163363 - RNA, 18 nt, Human
augggguuucaccauguu

SEQ ID NO: 1163364 - RNA, 22 nt, Human
augggguuucaccauguuggcc

SEQ ID NO: 1163365 - RNA, 23 nt, Human
augggguuucaccauguuggcca

SEQ ID NO: 1163366 - RNA, 24 nt, Human
augggguuucaccauguuggccag

SEQ ID NO: 1163367 - RNA, 21 nt, Human
auuacaggugccugccaccau

SEQ ID NO: 1163368 - RNA, 18 nt, Human
auucuccugccucagccu

SEQ ID NO: 1163369 - RNA, 22 nt, Human
caaaagaaccuaaaacaaggac

SEQ ID NO: 1163370 - RNA, 19 nt, Human
caaacccaacacugagccg

SEQ ID NO: 1163371 - RNA, 23 nt, Human
caaacccaacacugagccgggag

SEQ ID NO: 1163372 - RNA, 24 nt, Human
caaagugcugggauuacaagcgug

SEQ ID NO: 1163373 - RNA, 24 nt, Human
caaagugcugggauuccaggcaug

SEQ ID NO: 1163374 - RNA, 23 nt, Human
caaccuccaccuccugaguucaa

SEQ ID NO: 1163375 - RNA, 21 nt, Human
caagacaaugaacauccaagc

SEQ ID NO: 1163376 - RNA, 23 nt, Human
caagacaaugaacauccaagccc

SEQ ID NO: 1163377 - RNA, 22 nt, Human
caagccauucuccugccucagc

SEQ ID NO: 1163378 - RNA, 23 nt, Human
caagccugugcgagaaagauccu

SEQ ID NO: 1163379 - RNA, 22 nt, Human
caagugauucuccugccucagc

SEQ ID NO: 1163380 - RNA, 27 nt, Human
caagugauucuccugccucagccucca

SEQ ID NO: 1163381 - RNA, 22 nt, Human
caauagaaaaaaaaaaucaaug

SEQ ID NO: 1163382 - RNA, 19 nt, Human
caccacugcacuccaagcc

SEQ ID NO: 1163383 - RNA, 24 nt, Human
caccauguugacuagguuggucuc

SEQ ID NO: 1163384 - RNA, 21 nt, Human
caccauguuggccaggcuggu

SEQ ID NO: 1163385 - RNA, 24 nt, Human
caccauguuggccaggcuggucuc

SEQ ID NO: 1163386 - RNA, 27 nt, Human
caccauguuggccaggcuggucucaaa

SEQ ID NO: 1163387 - RNA, 19 nt, Human
caccgcacccggccggcuc

SEQ ID NO: 1163388 - RNA, 21 nt, Human
caccuccaccucccaaagugc

SEQ ID NO: 1163389 - RNA, 24 nt, Human
caccuccaccucccaaagugcugg

SEQ ID NO: 1163390 - RNA, 18 nt, Human
caccuguaauccuggcac

SEQ ID NO: 1163391 - RNA, 22 nt, Human
caccuguaauccuggcacuccg

SEQ ID NO: 1163392 - RNA, 27 nt, Human
cacgugauccgcccaccuccaccuccc

SEQ ID NO: 1163393 - RNA, 21 nt, Human
cacugcaaccuccaccuccug

SEQ ID NO: 1163394 - RNA, 18 nt, Human
cacugcaaccucugccuc

SEQ ID NO: 1163395 - RNA, 21 nt, Human
cacugcaaccucugccuccca

SEQ ID NO: 1163396 - RNA, 22 nt, Human
cacugcacuccaagccugugcg

SEQ ID NO: 1163397 - RNA, 23 nt, Human
cacugcacuccaagccugugcga

SEQ ID NO: 1163398 - RNA, 24 nt, Human
cagaguagcugggauuacaggcau

SEQ ID NO: 1163399 - RNA, 21 nt, Human
caggaaaagcccucagcaaau

SEQ ID NO: 1163400 - RNA, 21 nt, Human
caggcaugagccaccgcaccc

SEQ ID NO: 1163401 - RNA, 19 nt, Human
caggugccugccaccaugc

SEQ ID NO: 1163402 - RNA, 23 nt, Human
caggugccugccaccaugccugg

SEQ ID NO: 1163403 - RNA, 18 nt, Human
caucaaacuggaaaccuu

SEQ ID NO: 1163404 - RNA, 24 nt, Human
caugcagagaaaaggccaaugcac

SEQ ID NO: 1163405 - RNA, 24 nt, Human
cauguuggccaggcuggucucaaa

SEQ ID NO: 1163406 - RNA, 20 nt, Human
ccaaagugcugggauuacaa

SEQ ID NO: 1163407 - RNA, 22 nt, Human
ccaaagugcugggauuacaagc

SEQ ID NO: 1163408 - RNA, 24 nt, Human
ccaaagugcugggauuacaagcgu

SEQ ID NO: 1163409 - RNA, 24 nt, Human
ccaaagugcugggauuccaggcau

SEQ ID NO: 1163410 - RNA, 21 nt, Human
ccaaguagcugggauuacagg

SEQ ID NO: 1163411 - RNA, 24 nt, Human
ccaccuccugaguucaagugauuc

SEQ ID NO: 1163412 - RNA, 18 nt, Human
ccaccuguaauccuggca

SEQ ID NO: 1163413 - RNA, 19 nt, Human
ccacugcacuccaagccug

SEQ ID NO: 1163414 - RNA, 20 nt, Human
ccacugcacuccaagccugu

SEQ ID NO: 1163415 - RNA, 22 nt, Human
ccacugcacuccaagccugugc

SEQ ID NO: 1163416 - RNA, 19 nt, Human
ccagaguagcugggauuac

SEQ ID NO: 1163417 - RNA, 23 nt, Human
ccagaguagcugggauuacaggc

SEQ ID NO: 1163418 - RNA, 24 nt, Human
ccagaguagcugggauuacaggca

SEQ ID NO: 1163419 - RNA, 25 nt, Human
ccagaguagcugggauuacaggcau

SEQ ID NO: 1163420 - RNA, 21 nt, Human
ccaggcaugagccaccgcacc

SEQ ID NO: 1163421 - RNA, 23 nt, Human
ccaggccggagugcaauggcgcg

SEQ ID NO: 1163422 - RNA, 24 nt, Human
ccaggcuggguguggcggcucccg

SEQ ID NO: 1163423 - RNA, 24 nt, Human
ccagggaagugcaaguuacuacaa

SEQ ID NO: 1163424 - RNA, 22 nt, Human
ccagugcaaacccaacacugag

SEQ ID NO: 1163425 - RNA, 23 nt, Human
ccagugucccucaagagcauucc

SEQ ID NO: 1163426 - RNA, 23 nt, Human
cccaaguagcugggauuacaggu

SEQ ID NO: 1163427 - RNA, 24 nt, Human
cccaaguagcugggauuacaggug

SEQ ID NO: 1163428 - RNA, 20 nt, Human
cccagguucaagccauucuc

SEQ ID NO: 1163429 - RNA, 23 nt, Human
ccucaugucuauuuuuaaaaauc

SEQ ID NO: 1163430 - RNA, 24 nt, Human
ccucccagguucaagccauucucc

SEQ ID NO: 1163431 - RNA, 24 nt, Human
ccuccugaguucaagugauucucc

SEQ ID NO: 1163432 - RNA, 22 nt, Human
ccucgcucuguugcccaggcug

SEQ ID NO: 1163433 - RNA, 23 nt, Human
ccucgcucuguugcccaggcugg

SEQ ID NO: 1163434 - RNA, 24 nt, Human
ccucgcucuguugcccaggcugga

SEQ ID NO: 1163435 - RNA, 26 nt, Human
ccucgcucuguugcccaggcuggagu

SEQ ID NO: 1163436 - RNA, 27 nt, Human
ccucgcucuguugcccaggcuggagug

SEQ ID NO: 1163437 - RNA, 24 nt, Human
ccugaccucaggugauccauccac

SEQ ID NO: 1163438 - RNA, 23 nt, Human
ccugaguucaagugauucuccug

SEQ ID NO: 1163439 - RNA, 22 nt, Human
ccugggaauaacgcuaagacca

SEQ ID NO: 1163440 - RNA, 21 nt, Human
ccuguagucccagcuacucag

SEQ ID NO: 1163441 - RNA, 22 nt, Human
ccuguagucccagcuacucaga

SEQ ID NO: 1163442 - RNA, 19 nt, Human
cgaaaacaaaagaaucaaa

SEQ ID NO: 1163443 - RNA, 24 nt, Human
cgaggugggaggcucgcuugagcc

SEQ ID NO: 1163444 - RNA, 24 nt, Human
cgcucuguugcccaggcuggagug

SEQ ID NO: 1163445 - RNA, 24 nt, Human
cgggguuucaccauguugacuagg

SEQ ID NO: 1163446 - RNA, 25 nt, Human
cgugagccaccaugccaggccucau

SEQ ID NO: 1163447 - RNA, 23 nt, Human
cucaaaaaaaaagacaagauuuc

SEQ ID NO: 1163448 - RNA, 24 nt, Human
cucacgugauccgcccaccuccac

SEQ ID NO: 1163449 - RNA, 27 nt, Human
cucacugcaaccuccaccuccugaguu

SEQ ID NO: 1163450 - RNA, 24 nt, Human
cucacugcaaccucugccucccag

SEQ ID NO: 1163451 - RNA, 24 nt, Human
cucacugcaaccucugccucccag

SEQ ID NO: 1163452 - RNA, 18 nt, Human
cucagaagaccgaggugg

SEQ ID NO: 1163453 - RNA, 24 nt, Human
cucagccuccagaguagcugggau

SEQ ID NO: 1163454 - RNA, 24 nt, Human
cucagccucccaaguagcugggau

SEQ ID NO: 1163455 - RNA, 19 nt, Human
cuccgagaccagccugggc

SEQ ID NO: 1163456 - RNA, 23 nt, Human
cuccgagaccagccugggcaaca

SEQ ID NO: 1163457 - RNA, 19 nt, Human
cuccugaguucaagugauu

SEQ ID NO: 1163458 - RNA, 24 nt, Human
cucgcucuguugcccaggcuggag

SEQ ID NO: 1163459 - RNA, 23 nt, Human
cucgcuugagcccaggaguuuga

SEQ ID NO: 1163460 - RNA, 23 nt, Human
cucuguugcccaggcuggagugc

SEQ ID NO: 1163461 - RNA, 20 nt, Human
cugacucaaaaaaaaagaca

SEQ ID NO: 1163462 - RNA, 23 nt, Human
cugcaaccuccaccuccugaguu

SEQ ID NO: 1163463 - RNA, 24 nt, Human
cugcaaccuccaccuccugaguuc

SEQ ID NO: 1163464 - RNA, 23 nt, Human
cugcaaccucugccucccagguu

SEQ ID NO: 1163465 - RNA, 24 nt, Human
cugcaaccucugccucccagguuc

SEQ ID NO: 1163466 - RNA, 23 nt, Human
cugccucagccuccagaguagcu

SEQ ID NO: 1163467 - RNA, 23 nt, Human
cugccucagccucccaaguagcu

SEQ ID NO: 1163468 - RNA, 20 nt, Human
cugccucccagguucaagcc

SEQ ID NO: 1163469 - RNA, 22 nt, Human
cugcugagacgccgacuggagu

SEQ ID NO: 1163470 - RNA, 22 nt, Human
cugcugagacgccgacuggagu

SEQ ID NO: 1163471 - RNA, 22 nt, Human
cugcugagacgccgacuggagu

SEQ ID NO: 1163472 - RNA, 24 nt, Human
cuggagugcaguggugugaucuca

SEQ ID NO: 1163473 - RNA, 25 nt, Human
cuggccaaagaaugugauuuguauu

SEQ ID NO: 1163474 - RNA, 22 nt, Human
cuguugagacgccgacuggagu

SEQ ID NO: 1163475 - RNA, 22 nt, Human
cuguugagacgccgacuggagu

SEQ ID NO: 1163476 - RNA, 22 nt, Human
cuguugagacgccgacuggagu

SEQ ID NO: 1163477 - RNA, 22 nt, Human
cuguugagacgccgacuggagu

SEQ ID NO: 1163478 - RNA, 24 nt, Human
gaaaaagaaaacaauagaaaaaaa

SEQ ID NO: 1163479 - RNA, 25 nt, Human
gaaaacaauagaaaaaaaaaaucaa

SEQ ID NO: 1163480 - RNA, 20 nt, Human
gaaaacacaaauggcccaga

SEQ ID NO: 1163481 - RNA, 18 nt, Human
gaaaggcagcugaccaca

SEQ ID NO: 1163482 - RNA, 23 nt, Human
gaagucuugcucuuguccccagg

SEQ ID NO: 1163483 - RNA, 19 nt, Human
gacaaaggaagaaacagaa

SEQ ID NO: 1163484 - RNA, 19 nt, Human
gacacaucacaugacaaga

SEQ ID NO: 1163485 - RNA, 23 nt, Human
gacccagucucuauaaaaaaaac

SEQ ID NO: 1163486 - RNA, 24 nt, Human
gaccucacgugauccgcccaccuc

SEQ ID NO: 1163487 - RNA, 24 nt, Human
gaccucaggugauccauccacguu

SEQ ID NO: 1163488 - RNA, 20 nt, Human
gagacgggguuucaccaugu

SEQ ID NO: 1163489 - RNA, 18 nt, Human
gagaugggguuucaccau

SEQ ID NO: 1163490 - RNA, 24 nt, Human
gagaugggguuucaccauguuggc

SEQ ID NO: 1163491 - RNA, 19 nt, Human
gagcauuccuacacaggag

SEQ ID NO: 1163492 - RNA, 18 nt, Human
gagcccaggaguuugagg

SEQ ID NO: 1163493 - RNA, 25 nt, Human
gaggcaggugaaucacuugagacca

SEQ ID NO: 1163494 - RNA, 23 nt, Human
gaggugggaggcucgcuugagcc

SEQ ID NO: 1163495 - RNA, 22 nt, Human
gagguugcagugagcuaugauc

SEQ ID NO: 1163496 - RNA, 23 nt, Human
gagguugcagugagcuaugaucg

SEQ ID NO: 1163497 - RNA, 18 nt, Human
gauuacaagcgugagcca

SEQ ID NO: 1163498 - RNA, 22 nt, Human
gauuacaagcgugagccaccau

SEQ ID NO: 1163499 - RNA, 18 nt, Human
gauuacaggugccugcca

SEQ ID NO: 1163500 - RNA, 24 nt, Human
gauuacaggugccugccaccaugc

SEQ ID NO: 1163501 - RNA, 23 nt, Human
gauuccaggcaugagccaccgca

SEQ ID NO: 1163502 - RNA, 21 nt, Human
gauucuccugccucagccucc

SEQ ID NO: 1163503 - RNA, 22 nt, Human
gcaaccuccaccuccugaguuc

SEQ ID NO: 1163504 - RNA, 22 nt, Human
gcaaccucugccucccagguuc

SEQ ID NO: 1163505 - RNA, 23 nt, Human
gcagagcauagugaugcaugccu

SEQ ID NO: 1163506 - RNA, 21 nt, Human
gcaugcaccaccacacccugc

SEQ ID NO: 1163507 - RNA, 20 nt, Human
gcccaggcuggagugcagug

SEQ ID NO: 1163508 - RNA, 24 nt, Human
gcccaggcuggagugcaguggugu

SEQ ID NO: 1163509 - RNA, 19 nt, Human
gccggagugcaauggcgcg

SEQ ID NO: 1163510 - RNA, 18 nt, Human
gccgggagagacugagcc

SEQ ID NO: 1163511 - RNA, 20 nt, Human
gccucagccucccaaguagc

SEQ ID NO: 1163512 - RNA, 18 nt, Human
gcuacucagaagaccgag

SEQ ID NO: 1163513 - RNA, 23 nt, Human
gcuggucucaaacuccugaccuc

SEQ ID NO: 1163514 - RNA, 20 nt, Human
ggacuuaccuggaaaugcca

SEQ ID NO: 1163515 - RNA, 20 nt, Human
ggaggcaggugaaucacuug

SEQ ID NO: 1163516 - RNA, 23 nt, Human
ggagugcaauggcgcgaucucgg

SEQ ID NO: 1163517 - RNA, 22 nt, Human
ggaguuugagguugcagugagc

SEQ ID NO: 1163518 - RNA, 24 nt, Human
ggauuacaagcgugagccaccaug

SEQ ID NO: 1163519 - RNA, 21 nt, Human
ggcucccgccaccuguaaucc

SEQ ID NO: 1163520 - RNA, 22 nt, Human
ggcuggagugcaguggugugau

SEQ ID NO: 1163521 - RNA, 24 nt, Human
ggcuggucucaaacuccugaccuc

SEQ ID NO: 1163522 - RNA, 23 nt, Human
gggguuucaccauguugacuagg

SEQ ID NO: 1163523 - RNA, 22 nt, Human
gggguuucaccauguuggccag

SEQ ID NO: 1163524 - RNA, 20 nt, Human
ggucucaaacuccugaccuc

SEQ ID NO: 1163525 - RNA, 23 nt, Human
guagagaugggguuucaccaugu

SEQ ID NO: 1163526 - RNA, 18 nt, Human
guagcugggauuacaggc

SEQ ID NO: 1163527 - RNA, 20 nt, Human
guagcugggauuacaggcau

SEQ ID NO: 1163528 - RNA, 18 nt, Human
guagcugggauuacaggu

SEQ ID NO: 1163529 - RNA, 21 nt, Human
gugaaucacuugagaccagga

SEQ ID NO: 1163530 - RNA, 24 nt, Human
gugauccauccacguuggccuccc

SEQ ID NO: 1163531 - RNA, 24 nt, Human
gugauccgcccaccuccaccuccc

SEQ ID NO: 1163532 - RNA, 21 nt, Human
gugauucuccugccucagccu

SEQ ID NO: 1163533 - RNA, 22 nt, Human
uaaacucuuagcuagucugauc

SEQ ID NO: 1163534 - RNA, 22 nt, Human
uaaauaggcaaaagaauuaagu

SEQ ID NO: 1163535 - RNA, 24 nt, Human
uaaauuguuuugauaacuuagaug

SEQ ID NO: 1163536 - RNA, 21 nt, Human
uaagaaaagagcaaaagucaa

SEQ ID NO: 1163537 - RNA, 21 nt, Human
uaagugcaccagugcaaaccc

SEQ ID NO: 1163538 - RNA, 21 nt, Human
uaaugccaauccuauacaagg

SEQ ID NO: 1163539 - RNA, 24 nt, Human
uaauggagacgggguuucaccaug

SEQ ID NO: 1163540 - RNA, 24 nt, Human
uaauuuuuauauuuuuaauggaga

SEQ ID NO: 1163541 - RNA, 22 nt, Human
uaauuuuuuauuuuuaguagag

SEQ ID NO: 1163542 - RNA, 23 nt, Human
uaauuuuuuauuuuuaguagaga

SEQ ID NO: 1163543 - RNA, 23 nt, Human
uagaaagaccacuagaacggaaa

SEQ ID NO: 1163544 - RNA, 22 nt, Human
uagaacggaaaaauaaaaaaua

SEQ ID NO: 1163545 - RNA, 22 nt, Human
uagagaugggguuucaccaugu

SEQ ID NO: 1163546 - RNA, 24 nt, Human
uaguagagaugggguuucaccaug

SEQ ID NO: 1163547 - RNA, 26 nt, Human
uaguagagaugggguuucaccauguu

SEQ ID NO: 1163548 - RNA, 24 nt, Human
uagugaugcaugccuguaguccca

SEQ ID NO: 1163549 - RNA, 19 nt, Human
ucaaaagaaccuaaaacaa

SEQ ID NO: 1163550 - RNA, 23 nt, Human
ucaaacuccugaccucacgugau

SEQ ID NO: 1163551 - RNA, 25 nt, Human
ucaagccauucuccugccucagccu

SEQ ID NO: 1163552 - RNA, 23 nt, Human
ucaauugcacucuggccaaagaa

SEQ ID NO: 1163553 - RNA, 23 nt, Human
ucacacacggcagucaacgcgug

SEQ ID NO: 1163554 - RNA, 23 nt, Human
ucacacacggcagucaacgcgug

SEQ ID NO: 1163555 - RNA, 23 nt, Human
ucacacacggcagucaacgcgug

SEQ ID NO: 1163556 - RNA, 23 nt, Human
ucacacacggcagucaacgcgug

SEQ ID NO: 1163557 - RNA, 23 nt, Human
ucacacacggcagucaacgcgug

SEQ ID NO: 1163558 - RNA, 23 nt, Human
ucacacacggcagucaacgcgug

SEQ ID NO: 1163559 - RNA, 23 nt, Human
ucacacacggcagucaacgcgug

SEQ ID NO: 1163560 - RNA, 23 nt, Human
ucacacacggcagucaacgcgug

SEQ ID NO: 1163561 - RNA, 23 nt, Human
ucacacacggcagucaacgcgug

SEQ ID NO: 1163562 - RNA, 23 nt, Human
ucacacacggcagucaacgcgug

SEQ ID NO: 1163563 - RNA, 23 nt, Human
ucacacacggcagucaacgcgug

SEQ ID NO: 1163564 - RNA, 23 nt, Human
ucacacacggcagucaacgcgug

SEQ ID NO: 1163565 - RNA, 19 nt, Human
ucacugcaaccuccaccuc

SEQ ID NO: 1163566 - RNA, 20 nt, Human
ucacugcaaccuccaccucc

SEQ ID NO: 1163567 - RNA, 22 nt, Human
ucacugcaaccuccaccuccug

SEQ ID NO: 1163568 - RNA, 25 nt, Human
ucacugcaaccuccaccuccugagu

SEQ ID NO: 1163569 - RNA, 27 nt, Human
ucacugcaaccuccaccuccugaguuc

SEQ ID NO: 1163570 - RNA, 19 nt, Human
ucacugcaaccucugccuc

SEQ ID NO: 1163571 - RNA, 24 nt, Human
ucacugcaaccucugccucccagg

SEQ ID NO: 1163572 - RNA, 25 nt, Human
ucacugcaaccucugccucccaggu

SEQ ID NO: 1163573 - RNA, 20 nt, Human
ucagccucccaaguagcugg

SEQ ID NO: 1163574 - RNA, 23 nt, Human
ucauacauggcagucaacgcaug

SEQ ID NO: 1163575 - RNA, 24 nt, Human
uccagaguagcugggauuacaggc

SEQ ID NO: 1163576 - RNA, 19 nt, Human
ucccaaagacgccacccaa

SEQ ID NO: 1163577 - RNA, 25 nt, Human
ucccaaagacgccacccaaauggcc

SEQ ID NO: 1163578 - RNA, 18 nt, Human
ucccaaagugcugggauu

SEQ ID NO: 1163579 - RNA, 24 nt, Human
ucccaaagugcugggauuacaagc

SEQ ID NO: 1163580 - RNA, 24 nt, Human
ucccaaagugcugggauuccaggc

SEQ ID NO: 1163581 - RNA, 23 nt, Human
ucccaaguagcugggauuacagg

SEQ ID NO: 1163582 - RNA, 24 nt, Human
ucccaaguagcugggauuacaggu

SEQ ID NO: 1163583 - RNA, 21 nt, Human
ucccagguucaagccauucuc

SEQ ID NO: 1163584 - RNA, 24 nt, Human
ucccagguucaagccauucuccug

SEQ ID NO: 1163585 - RNA, 21 nt, Human
ucccgccaccuguaauccugg

SEQ ID NO: 1163586 - RNA, 23 nt, Human
uccgcccaccuccaccucccaaa

SEQ ID NO: 1163587 - RNA, 21 nt, Human
uccugaguucaagugauucuc

SEQ ID NO: 1163588 - RNA, 24 nt, Human
uccugaguucaagugauucuccug

SEQ ID NO: 1163589 - RNA, 21 nt, Human
ucgcaccacugcacuccaagc

SEQ ID NO: 1163590 - RNA, 24 nt, Human
ucgcaccacugcacuccaagccug

SEQ ID NO: 1163591 - RNA, 24 nt, Human
ucgcucuguugcccaggcuggagu

SEQ ID NO: 1163592 - RNA, 19 nt, Human
ucgcuugagcccaggaguu

SEQ ID NO: 1163593 - RNA, 24 nt, Human
ucgcuugagcccaggaguuugagg

SEQ ID NO: 1163594 - RNA, 24 nt, Human
ucuccugccucagccuccagagua

SEQ ID NO: 1163595 - RNA, 26 nt, Human
ucuccugccucagccucccaaguagc

SEQ ID NO: 1163596 - RNA, 18 nt, Human
ucuguugcccaggcugga

SEQ ID NO: 1163597 - RNA, 24 nt, Human
ucuguugcccaggcuggagugcag

SEQ ID NO: 1163598 - RNA, 24 nt, Human
ucuugcucuuguccccaggccgga

SEQ ID NO: 1163599 - RNA, 20 nt, Human
ucuuuuuuuuugagacagag

SEQ ID NO: 1163600 - RNA, 22 nt, Human
ucuuuuuuuuugagacagagcc

SEQ ID NO: 1163601 - RNA, 23 nt, Human
ugaaaaaccuaagcaaaaagaaa

SEQ ID NO: 1163602 - RNA, 19 nt, Human
ugaaaaagaaaacaauaga

SEQ ID NO: 1163603 - RNA, 23 nt, Human
ugaaucacuugagaccaggacuc

SEQ ID NO: 1163604 - RNA, 18 nt, Human
ugaccucacgugauccgc

SEQ ID NO: 1163605 - RNA, 19 nt, Human
ugaccucaggugauccauc

SEQ ID NO: 1163606 - RNA, 21 nt, Human
ugaccucaggugauccaucca

SEQ ID NO: 1163607 - RNA, 22 nt, Human
ugaccucaggugauccauccac

SEQ ID NO: 1163608 - RNA, 25 nt, Human
ugaccucaggugauccauccacguu

SEQ ID NO: 1163609 - RNA, 24 nt, Human
ugacuagguuggucucaaacuccu

SEQ ID NO: 1163610 - RNA, 20 nt, Human
ugacucaaaaaaaaagacaa

SEQ ID NO: 1163611 - RNA, 23 nt, Human
ugagaaaauagaaagaccacuag

SEQ ID NO: 1163612 - RNA, 18 nt, Human
ugagacagagccucgcuc

SEQ ID NO: 1163613 - RNA, 22 nt, Human
ugagacagagccucgcucuguu

SEQ ID NO: 1163614 - RNA, 21 nt, Human
ugagcaaaucucaucuggcca

SEQ ID NO: 1163615 - RNA, 27 nt, Human
ugagcaaaucucaucuggccaugcaga

SEQ ID NO: 1163616 - RNA, 22 nt, Human
ugagcccaggaguuugagguug

SEQ ID NO: 1163617 - RNA, 23 nt, Human
ugagguugcagugagcuaugauc

SEQ ID NO: 1163618 - RNA, 18 nt, Human
ugaguucaagugauucuc

SEQ ID NO: 1163619 - RNA, 23 nt, Human
ugaguucaagugauucuccugcc

SEQ ID NO: 1163620 - RNA, 24 nt, Human
ugaguucaagugauucuccugccu

SEQ ID NO: 1163621 - RNA, 20 nt, Human
ugauaaacucuuagcuaguc

SEQ ID NO: 1163622 - RNA, 24 nt, Human
ugauccgcccaccuccaccuccca

SEQ ID NO: 1163623 - RNA, 18 nt, Human
ugaugcaugccuguaguc

SEQ ID NO: 1163624 - RNA, 19 nt, Human
ugcaaacccaacacugagc

SEQ ID NO: 1163625 - RNA, 18 nt, Human
ugcccaggcuggagugca

SEQ ID NO: 1163626 - RNA, 21 nt, Human
ugcccaggcuggagugcagug

SEQ ID NO: 1163627 - RNA, 24 nt, Human
ugcccaggcuggagugcaguggug

SEQ ID NO: 1163628 - RNA, 24 nt, Human
ugccucagccuccagaguagcugg

SEQ ID NO: 1163629 - RNA, 24 nt, Human
ugccucagccucccaaguagcugg

SEQ ID NO: 1163630 - RNA, 23 nt, Human
ugccuguagucccagcuacucag

SEQ ID NO: 1163631 - RNA, 26 nt, Human
ugcugggauuacaagcgugagccacc

SEQ ID NO: 1163632 - RNA, 21 nt, Human
uggaaaccuuugcuuuccaaa

SEQ ID NO: 1163633 - RNA, 21 nt, Human
uggagacgggguuucaccaug

SEQ ID NO: 1163634 - RNA, 19 nt, Human
uggagugcaguggugugau

SEQ ID NO: 1163635 - RNA, 24 nt, Human
uggagugcaguggugugaucucag

SEQ ID NO: 1163636 - RNA, 24 nt, Human
uggccaggcuggucucaaacuccu

SEQ ID NO: 1163637 - RNA, 22 nt, Human
uggccaugcagagaaaaggcca

SEQ ID NO: 1163638 - RNA, 25 nt, Human
uggcggcucccgccaccuguaaucc

SEQ ID NO: 1163639 - RNA, 20 nt, Human
ugggaauaacgcuaagacca

SEQ ID NO: 1163640 - RNA, 18 nt, Human
ugggagaaguugaagaug

SEQ ID NO: 1163641 - RNA, 18 nt, Human
ugggauuacaagcgugag

SEQ ID NO: 1163642 - RNA, 22 nt, Human
ugggauuacaagcgugagccac

SEQ ID NO: 1163643 - RNA, 23 nt, Human
ugggauuacaagcgugagccacc

SEQ ID NO: 1163644 - RNA, 24 nt, Human
ugggauuacaagcgugagccacca

SEQ ID NO: 1163645 - RNA, 25 nt, Human
ugggauuacaagcgugagccaccau

SEQ ID NO: 1163646 - RNA, 21 nt, Human
ugggauuacaggcaugcacca

SEQ ID NO: 1163647 - RNA, 24 nt, Human
ugggauuacaggcaugcaccacca

SEQ ID NO: 1163648 - RNA, 21 nt, Human
ugggauuacaggugccugcca

SEQ ID NO: 1163649 - RNA, 22 nt, Human
ugggauuacaggugccugccac

SEQ ID NO: 1163650 - RNA, 24 nt, Human
ugggauuacaggugccugccacca

SEQ ID NO: 1163651 - RNA, 25 nt, Human
ugggauuacaggugccugccaccau

SEQ ID NO: 1163652 - RNA, 18 nt, Human
ugggauuccaggcaugag

SEQ ID NO: 1163653 - RNA, 23 nt, Human
ugggauuccaggcaugagccacc

SEQ ID NO: 1163654 - RNA, 24 nt, Human
ugggauuccaggcaugagccaccg

SEQ ID NO: 1163655 - RNA, 18 nt, Human
ugggcauaaguagaccaa

SEQ ID NO: 1163656 - RNA, 24 nt, Human
ugggguuucaccauguuggccagg

SEQ ID NO: 1163657 - RNA, 24 nt, Human
uggugugaucucagcucacugcaa

SEQ ID NO: 1163658 - RNA, 24 nt, Human
uuaauggagacgggguuucaccau

SEQ ID NO: 1163659 - RNA, 18 nt, Human
uuaguagagaugggguuu

SEQ ID NO: 1163660 - RNA, 22 nt, Human
uuaguagagaugggguuucacc

SEQ ID NO: 1163661 - RNA, 24 nt, Human
uuaguagagaugggguuucaccau

SEQ ID NO: 1163662 - RNA, 18 nt, Human
uucaagccauucuccugc

SEQ ID NO: 1163663 - RNA, 21 nt, Human
uucaagccauucuccugccuc

SEQ ID NO: 1163664 - RNA, 21 nt, Human
uucaagugauucuccugccuc

SEQ ID NO: 1163665 - RNA, 23 nt, Human
uucaagugauucuccugccucag

SEQ ID NO: 1163666 - RNA, 24 nt, Human
uucaagugauucuccugccucagc

SEQ ID NO: 1163667 - RNA, 25 nt, Human
uugagacagagccucgcucuguugc

SEQ ID NO: 1163668 - RNA, 22 nt, Human
uugcagugagcuaugaucgcac

SEQ ID NO: 1163669 - RNA, 19 nt, Human
uuucaccauguugacuagg

SEQ ID NO: 1163670 - RNA, 24 nt, Human
uuucaccauguuggccaggcuggu

SEQ ID NO: 1163671 - RNA, 18 nt, Human
uuugauaacuuagaugaa

SEQ ID NO: 1163672 - RNA, 23 nt, Human
uuuguauuauuuaccuacauauc

SEQ ID NO: 1163673 - RNA, 22 nt, Human
uuuuauuuuuaguagagauggg

SEQ ID NO: 1163674 - RNA, 24 nt, Human
uuuuuaauggagacgggguuucac

SEQ ID NO: 1163675 - RNA, 24 nt, Human
uuuuuaguagagaugggguuucac

SEQ ID NO: 1163676 - RNA, 28 nt, Human
uuuuuuauuuuuaguagagaugggguuu

SEQ ID NO: 1163677 - RNA, 22 nt, Human
cagagagggugacccuggccca

SEQ ID NO: 1163678 - RNA, 22 nt, Human
ccccgauccccagaaccgccuc

SEQ ID NO: 1163679 - RNA, 23 nt, Human
ccccgccacagccagcucugcag

SEQ ID NO: 1163680 - RNA, 18 nt, Human
ccugagacacugggcgug

SEQ ID NO: 1163681 - RNA, 19 nt, Human
ccuggcccaaggcgauggc

SEQ ID NO: 1163682 - RNA, 21 nt, Human
ccuggcccccgauccccagaa

SEQ ID NO: 1163683 - RNA, 23 nt, Human
cucauccugagacacugggcgug

SEQ ID NO: 1163684 - RNA, 22 nt, Human
cuggcccccgauccccagaacc

SEQ ID NO: 1163685 - RNA, 21 nt, Human
cuuggccccgccacagccagc

SEQ ID NO: 1163686 - RNA, 22 nt, Human
gagcagagagggugacccuggc

SEQ ID NO: 1163687 - RNA, 19 nt, Human
gccucacucauccugagac

SEQ ID NO: 1163688 - RNA, 27 nt, Human
ucauccugagacacugggcguggcugu

SEQ ID NO: 1163689 - RNA, 18 nt, Human
uccccagggacagguccu

SEQ ID NO: 1163690 - RNA, 23 nt, Human
uccccagggacagguccuagccu

SEQ ID NO: 1163691 - RNA, 24 nt, Human
uggcccccgauccccagaaccgcc

SEQ ID NO: 1163692 - RNA, 18 nt, Human
aaccuaugauccaauauc

SEQ ID NO: 1163693 - RNA, 20 nt, Human
cuguuuaauuuagaggagga

SEQ ID NO: 1163694 - RNA, 18 nt, Human
ggauaggaauuacuagag

SEQ ID NO: 1163695 - RNA, 18 nt, Human
guugcuuuuuucugaagg

SEQ ID NO: 1163696 - RNA, 22 nt, Human
ucucucagcaucuuaguaugga

SEQ ID NO: 1163697 - RNA, 18 nt, Human
ugaaggauaggcuuuuuu

SEQ ID NO: 1163698 - RNA, 24 nt, Human
uuauuguccaauuuugcaaccauc

SEQ ID NO: 1163699 - RNA, 20 nt, Human
uuuguugcuuuuuucugaag

SEQ ID NO: 1163700 - RNA, 22 nt, Human
cagcauguccucuuuaaggcau

SEQ ID NO: 1163701 - RNA, 23 nt, Human
ccucuuugguucuuuugguucau

SEQ ID NO: 1163702 - RNA, 25 nt, Human
cucuuuaaggcauuuggcagcuuca

SEQ ID NO: 1163703 - RNA, 21 nt, Human
cuuuugguucauuuucuuccu

SEQ ID NO: 1163704 - RNA, 23 nt, Human
gaaugguucccucuuugguucuu

SEQ ID NO: 1163705 - RNA, 22 nt, Human
uagaacauaucuaccuuaauau

SEQ ID NO: 1163706 - RNA, 20 nt, Human
ugaaugguucccucuuuggu

SEQ ID NO: 1163707 - RNA, 20 nt, Human
ugagaugccaccugucaaaa

SEQ ID NO: 1163708 - RNA, 27 nt, Human
ugagaugccaccugucaaaacuacaag

SEQ ID NO: 1163709 - RNA, 23 nt, Human
uugaaguaugaaugguucccucu

SEQ ID NO: 1163710 - RNA, 19 nt, Human
uugguucauuuucuuccuu

SEQ ID NO: 1163711 - RNA, 24 nt, Human
agugcaguggugcauuuucggcuc

SEQ ID NO: 1163712 - RNA, 20 nt, Human
cccaugcuggagugcagugg

SEQ ID NO: 1163713 - RNA, 23 nt, Human
ccgcaaccucugcuuccuggauu

SEQ ID NO: 1163714 - RNA, 24 nt, Human
ccgcaaccucugcuuccuggauuc

SEQ ID NO: 1163715 - RNA, 24 nt, Human
cucaccgcaaccucugcuuccugg

SEQ ID NO: 1163716 - RNA, 21 nt, Human
cuucacgggcguaggcuugcu

SEQ ID NO: 1163717 - RNA, 22 nt, Human
ggcugugcucucguugccucgg

SEQ ID NO: 1163718 - RNA, 23 nt, Human
ucaccgcaaccucugcuuccugg

SEQ ID NO: 1163719 - RNA, 20 nt, Human
ucccugggcgggagcgcggc

SEQ ID NO: 1163720 - RNA, 23 nt, Human
ucucacuguguugcccaugcugg

SEQ ID NO: 1163721 - RNA, 24 nt, Human
ucucacuguguugcccaugcugga

SEQ ID NO: 1163722 - RNA, 26 nt, Human
ucucacuguguugcccaugcuggagu

SEQ ID NO: 1163723 - RNA, 22 nt, Human
ugcaguggugcauuuucggcuc

SEQ ID NO: 1163724 - RNA, 24 nt, Human
ugcauuuucggcucaccgcaaccu

SEQ ID NO: 1163725 - RNA, 21 nt, Human
ugcccaugcuggagugcagug

SEQ ID NO: 1163726 - RNA, 24 nt, Human
ugcccaugcuggagugcaguggug

SEQ ID NO: 1163727 - RNA, 26 nt, Human
ugcggagggccgggcgcucggggcgu

SEQ ID NO: 1163728 - RNA, 27 nt, Human
uggagugcaguggugcauucuagcacg

SEQ ID NO: 1163729 - RNA, 24 nt, Human
uggagugcaguggugcauuuucgg

SEQ ID NO: 1163730 - RNA, 24 nt, Human
uguguugcccaugcuggagugcag

SEQ ID NO: 1163731 - RNA, 18 nt, Human
uugcccaugcuggagugc

SEQ ID NO: 1163732 - RNA, 23 nt, Human
uuuuuuuugagacaacagucuca

SEQ ID NO: 1163733 - RNA, 18 nt, Human
ucugccuuuaggaagugu

SEQ ID NO: 1163734 - RNA, 23 nt, Human
ugccuuuaggaaguguggggcac

SEQ ID NO: 1163735 - RNA, 21 nt, Human
uucuguggcucuucugccuuu

SEQ ID NO: 1163736 - RNA, 21 nt, Human
aaagguuucuccgaaauuuca

SEQ ID NO: 1163737 - RNA, 23 nt, Human
aagguuucuccgaaauuucacau

SEQ ID NO: 1163738 - RNA, 18 nt, Human
acgcaucaggugguccuu

SEQ ID NO: 1163739 - RNA, 21 nt, Human
agaauuccucaccguccgcuc

SEQ ID NO: 1163740 - RNA, 24 nt, Human
agacaggaggcaaggagugcagag

SEQ ID NO: 1163741 - RNA, 19 nt, Human
agaggcccaaaguucagug

SEQ ID NO: 1163742 - RNA, 18 nt, Human
agcaugcauggccaggug

SEQ ID NO: 1163743 - RNA, 19 nt, Human
agcugaggaccucuguggg

SEQ ID NO: 1163744 - RNA, 22 nt, Human
aggcaaggagugcagaggccca

SEQ ID NO: 1163745 - RNA, 20 nt, Human
aggcaggguggugcuacuca

SEQ ID NO: 1163746 - RNA, 23 nt, Human
aggccucagcuucucuccauuug

SEQ ID NO: 1163747 - RNA, 24 nt, Human
aggcucucagcucugucacagccu

SEQ ID NO: 1163748 - RNA, 18 nt, Human
auccuuacgaguauagaa

SEQ ID NO: 1163749 - RNA, 21 nt, Human
cacaguacauacacugguggg

SEQ ID NO: 1163750 - RNA, 21 nt, Human
caccuugcagcugaggucacc

SEQ ID NO: 1163751 - RNA, 19 nt, Human
cacucggggccccaccgcu

SEQ ID NO: 1163752 - RNA, 26 nt, Human
cagcccacuuccuccugauuugcauc

SEQ ID NO: 1163753 - RNA, 23 nt, Human
cagggccuggguacucucaaagg

SEQ ID NO: 1163754 - RNA, 23 nt, Human
ccucacggccugugugcaccacu

SEQ ID NO: 1163755 - RNA, 21 nt, Human
cuccacacaggcucucagcuc

SEQ ID NO: 1163756 - RNA, 25 nt, Human
cucugguugugggaggccggaaagc

SEQ ID NO: 1163757 - RNA, 18 nt, Human
cugcaggcacaccuugca

SEQ ID NO: 1163758 - RNA, 19 nt, Human
gcgccgguggcccagcuuc

SEQ ID NO: 1163759 - RNA, 21 nt, Human
gcgugaguggcccuucaggug

SEQ ID NO: 1163760 - RNA, 22 nt, Human
gcucccuaacagagccaaaaac

SEQ ID NO: 1163761 - RNA, 22 nt, Human
gcucugguugugggaggcugug

SEQ ID NO: 1163762 - RNA, 24 nt, Human
ggcacaguacugacacaggaaguc

SEQ ID NO: 1163763 - RNA, 19 nt, Human
ggccuggguacucucaaag

SEQ ID NO: 1163764 - RNA, 20 nt, Human
ggccuggguacucucaaagg

SEQ ID NO: 1163765 - RNA, 19 nt, Human
gguggguuucugggcugag

SEQ ID NO: 1163766 - RNA, 18 nt, Human
uaccgcacucagagcagc

SEQ ID NO: 1163767 - RNA, 20 nt, Human
ucacggccugugugcaccac

SEQ ID NO: 1163768 - RNA, 23 nt, Human
ucacuugacucuccgccucccgg

SEQ ID NO: 1163769 - RNA, 20 nt, Human
ucaggccagacgugaagaca

SEQ ID NO: 1163770 - RNA, 19 nt, Human
ucaggugguccuuacggcc

SEQ ID NO: 1163771 - RNA, 19 nt, Human
ucaugggggacacggacgg

SEQ ID NO: 1163772 - RNA, 20 nt, Human
uccuugcggugaaacaccuu

SEQ ID NO: 1163773 - RNA, 21 nt, Human
ucgcaguggucacaggggugc

SEQ ID NO: 1163774 - RNA, 23 nt, Human
ucucaaaggucugcaggcacacc

SEQ ID NO: 1163775 - RNA, 24 nt, Human
ucuccuuggcacugccugcuaccc

SEQ ID NO: 1163776 - RNA, 24 nt, Human
ucugcaggcacaccuugcagcuga

SEQ ID NO: 1163777 - RNA, 20 nt, Human
ugacaugacgcaucaggugg

SEQ ID NO: 1163778 - RNA, 22 nt, Human
ugacucuccgccucccggcccc

SEQ ID NO: 1163779 - RNA, 18 nt, Human
ugaguggcccuucaggug

SEQ ID NO: 1163780 - RNA, 23 nt, Human
ugcuucuucuccuuggcacugcc

SEQ ID NO: 1163781 - RNA, 21 nt, Human
uggccagguggcgccgguggc

SEQ ID NO: 1163782 - RNA, 22 nt, Human
ugggaggcugugaggccucagc

SEQ ID NO: 1163783 - RNA, 18 nt, Human
ugggggacacggacgggg

SEQ ID NO: 1163784 - RNA, 20 nt, Human
ugguggaaacgaggcagggu

SEQ ID NO: 1163785 - RNA, 20 nt, Human
ugguggguuucugggcugag

SEQ ID NO: 1163786 - RNA, 23 nt, Human
ugguugugggaggcugugaggcc

SEQ ID NO: 1163787 - RNA, 21 nt, Human
uucaugggggacacggacggg

SEQ ID NO: 1163788 - RNA, 22 nt, Human
uucgccgcacucggggccccac

SEQ ID NO: 1163789 - RNA, 23 nt, Human
uucgccgcacucggggccccacc

SEQ ID NO: 1163790 - RNA, 20 nt, Human
uucugggcugaguggguggc

SEQ ID NO: 1163791 - RNA, 19 nt, Human
uugcagcugaggucaccgc

SEQ ID NO: 1163792 - RNA, 21 nt, Human
uugcagcugaggucaccgcug

SEQ ID NO: 1163793 - RNA, 23 nt, Human
agcggcagcggagcucuugggcc

SEQ ID NO: 1163794 - RNA, 24 nt, Human
ccaagccaguuugccaccaucccc

SEQ ID NO: 1163795 - RNA, 21 nt, Human
ccccaagccaguuugccacca

SEQ ID NO: 1163796 - RNA, 23 nt, Human
cccccaagccaguuugccaccau

SEQ ID NO: 1163797 - RNA, 20 nt, Human
ccgcaaccuccguucagguc

SEQ ID NO: 1163798 - RNA, 20 nt, Human
ccgccgccgccgcucggcag

SEQ ID NO: 1163799 - RNA, 18 nt, Human
cggccgccgccgcagccg

SEQ ID NO: 1163800 - RNA, 20 nt, Human
cggccgccgccgcagccgcg

SEQ ID NO: 1163801 - RNA, 18 nt, Human
cggcugcagcggcagcgg

SEQ ID NO: 1163802 - RNA, 19 nt, Human
cggcugcagcggcagcgga

SEQ ID NO: 1163803 - RNA, 18 nt, Human
cugcagcggcagcggagc

SEQ ID NO: 1163804 - RNA, 25 nt, Human
gcagcggcagcggagcucuugggcc

SEQ ID NO: 1163805 - RNA, 18 nt, Human
gccgccgccgccgcucgg

SEQ ID NO: 1163806 - RNA, 21 nt, Human
gcggccgccgccgcagccgcg

SEQ ID NO: 1163807 - RNA, 19 nt, Human
uacaggaaggggcucugcu

SEQ ID NO: 1163808 - RNA, 19 nt, Human
ugggccagaaggcgguggc

SEQ ID NO: 1163809 - RNA, 19 nt, Human
uuugccaccauccccuuga

SEQ ID NO: 1163810 - RNA, 27 nt, Human
aaaaaucaguaaaaacauuuuaauaca

SEQ ID NO: 1163811 - RNA, 18 nt, Human
aacagcccccaaaccacg

SEQ ID NO: 1163812 - RNA, 20 nt, Human
aacauagugaaauccugucu

SEQ ID NO: 1163813 - RNA, 25 nt, Human
aaggugggcagaucaccugagauca

SEQ ID NO: 1163814 - RNA, 23 nt, Human
aaucgcuugaacccaugggugga

SEQ ID NO: 1163815 - RNA, 20 nt, Human
acaccacugcacuccagccu

SEQ ID NO: 1163816 - RNA, 24 nt, Human
acaccacugcacuccagccuaggc

SEQ ID NO: 1163817 - RNA, 24 nt, Human
accaacauagugaaauccugucuc

SEQ ID NO: 1163818 - RNA, 22 nt, Human
accacagagaaggcugccuuca

SEQ ID NO: 1163819 - RNA, 24 nt, Human
acccagucuggagccucucccccc

SEQ ID NO: 1163820 - RNA, 19 nt, Human
acugcacuccagccuaggc

SEQ ID NO: 1163821 - RNA, 22 nt, Human
acugcacuccagccuaggccag

SEQ ID NO: 1163822 - RNA, 20 nt, Human
agaagagugaaacuccaucu

SEQ ID NO: 1163823 - RNA, 18 nt, Human
agaucaggaguucgagac

SEQ ID NO: 1163824 - RNA, 19 nt, Human
agcaaggagagcggggggc

SEQ ID NO: 1163825 - RNA, 24 nt, Human
agcaaggagagcggggggcagagc

SEQ ID NO: 1163826 - RNA, 24 nt, Human
agcacuuugggaggccaagguggg

SEQ ID NO: 1163827 - RNA, 24 nt, Human
agcccacuggcuucaggcacuucc

SEQ ID NO: 1163828 - RNA, 23 nt, Human
agccgggcgugguggugcaugcc

SEQ ID NO: 1163829 - RNA, 19 nt, Human
aggaacagcccccaaacca

SEQ ID NO: 1163830 - RNA, 18 nt, Human
aggcacgagaaucgcuug

SEQ ID NO: 1163831 - RNA, 21 nt, Human
aggccaaggugggcagaucac

SEQ ID NO: 1163832 - RNA, 22 nt, Human
aggcuguggguuucuccaggcc

SEQ ID NO: 1163833 - RNA, 24 nt, Human
aggugcgguggcucacgccuguaa

SEQ ID NO: 1163834 - RNA, 20 nt, Human
aucacaccacugcacuccag

SEQ ID NO: 1163835 - RNA, 22 nt, Human
aucccagcacuuugggaggcca

SEQ ID NO: 1163836 - RNA, 25 nt, Human
auuagccgggcgugguggugcaugc

SEQ ID NO: 1163837 - RNA, 21 nt, Human
caacauagugaaauccugucu

SEQ ID NO: 1163838 - RNA, 24 nt, Human
caacauagugaaauccugucucua

SEQ ID NO: 1163839 - RNA, 19 nt, Human
caaggugggcagaucaccu

SEQ ID NO: 1163840 - RNA, 21 nt, Human
cacaccacugcacuccagccu

SEQ ID NO: 1163841 - RNA, 25 nt, Human
caccacugcacuccagccuaggcca

SEQ ID NO: 1163842 - RNA, 24 nt, Human
cacgccuguaaucccagcacuuug

SEQ ID NO: 1163843 - RNA, 18 nt, Human
cacugcacuccagccuag

SEQ ID NO: 1163844 - RNA, 19 nt, Human
cacugcacuccagccuagg

SEQ ID NO: 1163845 - RNA, 27 nt, Human
cagaucaccugagaucaggaguucgag

SEQ ID NO: 1163846 - RNA, 21 nt, Human
cagcacuuugggaggccaagg

SEQ ID NO: 1163847 - RNA, 24 nt, Human
cagcacuuugggaggccaaggugg

SEQ ID NO: 1163848 - RNA, 22 nt, Human
cagcccacuggcuucaggcacu

SEQ ID NO: 1163849 - RNA, 23 nt, Human
caugauuguaaaccuaguuaugc

SEQ ID NO: 1163850 - RNA, 23 nt, Human
ccacagagaaggcugccuucacc

SEQ ID NO: 1163851 - RNA, 25 nt, Human
ccacagagaaggcugccuucacccc

SEQ ID NO: 1163852 - RNA, 19 nt, Human
ccacugcacuccagccuag

SEQ ID NO: 1163853 - RNA, 20 nt, Human
ccacugcacuccagccuagg

SEQ ID NO: 1163854 - RNA, 20 nt, Human
ccacugcacuccagccuagg

SEQ ID NO: 1163855 - RNA, 21 nt, Human
ccacugcacuccagccuaggc

SEQ ID NO: 1163856 - RNA, 23 nt, Human
ccacugcacuccagccuaggcca

SEQ ID NO: 1163857 - RNA, 20 nt, Human
cccauggguggagguugcag

SEQ ID NO: 1163858 - RNA, 22 nt, Human
ccccaccacucaagcaaggaga

SEQ ID NO: 1163859 - RNA, 20 nt, Human
cccccaaaccacgcagggag

SEQ ID NO: 1163860 - RNA, 18 nt, Human
cccccagccugaagccca

SEQ ID NO: 1163861 - RNA, 22 nt, Human
cccccagccugaagcccagccu

SEQ ID NO: 1163862 - RNA, 21 nt, Human
ccuaggccagaagagugaaac

SEQ ID NO: 1163863 - RNA, 22 nt, Human
ccugaccaacauagugaaaucc

SEQ ID NO: 1163864 - RNA, 24 nt, Human
ccugaccaacauagugaaauccug

SEQ ID NO: 1163865 - RNA, 22 nt, Human
ccugagaucaggaguucgagac

SEQ ID NO: 1163866 - RNA, 19 nt, Human
ccuggaaauuuuaaaaaaa

SEQ ID NO: 1163867 - RNA, 21 nt, Human
ccuggaaauuuuaaaaaaagg

SEQ ID NO: 1163868 - RNA, 24 nt, Human
ccuggaaauuuuaaaaaaagggag

SEQ ID NO: 1163869 - RNA, 21 nt, Human
ccuguaaucccagcuacucgg

SEQ ID NO: 1163870 - RNA, 22 nt, Human
ccugucucuacuaaaaacacaa

SEQ ID NO: 1163871 - RNA, 24 nt, Human
cgagaccagccugaccaacauagu

SEQ ID NO: 1163872 - RNA, 23 nt, Human
cgagccgaaaucacaccacugca

SEQ ID NO: 1163873 - RNA, 23 nt, Human
cgccuguaaucccagcacuuugg

SEQ ID NO: 1163874 - RNA, 24 nt, Human
cgccuguaaucccagcacuuuggg

SEQ ID NO: 1163875 - RNA, 20 nt, Human
cggagaagacccagucugga

SEQ ID NO: 1163876 - RNA, 23 nt, Human
cggagaagacccagucuggagcc

SEQ ID NO: 1163877 - RNA, 22 nt, Human
cucacgccuguaaucccagcac

SEQ ID NO: 1163878 - RNA, 24 nt, Human
cucacgccuguaaucccagcacuu

SEQ ID NO: 1163879 - RNA, 22 nt, Human
cugaagcccagccuccagguuc

SEQ ID NO: 1163880 - RNA, 18 nt, Human
cugagaucaggaguucga

SEQ ID NO: 1163881 - RNA, 22 nt, Human
cugagaucaggaguucgagacc

SEQ ID NO: 1163882 - RNA, 22 nt, Human
cugccuucaccccgucugcacc

SEQ ID NO: 1163883 - RNA, 25 nt, Human
cuguggguuucuccaggccaggccu

SEQ ID NO: 1163884 - RNA, 20 nt, Human
cuuccaagccccuugcucgc

SEQ ID NO: 1163885 - RNA, 25 nt, Human
cuucccacuccucuagcaauaauca

SEQ ID NO: 1163886 - RNA, 24 nt, Human
gaucaccugagaucaggaguucga

SEQ ID NO: 1163887 - RNA, 22 nt, Human
gcaggcagguguuugugaucag

SEQ ID NO: 1163888 - RNA, 24 nt, Human
gccagaagagugaaacuccaucuc

SEQ ID NO: 1163889 - RNA, 18 nt, Human
ggagguugcagcgagccg

SEQ ID NO: 1163890 - RNA, 24 nt, Human
ggagguugcagcgagccgaaauca

SEQ ID NO: 1163891 - RNA, 18 nt, Human
ggagugccugccacacug

SEQ ID NO: 1163892 - RNA, 25 nt, Human
ggcagaucaccugagaucaggaguu

SEQ ID NO: 1163893 - RNA, 21 nt, Human
ggccagaagagugaaacucca

SEQ ID NO: 1163894 - RNA, 23 nt, Human
ggcgugguggugcaugccuguaa

SEQ ID NO: 1163895 - RNA, 18 nt, Human
ggggcagagccacggaga

SEQ ID NO: 1163896 - RNA, 19 nt, Human
ggguggagguugcagcgag

SEQ ID NO: 1163897 - RNA, 19 nt, Human
ggucagcaaugcaggcagg

SEQ ID NO: 1163898 - RNA, 21 nt, Human
ggugcaugccuguaaucccag

SEQ ID NO: 1163899 - RNA, 18 nt, Human
gguggagguugcagcgag

SEQ ID NO: 1163900 - RNA, 23 nt, Human
gguggcucacgccuguaauccca

SEQ ID NO: 1163901 - RNA, 24 nt, Human
gguggcucacgccuguaaucccag

SEQ ID NO: 1163902 - RNA, 24 nt, Human
gguggugcaugccuguaaucccag

SEQ ID NO: 1163903 - RNA, 23 nt, Human
gugaccacagagaaggcugccuu

SEQ ID NO: 1163904 - RNA, 21 nt, Human
guugcagcgagccgaaaucac

SEQ ID NO: 1163905 - RNA, 22 nt, Human
uaaaaacacaaaauuagccggg

SEQ ID NO: 1163906 - RNA, 23 nt, Human
uaaaaacacaaaauuagccgggc

SEQ ID NO: 1163907 - RNA, 22 nt, Human
uagcaauaaucaccuggaaauu

SEQ ID NO: 1163908 - RNA, 24 nt, Human
uagcaauaaucaccuggaaauuuu

SEQ ID NO: 1163909 - RNA, 21 nt, Human
uaucaggaacagcccccaaac

SEQ ID NO: 1163910 - RNA, 23 nt, Human
ucaccugagaucaggaguucgag

SEQ ID NO: 1163911 - RNA, 26 nt, Human
ucaggccaggugcgguggcucacgcc

SEQ ID NO: 1163912 - RNA, 27 nt, Human
uccaggagaaacggcgcauggccugcc

SEQ ID NO: 1163913 - RNA, 22 nt, Human
uccaucucaaaaaauauuaaaa

SEQ ID NO: 1163914 - RNA, 18 nt, Human
ucccggccgugagucccc

SEQ ID NO: 1163915 - RNA, 22 nt, Human
uccucuagcaauaaucaccugg

SEQ ID NO: 1163916 - RNA, 20 nt, Human
ucgcuucccugaagaggcug

SEQ ID NO: 1163917 - RNA, 23 nt, Human
ucgcuugaacccauggguggagg

SEQ ID NO: 1163918 - RNA, 20 nt, Human
ucucuacuaaaaacacaaaa

SEQ ID NO: 1163919 - RNA, 23 nt, Human
ucuggagccucuccccccagccu

SEQ ID NO: 1163920 - RNA, 24 nt, Human
ugaccaacauagugaaauccuguc

SEQ ID NO: 1163921 - RNA, 21 nt, Human
ugaccacagagaaggcugccu

SEQ ID NO: 1163922 - RNA, 22 nt, Human
ugaccacagagaaggcugccuu

SEQ ID NO: 1163923 - RNA, 24 nt, Human
ugaggcacgagaaucgcuugaacc

SEQ ID NO: 1163924 - RNA, 24 nt, Human
ugaguccccagcccacuggcuuca

SEQ ID NO: 1163925 - RNA, 18 nt, Human
ugccguuacaugcacgug

SEQ ID NO: 1163926 - RNA, 23 nt, Human
ugccuguaaucccagcuacucgg

SEQ ID NO: 1163927 - RNA, 24 nt, Human
ugccuguaaucccagcuacucggg

SEQ ID NO: 1163928 - RNA, 20 nt, Human
ugccuucaccccgucugcac

SEQ ID NO: 1163929 - RNA, 21 nt, Human
uggaaauuuuaaaaaaaggga

SEQ ID NO: 1163930 - RNA, 22 nt, Human
uggcucacgccuguaaucccag

SEQ ID NO: 1163931 - RNA, 24 nt, Human
uggcucacgccuguaaucccagca

SEQ ID NO: 1163932 - RNA, 20 nt, Human
ugggaggccaaggugggcag

SEQ ID NO: 1163933 - RNA, 24 nt, Human
ugggaggccaaggugggcagauca

SEQ ID NO: 1163934 - RNA, 24 nt, Human
ugggcagaucaccugagaucagga

SEQ ID NO: 1163935 - RNA, 18 nt, Human
uggguuucuccaggccag

SEQ ID NO: 1163936 - RNA, 21 nt, Human
uggugcaugccuguaauccca

SEQ ID NO: 1163937 - RNA, 22 nt, Human
uggugcaugccuguaaucccag

SEQ ID NO: 1163938 - RNA, 24 nt, Human
ugguggugcaugccuguaauccca

SEQ ID NO: 1163939 - RNA, 20 nt, Human
uguaaaccuaguuaugccuc

SEQ ID NO: 1163940 - RNA, 19 nt, Human
uuagccgggcgugguggug

SEQ ID NO: 1163941 - RNA, 24 nt, Human
uuagccgggcgugguggugcaugc

SEQ ID NO: 1163942 - RNA, 23 nt, Human
uugaacccauggguggagguugc

SEQ ID NO: 1163943 - RNA, 24 nt, Human
aaagugcugggauuauagguguga

SEQ ID NO: 1163944 - RNA, 21 nt, Human
aaccaagcacccacgggggcc

SEQ ID NO: 1163945 - RNA, 24 nt, Human
aaccucaagugauccgcccgccuc

SEQ ID NO: 1163946 - RNA, 20 nt, Human
aagacgggguuucuccacgu

SEQ ID NO: 1163947 - RNA, 22 nt, Human
aagcggcaggaaccccucugcu

SEQ ID NO: 1163948 - RNA, 24 nt, Human
aagcggcaggaaccccucugcuuu

SEQ ID NO: 1163949 - RNA, 24 nt, Human
aagcggccccugacccuggcgagu

SEQ ID NO: 1163950 - RNA, 24 nt, Human
aagugauccgcccgccucugccuc

SEQ ID NO: 1163951 - RNA, 18 nt, Human
aagugcugggauuauagg

SEQ ID NO: 1163952 - RNA, 26 nt, Human
aagugcugggauuauaggugugagcc

SEQ ID NO: 1163953 - RNA, 21 nt, Human
aauuucuccugguuggugagu

SEQ ID NO: 1163954 - RNA, 21 nt, Human
acagacaaacagggccagcca

SEQ ID NO: 1163955 - RNA, 19 nt, Human
acccacagacaaacagggc

SEQ ID NO: 1163956 - RNA, 20 nt, Human
acgggguuucuccacguugg

SEQ ID NO: 1163957 - RNA, 21 nt, Human
acgggguuucuccacguuggu

SEQ ID NO: 1163958 - RNA, 24 nt, Human
acgggguuucuccacguuggucag

SEQ ID NO: 1163959 - RNA, 24 nt, Human
acugcaauugugugaucucagcuc

SEQ ID NO: 1163960 - RNA, 23 nt, Human
agcacacaaccgacggggcgggg

SEQ ID NO: 1163961 - RNA, 26 nt, Human
aggagaaggucugggaaaaaccugcu

SEQ ID NO: 1163962 - RNA, 22 nt, Human
aggagggagacuaggacucaga

SEQ ID NO: 1163963 - RNA, 24 nt, Human
aggcgggaaggugcggccgcgggg

SEQ ID NO: 1163964 - RNA, 21 nt, Human
aggugugagccaccgcgccca

SEQ ID NO: 1163965 - RNA, 21 nt, Human
aguagcugggauuacagacau

SEQ ID NO: 1163966 - RNA, 23 nt, Human
agugaguuuucucuucacagccc

SEQ ID NO: 1163967 - RNA, 25 nt, Human
caaagccaucucuuugaacaacugu

SEQ ID NO: 1163968 - RNA, 24 nt, Human
caaagugcugggauuauaggugug

SEQ ID NO: 1163969 - RNA, 21 nt, Human
caaccuccaucucucagguuc

SEQ ID NO: 1163970 - RNA, 23 nt, Human
caagcggccccugacccuggcga

SEQ ID NO: 1163971 - RNA, 22 nt, Human
caagggauucuccugccucagc

SEQ ID NO: 1163972 - RNA, 23 nt, Human
caccaacuagcuuuguuccugag

SEQ ID NO: 1163973 - RNA, 20 nt, Human
cacuucucuaaacaauuacu

SEQ ID NO: 1163974 - RNA, 22 nt, Human
cagcacaguccgggagaccaca

SEQ ID NO: 1163975 - RNA, 25 nt, Human
caggaaccccucugcuuuccucagu

SEQ ID NO: 1163976 - RNA, 27 nt, Human
caguagcugggauuacagacaugcgcc

SEQ ID NO: 1163977 - RNA, 22 nt, Human
caguccuaggugaauuucuccu

SEQ ID NO: 1163978 - RNA, 20 nt, Human
ccaaagugcugggauuauag

SEQ ID NO: 1163979 - RNA, 21 nt, Human
ccaaagugcugggauuauagg

SEQ ID NO: 1163980 - RNA, 24 nt, Human
ccaaagugcugggauuauaggugu

SEQ ID NO: 1163981 - RNA, 23 nt, Human
ccacagacaaacagggccagcca

SEQ ID NO: 1163982 - RNA, 21 nt, Human
ccagggucacccggagcgcga

SEQ ID NO: 1163983 - RNA, 18 nt, Human
cccacagacaaacagggc

SEQ ID NO: 1163984 - RNA, 19 nt, Human
cccaggacccacagacaaa

SEQ ID NO: 1163985 - RNA, 23 nt, Human
cccaggacccacagacaaacagg

SEQ ID NO: 1163986 - RNA, 24 nt, Human
cccaguagcugggauuacagacau

SEQ ID NO: 1163987 - RNA, 19 nt, Human
ccccaguagcugggauuac

SEQ ID NO: 1163988 - RNA, 19 nt, Human
cccccugucccugcugccc

SEQ ID NO: 1163989 - RNA, 21 nt, Human
cccccugucccugcugcccac

SEQ ID NO: 1163990 - RNA, 21 nt, Human
cccgaggguggaaaagucauu

SEQ ID NO: 1163991 - RNA, 18 nt, Human
ccgaggguggaaaaguca

SEQ ID NO: 1163992 - RNA, 19 nt, Human
ccgaggguggaaaagucau

SEQ ID NO: 1163993 - RNA, 24 nt, Human
ccgccucugccucccaaagugcug

SEQ ID NO: 1163994 - RNA, 24 nt, Human
ccugccucagcuuccccaguagcu

SEQ ID NO: 1163995 - RNA, 22 nt, Human
cgaagaagcuucugccaggccc

SEQ ID NO: 1163996 - RNA, 23 nt, Human
cgagggcacggggccgaagaagc

SEQ ID NO: 1163997 - RNA, 23 nt, Human
cgccggccuaacgguggggaccg

SEQ ID NO: 1163998 - RNA, 24 nt, Human
cgccucugccucccaaagugcugg

SEQ ID NO: 1163999 - RNA, 21 nt, Human
cggccuaacgguggggaccgg

SEQ ID NO: 1164000 - RNA, 24 nt, Human
cggcggacugacccagcuccagcg

SEQ ID NO: 1164001 - RNA, 20 nt, Human
cggcuucggggcguccuccu

SEQ ID NO: 1164002 - RNA, 20 nt, Human
cgggaaggugcggccgcggg

SEQ ID NO: 1164003 - RNA, 20 nt, Human
cggggccaggcgagggcacg

SEQ ID NO: 1164004 - RNA, 24 nt, Human
cggggccgaagaagcuucugccag

SEQ ID NO: 1164005 - RNA, 19 nt, Human
cggggccgggcagggacgc

SEQ ID NO: 1164006 - RNA, 20 nt, Human
cguuccaaccaagcacccac

SEQ ID NO: 1164007 - RNA, 24 nt, Human
cucaagugauccgcccgccucugc

SEQ ID NO: 1164008 - RNA, 24 nt, Human
cucagcuuccccaguagcugggau

SEQ ID NO: 1164009 - RNA, 21 nt, Human
cucagguucaagggauucucc

SEQ ID NO: 1164010 - RNA, 23 nt, Human
cucgcaaaccucaagugauccgc

SEQ ID NO: 1164011 - RNA, 18 nt, Human
cucugcuuuccucaguga

SEQ ID NO: 1164012 - RNA, 18 nt, Human
cucuugcugcccaggcug

SEQ ID NO: 1164013 - RNA, 18 nt, Human
cucuugcugcccaggcug

SEQ ID NO: 1164014 - RNA, 19 nt, Human
cucuugcugcccaggcugg

SEQ ID NO: 1164015 - RNA, 19 nt, Human
cugcuuccgaggccucggc

SEQ ID NO: 1164016 - RNA, 21 nt, Human
cugggauuauaggugugagcc

SEQ ID NO: 1164017 - RNA, 26 nt, Human
cuucucuaaacaauuacuuuuuguug

SEQ ID NO: 1164018 - RNA, 24 nt, Human
gagccaccgcgcccagccuguguu

SEQ ID NO: 1164019 - RNA, 18 nt, Human
gauuacagacaugcgcca

SEQ ID NO: 1164020 - RNA, 18 nt, Human
gauuauaggugugagcca

SEQ ID NO: 1164021 - RNA, 20 nt, Human
gauuauaggugugagccacc

SEQ ID NO: 1164022 - RNA, 22 nt, Human
gauuauaggugugagccaccgc

SEQ ID NO: 1164023 - RNA, 22 nt, Human
gauucuccugccucagcuuccc

SEQ ID NO: 1164024 - RNA, 22 nt, Human
gcaggaaccccucugcuuuccu

SEQ ID NO: 1164025 - RNA, 22 nt, Human
gccagccagggucacccggagc

SEQ ID NO: 1164026 - RNA, 23 nt, Human
gccauuauuccucuccuacaacu

SEQ ID NO: 1164027 - RNA, 18 nt, Human
gcccgagacccgcacuua

SEQ ID NO: 1164028 - RNA, 19 nt, Human
gccuagggggaacgcggga

SEQ ID NO: 1164029 - RNA, 24 nt, Human
gccucagcuuccccaguagcuggg

SEQ ID NO: 1164030 - RNA, 24 nt, Human
gcgggacaggagaaggucugggaa

SEQ ID NO: 1164031 - RNA, 20 nt, Human
ggacaggagaaggucuggga

SEQ ID NO: 1164032 - RNA, 23 nt, Human
ggaguuucacucuugcugcccag

SEQ ID NO: 1164033 - RNA, 22 nt, Human
ggauucuccugccucagcuucc

SEQ ID NO: 1164034 - RNA, 22 nt, Human
guagcugggauuacagacaugc

SEQ ID NO: 1164035 - RNA, 24 nt, Human
gugauccgcccgccucugccuccc

SEQ ID NO: 1164036 - RNA, 20 nt, Human
gugcuaaacuguuauucucc

SEQ ID NO: 1164037 - RNA, 23 nt, Human
guuauucuccuuuaaucguucca

SEQ ID NO: 1164038 - RNA, 20 nt, Human
guuccugaggcaagcggcag

SEQ ID NO: 1164039 - RNA, 18 nt, Human
uaagcuuccagcacaguc

SEQ ID NO: 1164040 - RNA, 23 nt, Human
uaagcuuccagcacaguccggga

SEQ ID NO: 1164041 - RNA, 23 nt, Human
uaauuuuguauuuuuaguaaaga

SEQ ID NO: 1164042 - RNA, 25 nt, Human
uaauuuuguauuuuuaguaaagacg

SEQ ID NO: 1164043 - RNA, 22 nt, Human
uacagacaugcgccaccacacc

SEQ ID NO: 1164044 - RNA, 19 nt, Human
uaguaaagacgggguuucu

SEQ ID NO: 1164045 - RNA, 24 nt, Human
uaguaaagacgggguuucuccacg

SEQ ID NO: 1164046 - RNA, 23 nt, Human
ucaaagccaucucuuugaacaac

SEQ ID NO: 1164047 - RNA, 24 nt, Human
ucacaucaaccuccaucucucagg

SEQ ID NO: 1164048 - RNA, 22 nt, Human
ucacucuugcugcccaggcugg

SEQ ID NO: 1164049 - RNA, 23 nt, Human
ucacucuugcugcccaggcugga

SEQ ID NO: 1164050 - RNA, 27 nt, Human
ucagcucacaucaaccuccaucucuca

SEQ ID NO: 1164051 - RNA, 23 nt, Human
ucccaaagugcugggauuauagg

SEQ ID NO: 1164052 - RNA, 25 nt, Human
uccuucaucuugucacuucucuaaa

SEQ ID NO: 1164053 - RNA, 21 nt, Human
ucucagguucaagggauucuc

SEQ ID NO: 1164054 - RNA, 24 nt, Human
ucucagguucaagggauucuccug

SEQ ID NO: 1164055 - RNA, 24 nt, Human
ucucucagguucaagggauucucc

SEQ ID NO: 1164056 - RNA, 19 nt, Human
ucucuucacagcccccugu

SEQ ID NO: 1164057 - RNA, 18 nt, Human
ucuugcugcccaggcugg

SEQ ID NO: 1164058 - RNA, 22 nt, Human
ugacccuggcgagugaguuuuc

SEQ ID NO: 1164059 - RNA, 28 nt, Human
ugagcaagcggccccugacuguaaugac

SEQ ID NO: 1164060 - RNA, 18 nt, Human
ugaggcaagcggcaggaa

SEQ ID NO: 1164061 - RNA, 21 nt, Human
ugccucagcuuccccaguagc

SEQ ID NO: 1164062 - RNA, 24 nt, Human
ugccucagcuuccccaguagcugg

SEQ ID NO: 1164063 - RNA, 20 nt, Human
ugcugcccaggcuggacugc

SEQ ID NO: 1164064 - RNA, 23 nt, Human
uggacugcaauugugugaucuca

SEQ ID NO: 1164065 - RNA, 18 nt, Human
uggcgccagcccgcagcg

SEQ ID NO: 1164066 - RNA, 21 nt, Human
ugggauuacagacaugcgcca

SEQ ID NO: 1164067 - RNA, 22 nt, Human
ugggauuacagacaugcgccac

SEQ ID NO: 1164068 - RNA, 24 nt, Human
ugggauuacagacaugcgccacca

SEQ ID NO: 1164069 - RNA, 18 nt, Human
ugggauuauaggugugag

SEQ ID NO: 1164070 - RNA, 19 nt, Human
ugggauuauaggugugagc

SEQ ID NO: 1164071 - RNA, 21 nt, Human
ugggauuauaggugugagcca

SEQ ID NO: 1164072 - RNA, 22 nt, Human
ugggauuauaggugugagccac

SEQ ID NO: 1164073 - RNA, 23 nt, Human
ugggauuauaggugugagccacc

SEQ ID NO: 1164074 - RNA, 24 nt, Human
ugggauuauaggugugagccaccg

SEQ ID NO: 1164075 - RNA, 21 nt, Human
uggucagacugguuuccaacu

SEQ ID NO: 1164076 - RNA, 23 nt, Human
ugguguauaccuucugcgccagu

SEQ ID NO: 1164077 - RNA, 21 nt, Human
uguauuuuuaguaaagacggg

SEQ ID NO: 1164078 - RNA, 23 nt, Human
ugugugaucucagcucacaucaa

SEQ ID NO: 1164079 - RNA, 20 nt, Human
uguuuaccucugcucacaca

SEQ ID NO: 1164080 - RNA, 19 nt, Human
uuaccucugcucacacagg

SEQ ID NO: 1164081 - RNA, 18 nt, Human
uuaguaaagacgggguuu

SEQ ID NO: 1164082 - RNA, 18 nt, Human
uucaagggauucuccugc

SEQ ID NO: 1164083 - RNA, 23 nt, Human
uucaagggauucuccugccucag

SEQ ID NO: 1164084 - RNA, 24 nt, Human
uucacucuugcugcccaggcugga

SEQ ID NO: 1164085 - RNA, 19 nt, Human
uucauuguuuaccucugcu

SEQ ID NO: 1164086 - RNA, 23 nt, Human
uuguauuuuuaguaaagacgggg

SEQ ID NO: 1164087 - RNA, 20 nt, Human
uuuuguauuuuuaguaaaga

SEQ ID NO: 1164088 - RNA, 23 nt, Human
aaguauaccaauguugaccucac

SEQ ID NO: 1164089 - RNA, 23 nt, Human
acaaaguauaccaauguugaccc

SEQ ID NO: 1164090 - RNA, 18 nt, Human
accucacucagugccaag

SEQ ID NO: 1164091 - RNA, 21 nt, Human
acugaagcugucucuggaucc

SEQ ID NO: 1164092 - RNA, 19 nt, Human
cagugccaagaaguuaaaa

SEQ ID NO: 1164093 - RNA, 21 nt, Human
ccaauguugaccucacucagu

SEQ ID NO: 1164094 - RNA, 18 nt, Human
ccucacucagugccaaga

SEQ ID NO: 1164095 - RNA, 21 nt, Human
uaagaaccuuauuuggacuga

SEQ ID NO: 1164096 - RNA, 18 nt, Human
ucucaggaggaguaagac

SEQ ID NO: 1164097 - RNA, 22 nt, Human
ugaaacccauuuagaaauguua

SEQ ID NO: 1164098 - RNA, 22 nt, Human
aagcgcagaggccuuucaaacu

SEQ ID NO: 1164099 - RNA, 23 nt, Human
agcuaccggaagccggugagacc

SEQ ID NO: 1164100 - RNA, 25 nt, Human
aggcuuuuugaauuuuuuaaagucu

SEQ ID NO: 1164101 - RNA, 19 nt, Human
caaaacacaaaggucaagc

SEQ ID NO: 1164102 - RNA, 20 nt, Human
cacaucuguaccugccccuu

SEQ ID NO: 1164103 - RNA, 22 nt, Human
caccugagguggguuaacucag

SEQ ID NO: 1164104 - RNA, 22 nt, Human
cagccacaucuguaccugcccc

SEQ ID NO: 1164105 - RNA, 24 nt, Human
cagccacaucuguaccugccccuu

SEQ ID NO: 1164106 - RNA, 23 nt, Human
caucugagguuaaacacaaaaca

SEQ ID NO: 1164107 - RNA, 20 nt, Human
ccaaaacacaaaggucaagc

SEQ ID NO: 1164108 - RNA, 23 nt, Human
ccaaauugggcuccaaagcgcag

SEQ ID NO: 1164109 - RNA, 18 nt, Human
ccaggcagucuggggggu

SEQ ID NO: 1164110 - RNA, 18 nt, Human
ccccagcugacagcugga

SEQ ID NO: 1164111 - RNA, 22 nt, Human
ccuccaggcagucuggggggug

SEQ ID NO: 1164112 - RNA, 21 nt, Human
ccuccuacgagcugaccugac

SEQ ID NO: 1164113 - RNA, 18 nt, Human
gaagccuccuacgagcug

SEQ ID NO: 1164114 - RNA, 19 nt, Human
uaacucagcuaccggaagc

SEQ ID NO: 1164115 - RNA, 19 nt, Human
uaccugccccuugccaaag

SEQ ID NO: 1164116 - RNA, 25 nt, Human
uccuacgagcugaccugacgucacu

SEQ ID NO: 1164117 - RNA, 21 nt, Human
ugaccugacgucacucagcaa

SEQ ID NO: 1164118 - RNA, 21 nt, Human
uucaggggccagguuuccuuc

SEQ ID NO: 1164119 - RNA, 20 nt, Human
uugagggagcaaaggcuuuu

SEQ ID NO: 1164120 - RNA, 26 nt, Human
aagccaaggcacaguuugucgaagaa

SEQ ID NO: 1164121 - RNA, 21 nt, Human
accaggcguccgccgcccccc

SEQ ID NO: 1164122 - RNA, 23 nt, Human
accguuaaagaguguuuucagag

SEQ ID NO: 1164123 - RNA, 19 nt, Human
agauaaaaaagaaauaaaa

SEQ ID NO: 1164124 - RNA, 19 nt, Human
aguuugucgaagaagucgg

SEQ ID NO: 1164125 - RNA, 19 nt, Human
cagcagacgccgauaccac

SEQ ID NO: 1164126 - RNA, 20 nt, Human
cagccccacaacaacggccc

SEQ ID NO: 1164127 - RNA, 19 nt, Human
cagcgccagcgcgcagccc

SEQ ID NO: 1164128 - RNA, 22 nt, Human
caggcguccgccgccccccgga

SEQ ID NO: 1164129 - RNA, 20 nt, Human
cauacauauauauuuauaua

SEQ ID NO: 1164130 - RNA, 22 nt, Human
cauauauauuuauauauacaca

SEQ ID NO: 1164131 - RNA, 23 nt, Human
ccagaggcgguccagcuucuucc

SEQ ID NO: 1164132 - RNA, 20 nt, Human
ccccccggaccaugcuuucc

SEQ ID NO: 1164133 - RNA, 20 nt, Human
cccccggaccaugcuuuccg

SEQ ID NO: 1164134 - RNA, 21 nt, Human
cccccggaccaugcuuuccgc

SEQ ID NO: 1164135 - RNA, 18 nt, Human
ccgccgccccccggacca

SEQ ID NO: 1164136 - RNA, 18 nt, Human
ccgccgccccccggacca

SEQ ID NO: 1164137 - RNA, 21 nt, Human
ccgccgccccccggaccaugc

SEQ ID NO: 1164138 - RNA, 23 nt, Human
cuccagaggcgguccagcuucuu

SEQ ID NO: 1164139 - RNA, 21 nt, Human
cuuuccgcuccucugcugggc

SEQ ID NO: 1164140 - RNA, 18 nt, Human
gcagccccacaacaacgg

SEQ ID NO: 1164141 - RNA, 18 nt, Human
ggcgguccagcuucuucc

SEQ ID NO: 1164142 - RNA, 20 nt, Human
uaagaauccuuauaccguua

SEQ ID NO: 1164143 - RNA, 20 nt, Human
uacacacacaaacgugugug

SEQ ID NO: 1164144 - RNA, 21 nt, Human
uacagcaucccgcccugcagc

SEQ ID NO: 1164145 - RNA, 18 nt, Human
uaccaggcguccgccgcc

SEQ ID NO: 1164146 - RNA, 19 nt, Human
uacuccuagaagccaaggc

SEQ ID NO: 1164147 - RNA, 27 nt, Human
uauacacacacaaacgugugugucucu

SEQ ID NO: 1164148 - RNA, 22 nt, Human
uauauacacacacaaacgugug

SEQ ID NO: 1164149 - RNA, 24 nt, Human
uauauacacacacaaacgugugug

SEQ ID NO: 1164150 - RNA, 21 nt, Human
ucagauaaaaaagaaauaaaa

SEQ ID NO: 1164151 - RNA, 21 nt, Human
ucccgcgacggccucucucuu

SEQ ID NO: 1164152 - RNA, 24 nt, Human
uccgcucccgcgacggccucucuc

SEQ ID NO: 1164153 - RNA, 20 nt, Human
uccgcuccucugcugggccg

SEQ ID NO: 1164154 - RNA, 26 nt, Human
uccucuauaaaucaaaagagaguacu

SEQ ID NO: 1164155 - RNA, 20 nt, Human
ugcugggccgccgucugcgg

SEQ ID NO: 1164156 - RNA, 27 nt, Human
uuauauauacacacacaaacgugugug

SEQ ID NO: 1164157 - RNA, 23 nt, Human
uucaugcugucaguugauggacc

SEQ ID NO: 1164158 - RNA, 20 nt, Human
uuuccgcuccucugcugggc

SEQ ID NO: 1164159 - RNA, 24 nt, Human
cccgcucugcgacgcugcucgggg

SEQ ID NO: 1164160 - RNA, 25 nt, Human
cuccgcgccgggcgccggucacuuc

SEQ ID NO: 1164161 - RNA, 21 nt, Human
ugaggaaagcccagcgacgcc

SEQ ID NO: 1164162 - RNA, 20 nt, Human
uucccggaagucggcccgcu

SEQ ID NO: 1164163 - RNA, 20 nt, Human
aaaaaaaagcuuaaagggca

SEQ ID NO: 1164164 - RNA, 26 nt, Human
aaaaaguccucuuugaaaaccuaaaa

SEQ ID NO: 1164165 - RNA, 25 nt, Human
aaaaauaaagagaggcaccgguacc

SEQ ID NO: 1164166 - RNA, 24 nt, Human
aaaguccucuuugaaaaccuaaaa

SEQ ID NO: 1164167 - RNA, 24 nt, Human
aaccaaauaaccuucugaguucca

SEQ ID NO: 1164168 - RNA, 23 nt, Human
aagagcuuguggugacucacuaa

SEQ ID NO: 1164169 - RNA, 23 nt, Human
aagcaucuuuuaaaauauuaucc

SEQ ID NO: 1164170 - RNA, 20 nt, Human
aaguagcugggacuacaagc

SEQ ID NO: 1164171 - RNA, 24 nt, Human
aaguagcugggacuacaagcacgu

SEQ ID NO: 1164172 - RNA, 25 nt, Human
aaguagcugggacuacaagcacgug

SEQ ID NO: 1164173 - RNA, 25 nt, Human
aagugcuccucccaucucagccucc

SEQ ID NO: 1164174 - RNA, 21 nt, Human
aauucuuggccaaacgcccaa

SEQ ID NO: 1164175 - RNA, 21 nt, Human
acagcuccucugcugcccucu

SEQ ID NO: 1164176 - RNA, 22 nt, Human
acauaaauucucaaugcucucc

SEQ ID NO: 1164177 - RNA, 24 nt, Human
acucugucucccaggcugggauga

SEQ ID NO: 1164178 - RNA, 22 nt, Human
acugaaauaccaggauucucua

SEQ ID NO: 1164179 - RNA, 19 nt, Human
agacaagaaggaggauuaa

SEQ ID NO: 1164180 - RNA, 19 nt, Human
agcaucuucuagggauugg

SEQ ID NO: 1164181 - RNA, 23 nt, Human
agcucuacuuugcagacagcauu

SEQ ID NO: 1164182 - RNA, 24 nt, Human
agcugggacuacaagcacgugcca

SEQ ID NO: 1164183 - RNA, 18 nt, Human
aggagagaugaagaagca

SEQ ID NO: 1164184 - RNA, 23 nt, Human
aggcacacagucacagacaagaa

SEQ ID NO: 1164185 - RNA, 19 nt, Human
agguaugagccaccgcacc

SEQ ID NO: 1164186 - RNA, 23 nt, Human
agugaucugccagccuuggccuc

SEQ ID NO: 1164187 - RNA, 20 nt, Human
augcuuuagguagagggggu

SEQ ID NO: 1164188 - RNA, 21 nt, Human
auguuaggauuauagguauga

SEQ ID NO: 1164189 - RNA, 24 nt, Human
caaacuccugggcuccagugaucu

SEQ ID NO: 1164190 - RNA, 19 nt, Human
cacacagucacagacaaga

SEQ ID NO: 1164191 - RNA, 19 nt, Human
cacacagucacagacaaga

SEQ ID NO: 1164192 - RNA, 24 nt, Human
caccauauuacccagguuugucuc

SEQ ID NO: 1164193 - RNA, 20 nt, Human
cacuaaaaagccacagggag

SEQ ID NO: 1164194 - RNA, 19 nt, Human
cacuauagccuuaaccucc

SEQ ID NO: 1164195 - RNA, 24 nt, Human
cacucugucucccaggcugggaug

SEQ ID NO: 1164196 - RNA, 18 nt, Human
cagcagccaggauggggc

SEQ ID NO: 1164197 - RNA, 18 nt, Human
cagcaucagcaucuucua

SEQ ID NO: 1164198 - RNA, 24 nt, Human
cagccaggauggggcauuaaugcu

SEQ ID NO: 1164199 - RNA, 22 nt, Human
caggaaaaauagauaauguggu

SEQ ID NO: 1164200 - RNA, 21 nt, Human
caggagagaugaagaagcaua

SEQ ID NO: 1164201 - RNA, 20 nt, Human
caggagagaugaagaagcug

SEQ ID NO: 1164202 - RNA, 21 nt, Human
caguaggcauaauauugggac

SEQ ID NO: 1164203 - RNA, 24 nt, Human
cauauuacccagguuugucucaaa

SEQ ID NO: 1164204 - RNA, 24 nt, Human
caucucagccucccaaguagcugg

SEQ ID NO: 1164205 - RNA, 24 nt, Human
ccaaacgcccaauucaagggccag

SEQ ID NO: 1164206 - RNA, 21 nt, Human
ccaacauguuaggauuauagg

SEQ ID NO: 1164207 - RNA, 19 nt, Human
cccaaguagcugggacuac

SEQ ID NO: 1164208 - RNA, 19 nt, Human
ccccaccauauuacccagg

SEQ ID NO: 1164209 - RNA, 19 nt, Human
ccccaccauauuacccagg

SEQ ID NO: 1164210 - RNA, 20 nt, Human
ccccaccauauuacccaggu

SEQ ID NO: 1164211 - RNA, 19 nt, Human
ccuaggcucaagugcuccu

SEQ ID NO: 1164212 - RNA, 19 nt, Human
ccuccaggcucacaaaaua

SEQ ID NO: 1164213 - RNA, 20 nt, Human
ccucccaucucagccuccca

SEQ ID NO: 1164214 - RNA, 23 nt, Human
ccucugagacuucuucccaaggg

SEQ ID NO: 1164215 - RNA, 23 nt, Human
ccucugagacuucuucccaaguu

SEQ ID NO: 1164216 - RNA, 23 nt, Human
cuagacauugcuuccucugcacu

SEQ ID NO: 1164217 - RNA, 22 nt, Human
cuauagccuuaaccuccuaggc

SEQ ID NO: 1164218 - RNA, 23 nt, Human
cucaaacuccugggcuccaguga

SEQ ID NO: 1164219 - RNA, 21 nt, Human
cucacaaaauaggcauaucua

SEQ ID NO: 1164220 - RNA, 24 nt, Human
cucagccucccaaguagcugggac

SEQ ID NO: 1164221 - RNA, 25 nt, Human
cuccuaggcucaagugcuccuccca

SEQ ID NO: 1164222 - RNA, 19 nt, Human
cuccugggcuccagugauc

SEQ ID NO: 1164223 - RNA, 22 nt, Human
cucucuguucuacagaugagaa

SEQ ID NO: 1164224 - RNA, 21 nt, Human
cuggcaggagagaugaagaag

SEQ ID NO: 1164225 - RNA, 25 nt, Human
gaaaaaauaaagagaggccgguacc

SEQ ID NO: 1164226 - RNA, 23 nt, Human
gaaaaccuaaaaucauuagagaa

SEQ ID NO: 1164227 - RNA, 21 nt, Human
gaagcaguuaguuacaagaga

SEQ ID NO: 1164228 - RNA, 20 nt, Human
gagacagggucucacucugu

SEQ ID NO: 1164229 - RNA, 22 nt, Human
gaugaagaagcauaugaaaaaa

SEQ ID NO: 1164230 - RNA, 18 nt, Human
gauuauagguaugagcca

SEQ ID NO: 1164231 - RNA, 22 nt, Human
gauuauagguaugagccaccgc

SEQ ID NO: 1164232 - RNA, 23 nt, Human
gauuauagguaugagccaccgca

SEQ ID NO: 1164233 - RNA, 24 nt, Human
gccaauauacauuauuuuuaucau

SEQ ID NO: 1164234 - RNA, 21 nt, Human
gcuagggagcuggcaggagag

SEQ ID NO: 1164235 - RNA, 22 nt, Human
ggauuauagguaugagccaccg

SEQ ID NO: 1164236 - RNA, 18 nt, Human
ggucucaaaauauggcuc

SEQ ID NO: 1164237 - RNA, 21 nt, Human
guaauuacaaccccaaagagc

SEQ ID NO: 1164238 - RNA, 18 nt, Human
uaaaaagccacagggaga

SEQ ID NO: 1164239 - RNA, 22 nt, Human
uaaaaagccacagggagaagca

SEQ ID NO: 1164240 - RNA, 25 nt, Human
uaaccuccuaggcucaagugcuccu

SEQ ID NO: 1164241 - RNA, 22 nt, Human
uaacuugggaaacaaaaaugcu

SEQ ID NO: 1164242 - RNA, 26 nt, Human
uaauaaaaaugaggacaguaggcaua

SEQ ID NO: 1164243 - RNA, 24 nt, Human
uaaugcuuuagguagagggggucu

SEQ ID NO: 1164244 - RNA, 22 nt, Human
uacaagcacgugccaccaugcc

SEQ ID NO: 1164245 - RNA, 20 nt, Human
uacagaugagaaaauugaac

SEQ ID NO: 1164246 - RNA, 23 nt, Human
uacagugcagccaagugcagaaa

SEQ ID NO: 1164247 - RNA, 22 nt, Human
uacuacagaguaaauuuuuuca

SEQ ID NO: 1164248 - RNA, 23 nt, Human
uacucucuguucuacagaugaga

SEQ ID NO: 1164249 - RNA, 21 nt, Human
uagccuuaaccuccuaggcuc

SEQ ID NO: 1164250 - RNA, 18 nt, Human
uaggauuauagguaugag

SEQ ID NO: 1164251 - RNA, 21 nt, Human
uaggauuauagguaugagcca

SEQ ID NO: 1164252 - RNA, 22 nt, Human
uaggauuauagguaugagccac

SEQ ID NO: 1164253 - RNA, 23 nt, Human
uaggauuauagguaugagccacc

SEQ ID NO: 1164254 - RNA, 24 nt, Human
uaggauuauagguaugagccaccg

SEQ ID NO: 1164255 - RNA, 20 nt, Human
uagggauugguauaaacaua

SEQ ID NO: 1164256 - RNA, 23 nt, Human
uagggauuuuuuucagacagcuc

SEQ ID NO: 1164257 - RNA, 23 nt, Human
ucacuauagccuuaaccuccuag

SEQ ID NO: 1164258 - RNA, 18 nt, Human
ucagccucccaaguagcu

SEQ ID NO: 1164259 - RNA, 20 nt, Human
ucagccucccaaguagcugg

SEQ ID NO: 1164260 - RNA, 18 nt, Human
ucccaaguagcugggacu

SEQ ID NO: 1164261 - RNA, 18 nt, Human
uccuaggcucaagugcuc

SEQ ID NO: 1164262 - RNA, 27 nt, Human
uccucccaucucagccucccaaguagc

SEQ ID NO: 1164263 - RNA, 21 nt, Human
ucucaaacuccugggcuccag

SEQ ID NO: 1164264 - RNA, 18 nt, Human
ucucaauacaguguggcc

SEQ ID NO: 1164265 - RNA, 23 nt, Human
ucucacucugucucccaggcugg

SEQ ID NO: 1164266 - RNA, 23 nt, Human
ucucacucugucucccaggcugg

SEQ ID NO: 1164267 - RNA, 24 nt, Human
ucucacucugucucccaggcuggg

SEQ ID NO: 1164268 - RNA, 26 nt, Human
ucucacucugucucccaggcugggau

SEQ ID NO: 1164269 - RNA, 19 nt, Human
ucugagacuucuucccaag

SEQ ID NO: 1164270 - RNA, 24 nt, Human
ucugcuaagaaauaauacauaaag

SEQ ID NO: 1164271 - RNA, 19 nt, Human
ugacucacuaaaaagccac

SEQ ID NO: 1164272 - RNA, 20 nt, Human
ugagacagggucucacucug

SEQ ID NO: 1164273 - RNA, 22 nt, Human
ugagacagggucucacucuguc

SEQ ID NO: 1164274 - RNA, 20 nt, Human
ugaguuccagcuagggagcc

SEQ ID NO: 1164275 - RNA, 22 nt, Human
ugaucugccagccuuggccucc

SEQ ID NO: 1164276 - RNA, 24 nt, Human
ugcuccucccaucucagccuccca

SEQ ID NO: 1164277 - RNA, 23 nt, Human
ugcucucccuaccuccaggcuca

SEQ ID NO: 1164278 - RNA, 21 nt, Human
ugggacuacaagcacgugcca

SEQ ID NO: 1164279 - RNA, 24 nt, Human
ugggacuacaagcacgugccacca

SEQ ID NO: 1164280 - RNA, 23 nt, Human
uguacaugugauaauaccgaaau

SEQ ID NO: 1164281 - RNA, 21 nt, Human
uuaaaauuuccucugagacuu

SEQ ID NO: 1164282 - RNA, 21 nt, Human
uuaggauuauagguaugagcc

SEQ ID NO: 1164283 - RNA, 20 nt, Human
uucaagaaaaacauaacagc

SEQ ID NO: 1164284 - RNA, 22 nt, Human
uucaagaaaaacauaacagcuc

SEQ ID NO: 1164285 - RNA, 21 nt, Human
uucagcucugcaucagcagga

SEQ ID NO: 1164286 - RNA, 18 nt, Human
uuccuggucaaguaggga

SEQ ID NO: 1164287 - RNA, 20 nt, Human
uugcuuccucugcacuucuc

SEQ ID NO: 1164288 - RNA, 24 nt, Human
uuggaucagcagccaggauggggc

SEQ ID NO: 1164289 - RNA, 22 nt, Human
uuuaaaauuuccucugagacuu

SEQ ID NO: 1164290 - RNA, 22 nt, Human
uuugaaaaccuaaaaucauuag

SEQ ID NO: 1164291 - RNA, 23 nt, Human
aaacgaacaaaaccaucgcuaaa

SEQ ID NO: 1164292 - RNA, 23 nt, Human
aacaacuauuaaugcuaaacuuc

SEQ ID NO: 1164293 - RNA, 21 nt, Human
aagaagacucaacaugggcuc

SEQ ID NO: 1164294 - RNA, 21 nt, Human
auaaaacacguuucagaacaa

SEQ ID NO: 1164295 - RNA, 24 nt, Human
augaaaacccaugaaaagaagacu

SEQ ID NO: 1164296 - RNA, 20 nt, Human
caacaguauguuaccaaggu

SEQ ID NO: 1164297 - RNA, 23 nt, Human
caacgaugaccuuaaagugccaa

SEQ ID NO: 1164298 - RNA, 22 nt, Human
ccaagguguguguguuuuuuuu

SEQ ID NO: 1164299 - RNA, 22 nt, Human
ccucaaauacuccuaaauucac

SEQ ID NO: 1164300 - RNA, 23 nt, Human
ccuggcuuggccaucucuccuuu

SEQ ID NO: 1164301 - RNA, 19 nt, Human
ccuuaaagugccaaacacc

SEQ ID NO: 1164302 - RNA, 24 nt, Human
ccuuuacuuaaacgaacaaaacca

SEQ ID NO: 1164303 - RNA, 21 nt, Human
cuaaaccugauaaaacacguu

SEQ ID NO: 1164304 - RNA, 23 nt, Human
cuugauaucaacaguauguuacc

SEQ ID NO: 1164305 - RNA, 21 nt, Human
gaccguuuucuaauagacaau

SEQ ID NO: 1164306 - RNA, 25 nt, Human
gguguguguguuuuuuuuuuuuuuu

SEQ ID NO: 1164307 - RNA, 22 nt, Human
guucuugauaucaacaguaugu

SEQ ID NO: 1164308 - RNA, 22 nt, Human
uaaacuaaacagguucuugaua

SEQ ID NO: 1164309 - RNA, 20 nt, Human
uagaauguuacaauguaaac

SEQ ID NO: 1164310 - RNA, 23 nt, Human
ugaaaagaagacucaacaugggc

SEQ ID NO: 1164311 - RNA, 25 nt, Human
ugccaaacaccaaagaaucucuuag

SEQ ID NO: 1164312 - RNA, 27 nt, Human
ugcccaacgaugaccuuaaagugccaa

SEQ ID NO: 1164313 - RNA, 21 nt, Human
uguguguuuuuuuuuuuuuuu

SEQ ID NO: 1164314 - RNA, 19 nt, Human
uuuuuuuuuuuuuuuguuu

SEQ ID NO: 1164315 - RNA, 21 nt, Human
aaaaaaaaacaaaaacaagga

SEQ ID NO: 1164316 - RNA, 18 nt, Human
aaaaaaaaagcuuggaau

SEQ ID NO: 1164317 - RNA, 18 nt, Human
aaaaacaaggaaggcauc

SEQ ID NO: 1164318 - RNA, 20 nt, Human
aaaagagauagggggcggga

SEQ ID NO: 1164319 - RNA, 18 nt, Human
aaaauaacuggaugaggc

SEQ ID NO: 1164320 - RNA, 18 nt, Human
aaggacccagagguguuc

SEQ ID NO: 1164321 - RNA, 19 nt, Human
aaggaugggagaaaacacc

SEQ ID NO: 1164322 - RNA, 18 nt, Human
aagguccuuuggagggga

SEQ ID NO: 1164323 - RNA, 22 nt, Human
aaggugaagaaaaaaacuugcc

SEQ ID NO: 1164324 - RNA, 22 nt, Human
aaugcaggcucaagcugacacu

SEQ ID NO: 1164325 - RNA, 19 nt, Human
aauuuuucaucugcagguu

SEQ ID NO: 1164326 - RNA, 20 nt, Human
acgaguucucaaacuaacgc

SEQ ID NO: 1164327 - RNA, 23 nt, Human
agaaaagaacaacugggaaaaga

SEQ ID NO: 1164328 - RNA, 22 nt, Human
agaagggugaaaagagauaggg

SEQ ID NO: 1164329 - RNA, 22 nt, Human
agaucaagaaaagaacaacugg

SEQ ID NO: 1164330 - RNA, 25 nt, Human
agcuacagguaaaggcucuaccacc

SEQ ID NO: 1164331 - RNA, 18 nt, Human
agcugaguaagacuagug

SEQ ID NO: 1164332 - RNA, 21 nt, Human
agggaggaaagcacauucggg

SEQ ID NO: 1164333 - RNA, 19 nt, Human
aguggcagagggagugacg

SEQ ID NO: 1164334 - RNA, 21 nt, Human
augguguuuuaguaacuguug

SEQ ID NO: 1164335 - RNA, 20 nt, Human
caaaaaaaaaaacaaaaaca

SEQ ID NO: 1164336 - RNA, 22 nt, Human
caaaaacaaggaaggcaucaca

SEQ ID NO: 1164337 - RNA, 23 nt, Human
caaaaacaaggaaggcaucacac

SEQ ID NO: 1164338 - RNA, 19 nt, Human
caagucccuuuacucugcc

SEQ ID NO: 1164339 - RNA, 23 nt, Human
caauaacugaggagcccacaugc

SEQ ID NO: 1164340 - RNA, 19 nt, Human
cacacaguuucauuaguaa

SEQ ID NO: 1164341 - RNA, 20 nt, Human
cacagcagcaacaaaagaaa

SEQ ID NO: 1164342 - RNA, 22 nt, Human
cagauggcauucuuggaaucag

SEQ ID NO: 1164343 - RNA, 18 nt, Human
cagcagcaacaaaagaaa

SEQ ID NO: 1164344 - RNA, 23 nt, Human
caggaauuaucacuaucacuuau

SEQ ID NO: 1164345 - RNA, 19 nt, Human
caguacaagcaacgacguu

SEQ ID NO: 1164346 - RNA, 21 nt, Human
cauauuuauuaaacuugaggc

SEQ ID NO: 1164347 - RNA, 19 nt, Human
ccuccaaucuuuccccuuu

SEQ ID NO: 1164348 - RNA, 22 nt, Human
ccuuccacuacuuuuugcagcu

SEQ ID NO: 1164349 - RNA, 21 nt, Human
cgccagugcauauucccucug

SEQ ID NO: 1164350 - RNA, 22 nt, Human
cgggaaaagaucaagaaaagaa

SEQ ID NO: 1164351 - RNA, 24 nt, Human
cucucagucccacuuuccauuucc

SEQ ID NO: 1164352 - RNA, 19 nt, Human
cugaaggaacucacagaug

SEQ ID NO: 1164353 - RNA, 20 nt, Human
cuuuggaggggaagcccaaa

SEQ ID NO: 1164354 - RNA, 19 nt, Human
gaauguucccccccagacu

SEQ ID NO: 1164355 - RNA, 19 nt, Human
gagggcagaggaugaggau

SEQ ID NO: 1164356 - RNA, 21 nt, Human
gaucaagaaaaaaaggcuuuc

SEQ ID NO: 1164357 - RNA, 19 nt, Human
gaucaagaaaagaacaacu

SEQ ID NO: 1164358 - RNA, 19 nt, Human
gcaaaaaaaaaaacaaaaa

SEQ ID NO: 1164359 - RNA, 22 nt, Human
gcaacaaaagaaaauaacugga

SEQ ID NO: 1164360 - RNA, 18 nt, Human
gcauucuuggaaucagga

SEQ ID NO: 1164361 - RNA, 19 nt, Human
gcccaaauggcggagccuu

SEQ ID NO: 1164362 - RNA, 24 nt, Human
ggcacaaagaucucuucaauuauc

SEQ ID NO: 1164363 - RNA, 18 nt, Human
gggaaaagaucaagaaaa

SEQ ID NO: 1164364 - RNA, 26 nt, Human
gggaagcccaaaaagacaaucacuga

SEQ ID NO: 1164365 - RNA, 19 nt, Human
gggcaggggagagggagga

SEQ ID NO: 1164366 - RNA, 20 nt, Human
uaaacuugaggcgggcaggg

SEQ ID NO: 1164367 - RNA, 22 nt, Human
uaagacuagugcugaaaacugg

SEQ ID NO: 1164368 - RNA, 23 nt, Human
uacagguaaaggcucuaccacca

SEQ ID NO: 1164369 - RNA, 18 nt, Human
uacuguauuuuuauguug

SEQ ID NO: 1164370 - RNA, 30 nt, Human
uauguugcaugcacagacacguacacacag

SEQ ID NO: 1164371 - RNA, 19 nt, Human
uauuucaccucuugagaau

SEQ ID NO: 1164372 - RNA, 18 nt, Human
ucacaguacaagcaacga

SEQ ID NO: 1164373 - RNA, 18 nt, Human
ucacugacuuccugggag

SEQ ID NO: 1164374 - RNA, 21 nt, Human
ucagauggcauucuuggaauc

SEQ ID NO: 1164375 - RNA, 19 nt, Human
ucaggaguagcugcucaca

SEQ ID NO: 1164376 - RNA, 19 nt, Human
ucaguccaucaguuuuugu

SEQ ID NO: 1164377 - RNA, 19 nt, Human
ucccuggggauaguggcag

SEQ ID NO: 1164378 - RNA, 21 nt, Human
ucccuggggauaguggcagag

SEQ ID NO: 1164379 - RNA, 19 nt, Human
uccuuuggaggggaagccc

SEQ ID NO: 1164380 - RNA, 21 nt, Human
ucugaaggaucaugacuauga

SEQ ID NO: 1164381 - RNA, 20 nt, Human
ucuuucuucuucugaguucu

SEQ ID NO: 1164382 - RNA, 24 nt, Human
ucuuuuaucaguccaucaguuuuu

SEQ ID NO: 1164383 - RNA, 18 nt, Human
ugaaggugaagaaaaaaa

SEQ ID NO: 1164384 - RNA, 22 nt, Human
ugaauuuucauauugaagguga

SEQ ID NO: 1164385 - RNA, 23 nt, Human
ugacuaugagugagaaccugaag

SEQ ID NO: 1164386 - RNA, 24 nt, Human
ugacuaugagugagaaccugaagg

SEQ ID NO: 1164387 - RNA, 21 nt, Human
ugagauaggaucacaauaacu

SEQ ID NO: 1164388 - RNA, 23 nt, Human
ugagcgagggugggagaagggug

SEQ ID NO: 1164389 - RNA, 20 nt, Human
ugaggcucuuccacugcaga

SEQ ID NO: 1164390 - RNA, 20 nt, Human
ugaggguuaaagggaaagga

SEQ ID NO: 1164391 - RNA, 23 nt, Human
ugcaaaaaaaaaaacaaaaacaa

SEQ ID NO: 1164392 - RNA, 31 nt, Human
ugcaaaaaaaaaaacaaaaacaaggaaggcu

SEQ ID NO: 1164393 - RNA, 18 nt, Human
uggaaugcaggcucaagc

SEQ ID NO: 1164394 - RNA, 23 nt, Human
uggaaugcaggcucaagcugaca

SEQ ID NO: 1164395 - RNA, 21 nt, Human
uggcagagggagugacggcca

SEQ ID NO: 1164396 - RNA, 23 nt, Human
ugggagaaaacaccaaauuaaaa

SEQ ID NO: 1164397 - RNA, 24 nt, Human
ugggagaaaacaccaaauuaaaaa

SEQ ID NO: 1164398 - RNA, 21 nt, Human
ugggagaagggugaaaagaga

SEQ ID NO: 1164399 - RNA, 20 nt, Human
uggggcaggaagauaggauu

SEQ ID NO: 1164400 - RNA, 19 nt, Human
uuaaaaaaaaagcuuggaa

SEQ ID NO: 1164401 - RNA, 23 nt, Human
uuaaagggaaaggaugggagaaa

SEQ ID NO: 1164402 - RNA, 18 nt, Human
uucaagucccuuuacucu

SEQ ID NO: 1164403 - RNA, 18 nt, Human
uucacaguacaagcaacg

SEQ ID NO: 1164404 - RNA, 21 nt, Human
uucauauugaaggugaagaaa

SEQ ID NO: 1164405 - RNA, 19 nt, Human
uucccaaaacacguagaaa

SEQ ID NO: 1164406 - RNA, 22 nt, Human
uugcccaaauggcggagccuuu

SEQ ID NO: 1164407 - RNA, 19 nt, Human
uuuccccuuucaagcuaca

SEQ ID NO: 1164408 - RNA, 18 nt, Human
uuugauucuuucuucuuc

SEQ ID NO: 1164409 - RNA, 18 nt, Human
uuuucuuaaaaaaaaaaa

SEQ ID NO: 1164410 - RNA, 23 nt, Human
aaacugaggccggcgaggaggga

SEQ ID NO: 1164411 - RNA, 20 nt, Human
aaagaagaaagcucugugcu

SEQ ID NO: 1164412 - RNA, 22 nt, Human
agaagaaagcucugugcuuagu

SEQ ID NO: 1164413 - RNA, 19 nt, Human
agagcuggggggaucugga

SEQ ID NO: 1164414 - RNA, 22 nt, Human
agcccggaggugacacgggcuc

SEQ ID NO: 1164415 - RNA, 21 nt, Human
cagcgcgggacuaggaggggg

SEQ ID NO: 1164416 - RNA, 22 nt, Human
caggggccuuugaagacagcgc

SEQ ID NO: 1164417 - RNA, 20 nt, Human
caguaccaagcuugcaggcg

SEQ ID NO: 1164418 - RNA, 19 nt, Human
cccggaggugacacgggcu

SEQ ID NO: 1164419 - RNA, 24 nt, Human
cccugguggagacccuggucacca

SEQ ID NO: 1164420 - RNA, 20 nt, Human
cccuguaugugucccagccc

SEQ ID NO: 1164421 - RNA, 26 nt, Human
ccggggcuggggcgcgugcuaggggc

SEQ ID NO: 1164422 - RNA, 24 nt, Human
ccuguaugugucccagcccgggac

SEQ ID NO: 1164423 - RNA, 23 nt, Human
ccuguccccaaccccaggugugc

SEQ ID NO: 1164424 - RNA, 22 nt, Human
cgcuaagcagaaguaggagcag

SEQ ID NO: 1164425 - RNA, 21 nt, Human
cguccccaacgugggggaggg

SEQ ID NO: 1164426 - RNA, 18 nt, Human
cucaaaagaagaaagcuc

SEQ ID NO: 1164427 - RNA, 22 nt, Human
cucggaggacccuggagauagg

SEQ ID NO: 1164428 - RNA, 21 nt, Human
gagagcuggggggaucuggag

SEQ ID NO: 1164429 - RNA, 22 nt, Human
gagcggggccgggucgcaagaa

SEQ ID NO: 1164430 - RNA, 23 nt, Human
gcaccacaugcguggccucaaaa

SEQ ID NO: 1164431 - RNA, 19 nt, Human
gccuuggaggggggcugcg

SEQ ID NO: 1164432 - RNA, 25 nt, Human
ggagcggggccgggucgcaagaaga

SEQ ID NO: 1164433 - RNA, 19 nt, Human
gggaggcugaguccgggga

SEQ ID NO: 1164434 - RNA, 23 nt, Human
gguccgcggccgagagcuggggg

SEQ ID NO: 1164435 - RNA, 20 nt, Human
uaagcagaaguaggagcagg

SEQ ID NO: 1164436 - RNA, 19 nt, Human
uagagagaucgaacuguuu

SEQ ID NO: 1164437 - RNA, 22 nt, Human
uaggagcaggugugccggguug

SEQ ID NO: 1164438 - RNA, 21 nt, Human
ucauguccuguccccaacccc

SEQ ID NO: 1164439 - RNA, 27 nt, Human
uccccaacgugggggaggccguauacg

SEQ ID NO: 1164440 - RNA, 20 nt, Human
uccccaacgugggggagggg

SEQ ID NO: 1164441 - RNA, 27 nt, Human
uccgcaccacaugcguggccucaaaag

SEQ ID NO: 1164442 - RNA, 23 nt, Human
ucggaggacccuggagauaggag

SEQ ID NO: 1164443 - RNA, 19 nt, Human
ugacacgggcucuggaagg

SEQ ID NO: 1164444 - RNA, 20 nt, Human
ugacacgggcucuggaaggg

SEQ ID NO: 1164445 - RNA, 29 nt, Human
uggccgagggguucccaaggcuccacucc

SEQ ID NO: 1164446 - RNA, 22 nt, Human
ugguggagacccuggucaccac

SEQ ID NO: 1164447 - RNA, 18 nt, Human
uguccuguccccaacccc

SEQ ID NO: 1164448 - RNA, 24 nt, Human
uguccuguccccaaccccaggugu

SEQ ID NO: 1164449 - RNA, 22 nt, Human
uguuucucuuucucagccugga

SEQ ID NO: 1164450 - RNA, 24 nt, Human
uucagcuguauuuucgaaccccug

SEQ ID NO: 1164451 - RNA, 25 nt, Human
uucagcuguauuuucgaaccccugu

SEQ ID NO: 1164452 - RNA, 22 nt, Human
uuuucuguaaaaaaucguggcu

SEQ ID NO: 1164453 - RNA, 22 nt, Human
aaagaagaaaaaagggaaagag

SEQ ID NO: 1164454 - RNA, 22 nt, Human
aagaaaaaagggaaagagaaaa

SEQ ID NO: 1164455 - RNA, 23 nt, Human
aagaagaaaaaagggaaagagaa

SEQ ID NO: 1164456 - RNA, 21 nt, Human
accauggcguuuauuuuuggc

SEQ ID NO: 1164457 - RNA, 18 nt, Human
accgugugcagccgcggc

SEQ ID NO: 1164458 - RNA, 22 nt, Human
agaaaauaccgucugaagucca

SEQ ID NO: 1164459 - RNA, 19 nt, Human
agaagaaaaaagggaaaga

SEQ ID NO: 1164460 - RNA, 22 nt, Human
agaagaaaaggagggagggaca

SEQ ID NO: 1164461 - RNA, 22 nt, Human
aggaagagauagggcgagaaga

SEQ ID NO: 1164462 - RNA, 23 nt, Human
aggaagagauagggcgagaagaa

SEQ ID NO: 1164463 - RNA, 21 nt, Human
aggcaggcgccggggaguggg

SEQ ID NO: 1164464 - RNA, 24 nt, Human
agguuguaacaaagaggugaccau

SEQ ID NO: 1164465 - RNA, 23 nt, Human
auaacucuucccacucaaggcac

SEQ ID NO: 1164466 - RNA, 19 nt, Human
cacccccgccaggcggccc

SEQ ID NO: 1164467 - RNA, 20 nt, Human
cagauccaagagugcccagu

SEQ ID NO: 1164468 - RNA, 24 nt, Human
caguuuaaggcauaacucuuccca

SEQ ID NO: 1164469 - RNA, 21 nt, Human
caugucugucaccucaucuaa

SEQ ID NO: 1164470 - RNA, 23 nt, Human
ccacccccgccaggcggcccgcc

SEQ ID NO: 1164471 - RNA, 24 nt, Human
cccccgccaggcggcccgcccucc

SEQ ID NO: 1164472 - RNA, 24 nt, Human
cccgccaggcggcccgcccucccc

SEQ ID NO: 1164473 - RNA, 21 nt, Human
cccuccccuccugggcuccgg

SEQ ID NO: 1164474 - RNA, 22 nt, Human
cccuccgccgcugccucgcguc

SEQ ID NO: 1164475 - RNA, 22 nt, Human
ccgcccuccccuccugggcucc

SEQ ID NO: 1164476 - RNA, 20 nt, Human
ccgccgcugccucgcguccg

SEQ ID NO: 1164477 - RNA, 18 nt, Human
ccugagugugcggucagg

SEQ ID NO: 1164478 - RNA, 22 nt, Human
cgagaaagaagaaaaaagggaa

SEQ ID NO: 1164479 - RNA, 23 nt, Human
cgagaaagaagaaaaaagggaaa

SEQ ID NO: 1164480 - RNA, 22 nt, Human
cgccuccauccccuuuacgaga

SEQ ID NO: 1164481 - RNA, 21 nt, Human
cucgcagcgcccucguccgcu

SEQ ID NO: 1164482 - RNA, 20 nt, Human
cucguccgcuuccaagccca

SEQ ID NO: 1164483 - RNA, 23 nt, Human
gacgagaaagaagaaaaaaggga

SEQ ID NO: 1164484 - RNA, 25 nt, Human
gagaaagaagaaaaaagggaaagga

SEQ ID NO: 1164485 - RNA, 23 nt, Human
gagaagaggagaucaaaaaauau

SEQ ID NO: 1164486 - RNA, 20 nt, Human
gaguagaaagggaggaagag

SEQ ID NO: 1164487 - RNA, 18 nt, Human
gauuacccggaaaagccc

SEQ ID NO: 1164488 - RNA, 28 nt, Human
gcggcccgcccuccccuccugggcuccg

SEQ ID NO: 1164489 - RNA, 18 nt, Human
gcugccacagguuccuga

SEQ ID NO: 1164490 - RNA, 20 nt, Human
ggcccgcccuccccuccugg

SEQ ID NO: 1164491 - RNA, 18 nt, Human
ggcgagaagaaaaggagg

SEQ ID NO: 1164492 - RNA, 19 nt, Human
ggcgagaagaaaaggaggg

SEQ ID NO: 1164493 - RNA, 19 nt, Human
ggcggauucagccugcauu

SEQ ID NO: 1164494 - RNA, 18 nt, Human
ggggaguggggcgcgggc

SEQ ID NO: 1164495 - RNA, 19 nt, Human
gucacgcucgcccuccgcc

SEQ ID NO: 1164496 - RNA, 24 nt, Human
gucccagauuacccggaaaagccc

SEQ ID NO: 1164497 - RNA, 23 nt, Human
gugcacggugcugggcacgcugu

SEQ ID NO: 1164498 - RNA, 19 nt, Human
uaaagagaggacccgcgca

SEQ ID NO: 1164499 - RNA, 19 nt, Human
uaaagagaggacccgcgca

SEQ ID NO: 1164500 - RNA, 18 nt, Human
uacccggaaaagcccugg

SEQ ID NO: 1164501 - RNA, 19 nt, Human
uccugggcuccgggcugcc

SEQ ID NO: 1164502 - RNA, 23 nt, Human
ugcauugcaugcaugcaugucug

SEQ ID NO: 1164503 - RNA, 21 nt, Human
ugcccacccccgccaggcggc

SEQ ID NO: 1164504 - RNA, 19 nt, Human
uguaacaaagaggugacca

SEQ ID NO: 1164505 - RNA, 20 nt, Human
uuacccggaaaagcccuggc

SEQ ID NO: 1164506 - RNA, 24 nt, Human
uuuuuggcuccagacaggcggauu

SEQ ID NO: 1164507 - RNA, 20 nt, Human
augagaaauccaaaugaagc

SEQ ID NO: 1164508 - RNA, 19 nt, Human
caagaaccuccaaaugcug

SEQ ID NO: 1164509 - RNA, 18 nt, Human
gggaggcucuggcagcau

SEQ ID NO: 1164510 - RNA, 22 nt, Human
uaacugugacuuugcuauugca

SEQ ID NO: 1164511 - RNA, 21 nt, Human
uagaagaggagggcucucaag

SEQ ID NO: 1164512 - RNA, 22 nt, Human
uagaagaggagggcucucaagc

SEQ ID NO: 1164513 - RNA, 20 nt, Human
uccuggguccauagaguugg

SEQ ID NO: 1164514 - RNA, 24 nt, Human
ugaagucgacuguaauuuucuagg

SEQ ID NO: 1164515 - RNA, 21 nt, Human
ugagcaagaaccuccaaaugc

SEQ ID NO: 1164516 - RNA, 24 nt, Human
uggcagcaucauugugaucucagu

SEQ ID NO: 1164517 - RNA, 26 nt, Human
uggguccauagaguuggucggaugac

SEQ ID NO: 1164518 - RNA, 18 nt, Human
uugagcaagaaccuccaa

SEQ ID NO: 1164519 - RNA, 18 nt, Human
aaaaacaaacagguugaa

SEQ ID NO: 1164520 - RNA, 19 nt, Human
aagccuuuuaaaaaacaaa

SEQ ID NO: 1164521 - RNA, 21 nt, Human
agccuuuuaaaaaacaaacag

SEQ ID NO: 1164522 - RNA, 19 nt, Human
caaugguacauauaaaccc

SEQ ID NO: 1164523 - RNA, 22 nt, Human
caauugccuaggaccucaacug

SEQ ID NO: 1164524 - RNA, 24 nt, Human
cagguugaaaaauggguuaaagua

SEQ ID NO: 1164525 - RNA, 22 nt, Human
caucaauugccuaggaccucaa

SEQ ID NO: 1164526 - RNA, 22 nt, Human
ccagagcuuccuaucacgucag

SEQ ID NO: 1164527 - RNA, 21 nt, Human
cccagagcuuccuaucacguc

SEQ ID NO: 1164528 - RNA, 24 nt, Human
cugaggaauucucucaauuaugaa

SEQ ID NO: 1164529 - RNA, 18 nt, Human
gcccagagcuuccuauca

SEQ ID NO: 1164530 - RNA, 27 nt, Human
gcuaucaacugaggaauucucucaauu

SEQ ID NO: 1164531 - RNA, 24 nt, Human
ggacgggcgaacgggugggcgggc

SEQ ID NO: 1164532 - RNA, 18 nt, Human
gggcgaacgggugggcgg

SEQ ID NO: 1164533 - RNA, 23 nt, Human
gggcggcugucuggcggcggcug

SEQ ID NO: 1164534 - RNA, 24 nt, Human
gggcgggcggcugucuggcggcgg

SEQ ID NO: 1164535 - RNA, 22 nt, Human
uaaaaaacaaacagguugaaaa

SEQ ID NO: 1164536 - RNA, 23 nt, Human
uaaaaaacaaacagguugaaaaa

SEQ ID NO: 1164537 - RNA, 18 nt, Human
uaaaguaggcaaauacag

SEQ ID NO: 1164538 - RNA, 20 nt, Human
uaaaguaggcaaauacagca

SEQ ID NO: 1164539 - RNA, 23 nt, Human
uagcugacuucaaauugcuccau

SEQ ID NO: 1164540 - RNA, 18 nt, Human
uaugaagaaaaggagacu

SEQ ID NO: 1164541 - RNA, 22 nt, Human
ucugccuuuagggcuaucaacu

SEQ ID NO: 1164542 - RNA, 19 nt, Human
ugccuaggaccucaacagc

SEQ ID NO: 1164543 - RNA, 22 nt, Human
ugggaaauguucaugcauaagg

SEQ ID NO: 1164544 - RNA, 20 nt, Human
uguucucuuuaccuaagccc

SEQ ID NO: 1164545 - RNA, 21 nt, Human
uuaaaguaggcaaauacagca

SEQ ID NO: 1164546 - RNA, 22 nt, Human
uuauuuucuuucucaaaaucca

SEQ ID NO: 1164547 - RNA, 22 nt, Human
uucaaauugcuccauacaaugg

SEQ ID NO: 1164548 - RNA, 19 nt, Human
uucuuucucaaaauccagg

SEQ ID NO: 1164549 - RNA, 19 nt, Human
aaaaagaaaauaguaaaug

SEQ ID NO: 1164550 - RNA, 21 nt, Human
aaaaagaaaauaguaaaugaa

SEQ ID NO: 1164551 - RNA, 21 nt, Human
aaacacccuauguuucccagg

SEQ ID NO: 1164552 - RNA, 23 nt, Human
aagaaucacuugaaccugggagg

SEQ ID NO: 1164553 - RNA, 24 nt, Human
aagcagucaauauaaauccaaaac

SEQ ID NO: 1164554 - RNA, 20 nt, Human
aaguuacagaaauuuauaau

SEQ ID NO: 1164555 - RNA, 24 nt, Human
aaucacuugaaccugggaggcaga

SEQ ID NO: 1164556 - RNA, 18 nt, Human
aauuacaauugugagcca

SEQ ID NO: 1164557 - RNA, 24 nt, Human
acaacaacaaaaaaagaaacuaaa

SEQ ID NO: 1164558 - RNA, 19 nt, Human
acccuauguuucccaggcu

SEQ ID NO: 1164559 - RNA, 22 nt, Human
agaagagacuuauaguagacac

SEQ ID NO: 1164560 - RNA, 18 nt, Human
agagauccucccaccuca

SEQ ID NO: 1164561 - RNA, 20 nt, Human
agaucaugccccugcacucc

SEQ ID NO: 1164562 - RNA, 19 nt, Human
agcaguauuuuuuuuuucu

SEQ ID NO: 1164563 - RNA, 23 nt, Human
agccucgaccucccgagcucaag

SEQ ID NO: 1164564 - RNA, 19 nt, Human
agcuaggacuacaagccca

SEQ ID NO: 1164565 - RNA, 24 nt, Human
aggaaaauucaagguccugaaaag

SEQ ID NO: 1164566 - RNA, 21 nt, Human
aggaaguucaguuaaaaaaua

SEQ ID NO: 1164567 - RNA, 19 nt, Human
aggaguauuuauuucuuau

SEQ ID NO: 1164568 - RNA, 19 nt, Human
aggauagaugccaggagaa

SEQ ID NO: 1164569 - RNA, 21 nt, Human
aggcagagguuggaguaagcc

SEQ ID NO: 1164570 - RNA, 24 nt, Human
aggcagagguuggaguaagccgag

SEQ ID NO: 1164571 - RNA, 22 nt, Human
aggcauaagaaucacuugaacc

SEQ ID NO: 1164572 - RNA, 23 nt, Human
agugcaauggcacgaugauggcu

SEQ ID NO: 1164573 - RNA, 21 nt, Human
agugguggcagcacuuacagg

SEQ ID NO: 1164574 - RNA, 24 nt, Human
aucaugccccugcacuccagccug

SEQ ID NO: 1164575 - RNA, 23 nt, Human
auuucaauuaucuucuacuuuca

SEQ ID NO: 1164576 - RNA, 18 nt, Human
caaacacccuauguuucc

SEQ ID NO: 1164577 - RNA, 26 nt, Human
caauagcuaggacuacaagcccaugc

SEQ ID NO: 1164578 - RNA, 22 nt, Human
cacacaccaccacaccuggcua

SEQ ID NO: 1164579 - RNA, 23 nt, Human
cacacaccaccacaccuggcuaa

SEQ ID NO: 1164580 - RNA, 25 nt, Human
cacaguugggaggcugaggcauaag

SEQ ID NO: 1164581 - RNA, 18 nt, Human
caccgcauccagccucca

SEQ ID NO: 1164582 - RNA, 25 nt, Human
caccucagccucccgaaguugcuga

SEQ ID NO: 1164583 - RNA, 20 nt, Human
caccuuagcuuccagaguag

SEQ ID NO: 1164584 - RNA, 23 nt, Human
cacuccagccugggccacugagc

SEQ ID NO: 1164585 - RNA, 24 nt, Human
cacuccagccugggccacugagcg

SEQ ID NO: 1164586 - RNA, 21 nt, Human
caggcacacaccaccacaccu

SEQ ID NO: 1164587 - RNA, 21 nt, Human
cauaguacugagacuaucaca

SEQ ID NO: 1164588 - RNA, 21 nt, Human
cauuucaauuaucuucuacuu

SEQ ID NO: 1164589 - RNA, 21 nt, Human
ccaauagcuaggacuacaagc

SEQ ID NO: 1164590 - RNA, 21 nt, Human
cccgagcucaagcaaaccucc

SEQ ID NO: 1164591 - RNA, 19 nt, Human
cccugcacuccagccuggg

SEQ ID NO: 1164592 - RNA, 19 nt, Human
cccugcacuccagccuggg

SEQ ID NO: 1164593 - RNA, 20 nt, Human
cccugcacuccagccugggc

SEQ ID NO: 1164594 - RNA, 22 nt, Human
cccugcacuccagccugggcca

SEQ ID NO: 1164595 - RNA, 20 nt, Human
ccuauguuucccaggcugau

SEQ ID NO: 1164596 - RNA, 18 nt, Human
ccucccaccuuagcuucc

SEQ ID NO: 1164597 - RNA, 25 nt, Human
ccucucgccucagccuccccaauag

SEQ ID NO: 1164598 - RNA, 18 nt, Human
ccugcacuccagccuggg

SEQ ID NO: 1164599 - RNA, 20 nt, Human
ccugggaggcagagguugga

SEQ ID NO: 1164600 - RNA, 18 nt, Human
ccugggcucaagggaacc

SEQ ID NO: 1164601 - RNA, 21 nt, Human
ccugggcucaagggaaccucu

SEQ ID NO: 1164602 - RNA, 19 nt, Human
ccuugagcuccugggcuca

SEQ ID NO: 1164603 - RNA, 20 nt, Human
ccuuuagagaagcuuugccu

SEQ ID NO: 1164604 - RNA, 24 nt, Human
cgagaucaugccccugcacuccag

SEQ ID NO: 1164605 - RNA, 21 nt, Human
cgccucagccuccccaauagc

SEQ ID NO: 1164606 - RNA, 24 nt, Human
cgccucagccuccccaauagcuag

SEQ ID NO: 1164607 - RNA, 23 nt, Human
cuacaaacacccuauguuuccca

SEQ ID NO: 1164608 - RNA, 21 nt, Human
cuaggacuacaagcccaugcu

SEQ ID NO: 1164609 - RNA, 19 nt, Human
cucaagagauccucccacc

SEQ ID NO: 1164610 - RNA, 24 nt, Human
cucaagagauccucccaccucagc

SEQ ID NO: 1164611 - RNA, 24 nt, Human
cucaagcaaaccucccaccuuagc

SEQ ID NO: 1164612 - RNA, 23 nt, Human
cuccugggcucaagggaaccucu

SEQ ID NO: 1164613 - RNA, 23 nt, Human
cucgccucagccuccccaauagc

SEQ ID NO: 1164614 - RNA, 27 nt, Human
cugaaacugguaugugauaugucccug

SEQ ID NO: 1164615 - RNA, 22 nt, Human
cugcauugcuucuuuuaaagca

SEQ ID NO: 1164616 - RNA, 22 nt, Human
gaaccucucgccucagccuccc

SEQ ID NO: 1164617 - RNA, 24 nt, Human
gagaaagauaaaggaaaauucaag

SEQ ID NO: 1164618 - RNA, 21 nt, Human
gagcucaagcaaaccucccac

SEQ ID NO: 1164619 - RNA, 25 nt, Human
gccaauaucacuuuuaacauuuucu

SEQ ID NO: 1164620 - RNA, 22 nt, Human
gccccugcacuccagccugggc

SEQ ID NO: 1164621 - RNA, 20 nt, Human
gcucaagggaaccucucgcc

SEQ ID NO: 1164622 - RNA, 21 nt, Human
gcucacuguagccucgaccuc

SEQ ID NO: 1164623 - RNA, 25 nt, Human
ggcacgaugauggcucacuguagcc

SEQ ID NO: 1164624 - RNA, 18 nt, Human
guagagauggggucuaca

SEQ ID NO: 1164625 - RNA, 24 nt, Human
uaaaacuaagagaaauaauaaagc

SEQ ID NO: 1164626 - RNA, 26 nt, Human
uaaaauuuuguuaacaacaacaaaaa

SEQ ID NO: 1164627 - RNA, 19 nt, Human
uaacaaaaagcaaaaaauu

SEQ ID NO: 1164628 - RNA, 21 nt, Human
uaacaacaacaaaaaaagaaa

SEQ ID NO: 1164629 - RNA, 24 nt, Human
uaacuuuagcucuaauucagacuc

SEQ ID NO: 1164630 - RNA, 24 nt, Human
uaagaaccugagaaaacuuucaac

SEQ ID NO: 1164631 - RNA, 21 nt, Human
uacaagcccaugcuacugugu

SEQ ID NO: 1164632 - RNA, 24 nt, Human
uacaauugugagccaccgcaucca

SEQ ID NO: 1164633 - RNA, 21 nt, Human
uacaguaccuugugacauaau

SEQ ID NO: 1164634 - RNA, 20 nt, Human
uacugagugaggauacuuuc

SEQ ID NO: 1164635 - RNA, 21 nt, Human
uacugagugaggauacuuucu

SEQ ID NO: 1164636 - RNA, 25 nt, Human
uacugcauugcuucuuuuaaagcaa

SEQ ID NO: 1164637 - RNA, 19 nt, Human
uagccucgaccucccgagc

SEQ ID NO: 1164638 - RNA, 18 nt, Human
uaguacugagacuaucac

SEQ ID NO: 1164639 - RNA, 22 nt, Human
uaguagacacagaguucaucug

SEQ ID NO: 1164640 - RNA, 25 nt, Human
uauaaauccaaaacaucugcuggaa

SEQ ID NO: 1164641 - RNA, 24 nt, Human
uauauagauguuauaauguaugua

SEQ ID NO: 1164642 - RNA, 23 nt, Human
uauguuucccaggcugaucucaa

SEQ ID NO: 1164643 - RNA, 24 nt, Human
uauguuucccaggcugaucucaaa

SEQ ID NO: 1164644 - RNA, 19 nt, Human
ucacuguagccucgaccuc

SEQ ID NO: 1164645 - RNA, 22 nt, Human
ucacuguagccucgaccucccg

SEQ ID NO: 1164646 - RNA, 25 nt, Human
ucacuugaaccugggaggcagaggu

SEQ ID NO: 1164647 - RNA, 21 nt, Human
ucagaacauuuucucaguggu

SEQ ID NO: 1164648 - RNA, 20 nt, Human
ucagccuccccaauagcuag

SEQ ID NO: 1164649 - RNA, 24 nt, Human
ucaugcugaccuugagcuccuggg

SEQ ID NO: 1164650 - RNA, 24 nt, Human
uccagccugggccacugagcgaga

SEQ ID NO: 1164651 - RNA, 22 nt, Human
uccccaauagcuaggacuacaa

SEQ ID NO: 1164652 - RNA, 21 nt, Human
ucccgagcucaagcaaaccuc

SEQ ID NO: 1164653 - RNA, 27 nt, Human
uccucccaccucagccucccgaaguug

SEQ ID NO: 1164654 - RNA, 18 nt, Human
uccugggcucaagagauc

SEQ ID NO: 1164655 - RNA, 21 nt, Human
uccugggcucaagagauccuc

SEQ ID NO: 1164656 - RNA, 24 nt, Human
uccugggcucaagagauccuccca

SEQ ID NO: 1164657 - RNA, 21 nt, Human
uccugggcucaagggaaccuc

SEQ ID NO: 1164658 - RNA, 22 nt, Human
uccugggcucaagggaaccucu

SEQ ID NO: 1164659 - RNA, 20 nt, Human
ucugcuggaauauuugcuca

SEQ ID NO: 1164660 - RNA, 25 nt, Human
ucuugcucuguccaaauucuugcca

SEQ ID NO: 1164661 - RNA, 21 nt, Human
ugaaaaaaacuccugaaaacu

SEQ ID NO: 1164662 - RNA, 24 nt, Human
ugaaauuacaauugugagccaccg

SEQ ID NO: 1164663 - RNA, 18 nt, Human
ugacauaauguauuaauu

SEQ ID NO: 1164664 - RNA, 18 nt, Human
ugagaauauuuggguagg

SEQ ID NO: 1164665 - RNA, 20 nt, Human
ugaggcauaagaaucacuug

SEQ ID NO: 1164666 - RNA, 24 nt, Human
ugaggcauaagaaucacuugaacc

SEQ ID NO: 1164667 - RNA, 23 nt, Human
ugccacugggauaagaaucuaua

SEQ ID NO: 1164668 - RNA, 25 nt, Human
ugccaggagaaagauaaaggaaaau

SEQ ID NO: 1164669 - RNA, 19 nt, Human
ugcucaugcugaccuugag

SEQ ID NO: 1164670 - RNA, 24 nt, Human
ugcugaaauuacaauugugagcca

SEQ ID NO: 1164671 - RNA, 21 nt, Human
uggaaccgcaggcacacacca

SEQ ID NO: 1164672 - RNA, 24 nt, Human
uggaaccgcaggcacacaccacca

SEQ ID NO: 1164673 - RNA, 24 nt, Human
uggcacgaugauggcucacuguag

SEQ ID NO: 1164674 - RNA, 25 nt, Human
uggcagcacuuacaggaaguucagu

SEQ ID NO: 1164675 - RNA, 24 nt, Human
uggcucacuguagccucgaccucc

SEQ ID NO: 1164676 - RNA, 21 nt, Human
ugggaauguaguaacuuuagc

SEQ ID NO: 1164677 - RNA, 19 nt, Human
ugggaggcagagguuggag

SEQ ID NO: 1164678 - RNA, 20 nt, Human
ugggaggcagagguuggagg

SEQ ID NO: 1164679 - RNA, 24 nt, Human
ugggaggcugaggcauaagaauca

SEQ ID NO: 1164680 - RNA, 24 nt, Human
uguagcauaacaaaaagcaaaaaa

SEQ ID NO: 1164681 - RNA, 19 nt, Human
uuaaauuuuuguagagaug

SEQ ID NO: 1164682 - RNA, 21 nt, Human
uuacuguucuugcucugucca

SEQ ID NO: 1164683 - RNA, 23 nt, Human
uuagagugcaauggcacgaugau

SEQ ID NO: 1164684 - RNA, 19 nt, Human
uuauaguagacacagaguu

SEQ ID NO: 1164685 - RNA, 19 nt, Human
uuccagaguagguggaacc

SEQ ID NO: 1164686 - RNA, 24 nt, Human
uuccuaguucucacuucuuucacu

SEQ ID NO: 1164687 - RNA, 23 nt, Human
uuccugggcucaagagauccucc

SEQ ID NO: 1164688 - RNA, 19 nt, Human
uugaaucacacagauguuu

SEQ ID NO: 1164689 - RNA, 24 nt, Human
uugcucaugcugaccuugagcucc

SEQ ID NO: 1164690 - RNA, 25 nt, Human
uugggaggcugaggcauaagaauca

SEQ ID NO: 1164691 - RNA, 24 nt, Human
uuuauaauaaugagaauauuuggg

SEQ ID NO: 1164692 - RNA, 21 nt, Human
uuucuaugugaagcagucaau

SEQ ID NO: 1164693 - RNA, 18 nt, Human
uuuguagagauggggucu

SEQ ID NO: 1164694 - RNA, 22 nt, Human
uuuuuguagagauggggucuac

SEQ ID NO: 1164695 - RNA, 24 nt, Human
uuuuuuuuuucuuuugagacaggg

SEQ ID NO: 1164696 - RNA, 26 nt, Human
aaaaaugaucaaaagaaacccauagc

SEQ ID NO: 1164697 - RNA, 21 nt, Human
aaaagaaacccauagcugccu

SEQ ID NO: 1164698 - RNA, 23 nt, Human
aaaauuauuaaugugacacucuc

SEQ ID NO: 1164699 - RNA, 23 nt, Human
aaagaaacccauagcugccuaag

SEQ ID NO: 1164700 - RNA, 24 nt, Human
aaagugcugggauuacaggcauga

SEQ ID NO: 1164701 - RNA, 26 nt, Human
aaccacuucucauuugcucuuuccau

SEQ ID NO: 1164702 - RNA, 19 nt, Human
aagugcugggauuacaggc

SEQ ID NO: 1164703 - RNA, 21 nt, Human
aagugcugggauuacaggcau

SEQ ID NO: 1164704 - RNA, 26 nt, Human
aagugcugggauuacaggcaugagcc

SEQ ID NO: 1164705 - RNA, 22 nt, Human
acaauaauggaaugucucugga

SEQ ID NO: 1164706 - RNA, 18 nt, Human
acaggguuucaccauguu

SEQ ID NO: 1164707 - RNA, 21 nt, Human
acaggguuucaccauguuggc

SEQ ID NO: 1164708 - RNA, 24 nt, Human
acaggguuucaccauguuggccag

SEQ ID NO: 1164709 - RNA, 24 nt, Human
accauguuggccaggcuggucuug

SEQ ID NO: 1164710 - RNA, 20 nt, Human
acuucaaaaacguguucaaa

SEQ ID NO: 1164711 - RNA, 24 nt, Human
agaugaucuacccaccuuggccuc

SEQ ID NO: 1164712 - RNA, 21 nt, Human
agaugccgaugggaacgagcc

SEQ ID NO: 1164713 - RNA, 23 nt, Human
aggcaugagccacugugccuggc

SEQ ID NO: 1164714 - RNA, 18 nt, Human
agugcugggauuacaggc

SEQ ID NO: 1164715 - RNA, 20 nt, Human
augagcauuuaugaaaaaac

SEQ ID NO: 1164716 - RNA, 24 nt, Human
augaucuacccaccuuggccuccc

SEQ ID NO: 1164717 - RNA, 21 nt, Human
auggagagggagaagucuguu

SEQ ID NO: 1164718 - RNA, 24 nt, Human
caaagugcugggauuacaggcaug

SEQ ID NO: 1164719 - RNA, 21 nt, Human
caccauguuggccaggcuggu

SEQ ID NO: 1164720 - RNA, 22 nt, Human
caccauguuggccaggcugguc

SEQ ID NO: 1164721 - RNA, 24 nt, Human
caccauguuggccaggcuggucuu

SEQ ID NO: 1164722 - RNA, 19 nt, Human
cacucggcgagacggcugg

SEQ ID NO: 1164723 - RNA, 18 nt, Human
cagccagucacagaugcc

SEQ ID NO: 1164724 - RNA, 22 nt, Human
cagcuccaaaggacucagugau

SEQ ID NO: 1164725 - RNA, 24 nt, Human
caggguuucaccauguuggccagg

SEQ ID NO: 1164726 - RNA, 24 nt, Human
cauguuggccaggcuggucuugaa

SEQ ID NO: 1164727 - RNA, 23 nt, Human
ccaaaccacuucucauuugcucu

SEQ ID NO: 1164728 - RNA, 23 nt, Human
ccaaagugcugggauuacaggca

SEQ ID NO: 1164729 - RNA, 24 nt, Human
ccaaagugcugggauuacaggcau

SEQ ID NO: 1164730 - RNA, 20 nt, Human
ccagaauacaaaauauggua

SEQ ID NO: 1164731 - RNA, 18 nt, Human
ccagauggagagggagaa

SEQ ID NO: 1164732 - RNA, 24 nt, Human
cccaaagugcugggauuacaggca

SEQ ID NO: 1164733 - RNA, 20 nt, Human
ccgcccgggcccucgaucgc

SEQ ID NO: 1164734 - RNA, 24 nt, Human
ccgcccgggcccucgaucgcagcc

SEQ ID NO: 1164735 - RNA, 24 nt, Human
ccugaaaaauguuuuaauuagcua

SEQ ID NO: 1164736 - RNA, 24 nt, Human
ccugaccucagaugaucuacccac

SEQ ID NO: 1164737 - RNA, 19 nt, Human
cgaagcaagcagucaaagc

SEQ ID NO: 1164738 - RNA, 24 nt, Human
cgaagcaagcagucaaagcggcca

SEQ ID NO: 1164739 - RNA, 22 nt, Human
cgcccgggcccucgaucgcagc

SEQ ID NO: 1164740 - RNA, 24 nt, Human
cucagaugaucuacccaccuuggc

SEQ ID NO: 1164741 - RNA, 22 nt, Human
cucgaaaauuuuucucccgcag

SEQ ID NO: 1164742 - RNA, 18 nt, Human
cuggccggccgcccgggc

SEQ ID NO: 1164743 - RNA, 24 nt, Human
gaaaaaaauuuuuuuaaacuugga

SEQ ID NO: 1164744 - RNA, 22 nt, Human
gaacauguacagcggaacauaa

SEQ ID NO: 1164745 - RNA, 23 nt, Human
gaccucagaugaucuacccaccu

SEQ ID NO: 1164746 - RNA, 19 nt, Human
gagaagucuguucccgcug

SEQ ID NO: 1164747 - RNA, 21 nt, Human
gaucgcagccagucacagaug

SEQ ID NO: 1164748 - RNA, 18 nt, Human
gauuacaggcaugagcca

SEQ ID NO: 1164749 - RNA, 21 nt, Human
gauuacaggcaugagccacug

SEQ ID NO: 1164750 - RNA, 24 nt, Human
gauuacaggcaugagccacugugc

SEQ ID NO: 1164751 - RNA, 20 nt, Human
gcagauccggccaguccgca

SEQ ID NO: 1164752 - RNA, 19 nt, Human
gcaugguugcuuucaccag

SEQ ID NO: 1164753 - RNA, 24 nt, Human
ggauuacaggcaugagccacugug

SEQ ID NO: 1164754 - RNA, 24 nt, Human
ggcuggucuugaauuccugaccuc

SEQ ID NO: 1164755 - RNA, 22 nt, Human
ggguuucaccauguuggccagg

SEQ ID NO: 1164756 - RNA, 20 nt, Human
gguaaauaagagugccuucu

SEQ ID NO: 1164757 - RNA, 19 nt, Human
ggucuugaauuccugaccu

SEQ ID NO: 1164758 - RNA, 20 nt, Human
guaagugguccagaauacaa

SEQ ID NO: 1164759 - RNA, 22 nt, Human
uaaagaacaaaaaugaucaaaa

SEQ ID NO: 1164760 - RNA, 22 nt, Human
uaaugugacacucucaucucuc

SEQ ID NO: 1164761 - RNA, 22 nt, Human
uacaggcaugagccacugugcc

SEQ ID NO: 1164762 - RNA, 22 nt, Human
uacccaccuuggccucccaaag

SEQ ID NO: 1164763 - RNA, 23 nt, Human
uacccaccuuggccucccaaagu

SEQ ID NO: 1164764 - RNA, 24 nt, Human
uacuagagacaggguuucaccaug

SEQ ID NO: 1164765 - RNA, 20 nt, Human
uagagacaggguuucaccau

SEQ ID NO: 1164766 - RNA, 21 nt, Human
uagagacaggguuucaccaug

SEQ ID NO: 1164767 - RNA, 22 nt, Human
uagagacaggguuucaccaugu

SEQ ID NO: 1164768 - RNA, 29 nt, Human
ucaauggaacaauaauggaaugucucuuu

SEQ ID NO: 1164769 - RNA, 24 nt, Human
ucccaaagugcugggauuacaggc

SEQ ID NO: 1164770 - RNA, 24 nt, Human
ucgguaaauaagagugccuucucc

SEQ ID NO: 1164771 - RNA, 22 nt, Human
ucuaagugguuuacacugacuu

SEQ ID NO: 1164772 - RNA, 19 nt, Human
ucucuggauggcuacgucc

SEQ ID NO: 1164773 - RNA, 20 nt, Human
ugaccucagaugaucuaccc

SEQ ID NO: 1164774 - RNA, 24 nt, Human
ugaucuacccaccuuggccuccca

SEQ ID NO: 1164775 - RNA, 19 nt, Human
ugcacagaaacucuaaguc

SEQ ID NO: 1164776 - RNA, 21 nt, Human
ugccuugccugcuggaaauuc

SEQ ID NO: 1164777 - RNA, 21 nt, Human
ugcucagugaaaaacuguugc

SEQ ID NO: 1164778 - RNA, 24 nt, Human
uggccaaauuaauuucuuuugcau

SEQ ID NO: 1164779 - RNA, 24 nt, Human
uggccaggcuggucuugaauuccu

SEQ ID NO: 1164780 - RNA, 18 nt, Human
ugggauuacaggcaugag

SEQ ID NO: 1164781 - RNA, 21 nt, Human
ugggauuacaggcaugagcca

SEQ ID NO: 1164782 - RNA, 22 nt, Human
ugggauuacaggcaugagccac

SEQ ID NO: 1164783 - RNA, 22 nt, Human
ugggauuacaggcaugagccac

SEQ ID NO: 1164784 - RNA, 22 nt, Human
ugggauuacaggcaugagccac

SEQ ID NO: 1164785 - RNA, 23 nt, Human
ugggauuacaggcaugagccacu

SEQ ID NO: 1164786 - RNA, 24 nt, Human
ugggauuacaggcaugagccacug

SEQ ID NO: 1164787 - RNA, 24 nt, Human
uuacuagagacaggguuucaccau

SEQ ID NO: 1164788 - RNA, 22 nt, Human
uugaagaacuucaaaaacgugu

SEQ ID NO: 1164789 - RNA, 21 nt, Human
uugaucuuaucaguuucuuga

SEQ ID NO: 1164790 - RNA, 22 nt, Human
uugcucuuuccauuuaaagacu

SEQ ID NO: 1164791 - RNA, 24 nt, Human
uuucaccauguuggccaggcuggu

SEQ ID NO: 1164792 - RNA, 24 nt, Human
uuuuuacuagagacaggguuucac

SEQ ID NO: 1164793 - RNA, 19 nt, Human
aagcugcaccagaaagaac

SEQ ID NO: 1164794 - RNA, 21 nt, Human
aagcugcaccagaaagaacga

SEQ ID NO: 1164795 - RNA, 22 nt, Human
agguugaguuaugcugauuuag

SEQ ID NO: 1164796 - RNA, 22 nt, Human
aguuucuccuucuaaaagcagg

SEQ ID NO: 1164797 - RNA, 22 nt, Human
caccagaaagaacgaaagacuc

SEQ ID NO: 1164798 - RNA, 19 nt, Human
ccuucuaaaagcagguuga

SEQ ID NO: 1164799 - RNA, 21 nt, Human
cuaaagucuuaaccgugcuac

SEQ ID NO: 1164800 - RNA, 19 nt, Human
gcaccagaaagaacgaaag

SEQ ID NO: 1164801 - RNA, 24 nt, Human
uaaaagcagguugaguuaugcuga

SEQ ID NO: 1164802 - RNA, 23 nt, Human
uacuggauuuucuucuucggcuu

SEQ ID NO: 1164803 - RNA, 22 nt, Human
uauacaguaguaggcaguuucu

SEQ ID NO: 1164804 - RNA, 24 nt, Human
ugcaagacaucuguccuggggcaa

SEQ ID NO: 1164805 - RNA, 24 nt, Human
ugcaccagaaagaacgaaagacuc

SEQ ID NO: 1164806 - RNA, 20 nt, Human
uguuauacaguaguaggcag

SEQ ID NO: 1164807 - RNA, 22 nt, Human
uuaaccgugcuacuggauuuuc

SEQ ID NO: 1164808 - RNA, 26 nt, Human
uuauacaguaguaggcaguuucuccu

SEQ ID NO: 1164809 - RNA, 21 nt, Human
uucuucuucggcuucuucaaa

SEQ ID NO: 1164810 - RNA, 21 nt, Human
uuguuauacaguaguaggcag

SEQ ID NO: 1164811 - RNA, 19 nt, Human
aaaaaaaauucccacacaa

SEQ ID NO: 1164812 - RNA, 19 nt, Human
aaaauacccucucccccaa

SEQ ID NO: 1164813 - RNA, 22 nt, Human
aaaauucccacacaaugacauu

SEQ ID NO: 1164814 - RNA, 25 nt, Human
aaacaaaugguucacauuuaccaag

SEQ ID NO: 1164815 - RNA, 23 nt, Human
aaauaggaaaacauuaaaaagaa

SEQ ID NO: 1164816 - RNA, 24 nt, Human
aaaugauaaagaucuuacaaaacu

SEQ ID NO: 1164817 - RNA, 23 nt, Human
aaccaacucuagugaagaaccua

SEQ ID NO: 1164818 - RNA, 24 nt, Human
aacucuagugaagaaccuaaaaag

SEQ ID NO: 1164819 - RNA, 23 nt, Human
aaguaugcaugaacaaaauauuc

SEQ ID NO: 1164820 - RNA, 18 nt, Human
aaugcuaggcaaaaggaa

SEQ ID NO: 1164821 - RNA, 19 nt, Human
acccucucccccaagcaca

SEQ ID NO: 1164822 - RNA, 23 nt, Human
agacuaaauuuuuauaaaaucuc

SEQ ID NO: 1164823 - RNA, 19 nt, Human
aggaaaacauuaaaaagaa

SEQ ID NO: 1164824 - RNA, 28 nt, Human
aggaagaggcugaauuuaagacaaagaa

SEQ ID NO: 1164825 - RNA, 23 nt, Human
aggcaaaaggaaauaggagggac

SEQ ID NO: 1164826 - RNA, 21 nt, Human
agugaagaaccuaaaaagcua

SEQ ID NO: 1164827 - RNA, 26 nt, Human
auuaaaauacccucucccccaagcac

SEQ ID NO: 1164828 - RNA, 23 nt, Human
caaaugguucacauuuaccaaga

SEQ ID NO: 1164829 - RNA, 20 nt, Human
caagcacaauaaaaaacaaa

SEQ ID NO: 1164830 - RNA, 20 nt, Human
caaguuaaaaaaaauuccca

SEQ ID NO: 1164831 - RNA, 23 nt, Human
caaguuaaaaaaaauucccacac

SEQ ID NO: 1164832 - RNA, 21 nt, Human
caaucucacuuucaagauaua

SEQ ID NO: 1164833 - RNA, 19 nt, Human
cacagaaaaauggaucaaa

SEQ ID NO: 1164834 - RNA, 21 nt, Human
cacaugugacccaccuguagu

SEQ ID NO: 1164835 - RNA, 21 nt, Human
cacggagacagcccccacaug

SEQ ID NO: 1164836 - RNA, 22 nt, Human
cccaagcacaauaaaaaacaaa

SEQ ID NO: 1164837 - RNA, 18 nt, Human
ccccacaugugacccacc

SEQ ID NO: 1164838 - RNA, 22 nt, Human
ccuaaaaagcuacagacuaaau

SEQ ID NO: 1164839 - RNA, 23 nt, Human
ccucugcggcuaagccagaauga

SEQ ID NO: 1164840 - RNA, 20 nt, Human
cucaggcuuugaggggccug

SEQ ID NO: 1164841 - RNA, 18 nt, Human
gaaaagcaagaugcuaca

SEQ ID NO: 1164842 - RNA, 18 nt, Human
gagcaaguggggucccuu

SEQ ID NO: 1164843 - RNA, 21 nt, Human
gcaaucucacuuucaagauau

SEQ ID NO: 1164844 - RNA, 22 nt, Human
gcaaucucacuuucaagauaua

SEQ ID NO: 1164845 - RNA, 25 nt, Human
gcaugaacaaaauauucucuaaagu

SEQ ID NO: 1164846 - RNA, 20 nt, Human
ggauacuuuauauucuuuau

SEQ ID NO: 1164847 - RNA, 18 nt, Human
gggagcaagugggguccc

SEQ ID NO: 1164848 - RNA, 20 nt, Human
gguuaaguuuaaaaaguugc

SEQ ID NO: 1164849 - RNA, 27 nt, Human
gguuuuuuuuuucuuuuuugcuuuuag

SEQ ID NO: 1164850 - RNA, 22 nt, Human
uaagacaaagaaaacuugaaug

SEQ ID NO: 1164851 - RNA, 27 nt, Human
uacagaacuuaaaacaccaaagucaaa

SEQ ID NO: 1164852 - RNA, 19 nt, Human
uacagacuucugcucuguc

SEQ ID NO: 1164853 - RNA, 24 nt, Human
uacccucucccccaagcacaauaa

SEQ ID NO: 1164854 - RNA, 19 nt, Human
uaggaaaacauuaaaaaga

SEQ ID NO: 1164855 - RNA, 18 nt, Human
uagguucugacuggaauc

SEQ ID NO: 1164856 - RNA, 24 nt, Human
uauauuaaaauacccucuccccca

SEQ ID NO: 1164857 - RNA, 24 nt, Human
uauuaaaauacccucucccccaag

SEQ ID NO: 1164858 - RNA, 20 nt, Human
ucccccaagcacaauaaaaa

SEQ ID NO: 1164859 - RNA, 19 nt, Human
ucuaaaguacauauuagcg

SEQ ID NO: 1164860 - RNA, 24 nt, Human
ucugcggcuaagccagaaugaagc

SEQ ID NO: 1164861 - RNA, 21 nt, Human
ugagguagauuucuuuucuuu

SEQ ID NO: 1164862 - RNA, 23 nt, Human
ugagguuuuuuuuuucuuuuuug

SEQ ID NO: 1164863 - RNA, 26 nt, Human
ugauugauaaaaaauaaaauacuuug

SEQ ID NO: 1164864 - RNA, 21 nt, Human
ugccacagaaaaauggaucaa

SEQ ID NO: 1164865 - RNA, 19 nt, Human
ugcuuggaaaagcaagaug

SEQ ID NO: 1164866 - RNA, 20 nt, Human
uggaauccugucaacugagg

SEQ ID NO: 1164867 - RNA, 20 nt, Human
ugggcaugggagcaaguggg

SEQ ID NO: 1164868 - RNA, 21 nt, Human
uggggucccuuucuugccucu

SEQ ID NO: 1164869 - RNA, 21 nt, Human
uuaaaaaacagcacacuucga

SEQ ID NO: 1164870 - RNA, 21 nt, Human
uuuggaauuaugcacaaguua

SEQ ID NO: 1164871 - RNA, 23 nt, Human
uuuuguaggcaauagauaugagg

SEQ ID NO: 1164872 - RNA, 18 nt, Human
uuuuuuuuuucuuuuuug

SEQ ID NO: 1164873 - RNA, 23 nt, Human
uuuuuuuuuucuuuuuugcuuuu

SEQ ID NO: 1164874 - RNA, 27 nt, Human
aaagcauauauacaaauaguaugccaa

SEQ ID NO: 1164875 - RNA, 23 nt, Human
aacaacaacaaaaaggaaucaga

SEQ ID NO: 1164876 - RNA, 24 nt, Human
aacaacaacaaaaaggaaucagaa

SEQ ID NO: 1164877 - RNA, 19 nt, Human
aacaguaagcaacaacaac

SEQ ID NO: 1164878 - RNA, 21 nt, Human
aagcaacaacaacaaaaagga

SEQ ID NO: 1164879 - RNA, 25 nt, Human
aagcaacaacaacaaaaaggaaucc

SEQ ID NO: 1164880 - RNA, 23 nt, Human
accacuaaagacauguaauacau

SEQ ID NO: 1164881 - RNA, 21 nt, Human
agcaacaacaacaaaaaggaa

SEQ ID NO: 1164882 - RNA, 22 nt, Human
cagaggaacugauaaaauagug

SEQ ID NO: 1164883 - RNA, 20 nt, Human
cugauaaaauagugaucacc

SEQ ID NO: 1164884 - RNA, 24 nt, Human
gaaagaaaagcauauauacaaaua

SEQ ID NO: 1164885 - RNA, 23 nt, Human
gaguuuaccuacucccacauuuu

SEQ ID NO: 1164886 - RNA, 19 nt, Human
gcaacaacaacaaaaagga

SEQ ID NO: 1164887 - RNA, 21 nt, Human
gcaacaacaacaaaaaggaau

SEQ ID NO: 1164888 - RNA, 31 nt, Human
gguaacaguaagcaacaacaacaaaaaggaa

SEQ ID NO: 1164889 - RNA, 25 nt, Human
uaaaauagugaucaccacuaaagac

SEQ ID NO: 1164890 - RNA, 26 nt, Human
uaaaauagugaucaccacuaaagaca

SEQ ID NO: 1164891 - RNA, 24 nt, Human
uaacaguaagcaacaacaacaaaa

SEQ ID NO: 1164892 - RNA, 19 nt, Human
uaagcaacaacaacaaaaa

SEQ ID NO: 1164893 - RNA, 23 nt, Human
uaagcaacaacaacaaaaaggaa

SEQ ID NO: 1164894 - RNA, 22 nt, Human
uacuugguauaaagaaagacag

SEQ ID NO: 1164895 - RNA, 26 nt, Human
uauaaagaaagacagaggaacugaua

SEQ ID NO: 1164896 - RNA, 22 nt, Human
ucucuuggcaaauuaauacugg

SEQ ID NO: 1164897 - RNA, 23 nt, Human
ugaaagaaaagcauauauacaaa

SEQ ID NO: 1164898 - RNA, 19 nt, Human
uguaauacauaacuuaaau

SEQ ID NO: 1164899 - RNA, 22 nt, Human
caacaauaucugacacugaucu

SEQ ID NO: 1164900 - RNA, 25 nt, Human
caacaauaucugacacugaucuuga

SEQ ID NO: 1164901 - RNA, 22 nt, Human
cugaucuugauacuaguuagaa

SEQ ID NO: 1164902 - RNA, 20 nt, Human
gcgcggcggggggcacucgg

SEQ ID NO: 1164903 - RNA, 20 nt, Human
ggaugaccucggacggcggu

SEQ ID NO: 1164904 - RNA, 24 nt, Human
ucccucaacaauaucugacacuga

SEQ ID NO: 1164905 - RNA, 19 nt, Human
ugacacugaucuugauacu

SEQ ID NO: 1164906 - RNA, 19 nt, Human
ugcgcgggcugaggcuggc

SEQ ID NO: 1164907 - RNA, 21 nt, Human
ugggcuuuuuuuuauaacuac

SEQ ID NO: 1164908 - RNA, 19 nt, Human
uucaagcacaugaaaguca

SEQ ID NO: 1164909 - RNA, 20 nt, Human
uuucaagcacaugaaaguca

SEQ ID NO: 1164910 - RNA, 21 nt, Human
aaaauacaguuaaauggcaaa

SEQ ID NO: 1164911 - RNA, 22 nt, Human
aaacaacagaagcugaugugag

SEQ ID NO: 1164912 - RNA, 21 nt, Human
aaacuauagcagguuacauca

SEQ ID NO: 1164913 - RNA, 23 nt, Human
aaaugccuucuuagauagagaac

SEQ ID NO: 1164914 - RNA, 23 nt, Human
aagaaggaaaucuauacagaaga

SEQ ID NO: 1164915 - RNA, 21 nt, Human
aaggaaaaaaauacaguuaaa

SEQ ID NO: 1164916 - RNA, 27 nt, Human
aaguaugagaaccacaaccaugaaaac

SEQ ID NO: 1164917 - RNA, 25 nt, Human
acacugaaacguacucagagaaaaa

SEQ ID NO: 1164918 - RNA, 21 nt, Human
acagcagaacauauaugaaca

SEQ ID NO: 1164919 - RNA, 18 nt, Human
acaucaaaaaggaaaaaa

SEQ ID NO: 1164920 - RNA, 21 nt, Human
accacaaccaugaaaacaaca

SEQ ID NO: 1164921 - RNA, 19 nt, Human
accaugaaaacaacagaag

SEQ ID NO: 1164922 - RNA, 22 nt, Human
agaaaggacuuuccaagcauga

SEQ ID NO: 1164923 - RNA, 20 nt, Human
agaaccacaaccaugaaaac

SEQ ID NO: 1164924 - RNA, 22 nt, Human
agauauuaaaaguaugagaacc

SEQ ID NO: 1164925 - RNA, 25 nt, Human
aggaaaaaaauacaguuaaauggca

SEQ ID NO: 1164926 - RNA, 26 nt, Human
aggaaaaaaauacaguuaaauggcaa

SEQ ID NO: 1164927 - RNA, 21 nt, Human
aggggaagcaaguaugcagaa

SEQ ID NO: 1164928 - RNA, 24 nt, Human
aguguaaauaaucuuugugugaga

SEQ ID NO: 1164929 - RNA, 21 nt, Human
auaugaacagacuucaagcac

SEQ ID NO: 1164930 - RNA, 28 nt, Human
augaaaacaacagaagcugaugugagaa

SEQ ID NO: 1164931 - RNA, 23 nt, Human
augaccucaaaggcuagagcaua

SEQ ID NO: 1164932 - RNA, 23 nt, Human
caaaggcuagagcauaagagucu

SEQ ID NO: 1164933 - RNA, 24 nt, Human
caacaaaauauuuucaaaacuaaa

SEQ ID NO: 1164934 - RNA, 23 nt, Human
caacagauauuaaaaguaugaga

SEQ ID NO: 1164935 - RNA, 22 nt, Human
caagcaugaccucaaaggcuag

SEQ ID NO: 1164936 - RNA, 21 nt, Human
cacagaguaugacccauuucu

SEQ ID NO: 1164937 - RNA, 18 nt, Human
cacaguaggggcaauaag

SEQ ID NO: 1164938 - RNA, 24 nt, Human
cacuaaaauuaaacagugcagaca

SEQ ID NO: 1164939 - RNA, 18 nt, Human
cacuaaccuguuccuggc

SEQ ID NO: 1164940 - RNA, 19 nt, Human
cacugcuggcaagacuccu

SEQ ID NO: 1164941 - RNA, 18 nt, Human
caugaaaacaacagaagc

SEQ ID NO: 1164942 - RNA, 20 nt, Human
ccacaaccaugaaaacaacc

SEQ ID NO: 1164943 - RNA, 23 nt, Human
cguacacagaggaagaaagugug

SEQ ID NO: 1164944 - RNA, 20 nt, Human
gaagguauguucagccacag

SEQ ID NO: 1164945 - RNA, 21 nt, Human
ggaaaaccacacacacguaca

SEQ ID NO: 1164946 - RNA, 23 nt, Human
ggaaaucuauacagaagacacca

SEQ ID NO: 1164947 - RNA, 20 nt, Human
gggaagcaaguaugcagaac

SEQ ID NO: 1164948 - RNA, 20 nt, Human
ggugaggggaagcaaguaug

SEQ ID NO: 1164949 - RNA, 19 nt, Human
guggaaaaagauguccaca

SEQ ID NO: 1164950 - RNA, 21 nt, Human
uaaauggcaaaugaugcauga

SEQ ID NO: 1164951 - RNA, 22 nt, Human
uaagaaggaaaucuauacagaa

SEQ ID NO: 1164952 - RNA, 19 nt, Human
uccaagcaugaccucaaag

SEQ ID NO: 1164953 - RNA, 19 nt, Human
uccacagaguaugacccau

SEQ ID NO: 1164954 - RNA, 22 nt, Human
ucggcaacaggcagagaacaaa

SEQ ID NO: 1164955 - RNA, 21 nt, Human
ugaaaggaaaaccacacacac

SEQ ID NO: 1164956 - RNA, 22 nt, Human
ugaccucaaaggcuagagcaua

SEQ ID NO: 1164957 - RNA, 23 nt, Human
ugagaaacaacacuaaaauuaaa

SEQ ID NO: 1164958 - RNA, 18 nt, Human
ugaugcaugaggaauaau

SEQ ID NO: 1164959 - RNA, 25 nt, Human
uuuacagugaauauguuacagguuu

SEQ ID NO: 1164960 - RNA, 20 nt, Human
aaaaauaccaaucuggugga

SEQ ID NO: 1164961 - RNA, 24 nt, Human
aaacacagccagagcagagaccac

SEQ ID NO: 1164962 - RNA, 21 nt, Human
aacauagcaagccugacaccu

SEQ ID NO: 1164963 - RNA, 18 nt, Human
aagcggcugcaucugaaa

SEQ ID NO: 1164964 - RNA, 19 nt, Human
acaucuugcacgacuauuu

SEQ ID NO: 1164965 - RNA, 22 nt, Human
agaaauccucccaaagcgaauc

SEQ ID NO: 1164966 - RNA, 24 nt, Human
agagcagagaccacagcacugacg

SEQ ID NO: 1164967 - RNA, 19 nt, Human
aucccgccccggagcuggu

SEQ ID NO: 1164968 - RNA, 18 nt, Human
auccucccaaagcgaauc

SEQ ID NO: 1164969 - RNA, 21 nt, Human
caacauagcaagccugacacc

SEQ ID NO: 1164970 - RNA, 19 nt, Human
caaucugguggaucccugc

SEQ ID NO: 1164971 - RNA, 19 nt, Human
cacgcugcgccucuggcug

SEQ ID NO: 1164972 - RNA, 19 nt, Human
cagcgcccugggaagggcc

SEQ ID NO: 1164973 - RNA, 18 nt, Human
caggagacauuguaagga

SEQ ID NO: 1164974 - RNA, 19 nt, Human
caucugaaacaagccaggc

SEQ ID NO: 1164975 - RNA, 23 nt, Human
cauggccggggugcccggagucc

SEQ ID NO: 1164976 - RNA, 20 nt, Human
ccacgggcgagacuuuggga

SEQ ID NO: 1164977 - RNA, 20 nt, Human
ccccauccucuucacagaug

SEQ ID NO: 1164978 - RNA, 22 nt, Human
ccccucaucaucuucuuccaaa

SEQ ID NO: 1164979 - RNA, 25 nt, Human
cccugcuccagagcagcugcucucc

SEQ ID NO: 1164980 - RNA, 26 nt, Human
ccucaucaucuucuuccaaaggcaaa

SEQ ID NO: 1164981 - RNA, 20 nt, Human
ccucggcuggcaaggaugca

SEQ ID NO: 1164982 - RNA, 25 nt, Human
ccugggaagggccugugcaaggcag

SEQ ID NO: 1164983 - RNA, 23 nt, Human
cggcggggaagucgcccucccuu

SEQ ID NO: 1164984 - RNA, 19 nt, Human
cuaaaaacaaccucaacau

SEQ ID NO: 1164985 - RNA, 23 nt, Human
cucaacauagcaagccugacacc

SEQ ID NO: 1164986 - RNA, 21 nt, Human
cucccuuccuucagcauggcc

SEQ ID NO: 1164987 - RNA, 20 nt, Human
cuugcacgacuauuucccuc

SEQ ID NO: 1164988 - RNA, 26 nt, Human
gaaacgcuggcagauacggucuuacu

SEQ ID NO: 1164989 - RNA, 20 nt, Human
gaaauccucccaaagcgaau

SEQ ID NO: 1164990 - RNA, 23 nt, Human
gaauccagaucugcggcggggaa

SEQ ID NO: 1164991 - RNA, 19 nt, Human
gagaaacgcuggcagauac

SEQ ID NO: 1164992 - RNA, 21 nt, Human
gagcagcugcucuccagugug

SEQ ID NO: 1164993 - RNA, 21 nt, Human
gagcucacgcugcgccucugg

SEQ ID NO: 1164994 - RNA, 21 nt, Human
gcccggagucccucaggggca

SEQ ID NO: 1164995 - RNA, 24 nt, Human
gggcaaugugggcuaguuuucggg

SEQ ID NO: 1164996 - RNA, 22 nt, Human
gugcccggagucccucaggggc

SEQ ID NO: 1164997 - RNA, 18 nt, Human
guggugagaaacgcuggc

SEQ ID NO: 1164998 - RNA, 24 nt, Human
guggugagaaacgcuggcagauac

SEQ ID NO: 1164999 - RNA, 21 nt, Human
uaaagcccugucaacaauuca

SEQ ID NO: 1165000 - RNA, 21 nt, Human
ucacgcugcgccucuggcugc

SEQ ID NO: 1165001 - RNA, 24 nt, Human
ucaugccacuuagaguggcccaug

SEQ ID NO: 1165002 - RNA, 24 nt, Human
ucccccaggagacauuguaaggau

SEQ ID NO: 1165003 - RNA, 19 nt, Human
uccccucaucaucuucuuc

SEQ ID NO: 1165004 - RNA, 21 nt, Human
ucccucaggggcacugaggcu

SEQ ID NO: 1165005 - RNA, 24 nt, Human
ucucuguaacucuaaaaacaaccu

SEQ ID NO: 1165006 - RNA, 21 nt, Human
ucuggcugcgaucccgccccg

SEQ ID NO: 1165007 - RNA, 27 nt, Human
ucuggggagagggucucauggaggagg

SEQ ID NO: 1165008 - RNA, 22 nt, Human
ucugguggaucccugcuccaga

SEQ ID NO: 1165009 - RNA, 25 nt, Human
ugaaacacagccagagcagagacca

SEQ ID NO: 1165010 - RNA, 25 nt, Human
ugaggauguggagaaagcugggagg

SEQ ID NO: 1165011 - RNA, 19 nt, Human
ugcccggagucccucaggg

SEQ ID NO: 1165012 - RNA, 21 nt, Human
ugcccggagucccucaggggc

SEQ ID NO: 1165013 - RNA, 23 nt, Human
ugcccggagucccucaggggcac

SEQ ID NO: 1165014 - RNA, 20 nt, Human
uggagaaagcugggaggagg

SEQ ID NO: 1165015 - RNA, 22 nt, Human
ugggaagggccugugcaaggca

SEQ ID NO: 1165016 - RNA, 24 nt, Human
ugggaagggccugugcaaggcagc

SEQ ID NO: 1165017 - RNA, 20 nt, Human
ugggagaaauccucccaaag

SEQ ID NO: 1165018 - RNA, 21 nt, Human
uggggagagggucucauggag

SEQ ID NO: 1165019 - RNA, 20 nt, Human
uggggcaggcgucggacagc

SEQ ID NO: 1165020 - RNA, 24 nt, Human
uggggcaggcgucggacagcgccc

SEQ ID NO: 1165021 - RNA, 21 nt, Human
ugggggcuuccgaguaacugu

SEQ ID NO: 1165022 - RNA, 22 nt, Human
ugggggcuuccgaguaacugug

SEQ ID NO: 1165023 - RNA, 23 nt, Human
uggugagaaacgcuggcagauac

SEQ ID NO: 1165024 - RNA, 22 nt, Human
uggugaggaaggccagcaacuc

SEQ ID NO: 1165025 - RNA, 21 nt, Human
ugugauguuuaugaaauacgg

SEQ ID NO: 1165026 - RNA, 22 nt, Human
uguggagaaagcugggaggagg

SEQ ID NO: 1165027 - RNA, 20 nt, Human
uguggugagaaacgcuggca

SEQ ID NO: 1165028 - RNA, 23 nt, Human
uucacagauguggacaugguggg

SEQ ID NO: 1165029 - RNA, 23 nt, Human
uuccccucaucaucuucuuccaa

SEQ ID NO: 1165030 - RNA, 24 nt, Human
uucucgaggagccccauccucuuc

SEQ ID NO: 1165031 - RNA, 20 nt, Human
aaaaaaaacacacacacaca

SEQ ID NO: 1165032 - RNA, 20 nt, Human
aaaaaaacacacacacacaa

SEQ ID NO: 1165033 - RNA, 26 nt, Human
aaaaaaacacacacacacaaaagaaa

SEQ ID NO: 1165034 - RNA, 22 nt, Human
aaaaauuuacaacacagcacau

SEQ ID NO: 1165035 - RNA, 21 nt, Human
aaaacaaaggccagccccucc

SEQ ID NO: 1165036 - RNA, 22 nt, Human
aaacaaaggccagccccuccau

SEQ ID NO: 1165037 - RNA, 19 nt, Human
aaacacacacacacaaaag

SEQ ID NO: 1165038 - RNA, 25 nt, Human
aaacacacacacacaaaagaaaaag

SEQ ID NO: 1165039 - RNA, 27 nt, Human
aaacacacacacacaaaagaaaacucc

SEQ ID NO: 1165040 - RNA, 19 nt, Human
aagaagccaaguagagagc

SEQ ID NO: 1165041 - RNA, 24 nt, Human
acaaaagaaaacuccauccaggug

SEQ ID NO: 1165042 - RNA, 19 nt, Human
acaaaggccagccccucca

SEQ ID NO: 1165043 - RNA, 21 nt, Human
acagcacauacuaaggggaaa

SEQ ID NO: 1165044 - RNA, 24 nt, Human
accaaauuaaaaaaaacacacaca

SEQ ID NO: 1165045 - RNA, 19 nt, Human
acugcagggucuucaugag

SEQ ID NO: 1165046 - RNA, 18 nt, Human
acuuccaucugucuuucu

SEQ ID NO: 1165047 - RNA, 28 nt, Human
agaaaaauuuacaacacagcacauacua

SEQ ID NO: 1165048 - RNA, 18 nt, Human
agauccccucccuccacu

SEQ ID NO: 1165049 - RNA, 21 nt, Human
agaugccagaaaacaaaggcc

SEQ ID NO: 1165050 - RNA, 22 nt, Human
agcagcagcagcaggcaggcag

SEQ ID NO: 1165051 - RNA, 20 nt, Human
aggaagcagcagcagcagca

SEQ ID NO: 1165052 - RNA, 20 nt, Human
aucaaggaguugaaguugcc

SEQ ID NO: 1165053 - RNA, 24 nt, Human
caaauuaaaaaaaacacacacaca

SEQ ID NO: 1165054 - RNA, 23 nt, Human
caauguuaaaacacucccgagcu

SEQ ID NO: 1165055 - RNA, 20 nt, Human
cacaaaagaaaacuccaucc

SEQ ID NO: 1165056 - RNA, 21 nt, Human
cacacacacacaaaagaaaac

SEQ ID NO: 1165057 - RNA, 25 nt, Human
cagcagcagcagcaggcaggcagcu

SEQ ID NO: 1165058 - RNA, 24 nt, Human
cagcuuccaaccagucuuaccccu

SEQ ID NO: 1165059 - RNA, 21 nt, Human
caggcagcucccauguguuaa

SEQ ID NO: 1165060 - RNA, 20 nt, Human
caucuucacugaagacuggu

SEQ ID NO: 1165061 - RNA, 20 nt, Human
ccccucccuccacuccuuuc

SEQ ID NO: 1165062 - RNA, 23 nt, Human
cccggcugcgugccgcgcgccca

SEQ ID NO: 1165063 - RNA, 19 nt, Human
cccuccacuccuuucuuca

SEQ ID NO: 1165064 - RNA, 21 nt, Human
ccucagagccagcacucagcu

SEQ ID NO: 1165065 - RNA, 20 nt, Human
ccucucuggcaauacugauu

SEQ ID NO: 1165066 - RNA, 20 nt, Human
cgccaucaaggaguugaagu

SEQ ID NO: 1165067 - RNA, 19 nt, Human
cgggaagaagaaaaacaaa

SEQ ID NO: 1165068 - RNA, 25 nt, Human
cucccuccacuccuuucuucauuua

SEQ ID NO: 1165069 - RNA, 21 nt, Human
cucucuggcaauacugauuga

SEQ ID NO: 1165070 - RNA, 21 nt, Human
cuuaaagacuuccaucugucu

SEQ ID NO: 1165071 - RNA, 23 nt, Human
cuuaccccucucuggcaauacug

SEQ ID NO: 1165072 - RNA, 22 nt, Human
cuucagugaacauuucagucuc

SEQ ID NO: 1165073 - RNA, 25 nt, Human
gccagaaaacaaaggccagccccuc

SEQ ID NO: 1165074 - RNA, 18 nt, Human
gccgcgcgcccacaaaug

SEQ ID NO: 1165075 - RNA, 20 nt, Human
gcuaaccagcagccaacuca

SEQ ID NO: 1165076 - RNA, 19 nt, Human
gcuuccucagagccagcac

SEQ ID NO: 1165077 - RNA, 21 nt, Human
ggaaggcgguuggcacaaccc

SEQ ID NO: 1165078 - RNA, 20 nt, Human
ggacacuccacuuguuucca

SEQ ID NO: 1165079 - RNA, 24 nt, Human
guuuuagauccccucccuccacuc

SEQ ID NO: 1165080 - RNA, 25 nt, Human
uaaaaaaaacacacacacacaaaag

SEQ ID NO: 1165081 - RNA, 21 nt, Human
uaaaaaaaacacacacacacc

SEQ ID NO: 1165082 - RNA, 23 nt, Human
uaaaacacucccgagcuacguca

SEQ ID NO: 1165083 - RNA, 24 nt, Human
uaaaacacucccgagcuacgucaa

SEQ ID NO: 1165084 - RNA, 23 nt, Human
uaagagacugaagaaugguauca

SEQ ID NO: 1165085 - RNA, 24 nt, Human
uaaguuaacaaaagaaacgugggc

SEQ ID NO: 1165086 - RNA, 18 nt, Human
uaaguucuccaucugguc

SEQ ID NO: 1165087 - RNA, 23 nt, Human
uaaguucuccaucuggucuugag

SEQ ID NO: 1165088 - RNA, 20 nt, Human
uacaacacagcacauacuaa

SEQ ID NO: 1165089 - RNA, 24 nt, Human
uacugauugagcuaagguuuggga

SEQ ID NO: 1165090 - RNA, 20 nt, Human
uagcagcaaauguucaacca

SEQ ID NO: 1165091 - RNA, 21 nt, Human
ucaaccaaauuaaaaaaaaca

SEQ ID NO: 1165092 - RNA, 18 nt, Human
uccacuccuuucuucauu

SEQ ID NO: 1165093 - RNA, 19 nt, Human
ucugcaggaagcagcagca

SEQ ID NO: 1165094 - RNA, 20 nt, Human
ucugcagucagcuuccaacc

SEQ ID NO: 1165095 - RNA, 24 nt, Human
ugaacuccgaguccucggccuccc

SEQ ID NO: 1165096 - RNA, 20 nt, Human
ugacccgggugcuccaauga

SEQ ID NO: 1165097 - RNA, 18 nt, Human
ugagcagauacugcaaga

SEQ ID NO: 1165098 - RNA, 21 nt, Human
ugagucuaucugucagcugca

SEQ ID NO: 1165099 - RNA, 23 nt, Human
ugcaggaaauaaguucuccaucu

SEQ ID NO: 1165100 - RNA, 23 nt, Human
ugcagucagcuuccaaccagucu

SEQ ID NO: 1165101 - RNA, 24 nt, Human
ugccagaaaacaaaggccagcccc

SEQ ID NO: 1165102 - RNA, 26 nt, Human
ugccuaagaggcucgaccuuaaagac

SEQ ID NO: 1165103 - RNA, 20 nt, Human
ugcgaccaaaggacagggag

SEQ ID NO: 1165104 - RNA, 22 nt, Human
ugcuaaccagcagccaacucaa

SEQ ID NO: 1165105 - RNA, 24 nt, Human
ugcucaagaaugucaaauuuugca

SEQ ID NO: 1165106 - RNA, 24 nt, Human
ugcuuugcugacccgggugcucca

SEQ ID NO: 1165107 - RNA, 20 nt, Human
ugggaucuaaacgggggggu

SEQ ID NO: 1165108 - RNA, 23 nt, Human
ugucagcugcaggaaauaaguuc

SEQ ID NO: 1165109 - RNA, 24 nt, Human
uugaaggguccaucugaugcucaa

SEQ ID NO: 1165110 - RNA, 23 nt, Human
uuuagauccccucccuccacucc

SEQ ID NO: 1165111 - RNA, 28 nt, Human
uuuagauccccucccuccacuccuuucu

SEQ ID NO: 1165112 - RNA, 21 nt, Human
uuuccugcaggugaacuccga

SEQ ID NO: 1165113 - RNA, 24 nt, Human
uuucucaagugucuucagugaaca

SEQ ID NO: 1165114 - RNA, 21 nt, Human
aaaaaagaaaaaaaauaaaag

SEQ ID NO: 1165115 - RNA, 22 nt, Human
aagcaaaaaagaaaaaaaauaa

SEQ ID NO: 1165116 - RNA, 28 nt, Human
aagcaaaaaagaaaaaaaauaaaagcaa

SEQ ID NO: 1165117 - RNA, 21 nt, Human
aagccaacagcacuucugcag

SEQ ID NO: 1165118 - RNA, 27 nt, Human
aaguacaaacacaaugucaucuaaaau

SEQ ID NO: 1165119 - RNA, 20 nt, Human
acaaagguauaaaacucaaa

SEQ ID NO: 1165120 - RNA, 23 nt, Human
acaauaaaagcaaaaaagaaaaa

SEQ ID NO: 1165121 - RNA, 21 nt, Human
acagacagaaccaugagcagc

SEQ ID NO: 1165122 - RNA, 22 nt, Human
agaaaaaaaauaaaagcaaugu

SEQ ID NO: 1165123 - RNA, 22 nt, Human
agacagaaccaugagcagcaac

SEQ ID NO: 1165124 - RNA, 19 nt, Human
agcaacagcaagggcacgg

SEQ ID NO: 1165125 - RNA, 20 nt, Human
agccaacagcacuucugcag

SEQ ID NO: 1165126 - RNA, 22 nt, Human
agccaacagcacuucugcagcc

SEQ ID NO: 1165127 - RNA, 18 nt, Human
aggucaucggggaaggga

SEQ ID NO: 1165128 - RNA, 21 nt, Human
caacaaaguacaaacacaaug

SEQ ID NO: 1165129 - RNA, 30 nt, Human; identical to SEQ ID NO: 950410

SEQ ID NO: 1165130 - RNA, 21 nt, Human
caauuucagaguacagcggug

SEQ ID NO: 1165131 - RNA, 25 nt, Human
cacacagcauccaagccaacagcac

SEQ ID NO: 1165132 - RNA, 20 nt, Human
cacagcauccaagccaacag

SEQ ID NO: 1165133 - RNA, 19 nt, Human
cagaaccaugagcagcaac

SEQ ID NO: 1165134 - RNA, 24 nt, Human
cagcugcacuaaagccuggggcag

SEQ ID NO: 1165135 - RNA, 22 nt, Human
cauguugccaagauaaccugaa

SEQ ID NO: 1165136 - RNA, 21 nt, Human
ccaaaaagacacugcccagca

SEQ ID NO: 1165137 - RNA, 22 nt, Human
cccaagagccucacuugucccu

SEQ ID NO: 1165138 - RNA, 23 nt, Human
ccccaagagccucacuugucccu

SEQ ID NO: 1165139 - RNA, 24 nt, Human
ccgccaccaccuccuccugcuuuc

SEQ ID NO: 1165140 - RNA, 28 nt, Human
ccgccaccaccuccuccugcuuuccuca

SEQ ID NO: 1165141 - RNA, 18 nt, Human
ccugcaaauccugccagg

SEQ ID NO: 1165142 - RNA, 20 nt, Human
cgccgaggccggcgccgcuc

SEQ ID NO: 1165143 - RNA, 21 nt, Human
cgccgccaccaccuccuccug

SEQ ID NO: 1165144 - RNA, 22 nt, Human
cggacagacagaaccaugagca

SEQ ID NO: 1165145 - RNA, 24 nt, Human
cucaacucacucgccaauuucaga

SEQ ID NO: 1165146 - RNA, 22 nt, Human
cugacuguacaauaaaagcaaa

SEQ ID NO: 1165147 - RNA, 21 nt, Human
cugccagagucaaggguuugc

SEQ ID NO: 1165148 - RNA, 18 nt, Human
cugcccagcaacagcaag

SEQ ID NO: 1165149 - RNA, 22 nt, Human
cugccugcaaauccugccagag

SEQ ID NO: 1165150 - RNA, 22 nt, Human
cuucccgccgccaccaccuccu

SEQ ID NO: 1165151 - RNA, 23 nt, Human
cuucccgccgccaccaccuccuc

SEQ ID NO: 1165152 - RNA, 24 nt, Human
gaacugacuguacaauaaaagcaa

SEQ ID NO: 1165153 - RNA, 23 nt, Human
gcaaauccugccagagucaaggg

SEQ ID NO: 1165154 - RNA, 22 nt, Human
gccucacuuaucugaacucuca

SEQ ID NO: 1165155 - RNA, 18 nt, Human
gcucccuuuccaaaaaga

SEQ ID NO: 1165156 - RNA, 21 nt, Human
ggagcccggcuggcagagggg

SEQ ID NO: 1165157 - RNA, 21 nt, Human
ggcagcucccuuuccaaaaag

SEQ ID NO: 1165158 - RNA, 22 nt, Human
ggccuggccaccaucccagguc

SEQ ID NO: 1165159 - RNA, 24 nt, Human
ggcuggcagaggggugcugccugc

SEQ ID NO: 1165160 - RNA, 19 nt, Human
gggaagggaaaagugugcu

SEQ ID NO: 1165161 - RNA, 22 nt, Human
gggcagcucccuuuccaaaaag

SEQ ID NO: 1165162 - RNA, 21 nt, Human
guacaauaaaagcaaaaaaga

SEQ ID NO: 1165163 - RNA, 22 nt, Human
uaaaagcaaaaaagaaaaaaaa

SEQ ID NO: 1165164 - RNA, 21 nt, Human
uaaccugaaagaccaccauga

SEQ ID NO: 1165165 - RNA, 22 nt, Human
uaacuugauucugagaaacgau

SEQ ID NO: 1165166 - RNA, 21 nt, Human
uacacaacaaaguacaaacac

SEQ ID NO: 1165167 - RNA, 20 nt, Human
uaccaugggugagaggaucu

SEQ ID NO: 1165168 - RNA, 23 nt, Human
uaucugaacucucacuucuaacu

SEQ ID NO: 1165169 - RNA, 23 nt, Human
ucacuuaucugaacucucacuuc

SEQ ID NO: 1165170 - RNA, 24 nt, Human
ucagaguacagcgguggggugugg

SEQ ID NO: 1165171 - RNA, 20 nt, Human
ucccagguaagcagggucaa

SEQ ID NO: 1165172 - RNA, 18 nt, Human
uccuccugcuuuccucag

SEQ ID NO: 1165173 - RNA, 25 nt, Human
ucuccccuucugagguguucaaagc

SEQ ID NO: 1165174 - RNA, 18 nt, Human
ugaaagaccaccaugaag

SEQ ID NO: 1165175 - RNA, 20 nt, Human
ugaaagaccaccaugaagga

SEQ ID NO: 1165176 - RNA, 18 nt, Human
ugacaaaacugagcuggg

SEQ ID NO: 1165177 - RNA, 18 nt, Human
ugacccuugaagucagaa

SEQ ID NO: 1165178 - RNA, 23 nt, Human
ugcaucggugcacggacagacag

SEQ ID NO: 1165179 - RNA, 21 nt, Human
ugcgugaugaccccgcagagc

SEQ ID NO: 1165180 - RNA, 24 nt, Human
uggggcagcucccuuuccaaaaag

SEQ ID NO: 1165181 - RNA, 18 nt, Human
uggggugugguguaugca

SEQ ID NO: 1165182 - RNA, 22 nt, Human
uggggugugguguaugcaucgg

SEQ ID NO: 1165183 - RNA, 22 nt, Human
uguacaauaaaagcaaaaaaga

SEQ ID NO: 1165184 - RNA, 23 nt, Human
uguugccaagauaaccugaaaga

SEQ ID NO: 1165185 - RNA, 22 nt, Human
uucugagaaacgaucccuaauc

SEQ ID NO: 1165186 - RNA, 21 nt, Human
uuuccucagccgccgaggccg

SEQ ID NO: 1165187 - RNA, 21 nt, Human
acugcauagcuuguguuuucc

SEQ ID NO: 1165188 - RNA, 20 nt, Human
aggagucacuuccagagcug

SEQ ID NO: 1165189 - RNA, 23 nt, Human
aggagucacuuccagagcuguuc

SEQ ID NO: 1165190 - RNA, 20 nt, Human
ccagauuccagaggacagag

SEQ ID NO: 1165191 - RNA, 21 nt, Human
cugugagccucgguuuccccu

SEQ ID NO: 1165192 - RNA, 20 nt, Human
gagcacagaugucuggagaa

SEQ ID NO: 1165193 - RNA, 19 nt, Human
gagccucgguuuccccuua

SEQ ID NO: 1165194 - RNA, 20 nt, Human
ggccaagccucaccugcccc

SEQ ID NO: 1165195 - RNA, 18 nt, Human
ggccggugcuggauccug

SEQ ID NO: 1165196 - RNA, 18 nt, Human
ggguggaggggccugggc

SEQ ID NO: 1165197 - RNA, 22 nt, Human
uccagaggacagaggagucacu

SEQ ID NO: 1165198 - RNA, 21 nt, Human
ucccaugacacucaggacagg

SEQ ID NO: 1165199 - RNA, 24 nt, Human
ugagcacagaugucuggagaaggc

SEQ ID NO: 1165200 - RNA, 20 nt, Human
ugauccagauuccagaggac

SEQ ID NO: 1165201 - RNA, 23 nt, Human
uggaggggccugggcuuguugac

SEQ ID NO: 1165202 - RNA, 18 nt, Human
uggauccugggcuacacu

SEQ ID NO: 1165203 - RNA, 22 nt, Human
ugugagccucgguuuccccuua

SEQ ID NO: 1165204 - RNA, 23 nt, Human
uuccagaggacagaggagucacu

SEQ ID NO: 1165205 - RNA, 22 nt, Human
uuuccccuuagcucccaccugc

SEQ ID NO: 1165206 - RNA, 24 nt, Human
aaacuccuggguucaagcaauccu

SEQ ID NO: 1165207 - RNA, 24 nt, Human
aaauugcugggauuacagacguga

SEQ ID NO: 1165208 - RNA, 20 nt, Human
aacauggugaagccccaucu

SEQ ID NO: 1165209 - RNA, 21 nt, Human
aacauggugaagccccaucuc

SEQ ID NO: 1165210 - RNA, 18 nt, Human
aaccucaagccauaaaau

SEQ ID NO: 1165211 - RNA, 22 nt, Human
aaccucaugauccgcccaccuc

SEQ ID NO: 1165212 - RNA, 25 nt, Human
aagcaauccucccaccuuggccucc

SEQ ID NO: 1165213 - RNA, 25 nt, Human
aagcaauccucccaccuuggccucc

SEQ ID NO: 1165214 - RNA, 22 nt, Human
aagcagauaaacaaaucucaga

SEQ ID NO: 1165215 - RNA, 22 nt, Human
aagcauuugaauccuuccccag

SEQ ID NO: 1165216 - RNA, 24 nt, Human
aaucgcuugaacccaggaggcgga

SEQ ID NO: 1165217 - RNA, 27 nt, Human
aauucucccuaauaggaacacuucuau

SEQ ID NO: 1165218 - RNA, 21 nt, Human
acagaacucaacaauucacaa

SEQ ID NO: 1165219 - RNA, 18 nt, Human
acagacgugagccaccgu

SEQ ID NO: 1165220 - RNA, 18 nt, Human
acagcauauauauauaua

SEQ ID NO: 1165221 - RNA, 18 nt, Human
acccagcuaauuaaaauu

SEQ ID NO: 1165222 - RNA, 24 nt, Human
acccaggaggcggagguugcagug

SEQ ID NO: 1165223 - RNA, 24 nt, Human
accgcuguguuccaguuaaacuuu

SEQ ID NO: 1165224 - RNA, 23 nt, Human
accucagccucccaaauugcugg

SEQ ID NO: 1165225 - RNA, 21 nt, Human
accucagccucccgaguagcu

SEQ ID NO: 1165226 - RNA, 24 nt, Human
accugaggucaggaguucaagacc

SEQ ID NO: 1165227 - RNA, 21 nt, Human
acgugagccaccgugccuggc

SEQ ID NO: 1165228 - RNA, 20 nt, Human
acugcaagcuccgccuccca

SEQ ID NO: 1165229 - RNA, 18 nt, Human
acugcacuccagccuggg

SEQ ID NO: 1165230 - RNA, 23 nt, Human
acugcacuccagccugggugaua

SEQ ID NO: 1165231 - RNA, 21 nt, Human
acugcagccuugaccucccag

SEQ ID NO: 1165232 - RNA, 22 nt, Human
acugcagccuugaccucccagg

SEQ ID NO: 1165233 - RNA, 18 nt, Human
agaaaccucaagccauaa

SEQ ID NO: 1165234 - RNA, 19 nt, Human
agaacucaacaauucacaa

SEQ ID NO: 1165235 - RNA, 18 nt, Human
agacagggucucacugug

SEQ ID NO: 1165236 - RNA, 23 nt, Human
agacagggucucacuguguugcc

SEQ ID NO: 1165237 - RNA, 20 nt, Human
agacgugagccaccgugccu

SEQ ID NO: 1165238 - RNA, 23 nt, Human
agacgugagccaccgugccuggc

SEQ ID NO: 1165239 - RNA, 27 nt, Human
agaggagggaaaaauagguacagggag

SEQ ID NO: 1165240 - RNA, 19 nt, Human
agaggggguuucacugugu

SEQ ID NO: 1165241 - RNA, 22 nt, Human
agaucgaggaccuaacaaagga

SEQ ID NO: 1165242 - RNA, 24 nt, Human
agcacuuugggaggccgaggcagg

SEQ ID NO: 1165243 - RNA, 23 nt, Human
agccgggugugguggcaugcgcc

SEQ ID NO: 1165244 - RNA, 24 nt, Human
agccuggccaacauggugaagccc

SEQ ID NO: 1165245 - RNA, 20 nt, Human
agccugggugauaucagcuu

SEQ ID NO: 1165246 - RNA, 18 nt, Human
agccuugaccucccaggc

SEQ ID NO: 1165247 - RNA, 25 nt, Human
aggcacgguggcucaugccuguuaa

SEQ ID NO: 1165248 - RNA, 23 nt, Human
aggcaggacaaucgcuugaaccc

SEQ ID NO: 1165249 - RNA, 18 nt, Human
aggcagguggaucaccug

SEQ ID NO: 1165250 - RNA, 22 nt, Human
aggcagguggaucaccugaggu

SEQ ID NO: 1165251 - RNA, 26 nt, Human
aggcagguggaucaccugaggucagg

SEQ ID NO: 1165252 - RNA, 21 nt, Human
aggcaugagccaccaugcccg

SEQ ID NO: 1165253 - RNA, 21 nt, Human
aggccgaggcagguggaucac

SEQ ID NO: 1165254 - RNA, 24 nt, Human
aggcggagguugcagugagccgag

SEQ ID NO: 1165255 - RNA, 21 nt, Human
aggcucaagugauccuuucac

SEQ ID NO: 1165256 - RNA, 20 nt, Human
aggcugaggcaggacaaucg

SEQ ID NO: 1165257 - RNA, 24 nt, Human
aggcugaggcaggacaaucgcuug

SEQ ID NO: 1165258 - RNA, 25 nt, Human
aggcuggagugcaguugcaaaaucu

SEQ ID NO: 1165259 - RNA, 20 nt, Human
aggggguuucacuguguuag

SEQ ID NO: 1165260 - RNA, 22 nt, Human
agguggaucaccugaggucagg

SEQ ID NO: 1165261 - RNA, 24 nt, Human
agguggucugaaacuccuggguuc

SEQ ID NO: 1165262 - RNA, 19 nt, Human
aguagcugggauuauaggc

SEQ ID NO: 1165263 - RNA, 22 nt, Human
agucuuuuuucuacauguacau

SEQ ID NO: 1165264 - RNA, 24 nt, Human
agugcaguugcaaaaucucagcuc

SEQ ID NO: 1165265 - RNA, 23 nt, Human
auaaauguaaaagcuagucuugg

SEQ ID NO: 1165266 - RNA, 19 nt, Human
aucaaugucaauuuagucu

SEQ ID NO: 1165267 - RNA, 24 nt, Human
aucaccugaggucaggaguucaag

SEQ ID NO: 1165268 - RNA, 24 nt, Human
aucgcgccacugcacuccagccug

SEQ ID NO: 1165269 - RNA, 24 nt, Human
augauccgcccaccucagccuccc

SEQ ID NO: 1165270 - RNA, 19 nt, Human
augccuguuaacccagcac

SEQ ID NO: 1165271 - RNA, 19 nt, Human
auucuuuucccuucugccu

SEQ ID NO: 1165272 - RNA, 18 nt, Human
caaaaacagccauagaac

SEQ ID NO: 1165273 - RNA, 24 nt, Human
caaauugcugggauuacagacgug

SEQ ID NO: 1165274 - RNA, 24 nt, Human
caacauggugaagccccaucucua

SEQ ID NO: 1165275 - RNA, 19 nt, Human
caacuauacaucaauccuc

SEQ ID NO: 1165276 - RNA, 24 nt, Human
caagaccagccuggccaacauggu

SEQ ID NO: 1165277 - RNA, 27 nt, Human
caagcaauccucccaccuuggccuccc

SEQ ID NO: 1165278 - RNA, 27 nt, Human
caagugauccuuucaccucagccuccc

SEQ ID NO: 1165279 - RNA, 24 nt, Human
caccucagccucccgaguagcugg

SEQ ID NO: 1165280 - RNA, 23 nt, Human
caccugaggucaggaguucaaga

SEQ ID NO: 1165281 - RNA, 22 nt, Human
caccuguuccuuggacaagaau

SEQ ID NO: 1165282 - RNA, 18 nt, Human
caccuucuuggccacagu

SEQ ID NO: 1165283 - RNA, 23 nt, Human
cacuccagccugggugauaucag

SEQ ID NO: 1165284 - RNA, 24 nt, Human
cacuccagccugggugauaucagc

SEQ ID NO: 1165285 - RNA, 24 nt, Human
cacuccagccugggugauaucagg

SEQ ID NO: 1165286 - RNA, 19 nt, Human
cacugcacuccagccuggg

SEQ ID NO: 1165287 - RNA, 19 nt, Human
cacugcacuccagccuggg

SEQ ID NO: 1165288 - RNA, 22 nt, Human
cacugcacuccagccuggguga

SEQ ID NO: 1165289 - RNA, 23 nt, Human
cacugcacuccagccugggugau

SEQ ID NO: 1165290 - RNA, 24 nt, Human
cacugcacuccagccugggugaua

SEQ ID NO: 1165291 - RNA, 26 nt, Human
cacugcacuccagccugggugauauc

SEQ ID NO: 1165292 - RNA, 18 nt, Human
cacuguguuagccaggau

SEQ ID NO: 1165293 - RNA, 19 nt, Human
cacuguguuagccaggaug

SEQ ID NO: 1165294 - RNA, 24 nt, Human
cacuguguuagccaggauggucuc

SEQ ID NO: 1165295 - RNA, 24 nt, Human
cagcacuuugggaggccgaggcag

SEQ ID NO: 1165296 - RNA, 26 nt, Human
cagcacuuugggaggccgaggcaggu

SEQ ID NO: 1165297 - RNA, 23 nt, Human
cagccuugaccucccaggcucaa

SEQ ID NO: 1165298 - RNA, 24 nt, Human
cagccuugaccucccaggcucaag

SEQ ID NO: 1165299 - RNA, 23 nt, Human
cagcuacucgaggcugaggcagg

SEQ ID NO: 1165300 - RNA, 24 nt, Human
cagcuuacugcagccuugaccucc

SEQ ID NO: 1165301 - RNA, 23 nt, Human
caggauagcucauuuuucauuga

SEQ ID NO: 1165302 - RNA, 23 nt, Human
cagggucucacuguguugccaag

SEQ ID NO: 1165303 - RNA, 24 nt, Human
cagguggaucaccugaggucagga

SEQ ID NO: 1165304 - RNA, 26 nt, Human
cauaaaaacuacaguaaacuagauag

SEQ ID NO: 1165305 - RNA, 24 nt, Human
caugauccgcccaccucagccucc

SEQ ID NO: 1165306 - RNA, 20 nt, Human
caugccuguuaacccagcac

SEQ ID NO: 1165307 - RNA, 24 nt, Human
caugccuguuaacccagcacuuug

SEQ ID NO: 1165308 - RNA, 19 nt, Human
cauuuugguuuuuuuuuca

SEQ ID NO: 1165309 - RNA, 24 nt, Human
ccaaauugcugggauuacagacgu

SEQ ID NO: 1165310 - RNA, 22 nt, Human
ccaaccacucaacuagacuuua

SEQ ID NO: 1165311 - RNA, 24 nt, Human
ccaaccugcuaggauuacaggcau

SEQ ID NO: 1165312 - RNA, 20 nt, Human
ccacugcacuccagccuggg

SEQ ID NO: 1165313 - RNA, 20 nt, Human
ccacugcacuccagccuggg

SEQ ID NO: 1165314 - RNA, 21 nt, Human
ccacugcacuccagccugggu

SEQ ID NO: 1165315 - RNA, 21 nt, Human
ccacugcacuccagccugggu

SEQ ID NO: 1165316 - RNA, 23 nt, Human
ccacugcacuccagccuggguga

SEQ ID NO: 1165317 - RNA, 23 nt, Human
ccacugcacuccagccuggguga

SEQ ID NO: 1165318 - RNA, 24 nt, Human
ccacugcacuccagccugggugau

SEQ ID NO: 1165319 - RNA, 25 nt, Human
ccacugcacuccagccugggugaua

SEQ ID NO: 1165320 - RNA, 20 nt, Human
ccauaaaaacuacaguaaac

SEQ ID NO: 1165321 - RNA, 19 nt, Human
cccaggcucaagugauccu

SEQ ID NO: 1165322 - RNA, 22 nt, Human
cccaggcucaagugauccuuuc

SEQ ID NO: 1165323 - RNA, 20 nt, Human
cccagguucaugccauucuc

SEQ ID NO: 1165324 - RNA, 23 nt, Human
ccccaucucuacuaaaaauacaa

SEQ ID NO: 1165325 - RNA, 24 nt, Human
cccgaguagcuggaacuacaggcu

SEQ ID NO: 1165326 - RNA, 19 nt, Human
cccugagguggcaauaccc

SEQ ID NO: 1165327 - RNA, 23 nt, Human
ccgcccaccucagccucccaaau

SEQ ID NO: 1165328 - RNA, 26 nt, Human
ccgcccaccucagccucccaaauugc

SEQ ID NO: 1165329 - RNA, 21 nt, Human
ccucaagccauaaaauaaauu

SEQ ID NO: 1165330 - RNA, 22 nt, Human
ccucccaccuuggccucccaac

SEQ ID NO: 1165331 - RNA, 24 nt, Human
ccucccagguucaugccauucucc

SEQ ID NO: 1165332 - RNA, 23 nt, Human
ccugaguagcugggauuauaggc

SEQ ID NO: 1165333 - RNA, 24 nt, Human
ccugaguagcugggauuauaggcg

SEQ ID NO: 1165334 - RNA, 23 nt, Human
ccuggccaacauggugaagcccc

SEQ ID NO: 1165335 - RNA, 24 nt, Human
ccuggccaacauggugaagcccca

SEQ ID NO: 1165336 - RNA, 19 nt, Human
ccuggcccauguacaugua

SEQ ID NO: 1165337 - RNA, 23 nt, Human
ccuggguucaagcaauccuccca

SEQ ID NO: 1165338 - RNA, 20 nt, Human
ccuguagucccagcuacucg

SEQ ID NO: 1165339 - RNA, 22 nt, Human
ccuguagucccagcuacucgag

SEQ ID NO: 1165340 - RNA, 18 nt, Human
ccuguuuguucauuccau

SEQ ID NO: 1165341 - RNA, 22 nt, Human
ccuucagaaauugagacggccu

SEQ ID NO: 1165342 - RNA, 19 nt, Human
ccuuggccucccaaccugc

SEQ ID NO: 1165343 - RNA, 20 nt, Human
cgaggcagguggaucaccug

SEQ ID NO: 1165344 - RNA, 24 nt, Human
cgaggcagguggaucaccugaggu

SEQ ID NO: 1165345 - RNA, 26 nt, Human
cgaggcagguggaucaccugagguca

SEQ ID NO: 1165346 - RNA, 27 nt, Human
cgccacugcacuccagccugggugaua

SEQ ID NO: 1165347 - RNA, 23 nt, Human
cgccuguagucccagcuacucga

SEQ ID NO: 1165348 - RNA, 25 nt, Human
cgccuguagucccagcuacucgagg

SEQ ID NO: 1165349 - RNA, 24 nt, Human
cgugagccaccgugccuggcccau

SEQ ID NO: 1165350 - RNA, 23 nt, Human
cuaauuuuuuguauuuuuaucag

SEQ ID NO: 1165351 - RNA, 24 nt, Human
cucaagugauccuuucaccucagc

SEQ ID NO: 1165352 - RNA, 21 nt, Human
cucaggauagcucauuuuuca

SEQ ID NO: 1165353 - RNA, 23 nt, Human
cucaugccuguuaacccagcacu

SEQ ID NO: 1165354 - RNA, 24 nt, Human
cucaugccuguuaacccagcacuu

SEQ ID NO: 1165355 - RNA, 18 nt, Human
cucccaaccugcuaggau

SEQ ID NO: 1165356 - RNA, 24 nt, Human
cugcaagcuccgccucccagguuc

SEQ ID NO: 1165357 - RNA, 23 nt, Human
cugcagccuugaccucccaggcu

SEQ ID NO: 1165358 - RNA, 23 nt, Human
cugccucagacuccugaguagcu

SEQ ID NO: 1165359 - RNA, 24 nt, Human
cugugacaguauucccugaggugg

SEQ ID NO: 1165360 - RNA, 21 nt, Human
cuugcucuguagcccaggcug

SEQ ID NO: 1165361 - RNA, 22 nt, Human
gagagaggagggaaaaauaggu

SEQ ID NO: 1165362 - RNA, 23 nt, Human
gagaucgcgccacugcacuccag

SEQ ID NO: 1165363 - RNA, 21 nt, Human
gaggcggagguugcagugagc

SEQ ID NO: 1165364 - RNA, 23 nt, Human
gagguugcagugagccgagaucg

SEQ ID NO: 1165365 - RNA, 27 nt, Human
gaguagcuggaacuacaggcuugagcc

SEQ ID NO: 1165366 - RNA, 23 nt, Human
gaucaccugaggucaggaguuca

SEQ ID NO: 1165367 - RNA, 24 nt, Human
gaucaccugaggucaggaguucaa

SEQ ID NO: 1165368 - RNA, 18 nt, Human
gauuacagacgugagcca

SEQ ID NO: 1165369 - RNA, 21 nt, Human
gauuacagacgugagccaccg

SEQ ID NO: 1165370 - RNA, 24 nt, Human
gauuacagacgugagccaccgugc

SEQ ID NO: 1165371 - RNA, 18 nt, Human
gauuacaggcaugagcca

SEQ ID NO: 1165372 - RNA, 21 nt, Human
gauuacaggcaugagccacca

SEQ ID NO: 1165373 - RNA, 24 nt, Human
gauuacaggcaugagccaccaugc

SEQ ID NO: 1165374 - RNA, 22 nt, Human
gcaagcuccgccucccagguuc

SEQ ID NO: 1165375 - RNA, 19 nt, Human
gcaguuggaaagaaugaag

SEQ ID NO: 1165376 - RNA, 24 nt, Human
gccaacauggugaagccccaucuc

SEQ ID NO: 1165377 - RNA, 19 nt, Human
gccacugcacuccagccug

SEQ ID NO: 1165378 - RNA, 24 nt, Human
gccacugcacuccagccuggguga

SEQ ID NO: 1165379 - RNA, 22 nt, Human
gccaggcacgguggcucaugcc

SEQ ID NO: 1165380 - RNA, 19 nt, Human
gcccaggcuggagugcagu

SEQ ID NO: 1165381 - RNA, 20 nt, Human
gccgagaucgcgccacugca

SEQ ID NO: 1165382 - RNA, 20 nt, Human
ggacuaaacuuacuggcuaa

SEQ ID NO: 1165383 - RNA, 20 nt, Human
ggagguugcagugagccgag

SEQ ID NO: 1165384 - RNA, 22 nt, Human
ggagguugcagugagccgagau

SEQ ID NO: 1165385 - RNA, 24 nt, Human
ggagguugcagugagccgagaucg

SEQ ID NO: 1165386 - RNA, 22 nt, Human
ggaucaccugaggucaggaguu

SEQ ID NO: 1165387 - RNA, 22 nt, Human
ggauuacaggcaugagccacca

SEQ ID NO: 1165388 - RNA, 24 nt, Human
ggauuacaggcaugagccaccaug

SEQ ID NO: 1165389 - RNA, 21 nt, Human
ggccaggcacgguggcucaug

SEQ ID NO: 1165390 - RNA, 21 nt, Human
ggcucaugccuguuaacccag

SEQ ID NO: 1165391 - RNA, 24 nt, Human
ggggguuucacuguguuagccagg

SEQ ID NO: 1165392 - RNA, 18 nt, Human
gggguuucacuguguuag

SEQ ID NO: 1165393 - RNA, 23 nt, Human
gggguuucacuguguuagccagg

SEQ ID NO: 1165394 - RNA, 24 nt, Human
gggugugguggcaugcgccuguag

SEQ ID NO: 1165395 - RNA, 24 nt, Human
gguggcaugcgccuguagucccag

SEQ ID NO: 1165396 - RNA, 24 nt, Human
gguggcucaugccuguuaacccag

SEQ ID NO: 1165397 - RNA, 24 nt, Human
guagcuggaacuacaggcuugagc

SEQ ID NO: 1165398 - RNA, 18 nt, Human
guagcugggauuauaggc

SEQ ID NO: 1165399 - RNA, 23 nt, Human
guaguuuaaaaaugguuagauga

SEQ ID NO: 1165400 - RNA, 21 nt, Human
gugaagccccaucucuacuaa

SEQ ID NO: 1165401 - RNA, 24 nt, Human
gugauccuuucaccucagccuccc

SEQ ID NO: 1165402 - RNA, 24 nt, Human
guguuaaaaauguaagagugaaca

SEQ ID NO: 1165403 - RNA, 19 nt, Human
guugcagugagccgagauc

SEQ ID NO: 1165404 - RNA, 21 nt, Human
guugcagugagccgagaucgc

SEQ ID NO: 1165405 - RNA, 24 nt, Human
uaaacuagauaggccauaaagaug

SEQ ID NO: 1165406 - RNA, 22 nt, Human
uaaagacagggucucacugugu

SEQ ID NO: 1165407 - RNA, 19 nt, Human
uaaagcagauaaacaaauc

SEQ ID NO: 1165408 - RNA, 25 nt, Human
uaaaggaagaugagaaggaaggggg

SEQ ID NO: 1165409 - RNA, 23 nt, Human
uaaauaaggagagggccaggcac

SEQ ID NO: 1165410 - RNA, 20 nt, Human
uaacugugguugaacggcag

SEQ ID NO: 1165411 - RNA, 18 nt, Human
uaagagugaacauucacc

SEQ ID NO: 1165412 - RNA, 24 nt, Human
uaauuuuuuguauuuuuaucagag

SEQ ID NO: 1165413 - RNA, 20 nt, Human
uacaacauccucuguucagu

SEQ ID NO: 1165414 - RNA, 22 nt, Human
uacagacgugagccaccgugcc

SEQ ID NO: 1165415 - RNA, 23 nt, Human
uacaggcaugagccaccaugccc

SEQ ID NO: 1165416 - RNA, 24 nt, Human
uacaggcuugagccaccacaccca

SEQ ID NO: 1165417 - RNA, 22 nt, Human
uagcccaggcuggagugcaguu

SEQ ID NO: 1165418 - RNA, 20 nt, Human
uagccgggugugguggcaug

SEQ ID NO: 1165419 - RNA, 18 nt, Human
uaggauuacaggcaugag

SEQ ID NO: 1165420 - RNA, 22 nt, Human
uaggauuacaggcaugagccac

SEQ ID NO: 1165421 - RNA, 24 nt, Human
uaggauuacaggcaugagccacca

SEQ ID NO: 1165422 - RNA, 26 nt, Human
uaucuguauuuaacagcauauauaua

SEQ ID NO: 1165423 - RNA, 30 nt, Human
uauuuaacagcauauauauauauaaauaua

SEQ ID NO: 1165424 - RNA, 28 nt, Human
uauuuuuuuuuuuuuugagguggagucu

SEQ ID NO: 1165425 - RNA, 24 nt, Human
ucaagcaauccucccaccuuggcc

SEQ ID NO: 1165426 - RNA, 20 nt, Human
ucaccuucuuggccacagug

SEQ ID NO: 1165427 - RNA, 18 nt, Human
ucacugcaagcuccgccu

SEQ ID NO: 1165428 - RNA, 19 nt, Human
ucacugcaagcuccgccuc

SEQ ID NO: 1165429 - RNA, 19 nt, Human
ucacugcaagcuccgccuc

SEQ ID NO: 1165430 - RNA, 24 nt, Human
ucacugcaagcuccgccucccagg

SEQ ID NO: 1165431 - RNA, 24 nt, Human
ucacuguguuagccaggauggucu

SEQ ID NO: 1165432 - RNA, 20 nt, Human
ucagagagagaggagggaaa

SEQ ID NO: 1165433 - RNA, 23 nt, Human
ucagccucccgaguagcuggaac

SEQ ID NO: 1165434 - RNA, 19 nt, Human
ucagcucacugcaagcucc

SEQ ID NO: 1165435 - RNA, 25 nt, Human
ucagcucacugcaagcuccgccucc

SEQ ID NO: 1165436 - RNA, 19 nt, Human
ucagcuuacugcagccuug

SEQ ID NO: 1165437 - RNA, 25 nt, Human
ucaugccuguuaacccagcacuuug

SEQ ID NO: 1165438 - RNA, 24 nt, Human
uccaucauucugauugauucuuuu

SEQ ID NO: 1165439 - RNA, 24 nt, Human
ucccaaauugcugggauuacagac

SEQ ID NO: 1165440 - RNA, 20 nt, Human
ucccaggcucaagugauccu

SEQ ID NO: 1165441 - RNA, 20 nt, Human
ucccagguucaugccauucu

SEQ ID NO: 1165442 - RNA, 21 nt, Human
ucccagguucaugccauucuc

SEQ ID NO: 1165443 - RNA, 24 nt, Human
ucccagguucaugccauucuccug

SEQ ID NO: 1165444 - RNA, 24 nt, Human
ucccgaguagcuggaacuacaggc

SEQ ID NO: 1165445 - RNA, 21 nt, Human
uccgcccaccucagccuccca

SEQ ID NO: 1165446 - RNA, 23 nt, Human
uccucccaccuuggccucccaac

SEQ ID NO: 1165447 - RNA, 24 nt, Human
uccugaguagcugggauuauaggc

SEQ ID NO: 1165448 - RNA, 18 nt, Human
uccuggguucaagcaauc

SEQ ID NO: 1165449 - RNA, 23 nt, Human
ucgcgccacugcacuccagccug

SEQ ID NO: 1165450 - RNA, 24 nt, Human
ucgcuugaacccaggaggcggagg

SEQ ID NO: 1165451 - RNA, 22 nt, Human
ucucacuguguugccaaggugg

SEQ ID NO: 1165452 - RNA, 21 nt, Human
ucucuacuaaaaauacaaaaa

SEQ ID NO: 1165453 - RNA, 19 nt, Human
ucugauugauucuuuuccc

SEQ ID NO: 1165454 - RNA, 24 nt, Human
ucuguagcccaggcuggagugcag

SEQ ID NO: 1165455 - RNA, 19 nt, Human
ucuugcucuguagcccagg

SEQ ID NO: 1165456 - RNA, 22 nt, Human
ucuugcucuguagcccaggcug

SEQ ID NO: 1165457 - RNA, 23 nt, Human
ucuugcucuguagcccaggcugg

SEQ ID NO: 1165458 - RNA, 24 nt, Human
ucuugcucuguagcccaggcugga

SEQ ID NO: 1165459 - RNA, 19 nt, Human
ugaagccccaucucuacua

SEQ ID NO: 1165460 - RNA, 25 nt, Human
ugaccucccaggcucaagugauccu

SEQ ID NO: 1165461 - RNA, 22 nt, Human
ugagaaggaagggggaaaagaa

SEQ ID NO: 1165462 - RNA, 19 nt, Human
ugagacggccugaauucuc

SEQ ID NO: 1165463 - RNA, 22 nt, Human
ugagccgagaucgcgccacugc

SEQ ID NO: 1165464 - RNA, 24 nt, Human
ugaggcaggacaaucgcuugaacc

SEQ ID NO: 1165465 - RNA, 25 nt, Human
ugaggcaggacaaucgcuugaaccc

SEQ ID NO: 1165466 - RNA, 21 nt, Human
ugagguggcaauacccuuucc

SEQ ID NO: 1165467 - RNA, 24 nt, Human
ugauccgcccaccucagccuccca

SEQ ID NO: 1165468 - RNA, 23 nt, Human
ugccauaucuuuacauaaacuca

SEQ ID NO: 1165469 - RNA, 23 nt, Human
ugcccggcagauuuugcuauuuu

SEQ ID NO: 1165470 - RNA, 21 nt, Human
ugccucagacuccugaguagc

SEQ ID NO: 1165471 - RNA, 24 nt, Human
ugccucagacuccugaguagcugg

SEQ ID NO: 1165472 - RNA, 23 nt, Human
ugcucuguagcccaggcuggagu

SEQ ID NO: 1165473 - RNA, 24 nt, Human
ugcucuguagcccaggcuggagug

SEQ ID NO: 1165474 - RNA, 24 nt, Human
ugcugggauuacagacgugagcca

SEQ ID NO: 1165475 - RNA, 21 nt, Human
uggaacuacaggcuugagcca

SEQ ID NO: 1165476 - RNA, 24 nt, Human
uggaacuacaggcuugagccacca

SEQ ID NO: 1165477 - RNA, 23 nt, Human
uggagugcaguugcaaaaucuca

SEQ ID NO: 1165478 - RNA, 24 nt, Human
uggaucaccugaggucaggaguuc

SEQ ID NO: 1165479 - RNA, 26 nt, Human
uggaucaccugaggucaggaguucaa

SEQ ID NO: 1165480 - RNA, 21 nt, Human
uggcaugcgccuguaguccca

SEQ ID NO: 1165481 - RNA, 24 nt, Human
uggccaacauggugaagccccauc

SEQ ID NO: 1165482 - RNA, 19 nt, Human
uggcuaaaggacagcuugc

SEQ ID NO: 1165483 - RNA, 24 nt, Human
ugggaggccgaggcagguggauca

SEQ ID NO: 1165484 - RNA, 18 nt, Human
ugggauuacagacgugag

SEQ ID NO: 1165485 - RNA, 21 nt, Human
ugggauuacagacgugagcca

SEQ ID NO: 1165486 - RNA, 22 nt, Human
ugggauuacagacgugagccac

SEQ ID NO: 1165487 - RNA, 23 nt, Human
ugggauuacagacgugagccacc

SEQ ID NO: 1165488 - RNA, 23 nt, Human
ugggauuacagacgugagccacc

SEQ ID NO: 1165489 - RNA, 24 nt, Human
ugggauuacagacgugagccaccg

SEQ ID NO: 1165490 - RNA, 19 nt, Human
ugggauuauaggcgccugc

SEQ ID NO: 1165491 - RNA, 23 nt, Human
ugggauuauaggcgccugcacca

SEQ ID NO: 1165492 - RNA, 21 nt, Human
uggguucaagcaauccuccca

SEQ ID NO: 1165493 - RNA, 24 nt, Human
ugguggcaugcgccuguaguccca

SEQ ID NO: 1165494 - RNA, 21 nt, Human
uuaagcccauaaaaacuacag

SEQ ID NO: 1165495 - RNA, 20 nt, Human
uuacccuuaacugugguuga

SEQ ID NO: 1165496 - RNA, 23 nt, Human
uuacugcagccuugaccucccag

SEQ ID NO: 1165497 - RNA, 24 nt, Human
uuacugcagccuugaccucccagg

SEQ ID NO: 1165498 - RNA, 21 nt, Human
uuagaguaaauguaagaggac

SEQ ID NO: 1165499 - RNA, 20 nt, Human
uuagccgggugugguggcau

SEQ ID NO: 1165500 - RNA, 22 nt, Human
uuagccgggugugguggcaugc

SEQ ID NO: 1165501 - RNA, 24 nt, Human
uucaagcaauccucccaccuuggc

SEQ ID NO: 1165502 - RNA, 21 nt, Human
uucacuguguuagccaggaug

SEQ ID NO: 1165503 - RNA, 19 nt, Human
uucaugccauucuccugcc

SEQ ID NO: 1165504 - RNA, 22 nt, Human
uucugauugauucuuuucccuu

SEQ ID NO: 1165505 - RNA, 24 nt, Human
uugaacccaggaggcggagguugc

SEQ ID NO: 1165506 - RNA, 24 nt, Human
uugcaaaaucucagcucacugcaa

SEQ ID NO: 1165507 - RNA, 18 nt, Human
uugcagugagccgagauc

SEQ ID NO: 1165508 - RNA, 19 nt, Human
uugcagugagccgagaucg

SEQ ID NO: 1165509 - RNA, 22 nt, Human
uugcagugagccgagaucgcgc

SEQ ID NO: 1165510 - RNA, 22 nt, Human
uuggaaagaaugaagucagaga

SEQ ID NO: 1165511 - RNA, 25 nt, Human
uugggaggccgaggcagguggauca

SEQ ID NO: 1165512 - RNA, 19 nt, Human
uuucacuguguuagccagg

SEQ ID NO: 1165513 - RNA, 22 nt, Human
uuugagguggagucuugcucug

SEQ ID NO: 1165514 - RNA, 21 nt, Human
uuugguuuuuuuuucaaccau

SEQ ID NO: 1165515 - RNA, 20 nt, Human
uuuuuguauuuuuaucagag

SEQ ID NO: 1165516 - RNA, 19 nt, Human
uuuuuuuucaaccauuuau

SEQ ID NO: 1165517 - RNA, 24 nt, Human
aaacuaccaaccugcaaaggauua

SEQ ID NO: 1165518 - RNA, 21 nt, Human
aaagacauacaggaggaaugg

SEQ ID NO: 1165519 - RNA, 24 nt, Human
aacaaaaucaugauugcugacacc

SEQ ID NO: 1165520 - RNA, 19 nt, Human
aaucaugauugcugacacc

SEQ ID NO: 1165521 - RNA, 20 nt, Human
acaaaaucaugauugcugac

SEQ ID NO: 1165522 - RNA, 26 nt, Human
acacagcccuccuccaugcuggcucu

SEQ ID NO: 1165523 - RNA, 22 nt, Human
accacacugcaagauuaaguag

SEQ ID NO: 1165524 - RNA, 21 nt, Human
auggagcuugagucuccucca

SEQ ID NO: 1165525 - RNA, 22 nt, Human
caaaaucaugauugcugacacc

SEQ ID NO: 1165526 - RNA, 23 nt, Human
caagauguuacaacaaacaccau

SEQ ID NO: 1165527 - RNA, 22 nt, Human
cacuccagaccauacguggcug

SEQ ID NO: 1165528 - RNA, 18 nt, Human
cagcaaaaugacuuaaca

SEQ ID NO: 1165529 - RNA, 20 nt, Human
cagcccuccuccaugcuggc

SEQ ID NO: 1165530 - RNA, 20 nt, Human
cagcccuccuccaugcuggc

SEQ ID NO: 1165531 - RNA, 23 nt, Human
cagcccuccuccaugcuggcucu

SEQ ID NO: 1165532 - RNA, 22 nt, Human
cagcuaggauuauaacuuuagc

SEQ ID NO: 1165533 - RNA, 25 nt, Human
caggcguccccucaucucuggcccu

SEQ ID NO: 1165534 - RNA, 18 nt, Human
ccacacuguucccacaug

SEQ ID NO: 1165535 - RNA, 24 nt, Human
ccauuuucaccaggcguccccuca

SEQ ID NO: 1165536 - RNA, 20 nt, Human
cuccaacacauuccaugagc

SEQ ID NO: 1165537 - RNA, 28 nt, Human
cuccuccaacacauuccaugagcuucaa

SEQ ID NO: 1165538 - RNA, 21 nt, Human
cucuggggcugagucuuccuu

SEQ ID NO: 1165539 - RNA, 21 nt, Human
cucuugacuaaacuucccaag

SEQ ID NO: 1165540 - RNA, 22 nt, Human
cugguggcagcaaaaugacuuu

SEQ ID NO: 1165541 - RNA, 18 nt, Human
gaucugugguguguccuu

SEQ ID NO: 1165542 - RNA, 23 nt, Human
gccacacuguucccacauggagc

SEQ ID NO: 1165543 - RNA, 21 nt, Human
gcucacacagcccuccuccau

SEQ ID NO: 1165544 - RNA, 20 nt, Human
uaccaagauguuacaacaaa

SEQ ID NO: 1165545 - RNA, 18 nt, Human
uauaguacaaagaagagc

SEQ ID NO: 1165546 - RNA, 26 nt, Human
uccaugcuggcucuugggccacacug

SEQ ID NO: 1165547 - RNA, 23 nt, Human
ucccaagaaucauuacaaauaag

SEQ ID NO: 1165548 - RNA, 23 nt, Human
ucugcucacacagcccuccucca

SEQ ID NO: 1165549 - RNA, 19 nt, Human
ugaaauacacaccaaaugg

SEQ ID NO: 1165550 - RNA, 21 nt, Human
ugaacaagcaaaacaaaauca

SEQ ID NO: 1165551 - RNA, 21 nt, Human
ugacuaaacuucccaagaauc

SEQ ID NO: 1165552 - RNA, 21 nt, Human
ugauuggugccucaugcaccu

SEQ ID NO: 1165553 - RNA, 18 nt, Human
ugcuuuaaaaagaggauc

SEQ ID NO: 1165554 - RNA, 22 nt, Human
uggaaauggguuuuacagccca

SEQ ID NO: 1165555 - RNA, 21 nt, Human
uggagcacuucauuguuaccc

SEQ ID NO: 1165556 - RNA, 23 nt, Human
ugugaacaagcaaaacaaaauca

SEQ ID NO: 1165557 - RNA, 18 nt, Human
uguuuuaaauuuauacuc

SEQ ID NO: 1165558 - RNA, 20 nt, Human
uuaauuuuacuuacuuaacc

SEQ ID NO: 1165559 - RNA, 21 nt, Human
uuagcauucuauagcagucug

SEQ ID NO: 1165560 - RNA, 20 nt, Human
uucaccaggcguccccucau

SEQ ID NO: 1165561 - RNA, 24 nt, Human
uucauaacagauguaaauauuugu

SEQ ID NO: 1165562 - RNA, 25 nt, Human
caaggaaaaucaaauaaaggacaga

SEQ ID NO: 1165563 - RNA, 19 nt, Human
cagacacugugccuaggau

SEQ ID NO: 1165564 - RNA, 21 nt, Human
cccaagcgaacagccuuaaag

SEQ ID NO: 1165565 - RNA, 18 nt, Human
cucuugaaaaaaacaguu

SEQ ID NO: 1165566 - RNA, 18 nt, Human
cuuaaaggugacaaggaa

SEQ ID NO: 1165567 - RNA, 23 nt, Human
uccaaaugaaaucccaagcgaac

SEQ ID NO: 1165568 - RNA, 19 nt, Human
ucuucaagagugugaugau

SEQ ID NO: 1165569 - RNA, 18 nt, Human
ugaaaaaaacaguugagg

SEQ ID NO: 1165570 - RNA, 25 nt, Human
acccuaacauuugaucccaaacaca

SEQ ID NO: 1165571 - RNA, 21 nt, Human
ccacaccaccacacuucuagu

SEQ ID NO: 1165572 - RNA, 21 nt, Human
cuaacauuugaucccaaacac

SEQ ID NO: 1165573 - RNA, 19 nt, Human
uaguaggucucauuuggua

SEQ ID NO: 1165574 - RNA, 19 nt, Human
uuccacaccaccacacuuc

SEQ ID NO: 1165575 - RNA, 21 nt, Human
uugaucccaaacacaugaaaa

SEQ ID NO: 1165576 - RNA, 21 nt, Human
uugcaggauuccacaccacca

SEQ ID NO: 1165577 - RNA, 26 nt, Human
uuuacccuaacauuugaucccaaaca

SEQ ID NO: 1165578 - RNA, 23 nt, Human
aaaaaaaaacaaaaaacaaaaaa

SEQ ID NO: 1165579 - RNA, 21 nt, Human
aaaaaaacaggcaggcuuaga

SEQ ID NO: 1165580 - RNA, 22 nt, Human
aaaaaacaggcaggcuuagaaa

SEQ ID NO: 1165581 - RNA, 21 nt, Human
aaaaaacuuaaucuugagcuc

SEQ ID NO: 1165582 - RNA, 26 nt, Human
aaacaaaaaacuuaaucuugagcucu

SEQ ID NO: 1165583 - RNA, 19 nt, Human
aacauaccuagaucauaua

SEQ ID NO: 1165584 - RNA, 19 nt, Human
aacauggaauaaagaaaaa

SEQ ID NO: 1165585 - RNA, 22 nt, Human
aagcauaugaauacaacagucu

SEQ ID NO: 1165586 - RNA, 22 nt, Human
aaggucaaaacaauauuucuuu

SEQ ID NO: 1165587 - RNA, 23 nt, Human
aaggugguuucuauguccaauua

SEQ ID NO: 1165588 - RNA, 25 nt, Human
aauguaggaguuccuccagguacca

SEQ ID NO: 1165589 - RNA, 23 nt, Human
acaaacauaaaagguaugucucc

SEQ ID NO: 1165590 - RNA, 23 nt, Human
acacacacacacacacacacaca

SEQ ID NO: 1165591 - RNA, 22 nt, Human
acacacacacacacacacacag

SEQ ID NO: 1165592 - RNA, 26 nt, Human
acacacacacacacgaaaagccuggu

SEQ ID NO: 1165593 - RNA, 20 nt, Human
acacacgaaaagccuguaac

SEQ ID NO: 1165594 - RNA, 25 nt, Human
acauaauugaugcugcauugaugcu

SEQ ID NO: 1165595 - RNA, 25 nt, Human
accaaauugccuccaaggucaaaac

SEQ ID NO: 1165596 - RNA, 22 nt, Human
accaucaguuucccuaguucug

SEQ ID NO: 1165597 - RNA, 21 nt, Human
acgacaauggauauaguugcc

SEQ ID NO: 1165598 - RNA, 22 nt, Human
acuaugauacugccacucugaa

SEQ ID NO: 1165599 - RNA, 22 nt, Human
acuuggcaacugauugcaacau

SEQ ID NO: 1165600 - RNA, 19 nt, Human
agacacccuccuucuggug

SEQ ID NO: 1165601 - RNA, 22 nt, Human
agaucauauaaauuugugaagg

SEQ ID NO: 1165602 - RNA, 21 nt, Human
aggaagacaagcauaugaaua

SEQ ID NO: 1165603 - RNA, 24 nt, Human
aggaaguggagcaauauuacaacg

SEQ ID NO: 1165604 - RNA, 20 nt, Human
aggcugucuggccuugggau

SEQ ID NO: 1165605 - RNA, 21 nt, Human
augaagaccaaauugccucca

SEQ ID NO: 1165606 - RNA, 22 nt, Human
augucucccuucaauauuuccu

SEQ ID NO: 1165607 - RNA, 24 nt, Human
auucccauauuuccaucuacuaug

SEQ ID NO: 1165608 - RNA, 23 nt, Human
caaacauaaaagguaugucuccc

SEQ ID NO: 1165609 - RNA, 21 nt, Human
caaacuccaugagcugauuaa

SEQ ID NO: 1165610 - RNA, 20 nt, Human
cacacacacacacacacaca

SEQ ID NO: 1165611 - RNA, 20 nt, Human
cacacacacacacacacaca

SEQ ID NO: 1165612 - RNA, 20 nt, Human
cacacacacacacacacaca

SEQ ID NO: 1165613 - RNA, 22 nt, Human
cacacacacacacacacacaca

SEQ ID NO: 1165614 - RNA, 26 nt, Human
cacacacacacacacacacacacacg

SEQ ID NO: 1165615 - RNA, 33 nt, Human
cacacacacacacacacacgaaaagccuguagu

SEQ ID NO: 1165616 - RNA, 25 nt, Human
cacacacacgaaaagccuguaaccu

SEQ ID NO: 1165617 - RNA, 21 nt, Human
cacaguuaaaauuauaguuaa

SEQ ID NO: 1165618 - RNA, 21 nt, Human
cagaaagaaaauugcugacau

SEQ ID NO: 1165619 - RNA, 24 nt, Human
cagcuaaaccuaaugaagaccaaa

SEQ ID NO: 1165620 - RNA, 19 nt, Human
ccagggaaauggaaaaaaa

SEQ ID NO: 1165621 - RNA, 24 nt, Human
ccagggaaauggaaaaaaaaacaa

SEQ ID NO: 1165622 - RNA, 20 nt, Human
ccaucaguuucccuaguucu

SEQ ID NO: 1165623 - RNA, 24 nt, Human
ccuacagcuaaaccuaaugaagac

SEQ ID NO: 1165624 - RNA, 18 nt, Human
cuaaaccuaaugaagacc

SEQ ID NO: 1165625 - RNA, 20 nt, Human
cugaaauaucuaguauagca

SEQ ID NO: 1165626 - RNA, 23 nt, Human
cugaaauaucuaguauagcacau

SEQ ID NO: 1165627 - RNA, 21 nt, Human
cuggccuugggauuccaggag

SEQ ID NO: 1165628 - RNA, 20 nt, Human
cuugagcucuaguucucgac

SEQ ID NO: 1165629 - RNA, 22 nt, Human
cuuuuggacauccaaacuccag

SEQ ID NO: 1165630 - RNA, 20 nt, Human
gaacaucaacuauccuacag

SEQ ID NO: 1165631 - RNA, 19 nt, Human
gaccuaagacacccuccuu

SEQ ID NO: 1165632 - RNA, 21 nt, Human
ggaccuaagacacccuccuuc

SEQ ID NO: 1165633 - RNA, 23 nt, Human
ggaguuccuccagguacucacuu

SEQ ID NO: 1165634 - RNA, 23 nt, Human
uaaaacagauccucuagccagga

SEQ ID NO: 1165635 - RNA, 21 nt, Human
uaaagaaaaagguuucuguuc

SEQ ID NO: 1165636 - RNA, 20 nt, Human
uaaugaacaucaacuauccu

SEQ ID NO: 1165637 - RNA, 24 nt, Human
uacaugaacacucagcuauguaua

SEQ ID NO: 1165638 - RNA, 18 nt, Human
uacuuggguuguaaggaa

SEQ ID NO: 1165639 - RNA, 21 nt, Human
uagcaauaauugugccucagg

SEQ ID NO: 1165640 - RNA, 18 nt, Human
uaggaguuccuccaggua

SEQ ID NO: 1165641 - RNA, 18 nt, Human
uaguucagauggaucuua

SEQ ID NO: 1165642 - RNA, 18 nt, Human
uaguucagauggaucuua

SEQ ID NO: 1165643 - RNA, 22 nt, Human
uaguucagauggaucuuaccag

SEQ ID NO: 1165644 - RNA, 19 nt, Human
uauuuaauagagggacacc

SEQ ID NO: 1165645 - RNA, 21 nt, Human
ucaaaacacacacacacacac

SEQ ID NO: 1165646 - RNA, 31 nt, Human; identical to SEQ ID NO: 806593

SEQ ID NO: 1165647 - RNA, 18 nt, Human
ucacuggggucuauuguu

SEQ ID NO: 1165648 - RNA, 20 nt, Human
ucagaaagaaaauugcugac

SEQ ID NO: 1165649 - RNA, 22 nt, Human
uccaagcuagcugcccaucauc

SEQ ID NO: 1165650 - RNA, 21 nt, Human
uccacauuuucucuauuuuuc

SEQ ID NO: 1165651 - RNA, 25 nt, Human
ucucacgacaauggauauaguugcc

SEQ ID NO: 1165652 - RNA, 26 nt, Human
ucucacgacaauggauauaguugccu

SEQ ID NO: 1165653 - RNA, 24 nt, Human
ucugaaaagcugucuacauccaaa

SEQ ID NO: 1165654 - RNA, 21 nt, Human
ucuuucuuuuaucaauucucc

SEQ ID NO: 1165655 - RNA, 24 nt, Human
ugaaaacauaccuagaucauauaa

SEQ ID NO: 1165656 - RNA, 24 nt, Human
ugaaagccuaaaauguaggaguuc

SEQ ID NO: 1165657 - RNA, 25 nt, Human
ugaaauaucuaguauagcacauaau

SEQ ID NO: 1165658 - RNA, 20 nt, Human
ugcuaauugaauuacacuuc

SEQ ID NO: 1165659 - RNA, 21 nt, Human
uggaauaaagaaaaagguuuc

SEQ ID NO: 1165660 - RNA, 27 nt, Human
ugggauguaccgaaaaaaggauguuuu

SEQ ID NO: 1165661 - RNA, 25 nt, Human
uguucccagggaaauggaaaaaaaa

SEQ ID NO: 1165662 - RNA, 19 nt, Human
uguuucaauuccauuuuuc

SEQ ID NO: 1165663 - RNA, 21 nt, Human
uuaguauuaaccaauaauuua

SEQ ID NO: 1165664 - RNA, 20 nt, Human
uucaauauuuccucuuaaug

SEQ ID NO: 1165665 - RNA, 19 nt, Human
uucaauuuccuuucuuuuc

SEQ ID NO: 1165666 - RNA, 33 nt, Human
uucucaaaacacacacacacacacacacacagu

SEQ ID NO: 1165667 - RNA, 22 nt, Human
uucuguucaucucuauacuuca

SEQ ID NO: 1165668 - RNA, 23 nt, Human
aaaaccuucccaucccaguucaa

SEQ ID NO: 1165669 - RNA, 24 nt, Human
aaagugcugagauuacaggcguga

SEQ ID NO: 1165670 - RNA, 21 nt, Human
aagcaagugucuugggugugg

SEQ ID NO: 1165671 - RNA, 24 nt, Human
aaguagcuggaauuacuggcaugc

SEQ ID NO: 1165672 - RNA, 26 nt, Human
aagugcugagauuacaggcgugagcc

SEQ ID NO: 1165673 - RNA, 18 nt, Human
aauuacuggcaugcacca

SEQ ID NO: 1165674 - RNA, 19 nt, Human
acaaaccccaucccaacac

SEQ ID NO: 1165675 - RNA, 24 nt, Human
acaccuucagcuucagaaugaucc

SEQ ID NO: 1165676 - RNA, 18 nt, Human
accacacacacacgaaca

SEQ ID NO: 1165677 - RNA, 22 nt, Human
accacacacacacgaacacaca

SEQ ID NO: 1165678 - RNA, 26 nt, Human
accacacacacacgaacacacacuug

SEQ ID NO: 1165679 - RNA, 25 nt, Human
accauguugcccaggcugaucucaa

SEQ ID NO: 1165680 - RNA, 20 nt, Human
accuuggaggccaccugggg

SEQ ID NO: 1165681 - RNA, 18 nt, Human
acgagguuucaccauguu

SEQ ID NO: 1165682 - RNA, 19 nt, Human
acgagguuucaccauguug

SEQ ID NO: 1165683 - RNA, 24 nt, Human
acgagguuucaccauguugcccag

SEQ ID NO: 1165684 - RNA, 21 nt, Human
acuccacuccugcugaaacag

SEQ ID NO: 1165685 - RNA, 19 nt, Human
agagggagaaacccaguuc

SEQ ID NO: 1165686 - RNA, 24 nt, Human
agaucuguugucgccguggguucu

SEQ ID NO: 1165687 - RNA, 20 nt, Human
agauuacaggcgugagcccu

SEQ ID NO: 1165688 - RNA, 20 nt, Human
agcaaggaaagcagacagcu

SEQ ID NO: 1165689 - RNA, 21 nt, Human
aggaaaaaugaagaggaaagc

SEQ ID NO: 1165690 - RNA, 19 nt, Human
aggagcuggccaggggagc

SEQ ID NO: 1165691 - RNA, 25 nt, Human
aggcuggagugcaguggggcuaucu

SEQ ID NO: 1165692 - RNA, 20 nt, Human
aggcugguuucaaacuuggc

SEQ ID NO: 1165693 - RNA, 24 nt, Human
agggauucuccugccucaaccucc

SEQ ID NO: 1165694 - RNA, 22 nt, Human
agguuucaccauguugcccagg

SEQ ID NO: 1165695 - RNA, 22 nt, Human
aguagagacgagguuucaccau

SEQ ID NO: 1165696 - RNA, 24 nt, Human
aguaggacaucagcgaagaucugu

SEQ ID NO: 1165697 - RNA, 24 nt, Human
agugauaugccugccuuggccucc

SEQ ID NO: 1165698 - RNA, 21 nt, Human
aguuauagaauuuuaauaggg

SEQ ID NO: 1165699 - RNA, 23 nt, Human
auuaaauuuacaaaccccauccc

SEQ ID NO: 1165700 - RNA, 21 nt, Human
auucacaacacuguacucaac

SEQ ID NO: 1165701 - RNA, 24 nt, Human
auuuuuauauuuuuaguagagacg

SEQ ID NO: 1165702 - RNA, 24 nt, Human
caaagugcugagauuacaggcgug

SEQ ID NO: 1165703 - RNA, 21 nt, Human
caacauuuuguuauuccccag

SEQ ID NO: 1165704 - RNA, 20 nt, Human
caaccuguaccucccagguu

SEQ ID NO: 1165705 - RNA, 24 nt, Human
caaccuguaccucccagguucaag

SEQ ID NO: 1165706 - RNA, 19 nt, Human
caagugauaugccugcccc

SEQ ID NO: 1165707 - RNA, 22 nt, Human
caagugauaugccugccuuggc

SEQ ID NO: 1165708 - RNA, 27 nt, Human
cacacacacaccacacacacacgaaca

SEQ ID NO: 1165709 - RNA, 18 nt, Human
cacacacaccacacacac

SEQ ID NO: 1165710 - RNA, 22 nt, Human
caccacacacacacgaacacac

SEQ ID NO: 1165711 - RNA, 22 nt, Human
caccaccaugcccugcuaauuu

SEQ ID NO: 1165712 - RNA, 24 nt, Human
caccauguugcccaggcugaucuc

SEQ ID NO: 1165713 - RNA, 25 nt, Human
cacccaggcuggagugcaguggggc

SEQ ID NO: 1165714 - RNA, 26 nt, Human
caccuucagcuucagaaugauccuga

SEQ ID NO: 1165715 - RNA, 20 nt, Human
cacuagaauucuuccaccaa

SEQ ID NO: 1165716 - RNA, 23 nt, Human
cacuccugcugaaacaggaauug

SEQ ID NO: 1165717 - RNA, 21 nt, Human
cacugcaaccuguaccuccca

SEQ ID NO: 1165718 - RNA, 19 nt, Human
cagaaugauccugauuuaa

SEQ ID NO: 1165719 - RNA, 22 nt, Human
cagcuuagggucgaagccuagg

SEQ ID NO: 1165720 - RNA, 19 nt, Human
cagguucaagggauucucc

SEQ ID NO: 1165721 - RNA, 19 nt, Human
caguucuaggccuccuccc

SEQ ID NO: 1165722 - RNA, 21 nt, Human
caucccaacaccgugcugagc

SEQ ID NO: 1165723 - RNA, 23 nt, Human
cauccccauccugagagcuagcg

SEQ ID NO: 1165724 - RNA, 23 nt, Human
cauguugcccaggcugaucucaa

SEQ ID NO: 1165725 - RNA, 24 nt, Human
cauguugcccaggcugaucucaaa

SEQ ID NO: 1165726 - RNA, 20 nt, Human
ccaaagugcugagauuacag

SEQ ID NO: 1165727 - RNA, 22 nt, Human
ccaaagugcugagauuacaggc

SEQ ID NO: 1165728 - RNA, 22 nt, Human
ccaaagugcugagauuacaggc

SEQ ID NO: 1165729 - RNA, 24 nt, Human
ccaaagugcugagauuacaggcgu

SEQ ID NO: 1165730 - RNA, 21 nt, Human
ccaggccccucccccaggagc

SEQ ID NO: 1165731 - RNA, 20 nt, Human
cccaaguagcuggaauuacu

SEQ ID NO: 1165732 - RNA, 20 nt, Human
cccacuccacuccugcugaa

SEQ ID NO: 1165733 - RNA, 26 nt, Human
cccaggcugaucucaaaaacguccgc

SEQ ID NO: 1165734 - RNA, 23 nt, Human
cccccaggagcuggccaggggag

SEQ ID NO: 1165735 - RNA, 24 nt, Human
ccucccagguucaagggauucucc

SEQ ID NO: 1165736 - RNA, 22 nt, Human
ccucggcucaagugauaugccu

SEQ ID NO: 1165737 - RNA, 25 nt, Human
ccucugucacccaggcuggagugca

SEQ ID NO: 1165738 - RNA, 22 nt, Human
ccugccuuggccucccaaagug

SEQ ID NO: 1165739 - RNA, 19 nt, Human
ccuggggucagcacucagg

SEQ ID NO: 1165740 - RNA, 21 nt, Human
ccuugugcccagccaccuuuc

SEQ ID NO: 1165741 - RNA, 24 nt, Human
ccuugugcccagccaccuuucuua

SEQ ID NO: 1165742 - RNA, 24 nt, Human
cgagguuucaccauguugcccagg

SEQ ID NO: 1165743 - RNA, 20 nt, Human
cucaagugauaugccugccu

SEQ ID NO: 1165744 - RNA, 19 nt, Human
cucacacacacaccacaca

SEQ ID NO: 1165745 - RNA, 25 nt, Human
cucacacacacaccacacacacacg

SEQ ID NO: 1165746 - RNA, 24 nt, Human
cucacugcaaccuguaccucccag

SEQ ID NO: 1165747 - RNA, 19 nt, Human
cucaugccucuccuucugg

SEQ ID NO: 1165748 - RNA, 21 nt, Human
cucccaaagugcugagauuac

SEQ ID NO: 1165749 - RNA, 24 nt, Human
cucccucugucacccaggcuggag

SEQ ID NO: 1165750 - RNA, 22 nt, Human
cuccuccccaacauccccaucc

SEQ ID NO: 1165751 - RNA, 20 nt, Human
cucugucacccaggcuggag

SEQ ID NO: 1165752 - RNA, 24 nt, Human
cugcaaccuguaccucccagguuc

SEQ ID NO: 1165753 - RNA, 23 nt, Human
cugccuuggccucccaaagugcu

SEQ ID NO: 1165754 - RNA, 24 nt, Human
cuucacaauuccauaugcuucgcu

SEQ ID NO: 1165755 - RNA, 18 nt, Human
cuuccccugccuucuugg

SEQ ID NO: 1165756 - RNA, 18 nt, Human
gaaacaggaauucaggag

SEQ ID NO: 1165757 - RNA, 18 nt, Human
gacacaguaggacaucag

SEQ ID NO: 1165758 - RNA, 21 nt, Human
gacacaguaggacaucagcga

SEQ ID NO: 1165759 - RNA, 21 nt, Human
gagauggagucucccucuguc

SEQ ID NO: 1165760 - RNA, 19 nt, Human
gagcauuuaaagucagaga

SEQ ID NO: 1165761 - RNA, 21 nt, Human
gagcauuuaaagucagagaaa

SEQ ID NO: 1165762 - RNA, 22 nt, Human
gaucuuuuugcuuuuuuucccu

SEQ ID NO: 1165763 - RNA, 24 nt, Human
gauuacaggcgugagcccuugugc

SEQ ID NO: 1165764 - RNA, 21 nt, Human
gcccacuccacuccugcugaa

SEQ ID NO: 1165765 - RNA, 22 nt, Human
gcccugcuaauuuuuauauuuu

SEQ ID NO: 1165766 - RNA, 20 nt, Human
gccucaaccucccaaguagc

SEQ ID NO: 1165767 - RNA, 22 nt, Human
gccuccuccccaacauccccau

SEQ ID NO: 1165768 - RNA, 22 nt, Human
gccuuggccucccaaagugcug

SEQ ID NO: 1165769 - RNA, 19 nt, Human
ggcgggugacacuggacuc

SEQ ID NO: 1165770 - RNA, 18 nt, Human
gggagugaccacuggggc

SEQ ID NO: 1165771 - RNA, 18 nt, Human
gggugacagagggaggaa

SEQ ID NO: 1165772 - RNA, 19 nt, Human
gucugaaugccauguggga

SEQ ID NO: 1165773 - RNA, 19 nt, Human
gugaccaggccccuccccc

SEQ ID NO: 1165774 - RNA, 24 nt, Human
guuucaccauguugcccaggcuga

SEQ ID NO: 1165775 - RNA, 22 nt, Human
uaaaaugcacauuccugggccc

SEQ ID NO: 1165776 - RNA, 23 nt, Human
uaaaaugcacauuccugggccca

SEQ ID NO: 1165777 - RNA, 26 nt, Human
uaaaaugcacauuccugggcccacuc

SEQ ID NO: 1165778 - RNA, 20 nt, Human
uaaauggcccugacguccaa

SEQ ID NO: 1165779 - RNA, 18 nt, Human
uaacaaagucaaaaaaaa

SEQ ID NO: 1165780 - RNA, 22 nt, Human
uaacaaagucaaaaaaaaucuu

SEQ ID NO: 1165781 - RNA, 20 nt, Human
uaagaaacucuuuucuaucu

SEQ ID NO: 1165782 - RNA, 24 nt, Human
uaauuuuuauauuuuuaguagaga

SEQ ID NO: 1165783 - RNA, 21 nt, Human
uacacugaucuuuaguuuuau

SEQ ID NO: 1165784 - RNA, 24 nt, Human
uacuggcaugcaccaccaugcccu

SEQ ID NO: 1165785 - RNA, 22 nt, Human
uagagacgagguuucaccaugu

SEQ ID NO: 1165786 - RNA, 25 nt, Human
uaggagcauuuaaagucagagaaaa

SEQ ID NO: 1165787 - RNA, 23 nt, Human
uaggccuccuccccaacaucccc

SEQ ID NO: 1165788 - RNA, 24 nt, Human
uaguagagacgagguuucaccaug

SEQ ID NO: 1165789 - RNA, 25 nt, Human
uaguagagacgagguuucaccaugu

SEQ ID NO: 1165790 - RNA, 18 nt, Human
uauuccccaguauuuuau

SEQ ID NO: 1165791 - RNA, 22 nt, Human
ucacacacacaccacacacaca

SEQ ID NO: 1165792 - RNA, 26 nt, Human
ucacacacacaccacacacacacgaa

SEQ ID NO: 1165793 - RNA, 23 nt, Human
ucacccaggcuggagugcagugg

SEQ ID NO: 1165794 - RNA, 24 nt, Human
ucacugcaaccuguaccucccagg

SEQ ID NO: 1165795 - RNA, 23 nt, Human
ucaggucucauucacaacacugu

SEQ ID NO: 1165796 - RNA, 20 nt, Human
ucaguccauguaaauuaggc

SEQ ID NO: 1165797 - RNA, 24 nt, Human
ucccaaagugcugagauuacaggc

SEQ ID NO: 1165798 - RNA, 20 nt, Human
ucccagagguccccucccuu

SEQ ID NO: 1165799 - RNA, 24 nt, Human
ucccagagguccccucccuuggug

SEQ ID NO: 1165800 - RNA, 21 nt, Human
ucccagguucaagggauucuc

SEQ ID NO: 1165801 - RNA, 24 nt, Human
ucccagguucaagggauucuccug

SEQ ID NO: 1165802 - RNA, 27 nt, Human
uccccucccuuggugagcagaagcugg

SEQ ID NO: 1165803 - RNA, 20 nt, Human
ucccucugucacccaggcug

SEQ ID NO: 1165804 - RNA, 24 nt, Human
ucccucugucacccaggcuggagu

SEQ ID NO: 1165805 - RNA, 22 nt, Human
ucccuggaaaggucuccugggu

SEQ ID NO: 1165806 - RNA, 24 nt, Human
ucccuuggugagcagaagcaaugc

SEQ ID NO: 1165807 - RNA, 19 nt, Human
uccugggcccacuccacuc

SEQ ID NO: 1165808 - RNA, 29 nt, Human
ucucacacacacaccacacacacacgaaa

SEQ ID NO: 1165809 - RNA, 23 nt, Human
ucucccucugucacccaggcugg

SEQ ID NO: 1165810 - RNA, 24 nt, Human
ucucccucugucacccaggcugga

SEQ ID NO: 1165811 - RNA, 26 nt, Human
ucuccugccucaaccucccaaguagc

SEQ ID NO: 1165812 - RNA, 29 nt, Human
ucucuaagagucuucucccgagggugagg

SEQ ID NO: 1165813 - RNA, 27 nt, Human
ucugcacaaccagaauguguucacagu

SEQ ID NO: 1165814 - RNA, 24 nt, Human
ucugucacccaggcuggagugcag

SEQ ID NO: 1165815 - RNA, 21 nt, Human
ucuuccaccaauacaucucug

SEQ ID NO: 1165816 - RNA, 19 nt, Human
ucuugagcccacgaugcug

SEQ ID NO: 1165817 - RNA, 18 nt, Human
ucuuguguauacuaaacc

SEQ ID NO: 1165818 - RNA, 20 nt, Human
ugaccacuggggcuuccccu

SEQ ID NO: 1165819 - RNA, 22 nt, Human
ugaccaggccccucccccagga

SEQ ID NO: 1165820 - RNA, 24 nt, Human
ugaccaggccccucccccaggagc

SEQ ID NO: 1165821 - RNA, 25 nt, Human
ugaccaggccccucccccaggagcu

SEQ ID NO: 1165822 - RNA, 19 nt, Human
ugagauuacaggcgugagc

SEQ ID NO: 1165823 - RNA, 20 nt, Human
ugagauuacaggcgugagcc

SEQ ID NO: 1165824 - RNA, 21 nt, Human
ugagauuacaggcgugagccc

SEQ ID NO: 1165825 - RNA, 22 nt, Human
ugagauuacaggcgugagcccu

SEQ ID NO: 1165826 - RNA, 23 nt, Human
ugagauuacaggcgugagcccuu

SEQ ID NO: 1165827 - RNA, 19 nt, Human
ugagcagaagcaaugcuca

SEQ ID NO: 1165828 - RNA, 21 nt, Human
ugagcagaagcaaugcucacc

SEQ ID NO: 1165829 - RNA, 23 nt, Human
ugccaugugggagugaccacugg

SEQ ID NO: 1165830 - RNA, 22 nt, Human
ugcccaggcugaucucaaaaac

SEQ ID NO: 1165831 - RNA, 24 nt, Human
ugccucaaccucccaaguagcugg

SEQ ID NO: 1165832 - RNA, 18 nt, Human
ugccugccuuggccuccc

SEQ ID NO: 1165833 - RNA, 20 nt, Human
ugcugagauuacaggcguga

SEQ ID NO: 1165834 - RNA, 24 nt, Human
uggaauuacuggcaugcaccacca

SEQ ID NO: 1165835 - RNA, 20 nt, Human
uggagugcaguggggcuauc

SEQ ID NO: 1165836 - RNA, 23 nt, Human
uggagugcaguggggcuaucugg

SEQ ID NO: 1165837 - RNA, 22 nt, Human
ugggugacagagggaggaaaaa

SEQ ID NO: 1165838 - RNA, 20 nt, Human
uggugagcagaagcaaugcu

SEQ ID NO: 1165839 - RNA, 22 nt, Human
uggugaucuuuuugcuuuuuuu

SEQ ID NO: 1165840 - RNA, 21 nt, Human
uguaggcucuggcagcucacg

SEQ ID NO: 1165841 - RNA, 24 nt, Human
uuaaaaccuucccaucccaguuca

SEQ ID NO: 1165842 - RNA, 24 nt, Human
uuaguagagacgagguuucaccau

SEQ ID NO: 1165843 - RNA, 22 nt, Human
uucaggaggggguggcugagga

SEQ ID NO: 1165844 - RNA, 21 nt, Human
uuccugggcccacuccacucc

SEQ ID NO: 1165845 - RNA, 18 nt, Human
uucuaggccuccucccca

SEQ ID NO: 1165846 - RNA, 21 nt, Human
uucucuagcaagaagucauuu

SEQ ID NO: 1165847 - RNA, 18 nt, Human
uuggccucccaaagugcu

SEQ ID NO: 1165848 - RNA, 24 nt, Human
uuuaaaaugcacauuccugggccc

SEQ ID NO: 1165849 - RNA, 21 nt, Human
uuucaccauguugcccaggcu

SEQ ID NO: 1165850 - RNA, 24 nt, Human
uuuuuaguagagacgagguuucac

SEQ ID NO: 1165851 - RNA, 20 nt, Human
uuuuuauauuuuuaguagag

SEQ ID NO: 1165852 - RNA, 25 nt, Human
aaaacagcagaaaauccccagaaga

SEQ ID NO: 1165853 - RNA, 24 nt, Human
aaaaguuuuguccuucuuaggagg

SEQ ID NO: 1165854 - RNA, 23 nt, Human
aaaauacaacauuaaaacagguu

SEQ ID NO: 1165855 - RNA, 22 nt, Human
aaacaaaugauacagaaaucuu

SEQ ID NO: 1165856 - RNA, 22 nt, Human
aaagcuaacuccuuuuaaaaca

SEQ ID NO: 1165857 - RNA, 22 nt, Human
aaguggauauguggguggauga

SEQ ID NO: 1165858 - RNA, 18 nt, Human
acagcagaaaauccccag

SEQ ID NO: 1165859 - RNA, 23 nt, Human
accaaaacagcagaaaaucccca

SEQ ID NO: 1165860 - RNA, 26 nt, Human
accaaaacagcagaaaauccccagaa

SEQ ID NO: 1165861 - RNA, 23 nt, Human
agcagaaaauccccagaagagga

SEQ ID NO: 1165862 - RNA, 23 nt, Human
aggcaugguccccagaaucaggg

SEQ ID NO: 1165863 - RNA, 20 nt, Human
aucauauuaacaagugcccu

SEQ ID NO: 1165864 - RNA, 18 nt, Human
auuucaccugggugcagg

SEQ ID NO: 1165865 - RNA, 24 nt, Human
caaaagcaagccaggaguccaaga

SEQ ID NO: 1165866 - RNA, 25 nt, Human
cacacacugaggggcuaagagggga

SEQ ID NO: 1165867 - RNA, 19 nt, Human
caccauuacauauguaucu

SEQ ID NO: 1165868 - RNA, 19 nt, Human
cagguuaccaaaacagcag

SEQ ID NO: 1165869 - RNA, 26 nt, Human
cauaaaucacaugagauaauugccuc

SEQ ID NO: 1165870 - RNA, 21 nt, Human
cauccauccuuuaaugucucc

SEQ ID NO: 1165871 - RNA, 20 nt, Human
ccagaagaggaaacugcuga

SEQ ID NO: 1165872 - RNA, 23 nt, Human
ccagaagaggaaacugcugagga

SEQ ID NO: 1165873 - RNA, 26 nt, Human
ccagcaauaaaccugugagguacccc

SEQ ID NO: 1165874 - RNA, 19 nt, Human
ccaggaguccaagagggga

SEQ ID NO: 1165875 - RNA, 18 nt, Human
ccgggcccuugcucuucu

SEQ ID NO: 1165876 - RNA, 21 nt, Human
ccgggcccuugcucuucuuuu

SEQ ID NO: 1165877 - RNA, 19 nt, Human
ccugggugcaggugggcug

SEQ ID NO: 1165878 - RNA, 19 nt, Human
ccugggugcaggugggcug

SEQ ID NO: 1165879 - RNA, 21 nt, Human
ccugggugcaggugggcuggu

SEQ ID NO: 1165880 - RNA, 23 nt, Human
cuccagccgggcccuugcucuuc

SEQ ID NO: 1165881 - RNA, 21 nt, Human
guggguggaugaugaaaugua

SEQ ID NO: 1165882 - RNA, 23 nt, Human
uaaaucacaugagauaauugccu

SEQ ID NO: 1165883 - RNA, 22 nt, Human
uaagaggaguuuucagucagua

SEQ ID NO: 1165884 - RNA, 21 nt, Human
uaagaggggagggggacacca

SEQ ID NO: 1165885 - RNA, 19 nt, Human
uaccaaaacagcagaaaaa

SEQ ID NO: 1165886 - RNA, 23 nt, Human
uauuuuuuacauuuuuacaucuc

SEQ ID NO: 1165887 - RNA, 18 nt, Human
uccagaaagucccagugg

SEQ ID NO: 1165888 - RNA, 20 nt, Human
ucugaaagcaauacuuaugg

SEQ ID NO: 1165889 - RNA, 27 nt, Human
ucuguagccaaaagcaagccggggucc

SEQ ID NO: 1165890 - RNA, 18 nt, Human
ugccacacacuauagaga

SEQ ID NO: 1165891 - RNA, 20 nt, Human
uggagagccauucugggaaa

SEQ ID NO: 1165892 - RNA, 21 nt, Human
uggauaaguggauaugugggu

SEQ ID NO: 1165893 - RNA, 18 nt, Human
uggggaaaugaaggucug

SEQ ID NO: 1165894 - RNA, 20 nt, Human
uggggaaaugaaggucugaa

SEQ ID NO: 1165895 - RNA, 21 nt, Human
uguggguggaugaugaaaugu

SEQ ID NO: 1165896 - RNA, 24 nt, Human
uucaccugggugcaggugggcucc

SEQ ID NO: 1165897 - RNA, 25 nt, Human
uugaauggauaaguggauauguggg

SEQ ID NO: 1165898 - RNA, 19 nt, Human
uugauaccagcaauaaacc

SEQ ID NO: 1165899 - RNA, 18 nt, Human
uuguccuucuuaggaggu

SEQ ID NO: 1165900 - RNA, 21 nt, Human
uuuguccuucuuaggagguau

SEQ ID NO: 1165901 - RNA, 23 nt, Human
aaagaaagaaacucuauagagaa

SEQ ID NO: 1165902 - RNA, 24 nt, Human
aagaaacucuauagagaacaccac

SEQ ID NO: 1165903 - RNA, 21 nt, Human
aagaaagaaacucuauagaga

SEQ ID NO: 1165904 - RNA, 22 nt, Human
aagaaagaaacucuauagagaa

SEQ ID NO: 1165905 - RNA, 21 nt, Human
auccaaauuaaaaagaaagaa

SEQ ID NO: 1165906 - RNA, 22 nt, Human
caccacauggaccaaacuuggu

SEQ ID NO: 1165907 - RNA, 22 nt, Human
uaaagcagaagcaauccuuuca

SEQ ID NO: 1165908 - RNA, 24 nt, Human
uuaaagcagaagcaauccuuucau

SEQ ID NO: 1165909 - RNA, 22 nt, Human
aaaaacaaugucauuuaaaaac

SEQ ID NO: 1165910 - RNA, 24 nt, Human
aaaaacgaacccaaccaaaaaaaa

SEQ ID NO: 1165911 - RNA, 27 nt, Human
aaaaagacagcaggccuagggccucaa

SEQ ID NO: 1165912 - RNA, 18 nt, Human
aaacauaguuagaaaaug

SEQ ID NO: 1165913 - RNA, 25 nt, Human
aaagccguggcuggcagucucacca

SEQ ID NO: 1165914 - RNA, 21 nt, Human
aacauuguuguauuugcuuuu

SEQ ID NO: 1165915 - RNA, 18 nt, Human
aacccuaugccagucccu

SEQ ID NO: 1165916 - RNA, 18 nt, Human
aaccucugccugcuuccc

SEQ ID NO: 1165917 - RNA, 23 nt, Human
aagaaaaaaaaaaacaaaauauu

SEQ ID NO: 1165918 - RNA, 23 nt, Human
aagacagcaggccuagggccuca

SEQ ID NO: 1165919 - RNA, 20 nt, Human
aagacagggugaccccugag

SEQ ID NO: 1165920 - RNA, 21 nt, Human
aagcagaauuuggcaguugga

SEQ ID NO: 1165921 - RNA, 24 nt, Human
aagcccaugggcacagcucugugc

SEQ ID NO: 1165922 - RNA, 22 nt, Human
aagcuaacacagucauagaaaa

SEQ ID NO: 1165923 - RNA, 19 nt, Human
aaggaccuuccagccccaa

SEQ ID NO: 1165924 - RNA, 19 nt, Human
aaggaugggcucagaggca

SEQ ID NO: 1165925 - RNA, 18 nt, Human
aagggcagccagcccaca

SEQ ID NO: 1165926 - RNA, 23 nt, Human
aaguggcagcagugaccuaggca

SEQ ID NO: 1165927 - RNA, 24 nt, Human
aaguggcagcagugaccuaggcag

SEQ ID NO: 1165928 - RNA, 24 nt, Human
aauccagaagaucucugcugucac

SEQ ID NO: 1165929 - RNA, 19 nt, Human
acacagccucccucccugc

SEQ ID NO: 1165930 - RNA, 18 nt, Human
acagagaaaacauauaca

SEQ ID NO: 1165931 - RNA, 19 nt, Human
acagagaaaacauauacaa

SEQ ID NO: 1165932 - RNA, 22 nt, Human
acagcugucaagccaggaaccc

SEQ ID NO: 1165933 - RNA, 20 nt, Human
accaagaaaaaaaaaaacaa

SEQ ID NO: 1165934 - RNA, 22 nt, Human
accaggaagcggccuccccagg

SEQ ID NO: 1165935 - RNA, 24 nt, Human
accccacaaaacccuaugccaguc

SEQ ID NO: 1165936 - RNA, 24 nt, Human
acccccucuccccacucuccccac

SEQ ID NO: 1165937 - RNA, 18 nt, Human
agaaaaaaaaaaacaaaa

SEQ ID NO: 1165938 - RNA, 23 nt, Human
agaaaaaaaaaaacaaaauauua

SEQ ID NO: 1165939 - RNA, 21 nt, Human
agaaaacccucuccucccuca

SEQ ID NO: 1165940 - RNA, 28 nt, Human
agaaaucagcccagagaucccacugucu

SEQ ID NO: 1165941 - RNA, 23 nt, Human
agaaguggcagcagugaccuagg

SEQ ID NO: 1165942 - RNA, 27 nt, Human
agaauagacgauggagccaccugaaca

SEQ ID NO: 1165943 - RNA, 20 nt, Human
agacaagccucuccagaaag

SEQ ID NO: 1165944 - RNA, 28 nt, Human
agacagcaggccuagggccucaaaaaca

SEQ ID NO: 1165945 - RNA, 20 nt, Human
agaccccuggccugccucag

SEQ ID NO: 1165946 - RNA, 23 nt, Human
agaccccuggccugccucagucu

SEQ ID NO: 1165947 - RNA, 19 nt, Human
agacuuggaacauguggca

SEQ ID NO: 1165948 - RNA, 23 nt, Human
agagagagaaaaagaauguggca

SEQ ID NO: 1165949 - RNA, 21 nt, Human
agagaggccuccaggccuaga

SEQ ID NO: 1165950 - RNA, 23 nt, Human
agagaucccacugucuacaaggg

SEQ ID NO: 1165951 - RNA, 23 nt, Human
agaggagcacgaugggacuugga

SEQ ID NO: 1165952 - RNA, 20 nt, Human
agaugcuggggagugggcau

SEQ ID NO: 1165953 - RNA, 26 nt, Human
agcagaccccaaccagaaaucagccc

SEQ ID NO: 1165954 - RNA, 24 nt, Human
agcaggagggaugaacuucuuagg

SEQ ID NO: 1165955 - RNA, 23 nt, Human
agccacggcacuggggagggccc

SEQ ID NO: 1165956 - RNA, 22 nt, Human
agcccaccucuccugccuucca

SEQ ID NO: 1165957 - RNA, 23 nt, Human
agcuggccccuuggaagagccug

SEQ ID NO: 1165958 - RNA, 19 nt, Human
aggaagauggucaggcagc

SEQ ID NO: 1165959 - RNA, 18 nt, Human
aggagaugcaggcugaag

SEQ ID NO: 1165960 - RNA, 21 nt, Human
aggagggaugaacuucuuagg

SEQ ID NO: 1165961 - RNA, 22 nt, Human
aggcagaagugaagcugucaag

SEQ ID NO: 1165962 - RNA, 24 nt, Human
agguggcuaagcaaagccguggcu

SEQ ID NO: 1165963 - RNA, 24 nt, Human
aguaagagcaggagggaugaacuu

SEQ ID NO: 1165964 - RNA, 18 nt, Human
agugagggacagaaaaga

SEQ ID NO: 1165965 - RNA, 18 nt, Human
aguggagcuccugcccua

SEQ ID NO: 1165966 - RNA, 22 nt, Human
auagaaaacccucuccucccuc

SEQ ID NO: 1165967 - RNA, 20 nt, Human
auagaauauauauauauaca

SEQ ID NO: 1165968 - RNA, 19 nt, Human
auauauauauauauauaua

SEQ ID NO: 1165969 - RNA, 19 nt, Human
auauauauauauauauaua

SEQ ID NO: 1165970 - RNA, 19 nt, Human
auauauauauauauauaua

SEQ ID NO: 1165971 - RNA, 19 nt, Human
auauauauauauauauaua

SEQ ID NO: 1165972 - RNA, 19 nt, Human
aucauaucccagggggaag

SEQ ID NO: 1165973 - RNA, 20 nt, Human
augcuagagucuucugaaca

SEQ ID NO: 1165974 - RNA, 23 nt, Human
auggucaggcagcuacuaaaugc

SEQ ID NO: 1165975 - RNA, 24 nt, Human
auguacuuuuaaauuaggacagag

SEQ ID NO: 1165976 - RNA, 24 nt, Human
auguagccuaaauuauccuugaaa

SEQ ID NO: 1165977 - RNA, 18 nt, Human
caaaaccagacacauaag

SEQ ID NO: 1165978 - RNA, 21 nt, Human
caacccaaaacggcugguucg

SEQ ID NO: 1165979 - RNA, 18 nt, Human
caagcaggccaccucccc

SEQ ID NO: 1165980 - RNA, 19 nt, Human
caaguucccaggcuugcaa

SEQ ID NO: 1165981 - RNA, 20 nt, Human
cacaaaaggcaaaaucucau

SEQ ID NO: 1165982 - RNA, 19 nt, Human
cacaacccaaaacggcugg

SEQ ID NO: 1165983 - RNA, 18 nt, Human
cacacaucauaucccagg

SEQ ID NO: 1165984 - RNA, 22 nt, Human
cacauuauauauauauauauau

SEQ ID NO: 1165985 - RNA, 18 nt, Human
cacauuguuaaauggggu

SEQ ID NO: 1165986 - RNA, 23 nt, Human
caccaagaaaaaaaaaaacaaaa

SEQ ID NO: 1165987 - RNA, 25 nt, Human
caccagaccuccacagaguauugcu

SEQ ID NO: 1165988 - RNA, 18 nt, Human
caccaugugagggagagu

SEQ ID NO: 1165989 - RNA, 21 nt, Human
cacccccucuccccacucucc

SEQ ID NO: 1165990 - RNA, 26 nt, Human
cacccccucuccccacucuccccacc

SEQ ID NO: 1165991 - RNA, 20 nt, Human
cacccuguccucagacccuu

SEQ ID NO: 1165992 - RNA, 25 nt, Human
cacccuguccucagacccuuugcuu

SEQ ID NO: 1165993 - RNA, 18 nt, Human
cacucgcaccugcaccca

SEQ ID NO: 1165994 - RNA, 22 nt, Human
cacucgcaccugcacccacccu

SEQ ID NO: 1165995 - RNA, 26 nt, Human
cacucuccccaccccccuacaaggga

SEQ ID NO: 1165996 - RNA, 19 nt, Human
cagacccaggcccccacag

SEQ ID NO: 1165997 - RNA, 19 nt, Human
cagaguagggucccaagga

SEQ ID NO: 1165998 - RNA, 25 nt, Human
cagaguagggucccaaggaugggcu

SEQ ID NO: 1165999 - RNA, 25 nt, Human
cagcagagaacuggagaaaagggaa

SEQ ID NO: 1166000 - RNA, 19 nt, Human
cagcagcucuccucugcug

SEQ ID NO: 1166001 - RNA, 24 nt, Human
cagcccacagcugucaagccagga

SEQ ID NO: 1166002 - RNA, 18 nt, Human
cagcccgauguccuggag

SEQ ID NO: 1166003 - RNA, 24 nt, Human
cagcccugcucccagcuggcucca

SEQ ID NO: 1166004 - RNA, 22 nt, Human
cagccucagucacuucacauug

SEQ ID NO: 1166005 - RNA, 19 nt, Human
cagcgcagcagcucuccuc

SEQ ID NO: 1166006 - RNA, 25 nt, Human
cagcucagaacagacccaggccccc

SEQ ID NO: 1166007 - RNA, 20 nt, Human
cagcucccagccuagcacca

SEQ ID NO: 1166008 - RNA, 20 nt, Human
cagcuuaucugccucuccuu

SEQ ID NO: 1166009 - RNA, 21 nt, Human
caggcagcuuaucugccucuc

SEQ ID NO: 1166010 - RNA, 18 nt, Human
caggcuggggaaggaccc

SEQ ID NO: 1166011 - RNA, 18 nt, Human
cagggucacuggacuuca

SEQ ID NO: 1166012 - RNA, 24 nt, Human
cagguuccuggcauugaccccaca

SEQ ID NO: 1166013 - RNA, 19 nt, Human
cagucggcccucuccucuu

SEQ ID NO: 1166014 - RNA, 24 nt, Human
cagugccccaaggcccugcgggaa

SEQ ID NO: 1166015 - RNA, 21 nt, Human
caguuggagggggccagggag

SEQ ID NO: 1166016 - RNA, 23 nt, Human
cauagaaaacccucuccucccuc

SEQ ID NO: 1166017 - RNA, 24 nt, Human
cauagaaaacccucuccucccuca

SEQ ID NO: 1166018 - RNA, 22 nt, Human
caucccagcagagaacuggaga

SEQ ID NO: 1166019 - RNA, 25 nt, Human
caucccgcagcccaguccccucacu

SEQ ID NO: 1166020 - RNA, 21 nt, Human
caucucaccaccucuguucac

SEQ ID NO: 1166021 - RNA, 21 nt, Human
cauucuccuccagggccggaa

SEQ ID NO: 1166022 - RNA, 19 nt, Human
ccaagcagcaggaugcucc

SEQ ID NO: 1166023 - RNA, 18 nt, Human
ccacagcugucaagccag

SEQ ID NO: 1166024 - RNA, 22 nt, Human
ccaccugaacaauuucaguuau

SEQ ID NO: 1166025 - RNA, 21 nt, Human
ccacggcacuggggagggccc

SEQ ID NO: 1166026 - RNA, 19 nt, Human
ccagaacgggagggugaga

SEQ ID NO: 1166027 - RNA, 22 nt, Human
ccagagaucccacugucuacaa

SEQ ID NO: 1166028 - RNA, 19 nt, Human
ccagcccaccucuccugcc

SEQ ID NO: 1166029 - RNA, 20 nt, Human
ccagccccaagaugcuagag

SEQ ID NO: 1166030 - RNA, 25 nt, Human
ccagcuggcuccaugacgucggcca

SEQ ID NO: 1166031 - RNA, 21 nt, Human
ccaggcuugcagaagggucca

SEQ ID NO: 1166032 - RNA, 19 nt, Human
ccagggccggaaacaguaa

SEQ ID NO: 1166033 - RNA, 19 nt, Human
ccagucccuuagggaagcu

SEQ ID NO: 1166034 - RNA, 21 nt, Human
ccagucuccaggcuugcagaa

SEQ ID NO: 1166035 - RNA, 21 nt, Human
ccagugugccccccacccucu

SEQ ID NO: 1166036 - RNA, 22 nt, Human
cccacaggcuggggaaggaccc

SEQ ID NO: 1166037 - RNA, 21 nt, Human
cccagcacccaggguauaaac

SEQ ID NO: 1166038 - RNA, 24 nt, Human
cccagccccaccagaccuccacag

SEQ ID NO: 1166039 - RNA, 18 nt, Human
cccagcuggcuccaugac

SEQ ID NO: 1166040 - RNA, 19 nt, Human
cccaggcuugcaggcccca

SEQ ID NO: 1166041 - RNA, 19 nt, Human
cccagggggaagaaagggg

SEQ ID NO: 1166042 - RNA, 24 nt, Human
cccauagccagaggcagagagaag

SEQ ID NO: 1166043 - RNA, 21 nt, Human
ccccaagaugcuagagucuuc

SEQ ID NO: 1166044 - RNA, 20 nt, Human
ccccagaacgggagggugag

SEQ ID NO: 1166045 - RNA, 24 nt, Human
ccccagccucagucacuucacauu

SEQ ID NO: 1166046 - RNA, 26 nt, Human
ccccaggccacugaggacacagccuc

SEQ ID NO: 1166047 - RNA, 19 nt, Human
ccccauaccugcaaguccc

SEQ ID NO: 1166048 - RNA, 23 nt, Human
cccccacccucuccagucggccc

SEQ ID NO: 1166049 - RNA, 23 nt, Human
cccccagccccaccagaccucca

SEQ ID NO: 1166050 - RNA, 25 nt, Human
cccccucuccccacucuccccaccc

SEQ ID NO: 1166051 - RNA, 19 nt, Human
ccccuacaagggaaggaaa

SEQ ID NO: 1166052 - RNA, 22 nt, Human
ccccuacagccuggaggacagg

SEQ ID NO: 1166053 - RNA, 21 nt, Human
ccccucuccccacucucccca

SEQ ID NO: 1166054 - RNA, 24 nt, Human
ccccugagacuggggcuuaccacc

SEQ ID NO: 1166055 - RNA, 26 nt, Human
ccccugagacuggggcuuagguaccc

SEQ ID NO: 1166056 - RNA, 20 nt, Human
ccccuggcuccauggcgugg

SEQ ID NO: 1166057 - RNA, 25 nt, Human
cccuaggccagcccaccucuccugc

SEQ ID NO: 1166058 - RNA, 20 nt, Human
cccugcucccagcuggcucc

SEQ ID NO: 1166059 - RNA, 22 nt, Human
ccgccugggugcucccccagcc

SEQ ID NO: 1166060 - RNA, 23 nt, Human
ccuaccaggaagcggccucccca

SEQ ID NO: 1166061 - RNA, 23 nt, Human
ccuagcccagcccuggcuguuuc

SEQ ID NO: 1166062 - RNA, 19 nt, Human
ccuaggacugacuccgggg

SEQ ID NO: 1166063 - RNA, 24 nt, Human
ccucacaucaacuagagcagaggc

SEQ ID NO: 1166064 - RNA, 21 nt, Human
ccuccaggccuagaggguaga

SEQ ID NO: 1166065 - RNA, 19 nt, Human
ccucccauccagccuagga

SEQ ID NO: 1166066 - RNA, 21 nt, Human
ccuccuuugaugugugaaaau

SEQ ID NO: 1166067 - RNA, 19 nt, Human
ccucggaaugagaaggcuc

SEQ ID NO: 1166068 - RNA, 22 nt, Human
ccucggguucaacgcucagccc

SEQ ID NO: 1166069 - RNA, 24 nt, Human
ccucggguucaacgcucagcccug

SEQ ID NO: 1166070 - RNA, 21 nt, Human
ccucuugcuaauaauaaaagc

SEQ ID NO: 1166071 - RNA, 18 nt, Human
ccugcacccacccugggg

SEQ ID NO: 1166072 - RNA, 20 nt, Human
ccugggugcucccccagccc

SEQ ID NO: 1166073 - RNA, 20 nt, Human
ccuuagcugggcccagaagc

SEQ ID NO: 1166074 - RNA, 22 nt, Human
ccuugaaaguacaggggauaga

SEQ ID NO: 1166075 - RNA, 19 nt, Human
cggaaugagaaggcucaaa

SEQ ID NO: 1166076 - RNA, 22 nt, Human
cuagaugcuggggagugggcau

SEQ ID NO: 1166077 - RNA, 19 nt, Human
cuaggccagcccaccucuc

SEQ ID NO: 1166078 - RNA, 20 nt, Human
cucaccuuuaacacaaccca

SEQ ID NO: 1166079 - RNA, 23 nt, Human
cucagucuuuuaccacaggaaac

SEQ ID NO: 1166080 - RNA, 19 nt, Human
cucccagccuagcaccaug

SEQ ID NO: 1166081 - RNA, 22 nt, Human
cuccccacucuccccacccccc

SEQ ID NO: 1166082 - RNA, 22 nt, Human
cucccccagccccaccagaccu

SEQ ID NO: 1166083 - RNA, 27 nt, Human
cucccugccaccucaucucuagcucua

SEQ ID NO: 1166084 - RNA, 21 nt, Human
cuccugcccuaggccagccca

SEQ ID NO: 1166085 - RNA, 18 nt, Human
cucgggaggggguguccu

SEQ ID NO: 1166086 - RNA, 22 nt, Human
cucuccuccccuacagccugga

SEQ ID NO: 1166087 - RNA, 24 nt, Human
cucugugcugggaccaccaaccuc

SEQ ID NO: 1166088 - RNA, 19 nt, Human
cucuucucgggagggggug

SEQ ID NO: 1166089 - RNA, 26 nt, Human
cuggauagcacccccucuccccacuc

SEQ ID NO: 1166090 - RNA, 21 nt, Human
cuggcccacucaucuguggcu

SEQ ID NO: 1166091 - RNA, 18 nt, Human
cugggcccagaagcacug

SEQ ID NO: 1166092 - RNA, 20 nt, Human
cugucuacaagggccuggag

SEQ ID NO: 1166093 - RNA, 19 nt, Human
gaaacaguaagagcaggag

SEQ ID NO: 1166094 - RNA, 20 nt, Human
gaagaaacugagggccuggg

SEQ ID NO: 1166095 - RNA, 20 nt, Human
gaagaucucugcugucacag

SEQ ID NO: 1166096 - RNA, 24 nt, Human
gaauauauauauauacacauuaua

SEQ ID NO: 1166097 - RNA, 22 nt, Human
gaccccuggccugccucagucu

SEQ ID NO: 1166098 - RNA, 18 nt, Human
gaccuguuucauacccgu

SEQ ID NO: 1166099 - RNA, 24 nt, Human
gagaaaaagaauguggcaaaaugu

SEQ ID NO: 1166100 - RNA, 21 nt, Human
gagcaggagggaugaacuucu

SEQ ID NO: 1166101 - RNA, 20 nt, Human
gaggaagauggucaggcagc

SEQ ID NO: 1166102 - RNA, 24 nt, Human
gaggacacagccucccucccugcc

SEQ ID NO: 1166103 - RNA, 19 nt, Human
gaggauggaguggauacug

SEQ ID NO: 1166104 - RNA, 21 nt, Human
gaggcugggagggugugggga

SEQ ID NO: 1166105 - RNA, 21 nt, Human
gaggcugggaguccucuugag

SEQ ID NO: 1166106 - RNA, 21 nt, Human
gagggggccacccucccaucc

SEQ ID NO: 1166107 - RNA, 19 nt, Human
gauuuccaaccgccugcuc

SEQ ID NO: 1166108 - RNA, 19 nt, Human
gcagacccagcggugggug

SEQ ID NO: 1166109 - RNA, 18 nt, Human
gcagcagcucuccucugc

SEQ ID NO: 1166110 - RNA, 23 nt, Human
gcagcagugaccuaggcagacag

SEQ ID NO: 1166111 - RNA, 23 nt, Human
gcagugccccaaggcccugcggg

SEQ ID NO: 1166112 - RNA, 22 nt, Human
gccaagcaggccaccuccccuu

SEQ ID NO: 1166113 - RNA, 18 nt, Human
gccacccucccauccagc

SEQ ID NO: 1166114 - RNA, 19 nt, Human
gccacccuguccucagacc

SEQ ID NO: 1166115 - RNA, 22 nt, Human
gccagucccuuagggaagcuga

SEQ ID NO: 1166116 - RNA, 21 nt, Human
gcccagaagcacugacugcuc

SEQ ID NO: 1166117 - RNA, 20 nt, Human
gccccaaggcccugcgggaa

SEQ ID NO: 1166118 - RNA, 21 nt, Human
gcccccucauccucacaucaa

SEQ ID NO: 1166119 - RNA, 24 nt, Human
gccugggaggaagauggucaggcc

SEQ ID NO: 1166120 - RNA, 22 nt, Human
gccugggugcucccccagcccc

SEQ ID NO: 1166121 - RNA, 19 nt, Human
ggaaccuggcacagaguag

SEQ ID NO: 1166122 - RNA, 18 nt, Human
ggacagaaaagagucucg

SEQ ID NO: 1166123 - RNA, 25 nt, Human
ggccaggcucuccuccccuacagcc

SEQ ID NO: 1166124 - RNA, 18 nt, Human
ggccuagggccucaaaaa

SEQ ID NO: 1166125 - RNA, 24 nt, Human
ggccuagggccucaaaaacaaugu

SEQ ID NO: 1166126 - RNA, 23 nt, Human
ggccugaggcugggagggugugg

SEQ ID NO: 1166127 - RNA, 21 nt, Human
ggccugggaggaagaugguca

SEQ ID NO: 1166128 - RNA, 21 nt, Human
ggcggaacacagugagggaca

SEQ ID NO: 1166129 - RNA, 26 nt, Human
ggcuucaaaaagacagcaggccuagg

SEQ ID NO: 1166130 - RNA, 18 nt, Human
gggaagaaaggggugcag

SEQ ID NO: 1166131 - RNA, 20 nt, Human
ggggcccggagaacugggcc

SEQ ID NO: 1166132 - RNA, 23 nt, Human
ggguagccccagagcagccacgg

SEQ ID NO: 1166133 - RNA, 23 nt, Human
gguggggcccggagaacugggcc

SEQ ID NO: 1166134 - RNA, 22 nt, Human
uaaaaacauaguuagaaaaugc

SEQ ID NO: 1166135 - RNA, 21 nt, Human
uaaaacgcauccaguuucccc

SEQ ID NO: 1166136 - RNA, 18 nt, Human
uaagagcaggagggauga

SEQ ID NO: 1166137 - RNA, 18 nt, Human
uaagccccuggcuccaug

SEQ ID NO: 1166138 - RNA, 23 nt, Human
uacauuaauggaggaaggucuca

SEQ ID NO: 1166139 - RNA, 24 nt, Human
uaccacaggaaacaccacacauca

SEQ ID NO: 1166140 - RNA, 22 nt, Human
uaccaccauuuuguaggacuga

SEQ ID NO: 1166141 - RNA, 19 nt, Human
uaccccccauaccugcaag

SEQ ID NO: 1166142 - RNA, 18 nt, Human
uagaaaacccucuccucc

SEQ ID NO: 1166143 - RNA, 20 nt, Human
uagaaaaugcaaugugugca

SEQ ID NO: 1166144 - RNA, 21 nt, Human
uagaaaaugcaaugugugcac

SEQ ID NO: 1166145 - RNA, 22 nt, Human
uagaagaagugguuaugcgaca

SEQ ID NO: 1166146 - RNA, 18 nt, Human
uaggaaccagauguggag

SEQ ID NO: 1166147 - RNA, 22 nt, Human
uaggacaaugcccuaacucuua

SEQ ID NO: 1166148 - RNA, 23 nt, Human
uagggucccaaggaugggcucag

SEQ ID NO: 1166149 - RNA, 23 nt, Human
uagugggucuucaagaaaggucu

SEQ ID NO: 1166150 - RNA, 24 nt, Human
uagugggucuucaagaaaggucug

SEQ ID NO: 1166151 - RNA, 21 nt, Human
uauacacauuauauauauaua

SEQ ID NO: 1166152 - RNA, 28 nt, Human
uauauacacauuauauauauauauauau

SEQ ID NO: 1166153 - RNA, 21 nt, Human
uauauauacacauuauauaua

SEQ ID NO: 1166154 - RNA, 23 nt, Human
uauauauacacauuauauauaua

SEQ ID NO: 1166155 - RNA, 23 nt, Human
uauauauacacauuauauauaua

SEQ ID NO: 1166156 - RNA, 25 nt, Human
uauauauauauaacacagugcgacc

SEQ ID NO: 1166157 - RNA, 18 nt, Human
uauauauauauauauaua

SEQ ID NO: 1166158 - RNA, 23 nt, Human
uauauauauauauauauaacaca

SEQ ID NO: 1166159 - RNA, 19 nt, Human
uauauauauauauauauau

SEQ ID NO: 1166160 - RNA, 19 nt, Human
uauauauauauauauauau

SEQ ID NO: 1166161 - RNA, 19 nt, Human
uauauauauauauauauau

SEQ ID NO: 1166162 - RNA, 19 nt, Human
ucaaaggcacccuggcugg

SEQ ID NO: 1166163 - RNA, 18 nt, Human
ucaagucagcacaaaagg

SEQ ID NO: 1166164 - RNA, 21 nt, Human
ucagaacagacccaggccccc

SEQ ID NO: 1166165 - RNA, 25 nt, Human
ucagaacagacccaggcccccacag

SEQ ID NO: 1166166 - RNA, 23 nt, Human
uccaccacagaaggcucuggaac

SEQ ID NO: 1166167 - RNA, 20 nt, Human
uccagaaaguauuuccuggg

SEQ ID NO: 1166168 - RNA, 22 nt, Human
uccagggccggaaacaguaaga

SEQ ID NO: 1166169 - RNA, 21 nt, Human
ucccacuaacaagcccauggg

SEQ ID NO: 1166170 - RNA, 21 nt, Human
ucccacugaguguccaacuuu

SEQ ID NO: 1166171 - RNA, 19 nt, Human
uccccacucuccccacccc

SEQ ID NO: 1166172 - RNA, 21 nt, Human
uccccagugugccccccaccc

SEQ ID NO: 1166173 - RNA, 22 nt, Human
uccccagugugccccccacccu

SEQ ID NO: 1166174 - RNA, 26 nt, Human
uccccuacagccuggaggacagggac

SEQ ID NO: 1166175 - RNA, 23 nt, Human
ucccgcagcccaguccccucacu

SEQ ID NO: 1166176 - RNA, 20 nt, Human
ucccucauucuccuccaggg

SEQ ID NO: 1166177 - RNA, 21 nt, Human
ucccugcgcaucucaccaccu

SEQ ID NO: 1166178 - RNA, 20 nt, Human
uccuaaggucugcucagccc

SEQ ID NO: 1166179 - RNA, 19 nt, Human
uccuggagagagcuggucu

SEQ ID NO: 1166180 - RNA, 21 nt, Human
ucucagggcagcucccagccu

SEQ ID NO: 1166181 - RNA, 19 nt, Human
ucuccuagcccagcccugg

SEQ ID NO: 1166182 - RNA, 23 nt, Human
ucuccuagcccagcccuggcugu

SEQ ID NO: 1166183 - RNA, 18 nt, Human
ucuccuccagggccggaa

SEQ ID NO: 1166184 - RNA, 21 nt, Human
ucucugagagcccucggccac

SEQ ID NO: 1166185 - RNA, 18 nt, Human
ucugccucuccuucuacc

SEQ ID NO: 1166186 - RNA, 18 nt, Human
ucugugggccuugguggg

SEQ ID NO: 1166187 - RNA, 22 nt, Human
ugaagaaacugagggccuggga

SEQ ID NO: 1166188 - RNA, 24 nt, Human
ugaagaaacugagggccugggagg

SEQ ID NO: 1166189 - RNA, 20 nt, Human
ugaccccacaaaacccuaug

SEQ ID NO: 1166190 - RNA, 23 nt, Human
ugaccccacaaaacccuaugcca

SEQ ID NO: 1166191 - RNA, 21 nt, Human
ugaccccagcucuccuagccc

SEQ ID NO: 1166192 - RNA, 23 nt, Human
ugacggaugggacucuggaaguc

SEQ ID NO: 1166193 - RNA, 19 nt, Human
ugagaggcaugauggggac

SEQ ID NO: 1166194 - RNA, 27 nt, Human
ugagcaaacaaucugacaaauucagaa

SEQ ID NO: 1166195 - RNA, 18 nt, Human
ugagcacacaagcagaca

SEQ ID NO: 1166196 - RNA, 21 nt, Human
ugaggcugggagggugugggg

SEQ ID NO: 1166197 - RNA, 22 nt, Human
ugccagucccuuagggaagcug

SEQ ID NO: 1166198 - RNA, 22 nt, Human
ugccucaacggccugggcagca

SEQ ID NO: 1166199 - RNA, 23 nt, Human
ugccucaacggccugggcagcag

SEQ ID NO: 1166200 - RNA, 24 nt, Human
ugcgggaagccuugaggauggagu

SEQ ID NO: 1166201 - RNA, 21 nt, Human
ugcuaauaauaaaagcuaaca

SEQ ID NO: 1166202 - RNA, 25 nt, Human
ugcugggaccaccaaccucugcaac

SEQ ID NO: 1166203 - RNA, 24 nt, Human
ugcuugcagauccgccugggugcu

SEQ ID NO: 1166204 - RNA, 20 nt, Human
uggaagagccuggcucgaaa

SEQ ID NO: 1166205 - RNA, 19 nt, Human
uggacucccuccuaccagg

SEQ ID NO: 1166206 - RNA, 22 nt, Human
uggagaaaagggaaucagcuca

SEQ ID NO: 1166207 - RNA, 24 nt, Human
uggagccaccugaacaauuucagu

SEQ ID NO: 1166208 - RNA, 20 nt, Human
uggagggggccagggagagg

SEQ ID NO: 1166209 - RNA, 24 nt, Human
uggcaagggcagccagcccacagc

SEQ ID NO: 1166210 - RNA, 20 nt, Human
uggcaccaagaaaaaaaaaa

SEQ ID NO: 1166211 - RNA, 21 nt, Human
uggcaccaagaaaaaaaaaaa

SEQ ID NO: 1166212 - RNA, 23 nt, Human
uggcagcagugaccuaggcagac

SEQ ID NO: 1166213 - RNA, 19 nt, Human
uggcauugaccccacaaaa

SEQ ID NO: 1166214 - RNA, 20 nt, Human
uggcauugaccccacaaaac

SEQ ID NO: 1166215 - RNA, 18 nt, Human
uggccugccucagucuuu

SEQ ID NO: 1166216 - RNA, 19 nt, Human
ugggaacagauggcuuccu

SEQ ID NO: 1166217 - RNA, 21 nt, Human
ugggaaggagugguuuguccc

SEQ ID NO: 1166218 - RNA, 20 nt, Human
ugggaccaccaaccucugca

SEQ ID NO: 1166219 - RNA, 23 nt, Human
ugggaccaccaaccucugcaggu

SEQ ID NO: 1166220 - RNA, 20 nt, Human
ugggaggguguggggaccgu

SEQ ID NO: 1166221 - RNA, 20 nt, Human
ugggcagcagggggucuagg

SEQ ID NO: 1166222 - RNA, 18 nt, Human
ugggguucagagggaagc

SEQ ID NO: 1166223 - RNA, 19 nt, Human
ugggucuucaagaaagguc

SEQ ID NO: 1166224 - RNA, 18 nt, Human
ugucacaggauuuccaac

SEQ ID NO: 1166225 - RNA, 21 nt, Human
uguccagucugucucccccgg

SEQ ID NO: 1166226 - RNA, 27 nt, Human
ugugaagguaggaaccagauguggagg

SEQ ID NO: 1166227 - RNA, 20 nt, Human
ugugccccccacccucucca

SEQ ID NO: 1166228 - RNA, 21 nt, Human
ugugugaaaaucccugcugug

SEQ ID NO: 1166229 - RNA, 21 nt, Human
uguucaccugggguagcccca

SEQ ID NO: 1166230 - RNA, 22 nt, Human
uguuugcaauguacuuuuaaau

SEQ ID NO: 1166231 - RNA, 22 nt, Human
uuaaaaacgaacccaaccaaaa

SEQ ID NO: 1166232 - RNA, 24 nt, Human
uucacauuguuaaauggggugggg

SEQ ID NO: 1166233 - RNA, 23 nt, Human
uucagaauguggggcuucaaaaa

SEQ ID NO: 1166234 - RNA, 30 nt, Human
uucaugagcacacaagcagacaugccaccu

SEQ ID NO: 1166235 - RNA, 24 nt, Human
uucaugcacaaauuacaaaaggag

SEQ ID NO: 1166236 - RNA, 22 nt, Human
uucccaggcuugcaggccccau

SEQ ID NO: 1166237 - RNA, 19 nt, Human
uucucuucucgggaggggg

SEQ ID NO: 1166238 - RNA, 19 nt, Human
uucugaacaagacaagccu

SEQ ID NO: 1166239 - RNA, 25 nt, Human
uugaccccacaaaacccuaugccag

SEQ ID NO: 1166240 - RNA, 20 nt, Human
uugccucaacggccugggca

SEQ ID NO: 1166241 - RNA, 21 nt, Human
uuggcugugauacugggccaa

SEQ ID NO: 1166242 - RNA, 23 nt, Human
uuugaccccagcucuccuagccg

SEQ ID NO: 1166243 - RNA, 18 nt, Human
uuuggcaguuggaggggg

SEQ ID NO: 1166244 - RNA, 20 nt, Human
uuuuuuuggccaaaugcuua

SEQ ID NO: 1166245 - RNA, 24 nt, Human
aaaaaugagccuuuuguacuaaau

SEQ ID NO: 1166246 - RNA, 20 nt, Human
aaacacaucucaaaucccac

SEQ ID NO: 1166247 - RNA, 24 nt, Human
aaagaaaaacacaucucaaauccc

SEQ ID NO: 1166248 - RNA, 21 nt, Human
aaaguucuucaggaucuacuc

SEQ ID NO: 1166249 - RNA, 24 nt, Human
aaauacaaccaaaaagaaaaacac

SEQ ID NO: 1166250 - RNA, 32 nt, Human
aacaauagagaaaaauacaaccaaaaagaaag

SEQ ID NO: 1166251 - RNA, 21 nt, Human
aacacaucucaaaucccacca

SEQ ID NO: 1166252 - RNA, 22 nt, Human
aaccaaaaagaaaaacacaucu

SEQ ID NO: 1166253 - RNA, 25 nt, Human
aaccaaaaagaaaaacacaucucaa

SEQ ID NO: 1166254 - RNA, 19 nt, Human
aacccagagaacacaccca

SEQ ID NO: 1166255 - RNA, 18 nt, Human
aagcaccccuuuccaucu

SEQ ID NO: 1166256 - RNA, 21 nt, Human
aagucccuucuagaucccucc

SEQ ID NO: 1166257 - RNA, 25 nt, Human
aaucaaaugaguguuucucacagga

SEQ ID NO: 1166258 - RNA, 18 nt, Human
aauuucugccuacuccuc

SEQ ID NO: 1166259 - RNA, 21 nt, Human
acaaagaaagcccugagcaca

SEQ ID NO: 1166260 - RNA, 26 nt, Human
acacaacccauggaauucaguucuca

SEQ ID NO: 1166261 - RNA, 24 nt, Human
agacaaaucacaucccuuauuccc

SEQ ID NO: 1166262 - RNA, 21 nt, Human
agaggagcugaaacccagagc

SEQ ID NO: 1166263 - RNA, 18 nt, Human
agcaugcuguggagucuu

SEQ ID NO: 1166264 - RNA, 21 nt, Human
agcgagggaggaagaggcugg

SEQ ID NO: 1166265 - RNA, 23 nt, Human
aggaacucacacuccuuauaccu

SEQ ID NO: 1166266 - RNA, 19 nt, Human
aggaagaggcugggccgga

SEQ ID NO: 1166267 - RNA, 21 nt, Human
aggaaggcagcuaaggccuau

SEQ ID NO: 1166268 - RNA, 19 nt, Human
agggcggaagugggcagag

SEQ ID NO: 1166269 - RNA, 25 nt, Human
aguauauauucuggauuuucuccau

SEQ ID NO: 1166270 - RNA, 21 nt, Human
auagugggcacucaguaaacc

SEQ ID NO: 1166271 - RNA, 23 nt, Human
auuuugcaacaugcuuuuuccac

SEQ ID NO: 1166272 - RNA, 27 nt, Human
caaaagacaaaucacaucccuuauucc

SEQ ID NO: 1166273 - RNA, 21 nt, Human
caaaucccaccacgucagaga

SEQ ID NO: 1166274 - RNA, 24 nt, Human
caaccaaaaagaaaaacacaucuc

SEQ ID NO: 1166275 - RNA, 23 nt, Human
caagauaccaagagacaaugaug

SEQ ID NO: 1166276 - RNA, 22 nt, Human
caauaaauguaaacgaguagca

SEQ ID NO: 1166277 - RNA, 20 nt, Human
cacacccugcacgcuaaccc

SEQ ID NO: 1166278 - RNA, 20 nt, Human
cacacguauuccuacauaca

SEQ ID NO: 1166279 - RNA, 21 nt, Human
cacagcgagggaggaagaggc

SEQ ID NO: 1166280 - RNA, 21 nt, Human
caccaaguuauuuugcaacau

SEQ ID NO: 1166281 - RNA, 25 nt, Human
cagagaacacacccaugucccacac

SEQ ID NO: 1166282 - RNA, 19 nt, Human
cagagccugagacucugcc

SEQ ID NO: 1166283 - RNA, 19 nt, Human
cagcacagaggagcugaaa

SEQ ID NO: 1166284 - RNA, 18 nt, Human
cagccuggugcuuuggcc

SEQ ID NO: 1166285 - RNA, 23 nt, Human
caggaaaggaagagcggucaagc

SEQ ID NO: 1166286 - RNA, 22 nt, Human
caggaacucacacuccuuauac

SEQ ID NO: 1166287 - RNA, 23 nt, Human
cauaaaccaaguuuugguaaagc

SEQ ID NO: 1166288 - RNA, 22 nt, Human
cauagugggcacucaguaaacc

SEQ ID NO: 1166289 - RNA, 25 nt, Human
caucaugcgugcagggucuggaccc

SEQ ID NO: 1166290 - RNA, 21 nt, Human
caucucaaaucccaccacguc

SEQ ID NO: 1166291 - RNA, 23 nt, Human
caucuguagaacaugguuacgug

SEQ ID NO: 1166292 - RNA, 18 nt, Human
ccaaaaagaaaaacacau

SEQ ID NO: 1166293 - RNA, 20 nt, Human
ccaucaaaucuaaagccuaa

SEQ ID NO: 1166294 - RNA, 21 nt, Human
ccauccaggaaaggaagagcg

SEQ ID NO: 1166295 - RNA, 18 nt, Human
cccaaaagacaaaucaca

SEQ ID NO: 1166296 - RNA, 25 nt, Human
cccagagaacacacccaugucccac

SEQ ID NO: 1166297 - RNA, 20 nt, Human
cccccgggucggggacccuc

SEQ ID NO: 1166298 - RNA, 23 nt, Human
ccccugaaauaaaaaugagccuu

SEQ ID NO: 1166299 - RNA, 22 nt, Human
cccugcuggugccauccaggaa

SEQ ID NO: 1166300 - RNA, 20 nt, Human
cccuuuggcaugccuuccgg

SEQ ID NO: 1166301 - RNA, 24 nt, Human
ccucuugcagcacgugucaggagc

SEQ ID NO: 1166302 - RNA, 23 nt, Human
ccugagacucugccuucugucuc

SEQ ID NO: 1166303 - RNA, 21 nt, Human
ccuggcagugucagcuucucu

SEQ ID NO: 1166304 - RNA, 23 nt, Human
ccuucauaauaaccaagcacccc

SEQ ID NO: 1166305 - RNA, 23 nt, Human
cgucagagauaaccauuguuagc

SEQ ID NO: 1166306 - RNA, 19 nt, Human
cuaaagccuaauaaagucc

SEQ ID NO: 1166307 - RNA, 21 nt, Human
cucacacuccuuauaccuuca

SEQ ID NO: 1166308 - RNA, 18 nt, Human
cuccagguccucaagccc

SEQ ID NO: 1166309 - RNA, 22 nt, Human
cuccccugcagccucccccgaa

SEQ ID NO: 1166310 - RNA, 20 nt, Human
cuccuugcaguccaggccug

SEQ ID NO: 1166311 - RNA, 23 nt, Human
cuggagagacucuuauuugcugg

SEQ ID NO: 1166312 - RNA, 18 nt, Human
cuucauaauaaccaagca

SEQ ID NO: 1166313 - RNA, 20 nt, Human
cuucauaauaaccaagcacc

SEQ ID NO: 1166314 - RNA, 21 nt, Human
gaacaugguuacguguuuuuc

SEQ ID NO: 1166315 - RNA, 21 nt, Human
gaauucaguucucaaagcuga

SEQ ID NO: 1166316 - RNA, 23 nt, Human
gagaaagagcaucuuucuggaga

SEQ ID NO: 1166317 - RNA, 19 nt, Human
gagcaugcuguggagucuu

SEQ ID NO: 1166318 - RNA, 19 nt, Human
gagggaggaagaggcuggg

SEQ ID NO: 1166319 - RNA, 21 nt, Human
gagguccuugaucugaucagu

SEQ ID NO: 1166320 - RNA, 22 nt, Human
gcaaauacaaccucaaaaaucu

SEQ ID NO: 1166321 - RNA, 23 nt, Human
gcacagaggagcugaaacccaga

SEQ ID NO: 1166322 - RNA, 19 nt, Human
gccggaauggaagguucca

SEQ ID NO: 1166323 - RNA, 21 nt, Human
gccuaauaaaguccauauagc

SEQ ID NO: 1166324 - RNA, 21 nt, Human
gccuccaccuuccccaucaug

SEQ ID NO: 1166325 - RNA, 24 nt, Human
gcggagcugagggggaagccucca

SEQ ID NO: 1166326 - RNA, 20 nt, Human
ggaagguuccagccuggcag

SEQ ID NO: 1166327 - RNA, 25 nt, Human
gggcagagugugagaaggguggggg

SEQ ID NO: 1166328 - RNA, 18 nt, Human
guaaagcaaauacaaccu

SEQ ID NO: 1166329 - RNA, 26 nt, Human
guaaagcaaauacaaccucaaaaauc

SEQ ID NO: 1166330 - RNA, 24 nt, Human
gucagcuucucuccgcggagcuga

SEQ ID NO: 1166331 - RNA, 20 nt, Human
gucccuucuagaucccuccu

SEQ ID NO: 1166332 - RNA, 19 nt, Human
guggagucuuucaccugcc

SEQ ID NO: 1166333 - RNA, 21 nt, Human
uaaccaaacauguucuguguu

SEQ ID NO: 1166334 - RNA, 20 nt, Human
uaauguguguguguaucugu

SEQ ID NO: 1166335 - RNA, 21 nt, Human
uaauguguguguguaucugug

SEQ ID NO: 1166336 - RNA, 21 nt, Human
uacaaccaaaaagaaaaacac

SEQ ID NO: 1166337 - RNA, 21 nt, Human
uacauaaaccaaguuuuggua

SEQ ID NO: 1166338 - RNA, 25 nt, Human
uacuaaaucggaguucugagccaaa

SEQ ID NO: 1166339 - RNA, 19 nt, Human
uagcuacuuggaacccugc

SEQ ID NO: 1166340 - RNA, 20 nt, Human
uauacagugaauuucugccu

SEQ ID NO: 1166341 - RNA, 21 nt, Human
uauagcacucaugaggccucu

SEQ ID NO: 1166342 - RNA, 18 nt, Human
ucaaaucccaccacguca

SEQ ID NO: 1166343 - RNA, 18 nt, Human
ucaccaagguucugguuc

SEQ ID NO: 1166344 - RNA, 21 nt, Human
ucagagauaaccauuguuagc

SEQ ID NO: 1166345 - RNA, 22 nt, Human
uccaaucggcccugcuggugcc

SEQ ID NO: 1166346 - RNA, 24 nt, Human
uccacagcacagaggagcugaaac

SEQ ID NO: 1166347 - RNA, 20 nt, Human
ucccagccagcgagcuccua

SEQ ID NO: 1166348 - RNA, 19 nt, Human
ucuaaagccuaauaaaguc

SEQ ID NO: 1166349 - RNA, 21 nt, Human
ucuccagguccucaagcccac

SEQ ID NO: 1166350 - RNA, 21 nt, Human
ucuccagucuuccaagcucuu

SEQ ID NO: 1166351 - RNA, 18 nt, Human
ugaagaacugaauuucag

SEQ ID NO: 1166352 - RNA, 21 nt, Human
ugaauuucagaggucugacac

SEQ ID NO: 1166353 - RNA, 20 nt, Human
ugacacaacccauggaauuc

SEQ ID NO: 1166354 - RNA, 21 nt, Human
ugagaagggugggggaggucc

SEQ ID NO: 1166355 - RNA, 21 nt, Human
ugagaucaugcauacaaagaa

SEQ ID NO: 1166356 - RNA, 21 nt, Human
ugagauuucaccaagguucug

SEQ ID NO: 1166357 - RNA, 22 nt, Human
ugaggauacacaucggcuuuuc

SEQ ID NO: 1166358 - RNA, 22 nt, Human
ugaucugaucaguacaacccag

SEQ ID NO: 1166359 - RNA, 20 nt, Human
ugauuucucccaagagucuc

SEQ ID NO: 1166360 - RNA, 23 nt, Human
ugcaaagaccccuccuugcaguc

SEQ ID NO: 1166361 - RNA, 25 nt, Human
ugcaaagaccccuccuugcaguccu

SEQ ID NO: 1166362 - RNA, 18 nt, Human
ugcagggucuggaccccc

SEQ ID NO: 1166363 - RNA, 18 nt, Human
ugcgccugcuccccugca

SEQ ID NO: 1166364 - RNA, 21 nt, Human
ugcgugcagggucuggacccc

SEQ ID NO: 1166365 - RNA, 18 nt, Human
ugcuccccugcagccucc

SEQ ID NO: 1166366 - RNA, 23 nt, Human
uggaauucaguucucaaagcuga

SEQ ID NO: 1166367 - RNA, 23 nt, Human
uggacccccgggucggggacccu

SEQ ID NO: 1166368 - RNA, 19 nt, Human
uggagcuucuaguauauau

SEQ ID NO: 1166369 - RNA, 26 nt, Human
uggcaaugccaugugucucaagcuuc

SEQ ID NO: 1166370 - RNA, 22 nt, Human
uggcaugccuuccggcccaggg

SEQ ID NO: 1166371 - RNA, 23 nt, Human
ugggcacucaguaaaccucggug

SEQ ID NO: 1166372 - RNA, 19 nt, Human
ugggcagagugugagaagg

SEQ ID NO: 1166373 - RNA, 23 nt, Human
uggugagauucacugagaucaug

SEQ ID NO: 1166374 - RNA, 19 nt, Human
uuagcaaauugauguacaa

SEQ ID NO: 1166375 - RNA, 23 nt, Human
uugcugggguagaggaaggcagc

SEQ ID NO: 1166376 - RNA, 24 nt, Human
uuggagcuucuaguauauauucug

SEQ ID NO: 1166377 - RNA, 22 nt, Human
uugguaaagcaaauacaaccuc

SEQ ID NO: 1166378 - RNA, 23 nt, Human
aaccaauaaaguuugcaauaucc

SEQ ID NO: 1166379 - RNA, 21 nt, Human
aggagucuguagccaaggacg

SEQ ID NO: 1166380 - RNA, 23 nt, Human
cagcaugagcaagccuaaaaacu

SEQ ID NO: 1166381 - RNA, 21 nt, Human
cauucucacacucuaaaagaa

SEQ ID NO: 1166382 - RNA, 23 nt, Human
ccaauaaaguuugcaauauccaa

SEQ ID NO: 1166383 - RNA, 24 nt, Human
cucuucuuugauaaggccuggaug

SEQ ID NO: 1166384 - RNA, 20 nt, Human
cugaauaugggccugcucuu

SEQ ID NO: 1166385 - RNA, 20 nt, Human
cuuugauaaggccuggauga

SEQ ID NO: 1166386 - RNA, 19 nt, Human
gcuuauauuaagcuucagc

SEQ ID NO: 1166387 - RNA, 18 nt, Human
gugugugcgugugggugu

SEQ ID NO: 1166388 - RNA, 18 nt, Human
uaaaagaaauacuauucu

SEQ ID NO: 1166389 - RNA, 23 nt, Human
uaagcuucagcaugagcaagccu

SEQ ID NO: 1166390 - RNA, 22 nt, Human
uccaggagucuguagccaagga

SEQ ID NO: 1166391 - RNA, 20 nt, Human
ucuggaaaaguucuauuuca

SEQ ID NO: 1166392 - RNA, 22 nt, Human
ucuguagccaaggacguacagc

SEQ ID NO: 1166393 - RNA, 22 nt, Human
ucuuuuguuguuuauuuguaac

SEQ ID NO: 1166394 - RNA, 23 nt, Human
ugaauaugggccugcucuuguca

SEQ ID NO: 1166395 - RNA, 21 nt, Human
ugcgugugggugugugugugu

SEQ ID NO: 1166396 - RNA, 21 nt, Human
ugcgugugggugugugugugu

SEQ ID NO: 1166397 - RNA, 20 nt, Human
uggguaacaccccaaccaau

SEQ ID NO: 1166398 - RNA, 20 nt, Human
ugggugugugugugugugug

SEQ ID NO: 1166399 - RNA, 18 nt, Human
ugugauauuugguucuug

SEQ ID NO: 1166400 - RNA, 26 nt, Human
ugugauauuugguucuugucaguuug

SEQ ID NO: 1166401 - RNA, 21 nt, Human
ugugcgugugggugugugugu

SEQ ID NO: 1166402 - RNA, 20 nt, Human
ugugggugugugugugugug

SEQ ID NO: 1166403 - RNA, 21 nt, Human
ugugggugugugugugugugu

SEQ ID NO: 1166404 - RNA, 20 nt, Human
ugugugcgugugggugugug

SEQ ID NO: 1166405 - RNA, 22 nt, Human
ugugugcgugugggugugugug

SEQ ID NO: 1166406 - RNA, 18 nt, Human
uuccagaucauuugguga

SEQ ID NO: 1166407 - RNA, 22 nt, Human
uuggugauuuugugugugcgug

SEQ ID NO: 1166408 - RNA, 25 nt, Human
aaaaaaucaaauucugguuugcaga

SEQ ID NO: 1166409 - RNA, 21 nt, Human
aaaaaccagaauuccuaacag

SEQ ID NO: 1166410 - RNA, 21 nt, Human
aaaaaguaucaaaaaccagaa

SEQ ID NO: 1166411 - RNA, 21 nt, Human
aaaagagcaccuaaaaacuaa

SEQ ID NO: 1166412 - RNA, 24 nt, Human
aaaagcucaacuauuuaaaagcuu

SEQ ID NO: 1166413 - RNA, 24 nt, Human
aaaauaaaacaaucgcaauaaugu

SEQ ID NO: 1166414 - RNA, 21 nt, Human
aaaccccauaauuuuuccauc

SEQ ID NO: 1166415 - RNA, 23 nt, Human
aacuugcaagccuguguuuugcc

SEQ ID NO: 1166416 - RNA, 24 nt, Human
aagcacaagauuugagaauaaaac

SEQ ID NO: 1166417 - RNA, 18 nt, Human
aagcgaacuagaggaaca

SEQ ID NO: 1166418 - RNA, 23 nt, Human
aaucaaauucugguuugcagaca

SEQ ID NO: 1166419 - RNA, 23 nt, Human
acaaaguaaaagaaaagaacaaa

SEQ ID NO: 1166420 - RNA, 18 nt, Human
acaagcuauauauauagc

SEQ ID NO: 1166421 - RNA, 24 nt, Human
acaauuuaaaccgacuguuuaaaa

SEQ ID NO: 1166422 - RNA, 19 nt, Human
acagaguccccugguuaaa

SEQ ID NO: 1166423 - RNA, 26 nt, Human
acugaaacucaaagauauggaaucua

SEQ ID NO: 1166424 - RNA, 21 nt, Human
acuugcaagccuguguuuugc

SEQ ID NO: 1166425 - RNA, 22 nt, Human
agaaacuauagaagaauaaguc

SEQ ID NO: 1166426 - RNA, 26 nt, Human
agacaggaaaaaaguaucaaaaacca

SEQ ID NO: 1166427 - RNA, 26 nt, Human
agacaggauggaaaaaucuguggggg

SEQ ID NO: 1166428 - RNA, 22 nt, Human
agaggaagcagauuauuacugg

SEQ ID NO: 1166429 - RNA, 25 nt, Human
agaguuuccccaaaauacaaggcac

SEQ ID NO: 1166430 - RNA, 22 nt, Human
agauaauuggacccaaacagaa

SEQ ID NO: 1166431 - RNA, 19 nt, Human
auauauauauauauauaua

SEQ ID NO: 1166432 - RNA, 19 nt, Human
auauauauauauauauaua

SEQ ID NO: 1166433 - RNA, 19 nt, Human
auauauauauauauauaua

SEQ ID NO: 1166434 - RNA, 19 nt, Human
auauauauauauauauaua

SEQ ID NO: 1166435 - RNA, 19 nt, Human
auauauauauauauauaua

SEQ ID NO: 1166436 - RNA, 19 nt, Human
auauauauauauauauaua

SEQ ID NO: 1166437 - RNA, 25 nt, Human
aucauccuugucaucuucauaaucc

SEQ ID NO: 1166438 - RNA, 19 nt, Human
aucaugguccucaucauca

SEQ ID NO: 1166439 - RNA, 25 nt, Human
augguccucaucaucaacauccucc

SEQ ID NO: 1166440 - RNA, 21 nt, Human
caaaacgcagacauuucugac

SEQ ID NO: 1166441 - RNA, 21 nt, Human
caaacagaaauaaaauucaca

SEQ ID NO: 1166442 - RNA, 22 nt, Human
caacauuaaaaagcucaacuau

SEQ ID NO: 1166443 - RNA, 24 nt, Human
cagacaggaaaaaaguaucaaaaa

SEQ ID NO: 1166444 - RNA, 18 nt, Human
cagaguccccugguuaaa

SEQ ID NO: 1166445 - RNA, 24 nt, Human
cagauucaaagucuuuuuuuuuuu

SEQ ID NO: 1166446 - RNA, 19 nt, Human
caggcacaagugcugggug

SEQ ID NO: 1166447 - RNA, 22 nt, Human
cauacauauauaaauagguaca

SEQ ID NO: 1166448 - RNA, 23 nt, Human
cauauauauauauacauaauaca

SEQ ID NO: 1166449 - RNA, 22 nt, Human
cauuuaaaccccauaauuuuuc

SEQ ID NO: 1166450 - RNA, 19 nt, Human
cauuucaacauaguccuau

SEQ ID NO: 1166451 - RNA, 25 nt, Human
cauuuuacuauuucacuccuccaaa

SEQ ID NO: 1166452 - RNA, 18 nt, Human
ccaccaguuuucagaguu

SEQ ID NO: 1166453 - RNA, 18 nt, Human
ccccaaaauacaaggcac

SEQ ID NO: 1166454 - RNA, 21 nt, Human
ccccugguuaaaauguaaagc

SEQ ID NO: 1166455 - RNA, 23 nt, Human
ccucaucaucaacauccuccucg

SEQ ID NO: 1166456 - RNA, 24 nt, Human
ccucuuccucuucuuccuccuccu

SEQ ID NO: 1166457 - RNA, 20 nt, Human
ccucuucuuccuccuccuca

SEQ ID NO: 1166458 - RNA, 19 nt, Human
cgaaauaugaguuuucuag

SEQ ID NO: 1166459 - RNA, 19 nt, Human
cuccuuggauuucuuuuuu

SEQ ID NO: 1166460 - RNA, 19 nt, Human
cucuuccucuucuuccucc

SEQ ID NO: 1166461 - RNA, 18 nt, Human
cuuuacauauauauauau

SEQ ID NO: 1166462 - RNA, 25 nt, Human
gaaauaaaagacaucuaaauggcca

SEQ ID NO: 1166463 - RNA, 19 nt, Human
gaacaucuaauauggccca

SEQ ID NO: 1166464 - RNA, 21 nt, Human
gacauuugugugugugugugu

SEQ ID NO: 1166465 - RNA, 18 nt, Human
gauauacauacauauaua

SEQ ID NO: 1166466 - RNA, 19 nt, Human
gcucacugccgaauccuuc

SEQ ID NO: 1166467 - RNA, 19 nt, Human
guauauauauauauauaua

SEQ ID NO: 1166468 - RNA, 19 nt, Human
guauauauauauauauaua

SEQ ID NO: 1166469 - RNA, 18 nt, Human
guccuccucaucuucuuc

SEQ ID NO: 1166470 - RNA, 20 nt, Human
guguguauauauauauauau

SEQ ID NO: 1166471 - RNA, 25 nt, Human
uaaaacacugaaacucaaagauaug

SEQ ID NO: 1166472 - RNA, 21 nt, Human
uaaaagacaucuaaauggcca

SEQ ID NO: 1166473 - RNA, 26 nt, Human
uaaaguacaaccauuucuagacgguu

SEQ ID NO: 1166474 - RNA, 24 nt, Human
uaaaguuaaaacagcaagaggauu

SEQ ID NO: 1166475 - RNA, 20 nt, Human
uaagaucccuaacccugacc

SEQ ID NO: 1166476 - RNA, 20 nt, Human
uaagcuaaauaaacauuuua

SEQ ID NO: 1166477 - RNA, 21 nt, Human
uacaauacacagacucugugg

SEQ ID NO: 1166478 - RNA, 25 nt, Human
uacaguaucauguaagcugugcaaa

SEQ ID NO: 1166479 - RNA, 18 nt, Human
uacauauauauauauaca

SEQ ID NO: 1166480 - RNA, 23 nt, Human
uaccuaacauuuacuuaaacaua

SEQ ID NO: 1166481 - RNA, 22 nt, Human
uacuggguguucuagaucaaac

SEQ ID NO: 1166482 - RNA, 19 nt, Human
uagccugguucagagaaag

SEQ ID NO: 1166483 - RNA, 19 nt, Human
uauauauauauauauauau

SEQ ID NO: 1166484 - RNA, 19 nt, Human
uauauauauauauauauau

SEQ ID NO: 1166485 - RNA, 21 nt, Human
uaucgcugcagcauuuaacaa

SEQ ID NO: 1166486 - RNA, 23 nt, Human
uauuucacuccuccaaaauguuu

SEQ ID NO: 1166487 - RNA, 22 nt, Human
uauuuuguugucugguggaagu

SEQ ID NO: 1166488 - RNA, 22 nt, Human
ucaauagcuuacuaaaaugaaa

SEQ ID NO: 1166489 - RNA, 20 nt, Human
uccaucuauauaucuuguuu

SEQ ID NO: 1166490 - RNA, 23 nt, Human
ucccagaaguaucuucuuuuacc

SEQ ID NO: 1166491 - RNA, 21 nt, Human
uccucuuccucuucuuccucc

SEQ ID NO: 1166492 - RNA, 22 nt, Human
ucguccuccucaucuucuucag

SEQ ID NO: 1166493 - RNA, 19 nt, Human
ucuaaauggccaccaacuu

SEQ ID NO: 1166494 - RNA, 18 nt, Human
ucuuccucuucuuccucc

SEQ ID NO: 1166495 - RNA, 18 nt, Human
ucuucuuccuccuccuca

SEQ ID NO: 1166496 - RNA, 24 nt, Human
ucuucuuccuccuccucauuuucc

SEQ ID NO: 1166497 - RNA, 23 nt, Human
ugaaaaagaguuggaacaaaaaa

SEQ ID NO: 1166498 - RNA, 23 nt, Human
ugaaaugcaagaccaaaaaauca

SEQ ID NO: 1166499 - RNA, 23 nt, Human
ugaagauauugaagucaccuccu

SEQ ID NO: 1166500 - RNA, 20 nt, Human
ugacaugcaaaacagaauga

SEQ ID NO: 1166501 - RNA, 18 nt, Human
ugagauuaaugguugugg

SEQ ID NO: 1166502 - RNA, 18 nt, Human
ugagcaaaaaagagcacc

SEQ ID NO: 1166503 - RNA, 21 nt, Human
ugaggugauuuucaccugauu

SEQ ID NO: 1166504 - RNA, 25 nt, Human
ugcaaaacagaaugaaaauuuacaa

SEQ ID NO: 1166505 - RNA, 18 nt, Human
ugcacagacauuugugug

SEQ ID NO: 1166506 - RNA, 22 nt, Human
ugcacagacauuugugugugug

SEQ ID NO: 1166507 - RNA, 23 nt, Human
ugcagaaauaaaagacaucuaaa

SEQ ID NO: 1166508 - RNA, 22 nt, Human
ugcagacaggaaaaaaguauca

SEQ ID NO: 1166509 - RNA, 20 nt, Human
ugccacagaguccccugguu

SEQ ID NO: 1166510 - RNA, 21 nt, Human
ugccugaaauuuuugguauuu

SEQ ID NO: 1166511 - RNA, 23 nt, Human
uggaacaaaaaaacauuuaaacc

SEQ ID NO: 1166512 - RNA, 18 nt, Human
uguauauauauauauaua

SEQ ID NO: 1166513 - RNA, 22 nt, Human
uguauauauauauauauauaua

SEQ ID NO: 1166514 - RNA, 18 nt, Human
uguguauauauauauaua

SEQ ID NO: 1166515 - RNA, 20 nt, Human
uguguauauauauauauaua

SEQ ID NO: 1166516 - RNA, 22 nt, Human
uguguauauauauauauauaua

SEQ ID NO: 1166517 - RNA, 22 nt, Human
uguguguauauauauauauaua

SEQ ID NO: 1166518 - RNA, 24 nt, Human
uguguguauauauauauauauaac

SEQ ID NO: 1166519 - RNA, 18 nt, Human
uguguguguauauauaua

SEQ ID NO: 1166520 - RNA, 23 nt, Human
uguguguguguauauauauauau

SEQ ID NO: 1166521 - RNA, 23 nt, Human
uguguguguguguauauauauau

SEQ ID NO: 1166522 - RNA, 20 nt, Human
uguguguguguguguauaua

SEQ ID NO: 1166523 - RNA, 20 nt, Human
uguuuugcuuuaacagauuu

SEQ ID NO: 1166524 - RNA, 22 nt, Human
uugaaaauaccuguacaaaaau

SEQ ID NO: 1166525 - RNA, 21 nt, Human
uugaacacaguuaaaacacug

SEQ ID NO: 1166526 - RNA, 20 nt, Human
uugaagucaccuccuucagg

SEQ ID NO: 1166527 - RNA, 23 nt, Human
uugaucuuugaaaauauuacaug

SEQ ID NO: 1166528 - RNA, 22 nt, Human
uuggacccaaacagaaauaaaa

SEQ ID NO: 1166529 - RNA, 18 nt, Human
uuuacauauauauauaua

SEQ ID NO: 1166530 - RNA, 21 nt, Human
uuuacauauauauauauacau

SEQ ID NO: 1166531 - RNA, 18 nt, Human
uuucagacaguucaugcu

SEQ ID NO: 1166532 - RNA, 25 nt, Human
uuucauagccugguucagagaaagu

SEQ ID NO: 1166533 - RNA, 21 nt, Human
uuucuuuacauauauauauau

SEQ ID NO: 1166534 - RNA, 20 nt, Human
uuuuuguuuuagccuguguu

SEQ ID NO: 1166535 - RNA, 18 nt, Human
uuuuuucuuuuuuuucuc

SEQ ID NO: 1166536 - RNA, 24 nt, Human
uuuuuuuuuuugaaaugcaagacc

SEQ ID NO: 1166537 - RNA, 19 nt, Human
aaagccucaugagagcagg

SEQ ID NO: 1166538 - RNA, 21 nt, Human
aagaaaaaagcuagacuacgu

SEQ ID NO: 1166539 - RNA, 21 nt, Human
aagacaaagagauaaagagaa

SEQ ID NO: 1166540 - RNA, 19 nt, Human
aagcuuugggggggggggg

SEQ ID NO: 1166541 - RNA, 21 nt, Human
aagcuuugggggggggggggc

SEQ ID NO: 1166542 - RNA, 22 nt, Human
aaguggccccgaaaggcugggu

SEQ ID NO: 1166543 - RNA, 19 nt, Human
aaucuccaucccauguguc

SEQ ID NO: 1166544 - RNA, 19 nt, Human
acaaagaugcuauggcucc

SEQ ID NO: 1166545 - RNA, 20 nt, Human
acaagaagcugguggagcag

SEQ ID NO: 1166546 - RNA, 22 nt, Human
acaguuugugccuucagucucu

SEQ ID NO: 1166547 - RNA, 25 nt, Human
acgaacuucaaagaggagggaacgc

SEQ ID NO: 1166548 - RNA, 23 nt, Human
acucaccacgcagggcuuccccc

SEQ ID NO: 1166549 - RNA, 19 nt, Human
acuucugcucccuucccca

SEQ ID NO: 1166550 - RNA, 23 nt, Human
acuucugcucccuuccccaagag

SEQ ID NO: 1166551 - RNA, 24 nt, Human
agacaaagagauaaagagaaaaca

SEQ ID NO: 1166552 - RNA, 27 nt, Human
agacaaagagauaaagagaagggaccc

SEQ ID NO: 1166553 - RNA, 18 nt, Human
agacagagaaggcagcau

SEQ ID NO: 1166554 - RNA, 18 nt, Human
agagauaaagagaaaaca

SEQ ID NO: 1166555 - RNA, 22 nt, Human
agaugcagccuucucuucucuu

SEQ ID NO: 1166556 - RNA, 20 nt, Human
agcaauaccccuggcuuggu

SEQ ID NO: 1166557 - RNA, 23 nt, Human
agcaccacagggagggguuuagg

SEQ ID NO: 1166558 - RNA, 18 nt, Human
agccuucucuucucucuc

SEQ ID NO: 1166559 - RNA, 26 nt, Human
aggaagcuuugggggggggggggcgg

SEQ ID NO: 1166560 - RNA, 19 nt, Human
aggaaggaagcuuuggggg

SEQ ID NO: 1166561 - RNA, 22 nt, Human
agggaaggaggucaacacagug

SEQ ID NO: 1166562 - RNA, 20 nt, Human
agggggcaggguaaggaggg

SEQ ID NO: 1166563 - RNA, 24 nt, Human
agguagcugaagcagacagagaag

SEQ ID NO: 1166564 - RNA, 19 nt, Human
aggugccuucccagacacc

SEQ ID NO: 1166565 - RNA, 18 nt, Human
aguggacgaggagugugc

SEQ ID NO: 1166566 - RNA, 22 nt, Human
caaggucucucacuuacauccu

SEQ ID NO: 1166567 - RNA, 20 nt, Human
caauagacccacuggcccaa

SEQ ID NO: 1166568 - RNA, 18 nt, Human
cacagugccugacacaag

SEQ ID NO: 1166569 - RNA, 19 nt, Human
caccaagacguggagaccg

SEQ ID NO: 1166570 - RNA, 21 nt, Human
cacuguucuugcuccuggacu

SEQ ID NO: 1166571 - RNA, 27 nt, Human
cacuugaccaaggagcccucaagcaac

SEQ ID NO: 1166572 - RNA, 19 nt, Human
cagcaccugacccuauacc

SEQ ID NO: 1166573 - RNA, 19 nt, Human
cagccuucucuucucucuc

SEQ ID NO: 1166574 - RNA, 18 nt, Human
ccaccgguuauuccuagg

SEQ ID NO: 1166575 - RNA, 21 nt, Human
ccccaaacgccugaaagccuc

SEQ ID NO: 1166576 - RNA, 24 nt, Human
cccccaaacgccugaaagccucau

SEQ ID NO: 1166577 - RNA, 20 nt, Human
ccccuggagcaacacuguuc

SEQ ID NO: 1166578 - RNA, 26 nt, Human
ccccuggagcaacacuguucuugcuc

SEQ ID NO: 1166579 - RNA, 24 nt, Human
cccuauacccaccgguuauuccua

SEQ ID NO: 1166580 - RNA, 21 nt, Human
ccgcauggacuucugcucccu

SEQ ID NO: 1166581 - RNA, 19 nt, Human
ccucaugagagcagguaag

SEQ ID NO: 1166582 - RNA, 19 nt, Human
ccugaccuacaagaaaaaa

SEQ ID NO: 1166583 - RNA, 23 nt, Human
cuccaucccauguguccuaaguu

SEQ ID NO: 1166584 - RNA, 19 nt, Human
cucccaacuucagccccag

SEQ ID NO: 1166585 - RNA, 19 nt, Human
cucucccccucacucacca

SEQ ID NO: 1166586 - RNA, 18 nt, Human
cucucucccccucacuca

SEQ ID NO: 1166587 - RNA, 19 nt, Human
cugaugcgugucucguccu

SEQ ID NO: 1166588 - RNA, 24 nt, Human
cuggagcaacacuguucuugcucc

SEQ ID NO: 1166589 - RNA, 18 nt, Human
cuggcccaaguuccccug

SEQ ID NO: 1166590 - RNA, 19 nt, Human
gacaagggggcaggguaag

SEQ ID NO: 1166591 - RNA, 21 nt, Human
gacaagggggcaggguaagga

SEQ ID NO: 1166592 - RNA, 20 nt, Human
gacuccuccaaggaaaggag

SEQ ID NO: 1166593 - RNA, 18 nt, Human
gagcaauaccccuggcuu

SEQ ID NO: 1166594 - RNA, 21 nt, Human
gaguaugggaggaacaugaaa

SEQ ID NO: 1166595 - RNA, 22 nt, Human
gaucaucucuauaucuaauuug

SEQ ID NO: 1166596 - RNA, 20 nt, Human
gcagagugugcccugacucc

SEQ ID NO: 1166597 - RNA, 25 nt, Human
gcagggcuucccccaaacgccugaa

SEQ ID NO: 1166598 - RNA, 26 nt, Human
gcagggcuucccccaaacgccugaaa

SEQ ID NO: 1166599 - RNA, 24 nt, Human
gcccgcauggacuucugcucccuu

SEQ ID NO: 1166600 - RNA, 19 nt, Human
gccugaaagccucaugaga

SEQ ID NO: 1166601 - RNA, 23 nt, Human
gccuuccacaagaagcuggugga

SEQ ID NO: 1166602 - RNA, 27 nt, Human
gcucuggagccuguaggguccagcccu

SEQ ID NO: 1166603 - RNA, 21 nt, Human
ggaagcuuugggggggggggg

SEQ ID NO: 1166604 - RNA, 24 nt, Human
ggaaggaagcuuuggggggggggg

SEQ ID NO: 1166605 - RNA, 23 nt, Human
ggagagcaccugcggggccugaa

SEQ ID NO: 1166606 - RNA, 19 nt, Human
ggaggaacaugaaagugga

SEQ ID NO: 1166607 - RNA, 18 nt, Human
ggcaaagugcagaaguca

SEQ ID NO: 1166608 - RNA, 24 nt, Human
ggcaaagugcagaagucaucccug

SEQ ID NO: 1166609 - RNA, 19 nt, Human
ggccccgaaaggcugggug

SEQ ID NO: 1166610 - RNA, 23 nt, Human
gggcagggguggugguggauguc

SEQ ID NO: 1166611 - RNA, 24 nt, Human
gggggcgggcaggggugguggugg

SEQ ID NO: 1166612 - RNA, 23 nt, Human
ggggggcgggcaggggugguggu

SEQ ID NO: 1166613 - RNA, 22 nt, Human
gggggggggcgggcaggggugg

SEQ ID NO: 1166614 - RNA, 19 nt, Human
ggggggggggggcgggcag

SEQ ID NO: 1166615 - RNA, 19 nt, Human
gggggggggggggcgggca

SEQ ID NO: 1166616 - RNA, 21 nt, Human
gggggggggggggcgggcagg

SEQ ID NO: 1166617 - RNA, 23 nt, Human
gugacagaagacucaccucuugc

SEQ ID NO: 1166618 - RNA, 18 nt, Human
guggagcagagugugccc

SEQ ID NO: 1166619 - RNA, 26 nt, Human
uaaauaagacacaagacaaagagaua

SEQ ID NO: 1166620 - RNA, 21 nt, Human
uaaguggccccgaaaggcugg

SEQ ID NO: 1166621 - RNA, 18 nt, Human
uagacccacuggcccaag

SEQ ID NO: 1166622 - RNA, 24 nt, Human
uauaaguagcuuaauccaccuucu

SEQ ID NO: 1166623 - RNA, 18 nt, Human
uauauuaguaaugcaaca

SEQ ID NO: 1166624 - RNA, 26 nt, Human
ucacaccccaacagcugggcaaaaug

SEQ ID NO: 1166625 - RNA, 19 nt, Human
uccagccuuccacaagaag

SEQ ID NO: 1166626 - RNA, 21 nt, Human
ucccuucagcaccugacccua

SEQ ID NO: 1166627 - RNA, 18 nt, Human
uccugaccuacaagaaaa

SEQ ID NO: 1166628 - RNA, 22 nt, Human
ucucucucccccucacucacca

SEQ ID NO: 1166629 - RNA, 23 nt, Human
ucugaggccccccaggaagugac

SEQ ID NO: 1166630 - RNA, 20 nt, Human
ucugcucccuuccccaagag

SEQ ID NO: 1166631 - RNA, 24 nt, Human
ucuggagccuguaggguccagccc

SEQ ID NO: 1166632 - RNA, 18 nt, Human
ucuucacaccccaacagc

SEQ ID NO: 1166633 - RNA, 22 nt, Human
ucuucccagccacacucggcuc

SEQ ID NO: 1166634 - RNA, 23 nt, Human
ucuucccagccacacucggcucu

SEQ ID NO: 1166635 - RNA, 20 nt, Human
ucuucucucucccccucacu

SEQ ID NO: 1166636 - RNA, 18 nt, Human
ugaccaaggagcccucaa

SEQ ID NO: 1166637 - RNA, 18 nt, Human
ugccugacacaagguagg

SEQ ID NO: 1166638 - RNA, 22 nt, Human
ugccuucuaggucacuucuccc

SEQ ID NO: 1166639 - RNA, 18 nt, Human
ugcucuggagccuguagg

SEQ ID NO: 1166640 - RNA, 19 nt, Human
ugcuggucccaaggucucu

SEQ ID NO: 1166641 - RNA, 21 nt, Human
uggaaggcaugcucuggagcc

SEQ ID NO: 1166642 - RNA, 19 nt, Human
ugggaggaacaugaaagug

SEQ ID NO: 1166643 - RNA, 21 nt, Human
ugggaggaacaugaaagugga

SEQ ID NO: 1166644 - RNA, 20 nt, Human
ugggggggggggggcgggca

SEQ ID NO: 1166645 - RNA, 21 nt, Human
ugggggggggggggcgggcag

SEQ ID NO: 1166646 - RNA, 22 nt, Human
uuccacaagaagcugguggagc

SEQ ID NO: 1166647 - RNA, 28 nt, Human
uucccagccacacucggcucugaggccc

SEQ ID NO: 1166648 - RNA, 18 nt, Human
uucccucuuagguagcug

SEQ ID NO: 1166649 - RNA, 20 nt, Human
uucuaagugauugacaaggu

SEQ ID NO: 1166650 - RNA, 18 nt, Human
uucucuggagaugcagcc

SEQ ID NO: 1166651 - RNA, 21 nt, Human
uucucuucucucucccccuca

SEQ ID NO: 1166652 - RNA, 24 nt, Human
uugcuggucccaaggucucucacu

SEQ ID NO: 1166653 - RNA, 18 nt, Human
aucccauuuuuuuccaag

SEQ ID NO: 1166654 - RNA, 26 nt, Human
ucagaucccauuuuuuuccaagacuc

SEQ ID NO: 1166655 - RNA, 22 nt, Human
uguucuguacuuucagauccca

SEQ ID NO: 1166656 - RNA, 28 nt, Human
uuaacagucuucaucaauguucauguuc

SEQ ID NO: 1166657 - RNA, 22 nt, Human
gucucuauaaagcuuuuccaaa

SEQ ID NO: 1166658 - RNA, 22 nt, Human
ucacuuuugagguuuuuacaaa

SEQ ID NO: 1166659 - RNA, 25 nt, Human
aaaaaaaaaaaaaaaagcaacugaa

SEQ ID NO: 1166660 - RNA, 24 nt, Human
aaggagcuggcgcccaggccguag

SEQ ID NO: 1166661 - RNA, 18 nt, Human
aaguccuccaccagcccc

SEQ ID NO: 1166662 - RNA, 20 nt, Human
aauggacaugguggaggcag

SEQ ID NO: 1166663 - RNA, 30 nt, Human
aauuguuuuguagcuggaggcaugggcaaa

SEQ ID NO: 1166664 - RNA, 27 nt, Human
accaaaaaaaaaaaaaaaagcaacuga

SEQ ID NO: 1166665 - RNA, 20 nt, Human
accacggcccuggaguagcu

SEQ ID NO: 1166666 - RNA, 18 nt, Human
acucauguucugcauccc

SEQ ID NO: 1166667 - RNA, 18 nt, Human
agccgcugguggucuucg

SEQ ID NO: 1166668 - RNA, 21 nt, Human
agccggcucuccucgcccucc

SEQ ID NO: 1166669 - RNA, 24 nt, Human
aggacgucagaggacucggacacc

SEQ ID NO: 1166670 - RNA, 18 nt, Human
aggaggcaaacuuguugu

SEQ ID NO: 1166671 - RNA, 19 nt, Human
aggcaggaguggaggcagg

SEQ ID NO: 1166672 - RNA, 21 nt, Human
aggcaggcgggccgaaccagg

SEQ ID NO: 1166673 - RNA, 22 nt, Human
aggcaguaaacucccccgcggg

SEQ ID NO: 1166674 - RNA, 23 nt, Human
aggcaguaaacucccccgcgggu

SEQ ID NO: 1166675 - RNA, 20 nt, Human
aggcaugggcaaaggggggg

SEQ ID NO: 1166676 - RNA, 20 nt, Human
aggccggggcuugugaggcc

SEQ ID NO: 1166677 - RNA, 18 nt, Human
aggcuccacuuggucucc

SEQ ID NO: 1166678 - RNA, 23 nt, Human
agggguaggcugggaggggcugc

SEQ ID NO: 1166679 - RNA, 18 nt, Human
auggacaugguggaggca

SEQ ID NO: 1166680 - RNA, 20 nt, Human
caacugaauuguuuuguagc

SEQ ID NO: 1166681 - RNA, 23 nt, Human
caacugaauuguuuuguagcugg

SEQ ID NO: 1166682 - RNA, 20 nt, Human
caccacagccgccgcccagg

SEQ ID NO: 1166683 - RNA, 26 nt, Human
caccacagccgccgcccaggccaccc

SEQ ID NO: 1166684 - RNA, 20 nt, Human
cagcaucuuguucugcugcu

SEQ ID NO: 1166685 - RNA, 21 nt, Human
cagcugccgccuaagguuguu

SEQ ID NO: 1166686 - RNA, 19 nt, Human
cagcugcugcccacuuggg

SEQ ID NO: 1166687 - RNA, 21 nt, Human
cagcugcugcccacuugggag

SEQ ID NO: 1166688 - RNA, 19 nt, Human
cagcuucaguuucuccuag

SEQ ID NO: 1166689 - RNA, 19 nt, Human
caucuuguucugcugcucc

SEQ ID NO: 1166690 - RNA, 24 nt, Human
caugguggaggcaggaguggaggc

SEQ ID NO: 1166691 - RNA, 21 nt, Human
cccacaggccgagcucagacc

SEQ ID NO: 1166692 - RNA, 20 nt, Human
ccccacaggccgagcucaga

SEQ ID NO: 1166693 - RNA, 23 nt, Human
cccgcggguggacugaggccuag

SEQ ID NO: 1166694 - RNA, 23 nt, Human
cccucccaggcucuggggcagcg

SEQ ID NO: 1166695 - RNA, 27 nt, Human
ccgcuggccccaccacagccgccgccc

SEQ ID NO: 1166696 - RNA, 24 nt, Human
ccucccucccaggcucuggggcag

SEQ ID NO: 1166697 - RNA, 21 nt, Human
cgcccaggccaccccgaaagc

SEQ ID NO: 1166698 - RNA, 21 nt, Human
cgcccaggccguagcugaggc

SEQ ID NO: 1166699 - RNA, 21 nt, Human
cgccgcccaggccaccccgaa

SEQ ID NO: 1166700 - RNA, 22 nt, Human
cgucagaggacucggacaccag

SEQ ID NO: 1166701 - RNA, 24 nt, Human
cuccaccagccccuacauguugcc

SEQ ID NO: 1166702 - RNA, 22 nt, Human
cuccaggaaccguaccuugucu

SEQ ID NO: 1166703 - RNA, 21 nt, Human
cucccaugccgcuggccccac

SEQ ID NO: 1166704 - RNA, 25 nt, Human
cucccaugccgcuggccccaccaca

SEQ ID NO: 1166705 - RNA, 19 nt, Human
cuccugggugcacacagcc

SEQ ID NO: 1166706 - RNA, 23 nt, Human
cugccacagcuguucacuugggc

SEQ ID NO: 1166707 - RNA, 21 nt, Human
cuugugaggcccccacaggcc

SEQ ID NO: 1166708 - RNA, 20 nt, Human
gcaugggcaaaggggggguc

SEQ ID NO: 1166709 - RNA, 24 nt, Human
gccggggcuugugaggcccccaca

SEQ ID NO: 1166710 - RNA, 18 nt, Human
ggaccaaaaaaaaaaaaa

SEQ ID NO: 1166711 - RNA, 23 nt, Human
ggaggggcugccacagcuguuca

SEQ ID NO: 1166712 - RNA, 20 nt, Human
ggcccccacaggccgagcuc

SEQ ID NO: 1166713 - RNA, 24 nt, Human
ggccuagggcugagccucaggugg

SEQ ID NO: 1166714 - RNA, 21 nt, Human
gggaggggcugccacagcugu

SEQ ID NO: 1166715 - RNA, 19 nt, Human
gggccgaaccaggcagaga

SEQ ID NO: 1166716 - RNA, 20 nt, Human
gggggccagagguggacacc

SEQ ID NO: 1166717 - RNA, 23 nt, Human
gggggccagagguggacaccuug

SEQ ID NO: 1166718 - RNA, 25 nt, Human
gggguccaccuccaggacaaggggg

SEQ ID NO: 1166719 - RNA, 19 nt, Human
gguggacugaggccuaggg

SEQ ID NO: 1166720 - RNA, 20 nt, Human
gguggacugaggccuagggc

SEQ ID NO: 1166721 - RNA, 21 nt, Human
guccauguugcucccggccgu

SEQ ID NO: 1166722 - RNA, 18 nt, Human
guggaggcaggcgggccg

SEQ ID NO: 1166723 - RNA, 26 nt, Human
uacccugcauagugaccucccuccca

SEQ ID NO: 1166724 - RNA, 21 nt, Human
uagcccagagucuccagcugc

SEQ ID NO: 1166725 - RNA, 22 nt, Human
uagugaccucccucccaggcuc

SEQ ID NO: 1166726 - RNA, 24 nt, Human
ucacaaccacggcccuggaguagc

SEQ ID NO: 1166727 - RNA, 18 nt, Human
ucacuugggcaggacguc

SEQ ID NO: 1166728 - RNA, 22 nt, Human
uccaccagccccuacauguugc

SEQ ID NO: 1166729 - RNA, 27 nt, Human
uccccuaauggacaugguggaggcagg

SEQ ID NO: 1166730 - RNA, 23 nt, Human
uccuucuccugggugcacacagc

SEQ ID NO: 1166731 - RNA, 19 nt, Human
ucuccagcaucuuguucug

SEQ ID NO: 1166732 - RNA, 19 nt, Human
ucugcaucccagacuccag

SEQ ID NO: 1166733 - RNA, 21 nt, Human
ucuuguucugcugcuccagga

SEQ ID NO: 1166734 - RNA, 18 nt, Human
ugaaggaggcaaacuugu

SEQ ID NO: 1166735 - RNA, 22 nt, Human
ugaaggcccgggggccagaggu

SEQ ID NO: 1166736 - RNA, 19 nt, Human
ugaccucccucccaggcuc

SEQ ID NO: 1166737 - RNA, 21 nt, Human
ugaggagcugaugugggcacc

SEQ ID NO: 1166738 - RNA, 18 nt, Human
ugaggccuagggcugagc

SEQ ID NO: 1166739 - RNA, 18 nt, Human
ugccaagcuccgccucca

SEQ ID NO: 1166740 - RNA, 20 nt, Human
ugccacagcuguucacuugg

SEQ ID NO: 1166741 - RNA, 24 nt, Human
ugccacagcuguucacuugggcag

SEQ ID NO: 1166742 - RNA, 22 nt, Human
ugcggcugaaggagcuggcgcc

SEQ ID NO: 1166743 - RNA, 20 nt, Human
ugcucccggccgucuucugc

SEQ ID NO: 1166744 - RNA, 20 nt, Human
ugcuccuucuccugggugca

SEQ ID NO: 1166745 - RNA, 18 nt, Human
uggacugaggccuagggc

SEQ ID NO: 1166746 - RNA, 19 nt, Human
ugggagaagcuugaggagc

SEQ ID NO: 1166747 - RNA, 19 nt, Human
ugggagaagcuugaggagc

SEQ ID NO: 1166748 - RNA, 21 nt, Human
ugggagaagcuugaggagcug

SEQ ID NO: 1166749 - RNA, 24 nt, Human
ugggagaagcuugaggagcugaug

SEQ ID NO: 1166750 - RNA, 22 nt, Human
ugggcaggacgucagaggacuc

SEQ ID NO: 1166751 - RNA, 21 nt, Human
uggugcggcugaaggagcugg

SEQ ID NO: 1166752 - RNA, 19 nt, Human
uucacaaccacggcccugg

SEQ ID NO: 1166753 - RNA, 26 nt, Human
uucguaugaauacucauguucugcau

SEQ ID NO: 1166754 - RNA, 26 nt, Human
uuggaccaaaaaaaaaaaaaaaagca

SEQ ID NO: 1166755 - RNA, 23 nt, Human
uuucuccuagcccagagucucca

SEQ ID NO: 1166756 - RNA, 21 nt, Human
auauugaugauaaaguacauc

SEQ ID NO: 1166757 - RNA, 23 nt, Human
uaacaugcagauagaaaccgccu

SEQ ID NO: 1166758 - RNA, 24 nt, Human
agugacauggaggaagggaaagga

SEQ ID NO: 1166759 - RNA, 21 nt, Human
caagagucuaaggccaggagc

SEQ ID NO: 1166760 - RNA, 19 nt, Human
caagucuugguggcuucuu

SEQ ID NO: 1166761 - RNA, 19 nt, Human
cagaagaucuacauaccau

SEQ ID NO: 1166762 - RNA, 24 nt, Human
cccauccaggagaagaugaaggaa

SEQ ID NO: 1166763 - RNA, 24 nt, Human
gcaagagucuaaggccaggagccc

SEQ ID NO: 1166764 - RNA, 20 nt, Human
gggcaagagucuaaggccag

SEQ ID NO: 1166765 - RNA, 21 nt, Human
uaaacacaagggcaagagucu

SEQ ID NO: 1166766 - RNA, 21 nt, Human
uacuuuguggagucaccauuu

SEQ ID NO: 1166767 - RNA, 18 nt, Human
uccaggagaagaugaagg

SEQ ID NO: 1166768 - RNA, 22 nt, Human
uccaggagaagaugaaggaaug

SEQ ID NO: 1166769 - RNA, 19 nt, Human
ucuccauagaaugcaugcc

SEQ ID NO: 1166770 - RNA, 21 nt, Human
uucccagaagagucuguuuuc

SEQ ID NO: 1166771 - RNA, 24 nt, Human
aaagugcugggauuacagguguga

SEQ ID NO: 1166772 - RNA, 18 nt, Human
aagugcugggauuacagg

SEQ ID NO: 1166773 - RNA, 19 nt, Human
aagugcugggauuacaggu

SEQ ID NO: 1166774 - RNA, 26 nt, Human
aagugcugggauuacaggugugagcc

SEQ ID NO: 1166775 - RNA, 24 nt, Human
accauguuggucaggcuggucucg

SEQ ID NO: 1166776 - RNA, 18 nt, Human
accgcacccagcacacau

SEQ ID NO: 1166777 - RNA, 24 nt, Human
accuugugaucugcccgccucagc

SEQ ID NO: 1166778 - RNA, 21 nt, Human
acgggguuucaccauguuggu

SEQ ID NO: 1166779 - RNA, 23 nt, Human
acgggguuucaccauguugguca

SEQ ID NO: 1166780 - RNA, 24 nt, Human
acgggguuucaccauguuggucag

SEQ ID NO: 1166781 - RNA, 18 nt, Human
agccaccgcacccagcac

SEQ ID NO: 1166782 - RNA, 23 nt, Human
agguggggggcugcgagggcugg

SEQ ID NO: 1166783 - RNA, 22 nt, Human
aguagagacgggguuucaccau

SEQ ID NO: 1166784 - RNA, 22 nt, Human
aguuccaagagguaggacugca

SEQ ID NO: 1166785 - RNA, 24 nt, Human
auuuuuguauuuuuaguagagacg

SEQ ID NO: 1166786 - RNA, 24 nt, Human
caaagugcugggauuacaggugug

SEQ ID NO: 1166787 - RNA, 23 nt, Human
caaccuccaccuccuggguucaa

SEQ ID NO: 1166788 - RNA, 22 nt, Human
caagcauuucuccugccucagc

SEQ ID NO: 1166789 - RNA, 23 nt, Human
caagucccgggcgcacacggaaa

SEQ ID NO: 1166790 - RNA, 21 nt, Human
caccauguuggucaggcuggu

SEQ ID NO: 1166791 - RNA, 24 nt, Human
caccauguuggucaggcuggucuc

SEQ ID NO: 1166792 - RNA, 20 nt, Human
cacccagcacacauuuggcu

SEQ ID NO: 1166793 - RNA, 25 nt, Human
caccgcacccagcacacauuuggcc

SEQ ID NO: 1166794 - RNA, 21 nt, Human
cacgcccagcuaauuuuugua

SEQ ID NO: 1166795 - RNA, 21 nt, Human
cacgugccaucacgcccagcu

SEQ ID NO: 1166796 - RNA, 21 nt, Human
cacugcaaccuccaccuccug

SEQ ID NO: 1166797 - RNA, 23 nt, Human
cacugcaaccuccaccuccuggg

SEQ ID NO: 1166798 - RNA, 20 nt, Human
cagccuccugaguagcugag

SEQ ID NO: 1166799 - RNA, 21 nt, Human
ccaaagugcugggauuacagg

SEQ ID NO: 1166800 - RNA, 21 nt, Human
ccaaagugcugggauuacagg

SEQ ID NO: 1166801 - RNA, 21 nt, Human
ccaaagugcugggauuacagg

SEQ ID NO: 1166802 - RNA, 24 nt, Human
ccaaagugcugggauuacaggugu

SEQ ID NO: 1166803 - RNA, 20 nt, Human
ccaucacgcccagcuaauuu

SEQ ID NO: 1166804 - RNA, 20 nt, Human
ccgcacccagcacacauuug

SEQ ID NO: 1166805 - RNA, 18 nt, Human
ccggcgccugcaaaguuu

SEQ ID NO: 1166806 - RNA, 19 nt, Human
ccuccaccuccuggguuca

SEQ ID NO: 1166807 - RNA, 19 nt, Human
ccugaguagcugagacuac

SEQ ID NO: 1166808 - RNA, 24 nt, Human
ccugaguagcugagacuacaggca

SEQ ID NO: 1166809 - RNA, 23 nt, Human
ccugccucagccuccugaguagc

SEQ ID NO: 1166810 - RNA, 23 nt, Human
ccuggguucaagcauuucuccug

SEQ ID NO: 1166811 - RNA, 24 nt, Human
cgccucagccugccaaagugcugg

SEQ ID NO: 1166812 - RNA, 24 nt, Human
cgggguuucaccauguuggucagg

SEQ ID NO: 1166813 - RNA, 24 nt, Human
cucacugcaaccuccaccuccugg

SEQ ID NO: 1166814 - RNA, 27 nt, Human
cucacugcaaccuccaccuccuggguu

SEQ ID NO: 1166815 - RNA, 24 nt, Human
cuccugaccuugugaucugcccgc

SEQ ID NO: 1166816 - RNA, 22 nt, Human
cuccugccucagccuccugagu

SEQ ID NO: 1166817 - RNA, 23 nt, Human
cuccuggguucaagcauuucucc

SEQ ID NO: 1166818 - RNA, 23 nt, Human
cugcaaccuccaccuccuggguu

SEQ ID NO: 1166819 - RNA, 24 nt, Human
cugcaaccuccaccuccuggguuc

SEQ ID NO: 1166820 - RNA, 23 nt, Human
cugccucagccuccugaguagcu

SEQ ID NO: 1166821 - RNA, 24 nt, Human
gaccuugugaucugcccgccucag

SEQ ID NO: 1166822 - RNA, 23 nt, Human
gagacgggguuucaccauguugg

SEQ ID NO: 1166823 - RNA, 24 nt, Human
gagacgggguuucaccauguuggu

SEQ ID NO: 1166824 - RNA, 25 nt, Human
gaguagcugagacuacaggcacgug

SEQ ID NO: 1166825 - RNA, 18 nt, Human
gauuacaggugugagcca

SEQ ID NO: 1166826 - RNA, 20 nt, Human
gauuacaggugugagccacc

SEQ ID NO: 1166827 - RNA, 23 nt, Human
gauuacaggugugagccaccgca

SEQ ID NO: 1166828 - RNA, 22 nt, Human
gcccagcuaauuuuuguauuuu

SEQ ID NO: 1166829 - RNA, 24 nt, Human
ggacgcggccccaacggauccccg

SEQ ID NO: 1166830 - RNA, 18 nt, Human
ggcccggaaacacgggua

SEQ ID NO: 1166831 - RNA, 20 nt, Human
ggccggggcgaggagguggg

SEQ ID NO: 1166832 - RNA, 25 nt, Human
ggccggggcgaggagguggggggcu

SEQ ID NO: 1166833 - RNA, 23 nt, Human
ggcuggucucgaacuccugaccu

SEQ ID NO: 1166834 - RNA, 18 nt, Human
gggcgaggaggugggggg

SEQ ID NO: 1166835 - RNA, 22 nt, Human
gggcugcgagggcugggcccgg

SEQ ID NO: 1166836 - RNA, 23 nt, Human
gggguuucaccauguuggucagg

SEQ ID NO: 1166837 - RNA, 20 nt, Human
ggucucgaacuccugaccuu

SEQ ID NO: 1166838 - RNA, 23 nt, Human
guagagacgggguuucaccaugu

SEQ ID NO: 1166839 - RNA, 24 nt, Human
gugaucugcccgccucagccugcc

SEQ ID NO: 1166840 - RNA, 24 nt, Human
uaauuuuuguauuuuuaguagaga

SEQ ID NO: 1166841 - RNA, 24 nt, Human
uacaggcacgugccaucacgccca

SEQ ID NO: 1166842 - RNA, 24 nt, Human
uacaggugugagccaccgcaccca

SEQ ID NO: 1166843 - RNA, 22 nt, Human
uagagacgggguuucaccaugu

SEQ ID NO: 1166844 - RNA, 24 nt, Human
uaguagagacgggguuucaccaug

SEQ ID NO: 1166845 - RNA, 26 nt, Human
uaguagagacgggguuucaccauguu

SEQ ID NO: 1166846 - RNA, 23 nt, Human
uaguuccaagagguaggacugca

SEQ ID NO: 1166847 - RNA, 23 nt, Human
ucacugcaaccuccaccuccugg

SEQ ID NO: 1166848 - RNA, 24 nt, Human
ucacugcaaccuccaccuccuggg

SEQ ID NO: 1166849 - RNA, 25 nt, Human
ucacugcaaccuccaccuccugggu

SEQ ID NO: 1166850 - RNA, 27 nt, Human
ucacugcaaccuccaccuccuggguuc

SEQ ID NO: 1166851 - RNA, 18 nt, Human
ucccgggcgcacacggaa

SEQ ID NO: 1166852 - RNA, 24 nt, Human
uccugaguagcugagacuacaggc

SEQ ID NO: 1166853 - RNA, 21 nt, Human
uccuggguucaagcauuucuc

SEQ ID NO: 1166854 - RNA, 22 nt, Human
uccuggguucaagcauuucucc

SEQ ID NO: 1166855 - RNA, 24 nt, Human
uccuggguucaagcauuucuccug

SEQ ID NO: 1166856 - RNA, 19 nt, Human
ucucgaacuccugaccuug

SEQ ID NO: 1166857 - RNA, 21 nt, Human
ucugcccgccucagccugcca

SEQ ID NO: 1166858 - RNA, 21 nt, Human
ugagacuacaggcacgugcca

SEQ ID NO: 1166859 - RNA, 26 nt, Human
ugagacuacaggcacgugccaucacg

SEQ ID NO: 1166860 - RNA, 22 nt, Human
ugcaaaguuucaccaagucccg

SEQ ID NO: 1166861 - RNA, 18 nt, Human
ugcaauggcaugaucucg

SEQ ID NO: 1166862 - RNA, 24 nt, Human
ugccucagccuccugaguagcuga

SEQ ID NO: 1166863 - RNA, 24 nt, Human
ugcugggauuacaggugugagcca

SEQ ID NO: 1166864 - RNA, 18 nt, Human
ugggauuacaggugugag

SEQ ID NO: 1166865 - RNA, 19 nt, Human
ugggauuacaggugugagc

SEQ ID NO: 1166866 - RNA, 21 nt, Human
ugggauuacaggugugagcca

SEQ ID NO: 1166867 - RNA, 22 nt, Human
ugggauuacaggugugagccac

SEQ ID NO: 1166868 - RNA, 23 nt, Human
ugggauuacaggugugagccacc

SEQ ID NO: 1166869 - RNA, 24 nt, Human
ugggauuacaggugugagccaccg

SEQ ID NO: 1166870 - RNA, 22 nt, Human
ugggggacgcggccccaacgga

SEQ ID NO: 1166871 - RNA, 24 nt, Human
ugggggacgcggccccaacggauc

SEQ ID NO: 1166872 - RNA, 24 nt, Human
uggucaggcuggucucgaacuccu

SEQ ID NO: 1166873 - RNA, 18 nt, Human
uuaguagagacgggguuu

SEQ ID NO: 1166874 - RNA, 22 nt, Human
uuaguagagacgggguuucacc

SEQ ID NO: 1166875 - RNA, 24 nt, Human
uuaguagagacgggguuucaccau

SEQ ID NO: 1166876 - RNA, 21 nt, Human
uucaagcauuucuccugccuc

SEQ ID NO: 1166877 - RNA, 23 nt, Human
uuguauuuuuaguagagacgggg

SEQ ID NO: 1166878 - RNA, 24 nt, Human
uuucaccauguuggucaggcuggu

SEQ ID NO: 1166879 - RNA, 24 nt, Human
uuuuuaguagagacgggguuucac

SEQ ID NO: 1166880 - RNA, 20 nt, Human
uuuuuguauuuuuaguagag

SEQ ID NO: 1166881 - RNA, 23 nt, Human
ugaguuuaggcaaaguaggacaa

SEQ ID NO: 1166882 - RNA, 26 nt, Human
aacccuuccuaaugcaggauccccau

SEQ ID NO: 1166883 - RNA, 19 nt, Human
aagcaaugaaccacgaggg

SEQ ID NO: 1166884 - RNA, 21 nt, Human
acacaaucuacuccuugcauc

SEQ ID NO: 1166885 - RNA, 21 nt, Human
acaggaagaggacuaggcuag

SEQ ID NO: 1166886 - RNA, 21 nt, Human
acagggcugcaauucaccagc

SEQ ID NO: 1166887 - RNA, 18 nt, Human
accuguuaacaaaaggca

SEQ ID NO: 1166888 - RNA, 18 nt, Human
acggccugggaccuggcu

SEQ ID NO: 1166889 - RNA, 18 nt, Human
agaauccccuaugggccc

SEQ ID NO: 1166890 - RNA, 22 nt, Human
agcaaggaguguggaagaggga

SEQ ID NO: 1166891 - RNA, 19 nt, Human
agcaaugaaccacgagggu

SEQ ID NO: 1166892 - RNA, 20 nt, Human
agcuguagaauuugugucga

SEQ ID NO: 1166893 - RNA, 19 nt, Human
aggaagaggacuaggcuag

SEQ ID NO: 1166894 - RNA, 19 nt, Human
aggaguguggaagagggag

SEQ ID NO: 1166895 - RNA, 24 nt, Human
agggagaagggguaugguccucuc

SEQ ID NO: 1166896 - RNA, 19 nt, Human
aucauccuggaaauccgcu

SEQ ID NO: 1166897 - RNA, 19 nt, Human
augaaauauccuccaagag

SEQ ID NO: 1166898 - RNA, 18 nt, Human
cacaggaagaggacuagg

SEQ ID NO: 1166899 - RNA, 18 nt, Human
caccugacagcucaggga

SEQ ID NO: 1166900 - RNA, 22 nt, Human
cacgaaggaaagagguguggca

SEQ ID NO: 1166901 - RNA, 22 nt, Human
cagaaucacagcaaggagugug

SEQ ID NO: 1166902 - RNA, 19 nt, Human
cagcaaggaguguggaaga

SEQ ID NO: 1166903 - RNA, 22 nt, Human
caucucuuccucuucauucuug

SEQ ID NO: 1166904 - RNA, 20 nt, Human
caucugagucucugcugugu

SEQ ID NO: 1166905 - RNA, 22 nt, Human
cauucaguugagacgugccacg

SEQ ID NO: 1166906 - RNA, 23 nt, Human
ccccacacacaaucuacuccuug

SEQ ID NO: 1166907 - RNA, 23 nt, Human
ccucucacaaggaggucccaagc

SEQ ID NO: 1166908 - RNA, 20 nt, Human
ccuggaaauccgcugcuucc

SEQ ID NO: 1166909 - RNA, 22 nt, Human
cgggagccugagagucaacccc

SEQ ID NO: 1166910 - RNA, 21 nt, Human
cuaccaaguuggacucuuugc

SEQ ID NO: 1166911 - RNA, 21 nt, Human
cucuacaugacauucucaaga

SEQ ID NO: 1166912 - RNA, 20 nt, Human
cucuccucagaagacauccg

SEQ ID NO: 1166913 - RNA, 24 nt, Human
cugcagccaaccuugacaggaaau

SEQ ID NO: 1166914 - RNA, 21 nt, Human
cugcauggugucucuguaccc

SEQ ID NO: 1166915 - RNA, 20 nt, Human
cugcgugugggcgggcggac

SEQ ID NO: 1166916 - RNA, 19 nt, Human
cuguacccauuaauaccug

SEQ ID NO: 1166917 - RNA, 18 nt, Human
cuucuggcuucacuguga

SEQ ID NO: 1166918 - RNA, 19 nt, Human
cuugcaucuuggacucugu

SEQ ID NO: 1166919 - RNA, 21 nt, Human
cuuucaccaccccacacacaa

SEQ ID NO: 1166920 - RNA, 19 nt, Human
gacccccacuccucaucuc

SEQ ID NO: 1166921 - RNA, 24 nt, Human
gacucuguuuuacuucacagggca

SEQ ID NO: 1166922 - RNA, 18 nt, Human
gagaucagagccucucac

SEQ ID NO: 1166923 - RNA, 23 nt, Human
gcuccugccucggugcgcgcaca

SEQ ID NO: 1166924 - RNA, 20 nt, Human
gcugcaauucaccagcuacc

SEQ ID NO: 1166925 - RNA, 21 nt, Human
ggcgggcggacagccgggagc

SEQ ID NO: 1166926 - RNA, 19 nt, Human
gggcaggcaagagcaugcu

SEQ ID NO: 1166927 - RNA, 24 nt, Human
gggcaggcaagagcaugcuggauu

SEQ ID NO: 1166928 - RNA, 20 nt, Human
gggcccugaugcugauggag

SEQ ID NO: 1166929 - RNA, 21 nt, Human
ggggcaaggcuuggaggggau

SEQ ID NO: 1166930 - RNA, 18 nt, Human
gguguccuuucaccaccc

SEQ ID NO: 1166931 - RNA, 18 nt, Human
gugcugguaggcugcaug

SEQ ID NO: 1166932 - RNA, 24 nt, Human
uaaaaagucaguuaaagagaagca

SEQ ID NO: 1166933 - RNA, 21 nt, Human
uaauggauuuuacagcucauc

SEQ ID NO: 1166934 - RNA, 24 nt, Human
uaauggauuuuacagcucaucuga

SEQ ID NO: 1166935 - RNA, 18 nt, Human
uccauggggcaaggcuug

SEQ ID NO: 1166936 - RNA, 21 nt, Human
ucggugcgcgcacaaugcagg

SEQ ID NO: 1166937 - RNA, 23 nt, Human
ucggugcgcgcacaaugcaggcu

SEQ ID NO: 1166938 - RNA, 19 nt, Human
ucucacaaggaggucccaa

SEQ ID NO: 1166939 - RNA, 22 nt, Human
ugacagcucagggacuaaggcu

SEQ ID NO: 1166940 - RNA, 21 nt, Human
ugagcacauaugcagggcagg

SEQ ID NO: 1166941 - RNA, 26 nt, Human
ugaggagcuguagaauuugggucggc

SEQ ID NO: 1166942 - RNA, 20 nt, Human
ugaugaugucauaucucauc

SEQ ID NO: 1166943 - RNA, 18 nt, Human
ugcaaacacgaaggaaag

SEQ ID NO: 1166944 - RNA, 20 nt, Human
ugcaagaaacagggagaagg

SEQ ID NO: 1166945 - RNA, 25 nt, Human
ugcccuguguccuccguccuucccc

SEQ ID NO: 1166946 - RNA, 23 nt, Human
ugcgacggauaaaagagggacac

SEQ ID NO: 1166947 - RNA, 22 nt, Human
ugcgcgcacaaugcaggcugcg

SEQ ID NO: 1166948 - RNA, 18 nt, Human
uggcugccuuugaugaug

SEQ ID NO: 1166949 - RNA, 23 nt, Human
ugggaagggaggcacugaugcuc

SEQ ID NO: 1166950 - RNA, 23 nt, Human
uguggcagcugcgugcagccggu

SEQ ID NO: 1166951 - RNA, 20 nt, Human
uuacagggcugcaauucacc

SEQ ID NO: 1166952 - RNA, 24 nt, Human
uucacugugacacacauuuaucuc

SEQ ID NO: 1166953 - RNA, 20 nt, Human
uucaugcaagaaacagggag

SEQ ID NO: 1166954 - RNA, 24 nt, Human
uuuaaaaagucaguuaaagagaag

SEQ ID NO: 1166955 - RNA, 25 nt, Human
aaaaauaaaauccacucacucugcu

SEQ ID NO: 1166956 - RNA, 23 nt, Human
aagcauuccacagcaucagauuc

SEQ ID NO: 1166957 - RNA, 22 nt, Human
acuacacuucaaaugcagaaca

SEQ ID NO: 1166958 - RNA, 19 nt, Human
agaugccagggacauaugg

SEQ ID NO: 1166959 - RNA, 28 nt, Human
auaaaucaacagcuucaacucgcacuca

SEQ ID NO: 1166960 - RNA, 20 nt, Human
caacagcuucaacucgcacu

SEQ ID NO: 1166961 - RNA, 19 nt, Human
caacucgcacucaaagucu

SEQ ID NO: 1166962 - RNA, 22 nt, Human
cacagcaucagauuccagcagg

SEQ ID NO: 1166963 - RNA, 20 nt, Human
cacgcccuucccccacaacc

SEQ ID NO: 1166964 - RNA, 18 nt, Human
cagaagcaaauaaaaaaa

SEQ ID NO: 1166965 - RNA, 25 nt, Human
cagaagcaaauaaaaaaaaaagaug

SEQ ID NO: 1166966 - RNA, 18 nt, Human
caggagcuggcugguugg

SEQ ID NO: 1166967 - RNA, 24 nt, Human
caucaacaauaacaaaaaauaaaa

SEQ ID NO: 1166968 - RNA, 20 nt, Human
ccaaauguuacagugaccac

SEQ ID NO: 1166969 - RNA, 23 nt, Human
ccaagguagggaugauuuucuuu

SEQ ID NO: 1166970 - RNA, 18 nt, Human
ccagcaggagcuggcugg

SEQ ID NO: 1166971 - RNA, 25 nt, Human
cccaccccccaaauguuacagugac

SEQ ID NO: 1166972 - RNA, 22 nt, Human
ccucccugucccaccccccaaa

SEQ ID NO: 1166973 - RNA, 24 nt, Human
ccucccugucccaccccccaaaug

SEQ ID NO: 1166974 - RNA, 18 nt, Human
ccucuuccaagguaggga

SEQ ID NO: 1166975 - RNA, 25 nt, Human
cucaaagucucuuccuuuauagugu

SEQ ID NO: 1166976 - RNA, 18 nt, Human
cucccugucccacccccc

SEQ ID NO: 1166977 - RNA, 21 nt, Human
cuggaggcccucuuccaaggu

SEQ ID NO: 1166978 - RNA, 22 nt, Human
cugguuggagugaguaauggca

SEQ ID NO: 1166979 - RNA, 19 nt, Human
gcagaacaccuacaaagca

SEQ ID NO: 1166980 - RNA, 25 nt, Human
gggaugagaacagcauuccuagaaa

SEQ ID NO: 1166981 - RNA, 21 nt, Human
uaaaaagagcauuauauucug

SEQ ID NO: 1166982 - RNA, 27 nt, Human
uaaacagaagcaaauaaaaaaaaaaga

SEQ ID NO: 1166983 - RNA, 23 nt, Human
uaacaaaaaauaaaauccacuca

SEQ ID NO: 1166984 - RNA, 20 nt, Human
uacagugaccacaaagcaag

SEQ ID NO: 1166985 - RNA, 18 nt, Human
uagcaccuuugaccccaa

SEQ ID NO: 1166986 - RNA, 30 nt, Human
ucacucugcugcuguuucaaaauuucaauu

SEQ ID NO: 1166987 - RNA, 21 nt, Human
ucagauuccagcaggagcugg

SEQ ID NO: 1166988 - RNA, 22 nt, Human
ucuuuagaauuucuccaauugu

SEQ ID NO: 1166989 - RNA, 24 nt, Human
ucuuugauuuuagcaccuuugacc

SEQ ID NO: 1166990 - RNA, 18 nt, Human
ugaacagaugccagggac

SEQ ID NO: 1166991 - RNA, 21 nt, Human
ugaacagaugccagggacaua

SEQ ID NO: 1166992 - RNA, 25 nt, Human
ugaacagaugccagggacauaugga

SEQ ID NO: 1166993 - RNA, 28 nt, Human
ugaguaauggcaacuggaggcccucuuc

SEQ ID NO: 1166994 - RNA, 21 nt, Human
ugggaucauaaggcugugcag

SEQ ID NO: 1166995 - RNA, 20 nt, Human
uucacuacacuucaaaugca

SEQ ID NO: 1166996 - RNA, 24 nt, Human
uuccaagguagggaugauuuucuu

SEQ ID NO: 1166997 - RNA, 19 nt, Human
uugcacgcccuucccccac

SEQ ID NO: 1166998 - RNA, 21 nt, Human
uuuaaaccaucaacaauaaca

SEQ ID NO: 1166999 - RNA, 21 nt, Human
aagaaauauagugacucucau

SEQ ID NO: 1167000 - RNA, 18 nt, Human
cauuucuguuuaaaaguu

SEQ ID NO: 1167001 - RNA, 21 nt, Human
uaaauuuuaaaccuaggguca

SEQ ID NO: 1167002 - RNA, 23 nt, Human
ucuaaauuuuaaaccuaggguca

SEQ ID NO: 1167003 - RNA, 26 nt, Human
ucugaugcuuuucuggggccucuuuu

SEQ ID NO: 1167004 - RNA, 18 nt, Human
uggaauggagcuaagaaa

SEQ ID NO: 1167005 - RNA, 20 nt, Human
uggagcuaagaaauauagug

SEQ ID NO: 1167006 - RNA, 24 nt, Human
uuaaaaguuucccuuuuuuucuga

SEQ ID NO: 1167007 - RNA, 24 nt, Human
uuuuauaauuucugucugucagaa

SEQ ID NO: 1167008 - RNA, 25 nt, Human
aaacaaaaaagggauuuaauguuga

SEQ ID NO: 1167009 - RNA, 27 nt, Human
acuuuaaaagagaaaaacaaaaaaggg

SEQ ID NO: 1167010 - RNA, 18 nt, Human
agagaaaaacaaaaaagg

SEQ ID NO: 1167011 - RNA, 25 nt, Human
agagaaaaacaaaaaagggauuuaa

SEQ ID NO: 1167012 - RNA, 18 nt, Human
agagaaguuaagugcucu

SEQ ID NO: 1167013 - RNA, 21 nt, Human
agagaaguuaagugcucugag

SEQ ID NO: 1167014 - RNA, 21 nt, Human
auaauggucaauuguaaacac

SEQ ID NO: 1167015 - RNA, 21 nt, Human
cggggccaggccacauccauc

SEQ ID NO: 1167016 - RNA, 19 nt, Human
cuggggaauuggcaggcuc

SEQ ID NO: 1167017 - RNA, 21 nt, Human
ucaggagucuccuuugucucu

SEQ ID NO: 1167018 - RNA, 20 nt, Human
ucccucaggagucuccuuug

SEQ ID NO: 1167019 - RNA, 21 nt, Human
ugggaaaaugcuuagcucugg

SEQ ID NO: 1167020 - RNA, 22 nt, Human
uggucaauuguaaacacacuuu

SEQ ID NO: 1167021 - RNA, 24 nt, Human
uguuuuguuuuuuuugcuuuuucc

SEQ ID NO: 1167022 - RNA, 23 nt, Human
uugacacugggaaaaugcuuagc

SEQ ID NO: 1167023 - RNA, 21 nt, Human
aaagcucuuugaugccagccu

SEQ ID NO: 1167024 - RNA, 18 nt, Human
acagugaggagcacgcac

SEQ ID NO: 1167025 - RNA, 21 nt, Human
agcccagagcucacuggcccc

SEQ ID NO: 1167026 - RNA, 22 nt, Human
agggaguggcugagcccagagc

SEQ ID NO: 1167027 - RNA, 22 nt, Human
agugacucaugaggcaucccag

SEQ ID NO: 1167028 - RNA, 19 nt, Human
cagagcucacuggccccuc

SEQ ID NO: 1167029 - RNA, 22 nt, Human
ccaaaggccaaacaucugcagc

SEQ ID NO: 1167030 - RNA, 18 nt, Human
cccucccggagccggggc

SEQ ID NO: 1167031 - RNA, 19 nt, Human
ccucagacagaggagugaa

SEQ ID NO: 1167032 - RNA, 19 nt, Human
cgagcgcgccgcaagaccg

SEQ ID NO: 1167033 - RNA, 19 nt, Human
cugagcccagagcucacug

SEQ ID NO: 1167034 - RNA, 24 nt, Human
cugagcccagagcucacuggcccc

SEQ ID NO: 1167035 - RNA, 18 nt, Human
gcaggagcggggaaaaac

SEQ ID NO: 1167036 - RNA, 20 nt, Human
gcaucagaagggccacguca

SEQ ID NO: 1167037 - RNA, 19 nt, Human
gcucacuggccccucccca

SEQ ID NO: 1167038 - RNA, 18 nt, Human
ggcagugcccacuuagag

SEQ ID NO: 1167039 - RNA, 21 nt, Human
ggccccuccccauccucagac

SEQ ID NO: 1167040 - RNA, 20 nt, Human
ggggaaaaaccuggucggug

SEQ ID NO: 1167041 - RNA, 19 nt, Human
ggugcaggagcggggaaaa

SEQ ID NO: 1167042 - RNA, 24 nt, Human
gugauuuaaucacucaacagacac

SEQ ID NO: 1167043 - RNA, 24 nt, Human
gugcugagaggagacuggaggcac

SEQ ID NO: 1167044 - RNA, 20 nt, Human
uagagucaguggggcauggc

SEQ ID NO: 1167045 - RNA, 21 nt, Human
ucacuggccccuccccauccu

SEQ ID NO: 1167046 - RNA, 20 nt, Human
ucagaagggccacgucagug

SEQ ID NO: 1167047 - RNA, 21 nt, Human
ucucugggugguuucuggcuc

SEQ ID NO: 1167048 - RNA, 19 nt, Human
ugagaggagacuggaggca

SEQ ID NO: 1167049 - RNA, 18 nt, Human
ugauuuaaucacucaaca

SEQ ID NO: 1167050 - RNA, 18 nt, Human
ugcugcagaccugaggau

SEQ ID NO: 1167051 - RNA, 21 nt, Human
uggagguccaaaggccaaaca

SEQ ID NO: 1167052 - RNA, 21 nt, Human
uggucaggacuucucagcugg

SEQ ID NO: 1167053 - RNA, 24 nt, Human
uuacuugagacuggagggaguggc

SEQ ID NO: 1167054 - RNA, 18 nt, Human
uuagagucaguggggcau

SEQ ID NO: 1167055 - RNA, 19 nt, Human
uucucagcuggaccaaaca

SEQ ID NO: 1167056 - RNA, 19 nt, Human
aaaaggagggggaagagua

SEQ ID NO: 1167057 - RNA, 22 nt, Human
aaacaccaagcuucacaaagaa

SEQ ID NO: 1167058 - RNA, 18 nt, Human
aaagaaguaagcuccaca

SEQ ID NO: 1167059 - RNA, 19 nt, Human
aaagugcuaggauuacagg

SEQ ID NO: 1167060 - RNA, 24 nt, Human
aaagugcuaggauuacaggcauga

SEQ ID NO: 1167061 - RNA, 22 nt, Human
aacaguauucaucacaagcuga

SEQ ID NO: 1167062 - RNA, 19 nt, Human
aaccucagaucacugaaag

SEQ ID NO: 1167063 - RNA, 21 nt, Human
aagcugacugaaggguccuug

SEQ ID NO: 1167064 - RNA, 21 nt, Human
aagcuucacaaagaaguaagc

SEQ ID NO: 1167065 - RNA, 24 nt, Human
aaggagcacuuccaaaaccugugc

SEQ ID NO: 1167066 - RNA, 19 nt, Human
aaguagcuuggguuacagg

SEQ ID NO: 1167067 - RNA, 26 nt, Human
aagugcuaggauuacaggcaugagcc

SEQ ID NO: 1167068 - RNA, 23 nt, Human
aaugauaggcacagaugaaaaga

SEQ ID NO: 1167069 - RNA, 19 nt, Human
acaauucauuaacuacuga

SEQ ID NO: 1167070 - RNA, 23 nt, Human
acacugauguauuugcugcaggc

SEQ ID NO: 1167071 - RNA, 18 nt, Human
acagugugcuugucaaau

SEQ ID NO: 1167072 - RNA, 20 nt, Human
accauguuggccaggcuggc

SEQ ID NO: 1167073 - RNA, 24 nt, Human
acccaggcuggagugcaguggcgu

SEQ ID NO: 1167074 - RNA, 21 nt, Human
acccuacccucaacucccagc

SEQ ID NO: 1167075 - RNA, 23 nt, Human
acucaguccugccacaauucauu

SEQ ID NO: 1167076 - RNA, 20 nt, Human
acugaaggguccuugggccu

SEQ ID NO: 1167077 - RNA, 24 nt, Human
acugcuucagacucccaaguagcu

SEQ ID NO: 1167078 - RNA, 18 nt, Human
agaaccagcugccuuaaa

SEQ ID NO: 1167079 - RNA, 21 nt, Human
agaagagaaccagcugccuua

SEQ ID NO: 1167080 - RNA, 19 nt, Human
agacacacccugggccaga

SEQ ID NO: 1167081 - RNA, 21 nt, Human
agaggaggaggagcgagaugg

SEQ ID NO: 1167082 - RNA, 21 nt, Human
agcacuuccaaaaccugugca

SEQ ID NO: 1167083 - RNA, 24 nt, Human
agcggguuucaccauguuggccag

SEQ ID NO: 1167084 - RNA, 20 nt, Human
agcugacugaaggguccuug

SEQ ID NO: 1167085 - RNA, 21 nt, Human
agcuuggauuaaauggcugug

SEQ ID NO: 1167086 - RNA, 21 nt, Human
aggagcacuuccaaaaccugu

SEQ ID NO: 1167087 - RNA, 18 nt, Human
aggcuggagugcaguggc

SEQ ID NO: 1167088 - RNA, 22 nt, Human
agugcaguggcgugacucggcu

SEQ ID NO: 1167089 - RNA, 23 nt, Human
agugcaguggcgugacucggcuc

SEQ ID NO: 1167090 - RNA, 23 nt, Human
augaaacaccaagcuucacaaag

SEQ ID NO: 1167091 - RNA, 21 nt, Human
augaaggacagcuuuccauaa

SEQ ID NO: 1167092 - RNA, 20 nt, Human
auggauuaauaucaaauuga

SEQ ID NO: 1167093 - RNA, 24 nt, Human
caaagugcuaggauuacaggcaug

SEQ ID NO: 1167094 - RNA, 20 nt, Human
caaaugaaacaccaagcuuc

SEQ ID NO: 1167095 - RNA, 19 nt, Human
caaauugaaaggagcacuu

SEQ ID NO: 1167096 - RNA, 19 nt, Human
caacaguauucaucacaag

SEQ ID NO: 1167097 - RNA, 24 nt, Human
caaccuccaccuccuggguuuaag

SEQ ID NO: 1167098 - RNA, 18 nt, Human
caccacaccccaccaggc

SEQ ID NO: 1167099 - RNA, 19 nt, Human
caccacaccccaccaggca

SEQ ID NO: 1167100 - RNA, 25 nt, Human
caccacccuacccucaacucccagc

SEQ ID NO: 1167101 - RNA, 18 nt, Human
caccauguuggccaggcu

SEQ ID NO: 1167102 - RNA, 21 nt, Human
caccauguuggccaggcuggc

SEQ ID NO: 1167103 - RNA, 21 nt, Human
caccauguuggccaggcuggc

SEQ ID NO: 1167104 - RNA, 31 nt, Human
caccauguuggccaggcuggcguugaacucc

SEQ ID NO: 1167105 - RNA, 24 nt, Human
cacccaggcuggagugcaguggcg

SEQ ID NO: 1167106 - RNA, 22 nt, Human
cacccuacccucaacucccagc

SEQ ID NO: 1167107 - RNA, 21 nt, Human
cacugcaaccuccaccuccug

SEQ ID NO: 1167108 - RNA, 23 nt, Human
cacugcaaccuccaccuccuggg

SEQ ID NO: 1167109 - RNA, 18 nt, Human
cacuguccugaagggaga

SEQ ID NO: 1167110 - RNA, 24 nt, Human
cacuguccugaagggagaguccca

SEQ ID NO: 1167111 - RNA, 21 nt, Human
cagagggauagagaaccaagu

SEQ ID NO: 1167112 - RNA, 18 nt, Human
cauauacaccagcccuag

SEQ ID NO: 1167113 - RNA, 24 nt, Human
cauguuggccaggcuggcguugaa

SEQ ID NO: 1167114 - RNA, 19 nt, Human
ccaaagugcuaggauuaca

SEQ ID NO: 1167115 - RNA, 24 nt, Human
ccaaagugcuaggauuacaggcau

SEQ ID NO: 1167116 - RNA, 18 nt, Human
ccacaccccaccaggcau

SEQ ID NO: 1167117 - RNA, 24 nt, Human
ccaccuccuggguuuaagcgauuc

SEQ ID NO: 1167118 - RNA, 22 nt, Human
cccaaguagcuuggguuacagg

SEQ ID NO: 1167119 - RNA, 23 nt, Human
cccaaguagcuuggguuacaggu

SEQ ID NO: 1167120 - RNA, 18 nt, Human
cccacacaaaaaagcacc

SEQ ID NO: 1167121 - RNA, 24 nt, Human
cccacacaaaaaagcaccuucaua

SEQ ID NO: 1167122 - RNA, 24 nt, Human
ccccaaagugcuaggauuacaggc

SEQ ID NO: 1167123 - RNA, 22 nt, Human
ccuccuggguuuaagcgauucu

SEQ ID NO: 1167124 - RNA, 20 nt, Human
ccucuacugauuguccuccc

SEQ ID NO: 1167125 - RNA, 22 nt, Human
ccucuacugauuguccucccca

SEQ ID NO: 1167126 - RNA, 23 nt, Human
ccugaccuaaagugaucugccug

SEQ ID NO: 1167127 - RNA, 22 nt, Human
ccugacuuggucccccaaagug

SEQ ID NO: 1167128 - RNA, 22 nt, Human
cggguuucaccauguuggccag

SEQ ID NO: 1167129 - RNA, 21 nt, Human
cuaggucuuggcuuaaccugg

SEQ ID NO: 1167130 - RNA, 21 nt, Human
cuauacaguagaacugacauu

SEQ ID NO: 1167131 - RNA, 22 nt, Human
cuaugggccuugggugagauuc

SEQ ID NO: 1167132 - RNA, 24 nt, Human
cucacugcaaccuccaccuccugg

SEQ ID NO: 1167133 - RNA, 19 nt, Human
cucagaauuggaacagagg

SEQ ID NO: 1167134 - RNA, 19 nt, Human
cucccugcuaagcuugucc

SEQ ID NO: 1167135 - RNA, 21 nt, Human
cuccuggguuuaagcgauucu

SEQ ID NO: 1167136 - RNA, 20 nt, Human
cucugucacccaggcuggag

SEQ ID NO: 1167137 - RNA, 22 nt, Human
cugacaccacccuacccucaac

SEQ ID NO: 1167138 - RNA, 23 nt, Human
cugcaaccuccaccuccuggguu

SEQ ID NO: 1167139 - RNA, 21 nt, Human
cuggcuucaagugugacucag

SEQ ID NO: 1167140 - RNA, 18 nt, Human
cugucacccaggcuggag

SEQ ID NO: 1167141 - RNA, 21 nt, Human
cuugcucugucacccaggcug

SEQ ID NO: 1167142 - RNA, 18 nt, Human
gaccacgguaccugguuu

SEQ ID NO: 1167143 - RNA, 21 nt, Human
gagauggagucuugcucuguc

SEQ ID NO: 1167144 - RNA, 22 nt, Human
gaucacugaaagaggcacuuaa

SEQ ID NO: 1167145 - RNA, 18 nt, Human
gauuacaggcaugagcca

SEQ ID NO: 1167146 - RNA, 21 nt, Human
gauuacaggcaugagccacca

SEQ ID NO: 1167147 - RNA, 22 nt, Human
gauuacaggcaugagccaccac

SEQ ID NO: 1167148 - RNA, 21 nt, Human
gcaaccuccaccuccuggguu

SEQ ID NO: 1167149 - RNA, 20 nt, Human
gccacaauucauuaacuacu

SEQ ID NO: 1167150 - RNA, 20 nt, Human
gccaccacaccccaccaggc

SEQ ID NO: 1167151 - RNA, 23 nt, Human
gcggguuucaccauguuggccag

SEQ ID NO: 1167152 - RNA, 25 nt, Human
gcucugucacccaggcuggagugca

SEQ ID NO: 1167153 - RNA, 19 nt, Human
gcugcaggccugggguggu

SEQ ID NO: 1167154 - RNA, 19 nt, Human
gcuggagugcaguggcgug

SEQ ID NO: 1167155 - RNA, 21 nt, Human
gcuucaagugugacucagcac

SEQ ID NO: 1167156 - RNA, 23 nt, Human
gcuuggauuaaauggcugugugu

SEQ ID NO: 1167157 - RNA, 19 nt, Human
ggacucagaauuggaacag

SEQ ID NO: 1167158 - RNA, 19 nt, Human
ggauuacaggcaugagcca

SEQ ID NO: 1167159 - RNA, 22 nt, Human
ggauuacaggcaugagccacca

SEQ ID NO: 1167160 - RNA, 19 nt, Human
ggccaggcuggcguugaac

SEQ ID NO: 1167161 - RNA, 22 nt, Human
ggguuucaccauguuggccagg

SEQ ID NO: 1167162 - RNA, 18 nt, Human
ggucuuggcuuaaccugg

SEQ ID NO: 1167163 - RNA, 24 nt, Human
gguuacaggugaccgccaccauac

SEQ ID NO: 1167164 - RNA, 21 nt, Human
uaaauggcuguguguguguau

SEQ ID NO: 1167165 - RNA, 19 nt, Human
uaaccuggucccugccucu

SEQ ID NO: 1167166 - RNA, 19 nt, Human
uaagaagauagaaaagaca

SEQ ID NO: 1167167 - RNA, 23 nt, Human
uacaggcaugagccaccacaccc

SEQ ID NO: 1167168 - RNA, 22 nt, Human
uacuuuggcuuuguuuuuauuc

SEQ ID NO: 1167169 - RNA, 22 nt, Human
uagcucccugcuaagcuugucc

SEQ ID NO: 1167170 - RNA, 18 nt, Human
uaggauuacaggcaugag

SEQ ID NO: 1167171 - RNA, 22 nt, Human
uaggauuacaggcaugagccac

SEQ ID NO: 1167172 - RNA, 24 nt, Human
uaggauuacaggcaugagccacca

SEQ ID NO: 1167173 - RNA, 24 nt, Human
uaggauuacaggcaugagccacca

SEQ ID NO: 1167174 - RNA, 24 nt, Human
uaguagacagcggguuucaccaug

SEQ ID NO: 1167175 - RNA, 23 nt, Human
uauaguagcuucuuuccaaaggg

SEQ ID NO: 1167176 - RNA, 22 nt, Human
uauucagugcuuugccauuuca

SEQ ID NO: 1167177 - RNA, 18 nt, Human
ucaaugccuauggaggga

SEQ ID NO: 1167178 - RNA, 24 nt, Human
ucacccaggcuggagugcaguggc

SEQ ID NO: 1167179 - RNA, 23 nt, Human
ucacugcaaccuccaccuccugg

SEQ ID NO: 1167180 - RNA, 24 nt, Human
ucacugcaaccuccaccuccuggg

SEQ ID NO: 1167181 - RNA, 25 nt, Human
ucacugcaaccuccaccuccugggu

SEQ ID NO: 1167182 - RNA, 22 nt, Human
ucacugcuuaaauagaguaguu

SEQ ID NO: 1167183 - RNA, 19 nt, Human
ucagagacaugcuggcuuc

SEQ ID NO: 1167184 - RNA, 21 nt, Human
ucagaguaagcaugggaaucc

SEQ ID NO: 1167185 - RNA, 21 nt, Human
ucagcacauccccagcuaugc

SEQ ID NO: 1167186 - RNA, 22 nt, Human
ucaucuauuccaaugacuugga

SEQ ID NO: 1167187 - RNA, 23 nt, Human
ucccaaguagcuuggguuacagg

SEQ ID NO: 1167188 - RNA, 18 nt, Human
ucccagcagcugccaugu

SEQ ID NO: 1167189 - RNA, 23 nt, Human
ucccagcagcugccauguggugc

SEQ ID NO: 1167190 - RNA, 19 nt, Human
uccuggguuuaagcgauuc

SEQ ID NO: 1167191 - RNA, 20 nt, Human
ucuacugauuguccucccca

SEQ ID NO: 1167192 - RNA, 20 nt, Human
ucucacugcuuaaauagagu

SEQ ID NO: 1167193 - RNA, 24 nt, Human
ucugucacccaggcuggagugcag

SEQ ID NO: 1167194 - RNA, 23 nt, Human
ucuugcucugucacccaggcugg

SEQ ID NO: 1167195 - RNA, 24 nt, Human
ucuugcucugucacccaggcugga

SEQ ID NO: 1167196 - RNA, 21 nt, Human
ucuugggguccaugauucgag

SEQ ID NO: 1167197 - RNA, 23 nt, Human
ugaaacaccaagcuucacaaaga

SEQ ID NO: 1167198 - RNA, 23 nt, Human
ugaaagaggcacuuaagaagaua

SEQ ID NO: 1167199 - RNA, 21 nt, Human
ugaagacaguuuuaguaaaca

SEQ ID NO: 1167200 - RNA, 19 nt, Human
ugaagcauagcucccugcu

SEQ ID NO: 1167201 - RNA, 22 nt, Human
ugaaggguccuugggccuugag

SEQ ID NO: 1167202 - RNA, 21 nt, Human
ugaauacucaagguaggauuu

SEQ ID NO: 1167203 - RNA, 18 nt, Human
ugacaccacccuacccuc

SEQ ID NO: 1167204 - RNA, 20 nt, Human
ugacaccacccuacccucaa

SEQ ID NO: 1167205 - RNA, 21 nt, Human
ugacaccacccuacccucaac

SEQ ID NO: 1167206 - RNA, 18 nt, Human
ugaccuaaagugaucugc

SEQ ID NO: 1167207 - RNA, 24 nt, Human
ugacucagcacauccccagcuaug

SEQ ID NO: 1167208 - RNA, 18 nt, Human
ugacucggcucacugcaa

SEQ ID NO: 1167209 - RNA, 23 nt, Human
ugacuuggucccccaaagugcua

SEQ ID NO: 1167210 - RNA, 22 nt, Human
ugagagagagagaagagaaaua

SEQ ID NO: 1167211 - RNA, 23 nt, Human
ugagagagagagaagagaaauac

SEQ ID NO: 1167212 - RNA, 18 nt, Human
ugcccacacaaaaaagca

SEQ ID NO: 1167213 - RNA, 20 nt, Human
ugcugcccugucagaaaagc

SEQ ID NO: 1167214 - RNA, 19 nt, Human
ugcuggcuaugaugagaga

SEQ ID NO: 1167215 - RNA, 26 nt, Human
ugcuugagaaaaggagggggaagagu

SEQ ID NO: 1167216 - RNA, 25 nt, Human
ugcuuugccauuucaaaaaauuuca

SEQ ID NO: 1167217 - RNA, 18 nt, Human
uggaaagauccuugguuu

SEQ ID NO: 1167218 - RNA, 21 nt, Human
uggagaggacagugugcuugu

SEQ ID NO: 1167219 - RNA, 19 nt, Human
uggagucuugcucugucac

SEQ ID NO: 1167220 - RNA, 21 nt, Human
uggagugcaguggcgugacuc

SEQ ID NO: 1167221 - RNA, 23 nt, Human
uggagugcaguggcgugacucgg

SEQ ID NO: 1167222 - RNA, 26 nt, Human
uggaugguauuacuggacuuuuccug

SEQ ID NO: 1167223 - RNA, 24 nt, Human
uggccaggcuggcguugaacuccu

SEQ ID NO: 1167224 - RNA, 20 nt, Human
uggcuguguguguguaugug

SEQ ID NO: 1167225 - RNA, 21 nt, Human
ugggguggugguggguccugg

SEQ ID NO: 1167226 - RNA, 18 nt, Human
ugguagcuagacaguacu

SEQ ID NO: 1167227 - RNA, 25 nt, Human
ugguggggagagugcagugauugug

SEQ ID NO: 1167228 - RNA, 22 nt, Human
uguggugcugagagaagaucug

SEQ ID NO: 1167229 - RNA, 24 nt, Human
uuaguagacagcggguuucaccau

SEQ ID NO: 1167230 - RNA, 21 nt, Human
uuagucaaugccuauggaggg

SEQ ID NO: 1167231 - RNA, 18 nt, Human
uugagaaaaggaggggga

SEQ ID NO: 1167232 - RNA, 24 nt, Human
uugcucugucacccaggcuggagu

SEQ ID NO: 1167233 - RNA, 21 nt, Human
uuggguuacaggugaccgcca

SEQ ID NO: 1167234 - RNA, 22 nt, Human
uuggguuacaggugaccgccac

SEQ ID NO: 1167235 - RNA, 19 nt, Human
uuggucccccaaagugcua

SEQ ID NO: 1167236 - RNA, 23 nt, Human
uuuaagcgauucuacugcuucag

SEQ ID NO: 1167237 - RNA, 26 nt, Human
uuuauauuuauucagugcuuugccau

SEQ ID NO: 1167238 - RNA, 26 nt, Human
uuucaccauguuggccaggcuggcgu

SEQ ID NO: 1167239 - RNA, 19 nt, Human
uuuguggaaagauccuugg

SEQ ID NO: 1167240 - RNA, 24 nt, Human
uuuuuaguagacagcggguuucac

SEQ ID NO: 1167241 - RNA, 25 nt, Human
uuuuugaagaaaacuaauuagcaug

SEQ ID NO: 1167242 - RNA, 22 nt, Human
uuuuuuguauuuuuaguagaca

SEQ ID NO: 1167243 - RNA, 23 nt, Human
aaaaaacacccccaaacaaaaaa

SEQ ID NO: 1167244 - RNA, 24 nt, Human
aaaaaacacccccaaacaaaaaac

SEQ ID NO: 1167245 - RNA, 18 nt, Human
aaaaaccaccacaggcaa

SEQ ID NO: 1167246 - RNA, 23 nt, Human
aaaacaaacaaacaaaaaauccc

SEQ ID NO: 1167247 - RNA, 18 nt, Human
aaaacacccccaaacaaa

SEQ ID NO: 1167248 - RNA, 21 nt, Human
aaaaccaaaaccaaaccaaaa

SEQ ID NO: 1167249 - RNA, 20 nt, Human
aaaauccuugaccugaugua

SEQ ID NO: 1167250 - RNA, 26 nt, Human
aaacaaacaaaaaauccccagauagu

SEQ ID NO: 1167251 - RNA, 24 nt, Human
aaacaaacaaacaaaaaaucccca

SEQ ID NO: 1167252 - RNA, 18 nt, Human
aaacacccccaaacaaaa

SEQ ID NO: 1167253 - RNA, 21 nt, Human
aaaccaaaaaacacccccaaa

SEQ ID NO: 1167254 - RNA, 24 nt, Human
aaaccaaaacaaacaaacaaaaaa

SEQ ID NO: 1167255 - RNA, 26 nt, Human
aaaccaaaaccaaaaaacacccccaa

SEQ ID NO: 1167256 - RNA, 24 nt, Human
aaaccaaaaccaaaccaaaacaaa

SEQ ID NO: 1167257 - RNA, 22 nt, Human
aaaccaaaccaaaacaaacaaa

SEQ ID NO: 1167258 - RNA, 21 nt, Human
aaaccaccacaggcaacacac

SEQ ID NO: 1167259 - RNA, 20 nt, Human
aaaccacuugacaugaguuu

SEQ ID NO: 1167260 - RNA, 24 nt, Human
aaagagcgauuuugaaccugaaca

SEQ ID NO: 1167261 - RNA, 27 nt, Human
aaauacagaaaaucaaaccaaaaccaa

SEQ ID NO: 1167262 - RNA, 22 nt, Human
aaauuuucccccaaaauuaucu

SEQ ID NO: 1167263 - RNA, 18 nt, Human
aacaaaaaaccaccacag

SEQ ID NO: 1167264 - RNA, 21 nt, Human
aacaaaaaauccccagauaac

SEQ ID NO: 1167265 - RNA, 27 nt, Human
aacaaaauacagaaaaucaaaccaaaa

SEQ ID NO: 1167266 - RNA, 19 nt, Human
aacaacagacacuggggcc

SEQ ID NO: 1167267 - RNA, 21 nt, Human
aacacccccaaacaaaaaacc

SEQ ID NO: 1167268 - RNA, 23 nt, Human
aacaggaaugagaaaaauacaag

SEQ ID NO: 1167269 - RNA, 20 nt, Human
aaccaaaccaaaacaaacaa

SEQ ID NO: 1167270 - RNA, 22 nt, Human
aacucuuuuucacaaaaccagg

SEQ ID NO: 1167271 - RNA, 20 nt, Human
aagaaucuuccauucuuguu

SEQ ID NO: 1167272 - RNA, 18 nt, Human
aagcagugcuccucugga

SEQ ID NO: 1167273 - RNA, 25 nt, Human
aaggaacaacagacacuggggccua

SEQ ID NO: 1167274 - RNA, 23 nt, Human
aaggacacaaagaaaggaacagu

SEQ ID NO: 1167275 - RNA, 21 nt, Human
aaucugugugccuaucuuccu

SEQ ID NO: 1167276 - RNA, 21 nt, Human
acaaagaaaggaacaacagac

SEQ ID NO: 1167277 - RNA, 20 nt, Human
acaacagauggccacccaga

SEQ ID NO: 1167278 - RNA, 24 nt, Human
acagcguucacaaugcugguauua

SEQ ID NO: 1167279 - RNA, 20 nt, Human
accaaaacaaacaaacaaaa

SEQ ID NO: 1167280 - RNA, 19 nt, Human
accaaaaccaaaccaaaac

SEQ ID NO: 1167281 - RNA, 18 nt, Human
accaaaccaaaacaaaca

SEQ ID NO: 1167282 - RNA, 21 nt, Human
accaccacaggcaacacacaa

SEQ ID NO: 1167283 - RNA, 21 nt, Human
accaggcagagaucugcucau

SEQ ID NO: 1167284 - RNA, 19 nt, Human
accaugaccuuaaaauaac

SEQ ID NO: 1167285 - RNA, 19 nt, Human
acccagaaauuagagccag

SEQ ID NO: 1167286 - RNA, 20 nt, Human
acccagaaauuagagccaga

SEQ ID NO: 1167287 - RNA, 18 nt, Human
accccaccaaaaccacaa

SEQ ID NO: 1167288 - RNA, 19 nt, Human
agauuuuggagauuagcuu

SEQ ID NO: 1167289 - RNA, 23 nt, Human
agcaaacuaacacagaacagaaa

SEQ ID NO: 1167290 - RNA, 23 nt, Human
agcagggaaaauaacuacugggu

SEQ ID NO: 1167291 - RNA, 24 nt, Human
agccuauuaaucuagaaauaauuu

SEQ ID NO: 1167292 - RNA, 22 nt, Human
aggaagaacaaugauuauaacc

SEQ ID NO: 1167293 - RNA, 26 nt, Human
agggauagucuaucugaugcuuaaau

SEQ ID NO: 1167294 - RNA, 19 nt, Human
auagucuaucugaugcuua

SEQ ID NO: 1167295 - RNA, 22 nt, Human
caaaaaacacccccaaacaaaa

SEQ ID NO: 1167296 - RNA, 22 nt, Human
caaaaaaccaccacaggcaaca

SEQ ID NO: 1167297 - RNA, 19 nt, Human
caaaacaaacaaacaaaaa

SEQ ID NO: 1167298 - RNA, 21 nt, Human
caaaaccaaaaaacaccccca

SEQ ID NO: 1167299 - RNA, 23 nt, Human
caaaauaaucuguacaacaaaac

SEQ ID NO: 1167300 - RNA, 21 nt, Human
caaaauauaccacuuuuaacu

SEQ ID NO: 1167301 - RNA, 27 nt, Human
caaacaaaaaaccaccacaaucaacgg

SEQ ID NO: 1167302 - RNA, 19 nt, Human
caaacaaaaaauccccaga

SEQ ID NO: 1167303 - RNA, 22 nt, Human
caaacaaacaaaaaauccccag

SEQ ID NO: 1167304 - RNA, 20 nt, Human
caaaccaaaacaaacaaaca

SEQ ID NO: 1167305 - RNA, 21 nt, Human
caaaccaaaacaaacaaacaa

SEQ ID NO: 1167306 - RNA, 19 nt, Human
caaacuaacacagaacaga

SEQ ID NO: 1167307 - RNA, 23 nt, Human
caacagauggccacccagaaauu

SEQ ID NO: 1167308 - RNA, 22 nt, Human
cacaaagaaaggaacaacagac

SEQ ID NO: 1167309 - RNA, 21 nt, Human
cacaagcuagguuauuucuag

SEQ ID NO: 1167310 - RNA, 24 nt, Human
cacaagcuuaagauguuuccuaga

SEQ ID NO: 1167311 - RNA, 21 nt, Human
caccccaccaaaaccacaaga

SEQ ID NO: 1167312 - RNA, 21 nt, Human
cacuagacauauaugaacuaa

SEQ ID NO: 1167313 - RNA, 20 nt, Human
cagaacagaaaaccaaauac

SEQ ID NO: 1167314 - RNA, 21 nt, Human
caggaaauguaaaugcaacca

SEQ ID NO: 1167315 - RNA, 22 nt, Human
caggaaauguaaaugcaaccau

SEQ ID NO: 1167316 - RNA, 20 nt, Human
caucccaccaccccaccaaa

SEQ ID NO: 1167317 - RNA, 20 nt, Human
caucccaccaccccaccaag

SEQ ID NO: 1167318 - RNA, 22 nt, Human
caucucuuucaccuagugcacu

SEQ ID NO: 1167319 - RNA, 26 nt, Human
caugccaaaaauauaaaaccaaaacc

SEQ ID NO: 1167320 - RNA, 18 nt, Human
ccaaaaccaaaaaacacc

SEQ ID NO: 1167321 - RNA, 21 nt, Human
ccaaaaccaaaaaacaccccc

SEQ ID NO: 1167322 - RNA, 22 nt, Human
ccaaaaccaaaaaacaccccca

SEQ ID NO: 1167323 - RNA, 19 nt, Human
ccaaaaccaaaccaaaaca

SEQ ID NO: 1167324 - RNA, 23 nt, Human
ccaaaaccaaaccaaaacaaaca

SEQ ID NO: 1167325 - RNA, 19 nt, Human
ccaaacaaaaaaccaccac

SEQ ID NO: 1167326 - RNA, 23 nt, Human
ccaaacaaaaaaccaccacaggc

SEQ ID NO: 1167327 - RNA, 21 nt, Human
cccaaacaaaaaaccaccaca

SEQ ID NO: 1167328 - RNA, 23 nt, Human
cccaccaccccaccaaaaccaca

SEQ ID NO: 1167329 - RNA, 20 nt, Human
ccccaaacaaaaaaccacca

SEQ ID NO: 1167330 - RNA, 22 nt, Human
ccccaccaaaaccacaagagaa

SEQ ID NO: 1167331 - RNA, 20 nt, Human
cccccaaacaaaaaaccacc

SEQ ID NO: 1167332 - RNA, 22 nt, Human
cccccaaacaaaaaaccaccac

SEQ ID NO: 1167333 - RNA, 23 nt, Human
cccuaacugaacugucacucuuc

SEQ ID NO: 1167334 - RNA, 19 nt, Human
cccugacuucuccaaaagc

SEQ ID NO: 1167335 - RNA, 23 nt, Human
ccugaaccuaaaaguuaaaaaaa

SEQ ID NO: 1167336 - RNA, 20 nt, Human
cuaaaauaaaaauagguggc

SEQ ID NO: 1167337 - RNA, 21 nt, Human
cucucccugacuucuccaaaa

SEQ ID NO: 1167338 - RNA, 24 nt, Human
cugaugcuuaaauugaucuuuaau

SEQ ID NO: 1167339 - RNA, 23 nt, Human
cugcaucccaccaccccaccaaa

SEQ ID NO: 1167340 - RNA, 18 nt, Human
cugugugccuaucuuccu

SEQ ID NO: 1167341 - RNA, 22 nt, Human
cuuucaguuccauacguuguuu

SEQ ID NO: 1167342 - RNA, 23 nt, Human
cuuucuaggcuuaugucuuaaua

SEQ ID NO: 1167343 - RNA, 22 nt, Human
gagaaacccuaaaaauccuuga

SEQ ID NO: 1167344 - RNA, 21 nt, Human
gagaagagcagggaaaauaac

SEQ ID NO: 1167345 - RNA, 20 nt, Human
gcaaaauauaccacuuuuaa

SEQ ID NO: 1167346 - RNA, 24 nt, Human
gccuagacuaaaaauuguugaagg

SEQ ID NO: 1167347 - RNA, 20 nt, Human
gcugguauuaaucagcuaca

SEQ ID NO: 1167348 - RNA, 22 nt, Human
gcuuaaaaccaccuacacugcc

SEQ ID NO: 1167349 - RNA, 23 nt, Human
ggaaaguauacuacuguauuccu

SEQ ID NO: 1167350 - RNA, 21 nt, Human
ggcaaaguaaaagucauggaa

SEQ ID NO: 1167351 - RNA, 20 nt, Human
gguggagggugggaggaggg

SEQ ID NO: 1167352 - RNA, 20 nt, Human
guauuaaucagcuacauauu

SEQ ID NO: 1167353 - RNA, 20 nt, Human
gucaguugccuccaccuuau

SEQ ID NO: 1167354 - RNA, 23 nt, Human
uaaaaccaaaaccaaaccaaaac

SEQ ID NO: 1167355 - RNA, 24 nt, Human
uaaaugaugagaacucaaggacac

SEQ ID NO: 1167356 - RNA, 27 nt, Human
uaacaaaauacagaaaaucaaaccaaa

SEQ ID NO: 1167357 - RNA, 21 nt, Human
uaacacagaacagaaaaccaa

SEQ ID NO: 1167358 - RNA, 21 nt, Human
uaaccugauucccuaucuaaa

SEQ ID NO: 1167359 - RNA, 24 nt, Human
uaaccuucugcaucccaccacccc

SEQ ID NO: 1167360 - RNA, 18 nt, Human
uaagaaucuuccauucuu

SEQ ID NO: 1167361 - RNA, 20 nt, Human
uaauacucccgaaguggcac

SEQ ID NO: 1167362 - RNA, 24 nt, Human
uaauuccaccucccccuuuuuuuc

SEQ ID NO: 1167363 - RNA, 20 nt, Human
uacaacaaaaccacuugaca

SEQ ID NO: 1167364 - RNA, 21 nt, Human
uacaacaaaaccacuugacau

SEQ ID NO: 1167365 - RNA, 20 nt, Human
uaccccugaaccuaaaaguu

SEQ ID NO: 1167366 - RNA, 19 nt, Human
uacgaggaagaaucugugu

SEQ ID NO: 1167367 - RNA, 19 nt, Human
uacucuguaaacuuggaaa

SEQ ID NO: 1167368 - RNA, 18 nt, Human
uagaauaucuagaauauu

SEQ ID NO: 1167369 - RNA, 21 nt, Human
uagaauccauuccaagugguu

SEQ ID NO: 1167370 - RNA, 23 nt, Human
uagccuauuaaucuagaaauaau

SEQ ID NO: 1167371 - RNA, 21 nt, Human
uaggcaugaauauauucaacc

SEQ ID NO: 1167372 - RNA, 22 nt, Human
uagggcaaaguaaaagucaugg

SEQ ID NO: 1167373 - RNA, 24 nt, Human
uaguuuuguguuaggcaggaggaa

SEQ ID NO: 1167374 - RNA, 22 nt, Human
uauauaacaaccugcacaugua

SEQ ID NO: 1167375 - RNA, 22 nt, Human
uauuacacacuagacauauaug

SEQ ID NO: 1167376 - RNA, 18 nt, Human
uauuuaagaaucuuccau

SEQ ID NO: 1167377 - RNA, 20 nt, Human
ucaacaggaaugagaaaaaa

SEQ ID NO: 1167378 - RNA, 20 nt, Human
ucaaggacacaaagaaagga

SEQ ID NO: 1167379 - RNA, 20 nt, Human
ucaaucucuauuuuguccua

SEQ ID NO: 1167380 - RNA, 23 nt, Human
ucagcuuaagcagugcuccucug

SEQ ID NO: 1167381 - RNA, 24 nt, Human
uccacaaauuuucccccaaaauua

SEQ ID NO: 1167382 - RNA, 20 nt, Human
uccaccucccccuuuuuuuc

SEQ ID NO: 1167383 - RNA, 23 nt, Human
ucccaccaccccaccaaaaccac

SEQ ID NO: 1167384 - RNA, 25 nt, Human
ucccaccaccccaccaaaaccacaa

SEQ ID NO: 1167385 - RNA, 21 nt, Human
ucccugacuucuccaaaagcu

SEQ ID NO: 1167386 - RNA, 21 nt, Human
ucucucccugacuucuccaaa

SEQ ID NO: 1167387 - RNA, 18 nt, Human
ucuuguuauaagcuuccu

SEQ ID NO: 1167388 - RNA, 21 nt, Human
ugaaagaaugguguaggagua

SEQ ID NO: 1167389 - RNA, 18 nt, Human
ugaaagagcgauuuugaa

SEQ ID NO: 1167390 - RNA, 23 nt, Human
ugaagcuacuuuucagaagcuag

SEQ ID NO: 1167391 - RNA, 19 nt, Human
ugaggguggagggugggag

SEQ ID NO: 1167392 - RNA, 18 nt, Human
ugagguagguaaucaaca

SEQ ID NO: 1167393 - RNA, 23 nt, Human
ugaguuuaccuauauaacaaccu

SEQ ID NO: 1167394 - RNA, 21 nt, Human
ugauauuggaguagcauuuca

SEQ ID NO: 1167395 - RNA, 24 nt, Human
ugauguaaagcccaagaggcaguu

SEQ ID NO: 1167396 - RNA, 23 nt, Human
ugcaucccaccaccccaccaaaa

SEQ ID NO: 1167397 - RNA, 24 nt, Human
ugcaucccaccaccccaccaaaac

SEQ ID NO: 1167398 - RNA, 20 nt, Human
ugccaaaaauauaaaaccaa

SEQ ID NO: 1167399 - RNA, 26 nt, Human
ugccaaaaauauaaaaccaaaaccaa

SEQ ID NO: 1167400 - RNA, 18 nt, Human
ugggaggagggagaagag

SEQ ID NO: 1167401 - RNA, 25 nt, Human
ugggaggagggagaagagcagggaa

SEQ ID NO: 1167402 - RNA, 20 nt, Human
ugugcaugauucucuguacu

SEQ ID NO: 1167403 - RNA, 25 nt, Human
ugugugccuaucuuccugucuucag

SEQ ID NO: 1167404 - RNA, 24 nt, Human
uguuuagcaucuauacaaagcaaa

SEQ ID NO: 1167405 - RNA, 20 nt, Human
uuaauuaugaagcuacuuuu

SEQ ID NO: 1167406 - RNA, 23 nt, Human
uucacaaugcugguauuaaucag

SEQ ID NO: 1167407 - RNA, 21 nt, Human
uucauuuuaucuuuaugauga

SEQ ID NO: 1167408 - RNA, 21 nt, Human
uucucauuuagaaguaggagc

SEQ ID NO: 1167409 - RNA, 20 nt, Human
uugaaggucuccuuucacua

SEQ ID NO: 1167410 - RNA, 20 nt, Human
uuuaagaaucuuccauucuu

SEQ ID NO: 1167411 - RNA, 19 nt, Human
uuuccuagaauccauucca

SEQ ID NO: 1167412 - RNA, 23 nt, Human
aaaaaauagcaaaacuaaaaacu

SEQ ID NO: 1167413 - RNA, 21 nt, Human
aaaaauagcaaaacuaaaaac

SEQ ID NO: 1167414 - RNA, 22 nt, Human
aaaaauagcaaaacuaaaaacu

SEQ ID NO: 1167415 - RNA, 26 nt, Human
aaacauuugacaagauuuuaaaaaua

SEQ ID NO: 1167416 - RNA, 27 nt, Human
aaagaagccaguucugaaguauuuaca

SEQ ID NO: 1167417 - RNA, 21 nt, Human
aaagcaaagaagguuuccucc

SEQ ID NO: 1167418 - RNA, 21 nt, Human
aacaaaguugggaauaguuua

SEQ ID NO: 1167419 - RNA, 18 nt, Human
aagugcugagguggaaac

SEQ ID NO: 1167420 - RNA, 23 nt, Human
aaguggcugcuucuggagucuuc

SEQ ID NO: 1167421 - RNA, 21 nt, Human
aauacaaaauacagaaacaaa

SEQ ID NO: 1167422 - RNA, 30 nt, Human
aauacaaaauacagaaacaaaaaauugaaa

SEQ ID NO: 1167423 - RNA, 25 nt, Human
aauacagaaacaaaaaauugaacaa

SEQ ID NO: 1167424 - RNA, 19 nt, Human
acaaaauacagaaacaaaa

SEQ ID NO: 1167425 - RNA, 18 nt, Human
acaaaauccuuacaccca

SEQ ID NO: 1167426 - RNA, 18 nt, Human
acaaagcagauguguccc

SEQ ID NO: 1167427 - RNA, 25 nt, Human
acacacacacacaaacacacacaca

SEQ ID NO: 1167428 - RNA, 25 nt, Human
acacacacacacacacacaaacaca

SEQ ID NO: 1167429 - RNA, 27 nt, Human
acacacacacacacacacaaacacaca

SEQ ID NO: 1167430 - RNA, 30 nt, Human; identical to SEQ ID NO: 680238

SEQ ID NO: 1167431 - RNA, 23 nt, Human
acacacacccccaccacaaacac

SEQ ID NO: 1167432 - RNA, 25 nt, Human
acacacaggcacagacguguguaug

SEQ ID NO: 1167433 - RNA, 25 nt, Human
acagaaacaaaaaauugaacaaaaa

SEQ ID NO: 1167434 - RNA, 21 nt, Human
acagaauaauaauacauagag

SEQ ID NO: 1167435 - RNA, 19 nt, Human
acagacguguguaugugug

SEQ ID NO: 1167436 - RNA, 19 nt, Human
acagagaaaucacaccaga

SEQ ID NO: 1167437 - RNA, 23 nt, Human
accaauucccuucacaaguaacc

SEQ ID NO: 1167438 - RNA, 22 nt, Human
agaaacaaaaaauugaacaaaa

SEQ ID NO: 1167439 - RNA, 19 nt, Human
agaagguaagacagagaaa

SEQ ID NO: 1167440 - RNA, 21 nt, Human
agaauaauaauacauagagca

SEQ ID NO: 1167441 - RNA, 18 nt, Human
agaaucugacaauguaca

SEQ ID NO: 1167442 - RNA, 20 nt, Human
agagcaauuugguuaaauua

SEQ ID NO: 1167443 - RNA, 18 nt, Human
agagucuacuaaguggcu

SEQ ID NO: 1167444 - RNA, 18 nt, Human
agcugguggagacaaccu

SEQ ID NO: 1167445 - RNA, 18 nt, Human
agcugguggagacaaccu

SEQ ID NO: 1167446 - RNA, 21 nt, Human
aggcacagacguguguaugug

SEQ ID NO: 1167447 - RNA, 22 nt, Human
auggacagcaggguggccgaaa

SEQ ID NO: 1167448 - RNA, 19 nt, Human
augugucccucuguguagg

SEQ ID NO: 1167449 - RNA, 25 nt, Human
auuccacacacacacacacacacaa

SEQ ID NO: 1167450 - RNA, 23 nt, Human
caaacacagccuuacacucacgc

SEQ ID NO: 1167451 - RNA, 22 nt, Human
caacccaacaaaauggaaaaaa

SEQ ID NO: 1167452 - RNA, 19 nt, Human
cacacaaacacacacacac

SEQ ID NO: 1167453 - RNA, 22 nt, Human
cacacacaaacacacacacaca

SEQ ID NO: 1167454 - RNA, 28 nt, Human
cacacacacacacacaaacacacacaca

SEQ ID NO: 1167455 - RNA, 29 nt, Human
cacacacacacaggcacagacguguguag

SEQ ID NO: 1167456 - RNA, 24 nt, Human
cacacacacaggcacagacgugug

SEQ ID NO: 1167457 - RNA, 22 nt, Human
cacacacccccaccacaaacac

SEQ ID NO: 1167458 - RNA, 18 nt, Human
cacacacccccaccaccc

SEQ ID NO: 1167459 - RNA, 18 nt, Human
cacaccagaaauaaaaua

SEQ ID NO: 1167460 - RNA, 20 nt, Human
cacacccccaccacaaacac

SEQ ID NO: 1167461 - RNA, 22 nt, Human
cacccccaccacaaacacagcc

SEQ ID NO: 1167462 - RNA, 23 nt, Human
caccuuucucaauaaaugcauca

SEQ ID NO: 1167463 - RNA, 18 nt, Human
cacgauggacagcagggu

SEQ ID NO: 1167464 - RNA, 22 nt, Human
cacugaucucugaacacaaagg

SEQ ID NO: 1167465 - RNA, 19 nt, Human
caggccccccacaaaaucc

SEQ ID NO: 1167466 - RNA, 20 nt, Human
caguaaacccuucccgggca

SEQ ID NO: 1167467 - RNA, 26 nt, Human
caucccucaagaaacaaaguugggaa

SEQ ID NO: 1167468 - RNA, 18 nt, Human
ccaaaaauacagcccagg

SEQ ID NO: 1167469 - RNA, 21 nt, Human
ccacacacacacacacacaca

SEQ ID NO: 1167470 - RNA, 23 nt, Human
ccacacacacacacacacacaaa

SEQ ID NO: 1167471 - RNA, 20 nt, Human
ccacagugggaguuugagaa

SEQ ID NO: 1167472 - RNA, 22 nt, Human
ccaguucugaaguauuuacaga

SEQ ID NO: 1167473 - RNA, 24 nt, Human
cucacagaauaauaauacauagag

SEQ ID NO: 1167474 - RNA, 23 nt, Human
cugggcugccaguauugcaguua

SEQ ID NO: 1167475 - RNA, 21 nt, Human
cuucuuaucuugccuugaggg

SEQ ID NO: 1167476 - RNA, 21 nt, Human
cuugcaccuuucucaauaaau

SEQ ID NO: 1167477 - RNA, 20 nt, Human
gaccgcauguugauaaggca

SEQ ID NO: 1167478 - RNA, 23 nt, Human
gacuuuuuauuccuaacacaaaa

SEQ ID NO: 1167479 - RNA, 26 nt, Human
gcacagauacacacacacacaccccc

SEQ ID NO: 1167480 - RNA, 20 nt, Human
gcaccuggaccucuccuggu

SEQ ID NO: 1167481 - RNA, 23 nt, Human
gcagagucagggaaagcccuggc

SEQ ID NO: 1167482 - RNA, 18 nt, Human
ggccauuauauuucauuc

SEQ ID NO: 1167483 - RNA, 24 nt, Human
gggaauaguuuaugacuuuuuauu

SEQ ID NO: 1167484 - RNA, 25 nt, Human
guaagacagagaaaucacaccagaa

SEQ ID NO: 1167485 - RNA, 19 nt, Human
guggagacaaccuuuggcc

SEQ ID NO: 1167486 - RNA, 22 nt, Human
uaaauaacaaagcagauguguc

SEQ ID NO: 1167487 - RNA, 19 nt, Human
uaaauaaggacacaaccca

SEQ ID NO: 1167488 - RNA, 19 nt, Human
uaaggacacaacccaacaa

SEQ ID NO: 1167489 - RNA, 19 nt, Human
uaauaaauaaugcccccuu

SEQ ID NO: 1167490 - RNA, 22 nt, Human
uacaaauacaagaaaacauuuu

SEQ ID NO: 1167491 - RNA, 21 nt, Human
uacagaaacaaaaaauugaac

SEQ ID NO: 1167492 - RNA, 19 nt, Human
uagaaucugacaauguaca

SEQ ID NO: 1167493 - RNA, 21 nt, Human
uagcugguggagacaaccuuu

SEQ ID NO: 1167494 - RNA, 19 nt, Human
uagggacgaugacaaccac

SEQ ID NO: 1167495 - RNA, 18 nt, Human
uaucaaagaucauggcca

SEQ ID NO: 1167496 - RNA, 31 nt, Human
uauuuuguuuuuaaucuccauaguguauucu

SEQ ID NO: 1167497 - RNA, 25 nt, Human
ucagaacaucccucaagaaacaaag

SEQ ID NO: 1167498 - RNA, 20 nt, Human
uccacacacacacacacaca

SEQ ID NO: 1167499 - RNA, 21 nt, Human
uccacacacacacacacacac

SEQ ID NO: 1167500 - RNA, 22 nt, Human
uccacacacacacacacacaca

SEQ ID NO: 1167501 - RNA, 29 nt, Human
uccacacacacacacacacacaaacacac

SEQ ID NO: 1167502 - RNA, 18 nt, Human
ucccaaaguucacgaugg

SEQ ID NO: 1167503 - RNA, 19 nt, Human
ucccaaaguucacgaugga

SEQ ID NO: 1167504 - RNA, 20 nt, Human
uccugucucuucugcccaca

SEQ ID NO: 1167505 - RNA, 18 nt, Human
uccuuugaccaaaaauac

SEQ ID NO: 1167506 - RNA, 21 nt, Human
ucgcagagucagggaaagccc

SEQ ID NO: 1167507 - RNA, 23 nt, Human
ugacaaaaccucacagguuuagc

SEQ ID NO: 1167508 - RNA, 21 nt, Human
ugaccaaaaauacagcccagg

SEQ ID NO: 1167509 - RNA, 18 nt, Human
ugauguaaacaauaaccc

SEQ ID NO: 1167510 - RNA, 25 nt, Human
ugcacagauacacacacacacaccc

SEQ ID NO: 1167511 - RNA, 28 nt, Human
ugcacagauacacacacacacaccccca

SEQ ID NO: 1167512 - RNA, 23 nt, Human
uggacagcaggguggccgaaagg

SEQ ID NO: 1167513 - RNA, 20 nt, Human
uggagucuucugacccuagu

SEQ ID NO: 1167514 - RNA, 22 nt, Human
uggccaggccccccacaaaauc

SEQ ID NO: 1167515 - RNA, 21 nt, Human
ugggaguuugagaaaagaagc

SEQ ID NO: 1167516 - RNA, 18 nt, Human
uguaaaagcaaagaaggu

SEQ ID NO: 1167517 - RNA, 21 nt, Human
uguaauuccacacacacacac

SEQ ID NO: 1167518 - RNA, 30 nt, Human
uguaauuccacacacacacacacacacagu

SEQ ID NO: 1167519 - RNA, 24 nt, Human
ugugugcacagauacacacacaca

SEQ ID NO: 1167520 - RNA, 24 nt, Human
uuaaaaaaaauagcaaaacuaaaa

SEQ ID NO: 1167521 - RNA, 24 nt, Human
uugacccugucgcagagucaggga

SEQ ID NO: 1167522 - RNA, 20 nt, Human
uugcacugaucucugaacac

SEQ ID NO: 1167523 - RNA, 22 nt, Human
uuuagaagguaagacagagaaa

SEQ ID NO: 1167524 - RNA, 25 nt, Human
uuuauuuauaagcagaucacuucac

SEQ ID NO: 1167525 - RNA, 21 nt, Human
uuuguaagccgccuuggagac

SEQ ID NO: 1167526 - RNA, 23 nt, Human
agaaacccauagcaauucaguga

SEQ ID NO: 1167527 - RNA, 24 nt, Human
augucauuuuucccccugcuucag

SEQ ID NO: 1167528 - RNA, 22 nt, Human
cagucaaaacagguaacagcag

SEQ ID NO: 1167529 - RNA, 26 nt, Human
cccauagcaauucagugauuuuucuu

SEQ ID NO: 1167530 - RNA, 24 nt, Human
cuaauggugugaugucauuuuucc

SEQ ID NO: 1167531 - RNA, 22 nt, Human
ggauauuucagaaacccauagc

SEQ ID NO: 1167532 - RNA, 21 nt, Human
gucauuuuucccccugcuuca

SEQ ID NO: 1167533 - RNA, 21 nt, Human
gugaugucauuuuucccccug

SEQ ID NO: 1167534 - RNA, 19 nt, Human
uagaaaauguugcuuccac

SEQ ID NO: 1167535 - RNA, 19 nt, Human
ucccccugcuucagguuaa

SEQ ID NO: 1167536 - RNA, 18 nt, Human
uuucacacaauaccugcu

SEQ ID NO: 1167537 - RNA, 21 nt, Human
aagcacuucaugaaaugcuca

SEQ ID NO: 1167538 - RNA, 23 nt, Human
aggcgggggcgugggaugcgggg

SEQ ID NO: 1167539 - RNA, 22 nt, Human
aggcggggugagugugggcgug

SEQ ID NO: 1167540 - RNA, 26 nt, Human
agggaggaggcguagagcgaggcggg

SEQ ID NO: 1167541 - RNA, 21 nt, Human
agugagggugggaagagcuag

SEQ ID NO: 1167542 - RNA, 26 nt, Human
cacacacagggcacugcggcugugug

SEQ ID NO: 1167543 - RNA, 26 nt, Human
cacaggcuguccacacacagggcacu

SEQ ID NO: 1167544 - RNA, 19 nt, Human
caccagcacgggggcgcag

SEQ ID NO: 1167545 - RNA, 21 nt, Human
cagaggcccgcagugagggug

SEQ ID NO: 1167546 - RNA, 19 nt, Human
cccgcagugagggugggaa

SEQ ID NO: 1167547 - RNA, 18 nt, Human
ccgcacccuuccgccagg

SEQ ID NO: 1167548 - RNA, 27 nt, Human
ccugcagccagggaggaggcguagagc

SEQ ID NO: 1167549 - RNA, 19 nt, Human
cgcagccucggcagccgca

SEQ ID NO: 1167550 - RNA, 22 nt, Human
cgcccacccacuggcucugcag

SEQ ID NO: 1167551 - RNA, 20 nt, Human
cguagagcgaggcgggggcg

SEQ ID NO: 1167552 - RNA, 20 nt, Human
cugauauauaauagugguau

SEQ ID NO: 1167553 - RNA, 21 nt, Human
cugcagcagaauggagacuca

SEQ ID NO: 1167554 - RNA, 24 nt, Human
gccgcaccacgagagagcuuuaac

SEQ ID NO: 1167555 - RNA, 21 nt, Human
gccugcagccagggaggaggc

SEQ ID NO: 1167556 - RNA, 22 nt, Human
gcuuauucauucucaaucuuuc

SEQ ID NO: 1167557 - RNA, 18 nt, Human
ggaauaggaggaggaagg

SEQ ID NO: 1167558 - RNA, 23 nt, Human
ggcaggggugcagccaggcgggg

SEQ ID NO: 1167559 - RNA, 20 nt, Human
ggcgaccguuucgccacccc

SEQ ID NO: 1167560 - RNA, 22 nt, Human
guagcgugcgcucccgcacccu

SEQ ID NO: 1167561 - RNA, 19 nt, Human
uaggaggaggaaggacgca

SEQ ID NO: 1167562 - RNA, 18 nt, Human
uauaauagugguauaaaa

SEQ ID NO: 1167563 - RNA, 22 nt, Human
uauaauagugguauaaaagcac

SEQ ID NO: 1167564 - RNA, 33 nt, Human
uauaauagugguauaaaagcacuucaugaaaag

SEQ ID NO: 1167565 - RNA, 18 nt, Human
ucaaucuuucucugauau

SEQ ID NO: 1167566 - RNA, 19 nt, Human
ucaaucuuucucugauaua

SEQ ID NO: 1167567 - RNA, 18 nt, Human
ucccgcacccuuccgcca

SEQ ID NO: 1167568 - RNA, 21 nt, Human
ugaaaugcucacuauuaauca

SEQ ID NO: 1167569 - RNA, 18 nt, Human
ugcagccaggcgggguga

SEQ ID NO: 1167570 - RNA, 18 nt, Human
ugccugcagccagggagg

SEQ ID NO: 1167571 - RNA, 20 nt, Human
uggcgaccguuucgccaccc

SEQ ID NO: 1167572 - RNA, 18 nt, Human
ugggaagagcuagaaccg

SEQ ID NO: 1167573 - RNA, 19 nt, Human
ugggaagagcuagaaccgc

SEQ ID NO: 1167574 - RNA, 21 nt, Human
ugggaagagcuagaaccgccc

SEQ ID NO: 1167575 - RNA, 19 nt, Human
aaacauaagugcaauagau

SEQ ID NO: 1167576 - RNA, 27 nt, Human
aacuggggugggggguggggguagugu

SEQ ID NO: 1167577 - RNA, 19 nt, Human
aagcacaaugucucacaug

SEQ ID NO: 1167578 - RNA, 23 nt, Human
aagcgaacgucuaguacaauucu

SEQ ID NO: 1167579 - RNA, 20 nt, Human
acaaaguuccaaaaugccaa

SEQ ID NO: 1167580 - RNA, 21 nt, Human
agagggaggaugucacgguca

SEQ ID NO: 1167581 - RNA, 19 nt, Human
auauauauauauauauaua

SEQ ID NO: 1167582 - RNA, 19 nt, Human
auauauauauauauauaua

SEQ ID NO: 1167583 - RNA, 19 nt, Human
auauauauauauauauaua

SEQ ID NO: 1167584 - RNA, 19 nt, Human
auauauauauauauauaua

SEQ ID NO: 1167585 - RNA, 19 nt, Human
auauauauauauauauaua

SEQ ID NO: 1167586 - RNA, 19 nt, Human
auauauauauauauauaua

SEQ ID NO: 1167587 - RNA, 19 nt, Human
auauauauauauauauaua

SEQ ID NO: 1167588 - RNA, 19 nt, Human
auauauauauauauauaua

SEQ ID NO: 1167589 - RNA, 19 nt, Human
auauauauauauauauaua

SEQ ID NO: 1167590 - RNA, 19 nt, Human
auauauauauauauauaua

SEQ ID NO: 1167591 - RNA, 19 nt, Human
auauauauauauauauaua

SEQ ID NO: 1167592 - RNA, 19 nt, Human
auauauauauauauauaua

SEQ ID NO: 1167593 - RNA, 19 nt, Human
auauauauauauauauaua

SEQ ID NO: 1167594 - RNA, 19 nt, Human
auauauauauauauauaua

SEQ ID NO: 1167595 - RNA, 19 nt, Human
auauauauauauauauaua

SEQ ID NO: 1167596 - RNA, 19 nt, Human
auauauauauauauauaua

SEQ ID NO: 1167597 - RNA, 19 nt, Human
auauauauauauauauaua

SEQ ID NO: 1167598 - RNA, 19 nt, Human
auauauauauauauauaua

SEQ ID NO: 1167599 - RNA, 19 nt, Human
auauauauauauauauaua

SEQ ID NO: 1167600 - RNA, 19 nt, Human
auauauauauauauauaua

SEQ ID NO: 1167601 - RNA, 18 nt, Human
auauauauauauauaugu

SEQ ID NO: 1167602 - RNA, 18 nt, Human
auauauauauauauaugu

SEQ ID NO: 1167603 - RNA, 21 nt, Human
auauauauguguguguauaua

SEQ ID NO: 1167604 - RNA, 25 nt, Human
auauauaugugugugugugugugug

SEQ ID NO: 1167605 - RNA, 19 nt, Human
auauauguauauauaugca

SEQ ID NO: 1167606 - RNA, 19 nt, Human
auauguguauauauauaug

SEQ ID NO: 1167607 - RNA, 19 nt, Human
auccacaguaguuguugag

SEQ ID NO: 1167608 - RNA, 24 nt, Human
augcugcuauauauauauauauau

SEQ ID NO: 1167609 - RNA, 22 nt, Human
auguauauauguauaugugcau

SEQ ID NO: 1167610 - RNA, 21 nt, Human
augugugugugugugugugug

SEQ ID NO: 1167611 - RNA, 22 nt, Human
augugugugugugugugugugu

SEQ ID NO: 1167612 - RNA, 23 nt, Human
auguguguguguguguguguguu

SEQ ID NO: 1167613 - RNA, 23 nt, Human
caccuuucagccaaaacagaucc

SEQ ID NO: 1167614 - RNA, 27 nt, Human
cagcaaaguaggauucaucauuccaua

SEQ ID NO: 1167615 - RNA, 19 nt, Human
cuacugauguuccuuugga

SEQ ID NO: 1167616 - RNA, 18 nt, Human
cuauauauauauauauau

SEQ ID NO: 1167617 - RNA, 19 nt, Human
cuauauauauauauauaua

SEQ ID NO: 1167618 - RNA, 26 nt, Human
cucacaaacauaagugcaauagaucu

SEQ ID NO: 1167619 - RNA, 22 nt, Human
cugcugguuuuaacaacugugc

SEQ ID NO: 1167620 - RNA, 19 nt, Human
gagguugcuuuguuuuguc

SEQ ID NO: 1167621 - RNA, 25 nt, Human
gccaaauucuuauuuuuuaaaaagc

SEQ ID NO: 1167622 - RNA, 22 nt, Human
ggggugggggguggggguagug

SEQ ID NO: 1167623 - RNA, 19 nt, Human
gggugggggguggggguag

SEQ ID NO: 1167624 - RNA, 20 nt, Human
ggugggggguggggguagug

SEQ ID NO: 1167625 - RNA, 19 nt, Human
guauauauauauauauaua

SEQ ID NO: 1167626 - RNA, 19 nt, Human
guauauauauauauauaua

SEQ ID NO: 1167627 - RNA, 19 nt, Human
guauauauauauauaugug

SEQ ID NO: 1167628 - RNA, 18 nt, Human
guguauauauauauauau

SEQ ID NO: 1167629 - RNA, 19 nt, Human
guguauauauauauauaua

SEQ ID NO: 1167630 - RNA, 21 nt, Human
guguauauauauauauaugaa

SEQ ID NO: 1167631 - RNA, 23 nt, Human
guguguauauauauauauaaaau

SEQ ID NO: 1167632 - RNA, 20 nt, Human
guguguauauauauauauau

SEQ ID NO: 1167633 - RNA, 22 nt, Human
guucaaguuauagauucaaugg

SEQ ID NO: 1167634 - RNA, 22 nt, Human
uaacaugaaacuugucaccaug

SEQ ID NO: 1167635 - RNA, 25 nt, Human
uaacaugaaacuugucaccaugaga

SEQ ID NO: 1167636 - RNA, 21 nt, Human
uacaaaggugaaaauuguuug

SEQ ID NO: 1167637 - RNA, 18 nt, Human
uacauauauguauauaua

SEQ ID NO: 1167638 - RNA, 24 nt, Human
uacauauauguauauauaugcaca

SEQ ID NO: 1167639 - RNA, 21 nt, Human
uacgguauuuaggcauuugcc

SEQ ID NO: 1167640 - RNA, 18 nt, Human
uauauacauauauguaua

SEQ ID NO: 1167641 - RNA, 20 nt, Human
uauauacauauauguauaua

SEQ ID NO: 1167642 - RNA, 24 nt, Human
uauauacauauauguauauauaug

SEQ ID NO: 1167643 - RNA, 19 nt, Human
uauauauauauauauauau

SEQ ID NO: 1167644 - RNA, 19 nt, Human
uauauauauauauauauau

SEQ ID NO: 1167645 - RNA, 19 nt, Human
uauauauauauauauauau

SEQ ID NO: 1167646 - RNA, 19 nt, Human
uauauauauauauauauau

SEQ ID NO: 1167647 - RNA, 19 nt, Human
uauauauauauauauauau

SEQ ID NO: 1167648 - RNA, 19 nt, Human
uauauauauauauauauau

SEQ ID NO: 1167649 - RNA, 19 nt, Human
uauauauauauauauauau

SEQ ID NO: 1167650 - RNA, 19 nt, Human
uauauauauauauauauau

SEQ ID NO: 1167651 - RNA, 19 nt, Human
uauauauauauauauauau

SEQ ID NO: 1167652 - RNA, 19 nt, Human
uauauauauauauauauau

SEQ ID NO: 1167653 - RNA, 19 nt, Human
uauauauauauauauauau

SEQ ID NO: 1167654 - RNA, 19 nt, Human
uauauauauauauauauau

SEQ ID NO: 1167655 - RNA, 19 nt, Human
uauauauauauauauauau

SEQ ID NO: 1167656 - RNA, 23 nt, Human
uauauauauauauauauauaugu

SEQ ID NO: 1167657 - RNA, 23 nt, Human
uauauauauauauauauauaugu

SEQ ID NO: 1167658 - RNA, 24 nt, Human
uauauauauauauauguguauaua

SEQ ID NO: 1167659 - RNA, 19 nt, Human
uauauauauauaugugugu

SEQ ID NO: 1167660 - RNA, 24 nt, Human
uauauauauauauguguguguaua

SEQ ID NO: 1167661 - RNA, 21 nt, Human
uauauauauauguauauacau

SEQ ID NO: 1167662 - RNA, 24 nt, Human
uauauauauauguauauacauaua

SEQ ID NO: 1167663 - RNA, 27 nt, Human
uauauauauauguguauauauauaugu

SEQ ID NO: 1167664 - RNA, 24 nt, Human
uauauauauauguguguguauaua

SEQ ID NO: 1167665 - RNA, 23 nt, Human
uauauauauaugugugugugugu

SEQ ID NO: 1167666 - RNA, 20 nt, Human
uauauauaugcacauauaua

SEQ ID NO: 1167667 - RNA, 22 nt, Human
uauauauaugcacauauauaua

SEQ ID NO: 1167668 - RNA, 22 nt, Human
uauauauaugcacauauauaua

SEQ ID NO: 1167669 - RNA, 24 nt, Human
uauauauaugcacauauauauaug

SEQ ID NO: 1167670 - RNA, 18 nt, Human
uauauauauguauauaca

SEQ ID NO: 1167671 - RNA, 26 nt, Human
uauauauauguauauacauauaugua

SEQ ID NO: 1167672 - RNA, 26 nt, Human
uauauauauguguauauauauaugua

SEQ ID NO: 1167673 - RNA, 19 nt, Human
uauauauaugugugugugu

SEQ ID NO: 1167674 - RNA, 19 nt, Human
uauauauaugugugugugu

SEQ ID NO: 1167675 - RNA, 19 nt, Human
uauauauaugugugugugu

SEQ ID NO: 1167676 - RNA, 22 nt, Human
uauauaugcacauauauauaug

SEQ ID NO: 1167677 - RNA, 18 nt, Human
uauauauguauauacaua

SEQ ID NO: 1167678 - RNA, 21 nt, Human
uauauauguauauacauauau

SEQ ID NO: 1167679 - RNA, 25 nt, Human
uauauauguauauacauauauguaa

SEQ ID NO: 1167680 - RNA, 20 nt, Human
uauauauguguauauauaua

SEQ ID NO: 1167681 - RNA, 19 nt, Human
uauaugcacauauauauau

SEQ ID NO: 1167682 - RNA, 22 nt, Human
uauaugcacauauauauaugua

SEQ ID NO: 1167683 - RNA, 19 nt, Human
uauauguauauauaugcac

SEQ ID NO: 1167684 - RNA, 21 nt, Human
uauauguauauauaugcacau

SEQ ID NO: 1167685 - RNA, 26 nt, Human
uauauguauauauaugcacauauaua

SEQ ID NO: 1167686 - RNA, 18 nt, Human
uauauguguauauauaua

SEQ ID NO: 1167687 - RNA, 23 nt, Human
uauaugugugugugugugugugu

SEQ ID NO: 1167688 - RNA, 20 nt, Human
uauccaacuuaacaugaaac

SEQ ID NO: 1167689 - RNA, 21 nt, Human
uauggguggggaggaaauaga

SEQ ID NO: 1167690 - RNA, 24 nt, Human
uauguauauacauauauguauaua

SEQ ID NO: 1167691 - RNA, 29 nt, Human
uauguauauacauauauguauauauuaca

SEQ ID NO: 1167692 - RNA, 22 nt, Human
uauguauauauaugcacauaua

SEQ ID NO: 1167693 - RNA, 24 nt, Human
uauguauauauaugcacauauaua

SEQ ID NO: 1167694 - RNA, 31 nt, Human
uauguauauauaugcacauauauauauguaa

SEQ ID NO: 1167695 - RNA, 18 nt, Human
uauguguauauauauaug

SEQ ID NO: 1167696 - RNA, 22 nt, Human
uauguguauauauauauguaua

SEQ ID NO: 1167697 - RNA, 24 nt, Human
uauguguauauauauauguauaua

SEQ ID NO: 1167698 - RNA, 18 nt, Human
uaugugugugugugugug

SEQ ID NO: 1167699 - RNA, 23 nt, Human
uaugugugugugugugugugugu

SEQ ID NO: 1167700 - RNA, 24 nt, Human
uaugugugugugugugugugugug

SEQ ID NO: 1167701 - RNA, 18 nt, Human
ucaaaacaaaaaaaaacu

SEQ ID NO: 1167702 - RNA, 25 nt, Human
ucaauguuuuuaaaaaucuguuuau

SEQ ID NO: 1167703 - RNA, 21 nt, Human
uccaaaaugccaaauucuuau

SEQ ID NO: 1167704 - RNA, 21 nt, Human
ugagaucuguuugaguuuagg

SEQ ID NO: 1167705 - RNA, 20 nt, Human
ugagcugucacuguggggaa

SEQ ID NO: 1167706 - RNA, 20 nt, Human
ugcacauauauauauguauu

SEQ ID NO: 1167707 - RNA, 21 nt, Human
ugcuauauauauauauauaua

SEQ ID NO: 1167708 - RNA, 20 nt, Human
uggaagaaaaaaucugcugg

SEQ ID NO: 1167709 - RNA, 21 nt, Human
ugggacaaaguuccaaaaugc

SEQ ID NO: 1167710 - RNA, 20 nt, Human
ugggggguggggguagugug

SEQ ID NO: 1167711 - RNA, 18 nt, Human
uguauauauauauauaua

SEQ ID NO: 1167712 - RNA, 22 nt, Human
uguauauauauauauauauaua

SEQ ID NO: 1167713 - RNA, 22 nt, Human
uguauauauauauauaugugua

SEQ ID NO: 1167714 - RNA, 18 nt, Human
uguauauauguauaugug

SEQ ID NO: 1167715 - RNA, 19 nt, Human
ugucacggucaguuguaac

SEQ ID NO: 1167716 - RNA, 22 nt, Human
ugugaaucuuugugcuucaaca

SEQ ID NO: 1167717 - RNA, 18 nt, Human
ugugcuucaacauucuuu

SEQ ID NO: 1167718 - RNA, 18 nt, Human
uguguauauauauauaua

SEQ ID NO: 1167719 - RNA, 18 nt, Human
uguguauauauauauaua

SEQ ID NO: 1167720 - RNA, 19 nt, Human
uguguauauauauauauau

SEQ ID NO: 1167721 - RNA, 19 nt, Human
uguguauauauauauauau

SEQ ID NO: 1167722 - RNA, 20 nt, Human
uguguauauauauauauaua

SEQ ID NO: 1167723 - RNA, 20 nt, Human
uguguauauauauauauaua

SEQ ID NO: 1167724 - RNA, 22 nt, Human
uguguauauauauauauauaua

SEQ ID NO: 1167725 - RNA, 22 nt, Human
uguguauauauauauauaugug

SEQ ID NO: 1167726 - RNA, 24 nt, Human
uguguauauauauauauaugugua

SEQ ID NO: 1167727 - RNA, 19 nt, Human
uguguauauauauauguau

SEQ ID NO: 1167728 - RNA, 22 nt, Human
uguguauauauauauguauaua

SEQ ID NO: 1167729 - RNA, 20 nt, Human
uguguauuuuuuaaagcuac

SEQ ID NO: 1167730 - RNA, 18 nt, Human
uguguguauauauauaua

SEQ ID NO: 1167731 - RNA, 24 nt, Human
uguguguauauauauauauauaac

SEQ ID NO: 1167732 - RNA, 23 nt, Human
uguguguauauauauauauaugu

SEQ ID NO: 1167733 - RNA, 18 nt, Human
uguguguguauauauaua

SEQ ID NO: 1167734 - RNA, 18 nt, Human
uguguguguauauauaua

SEQ ID NO: 1167735 - RNA, 18 nt, Human
uguguguguauauauaua

SEQ ID NO: 1167736 - RNA, 24 nt, Human
uguguguguauauauauauauaau

SEQ ID NO: 1167737 - RNA, 26 nt, Human
uguguguguguauauauauauaaugu

SEQ ID NO: 1167738 - RNA, 23 nt, Human
uguguguguguauauauauauau

SEQ ID NO: 1167739 - RNA, 18 nt, Human
uguguguguguguguaua

SEQ ID NO: 1167740 - RNA, 20 nt, Human
uguguguguguguguauaua

SEQ ID NO: 1167741 - RNA, 18 nt, Human
ugugugugugugugugug

SEQ ID NO: 1167742 - RNA, 18 nt, Human
ugugugugugugugugug

SEQ ID NO: 1167743 - RNA, 18 nt, Human
ugugugugugugugugug

SEQ ID NO: 1167744 - RNA, 18 nt, Human
ugugugugugugugugug

SEQ ID NO: 1167745 - RNA, 18 nt, Human
ugugugugugugugugug

SEQ ID NO: 1167746 - RNA, 24 nt, Human
uguguguguguguguguguauaua

SEQ ID NO: 1167747 - RNA, 21 nt, Human
ugugugugugugugugugugu

SEQ ID NO: 1167748 - RNA, 21 nt, Human
ugugugugugugugugugugu

SEQ ID NO: 1167749 - RNA, 21 nt, Human
ugugugugugugugugugugu

SEQ ID NO: 1167750 - RNA, 21 nt, Human
ugugugugugugugugugugu

SEQ ID NO: 1167751 - RNA, 22 nt, Human
ugugugugugugugugugugua

SEQ ID NO: 1167752 - RNA, 22 nt, Human
ugugugugugugugugugugug

SEQ ID NO: 1167753 - RNA, 22 nt, Human
ugugugugugugugugugugug

SEQ ID NO: 1167754 - RNA, 27 nt, Human
uguguuuuuaaaaguuacuccuuuuag

SEQ ID NO: 1167755 - RNA, 21 nt, Human
uguuuccaguacaccuuucag

SEQ ID NO: 1167756 - RNA, 20 nt, Human
uuaaaaaaaucaaaacaaaa

SEQ ID NO: 1167757 - RNA, 23 nt, Human
uuaaaauaaaguuggucuuuuga

SEQ ID NO: 1167758 - RNA, 27 nt, Human
uuaaagcacaaugucucacaugggacc

SEQ ID NO: 1167759 - RNA, 24 nt, Human
uuaaagcuacaaucuguucaaugu

SEQ ID NO: 1167760 - RNA, 24 nt, Human
uuuuuuaaaaagcuaguucuauaa

SEQ ID NO: 1167761 - RNA, 22 nt, Human
uguauccgagagcuggggagca

SEQ ID NO: 1167762 - RNA, 23 nt, Human
aagacagaaguccucgaaaaaga

SEQ ID NO: 1167763 - RNA, 25 nt, Human
aauacucuugcuauucucaagcagc

SEQ ID NO: 1167764 - RNA, 18 nt, Human
accaggucagaaaagaca

SEQ ID NO: 1167765 - RNA, 22 nt, Human
acccugagaauacagaggaaac

SEQ ID NO: 1167766 - RNA, 19 nt, Human
acccuggaguugccggggc

SEQ ID NO: 1167767 - RNA, 28 nt, Human
agaaauauuacccuuguagauagcccuc

SEQ ID NO: 1167768 - RNA, 25 nt, Human
agacugcuggagguuucuguaaacc

SEQ ID NO: 1167769 - RNA, 22 nt, Human
agauacuggugauagaaaagcc

SEQ ID NO: 1167770 - RNA, 23 nt, Human
aggcaagcagcaauccaccaggg

SEQ ID NO: 1167771 - RNA, 19 nt, Human
aguccucgaaaaagaagag

SEQ ID NO: 1167772 - RNA, 21 nt, Human
auaaaaccauuaaaagcaauc

SEQ ID NO: 1167773 - RNA, 22 nt, Human
caacaguaccauaaaaccauua

SEQ ID NO: 1167774 - RNA, 20 nt, Human
caaucauuuuaaaagaacuc

SEQ ID NO: 1167775 - RNA, 24 nt, Human
cagauacuggugauagaaaagccc

SEQ ID NO: 1167776 - RNA, 21 nt, Human
cagguccaaaccuaauggcaa

SEQ ID NO: 1167777 - RNA, 18 nt, Human
cauggcucaguuugaaga

SEQ ID NO: 1167778 - RNA, 20 nt, Human
ccaaugccacaguguaacag

SEQ ID NO: 1167779 - RNA, 22 nt, Human
ccccuaaagcauggcucaguuu

SEQ ID NO: 1167780 - RNA, 18 nt, Human
cccugagaauacagagga

SEQ ID NO: 1167781 - RNA, 20 nt, Human
cccuggaguugccggggcag

SEQ ID NO: 1167782 - RNA, 23 nt, Human
cgagagacucucaaacagcgaaa

SEQ ID NO: 1167783 - RNA, 18 nt, Human
cugcaacuuaaaauauua

SEQ ID NO: 1167784 - RNA, 19 nt, Human
cuggagguuucuguaaacg

SEQ ID NO: 1167785 - RNA, 23 nt, Human
cuuguagauagcccucucauacc

SEQ ID NO: 1167786 - RNA, 24 nt, Human
gaaaaagaagaggaguaaaaauau

SEQ ID NO: 1167787 - RNA, 21 nt, Human
gacagaaguccucgaaaaaga

SEQ ID NO: 1167788 - RNA, 21 nt, Human
gccuaggauaggucguggacc

SEQ ID NO: 1167789 - RNA, 21 nt, Human
ggugauagaaaagcccaaaaa

SEQ ID NO: 1167790 - RNA, 23 nt, Human
gguuuucaucagcccuuuaaggg

SEQ ID NO: 1167791 - RNA, 22 nt, Human
uaaaacaaaauauggcaggucc

SEQ ID NO: 1167792 - RNA, 24 nt, Human
uaaaauuucuagauacaaauacau

SEQ ID NO: 1167793 - RNA, 26 nt, Human
uaccaguaaauacaaagaguuaaaau

SEQ ID NO: 1167794 - RNA, 20 nt, Human
uaggaucacagaauaaaaca

SEQ ID NO: 1167795 - RNA, 21 nt, Human
uauauacaauacauacaggua

SEQ ID NO: 1167796 - RNA, 20 nt, Human
ucaucuccauuaaauuuaaa

SEQ ID NO: 1167797 - RNA, 21 nt, Human
ucguggaccagacacccugga

SEQ ID NO: 1167798 - RNA, 24 nt, Human
ucguggaccagacacccuggaguu

SEQ ID NO: 1167799 - RNA, 20 nt, Human
ucuauaggcagccacuauga

SEQ ID NO: 1167800 - RNA, 23 nt, Human
ucuguuggauuuuauuguuucaa

SEQ ID NO: 1167801 - RNA, 31 nt, Human
ugagccgagagacucucaaacagcgaaagaa

SEQ ID NO: 1167802 - RNA, 21 nt, Human
uggcaagauuacaaauguuca

SEQ ID NO: 1167803 - RNA, 23 nt, Human
uuaaaagaacucucaaguugggu

SEQ ID NO: 1167804 - RNA, 23 nt, Human
uuauauauuuuaaccauauucau

SEQ ID NO: 1167805 - RNA, 20 nt, Human
uucauauggccaaucauuuu

SEQ ID NO: 1167806 - RNA, 18 nt, Human
uuguauuugcuuucuucu

SEQ ID NO: 1167807 - RNA, 18 nt, Human
uuuaaaacaauacucuug

SEQ ID NO: 1167808 - RNA, 24 nt, Human
uuuuaaaagaacucucaaguuggg

SEQ ID NO: 1167809 - RNA, 22 nt, Human
uuuuaagcugcucagugccacu

SEQ ID NO: 1167810 - RNA, 27 nt, Human
aaaaaagacucaaucuauaauugcaaa

SEQ ID NO: 1167811 - RNA, 21 nt, Human
aaccauguuguauguuguacc

SEQ ID NO: 1167812 - RNA, 26 nt, Human
aagccuacaccaaagugcucauauga

SEQ ID NO: 1167813 - RNA, 20 nt, Human
aaggcacauuaucuugacug

SEQ ID NO: 1167814 - RNA, 19 nt, Human
acccugaaagaacagcaag

SEQ ID NO: 1167815 - RNA, 19 nt, Human
acccugaaagaacagcaag

SEQ ID NO: 1167816 - RNA, 25 nt, Human
aggaacacagagagguaccgguacc

SEQ ID NO: 1167817 - RNA, 22 nt, Human
caagacucagcccuccccaaug

SEQ ID NO: 1167818 - RNA, 21 nt, Human
cacccaauaaaaaguggucag

SEQ ID NO: 1167819 - RNA, 24 nt, Human
cacccuuaacucuuauggaauuuu

SEQ ID NO: 1167820 - RNA, 21 nt, Human
cacgauggcuuuuuuccaccu

SEQ ID NO: 1167821 - RNA, 25 nt, Human
cagcaaguaugcacacaugcagugu

SEQ ID NO: 1167822 - RNA, 26 nt, Human
cauuuuuaucuuaauauggcuggaaa

SEQ ID NO: 1167823 - RNA, 20 nt, Human
ccaagccuacaccaaagugc

SEQ ID NO: 1167824 - RNA, 18 nt, Human
cccaagcuaucauuuaaa

SEQ ID NO: 1167825 - RNA, 22 nt, Human
ccuaaaauacauuuucagcaca

SEQ ID NO: 1167826 - RNA, 20 nt, Human
cggggccagugcuuucgaga

SEQ ID NO: 1167827 - RNA, 18 nt, Human
cuggacuauccagcaucc

SEQ ID NO: 1167828 - RNA, 20 nt, Human
gacucagcccuccccaaugg

SEQ ID NO: 1167829 - RNA, 21 nt, Human
gccaucuuucaugcuggacua

SEQ ID NO: 1167830 - RNA, 23 nt, Human
gcguguguaugugcgcgcgcgcg

SEQ ID NO: 1167831 - RNA, 23 nt, Human
gcuaugugacaaggaacacagag

SEQ ID NO: 1167832 - RNA, 20 nt, Human
gguagacacagcaauggaca

SEQ ID NO: 1167833 - RNA, 22 nt, Human
guaguuuuuccaagccuacacu

SEQ ID NO: 1167834 - RNA, 27 nt, Human
uaaaauggguagacacagcaauggaca

SEQ ID NO: 1167835 - RNA, 23 nt, Human
uaaauauucacauguauuucccc

SEQ ID NO: 1167836 - RNA, 19 nt, Human
uaagugaagugauuccaaa

SEQ ID NO: 1167837 - RNA, 24 nt, Human
uagcagaaacacaguucggggcca

SEQ ID NO: 1167838 - RNA, 25 nt, Human
uauagcaagauuacguuuccuaaaa

SEQ ID NO: 1167839 - RNA, 18 nt, Human
uaugacauuaaaaagcag

SEQ ID NO: 1167840 - RNA, 21 nt, Human
ucaaucuauaauugcaaaccc

SEQ ID NO: 1167841 - RNA, 20 nt, Human
ucagcccuccccaauggccu

SEQ ID NO: 1167842 - RNA, 20 nt, Human
uccccaauggccuucauguu

SEQ ID NO: 1167843 - RNA, 23 nt, Human
ucuauaauugcaaacccugaaag

SEQ ID NO: 1167844 - RNA, 20 nt, Human
ugaaagcaaauacacaaaua

SEQ ID NO: 1167845 - RNA, 19 nt, Human
ugaaugacuuaccugcaca

SEQ ID NO: 1167846 - RNA, 21 nt, Human
ugaaugacuuaccugcacaga

SEQ ID NO: 1167847 - RNA, 23 nt, Human
ugacaaggaacacagagagguac

SEQ ID NO: 1167848 - RNA, 22 nt, Human
ugacauuaaaaagcagaaacac

SEQ ID NO: 1167849 - RNA, 21 nt, Human
ugacugaaaagcauccuugau

SEQ ID NO: 1167850 - RNA, 21 nt, Human
ugcaaggaagacauuuucaac

SEQ ID NO: 1167851 - RNA, 24 nt, Human
ugcaaggaagacauuuucaaccau

SEQ ID NO: 1167852 - RNA, 21 nt, Human
ugcacagauacucaggccaag

SEQ ID NO: 1167853 - RNA, 22 nt, Human
ugcacagauacucaggccaaga

SEQ ID NO: 1167854 - RNA, 24 nt, Human
uggaaacaaggcacauuaucuuga

SEQ ID NO: 1167855 - RNA, 19 nt, Human
uggacagccuucugcaagg

SEQ ID NO: 1167856 - RNA, 22 nt, Human
uggguagacacagcaauggaca

SEQ ID NO: 1167857 - RNA, 21 nt, Human
uguguacagaugcguguguau

SEQ ID NO: 1167858 - RNA, 22 nt, Human
uguguacagaugcguguguaug

SEQ ID NO: 1167859 - RNA, 24 nt, Human
uuccccgcccuauugcuuucuagc

SEQ ID NO: 1167860 - RNA, 24 nt, Human
uuucaugcuggacuauccagcauc

SEQ ID NO: 1167861 - RNA, 26 nt, Human
uuucuuaugaaugacuuaccugcaca

SEQ ID NO: 1167862 - RNA, 19 nt, Human
aaaaaaggaaacauauaau

SEQ ID NO: 1167863 - RNA, 22 nt, Human
aaaaaggaaacauauaauaaga

SEQ ID NO: 1167864 - RNA, 18 nt, Human
aaaaauacuaaaccugua

SEQ ID NO: 1167865 - RNA, 21 nt, Human
aaaccuguauauuugguauug

SEQ ID NO: 1167866 - RNA, 21 nt, Human
aacaaucacuaacaggcaaaa

SEQ ID NO: 1167867 - RNA, 22 nt, Human
aacaguucuucagaccuggcuc

SEQ ID NO: 1167868 - RNA, 18 nt, Human
aagagauuugaaaagucu

SEQ ID NO: 1167869 - RNA, 19 nt, Human
aagagauuugaaaagucug

SEQ ID NO: 1167870 - RNA, 22 nt, Human
aaggcuuuuaguuuacauuugg

SEQ ID NO: 1167871 - RNA, 23 nt, Human
acaacauugguggaugaagaaug

SEQ ID NO: 1167872 - RNA, 21 nt, Human
acauccacaguacucguccac

SEQ ID NO: 1167873 - RNA, 22 nt, Human
acaugugaaacaaucacuaaca

SEQ ID NO: 1167874 - RNA, 20 nt, Human
agauauuaaaggcaacgucu

SEQ ID NO: 1167875 - RNA, 20 nt, Human
agauuugaaaagucuggaca

SEQ ID NO: 1167876 - RNA, 23 nt, Human
agccugaaaaugauuuacaaaaa

SEQ ID NO: 1167877 - RNA, 21 nt, Human
agcugcagaagccugaaaaug

SEQ ID NO: 1167878 - RNA, 19 nt, Human
aggagcucuuuggacuuuc

SEQ ID NO: 1167879 - RNA, 23 nt, Human
aggagcucuuuggacuuucuuuu

SEQ ID NO: 1167880 - RNA, 20 nt, Human
aggcaaaaauacuaaaccug

SEQ ID NO: 1167881 - RNA, 19 nt, Human
aggguaccaccacaggaaa

SEQ ID NO: 1167882 - RNA, 22 nt, Human
cacacgacuauaaacauuguuc

SEQ ID NO: 1167883 - RNA, 22 nt, Human
cacauccacaguacucguccac

SEQ ID NO: 1167884 - RNA, 18 nt, Human
caccacaggaaaguccaa

SEQ ID NO: 1167885 - RNA, 18 nt, Human
caggcaaaaauacuaaac

SEQ ID NO: 1167886 - RNA, 18 nt, Human
cccacauucacauccaca

SEQ ID NO: 1167887 - RNA, 19 nt, Human
cccccacuguacacacgac

SEQ ID NO: 1167888 - RNA, 31 nt, Human; identical to SEQ ID NO: 335636

SEQ ID NO: 1167889 - RNA, 24 nt, Human
gaaucuacagcugcagaagccuga

SEQ ID NO: 1167890 - RNA, 20 nt, Human
gacuauaaacauuguucccu

SEQ ID NO: 1167891 - RNA, 20 nt, Human
gagaaucuacagcugcagaa

SEQ ID NO: 1167892 - RNA, 21 nt, Human
gugagaaucuacagcugcaga

SEQ ID NO: 1167893 - RNA, 18 nt, Human
uaaagacaagaucaccgu

SEQ ID NO: 1167894 - RNA, 24 nt, Human
uaaaguauacaguacaccauuuuc

SEQ ID NO: 1167895 - RNA, 21 nt, Human
uacaaguaucaaagaagcgaa

SEQ ID NO: 1167896 - RNA, 21 nt, Human
uacaguacaccauuuucauac

SEQ ID NO: 1167897 - RNA, 24 nt, Human
uacauuauuguacucuccaauaca

SEQ ID NO: 1167898 - RNA, 20 nt, Human
uacuucaacuugcuuucuau

SEQ ID NO: 1167899 - RNA, 22 nt, Human
uagaaugugcaaacugauauag

SEQ ID NO: 1167900 - RNA, 23 nt, Human
uaucuggaguagucuauauagga

SEQ ID NO: 1167901 - RNA, 19 nt, Human
uauguaaacaaaaaaagga

SEQ ID NO: 1167902 - RNA, 19 nt, Human
uccaauacaaaguaugggg

SEQ ID NO: 1167903 - RNA, 25 nt, Human
ucccuauguaaacaaaaaaaggaaa

SEQ ID NO: 1167904 - RNA, 27 nt, Human
ucccuauguaaacaaaaaaaggaaacu

SEQ ID NO: 1167905 - RNA, 22 nt, Human
ucuccaauacaaaguauggggc

SEQ ID NO: 1167906 - RNA, 20 nt, Human
ucucuuagcaguaauacugg

SEQ ID NO: 1167907 - RNA, 21 nt, Human
ucucuugugauacuggaaagu

SEQ ID NO: 1167908 - RNA, 21 nt, Human
ugaaacaaucacuaacaggca

SEQ ID NO: 1167909 - RNA, 20 nt, Human
ugagaaucuacagcugcaga

SEQ ID NO: 1167910 - RNA, 21 nt, Human
uggacauuuccuucccaacag

SEQ ID NO: 1167911 - RNA, 26 nt, Human
uggccaccucaaaguaguuguaacau

SEQ ID NO: 1167912 - RNA, 21 nt, Human
uguaaacaaaaaaaggaaaca

SEQ ID NO: 1167913 - RNA, 20 nt, Human
uguacacacgacuauaaaca

SEQ ID NO: 1167914 - RNA, 26 nt, Human
uguucccuauguaaacaaaaaaagga

SEQ ID NO: 1167915 - RNA, 20 nt, Human
uuaaaguauacaguacacca

SEQ ID NO: 1167916 - RNA, 20 nt, Human
uucccuauguaaacaaaaaa

SEQ ID NO: 1167917 - RNA, 23 nt, Human
uuuaacaaaguuggaaugcuggc

SEQ ID NO: 1167918 - RNA, 23 nt, Human
aaucugcuucuccuuuaucuccg

SEQ ID NO: 1167919 - RNA, 27 nt, Human
acugagaaggaaaauguuucauaaucu

SEQ ID NO: 1167920 - RNA, 18 nt, Human
agaaggaaaauguuucau

SEQ ID NO: 1167921 - RNA, 22 nt, Human
ucuccgcaccugccuuccgcug

SEQ ID NO: 1167922 - RNA, 18 nt, Human
uuuaucuccgcaccugcc

SEQ ID NO: 1167923 - RNA, 18 nt, Human
acaugcugccauugaucc

SEQ ID NO: 1167924 - RNA, 20 nt, Human
acccucugggcagagcucaa

SEQ ID NO: 1167925 - RNA, 23 nt, Human
agaagcugacagauaaaguuuug

SEQ ID NO: 1167926 - RNA, 23 nt, Human
agcugguuucuguugcagagagu

SEQ ID NO: 1167927 - RNA, 19 nt, Human
agggagaagcugacagaua

SEQ ID NO: 1167928 - RNA, 23 nt, Human
caggaaacuaaagcacacaguga

SEQ ID NO: 1167929 - RNA, 19 nt, Human
cauccucucauuccaaccu

SEQ ID NO: 1167930 - RNA, 26 nt, Human
ccacagguuuucucuagccaagaucc

SEQ ID NO: 1167931 - RNA, 22 nt, Human
ccaggaaacuaaagcacacagu

SEQ ID NO: 1167932 - RNA, 24 nt, Human
cucaaugccccuauuuuauaaacc

SEQ ID NO: 1167933 - RNA, 20 nt, Human
cuuccaccauuccacacauc

SEQ ID NO: 1167934 - RNA, 19 nt, Human
gcagggagaagcugacaga

SEQ ID NO: 1167935 - RNA, 26 nt, Human
guagagcauuccucacaaguucauaa

SEQ ID NO: 1167936 - RNA, 23 nt, Human
gugaaguggcagggagaagcuga

SEQ ID NO: 1167937 - RNA, 19 nt, Human
guggcagggagaagcugac

SEQ ID NO: 1167938 - RNA, 19 nt, Human
uaaaccaggaaacuaaagc

SEQ ID NO: 1167939 - RNA, 22 nt, Human
uaaguaacuuguucaaagguau

SEQ ID NO: 1167940 - RNA, 25 nt, Human
ucauacaugcugccauugauccgaa

SEQ ID NO: 1167941 - RNA, 23 nt, Human
uccacacaucuuggaaguagagc

SEQ ID NO: 1167942 - RNA, 19 nt, Human
uccugcugguaccuugauu

SEQ ID NO: 1167943 - RNA, 18 nt, Human
uccuuugcagucauccuc

SEQ ID NO: 1167944 - RNA, 26 nt, Human
uccuuugcagucauccucucauucca

SEQ ID NO: 1167945 - RNA, 21 nt, Human
ugaggaggugaacuaggacca

SEQ ID NO: 1167946 - RNA, 23 nt, Human
ugauuacuaaguggaaaagcugg

SEQ ID NO: 1167947 - RNA, 19 nt, Human
uggcagggagaagcugaca

SEQ ID NO: 1167948 - RNA, 18 nt, Human
ugugaaguggcagggaga

SEQ ID NO: 1167949 - RNA, 21 nt, Human
uguugcagagaguugggucuc

SEQ ID NO: 1167950 - RNA, 25 nt, Human
uguuugucuuccaccauuccacaca

SEQ ID NO: 1167951 - RNA, 18 nt, Human
uucauaaaaauccugcug

SEQ ID NO: 1167952 - RNA, 20 nt, Human
uucucuagccaagauccuga

SEQ ID NO: 1167953 - RNA, 27 nt, Human
aaacaacagagcugaaccagugaagca

SEQ ID NO: 1167954 - RNA, 21 nt, Human
aacauuuuuuuuuuuagaugg

SEQ ID NO: 1167955 - RNA, 24 nt, Human
aauauuguacucuagucugggcaa

SEQ ID NO: 1167956 - RNA, 22 nt, Human
acuaaaauccccaaauuacuuc

SEQ ID NO: 1167957 - RNA, 19 nt, Human
agagcugaaccagugaagc

SEQ ID NO: 1167958 - RNA, 19 nt, Human
agcacuaaagagaaaauau

SEQ ID NO: 1167959 - RNA, 24 nt, Human
agcccuuugggaggcagagguggg

SEQ ID NO: 1167960 - RNA, 24 nt, Human
aggaucacuugagcccaggaguuu

SEQ ID NO: 1167961 - RNA, 24 nt, Human
aggcagaggugggaggaucacuug

SEQ ID NO: 1167962 - RNA, 18 nt, Human
aggugggaggaucacuug

SEQ ID NO: 1167963 - RNA, 23 nt, Human
aggugggaggaucacuugagccc

SEQ ID NO: 1167964 - RNA, 24 nt, Human
auauuguacucuagucugggcaac

SEQ ID NO: 1167965 - RNA, 20 nt, Human
aucacuugagcccaggaguu

SEQ ID NO: 1167966 - RNA, 18 nt, Human
auuguacucuagucuggg

SEQ ID NO: 1167967 - RNA, 23 nt, Human
auuguacucuagucugggcaaca

SEQ ID NO: 1167968 - RNA, 24 nt, Human
auuguacucuagucugggcaacag

SEQ ID NO: 1167969 - RNA, 20 nt, Human
caaaaaguacaugaucacaa

SEQ ID NO: 1167970 - RNA, 22 nt, Human
caccugcagucccagcccuuug

SEQ ID NO: 1167971 - RNA, 24 nt, Human
caccugcagucccagcccuuuggg

SEQ ID NO: 1167972 - RNA, 24 nt, Human
cagagccuggggugagaaagcugg

SEQ ID NO: 1167973 - RNA, 21 nt, Human
cagcccuuugggaggcagagg

SEQ ID NO: 1167974 - RNA, 24 nt, Human
cagcccuuugggaggcagaggugg

SEQ ID NO: 1167975 - RNA, 21 nt, Human
cauuuuuuuuuuuagauggaa

SEQ ID NO: 1167976 - RNA, 18 nt, Human
cccuuugggaggcagagg

SEQ ID NO: 1167977 - RNA, 18 nt, Human
ccugcagucccagcccuu

SEQ ID NO: 1167978 - RNA, 20 nt, Human
ccuggggugagaaagcuggg

SEQ ID NO: 1167979 - RNA, 21 nt, Human
ccuuugggaggcagagguggg

SEQ ID NO: 1167980 - RNA, 22 nt, Human
cugaaccagugaagcacauuuc

SEQ ID NO: 1167981 - RNA, 18 nt, Human
gagcccaggaguuugagg

SEQ ID NO: 1167982 - RNA, 25 nt, Human
gaggcagaggugggaggaucacuug

SEQ ID NO: 1167983 - RNA, 23 nt, Human
gaggugggaggaucacuugagcc

SEQ ID NO: 1167984 - RNA, 24 nt, Human
gaucacuugagcccaggaguuuga

SEQ ID NO: 1167985 - RNA, 20 nt, Human
gcacuaaagagaaaauauga

SEQ ID NO: 1167986 - RNA, 24 nt, Human
gcccaggaguuugaggcugcagug

SEQ ID NO: 1167987 - RNA, 22 nt, Human
ggaucacuugagcccaggaguu

SEQ ID NO: 1167988 - RNA, 20 nt, Human
uaaaauccccaaauuacuuc

SEQ ID NO: 1167989 - RNA, 21 nt, Human
uaagcacuaaagagaaaauau

SEQ ID NO: 1167990 - RNA, 19 nt, Human
ucacuugagcccaggaguu

SEQ ID NO: 1167991 - RNA, 20 nt, Human
uccauaauaaaaguuacuau

SEQ ID NO: 1167992 - RNA, 24 nt, Human
ucccaaaauuguccuagacaacua

SEQ ID NO: 1167993 - RNA, 23 nt, Human
ucucagaccgcggcugcgucgcc

SEQ ID NO: 1167994 - RNA, 22 nt, Human
ucuccccaagagacuuauucaa

SEQ ID NO: 1167995 - RNA, 21 nt, Human
ucugagggauauuauuaaaaa

SEQ ID NO: 1167996 - RNA, 20 nt, Human
ugagaaagcugggcauggua

SEQ ID NO: 1167997 - RNA, 23 nt, Human
ugaggcugcagugagcugugauu

SEQ ID NO: 1167998 - RNA, 19 nt, Human
ugcagagccuggggugaga

SEQ ID NO: 1167999 - RNA, 19 nt, Human
ugggaggcagaggugggag

SEQ ID NO: 1168000 - RNA, 20 nt, Human
ugggaggcagaggugggagg

SEQ ID NO: 1168001 - RNA, 24 nt, Human
ugggaggcagaggugggaggauca

SEQ ID NO: 1168002 - RNA, 18 nt, Human
uggggugagaaagcuggg

SEQ ID NO: 1168003 - RNA, 18 nt, Human
uguacucuagucugggca

SEQ ID NO: 1168004 - RNA, 19 nt, Human
uguacucuagucugggcaa

SEQ ID NO: 1168005 - RNA, 20 nt, Human
uguacucuagucugggcaac

SEQ ID NO: 1168006 - RNA, 22 nt, Human
uguacucuagucugggcaacag

SEQ ID NO: 1168007 - RNA, 19 nt, Human
uguuuaaggaaacaacaga

SEQ ID NO: 1168008 - RNA, 26 nt, Human
uuagauggaaaaguuugcagaaagag

SEQ ID NO: 1168009 - RNA, 24 nt, Human
uucuccccaagagacuuauucaaa

SEQ ID NO: 1168010 - RNA, 25 nt, Human
uuuaaaaaaaaauacaaaaacaaac

SEQ ID NO: 1168011 - RNA, 25 nt, Human
uuuaaauauauauugacauuuaugu

SEQ ID NO: 1168012 - RNA, 22 nt, Human
uuuaaguacauauuggauuugu

SEQ ID NO: 1168013 - RNA, 20 nt, Human
uuuccuauguuuccauuauu

SEQ ID NO: 1168014 - RNA, 22 nt, Human
agguccaugaaaccagcagccu

SEQ ID NO: 1168015 - RNA, 25 nt, Human
cccuuuauagacuguuguuuuuaac

SEQ ID NO: 1168016 - RNA, 22 nt, Human
cucugugucauugugguacagg

SEQ ID NO: 1168017 - RNA, 21 nt, Human
gaaacuuuuacuacucugccu

SEQ ID NO: 1168018 - RNA, 22 nt, Human
guacagguccaugaaaccagca

SEQ ID NO: 1168019 - RNA, 23 nt, Human
uagugcagcuuuaaaaacuccaa

SEQ ID NO: 1168020 - RNA, 22 nt, Human
ucaguccugaugcucugguguu

SEQ ID NO: 1168021 - RNA, 20 nt, Human
ucccuaauaccuuuucuucg

SEQ ID NO: 1168022 - RNA, 21 nt, Human
uccugaugcucugguguucuc

SEQ ID NO: 1168023 - RNA, 24 nt, Human
ucugcugugagcaauauuugaaac

SEQ ID NO: 1168024 - RNA, 23 nt, Human
ugagcaauauuugaaaccuuaac

SEQ ID NO: 1168025 - RNA, 19 nt, Human
ugaugcucugguguucucu

SEQ ID NO: 1168026 - RNA, 22 nt, Human
ugcucugguguucucuguguca

SEQ ID NO: 1168027 - RNA, 18 nt, Human
ugguguucucugugucau

SEQ ID NO: 1168028 - RNA, 19 nt, Human
uuuucuggcuuucauuuug

SEQ ID NO: 1168029 - RNA, 21 nt, Human
uuuugguuuuucccauccacu

SEQ ID NO: 1168030 - RNA, 19 nt, Human
aaaaagccagccaacugag

SEQ ID NO: 1168031 - RNA, 18 nt, Human
aaauauccacuauucccc

SEQ ID NO: 1168032 - RNA, 20 nt, Human
aacaccuauccagucuugac

SEQ ID NO: 1168033 - RNA, 25 nt, Human
aaccaucuguuugucaaacaccuaa

SEQ ID NO: 1168034 - RNA, 18 nt, Human
aacuucucucuccaaucu

SEQ ID NO: 1168035 - RNA, 21 nt, Human
aagccagccaacugagugcaa

SEQ ID NO: 1168036 - RNA, 20 nt, Human
aagcucagcucgggaugcgg

SEQ ID NO: 1168037 - RNA, 21 nt, Human
aauauccacuauucccccagc

SEQ ID NO: 1168038 - RNA, 23 nt, Human
aauggcaauuaacagucccuaca

SEQ ID NO: 1168039 - RNA, 19 nt, Human
acacacacacguauauaua

SEQ ID NO: 1168040 - RNA, 22 nt, Human
accaagcccuuauugcaauccc

SEQ ID NO: 1168041 - RNA, 26 nt, Human
accuaaccaucuaacuuuuacaccau

SEQ ID NO: 1168042 - RNA, 20 nt, Human
agacuagaaaaucuguggug

SEQ ID NO: 1168043 - RNA, 23 nt, Human
aggcuuucagccaagcucagcuc

SEQ ID NO: 1168044 - RNA, 19 nt, Human
agguacauccaaaaugcaa

SEQ ID NO: 1168045 - RNA, 18 nt, Human
agugaugacuaacaccua

SEQ ID NO: 1168046 - RNA, 24 nt, Human
auauauauguguguauauauacau

SEQ ID NO: 1168047 - RNA, 19 nt, Human
auauauguguauauauaca

SEQ ID NO: 1168048 - RNA, 19 nt, Human
auauguguguauauauaca

SEQ ID NO: 1168049 - RNA, 22 nt, Human
auccaaaaugcaacaauuacac

SEQ ID NO: 1168050 - RNA, 18 nt, Human
auggaagagagguggugg

SEQ ID NO: 1168051 - RNA, 20 nt, Human
caaaaugcaacaauuacaca

SEQ ID NO: 1168052 - RNA, 26 nt, Human
caaaaugcaacaauuacacauaugac

SEQ ID NO: 1168053 - RNA, 21 nt, Human
caaaguauaauuuuacuggga

SEQ ID NO: 1168054 - RNA, 24 nt, Human
cacacacacacacguauauauaug

SEQ ID NO: 1168055 - RNA, 18 nt, Human
cacacacacguauauaua

SEQ ID NO: 1168056 - RNA, 22 nt, Human
cacacguauauauauguauaua

SEQ ID NO: 1168057 - RNA, 21 nt, Human
cacacuugacuucugucccuu

SEQ ID NO: 1168058 - RNA, 19 nt, Human
caccauacguuucaugguc

SEQ ID NO: 1168059 - RNA, 22 nt, Human
cacguauauauauguauauaua

SEQ ID NO: 1168060 - RNA, 19 nt, Human
cacuugacuucugucccuu

SEQ ID NO: 1168061 - RNA, 22 nt, Human
cagccagucaggagaaaucuga

SEQ ID NO: 1168062 - RNA, 21 nt, Human
cauauccuaagaauuuaggaa

SEQ ID NO: 1168063 - RNA, 25 nt, Human
cauuaaauauccacuauucccccag

SEQ ID NO: 1168064 - RNA, 22 nt, Human
cuauccagucuugacaguuuua

SEQ ID NO: 1168065 - RNA, 20 nt, Human
cuccaaucuggccacgcuau

SEQ ID NO: 1168066 - RNA, 25 nt, Human
cuucacacuugacuucugucccuuc

SEQ ID NO: 1168067 - RNA, 22 nt, Human
ggauaccauggggcccaaacug

SEQ ID NO: 1168068 - RNA, 22 nt, Human
gucuugccuaccuuacugccca

SEQ ID NO: 1168069 - RNA, 19 nt, Human
guguauauauacauauaua

SEQ ID NO: 1168070 - RNA, 26 nt, Human
uaaaaagccagccaacugagugcaac

SEQ ID NO: 1168071 - RNA, 22 nt, Human
uaaacucccaaaccagaagcuu

SEQ ID NO: 1168072 - RNA, 23 nt, Human
uaagaauuuaggaacagccaguc

SEQ ID NO: 1168073 - RNA, 22 nt, Human
uaagguaaguauuaaaaagcca

SEQ ID NO: 1168074 - RNA, 23 nt, Human
uaaguauuaaaaagccagccaac

SEQ ID NO: 1168075 - RNA, 24 nt, Human
uacacacacacacacguauauaua

SEQ ID NO: 1168076 - RNA, 25 nt, Human
uacacacacacacacguauauauau

SEQ ID NO: 1168077 - RNA, 20 nt, Human
uacacggauauauauauaua

SEQ ID NO: 1168078 - RNA, 20 nt, Human
uacauacacggauauauaua

SEQ ID NO: 1168079 - RNA, 22 nt, Human
uauauacacacacacacacggu

SEQ ID NO: 1168080 - RNA, 25 nt, Human
uauauacacacacacacacguauag

SEQ ID NO: 1168081 - RNA, 25 nt, Human
uauauacacacacacacacguauau

SEQ ID NO: 1168082 - RNA, 24 nt, Human
uauauacauauauauguguguaua

SEQ ID NO: 1168083 - RNA, 27 nt, Human
uauauacauauauauguguguauauaa

SEQ ID NO: 1168084 - RNA, 21 nt, Human
uauauauacacacacacacac

SEQ ID NO: 1168085 - RNA, 20 nt, Human
uauauauauauguguauaua

SEQ ID NO: 1168086 - RNA, 18 nt, Human
uauauauauguauauaua

SEQ ID NO: 1168087 - RNA, 22 nt, Human
uauauauauguguauauauaca

SEQ ID NO: 1168088 - RNA, 23 nt, Human
uauauauauguguauauauacau

SEQ ID NO: 1168089 - RNA, 24 nt, Human
uauauauauguguauauauacaua

SEQ ID NO: 1168090 - RNA, 18 nt, Human
uauauauguauauauaca

SEQ ID NO: 1168091 - RNA, 22 nt, Human
uauauauguguguauauauaca

SEQ ID NO: 1168092 - RNA, 24 nt, Human
uauauauguguguauauauacaua

SEQ ID NO: 1168093 - RNA, 20 nt, Human
uauauguguguauauauaca

SEQ ID NO: 1168094 - RNA, 25 nt, Human
uaucuaaacucccaaaccagaagcu

SEQ ID NO: 1168095 - RNA, 22 nt, Human
uauguguauauauacauauaua

SEQ ID NO: 1168096 - RNA, 24 nt, Human
uauguguauauauacauauauaug

SEQ ID NO: 1168097 - RNA, 29 nt, Human
uauguguauauauacauauauaugugugu

SEQ ID NO: 1168098 - RNA, 24 nt, Human
uauuaaaaagccagccaacugagu

SEQ ID NO: 1168099 - RNA, 20 nt, Human
uauuuacagcuuuuuuuugg

SEQ ID NO: 1168100 - RNA, 22 nt, Human
uauuucauauauauauaugugu

SEQ ID NO: 1168101 - RNA, 21 nt, Human
ucaaacaccuaaccaucuaac

SEQ ID NO: 1168102 - RNA, 24 nt, Human
ucaaaccuaucuaaacucccaaac

SEQ ID NO: 1168103 - RNA, 22 nt, Human
ucaccaagcccuuauugcaauc

SEQ ID NO: 1168104 - RNA, 22 nt, Human
ucaguugaggcuauggcuccua

SEQ ID NO: 1168105 - RNA, 24 nt, Human
ucccugauaaacaaagggggagga

SEQ ID NO: 1168106 - RNA, 18 nt, Human
uccgaggagguggcugag

SEQ ID NO: 1168107 - RNA, 21 nt, Human
ucuaaacucccaaaccagaag

SEQ ID NO: 1168108 - RNA, 21 nt, Human
ucucuccaaucuggccacgcu

SEQ ID NO: 1168109 - RNA, 23 nt, Human
ucugaccaaauuuagcaaucacu

SEQ ID NO: 1168110 - RNA, 20 nt, Human
ugaccugcaaacagauaccu

SEQ ID NO: 1168111 - RNA, 21 nt, Human
ugaccugcaaacagauaccuu

SEQ ID NO: 1168112 - RNA, 20 nt, Human
ugcaaucccaaauaugcaau

SEQ ID NO: 1168113 - RNA, 21 nt, Human
ugccuaccuuacugcccaugu

SEQ ID NO: 1168114 - RNA, 18 nt, Human
uggaaguccacaggcuuu

SEQ ID NO: 1168115 - RNA, 24 nt, Human
uggcuccuaugccuugggaugguu

SEQ ID NO: 1168116 - RNA, 28 nt, Human
uguauauauacauacacggauauauaua

SEQ ID NO: 1168117 - RNA, 19 nt, Human
uguauauauacauauauau

SEQ ID NO: 1168118 - RNA, 24 nt, Human
uguauauauacauauauaugugug

SEQ ID NO: 1168119 - RNA, 20 nt, Human
uguauuucauauauauauau

SEQ ID NO: 1168120 - RNA, 22 nt, Human
uguauuucauauauauauaugu

SEQ ID NO: 1168121 - RNA, 18 nt, Human
uguguauauauacauaca

SEQ ID NO: 1168122 - RNA, 18 nt, Human
uguguauauauacauaua

SEQ ID NO: 1168123 - RNA, 20 nt, Human
uguguauauauacauauaua

SEQ ID NO: 1168124 - RNA, 20 nt, Human
uguguauauauacauauaua

SEQ ID NO: 1168125 - RNA, 22 nt, Human
uguguauauauacauauauaug

SEQ ID NO: 1168126 - RNA, 21 nt, Human
uuaaucccaaacacugggcua

SEQ ID NO: 1168127 - RNA, 21 nt, Human
uucccccagcucaccaagccc

SEQ ID NO: 1168128 - RNA, 23 nt, Human
uucccccagcucaccaagcccuu

SEQ ID NO: 1168129 - RNA, 22 nt, Human
uuucucauuuucugaccugcaa

SEQ ID NO: 1168130 - RNA, 24 nt, Human
aacaucaaauauucaucugaacaa

SEQ ID NO: 1168131 - RNA, 21 nt, Human
aaccaugauagcgauacuuuc

SEQ ID NO: 1168132 - RNA, 30 nt, Human
aagagagaagacucaagaagcgaagaggaa

SEQ ID NO: 1168133 - RNA, 25 nt, Human
aagcacacggugcuggugacagaac

SEQ ID NO: 1168134 - RNA, 22 nt, Human
aagcuccaugaggagaagauga

SEQ ID NO: 1168135 - RNA, 20 nt, Human
aagucugcucucugugcuuc

SEQ ID NO: 1168136 - RNA, 21 nt, Human
accugaaaacggccaagaagc

SEQ ID NO: 1168137 - RNA, 21 nt, Human
agacucaagaagcgaagagga

SEQ ID NO: 1168138 - RNA, 29 nt, Human
agagagaagacucaagaagcgaagaggaa

SEQ ID NO: 1168139 - RNA, 19 nt, Human
agagauccagaggcucaag

SEQ ID NO: 1168140 - RNA, 22 nt, Human
aggaaauugcggaccugaaaac

SEQ ID NO: 1168141 - RNA, 24 nt, Human
aggagcacacccguccuuugaggc

SEQ ID NO: 1168142 - RNA, 21 nt, Human
aggcccgggaggaggcccgga

SEQ ID NO: 1168143 - RNA, 18 nt, Human
agguaucaaagcuugaaa

SEQ ID NO: 1168144 - RNA, 21 nt, Human
aguaaggacagcgcucaccau

SEQ ID NO: 1168145 - RNA, 22 nt, Human
agugacaaaguaaggacagcgc

SEQ ID NO: 1168146 - RNA, 20 nt, Human
aucauuucgccucucuguuu

SEQ ID NO: 1168147 - RNA, 26 nt, Human
caagaagccaucucgaagaucaagug

SEQ ID NO: 1168148 - RNA, 20 nt, Human
cacggugcuggugacagaac

SEQ ID NO: 1168149 - RNA, 24 nt, Human
cagaacaucaaauauucaucugaa

SEQ ID NO: 1168150 - RNA, 18 nt, Human
cagauaaaaucaaggcug

SEQ ID NO: 1168151 - RNA, 28 nt, Human
caucagacccauguagaacccaucucuu

SEQ ID NO: 1168152 - RNA, 19 nt, Human
caugcuuccugggugauac

SEQ ID NO: 1168153 - RNA, 21 nt, Human
ccacacauugcauaguaaggc

SEQ ID NO: 1168154 - RNA, 19 nt, Human
ccaugaggagaagaugaag

SEQ ID NO: 1168155 - RNA, 22 nt, Human
cgacggcagcagugacaaagga

SEQ ID NO: 1168156 - RNA, 18 nt, Human
cggugaagguacgugaug

SEQ ID NO: 1168157 - RNA, 23 nt, Human
cuaagacacacauuuaucaguuu

SEQ ID NO: 1168158 - RNA, 21 nt, Human
cugguuaguacaguaauccca

SEQ ID NO: 1168159 - RNA, 18 nt, Human
cuucuucauguguuuucu

SEQ ID NO: 1168160 - RNA, 21 nt, Human
gacccauguagaacccaucuc

SEQ ID NO: 1168161 - RNA, 22 nt, Human
gaucuguuuugcaguccucccc

SEQ ID NO: 1168162 - RNA, 23 nt, Human
gcagcagugacaaaguaaggaca

SEQ ID NO: 1168163 - RNA, 21 nt, Human
gcaggaaaugucaaggacggu

SEQ ID NO: 1168164 - RNA, 21 nt, Human
gcgacggcagcagugacaaag

SEQ ID NO: 1168165 - RNA, 20 nt, Human
gcuucuaacaugcuuccugg

SEQ ID NO: 1168166 - RNA, 18 nt, Human
ggaauuggaaaagagaug

SEQ ID NO: 1168167 - RNA, 19 nt, Human
gggaaaaaccaugauagcg

SEQ ID NO: 1168168 - RNA, 21 nt, Human
gguaucaaagcuugaaagaga

SEQ ID NO: 1168169 - RNA, 24 nt, Human
uaaggccccagaacaucaaauauu

SEQ ID NO: 1168170 - RNA, 22 nt, Human
uagcgauacuuucuaauuuuaa

SEQ ID NO: 1168171 - RNA, 20 nt, Human
ucaagucugcucucugugcu

SEQ ID NO: 1168172 - RNA, 20 nt, Human
ucaagugggagucggagcgg

SEQ ID NO: 1168173 - RNA, 21 nt, Human
uccaagcagauaaaaucaagg

SEQ ID NO: 1168174 - RNA, 22 nt, Human
ugcagaccacacauugcauagu

SEQ ID NO: 1168175 - RNA, 19 nt, Human
ugcuugucugcagaccaca

SEQ ID NO: 1168176 - RNA, 23 nt, Human
uggagagauccagaggcucaagu

SEQ ID NO: 1168177 - RNA, 18 nt, Human
uggugacagaacucaaag

SEQ ID NO: 1168178 - RNA, 19 nt, Human
uguaaacagugccuaccuu

SEQ ID NO: 1168179 - RNA, 21 nt, Human
uguaaacagugccuaccuuuu

SEQ ID NO: 1168180 - RNA, 21 nt, Human
uguuaagaugcaaauucugag

SEQ ID NO: 1168181 - RNA, 21 nt, Human
uuaucaagcagcacgagcagg

SEQ ID NO: 1168182 - RNA, 22 nt, Human
uucuucauguguuuucuuguca

SEQ ID NO: 1168183 - RNA, 22 nt, Human
aacuaugugaucccaaagcgcc

SEQ ID NO: 1168184 - RNA, 18 nt, Human
acuaugugaucccaaagc

SEQ ID NO: 1168185 - RNA, 19 nt, Human
caacuaugugaucccaaag

SEQ ID NO: 1168186 - RNA, 21 nt, Human
cagucccaggacaacugucag

SEQ ID NO: 1168187 - RNA, 19 nt, Human
ggaagucuggcuuuggguc

SEQ ID NO: 1168188 - RNA, 22 nt, Human
ggaagucuggcuuugggucuuu

SEQ ID NO: 1168189 - RNA, 19 nt, Human
gucaggaauaagacaagca

SEQ ID NO: 1168190 - RNA, 20 nt, Human
gucugguuugucgucugcau

SEQ ID NO: 1168191 - RNA, 23 nt, Human
uaagacaagcagucccaggacaa

SEQ ID NO: 1168192 - RNA, 21 nt, Human
ucuggcuugucgucuggcuug

SEQ ID NO: 1168193 - RNA, 24 nt, Human
uggcuugucgucuggcuugucugg

SEQ ID NO: 1168194 - RNA, 21 nt, Human
aacgagcgccggcugugcacg

SEQ ID NO: 1168195 - RNA, 20 nt, Human
aaggguccaggggaguuguu

SEQ ID NO: 1168196 - RNA, 22 nt, Human
agaauaaccacugaaucccaaa

SEQ ID NO: 1168197 - RNA, 25 nt, Human
agagcuucuccgaagcagcggucau

SEQ ID NO: 1168198 - RNA, 21 nt, Human
agcagggaaccagggcuggcc

SEQ ID NO: 1168199 - RNA, 24 nt, Human
agcgacgccagcuucagcagcgcg

SEQ ID NO: 1168200 - RNA, 23 nt, Human
aggacgguggcugcagcagggaa

SEQ ID NO: 1168201 - RNA, 18 nt, Human
aggcagcuuugcuccucu

SEQ ID NO: 1168202 - RNA, 24 nt, Human
aguaacagugacugcaguuagggu

SEQ ID NO: 1168203 - RNA, 19 nt, Human
agucagaugcaggcccaag

SEQ ID NO: 1168204 - RNA, 20 nt, Human
caacaguaaaaagcuaucaa

SEQ ID NO: 1168205 - RNA, 19 nt, Human
cacugaaucccaaaaaguc

SEQ ID NO: 1168206 - RNA, 21 nt, Human
cacuuggaaggcagcuuugcu

SEQ ID NO: 1168207 - RNA, 22 nt, Human
cagacaggcacuuggaaggcag

SEQ ID NO: 1168208 - RNA, 19 nt, Human
cagaugggacaaacugggg

SEQ ID NO: 1168209 - RNA, 23 nt, Human
cagaugggacaaacugggggccu

SEQ ID NO: 1168210 - RNA, 22 nt, Human
cagcagcgcggggcggcggcgc

SEQ ID NO: 1168211 - RNA, 21 nt, Human
cagcggcgucuccuccugcuc

SEQ ID NO: 1168212 - RNA, 22 nt, Human
caggcccaaggguccaggggag

SEQ ID NO: 1168213 - RNA, 19 nt, Human
caugcaggcuuuugugugg

SEQ ID NO: 1168214 - RNA, 22 nt, Human
ccacccggaaaccucccagcag

SEQ ID NO: 1168215 - RNA, 23 nt, Human
ccacccggaaaccucccagcagu

SEQ ID NO: 1168216 - RNA, 19 nt, Human
ccccggccugcuccgauga

SEQ ID NO: 1168217 - RNA, 21 nt, Human
ccuggacucagcuucugacuc

SEQ ID NO: 1168218 - RNA, 25 nt, Human
cgcggacccuucccgccggcggcgu

SEQ ID NO: 1168219 - RNA, 23 nt, Human
cugcagcagggaaccagggcugg

SEQ ID NO: 1168220 - RNA, 20 nt, Human
cugcaguuagggucgagagc

SEQ ID NO: 1168221 - RNA, 21 nt, Human
cugcucuguucucccaggcaa

SEQ ID NO: 1168222 - RNA, 21 nt, Human
cugcucuguucucccaggcac

SEQ ID NO: 1168223 - RNA, 24 nt, Human
cuucagcagcgcggggcggcggcg

SEQ ID NO: 1168224 - RNA, 21 nt, Human
gaacgagcgccggcugugcac

SEQ ID NO: 1168225 - RNA, 19 nt, Human
gaaggcagcuuugcuccuc

SEQ ID NO: 1168226 - RNA, 20 nt, Human
gaaggcagcuuugcuccucu

SEQ ID NO: 1168227 - RNA, 18 nt, Human
gacugggcagggcuugcu

SEQ ID NO: 1168228 - RNA, 18 nt, Human
gcacuuggaaggcagcuu

SEQ ID NO: 1168229 - RNA, 21 nt, Human
gcacuuggaaggcagcuuugc

SEQ ID NO: 1168230 - RNA, 19 nt, Human
gcgcgcgcgaggccgcugg

SEQ ID NO: 1168231 - RNA, 20 nt, Human
gcggcggcgcgcgcgaggcc

SEQ ID NO: 1168232 - RNA, 22 nt, Human
ggaucuguccaguagggucacu

SEQ ID NO: 1168233 - RNA, 19 nt, Human
gguaaccggguguccaggg

SEQ ID NO: 1168234 - RNA, 18 nt, Human
gugccgggaaggccaggc

SEQ ID NO: 1168235 - RNA, 24 nt, Human
gugcguggcacgagggcggcagcg

SEQ ID NO: 1168236 - RNA, 18 nt, Human
uaacagugacugcaguua

SEQ ID NO: 1168237 - RNA, 22 nt, Human
uaaccacugaaucccaaaaagu

SEQ ID NO: 1168238 - RNA, 25 nt, Human
ucagaugggacaaacugggggccug

SEQ ID NO: 1168239 - RNA, 18 nt, Human
ucccaaaaagucacugcg

SEQ ID NO: 1168240 - RNA, 18 nt, Human
ugccgggaaggccaggcc

SEQ ID NO: 1168241 - RNA, 21 nt, Human
ugcucuguucucccaggcaca

SEQ ID NO: 1168242 - RNA, 20 nt, Human
uggccuuggaucuguccagu

SEQ ID NO: 1168243 - RNA, 18 nt, Human
uggcugacgcuucccuuu

SEQ ID NO: 1168244 - RNA, 18 nt, Human
uggcugacgcuucccuuu

SEQ ID NO: 1168245 - RNA, 22 nt, Human
uggcugcagcagggaaccaggg

SEQ ID NO: 1168246 - RNA, 22 nt, Human
uggcugcauuuugugcucagag

SEQ ID NO: 1168247 - RNA, 19 nt, Human
uguggcugacgcuucccuu

SEQ ID NO: 1168248 - RNA, 20 nt, Human
uuguguggcugacgcuuccc

SEQ ID NO: 1168249 - RNA, 18 nt, Human
aagagguccucccaaccc

SEQ ID NO: 1168250 - RNA, 19 nt, Human
aagauuuugagaagaggcg

SEQ ID NO: 1168251 - RNA, 21 nt, Human
acucucucacacgcuuccccu

SEQ ID NO: 1168252 - RNA, 23 nt, Human
agaaacuauacaggaacagacaa

SEQ ID NO: 1168253 - RNA, 19 nt, Human
agaagaggcgaaaaagaaa

SEQ ID NO: 1168254 - RNA, 18 nt, Human
aggcggaggcugugaggg

SEQ ID NO: 1168255 - RNA, 20 nt, Human
aggcuauuuuauuuucaaac

SEQ ID NO: 1168256 - RNA, 23 nt, Human
agggagugggaggacgucggggg

SEQ ID NO: 1168257 - RNA, 24 nt, Human
caacaaagggaagaauacugaaaa

SEQ ID NO: 1168258 - RNA, 19 nt, Human
caaggagaaacuauacagg

SEQ ID NO: 1168259 - RNA, 23 nt, Human
cagcuccugugccaagagguccu

SEQ ID NO: 1168260 - RNA, 19 nt, Human
cccccccaccccacuuggc

SEQ ID NO: 1168261 - RNA, 20 nt, Human
cccccccaccccacuuggcc

SEQ ID NO: 1168262 - RNA, 19 nt, Human
ccgcggagggaggcggagg

SEQ ID NO: 1168263 - RNA, 21 nt, Human
ccuucguucccccccaccccc

SEQ ID NO: 1168264 - RNA, 20 nt, Human
ccuuugaugcaacaaaggga

SEQ ID NO: 1168265 - RNA, 19 nt, Human
cgcggagggaggcggaggc

SEQ ID NO: 1168266 - RNA, 18 nt, Human
cgggggguggggggaggc

SEQ ID NO: 1168267 - RNA, 24 nt, Human
cgucgggggguggggggaggcguu

SEQ ID NO: 1168268 - RNA, 18 nt, Human
cucacucucucacacgcu

SEQ ID NO: 1168269 - RNA, 20 nt, Human
cuguacaaaugcuuuauuuc

SEQ ID NO: 1168270 - RNA, 20 nt, Human
gagaagaggcgaaaaagaaa

SEQ ID NO: 1168271 - RNA, 23 nt, Human
gcaacaaagggaagaauacugaa

SEQ ID NO: 1168272 - RNA, 24 nt, Human
gccaagacuggagaaacagauucc

SEQ ID NO: 1168273 - RNA, 18 nt, Human
gcgugcuggagggugugc

SEQ ID NO: 1168274 - RNA, 21 nt, Human
gcucccuucguucccccccac

SEQ ID NO: 1168275 - RNA, 21 nt, Human
gcuggugguagcggcuugggg

SEQ ID NO: 1168276 - RNA, 20 nt, Human
ggagggugugcgagggagug

SEQ ID NO: 1168277 - RNA, 23 nt, Human
gugguagcggcuuggggaggugc

SEQ ID NO: 1168278 - RNA, 22 nt, Human
ucacuggauuuaaccguauccc

SEQ ID NO: 1168279 - RNA, 22 nt, Human
ucagaacuucagcuccugugcc

SEQ ID NO: 1168280 - RNA, 21 nt, Human
ucccuuugaugcaacaaaggg

SEQ ID NO: 1168281 - RNA, 18 nt, Human
uccugugccaagaggucc

SEQ ID NO: 1168282 - RNA, 18 nt, Human
ucucugucauccaucgcu

SEQ ID NO: 1168283 - RNA, 20 nt, Human
ugagaagaggcgaaaaagaa

SEQ ID NO: 1168284 - RNA, 21 nt, Human
ugagaagaggcgaaaaagaaa

SEQ ID NO: 1168285 - RNA, 22 nt, Human
ugccaggcgccauguuggaggg

SEQ ID NO: 1168286 - RNA, 18 nt, Human
ugcuggagggugugcgag

SEQ ID NO: 1168287 - RNA, 24 nt, Human
uggcucccuucguucccccccacc

SEQ ID NO: 1168288 - RNA, 21 nt, Human
ugggaggacgucggggggugg

SEQ ID NO: 1168289 - RNA, 20 nt, Human
uggugguagcggcuugggga

SEQ ID NO: 1168290 - RNA, 19 nt, Human
ugugcgagggagugggagg

SEQ ID NO: 1168291 - RNA, 23 nt, Human
uucaaacuggagaaagugaugga

SEQ ID NO: 1168292 - RNA, 21 nt, Human
uuggccugcgugcuggagggu

SEQ ID NO: 1168293 - RNA, 22 nt, Human
uuugagaagaggcgaaaaagaa

SEQ ID NO: 1168294 - RNA, 19 nt, Human
aaacgacacccacaaccuc

SEQ ID NO: 1168295 - RNA, 21 nt, Human
aaacgacacccacaaccucga

SEQ ID NO: 1168296 - RNA, 22 nt, Human
aaagucuuccaggaggcaggcc

SEQ ID NO: 1168297 - RNA, 19 nt, Human
aagcgcggccaccgggacc

SEQ ID NO: 1168298 - RNA, 21 nt, Human
aauugucgaaaaucuccagcc

SEQ ID NO: 1168299 - RNA, 23 nt, Human
accccaggacagagaagacagcg

SEQ ID NO: 1168300 - RNA, 19 nt, Human
acuccacacccagcacuag

SEQ ID NO: 1168301 - RNA, 22 nt, Human
agacagcgauggacgcguacag

SEQ ID NO: 1168302 - RNA, 26 nt, Human
agaccaggcagaccagcccagucagg

SEQ ID NO: 1168303 - RNA, 22 nt, Human
agagaagacagcgauggacgcg

SEQ ID NO: 1168304 - RNA, 18 nt, Human
aggcaggccuucaggggg

SEQ ID NO: 1168305 - RNA, 21 nt, Human
aggcggcgcgcgcccagcccg

SEQ ID NO: 1168306 - RNA, 21 nt, Human
augaccgccuccacggucccg

SEQ ID NO: 1168307 - RNA, 23 nt, Human
caagcccccccacagacccgccc

SEQ ID NO: 1168308 - RNA, 21 nt, Human
caaggacagcagcacacaggc

SEQ ID NO: 1168309 - RNA, 18 nt, Human
caaggugaacagcauccc

SEQ ID NO: 1168310 - RNA, 18 nt, Human
cacaaccucgagaaaggc

SEQ ID NO: 1168311 - RNA, 19 nt, Human
cacagacccgcccaugcag

SEQ ID NO: 1168312 - RNA, 19 nt, Human
cacccagcacuagagagcc

SEQ ID NO: 1168313 - RNA, 24 nt, Human
caccgggacccacagcacgggcag

SEQ ID NO: 1168314 - RNA, 28 nt, Human
cagcagcaggggacugaccacccuccag

SEQ ID NO: 1168315 - RNA, 23 nt, Human
cagcaggggacugaccacccucc

SEQ ID NO: 1168316 - RNA, 18 nt, Human
caggagcccccggcaugu

SEQ ID NO: 1168317 - RNA, 20 nt, Human
caggcccgggcccgaggcac

SEQ ID NO: 1168318 - RNA, 25 nt, Human
caguaggggcugggccgccucccuc

SEQ ID NO: 1168319 - RNA, 22 nt, Human
ccaaggugaacagcaucccgaa

SEQ ID NO: 1168320 - RNA, 24 nt, Human
ccaaggugaacagcaucccgaaga

SEQ ID NO: 1168321 - RNA, 19 nt, Human
ccaccgggacccacagcac

SEQ ID NO: 1168322 - RNA, 18 nt, Human
ccagcccagucagggccu

SEQ ID NO: 1168323 - RNA, 21 nt, Human
ccaggacagagaagacagcga

SEQ ID NO: 1168324 - RNA, 25 nt, Human
ccaggacagagaagacagcgaugga

SEQ ID NO: 1168325 - RNA, 19 nt, Human
cccacagacccgcccaugc

SEQ ID NO: 1168326 - RNA, 24 nt, Human
cccacagacccgcccaugcaggcc

SEQ ID NO: 1168327 - RNA, 21 nt, Human
cccagucagggccuccuuggg

SEQ ID NO: 1168328 - RNA, 19 nt, Human
ccccaggcuucagggcgag

SEQ ID NO: 1168329 - RNA, 20 nt, Human
cccccacguccagcaggggu

SEQ ID NO: 1168330 - RNA, 27 nt, Human
ccccccacagacccgcccaugcaggcc

SEQ ID NO: 1168331 - RNA, 21 nt, Human
ccgaagaagagcauggcccac

SEQ ID NO: 1168332 - RNA, 24 nt, Human
ccucacuccacacccagcacuaga

SEQ ID NO: 1168333 - RNA, 20 nt, Human
cgagaaaggccaacaugagc

SEQ ID NO: 1168334 - RNA, 18 nt, Human
cgcaaugucaucgcagaa

SEQ ID NO: 1168335 - RNA, 19 nt, Human
cgccaguaggggcugggcc

SEQ ID NO: 1168336 - RNA, 20 nt, Human
cgccaguaggggcugggccg

SEQ ID NO: 1168337 - RNA, 22 nt, Human
cgggcagcaaggacagcagcac

SEQ ID NO: 1168338 - RNA, 23 nt, Human
cuccagccaguaguucccagacu

SEQ ID NO: 1168339 - RNA, 25 nt, Human
cucugccgacguuuggaaaccacaa

SEQ ID NO: 1168340 - RNA, 21 nt, Human
cugggcgcgcgucccuguccc

SEQ ID NO: 1168341 - RNA, 23 nt, Human
gaaaaucuccagccaguaguucc

SEQ ID NO: 1168342 - RNA, 22 nt, Human
gaaaccacaagcagccccacug

SEQ ID NO: 1168343 - RNA, 26 nt, Human
gagcaagcgcggccaccgggacccac

SEQ ID NO: 1168344 - RNA, 21 nt, Human
gagcagcugagcaagcgcggc

SEQ ID NO: 1168345 - RNA, 18 nt, Human
gagcauggcccacacagg

SEQ ID NO: 1168346 - RNA, 26 nt, Human
gagcauggcccacacaggagcccccg

SEQ ID NO: 1168347 - RNA, 21 nt, Human
gaugaccgccuccacgguccc

SEQ ID NO: 1168348 - RNA, 22 nt, Human
gcaaaauugucgaaaaucucca

SEQ ID NO: 1168349 - RNA, 22 nt, Human
gcagaccaggcagaccagccca

SEQ ID NO: 1168350 - RNA, 21 nt, Human
gcaggggacugaccacccucc

SEQ ID NO: 1168351 - RNA, 19 nt, Human
gccaagcccccccacagac

SEQ ID NO: 1168352 - RNA, 22 nt, Human
gccaagcccccccacagaccgg

SEQ ID NO: 1168353 - RNA, 19 nt, Human
gccacccucuugggccagg

SEQ ID NO: 1168354 - RNA, 18 nt, Human
gccaguaggggcugggcc

SEQ ID NO: 1168355 - RNA, 23 nt, Human
ggcaggccuucagggggagcugg

SEQ ID NO: 1168356 - RNA, 21 nt, Human
ggccagguggcguucaggugc

SEQ ID NO: 1168357 - RNA, 19 nt, Human
gggagcugggccacccucu

SEQ ID NO: 1168358 - RNA, 18 nt, Human
gggcagcaaggacagcag

SEQ ID NO: 1168359 - RNA, 22 nt, Human
gggccagguggcguucaggugc

SEQ ID NO: 1168360 - RNA, 19 nt, Human
gugaagacgacgaaggcca

SEQ ID NO: 1168361 - RNA, 23 nt, Human
gugggcgggggcggggcacgcau

SEQ ID NO: 1168362 - RNA, 22 nt, Human
guucagggaagcggcaaaauug

SEQ ID NO: 1168363 - RNA, 24 nt, Human
uaaacauaaacgacacccacaacc

SEQ ID NO: 1168364 - RNA, 20 nt, Human
uagagcuucuccugacgcga

SEQ ID NO: 1168365 - RNA, 19 nt, Human
ucaggccaagcccccccac

SEQ ID NO: 1168366 - RNA, 24 nt, Human
uccagaacaggaggaugauguaag

SEQ ID NO: 1168367 - RNA, 24 nt, Human
uccagcaggggugugaugaccgcc

SEQ ID NO: 1168368 - RNA, 24 nt, Human
uccauaaacauaaacgacacccac

SEQ ID NO: 1168369 - RNA, 25 nt, Human
uccauaaacauaaacgacacccaca

SEQ ID NO: 1168370 - RNA, 23 nt, Human
ucccuggagaugcucugcucugg

SEQ ID NO: 1168371 - RNA, 18 nt, Human
uccggccggcuucagcgc

SEQ ID NO: 1168372 - RNA, 18 nt, Human
uccuuggggacccaucua

SEQ ID NO: 1168373 - RNA, 22 nt, Human
ucuccgugaagacgacgaaggc

SEQ ID NO: 1168374 - RNA, 19 nt, Human
ugaagcagguggcggagag

SEQ ID NO: 1168375 - RNA, 19 nt, Human
ugacgcgaggggaacagcu

SEQ ID NO: 1168376 - RNA, 20 nt, Human
ugccccaggcuucagggcga

SEQ ID NO: 1168377 - RNA, 23 nt, Human
ugcucugggaagucaaagucguu

SEQ ID NO: 1168378 - RNA, 24 nt, Human
uggagaugcucugcucugggaagu

SEQ ID NO: 1168379 - RNA, 22 nt, Human
uggaggucggucuccgugaaga

SEQ ID NO: 1168380 - RNA, 23 nt, Human
uguugaccagggcgaugaccacc

SEQ ID NO: 1168381 - RNA, 20 nt, Human
uucagggggagcugggccac

SEQ ID NO: 1168382 - RNA, 21 nt, Human
uuccauaaacauaaacgacac

SEQ ID NO: 1168383 - RNA, 21 nt, Human
uaucuggagaauuaucuagag

SEQ ID NO: 1168384 - RNA, 19 nt, Human
ucuuggccaguaauucugg

SEQ ID NO: 1168385 - RNA, 21 nt, Human
aaacaaaaugaagguaccuuc

SEQ ID NO: 1168386 - RNA, 24 nt, Human
aagaacucuguuaccagcuauauc

SEQ ID NO: 1168387 - RNA, 18 nt, Human
accagggagucagccggg

SEQ ID NO: 1168388 - RNA, 19 nt, Human
agucagccggguuucucca

SEQ ID NO: 1168389 - RNA, 27 nt, Human
caaaauaucacaaauguggcuuaaaaa

SEQ ID NO: 1168390 - RNA, 19 nt, Human
cagccggguuucuccaucu

SEQ ID NO: 1168391 - RNA, 19 nt, Human
cccaggucaucccauccau

SEQ ID NO: 1168392 - RNA, 20 nt, Human
ccucuucagaaaccagggag

SEQ ID NO: 1168393 - RNA, 22 nt, Human
cuugccacgaucucccagguca

SEQ ID NO: 1168394 - RNA, 27 nt, Human
gcaaaauaucacaaauguggcuuaaaa

SEQ ID NO: 1168395 - RNA, 20 nt, Human
gcuuaaaacaacaaaaauuu

SEQ ID NO: 1168396 - RNA, 19 nt, Human
uaaucauguuuucuaaagg

SEQ ID NO: 1168397 - RNA, 18 nt, Human
uacaaacaaaaugaaggu

SEQ ID NO: 1168398 - RNA, 26 nt, Human
uacaaacaaaaugaagguaccuucac

SEQ ID NO: 1168399 - RNA, 24 nt, Human
ucauguuuucuaaagguuuucuug

SEQ ID NO: 1168400 - RNA, 19 nt, Human
ucauuucuuugcagaguau

SEQ ID NO: 1168401 - RNA, 21 nt, Human
ucccaggucaucccauccauc

SEQ ID NO: 1168402 - RNA, 19 nt, Human
ucugugcuguggcugcugu

SEQ ID NO: 1168403 - RNA, 19 nt, Human
ucuuugguguuagcacugu

SEQ ID NO: 1168404 - RNA, 21 nt, Human
ucuuugguguuagcacugugu

SEQ ID NO: 1168405 - RNA, 26 nt, Human
ugagauauuucuuaaaaguuuagugu

SEQ ID NO: 1168406 - RNA, 22 nt, Human
ugccuaagcaccucuucagaaa

SEQ ID NO: 1168407 - RNA, 23 nt, Human
ugccuaagcaccucuucagaaac

SEQ ID NO: 1168408 - RNA, 24 nt, Human
uguacaaacaaaaugaagguaccu

SEQ ID NO: 1168409 - RNA, 25 nt, Human
uguacaaacaaaaugaagguaccuu

SEQ ID NO: 1168410 - RNA, 18 nt, Human
ugucagggcauguggggu

SEQ ID NO: 1168411 - RNA, 24 nt, Human
uuaaacuugccacgaucucccagg

SEQ ID NO: 1168412 - RNA, 27 nt, Human
uucggguuuggucuuuggggccgccgg

SEQ ID NO: 1168413 - RNA, 21 nt, Human
uugcaagacaggacuuuuugg

SEQ ID NO: 1168414 - RNA, 18 nt, Human
uuggucuuugguguuagc

SEQ ID NO: 1168415 - RNA, 24 nt, Human
uuuaaucauguuuucuaaagguuu

SEQ ID NO: 1168416 - RNA, 19 nt, Human
uuucuuggcaauuuccugg

SEQ ID NO: 1168417 - RNA, 24 nt, Human
aaccuaugccuaaaaugccacaga

SEQ ID NO: 1168418 - RNA, 18 nt, Human
acacugacugcccuccuc

SEQ ID NO: 1168419 - RNA, 23 nt, Human
acuccaucaaguguuacaaugau

SEQ ID NO: 1168420 - RNA, 19 nt, Human
agauacugcucccaggugu

SEQ ID NO: 1168421 - RNA, 20 nt, Human
agccuagucaucugcauuag

SEQ ID NO: 1168422 - RNA, 18 nt, Human
agggcacauuagcaccaa

SEQ ID NO: 1168423 - RNA, 21 nt, Human
agugcuggggcacaucccaga

SEQ ID NO: 1168424 - RNA, 18 nt, Human
caccaaguuaacuguucu

SEQ ID NO: 1168425 - RNA, 24 nt, Human
cacuugggcuggucuucuaagggc

SEQ ID NO: 1168426 - RNA, 20 nt, Human
caucauguagccaugggggu

SEQ ID NO: 1168427 - RNA, 19 nt, Human
cauguaauuuaagagcacc

SEQ ID NO: 1168428 - RNA, 19 nt, Human
cauuaggguacauuuaccg

SEQ ID NO: 1168429 - RNA, 21 nt, Human
cauuuucauuacaagcaggag

SEQ ID NO: 1168430 - RNA, 18 nt, Human
ccacagcaaaccugggag

SEQ ID NO: 1168431 - RNA, 23 nt, Human
ccaugggcuguuugcccuucacu

SEQ ID NO: 1168432 - RNA, 22 nt, Human
cccagaagugacacugacugcc

SEQ ID NO: 1168433 - RNA, 24 nt, Human
cccuaaguagucuauguagcucac

SEQ ID NO: 1168434 - RNA, 19 nt, Human
cgcaagggaauucagugcu

SEQ ID NO: 1168435 - RNA, 21 nt, Human
cuaaaaugccacagaaacugc

SEQ ID NO: 1168436 - RNA, 22 nt, Human
cuaaaaugccacagaaacugcc

SEQ ID NO: 1168437 - RNA, 20 nt, Human
cugaauggcuaagacggcac

SEQ ID NO: 1168438 - RNA, 20 nt, Human
cugcccuccucuuccagcag

SEQ ID NO: 1168439 - RNA, 20 nt, Human
cuggauugcaaaccuaugcc

SEQ ID NO: 1168440 - RNA, 22 nt, Human
uaaaauaauaagcaacaacuaa

SEQ ID NO: 1168441 - RNA, 27 nt, Human
uaaauuagaauauaauuuacaaaagca

SEQ ID NO: 1168442 - RNA, 27 nt, Human
uagaauauaauuuacaaaagcaaaaaa

SEQ ID NO: 1168443 - RNA, 21 nt, Human
uaucccaguggcagauacugc

SEQ ID NO: 1168444 - RNA, 21 nt, Human
uaugugaugcacugacaugua

SEQ ID NO: 1168445 - RNA, 21 nt, Human
uauguuggagaaaaucagauc

SEQ ID NO: 1168446 - RNA, 23 nt, Human
ucccuaaguagucuauguagcuc

SEQ ID NO: 1168447 - RNA, 18 nt, Human
ucccugggguucccuaag

SEQ ID NO: 1168448 - RNA, 19 nt, Human
ugaaauaagaacaugagcu

SEQ ID NO: 1168449 - RNA, 20 nt, Human
ugacacugacugcccuccuc

SEQ ID NO: 1168450 - RNA, 21 nt, Human
ugcccuccucuuccagcauca

SEQ ID NO: 1168451 - RNA, 21 nt, Human
ugccuaaaaugccacagaaac

SEQ ID NO: 1168452 - RNA, 19 nt, Human
uggagaaaaucagaucugg

SEQ ID NO: 1168453 - RNA, 20 nt, Human
uggcuacagaguagcagcag

SEQ ID NO: 1168454 - RNA, 20 nt, Human
ugggcuggucuucuaagggc

SEQ ID NO: 1168455 - RNA, 18 nt, Human
uggggcacaucccagaag

SEQ ID NO: 1168456 - RNA, 27 nt, Human
uggggguggcuacagaguagcagcagu

SEQ ID NO: 1168457 - RNA, 21 nt, Human
ugugaugugcuaugaaauaga

SEQ ID NO: 1168458 - RNA, 19 nt, Human
uucagugcucgggccauac

SEQ ID NO: 1168459 - RNA, 19 nt, Human
uucauuuucauuacaagca

SEQ ID NO: 1168460 - RNA, 24 nt, Human
uuggcuuuuggugucugagggucu

SEQ ID NO: 1168461 - RNA, 24 nt, Human
uuuuaaccuacucagguuucaauu

SEQ ID NO: 1168462 - RNA, 21 nt, Human
uuuuuuuuuuuuuuuuucauu

SEQ ID NO: 1168463 - RNA, 22 nt, Human
aaaccaagaugaauuaccacuu

SEQ ID NO: 1168464 - RNA, 24 nt, Human
aaauggcaacaagaaguuaagaaa

SEQ ID NO: 1168465 - RNA, 22 nt, Human
aaauggcugauaucauaaaaac

SEQ ID NO: 1168466 - RNA, 22 nt, Human
aacaaaugagaacaugcagaaa

SEQ ID NO: 1168467 - RNA, 24 nt, Human
aaccaaauaaggcgcaaggaccug

SEQ ID NO: 1168468 - RNA, 22 nt, Human
aacugagaaaaagaacaaauga

SEQ ID NO: 1168469 - RNA, 24 nt, Human
aagaacaugggagagaaaaaugac

SEQ ID NO: 1168470 - RNA, 18 nt, Human
aagaggacuucuugugcu

SEQ ID NO: 1168471 - RNA, 24 nt, Human
aagcuacuucuuucuuugcuccua

SEQ ID NO: 1168472 - RNA, 21 nt, Human
aaggaccugaagaauaaacac

SEQ ID NO: 1168473 - RNA, 24 nt, Human
aaucaaauggcugauaucauaaaa

SEQ ID NO: 1168474 - RNA, 21 nt, Human
aaucaccaggagacaaaagga

SEQ ID NO: 1168475 - RNA, 22 nt, Human
aauccucuccuuacucccagac

SEQ ID NO: 1168476 - RNA, 22 nt, Human
aaugaaaaaaaucaaauggcug

SEQ ID NO: 1168477 - RNA, 24 nt, Human
aauuucaacugacugaaugcucac

SEQ ID NO: 1168478 - RNA, 19 nt, Human
acaaaaccaaauaaggcgc

SEQ ID NO: 1168479 - RNA, 20 nt, Human
acagaguuucaaauggcaac

SEQ ID NO: 1168480 - RNA, 19 nt, Human
acaugggagagaaaaauga

SEQ ID NO: 1168481 - RNA, 23 nt, Human
acauuuaaacgauuaaagagaaa

SEQ ID NO: 1168482 - RNA, 19 nt, Human
accaauguucaaauacauu

SEQ ID NO: 1168483 - RNA, 20 nt, Human
agaaaaagaacaaaugagaa

SEQ ID NO: 1168484 - RNA, 26 nt, Human
agacaaaaggaaaauaagggggaccc

SEQ ID NO: 1168485 - RNA, 19 nt, Human
agacaagaauagaaaucag

SEQ ID NO: 1168486 - RNA, 21 nt, Human
agacaagaauagaaaucagga

SEQ ID NO: 1168487 - RNA, 23 nt, Human
agacaagaauagaaaucaggaga

SEQ ID NO: 1168488 - RNA, 25 nt, Human
agacaagaauagaaaucaggagaaa

SEQ ID NO: 1168489 - RNA, 20 nt, Human
agcaaucaacaaaugcaagc

SEQ ID NO: 1168490 - RNA, 19 nt, Human
aggaaucuuuaauuucaac

SEQ ID NO: 1168491 - RNA, 18 nt, Human
aggaauguauuuaguagg

SEQ ID NO: 1168492 - RNA, 23 nt, Human
agugagaaagaacaugggagaga

SEQ ID NO: 1168493 - RNA, 20 nt, Human
auccuagucguccugcagcc

SEQ ID NO: 1168494 - RNA, 19 nt, Human
auguguccacaucuauuca

SEQ ID NO: 1168495 - RNA, 22 nt, Human
auucaacugagaaaaagaacaa

SEQ ID NO: 1168496 - RNA, 19 nt, Human
caaaaggaaaauaaggggg

SEQ ID NO: 1168497 - RNA, 21 nt, Human
caaaugcaagccaagaaauua

SEQ ID NO: 1168498 - RNA, 18 nt, Human
caacuccucucuacuuuu

SEQ ID NO: 1168499 - RNA, 19 nt, Human
caagaugaauuaccacuug

SEQ ID NO: 1168500 - RNA, 23 nt, Human
caagaugaauuaccacuugggca

SEQ ID NO: 1168501 - RNA, 25 nt, Human
caaggaccugaagaauaaacacaaa

SEQ ID NO: 1168502 - RNA, 24 nt, Human
caagguccaagcuaguuuacucca

SEQ ID NO: 1168503 - RNA, 19 nt, Human
caccaggagacaaaaggaa

SEQ ID NO: 1168504 - RNA, 24 nt, Human
cagaacccuuuaaacauaagagua

SEQ ID NO: 1168505 - RNA, 20 nt, Human
cauacaaacuuccaaacucc

SEQ ID NO: 1168506 - RNA, 22 nt, Human
cauuauaacccacugguuucug

SEQ ID NO: 1168507 - RNA, 19 nt, Human
ccaagcuacuucuuucuuu

SEQ ID NO: 1168508 - RNA, 19 nt, Human
ccuaugaauaccuuuccaa

SEQ ID NO: 1168509 - RNA, 20 nt, Human
ccucucuacuuuuuuagucc

SEQ ID NO: 1168510 - RNA, 24 nt, Human
ccugaagaauaaacacaaagcuag

SEQ ID NO: 1168511 - RNA, 22 nt, Human
ccugcagcccaagguccaagcu

SEQ ID NO: 1168512 - RNA, 24 nt, Human
cuaaucaccaggagacaaaaggaa

SEQ ID NO: 1168513 - RNA, 22 nt, Human
cuacugaaugauucccuaagau

SEQ ID NO: 1168514 - RNA, 20 nt, Human
cuaguuuacuccauaaccuu

SEQ ID NO: 1168515 - RNA, 19 nt, Human
cugaaugcucacaggacuc

SEQ ID NO: 1168516 - RNA, 21 nt, Human
gaagaaaaaaauugacccaac

SEQ ID NO: 1168517 - RNA, 23 nt, Human
gcaaggaccugaagaauaaacac

SEQ ID NO: 1168518 - RNA, 21 nt, Human
ggacuucuugugcugaaaaug

SEQ ID NO: 1168519 - RNA, 18 nt, Human
gggggguggggguggggg

SEQ ID NO: 1168520 - RNA, 20 nt, Human
gggggugggggugggggugg

SEQ ID NO: 1168521 - RNA, 20 nt, Human
gggugggggugaagaacgcu

SEQ ID NO: 1168522 - RNA, 22 nt, Human
gucauuuuuuaacaagcaaauu

SEQ ID NO: 1168523 - RNA, 24 nt, Human
gugccucaaaagauuuuaauuuuc

SEQ ID NO: 1168524 - RNA, 19 nt, Human
guggggguggggguggggg

SEQ ID NO: 1168525 - RNA, 24 nt, Human
guuccaagcuacuucuuucuuugc

SEQ ID NO: 1168526 - RNA, 18 nt, Human
uaaaaacaacuggucucu

SEQ ID NO: 1168527 - RNA, 25 nt, Human
uaaauagaaaaugaaaaaaaucaaa

SEQ ID NO: 1168528 - RNA, 18 nt, Human
uaacacauuguaaaagca

SEQ ID NO: 1168529 - RNA, 23 nt, Human
uaaguaaauaaccgcgguuccua

SEQ ID NO: 1168530 - RNA, 26 nt, Human
uacagugacaacaccuuuagaauccc

SEQ ID NO: 1168531 - RNA, 18 nt, Human
uacguagaaauaggaauu

SEQ ID NO: 1168532 - RNA, 26 nt, Human
uagaaucccuuagguacaauaaggua

SEQ ID NO: 1168533 - RNA, 22 nt, Human
uaggaauuccaaauauuucagu

SEQ ID NO: 1168534 - RNA, 22 nt, Human
uagguacaauaagguaccgcag

SEQ ID NO: 1168535 - RNA, 22 nt, Human
uaugaauaccuuuccaaaacca

SEQ ID NO: 1168536 - RNA, 25 nt, Human
ucaaagugagaaagaacaugggaga

SEQ ID NO: 1168537 - RNA, 18 nt, Human
ucaccaggagacaaaagg

SEQ ID NO: 1168538 - RNA, 24 nt, Human
ucaccaggagacaaaaggaaaaua

SEQ ID NO: 1168539 - RNA, 24 nt, Human
ucccuaagauuagaaaaaauugcc

SEQ ID NO: 1168540 - RNA, 22 nt, Human
uccugaauaccaguaaggacuc

SEQ ID NO: 1168541 - RNA, 24 nt, Human
ucucuaaauuuaagauugagacaa

SEQ ID NO: 1168542 - RNA, 25 nt, Human
ugaaaaaaaaaauggcuauacagaa

SEQ ID NO: 1168543 - RNA, 20 nt, Human
ugaaaaaaaucaaauggcug

SEQ ID NO: 1168544 - RNA, 22 nt, Human
ugaagaacgcuaauuauagaaa

SEQ ID NO: 1168545 - RNA, 23 nt, Human
ugaagcauaauuaggaauuccag

SEQ ID NO: 1168546 - RNA, 21 nt, Human
ugagaaaaagaacaaaugaga

SEQ ID NO: 1168547 - RNA, 19 nt, Human
ugagaacaugcagaaaaca

SEQ ID NO: 1168548 - RNA, 20 nt, Human
ugcagaaaacacuggaaaua

SEQ ID NO: 1168549 - RNA, 21 nt, Human
ugcuacacaagagauauuuau

SEQ ID NO: 1168550 - RNA, 19 nt, Human
uggcuauacagaacccuuu

SEQ ID NO: 1168551 - RNA, 20 nt, Human
ugggagagaaaaaugacaau

SEQ ID NO: 1168552 - RNA, 18 nt, Human
uggggguggggguggggg

SEQ ID NO: 1168553 - RNA, 20 nt, Human
ugggggugggggugggggug

SEQ ID NO: 1168554 - RNA, 25 nt, Human
uguuacagaucuuuucauucuggaa

SEQ ID NO: 1168555 - RNA, 24 nt, Human
uguucuguuguauuuacaguuuua

SEQ ID NO: 1168556 - RNA, 18 nt, Human
uuacauaguucucucugc

SEQ ID NO: 1168557 - RNA, 18 nt, Human
uuauuucuauacaaagca

SEQ ID NO: 1168558 - RNA, 24 nt, Human
uucaugugccucaaaagauuuuaa

SEQ ID NO: 1168559 - RNA, 18 nt, Human
uugagacaagaauagaaa

SEQ ID NO: 1168560 - RNA, 23 nt, Human
uuggugcauucaacugagaaaaa

SEQ ID NO: 1168561 - RNA, 23 nt, Human
uuuacauaguucucucugcuaua

SEQ ID NO: 1168562 - RNA, 23 nt, Human
uuuauccauuaucaguauuaacg

SEQ ID NO: 1168563 - RNA, 20 nt, Human
uuuuucuuucuuuuuuguca

SEQ ID NO: 1168564 - RNA, 18 nt, Human
aacaagcgccacccucua

SEQ ID NO: 1168565 - RNA, 20 nt, Human
aacucuuuggguuuuugcag

SEQ ID NO: 1168566 - RNA, 24 nt, Human
aagugcuccugcugggccucaagg

SEQ ID NO: 1168567 - RNA, 21 nt, Human
aauccaacccggagacugccc

SEQ ID NO: 1168568 - RNA, 19 nt, Human
acccagcgcagcuccggcc

SEQ ID NO: 1168569 - RNA, 24 nt, Human
acccagcgcagcuccggccuggug

SEQ ID NO: 1168570 - RNA, 21 nt, Human
acccggagacugcccgggaaa

SEQ ID NO: 1168571 - RNA, 22 nt, Human
acgccgccgacaaggagcgggc

SEQ ID NO: 1168572 - RNA, 19 nt, Human
agcgggcggcgggcggcgg

SEQ ID NO: 1168573 - RNA, 18 nt, Human
aggauggcacacaauacc

SEQ ID NO: 1168574 - RNA, 23 nt, Human
auuucaccuaguaacuacacgga

SEQ ID NO: 1168575 - RNA, 19 nt, Human
caacccggagacugcccgg

SEQ ID NO: 1168576 - RNA, 23 nt, Human
cacacaauaccauuccugguuaa

SEQ ID NO: 1168577 - RNA, 20 nt, Human
cacccucuacuccuccaacu

SEQ ID NO: 1168578 - RNA, 22 nt, Human
cacccucuacuccuccaacucc

SEQ ID NO: 1168579 - RNA, 24 nt, Human
cacggaaacccggaucggaggccg

SEQ ID NO: 1168580 - RNA, 20 nt, Human
cagcugacgccgagcggugu

SEQ ID NO: 1168581 - RNA, 19 nt, Human
caggugagcgcccgaggcu

SEQ ID NO: 1168582 - RNA, 22 nt, Human
caggugagcgcccgaggcuucc

SEQ ID NO: 1168583 - RNA, 18 nt, Human
cccgcaacgccgccgaca

SEQ ID NO: 1168584 - RNA, 24 nt, Human
cccgcaacgccgccgacaaggagc

SEQ ID NO: 1168585 - RNA, 23 nt, Human
cccgcgcaccugcccucgcuccg

SEQ ID NO: 1168586 - RNA, 20 nt, Human
ccgcgacgagcaggacgacg

SEQ ID NO: 1168587 - RNA, 18 nt, Human
ccguguagaccccagggu

SEQ ID NO: 1168588 - RNA, 20 nt, Human
ccuccccguagagauggcuu

SEQ ID NO: 1168589 - RNA, 19 nt, Human
ccuuaccccuuucacaguc

SEQ ID NO: 1168590 - RNA, 25 nt, Human
cgacgacaagggcgacuccaaggaa

SEQ ID NO: 1168591 - RNA, 22 nt, Human
cgacuccaaggaaacgcggcuu

SEQ ID NO: 1168592 - RNA, 19 nt, Human
cgaggccucccgcaacgcc

SEQ ID NO: 1168593 - RNA, 19 nt, Human
cgcaccgaggccucccgca

SEQ ID NO: 1168594 - RNA, 22 nt, Human
cggagacugcccgggaaacuaa

SEQ ID NO: 1168595 - RNA, 24 nt, Human
cggaucggaggccgcgcggggagg

SEQ ID NO: 1168596 - RNA, 18 nt, Human
cggcggcgcggggcccgg

SEQ ID NO: 1168597 - RNA, 23 nt, Human
cggcgggcggcggcgccggcagc

SEQ ID NO: 1168598 - RNA, 19 nt, Human
cggcucggcgccucggcgg

SEQ ID NO: 1168599 - RNA, 19 nt, Human
cgggcugggcggggggcgg

SEQ ID NO: 1168600 - RNA, 24 nt, Human
cggggaggaggagggcgacccggu

SEQ ID NO: 1168601 - RNA, 22 nt, Human
cguguagaccccagggugcaaa

SEQ ID NO: 1168602 - RNA, 21 nt, Human
cuccugcugggccucaaggac

SEQ ID NO: 1168603 - RNA, 24 nt, Human
cucggcccggcucggcgccucggc

SEQ ID NO: 1168604 - RNA, 21 nt, Human
gacagcuauuuuuuuaaccua

SEQ ID NO: 1168605 - RNA, 19 nt, Human
gacccggucgguccugcga

SEQ ID NO: 1168606 - RNA, 24 nt, Human
gacgacaagggcgacuccaaggaa

SEQ ID NO: 1168607 - RNA, 20 nt, Human
gaggccucccgcaacgccgc

SEQ ID NO: 1168608 - RNA, 18 nt, Human
gcaccgaggccucccgca

SEQ ID NO: 1168609 - RNA, 18 nt, Human
gcagcggcgcaccgaggc

SEQ ID NO: 1168610 - RNA, 19 nt, Human
gcagcggcgcaccgaggcc

SEQ ID NO: 1168611 - RNA, 23 nt, Human
gccacccucuacuccuccaacuc

SEQ ID NO: 1168612 - RNA, 21 nt, Human
gccccggcguccggauuuaac

SEQ ID NO: 1168613 - RNA, 22 nt, Human
gcccgaggcuuccggcccgcgc

SEQ ID NO: 1168614 - RNA, 20 nt, Human
gcgcggcgggcugggcgggg

SEQ ID NO: 1168615 - RNA, 21 nt, Human
gcggggggcggcggcgcgggg

SEQ ID NO: 1168616 - RNA, 21 nt, Human
gcuuugcuguuguuccacucu

SEQ ID NO: 1168617 - RNA, 26 nt, Human
ggcagcagcgaggacgacgcgcagag

SEQ ID NO: 1168618 - RNA, 20 nt, Human
ggcggcgccggcagcagcga

SEQ ID NO: 1168619 - RNA, 18 nt, Human
ggcggcgcggggcccggg

SEQ ID NO: 1168620 - RNA, 18 nt, Human
ggcggcggcgccggcagc

SEQ ID NO: 1168621 - RNA, 19 nt, Human
ggcggcggcgcggggcccg

SEQ ID NO: 1168622 - RNA, 21 nt, Human
ggcgggcggcggcgccggcag

SEQ ID NO: 1168623 - RNA, 19 nt, Human
ggcgggcugggcggggggc

SEQ ID NO: 1168624 - RNA, 19 nt, Human
ggcgggcugggcggggggc

SEQ ID NO: 1168625 - RNA, 23 nt, Human
ggcgggcugggcggggggcggcg

SEQ ID NO: 1168626 - RNA, 19 nt, Human
gggcgcggcgggcugggcg

SEQ ID NO: 1168627 - RNA, 21 nt, Human
gggcggcggcgcggggcccgg

SEQ ID NO: 1168628 - RNA, 24 nt, Human
gggcggcggcgcggggcccgggcg

SEQ ID NO: 1168629 - RNA, 21 nt, Human
ggggaggaggagggcgacccg

SEQ ID NO: 1168630 - RNA, 20 nt, Human
ggugagcuccagguaggugc

SEQ ID NO: 1168631 - RNA, 18 nt, Human
ggugcgggcgcggcgggc

SEQ ID NO: 1168632 - RNA, 22 nt, Human
uaacagcuggagccaccagcgc

SEQ ID NO: 1168633 - RNA, 26 nt, Human
ucacagucgcuccuuucauuucgaca

SEQ ID NO: 1168634 - RNA, 21 nt, Human
uccaaggaaacgcggcugacc

SEQ ID NO: 1168635 - RNA, 19 nt, Human
ucgucgccuuuuuuccgcg

SEQ ID NO: 1168636 - RNA, 19 nt, Human
ugacccagcgcagcuccgg

SEQ ID NO: 1168637 - RNA, 25 nt, Human
ugcccucgcuccgaaguccgcgccu

SEQ ID NO: 1168638 - RNA, 19 nt, Human
ugcuuucuggauccucccc

SEQ ID NO: 1168639 - RNA, 19 nt, Human
uguuuaauacaggauggca

SEQ ID NO: 1168640 - RNA, 19 nt, Human
uuggauuuuuccuuacccc

SEQ ID NO: 1168641 - RNA, 22 nt, Human
uuguuccacucuguccauacau

SEQ ID NO: 1168642 - RNA, 19 nt, Human
uuuuuugcuuugcuguugu

SEQ ID NO: 1168643 - RNA, 19 nt, Human
aaagacaggucucacucug

SEQ ID NO: 1168644 - RNA, 24 nt, Human
aaagugcugggaucacaggcauga

SEQ ID NO: 1168645 - RNA, 24 nt, Human
aaagugcugggauuacaggcauga

SEQ ID NO: 1168646 - RNA, 25 nt, Human
aagcaauccucccaccuuggccuuc

SEQ ID NO: 1168647 - RNA, 24 nt, Human
aagcagcuaggacuacaggcacac

SEQ ID NO: 1168648 - RNA, 24 nt, Human
aagugcagugguguaaucacagcu

SEQ ID NO: 1168649 - RNA, 26 nt, Human
aagugcugggaucacaggcaugagcc

SEQ ID NO: 1168650 - RNA, 19 nt, Human
aagugcugggauuacaggc

SEQ ID NO: 1168651 - RNA, 21 nt, Human
aagugcugggauuacaggcau

SEQ ID NO: 1168652 - RNA, 26 nt, Human
aagugcugggauuacaggcaugagcc

SEQ ID NO: 1168653 - RNA, 18 nt, Human
acagcuuacugcagccuc

SEQ ID NO: 1168654 - RNA, 25 nt, Human
acucuguugcccaggcucaagugca

SEQ ID NO: 1168655 - RNA, 19 nt, Human
acugcagccuccaacuccu

SEQ ID NO: 1168656 - RNA, 23 nt, Human
aggcacucucauuugcuucuguu

SEQ ID NO: 1168657 - RNA, 21 nt, Human
aguaaauccaaaaugaggucc

SEQ ID NO: 1168658 - RNA, 24 nt, Human
agugcagugguguaaucacagcuu

SEQ ID NO: 1168659 - RNA, 18 nt, Human
agugcugggauuacaggc

SEQ ID NO: 1168660 - RNA, 22 nt, Human
auaaaacagacugaaauaccuu

SEQ ID NO: 1168661 - RNA, 18 nt, Human
aucugccugccuuggccu

SEQ ID NO: 1168662 - RNA, 24 nt, Human
caaagugcugggaucacaggcaug

SEQ ID NO: 1168663 - RNA, 24 nt, Human
caaagugcugggauuacaggcaug

SEQ ID NO: 1168664 - RNA, 27 nt, Human
caagcaauccucccaccuuggccuucc

SEQ ID NO: 1168665 - RNA, 23 nt, Human
cacacaccaccacaccuagcuaa

SEQ ID NO: 1168666 - RNA, 22 nt, Human
cacaggcaugagccaccaugcc

SEQ ID NO: 1168667 - RNA, 19 nt, Human
cacucuguugcccaggcuc

SEQ ID NO: 1168668 - RNA, 24 nt, Human
cacucuguugcccaggcucaagug

SEQ ID NO: 1168669 - RNA, 23 nt, Human
cacugaacaucagagguggaucc

SEQ ID NO: 1168670 - RNA, 24 nt, Human
cagcuuacugcagccuccaacucc

SEQ ID NO: 1168671 - RNA, 21 nt, Human
caggcacacaccaccacaccu

SEQ ID NO: 1168672 - RNA, 23 nt, Human
caggucucacucuguugcccagg

SEQ ID NO: 1168673 - RNA, 22 nt, Human
ccaaagugcugggaucacaggc

SEQ ID NO: 1168674 - RNA, 24 nt, Human
ccaaagugcugggaucacaggcau

SEQ ID NO: 1168675 - RNA, 23 nt, Human
ccaaagugcugggauuacaggca

SEQ ID NO: 1168676 - RNA, 24 nt, Human
ccaaagugcugggauuacaggcau

SEQ ID NO: 1168677 - RNA, 24 nt, Human
cccaaagugcugggauuacaggca

SEQ ID NO: 1168678 - RNA, 19 nt, Human
cccacaaugaccacuccca

SEQ ID NO: 1168679 - RNA, 21 nt, Human
cccacaaugaccacucccagg

SEQ ID NO: 1168680 - RNA, 19 nt, Human
cccaggcucaagugcagug

SEQ ID NO: 1168681 - RNA, 20 nt, Human
cccaggcucaagugcagugg

SEQ ID NO: 1168682 - RNA, 20 nt, Human
ccccacaaugaccacuccca

SEQ ID NO: 1168683 - RNA, 23 nt, Human
ccgccugccucagccucccaagc

SEQ ID NO: 1168684 - RNA, 26 nt, Human
ccucccaccuuggccuuccaaagugc

SEQ ID NO: 1168685 - RNA, 22 nt, Human
ccugccuuggccucccaaagug

SEQ ID NO: 1168686 - RNA, 24 nt, Human
ccuggccucaagcaauccucccac

SEQ ID NO: 1168687 - RNA, 21 nt, Human
ccugggucacacaaacgggaa

SEQ ID NO: 1168688 - RNA, 18 nt, Human
ccuuaagcuucucagccu

SEQ ID NO: 1168689 - RNA, 18 nt, Human
cggcaaaauuccagauga

SEQ ID NO: 1168690 - RNA, 24 nt, Human
cucaagcaauccucccaccuuggc

SEQ ID NO: 1168691 - RNA, 23 nt, Human
cucaugcuauccgccugccucag

SEQ ID NO: 1168692 - RNA, 27 nt, Human
cuccuggccucaagcaauccucccacc

SEQ ID NO: 1168693 - RNA, 25 nt, Human
cugcagccuccaacuccugugcuca

SEQ ID NO: 1168694 - RNA, 23 nt, Human
cugccucagccucccaagcagcu

SEQ ID NO: 1168695 - RNA, 23 nt, Human
cugccuuggccucccaaagugcu

SEQ ID NO: 1168696 - RNA, 24 nt, Human
cugcuuuucgcaaaugaguaacau

SEQ ID NO: 1168697 - RNA, 22 nt, Human
cuggccucaagcaauccuccca

SEQ ID NO: 1168698 - RNA, 22 nt, Human
cugguacucuucacugaacauc

SEQ ID NO: 1168699 - RNA, 21 nt, Human
cuuacugcagccuccaacucc

SEQ ID NO: 1168700 - RNA, 26 nt, Human
cuuuuuuuuuuuaaagacaggucuca

SEQ ID NO: 1168701 - RNA, 23 nt, Human
gaacuccuggccucaagcaaucc

SEQ ID NO: 1168702 - RNA, 20 nt, Human
gaaugccccacaaugaccac

SEQ ID NO: 1168703 - RNA, 18 nt, Human
gaucacaggcaugagcca

SEQ ID NO: 1168704 - RNA, 24 nt, Human
gaucacaggcaugagccaccaugc

SEQ ID NO: 1168705 - RNA, 18 nt, Human
gauuacaggcaugagcca

SEQ ID NO: 1168706 - RNA, 20 nt, Human
gauuacaggcaugagccacc

SEQ ID NO: 1168707 - RNA, 21 nt, Human
gauuacaggcaugagccaccg

SEQ ID NO: 1168708 - RNA, 21 nt, Human
gccucccaagcagcuaggacu

SEQ ID NO: 1168709 - RNA, 22 nt, Human
gccuuggccucccaaagugcug

SEQ ID NO: 1168710 - RNA, 24 nt, Human
gcuauccgccugccucagccuccc

SEQ ID NO: 1168711 - RNA, 24 nt, Human
gcuaugcugaacaggcuggucucg

SEQ ID NO: 1168712 - RNA, 24 nt, Human
gcucaugcuauccgccugccucag

SEQ ID NO: 1168713 - RNA, 19 nt, Human
gcuccuuuuuuuuuuuaaa

SEQ ID NO: 1168714 - RNA, 23 nt, Human
gcuggucucgaacuccuggccuc

SEQ ID NO: 1168715 - RNA, 23 nt, Human
ggaaugccccacaaugaccacuc

SEQ ID NO: 1168716 - RNA, 22 nt, Human
ggacuacaggcacacaccacca

SEQ ID NO: 1168717 - RNA, 24 nt, Human
ggaucacaggcaugagccaccaug

SEQ ID NO: 1168718 - RNA, 24 nt, Human
ggauuacaggcaugagccaccgug

SEQ ID NO: 1168719 - RNA, 24 nt, Human
ggcuggucucgaacuccuggccuc

SEQ ID NO: 1168720 - RNA, 22 nt, Human
gucacacaaacgggaaugcccc

SEQ ID NO: 1168721 - RNA, 18 nt, Human
guuccugcuaugcugaac

SEQ ID NO: 1168722 - RNA, 22 nt, Human
uaaaacagacugaaauaccuua

SEQ ID NO: 1168723 - RNA, 21 nt, Human
uaaagacaggucucacucugu

SEQ ID NO: 1168724 - RNA, 24 nt, Human
uacaggcaugagccaccgugccca

SEQ ID NO: 1168725 - RNA, 24 nt, Human
uaggacuacaggcacacaccacca

SEQ ID NO: 1168726 - RNA, 18 nt, Human
uaucccaaaaguaaaucc

SEQ ID NO: 1168727 - RNA, 24 nt, Human
ucaagcaauccucccaccuuggcc

SEQ ID NO: 1168728 - RNA, 20 nt, Human
ucacacaaacgggaaugccc

SEQ ID NO: 1168729 - RNA, 18 nt, Human
ucagccucccaagcagcu

SEQ ID NO: 1168730 - RNA, 20 nt, Human
ucagccucccaagcagcuag

SEQ ID NO: 1168731 - RNA, 19 nt, Human
uccauacgcgcucugaaua

SEQ ID NO: 1168732 - RNA, 24 nt, Human
ucccaaagugcugggauuacaggc

SEQ ID NO: 1168733 - RNA, 23 nt, Human
ucccaagcagcuaggacuacagg

SEQ ID NO: 1168734 - RNA, 21 nt, Human
ucggcaaaauuccagaugagc

SEQ ID NO: 1168735 - RNA, 19 nt, Human
ucucacucuguugcccagg

SEQ ID NO: 1168736 - RNA, 21 nt, Human
ucucacucuguugcccaggcu

SEQ ID NO: 1168737 - RNA, 23 nt, Human
ucucacucuguugcccaggcuca

SEQ ID NO: 1168738 - RNA, 24 nt, Human
ucucacucuguugcccaggcucaa

SEQ ID NO: 1168739 - RNA, 21 nt, Human
ucucgaacuccuggccucaag

SEQ ID NO: 1168740 - RNA, 24 nt, Human
ucuguugcccaggcucaagugcag

SEQ ID NO: 1168741 - RNA, 21 nt, Human
ugaaacccuacaagcguuucc

SEQ ID NO: 1168742 - RNA, 18 nt, Human
ugaaaucggcaaaauucc

SEQ ID NO: 1168743 - RNA, 24 nt, Human
ugaacaggcuggucucgaacuccu

SEQ ID NO: 1168744 - RNA, 18 nt, Human
ugagauagaaucucgcuc

SEQ ID NO: 1168745 - RNA, 22 nt, Human
ugagauagaaucucgcucuguc

SEQ ID NO: 1168746 - RNA, 21 nt, Human
ugcagugguguaaucacagcu

SEQ ID NO: 1168747 - RNA, 24 nt, Human
ugcccaggcucaagugcaguggug

SEQ ID NO: 1168748 - RNA, 23 nt, Human
ugccucagccucccaagcagcua

SEQ ID NO: 1168749 - RNA, 24 nt, Human
ugccucagccucccaagcagcuag

SEQ ID NO: 1168750 - RNA, 18 nt, Human
ugccugccuuggccuccc

SEQ ID NO: 1168751 - RNA, 24 nt, Human
ugcuaugcugaacaggcuggucuc

SEQ ID NO: 1168752 - RNA, 19 nt, Human
ugcugggaucacaggcaug

SEQ ID NO: 1168753 - RNA, 20 nt, Human
uggccucaagcaauccuccc

SEQ ID NO: 1168754 - RNA, 21 nt, Human
uggccucaagcaauccuccca

SEQ ID NO: 1168755 - RNA, 25 nt, Human
uggccucaagcaauccucccaccuu

SEQ ID NO: 1168756 - RNA, 22 nt, Human
ugggaucacaggcaugagccac

SEQ ID NO: 1168757 - RNA, 23 nt, Human
ugggaucacaggcaugagccacc

SEQ ID NO: 1168758 - RNA, 24 nt, Human
ugggaucacaggcaugagccacca

SEQ ID NO: 1168759 - RNA, 18 nt, Human
ugggauuacaggcaugag

SEQ ID NO: 1168760 - RNA, 21 nt, Human
ugggauuacaggcaugagcca

SEQ ID NO: 1168761 - RNA, 22 nt, Human
ugggauuacaggcaugagccac

SEQ ID NO: 1168762 - RNA, 23 nt, Human
ugggauuacaggcaugagccacc

SEQ ID NO: 1168763 - RNA, 23 nt, Human
ugggauuacaggcaugagccacc

SEQ ID NO: 1168764 - RNA, 24 nt, Human
ugggauuacaggcaugagccaccg

SEQ ID NO: 1168765 - RNA, 26 nt, Human
ugggauuacaggcaugagccaccgug

SEQ ID NO: 1168766 - RNA, 26 nt, Human
uuagucaugaaaucggcaaaauucca

SEQ ID NO: 1168767 - RNA, 18 nt, Human
uuggccucccaaagugcu

SEQ ID NO: 1168768 - RNA, 25 nt, Human
uuguagagaugggguuccugcuaug

SEQ ID NO: 1168769 - RNA, 21 nt, Human
uuuaguuuuuguagagauggg

SEQ ID NO: 1168770 - RNA, 21 nt, Human
uuuguagagaugggguuccug

SEQ ID NO: 1168771 - RNA, 25 nt, Human
uuuguagagaugggguuccugcuau

SEQ ID NO: 1168772 - RNA, 23 nt, Human
uuuuuguagagaugggguuccug

SEQ ID NO: 1168773 - RNA, 25 nt, Human
uuuuuuuuuuuugagauagaaucuc

SEQ ID NO: 1168774 - RNA, 18 nt, Human
uuuuuuuuuuuuuuuuug

SEQ ID NO: 1168775 - RNA, 19 nt, Human
aggcggcgggggccuuggg

SEQ ID NO: 1168776 - RNA, 21 nt, Human
aggcggcgggggccuuggggc

SEQ ID NO: 1168777 - RNA, 22 nt, Human
caccugugagguggacgcgguc

SEQ ID NO: 1168778 - RNA, 18 nt, Human
caggaggcguagagcucc

SEQ ID NO: 1168779 - RNA, 21 nt, Human
ccagguucuguccaagcacug

SEQ ID NO: 1168780 - RNA, 31 nt, Human; identical to SEQ ID NO: 1062172

SEQ ID NO: 1168781 - RNA, 19 nt, Human
ccgagggcgcggugaggag

SEQ ID NO: 1168782 - RNA, 23 nt, Human
ccuggcgcaccugugagguggac

SEQ ID NO: 1168783 - RNA, 26 nt, Human
cuggcgguugauggcggccuuuaguc

SEQ ID NO: 1168784 - RNA, 22 nt, Human
cuguugaagcaggaaaccccga

SEQ ID NO: 1168785 - RNA, 21 nt, Human
cuuggugaccagggaagucac

SEQ ID NO: 1168786 - RNA, 19 nt, Human
ggugaccagggaagucacc

SEQ ID NO: 1168787 - RNA, 24 nt, Human
ggugaggaggugacggagggcugg

SEQ ID NO: 1168788 - RNA, 20 nt, Human
uacaaaucaaagaacuuaag

SEQ ID NO: 1168789 - RNA, 24 nt, Human
uacaacuuauagaaaagguaaagg

SEQ ID NO: 1168790 - RNA, 23 nt, Human
uggugguaguccuggcgcaccug

SEQ ID NO: 1168791 - RNA, 21 nt, Human
uuggugaccagggaagucacc

SEQ ID NO: 1168792 - RNA, 19 nt, Human
accccgagcccgagccucc

SEQ ID NO: 1168793 - RNA, 21 nt, Human
accuccccacuucccugcgac

SEQ ID NO: 1168794 - RNA, 21 nt, Human
aguccccuaauuggacccggc

SEQ ID NO: 1168795 - RNA, 23 nt, Human
cacaggggccgggccuccucggg

SEQ ID NO: 1168796 - RNA, 25 nt, Human
cagcggggcaggcugugaguccccu

SEQ ID NO: 1168797 - RNA, 21 nt, Human
caggaaauccccgcucgcuga

SEQ ID NO: 1168798 - RNA, 25 nt, Human
ccacagcgcccccucgccgcccgcg

SEQ ID NO: 1168799 - RNA, 19 nt, Human
ccccgagcccgagccuccg

SEQ ID NO: 1168800 - RNA, 20 nt, Human
ccccuaauuggacccggccu

SEQ ID NO: 1168801 - RNA, 20 nt, Human
cccggggagaccccgagccc

SEQ ID NO: 1168802 - RNA, 20 nt, Human
ccgcgcccggcgagcgcccc

SEQ ID NO: 1168803 - RNA, 19 nt, Human
ccggcagacacgggccaca

SEQ ID NO: 1168804 - RNA, 18 nt, Human
ccggcgagcgccccggcc

SEQ ID NO: 1168805 - RNA, 18 nt, Human
ccggcuguuccucgcgcu

SEQ ID NO: 1168806 - RNA, 24 nt, Human
ccgggccuccucggggugcacagc

SEQ ID NO: 1168807 - RNA, 18 nt, Human
ccuccccacuucccugcg

SEQ ID NO: 1168808 - RNA, 18 nt, Human
ccuccggggccggcuguu

SEQ ID NO: 1168809 - RNA, 19 nt, Human
ccucgcgcucggccucgca

SEQ ID NO: 1168810 - RNA, 23 nt, Human
cgagcccgagccuccggggccgg

SEQ ID NO: 1168811 - RNA, 19 nt, Human
cgcgcccggcgagcgcccc

SEQ ID NO: 1168812 - RNA, 24 nt, Human
cgcgcucggccucgcaggaaaucc

SEQ ID NO: 1168813 - RNA, 22 nt, Human
cggcagacacgggccacagcgc

SEQ ID NO: 1168814 - RNA, 22 nt, Human
gagccuccggggccggcuguuc

SEQ ID NO: 1168815 - RNA, 18 nt, Human
gcccgcgcgcacgacucc

SEQ ID NO: 1168816 - RNA, 18 nt, Human
ucggggugcacagcgggg

SEQ ID NO: 1168817 - RNA, 18 nt, Human
ugaaaugccucgaugccg

SEQ ID NO: 1168818 - RNA, 23 nt, Human
ugaaaugccucgaugccguuuuu

SEQ ID NO: 1168819 - RNA, 19 nt, Human
ugccgggacucgggccggc

SEQ ID NO: 1168820 - RNA, 20 nt, Human
uggacccggccuggccugac

SEQ ID NO: 1168821 - RNA, 21 nt, Human
ugggucgcgcccaccguugcc

SEQ ID NO: 1168822 - RNA, 22 nt, Human
uuuuucuucuuccccgaauuaa

SEQ ID NO: 1168823 - RNA, 19 nt, Human
accacagcuugggcuugcu

SEQ ID NO: 1168824 - RNA, 25 nt, Human
cacagcuugggcuugcuggcggggg

SEQ ID NO: 1168825 - RNA, 19 nt, Human
cagcggcgccuccaagccg

SEQ ID NO: 1168826 - RNA, 20 nt, Human
cagcuccucgcugcgcggag

SEQ ID NO: 1168827 - RNA, 22 nt, Human
caucuuguucuccuucuugagg

SEQ ID NO: 1168828 - RNA, 22 nt, Human
ccccgguggcccgcagcccggg

SEQ ID NO: 1168829 - RNA, 20 nt, Human
cccgaagccgguggccgccu

SEQ ID NO: 1168830 - RNA, 26 nt, Human
cccgacgccgagcgcgccagcuccuc

SEQ ID NO: 1168831 - RNA, 20 nt, Human
cccuggggcgucuugcggcc

SEQ ID NO: 1168832 - RNA, 21 nt, Human
ccgagcccgacgccgagcgcg

SEQ ID NO: 1168833 - RNA, 21 nt, Human
ccggcgcgcguuggcgaacca

SEQ ID NO: 1168834 - RNA, 20 nt, Human
cgagcccgacgccgagcgcg

SEQ ID NO: 1168835 - RNA, 20 nt, Human
cgagcccggguaggggcuga

SEQ ID NO: 1168836 - RNA, 21 nt, Human
cgcccuuggugggguaggggu

SEQ ID NO: 1168837 - RNA, 23 nt, Human
cgcgcccggagacguccggcugc

SEQ ID NO: 1168838 - RNA, 30 nt, Human
cgggaagccggcggcggcggcggcggcgac

SEQ ID NO: 1168839 - RNA, 18 nt, Human
cggguaggccgcgcugcc

SEQ ID NO: 1168840 - RNA, 20 nt, Human
cugcgcggagccgccaaagc

SEQ ID NO: 1168841 - RNA, 22 nt, Human
gagccgccaaagccgacgcgcc

SEQ ID NO: 1168842 - RNA, 18 nt, Human
gccgagcgcgccagcucc

SEQ ID NO: 1168843 - RNA, 21 nt, Human
gcgucuugcggccaccgcggg

SEQ ID NO: 1168844 - RNA, 18 nt, Human
gcguuggcgaaccaggug

SEQ ID NO: 1168845 - RNA, 24 nt, Human
ggaagccggcggcggcggcggcgg

SEQ ID NO: 1168846 - RNA, 18 nt, Human
ggcccgcagcccgggccc

SEQ ID NO: 1168847 - RNA, 25 nt, Human
ggccucgggcggggggcucagcagc

SEQ ID NO: 1168848 - RNA, 19 nt, Human
ggcggcgcgcccggagacg

SEQ ID NO: 1168849 - RNA, 18 nt, Human
ggcggcggcgucggccga

SEQ ID NO: 1168850 - RNA, 22 nt, Human
ggcuugcuggcggggggcggcg

SEQ ID NO: 1168851 - RNA, 18 nt, Human
gggcagccccgguggccc

SEQ ID NO: 1168852 - RNA, 25 nt, Human
gggcagccccgguggcccgcagccc

SEQ ID NO: 1168853 - RNA, 23 nt, Human
gggcgcggccucgggcggggggc

SEQ ID NO: 1168854 - RNA, 20 nt, Human
ggggcgcggccucgggcggg

SEQ ID NO: 1168855 - RNA, 21 nt, Human
ggugcucguugagccaggccu

SEQ ID NO: 1168856 - RNA, 21 nt, Human
ugagaguggccguggcguccc

SEQ ID NO: 1168857 - RNA, 21 nt, Human
ugcccuggggcgucuugcggc

SEQ ID NO: 1168858 - RNA, 24 nt, Human
ugcccuggggcgucuugcggccac

SEQ ID NO: 1168859 - RNA, 20 nt, Human
uggccguggcgucccgcgug

SEQ ID NO: 1168860 - RNA, 31 nt, Human
uuggugaugauggcuagcaugaucuucucuu

SEQ ID NO: 1168861 - RNA, 22 nt, Human
aaagcuccccaucacccugccc

SEQ ID NO: 1168862 - RNA, 19 nt, Human
aaccaggaagaggcugucu

SEQ ID NO: 1168863 - RNA, 23 nt, Human
aagaagagugagacugagaccug

SEQ ID NO: 1168864 - RNA, 21 nt, Human
aagcaguggagacagagauuu

SEQ ID NO: 1168865 - RNA, 20 nt, Human
aagcuccccaucacccugcc

SEQ ID NO: 1168866 - RNA, 20 nt, Human
aagguuuugcccuuuuccua

SEQ ID NO: 1168867 - RNA, 24 nt, Human
acaacccacuaggguuaggggccc

SEQ ID NO: 1168868 - RNA, 23 nt, Human
acaguauuuccaaaggaggcuuu

SEQ ID NO: 1168869 - RNA, 21 nt, Human
acuccccccaaagcuccccau

SEQ ID NO: 1168870 - RNA, 22 nt, Human
acugaauccauucugacacacu

SEQ ID NO: 1168871 - RNA, 19 nt, Human
agaaagccugaaaucccac

SEQ ID NO: 1168872 - RNA, 25 nt, Human
agaaagccugaaaucccacguuaga

SEQ ID NO: 1168873 - RNA, 19 nt, Human
agaacucagcagcuuaaaa

SEQ ID NO: 1168874 - RNA, 24 nt, Human
agaagagugagacugagaccugag

SEQ ID NO: 1168875 - RNA, 18 nt, Human
agaaggagccugggcccu

SEQ ID NO: 1168876 - RNA, 20 nt, Human
agcucccgcagccaaggaau

SEQ ID NO: 1168877 - RNA, 19 nt, Human
aggcagcccucggcugggc

SEQ ID NO: 1168878 - RNA, 21 nt, Human
aggcagcugccauccacccuu

SEQ ID NO: 1168879 - RNA, 19 nt, Human
aggguuaggggcccgcagg

SEQ ID NO: 1168880 - RNA, 18 nt, Human
aucccacagccaccacag

SEQ ID NO: 1168881 - RNA, 18 nt, Human
aucggccaccaggcuggu

SEQ ID NO: 1168882 - RNA, 24 nt, Human
auggguuuuggugguaaauguuuu

SEQ ID NO: 1168883 - RNA, 24 nt, Human
augucaguggaaagaguaugguuc

SEQ ID NO: 1168884 - RNA, 18 nt, Human
caaagcuccccaucaccc

SEQ ID NO: 1168885 - RNA, 20 nt, Human
caacugcccccgcucugccc

SEQ ID NO: 1168886 - RNA, 18 nt, Human
caagagaggaggaggcag

SEQ ID NO: 1168887 - RNA, 24 nt, Human
cacacagccccauuccgcugccag

SEQ ID NO: 1168888 - RNA, 21 nt, Human
cacccugcccucuccaaaucc

SEQ ID NO: 1168889 - RNA, 22 nt, Human
cacccugcccucuccaaauccu

SEQ ID NO: 1168890 - RNA, 19 nt, Human
caccguguauggccguggu

SEQ ID NO: 1168891 - RNA, 20 nt, Human
cacgauaagcacauauuacu

SEQ ID NO: 1168892 - RNA, 23 nt, Human
cacuccccagaacccuccagcaa

SEQ ID NO: 1168893 - RNA, 23 nt, Human
cagaacccuccagcaaggggcuc

SEQ ID NO: 1168894 - RNA, 24 nt, Human
cagcaggaaaaggaaagcagugga

SEQ ID NO: 1168895 - RNA, 21 nt, Human
cagcgcucugugagcuuccaa

SEQ ID NO: 1168896 - RNA, 19 nt, Human
caggaaaaggaaagcagug

SEQ ID NO: 1168897 - RNA, 18 nt, Human
caggaagaggcucuggca

SEQ ID NO: 1168898 - RNA, 21 nt, Human
caggaagaggcugucucccug

SEQ ID NO: 1168899 - RNA, 23 nt, Human
caggggugccugugugauccagu

SEQ ID NO: 1168900 - RNA, 22 nt, Human
caguaggacagguuucucaaac

SEQ ID NO: 1168901 - RNA, 22 nt, Human
cauacaaucacucccuucuuag

SEQ ID NO: 1168902 - RNA, 23 nt, Human
caucacccugcccucuccaaauc

SEQ ID NO: 1168903 - RNA, 27 nt, Human
caucggccaccaggcuggucuccagga

SEQ ID NO: 1168904 - RNA, 21 nt, Human
caugacccugagaagacucag

SEQ ID NO: 1168905 - RNA, 26 nt, Human
ccacagaagguuguguuacccccgcc

SEQ ID NO: 1168906 - RNA, 25 nt, Human
ccaccaggcuuuacucacaaugcaa

SEQ ID NO: 1168907 - RNA, 21 nt, Human
cccaucacccugcccucucca

SEQ ID NO: 1168908 - RNA, 19 nt, Human
ccccaaagcuccccaucac

SEQ ID NO: 1168909 - RNA, 19 nt, Human
ccccacaccagccugcacc

SEQ ID NO: 1168910 - RNA, 21 nt, Human
ccccaucacccugcccucucc

SEQ ID NO: 1168911 - RNA, 21 nt, Human
ccccgcucugcccgcuccaga

SEQ ID NO: 1168912 - RNA, 22 nt, Human
ccccgcucugcccgcuccagaa

SEQ ID NO: 1168913 - RNA, 18 nt, Human
cccgcagaacucagcagc

SEQ ID NO: 1168914 - RNA, 21 nt, Human
cccgcagccaaggaaugagac

SEQ ID NO: 1168915 - RNA, 24 nt, Human
ccgugggccacuccccagaacccu

SEQ ID NO: 1168916 - RNA, 18 nt, Human
ccuaaucuagcagccaca

SEQ ID NO: 1168917 - RNA, 21 nt, Human
ccucuuuugcugacagggguu

SEQ ID NO: 1168918 - RNA, 23 nt, Human
ccuucuuccuuccuccuucuucc

SEQ ID NO: 1168919 - RNA, 21 nt, Human
cgcugccagcguccugcaggc

SEQ ID NO: 1168920 - RNA, 25 nt, Human
cuccccaucacccugcccucuccaa

SEQ ID NO: 1168921 - RNA, 22 nt, Human
cucccgcagaacucagcagcuu

SEQ ID NO: 1168922 - RNA, 25 nt, Human
cugaucgccgcucaccuacuccuga

SEQ ID NO: 1168923 - RNA, 27 nt, Human
cugcaggccccuccucagggaaggccc

SEQ ID NO: 1168924 - RNA, 20 nt, Human
cuggaaggauacaccaccca

SEQ ID NO: 1168925 - RNA, 18 nt, Human
cuggucuccaggaaauag

SEQ ID NO: 1168926 - RNA, 20 nt, Human
cugucucccugccaugaccu

SEQ ID NO: 1168927 - RNA, 19 nt, Human
cuuccaccguuucaaggac

SEQ ID NO: 1168928 - RNA, 21 nt, Human
gcagaacucagcagcuuaaaa

SEQ ID NO: 1168929 - RNA, 19 nt, Human
gcagcugccauccacccuu

SEQ ID NO: 1168930 - RNA, 21 nt, Human
gcaggaaaaggaaagcagugg

SEQ ID NO: 1168931 - RNA, 19 nt, Human
gcccauacaaucacucccu

SEQ ID NO: 1168932 - RNA, 21 nt, Human
gcuccagacacauguggaggg

SEQ ID NO: 1168933 - RNA, 21 nt, Human
gcugccauccacccuuuaccu

SEQ ID NO: 1168934 - RNA, 19 nt, Human
gcuguguguggccuucagg

SEQ ID NO: 1168935 - RNA, 19 nt, Human
ggacagaacacaguauccg

SEQ ID NO: 1168936 - RNA, 24 nt, Human
ggagccaaggugaacagcaggaaa

SEQ ID NO: 1168937 - RNA, 20 nt, Human
ggauuaaucccacagccacc

SEQ ID NO: 1168938 - RNA, 19 nt, Human
gggcccagagcagggccgg

SEQ ID NO: 1168939 - RNA, 21 nt, Human
ggggcucaggguagucagaug

SEQ ID NO: 1168940 - RNA, 19 nt, Human
gggugacgguggccauggg

SEQ ID NO: 1168941 - RNA, 21 nt, Human
gggugacgguggccaugggug

SEQ ID NO: 1168942 - RNA, 22 nt, Human
gggugacgguggccgugggcca

SEQ ID NO: 1168943 - RNA, 21 nt, Human
ggguuaggggcccgcagguuu

SEQ ID NO: 1168944 - RNA, 20 nt, Human
ggugacgguggccgugggcc

SEQ ID NO: 1168945 - RNA, 19 nt, Human
gugaacagcaggaaaagga

SEQ ID NO: 1168946 - RNA, 20 nt, Human
guggguaggugggagaacag

SEQ ID NO: 1168947 - RNA, 22 nt, Human
uaauagaaccagucuccuagau

SEQ ID NO: 1168948 - RNA, 24 nt, Human
uacuuauauacgaaaaaaguuauu

SEQ ID NO: 1168949 - RNA, 20 nt, Human
uagaugacacugcuccccac

SEQ ID NO: 1168950 - RNA, 23 nt, Human
uagggcccuggugucuacuuccu

SEQ ID NO: 1168951 - RNA, 26 nt, Human
uaugacaucggccaccaggcuggucu

SEQ ID NO: 1168952 - RNA, 23 nt, Human
ucacccugcccucuccaaauccu

SEQ ID NO: 1168953 - RNA, 18 nt, Human
ucagaaagagggcaagcu

SEQ ID NO: 1168954 - RNA, 23 nt, Human
ucagcaaacucccgcagaacuca

SEQ ID NO: 1168955 - RNA, 21 nt, Human
ucaguggaaagaguaugguuc

SEQ ID NO: 1168956 - RNA, 19 nt, Human
uccauucuggucacauaaa

SEQ ID NO: 1168957 - RNA, 19 nt, Human
ucccacagccaccacagaa

SEQ ID NO: 1168958 - RNA, 21 nt, Human
uccccccaaagcuccccauca

SEQ ID NO: 1168959 - RNA, 24 nt, Human
uccccccaaagcuccccaucaccc

SEQ ID NO: 1168960 - RNA, 22 nt, Human
uccgagaguucugguuucuacu

SEQ ID NO: 1168961 - RNA, 18 nt, Human
ucgcccauacaaucacuc

SEQ ID NO: 1168962 - RNA, 20 nt, Human
ucggugaagagugaggccug

SEQ ID NO: 1168963 - RNA, 20 nt, Human
ucuccaggucaggguuccua

SEQ ID NO: 1168964 - RNA, 20 nt, Human
ucuggcaggaagaacagcug

SEQ ID NO: 1168965 - RNA, 23 nt, Human
ucuuuugcugacaggggugccug

SEQ ID NO: 1168966 - RNA, 20 nt, Human
ugaaaaaaaguuuuggaagg

SEQ ID NO: 1168967 - RNA, 25 nt, Human
ugaaaaacagaauauaaaauugaaa

SEQ ID NO: 1168968 - RNA, 25 nt, Human
ugacaucggccaccaggcuggucuc

SEQ ID NO: 1168969 - RNA, 21 nt, Human
ugagaaggagccugggcccug

SEQ ID NO: 1168970 - RNA, 19 nt, Human
ugcaugacccugagaagac

SEQ ID NO: 1168971 - RNA, 23 nt, Human
ugccagcguccugcaggccccuc

SEQ ID NO: 1168972 - RNA, 20 nt, Human
ugccaggggccagaaugugg

SEQ ID NO: 1168973 - RNA, 21 nt, Human
ugccaggggccagaauguggg

SEQ ID NO: 1168974 - RNA, 22 nt, Human
ugccaugaccuaaucuagcagc

SEQ ID NO: 1168975 - RNA, 19 nt, Human
ugccccucuccaggucagg

SEQ ID NO: 1168976 - RNA, 20 nt, Human
uggaaagaguaugguucuuc

SEQ ID NO: 1168977 - RNA, 18 nt, Human
uggaaggaaaaaauauuc

SEQ ID NO: 1168978 - RNA, 22 nt, Human
uggaaggaaaaaauauucccau

SEQ ID NO: 1168979 - RNA, 20 nt, Human
uggaaggauacaccacccac

SEQ ID NO: 1168980 - RNA, 19 nt, Human
uggaggaacccccacacca

SEQ ID NO: 1168981 - RNA, 18 nt, Human
uggcaggaagaacagcug

SEQ ID NO: 1168982 - RNA, 19 nt, Human
uggcaggaagaacagcugg

SEQ ID NO: 1168983 - RNA, 22 nt, Human
ugggggaaaguaacagccuugg

SEQ ID NO: 1168984 - RNA, 19 nt, Human
ugguggcaaaacacugacc

SEQ ID NO: 1168985 - RNA, 21 nt, Human
ugguggcaaaacacugaccuc

SEQ ID NO: 1168986 - RNA, 20 nt, Human
uggugguaaauguuuuaucu

SEQ ID NO: 1168987 - RNA, 20 nt, Human
ugguuucuacuguugcucag

SEQ ID NO: 1168988 - RNA, 18 nt, Human
ugugaggaagacgucugg

SEQ ID NO: 1168989 - RNA, 19 nt, Human
uguguuagaugcuggccag

SEQ ID NO: 1168990 - RNA, 23 nt, Human
uuaaucccacagccaccacagaa

SEQ ID NO: 1168991 - RNA, 23 nt, Human
uuauguaugaauuuuauuuuccu

SEQ ID NO: 1168992 - RNA, 19 nt, Human
uuccaaaggaggcuuuugg

SEQ ID NO: 1168993 - RNA, 23 nt, Human
uuccuaaacucccugugaauugc

SEQ ID NO: 1168994 - RNA, 20 nt, Human
uuccuaaugcacucccccca

SEQ ID NO: 1168995 - RNA, 21 nt, Human
uuccugcucugcaacugaauc

SEQ ID NO: 1168996 - RNA, 24 nt, Human
uugaaaaacagaauauaaaauuga

SEQ ID NO: 1168997 - RNA, 24 nt, Human
uuggaucaugucaguggaaagagu

SEQ ID NO: 1168998 - RNA, 24 nt, Human
uuggaugcugaugaguaaauguuu

SEQ ID NO: 1168999 - RNA, 26 nt, Human
uuucagaaagagggcaagcuucuguu

SEQ ID NO: 1169000 - RNA, 27 nt, Human
aaaaaaaaaaaaaaaagaugaagaaaa

SEQ ID NO: 1169001 - RNA, 25 nt, Human
aaaaaaaaaaaaaagaugaagaaaa

SEQ ID NO: 1169002 - RNA, 19 nt, Human
aaaccuggacgagguggcg

SEQ ID NO: 1169003 - RNA, 23 nt, Human
aaagaugaagaaaaggggaaaga

SEQ ID NO: 1169004 - RNA, 24 nt, Human
aaaguacugggauuacagguguga

SEQ ID NO: 1169005 - RNA, 27 nt, Human
aagcuccgcuucccggguucacgcccu

SEQ ID NO: 1169006 - RNA, 18 nt, Human
aaguacugggauuacagg

SEQ ID NO: 1169007 - RNA, 26 nt, Human
aaguacugggauuacaggugugagcc

SEQ ID NO: 1169008 - RNA, 22 nt, Human
acagaacagaugggugaacacu

SEQ ID NO: 1169009 - RNA, 25 nt, Human
acccgccucggccucccaaaguacu

SEQ ID NO: 1169010 - RNA, 20 nt, Human
accuccgaugcggcacuccc

SEQ ID NO: 1169011 - RNA, 18 nt, Human
acgggguuucacuguguu

SEQ ID NO: 1169012 - RNA, 19 nt, Human
acgggguuucacuguguua

SEQ ID NO: 1169013 - RNA, 20 nt, Human
acgggguuucacuguguuag

SEQ ID NO: 1169014 - RNA, 24 nt, Human
acgggguuucacuguguuagccag

SEQ ID NO: 1169015 - RNA, 24 nt, Human
acuguguuagccaggcuggucucg

SEQ ID NO: 1169016 - RNA, 19 nt, Human
agcucaccuccucugcaaa

SEQ ID NO: 1169017 - RNA, 18 nt, Human
aggcaggggauggggaag

SEQ ID NO: 1169018 - RNA, 19 nt, Human
aggcaggggauggggaagu

SEQ ID NO: 1169019 - RNA, 20 nt, Human
aggcaggggauggggaagug

SEQ ID NO: 1169020 - RNA, 25 nt, Human
aggcuggagugcaguggcgccaucu

SEQ ID NO: 1169021 - RNA, 19 nt, Human
aggcugggcuggaagugag

SEQ ID NO: 1169022 - RNA, 23 nt, Human
aggcugggcuggaagugaggcuc

SEQ ID NO: 1169023 - RNA, 20 nt, Human
agggcguaacgacagcagcc

SEQ ID NO: 1169024 - RNA, 24 nt, Human
aggggucacuuaccaagcucuguc

SEQ ID NO: 1169025 - RNA, 20 nt, Human
agguagcagcaaaaggucug

SEQ ID NO: 1169026 - RNA, 21 nt, Human
aguccuggugagcucaccucc

SEQ ID NO: 1169027 - RNA, 20 nt, Human
agugcaguggcgccaucucg

SEQ ID NO: 1169028 - RNA, 24 nt, Human
agugcaguggcgccaucucggcuc

SEQ ID NO: 1169029 - RNA, 24 nt, Human
caaaguacugggauuacaggugug

SEQ ID NO: 1169030 - RNA, 23 nt, Human
cacccgccucggccucccaaagu

SEQ ID NO: 1169031 - RNA, 24 nt, Human
caccgauccccguuccccgguggc

SEQ ID NO: 1169032 - RNA, 22 nt, Human
cacgcccuucuccugccucagc

SEQ ID NO: 1169033 - RNA, 19 nt, Human
cacuguguuagccaggcug

SEQ ID NO: 1169034 - RNA, 21 nt, Human
cacuguguuagccaggcuggu

SEQ ID NO: 1169035 - RNA, 24 nt, Human
cacuguguuagccaggcuggucuc

SEQ ID NO: 1169036 - RNA, 20 nt, Human
cagaacagaugggugaacag

SEQ ID NO: 1169037 - RNA, 20 nt, Human
cagaggccagggcacgugug

SEQ ID NO: 1169038 - RNA, 21 nt, Human
cagcagugggggccaccuggc

SEQ ID NO: 1169039 - RNA, 23 nt, Human
cagcagugggggccaccuggcag

SEQ ID NO: 1169040 - RNA, 20 nt, Human
cagcugagcuccagaggcca

SEQ ID NO: 1169041 - RNA, 20 nt, Human
cagguagcagcaaaaggucu

SEQ ID NO: 1169042 - RNA, 21 nt, Human
caucugugcacuagccuccgu

SEQ ID NO: 1169043 - RNA, 21 nt, Human
ccaaaguacugggauuacagg

SEQ ID NO: 1169044 - RNA, 24 nt, Human
ccaaaguacugggauuacaggugu

SEQ ID NO: 1169045 - RNA, 19 nt, Human
ccauguagcugggacuaca

SEQ ID NO: 1169046 - RNA, 22 nt, Human
cccuccugcuagugugaaaauc

SEQ ID NO: 1169047 - RNA, 20 nt, Human
ccucccaaaucuauuagcuc

SEQ ID NO: 1169048 - RNA, 19 nt, Human
ccuccugcuagugugaaaa

SEQ ID NO: 1169049 - RNA, 21 nt, Human
ccucgcgcuggaauaaacccu

SEQ ID NO: 1169050 - RNA, 22 nt, Human
ccucgcgcuggaauaaacccuc

SEQ ID NO: 1169051 - RNA, 20 nt, Human
ccugaccucgugauccaccc

SEQ ID NO: 1169052 - RNA, 18 nt, Human
ccuggcagguagcagcaa

SEQ ID NO: 1169053 - RNA, 24 nt, Human
cgacagcagccggucaacccugac

SEQ ID NO: 1169054 - RNA, 24 nt, Human
cgcccaggcuggagugcaguggcg

SEQ ID NO: 1169055 - RNA, 21 nt, Human
cgccgggcuaauuuuuuguau

SEQ ID NO: 1169056 - RNA, 24 nt, Human
cgccucggccucccaaaguacugg

SEQ ID NO: 1169057 - RNA, 20 nt, Human
cgcuggcagcagagacccug

SEQ ID NO: 1169058 - RNA, 24 nt, Human
cgggguuucacuguguuagccagg

SEQ ID NO: 1169059 - RNA, 24 nt, Human
cucagccucccauguagcugggac

SEQ ID NO: 1169060 - RNA, 23 nt, Human
cucccauguagcugggacuacag

SEQ ID NO: 1169061 - RNA, 24 nt, Human
cuccugaccucgugauccacccgc

SEQ ID NO: 1169062 - RNA, 25 nt, Human
cuccugccucagccucccauguagc

SEQ ID NO: 1169063 - RNA, 21 nt, Human
cucgcucugucgcccaggcug

SEQ ID NO: 1169064 - RNA, 24 nt, Human
cucgcucugucgcccaggcuggag

SEQ ID NO: 1169065 - RNA, 20 nt, Human
cucugucgcccaggcuggag

SEQ ID NO: 1169066 - RNA, 22 nt, Human
cugaagcuuuuccagcucugca

SEQ ID NO: 1169067 - RNA, 23 nt, Human
cugccucagccucccauguagcu

SEQ ID NO: 1169068 - RNA, 26 nt, Human
cuggcagguagcagcaaaaggucuuu

SEQ ID NO: 1169069 - RNA, 22 nt, Human
cugucugaagcuuuuccagcuc

SEQ ID NO: 1169070 - RNA, 24 nt, Human
cuucccggguucacgcccuucucc

SEQ ID NO: 1169071 - RNA, 19 nt, Human
gaacgaucuucccccuucc

SEQ ID NO: 1169072 - RNA, 19 nt, Human
gacagcagccggucaaccc

SEQ ID NO: 1169073 - RNA, 18 nt, Human
gacaucugugcacuagcc

SEQ ID NO: 1169074 - RNA, 19 nt, Human
gaccgccgcuuccugaccc

SEQ ID NO: 1169075 - RNA, 22 nt, Human
gaccucgugauccacccgccuc

SEQ ID NO: 1169076 - RNA, 22 nt, Human
gaccucgugauccacccgccuc

SEQ ID NO: 1169077 - RNA, 24 nt, Human
gaccucgugauccacccgccucgg

SEQ ID NO: 1169078 - RNA, 21 nt, Human
gagacagagucucgcucuguc

SEQ ID NO: 1169079 - RNA, 19 nt, Human
gaguccuggugagcucacc

SEQ ID NO: 1169080 - RNA, 18 nt, Human
gauuacaggugugagcca

SEQ ID NO: 1169081 - RNA, 21 nt, Human
gauuacaggugugagccacug

SEQ ID NO: 1169082 - RNA, 24 nt, Human
gauuacaggugugagccacuggac

SEQ ID NO: 1169083 - RNA, 20 nt, Human
gccacuggacccggcccuga

SEQ ID NO: 1169084 - RNA, 19 nt, Human
gcccaggcuggagugcagu

SEQ ID NO: 1169085 - RNA, 20 nt, Human
gcccaggcuggagugcagug

SEQ ID NO: 1169086 - RNA, 18 nt, Human
gcccuucugcauaggagg

SEQ ID NO: 1169087 - RNA, 18 nt, Human
gccgggcuaauuuuuugu

SEQ ID NO: 1169088 - RNA, 20 nt, Human
gccucagccucccauguagc

SEQ ID NO: 1169089 - RNA, 21 nt, Human
gcuaugaaaaccuggacgagg

SEQ ID NO: 1169090 - RNA, 23 nt, Human
gcuccaggcaggggauggggaag

SEQ ID NO: 1169091 - RNA, 25 nt, Human
gcucugucgcccaggcuggagugca

SEQ ID NO: 1169092 - RNA, 20 nt, Human
gcuggagugcaguggcgcca

SEQ ID NO: 1169093 - RNA, 23 nt, Human
gcuggucucgaucuccugaccuc

SEQ ID NO: 1169094 - RNA, 27 nt, Human
ggaagugcgcacccuuggcugcccuuc

SEQ ID NO: 1169095 - RNA, 24 nt, Human
ggcuggucucgaucuccugaccuc

SEQ ID NO: 1169096 - RNA, 23 nt, Human
gggguuucacuguguuagccagg

SEQ ID NO: 1169097 - RNA, 18 nt, Human
guagcugggacuacaggc

SEQ ID NO: 1169098 - RNA, 24 nt, Human
gucucgcucugucgcccaggcugg

SEQ ID NO: 1169099 - RNA, 19 nt, Human
gugaaaaucagggucggag

SEQ ID NO: 1169100 - RNA, 24 nt, Human
gugauccacccgccucggccuccc

SEQ ID NO: 1169101 - RNA, 21 nt, Human
uaaacccucguaacgggaccc

SEQ ID NO: 1169102 - RNA, 18 nt, Human
uaaagugucuugguccca

SEQ ID NO: 1169103 - RNA, 19 nt, Human
uaagccccggacacugccu

SEQ ID NO: 1169104 - RNA, 24 nt, Human
uaauuuuuuguauuuuuagaagag

SEQ ID NO: 1169105 - RNA, 25 nt, Human
uaauuuuuuguauuuuuagaagaga

SEQ ID NO: 1169106 - RNA, 18 nt, Human
uacaggugugagccacug

SEQ ID NO: 1169107 - RNA, 19 nt, Human
uacaggugugagccacugg

SEQ ID NO: 1169108 - RNA, 23 nt, Human
uacaggugugagccacuggaccc

SEQ ID NO: 1169109 - RNA, 22 nt, Human
uaccaagcucugucugaagcuu

SEQ ID NO: 1169110 - RNA, 24 nt, Human
uacugggauuacaggugugagcca

SEQ ID NO: 1169111 - RNA, 24 nt, Human
uagaagagacgggguuucacugug

SEQ ID NO: 1169112 - RNA, 24 nt, Human
uagccaggcuggucucgaucuccu

SEQ ID NO: 1169113 - RNA, 20 nt, Human
ucacgcccuucuccugccuc

SEQ ID NO: 1169114 - RNA, 23 nt, Human
ucacugcaagcuccgcuucccgg

SEQ ID NO: 1169115 - RNA, 24 nt, Human
ucacugcaagcuccgcuucccggg

SEQ ID NO: 1169116 - RNA, 22 nt, Human
ucacuguguuagccaggcuggu

SEQ ID NO: 1169117 - RNA, 24 nt, Human
ucacuguguuagccaggcuggucu

SEQ ID NO: 1169118 - RNA, 23 nt, Human
ucccaaaguacugggauuacagg

SEQ ID NO: 1169119 - RNA, 21 nt, Human
ucccagaugcuaagauucccu

SEQ ID NO: 1169120 - RNA, 24 nt, Human
ucccauguagcugggacuacaggc

SEQ ID NO: 1169121 - RNA, 24 nt, Human
ucccggguucacgcccuucuccug

SEQ ID NO: 1169122 - RNA, 23 nt, Human
uccgcuucccggguucacgcccu

SEQ ID NO: 1169123 - RNA, 22 nt, Human
ucgcccaggcuggagugcagug

SEQ ID NO: 1169124 - RNA, 24 nt, Human
ucgcucugucgcccaggcuggagu

SEQ ID NO: 1169125 - RNA, 23 nt, Human
ucuagagaaaaaaaaaaaaaaaa

SEQ ID NO: 1169126 - RNA, 19 nt, Human
ucucgcucugucgcccagg

SEQ ID NO: 1169127 - RNA, 23 nt, Human
ucucgcucugucgcccaggcugg

SEQ ID NO: 1169128 - RNA, 24 nt, Human
ucucgcucugucgcccaggcugga

SEQ ID NO: 1169129 - RNA, 26 nt, Human
ucucgcucugucgcccaggcuggagu

SEQ ID NO: 1169130 - RNA, 27 nt, Human
ucucgcucugucgcccaggcuggagug

SEQ ID NO: 1169131 - RNA, 18 nt, Human
ucugcgggcccaggcugg

SEQ ID NO: 1169132 - RNA, 21 nt, Human
ucugcgggcccaggcugggcu

SEQ ID NO: 1169133 - RNA, 21 nt, Human
ucuguacagugugaugugaag

SEQ ID NO: 1169134 - RNA, 22 nt, Human
ugacccagcgcccucccuccug

SEQ ID NO: 1169135 - RNA, 23 nt, Human
ugaggcagacagaacagaugggu

SEQ ID NO: 1169136 - RNA, 24 nt, Human
ugccucagccucccauguagcugg

SEQ ID NO: 1169137 - RNA, 18 nt, Human
ugcgggcccaggcugggc

SEQ ID NO: 1169138 - RNA, 28 nt, Human
uggagugcaguggcgccauccuagcacg

SEQ ID NO: 1169139 - RNA, 23 nt, Human
uggagugcaguggcgccaucucg

SEQ ID NO: 1169140 - RNA, 24 nt, Human
uggagugcaguggcgccaucucgg

SEQ ID NO: 1169141 - RNA, 19 nt, Human
uggcagcagagacccuggu

SEQ ID NO: 1169142 - RNA, 21 nt, Human
ugggacuacaggcacaugccg

SEQ ID NO: 1169143 - RNA, 22 nt, Human
ugggacuacaggcacaugccgc

SEQ ID NO: 1169144 - RNA, 24 nt, Human
ugggacuacaggcacaugccgcca

SEQ ID NO: 1169145 - RNA, 18 nt, Human
ugggauuacaggugugag

SEQ ID NO: 1169146 - RNA, 19 nt, Human
ugggauuacaggugugagc

SEQ ID NO: 1169147 - RNA, 21 nt, Human
ugggauuacaggugugagcca

SEQ ID NO: 1169148 - RNA, 22 nt, Human
ugggauuacaggugugagccac

SEQ ID NO: 1169149 - RNA, 22 nt, Human
ugggauuacaggugugagccac

SEQ ID NO: 1169150 - RNA, 24 nt, Human
ugggauuacaggugugagccacug

SEQ ID NO: 1169151 - RNA, 20 nt, Human
ugggggccaccuggcaggua

SEQ ID NO: 1169152 - RNA, 19 nt, Human
uguagcugggacuacaggc

SEQ ID NO: 1169153 - RNA, 24 nt, Human
uguagcugggacuacaggcacaug

SEQ ID NO: 1169154 - RNA, 21 nt, Human
ugucgcccaggcuggagugca

SEQ ID NO: 1169155 - RNA, 24 nt, Human
uuagaagagacgggguuucacugu

SEQ ID NO: 1169156 - RNA, 18 nt, Human
uucccggguucacgcccu

SEQ ID NO: 1169157 - RNA, 22 nt, Human
uugcgcauccgcccgacucccu

SEQ ID NO: 1169158 - RNA, 21 nt, Human
uuucacuguguuagccaggcu

SEQ ID NO: 1169159 - RNA, 21 nt, Human
uuucucggugccugaccgccg

SEQ ID NO: 1169160 - RNA, 24 nt, Human
uuuuuagaagagacgggguuucac

SEQ ID NO: 1169161 - RNA, 21 nt, Human
uuuuuguauuuuuagaagaga

SEQ ID NO: 1169162 - RNA, 24 nt, Human
uuuuuuguauuuuuagaagagacg

SEQ ID NO: 1169163 - RNA, 18 nt, Human
aaaaaaaaaaaaaaagcu

SEQ ID NO: 1169164 - RNA, 22 nt, Human
aaaaaaagcugaagaacuugga

SEQ ID NO: 1169165 - RNA, 21 nt, Human
aaacaaaaacaagaacguggu

SEQ ID NO: 1169166 - RNA, 23 nt, Human
aaccacagaauuacucccacuuc

SEQ ID NO: 1169167 - RNA, 22 nt, Human
aaccagaagccucuggaguuuc

SEQ ID NO: 1169168 - RNA, 18 nt, Human
aacuuccaucucugccuc

SEQ ID NO: 1169169 - RNA, 23 nt, Human
aagaagccagucugagucccaaa

SEQ ID NO: 1169170 - RNA, 23 nt, Human
aagccucuggaguuucucagugc

SEQ ID NO: 1169171 - RNA, 19 nt, Human
aaucaaguugacacucaau

SEQ ID NO: 1169172 - RNA, 19 nt, Human
aaugccacagagcaccaac

SEQ ID NO: 1169173 - RNA, 19 nt, Human
acaaacaaaaacaagaacg

SEQ ID NO: 1169174 - RNA, 24 nt, Human
acaaacaaaaacaagaacgugguc

SEQ ID NO: 1169175 - RNA, 18 nt, Human
acacugugaugguggggg

SEQ ID NO: 1169176 - RNA, 22 nt, Human
accaacacuggacagggacaca

SEQ ID NO: 1169177 - RNA, 21 nt, Human
acggaugccugagguuccacc

SEQ ID NO: 1169178 - RNA, 26 nt, Human
acucccacuuccagacagcacuccau

SEQ ID NO: 1169179 - RNA, 19 nt, Human
acugcaagcugaggagcca

SEQ ID NO: 1169180 - RNA, 24 nt, Human
acuucucaguucauguauauacgg

SEQ ID NO: 1169181 - RNA, 21 nt, Human
agacagcacuccaucugagca

SEQ ID NO: 1169182 - RNA, 19 nt, Human
agccagcgcugcuuccugg

SEQ ID NO: 1169183 - RNA, 18 nt, Human
agccucuggaguuucuca

SEQ ID NO: 1169184 - RNA, 19 nt, Human
aggcaucccccaccccggc

SEQ ID NO: 1169185 - RNA, 22 nt, Human
aggcaucccccaccccggcuua

SEQ ID NO: 1169186 - RNA, 24 nt, Human
aggcuggaacacucagcaagucug

SEQ ID NO: 1169187 - RNA, 24 nt, Human
agggacacacugugaugguggggg

SEQ ID NO: 1169188 - RNA, 24 nt, Human
agggaggagaugaggccccacugg

SEQ ID NO: 1169189 - RNA, 21 nt, Human
augaauggaugcuucccauuc

SEQ ID NO: 1169190 - RNA, 19 nt, Human
augcagccuggaagagcug

SEQ ID NO: 1169191 - RNA, 21 nt, Human
augcagccuggaagagcugga

SEQ ID NO: 1169192 - RNA, 18 nt, Human
augccacagagcaccaac

SEQ ID NO: 1169193 - RNA, 22 nt, Human
augguaucuggggaucagccag

SEQ ID NO: 1169194 - RNA, 19 nt, Human
auuagaaagucuucaagca

SEQ ID NO: 1169195 - RNA, 20 nt, Human
auugagggggacaugcagcc

SEQ ID NO: 1169196 - RNA, 21 nt, Human
caaaaaaaaaaaaaaagcuga

SEQ ID NO: 1169197 - RNA, 25 nt, Human
caaaaaaaaaaaaaaagcugaagaa

SEQ ID NO: 1169198 - RNA, 24 nt, Human
caaaaacaagaacguggucaauac

SEQ ID NO: 1169199 - RNA, 19 nt, Human
caaaaugcugaauuccgua

SEQ ID NO: 1169200 - RNA, 25 nt, Human
caaacaaaaacaagaacguggucaa

SEQ ID NO: 1169201 - RNA, 21 nt, Human
caaauugcagaaacagccuga

SEQ ID NO: 1169202 - RNA, 23 nt, Human
caagaguccaaaaaaaaaaaaaa

SEQ ID NO: 1169203 - RNA, 23 nt, Human
caagugcugcgucccaaaagucc

SEQ ID NO: 1169204 - RNA, 28 nt, Human
cacaaaauacaaucaaaaucagggcaua

SEQ ID NO: 1169205 - RNA, 18 nt, Human
cacaaacaaaaacaagaa

SEQ ID NO: 1169206 - RNA, 24 nt, Human
cacaaauacgccuaggcauccccc

SEQ ID NO: 1169207 - RNA, 20 nt, Human
cacaagcaaugccacagagc

SEQ ID NO: 1169208 - RNA, 21 nt, Human
cacacucucacauauacaccc

SEQ ID NO: 1169209 - RNA, 22 nt, Human
cacaucuguggaaucagggcgg

SEQ ID NO: 1169210 - RNA, 18 nt, Human
cacugugauggugggggc

SEQ ID NO: 1169211 - RNA, 19 nt, Human
cagagcagcacagggagga

SEQ ID NO: 1169212 - RNA, 18 nt, Human
cagagcuggacugacccu

SEQ ID NO: 1169213 - RNA, 19 nt, Human
cagcacagggaggagauga

SEQ ID NO: 1169214 - RNA, 19 nt, Human
cagccugaggacagagcca

SEQ ID NO: 1169215 - RNA, 20 nt, Human
cauccagcaugggagaaaga

SEQ ID NO: 1169216 - RNA, 22 nt, Human
cauucaaccacagaauuacucc

SEQ ID NO: 1169217 - RNA, 19 nt, Human
cauuccaacuucugccugc

SEQ ID NO: 1169218 - RNA, 23 nt, Human
ccaaacuucaaagguagggaggc

SEQ ID NO: 1169219 - RNA, 22 nt, Human
ccagacagcacuccaucugagc

SEQ ID NO: 1169220 - RNA, 22 nt, Human
ccagacagcuuuggugaccgag

SEQ ID NO: 1169221 - RNA, 23 nt, Human
ccagccucacuccauuucuccca

SEQ ID NO: 1169222 - RNA, 18 nt, Human
ccauuggguugaaaggau

SEQ ID NO: 1169223 - RNA, 25 nt, Human
ccgacugcaagcugaggagccaaga

SEQ ID NO: 1169224 - RNA, 20 nt, Human
ccucuuauuccuuacggcuc

SEQ ID NO: 1169225 - RNA, 22 nt, Human
ccuggggaggaggaggcaccgg

SEQ ID NO: 1169226 - RNA, 19 nt, Human
ccuguguauuagucagggu

SEQ ID NO: 1169227 - RNA, 20 nt, Human
cgucugggucugugcuguuc

SEQ ID NO: 1169228 - RNA, 21 nt, Human
cuccauuucucccaccuucca

SEQ ID NO: 1169229 - RNA, 19 nt, Human
cucugccucugacccacau

SEQ ID NO: 1169230 - RNA, 22 nt, Human
cugcauccccucgucugggucu

SEQ ID NO: 1169231 - RNA, 22 nt, Human
cugcggcuagaggccugggagc

SEQ ID NO: 1169232 - RNA, 19 nt, Human
cuggcucugggcugcaucc

SEQ ID NO: 1169233 - RNA, 18 nt, Human
cugggcugcauccccucg

SEQ ID NO: 1169234 - RNA, 18 nt, Human
cuggucuggucacaaaca

SEQ ID NO: 1169235 - RNA, 21 nt, Human
gaaggcuggaacacucagcaa

SEQ ID NO: 1169236 - RNA, 19 nt, Human
gaauuagaaagucuucaag

SEQ ID NO: 1169237 - RNA, 20 nt, Human
gacacacugugauggugggg

SEQ ID NO: 1169238 - RNA, 20 nt, Human
gagagccgaugagagggcag

SEQ ID NO: 1169239 - RNA, 22 nt, Human
gaucacaggcucccaggaggaa

SEQ ID NO: 1169240 - RNA, 19 nt, Human
gcauccccucgucuggguc

SEQ ID NO: 1169241 - RNA, 19 nt, Human
gccugucacucagcaccgc

SEQ ID NO: 1169242 - RNA, 19 nt, Human
ggaggaggaggcaccgggu

SEQ ID NO: 1169243 - RNA, 23 nt, Human
ggaggaggaggcaccggguuacu

SEQ ID NO: 1169244 - RNA, 22 nt, Human
ggaucagccagcgcugcuuccu

SEQ ID NO: 1169245 - RNA, 19 nt, Human
guagaccucucuucaagug

SEQ ID NO: 1169246 - RNA, 21 nt, Human
gugaauaccuacccaaaauug

SEQ ID NO: 1169247 - RNA, 20 nt, Human
uaacacauauaacauaauua

SEQ ID NO: 1169248 - RNA, 22 nt, Human
uacuauguacuaaaagauaaga

SEQ ID NO: 1169249 - RNA, 18 nt, Human
uagcugcuguggcagcug

SEQ ID NO: 1169250 - RNA, 22 nt, Human
uaggcaucccccaccccggcuu

SEQ ID NO: 1169251 - RNA, 18 nt, Human
uaucuggggaucagccag

SEQ ID NO: 1169252 - RNA, 20 nt, Human
uaugugauuuccaaaaugcu

SEQ ID NO: 1169253 - RNA, 24 nt, Human
ucaauaccacaaauacgccuaggg

SEQ ID NO: 1169254 - RNA, 25 nt, Human
uccaacuuccaucucugccucugac

SEQ ID NO: 1169255 - RNA, 19 nt, Human
ucccaaagaacugucuacc

SEQ ID NO: 1169256 - RNA, 19 nt, Human
uccuggggaggaggaggca

SEQ ID NO: 1169257 - RNA, 20 nt, Human
ucuacacacuucucaguuca

SEQ ID NO: 1169258 - RNA, 22 nt, Human
ucuacugcucucagucacuuua

SEQ ID NO: 1169259 - RNA, 21 nt, Human
ucucacauauacacccaggaa

SEQ ID NO: 1169260 - RNA, 21 nt, Human
ucucugccucugacccacauc

SEQ ID NO: 1169261 - RNA, 23 nt, Human
ucugcggcuagaggccugggagc

SEQ ID NO: 1169262 - RNA, 19 nt, Human
ucuggucuggucacaaaca

SEQ ID NO: 1169263 - RNA, 20 nt, Human
ugaaaggauauugaggggga

SEQ ID NO: 1169264 - RNA, 22 nt, Human
ugaagaggucguuaaagcuguu

SEQ ID NO: 1169265 - RNA, 20 nt, Human
ugagagggcaggcuugucca

SEQ ID NO: 1169266 - RNA, 19 nt, Human
ugagucccaaacuucaaag

SEQ ID NO: 1169267 - RNA, 21 nt, Human
ugaucccgugaauuccuccuc

SEQ ID NO: 1169268 - RNA, 18 nt, Human
ugccugagguuccaccac

SEQ ID NO: 1169269 - RNA, 20 nt, Human
ugccuguugaaacuuuccuc

SEQ ID NO: 1169270 - RNA, 23 nt, Human
uggaacacucagcaagucugcuc

SEQ ID NO: 1169271 - RNA, 21 nt, Human
uggacacaagcaaugccacag

SEQ ID NO: 1169272 - RNA, 21 nt, Human
uggagagccgaugagagggca

SEQ ID NO: 1169273 - RNA, 24 nt, Human
uggagucugauguucgagggcagg

SEQ ID NO: 1169274 - RNA, 23 nt, Human
uggccaauuggacuggcuggugu

SEQ ID NO: 1169275 - RNA, 21 nt, Human
uggcucugggcugcauccccu

SEQ ID NO: 1169276 - RNA, 21 nt, Human
ugggagaaagaugaaggcugg

SEQ ID NO: 1169277 - RNA, 24 nt, Human
ugggagucggauguuugccugguu

SEQ ID NO: 1169278 - RNA, 20 nt, Human
uggggaggaggaggcaccgg

SEQ ID NO: 1169279 - RNA, 21 nt, Human
uggggaggaggaggcaccggg

SEQ ID NO: 1169280 - RNA, 18 nt, Human
uguauauaacacauauaa

SEQ ID NO: 1169281 - RNA, 18 nt, Human
ugucacucagcaccgccc

SEQ ID NO: 1169282 - RNA, 24 nt, Human
ugugaauaccuacccaaaauugcu

SEQ ID NO: 1169283 - RNA, 18 nt, Human
ugugagcagcugcugcuu

SEQ ID NO: 1169284 - RNA, 21 nt, Human
ugugccucucccaguccacug

SEQ ID NO: 1169285 - RNA, 21 nt, Human
uguguaccugcucgguaugug

SEQ ID NO: 1169286 - RNA, 23 nt, Human
uguugaaacuuuccucagccuga

SEQ ID NO: 1169287 - RNA, 18 nt, Human
uuccagacagcacuccau

SEQ ID NO: 1169288 - RNA, 18 nt, Human
uuccauuggguugaaagg

SEQ ID NO: 1169289 - RNA, 20 nt, Human
uucccuggggccaggccuca

SEQ ID NO: 1169290 - RNA, 20 nt, Human
uucuucuacacacuucucag

SEQ ID NO: 1169291 - RNA, 21 nt, Human
uuuuuagugcaugugaauacc

SEQ ID NO: 1169292 - RNA, 22 nt, Human
aaagaaaccugucugggggcaa

SEQ ID NO: 1169293 - RNA, 21 nt, Human
aacacagcaucaccuguaccc

SEQ ID NO: 1169294 - RNA, 19 nt, Human
aaccugacaaaagaaaccu

SEQ ID NO: 1169295 - RNA, 22 nt, Human
aaguggaggggcuauuucccua

SEQ ID NO: 1169296 - RNA, 20 nt, Human
aauucaagcacugaagccga

SEQ ID NO: 1169297 - RNA, 20 nt, Human
acaauaucuuauuaaaaggc

SEQ ID NO: 1169298 - RNA, 21 nt, Human
accacagauacccggcuuucc

SEQ ID NO: 1169299 - RNA, 23 nt, Human
acccuaaagacguuuuggugaaa

SEQ ID NO: 1169300 - RNA, 24 nt, Human
agaaagccccccucccuguuccuc

SEQ ID NO: 1169301 - RNA, 18 nt, Human
aggaaugcguguuucuug

SEQ ID NO: 1169302 - RNA, 23 nt, Human
aguggaggggcuauuucccuaaa

SEQ ID NO: 1169303 - RNA, 23 nt, Human
caaaagaaaccugucugggggca

SEQ ID NO: 1169304 - RNA, 20 nt, Human
caauagagugggcugccaca

SEQ ID NO: 1169305 - RNA, 18 nt, Human
caccuguacccauaauca

SEQ ID NO: 1169306 - RNA, 18 nt, Human
cagcuuagggauguggcu

SEQ ID NO: 1169307 - RNA, 26 nt, Human
caggugauguucuuuccagaaagccc

SEQ ID NO: 1169308 - RNA, 19 nt, Human
cccauagcugaaguaaaau

SEQ ID NO: 1169309 - RNA, 27 nt, Human
ccccaaaagucagcgcucggccgcacu

SEQ ID NO: 1169310 - RNA, 21 nt, Human
ccuccggggugcagccacguc

SEQ ID NO: 1169311 - RNA, 23 nt, Human
ccuugagaaauggguuccagaga

SEQ ID NO: 1169312 - RNA, 22 nt, Human
cgcagagggacccagugagacg

SEQ ID NO: 1169313 - RNA, 18 nt, Human
cgggacagcgggcggggg

SEQ ID NO: 1169314 - RNA, 20 nt, Human
cucccaggagcgaagguggg

SEQ ID NO: 1169315 - RNA, 21 nt, Human
cucccuguuccucuggucuga

SEQ ID NO: 1169316 - RNA, 18 nt, Human
cugaagccgaggccggca

SEQ ID NO: 1169317 - RNA, 24 nt, Human
cuggggugcagcggggcucccagg

SEQ ID NO: 1169318 - RNA, 24 nt, Human
gaagccgaggccggcagagaggga

SEQ ID NO: 1169319 - RNA, 18 nt, Human
gagcucgaagaugagcag

SEQ ID NO: 1169320 - RNA, 18 nt, Human
gaggaaugcguguuucuu

SEQ ID NO: 1169321 - RNA, 19 nt, Human
gcauuaggaaaaagacuga

SEQ ID NO: 1169322 - RNA, 21 nt, Human
gccgcagagggacccagugag

SEQ ID NO: 1169323 - RNA, 23 nt, Human
gggcucccaggagcgaagguggg

SEQ ID NO: 1169324 - RNA, 23 nt, Human
uaggaaaaagacugaugggccug

SEQ ID NO: 1169325 - RNA, 22 nt, Human
uaggugagcaauaaagcagccc

SEQ ID NO: 1169326 - RNA, 20 nt, Human
uagugagacaucaaacuucc

SEQ ID NO: 1169327 - RNA, 22 nt, Human
uccaaguggaggggcuauuucc

SEQ ID NO: 1169328 - RNA, 23 nt, Human
uccagagagcucgaagaugagca

SEQ ID NO: 1169329 - RNA, 20 nt, Human
uccccacuuguagguuccua

SEQ ID NO: 1169330 - RNA, 22 nt, Human
uccccacuuguagguuccuaau

SEQ ID NO: 1169331 - RNA, 24 nt, Human
ucccuguuccucuggucugagauc

SEQ ID NO: 1169332 - RNA, 23 nt, Human
ucccuugagaaauggguuccaga

SEQ ID NO: 1169333 - RNA, 20 nt, Human
ucggccggcgccccccuccg

SEQ ID NO: 1169334 - RNA, 19 nt, Human
ucuugggguaagagaaccc

SEQ ID NO: 1169335 - RNA, 20 nt, Human
ugaaccgggacagcgggcgg

SEQ ID NO: 1169336 - RNA, 24 nt, Human
ugaaccgggacagcgggcggggga

SEQ ID NO: 1169337 - RNA, 20 nt, Human
ugacaaaagaaaccugucuu

SEQ ID NO: 1169338 - RNA, 22 nt, Human
ugaggugggggaaugugguucu

SEQ ID NO: 1169339 - RNA, 21 nt, Human
ugccucaaguauuuucugucu

SEQ ID NO: 1169340 - RNA, 22 nt, Human
ugccucaaguauuuucugucua

SEQ ID NO: 1169341 - RNA, 25 nt, Human
uggaacuccuggggugcagcggggc

SEQ ID NO: 1169342 - RNA, 22 nt, Human
uuagggauguggcugaaauuca

SEQ ID NO: 1169343 - RNA, 24 nt, Human
uuauuaaaaggcccguacugaaag

SEQ ID NO: 1169344 - RNA, 18 nt, Human
uucccuaaaaucucccca

SEQ ID NO: 1169345 - RNA, 21 nt, Human
uucuuuccagaaagccccccu

SEQ ID NO: 1169346 - RNA, 24 nt, Human
aaaauacacaagacaagaauccac

SEQ ID NO: 1169347 - RNA, 24 nt, Human
aaacaaaacaaaacaaaaaaccca

SEQ ID NO: 1169348 - RNA, 25 nt, Human
aaacaaaacaaaacaaaaaacccaa

SEQ ID NO: 1169349 - RNA, 26 nt, Human
aaacaaaacaaaacaaaaaacccaaa

SEQ ID NO: 1169350 - RNA, 22 nt, Human
aaacaaaacaaaacaaaacaaa

SEQ ID NO: 1169351 - RNA, 21 nt, Human
aaacaggaaugaaaacaggga

SEQ ID NO: 1169352 - RNA, 19 nt, Human
aaacaggaaugaaaacaua

SEQ ID NO: 1169353 - RNA, 28 nt, Human
aaacaggaaugaaaacauacauauacug

SEQ ID NO: 1169354 - RNA, 19 nt, Human
aacauggugaaacccuauc

SEQ ID NO: 1169355 - RNA, 20 nt, Human
aacauggugaaacccuaucu

SEQ ID NO: 1169356 - RNA, 21 nt, Human
aacauggugaaacccuaucuc

SEQ ID NO: 1169357 - RNA, 22 nt, Human
aacccuaucucuacuaaaauaa

SEQ ID NO: 1169358 - RNA, 20 nt, Human
aagcaaauauuaugcuggaa

SEQ ID NO: 1169359 - RNA, 20 nt, Human
aauauaaucaaguuggccag

SEQ ID NO: 1169360 - RNA, 18 nt, Human
aaucgcuugaaccuggga

SEQ ID NO: 1169361 - RNA, 24 nt, Human
aaucgcuugaaccugggaggcaga

SEQ ID NO: 1169362 - RNA, 25 nt, Human
acaaaacaaaacaaaaaacccaaaa

SEQ ID NO: 1169363 - RNA, 22 nt, Human
acaaaacaaaacaaaacaaaaa

SEQ ID NO: 1169364 - RNA, 25 nt, Human
acaaaacaaaacaaaacaaaaaacc

SEQ ID NO: 1169365 - RNA, 20 nt, Human
acaagacaagaauccacaau

SEQ ID NO: 1169366 - RNA, 20 nt, Human
acacaagacaagaauccaca

SEQ ID NO: 1169367 - RNA, 21 nt, Human
acccuaucucuacuaaaauaa

SEQ ID NO: 1169368 - RNA, 23 nt, Human
agacaagaauccacaauaauagc

SEQ ID NO: 1169369 - RNA, 22 nt, Human
agccuggccaacauggugaaac

SEQ ID NO: 1169370 - RNA, 24 nt, Human
agccuggccaacauggugaaaccc

SEQ ID NO: 1169371 - RNA, 22 nt, Human
aggcagagggugcagugaacca

SEQ ID NO: 1169372 - RNA, 22 nt, Human
aggcaggagaaucgcuugaacc

SEQ ID NO: 1169373 - RNA, 24 nt, Human
aggcaggagaaucgcuugaaccug

SEQ ID NO: 1169374 - RNA, 22 nt, Human
aggcugaaaagaaaacaccugg

SEQ ID NO: 1169375 - RNA, 20 nt, Human
aggcugaggcaggagaaucg

SEQ ID NO: 1169376 - RNA, 24 nt, Human
aggcugaggcaggagaaucgcuug

SEQ ID NO: 1169377 - RNA, 24 nt, Human
aggugugguggcacgcaccuguag

SEQ ID NO: 1169378 - RNA, 18 nt, Human
aguaacaggcugaaaaga

SEQ ID NO: 1169379 - RNA, 19 nt, Human
auacaagacagcuuaacca

SEQ ID NO: 1169380 - RNA, 21 nt, Human
aucaaacauaauuuacuaaua

SEQ ID NO: 1169381 - RNA, 25 nt, Human
aucucuacuaaaauaacuaaaauaa

SEQ ID NO: 1169382 - RNA, 22 nt, Human
auggagggcaauuuuuuggcca

SEQ ID NO: 1169383 - RNA, 19 nt, Human
auuaugcuggaaaaugcuu

SEQ ID NO: 1169384 - RNA, 25 nt, Human
caaaacaaaacaaaacaaaaaaccc

SEQ ID NO: 1169385 - RNA, 24 nt, Human
caacauggugaaacccuaucucua

SEQ ID NO: 1169386 - RNA, 18 nt, Human
caagauccacaaauucuu

SEQ ID NO: 1169387 - RNA, 22 nt, Human
caagcaaauauuaugcuggaaa

SEQ ID NO: 1169388 - RNA, 25 nt, Human
caagcaaauauuaugcuggaaaaug

SEQ ID NO: 1169389 - RNA, 26 nt, Human
caaggaggacggaucaccugcaguca

SEQ ID NO: 1169390 - RNA, 20 nt, Human
caauaauagcaguuacauua

SEQ ID NO: 1169391 - RNA, 24 nt, Human
cacaccuauaaucccagcacuuug

SEQ ID NO: 1169392 - RNA, 27 nt, Human
cacaggacaguaacaggcugaaaagaa

SEQ ID NO: 1169393 - RNA, 23 nt, Human
caccuauaaucccagcacuuugg

SEQ ID NO: 1169394 - RNA, 24 nt, Human
caccuauaaucccagcacuuuggg

SEQ ID NO: 1169395 - RNA, 22 nt, Human
caccugcagucaggaguuccga

SEQ ID NO: 1169396 - RNA, 20 nt, Human
caccuguaguaccagcuacu

SEQ ID NO: 1169397 - RNA, 24 nt, Human
caccuguaguaccagcuacuuggg

SEQ ID NO: 1169398 - RNA, 26 nt, Human
cacucguacaaaacaggaaugaaaac

SEQ ID NO: 1169399 - RNA, 20 nt, Human
cagcacuuugggagcccaag

SEQ ID NO: 1169400 - RNA, 21 nt, Human
cagcacuuugggagcccaagg

SEQ ID NO: 1169401 - RNA, 24 nt, Human
cagcuacuugggaggcugaggcag

SEQ ID NO: 1169402 - RNA, 20 nt, Human
caggacaguaacaggcugaa

SEQ ID NO: 1169403 - RNA, 21 nt, Human
cccagcacuuugggagcccaa

SEQ ID NO: 1169404 - RNA, 23 nt, Human
ccugcagucaggaguuccgagac

SEQ ID NO: 1169405 - RNA, 22 nt, Human
ccuggccaacauggugaaaccc

SEQ ID NO: 1169406 - RNA, 23 nt, Human
ccuggccaacauggugaaacccu

SEQ ID NO: 1169407 - RNA, 24 nt, Human
ccuggccaacauggugaaacccua

SEQ ID NO: 1169408 - RNA, 21 nt, Human
ccuguaguaccagcuacuugg

SEQ ID NO: 1169409 - RNA, 24 nt, Human
cgagaccagccuggccaacauggu

SEQ ID NO: 1169410 - RNA, 24 nt, Human
cgcaccuguaguaccagcuacuug

SEQ ID NO: 1169411 - RNA, 24 nt, Human
cggaucaccugcagucaggaguuc

SEQ ID NO: 1169412 - RNA, 19 nt, Human
cguauuaaugccaaagaua

SEQ ID NO: 1169413 - RNA, 18 nt, Human
cuaaaacccggaugcuac

SEQ ID NO: 1169414 - RNA, 22 nt, Human
cucacaccuauaaucccagcac

SEQ ID NO: 1169415 - RNA, 24 nt, Human
cucacaccuauaaucccagcacuu

SEQ ID NO: 1169416 - RNA, 18 nt, Human
gaaaagaaaacaccuggu

SEQ ID NO: 1169417 - RNA, 18 nt, Human
gaaagaaaauacacaaga

SEQ ID NO: 1169418 - RNA, 21 nt, Human
gaaccugggaggcagagggug

SEQ ID NO: 1169419 - RNA, 23 nt, Human
gagaaucgcuugaaccugggagg

SEQ ID NO: 1169420 - RNA, 22 nt, Human
gauaagauucauuuaaaauucu

SEQ ID NO: 1169421 - RNA, 25 nt, Human
gaucaccugcagucaggaguuccga

SEQ ID NO: 1169422 - RNA, 24 nt, Human
gccaacauggugaaacccuaucuc

SEQ ID NO: 1169423 - RNA, 19 nt, Human
ggaaagaaaauacacaaga

SEQ ID NO: 1169424 - RNA, 19 nt, Human
ggagcccaaggaggacgga

SEQ ID NO: 1169425 - RNA, 23 nt, Human
ggaucaccugcagucaggaguuc

SEQ ID NO: 1169426 - RNA, 21 nt, Human
ggcucacaccuauaaucccag

SEQ ID NO: 1169427 - RNA, 24 nt, Human
gggaaaaaagucaccuaaaaacau

SEQ ID NO: 1169428 - RNA, 21 nt, Human
gggaaagaaaauacacaagac

SEQ ID NO: 1169429 - RNA, 24 nt, Human
gggggcucacaccuauaaucccag

SEQ ID NO: 1169430 - RNA, 24 nt, Human
gguggcacgcaccuguaguaccag

SEQ ID NO: 1169431 - RNA, 24 nt, Human
guacaaaacaggaaugaaaacaua

SEQ ID NO: 1169432 - RNA, 25 nt, Human
uaaaaaacaaaacaaaacaaaacaa

SEQ ID NO: 1169433 - RNA, 26 nt, Human
uaaaaaacaaaacaaaacaaaacaaa

SEQ ID NO: 1169434 - RNA, 19 nt, Human
uaaaaauaaaacaaaaagg

SEQ ID NO: 1169435 - RNA, 22 nt, Human
uaaaacaaaaaggucuucuuuc

SEQ ID NO: 1169436 - RNA, 23 nt, Human
uaaaacccggaugcuacccaagc

SEQ ID NO: 1169437 - RNA, 25 nt, Human
uaaaauaacuaaaauaagccaggug

SEQ ID NO: 1169438 - RNA, 19 nt, Human
uaacaggcugaaaagaaaa

SEQ ID NO: 1169439 - RNA, 20 nt, Human
uaagagggggaaaaaaguug

SEQ ID NO: 1169440 - RNA, 21 nt, Human
uaagccaggugugguggcacg

SEQ ID NO: 1169441 - RNA, 20 nt, Human
uacaaaacaggaaugaaaac

SEQ ID NO: 1169442 - RNA, 22 nt, Human
uacacaaacgucacauuggcau

SEQ ID NO: 1169443 - RNA, 23 nt, Human
uacagaaaugacguaucuuggau

SEQ ID NO: 1169444 - RNA, 23 nt, Human
uacaucuggaauugagauggccc

SEQ ID NO: 1169445 - RNA, 20 nt, Human
uaccugccaguaaaauggag

SEQ ID NO: 1169446 - RNA, 23 nt, Human
uacuaauaaugaacaacugcaca

SEQ ID NO: 1169447 - RNA, 21 nt, Human
uagaaggcaacaaaugaccac

SEQ ID NO: 1169448 - RNA, 22 nt, Human
uagaaggcaacaaaugaccaca

SEQ ID NO: 1169449 - RNA, 22 nt, Human
uagcuucuacaauaguuauucc

SEQ ID NO: 1169450 - RNA, 23 nt, Human
uagcuucuacaauaguuauuccu

SEQ ID NO: 1169451 - RNA, 23 nt, Human
uauaaauaguaaaaauaaaacaa

SEQ ID NO: 1169452 - RNA, 22 nt, Human
uccacaauaauagcaguuacau

SEQ ID NO: 1169453 - RNA, 20 nt, Human
ucccuaugaaaauacuuauc

SEQ ID NO: 1169454 - RNA, 20 nt, Human
ucgcaaacgcaauacaaugu

SEQ ID NO: 1169455 - RNA, 18 nt, Human
ucgcuugaaccugggagg

SEQ ID NO: 1169456 - RNA, 23 nt, Human
ucuacaauaguuauuccuagacc

SEQ ID NO: 1169457 - RNA, 27 nt, Human
ucuacaauaguuauuccuagaccuuaa

SEQ ID NO: 1169458 - RNA, 21 nt, Human
ugaaaacaacacgauaaagua

SEQ ID NO: 1169459 - RNA, 19 nt, Human
ugaaaacauacauauacug

SEQ ID NO: 1169460 - RNA, 19 nt, Human
ugaagaagggcagcaauac

SEQ ID NO: 1169461 - RNA, 19 nt, Human
ugagauggcccaucuucau

SEQ ID NO: 1169462 - RNA, 20 nt, Human
ugaggcaggagaaucgcuug

SEQ ID NO: 1169463 - RNA, 24 nt, Human
ugaggcaggagaaucgcuugaacc

SEQ ID NO: 1169464 - RNA, 25 nt, Human
ugaggcaggagaaucgcuugaaccu

SEQ ID NO: 1169465 - RNA, 21 nt, Human
ugcacacuucauacuaugacc

SEQ ID NO: 1169466 - RNA, 22 nt, Human
ugcagucaggaguuccgagacc

SEQ ID NO: 1169467 - RNA, 20 nt, Human
ugccaaagauauugucaggg

SEQ ID NO: 1169468 - RNA, 22 nt, Human
ugcguugauagaaaauugacac

SEQ ID NO: 1169469 - RNA, 24 nt, Human
uggaaaaugcuuucccuaugaaaa

SEQ ID NO: 1169470 - RNA, 21 nt, Human
uggaauugagauggcccaucu

SEQ ID NO: 1169471 - RNA, 24 nt, Human
uggccaacauggugaaacccuauc

SEQ ID NO: 1169472 - RNA, 22 nt, Human
uggcuauuuuuaaaaauggcac

SEQ ID NO: 1169473 - RNA, 19 nt, Human
ugggaggcugaggcaggag

SEQ ID NO: 1169474 - RNA, 23 nt, Human
ugggaggcugaggcaggagaauc

SEQ ID NO: 1169475 - RNA, 19 nt, Human
uggucuggguacccuaagg

SEQ ID NO: 1169476 - RNA, 18 nt, Human
ugugguggcacgcaccug

SEQ ID NO: 1169477 - RNA, 20 nt, Human
uguuuguuuuguuuuaaaaa

SEQ ID NO: 1169478 - RNA, 21 nt, Human
uuaaaaaucaaacauaauuua

SEQ ID NO: 1169479 - RNA, 23 nt, Human
uuaaauacuaaaacccggaugcu

SEQ ID NO: 1169480 - RNA, 19 nt, Human
uuccgagaccagccuggcc

SEQ ID NO: 1169481 - RNA, 19 nt, Human
uugaaaaacuaggggagaa

SEQ ID NO: 1169482 - RNA, 27 nt, Human
uugaaauaaaaauuacuuuuuguuuac

SEQ ID NO: 1169483 - RNA, 24 nt, Human
uugggaggcugaggcaggagaauc

SEQ ID NO: 1169484 - RNA, 27 nt, Human
uuuuaaaaagucaucaauucaaccuaa

SEQ ID NO: 1169485 - RNA, 26 nt, Human
aagacaguuaugacauggacacaugc

SEQ ID NO: 1169486 - RNA, 25 nt, Human
aagcucccagccugggugccaaucu

SEQ ID NO: 1169487 - RNA, 21 nt, Human
agagcugugcccaguuuuauc

SEQ ID NO: 1169488 - RNA, 22 nt, Human
cacaugcaugagcuauuauaca

SEQ ID NO: 1169489 - RNA, 21 nt, Human
cacuggguuccuggcaagcuc

SEQ ID NO: 1169490 - RNA, 20 nt, Human
cagcaaaucucaauuuguca

SEQ ID NO: 1169491 - RNA, 25 nt, Human
ccacuggguuccuggcaagcuccca

SEQ ID NO: 1169492 - RNA, 19 nt, Human
cccggagugcagaagcgua

SEQ ID NO: 1169493 - RNA, 26 nt, Human
cucacaagaaugaagcaagggacaaa

SEQ ID NO: 1169494 - RNA, 22 nt, Human
cucccuggccacuggguuccug

SEQ ID NO: 1169495 - RNA, 23 nt, Human
cucccuggccacuggguuccugg

SEQ ID NO: 1169496 - RNA, 22 nt, Human
gauucaugacagauucuucccc

SEQ ID NO: 1169497 - RNA, 18 nt, Human
ggguuccuggcaagcucc

SEQ ID NO: 1169498 - RNA, 21 nt, Human
uaugacauggacacaugcaug

SEQ ID NO: 1169499 - RNA, 21 nt, Human
uccuggcaagcucccagccug

SEQ ID NO: 1169500 - RNA, 26 nt, Human
ucucacaagaaugaagcaagggacaa

SEQ ID NO: 1169501 - RNA, 26 nt, Human
uggacacaugcaugagcuauuauaca

SEQ ID NO: 1169502 - RNA, 25 nt, Human
uggguuccuggcaagcucccagccu

SEQ ID NO: 1169503 - RNA, 21 nt, Human
agccuuguucccccucuccac

SEQ ID NO: 1169504 - RNA, 18 nt, Human
aggauccccuucaacucc

SEQ ID NO: 1169505 - RNA, 20 nt, Human
caacuccugaggcugcuccu

SEQ ID NO: 1169506 - RNA, 25 nt, Human
cccacaguaauugcgcauuucucuc

SEQ ID NO: 1169507 - RNA, 23 nt, Human
cuccugaggcugcuccucugggc

SEQ ID NO: 1169508 - RNA, 26 nt, Human
cuucccaagucucugccucuguuucc

SEQ ID NO: 1169509 - RNA, 21 nt, Human
gccugccgacagccccuuugc

SEQ ID NO: 1169510 - RNA, 19 nt, Human
uccccuucaacuccugagg

SEQ ID NO: 1169511 - RNA, 24 nt, Human
ucugccucuguuuccccaugaccc

SEQ ID NO: 1169512 - RNA, 22 nt, Human
uuuuuaguuuuaacaaaugauu

SEQ ID NO: 1169513 - RNA, 23 nt, Human
aaacaaagaccaacaaccaacag

SEQ ID NO: 1169514 - RNA, 27 nt, Human
aaacaaagaccaacaaccaacagaaaa

SEQ ID NO: 1169515 - RNA, 21 nt, Human
aaacaaucccaucaaauacaa

SEQ ID NO: 1169516 - RNA, 18 nt, Human
aaacaguaacaaaaucag

SEQ ID NO: 1169517 - RNA, 24 nt, Human
aaaguccugggauuacagguguga

SEQ ID NO: 1169518 - RNA, 28 nt, Human
aacaaagaccaacaaccaacagaaaaag

SEQ ID NO: 1169519 - RNA, 21 nt, Human
aacagaaaaauaggcaaagaa

SEQ ID NO: 1169520 - RNA, 19 nt, Human
aaccaacagaaaaauaggc

SEQ ID NO: 1169521 - RNA, 23 nt, Human
aauacacuacauucuuacaaaau

SEQ ID NO: 1169522 - RNA, 25 nt, Human
aaugacaaugacaaacuggaaagaa

SEQ ID NO: 1169523 - RNA, 28 nt, Human
acaaaacaaagaccaacaaccaacagaa

SEQ ID NO: 1169524 - RNA, 18 nt, Human
acaggguuucaccauguu

SEQ ID NO: 1169525 - RNA, 23 nt, Human
acaggguuucaccauguuggcca

SEQ ID NO: 1169526 - RNA, 24 nt, Human
acaggguuucaccauguuggccag

SEQ ID NO: 1169527 - RNA, 21 nt, Human
acaguggcgcaaucucagcuc

SEQ ID NO: 1169528 - RNA, 22 nt, Human
acauccauggaauucacucaga

SEQ ID NO: 1169529 - RNA, 24 nt, Human
acauccauggaauucacucagaau

SEQ ID NO: 1169530 - RNA, 22 nt, Human
accaucaaaugcucacauacaa

SEQ ID NO: 1169531 - RNA, 24 nt, Human
accuguaauacaaaacaaagacca

SEQ ID NO: 1169532 - RNA, 24 nt, Human
acucuguugccaggcuggaguaca

SEQ ID NO: 1169533 - RNA, 20 nt, Human
agaaaaauaggcaaagaaua

SEQ ID NO: 1169534 - RNA, 25 nt, Human
agaaauuguacaaaggccuaaauaa

SEQ ID NO: 1169535 - RNA, 23 nt, Human
agagggaaaggacagagacuuca

SEQ ID NO: 1169536 - RNA, 24 nt, Human
aggaaaaagaagcaacaugcagaa

SEQ ID NO: 1169537 - RNA, 21 nt, Human
aggcaaagaauagaaauagga

SEQ ID NO: 1169538 - RNA, 22 nt, Human
aggcauucacauuacauccaug

SEQ ID NO: 1169539 - RNA, 23 nt, Human
aggugugagccacugugcccggc

SEQ ID NO: 1169540 - RNA, 21 nt, Human
aguacaguggcgcaaucucag

SEQ ID NO: 1169541 - RNA, 20 nt, Human
aguggcgcaaucucagcuca

SEQ ID NO: 1169542 - RNA, 21 nt, Human
auaucaaaaaauaccagaaca

SEQ ID NO: 1169543 - RNA, 20 nt, Human
aucagguacauccaggguuu

SEQ ID NO: 1169544 - RNA, 24 nt, Human
auuuuuguauuuuuaguagagaca

SEQ ID NO: 1169545 - RNA, 21 nt, Human
caaaacaaagaccaacaacca

SEQ ID NO: 1169546 - RNA, 22 nt, Human
caaaggccuaaauaauaaccau

SEQ ID NO: 1169547 - RNA, 24 nt, Human
caaaguccugggauuacaggugug

SEQ ID NO: 1169548 - RNA, 20 nt, Human
caagcgauccuccugccuca

SEQ ID NO: 1169549 - RNA, 22 nt, Human
caagcgauccuccugccucagc

SEQ ID NO: 1169550 - RNA, 23 nt, Human
caaguaacucaucgagcaccauc

SEQ ID NO: 1169551 - RNA, 22 nt, Human
caccaccgcgcccagcuaauuu

SEQ ID NO: 1169552 - RNA, 21 nt, Human
caccaucaaaugcucacauac

SEQ ID NO: 1169553 - RNA, 18 nt, Human
caccauguuggccaggau

SEQ ID NO: 1169554 - RNA, 22 nt, Human
caccauguuggccaggaugguc

SEQ ID NO: 1169555 - RNA, 24 nt, Human
caccauguuggccaggauggucuc

SEQ ID NO: 1169556 - RNA, 24 nt, Human
caccgcgcccagcuaauuuuugua

SEQ ID NO: 1169557 - RNA, 18 nt, Human
caccuguaauacaaaaca

SEQ ID NO: 1169558 - RNA, 18 nt, Human
cacucuguugccaggcug

SEQ ID NO: 1169559 - RNA, 21 nt, Human
cacugcaacugcugccucccg

SEQ ID NO: 1169560 - RNA, 23 nt, Human
cacugcaacugcugccucccggg

SEQ ID NO: 1169561 - RNA, 23 nt, Human
caggaucucuuacaaaaagcuaa

SEQ ID NO: 1169562 - RNA, 24 nt, Human
caggguuucaccauguuggccagg

SEQ ID NO: 1169563 - RNA, 27 nt, Human
cauccaaacaaucccaucaaauacaag

SEQ ID NO: 1169564 - RNA, 22 nt, Human
caugcagaacaaugugugcagu

SEQ ID NO: 1169565 - RNA, 21 nt, Human
ccaaaguccugggauuacagg

SEQ ID NO: 1169566 - RNA, 24 nt, Human
ccaaaguccugggauuacaggugu

SEQ ID NO: 1169567 - RNA, 24 nt, Human
ccacuaaauuguuagaaauuguac

SEQ ID NO: 1169568 - RNA, 20 nt, Human
cccggguucaagcgauccuc

SEQ ID NO: 1169569 - RNA, 23 nt, Human
cccggguucaagcgauccuccug

SEQ ID NO: 1169570 - RNA, 24 nt, Human
ccucccggguucaagcgauccucc

SEQ ID NO: 1169571 - RNA, 23 nt, Human
ccuccugccucagccucugagua

SEQ ID NO: 1169572 - RNA, 23 nt, Human
ccugccucagccucugaguagcu

SEQ ID NO: 1169573 - RNA, 21 nt, Human
ccuugugaucugcuuuccuca

SEQ ID NO: 1169574 - RNA, 22 nt, Human
ccuugugaucugcuuuccucag

SEQ ID NO: 1169575 - RNA, 18 nt, Human
cucacucuguugccaggc

SEQ ID NO: 1169576 - RNA, 23 nt, Human
cucacucuguugccaggcuggag

SEQ ID NO: 1169577 - RNA, 23 nt, Human
cucacugcaacugcugccucccg

SEQ ID NO: 1169578 - RNA, 24 nt, Human
cucacugcaacugcugccucccgg

SEQ ID NO: 1169579 - RNA, 21 nt, Human
cucagccucccaaaguccugg

SEQ ID NO: 1169580 - RNA, 23 nt, Human
cuccaaauacucccauuaaauac

SEQ ID NO: 1169581 - RNA, 23 nt, Human
cugcaacugcugccucccggguu

SEQ ID NO: 1169582 - RNA, 21 nt, Human
cuucuuggagggggaacugga

SEQ ID NO: 1169583 - RNA, 20 nt, Human
gaaaaaaaaaaggaaaaaga

SEQ ID NO: 1169584 - RNA, 23 nt, Human
gaauagaaauaggaaaggccaug

SEQ ID NO: 1169585 - RNA, 24 nt, Human
gaccuugugaucugcuuuccucag

SEQ ID NO: 1169586 - RNA, 23 nt, Human
gauggcagggaagagggaaagga

SEQ ID NO: 1169587 - RNA, 18 nt, Human
gauuacaggugugagcca

SEQ ID NO: 1169588 - RNA, 21 nt, Human
gauuacaggugugagccacug

SEQ ID NO: 1169589 - RNA, 24 nt, Human
gauuacaggugugagccacugugc

SEQ ID NO: 1169590 - RNA, 22 nt, Human
gcccagcuaauuuuuguauuuu

SEQ ID NO: 1169591 - RNA, 19 nt, Human
gcuggaguacaguggcgca

SEQ ID NO: 1169592 - RNA, 19 nt, Human
gggaacuggauggcaggga

SEQ ID NO: 1169593 - RNA, 22 nt, Human
ggguuucaccauguuggccagg

SEQ ID NO: 1169594 - RNA, 24 nt, Human
gguuucaccauguuggccaggaug

SEQ ID NO: 1169595 - RNA, 24 nt, Human
gucucacucuguugccaggcugga

SEQ ID NO: 1169596 - RNA, 24 nt, Human
gugaucugcuuuccucagccuccc

SEQ ID NO: 1169597 - RNA, 20 nt, Human
uaaaacaguaacaaaaucag

SEQ ID NO: 1169598 - RNA, 23 nt, Human
uaaagcagauuccaguggcuguu

SEQ ID NO: 1169599 - RNA, 22 nt, Human
uaaauacauccaaacaauccca

SEQ ID NO: 1169600 - RNA, 23 nt, Human
uaagaagacaugcauugauggug

SEQ ID NO: 1169601 - RNA, 24 nt, Human
uaauuuuuguauuuuuaguagaga

SEQ ID NO: 1169602 - RNA, 19 nt, Human
uacaaaacaaagaccaaca

SEQ ID NO: 1169603 - RNA, 21 nt, Human
uacaaaacaaagaccaacaac

SEQ ID NO: 1169604 - RNA, 23 nt, Human
uacaggugugagccacugugccc

SEQ ID NO: 1169605 - RNA, 23 nt, Human
uacaggugugagccacugugccc

SEQ ID NO: 1169606 - RNA, 19 nt, Human
uacauccaaacaaucccau

SEQ ID NO: 1169607 - RNA, 22 nt, Human
uacauccaaacaaucccaucaa

SEQ ID NO: 1169608 - RNA, 18 nt, Human
uaccagaacaaagucaaa

SEQ ID NO: 1169609 - RNA, 22 nt, Human
uagagacaggguuucaccaugu

SEQ ID NO: 1169610 - RNA, 24 nt, Human
uaguagagacaggguuucaccaug

SEQ ID NO: 1169611 - RNA, 26 nt, Human
uaguagagacaggguuucaccauguu

SEQ ID NO: 1169612 - RNA, 22 nt, Human
uagucuugacucaguaauuuca

SEQ ID NO: 1169613 - RNA, 19 nt, Human
ucaaaugcucacauacaac

SEQ ID NO: 1169614 - RNA, 19 nt, Human
ucaaucucuugaccuugug

SEQ ID NO: 1169615 - RNA, 20 nt, Human
ucaaucucuugaccuuguga

SEQ ID NO: 1169616 - RNA, 23 nt, Human
ucacauuacauccauggaauuca

SEQ ID NO: 1169617 - RNA, 24 nt, Human
ucaccauguuggccaggauggucu

SEQ ID NO: 1169618 - RNA, 24 nt, Human
ucacugcaacugcugccucccggg

SEQ ID NO: 1169619 - RNA, 18 nt, Human
ucagccucccaaaguccu

SEQ ID NO: 1169620 - RNA, 23 nt, Human
ucccaaaguccugggauuacagg

SEQ ID NO: 1169621 - RNA, 21 nt, Human
ucccggguucaagcgauccuc

SEQ ID NO: 1169622 - RNA, 24 nt, Human
ucccggguucaagcgauccuccug

SEQ ID NO: 1169623 - RNA, 27 nt, Human
ucuaaagcacaccuguaauacaaaaca

SEQ ID NO: 1169624 - RNA, 21 nt, Human
ucucacucuguugccaggcug

SEQ ID NO: 1169625 - RNA, 23 nt, Human
ucucacucuguugccaggcugga

SEQ ID NO: 1169626 - RNA, 23 nt, Human
ucugaguagcugagacuauaggu

SEQ ID NO: 1169627 - RNA, 24 nt, Human
ucugaguagcugagacuauaggug

SEQ ID NO: 1169628 - RNA, 18 nt, Human
ucuguugccaggcuggag

SEQ ID NO: 1169629 - RNA, 19 nt, Human
ugaaaaaaaaaaggaaaaa

SEQ ID NO: 1169630 - RNA, 21 nt, Human
ugaaaaaaaaaaggaaaaaga

SEQ ID NO: 1169631 - RNA, 25 nt, Human
ugacaaugacaaacuggaaagaaga

SEQ ID NO: 1169632 - RNA, 21 nt, Human
ugagacuauaggugugcacca

SEQ ID NO: 1169633 - RNA, 24 nt, Human
ugagacuauaggugugcaccaccg

SEQ ID NO: 1169634 - RNA, 26 nt, Human
ugauacauauuauuacaauauuuuau

SEQ ID NO: 1169635 - RNA, 22 nt, Human
ugcaacugcugccucccggguu

SEQ ID NO: 1169636 - RNA, 20 nt, Human
ugccaggcuggaguacagug

SEQ ID NO: 1169637 - RNA, 23 nt, Human
ugccaggcuggaguacaguggcg

SEQ ID NO: 1169638 - RNA, 20 nt, Human
ugccucagccucugaguagc

SEQ ID NO: 1169639 - RNA, 23 nt, Human
ugccucagccucugaguagcuga

SEQ ID NO: 1169640 - RNA, 24 nt, Human
ugccucccggguucaagcgauccu

SEQ ID NO: 1169641 - RNA, 19 nt, Human
ugcuucaauucuuuugaua

SEQ ID NO: 1169642 - RNA, 18 nt, Human
uggaaagaagauauuugc

SEQ ID NO: 1169643 - RNA, 19 nt, Human
uggaguacaguggcgcaau

SEQ ID NO: 1169644 - RNA, 18 nt, Human
uggcagggaagagggaaa

SEQ ID NO: 1169645 - RNA, 24 nt, Human
uggccaggauggucucaaucucuu

SEQ ID NO: 1169646 - RNA, 24 nt, Human
uggcgcaaucucagcucacugcaa

SEQ ID NO: 1169647 - RNA, 18 nt, Human
ugggauuacaggugugag

SEQ ID NO: 1169648 - RNA, 21 nt, Human
ugggauuacaggugugagcca

SEQ ID NO: 1169649 - RNA, 22 nt, Human
ugggauuacaggugugagccac

SEQ ID NO: 1169650 - RNA, 22 nt, Human
ugggauuacaggugugagccac

SEQ ID NO: 1169651 - RNA, 22 nt, Human
ugggauuacaggugugagccac

SEQ ID NO: 1169652 - RNA, 24 nt, Human
ugggauuacaggugugagccacug

SEQ ID NO: 1169653 - RNA, 24 nt, Human
uguaauacaaaacaaagaccaaca

SEQ ID NO: 1169654 - RNA, 20 nt, Human
ugugcaccaccgcgcccagc

SEQ ID NO: 1169655 - RNA, 20 nt, Human
ugugugcaguauguuaccgu

SEQ ID NO: 1169656 - RNA, 22 nt, Human
uuacaaaaagcuaauaucuaaa

SEQ ID NO: 1169657 - RNA, 22 nt, Human
uuacaaaauaaugaaaaauugg

SEQ ID NO: 1169658 - RNA, 24 nt, Human
uuaguagagacaggguuucaccau

SEQ ID NO: 1169659 - RNA, 21 nt, Human
uucaagcgauccuccugccuc

SEQ ID NO: 1169660 - RNA, 24 nt, Human
uucaagcgauccuccugccucagc

SEQ ID NO: 1169661 - RNA, 24 nt, Human
uuccucagccucccaaaguccugg

SEQ ID NO: 1169662 - RNA, 20 nt, Human
uuguguagggggaaaggaau

SEQ ID NO: 1169663 - RNA, 20 nt, Human
uuuauaaucauuggcauuuu

SEQ ID NO: 1169664 - RNA, 19 nt, Human
uuucaccauguuggccagg

SEQ ID NO: 1169665 - RNA, 20 nt, Human
uuucaccauguuggccagga

SEQ ID NO: 1169666 - RNA, 23 nt, Human
uuuuacccuguauauauauuacc

SEQ ID NO: 1169667 - RNA, 24 nt, Human
uuuuuaguagagacaggguuucac

SEQ ID NO: 1169668 - RNA, 20 nt, Human
uuuuuguauuuuuaguagag

SEQ ID NO: 1169669 - RNA, 20 nt, Human
aaaaagaagaugacugaaaa

SEQ ID NO: 1169670 - RNA, 19 nt, Human
aagcaguaaacaucccaga

SEQ ID NO: 1169671 - RNA, 23 nt, Human
acuaaggucuuccuguuucuggg

SEQ ID NO: 1169672 - RNA, 22 nt, Human
cccagagauaguaacuuucuuc

SEQ ID NO: 1169673 - RNA, 21 nt, Human
uaaaaggagacauuagaagca

SEQ ID NO: 1169674 - RNA, 24 nt, Human
uaaaaggagacauuagaagcagua

SEQ ID NO: 1169675 - RNA, 23 nt, Human
uaaggucuuccuguuucuggggc

SEQ ID NO: 1169676 - RNA, 24 nt, Human
uaguaacuuucuucuucagaacuu

SEQ ID NO: 1169677 - RNA, 18 nt, Human
ugaaaaacaaucucugug

SEQ ID NO: 1169678 - RNA, 24 nt, Human
ugaaaaagaagaugacugaaaagg

SEQ ID NO: 1169679 - RNA, 23 nt, Human
uggcugaugaaaaagaagaugac

SEQ ID NO: 1169680 - RNA, 25 nt, Human
uucuuugcuuuauuauuuuucuggu

SEQ ID NO: 1169681 - RNA, 18 nt, Human
uugcauccuaacuaaggc

SEQ ID NO: 1169682 - RNA, 18 nt, Human
uuucugguacauucgucu

SEQ ID NO: 1169683 - RNA, 21 nt, Human
uuugcuuuauuauuuuucugg

SEQ ID NO: 1169684 - RNA, 18 nt, Human
aaaugacaucugagggca

SEQ ID NO: 1169685 - RNA, 19 nt, Human
aaccccauuguucucccac

SEQ ID NO: 1169686 - RNA, 25 nt, Human
acaaaaacucaaaagaccacagaca

SEQ ID NO: 1169687 - RNA, 22 nt, Human
accccauuguucucccacucaa

SEQ ID NO: 1169688 - RNA, 21 nt, Human
acucuagaaaccccauuguuc

SEQ ID NO: 1169689 - RNA, 25 nt, Human
auuacaauacaauuuauucuugauu

SEQ ID NO: 1169690 - RNA, 20 nt, Human
auucauccuuuuuuuuuuga

SEQ ID NO: 1169691 - RNA, 23 nt, Human
caaaagaccacagacaacaauca

SEQ ID NO: 1169692 - RNA, 21 nt, Human
cacaaaaacucaaaagaccac

SEQ ID NO: 1169693 - RNA, 22 nt, Human
cacugcacguauccacucaaaa

SEQ ID NO: 1169694 - RNA, 25 nt, Human
ccacaaaaacucaaaagaccacaga

SEQ ID NO: 1169695 - RNA, 20 nt, Human
ccacagacaacaaucaccau

SEQ ID NO: 1169696 - RNA, 23 nt, Human
ccacagacaacaaucaccaucua

SEQ ID NO: 1169697 - RNA, 21 nt, Human
ccaucuaaaauauaaaauggg

SEQ ID NO: 1169698 - RNA, 18 nt, Human
cccauuguucucccacuc

SEQ ID NO: 1169699 - RNA, 22 nt, Human
cuuccauguaaaacaauuucac

SEQ ID NO: 1169700 - RNA, 22 nt, Human
gagccacaaaaacucaaaagac

SEQ ID NO: 1169701 - RNA, 21 nt, Human
uacaugguaauuuguccauua

SEQ ID NO: 1169702 - RNA, 22 nt, Human
uagaaaccccauuguucuccca

SEQ ID NO: 1169703 - RNA, 18 nt, Human
uauaaaauggggaaauga

SEQ ID NO: 1169704 - RNA, 23 nt, Human
uaucaagucacauauggccaaua

SEQ ID NO: 1169705 - RNA, 21 nt, Human
ucaagcaaugagccacaaaaa

SEQ ID NO: 1169706 - RNA, 23 nt, Human
ucaagcaaugagccacaaaaacu

SEQ ID NO: 1169707 - RNA, 19 nt, Human
ucacugcacguauccacuc

SEQ ID NO: 1169708 - RNA, 18 nt, Human
ucuagacauguaucacua

SEQ ID NO: 1169709 - RNA, 20 nt, Human
ucuccugcagauauagaaau

SEQ ID NO: 1169710 - RNA, 22 nt, Human
ugagaaauucauccuuuuuuuu

SEQ ID NO: 1169711 - RNA, 18 nt, Human
uggggaaaugacaucuga

SEQ ID NO: 1169712 - RNA, 20 nt, Human
uggggaaaugacaucugagg

SEQ ID NO: 1169713 - RNA, 19 nt, Human
uucuugauuccaaauucau

SEQ ID NO: 1169714 - RNA, 22 nt, Human
aaagugcugggauuacaggcau

SEQ ID NO: 1169715 - RNA, 23 nt, Human
aaagugcugggauuacaggcaug

SEQ ID NO: 1169716 - RNA, 24 nt, Human
aaagugcugggauuacaggcauga

SEQ ID NO: 1169717 - RNA, 25 nt, Human
aaccaaacugcaaagaaccaaacug

SEQ ID NO: 1169718 - RNA, 22 nt, Human
aaccucgugauccgaccaccuc

SEQ ID NO: 1169719 - RNA, 25 nt, Human
aagcaggaaaggaaaggaaccccag

SEQ ID NO: 1169720 - RNA, 19 nt, Human
aagugcugggauuacaggc

SEQ ID NO: 1169721 - RNA, 21 nt, Human
aagugcugggauuacaggcau

SEQ ID NO: 1169722 - RNA, 26 nt, Human
aagugcugggauuacaggcaugagcc

SEQ ID NO: 1169723 - RNA, 19 nt, Human
acaggcaccugccaccacg

SEQ ID NO: 1169724 - RNA, 20 nt, Human
acugcaagcucugccuccca

SEQ ID NO: 1169725 - RNA, 18 nt, Human
agccuccagaguagcugg

SEQ ID NO: 1169726 - RNA, 21 nt, Human
aggcaugagccaccgugcccg

SEQ ID NO: 1169727 - RNA, 23 nt, Human
aggcaugagccaccgugcccggc

SEQ ID NO: 1169728 - RNA, 20 nt, Human
aggugaaggcagauuuucaa

SEQ ID NO: 1169729 - RNA, 18 nt, Human
aguagcugggacuacagg

SEQ ID NO: 1169730 - RNA, 19 nt, Human
aguagcugggacuacaggc

SEQ ID NO: 1169731 - RNA, 18 nt, Human
agugcugggauuacaggc

SEQ ID NO: 1169732 - RNA, 19 nt, Human
agugcugggauuacaggca

SEQ ID NO: 1169733 - RNA, 20 nt, Human
agugugguggcgcgaucucg

SEQ ID NO: 1169734 - RNA, 24 nt, Human
agugugguggcgcgaucucggcuc

SEQ ID NO: 1169735 - RNA, 20 nt, Human
augggguuucacuguguuag

SEQ ID NO: 1169736 - RNA, 24 nt, Human
augggguuucacuguguuagccag

SEQ ID NO: 1169737 - RNA, 19 nt, Human
caaagaaccaaacugcaaa

SEQ ID NO: 1169738 - RNA, 23 nt, Human
caacugaacuucaggaauggcuc

SEQ ID NO: 1169739 - RNA, 18 nt, Human
cacuguguuagccaggau

SEQ ID NO: 1169740 - RNA, 19 nt, Human
cacuguguuagccaggaug

SEQ ID NO: 1169741 - RNA, 24 nt, Human
cacuguguuagccaggauggucuc

SEQ ID NO: 1169742 - RNA, 25 nt, Human
cagaaccaaacugcaaagaaccaaa

SEQ ID NO: 1169743 - RNA, 24 nt, Human
cagaguagcugggacuacaggcac

SEQ ID NO: 1169744 - RNA, 24 nt, Human
caggaaaggaaaggaaccccagac

SEQ ID NO: 1169745 - RNA, 21 nt, Human
caggcaccugccaccacgccc

SEQ ID NO: 1169746 - RNA, 24 nt, Human
ccagaguagcugggacuacaggca

SEQ ID NO: 1169747 - RNA, 20 nt, Human
ccaugcagagacaccccagu

SEQ ID NO: 1169748 - RNA, 20 nt, Human
cccagguucacaccauccuc

SEQ ID NO: 1169749 - RNA, 19 nt, Human
ccccaugcagagacacccc

SEQ ID NO: 1169750 - RNA, 23 nt, Human
ccgaaagugcugggauuacaggc

SEQ ID NO: 1169751 - RNA, 20 nt, Human
ccuauagagauuuauuaggg

SEQ ID NO: 1169752 - RNA, 24 nt, Human
ccuccugccucagccuccagagua

SEQ ID NO: 1169753 - RNA, 24 nt, Human
cgaaagugcugggauuacaggcau

SEQ ID NO: 1169754 - RNA, 24 nt, Human
cgcucaggcuggagugugguggcg

SEQ ID NO: 1169755 - RNA, 24 nt, Human
cgugauccgaccaccucggccucc

SEQ ID NO: 1169756 - RNA, 23 nt, Human
cucaaauaguuuaagccuauaga

SEQ ID NO: 1169757 - RNA, 24 nt, Human
cucagaaccaaacugcaaagaacc

SEQ ID NO: 1169758 - RNA, 24 nt, Human
cucagccuccagaguagcugggac

SEQ ID NO: 1169759 - RNA, 18 nt, Human
cuccuaaccucgugaucc

SEQ ID NO: 1169760 - RNA, 21 nt, Human
cucggccuccgaaagugcugg

SEQ ID NO: 1169761 - RNA, 24 nt, Human
cugcaagcucugccucccagguuc

SEQ ID NO: 1169762 - RNA, 23 nt, Human
cugccucagccuccagaguagcu

SEQ ID NO: 1169763 - RNA, 18 nt, Human
cugucgcucaggcuggag

SEQ ID NO: 1169764 - RNA, 19 nt, Human
gagacaccccagugagggc

SEQ ID NO: 1169765 - RNA, 18 nt, Human
gagaugggguuucacugu

SEQ ID NO: 1169766 - RNA, 25 nt, Human
gaguagcugggacuacaggcaccug

SEQ ID NO: 1169767 - RNA, 18 nt, Human
gauuacaggcaugagcca

SEQ ID NO: 1169768 - RNA, 21 nt, Human
gauuacaggcaugagccaccg

SEQ ID NO: 1169769 - RNA, 24 nt, Human
gauuacaggcaugagccaccgugc

SEQ ID NO: 1169770 - RNA, 20 nt, Human
gcucaggcuggaguguggug

SEQ ID NO: 1169771 - RNA, 19 nt, Human
ggaaaggaaaggaacccca

SEQ ID NO: 1169772 - RNA, 24 nt, Human
ggauuacaggcaugagccaccgug

SEQ ID NO: 1169773 - RNA, 21 nt, Human
gggguuaaagauaacuuaaaa

SEQ ID NO: 1169774 - RNA, 22 nt, Human
gggguuucacuguguuagccag

SEQ ID NO: 1169775 - RNA, 22 nt, Human
ggguuucacuguguuagccagg

SEQ ID NO: 1169776 - RNA, 24 nt, Human
gucuugcucugucgcucaggcugg

SEQ ID NO: 1169777 - RNA, 19 nt, Human
gugcugggauuacaggcau

SEQ ID NO: 1169778 - RNA, 23 nt, Human
uacaggcaccugccaccacgccc

SEQ ID NO: 1169779 - RNA, 23 nt, Human
uacaggcaugagccaccgugccc

SEQ ID NO: 1169780 - RNA, 25 nt, Human
uagacauaaaauugaaugugauauc

SEQ ID NO: 1169781 - RNA, 24 nt, Human
uauuagagaugggguuucacugug

SEQ ID NO: 1169782 - RNA, 21 nt, Human
ucacaccauccuccugccuca

SEQ ID NO: 1169783 - RNA, 18 nt, Human
ucacugcaagcucugccu

SEQ ID NO: 1169784 - RNA, 18 nt, Human
ucacugcaagcucugccu

SEQ ID NO: 1169785 - RNA, 19 nt, Human
ucacugcaagcucugccuc

SEQ ID NO: 1169786 - RNA, 24 nt, Human
ucacugcaagcucugccucccagg

SEQ ID NO: 1169787 - RNA, 24 nt, Human
ucacuguguuagccaggauggucu

SEQ ID NO: 1169788 - RNA, 24 nt, Human
uccagaguagcugggacuacaggc

SEQ ID NO: 1169789 - RNA, 19 nt, Human
ucccagguucacaccaucc

SEQ ID NO: 1169790 - RNA, 24 nt, Human
ucccagguucacaccauccuccug

SEQ ID NO: 1169791 - RNA, 24 nt, Human
uccgaaagugcugggauuacaggc

SEQ ID NO: 1169792 - RNA, 24 nt, Human
ucgcucaggcuggagugugguggc

SEQ ID NO: 1169793 - RNA, 24 nt, Human
ucugucgcucaggcuggagugugg

SEQ ID NO: 1169794 - RNA, 20 nt, Human
ucuugcucugucgcucaggc

SEQ ID NO: 1169795 - RNA, 23 nt, Human
ucuugcucugucgcucaggcugg

SEQ ID NO: 1169796 - RNA, 24 nt, Human
ucuugcucugucgcucaggcugga

SEQ ID NO: 1169797 - RNA, 22 nt, Human
ugagacggagucuugcucuguc

SEQ ID NO: 1169798 - RNA, 25 nt, Human
ugagggcccucauauugcccuugug

SEQ ID NO: 1169799 - RNA, 20 nt, Human
ugcaaagaaccaaacugcaa

SEQ ID NO: 1169800 - RNA, 24 nt, Human
ugccucagccuccagaguagcugg

SEQ ID NO: 1169801 - RNA, 24 nt, Human
ugccucccagguucacaccauccu

SEQ ID NO: 1169802 - RNA, 24 nt, Human
ugcucugucgcucaggcuggagug

SEQ ID NO: 1169803 - RNA, 22 nt, Human
uggaagcaggaaaggaaaggaa

SEQ ID NO: 1169804 - RNA, 24 nt, Human
uggagugugguggcgcgaucucgg

SEQ ID NO: 1169805 - RNA, 21 nt, Human
ugggacuacaggcaccugcca

SEQ ID NO: 1169806 - RNA, 22 nt, Human
ugggacuacaggcaccugccac

SEQ ID NO: 1169807 - RNA, 24 nt, Human
ugggacuacaggcaccugccacca

SEQ ID NO: 1169808 - RNA, 18 nt, Human
ugggauuacaggcaugag

SEQ ID NO: 1169809 - RNA, 21 nt, Human
ugggauuacaggcaugagcca

SEQ ID NO: 1169810 - RNA, 22 nt, Human
ugggauuacaggcaugagccac

SEQ ID NO: 1169811 - RNA, 23 nt, Human
ugggauuacaggcaugagccacc

SEQ ID NO: 1169812 - RNA, 23 nt, Human
ugggauuacaggcaugagccacc

SEQ ID NO: 1169813 - RNA, 24 nt, Human
ugggauuacaggcaugagccaccg

SEQ ID NO: 1169814 - RNA, 24 nt, Human
ugggguuucacuguguuagccagg

SEQ ID NO: 1169815 - RNA, 25 nt, Human
ugugguggcgcgaucucggcucaac

SEQ ID NO: 1169816 - RNA, 24 nt, Human
uuauuagagaugggguuucacugu

SEQ ID NO: 1169817 - RNA, 21 nt, Human
uucacuguguuagccaggaug

SEQ ID NO: 1169818 - RNA, 23 nt, Human
uuccccaugcagagacaccccag

SEQ ID NO: 1169819 - RNA, 24 nt, Human
uugcucugucgcucaggcuggagu

SEQ ID NO: 1169820 - RNA, 19 nt, Human
uuuaagaacauuauuuuua

SEQ ID NO: 1169821 - RNA, 19 nt, Human
uuucacuguguuagccagg

SEQ ID NO: 1169822 - RNA, 24 nt, Human
uuuuuauuagagaugggguuucac

SEQ ID NO: 1169823 - RNA, 24 nt, Human
uuuuuuguauuuuuauuagagaug

SEQ ID NO: 1169824 - RNA, 21 nt, Human
aaauuuaauuuccaccuccac

SEQ ID NO: 1169825 - RNA, 25 nt, Human
aacugccugagaaugccugaccugg

SEQ ID NO: 1169826 - RNA, 21 nt, Human
acagggcugggggucuuccuc

SEQ ID NO: 1169827 - RNA, 21 nt, Human
accaaguuucuggguuuuagu

SEQ ID NO: 1169828 - RNA, 23 nt, Human
auuaaugccaacaccaaguuucu

SEQ ID NO: 1169829 - RNA, 19 nt, Human
cccugaaaugccaugguug

SEQ ID NO: 1169830 - RNA, 19 nt, Human
ccuggagcugaugcccuga

SEQ ID NO: 1169831 - RNA, 20 nt, Human
cugaccuggagcugaugccc

SEQ ID NO: 1169832 - RNA, 21 nt, Human
cugaccuggagcugaugcccu

SEQ ID NO: 1169833 - RNA, 22 nt, Human
cugaccuggagcugaugcccug

SEQ ID NO: 1169834 - RNA, 22 nt, Human
cugggggucuuccucauggcuc

SEQ ID NO: 1169835 - RNA, 25 nt, Human
cuuccucauggcucccuaaauuuaa

SEQ ID NO: 1169836 - RNA, 24 nt, Human
gugaaaaaaaaaaaaaaaaagucu

SEQ ID NO: 1169837 - RNA, 18 nt, Human
uaauuuccaccuccaccc

SEQ ID NO: 1169838 - RNA, 27 nt, Human
ucacugugugaaaaaaaaaaaaaaaaa

SEQ ID NO: 1169839 - RNA, 19 nt, Human
uccaccuccacccuguaaa

SEQ ID NO: 1169840 - RNA, 18 nt, Human
ucuuccucauggcucccu

SEQ ID NO: 1169841 - RNA, 22 nt, Human
uggagcugaugcccugaaaugc

SEQ ID NO: 1169842 - RNA, 22 nt, Human
aaaggcaagcaguuguuggccc

SEQ ID NO: 1169843 - RNA, 20 nt, Human
aaagugcuaggauuauagca

SEQ ID NO: 1169844 - RNA, 22 nt, Human
aaagugcuaggauuauagcagg

SEQ ID NO: 1169845 - RNA, 23 nt, Human
aaagugcuaggauuauagcaggg

SEQ ID NO: 1169846 - RNA, 23 nt, Human
aaguuacccugugacucguuggu

SEQ ID NO: 1169847 - RNA, 23 nt, Human
aaugugaaagcuuaugggaaaaa

SEQ ID NO: 1169848 - RNA, 19 nt, Human
acaccacugcaccagcccg

SEQ ID NO: 1169849 - RNA, 19 nt, Human
acugagccaagaugacacc

SEQ ID NO: 1169850 - RNA, 24 nt, Human
agagauacuccugacuuagccucc

SEQ ID NO: 1169851 - RNA, 18 nt, Human
agcugcgaucagaaaacg

SEQ ID NO: 1169852 - RNA, 24 nt, Human
aggaagucgaggcugcacugagcc

SEQ ID NO: 1169853 - RNA, 20 nt, Human
aggcugaagcgggaggaucg

SEQ ID NO: 1169854 - RNA, 23 nt, Human
aggcugaagcgggaggaucgcug

SEQ ID NO: 1169855 - RNA, 19 nt, Human
aggggcgggagaccugaag

SEQ ID NO: 1169856 - RNA, 20 nt, Human
agucuugcaguucauuuuuc

SEQ ID NO: 1169857 - RNA, 24 nt, Human
auuuuucucuccugcccucuucca

SEQ ID NO: 1169858 - RNA, 21 nt, Human
caaagugcuaggauuauagca

SEQ ID NO: 1169859 - RNA, 21 nt, Human
caccagcccguuuccccaugc

SEQ ID NO: 1169860 - RNA, 22 nt, Human
cagaaucaacgagcguucccac

SEQ ID NO: 1169861 - RNA, 18 nt, Human
caggauccgauugggaga

SEQ ID NO: 1169862 - RNA, 23 nt, Human
caggaucucacuuugugcuuagg

SEQ ID NO: 1169863 - RNA, 18 nt, Human
ccaaagugcuaggauuau

SEQ ID NO: 1169864 - RNA, 18 nt, Human
cccacagaguuccguccu

SEQ ID NO: 1169865 - RNA, 21 nt, Human
ccccacucuugacugaaaagu

SEQ ID NO: 1169866 - RNA, 19 nt, Human
ccugcccucuuccaaaucc

SEQ ID NO: 1169867 - RNA, 23 nt, Human
ccuguggucucggcuacucuaga

SEQ ID NO: 1169868 - RNA, 19 nt, Human
cgcuggaucccaggaaguc

SEQ ID NO: 1169869 - RNA, 23 nt, Human
cgggagaccugaagcugcgauca

SEQ ID NO: 1169870 - RNA, 24 nt, Human
cucuccugcccucuuccaaauccu

SEQ ID NO: 1169871 - RNA, 21 nt, Human
cuuuuuuuuuuuuuuuaaagg

SEQ ID NO: 1169872 - RNA, 26 nt, Human
gcuccugguagggucuguaagccucu

SEQ ID NO: 1169873 - RNA, 22 nt, Human
ggaaagacagagaaagcgucag

SEQ ID NO: 1169874 - RNA, 24 nt, Human
ggcugcacugagccaagaugacac

SEQ ID NO: 1169875 - RNA, 19 nt, Human
ggugaccuguggucucggc

SEQ ID NO: 1169876 - RNA, 21 nt, Human
guaggauccugugggcucugg

SEQ ID NO: 1169877 - RNA, 20 nt, Human
uaaagagauacuccugacuu

SEQ ID NO: 1169878 - RNA, 19 nt, Human
uacccugugacucguuggu

SEQ ID NO: 1169879 - RNA, 22 nt, Human
uagaggcaggaucucacuuugu

SEQ ID NO: 1169880 - RNA, 23 nt, Human
uagggucuguaagccucuuaggg

SEQ ID NO: 1169881 - RNA, 24 nt, Human
uaugaggaaggaguuuauagcccc

SEQ ID NO: 1169882 - RNA, 22 nt, Human
ucagaaaacgcugugccuuuua

SEQ ID NO: 1169883 - RNA, 23 nt, Human
ucccaaagugcuaggauuauagc

SEQ ID NO: 1169884 - RNA, 20 nt, Human
uccccaugcgaaggcgaagu

SEQ ID NO: 1169885 - RNA, 19 nt, Human
ucgcuggaucccaggaagu

SEQ ID NO: 1169886 - RNA, 19 nt, Human
ucuccugcccucuuccaaa

SEQ ID NO: 1169887 - RNA, 24 nt, Human
ucuccugcccucuuccaaauccua

SEQ ID NO: 1169888 - RNA, 18 nt, Human
ucugccagcaaucccacc

SEQ ID NO: 1169889 - RNA, 24 nt, Human
ucugccagcaaucccaccucuugu

SEQ ID NO: 1169890 - RNA, 25 nt, Human
ucuguaagccucuuagggggauuac

SEQ ID NO: 1169891 - RNA, 22 nt, Human
ugaaaagugugagagacaauuc

SEQ ID NO: 1169892 - RNA, 21 nt, Human
ugagauguucauuagguuugg

SEQ ID NO: 1169893 - RNA, 23 nt, Human
ugcuuuuuuuuuuuuuuuaaagg

SEQ ID NO: 1169894 - RNA, 20 nt, Human
uggcagcgaggggugaccug

SEQ ID NO: 1169895 - RNA, 19 nt, Human
ugggaaaugugaaagcuua

SEQ ID NO: 1169896 - RNA, 19 nt, Human
ugggagcucuuauaccaag

SEQ ID NO: 1169897 - RNA, 19 nt, Human
ugugacucguuggucagca

SEQ ID NO: 1169898 - RNA, 24 nt, Human
uuaaccaucagaaucaacgagcgu

SEQ ID NO: 1169899 - RNA, 18 nt, Human
uuagccucccaaagugcu

SEQ ID NO: 1169900 - RNA, 19 nt, Human
uugaaaauucaccuguuuu

SEQ ID NO: 1169901 - RNA, 19 nt, Human
uuugugcuuagggugguau

SEQ ID NO: 1169902 - RNA, 22 nt, Human
uuuuuuuuuuuuuaaagguuua

SEQ ID NO: 1169903 - RNA, 23 nt, Human
aaaaaaaaaaaaaaggcugggag

SEQ ID NO: 1169904 - RNA, 22 nt, Human
aaaaaaacaaaaacagagcugg

SEQ ID NO: 1169905 - RNA, 25 nt, Human
aaaaaggacucauccuacauuuaaa

SEQ ID NO: 1169906 - RNA, 23 nt, Human
aaagaaaacaaggcaugagaaag

SEQ ID NO: 1169907 - RNA, 24 nt, Human
aaagugcugggauuauaggcauga

SEQ ID NO: 1169908 - RNA, 20 nt, Human
aacacgaugaaauccugucu

SEQ ID NO: 1169909 - RNA, 21 nt, Human
aacacgaugaaauccugucuc

SEQ ID NO: 1169910 - RNA, 20 nt, Human
aacauggugaaacccugucu

SEQ ID NO: 1169911 - RNA, 21 nt, Human
aacauggugaaacccugucuc

SEQ ID NO: 1169912 - RNA, 24 nt, Human
aaccagguggccucaguuuuaccu

SEQ ID NO: 1169913 - RNA, 21 nt, Human
aacccagggcccucguuuuaa

SEQ ID NO: 1169914 - RNA, 20 nt, Human
aaccccuaguccugggcaga

SEQ ID NO: 1169915 - RNA, 24 nt, Human
aagaaaacaaggcaugagaaagca

SEQ ID NO: 1169916 - RNA, 20 nt, Human
aagaugccaccuuuaagaca

SEQ ID NO: 1169917 - RNA, 22 nt, Human
aagcacaccuggaggacaaaaa

SEQ ID NO: 1169918 - RNA, 21 nt, Human
aagcugagaaggcuuccugga

SEQ ID NO: 1169919 - RNA, 20 nt, Human
aaguagcugggacuacaggc

SEQ ID NO: 1169920 - RNA, 20 nt, Human
aaguagcugggacuacaggc

SEQ ID NO: 1169921 - RNA, 19 nt, Human
aagugcugggauuauaggc

SEQ ID NO: 1169922 - RNA, 21 nt, Human
aagugcugggauuauaggcau

SEQ ID NO: 1169923 - RNA, 19 nt, Human
aagugggaugaggagagag

SEQ ID NO: 1169924 - RNA, 18 nt, Human
aaucauaauucccaaucu

SEQ ID NO: 1169925 - RNA, 21 nt, Human
acaaggcaugagaaagcacca

SEQ ID NO: 1169926 - RNA, 21 nt, Human
acaccuguaaucccaacccuu

SEQ ID NO: 1169927 - RNA, 20 nt, Human
acagagugagacuccgucuc

SEQ ID NO: 1169928 - RNA, 24 nt, Human
acagagugagacuccgucucaaaa

SEQ ID NO: 1169929 - RNA, 21 nt, Human
acauggaagaaauaaaauagg

SEQ ID NO: 1169930 - RNA, 20 nt, Human
accaagaaaggaaguuucag

SEQ ID NO: 1169931 - RNA, 23 nt, Human
accaagaaaggaaguuucagcag

SEQ ID NO: 1169932 - RNA, 21 nt, Human
accaggaaggggauuguucca

SEQ ID NO: 1169933 - RNA, 21 nt, Human
acccugucaacugugcucacu

SEQ ID NO: 1169934 - RNA, 24 nt, Human
acccugucucuacuaaaaauacaa

SEQ ID NO: 1169935 - RNA, 21 nt, Human
accgugggguacaaagccuca

SEQ ID NO: 1169936 - RNA, 24 nt, Human
acuccagccugggugacagaguga

SEQ ID NO: 1169937 - RNA, 22 nt, Human
agaaaggagugagguggaauca

SEQ ID NO: 1169938 - RNA, 19 nt, Human
agacagagucucccucugu

SEQ ID NO: 1169939 - RNA, 18 nt, Human
agacaggacacaacagaa

SEQ ID NO: 1169940 - RNA, 23 nt, Human
agacaggguuucaccacguugcc

SEQ ID NO: 1169941 - RNA, 20 nt, Human
agauagcaucuccccuaggu

SEQ ID NO: 1169942 - RNA, 22 nt, Human
agcacuuugggaagccgaggca

SEQ ID NO: 1169943 - RNA, 20 nt, Human
agcacuuugggaggcucagg

SEQ ID NO: 1169944 - RNA, 23 nt, Human
agcacuuugggaggcucaggcag

SEQ ID NO: 1169945 - RNA, 24 nt, Human
agcccggccaacauggugaaaccc

SEQ ID NO: 1169946 - RNA, 22 nt, Human
agcccuuucccucucugggcuu

SEQ ID NO: 1169947 - RNA, 24 nt, Human
agccugggcaacacgaugaaaucc

SEQ ID NO: 1169948 - RNA, 23 nt, Human
agccugggcaacauggggagccc

SEQ ID NO: 1169949 - RNA, 24 nt, Human
agccugggcaacauggggagcccu

SEQ ID NO: 1169950 - RNA, 24 nt, Human
agccugggugacagagugagacuc

SEQ ID NO: 1169951 - RNA, 23 nt, Human
agccuguaaucccagcuaccugg

SEQ ID NO: 1169952 - RNA, 22 nt, Human
agccuguguagaggacagccuc

SEQ ID NO: 1169953 - RNA, 20 nt, Human
agcugcaggacugaaagaug

SEQ ID NO: 1169954 - RNA, 25 nt, Human
aggaggggcagaggggccgggaggg

SEQ ID NO: 1169955 - RNA, 23 nt, Human
aggaguucaagaccagccugggc

SEQ ID NO: 1169956 - RNA, 28 nt, Human
aggaugaaagaaaacaaggcaugagaaa

SEQ ID NO: 1169957 - RNA, 18 nt, Human
aggcaggagaaugguuug

SEQ ID NO: 1169958 - RNA, 24 nt, Human
aggcaggagaaugguuugaacccg

SEQ ID NO: 1169959 - RNA, 22 nt, Human
aggcaggaggaucgcuugagcc

SEQ ID NO: 1169960 - RNA, 23 nt, Human
aggcaggaggaucgcuugagccu

SEQ ID NO: 1169961 - RNA, 18 nt, Human
aggcagguggaucgcuug

SEQ ID NO: 1169962 - RNA, 21 nt, Human
aggccuugguuugggggcagg

SEQ ID NO: 1169963 - RNA, 24 nt, Human
aggcgugguggcgggagccuguaa

SEQ ID NO: 1169964 - RNA, 24 nt, Human
aggcucaggcaggaggaucgcuug

SEQ ID NO: 1169965 - RNA, 24 nt, Human
aggcugaggcaggagaaugguuug

SEQ ID NO: 1169966 - RNA, 25 nt, Human
aggcuggagugcagugacacgaucu

SEQ ID NO: 1169967 - RNA, 23 nt, Human
aggggccgggagggaggugcuuc

SEQ ID NO: 1169968 - RNA, 22 nt, Human
agguaggcggaucaccugaggg

SEQ ID NO: 1169969 - RNA, 22 nt, Human
aggucucuaaucaaguggccac

SEQ ID NO: 1169970 - RNA, 24 nt, Human
aggugauccacccgccuuggucuc

SEQ ID NO: 1169971 - RNA, 21 nt, Human
agguggagguugcagugagcc

SEQ ID NO: 1169972 - RNA, 24 nt, Human
agguggagguugcagugagccgag

SEQ ID NO: 1169973 - RNA, 24 nt, Human
agugcagugacacgaucucggcuc

SEQ ID NO: 1169974 - RNA, 20 nt, Human
agugcucaugccuguaaucc

SEQ ID NO: 1169975 - RNA, 20 nt, Human
agugcucaugccuguaaucc

SEQ ID NO: 1169976 - RNA, 23 nt, Human
aguggcucacgccuguaauccug

SEQ ID NO: 1169977 - RNA, 24 nt, Human
aucuagccccagugaccucuuccu

SEQ ID NO: 1169978 - RNA, 24 nt, Human
aucuugccauugcacuccagccug

SEQ ID NO: 1169979 - RNA, 19 nt, Human
augccuguaauccuagcac

SEQ ID NO: 1169980 - RNA, 21 nt, Human
auguccuuccauucuccuagg

SEQ ID NO: 1169981 - RNA, 21 nt, Human
auugcacuccagccuggguga

SEQ ID NO: 1169982 - RNA, 24 nt, Human
auugcacuccagccugggugacag

SEQ ID NO: 1169983 - RNA, 24 nt, Human
auuuuuguauuuuuaguagagaca

SEQ ID NO: 1169984 - RNA, 21 nt, Human
caaagccccuucucacucuuc

SEQ ID NO: 1169985 - RNA, 22 nt, Human
caacacgaugaaauccugucuc

SEQ ID NO: 1169986 - RNA, 24 nt, Human
caacacgaugaaauccugucucua

SEQ ID NO: 1169987 - RNA, 24 nt, Human
caacauggugaaacccugucucua

SEQ ID NO: 1169988 - RNA, 23 nt, Human
caagauguaggcuaagauuauug

SEQ ID NO: 1169989 - RNA, 21 nt, Human
caaggcaugagaaagcaccaa

SEQ ID NO: 1169990 - RNA, 21 nt, Human
caaggccauuuccauuccaag

SEQ ID NO: 1169991 - RNA, 24 nt, Human
caagguaggcggaucaccugaggu

SEQ ID NO: 1169992 - RNA, 24 nt, Human
cacacccguccucucacccccaga

SEQ ID NO: 1169993 - RNA, 19 nt, Human
caccaagaaaggaaguuuc

SEQ ID NO: 1169994 - RNA, 20 nt, Human
caccaagaaaggaaguuuca

SEQ ID NO: 1169995 - RNA, 22 nt, Human
caccaccaugccuggcuaauuu

SEQ ID NO: 1169996 - RNA, 27 nt, Human
caccacguugcccaggcuggucuagaa

SEQ ID NO: 1169997 - RNA, 22 nt, Human
caccauccaaaaaagaagcucc

SEQ ID NO: 1169998 - RNA, 24 nt, Human
caccaugccuggcuaauuuuugua

SEQ ID NO: 1169999 - RNA, 25 nt, Human
cacccacuucgggcucccagggacu

SEQ ID NO: 1170000 - RNA, 19 nt, Human
cacccagagaaagagggga

SEQ ID NO: 1170001 - RNA, 24 nt, Human
cacccccugcuucauguucucacc

SEQ ID NO: 1170002 - RNA, 19 nt, Human
caccccgccccccccccac

SEQ ID NO: 1170003 - RNA, 20 nt, Human
caccccgccccccccccacc

SEQ ID NO: 1170004 - RNA, 22 nt, Human
caccccgccccccccccacccc

SEQ ID NO: 1170005 - RNA, 27 nt, Human
caccccgccccccccccaccccauucc

SEQ ID NO: 1170006 - RNA, 24 nt, Human
cacccgccuuggucucccaaagug

SEQ ID NO: 1170007 - RNA, 20 nt, Human
caccuggaggacaaaaaggu

SEQ ID NO: 1170008 - RNA, 19 nt, Human
caccuguaaucccaacccu

SEQ ID NO: 1170009 - RNA, 23 nt, Human
caccuguaaucccaacccuuugg

SEQ ID NO: 1170010 - RNA, 24 nt, Human
caccuguaaucccaacccuuuggg

SEQ ID NO: 1170011 - RNA, 25 nt, Human
cacgccuguaauccugagcacuuug

SEQ ID NO: 1170012 - RNA, 24 nt, Human
cacguugcccaggcuggucuagaa

SEQ ID NO: 1170013 - RNA, 22 nt, Human
cacuccagccugggugacagag

SEQ ID NO: 1170014 - RNA, 24 nt, Human
cacuccagccugggugacagagug

SEQ ID NO: 1170015 - RNA, 21 nt, Human
cacucuccacggcucccacug

SEQ ID NO: 1170016 - RNA, 19 nt, Human
cacugcaaacuccaccuuc

SEQ ID NO: 1170017 - RNA, 21 nt, Human
cagaagccagagcagggcuaa

SEQ ID NO: 1170018 - RNA, 22 nt, Human
cagagcugagaacugagcuggg

SEQ ID NO: 1170019 - RNA, 19 nt, Human
cagaggaccuucuugcauu

SEQ ID NO: 1170020 - RNA, 24 nt, Human
cagcuaccugggaggcugaggcag

SEQ ID NO: 1170021 - RNA, 19 nt, Human
cagcuccuggguggauggg

SEQ ID NO: 1170022 - RNA, 22 nt, Human
caggccuugguuugggggcagg

SEQ ID NO: 1170023 - RNA, 24 nt, Human
caggguuucaccacguugcccagg

SEQ ID NO: 1170024 - RNA, 21 nt, Human
cagguggccucaguuuuaccu

SEQ ID NO: 1170025 - RNA, 24 nt, Human
cagugcucaugccuguaauccuag

SEQ ID NO: 1170026 - RNA, 19 nt, Human
caugagggccuuacugaga

SEQ ID NO: 1170027 - RNA, 19 nt, Human
cauugcacuccagccuggg

SEQ ID NO: 1170028 - RNA, 21 nt, Human
cauugcacuccagccugggug

SEQ ID NO: 1170029 - RNA, 22 nt, Human
cauugcacuccagccuggguga

SEQ ID NO: 1170030 - RNA, 24 nt, Human
cauugcacuccagccugggugaca

SEQ ID NO: 1170031 - RNA, 24 nt, Human
cauugcacuccagccugggugaca

SEQ ID NO: 1170032 - RNA, 24 nt, Human
ccaaagugcugggauuauaggcau

SEQ ID NO: 1170033 - RNA, 23 nt, Human
ccagccagauaacugcuuuccuc

SEQ ID NO: 1170034 - RNA, 19 nt, Human
ccagccccuccuuuacuuc

SEQ ID NO: 1170035 - RNA, 24 nt, Human
ccagccccuccuuuacuucuuuag

SEQ ID NO: 1170036 - RNA, 25 nt, Human
ccagugucuucugagcugacucccc

SEQ ID NO: 1170037 - RNA, 20 nt, Human
ccauugcacuccagccuggg

SEQ ID NO: 1170038 - RNA, 21 nt, Human
ccauugcacuccagccugggu

SEQ ID NO: 1170039 - RNA, 21 nt, Human
ccauugcacuccagccugggu

SEQ ID NO: 1170040 - RNA, 22 nt, Human
ccauugcacuccagccugggug

SEQ ID NO: 1170041 - RNA, 24 nt, Human
ccauugcacuccagccugggugac

SEQ ID NO: 1170042 - RNA, 23 nt, Human
cccaaguagcugggacuacaggc

SEQ ID NO: 1170043 - RNA, 24 nt, Human
cccaaguagcugggacuacaggcg

SEQ ID NO: 1170044 - RNA, 22 nt, Human
cccaccccuggggaagcugaga

SEQ ID NO: 1170045 - RNA, 24 nt, Human
ccccacccuccaccaccacucaga

SEQ ID NO: 1170046 - RNA, 26 nt, Human
ccccauuguccucaggcugaauucug

SEQ ID NO: 1170047 - RNA, 23 nt, Human
cccccacccuccaccaccacuca

SEQ ID NO: 1170048 - RNA, 18 nt, Human
ccccccccaccccauucc

SEQ ID NO: 1170049 - RNA, 21 nt, Human
ccccccccaccccauuccacu

SEQ ID NO: 1170050 - RNA, 21 nt, Human
cccccccccaccccauuccac

SEQ ID NO: 1170051 - RNA, 21 nt, Human
ccccgucacucucccugccca

SEQ ID NO: 1170052 - RNA, 25 nt, Human
ccccgucacucucccugcccaucuc

SEQ ID NO: 1170053 - RNA, 18 nt, Human
ccccuaguccugggcaga

SEQ ID NO: 1170054 - RNA, 20 nt, Human
ccccuugcuguuggugccuc

SEQ ID NO: 1170055 - RNA, 22 nt, Human
cccggcagugugggggacagcu

SEQ ID NO: 1170056 - RNA, 22 nt, Human
cccggccaacauggugaaaccc

SEQ ID NO: 1170057 - RNA, 24 nt, Human
cccggccaacauggugaaacccug

SEQ ID NO: 1170058 - RNA, 22 nt, Human
cccguccucucacccccagaca

SEQ ID NO: 1170059 - RNA, 24 nt, Human
cccuccaccaccacucagagggcc

SEQ ID NO: 1170060 - RNA, 21 nt, Human
cccuccuuuacuucuuuagcc

SEQ ID NO: 1170061 - RNA, 21 nt, Human
cccucguuuuaaccucuacgc

SEQ ID NO: 1170062 - RNA, 24 nt, Human
cccucugucgcccaggcuggagug

SEQ ID NO: 1170063 - RNA, 18 nt, Human
cccugagcuccuucccuu

SEQ ID NO: 1170064 - RNA, 20 nt, Human
cccugcccaucucuuccucc

SEQ ID NO: 1170065 - RNA, 24 nt, Human
ccgccuuggucucccaaagugcug

SEQ ID NO: 1170066 - RNA, 21 nt, Human
ccggggagguggagguugcag

SEQ ID NO: 1170067 - RNA, 19 nt, Human
ccggguuaaagcaauucuc

SEQ ID NO: 1170068 - RNA, 22 nt, Human
ccggguuaaagcaauucucaug

SEQ ID NO: 1170069 - RNA, 23 nt, Human
ccuaccuuuugaugccaugcccc

SEQ ID NO: 1170070 - RNA, 23 nt, Human
ccucaggcugaauucugaagccc

SEQ ID NO: 1170071 - RNA, 22 nt, Human
ccugaccucaggugauccaccc

SEQ ID NO: 1170072 - RNA, 23 nt, Human
ccugaccucaggugauccacccg

SEQ ID NO: 1170073 - RNA, 25 nt, Human
ccugccaagaucucagggcacccca

SEQ ID NO: 1170074 - RNA, 22 nt, Human
ccugcccaucucuuccuccugu

SEQ ID NO: 1170075 - RNA, 22 nt, Human
ccugggcaacacgaugaaaucc

SEQ ID NO: 1170076 - RNA, 24 nt, Human
ccugggcaacacgaugaaauccug

SEQ ID NO: 1170077 - RNA, 22 nt, Human
ccugggugacagagugagacuc

SEQ ID NO: 1170078 - RNA, 18 nt, Human
ccuggguggaugggcugu

SEQ ID NO: 1170079 - RNA, 21 nt, Human
ccuguaaucccagcuaccugg

SEQ ID NO: 1170080 - RNA, 22 nt, Human
ccuguaaucccagcuaccuggg

SEQ ID NO: 1170081 - RNA, 20 nt, Human
ccuguaauccuagcacuuug

SEQ ID NO: 1170082 - RNA, 22 nt, Human
ccuguaauccuagcacuuuggg

SEQ ID NO: 1170083 - RNA, 21 nt, Human
ccuuaaaaaaacaaaaacaga

SEQ ID NO: 1170084 - RNA, 21 nt, Human
ccuugguuugggggcaggguc

SEQ ID NO: 1170085 - RNA, 24 nt, Human
cgagaccagcccggccaacauggu

SEQ ID NO: 1170086 - RNA, 22 nt, Human
cgcagcaguggccaugggagaa

SEQ ID NO: 1170087 - RNA, 24 nt, Human
cgccuguaauccugagcacuuugg

SEQ ID NO: 1170088 - RNA, 25 nt, Human
cgccuguaauccugagcacuuuggg

SEQ ID NO: 1170089 - RNA, 24 nt, Human
cggaucaccugagguugggaguuc

SEQ ID NO: 1170090 - RNA, 24 nt, Human
cggccaacauggugaaacccuguc

SEQ ID NO: 1170091 - RNA, 22 nt, Human
cggcuugggugggaacuuucag

SEQ ID NO: 1170092 - RNA, 23 nt, Human
cgugcaccaccaugccuggcuaa

SEQ ID NO: 1170093 - RNA, 20 nt, Human
cuagcacuuugggaggcuca

SEQ ID NO: 1170094 - RNA, 20 nt, Human
cuauggccaccccgcccccc

SEQ ID NO: 1170095 - RNA, 25 nt, Human
cucacgccuguaauccugagcacuu

SEQ ID NO: 1170096 - RNA, 24 nt, Human
cucaggugauccacccgccuuggu

SEQ ID NO: 1170097 - RNA, 24 nt, Human
cucaugccuguaauccuagcacuu

SEQ ID NO: 1170098 - RNA, 23 nt, Human
cucccuccuacucuggaucccca

SEQ ID NO: 1170099 - RNA, 24 nt, Human
cucccucugucgcccaggcuggag

SEQ ID NO: 1170100 - RNA, 19 nt, Human
cuccgucucaaaaaaaaaa

SEQ ID NO: 1170101 - RNA, 20 nt, Human
cuccuagggagcccugugcc

SEQ ID NO: 1170102 - RNA, 20 nt, Human
cuccuuaaaaaaacaaaaac

SEQ ID NO: 1170103 - RNA, 20 nt, Human
cucgccaggccugagccagg

SEQ ID NO: 1170104 - RNA, 19 nt, Human
cucuccacggcucccacug

SEQ ID NO: 1170105 - RNA, 23 nt, Human
cugggcuucuguuucucccccug

SEQ ID NO: 1170106 - RNA, 21 nt, Human
cuggucacccaggacucugcu

SEQ ID NO: 1170107 - RNA, 20 nt, Human
cuuacaccuguaaucccaac

SEQ ID NO: 1170108 - RNA, 19 nt, Human
cuucaggaaaugucucugg

SEQ ID NO: 1170109 - RNA, 18 nt, Human
cuucccagccaucuuccc

SEQ ID NO: 1170110 - RNA, 19 nt, Human
cuucugagcugacuccccg

SEQ ID NO: 1170111 - RNA, 19 nt, Human
gaaacccugucucuacuaa

SEQ ID NO: 1170112 - RNA, 23 nt, Human
gacaaccugggcaacuggggagg

SEQ ID NO: 1170113 - RNA, 24 nt, Human
gacagagugagacuccgucucaaa

SEQ ID NO: 1170114 - RNA, 24 nt, Human
gaccucaggugauccacccgccuu

SEQ ID NO: 1170115 - RNA, 24 nt, Human
gacuacaggcgugcaccaccaugc

SEQ ID NO: 1170116 - RNA, 23 nt, Human
gagaggcugccggaggggagggg

SEQ ID NO: 1170117 - RNA, 23 nt, Human
gagaucuugccauugcacuccag

SEQ ID NO: 1170118 - RNA, 24 nt, Human
gagcacuuugggaagccgaggcag

SEQ ID NO: 1170119 - RNA, 26 nt, Human
gaggaccaggaaggggauuguuccag

SEQ ID NO: 1170120 - RNA, 22 nt, Human
gaggggccgggagggaggugcu

SEQ ID NO: 1170121 - RNA, 22 nt, Human
gagguugcagugagccgagauc

SEQ ID NO: 1170122 - RNA, 24 nt, Human
gaucaccugagguugggaguucga

SEQ ID NO: 1170123 - RNA, 24 nt, Human
gaucgcuugagcccaggaguucaa

SEQ ID NO: 1170124 - RNA, 23 nt, Human
gaucgcuugagccuagaguucaa

SEQ ID NO: 1170125 - RNA, 19 nt, Human
gauuauaggcaugaaccac

SEQ ID NO: 1170126 - RNA, 24 nt, Human
gauuauaggcaugaaccacagugc

SEQ ID NO: 1170127 - RNA, 24 nt, Human
gcacaggcucagggaucagaaagg

SEQ ID NO: 1170128 - RNA, 24 nt, Human
gcacuccagccugggugacagagu

SEQ ID NO: 1170129 - RNA, 18 nt, Human
gcagcaguggccauggga

SEQ ID NO: 1170130 - RNA, 20 nt, Human
gcagugcacccccacccucc

SEQ ID NO: 1170131 - RNA, 24 nt, Human
gccaacauggugaaacccugucuc

SEQ ID NO: 1170132 - RNA, 23 nt, Human
gccaagaucucagggcaccccag

SEQ ID NO: 1170133 - RNA, 20 nt, Human
gccaggcugcucugggcugg

SEQ ID NO: 1170134 - RNA, 19 nt, Human
gccauugcacuccagccug

SEQ ID NO: 1170135 - RNA, 24 nt, Human
gccauugcacuccagccuggguga

SEQ ID NO: 1170136 - RNA, 22 nt, Human
gcccaggaguucaagaccagcc

SEQ ID NO: 1170137 - RNA, 23 nt, Human
gcccaggcuggagugcagugaca

SEQ ID NO: 1170138 - RNA, 18 nt, Human
gcccagggccuugcaagc

SEQ ID NO: 1170139 - RNA, 24 nt, Human
gcccucuuucuaacccuuuaccau

SEQ ID NO: 1170140 - RNA, 22 nt, Human
gccuuggucucccaaagugcug

SEQ ID NO: 1170141 - RNA, 24 nt, Human
gccuuggucucccaaagugcuggg

SEQ ID NO: 1170142 - RNA, 18 nt, Human
gcggcucugggugccggc

SEQ ID NO: 1170143 - RNA, 20 nt, Human
gcgggagccuguaaucccag

SEQ ID NO: 1170144 - RNA, 21 nt, Human
gcuacagcucauagauguccu

SEQ ID NO: 1170145 - RNA, 22 nt, Human
gcucaugccuguaauccuagca

SEQ ID NO: 1170146 - RNA, 18 nt, Human
ggaaguuucagcagucac

SEQ ID NO: 1170147 - RNA, 24 nt, Human
ggacuacaggcgugcaccaccaug

SEQ ID NO: 1170148 - RNA, 21 nt, Human
ggagagagagagagagagagc

SEQ ID NO: 1170149 - RNA, 22 nt, Human
ggagcagugcucaugccuguaa

SEQ ID NO: 1170150 - RNA, 20 nt, Human
ggagcaguggcuuacaccug

SEQ ID NO: 1170151 - RNA, 23 nt, Human
ggagcaguggcuuacaccuguaa

SEQ ID NO: 1170152 - RNA, 18 nt, Human
ggaggacaaaaagguucc

SEQ ID NO: 1170153 - RNA, 18 nt, Human
ggagguugcagugagccg

SEQ ID NO: 1170154 - RNA, 20 nt, Human
ggagguugcagugagccgag

SEQ ID NO: 1170155 - RNA, 22 nt, Human
ggagguugcagugagccgagau

SEQ ID NO: 1170156 - RNA, 23 nt, Human
ggagguugcagugagccgagauc

SEQ ID NO: 1170157 - RNA, 23 nt, Human
ggaucaccugagguugggaguuc

SEQ ID NO: 1170158 - RNA, 23 nt, Human
ggcacaguggcucacgccuguaa

SEQ ID NO: 1170159 - RNA, 24 nt, Human
ggccaccccgccccccccccaccc

SEQ ID NO: 1170160 - RNA, 23 nt, Human
ggccaggcugcucugggcuggga

SEQ ID NO: 1170161 - RNA, 24 nt, Human
ggcuggucuagaacuccugaccuc

SEQ ID NO: 1170162 - RNA, 24 nt, Human
gggagaggaacacccagagaaaga

SEQ ID NO: 1170163 - RNA, 24 nt, Human
gggagguagucccaugcuucugaa

SEQ ID NO: 1170164 - RNA, 18 nt, Human
gggcacaguggcucacgc

SEQ ID NO: 1170165 - RNA, 22 nt, Human
gggcugggagcuugcugcagug

SEQ ID NO: 1170166 - RNA, 22 nt, Human
ggggagggugaggggggaagug

SEQ ID NO: 1170167 - RNA, 29 nt, Human
ggggagguggagguugcagugacaacggu

SEQ ID NO: 1170168 - RNA, 24 nt, Human
ggggagguggagguugcagugagc

SEQ ID NO: 1170169 - RNA, 18 nt, Human
ggggcccugggucugacc

SEQ ID NO: 1170170 - RNA, 20 nt, Human
ggggcccugggucugaccug

SEQ ID NO: 1170171 - RNA, 24 nt, Human
gggggcccugggucugaccugugg

SEQ ID NO: 1170172 - RNA, 22 nt, Human
ggggggcccugggucugaccug

SEQ ID NO: 1170173 - RNA, 18 nt, Human
gggugagcuggggaggag

SEQ ID NO: 1170174 - RNA, 22 nt, Human
gggugaggggggaagugggggc

SEQ ID NO: 1170175 - RNA, 20 nt, Human
ggucacagggccugagcuug

SEQ ID NO: 1170176 - RNA, 20 nt, Human
ggucccagguuccacuucuu

SEQ ID NO: 1170177 - RNA, 24 nt, Human
gguggcgggagccuguaaucccag

SEQ ID NO: 1170178 - RNA, 21 nt, Human
guacagagcugagaacugagc

SEQ ID NO: 1170179 - RNA, 24 nt, Human
gugauccacccgccuuggucuccc

SEQ ID NO: 1170180 - RNA, 24 nt, Human
gugcucaugccuguaauccuagca

SEQ ID NO: 1170181 - RNA, 19 nt, Human
guuucucccccugucaaau

SEQ ID NO: 1170182 - RNA, 23 nt, Human
uaaaaaaaaaaaaaaggcuggga

SEQ ID NO: 1170183 - RNA, 21 nt, Human
uaaaaauacaaaaauuagcca

SEQ ID NO: 1170184 - RNA, 24 nt, Human
uaauuuuuguauuuuuaguagaga

SEQ ID NO: 1170185 - RNA, 21 nt, Human
uacaccuguaaucccaacccu

SEQ ID NO: 1170186 - RNA, 24 nt, Human
uacaccuguaaucccaacccuuug

SEQ ID NO: 1170187 - RNA, 21 nt, Human
uacagcucauagauguccuuc

SEQ ID NO: 1170188 - RNA, 23 nt, Human
uacauggaauuauuuaauauguu

SEQ ID NO: 1170189 - RNA, 24 nt, Human
uacauuuaaaaauauuauaaucau

SEQ ID NO: 1170190 - RNA, 20 nt, Human
uaccgugggguacaaagccu

SEQ ID NO: 1170191 - RNA, 21 nt, Human
uagaaggaaaauuccccucac

SEQ ID NO: 1170192 - RNA, 22 nt, Human
uagagacaggguuucaccacgu

SEQ ID NO: 1170193 - RNA, 19 nt, Human
uagcacuugucccaacccc

SEQ ID NO: 1170194 - RNA, 21 nt, Human
uagcacuuugggaggcucagg

SEQ ID NO: 1170195 - RNA, 20 nt, Human
uaggcaugaaccacagugcc

SEQ ID NO: 1170196 - RNA, 18 nt, Human
uaggcggaucaccugagg

SEQ ID NO: 1170197 - RNA, 19 nt, Human
uaguagagacaggguuuca

SEQ ID NO: 1170198 - RNA, 22 nt, Human
uaucaguguuauuugugugugg

SEQ ID NO: 1170199 - RNA, 18 nt, Human
ucaccugagguugggagu

SEQ ID NO: 1170200 - RNA, 24 nt, Human
ucacugcaaacuccaccuuccggg

SEQ ID NO: 1170201 - RNA, 20 nt, Human
ucacugugguggccuugaug

SEQ ID NO: 1170202 - RNA, 22 nt, Human
ucacuuggugcgugauuauuuc

SEQ ID NO: 1170203 - RNA, 21 nt, Human
ucagaagcucuuucuucccuc

SEQ ID NO: 1170204 - RNA, 22 nt, Human
ucagcagucacacccguccucu

SEQ ID NO: 1170205 - RNA, 21 nt, Human
ucaggugagcaggcaaagccc

SEQ ID NO: 1170206 - RNA, 23 nt, Human
uccagccugggugacagagugag

SEQ ID NO: 1170207 - RNA, 24 nt, Human
uccagccugggugacagagugaga

SEQ ID NO: 1170208 - RNA, 21 nt, Human
uccauucuccuagggagcccu

SEQ ID NO: 1170209 - RNA, 24 nt, Human
ucccaaagugcugggauuauaggc

SEQ ID NO: 1170210 - RNA, 18 nt, Human
ucccaaccccugccuccu

SEQ ID NO: 1170211 - RNA, 24 nt, Human
ucccaaguagcugggacuacaggc

SEQ ID NO: 1170212 - RNA, 18 nt, Human
ucccagggacugugcugc

SEQ ID NO: 1170213 - RNA, 21 nt, Human
uccccaggccagugucuucug

SEQ ID NO: 1170214 - RNA, 20 nt, Human
ucccucugucgcccaggcug

SEQ ID NO: 1170215 - RNA, 24 nt, Human
ucccucugucgcccaggcuggagu

SEQ ID NO: 1170216 - RNA, 20 nt, Human
uccgauaccauuuaaucauc

SEQ ID NO: 1170217 - RNA, 23 nt, Human
uccgucucaaaaaaaaaaaaaaa

SEQ ID NO: 1170218 - RNA, 22 nt, Human
ucgcccaggcuggagugcagug

SEQ ID NO: 1170219 - RNA, 23 nt, Human
ucgcuugagcccaggaguucaag

SEQ ID NO: 1170220 - RNA, 22 nt, Human
ucgcuugagccuagaguucaag

SEQ ID NO: 1170221 - RNA, 21 nt, Human
ucuauccaaaaauacgaaaaa

SEQ ID NO: 1170222 - RNA, 18 nt, Human
ucucaaaaaaaaaaaaaa

SEQ ID NO: 1170223 - RNA, 22 nt, Human
ucucacuuauugcccaggcuuc

SEQ ID NO: 1170224 - RNA, 23 nt, Human
ucucacuuauugcccaggcuuca

SEQ ID NO: 1170225 - RNA, 23 nt, Human
ucucccucugucgcccaggcugg

SEQ ID NO: 1170226 - RNA, 24 nt, Human
ucucccucugucgcccaggcugga

SEQ ID NO: 1170227 - RNA, 22 nt, Human
ucucuaauaaaaaaaaaaaaaa

SEQ ID NO: 1170228 - RNA, 23 nt, Human
ucucuacuaaaaauacaaaaauu

SEQ ID NO: 1170229 - RNA, 21 nt, Human
ucucugggcuucuguuucucc

SEQ ID NO: 1170230 - RNA, 22 nt, Human
ucuggguuuucucgccaggccu

SEQ ID NO: 1170231 - RNA, 24 nt, Human
ucugucgcccaggcuggagugcag

SEQ ID NO: 1170232 - RNA, 20 nt, Human
ugaaaucagggccagguggu

SEQ ID NO: 1170233 - RNA, 20 nt, Human
ugaccucaggugauccaccc

SEQ ID NO: 1170234 - RNA, 24 nt, Human
ugaccucaggugauccacccgccu

SEQ ID NO: 1170235 - RNA, 20 nt, Human
ugacugaguuuggaaaacag

SEQ ID NO: 1170236 - RNA, 18 nt, Human
ugagaaagcaccaagaug

SEQ ID NO: 1170237 - RNA, 22 nt, Human
ugagaaagcaccaagaugccac

SEQ ID NO: 1170238 - RNA, 24 nt, Human
ugagaaggcuuccuggaggaggaa

SEQ ID NO: 1170239 - RNA, 23 nt, Human
ugagauaagggaugggggagagg

SEQ ID NO: 1170240 - RNA, 23 nt, Human
ugagcccaggaguucaagaccag

SEQ ID NO: 1170241 - RNA, 22 nt, Human
ugagccgagaucuugccauugc

SEQ ID NO: 1170242 - RNA, 24 nt, Human
ugaggcaggagaaugguuugaacc

SEQ ID NO: 1170243 - RNA, 25 nt, Human
ugaggcaggagaaugguuugaaccc

SEQ ID NO: 1170244 - RNA, 24 nt, Human
ugagguggaaucaccaagaaagga

SEQ ID NO: 1170245 - RNA, 18 nt, Human
ugauuugcugcugagaac

SEQ ID NO: 1170246 - RNA, 23 nt, Human
ugcaaauaugcucauaucuuacu

SEQ ID NO: 1170247 - RNA, 22 nt, Human
ugcacuccagccugggugacag

SEQ ID NO: 1170248 - RNA, 24 nt, Human
ugcacuccagccugggugacagag

SEQ ID NO: 1170249 - RNA, 22 nt, Human
ugcagugacacgaucucggcuc

SEQ ID NO: 1170250 - RNA, 24 nt, Human
ugcccaggcuggucuagaacuccu

SEQ ID NO: 1170251 - RNA, 24 nt, Human
ugccccagccucccaaguagcugg

SEQ ID NO: 1170252 - RNA, 19 nt, Human
ugcccuguccaauuggcca

SEQ ID NO: 1170253 - RNA, 23 nt, Human
ugccuguaauccuagcacuuugg

SEQ ID NO: 1170254 - RNA, 23 nt, Human
ugccuguaauccuagcacuuugg

SEQ ID NO: 1170255 - RNA, 22 nt, Human
ugcugcagugcacccccacccu

SEQ ID NO: 1170256 - RNA, 18 nt, Human
ugcugggagacaggacac

SEQ ID NO: 1170257 - RNA, 23 nt, Human
uggagugcagugacacgaucucg

SEQ ID NO: 1170258 - RNA, 24 nt, Human
uggagugcagugacacgaucucgg

SEQ ID NO: 1170259 - RNA, 24 nt, Human
uggaucgcuugagcccaggaguuc

SEQ ID NO: 1170260 - RNA, 22 nt, Human
uggccacucugggaaacccucc

SEQ ID NO: 1170261 - RNA, 24 nt, Human
uggccaggcugcucugggcuggga

SEQ ID NO: 1170262 - RNA, 22 nt, Human
uggcgggagccuguaaucccag

SEQ ID NO: 1170263 - RNA, 25 nt, Human
uggcucacgccuguaauccugagca

SEQ ID NO: 1170264 - RNA, 18 nt, Human
uggcugugggggaccucu

SEQ ID NO: 1170265 - RNA, 21 nt, Human
uggcuuacaccuguaauccca

SEQ ID NO: 1170266 - RNA, 24 nt, Human
ugggacuacaggcgugcaccacca

SEQ ID NO: 1170267 - RNA, 25 nt, Human
ugggacuacaggcgugcaccaccau

SEQ ID NO: 1170268 - RNA, 18 nt, Human
ugggagaggcugccggag

SEQ ID NO: 1170269 - RNA, 24 nt, Human
ugggaggccaagguaggcggauca

SEQ ID NO: 1170270 - RNA, 23 nt, Human
ugggaggcucaggcaggaggauc

SEQ ID NO: 1170271 - RNA, 18 nt, Human
ugggaggcugaggcagga

SEQ ID NO: 1170272 - RNA, 24 nt, Human
ugggaggcugaggcaggagaaugg

SEQ ID NO: 1170273 - RNA, 26 nt, Human
ugggaggcugaggcaggagaaugguu

SEQ ID NO: 1170274 - RNA, 24 nt, Human
ugggagguagucccaugcuucuga

SEQ ID NO: 1170275 - RNA, 21 nt, Human
ugggauuauaggcaugaacca

SEQ ID NO: 1170276 - RNA, 24 nt, Human
ugggauuauaggcaugaaccacag

SEQ ID NO: 1170277 - RNA, 26 nt, Human
ugggauuauaggcaugaaccacagug

SEQ ID NO: 1170278 - RNA, 24 nt, Human
ugggcaacacgaugaaauccuguc

SEQ ID NO: 1170279 - RNA, 23 nt, Human
uggucuagaacuccugaccucag

SEQ ID NO: 1170280 - RNA, 24 nt, Human
ugguggcgggagccuguaauccca

SEQ ID NO: 1170281 - RNA, 23 nt, Human
ugguggcugggcacaguggcuca

SEQ ID NO: 1170282 - RNA, 20 nt, Human
ugguuugaacccggggaggu

SEQ ID NO: 1170283 - RNA, 25 nt, Human
ugguuugaacccggggagguggagg

SEQ ID NO: 1170284 - RNA, 21 nt, Human
uguagaggacagccucugucu

SEQ ID NO: 1170285 - RNA, 20 nt, Human
ugucccuucagcgcacugcc

SEQ ID NO: 1170286 - RNA, 20 nt, Human
ugucuucugagcugacuccc

SEQ ID NO: 1170287 - RNA, 22 nt, Human
ugugcaaacaauggcacaauau

SEQ ID NO: 1170288 - RNA, 21 nt, Human
ugugcuaggucucuaaucaag

SEQ ID NO: 1170289 - RNA, 20 nt, Human
uguggaauuuuauaguccug

SEQ ID NO: 1170290 - RNA, 21 nt, Human
uguuagaguuugcuauuuaca

SEQ ID NO: 1170291 - RNA, 25 nt, Human
uguugaaccagguggccucaguuuu

SEQ ID NO: 1170292 - RNA, 21 nt, Human
uguuucccucuggucuaucau

SEQ ID NO: 1170293 - RNA, 23 nt, Human
uuagccaggcgugguggcgggag

SEQ ID NO: 1170294 - RNA, 18 nt, Human
uuaguagagacaggguuu

SEQ ID NO: 1170295 - RNA, 21 nt, Human
uucaggaaugucugaagggga

SEQ ID NO: 1170296 - RNA, 22 nt, Human
uucaggaaugucugaaggggau

SEQ ID NO: 1170297 - RNA, 24 nt, Human
uucccagccaucuucccauaauga

SEQ ID NO: 1170298 - RNA, 21 nt, Human
uucccuugagucuugcauacu

SEQ ID NO: 1170299 - RNA, 21 nt, Human
uucucaugccccagccuccca

SEQ ID NO: 1170300 - RNA, 23 nt, Human
uucucaugccccagccucccaag

SEQ ID NO: 1170301 - RNA, 22 nt, Human
uucuugcauugcuuagugguca

SEQ ID NO: 1170302 - RNA, 21 nt, Human
uucuuucuguggcugcuuccc

SEQ ID NO: 1170303 - RNA, 19 nt, Human
uugaacccggggaggugga

SEQ ID NO: 1170304 - RNA, 21 nt, Human
uugaacccggggagguggagg

SEQ ID NO: 1170305 - RNA, 25 nt, Human
uugaacccggggagguggagguugc

SEQ ID NO: 1170306 - RNA, 22 nt, Human
uugaagaccauuuccaccaagg

SEQ ID NO: 1170307 - RNA, 22 nt, Human
uugagcccaggaguucaagacc

SEQ ID NO: 1170308 - RNA, 20 nt, Human
uugagccuagaguucaagau

SEQ ID NO: 1170309 - RNA, 21 nt, Human
uugcagugagccgagaucuug

SEQ ID NO: 1170310 - RNA, 22 nt, Human
uugcagugagccgagaucuugc

SEQ ID NO: 1170311 - RNA, 23 nt, Human
uugcagugagccgagaucuugcc

SEQ ID NO: 1170312 - RNA, 21 nt, Human
uuuaauaucccaaaagggcuc

SEQ ID NO: 1170313 - RNA, 21 nt, Human
uuuaccaugcugguaaugugg

SEQ ID NO: 1170314 - RNA, 27 nt, Human
uuuauguugagauaagggaugggggag

SEQ ID NO: 1170315 - RNA, 23 nt, Human
uuucaccacguugcccaggcugg

SEQ ID NO: 1170316 - RNA, 22 nt, Human
uuucucccccugucaaaugagg

SEQ ID NO: 1170317 - RNA, 24 nt, Human
uuuuuaguagagacaggguuucac

SEQ ID NO: 1170318 - RNA, 20 nt, Human
uuuuuguauuuuuaguagag

SEQ ID NO: 1170319 - RNA, 18 nt, Human
caggugacccaagcaaaa

SEQ ID NO: 1170320 - RNA, 19 nt, Human
gugcaaggaggauggucuc

SEQ ID NO: 1170321 - RNA, 22 nt, Human
ucaugggaacucugccuccugg

SEQ ID NO: 1170322 - RNA, 23 nt, Human
ucuuggcacaaaggugcaaggag

SEQ ID NO: 1170323 - RNA, 24 nt, Human
uggcacaaaggugcaaggaggaug

SEQ ID NO: 1170324 - RNA, 22 nt, Human
uuggcacaaaggugcaaggagg

SEQ ID NO: 1170325 - RNA, 21 nt, Human
aaaagucuucuuccuuccacc

SEQ ID NO: 1170326 - RNA, 23 nt, Human
aacaguaaagaccggaaccaagg

SEQ ID NO: 1170327 - RNA, 19 nt, Human
aacccuggcgaccagggag

SEQ ID NO: 1170328 - RNA, 24 nt, Human
aacccuggcgaccagggagcuggg

SEQ ID NO: 1170329 - RNA, 24 nt, Human
aaguugccccaaagcaccagaguu

SEQ ID NO: 1170330 - RNA, 21 nt, Human
accccaucugcuucaacccag

SEQ ID NO: 1170331 - RNA, 21 nt, Human
accgaaacuuuuggaccagca

SEQ ID NO: 1170332 - RNA, 22 nt, Human
acgugugugugcauauguaugu

SEQ ID NO: 1170333 - RNA, 19 nt, Human
agaaauaaugaguuuaaug

SEQ ID NO: 1170334 - RNA, 20 nt, Human
agacaucaauaaacucgaaa

SEQ ID NO: 1170335 - RNA, 21 nt, Human
agaucucggaaguucuuaacu

SEQ ID NO: 1170336 - RNA, 24 nt, Human
aggaugguggagagguacucagag

SEQ ID NO: 1170337 - RNA, 20 nt, Human
auagaugagggaaauccugg

SEQ ID NO: 1170338 - RNA, 18 nt, Human
auguauauguguaugugc

SEQ ID NO: 1170339 - RNA, 26 nt, Human
auguauguauguguguauguauguau

SEQ ID NO: 1170340 - RNA, 24 nt, Human
auguauguguguauguauguauau

SEQ ID NO: 1170341 - RNA, 20 nt, Human
auguguguauguauguauau

SEQ ID NO: 1170342 - RNA, 21 nt, Human
caacaguaaagaccggaacca

SEQ ID NO: 1170343 - RNA, 22 nt, Human
caacaguaaagaccggaaccaa

SEQ ID NO: 1170344 - RNA, 20 nt, Human
caacccaggagcuuacucag

SEQ ID NO: 1170345 - RNA, 24 nt, Human
caacccaggagcuuacucagauac

SEQ ID NO: 1170346 - RNA, 21 nt, Human
caccccguuucacuccaccuu

SEQ ID NO: 1170347 - RNA, 21 nt, Human
cagaagaaaagugagucuaac

SEQ ID NO: 1170348 - RNA, 24 nt, Human
cagcacucucccuuaccacuuucc

SEQ ID NO: 1170349 - RNA, 19 nt, Human
caguaaagaccggaaccaa

SEQ ID NO: 1170350 - RNA, 20 nt, Human
caguaaagaccggaaccaag

SEQ ID NO: 1170351 - RNA, 21 nt, Human
cauauguauguauguguguau

SEQ ID NO: 1170352 - RNA, 23 nt, Human
caucaauaaacucgaaaggcucc

SEQ ID NO: 1170353 - RNA, 21 nt, Human
ccaccgccguccccacccccg

SEQ ID NO: 1170354 - RNA, 25 nt, Human
ccagcacucucccuuaccacuuucc

SEQ ID NO: 1170355 - RNA, 18 nt, Human
cccacccgaccccugccc

SEQ ID NO: 1170356 - RNA, 22 nt, Human
cccaucugcuucaacccaggag

SEQ ID NO: 1170357 - RNA, 26 nt, Human
ccccaaagcaccagaguuuuauuacu

SEQ ID NO: 1170358 - RNA, 21 nt, Human
cccccgcaccccguuucacuc

SEQ ID NO: 1170359 - RNA, 22 nt, Human
cccccgcaccccguuucacucc

SEQ ID NO: 1170360 - RNA, 18 nt, Human
ccccguucgcugugcugc

SEQ ID NO: 1170361 - RNA, 19 nt, Human
ccccuagcucuaccugaag

SEQ ID NO: 1170362 - RNA, 19 nt, Human
cccgaccccugcccucagc

SEQ ID NO: 1170363 - RNA, 21 nt, Human
cccgcaccccguuucacucca

SEQ ID NO: 1170364 - RNA, 19 nt, Human
cccuggcgaccagggagcu

SEQ ID NO: 1170365 - RNA, 20 nt, Human
ccgaaacuuuuggaccagca

SEQ ID NO: 1170366 - RNA, 21 nt, Human
ccguccccacccccgcacccc

SEQ ID NO: 1170367 - RNA, 24 nt, Human
ccguuucacuccaccuuggagggc

SEQ ID NO: 1170368 - RNA, 24 nt, Human
ccuauaaucuaaaauauaguuguc

SEQ ID NO: 1170369 - RNA, 20 nt, Human
cgaccccugcccucagcccc

SEQ ID NO: 1170370 - RNA, 22 nt, Human
cggaaccaaggcgugguacuag

SEQ ID NO: 1170371 - RNA, 18 nt, Human
cggcgggagggaagauug

SEQ ID NO: 1170372 - RNA, 20 nt, Human
cggcgggagggaagauugga

SEQ ID NO: 1170373 - RNA, 22 nt, Human
cuagaggaaguaugguaaacac

SEQ ID NO: 1170374 - RNA, 20 nt, Human
cucaugcuagaggugccucc

SEQ ID NO: 1170375 - RNA, 18 nt, Human
cucuggaguugcgcauac

SEQ ID NO: 1170376 - RNA, 18 nt, Human
cugcagaauccugagcca

SEQ ID NO: 1170377 - RNA, 18 nt, Human
cuuaaacucuagaggaag

SEQ ID NO: 1170378 - RNA, 24 nt, Human
cuucaaaguugccccaaagcacca

SEQ ID NO: 1170379 - RNA, 23 nt, Human
cuuccuuccaccgccguccccac

SEQ ID NO: 1170380 - RNA, 19 nt, Human
cuuuuguaaucugucccca

SEQ ID NO: 1170381 - RNA, 21 nt, Human
gccccggaucccuuuuaacuu

SEQ ID NO: 1170382 - RNA, 20 nt, Human
gcuuugaugucccaggagag

SEQ ID NO: 1170383 - RNA, 20 nt, Human
ggaaccaaggcgugguacua

SEQ ID NO: 1170384 - RNA, 20 nt, Human
guccaccacccaugcagagu

SEQ ID NO: 1170385 - RNA, 22 nt, Human
gugcgcgagcucgcaggcgcgu

SEQ ID NO: 1170386 - RNA, 20 nt, Human
guguacgugugugugcauau

SEQ ID NO: 1170387 - RNA, 20 nt, Human
guguacgugugugugcauau

SEQ ID NO: 1170388 - RNA, 21 nt, Human
gugugugcauauguauguaug

SEQ ID NO: 1170389 - RNA, 19 nt, Human
guuuuauuacucucuggag

SEQ ID NO: 1170390 - RNA, 23 nt, Human
guuuuauucaucuuuguguuccc

SEQ ID NO: 1170391 - RNA, 23 nt, Human
uaaacaccccaucugcuucaacc

SEQ ID NO: 1170392 - RNA, 20 nt, Human
uacaaguacgaaaaauggug

SEQ ID NO: 1170393 - RNA, 26 nt, Human
uagcaaaagcgauugaaagaagguac

SEQ ID NO: 1170394 - RNA, 21 nt, Human
uauagauuauacucacuuucc

SEQ ID NO: 1170395 - RNA, 25 nt, Human
uaucuuggagcucccagguccagag

SEQ ID NO: 1170396 - RNA, 19 nt, Human
uauguauauguguaugugc

SEQ ID NO: 1170397 - RNA, 25 nt, Human
uauguauauguguaugugcgcgagc

SEQ ID NO: 1170398 - RNA, 19 nt, Human
uauguauguauauguguau

SEQ ID NO: 1170399 - RNA, 21 nt, Human
uauguauguauauguguaugu

SEQ ID NO: 1170400 - RNA, 22 nt, Human
uauguauguauauguguaugug

SEQ ID NO: 1170401 - RNA, 23 nt, Human
uauguauguauauguguaugugc

SEQ ID NO: 1170402 - RNA, 23 nt, Human
uauguauguauguguguauguau

SEQ ID NO: 1170403 - RNA, 19 nt, Human
uauguauguguguauguau

SEQ ID NO: 1170404 - RNA, 23 nt, Human
uauguauguguguauguauguau

SEQ ID NO: 1170405 - RNA, 18 nt, Human
uauguguguauguaugua

SEQ ID NO: 1170406 - RNA, 18 nt, Human
ucccagguccagagagcu

SEQ ID NO: 1170407 - RNA, 18 nt, Human
uccccacccccgcacccc

SEQ ID NO: 1170408 - RNA, 19 nt, Human
uccccacccccgcaccccc

SEQ ID NO: 1170409 - RNA, 23 nt, Human
uccccacccccgcaccccguuuc

SEQ ID NO: 1170410 - RNA, 23 nt, Human
uccgcacacauugccugccccau

SEQ ID NO: 1170411 - RNA, 24 nt, Human
uccgcacacauugccugccccaua

SEQ ID NO: 1170412 - RNA, 22 nt, Human
uccuaaccaugcaucccucucc

SEQ ID NO: 1170413 - RNA, 20 nt, Human
ucguccaccacccaugcaga

SEQ ID NO: 1170414 - RNA, 18 nt, Human
ucuccgcacacauugccu

SEQ ID NO: 1170415 - RNA, 22 nt, Human
ucuuccgggcuucaaaaggcuu

SEQ ID NO: 1170416 - RNA, 24 nt, Human
ucuucuuccuuccaccgccguccc

SEQ ID NO: 1170417 - RNA, 28 nt, Human
ugaaaacaggagucuguguguccccuuc

SEQ ID NO: 1170418 - RNA, 22 nt, Human
ugaacaaucgaacacagaacuc

SEQ ID NO: 1170419 - RNA, 24 nt, Human
ugaagcuacuguucaaccugaagg

SEQ ID NO: 1170420 - RNA, 21 nt, Human
ugaguaauaaaagucuucuuc

SEQ ID NO: 1170421 - RNA, 25 nt, Human
ugaguaauaaaagucuucuuccuuc

SEQ ID NO: 1170422 - RNA, 25 nt, Human
ugaguacaccgaaacuuuuggacca

SEQ ID NO: 1170423 - RNA, 20 nt, Human
ugcaaagaggaaauucaaga

SEQ ID NO: 1170424 - RNA, 18 nt, Human
ugccagaagaaaagugag

SEQ ID NO: 1170425 - RNA, 19 nt, Human
ugccugccccauaaccauu

SEQ ID NO: 1170426 - RNA, 22 nt, Human
uggcgggaaccuuggguuuuua

SEQ ID NO: 1170427 - RNA, 19 nt, Human
uguacgugugugugcauau

SEQ ID NO: 1170428 - RNA, 23 nt, Human
uguacgugugugugcauauguau

SEQ ID NO: 1170429 - RNA, 19 nt, Human
uguauguauauguguaugu

SEQ ID NO: 1170430 - RNA, 19 nt, Human
uguauguauauguguaugu

SEQ ID NO: 1170431 - RNA, 19 nt, Human
uguauguauguauaugugu

SEQ ID NO: 1170432 - RNA, 19 nt, Human
uguauguauguguguaugu

SEQ ID NO: 1170433 - RNA, 19 nt, Human
uguauguauguguguaugu

SEQ ID NO: 1170434 - RNA, 18 nt, Human
uguauguguguauguaug

SEQ ID NO: 1170435 - RNA, 18 nt, Human
uguccccuucacccggaa

SEQ ID NO: 1170436 - RNA, 23 nt, Human
uguccccuucacccggaaacuca

SEQ ID NO: 1170437 - RNA, 21 nt, Human
ugucccugccacccaauacaa

SEQ ID NO: 1170438 - RNA, 24 nt, Human
ugucuacuguuuaaaaaucaaagu

SEQ ID NO: 1170439 - RNA, 19 nt, Human
ugugcauauguauguaugu

SEQ ID NO: 1170440 - RNA, 19 nt, Human
ugugcauauguauguaugu

SEQ ID NO: 1170441 - RNA, 22 nt, Human
ugugugauucugcguguacgug

SEQ ID NO: 1170442 - RNA, 18 nt, Human
ugugugcauauguaugua

SEQ ID NO: 1170443 - RNA, 19 nt, Human
ugugugcauauguauguau

SEQ ID NO: 1170444 - RNA, 19 nt, Human
ugugugcauauguauguau

SEQ ID NO: 1170445 - RNA, 27 nt, Human
ugugugcauauguauguauguguguau

SEQ ID NO: 1170446 - RNA, 19 nt, Human
uguguguauguauguauau

SEQ ID NO: 1170447 - RNA, 23 nt, Human
uguguguauguauguauaugugu

SEQ ID NO: 1170448 - RNA, 20 nt, Human
ugugugugcauauguaugua

SEQ ID NO: 1170449 - RNA, 26 nt, Human
uuacucuaucccugacagagagugau

SEQ ID NO: 1170450 - RNA, 22 nt, Human
uucaacuggagagaaacccugg

SEQ ID NO: 1170451 - RNA, 23 nt, Human
uucccaucuccgcacacauugcc

SEQ ID NO: 1170452 - RNA, 21 nt, Human
uuccuuccaccgccgucccca

SEQ ID NO: 1170453 - RNA, 21 nt, Human
uuguuuguuuguuuguuuuuu

SEQ ID NO: 1170454 - RNA, 18 nt, Human
uuuccugcagaauccuga

SEQ ID NO: 1170455 - RNA, 21 nt, Human
uuugaugucccaggagagugu

SEQ ID NO: 1170456 - RNA, 18 nt, Human
uuugcgugugagggugug

SEQ ID NO: 1170457 - RNA, 21 nt, Human
aagcucggagaguagcagcag

SEQ ID NO: 1170458 - RNA, 22 nt, Human
uagcagcagacaccgcagccuc

SEQ ID NO: 1170459 - RNA, 24 nt, Human
aaagugcugagauuacaggcauga

SEQ ID NO: 1170460 - RNA, 21 nt, Human
aagcaagaaaaaaaucuuccc

SEQ ID NO: 1170461 - RNA, 22 nt, Human
aagcaagaaaaaaaucuuccca

SEQ ID NO: 1170462 - RNA, 22 nt, Human
aagggauucuucuccugucuca

SEQ ID NO: 1170463 - RNA, 22 nt, Human
aaguagcugagauuacaggcau

SEQ ID NO: 1170464 - RNA, 24 nt, Human
aaguagcugagauuacaggcauga

SEQ ID NO: 1170465 - RNA, 26 nt, Human
aagugcugagauuacaggcaugagcc

SEQ ID NO: 1170466 - RNA, 19 nt, Human
aauaccugauaaacuacaa

SEQ ID NO: 1170467 - RNA, 24 nt, Human
aaucuuacucuuucucacucuuac

SEQ ID NO: 1170468 - RNA, 23 nt, Human
acaaccucugccucccuagguuc

SEQ ID NO: 1170469 - RNA, 24 nt, Human
accauguuggccaggguggucucg

SEQ ID NO: 1170470 - RNA, 18 nt, Human
acgggguuucaccauguu

SEQ ID NO: 1170471 - RNA, 23 nt, Human
acgggguuucaccauguuggcca

SEQ ID NO: 1170472 - RNA, 24 nt, Human
acgggguuucaccauguuggccag

SEQ ID NO: 1170473 - RNA, 19 nt, Human
agauuacaggcaugagcca

SEQ ID NO: 1170474 - RNA, 19 nt, Human
agauuacaggcaugagcca

SEQ ID NO: 1170475 - RNA, 21 nt, Human
agauuacaggcaugagccacc

SEQ ID NO: 1170476 - RNA, 22 nt, Human
agauuacaggcaugagccacca

SEQ ID NO: 1170477 - RNA, 21 nt, Human
aguagaaacuagcacacugag

SEQ ID NO: 1170478 - RNA, 25 nt, Human
aguagcugagauuacaggcaugagc

SEQ ID NO: 1170479 - RNA, 20 nt, Human
agugcaguggcacgaucuug

SEQ ID NO: 1170480 - RNA, 23 nt, Human
agugcaguggcacgaucuuggcu

SEQ ID NO: 1170481 - RNA, 24 nt, Human
agugcaguggcacgaucuuggcuc

SEQ ID NO: 1170482 - RNA, 19 nt, Human
auauacccauauauauaua

SEQ ID NO: 1170483 - RNA, 18 nt, Human
auucuucuccugucucag

SEQ ID NO: 1170484 - RNA, 24 nt, Human
caaagugcugagauuacaggcaug

SEQ ID NO: 1170485 - RNA, 24 nt, Human
caacacacuccccugccacgcuaa

SEQ ID NO: 1170486 - RNA, 24 nt, Human
caagauaucucuuuaauauucucu

SEQ ID NO: 1170487 - RNA, 20 nt, Human
cacaggagggauauggaugg

SEQ ID NO: 1170488 - RNA, 23 nt, Human
cacaugucuaaagccaaaguucc

SEQ ID NO: 1170489 - RNA, 24 nt, Human
caccacacucggcuaauuuuugua

SEQ ID NO: 1170490 - RNA, 18 nt, Human
caccauguuggccagggu

SEQ ID NO: 1170491 - RNA, 22 nt, Human
caccauguuggccagggugguc

SEQ ID NO: 1170492 - RNA, 24 nt, Human
caccauguuggccaggguggucuc

SEQ ID NO: 1170493 - RNA, 24 nt, Human
cagaaccuuggagcacaggaggga

SEQ ID NO: 1170494 - RNA, 25 nt, Human
cagcaauauacacaaaauuaaucuu

SEQ ID NO: 1170495 - RNA, 19 nt, Human
cagcacaacaccacugcuu

SEQ ID NO: 1170496 - RNA, 23 nt, Human
cagcgaaucacucccuucuguuu

SEQ ID NO: 1170497 - RNA, 19 nt, Human
caguggcacgaucuuggcu

SEQ ID NO: 1170498 - RNA, 26 nt, Human
ccaaaagcaagaaaaaaaucuuccca

SEQ ID NO: 1170499 - RNA, 23 nt, Human
ccaaagugcugagauuacaggca

SEQ ID NO: 1170500 - RNA, 24 nt, Human
ccaaagugcugagauuacaggcau

SEQ ID NO: 1170501 - RNA, 22 nt, Human
ccaacuuucuuuccucucccuc

SEQ ID NO: 1170502 - RNA, 23 nt, Human
ccaaguagcugagauuacaggca

SEQ ID NO: 1170503 - RNA, 24 nt, Human
ccaaguagcugagauuacaggcau

SEQ ID NO: 1170504 - RNA, 21 nt, Human
ccacuuucuccucuuuguucc

SEQ ID NO: 1170505 - RNA, 18 nt, Human
ccagucccuuuuucccuc

SEQ ID NO: 1170506 - RNA, 21 nt, Human
ccaucuccccuugguugauuc

SEQ ID NO: 1170507 - RNA, 18 nt, Human
ccaugaaggcaaagauaa

SEQ ID NO: 1170508 - RNA, 23 nt, Human
ccccaaauccaaaagcaagaaaa

SEQ ID NO: 1170509 - RNA, 20 nt, Human
ccccugacuucgugcccugc

SEQ ID NO: 1170510 - RNA, 23 nt, Human
ccccugccacgcuaacaucaccc

SEQ ID NO: 1170511 - RNA, 20 nt, Human
cccgcccggccucccaaagu

SEQ ID NO: 1170512 - RNA, 20 nt, Human
cccuagguucaagggauucu

SEQ ID NO: 1170513 - RNA, 27 nt, Human
cccuagguucaagggauucuucuccug

SEQ ID NO: 1170514 - RNA, 18 nt, Human
cccuaucaucucuuaaaa

SEQ ID NO: 1170515 - RNA, 19 nt, Human
cccuuuuucccucauuguc

SEQ ID NO: 1170516 - RNA, 23 nt, Human
ccgcccggccucccaaagugcug

SEQ ID NO: 1170517 - RNA, 18 nt, Human
ccuagguucaagggauuc

SEQ ID NO: 1170518 - RNA, 21 nt, Human
ccuaucaucucuuaaaacuuc

SEQ ID NO: 1170519 - RNA, 23 nt, Human
ccucaacacacuccccugccacg

SEQ ID NO: 1170520 - RNA, 22 nt, Human
ccucagugccucaacacacucc

SEQ ID NO: 1170521 - RNA, 19 nt, Human
ccucccucuucuucacucc

SEQ ID NO: 1170522 - RNA, 25 nt, Human
ccuugguugauucucucuucucugg

SEQ ID NO: 1170523 - RNA, 24 nt, Human
cgggguuucaccauguuggccagg

SEQ ID NO: 1170524 - RNA, 20 nt, Human
cuaauuuuuguauuuuuaga

SEQ ID NO: 1170525 - RNA, 25 nt, Human
cuacaaccucugccucccuagguuc

SEQ ID NO: 1170526 - RNA, 24 nt, Human
cuccaugaaggcaaagauaagggc

SEQ ID NO: 1170527 - RNA, 21 nt, Human
cucccaaagugcugagauuac

SEQ ID NO: 1170528 - RNA, 25 nt, Human
cucccucuucuucacuccucacaug

SEQ ID NO: 1170529 - RNA, 19 nt, Human
cucgugaaacauuuucccc

SEQ ID NO: 1170530 - RNA, 24 nt, Human
cucucugucacccaggcuagagug

SEQ ID NO: 1170531 - RNA, 23 nt, Human
cucugucacccaggcuagagugc

SEQ ID NO: 1170532 - RNA, 19 nt, Human
cugcagcauucaucacagc

SEQ ID NO: 1170533 - RNA, 24 nt, Human
cuuagccccaaauccaaaagcaag

SEQ ID NO: 1170534 - RNA, 21 nt, Human
cuucagaaccuuggagcacag

SEQ ID NO: 1170535 - RNA, 20 nt, Human
cuuuauaacucauaaggcug

SEQ ID NO: 1170536 - RNA, 24 nt, Human
gaaaaaaaucuucccaauaaugag

SEQ ID NO: 1170537 - RNA, 23 nt, Human
gaauguuauuacuaaggccaaga

SEQ ID NO: 1170538 - RNA, 21 nt, Human
gagacggagucucucucuguc

SEQ ID NO: 1170539 - RNA, 21 nt, Human
gagcagcaggcuauaaacagg

SEQ ID NO: 1170540 - RNA, 18 nt, Human
gauuacaggcaugagcca

SEQ ID NO: 1170541 - RNA, 18 nt, Human
gauuacaggcaugagcca

SEQ ID NO: 1170542 - RNA, 22 nt, Human
gauuacaggcaugagccaccac

SEQ ID NO: 1170543 - RNA, 24 nt, Human
gauuacaggcaugagccaccucgc

SEQ ID NO: 1170544 - RNA, 24 nt, Human
gcauucaucacagcgaaucacucc

SEQ ID NO: 1170545 - RNA, 19 nt, Human
gcuagagugcaguggcacg

SEQ ID NO: 1170546 - RNA, 21 nt, Human
gcucacuacaaccucugccuc

SEQ ID NO: 1170547 - RNA, 20 nt, Human
gggaaagaauauaagauucc

SEQ ID NO: 1170548 - RNA, 23 nt, Human
gggguuucaccauguuggccagg

SEQ ID NO: 1170549 - RNA, 23 nt, Human
gguggucucgaacuccugaccuc

SEQ ID NO: 1170550 - RNA, 18 nt, Human
gguugauucucucuucuc

SEQ ID NO: 1170551 - RNA, 21 nt, Human
guauauuuauauauauaccca

SEQ ID NO: 1170552 - RNA, 18 nt, Human
guuggccaggguggucuc

SEQ ID NO: 1170553 - RNA, 25 nt, Human
uaaaauuugggaaagaauauaagau

SEQ ID NO: 1170554 - RNA, 24 nt, Human
uaauuuuuguauuuuuaguacaga

SEQ ID NO: 1170555 - RNA, 22 nt, Human
uacagacgggguuucaccaugu

SEQ ID NO: 1170556 - RNA, 21 nt, Human
uacaggcaugagccaccacac

SEQ ID NO: 1170557 - RNA, 23 nt, Human
uagagugcaguggcacgaucuug

SEQ ID NO: 1170558 - RNA, 24 nt, Human
uagagugcaguggcacgaucuugg

SEQ ID NO: 1170559 - RNA, 22 nt, Human
uaggagaaugaaaaauguaaga

SEQ ID NO: 1170560 - RNA, 24 nt, Human
uaguacagacgggguuucaccaug

SEQ ID NO: 1170561 - RNA, 18 nt, Human
uauaaaauuugggaaaga

SEQ ID NO: 1170562 - RNA, 19 nt, Human
uauacccauauauauauau

SEQ ID NO: 1170563 - RNA, 19 nt, Human
uauacccauauauauauau

SEQ ID NO: 1170564 - RNA, 20 nt, Human
uauagcaaaacuucuuuaaa

SEQ ID NO: 1170565 - RNA, 20 nt, Human
uauauauacccauauauaua

SEQ ID NO: 1170566 - RNA, 22 nt, Human
uauauauauacccauauauaua

SEQ ID NO: 1170567 - RNA, 20 nt, Human
uaucuagaacuccaggcuuc

SEQ ID NO: 1170568 - RNA, 23 nt, Human
uauucucuccccucagugccuca

SEQ ID NO: 1170569 - RNA, 24 nt, Human
uauuuggccucugcagcauucauc

SEQ ID NO: 1170570 - RNA, 19 nt, Human
ucacagcgaaucacucccu

SEQ ID NO: 1170571 - RNA, 24 nt, Human
ucaccauguuggccaggguggucu

SEQ ID NO: 1170572 - RNA, 18 nt, Human
ucacuacaaccucugccu

SEQ ID NO: 1170573 - RNA, 19 nt, Human
ucacuacaaccucugccuc

SEQ ID NO: 1170574 - RNA, 25 nt, Human
ucacuacaaccucugccucccuagg

SEQ ID NO: 1170575 - RNA, 23 nt, Human
ucacucuuacuccaacuuucuuu

SEQ ID NO: 1170576 - RNA, 22 nt, Human
ucagugccucaacacacucccc

SEQ ID NO: 1170577 - RNA, 20 nt, Human
uccaacuuucuuuccucucc

SEQ ID NO: 1170578 - RNA, 22 nt, Human
uccacuuucuccucuuuguucc

SEQ ID NO: 1170579 - RNA, 24 nt, Human
ucccaaagugcugagauuacaggc

SEQ ID NO: 1170580 - RNA, 19 nt, Human
uccccugccacgcuaacau

SEQ ID NO: 1170581 - RNA, 25 nt, Human
uccccugccacgcuaacaucacccc

SEQ ID NO: 1170582 - RNA, 21 nt, Human
uccccuugguugauucucucu

SEQ ID NO: 1170583 - RNA, 19 nt, Human
ucccucucugucacacucu

SEQ ID NO: 1170584 - RNA, 20 nt, Human
uccucccucuucuucacucc

SEQ ID NO: 1170585 - RNA, 18 nt, Human
ucgaagauaaaaucaaaa

SEQ ID NO: 1170586 - RNA, 25 nt, Human
ucgaagauaaaaucaaaaggucuau

SEQ ID NO: 1170587 - RNA, 22 nt, Human
ucuaagaucacucuaaugucca

SEQ ID NO: 1170588 - RNA, 19 nt, Human
ucucgaacuccugaccucg

SEQ ID NO: 1170589 - RNA, 24 nt, Human
ucucucucugucacccaggcuaga

SEQ ID NO: 1170590 - RNA, 24 nt, Human
ucucucugucacccaggcuagagu

SEQ ID NO: 1170591 - RNA, 24 nt, Human
ucugucacccaggcuagagugcag

SEQ ID NO: 1170592 - RNA, 23 nt, Human
ucuuaaaacuucucagucuaaga

SEQ ID NO: 1170593 - RNA, 18 nt, Human
ugaacaaguuuugacagu

SEQ ID NO: 1170594 - RNA, 19 nt, Human
ugacuucugggaccaucuc

SEQ ID NO: 1170595 - RNA, 21 nt, Human
ugacuucugggaccaucuccc

SEQ ID NO: 1170596 - RNA, 21 nt, Human
ugagagcaaaagaugucacaa

SEQ ID NO: 1170597 - RNA, 22 nt, Human
ugagagcaaaagaugucacaaa

SEQ ID NO: 1170598 - RNA, 21 nt, Human
ugagauuacaggcaugagcca

SEQ ID NO: 1170599 - RNA, 22 nt, Human
ugagauuacaggcaugagccac

SEQ ID NO: 1170600 - RNA, 22 nt, Human
ugagauuacaggcaugagccac

SEQ ID NO: 1170601 - RNA, 23 nt, Human
ugagauuacaggcaugagccacc

SEQ ID NO: 1170602 - RNA, 23 nt, Human
ugagauuacaggcaugagccacc

SEQ ID NO: 1170603 - RNA, 24 nt, Human
ugagauuacaggcaugagccacca

SEQ ID NO: 1170604 - RNA, 24 nt, Human
ugagauuacaggcaugagccacca

SEQ ID NO: 1170605 - RNA, 26 nt, Human
ugagauuacaggcaugagccaccucg

SEQ ID NO: 1170606 - RNA, 27 nt, Human
ugagauuacaggcaugagccaccucgc

SEQ ID NO: 1170607 - RNA, 22 nt, Human
ugcaguggcacgaucuuggcuc

SEQ ID NO: 1170608 - RNA, 19 nt, Human
ugccacgcuaacaucaccc

SEQ ID NO: 1170609 - RNA, 24 nt, Human
ugccucaacacacuccccugccac

SEQ ID NO: 1170610 - RNA, 24 nt, Human
uggcacgaucuuggcucacuacaa

SEQ ID NO: 1170611 - RNA, 24 nt, Human
uggccaggguggucucgaacuccu

SEQ ID NO: 1170612 - RNA, 20 nt, Human
uggcuaauuuuaccccacug

SEQ ID NO: 1170613 - RNA, 21 nt, Human
uggcuuuauaacucauaaggc

SEQ ID NO: 1170614 - RNA, 21 nt, Human
uguauuuuuaguacagacggg

SEQ ID NO: 1170615 - RNA, 19 nt, Human
uguccaggacaaaaucaac

SEQ ID NO: 1170616 - RNA, 24 nt, Human
uuaguacagacgggguuucaccau

SEQ ID NO: 1170617 - RNA, 19 nt, Human
uuccccccgcccggccucc

SEQ ID NO: 1170618 - RNA, 23 nt, Human
uuccccccgcccggccucccaaa

SEQ ID NO: 1170619 - RNA, 22 nt, Human
uucuccccuguuacucuucaaa

SEQ ID NO: 1170620 - RNA, 24 nt, Human
uucugccuacccuguuuuaggaga

SEQ ID NO: 1170621 - RNA, 19 nt, Human
uugcuaucuauuaaucuua

SEQ ID NO: 1170622 - RNA, 18 nt, Human
uugcuugcuccuaucaca

SEQ ID NO: 1170623 - RNA, 23 nt, Human
uuguauuuuuaguacagacgggg

SEQ ID NO: 1170624 - RNA, 19 nt, Human
uuucaccauguuggccagg

SEQ ID NO: 1170625 - RNA, 24 nt, Human
uuuuuaguacagacgggguuucac

SEQ ID NO: 1170626 - RNA, 20 nt, Human
uuuuuguauuuuuaguacag

SEQ ID NO: 1170627 - RNA, 23 nt, Human
uuuuuguauuuuuaguacagacg

SEQ ID NO: 1170628 - RNA, 24 nt, Human
aaaaguacuaacauuucguaacuc

SEQ ID NO: 1170629 - RNA, 25 nt, Human
aaacagaagcagaaaagaaaacugc

SEQ ID NO: 1170630 - RNA, 25 nt, Human
aaacagaagcagaaaagaagggacc

SEQ ID NO: 1170631 - RNA, 18 nt, Human
aaagugcugggauuacaa

SEQ ID NO: 1170632 - RNA, 23 nt, Human
aaagugcugggauuacaagcaug

SEQ ID NO: 1170633 - RNA, 24 nt, Human
aaagugcugggauuacaagcauga

SEQ ID NO: 1170634 - RNA, 23 nt, Human
aacaccucugccuccgaccaucc

SEQ ID NO: 1170635 - RNA, 21 nt, Human
aacauagaaaaaguacuaaca

SEQ ID NO: 1170636 - RNA, 23 nt, Human
aacauagaaaaaguacuaacauu

SEQ ID NO: 1170637 - RNA, 23 nt, Human
aagcagaaaagaaaacugcauua

SEQ ID NO: 1170638 - RNA, 24 nt, Human
aagcagaaaagaaaacugcauuag

SEQ ID NO: 1170639 - RNA, 27 nt, Human
aagcagaaaagaaaacugcauuagcca

SEQ ID NO: 1170640 - RNA, 22 nt, Human
aagcggcagagccggguuccca

SEQ ID NO: 1170641 - RNA, 19 nt, Human
aagugcugggauuacaagc

SEQ ID NO: 1170642 - RNA, 21 nt, Human
aagugcugggauuacaagcau

SEQ ID NO: 1170643 - RNA, 26 nt, Human
aagugcugggauuacaagcaugagcc

SEQ ID NO: 1170644 - RNA, 21 nt, Human
aauaccuucuugguagaagca

SEQ ID NO: 1170645 - RNA, 22 nt, Human
acaaaaaugucauaacugacaa

SEQ ID NO: 1170646 - RNA, 26 nt, Human
acaaagcaugcuucaaacaaauacaa

SEQ ID NO: 1170647 - RNA, 25 nt, Human
acaaagccucaugaaacuuaauacc

SEQ ID NO: 1170648 - RNA, 20 nt, Human
acagagucccccuccaauca

SEQ ID NO: 1170649 - RNA, 22 nt, Human
acagagucccccuccaaucaag

SEQ ID NO: 1170650 - RNA, 20 nt, Human
acaguaacagagcugccacc

SEQ ID NO: 1170651 - RNA, 19 nt, Human
accacuuuaccuuuuuguu

SEQ ID NO: 1170652 - RNA, 21 nt, Human
accucugccuccgaccauccc

SEQ ID NO: 1170653 - RNA, 21 nt, Human
acugagcacagagucccccuc

SEQ ID NO: 1170654 - RNA, 20 nt, Human
agacacaaagauuuuauaaa

SEQ ID NO: 1170655 - RNA, 23 nt, Human
agacagggucucccuguguugcc

SEQ ID NO: 1170656 - RNA, 19 nt, Human
agcuauugauauuuaaaga

SEQ ID NO: 1170657 - RNA, 20 nt, Human
agcuauugauauuuaaagaa

SEQ ID NO: 1170658 - RNA, 24 nt, Human
agugcugggauuacaagcaugagc

SEQ ID NO: 1170659 - RNA, 21 nt, Human
auaaaucugugaaauccagaa

SEQ ID NO: 1170660 - RNA, 23 nt, Human
auauaaaacaaagcaugcuucaa

SEQ ID NO: 1170661 - RNA, 18 nt, Human
aucaagcacugugccagg

SEQ ID NO: 1170662 - RNA, 21 nt, Human
auuacaagcaugagccaccau

SEQ ID NO: 1170663 - RNA, 22 nt, Human
caaaaagauuauaucaauaaua

SEQ ID NO: 1170664 - RNA, 24 nt, Human
caaacuccaggccucaauucuccu

SEQ ID NO: 1170665 - RNA, 23 nt, Human
caccaccuagaaagcgguccuaa

SEQ ID NO: 1170666 - RNA, 21 nt, Human
caccuagaaagcgguccuaag

SEQ ID NO: 1170667 - RNA, 21 nt, Human
caccucugccuccgaccaucc

SEQ ID NO: 1170668 - RNA, 25 nt, Human
cacucuuguccucaccaccuagaaa

SEQ ID NO: 1170669 - RNA, 20 nt, Human
cacugugccaggggcucccc

SEQ ID NO: 1170670 - RNA, 21 nt, Human
cagaacaaagaauuuuccuau

SEQ ID NO: 1170671 - RNA, 20 nt, Human
cagagucccccuccaaucaa

SEQ ID NO: 1170672 - RNA, 24 nt, Human
cagggucucccuguguugcccagg

SEQ ID NO: 1170673 - RNA, 19 nt, Human
caugagccaccaugcccca

SEQ ID NO: 1170674 - RNA, 25 nt, Human
ccaccugaaguacuaaaacagccau

SEQ ID NO: 1170675 - RNA, 24 nt, Human
cccagacauaacguuaguccaaag

SEQ ID NO: 1170676 - RNA, 24 nt, Human
ccgaucacuggaaacaccucugcc

SEQ ID NO: 1170677 - RNA, 21 nt, Human
ccuaagccgaucacuggaaac

SEQ ID NO: 1170678 - RNA, 19 nt, Human
ccuccaaucaagcacugug

SEQ ID NO: 1170679 - RNA, 19 nt, Human
ccucugccuccgaccaucc

SEQ ID NO: 1170680 - RNA, 19 nt, Human
ccuguguugcccaggcuag

SEQ ID NO: 1170681 - RNA, 22 nt, Human
ccuucuugguagaagcaggaau

SEQ ID NO: 1170682 - RNA, 21 nt, Human
cgaauuccaccugaaguacua

SEQ ID NO: 1170683 - RNA, 18 nt, Human
cgggaggugcauguuacu

SEQ ID NO: 1170684 - RNA, 24 nt, Human
cuaaaacauuuuaagugccaucaa

SEQ ID NO: 1170685 - RNA, 19 nt, Human
cuggaaacaccucugccuc

SEQ ID NO: 1170686 - RNA, 22 nt, Human
cuguagagacagggucucccug

SEQ ID NO: 1170687 - RNA, 21 nt, Human
cuuguccucaccaccuagaaa

SEQ ID NO: 1170688 - RNA, 23 nt, Human
cuuucugcuuccaguucugaaga

SEQ ID NO: 1170689 - RNA, 19 nt, Human
gacagggucucccuguguu

SEQ ID NO: 1170690 - RNA, 18 nt, Human
gaccucugaaagugcugg

SEQ ID NO: 1170691 - RNA, 19 nt, Human
gagccaccaugccccaccu

SEQ ID NO: 1170692 - RNA, 19 nt, Human
gagccggguucccacccag

SEQ ID NO: 1170693 - RNA, 18 nt, Human
gauuacaagcaugagcca

SEQ ID NO: 1170694 - RNA, 24 nt, Human
gauuacaagcaugagccaccaugc

SEQ ID NO: 1170695 - RNA, 19 nt, Human
gcaugagccaccaugcccc

SEQ ID NO: 1170696 - RNA, 21 nt, Human
gcggcuaggaagcggcagagc

SEQ ID NO: 1170697 - RNA, 24 nt, Human
ggauuacaagcaugagccaccaug

SEQ ID NO: 1170698 - RNA, 23 nt, Human
ggcaaacagaagcagaaaagaaa

SEQ ID NO: 1170699 - RNA, 23 nt, Human
guuaaacauagaaaaaguacuaa

SEQ ID NO: 1170700 - RNA, 22 nt, Human
uaagccgaucacuggaaacacc

SEQ ID NO: 1170701 - RNA, 18 nt, Human
uagaaaaaguacuaacau

SEQ ID NO: 1170702 - RNA, 22 nt, Human
uagagacagggucucccugugu

SEQ ID NO: 1170703 - RNA, 23 nt, Human
uaggccaacacauauauuaaaua

SEQ ID NO: 1170704 - RNA, 19 nt, Human
uagucacucucucccuggu

SEQ ID NO: 1170705 - RNA, 23 nt, Human
uauaaaacaaagcaugcuucaaa

SEQ ID NO: 1170706 - RNA, 19 nt, Human
uauuuuaaagcuggcuuau

SEQ ID NO: 1170707 - RNA, 20 nt, Human
ucaagcacugugccaggggc

SEQ ID NO: 1170708 - RNA, 26 nt, Human
ucacuggaaacaccucugccuccgac

SEQ ID NO: 1170709 - RNA, 18 nt, Human
uccaguucugaagaugaa

SEQ ID NO: 1170710 - RNA, 22 nt, Human
uccccagacauaacguuagucc

SEQ ID NO: 1170711 - RNA, 19 nt, Human
uccucgacuccgaaaccac

SEQ ID NO: 1170712 - RNA, 24 nt, Human
ucuaacauuaacuuauuuaaauaa

SEQ ID NO: 1170713 - RNA, 19 nt, Human
ucucccuguguugcccagg

SEQ ID NO: 1170714 - RNA, 24 nt, Human
ucugaaagugcugggauuacaagc

SEQ ID NO: 1170715 - RNA, 23 nt, Human
ucuguagagacagggucucccug

SEQ ID NO: 1170716 - RNA, 23 nt, Human
ucuguagagacagggucucccug

SEQ ID NO: 1170717 - RNA, 19 nt, Human
ucuuugaaauguuuucagu

SEQ ID NO: 1170718 - RNA, 21 nt, Human
ugaaagacacaaagauuuuau

SEQ ID NO: 1170719 - RNA, 19 nt, Human
ugaaagugcugggauuaca

SEQ ID NO: 1170720 - RNA, 24 nt, Human
ugaaagugcugggauuacaagcau

SEQ ID NO: 1170721 - RNA, 21 nt, Human
ugaaggaaaauuuggaauugc

SEQ ID NO: 1170722 - RNA, 24 nt, Human
ugagcacagagucccccuccaauc

SEQ ID NO: 1170723 - RNA, 19 nt, Human
ugauauuuaaagaaugugg

SEQ ID NO: 1170724 - RNA, 23 nt, Human
ugccaggggcuccccagacauaa

SEQ ID NO: 1170725 - RNA, 25 nt, Human
ugcugggauuacaagcaugagccac

SEQ ID NO: 1170726 - RNA, 21 nt, Human
uggaaacaccucugccuccga

SEQ ID NO: 1170727 - RNA, 22 nt, Human
ugggauuacaagcaugagccac

SEQ ID NO: 1170728 - RNA, 23 nt, Human
ugggauuacaagcaugagccacc

SEQ ID NO: 1170729 - RNA, 24 nt, Human
ugggauuacaagcaugagccacca

SEQ ID NO: 1170730 - RNA, 22 nt, Human
uguagagacagggucucccugu

SEQ ID NO: 1170731 - RNA, 23 nt, Human
uguguugcccaggcuagugucaa

SEQ ID NO: 1170732 - RNA, 24 nt, Human
uguguugcccaggcuagugucaaa

SEQ ID NO: 1170733 - RNA, 24 nt, Human
uuaaacauagaaaaaguacuaaca

SEQ ID NO: 1170734 - RNA, 24 nt, Human
uucacaauauagcacaauaaucaa

SEQ ID NO: 1170735 - RNA, 23 nt, Human
uuccaguucugaagaugaaaagg

SEQ ID NO: 1170736 - RNA, 23 nt, Human
uucguaacucuaaacaaaaacca

SEQ ID NO: 1170737 - RNA, 25 nt, Human
uugaggcaaacagaagcagaaaaga

SEQ ID NO: 1170738 - RNA, 23 nt, Human
aaacagacaaaucaaguugaagg

SEQ ID NO: 1170739 - RNA, 18 nt, Human
aaugcaguuuuggacuga

SEQ ID NO: 1170740 - RNA, 27 nt, Human
aggcauuuucagucuaauuagucucua

SEQ ID NO: 1170741 - RNA, 20 nt, Human
caacaggaauuuuaaagguc

SEQ ID NO: 1170742 - RNA, 19 nt, Human
caacaguaacucuuacaau

SEQ ID NO: 1170743 - RNA, 23 nt, Human
cagaaaaugcaacaguaacucuu

SEQ ID NO: 1170744 - RNA, 23 nt, Human
ccccaaagauauugcuuaacuuc

SEQ ID NO: 1170745 - RNA, 19 nt, Human
cuuguaaacacaaagaaac

SEQ ID NO: 1170746 - RNA, 23 nt, Human
gagaaaaaguucaguccuuuccu

SEQ ID NO: 1170747 - RNA, 19 nt, Human
uaaugcaguuuuggacuga

SEQ ID NO: 1170748 - RNA, 23 nt, Human
uaggucagaaaaugcaacaguaa

SEQ ID NO: 1170749 - RNA, 27 nt, Human
uauccuguuguucaacuggcuuuugau

SEQ ID NO: 1170750 - RNA, 20 nt, Human
uccuuguaaacacaaagaaa

SEQ ID NO: 1170751 - RNA, 21 nt, Human
ugaaaauaaauuaguuccccc

SEQ ID NO: 1170752 - RNA, 28 nt, Human
ugcaacaguaacucuuacaauucuuuuc

SEQ ID NO: 1170753 - RNA, 18 nt, Human
uggggaaaaaagcuaguu

SEQ ID NO: 1170754 - RNA, 22 nt, Human
uguaaacacaaagaaacucaac

SEQ ID NO: 1170755 - RNA, 23 nt, Human
uguaaacacaaagaaacucaaca

SEQ ID NO: 1170756 - RNA, 25 nt, Human
uugguacuuaagucaugaauugugg

SEQ ID NO: 1170757 - RNA, 20 nt, Human
ucagauauucaacucuugcu

SEQ ID NO: 1170758 - RNA, 23 nt, Human
ucuugcuaguuuaaucugucuug

SEQ ID NO: 1170759 - RNA, 22 nt, Human
ugagugagucacuggaccaaaa

SEQ ID NO: 1170760 - RNA, 19 nt, Human
ugcuucuuuuuguagccuc

SEQ ID NO: 1170761 - RNA, 24 nt, Human
uugguccuaacuuuaaucuaugcu

SEQ ID NO: 1170762 - RNA, 22 nt, Human
aaacacaauccaguaugacugc

SEQ ID NO: 1170763 - RNA, 21 nt, Human
aaaccuguauuccagaaacug

SEQ ID NO: 1170764 - RNA, 18 nt, Human
aagaagugauucucaaaa

SEQ ID NO: 1170765 - RNA, 21 nt, Human
aagcaggcucccagaggaggg

SEQ ID NO: 1170766 - RNA, 23 nt, Human
aagggguacuuguacaccuggug

SEQ ID NO: 1170767 - RNA, 19 nt, Human
aauaaaaaaguagacaugg

SEQ ID NO: 1170768 - RNA, 18 nt, Human
acaggaggcagauggcca

SEQ ID NO: 1170769 - RNA, 22 nt, Human
agaggaggguaucauuuuaugu

SEQ ID NO: 1170770 - RNA, 22 nt, Human
agcaggcucccagaggagggua

SEQ ID NO: 1170771 - RNA, 23 nt, Human
agggugcuauccuagagaagcug

SEQ ID NO: 1170772 - RNA, 19 nt, Human
caccuuuucaaacacaauc

SEQ ID NO: 1170773 - RNA, 24 nt, Human
cacgccuccgcgagcucagagcug

SEQ ID NO: 1170774 - RNA, 20 nt, Human
cacuauucgaagcaggcucc

SEQ ID NO: 1170775 - RNA, 23 nt, Human
caguaugacugcagaauugaucc

SEQ ID NO: 1170776 - RNA, 26 nt, Human
ccaugcgcaugaucucauucaguccu

SEQ ID NO: 1170777 - RNA, 26 nt, Human
cccacuauucgaagcaggcucccaga

SEQ ID NO: 1170778 - RNA, 23 nt, Human
cccaucaaagacuuaacugagca

SEQ ID NO: 1170779 - RNA, 22 nt, Human
ccccgcgcgccgcgggccccgc

SEQ ID NO: 1170780 - RNA, 18 nt, Human
cggagaaagcuggcgacc

SEQ ID NO: 1170781 - RNA, 19 nt, Human
cuggcaagaaggucuucuc

SEQ ID NO: 1170782 - RNA, 18 nt, Human
cuggugcacauccaccga

SEQ ID NO: 1170783 - RNA, 25 nt, Human
gacccccauccccgcgcgccgcggg

SEQ ID NO: 1170784 - RNA, 18 nt, Human
gagcucagagcugcccag

SEQ ID NO: 1170785 - RNA, 19 nt, Human
gagcugcccagggcuccgc

SEQ ID NO: 1170786 - RNA, 21 nt, Human
gcccagggcuccgcagaggcc

SEQ ID NO: 1170787 - RNA, 26 nt, Human
gggaagacaggaggcagauggccagg

SEQ ID NO: 1170788 - RNA, 19 nt, Human
gggguugggguacugggaa

SEQ ID NO: 1170789 - RNA, 25 nt, Human
ggguugggguacugggaagacagga

SEQ ID NO: 1170790 - RNA, 21 nt, Human
uccaccgagacccccaucccc

SEQ ID NO: 1170791 - RNA, 22 nt, Human
uccaccgagacccccauccccg

SEQ ID NO: 1170792 - RNA, 20 nt, Human
uccccgcgcgccgcgggccc

SEQ ID NO: 1170793 - RNA, 22 nt, Human
uccccgcgcgccgcgggccccg

SEQ ID NO: 1170794 - RNA, 21 nt, Human
ucuuaucucccugagucccac

SEQ ID NO: 1170795 - RNA, 23 nt, Human
ugacugcagaauugaucaagcug

SEQ ID NO: 1170796 - RNA, 18 nt, Human
ugcacauccaccgagacc

SEQ ID NO: 1170797 - RNA, 22 nt, Human
ugcccagggcuccgcagaggcc

SEQ ID NO: 1170798 - RNA, 20 nt, Human
ugcucgaagggguacuuguu

SEQ ID NO: 1170799 - RNA, 19 nt, Human
ugggaagacaggaggcaga

SEQ ID NO: 1170800 - RNA, 20 nt, Human
ugucauaaaaauccagcaag

SEQ ID NO: 1170801 - RNA, 19 nt, Human
ugugaugugcuguggccaa

SEQ ID NO: 1170802 - RNA, 20 nt, Human
ugugcuguggccaagaagug

SEQ ID NO: 1170803 - RNA, 26 nt, Human
uucaaacacaauccaguaugacugca

SEQ ID NO: 1170804 - RNA, 26 nt, Human
uuccagaaacugugucuuccuggugg

SEQ ID NO: 1170805 - RNA, 24 nt, Human
uugugucauaaaaauccagcaaga

SEQ ID NO: 1170806 - RNA, 21 nt, Human
aaagaauggcaggaugcccuc

SEQ ID NO: 1170807 - RNA, 26 nt, Human
aagagacccuuguccuaaagucccag

SEQ ID NO: 1170808 - RNA, 18 nt, Human
aaguauccaccucacacc

SEQ ID NO: 1170809 - RNA, 24 nt, Human
accauagaaauucuacacaguaac

SEQ ID NO: 1170810 - RNA, 25 nt, Human
accaugguggggcugcgucugaggg

SEQ ID NO: 1170811 - RNA, 21 nt, Human
acgggggcagagcuggucucu

SEQ ID NO: 1170812 - RNA, 21 nt, Human
agaaauccucccuuugcagcc

SEQ ID NO: 1170813 - RNA, 21 nt, Human
agaagauggcagaaguuguuc

SEQ ID NO: 1170814 - RNA, 21 nt, Human
agaauguucaaaguauccacc

SEQ ID NO: 1170815 - RNA, 20 nt, Human
agcaacgccaacaaucccag

SEQ ID NO: 1170816 - RNA, 21 nt, Human
agcaggggugcgcugcgcccu

SEQ ID NO: 1170817 - RNA, 23 nt, Human
agcuggucucuugacgugacaca

SEQ ID NO: 1170818 - RNA, 18 nt, Human
aggaccaugguggggcug

SEQ ID NO: 1170819 - RNA, 23 nt, Human
aggccacgccaucuauccuccca

SEQ ID NO: 1170820 - RNA, 21 nt, Human
agggagcuggccgcggagugg

SEQ ID NO: 1170821 - RNA, 22 nt, Human
agggcaggcuuggaccccaucu

SEQ ID NO: 1170822 - RNA, 18 nt, Human
agguguaauguuuggugg

SEQ ID NO: 1170823 - RNA, 19 nt, Human
aucccaccguugucacacc

SEQ ID NO: 1170824 - RNA, 22 nt, Human
augcugccuugggaggacacag

SEQ ID NO: 1170825 - RNA, 23 nt, Human
auucuuucucaugcugcuccgcc

SEQ ID NO: 1170826 - RNA, 23 nt, Human
caaagaagcaacgccaacaaucc

SEQ ID NO: 1170827 - RNA, 20 nt, Human
cacaccccugcugcagcccc

SEQ ID NO: 1170828 - RNA, 20 nt, Human
cacuuuugcuuuccuggagg

SEQ ID NO: 1170829 - RNA, 21 nt, Human
cagagggaaaaagauauggca

SEQ ID NO: 1170830 - RNA, 19 nt, Human
caggauggaugguggggca

SEQ ID NO: 1170831 - RNA, 20 nt, Human
caggccccagaagauggcag

SEQ ID NO: 1170832 - RNA, 24 nt, Human
caggccccagaagauggcagaagg

SEQ ID NO: 1170833 - RNA, 19 nt, Human
caguugagccacgggggca

SEQ ID NO: 1170834 - RNA, 24 nt, Human
caucuccaccaccacggcugaggg

SEQ ID NO: 1170835 - RNA, 21 nt, Human
ccaacaaucccaccguuguca

SEQ ID NO: 1170836 - RNA, 22 nt, Human
ccacccagggcaggaauuucug

SEQ ID NO: 1170837 - RNA, 19 nt, Human
ccaucuauccucccaccca

SEQ ID NO: 1170838 - RNA, 22 nt, Human
cccaugcucaaguccccaaaga

SEQ ID NO: 1170839 - RNA, 20 nt, Human
ccccaaagaauggcaggaug

SEQ ID NO: 1170840 - RNA, 22 nt, Human
ccccaaagaauggcaggaugcc

SEQ ID NO: 1170841 - RNA, 24 nt, Human
cccccuuuaggacaccauagaaau

SEQ ID NO: 1170842 - RNA, 21 nt, Human
ccucccacccagggcaggaau

SEQ ID NO: 1170843 - RNA, 21 nt, Human
ccuccuccgcgcagcaggggu

SEQ ID NO: 1170844 - RNA, 23 nt, Human
ccuguggcugguagaauuggaac

SEQ ID NO: 1170845 - RNA, 19 nt, Human
cgagaguggggaucccgga

SEQ ID NO: 1170846 - RNA, 22 nt, Human
cggaggucugucugcuguccgg

SEQ ID NO: 1170847 - RNA, 20 nt, Human
cucacugccccugcugaugc

SEQ ID NO: 1170848 - RNA, 26 nt, Human
cucagaauguucaaaguauccaccuc

SEQ ID NO: 1170849 - RNA, 20 nt, Human
cuccaagcgccgcugcugcc

SEQ ID NO: 1170850 - RNA, 19 nt, Human
cugaugcacgugagggcgg

SEQ ID NO: 1170851 - RNA, 21 nt, Human
cugaugcacgugagggcgggc

SEQ ID NO: 1170852 - RNA, 22 nt, Human
cugcagcccccuuuaggacacc

SEQ ID NO: 1170853 - RNA, 18 nt, Human
cugcgcccuccaaccggc

SEQ ID NO: 1170854 - RNA, 23 nt, Human
cuggucucuugagaacgucagaa

SEQ ID NO: 1170855 - RNA, 20 nt, Human
gagaacgucagaauuuuugc

SEQ ID NO: 1170856 - RNA, 22 nt, Human
gaggcaguggacaccagggaag

SEQ ID NO: 1170857 - RNA, 22 nt, Human
gagggcgggcucccccgugagg

SEQ ID NO: 1170858 - RNA, 22 nt, Human
gagguguaauguuuggugggag

SEQ ID NO: 1170859 - RNA, 19 nt, Human
gccuugggaggacacagag

SEQ ID NO: 1170860 - RNA, 19 nt, Human
ggaaaagccacccguaggg

SEQ ID NO: 1170861 - RNA, 26 nt, Human
ggcacaaagacggauuugaagggacg

SEQ ID NO: 1170862 - RNA, 18 nt, Human
gggaggacacagaggagg

SEQ ID NO: 1170863 - RNA, 18 nt, Human
ggggcagagcuggucucu

SEQ ID NO: 1170864 - RNA, 23 nt, Human
gguucauuugcugggaaacacgg

SEQ ID NO: 1170865 - RNA, 19 nt, Human
guggauccgggccucacug

SEQ ID NO: 1170866 - RNA, 18 nt, Human
uaggaaaagccacccgua

SEQ ID NO: 1170867 - RNA, 20 nt, Human
uaggauggucaucucugggc

SEQ ID NO: 1170868 - RNA, 19 nt, Human
uauccaccucacaccccgc

SEQ ID NO: 1170869 - RNA, 18 nt, Human
ucaaaacuccaguuccca

SEQ ID NO: 1170870 - RNA, 23 nt, Human
ucaaaguauccaccucacacccc

SEQ ID NO: 1170871 - RNA, 24 nt, Human
uccaugcuggggcauaaagugggc

SEQ ID NO: 1170872 - RNA, 22 nt, Human
ucccggacuggaggggucucug

SEQ ID NO: 1170873 - RNA, 19 nt, Human
ucucacgguuuugacuugc

SEQ ID NO: 1170874 - RNA, 22 nt, Human
ucugcugaguucagcucagccc

SEQ ID NO: 1170875 - RNA, 23 nt, Human
ucugguuucaccaggauggaugg

SEQ ID NO: 1170876 - RNA, 21 nt, Human
ucuuucucaugcugcuccgcc

SEQ ID NO: 1170877 - RNA, 23 nt, Human
ugaggccgaaggaccaugguggg

SEQ ID NO: 1170878 - RNA, 19 nt, Human
ugccuugggaggacacaga

SEQ ID NO: 1170879 - RNA, 20 nt, Human
ugcgugccugaggcagugga

SEQ ID NO: 1170880 - RNA, 19 nt, Human
ugcugaggccgaaggacca

SEQ ID NO: 1170881 - RNA, 19 nt, Human
uggaggugaaauaggaaga

SEQ ID NO: 1170882 - RNA, 23 nt, Human
ugggaggacacagaggaggugga

SEQ ID NO: 1170883 - RNA, 19 nt, Human
ugggagguguaauguuugg

SEQ ID NO: 1170884 - RNA, 22 nt, Human
ugggcaaauaggauggucaucu

SEQ ID NO: 1170885 - RNA, 21 nt, Human
uggggcugcgucugagggagc

SEQ ID NO: 1170886 - RNA, 21 nt, Human
uguccggaguggcagccacuu

SEQ ID NO: 1170887 - RNA, 20 nt, Human
uucaaaguauccaccucaca

SEQ ID NO: 1170888 - RNA, 24 nt, Human
uucaaaguauccaccucacacccc

SEQ ID NO: 1170889 - RNA, 22 nt, Human
uucaggcugggacgccuugagg

SEQ ID NO: 1170890 - RNA, 19 nt, Human
uucauuugcugggaaacac

SEQ ID NO: 1170891 - RNA, 23 nt, Human
uugcugggaaacacggucugcgu

SEQ ID NO: 1170892 - RNA, 23 nt, Human
uuucaaaacuccaguucccaccu

SEQ ID NO: 1170893 - RNA, 21 nt, Human
uuucugguuucaccaggaugg

SEQ ID NO: 1170894 - RNA, 18 nt, Human
uuuucugguuucaccagg

SEQ ID NO: 1170895 - RNA, 23 nt, Human
aaaaagcaauuguuccacugaga

SEQ ID NO: 1170896 - RNA, 23 nt, Human
aggguguuggggaguaaggagga

SEQ ID NO: 1170897 - RNA, 23 nt, Human
ccacugagagguuugagaggagg

SEQ ID NO: 1170898 - RNA, 22 nt, Human
cccuuuggcaauaagcugguuu

SEQ ID NO: 1170899 - RNA, 21 nt, Human
cuuaggaaaaagcaauuguuc

SEQ ID NO: 1170900 - RNA, 18 nt, Human
gaggaggguguuggggag

SEQ ID NO: 1170901 - RNA, 22 nt, Human
gcuauccuuuuucccuuuggca

SEQ ID NO: 1170902 - RNA, 20 nt, Human
ggaggaggaguuaucuugcu

SEQ ID NO: 1170903 - RNA, 22 nt, Human
gguguuggggaguaaggaggag

SEQ ID NO: 1170904 - RNA, 24 nt, Human
ugagagguuugagaggaggguguu

SEQ ID NO: 1170905 - RNA, 23 nt, Human
uggggaguaaggaggaggaguua

SEQ ID NO: 1170906 - RNA, 18 nt, Human
guagaaaucccucaaaug

SEQ ID NO: 1170907 - RNA, 20 nt, Human
uggcccgggcaaccacacag

SEQ ID NO: 1170908 - RNA, 21 nt, Human
uucuggcccgggcaaccacac

SEQ ID NO: 1170909 - RNA, 19 nt, Human
agaggaacgaagcgcucag

SEQ ID NO: 1170910 - RNA, 23 nt, Human
agcagcggcggcggcggcggcgg

SEQ ID NO: 1170911 - RNA, 23 nt, Human
agcggcggcggcggcggcggcgg

SEQ ID NO: 1170912 - RNA, 19 nt, Human
aggaggaaaggaugcggcg

SEQ ID NO: 1170913 - RNA, 21 nt, Human
cagcagcagcgacacguccag

SEQ ID NO: 1170914 - RNA, 23 nt, Human
cagcggcagcagcagcagcgaca

SEQ ID NO: 1170915 - RNA, 23 nt, Human
cagcggcagcggcagcagcagca

SEQ ID NO: 1170916 - RNA, 25 nt, Human
cggcagcagcagcagcgacacgucc

SEQ ID NO: 1170917 - RNA, 18 nt, Human
cguggcuccgggcgccuc

SEQ ID NO: 1170918 - RNA, 19 nt, Human
gacccgacuccuacccggc

SEQ ID NO: 1170919 - RNA, 22 nt, Human
gcagcagcagcgacacguccag

SEQ ID NO: 1170920 - RNA, 23 nt, Human
gcagcggcggcggcggcggcggc

SEQ ID NO: 1170921 - RNA, 22 nt, Human
gcagcggcggcggcggcggcuu

SEQ ID NO: 1170922 - RNA, 20 nt, Human
gcggcggcggcagcggcagc

SEQ ID NO: 1170923 - RNA, 20 nt, Human
gcggcggcggcggcggcagc

SEQ ID NO: 1170924 - RNA, 20 nt, Human
gcggcggcggcggcggcggc

SEQ ID NO: 1170925 - RNA, 20 nt, Human
gcggcggcggcggcggcggc

SEQ ID NO: 1170926 - RNA, 24 nt, Human
gcggcggcggcggcggcggcagcg

SEQ ID NO: 1170927 - RNA, 24 nt, Human
gcggcggcggcggcggcggcggca

SEQ ID NO: 1170928 - RNA, 18 nt, Human
gcucaggagcaaacuagg

SEQ ID NO: 1170929 - RNA, 21 nt, Human
ggcggcagcggcagcggcagc

SEQ ID NO: 1170930 - RNA, 22 nt, Human
uagggcuagacccgacuccuac

SEQ ID NO: 1170931 - RNA, 22 nt, Human
uccagcagcggcggcggcggcg

SEQ ID NO: 1170932 - RNA, 24 nt, Human
uccagcagcggcggcggcggcuuu

SEQ ID NO: 1170933 - RNA, 24 nt, Human
ugcgacggcgacggggacggauac

SEQ ID NO: 1170934 - RNA, 23 nt, Human
uuccaaacuucagagcccaaaga

SEQ ID NO: 1170935 - RNA, 24 nt, Human
uucggcguggcuccgggcgccucc

SEQ ID NO: 1170936 - RNA, 22 nt, Human
acuuuuuuuuuuuuuuuuuuuc

SEQ ID NO: 1170937 - RNA, 21 nt, Human
cacuauuugaagucugaacuu

SEQ ID NO: 1170938 - RNA, 24 nt, Human
ccaguggcucuuccagaacuacug

SEQ ID NO: 1170939 - RNA, 23 nt, Human
cucauccccaguggcucuuccag

SEQ ID NO: 1170940 - RNA, 25 nt, Human
ugucucauccccaguggcucuucca

SEQ ID NO: 1170941 - RNA, 19 nt, Human
uucauauccaucagcucgu

SEQ ID NO: 1170942 - RNA, 25 nt, Human
uuccagaacuacugccuuccuggug

SEQ ID NO: 1170943 - RNA, 20 nt, Human
uuuuuuuuuuuuucuuucac

SEQ ID NO: 1170944 - RNA, 22 nt, Human
aaaacaaaugggcuacaggccc

SEQ ID NO: 1170945 - RNA, 18 nt, Human
aacaaguuaguuucuucc

SEQ ID NO: 1170946 - RNA, 21 nt, Human
aagcaagaacaucuucacaug

SEQ ID NO: 1170947 - RNA, 18 nt, Human
aaucauggcagaaggcaa

SEQ ID NO: 1170948 - RNA, 19 nt, Human
aauuacaauucaacaugag

SEQ ID NO: 1170949 - RNA, 22 nt, Human
acacaaucaugccuucccaaca

SEQ ID NO: 1170950 - RNA, 23 nt, Human
accaccaggucccucccccaaca

SEQ ID NO: 1170951 - RNA, 23 nt, Human
accauaucauucuccccagccuc

SEQ ID NO: 1170952 - RNA, 20 nt, Human
acucacaguucuguaggcuu

SEQ ID NO: 1170953 - RNA, 21 nt, Human
acugggaauuacaauucaaca

SEQ ID NO: 1170954 - RNA, 19 nt, Human
agaucuugcgggaauuuac

SEQ ID NO: 1170955 - RNA, 22 nt, Human
agccaaaccauaucauucuccc

SEQ ID NO: 1170956 - RNA, 20 nt, Human
agccucugccuauuacccag

SEQ ID NO: 1170957 - RNA, 23 nt, Human
aggggaaauuugcucccaugauc

SEQ ID NO: 1170958 - RNA, 18 nt, Human
agucaugaaaucuucaag

SEQ ID NO: 1170959 - RNA, 26 nt, Human
aucaccuccuaccagguccccuccca

SEQ ID NO: 1170960 - RNA, 19 nt, Human
auccaaucaccuccuacca

SEQ ID NO: 1170961 - RNA, 19 nt, Human
auucuccccagccucuccc

SEQ ID NO: 1170962 - RNA, 22 nt, Human
caaaacaaaugggcuacaggcc

SEQ ID NO: 1170963 - RNA, 24 nt, Human
caaagaacuaccugagaccggggc

SEQ ID NO: 1170964 - RNA, 18 nt, Human
caacacugggaauuacaa

SEQ ID NO: 1170965 - RNA, 23 nt, Human
caaccauaucagagggagguaau

SEQ ID NO: 1170966 - RNA, 21 nt, Human
caagaacaucuucacauggug

SEQ ID NO: 1170967 - RNA, 26 nt, Human
caagacacaaucaugccuucccaaca

SEQ ID NO: 1170968 - RNA, 23 nt, Human
caauaaguuccucaucuccaucu

SEQ ID NO: 1170969 - RNA, 21 nt, Human
cagaaggcaaaggggaagcaa

SEQ ID NO: 1170970 - RNA, 24 nt, Human
cagccucucccaaaucucauauua

SEQ ID NO: 1170971 - RNA, 24 nt, Human
caggucccucccccaacacuggga

SEQ ID NO: 1170972 - RNA, 19 nt, Human
cauagcaagagugaccguu

SEQ ID NO: 1170973 - RNA, 21 nt, Human
cauaucacugucagcauuuug

SEQ ID NO: 1170974 - RNA, 23 nt, Human
caugauccaaucaccuccuacca

SEQ ID NO: 1170975 - RNA, 22 nt, Human
caugcaagucugaaacccaaca

SEQ ID NO: 1170976 - RNA, 20 nt, Human
cauuccaccuaugagccugu

SEQ ID NO: 1170977 - RNA, 22 nt, Human
ccaagguacaaugagaguacag

SEQ ID NO: 1170978 - RNA, 22 nt, Human
ccagccucucccaaaucucaua

SEQ ID NO: 1170979 - RNA, 21 nt, Human
ccccaaaauggguuugucuuu

SEQ ID NO: 1170980 - RNA, 22 nt, Human
cccuuuuaaacauaaguuccaa

SEQ ID NO: 1170981 - RNA, 20 nt, Human
ccuaccagguccccucccaa

SEQ ID NO: 1170982 - RNA, 23 nt, Human
cuaccaccaggucccucccccaa

SEQ ID NO: 1170983 - RNA, 18 nt, Human
cuaccagguccccuccca

SEQ ID NO: 1170984 - RNA, 26 nt, Human
cugaaaaguccaaagucuuaucugag

SEQ ID NO: 1170985 - RNA, 19 nt, Human
cugaaacccaacagggaag

SEQ ID NO: 1170986 - RNA, 21 nt, Human
cugguaccaguuuucuguauu

SEQ ID NO: 1170987 - RNA, 25 nt, Human
cuucaugauucaaucaccuaccacc

SEQ ID NO: 1170988 - RNA, 18 nt, Human
cuuuuaaaccaucagauc

SEQ ID NO: 1170989 - RNA, 18 nt, Human
cuuuuaaaccaucagauc

SEQ ID NO: 1170990 - RNA, 21 nt, Human
gagauuuggauggggguacag

SEQ ID NO: 1170991 - RNA, 28 nt, Human
gagcaagucucuaggaagucugaaacuu

SEQ ID NO: 1170992 - RNA, 21 nt, Human
ggagacagagagaguaaagug

SEQ ID NO: 1170993 - RNA, 18 nt, Human
ggcgggggaggccucagg

SEQ ID NO: 1170994 - RNA, 18 nt, Human
gggcaggggcacaaugcu

SEQ ID NO: 1170995 - RNA, 18 nt, Human
guaaauguuccuguugca

SEQ ID NO: 1170996 - RNA, 20 nt, Human
gugaaggggaaugugccaca

SEQ ID NO: 1170997 - RNA, 27 nt, Human
uaaaucaucucucaaguucaaaguucc

SEQ ID NO: 1170998 - RNA, 19 nt, Human
uaccagguccccucccaac

SEQ ID NO: 1170999 - RNA, 25 nt, Human
uagaaaaauaccaggucacaucuug

SEQ ID NO: 1171000 - RNA, 21 nt, Human
uagaaggcaaaggggaagcaa

SEQ ID NO: 1171001 - RNA, 20 nt, Human
uagggauacagagcaaccau

SEQ ID NO: 1171002 - RNA, 20 nt, Human
uauagcagugccacacuucu

SEQ ID NO: 1171003 - RNA, 20 nt, Human
uaucacugucagcauuuugg

SEQ ID NO: 1171004 - RNA, 24 nt, Human
uauguaaauuucuaccacuggcuu

SEQ ID NO: 1171005 - RNA, 21 nt, Human
ucaaguucaaaguuccauaca

SEQ ID NO: 1171006 - RNA, 22 nt, Human
ucacaccgucucuucauacaua

SEQ ID NO: 1171007 - RNA, 24 nt, Human
ucaccuccuaccagguccccuccc

SEQ ID NO: 1171008 - RNA, 19 nt, Human
ucaugaaaucuucaagcuc

SEQ ID NO: 1171009 - RNA, 19 nt, Human
ucauucuccccagccucuc

SEQ ID NO: 1171010 - RNA, 26 nt, Human
ucauucuccccagccucucccaaauc

SEQ ID NO: 1171011 - RNA, 18 nt, Human
uccaagguacaaugagag

SEQ ID NO: 1171012 - RNA, 21 nt, Human
uccagccucugccuauuaccc

SEQ ID NO: 1171013 - RNA, 21 nt, Human
ucccacaucuucugucuucuu

SEQ ID NO: 1171014 - RNA, 19 nt, Human
uccccagccucucccaaau

SEQ ID NO: 1171015 - RNA, 22 nt, Human
uccccagccucucccaaaucuc

SEQ ID NO: 1171016 - RNA, 20 nt, Human
ucccccaaagucuuaacucc

SEQ ID NO: 1171017 - RNA, 20 nt, Human
ucuccaaacuguuccagccu

SEQ ID NO: 1171018 - RNA, 23 nt, Human
ucuccccagccucucccaaaucu

SEQ ID NO: 1171019 - RNA, 22 nt, Human
ucucuaggaagucugaaacuuu

SEQ ID NO: 1171020 - RNA, 19 nt, Human
ucugaucucuccaaacugu

SEQ ID NO: 1171021 - RNA, 23 nt, Human
ucuuacagucaugguagaaggca

SEQ ID NO: 1171022 - RNA, 22 nt, Human
ucuuuauagcagugccacacuu

SEQ ID NO: 1171023 - RNA, 18 nt, Human
ugacaggagaaacagcau

SEQ ID NO: 1171024 - RNA, 20 nt, Human
ugagaccacaucagccugga

SEQ ID NO: 1171025 - RNA, 24 nt, Human
ugagccuguaaaauaaaaaacaag

SEQ ID NO: 1171026 - RNA, 22 nt, Human
ugauccaaucaccuccuaccag

SEQ ID NO: 1171027 - RNA, 22 nt, Human
ugauuccaugucucacauccag

SEQ ID NO: 1171028 - RNA, 23 nt, Human
ugauuccaugucucacauccagg

SEQ ID NO: 1171029 - RNA, 20 nt, Human
ugcaagucugaaacccaaca

SEQ ID NO: 1171030 - RNA, 24 nt, Human
ugccagguacccuaaaucaucucu

SEQ ID NO: 1171031 - RNA, 21 nt, Human
ugccagucucugcuaaaucau

SEQ ID NO: 1171032 - RNA, 23 nt, Human
uggguaaauguuccuguugcaaa

SEQ ID NO: 1171033 - RNA, 24 nt, Human
uggguuugucuuuucuauagcaug

SEQ ID NO: 1171034 - RNA, 21 nt, Human
ugugaaggggaaugugccaca

SEQ ID NO: 1171035 - RNA, 18 nt, Human
uguuccagccucugccua

SEQ ID NO: 1171036 - RNA, 23 nt, Human
uucacauagugacaggagaaaca

SEQ ID NO: 1171037 - RNA, 21 nt, Human
uucacuguccauaucacuguc

SEQ ID NO: 1171038 - RNA, 21 nt, Human
uucuccccagccucucccaaa

SEQ ID NO: 1171039 - RNA, 19 nt, Human
uucugcauuuugagguauc

SEQ ID NO: 1171040 - RNA, 26 nt, Human
uugcuucugcauuuugagguaucuuu

SEQ ID NO: 1171041 - RNA, 24 nt, Human
uugguuacaauuauugagcaaguc

SEQ ID NO: 1171042 - RNA, 22 nt, Human
aaaaaacccacagcuucgcagg

SEQ ID NO: 1171043 - RNA, 18 nt, Human
aaaaacaugagaagagcc

SEQ ID NO: 1171044 - RNA, 26 nt, Human
aaaacaaacaaacaaacaaaaaaccc

SEQ ID NO: 1171045 - RNA, 24 nt, Human
aaaacaggaaaaaaauaccuucag

SEQ ID NO: 1171046 - RNA, 26 nt, Human
aaacaaacaaaaaacccacagcuucg

SEQ ID NO: 1171047 - RNA, 22 nt, Human
aaacaaacaaacaaaaaaccca

SEQ ID NO: 1171048 - RNA, 21 nt, Human
aaacaggaaaaaaauaccuuc

SEQ ID NO: 1171049 - RNA, 24 nt, Human
aaacaggaaaaaaauaccuucagc

SEQ ID NO: 1171050 - RNA, 23 nt, Human
aaacaugagaagagcuuauaaag

SEQ ID NO: 1171051 - RNA, 21 nt, Human
aaaggagggugugucgaagcu

SEQ ID NO: 1171052 - RNA, 19 nt, Human
aaauacaagacaaaacucc

SEQ ID NO: 1171053 - RNA, 18 nt, Human
aaccaccgacauuaacgu

SEQ ID NO: 1171054 - RNA, 23 nt, Human
aacuucaagcauguguuuggcac

SEQ ID NO: 1171055 - RNA, 26 nt, Human
aagaaaacaggaaaaaaauaccuuca

SEQ ID NO: 1171056 - RNA, 19 nt, Human
aagacucaggcauaagagc

SEQ ID NO: 1171057 - RNA, 22 nt, Human
aaguauccccacaggacucucc

SEQ ID NO: 1171058 - RNA, 24 nt, Human
aaguugaggcugcagugagccaag

SEQ ID NO: 1171059 - RNA, 20 nt, Human
aauugcuuuucuaaauccau

SEQ ID NO: 1171060 - RNA, 23 nt, Human
acaagacaaaacuccacgccccu

SEQ ID NO: 1171061 - RNA, 19 nt, Human
acaaggccaaaauacaaga

SEQ ID NO: 1171062 - RNA, 24 nt, Human
acaccacugcacuccagucugggc

SEQ ID NO: 1171063 - RNA, 24 nt, Human
acaccuguaauuccagcacuuggg

SEQ ID NO: 1171064 - RNA, 25 nt, Human
acagagcgagauccugccucuaaaa

SEQ ID NO: 1171065 - RNA, 20 nt, Human
acagagugacacccugucuc

SEQ ID NO: 1171066 - RNA, 24 nt, Human
acagagugagacccugucucuaaa

SEQ ID NO: 1171067 - RNA, 20 nt, Human
acaggaaaaaaauaccuuca

SEQ ID NO: 1171068 - RNA, 22 nt, Human
acagggccagccagucccaugc

SEQ ID NO: 1171069 - RNA, 18 nt, Human
acagugugagccaauguu

SEQ ID NO: 1171070 - RNA, 21 nt, Human
accaacaaggccaaaauacaa

SEQ ID NO: 1171071 - RNA, 22 nt, Human
accacugcacuccagucugggc

SEQ ID NO: 1171072 - RNA, 18 nt, Human
accauagcccagggagcu

SEQ ID NO: 1171073 - RNA, 22 nt, Human
accucaaaacucagagcccccg

SEQ ID NO: 1171074 - RNA, 24 nt, Human
accucguuucuacuaaaaauacaa

SEQ ID NO: 1171075 - RNA, 21 nt, Human
accuggguguaguggcaugcg

SEQ ID NO: 1171076 - RNA, 18 nt, Human
accuguaaucccagcacu

SEQ ID NO: 1171077 - RNA, 24 nt, Human
acggcgcuacugcacuccagucug

SEQ ID NO: 1171078 - RNA, 24 nt, Human
acuccagucugggcaacagaguga

SEQ ID NO: 1171079 - RNA, 24 nt, Human
acuccagucugggcgacagaguga

SEQ ID NO: 1171080 - RNA, 18 nt, Human
acucgggaggcagaggug

SEQ ID NO: 1171081 - RNA, 20 nt, Human
acucgggaggcagagguggg

SEQ ID NO: 1171082 - RNA, 18 nt, Human
acugcacuccagucuggg

SEQ ID NO: 1171083 - RNA, 18 nt, Human
acugcacuccagucuggg

SEQ ID NO: 1171084 - RNA, 19 nt, Human
acugcacuccagucugggc

SEQ ID NO: 1171085 - RNA, 19 nt, Human
acugcacuccagucugggc

SEQ ID NO: 1171086 - RNA, 24 nt, Human
acugcacuccagucugggcaacag

SEQ ID NO: 1171087 - RNA, 24 nt, Human
acugcacuccagucugggcaacag

SEQ ID NO: 1171088 - RNA, 21 nt, Human
acugcacuccagucugggcga

SEQ ID NO: 1171089 - RNA, 22 nt, Human
acugcacuccagucugggcgac

SEQ ID NO: 1171090 - RNA, 24 nt, Human
acugcacuccagucugggcgacag

SEQ ID NO: 1171091 - RNA, 26 nt, Human
acugcacuccagucugggcgacagag

SEQ ID NO: 1171092 - RNA, 24 nt, Human
acugcacuccugccugggugacag

SEQ ID NO: 1171093 - RNA, 26 nt, Human
acugcacuccugccugggugacagag

SEQ ID NO: 1171094 - RNA, 24 nt, Human
acugugccacugcacuccugccug

SEQ ID NO: 1171095 - RNA, 19 nt, Human
agaacgcaggcggcgggag

SEQ ID NO: 1171096 - RNA, 19 nt, Human
agacaaaacuccacgcccc

SEQ ID NO: 1171097 - RNA, 20 nt, Human
agacaaaacuccacgccccu

SEQ ID NO: 1171098 - RNA, 18 nt, Human
agaggugggaggauugcu

SEQ ID NO: 1171099 - RNA, 18 nt, Human
agagugaagaaaacagga

SEQ ID NO: 1171100 - RNA, 24 nt, Human
agagugaagaaaacaggaaaaaaa

SEQ ID NO: 1171101 - RNA, 23 nt, Human
agauacuucagcaggacaagaug

SEQ ID NO: 1171102 - RNA, 24 nt, Human
agcauguguuuggcacagagugag

SEQ ID NO: 1171103 - RNA, 23 nt, Human
agccuggccaacguggugaaacc

SEQ ID NO: 1171104 - RNA, 25 nt, Human
agccuggccaacguggugaaaccuc

SEQ ID NO: 1171105 - RNA, 20 nt, Human
agccugggcaacauggagaa

SEQ ID NO: 1171106 - RNA, 24 nt, Human
agccugggcaacauggagaagcuc

SEQ ID NO: 1171107 - RNA, 23 nt, Human
agccuguggucccagcuacuggg

SEQ ID NO: 1171108 - RNA, 23 nt, Human
agccuguggucccagcuacuggg

SEQ ID NO: 1171109 - RNA, 18 nt, Human
agcgcuggaaguugaggc

SEQ ID NO: 1171110 - RNA, 25 nt, Human
aggaggaaggaggagauuugggucg

SEQ ID NO: 1171111 - RNA, 20 nt, Human
aggaguuugagaccagccug

SEQ ID NO: 1171112 - RNA, 21 nt, Human
aggcagaggugggaggauugc

SEQ ID NO: 1171113 - RNA, 23 nt, Human
aggcagaggugggaggauugcuu

SEQ ID NO: 1171114 - RNA, 18 nt, Human
aggcaggagaaucacuug

SEQ ID NO: 1171115 - RNA, 22 nt, Human
aggcaggagaaucacuugaucc

SEQ ID NO: 1171116 - RNA, 26 nt, Human
aggcagguggaucauuugaggucagg

SEQ ID NO: 1171117 - RNA, 21 nt, Human
aggcggagcuugcagugagcc

SEQ ID NO: 1171118 - RNA, 24 nt, Human
aggcggagcuugcagugagccgag

SEQ ID NO: 1171119 - RNA, 24 nt, Human
aggcugaggcaggagaaucacuug

SEQ ID NO: 1171120 - RNA, 22 nt, Human
agguggaucauuugaggucagg

SEQ ID NO: 1171121 - RNA, 22 nt, Human
agucugggcaacagagugagac

SEQ ID NO: 1171122 - RNA, 22 nt, Human
agugaagaaaacaggaaaaaaa

SEQ ID NO: 1171123 - RNA, 26 nt, Human
auaaagccaauagaaaaugucaagcu

SEQ ID NO: 1171124 - RNA, 24 nt, Human
aucauuugaggucaggaguuugag

SEQ ID NO: 1171125 - RNA, 22 nt, Human
auggagaagcucugucucuaaa

SEQ ID NO: 1171126 - RNA, 24 nt, Human
auuacaccacugcacuccagucug

SEQ ID NO: 1171127 - RNA, 24 nt, Human
auuugaggucaggaguuugagacc

SEQ ID NO: 1171128 - RNA, 24 nt, Human
caaacaaaaaacccacagcuucgc

SEQ ID NO: 1171129 - RNA, 26 nt, Human
caaacaaacaaacaaaaaacccacag

SEQ ID NO: 1171130 - RNA, 21 nt, Human
caaacacacagggcuucuccc

SEQ ID NO: 1171131 - RNA, 22 nt, Human
caacagagugagacccugucuc

SEQ ID NO: 1171132 - RNA, 22 nt, Human
caacauggagaagcucugucuc

SEQ ID NO: 1171133 - RNA, 24 nt, Human
caacauggagaagcucugucucua

SEQ ID NO: 1171134 - RNA, 19 nt, Human
caaccacuugucaaggagc

SEQ ID NO: 1171135 - RNA, 21 nt, Human
caacccagcccucucagccag

SEQ ID NO: 1171136 - RNA, 24 nt, Human
caacguggugaaaccucguuucua

SEQ ID NO: 1171137 - RNA, 18 nt, Human
caagacaaaacuccacgc

SEQ ID NO: 1171138 - RNA, 21 nt, Human
caaggagcagacauaggcacc

SEQ ID NO: 1171139 - RNA, 23 nt, Human
cacaccuguaauuccagcacuug

SEQ ID NO: 1171140 - RNA, 18 nt, Human
cacaggacucucccuggg

SEQ ID NO: 1171141 - RNA, 18 nt, Human
cacagggccagccagucc

SEQ ID NO: 1171142 - RNA, 24 nt, Human
caccacugcacuccagucugggca

SEQ ID NO: 1171143 - RNA, 24 nt, Human
caccccaacuucaagcauguguuu

SEQ ID NO: 1171144 - RNA, 19 nt, Human
cacccuuucagcagccaag

SEQ ID NO: 1171145 - RNA, 19 nt, Human
caccgacauuaacgucacc

SEQ ID NO: 1171146 - RNA, 18 nt, Human
caccuccaugccucuccu

SEQ ID NO: 1171147 - RNA, 19 nt, Human
caccuguaauuccagcacu

SEQ ID NO: 1171148 - RNA, 22 nt, Human
caccuuguccccaccugccuuc

SEQ ID NO: 1171149 - RNA, 23 nt, Human
cacgccccucauauguaacaacu

SEQ ID NO: 1171150 - RNA, 22 nt, Human
cacuccagucugggcaacagag

SEQ ID NO: 1171151 - RNA, 24 nt, Human
cacuccagucugggcaacagagug

SEQ ID NO: 1171152 - RNA, 22 nt, Human
cacuccagucugggcgacagag

SEQ ID NO: 1171153 - RNA, 22 nt, Human
cacuccagucugggcgacagag

SEQ ID NO: 1171154 - RNA, 24 nt, Human
cacuccagucugggcgacagagug

SEQ ID NO: 1171155 - RNA, 23 nt, Human
cacuccugccugggugacagagc

SEQ ID NO: 1171156 - RNA, 24 nt, Human
cacuccugccugggugacagagcg

SEQ ID NO: 1171157 - RNA, 19 nt, Human
cacugcacuccagucuggg

SEQ ID NO: 1171158 - RNA, 21 nt, Human
cacugcacuccagucugggca

SEQ ID NO: 1171159 - RNA, 22 nt, Human
cacugcacuccagucugggcaa

SEQ ID NO: 1171160 - RNA, 23 nt, Human
cacugcacuccagucugggcaac

SEQ ID NO: 1171161 - RNA, 24 nt, Human
cacugcacuccagucugggcaaca

SEQ ID NO: 1171162 - RNA, 23 nt, Human
cacugcacuccugccugggugac

SEQ ID NO: 1171163 - RNA, 24 nt, Human
cacugcacuccugccugggugaca

SEQ ID NO: 1171164 - RNA, 21 nt, Human
cacuugauccugggaggcgga

SEQ ID NO: 1171165 - RNA, 29 nt, Human
cagagccccugccagcccagacccaaagg

SEQ ID NO: 1171166 - RNA, 23 nt, Human
cagcacuugggaggacgaggcag

SEQ ID NO: 1171167 - RNA, 24 nt, Human
cagcacuuugagacacuaaggcgg

SEQ ID NO: 1171168 - RNA, 23 nt, Human
cagcgcaugggaggguaugcaug

SEQ ID NO: 1171169 - RNA, 24 nt, Human
cagcuacucgggaggcugaggcag

SEQ ID NO: 1171170 - RNA, 23 nt, Human
cagggacaccucuccuggccagc

SEQ ID NO: 1171171 - RNA, 24 nt, Human
cagguggaucauuugaggucagga

SEQ ID NO: 1171172 - RNA, 23 nt, Human
cagugugagccaauguugacuuu

SEQ ID NO: 1171173 - RNA, 22 nt, Human
cauaaaggaucuuccuucuucc

SEQ ID NO: 1171174 - RNA, 24 nt, Human
cauaccuguaaucccagcacuuug

SEQ ID NO: 1171175 - RNA, 23 nt, Human
caucuguaaauccagcuacucgg

SEQ ID NO: 1171176 - RNA, 23 nt, Human
caugagaagagcuuauaaagcca

SEQ ID NO: 1171177 - RNA, 20 nt, Human
ccaacguggugaaaccucgu

SEQ ID NO: 1171178 - RNA, 21 nt, Human
ccacaaaaaagagggugaacc

SEQ ID NO: 1171179 - RNA, 20 nt, Human
ccacucuggcuuccaccucc

SEQ ID NO: 1171180 - RNA, 21 nt, Human
ccacugcaccuccaccugggc

SEQ ID NO: 1171181 - RNA, 27 nt, Human
ccacugcaccuccaccugggcaccagg

SEQ ID NO: 1171182 - RNA, 20 nt, Human
ccacugcacuccagucuggg

SEQ ID NO: 1171183 - RNA, 20 nt, Human
ccacugcacuccagucuggg

SEQ ID NO: 1171184 - RNA, 21 nt, Human
ccacugcacuccagucugggc

SEQ ID NO: 1171185 - RNA, 23 nt, Human
ccacugcacuccagucugggcaa

SEQ ID NO: 1171186 - RNA, 24 nt, Human
ccacugcacuccagucugggcaac

SEQ ID NO: 1171187 - RNA, 20 nt, Human
ccacugcacuccugccuggg

SEQ ID NO: 1171188 - RNA, 20 nt, Human
ccacugcacuccugccuggg

SEQ ID NO: 1171189 - RNA, 21 nt, Human
ccacugcacuccugccugggu

SEQ ID NO: 1171190 - RNA, 24 nt, Human
ccacugcacuccugccugggugac

SEQ ID NO: 1171191 - RNA, 19 nt, Human
ccagagccccugccagccc

SEQ ID NO: 1171192 - RNA, 30 nt, Human
ccagagccccugccagcccagacccaaagg

SEQ ID NO: 1171193 - RNA, 28 nt, Human
ccagcccagacccaaaguauccccacag

SEQ ID NO: 1171194 - RNA, 21 nt, Human
ccagguucgcaccuccaugcc

SEQ ID NO: 1171195 - RNA, 23 nt, Human
cccacugcaccuccaccugggca

SEQ ID NO: 1171196 - RNA, 21 nt, Human
cccaggaguuugaggcuagcc

SEQ ID NO: 1171197 - RNA, 21 nt, Human
cccaucaacacccgcccagga

SEQ ID NO: 1171198 - RNA, 27 nt, Human
ccccaacccagcccucucagccaggcc

SEQ ID NO: 1171199 - RNA, 21 nt, Human
ccccacugcaccuccaccugg

SEQ ID NO: 1171200 - RNA, 24 nt, Human
ccccacugcaccuccaccugggca

SEQ ID NO: 1171201 - RNA, 25 nt, Human
cccucauauguaacaacugcccuaa

SEQ ID NO: 1171202 - RNA, 21 nt, Human
cccugggucccaucaacaccc

SEQ ID NO: 1171203 - RNA, 22 nt, Human
ccuccaugccucuccuuccaga

SEQ ID NO: 1171204 - RNA, 24 nt, Human
ccugacccccaacccagcccucuc

SEQ ID NO: 1171205 - RNA, 27 nt, Human
ccugacccccaacccagcccucucagc

SEQ ID NO: 1171206 - RNA, 21 nt, Human
ccuggccaacguggugaaacc

SEQ ID NO: 1171207 - RNA, 24 nt, Human
ccuggccaacguggugaaaccucg

SEQ ID NO: 1171208 - RNA, 18 nt, Human
ccugggcaacauggagaa

SEQ ID NO: 1171209 - RNA, 19 nt, Human
ccugggugacagagcgaga

SEQ ID NO: 1171210 - RNA, 20 nt, Human
ccuguggggguguuuugggg

SEQ ID NO: 1171211 - RNA, 18 nt, Human
ccuguggucccagcuacu

SEQ ID NO: 1171212 - RNA, 22 nt, Human
ccuguggucccagcuacugggg

SEQ ID NO: 1171213 - RNA, 24 nt, Human
cgagacggcgcuacugcacuccag

SEQ ID NO: 1171214 - RNA, 19 nt, Human
cgagauccugccucuaaaa

SEQ ID NO: 1171215 - RNA, 24 nt, Human
cgaggcagguggaucauuugaggu

SEQ ID NO: 1171216 - RNA, 26 nt, Human
cgaggcagguggaucauuugagguca

SEQ ID NO: 1171217 - RNA, 22 nt, Human
cggcucacaccuguaauuccag

SEQ ID NO: 1171218 - RNA, 20 nt, Human
cgggaggcugaggcaggaga

SEQ ID NO: 1171219 - RNA, 24 nt, Human
cguguguagucccaguuacucggg

SEQ ID NO: 1171220 - RNA, 21 nt, Human
cuacugcacuccagucugggc

SEQ ID NO: 1171221 - RNA, 24 nt, Human
cuacugcacuccagucugggcgac

SEQ ID NO: 1171222 - RNA, 19 nt, Human
cuaucucccucuucuucca

SEQ ID NO: 1171223 - RNA, 21 nt, Human
cucaaaacucagagcccccgu

SEQ ID NO: 1171224 - RNA, 24 nt, Human
cucacaccuguaauuccagcacuu

SEQ ID NO: 1171225 - RNA, 24 nt, Human
cucauaccuguaaucccagcacuu

SEQ ID NO: 1171226 - RNA, 27 nt, Human
cugcaccuccaccugggcaccagguuc

SEQ ID NO: 1171227 - RNA, 21 nt, Human
cuguaaauccagcuacucggg

SEQ ID NO: 1171228 - RNA, 21 nt, Human
cuguggggguguuuuggggga

SEQ ID NO: 1171229 - RNA, 24 nt, Human
cuuccagagccccugccagcccag

SEQ ID NO: 1171230 - RNA, 24 nt, Human
cuugcagugagccgagacggcgcu

SEQ ID NO: 1171231 - RNA, 22 nt, Human
cuuuaucccaagccccauccuc

SEQ ID NO: 1171232 - RNA, 19 nt, Human
gaaaccucguuucuacuaa

SEQ ID NO: 1171233 - RNA, 22 nt, Human
gaagcccaggcuucugcuucua

SEQ ID NO: 1171234 - RNA, 22 nt, Human
gacacugaacacacgagaggaa

SEQ ID NO: 1171235 - RNA, 24 nt, Human
gacagagugacacccugucucgaa

SEQ ID NO: 1171236 - RNA, 23 nt, Human
gagaaucacuugauccugggagg

SEQ ID NO: 1171237 - RNA, 18 nt, Human
gagaccagccuggccaac

SEQ ID NO: 1171238 - RNA, 24 nt, Human
gagcaucacccuuucagcagccaa

SEQ ID NO: 1171239 - RNA, 22 nt, Human
gagccaagacucaggcauaaga

SEQ ID NO: 1171240 - RNA, 18 nt, Human
gagccccugccagcccag

SEQ ID NO: 1171241 - RNA, 21 nt, Human
gagcuugcagugagccgagac

SEQ ID NO: 1171242 - RNA, 18 nt, Human
gaggcugcagugagccaa

SEQ ID NO: 1171243 - RNA, 18 nt, Human
gaggcugcagugagccaa

SEQ ID NO: 1171244 - RNA, 24 nt, Human
gaucauuugaggucaggaguuuga

SEQ ID NO: 1171245 - RNA, 22 nt, Human
gcaaggcucuuaaccauagccc

SEQ ID NO: 1171246 - RNA, 24 nt, Human
gcacuccagucugggcaacagagu

SEQ ID NO: 1171247 - RNA, 24 nt, Human
gcacuccagucugggcgacagagu

SEQ ID NO: 1171248 - RNA, 25 nt, Human
gcaggaccacaggagccaagacuca

SEQ ID NO: 1171249 - RNA, 25 nt, Human
gccaaaauacaagacaaaacuccag

SEQ ID NO: 1171250 - RNA, 21 nt, Human
gccaacguggugaaaccucgu

SEQ ID NO: 1171251 - RNA, 24 nt, Human
gccacugcacuccugccuggguga

SEQ ID NO: 1171252 - RNA, 22 nt, Human
gcuacugcacuccagucugggc

SEQ ID NO: 1171253 - RNA, 24 nt, Human
gcuacugcacuccagucugggcga

SEQ ID NO: 1171254 - RNA, 22 nt, Human
gcuggaaguugaggcugcagug

SEQ ID NO: 1171255 - RNA, 18 nt, Human
ggagcuugcagugagccg

SEQ ID NO: 1171256 - RNA, 22 nt, Human
ggaucauuugaggucaggaguu

SEQ ID NO: 1171257 - RNA, 23 nt, Human
ggcgugguggcucauaccuguaa

SEQ ID NO: 1171258 - RNA, 23 nt, Human
ggcucacaccuguaauuccagca

SEQ ID NO: 1171259 - RNA, 19 nt, Human
gggaggcagaggugggagg

SEQ ID NO: 1171260 - RNA, 23 nt, Human
gggaggcugaggcaggagaauca

SEQ ID NO: 1171261 - RNA, 22 nt, Human
gggagggucacuggagcccagg

SEQ ID NO: 1171262 - RNA, 18 nt, Human
gggccauagcugcagaga

SEQ ID NO: 1171263 - RNA, 27 nt, Human
gggucacuggagcccaggaguuugagg

SEQ ID NO: 1171264 - RNA, 19 nt, Human
ggucaggaguuugagacca

SEQ ID NO: 1171265 - RNA, 24 nt, Human
gguggcucauaccuguaaucccag

SEQ ID NO: 1171266 - RNA, 21 nt, Human
gucacagauucaccccaacuu

SEQ ID NO: 1171267 - RNA, 25 nt, Human
gugaaccuuuaacaaugccccagag

SEQ ID NO: 1171268 - RNA, 23 nt, Human
guggcucauaccuguaaucccag

SEQ ID NO: 1171269 - RNA, 21 nt, Human
guggggccauagcugcagaga

SEQ ID NO: 1171270 - RNA, 21 nt, Human
guuugaggcuagccugggcaa

SEQ ID NO: 1171271 - RNA, 24 nt, Human
uaaaaaacaggcuggugcggcuca

SEQ ID NO: 1171272 - RNA, 24 nt, Human
uaaaacaaacaaacaaacaaaaaa

SEQ ID NO: 1171273 - RNA, 23 nt, Human
uaacaaugccccagaggagcuuc

SEQ ID NO: 1171274 - RNA, 21 nt, Human
uacaccacugcacuccagucu

SEQ ID NO: 1171275 - RNA, 19 nt, Human
uacccccacugcaccucca

SEQ ID NO: 1171276 - RNA, 19 nt, Human
uaccuggguguaguggcau

SEQ ID NO: 1171277 - RNA, 25 nt, Human
uaccuggguguaguggcaugcgugu

SEQ ID NO: 1171278 - RNA, 18 nt, Human
uaccuguaaucccagcac

SEQ ID NO: 1171279 - RNA, 21 nt, Human
uacugcacuccagucugggcg

SEQ ID NO: 1171280 - RNA, 23 nt, Human
uacugcacuccagucugggcgac

SEQ ID NO: 1171281 - RNA, 24 nt, Human
uacugcacuccagucugggcgaca

SEQ ID NO: 1171282 - RNA, 24 nt, Human
uagccugggcaacauggagaagcu

SEQ ID NO: 1171283 - RNA, 20 nt, Human
uagcuccuucuguccacacu

SEQ ID NO: 1171284 - RNA, 18 nt, Human
uagcugcagagaacgcag

SEQ ID NO: 1171285 - RNA, 20 nt, Human
uagcugggcgugguggcaug

SEQ ID NO: 1171286 - RNA, 20 nt, Human
uaggguggaaaaggaaggaa

SEQ ID NO: 1171287 - RNA, 23 nt, Human
ucaacacccgcccaggaaccagg

SEQ ID NO: 1171288 - RNA, 23 nt, Human
ucaacagccuuuccuaaugggcu

SEQ ID NO: 1171289 - RNA, 21 nt, Human
ucaaccaccgacauuaacguc

SEQ ID NO: 1171290 - RNA, 19 nt, Human
ucacuggagcccaggaguu

SEQ ID NO: 1171291 - RNA, 22 nt, Human
ucacuggagcccaggaguuuga

SEQ ID NO: 1171292 - RNA, 26 nt, Human
ucacuggagcccaggaguuugaggcu

SEQ ID NO: 1171293 - RNA, 18 nt, Human
ucacuggguggucccagc

SEQ ID NO: 1171294 - RNA, 20 nt, Human
ucacuggguggucccagccc

SEQ ID NO: 1171295 - RNA, 19 nt, Human
ucacuugauccugggaggc

SEQ ID NO: 1171296 - RNA, 22 nt, Human
ucagagccugguguggggucug

SEQ ID NO: 1171297 - RNA, 22 nt, Human
ucagccgggcgugcguggcaug

SEQ ID NO: 1171298 - RNA, 20 nt, Human
uccagagccccugccagccc

SEQ ID NO: 1171299 - RNA, 24 nt, Human
uccagucugggcaacagagugaga

SEQ ID NO: 1171300 - RNA, 22 nt, Human
uccagucugggcgacagaguga

SEQ ID NO: 1171301 - RNA, 18 nt, Human
ucccaagccccauccuca

SEQ ID NO: 1171302 - RNA, 18 nt, Human
ucccagccccacucuggc

SEQ ID NO: 1171303 - RNA, 24 nt, Human
uccugccugggugacagagcgaga

SEQ ID NO: 1171304 - RNA, 24 nt, Human
ucgaaauaaaacaaacaaacaaac

SEQ ID NO: 1171305 - RNA, 22 nt, Human
ucgggaggcagaggugggagga

SEQ ID NO: 1171306 - RNA, 25 nt, Human
ucgggaggcugaggcaggagaauca

SEQ ID NO: 1171307 - RNA, 20 nt, Human
ucucccucuucuuccacuuc

SEQ ID NO: 1171308 - RNA, 19 nt, Human
ucuccuggccagcuccccu

SEQ ID NO: 1171309 - RNA, 24 nt, Human
ucugaccgggcgugguggcucaua

SEQ ID NO: 1171310 - RNA, 22 nt, Human
ucugcuucuaucucccucuucu

SEQ ID NO: 1171311 - RNA, 19 nt, Human
ucuguccacacuuuaaaug

SEQ ID NO: 1171312 - RNA, 20 nt, Human
ugacagagcgagauccugcc

SEQ ID NO: 1171313 - RNA, 19 nt, Human
ugacccccaacccagcccu

SEQ ID NO: 1171314 - RNA, 20 nt, Human
ugacccccaacccagcccuc

SEQ ID NO: 1171315 - RNA, 19 nt, Human
ugaccgggcgugguggcuc

SEQ ID NO: 1171316 - RNA, 22 nt, Human
ugagaagagcuuauaaagccaa

SEQ ID NO: 1171317 - RNA, 23 nt, Human
ugagaccagccuggccaacgugg

SEQ ID NO: 1171318 - RNA, 18 nt, Human
ugagccaauguugacuuu

SEQ ID NO: 1171319 - RNA, 20 nt, Human
ugaggcaggagaaucacuug

SEQ ID NO: 1171320 - RNA, 24 nt, Human
ugaggcaggagaaucacuugaucc

SEQ ID NO: 1171321 - RNA, 18 nt, Human
ugaggcgaggucaaggcu

SEQ ID NO: 1171322 - RNA, 24 nt, Human
ugaggcuagccugggcaacaugga

SEQ ID NO: 1171323 - RNA, 18 nt, Human
ugaggucaggaguuugag

SEQ ID NO: 1171324 - RNA, 18 nt, Human
ugagugcaggugacgacc

SEQ ID NO: 1171325 - RNA, 22 nt, Human
ugcagcgagccaugacugugcc

SEQ ID NO: 1171326 - RNA, 25 nt, Human
ugccugggugacagagcgagauccu

SEQ ID NO: 1171327 - RNA, 19 nt, Human
ugccuguggggguguuuug

SEQ ID NO: 1171328 - RNA, 24 nt, Human
ugcggcucacaccuguaauuccag

SEQ ID NO: 1171329 - RNA, 26 nt, Human
ugcuacaauacuucaaacacacaggg

SEQ ID NO: 1171330 - RNA, 18 nt, Human
uggaagcccaggcuucug

SEQ ID NO: 1171331 - RNA, 23 nt, Human
uggagaagcucugucucuaaaaa

SEQ ID NO: 1171332 - RNA, 24 nt, Human
uggagauacuucagcaggacaaga

SEQ ID NO: 1171333 - RNA, 23 nt, Human
uggaucauuugaggucaggaguu

SEQ ID NO: 1171334 - RNA, 24 nt, Human
uggaucauuugaggucaggaguuu

SEQ ID NO: 1171335 - RNA, 24 nt, Human
uggcaugagccuguggucccagcu

SEQ ID NO: 1171336 - RNA, 24 nt, Human
uggccaacguggugaaaccucguu

SEQ ID NO: 1171337 - RNA, 22 nt, Human
uggcuacagggggccuccugac

SEQ ID NO: 1171338 - RNA, 21 nt, Human
uggcucauaccuguaauccca

SEQ ID NO: 1171339 - RNA, 22 nt, Human
uggcucauaccuguaaucccag

SEQ ID NO: 1171340 - RNA, 24 nt, Human
uggcucauaccuguaaucccagca

SEQ ID NO: 1171341 - RNA, 29 nt, Human
ugggaggcggagcuugcagugacaacggu

SEQ ID NO: 1171342 - RNA, 24 nt, Human
ugggaggcggagcuugcagugagc

SEQ ID NO: 1171343 - RNA, 21 nt, Human
ugggcaacagagugagacccu

SEQ ID NO: 1171344 - RNA, 24 nt, Human
ugggcaacagagugagacccuguc

SEQ ID NO: 1171345 - RNA, 19 nt, Human
ugggggagggaggaggaag

SEQ ID NO: 1171346 - RNA, 18 nt, Human
uggguguaguggcaugcg

SEQ ID NO: 1171347 - RNA, 22 nt, Human
uggguguaguggcaugcgugug

SEQ ID NO: 1171348 - RNA, 18 nt, Human
ugguauguccacuuaaaa

SEQ ID NO: 1171349 - RNA, 24 nt, Human
ugguggcucauaccuguaauccca

SEQ ID NO: 1171350 - RNA, 21 nt, Human
uguaacaacugcccuaaccag

SEQ ID NO: 1171351 - RNA, 23 nt, Human
uuacaccacugcacuccagucug

SEQ ID NO: 1171352 - RNA, 22 nt, Human
uuaccuggguguaguggcaugc

SEQ ID NO: 1171353 - RNA, 20 nt, Human
uuagcugggcgugguggcau

SEQ ID NO: 1171354 - RNA, 22 nt, Human
uuagcugggcgugguggcaugc

SEQ ID NO: 1171355 - RNA, 22 nt, Human
uucgcaccuccaugccucuccu

SEQ ID NO: 1171356 - RNA, 19 nt, Human
uucuugagaucuuccagga

SEQ ID NO: 1171357 - RNA, 18 nt, Human
uugcagugagccgagacg

SEQ ID NO: 1171358 - RNA, 22 nt, Human
uugcagugagccgagacggcgc

SEQ ID NO: 1171359 - RNA, 23 nt, Human
uugggggagggaggaggaaggag

SEQ ID NO: 1171360 - RNA, 22 nt, Human
uuucuacuaaaaauacaaaaaa

SEQ ID NO: 1171361 - RNA, 23 nt, Human
uuugaggucaggaguuugagacc

SEQ ID NO: 1171362 - RNA, 20 nt, Human
uuuuuaaaaauuaccugggu

SEQ ID NO: 1171363 - RNA, 21 nt, Human
aacccuuuguuggaaugcuuu

SEQ ID NO: 1171364 - RNA, 22 nt, Human
aacccuuuguuggaaugcuuuc

SEQ ID NO: 1171365 - RNA, 25 nt, Human
agcuucauucccaucuauaauuuua

SEQ ID NO: 1171366 - RNA, 23 nt, Human
auagaaccuggcaucacccugaa

SEQ ID NO: 1171367 - RNA, 26 nt, Human
auuuugcuuggguaaucccuuuuaau

SEQ ID NO: 1171368 - RNA, 23 nt, Human
caacagcauaggugcaaaaaaaa

SEQ ID NO: 1171369 - RNA, 28 nt, Human
caacuacaccaagguuucugaagacaau

SEQ ID NO: 1171370 - RNA, 25 nt, Human
caauggcuucucccuccaagcaggu

SEQ ID NO: 1171371 - RNA, 21 nt, Human
cagcauaggugcaaaaaaaaa

SEQ ID NO: 1171372 - RNA, 22 nt, Human
cagcauaggugcaaaaaaaaaa

SEQ ID NO: 1171373 - RNA, 19 nt, Human
cagcccuccaaugaagagc

SEQ ID NO: 1171374 - RNA, 21 nt, Human
cagggugaagagagacuuuaa

SEQ ID NO: 1171375 - RNA, 20 nt, Human
ccugcuaagcuuuguuuccu

SEQ ID NO: 1171376 - RNA, 22 nt, Human
cgggcucuucaggagacucuga

SEQ ID NO: 1171377 - RNA, 18 nt, Human
cugcuaagcuuuguuucc

SEQ ID NO: 1171378 - RNA, 21 nt, Human
cuuuccacagaacagaaacua

SEQ ID NO: 1171379 - RNA, 18 nt, Human
gagcuuccucagcuguuc

SEQ ID NO: 1171380 - RNA, 24 nt, Human
guuuuuugcccauacacaugaguc

SEQ ID NO: 1171381 - RNA, 19 nt, Human
uacacaagcuucauuccca

SEQ ID NO: 1171382 - RNA, 21 nt, Human
uacaccaagguuucugaagac

SEQ ID NO: 1171383 - RNA, 19 nt, Human
ucaaagcucagcccuccaa

SEQ ID NO: 1171384 - RNA, 18 nt, Human
ucaggagacucugacuua

SEQ ID NO: 1171385 - RNA, 19 nt, Human
ucaggagacucugacuuag

SEQ ID NO: 1171386 - RNA, 19 nt, Human
ugaagagagacuuuaacaa

SEQ ID NO: 1171387 - RNA, 19 nt, Human
uguuguaaccuguagcuuc

SEQ ID NO: 1171388 - RNA, 20 nt, Human
uucagaguagacuaacuuua

SEQ ID NO: 1171389 - RNA, 18 nt, Human
uuccucagcuguucgggc

SEQ ID NO: 1171390 - RNA, 20 nt, Human
aauagaaaagacgaccugga

SEQ ID NO: 1171391 - RNA, 20 nt, Human
accuggaaguuaccccagcu

SEQ ID NO: 1171392 - RNA, 21 nt, Human
agacgaccuggaaguuacccc

SEQ ID NO: 1171393 - RNA, 18 nt, Human
aggguccuggcccucucc

SEQ ID NO: 1171394 - RNA, 19 nt, Human
cuggaaguuaccccagcuc

SEQ ID NO: 1171395 - RNA, 27 nt, Human
ggacaugcagguguaaaauagaaaaga

SEQ ID NO: 1171396 - RNA, 23 nt, Human
uaaaauagaaaagacgaccugga

SEQ ID NO: 1171397 - RNA, 24 nt, Human
uaccccagcuccagcuccaagccu

SEQ ID NO: 1171398 - RNA, 18 nt, Human
uaggguccuggcccucuc

SEQ ID NO: 1171399 - RNA, 18 nt, Human
ucccaggggucgggaacu

SEQ ID NO: 1171400 - RNA, 21 nt, Human
ucuaaagaaucugaaaugcaa

SEQ ID NO: 1171401 - RNA, 19 nt, Human
uguaaaauagaaaagacga

SEQ ID NO: 1171402 - RNA, 24 nt, Human
aaacuggcuugaaaaagauuucua

SEQ ID NO: 1171403 - RNA, 18 nt, Human
aagcagccaacugcugaa

SEQ ID NO: 1171404 - RNA, 19 nt, Human
aagcagccaacugcugaac

SEQ ID NO: 1171405 - RNA, 24 nt, Human
aagcauuugugugugucagaaguu

SEQ ID NO: 1171406 - RNA, 19 nt, Human
acagauacauguacagagu

SEQ ID NO: 1171407 - RNA, 18 nt, Human
agacgccagugcacauag

SEQ ID NO: 1171408 - RNA, 23 nt, Human
aggucacugucuuagacgccagu

SEQ ID NO: 1171409 - RNA, 18 nt, Human
augguagaacauuaaaca

SEQ ID NO: 1171410 - RNA, 21 nt, Human
caagaaaaagcucuuguagca

SEQ ID NO: 1171411 - RNA, 21 nt, Human
ccccacauacaaugcaacacc

SEQ ID NO: 1171412 - RNA, 19 nt, Human
cgccagugcacauaguccc

SEQ ID NO: 1171413 - RNA, 21 nt, Human
cuaagcagccaacugcugaac

SEQ ID NO: 1171414 - RNA, 21 nt, Human
cucuaugguuugugcaaagcu

SEQ ID NO: 1171415 - RNA, 21 nt, Human
cuuguauuuuaagcuuuugca

SEQ ID NO: 1171416 - RNA, 22 nt, Human
gaaaaagauuucuaagcagcca

SEQ ID NO: 1171417 - RNA, 18 nt, Human
gcacauaguccccacaua

SEQ ID NO: 1171418 - RNA, 23 nt, Human
uccccacauacaaugcaacaccu

SEQ ID NO: 1171419 - RNA, 22 nt, Human
ucuuuagaaacuggcuugaaaa

SEQ ID NO: 1171420 - RNA, 23 nt, Human
uugacaauggugugcauuauucu

SEQ ID NO: 1171421 - RNA, 22 nt, Human
uuuaagcuuuugcaagaaaaag

SEQ ID NO: 1171422 - RNA, 21 nt, Human
aagggcuccaaagagaaggug

SEQ ID NO: 1171423 - RNA, 19 nt, Human
agaccaccaacaggaaucu

SEQ ID NO: 1171424 - RNA, 22 nt, Human
cagcucccgaaaccugccuccu

SEQ ID NO: 1171425 - RNA, 23 nt, Human
ccugugacccagaccaccaacag

SEQ ID NO: 1171426 - RNA, 25 nt, Human
cgaaaccugccuccugugacccaga

SEQ ID NO: 1171427 - RNA, 28 nt, Human
cucccgaaaccugccuccugugacccag

SEQ ID NO: 1171428 - RNA, 20 nt, Human
cuccugugacccagaccacc

SEQ ID NO: 1171429 - RNA, 23 nt, Human
cugaugaccauauacaacuuguu

SEQ ID NO: 1171430 - RNA, 22 nt, Human
gaagaugaauaaguagaaccca

SEQ ID NO: 1171431 - RNA, 24 nt, Human
gacaaaccauuuacuucugugguc

SEQ ID NO: 1171432 - RNA, 18 nt, Human
gaccaccaacaggaaucu

SEQ ID NO: 1171433 - RNA, 25 nt, Human
gcuccaaagagaaggugugaagaga

SEQ ID NO: 1171434 - RNA, 21 nt, Human
uagaagaugaauaaguagaac

SEQ ID NO: 1171435 - RNA, 21 nt, Human
uccaaagagaaggugugaaga

SEQ ID NO: 1171436 - RNA, 22 nt, Human
ucuaaaccgcaaacaggcgaaa

SEQ ID NO: 1171437 - RNA, 24 nt, Human
ucuuuggggucuaaaccgcaaaca

SEQ ID NO: 1171438 - RNA, 21 nt, Human
ugacaggcuuauuaaaucaca

SEQ ID NO: 1171439 - RNA, 19 nt, Human
ugacccagaccaccaacag

SEQ ID NO: 1171440 - RNA, 19 nt, Human
aaaaaaaaacaaacucaaa

SEQ ID NO: 1171441 - RNA, 22 nt, Human
aaaauaaaaauacugccacaga

SEQ ID NO: 1171442 - RNA, 26 nt, Human
aaacaagagaaaaaaagaagggaccc

SEQ ID NO: 1171443 - RNA, 19 nt, Human
aacaugguaaaaccccauu

SEQ ID NO: 1171444 - RNA, 20 nt, Human
aacaugguaaaaccccauuu

SEQ ID NO: 1171445 - RNA, 21 nt, Human
aacaugguaaaaccccauuuc

SEQ ID NO: 1171446 - RNA, 21 nt, Human
aacaugguaaaaccccauuuc

SEQ ID NO: 1171447 - RNA, 19 nt, Human
aagcauuuugggaggcuga

SEQ ID NO: 1171448 - RNA, 24 nt, Human
aagcauuuugggaggcugaagugg

SEQ ID NO: 1171449 - RNA, 21 nt, Human
aagcuaacaaugcaucaccug

SEQ ID NO: 1171450 - RNA, 18 nt, Human
aaggcacauuaguauaug

SEQ ID NO: 1171451 - RNA, 23 nt, Human
aaguaacaaaugaaaagccaaac

SEQ ID NO: 1171452 - RNA, 21 nt, Human
aaguaagcaccugaauauuaa

SEQ ID NO: 1171453 - RNA, 19 nt, Human
aaguacagaauacaaacaa

SEQ ID NO: 1171454 - RNA, 20 nt, Human
aagucaguugucaaagcuaa

SEQ ID NO: 1171455 - RNA, 25 nt, Human
aauacaaacaacagaaaucauuaga

SEQ ID NO: 1171456 - RNA, 21 nt, Human
acacaguaguauuuuguaaca

SEQ ID NO: 1171457 - RNA, 21 nt, Human
accccauuucuacuaaaaaca

SEQ ID NO: 1171458 - RNA, 18 nt, Human
acugcacuccagccuggg

SEQ ID NO: 1171459 - RNA, 21 nt, Human
acugcacuccagccugggcaa

SEQ ID NO: 1171460 - RNA, 24 nt, Human
acugcacuccagccugggcaaaag

SEQ ID NO: 1171461 - RNA, 24 nt, Human
acuugaggucaggaguucaagacc

SEQ ID NO: 1171462 - RNA, 24 nt, Human
agaugcagugguucaugccuguaa

SEQ ID NO: 1171463 - RNA, 20 nt, Human
agcaaggaaaacauuuuacu

SEQ ID NO: 1171464 - RNA, 21 nt, Human
agcacugaugugucaaaaaug

SEQ ID NO: 1171465 - RNA, 20 nt, Human
agcauuuugggaggcugaag

SEQ ID NO: 1171466 - RNA, 24 nt, Human
agcauuuugggaggcugaaguggg

SEQ ID NO: 1171467 - RNA, 22 nt, Human
agccuggacaacaugguaaaac

SEQ ID NO: 1171468 - RNA, 24 nt, Human
agccuggacaacaugguaaaaccc

SEQ ID NO: 1171469 - RNA, 24 nt, Human
agccugggcaaaagaaugagacuc

SEQ ID NO: 1171470 - RNA, 23 nt, Human
aggaguucaagaccagccuggac

SEQ ID NO: 1171471 - RNA, 22 nt, Human
aggcaggagacucgcuugaacc

SEQ ID NO: 1171472 - RNA, 24 nt, Human
aggcaggagacucgcuugaaccug

SEQ ID NO: 1171473 - RNA, 24 nt, Human
aggcugaggcaggagacucgcuug

SEQ ID NO: 1171474 - RNA, 18 nt, Human
aggugaugauuggcaguu

SEQ ID NO: 1171475 - RNA, 24 nt, Human
aggugugguggcaugugccuguaa

SEQ ID NO: 1171476 - RNA, 24 nt, Human
agugguucaugccuguaauccaag

SEQ ID NO: 1171477 - RNA, 23 nt, Human
aguuaccagcauuuugagugcca

SEQ ID NO: 1171478 - RNA, 23 nt, Human
aguuaggugugguggcaugugcc

SEQ ID NO: 1171479 - RNA, 24 nt, Human
auaaaaauacugccacagagaaau

SEQ ID NO: 1171480 - RNA, 20 nt, Human
aucaaaacaagagaaaaaaa

SEQ ID NO: 1171481 - RNA, 23 nt, Human
aucacuugaggucaggaguucaa

SEQ ID NO: 1171482 - RNA, 24 nt, Human
aucacuugaggucaggaguucaag

SEQ ID NO: 1171483 - RNA, 18 nt, Human
augcacaaaauuuaagcc

SEQ ID NO: 1171484 - RNA, 24 nt, Human
auugugccacugcacuccagccug

SEQ ID NO: 1171485 - RNA, 21 nt, Human
caaaaaaagcaaaugagguga

SEQ ID NO: 1171486 - RNA, 21 nt, Human
caaaaaaagcaaaugagguga

SEQ ID NO: 1171487 - RNA, 21 nt, Human
caaaaaaagcaaaugagguga

SEQ ID NO: 1171488 - RNA, 22 nt, Human
caaaacaagagaaaaaaagaaa

SEQ ID NO: 1171489 - RNA, 19 nt, Human
caaaaugcaaagauaaaua

SEQ ID NO: 1171490 - RNA, 23 nt, Human
caaagcuaacaaugcaucacccc

SEQ ID NO: 1171491 - RNA, 24 nt, Human
caagccaaauccagccagcucaua

SEQ ID NO: 1171492 - RNA, 26 nt, Human
cacaaaauuuaagccaaauauucaag

SEQ ID NO: 1171493 - RNA, 18 nt, Human
cacugcacuccagccugg

SEQ ID NO: 1171494 - RNA, 19 nt, Human
cacugcacuccagccuggg

SEQ ID NO: 1171495 - RNA, 21 nt, Human
cacugcacuccagccugggca

SEQ ID NO: 1171496 - RNA, 23 nt, Human
cacugcacuccagccugggcaaa

SEQ ID NO: 1171497 - RNA, 23 nt, Human
cacuugaggucaggaguucaaga

SEQ ID NO: 1171498 - RNA, 24 nt, Human
cagcuacuugggaggcugaggcag

SEQ ID NO: 1171499 - RNA, 20 nt, Human
caguuucacauuuucuaaug

SEQ ID NO: 1171500 - RNA, 19 nt, Human
caucaaaacaagagaaaaa

SEQ ID NO: 1171501 - RNA, 24 nt, Human
caugccuguaauccaagcauuuug

SEQ ID NO: 1171502 - RNA, 18 nt, Human
cauggauuaacugacucg

SEQ ID NO: 1171503 - RNA, 18 nt, Human
cauuuugggaggcugaag

SEQ ID NO: 1171504 - RNA, 18 nt, Human
ccacugcacuccagccug

SEQ ID NO: 1171505 - RNA, 20 nt, Human
ccacugcacuccagccuggg

SEQ ID NO: 1171506 - RNA, 20 nt, Human
ccacugcacuccagccuggg

SEQ ID NO: 1171507 - RNA, 21 nt, Human
ccacugcacuccagccugggc

SEQ ID NO: 1171508 - RNA, 24 nt, Human
ccacugcacuccagccugggcaaa

SEQ ID NO: 1171509 - RNA, 21 nt, Human
ccugcaggguggagguugcag

SEQ ID NO: 1171510 - RNA, 24 nt, Human
ccuggacaacaugguaaaacccca

SEQ ID NO: 1171511 - RNA, 22 nt, Human
ccuguaauccaagcauuuuggg

SEQ ID NO: 1171512 - RNA, 24 nt, Human
ccuguaauccaagcauuuugggag

SEQ ID NO: 1171513 - RNA, 18 nt, Human
ccuguaaucucagcuacu

SEQ ID NO: 1171514 - RNA, 19 nt, Human
ccuguaaucucagcuacuu

SEQ ID NO: 1171515 - RNA, 21 nt, Human
ccuguaaucucagcuacuugg

SEQ ID NO: 1171516 - RNA, 22 nt, Human
ccuguaaucucagcuacuuggg

SEQ ID NO: 1171517 - RNA, 19 nt, Human
ccuuucaaaauguagucaa

SEQ ID NO: 1171518 - RNA, 18 nt, Human
cucaaaaaaaaaaaaaaa

SEQ ID NO: 1171519 - RNA, 24 nt, Human
cucagucucaaaaaaaaaaaaaaa

SEQ ID NO: 1171520 - RNA, 23 nt, Human
cuggacaacaugguaaaacccca

SEQ ID NO: 1171521 - RNA, 21 nt, Human
gaaaauguaaauuccuguguc

SEQ ID NO: 1171522 - RNA, 23 nt, Human
gaaguggguggaucacuugaggu

SEQ ID NO: 1171523 - RNA, 23 nt, Human
gagguugcagugaacugagauug

SEQ ID NO: 1171524 - RNA, 23 nt, Human
gaucacuugaggucaggaguuca

SEQ ID NO: 1171525 - RNA, 24 nt, Human
gaucacuugaggucaggaguucaa

SEQ ID NO: 1171526 - RNA, 18 nt, Human
gcacaaaauuuaagccaa

SEQ ID NO: 1171527 - RNA, 18 nt, Human
gcaucaccuggcuucaaa

SEQ ID NO: 1171528 - RNA, 23 nt, Human
gcauuuugagugccacauauguu

SEQ ID NO: 1171529 - RNA, 22 nt, Human
gccacugcacuccagccugggc

SEQ ID NO: 1171530 - RNA, 24 nt, Human
gccacugcacuccagccugggcaa

SEQ ID NO: 1171531 - RNA, 20 nt, Human
gccuguaaucucagcuacuu

SEQ ID NO: 1171532 - RNA, 22 nt, Human
ggaggucagaugcagugguuca

SEQ ID NO: 1171533 - RNA, 22 nt, Human
ggagguugcagugaacugagau

SEQ ID NO: 1171534 - RNA, 24 nt, Human
ggagguugcagugaacugagauug

SEQ ID NO: 1171535 - RNA, 22 nt, Human
ggaucacuugaggucaggaguu

SEQ ID NO: 1171536 - RNA, 18 nt, Human
ggauuaacugacucgaaa

SEQ ID NO: 1171537 - RNA, 20 nt, Human
gggaggcugaagugggugga

SEQ ID NO: 1171538 - RNA, 21 nt, Human
gggauaucuuuauuucuagac

SEQ ID NO: 1171539 - RNA, 19 nt, Human
gguggagguugcagugaac

SEQ ID NO: 1171540 - RNA, 23 nt, Human
gguggagguugcagugaacugag

SEQ ID NO: 1171541 - RNA, 21 nt, Human
gguggaucacuugaggucagg

SEQ ID NO: 1171542 - RNA, 24 nt, Human
gguggcaugugccuguaaucucag

SEQ ID NO: 1171543 - RNA, 20 nt, Human
gugagcuauugccaaaaaaa

SEQ ID NO: 1171544 - RNA, 18 nt, Human
guugaacaaaugcaaagg

SEQ ID NO: 1171545 - RNA, 18 nt, Human
uaaaaacugcaguaaugc

SEQ ID NO: 1171546 - RNA, 22 nt, Human
uaaaaauacugccacagagaaa

SEQ ID NO: 1171547 - RNA, 19 nt, Human
uaaaauaucccuaaauguc

SEQ ID NO: 1171548 - RNA, 21 nt, Human
uaaagaauacuauagggaggu

SEQ ID NO: 1171549 - RNA, 19 nt, Human
uaacaaaugaaaagccaaa

SEQ ID NO: 1171550 - RNA, 21 nt, Human
uaacaguauucauaugcacaa

SEQ ID NO: 1171551 - RNA, 21 nt, Human
uaagaacaguuucacauuuuc

SEQ ID NO: 1171552 - RNA, 21 nt, Human
uaaggcacauuaguauaugaa

SEQ ID NO: 1171553 - RNA, 19 nt, Human
uacagaauacaaacaacag

SEQ ID NO: 1171554 - RNA, 21 nt, Human
uacagaauacaaacaacagaa

SEQ ID NO: 1171555 - RNA, 23 nt, Human
uacaggcaaagaucuugagcaca

SEQ ID NO: 1171556 - RNA, 27 nt, Human
uaccaaauacauagauuaaaauauccc

SEQ ID NO: 1171557 - RNA, 22 nt, Human
uagauuaaaauaucccuaaaug

SEQ ID NO: 1171558 - RNA, 18 nt, Human
uagguuucuaguaguaug

SEQ ID NO: 1171559 - RNA, 22 nt, Human
uaguuaggugugguggcaugug

SEQ ID NO: 1171560 - RNA, 20 nt, Human
uauaacuaauacuucacuaa

SEQ ID NO: 1171561 - RNA, 21 nt, Human
uaucucagucgucuguacaga

SEQ ID NO: 1171562 - RNA, 22 nt, Human
uaugcacaaaauuuaagccaaa

SEQ ID NO: 1171563 - RNA, 23 nt, Human
uauugccaaaaaaaugauucuaa

SEQ ID NO: 1171564 - RNA, 19 nt, Human
ucaaaacaagagaaaaaaa

SEQ ID NO: 1171565 - RNA, 19 nt, Human
ucaaaacaagagaaaaaaa

SEQ ID NO: 1171566 - RNA, 23 nt, Human
ucagucucaaaaaaaaaaaaaaa

SEQ ID NO: 1171567 - RNA, 20 nt, Human
ucagugcucaugaaauuuua

SEQ ID NO: 1171568 - RNA, 20 nt, Human
ucaugccuguaauccaagca

SEQ ID NO: 1171569 - RNA, 19 nt, Human
uccaagcauuuugggaggc

SEQ ID NO: 1171570 - RNA, 19 nt, Human
uccacaagccaaauccagc

SEQ ID NO: 1171571 - RNA, 24 nt, Human
ucgcuugaaccugcaggguggagg

SEQ ID NO: 1171572 - RNA, 24 nt, Human
ucucaaaaaaaaaaaaaaacaaac

SEQ ID NO: 1171573 - RNA, 18 nt, Human
ugaacaaaugcaaaggag

SEQ ID NO: 1171574 - RNA, 22 nt, Human
ugaacugagauugugccacugc

SEQ ID NO: 1171575 - RNA, 24 nt, Human
ugaaguggguggaucacuugaggu

SEQ ID NO: 1171576 - RNA, 26 nt, Human
ugaaguggguggaucacuugagguca

SEQ ID NO: 1171577 - RNA, 24 nt, Human
ugagauugugccacugcacuccag

SEQ ID NO: 1171578 - RNA, 24 nt, Human
ugaggcaggagacucgcuugaacc

SEQ ID NO: 1171579 - RNA, 24 nt, Human
ugaggcaggagacucgcuugaacc

SEQ ID NO: 1171580 - RNA, 22 nt, Human
ugcaaaggagacuuauguggug

SEQ ID NO: 1171581 - RNA, 23 nt, Human
ugcaucaccuggcuucaaaauuu

SEQ ID NO: 1171582 - RNA, 21 nt, Human
ugccaaaggaauaaucuuggc

SEQ ID NO: 1171583 - RNA, 24 nt, Human
ugccacugcacuccagccugggca

SEQ ID NO: 1171584 - RNA, 24 nt, Human
ugccuguaaucucagcuacuuggg

SEQ ID NO: 1171585 - RNA, 19 nt, Human
ugcuaaaaggagaaaagua

SEQ ID NO: 1171586 - RNA, 26 nt, Human
ugcugucaucauuuugcacugcuacu

SEQ ID NO: 1171587 - RNA, 21 nt, Human
uggaauaggggucacaaauuu

SEQ ID NO: 1171588 - RNA, 22 nt, Human
uggacaacaugguaaaacccca

SEQ ID NO: 1171589 - RNA, 24 nt, Human
uggaucacuugaggucaggaguuc

SEQ ID NO: 1171590 - RNA, 27 nt, Human
uggaucacuugaggucaggaguucaag

SEQ ID NO: 1171591 - RNA, 27 nt, Human
uggcagaguugaacaaaugcaaaggag

SEQ ID NO: 1171592 - RNA, 21 nt, Human
uggcaugugccuguaaucuca

SEQ ID NO: 1171593 - RNA, 24 nt, Human
uggcaugugccuguaaucucagcu

SEQ ID NO: 1171594 - RNA, 18 nt, Human
uggcucaaaaguaagcac

SEQ ID NO: 1171595 - RNA, 26 nt, Human
uggcugaaaaaaucuaauggcuaaaa

SEQ ID NO: 1171596 - RNA, 18 nt, Human
ugggaagauaauuuaccu

SEQ ID NO: 1171597 - RNA, 23 nt, Human
ugggaggcugaaguggguggauc

SEQ ID NO: 1171598 - RNA, 24 nt, Human
ugggaggcugaaguggguggauca

SEQ ID NO: 1171599 - RNA, 19 nt, Human
ugggaggcugaggcaggag

SEQ ID NO: 1171600 - RNA, 23 nt, Human
ugggaggcugaggcaggagacuc

SEQ ID NO: 1171601 - RNA, 24 nt, Human
uggguggaucacuugaggucagga

SEQ ID NO: 1171602 - RNA, 24 nt, Human
ugguggcaugugccuguaaucuca

SEQ ID NO: 1171603 - RNA, 22 nt, Human
ugguucaugccuguaauccaag

SEQ ID NO: 1171604 - RNA, 24 nt, Human
ugguucaugccuguaauccaagca

SEQ ID NO: 1171605 - RNA, 19 nt, Human
uguggugcugucaucauuu

SEQ ID NO: 1171606 - RNA, 22 nt, Human
uuaguuaggugugguggcaugu

SEQ ID NO: 1171607 - RNA, 24 nt, Human
uuaguuaggugugguggcaugugc

SEQ ID NO: 1171608 - RNA, 23 nt, Human
uuauguaaaauucaacuuucagu

SEQ ID NO: 1171609 - RNA, 24 nt, Human
uugaaccugcaggguggagguugc

SEQ ID NO: 1171610 - RNA, 19 nt, Human
uugcacugcuacuuggcac

SEQ ID NO: 1171611 - RNA, 19 nt, Human
uugcagugaacugagauug

SEQ ID NO: 1171612 - RNA, 22 nt, Human
uugcagugaacugagauugugc

SEQ ID NO: 1171613 - RNA, 25 nt, Human
uugggaggcugaaguggguggauca

SEQ ID NO: 1171614 - RNA, 21 nt, Human
uuuaagucaguugucaaagcu

SEQ ID NO: 1171615 - RNA, 18 nt, Human
uuuaauagcugaaaguaa

SEQ ID NO: 1171616 - RNA, 21 nt, Human
uuucacauuuucuaauggcug

SEQ ID NO: 1171617 - RNA, 21 nt, Human
uuucuacuaaaaacauaaaaa

SEQ ID NO: 1171618 - RNA, 21 nt, Human
uuucucugaaguaucaauauc

SEQ ID NO: 1171619 - RNA, 23 nt, Human
uuucuugucuacacaucuuucuu

SEQ ID NO: 1171620 - RNA, 23 nt, Human
uuuugggaggcugaagugggugg

SEQ ID NO: 1171621 - RNA, 23 nt, Human
aagcagcgagcugcuggcguucu

SEQ ID NO: 1171622 - RNA, 18 nt, Human
agagauuacaaagagauu

SEQ ID NO: 1171623 - RNA, 24 nt, Human
agcaggaaggagaugauuggugag

SEQ ID NO: 1171624 - RNA, 25 nt, Human
agcaggaaggagaugauuggugagu

SEQ ID NO: 1171625 - RNA, 18 nt, Human
aggaaggagaugauuggu

SEQ ID NO: 1171626 - RNA, 20 nt, Human
gaacucggugggagcaacaa

SEQ ID NO: 1171627 - RNA, 20 nt, Human
gagccugccuuccuucccac

SEQ ID NO: 1171628 - RNA, 22 nt, Human
gugaguuuucuucauagccagg

SEQ ID NO: 1171629 - RNA, 25 nt, Human
gugaguuuucuucauagccagguuc

SEQ ID NO: 1171630 - RNA, 23 nt, Human
uagcaggaaggagaugauuggug

SEQ ID NO: 1171631 - RNA, 20 nt, Human
ugguuuaauuuuaagcagcg

SEQ ID NO: 1171632 - RNA, 21 nt, Human
uguuaaaaagggcuuaguuuc

SEQ ID NO: 1171633 - RNA, 22 nt, Human
uuccuucccaccauggagaucc

SEQ ID NO: 1171634 - RNA, 25 nt, Human
uucuuuacaaugauuucagaagaga

SEQ ID NO: 1171635 - RNA, 19 nt, Human
aaaaccaaauaaaaaucac

SEQ ID NO: 1171636 - RNA, 20 nt, Human
aaguguguaguuucauaguu

SEQ ID NO: 1171637 - RNA, 19 nt, Human
aauaaaaaucacaucugaa

SEQ ID NO: 1171638 - RNA, 21 nt, Human
acaauauaaccucaagaggac

SEQ ID NO: 1171639 - RNA, 25 nt, Human
acggagagauacauuccuguuggua

SEQ ID NO: 1171640 - RNA, 23 nt, Human
acugacaguuuaaaaaugacauc

SEQ ID NO: 1171641 - RNA, 22 nt, Human
acugcagcgagagcagcggcgg

SEQ ID NO: 1171642 - RNA, 20 nt, Human
agaagcaggcgcagccugac

SEQ ID NO: 1171643 - RNA, 18 nt, Human
agagcagcggcggcaaca

SEQ ID NO: 1171644 - RNA, 20 nt, Human
auaaaaaucacaucugaaug

SEQ ID NO: 1171645 - RNA, 19 nt, Human
aucagacauuuucccagca

SEQ ID NO: 1171646 - RNA, 20 nt, Human
auggcccuaugggccagggc

SEQ ID NO: 1171647 - RNA, 24 nt, Human
auuauagaaaaauacuugaaguaa

SEQ ID NO: 1171648 - RNA, 20 nt, Human
cacaauauaaccucaagagg

SEQ ID NO: 1171649 - RNA, 18 nt, Human
cagaaggaguaaagggug

SEQ ID NO: 1171650 - RNA, 21 nt, Human
cagcacuuuuuauauaugcau

SEQ ID NO: 1171651 - RNA, 21 nt, Human
caggagggucuagaagcggcg

SEQ ID NO: 1171652 - RNA, 19 nt, Human
caggcaucaguggaguacc

SEQ ID NO: 1171653 - RNA, 23 nt, Human
caugugcauauauacguacuuca

SEQ ID NO: 1171654 - RNA, 23 nt, Human
ccagggccuggcacaguugaggc

SEQ ID NO: 1171655 - RNA, 21 nt, Human
cccagcaauauccgagacugc

SEQ ID NO: 1171656 - RNA, 20 nt, Human
ccuggaggugguccgguggg

SEQ ID NO: 1171657 - RNA, 27 nt, Human
cgagagcagcggcggcaacuggagacc

SEQ ID NO: 1171658 - RNA, 20 nt, Human
cuagaagcggcgaugugucc

SEQ ID NO: 1171659 - RNA, 18 nt, Human
cucugagaggugcaagag

SEQ ID NO: 1171660 - RNA, 20 nt, Human
cuggauuaaaaacaaaaaag

SEQ ID NO: 1171661 - RNA, 19 nt, Human
cugggcccugaagaagcag

SEQ ID NO: 1171662 - RNA, 20 nt, Human
cuggguagcucuggaaaggg

SEQ ID NO: 1171663 - RNA, 18 nt, Human
cuggucagcuuugaggag

SEQ ID NO: 1171664 - RNA, 21 nt, Human
gaauauacuuuaucacuuuaa

SEQ ID NO: 1171665 - RNA, 22 nt, Human
gaaugcccucuaauagugaaac

SEQ ID NO: 1171666 - RNA, 22 nt, Human
gagcagcggcggcaacagcacc

SEQ ID NO: 1171667 - RNA, 22 nt, Human
gaggguguugcacuugguggga

SEQ ID NO: 1171668 - RNA, 19 nt, Human
gaguaaagggugcuggggg

SEQ ID NO: 1171669 - RNA, 18 nt, Human
gcagcggcggcaacagca

SEQ ID NO: 1171670 - RNA, 18 nt, Human
gcggcgauguguccaagg

SEQ ID NO: 1171671 - RNA, 21 nt, Human
ggcacaguggaggguguugca

SEQ ID NO: 1171672 - RNA, 21 nt, Human
gguccuggaggugguccggug

SEQ ID NO: 1171673 - RNA, 21 nt, Human
guagugcaucugccaacgaaa

SEQ ID NO: 1171674 - RNA, 18 nt, Human
guccaaaaggcacagugg

SEQ ID NO: 1171675 - RNA, 22 nt, Human
uaaaaacaaaaaaguuaguuuc

SEQ ID NO: 1171676 - RNA, 18 nt, Human
uaauagugaaaccagcac

SEQ ID NO: 1171677 - RNA, 20 nt, Human
uacauacauguuggccugga

SEQ ID NO: 1171678 - RNA, 21 nt, Human
uagcagacuuuagggcuguau

SEQ ID NO: 1171679 - RNA, 25 nt, Human
uauaugcauucaugugcauauauac

SEQ ID NO: 1171680 - RNA, 20 nt, Human
ucaugugcauauauacguag

SEQ ID NO: 1171681 - RNA, 22 nt, Human
uccacaauauaaccucaagagg

SEQ ID NO: 1171682 - RNA, 19 nt, Human
uccuguugguacuggucca

SEQ ID NO: 1171683 - RNA, 18 nt, Human
ucugacaauaauuacuga

SEQ ID NO: 1171684 - RNA, 19 nt, Human
ucugccaacgaaaauucau

SEQ ID NO: 1171685 - RNA, 22 nt, Human
ugaagucacagauucuaacaau

SEQ ID NO: 1171686 - RNA, 21 nt, Human
ugacuaaaaauaaaaccagga

SEQ ID NO: 1171687 - RNA, 18 nt, Human
ugauuauagaaaaauacu

SEQ ID NO: 1171688 - RNA, 20 nt, Human
uggaaagggcauauuuggua

SEQ ID NO: 1171689 - RNA, 19 nt, Human
uggggguccuggagguggu

SEQ ID NO: 1171690 - RNA, 23 nt, Human
ugguaagaaugggggccaccagg

SEQ ID NO: 1171691 - RNA, 18 nt, Human
uguauacauaugauguac

SEQ ID NO: 1171692 - RNA, 18 nt, Human
ugucaaagagcuagugaa

SEQ ID NO: 1171693 - RNA, 21 nt, Human
uugaggagguuggccagguuu

SEQ ID NO: 1171694 - RNA, 20 nt, Human
aacauggcaaaacccugucu

SEQ ID NO: 1171695 - RNA, 21 nt, Human
aacauggcaaaacccugucuc

SEQ ID NO: 1171696 - RNA, 20 nt, Human
aagaacagcaaauccaaccc

SEQ ID NO: 1171697 - RNA, 18 nt, Human
aagaggcuggguaagccc

SEQ ID NO: 1171698 - RNA, 26 nt, Human
aagcagggcagacgaagaggcugggu

SEQ ID NO: 1171699 - RNA, 22 nt, Human
aagcuggagcuuguccacucgu

SEQ ID NO: 1171700 - RNA, 20 nt, Human
aaggucaaagcugaagugag

SEQ ID NO: 1171701 - RNA, 21 nt, Human
aagugacugggagccugaagc

SEQ ID NO: 1171702 - RNA, 21 nt, Human
acaaaaaaauacaaaaguuag

SEQ ID NO: 1171703 - RNA, 23 nt, Human
acagcaaauccaacccagaaaca

SEQ ID NO: 1171704 - RNA, 24 nt, Human
acagcaaauccaacccagaaacau

SEQ ID NO: 1171705 - RNA, 25 nt, Human
acccgugguuccaguugcuccagag

SEQ ID NO: 1171706 - RNA, 18 nt, Human
accuccuuucuguuccau

SEQ ID NO: 1171707 - RNA, 18 nt, Human
acugcacuccagacuggg

SEQ ID NO: 1171708 - RNA, 24 nt, Human
acugcacuccagacugggcuacag

SEQ ID NO: 1171709 - RNA, 18 nt, Human
acuuggcugguggaauga

SEQ ID NO: 1171710 - RNA, 26 nt, Human
agaacagcaaauccaacccagaaaca

SEQ ID NO: 1171711 - RNA, 23 nt, Human
agccuaggcacaaguucccuaag

SEQ ID NO: 1171712 - RNA, 23 nt, Human
agcucuuucacccagaccugcuu

SEQ ID NO: 1171713 - RNA, 21 nt, Human
aggcaagaacagcaaauccaa

SEQ ID NO: 1171714 - RNA, 21 nt, Human
aggcaaguuaucugggggccu

SEQ ID NO: 1171715 - RNA, 24 nt, Human
aggcugagguagaaggaccgcuug

SEQ ID NO: 1171716 - RNA, 23 nt, Human
agggagaaaagcagggcagacga

SEQ ID NO: 1171717 - RNA, 24 nt, Human
agguagaaggaccgcuugagccug

SEQ ID NO: 1171718 - RNA, 22 nt, Human
auagaaggaucuccacaccucc

SEQ ID NO: 1171719 - RNA, 23 nt, Human
augguaagugaggcuauugcugc

SEQ ID NO: 1171720 - RNA, 21 nt, Human
auugauuaaugcucaugguac

SEQ ID NO: 1171721 - RNA, 24 nt, Human
auuguaccacugcacuccagacug

SEQ ID NO: 1171722 - RNA, 21 nt, Human
auuguuuguuuagcauguaua

SEQ ID NO: 1171723 - RNA, 26 nt, Human
caaauccaacccagaaacaugaauua

SEQ ID NO: 1171724 - RNA, 22 nt, Human
caacauggcaaaacccugucuc

SEQ ID NO: 1171725 - RNA, 24 nt, Human
caacauggcaaaacccugucucua

SEQ ID NO: 1171726 - RNA, 21 nt, Human
caagaacagcaaauccaaccc

SEQ ID NO: 1171727 - RNA, 27 nt, Human
caagaacagcaaauccaacccagaaac

SEQ ID NO: 1171728 - RNA, 23 nt, Human
caccaggaccucuaaacccacag

SEQ ID NO: 1171729 - RNA, 24 nt, Human
cacccaggcaaguuaucugggggc

SEQ ID NO: 1171730 - RNA, 22 nt, Human
cacuccagacugggcuacagag

SEQ ID NO: 1171731 - RNA, 19 nt, Human
cacugcacuccagacuggg

SEQ ID NO: 1171732 - RNA, 24 nt, Human
cacugcacuccagacugggcuaca

SEQ ID NO: 1171733 - RNA, 23 nt, Human
cagcaaauccaacccagaaacau

SEQ ID NO: 1171734 - RNA, 22 nt, Human
caggaccucuaaacccacagag

SEQ ID NO: 1171735 - RNA, 30 nt, Human
cauggcaaaacccugucucuacaaaaaaag

SEQ ID NO: 1171736 - RNA, 21 nt, Human
ccacauauuuuaccucuuggg

SEQ ID NO: 1171737 - RNA, 20 nt, Human
ccacugcacuccagacuggg

SEQ ID NO: 1171738 - RNA, 20 nt, Human
ccacugcacuccagacuggg

SEQ ID NO: 1171739 - RNA, 21 nt, Human
ccacugcacuccagacugggc

SEQ ID NO: 1171740 - RNA, 21 nt, Human
ccagaaacaugaauuaauuca

SEQ ID NO: 1171741 - RNA, 22 nt, Human
ccagcugaggcccugcaggcaa

SEQ ID NO: 1171742 - RNA, 21 nt, Human
ccauucacagcucuuucaccc

SEQ ID NO: 1171743 - RNA, 25 nt, Human
cccacagagccuaggcacaaguucc

SEQ ID NO: 1171744 - RNA, 23 nt, Human
cccagucucagcccuaacccugc

SEQ ID NO: 1171745 - RNA, 22 nt, Human
cccuaacccugccagagaaggg

SEQ ID NO: 1171746 - RNA, 22 nt, Human
cccugcaggcaagaacagcaaa

SEQ ID NO: 1171747 - RNA, 25 nt, Human
ccuaacccugccagagaagggcagg

SEQ ID NO: 1171748 - RNA, 24 nt, Human
ccuuugggcaccaggaccucuaaa

SEQ ID NO: 1171749 - RNA, 19 nt, Human
cuacaaaaaaauacaaaag

SEQ ID NO: 1171750 - RNA, 18 nt, Human
cucagcccuaacccugcc

SEQ ID NO: 1171751 - RNA, 23 nt, Human
cugcacuccagacugggcuacag

SEQ ID NO: 1171752 - RNA, 24 nt, Human
cuucagagguggaugcaccucucu

SEQ ID NO: 1171753 - RNA, 25 nt, Human
gaagcacaucuccuuugggcaccag

SEQ ID NO: 1171754 - RNA, 29 nt, Human
gaaggaaggggagggagaaaagcagggcc

SEQ ID NO: 1171755 - RNA, 19 nt, Human
gaagucccaucauuaugcc

SEQ ID NO: 1171756 - RNA, 22 nt, Human
gaccucuaaacccacagagccu

SEQ ID NO: 1171757 - RNA, 22 nt, Human
gagaaucugaugaugacauucc

SEQ ID NO: 1171758 - RNA, 20 nt, Human
gcaagaacagcaaauccaac

SEQ ID NO: 1171759 - RNA, 22 nt, Human
gccauuauuguaccacugcacu

SEQ ID NO: 1171760 - RNA, 22 nt, Human
gccuuuguuagguggagacugu

SEQ ID NO: 1171761 - RNA, 23 nt, Human
gcucaugguacggugauuccucu

SEQ ID NO: 1171762 - RNA, 18 nt, Human
gcuguuugauuuguggac

SEQ ID NO: 1171763 - RNA, 18 nt, Human
ggcaugagguuuauuagg

SEQ ID NO: 1171764 - RNA, 19 nt, Human
ggccucucuguggccuugu

SEQ ID NO: 1171765 - RNA, 19 nt, Human
gggagggagaaaagcaggg

SEQ ID NO: 1171766 - RNA, 19 nt, Human
gggggacuagguccuucag

SEQ ID NO: 1171767 - RNA, 18 nt, Human
gggugcacccgugguucc

SEQ ID NO: 1171768 - RNA, 19 nt, Human
gugacugggagccugaagc

SEQ ID NO: 1171769 - RNA, 18 nt, Human
uaaauaaaccuccgauga

SEQ ID NO: 1171770 - RNA, 19 nt, Human
uaacccugccagagaaggg

SEQ ID NO: 1171771 - RNA, 22 nt, Human
uaacucucuaagccuuuagaug

SEQ ID NO: 1171772 - RNA, 21 nt, Human
uaagcccaaagugacugggag

SEQ ID NO: 1171773 - RNA, 20 nt, Human
uaaggagaagcuccucuagg

SEQ ID NO: 1171774 - RNA, 21 nt, Human
uacagucuagauuuccugucu

SEQ ID NO: 1171775 - RNA, 22 nt, Human
uaccacugcacuccagacuggg

SEQ ID NO: 1171776 - RNA, 18 nt, Human
uacggugauuccucuuuu

SEQ ID NO: 1171777 - RNA, 18 nt, Human
uacuuggcugguggaaug

SEQ ID NO: 1171778 - RNA, 18 nt, Human
uaguguggcagcuucugg

SEQ ID NO: 1171779 - RNA, 23 nt, Human
uauuauuaaaaaaugggcaaggg

SEQ ID NO: 1171780 - RNA, 22 nt, Human
ucacucuugagaagucccauca

SEQ ID NO: 1171781 - RNA, 21 nt, Human
ucagcagggcuucagcagcac

SEQ ID NO: 1171782 - RNA, 21 nt, Human
ucagcagucccaucuccuucu

SEQ ID NO: 1171783 - RNA, 22 nt, Human
ucaguccugaugggaaauuuga

SEQ ID NO: 1171784 - RNA, 22 nt, Human
uccacaccuccuuucuguucca

SEQ ID NO: 1171785 - RNA, 19 nt, Human
uccauucacagcucuuuca

SEQ ID NO: 1171786 - RNA, 19 nt, Human
uccuuagcucccacauauu

SEQ ID NO: 1171787 - RNA, 22 nt, Human
ucucuuggcaugaggagccuga

SEQ ID NO: 1171788 - RNA, 22 nt, Human
ucucuugugucuacuggugauu

SEQ ID NO: 1171789 - RNA, 22 nt, Human
ugacagcucagcucuugugcuu

SEQ ID NO: 1171790 - RNA, 20 nt, Human
ugacauuaccuugcaauggu

SEQ ID NO: 1171791 - RNA, 22 nt, Human
ugacucagcagggcuucagcag

SEQ ID NO: 1171792 - RNA, 21 nt, Human
ugacugucuucagccuguggg

SEQ ID NO: 1171793 - RNA, 19 nt, Human
ugagaacuugcaacuguag

SEQ ID NO: 1171794 - RNA, 20 nt, Human
ugagaacuugcaacuguaga

SEQ ID NO: 1171795 - RNA, 18 nt, Human
ugagaagggagugagagc

SEQ ID NO: 1171796 - RNA, 19 nt, Human
ugagaugccauguuggugg

SEQ ID NO: 1171797 - RNA, 23 nt, Human
ugagccuggaaggucaaagcuga

SEQ ID NO: 1171798 - RNA, 23 nt, Human
ugaucucuuggcaugaggagccu

SEQ ID NO: 1171799 - RNA, 20 nt, Human
ugauuuguggacucugacuc

SEQ ID NO: 1171800 - RNA, 20 nt, Human
ugcucaugguacggugauuc

SEQ ID NO: 1171801 - RNA, 21 nt, Human
ugcucccaaguggcagccuua

SEQ ID NO: 1171802 - RNA, 24 nt, Human
ugcucucaggauccaaaccugcag

SEQ ID NO: 1171803 - RNA, 21 nt, Human
ugcuucacagaggcaaagggu

SEQ ID NO: 1171804 - RNA, 19 nt, Human
ugcuucauggauccacuuc

SEQ ID NO: 1171805 - RNA, 22 nt, Human
uggccuugugucagcaguccca

SEQ ID NO: 1171806 - RNA, 25 nt, Human
uggcucauccacuaugccuucaaca

SEQ ID NO: 1171807 - RNA, 19 nt, Human
ugggaaauuugagaugugc

SEQ ID NO: 1171808 - RNA, 18 nt, Human
ugggaugcuucacagagg

SEQ ID NO: 1171809 - RNA, 24 nt, Human
ugggauguuaugugagaugccaug

SEQ ID NO: 1171810 - RNA, 21 nt, Human
uggggugcacccgugguucca

SEQ ID NO: 1171811 - RNA, 22 nt, Human
uggucugagggcccagucucag

SEQ ID NO: 1171812 - RNA, 18 nt, Human
ugugcugacaaguuguug

SEQ ID NO: 1171813 - RNA, 23 nt, Human
uguggcagcuucuggauggugcc

SEQ ID NO: 1171814 - RNA, 19 nt, Human
uguuccuggggaaucuucc

SEQ ID NO: 1171815 - RNA, 25 nt, Human
uuaauccauucacagcucuuucacc

SEQ ID NO: 1171816 - RNA, 22 nt, Human
uuagcugggcgugguggggugc

SEQ ID NO: 1171817 - RNA, 21 nt, Human
uuccaaauggucugagggccc

SEQ ID NO: 1171818 - RNA, 19 nt, Human
uuccucuuuuugcuuggug

SEQ ID NO: 1171819 - RNA, 21 nt, Human
uuccuggggaaucuuccuguc

SEQ ID NO: 1171820 - RNA, 23 nt, Human
uuguaccacugcacuccagacug

SEQ ID NO: 1171821 - RNA, 21 nt, Human
uuuuugguaccucugcugguc

SEQ ID NO: 1171822 - RNA, 21 nt, Human
aaaucagguuuuauuaagcca

SEQ ID NO: 1171823 - RNA, 21 nt, Human
aaauccacgucgcagcccagg

SEQ ID NO: 1171824 - RNA, 20 nt, Human
aacaacaaaaaagcaccaag

SEQ ID NO: 1171825 - RNA, 22 nt, Human
aacaaguuaacaacaacaaaaa

SEQ ID NO: 1171826 - RNA, 20 nt, Human
aacauacuaaugauauauaa

SEQ ID NO: 1171827 - RNA, 22 nt, Human
aacugcuaaaaaauaaauugag

SEQ ID NO: 1171828 - RNA, 20 nt, Human
aagaaaccuggcaucucuac

SEQ ID NO: 1171829 - RNA, 25 nt, Human
aagcuuguggccacuagcauagaug

SEQ ID NO: 1171830 - RNA, 27 nt, Human
acaaaauggaagacucuaaaauguacc

SEQ ID NO: 1171831 - RNA, 19 nt, Human
acagcauuugaggaagagg

SEQ ID NO: 1171832 - RNA, 20 nt, Human
acccagcacuuaagagugcc

SEQ ID NO: 1171833 - RNA, 21 nt, Human
acgcuggaggaacauaaaaca

SEQ ID NO: 1171834 - RNA, 19 nt, Human
agaaggaugaauggagggu

SEQ ID NO: 1171835 - RNA, 21 nt, Human
agaauuacagauguauuacua

SEQ ID NO: 1171836 - RNA, 18 nt, Human
agauaaaaaagaaaccug

SEQ ID NO: 1171837 - RNA, 24 nt, Human
agccaauccucauaacccagcacu

SEQ ID NO: 1171838 - RNA, 19 nt, Human
aguacacgaccaauuaaaa

SEQ ID NO: 1171839 - RNA, 20 nt, Human
auacuugcaucccagccaua

SEQ ID NO: 1171840 - RNA, 18 nt, Human
aucucggugccuagugug

SEQ ID NO: 1171841 - RNA, 24 nt, Human
auggagggucagcuucaguccaca

SEQ ID NO: 1171842 - RNA, 22 nt, Human
caaaauggaagacucuaaaaug

SEQ ID NO: 1171843 - RNA, 18 nt, Human
caacaacaaaaaagcacc

SEQ ID NO: 1171844 - RNA, 23 nt, Human
caacaacaaaaaagcaccaagua

SEQ ID NO: 1171845 - RNA, 18 nt, Human
caacauuaaaagauacac

SEQ ID NO: 1171846 - RNA, 21 nt, Human
caagcaacaagccucucaucc

SEQ ID NO: 1171847 - RNA, 18 nt, Human
caccaaguuccccaaauc

SEQ ID NO: 1171848 - RNA, 24 nt, Human
cauaacccagcacuuaagagugcc

SEQ ID NO: 1171849 - RNA, 20 nt, Human
ccacaugcuaacuggucuuc

SEQ ID NO: 1171850 - RNA, 20 nt, Human
ccacccaggagagcugacag

SEQ ID NO: 1171851 - RNA, 23 nt, Human
cccagcgagacugacagcagucu

SEQ ID NO: 1171852 - RNA, 22 nt, Human
ccccugaaaggguaacaccuua

SEQ ID NO: 1171853 - RNA, 23 nt, Human
ccuagaccaagcuuguggccacu

SEQ ID NO: 1171854 - RNA, 23 nt, Human
cgagaaggaugaauggaggguca

SEQ ID NO: 1171855 - RNA, 18 nt, Human
cgaguguuccuguuucuu

SEQ ID NO: 1171856 - RNA, 20 nt, Human
cuaaaugaacaaguuaacag

SEQ ID NO: 1171857 - RNA, 21 nt, Human
cuaaaugaagaauuacagaug

SEQ ID NO: 1171858 - RNA, 23 nt, Human
cuacaggggccaccaaguucccc

SEQ ID NO: 1171859 - RNA, 21 nt, Human
cucccuggcagugagcuucag

SEQ ID NO: 1171860 - RNA, 19 nt, Human
cugacagcagucuccaacu

SEQ ID NO: 1171861 - RNA, 18 nt, Human
cugccugucacuuuggug

SEQ ID NO: 1171862 - RNA, 20 nt, Human
cuggcagugagcuucaggcc

SEQ ID NO: 1171863 - RNA, 25 nt, Human
cuugcugucccagcgagacugacag

SEQ ID NO: 1171864 - RNA, 21 nt, Human
cuuuugcccuaauuacccuuc

SEQ ID NO: 1171865 - RNA, 19 nt, Human
gaaauaauaacaaaaaugc

SEQ ID NO: 1171866 - RNA, 24 nt, Human
gaaauaauaacaaaaaugcuaugg

SEQ ID NO: 1171867 - RNA, 19 nt, Human
gaguuguucacuuuagugg

SEQ ID NO: 1171868 - RNA, 20 nt, Human
gcucugggucacucaggacu

SEQ ID NO: 1171869 - RNA, 22 nt, Human
ggaggaacauaaaacaauguua

SEQ ID NO: 1171870 - RNA, 21 nt, Human
ggaguuguucacuuuaguggg

SEQ ID NO: 1171871 - RNA, 24 nt, Human
gugcucccacuuguauccugucuu

SEQ ID NO: 1171872 - RNA, 19 nt, Human
uaaaaaagaaaccuggcau

SEQ ID NO: 1171873 - RNA, 24 nt, Human
uaacaacaacaaaaaagcaccaag

SEQ ID NO: 1171874 - RNA, 22 nt, Human
uaagccaaauccauaucccuug

SEQ ID NO: 1171875 - RNA, 20 nt, Human
uaccacauaagcccaguuua

SEQ ID NO: 1171876 - RNA, 19 nt, Human
uagcaauacuugcauccca

SEQ ID NO: 1171877 - RNA, 21 nt, Human
uagcaauacuugcaucccagc

SEQ ID NO: 1171878 - RNA, 19 nt, Human
uagccucuaaaccaauaug

SEQ ID NO: 1171879 - RNA, 19 nt, Human
uagcuggccagccaauccu

SEQ ID NO: 1171880 - RNA, 23 nt, Human
uaguggagaagugggcuuuagga

SEQ ID NO: 1171881 - RNA, 19 nt, Human
uccagacugccugucacuu

SEQ ID NO: 1171882 - RNA, 25 nt, Human
uccccaaaucuaccacugaagggac

SEQ ID NO: 1171883 - RNA, 23 nt, Human
ucccccaguguuaggcgagaagg

SEQ ID NO: 1171884 - RNA, 19 nt, Human
ucccuuggugaagacaugc

SEQ ID NO: 1171885 - RNA, 19 nt, Human
uccuagaccaagcuugugg

SEQ ID NO: 1171886 - RNA, 23 nt, Human
ucugaagcgaguguuccuguuuc

SEQ ID NO: 1171887 - RNA, 22 nt, Human
ucuuugcaaaugucaggccaua

SEQ ID NO: 1171888 - RNA, 25 nt, Human
ugaaaggguaacaccuuaaagcuga

SEQ ID NO: 1171889 - RNA, 18 nt, Human
ugaagacaugcuuggcag

SEQ ID NO: 1171890 - RNA, 19 nt, Human
ugagaauaccacauaagcc

SEQ ID NO: 1171891 - RNA, 20 nt, Human
ugauuuuagcacuuuucccc

SEQ ID NO: 1171892 - RNA, 18 nt, Human
ugccacccaggagagcug

SEQ ID NO: 1171893 - RNA, 18 nt, Human
ugcccuaauuacccuucu

SEQ ID NO: 1171894 - RNA, 21 nt, Human
uggagaagugggcuuuaggau

SEQ ID NO: 1171895 - RNA, 19 nt, Human
uggcacagccaucuucugc

SEQ ID NO: 1171896 - RNA, 23 nt, Human
uggcagauuugccaagauuagca

SEQ ID NO: 1171897 - RNA, 18 nt, Human
uggguuucuucuguaccc

SEQ ID NO: 1171898 - RNA, 22 nt, Human
uguauccugucuugauuuuagc

SEQ ID NO: 1171899 - RNA, 19 nt, Human
ugugaagguaucuaugcug

SEQ ID NO: 1171900 - RNA, 23 nt, Human
uuaaaaugaaacuuaaacuagca

SEQ ID NO: 1171901 - RNA, 18 nt, Human
uugaggaagaggaucuaa

SEQ ID NO: 1171902 - RNA, 20 nt, Human
uugaggaagaggaucuaauu

SEQ ID NO: 1171903 - RNA, 20 nt, Human
uugucaguguuccauuucuu

SEQ ID NO: 1171904 - RNA, 26 nt, Human
aaacagacaucacaucuaccguuccu

SEQ ID NO: 1171905 - RNA, 21 nt, Human
agggaguaaauaaaaaucuga

SEQ ID NO: 1171906 - RNA, 24 nt, Human
agggaguaaauaaaaaucugaagc

SEQ ID NO: 1171907 - RNA, 19 nt, Human
gaagcaaguuuuacuuguu

SEQ ID NO: 1171908 - RNA, 20 nt, Human
guuccuuccccuuagguggc

SEQ ID NO: 1171909 - RNA, 19 nt, Human
ucugaagcaaguuuuacuu

SEQ ID NO: 1171910 - RNA, 21 nt, Human
uggguuucagggaggcagucu

SEQ ID NO: 1171911 - RNA, 19 nt, Human
uucuaagugaugcuucaag

SEQ ID NO: 1171912 - RNA, 21 nt, Human
aacaaaaagaagucagaagga

SEQ ID NO: 1171913 - RNA, 18 nt, Human
aagcaaugauaccagcca

SEQ ID NO: 1171914 - RNA, 23 nt, Human
aagcuccauuaaguucaagcaau

SEQ ID NO: 1171915 - RNA, 23 nt, Human
acuucaaaaaguucauggaaaaa

SEQ ID NO: 1171916 - RNA, 22 nt, Human
agaaaaacaggugcccuucagg

SEQ ID NO: 1171917 - RNA, 25 nt, Human
cauauguguguguuucuaucuuccc

SEQ ID NO: 1171918 - RNA, 19 nt, Human
gaaaaauagaauuaaaaga

SEQ ID NO: 1171919 - RNA, 20 nt, Human
uaucccuaaagaacugaggg

SEQ ID NO: 1171920 - RNA, 20 nt, Human
uauguguguguuucuaucuu

SEQ ID NO: 1171921 - RNA, 20 nt, Human
ucagaaggagccaaaucagg

SEQ ID NO: 1171922 - RNA, 18 nt, Human
ucuaucccuaaagaacug

SEQ ID NO: 1171923 - RNA, 23 nt, Human
uucaaaaaguucauggaaaaaua

SEQ ID NO: 1171924 - RNA, 24 nt, Human
aaaaagggaagaaagcaaaaacgu

SEQ ID NO: 1171925 - RNA, 21 nt, Human
aagcaaaaacgucccuugcac

SEQ ID NO: 1171926 - RNA, 18 nt, Human
agaaagcaaaaacguccc

SEQ ID NO: 1171927 - RNA, 18 nt, Human
cccugcaacccagugucu

SEQ ID NO: 1171928 - RNA, 18 nt, Human
ccgaacuggaacguaauu

SEQ ID NO: 1171929 - RNA, 18 nt, Human
cucgugcuuuuucagccc

SEQ ID NO: 1171930 - RNA, 24 nt, Human
gggagguggaaaacuaaaggucaa

SEQ ID NO: 1171931 - RNA, 20 nt, Human
uacacaccgaacuggaacgu

SEQ ID NO: 1171932 - RNA, 19 nt, Human
ucaaaaagggaagaaagca

SEQ ID NO: 1171933 - RNA, 24 nt, Human
ugggagguggaaaacuaaagguca

SEQ ID NO: 1171934 - RNA, 18 nt, Human
uugaaguugggaggugga

SEQ ID NO: 1171935 - RNA, 24 nt, Human
aaacaggcaagcugcuacauuccu

SEQ ID NO: 1171936 - RNA, 23 nt, Human
aagcauuucggcacccucaaaug

SEQ ID NO: 1171937 - RNA, 20 nt, Human
acccugagaacgauaaacug

SEQ ID NO: 1171938 - RNA, 21 nt, Human
agaaaggaggaauuaguguuu

SEQ ID NO: 1171939 - RNA, 18 nt, Human
agaggcagaaaucugguc

SEQ ID NO: 1171940 - RNA, 23 nt, Human
agcaaucuuguucuuuucucucc

SEQ ID NO: 1171941 - RNA, 18 nt, Human
agcuuccgaaaaaauucu

SEQ ID NO: 1171942 - RNA, 23 nt, Human
aguuagucacaccagaucgagga

SEQ ID NO: 1171943 - RNA, 21 nt, Human
augcuucuggauugaagguag

SEQ ID NO: 1171944 - RNA, 21 nt, Human
auuuugagaguuucugaauuu

SEQ ID NO: 1171945 - RNA, 21 nt, Human
caaaugcaauacuuucuaaug

SEQ ID NO: 1171946 - RNA, 21 nt, Human
caacugggccgaacaagcagg

SEQ ID NO: 1171947 - RNA, 24 nt, Human
cacacuugcuaaaugagcuggaaa

SEQ ID NO: 1171948 - RNA, 19 nt, Human
caccauuaccccccuuuag

SEQ ID NO: 1171949 - RNA, 22 nt, Human
cacuuauaacagaaacacgaga

SEQ ID NO: 1171950 - RNA, 20 nt, Human
cagcucacccugagaacgau

SEQ ID NO: 1171951 - RNA, 21 nt, Human
cauaacauaccaccuuguuca

SEQ ID NO: 1171952 - RNA, 18 nt, Human
caucaaguuguucacuug

SEQ ID NO: 1171953 - RNA, 20 nt, Human
ccucaaauguacugggaaug

SEQ ID NO: 1171954 - RNA, 21 nt, Human
cugaauggaaucuccagauga

SEQ ID NO: 1171955 - RNA, 18 nt, Human
cuggaaaaauggguggcg

SEQ ID NO: 1171956 - RNA, 26 nt, Human
cuucaugaucauauaguaaauaagcu

SEQ ID NO: 1171957 - RNA, 28 nt, Human
gaccuggcagcugaauuucugaacugga

SEQ ID NO: 1171958 - RNA, 20 nt, Human
gcaucaccguugcauuuacu

SEQ ID NO: 1171959 - RNA, 21 nt, Human
gcuccuuucgguggguuaaaa

SEQ ID NO: 1171960 - RNA, 23 nt, Human
gcuuuccaaaguuauccucaauc

SEQ ID NO: 1171961 - RNA, 23 nt, Human
gggaaugccagcaguuuccaaag

SEQ ID NO: 1171962 - RNA, 20 nt, Human
ggucagcaagguguuuggau

SEQ ID NO: 1171963 - RNA, 21 nt, Human
guaaaggaaggaaaggaucug

SEQ ID NO: 1171964 - RNA, 21 nt, Human
uaguaagcuguuuucaauguu

SEQ ID NO: 1171965 - RNA, 22 nt, Human
uaguagcaggguuuuccaaacc

SEQ ID NO: 1171966 - RNA, 25 nt, Human
uaucccaagcaucacuucuaucugc

SEQ ID NO: 1171967 - RNA, 20 nt, Human
ucaguaguaagucauucguu

SEQ ID NO: 1171968 - RNA, 24 nt, Human
ucccuuuuuauuuaaaugacugga

SEQ ID NO: 1171969 - RNA, 19 nt, Human
ucucaauauucucugcugu

SEQ ID NO: 1171970 - RNA, 19 nt, Human
ucucuccuggaaaccugga

SEQ ID NO: 1171971 - RNA, 23 nt, Human
ucugaacuggagcuuuuggaggc

SEQ ID NO: 1171972 - RNA, 21 nt, Human
ucuuucuuucucaauauucuc

SEQ ID NO: 1171973 - RNA, 18 nt, Human
ugaacuacuuucugcagg

SEQ ID NO: 1171974 - RNA, 23 nt, Human
ugaaggaaaaacugcauuuucac

SEQ ID NO: 1171975 - RNA, 19 nt, Human
ugacacacuugcuaaauga

SEQ ID NO: 1171976 - RNA, 19 nt, Human
ugaccagugcuucaccacu

SEQ ID NO: 1171977 - RNA, 23 nt, Human
ugaucauauaguaaauaagcuuc

SEQ ID NO: 1171978 - RNA, 19 nt, Human
ugcacagaaaaggucauca

SEQ ID NO: 1171979 - RNA, 19 nt, Human
ugcauuuucaccauuaccc

SEQ ID NO: 1171980 - RNA, 24 nt, Human
ugccugagcucagaggcagaaauc

SEQ ID NO: 1171981 - RNA, 19 nt, Human
uggaaaaacaggcaagcug

SEQ ID NO: 1171982 - RNA, 20 nt, Human
uggaaaaacaggcaagcugc

SEQ ID NO: 1171983 - RNA, 24 nt, Human
uggagcuuuuggaggcacugaugg

SEQ ID NO: 1171984 - RNA, 18 nt, Human
uggaucuuuaaaacaugc

SEQ ID NO: 1171985 - RNA, 20 nt, Human
uggcaaaaaauaaacaaacu

SEQ ID NO: 1171986 - RNA, 25 nt, Human
uggcaaaaaauaaacaaacuuucca

SEQ ID NO: 1171987 - RNA, 22 nt, Human
uggcaucaccguugcauuuacu

SEQ ID NO: 1171988 - RNA, 24 nt, Human
ugggaaaaaacagaauuaguccca

SEQ ID NO: 1171989 - RNA, 19 nt, Human
uggucagcaagguguuugg

SEQ ID NO: 1171990 - RNA, 21 nt, Human
ugguccauuagcuugccugag

SEQ ID NO: 1171991 - RNA, 19 nt, Human
uguacugggaaugccagca

SEQ ID NO: 1171992 - RNA, 23 nt, Human
uguuacugguaaaauuuugugau

SEQ ID NO: 1171993 - RNA, 22 nt, Human
uguuuggauggcauacagugug

SEQ ID NO: 1171994 - RNA, 18 nt, Human
uuaguguuuccuucaauc

SEQ ID NO: 1171995 - RNA, 23 nt, Human
uuccacaguugaguuuucuugcu

SEQ ID NO: 1171996 - RNA, 22 nt, Human
uugaacuacuuucugcagguaa

SEQ ID NO: 1171997 - RNA, 22 nt, Human
uugaggacaacaauggaguuga

SEQ ID NO: 1171998 - RNA, 24 nt, Human
uuguuuggucacagcugauucugc

SEQ ID NO: 1171999 - RNA, 20 nt, Human
uuucccuuuuuauuuaaaug

SEQ ID NO: 1172000 - RNA, 21 nt, Human
uuuggauuuaugacacuuucc

SEQ ID NO: 1172001 - RNA, 18 nt, Human
aguacuuugaggcuagug

SEQ ID NO: 1172002 - RNA, 20 nt, Human
gagagauaguagggggaccc

SEQ ID NO: 1172003 - RNA, 18 nt, Human
gaggagggauugguagca

SEQ ID NO: 1172004 - RNA, 20 nt, Human
ggauuuggaggagggauugg

SEQ ID NO: 1172005 - RNA, 18 nt, Human
uagcucaggcugagauca

SEQ ID NO: 1172006 - RNA, 19 nt, Human
uuucaugguugacauggau

SEQ ID NO: 1172007 - RNA, 23 nt, Human
aaacugauuuugccuucucuuug

SEQ ID NO: 1172008 - RNA, 20 nt, Human
acugauuuugccuucucuuu

SEQ ID NO: 1172009 - RNA, 26 nt, Human
acuuagcaacucagggacacaaacug

SEQ ID NO: 1172010 - RNA, 21 nt, Human
augcugaccagaaacaaagca

SEQ ID NO: 1172011 - RNA, 19 nt, Human
cacacccacacaaauacca

SEQ ID NO: 1172012 - RNA, 20 nt, Human
cacacccacacaaauaccaa

SEQ ID NO: 1172013 - RNA, 21 nt, Human
cacacccacacaaauaccaau

SEQ ID NO: 1172014 - RNA, 21 nt, Human
caguagccaggaacugaaugc

SEQ ID NO: 1172015 - RNA, 25 nt, Human
cccacacaaauaccaauaucuauau

SEQ ID NO: 1172016 - RNA, 23 nt, Human
cgagcaccucccaguaagacuga

SEQ ID NO: 1172017 - RNA, 25 nt, Human
cugaccagaaacaaagcacauuuca

SEQ ID NO: 1172018 - RNA, 21 nt, Human
cugcaaaauuucuucaguagc

SEQ ID NO: 1172019 - RNA, 22 nt, Human
cugguugguggacguuucuucu

SEQ ID NO: 1172020 - RNA, 22 nt, Human
gagcaccucccaguaagacuga

SEQ ID NO: 1172021 - RNA, 18 nt, Human
gcaaaauuucuucaguag

SEQ ID NO: 1172022 - RNA, 19 nt, Human
ggaggcagguguuuccugg

SEQ ID NO: 1172023 - RNA, 26 nt, Human
guaacacacacccacacaaauaccaa

SEQ ID NO: 1172024 - RNA, 23 nt, Human
uaaaugaauuaauauauauuuua

SEQ ID NO: 1172025 - RNA, 22 nt, Human
ucuggaacuccugcaaaauuuc

SEQ ID NO: 1172026 - RNA, 20 nt, Human
ugaacauguucaacauuuuu

SEQ ID NO: 1172027 - RNA, 19 nt, Human
ugaccagaaacaaagcaca

SEQ ID NO: 1172028 - RNA, 20 nt, Human
ugcaaaauuucuucaguagc

SEQ ID NO: 1172029 - RNA, 19 nt, Human
uguaacacacacccacaca

SEQ ID NO: 1172030 - RNA, 18 nt, Human
aaccugcucuuucacucu

SEQ ID NO: 1172031 - RNA, 19 nt, Human
aaccugcucuuucacucuu

SEQ ID NO: 1172032 - RNA, 22 nt, Human
aaguucuccaaguacccaccgg

SEQ ID NO: 1172033 - RNA, 18 nt, Human
aggaagcuucaggacuac

SEQ ID NO: 1172034 - RNA, 24 nt, Human
aggaagcuucaggacuacaccaaa

SEQ ID NO: 1172035 - RNA, 26 nt, Human
caaguacccaccggacucaggagccc

SEQ ID NO: 1172036 - RNA, 20 nt, Human
caccaaagaagcagaaccug

SEQ ID NO: 1172037 - RNA, 19 nt, Human
caugacugcucucuacaug

SEQ ID NO: 1172038 - RNA, 18 nt, Human
ccugcucuuucacucugu

SEQ ID NO: 1172039 - RNA, 18 nt, Human
cgcucugaauaaugggau

SEQ ID NO: 1172040 - RNA, 21 nt, Human
cuacaccaaagaagcagaacc

SEQ ID NO: 1172041 - RNA, 22 nt, Human
cuccaaguacccaccggacuca

SEQ ID NO: 1172042 - RNA, 22 nt, Human
cuguugcauuguguggagugca

SEQ ID NO: 1172043 - RNA, 18 nt, Human
gacugcucucuacaugaa

SEQ ID NO: 1172044 - RNA, 20 nt, Human
ggagcccagcuggcuuugcc

SEQ ID NO: 1172045 - RNA, 19 nt, Human
guucuccaaguacccaccg

SEQ ID NO: 1172046 - RNA, 22 nt, Human
ucacucuguugcauugugugga

SEQ ID NO: 1172047 - RNA, 19 nt, Human
uccaaguacccaccggacu

SEQ ID NO: 1172048 - RNA, 23 nt, Human
ucuccaaguacccaccggacucu

SEQ ID NO: 1172049 - RNA, 26 nt, Human
ugaaacaucuccucauggagcuucag

SEQ ID NO: 1172050 - RNA, 21 nt, Human
ugaaacccuacaagcguuucc

SEQ ID NO: 1172051 - RNA, 23 nt, Human
agcuccccaaugucauggccucu

SEQ ID NO: 1172052 - RNA, 21 nt, Human
aggcucugauggccaaaaacg

SEQ ID NO: 1172053 - RNA, 19 nt, Human
ccccaaugucauggccucu

SEQ ID NO: 1172054 - RNA, 23 nt, Human
aaacagaucauaaaaacauucuc

SEQ ID NO: 1172055 - RNA, 22 nt, Human
aacaaaaaaaaugcacaacuga

SEQ ID NO: 1172056 - RNA, 20 nt, Human
aacagagcaagacuccaucu

SEQ ID NO: 1172057 - RNA, 21 nt, Human
aacauagugagauccugucuc

SEQ ID NO: 1172058 - RNA, 25 nt, Human
aacugacacacagggaucaaucuca

SEQ ID NO: 1172059 - RNA, 20 nt, Human
aagagcauacuaugaacuaa

SEQ ID NO: 1172060 - RNA, 20 nt, Human
aagauggacagcagcuauag

SEQ ID NO: 1172061 - RNA, 22 nt, Human
aaggggguaugagaauuuuggg

SEQ ID NO: 1172062 - RNA, 21 nt, Human
aauaaaugacaaacaauucua

SEQ ID NO: 1172063 - RNA, 18 nt, Human
aauggaugggcaagaugg

SEQ ID NO: 1172064 - RNA, 24 nt, Human
aauuugggaggaaaacacagauua

SEQ ID NO: 1172065 - RNA, 18 nt, Human
acaaaauaucaaucuaag

SEQ ID NO: 1172066 - RNA, 25 nt, Human
acagagcaagacuccaucucuaaaa

SEQ ID NO: 1172067 - RNA, 26 nt, Human
acauuuaucacaucucgaaucaccuc

SEQ ID NO: 1172068 - RNA, 18 nt, Human
accagcuggagaacauag

SEQ ID NO: 1172069 - RNA, 22 nt, Human
accaguguagugguaaacagua

SEQ ID NO: 1172070 - RNA, 23 nt, Human
acuaagcauuacaacaaaaaaga

SEQ ID NO: 1172071 - RNA, 20 nt, Human
acucgcuguuagaacuuugg

SEQ ID NO: 1172072 - RNA, 24 nt, Human
agaaaucccacaccuccucacgcc

SEQ ID NO: 1172073 - RNA, 22 nt, Human
agaacauacuacucagcaacaa

SEQ ID NO: 1172074 - RNA, 21 nt, Human
agacagaucccauggaggcag

SEQ ID NO: 1172075 - RNA, 19 nt, Human
agaggaauugauugggaaa

SEQ ID NO: 1172076 - RNA, 25 nt, Human
agauuagaaauguuugugagaaggu

SEQ ID NO: 1172077 - RNA, 18 nt, Human
agcaaaucuguggcugcc

SEQ ID NO: 1172078 - RNA, 21 nt, Human
agcaacaaaaaaaaugcacaa

SEQ ID NO: 1172079 - RNA, 20 nt, Human
agcauuuugggaggcugagg

SEQ ID NO: 1172080 - RNA, 24 nt, Human
agccuaggcaacagagcaagacuc

SEQ ID NO: 1172081 - RNA, 23 nt, Human
aggaguucaagaccagccuaggc

SEQ ID NO: 1172082 - RNA, 24 nt, Human
aggaucaucugagcccaggaguuc

SEQ ID NO: 1172083 - RNA, 24 nt, Human
aggcacaguggcucacacuuguaa

SEQ ID NO: 1172084 - RNA, 25 nt, Human
aggcugaggacaggaggaucaucug

SEQ ID NO: 1172085 - RNA, 23 nt, Human
agggaucaaucucaaaaaucugc

SEQ ID NO: 1172086 - RNA, 18 nt, Human
aguggcacacaccuauag

SEQ ID NO: 1172087 - RNA, 24 nt, Human
aguggcucacacuuguaaucccag

SEQ ID NO: 1172088 - RNA, 23 nt, Human
auggcaguugacuugccaauauc

SEQ ID NO: 1172089 - RNA, 23 nt, Human
auggucaauauucaaaauauauc

SEQ ID NO: 1172090 - RNA, 23 nt, Human
auuugggaggaaaacacagauua

SEQ ID NO: 1172091 - RNA, 24 nt, Human
caaaauuccaauucaagacuauaa

SEQ ID NO: 1172092 - RNA, 18 nt, Human
caaacaaagaacaugagc

SEQ ID NO: 1172093 - RNA, 19 nt, Human
caaaccacaaacagggaag

SEQ ID NO: 1172094 - RNA, 20 nt, Human
caacaaaaaaaaugcacaac

SEQ ID NO: 1172095 - RNA, 25 nt, Human
caacaaaaaaaaugcacaacugaca

SEQ ID NO: 1172096 - RNA, 20 nt, Human
caacaaaaaagagguacuac

SEQ ID NO: 1172097 - RNA, 23 nt, Human
caacaauauaaagacagauccca

SEQ ID NO: 1172098 - RNA, 21 nt, Human
caagguaggauuuuggacuuu

SEQ ID NO: 1172099 - RNA, 22 nt, Human
caaguagcucacauccagugaa

SEQ ID NO: 1172100 - RNA, 18 nt, Human
caaucugauccaaaucca

SEQ ID NO: 1172101 - RNA, 23 nt, Human
cacacuuguaaucccagcacuuu

SEQ ID NO: 1172102 - RNA, 24 nt, Human
cacauuuaucacaucucgaaucaa

SEQ ID NO: 1172103 - RNA, 19 nt, Human
cacugcacuccagccagua

SEQ ID NO: 1172104 - RNA, 19 nt, Human
cacugcacuccagccagua

SEQ ID NO: 1172105 - RNA, 20 nt, Human
cacugcacuccagccaguag

SEQ ID NO: 1172106 - RNA, 18 nt, Human
cacuuguaaucccagcac

SEQ ID NO: 1172107 - RNA, 22 nt, Human
cacuuguaaucccagcacuuua

SEQ ID NO: 1172108 - RNA, 24 nt, Human
cagagcaagacuccaucucuaaaa

SEQ ID NO: 1172109 - RNA, 18 nt, Human
cagcacuuuaggaggccg

SEQ ID NO: 1172110 - RNA, 20 nt, Human
cagcacuuuaggaggccgag

SEQ ID NO: 1172111 - RNA, 18 nt, Human
cagcauuuugggaggcug

SEQ ID NO: 1172112 - RNA, 25 nt, Human
cagcauuuugggaggcugaggacag

SEQ ID NO: 1172113 - RNA, 21 nt, Human
cauuauauagccauagagaau

SEQ ID NO: 1172114 - RNA, 24 nt, Human
cauuauauagccauagagaaugca

SEQ ID NO: 1172115 - RNA, 18 nt, Human
ccaagaggaagcggccga

SEQ ID NO: 1172116 - RNA, 18 nt, Human
ccacugcacuccagccag

SEQ ID NO: 1172117 - RNA, 18 nt, Human
ccacugcacuccagccag

SEQ ID NO: 1172118 - RNA, 19 nt, Human
ccacugcacuccagccagu

SEQ ID NO: 1172119 - RNA, 22 nt, Human
ccacugcacuccagccaguaga

SEQ ID NO: 1172120 - RNA, 19 nt, Human
ccaguuaguaaaaucaaug

SEQ ID NO: 1172121 - RNA, 24 nt, Human
ccaguuaguaaaaucaaugaaauc

SEQ ID NO: 1172122 - RNA, 23 nt, Human
ccccaauuucuccaauccacucc

SEQ ID NO: 1172123 - RNA, 22 nt, Human
ccccuaaucucucaucuauacc

SEQ ID NO: 1172124 - RNA, 18 nt, Human
ccuaaaguaaaaauaaaa

SEQ ID NO: 1172125 - RNA, 22 nt, Human
ccugguggcucccagcauuuug

SEQ ID NO: 1172126 - RNA, 23 nt, Human
ccuucuaugucgugaacacucag

SEQ ID NO: 1172127 - RNA, 20 nt, Human
cgugauaguggcugcacaga

SEQ ID NO: 1172128 - RNA, 19 nt, Human
cuaggaguuugaggcugca

SEQ ID NO: 1172129 - RNA, 22 nt, Human
cucaaaccacaaacagggaagu

SEQ ID NO: 1172130 - RNA, 22 nt, Human
cucacacuuguaaucccagcac

SEQ ID NO: 1172131 - RNA, 24 nt, Human
cucacacuuguaaucccagcacuu

SEQ ID NO: 1172132 - RNA, 21 nt, Human
cucugccuucucuugcucuuc

SEQ ID NO: 1172133 - RNA, 20 nt, Human
cugacauaagauagaacaua

SEQ ID NO: 1172134 - RNA, 19 nt, Human
cugcagcccacccgccaag

SEQ ID NO: 1172135 - RNA, 23 nt, Human
cugcagugagcuacagacugcac

SEQ ID NO: 1172136 - RNA, 24 nt, Human
cuuuccuucuucucgacucacagu

SEQ ID NO: 1172137 - RNA, 21 nt, Human
gaacauagugagauccugucu

SEQ ID NO: 1172138 - RNA, 24 nt, Human
gaacauagugagauccugucucua

SEQ ID NO: 1172139 - RNA, 20 nt, Human
gaggacaggaggaucaucug

SEQ ID NO: 1172140 - RNA, 22 nt, Human
gaggccaggagcuugagaccag

SEQ ID NO: 1172141 - RNA, 24 nt, Human
gaucaucugagcccaggaguucaa

SEQ ID NO: 1172142 - RNA, 24 nt, Human
gaucgccugagccuaggaguuuga

SEQ ID NO: 1172143 - RNA, 23 nt, Human
gaucgugauaguggcugcacaga

SEQ ID NO: 1172144 - RNA, 21 nt, Human
gauuauuucuuuuaacuccaa

SEQ ID NO: 1172145 - RNA, 18 nt, Human
gccaaugauugcugaguu

SEQ ID NO: 1172146 - RNA, 22 nt, Human
gcccaggaguucaagaccagcc

SEQ ID NO: 1172147 - RNA, 19 nt, Human
gccgugaaucuacugaagc

SEQ ID NO: 1172148 - RNA, 18 nt, Human
gccuaggaguuugaggcu

SEQ ID NO: 1172149 - RNA, 24 nt, Human
gccuaggaguuugaggcugcagug

SEQ ID NO: 1172150 - RNA, 19 nt, Human
gcugcagugagcuacagac

SEQ ID NO: 1172151 - RNA, 20 nt, Human
ggaaaaaaugcuuuuaauaa

SEQ ID NO: 1172152 - RNA, 19 nt, Human
ggaagaccuaugaacaugu

SEQ ID NO: 1172153 - RNA, 18 nt, Human
ggacaggaggaucaucug

SEQ ID NO: 1172154 - RNA, 23 nt, Human
ggaucaucugagcccaggaguuc

SEQ ID NO: 1172155 - RNA, 19 nt, Human
gggcaagauggacagcagc

SEQ ID NO: 1172156 - RNA, 19 nt, Human
ggggcgagggggaagaccu

SEQ ID NO: 1172157 - RNA, 23 nt, Human
gguggcucccagcauuuugggag

SEQ ID NO: 1172158 - RNA, 22 nt, Human
guagaucacaccuggugccugg

SEQ ID NO: 1172159 - RNA, 20 nt, Human
gugccugguggcucccagca

SEQ ID NO: 1172160 - RNA, 22 nt, Human
uaaaaagaaacagaaaaugccc

SEQ ID NO: 1172161 - RNA, 19 nt, Human
uaaaagcagcaauuucaug

SEQ ID NO: 1172162 - RNA, 25 nt, Human
uaaaauacacacguaaaaagggugc

SEQ ID NO: 1172163 - RNA, 23 nt, Human
uaaaaucacaagaauaaacaaua

SEQ ID NO: 1172164 - RNA, 24 nt, Human
uaaaaucacaagaauaaacaauac

SEQ ID NO: 1172165 - RNA, 20 nt, Human
uaaaauuacagauuaacacc

SEQ ID NO: 1172166 - RNA, 24 nt, Human
uaaaguucccucugaccacccucc

SEQ ID NO: 1172167 - RNA, 21 nt, Human
uaacuccaauacaauaaucua

SEQ ID NO: 1172168 - RNA, 21 nt, Human
uaagagcauacuaugaacuaa

SEQ ID NO: 1172169 - RNA, 21 nt, Human
uaaguacaauggcagcaauau

SEQ ID NO: 1172170 - RNA, 21 nt, Human
uaauauagguacaaguacuuc

SEQ ID NO: 1172171 - RNA, 18 nt, Human
uaaucgguaaccaaaagc

SEQ ID NO: 1172172 - RNA, 24 nt, Human
uaaugcaauauuaacacaaacuuu

SEQ ID NO: 1172173 - RNA, 22 nt, Human
uacaaaaaaccuaaauaugcca

SEQ ID NO: 1172174 - RNA, 20 nt, Human
uacaaaacacaacaugacag

SEQ ID NO: 1172175 - RNA, 18 nt, Human
uacacagguaauuagaaa

SEQ ID NO: 1172176 - RNA, 21 nt, Human
uacagacugcaccacugcacu

SEQ ID NO: 1172177 - RNA, 21 nt, Human
uaccugaagccuaacagccaa

SEQ ID NO: 1172178 - RNA, 22 nt, Human
uacgaaaucauagagggcaaga

SEQ ID NO: 1172179 - RNA, 21 nt, Human
uagaacauacuacucagcaac

SEQ ID NO: 1172180 - RNA, 19 nt, Human
uagaucacaccuggugccu

SEQ ID NO: 1172181 - RNA, 19 nt, Human
uagcaaaacgaacaaaaca

SEQ ID NO: 1172182 - RNA, 19 nt, Human
uagcagugauacuauaaaa

SEQ ID NO: 1172183 - RNA, 19 nt, Human
uaggaggccgaggccagga

SEQ ID NO: 1172184 - RNA, 19 nt, Human
uauacauaacaauauaugg

SEQ ID NO: 1172185 - RNA, 24 nt, Human
uauauuagcaaaacgaacaaaaca

SEQ ID NO: 1172186 - RNA, 27 nt, Human
uauggauaaagcuaaaguucccucuga

SEQ ID NO: 1172187 - RNA, 22 nt, Human
uauggugucuuuccccaucccu

SEQ ID NO: 1172188 - RNA, 22 nt, Human
ucaaucuaagcaauaaaugaca

SEQ ID NO: 1172189 - RNA, 20 nt, Human
ucagagcgcuuuuucuuugu

SEQ ID NO: 1172190 - RNA, 23 nt, Human
ucaucugagcccaggaguucaag

SEQ ID NO: 1172191 - RNA, 19 nt, Human
uccacaaaaaaaaaaaaaa

SEQ ID NO: 1172192 - RNA, 21 nt, Human
ucccacaccuccucacgccag

SEQ ID NO: 1172193 - RNA, 18 nt, Human
uccucugccuucucuugc

SEQ ID NO: 1172194 - RNA, 18 nt, Human
ucgccugagccuaggagu

SEQ ID NO: 1172195 - RNA, 18 nt, Human
ucggaugcuuaacauuuc

SEQ ID NO: 1172196 - RNA, 20 nt, Human
ucucuccaacaauauaaaga

SEQ ID NO: 1172197 - RNA, 22 nt, Human
ucugaccacccucccaauccug

SEQ ID NO: 1172198 - RNA, 23 nt, Human
ucugagcccaggaguucaagacc

SEQ ID NO: 1172199 - RNA, 20 nt, Human
ucuugcucuucuugccaaug

SEQ ID NO: 1172200 - RNA, 21 nt, Human
ugaagcauauuuacuggaaaa

SEQ ID NO: 1172201 - RNA, 19 nt, Human
ugaaggcauaaacccugcu

SEQ ID NO: 1172202 - RNA, 20 nt, Human
ugacuauggugucuuucccc

SEQ ID NO: 1172203 - RNA, 25 nt, Human
ugacuauggugucuuuccccauccc

SEQ ID NO: 1172204 - RNA, 25 nt, Human
ugagaccaauccagguuaauaugga

SEQ ID NO: 1172205 - RNA, 23 nt, Human
ugagaccagcuggagaacauagu

SEQ ID NO: 1172206 - RNA, 23 nt, Human
ugagcccaggaguucaagaccag

SEQ ID NO: 1172207 - RNA, 19 nt, Human
ugagcuacagacugcacca

SEQ ID NO: 1172208 - RNA, 18 nt, Human
ugaggcugcaggcacagg

SEQ ID NO: 1172209 - RNA, 19 nt, Human
ugauaaagucuaaccucau

SEQ ID NO: 1172210 - RNA, 23 nt, Human
ugauaugauguauuaaacauuga

SEQ ID NO: 1172211 - RNA, 18 nt, Human
ugaucuauaaaagcagca

SEQ ID NO: 1172212 - RNA, 19 nt, Human
ugaucuauaaaagcagcaa

SEQ ID NO: 1172213 - RNA, 22 nt, Human
ugauguauuacaaacaagcuuc

SEQ ID NO: 1172214 - RNA, 23 nt, Human
ugauugggaaaggggguaugaga

SEQ ID NO: 1172215 - RNA, 20 nt, Human
ugauuugcaccccuaaucuc

SEQ ID NO: 1172216 - RNA, 19 nt, Human
ugccugguggcucccagca

SEQ ID NO: 1172217 - RNA, 20 nt, Human
ugcgccagaaccguuaaaca

SEQ ID NO: 1172218 - RNA, 18 nt, Human
uggaacuguaaaaaaagc

SEQ ID NO: 1172219 - RNA, 18 nt, Human
uggauguuugcuauucuc

SEQ ID NO: 1172220 - RNA, 21 nt, Human
uggcucacacuuguaauccca

SEQ ID NO: 1172221 - RNA, 24 nt, Human
uggcucacacuuguaaucccagca

SEQ ID NO: 1172222 - RNA, 19 nt, Human
ugggaggccagggcaagag

SEQ ID NO: 1172223 - RNA, 23 nt, Human
ugggaggccagggcaagaggauc

SEQ ID NO: 1172224 - RNA, 25 nt, Human
ugggaggcugaggacaggaggauca

SEQ ID NO: 1172225 - RNA, 19 nt, Human
ugguauggauuccucugaa

SEQ ID NO: 1172226 - RNA, 22 nt, Human
ugguauggauuccucugaaccu

SEQ ID NO: 1172227 - RNA, 25 nt, Human
uguacauauauauaauuuguauaua

SEQ ID NO: 1172228 - RNA, 19 nt, Human
ugugcacauuuaucacauc

SEQ ID NO: 1172229 - RNA, 23 nt, Human
uguuuugagauucaaauuuucuc

SEQ ID NO: 1172230 - RNA, 20 nt, Human
uuaaaugaaacauuaagacc

SEQ ID NO: 1172231 - RNA, 21 nt, Human
uuacucacuaaugcaaacaaa

SEQ ID NO: 1172232 - RNA, 19 nt, Human
uuagaaaauauucucaaug

SEQ ID NO: 1172233 - RNA, 24 nt, Human
uuagaaauguuugugagaagguac

SEQ ID NO: 1172234 - RNA, 24 nt, Human
uuaggaggccgaggccaggagcuu

SEQ ID NO: 1172235 - RNA, 22 nt, Human
uucaaauaagagcauacuauga

SEQ ID NO: 1172236 - RNA, 21 nt, Human
uucauagcagcacucuagaaa

SEQ ID NO: 1172237 - RNA, 19 nt, Human
uuccccaucccucucuuuc

SEQ ID NO: 1172238 - RNA, 21 nt, Human
uugcagcuacaugggaggcca

SEQ ID NO: 1172239 - RNA, 22 nt, Human
uugcucuaagaaagccuuuugg

SEQ ID NO: 1172240 - RNA, 26 nt, Human
uugggaggcugaggacaggaggauca

SEQ ID NO: 1172241 - RNA, 25 nt, Human
uuuccugaggaggaagcauaguggc

SEQ ID NO: 1172242 - RNA, 22 nt, Human
uuugaucuauaaaagcagcaau

SEQ ID NO: 1172243 - RNA, 23 nt, Human
aaaagaaaaagaaauugcauaag

SEQ ID NO: 1172244 - RNA, 19 nt, Human
aaacaaguguaacaggccu

SEQ ID NO: 1172245 - RNA, 22 nt, Human
aaguguaacaggccuacacuua

SEQ ID NO: 1172246 - RNA, 23 nt, Human
aauaccugaugcuaguugaaaau

SEQ ID NO: 1172247 - RNA, 23 nt, Human
acaggucaaaaugcaaacucaug

SEQ ID NO: 1172248 - RNA, 24 nt, Human
accaauuugaguccccccagcccc

SEQ ID NO: 1172249 - RNA, 21 nt, Human
accaccccacacaaauaacca

SEQ ID NO: 1172250 - RNA, 19 nt, Human
acccauuucccuccuuuug

SEQ ID NO: 1172251 - RNA, 22 nt, Human
agcaaggcacuuggggcaggag

SEQ ID NO: 1172252 - RNA, 18 nt, Human
agccagucgucccagcgc

SEQ ID NO: 1172253 - RNA, 19 nt, Human
agcuccuccuucccccgcc

SEQ ID NO: 1172254 - RNA, 22 nt, Human
aguugaaaauuagugaccauga

SEQ ID NO: 1172255 - RNA, 18 nt, Human
auaguuuagaaaaaucaa

SEQ ID NO: 1172256 - RNA, 18 nt, Human
auccugcaaacuuccaag

SEQ ID NO: 1172257 - RNA, 23 nt, Human
caaacaggcucuacccauuuccc

SEQ ID NO: 1172258 - RNA, 22 nt, Human
caaaccaacacaucugugugaa

SEQ ID NO: 1172259 - RNA, 23 nt, Human
caaagucaaagcugcuacacuua

SEQ ID NO: 1172260 - RNA, 25 nt, Human
caacaccaccccacacaaauaacca

SEQ ID NO: 1172261 - RNA, 23 nt, Human
caagaguuaauauccagacacac

SEQ ID NO: 1172262 - RNA, 20 nt, Human
caagccagcaccuaagaucc

SEQ ID NO: 1172263 - RNA, 23 nt, Human
caauaauauauaacaacaccacc

SEQ ID NO: 1172264 - RNA, 18 nt, Human
caccaccccacacaaaua

SEQ ID NO: 1172265 - RNA, 25 nt, Human
caccuaagauccucugaauuuguuc

SEQ ID NO: 1172266 - RNA, 23 nt, Human
cagauaaagaaguuggaccacaa

SEQ ID NO: 1172267 - RNA, 22 nt, Human
cagccccucaaaaaggaacaau

SEQ ID NO: 1172268 - RNA, 19 nt, Human
cagcugcagcuccuccuuc

SEQ ID NO: 1172269 - RNA, 24 nt, Human
caggucaaaaugcaaacucaugua

SEQ ID NO: 1172270 - RNA, 24 nt, Human
caggucccaccuccugcgccgccc

SEQ ID NO: 1172271 - RNA, 19 nt, Human
cagguggccugagcagggu

SEQ ID NO: 1172272 - RNA, 24 nt, Human
cauaauacugaggcugaaacgaga

SEQ ID NO: 1172273 - RNA, 27 nt, Human
cauguaucuuucaucaaccuaaaucuu

SEQ ID NO: 1172274 - RNA, 22 nt, Human
ccaauccugcaaacuuccaaga

SEQ ID NO: 1172275 - RNA, 23 nt, Human
ccacaagccagcaccuaagaucc

SEQ ID NO: 1172276 - RNA, 21 nt, Human
ccacacaaauaaccauaaacu

SEQ ID NO: 1172277 - RNA, 18 nt, Human
ccacuguaaaagcaaggc

SEQ ID NO: 1172278 - RNA, 20 nt, Human
ccagacacacguuuucaaaa

SEQ ID NO: 1172279 - RNA, 22 nt, Human
ccaggggagcccggcccucucc

SEQ ID NO: 1172280 - RNA, 18 nt, Human
cccacacaaauaaccaua

SEQ ID NO: 1172281 - RNA, 23 nt, Human
cccccagccccucaaaaaggaac

SEQ ID NO: 1172282 - RNA, 21 nt, Human
ccccugcgcccgagcgacucc

SEQ ID NO: 1172283 - RNA, 18 nt, Human
cccggcccucucccucca

SEQ ID NO: 1172284 - RNA, 20 nt, Human
cccugcgcccgagcgacucc

SEQ ID NO: 1172285 - RNA, 21 nt, Human
ccuccugcgccgcccucccgu

SEQ ID NO: 1172286 - RNA, 24 nt, Human
ccucucccuccagcugccacaguc

SEQ ID NO: 1172287 - RNA, 21 nt, Human
ccucucgcugggcuggagagu

SEQ ID NO: 1172288 - RNA, 23 nt, Human
ccuggccucggcucggcacggga

SEQ ID NO: 1172289 - RNA, 24 nt, Human
cgccgggcugcgaccccagacccc

SEQ ID NO: 1172290 - RNA, 21 nt, Human
cgcggcuccgccaggggagcc

SEQ ID NO: 1172291 - RNA, 18 nt, Human
cuacacuuaaaccucugc

SEQ ID NO: 1172292 - RNA, 22 nt, Human
cuaucucuggggaagcaagaca

SEQ ID NO: 1172293 - RNA, 22 nt, Human
cucccuccagcugccacagucc

SEQ ID NO: 1172294 - RNA, 21 nt, Human
cugcaaacuuccaagaagggc

SEQ ID NO: 1172295 - RNA, 27 nt, Human
cugcgaccccagaccccuggccucggc

SEQ ID NO: 1172296 - RNA, 19 nt, Human
cuucacauucuaucucugg

SEQ ID NO: 1172297 - RNA, 18 nt, Human
gaguccccccagccccuc

SEQ ID NO: 1172298 - RNA, 27 nt, Human
gcacgggagccucccggcccgcgacca

SEQ ID NO: 1172299 - RNA, 20 nt, Human
gccgccgggaucccgggcac

SEQ ID NO: 1172300 - RNA, 24 nt, Human
gcugaaacgagaagaggcugucca

SEQ ID NO: 1172301 - RNA, 22 nt, Human
gcuguccacuguaaaagcaagg

SEQ ID NO: 1172302 - RNA, 21 nt, Human
ggaagacagacacugaacagg

SEQ ID NO: 1172303 - RNA, 22 nt, Human
ggcagguggccugagcaggguc

SEQ ID NO: 1172304 - RNA, 21 nt, Human
ggcccgcgaccacuuccucgg

SEQ ID NO: 1172305 - RNA, 20 nt, Human
ggcgcaggucccaccuccug

SEQ ID NO: 1172306 - RNA, 21 nt, Human
ggcgcgaucggcucucccucg

SEQ ID NO: 1172307 - RNA, 19 nt, Human
gucaaaaugcaaacucaug

SEQ ID NO: 1172308 - RNA, 25 nt, Human
gucccaccuccugcgccgcccuccc

SEQ ID NO: 1172309 - RNA, 20 nt, Human
guguacaauuuugaagaagu

SEQ ID NO: 1172310 - RNA, 23 nt, Human
uaaagaaguuggaccacaaacca

SEQ ID NO: 1172311 - RNA, 25 nt, Human
uacauaauacugaggcugaaacgag

SEQ ID NO: 1172312 - RNA, 22 nt, Human
uaguuuagaaaaaucaaaucaa

SEQ ID NO: 1172313 - RNA, 20 nt, Human
uauaacaacaccaccccaca

SEQ ID NO: 1172314 - RNA, 22 nt, Human
uauaacaacaccaccccacaca

SEQ ID NO: 1172315 - RNA, 21 nt, Human
ucaaaaaggaacaaugccacc

SEQ ID NO: 1172316 - RNA, 23 nt, Human
ucaaaaauguuuucucacuggcu

SEQ ID NO: 1172317 - RNA, 21 nt, Human
ucaaacaaguguaacaggccc

SEQ ID NO: 1172318 - RNA, 23 nt, Human
ucaaacaaguguaacaggccuac

SEQ ID NO: 1172319 - RNA, 24 nt, Human
ucaaacaaguguaacaggccuaca

SEQ ID NO: 1172320 - RNA, 19 nt, Human
uccacuguaaaagcaaggc

SEQ ID NO: 1172321 - RNA, 22 nt, Human
ucccaccuccugcgccgcccuc

SEQ ID NO: 1172322 - RNA, 21 nt, Human
uccgccaggggagcccggccc

SEQ ID NO: 1172323 - RNA, 22 nt, Human
uccugcgccgcccucccgugcc

SEQ ID NO: 1172324 - RNA, 23 nt, Human
ucgaggcgcgaucggcucucccu

SEQ ID NO: 1172325 - RNA, 23 nt, Human
ucucuggggaagcaagacaaaca

SEQ ID NO: 1172326 - RNA, 26 nt, Human
ucuggggaagcaagacaaacaggcuu

SEQ ID NO: 1172327 - RNA, 19 nt, Human
ugaacaggucaaaaugcaa

SEQ ID NO: 1172328 - RNA, 19 nt, Human
ugcugcugccugcgcuccg

SEQ ID NO: 1172329 - RNA, 20 nt, Human
uggccucggcucggcacggg

SEQ ID NO: 1172330 - RNA, 24 nt, Human
uguaaaagcaaggcacuuggggca

SEQ ID NO: 1172331 - RNA, 23 nt, Human
uguaacaggccuacacuuaaacc

SEQ ID NO: 1172332 - RNA, 23 nt, Human
uuaaacaagaguuaauauccaga

SEQ ID NO: 1172333 - RNA, 18 nt, Human
uucccggcgcagguccca

SEQ ID NO: 1172334 - RNA, 22 nt, Human
uucgccucucgcugggcuggag

SEQ ID NO: 1172335 - RNA, 18 nt, Human
uuggggcaggagccaggc

SEQ ID NO: 1172336 - RNA, 23 nt, Human
uuuucuaaaugauacuuuggcug

SEQ ID NO: 1172337 - RNA, 18 nt, Human
agucaaaauguggaaagu

SEQ ID NO: 1172338 - RNA, 19 nt, Human
auguuuaaacuuugacauu

SEQ ID NO: 1172339 - RNA, 21 nt, Human
caucuucuuccaagaagcuug

SEQ ID NO: 1172340 - RNA, 22 nt, Human
cauuuccaaagaccccaucugc

SEQ ID NO: 1172341 - RNA, 19 nt, Human
guguuucuggcacucacuc

SEQ ID NO: 1172342 - RNA, 21 nt, Human
uuuccaaagaccccaucugca

SEQ ID NO: 1172343 - RNA, 22 nt, Human
uuugacauuuuuccauuguugg

SEQ ID NO: 1172344 - RNA, 20 nt, Human
aauugcuugaacccaggagg

SEQ ID NO: 1172345 - RNA, 24 nt, Human
aauugcuugaacccaggaggcgga

SEQ ID NO: 1172346 - RNA, 24 nt, Human
acccaggaggcggagguugcagug

SEQ ID NO: 1172347 - RNA, 22 nt, Human
aggagacaggcagguucaaaca

SEQ ID NO: 1172348 - RNA, 26 nt, Human
aggagacaggcagguucaaacagcaa

SEQ ID NO: 1172349 - RNA, 20 nt, Human
aggcggagguugcagugagc

SEQ ID NO: 1172350 - RNA, 24 nt, Human
aggcggagguugcagugagcugag

SEQ ID NO: 1172351 - RNA, 21 nt, Human
cagagcuuagaacugcugccc

SEQ ID NO: 1172352 - RNA, 19 nt, Human
cagcggcagugguucucag

SEQ ID NO: 1172353 - RNA, 22 nt, Human
ccagagaauugcuugaacccag

SEQ ID NO: 1172354 - RNA, 21 nt, Human
ccccagagaauugcuugaacc

SEQ ID NO: 1172355 - RNA, 22 nt, Human
gagcuuagaacugcugccccag

SEQ ID NO: 1172356 - RNA, 21 nt, Human
gaggcggagguugcagugagc

SEQ ID NO: 1172357 - RNA, 23 nt, Human
gagguugcagugagcugagaucg

SEQ ID NO: 1172358 - RNA, 22 nt, Human
ggagguugcagugagcugagau

SEQ ID NO: 1172359 - RNA, 24 nt, Human
ggagguugcagugagcugagaucg

SEQ ID NO: 1172360 - RNA, 19 nt, Human
ggcagugguucucagccgu

SEQ ID NO: 1172361 - RNA, 26 nt, Human
gugcaaccagagcuuagaacugcugg

SEQ ID NO: 1172362 - RNA, 19 nt, Human
guugcagugagcugagauc

SEQ ID NO: 1172363 - RNA, 21 nt, Human
guugcagugagcugagaucgc

SEQ ID NO: 1172364 - RNA, 21 nt, Human
uagaacugcugccccagagaa

SEQ ID NO: 1172365 - RNA, 25 nt, Human
uagaauaaucccauccucaaauuaa

SEQ ID NO: 1172366 - RNA, 18 nt, Human
ugagcugagaucgcgcca

SEQ ID NO: 1172367 - RNA, 24 nt, Human
ugccccagagaauugcuugaaccc

SEQ ID NO: 1172368 - RNA, 19 nt, Human
uguguugaaacgucagcgg

SEQ ID NO: 1172369 - RNA, 21 nt, Human
uguguugaaacgucagcggca

SEQ ID NO: 1172370 - RNA, 24 nt, Human
uugaacccaggaggcggagguugc

SEQ ID NO: 1172371 - RNA, 19 nt, Human
uugcagugagcugagaucg

SEQ ID NO: 1172372 - RNA, 22 nt, Human
uugcagugagcugagaucgcgc

SEQ ID NO: 1172373 - RNA, 24 nt, Human
uugcuugaacccaggaggcggagg

SEQ ID NO: 1172374 - RNA, 25 nt, Human
aaaagcagugaagacacuaaauaac

SEQ ID NO: 1172375 - RNA, 23 nt, Human
aaacaaauguauagucacuugau

SEQ ID NO: 1172376 - RNA, 20 nt, Human
aaaguaauuuugaccuaaaa

SEQ ID NO: 1172377 - RNA, 21 nt, Human
aacagccaaauaccuaaugcc

SEQ ID NO: 1172378 - RNA, 27 nt, Human
aagcagugaagacacuaaauaacccag

SEQ ID NO: 1172379 - RNA, 20 nt, Human
aauaggccuaaccagauacc

SEQ ID NO: 1172380 - RNA, 21 nt, Human
aauggcacgcaagguaaacac

SEQ ID NO: 1172381 - RNA, 27 nt, Human
aauugcuuuuuuaaugaaggaugacac

SEQ ID NO: 1172382 - RNA, 23 nt, Human
acacccuaaaauaaaaaccugga

SEQ ID NO: 1172383 - RNA, 20 nt, Human
acagccaaauaccuaaugcc

SEQ ID NO: 1172384 - RNA, 23 nt, Human
acuaaaaaaacaagcuacucuag

SEQ ID NO: 1172385 - RNA, 26 nt, Human
agaaagaguaucaaauaaacuagaaa

SEQ ID NO: 1172386 - RNA, 23 nt, Human
agacacaaauaaaaauuauacca

SEQ ID NO: 1172387 - RNA, 20 nt, Human
agaugcugaauggccacagu

SEQ ID NO: 1172388 - RNA, 23 nt, Human
agaugcugaauggccacagugca

SEQ ID NO: 1172389 - RNA, 21 nt, Human
agcaguucuaaaacugaccua

SEQ ID NO: 1172390 - RNA, 27 nt, Human
agguaaauaauggcccacaaaaccaga

SEQ ID NO: 1172391 - RNA, 25 nt, Human
aggugaccuguggucccaccagagc

SEQ ID NO: 1172392 - RNA, 20 nt, Human
aucagacuuaaauagaccag

SEQ ID NO: 1172393 - RNA, 18 nt, Human
augcaaagcaacuucuac

SEQ ID NO: 1172394 - RNA, 21 nt, Human
auggcccacaaaaccagauga

SEQ ID NO: 1172395 - RNA, 21 nt, Human
auggucccacaccuacuaaaa

SEQ ID NO: 1172396 - RNA, 18 nt, Human
auucaccaugcugucagu

SEQ ID NO: 1172397 - RNA, 27 nt, Human
caauuuuuaacaaaagcagugaagaca

SEQ ID NO: 1172398 - RNA, 21 nt, Human
cacaccuacuaaaaaaacaag

SEQ ID NO: 1172399 - RNA, 23 nt, Human
cacugcauccauggcuguccuag

SEQ ID NO: 1172400 - RNA, 23 nt, Human
cagaaagaugcugaauggccaca

SEQ ID NO: 1172401 - RNA, 22 nt, Human
cagaggguccaacuccagacac

SEQ ID NO: 1172402 - RNA, 18 nt, Human
cagaugauaugguuaaga

SEQ ID NO: 1172403 - RNA, 18 nt, Human
cauggaaagaggggccuu

SEQ ID NO: 1172404 - RNA, 22 nt, Human
ccaaauaccuaaugccacauug

SEQ ID NO: 1172405 - RNA, 19 nt, Human
cccguaaacaucagacuua

SEQ ID NO: 1172406 - RNA, 23 nt, Human
ccuuuuguggaaaaaaauggagu

SEQ ID NO: 1172407 - RNA, 23 nt, Human
cuaaaauaaaaaccuggagugaa

SEQ ID NO: 1172408 - RNA, 22 nt, Human
cucuaaguuccaaucacucacu

SEQ ID NO: 1172409 - RNA, 19 nt, Human
cuggcaacaggagucucua

SEQ ID NO: 1172410 - RNA, 27 nt, Human
gaagguaaauaauggcccacaaaacca

SEQ ID NO: 1172411 - RNA, 24 nt, Human
gagcuugccaaguuaaacaccgcc

SEQ ID NO: 1172412 - RNA, 23 nt, Human
gauguauuucauggaaagagggg

SEQ ID NO: 1172413 - RNA, 23 nt, Human
gcacacaaaaacaaauguauagu

SEQ ID NO: 1172414 - RNA, 21 nt, Human
gcacgcaagguaaacacuaaa

SEQ ID NO: 1172415 - RNA, 20 nt, Human
ggaagguaaauaauggccca

SEQ ID NO: 1172416 - RNA, 24 nt, Human
ggaagguaaauaauggcccacaaa

SEQ ID NO: 1172417 - RNA, 21 nt, Human
gggcagccagcgggcucagag

SEQ ID NO: 1172418 - RNA, 23 nt, Human
guuaaacaccgccuucaguaccg

SEQ ID NO: 1172419 - RNA, 26 nt, Human
uaaaaaaacaagcuacucuaguauca

SEQ ID NO: 1172420 - RNA, 18 nt, Human
uaaaagagauggucccac

SEQ ID NO: 1172421 - RNA, 20 nt, Human
uaaauaauggcccacaaaac

SEQ ID NO: 1172422 - RNA, 22 nt, Human
uaacccaguggcgaccucuuca

SEQ ID NO: 1172423 - RNA, 23 nt, Human
uaagggaagguaaauaauggccc

SEQ ID NO: 1172424 - RNA, 21 nt, Human
uacaaaguauaaacuaagaua

SEQ ID NO: 1172425 - RNA, 22 nt, Human
uaccgagcugcuauacaagaac

SEQ ID NO: 1172426 - RNA, 19 nt, Human
uaggccuaaccagauaccu

SEQ ID NO: 1172427 - RNA, 23 nt, Human
uagguaaaaucgaugacacccua

SEQ ID NO: 1172428 - RNA, 20 nt, Human
uagucacuugaugaggaaau

SEQ ID NO: 1172429 - RNA, 20 nt, Human
uauauacacagaaagaguag

SEQ ID NO: 1172430 - RNA, 25 nt, Human
uauugcaaaaccauaguauuuaacg

SEQ ID NO: 1172431 - RNA, 20 nt, Human
ucaucuuuauuuugguugca

SEQ ID NO: 1172432 - RNA, 19 nt, Human
uccaugcugagguuucagg

SEQ ID NO: 1172433 - RNA, 19 nt, Human
ucccccguaaacaucagac

SEQ ID NO: 1172434 - RNA, 21 nt, Human
ucgaugacacccuaaaauaaa

SEQ ID NO: 1172435 - RNA, 23 nt, Human
ucuaaaacugaccuacagaaaag

SEQ ID NO: 1172436 - RNA, 24 nt, Human
ucucuaaguuccaaucacucacuc

SEQ ID NO: 1172437 - RNA, 19 nt, Human
ugaaauaggccuaaccaga

SEQ ID NO: 1172438 - RNA, 19 nt, Human
ugacacccuaaaauaaaaa

SEQ ID NO: 1172439 - RNA, 23 nt, Human
ugagauaacuggcaaaccuccaa

SEQ ID NO: 1172440 - RNA, 23 nt, Human
ugauaugguuaagauaacuaguu

SEQ ID NO: 1172441 - RNA, 22 nt, Human
ugauucuggcaacaggagucuc

SEQ ID NO: 1172442 - RNA, 23 nt, Human
ugcaaaaccauaguauuuaacga

SEQ ID NO: 1172443 - RNA, 23 nt, Human
ugcacuuguaaaagagauggucc

SEQ ID NO: 1172444 - RNA, 19 nt, Human
ugcauuaaaacaacauuga

SEQ ID NO: 1172445 - RNA, 19 nt, Human
ugcuccagaaagaugcuga

SEQ ID NO: 1172446 - RNA, 26 nt, Human
uggaaagaggggccuuuaaaggcacu

SEQ ID NO: 1172447 - RNA, 26 nt, Human
uguggaaaaaaauggaguuuuucuga

SEQ ID NO: 1172448 - RNA, 22 nt, Human
uucauuuuuucuacaugaagac

SEQ ID NO: 1172449 - RNA, 19 nt, Human
uugaagccacuaaaguucc

SEQ ID NO: 1172450 - RNA, 28 nt, Human
uugagcacacaaaaacaaauguauaguc

SEQ ID NO: 1172451 - RNA, 19 nt, Human
uuugguugcaaagaugugg

SEQ ID NO: 1172452 - RNA, 26 nt, Human
uuuucuguaaucccuuuuguggaaaa

SEQ ID NO: 1172453 - RNA, 19 nt, Human
aaaaaagcaaaaacugggg

SEQ ID NO: 1172454 - RNA, 19 nt, Human
aaaaaaguacagccaacag

SEQ ID NO: 1172455 - RNA, 21 nt, Human
aaaauacugaaaaaaaguaug

SEQ ID NO: 1172456 - RNA, 19 nt, Human
aaagugcugggauuacagg

SEQ ID NO: 1172457 - RNA, 24 nt, Human
aaagugcugggauuacaggcacga

SEQ ID NO: 1172458 - RNA, 19 nt, Human
aacaagcccgcauauggaa

SEQ ID NO: 1172459 - RNA, 19 nt, Human
aacauuugcaagaguguca

SEQ ID NO: 1172460 - RNA, 21 nt, Human
aagagugucagguagguuuua

SEQ ID NO: 1172461 - RNA, 18 nt, Human
aagcgauccaccugccuc

SEQ ID NO: 1172462 - RNA, 24 nt, Human
aaggauucucccaccuuagccuuc

SEQ ID NO: 1172463 - RNA, 24 nt, Human
aagugcaguggugcaaucacagcu

SEQ ID NO: 1172464 - RNA, 18 nt, Human
aagugcugggauuacagg

SEQ ID NO: 1172465 - RNA, 19 nt, Human
aagugcugggauuacaggc

SEQ ID NO: 1172466 - RNA, 26 nt, Human
aagugcugggauuacaggcacgagcc

SEQ ID NO: 1172467 - RNA, 18 nt, Human
acagcucacugcagccuc

SEQ ID NO: 1172468 - RNA, 18 nt, Human
acaggguuucaccauguu

SEQ ID NO: 1172469 - RNA, 19 nt, Human
acaggguuucaccauguug

SEQ ID NO: 1172470 - RNA, 21 nt, Human
acaggguuucaccauguugcc

SEQ ID NO: 1172471 - RNA, 23 nt, Human
acaggguuucaccauguugccua

SEQ ID NO: 1172472 - RNA, 24 nt, Human
acaggguuucaccauguugccuag

SEQ ID NO: 1172473 - RNA, 24 nt, Human
accauguugccuaggcuggucuug

SEQ ID NO: 1172474 - RNA, 18 nt, Human
acuccagaguuugguagg

SEQ ID NO: 1172475 - RNA, 19 nt, Human
acugcagccucaaccuccu

SEQ ID NO: 1172476 - RNA, 21 nt, Human
agacaaaaaggaacagcaagg

SEQ ID NO: 1172477 - RNA, 23 nt, Human
agacaggguuucaccauguugcc

SEQ ID NO: 1172478 - RNA, 24 nt, Human
agacuaaagugcaguggugcaauc

SEQ ID NO: 1172479 - RNA, 25 nt, Human
agagaaacaguaaauauaaagggag

SEQ ID NO: 1172480 - RNA, 22 nt, Human
agagagaaacaguaaauauaaa

SEQ ID NO: 1172481 - RNA, 19 nt, Human
agccucaaccuccuggccu

SEQ ID NO: 1172482 - RNA, 19 nt, Human
aggaaaagacaaacuuugg

SEQ ID NO: 1172483 - RNA, 21 nt, Human
agugcaguggugcaaucacag

SEQ ID NO: 1172484 - RNA, 22 nt, Human
aucaaaaaaguacagccaacag

SEQ ID NO: 1172485 - RNA, 19 nt, Human
augaaaauaaccacuuuau

SEQ ID NO: 1172486 - RNA, 26 nt, Human
augaaaauaaccacuuuauaugaaug

SEQ ID NO: 1172487 - RNA, 22 nt, Human
auggcugaauaauauuccauug

SEQ ID NO: 1172488 - RNA, 23 nt, Human
caaagugcugggauuacaggcac

SEQ ID NO: 1172489 - RNA, 24 nt, Human
caaagugcugggauuacaggcacg

SEQ ID NO: 1172490 - RNA, 22 nt, Human
caccauguugccuaggcugguc

SEQ ID NO: 1172491 - RNA, 23 nt, Human
caccauguugccuaggcuggucu

SEQ ID NO: 1172492 - RNA, 24 nt, Human
caccauguugccuaggcuggucuu

SEQ ID NO: 1172493 - RNA, 22 nt, Human
caccuaagguaaaauuauuagc

SEQ ID NO: 1172494 - RNA, 23 nt, Human
caccugccucgaccucccaaagu

SEQ ID NO: 1172495 - RNA, 21 nt, Human
caccuuagccuucccaggagc

SEQ ID NO: 1172496 - RNA, 21 nt, Human
cacgguuggcuaauuuuugua

SEQ ID NO: 1172497 - RNA, 19 nt, Human
cacugcagccucaaccucc

SEQ ID NO: 1172498 - RNA, 24 nt, Human
cagccucaaccuccuggccucaag

SEQ ID NO: 1172499 - RNA, 24 nt, Human
caggguuucaccauguugccuagg

SEQ ID NO: 1172500 - RNA, 22 nt, Human
caugcaucaguuggugggcauu

SEQ ID NO: 1172501 - RNA, 24 nt, Human
cauguugccuaggcuggucuugaa

SEQ ID NO: 1172502 - RNA, 19 nt, Human
ccaaagugcugggauuaca

SEQ ID NO: 1172503 - RNA, 23 nt, Human
ccaaagugcugggauuacaggca

SEQ ID NO: 1172504 - RNA, 23 nt, Human
ccagagcucuaggcucucaguag

SEQ ID NO: 1172505 - RNA, 20 nt, Human
ccagaguuugguagguggca

SEQ ID NO: 1172506 - RNA, 24 nt, Human
ccauguuuucaccagaaaccucuu

SEQ ID NO: 1172507 - RNA, 24 nt, Human
cccaaagugcugggauuacaggca

SEQ ID NO: 1172508 - RNA, 24 nt, Human
ccccagcccuauacaaccacuaaa

SEQ ID NO: 1172509 - RNA, 18 nt, Human
ccugggcucaagcgaucc

SEQ ID NO: 1172510 - RNA, 21 nt, Human
ccugggcucaagcgauccacc

SEQ ID NO: 1172511 - RNA, 22 nt, Human
ccugggcucaagcgauccaccu

SEQ ID NO: 1172512 - RNA, 23 nt, Human
ccugggcucaagcgauccaccug

SEQ ID NO: 1172513 - RNA, 18 nt, Human
cuaaaaauaagucacuuu

SEQ ID NO: 1172514 - RNA, 20 nt, Human
cuagaagacaauauugucua

SEQ ID NO: 1172515 - RNA, 19 nt, Human
cuagugaauuugaguugug

SEQ ID NO: 1172516 - RNA, 23 nt, Human
cucaaggauucucccaccuuagc

SEQ ID NO: 1172517 - RNA, 24 nt, Human
cucacugcagccucaaccuccugg

SEQ ID NO: 1172518 - RNA, 18 nt, Human
cucacuggcagucacucc

SEQ ID NO: 1172519 - RNA, 20 nt, Human
cucacuggcagucacuccua

SEQ ID NO: 1172520 - RNA, 20 nt, Human
cuccagauaacaaaucuaac

SEQ ID NO: 1172521 - RNA, 23 nt, Human
cucccaccuuagccuucccagga

SEQ ID NO: 1172522 - RNA, 20 nt, Human
cucugucacccagacuaaag

SEQ ID NO: 1172523 - RNA, 23 nt, Human
cucugucacccagacuaaagugc

SEQ ID NO: 1172524 - RNA, 22 nt, Human
cugcagccucaaccuccuggcc

SEQ ID NO: 1172525 - RNA, 24 nt, Human
cugccucgaccucccaaagugcug

SEQ ID NO: 1172526 - RNA, 19 nt, Human
cuggucuugaaguccuggg

SEQ ID NO: 1172527 - RNA, 25 nt, Human
gaacagcaaaugaauggggaauaaa

SEQ ID NO: 1172528 - RNA, 18 nt, Human
gauuacaggcacgagcca

SEQ ID NO: 1172529 - RNA, 18 nt, Human
gccaaacagaaauggcag

SEQ ID NO: 1172530 - RNA, 24 nt, Human
gcgauccaccugccucgaccuccc

SEQ ID NO: 1172531 - RNA, 18 nt, Human
gcuguugagcaguuuccc

SEQ ID NO: 1172532 - RNA, 23 nt, Human
ggaauaaaauauuaagaucaaaa

SEQ ID NO: 1172533 - RNA, 24 nt, Human
ggaaugcuguugagcaguuucccc

SEQ ID NO: 1172534 - RNA, 20 nt, Human
ggagacacacuuucccuccc

SEQ ID NO: 1172535 - RNA, 19 nt, Human
ggauuacaggcacgagcca

SEQ ID NO: 1172536 - RNA, 21 nt, Human
gggaauaaaauauuaagauca

SEQ ID NO: 1172537 - RNA, 24 nt, Human
gggcucaagcgauccaccugccuc

SEQ ID NO: 1172538 - RNA, 22 nt, Human
guaaaauuuuaaaaaguguauu

SEQ ID NO: 1172539 - RNA, 18 nt, Human
gucaagaugcaugaugcc

SEQ ID NO: 1172540 - RNA, 23 nt, Human
guggugcaaucacagcucacugc

SEQ ID NO: 1172541 - RNA, 24 nt, Human
uaaaaacaguuuugaaauacagga

SEQ ID NO: 1172542 - RNA, 18 nt, Human
uaaaucacuauuuucgag

SEQ ID NO: 1172543 - RNA, 21 nt, Human
uaacuuccuaggaaaagacaa

SEQ ID NO: 1172544 - RNA, 23 nt, Human
uaagaucaaaacaauaauuuaau

SEQ ID NO: 1172545 - RNA, 18 nt, Human
uaauuuuuguauuuuuag

SEQ ID NO: 1172546 - RNA, 19 nt, Human
uaauuuuuguauuuuuaga

SEQ ID NO: 1172547 - RNA, 21 nt, Human
uacaugcaugugguuuaucuc

SEQ ID NO: 1172548 - RNA, 24 nt, Human
uaccagggagaacauaagaaauac

SEQ ID NO: 1172549 - RNA, 26 nt, Human
uaccuccucauuucucuauaacuucc

SEQ ID NO: 1172550 - RNA, 18 nt, Human
uacuuuguaacugucuca

SEQ ID NO: 1172551 - RNA, 24 nt, Human
uagaaaagacaggguuucaccaug

SEQ ID NO: 1172552 - RNA, 18 nt, Human
uagaacagacaaaaagga

SEQ ID NO: 1172553 - RNA, 18 nt, Human
uagaagcucacagaauuc

SEQ ID NO: 1172554 - RNA, 21 nt, Human
uaggaaaagacaaacuuuggg

SEQ ID NO: 1172555 - RNA, 23 nt, Human
uaggaaaagacaaacuuugggug

SEQ ID NO: 1172556 - RNA, 19 nt, Human
uaguggauaauccccagug

SEQ ID NO: 1172557 - RNA, 19 nt, Human
uaucaaaaaaguacagcca

SEQ ID NO: 1172558 - RNA, 22 nt, Human
uaucaaaaaaguacagccaaca

SEQ ID NO: 1172559 - RNA, 26 nt, Human
uauguagauagugccaugcauggcuu

SEQ ID NO: 1172560 - RNA, 24 nt, Human
uauguuauuuagagauggguuuua

SEQ ID NO: 1172561 - RNA, 18 nt, Human
uauucaugcaucaguugg

SEQ ID NO: 1172562 - RNA, 19 nt, Human
ucaccagaaaccucuugcu

SEQ ID NO: 1172563 - RNA, 19 nt, Human
ucacugcagccucaaccuc

SEQ ID NO: 1172564 - RNA, 23 nt, Human
ucacugcagccucaaccuccugg

SEQ ID NO: 1172565 - RNA, 24 nt, Human
ucacugcagccucaaccuccuggc

SEQ ID NO: 1172566 - RNA, 21 nt, Human
ucagaggagguguggcucugg

SEQ ID NO: 1172567 - RNA, 21 nt, Human
uccagaguuugguagguggca

SEQ ID NO: 1172568 - RNA, 24 nt, Human
ucccaaagugcugggauuacaggc

SEQ ID NO: 1172569 - RNA, 18 nt, Human
uccugggcucaagcgauc

SEQ ID NO: 1172570 - RNA, 24 nt, Human
uccugggcucaagcgauccaccug

SEQ ID NO: 1172571 - RNA, 21 nt, Human
ucuggaguuguuucugccugg

SEQ ID NO: 1172572 - RNA, 20 nt, Human
ucuggaguuguuucugccuu

SEQ ID NO: 1172573 - RNA, 21 nt, Human
ucugggaaagcuaggaugauu

SEQ ID NO: 1172574 - RNA, 24 nt, Human
ucugucacccagacuaaagugcag

SEQ ID NO: 1172575 - RNA, 21 nt, Human
ucuugaaguccugggcucaag

SEQ ID NO: 1172576 - RNA, 18 nt, Human
ucuugcucugucacccag

SEQ ID NO: 1172577 - RNA, 19 nt, Human
ucuugcucugucacccaga

SEQ ID NO: 1172578 - RNA, 24 nt, Human
ucuugcucugucacccagacuaaa

SEQ ID NO: 1172579 - RNA, 18 nt, Human
ugaaguccugggcucaag

SEQ ID NO: 1172580 - RNA, 19 nt, Human
ugaauaauacaauuugugg

SEQ ID NO: 1172581 - RNA, 21 nt, Human
ugaccccagcccuauacaacc

SEQ ID NO: 1172582 - RNA, 18 nt, Human
ugacuauuaugaauaaug

SEQ ID NO: 1172583 - RNA, 22 nt, Human
ugagacagggucuugcucuguc

SEQ ID NO: 1172584 - RNA, 22 nt, Human
ugagauauuaacauccuaaaaa

SEQ ID NO: 1172585 - RNA, 25 nt, Human
ugagcaaauaaccuuauuguaauau

SEQ ID NO: 1172586 - RNA, 22 nt, Human
ugcaguggugcaaucacagcuc

SEQ ID NO: 1172587 - RNA, 20 nt, Human
ugccaaacagaaauggcagg

SEQ ID NO: 1172588 - RNA, 24 nt, Human
ugccuaggcuggucuugaaguccu

SEQ ID NO: 1172589 - RNA, 24 nt, Human
ugccucgaccucccaaagugcugg

SEQ ID NO: 1172590 - RNA, 22 nt, Human
ugccuggcucugucuuugugcu

SEQ ID NO: 1172591 - RNA, 19 nt, Human
ugcugggauuacaggcacg

SEQ ID NO: 1172592 - RNA, 26 nt, Human
ugcugggauuacaggcacgagccaac

SEQ ID NO: 1172593 - RNA, 20 nt, Human
uggaauuuucagucaagaug

SEQ ID NO: 1172594 - RNA, 21 nt, Human
uggaauuuucagucaagaugc

SEQ ID NO: 1172595 - RNA, 21 nt, Human
uggcuucuuucacuuagcaua

SEQ ID NO: 1172596 - RNA, 18 nt, Human
ugggauuacaggcacgag

SEQ ID NO: 1172597 - RNA, 21 nt, Human
ugggauuacaggcacgagcca

SEQ ID NO: 1172598 - RNA, 24 nt, Human
ugggauuacaggcacgagccaaca

SEQ ID NO: 1172599 - RNA, 27 nt, Human
ugggauuacaggcacgagccaacaagc

SEQ ID NO: 1172600 - RNA, 31 nt, Human
ugggauuacaggcacgagccaacaagcccgg

SEQ ID NO: 1172601 - RNA, 23 nt, Human
ugguagguggcagagcauaacac

SEQ ID NO: 1172602 - RNA, 18 nt, Human
ugguccuugauggcuggc

SEQ ID NO: 1172603 - RNA, 24 nt, Human
uggugcaaucacagcucacugcag

SEQ ID NO: 1172604 - RNA, 20 nt, Human
ugugaugauuguaucacuuu

SEQ ID NO: 1172605 - RNA, 23 nt, Human
uguucauuuaccaggcugagagu

SEQ ID NO: 1172606 - RNA, 23 nt, Human
uguugaaaaaaaugaaauuggcu

SEQ ID NO: 1172607 - RNA, 21 nt, Human
uuacuuuguaacugucucagu

SEQ ID NO: 1172608 - RNA, 22 nt, Human
uucaugcaucaguuggugggca

SEQ ID NO: 1172609 - RNA, 21 nt, Human
uucucaucccacccauauguc

SEQ ID NO: 1172610 - RNA, 22 nt, Human
uucugccaaacagaaauggcag

SEQ ID NO: 1172611 - RNA, 22 nt, Human
uugagacagggucuugcucugu

SEQ ID NO: 1172612 - RNA, 19 nt, Human
uugauaacaccuaagguaa

SEQ ID NO: 1172613 - RNA, 22 nt, Human
uuuauccuuuuuaauggcugaa

SEQ ID NO: 1172614 - RNA, 26 nt, Human
uuuauucaugcaucaguuggugggca

SEQ ID NO: 1172615 - RNA, 24 nt, Human
uuucaccauguugccuaggcuggu

SEQ ID NO: 1172616 - RNA, 26 nt, Human
uuucauauauaaggugaauuauccau

SEQ ID NO: 1172617 - RNA, 22 nt, Human
uuucucugauacaugcaugugg

SEQ ID NO: 1172618 - RNA, 19 nt, Human
uuuuguuuauucaugcauc

SEQ ID NO: 1172619 - RNA, 23 nt, Human
uuuuuguauuuuuagaaaagaca

SEQ ID NO: 1172620 - RNA, 19 nt, Human
aaagaaaugugauaauuac

SEQ ID NO: 1172621 - RNA, 19 nt, Human
aaagugcugggauuacaga

SEQ ID NO: 1172622 - RNA, 23 nt, Human
aaagugcugggauuacagaugug

SEQ ID NO: 1172623 - RNA, 20 nt, Human
aaaugcuguugcugaagaag

SEQ ID NO: 1172624 - RNA, 22 nt, Human
aagcaccuccucuuccacaucc

SEQ ID NO: 1172625 - RNA, 19 nt, Human
aagcucaagugauccuccu

SEQ ID NO: 1172626 - RNA, 21 nt, Human
aagcucaagugauccuccugc

SEQ ID NO: 1172627 - RNA, 18 nt, Human
aagugcugggauuacaga

SEQ ID NO: 1172628 - RNA, 19 nt, Human
acacccggagcagccagac

SEQ ID NO: 1172629 - RNA, 18 nt, Human
acagaugugggccaccgc

SEQ ID NO: 1172630 - RNA, 19 nt, Human
accacaccuccaccuuugc

SEQ ID NO: 1172631 - RNA, 24 nt, Human
accuccucuuccacauccccccaa

SEQ ID NO: 1172632 - RNA, 19 nt, Human
acuugugaagaacuuccuu

SEQ ID NO: 1172633 - RNA, 22 nt, Human
agaacuuccuucaguaagaaag

SEQ ID NO: 1172634 - RNA, 22 nt, Human
agaauauuuccaaaauucacau

SEQ ID NO: 1172635 - RNA, 25 nt, Human
agaauccuacucauacccuacuaau

SEQ ID NO: 1172636 - RNA, 25 nt, Human
aggcucuugguggggcacucuuggu

SEQ ID NO: 1172637 - RNA, 24 nt, Human
agugcugggauuacagaugugggc

SEQ ID NO: 1172638 - RNA, 22 nt, Human
auaauauuuguuugguaagauc

SEQ ID NO: 1172639 - RNA, 23 nt, Human
aucuuaaagcaccuccucuucca

SEQ ID NO: 1172640 - RNA, 22 nt, Human
auggugcugcaggcugcccuua

SEQ ID NO: 1172641 - RNA, 24 nt, Human
caaagugcugggauuacagaugug

SEQ ID NO: 1172642 - RNA, 22 nt, Human
caagugauccuccugcuucagc

SEQ ID NO: 1172643 - RNA, 27 nt, Human
caagugauccuccugcuucagccuccc

SEQ ID NO: 1172644 - RNA, 24 nt, Human
cacaccuccaccuuugccccugcu

SEQ ID NO: 1172645 - RNA, 19 nt, Human
cacauccccccaacacccc

SEQ ID NO: 1172646 - RNA, 20 nt, Human
cacccggagcagccagacag

SEQ ID NO: 1172647 - RNA, 21 nt, Human
caccuccaccuuugccccugc

SEQ ID NO: 1172648 - RNA, 18 nt, Human
caccuccucuuccacauc

SEQ ID NO: 1172649 - RNA, 20 nt, Human
caccuccucuuccacauccc

SEQ ID NO: 1172650 - RNA, 20 nt, Human
caccuuugccccugcuggac

SEQ ID NO: 1172651 - RNA, 19 nt, Human
cacggccaagcuggcaggu

SEQ ID NO: 1172652 - RNA, 21 nt, Human
cagagucaggggccaccgcca

SEQ ID NO: 1172653 - RNA, 21 nt, Human
cagcaaacagcgacgucagga

SEQ ID NO: 1172654 - RNA, 20 nt, Human
cagccagacagcuugcaguc

SEQ ID NO: 1172655 - RNA, 22 nt, Human
caggaaaggacaacugaacagu

SEQ ID NO: 1172656 - RNA, 22 nt, Human
caggcaccagcagaauccuacu

SEQ ID NO: 1172657 - RNA, 20 nt, Human
caugaauaauauuuguuugg

SEQ ID NO: 1172658 - RNA, 21 nt, Human
ccaaagugcugggauuacaga

SEQ ID NO: 1172659 - RNA, 22 nt, Human
ccaaagugcugggauuacagau

SEQ ID NO: 1172660 - RNA, 24 nt, Human
ccaaagugcugggauuacagaugu

SEQ ID NO: 1172661 - RNA, 23 nt, Human
ccacaccuccaccuuugccccug

SEQ ID NO: 1172662 - RNA, 18 nt, Human
ccacguucuccaccuccu

SEQ ID NO: 1172663 - RNA, 23 nt, Human
ccaggcaccagcagaauccuacu

SEQ ID NO: 1172664 - RNA, 21 nt, Human
ccccaacaccccacgugcagg

SEQ ID NO: 1172665 - RNA, 25 nt, Human
ccccaacaccccacgugcaggacca

SEQ ID NO: 1172666 - RNA, 22 nt, Human
ccccccaacaccccacgugcag

SEQ ID NO: 1172667 - RNA, 24 nt, Human
ccccgauuccucaggcagcuugga

SEQ ID NO: 1172668 - RNA, 25 nt, Human
ccccuccagcucugagcucuagcuc

SEQ ID NO: 1172669 - RNA, 19 nt, Human
cccggagcagccagacagc

SEQ ID NO: 1172670 - RNA, 21 nt, Human
cccuccagcucugagcucuag

SEQ ID NO: 1172671 - RNA, 26 nt, Human
ccuccugcuucagccucccaaagugc

SEQ ID NO: 1172672 - RNA, 24 nt, Human
ccugcuucagccucccaaagugcu

SEQ ID NO: 1172673 - RNA, 19 nt, Human
ccuucccaggcaccagcag

SEQ ID NO: 1172674 - RNA, 18 nt, Human
ccuucuggagcucuccac

SEQ ID NO: 1172675 - RNA, 24 nt, Human
cucaagugauccuccugcuucagc

SEQ ID NO: 1172676 - RNA, 23 nt, Human
cucacaguuuccucccuucugga

SEQ ID NO: 1172677 - RNA, 23 nt, Human
cuccucuuccacauccccccaac

SEQ ID NO: 1172678 - RNA, 24 nt, Human
cucuaagccugcagagaaauucac

SEQ ID NO: 1172679 - RNA, 18 nt, Human
cucuuccacaucccccca

SEQ ID NO: 1172680 - RNA, 22 nt, Human
cugccuucccaggcaccagcag

SEQ ID NO: 1172681 - RNA, 24 nt, Human
cugcuucagccucccaaagugcug

SEQ ID NO: 1172682 - RNA, 24 nt, Human
cugcuuuaauuuccccuccagcuc

SEQ ID NO: 1172683 - RNA, 18 nt, Human
cuuggcuugccuauuacc

SEQ ID NO: 1172684 - RNA, 19 nt, Human
gaaagaacauuggaaacua

SEQ ID NO: 1172685 - RNA, 19 nt, Human
gaacugaauuugaaagacc

SEQ ID NO: 1172686 - RNA, 22 nt, Human
gaacugaauuugaaagaccaaa

SEQ ID NO: 1172687 - RNA, 24 nt, Human
gaagaacuuccuucaguaagaaag

SEQ ID NO: 1172688 - RNA, 22 nt, Human
gaucagucaggccccccuuggc

SEQ ID NO: 1172689 - RNA, 20 nt, Human
gaucuccuuuaccugacuca

SEQ ID NO: 1172690 - RNA, 18 nt, Human
gauuacagaugugggcca

SEQ ID NO: 1172691 - RNA, 19 nt, Human
gcagauggguacuugugaa

SEQ ID NO: 1172692 - RNA, 23 nt, Human
gccuuguggucaucggggcugua

SEQ ID NO: 1172693 - RNA, 19 nt, Human
gcuguugcugaagaaggcg

SEQ ID NO: 1172694 - RNA, 24 nt, Human
gcuugcagucugagcuuuggccug

SEQ ID NO: 1172695 - RNA, 20 nt, Human
ggaaacuaauuccacaggga

SEQ ID NO: 1172696 - RNA, 24 nt, Human
ggcuggucuugaacucccaagcuc

SEQ ID NO: 1172697 - RNA, 19 nt, Human
gguggggcacucuuggugg

SEQ ID NO: 1172698 - RNA, 19 nt, Human
guagauggcacugccuucc

SEQ ID NO: 1172699 - RNA, 24 nt, Human
gugauccuccugcuucagccuccc

SEQ ID NO: 1172700 - RNA, 25 nt, Human
gugguggguaucuggauuccuuuua

SEQ ID NO: 1172701 - RNA, 21 nt, Human
guuuccucccuucuggagcuc

SEQ ID NO: 1172702 - RNA, 23 nt, Human
uaaauggcuuaguaaucucuaag

SEQ ID NO: 1172703 - RNA, 20 nt, Human
uaaggaaacaaaauguggug

SEQ ID NO: 1172704 - RNA, 22 nt, Human
uagaauucaacgucgucgccuc

SEQ ID NO: 1172705 - RNA, 24 nt, Human
uaggggagaauauuuccaaaauuc

SEQ ID NO: 1172706 - RNA, 18 nt, Human
uaucuggauuccuuuuaa

SEQ ID NO: 1172707 - RNA, 19 nt, Human
ucacaguuuccucccuucu

SEQ ID NO: 1172708 - RNA, 21 nt, Human
ucaggcagcuuggacucgagc

SEQ ID NO: 1172709 - RNA, 20 nt, Human
uccacauccccccaacaccc

SEQ ID NO: 1172710 - RNA, 18 nt, Human
ucccaaagugcugggauu

SEQ ID NO: 1172711 - RNA, 23 nt, Human
ucccaaagugcugggauuacaga

SEQ ID NO: 1172712 - RNA, 22 nt, Human
ucccugccacguucuccaccuc

SEQ ID NO: 1172713 - RNA, 21 nt, Human
uccucaggcagcuuggacucg

SEQ ID NO: 1172714 - RNA, 20 nt, Human
ucuagcucugccuuggcuug

SEQ ID NO: 1172715 - RNA, 22 nt, Human
ucucuggaucuuaaagcaccuc

SEQ ID NO: 1172716 - RNA, 27 nt, Human
ucucuggaucuuaaagcaccuccucuu

SEQ ID NO: 1172717 - RNA, 25 nt, Human
ugaacucccaagcucaagugauccu

SEQ ID NO: 1172718 - RNA, 20 nt, Human
ugaagaacuuccuucaguaa

SEQ ID NO: 1172719 - RNA, 24 nt, Human
ugaagaacuuccuucaguaagaaa

SEQ ID NO: 1172720 - RNA, 22 nt, Human
ugaauuugaaagaccaaaauga

SEQ ID NO: 1172721 - RNA, 18 nt, Human
ugacuucugggcacaccc

SEQ ID NO: 1172722 - RNA, 20 nt, Human
ugaguuauguuuucuucccu

SEQ ID NO: 1172723 - RNA, 19 nt, Human
ugaguucagagcaucccag

SEQ ID NO: 1172724 - RNA, 22 nt, Human
ugauaauuacucauuaaggaaa

SEQ ID NO: 1172725 - RNA, 19 nt, Human
ugccuauuaccuuggccac

SEQ ID NO: 1172726 - RNA, 22 nt, Human
ugccuauuaccuuggccacacg

SEQ ID NO: 1172727 - RNA, 18 nt, Human
ugcugggauuacagaugu

SEQ ID NO: 1172728 - RNA, 24 nt, Human
ugcugggauuacagaugugggcca

SEQ ID NO: 1172729 - RNA, 24 nt, Human
ugcuucagccucccaaagugcugg

SEQ ID NO: 1172730 - RNA, 18 nt, Human
ugcuuuaauuuccccucc

SEQ ID NO: 1172731 - RNA, 19 nt, Human
uggagaaagacccaauagg

SEQ ID NO: 1172732 - RNA, 18 nt, Human
uggauuuuuaaauacugc

SEQ ID NO: 1172733 - RNA, 18 nt, Human
uggcauggugcugcaggc

SEQ ID NO: 1172734 - RNA, 19 nt, Human
ugggauuacagaugugggc

SEQ ID NO: 1172735 - RNA, 21 nt, Human
ugggauuacagaugugggcca

SEQ ID NO: 1172736 - RNA, 22 nt, Human
ugggauuacagaugugggccac

SEQ ID NO: 1172737 - RNA, 23 nt, Human
ugggauuacagaugugggccacc

SEQ ID NO: 1172738 - RNA, 24 nt, Human
ugggauuacagaugugggccaccg

SEQ ID NO: 1172739 - RNA, 18 nt, Human
ugguccgaggacucaauc

SEQ ID NO: 1172740 - RNA, 18 nt, Human
uggugcugcaggcugccc

SEQ ID NO: 1172741 - RNA, 22 nt, Human
ugugggaauaacuugaagaaug

SEQ ID NO: 1172742 - RNA, 21 nt, Human
ugugguggguaucuggauucc

SEQ ID NO: 1172743 - RNA, 20 nt, Human
uguugccagcaaacagcgag

SEQ ID NO: 1172744 - RNA, 23 nt, Human
uuaggaucccugccacguucucc

SEQ ID NO: 1172745 - RNA, 25 nt, Human
uuuuaaauacugcccugaccuccca

SEQ ID NO: 1172746 - RNA, 21 nt, Human
aaagcugucugccacaacuga

SEQ ID NO: 1172747 - RNA, 21 nt, Human
aagaaaccacaaagaaauuac

SEQ ID NO: 1172748 - RNA, 19 nt, Human
aauggcaaaaaucagaaga

SEQ ID NO: 1172749 - RNA, 24 nt, Human
aaugugcagguggccucccugagg

SEQ ID NO: 1172750 - RNA, 20 nt, Human
acuaaaauagaagguaucug

SEQ ID NO: 1172751 - RNA, 23 nt, Human
acuacgccuacuaggaaaaaaga

SEQ ID NO: 1172752 - RNA, 18 nt, Human
acugaacugucuugccag

SEQ ID NO: 1172753 - RNA, 21 nt, Human
agaaucaccccaaacuaggac

SEQ ID NO: 1172754 - RNA, 18 nt, Human
aggaaaaaagagaagaaa

SEQ ID NO: 1172755 - RNA, 19 nt, Human
aucagaagaaaccacaaag

SEQ ID NO: 1172756 - RNA, 23 nt, Human
augcaauuucuuuauugaaaagc

SEQ ID NO: 1172757 - RNA, 19 nt, Human
caacauggguaguaauuga

SEQ ID NO: 1172758 - RNA, 22 nt, Human
caauggcaaaaaucagaagaaa

SEQ ID NO: 1172759 - RNA, 20 nt, Human
ccucccugaggauucagagc

SEQ ID NO: 1172760 - RNA, 22 nt, Human
ccugaggauucagagcuucagc

SEQ ID NO: 1172761 - RNA, 18 nt, Human
ccuggacagaguaugaga

SEQ ID NO: 1172762 - RNA, 25 nt, Human
ccuuuacauuguuaucuuuuuugau

SEQ ID NO: 1172763 - RNA, 23 nt, Human
cuauaagucucccccugggauuc

SEQ ID NO: 1172764 - RNA, 22 nt, Human
cugcuagauauuuacugaagag

SEQ ID NO: 1172765 - RNA, 23 nt, Human
gaaucaccccaaacuaggaccag

SEQ ID NO: 1172766 - RNA, 21 nt, Human
gagaaugugcagguggccucc

SEQ ID NO: 1172767 - RNA, 22 nt, Human
guuugagauuucagaaucaccc

SEQ ID NO: 1172768 - RNA, 25 nt, Human
guuuguuagcaacuaaaauagaagg

SEQ ID NO: 1172769 - RNA, 18 nt, Human
uaacucacugaacugucu

SEQ ID NO: 1172770 - RNA, 19 nt, Human
uaacuguaacggaaucuuu

SEQ ID NO: 1172771 - RNA, 20 nt, Human
uacauuguuaucuuuuuuga

SEQ ID NO: 1172772 - RNA, 21 nt, Human
ucagaagaaaccacaaagaaa

SEQ ID NO: 1172773 - RNA, 20 nt, Human
uccacauauaguauuauggu

SEQ ID NO: 1172774 - RNA, 26 nt, Human
ugacugggcauaauucaaaaaggaaa

SEQ ID NO: 1172775 - RNA, 21 nt, Human
uggcaaaaaucagaagaaacc

SEQ ID NO: 1172776 - RNA, 24 nt, Human
uggcaaaaaucagaagaaaccaca

SEQ ID NO: 1172777 - RNA, 25 nt, Human
uggcaaaaaucagaagaaaccacaa

SEQ ID NO: 1172778 - RNA, 18 nt, Human
uguuguacaacaugggua

SEQ ID NO: 1172779 - RNA, 24 nt, Human
uucaaaaaggaaaagcucauauuc

SEQ ID NO: 1172780 - RNA, 19 nt, Human
uuccuguucuuuugacuca

SEQ ID NO: 1172781 - RNA, 26 nt, Human
uugaccccaauggcaaaaaucagaag

SEQ ID NO: 1172782 - RNA, 24 nt, Human
uugaugccugugcugccuauggug

SEQ ID NO: 1172783 - RNA, 23 nt, Human
ccucugcggcggucacgucgccc

SEQ ID NO: 1172784 - RNA, 23 nt, Human
cgccggagccgugccgggucccc

SEQ ID NO: 1172785 - RNA, 19 nt, Human
cggcugccucuucauugcu

SEQ ID NO: 1172786 - RNA, 21 nt, Human
cuuuucacguggccacccucc

SEQ ID NO: 1172787 - RNA, 22 nt, Human
gccggagccgugccgggucccc

SEQ ID NO: 1172788 - RNA, 24 nt, Human
guggccacccuccuguccguuggc

SEQ ID NO: 1172789 - RNA, 23 nt, Human
ucauugcuuuucacguggccacc

SEQ ID NO: 1172790 - RNA, 21 nt, Human
ucggagcucuggcugcccacg

SEQ ID NO: 1172791 - RNA, 18 nt, Human
ugccggguccccgccgca

SEQ ID NO: 1172792 - RNA, 20 nt, Human
aaggagacaggaaggcucca

SEQ ID NO: 1172793 - RNA, 18 nt, Human
gagaguuuucaccaagga

SEQ ID NO: 1172794 - RNA, 18 nt, Human
gcuagucucagcuccugg

SEQ ID NO: 1172795 - RNA, 22 nt, Human
ucaccaaggagacaggaaggcu

SEQ ID NO: 1172796 - RNA, 24 nt, Human
uccagcucagucugggcucugcag

SEQ ID NO: 1172797 - RNA, 19 nt, Human
ucucagcuccuggcgcugg

SEQ ID NO: 1172798 - RNA, 19 nt, Human
ucugcagaagguguccuug

SEQ ID NO: 1172799 - RNA, 20 nt, Human
uggcuagucucagcuccugg

SEQ ID NO: 1172800 - RNA, 18 nt, Human
aaaaaagagagaugaaaa

SEQ ID NO: 1172801 - RNA, 19 nt, Human
aaaaagccagcagcccaga

SEQ ID NO: 1172802 - RNA, 19 nt, Human
aaaaagccagcagcccaga

SEQ ID NO: 1172803 - RNA, 25 nt, Human
aaaaccaacccugaguuaagaaccu

SEQ ID NO: 1172804 - RNA, 21 nt, Human
aaaaggcauucugcugccuuu

SEQ ID NO: 1172805 - RNA, 20 nt, Human
aaaccugcacauguaccccu

SEQ ID NO: 1172806 - RNA, 22 nt, Human
aaccaauaaccuggacauggcc

SEQ ID NO: 1172807 - RNA, 22 nt, Human
aaccaguaaugucacaagucaa

SEQ ID NO: 1172808 - RNA, 21 nt, Human
aaccaugaucccucugccucc

SEQ ID NO: 1172809 - RNA, 27 nt, Human
aacugcuucuucuuaccaaacuucuau

SEQ ID NO: 1172810 - RNA, 20 nt, Human
aagcacucauagacaauaca

SEQ ID NO: 1172811 - RNA, 18 nt, Human
aagggcaaaaagccagca

SEQ ID NO: 1172812 - RNA, 22 nt, Human
acagcagccccucuucagcucc

SEQ ID NO: 1172813 - RNA, 21 nt, Human
accccuaaauuuuuuuaaaaa

SEQ ID NO: 1172814 - RNA, 20 nt, Human
accugggugacgaaauaauc

SEQ ID NO: 1172815 - RNA, 21 nt, Human
acuguagugcaaaagcacuca

SEQ ID NO: 1172816 - RNA, 20 nt, Human
agcacuuugggaggccgagg

SEQ ID NO: 1172817 - RNA, 18 nt, Human
caaaaagccagcagccca

SEQ ID NO: 1172818 - RNA, 24 nt, Human
cacgccuguaaucccagcacuuug

SEQ ID NO: 1172819 - RNA, 26 nt, Human
cacggccagccaugaucauuaacacc

SEQ ID NO: 1172820 - RNA, 22 nt, Human
cagcacuuugggaggccgaggg

SEQ ID NO: 1172821 - RNA, 20 nt, Human
cagcccagaauggacugucu

SEQ ID NO: 1172822 - RNA, 19 nt, Human
caggaagggcaaaaagcca

SEQ ID NO: 1172823 - RNA, 21 nt, Human
caggaagggcaaaaagccagc

SEQ ID NO: 1172824 - RNA, 18 nt, Human
caguagcuggaaaucaug

SEQ ID NO: 1172825 - RNA, 19 nt, Human
caugacacagguuugccua

SEQ ID NO: 1172826 - RNA, 21 nt, Human
cauucugcugccuuucugagg

SEQ ID NO: 1172827 - RNA, 18 nt, Human
ccaaccccgggcaagcag

SEQ ID NO: 1172828 - RNA, 20 nt, Human
ccaacccugaguuaagaacc

SEQ ID NO: 1172829 - RNA, 20 nt, Human
ccugaguuaagaaccucaga

SEQ ID NO: 1172830 - RNA, 23 nt, Human
cgccuguaaucccagcacuuugg

SEQ ID NO: 1172831 - RNA, 24 nt, Human
cgccuguaaucccagcacuuuggg

SEQ ID NO: 1172832 - RNA, 22 nt, Human
cucacgccuguaaucccagcac

SEQ ID NO: 1172833 - RNA, 24 nt, Human
cucacgccuguaaucccagcacuu

SEQ ID NO: 1172834 - RNA, 20 nt, Human
cucaggucagaagaaaaagg

SEQ ID NO: 1172835 - RNA, 20 nt, Human
cucuacacaucgccacacca

SEQ ID NO: 1172836 - RNA, 18 nt, Human
cugaaaccaugaucccuc

SEQ ID NO: 1172837 - RNA, 22 nt, Human
cugaaaccaugaucccucugcc

SEQ ID NO: 1172838 - RNA, 21 nt, Human
cugauuuccaaucuuggcuca

SEQ ID NO: 1172839 - RNA, 22 nt, Human
cuucucagcacucgccuucuaa

SEQ ID NO: 1172840 - RNA, 21 nt, Human
gaaaucaugcaggaagggcaa

SEQ ID NO: 1172841 - RNA, 23 nt, Human
gagccgaugccuggguucccagc

SEQ ID NO: 1172842 - RNA, 21 nt, Human
ggccgggcgcgguggcucacg

SEQ ID NO: 1172843 - RNA, 21 nt, Human
ggcucacgccuguaaucccag

SEQ ID NO: 1172844 - RNA, 18 nt, Human
gggcaaaaagccagcagc

SEQ ID NO: 1172845 - RNA, 24 nt, Human
gggcgcgguggcucacgccuguaa

SEQ ID NO: 1172846 - RNA, 23 nt, Human
gguggcucacgccuguaauccca

SEQ ID NO: 1172847 - RNA, 24 nt, Human
gguggcucacgccuguaaucccag

SEQ ID NO: 1172848 - RNA, 21 nt, Human
guccucuuggcucguagaguu

SEQ ID NO: 1172849 - RNA, 19 nt, Human
gugacaagucuucucagca

SEQ ID NO: 1172850 - RNA, 24 nt, Human
uaagaaccucagaacagggguuga

SEQ ID NO: 1172851 - RNA, 23 nt, Human
uagugcaaaagcacucauagaca

SEQ ID NO: 1172852 - RNA, 23 nt, Human
uauguaacaaaccugcacaugua

SEQ ID NO: 1172853 - RNA, 20 nt, Human
ucuacacaucgccacaccac

SEQ ID NO: 1172854 - RNA, 23 nt, Human
ugaaaccaugaucccucugccuc

SEQ ID NO: 1172855 - RNA, 19 nt, Human
ugaaauggaaaacauucgg

SEQ ID NO: 1172856 - RNA, 23 nt, Human
ugaaauggaaaacauucggaaaa

SEQ ID NO: 1172857 - RNA, 21 nt, Human
ugaguuaagaaccucagaaca

SEQ ID NO: 1172858 - RNA, 22 nt, Human
ugaucauuaacaccuccaugaa

SEQ ID NO: 1172859 - RNA, 22 nt, Human
ugauuugagaaaccugugacaa

SEQ ID NO: 1172860 - RNA, 22 nt, Human
ugccugacuuucaguccaugca

SEQ ID NO: 1172861 - RNA, 24 nt, Human
uggcucacgccuguaaucccagca

SEQ ID NO: 1172862 - RNA, 23 nt, Human
ugggaggccgagggagaggauca

SEQ ID NO: 1172863 - RNA, 18 nt, Human
uggguucccagcauccag

SEQ ID NO: 1172864 - RNA, 23 nt, Human
uguaaagaaccaaauaguaaaua

SEQ ID NO: 1172865 - RNA, 19 nt, Human
uucagcuccauguacagga

SEQ ID NO: 1172866 - RNA, 20 nt, Human
uucagcuccauguacaggag

SEQ ID NO: 1172867 - RNA, 24 nt, Human
uugggaggccgagggagaggauca

SEQ ID NO: 1172868 - RNA, 20 nt, Human
uuucugauuuccaaucuugg

SEQ ID NO: 1172869 - RNA, 21 nt, Human
uggccaaaggaacaacuccau

SEQ ID NO: 1172870 - RNA, 19 nt, Human
aaaaaaaagauguaugaau

SEQ ID NO: 1172871 - RNA, 21 nt, Human
aaaaaaacaggcaggcuuaga

SEQ ID NO: 1172872 - RNA, 22 nt, Human
aaaaaacaggcaggcuuagaaa

SEQ ID NO: 1172873 - RNA, 20 nt, Human
aaaaacaaaaaacaaaaauc

SEQ ID NO: 1172874 - RNA, 21 nt, Human
aaaaacaaaaaacaaaaaucu

SEQ ID NO: 1172875 - RNA, 25 nt, Human
aaaacaaaaaucuuaaucuugagcc

SEQ ID NO: 1172876 - RNA, 19 nt, Human
aaacuccaggcucucuggc

SEQ ID NO: 1172877 - RNA, 22 nt, Human
aaagccuaaaauguaggaguuc

SEQ ID NO: 1172878 - RNA, 21 nt, Human
aacauaaaagguaugucuccc

SEQ ID NO: 1172879 - RNA, 19 nt, Human
aacauaccuagaucauaua

SEQ ID NO: 1172880 - RNA, 22 nt, Human
aagcauaugaauacaacagucu

SEQ ID NO: 1172881 - RNA, 23 nt, Human
aaggugguuucuauguccaauua

SEQ ID NO: 1172882 - RNA, 25 nt, Human
aauguaggaguuccuccagguacca

SEQ ID NO: 1172883 - RNA, 23 nt, Human
acaaacauaaaagguaugucucc

SEQ ID NO: 1172884 - RNA, 23 nt, Human
acacacacacacacacacacaca

SEQ ID NO: 1172885 - RNA, 23 nt, Human
acacacacacacacacacacaca

SEQ ID NO: 1172886 - RNA, 23 nt, Human
acacacacacacacacacacaca

SEQ ID NO: 1172887 - RNA, 28 nt, Human
acacacacacacacgaaaagccuguagu

SEQ ID NO: 1172888 - RNA, 20 nt, Human
acacacgaaaagccuguaac

SEQ ID NO: 1172889 - RNA, 25 nt, Human
accaaauugccuccaaggucaaaac

SEQ ID NO: 1172890 - RNA, 22 nt, Human
accaucaguuucccuaguucug

SEQ ID NO: 1172891 - RNA, 23 nt, Human
acgcacacacacacacacacaca

SEQ ID NO: 1172892 - RNA, 22 nt, Human
acuaugauacugccacucugaa

SEQ ID NO: 1172893 - RNA, 22 nt, Human
acuuggcaacugauugcaacau

SEQ ID NO: 1172894 - RNA, 22 nt, Human
agaucauauaaauuugugaagg

SEQ ID NO: 1172895 - RNA, 21 nt, Human
aggaagacaagcauaugaaua

SEQ ID NO: 1172896 - RNA, 22 nt, Human
auauaaguaaacauacauucua

SEQ ID NO: 1172897 - RNA, 22 nt, Human
augaacaucaacuauccuacag

SEQ ID NO: 1172898 - RNA, 21 nt, Human
augaagaccaaauugccucca

SEQ ID NO: 1172899 - RNA, 25 nt, Human
caaggucaaaacaauaguucuuugu

SEQ ID NO: 1172900 - RNA, 20 nt, Human
cacacacacacacacacaca

SEQ ID NO: 1172901 - RNA, 20 nt, Human
cacacacacacacacacaca

SEQ ID NO: 1172902 - RNA, 20 nt, Human
cacacacacacacacacaca

SEQ ID NO: 1172903 - RNA, 20 nt, Human
cacacacacacacacacaca

SEQ ID NO: 1172904 - RNA, 20 nt, Human
cacacacacacacacacaca

SEQ ID NO: 1172905 - RNA, 20 nt, Human
cacacacacacacacacaca

SEQ ID NO: 1172906 - RNA, 20 nt, Human
cacacacacacacacacaca

SEQ ID NO: 1172907 - RNA, 22 nt, Human
cacacacacacacacacacaca

SEQ ID NO: 1172908 - RNA, 22 nt, Human
cacacacacacacacacacaca

SEQ ID NO: 1172909 - RNA, 26 nt, Human
cacacacacacacacacacacacaca

SEQ ID NO: 1172910 - RNA, 26 nt, Human
cacacacacacacacacacacacaca

SEQ ID NO: 1172911 - RNA, 26 nt, Human
cacacacacacacacacacacacaca

SEQ ID NO: 1172912 - RNA, 26 nt, Human
cacacacacacacacacacacacaca

SEQ ID NO: 1172913 - RNA, 26 nt, Human
cacacacacacacacacacacacacg

SEQ ID NO: 1172914 - RNA, 33 nt, Human
cacacacacacacacacacacgaaaagccuggu

SEQ ID NO: 1172915 - RNA, 25 nt, Human
cacacacacgaaaagccuguaaccu

SEQ ID NO: 1172916 - RNA, 18 nt, Human
cacaguguuugaauucca

SEQ ID NO: 1172917 - RNA, 21 nt, Human
cagaaagaaaauugcugacau

SEQ ID NO: 1172918 - RNA, 24 nt, Human
cagcuaaaccuaaugaagaccaaa

SEQ ID NO: 1172919 - RNA, 21 nt, Human
ccaggcucucuggccuuggga

SEQ ID NO: 1172920 - RNA, 19 nt, Human
ccagggaaauggaaaaaaa

SEQ ID NO: 1172921 - RNA, 23 nt, Human
ccagggaaauggaaaaaaaacaa

SEQ ID NO: 1172922 - RNA, 20 nt, Human
ccaucaguuucccuaguucu

SEQ ID NO: 1172923 - RNA, 25 nt, Human
cccacgacaauggauauaguugcuu

SEQ ID NO: 1172924 - RNA, 24 nt, Human
ccuacagcuaaaccuaaugaagac

SEQ ID NO: 1172925 - RNA, 20 nt, Human
cgcacacacacacacacaca

SEQ ID NO: 1172926 - RNA, 25 nt, Human
cgcacacacacacacacacacacac

SEQ ID NO: 1172927 - RNA, 24 nt, Human
cucaagaaguauaaauuuuacaaa

SEQ ID NO: 1172928 - RNA, 22 nt, Human
cucucuggccuugggauuccag

SEQ ID NO: 1172929 - RNA, 20 nt, Human
cugaaauaucuaguguagca

SEQ ID NO: 1172930 - RNA, 20 nt, Human
cuugagcucuaguucuugac

SEQ ID NO: 1172931 - RNA, 22 nt, Human
gaaauggaaaaaaaacaaaaaa

SEQ ID NO: 1172932 - RNA, 19 nt, Human
gaccuaagacacccuccuu

SEQ ID NO: 1172933 - RNA, 21 nt, Human
ggaccuaagacacccuccuuc

SEQ ID NO: 1172934 - RNA, 23 nt, Human
ggaguuccuccagguacucacuu

SEQ ID NO: 1172935 - RNA, 24 nt, Human
guaugucucccuucaauauuuccu

SEQ ID NO: 1172936 - RNA, 23 nt, Human
uaaaacagauccucuagccagga

SEQ ID NO: 1172937 - RNA, 22 nt, Human
uaaguggagcaauauuauuggc

SEQ ID NO: 1172938 - RNA, 20 nt, Human
uaaugaacaucaacuauccu

SEQ ID NO: 1172939 - RNA, 21 nt, Human
uaauugaugcugcauugacgc

SEQ ID NO: 1172940 - RNA, 24 nt, Human
uacaugaacacucagcuauguaua

SEQ ID NO: 1172941 - RNA, 18 nt, Human
uaggaguuccuccaggua

SEQ ID NO: 1172942 - RNA, 24 nt, Human
uaggaugugacuuggcaacugauu

SEQ ID NO: 1172943 - RNA, 18 nt, Human
uaguucagauggaucuua

SEQ ID NO: 1172944 - RNA, 18 nt, Human
uaguucagauggaucuua

SEQ ID NO: 1172945 - RNA, 22 nt, Human
uaguucagauggaucuuaccag

SEQ ID NO: 1172946 - RNA, 24 nt, Human
uaucacaguuaaaauuauaguuaa

SEQ ID NO: 1172947 - RNA, 19 nt, Human
uauuuaauagagggacacc

SEQ ID NO: 1172948 - RNA, 31 nt, Human
ucaaaacgcacacacacacacacacacacag

SEQ ID NO: 1172949 - RNA, 18 nt, Human
ucacuggggucuauuguu

SEQ ID NO: 1172950 - RNA, 20 nt, Human
ucagaaagaaaauugcugac

SEQ ID NO: 1172951 - RNA, 19 nt, Human
ucaguaaguggagcaauau

SEQ ID NO: 1172952 - RNA, 22 nt, Human
uccaagcuagcugcccaucauc

SEQ ID NO: 1172953 - RNA, 21 nt, Human
uccacauuuucucuauuuuuc

SEQ ID NO: 1172954 - RNA, 25 nt, Human
ucccacgacaauggauauaguugcu

SEQ ID NO: 1172955 - RNA, 21 nt, Human
ucuauacuucaguaaguggag

SEQ ID NO: 1172956 - RNA, 24 nt, Human
ucugaaaagcugucuacauccaaa

SEQ ID NO: 1172957 - RNA, 24 nt, Human
ucuggccuugggauuccaggagga

SEQ ID NO: 1172958 - RNA, 21 nt, Human
ucuuucuuuuaucaauucucc

SEQ ID NO: 1172959 - RNA, 18 nt, Human
ugaaaaaaggauguuuua

SEQ ID NO: 1172960 - RNA, 24 nt, Human
ugaaaacauaccuagaucauauaa

SEQ ID NO: 1172961 - RNA, 22 nt, Human
ugaaauaucuaguguagcacau

SEQ ID NO: 1172962 - RNA, 25 nt, Human
ugaaauaucuaguguagcacauaau

SEQ ID NO: 1172963 - RNA, 19 nt, Human
ugccucaggucaucuucau

SEQ ID NO: 1172964 - RNA, 20 nt, Human
ugcuaauugaauuacacuuc

SEQ ID NO: 1172965 - RNA, 24 nt, Human
ugcuuuuggacauccaaacuccag

SEQ ID NO: 1172966 - RNA, 19 nt, Human
uggaaaaaaaacaaaaaac

SEQ ID NO: 1172967 - RNA, 25 nt, Human
ugguucuccagcuugcagacaaccu

SEQ ID NO: 1172968 - RNA, 25 nt, Human
uguucccagggaaauggaaaaaaaa

SEQ ID NO: 1172969 - RNA, 20 nt, Human
uuaguauuaaccaauaauaa

SEQ ID NO: 1172970 - RNA, 20 nt, Human
uucaauauuuccucuuaaug

SEQ ID NO: 1172971 - RNA, 22 nt, Human
uucaauuuccuuucuuuucacu

SEQ ID NO: 1172972 - RNA, 21 nt, Human
uucccugguucuccagcuugc

SEQ ID NO: 1172973 - RNA, 33 nt, Human
uucucaaaacgcacacacacacacacacacagu

SEQ ID NO: 1172974 - RNA, 21 nt, Human
uuggacauccaaacuccaggc

SEQ ID NO: 1172975 - RNA, 22 nt, Human
aaacagaaucugauuuacacgg

SEQ ID NO: 1172976 - RNA, 18 nt, Human
acagaaucugauuuacac

SEQ ID NO: 1172977 - RNA, 21 nt, Human
acagaauuucuagaaaagacc

SEQ ID NO: 1172978 - RNA, 19 nt, Human
agagagcauggggacccga

SEQ ID NO: 1172979 - RNA, 25 nt, Human
caaacagauccaucugcaaacagaa

SEQ ID NO: 1172980 - RNA, 21 nt, Human
cacacccagcacaccucccag

SEQ ID NO: 1172981 - RNA, 24 nt, Human
cacgaacacacccagcacaccucc

SEQ ID NO: 1172982 - RNA, 20 nt, Human
ccucccagagagcaugggga

SEQ ID NO: 1172983 - RNA, 20 nt, Human
cgaacacacccagcacaccu

SEQ ID NO: 1172984 - RNA, 28 nt, Human
gaaaagaccaaacagauccaucugcaaa

SEQ ID NO: 1172985 - RNA, 21 nt, Human
gaacacacccagcacaccucc

SEQ ID NO: 1172986 - RNA, 20 nt, Human
uagaaaagaccaaacagauc

SEQ ID NO: 1172987 - RNA, 23 nt, Human
ucaggacauaacagaauuucuag

SEQ ID NO: 1172988 - RNA, 20 nt, Human
ucccagagagcauggggacc

SEQ ID NO: 1172989 - RNA, 21 nt, Human
ucuagaaaagaccaaacagau

SEQ ID NO: 1172990 - RNA, 22 nt, Human
ugauuuacacgaacacacccag

SEQ ID NO: 1172991 - RNA, 24 nt, Human
uuucuagaaaagaccaaacagauc

SEQ ID NO: 1172992 - RNA, 18 nt, Human
aaauguggaaaaauagug

SEQ ID NO: 1172993 - RNA, 21 nt, Human
aagagccaaugucaacagagc

SEQ ID NO: 1172994 - RNA, 18 nt, Human
aaggagccaucaucuuuc

SEQ ID NO: 1172995 - RNA, 21 nt, Human
acacauucacgccccuacgca

SEQ ID NO: 1172996 - RNA, 21 nt, Human
acagagcuuuaauuauauaac

SEQ ID NO: 1172997 - RNA, 20 nt, Human
agaggcauuguggcccacgg

SEQ ID NO: 1172998 - RNA, 23 nt, Human
agaugguagaagguuccucucag

SEQ ID NO: 1172999 - RNA, 23 nt, Human
aucaucugcauguuaccagugca

SEQ ID NO: 1173000 - RNA, 24 nt, Human
aucuucuuccaagaaccacaaagg

SEQ ID NO: 1173001 - RNA, 22 nt, Human
auuauguccacaaaggagccau

SEQ ID NO: 1173002 - RNA, 20 nt, Human
caacagcuuugauucuccua

SEQ ID NO: 1173003 - RNA, 22 nt, Human
caagugaggacauaaauccacu

SEQ ID NO: 1173004 - RNA, 26 nt, Human
cacaaaacuugacucuuccccucauu

SEQ ID NO: 1173005 - RNA, 30 nt, Human
cacacacauucacgccccuacgcauauaca

SEQ ID NO: 1173006 - RNA, 19 nt, Human
cacuguauaugcuucaggu

SEQ ID NO: 1173007 - RNA, 18 nt, Human
cagugaacucuuaucuuc

SEQ ID NO: 1173008 - RNA, 24 nt, Human
cauaaauccacuaaaccaucacuc

SEQ ID NO: 1173009 - RNA, 25 nt, Human
cauuaugaaguuugccuucaagagg

SEQ ID NO: 1173010 - RNA, 20 nt, Human
ccaaugucaacagagcuuua

SEQ ID NO: 1173011 - RNA, 22 nt, Human
ccccuacgcauauacacuucag

SEQ ID NO: 1173012 - RNA, 23 nt, Human
ccuacuccaaccagcuuagcugg

SEQ ID NO: 1173013 - RNA, 23 nt, Human
cuggcaauggacacuguauaugc

SEQ ID NO: 1173014 - RNA, 24 nt, Human
gaaaauguggaaaaauaguguagc

SEQ ID NO: 1173015 - RNA, 21 nt, Human
gagaaucacugggagaugaga

SEQ ID NO: 1173016 - RNA, 18 nt, Human
ggugcagaguucaaagac

SEQ ID NO: 1173017 - RNA, 21 nt, Human
uacaagguuacugggccuagu

SEQ ID NO: 1173018 - RNA, 22 nt, Human
uagaagguuccucucaguguuu

SEQ ID NO: 1173019 - RNA, 25 nt, Human
uaguuuaugaaagugaccauuuuuu

SEQ ID NO: 1173020 - RNA, 20 nt, Human
uauaauaggugcauucaguu

SEQ ID NO: 1173021 - RNA, 25 nt, Human
uauacacacacauucacgccccuac

SEQ ID NO: 1173022 - RNA, 29 nt, Human
uauacacacacauucacgccccuacgcau

SEQ ID NO: 1173023 - RNA, 20 nt, Human
uauauacacacacauucacg

SEQ ID NO: 1173024 - RNA, 21 nt, Human
uaucuuuacucaagugcuggc

SEQ ID NO: 1173025 - RNA, 26 nt, Human
ucacucucuaccuuaaucuucucaau

SEQ ID NO: 1173026 - RNA, 24 nt, Human
ucacugggagaugagaugguagaa

SEQ ID NO: 1173027 - RNA, 19 nt, Human
ucagugaacucuuaucuuc

SEQ ID NO: 1173028 - RNA, 22 nt, Human
uccaagcaauucucagaagagg

SEQ ID NO: 1173029 - RNA, 19 nt, Human
ucuuaggauaacugguucu

SEQ ID NO: 1173030 - RNA, 22 nt, Human
ugacuuuaauuuaauacauugc

SEQ ID NO: 1173031 - RNA, 18 nt, Human
ugcagaguucaaagacag

SEQ ID NO: 1173032 - RNA, 29 nt, Human
uggcccacggagaaucacugggagaugaa

SEQ ID NO: 1173033 - RNA, 27 nt, Human
uguagcggcauggaacuggguaaguac

SEQ ID NO: 1173034 - RNA, 21 nt, Human
uguauaugcuucagguuacac

SEQ ID NO: 1173035 - RNA, 20 nt, Human
uuaauuuaguuucacucauu

SEQ ID NO: 1173036 - RNA, 25 nt, Human
uuauauacacacacauucacggugu

SEQ ID NO: 1173037 - RNA, 22 nt, Human
uucaagagccaaugucaacaga

SEQ ID NO: 1173038 - RNA, 19 nt, Human
uucaagaugugacucacag

SEQ ID NO: 1173039 - RNA, 20 nt, Human
uucacucucuaccuuaaucu

SEQ ID NO: 1173040 - RNA, 20 nt, Human
uugcuuguugguacagauag

SEQ ID NO: 1173041 - RNA, 25 nt, Human
uugguacagauaggacuucagcuau

SEQ ID NO: 1173042 - RNA, 24 nt, Human
uuguccugaccauauuucacucuc

SEQ ID NO: 1173043 - RNA, 23 nt, Human
uuuaucuuuacucaagugcuggc

SEQ ID NO: 1173044 - RNA, 20 nt, Human
aacuauugcuccccccaccc

SEQ ID NO: 1173045 - RNA, 18 nt, Human
aagacagagcucucaaac

SEQ ID NO: 1173046 - RNA, 20 nt, Human
acaaaugcaaaaaaaaagga

SEQ ID NO: 1173047 - RNA, 19 nt, Human
acauugguaaauauuuuuc

SEQ ID NO: 1173048 - RNA, 22 nt, Human
acucugucccacccccaacccc

SEQ ID NO: 1173049 - RNA, 21 nt, Human
agaaaaaacuugcuccaugcc

SEQ ID NO: 1173050 - RNA, 23 nt, Human
agaaaaauagcauucuucaccgg

SEQ ID NO: 1173051 - RNA, 18 nt, Human
agaauuaacaaaugcaaa

SEQ ID NO: 1173052 - RNA, 18 nt, Human
agacacacuggagcugcu

SEQ ID NO: 1173053 - RNA, 20 nt, Human
aggacucaaaggacaauaca

SEQ ID NO: 1173054 - RNA, 20 nt, Human
aggucaucauggcauguuuc

SEQ ID NO: 1173055 - RNA, 19 nt, Human
aguguuguauguagaggcu

SEQ ID NO: 1173056 - RNA, 27 nt, Human
augaaaaccaaauaaugcuuuaaaaua

SEQ ID NO: 1173057 - RNA, 18 nt, Human
augaaaugcaggaggcca

SEQ ID NO: 1173058 - RNA, 18 nt, Human
augauaguugugauuugg

SEQ ID NO: 1173059 - RNA, 19 nt, Human
augcaaaaaaaaaggacac

SEQ ID NO: 1173060 - RNA, 18 nt, Human
caagaaaaaauaugacuc

SEQ ID NO: 1173061 - RNA, 26 nt, Human
cacacaacagaucccccaaauaccac

SEQ ID NO: 1173062 - RNA, 21 nt, Human
cacacaauguagguggguuaa

SEQ ID NO: 1173063 - RNA, 19 nt, Human
caccauggaggcucuaugg

SEQ ID NO: 1173064 - RNA, 21 nt, Human
caccauggaggcucuauggua

SEQ ID NO: 1173065 - RNA, 24 nt, Human
cacccccaaccccaucagaagacc

SEQ ID NO: 1173066 - RNA, 22 nt, Human
caccuagagugcaauaaauaaa

SEQ ID NO: 1173067 - RNA, 24 nt, Human
cacgugugugugugugugugugag

SEQ ID NO: 1173068 - RNA, 19 nt, Human
cagaucccccaaauaccac

SEQ ID NO: 1173069 - RNA, 18 nt, Human
cagccuuuagggcaaaca

SEQ ID NO: 1173070 - RNA, 22 nt, Human
cagcgaguuaagccauuucugc

SEQ ID NO: 1173071 - RNA, 26 nt, Human
cauggcauguuucguuuguuuuugca

SEQ ID NO: 1173072 - RNA, 18 nt, Human
ccaacccgcugggcugca

SEQ ID NO: 1173073 - RNA, 19 nt, Human
ccacagcuguuucuguguu

SEQ ID NO: 1173074 - RNA, 21 nt, Human
ccacugaggaaauucaagcau

SEQ ID NO: 1173075 - RNA, 22 nt, Human
ccaugcaaacacaguaauggaa

SEQ ID NO: 1173076 - RNA, 25 nt, Human
cccacccccaaccccaucagaagac

SEQ ID NO: 1173077 - RNA, 20 nt, Human
ccccaaauaccacaaaaaga

SEQ ID NO: 1173078 - RNA, 20 nt, Human
ccccacccacccaaaaauaa

SEQ ID NO: 1173079 - RNA, 24 nt, Human
cccccaaauaccacaaaaagaucu

SEQ ID NO: 1173080 - RNA, 21 nt, Human
ccgaaggccugggagaaaggg

SEQ ID NO: 1173081 - RNA, 21 nt, Human
ccuuggaugacuucccagcuc

SEQ ID NO: 1173082 - RNA, 19 nt, Human
cgugcucacgugugugugu

SEQ ID NO: 1173083 - RNA, 19 nt, Human
cucacagaggccaacccgc

SEQ ID NO: 1173084 - RNA, 23 nt, Human
cucauacauuaaacaugcauggu

SEQ ID NO: 1173085 - RNA, 24 nt, Human
cugauaagccugagcuaauuaugu

SEQ ID NO: 1173086 - RNA, 26 nt, Human
cuugaacucauuuagaauuaauagca

SEQ ID NO: 1173087 - RNA, 18 nt, Human
gacacacuggagcugcug

SEQ ID NO: 1173088 - RNA, 24 nt, Human
gauuacuuuuuaguagucaacuac

SEQ ID NO: 1173089 - RNA, 22 nt, Human
gcgugcucacgugugugugugu

SEQ ID NO: 1173090 - RNA, 19 nt, Human
gcugcagaggaguuagcaa

SEQ ID NO: 1173091 - RNA, 21 nt, Human
ggccacugcgaaaaaaguucu

SEQ ID NO: 1173092 - RNA, 25 nt, Human
gugugugcgugcucacgugugugug

SEQ ID NO: 1173093 - RNA, 21 nt, Human
guuucaguuagaaagaggagg

SEQ ID NO: 1173094 - RNA, 19 nt, Human
uaacaaaugcaaaaaaaaa

SEQ ID NO: 1173095 - RNA, 19 nt, Human
uaacacacaacagaucccc

SEQ ID NO: 1173096 - RNA, 20 nt, Human
uaacacacaacagauccccc

SEQ ID NO: 1173097 - RNA, 22 nt, Human
uaacugaaacuucauagaaauc

SEQ ID NO: 1173098 - RNA, 21 nt, Human
uacacucuaacacacaacaga

SEQ ID NO: 1173099 - RNA, 22 nt, Human
uacauauucaguuggccucugu

SEQ ID NO: 1173100 - RNA, 27 nt, Human
uaccacaaaaagaucucaaauauuuca

SEQ ID NO: 1173101 - RNA, 19 nt, Human
uacuauaaggugaaaucgc

SEQ ID NO: 1173102 - RNA, 20 nt, Human
uagaaauccacagcuguuuc

SEQ ID NO: 1173103 - RNA, 20 nt, Human
ucagaagaccauauuuuagg

SEQ ID NO: 1173104 - RNA, 20 nt, Human
ucagaauuaacaaaugcaaa

SEQ ID NO: 1173105 - RNA, 27 nt, Human
ucauggcauguuucguuuguuuuugca

SEQ ID NO: 1173106 - RNA, 20 nt, Human
uccaagaaaaaauaugacuc

SEQ ID NO: 1173107 - RNA, 24 nt, Human
uccauaaacacauugaccuacuau

SEQ ID NO: 1173108 - RNA, 26 nt, Human
ucccacccccaaccccaucagaagac

SEQ ID NO: 1173109 - RNA, 25 nt, Human
ucuaucauuuucaaauguauaugug

SEQ ID NO: 1173110 - RNA, 22 nt, Human
ucugaacuuuccgaaggccugg

SEQ ID NO: 1173111 - RNA, 20 nt, Human
ugaaauacacucuaacacac

SEQ ID NO: 1173112 - RNA, 22 nt, Human
ugaaauacacucuaacacacaa

SEQ ID NO: 1173113 - RNA, 24 nt, Human
ugaaaugcaggaggccacugcgaa

SEQ ID NO: 1173114 - RNA, 20 nt, Human
ugaccuguccacugauuacu

SEQ ID NO: 1173115 - RNA, 19 nt, Human
ugaggaaauucaagcauga

SEQ ID NO: 1173116 - RNA, 21 nt, Human
ugaggaaauucaagcaugagu

SEQ ID NO: 1173117 - RNA, 23 nt, Human
ugcacugggauucuugggcacac

SEQ ID NO: 1173118 - RNA, 21 nt, Human
ugccaacuacguuaacagcac

SEQ ID NO: 1173119 - RNA, 21 nt, Human
ugccuuggaugacuucccagc

SEQ ID NO: 1173120 - RNA, 25 nt, Human
ugcgugcucacgugugugugugugu

SEQ ID NO: 1173121 - RNA, 18 nt, Human
ugcuccccccacccaccc

SEQ ID NO: 1173122 - RNA, 18 nt, Human
uggcauguuucguuuguu

SEQ ID NO: 1173123 - RNA, 24 nt, Human
uggcauguuucguuuguuuuugca

SEQ ID NO: 1173124 - RNA, 20 nt, Human
uggcuuggggcugucugcac

SEQ ID NO: 1173125 - RNA, 24 nt, Human
ugggagaaaggggccugcuuucag

SEQ ID NO: 1173126 - RNA, 21 nt, Human
ugggcacacaauguagguggg

SEQ ID NO: 1173127 - RNA, 21 nt, Human
uggguuaaggcaaguauguac

SEQ ID NO: 1173128 - RNA, 18 nt, Human
ugucccacccccaacccc

SEQ ID NO: 1173129 - RNA, 21 nt, Human
ugugcgugcucacgugugugu

SEQ ID NO: 1173130 - RNA, 18 nt, Human
ugugugcgugcucacgug

SEQ ID NO: 1173131 - RNA, 22 nt, Human
ugugugcgugcucacgugugug

SEQ ID NO: 1173132 - RNA, 22 nt, Human
ugugugugucaguguuguaugu

SEQ ID NO: 1173133 - RNA, 22 nt, Human
ugugugugugugugugucagug

SEQ ID NO: 1173134 - RNA, 18 nt, Human
ugugugugugugugugug

SEQ ID NO: 1173135 - RNA, 19 nt, Human
ugugugugugugugugugu

SEQ ID NO: 1173136 - RNA, 23 nt, Human
uguugccaacuacguuaacagca

SEQ ID NO: 1173137 - RNA, 21 nt, Human
uguuuauuuuauacauguaug

SEQ ID NO: 1173138 - RNA, 23 nt, Human
uguuuauuuuauacauguaugua

SEQ ID NO: 1173139 - RNA, 20 nt, Human
uuaauguuuuacucuguccc

SEQ ID NO: 1173140 - RNA, 18 nt, Human
uuacucugucccaccccc

SEQ ID NO: 1173141 - RNA, 24 nt, Human
uucaagcaugagugcuggaaucuu

SEQ ID NO: 1173142 - RNA, 21 nt, Human
uuggggcugucugcacuggga

SEQ ID NO: 1173143 - RNA, 19 nt, Human
uugguggugaugauaguug

SEQ ID NO: 1173144 - RNA, 20 nt, Human
uugguggugaugauaguugu

SEQ ID NO: 1173145 - RNA, 18 nt, Human
aaacaggcaguccccaga

SEQ ID NO: 1173146 - RNA, 20 nt, Human
aaaugcugaggccuacaacc

SEQ ID NO: 1173147 - RNA, 21 nt, Human
aaccgugcagcuccagguccu

SEQ ID NO: 1173148 - RNA, 20 nt, Human
aaccuggccccuguucucgg

SEQ ID NO: 1173149 - RNA, 19 nt, Human
aagcaagccacaacuucug

SEQ ID NO: 1173150 - RNA, 21 nt, Human
aagcaagccacaacuucugcu

SEQ ID NO: 1173151 - RNA, 21 nt, Human
aaggggcaguugcccagggug

SEQ ID NO: 1173152 - RNA, 24 nt, Human
acuggaagggaaggggcaguugcc

SEQ ID NO: 1173153 - RNA, 25 nt, Human
agaaacaggcaguccccagacagaa

SEQ ID NO: 1173154 - RNA, 23 nt, Human
agacagaagcacaaagggcaauc

SEQ ID NO: 1173155 - RNA, 25 nt, Human
agacagaagcacaaagggcaaucuc

SEQ ID NO: 1173156 - RNA, 18 nt, Human
agcagagugccaaaguca

SEQ ID NO: 1173157 - RNA, 22 nt, Human
aggaagucaaggguaugcaggc

SEQ ID NO: 1173158 - RNA, 25 nt, Human
aggaagucaaggguaugcaggcgcu

SEQ ID NO: 1173159 - RNA, 23 nt, Human
aggccuacaaccauguguucuga

SEQ ID NO: 1173160 - RNA, 24 nt, Human
aucuggacaaagcuaaugcagaag

SEQ ID NO: 1173161 - RNA, 24 nt, Human
augcaggcgcuccaguuucccugc

SEQ ID NO: 1173162 - RNA, 22 nt, Human
auggcagguuaaaaaaaaaaaa

SEQ ID NO: 1173163 - RNA, 21 nt, Human
caaaauacccuauaagggcug

SEQ ID NO: 1173164 - RNA, 19 nt, Human
caaagcuaaugcagaauga

SEQ ID NO: 1173165 - RNA, 18 nt, Human
caaagucaggcuggagug

SEQ ID NO: 1173166 - RNA, 21 nt, Human
caaaugcugaggccuacaacc

SEQ ID NO: 1173167 - RNA, 18 nt, Human
caacagagaccccaccga

SEQ ID NO: 1173168 - RNA, 24 nt, Human
caaccagacauucucccuggagac

SEQ ID NO: 1173169 - RNA, 27 nt, Human
cacaaccagacauucucccuggagacc

SEQ ID NO: 1173170 - RNA, 18 nt, Human
caccccgcugaccugagc

SEQ ID NO: 1173171 - RNA, 21 nt, Human
caccccgcugaccugagcaga

SEQ ID NO: 1173172 - RNA, 23 nt, Human
cacuggacaucacagcacaugag

SEQ ID NO: 1173173 - RNA, 19 nt, Human
cagaagcacaaagggcaau

SEQ ID NO: 1173174 - RNA, 25 nt, Human
cagcaggcauucccaacagagaccc

SEQ ID NO: 1173175 - RNA, 21 nt, Human
caggagccugggaggagguga

SEQ ID NO: 1173176 - RNA, 19 nt, Human
caggcaguccccagacaga

SEQ ID NO: 1173177 - RNA, 21 nt, Human
caggccccacuggaagggaag

SEQ ID NO: 1173178 - RNA, 21 nt, Human
caguccccagacagaagcaca

SEQ ID NO: 1173179 - RNA, 21 nt, Human
ccaaaggauuccugccuucug

SEQ ID NO: 1173180 - RNA, 20 nt, Human
ccaauauuaauuaccaccca

SEQ ID NO: 1173181 - RNA, 22 nt, Human
ccacagucuuuaauuaucuucc

SEQ ID NO: 1173182 - RNA, 23 nt, Human
ccacagucuuuaauuaucuuccc

SEQ ID NO: 1173183 - RNA, 22 nt, Human
ccagacagaagcacaaagggca

SEQ ID NO: 1173184 - RNA, 24 nt, Human
ccagucuggagcccucccagccac

SEQ ID NO: 1173185 - RNA, 19 nt, Human
cccacacugaacaaucugg

SEQ ID NO: 1173186 - RNA, 19 nt, Human
cccaggagccugggaggag

SEQ ID NO: 1173187 - RNA, 22 nt, Human
ccccaaaauuuguaucuugaag

SEQ ID NO: 1173188 - RNA, 21 nt, Human
ccccuucuccuccaccauguc

SEQ ID NO: 1173189 - RNA, 23 nt, Human
ccucccagccacggaacugccug

SEQ ID NO: 1173190 - RNA, 24 nt, Human
ccucccagccacggaacugccugg

SEQ ID NO: 1173191 - RNA, 22 nt, Human
cgggugcuauggauggaauguu

SEQ ID NO: 1173192 - RNA, 21 nt, Human
cucccuggagacccuaagcuc

SEQ ID NO: 1173193 - RNA, 22 nt, Human
cucuguccauuccacugauaaa

SEQ ID NO: 1173194 - RNA, 18 nt, Human
cugauaagaacagagaug

SEQ ID NO: 1173195 - RNA, 26 nt, Human
cugcucacuggacaucacagcacaug

SEQ ID NO: 1173196 - RNA, 24 nt, Human
cugguauuaggaagcggggcauuu

SEQ ID NO: 1173197 - RNA, 23 nt, Human
gaaccacacgcuucacacagcaa

SEQ ID NO: 1173198 - RNA, 18 nt, Human
gagaaggagcaccuggca

SEQ ID NO: 1173199 - RNA, 22 nt, Human
gagacugcuugaggauggaggg

SEQ ID NO: 1173200 - RNA, 22 nt, Human
gagcacagacaccacauccugc

SEQ ID NO: 1173201 - RNA, 25 nt, Human
gagcaccuggcacugaccagcccug

SEQ ID NO: 1173202 - RNA, 18 nt, Human
gagcgugaaugcugaggg

SEQ ID NO: 1173203 - RNA, 19 nt, Human
gaggagcaaccuggccccu

SEQ ID NO: 1173204 - RNA, 20 nt, Human
gcaaucucaaggaaucaaga

SEQ ID NO: 1173205 - RNA, 19 nt, Human
gcacagacaccacauccug

SEQ ID NO: 1173206 - RNA, 18 nt, Human
gcccagggugccugagga

SEQ ID NO: 1173207 - RNA, 19 nt, Human
ggaaccuagggauuaggga

SEQ ID NO: 1173208 - RNA, 21 nt, Human
ggaagcggggcauuuaggagg

SEQ ID NO: 1173209 - RNA, 27 nt, Human
ggagcccucccagccacggaacugccu

SEQ ID NO: 1173210 - RNA, 18 nt, Human
ggagguguugugauuuga

SEQ ID NO: 1173211 - RNA, 24 nt, Human
gggugggagaaggagcaccuggca

SEQ ID NO: 1173212 - RNA, 19 nt, Human
gucuggagcccucccagcc

SEQ ID NO: 1173213 - RNA, 20 nt, Human
gugaaugggauuagugcccu

SEQ ID NO: 1173214 - RNA, 23 nt, Human
uaaaaaaaaaaaaucacuguucc

SEQ ID NO: 1173215 - RNA, 21 nt, Human
uaacagaaauggcagguuaaa

SEQ ID NO: 1173216 - RNA, 21 nt, Human
uaaggcaaaugcugaggccua

SEQ ID NO: 1173217 - RNA, 21 nt, Human
uaagugaggauuagaaagccc

SEQ ID NO: 1173218 - RNA, 23 nt, Human
uaaguugagcacuuugucacuug

SEQ ID NO: 1173219 - RNA, 22 nt, Human
uacagcagccugaacugacuaa

SEQ ID NO: 1173220 - RNA, 24 nt, Human
uacccuacauauccauaacagacu

SEQ ID NO: 1173221 - RNA, 24 nt, Human
uaggaagcggggcauuuaggaggu

SEQ ID NO: 1173222 - RNA, 22 nt, Human
ucacaaccagacauucucccug

SEQ ID NO: 1173223 - RNA, 24 nt, Human
ucaggcuggagugugcccugaaag

SEQ ID NO: 1173224 - RNA, 23 nt, Human
ucagggccccuucuccuccacca

SEQ ID NO: 1173225 - RNA, 21 nt, Human
ucagugucuauccaggcacug

SEQ ID NO: 1173226 - RNA, 24 nt, Human
uccauaacagacuucaacacgaga

SEQ ID NO: 1173227 - RNA, 20 nt, Human
ucccuggagacccuaagcuc

SEQ ID NO: 1173228 - RNA, 18 nt, Human
uccugcagccguccuugg

SEQ ID NO: 1173229 - RNA, 24 nt, Human
uccugcgucccagccucacaagaa

SEQ ID NO: 1173230 - RNA, 23 nt, Human
ucgcccaagcgcuugcuugauuu

SEQ ID NO: 1173231 - RNA, 20 nt, Human
ucucaggguuaucuuuucca

SEQ ID NO: 1173232 - RNA, 19 nt, Human
ucugcuggaaauugcucca

SEQ ID NO: 1173233 - RNA, 24 nt, Human
ugaagguucggaugcaagcacucu

SEQ ID NO: 1173234 - RNA, 20 nt, Human
ugagcacagacaccacaucc

SEQ ID NO: 1173235 - RNA, 19 nt, Human
ugauaaagggccaagucca

SEQ ID NO: 1173236 - RNA, 21 nt, Human
ugcccagggugccugaggagc

SEQ ID NO: 1173237 - RNA, 19 nt, Human
ugcccugauaagaacagag

SEQ ID NO: 1173238 - RNA, 22 nt, Human
ugcucaggugcuucccaggagc

SEQ ID NO: 1173239 - RNA, 20 nt, Human
ugcuucccaggagccuggga

SEQ ID NO: 1173240 - RNA, 18 nt, Human
uggaauguuugagucccc

SEQ ID NO: 1173241 - RNA, 19 nt, Human
ugggaggaggugacgcuga

SEQ ID NO: 1173242 - RNA, 21 nt, Human
ugggaggaggugacgcugagc

SEQ ID NO: 1173243 - RNA, 21 nt, Human
ugggaggaggugacgcugagc

SEQ ID NO: 1173244 - RNA, 22 nt, Human
ugggaggaggugacgcugagcc

SEQ ID NO: 1173245 - RNA, 21 nt, Human
uguugugauuugagucacucu

SEQ ID NO: 1173246 - RNA, 20 nt, Human
uuaggaggugauuaggucau

SEQ ID NO: 1173247 - RNA, 21 nt, Human
uucccaacagagaccccaccg

SEQ ID NO: 1173248 - RNA, 18 nt, Human
uucccaggagccugggag

SEQ ID NO: 1173249 - RNA, 22 nt, Human
uuccucuguugggggagcacaa

SEQ ID NO: 1173250 - RNA, 19 nt, Human
uucuucaucucugccuugg

SEQ ID NO: 1173251 - RNA, 18 nt, Human
uuguggucugaggucugc

SEQ ID NO: 1173252 - RNA, 21 nt, Human
aaaccgcuuauucaagccucc

SEQ ID NO: 1173253 - RNA, 20 nt, Human
aaaugcagaaaucaccugcc

SEQ ID NO: 1173254 - RNA, 19 nt, Human
aacagucaugcccuucuuc

SEQ ID NO: 1173255 - RNA, 19 nt, Human
aacauggugaaacaccauc

SEQ ID NO: 1173256 - RNA, 20 nt, Human
aacauggugaaacaccaucu

SEQ ID NO: 1173257 - RNA, 21 nt, Human
aacauggugaaacaccaucuc

SEQ ID NO: 1173258 - RNA, 23 nt, Human
aagaauugcuugaaccugggagg

SEQ ID NO: 1173259 - RNA, 24 nt, Human
aagccuccguaauggccgacaccc

SEQ ID NO: 1173260 - RNA, 19 nt, Human
aagcugcgcccacggccgc

SEQ ID NO: 1173261 - RNA, 24 nt, Human
aauugcuugaaccugggaggugga

SEQ ID NO: 1173262 - RNA, 20 nt, Human
acaccccuccccguaccaag

SEQ ID NO: 1173263 - RNA, 24 nt, Human
acagagcgagacucugucucagga

SEQ ID NO: 1173264 - RNA, 24 nt, Human
acaggccggaugcaguggcucaug

SEQ ID NO: 1173265 - RNA, 19 nt, Human
acauggugaaacaccaucu

SEQ ID NO: 1173266 - RNA, 23 nt, Human
acccugcuucugcuugccuuccg

SEQ ID NO: 1173267 - RNA, 22 nt, Human
accuggcgacagagcgagacuc

SEQ ID NO: 1173268 - RNA, 22 nt, Human
acgccacugcacuccaaccugg

SEQ ID NO: 1173269 - RNA, 23 nt, Human
acugcacuccaaccuggcgacag

SEQ ID NO: 1173270 - RNA, 25 nt, Human
acugcacuccaaccuggcgacagag

SEQ ID NO: 1173271 - RNA, 19 nt, Human
acuggggcugcugccuuuc

SEQ ID NO: 1173272 - RNA, 19 nt, Human
agagauccugagcuuucau

SEQ ID NO: 1173273 - RNA, 24 nt, Human
agcacuuugggaggcugaggcagg

SEQ ID NO: 1173274 - RNA, 23 nt, Human
agccgggcgugguggcaugugcc

SEQ ID NO: 1173275 - RNA, 22 nt, Human
aggaaaaaaaaaaaaaaaaucc

SEQ ID NO: 1173276 - RNA, 22 nt, Human
aggcagaagaauugcuugaacc

SEQ ID NO: 1173277 - RNA, 24 nt, Human
aggcagaagaauugcuugaaccug

SEQ ID NO: 1173278 - RNA, 24 nt, Human
aggcagguggaucacaaggucaag

SEQ ID NO: 1173279 - RNA, 24 nt, Human
aggcagucugucccucagcagagc

SEQ ID NO: 1173280 - RNA, 24 nt, Human
aggcugaggcagaagaauugcuug

SEQ ID NO: 1173281 - RNA, 19 nt, Human
aggcugaggcagguggauc

SEQ ID NO: 1173282 - RNA, 21 nt, Human
aggcugaggcagguggaucac

SEQ ID NO: 1173283 - RNA, 25 nt, Human
agguggagguugcagugacaacggu

SEQ ID NO: 1173284 - RNA, 21 nt, Human
agguggagguugcagugagcc

SEQ ID NO: 1173285 - RNA, 24 nt, Human
agguggagguugcagugagccgag

SEQ ID NO: 1173286 - RNA, 19 nt, Human
agguggaucacaaggucaa

SEQ ID NO: 1173287 - RNA, 23 nt, Human
aguggcucaugccuguaauccca

SEQ ID NO: 1173288 - RNA, 24 nt, Human
aguggcucaugccuguaaucccag

SEQ ID NO: 1173289 - RNA, 24 nt, Human
aucacgccacugcacuccaaccug

SEQ ID NO: 1173290 - RNA, 20 nt, Human
auccauuaaaaauccuuaac

SEQ ID NO: 1173291 - RNA, 21 nt, Human
auccuggccaacauggugaaa

SEQ ID NO: 1173292 - RNA, 19 nt, Human
augccuguaaucccagcac

SEQ ID NO: 1173293 - RNA, 24 nt, Human
caacauggugaaacaccaucucua

SEQ ID NO: 1173294 - RNA, 19 nt, Human
caccccacccugcuucugc

SEQ ID NO: 1173295 - RNA, 23 nt, Human
caccccacccugcuucugcuugc

SEQ ID NO: 1173296 - RNA, 23 nt, Human
caccccuccccguaccaagcuug

SEQ ID NO: 1173297 - RNA, 22 nt, Human
cacuccaaccuggcgacagagc

SEQ ID NO: 1173298 - RNA, 21 nt, Human
cacugcacuccaaccuggcga

SEQ ID NO: 1173299 - RNA, 22 nt, Human
cacugcacuccaaccuggcgac

SEQ ID NO: 1173300 - RNA, 23 nt, Human
cacugcacuccaaccuggcgaca

SEQ ID NO: 1173301 - RNA, 18 nt, Human
cacugcucuuuucagagc

SEQ ID NO: 1173302 - RNA, 24 nt, Human
cagcacuuugggaggcugaggcag

SEQ ID NO: 1173303 - RNA, 26 nt, Human
cagcacuuugggaggcugaggcaggu

SEQ ID NO: 1173304 - RNA, 24 nt, Human
cagcuacucaggaggcugaggcag

SEQ ID NO: 1173305 - RNA, 27 nt, Human
caggaggcugaggcagaagaauugcuu

SEQ ID NO: 1173306 - RNA, 19 nt, Human
cagucaugcccuucuucug

SEQ ID NO: 1173307 - RNA, 20 nt, Human
caugccuguaaucccagcac

SEQ ID NO: 1173308 - RNA, 24 nt, Human
caugccuguaaucccagcacuuug

SEQ ID NO: 1173309 - RNA, 18 nt, Human
ccaaagaggagaaaucua

SEQ ID NO: 1173310 - RNA, 19 nt, Human
ccacugcacuccaaccugg

SEQ ID NO: 1173311 - RNA, 19 nt, Human
ccacugcacuccaaccugg

SEQ ID NO: 1173312 - RNA, 19 nt, Human
ccacugcacuccaaccugg

SEQ ID NO: 1173313 - RNA, 20 nt, Human
ccacugcacuccaaccuggc

SEQ ID NO: 1173314 - RNA, 23 nt, Human
ccacugcacuccaaccuggcgac

SEQ ID NO: 1173315 - RNA, 18 nt, Human
ccagucaggaggcacagg

SEQ ID NO: 1173316 - RNA, 23 nt, Human
cccaaucagaugaaccggguacc

SEQ ID NO: 1173317 - RNA, 19 nt, Human
cccagucaggaggcacagg

SEQ ID NO: 1173318 - RNA, 22 nt, Human
ccccaggugcucugucccaggg

SEQ ID NO: 1173319 - RNA, 23 nt, Human
ccccguaccaagcuugagcaucc

SEQ ID NO: 1173320 - RNA, 19 nt, Human
ccuggccaacauggugaaa

SEQ ID NO: 1173321 - RNA, 24 nt, Human
ccuggccaacauggugaaacacca

SEQ ID NO: 1173322 - RNA, 21 nt, Human
ccugggagguggagguugcag

SEQ ID NO: 1173323 - RNA, 19 nt, Human
ccuguagucccagcuacuc

SEQ ID NO: 1173324 - RNA, 21 nt, Human
ccuguagucccagcuacucag

SEQ ID NO: 1173325 - RNA, 21 nt, Human
ccuucuucauugaucucgcug

SEQ ID NO: 1173326 - RNA, 19 nt, Human
cgagaucacgccacugcac

SEQ ID NO: 1173327 - RNA, 25 nt, Human
cgccacugcacuccaaccuggcgac

SEQ ID NO: 1173328 - RNA, 19 nt, Human
cgcugggagcugcagacug

SEQ ID NO: 1173329 - RNA, 21 nt, Human
cuauaggccccugacuggggc

SEQ ID NO: 1173330 - RNA, 22 nt, Human
cucaggaaaaaaaaaaaaaaaa

SEQ ID NO: 1173331 - RNA, 24 nt, Human
cucaggaaaaaaaaaaaaaaaauc

SEQ ID NO: 1173332 - RNA, 26 nt, Human
cucaggaaaaaaaaaaaaaaaauccu

SEQ ID NO: 1173333 - RNA, 23 nt, Human
cucaugccuguaaucccagcacu

SEQ ID NO: 1173334 - RNA, 24 nt, Human
cucaugccuguaaucccagcacuu

SEQ ID NO: 1173335 - RNA, 24 nt, Human
cucuuggacuucccaggugaggug

SEQ ID NO: 1173336 - RNA, 19 nt, Human
cugaagcugcgcccacggc

SEQ ID NO: 1173337 - RNA, 24 nt, Human
cugucucaggaaaaaaaaaaaaaa

SEQ ID NO: 1173338 - RNA, 23 nt, Human
cuucccaggugaggugacacccc

SEQ ID NO: 1173339 - RNA, 19 nt, Human
cuugaaccugggaggugga

SEQ ID NO: 1173340 - RNA, 23 nt, Human
cuuuggaugggguuuuugcgugg

SEQ ID NO: 1173341 - RNA, 18 nt, Human
cuuuuuguugauguugau

SEQ ID NO: 1173342 - RNA, 24 nt, Human
gacagagcgagacucugucucagg

SEQ ID NO: 1173343 - RNA, 23 nt, Human
gacccuguuuuccucgguaucac

SEQ ID NO: 1173344 - RNA, 18 nt, Human
gacucugucucaggaaaa

SEQ ID NO: 1173345 - RNA, 22 nt, Human
gagguugcagugagccgagauc

SEQ ID NO: 1173346 - RNA, 24 nt, Human
gccaacauggugaaacaccaucuc

SEQ ID NO: 1173347 - RNA, 20 nt, Human
gccgagaucacgccacugca

SEQ ID NO: 1173348 - RNA, 24 nt, Human
gcgacagagcgagacucugucuca

SEQ ID NO: 1173349 - RNA, 22 nt, Human
gcugaagcugcgcccacggccg

SEQ ID NO: 1173350 - RNA, 21 nt, Human
ggacuucccaggugaggugac

SEQ ID NO: 1173351 - RNA, 20 nt, Human
ggagguugcagugagccgag

SEQ ID NO: 1173352 - RNA, 22 nt, Human
ggagguugcagugagccgagau

SEQ ID NO: 1173353 - RNA, 23 nt, Human
ggagguugcagugagccgagauc

SEQ ID NO: 1173354 - RNA, 24 nt, Human
ggagguugcagugagccgagauca

SEQ ID NO: 1173355 - RNA, 20 nt, Human
ggaguuugcuggagguccac

SEQ ID NO: 1173356 - RNA, 24 nt, Human
ggaugcaguggcucaugccuguaa

SEQ ID NO: 1173357 - RNA, 20 nt, Human
ggcaagaacguuuaagucug

SEQ ID NO: 1173358 - RNA, 26 nt, Human
ggccccugacuggggcugcugccuuu

SEQ ID NO: 1173359 - RNA, 19 nt, Human
ggguaccucaguuggaaau

SEQ ID NO: 1173360 - RNA, 24 nt, Human
gguugcugccugcuucuuccucug

SEQ ID NO: 1173361 - RNA, 20 nt, Human
gucaugcccuucuucugcag

SEQ ID NO: 1173362 - RNA, 21 nt, Human
guggugggcucugccccgugu

SEQ ID NO: 1173363 - RNA, 23 nt, Human
guugcugccugcuucuuccucug

SEQ ID NO: 1173364 - RNA, 26 nt, Human
uagacauccauuaaaaauccuuaaca

SEQ ID NO: 1173365 - RNA, 18 nt, Human
uagcccaauucagagauc

SEQ ID NO: 1173366 - RNA, 22 nt, Human
uagccgggcgugguggcaugug

SEQ ID NO: 1173367 - RNA, 21 nt, Human
uauguugggagauccacugcu

SEQ ID NO: 1173368 - RNA, 24 nt, Human
ucacaaggucaagagauugagacc

SEQ ID NO: 1173369 - RNA, 23 nt, Human
ucacgccacugcacuccaaccug

SEQ ID NO: 1173370 - RNA, 22 nt, Human
ucaggaaaaaaaaaaaaaaaaa

SEQ ID NO: 1173371 - RNA, 22 nt, Human
ucaggaaaaaaaaaaaaaaaau

SEQ ID NO: 1173372 - RNA, 21 nt, Human
ucaguuggaaaugcagaaauc

SEQ ID NO: 1173373 - RNA, 23 nt, Human
uccaaccuggcgacagagcgaga

SEQ ID NO: 1173374 - RNA, 26 nt, Human
ucccagaggggcacccaccagaugcc

SEQ ID NO: 1173375 - RNA, 18 nt, Human
uccccaggugcucugucc

SEQ ID NO: 1173376 - RNA, 21 nt, Human
uccccguaccaagcuugagca

SEQ ID NO: 1173377 - RNA, 18 nt, Human
uccuccuuuuuguugaug

SEQ ID NO: 1173378 - RNA, 20 nt, Human
ucuaacagucaugcccuucu

SEQ ID NO: 1173379 - RNA, 21 nt, Human
ucucuacuaaaaacauaaaaa

SEQ ID NO: 1173380 - RNA, 20 nt, Human
ugaaacaccaucucuacuaa

SEQ ID NO: 1173381 - RNA, 21 nt, Human
ugaaacaccaucucuacuaaa

SEQ ID NO: 1173382 - RNA, 24 nt, Human
ugaaccugggagguggagguugca

SEQ ID NO: 1173383 - RNA, 19 nt, Human
ugaccucuuggacuucccu

SEQ ID NO: 1173384 - RNA, 24 nt, Human
ugagaccauccuggccaacauggu

SEQ ID NO: 1173385 - RNA, 22 nt, Human
ugagccgagaucacgccacugc

SEQ ID NO: 1173386 - RNA, 24 nt, Human
ugaggcagaagaauugcuugaacc

SEQ ID NO: 1173387 - RNA, 25 nt, Human
ugaggcagaagaauugcuugaaccu

SEQ ID NO: 1173388 - RNA, 24 nt, Human
ugaggcagguggaucacaagguca

SEQ ID NO: 1173389 - RNA, 22 nt, Human
ugaggugacaccccacccugcu

SEQ ID NO: 1173390 - RNA, 23 nt, Human
ugccuguaaucccagcacuuugg

SEQ ID NO: 1173391 - RNA, 24 nt, Human
ugccuguaaucccagcacuuuggg

SEQ ID NO: 1173392 - RNA, 24 nt, Human
ugccuguagucccagcuacucagg

SEQ ID NO: 1173393 - RNA, 22 nt, Human
ugcgcccacggccgccccuuuc

SEQ ID NO: 1173394 - RNA, 21 nt, Human
uggagguccacuacagacccu

SEQ ID NO: 1173395 - RNA, 24 nt, Human
uggcaugugccuguagucccagcu

SEQ ID NO: 1173396 - RNA, 18 nt, Human
uggccaacauggugaaac

SEQ ID NO: 1173397 - RNA, 22 nt, Human
uggcucaugccuguaaucccag

SEQ ID NO: 1173398 - RNA, 24 nt, Human
uggcucaugccuguaaucccagca

SEQ ID NO: 1173399 - RNA, 18 nt, Human
ugggaggcugaggcaggu

SEQ ID NO: 1173400 - RNA, 24 nt, Human
ugggaggcugaggcagguggauca

SEQ ID NO: 1173401 - RNA, 18 nt, Human
ugggagguggagguugca

SEQ ID NO: 1173402 - RNA, 24 nt, Human
ugggagguggagguugcagugagc

SEQ ID NO: 1173403 - RNA, 22 nt, Human
ugggaguuuuaucuauaggccc

SEQ ID NO: 1173404 - RNA, 24 nt, Human
ugguggcaugugccuguaguccca

SEQ ID NO: 1173405 - RNA, 19 nt, Human
ugugcuguggugggcucug

SEQ ID NO: 1173406 - RNA, 18 nt, Human
uguuugcuaguuuuccuu

SEQ ID NO: 1173407 - RNA, 23 nt, Human
uuaacacugaggggaaaaccgcu

SEQ ID NO: 1173408 - RNA, 19 nt, Human
uuagccgggcgugguggca

SEQ ID NO: 1173409 - RNA, 20 nt, Human
uuagccgggcgugguggcau

SEQ ID NO: 1173410 - RNA, 24 nt, Human
uuagccgggcgugguggcaugugc

SEQ ID NO: 1173411 - RNA, 24 nt, Human
uuccugguggcuuuaacacugagg

SEQ ID NO: 1173412 - RNA, 24 nt, Human
uugaaccugggagguggagguugc

SEQ ID NO: 1173413 - RNA, 18 nt, Human
uugcagugagccgagauc

SEQ ID NO: 1173414 - RNA, 20 nt, Human
uugcagugagccgagaucac

SEQ ID NO: 1173415 - RNA, 21 nt, Human
uugcagugagccgagaucacg

SEQ ID NO: 1173416 - RNA, 24 nt, Human
uugcugccugcuucuuccucugga

SEQ ID NO: 1173417 - RNA, 24 nt, Human
uugcugugcuguggugggcucugc

SEQ ID NO: 1173418 - RNA, 24 nt, Human
uugcuugaaccugggagguggagg

SEQ ID NO: 1173419 - RNA, 25 nt, Human
uugggaggcugaggcagguggauca

SEQ ID NO: 1173420 - RNA, 18 nt, Human
aaggacaccacagcaaac

SEQ ID NO: 1173421 - RNA, 23 nt, Human
aaggacaccacagcaaacccaaa

SEQ ID NO: 1173422 - RNA, 25 nt, Human
aaggacaccacagcaaacccaaagg

SEQ ID NO: 1173423 - RNA, 26 nt, Human
aaggacaccacagcaaacccaaaggc

SEQ ID NO: 1173424 - RNA, 20 nt, Human
ccacagcaaacccaaaggcc

SEQ ID NO: 1173425 - RNA, 19 nt, Human
ggagacaaggacaccacag

SEQ ID NO: 1173426 - RNA, 18 nt, Human
caagcugguccacagagu

SEQ ID NO: 1173427 - RNA, 23 nt, Human
cagaguagaaagugcaaugaaga

SEQ ID NO: 1173428 - RNA, 21 nt, Human
cccucaccgcgacggucggag

SEQ ID NO: 1173429 - RNA, 20 nt, Human
gccgugucugucugcuucug

SEQ ID NO: 1173430 - RNA, 21 nt, Human
gugcaaugaagauaggaaaga

SEQ ID NO: 1173431 - RNA, 21 nt, Human
uccacagaguagaaagugcaa

SEQ ID NO: 1173432 - RNA, 19 nt, Human
ugcuucuguccuggggccc

SEQ ID NO: 1173433 - RNA, 22 nt, Human
uguugggaccgcuaucuuugau

SEQ ID NO: 1173434 - RNA, 18 nt, Human
uguuuugucaucauuucc

SEQ ID NO: 1173435 - RNA, 21 nt, Human
aaugccacugcccugggcagc

SEQ ID NO: 1173436 - RNA, 25 nt, Human
accccaacaaaugaaaugagaagag

SEQ ID NO: 1173437 - RNA, 19 nt, Human
agagcagggcugacggggg

SEQ ID NO: 1173438 - RNA, 22 nt, Human
cccaacaaaugaaaugagaaga

SEQ ID NO: 1173439 - RNA, 19 nt, Human
ccccaacaaaugaaaugag

SEQ ID NO: 1173440 - RNA, 24 nt, Human
cccuaggucacgucugcaaaaccc

SEQ ID NO: 1173441 - RNA, 24 nt, Human
gcaaaaccccagcgcucaggggac

SEQ ID NO: 1173442 - RNA, 24 nt, Human
ggggacacagugcaaaugccacug

SEQ ID NO: 1173443 - RNA, 20 nt, Human
gggggagaaggggcugaggg

SEQ ID NO: 1173444 - RNA, 21 nt, Human
uaaauagugacagaaaugaga

SEQ ID NO: 1173445 - RNA, 19 nt, Human
ugagaagagcagggcugac

SEQ ID NO: 1173446 - RNA, 22 nt, Human
ugcccugggcagccguggagug

SEQ ID NO: 1173447 - RNA, 20 nt, Human
ugcugucaagcaccccgccc

SEQ ID NO: 1173448 - RNA, 26 nt, Human
uggaguucacauguuucccguacccg

SEQ ID NO: 1173449 - RNA, 25 nt, Human
uggaucacauguggugauuaaguuu

SEQ ID NO: 1173450 - RNA, 22 nt, Human
cuguguuguguccuaggcacug

SEQ ID NO: 1173451 - RNA, 21 nt, Human
uagagucuccucccgaaguuc

SEQ ID NO: 1173452 - RNA, 21 nt, Human
uuugcuagagucuccucccga

SEQ ID NO: 1173453 - RNA, 20 nt, Human
caccccagcaccacauucau

SEQ ID NO: 1173454 - RNA, 18 nt, Human
gaaggcgacuaauuuugc

SEQ ID NO: 1173455 - RNA, 22 nt, Human
gccauaaacaccccagcaccac

SEQ ID NO: 1173456 - RNA, 18 nt, Human
uggcuugccauaaacacc

SEQ ID NO: 1173457 - RNA, 24 nt, Human
ugucaaaguggcuugccauaaaca

SEQ ID NO: 1173458 - RNA, 24 nt, Human
uugaagcaguaagucagacaacau

SEQ ID NO: 1173459 - RNA, 21 nt, Human
uugguggcggcuccacugcag

SEQ ID NO: 1173460 - RNA, 23 nt, Human
aaaaaaaaaauucaggaugaaca

SEQ ID NO: 1173461 - RNA, 18 nt, Human
aaagaucaaaauuaaugc

SEQ ID NO: 1173462 - RNA, 19 nt, Human
aagaucaaaauuaaugcca

SEQ ID NO: 1173463 - RNA, 22 nt, Human
aagcaaccuggugucugagagc

SEQ ID NO: 1173464 - RNA, 21 nt, Human
aaugccaaaaaaaaaaauuca

SEQ ID NO: 1173465 - RNA, 24 nt, Human
acccacccaucguacuaucacaca

SEQ ID NO: 1173466 - RNA, 22 nt, Human
acucuguacccaguaaacaaua

SEQ ID NO: 1173467 - RNA, 18 nt, Human
acucuuugcugaucuuuu

SEQ ID NO: 1173468 - RNA, 19 nt, Human
acuuuuucuuaggcuauau

SEQ ID NO: 1173469 - RNA, 20 nt, Human
agaaugucauauagcuggaa

SEQ ID NO: 1173470 - RNA, 20 nt, Human
agacagccguggggccaugg

SEQ ID NO: 1173471 - RNA, 21 nt, Human
agacagggacgacaucuucag

SEQ ID NO: 1173472 - RNA, 20 nt, Human
agaguucccacauaucaccu

SEQ ID NO: 1173473 - RNA, 23 nt, Human
agaguucccacauaucaccuucc

SEQ ID NO: 1173474 - RNA, 21 nt, Human
agcauggagcucuguccucgg

SEQ ID NO: 1173475 - RNA, 19 nt, Human
aggggcugccggugcuggc

SEQ ID NO: 1173476 - RNA, 20 nt, Human
agguggugggugguguagau

SEQ ID NO: 1173477 - RNA, 18 nt, Human
aguaaacaauaacuccca

SEQ ID NO: 1173478 - RNA, 22 nt, Human
auucuugccuuuuccagaaugu

SEQ ID NO: 1173479 - RNA, 21 nt, Human
caaaauaccauuagugucugc

SEQ ID NO: 1173480 - RNA, 19 nt, Human
caaaauuaaugccaaaaaa

SEQ ID NO: 1173481 - RNA, 23 nt, Human
caacauaugcacagccuccccca

SEQ ID NO: 1173482 - RNA, 26 nt, Human
caagaagcaaccuggugucugagagc

SEQ ID NO: 1173483 - RNA, 22 nt, Human
cacaacauaaaguuagccgucu

SEQ ID NO: 1173484 - RNA, 18 nt, Human
caccuccaucuaccucca

SEQ ID NO: 1173485 - RNA, 20 nt, Human
cagaagguauagagaguucc

SEQ ID NO: 1173486 - RNA, 28 nt, Human
cagaucaugcaaauaaauaguuaaagag

SEQ ID NO: 1173487 - RNA, 20 nt, Human
cagcacaagcucccaucaca

SEQ ID NO: 1173488 - RNA, 20 nt, Human
ccacaggaaagaccaauacc

SEQ ID NO: 1173489 - RNA, 20 nt, Human
ccaccccuccccugcuggac

SEQ ID NO: 1173490 - RNA, 20 nt, Human
cccccaugucaacaucccca

SEQ ID NO: 1173491 - RNA, 18 nt, Human
ccguucgguggguuugga

SEQ ID NO: 1173492 - RNA, 23 nt, Human
ccucagaggcaacuucccucccu

SEQ ID NO: 1173493 - RNA, 19 nt, Human
ccuccaucuaccuccagaa

SEQ ID NO: 1173494 - RNA, 19 nt, Human
cggcuuccagcacaagcuc

SEQ ID NO: 1173495 - RNA, 23 nt, Human
cucccccaugucaacauccccaa

SEQ ID NO: 1173496 - RNA, 20 nt, Human
cuccgcacccaaagggugcc

SEQ ID NO: 1173497 - RNA, 21 nt, Human
cugaaacucuguacccaguaa

SEQ ID NO: 1173498 - RNA, 24 nt, Human
cugaaacucuguacccaguaaaca

SEQ ID NO: 1173499 - RNA, 19 nt, Human
cugcgcagacccugccaga

SEQ ID NO: 1173500 - RNA, 18 nt, Human
gaaauagcgcucagcuuu

SEQ ID NO: 1173501 - RNA, 21 nt, Human
gagcaccggaggcuggaaacg

SEQ ID NO: 1173502 - RNA, 24 nt, Human
gcaggugcucguucucuccuguaa

SEQ ID NO: 1173503 - RNA, 24 nt, Human
gcaguaaaacauacacaacauaaa

SEQ ID NO: 1173504 - RNA, 18 nt, Human
gccauggcuccccugaga

SEQ ID NO: 1173505 - RNA, 20 nt, Human
gcuccccugagaggugugug

SEQ ID NO: 1173506 - RNA, 25 nt, Human
ggcugccggugcuggcaggugcucg

SEQ ID NO: 1173507 - RNA, 24 nt, Human
uaaacaauaacucccaagauuaaa

SEQ ID NO: 1173508 - RNA, 20 nt, Human
uaagucggccgugaccgucu

SEQ ID NO: 1173509 - RNA, 22 nt, Human
uaaugccaaaaaaaaaaauuca

SEQ ID NO: 1173510 - RNA, 24 nt, Human
uacaguggugaagaugauccccac

SEQ ID NO: 1173511 - RNA, 24 nt, Human
uaccauuagugucugcccugucuu

SEQ ID NO: 1173512 - RNA, 22 nt, Human
uaggaucgaggggcugccggug

SEQ ID NO: 1173513 - RNA, 24 nt, Human
uaucacacagauguagucuccaca

SEQ ID NO: 1173514 - RNA, 22 nt, Human
uauugggcagaagguauagaga

SEQ ID NO: 1173515 - RNA, 23 nt, Human
ucauugcagugaauggaaagaaa

SEQ ID NO: 1173516 - RNA, 19 nt, Human
ucccaagauuaaaguuacu

SEQ ID NO: 1173517 - RNA, 21 nt, Human
ucccaccccuccccugcugga

SEQ ID NO: 1173518 - RNA, 23 nt, Human
uccucggcuuccagcacaagcuc

SEQ ID NO: 1173519 - RNA, 22 nt, Human
ucuauucuugccuuuuccagaa

SEQ ID NO: 1173520 - RNA, 20 nt, Human
ucucaagaagcaaccuggug

SEQ ID NO: 1173521 - RNA, 21 nt, Human
ucucguucccaccccuccccu

SEQ ID NO: 1173522 - RNA, 22 nt, Human
ucugagguuaggaucgaggggc

SEQ ID NO: 1173523 - RNA, 21 nt, Human
ucuguccucggcuuccagcac

SEQ ID NO: 1173524 - RNA, 24 nt, Human
ucuucagggggagacagccguggg

SEQ ID NO: 1173525 - RNA, 21 nt, Human
ugagagcaguuuuagguucgc

SEQ ID NO: 1173526 - RNA, 22 nt, Human
ugagccuucaccagcugagucu

SEQ ID NO: 1173527 - RNA, 21 nt, Human
ugcagugaauggaaagaaagg

SEQ ID NO: 1173528 - RNA, 22 nt, Human
ugcauaaugccauguacccacc

SEQ ID NO: 1173529 - RNA, 22 nt, Human
ugcccugucuucacacuucagc

SEQ ID NO: 1173530 - RNA, 19 nt, Human
ugcugccaacauuuugugc

SEQ ID NO: 1173531 - RNA, 21 nt, Human
ugcuggacguuucugggaagu

SEQ ID NO: 1173532 - RNA, 24 nt, Human
ugggaaguuucuagguggugggug

SEQ ID NO: 1173533 - RNA, 18 nt, Human
uggguuuggacaaaugca

SEQ ID NO: 1173534 - RNA, 22 nt, Human
ugguuucuuucacuuacucaua

SEQ ID NO: 1173535 - RNA, 19 nt, Human
uguacaguggugaagauga

SEQ ID NO: 1173536 - RNA, 18 nt, Human
ugugagcauuacggugag

SEQ ID NO: 1173537 - RNA, 19 nt, Human
uuaaugccaaaaaaaaaaa

SEQ ID NO: 1173538 - RNA, 18 nt, Human
uucaccuuccagaacuga

SEQ ID NO: 1173539 - RNA, 18 nt, Human
uucagggggagacagccg

SEQ ID NO: 1173540 - RNA, 19 nt, Human
uucaugggcuguugggggg

SEQ ID NO: 1173541 - RNA, 18 nt, Human
uuugagccugguacaggg

SEQ ID NO: 1173542 - RNA, 22 nt, Human
uuugucccuuuccgacuuauuu

SEQ ID NO: 1173543 - RNA, 23 nt, Human
aaacaccacaaaucuaccaucuu

SEQ ID NO: 1173544 - RNA, 24 nt, Human
aaagugcugggauuacaggcuuga

SEQ ID NO: 1173545 - RNA, 20 nt, Human
aaaguucugggauuacaggc

SEQ ID NO: 1173546 - RNA, 24 nt, Human
aaaguucugggauuacaggcguga

SEQ ID NO: 1173547 - RNA, 21 nt, Human
aacaccacaaaucuaccaucu

SEQ ID NO: 1173548 - RNA, 19 nt, Human
aacuguaacaugagguccc

SEQ ID NO: 1173549 - RNA, 19 nt, Human
aagaguuagagaucagccu

SEQ ID NO: 1173550 - RNA, 26 nt, Human
aagccacccccauuccuugacuuacc

SEQ ID NO: 1173551 - RNA, 25 nt, Human
aagcgauccucccaccucagccucc

SEQ ID NO: 1173552 - RNA, 18 nt, Human
aagugauucucugccucc

SEQ ID NO: 1173553 - RNA, 19 nt, Human
aagugauucucugccuccc

SEQ ID NO: 1173554 - RNA, 19 nt, Human
aagugcugggauuacaggc

SEQ ID NO: 1173555 - RNA, 19 nt, Human
aagugcugggauuacaggc

SEQ ID NO: 1173556 - RNA, 26 nt, Human
aagugcugggauuacaggcuugagcc

SEQ ID NO: 1173557 - RNA, 21 nt, Human
acagaaugugcuccuuugccu

SEQ ID NO: 1173558 - RNA, 21 nt, Human
acaggcacccaccaccacacc

SEQ ID NO: 1173559 - RNA, 24 nt, Human
acaggcgugagcaacuguaacaug

SEQ ID NO: 1173560 - RNA, 24 nt, Human
accaucuuggcuaggcuggucuug

SEQ ID NO: 1173561 - RNA, 23 nt, Human
accauguuggucaggcuggucug

SEQ ID NO: 1173562 - RNA, 26 nt, Human
accucgugacuccauauucaaggcca

SEQ ID NO: 1173563 - RNA, 19 nt, Human
accucgugauccacccucc

SEQ ID NO: 1173564 - RNA, 18 nt, Human
acucuccuaccuccuucu

SEQ ID NO: 1173565 - RNA, 22 nt, Human
agaggaaggauugcuugaggcc

SEQ ID NO: 1173566 - RNA, 20 nt, Human
agccaccgcaccuggcccca

SEQ ID NO: 1173567 - RNA, 21 nt, Human
agcugccagagaaagcaacca

SEQ ID NO: 1173568 - RNA, 22 nt, Human
agcugccagagaaagcaaccac

SEQ ID NO: 1173569 - RNA, 23 nt, Human
agcuggacauggugaugcaugcc

SEQ ID NO: 1173570 - RNA, 19 nt, Human
aggaggagggcuagcugcc

SEQ ID NO: 1173571 - RNA, 20 nt, Human
aggcuaaggugggaggauug

SEQ ID NO: 1173572 - RNA, 18 nt, Human
aggugucagaaggcugca

SEQ ID NO: 1173573 - RNA, 22 nt, Human
aguagagaugggguuucaccau

SEQ ID NO: 1173574 - RNA, 23 nt, Human
aguagcuggaauuauagggaugu

SEQ ID NO: 1173575 - RNA, 18 nt, Human
aguagcugggauuacagg

SEQ ID NO: 1173576 - RNA, 24 nt, Human
agugcugggauuacaggcuugagc

SEQ ID NO: 1173577 - RNA, 24 nt, Human
agugguccaugugccucagccuuc

SEQ ID NO: 1173578 - RNA, 18 nt, Human
aguucugggauuacaggc

SEQ ID NO: 1173579 - RNA, 20 nt, Human
augggguuucaccaucuugg

SEQ ID NO: 1173580 - RNA, 22 nt, Human
augggguuucaccaucuuggcu

SEQ ID NO: 1173581 - RNA, 24 nt, Human
augggguuucaccaucuuggcuag

SEQ ID NO: 1173582 - RNA, 24 nt, Human
augggguuucaccauguuggucag

SEQ ID NO: 1173583 - RNA, 19 nt, Human
auguugcccaggcuggucu

SEQ ID NO: 1173584 - RNA, 24 nt, Human
auguuuguauuuuuaguagagaug

SEQ ID NO: 1173585 - RNA, 24 nt, Human
caaacugcuaggauuacaggagug

SEQ ID NO: 1173586 - RNA, 24 nt, Human
caaagugcugggauuacaggcuug

SEQ ID NO: 1173587 - RNA, 21 nt, Human
caacauuuugggaggccaaag

SEQ ID NO: 1173588 - RNA, 23 nt, Human
caaccuccaccucccggguucaa

SEQ ID NO: 1173589 - RNA, 23 nt, Human
caacuaggucuauuaaggcuaaa

SEQ ID NO: 1173590 - RNA, 22 nt, Human
caagcaauucuccugccucggc

SEQ ID NO: 1173591 - RNA, 22 nt, Human
caagugguccaugugccucagc

SEQ ID NO: 1173592 - RNA, 21 nt, Human
caccaucuuggcuaggcuggu

SEQ ID NO: 1173593 - RNA, 24 nt, Human
caccaucuuggcuaggcuggucuu

SEQ ID NO: 1173594 - RNA, 21 nt, Human
caccauguuggucaggcuggu

SEQ ID NO: 1173595 - RNA, 22 nt, Human
caccauguuggucaggcugguc

SEQ ID NO: 1173596 - RNA, 18 nt, Human
cacccaccaccacaccug

SEQ ID NO: 1173597 - RNA, 24 nt, Human
caccucagccuccuaaaguucugg

SEQ ID NO: 1173598 - RNA, 21 nt, Human
cacuacaaccuccaccucccg

SEQ ID NO: 1173599 - RNA, 23 nt, Human
cacugcaaugucugccuuuuggg

SEQ ID NO: 1173600 - RNA, 21 nt, Human
cagcuucuagaagccaccccc

SEQ ID NO: 1173601 - RNA, 22 nt, Human
caguucugggggccagaagccc

SEQ ID NO: 1173602 - RNA, 22 nt, Human
caucuguaaucccaacauuuug

SEQ ID NO: 1173603 - RNA, 22 nt, Human
cauuauguugcccaggcugguc

SEQ ID NO: 1173604 - RNA, 19 nt, Human
ccaaagugcugggauuaca

SEQ ID NO: 1173605 - RNA, 20 nt, Human
ccaaagugcugggauuacag

SEQ ID NO: 1173606 - RNA, 22 nt, Human
ccaaagugcugggauuacaggc

SEQ ID NO: 1173607 - RNA, 23 nt, Human
ccaaagugcugggauuacaggcu

SEQ ID NO: 1173608 - RNA, 19 nt, Human
ccaacauuuugggaggcca

SEQ ID NO: 1173609 - RNA, 20 nt, Human
ccaccacaccuggcuaaugu

SEQ ID NO: 1173610 - RNA, 19 nt, Human
ccacccccauuccuugacu

SEQ ID NO: 1173611 - RNA, 18 nt, Human
ccaccgcaccuggcccca

SEQ ID NO: 1173612 - RNA, 26 nt, Human
ccaccucccggguucaagcaauucuu

SEQ ID NO: 1173613 - RNA, 24 nt, Human
cccaaagugcugggauuacaggcu

SEQ ID NO: 1173614 - RNA, 24 nt, Human
cccaacauuuugggaggccaaaga

SEQ ID NO: 1173615 - RNA, 19 nt, Human
cccgaguagcuggaauuau

SEQ ID NO: 1173616 - RNA, 23 nt, Human
cccgaguagcugggauuacaggc

SEQ ID NO: 1173617 - RNA, 24 nt, Human
cccgaguagcugggauuacaggca

SEQ ID NO: 1173618 - RNA, 23 nt, Human
cccggguucaagcaauucuccug

SEQ ID NO: 1173619 - RNA, 23 nt, Human
ccgaguagcugggauuacaggca

SEQ ID NO: 1173620 - RNA, 25 nt, Human
ccucaccugcugaacuccaggaggc

SEQ ID NO: 1173621 - RNA, 18 nt, Human
ccucccaccucagccucc

SEQ ID NO: 1173622 - RNA, 23 nt, Human
ccucccaccucagccuccuaaag

SEQ ID NO: 1173623 - RNA, 24 nt, Human
ccucccggguucaagcaauucucc

SEQ ID NO: 1173624 - RNA, 20 nt, Human
ccucggccucccaaagugcu

SEQ ID NO: 1173625 - RNA, 21 nt, Human
ccucgugauccacccuccucg

SEQ ID NO: 1173626 - RNA, 18 nt, Human
ccucucugaccucuucuu

SEQ ID NO: 1173627 - RNA, 23 nt, Human
ccugccucggccucccgaguagc

SEQ ID NO: 1173628 - RNA, 24 nt, Human
ccugccucggccucccgaguagcu

SEQ ID NO: 1173629 - RNA, 21 nt, Human
ccuuuuggguucaagugauuc

SEQ ID NO: 1173630 - RNA, 24 nt, Human
cuaaaguucugggauuacaggcgu

SEQ ID NO: 1173631 - RNA, 23 nt, Human
cuacaaccuccaccucccggguu

SEQ ID NO: 1173632 - RNA, 24 nt, Human
cuacaaccuccaccucccggguuc

SEQ ID NO: 1173633 - RNA, 23 nt, Human
cucaagugguccaugugccucag

SEQ ID NO: 1173634 - RNA, 19 nt, Human
cucaccugcugaacuccag

SEQ ID NO: 1173635 - RNA, 24 nt, Human
cucacuacaaccuccaccucccgg

SEQ ID NO: 1173636 - RNA, 25 nt, Human
cucacuacaaccuccaccucccggg

SEQ ID NO: 1173637 - RNA, 19 nt, Human
cucacugcaaugucugccu

SEQ ID NO: 1173638 - RNA, 25 nt, Human
cucagccuccuaaaguucugggauu

SEQ ID NO: 1173639 - RNA, 23 nt, Human
cuccugggcuuaagcgauccucc

SEQ ID NO: 1173640 - RNA, 19 nt, Human
cucugccucccgaguagcu

SEQ ID NO: 1173641 - RNA, 18 nt, Human
cucuuguagcccaggcug

SEQ ID NO: 1173642 - RNA, 19 nt, Human
cucuuguagcccaggcugg

SEQ ID NO: 1173643 - RNA, 22 nt, Human
cucuuguagcccaggcuggagu

SEQ ID NO: 1173644 - RNA, 23 nt, Human
cugccuuuuggguucaagugauu

SEQ ID NO: 1173645 - RNA, 23 nt, Human
cugggggccagaagcccaacuag

SEQ ID NO: 1173646 - RNA, 21 nt, Human
cuguaaucccaacauuuuggg

SEQ ID NO: 1173647 - RNA, 24 nt, Human
cuuaagcgauccucccaccucagc

SEQ ID NO: 1173648 - RNA, 22 nt, Human
cuucaaaucucccucucugacc

SEQ ID NO: 1173649 - RNA, 21 nt, Human
cuuccaaacugcuaggauuac

SEQ ID NO: 1173650 - RNA, 21 nt, Human
cuucuagaagccacccccauu

SEQ ID NO: 1173651 - RNA, 18 nt, Human
cuucugaccucgugaucc

SEQ ID NO: 1173652 - RNA, 21 nt, Human
cuugaccucaagugguccaug

SEQ ID NO: 1173653 - RNA, 21 nt, Human
cuugaggccaagaguuagaga

SEQ ID NO: 1173654 - RNA, 19 nt, Human
cuuguagcccaggcuggag

SEQ ID NO: 1173655 - RNA, 24 nt, Human
cuuguagcccaggcuggagugcaa

SEQ ID NO: 1173656 - RNA, 25 nt, Human
cuuucagccucaccugcugaacucc

SEQ ID NO: 1173657 - RNA, 24 nt, Human
gaaaugggguuucaccauguuggu

SEQ ID NO: 1173658 - RNA, 24 nt, Human
gaccucaagugguccaugugccuc

SEQ ID NO: 1173659 - RNA, 22 nt, Human
gaccucgugauccacccuccuc

SEQ ID NO: 1173660 - RNA, 22 nt, Human
gaccucgugauccacccuccuc

SEQ ID NO: 1173661 - RNA, 24 nt, Human
gaccucgugauccacccuccucgg

SEQ ID NO: 1173662 - RNA, 21 nt, Human
gaccucuucuuccauuaccac

SEQ ID NO: 1173663 - RNA, 18 nt, Human
gagaugggguuucaccau

SEQ ID NO: 1173664 - RNA, 24 nt, Human
gagaugggguuucaccaucuuggc

SEQ ID NO: 1173665 - RNA, 25 nt, Human
gaguagcugggauuacaggcaccca

SEQ ID NO: 1173666 - RNA, 18 nt, Human
gauuacaggagugagcca

SEQ ID NO: 1173667 - RNA, 21 nt, Human
gauuacaggcgugagcaacug

SEQ ID NO: 1173668 - RNA, 22 nt, Human
gauuacaggcgugagcaacugu

SEQ ID NO: 1173669 - RNA, 18 nt, Human
gauuacaggcuugagcca

SEQ ID NO: 1173670 - RNA, 19 nt, Human
gauuacaggcuugagccac

SEQ ID NO: 1173671 - RNA, 22 nt, Human
gauuacaggcuugagccacugc

SEQ ID NO: 1173672 - RNA, 23 nt, Human
gauugcuugaggccaagaguuag

SEQ ID NO: 1173673 - RNA, 19 nt, Human
gcaucaaacaccacaaauc

SEQ ID NO: 1173674 - RNA, 21 nt, Human
gccacaacgccuagcuaacug

SEQ ID NO: 1173675 - RNA, 19 nt, Human
gcccaggcuggagugcaau

SEQ ID NO: 1173676 - RNA, 23 nt, Human
gcccaggcuggagugcaauggca

SEQ ID NO: 1173677 - RNA, 21 nt, Human
gccucggccucccgaguagcu

SEQ ID NO: 1173678 - RNA, 23 nt, Human
gcuacaacaaaguacccuacauu

SEQ ID NO: 1173679 - RNA, 20 nt, Human
gcucacugcaaugucugccu

SEQ ID NO: 1173680 - RNA, 20 nt, Human
gcucuuguagcccaggcugg

SEQ ID NO: 1173681 - RNA, 24 nt, Human
gcucuuguagcccaggcuggagug

SEQ ID NO: 1173682 - RNA, 19 nt, Human
gcuggagugcaauggcaca

SEQ ID NO: 1173683 - RNA, 23 nt, Human
gcuggucugaaacucuugaccuc

SEQ ID NO: 1173684 - RNA, 22 nt, Human
ggaugcuguugagcuaacaggg

SEQ ID NO: 1173685 - RNA, 22 nt, Human
ggauuacaggagugagccaccg

SEQ ID NO: 1173686 - RNA, 21 nt, Human
ggccaaagaggaaggauugcu

SEQ ID NO: 1173687 - RNA, 24 nt, Human
ggcuggucuugaacuucugaccuc

SEQ ID NO: 1173688 - RNA, 21 nt, Human
gggaaaauaggaagacccugc

SEQ ID NO: 1173689 - RNA, 19 nt, Human
gggguuucaccaucuuggc

SEQ ID NO: 1173690 - RNA, 22 nt, Human
gggguuucaccauguuggucag

SEQ ID NO: 1173691 - RNA, 19 nt, Human
ggguucaagugauucucug

SEQ ID NO: 1173692 - RNA, 22 nt, Human
ggguuucaccaucuuggcuagg

SEQ ID NO: 1173693 - RNA, 20 nt, Human
ggucuugaacuucugaccuc

SEQ ID NO: 1173694 - RNA, 21 nt, Human
gucucggucgcccaggcugaa

SEQ ID NO: 1173695 - RNA, 24 nt, Human
gugauccacccuccucggccuccc

SEQ ID NO: 1173696 - RNA, 24 nt, Human
gugguccaugugccucagccuucc

SEQ ID NO: 1173697 - RNA, 22 nt, Human
guugcuacaacaaaguacccua

SEQ ID NO: 1173698 - RNA, 18 nt, Human
uaagcgauccucccaccu

SEQ ID NO: 1173699 - RNA, 27 nt, Human
uaagcgauccucccaccucagccuccu

SEQ ID NO: 1173700 - RNA, 21 nt, Human
uaagcuccugggcuuaagcga

SEQ ID NO: 1173701 - RNA, 18 nt, Human
uaaggugggaggauugcu

SEQ ID NO: 1173702 - RNA, 24 nt, Human
uaauguuuguauuuuuaguagaga

SEQ ID NO: 1173703 - RNA, 22 nt, Human
uacaggagugagccaccgcacc

SEQ ID NO: 1173704 - RNA, 22 nt, Human
uacaggagugagccaccgcacc

SEQ ID NO: 1173705 - RNA, 23 nt, Human
uacaggagugagccaccgcaccu

SEQ ID NO: 1173706 - RNA, 22 nt, Human
uacaggcuugagccacugcgcc

SEQ ID NO: 1173707 - RNA, 22 nt, Human
uagaaaugggguuucaccaugu

SEQ ID NO: 1173708 - RNA, 18 nt, Human
uagcccaggcuggagugc

SEQ ID NO: 1173709 - RNA, 22 nt, Human
uaggauuacaggagugagccac

SEQ ID NO: 1173710 - RNA, 23 nt, Human
uaggauuacaggagugagccacc

SEQ ID NO: 1173711 - RNA, 24 nt, Human
uaggauuacaggagugagccaccg

SEQ ID NO: 1173712 - RNA, 24 nt, Human
uaguagaaaugggguuucaccaug

SEQ ID NO: 1173713 - RNA, 26 nt, Human
uaguagaaaugggguuucaccauguu

SEQ ID NO: 1173714 - RNA, 19 nt, Human
uaguagagaugggguuuca

SEQ ID NO: 1173715 - RNA, 23 nt, Human
uaguagagaugggguuucaccau

SEQ ID NO: 1173716 - RNA, 26 nt, Human
uaguagagaugggguuucaccaucuu

SEQ ID NO: 1173717 - RNA, 23 nt, Human
uauguugcccaggcuggucuuaa

SEQ ID NO: 1173718 - RNA, 24 nt, Human
uauguugcccaggcuggucuuaag

SEQ ID NO: 1173719 - RNA, 24 nt, Human
ucacuacaaccuccaccucccggg

SEQ ID NO: 1173720 - RNA, 25 nt, Human
ucacuacaaccuccaccucccgggu

SEQ ID NO: 1173721 - RNA, 27 nt, Human
ucacuacaaccuccaccucccggguuc

SEQ ID NO: 1173722 - RNA, 24 nt, Human
ucacugcaaugucugccuuuuggg

SEQ ID NO: 1173723 - RNA, 27 nt, Human
ucacuuucucuaauucugacucuccua

SEQ ID NO: 1173724 - RNA, 21 nt, Human
uccacccuccucggccuccca

SEQ ID NO: 1173725 - RNA, 24 nt, Human
ucccaaagugcugggauuacaggc

SEQ ID NO: 1173726 - RNA, 24 nt, Human
ucccgaguagcugggauuacaggc

SEQ ID NO: 1173727 - RNA, 21 nt, Human
ucccggguucaagcaauucuc

SEQ ID NO: 1173728 - RNA, 24 nt, Human
ucccggguucaagcaauucuccug

SEQ ID NO: 1173729 - RNA, 25 nt, Human
ucccucucugaccucuucuuccauu

SEQ ID NO: 1173730 - RNA, 24 nt, Human
uccuaaaguucugggauuacaggc

SEQ ID NO: 1173731 - RNA, 21 nt, Human
uccugggcuuaagcgauccuc

SEQ ID NO: 1173732 - RNA, 24 nt, Human
uccugggcuuaagcgauccuccca

SEQ ID NO: 1173733 - RNA, 18 nt, Human
ucgcccaggcugaagugu

SEQ ID NO: 1173734 - RNA, 23 nt, Human
ucggccucccgaguagcuggaau

SEQ ID NO: 1173735 - RNA, 21 nt, Human
ucuagaagccacccccauucc

SEQ ID NO: 1173736 - RNA, 18 nt, Human
ucucauuauguugcccag

SEQ ID NO: 1173737 - RNA, 23 nt, Human
ucucauuauguugcccaggcugg

SEQ ID NO: 1173738 - RNA, 24 nt, Human
ucucauuauguugcccaggcuggu

SEQ ID NO: 1173739 - RNA, 23 nt, Human
ucuccuaccuccuucucuuauaa

SEQ ID NO: 1173740 - RNA, 19 nt, Human
ucucggucgcccaggcuga

SEQ ID NO: 1173741 - RNA, 22 nt, Human
ucucuaauucugacucuccuac

SEQ ID NO: 1173742 - RNA, 18 nt, Human
ucucugaccucuucuucc

SEQ ID NO: 1173743 - RNA, 19 nt, Human
ucucuuauaaagauccuug

SEQ ID NO: 1173744 - RNA, 18 nt, Human
ucuuguagcccaggcugg

SEQ ID NO: 1173745 - RNA, 24 nt, Human
ugaccucaagugguccaugugccu

SEQ ID NO: 1173746 - RNA, 20 nt, Human
ugaggcuuggaacuuucagc

SEQ ID NO: 1173747 - RNA, 24 nt, Human
ugaggucucauuauguugcccagg

SEQ ID NO: 1173748 - RNA, 18 nt, Human
ugaugcaugccuguaguu

SEQ ID NO: 1173749 - RNA, 24 nt, Human
ugcccaggcuggucuuaagcuccu

SEQ ID NO: 1173750 - RNA, 28 nt, Human
ugcccaggcuggucuuaagcuccugggc

SEQ ID NO: 1173751 - RNA, 18 nt, Human
ugccucagccuuccaaac

SEQ ID NO: 1173752 - RNA, 24 nt, Human
ugccucagccuuccaaacugcuag

SEQ ID NO: 1173753 - RNA, 19 nt, Human
ugccucggccucccgagua

SEQ ID NO: 1173754 - RNA, 21 nt, Human
ugccucggccucccgaguagc

SEQ ID NO: 1173755 - RNA, 24 nt, Human
ugccucggccucccgaguagcugg

SEQ ID NO: 1173756 - RNA, 22 nt, Human
ugccuguaguuccagcuacugg

SEQ ID NO: 1173757 - RNA, 21 nt, Human
uggaauuauagggaugugcca

SEQ ID NO: 1173758 - RNA, 22 nt, Human
uggaauuauagggaugugccac

SEQ ID NO: 1173759 - RNA, 23 nt, Human
uggagugcaauggcacaaucuca

SEQ ID NO: 1173760 - RNA, 24 nt, Human
uggagugcaauggcacaaucucag

SEQ ID NO: 1173761 - RNA, 24 nt, Human
uggcacaaucucagcucacuacaa

SEQ ID NO: 1173762 - RNA, 24 nt, Human
uggcuaggcuggucuugaacuucu

SEQ ID NO: 1173763 - RNA, 22 nt, Human
ugggaggccaaagaggaaggau

SEQ ID NO: 1173764 - RNA, 19 nt, Human
ugggauuacaggcacccac

SEQ ID NO: 1173765 - RNA, 21 nt, Human
ugggauuacaggcacccacca

SEQ ID NO: 1173766 - RNA, 24 nt, Human
ugggauuacaggcacccaccacca

SEQ ID NO: 1173767 - RNA, 18 nt, Human
ugggauuacaggcgugag

SEQ ID NO: 1173768 - RNA, 19 nt, Human
ugggauuacaggcgugagc

SEQ ID NO: 1173769 - RNA, 19 nt, Human
ugggauuacaggcgugagc

SEQ ID NO: 1173770 - RNA, 20 nt, Human
ugggauuacaggcgugagca

SEQ ID NO: 1173771 - RNA, 22 nt, Human
ugggauuacaggcgugagcaac

SEQ ID NO: 1173772 - RNA, 23 nt, Human
ugggauuacaggcgugagcaacu

SEQ ID NO: 1173773 - RNA, 24 nt, Human
ugggauuacaggcgugagcaacug

SEQ ID NO: 1173774 - RNA, 27 nt, Human
ugggauuacaggcgugagcaacuguaa

SEQ ID NO: 1173775 - RNA, 19 nt, Human
ugggauuacaggcuugagc

SEQ ID NO: 1173776 - RNA, 21 nt, Human
ugggauuacaggcuugagcca

SEQ ID NO: 1173777 - RNA, 22 nt, Human
ugggauuacaggcuugagccac

SEQ ID NO: 1173778 - RNA, 22 nt, Human
ugggauuacaggcuugagccac

SEQ ID NO: 1173779 - RNA, 24 nt, Human
ugggauuacaggcuugagccacug

SEQ ID NO: 1173780 - RNA, 24 nt, Human
ugggauuacaggcuugagccacug

SEQ ID NO: 1173781 - RNA, 24 nt, Human
ugggggcucccaucuguaauccca

SEQ ID NO: 1173782 - RNA, 24 nt, Human
ugggguuucaccaucuuggcuagg

SEQ ID NO: 1173783 - RNA, 24 nt, Human
ugggguuucaccauguuggucagg

SEQ ID NO: 1173784 - RNA, 18 nt, Human
uggguucaagugauucuc

SEQ ID NO: 1173785 - RNA, 20 nt, Human
uggguucaagugauucucuu

SEQ ID NO: 1173786 - RNA, 24 nt, Human
uggucaggcuggucugaaacucuu

SEQ ID NO: 1173787 - RNA, 20 nt, Human
ugguccaugugccucagccu

SEQ ID NO: 1173788 - RNA, 23 nt, Human
uggugaugcaugccuguaguucc

SEQ ID NO: 1173789 - RNA, 24 nt, Human
uggugaugcaugccuguaguucca

SEQ ID NO: 1173790 - RNA, 21 nt, Human
ugugauugguggguauggggg

SEQ ID NO: 1173791 - RNA, 21 nt, Human
uguuuguauuuuuaguagaga

SEQ ID NO: 1173792 - RNA, 18 nt, Human
uuaaggcuaaagucaagg

SEQ ID NO: 1173793 - RNA, 18 nt, Human
uuaguagaaaugggguuu

SEQ ID NO: 1173794 - RNA, 22 nt, Human
uuaguagaaaugggguuucacc

SEQ ID NO: 1173795 - RNA, 24 nt, Human
uuaguagaaaugggguuucaccau

SEQ ID NO: 1173796 - RNA, 18 nt, Human
uuaguagagaugggguuu

SEQ ID NO: 1173797 - RNA, 22 nt, Human
uuaguagagaugggguuucacc

SEQ ID NO: 1173798 - RNA, 24 nt, Human
uuaguagagaugggguuucaccau

SEQ ID NO: 1173799 - RNA, 21 nt, Human
uucaagcaauucuccugccuc

SEQ ID NO: 1173800 - RNA, 24 nt, Human
uucaagcaauucuccugccucggc

SEQ ID NO: 1173801 - RNA, 22 nt, Human
uucaggaggagggcuagcugcc

SEQ ID NO: 1173802 - RNA, 23 nt, Human
uuguauuuuuaguagagaugggg

SEQ ID NO: 1173803 - RNA, 19 nt, Human
uuuaaaacggaguuuggcu

SEQ ID NO: 1173804 - RNA, 24 nt, Human
uuucaccaucuuggcuaggcuggu

SEQ ID NO: 1173805 - RNA, 24 nt, Human
uuucaccauguuggucaggcuggu

SEQ ID NO: 1173806 - RNA, 22 nt, Human
uuugccuuuuccagcuucuaga

SEQ ID NO: 1173807 - RNA, 24 nt, Human
uuuggcucuuguagcccaggcugg

SEQ ID NO: 1173808 - RNA, 18 nt, Human
uuuguauuuuuaguagag

SEQ ID NO: 1173809 - RNA, 24 nt, Human
uuuuuaguagaaaugggguuucac

SEQ ID NO: 1173810 - RNA, 24 nt, Human
uuuuuaguagagaugggguuucac

SEQ ID NO: 1173811 - RNA, 24 nt, Human
uuuuuuuuuuaaaacggaguuugg

SEQ ID NO: 1173812 - RNA, 22 nt, Human
aaauggcaaugaagaucuggag

SEQ ID NO: 1173813 - RNA, 26 nt, Human
acccuagaacagcugagccagaaagc

SEQ ID NO: 1173814 - RNA, 18 nt, Human
acgcuguccacugcagcc

SEQ ID NO: 1173815 - RNA, 21 nt, Human
agaaagcaguuguuugcauug

SEQ ID NO: 1173816 - RNA, 21 nt, Human
agcucaagcucccagcagcag

SEQ ID NO: 1173817 - RNA, 28 nt, Human
augaagaucuggagaaaggugcuucucu

SEQ ID NO: 1173818 - RNA, 23 nt, Human
augggacuggucagcacugggac

SEQ ID NO: 1173819 - RNA, 23 nt, Human
auuuuggguuuggagcugugugu

SEQ ID NO: 1173820 - RNA, 23 nt, Human
cacccuagaacagcugagccaga

SEQ ID NO: 1173821 - RNA, 24 nt, Human
cacgucagaagugggcugccuccu

SEQ ID NO: 1173822 - RNA, 19 nt, Human
cagcacugggacugguccg

SEQ ID NO: 1173823 - RNA, 19 nt, Human
cauuguggguugauccagu

SEQ ID NO: 1173824 - RNA, 22 nt, Human
cgcagcucagcuucaucgcagc

SEQ ID NO: 1173825 - RNA, 24 nt, Human
cugcagccuguuaacugaaggaca

SEQ ID NO: 1173826 - RNA, 24 nt, Human
cuucucuguagaaagcugugucug

SEQ ID NO: 1173827 - RNA, 22 nt, Human
gagcuguguguccaaaauggca

SEQ ID NO: 1173828 - RNA, 21 nt, Human
gucagaagugggcugccuccu

SEQ ID NO: 1173829 - RNA, 21 nt, Human
uagaacagcugagccagaaag

SEQ ID NO: 1173830 - RNA, 18 nt, Human
uccaaaauggcaaugaag

SEQ ID NO: 1173831 - RNA, 22 nt, Human
uccacccaccacacgcugucca

SEQ ID NO: 1173832 - RNA, 18 nt, Human
ucucaucugccgucuucc

SEQ ID NO: 1173833 - RNA, 23 nt, Human
ucugccgucuuccuccacccccc

SEQ ID NO: 1173834 - RNA, 18 nt, Human
uggcaaugaagaucugga

SEQ ID NO: 1173835 - RNA, 20 nt, Human
uguccaaaauggcaaugaag

SEQ ID NO: 1173836 - RNA, 23 nt, Human
uugcauuguggguugauccagug

SEQ ID NO: 1173837 - RNA, 23 nt, Human
uuguggguugauccaguggacac

SEQ ID NO: 1173838 - RNA, 21 nt, Human
auccuggcugaguucuuccca

SEQ ID NO: 1173839 - RNA, 23 nt, Human
cagagaaucacccuggcaggagc

SEQ ID NO: 1173840 - RNA, 18 nt, Human
ccuggcaggagcguggaa

SEQ ID NO: 1173841 - RNA, 19 nt, Human
ccuggcugaguucuuccca

SEQ ID NO: 1173842 - RNA, 18 nt, Human
ccuuggucugugggccug

SEQ ID NO: 1173843 - RNA, 21 nt, Human
cugaggcgaugcagcucuccc

SEQ ID NO: 1173844 - RNA, 23 nt, Human
cugcgggaggggccgggggagcg

SEQ ID NO: 1173845 - RNA, 19 nt, Human
cugugggccuggcugaggc

SEQ ID NO: 1173846 - RNA, 18 nt, Human
gagaaucacccuggcagg

SEQ ID NO: 1173847 - RNA, 18 nt, Human
gcaaaugaagaaaugcua

SEQ ID NO: 1173848 - RNA, 19 nt, Human
gccuuggucugugggccug

SEQ ID NO: 1173849 - RNA, 19 nt, Human
gcugcgcucuuggucggcc

SEQ ID NO: 1173850 - RNA, 22 nt, Human
gggaacugcugcgggaggggcc

SEQ ID NO: 1173851 - RNA, 24 nt, Human
gggaggggccgggggagcggcugc

SEQ ID NO: 1173852 - RNA, 19 nt, Human
gugaggcagaagaacuaag

SEQ ID NO: 1173853 - RNA, 20 nt, Human
ucccaggagcagagaaucac

SEQ ID NO: 1173854 - RNA, 22 nt, Human
ugcagcucucccaggagcagag

SEQ ID NO: 1173855 - RNA, 20 nt, Human
ugccuuggucugugggccug

SEQ ID NO: 1173856 - RNA, 22 nt, Human
ugccuuggucugugggccuggc

SEQ ID NO: 1173857 - RNA, 22 nt, Human
uggcaggagcguggaauccugg

SEQ ID NO: 1173858 - RNA, 23 nt, Human
uggcugaggcgaugcagcucucc

SEQ ID NO: 1173859 - RNA, 18 nt, Human
ugugggccuggcugaggc

SEQ ID NO: 1173860 - RNA, 21 nt, Human
uguugaauuuucuuguucauu

SEQ ID NO: 1173861 - RNA, 23 nt, Human
uuagugacauuucugcaacuguu

SEQ ID NO: 1173862 - RNA, 20 nt, Human
uucgaucuaugauuuaugca

SEQ ID NO: 1173863 - RNA, 20 nt, Human
uuucuuguucauucgaucua

SEQ ID NO: 1173864 - RNA, 21 nt, Human
aacagaaaagaggggggcgag

SEQ ID NO: 1173865 - RNA, 22 nt, Human
aacagaaaagaggggggcgagg

SEQ ID NO: 1173866 - RNA, 18 nt, Human
agaguaaaaucgaagauc

SEQ ID NO: 1173867 - RNA, 24 nt, Human
caacaaacugggucacugaaaacc

SEQ ID NO: 1173868 - RNA, 23 nt, Human
caauuacagaguaaaaucgaaga

SEQ ID NO: 1173869 - RNA, 21 nt, Human
cacaguucagcugugccgucc

SEQ ID NO: 1173870 - RNA, 23 nt, Human
cacccccccccccgcccccggac

SEQ ID NO: 1173871 - RNA, 21 nt, Human
cacgugguccagacagacggc

SEQ ID NO: 1173872 - RNA, 25 nt, Human
cagcgacaagggcggcgccccccac

SEQ ID NO: 1173873 - RNA, 23 nt, Human
cccacagcgaagucacucugaag

SEQ ID NO: 1173874 - RNA, 23 nt, Human
ccccaaaacaauuacagaguaaa

SEQ ID NO: 1173875 - RNA, 21 nt, Human
ccccacccgccugcgcucccc

SEQ ID NO: 1173876 - RNA, 19 nt, Human
ccccccgcccccggaccag

SEQ ID NO: 1173877 - RNA, 18 nt, Human
ccccgcccccggaccagg

SEQ ID NO: 1173878 - RNA, 20 nt, Human
cccgccugcgcucccggaag

SEQ ID NO: 1173879 - RNA, 21 nt, Human
ccgccugaagaaacugggcuc

SEQ ID NO: 1173880 - RNA, 21 nt, Human
ccuucuguugccugccgcagc

SEQ ID NO: 1173881 - RNA, 22 nt, Human
ccuuuccucuucugcuuaugcc

SEQ ID NO: 1173882 - RNA, 23 nt, Human
cgaggcggaguccugaaggcuuu

SEQ ID NO: 1173883 - RNA, 20 nt, Human
cgagucugucagcgcugccu

SEQ ID NO: 1173884 - RNA, 20 nt, Human
cgccugaagaaacugggcuc

SEQ ID NO: 1173885 - RNA, 21 nt, Human
cgcuccuucccuguggggcag

SEQ ID NO: 1173886 - RNA, 20 nt, Human
cgcuggccugcgcuucugcc

SEQ ID NO: 1173887 - RNA, 19 nt, Human
cuccuucccuguggggcag

SEQ ID NO: 1173888 - RNA, 21 nt, Human
cugaagaaacugggcucuguc

SEQ ID NO: 1173889 - RNA, 22 nt, Human
cuggccugcgcuucugcuucua

SEQ ID NO: 1173890 - RNA, 22 nt, Human
gaacagaaaagaggggggcgag

SEQ ID NO: 1173891 - RNA, 19 nt, Human
gaccagguggguugcgccc

SEQ ID NO: 1173892 - RNA, 20 nt, Human
gcgggagaaccaggcagggg

SEQ ID NO: 1173893 - RNA, 22 nt, Human
ggaaguuuauuccucacccccc

SEQ ID NO: 1173894 - RNA, 25 nt, Human
ggcgccccccacccgccugcgcucc

SEQ ID NO: 1173895 - RNA, 22 nt, Human
gggcgaggcggaguccugaagg

SEQ ID NO: 1173896 - RNA, 20 nt, Human
ggggcagagcuggcuggagc

SEQ ID NO: 1173897 - RNA, 23 nt, Human
ucagcugugccguccccagcgcu

SEQ ID NO: 1173898 - RNA, 19 nt, Human
uccggacagcgacaagggg

SEQ ID NO: 1173899 - RNA, 22 nt, Human
uccucacccccccccccgcccc

SEQ ID NO: 1173900 - RNA, 20 nt, Human
uccuccgcuccggggagggg

SEQ ID NO: 1173901 - RNA, 24 nt, Human
ucgcugccagcacaguucagcugu

SEQ ID NO: 1173902 - RNA, 18 nt, Human
ucuaggcggcucugaccu

SEQ ID NO: 1173903 - RNA, 22 nt, Human
ucuccgaacagaaaagaggggg

SEQ ID NO: 1173904 - RNA, 19 nt, Human
ucugucagcgcugccugcg

SEQ ID NO: 1173905 - RNA, 21 nt, Human
ucuguccuccgcuccggggag

SEQ ID NO: 1173906 - RNA, 18 nt, Human
ugaagaaacugggcucug

SEQ ID NO: 1173907 - RNA, 22 nt, Human
ugaagagcaucucgcuggccug

SEQ ID NO: 1173908 - RNA, 21 nt, Human
ugcggugccuguagcuggugu

SEQ ID NO: 1173909 - RNA, 21 nt, Human
uggggcagagcuggcuggagc

SEQ ID NO: 1173910 - RNA, 26 nt, Human
uuuauuccucacccccccccccgccc

SEQ ID NO: 1173911 - RNA, 20 nt, Human
aacaguggcgcgugucagaa

SEQ ID NO: 1173912 - RNA, 22 nt, Human
aagaaauagaguuaauucuuuu

SEQ ID NO: 1173913 - RNA, 27 nt, Human
accaugaaaacaugguauucuaggaau

SEQ ID NO: 1173914 - RNA, 21 nt, Human
agacacuggcaucugccugcc

SEQ ID NO: 1173915 - RNA, 20 nt, Human
agagagcagacacuggcauc

SEQ ID NO: 1173916 - RNA, 20 nt, Human
aggcaguucacauauggaug

SEQ ID NO: 1173917 - RNA, 21 nt, Human
aggugucagacacacugagcu

SEQ ID NO: 1173918 - RNA, 21 nt, Human
agugaaucugggcuauaucuu

SEQ ID NO: 1173919 - RNA, 21 nt, Human
aucaaugucauaacuauucug

SEQ ID NO: 1173920 - RNA, 25 nt, Human
aucuucuuuaagcucauagaggcug

SEQ ID NO: 1173921 - RNA, 20 nt, Human
auggagggccuuguaccgcc

SEQ ID NO: 1173922 - RNA, 21 nt, Human
cacagaucuauauucuaauuc

SEQ ID NO: 1173923 - RNA, 22 nt, Human
cacaucaaucacucugacaucc

SEQ ID NO: 1173924 - RNA, 23 nt, Human
cagaagucccucccgcgcggccu

SEQ ID NO: 1173925 - RNA, 21 nt, Human
cagggucucucauagggucuu

SEQ ID NO: 1173926 - RNA, 24 nt, Human
caguuuuuguggaucaggagucca

SEQ ID NO: 1173927 - RNA, 18 nt, Human
cauccaaucucucuccag

SEQ ID NO: 1173928 - RNA, 25 nt, Human
cauccaaucucucuccaguccuaug

SEQ ID NO: 1173929 - RNA, 22 nt, Human
caucugccugccugggagugaa

SEQ ID NO: 1173930 - RNA, 20 nt, Human
ccaaucucucuccaguccua

SEQ ID NO: 1173931 - RNA, 20 nt, Human
cccuguuugaaaacaaaaac

SEQ ID NO: 1173932 - RNA, 25 nt, Human
cgcggccucuucccccucuuccucc

SEQ ID NO: 1173933 - RNA, 20 nt, Human
cuaauaccucaauuuucuua

SEQ ID NO: 1173934 - RNA, 24 nt, Human
cucuccaguccuaugauggagucc

SEQ ID NO: 1173935 - RNA, 19 nt, Human
cugacuaugaaaggaaaac

SEQ ID NO: 1173936 - RNA, 24 nt, Human
cugcagucaaggugucagacacac

SEQ ID NO: 1173937 - RNA, 23 nt, Human
cuggaaguugcccauguguucaa

SEQ ID NO: 1173938 - RNA, 21 nt, Human
gaagucccucccgcgcggccu

SEQ ID NO: 1173939 - RNA, 20 nt, Human
ggagggccuuguaccgccug

SEQ ID NO: 1173940 - RNA, 18 nt, Human
ucccccucuuccuccgca

SEQ ID NO: 1173941 - RNA, 23 nt, Human
ucccuaggcaaccaacuuaacuu

SEQ ID NO: 1173942 - RNA, 23 nt, Human
ucuagcaaggauugagugucuuc

SEQ ID NO: 1173943 - RNA, 18 nt, Human
ucugcucaggaccuccca

SEQ ID NO: 1173944 - RNA, 19 nt, Human
ugaaaacaaaaacaguggc

SEQ ID NO: 1173945 - RNA, 19 nt, Human
ugaaaacaaaaacaguggc

SEQ ID NO: 1173946 - RNA, 23 nt, Human
ugagguuauaggacuaaaguccc

SEQ ID NO: 1173947 - RNA, 21 nt, Human
ugccugggagugaaucugggc

SEQ ID NO: 1173948 - RNA, 23 nt, Human
ugcucaggaccucccaagccugc

SEQ ID NO: 1173949 - RNA, 27 nt, Human
ugcucaguaaaugcuagaugcuaguag

SEQ ID NO: 1173950 - RNA, 21 nt, Human
uggacaauaaaacuaucugcu

SEQ ID NO: 1173951 - RNA, 19 nt, Human
ugggguccucuuccaagcu

SEQ ID NO: 1173952 - RNA, 22 nt, Human
ugucagacacacugagcuucuu

SEQ ID NO: 1173953 - RNA, 21 nt, Human
ugucuucagcuucacagaucu

SEQ ID NO: 1173954 - RNA, 19 nt, Human
uguggaucaggaguccagg

SEQ ID NO: 1173955 - RNA, 22 nt, Human
uuccaagcuucucagaugguuc

SEQ ID NO: 1173956 - RNA, 19 nt, Human
uuugccuucuuccaguagg

SEQ ID NO: 1173957 - RNA, 19 nt, Human
aagacccccagagugaagc

SEQ ID NO: 1173958 - RNA, 22 nt, Human
aagcagcagacagaacccagga

SEQ ID NO: 1173959 - RNA, 19 nt, Human
acccccagagugaagcagc

SEQ ID NO: 1173960 - RNA, 18 nt, Human
acgugcugccaagucugg

SEQ ID NO: 1173961 - RNA, 21 nt, Human
acuuguacuuccaaggggaca

SEQ ID NO: 1173962 - RNA, 18 nt, Human
agaacucucuagaacgca

SEQ ID NO: 1173963 - RNA, 26 nt, Human
agacagaacccaggaccuucucugca

SEQ ID NO: 1173964 - RNA, 20 nt, Human
aggaccuucucugcacucac

SEQ ID NO: 1173965 - RNA, 23 nt, Human
aggagcauggacgggccugagcc

SEQ ID NO: 1173966 - RNA, 19 nt, Human
caacaugaagagcuguaca

SEQ ID NO: 1173967 - RNA, 26 nt, Human
caccccggacucuggugccauggccu

SEQ ID NO: 1173968 - RNA, 25 nt, Human
cagcagacagaacccaggaccuucu

SEQ ID NO: 1173969 - RNA, 22 nt, Human
caugcccacuucccacauggga

SEQ ID NO: 1173970 - RNA, 18 nt, Human
ccaagucuggucucugcc

SEQ ID NO: 1173971 - RNA, 25 nt, Human
ccaccgcagcccacaguuucuaugu

SEQ ID NO: 1173972 - RNA, 21 nt, Human
ccagagccaccgcagcccaca

SEQ ID NO: 1173973 - RNA, 23 nt, Human
ccagagugaagcagcagacagaa

SEQ ID NO: 1173974 - RNA, 19 nt, Human
ccagcuccagagccaccgg

SEQ ID NO: 1173975 - RNA, 19 nt, Human
ccaggaccuucucugcacu

SEQ ID NO: 1173976 - RNA, 22 nt, Human
ccaggcacgaaaaugaagaagg

SEQ ID NO: 1173977 - RNA, 19 nt, Human
ccccgcacgaggcccugcc

SEQ ID NO: 1173978 - RNA, 23 nt, Human
ccucagggcugugcagccucacc

SEQ ID NO: 1173979 - RNA, 19 nt, Human
ccugccggagucucugcca

SEQ ID NO: 1173980 - RNA, 20 nt, Human
cuccagagccaccgcagccc

SEQ ID NO: 1173981 - RNA, 22 nt, Human
cuccagagccaccgcagcccac

SEQ ID NO: 1173982 - RNA, 23 nt, Human
cuccaggcacgaaaaugaagaag

SEQ ID NO: 1173983 - RNA, 23 nt, Human
cucccggcccccgcacgaggccc

SEQ ID NO: 1173984 - RNA, 18 nt, Human
cucugagaaauggagaag

SEQ ID NO: 1173985 - RNA, 19 nt, Human
cuguguggguuuagugugu

SEQ ID NO: 1173986 - RNA, 22 nt, Human
gaagcagcagacagaacccagg

SEQ ID NO: 1173987 - RNA, 22 nt, Human
gaaggcgcugcucccggccccc

SEQ ID NO: 1173988 - RNA, 22 nt, Human
gaaugugccuguguggguuuag

SEQ ID NO: 1173989 - RNA, 20 nt, Human
gagcauggacgggccugagc

SEQ ID NO: 1173990 - RNA, 19 nt, Human
ggcacgaaaaugaagaagg

SEQ ID NO: 1173991 - RNA, 18 nt, Human
gguucugggcucucucag

SEQ ID NO: 1173992 - RNA, 24 nt, Human
gucggggccuagcagcuuccucag

SEQ ID NO: 1173993 - RNA, 21 nt, Human
guggaaugcagcuccuuguca

SEQ ID NO: 1173994 - RNA, 22 nt, Human
uaccucugagaaauggagaaga

SEQ ID NO: 1173995 - RNA, 18 nt, Human
ugaagcgucguuuccuaa

SEQ ID NO: 1173996 - RNA, 20 nt, Human
ugaagcgucguuuccuaaaa

SEQ ID NO: 1173997 - RNA, 20 nt, Human
uggaaugugccugugugggu

SEQ ID NO: 1173998 - RNA, 20 nt, Human
uggaaugugccugugugggu

SEQ ID NO: 1173999 - RNA, 18 nt, Human
ugggcucucucaggucca

SEQ ID NO: 1174000 - RNA, 24 nt, Human
uucugcugcuacugggguucuggg

SEQ ID NO: 1174001 - RNA, 23 nt, Human
aagaaaacguccugugagaggcc

SEQ ID NO: 1174002 - RNA, 21 nt, Human
aaucuugccucucagucccac

SEQ ID NO: 1174003 - RNA, 19 nt, Human
acagggucaugguggacac

SEQ ID NO: 1174004 - RNA, 21 nt, Human
agaaagagaagucaggguucu

SEQ ID NO: 1174005 - RNA, 19 nt, Human
agaggccaggaagguagca

SEQ ID NO: 1174006 - RNA, 20 nt, Human
agggucaugguggacacggg

SEQ ID NO: 1174007 - RNA, 22 nt, Human
augaacaaaucuugccucucag

SEQ ID NO: 1174008 - RNA, 24 nt, Human
caaaucuugccucucagucccaca

SEQ ID NO: 1174009 - RNA, 21 nt, Human
caugaacaaaucuugccucuc

SEQ ID NO: 1174010 - RNA, 24 nt, Human
ccccaccaccucacauuaugccua

SEQ ID NO: 1174011 - RNA, 23 nt, Human
cucacauuaugccuauagggaca

SEQ ID NO: 1174012 - RNA, 20 nt, Human
cucagucccacacaaggcag

SEQ ID NO: 1174013 - RNA, 21 nt, Human
gaacagggucaugguggacac

SEQ ID NO: 1174014 - RNA, 19 nt, Human
gggaaggaauguaggucag

SEQ ID NO: 1174015 - RNA, 23 nt, Human
gucaggguucuugaagucacaaa

SEQ ID NO: 1174016 - RNA, 22 nt, Human
ugaacaaaucuugccucucagu

SEQ ID NO: 1174017 - RNA, 23 nt, Human
ugagaggccaggaagguagcagg

SEQ ID NO: 1174018 - RNA, 23 nt, Human
ugugagaggccaggaagguagca

SEQ ID NO: 1174019 - RNA, 24 nt, Human
uguggggaacagggucauggugga

SEQ ID NO: 1174020 - RNA, 21 nt, Human
aaggccugggccgccaggaag

SEQ ID NO: 1174021 - RNA, 18 nt, Human
accccagcaccuuggucc

SEQ ID NO: 1174022 - RNA, 21 nt, Human
accccccagcaggccagggag

SEQ ID NO: 1174023 - RNA, 23 nt, Human
acccggaaccccccagcaggcca

SEQ ID NO: 1174024 - RNA, 19 nt, Human
ccagggaggcaaggccugg

SEQ ID NO: 1174025 - RNA, 19 nt, Human
ccgccaggaagccaugcuu

SEQ ID NO: 1174026 - RNA, 23 nt, Human
cgggaucccccagucaucacugg

SEQ ID NO: 1174027 - RNA, 22 nt, Human
cuucuggagacccggaaccccc

SEQ ID NO: 1174028 - RNA, 21 nt, Human
cuugccgggaucccccaguca

SEQ ID NO: 1174029 - RNA, 22 nt, Human
gaccagcaccauguccuucugg

SEQ ID NO: 1174030 - RNA, 21 nt, Human
ugauccugaucaaggggccaa

SEQ ID NO: 1174031 - RNA, 20 nt, Human
uggagacccggaaccccccu

SEQ ID NO: 1174032 - RNA, 21 nt, Human
ugguuguggggaagugccagg

SEQ ID NO: 1174033 - RNA, 20 nt, Human
aaacaggagcaaaagacugg

SEQ ID NO: 1174034 - RNA, 26 nt, Human
aaacaggagcaaaagacuggcggcga

SEQ ID NO: 1174035 - RNA, 23 nt, Human
aucuucuuuggugacaucuguua

SEQ ID NO: 1174036 - RNA, 24 nt, Human
caaguuuacaaugcacacgcauag

SEQ ID NO: 1174037 - RNA, 21 nt, Human
cacacgcauaccugaaacagg

SEQ ID NO: 1174038 - RNA, 22 nt, Human
cacuugcagcuaugugcucgcu

SEQ ID NO: 1174039 - RNA, 18 nt, Human
ccugaaacaggagcaaaa

SEQ ID NO: 1174040 - RNA, 21 nt, Human
cugaaacaggagcaaaagacu

SEQ ID NO: 1174041 - RNA, 18 nt, Human
ggagcaaaagacuggcgg

SEQ ID NO: 1174042 - RNA, 25 nt, Human
uaagcauuagaaaaacauguugggg

SEQ ID NO: 1174043 - RNA, 19 nt, Human
uagaaaaacauguuggggc

SEQ ID NO: 1174044 - RNA, 19 nt, Human
ucaguucagucagacaagu

SEQ ID NO: 1174045 - RNA, 24 nt, Human
ugaguuuuaagaguucuuauauau

SEQ ID NO: 1174046 - RNA, 18 nt, Human
uuaagcauuagaaaaaca

SEQ ID NO: 1174047 - RNA, 19 nt, Human
uuagggucuuuggccuauu

SEQ ID NO: 1174048 - RNA, 19 nt, Human
uuggauucuuuuuuucugc

SEQ ID NO: 1174049 - RNA, 19 nt, Human
uuggugacaucuguuaggg

SEQ ID NO: 1174050 - RNA, 22 nt, Human
aaacaacaagacgcuugacuug

SEQ ID NO: 1174051 - RNA, 18 nt, Human
aagcagcaccaggagcgg

SEQ ID NO: 1174052 - RNA, 25 nt, Human
aagcagcaccaggagcggcagaaga

SEQ ID NO: 1174053 - RNA, 25 nt, Human
agcaccaggagcggcagaagaagga

SEQ ID NO: 1174054 - RNA, 21 nt, Human
aggcggcagcaguggacaagg

SEQ ID NO: 1174055 - RNA, 24 nt, Human
caaacgagcacacaagcagcacca

SEQ ID NO: 1174056 - RNA, 24 nt, Human
caagcagcaccaggagcggcagaa

SEQ ID NO: 1174057 - RNA, 20 nt, Human
cacaagcagcaccaggagcg

SEQ ID NO: 1174058 - RNA, 24 nt, Human
cacaagcagcaccaggagcggcag

SEQ ID NO: 1174059 - RNA, 20 nt, Human
cagaagaaggaggcggcagc

SEQ ID NO: 1174060 - RNA, 18 nt, Human
caggagcggcagaagaag

SEQ ID NO: 1174061 - RNA, 23 nt, Human
caggagcggcagaagaaggaggc

SEQ ID NO: 1174062 - RNA, 18 nt, Human
caguaaaggaauggggaa

SEQ ID NO: 1174063 - RNA, 18 nt, Human
caugccacuaauggagaa

SEQ ID NO: 1174064 - RNA, 20 nt, Human
gagaaaggggguauuuucac

SEQ ID NO: 1174065 - RNA, 19 nt, Human
gagcaugccacuaauggag

SEQ ID NO: 1174066 - RNA, 21 nt, Human
gaggcggcagcaguggacaag

SEQ ID NO: 1174067 - RNA, 21 nt, Human
gaggcggcagcaguggacaag

SEQ ID NO: 1174068 - RNA, 18 nt, Human
gcggcagcaguggacaag

SEQ ID NO: 1174069 - RNA, 20 nt, Human
ggaaaacuaucuaggauucu

SEQ ID NO: 1174070 - RNA, 23 nt, Human
gguauuuucacagaaucaguauu

SEQ ID NO: 1174071 - RNA, 19 nt, Human
uaaaauucuccaauugaac

SEQ ID NO: 1174072 - RNA, 21 nt, Human
ucagcugccgcuucacaaaag

SEQ ID NO: 1174073 - RNA, 24 nt, Human
uccucagcugccgcuucacaaaag

SEQ ID NO: 1174074 - RNA, 21 nt, Human
ugcauguaacagcuaaguaca

SEQ ID NO: 1174075 - RNA, 19 nt, Human
uggggaagggggaaaugaa

SEQ ID NO: 1174076 - RNA, 23 nt, Human
uguuguuguuuuuuuguuguugu

SEQ ID NO: 1174077 - RNA, 20 nt, Human
uuguuguuguuguuaaaaca

SEQ ID NO: 1174078 - RNA, 19 nt, Human
uuguuguuuuuuuguuguu

SEQ ID NO: 1174079 - RNA, 23 nt, Human
uuucacagaaucaguauuuuucc

SEQ ID NO: 1174080 - RNA, 22 nt, Human
uuuguuguuguuguuaaaacag

SEQ ID NO: 1174081 - RNA, 23 nt, Human
uuuuguuguuguuguuaaaacag

SEQ ID NO: 1174082 - RNA, 24 nt, Human
uuuuuuuguuguuguuguuaaaac

SEQ ID NO: 1174083 - RNA, 19 nt, Human
aacuagacuucugacgcug

SEQ ID NO: 1174084 - RNA, 19 nt, Human
acacgcugcacaacugaca

SEQ ID NO: 1174085 - RNA, 25 nt, Human
acagcugccuauaaaacuagacuuc

SEQ ID NO: 1174086 - RNA, 24 nt, Human
caacugacaucacaggacagcugc

SEQ ID NO: 1174087 - RNA, 28 nt, Human
cgcugcacaacugacaucacaggacagc

SEQ ID NO: 1174088 - RNA, 18 nt, Human
gagagcaggcauggcaac

SEQ ID NO: 1174089 - RNA, 22 nt, Human
uaaaacuagacuucugacgcug

SEQ ID NO: 1174090 - RNA, 18 nt, Human
uauaaaacuagacuucug

SEQ ID NO: 1174091 - RNA, 25 nt, Human
ucacuuuccuguccuuaauauccac

SEQ ID NO: 1174092 - RNA, 21 nt, Human
ucuuucgguggaagacaaugg

SEQ ID NO: 1174093 - RNA, 23 nt, Human
uuagggucuccaaugagcuuccu

SEQ ID NO: 1174094 - RNA, 18 nt, Human
aaaaaacaagauagaggc

SEQ ID NO: 1174095 - RNA, 22 nt, Human
aaaaacaaaaaacaagauagag

SEQ ID NO: 1174096 - RNA, 24 nt, Human
aaaaagcagcaaguucaacacaaa

SEQ ID NO: 1174097 - RNA, 25 nt, Human
aaaaagcagcaaguucaacacaaaa

SEQ ID NO: 1174098 - RNA, 21 nt, Human
aaaggggcaguugaguaagau

SEQ ID NO: 1174099 - RNA, 25 nt, Human
aagaaaugagauguugugaaaaaga

SEQ ID NO: 1174100 - RNA, 21 nt, Human
aagaggacauuucuggaggcu

SEQ ID NO: 1174101 - RNA, 18 nt, Human
aagcagcaaguucaacac

SEQ ID NO: 1174102 - RNA, 19 nt, Human
aagcugagaugggaaaugg

SEQ ID NO: 1174103 - RNA, 22 nt, Human
accaucuucuacuuugggcuua

SEQ ID NO: 1174104 - RNA, 22 nt, Human
accuccccagaagaaaaaacaa

SEQ ID NO: 1174105 - RNA, 22 nt, Human
acugccuucuaccaucuucuac

SEQ ID NO: 1174106 - RNA, 24 nt, Human
agaaaugagauguugugaaaaaga

SEQ ID NO: 1174107 - RNA, 22 nt, Human
agaaggaaauacagggucaccc

SEQ ID NO: 1174108 - RNA, 19 nt, Human
agaauggcagaaaccuagg

SEQ ID NO: 1174109 - RNA, 25 nt, Human
agaggcagcaaacacaaauucugag

SEQ ID NO: 1174110 - RNA, 19 nt, Human
agcaacagcaaaaggaaga

SEQ ID NO: 1174111 - RNA, 26 nt, Human
agccuggauuucccucuccaaaacuu

SEQ ID NO: 1174112 - RNA, 21 nt, Human
aggaaugggcaccagaaggaa

SEQ ID NO: 1174113 - RNA, 22 nt, Human
aggcagcaaacacaaauucuga

SEQ ID NO: 1174114 - RNA, 20 nt, Human
aguaugaaaaaaagcagcaa

SEQ ID NO: 1174115 - RNA, 18 nt, Human
agucagggauguuccuuc

SEQ ID NO: 1174116 - RNA, 19 nt, Human
augguggccauuaucuaca

SEQ ID NO: 1174117 - RNA, 22 nt, Human
auucugagggagaggaaagggg

SEQ ID NO: 1174118 - RNA, 19 nt, Human
caaaaaacaagauagaggc

SEQ ID NO: 1174119 - RNA, 19 nt, Human
caaaauccuccuccucuuc

SEQ ID NO: 1174120 - RNA, 20 nt, Human
caacacaaaauagaaaucuc

SEQ ID NO: 1174121 - RNA, 24 nt, Human
caacagcaaaaggaagaaaugaga

SEQ ID NO: 1174122 - RNA, 24 nt, Human
cacccagaauggcagaaaccuagg

SEQ ID NO: 1174123 - RNA, 22 nt, Human
cacuguucuagaccuccccaga

SEQ ID NO: 1174124 - RNA, 21 nt, Human
cagaaaccuagguuucccaga

SEQ ID NO: 1174125 - RNA, 18 nt, Human
cagaagaaaaaacaaaaa

SEQ ID NO: 1174126 - RNA, 20 nt, Human
cagaguggaaagagagagga

SEQ ID NO: 1174127 - RNA, 20 nt, Human
cagagugggacagacaccuc

SEQ ID NO: 1174128 - RNA, 18 nt, Human
ccagaagaaaaaacaaaa

SEQ ID NO: 1174129 - RNA, 21 nt, Human
ccagaguggaaagagagagga

SEQ ID NO: 1174130 - RNA, 19 nt, Human
cccagaagaaaaaacaaaa

SEQ ID NO: 1174131 - RNA, 19 nt, Human
ccuccucuucugcgguggc

SEQ ID NO: 1174132 - RNA, 20 nt, Human
cuaugugccaggcacuguuc

SEQ ID NO: 1174133 - RNA, 23 nt, Human
cucuccaaaacuuuuagaaugga

SEQ ID NO: 1174134 - RNA, 20 nt, Human
cucugauacucagagacgag

SEQ ID NO: 1174135 - RNA, 18 nt, Human
cugccuucuaccaucuuc

SEQ ID NO: 1174136 - RNA, 24 nt, Human
cuggaggcuuagggaccaaggcug

SEQ ID NO: 1174137 - RNA, 18 nt, Human
cuguucuagaccucccca

SEQ ID NO: 1174138 - RNA, 23 nt, Human
gaaaguggagauaauacugcuga

SEQ ID NO: 1174139 - RNA, 23 nt, Human
gagagaggagacauucaacaaac

SEQ ID NO: 1174140 - RNA, 19 nt, Human
gaggcuuagggaccaaggc

SEQ ID NO: 1174141 - RNA, 20 nt, Human
gagggagguagaguuggaaa

SEQ ID NO: 1174142 - RNA, 21 nt, Human
gauuucccucuccaaaacuuu

SEQ ID NO: 1174143 - RNA, 21 nt, Human
gcuggacucuuucccccacuc

SEQ ID NO: 1174144 - RNA, 19 nt, Human
ggaaaggaaaggauuccac

SEQ ID NO: 1174145 - RNA, 22 nt, Human
ggaaaggauuccacuugacaga

SEQ ID NO: 1174146 - RNA, 24 nt, Human
ggaacugaaaagccugaggugaug

SEQ ID NO: 1174147 - RNA, 23 nt, Human
ggagguagaguuggaaaggaaag

SEQ ID NO: 1174148 - RNA, 20 nt, Human
ggcaguugaguaagauggcu

SEQ ID NO: 1174149 - RNA, 23 nt, Human
ggcuuagggaccaaggcuggacu

SEQ ID NO: 1174150 - RNA, 22 nt, Human
gggagguagaguuggaaaggaa

SEQ ID NO: 1174151 - RNA, 23 nt, Human
gggggggaagcaacagcaaaagg

SEQ ID NO: 1174152 - RNA, 20 nt, Human
uaaauggcaucuggaugaga

SEQ ID NO: 1174153 - RNA, 20 nt, Human
uaagauggcuaagggaacug

SEQ ID NO: 1174154 - RNA, 20 nt, Human
uaagggaacugaaaagccug

SEQ ID NO: 1174155 - RNA, 21 nt, Human
uaccaucuucuacuuugggcu

SEQ ID NO: 1174156 - RNA, 21 nt, Human
uacuaugugccaggcacuguu

SEQ ID NO: 1174157 - RNA, 23 nt, Human
uagaauggaaaaucccauccccu

SEQ ID NO: 1174158 - RNA, 21 nt, Human
uaggggguaagaaaaaguggg

SEQ ID NO: 1174159 - RNA, 21 nt, Human
ucacguugcucucagccucgg

SEQ ID NO: 1174160 - RNA, 22 nt, Human
uccccagaagaaaaaacaaaaa

SEQ ID NO: 1174161 - RNA, 24 nt, Human
ucccccacuccuugaucccuuucu

SEQ ID NO: 1174162 - RNA, 22 nt, Human
ucuagaccuccccagaagaaaa

SEQ ID NO: 1174163 - RNA, 22 nt, Human
ucucugaucaggggaaaggagc

SEQ ID NO: 1174164 - RNA, 23 nt, Human
ucuggaggcuuagggaccaaggc

SEQ ID NO: 1174165 - RNA, 19 nt, Human
ucuggaugagacccagcuu

SEQ ID NO: 1174166 - RNA, 19 nt, Human
ugaaaaagauggaggaggg

SEQ ID NO: 1174167 - RNA, 21 nt, Human
ugacaccucucuugaagcuga

SEQ ID NO: 1174168 - RNA, 23 nt, Human
ugacucaaacacugauguggcag

SEQ ID NO: 1174169 - RNA, 22 nt, Human
ugagaugggaaauggacauacu

SEQ ID NO: 1174170 - RNA, 23 nt, Human
ugagaugggaaauggacauacuu

SEQ ID NO: 1174171 - RNA, 25 nt, Human
ugagaugggaaauggacauacuuag

SEQ ID NO: 1174172 - RNA, 19 nt, Human
ugagggagaggaaaggggc

SEQ ID NO: 1174173 - RNA, 21 nt, Human
ugaggugaugggggcucuguc

SEQ ID NO: 1174174 - RNA, 24 nt, Human
uggaaaaucccauccccuuccuua

SEQ ID NO: 1174175 - RNA, 19 nt, Human
uggaaggaaugggcaccag

SEQ ID NO: 1174176 - RNA, 21 nt, Human
uggacucuuucccccacuccu

SEQ ID NO: 1174177 - RNA, 23 nt, Human
uggauuucccucuccaaaacuuu

SEQ ID NO: 1174178 - RNA, 19 nt, Human
uggcaucuggaugagaccc

SEQ ID NO: 1174179 - RNA, 19 nt, Human
ugugaaaaagauggaggag

SEQ ID NO: 1174180 - RNA, 21 nt, Human
ugugaaaaagauggaggaggg

SEQ ID NO: 1174181 - RNA, 20 nt, Human
uguggggggggggaagcaac

SEQ ID NO: 1174182 - RNA, 21 nt, Human
uguugugaaaaagauggagga

SEQ ID NO: 1174183 - RNA, 25 nt, Human
uucaacacaaaauagaaaucucaaa

SEQ ID NO: 1174184 - RNA, 19 nt, Human
uuuauuuuuggcucuuggg

SEQ ID NO: 1174185 - RNA, 18 nt, Human
uuucccucuccaaaacuu

SEQ ID NO: 1174186 - RNA, 23 nt, Human
uuucccucuccaaaacuuuuaga

SEQ ID NO: 1174187 - RNA, 19 nt, Human
uuucuggaggcuuagggac

SEQ ID NO: 1174188 - RNA, 18 nt, Human
gcaauaucuguucccagc

SEQ ID NO: 1174189 - RNA, 27 nt, Human
cagggcacucuuccauucuuuaccuau

SEQ ID NO: 1174190 - RNA, 22 nt, Human
uaaacaauccuuaguaccugua

SEQ ID NO: 1174191 - RNA, 23 nt, Human
uccacauacugaacauugugaau

SEQ ID NO: 1174192 - RNA, 18 nt, Human
ugaaaaguucggaaguaa

SEQ ID NO: 1174193 - RNA, 21 nt, Human
uugugaauugacucucucagu

SEQ ID NO: 1174194 - RNA, 22 nt, Human
ccuacaccuugauccaguguua

SEQ ID NO: 1174195 - RNA, 22 nt, Human
ugaaguuccuacaccuugaucc

SEQ ID NO: 1174196 - RNA, 23 nt, Human
uugauccaguguuacaaagaagg

SEQ ID NO: 1174197 - RNA, 24 nt, Human
aucuucugccacugccauagcuac

SEQ ID NO: 1174198 - RNA, 20 nt, Human
ccugcuaagcuuuguuuccu

SEQ ID NO: 1174199 - RNA, 18 nt, Human
cugcuaagcuuuguuucc

SEQ ID NO: 1174200 - RNA, 20 nt, Human
guuuugcaaaguauugccuc

SEQ ID NO: 1174201 - RNA, 21 nt, Human
uacugcugcugcuggaacugc

SEQ ID NO: 1174202 - RNA, 20 nt, Human
ucucuggcucuccucuccug

SEQ ID NO: 1174203 - RNA, 21 nt, Human
ucugccacugccauagcuacu

SEQ ID NO: 1174204 - RNA, 24 nt, Human
ugcaaaguauugccuccaccgcca

SEQ ID NO: 1174205 - RNA, 23 nt, Human
aaaaaguuuacccaagguaauua

SEQ ID NO: 1174206 - RNA, 21 nt, Human
aacaaacuaucacagcauaaa

SEQ ID NO: 1174207 - RNA, 18 nt, Human
aaggcagguggaucaucu

SEQ ID NO: 1174208 - RNA, 18 nt, Human
aaucgcuugaaccuggga

SEQ ID NO: 1174209 - RNA, 24 nt, Human
aaucgcuugaaccugggaggcgga

SEQ ID NO: 1174210 - RNA, 20 nt, Human
acaagagcgaaacucugucu

SEQ ID NO: 1174211 - RNA, 21 nt, Human
acaagagcgaaacucugucuc

SEQ ID NO: 1174212 - RNA, 22 nt, Human
acggaagcugugguaucacuuu

SEQ ID NO: 1174213 - RNA, 22 nt, Human
acguggcaagagccugucucuc

SEQ ID NO: 1174214 - RNA, 18 nt, Human
acugcacuccagccuggg

SEQ ID NO: 1174215 - RNA, 21 nt, Human
acugcacuccagccugggcaa

SEQ ID NO: 1174216 - RNA, 24 nt, Human
acugcacuccagccugggcaacaa

SEQ ID NO: 1174217 - RNA, 18 nt, Human
agagcgaaacucugucuc

SEQ ID NO: 1174218 - RNA, 24 nt, Human
agcacuuugggaggcugaggcagg

SEQ ID NO: 1174219 - RNA, 21 nt, Human
agccugucucuccaaaaccua

SEQ ID NO: 1174220 - RNA, 24 nt, Human
aggcacgguggcucaugccuguaa

SEQ ID NO: 1174221 - RNA, 22 nt, Human
aggcaggagaaucgcuugaacc

SEQ ID NO: 1174222 - RNA, 24 nt, Human
aggcaggagaaucgcuugaaccug

SEQ ID NO: 1174223 - RNA, 26 nt, Human
aggcagguggaucaucugagcccagg

SEQ ID NO: 1174224 - RNA, 20 nt, Human
aggcggagguuguggugagc

SEQ ID NO: 1174225 - RNA, 20 nt, Human
aggcugaggcaggagaaucg

SEQ ID NO: 1174226 - RNA, 24 nt, Human
aggcugaggcaggagaaucgcuug

SEQ ID NO: 1174227 - RNA, 20 nt, Human
agugcuuugggaggcgaagg

SEQ ID NO: 1174228 - RNA, 24 nt, Human
aucgugccacugcacuccagccug

SEQ ID NO: 1174229 - RNA, 19 nt, Human
augccuguaaucccagcac

SEQ ID NO: 1174230 - RNA, 18 nt, Human
augguguuugcauuuugu

SEQ ID NO: 1174231 - RNA, 23 nt, Human
caacaagagcgaaacucugucuc

SEQ ID NO: 1174232 - RNA, 24 nt, Human
caacguggcaagagccugucucuc

SEQ ID NO: 1174233 - RNA, 24 nt, Human
caagagccugucucuccaaaaccu

SEQ ID NO: 1174234 - RNA, 24 nt, Human
cacuccagccugggcaacaagagc

SEQ ID NO: 1174235 - RNA, 25 nt, Human
cacuccagccugggcaacaagagcg

SEQ ID NO: 1174236 - RNA, 18 nt, Human
cacugcacuccagccugg

SEQ ID NO: 1174237 - RNA, 19 nt, Human
cacugcacuccagccuggg

SEQ ID NO: 1174238 - RNA, 21 nt, Human
cacugcacuccagccugggca

SEQ ID NO: 1174239 - RNA, 23 nt, Human
cacugcacuccagccugggcaac

SEQ ID NO: 1174240 - RNA, 24 nt, Human
cacugcacuccagccugggcaaca

SEQ ID NO: 1174241 - RNA, 24 nt, Human
cagcacuuugggaggcugaggcag

SEQ ID NO: 1174242 - RNA, 25 nt, Human
cagcacuuugggaggcugaggcagg

SEQ ID NO: 1174243 - RNA, 18 nt, Human
cagcauaaaguaggaaua

SEQ ID NO: 1174244 - RNA, 24 nt, Human
cagguggaucaucugagcccagga

SEQ ID NO: 1174245 - RNA, 24 nt, Human
cagugcuuugggaggcgaaggcag

SEQ ID NO: 1174246 - RNA, 26 nt, Human
cagugcuuugggaggcgaaggcaggu

SEQ ID NO: 1174247 - RNA, 24 nt, Human
caugccuguaaucccagcacuuug

SEQ ID NO: 1174248 - RNA, 20 nt, Human
ccacugcacuccagccuggg

SEQ ID NO: 1174249 - RNA, 21 nt, Human
ccacugcacuccagccugggc

SEQ ID NO: 1174250 - RNA, 23 nt, Human
ccacugcacuccagccugggcaa

SEQ ID NO: 1174251 - RNA, 24 nt, Human
ccacugcacuccagccugggcaac

SEQ ID NO: 1174252 - RNA, 18 nt, Human
cccagugcuuugggaggc

SEQ ID NO: 1174253 - RNA, 19 nt, Human
ccugggaggcggagguugu

SEQ ID NO: 1174254 - RNA, 21 nt, Human
cgcuugaaccugggaggcgga

SEQ ID NO: 1174255 - RNA, 24 nt, Human
cucaugccuguaaucccagcacuu

SEQ ID NO: 1174256 - RNA, 23 nt, Human
gagaaucgcuugaaccugggagg

SEQ ID NO: 1174257 - RNA, 23 nt, Human
gagaucgugccacugcacuccag

SEQ ID NO: 1174258 - RNA, 24 nt, Human
gaucaucugagcccaggaguuuga

SEQ ID NO: 1174259 - RNA, 23 nt, Human
gcagguggaucaucugagcccag

SEQ ID NO: 1174260 - RNA, 22 nt, Human
gccacugcacuccagccugggc

SEQ ID NO: 1174261 - RNA, 24 nt, Human
gccacugcacuccagccugggcaa

SEQ ID NO: 1174262 - RNA, 22 nt, Human
gccaggcacgguggcucaugcc

SEQ ID NO: 1174263 - RNA, 22 nt, Human
gcccaggaguuugagaccagcc

SEQ ID NO: 1174264 - RNA, 20 nt, Human
gcugagaucgugccacugca

SEQ ID NO: 1174265 - RNA, 22 nt, Human
ggagguuguggugagcugagau

SEQ ID NO: 1174266 - RNA, 24 nt, Human
ggagguuguggugagcugagaucg

SEQ ID NO: 1174267 - RNA, 20 nt, Human
ggcaacguggcaagagccug

SEQ ID NO: 1174268 - RNA, 21 nt, Human
ggcugggcgugguggcucaug

SEQ ID NO: 1174269 - RNA, 23 nt, Human
gggcgugguggcucaugucccag

SEQ ID NO: 1174270 - RNA, 23 nt, Human
gguggcucaugccuguaauccca

SEQ ID NO: 1174271 - RNA, 24 nt, Human
gguggcucaugccuguaaucccag

SEQ ID NO: 1174272 - RNA, 27 nt, Human
guacuugcggcugggcgugguggcuca

SEQ ID NO: 1174273 - RNA, 23 nt, Human
guggcucaugccuguaaucccag

SEQ ID NO: 1174274 - RNA, 18 nt, Human
guggugugagccuguagu

SEQ ID NO: 1174275 - RNA, 21 nt, Human
guguguguuuacaauuuucug

SEQ ID NO: 1174276 - RNA, 25 nt, Human
uaaauaaacaaacuaucacagcaua

SEQ ID NO: 1174277 - RNA, 24 nt, Human
uaagaagauacaguuuaacaucaa

SEQ ID NO: 1174278 - RNA, 20 nt, Human
uacaaaaaugaacacaaguu

SEQ ID NO: 1174279 - RNA, 20 nt, Human
uaccuggcaaaacuucacgg

SEQ ID NO: 1174280 - RNA, 23 nt, Human
ucaucugagcccaggaguuugag

SEQ ID NO: 1174281 - RNA, 22 nt, Human
ucaugccuguaaucccagcacu

SEQ ID NO: 1174282 - RNA, 24 nt, Human
ucgcuugaaccugggaggcggagg

SEQ ID NO: 1174283 - RNA, 23 nt, Human
ucgugccacugcacuccagccug

SEQ ID NO: 1174284 - RNA, 25 nt, Human
ucuccaaaaccuacaaaauuuagcc

SEQ ID NO: 1174285 - RNA, 23 nt, Human
ucugagcccaggaguuugagacc

SEQ ID NO: 1174286 - RNA, 24 nt, Human
ucugagcccaggaguuugagacca

SEQ ID NO: 1174287 - RNA, 24 nt, Human
ucuggccaggcacgguggcucaug

SEQ ID NO: 1174288 - RNA, 22 nt, Human
ugaaccugggaggcggagguug

SEQ ID NO: 1174289 - RNA, 23 nt, Human
ugagcccaggaguuugagaccag

SEQ ID NO: 1174290 - RNA, 22 nt, Human
ugagcugagaucgugccacugc

SEQ ID NO: 1174291 - RNA, 20 nt, Human
ugaggcaggagaaucgcuug

SEQ ID NO: 1174292 - RNA, 24 nt, Human
ugaggcaggagaaucgcuugaacc

SEQ ID NO: 1174293 - RNA, 25 nt, Human
ugaggcaggagaaucgcuugaaccu

SEQ ID NO: 1174294 - RNA, 22 nt, Human
ugaguacuaccuggcaaaacuu

SEQ ID NO: 1174295 - RNA, 23 nt, Human
ugauugguuuggugagagggaau

SEQ ID NO: 1174296 - RNA, 24 nt, Human
ugccacugcacuccagccugggca

SEQ ID NO: 1174297 - RNA, 23 nt, Human
ugccuguaaucccagcacuuugg

SEQ ID NO: 1174298 - RNA, 24 nt, Human
ugccuguaaucccagcacuuuggg

SEQ ID NO: 1174299 - RNA, 24 nt, Human
ugcggcugggcgugguggcucaug

SEQ ID NO: 1174300 - RNA, 23 nt, Human
uggaucaucugagcccaggaguu

SEQ ID NO: 1174301 - RNA, 24 nt, Human
uggaucaucugagcccaggaguuu

SEQ ID NO: 1174302 - RNA, 21 nt, Human
uggcaaaacuucacggaagcu

SEQ ID NO: 1174303 - RNA, 24 nt, Human
uggccaggcacgguggcucaugcc

SEQ ID NO: 1174304 - RNA, 22 nt, Human
uggcucaugccuguaaucccag

SEQ ID NO: 1174305 - RNA, 24 nt, Human
uggcucaugccuguaaucccagca

SEQ ID NO: 1174306 - RNA, 24 nt, Human
ugggaggcgaaggcagguggauca

SEQ ID NO: 1174307 - RNA, 24 nt, Human
ugggaggcggagguuguggugagc

SEQ ID NO: 1174308 - RNA, 19 nt, Human
ugggaggcugaggcaggag

SEQ ID NO: 1174309 - RNA, 23 nt, Human
ugggaggcugaggcaggagaauc

SEQ ID NO: 1174310 - RNA, 24 nt, Human
ugguggugugagccuguaguccca

SEQ ID NO: 1174311 - RNA, 20 nt, Human
uguaaaaguacuugcggcug

SEQ ID NO: 1174312 - RNA, 23 nt, Human
uugaaccugggaggcggagguug

SEQ ID NO: 1174313 - RNA, 24 nt, Human
uugggaggcugaggcaggagaauc

SEQ ID NO: 1174314 - RNA, 21 nt, Human
uuuguacaaaaaugaacacaa

SEQ ID NO: 1174315 - RNA, 23 nt, Human
uuuguacaaaaaugaacacaagu

SEQ ID NO: 1174316 - RNA, 19 nt, Human
aaaagaaccaacacggaug

SEQ ID NO: 1174317 - RNA, 24 nt, Human
aaaagaaccaacacggaugcaugg

SEQ ID NO: 1174318 - RNA, 21 nt, Human
aaaaugaaacaagcuuagccc

SEQ ID NO: 1174319 - RNA, 22 nt, Human
aaaaugaaacaagcuuagccca

SEQ ID NO: 1174320 - RNA, 19 nt, Human
aaaaugcugggauuacagg

SEQ ID NO: 1174321 - RNA, 24 nt, Human
aaaaugcugggauuacagguguca

SEQ ID NO: 1174322 - RNA, 23 nt, Human
aaaccugcacagguacccuccgg

SEQ ID NO: 1174323 - RNA, 21 nt, Human
aaagccuuccuuacaaacacc

SEQ ID NO: 1174324 - RNA, 21 nt, Human
aaauaaaccacccacacccaa

SEQ ID NO: 1174325 - RNA, 19 nt, Human
aaauacaaaaagcaagccc

SEQ ID NO: 1174326 - RNA, 26 nt, Human
aaaugcugggauuacaggugucagcc

SEQ ID NO: 1174327 - RNA, 21 nt, Human
aaaugggaauaauaagaauau

SEQ ID NO: 1174328 - RNA, 20 nt, Human
aacaagcuuagcccaucagc

SEQ ID NO: 1174329 - RNA, 18 nt, Human
aacaguuuagaugucauc

SEQ ID NO: 1174330 - RNA, 23 nt, Human
aaccacccacacccaaguccuua

SEQ ID NO: 1174331 - RNA, 20 nt, Human
aacuccauagaaauucaacu

SEQ ID NO: 1174332 - RNA, 23 nt, Human
aacuccugaacccaagggauccu

SEQ ID NO: 1174333 - RNA, 19 nt, Human
aacugcauggcaggagccu

SEQ ID NO: 1174334 - RNA, 19 nt, Human
aacuuccucuucuucucug

SEQ ID NO: 1174335 - RNA, 25 nt, Human
aagugccuucuaaccacugaucuac

SEQ ID NO: 1174336 - RNA, 24 nt, Human
aagugcgguggcaugaucacagcu

SEQ ID NO: 1174337 - RNA, 21 nt, Human
aauagaaggguucugccugga

SEQ ID NO: 1174338 - RNA, 19 nt, Human
aauaucuacuuaaccucaa

SEQ ID NO: 1174339 - RNA, 26 nt, Human
aaucacuucccaaauaaaccacccac

SEQ ID NO: 1174340 - RNA, 24 nt, Human
aaugcaacugcccaaauuuuugcc

SEQ ID NO: 1174341 - RNA, 19 nt, Human
aauuaccugaggucagaga

SEQ ID NO: 1174342 - RNA, 27 nt, Human
acaaaaagcaagcccauggaugucaac

SEQ ID NO: 1174343 - RNA, 19 nt, Human
acaaacaccuccaguagau

SEQ ID NO: 1174344 - RNA, 24 nt, Human
acaaagauaaauuuacuucuuucc

SEQ ID NO: 1174345 - RNA, 23 nt, Human
acacauccaaauacaaaaagcaa

SEQ ID NO: 1174346 - RNA, 18 nt, Human
acagccucaggggaagac

SEQ ID NO: 1174347 - RNA, 18 nt, Human
acagcucacugcagccuc

SEQ ID NO: 1174348 - RNA, 20 nt, Human
acaguucuggauaacuuucc

SEQ ID NO: 1174349 - RNA, 19 nt, Human
acauuugcauuaugucuaa

SEQ ID NO: 1174350 - RNA, 18 nt, Human
accacccacacccaaguc

SEQ ID NO: 1174351 - RNA, 21 nt, Human
accacucacagccacaaaaug

SEQ ID NO: 1174352 - RNA, 23 nt, Human
accauguuggucaggcuggucuc

SEQ ID NO: 1174353 - RNA, 22 nt, Human
acccacucuuuugcccuuccca

SEQ ID NO: 1174354 - RNA, 23 nt, Human
accucagccucccaaauugcugg

SEQ ID NO: 1174355 - RNA, 20 nt, Human
accucagccucccaaguagc

SEQ ID NO: 1174356 - RNA, 19 nt, Human
accugcacagguacccucc

SEQ ID NO: 1174357 - RNA, 24 nt, Human
accuguugcccaggcuggaguuca

SEQ ID NO: 1174358 - RNA, 19 nt, Human
acgggguuuugauauguug

SEQ ID NO: 1174359 - RNA, 24 nt, Human
acgggguuuugauauguugcucag

SEQ ID NO: 1174360 - RNA, 18 nt, Human
acucugucacccaggcug

SEQ ID NO: 1174361 - RNA, 26 nt, Human
acucugucacccaggcuggaagugcg

SEQ ID NO: 1174362 - RNA, 22 nt, Human
acugcaaccuuccucuacuggg

SEQ ID NO: 1174363 - RNA, 21 nt, Human
agacaggcacucacaccuuca

SEQ ID NO: 1174364 - RNA, 20 nt, Human
agagaccuaccaccaggaua

SEQ ID NO: 1174365 - RNA, 22 nt, Human
agcacugagccagcaggaagga

SEQ ID NO: 1174366 - RNA, 23 nt, Human
agccccuucccaucuugucuuug

SEQ ID NO: 1174367 - RNA, 18 nt, Human
agccuccagaguagcugg

SEQ ID NO: 1174368 - RNA, 23 nt, Human
aggaggcugaggcaggaguauca

SEQ ID NO: 1174369 - RNA, 20 nt, Human
aggauuuugccugagcacaa

SEQ ID NO: 1174370 - RNA, 24 nt, Human
aggcaaucugcccaccuuggucuc

SEQ ID NO: 1174371 - RNA, 18 nt, Human
aggcaggaguaucauuug

SEQ ID NO: 1174372 - RNA, 24 nt, Human
aggcaggaguaucauuugaacccg

SEQ ID NO: 1174373 - RNA, 24 nt, Human
aggcaugguggcucaugccuguaa

SEQ ID NO: 1174374 - RNA, 18 nt, Human
aggcuaaacuuuuuucuu

SEQ ID NO: 1174375 - RNA, 22 nt, Human
aggcucaggugauccuccuacc

SEQ ID NO: 1174376 - RNA, 18 nt, Human
aggcugagauagcuccca

SEQ ID NO: 1174377 - RNA, 20 nt, Human
aggcugaggcaggaguauca

SEQ ID NO: 1174378 - RNA, 24 nt, Human
aggcugaggcaggaguaucauuug

SEQ ID NO: 1174379 - RNA, 24 nt, Human
agggacuacaggcaugagccacca

SEQ ID NO: 1174380 - RNA, 18 nt, Human
aggguuucaccauguugg

SEQ ID NO: 1174381 - RNA, 22 nt, Human
aggguuucaccauguuggucag

SEQ ID NO: 1174382 - RNA, 23 nt, Human
aguagcuggaauuauagacaugu

SEQ ID NO: 1174383 - RNA, 18 nt, Human
aguagcugggauuacagg

SEQ ID NO: 1174384 - RNA, 24 nt, Human
agugauucuccugccucagccucc

SEQ ID NO: 1174385 - RNA, 24 nt, Human
agugcgguggcaugaucacagcuc

SEQ ID NO: 1174386 - RNA, 24 nt, Human
aguggcaugaucucagcuuacugc

SEQ ID NO: 1174387 - RNA, 24 nt, Human
aguuauaaaugaagcuaacaaaua

SEQ ID NO: 1174388 - RNA, 21 nt, Human
aguugugggcauacauuugaa

SEQ ID NO: 1174389 - RNA, 23 nt, Human
aucauucaauaauaaucauaauc

SEQ ID NO: 1174390 - RNA, 24 nt, Human
aucucaccuguugcccaggcugga

SEQ ID NO: 1174391 - RNA, 18 nt, Human
aucucacucuuuccuuag

SEQ ID NO: 1174392 - RNA, 23 nt, Human
aucuuccuauguuguccaggcug

SEQ ID NO: 1174393 - RNA, 20 nt, Human
augucuccugccucauaagu

SEQ ID NO: 1174394 - RNA, 19 nt, Human
auguggggauaaaagaacc

SEQ ID NO: 1174395 - RNA, 20 nt, Human
auguugccaggcaugguggc

SEQ ID NO: 1174396 - RNA, 20 nt, Human
auguugcucaggcuggucuc

SEQ ID NO: 1174397 - RNA, 18 nt, Human
auucuccugccucagccu

SEQ ID NO: 1174398 - RNA, 21 nt, Human
auuuggagacagaaucucacc

SEQ ID NO: 1174399 - RNA, 25 nt, Human
caaaaugcugggauuacagguguca

SEQ ID NO: 1174400 - RNA, 20 nt, Human
caaaaugggaauaauaagaa

SEQ ID NO: 1174401 - RNA, 21 nt, Human
caaauaaaccacccacaccca

SEQ ID NO: 1174402 - RNA, 24 nt, Human
caaauugcugggaugacuggcaug

SEQ ID NO: 1174403 - RNA, 22 nt, Human
caacagcgcaagucacacgaaa

SEQ ID NO: 1174404 - RNA, 18 nt, Human
caacuccauagaaauuca

SEQ ID NO: 1174405 - RNA, 22 nt, Human
caagugauucuccugccucagc

SEQ ID NO: 1174406 - RNA, 27 nt, Human
caagugauucuccugccucagccucca

SEQ ID NO: 1174407 - RNA, 24 nt, Human
cacacaauacacccauguaauaaa

SEQ ID NO: 1174408 - RNA, 21 nt, Human
cacacccaaguccuuacucca

SEQ ID NO: 1174409 - RNA, 24 nt, Human
caccacaccuggcuaauuuuugua

SEQ ID NO: 1174410 - RNA, 21 nt, Human
caccauguuggucaggcuggu

SEQ ID NO: 1174411 - RNA, 24 nt, Human
caccauguuggucaggcuggucuc

SEQ ID NO: 1174412 - RNA, 23 nt, Human
cacccacucuuuugcccuuccca

SEQ ID NO: 1174413 - RNA, 24 nt, Human
cacccuauaaaagccuuccuuaca

SEQ ID NO: 1174414 - RNA, 21 nt, Human
caccuguugcccaggcuggag

SEQ ID NO: 1174415 - RNA, 23 nt, Human
caccuguugcccaggcuggaguu

SEQ ID NO: 1174416 - RNA, 18 nt, Human
cacucacagccacaaaau

SEQ ID NO: 1174417 - RNA, 19 nt, Human
cacucugucacccaggcug

SEQ ID NO: 1174418 - RNA, 24 nt, Human
cacucugucacccaggcuggaagu

SEQ ID NO: 1174419 - RNA, 21 nt, Human
cacuuaaaaaacacacuaaga

SEQ ID NO: 1174420 - RNA, 20 nt, Human
cacuugcagguuaacagccu

SEQ ID NO: 1174421 - RNA, 19 nt, Human
cagaaaaaacugcauggca

SEQ ID NO: 1174422 - RNA, 25 nt, Human
cagaagaugcuacugcaguuuguau

SEQ ID NO: 1174423 - RNA, 21 nt, Human
cagaaguugguuaaugggcac

SEQ ID NO: 1174424 - RNA, 23 nt, Human
cagaaucucaccuguugcccagg

SEQ ID NO: 1174425 - RNA, 21 nt, Human
cagauauguguuguuccuggu

SEQ ID NO: 1174426 - RNA, 21 nt, Human
cagcaucacacaauacaccca

SEQ ID NO: 1174427 - RNA, 25 nt, Human
cagccaccacucacagccacaaaau

SEQ ID NO: 1174428 - RNA, 20 nt, Human
cagcccagaagcacuugcag

SEQ ID NO: 1174429 - RNA, 19 nt, Human
cagccuccugaguagcugg

SEQ ID NO: 1174430 - RNA, 24 nt, Human
cagcuacucaggaggcugaggcag

SEQ ID NO: 1174431 - RNA, 23 nt, Human
cagcucacugcagccucuacauc

SEQ ID NO: 1174432 - RNA, 18 nt, Human
caguagauccuucaacca

SEQ ID NO: 1174433 - RNA, 19 nt, Human
caguggcaugaucucagcu

SEQ ID NO: 1174434 - RNA, 21 nt, Human
cauaacaagaugcaaacaaga

SEQ ID NO: 1174435 - RNA, 22 nt, Human
caugcaccacugucccagccug

SEQ ID NO: 1174436 - RNA, 20 nt, Human
caugggcagggccuggucca

SEQ ID NO: 1174437 - RNA, 21 nt, Human
ccaaaaugcugggauuacagg

SEQ ID NO: 1174438 - RNA, 21 nt, Human
ccaaaaugcugggauuacagg

SEQ ID NO: 1174439 - RNA, 24 nt, Human
ccaaaaugcugggauuacaggugu

SEQ ID NO: 1174440 - RNA, 21 nt, Human
ccaaauaaaccacccacaccc

SEQ ID NO: 1174441 - RNA, 23 nt, Human
ccaaauaaaccacccacacccaa

SEQ ID NO: 1174442 - RNA, 23 nt, Human
ccaaauacaaaaagcaagcccau

SEQ ID NO: 1174443 - RNA, 22 nt, Human
ccacaaggucaaagucaagugu

SEQ ID NO: 1174444 - RNA, 24 nt, Human
ccaccuuggucucccaaaaugcug

SEQ ID NO: 1174445 - RNA, 18 nt, Human
ccacgaagccauccaagc

SEQ ID NO: 1174446 - RNA, 19 nt, Human
ccagaguagcugggauuac

SEQ ID NO: 1174447 - RNA, 22 nt, Human
ccagaguagcugggauuacagg

SEQ ID NO: 1174448 - RNA, 23 nt, Human
ccagaguagcugggauuacaggu

SEQ ID NO: 1174449 - RNA, 24 nt, Human
ccagaguagcugggauuacaggug

SEQ ID NO: 1174450 - RNA, 20 nt, Human
ccaggguacagucaguggag

SEQ ID NO: 1174451 - RNA, 24 nt, Human
cccaaguagcagggacuacaggca

SEQ ID NO: 1174452 - RNA, 26 nt, Human
cccacacccaaguccuuacuccagcu

SEQ ID NO: 1174453 - RNA, 19 nt, Human
cccacauuugcauuauguc

SEQ ID NO: 1174454 - RNA, 21 nt, Human
cccacucuuuugcccuuccca

SEQ ID NO: 1174455 - RNA, 24 nt, Human
cccaggcuggaagugcgguggcau

SEQ ID NO: 1174456 - RNA, 19 nt, Human
cccaggcuggaguucagug

SEQ ID NO: 1174457 - RNA, 23 nt, Human
cccaggcuggaguucaguggcau

SEQ ID NO: 1174458 - RNA, 21 nt, Human
cccaucauuuguuugcuguug

SEQ ID NO: 1174459 - RNA, 21 nt, Human
cccaugguccacauuuuuauc

SEQ ID NO: 1174460 - RNA, 23 nt, Human
cccuagaaauauguauaauugcc

SEQ ID NO: 1174461 - RNA, 21 nt, Human
cccuaggccccaugcaagcuc

SEQ ID NO: 1174462 - RNA, 20 nt, Human
cccucuuucagccagcacug

SEQ ID NO: 1174463 - RNA, 23 nt, Human
cccugagugcccagcgugugccc

SEQ ID NO: 1174464 - RNA, 20 nt, Human
cccuuuucauccacccacuc

SEQ ID NO: 1174465 - RNA, 20 nt, Human
ccgcugaguauuagcugugu

SEQ ID NO: 1174466 - RNA, 18 nt, Human
ccuauaaaagccuuccuu

SEQ ID NO: 1174467 - RNA, 22 nt, Human
ccuauguuguccaggcuggucu

SEQ ID NO: 1174468 - RNA, 22 nt, Human
ccucauaaguaccacuggacaa

SEQ ID NO: 1174469 - RNA, 19 nt, Human
ccucccugcauucccuccu

SEQ ID NO: 1174470 - RNA, 24 nt, Human
ccuccugccucagccuccugagua

SEQ ID NO: 1174471 - RNA, 20 nt, Human
ccucuugcuuuuagucauuu

SEQ ID NO: 1174472 - RNA, 21 nt, Human
ccugagaucaacccuccaccu

SEQ ID NO: 1174473 - RNA, 19 nt, Human
ccugaguagcuggaauuau

SEQ ID NO: 1174474 - RNA, 19 nt, Human
ccugauccaugaaucucug

SEQ ID NO: 1174475 - RNA, 24 nt, Human
ccugccucagccuccagaguagcu

SEQ ID NO: 1174476 - RNA, 23 nt, Human
ccugccucagccuccugaguagc

SEQ ID NO: 1174477 - RNA, 21 nt, Human
ccuguaaucccagcuacucag

SEQ ID NO: 1174478 - RNA, 22 nt, Human
ccuguaaucccagcuacucagg

SEQ ID NO: 1174479 - RNA, 18 nt, Human
ccugucccucuuucagcc

SEQ ID NO: 1174480 - RNA, 20 nt, Human
cgccagggcccugagugccc

SEQ ID NO: 1174481 - RNA, 19 nt, Human
cgcuuugaaauggacccag

SEQ ID NO: 1174482 - RNA, 24 nt, Human
cgggguuuugauauguugcucagg

SEQ ID NO: 1174483 - RNA, 23 nt, Human
cuaaaaugaaaguugaaauucau

SEQ ID NO: 1174484 - RNA, 24 nt, Human
cuauaucaugucuccugccucaua

SEQ ID NO: 1174485 - RNA, 23 nt, Human
cucaaggccacaaaaaaucagaa

SEQ ID NO: 1174486 - RNA, 24 nt, Human
cucaagugaucugcccaccucagc

SEQ ID NO: 1174487 - RNA, 24 nt, Human
cucaccuguugcccaggcuggagu

SEQ ID NO: 1174488 - RNA, 21 nt, Human
cucagcaucacacaauacacc

SEQ ID NO: 1174489 - RNA, 24 nt, Human
cucagccuccagaguagcugggau

SEQ ID NO: 1174490 - RNA, 24 nt, Human
cucaggugauccuccuaccucagc

SEQ ID NO: 1174491 - RNA, 18 nt, Human
cucugcuucuagggauac

SEQ ID NO: 1174492 - RNA, 21 nt, Human
cucugcuucuagggauacagg

SEQ ID NO: 1174493 - RNA, 23 nt, Human
cugcccaccucagccucccaaau

SEQ ID NO: 1174494 - RNA, 23 nt, Human
cugccucagccuccugaguagcu

SEQ ID NO: 1174495 - RNA, 19 nt, Human
cuggaagugcgguggcaug

SEQ ID NO: 1174496 - RNA, 21 nt, Human
cuggacaaggucccuuuuaug

SEQ ID NO: 1174497 - RNA, 24 nt, Human
cuggaguucaguggcaugaucuca

SEQ ID NO: 1174498 - RNA, 22 nt, Human
cuggauaacuuuccggagccuc

SEQ ID NO: 1174499 - RNA, 18 nt, Human
cugugucaugucuucuca

SEQ ID NO: 1174500 - RNA, 24 nt, Human
cuuacaaacaccuccaguagaucc

SEQ ID NO: 1174501 - RNA, 20 nt, Human
cuuacugcaaccuuccucua

SEQ ID NO: 1174502 - RNA, 23 nt, Human
cuuagcucaaggccacaaaaaau

SEQ ID NO: 1174503 - RNA, 24 nt, Human
cuucuuggaaucacuucccaaaua

SEQ ID NO: 1174504 - RNA, 22 nt, Human
cuugccuggcucacucuuccca

SEQ ID NO: 1174505 - RNA, 18 nt, Human
cuuuaugccugugcaucc

SEQ ID NO: 1174506 - RNA, 22 nt, Human
gaagaggccaugcaggcucagg

SEQ ID NO: 1174507 - RNA, 23 nt, Human
gaagccccuucccaucuugucuu

SEQ ID NO: 1174508 - RNA, 18 nt, Human
gaaguagcaacuccauag

SEQ ID NO: 1174509 - RNA, 23 nt, Human
gaaguggagaacaaagauaagug

SEQ ID NO: 1174510 - RNA, 24 nt, Human
gaccuaccaccaggauaguucaaa

SEQ ID NO: 1174511 - RNA, 19 nt, Human
gacgggguuuugauauguu

SEQ ID NO: 1174512 - RNA, 21 nt, Human
gacuacaggcaugagccacca

SEQ ID NO: 1174513 - RNA, 23 nt, Human
gacucaagugaucugcccaccuc

SEQ ID NO: 1174514 - RNA, 25 nt, Human
gacucuugcuucuuggaaucacuuc

SEQ ID NO: 1174515 - RNA, 19 nt, Human
gagacagaaucucaccugu

SEQ ID NO: 1174516 - RNA, 20 nt, Human
gagacagaaucucaccuguu

SEQ ID NO: 1174517 - RNA, 19 nt, Human
gagagaccuaccaccagga

SEQ ID NO: 1174518 - RNA, 20 nt, Human
gagagggugagagcucuggg

SEQ ID NO: 1174519 - RNA, 22 nt, Human
gagcaacuggcaucaauaaaug

SEQ ID NO: 1174520 - RNA, 24 nt, Human
gagcucaggcaaucugcccaccuu

SEQ ID NO: 1174521 - RNA, 26 nt, Human
gaguagcugggauuacaggugcacac

SEQ ID NO: 1174522 - RNA, 18 nt, Human
gauuacaggugucagcca

SEQ ID NO: 1174523 - RNA, 21 nt, Human
gauuacaggugucagccacca

SEQ ID NO: 1174524 - RNA, 18 nt, Human
gccagcacugagccagca

SEQ ID NO: 1174525 - RNA, 22 nt, Human
gccaggcaugguggcucaugcc

SEQ ID NO: 1174526 - RNA, 19 nt, Human
gccccuucccaucuugucu

SEQ ID NO: 1174527 - RNA, 24 nt, Human
gccuggcuaauuuuuuuguauuuu

SEQ ID NO: 1174528 - RNA, 18 nt, Human
gccuggcucacucuuccc

SEQ ID NO: 1174529 - RNA, 20 nt, Human
gcugggauuacaggugucag

SEQ ID NO: 1174530 - RNA, 21 nt, Human
ggaaagauguggaauguccuc

SEQ ID NO: 1174531 - RNA, 19 nt, Human
ggacuacaggcaugagcca

SEQ ID NO: 1174532 - RNA, 22 nt, Human
ggauccuccugccucagccucc

SEQ ID NO: 1174533 - RNA, 22 nt, Human
ggcacaaaaauacaguuagaug

SEQ ID NO: 1174534 - RNA, 18 nt, Human
ggcagggccugguccaua

SEQ ID NO: 1174535 - RNA, 23 nt, Human
ggcucaggugauccuccuaccuc

SEQ ID NO: 1174536 - RNA, 23 nt, Human
gggacuacaggcaugagccacca

SEQ ID NO: 1174537 - RNA, 24 nt, Human
gggauccuccugccucagccuccu

SEQ ID NO: 1174538 - RNA, 23 nt, Human
gggguuuugauauguugcucagg

SEQ ID NO: 1174539 - RNA, 20 nt, Human
ggguucaagugauucuccug

SEQ ID NO: 1174540 - RNA, 21 nt, Human
ggguuucaccauguuggucag

SEQ ID NO: 1174541 - RNA, 22 nt, Human
ggguuucaccauguuggucagg

SEQ ID NO: 1174542 - RNA, 24 nt, Human
gguggcacaugccuguaaucccag

SEQ ID NO: 1174543 - RNA, 19 nt, Human
gguggcucaugccuguaau

SEQ ID NO: 1174544 - RNA, 18 nt, Human
guagcugggauuacaggu

SEQ ID NO: 1174545 - RNA, 24 nt, Human
guaggguuucaccauguuggucag

SEQ ID NO: 1174546 - RNA, 24 nt, Human
gugauccuccuaccucagccuccc

SEQ ID NO: 1174547 - RNA, 24 nt, Human
gugaucugcccaccucagccuccc

SEQ ID NO: 1174548 - RNA, 21 nt, Human
gugauucuccugccucagccu

SEQ ID NO: 1174549 - RNA, 22 nt, Human
gugccuccacacccagcuuaca

SEQ ID NO: 1174550 - RNA, 20 nt, Human
guggcaugaggaguuguggg

SEQ ID NO: 1174551 - RNA, 20 nt, Human
guggcccgcugaguauuagc

SEQ ID NO: 1174552 - RNA, 19 nt, Human
guguccuaauacauaugua

SEQ ID NO: 1174553 - RNA, 19 nt, Human
guuguuccuggugcucucc

SEQ ID NO: 1174554 - RNA, 21 nt, Human
guuugaggugauggauaugca

SEQ ID NO: 1174555 - RNA, 18 nt, Human
uaaaaauaaaagggccua

SEQ ID NO: 1174556 - RNA, 22 nt, Human
uaaaagaaccaacacggaugca

SEQ ID NO: 1174557 - RNA, 26 nt, Human
uaaaagccuuccuuacaaacaccucc

SEQ ID NO: 1174558 - RNA, 21 nt, Human
uaaaccacccacacccaaguc

SEQ ID NO: 1174559 - RNA, 22 nt, Human
uaaaccacccacacccaagucc

SEQ ID NO: 1174560 - RNA, 19 nt, Human
uaaagggagagccgauccu

SEQ ID NO: 1174561 - RNA, 23 nt, Human
uaaaguagcuucaaagcccauuu

SEQ ID NO: 1174562 - RNA, 25 nt, Human
uaaauacuuucacuuaaaaaacaca

SEQ ID NO: 1174563 - RNA, 25 nt, Human
uaaugcaguucucucccaauuguuu

SEQ ID NO: 1174564 - RNA, 20 nt, Human
uaauuggcugauucauucag

SEQ ID NO: 1174565 - RNA, 22 nt, Human
uaauuuuuguauuuuuuguaga

SEQ ID NO: 1174566 - RNA, 24 nt, Human
uaauuuuuguauuuuuuguagaga

SEQ ID NO: 1174567 - RNA, 21 nt, Human
uacaaaaagcaagcccaugga

SEQ ID NO: 1174568 - RNA, 22 nt, Human
uacaaacaccuccaguagaucc

SEQ ID NO: 1174569 - RNA, 25 nt, Human
uacaaagcaguauuucaccagaaga

SEQ ID NO: 1174570 - RNA, 23 nt, Human
uacagcccagaagcacuugcagg

SEQ ID NO: 1174571 - RNA, 22 nt, Human
uacaggcaugagccaccacacc

SEQ ID NO: 1174572 - RNA, 19 nt, Human
uacaggugucagccaccac

SEQ ID NO: 1174573 - RNA, 21 nt, Human
uacauagacaaaaugaaacaa

SEQ ID NO: 1174574 - RNA, 21 nt, Human
uaccccaaaucucagcaucac

SEQ ID NO: 1174575 - RNA, 23 nt, Human
uaccccaaaucucagcaucacac

SEQ ID NO: 1174576 - RNA, 23 nt, Human
uaccucagccucccaaguagcag

SEQ ID NO: 1174577 - RNA, 24 nt, Human
uacuggguucaagugauucuccug

SEQ ID NO: 1174578 - RNA, 23 nt, Human
uacuuuuuuuggaaauaggguga

SEQ ID NO: 1174579 - RNA, 20 nt, Human
uagaauucucugauuucuug

SEQ ID NO: 1174580 - RNA, 18 nt, Human
uagcagggacuacaggca

SEQ ID NO: 1174581 - RNA, 26 nt, Human
uagcucccauggccaggguuccuucc

SEQ ID NO: 1174582 - RNA, 22 nt, Human
uagcuucaaagcccauuugcaa

SEQ ID NO: 1174583 - RNA, 23 nt, Human
uaggguuccucuugcccagauug

SEQ ID NO: 1174584 - RNA, 24 nt, Human
uaggguuucaccauguuggucagg

SEQ ID NO: 1174585 - RNA, 25 nt, Human
uauaaaagccuuccuuacaaacacc

SEQ ID NO: 1174586 - RNA, 26 nt, Human
uauauaguauauaacuauauagugau

SEQ ID NO: 1174587 - RNA, 23 nt, Human
uaucacaacagcgcaagucacac

SEQ ID NO: 1174588 - RNA, 19 nt, Human
uaucaugucuccugccuca

SEQ ID NO: 1174589 - RNA, 24 nt, Human
uauguguuguuccuggugcucucc

SEQ ID NO: 1174590 - RNA, 24 nt, Human
uauguucccugcaccacuggugcc

SEQ ID NO: 1174591 - RNA, 18 nt, Human
uauguugcucaggcuggu

SEQ ID NO: 1174592 - RNA, 23 nt, Human
uauguugcucaggcuggucucaa

SEQ ID NO: 1174593 - RNA, 24 nt, Human
uauguugcucaggcuggucucaaa

SEQ ID NO: 1174594 - RNA, 24 nt, Human
uauguuguccaggcuggucuuaaa

SEQ ID NO: 1174595 - RNA, 22 nt, Human
uauuuggagacagaaucucacc

SEQ ID NO: 1174596 - RNA, 24 nt, Human
uauuuggagacagaaucucaccug

SEQ ID NO: 1174597 - RNA, 23 nt, Human
ucaaaauacauaugaguacaauc

SEQ ID NO: 1174598 - RNA, 23 nt, Human
ucaaagcccauuugcaaauagau

SEQ ID NO: 1174599 - RNA, 21 nt, Human
ucaaagucaaguguagaauuc

SEQ ID NO: 1174600 - RNA, 19 nt, Human
ucaagugauucuccugccu

SEQ ID NO: 1174601 - RNA, 19 nt, Human
ucacacaaaauuuuuugcu

SEQ ID NO: 1174602 - RNA, 23 nt, Human
ucacccuauaaaagccuuccuua

SEQ ID NO: 1174603 - RNA, 19 nt, Human
ucacugcagccucuacauc

SEQ ID NO: 1174604 - RNA, 25 nt, Human
ucacugcagccucuacaucuccagg

SEQ ID NO: 1174605 - RNA, 25 nt, Human
ucagacacauaauuaucaagucaaa

SEQ ID NO: 1174606 - RNA, 22 nt, Human
ucagcaaguggcccgcugagua

SEQ ID NO: 1174607 - RNA, 23 nt, Human
ucagcaaguggcccgcugaguau

SEQ ID NO: 1174608 - RNA, 22 nt, Human
ucagccuccugaguagcuggaa

SEQ ID NO: 1174609 - RNA, 23 nt, Human
ucagcucaccuuucauucagucu

SEQ ID NO: 1174610 - RNA, 19 nt, Human
ucauauccagcuucccaaa

SEQ ID NO: 1174611 - RNA, 21 nt, Human
uccacaauucucaccccuuca

SEQ ID NO: 1174612 - RNA, 24 nt, Human
uccagaguagcugggauuacaggu

SEQ ID NO: 1174613 - RNA, 20 nt, Human
uccaggcucaggugauccuc

SEQ ID NO: 1174614 - RNA, 25 nt, Human
uccaguagauccuucaaccacuuuc

SEQ ID NO: 1174615 - RNA, 23 nt, Human
ucccaaaaugcugggauuacagg

SEQ ID NO: 1174616 - RNA, 22 nt, Human
ucccaaauaaaccacccacacc

SEQ ID NO: 1174617 - RNA, 27 nt, Human
ucccaaauaaaccacccacacccaagu

SEQ ID NO: 1174618 - RNA, 24 nt, Human
ucccaaauugcugggaugacuggc

SEQ ID NO: 1174619 - RNA, 24 nt, Human
ucccaaguagcagggacuacaggc

SEQ ID NO: 1174620 - RNA, 23 nt, Human
ucccucaucuacaaaaugggaau

SEQ ID NO: 1174621 - RNA, 25 nt, Human
ucccugcaccacuggugccuaucuc

SEQ ID NO: 1174622 - RNA, 19 nt, Human
ucccuugugcugccagcaa

SEQ ID NO: 1174623 - RNA, 27 nt, Human
uccuccuaccucagccucccaaguagc

SEQ ID NO: 1174624 - RNA, 21 nt, Human
uccugaacccaagggauccuc

SEQ ID NO: 1174625 - RNA, 24 nt, Human
ucuacuggguucaagugauucucc

SEQ ID NO: 1174626 - RNA, 23 nt, Human
ucucaaacuccugagcucaggca

SEQ ID NO: 1174627 - RNA, 21 nt, Human
ucucaccuguugcccaggcug

SEQ ID NO: 1174628 - RNA, 22 nt, Human
ucucaccuguugcccaggcugg

SEQ ID NO: 1174629 - RNA, 23 nt, Human
ucucaccuguugcccaggcugga

SEQ ID NO: 1174630 - RNA, 23 nt, Human
ucucacucugucacccaggcugg

SEQ ID NO: 1174631 - RNA, 24 nt, Human
ucucacucugucacccaggcugga

SEQ ID NO: 1174632 - RNA, 22 nt, Human
ucuccaggcucaggugauccuc

SEQ ID NO: 1174633 - RNA, 25 nt, Human
ucuccaggcucaggugauccuccua

SEQ ID NO: 1174634 - RNA, 24 nt, Human
ucuccugccucagccuccagagua

SEQ ID NO: 1174635 - RNA, 18 nt, Human
ucucugauuucuuggugc

SEQ ID NO: 1174636 - RNA, 21 nt, Human
ucugcagucccuacucuaagc

SEQ ID NO: 1174637 - RNA, 21 nt, Human
ucugcccaccucagccuccca

SEQ ID NO: 1174638 - RNA, 21 nt, Human
ucugcccaccuuggucuccca

SEQ ID NO: 1174639 - RNA, 25 nt, Human
ucugucacccaggcuggaagugcgg

SEQ ID NO: 1174640 - RNA, 19 nt, Human
ucugugaagaccuguaccc

SEQ ID NO: 1174641 - RNA, 26 nt, Human
ucuuauauucacauauguauuggugu

SEQ ID NO: 1174642 - RNA, 19 nt, Human
ucuuccuauguuguccagg

SEQ ID NO: 1174643 - RNA, 21 nt, Human
ucuuccuauguuguccaggcu

SEQ ID NO: 1174644 - RNA, 23 nt, Human
ucuuccuauguuguccaggcugg

SEQ ID NO: 1174645 - RNA, 24 nt, Human
ucuuccuauguuguccaggcuggu

SEQ ID NO: 1174646 - RNA, 23 nt, Human
ucuucuucucugagauuucuaga

SEQ ID NO: 1174647 - RNA, 18 nt, Human
ugaaaagagcuugugaaa

SEQ ID NO: 1174648 - RNA, 22 nt, Human
ugaaaggaaugacauugagaug

SEQ ID NO: 1174649 - RNA, 21 nt, Human
ugaaaguuccagauaugaaga

SEQ ID NO: 1174650 - RNA, 21 nt, Human
ugaaauggacccagggaagag

SEQ ID NO: 1174651 - RNA, 19 nt, Human
ugaacccgggagugauaua

SEQ ID NO: 1174652 - RNA, 20 nt, Human
ugaagaccuguacccucagu

SEQ ID NO: 1174653 - RNA, 21 nt, Human
ugacauugagauguauuuuca

SEQ ID NO: 1174654 - RNA, 24 nt, Human
ugaccugcucuccuaagaaauuca

SEQ ID NO: 1174655 - RNA, 19 nt, Human
ugacucaaagaaagauucu

SEQ ID NO: 1174656 - RNA, 19 nt, Human
ugacuucauauccagcuuc

SEQ ID NO: 1174657 - RNA, 24 nt, Human
ugagaagcuuugcguaccccugug

SEQ ID NO: 1174658 - RNA, 24 nt, Human
ugagagugaaaaauuaccugaggu

SEQ ID NO: 1174659 - RNA, 18 nt, Human
ugagauauccacagaacu

SEQ ID NO: 1174660 - RNA, 20 nt, Human
ugagaucaacccuccaccuc

SEQ ID NO: 1174661 - RNA, 21 nt, Human
ugagaucaacccuccaccucu

SEQ ID NO: 1174662 - RNA, 20 nt, Human
ugagauuucuagacaguaac

SEQ ID NO: 1174663 - RNA, 24 nt, Human
ugagcacaaauacagcccagaagc

SEQ ID NO: 1174664 - RNA, 24 nt, Human
ugagccagcaggaaggaucucaca

SEQ ID NO: 1174665 - RNA, 20 nt, Human
ugaggcaggaguaucauuug

SEQ ID NO: 1174666 - RNA, 24 nt, Human
ugaggcaggaguaucauuugaacc

SEQ ID NO: 1174667 - RNA, 25 nt, Human
ugaggcaggaguaucauuugaaccc

SEQ ID NO: 1174668 - RNA, 28 nt, Human
ugaggcaggaguaucauuugaacccccu

SEQ ID NO: 1174669 - RNA, 21 nt, Human
ugagucaagugccuucuaacc

SEQ ID NO: 1174670 - RNA, 24 nt, Human
ugaucugcccaccucagccuccca

SEQ ID NO: 1174671 - RNA, 19 nt, Human
ugauuugaucacuacacag

SEQ ID NO: 1174672 - RNA, 19 nt, Human
ugcaaaaagagauuggaaa

SEQ ID NO: 1174673 - RNA, 19 nt, Human
ugcaauggcaguuaaugcc

SEQ ID NO: 1174674 - RNA, 18 nt, Human
ugcaccacugucccagcc

SEQ ID NO: 1174675 - RNA, 18 nt, Human
ugcaugggcagggccugg

SEQ ID NO: 1174676 - RNA, 19 nt, Human
ugccauucaauuucugcag

SEQ ID NO: 1174677 - RNA, 19 nt, Human
ugccauucaauuucugcag

SEQ ID NO: 1174678 - RNA, 22 nt, Human
ugcccaccuuggucucccaaaa

SEQ ID NO: 1174679 - RNA, 21 nt, Human
ugcccaggcuggaguucagug

SEQ ID NO: 1174680 - RNA, 24 nt, Human
ugcccaggcuggaguucaguggca

SEQ ID NO: 1174681 - RNA, 24 nt, Human
ugccucagccuccagaguagcugg

SEQ ID NO: 1174682 - RNA, 24 nt, Human
ugccucagccuccugaguagcugg

SEQ ID NO: 1174683 - RNA, 19 nt, Human
ugccugagcacaaauacag

SEQ ID NO: 1174684 - RNA, 28 nt, Human
ugccugagcacaaauacagcccagaagc

SEQ ID NO: 1174685 - RNA, 21 nt, Human
ugccugauccaugaaucucug

SEQ ID NO: 1174686 - RNA, 20 nt, Human
ugccuggauuugcauguggg

SEQ ID NO: 1174687 - RNA, 24 nt, Human
ugccuguaaucccagcuacucagg

SEQ ID NO: 1174688 - RNA, 24 nt, Human
ugcucaggcuggucucaaacucuu

SEQ ID NO: 1174689 - RNA, 21 nt, Human
ugcucuccugucccucuuuca

SEQ ID NO: 1174690 - RNA, 18 nt, Human
ugcugggaugacuggcau

SEQ ID NO: 1174691 - RNA, 20 nt, Human
ugcugggauuacagguguca

SEQ ID NO: 1174692 - RNA, 21 nt, Human
uggaaggaacagaagaauuuc

SEQ ID NO: 1174693 - RNA, 24 nt, Human
uggaauuauagacaugugccucca

SEQ ID NO: 1174694 - RNA, 19 nt, Human
uggacaagcacaguuugcg

SEQ ID NO: 1174695 - RNA, 21 nt, Human
uggacaagcacaguuugcgcu

SEQ ID NO: 1174696 - RNA, 18 nt, Human
uggacucaagugaucugc

SEQ ID NO: 1174697 - RNA, 22 nt, Human
uggacucaagugaucugcccac

SEQ ID NO: 1174698 - RNA, 19 nt, Human
uggaguucaguggcaugau

SEQ ID NO: 1174699 - RNA, 19 nt, Human
uggaguucaguggcaugau

SEQ ID NO: 1174700 - RNA, 23 nt, Human
uggaucuuccuauguuguccagg

SEQ ID NO: 1174701 - RNA, 21 nt, Human
uggcacaugccuguaauccca

SEQ ID NO: 1174702 - RNA, 22 nt, Human
uggcacaugccuguaaucccag

SEQ ID NO: 1174703 - RNA, 20 nt, Human
uggcaggagccucaauagca

SEQ ID NO: 1174704 - RNA, 23 nt, Human
uggcaugaucacagcucacugca

SEQ ID NO: 1174705 - RNA, 24 nt, Human
uggcaugaucucagcuuacugcaa

SEQ ID NO: 1174706 - RNA, 22 nt, Human
ugggacagggucucacucuguc

SEQ ID NO: 1174707 - RNA, 21 nt, Human
ugggagagcauuaggcugaga

SEQ ID NO: 1174708 - RNA, 21 nt, Human
ugggauuacaggugcacacca

SEQ ID NO: 1174709 - RNA, 19 nt, Human
ugggauuacaggugcacca

SEQ ID NO: 1174710 - RNA, 18 nt, Human
ugggauuacaggugucag

SEQ ID NO: 1174711 - RNA, 19 nt, Human
ugggauuacaggugucagc

SEQ ID NO: 1174712 - RNA, 22 nt, Human
ugggauuacaggugucagccac

SEQ ID NO: 1174713 - RNA, 24 nt, Human
ugggauuacaggugucagccacca

SEQ ID NO: 1174714 - RNA, 23 nt, Human
uggguucaagugauucuccugcc

SEQ ID NO: 1174715 - RNA, 24 nt, Human
uggguucaagugauucuccugccu

SEQ ID NO: 1174716 - RNA, 24 nt, Human
uggucaggcuggucucaaacuccu

SEQ ID NO: 1174717 - RNA, 24 nt, Human
ugguggcacaugccuguaauccca

SEQ ID NO: 1174718 - RNA, 18 nt, Human
ugguggcucaugccugua

SEQ ID NO: 1174719 - RNA, 23 nt, Human
ugguguccuaauacauauguaug

SEQ ID NO: 1174720 - RNA, 24 nt, Human
uguagagacgggguuuugauaugu

SEQ ID NO: 1174721 - RNA, 24 nt, Human
uguccaggcuggucuuaaacuccu

SEQ ID NO: 1174722 - RNA, 23 nt, Human
uguucuauucuccuacuucgaua

SEQ ID NO: 1174723 - RNA, 24 nt, Human
uguugccaggcaugguggcucaug

SEQ ID NO: 1174724 - RNA, 20 nt, Human
uguugcucaggcuggucuca

SEQ ID NO: 1174725 - RNA, 18 nt, Human
uuaaaguagcuucaaagc

SEQ ID NO: 1174726 - RNA, 22 nt, Human
uuaaaguagcuucaaagcccau

SEQ ID NO: 1174727 - RNA, 24 nt, Human
uuacugcaaccuuccucuacuggg

SEQ ID NO: 1174728 - RNA, 22 nt, Human
uuagaccauugagcacuuuugu

SEQ ID NO: 1174729 - RNA, 18 nt, Human
uuagcccaucagcaagug

SEQ ID NO: 1174730 - RNA, 22 nt, Human
uuaggcugagauagcucccaug

SEQ ID NO: 1174731 - RNA, 18 nt, Human
uuaguaggguuucaccau

SEQ ID NO: 1174732 - RNA, 20 nt, Human
uucaaaaugacuacaggaaa

SEQ ID NO: 1174733 - RNA, 21 nt, Human
uucaagugauucuccugccuc

SEQ ID NO: 1174734 - RNA, 23 nt, Human
uucaagugauucuccugccucag

SEQ ID NO: 1174735 - RNA, 24 nt, Human
uucaagugauucuccugccucagc

SEQ ID NO: 1174736 - RNA, 27 nt, Human
uucauucauaccccaaaucucagcauc

SEQ ID NO: 1174737 - RNA, 24 nt, Human
uucccugggucccuuuuccuuagc

SEQ ID NO: 1174738 - RNA, 21 nt, Human
uugcugggaugacuggcaugc

SEQ ID NO: 1174739 - RNA, 24 nt, Human
uuggagacagaaucucaccuguug

SEQ ID NO: 1174740 - RNA, 19 nt, Human
uuggcuuuucuuucuugcc

SEQ ID NO: 1174741 - RNA, 22 nt, Human
uuguagagacgggguuuugaua

SEQ ID NO: 1174742 - RNA, 24 nt, Human
uuguagagacgggguuuugauaug

SEQ ID NO: 1174743 - RNA, 18 nt, Human
uuuaguaggguuucacca

SEQ ID NO: 1174744 - RNA, 19 nt, Human
uuucaccagaagaugcuac

SEQ ID NO: 1174745 - RNA, 24 nt, Human
uuucaccauguuggucaggcuggu

SEQ ID NO: 1174746 - RNA, 20 nt, Human
uuucugcccuagggcaucuc

SEQ ID NO: 1174747 - RNA, 20 nt, Human
uuuguagagacgggguuuug

SEQ ID NO: 1174748 - RNA, 24 nt, Human
uuuguagagacgggguuuugauau

SEQ ID NO: 1174749 - RNA, 18 nt, Human
uuuucacauugcuaaguu

SEQ ID NO: 1174750 - RNA, 21 nt, Human
uuuucugcaagucacacaaaa

SEQ ID NO: 1174751 - RNA, 23 nt, Human
uuuugauauguugcucaggcugg

SEQ ID NO: 1174752 - RNA, 20 nt, Human
uuuuuguauuuuuuguagag

SEQ ID NO: 1174753 - RNA, 23 nt, Human
uuuuuguauuuuuuguagagacg

SEQ ID NO: 1174754 - RNA, 21 nt, Human
uuuuuuguagagacgggguuu

SEQ ID NO: 1174755 - RNA, 18 nt, Human
uuuuuuguauuuuuagua

SEQ ID NO: 1174756 - RNA, 19 nt, Human
uuuuuuguauuuuuaguag

SEQ ID NO: 1174757 - RNA, 19 nt, Human
aaaaugacuuucuguaaca

SEQ ID NO: 1174758 - RNA, 20 nt, Human
aaaugcuaaaguaacaguag

SEQ ID NO: 1174759 - RNA, 24 nt, Human
aagaaaaagauaagugcaucacaa

SEQ ID NO: 1174760 - RNA, 20 nt, Human
aaucauuugcuucugauuca

SEQ ID NO: 1174761 - RNA, 21 nt, Human
acaccaaggcccaaaucaaca

SEQ ID NO: 1174762 - RNA, 26 nt, Human
acaccaaggcccaaaucaacaagaaa

SEQ ID NO: 1174763 - RNA, 19 nt, Human
acgcuccccagauggagga

SEQ ID NO: 1174764 - RNA, 23 nt, Human
acuggguacauacacucaaccau

SEQ ID NO: 1174765 - RNA, 25 nt, Human
agaaaaagauaagugcaucacaaaa

SEQ ID NO: 1174766 - RNA, 24 nt, Human
agacaaaaaaggaacauaaaauga

SEQ ID NO: 1174767 - RNA, 21 nt, Human
agacgcuccccagauggagga

SEQ ID NO: 1174768 - RNA, 18 nt, Human
agauggaggagguggggu

SEQ ID NO: 1174769 - RNA, 19 nt, Human
agcagccagaggaggcaga

SEQ ID NO: 1174770 - RNA, 19 nt, Human
aggaucaacuauugaaaau

SEQ ID NO: 1174771 - RNA, 21 nt, Human
aggcccccgcagacgcucccc

SEQ ID NO: 1174772 - RNA, 19 nt, Human
auaagaauaaauuuuaaaa

SEQ ID NO: 1174773 - RNA, 26 nt, Human
caacacugaaaaguugaaaaggaaaa

SEQ ID NO: 1174774 - RNA, 18 nt, Human
caauaagcacaaaaacau

SEQ ID NO: 1174775 - RNA, 19 nt, Human
cacaauagcacuaaagaga

SEQ ID NO: 1174776 - RNA, 18 nt, Human
cacaccaaggcccaaauc

SEQ ID NO: 1174777 - RNA, 21 nt, Human
cacaccaaggcccaaaucaac

SEQ ID NO: 1174778 - RNA, 23 nt, Human
cacaccaaggcccaaaucaacaa

SEQ ID NO: 1174779 - RNA, 21 nt, Human
caccaaggcccaaaucaacaa

SEQ ID NO: 1174780 - RNA, 24 nt, Human
cagccgccgccgccgccgccgccc

SEQ ID NO: 1174781 - RNA, 23 nt, Human
cagcuuuaccagaguaaagaagu

SEQ ID NO: 1174782 - RNA, 20 nt, Human
caggcccccgcagacgcucc

SEQ ID NO: 1174783 - RNA, 24 nt, Human
cagguaaauauacuucacaccaag

SEQ ID NO: 1174784 - RNA, 19 nt, Human
caucacaaaacaacuaacc

SEQ ID NO: 1174785 - RNA, 22 nt, Human
ccacacaguggcacucuuaaaa

SEQ ID NO: 1174786 - RNA, 18 nt, Human
ccagaguaaagaagugca

SEQ ID NO: 1174787 - RNA, 20 nt, Human
ccccagauggaggagguggg

SEQ ID NO: 1174788 - RNA, 22 nt, Human
cccgcagacgcuccccagaugg

SEQ ID NO: 1174789 - RNA, 19 nt, Human
ccgccgccgccccucaggc

SEQ ID NO: 1174790 - RNA, 21 nt, Human
ccgccgccgccccucaggccc

SEQ ID NO: 1174791 - RNA, 21 nt, Human
ccgccgccgccgccgccccuc

SEQ ID NO: 1174792 - RNA, 18 nt, Human
ccgccgccgccgccgccg

SEQ ID NO: 1174793 - RNA, 24 nt, Human
ccuccuuaacggaaaggugaggac

SEQ ID NO: 1174794 - RNA, 20 nt, Human
cgcacaacauuaaccaugaa

SEQ ID NO: 1174795 - RNA, 22 nt, Human
cgcacaacauuaaccaugaaau

SEQ ID NO: 1174796 - RNA, 22 nt, Human
cgccgccgccccucaggccccc

SEQ ID NO: 1174797 - RNA, 27 nt, Human
cucaggcccccgcagacgcuccccaga

SEQ ID NO: 1174798 - RNA, 26 nt, Human
cucuuccaagugcaaacccuuucaaa

SEQ ID NO: 1174799 - RNA, 19 nt, Human
cuguaaaccucugcauuuc

SEQ ID NO: 1174800 - RNA, 20 nt, Human
gaaagggaaaauucccacag

SEQ ID NO: 1174801 - RNA, 22 nt, Human
gacaaaaaaggaacauaaaaug

SEQ ID NO: 1174802 - RNA, 20 nt, Human
gauagugcuaaaugcuaaag

SEQ ID NO: 1174803 - RNA, 22 nt, Human
gcacuaaagagaaaaagguacc

SEQ ID NO: 1174804 - RNA, 21 nt, Human
gcagccagaggaggcagagga

SEQ ID NO: 1174805 - RNA, 22 nt, Human
gccgccgccgccgccgccgccc

SEQ ID NO: 1174806 - RNA, 23 nt, Human
ggagccuggacugaaaggggcuu

SEQ ID NO: 1174807 - RNA, 21 nt, Human
gguaggaggagggagcugcgg

SEQ ID NO: 1174808 - RNA, 22 nt, Human
uaaccacuugaaaaaaaaaucc

SEQ ID NO: 1174809 - RNA, 21 nt, Human
uacacucaaccauuuauauca

SEQ ID NO: 1174810 - RNA, 22 nt, Human
uacgcacaacauuaaccaugaa

SEQ ID NO: 1174811 - RNA, 23 nt, Human
uauaagaauaaauuuuaaaauug

SEQ ID NO: 1174812 - RNA, 21 nt, Human
uauacuucacaccaaggcccu

SEQ ID NO: 1174813 - RNA, 20 nt, Human
ucacaauaagcacaaaaaca

SEQ ID NO: 1174814 - RNA, 19 nt, Human
ucagaaacacagaaaggca

SEQ ID NO: 1174815 - RNA, 20 nt, Human
ucagaaacacagaaaggcau

SEQ ID NO: 1174816 - RNA, 19 nt, Human
ucauuugcuucugauucag

SEQ ID NO: 1174817 - RNA, 21 nt, Human
uccccagauggaggagguggg

SEQ ID NO: 1174818 - RNA, 24 nt, Human
ucgcagccgccgccgccgccgccg

SEQ ID NO: 1174819 - RNA, 22 nt, Human
ucugcuaugacaugagucacuc

SEQ ID NO: 1174820 - RNA, 19 nt, Human
ucuguaaaccucugcauuu

SEQ ID NO: 1174821 - RNA, 25 nt, Human
ugaaaaaaaaauccacacaguggca

SEQ ID NO: 1174822 - RNA, 21 nt, Human
ugaaaaggaaaacauauagca

SEQ ID NO: 1174823 - RNA, 18 nt, Human
ugaaacuuuaagcuuucu

SEQ ID NO: 1174824 - RNA, 23 nt, Human
ugagaaguagaaaaaaauagcaa

SEQ ID NO: 1174825 - RNA, 22 nt, Human
ugaugcugucaaaugagcuuuu

SEQ ID NO: 1174826 - RNA, 22 nt, Human
ugcaaacccuuucaaaaaggug

SEQ ID NO: 1174827 - RNA, 19 nt, Human
uggaggaggugggguagga

SEQ ID NO: 1174828 - RNA, 19 nt, Human
ugggguaggaggagggagc

SEQ ID NO: 1174829 - RNA, 19 nt, Human
uggguacauacacucaacc

SEQ ID NO: 1174830 - RNA, 24 nt, Human
uuaagauaccaaaaggucaaaacc

SEQ ID NO: 1174831 - RNA, 25 nt, Human
uuaagauaccaaaaggucaaaacca

SEQ ID NO: 1174832 - RNA, 21 nt, Human
uuacauuguuccuugcuuaaa

SEQ ID NO: 1174833 - RNA, 22 nt, Human
uucuaugauagugcuaaaugcu

SEQ ID NO: 1174834 - RNA, 24 nt, Human
aaacucaguuugcaaauuuccugc

SEQ ID NO: 1174835 - RNA, 23 nt, Human
aaagauccucuguuggccucuga

SEQ ID NO: 1174836 - RNA, 20 nt, Human
aaccagagacucucugccuc

SEQ ID NO: 1174837 - RNA, 19 nt, Human
aaugacaggaaaccagaga

SEQ ID NO: 1174838 - RNA, 20 nt, Human
acaggcaaaggcccagcaca

SEQ ID NO: 1174839 - RNA, 24 nt, Human
accaaagccacagggacacaacug

SEQ ID NO: 1174840 - RNA, 21 nt, Human
acccgaggcagcccauacccc

SEQ ID NO: 1174841 - RNA, 21 nt, Human
acccucugcugauccuaacuu

SEQ ID NO: 1174842 - RNA, 21 nt, Human
agcacaauggccggaggcccu

SEQ ID NO: 1174843 - RNA, 22 nt, Human
agccccacuuacccugucugac

SEQ ID NO: 1174844 - RNA, 24 nt, Human
aggaaaccagagacucucugccuc

SEQ ID NO: 1174845 - RNA, 18 nt, Human
aggcgcaccaaagccaca

SEQ ID NO: 1174846 - RNA, 20 nt, Human
agguagcccaguggcuggga

SEQ ID NO: 1174847 - RNA, 22 nt, Human
aucuccacccccaccuccccag

SEQ ID NO: 1174848 - RNA, 19 nt, Human
aucugccagggcccuccuc

SEQ ID NO: 1174849 - RNA, 23 nt, Human
caacccgaggcagcccauacccc

SEQ ID NO: 1174850 - RNA, 19 nt, Human
cacacaggcgcaccaaagc

SEQ ID NO: 1174851 - RNA, 21 nt, Human
caccuccccagccagaggccc

SEQ ID NO: 1174852 - RNA, 21 nt, Human
cagcccauaccccagaaacag

SEQ ID NO: 1174853 - RNA, 24 nt, Human
cagcccauaccccagaaacagccu

SEQ ID NO: 1174854 - RNA, 20 nt, Human
cagccccguuagagagaaga

SEQ ID NO: 1174855 - RNA, 21 nt, Human
cagccugucagaaguugccag

SEQ ID NO: 1174856 - RNA, 19 nt, Human
caggagguagcccaguggc

SEQ ID NO: 1174857 - RNA, 20 nt, Human
cagugcacacuggcaucucu

SEQ ID NO: 1174858 - RNA, 20 nt, Human
cagugcacacuggcaucucu

SEQ ID NO: 1174859 - RNA, 24 nt, Human
cauccaggauccgguccugggcac

SEQ ID NO: 1174860 - RNA, 19 nt, Human
ccaaagccacagggacaca

SEQ ID NO: 1174861 - RNA, 25 nt, Human
ccacccccaccuccccagccagagg

SEQ ID NO: 1174862 - RNA, 29 nt, Human
ccagagacucucugccucagagacuacag

SEQ ID NO: 1174863 - RNA, 22 nt, Human
ccagggcccuccucuacccucu

SEQ ID NO: 1174864 - RNA, 20 nt, Human
ccccacaucugccagggccc

SEQ ID NO: 1174865 - RNA, 23 nt, Human
cccucgcacccacaccugucuca

SEQ ID NO: 1174866 - RNA, 19 nt, Human
cccuguagucucccuucca

SEQ ID NO: 1174867 - RNA, 18 nt, Human
cccuuccagcuuuguccc

SEQ ID NO: 1174868 - RNA, 21 nt, Human
ccuacuggaucuccaccccca

SEQ ID NO: 1174869 - RNA, 20 nt, Human
ccuggggcuucagugcacac

SEQ ID NO: 1174870 - RNA, 22 nt, Human
ccuucuuuccuuucuccuuccc

SEQ ID NO: 1174871 - RNA, 24 nt, Human
cgaggcagcccauaccccagaaac

SEQ ID NO: 1174872 - RNA, 22 nt, Human
cgcaccaaagccacagggacac

SEQ ID NO: 1174873 - RNA, 19 nt, Human
cuacuggaucuccaccccc

SEQ ID NO: 1174874 - RNA, 18 nt, Human
cucacaccucggucccaa

SEQ ID NO: 1174875 - RNA, 18 nt, Human
cuccacccccaccucccc

SEQ ID NO: 1174876 - RNA, 19 nt, Human
cuccagguggagggagaaa

SEQ ID NO: 1174877 - RNA, 20 nt, Human
cucccgcugaugccaaugac

SEQ ID NO: 1174878 - RNA, 18 nt, Human
cucugccucagagacuac

SEQ ID NO: 1174879 - RNA, 21 nt, Human
cucugccucagagacuacagg

SEQ ID NO: 1174880 - RNA, 18 nt, Human
cugccaggagguagccca

SEQ ID NO: 1174881 - RNA, 20 nt, Human
cuucuuuccuuucuccuucc

SEQ ID NO: 1174882 - RNA, 20 nt, Human
gaggcggugggcaggggaac

SEQ ID NO: 1174883 - RNA, 21 nt, Human
gagggagccccacuuacccug

SEQ ID NO: 1174884 - RNA, 20 nt, Human
gaucuccacccccaccuccc

SEQ ID NO: 1174885 - RNA, 21 nt, Human
gcaccaaagccacagggacac

SEQ ID NO: 1174886 - RNA, 18 nt, Human
gccagaggcccucaaucc

SEQ ID NO: 1174887 - RNA, 25 nt, Human
gcgcaccaaagccacagggacacaa

SEQ ID NO: 1174888 - RNA, 18 nt, Human
ggcucugccuucuuuccu

SEQ ID NO: 1174889 - RNA, 21 nt, Human
gggaacucuuuucuuuccuug

SEQ ID NO: 1174890 - RNA, 18 nt, Human
gguccugggcacgcccug

SEQ ID NO: 1174891 - RNA, 26 nt, Human
uaacagcaacaacccgaggcagccca

SEQ ID NO: 1174892 - RNA, 25 nt, Human
uaacuccuguccucuucuagacccc

SEQ ID NO: 1174893 - RNA, 23 nt, Human
uaccccagaaacagccugucaga

SEQ ID NO: 1174894 - RNA, 22 nt, Human
uagcccaguggcugggaggcgg

SEQ ID NO: 1174895 - RNA, 23 nt, Human
uauugcuccuacuggaucuccac

SEQ ID NO: 1174896 - RNA, 23 nt, Human
ucaggugauggggcaggcccugc

SEQ ID NO: 1174897 - RNA, 25 nt, Human
ucagugcacacuggcaucucuggaa

SEQ ID NO: 1174898 - RNA, 21 nt, Human
uccagccccguuagagagaag

SEQ ID NO: 1174899 - RNA, 19 nt, Human
uccagguggagggagaaag

SEQ ID NO: 1174900 - RNA, 24 nt, Human
uccccagccagaggcccucaaucc

SEQ ID NO: 1174901 - RNA, 25 nt, Human
uccucuguuauugcuccuacuggau

SEQ ID NO: 1174902 - RNA, 19 nt, Human
uccucuucuagaccccaca

SEQ ID NO: 1174903 - RNA, 21 nt, Human
ucucugccucagagacuacag

SEQ ID NO: 1174904 - RNA, 20 nt, Human
ucugccagggcccuccucua

SEQ ID NO: 1174905 - RNA, 23 nt, Human
ucugccagggcccuccucuaccc

SEQ ID NO: 1174906 - RNA, 21 nt, Human
ucugccuucuuuccuuucucc

SEQ ID NO: 1174907 - RNA, 19 nt, Human
ucugcugugggcaaaagau

SEQ ID NO: 1174908 - RNA, 21 nt, Human
ucuucuagaccccacaucugc

SEQ ID NO: 1174909 - RNA, 18 nt, Human
ucuuuccuuucuccuucc

SEQ ID NO: 1174910 - RNA, 22 nt, Human
ugccagggcccuccucuacccu

SEQ ID NO: 1174911 - RNA, 22 nt, Human
ugccuggggcuucagugcacac

SEQ ID NO: 1174912 - RNA, 21 nt, Human
uggccucugaccccuccuccc

SEQ ID NO: 1174913 - RNA, 18 nt, Human
ugggaggcggugggcagg

SEQ ID NO: 1174914 - RNA, 22 nt, Human
uguaacagcaacaacccgaggc

SEQ ID NO: 1174915 - RNA, 18 nt, Human
ugucucagaaguucgucg

SEQ ID NO: 1174916 - RNA, 26 nt, Human
ugucucagaaguucgucgaccgacgg

SEQ ID NO: 1174917 - RNA, 19 nt, Human
uguuagcccaugcuccagg

SEQ ID NO: 1174918 - RNA, 20 nt, Human
uuagagagaagaggggaggg

SEQ ID NO: 1174919 - RNA, 19 nt, Human
uuagcccaugcuccaggug

SEQ ID NO: 1174920 - RNA, 21 nt, Human
uucccuccucacaccucgguc

SEQ ID NO: 1174921 - RNA, 23 nt, Human
uugcaaauuuccugccaggaggu

SEQ ID NO: 1174922 - RNA, 19 nt, Human
uuugcaaauuuccugccag

SEQ ID NO: 1174923 - RNA, 18 nt, Human
aaacagaucuccacccau

SEQ ID NO: 1174924 - RNA, 23 nt, Human
aaagggaagcucugggcaaagag

SEQ ID NO: 1174925 - RNA, 21 nt, Human
aacaucauccugacagugcca

SEQ ID NO: 1174926 - RNA, 22 nt, Human
acaaagagaagagucaggaagc

SEQ ID NO: 1174927 - RNA, 23 nt, Human
acaccgaugaccuuaccaaggcc

SEQ ID NO: 1174928 - RNA, 28 nt, Human
accaguggaaaaaagcagccgagagaga

SEQ ID NO: 1174929 - RNA, 19 nt, Human
accucuucaugccuccuca

SEQ ID NO: 1174930 - RNA, 20 nt, Human
agaaaagggaagcugggguu

SEQ ID NO: 1174931 - RNA, 22 nt, Human
agaaaagggaagcugggguuuc

SEQ ID NO: 1174932 - RNA, 19 nt, Human
agacaaaacagaucuccac

SEQ ID NO: 1174933 - RNA, 19 nt, Human
agacaaagagaagagucag

SEQ ID NO: 1174934 - RNA, 24 nt, Human
agacaggagcccagcucaaaucug

SEQ ID NO: 1174935 - RNA, 20 nt, Human
agacuuauaguggagcuguu

SEQ ID NO: 1174936 - RNA, 23 nt, Human
agggcagccaacuaggcccugug

SEQ ID NO: 1174937 - RNA, 25 nt, Human
auugcaauuugauuaacaaggagaa

SEQ ID NO: 1174938 - RNA, 20 nt, Human
caaaacagaucuccacccau

SEQ ID NO: 1174939 - RNA, 23 nt, Human
caaagcaucacaaagacucuaau

SEQ ID NO: 1174940 - RNA, 23 nt, Human
caaaugacuuuggagugcuaaaa

SEQ ID NO: 1174941 - RNA, 23 nt, Human
caaggagacaggagcccagcuca

SEQ ID NO: 1174942 - RNA, 20 nt, Human
cacauagaaaagggaagcuu

SEQ ID NO: 1174943 - RNA, 23 nt, Human
cacaucacaaagcaucacaaaga

SEQ ID NO: 1174944 - RNA, 20 nt, Human
cagacaaaacagaucuccaa

SEQ ID NO: 1174945 - RNA, 22 nt, Human
cagacaaaacagaucuccaccc

SEQ ID NO: 1174946 - RNA, 19 nt, Human
cagagucccccagcucauc

SEQ ID NO: 1174947 - RNA, 20 nt, Human
cagggcagacaaagagaaga

SEQ ID NO: 1174948 - RNA, 18 nt, Human
cagugccaaccacaaacc

SEQ ID NO: 1174949 - RNA, 18 nt, Human
ccacggacaacaucaucc

SEQ ID NO: 1174950 - RNA, 20 nt, Human
ccacuuccuaccacagcuag

SEQ ID NO: 1174951 - RNA, 22 nt, Human
ccaguggaaaaaagcagccgag

SEQ ID NO: 1174952 - RNA, 19 nt, Human
cccaucacuccccaaaaua

SEQ ID NO: 1174953 - RNA, 21 nt, Human
cccccagcucauccucaauau

SEQ ID NO: 1174954 - RNA, 24 nt, Human
ccuaagaaaagcaacuccaggacu

SEQ ID NO: 1174955 - RNA, 23 nt, Human
ccucacacgcacaucacaaagca

SEQ ID NO: 1174956 - RNA, 24 nt, Human
ccucuacgucaucgugcccaaggg

SEQ ID NO: 1174957 - RNA, 26 nt, Human
cuaauaccuuccaucuacacaaccuc

SEQ ID NO: 1174958 - RNA, 23 nt, Human
cuccucuacgucaucgugcccaa

SEQ ID NO: 1174959 - RNA, 21 nt, Human
cuggcuuagguccugcuagaa

SEQ ID NO: 1174960 - RNA, 22 nt, Human
gaaaagcaacuccaggacucca

SEQ ID NO: 1174961 - RNA, 19 nt, Human
gagggagagagaaucaacc

SEQ ID NO: 1174962 - RNA, 22 nt, Human
gcccugugccugucacuaucag

SEQ ID NO: 1174963 - RNA, 19 nt, Human
gggaaguuggagaaguggg

SEQ ID NO: 1174964 - RNA, 19 nt, Human
ggggagagcuggccacgga

SEQ ID NO: 1174965 - RNA, 21 nt, Human
ggggagcugugccugccccau

SEQ ID NO: 1174966 - RNA, 19 nt, Human
gggugguugcuaaauggga

SEQ ID NO: 1174967 - RNA, 20 nt, Human
guauuuuucagcucaaggga

SEQ ID NO: 1174968 - RNA, 22 nt, Human
gucaggugaagacuuauagugg

SEQ ID NO: 1174969 - RNA, 18 nt, Human
guccugcuagaagaaccc

SEQ ID NO: 1174970 - RNA, 23 nt, Human
uaaguuuccaugccuagcacaua

SEQ ID NO: 1174971 - RNA, 18 nt, Human
uacacaaccucacacgca

SEQ ID NO: 1174972 - RNA, 19 nt, Human
uaccacagcuagggucccu

SEQ ID NO: 1174973 - RNA, 24 nt, Human
ucacaaagacucuaauuucuccaa

SEQ ID NO: 1174974 - RNA, 26 nt, Human
ucacacgcacaucacaaagcaucaca

SEQ ID NO: 1174975 - RNA, 23 nt, Human
ucaugggucccaugugcaaacuc

SEQ ID NO: 1174976 - RNA, 21 nt, Human
uccaaaugacuuuggagugcu

SEQ ID NO: 1174977 - RNA, 21 nt, Human
uccaugauauuuauucccagg

SEQ ID NO: 1174978 - RNA, 21 nt, Human
uccccaaaauaugcccuacau

SEQ ID NO: 1174979 - RNA, 23 nt, Human
uccccagacuggcuuagguccug

SEQ ID NO: 1174980 - RNA, 23 nt, Human
ucccuggggagagcuggccacgg

SEQ ID NO: 1174981 - RNA, 18 nt, Human
uccuugacucugagggcc

SEQ ID NO: 1174982 - RNA, 22 nt, Human
ucgcuggaggaguggaagaggc

SEQ ID NO: 1174983 - RNA, 18 nt, Human
ucugucagcauucuuucu

SEQ ID NO: 1174984 - RNA, 25 nt, Human
ugauugauagaaagaaaaggaaggg

SEQ ID NO: 1174985 - RNA, 23 nt, Human
ugccaggaucagccuggucucuu

SEQ ID NO: 1174986 - RNA, 20 nt, Human
ugccuggcagaaagacacaa

SEQ ID NO: 1174987 - RNA, 18 nt, Human
uggaaaaaagcagccgag

SEQ ID NO: 1174988 - RNA, 19 nt, Human
uggaggcagaagauacgga

SEQ ID NO: 1174989 - RNA, 19 nt, Human
uggcagaugccgugggaac

SEQ ID NO: 1174990 - RNA, 18 nt, Human
uggcggccagaaagggaa

SEQ ID NO: 1174991 - RNA, 19 nt, Human
ugggagggaacauggaggc

SEQ ID NO: 1174992 - RNA, 18 nt, Human
ugggcaaagagggagaga

SEQ ID NO: 1174993 - RNA, 20 nt, Human
ugggcaaagagggagagaga

SEQ ID NO: 1174994 - RNA, 18 nt, Human
ugguggagagaaagagga

SEQ ID NO: 1174995 - RNA, 23 nt, Human
ugguugcuaaaugggagagggau

SEQ ID NO: 1174996 - RNA, 21 nt, Human
uuaccaguggaaaaaagcagc

SEQ ID NO: 1174997 - RNA, 19 nt, Human
uucacagaggacagagcag

SEQ ID NO: 1174998 - RNA, 20 nt, Human
uuccaugauauuuauuccca

SEQ ID NO: 1174999 - RNA, 23 nt, Human
uucugcacaaacucugguuuuau

SEQ ID NO: 1175000 - RNA, 18 nt, Human
uuugccaggaucagccug

SEQ ID NO: 1175001 - RNA, 22 nt, Human
aaaccguacggugaaggaacac

SEQ ID NO: 1175002 - RNA, 20 nt, Human
aaagguaaacauuucugcag

SEQ ID NO: 1175003 - RNA, 22 nt, Human
aacacuuuuuauuacagaaacc

SEQ ID NO: 1175004 - RNA, 21 nt, Human
aagaaacuaugaguaacaagc

SEQ ID NO: 1175005 - RNA, 21 nt, Human
aagcuauaacauaguucacca

SEQ ID NO: 1175006 - RNA, 21 nt, Human
acaaaagggaggagagcagaa

SEQ ID NO: 1175007 - RNA, 19 nt, Human
acauucuaaagccaaguaa

SEQ ID NO: 1175008 - RNA, 18 nt, Human
accgaaaaaaugaucaaa

SEQ ID NO: 1175009 - RNA, 21 nt, Human
acggugaaggaacacaacaga

SEQ ID NO: 1175010 - RNA, 21 nt, Human
agcgcugacgggaacaucugc

SEQ ID NO: 1175011 - RNA, 20 nt, Human
aggccagcgcccacgguccc

SEQ ID NO: 1175012 - RNA, 18 nt, Human
agggagccacguuccuug

SEQ ID NO: 1175013 - RNA, 19 nt, Human
aucugcuugggguggcauc

SEQ ID NO: 1175014 - RNA, 23 nt, Human
caagacuaauauaaauucacucc

SEQ ID NO: 1175015 - RNA, 18 nt, Human
caaugggacccccccccc

SEQ ID NO: 1175016 - RNA, 20 nt, Human
cacauaggaaaaagagguac

SEQ ID NO: 1175017 - RNA, 24 nt, Human
cacccuacaguuaguaauauuaca

SEQ ID NO: 1175018 - RNA, 18 nt, Human
cagaaaccguacggugaa

SEQ ID NO: 1175019 - RNA, 21 nt, Human
cauauacaauaugcauaugug

SEQ ID NO: 1175020 - RNA, 20 nt, Human
ccacaaugggaccccccccc

SEQ ID NO: 1175021 - RNA, 19 nt, Human
ccagcgcccacggucccag

SEQ ID NO: 1175022 - RNA, 24 nt, Human
cccacggucccaggagcgccuccc

SEQ ID NO: 1175023 - RNA, 19 nt, Human
ccccccccccuuuuucuca

SEQ ID NO: 1175024 - RNA, 19 nt, Human
cccccccccuuuuucucac

SEQ ID NO: 1175025 - RNA, 20 nt, Human
ccugaauucaugagcaguug

SEQ ID NO: 1175026 - RNA, 22 nt, Human
cgaaaaaaugaucaaaaagaaa

SEQ ID NO: 1175027 - RNA, 25 nt, Human
cgagaaaauacuguugcacgcaaua

SEQ ID NO: 1175028 - RNA, 23 nt, Human
cuucccuguucucauuuugggga

SEQ ID NO: 1175029 - RNA, 18 nt, Human
gagaaaauacuguugcac

SEQ ID NO: 1175030 - RNA, 20 nt, Human
gagaugacccuggggaggga

SEQ ID NO: 1175031 - RNA, 21 nt, Human
gcacgcaauaauuuucacaca

SEQ ID NO: 1175032 - RNA, 19 nt, Human
gcgcccacggucccaggag

SEQ ID NO: 1175033 - RNA, 26 nt, Human
ggaaaaagagguacacgagaaaauac

SEQ ID NO: 1175034 - RNA, 24 nt, Human
ggaccgacugacucagggcagcgc

SEQ ID NO: 1175035 - RNA, 23 nt, Human
gguuaaaaaaaugcacacacaga

SEQ ID NO: 1175036 - RNA, 20 nt, Human
uaaagccaaguaaaauaucc

SEQ ID NO: 1175037 - RNA, 21 nt, Human
uaacauaguucaccacaaugg

SEQ ID NO: 1175038 - RNA, 22 nt, Human
uaauuuucacacagauuaacaa

SEQ ID NO: 1175039 - RNA, 23 nt, Human
uagacauuuauaaauaaaaaaga

SEQ ID NO: 1175040 - RNA, 22 nt, Human
uauaacauaguucaccacaaug

SEQ ID NO: 1175041 - RNA, 18 nt, Human
ucaaaaagaaacuaugag

SEQ ID NO: 1175042 - RNA, 19 nt, Human
uccaguguccugaauucau

SEQ ID NO: 1175043 - RNA, 23 nt, Human
ucuacacauauacaauaugcaua

SEQ ID NO: 1175044 - RNA, 20 nt, Human
ugaaggaacacaacagacca

SEQ ID NO: 1175045 - RNA, 21 nt, Human
ugaccugggagagaaagaucu

SEQ ID NO: 1175046 - RNA, 22 nt, Human
ugacucagggcagcgcugacgg

SEQ ID NO: 1175047 - RNA, 23 nt, Human
ugacucagggcagcgcugacggg

SEQ ID NO: 1175048 - RNA, 19 nt, Human
ugacugugcccuggaaagu

SEQ ID NO: 1175049 - RNA, 23 nt, Human
ugagaugacccuggggagggagc

SEQ ID NO: 1175050 - RNA, 22 nt, Human
ugagaugaccugggagagaaaa

SEQ ID NO: 1175051 - RNA, 25 nt, Human
ugaguaacaagcuauaacauaguuc

SEQ ID NO: 1175052 - RNA, 19 nt, Human
ugcacgcaauaauuuucac

SEQ ID NO: 1175053 - RNA, 22 nt, Human
uggaagaagcuugaagugagca

SEQ ID NO: 1175054 - RNA, 22 nt, Human
uggaccuggugacuuagugucg

SEQ ID NO: 1175055 - RNA, 19 nt, Human
uggggagggagccacguuc

SEQ ID NO: 1175056 - RNA, 20 nt, Human
uggggagggagccacguucc

SEQ ID NO: 1175057 - RNA, 21 nt, Human
uguaaaacauucuaaagccaa

SEQ ID NO: 1175058 - RNA, 23 nt, Human
uguugcacgcaauaauuuucaca

SEQ ID NO: 1175059 - RNA, 23 nt, Human
uuaacauggauuaacacuuuuua

SEQ ID NO: 1175060 - RNA, 26 nt, Human
uuagaaauucugcugccccaaaguau

SEQ ID NO: 1175061 - RNA, 19 nt, Human
aaaaaaaaggacagagagg

SEQ ID NO: 1175062 - RNA, 25 nt, Human
aaaaauauauaccuuuaguauugcc

SEQ ID NO: 1175063 - RNA, 21 nt, Human
aaacaggacaacccaugagca

SEQ ID NO: 1175064 - RNA, 23 nt, Human
aacagaaagaaaaaaguuccugg

SEQ ID NO: 1175065 - RNA, 22 nt, Human
aacugaacuccuggcagcccug

SEQ ID NO: 1175066 - RNA, 19 nt, Human
aagagaaagacaaauagaa

SEQ ID NO: 1175067 - RNA, 21 nt, Human
aagcacaggagagcucugagg

SEQ ID NO: 1175068 - RNA, 18 nt, Human
aagcccaaucaaggcuuu

SEQ ID NO: 1175069 - RNA, 18 nt, Human
aagcccuccucgccccuc

SEQ ID NO: 1175070 - RNA, 22 nt, Human
aagcucaguucuggagcugggc

SEQ ID NO: 1175071 - RNA, 24 nt, Human
aaggaaaagacacagacagggaau

SEQ ID NO: 1175072 - RNA, 19 nt, Human
aaguaaggacuagguuggc

SEQ ID NO: 1175073 - RNA, 22 nt, Human
aauaccagaggcaagccaaaga

SEQ ID NO: 1175074 - RNA, 20 nt, Human
aauucugccccuuuugccua

SEQ ID NO: 1175075 - RNA, 19 nt, Human
acagaaacaauuuuccuac

SEQ ID NO: 1175076 - RNA, 23 nt, Human
acagaaagaaaaaaguuccugga

SEQ ID NO: 1175077 - RNA, 18 nt, Human
acaguccuuuagcugagu

SEQ ID NO: 1175078 - RNA, 18 nt, Human
accccacccugcccucag

SEQ ID NO: 1175079 - RNA, 23 nt, Human
accccuuucuucaacuggggccu

SEQ ID NO: 1175080 - RNA, 25 nt, Human
accucagccaccaggaagacuagaa

SEQ ID NO: 1175081 - RNA, 19 nt, Human
acuaauauugccgaucuca

SEQ ID NO: 1175082 - RNA, 19 nt, Human
acucacacaugcucacacg

SEQ ID NO: 1175083 - RNA, 19 nt, Human
acuccuggcagcccugcuu

SEQ ID NO: 1175084 - RNA, 22 nt, Human
agaagcacaggagagcucugag

SEQ ID NO: 1175085 - RNA, 24 nt, Human
agaaggaacccuuaccucuccuca

SEQ ID NO: 1175086 - RNA, 22 nt, Human
agaagucuguaaaacacaccag

SEQ ID NO: 1175087 - RNA, 24 nt, Human
agacagggaaugaagccugcaaag

SEQ ID NO: 1175088 - RNA, 18 nt, Human
agacuagaaaggcuaaca

SEQ ID NO: 1175089 - RNA, 19 nt, Human
agagaaagacaaauagaau

SEQ ID NO: 1175090 - RNA, 18 nt, Human
agaggaggccauugggug

SEQ ID NO: 1175091 - RNA, 21 nt, Human
agagugaaucuauuacagaga

SEQ ID NO: 1175092 - RNA, 24 nt, Human
agauuucagaagcacaggagagcu

SEQ ID NO: 1175093 - RNA, 24 nt, Human
agccgcccagcuuuguucaggguu

SEQ ID NO: 1175094 - RNA, 21 nt, Human
agccucgacucucccaccccu

SEQ ID NO: 1175095 - RNA, 20 nt, Human
agcgcacacagcacagugca

SEQ ID NO: 1175096 - RNA, 20 nt, Human
agcugggcagacucagguuc

SEQ ID NO: 1175097 - RNA, 22 nt, Human
aggaagggccugaugaacaaaa

SEQ ID NO: 1175098 - RNA, 19 nt, Human
aggacagagaggaaagaga

SEQ ID NO: 1175099 - RNA, 24 nt, Human
aggagcccccucuuugcacagucc

SEQ ID NO: 1175100 - RNA, 21 nt, Human
aggaggccauugggugaggac

SEQ ID NO: 1175101 - RNA, 21 nt, Human
agggaaugaagccugcaaagu

SEQ ID NO: 1175102 - RNA, 24 nt, Human
agggagcuggccucuccugcaggg

SEQ ID NO: 1175103 - RNA, 20 nt, Human
agguugaagaggacaaaggu

SEQ ID NO: 1175104 - RNA, 21 nt, Human
caacccaugagcaauucccag

SEQ ID NO: 1175105 - RNA, 21 nt, Human
caacugaacuccuggcagccc

SEQ ID NO: 1175106 - RNA, 20 nt, Human
cacacaugcucacacggccu

SEQ ID NO: 1175107 - RNA, 22 nt, Human
cacacggccuaaaucuuccacc

SEQ ID NO: 1175108 - RNA, 19 nt, Human
cacaggagagcucugagga

SEQ ID NO: 1175109 - RNA, 23 nt, Human
cacagugcacugaagauguggcc

SEQ ID NO: 1175110 - RNA, 24 nt, Human
caccaggcuccaguuaaacacucc

SEQ ID NO: 1175111 - RNA, 20 nt, Human
caccccacccugcccucagc

SEQ ID NO: 1175112 - RNA, 20 nt, Human
caccccuuucuucaacuggg

SEQ ID NO: 1175113 - RNA, 19 nt, Human
caccugccacuucucagag

SEQ ID NO: 1175114 - RNA, 27 nt, Human
cacucuuacuuauaagagcugguugua

SEQ ID NO: 1175115 - RNA, 21 nt, Human
cagaagcaaauugcccugcgg

SEQ ID NO: 1175116 - RNA, 20 nt, Human
cagaagucuguaaaacacac

SEQ ID NO: 1175117 - RNA, 20 nt, Human
cagauuucagaagcacagga

SEQ ID NO: 1175118 - RNA, 22 nt, Human
cagcagcaucgaaggggucacc

SEQ ID NO: 1175119 - RNA, 23 nt, Human
cagcagcaucgaaggggucaccu

SEQ ID NO: 1175120 - RNA, 27 nt, Human
cagcccccgcgugcucuacgcccuuga

SEQ ID NO: 1175121 - RNA, 18 nt, Human
cagcuggcuagaauuggg

SEQ ID NO: 1175122 - RNA, 22 nt, Human
caggcuccaguuaaacacuccu

SEQ ID NO: 1175123 - RNA, 24 nt, Human
ccaaaacaucaugaagaggcccua

SEQ ID NO: 1175124 - RNA, 25 nt, Human
ccacucacucacacaugcucacacg

SEQ ID NO: 1175125 - RNA, 24 nt, Human
ccagcccgugaacaccucagccac

SEQ ID NO: 1175126 - RNA, 20 nt, Human
ccaggcuccaguuaaacacu

SEQ ID NO: 1175127 - RNA, 19 nt, Human
ccagggagcuggccucucc

SEQ ID NO: 1175128 - RNA, 22 nt, Human
cccacaccccacccugcccuca

SEQ ID NO: 1175129 - RNA, 18 nt, Human
cccccagcccgugaacac

SEQ ID NO: 1175130 - RNA, 18 nt, Human
cccccgcgugcucuacgc

SEQ ID NO: 1175131 - RNA, 21 nt, Human
ccccuucccuuccugaugucc

SEQ ID NO: 1175132 - RNA, 26 nt, Human
cccgcgugcucuacgcccuugaugca

SEQ ID NO: 1175133 - RNA, 18 nt, Human
cccgugaacaccucagcc

SEQ ID NO: 1175134 - RNA, 22 nt, Human
cccgugaacaccucagccacca

SEQ ID NO: 1175135 - RNA, 27 nt, Human
cccuuaccucuccucaauucucucugc

SEQ ID NO: 1175136 - RNA, 21 nt, Human
ccuaagcacagagacaugggg

SEQ ID NO: 1175137 - RNA, 20 nt, Human
ccucaucuccucccuccagu

SEQ ID NO: 1175138 - RNA, 24 nt, Human
ccuccacccacuuccagcuggcua

SEQ ID NO: 1175139 - RNA, 21 nt, Human
ccuccucaucuccucccucca

SEQ ID NO: 1175140 - RNA, 20 nt, Human
ccugagcagccgcccagcuu

SEQ ID NO: 1175141 - RNA, 21 nt, Human
ccugcuggcgcuguggagucc

SEQ ID NO: 1175142 - RNA, 25 nt, Human
ccugcugucccuccacccacuucca

SEQ ID NO: 1175143 - RNA, 19 nt, Human
ccuggcagcccugcuuugc

SEQ ID NO: 1175144 - RNA, 21 nt, Human
ccuucuuuccauuuucugucc

SEQ ID NO: 1175145 - RNA, 18 nt, Human
ccuuggcuguagggggac

SEQ ID NO: 1175146 - RNA, 19 nt, Human
cgagcccagcccccgcgug

SEQ ID NO: 1175147 - RNA, 18 nt, Human
cgagcccaugagaugcca

SEQ ID NO: 1175148 - RNA, 24 nt, Human
cgcacacagcacagugcacugaag

SEQ ID NO: 1175149 - RNA, 24 nt, Human
cucacugugcccagcagcuucugg

SEQ ID NO: 1175150 - RNA, 26 nt, Human
cucagguucaagcccuccucgccccu

SEQ ID NO: 1175151 - RNA, 18 nt, Human
cucccaccccuugaucug

SEQ ID NO: 1175152 - RNA, 21 nt, Human
cucccccagcccgugaacacc

SEQ ID NO: 1175153 - RNA, 23 nt, Human
cucccccagcccgugaacaccuc

SEQ ID NO: 1175154 - RNA, 25 nt, Human
cucccccagcccgugaacaccuucc

SEQ ID NO: 1175155 - RNA, 21 nt, Human
cuccucaucuccucccuccag

SEQ ID NO: 1175156 - RNA, 19 nt, Human
cucucugcuaguugagagc

SEQ ID NO: 1175157 - RNA, 21 nt, Human
cucugcuugagagcuuggucc

SEQ ID NO: 1175158 - RNA, 21 nt, Human
cugaagauguggccggagccc

SEQ ID NO: 1175159 - RNA, 21 nt, Human
cugaggaugugggagagaagc

SEQ ID NO: 1175160 - RNA, 23 nt, Human
cugcaagcucaguucuggagcug

SEQ ID NO: 1175161 - RNA, 24 nt, Human
cuggagcugggcagacucagguuc

SEQ ID NO: 1175162 - RNA, 22 nt, Human
cuugagagcuugguccuaguga

SEQ ID NO: 1175163 - RNA, 25 nt, Human
cuuguggccaagucacuccugcugg

SEQ ID NO: 1175164 - RNA, 20 nt, Human
cuuugcuccaacccuucuuu

SEQ ID NO: 1175165 - RNA, 24 nt, Human
gaaacauccaaaacaucaugaaga

SEQ ID NO: 1175166 - RNA, 21 nt, Human
gaagucuguaaaacacaccag

SEQ ID NO: 1175167 - RNA, 18 nt, Human
gaaugucuuguggccaag

SEQ ID NO: 1175168 - RNA, 24 nt, Human
gacaaaggucagcuggcuccccca

SEQ ID NO: 1175169 - RNA, 20 nt, Human
gagaaccugggacaaaagcu

SEQ ID NO: 1175170 - RNA, 26 nt, Human
gagcagaagcaaauugcccugcgguu

SEQ ID NO: 1175171 - RNA, 21 nt, Human
gagcugaagagugaaucuauu

SEQ ID NO: 1175172 - RNA, 20 nt, Human
gauagagaugacagaaacaa

SEQ ID NO: 1175173 - RNA, 20 nt, Human
gauucuggcccaucacugcu

SEQ ID NO: 1175174 - RNA, 21 nt, Human
gcccugcuuugcucucuccca

SEQ ID NO: 1175175 - RNA, 18 nt, Human
ggaaagaaaucuaaaagg

SEQ ID NO: 1175176 - RNA, 19 nt, Human
ggaaggagggagcccacaa

SEQ ID NO: 1175177 - RNA, 23 nt, Human
ggacaaaagcuggggcgagcugg

SEQ ID NO: 1175178 - RNA, 20 nt, Human
ggagaagaugaaacaggaca

SEQ ID NO: 1175179 - RNA, 21 nt, Human
ggagaugagaagugagaguuc

SEQ ID NO: 1175180 - RNA, 24 nt, Human
ggauagagaugacagaaacaauuu

SEQ ID NO: 1175181 - RNA, 21 nt, Human
ggauuguggggaagcggaugg

SEQ ID NO: 1175182 - RNA, 19 nt, Human
ggggcaggcugaggaacug

SEQ ID NO: 1175183 - RNA, 20 nt, Human
ggggcccacguccagacggg

SEQ ID NO: 1175184 - RNA, 20 nt, Human
ggugaugcuguguaaaggcc

SEQ ID NO: 1175185 - RNA, 23 nt, Human
gugaugcuguguaaaggccuuuc

SEQ ID NO: 1175186 - RNA, 21 nt, Human
gugcaugggauggcacaggga

SEQ ID NO: 1175187 - RNA, 26 nt, Human
gugcaugggauggcacagggugaugc

SEQ ID NO: 1175188 - RNA, 24 nt, Human
guggagaugagaagugagaguucu

SEQ ID NO: 1175189 - RNA, 21 nt, Human
gugggauggcuguuggggccc

SEQ ID NO: 1175190 - RNA, 18 nt, Human
uaaaugcauuuuuuuuuu

SEQ ID NO: 1175191 - RNA, 21 nt, Human
uaacagaaagaaaaaaguucc

SEQ ID NO: 1175192 - RNA, 20 nt, Human
uauaagagcugguuguagca

SEQ ID NO: 1175193 - RNA, 22 nt, Human
uauuucaccccuuucuucaacu

SEQ ID NO: 1175194 - RNA, 21 nt, Human
ucaaaagaaacucuccagaga

SEQ ID NO: 1175195 - RNA, 22 nt, Human
ucaaaagaaacucuccagagau

SEQ ID NO: 1175196 - RNA, 19 nt, Human
ucaacaccugccacuucuc

SEQ ID NO: 1175197 - RNA, 24 nt, Human
ucaagcccuccucgccccucaaga

SEQ ID NO: 1175198 - RNA, 20 nt, Human
ucacccacuucccuuggaaa

SEQ ID NO: 1175199 - RNA, 23 nt, Human
ucagacaaagagaaccugggaca

SEQ ID NO: 1175200 - RNA, 25 nt, Human
ucaguaauacuucccgaagccuccu

SEQ ID NO: 1175201 - RNA, 20 nt, Human
ucccacaccccacccugccc

SEQ ID NO: 1175202 - RNA, 19 nt, Human
ucccuccacccacuuccag

SEQ ID NO: 1175203 - RNA, 25 nt, Human
ucccuggggcuggaaugucuugugg

SEQ ID NO: 1175204 - RNA, 22 nt, Human
ucccuuaucuauaaaugggggc

SEQ ID NO: 1175205 - RNA, 21 nt, Human
uccuaagucuuuccuuuuuuu

SEQ ID NO: 1175206 - RNA, 23 nt, Human
uccucaucuccucccuccaguuu

SEQ ID NO: 1175207 - RNA, 25 nt, Human
uccugcuggcgcuguggagucccag

SEQ ID NO: 1175208 - RNA, 23 nt, Human
uccuucuuuccauuuucuguccu

SEQ ID NO: 1175209 - RNA, 18 nt, Human
ucgacucucccaccccuu

SEQ ID NO: 1175210 - RNA, 21 nt, Human
ucucagagcauccggucagcu

SEQ ID NO: 1175211 - RNA, 21 nt, Human
ucucccgauagcagcagcauc

SEQ ID NO: 1175212 - RNA, 20 nt, Human
ucugaggaugugggagagaa

SEQ ID NO: 1175213 - RNA, 23 nt, Human
ucuuacuuauaagagcugguugu

SEQ ID NO: 1175214 - RNA, 21 nt, Human
ucuuuggcuaaagaaaggaac

SEQ ID NO: 1175215 - RNA, 19 nt, Human
ugaaacaggacaacccaug

SEQ ID NO: 1175216 - RNA, 23 nt, Human
ugaaacaggacaacccaugagca

SEQ ID NO: 1175217 - RNA, 21 nt, Human
ugaccauguugucagaagccc

SEQ ID NO: 1175218 - RNA, 18 nt, Human
ugacucaauggcagauuc

SEQ ID NO: 1175219 - RNA, 20 nt, Human
ugacucaauggcagauucgg

SEQ ID NO: 1175220 - RNA, 22 nt, Human
ugagaagugagaguucuaaggc

SEQ ID NO: 1175221 - RNA, 22 nt, Human
ugagaugccaccugacgucgca

SEQ ID NO: 1175222 - RNA, 18 nt, Human
ugagcgucuguggggcug

SEQ ID NO: 1175223 - RNA, 20 nt, Human
ugaggaacuggguggugugg

SEQ ID NO: 1175224 - RNA, 21 nt, Human
ugaggacuaggagaaugugca

SEQ ID NO: 1175225 - RNA, 23 nt, Human
ugaucugcucacccacuucccuu

SEQ ID NO: 1175226 - RNA, 22 nt, Human
ugccuaaauccaacucaggagc

SEQ ID NO: 1175227 - RNA, 23 nt, Human
ugccugagcagccgcccagcuuu

SEQ ID NO: 1175228 - RNA, 19 nt, Human
ugccuggaaaggaacgaag

SEQ ID NO: 1175229 - RNA, 24 nt, Human
ugcuugagagcuugguccuaguga

SEQ ID NO: 1175230 - RNA, 18 nt, Human
ugcuuuauccuuccuuca

SEQ ID NO: 1175231 - RNA, 19 nt, Human
uggaaagaaaucuaaaagg

SEQ ID NO: 1175232 - RNA, 18 nt, Human
uggcuagaauugggugcu

SEQ ID NO: 1175233 - RNA, 19 nt, Human
uggcucugggcaguuuccu

SEQ ID NO: 1175234 - RNA, 20 nt, Human
uggcucugggcaguuuccuu

SEQ ID NO: 1175235 - RNA, 23 nt, Human
uggcugcaagcucaguucuggag

SEQ ID NO: 1175236 - RNA, 20 nt, Human
ugggagggggcaaauguccc

SEQ ID NO: 1175237 - RNA, 18 nt, Human
ugggcgggcugagucuuc

SEQ ID NO: 1175238 - RNA, 18 nt, Human
uggggaagguaccaccug

SEQ ID NO: 1175239 - RNA, 19 nt, Human
uggggucaccucugggagg

SEQ ID NO: 1175240 - RNA, 21 nt, Human
ugggugaggacuaggagaaug

SEQ ID NO: 1175241 - RNA, 18 nt, Human
ugggugcugggggcaugc

SEQ ID NO: 1175242 - RNA, 19 nt, Human
ugucagaagcccaaucaag

SEQ ID NO: 1175243 - RNA, 19 nt, Human
ugucuuguggccaagucaa

SEQ ID NO: 1175244 - RNA, 21 nt, Human
ugugagcacccagcgcacaca

SEQ ID NO: 1175245 - RNA, 20 nt, Human
uguggcagcuccaugcaugg

SEQ ID NO: 1175246 - RNA, 23 nt, Human
uguggccaagucacuccugcugg

SEQ ID NO: 1175247 - RNA, 21 nt, Human
uguuccaauaugaguguuugc

SEQ ID NO: 1175248 - RNA, 20 nt, Human
uucacucuuacuuauaagaa

SEQ ID NO: 1175249 - RNA, 18 nt, Human
uuggggcuucugaugugg

SEQ ID NO: 1175250 - RNA, 19 nt, Human
uuguggggaagcggauggg

SEQ ID NO: 1175251 - RNA, 21 nt, Human
uuguucaggguuucucuggcc

SEQ ID NO: 1175252 - RNA, 23 nt, Human
uuguuccacucacucacacaugc

SEQ ID NO: 1175253 - RNA, 22 nt, Human
uuuacaaauuuggugugaaccc

SEQ ID NO: 1175254 - RNA, 22 nt, Human
uuuccuggggaagguaccaccu

SEQ ID NO: 1175255 - RNA, 20 nt, Human
uuuccuucuuuccauuuucu

SEQ ID NO: 1175256 - RNA, 20 nt, Human
uuugauucuucuuuaaacuu

SEQ ID NO: 1175257 - RNA, 20 nt, Human
uuuuuuuaacagaaagaaaa

SEQ ID NO: 1175258 - RNA, 22 nt, Human
aaacagaugccaucucucccau

SEQ ID NO: 1175259 - RNA, 19 nt, Human
aaagaagcacaccagccuc

SEQ ID NO: 1175260 - RNA, 20 nt, Human
aaagaagcacaccagccucc

SEQ ID NO: 1175261 - RNA, 25 nt, Human
aaaggaggccaggaaccagggacuc

SEQ ID NO: 1175262 - RNA, 23 nt, Human
aaauaacuucuuaaauccaaaug

SEQ ID NO: 1175263 - RNA, 23 nt, Human
aacagcaccacggacacagcagg

SEQ ID NO: 1175264 - RNA, 21 nt, Human
aagaagggggaugcaggggac

SEQ ID NO: 1175265 - RNA, 18 nt, Human
aagugacagcagggcagc

SEQ ID NO: 1175266 - RNA, 20 nt, Human
acaacagcaccacggacaca

SEQ ID NO: 1175267 - RNA, 22 nt, Human
acaacagcaccacggacacagc

SEQ ID NO: 1175268 - RNA, 23 nt, Human
acacugcagauguggcuguccuc

SEQ ID NO: 1175269 - RNA, 20 nt, Human
acagcagggcagccccuggg

SEQ ID NO: 1175270 - RNA, 22 nt, Human
accaccaugcugucuuccaguc

SEQ ID NO: 1175271 - RNA, 21 nt, Human
accacugaacugcugggaagu

SEQ ID NO: 1175272 - RNA, 18 nt, Human
acccaguggaauucgucc

SEQ ID NO: 1175273 - RNA, 24 nt, Human
acccgcucugucuucuacccccua

SEQ ID NO: 1175274 - RNA, 23 nt, Human
accgggacacaucagauguggcu

SEQ ID NO: 1175275 - RNA, 21 nt, Human
acugugggaagccuggcaggg

SEQ ID NO: 1175276 - RNA, 22 nt, Human
agagcagccaguccuccggggg

SEQ ID NO: 1175277 - RNA, 20 nt, Human
agaugccaucucucccauga

SEQ ID NO: 1175278 - RNA, 21 nt, Human
agccccuggguuaggaucucc

SEQ ID NO: 1175279 - RNA, 18 nt, Human
agcccuuggaagcugcag

SEQ ID NO: 1175280 - RNA, 21 nt, Human
aggccagguaccaacagcagg

SEQ ID NO: 1175281 - RNA, 20 nt, Human
aggccucuggagugacccag

SEQ ID NO: 1175282 - RNA, 24 nt, Human
agugaccaauacaacagcaccacg

SEQ ID NO: 1175283 - RNA, 24 nt, Human
aucuccagucugcagacugcuucc

SEQ ID NO: 1175284 - RNA, 21 nt, Human
caaggcaaagaagggggaugc

SEQ ID NO: 1175285 - RNA, 23 nt, Human
cacagcaggggcccugccugaga

SEQ ID NO: 1175286 - RNA, 25 nt, Human
cacaggccuaggggcggggccaccu

SEQ ID NO: 1175287 - RNA, 23 nt, Human
cacaucagauguggcucuaccag

SEQ ID NO: 1175288 - RNA, 19 nt, Human
cacccaccgcuucgccuug

SEQ ID NO: 1175289 - RNA, 21 nt, Human
caccgcuucgccuugcagagg

SEQ ID NO: 1175290 - RNA, 19 nt, Human
caccucaaguauaggccau

SEQ ID NO: 1175291 - RNA, 22 nt, Human
caccucuggccccacccaccuc

SEQ ID NO: 1175292 - RNA, 18 nt, Human
cacuugaugcagcccuug

SEQ ID NO: 1175293 - RNA, 24 nt, Human
cagcaccgccucguggguguggcc

SEQ ID NO: 1175294 - RNA, 23 nt, Human
cagcagcaacagugaccaccaug

SEQ ID NO: 1175295 - RNA, 18 nt, Human
cagcaggacagacugccc

SEQ ID NO: 1175296 - RNA, 18 nt, Human
cagcagggcagccccugg

SEQ ID NO: 1175297 - RNA, 23 nt, Human
cagccccuggguuaggaucuccu

SEQ ID NO: 1175298 - RNA, 23 nt, Human
cagcucggcccugcccgcccccc

SEQ ID NO: 1175299 - RNA, 20 nt, Human
caggaaccagggacucagag

SEQ ID NO: 1175300 - RNA, 18 nt, Human
cagggccugggagagggg

SEQ ID NO: 1175301 - RNA, 20 nt, Human
cagggccugggagaggggcc

SEQ ID NO: 1175302 - RNA, 22 nt, Human
caggucucccccagugucagaa

SEQ ID NO: 1175303 - RNA, 26 nt, Human
caguacugccugccugugucguaguc

SEQ ID NO: 1175304 - RNA, 21 nt, Human
cagucugcagacugcuuccac

SEQ ID NO: 1175305 - RNA, 19 nt, Human
ccacgcacccaccgcuucg

SEQ ID NO: 1175306 - RNA, 18 nt, Human
ccaggcaaggcaaagaag

SEQ ID NO: 1175307 - RNA, 22 nt, Human
ccagguugaaacagaugccauc

SEQ ID NO: 1175308 - RNA, 23 nt, Human
cccacaggccuaggggcggggcc

SEQ ID NO: 1175309 - RNA, 20 nt, Human
cccagagacacccgcucugu

SEQ ID NO: 1175310 - RNA, 19 nt, Human
ccccagcccgagucccacu

SEQ ID NO: 1175311 - RNA, 28 nt, Human
ccccccagcccgagucccaguccgagga

SEQ ID NO: 1175312 - RNA, 22 nt, Human
cccccccagcccgagucccacu

SEQ ID NO: 1175313 - RNA, 21 nt, Human
cccccuacucaaagaagcaca

SEQ ID NO: 1175314 - RNA, 18 nt, Human
ccuagaccugcuggucua

SEQ ID NO: 1175315 - RNA, 20 nt, Human
ccucccacaggccuaggggc

SEQ ID NO: 1175316 - RNA, 20 nt, Human
ccucuggccccacccaccuc

SEQ ID NO: 1175317 - RNA, 29 nt, Human
ccugccugcagacaaaggaggccaggaac

SEQ ID NO: 1175318 - RNA, 20 nt, Human
cgaagacacacuccccugga

SEQ ID NO: 1175319 - RNA, 25 nt, Human
cgucaugggaucuccagucugcaga

SEQ ID NO: 1175320 - RNA, 22 nt, Human
cguccccaacucugcguagucc

SEQ ID NO: 1175321 - RNA, 19 nt, Human
cuccaaacucccagaggca

SEQ ID NO: 1175322 - RNA, 24 nt, Human
cucccagaggcauggaacgccaga

SEQ ID NO: 1175323 - RNA, 21 nt, Human
cuccucugucuccaaacuccc

SEQ ID NO: 1175324 - RNA, 20 nt, Human
cucgcugcaauguccccaug

SEQ ID NO: 1175325 - RNA, 20 nt, Human
cucggcccugcccgcccccc

SEQ ID NO: 1175326 - RNA, 24 nt, Human
cucggcccugcccgcccccccagc

SEQ ID NO: 1175327 - RNA, 21 nt, Human
cucuccuuccagcuaggccag

SEQ ID NO: 1175328 - RNA, 24 nt, Human
cucugaaucacagccagcaccgcc

SEQ ID NO: 1175329 - RNA, 20 nt, Human
cugcacacccagggccgggu

SEQ ID NO: 1175330 - RNA, 24 nt, Human
cugggaaggaagcccggagcuucu

SEQ ID NO: 1175331 - RNA, 27 nt, Human
cuucuggcucugaaucacagccagcac

SEQ ID NO: 1175332 - RNA, 23 nt, Human
cuugcugcacacccagggccgac

SEQ ID NO: 1175333 - RNA, 21 nt, Human
gaacccaggcaaggcaaagaa

SEQ ID NO: 1175334 - RNA, 19 nt, Human
gaagacacacuccccugga

SEQ ID NO: 1175335 - RNA, 20 nt, Human
gaagacacacuccccuggac

SEQ ID NO: 1175336 - RNA, 21 nt, Human
gaagacacacuccccuggacc

SEQ ID NO: 1175337 - RNA, 22 nt, Human
gaagccuggcaggggcaucauc

SEQ ID NO: 1175338 - RNA, 24 nt, Human
gagcagacaccagacaccucccac

SEQ ID NO: 1175339 - RNA, 21 nt, Human
gcagcccuuggaagcugcagg

SEQ ID NO: 1175340 - RNA, 21 nt, Human
gcauggaacgccagaaacuca

SEQ ID NO: 1175341 - RNA, 18 nt, Human
gccaucucucccaugauu

SEQ ID NO: 1175342 - RNA, 18 nt, Human
ggagaggggccuggggcg

SEQ ID NO: 1175343 - RNA, 23 nt, Human
ggaugcaggggaccucuggggcc

SEQ ID NO: 1175344 - RNA, 20 nt, Human
ggccaggaaccagggacuca

SEQ ID NO: 1175345 - RNA, 19 nt, Human
ggcggggccaccucuggcc

SEQ ID NO: 1175346 - RNA, 21 nt, Human
ggggaccucuggggcccgggg

SEQ ID NO: 1175347 - RNA, 19 nt, Human
gucugcagacugcuuccac

SEQ ID NO: 1175348 - RNA, 18 nt, Human
gugacagcagggcagccc

SEQ ID NO: 1175349 - RNA, 19 nt, Human
uacaacagcaccacggaca

SEQ ID NO: 1175350 - RNA, 19 nt, Human
uaccagcagcaacagugac

SEQ ID NO: 1175351 - RNA, 24 nt, Human
ucacuuuggcucaucauuugaguu

SEQ ID NO: 1175352 - RNA, 24 nt, Human
ucauccagguugaaacagaugcca

SEQ ID NO: 1175353 - RNA, 20 nt, Human
uccacgaagacacacucccc

SEQ ID NO: 1175354 - RNA, 20 nt, Human
ucccagaggcauggaacgcc

SEQ ID NO: 1175355 - RNA, 22 nt, Human
uccugcagggacacugcagaug

SEQ ID NO: 1175356 - RNA, 20 nt, Human
ucggcccugcccgccccccc

SEQ ID NO: 1175357 - RNA, 24 nt, Human
ucuaccagcagcaacagugaccac

SEQ ID NO: 1175358 - RNA, 26 nt, Human
ucuacccccuacucaaagaagcacca

SEQ ID NO: 1175359 - RNA, 19 nt, Human
ucuccaaacucccagaggc

SEQ ID NO: 1175360 - RNA, 24 nt, Human
ucucccaugauuccugacaagggu

SEQ ID NO: 1175361 - RNA, 20 nt, Human
ucuccuuccagcuaggccag

SEQ ID NO: 1175362 - RNA, 24 nt, Human
ucugcguaguccaauccagggcuc

SEQ ID NO: 1175363 - RNA, 21 nt, Human
ucugggaaggaagcccggagc

SEQ ID NO: 1175364 - RNA, 23 nt, Human
ucuguggcucccuccccugccuc

SEQ ID NO: 1175365 - RNA, 21 nt, Human
ucuugauuucuuucacccauc

SEQ ID NO: 1175366 - RNA, 19 nt, Human
ugagaaaggggacuguggg

SEQ ID NO: 1175367 - RNA, 18 nt, Human
ugaugcagcccuuggaag

SEQ ID NO: 1175368 - RNA, 21 nt, Human
ugauucuaagccaggucuccc

SEQ ID NO: 1175369 - RNA, 23 nt, Human
ugcagggaagagaccagcucggc

SEQ ID NO: 1175370 - RNA, 24 nt, Human
ugcccauguuagcuaccaaggcug

SEQ ID NO: 1175371 - RNA, 23 nt, Human
ugccugcagacaaaggaggccag

SEQ ID NO: 1175372 - RNA, 22 nt, Human
ugccugccuguguuccagucuc

SEQ ID NO: 1175373 - RNA, 21 nt, Human
ugccuggagguaaaagggugg

SEQ ID NO: 1175374 - RNA, 21 nt, Human
uggauuuugucagcugcaaau

SEQ ID NO: 1175375 - RNA, 18 nt, Human
uggcucugaaucacagcc

SEQ ID NO: 1175376 - RNA, 21 nt, Human
ugggaagccuggcaggggcau

SEQ ID NO: 1175377 - RNA, 18 nt, Human
uggggcccggggcggggc

SEQ ID NO: 1175378 - RNA, 21 nt, Human
uggggcccggggcggggcugg

SEQ ID NO: 1175379 - RNA, 24 nt, Human
uggggcggaggccacgcacccacc

SEQ ID NO: 1175380 - RNA, 18 nt, Human
uggguuaggaucuccucu

SEQ ID NO: 1175381 - RNA, 21 nt, Human
uggguuaggaucuccucuguc

SEQ ID NO: 1175382 - RNA, 21 nt, Human
uguccggaucaaacggguccc

SEQ ID NO: 1175383 - RNA, 23 nt, Human
uuaauccacaaucuuagauuguu

SEQ ID NO: 1175384 - RNA, 20 nt, Human
uuccagcuccuucuggcucu

SEQ ID NO: 1175385 - RNA, 22 nt, Human
uucgcacuugaugcagcccuug

SEQ ID NO: 1175386 - RNA, 24 nt, Human
uuuuggauuuugucagcugcaaau

SEQ ID NO: 1175387 - RNA, 24 nt, Human
aaaaauuuuuuuaaguagaaaaac

SEQ ID NO: 1175388 - RNA, 23 nt, Human
aaacaaaauuacagagaaaaacc

SEQ ID NO: 1175389 - RNA, 21 nt, Human
aaacgaaacccgacuguuaac

SEQ ID NO: 1175390 - RNA, 24 nt, Human
aaagugcugggauuacaggcguga

SEQ ID NO: 1175391 - RNA, 23 nt, Human
aaccucaggugauccgccugccu

SEQ ID NO: 1175392 - RNA, 19 nt, Human
aagugcugggauuacaggc

SEQ ID NO: 1175393 - RNA, 19 nt, Human
aagugcugggauuacaggc

SEQ ID NO: 1175394 - RNA, 26 nt, Human
aagugcugggauuacaggcgugagcc

SEQ ID NO: 1175395 - RNA, 24 nt, Human
aauuuuguauuuuuaguagagacg

SEQ ID NO: 1175396 - RNA, 23 nt, Human
acagagaaaaaccuuaaacuuaa

SEQ ID NO: 1175397 - RNA, 25 nt, Human
acccugaaaaccccuccuccggccc

SEQ ID NO: 1175398 - RNA, 20 nt, Human
acgggguuuuuccauguugg

SEQ ID NO: 1175399 - RNA, 21 nt, Human
acgggguuuuuccauguuggu

SEQ ID NO: 1175400 - RNA, 24 nt, Human
acgggguuuuuccauguuggucag

SEQ ID NO: 1175401 - RNA, 20 nt, Human
agaaaaaccuuaaacuuaaa

SEQ ID NO: 1175402 - RNA, 23 nt, Human
agcgauucuccugucccagccuc

SEQ ID NO: 1175403 - RNA, 19 nt, Human
aggaccucuaacccagaac

SEQ ID NO: 1175404 - RNA, 23 nt, Human
aggcgugagccaccgugccuggc

SEQ ID NO: 1175405 - RNA, 24 nt, Human
aggugauccgccugccuuggccuc

SEQ ID NO: 1175406 - RNA, 23 nt, Human
aguagcugggauuacaggcaugu

SEQ ID NO: 1175407 - RNA, 18 nt, Human
agugcugggauuacaggc

SEQ ID NO: 1175408 - RNA, 24 nt, Human
caaagugcugggauuacaggcgug

SEQ ID NO: 1175409 - RNA, 23 nt, Human
caaccuccaccucccggguucaa

SEQ ID NO: 1175410 - RNA, 22 nt, Human
caacggcguccuacgacccuga

SEQ ID NO: 1175411 - RNA, 20 nt, Human
caagcgauucuccuguccca

SEQ ID NO: 1175412 - RNA, 21 nt, Human
caccgugccuggcuaaggcuu

SEQ ID NO: 1175413 - RNA, 20 nt, Human
cagccuccugaguagcuggg

SEQ ID NO: 1175414 - RNA, 21 nt, Human
caucgcaaccuccaccucccg

SEQ ID NO: 1175415 - RNA, 23 nt, Human
caucgcaaccuccaccucccggg

SEQ ID NO: 1175416 - RNA, 24 nt, Human
cauguuggucaggcuggucgcgaa

SEQ ID NO: 1175417 - RNA, 20 nt, Human
ccaaagugcugggauuacag

SEQ ID NO: 1175418 - RNA, 22 nt, Human
ccaaagugcugggauuacaggc

SEQ ID NO: 1175419 - RNA, 22 nt, Human
ccaaagugcugggauuacaggc

SEQ ID NO: 1175420 - RNA, 24 nt, Human
ccaaagugcugggauuacaggcgu

SEQ ID NO: 1175421 - RNA, 20 nt, Human
ccaccacgccuggcuaauuu

SEQ ID NO: 1175422 - RNA, 24 nt, Human
ccaccucccggguucaagcgauuc

SEQ ID NO: 1175423 - RNA, 19 nt, Human
ccauguuggucaggcuggu

SEQ ID NO: 1175424 - RNA, 20 nt, Human
ccauguuggucaggcugguc

SEQ ID NO: 1175425 - RNA, 20 nt, Human
ccauguuggucaggcugguc

SEQ ID NO: 1175426 - RNA, 20 nt, Human
cccaaccucaggugauccgc

SEQ ID NO: 1175427 - RNA, 24 nt, Human
cccaaccucaggugauccgccugc

SEQ ID NO: 1175428 - RNA, 20 nt, Human
cccaacggcguccuacgacc

SEQ ID NO: 1175429 - RNA, 18 nt, Human
cccaggcuggagugagug

SEQ ID NO: 1175430 - RNA, 22 nt, Human
ccccuaagaacuaguaaacaaa

SEQ ID NO: 1175431 - RNA, 20 nt, Human
cccggguucaagcgauucuc

SEQ ID NO: 1175432 - RNA, 23 nt, Human
cccggguucaagcgauucuccug

SEQ ID NO: 1175433 - RNA, 25 nt, Human
cccugaaaaccccuccuccggcccu

SEQ ID NO: 1175434 - RNA, 24 nt, Human
ccucccggguucaagcgauucucc

SEQ ID NO: 1175435 - RNA, 21 nt, Human
ccucuaacccagaacaagggu

SEQ ID NO: 1175436 - RNA, 23 nt, Human
ccugaguagcugggauuacaggc

SEQ ID NO: 1175437 - RNA, 24 nt, Human
ccugaguagcugggauuacaggca

SEQ ID NO: 1175438 - RNA, 22 nt, Human
ccugccuuggccucccaaagug

SEQ ID NO: 1175439 - RNA, 24 nt, Human
cgggguuuuuccauguuggucagg

SEQ ID NO: 1175440 - RNA, 24 nt, Human
cuaauuuuguauuuuuaguagaga

SEQ ID NO: 1175441 - RNA, 24 nt, Human
cucaucgcaaccuccaccucccgg

SEQ ID NO: 1175442 - RNA, 23 nt, Human
cugaguagcugggauuacaggca

SEQ ID NO: 1175443 - RNA, 24 nt, Human
cugaguagcugggauuacaggcau

SEQ ID NO: 1175444 - RNA, 23 nt, Human
cugccuuggccucccaaagugcu

SEQ ID NO: 1175445 - RNA, 23 nt, Human
cugucccagccuccugaguagcu

SEQ ID NO: 1175446 - RNA, 26 nt, Human
cuuauacuaauuuuuuuuuuuuuuuu

SEQ ID NO: 1175447 - RNA, 20 nt, Human
gacccugaaaaccccuccuc

SEQ ID NO: 1175448 - RNA, 23 nt, Human
gagacgggguuuuuccauguugg

SEQ ID NO: 1175449 - RNA, 24 nt, Human
gagacgggguuuuuccauguuggu

SEQ ID NO: 1175450 - RNA, 22 nt, Human
gaguagcugggauuacaggcau

SEQ ID NO: 1175451 - RNA, 25 nt, Human
gaguagcugggauuacaggcaugug

SEQ ID NO: 1175452 - RNA, 18 nt, Human
gauuacaggcaugugcca

SEQ ID NO: 1175453 - RNA, 18 nt, Human
gauuacaggcgugagcca

SEQ ID NO: 1175454 - RNA, 20 nt, Human
gauuacaggcgugagccacc

SEQ ID NO: 1175455 - RNA, 21 nt, Human
gauuacaggcgugagccaccg

SEQ ID NO: 1175456 - RNA, 18 nt, Human
gcccaggcuggagugagu

SEQ ID NO: 1175457 - RNA, 22 nt, Human
gccuuggccucccaaagugcug

SEQ ID NO: 1175458 - RNA, 21 nt, Human
gcucuuguugcccaggcugga

SEQ ID NO: 1175459 - RNA, 24 nt, Human
gcucuuguugcccaggcuggagug

SEQ ID NO: 1175460 - RNA, 23 nt, Human
gcuggucgcgaacucccaaccuc

SEQ ID NO: 1175461 - RNA, 19 nt, Human
ggauuacaggcaugugcca

SEQ ID NO: 1175462 - RNA, 23 nt, Human
gggguuuuuccauguuggucagg

SEQ ID NO: 1175463 - RNA, 23 nt, Human
guagagacgggguuuuuccaugu

SEQ ID NO: 1175464 - RNA, 18 nt, Human
guagcugggauuacaggc

SEQ ID NO: 1175465 - RNA, 20 nt, Human
guagcugggauuacaggcau

SEQ ID NO: 1175466 - RNA, 19 nt, Human
uaacccagaacaaggguuu

SEQ ID NO: 1175467 - RNA, 22 nt, Human
uaaugguacggucggacagacu

SEQ ID NO: 1175468 - RNA, 23 nt, Human
uaauuuuuuuuuuuuuuuugaga

SEQ ID NO: 1175469 - RNA, 26 nt, Human
uacagagaaaaaccuuaaacuuaaaa

SEQ ID NO: 1175470 - RNA, 22 nt, Human
uacaggcaugugccaccacgcc

SEQ ID NO: 1175471 - RNA, 22 nt, Human
uacaggcgugagccaccgugcc

SEQ ID NO: 1175472 - RNA, 22 nt, Human
uacaggcgugagccaccgugcc

SEQ ID NO: 1175473 - RNA, 24 nt, Human
uaguaaacaaaauuacagagaaaa

SEQ ID NO: 1175474 - RNA, 24 nt, Human
uaguagagacgggguuuuuccaug

SEQ ID NO: 1175475 - RNA, 24 nt, Human
ucaucgcaaccuccaccucccggg

SEQ ID NO: 1175476 - RNA, 19 nt, Human
uccaaggauauucuccaug

SEQ ID NO: 1175477 - RNA, 24 nt, Human
ucccaaagugcugggauuacaggc

SEQ ID NO: 1175478 - RNA, 21 nt, Human
ucccggguucaagcgauucuc

SEQ ID NO: 1175479 - RNA, 24 nt, Human
ucccggguucaagcgauucuccug

SEQ ID NO: 1175480 - RNA, 20 nt, Human
uccuacgacccugaaaaccc

SEQ ID NO: 1175481 - RNA, 24 nt, Human
uccugaguagcugggauuacaggc

SEQ ID NO: 1175482 - RNA, 23 nt, Human
ucgcaaccuccaccucccggguu

SEQ ID NO: 1175483 - RNA, 24 nt, Human
ucgcaaccuccaccucccggguuc

SEQ ID NO: 1175484 - RNA, 24 nt, Human
ucuccugucccagccuccugagua

SEQ ID NO: 1175485 - RNA, 22 nt, Human
ucuuguugcccaggcuggagug

SEQ ID NO: 1175486 - RNA, 22 nt, Human
ugaaauguccaguuaauucccc

SEQ ID NO: 1175487 - RNA, 23 nt, Human
ugagacagaguuuugcucuuguu

SEQ ID NO: 1175488 - RNA, 23 nt, Human
ugagaguaaagaugaaaugucca

SEQ ID NO: 1175489 - RNA, 22 nt, Human
ugauaaauacauauugauagaa

SEQ ID NO: 1175490 - RNA, 20 nt, Human
ugcccaggcuggagugagug

SEQ ID NO: 1175491 - RNA, 21 nt, Human
ugcccaggcuggagugagugc

SEQ ID NO: 1175492 - RNA, 24 nt, Human
ugcucuuguugcccaggcuggagu

SEQ ID NO: 1175493 - RNA, 24 nt, Human
ugcugggauuacaggcgugagcca

SEQ ID NO: 1175494 - RNA, 20 nt, Human
uggagugagugccauggcgc

SEQ ID NO: 1175495 - RNA, 24 nt, Human
uggcgcgaucucagcucaucgcaa

SEQ ID NO: 1175496 - RNA, 18 nt, Human
ugggauuacaggcaugug

SEQ ID NO: 1175497 - RNA, 21 nt, Human
ugggauuacaggcaugugcca

SEQ ID NO: 1175498 - RNA, 22 nt, Human
ugggauuacaggcaugugccac

SEQ ID NO: 1175499 - RNA, 24 nt, Human
ugggauuacaggcaugugccacca

SEQ ID NO: 1175500 - RNA, 18 nt, Human
ugggauuacaggcgugag

SEQ ID NO: 1175501 - RNA, 21 nt, Human
ugggauuacaggcgugagcca

SEQ ID NO: 1175502 - RNA, 22 nt, Human
ugggauuacaggcgugagccac

SEQ ID NO: 1175503 - RNA, 23 nt, Human
ugggauuacaggcgugagccacc

SEQ ID NO: 1175504 - RNA, 23 nt, Human
ugggauuacaggcgugagccacc

SEQ ID NO: 1175505 - RNA, 24 nt, Human
ugggauuacaggcgugagccaccg

SEQ ID NO: 1175506 - RNA, 21 nt, Human
uggucaggcuggucgcgaacu

SEQ ID NO: 1175507 - RNA, 24 nt, Human
ugucccagccuccugaguagcugg

SEQ ID NO: 1175508 - RNA, 18 nt, Human
uuaguagagacgggguuu

SEQ ID NO: 1175509 - RNA, 18 nt, Human
uuaguagagacgggguuu

SEQ ID NO: 1175510 - RNA, 22 nt, Human
uuaguagagacgggguuuuucc

SEQ ID NO: 1175511 - RNA, 24 nt, Human
uuaguagagacgggguuuuuccau

SEQ ID NO: 1175512 - RNA, 19 nt, Human
uucacugagaguaaagaug

SEQ ID NO: 1175513 - RNA, 23 nt, Human
uugcucuuguugcccaggcugga

SEQ ID NO: 1175514 - RNA, 18 nt, Human
uuggccucccaaagugcu

SEQ ID NO: 1175515 - RNA, 23 nt, Human
uuguauuuuuaguagagacgggg

SEQ ID NO: 1175516 - RNA, 21 nt, Human
uuguugcccaggcuggaguga

SEQ ID NO: 1175517 - RNA, 19 nt, Human
uuuaaguagaaaaacaaca

SEQ ID NO: 1175518 - RNA, 24 nt, Human
uuugcucuuguugcccaggcugga

SEQ ID NO: 1175519 - RNA, 24 nt, Human
uuuugcucuuguugcccaggcugg

SEQ ID NO: 1175520 - RNA, 19 nt, Human
uuuuguauuuuuaguagag

SEQ ID NO: 1175521 - RNA, 20 nt, Human
uuuuguauuuuuaguagaga

SEQ ID NO: 1175522 - RNA, 22 nt, Human
uuuuuaguagagacgggguuuu

SEQ ID NO: 1175523 - RNA, 20 nt, Human
uuuuuuuuuuugagacagag

SEQ ID NO: 1175524 - RNA, 25 nt, Human
aaaaaaaaaaaaaacacaaaaaucc

SEQ ID NO: 1175525 - RNA, 20 nt, Human
aaaaaaauuuaccugcccuu

SEQ ID NO: 1175526 - RNA, 22 nt, Human
aaaaaacacucauuaaaaggcc

SEQ ID NO: 1175527 - RNA, 21 nt, Human
aaaaacacaaaaaucccugca

SEQ ID NO: 1175528 - RNA, 22 nt, Human
aaaaacacucauuaaaaggccc

SEQ ID NO: 1175529 - RNA, 21 nt, Human
aaacacacacgcacacauacc

SEQ ID NO: 1175530 - RNA, 24 nt, Human
aaacacagauuuacaauagugagg

SEQ ID NO: 1175531 - RNA, 24 nt, Human
aaagaaaaaacacucauuaaaagg

SEQ ID NO: 1175532 - RNA, 20 nt, Human
aaauagccucuaaugaagau

SEQ ID NO: 1175533 - RNA, 23 nt, Human
aagaaagaagaauucaacauuaa

SEQ ID NO: 1175534 - RNA, 19 nt, Human
aagaaugaagacuaaagga

SEQ ID NO: 1175535 - RNA, 23 nt, Human
aagcaaaccauccaaagugugaa

SEQ ID NO: 1175536 - RNA, 20 nt, Human
aagcaggccugcacagggcu

SEQ ID NO: 1175537 - RNA, 24 nt, Human
aaggagaagaggaaaaaaaagaac

SEQ ID NO: 1175538 - RNA, 25 nt, Human
aagggagacagguauauuuacaaaa

SEQ ID NO: 1175539 - RNA, 19 nt, Human
aaguacuaacgcacuauga

SEQ ID NO: 1175540 - RNA, 22 nt, Human
aagucacacacuuauuugaaau

SEQ ID NO: 1175541 - RNA, 25 nt, Human
aauagccucuaaugaagaucuccau

SEQ ID NO: 1175542 - RNA, 22 nt, Human
acaaaauuuucaccagcuggag

SEQ ID NO: 1175543 - RNA, 23 nt, Human
acacacacgcacacauacccgca

SEQ ID NO: 1175544 - RNA, 24 nt, Human
acauacccgcacccauucacaugu

SEQ ID NO: 1175545 - RNA, 23 nt, Human
accuugaaaaguaacaagaggaa

SEQ ID NO: 1175546 - RNA, 24 nt, Human
acuaaaggaaaccaagaaagaaga

SEQ ID NO: 1175547 - RNA, 21 nt, Human
acuacugcgauucugaaaagc

SEQ ID NO: 1175548 - RNA, 23 nt, Human
acuuugagagucuaugagaaaaa

SEQ ID NO: 1175549 - RNA, 21 nt, Human
agaaaaaacacucauuaaaag

SEQ ID NO: 1175550 - RNA, 19 nt, Human
agaagaggaaaaaaaagaa

SEQ ID NO: 1175551 - RNA, 22 nt, Human
agacaagcaaaccauccaaagu

SEQ ID NO: 1175552 - RNA, 21 nt, Human
agauggcagugggaagaagaa

SEQ ID NO: 1175553 - RNA, 23 nt, Human
aggaaaaaaaaaucccaaaauau

SEQ ID NO: 1175554 - RNA, 23 nt, Human
aggaaaaaaaagaacaccucuag

SEQ ID NO: 1175555 - RNA, 18 nt, Human
aggaaagacugaaaagua

SEQ ID NO: 1175556 - RNA, 18 nt, Human
aggaggaaaaaaaaaucc

SEQ ID NO: 1175557 - RNA, 23 nt, Human
aggaggaaaaaaaaaucccaaaa

SEQ ID NO: 1175558 - RNA, 18 nt, Human
aggcaagauggcaguggg

SEQ ID NO: 1175559 - RNA, 27 nt, Human
auacaacaacaaacacguaacauauac

SEQ ID NO: 1175560 - RNA, 22 nt, Human
aucacauuauucaaaggcaguc

SEQ ID NO: 1175561 - RNA, 21 nt, Human
auccaagggcaagccccagga

SEQ ID NO: 1175562 - RNA, 19 nt, Human
aucuaugucaaguguggag

SEQ ID NO: 1175563 - RNA, 22 nt, Human
auucuugucuuucaccuagagg

SEQ ID NO: 1175564 - RNA, 26 nt, Human
caaaaaaauuaaaaaaaaaaaaaaaa

SEQ ID NO: 1175565 - RNA, 19 nt, Human
caaagggcacguagaacug

SEQ ID NO: 1175566 - RNA, 19 nt, Human
caaaugcaauacaguaauu

SEQ ID NO: 1175567 - RNA, 22 nt, Human
caaauggaaauaccucggcuca

SEQ ID NO: 1175568 - RNA, 19 nt, Human
caaguagcuacuuucaagc

SEQ ID NO: 1175569 - RNA, 22 nt, Human
caaguuagcaaaaacacaccuc

SEQ ID NO: 1175570 - RNA, 27 nt, Human
cacacgcacacauacccgcacccauuc

SEQ ID NO: 1175571 - RNA, 18 nt, Human
cacaugucaucaccaccc

SEQ ID NO: 1175572 - RNA, 21 nt, Human
caggaaacaucuacacugaau

SEQ ID NO: 1175573 - RNA, 21 nt, Human
cagguauauuuacaaaaaucc

SEQ ID NO: 1175574 - RNA, 23 nt, Human
caguucaucucaaaagagccuua

SEQ ID NO: 1175575 - RNA, 23 nt, Human
cauauacaaaaagaaaaaacacu

SEQ ID NO: 1175576 - RNA, 24 nt, Human
ccauucacaugucaucaccacccc

SEQ ID NO: 1175577 - RNA, 22 nt, Human
ccauucagcucuauaaaccuga

SEQ ID NO: 1175578 - RNA, 19 nt, Human
ccucugcugggauguaaag

SEQ ID NO: 1175579 - RNA, 24 nt, Human
ccugcccuucuuuuuucuuaggaa

SEQ ID NO: 1175580 - RNA, 25 nt, Human
ccuugggcuaccaaacaagucuuuc

SEQ ID NO: 1175581 - RNA, 24 nt, Human
cuaaaugcuacaaucuuucagguc

SEQ ID NO: 1175582 - RNA, 22 nt, Human
cuaauuacaaaggcauagccaa

SEQ ID NO: 1175583 - RNA, 23 nt, Human
cugaaaaguagaacuaucacaau

SEQ ID NO: 1175584 - RNA, 21 nt, Human
cugccugaauccucugcuggg

SEQ ID NO: 1175585 - RNA, 24 nt, Human
cuggaggcuugccauggaucacag

SEQ ID NO: 1175586 - RNA, 30 nt, Human
cuuauacaaacacacacgcacacauagugu

SEQ ID NO: 1175587 - RNA, 21 nt, Human
cuuguguucagguccaguuuu

SEQ ID NO: 1175588 - RNA, 23 nt, Human
gaaauggagauacacaggaaaga

SEQ ID NO: 1175589 - RNA, 21 nt, Human
gaagacuaaaggaaaccaaga

SEQ ID NO: 1175590 - RNA, 23 nt, Human
gagaagaggaaaaaaaagaacac

SEQ ID NO: 1175591 - RNA, 19 nt, Human
gcucugaauaaagaaugaa

SEQ ID NO: 1175592 - RNA, 21 nt, Human
ggaagaagaacgugacuucug

SEQ ID NO: 1175593 - RNA, 22 nt, Human
gugaacauucacuguauaaaua

SEQ ID NO: 1175594 - RNA, 25 nt, Human
uaaaaaaaaaaaaaaaacacaaaaa

SEQ ID NO: 1175595 - RNA, 21 nt, Human
uaaaaggcccugucacaaagg

SEQ ID NO: 1175596 - RNA, 22 nt, Human
uaaaauccugagagucccugcc

SEQ ID NO: 1175597 - RNA, 21 nt, Human
uaaagcaggccugcacagggc

SEQ ID NO: 1175598 - RNA, 22 nt, Human
uaaaugcuacaaucuuucaggu

SEQ ID NO: 1175599 - RNA, 21 nt, Human
uaacaagaggaagucaugaaa

SEQ ID NO: 1175600 - RNA, 22 nt, Human
uaacauauacaaaaagaaaaaa

SEQ ID NO: 1175601 - RNA, 22 nt, Human
uauacaaaaagaaaaaacacuc

SEQ ID NO: 1175602 - RNA, 22 nt, Human
uauacaaaaagaaaaaacacuc

SEQ ID NO: 1175603 - RNA, 22 nt, Human
uauacaguagcaaaaucuauuu

SEQ ID NO: 1175604 - RNA, 22 nt, Human
uaugaaauggagauacacagga

SEQ ID NO: 1175605 - RNA, 18 nt, Human
uaugagcaaggcuguugc

SEQ ID NO: 1175606 - RNA, 23 nt, Human
uauuacaaacaucaacucaaagc

SEQ ID NO: 1175607 - RNA, 25 nt, Human
uauuaugagaaauagccucuaauga

SEQ ID NO: 1175608 - RNA, 27 nt, Human
uauuccugcuccgauuugagcuggaaa

SEQ ID NO: 1175609 - RNA, 23 nt, Human
ucacacacuuauuugaaauacag

SEQ ID NO: 1175610 - RNA, 21 nt, Human
ucaguagcagcaguuugucca

SEQ ID NO: 1175611 - RNA, 18 nt, Human
uccauggcugguacagua

SEQ ID NO: 1175612 - RNA, 24 nt, Human
ucccaaaauauuaagucacacacu

SEQ ID NO: 1175613 - RNA, 18 nt, Human
uccuagacacagagaccc

SEQ ID NO: 1175614 - RNA, 18 nt, Human
uccuagacacagagaccc

SEQ ID NO: 1175615 - RNA, 20 nt, Human
ucuuuuuucuuaggaaggag

SEQ ID NO: 1175616 - RNA, 19 nt, Human
ugaaaagcauuccugacuu

SEQ ID NO: 1175617 - RNA, 18 nt, Human
ugaaaaguaacaagagga

SEQ ID NO: 1175618 - RNA, 19 nt, Human
ugaaaaguagaacuaucac

SEQ ID NO: 1175619 - RNA, 21 nt, Human
ugaaaaguagaacuaucacaa

SEQ ID NO: 1175620 - RNA, 21 nt, Human
ugaaauccaagggcaagcccc

SEQ ID NO: 1175621 - RNA, 23 nt, Human
ugaaauggagauacacaggaaag

SEQ ID NO: 1175622 - RNA, 18 nt, Human
ugaagacuaaaggaaacc

SEQ ID NO: 1175623 - RNA, 18 nt, Human
ugaaggucucagaaggua

SEQ ID NO: 1175624 - RNA, 20 nt, Human
ugacuucugcgucauuuccu

SEQ ID NO: 1175625 - RNA, 19 nt, Human
ugagaagaggauguaaaag

SEQ ID NO: 1175626 - RNA, 18 nt, Human
ugagcuggaaauuaaaca

SEQ ID NO: 1175627 - RNA, 21 nt, Human
ugaggaagauguaacuggagg

SEQ ID NO: 1175628 - RNA, 19 nt, Human
ugccugaauccucugcugg

SEQ ID NO: 1175629 - RNA, 21 nt, Human
ugccugaauccucugcuggga

SEQ ID NO: 1175630 - RNA, 19 nt, Human
ugcucuguuauaaaauauu

SEQ ID NO: 1175631 - RNA, 20 nt, Human
uggaaauaccucggcucagu

SEQ ID NO: 1175632 - RNA, 18 nt, Human
uguguucagguccaguuu

SEQ ID NO: 1175633 - RNA, 24 nt, Human
uguugcaaaaaaauuaaaaaaaaa

SEQ ID NO: 1175634 - RNA, 21 nt, Human
uuaauacaaaggagaagagga

SEQ ID NO: 1175635 - RNA, 21 nt, Human
uucaacauuaauauucaaagc

SEQ ID NO: 1175636 - RNA, 18 nt, Human
uucagggggaguaugaaa

SEQ ID NO: 1175637 - RNA, 20 nt, Human
uucagggggaguaugaaaau

SEQ ID NO: 1175638 - RNA, 23 nt, Human
uuccuugggcuaccaaacaaguc

SEQ ID NO: 1175639 - RNA, 18 nt, Human
uugaaacauguuggcauc

SEQ ID NO: 1175640 - RNA, 19 nt, Human
uugaaucuuuucucuggag

SEQ ID NO: 1175641 - RNA, 22 nt, Human
uugaaucuuuucucuggaggcu

SEQ ID NO: 1175642 - RNA, 21 nt, Human
uugguuaaaaaaauuuaccug

SEQ ID NO: 1175643 - RNA, 19 nt, Human
uugguuuugaaacauguug

SEQ ID NO: 1175644 - RNA, 19 nt, Human
uuuaaaggaggaaaaaaaa

SEQ ID NO: 1175645 - RNA, 21 nt, Human
uuuaauuagaguuugaucacc

SEQ ID NO: 1175646 - RNA, 20 nt, Human
uuuacauacucucugaaaga

SEQ ID NO: 1175647 - RNA, 22 nt, Human
uuuccauuagugcucuguuaua

SEQ ID NO: 1175648 - RNA, 18 nt, Human
uuucuuaggaaggaguga

SEQ ID NO: 1175649 - RNA, 20 nt, Human
uuugauacuuucugaaauaa

SEQ ID NO: 1175650 - RNA, 18 nt, Human
uuuggggcacaaaauuuu

SEQ ID NO: 1175651 - RNA, 21 nt, Human
uuuuaaaggaggaaaaaaaaa

SEQ ID NO: 1175652 - RNA, 23 nt, Human
uuuuacuaaaauacaaaaaaggg

SEQ ID NO: 1175653 - RNA, 23 nt, Human
agcagcccuaugaccacauaagu

SEQ ID NO: 1175654 - RNA, 21 nt, Human
augaccacauaaguacuuucc

SEQ ID NO: 1175655 - RNA, 19 nt, Human
auuccaucagucaacuaaa

SEQ ID NO: 1175656 - RNA, 21 nt, Human
caacuaaacauuucgucuccu

SEQ ID NO: 1175657 - RNA, 19 nt, Human
ccucaccacagugcuuggg

SEQ ID NO: 1175658 - RNA, 21 nt, Human
cgacagaaacagcagcccuau

SEQ ID NO: 1175659 - RNA, 24 nt, Human
gaaacagcagcccuaugaccacau

SEQ ID NO: 1175660 - RNA, 22 nt, Human
uaaacaucgacagaaacagcag

SEQ ID NO: 1175661 - RNA, 21 nt, Human
uuagccaauaaugaugcuccu

SEQ ID NO: 1175662 - RNA, 21 nt, Human
accucagccgccgccgcccgu

SEQ ID NO: 1175663 - RNA, 26 nt, Human
acuuuacaauugagggcagggggcua

SEQ ID NO: 1175664 - RNA, 19 nt, Human
auaccgggccacccgcucc

SEQ ID NO: 1175665 - RNA, 21 nt, Human
cacucuuagcaggacgggagc

SEQ ID NO: 1175666 - RNA, 22 nt, Human
cagccgccgccgcccgucgggg

SEQ ID NO: 1175667 - RNA, 24 nt, Human
cagggccccaggucgcagagggcc

SEQ ID NO: 1175668 - RNA, 26 nt, Human
ccaccgccgccaccgccgccuccgcc

SEQ ID NO: 1175669 - RNA, 21 nt, Human
ccaccucagccgccgccgccc

SEQ ID NO: 1175670 - RNA, 28 nt, Human
cccagggccccaggucgcagagggcccc

SEQ ID NO: 1175671 - RNA, 30 nt, Human
ccgccaucuucccgccgccgccgccgccgg

SEQ ID NO: 1175672 - RNA, 21 nt, Human
ccgccgccaccgccgccuccg

SEQ ID NO: 1175673 - RNA, 18 nt, Human
ccgccgccgccgccgccg

SEQ ID NO: 1175674 - RNA, 20 nt, Human
ccgccgccgccgccgccgcc

SEQ ID NO: 1175675 - RNA, 20 nt, Human
ccgccgccgccucccuccgc

SEQ ID NO: 1175676 - RNA, 21 nt, Human
ccgccgccgccucccuccgcc

SEQ ID NO: 1175677 - RNA, 22 nt, Human
ccgccgccgccucccuccgccu

SEQ ID NO: 1175678 - RNA, 18 nt, Human
ccgccucccuccgccucc

SEQ ID NO: 1175679 - RNA, 22 nt, Human
ccuucuaauuuaccggauuuuu

SEQ ID NO: 1175680 - RNA, 23 nt, Human
ccuuuuuguauccauauuuaaaa

SEQ ID NO: 1175681 - RNA, 21 nt, Human
cgcagagggcccggugcucgg

SEQ ID NO: 1175682 - RNA, 20 nt, Human
cgccgccaccgccgccuccc

SEQ ID NO: 1175683 - RNA, 22 nt, Human
cggagcacuucacccagggccc

SEQ ID NO: 1175684 - RNA, 21 nt, Human
cggcaccgacacucuuagcag

SEQ ID NO: 1175685 - RNA, 18 nt, Human
cggggcccgacccagccg

SEQ ID NO: 1175686 - RNA, 21 nt, Human
cuagcaaugguugcucacuuu

SEQ ID NO: 1175687 - RNA, 21 nt, Human
cucccaccgcggcaccgacac

SEQ ID NO: 1175688 - RNA, 23 nt, Human
cuucccgccgccgccgccgccgc

SEQ ID NO: 1175689 - RNA, 24 nt, Human
gagggcccggugcucggggucccg

SEQ ID NO: 1175690 - RNA, 20 nt, Human
ggauuuuuaaaaaucaguuu

SEQ ID NO: 1175691 - RNA, 23 nt, Human
gucccgcuccuucucccgcucca

SEQ ID NO: 1175692 - RNA, 20 nt, Human
uacaguaucuauucuagaau

SEQ ID NO: 1175693 - RNA, 25 nt, Human
uaccggauuuuuaaaaaucaguuug

SEQ ID NO: 1175694 - RNA, 22 nt, Human
uauccauauuuaaaaugaagac

SEQ ID NO: 1175695 - RNA, 18 nt, Human
ucaaaguaaaguuaaagc

SEQ ID NO: 1175696 - RNA, 19 nt, Human
uccaccucagccgccgccg

SEQ ID NO: 1175697 - RNA, 21 nt, Human
ucuucccgccgccgccgccgc

SEQ ID NO: 1175698 - RNA, 24 nt, Human
uucccgccgccgccgccgccgccu

SEQ ID NO: 1175699 - RNA, 19 nt, Human
uuccggcagcgcacacugc

SEQ ID NO: 1175700 - RNA, 21 nt, Human
acccuugcggauauggugcca

SEQ ID NO: 1175701 - RNA, 25 nt, Human
accucguaauccauaggccaaacca

SEQ ID NO: 1175702 - RNA, 24 nt, Human
agcaacagcaaccucguaauccau

SEQ ID NO: 1175703 - RNA, 22 nt, Human
agcaaccucguaauccauaggc

SEQ ID NO: 1175704 - RNA, 21 nt, Human
auguacaacgagucccuggga

SEQ ID NO: 1175705 - RNA, 22 nt, Human
caacagcaaccucguaauccau

SEQ ID NO: 1175706 - RNA, 23 nt, Human
cacuuccucaaagaagcugggaa

SEQ ID NO: 1175707 - RNA, 20 nt, Human
ccugcagccacugcaauugu

SEQ ID NO: 1175708 - RNA, 18 nt, Human
ccugggaagcgcugugga

SEQ ID NO: 1175709 - RNA, 18 nt, Human
cuauguacaacgaguccc

SEQ ID NO: 1175710 - RNA, 25 nt, Human
gacccacuuccucaaagaagcuggu

SEQ ID NO: 1175711 - RNA, 21 nt, Human
gagcagacuggaaaagcuuuc

SEQ ID NO: 1175712 - RNA, 23 nt, Human
ggauauggugccaugcagcacca

SEQ ID NO: 1175713 - RNA, 25 nt, Human
gggaauucucucuuaggaacagcau

SEQ ID NO: 1175714 - RNA, 18 nt, Human
uaggagacccacuuccuc

SEQ ID NO: 1175715 - RNA, 24 nt, Human
uauggugccaugcagcaccauugg

SEQ ID NO: 1175716 - RNA, 18 nt, Human
ucccugggaucuuuggug

SEQ ID NO: 1175717 - RNA, 24 nt, Human
ugacuucaacucuaaacuaaauuc

SEQ ID NO: 1175718 - RNA, 20 nt, Human
uggggaaucagcaacagcaa

SEQ ID NO: 1175719 - RNA, 23 nt, Human
aagaauugcuugagcccaggaga

SEQ ID NO: 1175720 - RNA, 18 nt, Human
aaguuuuucuuuguugac

SEQ ID NO: 1175721 - RNA, 20 nt, Human
aauugcuugagcccaggaga

SEQ ID NO: 1175722 - RNA, 19 nt, Human
acauugcacuccagccugg

SEQ ID NO: 1175723 - RNA, 20 nt, Human
acauugcacuccagccugga

SEQ ID NO: 1175724 - RNA, 20 nt, Human
acauugcacuccagccuggc

SEQ ID NO: 1175725 - RNA, 25 nt, Human
acauugcacuccagccuggcugaca

SEQ ID NO: 1175726 - RNA, 26 nt, Human
acauugcacuccagccuggcugacaa

SEQ ID NO: 1175727 - RNA, 24 nt, Human
agacagagguugcagugagccaag

SEQ ID NO: 1175728 - RNA, 21 nt, Human
agagaacacuucggaauacag

SEQ ID NO: 1175729 - RNA, 22 nt, Human
agagguugcagugagccaagau

SEQ ID NO: 1175730 - RNA, 24 nt, Human
agagguugcagugagccaagauug

SEQ ID NO: 1175731 - RNA, 19 nt, Human
agccuggcugacaaaggaa

SEQ ID NO: 1175732 - RNA, 24 nt, Human
aggaagacucuagcaaggauauug

SEQ ID NO: 1175733 - RNA, 23 nt, Human
aggcagaagaauugcuugagccc

SEQ ID NO: 1175734 - RNA, 24 nt, Human
aggcagaagaauugcuugagccca

SEQ ID NO: 1175735 - RNA, 24 nt, Human
aggcugaggcagaagaauugcuug

SEQ ID NO: 1175736 - RNA, 20 nt, Human
auugcacuccagccuggcug

SEQ ID NO: 1175737 - RNA, 21 nt, Human
auugcacuccagccuggcuga

SEQ ID NO: 1175738 - RNA, 20 nt, Human
cacugcauguaaccuaggcu

SEQ ID NO: 1175739 - RNA, 22 nt, Human
cagccuggcugacaaaggaaga

SEQ ID NO: 1175740 - RNA, 24 nt, Human
cagcuacucaggaggcugaggcag

SEQ ID NO: 1175741 - RNA, 27 nt, Human
caggaggcugaggcagaagaauugcuu

SEQ ID NO: 1175742 - RNA, 24 nt, Human
cauugcacauugcacuccagccug

SEQ ID NO: 1175743 - RNA, 18 nt, Human
cauugcacuccagccugg

SEQ ID NO: 1175744 - RNA, 18 nt, Human
cauugcacuccagccugg

SEQ ID NO: 1175745 - RNA, 19 nt, Human
cauugcacuccagccuggc

SEQ ID NO: 1175746 - RNA, 21 nt, Human
cauugcacuccagccuggcug

SEQ ID NO: 1175747 - RNA, 24 nt, Human
cauugcacuccagccuggcugaca

SEQ ID NO: 1175748 - RNA, 18 nt, Human
cccacacgggugugggag

SEQ ID NO: 1175749 - RNA, 24 nt, Human
cccacacgggugugggagcgaccg

SEQ ID NO: 1175750 - RNA, 21 nt, Human
cuguaaucccagcuacucagg

SEQ ID NO: 1175751 - RNA, 21 nt, Human
cuguaugcagcaucuucuucc

SEQ ID NO: 1175752 - RNA, 24 nt, Human
cuuaguggaacucaaacaucugag

SEQ ID NO: 1175753 - RNA, 27 nt, Human
gagaacacuucggaauacagaugccau

SEQ ID NO: 1175754 - RNA, 21 nt, Human
gagacagagguugcagugagc

SEQ ID NO: 1175755 - RNA, 18 nt, Human
gagguugcagugagccaa

SEQ ID NO: 1175756 - RNA, 18 nt, Human
gcccacacggguguggga

SEQ ID NO: 1175757 - RNA, 24 nt, Human
gcccaggagacagagguugcagug

SEQ ID NO: 1175758 - RNA, 19 nt, Human
gccuggcugacaaaggaag

SEQ ID NO: 1175759 - RNA, 19 nt, Human
ggcuggguccugagacagc

SEQ ID NO: 1175760 - RNA, 20 nt, Human
ucccagagcccacacgggug

SEQ ID NO: 1175761 - RNA, 18 nt, Human
uccuuagacgucuucccc

SEQ ID NO: 1175762 - RNA, 20 nt, Human
ugacaaaggaagacucuagc

SEQ ID NO: 1175763 - RNA, 22 nt, Human
ugagccaagauugugccauugc

SEQ ID NO: 1175764 - RNA, 25 nt, Human
ugaggcagaagaauugcuugagccc

SEQ ID NO: 1175765 - RNA, 21 nt, Human
ugccauucucaaaauugaagu

SEQ ID NO: 1175766 - RNA, 20 nt, Human
ugggagcgaccgggaugacc

SEQ ID NO: 1175767 - RNA, 20 nt, Human
ugggcuggcuggaagagggg

SEQ ID NO: 1175768 - RNA, 21 nt, Human
uugcacauugcacuccagccu

SEQ ID NO: 1175769 - RNA, 22 nt, Human
uugcagugagccaagauugugc

SEQ ID NO: 1175770 - RNA, 24 nt, Human
uugcuugagcccaggagacagagg

SEQ ID NO: 1175771 - RNA, 24 nt, Human
aagaugccccaggucccagggggc

SEQ ID NO: 1175772 - RNA, 25 nt, Human
aagcgggugcucgaacagccuggcc

SEQ ID NO: 1175773 - RNA, 19 nt, Human
aauccacaaagcccucccu

SEQ ID NO: 1175774 - RNA, 26 nt, Human
acaaagcacuccuaaggugggcaaag

SEQ ID NO: 1175775 - RNA, 21 nt, Human
acaaagcccucccucugcuca

SEQ ID NO: 1175776 - RNA, 19 nt, Human
acacacccaggcggaggcc

SEQ ID NO: 1175777 - RNA, 20 nt, Human
agaagacuggaugagaacca

SEQ ID NO: 1175778 - RNA, 20 nt, Human
agacuggaugagaaccaaug

SEQ ID NO: 1175779 - RNA, 19 nt, Human
agggguggcagugagccaa

SEQ ID NO: 1175780 - RNA, 20 nt, Human
agggguggcagugagccaag

SEQ ID NO: 1175781 - RNA, 19 nt, Human
caaagcacuccuaaggugg

SEQ ID NO: 1175782 - RNA, 21 nt, Human
caggucccagggggccccaca

SEQ ID NO: 1175783 - RNA, 22 nt, Human
caguugccugccaagggccugg

SEQ ID NO: 1175784 - RNA, 24 nt, Human
cauccuauccuugcauugguccca

SEQ ID NO: 1175785 - RNA, 23 nt, Human
ccacaccagaauccugggguagg

SEQ ID NO: 1175786 - RNA, 26 nt, Human
cccacgcagcgagaucccacuggaca

SEQ ID NO: 1175787 - RNA, 20 nt, Human
ccccaccccagaagacugga

SEQ ID NO: 1175788 - RNA, 20 nt, Human
ccccgggacagcuggaccaa

SEQ ID NO: 1175789 - RNA, 21 nt, Human
ccgcuuuggggcugagccugg

SEQ ID NO: 1175790 - RNA, 21 nt, Human
ccgcuuuggggcugagccugg

SEQ ID NO: 1175791 - RNA, 27 nt, Human
ccggugcgcggggucgugggggacgcc

SEQ ID NO: 1175792 - RNA, 20 nt, Human
cgacagacccuguggaaggu

SEQ ID NO: 1175793 - RNA, 18 nt, Human
cgacucggaccgacgcgg

SEQ ID NO: 1175794 - RNA, 21 nt, Human
cgcccuggcuggugugcacgg

SEQ ID NO: 1175795 - RNA, 21 nt, Human
cgccgggaucccgcccccgca

SEQ ID NO: 1175796 - RNA, 22 nt, Human
cucccucugcucagacccugcc

SEQ ID NO: 1175797 - RNA, 20 nt, Human
cuugcgugcugcuccucccg

SEQ ID NO: 1175798 - RNA, 20 nt, Human
gaacaggacguccuccuccg

SEQ ID NO: 1175799 - RNA, 18 nt, Human
gagcuccuggcacagaac

SEQ ID NO: 1175800 - RNA, 22 nt, Human
gagcuccuggcacagaacuccc

SEQ ID NO: 1175801 - RNA, 20 nt, Human
gaggcgagcgagcgagauca

SEQ ID NO: 1175802 - RNA, 19 nt, Human
gauggggaaaaugagcugg

SEQ ID NO: 1175803 - RNA, 20 nt, Human
gcaaagaugccccagguccc

SEQ ID NO: 1175804 - RNA, 21 nt, Human
gccacaccagaauccuggggu

SEQ ID NO: 1175805 - RNA, 22 nt, Human
gccacaccagaauccuggggua

SEQ ID NO: 1175806 - RNA, 24 nt, Human
gcugcaguugccugccaagggccu

SEQ ID NO: 1175807 - RNA, 19 nt, Human
guggcagugagccaagccu

SEQ ID NO: 1175808 - RNA, 22 nt, Human
uaaccaggacacacccaggcgg

SEQ ID NO: 1175809 - RNA, 20 nt, Human
uaacuugcgugcugcuccuc

SEQ ID NO: 1175810 - RNA, 27 nt, Human
uaaggugggcaaagaugccccaggucc

SEQ ID NO: 1175811 - RNA, 25 nt, Human
ucacaugcacaucucauccuauccu

SEQ ID NO: 1175812 - RNA, 23 nt, Human
ucccagggggccccacacucucc

SEQ ID NO: 1175813 - RNA, 24 nt, Human
ucccugaagcugcucugggagcuc

SEQ ID NO: 1175814 - RNA, 19 nt, Human
uccgccgcuuuggggcuga

SEQ ID NO: 1175815 - RNA, 19 nt, Human
uccgccggggccggggggc

SEQ ID NO: 1175816 - RNA, 21 nt, Human
ucucauuccucucccugccaa

SEQ ID NO: 1175817 - RNA, 19 nt, Human
ucuccgccggggccggggg

SEQ ID NO: 1175818 - RNA, 19 nt, Human
ugaacaggacguccuccuc

SEQ ID NO: 1175819 - RNA, 22 nt, Human
ugcaaugucaggcagccugggc

SEQ ID NO: 1175820 - RNA, 23 nt, Human
ugccaagacggacccaccuggaa

SEQ ID NO: 1175821 - RNA, 18 nt, Human
ugccaagggccugguggc

SEQ ID NO: 1175822 - RNA, 19 nt, Human
ugccaagggccugguggcc

SEQ ID NO: 1175823 - RNA, 21 nt, Human
ugccaagggccugguggccuu

SEQ ID NO: 1175824 - RNA, 19 nt, Human
ugcccgacagacccugugg

SEQ ID NO: 1175825 - RNA, 18 nt, Human
uggcacagaacucccaca

SEQ ID NO: 1175826 - RNA, 22 nt, Human
uggcacagaacucccacaccuc

SEQ ID NO: 1175827 - RNA, 19 nt, Human
uggccaggagggaggcguc

SEQ ID NO: 1175828 - RNA, 22 nt, Human
uggggaaaaugagcuggagaga

SEQ ID NO: 1175829 - RNA, 18 nt, Human
ugucaggcagccugggca

SEQ ID NO: 1175830 - RNA, 27 nt, Human
uugcgugcugcuccucccgaacgcccu

SEQ ID NO: 1175831 - RNA, 22 nt, Human
uuggaauccacaaagcccuccc

SEQ ID NO: 1175832 - RNA, 21 nt, Human
aaaaaacagggcaggaaccua

SEQ ID NO: 1175833 - RNA, 23 nt, Human
aaacaaaaaacagggcaggaacc

SEQ ID NO: 1175834 - RNA, 26 nt, Human
aaacaaaaaacagggcaggaaccuaa

SEQ ID NO: 1175835 - RNA, 22 nt, Human
aaacaaacaaacaaaaaacagg

SEQ ID NO: 1175836 - RNA, 18 nt, Human
aaacagggcaggaaccua

SEQ ID NO: 1175837 - RNA, 19 nt, Human
aaacagggcaggaaccuaa

SEQ ID NO: 1175838 - RNA, 22 nt, Human
aaagucagauuuggugguucuc

SEQ ID NO: 1175839 - RNA, 23 nt, Human
aacaaacaaacaaacaaaaaaca

SEQ ID NO: 1175840 - RNA, 23 nt, Human
aacaaacaaacaaacaaacaaac

SEQ ID NO: 1175841 - RNA, 23 nt, Human
aacaaacaaacaaacaaacaaac

SEQ ID NO: 1175842 - RNA, 18 nt, Human
aaccugcaggcaugguca

SEQ ID NO: 1175843 - RNA, 18 nt, Human
acaaacaaacaaacaaac

SEQ ID NO: 1175844 - RNA, 18 nt, Human
acaaacaaacaaacaaac

SEQ ID NO: 1175845 - RNA, 18 nt, Human
acaaacaaacaaacaaac

SEQ ID NO: 1175846 - RNA, 24 nt, Human
acaaacaaacaaacaaacaaaaaa

SEQ ID NO: 1175847 - RNA, 25 nt, Human
acccugcaugccugaaguccgacuc

SEQ ID NO: 1175848 - RNA, 26 nt, Human
acuguuuaaaaaacaaacaaacaaac

SEQ ID NO: 1175849 - RNA, 19 nt, Human
agcaggguggucggagaug

SEQ ID NO: 1175850 - RNA, 19 nt, Human
augguuuuucuuguuggcu

SEQ ID NO: 1175851 - RNA, 23 nt, Human
auuguaucaucaaaagcugcuuu

SEQ ID NO: 1175852 - RNA, 20 nt, Human
caaaagcugcuuuugccaac

SEQ ID NO: 1175853 - RNA, 23 nt, Human
caaacaaacaaaaaacagggcug

SEQ ID NO: 1175854 - RNA, 25 nt, Human
caaacaaacaaacaaacaaaaaaca

SEQ ID NO: 1175855 - RNA, 21 nt, Human
caccaucacccugcaugccug

SEQ ID NO: 1175856 - RNA, 21 nt, Human
cagcggcagccgcucccacag

SEQ ID NO: 1175857 - RNA, 23 nt, Human
caggaaccuaaauucugacgcca

SEQ ID NO: 1175858 - RNA, 21 nt, Human
caggguggucggagaugguuu

SEQ ID NO: 1175859 - RNA, 19 nt, Human
caucuuccaccuccugcag

SEQ ID NO: 1175860 - RNA, 23 nt, Human
ccacagcggcagccgcucccaca

SEQ ID NO: 1175861 - RNA, 24 nt, Human
cugcucggccagcuuuaccugggg

SEQ ID NO: 1175862 - RNA, 18 nt, Human
gaccgauggaaguggaua

SEQ ID NO: 1175863 - RNA, 20 nt, Human
gauagggaagagcagggugg

SEQ ID NO: 1175864 - RNA, 20 nt, Human
gccugaaguccauagugucc

SEQ ID NO: 1175865 - RNA, 21 nt, Human
ggaaccuaaauucugacgcca

SEQ ID NO: 1175866 - RNA, 24 nt, Human
guaccagauccucucgaucaucca

SEQ ID NO: 1175867 - RNA, 18 nt, Human
gugggauagggaagagca

SEQ ID NO: 1175868 - RNA, 25 nt, Human
ucagugacaauggggaguugccaag

SEQ ID NO: 1175869 - RNA, 21 nt, Human
uccacagcggcagccgcuccc

SEQ ID NO: 1175870 - RNA, 19 nt, Human
uccugcagcgcuucuuuau

SEQ ID NO: 1175871 - RNA, 25 nt, Human
ucgaucauccacagcggcagccgcu

SEQ ID NO: 1175872 - RNA, 20 nt, Human
ucucacugauuuucaucuuc

SEQ ID NO: 1175873 - RNA, 21 nt, Human
ucucacugauuuucaucuucc

SEQ ID NO: 1175874 - RNA, 27 nt, Human
ucugcaauuguaucaucaaaagcugcu

SEQ ID NO: 1175875 - RNA, 19 nt, Human
ucugcgcgaccgauggaag

SEQ ID NO: 1175876 - RNA, 19 nt, Human
ugccaaggggugggauagg

SEQ ID NO: 1175877 - RNA, 20 nt, Human
ugccaaggggugggauaggg

SEQ ID NO: 1175878 - RNA, 23 nt, Human
uuguauugcucagccugcucggc

SEQ ID NO: 1175879 - RNA, 23 nt, Human
uuuuaugucucacugauuuucau

SEQ ID NO: 1175880 - RNA, 23 nt, Human
uuuucaucuuccaccuccugcag

SEQ ID NO: 1175881 - RNA, 19 nt, Human
agucacagaggcugggccu

SEQ ID NO: 1175882 - RNA, 18 nt, Human
ccauauccucucaguauc

SEQ ID NO: 1175883 - RNA, 18 nt, Human
cucuggguaguucucaaa

SEQ ID NO: 1175884 - RNA, 19 nt, Human
guaaauucucauguccaca

SEQ ID NO: 1175885 - RNA, 21 nt, Human
uauaaccuucuuugaacaccu

SEQ ID NO: 1175886 - RNA, 21 nt, Human
ucacagaggcugggccucuag

SEQ ID NO: 1175887 - RNA, 18 nt, Human
ucaguaucacuuuuugaa

SEQ ID NO: 1175888 - RNA, 20 nt, Human
ucucaaacauugguuaaguu

SEQ ID NO: 1175889 - RNA, 19 nt, Human
aaaaccacaaacacagaac

SEQ ID NO: 1175890 - RNA, 18 nt, Human
aaacagguuuuuucuauu

SEQ ID NO: 1175891 - RNA, 23 nt, Human
aaccacaaacacagaacaagccu

SEQ ID NO: 1175892 - RNA, 18 nt, Human
aaccuagcccgguggcgg

SEQ ID NO: 1175893 - RNA, 21 nt, Human
acaaaaccacaaacacagaac

SEQ ID NO: 1175894 - RNA, 26 nt, Human
acaaaaccacaaacacagaacaagcc

SEQ ID NO: 1175895 - RNA, 27 nt, Human
acagaacaagccuccuaaggcuuuuaa

SEQ ID NO: 1175896 - RNA, 22 nt, Human
accacaaacacagaacaagccu

SEQ ID NO: 1175897 - RNA, 19 nt, Human
accgaggugacggcccaug

SEQ ID NO: 1175898 - RNA, 22 nt, Human
accgugucuugaauaugguugu

SEQ ID NO: 1175899 - RNA, 22 nt, Human
acuccgggauuccgggagcggg

SEQ ID NO: 1175900 - RNA, 19 nt, Human
acuuuguggaugaaagugc

SEQ ID NO: 1175901 - RNA, 22 nt, Human
agcucugcgcgcuccuuuggcc

SEQ ID NO: 1175902 - RNA, 18 nt, Human
agcuggacucuccaaagc

SEQ ID NO: 1175903 - RNA, 23 nt, Human
aggcagguucggcuggugaugcc

SEQ ID NO: 1175904 - RNA, 18 nt, Human
aguagcuuucaaagaccu

SEQ ID NO: 1175905 - RNA, 19 nt, Human
aguagugauuguccccgag

SEQ ID NO: 1175906 - RNA, 19 nt, Human
auggcaccuugagcugcug

SEQ ID NO: 1175907 - RNA, 21 nt, Human
caaaaccacaaacacagaaca

SEQ ID NO: 1175908 - RNA, 28 nt, Human
caaaaccacaaacacagaacaagccucc

SEQ ID NO: 1175909 - RNA, 21 nt, Human
caaacacagaacaagccuccu

SEQ ID NO: 1175910 - RNA, 20 nt, Human
caaccccgagcccuucuccu

SEQ ID NO: 1175911 - RNA, 24 nt, Human
caagcucucuuccuuuccaccccu

SEQ ID NO: 1175912 - RNA, 19 nt, Human
cacucacuucaggguccag

SEQ ID NO: 1175913 - RNA, 18 nt, Human
cagacucgguucgggccg

SEQ ID NO: 1175914 - RNA, 19 nt, Human
cagcaguacaagcugguaa

SEQ ID NO: 1175915 - RNA, 21 nt, Human
cagcuggacucuccaaagccu

SEQ ID NO: 1175916 - RNA, 25 nt, Human
cagcuuacagcugccgugucuucaa

SEQ ID NO: 1175917 - RNA, 19 nt, Human
ccaaaaacguauuuagccg

SEQ ID NO: 1175918 - RNA, 18 nt, Human
ccaacccugagucauagc

SEQ ID NO: 1175919 - RNA, 22 nt, Human
ccacaaacacagaacaagccuc

SEQ ID NO: 1175920 - RNA, 28 nt, Human
ccacaaacacagaacaagcugcuacugc

SEQ ID NO: 1175921 - RNA, 23 nt, Human
ccacccgguggccuccuacuucc

SEQ ID NO: 1175922 - RNA, 22 nt, Human
ccagagccgggcugcuucgcgc

SEQ ID NO: 1175923 - RNA, 20 nt, Human
cccagcccaagcucucuucc

SEQ ID NO: 1175924 - RNA, 19 nt, Human
ccccucuuggcucuugggg

SEQ ID NO: 1175925 - RNA, 19 nt, Human
cccgguggcggaggagugc

SEQ ID NO: 1175926 - RNA, 21 nt, Human
cccuuugcacccgcagccaaa

SEQ ID NO: 1175927 - RNA, 19 nt, Human
ccgguggccuccuacuucc

SEQ ID NO: 1175928 - RNA, 22 nt, Human
ccuacgacacgagccccaaggc

SEQ ID NO: 1175929 - RNA, 19 nt, Human
ccugaaccgaggugacggc

SEQ ID NO: 1175930 - RNA, 18 nt, Human
ccuucuggaguagcuuuc

SEQ ID NO: 1175931 - RNA, 19 nt, Human
cgaaaggaauaaacuggug

SEQ ID NO: 1175932 - RNA, 19 nt, Human
cgagccccaaggcaggagg

SEQ ID NO: 1175933 - RNA, 22 nt, Human
cgaggugacggcccaugccacc

SEQ ID NO: 1175934 - RNA, 19 nt, Human
cgccaagaacucugcgaug

SEQ ID NO: 1175935 - RNA, 23 nt, Human
cgccaagaacucugcgaugggcu

SEQ ID NO: 1175936 - RNA, 19 nt, Human
cgcccuuugcuugcagcuc

SEQ ID NO: 1175937 - RNA, 22 nt, Human
cgccuugugcuaccugaaccga

SEQ ID NO: 1175938 - RNA, 26 nt, Human
cgcgcgcgcgcgucuguguguauccu

SEQ ID NO: 1175939 - RNA, 18 nt, Human
cgcgcuucuuggcuuuuu

SEQ ID NO: 1175940 - RNA, 19 nt, Human
cgcuaaucaaucaauugca

SEQ ID NO: 1175941 - RNA, 23 nt, Human
cggcggcgcccgcggcggugccc

SEQ ID NO: 1175942 - RNA, 22 nt, Human
cgguggccuccuacuuccucag

SEQ ID NO: 1175943 - RNA, 23 nt, Human
cuacgacacgagccccaaggcag

SEQ ID NO: 1175944 - RNA, 23 nt, Human
cucaacugcgcacugagucucaa

SEQ ID NO: 1175945 - RNA, 23 nt, Human
cuccuacuuccucaguuccccuu

SEQ ID NO: 1175946 - RNA, 25 nt, Human
cugcaugauccccuucgugccugug

SEQ ID NO: 1175947 - RNA, 19 nt, Human
gacucgguucgggccgcgg

SEQ ID NO: 1175948 - RNA, 18 nt, Human
gagcugcugcggucggcc

SEQ ID NO: 1175949 - RNA, 19 nt, Human
gaucacuuaagaaaguuug

SEQ ID NO: 1175950 - RNA, 18 nt, Human
gauccccugcaugauccc

SEQ ID NO: 1175951 - RNA, 19 nt, Human
gcagguacuuaagaaagaa

SEQ ID NO: 1175952 - RNA, 21 nt, Human
gcccaugccacccggcagccg

SEQ ID NO: 1175953 - RNA, 21 nt, Human
gccgcggaaggccagucugga

SEQ ID NO: 1175954 - RNA, 22 nt, Human
gcgcccgcggcggugcccucgg

SEQ ID NO: 1175955 - RNA, 22 nt, Human
gcggaggagugcagcaggaggg

SEQ ID NO: 1175956 - RNA, 20 nt, Human
ggccccaccgcccuuugcuu

SEQ ID NO: 1175957 - RNA, 18 nt, Human
ggcccgcgacgcgcugcc

SEQ ID NO: 1175958 - RNA, 18 nt, Human
ggccuccuacuuccucag

SEQ ID NO: 1175959 - RNA, 24 nt, Human
ggcggaggagugcagcaggagggg

SEQ ID NO: 1175960 - RNA, 21 nt, Human
guucaaaaccucggauuucag

SEQ ID NO: 1175961 - RNA, 24 nt, Human
guucccagcccaagcucucuuccu

SEQ ID NO: 1175962 - RNA, 18 nt, Human
uaaggcuccagaggccgc

SEQ ID NO: 1175963 - RNA, 23 nt, Human
uacaaaaccacaaacacagaaca

SEQ ID NO: 1175964 - RNA, 25 nt, Human
uacaaaaccacaaacacagaacaag

SEQ ID NO: 1175965 - RNA, 18 nt, Human
uaccugaaccgaggugac

SEQ ID NO: 1175966 - RNA, 18 nt, Human
uacgacacgagccccaag

SEQ ID NO: 1175967 - RNA, 21 nt, Human
uacgacacgagccccaaggca

SEQ ID NO: 1175968 - RNA, 20 nt, Human
uagccagaaacugcauuugc

SEQ ID NO: 1175969 - RNA, 20 nt, Human
uagccgaaaggaauaaacug

SEQ ID NO: 1175970 - RNA, 23 nt, Human
uagcuuucaaagaccugucccag

SEQ ID NO: 1175971 - RNA, 19 nt, Human
ucaacaaaaagccacaagc

SEQ ID NO: 1175972 - RNA, 18 nt, Human
ucacuucaggguccaggc

SEQ ID NO: 1175973 - RNA, 21 nt, Human
uccacaguaaagguuggagaa

SEQ ID NO: 1175974 - RNA, 22 nt, Human
uccauaaaguccaacccugagu

SEQ ID NO: 1175975 - RNA, 20 nt, Human
ucccaggccuauugccgcgg

SEQ ID NO: 1175976 - RNA, 20 nt, Human
uccccuucgugccuguggcc

SEQ ID NO: 1175977 - RNA, 24 nt, Human
uccucuuggaaguuaacgauuggc

SEQ ID NO: 1175978 - RNA, 25 nt, Human
uccuuuggccuccucacgccagcuu

SEQ ID NO: 1175979 - RNA, 18 nt, Human
ucggcucccgcauucagc

SEQ ID NO: 1175980 - RNA, 23 nt, Human
ucuaaaugguccagacucgguuc

SEQ ID NO: 1175981 - RNA, 20 nt, Human
ucucaagggcgaccuggccc

SEQ ID NO: 1175982 - RNA, 18 nt, Human
ucucuuccuuuccacccc

SEQ ID NO: 1175983 - RNA, 20 nt, Human
ucuucuaaaugguccagacu

SEQ ID NO: 1175984 - RNA, 19 nt, Human
ugacaagcaaaacuuugcu

SEQ ID NO: 1175985 - RNA, 20 nt, Human
ugcagcccuuccugcgcgcc

SEQ ID NO: 1175986 - RNA, 18 nt, Human
ugccaggcagauggcacc

SEQ ID NO: 1175987 - RNA, 21 nt, Human
ugcgcacugagucucaagggc

SEQ ID NO: 1175988 - RNA, 22 nt, Human
ugcgcgcgcgcgcgucugugug

SEQ ID NO: 1175989 - RNA, 20 nt, Human
ugcucuuuccagacucucaa

SEQ ID NO: 1175990 - RNA, 19 nt, Human
ugcuugcagcucugcgcgc

SEQ ID NO: 1175991 - RNA, 22 nt, Human
uggcaggaguccauugggcugg

SEQ ID NO: 1175992 - RNA, 19 nt, Human
uggcccgcgacgcgcugcc

SEQ ID NO: 1175993 - RNA, 21 nt, Human
ugggcuaucuucuaauuguuc

SEQ ID NO: 1175994 - RNA, 22 nt, Human
uggggcggagggacccggguag

SEQ ID NO: 1175995 - RNA, 18 nt, Human
uggucccggcgguggaga

SEQ ID NO: 1175996 - RNA, 20 nt, Human
uguacaagucagcuggacuc

SEQ ID NO: 1175997 - RNA, 22 nt, Human
uguuuugugugugugucugcuu

SEQ ID NO: 1175998 - RNA, 24 nt, Human
uugugugugugucugcuuguuucu

SEQ ID NO: 1175999 - RNA, 21 nt, Human
uuuauaaacuucuuuuuuucc

SEQ ID NO: 1176000 - RNA, 22 nt, Human
aaaggucucccuggaucaaagc

SEQ ID NO: 1176001 - RNA, 25 nt, Human
aagagacaaacaugagaaaacaaaa

SEQ ID NO: 1176002 - RNA, 21 nt, Human
aauggaaaaggucucccugga

SEQ ID NO: 1176003 - RNA, 25 nt, Human
acaaaacaacaucaguuguagaaga

SEQ ID NO: 1176004 - RNA, 21 nt, Human
acaaacaugagaaaacaaaac

SEQ ID NO: 1176005 - RNA, 18 nt, Human
agagacaaacaugagaaa

SEQ ID NO: 1176006 - RNA, 18 nt, Human
cacaaauuucacccuugu

SEQ ID NO: 1176007 - RNA, 24 nt, Human
caugagaaaacaaaacaacaucag

SEQ ID NO: 1176008 - RNA, 23 nt, Human
cuucagaaaauucuccagauuuc

SEQ ID NO: 1176009 - RNA, 19 nt, Human
gagacaaacaugagaaaac

SEQ ID NO: 1176010 - RNA, 23 nt, Human
uaaguuuucaggaugucacacuu

SEQ ID NO: 1176011 - RNA, 18 nt, Human
uagaagaacauaaagaag

SEQ ID NO: 1176012 - RNA, 19 nt, Human
uagaagaacauaaagaaga

SEQ ID NO: 1176013 - RNA, 24 nt, Human
uaucuugcuccuuccaguauuuua

SEQ ID NO: 1176014 - RNA, 21 nt, Human
uauuaagagacaaacaugaga

SEQ ID NO: 1176015 - RNA, 21 nt, Human
ugagaaaacaaaacaacaucg

SEQ ID NO: 1176016 - RNA, 19 nt, Human
ugcaugccuuauggaaaaa

SEQ ID NO: 1176017 - RNA, 18 nt, Human
uggaaaaggucucccugg

SEQ ID NO: 1176018 - RNA, 20 nt, Human
uguccuaugggcuaaaagcu

SEQ ID NO: 1176019 - RNA, 24 nt, Human
aaacagauuaaauuccauuuccau

SEQ ID NO: 1176020 - RNA, 22 nt, Human
aaacauuuguacuucaaaaaug

SEQ ID NO: 1176021 - RNA, 21 nt, Human
aacuucaggauuaaacagagg

SEQ ID NO: 1176022 - RNA, 22 nt, Human
aagcagacgauaaacugcaaag

SEQ ID NO: 1176023 - RNA, 24 nt, Human
aauucuguagaaggcaaauaaagc

SEQ ID NO: 1176024 - RNA, 23 nt, Human
acucaaaauacuaugaaaaacaa

SEQ ID NO: 1176025 - RNA, 24 nt, Human
acuuaaagaaguuuucaagaaaga

SEQ ID NO: 1176026 - RNA, 24 nt, Human
agagcacuuuauaauguuuccucc

SEQ ID NO: 1176027 - RNA, 20 nt, Human
augaaaaacaaaaaacaaaa

SEQ ID NO: 1176028 - RNA, 22 nt, Human
caagaaagagcacuuuauaaug

SEQ ID NO: 1176029 - RNA, 18 nt, Human
cggcgugagguggaugau

SEQ ID NO: 1176030 - RNA, 25 nt, Human
cuaugaaaaacaaaaaacaaaauca

SEQ ID NO: 1176031 - RNA, 22 nt, Human
cucugugaccucuguauuaccc

SEQ ID NO: 1176032 - RNA, 22 nt, Human
cuguagaaggcaaauaaagcug

SEQ ID NO: 1176033 - RNA, 18 nt, Human
gugagguggaugauacag

SEQ ID NO: 1176034 - RNA, 26 nt, Human
uaccccaaaauauuaauuucaguaac

SEQ ID NO: 1176035 - RNA, 24 nt, Human
uagaaggcaaauaaagcuggcaac

SEQ ID NO: 1176036 - RNA, 22 nt, Human
ucaagaaagagcacuuuauaau

SEQ ID NO: 1176037 - RNA, 18 nt, Human
ugagaaggauggaaggug

SEQ ID NO: 1176038 - RNA, 23 nt, Human
ugccgaucaucaaacaaauacuc

SEQ ID NO: 1176039 - RNA, 22 nt, Human
uggcaacuguggcaaaaguaaa

SEQ ID NO: 1176040 - RNA, 21 nt, Human
ugggucuugagggaccuuaag

SEQ ID NO: 1176041 - RNA, 23 nt, Human
uguuuucuuuaccccaaaauauu

SEQ ID NO: 1176042 - RNA, 21 nt, Human
uucaaugggucuugagggacc

SEQ ID NO: 1176043 - RNA, 19 nt, Human
uucucguuuuugagccuca

SEQ ID NO: 1176044 - RNA, 18 nt, Human
uugucuaguuuuuauuug

SEQ ID NO: 1176045 - RNA, 25 nt, Human
uuucaagaaagagcacuuuauaaug

SEQ ID NO: 1176046 - RNA, 20 nt, Human
aacaucucacaaugcauuuc

SEQ ID NO: 1176047 - RNA, 18 nt, Human
aagcaggcagggaggcaa

SEQ ID NO: 1176048 - RNA, 23 nt, Human
acccgcuuuagcuguuuuaugcu

SEQ ID NO: 1176049 - RNA, 18 nt, Human
aggcagggaggcaagugg

SEQ ID NO: 1176050 - RNA, 24 nt, Human
agggaaaaaacuucaauccacauu

SEQ ID NO: 1176051 - RNA, 24 nt, Human
agggaggcaaguggcaggcugguc

SEQ ID NO: 1176052 - RNA, 20 nt, Human
aucuuuaaauuaacugcuuc

SEQ ID NO: 1176053 - RNA, 23 nt, Human
cagaagcaggcagggaggcaagu

SEQ ID NO: 1176054 - RNA, 25 nt, Human
cagaaggagcuugaaggaccaggca

SEQ ID NO: 1176055 - RNA, 24 nt, Human
cugcauccucuucuaaagaucaug

SEQ ID NO: 1176056 - RNA, 20 nt, Human
ggaccaggcauucaaggcgg

SEQ ID NO: 1176057 - RNA, 18 nt, Human
ggcuucuggaacuuccac

SEQ ID NO: 1176058 - RNA, 22 nt, Human
uacaacucggaguuaccaacac

SEQ ID NO: 1176059 - RNA, 22 nt, Human
uauugagauuacaaaaauaaca

SEQ ID NO: 1176060 - RNA, 19 nt, Human
uccacagauaggaagagca

SEQ ID NO: 1176061 - RNA, 20 nt, Human
ucuuuggaauuaauggguga

SEQ ID NO: 1176062 - RNA, 20 nt, Human
ugaaggaccaggcauucaag

SEQ ID NO: 1176063 - RNA, 23 nt, Human
uucauauuuacagaagaaacaug

SEQ ID NO: 1176064 - RNA, 19 nt, Human
uugaaggaccaggcauuca

SEQ ID NO: 1176065 - RNA, 20 nt, Human
caggagagauaaagccucug

SEQ ID NO: 1176066 - RNA, 23 nt, Human
ucaggauuuucuacuaacauugg

SEQ ID NO: 1176067 - RNA, 20 nt, Human
ucaugagccuucccugcagg

SEQ ID NO: 1176068 - RNA, 24 nt, Human
aaaaaaaaaaaaaaaagcagcaag

SEQ ID NO: 1176069 - RNA, 24 nt, Human
aaaaaaaaaaaaagcagcaagcaa

SEQ ID NO: 1176070 - RNA, 20 nt, Human
aaaaaaaaaagagagagaca

SEQ ID NO: 1176071 - RNA, 19 nt, Human
aaaaaacuuagucuggcac

SEQ ID NO: 1176072 - RNA, 19 nt, Human
aaaauacaaaaauuagccc

SEQ ID NO: 1176073 - RNA, 25 nt, Human
aaacagaagugagcucuucccagag

SEQ ID NO: 1176074 - RNA, 19 nt, Human
aaagugcugggauuacaua

SEQ ID NO: 1176075 - RNA, 20 nt, Human
aacagggugaaacccugucu

SEQ ID NO: 1176076 - RNA, 21 nt, Human
aacagggugaaacccugucuc

SEQ ID NO: 1176077 - RNA, 24 nt, Human
aacagggugaaacccugucucaaa

SEQ ID NO: 1176078 - RNA, 20 nt, Human
aacagguugcagugcgaugg

SEQ ID NO: 1176079 - RNA, 19 nt, Human
aacauggcaaaaccccauc

SEQ ID NO: 1176080 - RNA, 21 nt, Human
aacauggcaaaaccccaucuc

SEQ ID NO: 1176081 - RNA, 21 nt, Human
aacauggcaaaaccccaucuc

SEQ ID NO: 1176082 - RNA, 19 nt, Human
aacauggugaaaccccgac

SEQ ID NO: 1176083 - RNA, 21 nt, Human
aacauggugaaaccccgacuc

SEQ ID NO: 1176084 - RNA, 21 nt, Human
aacauggugaaaccccgacuc

SEQ ID NO: 1176085 - RNA, 20 nt, Human
aacauggugagacccugucu

SEQ ID NO: 1176086 - RNA, 21 nt, Human
aacauggugagacccugucuc

SEQ ID NO: 1176087 - RNA, 23 nt, Human
aaccggaugugguggcaggcgcc

SEQ ID NO: 1176088 - RNA, 20 nt, Human
aagcaacaggauggguggaa

SEQ ID NO: 1176089 - RNA, 21 nt, Human
aagcagcacagagcaccagcc

SEQ ID NO: 1176090 - RNA, 22 nt, Human
aagcagcacagagcaccagccc

SEQ ID NO: 1176091 - RNA, 18 nt, Human
aagcaggaggaucacuug

SEQ ID NO: 1176092 - RNA, 23 nt, Human
aagcaggaggaucacuugagccu

SEQ ID NO: 1176093 - RNA, 24 nt, Human
aagcaggaggaucacuugagccua

SEQ ID NO: 1176094 - RNA, 19 nt, Human
aagcgacccagauaggguc

SEQ ID NO: 1176095 - RNA, 21 nt, Human
aagggccuggacugcaaagcu

SEQ ID NO: 1176096 - RNA, 19 nt, Human
aaguagcuugcucuccucu

SEQ ID NO: 1176097 - RNA, 22 nt, Human
aagugagcucuucccagaguuu

SEQ ID NO: 1176098 - RNA, 19 nt, Human
aagugagcugugggagagg

SEQ ID NO: 1176099 - RNA, 25 nt, Human
aagugauucuccugccucagccucc

SEQ ID NO: 1176100 - RNA, 21 nt, Human
aagugcugggauuacauaugu

SEQ ID NO: 1176101 - RNA, 24 nt, Human
aaucgcuugaacccaggagguaga

SEQ ID NO: 1176102 - RNA, 19 nt, Human
aauuagccaggcaugguug

SEQ ID NO: 1176103 - RNA, 20 nt, Human
acagagcgagacucuaucuc

SEQ ID NO: 1176104 - RNA, 21 nt, Human
acagcugaaauccccaggaaa

SEQ ID NO: 1176105 - RNA, 19 nt, Human
acagggugaaacccugucu

SEQ ID NO: 1176106 - RNA, 24 nt, Human
acagggugaaacccugucucaaaa

SEQ ID NO: 1176107 - RNA, 20 nt, Human
acauagcaagaccccaucuc

SEQ ID NO: 1176108 - RNA, 24 nt, Human
accagguaguuagcaugaccccaa

SEQ ID NO: 1176109 - RNA, 24 nt, Human
accccaucucuacuaaaaauacaa

SEQ ID NO: 1176110 - RNA, 24 nt, Human
accccgacucuacuaaaaauacaa

SEQ ID NO: 1176111 - RNA, 24 nt, Human
acccugggcgacagagcgagacuc

SEQ ID NO: 1176112 - RNA, 24 nt, Human
acccugucucaaaaaacaggagcc

SEQ ID NO: 1176113 - RNA, 22 nt, Human
acgccacugcacuccacccugg

SEQ ID NO: 1176114 - RNA, 24 nt, Human
acgccacugcacuccacccugggc

SEQ ID NO: 1176115 - RNA, 23 nt, Human
acggcauuccagccuggcaacag

SEQ ID NO: 1176116 - RNA, 24 nt, Human
acggcauuccagccuggcaacaga

SEQ ID NO: 1176117 - RNA, 24 nt, Human
acguaaggucaggaguucgagacc

SEQ ID NO: 1176118 - RNA, 24 nt, Human
acuaaaaauacaaaaauuaaccgg

SEQ ID NO: 1176119 - RNA, 21 nt, Human
acucuacuaaaaauacaaaaa

SEQ ID NO: 1176120 - RNA, 18 nt, Human
acugcacuccacccuggg

SEQ ID NO: 1176121 - RNA, 24 nt, Human
acugcacuccacccugggcgacag

SEQ ID NO: 1176122 - RNA, 19 nt, Human
acugcacucuggccugcga

SEQ ID NO: 1176123 - RNA, 23 nt, Human
acugcacucuggccugcgagaca

SEQ ID NO: 1176124 - RNA, 24 nt, Human
agaacuuugggaggccgagguggg

SEQ ID NO: 1176125 - RNA, 22 nt, Human
agaaucgcugggacccaggaga

SEQ ID NO: 1176126 - RNA, 22 nt, Human
agaaucgcuugaacccaggagg

SEQ ID NO: 1176127 - RNA, 25 nt, Human
agagaaaccugcccggggcaucaga

SEQ ID NO: 1176128 - RNA, 18 nt, Human
agagagagacagguggaa

SEQ ID NO: 1176129 - RNA, 22 nt, Human
agagagggaagugagcuguggg

SEQ ID NO: 1176130 - RNA, 18 nt, Human
agagauggaacgugccgu

SEQ ID NO: 1176131 - RNA, 20 nt, Human
agagcaccagcccaggagau

SEQ ID NO: 1176132 - RNA, 22 nt, Human
agaggaaggagaggagaucaag

SEQ ID NO: 1176133 - RNA, 18 nt, Human
agagguucaggacuggcc

SEQ ID NO: 1176134 - RNA, 22 nt, Human
agagguugcagugagcugagau

SEQ ID NO: 1176135 - RNA, 24 nt, Human
agagguugcagugagcugagauug

SEQ ID NO: 1176136 - RNA, 18 nt, Human
agaguggauuggagaagg

SEQ ID NO: 1176137 - RNA, 24 nt, Human
agaugcaguggcucacgccuguaa

SEQ ID NO: 1176138 - RNA, 20 nt, Human
agcacuuucggaggcugaag

SEQ ID NO: 1176139 - RNA, 24 nt, Human
agcacuuugggaggccgaggcagg

SEQ ID NO: 1176140 - RNA, 21 nt, Human
agccaggcacagugacucaca

SEQ ID NO: 1176141 - RNA, 22 nt, Human
agccaggcugggcaccauggcu

SEQ ID NO: 1176142 - RNA, 19 nt, Human
agccagugugguggugcac

SEQ ID NO: 1176143 - RNA, 21 nt, Human
agccgggugugguggcucacg

SEQ ID NO: 1176144 - RNA, 24 nt, Human
agccuagccaacauggugagaccc

SEQ ID NO: 1176145 - RNA, 24 nt, Human
agccugaggcaggagaaucgcuug

SEQ ID NO: 1176146 - RNA, 22 nt, Human
agccuggcaacagaggagacug

SEQ ID NO: 1176147 - RNA, 18 nt, Human
agccuggccaacauggca

SEQ ID NO: 1176148 - RNA, 24 nt, Human
agccuggccaacauggcaaaaccc

SEQ ID NO: 1176149 - RNA, 21 nt, Human
agccugggcaacauagugaga

SEQ ID NO: 1176150 - RNA, 24 nt, Human
agccugggcaacauagugagaucc

SEQ ID NO: 1176151 - RNA, 25 nt, Human
agccugggcaacauagugagauccu

SEQ ID NO: 1176152 - RNA, 19 nt, Human
agccugggcaacaugguga

SEQ ID NO: 1176153 - RNA, 22 nt, Human
agccugggcaacauggugaaac

SEQ ID NO: 1176154 - RNA, 24 nt, Human
agccugggcaacauggugaaaccc

SEQ ID NO: 1176155 - RNA, 23 nt, Human
agccuguaaucccaggacuuugg

SEQ ID NO: 1176156 - RNA, 24 nt, Human
agccuguaaucccaggacuuuggg

SEQ ID NO: 1176157 - RNA, 21 nt, Human
agcucccccucccuggacagc

SEQ ID NO: 1176158 - RNA, 19 nt, Human
aggaagggccauguugggc

SEQ ID NO: 1176159 - RNA, 20 nt, Human
aggacuuugggaggcugagg

SEQ ID NO: 1176160 - RNA, 19 nt, Human
aggagcuggucuuugggcc

SEQ ID NO: 1176161 - RNA, 23 nt, Human
aggaguucgagaccagccugggc

SEQ ID NO: 1176162 - RNA, 24 nt, Human
aggaguuugagaccagccacauag

SEQ ID NO: 1176163 - RNA, 24 nt, Human
aggaucacuugagcccaggaguuu

SEQ ID NO: 1176164 - RNA, 24 nt, Human
aggaucacuugagccuaggaguuc

SEQ ID NO: 1176165 - RNA, 24 nt, Human
aggcacagugacucacaacuguaa

SEQ ID NO: 1176166 - RNA, 23 nt, Human
aggcaggaacagcagcugcauga

SEQ ID NO: 1176167 - RNA, 23 nt, Human
aggcaggagaaucgcugggaccc

SEQ ID NO: 1176168 - RNA, 23 nt, Human
aggcaggagaaucgcuugaaccc

SEQ ID NO: 1176169 - RNA, 18 nt, Human
aggcaggagaauggugug

SEQ ID NO: 1176170 - RNA, 21 nt, Human
aggcaggagaauggugugaac

SEQ ID NO: 1176171 - RNA, 24 nt, Human
aggcaggagaauggugugaacccg

SEQ ID NO: 1176172 - RNA, 18 nt, Human
aggcaggaggaucacuug

SEQ ID NO: 1176173 - RNA, 23 nt, Human
aggcaggaggaucacuugagccc

SEQ ID NO: 1176174 - RNA, 18 nt, Human
aggcaggaggauugcuug

SEQ ID NO: 1176175 - RNA, 24 nt, Human
aggccaaggcaggaggauugcuug

SEQ ID NO: 1176176 - RNA, 22 nt, Human
aggccagaugcaguggcucacg

SEQ ID NO: 1176177 - RNA, 24 nt, Human
aggccgaggcaggaggaucacuug

SEQ ID NO: 1176178 - RNA, 21 nt, Human
aggccgaggugggcagaucac

SEQ ID NO: 1176179 - RNA, 21 nt, Human
aggcggagguugcaaugagcc

SEQ ID NO: 1176180 - RNA, 24 nt, Human
aggcggagguugcaaugagccgag

SEQ ID NO: 1176181 - RNA, 22 nt, Human
aggcggguagaucaccugaggg

SEQ ID NO: 1176182 - RNA, 22 nt, Human
aggcggguagaucaccugaggu

SEQ ID NO: 1176183 - RNA, 26 nt, Human
aggcggguggaucacguaaggucagg

SEQ ID NO: 1176184 - RNA, 24 nt, Human
aggcugaagcaggaggaucacuug

SEQ ID NO: 1176185 - RNA, 24 nt, Human
aggcugaggagggaggauugcuug

SEQ ID NO: 1176186 - RNA, 20 nt, Human
aggcugaggcaggagaaucg

SEQ ID NO: 1176187 - RNA, 23 nt, Human
aggcugaggcaggagaaucgcug

SEQ ID NO: 1176188 - RNA, 19 nt, Human
aggcugaggcaggagaaug

SEQ ID NO: 1176189 - RNA, 21 nt, Human
aggcugaggcggguagaucac

SEQ ID NO: 1176190 - RNA, 24 nt, Human
aggcugaguggggaggacugcuug

SEQ ID NO: 1176191 - RNA, 25 nt, Human
aggcuggagugcaguggcgcaaucu

SEQ ID NO: 1176192 - RNA, 23 nt, Human
agggaggauugcuugagcccagg

SEQ ID NO: 1176193 - RNA, 24 nt, Human
aggggccccucuacccaccaaauc

SEQ ID NO: 1176194 - RNA, 24 nt, Human
agguagagguugcagugagcugag

SEQ ID NO: 1176195 - RNA, 18 nt, Human
agguagugaacuccccau

SEQ ID NO: 1176196 - RNA, 22 nt, Human
aggugaagaggugaagcccagg

SEQ ID NO: 1176197 - RNA, 26 nt, Human
aggugggcagaucaccugagcucagg

SEQ ID NO: 1176198 - RNA, 24 nt, Human
agugacucacaacuguaaucccag

SEQ ID NO: 1176199 - RNA, 24 nt, Human
agugauucuccugccucagccucc

SEQ ID NO: 1176200 - RNA, 20 nt, Human
agugcaguggcgcaaucucg

SEQ ID NO: 1176201 - RNA, 24 nt, Human
agugcaguggcgcaaucucggcuc

SEQ ID NO: 1176202 - RNA, 24 nt, Human
aguggcucacgccuguaaucccag

SEQ ID NO: 1176203 - RNA, 18 nt, Human
agugguggggaccagagu

SEQ ID NO: 1176204 - RNA, 24 nt, Human
aucacaccacugcacucuggccug

SEQ ID NO: 1176205 - RNA, 24 nt, Human
aucacgccacugcacuccacccug

SEQ ID NO: 1176206 - RNA, 24 nt, Human
aucacguaaggucaggaguucgag

SEQ ID NO: 1176207 - RNA, 24 nt, Human
aucacuugagcccaggaguuugag

SEQ ID NO: 1176208 - RNA, 24 nt, Human
aucacuugagccuaggaguucaag

SEQ ID NO: 1176209 - RNA, 21 nt, Human
augcaguucccaaggcagccu

SEQ ID NO: 1176210 - RNA, 21 nt, Human
augcaucugugccugcacaca

SEQ ID NO: 1176211 - RNA, 22 nt, Human
auggaacgugccguugcuuccc

SEQ ID NO: 1176212 - RNA, 22 nt, Human
auggagguuauucucucugagc

SEQ ID NO: 1176213 - RNA, 23 nt, Human
auggcucacgccuguaaucccag

SEQ ID NO: 1176214 - RNA, 24 nt, Human
auugcgccacggcauuccagccug

SEQ ID NO: 1176215 - RNA, 21 nt, Human
caaaaaaaaaaggccagaugc

SEQ ID NO: 1176216 - RNA, 23 nt, Human
caacagagagagauucucucuac

SEQ ID NO: 1176217 - RNA, 21 nt, Human
caacauagugagauccugucu

SEQ ID NO: 1176218 - RNA, 22 nt, Human
caacauagugagauccugucuc

SEQ ID NO: 1176219 - RNA, 24 nt, Human
caacauagugagauccugucucua

SEQ ID NO: 1176220 - RNA, 22 nt, Human
caacauggugaaaccccgacuc

SEQ ID NO: 1176221 - RNA, 24 nt, Human
caacauggugaaaccccgacucua

SEQ ID NO: 1176222 - RNA, 24 nt, Human
caacauggugagacccugucucca

SEQ ID NO: 1176223 - RNA, 20 nt, Human
caaccuccgccucccggguu

SEQ ID NO: 1176224 - RNA, 21 nt, Human
caacugagcaaacagccugaa

SEQ ID NO: 1176225 - RNA, 24 nt, Human
caacuguaaucccagcacuuucgg

SEQ ID NO: 1176226 - RNA, 26 nt, Human
caaggcaggaggauugcuugaagcca

SEQ ID NO: 1176227 - RNA, 22 nt, Human
caagugauucuccugccucagc

SEQ ID NO: 1176228 - RNA, 19 nt, Human
cacaacuguaaucccagca

SEQ ID NO: 1176229 - RNA, 19 nt, Human
cacagagcaccagcccagg

SEQ ID NO: 1176230 - RNA, 20 nt, Human
cacauagcaagaccccaucu

SEQ ID NO: 1176231 - RNA, 20 nt, Human
caccaagagguucaggacug

SEQ ID NO: 1176232 - RNA, 18 nt, Human
caccacugcacucuggcc

SEQ ID NO: 1176233 - RNA, 18 nt, Human
cacccaccacacccagcc

SEQ ID NO: 1176234 - RNA, 24 nt, Human
caccuaggcuggagugcaguggcg

SEQ ID NO: 1176235 - RNA, 23 nt, Human
caccuguaaucccagcuacuugg

SEQ ID NO: 1176236 - RNA, 24 nt, Human
caccuguaaucccagcuacuuggg

SEQ ID NO: 1176237 - RNA, 20 nt, Human
cacgccuguaaucccagaac

SEQ ID NO: 1176238 - RNA, 24 nt, Human
cacgccuguaaucccagaacuuug

SEQ ID NO: 1176239 - RNA, 24 nt, Human
cacgccuguaaucccagcacuuug

SEQ ID NO: 1176240 - RNA, 20 nt, Human
cacggcauuccagccuggca

SEQ ID NO: 1176241 - RNA, 23 nt, Human
cacguaaggucaggaguucgaga

SEQ ID NO: 1176242 - RNA, 24 nt, Human
cacuauacuccaaccugggaaaca

SEQ ID NO: 1176243 - RNA, 23 nt, Human
cacuccacccugggcgacagagc

SEQ ID NO: 1176244 - RNA, 21 nt, Human
cacugcaaccuccgccucccg

SEQ ID NO: 1176245 - RNA, 23 nt, Human
cacugcaaccuccgccucccggg

SEQ ID NO: 1176246 - RNA, 23 nt, Human
cacugcacuccacccugggcgac

SEQ ID NO: 1176247 - RNA, 24 nt, Human
cacugcacuccacccugggcgaca

SEQ ID NO: 1176248 - RNA, 19 nt, Human
cacugcacucuggccugcg

SEQ ID NO: 1176249 - RNA, 20 nt, Human
cacugcacucuggccugcga

SEQ ID NO: 1176250 - RNA, 20 nt, Human
cacugcacucuggccugcga

SEQ ID NO: 1176251 - RNA, 22 nt, Human
cacugcacucuggccugcgaga

SEQ ID NO: 1176252 - RNA, 24 nt, Human
cagaacuuugggaggccgaggugg

SEQ ID NO: 1176253 - RNA, 25 nt, Human
cagagcaccagcccaggagaugcag

SEQ ID NO: 1176254 - RNA, 24 nt, Human
cagaucaccugagcucaggaguuc

SEQ ID NO: 1176255 - RNA, 19 nt, Human
cagcaagcaacaggauggg

SEQ ID NO: 1176256 - RNA, 18 nt, Human
cagcacuuucggaggcug

SEQ ID NO: 1176257 - RNA, 24 nt, Human
cagcacuuucggaggcugaagcag

SEQ ID NO: 1176258 - RNA, 24 nt, Human
cagcacuuugggaggccaaggcag

SEQ ID NO: 1176259 - RNA, 25 nt, Human
cagcacuuugggaggccaaggcagg

SEQ ID NO: 1176260 - RNA, 24 nt, Human
cagcacuuugggaggccgaggcag

SEQ ID NO: 1176261 - RNA, 24 nt, Human
cagcacuuugggaggccgaggcag

SEQ ID NO: 1176262 - RNA, 18 nt, Human
cagcagggccggucgcgg

SEQ ID NO: 1176263 - RNA, 24 nt, Human
cagccugaaagagacaaaaaccag

SEQ ID NO: 1176264 - RNA, 23 nt, Human
cagccuguaaucccaggacuuug

SEQ ID NO: 1176265 - RNA, 24 nt, Human
cagcuacucgggaggcugaggcag

SEQ ID NO: 1176266 - RNA, 22 nt, Human
cagcuaguguucccuaggccaa

SEQ ID NO: 1176267 - RNA, 19 nt, Human
cagcucccugcagcuccuc

SEQ ID NO: 1176268 - RNA, 19 nt, Human
caggacuggccagaggaag

SEQ ID NO: 1176269 - RNA, 24 nt, Human
caggacuuugggaggcugaggcgg

SEQ ID NO: 1176270 - RNA, 23 nt, Human
caggagccaggcugggcaccaug

SEQ ID NO: 1176271 - RNA, 24 nt, Human
caggcgccuguagucccagcucuc

SEQ ID NO: 1176272 - RNA, 18 nt, Human
cagggaaagcucccccuc

SEQ ID NO: 1176273 - RNA, 21 nt, Human
cauagcaagaccccaucucua

SEQ ID NO: 1176274 - RNA, 21 nt, Human
cauaugucacccaccacaccc

SEQ ID NO: 1176275 - RNA, 24 nt, Human
caucuguagucucagguacucagg

SEQ ID NO: 1176276 - RNA, 19 nt, Human
ccaaagugcugggauuaca

SEQ ID NO: 1176277 - RNA, 19 nt, Human
ccaaagugcugggauuaca

SEQ ID NO: 1176278 - RNA, 20 nt, Human
ccaaagugcugggauuacau

SEQ ID NO: 1176279 - RNA, 22 nt, Human
ccaaagugcugggauuacauau

SEQ ID NO: 1176280 - RNA, 21 nt, Human
ccaacauggugagacccuguc

SEQ ID NO: 1176281 - RNA, 20 nt, Human
ccaagaguggauuggagaag

SEQ ID NO: 1176282 - RNA, 19 nt, Human
ccaccaaaaaauacaaaaa

SEQ ID NO: 1176283 - RNA, 19 nt, Human
ccacggcauuccagccugg

SEQ ID NO: 1176284 - RNA, 20 nt, Human
ccacggcauuccagccuggc

SEQ ID NO: 1176285 - RNA, 21 nt, Human
ccacugcacuccacccugggc

SEQ ID NO: 1176286 - RNA, 21 nt, Human
ccacugcacuccacccugggc

SEQ ID NO: 1176287 - RNA, 24 nt, Human
ccacugcacuccacccugggcgac

SEQ ID NO: 1176288 - RNA, 18 nt, Human
ccacugcacucuggccug

SEQ ID NO: 1176289 - RNA, 19 nt, Human
ccacugcacucuggccugc

SEQ ID NO: 1176290 - RNA, 21 nt, Human
ccacugcacucuggccugcga

SEQ ID NO: 1176291 - RNA, 22 nt, Human
ccacugcacucuggccugcgag

SEQ ID NO: 1176292 - RNA, 24 nt, Human
ccacugcacucuggccugcgagac

SEQ ID NO: 1176293 - RNA, 22 nt, Human
ccagaaguagcuugcucuccuc

SEQ ID NO: 1176294 - RNA, 21 nt, Human
ccaggaaauaagacgggagca

SEQ ID NO: 1176295 - RNA, 18 nt, Human
ccaggaagucaaagcugc

SEQ ID NO: 1176296 - RNA, 22 nt, Human
ccaggagguagagguugcagug

SEQ ID NO: 1176297 - RNA, 24 nt, Human
ccaggcugggcaccauggcucacg

SEQ ID NO: 1176298 - RNA, 19 nt, Human
cccacaacuccccucccag

SEQ ID NO: 1176299 - RNA, 19 nt, Human
cccacaacuccccucccag

SEQ ID NO: 1176300 - RNA, 25 nt, Human
cccacggccaugccugcugagaauc

SEQ ID NO: 1176301 - RNA, 18 nt, Human
ccccagagcaggggcucc

SEQ ID NO: 1176302 - RNA, 19 nt, Human
cccccagaaaugcugccgg

SEQ ID NO: 1176303 - RNA, 20 nt, Human
cccccagaaaugcugccgga

SEQ ID NO: 1176304 - RNA, 24 nt, Human
ccccuccucccaucccgcacgucc

SEQ ID NO: 1176305 - RNA, 18 nt, Human
ccccucuccagcucccuu

SEQ ID NO: 1176306 - RNA, 26 nt, Human
ccccucuccagcucccuuuugggcaa

SEQ ID NO: 1176307 - RNA, 21 nt, Human
cccgccaccagcucccugcag

SEQ ID NO: 1176308 - RNA, 23 nt, Human
cccggguucaagugauucuccuc

SEQ ID NO: 1176309 - RNA, 23 nt, Human
cccggguucaagugauucuccug

SEQ ID NO: 1176310 - RNA, 22 nt, Human
ccuagccaacauggugagaccc

SEQ ID NO: 1176311 - RNA, 24 nt, Human
ccuagccaacauggugagacccug

SEQ ID NO: 1176312 - RNA, 24 nt, Human
ccucccggguucaagugauucucc

SEQ ID NO: 1176313 - RNA, 19 nt, Human
ccuccuaaacagaagugag

SEQ ID NO: 1176314 - RNA, 22 nt, Human
ccugaggucgggaguucgaaac

SEQ ID NO: 1176315 - RNA, 21 nt, Human
ccugcacacagcugaaauccc

SEQ ID NO: 1176316 - RNA, 18 nt, Human
ccugcugagaauccugcc

SEQ ID NO: 1176317 - RNA, 19 nt, Human
ccugcugagaauccugcca

SEQ ID NO: 1176318 - RNA, 24 nt, Human
ccuggccaacauggcaaaacccca

SEQ ID NO: 1176319 - RNA, 24 nt, Human
ccugggaaacagggugaaacccug

SEQ ID NO: 1176320 - RNA, 22 nt, Human
ccugggcaacauagugagaucc

SEQ ID NO: 1176321 - RNA, 24 nt, Human
ccugggcaacauagugagauccug

SEQ ID NO: 1176322 - RNA, 23 nt, Human
ccugggcaacauggugaaacccc

SEQ ID NO: 1176323 - RNA, 24 nt, Human
ccugggcaacauggugaaaccccg

SEQ ID NO: 1176324 - RNA, 22 nt, Human
ccuguaaucccagaacuuuggg

SEQ ID NO: 1176325 - RNA, 22 nt, Human
ccuguaaucccagcacuuuggg

SEQ ID NO: 1176326 - RNA, 21 nt, Human
ccuguaaucccagcuacucgg

SEQ ID NO: 1176327 - RNA, 22 nt, Human
ccuguaaucccagcuacucggg

SEQ ID NO: 1176328 - RNA, 21 nt, Human
ccuguaaucccagcuacuugg

SEQ ID NO: 1176329 - RNA, 18 nt, Human
ccuguagucccagcucuc

SEQ ID NO: 1176330 - RNA, 20 nt, Human
ccuguagucccagcucucag

SEQ ID NO: 1176331 - RNA, 21 nt, Human
ccuguagucccagcucucagg

SEQ ID NO: 1176332 - RNA, 20 nt, Human
ccugugugacuccagcaagu

SEQ ID NO: 1176333 - RNA, 20 nt, Human
cgacugugcaggaacagagu

SEQ ID NO: 1176334 - RNA, 24 nt, Human
cgagaccagccugggcaacauggu

SEQ ID NO: 1176335 - RNA, 20 nt, Human
cgaggcaggaggaucacuug

SEQ ID NO: 1176336 - RNA, 24 nt, Human
cgaggcaggaggaucacuugagcc

SEQ ID NO: 1176337 - RNA, 19 nt, Human
cgaggugggcagaucaccu

SEQ ID NO: 1176338 - RNA, 26 nt, Human
cgaggugggcagaucaccugagcuca

SEQ ID NO: 1176339 - RNA, 21 nt, Human
cgccuguaauccagcacuuug

SEQ ID NO: 1176340 - RNA, 23 nt, Human
cgccuguaauccagcacuuuggg

SEQ ID NO: 1176341 - RNA, 26 nt, Human
cgccuguaauccagcacuuugggagg

SEQ ID NO: 1176342 - RNA, 18 nt, Human
cgccuguaaucccagaac

SEQ ID NO: 1176343 - RNA, 23 nt, Human
cgccuguaaucccagaacuuugg

SEQ ID NO: 1176344 - RNA, 23 nt, Human
cgccuguagucccagcucucagg

SEQ ID NO: 1176345 - RNA, 22 nt, Human
cggagccgggugugguggcuca

SEQ ID NO: 1176346 - RNA, 23 nt, Human
cggaggcugaagcaggaggauca

SEQ ID NO: 1176347 - RNA, 18 nt, Human
cggaugggggacuccaga

SEQ ID NO: 1176348 - RNA, 22 nt, Human
cggcaccacuauacuccaaccu

SEQ ID NO: 1176349 - RNA, 18 nt, Human
cgggguugugcagugggg

SEQ ID NO: 1176350 - RNA, 24 nt, Human
cggguagaucaccugaggucggga

SEQ ID NO: 1176351 - RNA, 24 nt, Human
cggguggaucacguaaggucagga

SEQ ID NO: 1176352 - RNA, 24 nt, Human
cgguggcucagccuguaaucccag

SEQ ID NO: 1176353 - RNA, 20 nt, Human
cgugccagauccugugcugc

SEQ ID NO: 1176354 - RNA, 21 nt, Human
cuaacuugcccuuccccacaa

SEQ ID NO: 1176355 - RNA, 19 nt, Human
cuaucaccuaggcuggagu

SEQ ID NO: 1176356 - RNA, 20 nt, Human
cucaaaaaacaggagccagg

SEQ ID NO: 1176357 - RNA, 24 nt, Human
cucacaacuguaaucccagcacuu

SEQ ID NO: 1176358 - RNA, 23 nt, Human
cucacgccuguaauccagcacuu

SEQ ID NO: 1176359 - RNA, 22 nt, Human
cucacgccuguaaucccagaac

SEQ ID NO: 1176360 - RNA, 24 nt, Human
cucacgccuguaaucccagaacuu

SEQ ID NO: 1176361 - RNA, 22 nt, Human
cucacgccuguaaucccagcac

SEQ ID NO: 1176362 - RNA, 24 nt, Human
cucacgccuguaaucccagcacuu

SEQ ID NO: 1176363 - RNA, 24 nt, Human
cucacugcaaccuccgccucccgg

SEQ ID NO: 1176364 - RNA, 23 nt, Human
cucagccuguaaucccaggacuu

SEQ ID NO: 1176365 - RNA, 23 nt, Human
cuccaaaaaaaaaaggccagaug

SEQ ID NO: 1176366 - RNA, 19 nt, Human
cucccccucccuggacagc

SEQ ID NO: 1176367 - RNA, 20 nt, Human
cucccggguucaagugauuc

SEQ ID NO: 1176368 - RNA, 20 nt, Human
cucuaucaccuaggcuggag

SEQ ID NO: 1176369 - RNA, 23 nt, Human
cucuaucaccuaggcuggagugc

SEQ ID NO: 1176370 - RNA, 20 nt, Human
cucugagccucuguguccuu

SEQ ID NO: 1176371 - RNA, 22 nt, Human
cugagcucaggaguucaagacc

SEQ ID NO: 1176372 - RNA, 24 nt, Human
cugcaaccuccgccucccggguuc

SEQ ID NO: 1176373 - RNA, 21 nt, Human
cugcagccugagccuggggug

SEQ ID NO: 1176374 - RNA, 20 nt, Human
cugcaggagacaagaaggac

SEQ ID NO: 1176375 - RNA, 23 nt, Human
cugccucagccucccaaagugcu

SEQ ID NO: 1176376 - RNA, 24 nt, Human
cugccucagccucccaaagugcug

SEQ ID NO: 1176377 - RNA, 24 nt, Human
cuggacccaggccagcuuccgcuc

SEQ ID NO: 1176378 - RNA, 25 nt, Human
cuggaggcauuuagcagagguugag

SEQ ID NO: 1176379 - RNA, 23 nt, Human
cuggccaacauggcaaaacccca

SEQ ID NO: 1176380 - RNA, 21 nt, Human
cuguaaucccagcuacuuggg

SEQ ID NO: 1176381 - RNA, 20 nt, Human
cugugcacccacggccaugc

SEQ ID NO: 1176382 - RNA, 22 nt, Human
cuuaaaaaaaaaagagagagac

SEQ ID NO: 1176383 - RNA, 18 nt, Human
cuugcaagauccucucug

SEQ ID NO: 1176384 - RNA, 19 nt, Human
cuugccuaccugggcuuca

SEQ ID NO: 1176385 - RNA, 23 nt, Human
cuuugggaggccgaggugggcag

SEQ ID NO: 1176386 - RNA, 22 nt, Human
gaacccggaaggcggagguugc

SEQ ID NO: 1176387 - RNA, 23 nt, Human
gaacggagccgggugugguggcu

SEQ ID NO: 1176388 - RNA, 21 nt, Human
gaaggaggaugggggaaaugg

SEQ ID NO: 1176389 - RNA, 18 nt, Human
gaauggaugcagagaggg

SEQ ID NO: 1176390 - RNA, 25 nt, Human
gacagaaugagaccuugucuuucaa

SEQ ID NO: 1176391 - RNA, 21 nt, Human
gacagugggcagcugggcccc

SEQ ID NO: 1176392 - RNA, 18 nt, Human
gagacaagaaggacagga

SEQ ID NO: 1176393 - RNA, 19 nt, Human
gagacaagaaggacaggag

SEQ ID NO: 1176394 - RNA, 24 nt, Human
gagacccugucuccaccaaaaaau

SEQ ID NO: 1176395 - RNA, 18 nt, Human
gagaggaaggaggauggg

SEQ ID NO: 1176396 - RNA, 18 nt, Human
gagaucacgccacugcac

SEQ ID NO: 1176397 - RNA, 20 nt, Human
gagcugugggagaggaagga

SEQ ID NO: 1176398 - RNA, 24 nt, Human
gaggagggaggauugcuugagccc

SEQ ID NO: 1176399 - RNA, 19 nt, Human
gaggaugggggaaauggca

SEQ ID NO: 1176400 - RNA, 20 nt, Human
gaggaugggggaaauggcaa

SEQ ID NO: 1176401 - RNA, 23 nt, Human
gagggcuggaaggagggaaggag

SEQ ID NO: 1176402 - RNA, 21 nt, Human
gagguagagguugcagugagc

SEQ ID NO: 1176403 - RNA, 19 nt, Human
gaggugggcagaucaccug

SEQ ID NO: 1176404 - RNA, 22 nt, Human
gagguugcaaugagccgagauc

SEQ ID NO: 1176405 - RNA, 23 nt, Human
gaucaccugagcucaggaguuca

SEQ ID NO: 1176406 - RNA, 24 nt, Human
gaucaccugagcucaggaguucaa

SEQ ID NO: 1176407 - RNA, 24 nt, Human
gaucaccugaggucgggaguucga

SEQ ID NO: 1176408 - RNA, 24 nt, Human
gaucacguaaggucaggaguucga

SEQ ID NO: 1176409 - RNA, 24 nt, Human
gaucacuugagcccaggaguuuga

SEQ ID NO: 1176410 - RNA, 24 nt, Human
gaucacuugagccuaggaguucaa

SEQ ID NO: 1176411 - RNA, 21 nt, Human
gauucaugccuggagccccag

SEQ ID NO: 1176412 - RNA, 20 nt, Human
gcaccacuauacuccaaccu

SEQ ID NO: 1176413 - RNA, 19 nt, Human
gcagagaugaggagcuggg

SEQ ID NO: 1176414 - RNA, 22 nt, Human
gcaggagaaucgcuugaaccca

SEQ ID NO: 1176415 - RNA, 20 nt, Human
gcaguuuugggggaaguggu

SEQ ID NO: 1176416 - RNA, 22 nt, Human
gccaaagaguucaaggcugcag

SEQ ID NO: 1176417 - RNA, 24 nt, Human
gccaacauggugagacccugucuc

SEQ ID NO: 1176418 - RNA, 24 nt, Human
gccacugcacuccacccugggcga

SEQ ID NO: 1176419 - RNA, 22 nt, Human
gcccaggaguuugagaccagcc

SEQ ID NO: 1176420 - RNA, 20 nt, Human
gccgagaucacgccacugca

SEQ ID NO: 1176421 - RNA, 20 nt, Human
gcgggcaccuguaaucccag

SEQ ID NO: 1176422 - RNA, 19 nt, Human
gcgguggcucagccuguaa

SEQ ID NO: 1176423 - RNA, 23 nt, Human
gcuaugaucacaccacugcacuu

SEQ ID NO: 1176424 - RNA, 19 nt, Human
gcuggagugcaguggcgca

SEQ ID NO: 1176425 - RNA, 20 nt, Human
ggaacgugccguugcuuccc

SEQ ID NO: 1176426 - RNA, 18 nt, Human
ggaagaggcugaggcagg

SEQ ID NO: 1176427 - RNA, 19 nt, Human
ggacuccagaagcguggag

SEQ ID NO: 1176428 - RNA, 21 nt, Human
ggagaaucgcugggacccagg

SEQ ID NO: 1176429 - RNA, 23 nt, Human
ggagaggaaggaggaugggggaa

SEQ ID NO: 1176430 - RNA, 21 nt, Human
ggagccgggugugguggcuca

SEQ ID NO: 1176431 - RNA, 22 nt, Human
ggaggcugaagcaggaggauca

SEQ ID NO: 1176432 - RNA, 24 nt, Human
ggagggcuggaaggagggaaggag

SEQ ID NO: 1176433 - RNA, 18 nt, Human
ggagguugcaaugagccg

SEQ ID NO: 1176434 - RNA, 24 nt, Human
ggagguugcaaugagccgagauca

SEQ ID NO: 1176435 - RNA, 22 nt, Human
ggaguucgagaccagccugggc

SEQ ID NO: 1176436 - RNA, 25 nt, Human
ggaucaccaagagguucaggaagaa

SEQ ID NO: 1176437 - RNA, 22 nt, Human
ggaucacuugagcccaggaguu

SEQ ID NO: 1176438 - RNA, 23 nt, Human
ggaucacuugagccuaggaguuc

SEQ ID NO: 1176439 - RNA, 19 nt, Human
ggcaagugauugaaucugc

SEQ ID NO: 1176440 - RNA, 24 nt, Human
ggcaccuguaaucccagcuacuug

SEQ ID NO: 1176441 - RNA, 20 nt, Human
ggccccaagacggauggggg

SEQ ID NO: 1176442 - RNA, 18 nt, Human
ggccgaggcaggaggauc

SEQ ID NO: 1176443 - RNA, 21 nt, Human
ggcgggcaccuguaaucccag

SEQ ID NO: 1176444 - RNA, 21 nt, Human
ggcucacgccuguaaucccag

SEQ ID NO: 1176445 - RNA, 23 nt, Human
gggcaacauggugaaaccccgac

SEQ ID NO: 1176446 - RNA, 24 nt, Human
gggcaccauggcucacgccuguaa

SEQ ID NO: 1176447 - RNA, 22 nt, Human
gggcagaucaccugagcucagg

SEQ ID NO: 1176448 - RNA, 26 nt, Human
gggcagaucaccugagcucaggaguu

SEQ ID NO: 1176449 - RNA, 19 nt, Human
ggggaagugguggggacca

SEQ ID NO: 1176450 - RNA, 20 nt, Human
ggggaagugguggggaccag

SEQ ID NO: 1176451 - RNA, 22 nt, Human
ggguucaagugauucuccugcc

SEQ ID NO: 1176452 - RNA, 23 nt, Human
ggguucaagugauucuccugccu

SEQ ID NO: 1176453 - RNA, 21 nt, Human
ggugaagaggugaagcccagg

SEQ ID NO: 1176454 - RNA, 24 nt, Human
ggugauucaugccuggagccccag

SEQ ID NO: 1176455 - RNA, 21 nt, Human
gguggaucacguaaggucagg

SEQ ID NO: 1176456 - RNA, 23 nt, Human
gguggcucacgccuguaauccag

SEQ ID NO: 1176457 - RNA, 22 nt, Human
gguggcucagccuguaauccca

SEQ ID NO: 1176458 - RNA, 23 nt, Human
ggugugguggcgggcaccuguaa

SEQ ID NO: 1176459 - RNA, 23 nt, Human
ggugugguggcucacgccuguaa

SEQ ID NO: 1176460 - RNA, 24 nt, Human
gucucaaaaaacaggagccaggcu

SEQ ID NO: 1176461 - RNA, 22 nt, Human
gugacuugagcuuuauuuugug

SEQ ID NO: 1176462 - RNA, 24 nt, Human
gugauucuccugccucagccuccc

SEQ ID NO: 1176463 - RNA, 22 nt, Human
guggaauggaugcagagagggc

SEQ ID NO: 1176464 - RNA, 19 nt, Human
guggagcuggcagagagaa

SEQ ID NO: 1176465 - RNA, 24 nt, Human
guggaucacguaaggucaggaguu

SEQ ID NO: 1176466 - RNA, 23 nt, Human
guggcaggcgccuguagucccag

SEQ ID NO: 1176467 - RNA, 21 nt, Human
gugguccaggccauccuuucu

SEQ ID NO: 1176468 - RNA, 19 nt, Human
guugcagugagcugagauu

SEQ ID NO: 1176469 - RNA, 24 nt, Human
guuggcagaugccuguaaucccag

SEQ ID NO: 1176470 - RNA, 21 nt, Human
uaaaaaaacuuagucuggcac

SEQ ID NO: 1176471 - RNA, 20 nt, Human
uaaaaauacaaaaauuagcc

SEQ ID NO: 1176472 - RNA, 21 nt, Human
uaaaaauacaaaaauuagccc

SEQ ID NO: 1176473 - RNA, 19 nt, Human
uacgcuguucugcagccug

SEQ ID NO: 1176474 - RNA, 20 nt, Human
uacuccaaccugggaaacag

SEQ ID NO: 1176475 - RNA, 23 nt, Human
uacuccaaccugggaaacagggu

SEQ ID NO: 1176476 - RNA, 24 nt, Human
uacuccaaccugggaaacagggug

SEQ ID NO: 1176477 - RNA, 22 nt, Human
uagaaccaaggaggggccccuc

SEQ ID NO: 1176478 - RNA, 18 nt, Human
uagagguugcagugagcu

SEQ ID NO: 1176479 - RNA, 24 nt, Human
uagaucaccugaggucgggaguuc

SEQ ID NO: 1176480 - RNA, 23 nt, Human
uagccaacauggugagacccugu

SEQ ID NO: 1176481 - RNA, 19 nt, Human
uagcuugcucuccucugcc

SEQ ID NO: 1176482 - RNA, 20 nt, Human
ucaagauuaaaagagccagg

SEQ ID NO: 1176483 - RNA, 19 nt, Human
ucaagugauucuccugccu

SEQ ID NO: 1176484 - RNA, 23 nt, Human
ucacaccacugcacucuggccug

SEQ ID NO: 1176485 - RNA, 19 nt, Human
ucaccaagagguucaggac

SEQ ID NO: 1176486 - RNA, 24 nt, Human
ucaccuaggcuggagugcaguggc

SEQ ID NO: 1176487 - RNA, 23 nt, Human
ucaccugagcucaggaguucaag

SEQ ID NO: 1176488 - RNA, 23 nt, Human
ucacgccacugcacuccacccug

SEQ ID NO: 1176489 - RNA, 24 nt, Human
ucacgccuguaauccagcacuuug

SEQ ID NO: 1176490 - RNA, 23 nt, Human
ucacugcaaccuccgccucccgg

SEQ ID NO: 1176491 - RNA, 24 nt, Human
ucacugcaaccuccgccucccggg

SEQ ID NO: 1176492 - RNA, 25 nt, Human
ucacugcaaccuccgccucccgggu

SEQ ID NO: 1176493 - RNA, 27 nt, Human
ucacugcaaccuccgccucccggguuc

SEQ ID NO: 1176494 - RNA, 18 nt, Human
ucacuugagccuaggagu

SEQ ID NO: 1176495 - RNA, 19 nt, Human
ucagaagcaacagcagggc

SEQ ID NO: 1176496 - RNA, 21 nt, Human
ucaguagagagggaagugagc

SEQ ID NO: 1176497 - RNA, 21 nt, Human
ucaguagagagggaagugagc

SEQ ID NO: 1176498 - RNA, 24 nt, Human
ucauguagggcuugcugcaggaga

SEQ ID NO: 1176499 - RNA, 22 nt, Human
ucauuguaaugauacaaucaga

SEQ ID NO: 1176500 - RNA, 20 nt, Human
uccaaccugggaaacagggu

SEQ ID NO: 1176501 - RNA, 18 nt, Human
uccaagcagcacagagca

SEQ ID NO: 1176502 - RNA, 24 nt, Human
uccacccugggcgacagagcgaga

SEQ ID NO: 1176503 - RNA, 18 nt, Human
ucccaaagugcugggauu

SEQ ID NO: 1176504 - RNA, 21 nt, Human
ucccaaagugcugggauuaca

SEQ ID NO: 1176505 - RNA, 25 nt, Human
ucccagcuacuugggagccugaggc

SEQ ID NO: 1176506 - RNA, 19 nt, Human
uccccacaacuccccuccc

SEQ ID NO: 1176507 - RNA, 23 nt, Human
ucccgcacguccacgcgugccag

SEQ ID NO: 1176508 - RNA, 21 nt, Human
ucccggguucaagugauucuc

SEQ ID NO: 1176509 - RNA, 24 nt, Human
ucccggguucaagugauucuccug

SEQ ID NO: 1176510 - RNA, 19 nt, Human
ucccuggacagcuaguguu

SEQ ID NO: 1176511 - RNA, 22 nt, Human
ucccuggacagcuaguguuccc

SEQ ID NO: 1176512 - RNA, 19 nt, Human
ucccuggucuacgcuguuc

SEQ ID NO: 1176513 - RNA, 24 nt, Human
ucggaggcugaagcaggaggauca

SEQ ID NO: 1176514 - RNA, 26 nt, Human
ucuacaaaaaaugaaaacaaugagcc

SEQ ID NO: 1176515 - RNA, 24 nt, Human
ucuaggaaagcaucugcacacagu

SEQ ID NO: 1176516 - RNA, 24 nt, Human
ucuaucaccuaggcuggagugcag

SEQ ID NO: 1176517 - RNA, 21 nt, Human
ucuaucuccaaaaaaaaaagg

SEQ ID NO: 1176518 - RNA, 19 nt, Human
ucucaaaaaacaggagcca

SEQ ID NO: 1176519 - RNA, 27 nt, Human
ucuccagcucccuuuuggggggccgcc

SEQ ID NO: 1176520 - RNA, 26 nt, Human
ucuccugccucagccucccaaagugc

SEQ ID NO: 1176521 - RNA, 21 nt, Human
ucucuacuaaaaauacaaaaa

SEQ ID NO: 1176522 - RNA, 26 nt, Human
ucucucuacaaaaaauuuuaaaaaaa

SEQ ID NO: 1176523 - RNA, 22 nt, Human
ucugaacccagacagugggcag

SEQ ID NO: 1176524 - RNA, 19 nt, Human
ucuugcucuaucaccuagg

SEQ ID NO: 1176525 - RNA, 23 nt, Human
ucuugcucuaucaccuaggcugg

SEQ ID NO: 1176526 - RNA, 24 nt, Human
ucuugcucuaucaccuaggcugga

SEQ ID NO: 1176527 - RNA, 18 nt, Human
ugaaagagacaaaaacca

SEQ ID NO: 1176528 - RNA, 22 nt, Human
ugaaagagacaaaaaccaggua

SEQ ID NO: 1176529 - RNA, 22 nt, Human
ugaaauccccaggaaauaagac

SEQ ID NO: 1176530 - RNA, 20 nt, Human
ugaagcaggaggaucacuug

SEQ ID NO: 1176531 - RNA, 24 nt, Human
ugaagcaggaggaucacuugagcc

SEQ ID NO: 1176532 - RNA, 19 nt, Human
ugaccccaaagccacuccc

SEQ ID NO: 1176533 - RNA, 23 nt, Human
ugacggcaccacuauacuccaac

SEQ ID NO: 1176534 - RNA, 22 nt, Human
ugacucacaacuguaaucccag

SEQ ID NO: 1176535 - RNA, 24 nt, Human
ugacucacaacuguaaucccagca

SEQ ID NO: 1176536 - RNA, 22 nt, Human
ugagacuagauggaggggcuaa

SEQ ID NO: 1176537 - RNA, 23 nt, Human
ugagcccaggaguuugagaccag

SEQ ID NO: 1176538 - RNA, 22 nt, Human
ugagccgagaucacgccacugc

SEQ ID NO: 1176539 - RNA, 25 nt, Human
ugagccucuguguccuuggcugcag

SEQ ID NO: 1176540 - RNA, 18 nt, Human
ugaggagggaggauugcu

SEQ ID NO: 1176541 - RNA, 24 nt, Human
ugaggagggaggauugcuugagcc

SEQ ID NO: 1176542 - RNA, 18 nt, Human
ugaggcacuugggagaug

SEQ ID NO: 1176543 - RNA, 19 nt, Human
ugaggcaggagaaucgcug

SEQ ID NO: 1176544 - RNA, 23 nt, Human
ugaggcaggagaaucgcugggac

SEQ ID NO: 1176545 - RNA, 24 nt, Human
ugaggcaggagaaucgcugggacc

SEQ ID NO: 1176546 - RNA, 25 nt, Human
ugaggcaggagaaucgcugggaccc

SEQ ID NO: 1176547 - RNA, 20 nt, Human
ugaggcaggagaaucgcuug

SEQ ID NO: 1176548 - RNA, 24 nt, Human
ugaggcaggagaaucgcuugaacc

SEQ ID NO: 1176549 - RNA, 25 nt, Human
ugaggcaggagaaucgcuugaaccc

SEQ ID NO: 1176550 - RNA, 24 nt, Human
ugaggcaggagaauggugugaacc

SEQ ID NO: 1176551 - RNA, 25 nt, Human
ugaggcaggagaauggugugaaccc

SEQ ID NO: 1176552 - RNA, 20 nt, Human
ugaggcggguagaucaccug

SEQ ID NO: 1176553 - RNA, 24 nt, Human
ugaggcggguagaucaccugaggu

SEQ ID NO: 1176554 - RNA, 23 nt, Human
ugaggucgggaguucgaaaccag

SEQ ID NO: 1176555 - RNA, 20 nt, Human
ugauucuccugccucagccu

SEQ ID NO: 1176556 - RNA, 22 nt, Human
ugcaaugagccgagaucacgcc

SEQ ID NO: 1176557 - RNA, 22 nt, Human
ugcacgggaggccaagcgaccc

SEQ ID NO: 1176558 - RNA, 25 nt, Human
ugcacuccacccugggcgacagagc

SEQ ID NO: 1176559 - RNA, 19 nt, Human
ugcaguaagucaugacggc

SEQ ID NO: 1176560 - RNA, 22 nt, Human
ugcaguggcgcaaucucggcuc

SEQ ID NO: 1176561 - RNA, 23 nt, Human
ugcaguggcgcaaucucggcuca

SEQ ID NO: 1176562 - RNA, 18 nt, Human
ugcauaugggcccagcug

SEQ ID NO: 1176563 - RNA, 19 nt, Human
ugccagauccugugcugcg

SEQ ID NO: 1176564 - RNA, 24 nt, Human
ugccucagccucccaaagugcugg

SEQ ID NO: 1176565 - RNA, 24 nt, Human
ugccuggagccccagcuacuagag

SEQ ID NO: 1176566 - RNA, 23 nt, Human
ugccuguaaucccagcuacucgg

SEQ ID NO: 1176567 - RNA, 24 nt, Human
ugccuguaaucccagcuacucggg

SEQ ID NO: 1176568 - RNA, 18 nt, Human
ugcugccccgccaccagc

SEQ ID NO: 1176569 - RNA, 20 nt, Human
ugcugggauuacauauguca

SEQ ID NO: 1176570 - RNA, 21 nt, Human
uggaagagaguugcugaaggc

SEQ ID NO: 1176571 - RNA, 18 nt, Human
uggaaggagggaaggaga

SEQ ID NO: 1176572 - RNA, 19 nt, Human
uggaauagugggcucagga

SEQ ID NO: 1176573 - RNA, 19 nt, Human
uggaauggaugcagagagg

SEQ ID NO: 1176574 - RNA, 20 nt, Human
uggacaagggugaccuugau

SEQ ID NO: 1176575 - RNA, 19 nt, Human
uggagaguggaauggaugc

SEQ ID NO: 1176576 - RNA, 18 nt, Human
uggagcuggcagagagaa

SEQ ID NO: 1176577 - RNA, 22 nt, Human
uggagcuggcagagagaaaccu

SEQ ID NO: 1176578 - RNA, 23 nt, Human
uggagugcaguggcgcaaucucg

SEQ ID NO: 1176579 - RNA, 24 nt, Human
uggagugcaguggcgcaaucucgg

SEQ ID NO: 1176580 - RNA, 24 nt, Human
uggaucacguaaggucaggaguuc

SEQ ID NO: 1176581 - RNA, 21 nt, Human
uggcagaugccuguaauccca

SEQ ID NO: 1176582 - RNA, 22 nt, Human
uggcgggcaccuguaaucccag

SEQ ID NO: 1176583 - RNA, 19 nt, Human
uggcucacgccuguaaucc

SEQ ID NO: 1176584 - RNA, 23 nt, Human
uggcucacgccuguaauccagca

SEQ ID NO: 1176585 - RNA, 21 nt, Human
uggcucacgccuguaauccca

SEQ ID NO: 1176586 - RNA, 22 nt, Human
uggcucacgccuguaaucccag

SEQ ID NO: 1176587 - RNA, 22 nt, Human
uggcucacgccuguaaucccag

SEQ ID NO: 1176588 - RNA, 24 nt, Human
uggcucacgccuguaaucccagca

SEQ ID NO: 1176589 - RNA, 20 nt, Human
uggcucagccuguaauccca

SEQ ID NO: 1176590 - RNA, 21 nt, Human
uggcucagccuguaaucccag

SEQ ID NO: 1176591 - RNA, 22 nt, Human
ugggaaacagggugaaacccug

SEQ ID NO: 1176592 - RNA, 20 nt, Human
ugggaggccgaggcaggagg

SEQ ID NO: 1176593 - RNA, 24 nt, Human
ugggaggccgaggcaggaggauca

SEQ ID NO: 1176594 - RNA, 20 nt, Human
ugggaggccgaggugggcag

SEQ ID NO: 1176595 - RNA, 24 nt, Human
ugggaggccgaggugggcagauca

SEQ ID NO: 1176596 - RNA, 20 nt, Human
ugggaggcugaggcggguag

SEQ ID NO: 1176597 - RNA, 24 nt, Human
ugggaggcugaggcggguagauca

SEQ ID NO: 1176598 - RNA, 24 nt, Human
ugggauuacauaugucacccacca

SEQ ID NO: 1176599 - RNA, 24 nt, Human
ugggcaacauagugagauccuguc

SEQ ID NO: 1176600 - RNA, 24 nt, Human
ugggcagaucaccugagcucagga

SEQ ID NO: 1176601 - RNA, 21 nt, Human
ugggguggccaggcgggguug

SEQ ID NO: 1176602 - RNA, 18 nt, Human
uggugcacaucuguaguc

SEQ ID NO: 1176603 - RNA, 19 nt, Human
ugguggagggaggggacag

SEQ ID NO: 1176604 - RNA, 20 nt, Human
ugguggagggaggggacaga

SEQ ID NO: 1176605 - RNA, 23 nt, Human
ugguggagggaggggacagaguc

SEQ ID NO: 1176606 - RNA, 24 nt, Human
ugguggcaggcgccuguaguccca

SEQ ID NO: 1176607 - RNA, 24 nt, Human
ugguggcgggcaccuguaauccca

SEQ ID NO: 1176608 - RNA, 22 nt, Human
ugguggcucacgccuguaaucc

SEQ ID NO: 1176609 - RNA, 24 nt, Human
ugguggugcacaucuguagucuca

SEQ ID NO: 1176610 - RNA, 24 nt, Human
ugguuggggucaggguccuagagg

SEQ ID NO: 1176611 - RNA, 20 nt, Human
uguaaugauacaaucagauu

SEQ ID NO: 1176612 - RNA, 18 nt, Human
ugucacccaccacaccca

SEQ ID NO: 1176613 - RNA, 20 nt, Human
ugucuuaaaaaaaaaagaga

SEQ ID NO: 1176614 - RNA, 23 nt, Human
ugugguggcaggcgccuguaguc

SEQ ID NO: 1176615 - RNA, 19 nt, Human
ugugguggcgggcaccugu

SEQ ID NO: 1176616 - RNA, 18 nt, Human
uguugggccacaggagau

SEQ ID NO: 1176617 - RNA, 21 nt, Human
uuaaaagagccaggcacagug

SEQ ID NO: 1176618 - RNA, 21 nt, Human
uuagaggcaggaacagcagcu

SEQ ID NO: 1176619 - RNA, 18 nt, Human
uuagcagagguugagcug

SEQ ID NO: 1176620 - RNA, 25 nt, Human
uucaaaaaaaaaaaaauucuagaau

SEQ ID NO: 1176621 - RNA, 21 nt, Human
uucaagugauucuccugccuc

SEQ ID NO: 1176622 - RNA, 23 nt, Human
uucaagugauucuccugccucag

SEQ ID NO: 1176623 - RNA, 24 nt, Human
uucaagugauucuccugccucagc

SEQ ID NO: 1176624 - RNA, 18 nt, Human
uucccagucauuguaaug

SEQ ID NO: 1176625 - RNA, 24 nt, Human
uuccccacaacuccccucccagaa

SEQ ID NO: 1176626 - RNA, 23 nt, Human
uuccucaguggcauggggagaga

SEQ ID NO: 1176627 - RNA, 19 nt, Human
uuccugugugacuccagca

SEQ ID NO: 1176628 - RNA, 19 nt, Human
uucucuguucugugcaccc

SEQ ID NO: 1176629 - RNA, 19 nt, Human
uucugcagccugagccugg

SEQ ID NO: 1176630 - RNA, 20 nt, Human
uugaagccaggagaccagcc

SEQ ID NO: 1176631 - RNA, 21 nt, Human
uugagccaaagaguucaaggc

SEQ ID NO: 1176632 - RNA, 22 nt, Human
uugagcccaggaguuugagacc

SEQ ID NO: 1176633 - RNA, 20 nt, Human
uugcaaugagccgagaucac

SEQ ID NO: 1176634 - RNA, 19 nt, Human
uugcagugagcugagauug

SEQ ID NO: 1176635 - RNA, 20 nt, Human
uugcagugagcugagauugc

SEQ ID NO: 1176636 - RNA, 22 nt, Human
uugcagugagcugagauugcgc

SEQ ID NO: 1176637 - RNA, 23 nt, Human
uugcgccacggcauuccagccug

SEQ ID NO: 1176638 - RNA, 19 nt, Human
uugcuucccugcagguucu

SEQ ID NO: 1176639 - RNA, 24 nt, Human
uugcuugagcccaggaagucaaag

SEQ ID NO: 1176640 - RNA, 18 nt, Human
uuggagaaggcaaaacua

SEQ ID NO: 1176641 - RNA, 25 nt, Human
uugggaggccgaggcaggaggauca

SEQ ID NO: 1176642 - RNA, 25 nt, Human
uugggaggccgaggugggcagauca

SEQ ID NO: 1176643 - RNA, 25 nt, Human
uugggaggcugaggcggguagauca

SEQ ID NO: 1176644 - RNA, 18 nt, Human
uuuagaggcaggaacagc

SEQ ID NO: 1176645 - RNA, 18 nt, Human
uuuuuugguggagggagg

SEQ ID NO: 1176646 - RNA, 20 nt, Human
uuuuuuugguggagggaggg

SEQ ID NO: 1176647 - RNA, 23 nt, Human
ugacaacgcgcaccucaggccuu

SEQ ID NO: 1176648 - RNA, 21 nt, Human
aaaaugaacacauauuaggca

SEQ ID NO: 1176649 - RNA, 22 nt, Human
aaagaugcacuuccuuaugauc

SEQ ID NO: 1176650 - RNA, 25 nt, Human
aagaaggaaaugcaguaguaacaga

SEQ ID NO: 1176651 - RNA, 21 nt, Human
aagagcucucagcuugcugcc

SEQ ID NO: 1176652 - RNA, 19 nt, Human
aagauaagagaagccgcgg

SEQ ID NO: 1176653 - RNA, 24 nt, Human
aaguagcugggacuacagacaugu

SEQ ID NO: 1176654 - RNA, 19 nt, Human
aaugggcuuaaugaacugc

SEQ ID NO: 1176655 - RNA, 24 nt, Human
acaauccaccacaucuaauugcac

SEQ ID NO: 1176656 - RNA, 19 nt, Human
acagagcaagaaggaaaug

SEQ ID NO: 1176657 - RNA, 21 nt, Human
acauuacugaaagcaaugggc

SEQ ID NO: 1176658 - RNA, 21 nt, Human
accaagcaagguggacauccu

SEQ ID NO: 1176659 - RNA, 24 nt, Human
accacaauccaccacaucuaauug

SEQ ID NO: 1176660 - RNA, 23 nt, Human
acccaucuugucuaucugguccu

SEQ ID NO: 1176661 - RNA, 19 nt, Human
accccuuuaucuggaggcc

SEQ ID NO: 1176662 - RNA, 19 nt, Human
acccugaggugcagucagg

SEQ ID NO: 1176663 - RNA, 19 nt, Human
agagaagccgcggcccuaa

SEQ ID NO: 1176664 - RNA, 20 nt, Human
agagcaagaaggaaaugcag

SEQ ID NO: 1176665 - RNA, 18 nt, Human
agagcgcauaucucagaa

SEQ ID NO: 1176666 - RNA, 22 nt, Human
agcagccaaggagguguucuga

SEQ ID NO: 1176667 - RNA, 23 nt, Human
agcaucccuguaauccuaagcaa

SEQ ID NO: 1176668 - RNA, 24 nt, Human
agccaccaagcaagguggacaucc

SEQ ID NO: 1176669 - RNA, 18 nt, Human
agccuccagaguagcugg

SEQ ID NO: 1176670 - RNA, 22 nt, Human
agcugguacuacaggugugugc

SEQ ID NO: 1176671 - RNA, 24 nt, Human
agcuugcugcccagugucaccucu

SEQ ID NO: 1176672 - RNA, 18 nt, Human
aggaagagacagguacaa

SEQ ID NO: 1176673 - RNA, 18 nt, Human
aggaaggugguggaagau

SEQ ID NO: 1176674 - RNA, 19 nt, Human
aggaguaaguaaaccaaaa

SEQ ID NO: 1176675 - RNA, 21 nt, Human
aggcgugugcccaaguagcug

SEQ ID NO: 1176676 - RNA, 21 nt, Human
aggugguggaagauaagagaa

SEQ ID NO: 1176677 - RNA, 23 nt, Human
aggugguggaagauaagagaagc

SEQ ID NO: 1176678 - RNA, 23 nt, Human
aguagcugggacuacagacaugu

SEQ ID NO: 1176679 - RNA, 23 nt, Human
aguagcugguacuacaggugugu

SEQ ID NO: 1176680 - RNA, 19 nt, Human
aguggccuggacuacaggc

SEQ ID NO: 1176681 - RNA, 23 nt, Human
aguggccuggacuacaggcgugu

SEQ ID NO: 1176682 - RNA, 21 nt, Human
aguuuugucuuccuacggcuc

SEQ ID NO: 1176683 - RNA, 23 nt, Human
auaacccugcaagcaaggaaggu

SEQ ID NO: 1176684 - RNA, 19 nt, Human
auccuuggggaucuuuuuc

SEQ ID NO: 1176685 - RNA, 18 nt, Human
augagauagcagccaagg

SEQ ID NO: 1176686 - RNA, 22 nt, Human
auguuacaugucaaagauaaca

SEQ ID NO: 1176687 - RNA, 21 nt, Human
caagaugaauccagucccuug

SEQ ID NO: 1176688 - RNA, 23 nt, Human
caagaugaauccagucccuuguc

SEQ ID NO: 1176689 - RNA, 20 nt, Human
caagcccugagcccaacccu

SEQ ID NO: 1176690 - RNA, 22 nt, Human
caagugauccuccugccucagc

SEQ ID NO: 1176691 - RNA, 27 nt, Human
caagugauccuccugccucagccucca

SEQ ID NO: 1176692 - RNA, 20 nt, Human
caauagagagagcgcauauc

SEQ ID NO: 1176693 - RNA, 19 nt, Human
cacaacaauucuauaaaga

SEQ ID NO: 1176694 - RNA, 23 nt, Human
caccaauauacugagcacaaggg

SEQ ID NO: 1176695 - RNA, 22 nt, Human
caccaaucagaagaaccaaaau

SEQ ID NO: 1176696 - RNA, 23 nt, Human
cacuuccuuaugaucagggagaa

SEQ ID NO: 1176697 - RNA, 23 nt, Human
cagacauguuccuggcucgcauc

SEQ ID NO: 1176698 - RNA, 23 nt, Human
cagccccacggaggaauucagcc

SEQ ID NO: 1176699 - RNA, 21 nt, Human
caggugugugcucgaguggcc

SEQ ID NO: 1176700 - RNA, 19 nt, Human
cagugucaccucucugccu

SEQ ID NO: 1176701 - RNA, 23 nt, Human
ccaaucagaagaaccaaaaugaa

SEQ ID NO: 1176702 - RNA, 22 nt, Human
ccagaguagcugguacuacagg

SEQ ID NO: 1176703 - RNA, 25 nt, Human
ccagaguagcugguacuacaggugu

SEQ ID NO: 1176704 - RNA, 19 nt, Human
cccaaguagcugggacuac

SEQ ID NO: 1176705 - RNA, 22 nt, Human
cccagcccuuccuuuaccuucu

SEQ ID NO: 1176706 - RNA, 23 nt, Human
cccagcccuuccuuuaccuucuc

SEQ ID NO: 1176707 - RNA, 21 nt, Human
cccaggcuggagcacaguggc

SEQ ID NO: 1176708 - RNA, 23 nt, Human
cccucuggcucugggcagugggc

SEQ ID NO: 1176709 - RNA, 22 nt, Human
cccugaggugcagucagggaga

SEQ ID NO: 1176710 - RNA, 23 nt, Human
cccugggagcugugccucaggau

SEQ ID NO: 1176711 - RNA, 28 nt, Human
ccggaaggaaaagaaaagucuuuccaca

SEQ ID NO: 1176712 - RNA, 24 nt, Human
ccuccugccucagccuccagagua

SEQ ID NO: 1176713 - RNA, 24 nt, Human
ccugcaggccgcaagcccugagcc

SEQ ID NO: 1176714 - RNA, 19 nt, Human
ccugccaugcuccauggga

SEQ ID NO: 1176715 - RNA, 20 nt, Human
ccuggacuacaggcgugugc

SEQ ID NO: 1176716 - RNA, 22 nt, Human
ccugggcucaagugauccuccu

SEQ ID NO: 1176717 - RNA, 23 nt, Human
ccugggcucaagugauccuccug

SEQ ID NO: 1176718 - RNA, 21 nt, Human
ccuuccuuuaccuucucagaa

SEQ ID NO: 1176719 - RNA, 24 nt, Human
cucaagugauccuccugccucagc

SEQ ID NO: 1176720 - RNA, 20 nt, Human
cucaauggcuugcauguaug

SEQ ID NO: 1176721 - RNA, 21 nt, Human
cuccagaaaagagacuauccc

SEQ ID NO: 1176722 - RNA, 22 nt, Human
cuccagcgagagagaggaacgg

SEQ ID NO: 1176723 - RNA, 23 nt, Human
cucgaguggccuggacuacaggc

SEQ ID NO: 1176724 - RNA, 18 nt, Human
cucuaaauaaccaagccc

SEQ ID NO: 1176725 - RNA, 20 nt, Human
cucugggcagugggcgcggc

SEQ ID NO: 1176726 - RNA, 21 nt, Human
cucugggcagugggcgcggcu

SEQ ID NO: 1176727 - RNA, 18 nt, Human
cucuguucacacagacuu

SEQ ID NO: 1176728 - RNA, 22 nt, Human
cugauaccagugaggcuguccc

SEQ ID NO: 1176729 - RNA, 23 nt, Human
cugccucagccuccagaguagcu

SEQ ID NO: 1176730 - RNA, 23 nt, Human
cuggaggccguuaccacaaucca

SEQ ID NO: 1176731 - RNA, 19 nt, Human
cugguacuacaggugugug

SEQ ID NO: 1176732 - RNA, 24 nt, Human
cuuagaucucaguauccaccucuu

SEQ ID NO: 1176733 - RNA, 23 nt, Human
cuuggucuucucuuccucauaug

SEQ ID NO: 1176734 - RNA, 19 nt, Human
cuuucauccuuuggagccu

SEQ ID NO: 1176735 - RNA, 18 nt, Human
cuuucuucuucagccagg

SEQ ID NO: 1176736 - RNA, 22 nt, Human
gaaauagaggaguaaguaaacc

SEQ ID NO: 1176737 - RNA, 20 nt, Human
gaagaucuaggcaucuugcc

SEQ ID NO: 1176738 - RNA, 22 nt, Human
gagaagggggaagcagaagggg

SEQ ID NO: 1176739 - RNA, 21 nt, Human
gagaauguuaccaggacagag

SEQ ID NO: 1176740 - RNA, 25 nt, Human
gagauagcagccaaggagguguucu

SEQ ID NO: 1176741 - RNA, 20 nt, Human
gagcugugccucaggaugcu

SEQ ID NO: 1176742 - RNA, 22 nt, Human
gauucuggggcagucagcagcc

SEQ ID NO: 1176743 - RNA, 21 nt, Human
gcagugggcgcggcuucgggc

SEQ ID NO: 1176744 - RNA, 18 nt, Human
gcccagagccuugugucc

SEQ ID NO: 1176745 - RNA, 22 nt, Human
gcccuggaaucuuuguuuacac

SEQ ID NO: 1176746 - RNA, 18 nt, Human
gccucaggaugcuguucu

SEQ ID NO: 1176747 - RNA, 19 nt, Human
gcuaugggguggcugguca

SEQ ID NO: 1176748 - RNA, 22 nt, Human
gcucuuucuucuucagccaggg

SEQ ID NO: 1176749 - RNA, 23 nt, Human
gcuguaaacauugugguuuucua

SEQ ID NO: 1176750 - RNA, 23 nt, Human
gcugugugucucacccagcccuu

SEQ ID NO: 1176751 - RNA, 24 nt, Human
ggagagaagaugcucuuucuucuu

SEQ ID NO: 1176752 - RNA, 18 nt, Human
ggagaucacugccgucca

SEQ ID NO: 1176753 - RNA, 19 nt, Human
ggagccuuccuuccagacc

SEQ ID NO: 1176754 - RNA, 24 nt, Human
ggcagugggcgcggcuucucgcgg

SEQ ID NO: 1176755 - RNA, 24 nt, Human
ggcgggcggaggcggcggccccgg

SEQ ID NO: 1176756 - RNA, 20 nt, Human
gggaagcagaaggggucaag

SEQ ID NO: 1176757 - RNA, 23 nt, Human
gggcagugggcgcggcuucgggc

SEQ ID NO: 1176758 - RNA, 20 nt, Human
gggccuggccauuuagaguu

SEQ ID NO: 1176759 - RNA, 21 nt, Human
gggcucaagugauccuccugc

SEQ ID NO: 1176760 - RNA, 22 nt, Human
gggcucaagugauccuccugcc

SEQ ID NO: 1176761 - RNA, 22 nt, Human
ggucaagaaggugacaaaacuu

SEQ ID NO: 1176762 - RNA, 20 nt, Human
ggugcagugggagagaagau

SEQ ID NO: 1176763 - RNA, 21 nt, Human
gguggaagauaagagaagccg

SEQ ID NO: 1176764 - RNA, 18 nt, Human
gguguugcccaggcugga

SEQ ID NO: 1176765 - RNA, 24 nt, Human
gguguugcccaggcuggagcacag

SEQ ID NO: 1176766 - RNA, 22 nt, Human
guaaaacaaaauauaaagaagu

SEQ ID NO: 1176767 - RNA, 19 nt, Human
guaaaccaaaauauacagg

SEQ ID NO: 1176768 - RNA, 25 nt, Human
guaacaccaaucagaagaaccaaaa

SEQ ID NO: 1176769 - RNA, 19 nt, Human
guauggacucuaaauaacc

SEQ ID NO: 1176770 - RNA, 21 nt, Human
gugauccuccugccucagccu

SEQ ID NO: 1176771 - RNA, 26 nt, Human
uaaaagaguacaacaggagugcagcg

SEQ ID NO: 1176772 - RNA, 21 nt, Human
uaacaccaaucagaagaacca

SEQ ID NO: 1176773 - RNA, 21 nt, Human
uaaccaagcccugccaugcuc

SEQ ID NO: 1176774 - RNA, 18 nt, Human
uaagacagggcuguaaac

SEQ ID NO: 1176775 - RNA, 19 nt, Human
uacacauagggaacaggag

SEQ ID NO: 1176776 - RNA, 19 nt, Human
uaccacaauccaccacauc

SEQ ID NO: 1176777 - RNA, 24 nt, Human
uacgaugguguugcccaggcugga

SEQ ID NO: 1176778 - RNA, 19 nt, Human
uagcuuuggcagcuauggu

SEQ ID NO: 1176779 - RNA, 26 nt, Human
uauccaccucuuuuccaccucuaaaa

SEQ ID NO: 1176780 - RNA, 19 nt, Human
ucaaauggggaaaagucac

SEQ ID NO: 1176781 - RNA, 23 nt, Human
ucaaauggggaaaagucacuucc

SEQ ID NO: 1176782 - RNA, 23 nt, Human
ucagcuccccuuauacccaucuu

SEQ ID NO: 1176783 - RNA, 19 nt, Human
uccacauuuugggaaugug

SEQ ID NO: 1176784 - RNA, 20 nt, Human
uccaccucuaaaagaguaca

SEQ ID NO: 1176785 - RNA, 22 nt, Human
uccaccucuuuuccaccucuaa

SEQ ID NO: 1176786 - RNA, 18 nt, Human
ucccagggcuuggucuuc

SEQ ID NO: 1176787 - RNA, 23 nt, Human
ucccagggcuuggucuucucuuc

SEQ ID NO: 1176788 - RNA, 19 nt, Human
uccccugggagcugugccu

SEQ ID NO: 1176789 - RNA, 24 nt, Human
ucccuguaauccuaagcaagccuu

SEQ ID NO: 1176790 - RNA, 25 nt, Human
uccucauaugaacacagacuucagc

SEQ ID NO: 1176791 - RNA, 26 nt, Human
uccuccccaauuuauuuauuuauuua

SEQ ID NO: 1176792 - RNA, 21 nt, Human
uccugggcucaagugauccuc

SEQ ID NO: 1176793 - RNA, 22 nt, Human
uccugggcucaagugauccucc

SEQ ID NO: 1176794 - RNA, 22 nt, Human
uccugggcucaagugauccucc

SEQ ID NO: 1176795 - RNA, 24 nt, Human
uccugggcucaagugauccuccug

SEQ ID NO: 1176796 - RNA, 25 nt, Human
uccuucacuccauuuagaaagagcu

SEQ ID NO: 1176797 - RNA, 22 nt, Human
ucggcagauucuggggcaguca

SEQ ID NO: 1176798 - RNA, 22 nt, Human
ucuuaaucuccugggcucaagu

SEQ ID NO: 1176799 - RNA, 21 nt, Human
ugaauccagucccuugucaag

SEQ ID NO: 1176800 - RNA, 20 nt, Human
ugaauuccuucacuccauuu

SEQ ID NO: 1176801 - RNA, 19 nt, Human
ugacaaaacuucucgggac

SEQ ID NO: 1176802 - RNA, 20 nt, Human
ugacuaguuggccuaggcug

SEQ ID NO: 1176803 - RNA, 24 nt, Human
ugacuuggggaaucuucaaaagaa

SEQ ID NO: 1176804 - RNA, 18 nt, Human
ugagaagauaacccugca

SEQ ID NO: 1176805 - RNA, 21 nt, Human
ugagauagcagccaaggaggu

SEQ ID NO: 1176806 - RNA, 20 nt, Human
ugaggaaaggccaggugagc

SEQ ID NO: 1176807 - RNA, 23 nt, Human
ugcauagcuuuggcagcuauggu

SEQ ID NO: 1176808 - RNA, 19 nt, Human
ugcccagugucaccucucu

SEQ ID NO: 1176809 - RNA, 24 nt, Human
ugccucagccuccagaguagcugg

SEQ ID NO: 1176810 - RNA, 21 nt, Human
ugccugcaggccgcaagcccu

SEQ ID NO: 1176811 - RNA, 19 nt, Human
uggacuacaggcgugugcc

SEQ ID NO: 1176812 - RNA, 21 nt, Human
uggacuacaggcgugugccca

SEQ ID NO: 1176813 - RNA, 22 nt, Human
uggacucuaaauaaccaagccc

SEQ ID NO: 1176814 - RNA, 18 nt, Human
uggagcuacaccucuguc

SEQ ID NO: 1176815 - RNA, 25 nt, Human
uggauucuaacacaugagauagcag

SEQ ID NO: 1176816 - RNA, 22 nt, Human
ugggacuacagacauguuccug

SEQ ID NO: 1176817 - RNA, 22 nt, Human
ugggagaagggggaagcagaag

SEQ ID NO: 1176818 - RNA, 20 nt, Human
ugggcucaagugauccuccu

SEQ ID NO: 1176819 - RNA, 24 nt, Human
ugggcucaagugauccuccugccu

SEQ ID NO: 1176820 - RNA, 24 nt, Human
uggggaaaagucacuuccacaggg

SEQ ID NO: 1176821 - RNA, 18 nt, Human
ugguacuacaggugugug

SEQ ID NO: 1176822 - RNA, 19 nt, Human
uggugaagaacauguuccg

SEQ ID NO: 1176823 - RNA, 22 nt, Human
ugguguugcccaggcuggagca

SEQ ID NO: 1176824 - RNA, 23 nt, Human
ugucucacccagcccuuccuuua

SEQ ID NO: 1176825 - RNA, 18 nt, Human
ugugaucaauggugcuac

SEQ ID NO: 1176826 - RNA, 20 nt, Human
uuauuuauuuauuuauuuuu

SEQ ID NO: 1176827 - RNA, 21 nt, Human
uuauuuauuuauuuauuuuua

SEQ ID NO: 1176828 - RNA, 20 nt, Human
uuccaaagagguucaccaca

SEQ ID NO: 1176829 - RNA, 19 nt, Human
uucucgggacuuccugguc

SEQ ID NO: 1176830 - RNA, 19 nt, Human
uucucuuccucauaugaac

SEQ ID NO: 1176831 - RNA, 24 nt, Human
uucuggggcagucagcagccccuu

SEQ ID NO: 1176832 - RNA, 19 nt, Human
uugcauuccagcccuguga

SEQ ID NO: 1176833 - RNA, 19 nt, Human
uuggagcuacaccucuguc

SEQ ID NO: 1176834 - RNA, 19 nt, Human
uuggaggagaaggggugca

SEQ ID NO: 1176835 - RNA, 22 nt, Human
uuguguacgagaacaauagaga

SEQ ID NO: 1176836 - RNA, 22 nt, Human
uuuauuuauuuauuuauuuauu

SEQ ID NO: 1176837 - RNA, 20 nt, Human
uuugcauuccagcccuguga

SEQ ID NO: 1176838 - RNA, 23 nt, Human
aagguuuauauggaugucauugc

SEQ ID NO: 1176839 - RNA, 20 nt, Human
augucauugcauguuuggga

SEQ ID NO: 1176840 - RNA, 20 nt, Human
uggaugucauugcauguuug

SEQ ID NO: 1176841 - RNA, 21 nt, Human
aaaacaaacaaacaaacaaac

SEQ ID NO: 1176842 - RNA, 18 nt, Human
aaaaucauuuucacauuu

SEQ ID NO: 1176843 - RNA, 21 nt, Human
aaacaaaacaaaacaaacaaa

SEQ ID NO: 1176844 - RNA, 21 nt, Human
aaacaaacaaacaaacaaacc

SEQ ID NO: 1176845 - RNA, 24 nt, Human
aaacaaacaaacaaacaaaccaca

SEQ ID NO: 1176846 - RNA, 18 nt, Human
aaacaaacaaaccacaca

SEQ ID NO: 1176847 - RNA, 26 nt, Human
aaacaaacaaaccacacacuaaaaca

SEQ ID NO: 1176848 - RNA, 26 nt, Human
aaacaaacaaaccacacacuaaaacu

SEQ ID NO: 1176849 - RNA, 22 nt, Human
aaauccugucucuacuaaaaaa

SEQ ID NO: 1176850 - RNA, 25 nt, Human
aacaaacaaacaaaccacacacuaa

SEQ ID NO: 1176851 - RNA, 22 nt, Human
aacaaaccacacacuaaaacaa

SEQ ID NO: 1176852 - RNA, 20 nt, Human
aacacaguaaaauccugucu

SEQ ID NO: 1176853 - RNA, 21 nt, Human
aacacaguaaaauccugucuc

SEQ ID NO: 1176854 - RNA, 21 nt, Human
aagaaguuuugaggauuguaa

SEQ ID NO: 1176855 - RNA, 20 nt, Human
aauugcuugaaccuggaagg

SEQ ID NO: 1176856 - RNA, 19 nt, Human
acaaaacaaaacaaacaaa

SEQ ID NO: 1176857 - RNA, 24 nt, Human
acaaaacaaaacaaacaaacaaac

SEQ ID NO: 1176858 - RNA, 18 nt, Human
acaaaaccuuaugcugag

SEQ ID NO: 1176859 - RNA, 20 nt, Human
acaaacaaaccacacacuaa

SEQ ID NO: 1176860 - RNA, 21 nt, Human
acacacuaaaacaaaaccuua

SEQ ID NO: 1176861 - RNA, 22 nt, Human
acauauuaauggcuuuucuaca

SEQ ID NO: 1176862 - RNA, 21 nt, Human
acauuuuucugguuuguaaca

SEQ ID NO: 1176863 - RNA, 20 nt, Human
accuguuauuccagcacuuu

SEQ ID NO: 1176864 - RNA, 18 nt, Human
acuccagccugggagaga

SEQ ID NO: 1176865 - RNA, 24 nt, Human
agagguuacgguaaaccaagauug

SEQ ID NO: 1176866 - RNA, 22 nt, Human
agauugcaccagugcacuccag

SEQ ID NO: 1176867 - RNA, 22 nt, Human
agcacuuugggaggcagaggug

SEQ ID NO: 1176868 - RNA, 23 nt, Human
agccgggcgugaugguacaugcc

SEQ ID NO: 1176869 - RNA, 24 nt, Human
agccuggccaacacaguaaaaucc

SEQ ID NO: 1176870 - RNA, 24 nt, Human
aggcagagguuacgguaaaccaag

SEQ ID NO: 1176871 - RNA, 22 nt, Human
aggcaggagaauugcuugaacc

SEQ ID NO: 1176872 - RNA, 22 nt, Human
aggcaggagaauugcuugaacc

SEQ ID NO: 1176873 - RNA, 23 nt, Human
aggcaggagaauugcuugaaccu

SEQ ID NO: 1176874 - RNA, 24 nt, Human
aggcaggagaauugcuugaaccug

SEQ ID NO: 1176875 - RNA, 18 nt, Human
agugcacuccagccuggg

SEQ ID NO: 1176876 - RNA, 21 nt, Human
aucauuucaagucaggaguuc

SEQ ID NO: 1176877 - RNA, 22 nt, Human
auguaagcacauauuaauggcu

SEQ ID NO: 1176878 - RNA, 24 nt, Human
auugcaccagugcacuccagccug

SEQ ID NO: 1176879 - RNA, 19 nt, Human
auuugugggguuucucccc

SEQ ID NO: 1176880 - RNA, 24 nt, Human
caacacaguaaaauccugucucua

SEQ ID NO: 1176881 - RNA, 24 nt, Human
cacaccuguuauuccagcacuuug

SEQ ID NO: 1176882 - RNA, 21 nt, Human
cacauucuucacauuuguaga

SEQ ID NO: 1176883 - RNA, 24 nt, Human
cacauuuuucugguuuguaacauu

SEQ ID NO: 1176884 - RNA, 20 nt, Human
cacuccagccugggagagag

SEQ ID NO: 1176885 - RNA, 18 nt, Human
cagcacuuugggaggcag

SEQ ID NO: 1176886 - RNA, 20 nt, Human
caguaugaauuuucuuaugu

SEQ ID NO: 1176887 - RNA, 18 nt, Human
cagugcacuccagccugg

SEQ ID NO: 1176888 - RNA, 20 nt, Human
cagugcacuccagccuggga

SEQ ID NO: 1176889 - RNA, 22 nt, Human
cagugcacuccagccugggaga

SEQ ID NO: 1176890 - RNA, 19 nt, Human
ccagugcacuccagccugg

SEQ ID NO: 1176891 - RNA, 22 nt, Human
ccagugcacuccagccugggag

SEQ ID NO: 1176892 - RNA, 22 nt, Human
ccauauucuucacacuucuggg

SEQ ID NO: 1176893 - RNA, 21 nt, Human
ccuggaaggcagagguuacgg

SEQ ID NO: 1176894 - RNA, 22 nt, Human
ccuggccaacacaguaaaaucc

SEQ ID NO: 1176895 - RNA, 24 nt, Human
ccuggccaacacaguaaaauccug

SEQ ID NO: 1176896 - RNA, 22 nt, Human
ccuguagucccagcuauucugg

SEQ ID NO: 1176897 - RNA, 23 nt, Human
ccugucucuacuaaaaaauacaa

SEQ ID NO: 1176898 - RNA, 19 nt, Human
cuaaaacaaaaccuuaugc

SEQ ID NO: 1176899 - RNA, 24 nt, Human
cucacaccuguuauuccagcacuu

SEQ ID NO: 1176900 - RNA, 20 nt, Human
cucuacuaaaaaauacaaaa

SEQ ID NO: 1176901 - RNA, 22 nt, Human
gaaccuggaaggcagagguuac

SEQ ID NO: 1176902 - RNA, 24 nt, Human
gaucauuucaagucaggaguucga

SEQ ID NO: 1176903 - RNA, 21 nt, Human
gcacuccagccugggagagag

SEQ ID NO: 1176904 - RNA, 20 nt, Human
gcagaaaggguugaagacuu

SEQ ID NO: 1176905 - RNA, 24 nt, Human
gccaacacaguaaaauccugucuc

SEQ ID NO: 1176906 - RNA, 22 nt, Human
guaaggcaggcacuacaacccu

SEQ ID NO: 1176907 - RNA, 23 nt, Human
guagaguuucucuccaguuugaa

SEQ ID NO: 1176908 - RNA, 23 nt, Human
uaaaaaaaacaaaacaaaacaaa

SEQ ID NO: 1176909 - RNA, 18 nt, Human
uaaaacaaaaccuuaugc

SEQ ID NO: 1176910 - RNA, 21 nt, Human
uacuaaggauugaguaucggu

SEQ ID NO: 1176911 - RNA, 21 nt, Human
uaucuuauguguaauaagagu

SEQ ID NO: 1176912 - RNA, 23 nt, Human
uauuggcugggaacaguggcuca

SEQ ID NO: 1176913 - RNA, 22 nt, Human
ucacauucuucacauuuuuaua

SEQ ID NO: 1176914 - RNA, 20 nt, Human
ucauuucaagucaggaguuc

SEQ ID NO: 1176915 - RNA, 24 nt, Human
ucauuucaagucaggaguucgaga

SEQ ID NO: 1176916 - RNA, 21 nt, Human
ucucuacuaaaaaauacaaaa

SEQ ID NO: 1176917 - RNA, 27 nt, Human
ucugugauacaaguaaggccggggucc

SEQ ID NO: 1176918 - RNA, 21 nt, Human
ugacaaccauuuaaaggcuuu

SEQ ID NO: 1176919 - RNA, 20 nt, Human
ugauacaaguaaggcaggca

SEQ ID NO: 1176920 - RNA, 24 nt, Human
ugaugguacaugccuguaguccca

SEQ ID NO: 1176921 - RNA, 23 nt, Human
ugcaccagugcacuccagccugg

SEQ ID NO: 1176922 - RNA, 20 nt, Human
ugcagaaaggguugaagacu

SEQ ID NO: 1176923 - RNA, 22 nt, Human
ugccacauucuucacauuugua

SEQ ID NO: 1176924 - RNA, 24 nt, Human
ugccuguagucccagcuauucugg

SEQ ID NO: 1176925 - RNA, 18 nt, Human
uggaaggcagagguuacg

SEQ ID NO: 1176926 - RNA, 20 nt, Human
uggaucauuucaagucagga

SEQ ID NO: 1176927 - RNA, 24 nt, Human
uggaucauuucaagucaggaguuc

SEQ ID NO: 1176928 - RNA, 22 nt, Human
uggcucacaccuguuauuccag

SEQ ID NO: 1176929 - RNA, 24 nt, Human
uggcucacaccuguuauuccagca

SEQ ID NO: 1176930 - RNA, 21 nt, Human
uggcuuuucuacauucuuuau

SEQ ID NO: 1176931 - RNA, 21 nt, Human
ugggaggcagagguguaugga

SEQ ID NO: 1176932 - RNA, 24 nt, Human
ugggaggcagagguguauggauca

SEQ ID NO: 1176933 - RNA, 18 nt, Human
ugggaguuucugccagua

SEQ ID NO: 1176934 - RNA, 23 nt, Human
uguagaguuucucuccaguuuga

SEQ ID NO: 1176935 - RNA, 23 nt, Human
uguaggguuuuucuccacuguga

SEQ ID NO: 1176936 - RNA, 23 nt, Human
uguaggguuuuucuccaguauga

SEQ ID NO: 1176937 - RNA, 24 nt, Human
uguauggaucauuucaagucagga

SEQ ID NO: 1176938 - RNA, 18 nt, Human
uguauuacauuuguaguu

SEQ ID NO: 1176939 - RNA, 24 nt, Human
ugucacauucuucacauuuuuaua

SEQ ID NO: 1176940 - RNA, 23 nt, Human
ugugggguuucucuccaguauga

SEQ ID NO: 1176941 - RNA, 21 nt, Human
uuaauggcuuuucuacauucu

SEQ ID NO: 1176942 - RNA, 20 nt, Human
uuagccgggcgugaugguac

SEQ ID NO: 1176943 - RNA, 22 nt, Human
uuaugugcagaaaggguugaag

SEQ ID NO: 1176944 - RNA, 20 nt, Human
uucacauuugugguguuucc

SEQ ID NO: 1176945 - RNA, 30 nt, Human; identical to SEQ ID NO: 428589

SEQ ID NO: 1176946 - RNA, 18 nt, Human
uucauauuugugggguuu

SEQ ID NO: 1176947 - RNA, 23 nt, Human
uugcaccagugcacuccagccug

SEQ ID NO: 1176948 - RNA, 18 nt, Human
uugcuugaaccuggaagg

SEQ ID NO: 1176949 - RNA, 24 nt, Human
uuguuaaaaucauuuucacauuuu

SEQ ID NO: 1176950 - RNA, 22 nt, Human
uuucaagucaggaguucgagau

SEQ ID NO: 1176951 - RNA, 19 nt, Human
uuuguagaguuucucucca

SEQ ID NO: 1176952 - RNA, 19 nt, Human
uuugugggguuucucccca

SEQ ID NO: 1176953 - RNA, 19 nt, Human
uuugugggguuucucucca

SEQ ID NO: 1176954 - RNA, 21 nt, Human
uuuaauuagaaaaacacagau

SEQ ID NO: 1176955 - RNA, 21 nt, Human
ccgcuguuggggcgcccgggg

SEQ ID NO: 1176956 - RNA, 18 nt, Human
uucucugauaauccugcu

SEQ ID NO: 1176957 - RNA, 21 nt, Human
cugacccugauccaccucccc

SEQ ID NO: 1176958 - RNA, 27 nt, Human
aaauggccucacagucaugaguugggc

SEQ ID NO: 1176959 - RNA, 20 nt, Human
aagcggccgagaggcaggag

SEQ ID NO: 1176960 - RNA, 21 nt, Human
aagcggccgagaggcaggagc

SEQ ID NO: 1176961 - RNA, 19 nt, Human
acgaggcaggcacuaggcc

SEQ ID NO: 1176962 - RNA, 24 nt, Human
agacagaaguugggcaaaagccug

SEQ ID NO: 1176963 - RNA, 26 nt, Human
agacagaaguugggcaaaagggaccc

SEQ ID NO: 1176964 - RNA, 18 nt, Human
agcagggccugcagaggc

SEQ ID NO: 1176965 - RNA, 19 nt, Human
aggcacuaggccuggaaau

SEQ ID NO: 1176966 - RNA, 25 nt, Human
aggcagaaauuuggccuggggcagc

SEQ ID NO: 1176967 - RNA, 22 nt, Human
aggcaggagcuucgccugagga

SEQ ID NO: 1176968 - RNA, 25 nt, Human
aggcaggagcuucgccugaggaugc

SEQ ID NO: 1176969 - RNA, 19 nt, Human
aggcaggaggagcugggcc

SEQ ID NO: 1176970 - RNA, 21 nt, Human
aggcaggaggagcugggccug

SEQ ID NO: 1176971 - RNA, 19 nt, Human
aggcaggaggcugggccuu

SEQ ID NO: 1176972 - RNA, 20 nt, Human
aggcaugagcugggcugggc

SEQ ID NO: 1176973 - RNA, 19 nt, Human
aucugggucuggagggucc

SEQ ID NO: 1176974 - RNA, 21 nt, Human
augggccugaagaggccacug

SEQ ID NO: 1176975 - RNA, 20 nt, Human
caagagcagggccugcagag

SEQ ID NO: 1176976 - RNA, 21 nt, Human
caccgggaagcagaagguggg

SEQ ID NO: 1176977 - RNA, 21 nt, Human
cacuaggccuggaaauggccu

SEQ ID NO: 1176978 - RNA, 19 nt, Human
cagcaaacaagcucuuuug

SEQ ID NO: 1176979 - RNA, 21 nt, Human
ccaccgaaagucaaaagcggg

SEQ ID NO: 1176980 - RNA, 18 nt, Human
ccacugugaggcagaggc

SEQ ID NO: 1176981 - RNA, 18 nt, Human
ccccaugggccugaagag

SEQ ID NO: 1176982 - RNA, 21 nt, Human
ccccugagaggcaagagcagg

SEQ ID NO: 1176983 - RNA, 21 nt, Human
ccgaaaggcaggagcuucgcc

SEQ ID NO: 1176984 - RNA, 22 nt, Human
ccucacagucaugaguugggcc

SEQ ID NO: 1176985 - RNA, 20 nt, Human
cgccgggaggcaugagcugg

SEQ ID NO: 1176986 - RNA, 22 nt, Human
cgggagcugggccugccgaagc

SEQ ID NO: 1176987 - RNA, 22 nt, Human
cgggaggcaugagcugggcugg

SEQ ID NO: 1176988 - RNA, 18 nt, Human
cugaagaggccacuggca

SEQ ID NO: 1176989 - RNA, 20 nt, Human
cuggggcagcugccaugagg

SEQ ID NO: 1176990 - RNA, 21 nt, Human
gaagcagaaggugggccugga

SEQ ID NO: 1176991 - RNA, 20 nt, Human
gccccugagaggcaagagcu

SEQ ID NO: 1176992 - RNA, 24 nt, Human
gccgaaaggcaggagcuucgccug

SEQ ID NO: 1176993 - RNA, 18 nt, Human
gcgggagcugggccugcc

SEQ ID NO: 1176994 - RNA, 18 nt, Human
ggaaggccgccgggaggc

SEQ ID NO: 1176995 - RNA, 23 nt, Human
ggaggcaggaggagcugggcccc

SEQ ID NO: 1176996 - RNA, 22 nt, Human
ggcaggcagaaauuuggccugg

SEQ ID NO: 1176997 - RNA, 20 nt, Human
gggaggcaugagcugggcug

SEQ ID NO: 1176998 - RNA, 23 nt, Human
gggaggcaugagcugggcugggc

SEQ ID NO: 1176999 - RNA, 19 nt, Human
gggcugggccgaaagaggc

SEQ ID NO: 1177000 - RNA, 18 nt, Human
gggcuugggaaggccgcc

SEQ ID NO: 1177001 - RNA, 18 nt, Human
gugaggcagaggcugacc

SEQ ID NO: 1177002 - RNA, 19 nt, Human
gugaggcagaggcugggcc

SEQ ID NO: 1177003 - RNA, 25 nt, Human
ucaaagcugggccuguugaugccac

SEQ ID NO: 1177004 - RNA, 20 nt, Human
uccacugugaggcagaggcu

SEQ ID NO: 1177005 - RNA, 20 nt, Human
uccgcugugaggcagaggcu

SEQ ID NO: 1177006 - RNA, 23 nt, Human
ugagcugggcugggccgaaagag

SEQ ID NO: 1177007 - RNA, 25 nt, Human
ugaggaugccacagugagacaccau

SEQ ID NO: 1177008 - RNA, 20 nt, Human
ugaggcaagagcugggccug

SEQ ID NO: 1177009 - RNA, 19 nt, Human
ugaggcagaggcugaccug

SEQ ID NO: 1177010 - RNA, 18 nt, Human
ugaggcagaggcugggcc

SEQ ID NO: 1177011 - RNA, 18 nt, Human
ugaggcagaggcugggcc

SEQ ID NO: 1177012 - RNA, 18 nt, Human
ugaguugggccuaaaugg

SEQ ID NO: 1177013 - RNA, 19 nt, Human
uggaaaaagccccugagag

SEQ ID NO: 1177014 - RNA, 25 nt, Human
uggaaaaagccccugagaggcaaga

SEQ ID NO: 1177015 - RNA, 22 nt, Human
uggcaggcgggagcugggccug

SEQ ID NO: 1177016 - RNA, 24 nt, Human
uggccuggggcagcugccaugagg

SEQ ID NO: 1177017 - RNA, 21 nt, Human
ugggaggcaggaggagcuggg

SEQ ID NO: 1177018 - RNA, 21 nt, Human
ugggcaaaagccugauuugag

SEQ ID NO: 1177019 - RNA, 26 nt, Human
ugggcaaaagccugauuugaggaagu

SEQ ID NO: 1177020 - RNA, 18 nt, Human
ugugaggcagaggcuggg

SEQ ID NO: 1177021 - RNA, 23 nt, Human
aaacaccacaaaucuaccaucuu

SEQ ID NO: 1177022 - RNA, 21 nt, Human
aaagcaaccguuuuuuuuuuu

SEQ ID NO: 1177023 - RNA, 24 nt, Human
aaagugcugggauuacgaauguga

SEQ ID NO: 1177024 - RNA, 18 nt, Human
aaaguucugggauuacag

SEQ ID NO: 1177025 - RNA, 20 nt, Human
aaaguucugggauuacaggc

SEQ ID NO: 1177026 - RNA, 24 nt, Human
aaaguucugggauuacaggcguga

SEQ ID NO: 1177027 - RNA, 21 nt, Human
aacaccacaaaucuaccaucu

SEQ ID NO: 1177028 - RNA, 19 nt, Human
aacuguaacaugagguccc

SEQ ID NO: 1177029 - RNA, 19 nt, Human
aagaguuagagaucagccu

SEQ ID NO: 1177030 - RNA, 26 nt, Human
aagccacccccauuccuugacuuacc

SEQ ID NO: 1177031 - RNA, 21 nt, Human
aagcgauccuccuaccucagc

SEQ ID NO: 1177032 - RNA, 24 nt, Human
aagugauucucugccucagccucc

SEQ ID NO: 1177033 - RNA, 26 nt, Human
aagugcugggauuacgaaugugagcc

SEQ ID NO: 1177034 - RNA, 21 nt, Human
acagaaugugcuccuuugccu

SEQ ID NO: 1177035 - RNA, 24 nt, Human
acaggcgugagcaacuguaacaug

SEQ ID NO: 1177036 - RNA, 21 nt, Human
acagguacccaccaccacacc

SEQ ID NO: 1177037 - RNA, 24 nt, Human
accaucuuggcuaggcuggucuug

SEQ ID NO: 1177038 - RNA, 23 nt, Human
accauguuggucaggcuggucuc

SEQ ID NO: 1177039 - RNA, 26 nt, Human
accucgugauuccauauucaaggcca

SEQ ID NO: 1177040 - RNA, 21 nt, Human
acgggguuucaccauguuggu

SEQ ID NO: 1177041 - RNA, 23 nt, Human
acgggguuucaccauguugguca

SEQ ID NO: 1177042 - RNA, 24 nt, Human
acgggguuucaccauguuggucag

SEQ ID NO: 1177043 - RNA, 18 nt, Human
acucuccuaccuccuucu

SEQ ID NO: 1177044 - RNA, 22 nt, Human
agaggaaggauugcuugaggcc

SEQ ID NO: 1177045 - RNA, 20 nt, Human
agccaccacaccuggcccca

SEQ ID NO: 1177046 - RNA, 21 nt, Human
agccaccacaccuggccccaa

SEQ ID NO: 1177047 - RNA, 21 nt, Human
agcugccagagaaagcaacca

SEQ ID NO: 1177048 - RNA, 22 nt, Human
agcugccagagaaagcaaccac

SEQ ID NO: 1177049 - RNA, 23 nt, Human
agcuggacauggugaugcacgcc

SEQ ID NO: 1177050 - RNA, 20 nt, Human
aggaaggauugcuugaggcc

SEQ ID NO: 1177051 - RNA, 19 nt, Human
aggaggagggcuagcugcc

SEQ ID NO: 1177052 - RNA, 22 nt, Human
aggcuaaggugggaggaucgcu

SEQ ID NO: 1177053 - RNA, 22 nt, Human
aggucucauuauguugcccagg

SEQ ID NO: 1177054 - RNA, 22 nt, Human
aguagaaacgggguuucaccau

SEQ ID NO: 1177055 - RNA, 22 nt, Human
aguagagauggaguuucaccau

SEQ ID NO: 1177056 - RNA, 23 nt, Human
aguagcuggaauuacagggaugu

SEQ ID NO: 1177057 - RNA, 18 nt, Human
aguagcugggauuacagg

SEQ ID NO: 1177058 - RNA, 18 nt, Human
aguucugggauuacaggc

SEQ ID NO: 1177059 - RNA, 20 nt, Human
auggaguuucaccaucuugg

SEQ ID NO: 1177060 - RNA, 24 nt, Human
auggaguuucaccaucuuggcuag

SEQ ID NO: 1177061 - RNA, 24 nt, Human
auguuuguauuuuuaguagagaug

SEQ ID NO: 1177062 - RNA, 24 nt, Human
caaacugcuaggauuacaggagug

SEQ ID NO: 1177063 - RNA, 24 nt, Human
caaagugcugggauuacgaaugug

SEQ ID NO: 1177064 - RNA, 21 nt, Human
caacauuuugggaggccaaag

SEQ ID NO: 1177065 - RNA, 20 nt, Human
caaccuccaccucccggguu

SEQ ID NO: 1177066 - RNA, 23 nt, Human
caaccuccaccucccggguucaa

SEQ ID NO: 1177067 - RNA, 23 nt, Human
caacuaggucuauuaaggcuaaa

SEQ ID NO: 1177068 - RNA, 22 nt, Human
caagcaauucuccugccucagc

SEQ ID NO: 1177069 - RNA, 19 nt, Human
caagugauucucugccuca

SEQ ID NO: 1177070 - RNA, 21 nt, Human
caagugauucucugccucagc

SEQ ID NO: 1177071 - RNA, 21 nt, Human
caccaucuuggcuaggcuggu

SEQ ID NO: 1177072 - RNA, 24 nt, Human
caccaucuuggcuaggcuggucuu

SEQ ID NO: 1177073 - RNA, 21 nt, Human
caccauguuggucaggcuggu

SEQ ID NO: 1177074 - RNA, 24 nt, Human
caccauguuggucaggcuggucuc

SEQ ID NO: 1177075 - RNA, 18 nt, Human
cacgccuguaguuccagc

SEQ ID NO: 1177076 - RNA, 21 nt, Human
cacugcaaccuccaccucccg

SEQ ID NO: 1177077 - RNA, 23 nt, Human
cacugcaaccuccaccucccggg

SEQ ID NO: 1177078 - RNA, 23 nt, Human
cacugcaaugucugccuuuuggg

SEQ ID NO: 1177079 - RNA, 22 nt, Human
caguucugggggccagaagccc

SEQ ID NO: 1177080 - RNA, 22 nt, Human
caucuguaaucccaacauuuug

SEQ ID NO: 1177081 - RNA, 24 nt, Human
caucuguaaucccaacauuuuggg

SEQ ID NO: 1177082 - RNA, 24 nt, Human
cauuauguugcccaggcuggucuu

SEQ ID NO: 1177083 - RNA, 27 nt, Human
cauuauguugcccaggcuggucuuaaa

SEQ ID NO: 1177084 - RNA, 18 nt, Human
ccaaagugcugggauuac

SEQ ID NO: 1177085 - RNA, 23 nt, Human
ccaaagugcugggauuacgaaug

SEQ ID NO: 1177086 - RNA, 24 nt, Human
ccaaagugcugggauuacgaaugu

SEQ ID NO: 1177087 - RNA, 19 nt, Human
ccaacauuuugggaggcca

SEQ ID NO: 1177088 - RNA, 23 nt, Human
ccaacauuuugggaggccaaaga

SEQ ID NO: 1177089 - RNA, 18 nt, Human
ccaccacaccuggcccca

SEQ ID NO: 1177090 - RNA, 20 nt, Human
ccaccacaccuggcuaaugu

SEQ ID NO: 1177091 - RNA, 19 nt, Human
ccacccccauuccuugacu

SEQ ID NO: 1177092 - RNA, 27 nt, Human
ccaccucccggguucaagcaauucuuu

SEQ ID NO: 1177093 - RNA, 23 nt, Human
cccgaguagcuggaauuacaggg

SEQ ID NO: 1177094 - RNA, 23 nt, Human
cccgaguagcugggauuacaggu

SEQ ID NO: 1177095 - RNA, 24 nt, Human
cccgaguagcugggauuacaggua

SEQ ID NO: 1177096 - RNA, 23 nt, Human
cccggguucaagcaauucuccug

SEQ ID NO: 1177097 - RNA, 21 nt, Human
ccgaguagcugggauuacagg

SEQ ID NO: 1177098 - RNA, 25 nt, Human
ccucaccugcugaacuccaagaggc

SEQ ID NO: 1177099 - RNA, 24 nt, Human
ccucccggguucaagcaauucucc

SEQ ID NO: 1177100 - RNA, 23 nt, Human
ccuccuaccucagccuccuaaag

SEQ ID NO: 1177101 - RNA, 18 nt, Human
ccucgugauccacccucc

SEQ ID NO: 1177102 - RNA, 21 nt, Human
ccucgugauccacccuccucg

SEQ ID NO: 1177103 - RNA, 18 nt, Human
ccucucugaccucuucuu

SEQ ID NO: 1177104 - RNA, 23 nt, Human
ccugccucagccucccgaguagc

SEQ ID NO: 1177105 - RNA, 21 nt, Human
ccuuuuggguucaagugauuc

SEQ ID NO: 1177106 - RNA, 22 nt, Human
cgccuguaguuccagcuacugg

SEQ ID NO: 1177107 - RNA, 24 nt, Human
cuaaaguucugggauuacaggcgu

SEQ ID NO: 1177108 - RNA, 24 nt, Human
cucacugcaaccuccaccucccgg

SEQ ID NO: 1177109 - RNA, 19 nt, Human
cucacugcaaugucugccu

SEQ ID NO: 1177110 - RNA, 24 nt, Human
cucagccucccgaguagcugggau

SEQ ID NO: 1177111 - RNA, 25 nt, Human
cucagccuccuaaaguucugggauu

SEQ ID NO: 1177112 - RNA, 23 nt, Human
cuccugggcuuaagcgauccucc

SEQ ID NO: 1177113 - RNA, 24 nt, Human
cucugccucagccucccgaguagc

SEQ ID NO: 1177114 - RNA, 22 nt, Human
cucuuauagcccaggcuggagu

SEQ ID NO: 1177115 - RNA, 23 nt, Human
cugccucagccucccgaguagcu

SEQ ID NO: 1177116 - RNA, 23 nt, Human
cugccucagccucccgaguagcu

SEQ ID NO: 1177117 - RNA, 23 nt, Human
cugccuuuuggguucaagugauu

SEQ ID NO: 1177118 - RNA, 23 nt, Human
cugggggccagaagcccaacuag

SEQ ID NO: 1177119 - RNA, 24 nt, Human
cuuauagcccaggcuggagugcaa

SEQ ID NO: 1177120 - RNA, 22 nt, Human
cuucaaaucucccucucugacc

SEQ ID NO: 1177121 - RNA, 21 nt, Human
cuuccaaacugcuaggauuac

SEQ ID NO: 1177122 - RNA, 21 nt, Human
cuucuagaagccacccccauu

SEQ ID NO: 1177123 - RNA, 21 nt, Human
cuugaggccaagaguuagaga

SEQ ID NO: 1177124 - RNA, 19 nt, Human
cuuggucacccaggcugaa

SEQ ID NO: 1177125 - RNA, 25 nt, Human
cuuucagccucaccugcugaacucc

SEQ ID NO: 1177126 - RNA, 22 nt, Human
gaccucgugauccacccuccuc

SEQ ID NO: 1177127 - RNA, 22 nt, Human
gaccucgugauccacccuccuc

SEQ ID NO: 1177128 - RNA, 24 nt, Human
gaccucgugauccacccuccucgg

SEQ ID NO: 1177129 - RNA, 21 nt, Human
gaccucuucuuccauuaccac

SEQ ID NO: 1177130 - RNA, 25 nt, Human
gaguagcuggaauuacagggaugug

SEQ ID NO: 1177131 - RNA, 22 nt, Human
gaguagcugggauuacagguac

SEQ ID NO: 1177132 - RNA, 18 nt, Human
gauuacaggagugagcca

SEQ ID NO: 1177133 - RNA, 19 nt, Human
gauuacaggcgugagcaac

SEQ ID NO: 1177134 - RNA, 21 nt, Human
gauuacaggcgugagcaacug

SEQ ID NO: 1177135 - RNA, 18 nt, Human
gauuacgaaugugagcca

SEQ ID NO: 1177136 - RNA, 23 nt, Human
gauuacgaaugugagccacugca

SEQ ID NO: 1177137 - RNA, 22 nt, Human
gcaaccuccaccucccggguuc

SEQ ID NO: 1177138 - RNA, 19 nt, Human
gcccaggcuggagugcaau

SEQ ID NO: 1177139 - RNA, 23 nt, Human
gcccaggcuggagugcaauggca

SEQ ID NO: 1177140 - RNA, 19 nt, Human
gcgucagccuuccaaacug

SEQ ID NO: 1177141 - RNA, 23 nt, Human
gcuacaacaaaguacccuacauu

SEQ ID NO: 1177142 - RNA, 20 nt, Human
gcucacugcaaugucugccu

SEQ ID NO: 1177143 - RNA, 24 nt, Human
gcucuuauagcccaggcuggagug

SEQ ID NO: 1177144 - RNA, 26 nt, Human
gcuggaauuacagggaugugccaguc

SEQ ID NO: 1177145 - RNA, 19 nt, Human
gcuggagugcaauggcaca

SEQ ID NO: 1177146 - RNA, 21 nt, Human
gcugggauuacgaaugugagc

SEQ ID NO: 1177147 - RNA, 23 nt, Human
gcuggucucaaacuccugaccuc

SEQ ID NO: 1177148 - RNA, 19 nt, Human
gcuucaaacaccacaaauc

SEQ ID NO: 1177149 - RNA, 24 nt, Human
ggacauggugaugcacgccuguag

SEQ ID NO: 1177150 - RNA, 19 nt, Human
ggaguuucaccaucuuggc

SEQ ID NO: 1177151 - RNA, 23 nt, Human
ggaguuucaccaucuuggcuagg

SEQ ID NO: 1177152 - RNA, 22 nt, Human
ggaugcuguugagcuaacaggg

SEQ ID NO: 1177153 - RNA, 22 nt, Human
ggauuacaggagugagccacca

SEQ ID NO: 1177154 - RNA, 21 nt, Human
ggccaaagaggaaggauugcu

SEQ ID NO: 1177155 - RNA, 24 nt, Human
ggcuggucucaaacuccugaccuc

SEQ ID NO: 1177156 - RNA, 24 nt, Human
ggcuggucuugaacuucugaccuc

SEQ ID NO: 1177157 - RNA, 21 nt, Human
gggaaaauaggaagacccugc

SEQ ID NO: 1177158 - RNA, 22 nt, Human
gggcuuaagcgauccuccuacc

SEQ ID NO: 1177159 - RNA, 21 nt, Human
ggggaggcucuagacagaaug

SEQ ID NO: 1177160 - RNA, 23 nt, Human
gggguuucaccauguuggucagg

SEQ ID NO: 1177161 - RNA, 19 nt, Human
ggguucaagugauucucug

SEQ ID NO: 1177162 - RNA, 22 nt, Human
ggguuucaccauguuggucagg

SEQ ID NO: 1177163 - RNA, 20 nt, Human
ggucuugaacuucugaccuc

SEQ ID NO: 1177164 - RNA, 24 nt, Human
ggugaugcacgccuguaguuccag

SEQ ID NO: 1177165 - RNA, 18 nt, Human
gucacccaggcugaagug

SEQ ID NO: 1177166 - RNA, 21 nt, Human
gucuuggucacccaggcugaa

SEQ ID NO: 1177167 - RNA, 24 nt, Human
gugauccacccuccucggccuccc

SEQ ID NO: 1177168 - RNA, 23 nt, Human
gugauucucugccucagccuccc

SEQ ID NO: 1177169 - RNA, 23 nt, Human
guucaagugauucucugccucag

SEQ ID NO: 1177170 - RNA, 22 nt, Human
guugcuacaacaaaguacccua

SEQ ID NO: 1177171 - RNA, 20 nt, Human
uaagcgauccuccuaccuca

SEQ ID NO: 1177172 - RNA, 27 nt, Human
uaagcgauccuccuaccucagccuccu

SEQ ID NO: 1177173 - RNA, 24 nt, Human
uaauguuuguauuuuuaguagaga

SEQ ID NO: 1177174 - RNA, 22 nt, Human
uacaggagugagccaccacacc

SEQ ID NO: 1177175 - RNA, 23 nt, Human
uacaggagugagccaccacaccu

SEQ ID NO: 1177176 - RNA, 23 nt, Human
uacaggagugagccaccacaccu

SEQ ID NO: 1177177 - RNA, 22 nt, Human
uacagguacccaccaccacacc

SEQ ID NO: 1177178 - RNA, 24 nt, Human
uaccucagccuccuaaaguucugg

SEQ ID NO: 1177179 - RNA, 24 nt, Human
uacgaaugugagccacugcaccug

SEQ ID NO: 1177180 - RNA, 22 nt, Human
uagaaacgggguuucaccaugu

SEQ ID NO: 1177181 - RNA, 18 nt, Human
uagcccaggcuggagugc

SEQ ID NO: 1177182 - RNA, 19 nt, Human
uagcuggaauuacagggau

SEQ ID NO: 1177183 - RNA, 21 nt, Human
uagcuucuagaagccaccccc

SEQ ID NO: 1177184 - RNA, 22 nt, Human
uaggauuacaggagugagccac

SEQ ID NO: 1177185 - RNA, 24 nt, Human
uaggauuacaggagugagccacca

SEQ ID NO: 1177186 - RNA, 24 nt, Human
uaguagaaacgggguuucaccaug

SEQ ID NO: 1177187 - RNA, 25 nt, Human
uaguagaaacgggguuucaccaugu

SEQ ID NO: 1177188 - RNA, 19 nt, Human
uaguagagauggaguuuca

SEQ ID NO: 1177189 - RNA, 26 nt, Human
uaguagagauggaguuucaccaucuu

SEQ ID NO: 1177190 - RNA, 20 nt, Human
uauguugcccaggcuggucu

SEQ ID NO: 1177191 - RNA, 23 nt, Human
uauguugcccaggcuggucuuaa

SEQ ID NO: 1177192 - RNA, 24 nt, Human
uauguugcccaggcuggucuuaaa

SEQ ID NO: 1177193 - RNA, 23 nt, Human
ucacugcaaccuccaccucccgg

SEQ ID NO: 1177194 - RNA, 24 nt, Human
ucacugcaaccuccaccucccggg

SEQ ID NO: 1177195 - RNA, 25 nt, Human
ucacugcaaccuccaccucccgggu

SEQ ID NO: 1177196 - RNA, 26 nt, Human
ucacugcaaccuccaccucccggguu

SEQ ID NO: 1177197 - RNA, 24 nt, Human
ucacugcaaugucugccuuuuggg

SEQ ID NO: 1177198 - RNA, 27 nt, Human
ucacuuucucuaauucugacucuccua

SEQ ID NO: 1177199 - RNA, 20 nt, Human
ucagccucccgaguagcugg

SEQ ID NO: 1177200 - RNA, 22 nt, Human
ucagccucccgaguagcuggaa

SEQ ID NO: 1177201 - RNA, 21 nt, Human
uccacccuccucggccuccca

SEQ ID NO: 1177202 - RNA, 18 nt, Human
ucccaaagugcugggauu

SEQ ID NO: 1177203 - RNA, 20 nt, Human
ucccaaagugcugggauuac

SEQ ID NO: 1177204 - RNA, 23 nt, Human
ucccgaguagcugggauuacagg

SEQ ID NO: 1177205 - RNA, 24 nt, Human
ucccgaguagcugggauuacaggu

SEQ ID NO: 1177206 - RNA, 21 nt, Human
ucccggguucaagcaauucuc

SEQ ID NO: 1177207 - RNA, 24 nt, Human
ucccggguucaagcaauucuccug

SEQ ID NO: 1177208 - RNA, 25 nt, Human
ucccucucugaccucuucuuccauu

SEQ ID NO: 1177209 - RNA, 24 nt, Human
uccuaaaguucugggauuacaggc

SEQ ID NO: 1177210 - RNA, 20 nt, Human
uccuccuaccucagccuccc

SEQ ID NO: 1177211 - RNA, 21 nt, Human
uccucggccucccaaagugcu

SEQ ID NO: 1177212 - RNA, 21 nt, Human
uccugggcuuaagcgauccuc

SEQ ID NO: 1177213 - RNA, 21 nt, Human
ucuagaagccacccccauucc

SEQ ID NO: 1177214 - RNA, 24 nt, Human
ucucaaacuccugaccucaaguag

SEQ ID NO: 1177215 - RNA, 18 nt, Human
ucucauuauguugcccag

SEQ ID NO: 1177216 - RNA, 23 nt, Human
ucucauuauguugcccaggcugg

SEQ ID NO: 1177217 - RNA, 24 nt, Human
ucucauuauguugcccaggcuggu

SEQ ID NO: 1177218 - RNA, 22 nt, Human
ucuccuaccuccuucucuuaua

SEQ ID NO: 1177219 - RNA, 24 nt, Human
ucuccugccucagccucccgagua

SEQ ID NO: 1177220 - RNA, 22 nt, Human
ucucuaauucugacucuccuac

SEQ ID NO: 1177221 - RNA, 24 nt, Human
ucuggcucuuauagcccaggcugg

SEQ ID NO: 1177222 - RNA, 23 nt, Human
ucuuaaacuccugggcuuaagcg

SEQ ID NO: 1177223 - RNA, 20 nt, Human
ugaggcuuggaacuuucagc

SEQ ID NO: 1177224 - RNA, 24 nt, Human
ugaggucucauuauguugcccagg

SEQ ID NO: 1177225 - RNA, 18 nt, Human
ugaugcacgccuguaguu

SEQ ID NO: 1177226 - RNA, 20 nt, Human
ugaugcacgccuguaguucc

SEQ ID NO: 1177227 - RNA, 24 nt, Human
ugcccaggcuggucuuaaacuccu

SEQ ID NO: 1177228 - RNA, 28 nt, Human
ugcccaggcuggucuuaaacuccugggc

SEQ ID NO: 1177229 - RNA, 24 nt, Human
ugccucagccucccgaguagcugg

SEQ ID NO: 1177230 - RNA, 24 nt, Human
ugccucagccucccgaguagcugg

SEQ ID NO: 1177231 - RNA, 24 nt, Human
ugcugggauuacgaaugugagcca

SEQ ID NO: 1177232 - RNA, 21 nt, Human
uggaauuacagggaugugcca

SEQ ID NO: 1177233 - RNA, 22 nt, Human
uggaauuacagggaugugccac

SEQ ID NO: 1177234 - RNA, 23 nt, Human
uggagugcaauggcacaaucuca

SEQ ID NO: 1177235 - RNA, 24 nt, Human
uggagugcaauggcacaaucucag

SEQ ID NO: 1177236 - RNA, 24 nt, Human
uggaguuucaccaucuuggcuagg

SEQ ID NO: 1177237 - RNA, 24 nt, Human
uggcacaaucucagcucacugcaa

SEQ ID NO: 1177238 - RNA, 24 nt, Human
uggcuaggcuggucuugaacuucu

SEQ ID NO: 1177239 - RNA, 22 nt, Human
ugggaggccaaagaggaaggau

SEQ ID NO: 1177240 - RNA, 18 nt, Human
ugggauuacaggcgugag

SEQ ID NO: 1177241 - RNA, 19 nt, Human
ugggauuacaggcgugagc

SEQ ID NO: 1177242 - RNA, 19 nt, Human
ugggauuacaggcgugagc

SEQ ID NO: 1177243 - RNA, 20 nt, Human
ugggauuacaggcgugagca

SEQ ID NO: 1177244 - RNA, 22 nt, Human
ugggauuacaggcgugagcaac

SEQ ID NO: 1177245 - RNA, 23 nt, Human
ugggauuacaggcgugagcaacu

SEQ ID NO: 1177246 - RNA, 24 nt, Human
ugggauuacaggcgugagcaacug

SEQ ID NO: 1177247 - RNA, 27 nt, Human
ugggauuacaggcgugagcaacuguaa

SEQ ID NO: 1177248 - RNA, 19 nt, Human
ugggauuacagguacccac

SEQ ID NO: 1177249 - RNA, 21 nt, Human
ugggauuacagguacccacca

SEQ ID NO: 1177250 - RNA, 24 nt, Human
ugggauuacagguacccaccacca

SEQ ID NO: 1177251 - RNA, 22 nt, Human
ugggauuacgaaugugagccac

SEQ ID NO: 1177252 - RNA, 22 nt, Human
ugggauuacgaaugugagccac

SEQ ID NO: 1177253 - RNA, 24 nt, Human
ugggauuacgaaugugagccacug

SEQ ID NO: 1177254 - RNA, 25 nt, Human
ugggggaggcucuagacagaaugug

SEQ ID NO: 1177255 - RNA, 24 nt, Human
ugggggcucccaucuguaauccca

SEQ ID NO: 1177256 - RNA, 18 nt, Human
uggguucaagugauucuc

SEQ ID NO: 1177257 - RNA, 20 nt, Human
uggguucaagugauucucuu

SEQ ID NO: 1177258 - RNA, 24 nt, Human
uggucaggcuggucucaaacuccu

SEQ ID NO: 1177259 - RNA, 24 nt, Human
uggugaugcacgccuguaguucca

SEQ ID NO: 1177260 - RNA, 21 nt, Human
ugugauugguggguauggggg

SEQ ID NO: 1177261 - RNA, 21 nt, Human
uguuuguauuuuuaguagaga

SEQ ID NO: 1177262 - RNA, 18 nt, Human
uuaaggcuaaagucaagg

SEQ ID NO: 1177263 - RNA, 24 nt, Human
uuaguagaaacgggguuucaccau

SEQ ID NO: 1177264 - RNA, 18 nt, Human
uuaguagagauggaguuu

SEQ ID NO: 1177265 - RNA, 22 nt, Human
uuaguagagauggaguuucacc

SEQ ID NO: 1177266 - RNA, 24 nt, Human
uuaguagagauggaguuucaccau

SEQ ID NO: 1177267 - RNA, 21 nt, Human
uucaagcaauucuccugccuc

SEQ ID NO: 1177268 - RNA, 24 nt, Human
uucaagcaauucuccugccucagc

SEQ ID NO: 1177269 - RNA, 22 nt, Human
uucaggaggagggcuagcugcc

SEQ ID NO: 1177270 - RNA, 23 nt, Human
uuguauuuuuaguagagauggag

SEQ ID NO: 1177271 - RNA, 24 nt, Human
uuucaccaucuuggcuaggcuggu

SEQ ID NO: 1177272 - RNA, 24 nt, Human
uuucaccauguuggucaggcuggu

SEQ ID NO: 1177273 - RNA, 22 nt, Human
uuugccuuuucuagcuucuaga

SEQ ID NO: 1177274 - RNA, 18 nt, Human
uuuguauuuuuaguagag

SEQ ID NO: 1177275 - RNA, 18 nt, Human
uuuuguuguugcuacaac

SEQ ID NO: 1177276 - RNA, 24 nt, Human
uuuuuaguagaaacgggguuucac

SEQ ID NO: 1177277 - RNA, 24 nt, Human
uuuuuaguagagauggaguuucac

SEQ ID NO: 1177278 - RNA, 24 nt, Human
uuuuugaggcuuggaacuuucagc

SEQ ID NO: 1177279 - RNA, 21 nt, Human
uuuuuuuuuaaacggagucug

SEQ ID NO: 1177280 - RNA, 24 nt, Human
uuuuuuuuuuuaaacggagucugg

SEQ ID NO: 1177281 - RNA, 20 nt, Human
accuggaggccgguggggcu

SEQ ID NO: 1177282 - RNA, 20 nt, Human
ccgccagguaaucguugagc

SEQ ID NO: 1177283 - RNA, 20 nt, Human
cguugagcaccuggaggccg

SEQ ID NO: 1177284 - RNA, 22 nt, Human
uguauccgagagcuggggagca

SEQ ID NO: 1177285 - RNA, 21 nt, Human
aggaggggaaggggagggggu

SEQ ID NO: 1177286 - RNA, 21 nt, Human
aggcagaggcuugcaugccuc

SEQ ID NO: 1177287 - RNA, 22 nt, Human
aggcaggaggggaaggggaggg

SEQ ID NO: 1177288 - RNA, 27 nt, Human
aggcaggaggggaaggggagggggugu

SEQ ID NO: 1177289 - RNA, 21 nt, Human
cagcucccuguggagaccccu

SEQ ID NO: 1177290 - RNA, 18 nt, Human
cagcuuagcuuuucccuu

SEQ ID NO: 1177291 - RNA, 20 nt, Human
cauuuucccuaugcugcugg

SEQ ID NO: 1177292 - RNA, 22 nt, Human
cauuuucccuaugcugcuggcg

SEQ ID NO: 1177293 - RNA, 20 nt, Human
cccagcuuagcuuuucccuu

SEQ ID NO: 1177294 - RNA, 22 nt, Human
ccuaugcugcuggcgcauuggg

SEQ ID NO: 1177295 - RNA, 22 nt, Human
cuauuauauccagcauaggauc

SEQ ID NO: 1177296 - RNA, 19 nt, Human
gaaauccuuucaaacgcac

SEQ ID NO: 1177297 - RNA, 23 nt, Human
gaaauccuuucaaacgcacgccu

SEQ ID NO: 1177298 - RNA, 18 nt, Human
gagcagaaggaaaggcag

SEQ ID NO: 1177299 - RNA, 21 nt, Human
gcaaagcaggcaggaggggaa

SEQ ID NO: 1177300 - RNA, 23 nt, Human
ggauugcagaucuuuuggccgcu

SEQ ID NO: 1177301 - RNA, 22 nt, Human
ggcugagaaauccuuucaaacg

SEQ ID NO: 1177302 - RNA, 18 nt, Human
ggcuugcgucugcggcug

SEQ ID NO: 1177303 - RNA, 20 nt, Human
gggcaaagcaggcaggaggg

SEQ ID NO: 1177304 - RNA, 18 nt, Human
gucacauuuuccucagca

SEQ ID NO: 1177305 - RNA, 21 nt, Human
uccgcagcaauuugcucugga

SEQ ID NO: 1177306 - RNA, 23 nt, Human
uccgcagcaauuugcucuggagc

SEQ ID NO: 1177307 - RNA, 19 nt, Human
uccucagcauuuucccuau

SEQ ID NO: 1177308 - RNA, 20 nt, Human
ugaaaggggcaaagcaggca

SEQ ID NO: 1177309 - RNA, 22 nt, Human
ugacccggcaggaccucaguaa

SEQ ID NO: 1177310 - RNA, 23 nt, Human
ugcagaucuuuuggccgcugcau

SEQ ID NO: 1177311 - RNA, 21 nt, Human
ugccgucacauuuuccucagc

SEQ ID NO: 1177312 - RNA, 20 nt, Human
uggcagaaugaacugggucu

SEQ ID NO: 1177313 - RNA, 21 nt, Human
uggguagcucuacucaaccca

SEQ ID NO: 1177314 - RNA, 24 nt, Human
uguggcugcuuuaagagugggcac

SEQ ID NO: 1177315 - RNA, 21 nt, Human
uuccgcagcaauuugcucugg

SEQ ID NO: 1177316 - RNA, 25 nt, Human
uuucaaacgcacgccuucccuauua

SEQ ID NO: 1177317 - RNA, 24 nt, Human
aaagugcugggauuacaggcauga

SEQ ID NO: 1177318 - RNA, 24 nt, Human
aaagugcugggauuacaggcauga

SEQ ID NO: 1177319 - RNA, 22 nt, Human
aaccaggcaaucucuucaguuu

SEQ ID NO: 1177320 - RNA, 20 nt, Human
aaccugcccucuccuccucu

SEQ ID NO: 1177321 - RNA, 21 nt, Human
aaccugcccucuccuccucug

SEQ ID NO: 1177322 - RNA, 21 nt, Human
aagacaccaggaugaggagug

SEQ ID NO: 1177323 - RNA, 21 nt, Human
aagacaggaugaagccagaag

SEQ ID NO: 1177324 - RNA, 20 nt, Human
aagcagauaaccugguuuug

SEQ ID NO: 1177325 - RNA, 21 nt, Human
aagcagauaaccugguuuugg

SEQ ID NO: 1177326 - RNA, 18 nt, Human
aagccagaaggagagcug

SEQ ID NO: 1177327 - RNA, 22 nt, Human
aaggagagcuggagaaggaccu

SEQ ID NO: 1177328 - RNA, 19 nt, Human
aaguagcugggauuacagg

SEQ ID NO: 1177329 - RNA, 19 nt, Human
aagugcugggauuacaggc

SEQ ID NO: 1177330 - RNA, 19 nt, Human
aagugcugggauuacaggc

SEQ ID NO: 1177331 - RNA, 21 nt, Human
aagugcugggauuacaggcau

SEQ ID NO: 1177332 - RNA, 21 nt, Human
aagugcugggauuacaggcau

SEQ ID NO: 1177333 - RNA, 26 nt, Human
aagugcugggauuacaggcaugagcc

SEQ ID NO: 1177334 - RNA, 26 nt, Human
aagugcugggauuacaggcaugagcc

SEQ ID NO: 1177335 - RNA, 19 nt, Human
acagggucucauuauguug

SEQ ID NO: 1177336 - RNA, 18 nt, Human
acaggguuucaccauguu

SEQ ID NO: 1177337 - RNA, 23 nt, Human
acaggguuucaccauguuggcca

SEQ ID NO: 1177338 - RNA, 24 nt, Human
acaggguuucaccauguuggccag

SEQ ID NO: 1177339 - RNA, 23 nt, Human
accagcuccaggucacccaagga

SEQ ID NO: 1177340 - RNA, 18 nt, Human
accauguuggccaggcug

SEQ ID NO: 1177341 - RNA, 22 nt, Human
accauuuugugcaccgagccug

SEQ ID NO: 1177342 - RNA, 24 nt, Human
acucccaccugcaggagcuggaaa

SEQ ID NO: 1177343 - RNA, 26 nt, Human
agaaggcacaaaaugcuucauaagga

SEQ ID NO: 1177344 - RNA, 21 nt, Human
agacaggaugaagccagaagg

SEQ ID NO: 1177345 - RNA, 19 nt, Human
agagccguggaagacagga

SEQ ID NO: 1177346 - RNA, 22 nt, Human
agauucuccugccucggccucc

SEQ ID NO: 1177347 - RNA, 18 nt, Human
aggaaggauaaacuaugg

SEQ ID NO: 1177348 - RNA, 20 nt, Human
aggcaugagccaccauaccu

SEQ ID NO: 1177349 - RNA, 25 nt, Human
aggcuggagugcaguggcaugaucu

SEQ ID NO: 1177350 - RNA, 22 nt, Human
agggacagaagcagauaaccug

SEQ ID NO: 1177351 - RNA, 23 nt, Human
aggggcccuugggagugacaugc

SEQ ID NO: 1177352 - RNA, 22 nt, Human
aguagagacaggguuucaccau

SEQ ID NO: 1177353 - RNA, 23 nt, Human
aguagcugggauuacaggugugc

SEQ ID NO: 1177354 - RNA, 18 nt, Human
agugaugagccggggagg

SEQ ID NO: 1177355 - RNA, 20 nt, Human
agugcaguggcaugaucuug

SEQ ID NO: 1177356 - RNA, 23 nt, Human
agugcaguggcaugaucuuggcu

SEQ ID NO: 1177357 - RNA, 24 nt, Human
agugcaguggcaugaucuuggcuc

SEQ ID NO: 1177358 - RNA, 18 nt, Human
agugcugggauuacaggc

SEQ ID NO: 1177359 - RNA, 24 nt, Human
aguggcaugaucuuggcucacugc

SEQ ID NO: 1177360 - RNA, 28 nt, Human
auccucacauucuuuuuuuuuuuuuuuu

SEQ ID NO: 1177361 - RNA, 18 nt, Human
aucuggagaaaaauggag

SEQ ID NO: 1177362 - RNA, 19 nt, Human
augaagccagaaggagagc

SEQ ID NO: 1177363 - RNA, 24 nt, Human
auuuuuguauuuuuaguagagaca

SEQ ID NO: 1177364 - RNA, 23 nt, Human
caaagugcugggauuacaggcau

SEQ ID NO: 1177365 - RNA, 24 nt, Human
caaagugcugggauuacaggcaug

SEQ ID NO: 1177366 - RNA, 24 nt, Human
caaagugcugggauuacaggcaug

SEQ ID NO: 1177367 - RNA, 19 nt, Human
caagacagugaggacagaa

SEQ ID NO: 1177368 - RNA, 22 nt, Human
caagagauucuccugccucggc

SEQ ID NO: 1177369 - RNA, 20 nt, Human
caagccagggacagaagcag

SEQ ID NO: 1177370 - RNA, 24 nt, Human
caaggucuugccaucuugcccagg

SEQ ID NO: 1177371 - RNA, 24 nt, Human
caccacaccuggcuaauuuuugua

SEQ ID NO: 1177372 - RNA, 22 nt, Human
caccagcuccaggucacccaag

SEQ ID NO: 1177373 - RNA, 21 nt, Human
caccauguuggccaggcugau

SEQ ID NO: 1177374 - RNA, 22 nt, Human
caccauguuggccaggcugauc

SEQ ID NO: 1177375 - RNA, 27 nt, Human
caccauguuggccaggcugaucuggaa

SEQ ID NO: 1177376 - RNA, 24 nt, Human
caccucugccucccaaagugcugg

SEQ ID NO: 1177377 - RNA, 24 nt, Human
cagagucuugcucugccgcccagg

SEQ ID NO: 1177378 - RNA, 24 nt, Human
cagcagagaagcugaagacaccag

SEQ ID NO: 1177379 - RNA, 18 nt, Human
caggacucaagccaggga

SEQ ID NO: 1177380 - RNA, 19 nt, Human
caggagcuggaaagcaacu

SEQ ID NO: 1177381 - RNA, 24 nt, Human
cagggucucauuauguugcucagg

SEQ ID NO: 1177382 - RNA, 24 nt, Human
caggguuucaccauguuggccagg

SEQ ID NO: 1177383 - RNA, 24 nt, Human
caucuugcccaggcuggucucgaa

SEQ ID NO: 1177384 - RNA, 24 nt, Human
cauguuggccaggcugaucuggaa

SEQ ID NO: 1177385 - RNA, 20 nt, Human
cauucacaacaacugcacau

SEQ ID NO: 1177386 - RNA, 23 nt, Human
cauuugccucuucaagagauugu

SEQ ID NO: 1177387 - RNA, 23 nt, Human
ccaaagugcugggauuacaggca

SEQ ID NO: 1177388 - RNA, 24 nt, Human
ccaaagugcugggauuacaggcau

SEQ ID NO: 1177389 - RNA, 21 nt, Human
ccaaguagcugggauuacagg

SEQ ID NO: 1177390 - RNA, 24 nt, Human
ccaaguagcugggauuacaggugu

SEQ ID NO: 1177391 - RNA, 22 nt, Human
ccaucuugcccaggcuggucuc

SEQ ID NO: 1177392 - RNA, 23 nt, Human
ccaucuugcccaggcuggucucg

SEQ ID NO: 1177393 - RNA, 24 nt, Human
cccaaagugcugggauuacaggca

SEQ ID NO: 1177394 - RNA, 22 nt, Human
cccaaguagcugggauuacagg

SEQ ID NO: 1177395 - RNA, 23 nt, Human
cccaaguagcugggauuacaggu

SEQ ID NO: 1177396 - RNA, 24 nt, Human
cccaaguagcugggauuacaggug

SEQ ID NO: 1177397 - RNA, 24 nt, Human
cccaggacucaagccagggacaga

SEQ ID NO: 1177398 - RNA, 24 nt, Human
ccgcccaggcuggagugcaguggc

SEQ ID NO: 1177399 - RNA, 19 nt, Human
ccgcucuuucuucuuuccc

SEQ ID NO: 1177400 - RNA, 24 nt, Human
ccuccgagguucaagagauucucc

SEQ ID NO: 1177401 - RNA, 19 nt, Human
ccuccugucucagucucuc

SEQ ID NO: 1177402 - RNA, 19 nt, Human
ccugcccucuccuccucuc

SEQ ID NO: 1177403 - RNA, 23 nt, Human
ccugccucggccucccaaguagc

SEQ ID NO: 1177404 - RNA, 24 nt, Human
ccugccucggccucccaaguagcu

SEQ ID NO: 1177405 - RNA, 18 nt, Human
ccugggcacagcccaggg

SEQ ID NO: 1177406 - RNA, 20 nt, Human
ccugggcuaaagugauccuc

SEQ ID NO: 1177407 - RNA, 23 nt, Human
ccuugagugaucugcccaccucu

SEQ ID NO: 1177408 - RNA, 19 nt, Human
cgagguucaagagauucuc

SEQ ID NO: 1177409 - RNA, 24 nt, Human
cguccacucuccaugcuaagugac

SEQ ID NO: 1177410 - RNA, 23 nt, Human
cuaauuuuuguauuuuuaguaga

SEQ ID NO: 1177411 - RNA, 22 nt, Human
cucagucucucaaagugcuggg

SEQ ID NO: 1177412 - RNA, 22 nt, Human
cuccugaccuugagugaucugc

SEQ ID NO: 1177413 - RNA, 24 nt, Human
cucggccucccaaguagcugggau

SEQ ID NO: 1177414 - RNA, 19 nt, Human
cucuuucuucuuucccuug

SEQ ID NO: 1177415 - RNA, 24 nt, Human
cugcaaccuccgccuccgagguuc

SEQ ID NO: 1177416 - RNA, 18 nt, Human
cugcugcaggugagucga

SEQ ID NO: 1177417 - RNA, 22 nt, Human
cuggagguggaguugggaagca

SEQ ID NO: 1177418 - RNA, 24 nt, Human
cuggagugcaguggcaugaucuug

SEQ ID NO: 1177419 - RNA, 18 nt, Human
gaagcuuaaaggugaaaa

SEQ ID NO: 1177420 - RNA, 19 nt, Human
gaccugaggugggggugaa

SEQ ID NO: 1177421 - RNA, 24 nt, Human
gaccuugagugaucugcccaccuc

SEQ ID NO: 1177422 - RNA, 19 nt, Human
gagcaguuuugagucauuu

SEQ ID NO: 1177423 - RNA, 23 nt, Human
gagcaguuuugagucauuugccu

SEQ ID NO: 1177424 - RNA, 18 nt, Human
gagccaccaugcccaccu

SEQ ID NO: 1177425 - RNA, 19 nt, Human
gaggcugugcugagugccc

SEQ ID NO: 1177426 - RNA, 24 nt, Human
gagucauuuuguccuuucuuucuu

SEQ ID NO: 1177427 - RNA, 18 nt, Human
gauuacaggcaugagcca

SEQ ID NO: 1177428 - RNA, 18 nt, Human
gauuacaggcaugagcca

SEQ ID NO: 1177429 - RNA, 21 nt, Human
gauuacaggcaugagccacca

SEQ ID NO: 1177430 - RNA, 21 nt, Human
gauuacaggcaugagccacca

SEQ ID NO: 1177431 - RNA, 24 nt, Human
gauuacaggcaugagccaccauac

SEQ ID NO: 1177432 - RNA, 24 nt, Human
gauuacaggcaugagccaccaugc

SEQ ID NO: 1177433 - RNA, 22 nt, Human
gcacagcccaggggcccuuggg

SEQ ID NO: 1177434 - RNA, 19 nt, Human
gcacuugcuucugaaaaug

SEQ ID NO: 1177435 - RNA, 21 nt, Human
gcagagaagcugaagacacca

SEQ ID NO: 1177436 - RNA, 19 nt, Human
gcaggugagccgguccugc

SEQ ID NO: 1177437 - RNA, 24 nt, Human
gcagugaaggcuaaaacuugggca

SEQ ID NO: 1177438 - RNA, 21 nt, Human
gcaugagccaccaugcccacc

SEQ ID NO: 1177439 - RNA, 23 nt, Human
gcccaggcuggagugcaguggca

SEQ ID NO: 1177440 - RNA, 24 nt, Human
gcccaggcuggagugcaguggcau

SEQ ID NO: 1177441 - RNA, 21 nt, Human
gccucggccucccaaguagcu

SEQ ID NO: 1177442 - RNA, 19 nt, Human
gccuuacuccccuucccca

SEQ ID NO: 1177443 - RNA, 24 nt, Human
gcuccaggcagaucaagcauucga

SEQ ID NO: 1177444 - RNA, 25 nt, Human
gcucugccgcccaggcuggagugca

SEQ ID NO: 1177445 - RNA, 22 nt, Human
gcugaucuggaacuccugaccu

SEQ ID NO: 1177446 - RNA, 19 nt, Human
gcuggagugcaguggcaug

SEQ ID NO: 1177447 - RNA, 18 nt, Human
gcugggggacagauggac

SEQ ID NO: 1177448 - RNA, 19 nt, Human
ggaccugagguggggguga

SEQ ID NO: 1177449 - RNA, 22 nt, Human
ggaugaagccagaaggagagcu

SEQ ID NO: 1177450 - RNA, 19 nt, Human
ggauuacaggcaugagcca

SEQ ID NO: 1177451 - RNA, 24 nt, Human
ggauuacaggcaugagccaccaug

SEQ ID NO: 1177452 - RNA, 23 nt, Human
ggcagcagagaagcugaagacac

SEQ ID NO: 1177453 - RNA, 19 nt, Human
gggcaccggcagggagaau

SEQ ID NO: 1177454 - RNA, 19 nt, Human
gggcuaaagugauccuccu

SEQ ID NO: 1177455 - RNA, 22 nt, Human
ggguuucaccauguuggccagg

SEQ ID NO: 1177456 - RNA, 22 nt, Human
guaaaaguaacugaagcuuaaa

SEQ ID NO: 1177457 - RNA, 18 nt, Human
guagcugggauuacaggu

SEQ ID NO: 1177458 - RNA, 24 nt, Human
gucuugccaucuugcccaggcugg

SEQ ID NO: 1177459 - RNA, 24 nt, Human
gucuugcucugccgcccaggcugg

SEQ ID NO: 1177460 - RNA, 18 nt, Human
gugaagauggugggagug

SEQ ID NO: 1177461 - RNA, 24 nt, Human
gugaucugcccaccucugccuccc

SEQ ID NO: 1177462 - RNA, 22 nt, Human
uaaagugauccuccugucucag

SEQ ID NO: 1177463 - RNA, 21 nt, Human
uaagcccaggacucaagccag

SEQ ID NO: 1177464 - RNA, 24 nt, Human
uaagcccaggacucaagccaggga

SEQ ID NO: 1177465 - RNA, 24 nt, Human
uaauuuuuguauuuuuaguagaga

SEQ ID NO: 1177466 - RNA, 22 nt, Human
uacaggcaugagccaccauacc

SEQ ID NO: 1177467 - RNA, 24 nt, Human
uacaggcaugagccaccaugccca

SEQ ID NO: 1177468 - RNA, 22 nt, Human
uacaggugugcaccaccacacc

SEQ ID NO: 1177469 - RNA, 20 nt, Human
uaccugggcacagcccaggg

SEQ ID NO: 1177470 - RNA, 22 nt, Human
uaccugggcacagcccaggggc

SEQ ID NO: 1177471 - RNA, 22 nt, Human
uagagacagggucucauuaugu

SEQ ID NO: 1177472 - RNA, 22 nt, Human
uagagacaggguuucaccaugu

SEQ ID NO: 1177473 - RNA, 24 nt, Human
uaguagagacaggguuucaccaug

SEQ ID NO: 1177474 - RNA, 26 nt, Human
uaguagagacaggguuucaccauguu

SEQ ID NO: 1177475 - RNA, 24 nt, Human
uauguugcucaggcucagacucuu

SEQ ID NO: 1177476 - RNA, 26 nt, Human
uauguugcucaggcucagacucuuuu

SEQ ID NO: 1177477 - RNA, 23 nt, Human
ucaaagugcugggauuacaggca

SEQ ID NO: 1177478 - RNA, 24 nt, Human
ucaaagugcugggauuacaggcau

SEQ ID NO: 1177479 - RNA, 18 nt, Human
ucaagacagugaggacag

SEQ ID NO: 1177480 - RNA, 23 nt, Human
ucacccaugcacucauuggacaa

SEQ ID NO: 1177481 - RNA, 20 nt, Human
ucacugcaaccuccgccucc

SEQ ID NO: 1177482 - RNA, 21 nt, Human
ucacugcaaccuccgccuccg

SEQ ID NO: 1177483 - RNA, 24 nt, Human
ucacugcaaccuccgccuccgagg

SEQ ID NO: 1177484 - RNA, 25 nt, Human
ucacugcaaccuccgccuccgaggu

SEQ ID NO: 1177485 - RNA, 26 nt, Human
ucacugcaaccuccgccuccgagguu

SEQ ID NO: 1177486 - RNA, 23 nt, Human
ucagaaauuaucugcuguuuugg

SEQ ID NO: 1177487 - RNA, 21 nt, Human
ucagaggucuuucauuuuucc

SEQ ID NO: 1177488 - RNA, 22 nt, Human
ucagaggucuuucauuuuuccu

SEQ ID NO: 1177489 - RNA, 18 nt, Human
ucauucauuaauucaccc

SEQ ID NO: 1177490 - RNA, 22 nt, Human
uccaugcuaagugacagugacu

SEQ ID NO: 1177491 - RNA, 24 nt, Human
ucccaaagugcugggauuacaggc

SEQ ID NO: 1177492 - RNA, 23 nt, Human
ucccaaguagcugggauuacagg

SEQ ID NO: 1177493 - RNA, 21 nt, Human
uccgagguucaagagauucuc

SEQ ID NO: 1177494 - RNA, 24 nt, Human
uccgagguucaagagauucuccug

SEQ ID NO: 1177495 - RNA, 24 nt, Human
uccuugauucuggagguggaguug

SEQ ID NO: 1177496 - RNA, 24 nt, Human
ucucaaagugcugggauuacaggc

SEQ ID NO: 1177497 - RNA, 27 nt, Human
ucucccgcucuuucuucuugggccgcc

SEQ ID NO: 1177498 - RNA, 22 nt, Human
ucucgaauuccugggcuaaagu

SEQ ID NO: 1177499 - RNA, 24 nt, Human
ucucgaauuccugggcuaaaguga

SEQ ID NO: 1177500 - RNA, 23 nt, Human
ucugcuguuuuggaagacuacaa

SEQ ID NO: 1177501 - RNA, 23 nt, Human
ucuugccaucuugcccaggcugg

SEQ ID NO: 1177502 - RNA, 22 nt, Human
ucuugcucugccgcccaggcug

SEQ ID NO: 1177503 - RNA, 24 nt, Human
ucuugcucugccgcccaggcugga

SEQ ID NO: 1177504 - RNA, 19 nt, Human
ugaaaugacaguuaagccc

SEQ ID NO: 1177505 - RNA, 19 nt, Human
ugaagacaccaggaugagg

SEQ ID NO: 1177506 - RNA, 21 nt, Human
ugaagccagaaggagagcugg

SEQ ID NO: 1177507 - RNA, 18 nt, Human
ugacagcgccuacccugg

SEQ ID NO: 1177508 - RNA, 20 nt, Human
ugacaguuaagcccaggacu

SEQ ID NO: 1177509 - RNA, 20 nt, Human
ugaggaaggauaaacuaugg

SEQ ID NO: 1177510 - RNA, 23 nt, Human
ugaggugggggugaagauggugg

SEQ ID NO: 1177511 - RNA, 21 nt, Human
ugagugcccggugcaggugag

SEQ ID NO: 1177512 - RNA, 24 nt, Human
ugaucugcccaccucugccuccca

SEQ ID NO: 1177513 - RNA, 22 nt, Human
ugauucuggagguggaguuggg

SEQ ID NO: 1177514 - RNA, 24 nt, Human
ugauucuggagguggaguugggaa

SEQ ID NO: 1177515 - RNA, 22 nt, Human
ugcaguggcaugaucuuggcuc

SEQ ID NO: 1177516 - RNA, 24 nt, Human
ugccaucuugcccaggcuggucuc

SEQ ID NO: 1177517 - RNA, 24 nt, Human
ugcccaggcuggucucgaauuccu

SEQ ID NO: 1177518 - RNA, 18 nt, Human
ugccccaggggugugagg

SEQ ID NO: 1177519 - RNA, 21 nt, Human
ugccgcccaggcuggagugca

SEQ ID NO: 1177520 - RNA, 20 nt, Human
ugccuagaagaaagguuaaa

SEQ ID NO: 1177521 - RNA, 21 nt, Human
ugccucggccucccaaguagc

SEQ ID NO: 1177522 - RNA, 24 nt, Human
ugccucggccucccaaguagcugg

SEQ ID NO: 1177523 - RNA, 24 nt, Human
ugcucugccgcccaggcuggagug

SEQ ID NO: 1177524 - RNA, 22 nt, Human
uggaagacuacaagaugaacca

SEQ ID NO: 1177525 - RNA, 19 nt, Human
uggagugcaguggcaugau

SEQ ID NO: 1177526 - RNA, 24 nt, Human
uggagugcaguggcaugaucuugg

SEQ ID NO: 1177527 - RNA, 23 nt, Human
uggcagcugcccauggggaguga

SEQ ID NO: 1177528 - RNA, 19 nt, Human
uggcaugaucuuggcucac

SEQ ID NO: 1177529 - RNA, 21 nt, Human
uggcaugaucuuggcucacug

SEQ ID NO: 1177530 - RNA, 24 nt, Human
uggccaggcugaucuggaacuccu

SEQ ID NO: 1177531 - RNA, 23 nt, Human
uggcguguucuaggggaaggcag

SEQ ID NO: 1177532 - RNA, 18 nt, Human
ugggauuacaggcaugag

SEQ ID NO: 1177533 - RNA, 18 nt, Human
ugggauuacaggcaugag

SEQ ID NO: 1177534 - RNA, 22 nt, Human
ugggauuacaggcaugagccac

SEQ ID NO: 1177535 - RNA, 22 nt, Human
ugggauuacaggcaugagccac

SEQ ID NO: 1177536 - RNA, 23 nt, Human
ugggauuacaggcaugagccacc

SEQ ID NO: 1177537 - RNA, 23 nt, Human
ugggauuacaggcaugagccacc

SEQ ID NO: 1177538 - RNA, 24 nt, Human
ugggauuacaggcaugagccacca

SEQ ID NO: 1177539 - RNA, 24 nt, Human
ugggauuacaggcaugagccacca

SEQ ID NO: 1177540 - RNA, 25 nt, Human
ugggauuacaggcaugagccaccau

SEQ ID NO: 1177541 - RNA, 25 nt, Human
ugggauuacaggcaugagccaccau

SEQ ID NO: 1177542 - RNA, 21 nt, Human
ugggauuacaggugugcacca

SEQ ID NO: 1177543 - RNA, 22 nt, Human
ugggauuacaggugugcaccac

SEQ ID NO: 1177544 - RNA, 24 nt, Human
ugggauuacaggugugcaccacca

SEQ ID NO: 1177545 - RNA, 24 nt, Human
ugggcuaaagugauccuccugucu

SEQ ID NO: 1177546 - RNA, 18 nt, Human
uggggagugaugagccga

SEQ ID NO: 1177547 - RNA, 19 nt, Human
ugugccgagugccugcugc

SEQ ID NO: 1177548 - RNA, 21 nt, Human
uuagccuuacuccccuucccc

SEQ ID NO: 1177549 - RNA, 24 nt, Human
uuaguagagacaggguuucaccau

SEQ ID NO: 1177550 - RNA, 24 nt, Human
uugcucugccgcccaggcuggagu

SEQ ID NO: 1177551 - RNA, 21 nt, Human
uugucagggaacuuuacuuag

SEQ ID NO: 1177552 - RNA, 21 nt, Human
uuucaccauguuggccaggcu

SEQ ID NO: 1177553 - RNA, 24 nt, Human
uuuuuaguagagacaggguuucac

SEQ ID NO: 1177554 - RNA, 22 nt, Human
uuuuuccuuuuuguauuuugac

SEQ ID NO: 1177555 - RNA, 20 nt, Human
uuuuuguauuuuuaguagag

SEQ ID NO: 1177556 - RNA, 24 nt, Human
uuuuuuuuuucugauacagagucu

SEQ ID NO: 1177557 - RNA, 18 nt, Human
uuuuuuuuuuuuuuucug

SEQ ID NO: 1177558 - RNA, 21 nt, Human
aaacgucugcuccucugccgg

SEQ ID NO: 1177559 - RNA, 19 nt, Human
aaaugaaggcagaagaccc

SEQ ID NO: 1177560 - RNA, 23 nt, Human
aggaggggacgcgcagagcugcc

SEQ ID NO: 1177561 - RNA, 22 nt, Human
caaaaugaaggcagaagacccg

SEQ ID NO: 1177562 - RNA, 20 nt, Human
caagguuccucucucuccgc

SEQ ID NO: 1177563 - RNA, 24 nt, Human
ccccagggacacgagccggaccaa

SEQ ID NO: 1177564 - RNA, 22 nt, Human
ccucggaccggcaagguuccuc

SEQ ID NO: 1177565 - RNA, 26 nt, Human
cgcgcugggccgaggaugccgugcac

SEQ ID NO: 1177566 - RNA, 22 nt, Human
cgcgugugcuugcgugugugcg

SEQ ID NO: 1177567 - RNA, 18 nt, Human
cgcucccguccggugucc

SEQ ID NO: 1177568 - RNA, 22 nt, Human
cgcugggccgaggaugcuaagc

SEQ ID NO: 1177569 - RNA, 22 nt, Human
gaaaaucccuuagccgcaagcc

SEQ ID NO: 1177570 - RNA, 19 nt, Human
gcggugcgggccgcgcugg

SEQ ID NO: 1177571 - RNA, 21 nt, Human
ggcggugcgggccgcgcuggg

SEQ ID NO: 1177572 - RNA, 23 nt, Human
gugugcgcgcgcgugucuguagu

SEQ ID NO: 1177573 - RNA, 27 nt, Human
gugugcuugcgugugugcgcgcgcgug

SEQ ID NO: 1177574 - RNA, 21 nt, Human
gugugugcgcgcgcgugucug

SEQ ID NO: 1177575 - RNA, 20 nt, Human
uccaaaaugaaggcagaaga

SEQ ID NO: 1177576 - RNA, 22 nt, Human
uccaaaaugaaggcagaagacc

SEQ ID NO: 1177577 - RNA, 20 nt, Human
uccccagggacacgagccgg

SEQ ID NO: 1177578 - RNA, 23 nt, Human
uccccagggacacgagccggacc

SEQ ID NO: 1177579 - RNA, 21 nt, Human
ugccgcuacggcuccagacac

SEQ ID NO: 1177580 - RNA, 18 nt, Human
ugugcgcgcgcgugucug

SEQ ID NO: 1177581 - RNA, 18 nt, Human
ucccugaagggcaggugc

SEQ ID NO: 1177582 - RNA, 21 nt, Human
aaaaaucaaaaccagaagacc

SEQ ID NO: 1177583 - RNA, 25 nt, Human
aaaagaucaaagauacuaacaaagg

SEQ ID NO: 1177584 - RNA, 21 nt, Human
aaaaucccaaauaaauggccc

SEQ ID NO: 1177585 - RNA, 18 nt, Human
aaacaaaaaccaaacaac

SEQ ID NO: 1177586 - RNA, 25 nt, Human
aaacaaaaaccaaacaacuccaaaa

SEQ ID NO: 1177587 - RNA, 21 nt, Human
aaacagaagugggauggggcu

SEQ ID NO: 1177588 - RNA, 21 nt, Human
aaacuuggauacucccucuaa

SEQ ID NO: 1177589 - RNA, 21 nt, Human
aaagaaauugcuggaagaaga

SEQ ID NO: 1177590 - RNA, 23 nt, Human
aaaguguuccuuaguccuguuug

SEQ ID NO: 1177591 - RNA, 25 nt, Human
aaauaaagaaauugcuggaagaaga

SEQ ID NO: 1177592 - RNA, 18 nt, Human
aacacuguugucuaaaga

SEQ ID NO: 1177593 - RNA, 18 nt, Human
aaccacccuuccauccug

SEQ ID NO: 1177594 - RNA, 18 nt, Human
aacgucggggagggagag

SEQ ID NO: 1177595 - RNA, 21 nt, Human
aagaagacagauggaaauuga

SEQ ID NO: 1177596 - RNA, 23 nt, Human
aagaggggaagaggcccuugaug

SEQ ID NO: 1177597 - RNA, 24 nt, Human
aaggagcaggggaaguucccggag

SEQ ID NO: 1177598 - RNA, 18 nt, Human
aaguuacaacugggcucc

SEQ ID NO: 1177599 - RNA, 22 nt, Human
aauugagcuuuucuuuuuaggu

SEQ ID NO: 1177600 - RNA, 22 nt, Human
acaaacaaaaaccaaacaacuc

SEQ ID NO: 1177601 - RNA, 23 nt, Human
acagagccuccuuaaaguuugag

SEQ ID NO: 1177602 - RNA, 24 nt, Human
acccuuccauccuguuucuccccu

SEQ ID NO: 1177603 - RNA, 21 nt, Human
acuccugcuucuuccugggaa

SEQ ID NO: 1177604 - RNA, 19 nt, Human
acuggaacagagauaaccu

SEQ ID NO: 1177605 - RNA, 21 nt, Human
acugggcucacuguuccugga

SEQ ID NO: 1177606 - RNA, 18 nt, Human
agaagccagacaugcaac

SEQ ID NO: 1177607 - RNA, 18 nt, Human
agacacgguggaaugagg

SEQ ID NO: 1177608 - RNA, 23 nt, Human
agagaugggcuggccccuacaug

SEQ ID NO: 1177609 - RNA, 21 nt, Human
agagcuggcaggaagagggga

SEQ ID NO: 1177610 - RNA, 18 nt, Human
agaggaaaggaggacaga

SEQ ID NO: 1177611 - RNA, 29 nt, Human
agcaaaaauuuguaguaaaaaaaaaaaaa

SEQ ID NO: 1177612 - RNA, 18 nt, Human
agcuccuggaggugacuc

SEQ ID NO: 1177613 - RNA, 20 nt, Human
agcuggcaggaagaggggaa

SEQ ID NO: 1177614 - RNA, 20 nt, Human
agcuuuucauuuuaagaaca

SEQ ID NO: 1177615 - RNA, 18 nt, Human
aggaagaggcugaggguu

SEQ ID NO: 1177616 - RNA, 23 nt, Human
aggaagaggcugaggguucaagg

SEQ ID NO: 1177617 - RNA, 19 nt, Human
aggaagaggggaagaggcc

SEQ ID NO: 1177618 - RNA, 24 nt, Human
aggagcacaggcagaagccagaca

SEQ ID NO: 1177619 - RNA, 19 nt, Human
aggaggagcacaggcagaa

SEQ ID NO: 1177620 - RNA, 19 nt, Human
aggagggacagggaggaug

SEQ ID NO: 1177621 - RNA, 22 nt, Human
aggcaagaaaauauuuuccuga

SEQ ID NO: 1177622 - RNA, 22 nt, Human
aggcagaagccagacaugcaac

SEQ ID NO: 1177623 - RNA, 28 nt, Human
aggcagaagccagacaugcaacgggaga

SEQ ID NO: 1177624 - RNA, 19 nt, Human
aggcagcuuuggguggggu

SEQ ID NO: 1177625 - RNA, 22 nt, Human
aggcagcuuugggugggguagg

SEQ ID NO: 1177626 - RNA, 19 nt, Human
agggagcuccuacagccag

SEQ ID NO: 1177627 - RNA, 23 nt, Human
agggagcuccuacagccaggaag

SEQ ID NO: 1177628 - RNA, 19 nt, Human
aggggcuggcuuugggugc

SEQ ID NO: 1177629 - RNA, 21 nt, Human
agggguaggcuuuaggggcug

SEQ ID NO: 1177630 - RNA, 22 nt, Human
aguaccaggggcagcccagaga

SEQ ID NO: 1177631 - RNA, 23 nt, Human
auaaagugaggcucccgcaaccc

SEQ ID NO: 1177632 - RNA, 21 nt, Human
auaaaucgcccugggacagag

SEQ ID NO: 1177633 - RNA, 23 nt, Human
auccaauccuuccuucccaccuc

SEQ ID NO: 1177634 - RNA, 19 nt, Human
auccuguuucuccccuucu

SEQ ID NO: 1177635 - RNA, 19 nt, Human
auccuguuucuccccuucu

SEQ ID NO: 1177636 - RNA, 18 nt, Human
aucgcccugggacagagg

SEQ ID NO: 1177637 - RNA, 22 nt, Human
auggcggggggggauuuggggc

SEQ ID NO: 1177638 - RNA, 21 nt, Human
caaaaccccugcaucaucccc

SEQ ID NO: 1177639 - RNA, 25 nt, Human
caaacaaaaaccaaacaaccccggg

SEQ ID NO: 1177640 - RNA, 24 nt, Human
caaacaacuccaaaaucccaaaua

SEQ ID NO: 1177641 - RNA, 25 nt, Human
caaagcagccaacacacgacuaagc

SEQ ID NO: 1177642 - RNA, 24 nt, Human
caaauaaauggcccacaguuuugu

SEQ ID NO: 1177643 - RNA, 18 nt, Human
caaggacaccaggccaag

SEQ ID NO: 1177644 - RNA, 18 nt, Human
caauccuuccuucccacc

SEQ ID NO: 1177645 - RNA, 23 nt, Human
caccucacuaccucugccaauac

SEQ ID NO: 1177646 - RNA, 24 nt, Human
cagaagccagacaugcaacgggag

SEQ ID NO: 1177647 - RNA, 22 nt, Human
cagccuaccugaaucaccucag

SEQ ID NO: 1177648 - RNA, 26 nt, Human
cagcuuugggugggguaggauggggc

SEQ ID NO: 1177649 - RNA, 21 nt, Human
caggcagaagccagacaugca

SEQ ID NO: 1177650 - RNA, 24 nt, Human
caggcagaagccagacaugcaacg

SEQ ID NO: 1177651 - RNA, 20 nt, Human
cagggaggaugcucguggca

SEQ ID NO: 1177652 - RNA, 24 nt, Human
cagggcacggagcugccuggggua

SEQ ID NO: 1177653 - RNA, 21 nt, Human
caguaccaggggcagcccaga

SEQ ID NO: 1177654 - RNA, 18 nt, Human
caugcaacgggagacacg

SEQ ID NO: 1177655 - RNA, 20 nt, Human
cauggaaagaccccuugaag

SEQ ID NO: 1177656 - RNA, 22 nt, Human
cauuggaauguaccuuggccug

SEQ ID NO: 1177657 - RNA, 23 nt, Human
ccaaaaccccugcaucaucccca

SEQ ID NO: 1177658 - RNA, 20 nt, Human
ccaaauaaauggcccacagu

SEQ ID NO: 1177659 - RNA, 25 nt, Human
ccaacacacgacuaagcaaagaccg

SEQ ID NO: 1177660 - RNA, 25 nt, Human
ccaggccaagguagggaguggugag

SEQ ID NO: 1177661 - RNA, 22 nt, Human
cccacacgucggcucgcugagc

SEQ ID NO: 1177662 - RNA, 21 nt, Human
cccgcaacccaggauuuucag

SEQ ID NO: 1177663 - RNA, 23 nt, Human
cccgcaacccaggauuuucagcc

SEQ ID NO: 1177664 - RNA, 22 nt, Human
ccgcaacccaggauuuucagcc

SEQ ID NO: 1177665 - RNA, 23 nt, Human
ccggagaggggcuucucugggcc

SEQ ID NO: 1177666 - RNA, 19 nt, Human
ccucccagucaccuguccu

SEQ ID NO: 1177667 - RNA, 27 nt, Human
ccucuggcugggccaaaaccggggucc

SEQ ID NO: 1177668 - RNA, 18 nt, Human
ccugaggaaguaacuggc

SEQ ID NO: 1177669 - RNA, 21 nt, Human
ccugcagagcaccuuccuacc

SEQ ID NO: 1177670 - RNA, 18 nt, Human
ccugcccuaccuccuuca

SEQ ID NO: 1177671 - RNA, 25 nt, Human
ccugccgguuccuuaaaccacccuu

SEQ ID NO: 1177672 - RNA, 23 nt, Human
ccuggauugcggcugacuucugu

SEQ ID NO: 1177673 - RNA, 24 nt, Human
cgcccugggacagaggcuaugugu

SEQ ID NO: 1177674 - RNA, 23 nt, Human
cuaccucugccaauacaaacaga

SEQ ID NO: 1177675 - RNA, 19 nt, Human
cucuaugugacucaaagac

SEQ ID NO: 1177676 - RNA, 21 nt, Human
cucuggcugggccaaaacccc

SEQ ID NO: 1177677 - RNA, 23 nt, Human
cucuggguccucuggcugggcca

SEQ ID NO: 1177678 - RNA, 21 nt, Human
cugaaacuuuuacugcagugg

SEQ ID NO: 1177679 - RNA, 21 nt, Human
cugaaucaccucacuaccucu

SEQ ID NO: 1177680 - RNA, 24 nt, Human
cugaaucaccucacuaccucugcc

SEQ ID NO: 1177681 - RNA, 21 nt, Human
cuggaacagagauaaccugcc

SEQ ID NO: 1177682 - RNA, 21 nt, Human
cuggccccuacaugcuaaagu

SEQ ID NO: 1177683 - RNA, 24 nt, Human
cuggcuggggcugcucacugggcu

SEQ ID NO: 1177684 - RNA, 18 nt, Human
cugggccugaggggacca

SEQ ID NO: 1177685 - RNA, 20 nt, Human
cugucugucuuucccucacu

SEQ ID NO: 1177686 - RNA, 20 nt, Human
cuucguccugugccuggauu

SEQ ID NO: 1177687 - RNA, 22 nt, Human
cuuuucauuuuaagaacagaag

SEQ ID NO: 1177688 - RNA, 19 nt, Human
gaaugaggagggacaggga

SEQ ID NO: 1177689 - RNA, 22 nt, Human
gagcugccugggguaggucuuc

SEQ ID NO: 1177690 - RNA, 20 nt, Human
gaggaugcucguggcaggag

SEQ ID NO: 1177691 - RNA, 19 nt, Human
gagguaagcuagcuuuuca

SEQ ID NO: 1177692 - RNA, 22 nt, Human
gauggggacccauagggccuug

SEQ ID NO: 1177693 - RNA, 25 nt, Human
gcaaagaccguaugucucaaggaca

SEQ ID NO: 1177694 - RNA, 25 nt, Human
gcaguaccaggggcagcccagagag

SEQ ID NO: 1177695 - RNA, 20 nt, Human
gccagacaugcaacgggaga

SEQ ID NO: 1177696 - RNA, 18 nt, Human
gccaggaaggcagcuuug

SEQ ID NO: 1177697 - RNA, 18 nt, Human
gcucaaagcagccaacac

SEQ ID NO: 1177698 - RNA, 20 nt, Human
gcugucugugaggugggagg

SEQ ID NO: 1177699 - RNA, 25 nt, Human
ggaaauugagcuuuucuuuuuaggu

SEQ ID NO: 1177700 - RNA, 22 nt, Human
ggaagaggcugaggguucaagg

SEQ ID NO: 1177701 - RNA, 22 nt, Human
ggagcccuuccaaaaugugcuu

SEQ ID NO: 1177702 - RNA, 22 nt, Human
ggauggggcuggaaggggguga

SEQ ID NO: 1177703 - RNA, 19 nt, Human
ggcagaagccagacaugca

SEQ ID NO: 1177704 - RNA, 18 nt, Human
ggccuugaagagcuggcu

SEQ ID NO: 1177705 - RNA, 25 nt, Human
gggagaagccagggcacggagcugc

SEQ ID NO: 1177706 - RNA, 21 nt, Human
gggauuuggggcauggggaga

SEQ ID NO: 1177707 - RNA, 18 nt, Human
gggcagucacagagggcu

SEQ ID NO: 1177708 - RNA, 23 nt, Human
ggggaggagggcaguggcaucca

SEQ ID NO: 1177709 - RNA, 19 nt, Human
ggggagggagaggaaagga

SEQ ID NO: 1177710 - RNA, 21 nt, Human
gggugggguaggauggggcug

SEQ ID NO: 1177711 - RNA, 24 nt, Human
gguaaggauucuucuugcagugga

SEQ ID NO: 1177712 - RNA, 18 nt, Human
ggugggguaggauggggc

SEQ ID NO: 1177713 - RNA, 18 nt, Human
ggugggguaggauggggc

SEQ ID NO: 1177714 - RNA, 23 nt, Human
guacccuggaguugcugguugcu

SEQ ID NO: 1177715 - RNA, 21 nt, Human
gugggauggggcuggaagggg

SEQ ID NO: 1177716 - RNA, 22 nt, Human
uaaagugaggcucccgcaaccc

SEQ ID NO: 1177717 - RNA, 28 nt, Human
uaacuguauccucuguuuugggcccucc

SEQ ID NO: 1177718 - RNA, 23 nt, Human
uaagauauacaaacaaaaaccaa

SEQ ID NO: 1177719 - RNA, 19 nt, Human
uacauuugaggcucauuuu

SEQ ID NO: 1177720 - RNA, 18 nt, Human
uaccagggaccugguugc

SEQ ID NO: 1177721 - RNA, 21 nt, Human
uacccuggaguugcugguugc

SEQ ID NO: 1177722 - RNA, 18 nt, Human
uaggauggggcuggggca

SEQ ID NO: 1177723 - RNA, 22 nt, Human
uauaacaaagguacagaagcuu

SEQ ID NO: 1177724 - RNA, 21 nt, Human
uaugugacucaaagaccccug

SEQ ID NO: 1177725 - RNA, 22 nt, Human
uauuuacauacacagguauaca

SEQ ID NO: 1177726 - RNA, 19 nt, Human
ucaaaaccagaagacccuc

SEQ ID NO: 1177727 - RNA, 24 nt, Human
ucaaggacaccaggccaagguagg

SEQ ID NO: 1177728 - RNA, 19 nt, Human
ucagagacuuuuccugugg

SEQ ID NO: 1177729 - RNA, 23 nt, Human
ucauccccacacgucggcucgcu

SEQ ID NO: 1177730 - RNA, 25 nt, Human
ucauggaaagaccccuugaaggccu

SEQ ID NO: 1177731 - RNA, 24 nt, Human
uccaaaaucccaaauaaauggccc

SEQ ID NO: 1177732 - RNA, 19 nt, Human
uccucacaagcagccaagc

SEQ ID NO: 1177733 - RNA, 21 nt, Human
uccugugccuggauugcggcu

SEQ ID NO: 1177734 - RNA, 21 nt, Human
uccuucccaccucagggccug

SEQ ID NO: 1177735 - RNA, 19 nt, Human
ucguccugugccuggauug

SEQ ID NO: 1177736 - RNA, 20 nt, Human
ucucaaggacaccaggccaa

SEQ ID NO: 1177737 - RNA, 21 nt, Human
ucugaaacuuuuacugcagug

SEQ ID NO: 1177738 - RNA, 24 nt, Human
ugaagcucaacucuggguccucug

SEQ ID NO: 1177739 - RNA, 19 nt, Human
ugaaggccuugaagagcug

SEQ ID NO: 1177740 - RNA, 20 nt, Human
ugaaguggucucgguuucuu

SEQ ID NO: 1177741 - RNA, 23 nt, Human
ugacuggaacagagauaaccugc

SEQ ID NO: 1177742 - RNA, 18 nt, Human
ugagaggaguggucauuu

SEQ ID NO: 1177743 - RNA, 20 nt, Human
ugagaggucugagcagcucc

SEQ ID NO: 1177744 - RNA, 25 nt, Human
ugagcagcuccuguacucaagugga

SEQ ID NO: 1177745 - RNA, 22 nt, Human
ugaggaaagcugauaagagaug

SEQ ID NO: 1177746 - RNA, 22 nt, Human
ugaggaaagcugauaagagaug

SEQ ID NO: 1177747 - RNA, 18 nt, Human
ugcaguggauuacuuucc

SEQ ID NO: 1177748 - RNA, 18 nt, Human
ugcccuaccuccuucaac

SEQ ID NO: 1177749 - RNA, 20 nt, Human
ugccucaaacuuugggauuu

SEQ ID NO: 1177750 - RNA, 18 nt, Human
ugccugggguaggucuuc

SEQ ID NO: 1177751 - RNA, 21 nt, Human
ugcuaugguaacucagcagga

SEQ ID NO: 1177752 - RNA, 20 nt, Human
uggaagggggugacuggaac

SEQ ID NO: 1177753 - RNA, 22 nt, Human
uggaagggggugacuggaacag

SEQ ID NO: 1177754 - RNA, 22 nt, Human
uggaaugaggagggacagggag

SEQ ID NO: 1177755 - RNA, 25 nt, Human
uggcggagggaaagcuugggucuuc

SEQ ID NO: 1177756 - RNA, 19 nt, Human
uggcuggggcugcucacug

SEQ ID NO: 1177757 - RNA, 20 nt, Human
uggcuggggcugcucacugg

SEQ ID NO: 1177758 - RNA, 21 nt, Human
ugggauggggcuggaaggggg

SEQ ID NO: 1177759 - RNA, 22 nt, Human
ugggauggggcuggaagggggu

SEQ ID NO: 1177760 - RNA, 20 nt, Human
uggggacccauagggccuug

SEQ ID NO: 1177761 - RNA, 18 nt, Human
uggggaggagggcagugg

SEQ ID NO: 1177762 - RNA, 23 nt, Human
uggggaggagggcaguggcaucc

SEQ ID NO: 1177763 - RNA, 19 nt, Human
uggggcagucacagagggc

SEQ ID NO: 1177764 - RNA, 20 nt, Human
ugggguaggauggggcuggg

SEQ ID NO: 1177765 - RNA, 18 nt, Human
uggguaacuccugcuucu

SEQ ID NO: 1177766 - RNA, 25 nt, Human
ugggugcagggaucaugcugccauu

SEQ ID NO: 1177767 - RNA, 22 nt, Human
uguaguaaaaaaaaaaaaacuc

SEQ ID NO: 1177768 - RNA, 19 nt, Human
ugugguacccuggaguugc

SEQ ID NO: 1177769 - RNA, 21 nt, Human
uguuuuguuuuguuuuuuuua

SEQ ID NO: 1177770 - RNA, 21 nt, Human
uucacuuguagcuccucacaa

SEQ ID NO: 1177771 - RNA, 19 nt, Human
uucuugcaguggaggucau

SEQ ID NO: 1177772 - RNA, 22 nt, Human
uugaagagcuggcuggggcugc

SEQ ID NO: 1177773 - RNA, 19 nt, Human
uugcuuuguucuaacaaag

SEQ ID NO: 1177774 - RNA, 20 nt, Human
uugggugggguaggaugggg

SEQ ID NO: 1177775 - RNA, 21 nt, Human
uugucuaaagauaugcuuugc

SEQ ID NO: 1177776 - RNA, 22 nt, Human
uuuacuaggauacucuucuuua

SEQ ID NO: 1177777 - RNA, 24 nt, Human
aaauggaagagaaugagaagugag

SEQ ID NO: 1177778 - RNA, 22 nt, Human
aacaaaucugaccaucuugucu

SEQ ID NO: 1177779 - RNA, 20 nt, Human
aacaagaaacaaaaccagaa

SEQ ID NO: 1177780 - RNA, 22 nt, Human
aagaaacaaaaccagaagagaa

SEQ ID NO: 1177781 - RNA, 18 nt, Human
aagagaaugagaagugag

SEQ ID NO: 1177782 - RNA, 23 nt, Human
aagccgggccccguggaucagaa

SEQ ID NO: 1177783 - RNA, 19 nt, Human
aagggaaugacuaaaaagg

SEQ ID NO: 1177784 - RNA, 19 nt, Human
aaucugcuuccaauuccag

SEQ ID NO: 1177785 - RNA, 20 nt, Human
aaugacaaugccucuuccua

SEQ ID NO: 1177786 - RNA, 20 nt, Human
acaucuggaagaagguuuug

SEQ ID NO: 1177787 - RNA, 21 nt, Human
accagacucaagcucccacca

SEQ ID NO: 1177788 - RNA, 23 nt, Human
accagacucaagcucccaccagc

SEQ ID NO: 1177789 - RNA, 22 nt, Human
acucauggcuguuuucuguucc

SEQ ID NO: 1177790 - RNA, 25 nt, Human
acuccugcagagccggggugggggu

SEQ ID NO: 1177791 - RNA, 19 nt, Human
acuggauguguccucaugc

SEQ ID NO: 1177792 - RNA, 21 nt, Human
acuuuugacccaggggagcca

SEQ ID NO: 1177793 - RNA, 21 nt, Human
agaaacaaaaccagaagagaa

SEQ ID NO: 1177794 - RNA, 24 nt, Human
agaacaagaaacaaaaccagaaga

SEQ ID NO: 1177795 - RNA, 26 nt, Human
agaacaagaaacaaaaccagaagaga

SEQ ID NO: 1177796 - RNA, 20 nt, Human
agagaaaaucuagcccaagg

SEQ ID NO: 1177797 - RNA, 23 nt, Human
agagaacacacagaaagauccuc

SEQ ID NO: 1177798 - RNA, 20 nt, Human
agagaagccagcucuccaca

SEQ ID NO: 1177799 - RNA, 19 nt, Human
agcaggugaaguccccagg

SEQ ID NO: 1177800 - RNA, 26 nt, Human
agccacaggcaccaggagcgaggccc

SEQ ID NO: 1177801 - RNA, 22 nt, Human
aggaaggaggaaugugggcugg

SEQ ID NO: 1177802 - RNA, 24 nt, Human
aggcagaacaagaaacaaaaccag

SEQ ID NO: 1177803 - RNA, 25 nt, Human
aggcagaacaagaaacaaaaccaga

SEQ ID NO: 1177804 - RNA, 21 nt, Human
aggcuuggccagggggaggga

SEQ ID NO: 1177805 - RNA, 22 nt, Human
aguaccaccccauccuugcaga

SEQ ID NO: 1177806 - RNA, 21 nt, Human
aguuuugccuuuucugauguu

SEQ ID NO: 1177807 - RNA, 20 nt, Human
auccucuuccuccccagccc

SEQ ID NO: 1177808 - RNA, 20 nt, Human
caaaaccagaagagaaaauc

SEQ ID NO: 1177809 - RNA, 24 nt, Human
caagacacacacggaagagacugg

SEQ ID NO: 1177810 - RNA, 18 nt, Human
caagggaccucugccaau

SEQ ID NO: 1177811 - RNA, 21 nt, Human
caauuccaggcuccaaccagu

SEQ ID NO: 1177812 - RNA, 18 nt, Human
caccagcguccacagcag

SEQ ID NO: 1177813 - RNA, 18 nt, Human
caccccauccuugcagaa

SEQ ID NO: 1177814 - RNA, 23 nt, Human
caccccauccuugcagaaggcug

SEQ ID NO: 1177815 - RNA, 19 nt, Human
cacgugcacugcccauuac

SEQ ID NO: 1177816 - RNA, 18 nt, Human
cagaacaagaaacaaaac

SEQ ID NO: 1177817 - RNA, 18 nt, Human
cagaacaagaaacaaaac

SEQ ID NO: 1177818 - RNA, 19 nt, Human
cagagcccaggccaggagc

SEQ ID NO: 1177819 - RNA, 20 nt, Human
cagcguccacagcaguccag

SEQ ID NO: 1177820 - RNA, 22 nt, Human
caggagcaaagggcuccuuugu

SEQ ID NO: 1177821 - RNA, 20 nt, Human
caggucuucuuacuggaugu

SEQ ID NO: 1177822 - RNA, 22 nt, Human
caguggcagagagugggggccu

SEQ ID NO: 1177823 - RNA, 23 nt, Human
caguggcagagagugggggccug

SEQ ID NO: 1177824 - RNA, 24 nt, Human
caguggcagagagugggggccugu

SEQ ID NO: 1177825 - RNA, 18 nt, Human
caguggcuccugaaauug

SEQ ID NO: 1177826 - RNA, 23 nt, Human
caucuggaagaagguuuugccuc

SEQ ID NO: 1177827 - RNA, 24 nt, Human
caugcuccagaguauuuuggauug

SEQ ID NO: 1177828 - RNA, 18 nt, Human
ccacugccccaaggaggu

SEQ ID NO: 1177829 - RNA, 20 nt, Human
ccagcggccagucaggcaga

SEQ ID NO: 1177830 - RNA, 22 nt, Human
ccaggggagccagcccacagcc

SEQ ID NO: 1177831 - RNA, 22 nt, Human
ccagucaggcagaacaagaaac

SEQ ID NO: 1177832 - RNA, 22 nt, Human
cccacagcccaagaaaaggcac

SEQ ID NO: 1177833 - RNA, 23 nt, Human
cccacagcccaagaaaaggcacu

SEQ ID NO: 1177834 - RNA, 22 nt, Human
cccagcccuggucaguuuugcc

SEQ ID NO: 1177835 - RNA, 20 nt, Human
cccgggugcagugccagcca

SEQ ID NO: 1177836 - RNA, 20 nt, Human
cccuucaacugcacugcugc

SEQ ID NO: 1177837 - RNA, 19 nt, Human
cccuugcccucagggagcu

SEQ ID NO: 1177838 - RNA, 18 nt, Human
ccgggguggggguggggg

SEQ ID NO: 1177839 - RNA, 19 nt, Human
ccgugcacuccugcagagc

SEQ ID NO: 1177840 - RNA, 25 nt, Human
ccuaaauauccucugacccagguuu

SEQ ID NO: 1177841 - RNA, 23 nt, Human
ccucuagaaccaggucugccacc

SEQ ID NO: 1177842 - RNA, 19 nt, Human
ccucuuccuccccagccca

SEQ ID NO: 1177843 - RNA, 19 nt, Human
ccugaaauugcuugggguu

SEQ ID NO: 1177844 - RNA, 19 nt, Human
ccugggcccuguucccuuc

SEQ ID NO: 1177845 - RNA, 22 nt, Human
cggggugggggugggggucccu

SEQ ID NO: 1177846 - RNA, 19 nt, Human
cuaaauauccucugaccca

SEQ ID NO: 1177847 - RNA, 19 nt, Human
cuagaaccaggucugccac

SEQ ID NO: 1177848 - RNA, 23 nt, Human
cuagacccugguaggacucaaga

SEQ ID NO: 1177849 - RNA, 18 nt, Human
cucacaccggaccuguuc

SEQ ID NO: 1177850 - RNA, 23 nt, Human
cuccagaaaccugacgcaccauu

SEQ ID NO: 1177851 - RNA, 24 nt, Human
cuccccagcccacugggcugaaca

SEQ ID NO: 1177852 - RNA, 20 nt, Human
cugaacaagggaaggaggcu

SEQ ID NO: 1177853 - RNA, 23 nt, Human
cugcugccugccugggcccuguu

SEQ ID NO: 1177854 - RNA, 21 nt, Human
cuuccugucucugaacucuag

SEQ ID NO: 1177855 - RNA, 23 nt, Human
gaaaggaaaaugaagccugcagg

SEQ ID NO: 1177856 - RNA, 20 nt, Human
gaagggaaugacuaaaaagg

SEQ ID NO: 1177857 - RNA, 23 nt, Human
gaagggaaugacuaaaaagggcu

SEQ ID NO: 1177858 - RNA, 20 nt, Human
gacagguaaggaaagggcag

SEQ ID NO: 1177859 - RNA, 23 nt, Human
gaccacacagugaaaucagagcc

SEQ ID NO: 1177860 - RNA, 19 nt, Human
gaccucucacccugcccag

SEQ ID NO: 1177861 - RNA, 21 nt, Human
gagaaugagaagugagaagga

SEQ ID NO: 1177862 - RNA, 19 nt, Human
gagccgggguggggguggg

SEQ ID NO: 1177863 - RNA, 24 nt, Human
gcagaacaagaaacaaaaccagaa

SEQ ID NO: 1177864 - RNA, 25 nt, Human
gcagaacaagaaacaaaaccagaag

SEQ ID NO: 1177865 - RNA, 21 nt, Human
gcagagagugggggccugugg

SEQ ID NO: 1177866 - RNA, 18 nt, Human
gccagggggagggagggg

SEQ ID NO: 1177867 - RNA, 24 nt, Human
gcccaggccaggagcaaagggcuc

SEQ ID NO: 1177868 - RNA, 19 nt, Human
ggacucaagacacacacgg

SEQ ID NO: 1177869 - RNA, 23 nt, Human
ggacucaagacacacacggaaga

SEQ ID NO: 1177870 - RNA, 18 nt, Human
ggagcagagaagccagcu

SEQ ID NO: 1177871 - RNA, 20 nt, Human
ggcacuacuuguacaguggc

SEQ ID NO: 1177872 - RNA, 23 nt, Human
ggcagcaggugaaguccccaggg

SEQ ID NO: 1177873 - RNA, 23 nt, Human
ggccaggagcaaagggcuccuuu

SEQ ID NO: 1177874 - RNA, 20 nt, Human
ggccagggggagggaggggc

SEQ ID NO: 1177875 - RNA, 21 nt, Human
ggcuggacgaccacuuccgug

SEQ ID NO: 1177876 - RNA, 22 nt, Human
ggcugggugguuugggaagccg

SEQ ID NO: 1177877 - RNA, 18 nt, Human
gggagcagagaagccagc

SEQ ID NO: 1177878 - RNA, 22 nt, Human
gggugcagugccagccaggccu

SEQ ID NO: 1177879 - RNA, 19 nt, Human
ggucaguuuugccuuuucu

SEQ ID NO: 1177880 - RNA, 18 nt, Human
ggugugaagaugggagga

SEQ ID NO: 1177881 - RNA, 23 nt, Human
gucaccuccacuggucaccgcag

SEQ ID NO: 1177882 - RNA, 26 nt, Human
guccaugggacagcacgcaguucggg

SEQ ID NO: 1177883 - RNA, 24 nt, Human
gucugccccagcugugauucccac

SEQ ID NO: 1177884 - RNA, 23 nt, Human
gugaaguccccagggcugagguu

SEQ ID NO: 1177885 - RNA, 21 nt, Human
uaacucacauacccucucccc

SEQ ID NO: 1177886 - RNA, 19 nt, Human
uaagagccugaggccuccg

SEQ ID NO: 1177887 - RNA, 18 nt, Human
uacaguggccuugacucg

SEQ ID NO: 1177888 - RNA, 18 nt, Human
uaccggccaccgacaagc

SEQ ID NO: 1177889 - RNA, 23 nt, Human
uaggucugggagaagggaaugac

SEQ ID NO: 1177890 - RNA, 18 nt, Human
uauccaggcuggacgacc

SEQ ID NO: 1177891 - RNA, 19 nt, Human
ucagaccagacucaagcuc

SEQ ID NO: 1177892 - RNA, 23 nt, Human
uccaccgaccucucacccugccc

SEQ ID NO: 1177893 - RNA, 21 nt, Human
uccaugggacagcacgcaguu

SEQ ID NO: 1177894 - RNA, 21 nt, Human
ucccugaugcucccacugccc

SEQ ID NO: 1177895 - RNA, 19 nt, Human
ucccuuggcaaccaccuua

SEQ ID NO: 1177896 - RNA, 23 nt, Human
ucccuuggcaaccaccuuaaucu

SEQ ID NO: 1177897 - RNA, 18 nt, Human
uccgugcacuccugcaga

SEQ ID NO: 1177898 - RNA, 22 nt, Human
uccgugcacuccugcagagccg

SEQ ID NO: 1177899 - RNA, 19 nt, Human
uccuaaauauccucugacc

SEQ ID NO: 1177900 - RNA, 26 nt, Human
uccugcagagccgggguggggguggg

SEQ ID NO: 1177901 - RNA, 18 nt, Human
uccuggucuccgugucca

SEQ ID NO: 1177902 - RNA, 20 nt, Human
ucgggucuuaagauccugcc

SEQ ID NO: 1177903 - RNA, 21 nt, Human
ucucugaacucuagccaagug

SEQ ID NO: 1177904 - RNA, 18 nt, Human
ugacagguaaggaaaggg

SEQ ID NO: 1177905 - RNA, 18 nt, Human
ugacugguucagguguga

SEQ ID NO: 1177906 - RNA, 21 nt, Human
ugagaacuuguagcuuccagg

SEQ ID NO: 1177907 - RNA, 19 nt, Human
ugagaaggacaguaccacc

SEQ ID NO: 1177908 - RNA, 21 nt, Human
ugaggcaggucuucuuacugg

SEQ ID NO: 1177909 - RNA, 23 nt, Human
ugcacugcccauuaccggccacc

SEQ ID NO: 1177910 - RNA, 21 nt, Human
ugcuagacccugguaggacuc

SEQ ID NO: 1177911 - RNA, 21 nt, Human
ugcugccugccugggcccugu

SEQ ID NO: 1177912 - RNA, 22 nt, Human
uggaagagaaugagaagugaga

SEQ ID NO: 1177913 - RNA, 22 nt, Human
uggcaaccaccuuaaucucagc

SEQ ID NO: 1177914 - RNA, 25 nt, Human
uggcagagagugggggccuguggcc

SEQ ID NO: 1177915 - RNA, 20 nt, Human
uggccaggcagccaggauga

SEQ ID NO: 1177916 - RNA, 24 nt, Human
ugggaagccgggccccguggauca

SEQ ID NO: 1177917 - RNA, 22 nt, Human
ugggaggaguccuugcccugcu

SEQ ID NO: 1177918 - RNA, 20 nt, Human
ugguggaagcaggauucuuu

SEQ ID NO: 1177919 - RNA, 24 nt, Human
uguagcuuccaggcugacugguuc

SEQ ID NO: 1177920 - RNA, 21 nt, Human
ugucuggggaagggaaaugag

SEQ ID NO: 1177921 - RNA, 22 nt, Human
ugucuggggaagggaaaugagg

SEQ ID NO: 1177922 - RNA, 22 nt, Human
ugugaagaugggaggaguccuu

SEQ ID NO: 1177923 - RNA, 19 nt, Human
uguucauucuggggaggca

SEQ ID NO: 1177924 - RNA, 23 nt, Human
uuaacucacauacccucucccca

SEQ ID NO: 1177925 - RNA, 22 nt, Human
uuaaugacaaugccucuuccua

SEQ ID NO: 1177926 - RNA, 24 nt, Human
uuaaugacaaugccucuuccuaaa

SEQ ID NO: 1177927 - RNA, 18 nt, Human
uuccacucagucagcucc

SEQ ID NO: 1177928 - RNA, 22 nt, Human
uuccaggcuccaaccagucacc

SEQ ID NO: 1177929 - RNA, 22 nt, Human
uuccugaacaagggaaggaggc

SEQ ID NO: 1177930 - RNA, 21 nt, Human
uuccuggucuccguguccaga

SEQ ID NO: 1177931 - RNA, 22 nt, Human
caagcucaaguuccccugcugg

SEQ ID NO: 1177932 - RNA, 19 nt, Human
ccucuuccuccacugccuu

SEQ ID NO: 1177933 - RNA, 26 nt, Human
aaacagaugacaaagauuaugcucuc

SEQ ID NO: 1177934 - RNA, 26 nt, Human
aaagaacaccacugucuugaaaccaa

SEQ ID NO: 1177935 - RNA, 23 nt, Human
aaaucuagaacaacacuuagaau

SEQ ID NO: 1177936 - RNA, 21 nt, Human
aagaacaccacugucuugaaa

SEQ ID NO: 1177937 - RNA, 21 nt, Human
aagaagguuccagauuucucu

SEQ ID NO: 1177938 - RNA, 22 nt, Human
aaggagaaagagaaacgcaaug

SEQ ID NO: 1177939 - RNA, 19 nt, Human
aaggagacaggagagcuca

SEQ ID NO: 1177940 - RNA, 20 nt, Human
aaucuucacccuccugccac

SEQ ID NO: 1177941 - RNA, 23 nt, Human
aauuuuuauuucagguucaaggg

SEQ ID NO: 1177942 - RNA, 21 nt, Human
acagaaagauagaacaaaacu

SEQ ID NO: 1177943 - RNA, 19 nt, Human
acagguuguaccaugcccc

SEQ ID NO: 1177944 - RNA, 18 nt, Human
accagccccagccugcuu

SEQ ID NO: 1177945 - RNA, 19 nt, Human
accuacacaagugagguga

SEQ ID NO: 1177946 - RNA, 24 nt, Human
accuguuuccuaaccucaagggaa

SEQ ID NO: 1177947 - RNA, 23 nt, Human
acgacuaucuauauucucauccc

SEQ ID NO: 1177948 - RNA, 20 nt, Human
agaacaccacugucuugaaa

SEQ ID NO: 1177949 - RNA, 18 nt, Human
agacaggagagcucaggg

SEQ ID NO: 1177950 - RNA, 23 nt, Human
agauuaugcucucaaagcaugua

SEQ ID NO: 1177951 - RNA, 21 nt, Human
aggggaaaaaaacagaugaca

SEQ ID NO: 1177952 - RNA, 21 nt, Human
auagaacaaaacugggauguu

SEQ ID NO: 1177953 - RNA, 24 nt, Human
aucccaaaggagacaggagagcuc

SEQ ID NO: 1177954 - RNA, 26 nt, Human
caacacuuagaauuacagaacuuugc

SEQ ID NO: 1177955 - RNA, 24 nt, Human
caaggcgggaugcauuugccucuc

SEQ ID NO: 1177956 - RNA, 23 nt, Human
cacccaccucucaaaauaaucug

SEQ ID NO: 1177957 - RNA, 21 nt, Human
cacccaggaaaccagcauaac

SEQ ID NO: 1177958 - RNA, 22 nt, Human
cacccaggaaaccagcauaaca

SEQ ID NO: 1177959 - RNA, 19 nt, Human
cacccuccacccucaagua

SEQ ID NO: 1177960 - RNA, 22 nt, Human
cacccuccacccucaaguauac

SEQ ID NO: 1177961 - RNA, 22 nt, Human
cacccuccugccacccuccacc

SEQ ID NO: 1177962 - RNA, 19 nt, Human
cagguggccucagccuuga

SEQ ID NO: 1177963 - RNA, 18 nt, Human
cauuuuacccuguaucua

SEQ ID NO: 1177964 - RNA, 18 nt, Human
ccaccagccccagccugc

SEQ ID NO: 1177965 - RNA, 22 nt, Human
ccagaagaagguuccagauuuc

SEQ ID NO: 1177966 - RNA, 21 nt, Human
ccagcaauggaagacuauguc

SEQ ID NO: 1177967 - RNA, 22 nt, Human
ccaugccccgccccucccccca

SEQ ID NO: 1177968 - RNA, 24 nt, Human
ccccaaccugagggugucucuaau

SEQ ID NO: 1177969 - RNA, 20 nt, Human
cccccaaccugagggugucu

SEQ ID NO: 1177970 - RNA, 23 nt, Human
cccuaagucgcaucccaaaggag

SEQ ID NO: 1177971 - RNA, 22 nt, Human
cccuggacaacagggaggcccu

SEQ ID NO: 1177972 - RNA, 23 nt, Human
ccuccacccucaaguauaccccu

SEQ ID NO: 1177973 - RNA, 21 nt, Human
ccugccacccuccacccucaa

SEQ ID NO: 1177974 - RNA, 18 nt, Human
cgcccccaccugcaauuu

SEQ ID NO: 1177975 - RNA, 22 nt, Human
cucaaagccaugaacccgcuuu

SEQ ID NO: 1177976 - RNA, 23 nt, Human
cucaagggaaagagaaggagaaa

SEQ ID NO: 1177977 - RNA, 24 nt, Human
cucacauaucacccaccucucaaa

SEQ ID NO: 1177978 - RNA, 21 nt, Human
cucaucccagguggccucagc

SEQ ID NO: 1177979 - RNA, 21 nt, Human
cugauuccaaccuaccuacac

SEQ ID NO: 1177980 - RNA, 21 nt, Human
cuggagucugcuuccugcuuc

SEQ ID NO: 1177981 - RNA, 20 nt, Human
cuguucuagucuaugucacu

SEQ ID NO: 1177982 - RNA, 22 nt, Human
cuucacccuccugccacccucc

SEQ ID NO: 1177983 - RNA, 19 nt, Human
gaaaaaaacagaugacaaa

SEQ ID NO: 1177984 - RNA, 27 nt, Human
gaaagaacaccacugucuugaaaccaa

SEQ ID NO: 1177985 - RNA, 20 nt, Human
gaacccgcuucccuucccac

SEQ ID NO: 1177986 - RNA, 19 nt, Human
gaagcaaauucgaguguag

SEQ ID NO: 1177987 - RNA, 19 nt, Human
gagcucagggagccaacgg

SEQ ID NO: 1177988 - RNA, 18 nt, Human
gaggugauucuugugacu

SEQ ID NO: 1177989 - RNA, 19 nt, Human
gaguguagaagccacaucc

SEQ ID NO: 1177990 - RNA, 24 nt, Human
gauucucugauuuuggcaaucuua

SEQ ID NO: 1177991 - RNA, 22 nt, Human
ggcuuccugacaggagauacag

SEQ ID NO: 1177992 - RNA, 20 nt, Human
gggaaagagaaggagaaagg

SEQ ID NO: 1177993 - RNA, 21 nt, Human
gguaauuuugucacccaggaa

SEQ ID NO: 1177994 - RNA, 22 nt, Human
gguggccucagccuugaucaca

SEQ ID NO: 1177995 - RNA, 24 nt, Human
gugggacagaaagauagaacaaaa

SEQ ID NO: 1177996 - RNA, 21 nt, Human
guuuccucagggacagccagc

SEQ ID NO: 1177997 - RNA, 18 nt, Human
uaaguugugugucacagg

SEQ ID NO: 1177998 - RNA, 20 nt, Human
uacccagaagaagguuccag

SEQ ID NO: 1177999 - RNA, 20 nt, Human
uacccuacuauucgccccca

SEQ ID NO: 1178000 - RNA, 25 nt, Human
uacccuacuauucgcccccaccugc

SEQ ID NO: 1178001 - RNA, 19 nt, Human
uagcccuaagucgcauccc

SEQ ID NO: 1178002 - RNA, 19 nt, Human
uauuguucccuucuuugug

SEQ ID NO: 1178003 - RNA, 23 nt, Human
ucacagugucuauccugauucca

SEQ ID NO: 1178004 - RNA, 22 nt, Human
ucagcuauggaaagaacaccac

SEQ ID NO: 1178005 - RNA, 23 nt, Human
uccagauuucucucucacauauc

SEQ ID NO: 1178006 - RNA, 22 nt, Human
uccauguccuuuuaaauggauu

SEQ ID NO: 1178007 - RNA, 19 nt, Human
ucccacagguuguaccaug

SEQ ID NO: 1178008 - RNA, 26 nt, Human
ucccacagguuguaccaugccccgcc

SEQ ID NO: 1178009 - RNA, 20 nt, Human
ucccagugcaggugggacag

SEQ ID NO: 1178010 - RNA, 24 nt, Human
uccugcuuccgccaugcccaggag

SEQ ID NO: 1178011 - RNA, 21 nt, Human
ucgcaucccaaaggagacagg

SEQ ID NO: 1178012 - RNA, 20 nt, Human
ucuaggggaaaaaaacagau

SEQ ID NO: 1178013 - RNA, 18 nt, Human
ucucacauaucacccacc

SEQ ID NO: 1178014 - RNA, 23 nt, Human
ucuucacccuccugccacccucc

SEQ ID NO: 1178015 - RNA, 21 nt, Human
ugccccgccccuccccccaac

SEQ ID NO: 1178016 - RNA, 19 nt, Human
ugcucagcuauggaaagaa

SEQ ID NO: 1178017 - RNA, 22 nt, Human
uggaaagaacaccacugucuug

SEQ ID NO: 1178018 - RNA, 25 nt, Human
uggaaagaacaccacugucuugaaa

SEQ ID NO: 1178019 - RNA, 22 nt, Human
uggagucugcuuccugcuuccg

SEQ ID NO: 1178020 - RNA, 23 nt, Human
uggcaaucuuacuaugcuucuaa

SEQ ID NO: 1178021 - RNA, 19 nt, Human
ugucacccaggaaaccagc

SEQ ID NO: 1178022 - RNA, 19 nt, Human
ugugcugaacgcugcccug

SEQ ID NO: 1178023 - RNA, 20 nt, Human
ugugucuacggcacacacau

SEQ ID NO: 1178024 - RNA, 22 nt, Human
uucaagggguacaugcacaggu

SEQ ID NO: 1178025 - RNA, 23 nt, Human
uucacccuccugccacccuccac

SEQ ID NO: 1178026 - RNA, 24 nt, Human
uucagaaccuccaagacucauguc

SEQ ID NO: 1178027 - RNA, 21 nt, Human
uugaaaccaagaagcaaauuc

SEQ ID NO: 1178028 - RNA, 20 nt, Human
uuguucccuucuuugugucu

SEQ ID NO: 1178029 - RNA, 21 nt, Human
uuuccagauuuccccaccuug

SEQ ID NO: 1178030 - RNA, 20 nt, Human
uuuucaaucuucacccuccc

SEQ ID NO: 1178031 - RNA, 28 nt, Human
acgccacuaaucucaggugcccgcaagc

SEQ ID NO: 1178032 - RNA, 18 nt, Human
cacugcccugucccacgc

SEQ ID NO: 1178033 - RNA, 23 nt, Human
cccacgccacuaaucucaggugc

SEQ ID NO: 1178034 - RNA, 21 nt, Human
ucucaggugcccgcaagccuu

SEQ ID NO: 1178035 - RNA, 26 nt, Human
ugcccugucccacgccacuaaucuca

SEQ ID NO: 1178036 - RNA, 18 nt, Human
ugggcauuuaugccucug

SEQ ID NO: 1178037 - RNA, 19 nt, Human
uuaugccucugccccaucc

SEQ ID NO: 1178038 - RNA, 24 nt, Human
aaacuucugggcucaagcgauccu

SEQ ID NO: 1178039 - RNA, 23 nt, Human
aaauggccugguaauggaaaagc

SEQ ID NO: 1178040 - RNA, 19 nt, Human
aagcaugcaccacaacgcc

SEQ ID NO: 1178041 - RNA, 25 nt, Human
aagcgauccucccaccugggccucc

SEQ ID NO: 1178042 - RNA, 27 nt, Human
aagcgauccuccugccucaaccuccca

SEQ ID NO: 1178043 - RNA, 21 nt, Human
aaguagcugggaccacaagca

SEQ ID NO: 1178044 - RNA, 24 nt, Human
aaguagcugggaccacaagcaugc

SEQ ID NO: 1178045 - RNA, 24 nt, Human
aauguugccuaggcuggucucaaa

SEQ ID NO: 1178046 - RNA, 23 nt, Human
acccaggcuggagugcaguggug

SEQ ID NO: 1178047 - RNA, 24 nt, Human
acccaggcuggagugcaguggugu

SEQ ID NO: 1178048 - RNA, 19 nt, Human
acugaagagaucguuggac

SEQ ID NO: 1178049 - RNA, 22 nt, Human
agccaacagagcugcuggcacc

SEQ ID NO: 1178050 - RNA, 26 nt, Human
agcugggaccacaagcaugcaccaca

SEQ ID NO: 1178051 - RNA, 23 nt, Human
agugcaguggugugagcauggcu

SEQ ID NO: 1178052 - RNA, 24 nt, Human
agugcaguggugugagcauggcuc

SEQ ID NO: 1178053 - RNA, 20 nt, Human
auauuuuuuguagagaugga

SEQ ID NO: 1178054 - RNA, 22 nt, Human
aucagugugaauguuuccucca

SEQ ID NO: 1178055 - RNA, 19 nt, Human
auggaaacauuccaagaaa

SEQ ID NO: 1178056 - RNA, 20 nt, Human
auguugccuaggcuggucuc

SEQ ID NO: 1178057 - RNA, 23 nt, Human
auguugccuaggcuggucucaaa

SEQ ID NO: 1178058 - RNA, 20 nt, Human
auuuugugauuuuuuuucuu

SEQ ID NO: 1178059 - RNA, 22 nt, Human
caaaguaaugggauuacaggcg

SEQ ID NO: 1178060 - RNA, 22 nt, Human
caaaguagcugggaccacaagc

SEQ ID NO: 1178061 - RNA, 18 nt, Human
caacuugagccaacagag

SEQ ID NO: 1178062 - RNA, 19 nt, Human
caacuugagccaacagagc

SEQ ID NO: 1178063 - RNA, 21 nt, Human
caagaaacagaagcccucuca

SEQ ID NO: 1178064 - RNA, 27 nt, Human
caagcgauccucccaccugggccuccc

SEQ ID NO: 1178065 - RNA, 27 nt, Human
caagcgauccucccaccugggccuccc

SEQ ID NO: 1178066 - RNA, 23 nt, Human
caagcgauccuccugccucaacc

SEQ ID NO: 1178067 - RNA, 20 nt, Human
cacaagcaugcaccacaacg

SEQ ID NO: 1178068 - RNA, 24 nt, Human
cacccaggcuggagugcaguggug

SEQ ID NO: 1178069 - RNA, 23 nt, Human
cacugcagccucugccuccuggg

SEQ ID NO: 1178070 - RNA, 19 nt, Human
cagccucugccuccugggc

SEQ ID NO: 1178071 - RNA, 23 nt, Human
cagccucugccuccugggcucaa

SEQ ID NO: 1178072 - RNA, 21 nt, Human
caguggugugagcauggcuca

SEQ ID NO: 1178073 - RNA, 21 nt, Human
cauggcucacugcagccucug

SEQ ID NO: 1178074 - RNA, 18 nt, Human
cauuccaagaaacagaag

SEQ ID NO: 1178075 - RNA, 19 nt, Human
ccaucugagagaaaaugaa

SEQ ID NO: 1178076 - RNA, 18 nt, Human
cccaaaguagcugggacc

SEQ ID NO: 1178077 - RNA, 22 nt, Human
ccccuccgcuccgccccaaccc

SEQ ID NO: 1178078 - RNA, 25 nt, Human
cccugccuggcacggccuccccucc

SEQ ID NO: 1178079 - RNA, 24 nt, Human
ccgccccaacccaacucccaggua

SEQ ID NO: 1178080 - RNA, 22 nt, Human
ccuccugccucaaccucccaaa

SEQ ID NO: 1178081 - RNA, 24 nt, Human
ccuccugggcucaagcgauccucc

SEQ ID NO: 1178082 - RNA, 19 nt, Human
ccucugccuccugggcuca

SEQ ID NO: 1178083 - RNA, 22 nt, Human
ccuggcugacuuuuauauuuuu

SEQ ID NO: 1178084 - RNA, 20 nt, Human
ccugggcucaagcgauccuc

SEQ ID NO: 1178085 - RNA, 23 nt, Human
ccugggcucaagcgauccuccug

SEQ ID NO: 1178086 - RNA, 18 nt, Human
cgcuccgccccaacccaa

SEQ ID NO: 1178087 - RNA, 18 nt, Human
cggccuccccuccgcucc

SEQ ID NO: 1178088 - RNA, 18 nt, Human
cgggagccacugugcccg

SEQ ID NO: 1178089 - RNA, 24 nt, Human
cucaagcgauccucccaccugggc

SEQ ID NO: 1178090 - RNA, 24 nt, Human
cucaagcgauccuccugccucaac

SEQ ID NO: 1178091 - RNA, 21 nt, Human
cucacugcagccucugccucc

SEQ ID NO: 1178092 - RNA, 24 nt, Human
cucacugcagccucugccuccugg

SEQ ID NO: 1178093 - RNA, 19 nt, Human
cuccacaacuggcacgucu

SEQ ID NO: 1178094 - RNA, 18 nt, Human
cuccugccucaaccuccc

SEQ ID NO: 1178095 - RNA, 21 nt, Human
cugaagacuuuaauacagaaa

SEQ ID NO: 1178096 - RNA, 22 nt, Human
cugagagaaaaugaaaauccac

SEQ ID NO: 1178097 - RNA, 23 nt, Human
cugcagccucugccuccugggcu

SEQ ID NO: 1178098 - RNA, 20 nt, Human
cugggcucaagcgauccucc

SEQ ID NO: 1178099 - RNA, 18 nt, Human
cugucacccaggcuggag

SEQ ID NO: 1178100 - RNA, 25 nt, Human
cuucugggcucaagcgauccuccca

SEQ ID NO: 1178101 - RNA, 19 nt, Human
gagcauggcucacugcagc

SEQ ID NO: 1178102 - RNA, 18 nt, Human
gauuacaggcgggagcca

SEQ ID NO: 1178103 - RNA, 21 nt, Human
gauuacaggcgggagccacug

SEQ ID NO: 1178104 - RNA, 24 nt, Human
gauuacaggcgggagccacugugc

SEQ ID NO: 1178105 - RNA, 20 nt, Human
gcaccacaacgccuggcuga

SEQ ID NO: 1178106 - RNA, 23 nt, Human
gccuaggcuggucucaaacuucu

SEQ ID NO: 1178107 - RNA, 21 nt, Human
gcucacugcagccucugccuc

SEQ ID NO: 1178108 - RNA, 25 nt, Human
gcucugucacccaggcuggagugca

SEQ ID NO: 1178109 - RNA, 23 nt, Human
ggagucuugcaauguugccuagg

SEQ ID NO: 1178110 - RNA, 21 nt, Human
ggccugguaauggaaaagcug

SEQ ID NO: 1178111 - RNA, 22 nt, Human
gggcucaagcgauccuccugcc

SEQ ID NO: 1178112 - RNA, 25 nt, Human
gguaauggaaaagcugacugaggaa

SEQ ID NO: 1178113 - RNA, 23 nt, Human
uaacauuucuucacucaggcugu

SEQ ID NO: 1178114 - RNA, 24 nt, Human
ucacccaggcuggagugcaguggu

SEQ ID NO: 1178115 - RNA, 24 nt, Human
ucacugcagccucugccuccuggg

SEQ ID NO: 1178116 - RNA, 25 nt, Human
ucacugcagccucugccuccugggc

SEQ ID NO: 1178117 - RNA, 24 nt, Human
uccaagaaacagaagcccucucac

SEQ ID NO: 1178118 - RNA, 25 nt, Human
uccaagaaacagaagcccucucacc

SEQ ID NO: 1178119 - RNA, 24 nt, Human
uccacuaugagagaaaacugaaga

SEQ ID NO: 1178120 - RNA, 24 nt, Human
ucccaaaguaaugggauuacaggc

SEQ ID NO: 1178121 - RNA, 21 nt, Human
uccccuccgcuccgccccaac

SEQ ID NO: 1178122 - RNA, 19 nt, Human
uccgccccaacccaacucc

SEQ ID NO: 1178123 - RNA, 27 nt, Human
uccuccugccucaaccucccaaaguag

SEQ ID NO: 1178124 - RNA, 21 nt, Human
uccugggcucaagcgauccuc

SEQ ID NO: 1178125 - RNA, 22 nt, Human
uccugggcucaagcgauccucc

SEQ ID NO: 1178126 - RNA, 24 nt, Human
uccugggcucaagcgauccuccug

SEQ ID NO: 1178127 - RNA, 23 nt, Human
ucucaaacuucugggcucaagcg

SEQ ID NO: 1178128 - RNA, 24 nt, Human
ucugucacccaggcuggagugcag

SEQ ID NO: 1178129 - RNA, 23 nt, Human
ucuugcaauguugccuaggcugg

SEQ ID NO: 1178130 - RNA, 24 nt, Human
ucuugcaauguugccuaggcuggu

SEQ ID NO: 1178131 - RNA, 23 nt, Human
ucuugcucugucacccaggcugg

SEQ ID NO: 1178132 - RNA, 24 nt, Human
ucuugcucugucacccaggcugga

SEQ ID NO: 1178133 - RNA, 22 nt, Human
ugagacaagaucuugcucuguc

SEQ ID NO: 1178134 - RNA, 20 nt, Human
ugagagaaaacugaagacuu

SEQ ID NO: 1178135 - RNA, 19 nt, Human
ugagccaacagagcugcug

SEQ ID NO: 1178136 - RNA, 24 nt, Human
ugagccaacagagcugcuggcacc

SEQ ID NO: 1178137 - RNA, 25 nt, Human
ugccucaaccucccaaaguagcugg

SEQ ID NO: 1178138 - RNA, 24 nt, Human
ugccuccugggcucaagcgauccu

SEQ ID NO: 1178139 - RNA, 24 nt, Human
ugcucugucacccaggcuggagug

SEQ ID NO: 1178140 - RNA, 24 nt, Human
uggagucuugcaauguugccuagg

SEQ ID NO: 1178141 - RNA, 18 nt, Human
uggagugcagugguguga

SEQ ID NO: 1178142 - RNA, 24 nt, Human
uggagugcaguggugugagcaugg

SEQ ID NO: 1178143 - RNA, 21 nt, Human
uggagugcaguggugugagcc

SEQ ID NO: 1178144 - RNA, 20 nt, Human
uggcacgucuuuccuaugac

SEQ ID NO: 1178145 - RNA, 22 nt, Human
uggccugguaauggaaaagcug

SEQ ID NO: 1178146 - RNA, 21 nt, Human
ugggaccacaagcaugcacca

SEQ ID NO: 1178147 - RNA, 24 nt, Human
ugggaccacaagcaugcaccacaa

SEQ ID NO: 1178148 - RNA, 21 nt, Human
ugggauuacaggcgggagcca

SEQ ID NO: 1178149 - RNA, 22 nt, Human
ugggauuacaggcgggagccac

SEQ ID NO: 1178150 - RNA, 22 nt, Human
ugggauuacaggcgggagccac

SEQ ID NO: 1178151 - RNA, 22 nt, Human
ugggauuacaggcgggagccac

SEQ ID NO: 1178152 - RNA, 24 nt, Human
ugggauuacaggcgggagccacug

SEQ ID NO: 1178153 - RNA, 24 nt, Human
ugggcucaagcgauccuccugccu

SEQ ID NO: 1178154 - RNA, 18 nt, Human
ugguaauggaaaagcuga

SEQ ID NO: 1178155 - RNA, 24 nt, Human
uggugugagcauggcucacugcag

SEQ ID NO: 1178156 - RNA, 24 nt, Human
uguagagauggagucuugcaaugu

SEQ ID NO: 1178157 - RNA, 22 nt, Human
ugugaauguuuccuccacaacu

SEQ ID NO: 1178158 - RNA, 19 nt, Human
ugugagcauggcucacugc

SEQ ID NO: 1178159 - RNA, 23 nt, Human
uuaaugaagggauuauuggauga

SEQ ID NO: 1178160 - RNA, 25 nt, Human
uucaaccugccucaacuugagccaa

SEQ ID NO: 1178161 - RNA, 25 nt, Human
uuccuggcuguaacauuucuucacu

SEQ ID NO: 1178162 - RNA, 19 nt, Human
uugagggagaugucucuuu

SEQ ID NO: 1178163 - RNA, 24 nt, Human
uugcucugucacccaggcuggagu

SEQ ID NO: 1178164 - RNA, 24 nt, Human
uuguagagauggagucuugcaaug

SEQ ID NO: 1178165 - RNA, 20 nt, Human
uuuguagagauggagucuug

SEQ ID NO: 1178166 - RNA, 24 nt, Human
uuuuucuuuuuugagacaagaucu

SEQ ID NO: 1178167 - RNA, 21 nt, Human
uuuuuuguagagauggagucu

SEQ ID NO: 1178168 - RNA, 18 nt, Human
aaacaggaggcugggucu

SEQ ID NO: 1178169 - RNA, 23 nt, Human
aacuggccggccaccauaagggc

SEQ ID NO: 1178170 - RNA, 21 nt, Human
aagcaucacugaaggccccac

SEQ ID NO: 1178171 - RNA, 21 nt, Human
aagccaagaccauggccagaa

SEQ ID NO: 1178172 - RNA, 21 nt, Human
aagcccaggccuuccccucag

SEQ ID NO: 1178173 - RNA, 18 nt, Human
aaggccuccugccaccac

SEQ ID NO: 1178174 - RNA, 23 nt, Human
aaucuuacaacucaccaaggcug

SEQ ID NO: 1178175 - RNA, 23 nt, Human
aauggcuugaagacaaauauuac

SEQ ID NO: 1178176 - RNA, 23 nt, Human
accaacugccccugggcccucag

SEQ ID NO: 1178177 - RNA, 27 nt, Human
acugagcaccagcgaaaggccgggggc

SEQ ID NO: 1178178 - RNA, 23 nt, Human
acugcagcccaugcugccugcug

SEQ ID NO: 1178179 - RNA, 19 nt, Human
acugcuccgugccccuagc

SEQ ID NO: 1178180 - RNA, 20 nt, Human
acugggcgcaaggugggcac

SEQ ID NO: 1178181 - RNA, 24 nt, Human
agaauacuuugaccuggccaagaa

SEQ ID NO: 1178182 - RNA, 19 nt, Human
aggaaccaggccugucuuu

SEQ ID NO: 1178183 - RNA, 20 nt, Human
aggccuuccccucagugagg

SEQ ID NO: 1178184 - RNA, 21 nt, Human
aggcucccccguucauccacc

SEQ ID NO: 1178185 - RNA, 23 nt, Human
agguugcucagauuuaaggggca

SEQ ID NO: 1178186 - RNA, 21 nt, Human
caaagcacugaguaauuacgg

SEQ ID NO: 1178187 - RNA, 18 nt, Human
caaaggacacagaagggu

SEQ ID NO: 1178188 - RNA, 19 nt, Human
caacauuuacugcagccca

SEQ ID NO: 1178189 - RNA, 24 nt, Human
cacacugggcgcaaggugggcacu

SEQ ID NO: 1178190 - RNA, 22 nt, Human
cacagccagcccaggcccuucc

SEQ ID NO: 1178191 - RNA, 27 nt, Human
caccucugagccuuggcccgagggucc

SEQ ID NO: 1178192 - RNA, 21 nt, Human
caccugcccuuggcucuucug

SEQ ID NO: 1178193 - RNA, 18 nt, Human
cacugagcuccuucuggc

SEQ ID NO: 1178194 - RNA, 26 nt, Human
cacugagcuccuucuggccgaagcuc

SEQ ID NO: 1178195 - RNA, 19 nt, Human
cacugggcgcaaggugggc

SEQ ID NO: 1178196 - RNA, 19 nt, Human
cagcccaugcugccugcug

SEQ ID NO: 1178197 - RNA, 23 nt, Human
cagcccucccccgggaagccaag

SEQ ID NO: 1178198 - RNA, 18 nt, Human
cagcucccauuguccucu

SEQ ID NO: 1178199 - RNA, 22 nt, Human
caguuguggcugagaucuccag

SEQ ID NO: 1178200 - RNA, 20 nt, Human
caucagcucccauuguccuc

SEQ ID NO: 1178201 - RNA, 20 nt, Human
caucagcucccauuguccuc

SEQ ID NO: 1178202 - RNA, 21 nt, Human
cauggccagaauacuuugacc

SEQ ID NO: 1178203 - RNA, 18 nt, Human
ccaagauggcugguccug

SEQ ID NO: 1178204 - RNA, 23 nt, Human
ccacagcuaggaaccaggccugu

SEQ ID NO: 1178205 - RNA, 22 nt, Human
ccacaggcucugcagccgggcc

SEQ ID NO: 1178206 - RNA, 22 nt, Human
ccagcccaggcccuuccgggac

SEQ ID NO: 1178207 - RNA, 20 nt, Human
ccccacagcuaggaaccagg

SEQ ID NO: 1178208 - RNA, 22 nt, Human
ccccuagcggcuggcucagccu

SEQ ID NO: 1178209 - RNA, 19 nt, Human
cccugggcccucagagccc

SEQ ID NO: 1178210 - RNA, 19 nt, Human
cccugggcccucagagccc

SEQ ID NO: 1178211 - RNA, 23 nt, Human
cccuuugccugccugcuccaaca

SEQ ID NO: 1178212 - RNA, 29 nt, Human
ccgacgguggcuggcgggggugguccuuu

SEQ ID NO: 1178213 - RNA, 19 nt, Human
ccguccaaggccuccugcc

SEQ ID NO: 1178214 - RNA, 22 nt, Human
ccucuaucccagccgccucccu

SEQ ID NO: 1178215 - RNA, 22 nt, Human
ccugggagaacagcccuccccc

SEQ ID NO: 1178216 - RNA, 21 nt, Human
ccugggguucaagcaucacug

SEQ ID NO: 1178217 - RNA, 22 nt, Human
ccugugcuguuccaccuaaggc

SEQ ID NO: 1178218 - RNA, 18 nt, Human
cgagaaggcccaugggca

SEQ ID NO: 1178219 - RNA, 19 nt, Human
cgccaggaucucagggggg

SEQ ID NO: 1178220 - RNA, 23 nt, Human
cguccaaggccuccugccaccac

SEQ ID NO: 1178221 - RNA, 22 nt, Human
cucagccuauuaaacaggaggc

SEQ ID NO: 1178222 - RNA, 22 nt, Human
cugagcaccagcgaaaggccgg

SEQ ID NO: 1178223 - RNA, 23 nt, Human
cugcaacauuuacugcagcccau

SEQ ID NO: 1178224 - RNA, 25 nt, Human
cugccccugggcccucagagccccu

SEQ ID NO: 1178225 - RNA, 20 nt, Human
cuuacaacucaccaaggcug

SEQ ID NO: 1178226 - RNA, 24 nt, Human
gaacagcccucccccgggaagcca

SEQ ID NO: 1178227 - RNA, 20 nt, Human
gaccauggccagaauacuuu

SEQ ID NO: 1178228 - RNA, 22 nt, Human
gauacccuucccagccccacag

SEQ ID NO: 1178229 - RNA, 19 nt, Human
gccaccaccgcccacccua

SEQ ID NO: 1178230 - RNA, 23 nt, Human
gcucccauuguccucugccgggu

SEQ ID NO: 1178231 - RNA, 21 nt, Human
gcugcuggcaggccaugucca

SEQ ID NO: 1178232 - RNA, 18 nt, Human
ggagaacagcccuccccc

SEQ ID NO: 1178233 - RNA, 22 nt, Human
ggagaacagcccucccccgguc

SEQ ID NO: 1178234 - RNA, 20 nt, Human
ggcagggcgcugugagggcc

SEQ ID NO: 1178235 - RNA, 20 nt, Human
ggcuggcucagccuggcucg

SEQ ID NO: 1178236 - RNA, 18 nt, Human
gggacgcuugggcucagc

SEQ ID NO: 1178237 - RNA, 18 nt, Human
gggccuccagacuccucu

SEQ ID NO: 1178238 - RNA, 21 nt, Human
gguaauggggagcaaggggga

SEQ ID NO: 1178239 - RNA, 19 nt, Human
uaagagugagcaccuugga

SEQ ID NO: 1178240 - RNA, 20 nt, Human
uaccucccuucugcucaacc

SEQ ID NO: 1178241 - RNA, 19 nt, Human
uagaacaaggcaaagccag

SEQ ID NO: 1178242 - RNA, 23 nt, Human
uagcggcuggcucagccuggcuc

SEQ ID NO: 1178243 - RNA, 18 nt, Human
uaucaaaaugggaggguc

SEQ ID NO: 1178244 - RNA, 20 nt, Human
uaucccagccgccucccugc

SEQ ID NO: 1178245 - RNA, 18 nt, Human
uauuacaccaacugggca

SEQ ID NO: 1178246 - RNA, 19 nt, Human
ucacagucagcauccagga

SEQ ID NO: 1178247 - RNA, 25 nt, Human
ucagagccccuuuagggagcucucu

SEQ ID NO: 1178248 - RNA, 24 nt, Human
ucagccuggcucggggggccucca

SEQ ID NO: 1178249 - RNA, 24 nt, Human
ucccauuguccucugccggguucc

SEQ ID NO: 1178250 - RNA, 20 nt, Human
ucccugcaacgagaaggccc

SEQ ID NO: 1178251 - RNA, 24 nt, Human
ucccugcaacgagaaggcccaugg

SEQ ID NO: 1178252 - RNA, 18 nt, Human
uccgugccccuagcggcu

SEQ ID NO: 1178253 - RNA, 20 nt, Human
uccugagcacugggccacag

SEQ ID NO: 1178254 - RNA, 28 nt, Human
ucucugcaggcaaaggacacagaagggu

SEQ ID NO: 1178255 - RNA, 23 nt, Human
ucuucacagucagcauccaggaa

SEQ ID NO: 1178256 - RNA, 22 nt, Human
ugaggaucuaggggauccuggc

SEQ ID NO: 1178257 - RNA, 21 nt, Human
ugagggacgcuugggcucagc

SEQ ID NO: 1178258 - RNA, 18 nt, Human
ugagugaggccugccugc

SEQ ID NO: 1178259 - RNA, 19 nt, Human
ugccacaggcucugcagcc

SEQ ID NO: 1178260 - RNA, 24 nt, Human
ugcccuuggcucuucuggagucuu

SEQ ID NO: 1178261 - RNA, 21 nt, Human
ugccugccacaggcucugcag

SEQ ID NO: 1178262 - RNA, 24 nt, Human
ugccugccugcuccaacaauggcu

SEQ ID NO: 1178263 - RNA, 25 nt, Human
ugcuccgugccccuagcggcuggcu

SEQ ID NO: 1178264 - RNA, 19 nt, Human
uggagucugaagccugggg

SEQ ID NO: 1178265 - RNA, 24 nt, Human
uggccagaauacuuugaccuggcc

SEQ ID NO: 1178266 - RNA, 22 nt, Human
uggccucuaucccagccgccuc

SEQ ID NO: 1178267 - RNA, 23 nt, Human
uggcucagccuggcucggggggc

SEQ ID NO: 1178268 - RNA, 22 nt, Human
uggcugguccugagcacugggg

SEQ ID NO: 1178269 - RNA, 23 nt, Human
ugucagauacccuucccagcccc

SEQ ID NO: 1178270 - RNA, 24 nt, Human
uguuggauucgcaucugagggacg

SEQ ID NO: 1178271 - RNA, 22 nt, Human
uucaagcaucacugaaggcccc

SEQ ID NO: 1178272 - RNA, 18 nt, Human
uucuggagucugaagccu

SEQ ID NO: 1178273 - RNA, 24 nt, Human
uucuggccgaagcucuggccacac

SEQ ID NO: 1178274 - RNA, 23 nt, Human
aaaaaaaaacaaaaaacaaaaaa

SEQ ID NO: 1178275 - RNA, 26 nt, Human
aaaaacaaaacagguuugcaauuaaa

SEQ ID NO: 1178276 - RNA, 19 nt, Human
aaacaaaaaacaaaacagg

SEQ ID NO: 1178277 - RNA, 21 nt, Human
aaacccagccucgcgagcugu

SEQ ID NO: 1178278 - RNA, 23 nt, Human
aaacuaccacacaaagugaacag

SEQ ID NO: 1178279 - RNA, 22 nt, Human
aagccacuuggcccccaaaccc

SEQ ID NO: 1178280 - RNA, 18 nt, Human
aauggcccucacugccca

SEQ ID NO: 1178281 - RNA, 25 nt, Human
acaagcagaaguuccuuugaggccu

SEQ ID NO: 1178282 - RNA, 20 nt, Human
acagguacaaaauauacagu

SEQ ID NO: 1178283 - RNA, 19 nt, Human
accccauccccaggaguca

SEQ ID NO: 1178284 - RNA, 22 nt, Human
acgcugaggccacaaguccagu

SEQ ID NO: 1178285 - RNA, 22 nt, Human
agacguuuguggugcagcuccc

SEQ ID NO: 1178286 - RNA, 18 nt, Human
agagggaaaaccuggaaa

SEQ ID NO: 1178287 - RNA, 21 nt, Human
agaugcuggaaugaacaagcc

SEQ ID NO: 1178288 - RNA, 20 nt, Human
agauggcccaaaauagagaa

SEQ ID NO: 1178289 - RNA, 24 nt, Human
agccacuuggcccccaaacccagc

SEQ ID NO: 1178290 - RNA, 19 nt, Human
aggagaggcaagcugggaa

SEQ ID NO: 1178291 - RNA, 22 nt, Human
aggcugagguguguccccucug

SEQ ID NO: 1178292 - RNA, 21 nt, Human
agguuggggugggcggccagg

SEQ ID NO: 1178293 - RNA, 23 nt, Human
aguaccuacaaaauuuaaauagc

SEQ ID NO: 1178294 - RNA, 23 nt, Human
agugggaggcagccccagguugg

SEQ ID NO: 1178295 - RNA, 20 nt, Human
auagaaacaauuuucuuaac

SEQ ID NO: 1178296 - RNA, 21 nt, Human
auagugacagaaaugcacgcc

SEQ ID NO: 1178297 - RNA, 21 nt, Human
augaggcaucucgccuguugc

SEQ ID NO: 1178298 - RNA, 20 nt, Human
auuucagacaacucguccuu

SEQ ID NO: 1178299 - RNA, 22 nt, Human
caaaaaacaaaaaacaaaacag

SEQ ID NO: 1178300 - RNA, 23 nt, Human
caaaaaacaaaaaacaaaacagg

SEQ ID NO: 1178301 - RNA, 18 nt, Human
caacaaaacaggaaugga

SEQ ID NO: 1178302 - RNA, 22 nt, Human
caagaaaucugggcccaccuuu

SEQ ID NO: 1178303 - RNA, 21 nt, Human
caagcagaaguuccuuugagg

SEQ ID NO: 1178304 - RNA, 19 nt, Human
cacagauggcccaaaauag

SEQ ID NO: 1178305 - RNA, 19 nt, Human
caccaagugcccuugggac

SEQ ID NO: 1178306 - RNA, 21 nt, Human
caccuccucuuccuggacuuc

SEQ ID NO: 1178307 - RNA, 19 nt, Human
cacgugcggccggcagggg

SEQ ID NO: 1178308 - RNA, 23 nt, Human
cacucagcccaacugggcagagc

SEQ ID NO: 1178309 - RNA, 20 nt, Human
cagcacaggguccuggcugg

SEQ ID NO: 1178310 - RNA, 25 nt, Human
cagcacuuuuggggggccuuuucag

SEQ ID NO: 1178311 - RNA, 26 nt, Human
cagcacuuuuggggggccuuuucagg

SEQ ID NO: 1178312 - RNA, 21 nt, Human
cagccucgcgagcugugcccu

SEQ ID NO: 1178313 - RNA, 20 nt, Human
caggucccuccgucugcagg

SEQ ID NO: 1178314 - RNA, 29 nt, Human
cccaaacccagccucgcgagccgguuccg

SEQ ID NO: 1178315 - RNA, 22 nt, Human
cccagcucugcugagagcuaga

SEQ ID NO: 1178316 - RNA, 23 nt, Human
ccccaaacccagccucgcgagcu

SEQ ID NO: 1178317 - RNA, 24 nt, Human
cccccaaacccagccucgcgagcu

SEQ ID NO: 1178318 - RNA, 24 nt, Human
cccgccaucggugggucccaggac

SEQ ID NO: 1178319 - RNA, 19 nt, Human
ccugaagcuuccacgccgc

SEQ ID NO: 1178320 - RNA, 24 nt, Human
ccugcacacggggcuuuuuacacg

SEQ ID NO: 1178321 - RNA, 21 nt, Human
ccuggaaaucucuguucaccc

SEQ ID NO: 1178322 - RNA, 22 nt, Human
ccuguccugcugcuucccaagg

SEQ ID NO: 1178323 - RNA, 22 nt, Human
cgcuaggcccacucagcccaac

SEQ ID NO: 1178324 - RNA, 19 nt, Human
cgcugaggccacaagucca

SEQ ID NO: 1178325 - RNA, 19 nt, Human
cggcgucgggaguggcugg

SEQ ID NO: 1178326 - RNA, 26 nt, Human
cucaagaauuaaaaaaaaacaaaaaa

SEQ ID NO: 1178327 - RNA, 24 nt, Human
cucccauuucacagagaauucuac

SEQ ID NO: 1178328 - RNA, 20 nt, Human
cucgcgagcugugcccucug

SEQ ID NO: 1178329 - RNA, 19 nt, Human
cucuaggucaguaggaugu

SEQ ID NO: 1178330 - RNA, 21 nt, Human
cugggcccaccuuuaugaugu

SEQ ID NO: 1178331 - RNA, 18 nt, Human
cuuggcccccaaacccag

SEQ ID NO: 1178332 - RNA, 19 nt, Human
cuuugcucccagcucugcu

SEQ ID NO: 1178333 - RNA, 18 nt, Human
gaaaaccuggaaaucucu

SEQ ID NO: 1178334 - RNA, 18 nt, Human
gaaaaguuggggccagca

SEQ ID NO: 1178335 - RNA, 21 nt, Human
gaaguuccuuugaggccuggu

SEQ ID NO: 1178336 - RNA, 21 nt, Human
gagcaguuugcaccucuaaaa

SEQ ID NO: 1178337 - RNA, 18 nt, Human
gaggcagccccagguugg

SEQ ID NO: 1178338 - RNA, 19 nt, Human
gaggcggcugcuacaagca

SEQ ID NO: 1178339 - RNA, 21 nt, Human
gauaguuucucuuucuccagu

SEQ ID NO: 1178340 - RNA, 19 nt, Human
gcacacacaggaccccauc

SEQ ID NO: 1178341 - RNA, 21 nt, Human
gcagccccagguugggguggg

SEQ ID NO: 1178342 - RNA, 22 nt, Human
gcccaggggcuuggugcgcuag

SEQ ID NO: 1178343 - RNA, 21 nt, Human
gcccccaaacccagccucgcg

SEQ ID NO: 1178344 - RNA, 18 nt, Human
gcccugaaaaccaaaagu

SEQ ID NO: 1178345 - RNA, 21 nt, Human
gcuauggggcuggaggcgcuc

SEQ ID NO: 1178346 - RNA, 24 nt, Human
gcuggggcacaggggaggcggcug

SEQ ID NO: 1178347 - RNA, 21 nt, Human
ggaaacaagaggaccaguggc

SEQ ID NO: 1178348 - RNA, 20 nt, Human
ggacgcugaggccacaaguc

SEQ ID NO: 1178349 - RNA, 20 nt, Human
ggcccaaaauagagaaaagu

SEQ ID NO: 1178350 - RNA, 22 nt, Human
ggccuuuucaggagaggcaagc

SEQ ID NO: 1178351 - RNA, 22 nt, Human
ggcucucgcagccccagcacag

SEQ ID NO: 1178352 - RNA, 18 nt, Human
gggcacaggggaggcggc

SEQ ID NO: 1178353 - RNA, 22 nt, Human
ggguaccacagauggcccaaaa

SEQ ID NO: 1178354 - RNA, 23 nt, Human
gguccuggcuggggaaggagcug

SEQ ID NO: 1178355 - RNA, 21 nt, Human
gguggauaguuucucuuucuc

SEQ ID NO: 1178356 - RNA, 19 nt, Human
guguaaacagguacaaaag

SEQ ID NO: 1178357 - RNA, 24 nt, Human
uaaaaaaaaacaaaaaacaaaaaa

SEQ ID NO: 1178358 - RNA, 23 nt, Human
uaaaaagaaaucccuguccugcu

SEQ ID NO: 1178359 - RNA, 20 nt, Human
uaaaauucuacggcgcuccc

SEQ ID NO: 1178360 - RNA, 23 nt, Human
uagaaugaggcaucucgccuguu

SEQ ID NO: 1178361 - RNA, 21 nt, Human
ucacaaggucuguggaggccc

SEQ ID NO: 1178362 - RNA, 20 nt, Human
ucaggccgggcgggcucucg

SEQ ID NO: 1178363 - RNA, 21 nt, Human
ucaguuauaucaauauuagaa

SEQ ID NO: 1178364 - RNA, 20 nt, Human
uccaagggacccaauggccc

SEQ ID NO: 1178365 - RNA, 20 nt, Human
uccacgccgcccugcugccu

SEQ ID NO: 1178366 - RNA, 18 nt, Human
ucccaggcuccuuccugg

SEQ ID NO: 1178367 - RNA, 22 nt, Human
uccgucugcaggggaaacaaga

SEQ ID NO: 1178368 - RNA, 18 nt, Human
uccuggcuggggaaggag

SEQ ID NO: 1178369 - RNA, 21 nt, Human
uccugggcaggacuagggaag

SEQ ID NO: 1178370 - RNA, 20 nt, Human
uccuuuggaggcggggcucu

SEQ ID NO: 1178371 - RNA, 22 nt, Human
uccuuuggaggcggggcucuug

SEQ ID NO: 1178372 - RNA, 21 nt, Human
ugaaugggcacugccaggucc

SEQ ID NO: 1178373 - RNA, 18 nt, Human
ugacagaaaugcacgccc

SEQ ID NO: 1178374 - RNA, 22 nt, Human
ugagccucuaggucaggacccu

SEQ ID NO: 1178375 - RNA, 19 nt, Human
ugcaaccgcuacucccgga

SEQ ID NO: 1178376 - RNA, 21 nt, Human
ugcccuggcuuucccaggcuc

SEQ ID NO: 1178377 - RNA, 18 nt, Human
ugccugaagcuuccacgc

SEQ ID NO: 1178378 - RNA, 19 nt, Human
ugcgcuaggcccacucagc

SEQ ID NO: 1178379 - RNA, 20 nt, Human
ugcuacaagcagaaguuccu

SEQ ID NO: 1178380 - RNA, 25 nt, Human
uggaaugaacaagccacuuggcccc

SEQ ID NO: 1178381 - RNA, 20 nt, Human
uggcagcuguccugguggau

SEQ ID NO: 1178382 - RNA, 23 nt, Human
ugggccagggguccccaacuggc

SEQ ID NO: 1178383 - RNA, 21 nt, Human
uucacagagaauucuacuugg

SEQ ID NO: 1178384 - RNA, 19 nt, Human
uuccacgccgcccugcugc

SEQ ID NO: 1178385 - RNA, 23 nt, Human
uuccuggacuucuguuuuuauua

SEQ ID NO: 1178386 - RNA, 21 nt, Human
uuucccaggcuccuuccuggg

SEQ ID NO: 1178387 - RNA, 24 nt, Human
uuugcaauuaaauuacuuaaaauu

SEQ ID NO: 1178388 - RNA, 21 nt, Human
uuuuggggggccuuuucagga

SEQ ID NO: 1178389 - RNA, 20 nt, Human
aacaaggcugcaccccaccc

SEQ ID NO: 1178390 - RNA, 23 nt, Human
aaccaacaaggcugcaccccacc

SEQ ID NO: 1178391 - RNA, 25 nt, Human
accccacccguuaucucccaagcua

SEQ ID NO: 1178392 - RNA, 20 nt, Human
acgcugcaaccaacaaggcu

SEQ ID NO: 1178393 - RNA, 19 nt, Human
aggcugcaccccacccguu

SEQ ID NO: 1178394 - RNA, 25 nt, Human
aucacagccacacacggcugccuug

SEQ ID NO: 1178395 - RNA, 22 nt, Human
cacacacggcugccaggcagcg

SEQ ID NO: 1178396 - RNA, 25 nt, Human
cacccguuaucucccaagcuaccuc

SEQ ID NO: 1178397 - RNA, 26 nt, Human
caccgggcacaggcagucacugccgg

SEQ ID NO: 1178398 - RNA, 20 nt, Human
cacgcugcaaccaacaaggc

SEQ ID NO: 1178399 - RNA, 23 nt, Human
cacucugucacccccagcaugca

SEQ ID NO: 1178400 - RNA, 19 nt, Human
cagccuguggcauuccugg

SEQ ID NO: 1178401 - RNA, 22 nt, Human
cagcgcagauagaauggcucuu

SEQ ID NO: 1178402 - RNA, 23 nt, Human
ccaagcuaccucuucacccccac

SEQ ID NO: 1178403 - RNA, 22 nt, Human
ccacauucuuccucuugcccca

SEQ ID NO: 1178404 - RNA, 24 nt, Human
ccagcaugcacgcugcaaccaaca

SEQ ID NO: 1178405 - RNA, 19 nt, Human
ccccaaaggucgcugcccu

SEQ ID NO: 1178406 - RNA, 23 nt, Human
ccccaaaggucgcugcccucacc

SEQ ID NO: 1178407 - RNA, 23 nt, Human
ccccacccguuaucucccaagcu

SEQ ID NO: 1178408 - RNA, 21 nt, Human
ccuaaagugccccacgaccga

SEQ ID NO: 1178409 - RNA, 23 nt, Human
cggcugccaggcagcgcagauag

SEQ ID NO: 1178410 - RNA, 23 nt, Human
cugcaaccaacaaggcugcaccc

SEQ ID NO: 1178411 - RNA, 21 nt, Human
cugccgggaucacagccacac

SEQ ID NO: 1178412 - RNA, 21 nt, Human
gcucuuuguccaccagccugu

SEQ ID NO: 1178413 - RNA, 23 nt, Human
ggcugcaccccacccguuaucuc

SEQ ID NO: 1178414 - RNA, 22 nt, Human
ucuuccucuugccccaaagguc

SEQ ID NO: 1178415 - RNA, 23 nt, Human
ugcaaccaacaaggcugcacccc

SEQ ID NO: 1178416 - RNA, 24 nt, Human
uucuuccucuugccccaaaggucg

SEQ ID NO: 1178417 - RNA, 21 nt, Human
uuguccaccagccuguggcau

SEQ ID NO: 1178418 - RNA, 23 nt, Human
aaacacacacauuagccuaagcc

SEQ ID NO: 1178419 - RNA, 25 nt, Human
aaacagaaguggcaaaaagcaugcc

SEQ ID NO: 1178420 - RNA, 22 nt, Human
aaacagaaguggcaaaagggac

SEQ ID NO: 1178421 - RNA, 21 nt, Human
aaagccucuugcccaaagcca

SEQ ID NO: 1178422 - RNA, 22 nt, Human
aaaucaacuucaaaucacugau

SEQ ID NO: 1178423 - RNA, 26 nt, Human
aaccuagaaacagaaguggcaaaaag

SEQ ID NO: 1178424 - RNA, 21 nt, Human
aaccucauuauccuuuucucc

SEQ ID NO: 1178425 - RNA, 23 nt, Human
aagacacaaacacacacauuagc

SEQ ID NO: 1178426 - RNA, 18 nt, Human
aagccucugacugaacag

SEQ ID NO: 1178427 - RNA, 22 nt, Human
aagcuaaugugcccacaaccac

SEQ ID NO: 1178428 - RNA, 21 nt, Human
acagggucaggaucaugaaga

SEQ ID NO: 1178429 - RNA, 21 nt, Human
accaauaucaaucccaauauu

SEQ ID NO: 1178430 - RNA, 21 nt, Human
agaaacagaaguggcaaaaag

SEQ ID NO: 1178431 - RNA, 21 nt, Human
agagaauucuccucugugcca

SEQ ID NO: 1178432 - RNA, 22 nt, Human
aggaaaaacuacagcaucaaaa

SEQ ID NO: 1178433 - RNA, 22 nt, Human
aggaauuucucagccccacugu

SEQ ID NO: 1178434 - RNA, 21 nt, Human
aggcugccacugucuccaagc

SEQ ID NO: 1178435 - RNA, 19 nt, Human
agggagggagcgcggccca

SEQ ID NO: 1178436 - RNA, 21 nt, Human
augcagccgccgcgaccgccc

SEQ ID NO: 1178437 - RNA, 19 nt, Human
caaagccaauuuaugacac

SEQ ID NO: 1178438 - RNA, 26 nt, Human
cacacacauuagccuaagccuacaca

SEQ ID NO: 1178439 - RNA, 23 nt, Human
caccuuuucuuccaacucaaagc

SEQ ID NO: 1178440 - RNA, 22 nt, Human
cagaguccuuccuagucuuccc

SEQ ID NO: 1178441 - RNA, 21 nt, Human
cagcaucaaaagaaccucauu

SEQ ID NO: 1178442 - RNA, 20 nt, Human
cagccgccgcgaccgccccg

SEQ ID NO: 1178443 - RNA, 18 nt, Human
caggaaaaacuacagcau

SEQ ID NO: 1178444 - RNA, 21 nt, Human
cauggccccgcuuucggaggc

SEQ ID NO: 1178445 - RNA, 23 nt, Human
cccaagaggcugccacugucucc

SEQ ID NO: 1178446 - RNA, 21 nt, Human
cccaagcacuuucuuuccacc

SEQ ID NO: 1178447 - RNA, 25 nt, Human
ccccggggacccaggcucccggagg

SEQ ID NO: 1178448 - RNA, 22 nt, Human
ccccuccccccgcggccuggcc

SEQ ID NO: 1178449 - RNA, 20 nt, Human
ccgcccccaagcacuuucuu

SEQ ID NO: 1178450 - RNA, 21 nt, Human
ccgcccccaagcacuuucuuu

SEQ ID NO: 1178451 - RNA, 18 nt, Human
ccgccgcgaccgccccgg

SEQ ID NO: 1178452 - RNA, 23 nt, Human
ccggagggggagggcacccaggu

SEQ ID NO: 1178453 - RNA, 21 nt, Human
ccgugccgcccccuccccccg

SEQ ID NO: 1178454 - RNA, 19 nt, Human
ccuacauuuugcuucucuu

SEQ ID NO: 1178455 - RNA, 19 nt, Human
ccucgcccgagcccggcuc

SEQ ID NO: 1178456 - RNA, 22 nt, Human
ccuuccaguccuaccuuccccg

SEQ ID NO: 1178457 - RNA, 18 nt, Human
cgaaaacguuuguugaga

SEQ ID NO: 1178458 - RNA, 23 nt, Human
cgcccccuccccccgcggccugg

SEQ ID NO: 1178459 - RNA, 18 nt, Human
cgccccgccucgcccgag

SEQ ID NO: 1178460 - RNA, 23 nt, Human
cgccccggggacccaggcucccg

SEQ ID NO: 1178461 - RNA, 19 nt, Human
cggaggcccgugccgcccc

SEQ ID NO: 1178462 - RNA, 23 nt, Human
cggcccccgggccuuccaguccu

SEQ ID NO: 1178463 - RNA, 19 nt, Human
cgggagggagcgggcggcc

SEQ ID NO: 1178464 - RNA, 23 nt, Human
cgggagggagcgggcggcccccg

SEQ ID NO: 1178465 - RNA, 19 nt, Human
cggggccuccgcccgagcc

SEQ ID NO: 1178466 - RNA, 22 nt, Human
cgugccgcccccuccccccgcg

SEQ ID NO: 1178467 - RNA, 19 nt, Human
cucccggagggggagggca

SEQ ID NO: 1178468 - RNA, 19 nt, Human
cucuugcccaaagccaauu

SEQ ID NO: 1178469 - RNA, 21 nt, Human
gagaauucuccucugugccaa

SEQ ID NO: 1178470 - RNA, 22 nt, Human
gagggcacccagguagggaggg

SEQ ID NO: 1178471 - RNA, 23 nt, Human
gccccgccucgcccgagcccggc

SEQ ID NO: 1178472 - RNA, 21 nt, Human
gccccgcuuucggaggcccgu

SEQ ID NO: 1178473 - RNA, 20 nt, Human
gccgcgaccgccccggggac

SEQ ID NO: 1178474 - RNA, 19 nt, Human
gcgcggcccaagaacuucg

SEQ ID NO: 1178475 - RNA, 22 nt, Human
gcggcccccgggccuuccaguc

SEQ ID NO: 1178476 - RNA, 20 nt, Human
ggacccaggcucccggaggg

SEQ ID NO: 1178477 - RNA, 19 nt, Human
ggagcgggcggcccccggg

SEQ ID NO: 1178478 - RNA, 18 nt, Human
ggccuggaagcgcuggca

SEQ ID NO: 1178479 - RNA, 23 nt, Human
gggccuuccaguccuaccuuccc

SEQ ID NO: 1178480 - RNA, 19 nt, Human
gggggcgguagcgccggug

SEQ ID NO: 1178481 - RNA, 20 nt, Human
gggggcgguagcgccggugg

SEQ ID NO: 1178482 - RNA, 21 nt, Human
guucaaugcaaaucacagauc

SEQ ID NO: 1178483 - RNA, 20 nt, Human
uaaaaccuaagacacaaacu

SEQ ID NO: 1178484 - RNA, 21 nt, Human
uaagaaacaauacucaagaac

SEQ ID NO: 1178485 - RNA, 19 nt, Human
uaagaaagccucugacuga

SEQ ID NO: 1178486 - RNA, 20 nt, Human
uacaugcaucacuguagcuu

SEQ ID NO: 1178487 - RNA, 20 nt, Human
uacucaagaacuggcagcaa

SEQ ID NO: 1178488 - RNA, 24 nt, Human
uacucaagaacuggcagcaaacaa

SEQ ID NO: 1178489 - RNA, 21 nt, Human
uagcgccgguggacccaggau

SEQ ID NO: 1178490 - RNA, 23 nt, Human
ucaaagccucuugcccaaagcca

SEQ ID NO: 1178491 - RNA, 22 nt, Human
ucagaguccuuccuagucuucc

SEQ ID NO: 1178492 - RNA, 18 nt, Human
uccagaaagauguuaguc

SEQ ID NO: 1178493 - RNA, 24 nt, Human
uccagaaagauguuagucccaaga

SEQ ID NO: 1178494 - RNA, 26 nt, Human
uccaugaaguacauaaccuagaaacc

SEQ ID NO: 1178495 - RNA, 24 nt, Human
ucccaagaggcugccacugucucc

SEQ ID NO: 1178496 - RNA, 20 nt, Human
uccccgacucucugggcucc

SEQ ID NO: 1178497 - RNA, 22 nt, Human
uccccgacucucugggcuccau

SEQ ID NO: 1178498 - RNA, 23 nt, Human
uccuauuuauccucauacuucca

SEQ ID NO: 1178499 - RNA, 21 nt, Human
uccucauacuuccagcaucuc

SEQ ID NO: 1178500 - RNA, 21 nt, Human
uccucauacuuccagcaucuc

SEQ ID NO: 1178501 - RNA, 20 nt, Human
ucgcucucucacgucggggg

SEQ ID NO: 1178502 - RNA, 18 nt, Human
ucucugggcuccauggcc

SEQ ID NO: 1178503 - RNA, 18 nt, Human
ucuuggaugacacggccu

SEQ ID NO: 1178504 - RNA, 19 nt, Human
ugaacuccgcccccaagcc

SEQ ID NO: 1178505 - RNA, 21 nt, Human
ugagagaauucuccucugugc

SEQ ID NO: 1178506 - RNA, 21 nt, Human
ugcccagauauuccaugaagu

SEQ ID NO: 1178507 - RNA, 18 nt, Human
uggcaaaaagcaugccag

SEQ ID NO: 1178508 - RNA, 21 nt, Human
uggcagcaaacaacauccaga

SEQ ID NO: 1178509 - RNA, 22 nt, Human
uggcagcaaacaacauccagaa

SEQ ID NO: 1178510 - RNA, 25 nt, Human
uggcuuggaccacguacucuguagg

SEQ ID NO: 1178511 - RNA, 20 nt, Human
uguuauacagcgcaugaccg

SEQ ID NO: 1178512 - RNA, 21 nt, Human
uguugagagaauucuccucug

SEQ ID NO: 1178513 - RNA, 23 nt, Human
uguugagagaauucuccucugug

SEQ ID NO: 1178514 - RNA, 18 nt, Human
uuagucccaagaggcugc

SEQ ID NO: 1178515 - RNA, 21 nt, Human
uuccccgacucucugggcucc

SEQ ID NO: 1178516 - RNA, 22 nt, Human
uucucagccccacuguagucuc

SEQ ID NO: 1178517 - RNA, 20 nt, Human
uucucuuuauucaaauucag

SEQ ID NO: 1178518 - RNA, 21 nt, Human
aaaaggccuugccuauaaccc

SEQ ID NO: 1178519 - RNA, 18 nt, Human
aaaccugcacugugcucg

SEQ ID NO: 1178520 - RNA, 20 nt, Human
aaagaccccuggagcuuggg

SEQ ID NO: 1178521 - RNA, 21 nt, Human
aaauccacccccacugcagcc

SEQ ID NO: 1178522 - RNA, 20 nt, Human
aacacccuuacccaacagga

SEQ ID NO: 1178523 - RNA, 19 nt, Human
aagaccccuggagcuuggg

SEQ ID NO: 1178524 - RNA, 20 nt, Human
aaugcccgcugaacaggaug

SEQ ID NO: 1178525 - RNA, 21 nt, Human
acacagcaaagggugccaaca

SEQ ID NO: 1178526 - RNA, 19 nt, Human
acgcagcgggagggcgguc

SEQ ID NO: 1178527 - RNA, 18 nt, Human
agaaaggccccagcggcg

SEQ ID NO: 1178528 - RNA, 21 nt, Human
agagggaguguagggggagga

SEQ ID NO: 1178529 - RNA, 20 nt, Human
agcaggaugguggcagagcu

SEQ ID NO: 1178530 - RNA, 20 nt, Human
agcccaagucagagccaaac

SEQ ID NO: 1178531 - RNA, 22 nt, Human
agcgugagggcaaggcuggaga

SEQ ID NO: 1178532 - RNA, 21 nt, Human
aggaccugccuaggagcccac

SEQ ID NO: 1178533 - RNA, 20 nt, Human
aggcccccccaguucccagc

SEQ ID NO: 1178534 - RNA, 19 nt, Human
aggcuggggucgggggagg

SEQ ID NO: 1178535 - RNA, 19 nt, Human
agggagguccagguggcag

SEQ ID NO: 1178536 - RNA, 19 nt, Human
agggcaaggcuggagaggu

SEQ ID NO: 1178537 - RNA, 19 nt, Human
aggguccgcgucagccccg

SEQ ID NO: 1178538 - RNA, 22 nt, Human
agggugccaacaucuaggacug

SEQ ID NO: 1178539 - RNA, 24 nt, Human
agguuuucagcacaagucacacuc

SEQ ID NO: 1178540 - RNA, 18 nt, Human
auacucugaggagacaca

SEQ ID NO: 1178541 - RNA, 20 nt, Human
auccacccccacugcagcca

SEQ ID NO: 1178542 - RNA, 23 nt, Human
auccuauucuccugcugcuccaa

SEQ ID NO: 1178543 - RNA, 20 nt, Human
caaaagcccaagucagagcc

SEQ ID NO: 1178544 - RNA, 22 nt, Human
caaaagcccaagucagagccaa

SEQ ID NO: 1178545 - RNA, 23 nt, Human
caaaagcccaagucagagccaaa

SEQ ID NO: 1178546 - RNA, 19 nt, Human
caacaggaggggcgacgga

SEQ ID NO: 1178547 - RNA, 20 nt, Human
cacagagcccagggccaggg

SEQ ID NO: 1178548 - RNA, 21 nt, Human
cacgccgcauucuuauuucca

SEQ ID NO: 1178549 - RNA, 18 nt, Human
cacucaacacccuuaccc

SEQ ID NO: 1178550 - RNA, 21 nt, Human
cagagcccagggccagggggc

SEQ ID NO: 1178551 - RNA, 20 nt, Human
cagccugagcccugagcagc

SEQ ID NO: 1178552 - RNA, 23 nt, Human
cagggggcagagggcggggcugg

SEQ ID NO: 1178553 - RNA, 23 nt, Human
cauccuauucuccugcugcucca

SEQ ID NO: 1178554 - RNA, 19 nt, Human
caucuggacccacaugacu

SEQ ID NO: 1178555 - RNA, 24 nt, Human
ccaauagaggcccccccaguuccc

SEQ ID NO: 1178556 - RNA, 19 nt, Human
ccacugagggagguccagg

SEQ ID NO: 1178557 - RNA, 25 nt, Human
ccagcggucuuucggggcguccccu

SEQ ID NO: 1178558 - RNA, 20 nt, Human
ccaggacuagcgagcggcgg

SEQ ID NO: 1178559 - RNA, 19 nt, Human
ccaggcaaggugggugagc

SEQ ID NO: 1178560 - RNA, 19 nt, Human
ccagggccagggggcagag

SEQ ID NO: 1178561 - RNA, 20 nt, Human
ccagggccagggggcagagg

SEQ ID NO: 1178562 - RNA, 21 nt, Human
ccaugagaggcucugaaaucc

SEQ ID NO: 1178563 - RNA, 19 nt, Human
cccacaugacuauguugcu

SEQ ID NO: 1178564 - RNA, 26 nt, Human
cccagccugagcccugagcagcuggc

SEQ ID NO: 1178565 - RNA, 18 nt, Human
cccauagcgccacucaca

SEQ ID NO: 1178566 - RNA, 21 nt, Human
ccccagccugagcccugagca

SEQ ID NO: 1178567 - RNA, 21 nt, Human
ccccauucuucaccaucccua

SEQ ID NO: 1178568 - RNA, 23 nt, Human
ccccauucuucaccaucccuagc

SEQ ID NO: 1178569 - RNA, 21 nt, Human
cccccacugcagccaaaagcc

SEQ ID NO: 1178570 - RNA, 24 nt, Human
cccccacugcagccaaaagcccaa

SEQ ID NO: 1178571 - RNA, 20 nt, Human
cccccauucuucaccauccc

SEQ ID NO: 1178572 - RNA, 25 nt, Human
ccccuggagcaccagugaggacagg

SEQ ID NO: 1178573 - RNA, 23 nt, Human
cccgcagccugggccgccccgaa

SEQ ID NO: 1178574 - RNA, 18 nt, Human
cccgcgcccgcacagcca

SEQ ID NO: 1178575 - RNA, 21 nt, Human
cccgcugaacaggauggcagg

SEQ ID NO: 1178576 - RNA, 21 nt, Human
ccgcacagccaacgucacgcc

SEQ ID NO: 1178577 - RNA, 23 nt, Human
ccgcauucuuauuuccaaagacc

SEQ ID NO: 1178578 - RNA, 26 nt, Human
ccuauaacccaauagaggccccccca

SEQ ID NO: 1178579 - RNA, 22 nt, Human
ccuauucuccugcugcuccaaa

SEQ ID NO: 1178580 - RNA, 21 nt, Human
ccucagcacgcguucuccuca

SEQ ID NO: 1178581 - RNA, 18 nt, Human
ccugggccgccccgaacc

SEQ ID NO: 1178582 - RNA, 22 nt, Human
cgcacagccaacgucacgccgc

SEQ ID NO: 1178583 - RNA, 20 nt, Human
cggcccgaagcgcccugcgg

SEQ ID NO: 1178584 - RNA, 23 nt, Human
cggccgggccggcguucagggac

SEQ ID NO: 1178585 - RNA, 23 nt, Human
cggcgcagccagaaaggccccag

SEQ ID NO: 1178586 - RNA, 21 nt, Human
cggcgggcgcggaccggggcc

SEQ ID NO: 1178587 - RNA, 24 nt, Human
cggcguucagggacccggcgggag

SEQ ID NO: 1178588 - RNA, 18 nt, Human
cguucuccucacucccag

SEQ ID NO: 1178589 - RNA, 21 nt, Human
cguuucuuccccuggagcacc

SEQ ID NO: 1178590 - RNA, 19 nt, Human
cucccaggacuagcgagcg

SEQ ID NO: 1178591 - RNA, 21 nt, Human
cucugcuucaacauuuucaga

SEQ ID NO: 1178592 - RNA, 22 nt, Human
cugcguguugcuucccacuccu

SEQ ID NO: 1178593 - RNA, 18 nt, Human
cugcuuuccuccuucggc

SEQ ID NO: 1178594 - RNA, 20 nt, Human
cugucccucuggccgggucc

SEQ ID NO: 1178595 - RNA, 21 nt, Human
cugucccucuggccggguccu

SEQ ID NO: 1178596 - RNA, 21 nt, Human
gaaccagguuuucagcacaag

SEQ ID NO: 1178597 - RNA, 21 nt, Human
gaauguuucucugcuucaaca

SEQ ID NO: 1178598 - RNA, 21 nt, Human
gacccgcagccugggccgccc

SEQ ID NO: 1178599 - RNA, 23 nt, Human
gagacacagcaaagggugccaac

SEQ ID NO: 1178600 - RNA, 20 nt, Human
gagacgcagcgggagggcgg

SEQ ID NO: 1178601 - RNA, 23 nt, Human
gagcacccucuccaugaggacac

SEQ ID NO: 1178602 - RNA, 20 nt, Human
gagcagcuggccagccagga

SEQ ID NO: 1178603 - RNA, 24 nt, Human
gaggcggcgcagccagaaaggccc

SEQ ID NO: 1178604 - RNA, 18 nt, Human
gagggcaaggcuggagag

SEQ ID NO: 1178605 - RNA, 24 nt, Human
gaugucaaugggaggccccagccu

SEQ ID NO: 1178606 - RNA, 23 nt, Human
gcccaagucagagccaaaccugc

SEQ ID NO: 1178607 - RNA, 21 nt, Human
gcccccauucuucaccauccc

SEQ ID NO: 1178608 - RNA, 20 nt, Human
gcgcagccagaaaggcccca

SEQ ID NO: 1178609 - RNA, 18 nt, Human
gcgcggaccggggccugg

SEQ ID NO: 1178610 - RNA, 21 nt, Human
gcggaccggggccuggggucg

SEQ ID NO: 1178611 - RNA, 21 nt, Human
gcggcgcagccagaaaggccc

SEQ ID NO: 1178612 - RNA, 18 nt, Human
gcucaggagcagggcugg

SEQ ID NO: 1178613 - RNA, 21 nt, Human
gcuuggggucccaccccagcg

SEQ ID NO: 1178614 - RNA, 18 nt, Human
ggaccggccgggccggcg

SEQ ID NO: 1178615 - RNA, 18 nt, Human
ggagcaccagugaggaca

SEQ ID NO: 1178616 - RNA, 19 nt, Human
ggaggaugucaaugggagg

SEQ ID NO: 1178617 - RNA, 24 nt, Human
ggcaaggugggugagcucugugcu

SEQ ID NO: 1178618 - RNA, 23 nt, Human
ggcgacggaggcucagagaggga

SEQ ID NO: 1178619 - RNA, 21 nt, Human
gggaggccccagccugagccc

SEQ ID NO: 1178620 - RNA, 20 nt, Human
gggcagagggcggggcuggc

SEQ ID NO: 1178621 - RNA, 22 nt, Human
gggcagagggcggggcuggcuc

SEQ ID NO: 1178622 - RNA, 20 nt, Human
gggccgcggacagagagaaa

SEQ ID NO: 1178623 - RNA, 19 nt, Human
gugagggcaaggcuggaga

SEQ ID NO: 1178624 - RNA, 19 nt, Human
guuugggggaaggcggggg

SEQ ID NO: 1178625 - RNA, 20 nt, Human
ucaaaaaucccuaucuucug

SEQ ID NO: 1178626 - RNA, 21 nt, Human
ucacaucuagacgugucagaa

SEQ ID NO: 1178627 - RNA, 24 nt, Human
ucacauugccccuuccccucucuc

SEQ ID NO: 1178628 - RNA, 21 nt, Human
ucagagccaaaccugcacugu

SEQ ID NO: 1178629 - RNA, 23 nt, Human
ucccauagcgccacucacauugc

SEQ ID NO: 1178630 - RNA, 20 nt, Human
uccccuggagcaccagugag

SEQ ID NO: 1178631 - RNA, 23 nt, Human
uccccuggagcaccagugaggac

SEQ ID NO: 1178632 - RNA, 20 nt, Human
ucugaaauccacccccacug

SEQ ID NO: 1178633 - RNA, 20 nt, Human
ucugaggagacacagcaaag

SEQ ID NO: 1178634 - RNA, 19 nt, Human
ugacuccuugcgucaguag

SEQ ID NO: 1178635 - RNA, 21 nt, Human
ugagacguuugggggaaggcg

SEQ ID NO: 1178636 - RNA, 21 nt, Human
ugcagccaaaagcccaaguca

SEQ ID NO: 1178637 - RNA, 19 nt, Human
ugccaggcuggcacgcccc

SEQ ID NO: 1178638 - RNA, 26 nt, Human
ugccuauaacccaauagaggcccccc

SEQ ID NO: 1178639 - RNA, 26 nt, Human
ugcuuuccuccuucggcguuuggauc

SEQ ID NO: 1178640 - RNA, 19 nt, Human
uggagcuuggggucccacc

SEQ ID NO: 1178641 - RNA, 25 nt, Human
uggcagagcugcugacugggcacug

SEQ ID NO: 1178642 - RNA, 20 nt, Human
ugggagccaggcaagguggg

SEQ ID NO: 1178643 - RNA, 19 nt, Human
ugggggaaggcgggggcuu

SEQ ID NO: 1178644 - RNA, 19 nt, Human
uggggucgggggagggaag

SEQ ID NO: 1178645 - RNA, 21 nt, Human
uggggucgggggagggaagac

SEQ ID NO: 1178646 - RNA, 24 nt, Human
uuaaaugaauaggcauguggaaag

SEQ ID NO: 1178647 - RNA, 19 nt, Human
uuacagaucaguggccucc

SEQ ID NO: 1178648 - RNA, 18 nt, Human
uuccaucagggcuggaag

SEQ ID NO: 1178649 - RNA, 24 nt, Human
uuccccuggagcaccagugaggac

SEQ ID NO: 1178650 - RNA, 22 nt, Human
uuccuccuucggcguuuggauc

SEQ ID NO: 1178651 - RNA, 26 nt, Human
aaaacaagaaaacacaaggacaaacc

SEQ ID NO: 1178652 - RNA, 24 nt, Human
aaaacacaaggacaaacccuacug

SEQ ID NO: 1178653 - RNA, 21 nt, Human
aaacaaaacaagaaaacacaa

SEQ ID NO: 1178654 - RNA, 22 nt, Human
aaacauggaacaugggagaaaa

SEQ ID NO: 1178655 - RNA, 20 nt, Human
aaagcauggggaguggcauc

SEQ ID NO: 1178656 - RNA, 24 nt, Human
aaagugcugggauuacaggcguga

SEQ ID NO: 1178657 - RNA, 24 nt, Human
aaagugcugggauuacagguguga

SEQ ID NO: 1178658 - RNA, 20 nt, Human
aagaaugggacuagcgcccu

SEQ ID NO: 1178659 - RNA, 20 nt, Human
aagacggccaagugcuuuuc

SEQ ID NO: 1178660 - RNA, 18 nt, Human
aagagacagagaaggcca

SEQ ID NO: 1178661 - RNA, 19 nt, Human
aagcccacaagaaugggac

SEQ ID NO: 1178662 - RNA, 19 nt, Human
aaguagcugggacuacagg

SEQ ID NO: 1178663 - RNA, 20 nt, Human
aaguagcugggacuacaggc

SEQ ID NO: 1178664 - RNA, 25 nt, Human
aaguagcugggacuacaggcgcccg

SEQ ID NO: 1178665 - RNA, 18 nt, Human
aagugcugggauuacagg

SEQ ID NO: 1178666 - RNA, 19 nt, Human
aagugcugggauuacaggc

SEQ ID NO: 1178667 - RNA, 19 nt, Human
aagugcugggauuacaggc

SEQ ID NO: 1178668 - RNA, 26 nt, Human
aagugcugggauuacaggcgugagcc

SEQ ID NO: 1178669 - RNA, 19 nt, Human
aagugcugggauuacaggu

SEQ ID NO: 1178670 - RNA, 26 nt, Human
aagugcugggauuacaggugugagcc

SEQ ID NO: 1178671 - RNA, 22 nt, Human
aauuuuugacauaaggcaauuu

SEQ ID NO: 1178672 - RNA, 18 nt, Human
acaaaacaagaaaacaca

SEQ ID NO: 1178673 - RNA, 19 nt, Human
acaaaacaagaaaacacaa

SEQ ID NO: 1178674 - RNA, 19 nt, Human
acacagcgagaagccaucc

SEQ ID NO: 1178675 - RNA, 20 nt, Human
acagcgagaagccauccucu

SEQ ID NO: 1178676 - RNA, 21 nt, Human
acagcgagaagccauccucug

SEQ ID NO: 1178677 - RNA, 18 nt, Human
acaggguuucaccauguu

SEQ ID NO: 1178678 - RNA, 19 nt, Human
acaggguuucaccauguua

SEQ ID NO: 1178679 - RNA, 20 nt, Human
acaggguuucaccauguuag

SEQ ID NO: 1178680 - RNA, 24 nt, Human
acaggguuucaccauguuagccag

SEQ ID NO: 1178681 - RNA, 19 nt, Human
acccaggcuggaguacagu

SEQ ID NO: 1178682 - RNA, 25 nt, Human
acccgccucagccucccaaagugcu

SEQ ID NO: 1178683 - RNA, 18 nt, Human
acgccaugcuccugcuuc

SEQ ID NO: 1178684 - RNA, 18 nt, Human
acgggguuucaccauguu

SEQ ID NO: 1178685 - RNA, 19 nt, Human
acgggguuucaccauguua

SEQ ID NO: 1178686 - RNA, 20 nt, Human
acgggguuucaccauguuag

SEQ ID NO: 1178687 - RNA, 24 nt, Human
acgggguuucaccauguuagccag

SEQ ID NO: 1178688 - RNA, 18 nt, Human
acugcaagcucugccucc

SEQ ID NO: 1178689 - RNA, 20 nt, Human
acugcaagcucugccuccca

SEQ ID NO: 1178690 - RNA, 20 nt, Human
agaaacagugaaggugucag

SEQ ID NO: 1178691 - RNA, 21 nt, Human
agacagcaaaucaacuccaga

SEQ ID NO: 1178692 - RNA, 22 nt, Human
agacgagggaguuaacaaggga

SEQ ID NO: 1178693 - RNA, 22 nt, Human
agaggaaaagaaagcaugggga

SEQ ID NO: 1178694 - RNA, 24 nt, Human
agcacauuaggguguauucggggg

SEQ ID NO: 1178695 - RNA, 19 nt, Human
aggagguggacuuugggag

SEQ ID NO: 1178696 - RNA, 20 nt, Human
aggcaggcagccacccaugu

SEQ ID NO: 1178697 - RNA, 20 nt, Human
aggcuggcaggcaggcagcc

SEQ ID NO: 1178698 - RNA, 19 nt, Human
aggggucagaggcaucagg

SEQ ID NO: 1178699 - RNA, 21 nt, Human
aguacaguggugcgaucucag

SEQ ID NO: 1178700 - RNA, 24 nt, Human
aguacaguggugcgaucucagcuc

SEQ ID NO: 1178701 - RNA, 18 nt, Human
aguagcugggacuacagg

SEQ ID NO: 1178702 - RNA, 19 nt, Human
aguagcugggacuacaggc

SEQ ID NO: 1178703 - RNA, 24 nt, Human
aguggcgugaucucagcucacugc

SEQ ID NO: 1178704 - RNA, 22 nt, Human
aguggucuguggacugcauggc

SEQ ID NO: 1178705 - RNA, 24 nt, Human
aguggugcgaucucagcucacugc

SEQ ID NO: 1178706 - RNA, 19 nt, Human
aguguaguggcgugaucuc

SEQ ID NO: 1178707 - RNA, 21 nt, Human
aguguaguggcgugaucucag

SEQ ID NO: 1178708 - RNA, 24 nt, Human
aguguaguggcgugaucucagcuc

SEQ ID NO: 1178709 - RNA, 24 nt, Human
auaaagcccacaagaaugggacuu

SEQ ID NO: 1178710 - RNA, 24 nt, Human
augauccaccuaccucagccuccc

SEQ ID NO: 1178711 - RNA, 21 nt, Human
augcuccugcuucagccuccc

SEQ ID NO: 1178712 - RNA, 20 nt, Human
augguguggucggagcugcu

SEQ ID NO: 1178713 - RNA, 23 nt, Human
caaaacaagaaaacacaaggaca

SEQ ID NO: 1178714 - RNA, 24 nt, Human
caaagugcugggauuacaggcgug

SEQ ID NO: 1178715 - RNA, 24 nt, Human
caaagugcugggauuacaggugug

SEQ ID NO: 1178716 - RNA, 22 nt, Human
caaguaaguuaacaugaccaaa

SEQ ID NO: 1178717 - RNA, 20 nt, Human
cacacagugucaggggucag

SEQ ID NO: 1178718 - RNA, 18 nt, Human
caccauguuagccaggau

SEQ ID NO: 1178719 - RNA, 18 nt, Human
caccauguuagccaggau

SEQ ID NO: 1178720 - RNA, 22 nt, Human
caccauguuagccaggaugguc

SEQ ID NO: 1178721 - RNA, 22 nt, Human
caccauguuagccaggaugguc

SEQ ID NO: 1178722 - RNA, 24 nt, Human
caccauguuagccaggauggucuc

SEQ ID NO: 1178723 - RNA, 24 nt, Human
caccauguuagccaggauggucuc

SEQ ID NO: 1178724 - RNA, 18 nt, Human
caccccuuccaccacaug

SEQ ID NO: 1178725 - RNA, 23 nt, Human
cacccgccucagccucccaaagu

SEQ ID NO: 1178726 - RNA, 23 nt, Human
caccuaccucagccucccaaagu

SEQ ID NO: 1178727 - RNA, 22 nt, Human
caccugggcagcccaugggagc

SEQ ID NO: 1178728 - RNA, 22 nt, Human
cacgccauucuccugccucagc

SEQ ID NO: 1178729 - RNA, 23 nt, Human
cacugcaagcucugccucccggg

SEQ ID NO: 1178730 - RNA, 19 nt, Human
cagaaugcagaagacggcc

SEQ ID NO: 1178731 - RNA, 21 nt, Human
cagaaugcagaagacggccaa

SEQ ID NO: 1178732 - RNA, 18 nt, Human
cagcgagaagccauccuc

SEQ ID NO: 1178733 - RNA, 22 nt, Human
caggcagccacccauguuuccg

SEQ ID NO: 1178734 - RNA, 20 nt, Human
caggcgcccgccaccgcgcc

SEQ ID NO: 1178735 - RNA, 24 nt, Human
caggguuucaccauguuagccagg

SEQ ID NO: 1178736 - RNA, 19 nt, Human
caucugaaaaccacaacag

SEQ ID NO: 1178737 - RNA, 24 nt, Human
caugauccaccuaccucagccucc

SEQ ID NO: 1178738 - RNA, 22 nt, Human
ccaaaaaaaauguuuagaaaca

SEQ ID NO: 1178739 - RNA, 21 nt, Human
ccaaagugcugggauuacagg

SEQ ID NO: 1178740 - RNA, 21 nt, Human
ccaaagugcugggauuacagg

SEQ ID NO: 1178741 - RNA, 22 nt, Human
ccaaagugcugggauuacaggc

SEQ ID NO: 1178742 - RNA, 22 nt, Human
ccaaagugcugggauuacaggc

SEQ ID NO: 1178743 - RNA, 24 nt, Human
ccaaagugcugggauuacaggcgu

SEQ ID NO: 1178744 - RNA, 24 nt, Human
ccaaagugcugggauuacaggugu

SEQ ID NO: 1178745 - RNA, 26 nt, Human
ccacccgccucagccucccaaagugc

SEQ ID NO: 1178746 - RNA, 26 nt, Human
ccaccuaccucagccucccaaagugc

SEQ ID NO: 1178747 - RNA, 22 nt, Human
ccagaagucucuguucaucuga

SEQ ID NO: 1178748 - RNA, 23 nt, Human
cccaaguagcugggacuacaggc

SEQ ID NO: 1178749 - RNA, 24 nt, Human
cccaaguagcugggacuacaggcg

SEQ ID NO: 1178750 - RNA, 22 nt, Human
cccaccgugccggacucucaga

SEQ ID NO: 1178751 - RNA, 22 nt, Human
cccagaaugcagaagacggcca

SEQ ID NO: 1178752 - RNA, 23 nt, Human
cccaugggagcaccggccggugg

SEQ ID NO: 1178753 - RNA, 20 nt, Human
ccccaccgugccggacucuc

SEQ ID NO: 1178754 - RNA, 18 nt, Human
ccccucaccccuuccacc

SEQ ID NO: 1178755 - RNA, 23 nt, Human
cccgaguagcugggacuacaggc

SEQ ID NO: 1178756 - RNA, 24 nt, Human
cccgaguagcugggacuacaggcg

SEQ ID NO: 1178757 - RNA, 26 nt, Human
cccucaccccuuccaccaaucgguug

SEQ ID NO: 1178758 - RNA, 24 nt, Human
ccgccucagccucccaaagugcug

SEQ ID NO: 1178759 - RNA, 24 nt, Human
ccgguggugacgaagcaccaugca

SEQ ID NO: 1178760 - RNA, 21 nt, Human
ccuacugugaagcaguggaga

SEQ ID NO: 1178761 - RNA, 23 nt, Human
ccucccauaaguaaggccagagu

SEQ ID NO: 1178762 - RNA, 22 nt, Human
ccugaccucaugauccaccuac

SEQ ID NO: 1178763 - RNA, 20 nt, Human
ccugaccucgugauccaccc

SEQ ID NO: 1178764 - RNA, 23 nt, Human
ccugccucagccucccgaguagc

SEQ ID NO: 1178765 - RNA, 24 nt, Human
ccugcuucagccucccaaguagcu

SEQ ID NO: 1178766 - RNA, 18 nt, Human
cgaagcaccaugcagugg

SEQ ID NO: 1178767 - RNA, 22 nt, Human
cgaagcaccaugcaguggucug

SEQ ID NO: 1178768 - RNA, 24 nt, Human
cgagaacaagcagggagaacaaau

SEQ ID NO: 1178769 - RNA, 24 nt, Human
cgggguuucaccauguuagccagg

SEQ ID NO: 1178770 - RNA, 24 nt, Human
cgugauccacccgccucagccucc

SEQ ID NO: 1178771 - RNA, 24 nt, Human
cucacugcaagcucugccucccgg

SEQ ID NO: 1178772 - RNA, 24 nt, Human
cucagccucccgaguagcugggac

SEQ ID NO: 1178773 - RNA, 21 nt, Human
cucagucacccaggcuggagu

SEQ ID NO: 1178774 - RNA, 21 nt, Human
cucccggguucacgccauucu

SEQ ID NO: 1178775 - RNA, 18 nt, Human
cuccugaccucaugaucc

SEQ ID NO: 1178776 - RNA, 24 nt, Human
cuccugaccucgugauccacccgc

SEQ ID NO: 1178777 - RNA, 22 nt, Human
cuccugccucagccucccgagu

SEQ ID NO: 1178778 - RNA, 20 nt, Human
cucugucacccagguuggag

SEQ ID NO: 1178779 - RNA, 23 nt, Human
cugccucagccucccgaguagcu

SEQ ID NO: 1178780 - RNA, 23 nt, Human
cuguggacugcauggcucugucc

SEQ ID NO: 1178781 - RNA, 21 nt, Human
cugugggucaggaagccacau

SEQ ID NO: 1178782 - RNA, 25 nt, Human
cuucagccucccaaguagcugggac

SEQ ID NO: 1178783 - RNA, 22 nt, Human
cuuccaccacaugaggacacag

SEQ ID NO: 1178784 - RNA, 24 nt, Human
cuuucuuuuuuuguuugagaugga

SEQ ID NO: 1178785 - RNA, 21 nt, Human
gaaaggagaggagggagagga

SEQ ID NO: 1178786 - RNA, 20 nt, Human
gaacaugggagaaaacaagu

SEQ ID NO: 1178787 - RNA, 18 nt, Human
gaagaaaagggccuccca

SEQ ID NO: 1178788 - RNA, 19 nt, Human
gaagaagggacaaaccacc

SEQ ID NO: 1178789 - RNA, 21 nt, Human
gaccccucaccccuuccacca

SEQ ID NO: 1178790 - RNA, 22 nt, Human
gaccucaugauccaccuaccuc

SEQ ID NO: 1178791 - RNA, 22 nt, Human
gaccucgugauccacccgccuc

SEQ ID NO: 1178792 - RNA, 24 nt, Human
gaccucgugauccacccgccucag

SEQ ID NO: 1178793 - RNA, 24 nt, Human
gacuacaggcgcccgccaccaugc

SEQ ID NO: 1178794 - RNA, 27 nt, Human
gagaacaagcagggagaaccgguaccc

SEQ ID NO: 1178795 - RNA, 24 nt, Human
gagacgggguuucaccauguuagc

SEQ ID NO: 1178796 - RNA, 22 nt, Human
gaggaggagcugaaggaagaua

SEQ ID NO: 1178797 - RNA, 22 nt, Human
gagguggcagugugaggauggu

SEQ ID NO: 1178798 - RNA, 25 nt, Human
gaguagcugggacuacaggcgcccg

SEQ ID NO: 1178799 - RNA, 19 nt, Human
gagugauuagguggugaga

SEQ ID NO: 1178800 - RNA, 19 nt, Human
gauacuggaagaggaaagg

SEQ ID NO: 1178801 - RNA, 18 nt, Human
gauuacaggcgugagcca

SEQ ID NO: 1178802 - RNA, 21 nt, Human
gauuacaggcgugagccacca

SEQ ID NO: 1178803 - RNA, 24 nt, Human
gauuacaggcgugagccaccaugc

SEQ ID NO: 1178804 - RNA, 18 nt, Human
gauuacaggugugagcca

SEQ ID NO: 1178805 - RNA, 21 nt, Human
gauuacaggugugagccacug

SEQ ID NO: 1178806 - RNA, 24 nt, Human
gauuacaggugugagccacugugc

SEQ ID NO: 1178807 - RNA, 19 nt, Human
gcaaaucaacuccagaagu

SEQ ID NO: 1178808 - RNA, 22 nt, Human
gcaagcucugccucccagguuc

SEQ ID NO: 1178809 - RNA, 20 nt, Human
gcagaagacggccaagugcu

SEQ ID NO: 1178810 - RNA, 18 nt, Human
gcaggcagccacccaugu

SEQ ID NO: 1178811 - RNA, 24 nt, Human
gcccagcuauuuuuuuuguauuuu

SEQ ID NO: 1178812 - RNA, 23 nt, Human
gccucagccucccaaagugcugg

SEQ ID NO: 1178813 - RNA, 25 nt, Human
gccucccggguucacgccauucucc

SEQ ID NO: 1178814 - RNA, 19 nt, Human
gccugggcaccugggcagc

SEQ ID NO: 1178815 - RNA, 18 nt, Human
gcuauaauaagcaaacuc

SEQ ID NO: 1178816 - RNA, 19 nt, Human
gcucugucacccagguugg

SEQ ID NO: 1178817 - RNA, 22 nt, Human
ggaaaggagaggagggagagga

SEQ ID NO: 1178818 - RNA, 20 nt, Human
ggaagaaaagggccucccau

SEQ ID NO: 1178819 - RNA, 21 nt, Human
ggaagaggaaaggagaggagg

SEQ ID NO: 1178820 - RNA, 24 nt, Human
ggagguggcagugugaggauggug

SEQ ID NO: 1178821 - RNA, 24 nt, Human
ggauuacaggcgugagccaccaug

SEQ ID NO: 1178822 - RNA, 18 nt, Human
gggaagagacagagaagg

SEQ ID NO: 1178823 - RNA, 21 nt, Human
gggagugauuagguggugaga

SEQ ID NO: 1178824 - RNA, 23 nt, Human
gggguuucaccauguuagccagg

SEQ ID NO: 1178825 - RNA, 20 nt, Human
ggucucgaucuccugaccuc

SEQ ID NO: 1178826 - RNA, 20 nt, Human
ggucucgaucuccugaccuc

SEQ ID NO: 1178827 - RNA, 22 nt, Human
gguuggaguguaguggcgugau

SEQ ID NO: 1178828 - RNA, 24 nt, Human
gguuucaccauguuagccaggaug

SEQ ID NO: 1178829 - RNA, 24 nt, Human
gguuucaccauguuagccaggaug

SEQ ID NO: 1178830 - RNA, 23 nt, Human
guagagacgggguuucaccaugu

SEQ ID NO: 1178831 - RNA, 27 nt, Human
guauguggcaguguuuccucuuaguag

SEQ ID NO: 1178832 - RNA, 22 nt, Human
gugaagaaaggaagagggcuug

SEQ ID NO: 1178833 - RNA, 24 nt, Human
gugauccacccgccucagccuccc

SEQ ID NO: 1178834 - RNA, 22 nt, Human
uaaagacaggguuucaccaugu

SEQ ID NO: 1178835 - RNA, 25 nt, Human
uaacaugaccaaaaaaaauguuuag

SEQ ID NO: 1178836 - RNA, 22 nt, Human
uaagaaccccacacaaauguca

SEQ ID NO: 1178837 - RNA, 22 nt, Human
uaaggccagaguugugggcauu

SEQ ID NO: 1178838 - RNA, 19 nt, Human
uaauuuuuugcauuuuuag

SEQ ID NO: 1178839 - RNA, 20 nt, Human
uacaacaaaucucuuuugca

SEQ ID NO: 1178840 - RNA, 21 nt, Human
uacaacaaaucucuuuugcau

SEQ ID NO: 1178841 - RNA, 24 nt, Human
uacaggcgugagccaccaugccca

SEQ ID NO: 1178842 - RNA, 23 nt, Human
uacaggugugagccacugugccc

SEQ ID NO: 1178843 - RNA, 24 nt, Human
uacaggugugagccacugugccca

SEQ ID NO: 1178844 - RNA, 24 nt, Human
uaccucagccucccaaagugcugg

SEQ ID NO: 1178845 - RNA, 22 nt, Human
uagagacgggguuucaccaugu

SEQ ID NO: 1178846 - RNA, 24 nt, Human
uaguaaagacaggguuucaccaug

SEQ ID NO: 1178847 - RNA, 26 nt, Human
uaguaaagacaggguuucaccauguu

SEQ ID NO: 1178848 - RNA, 24 nt, Human
uaguagagacgggguuucaccaug

SEQ ID NO: 1178849 - RNA, 26 nt, Human
uaguagagacgggguuucaccauguu

SEQ ID NO: 1178850 - RNA, 19 nt, Human
uauuaguuaagaguccuca

SEQ ID NO: 1178851 - RNA, 21 nt, Human
ucaaagcuuuuacaacaaauc

SEQ ID NO: 1178852 - RNA, 24 nt, Human
ucaccauguuagccaggauggucu

SEQ ID NO: 1178853 - RNA, 24 nt, Human
ucaccauguuagccaggauggucu

SEQ ID NO: 1178854 - RNA, 22 nt, Human
ucacccagguuggaguguagug

SEQ ID NO: 1178855 - RNA, 25 nt, Human
ucaccccuuccaccacaugaggacc

SEQ ID NO: 1178856 - RNA, 18 nt, Human
ucacugcaagcucugccu

SEQ ID NO: 1178857 - RNA, 18 nt, Human
ucacugcaagcucugccu

SEQ ID NO: 1178858 - RNA, 18 nt, Human
ucacugcaagcucugccu

SEQ ID NO: 1178859 - RNA, 18 nt, Human
ucacugcaagcucugccu

SEQ ID NO: 1178860 - RNA, 19 nt, Human
ucacugcaagcucugccuc

SEQ ID NO: 1178861 - RNA, 24 nt, Human
ucacugcaagcucugccucccagg

SEQ ID NO: 1178862 - RNA, 24 nt, Human
ucacugcaagcucugccucccggg

SEQ ID NO: 1178863 - RNA, 18 nt, Human
ucagccucccaaagugcu

SEQ ID NO: 1178864 - RNA, 18 nt, Human
ucagccucccaaguagcu

SEQ ID NO: 1178865 - RNA, 23 nt, Human
ucagccucccgaguagcugggac

SEQ ID NO: 1178866 - RNA, 26 nt, Human
ucagcucacugcaagcucugccuccc

SEQ ID NO: 1178867 - RNA, 18 nt, Human
ucagggcagauauccaaa

SEQ ID NO: 1178868 - RNA, 21 nt, Human
uccacccgccucagccuccca

SEQ ID NO: 1178869 - RNA, 22 nt, Human
uccagaaaugaaacaagcacau

SEQ ID NO: 1178870 - RNA, 22 nt, Human
uccaggaugaacuacggaaaaa

SEQ ID NO: 1178871 - RNA, 23 nt, Human
ucccaaagugcugggauuacagg

SEQ ID NO: 1178872 - RNA, 24 nt, Human
ucccaaagugcugggauuacaggc

SEQ ID NO: 1178873 - RNA, 24 nt, Human
ucccaaguagcugggacuacaggc

SEQ ID NO: 1178874 - RNA, 21 nt, Human
ucccagguucacgccaugcuc

SEQ ID NO: 1178875 - RNA, 24 nt, Human
ucccagguucacgccaugcuccug

SEQ ID NO: 1178876 - RNA, 24 nt, Human
ucccgaguagcugggacuacaggc

SEQ ID NO: 1178877 - RNA, 21 nt, Human
ucccggguucacgccauucuc

SEQ ID NO: 1178878 - RNA, 24 nt, Human
ucccggguucacgccauucuccug

SEQ ID NO: 1178879 - RNA, 22 nt, Human
uccucuuuucuaaaauuaaagc

SEQ ID NO: 1178880 - RNA, 21 nt, Human
ucgcucugucacccagguugg

SEQ ID NO: 1178881 - RNA, 22 nt, Human
ucgcucugucacccagguugga

SEQ ID NO: 1178882 - RNA, 24 nt, Human
ucgcucugucacccagguuggagu

SEQ ID NO: 1178883 - RNA, 24 nt, Human
ucucgcucagucacccaggcugga

SEQ ID NO: 1178884 - RNA, 24 nt, Human
ucugucacccagguuggaguguag

SEQ ID NO: 1178885 - RNA, 24 nt, Human
ucuuucuuuuuuuguuugagaugg

SEQ ID NO: 1178886 - RNA, 20 nt, Human
ugacaguagcccuguggacu

SEQ ID NO: 1178887 - RNA, 24 nt, Human
ugagcuccuaagaggaggagcuga

SEQ ID NO: 1178888 - RNA, 24 nt, Human
ugauccaccuaccucagccuccca

SEQ ID NO: 1178889 - RNA, 22 nt, Human
ugcauuauuuucccaaacaaaa

SEQ ID NO: 1178890 - RNA, 24 nt, Human
ugccucagccucccgaguagcugg

SEQ ID NO: 1178891 - RNA, 19 nt, Human
ugccucccagguucacgcc

SEQ ID NO: 1178892 - RNA, 19 nt, Human
ugccucccggguucacgcc

SEQ ID NO: 1178893 - RNA, 24 nt, Human
ugcugggauuacaggcgugagcca

SEQ ID NO: 1178894 - RNA, 24 nt, Human
ugcugggauuacaggugugagcca

SEQ ID NO: 1178895 - RNA, 24 nt, Human
ugcuucagccucccaaguagcugg

SEQ ID NO: 1178896 - RNA, 23 nt, Human
uggaagaggaaaggagaggaggg

SEQ ID NO: 1178897 - RNA, 22 nt, Human
uggacuuugggagugauuaggu

SEQ ID NO: 1178898 - RNA, 24 nt, Human
uggacuuugggagugauuaggugg

SEQ ID NO: 1178899 - RNA, 19 nt, Human
uggaguacaguggugcgau

SEQ ID NO: 1178900 - RNA, 24 nt, Human
uggaguguaguggcgugaucucag

SEQ ID NO: 1178901 - RNA, 24 nt, Human
uggcgugaucucagcucacugcaa

SEQ ID NO: 1178902 - RNA, 21 nt, Human
ugggacuacaggcgcccgcca

SEQ ID NO: 1178903 - RNA, 21 nt, Human
ugggacuacaggcgcccgcca

SEQ ID NO: 1178904 - RNA, 22 nt, Human
ugggacuacaggcgcccgccac

SEQ ID NO: 1178905 - RNA, 22 nt, Human
ugggacuacaggcgcccgccac

SEQ ID NO: 1178906 - RNA, 23 nt, Human
ugggacuacaggcgcccgccacc

SEQ ID NO: 1178907 - RNA, 24 nt, Human
ugggacuacaggcgcccgccacca

SEQ ID NO: 1178908 - RNA, 25 nt, Human
ugggacuacaggcgcccgccaccau

SEQ ID NO: 1178909 - RNA, 24 nt, Human
ugggacuacaggcgcccgccaccg

SEQ ID NO: 1178910 - RNA, 23 nt, Human
ugggagaaaacaaguauguggca

SEQ ID NO: 1178911 - RNA, 18 nt, Human
ugggauuacaggcgugag

SEQ ID NO: 1178912 - RNA, 22 nt, Human
ugggauuacaggcgugagccac

SEQ ID NO: 1178913 - RNA, 23 nt, Human
ugggauuacaggcgugagccacc

SEQ ID NO: 1178914 - RNA, 24 nt, Human
ugggauuacaggcgugagccacca

SEQ ID NO: 1178915 - RNA, 25 nt, Human
ugggauuacaggcgugagccaccau

SEQ ID NO: 1178916 - RNA, 18 nt, Human
ugggauuacaggugugag

SEQ ID NO: 1178917 - RNA, 21 nt, Human
ugggauuacaggugugagcca

SEQ ID NO: 1178918 - RNA, 22 nt, Human
ugggauuacaggugugagccac

SEQ ID NO: 1178919 - RNA, 22 nt, Human
ugggauuacaggugugagccac

SEQ ID NO: 1178920 - RNA, 22 nt, Human
ugggauuacaggugugagccac

SEQ ID NO: 1178921 - RNA, 24 nt, Human
ugggauuacaggugugagccacug

SEQ ID NO: 1178922 - RNA, 19 nt, Human
ugggcagcccaugggagca

SEQ ID NO: 1178923 - RNA, 24 nt, Human
uggugcgaucucagcucacugcaa

SEQ ID NO: 1178924 - RNA, 22 nt, Human
uguaguggcgugaucucagcuc

SEQ ID NO: 1178925 - RNA, 21 nt, Human
uguauuuuuaguagagacggg

SEQ ID NO: 1178926 - RNA, 23 nt, Human
uguggcaguguuucagagacagg

SEQ ID NO: 1178927 - RNA, 19 nt, Human
ugugggcauuucaggucug

SEQ ID NO: 1178928 - RNA, 24 nt, Human
uuaacaagggaagagacagagaag

SEQ ID NO: 1178929 - RNA, 23 nt, Human
uuaagaguccucaaaaauucuuu

SEQ ID NO: 1178930 - RNA, 24 nt, Human
uuaguaaagacaggguuucaccau

SEQ ID NO: 1178931 - RNA, 18 nt, Human
uuaguagagacgggguuu

SEQ ID NO: 1178932 - RNA, 22 nt, Human
uuaguagagacgggguuucacc

SEQ ID NO: 1178933 - RNA, 24 nt, Human
uuaguagagacgggguuucaccau

SEQ ID NO: 1178934 - RNA, 21 nt, Human
uucagagagaccccucacccc

SEQ ID NO: 1178935 - RNA, 21 nt, Human
uucccaaacaaaacaagaaaa

SEQ ID NO: 1178936 - RNA, 24 nt, Human
uuccuuuagaacucccugaucaua

SEQ ID NO: 1178937 - RNA, 24 nt, Human
uucgcucugucacccagguuggag

SEQ ID NO: 1178938 - RNA, 24 nt, Human
uucucacauuuuuaagaaccccac

SEQ ID NO: 1178939 - RNA, 24 nt, Human
uuggaguguaguggcgugaucuca

SEQ ID NO: 1178940 - RNA, 23 nt, Human
uuuaaaauuaaauucuaucagag

SEQ ID NO: 1178941 - RNA, 19 nt, Human
uuucaccauguuagccagg

SEQ ID NO: 1178942 - RNA, 19 nt, Human
uuucaccauguuagccagg

SEQ ID NO: 1178943 - RNA, 20 nt, Human
uuucaccauguuagccagga

SEQ ID NO: 1178944 - RNA, 20 nt, Human
uuucaccauguuagccagga

SEQ ID NO: 1178945 - RNA, 19 nt, Human
uuucgcucugucacccagg

SEQ ID NO: 1178946 - RNA, 23 nt, Human
uuucgcucugucacccagguugg

SEQ ID NO: 1178947 - RNA, 24 nt, Human
uuucgcucugucacccagguugga

SEQ ID NO: 1178948 - RNA, 21 nt, Human
uuuuguauuuuuaguagagac

SEQ ID NO: 1178949 - RNA, 24 nt, Human
uuuuuaguaaagacaggguuucac

SEQ ID NO: 1178950 - RNA, 24 nt, Human
uuuuuaguagagacgggguuucac

SEQ ID NO: 1178951 - RNA, 21 nt, Human
uuuuuguauuuuuaguagaga

SEQ ID NO: 1178952 - RNA, 21 nt, Human
uuuuuuguauuuuuaguagag

SEQ ID NO: 1178953 - RNA, 24 nt, Human
uuuuuuuuguauuuuuaguagaga

SEQ ID NO: 1178954 - RNA, 23 nt, Human
aaaaacaugcucccuucagcagc

SEQ ID NO: 1178955 - RNA, 26 nt, Human
aaaaacaugcucccuucagcagcacg

SEQ ID NO: 1178956 - RNA, 26 nt, Human
aaaaagaauugucucuuaaaaaugaa

SEQ ID NO: 1178957 - RNA, 19 nt, Human
aaacaaaccaauaaaaugc

SEQ ID NO: 1178958 - RNA, 24 nt, Human
aaacaagguaaaaaauuacaucug

SEQ ID NO: 1178959 - RNA, 21 nt, Human
aaacacacagcucauguccuc

SEQ ID NO: 1178960 - RNA, 23 nt, Human
aaaguaauauacaaacaugccaa

SEQ ID NO: 1178961 - RNA, 26 nt, Human
aaaguaauauacaaacaugccaaaac

SEQ ID NO: 1178962 - RNA, 26 nt, Human
aaggaccccaccccccucccccaacc

SEQ ID NO: 1178963 - RNA, 18 nt, Human
aaguaauauacaaacaug

SEQ ID NO: 1178964 - RNA, 20 nt, Human
accccaccccccucccccaa

SEQ ID NO: 1178965 - RNA, 19 nt, Human
accccccucccccaacccc

SEQ ID NO: 1178966 - RNA, 21 nt, Human
aggaaaggguggaacuggaaa

SEQ ID NO: 1178967 - RNA, 19 nt, Human
aggaugaaaagaauccucu

SEQ ID NO: 1178968 - RNA, 18 nt, Human
auaacaacuauaacucuc

SEQ ID NO: 1178969 - RNA, 21 nt, Human
aucacuguauucagcuccauc

SEQ ID NO: 1178970 - RNA, 18 nt, Human
augaaaagaauccucucu

SEQ ID NO: 1178971 - RNA, 23 nt, Human
augcagagugugcaugaagcuau

SEQ ID NO: 1178972 - RNA, 19 nt, Human
augcucccuucagcagcac

SEQ ID NO: 1178973 - RNA, 23 nt, Human
augguccagguucuucuagauga

SEQ ID NO: 1178974 - RNA, 20 nt, Human
caaaccuaaacagcaaauaa

SEQ ID NO: 1178975 - RNA, 26 nt, Human
cacaaaccuaaacagcaaauaaaaau

SEQ ID NO: 1178976 - RNA, 23 nt, Human
cacacagcgucuccacuacccag

SEQ ID NO: 1178977 - RNA, 18 nt, Human
caccccccucccccaacc

SEQ ID NO: 1178978 - RNA, 22 nt, Human
caccccccucccccaaccccug

SEQ ID NO: 1178979 - RNA, 24 nt, Human
caccccccucccccaaccccugcu

SEQ ID NO: 1178980 - RNA, 19 nt, Human
caccuccagguuccgcccc

SEQ ID NO: 1178981 - RNA, 27 nt, Human
cacuccuucuuccuuuuccagccaagg

SEQ ID NO: 1178982 - RNA, 18 nt, Human
cagcuccaucaagaaugg

SEQ ID NO: 1178983 - RNA, 23 nt, Human
caucacacagcuuuauagaaaca

SEQ ID NO: 1178984 - RNA, 23 nt, Human
ccaaaacaagguaaaaaauuaca

SEQ ID NO: 1178985 - RNA, 20 nt, Human
ccaccccccucccccaaccc

SEQ ID NO: 1178986 - RNA, 26 nt, Human
ccacuccuucuuccuuuuccagccaa

SEQ ID NO: 1178987 - RNA, 23 nt, Human
cccacacagcgucuccacuaccc

SEQ ID NO: 1178988 - RNA, 20 nt, Human
cccaggaggacacgugaucc

SEQ ID NO: 1178989 - RNA, 19 nt, Human
ccccaccccccucccccaa

SEQ ID NO: 1178990 - RNA, 22 nt, Human
ccccaccccccucccccaaccc

SEQ ID NO: 1178991 - RNA, 20 nt, Human
cccccucccccaaccccugc

SEQ ID NO: 1178992 - RNA, 19 nt, Human
ccccuggguccgguguucu

SEQ ID NO: 1178993 - RNA, 23 nt, Human
cccuucagcagcacguguaauaa

SEQ ID NO: 1178994 - RNA, 20 nt, Human
ccgaugaccucaggccucca

SEQ ID NO: 1178995 - RNA, 19 nt, Human
ccucaggcucaggggcgag

SEQ ID NO: 1178996 - RNA, 22 nt, Human
ccuucagcagcacguguaauaa

SEQ ID NO: 1178997 - RNA, 19 nt, Human
cucccccaaccccugcucc

SEQ ID NO: 1178998 - RNA, 21 nt, Human
cucccccaaccccugcuccca

SEQ ID NO: 1178999 - RNA, 21 nt, Human
cuccuagaaggaccccacccc

SEQ ID NO: 1179000 - RNA, 18 nt, Human
cuccucagauucaucuga

SEQ ID NO: 1179001 - RNA, 18 nt, Human
cuccucaggcucaggggc

SEQ ID NO: 1179002 - RNA, 19 nt, Human
cuccuuccuggugucugcc

SEQ ID NO: 1179003 - RNA, 22 nt, Human
cuccuucuccggcuccuccuca

SEQ ID NO: 1179004 - RNA, 22 nt, Human
cucuucuccuuccuggugucug

SEQ ID NO: 1179005 - RNA, 24 nt, Human
gaaaacacacagcucauguccucc

SEQ ID NO: 1179006 - RNA, 25 nt, Human
gaccccaccccccucccccaacccc

SEQ ID NO: 1179007 - RNA, 21 nt, Human
gagugcucgcuucaggagcac

SEQ ID NO: 1179008 - RNA, 23 nt, Human
ggaaaggguggaacuggaaacac

SEQ ID NO: 1179009 - RNA, 24 nt, Human
ggaccuacauggggggcugggauc

SEQ ID NO: 1179010 - RNA, 25 nt, Human
ggacuccuagaaggaccccaccccc

SEQ ID NO: 1179011 - RNA, 20 nt, Human
ggcaaccaaguccguaagaa

SEQ ID NO: 1179012 - RNA, 25 nt, Human
uaaaauagauaguauauauuagacg

SEQ ID NO: 1179013 - RNA, 23 nt, Human
uaauauacaaacaugccaaaaca

SEQ ID NO: 1179014 - RNA, 26 nt, Human
uaccaguauuuccaaaauauuuaaaa

SEQ ID NO: 1179015 - RNA, 18 nt, Human
uagaaggaccccaccccc

SEQ ID NO: 1179016 - RNA, 26 nt, Human
uagaaggaccccaccccccuccccca

SEQ ID NO: 1179017 - RNA, 22 nt, Human
uagauaaaaacaugcucccuuc

SEQ ID NO: 1179018 - RNA, 22 nt, Human
uagaugaucugcacaaaugguu

SEQ ID NO: 1179019 - RNA, 24 nt, Human
uauaaaaagggugguggugccgca

SEQ ID NO: 1179020 - RNA, 18 nt, Human
uauauguauguguauaua

SEQ ID NO: 1179021 - RNA, 19 nt, Human
uauauguauguguauauaa

SEQ ID NO: 1179022 - RNA, 22 nt, Human
ucaaaaguacaacaauuuccaa

SEQ ID NO: 1179023 - RNA, 24 nt, Human
ucaggagcacauauaauaauacag

SEQ ID NO: 1179024 - RNA, 26 nt, Human
uccccuggguccgguguucuucucuc

SEQ ID NO: 1179025 - RNA, 25 nt, Human
ucucaggccgaugaccucaggccuc

SEQ ID NO: 1179026 - RNA, 24 nt, Human
ucuccggcuccuccucagauucau

SEQ ID NO: 1179027 - RNA, 25 nt, Human
ucuccggcuccuccucagauucauc

SEQ ID NO: 1179028 - RNA, 18 nt, Human
ugagccccugcauugugc

SEQ ID NO: 1179029 - RNA, 22 nt, Human
ugaucugcacaaaugguuccuc

SEQ ID NO: 1179030 - RNA, 18 nt, Human
ugccaaaacaagguaaaa

SEQ ID NO: 1179031 - RNA, 19 nt, Human
ugccaaucugagccccugc

SEQ ID NO: 1179032 - RNA, 23 nt, Human
uggaauaaaguuccugcugaaaa

SEQ ID NO: 1179033 - RNA, 19 nt, Human
uuacaagaauuuaggggaa

SEQ ID NO: 1179034 - RNA, 18 nt, Human
uuaggggaacuacuacau

SEQ ID NO: 1179035 - RNA, 18 nt, Human
uucaaauauauaugaaau

SEQ ID NO: 1179036 - RNA, 21 nt, Human
uucacaaaagaauucugugcc

SEQ ID NO: 1179037 - RNA, 23 nt, Human
uucauuuuuauuauguuucccca

SEQ ID NO: 1179038 - RNA, 19 nt, Human
aaagagcccaguccuaaag

SEQ ID NO: 1179039 - RNA, 23 nt, Human
aaagagcccaguccuaaagccac

SEQ ID NO: 1179040 - RNA, 27 nt, Human
agaaacagcagcaggggcacccuugac

SEQ ID NO: 1179041 - RNA, 26 nt, Human
agaggagaggccaccguggggcacgc

SEQ ID NO: 1179042 - RNA, 21 nt, Human
agcccaguccuaaagccaccc

SEQ ID NO: 1179043 - RNA, 23 nt, Human
cacuguggguccaaggaugagcu

SEQ ID NO: 1179044 - RNA, 19 nt, Human
cagagaugcucuagaaaca

SEQ ID NO: 1179045 - RNA, 22 nt, Human
ccacuguggguccaaggaugag

SEQ ID NO: 1179046 - RNA, 19 nt, Human
ucaguggaagcaaggagcc

SEQ ID NO: 1179047 - RNA, 24 nt, Human
uccaaagagcccaguccuaaagcc

SEQ ID NO: 1179048 - RNA, 22 nt, Human
ucuagaaacagcagcaggggca

SEQ ID NO: 1179049 - RNA, 23 nt, Human
ucuagaaacagcagcaggggcac

SEQ ID NO: 1179050 - RNA, 20 nt, Human
ugaaaguacucaagagguca

SEQ ID NO: 1179051 - RNA, 19 nt, Human
uggaagcaaggagccaaau

SEQ ID NO: 1179052 - RNA, 18 nt, Human
uggguugcagagaugcuc

SEQ ID NO: 1179053 - RNA, 21 nt, Human
uuguucccuucuuggcaaucc

SEQ ID NO: 1179054 - RNA, 24 nt, Human
aaaaaugcagccaagcuuugcugu

SEQ ID NO: 1179055 - RNA, 22 nt, Human
aaaaugcagccaagcuuugcug

SEQ ID NO: 1179056 - RNA, 25 nt, Human
aaacacguacacaagccaggccccc

SEQ ID NO: 1179057 - RNA, 26 nt, Human
aaacacguacacaagccaggcccccc

SEQ ID NO: 1179058 - RNA, 24 nt, Human
aaagagacacgacgcagaugcuga

SEQ ID NO: 1179059 - RNA, 20 nt, Human
aaauacaaaaugccaaagac

SEQ ID NO: 1179060 - RNA, 19 nt, Human
aacaacaccugccaccaac

SEQ ID NO: 1179061 - RNA, 18 nt, Human
aaccaaauuccuuccugg

SEQ ID NO: 1179062 - RNA, 18 nt, Human
aaccaggccgccgaccua

SEQ ID NO: 1179063 - RNA, 19 nt, Human
aacccacagaccaaauaag

SEQ ID NO: 1179064 - RNA, 20 nt, Human
aagcaagugugaugcugcuu

SEQ ID NO: 1179065 - RNA, 22 nt, Human
aaggaugucccuggagcccucc

SEQ ID NO: 1179066 - RNA, 25 nt, Human
acaaacaaaagcacaaagagacacg

SEQ ID NO: 1179067 - RNA, 31 nt, Human; identical to SEQ ID NO: 764339

SEQ ID NO: 1179068 - RNA, 22 nt, Human
acacaagcaagagaugggcacu

SEQ ID NO: 1179069 - RNA, 21 nt, Human
acagcggggugugucugccug

SEQ ID NO: 1179070 - RNA, 18 nt, Human
acaggcugggcuggggac

SEQ ID NO: 1179071 - RNA, 18 nt, Human
accagaugcaacacgccc

SEQ ID NO: 1179072 - RNA, 20 nt, Human
acccagccguggucuguacc

SEQ ID NO: 1179073 - RNA, 20 nt, Human
acugcaccuguggcucacca

SEQ ID NO: 1179074 - RNA, 18 nt, Human
acugggagagaacaggcu

SEQ ID NO: 1179075 - RNA, 23 nt, Human
agacaccaggccugggcugugca

SEQ ID NO: 1179076 - RNA, 18 nt, Human
agagaacaggcugggcug

SEQ ID NO: 1179077 - RNA, 22 nt, Human
agagaugggcacuggacacugu

SEQ ID NO: 1179078 - RNA, 19 nt, Human
agaugcaacacgccccacc

SEQ ID NO: 1179079 - RNA, 20 nt, Human
agaugcaacacgccccacca

SEQ ID NO: 1179080 - RNA, 19 nt, Human
agaugugucuguuggcacu

SEQ ID NO: 1179081 - RNA, 20 nt, Human
agcagacagaccacagccag

SEQ ID NO: 1179082 - RNA, 19 nt, Human
agccacgggagagcaaacg

SEQ ID NO: 1179083 - RNA, 19 nt, Human
agccgcuggcccuccccag

SEQ ID NO: 1179084 - RNA, 23 nt, Human
agcuggugccucugcugaggucu

SEQ ID NO: 1179085 - RNA, 19 nt, Human
aggaacucccuccuaggcc

SEQ ID NO: 1179086 - RNA, 19 nt, Human
aggccgccgaccuacccag

SEQ ID NO: 1179087 - RNA, 21 nt, Human
aggccucugcagcugcuggcu

SEQ ID NO: 1179088 - RNA, 24 nt, Human
aggcugcacgccucucuggcauca

SEQ ID NO: 1179089 - RNA, 20 nt, Human
agggcagcucuggagggcag

SEQ ID NO: 1179090 - RNA, 18 nt, Human
aguuggcacagcguaggc

SEQ ID NO: 1179091 - RNA, 21 nt, Human
auagaaucucauucagaucuu

SEQ ID NO: 1179092 - RNA, 22 nt, Human
auagaaucucauucagaucuug

SEQ ID NO: 1179093 - RNA, 22 nt, Human
augacccaggcucagcuuaggu

SEQ ID NO: 1179094 - RNA, 24 nt, Human
auggagcuugggagugcagaggcc

SEQ ID NO: 1179095 - RNA, 23 nt, Human
caaaagcacaaagagacacgacg

SEQ ID NO: 1179096 - RNA, 20 nt, Human
caaaaugccaaagaccagcg

SEQ ID NO: 1179097 - RNA, 23 nt, Human
caaacgcugcuuccaaaaccaaa

SEQ ID NO: 1179098 - RNA, 25 nt, Human
cacaaacaaaagcacaaagagacac

SEQ ID NO: 1179099 - RNA, 23 nt, Human
cacccugcuguucucagaagcaa

SEQ ID NO: 1179100 - RNA, 21 nt, Human
cacgagccuaugcugucccuu

SEQ ID NO: 1179101 - RNA, 20 nt, Human
cacgccucucuggcaucacg

SEQ ID NO: 1179102 - RNA, 24 nt, Human
cagacaaacgagcaaagggaguuc

SEQ ID NO: 1179103 - RNA, 19 nt, Human
cagacgucauuucuguugc

SEQ ID NO: 1179104 - RNA, 19 nt, Human
cagagccuccucucucccu

SEQ ID NO: 1179105 - RNA, 21 nt, Human
cagaggccgcacacauggggu

SEQ ID NO: 1179106 - RNA, 21 nt, Human
cagaugcaacacgccccacca

SEQ ID NO: 1179107 - RNA, 19 nt, Human
cagcaagggcuaaucucac

SEQ ID NO: 1179108 - RNA, 20 nt, Human
cagccaccugcacggggcca

SEQ ID NO: 1179109 - RNA, 24 nt, Human
cagcgccccagggaguggacccgg

SEQ ID NO: 1179110 - RNA, 24 nt, Human
cagcgcugccaucacggcguggag

SEQ ID NO: 1179111 - RNA, 18 nt, Human
cagcggguccacuccuuc

SEQ ID NO: 1179112 - RNA, 21 nt, Human
cagcugucuggugggugaugu

SEQ ID NO: 1179113 - RNA, 18 nt, Human
caggagacaaaaauagac

SEQ ID NO: 1179114 - RNA, 18 nt, Human
caggcccuugggagcuug

SEQ ID NO: 1179115 - RNA, 18 nt, Human
caggguggggcggguccu

SEQ ID NO: 1179116 - RNA, 18 nt, Human
ccaacaccgggcccuggg

SEQ ID NO: 1179117 - RNA, 22 nt, Human
ccaggccugggcugugcagggg

SEQ ID NO: 1179118 - RNA, 18 nt, Human
ccagggguuaagccuguc

SEQ ID NO: 1179119 - RNA, 18 nt, Human
cccagcccagcccagccc

SEQ ID NO: 1179120 - RNA, 25 nt, Human
cccagccccucccugcacucucucc

SEQ ID NO: 1179121 - RNA, 21 nt, Human
ccccacacaggcuaaggcucc

SEQ ID NO: 1179122 - RNA, 23 nt, Human
ccccgcugacucgcuuccaccca

SEQ ID NO: 1179123 - RNA, 23 nt, Human
ccccggcaggaguccccacaggg

SEQ ID NO: 1179124 - RNA, 18 nt, Human
cccgccaccagcuuggga

SEQ ID NO: 1179125 - RNA, 20 nt, Human
cccuccucuccuccucuucc

SEQ ID NO: 1179126 - RNA, 23 nt, Human
cccuggguuggaguuuagcccug

SEQ ID NO: 1179127 - RNA, 21 nt, Human
cccugugccaggaaagccucc

SEQ ID NO: 1179128 - RNA, 21 nt, Human
ccggcccgcgaccccgcugcc

SEQ ID NO: 1179129 - RNA, 19 nt, Human
ccuccggguacugcaccug

SEQ ID NO: 1179130 - RNA, 24 nt, Human
ccuccucucucccuuucacaagcc

SEQ ID NO: 1179131 - RNA, 18 nt, Human
ccucggggccuucccugg

SEQ ID NO: 1179132 - RNA, 21 nt, Human
ccucuccuaagccaucuugac

SEQ ID NO: 1179133 - RNA, 20 nt, Human
ccucucuggcaucacagucc

SEQ ID NO: 1179134 - RNA, 23 nt, Human
ccugccaccaacgucgacccuga

SEQ ID NO: 1179135 - RNA, 20 nt, Human
ccuggccugcugggcugaga

SEQ ID NO: 1179136 - RNA, 20 nt, Human
ccuggcgccggcccgcgacc

SEQ ID NO: 1179137 - RNA, 22 nt, Human
ccuggcuucugagccuggggcc

SEQ ID NO: 1179138 - RNA, 18 nt, Human
ccugggaagggcagcucu

SEQ ID NO: 1179139 - RNA, 27 nt, Human
ccuguccccguggacggaagccuuggg

SEQ ID NO: 1179140 - RNA, 21 nt, Human
ccuuaucccuuccaaaagauc

SEQ ID NO: 1179141 - RNA, 22 nt, Human
cgccggcccgcgaccccgcugc

SEQ ID NO: 1179142 - RNA, 18 nt, Human
cggcgcuggcuucgugcc

SEQ ID NO: 1179143 - RNA, 18 nt, Human
cggguaagcgaccugcgu

SEQ ID NO: 1179144 - RNA, 19 nt, Human
cggguccugcacuuugggu

SEQ ID NO: 1179145 - RNA, 18 nt, Human
cgugggcaggcggcaagg

SEQ ID NO: 1179146 - RNA, 23 nt, Human
cuaaauacaaaaugccaaagacc

SEQ ID NO: 1179147 - RNA, 21 nt, Human
cuacaaaggccuccuaagagc

SEQ ID NO: 1179148 - RNA, 24 nt, Human
cuccuccucuuucuccccauccug

SEQ ID NO: 1179149 - RNA, 18 nt, Human
cugagcuagguugggcua

SEQ ID NO: 1179150 - RNA, 21 nt, Human
cugcccggccgccccucaggg

SEQ ID NO: 1179151 - RNA, 21 nt, Human
cuggccugcugggcugagauc

SEQ ID NO: 1179152 - RNA, 24 nt, Human
cuuggaacggcgagccugccuccu

SEQ ID NO: 1179153 - RNA, 27 nt, Human
gaaaacacguacacaagccaggccccc

SEQ ID NO: 1179154 - RNA, 25 nt, Human
gaacagacaucacccugcuguucuc

SEQ ID NO: 1179155 - RNA, 19 nt, Human
gacauucagcagacagacc

SEQ ID NO: 1179156 - RNA, 26 nt, Human
gacgcuggggcagcgccccagggagu

SEQ ID NO: 1179157 - RNA, 20 nt, Human
gagccgcuggcccuccccag

SEQ ID NO: 1179158 - RNA, 21 nt, Human
gcaaacgcugcuuccaaaacc

SEQ ID NO: 1179159 - RNA, 23 nt, Human
gcagacaccaggccugggcugug

SEQ ID NO: 1179160 - RNA, 28 nt, Human
gccaugcugcagaaaaggcgcccagggg

SEQ ID NO: 1179161 - RNA, 20 nt, Human
gccccaggcacacccaccuc

SEQ ID NO: 1179162 - RNA, 18 nt, Human
gcccggccgccccucagg

SEQ ID NO: 1179163 - RNA, 18 nt, Human
gcccugcuuggcucugcc

SEQ ID NO: 1179164 - RNA, 19 nt, Human
gccgcccgcagccucgggg

SEQ ID NO: 1179165 - RNA, 22 nt, Human
gccuccuccucuuucuccccau

SEQ ID NO: 1179166 - RNA, 21 nt, Human
gccucucuggcaucacagucc

SEQ ID NO: 1179167 - RNA, 23 nt, Human
gccuggggccuccuccucuuucu

SEQ ID NO: 1179168 - RNA, 19 nt, Human
gcgaccagcgucguuuggc

SEQ ID NO: 1179169 - RNA, 23 nt, Human
gcucaccagccaccugcacgggg

SEQ ID NO: 1179170 - RNA, 18 nt, Human
gcugaggucugugagcag

SEQ ID NO: 1179171 - RNA, 18 nt, Human
gcuguaaggcuccacuga

SEQ ID NO: 1179172 - RNA, 18 nt, Human
gcuguggggaugggggaa

SEQ ID NO: 1179173 - RNA, 23 nt, Human
ggaauccgcgggcagcccuggcc

SEQ ID NO: 1179174 - RNA, 24 nt, Human
ggacggaagccuugggagaagcug

SEQ ID NO: 1179175 - RNA, 18 nt, Human
ggagacaggggccaggcu

SEQ ID NO: 1179176 - RNA, 21 nt, Human
ggagcuugggagugcagaggc

SEQ ID NO: 1179177 - RNA, 19 nt, Human
ggauagcaagggugacggg

SEQ ID NO: 1179178 - RNA, 18 nt, Human
ggcggguggggugaaggc

SEQ ID NO: 1179179 - RNA, 19 nt, Human
ggcguccgggucugggaau

SEQ ID NO: 1179180 - RNA, 21 nt, Human
ggcuccacugaaauccccccg

SEQ ID NO: 1179181 - RNA, 19 nt, Human
ggcuguaaggcuccacuga

SEQ ID NO: 1179182 - RNA, 20 nt, Human
gggaagggcagcucuggagg

SEQ ID NO: 1179183 - RNA, 18 nt, Human
gggcagcccuggccgccc

SEQ ID NO: 1179184 - RNA, 20 nt, Human
gggcaggcggcaaggugcug

SEQ ID NO: 1179185 - RNA, 24 nt, Human
gggcggguggggugaaggcaggga

SEQ ID NO: 1179186 - RNA, 21 nt, Human
ggggaagccggucucacaccu

SEQ ID NO: 1179187 - RNA, 19 nt, Human
ggggaggaguuggggacag

SEQ ID NO: 1179188 - RNA, 18 nt, Human
ggggugugucugccuggc

SEQ ID NO: 1179189 - RNA, 22 nt, Human
ggguggggcggguccugcacuu

SEQ ID NO: 1179190 - RNA, 21 nt, Human
ggugauguggagguguugcag

SEQ ID NO: 1179191 - RNA, 20 nt, Human
ggugccucugcugaggucug

SEQ ID NO: 1179192 - RNA, 19 nt, Human
gucaaggucgugggcaggc

SEQ ID NO: 1179193 - RNA, 19 nt, Human
gucccuggcuucugagccu

SEQ ID NO: 1179194 - RNA, 21 nt, Human
gugaacaacaccugccaccaa

SEQ ID NO: 1179195 - RNA, 18 nt, Human
gugccucugcugaggucu

SEQ ID NO: 1179196 - RNA, 18 nt, Human
gugcuuucugcagguuuu

SEQ ID NO: 1179197 - RNA, 18 nt, Human
guggucuucucuggcccu

SEQ ID NO: 1179198 - RNA, 22 nt, Human
guggucuugguggucuucucug

SEQ ID NO: 1179199 - RNA, 22 nt, Human
uaaaaggccaauaaugagaaua

SEQ ID NO: 1179200 - RNA, 24 nt, Human
uacacaguccaucaaguuaccagc

SEQ ID NO: 1179201 - RNA, 21 nt, Human
uagcccugcuuggcucugccc

SEQ ID NO: 1179202 - RNA, 24 nt, Human
ucacggcguggagacagugacggg

SEQ ID NO: 1179203 - RNA, 19 nt, Human
ucacuacagggcucccugg

SEQ ID NO: 1179204 - RNA, 20 nt, Human
ucacuucugccucuuuucug

SEQ ID NO: 1179205 - RNA, 21 nt, Human
ucagcagacagaccacagcca

SEQ ID NO: 1179206 - RNA, 22 nt, Human
ucagccucagcagugucagcuc

SEQ ID NO: 1179207 - RNA, 19 nt, Human
ucagucaggucacucaccc

SEQ ID NO: 1179208 - RNA, 19 nt, Human
uccacaaacaaaagcacaa

SEQ ID NO: 1179209 - RNA, 21 nt, Human
uccaccauccgagcugcagcu

SEQ ID NO: 1179210 - RNA, 21 nt, Human
uccacugaaauccccccggcg

SEQ ID NO: 1179211 - RNA, 24 nt, Human
ucccccaggaacucccuccuaggc

SEQ ID NO: 1179212 - RNA, 24 nt, Human
ucccuggagcccuccagcuggugc

SEQ ID NO: 1179213 - RNA, 19 nt, Human
ucccuggcuucugagccug

SEQ ID NO: 1179214 - RNA, 20 nt, Human
ucccuggcuucugagccugg

SEQ ID NO: 1179215 - RNA, 21 nt, Human
ucccuggcuucugagccuggg

SEQ ID NO: 1179216 - RNA, 23 nt, Human
ucccuggcuucugagccuggggc

SEQ ID NO: 1179217 - RNA, 20 nt, Human
uccgagcugcagcuggagau

SEQ ID NO: 1179218 - RNA, 19 nt, Human
ucgacccugaagugguaga

SEQ ID NO: 1179219 - RNA, 22 nt, Human
ucuaaauacaaaaugccaaaga

SEQ ID NO: 1179220 - RNA, 19 nt, Human
ucucuggcccuuccaccuc

SEQ ID NO: 1179221 - RNA, 24 nt, Human
ucugccucuuuucugcugguuucu

SEQ ID NO: 1179222 - RNA, 21 nt, Human
ucugucccuggcuucugagcc

SEQ ID NO: 1179223 - RNA, 23 nt, Human
ucuguuggcacugaaaauccacc

SEQ ID NO: 1179224 - RNA, 18 nt, Human
ugagccuggggccuccuc

SEQ ID NO: 1179225 - RNA, 21 nt, Human
ugagggggaugcgagccgcug

SEQ ID NO: 1179226 - RNA, 23 nt, Human
ugagggugucaccaggaagaggg

SEQ ID NO: 1179227 - RNA, 19 nt, Human
ugaugugaaccaagggaca

SEQ ID NO: 1179228 - RNA, 18 nt, Human
ugcagacaccaggccugg

SEQ ID NO: 1179229 - RNA, 21 nt, Human
ugcagacaccaggccugggcu

SEQ ID NO: 1179230 - RNA, 23 nt, Human
ugcgggaacgguggucuuggugg

SEQ ID NO: 1179231 - RNA, 23 nt, Human
ugcuguggggaugggggaagccg

SEQ ID NO: 1179232 - RNA, 19 nt, Human
uggagacagugacggggac

SEQ ID NO: 1179233 - RNA, 24 nt, Human
uggcacugccuggauucaguuugg

SEQ ID NO: 1179234 - RNA, 18 nt, Human
uggcaucacaguccgcac

SEQ ID NO: 1179235 - RNA, 21 nt, Human
uggccugcugggcugagaucg

SEQ ID NO: 1179236 - RNA, 24 nt, Human
uggcuccacaggcuccgcacgccc

SEQ ID NO: 1179237 - RNA, 19 nt, Human
uggcucggacccauggcgg

SEQ ID NO: 1179238 - RNA, 20 nt, Human
uggcucggacccauggcggg

SEQ ID NO: 1179239 - RNA, 21 nt, Human
uggcuucugagccuggggccu

SEQ ID NO: 1179240 - RNA, 24 nt, Human
uggcuucugagccuggggccuccu

SEQ ID NO: 1179241 - RNA, 25 nt, Human
ugggaagggcagcucuggagggcag

SEQ ID NO: 1179242 - RNA, 25 nt, Human
ugggaagggcagcucuggagggcag

SEQ ID NO: 1179243 - RNA, 18 nt, Human
ugggacaggccguguuuu

SEQ ID NO: 1179244 - RNA, 19 nt, Human
ugggagaagcugucagcug

SEQ ID NO: 1179245 - RNA, 22 nt, Human
ugggagagaacaggcugggcug

SEQ ID NO: 1179246 - RNA, 23 nt, Human
ugggagagaacaggcugggcugg

SEQ ID NO: 1179247 - RNA, 23 nt, Human
ugggcaggcggcaaggugcuguc

SEQ ID NO: 1179248 - RNA, 25 nt, Human
uggggacaccuguguccuccuccca

SEQ ID NO: 1179249 - RNA, 21 nt, Human
uggugccucugcugaggucug

SEQ ID NO: 1179250 - RNA, 20 nt, Human
uuccaaaagaucggccuaua

SEQ ID NO: 1179251 - RNA, 23 nt, Human
uucucagaagcaagugugaugcu

SEQ ID NO: 1179252 - RNA, 21 nt, Human
uucuggccuguuuggucccag

SEQ ID NO: 1179253 - RNA, 24 nt, Human
uucuggccuguuuggucccagccc

SEQ ID NO: 1179254 - RNA, 21 nt, Human
uuggggccaucggccuucuga

SEQ ID NO: 1179255 - RNA, 20 nt, Human
uuuagcccugcuuggcucuu

SEQ ID NO: 1179256 - RNA, 24 nt, Human
uuucuaaccauugggucucuccug

SEQ ID NO: 1179257 - RNA, 19 nt, Human
uuucugcugguuucuggcc

SEQ ID NO: 1179258 - RNA, 19 nt, Human
gugcacagcauuuucauga

SEQ ID NO: 1179259 - RNA, 20 nt, Human
aagacccugacccugcuccg

SEQ ID NO: 1179260 - RNA, 22 nt, Human
acaggcccagcagaaccaggag

SEQ ID NO: 1179261 - RNA, 29 nt, Human
accccaaagggcggcugccacacagaggg

SEQ ID NO: 1179262 - RNA, 25 nt, Human
agaccgcggccaccaccagcgucac

SEQ ID NO: 1179263 - RNA, 19 nt, Human
agagcuggggggaucugga

SEQ ID NO: 1179264 - RNA, 20 nt, Human
agcagcaccgccagcuuagc

SEQ ID NO: 1179265 - RNA, 19 nt, Human
agugguagauggugaagau

SEQ ID NO: 1179266 - RNA, 19 nt, Human
caccaccagcgucaccagc

SEQ ID NO: 1179267 - RNA, 25 nt, Human
caccagcagcaccgccagcuuagcc

SEQ ID NO: 1179268 - RNA, 18 nt, Human
caccccuucuccagccac

SEQ ID NO: 1179269 - RNA, 19 nt, Human
cagaaaaagaggaugaagg

SEQ ID NO: 1179270 - RNA, 18 nt, Human
cagcaggugcaccccuuc

SEQ ID NO: 1179271 - RNA, 23 nt, Human
ccacacagaggauccagcugugu

SEQ ID NO: 1179272 - RNA, 23 nt, Human
ccaccgagcacacaccauaaccc

SEQ ID NO: 1179273 - RNA, 18 nt, Human
ccccaaagggcggcugcc

SEQ ID NO: 1179274 - RNA, 23 nt, Human
ccugaggcacaggggcccagaaa

SEQ ID NO: 1179275 - RNA, 18 nt, Human
cgagcacacaccauaacc

SEQ ID NO: 1179276 - RNA, 18 nt, Human
cggcgcuggggcgcgugc

SEQ ID NO: 1179277 - RNA, 18 nt, Human
cggggcuggcgcggggcc

SEQ ID NO: 1179278 - RNA, 22 nt, Human
cucggcggacccuggagauagg

SEQ ID NO: 1179279 - RNA, 24 nt, Human
cucggcggacccuggagauaggag

SEQ ID NO: 1179280 - RNA, 18 nt, Human
gaagauggccacagccug

SEQ ID NO: 1179281 - RNA, 25 nt, Human
gaaggugagcagcaggugcaccccc

SEQ ID NO: 1179282 - RNA, 21 nt, Human
gagagcuggggggaucuggag

SEQ ID NO: 1179283 - RNA, 22 nt, Human
gagcggggccgggucgcaagaa

SEQ ID NO: 1179284 - RNA, 23 nt, Human
gagcggggccgggucgcaagaag

SEQ ID NO: 1179285 - RNA, 24 nt, Human
gaggagguaagccagccacuccag

SEQ ID NO: 1179286 - RNA, 18 nt, Human
gcucucggcggacccugg

SEQ ID NO: 1179287 - RNA, 20 nt, Human
ggcacaggggcccagaaaaa

SEQ ID NO: 1179288 - RNA, 20 nt, Human
gggcgcucacacgcggcccg

SEQ ID NO: 1179289 - RNA, 23 nt, Human
gguccgcggccgagagcuggggg

SEQ ID NO: 1179290 - RNA, 21 nt, Human
ggugaagauggccacagccug

SEQ ID NO: 1179291 - RNA, 27 nt, Human
gugcuggggccgcgggaugcggggcug

SEQ ID NO: 1179292 - RNA, 18 nt, Human
guggcucucggcggaccc

SEQ ID NO: 1179293 - RNA, 21 nt, Human
uaagccagccacuccagcccc

SEQ ID NO: 1179294 - RNA, 19 nt, Human
uaggagaccgcggccacca

SEQ ID NO: 1179295 - RNA, 24 nt, Human
ucagggcgcugcccacaccccaaa

SEQ ID NO: 1179296 - RNA, 18 nt, Human
uccagccccaccgagcac

SEQ ID NO: 1179297 - RNA, 18 nt, Human
uccagccccaccgagcac

SEQ ID NO: 1179298 - RNA, 21 nt, Human
uccgcagguaggagaccgcgg

SEQ ID NO: 1179299 - RNA, 22 nt, Human
ucucguccgaguuguccuccuc

SEQ ID NO: 1179300 - RNA, 24 nt, Human
ucucguccgaguuguccuccucca

SEQ ID NO: 1179301 - RNA, 21 nt, Human
ucuucguacaagauucccagg

SEQ ID NO: 1179302 - RNA, 19 nt, Human
ugaagauggccacagccug

SEQ ID NO: 1179303 - RNA, 18 nt, Human
ugagcagcaggugcaccc

SEQ ID NO: 1179304 - RNA, 24 nt, Human
ugaguccagucuuguucagggcgc

SEQ ID NO: 1179305 - RNA, 19 nt, Human
ugcaggaccugaggcacag

SEQ ID NO: 1179306 - RNA, 18 nt, Human
ugcuaagggcccgcgggg

SEQ ID NO: 1179307 - RNA, 20 nt, Human
uggcagccacaggcccagca

SEQ ID NO: 1179308 - RNA, 23 nt, Human
uggcagccacaggcccagcagaa

SEQ ID NO: 1179309 - RNA, 22 nt, Human
uggcgcggggccacgccccgcc

SEQ ID NO: 1179310 - RNA, 24 nt, Human
uucuccagccacgaggggcaccgg

SEQ ID NO: 1179311 - RNA, 22 nt, Human
uuuucuguaaaaaaucguggcu

SEQ ID NO: 1179312 - RNA, 22 nt, Human
agaggaggcccagcagaugggc

SEQ ID NO: 1179313 - RNA, 20 nt, Human
aggccacauggagucagggg

SEQ ID NO: 1179314 - RNA, 18 nt, Human
ccagcugggggcuggggg

SEQ ID NO: 1179315 - RNA, 23 nt, Human
cugaggggcaggguugguucgga

SEQ ID NO: 1179316 - RNA, 20 nt, Human
cugggagcucauuuaauagg

SEQ ID NO: 1179317 - RNA, 18 nt, Human
gagcucauuuaauaggca

SEQ ID NO: 1179318 - RNA, 18 nt, Human
gaggcagaggaggcccag

SEQ ID NO: 1179319 - RNA, 21 nt, Human
gaggcagaggaggcccagcag

SEQ ID NO: 1179320 - RNA, 20 nt, Human
ggagucaggggccagcuggg

SEQ ID NO: 1179321 - RNA, 23 nt, Human
gggaggcagaggaggcccagcag

SEQ ID NO: 1179322 - RNA, 19 nt, Human
ggggccagcugggggcugg

SEQ ID NO: 1179323 - RNA, 18 nt, Human
uaauaggcagggcauuuc

SEQ ID NO: 1179324 - RNA, 19 nt, Human
ucaggggccagcugggggc

SEQ ID NO: 1179325 - RNA, 20 nt, Human
uggagucaggggccagcugg

SEQ ID NO: 1179326 - RNA, 21 nt, Human
ugggagcucauuuaauaggca

SEQ ID NO: 1179327 - RNA, 24 nt, Human
aaaaucugcuuacagauuucaguu

SEQ ID NO: 1179328 - RNA, 23 nt, Human
accagcgccucgcgguaacgacc

SEQ ID NO: 1179329 - RNA, 19 nt, Human
acccagaagccggcaaacc

SEQ ID NO: 1179330 - RNA, 18 nt, Human
agacccagaagccggcaa

SEQ ID NO: 1179331 - RNA, 21 nt, Human
aggcagccgccacagcguguc

SEQ ID NO: 1179332 - RNA, 22 nt, Human
caaaccagggcugacccgcgcc

SEQ ID NO: 1179333 - RNA, 23 nt, Human
caaagacccagaagccggcaaac

SEQ ID NO: 1179334 - RNA, 23 nt, Human
caagccgcuccgccagccgacga

SEQ ID NO: 1179335 - RNA, 18 nt, Human
cagaagccggcaaaccag

SEQ ID NO: 1179336 - RNA, 21 nt, Human
cagccgacgaccuuguuucug

SEQ ID NO: 1179337 - RNA, 23 nt, Human
cagcgccucgcgguaacgaccga

SEQ ID NO: 1179338 - RNA, 22 nt, Human
ccaaccacaagugcgcggcgcc

SEQ ID NO: 1179339 - RNA, 23 nt, Human
ccacaagugcgcggcgccgcgac

SEQ ID NO: 1179340 - RNA, 25 nt, Human
ccagcgccucgcgguaacgaccgag

SEQ ID NO: 1179341 - RNA, 20 nt, Human
ggucugcagaacuucaucaa

SEQ ID NO: 1179342 - RNA, 24 nt, Human
uaggaaacauuuacaaacacugag

SEQ ID NO: 1179343 - RNA, 21 nt, Human
uccguaccacggccacauugg

SEQ ID NO: 1179344 - RNA, 19 nt, Human
ugagaucuuccuucuuggc

SEQ ID NO: 1179345 - RNA, 19 nt, Human
uguucaaagacccagaagc

SEQ ID NO: 1179346 - RNA, 22 nt, Human
uugguuaggcggaucugguugg

SEQ ID NO: 1179347 - RNA, 18 nt, Human
uuuggucaucuguuccaa

SEQ ID NO: 1179348 - RNA, 21 nt, Human
agacaccaacggucggaaacc

SEQ ID NO: 1179349 - RNA, 25 nt, Human
agaucaccugaggucaggaguuggg

SEQ ID NO: 1179350 - RNA, 22 nt, Human
aggcgggcagaucaccugaggu

SEQ ID NO: 1179351 - RNA, 26 nt, Human
aggcgggcagaucaccugaggucagg

SEQ ID NO: 1179352 - RNA, 20 nt, Human
caccaacggucagaaaccgc

SEQ ID NO: 1179353 - RNA, 18 nt, Human
cagacaccaacggucaga

SEQ ID NO: 1179354 - RNA, 21 nt, Human
cagacaccaacggucggaaag

SEQ ID NO: 1179355 - RNA, 24 nt, Human
cagcacuuugggagguggaggcgg

SEQ ID NO: 1179356 - RNA, 22 nt, Human
caggaguuggggaccagucaug

SEQ ID NO: 1179357 - RNA, 24 nt, Human
caggccuguaaucucagcacuuug

SEQ ID NO: 1179358 - RNA, 18 nt, Human
caguguccuguaucaugu

SEQ ID NO: 1179359 - RNA, 24 nt, Human
cauggccaccauggugaaauuccg

SEQ ID NO: 1179360 - RNA, 19 nt, Human
cauggugaaauuccgucuc

SEQ ID NO: 1179361 - RNA, 21 nt, Human
cauggugaaauuccgucucua

SEQ ID NO: 1179362 - RNA, 20 nt, Human
ccugaggucaggaguugggg

SEQ ID NO: 1179363 - RNA, 22 nt, Human
ccuguaaucucagcacuuuggg

SEQ ID NO: 1179364 - RNA, 21 nt, Human
cgcucggaaaccgccagacac

SEQ ID NO: 1179365 - RNA, 24 nt, Human
cgcucggaauacacgccagaccac

SEQ ID NO: 1179366 - RNA, 24 nt, Human
cgggcagaucaccugaggucagga

SEQ ID NO: 1179367 - RNA, 21 nt, Human
cggucagaaaccgccagacac

SEQ ID NO: 1179368 - RNA, 24 nt, Human
cucaggccuguaaucucagcacuu

SEQ ID NO: 1179369 - RNA, 22 nt, Human
cugcuuucuucuucacaccgcg

SEQ ID NO: 1179370 - RNA, 21 nt, Human
gaucaccugaggucaggaguu

SEQ ID NO: 1179371 - RNA, 23 nt, Human
gaucaccugaggucaggaguugg

SEQ ID NO: 1179372 - RNA, 24 nt, Human
gaucaccugaggucaggaguuggg

SEQ ID NO: 1179373 - RNA, 25 nt, Human
gaucaccugaggucaggaguugggg

SEQ ID NO: 1179374 - RNA, 24 nt, Human
gccaccauggugaaauuccgucuc

SEQ ID NO: 1179375 - RNA, 20 nt, Human
ggaggcgggcagaucaccug

SEQ ID NO: 1179376 - RNA, 23 nt, Human
ggccuguaaucucagcacuuugg

SEQ ID NO: 1179377 - RNA, 23 nt, Human
ggcgcgguggcucaggccuguaa

SEQ ID NO: 1179378 - RNA, 19 nt, Human
ggcugggcgcgguggcuca

SEQ ID NO: 1179379 - RNA, 26 nt, Human
gggcagaucaccugaggucaggaguu

SEQ ID NO: 1179380 - RNA, 23 nt, Human
gguggcucaggccuguaaucuca

SEQ ID NO: 1179381 - RNA, 24 nt, Human
gguggcucaggccuguaaucucag

SEQ ID NO: 1179382 - RNA, 20 nt, Human
guaucauguuucagagggug

SEQ ID NO: 1179383 - RNA, 18 nt, Human
uaaaacagaugccauggc

SEQ ID NO: 1179384 - RNA, 24 nt, Human
ucaguggucguuuugcugcuuucu

SEQ ID NO: 1179385 - RNA, 26 nt, Human
ucaguggucguuuugcugcuuucuuc

SEQ ID NO: 1179386 - RNA, 23 nt, Human
ucuucacaccgcgauugaagcug

SEQ ID NO: 1179387 - RNA, 22 nt, Human
ugacgauguaccgcuugggacc

SEQ ID NO: 1179388 - RNA, 18 nt, Human
ugccauggcugggcgcgg

SEQ ID NO: 1179389 - RNA, 18 nt, Human
ugcugcuuucuucuucac

SEQ ID NO: 1179390 - RNA, 27 nt, Human
uggaggcgggcagaucaccugagguca

SEQ ID NO: 1179391 - RNA, 21 nt, Human
uggccaccauggugaaauucc

SEQ ID NO: 1179392 - RNA, 19 nt, Human
uggcucaggccuguaaucu

SEQ ID NO: 1179393 - RNA, 24 nt, Human
uggcucaggccuguaaucucagca

SEQ ID NO: 1179394 - RNA, 22 nt, Human
uggcugggcgcgguggcucagg

SEQ ID NO: 1179395 - RNA, 23 nt, Human
uggcugggcgcgguggcucaggc

SEQ ID NO: 1179396 - RNA, 24 nt, Human
ugggagguggaggcgggcagauca

SEQ ID NO: 1179397 - RNA, 25 nt, Human
uuuccggcuaugacgauguaccgcu

SEQ ID NO: 1179398 - RNA, 18 nt, Human
aaagugcugggauuacaa

SEQ ID NO: 1179399 - RNA, 24 nt, Human
aaagugcugggauuacaaguguga

SEQ ID NO: 1179400 - RNA, 19 nt, Human
aacugaacucccaggugcc

SEQ ID NO: 1179401 - RNA, 20 nt, Human
aagcguguuggggucuccuc

SEQ ID NO: 1179402 - RNA, 19 nt, Human
aaguagcugggauuauagg

SEQ ID NO: 1179403 - RNA, 24 nt, Human
aaguagcugggauuauaggcacac

SEQ ID NO: 1179404 - RNA, 24 nt, Human
aagugauccgccugccuuggcuuc

SEQ ID NO: 1179405 - RNA, 18 nt, Human
aagugcugggauuacaag

SEQ ID NO: 1179406 - RNA, 19 nt, Human
aagugcugggauuacaagu

SEQ ID NO: 1179407 - RNA, 26 nt, Human
aagugcugggauuacaagugugagcc

SEQ ID NO: 1179408 - RNA, 21 nt, Human
aaucaggaaggucggaaucuc

SEQ ID NO: 1179409 - RNA, 18 nt, Human
acaggguuucaccauguu

SEQ ID NO: 1179410 - RNA, 23 nt, Human
acaggguuucaccauguuggcca

SEQ ID NO: 1179411 - RNA, 24 nt, Human
acaggguuucaccauguuggccag

SEQ ID NO: 1179412 - RNA, 18 nt, Human
accauguuggccaggcug

SEQ ID NO: 1179413 - RNA, 23 nt, Human
acccaggcuggaguguaguggug

SEQ ID NO: 1179414 - RNA, 20 nt, Human
acccuucuuuuuuuucuucu

SEQ ID NO: 1179415 - RNA, 21 nt, Human
accgccuggcuaauuuuugua

SEQ ID NO: 1179416 - RNA, 18 nt, Human
acucugucacccagacug

SEQ ID NO: 1179417 - RNA, 25 nt, Human
acucugucacccagacuggagugca

SEQ ID NO: 1179418 - RNA, 24 nt, Human
aggcacacaccacuaccgccuggc

SEQ ID NO: 1179419 - RNA, 19 nt, Human
aggcucaagugauucuccu

SEQ ID NO: 1179420 - RNA, 24 nt, Human
agugcaguagcacgaucucggcuc

SEQ ID NO: 1179421 - RNA, 21 nt, Human
aguguaguggugcaaucucag

SEQ ID NO: 1179422 - RNA, 24 nt, Human
aguguaguggugcaaucucagcuc

SEQ ID NO: 1179423 - RNA, 20 nt, Human
aguuauucuccugccucagc

SEQ ID NO: 1179424 - RNA, 18 nt, Human
aucucacucugucaccca

SEQ ID NO: 1179425 - RNA, 24 nt, Human
aucuugcuuugucacccaggcugg

SEQ ID NO: 1179426 - RNA, 24 nt, Human
auuuuuguacuuuuaguagagaug

SEQ ID NO: 1179427 - RNA, 24 nt, Human
caaagugcugggauuacaagugug

SEQ ID NO: 1179428 - RNA, 23 nt, Human
caaccucuuccucccaggcucaa

SEQ ID NO: 1179429 - RNA, 22 nt, Human
caagugauccgccugccuuggc

SEQ ID NO: 1179430 - RNA, 22 nt, Human
caagugauucuccugucuuagc

SEQ ID NO: 1179431 - RNA, 21 nt, Human
caccauguuggccaggcuggu

SEQ ID NO: 1179432 - RNA, 24 nt, Human
caccauguuggccaggcuggucuc

SEQ ID NO: 1179433 - RNA, 27 nt, Human
caccauguuggccaggcuggucucaaa

SEQ ID NO: 1179434 - RNA, 24 nt, Human
cacccaggcuggaguguaguggug

SEQ ID NO: 1179435 - RNA, 22 nt, Human
cacucugucacccagacuggag

SEQ ID NO: 1179436 - RNA, 23 nt, Human
cacucugucacccagacuggagu

SEQ ID NO: 1179437 - RNA, 24 nt, Human
cacugcacccagccugaauuucuc

SEQ ID NO: 1179438 - RNA, 24 nt, Human
caggguuucaccauguuggccagg

SEQ ID NO: 1179439 - RNA, 28 nt, Human
caucucccggauuccaguuauucuccuu

SEQ ID NO: 1179440 - RNA, 24 nt, Human
cauguuggccaggcuggucucaaa

SEQ ID NO: 1179441 - RNA, 24 nt, Human
cauuuuguacuuuuaauagagaca

SEQ ID NO: 1179442 - RNA, 20 nt, Human
ccaaagugcugggauuacaa

SEQ ID NO: 1179443 - RNA, 21 nt, Human
ccaaagugcugggauuacaag

SEQ ID NO: 1179444 - RNA, 24 nt, Human
ccaaagugcugggauuacaagugu

SEQ ID NO: 1179445 - RNA, 19 nt, Human
ccacugcacccagccugaa

SEQ ID NO: 1179446 - RNA, 20 nt, Human
ccacugcacccagccugaau

SEQ ID NO: 1179447 - RNA, 23 nt, Human
ccagcagaggcuguguccucucc

SEQ ID NO: 1179448 - RNA, 24 nt, Human
ccaguuauucuccugccucagccu

SEQ ID NO: 1179449 - RNA, 20 nt, Human
cccaaccucagaccacuguc

SEQ ID NO: 1179450 - RNA, 23 nt, Human
cccaaguagcugggauuauaggc

SEQ ID NO: 1179451 - RNA, 24 nt, Human
cccaaguagcugggauuauaggca

SEQ ID NO: 1179452 - RNA, 21 nt, Human
cccaggcucaagugauucucc

SEQ ID NO: 1179453 - RNA, 21 nt, Human
cccaggcucaagugauucucc

SEQ ID NO: 1179454 - RNA, 20 nt, Human
ccgccuggcuaauuuuugua

SEQ ID NO: 1179455 - RNA, 21 nt, Human
ccucaagugauccgccugccu

SEQ ID NO: 1179456 - RNA, 24 nt, Human
ccucccaggcucaagugauucucc

SEQ ID NO: 1179457 - RNA, 24 nt, Human
ccucucagguagcugggauuacag

SEQ ID NO: 1179458 - RNA, 22 nt, Human
ccugccuuggcuucccaaagug

SEQ ID NO: 1179459 - RNA, 22 nt, Human
ccuggagauccugggugaaugg

SEQ ID NO: 1179460 - RNA, 18 nt, Human
ccuggccucaagugaucc

SEQ ID NO: 1179461 - RNA, 18 nt, Human
ccuggccucaagugaucc

SEQ ID NO: 1179462 - RNA, 21 nt, Human
ccuggccucaagugauccgcc

SEQ ID NO: 1179463 - RNA, 23 nt, Human
ccuggccucaagugauccgccug

SEQ ID NO: 1179464 - RNA, 21 nt, Human
cuaccgccuggcuaauuuuug

SEQ ID NO: 1179465 - RNA, 23 nt, Human
cucaagugauccgccugccuugg

SEQ ID NO: 1179466 - RNA, 23 nt, Human
cucaagugauucuccugucuuag

SEQ ID NO: 1179467 - RNA, 24 nt, Human
cucacugcaacaugcaucucccgg

SEQ ID NO: 1179468 - RNA, 19 nt, Human
cucacugcaaccucuuccu

SEQ ID NO: 1179469 - RNA, 24 nt, Human
cucacugcaaccucuuccucccag

SEQ ID NO: 1179470 - RNA, 23 nt, Human
cucagccucucagguagcuggga

SEQ ID NO: 1179471 - RNA, 23 nt, Human
cucagguagcugggauuacaggu

SEQ ID NO: 1179472 - RNA, 24 nt, Human
cucagguagcugggauuacaggug

SEQ ID NO: 1179473 - RNA, 20 nt, Human
cucaugccaaccuggcaacc

SEQ ID NO: 1179474 - RNA, 18 nt, Human
cucccaggcucaagugau

SEQ ID NO: 1179475 - RNA, 20 nt, Human
cucccaggugccgacagagu

SEQ ID NO: 1179476 - RNA, 24 nt, Human
cuccugccacugucccaaccucag

SEQ ID NO: 1179477 - RNA, 22 nt, Human
cuccugccucagccucucaggu

SEQ ID NO: 1179478 - RNA, 23 nt, Human
cugcaaccucuuccucccaggcu

SEQ ID NO: 1179479 - RNA, 24 nt, Human
cugcaaccucuuccucccaggcuc

SEQ ID NO: 1179480 - RNA, 20 nt, Human
cugccaggcugaucucuugu

SEQ ID NO: 1179481 - RNA, 23 nt, Human
cugccucagccucucagguagcu

SEQ ID NO: 1179482 - RNA, 19 nt, Human
cugggugaaugguaucucc

SEQ ID NO: 1179483 - RNA, 23 nt, Human
cugucuuagccucccaaguagcu

SEQ ID NO: 1179484 - RNA, 18 nt, Human
cuuccucccaggcucaag

SEQ ID NO: 1179485 - RNA, 19 nt, Human
cuuuuaguagagauggggu

SEQ ID NO: 1179486 - RNA, 22 nt, Human
gacagaaucuugcuuugucacc

SEQ ID NO: 1179487 - RNA, 18 nt, Human
gauuacaagugugagcca

SEQ ID NO: 1179488 - RNA, 22 nt, Human
gauuacaagugugagccacugc

SEQ ID NO: 1179489 - RNA, 23 nt, Human
gauuacaagugugagccacugca

SEQ ID NO: 1179490 - RNA, 18 nt, Human
gauuacaggugccugcca

SEQ ID NO: 1179491 - RNA, 21 nt, Human
gccauaaugcccagcuccauu

SEQ ID NO: 1179492 - RNA, 22 nt, Human
gccuuggcuucccaaagugcug

SEQ ID NO: 1179493 - RNA, 24 nt, Human
gccuuggcuucccaaagugcuggg

SEQ ID NO: 1179494 - RNA, 21 nt, Human
gcucacugcaaccucuuccuc

SEQ ID NO: 1179495 - RNA, 21 nt, Human
gcugggauuacaagugugagc

SEQ ID NO: 1179496 - RNA, 23 nt, Human
gcuggucucaaacuccuggccuc

SEQ ID NO: 1179497 - RNA, 24 nt, Human
gcuugaagcguguuggggucuccu

SEQ ID NO: 1179498 - RNA, 24 nt, Human
ggcuggucucaaacuccuggccuc

SEQ ID NO: 1179499 - RNA, 22 nt, Human
ggguuucaccauguuggccagg

SEQ ID NO: 1179500 - RNA, 20 nt, Human
gguagcugggauuacaggug

SEQ ID NO: 1179501 - RNA, 18 nt, Human
guagcugggauuacaggu

SEQ ID NO: 1179502 - RNA, 20 nt, Human
guagcugggauuacaggugc

SEQ ID NO: 1179503 - RNA, 18 nt, Human
guagcugggauuauaggc

SEQ ID NO: 1179504 - RNA, 18 nt, Human
guccaacugaacucccag

SEQ ID NO: 1179505 - RNA, 24 nt, Human
gugauucuccugucuuagccuccc

SEQ ID NO: 1179506 - RNA, 23 nt, Human
uaacugccaggcugaucucuugu

SEQ ID NO: 1179507 - RNA, 24 nt, Human
uaauagagacaggguuucaccaug

SEQ ID NO: 1179508 - RNA, 25 nt, Human
uaauagagacaggguuucaccaugu

SEQ ID NO: 1179509 - RNA, 24 nt, Human
uaauuuuuguacuuuuaguagaga

SEQ ID NO: 1179510 - RNA, 24 nt, Human
uacaagugugagccacugcaccca

SEQ ID NO: 1179511 - RNA, 21 nt, Human
uagagacaggguuucaccaug

SEQ ID NO: 1179512 - RNA, 22 nt, Human
uagagacaggguuucaccaugu

SEQ ID NO: 1179513 - RNA, 19 nt, Human
uauucuccugccucagccu

SEQ ID NO: 1179514 - RNA, 24 nt, Human
ucacccaggcuggaguguaguggu

SEQ ID NO: 1179515 - RNA, 24 nt, Human
ucacugcaacaugcaucucccgga

SEQ ID NO: 1179516 - RNA, 22 nt, Human
ucacugcaaccucuuccuccca

SEQ ID NO: 1179517 - RNA, 24 nt, Human
ucacugcaaccucuuccucccagg

SEQ ID NO: 1179518 - RNA, 25 nt, Human
ucaggaugggaaagaaaaguagggu

SEQ ID NO: 1179519 - RNA, 21 nt, Human
ucagguagcugggauuacagg

SEQ ID NO: 1179520 - RNA, 18 nt, Human
ucccaaagugcugggauu

SEQ ID NO: 1179521 - RNA, 23 nt, Human
ucccaaagugcugggauuacaag

SEQ ID NO: 1179522 - RNA, 24 nt, Human
ucccaaguagcugggauuauaggc

SEQ ID NO: 1179523 - RNA, 21 nt, Human
ucccaggcucaagugauucuc

SEQ ID NO: 1179524 - RNA, 24 nt, Human
ucccaggcucaagugauucuccug

SEQ ID NO: 1179525 - RNA, 21 nt, Human
ucccaggugccgacagagucc

SEQ ID NO: 1179526 - RNA, 18 nt, Human
uccccagguucuccuucc

SEQ ID NO: 1179527 - RNA, 21 nt, Human
uccccagguucuccuuccuga

SEQ ID NO: 1179528 - RNA, 21 nt, Human
ucccggauuccaguuauucuc

SEQ ID NO: 1179529 - RNA, 24 nt, Human
ucccggauuccaguuauucuccug

SEQ ID NO: 1179530 - RNA, 18 nt, Human
ucccucuguucccugucc

SEQ ID NO: 1179531 - RNA, 21 nt, Human
uccugggugaaugguaucucc

SEQ ID NO: 1179532 - RNA, 18 nt, Human
uccuuggucuucuucugg

SEQ ID NO: 1179533 - RNA, 24 nt, Human
ucucacucugucacccagacugga

SEQ ID NO: 1179534 - RNA, 26 nt, Human
ucucacucugucacccagacuggagu

SEQ ID NO: 1179535 - RNA, 27 nt, Human
ucucacucugucacccagacuggagug

SEQ ID NO: 1179536 - RNA, 23 nt, Human
ucucagguagcugggauuacagg

SEQ ID NO: 1179537 - RNA, 24 nt, Human
ucucagguagcugggauuacaggu

SEQ ID NO: 1179538 - RNA, 24 nt, Human
ucucccggauuccaguuauucucc

SEQ ID NO: 1179539 - RNA, 26 nt, Human
ucuccugucuuagccucccaaguagc

SEQ ID NO: 1179540 - RNA, 24 nt, Human
ucugucacccagacuggagugcag

SEQ ID NO: 1179541 - RNA, 25 nt, Human
ucuuagccucccaaguagcugggau

SEQ ID NO: 1179542 - RNA, 19 nt, Human
ucuuccucccaggcucaag

SEQ ID NO: 1179543 - RNA, 23 nt, Human
ucuugcuuugucacccaggcugg

SEQ ID NO: 1179544 - RNA, 24 nt, Human
ucuugcuuugucacccaggcugga

SEQ ID NO: 1179545 - RNA, 18 nt, Human
ucuuuuuuuuuuuuuuuu

SEQ ID NO: 1179546 - RNA, 21 nt, Human
ugaauuucuccauucuuccca

SEQ ID NO: 1179547 - RNA, 23 nt, Human
ugacccuucuuuuuuuucuucuu

SEQ ID NO: 1179548 - RNA, 24 nt, Human
ugccucagccucucagguagcugg

SEQ ID NO: 1179549 - RNA, 19 nt, Human
ugccuuggcuucccaaagu

SEQ ID NO: 1179550 - RNA, 27 nt, Human
ugcugggauuacaagugugagccacug

SEQ ID NO: 1179551 - RNA, 24 nt, Human
ugcuuugucacccaggcuggagug

SEQ ID NO: 1179552 - RNA, 23 nt, Human
uggagugcaguagcacgaucucg

SEQ ID NO: 1179553 - RNA, 24 nt, Human
uggagugcaguagcacgaucucgg

SEQ ID NO: 1179554 - RNA, 23 nt, Human
uggaguguaguggugcaaucuca

SEQ ID NO: 1179555 - RNA, 24 nt, Human
uggaguguaguggugcaaucucag

SEQ ID NO: 1179556 - RNA, 24 nt, Human
uggccaggcuggucucaaacuccu

SEQ ID NO: 1179557 - RNA, 18 nt, Human
uggccucaagugauccgc

SEQ ID NO: 1179558 - RNA, 24 nt, Human
uggccucaagugauccgccugccu

SEQ ID NO: 1179559 - RNA, 19 nt, Human
ugggagaagucaggagugg

SEQ ID NO: 1179560 - RNA, 24 nt, Human
ugggagaagucaggaguggagaac

SEQ ID NO: 1179561 - RNA, 19 nt, Human
ugggauuacaagugugagc

SEQ ID NO: 1179562 - RNA, 21 nt, Human
ugggauuacaagugugagcca

SEQ ID NO: 1179563 - RNA, 22 nt, Human
ugggauuacaagugugagccac

SEQ ID NO: 1179564 - RNA, 22 nt, Human
ugggauuacaagugugagccac

SEQ ID NO: 1179565 - RNA, 24 nt, Human
ugggauuacaagugugagccacug

SEQ ID NO: 1179566 - RNA, 19 nt, Human
ugggauuacaggugccugc

SEQ ID NO: 1179567 - RNA, 21 nt, Human
ugggauuacaggugccugcca

SEQ ID NO: 1179568 - RNA, 21 nt, Human
ugggauuacaggugccugcca

SEQ ID NO: 1179569 - RNA, 22 nt, Human
ugggauuacaggugccugccau

SEQ ID NO: 1179570 - RNA, 21 nt, Human
ugggauuauaggcacacacca

SEQ ID NO: 1179571 - RNA, 22 nt, Human
ugggauuauaggcacacaccac

SEQ ID NO: 1179572 - RNA, 24 nt, Human
uggugcaaucucagcucacugcaa

SEQ ID NO: 1179573 - RNA, 20 nt, Human
uguacaugcccguuucagag

SEQ ID NO: 1179574 - RNA, 21 nt, Human
uguccaaaagcaucuucaggg

SEQ ID NO: 1179575 - RNA, 22 nt, Human
ugucccagcagaggcugugucc

SEQ ID NO: 1179576 - RNA, 19 nt, Human
uguccuggagauccugggu

SEQ ID NO: 1179577 - RNA, 24 nt, Human
uuaauagagacaggguuucaccau

SEQ ID NO: 1179578 - RNA, 18 nt, Human
uuaguagagaugggguuu

SEQ ID NO: 1179579 - RNA, 21 nt, Human
uuccaguuauucuccugccuc

SEQ ID NO: 1179580 - RNA, 23 nt, Human
uucuucccacacacccuccccag

SEQ ID NO: 1179581 - RNA, 19 nt, Human
uugaagcguguuggggucu

SEQ ID NO: 1179582 - RNA, 24 nt, Human
uugaagcguguuggggucuccucu

SEQ ID NO: 1179583 - RNA, 24 nt, Human
uugcuuugucacccaggcuggagu

SEQ ID NO: 1179584 - RNA, 24 nt, Human
uuucaccauguuggccaggcuggu

SEQ ID NO: 1179585 - RNA, 24 nt, Human
uuugucacccaggcuggaguguag

SEQ ID NO: 1179586 - RNA, 20 nt, Human
uuuuuguacuuuuaguagag

SEQ ID NO: 1179587 - RNA, 26 nt, Human
uuuuuuuuuuuugagauagcaucuca

SEQ ID NO: 1179588 - RNA, 18 nt, Human
uuuuuuuuuuuuuuuuug

SEQ ID NO: 1179589 - RNA, 19 nt, Human
aaaacacuccuggcggccu

SEQ ID NO: 1179590 - RNA, 19 nt, Human
aaagcccugcccacccacc

SEQ ID NO: 1179591 - RNA, 20 nt, Human
aagcccugcccacccacccc

SEQ ID NO: 1179592 - RNA, 21 nt, Human
aagcccugcccacccaccccc

SEQ ID NO: 1179593 - RNA, 19 nt, Human
acagaacguacaaagacaa

SEQ ID NO: 1179594 - RNA, 20 nt, Human
acagccgaggccugaucacc

SEQ ID NO: 1179595 - RNA, 22 nt, Human
acagguccccuuggcaaggccc

SEQ ID NO: 1179596 - RNA, 22 nt, Human
acgccgcagcagcuccugcagc

SEQ ID NO: 1179597 - RNA, 24 nt, Human
acgcuggaaggcaggcaggaaggc

SEQ ID NO: 1179598 - RNA, 18 nt, Human
agaacgcucccgacgccg

SEQ ID NO: 1179599 - RNA, 24 nt, Human
agacagggacagaaaaauacagaa

SEQ ID NO: 1179600 - RNA, 20 nt, Human
agcaggucccggagcugccc

SEQ ID NO: 1179601 - RNA, 20 nt, Human
agcgccagaggcauaaagcc

SEQ ID NO: 1179602 - RNA, 23 nt, Human
aggacagcugcagccgggaagga

SEQ ID NO: 1179603 - RNA, 19 nt, Human
aggcaggcaggaaggccuc

SEQ ID NO: 1179604 - RNA, 23 nt, Human
aggcagggugucuucagcgccag

SEQ ID NO: 1179605 - RNA, 18 nt, Human
aggcagugggggaggagg

SEQ ID NO: 1179606 - RNA, 19 nt, Human
aggccccuaggggacccag

SEQ ID NO: 1179607 - RNA, 24 nt, Human
aggccccuaggggacccaggcauc

SEQ ID NO: 1179608 - RNA, 21 nt, Human
aggccuccaggcuuugcuccc

SEQ ID NO: 1179609 - RNA, 20 nt, Human
aggcucaggacaugaugucg

SEQ ID NO: 1179610 - RNA, 19 nt, Human
aggggggccgggccgaggg

SEQ ID NO: 1179611 - RNA, 19 nt, Human
agugggcaggacagcugca

SEQ ID NO: 1179612 - RNA, 23 nt, Human
aucuucccaggccccuguaguug

SEQ ID NO: 1179613 - RNA, 21 nt, Human
cacagccgaggccugaucacc

SEQ ID NO: 1179614 - RNA, 22 nt, Human
cacagccgaggccugaucaccu

SEQ ID NO: 1179615 - RNA, 18 nt, Human
cacggaaacaaaaaaggc

SEQ ID NO: 1179616 - RNA, 25 nt, Human
cacucucaccugcacaggucagaag

SEQ ID NO: 1179617 - RNA, 19 nt, Human
cacugggcgggaguccaag

SEQ ID NO: 1179618 - RNA, 21 nt, Human
cagaauggucuuuccugggua

SEQ ID NO: 1179619 - RNA, 25 nt, Human
cagcagccgaggugggggccggcug

SEQ ID NO: 1179620 - RNA, 23 nt, Human
cagcuccugcagcuucucugccu

SEQ ID NO: 1179621 - RNA, 23 nt, Human
cagggccagggccugccugaggc

SEQ ID NO: 1179622 - RNA, 23 nt, Human
caggggacccuccuccccagcuc

SEQ ID NO: 1179623 - RNA, 24 nt, Human
cauaaagcccugcccacccacccc

SEQ ID NO: 1179624 - RNA, 24 nt, Human
caucugcuccucugccuccugcuc

SEQ ID NO: 1179625 - RNA, 18 nt, Human
ccacccaggcaguggggg

SEQ ID NO: 1179626 - RNA, 24 nt, Human
ccagggccagggccugccugaggc

SEQ ID NO: 1179627 - RNA, 19 nt, Human
ccaggggacccuccucccc

SEQ ID NO: 1179628 - RNA, 18 nt, Human
cccaaagcgccccgggcu

SEQ ID NO: 1179629 - RNA, 23 nt, Human
cccaaagcgccccgggcugccgg

SEQ ID NO: 1179630 - RNA, 22 nt, Human
cccacccacccccagcccccuc

SEQ ID NO: 1179631 - RNA, 22 nt, Human
cccagcucagccuccagggccu

SEQ ID NO: 1179632 - RNA, 22 nt, Human
cccaggccccuguaguugaguc

SEQ ID NO: 1179633 - RNA, 23 nt, Human
ccccagcccccucucgggccucu

SEQ ID NO: 1179634 - RNA, 19 nt, Human
ccccagggucuggagcaug

SEQ ID NO: 1179635 - RNA, 18 nt, Human
ccccgggcugccgggcuc

SEQ ID NO: 1179636 - RNA, 19 nt, Human
ccccuguaguugagucaag

SEQ ID NO: 1179637 - RNA, 18 nt, Human
ccccuuggcaaggccccu

SEQ ID NO: 1179638 - RNA, 20 nt, Human
ccccuuggcaaggccccuag

SEQ ID NO: 1179639 - RNA, 22 nt, Human
cccgcccgcgccgcccgggccc

SEQ ID NO: 1179640 - RNA, 19 nt, Human
ccgcaccguggauccuacc

SEQ ID NO: 1179641 - RNA, 18 nt, Human
ccgcagcagcuccugcag

SEQ ID NO: 1179642 - RNA, 24 nt, Human
ccgcagcagcuccugcagcuucuc

SEQ ID NO: 1179643 - RNA, 25 nt, Human
ccgcagcagcuccugcagcuucucu

SEQ ID NO: 1179644 - RNA, 21 nt, Human
ccgcgcccccagcucggcugc

SEQ ID NO: 1179645 - RNA, 18 nt, Human
ccgcuccgccccggcucc

SEQ ID NO: 1179646 - RNA, 18 nt, Human
ccgcuccgcuccggcucc

SEQ ID NO: 1179647 - RNA, 25 nt, Human
ccucucgggccucuuccaggggacc

SEQ ID NO: 1179648 - RNA, 21 nt, Human
ccugaggccagggggaggggc

SEQ ID NO: 1179649 - RNA, 20 nt, Human
ccugccugaggccaggggga

SEQ ID NO: 1179650 - RNA, 19 nt, Human
ccuugccccagggucugga

SEQ ID NO: 1179651 - RNA, 21 nt, Human
cgagcagcagcugcuccaucu

SEQ ID NO: 1179652 - RNA, 22 nt, Human
cgagggggcacccgggggagcc

SEQ ID NO: 1179653 - RNA, 24 nt, Human
cgcccccagcucggcugcuggcuc

SEQ ID NO: 1179654 - RNA, 20 nt, Human
cgcccgcccgcgcccccagc

SEQ ID NO: 1179655 - RNA, 23 nt, Human
cgcuccgcuccgcuccggcucca

SEQ ID NO: 1179656 - RNA, 23 nt, Human
cgcuccgcuccggcuccaggauc

SEQ ID NO: 1179657 - RNA, 23 nt, Human
cggaaacaaaaaaggcagggugu

SEQ ID NO: 1179658 - RNA, 19 nt, Human
cggcccgcuccgccccggc

SEQ ID NO: 1179659 - RNA, 22 nt, Human
cggggcacggaaacaaaaaagg

SEQ ID NO: 1179660 - RNA, 18 nt, Human
cguacaaagacaaggacc

SEQ ID NO: 1179661 - RNA, 19 nt, Human
cucaaaaagcuuccauucu

SEQ ID NO: 1179662 - RNA, 22 nt, Human
cuccaggauccgcuccggcucc

SEQ ID NO: 1179663 - RNA, 18 nt, Human
cuccccagcucagccucc

SEQ ID NO: 1179664 - RNA, 21 nt, Human
cuccccagcucagccuccagg

SEQ ID NO: 1179665 - RNA, 19 nt, Human
cuccucugccuccugcucc

SEQ ID NO: 1179666 - RNA, 25 nt, Human
cugcccucaaaaagcuuccauucua

SEQ ID NO: 1179667 - RNA, 22 nt, Human
cuggaaggcaggcaggaaggcc

SEQ ID NO: 1179668 - RNA, 23 nt, Human
cugugggccccagaauuuggggg

SEQ ID NO: 1179669 - RNA, 20 nt, Human
gacccuccuccccagcucag

SEQ ID NO: 1179670 - RNA, 20 nt, Human
gagacagggacagaaaaaua

SEQ ID NO: 1179671 - RNA, 21 nt, Human
gaucagcagccgagguggggg

SEQ ID NO: 1179672 - RNA, 19 nt, Human
gcagccgggaaggauuugg

SEQ ID NO: 1179673 - RNA, 21 nt, Human
gcagccgggaaggauuugggg

SEQ ID NO: 1179674 - RNA, 19 nt, Human
gccagggggaggggccugc

SEQ ID NO: 1179675 - RNA, 18 nt, Human
gcccgcccgcgcccccag

SEQ ID NO: 1179676 - RNA, 19 nt, Human
gcccugcccacccaccccc

SEQ ID NO: 1179677 - RNA, 22 nt, Human
gcccugcccacccacccccagc

SEQ ID NO: 1179678 - RNA, 24 nt, Human
gccgcaccguggauccuaccggug

SEQ ID NO: 1179679 - RNA, 18 nt, Human
gccgggaaggauuugggg

SEQ ID NO: 1179680 - RNA, 19 nt, Human
gccugccccuccccccacc

SEQ ID NO: 1179681 - RNA, 20 nt, Human
gcuccggccccgcccgcgcc

SEQ ID NO: 1179682 - RNA, 24 nt, Human
gggcacugcugguggcccccgggc

SEQ ID NO: 1179683 - RNA, 20 nt, Human
gggcuccggccccgcccgcg

SEQ ID NO: 1179684 - RNA, 18 nt, Human
ggggaucagcagccgagg

SEQ ID NO: 1179685 - RNA, 18 nt, Human
gggggaggaggaggagcc

SEQ ID NO: 1179686 - RNA, 21 nt, Human
gggggcaggcuccggggcacu

SEQ ID NO: 1179687 - RNA, 19 nt, Human
gggggccgcaccguggauc

SEQ ID NO: 1179688 - RNA, 25 nt, Human
uacaaagacaaggaccugcccucaa

SEQ ID NO: 1179689 - RNA, 25 nt, Human
uccagggccagggccugccugaggc

SEQ ID NO: 1179690 - RNA, 20 nt, Human
uccccgagcagcagcugcuc

SEQ ID NO: 1179691 - RNA, 22 nt, Human
uccccgagcagcagcugcucca

SEQ ID NO: 1179692 - RNA, 22 nt, Human
uccgccccggcuccgcuccgcu

SEQ ID NO: 1179693 - RNA, 21 nt, Human
uccgcuccggcuccaggaucc

SEQ ID NO: 1179694 - RNA, 18 nt, Human
uccgcuccggcuccggcc

SEQ ID NO: 1179695 - RNA, 25 nt, Human
ucucgggccucuuccaggggacccu

SEQ ID NO: 1179696 - RNA, 22 nt, Human
ucugccuccugcuccgccucuu

SEQ ID NO: 1179697 - RNA, 18 nt, Human
ucuucagcgccagaggca

SEQ ID NO: 1179698 - RNA, 26 nt, Human
ucuucagcgccagaggcauaaagccc

SEQ ID NO: 1179699 - RNA, 18 nt, Human
ugcagccgggaaggauuu

SEQ ID NO: 1179700 - RNA, 24 nt, Human
ugcgagcccaguggaguggugggg

SEQ ID NO: 1179701 - RNA, 21 nt, Human
uggacacguaguagccccagg

SEQ ID NO: 1179702 - RNA, 18 nt, Human
uggcccccgggcggcccc

SEQ ID NO: 1179703 - RNA, 22 nt, Human
uggcccccgggcggccccagug

SEQ ID NO: 1179704 - RNA, 22 nt, Human
uggcuccuaggcugugggcccc

SEQ ID NO: 1179705 - RNA, 21 nt, Human
uggcugcgagggccgagggcu

SEQ ID NO: 1179706 - RNA, 22 nt, Human
ugggggaaagguaggcucagga

SEQ ID NO: 1179707 - RNA, 20 nt, Human
ugggggaggaggaggagcca

SEQ ID NO: 1179708 - RNA, 25 nt, Human
ugggggaggaggaggagccacgcau

SEQ ID NO: 1179709 - RNA, 21 nt, Human
uggggggaucagcagccgagg

SEQ ID NO: 1179710 - RNA, 23 nt, Human
uggggugcgacagguccccuugg

SEQ ID NO: 1179711 - RNA, 21 nt, Human
ugguggggugcgacagguccc

SEQ ID NO: 1179712 - RNA, 19 nt, Human
uugugcgagcccaguggag

SEQ ID NO: 1179713 - RNA, 20 nt, Human
aacucugggugaacugaguc

SEQ ID NO: 1179714 - RNA, 20 nt, Human
agacaaauacaccuggguua

SEQ ID NO: 1179715 - RNA, 18 nt, Human
cagggcacgggugggcag

SEQ ID NO: 1179716 - RNA, 20 nt, Human
cccagcagccuggggccgac

SEQ ID NO: 1179717 - RNA, 21 nt, Human
cgcggucaccccagcagccug

SEQ ID NO: 1179718 - RNA, 21 nt, Human
gggcacgggugggcagcugcc

SEQ ID NO: 1179719 - RNA, 19 nt, Human
uagcagcaugagaacagac

SEQ ID NO: 1179720 - RNA, 18 nt, Human
uccccagggcacgggugg

SEQ ID NO: 1179721 - RNA, 27 nt, Human
uccgcggucaccccagcagccuggggc

SEQ ID NO: 1179722 - RNA, 21 nt, Human
ugagaacagacaaauacaccu

SEQ ID NO: 1179723 - RNA, 18 nt, Human
ccaccggggagcagccga

SEQ ID NO: 1179724 - RNA, 26 nt, Human
cccugcucgccacucgcccuccuuuu

SEQ ID NO: 1179725 - RNA, 18 nt, Human
ccgcgccgggccggccgc

SEQ ID NO: 1179726 - RNA, 19 nt, Human
cggaguccgaggccugggc

SEQ ID NO: 1179727 - RNA, 23 nt, Human
cggccgaggccccugcucgccac

SEQ ID NO: 1179728 - RNA, 22 nt, Human
cguguggguggcggccgaggcc

SEQ ID NO: 1179729 - RNA, 19 nt, Human
gccgagggcggcggccggg

SEQ ID NO: 1179730 - RNA, 20 nt, Human
ggagcagccgauggccgagg

SEQ ID NO: 1179731 - RNA, 21 nt, Human
ggccaccggggagcagccgau

SEQ ID NO: 1179732 - RNA, 19 nt, Human
ugaauccaagaagaugugu

SEQ ID NO: 1179733 - RNA, 21 nt, Human
ugcucgccacucgcccuccuu

SEQ ID NO: 1179734 - RNA, 19 nt, Human
aacugaacucccaggugcc

SEQ ID NO: 1179735 - RNA, 21 nt, Human
aaucaggaaggucggaaucuc

SEQ ID NO: 1179736 - RNA, 18 nt, Human
guccaacugaacucccag

SEQ ID NO: 1179737 - RNA, 19 nt, Human
ucccaaaaucugucccauc

SEQ ID NO: 1179738 - RNA, 21 nt, Human
ucccaggugccgacagagucc

SEQ ID NO: 1179739 - RNA, 18 nt, Human
uccuuggucuucuucugg

SEQ ID NO: 1179740 - RNA, 19 nt, Human
ugggagaagucaggagugg

SEQ ID NO: 1179741 - RNA, 25 nt, Human
uugauggcucaucaugaucuuuccc

SEQ ID NO: 1179742 - RNA, 18 nt, Human
aaagcagggccaccaccu

SEQ ID NO: 1179743 - RNA, 22 nt, Human
aggcagagaugaggucuccccu

SEQ ID NO: 1179744 - RNA, 21 nt, Human
aggcuucccugccccacugga

SEQ ID NO: 1179745 - RNA, 20 nt, Human
caaggcuucccugccccacu

SEQ ID NO: 1179746 - RNA, 20 nt, Human
cagaguccucacaaccccuc

SEQ ID NO: 1179747 - RNA, 23 nt, Human
cagggccaccaccucuuuggcuc

SEQ ID NO: 1179748 - RNA, 20 nt, Human
cauaccccuagcauccucau

SEQ ID NO: 1179749 - RNA, 21 nt, Human
ccacuggagauggcuuuucuu

SEQ ID NO: 1179750 - RNA, 22 nt, Human
ccagaguccucacaaccccucc

SEQ ID NO: 1179751 - RNA, 24 nt, Human
ccccagaguccucacaaccccucc

SEQ ID NO: 1179752 - RNA, 21 nt, Human
ccccuagcauccucauaccua

SEQ ID NO: 1179753 - RNA, 18 nt, Human
ccccugaaagcagggcca

SEQ ID NO: 1179754 - RNA, 23 nt, Human
ccccugaaagcagggccaccacc

SEQ ID NO: 1179755 - RNA, 23 nt, Human
ccuagcauccucauaccuaccuc

SEQ ID NO: 1179756 - RNA, 20 nt, Human
cuacuugaaugcugucaggc

SEQ ID NO: 1179757 - RNA, 23 nt, Human
cucacaaccccuccuggguguca

SEQ ID NO: 1179758 - RNA, 22 nt, Human
cucauaccuaccucucagaccu

SEQ ID NO: 1179759 - RNA, 20 nt, Human
cuccugggugucaugugauc

SEQ ID NO: 1179760 - RNA, 23 nt, Human
ggccaccaccucuuuggcucaga

SEQ ID NO: 1179761 - RNA, 18 nt, Human
uccccagaguccucacaa

SEQ ID NO: 1179762 - RNA, 20 nt, Human
uccccugaaagcagggccac

SEQ ID NO: 1179763 - RNA, 19 nt, Human
uccucacaaccccuccugg

SEQ ID NO: 1179764 - RNA, 18 nt, Human
uggcuuuucuuccccaga

SEQ ID NO: 1179765 - RNA, 18 nt, Human
aaacaaagaagcgggugg

SEQ ID NO: 1179766 - RNA, 23 nt, Human
aaacaacagaauuaaaaaguuac

SEQ ID NO: 1179767 - RNA, 23 nt, Human
aaacaggauggagaucaaaccca

SEQ ID NO: 1179768 - RNA, 24 nt, Human
aaacaggauggagaucaaacccag

SEQ ID NO: 1179769 - RNA, 19 nt, Human
aacagaaauggacagagag

SEQ ID NO: 1179770 - RNA, 25 nt, Human
aacccagagaaacgcacuccccgag

SEQ ID NO: 1179771 - RNA, 19 nt, Human
aacugcaaaacaacagaau

SEQ ID NO: 1179772 - RNA, 21 nt, Human
aagcaaaacagaaauggacag

SEQ ID NO: 1179773 - RNA, 28 nt, Human
aagcagaggggcgggaaacaaagaagcg

SEQ ID NO: 1179774 - RNA, 30 nt, Human
aagcagaggggcgggaaacaaagaagcggg

SEQ ID NO: 1179775 - RNA, 23 nt, Human
aaggaaaaagcaaguacucagaa

SEQ ID NO: 1179776 - RNA, 23 nt, Human
aauaaaauaacaaagaaauacaa

SEQ ID NO: 1179777 - RNA, 22 nt, Human
aaugaaaagcaguuuaaaagaa

SEQ ID NO: 1179778 - RNA, 18 nt, Human
acacagcuucgcccccaa

SEQ ID NO: 1179779 - RNA, 19 nt, Human
acagaacgcauacagcuag

SEQ ID NO: 1179780 - RNA, 20 nt, Human
acagagagggagagcccaga

SEQ ID NO: 1179781 - RNA, 22 nt, Human
acagagagggagagcccagagc

SEQ ID NO: 1179782 - RNA, 24 nt, Human
accacagcaguuaacgcgaaguga

SEQ ID NO: 1179783 - RNA, 22 nt, Human
accccccucccucccacuccaa

SEQ ID NO: 1179784 - RNA, 19 nt, Human
acgcaucagggccgggagg

SEQ ID NO: 1179785 - RNA, 21 nt, Human
acucaagcacaagagcuccug

SEQ ID NO: 1179786 - RNA, 21 nt, Human
agaaaacaggauggagaucaa

SEQ ID NO: 1179787 - RNA, 18 nt, Human
agaaacgcacucccguca

SEQ ID NO: 1179788 - RNA, 20 nt, Human
agaaucagcucagacaugaa

SEQ ID NO: 1179789 - RNA, 18 nt, Human
agcaaaauaucaacauga

SEQ ID NO: 1179790 - RNA, 27 nt, Human
agccacgcuaccacuaacacugaacuc

SEQ ID NO: 1179791 - RNA, 22 nt, Human
agccaggagguggagggagagg

SEQ ID NO: 1179792 - RNA, 29 nt, Human
agccaggagguggagggagaggggacccc

SEQ ID NO: 1179793 - RNA, 20 nt, Human
aggcugaggcggagcagagu

SEQ ID NO: 1179794 - RNA, 19 nt, Human
agggagagcccagagcaug

SEQ ID NO: 1179795 - RNA, 25 nt, Human
agggagaggagcauggaaagccagg

SEQ ID NO: 1179796 - RNA, 20 nt, Human
aguaaaauaaaaccaagcaa

SEQ ID NO: 1179797 - RNA, 25 nt, Human
auaaaauaacaaagaaauacaaaac

SEQ ID NO: 1179798 - RNA, 22 nt, Human
aucacacaaaugaaacacacaa

SEQ ID NO: 1179799 - RNA, 23 nt, Human
auuaaaaaaaaaaaaaauggggu

SEQ ID NO: 1179800 - RNA, 24 nt, Human
caaaaaaaccuuacauaaaauccu

SEQ ID NO: 1179801 - RNA, 19 nt, Human
caaacugcaaaacaacaga

SEQ ID NO: 1179802 - RNA, 22 nt, Human
caaaggaaaaagcaaguacuca

SEQ ID NO: 1179803 - RNA, 23 nt, Human
caagaagcaggcacguggagcaa

SEQ ID NO: 1179804 - RNA, 33 nt, Human
caagcaaaauaucaacaugaagaccuccuucuu

SEQ ID NO: 1179805 - RNA, 21 nt, Human
cacaaacuuuaaaaauagcug

SEQ ID NO: 1179806 - RNA, 19 nt, Human
cacacaaaugaaacacaca

SEQ ID NO: 1179807 - RNA, 19 nt, Human
cacagcuucgcccccaacc

SEQ ID NO: 1179808 - RNA, 19 nt, Human
caccccccucccucccacu

SEQ ID NO: 1179809 - RNA, 24 nt, Human
caccccccucccucccacuccaaa

SEQ ID NO: 1179810 - RNA, 21 nt, Human
cacggucagacggccgccacc

SEQ ID NO: 1179811 - RNA, 21 nt, Human
cacuaaaguaucuaagccucu

SEQ ID NO: 1179812 - RNA, 24 nt, Human
cacucugugcuuugcugcuguggu

SEQ ID NO: 1179813 - RNA, 24 nt, Human
cagcuuacacaguccuugcaaaac

SEQ ID NO: 1179814 - RNA, 21 nt, Human
caggcaacggcauucccccaa

SEQ ID NO: 1179815 - RNA, 18 nt, Human
cauuccgcuuaccuuccc

SEQ ID NO: 1179816 - RNA, 21 nt, Human
ccaaaacaugacacagaaaag

SEQ ID NO: 1179817 - RNA, 24 nt, Human
ccaauaauaccuuucgagcuuucu

SEQ ID NO: 1179818 - RNA, 21 nt, Human
ccacccagcccacguggaguu

SEQ ID NO: 1179819 - RNA, 26 nt, Human
ccaccccccucccucccacuccaaau

SEQ ID NO: 1179820 - RNA, 19 nt, Human
ccacgccugugaaaagcaa

SEQ ID NO: 1179821 - RNA, 23 nt, Human
cccaauaaaauaacaaagaaaua

SEQ ID NO: 1179822 - RNA, 18 nt, Human
cccaccccccucccuccc

SEQ ID NO: 1179823 - RNA, 21 nt, Human
cccagcccacguggaguucuc

SEQ ID NO: 1179824 - RNA, 22 nt, Human
ccccccucccucccacuccaaa

SEQ ID NO: 1179825 - RNA, 18 nt, Human
ccccucccucccacucca

SEQ ID NO: 1179826 - RNA, 19 nt, Human
ccccugugugcugugcgcg

SEQ ID NO: 1179827 - RNA, 22 nt, Human
cccucccacuccaaauuaaaaa

SEQ ID NO: 1179828 - RNA, 19 nt, Human
ccuaagaaaagacuacaga

SEQ ID NO: 1179829 - RNA, 23 nt, Human
ccuccaaguggagugagccacgc

SEQ ID NO: 1179830 - RNA, 23 nt, Human
cgcauacagcuagaacgcauaca

SEQ ID NO: 1179831 - RNA, 24 nt, Human
cgcccaccccccucccucccacuc

SEQ ID NO: 1179832 - RNA, 21 nt, Human
cggccgccaccuccaagugga

SEQ ID NO: 1179833 - RNA, 19 nt, Human
cggucagacggccgccacc

SEQ ID NO: 1179834 - RNA, 19 nt, Human
cuagccaaggcagguuaca

SEQ ID NO: 1179835 - RNA, 23 nt, Human
cucccucccacuccaaauuaaaa

SEQ ID NO: 1179836 - RNA, 21 nt, Human
cuccuucggcucagggcaccc

SEQ ID NO: 1179837 - RNA, 18 nt, Human
cucugugcuuugcugcug

SEQ ID NO: 1179838 - RNA, 18 nt, Human
cugggagaaaacaggaug

SEQ ID NO: 1179839 - RNA, 18 nt, Human
cugugaaaagcaaagcug

SEQ ID NO: 1179840 - RNA, 18 nt, Human
cuuugcugcugugguacc

SEQ ID NO: 1179841 - RNA, 18 nt, Human
cuuuuuaaaggccuacau

SEQ ID NO: 1179842 - RNA, 19 nt, Human
gaaaaagcaaguacucaga

SEQ ID NO: 1179843 - RNA, 19 nt, Human
gaacaggcaacggcauucc

SEQ ID NO: 1179844 - RNA, 18 nt, Human
gaaucagcucagacauga

SEQ ID NO: 1179845 - RNA, 18 nt, Human
gcaaaacagaaauggaca

SEQ ID NO: 1179846 - RNA, 21 nt, Human
gcaaaacagaaauggacagag

SEQ ID NO: 1179847 - RNA, 21 nt, Human
gcacacugcgggacgccggca

SEQ ID NO: 1179848 - RNA, 27 nt, Human
gcagaguguacacgcaucagggccccc

SEQ ID NO: 1179849 - RNA, 19 nt, Human
gccaaacugcaaaacaaca

SEQ ID NO: 1179850 - RNA, 20 nt, Human
gcccaccccccucccuccca

SEQ ID NO: 1179851 - RNA, 19 nt, Human
gcugugguaccugaaaauu

SEQ ID NO: 1179852 - RNA, 18 nt, Human
guaccugaaaauuaaaca

SEQ ID NO: 1179853 - RNA, 20 nt, Human
guggagugagccacgcuacc

SEQ ID NO: 1179854 - RNA, 18 nt, Human
guggaguucucaaggcug

SEQ ID NO: 1179855 - RNA, 20 nt, Human
gugguaccugaaaauuaaac

SEQ ID NO: 1179856 - RNA, 25 nt, Human
uaaaaaaaaaaaaaaugggguggag

SEQ ID NO: 1179857 - RNA, 22 nt, Human
uaaaaccaagcaaaauaucaac

SEQ ID NO: 1179858 - RNA, 25 nt, Human
uaaaauaacaaagaaauacaaaaca

SEQ ID NO: 1179859 - RNA, 21 nt, Human
uaaaaucaguaaaauaaaacc

SEQ ID NO: 1179860 - RNA, 23 nt, Human
uaacugaaaugcucuuuaaauac

SEQ ID NO: 1179861 - RNA, 19 nt, Human
uaagucaaggcuaaaugcc

SEQ ID NO: 1179862 - RNA, 23 nt, Human
uacauaaaauccuuaggauuuaa

SEQ ID NO: 1179863 - RNA, 26 nt, Human
uacauuuuucuauauaccuuuuaaaa

SEQ ID NO: 1179864 - RNA, 19 nt, Human
uaccugaaaauuaaacagu

SEQ ID NO: 1179865 - RNA, 19 nt, Human
uaccugaaaauuaaacagu

SEQ ID NO: 1179866 - RNA, 19 nt, Human
uagccaaggcagguuacaa

SEQ ID NO: 1179867 - RNA, 22 nt, Human
ucaacacagcuucgcccccaac

SEQ ID NO: 1179868 - RNA, 23 nt, Human
uccaaaauaacacuccauucaca

SEQ ID NO: 1179869 - RNA, 27 nt, Human
uccaugucucaauuuccaacgcucucc

SEQ ID NO: 1179870 - RNA, 21 nt, Human
ucccugguagaaucgucaccu

SEQ ID NO: 1179871 - RNA, 18 nt, Human
ucucgcccaccccccucc

SEQ ID NO: 1179872 - RNA, 22 nt, Human
ucucgcccaccccccucccucc

SEQ ID NO: 1179873 - RNA, 22 nt, Human
ugaaaaaccaauaauaccuuuc

SEQ ID NO: 1179874 - RNA, 19 nt, Human
ugaaaagcaaagcuggaag

SEQ ID NO: 1179875 - RNA, 25 nt, Human
ugaggcaaacggccuuuuccagcca

SEQ ID NO: 1179876 - RNA, 19 nt, Human
ugcaaaacaacagaauuaa

SEQ ID NO: 1179877 - RNA, 22 nt, Human
ugcaaaaccagcuuccgccacg

SEQ ID NO: 1179878 - RNA, 18 nt, Human
ugccuccgaaccuuuccu

SEQ ID NO: 1179879 - RNA, 22 nt, Human
uggagcaaacagaaucagcuca

SEQ ID NO: 1179880 - RNA, 26 nt, Human
uggagcaaacagaaucagcucagaca

SEQ ID NO: 1179881 - RNA, 19 nt, Human
ugggaaggucugagagagu

SEQ ID NO: 1179882 - RNA, 21 nt, Human
ugguacgaaaucacacaaaug

SEQ ID NO: 1179883 - RNA, 19 nt, Human
uguccaaaauaacacucca

SEQ ID NO: 1179884 - RNA, 21 nt, Human
ugucugggagaaaacaggaug

SEQ ID NO: 1179885 - RNA, 23 nt, Human
uuaaaagaaaaucaugcuaaaag

SEQ ID NO: 1179886 - RNA, 25 nt, Human
uuaaauacacuaaaguaucuaagcc

SEQ ID NO: 1179887 - RNA, 22 nt, Human
uuccuaccaaaacaugacacag

SEQ ID NO: 1179888 - RNA, 23 nt, Human
aaaaacaggucuguuccaccuuc

SEQ ID NO: 1179889 - RNA, 19 nt, Human
aaacaaaacaaaacgaaaa

SEQ ID NO: 1179890 - RNA, 21 nt, Human
aaacacgcacaccccagggcc

SEQ ID NO: 1179891 - RNA, 19 nt, Human
aagaacaaagauaaugguu

SEQ ID NO: 1179892 - RNA, 25 nt, Human
aagccacccucaccccgcaugccag

SEQ ID NO: 1179893 - RNA, 21 nt, Human
aagggcuaccaaagucaccac

SEQ ID NO: 1179894 - RNA, 21 nt, Human
aaggucaggcucucuuguuag

SEQ ID NO: 1179895 - RNA, 21 nt, Human
aagucaugaaacucauuucau

SEQ ID NO: 1179896 - RNA, 24 nt, Human
aaucaccuuucaagaacauucuau

SEQ ID NO: 1179897 - RNA, 23 nt, Human
aaugccuacuuuucagagacaac

SEQ ID NO: 1179898 - RNA, 19 nt, Human
aaugugacaugaaaucgua

SEQ ID NO: 1179899 - RNA, 23 nt, Human
acaaaacaaaacgaaaaacuugg

SEQ ID NO: 1179900 - RNA, 24 nt, Human
acaaaacaaaacgaaaaacuugga

SEQ ID NO: 1179901 - RNA, 18 nt, Human
acacccuggcuuuccagg

SEQ ID NO: 1179902 - RNA, 21 nt, Human
acacucagguaacaccaaaac

SEQ ID NO: 1179903 - RNA, 21 nt, Human
accccagggccugugucacac

SEQ ID NO: 1179904 - RNA, 22 nt, Human
agaaaaacagaggugacugaag

SEQ ID NO: 1179905 - RNA, 23 nt, Human
agaaacacgcacaccccagggcc

SEQ ID NO: 1179906 - RNA, 19 nt, Human
agaaaggaucgcagggucu

SEQ ID NO: 1179907 - RNA, 18 nt, Human
agagccagugauaaacag

SEQ ID NO: 1179908 - RNA, 20 nt, Human
agcgccaugcucccuccagg

SEQ ID NO: 1179909 - RNA, 23 nt, Human
aggaaaaaaacaggucuguucca

SEQ ID NO: 1179910 - RNA, 19 nt, Human
aggccaccuuacugcauuu

SEQ ID NO: 1179911 - RNA, 21 nt, Human
aggccagagggcugccaggug

SEQ ID NO: 1179912 - RNA, 19 nt, Human
aggcgggccugcaugacuu

SEQ ID NO: 1179913 - RNA, 26 nt, Human
auaaaaaucgaauauacacacaaaca

SEQ ID NO: 1179914 - RNA, 21 nt, Human
auaccaaacaccuaaguacca

SEQ ID NO: 1179915 - RNA, 20 nt, Human
auauuuacaugguaugcuaa

SEQ ID NO: 1179916 - RNA, 19 nt, Human
aucccuggagggacaggcg

SEQ ID NO: 1179917 - RNA, 23 nt, Human
auggagaauaugucucaccuaca

SEQ ID NO: 1179918 - RNA, 24 nt, Human
caaauaaacuagacgaaauacauc

SEQ ID NO: 1179919 - RNA, 27 nt, Human
caacacaaagaacuaauagcuaagaug

SEQ ID NO: 1179920 - RNA, 22 nt, Human
caaccaccccacucacacccug

SEQ ID NO: 1179921 - RNA, 18 nt, Human
caacuggcaccacuccca

SEQ ID NO: 1179922 - RNA, 21 nt, Human
caagcacacagcaaacgccac

SEQ ID NO: 1179923 - RNA, 20 nt, Human
caagggcuaccaaagucacc

SEQ ID NO: 1179924 - RNA, 19 nt, Human
cacagaguugacgcuuuug

SEQ ID NO: 1179925 - RNA, 20 nt, Human
caccaaaacagaccuuccag

SEQ ID NO: 1179926 - RNA, 24 nt, Human
cacucccaaccaccccacucacac

SEQ ID NO: 1179927 - RNA, 25 nt, Human
cacugcuacagaaaggaucgcaggg

SEQ ID NO: 1179928 - RNA, 19 nt, Human
cagaaaaacagaggugacu

SEQ ID NO: 1179929 - RNA, 22 nt, Human
cagacccugcucuagccgaggg

SEQ ID NO: 1179930 - RNA, 19 nt, Human
cagcacagcugcagggucc

SEQ ID NO: 1179931 - RNA, 22 nt, Human
cagcacauugccuuaucuggga

SEQ ID NO: 1179932 - RNA, 24 nt, Human
caggccagagugaacauccgcuga

SEQ ID NO: 1179933 - RNA, 24 nt, Human
cagugacaagaagcagaaucugcu

SEQ ID NO: 1179934 - RNA, 24 nt, Human
cagugacagccaugggaaccugcu

SEQ ID NO: 1179935 - RNA, 21 nt, Human
caguguuacucucaagcacac

SEQ ID NO: 1179936 - RNA, 21 nt, Human
cauaccaaacaccuaaguacc

SEQ ID NO: 1179937 - RNA, 24 nt, Human
caucaacaacuguggaacuguauc

SEQ ID NO: 1179938 - RNA, 20 nt, Human
cauucugcuucuuuccuuuu

SEQ ID NO: 1179939 - RNA, 19 nt, Human
ccacucccaaccaccccac

SEQ ID NO: 1179940 - RNA, 19 nt, Human
ccaugccgugugccugucc

SEQ ID NO: 1179941 - RNA, 25 nt, Human
ccccagggccugugucacacucagg

SEQ ID NO: 1179942 - RNA, 24 nt, Human
ccccugcagcgugcaguguuacuc

SEQ ID NO: 1179943 - RNA, 22 nt, Human
cccgcaauuacgaaaagcaguu

SEQ ID NO: 1179944 - RNA, 21 nt, Human
cccuagcgccaugcucccucc

SEQ ID NO: 1179945 - RNA, 18 nt, Human
cccuuccuucuaggaggc

SEQ ID NO: 1179946 - RNA, 21 nt, Human
ccuacaggaaccuacccgcaa

SEQ ID NO: 1179947 - RNA, 21 nt, Human
ccuagcgccaugcucccucca

SEQ ID NO: 1179948 - RNA, 23 nt, Human
ccucaccccgcaugccacgggga

SEQ ID NO: 1179949 - RNA, 18 nt, Human
ccucauguguggugggaa

SEQ ID NO: 1179950 - RNA, 19 nt, Human
ccuucauuacugggauugu

SEQ ID NO: 1179951 - RNA, 18 nt, Human
cgaggguuuggcuggugu

SEQ ID NO: 1179952 - RNA, 22 nt, Human
cuaacaccaacuccagccugcu

SEQ ID NO: 1179953 - RNA, 22 nt, Human
cucaagggcuaccaaagucacc

SEQ ID NO: 1179954 - RNA, 19 nt, Human
cucauuuggggcuggaaga

SEQ ID NO: 1179955 - RNA, 23 nt, Human
cucccaaccaccccacucacacc

SEQ ID NO: 1179956 - RNA, 20 nt, Human
cugaagauaagugcaaccau

SEQ ID NO: 1179957 - RNA, 18 nt, Human
cugcucccuggacagccu

SEQ ID NO: 1179958 - RNA, 20 nt, Human
cugcuucuuuccuuuucugu

SEQ ID NO: 1179959 - RNA, 20 nt, Human
cuggaacagccuucagaaaa

SEQ ID NO: 1179960 - RNA, 23 nt, Human
gaaaacaaaacaaaacgaaaaac

SEQ ID NO: 1179961 - RNA, 18 nt, Human
gaacaaugucuacaugca

SEQ ID NO: 1179962 - RNA, 22 nt, Human
gaacgggcuucuauuucccuua

SEQ ID NO: 1179963 - RNA, 22 nt, Human
gaacuaggccagagggcugcca

SEQ ID NO: 1179964 - RNA, 22 nt, Human
gagcagcauaccaaacaccuaa

SEQ ID NO: 1179965 - RNA, 18 nt, Human
gagugugcguggggcccc

SEQ ID NO: 1179966 - RNA, 23 nt, Human
gaucauagagucagaccacaaag

SEQ ID NO: 1179967 - RNA, 22 nt, Human
gaucgcagggucuggaagaccu

SEQ ID NO: 1179968 - RNA, 18 nt, Human
gcaggcauggugaggcag

SEQ ID NO: 1179969 - RNA, 18 nt, Human
gcccguggcuggcuggcg

SEQ ID NO: 1179970 - RNA, 23 nt, Human
gcugcaggguccuagcagauccu

SEQ ID NO: 1179971 - RNA, 23 nt, Human
guacaagagccuuuugagggcug

SEQ ID NO: 1179972 - RNA, 19 nt, Human
guggggccccgcuggcaga

SEQ ID NO: 1179973 - RNA, 19 nt, Human
uaacaccaacuccagccug

SEQ ID NO: 1179974 - RNA, 18 nt, Human
uaagacaacacaaagaac

SEQ ID NO: 1179975 - RNA, 19 nt, Human
uaagacaacacaaagaacu

SEQ ID NO: 1179976 - RNA, 21 nt, Human
uacacacaaacacaucaacaa

SEQ ID NO: 1179977 - RNA, 24 nt, Human
uaccaaacaccuaaguaccauucc

SEQ ID NO: 1179978 - RNA, 19 nt, Human
uaccaaagucaccacucca

SEQ ID NO: 1179979 - RNA, 21 nt, Human
uagacaguuagagaaacacgc

SEQ ID NO: 1179980 - RNA, 21 nt, Human
uagagaaacacgcacacccca

SEQ ID NO: 1179981 - RNA, 25 nt, Human
uagcagauccuacaagcgcuguggc

SEQ ID NO: 1179982 - RNA, 19 nt, Human
uagcgccaugcucccucca

SEQ ID NO: 1179983 - RNA, 20 nt, Human
uaggccuucccacugcccag

SEQ ID NO: 1179984 - RNA, 26 nt, Human
uaugcaaaggucaaucaacaaucacc

SEQ ID NO: 1179985 - RNA, 19 nt, Human
ucaacuguggaaacgagau

SEQ ID NO: 1179986 - RNA, 20 nt, Human
ucaagcacacagcaaacgcc

SEQ ID NO: 1179987 - RNA, 21 nt, Human
ucaagggcuaccaaagucacc

SEQ ID NO: 1179988 - RNA, 21 nt, Human
ucacagagccagugauaaaca

SEQ ID NO: 1179989 - RNA, 21 nt, Human
ucagaaaaacagaggugacug

SEQ ID NO: 1179990 - RNA, 23 nt, Human
ucagcgcuuuaaggcgggccugc

SEQ ID NO: 1179991 - RNA, 18 nt, Human
uccaacgcagcuguggac

SEQ ID NO: 1179992 - RNA, 23 nt, Human
uccauuuucgaugguugugggua

SEQ ID NO: 1179993 - RNA, 20 nt, Human
ucccuccaggggcaguaaga

SEQ ID NO: 1179994 - RNA, 18 nt, Human
ucccuggagggacaggcg

SEQ ID NO: 1179995 - RNA, 23 nt, Human
uccucuggaaucaggcccguggc

SEQ ID NO: 1179996 - RNA, 24 nt, Human
ucgccgggugaauuccuuggaugc

SEQ ID NO: 1179997 - RNA, 21 nt, Human
ucgucucauuuggggcuggaa

SEQ ID NO: 1179998 - RNA, 21 nt, Human
ucuuaauuagagcucaagggc

SEQ ID NO: 1179999 - RNA, 20 nt, Human
ugaaaacaaaacaaaacgaa

SEQ ID NO: 1180000 - RNA, 25 nt, Human
ugaaaacaaaacaaaacgaaaaacu

SEQ ID NO: 1180001 - RNA, 23 nt, Human
ugaaacagugacaagaagcagaa

SEQ ID NO: 1180002 - RNA, 19 nt, Human
ugaaaucguagguauaaaa

SEQ ID NO: 1180003 - RNA, 24 nt, Human
ugaggccaucacagacccugcucu

SEQ ID NO: 1180004 - RNA, 21 nt, Human
ugagggcugagaagacaacuc

SEQ ID NO: 1180005 - RNA, 22 nt, Human
ugagugaggucggacuguguug

SEQ ID NO: 1180006 - RNA, 21 nt, Human
ugagugguuuggaucucucuu

SEQ ID NO: 1180007 - RNA, 19 nt, Human
ugaguugaaagcacuucca

SEQ ID NO: 1180008 - RNA, 21 nt, Human
ugauaaacaggccaccuuacu

SEQ ID NO: 1180009 - RNA, 23 nt, Human
ugcccagaaugaauucuacuaca

SEQ ID NO: 1180010 - RNA, 21 nt, Human
ugcguggggccccgcuggcag

SEQ ID NO: 1180011 - RNA, 22 nt, Human
ugcguggggccccgcuggcaga

SEQ ID NO: 1180012 - RNA, 22 nt, Human
ugcuccuggggguucugcgccg

SEQ ID NO: 1180013 - RNA, 18 nt, Human
ugcugcaacagccccugc

SEQ ID NO: 1180014 - RNA, 22 nt, Human
uggaacagccuucagaaaaaca

SEQ ID NO: 1180015 - RNA, 20 nt, Human
uggaagaaagccacccucac

SEQ ID NO: 1180016 - RNA, 23 nt, Human
uggcagaugugggggcugcugga

SEQ ID NO: 1180017 - RNA, 21 nt, Human
uggcugaguugaaagcacuuc

SEQ ID NO: 1180018 - RNA, 19 nt, Human
uggcuggcuggcgcucugg

SEQ ID NO: 1180019 - RNA, 23 nt, Human
ugggauugucugguacuaagaau

SEQ ID NO: 1180020 - RNA, 18 nt, Human
ugguugcagcagaucuuc

SEQ ID NO: 1180021 - RNA, 22 nt, Human
ugugacaugaaaucguagguau

SEQ ID NO: 1180022 - RNA, 22 nt, Human
uguguuaaaaaugaauggggag

SEQ ID NO: 1180023 - RNA, 24 nt, Human
uuaaaaaaaaaaaaagucaugaaa

SEQ ID NO: 1180024 - RNA, 19 nt, Human
uuaaacuuugauaagacaa

SEQ ID NO: 1180025 - RNA, 20 nt, Human
uucuguaguuuccuucaagg

SEQ ID NO: 1180026 - RNA, 20 nt, Human
uuucuguaguuuccuucaag

SEQ ID NO: 1180027 - RNA, 20 nt, Human
uuuucaguguuugcccagaa

SEQ ID NO: 1180028 - RNA, 20 nt, Human
aaacaagguucaugccugca

SEQ ID NO: 1180029 - RNA, 27 nt, Human
aacaaagaggacaugaauuaagaagaa

SEQ ID NO: 1180030 - RNA, 21 nt, Human
aaccaaaacaagguucaugcc

SEQ ID NO: 1180031 - RNA, 22 nt, Human
aaccaaaccaaaacaagguuca

SEQ ID NO: 1180032 - RNA, 23 nt, Human
aagaaauuaguucuccccaguuc

SEQ ID NO: 1180033 - RNA, 24 nt, Human
aagcgaucugcccaccuuggccuc

SEQ ID NO: 1180034 - RNA, 25 nt, Human
aaggggacagaggaaggcaguccca

SEQ ID NO: 1180035 - RNA, 22 nt, Human
aauaaagauuccugaacagcug

SEQ ID NO: 1180036 - RNA, 24 nt, Human
aauaaccaaugucaccacacuaag

SEQ ID NO: 1180037 - RNA, 28 nt, Human
acagagaguaacaaccaaaccaaaacaa

SEQ ID NO: 1180038 - RNA, 18 nt, Human
acagagcagggcgaaguc

SEQ ID NO: 1180039 - RNA, 19 nt, Human
acagagcagggcgaagucu

SEQ ID NO: 1180040 - RNA, 21 nt, Human
accugcuguuugucggccccg

SEQ ID NO: 1180041 - RNA, 23 nt, Human
agaaaacccagguucccacugga

SEQ ID NO: 1180042 - RNA, 21 nt, Human
agaguaacaaccaaaccaaaa

SEQ ID NO: 1180043 - RNA, 22 nt, Human
agaguaacaaccaaaccaaaac

SEQ ID NO: 1180044 - RNA, 22 nt, Human
agaucacaggcaaauuacugca

SEQ ID NO: 1180045 - RNA, 23 nt, Human
agcaccaaggggacagaggaagg

SEQ ID NO: 1180046 - RNA, 23 nt, Human
agccaggagggcaccaggcagug

SEQ ID NO: 1180047 - RNA, 18 nt, Human
agcugcagcagcccgagg

SEQ ID NO: 1180048 - RNA, 26 nt, Human
agguacugggauuacaggugugagcc

SEQ ID NO: 1180049 - RNA, 20 nt, Human
caaaacguagggcccugagc

SEQ ID NO: 1180050 - RNA, 22 nt, Human
caacccguaucugggagacaau

SEQ ID NO: 1180051 - RNA, 18 nt, Human
caagccucggcuggcaca

SEQ ID NO: 1180052 - RNA, 24 nt, Human
caagguacugggauuacaggugug

SEQ ID NO: 1180053 - RNA, 24 nt, Human
cacacucacacucacauucgugua

SEQ ID NO: 1180054 - RNA, 24 nt, Human
cacacucacauucguguacaugua

SEQ ID NO: 1180055 - RNA, 25 nt, Human
caccagcuagaaaacccagguuccc

SEQ ID NO: 1180056 - RNA, 19 nt, Human
cagcccgaggcagucacug

SEQ ID NO: 1180057 - RNA, 20 nt, Human
caggagggcaccaggcagug

SEQ ID NO: 1180058 - RNA, 19 nt, Human
cagucaaaacagcgcucag

SEQ ID NO: 1180059 - RNA, 18 nt, Human
caugagguuucaauaugu

SEQ ID NO: 1180060 - RNA, 22 nt, Human
ccaaaccaaaacaagguucaug

SEQ ID NO: 1180061 - RNA, 20 nt, Human
ccaagguacugggauuacag

SEQ ID NO: 1180062 - RNA, 21 nt, Human
ccaagguacugggauuacagg

SEQ ID NO: 1180063 - RNA, 24 nt, Human
ccaagguacugggauuacaggugu

SEQ ID NO: 1180064 - RNA, 23 nt, Human
ccacuggaugacaaccccaaccc

SEQ ID NO: 1180065 - RNA, 21 nt, Human
ccagcuagaaaacccagguuc

SEQ ID NO: 1180066 - RNA, 23 nt, Human
ccaucucuucacuacuagaaucc

SEQ ID NO: 1180067 - RNA, 26 nt, Human
cccacuggaugacaaccccaacccgu

SEQ ID NO: 1180068 - RNA, 22 nt, Human
cccgcagugugagugcugggac

SEQ ID NO: 1180069 - RNA, 18 nt, Human
ccgccaauccuacagagc

SEQ ID NO: 1180070 - RNA, 24 nt, Human
ccucgggggucugggaaacugugg

SEQ ID NO: 1180071 - RNA, 23 nt, Human
ccugagcugcagcagcccgaggc

SEQ ID NO: 1180072 - RNA, 18 nt, Human
ccugcauuggcuguucug

SEQ ID NO: 1180073 - RNA, 21 nt, Human
ccugcauuggcuguucugugg

SEQ ID NO: 1180074 - RNA, 19 nt, Human
ccugggaaguagcugugga

SEQ ID NO: 1180075 - RNA, 24 nt, Human
cgaucugcccaccuuggccuccca

SEQ ID NO: 1180076 - RNA, 18 nt, Human
cggccccaacagaggcaa

SEQ ID NO: 1180077 - RNA, 20 nt, Human
cgggggucugggaaacugug

SEQ ID NO: 1180078 - RNA, 22 nt, Human
cguguacauguacacauucaca

SEQ ID NO: 1180079 - RNA, 24 nt, Human
cucaagcgaucugcccaccuuggc

SEQ ID NO: 1180080 - RNA, 18 nt, Human
cugccuuggugaugccuc

SEQ ID NO: 1180081 - RNA, 20 nt, Human
cuugcuagcuacaagaucac

SEQ ID NO: 1180082 - RNA, 19 nt, Human
gaaacagagaguaacaacc

SEQ ID NO: 1180083 - RNA, 21 nt, Human
gagcaccaaggggacagagga

SEQ ID NO: 1180084 - RNA, 22 nt, Human
gagccgccaauccuacagagca

SEQ ID NO: 1180085 - RNA, 23 nt, Human
gagccgccaauccuacagagcag

SEQ ID NO: 1180086 - RNA, 18 nt, Human
gauuacaggugugagcca

SEQ ID NO: 1180087 - RNA, 23 nt, Human
gauuacaggugugagccacggca

SEQ ID NO: 1180088 - RNA, 20 nt, Human
gcccgaggcagucacugucc

SEQ ID NO: 1180089 - RNA, 20 nt, Human
gcugccuuggugaugccuca

SEQ ID NO: 1180090 - RNA, 24 nt, Human
gcuuggugaagggcaucauucggc

SEQ ID NO: 1180091 - RNA, 25 nt, Human
ggaaacugugggaggagccgguacc

SEQ ID NO: 1180092 - RNA, 18 nt, Human
ggagcuggggcagagugg

SEQ ID NO: 1180093 - RNA, 23 nt, Human
ggccuccugagcugcagcagccc

SEQ ID NO: 1180094 - RNA, 22 nt, Human
gggggcacaguucccugcauug

SEQ ID NO: 1180095 - RNA, 21 nt, Human
guacugggauuacagguguga

SEQ ID NO: 1180096 - RNA, 19 nt, Human
guuccacuaacaaagagga

SEQ ID NO: 1180097 - RNA, 22 nt, Human
uaaggaaggaagagcucagaaa

SEQ ID NO: 1180098 - RNA, 24 nt, Human
uacaggugugagccacggcacccu

SEQ ID NO: 1180099 - RNA, 24 nt, Human
uacugggauuacaggugugagcca

SEQ ID NO: 1180100 - RNA, 22 nt, Human
uccagggagcuggggcagagug

SEQ ID NO: 1180101 - RNA, 19 nt, Human
ucccaaaggaagcggaugg

SEQ ID NO: 1180102 - RNA, 23 nt, Human
ucccaagguacugggauuacagg

SEQ ID NO: 1180103 - RNA, 18 nt, Human
ucccacuggaugacaacc

SEQ ID NO: 1180104 - RNA, 19 nt, Human
ucggccccgcagugugagu

SEQ ID NO: 1180105 - RNA, 27 nt, Human
ugaagcaggcagaaugccaaucgagcc

SEQ ID NO: 1180106 - RNA, 20 nt, Human
ugagugcugggaccucgggg

SEQ ID NO: 1180107 - RNA, 21 nt, Human
ugauuaaauggccuggggugc

SEQ ID NO: 1180108 - RNA, 24 nt, Human
ugcugggaccucgggggucuggga

SEQ ID NO: 1180109 - RNA, 22 nt, Human
uggaaaggaauaaagauuccug

SEQ ID NO: 1180110 - RNA, 24 nt, Human
uggaugacaaccccaacccguauc

SEQ ID NO: 1180111 - RNA, 20 nt, Human
ugggaggagccaggagggca

SEQ ID NO: 1180112 - RNA, 18 nt, Human
ugggauuacaggugugag

SEQ ID NO: 1180113 - RNA, 19 nt, Human
ugggauuacaggugugagc

SEQ ID NO: 1180114 - RNA, 21 nt, Human
ugggauuacaggugugagcca

SEQ ID NO: 1180115 - RNA, 22 nt, Human
ugggauuacaggugugagccac

SEQ ID NO: 1180116 - RNA, 22 nt, Human
ugggauuacaggugugagccac

SEQ ID NO: 1180117 - RNA, 24 nt, Human
ugggauuacaggugugagccacgg

SEQ ID NO: 1180118 - RNA, 25 nt, Human
ugggauuacaggugugagccacggc

SEQ ID NO: 1180119 - RNA, 21 nt, Human
ugggcaacccagaauaaccaa

SEQ ID NO: 1180120 - RNA, 21 nt, Human
ugggguaggauccagggagcu

SEQ ID NO: 1180121 - RNA, 18 nt, Human
uguacacauucacacccg

SEQ ID NO: 1180122 - RNA, 20 nt, Human
uguacacauucacacccgca

SEQ ID NO: 1180123 - RNA, 23 nt, Human
uguugagaugcuaguuaugagca

SEQ ID NO: 1180124 - RNA, 21 nt, Human
uuagcgcugccuuggugaugc

SEQ ID NO: 1180125 - RNA, 21 nt, Human
uucggccuccugagcugcagc

SEQ ID NO: 1180126 - RNA, 19 nt, Human
uugcacucaagcgaucugc

SEQ ID NO: 1180127 - RNA, 18 nt, Human
uuuaaaaauuucucccaa

SEQ ID NO: 1180128 - RNA, 20 nt, Human
agaagaagcugacuuggcca

SEQ ID NO: 1180129 - RNA, 21 nt, Human
cagaagaagcugacuuggcca

SEQ ID NO: 1180130 - RNA, 23 nt, Human
cagagguuuucuucaugaaauuu

SEQ ID NO: 1180131 - RNA, 23 nt, Human
gugcucuuguuggaaauguauuc

SEQ ID NO: 1180132 - RNA, 24 nt, Human
uaguaauauuacaaaaucuauaua

SEQ ID NO: 1180133 - RNA, 25 nt, Human
uauugcaaacacauuaaaaaaacua

SEQ ID NO: 1180134 - RNA, 22 nt, Human
ucagaagaagcugacuuggcca

SEQ ID NO: 1180135 - RNA, 19 nt, Human
ucucucagaagaagcugac

SEQ ID NO: 1180136 - RNA, 22 nt, Human
uuaaaaaaacuaaauaguaaua

SEQ ID NO: 1180137 - RNA, 19 nt, Human
uugaagugaaggcuuuuuu

SEQ ID NO: 1180138 - RNA, 23 nt, Human
uugaagugaaggcuuuuuuccau

SEQ ID NO: 1180139 - RNA, 19 nt, Human
guccuuuauuuuuuuuuuu

SEQ ID NO: 1180140 - RNA, 23 nt, Human
aaaaagagacauauuuagguaaa

SEQ ID NO: 1180141 - RNA, 23 nt, Human
aaaaauaauaaaaaccccaugcu

SEQ ID NO: 1180142 - RNA, 20 nt, Human
aacaacaucaaacuccacag

SEQ ID NO: 1180143 - RNA, 25 nt, Human
aagcacuuaaggucuucagcuccaa

SEQ ID NO: 1180144 - RNA, 23 nt, Human
acacugcgaagguacuuccuggg

SEQ ID NO: 1180145 - RNA, 21 nt, Human
aguucuauuuaucuggucaac

SEQ ID NO: 1180146 - RNA, 25 nt, Human
aucuuccuuggugucauuccuguug

SEQ ID NO: 1180147 - RNA, 21 nt, Human
caacgggcaaaaagcaagcac

SEQ ID NO: 1180148 - RNA, 18 nt, Human
cacccucuucuccuucaa

SEQ ID NO: 1180149 - RNA, 22 nt, Human
cacccucuucuccuucaacaac

SEQ ID NO: 1180150 - RNA, 18 nt, Human
cagcggcggggcugcuca

SEQ ID NO: 1180151 - RNA, 22 nt, Human
cauuugcugccuccgcacccuc

SEQ ID NO: 1180152 - RNA, 18 nt, Human
ccugcgguagggccggca

SEQ ID NO: 1180153 - RNA, 19 nt, Human
cggcggcgcugagggcggg

SEQ ID NO: 1180154 - RNA, 21 nt, Human
cggcugcggcagcugcggcuu

SEQ ID NO: 1180155 - RNA, 24 nt, Human
cgggggcggcggguggcugcuggg

SEQ ID NO: 1180156 - RNA, 20 nt, Human
cucaggguucucuggggucc

SEQ ID NO: 1180157 - RNA, 21 nt, Human
cuccgcacccucuucuccuuc

SEQ ID NO: 1180158 - RNA, 19 nt, Human
gacgggaggggggcggugg

SEQ ID NO: 1180159 - RNA, 18 nt, Human
gaucccucggucuuuucc

SEQ ID NO: 1180160 - RNA, 20 nt, Human
gaucccucggucuuuucccc

SEQ ID NO: 1180161 - RNA, 19 nt, Human
gcagcggcggggcugcuca

SEQ ID NO: 1180162 - RNA, 21 nt, Human
gcggcggggcugcucaggguu

SEQ ID NO: 1180163 - RNA, 18 nt, Human
gcggcggggggacgggag

SEQ ID NO: 1180164 - RNA, 18 nt, Human
gcugcggcuccucccgug

SEQ ID NO: 1180165 - RNA, 20 nt, Human
ggcggcggguggcugcuggg

SEQ ID NO: 1180166 - RNA, 26 nt, Human
ggcggggggacgggaggggggcggug

SEQ ID NO: 1180167 - RNA, 24 nt, Human
ggcgguggggggaaaggcgggggc

SEQ ID NO: 1180168 - RNA, 25 nt, Human
ggcuuggugucggcggcgcugaggg

SEQ ID NO: 1180169 - RNA, 18 nt, Human
gggacgggaggggggcgg

SEQ ID NO: 1180170 - RNA, 24 nt, Human
gggacgggaggggggcgguggggg

SEQ ID NO: 1180171 - RNA, 24 nt, Human
gggcggcggggggacgggaggggg

SEQ ID NO: 1180172 - RNA, 23 nt, Human
gggcggcggguggcugcuggguc

SEQ ID NO: 1180173 - RNA, 25 nt, Human
gggcgguggggggaaaggcgggggc

SEQ ID NO: 1180174 - RNA, 20 nt, Human
ggggaaaggcgggggcggcg

SEQ ID NO: 1180175 - RNA, 19 nt, Human
ggggacgggaggggggcgg

SEQ ID NO: 1180176 - RNA, 18 nt, Human
gggggcgguggggggaaa

SEQ ID NO: 1180177 - RNA, 23 nt, Human
gggggcgguggggggaaaggcgg

SEQ ID NO: 1180178 - RNA, 27 nt, Human
gggggcgguggggggaaaggcggggaa

SEQ ID NO: 1180179 - RNA, 19 nt, Human
ggggggaaaggcgggggcg

SEQ ID NO: 1180180 - RNA, 23 nt, Human
gguggcugcugggucucggccuu

SEQ ID NO: 1180181 - RNA, 20 nt, Human
gguggggggaaaggcggggg

SEQ ID NO: 1180182 - RNA, 21 nt, Human
gucucggccuugcugcucauu

SEQ ID NO: 1180183 - RNA, 20 nt, Human
uacacugcgaagguacuucc

SEQ ID NO: 1180184 - RNA, 23 nt, Human
uacacugcgaagguacuuccugg

SEQ ID NO: 1180185 - RNA, 24 nt, Human
uagguaaaaauaauaaaaacccca

SEQ ID NO: 1180186 - RNA, 23 nt, Human
uauuaccaaaaagagacauauuu

SEQ ID NO: 1180187 - RNA, 19 nt, Human
ucccaaaaccuucacugcg

SEQ ID NO: 1180188 - RNA, 19 nt, Human
uccgcacccucuucuccuu

SEQ ID NO: 1180189 - RNA, 21 nt, Human
uccgggguccgcucuccgcuc

SEQ ID NO: 1180190 - RNA, 22 nt, Human
uccuguugaugaaaccauaucc

SEQ ID NO: 1180191 - RNA, 18 nt, Human
ucuccuacacugcgaagg

SEQ ID NO: 1180192 - RNA, 18 nt, Human
ugaacucgaacaccacca

SEQ ID NO: 1180193 - RNA, 20 nt, Human
ugcucauugguugcggugau

SEQ ID NO: 1180194 - RNA, 19 nt, Human
uguccacgcuggcaggcgc

SEQ ID NO: 1180195 - RNA, 24 nt, Human
uuccccacucucacuguucuggua

SEQ ID NO: 1180196 - RNA, 19 nt, Human
uuccuuggugucauuccug

SEQ ID NO: 1180197 - RNA, 24 nt, Human
uuccuuggugucauuccuguugau

SEQ ID NO: 1180198 - RNA, 20 nt, Human
uuguccacgcuggcaggcgc

SEQ ID NO: 1180199 - RNA, 19 nt, Human
aaagugcugggaauauagg

SEQ ID NO: 1180200 - RNA, 24 nt, Human
aaagugcugggaauauaggcauga

SEQ ID NO: 1180201 - RNA, 24 nt, Human
aacacuggugaaaccccgucucua

SEQ ID NO: 1180202 - RNA, 19 nt, Human
aaccaugauaugacacaac

SEQ ID NO: 1180203 - RNA, 21 nt, Human
aaccccgucucuaccaaaaau

SEQ ID NO: 1180204 - RNA, 24 nt, Human
aacugcuugaaccuggggggugga

SEQ ID NO: 1180205 - RNA, 22 nt, Human
aagcccagcuaggcccuggaaa

SEQ ID NO: 1180206 - RNA, 20 nt, Human
aaugcaggggagagggagaa

SEQ ID NO: 1180207 - RNA, 21 nt, Human
acaagaaugaaacucugucuc

SEQ ID NO: 1180208 - RNA, 22 nt, Human
acaauggcauaugcuuugucga

SEQ ID NO: 1180209 - RNA, 19 nt, Human
acacuggugaaaccccguc

SEQ ID NO: 1180210 - RNA, 20 nt, Human
acacuggugaaaccccgucu

SEQ ID NO: 1180211 - RNA, 21 nt, Human
acacuggugaaaccccgucuc

SEQ ID NO: 1180212 - RNA, 22 nt, Human
accaaucacuaagcauugccau

SEQ ID NO: 1180213 - RNA, 21 nt, Human
accacaaugcaggggagaggg

SEQ ID NO: 1180214 - RNA, 19 nt, Human
accagacuacaaauaaaug

SEQ ID NO: 1180215 - RNA, 24 nt, Human
accccgucucuaccaaaaauacaa

SEQ ID NO: 1180216 - RNA, 24 nt, Human
accugaggucaggaguucgagacc

SEQ ID NO: 1180217 - RNA, 24 nt, Human
acuccugggcucaagugauucucc

SEQ ID NO: 1180218 - RNA, 28 nt, Human
acucugucucaaaaaaaaaaaaaaaaaa

SEQ ID NO: 1180219 - RNA, 19 nt, Human
acugcacuccagcccuggg

SEQ ID NO: 1180220 - RNA, 20 nt, Human
acugcacuccagcccugggg

SEQ ID NO: 1180221 - RNA, 24 nt, Human
agcacuuugggaggccgagguggg

SEQ ID NO: 1180222 - RNA, 21 nt, Human
agccgagggaagcuguuucuu

SEQ ID NO: 1180223 - RNA, 25 nt, Human
agccuggccaacacuggugaaaccc

SEQ ID NO: 1180224 - RNA, 24 nt, Human
aggaaagaaagagaaaauacauaa

SEQ ID NO: 1180225 - RNA, 19 nt, Human
aggaagaacugcuugaacc

SEQ ID NO: 1180226 - RNA, 21 nt, Human
aggaagaacugcuugaaccug

SEQ ID NO: 1180227 - RNA, 19 nt, Human
aggcaugagccaccaugcc

SEQ ID NO: 1180228 - RNA, 21 nt, Human
aggccgagguggguggaucac

SEQ ID NO: 1180229 - RNA, 21 nt, Human
aggcugaggaagaacugcuug

SEQ ID NO: 1180230 - RNA, 19 nt, Human
aggggagagggagaaaagg

SEQ ID NO: 1180231 - RNA, 19 nt, Human
aggggagagggagaaaagg

SEQ ID NO: 1180232 - RNA, 22 nt, Human
agguggguggaucaccugaggu

SEQ ID NO: 1180233 - RNA, 23 nt, Human
aguacuuuacaggccugcuuuac

SEQ ID NO: 1180234 - RNA, 18 nt, Human
aguccugaacuccugggc

SEQ ID NO: 1180235 - RNA, 22 nt, Human
agugcuggauaacacuugagug

SEQ ID NO: 1180236 - RNA, 20 nt, Human
auagcauuuuuucugcagua

SEQ ID NO: 1180237 - RNA, 21 nt, Human
aucaccugaggucaggaguuc

SEQ ID NO: 1180238 - RNA, 25 nt, Human
aucaugccacugcacuccagcccug

SEQ ID NO: 1180239 - RNA, 24 nt, Human
augccacugcacuccagcccuggg

SEQ ID NO: 1180240 - RNA, 19 nt, Human
augccuguaaucccagcac

SEQ ID NO: 1180241 - RNA, 23 nt, Human
caaagugcugggaauauaggcau

SEQ ID NO: 1180242 - RNA, 24 nt, Human
caaagugcugggaauauaggcaug

SEQ ID NO: 1180243 - RNA, 23 nt, Human
caacaagaaugaaacucugucuc

SEQ ID NO: 1180244 - RNA, 18 nt, Human
caacugauggccacugug

SEQ ID NO: 1180245 - RNA, 22 nt, Human
caagaaugaaacucugucucaa

SEQ ID NO: 1180246 - RNA, 19 nt, Human
caaguaagccacaauggca

SEQ ID NO: 1180247 - RNA, 23 nt, Human
caaguuuaagaaacacuggauuu

SEQ ID NO: 1180248 - RNA, 18 nt, Human
caccauggaccagaauac

SEQ ID NO: 1180249 - RNA, 19 nt, Human
caccauggaccagaauaca

SEQ ID NO: 1180250 - RNA, 19 nt, Human
caccauggaccagaauaca

SEQ ID NO: 1180251 - RNA, 23 nt, Human
caccugaggucaggaguucgaga

SEQ ID NO: 1180252 - RNA, 18 nt, Human
cacgccuguaaucccagc

SEQ ID NO: 1180253 - RNA, 19 nt, Human
cacgccuguaaucccagcu

SEQ ID NO: 1180254 - RNA, 20 nt, Human
cacugcacuccagcccuggg

SEQ ID NO: 1180255 - RNA, 22 nt, Human
cacugcacuccagcccugggca

SEQ ID NO: 1180256 - RNA, 23 nt, Human
cacugcacuccagcccugggcaa

SEQ ID NO: 1180257 - RNA, 24 nt, Human
cacugcacuccagcccugggcaac

SEQ ID NO: 1180258 - RNA, 25 nt, Human
cacugcacuccagcccugggcaaca

SEQ ID NO: 1180259 - RNA, 22 nt, Human
cagaauccugcugcagagcuga

SEQ ID NO: 1180260 - RNA, 24 nt, Human
cagcacuuugggaggccgaggugg

SEQ ID NO: 1180261 - RNA, 18 nt, Human
caggcuaguccugaacuc

SEQ ID NO: 1180262 - RNA, 23 nt, Human
caggggagagggagaaaaggggu

SEQ ID NO: 1180263 - RNA, 20 nt, Human
caugccuguaaucccagcac

SEQ ID NO: 1180264 - RNA, 24 nt, Human
caugccuguaaucccagcacuuug

SEQ ID NO: 1180265 - RNA, 19 nt, Human
caugcugucuuuugggguc

SEQ ID NO: 1180266 - RNA, 23 nt, Human
ccaaagcaaaaauuucaucagaa

SEQ ID NO: 1180267 - RNA, 21 nt, Human
ccacugcacuccagcccuggg

SEQ ID NO: 1180268 - RNA, 22 nt, Human
ccacugcacuccagcccugggc

SEQ ID NO: 1180269 - RNA, 25 nt, Human
ccacugcacuccagcccugggcaac

SEQ ID NO: 1180270 - RNA, 20 nt, Human
ccagacuucacaucccgccu

SEQ ID NO: 1180271 - RNA, 21 nt, Human
cccagaccacaaugcagggga

SEQ ID NO: 1180272 - RNA, 18 nt, Human
ccggggacuuagaggaag

SEQ ID NO: 1180273 - RNA, 22 nt, Human
ccugaggucaggaguucgagac

SEQ ID NO: 1180274 - RNA, 30 nt, Human
ccugccuuaaaggacaagaaaugauuuucc

SEQ ID NO: 1180275 - RNA, 24 nt, Human
ccuggccaacacuggugaaacccc

SEQ ID NO: 1180276 - RNA, 25 nt, Human
ccuggccaacacuggugaaaccccg

SEQ ID NO: 1180277 - RNA, 22 nt, Human
ccugggcucaagugauucuccc

SEQ ID NO: 1180278 - RNA, 21 nt, Human
ccugggggguggagguugcag

SEQ ID NO: 1180279 - RNA, 22 nt, Human
ccuguaaucccagcacuuuggg

SEQ ID NO: 1180280 - RNA, 22 nt, Human
ccuguaaucccagcuacuccgg

SEQ ID NO: 1180281 - RNA, 23 nt, Human
ccuguaaucccagcuacuccgga

SEQ ID NO: 1180282 - RNA, 25 nt, Human
cgagaccagccuggccaacacuggu

SEQ ID NO: 1180283 - RNA, 24 nt, Human
cgagguggguggaucaccugaggu

SEQ ID NO: 1180284 - RNA, 24 nt, Human
cgccuguaaucccagcuacuccgg

SEQ ID NO: 1180285 - RNA, 19 nt, Human
cuaagcauugccauguacc

SEQ ID NO: 1180286 - RNA, 22 nt, Human
cuaguucuuauaguggcucaug

SEQ ID NO: 1180287 - RNA, 18 nt, Human
cucaaaaaaaaaaaaaaa

SEQ ID NO: 1180288 - RNA, 23 nt, Human
cucaagugauucucccacuuuga

SEQ ID NO: 1180289 - RNA, 18 nt, Human
cucagaauuaguggguca

SEQ ID NO: 1180290 - RNA, 21 nt, Human
cucccacuuugaccucucaaa

SEQ ID NO: 1180291 - RNA, 20 nt, Human
cuccugggcucaagugauuc

SEQ ID NO: 1180292 - RNA, 21 nt, Human
cuccugggcucaagugauucu

SEQ ID NO: 1180293 - RNA, 19 nt, Human
cucugucucaaaaaaaaaa

SEQ ID NO: 1180294 - RNA, 24 nt, Human
cugcuugaaccugggggguggagg

SEQ ID NO: 1180295 - RNA, 19 nt, Human
cuugaaccuggggggugga

SEQ ID NO: 1180296 - RNA, 25 nt, Human
cuugcacauccagacuucacauccc

SEQ ID NO: 1180297 - RNA, 28 nt, Human
cuugugcauacagacugggagucccuug

SEQ ID NO: 1180298 - RNA, 21 nt, Human
gaauauaggcaugagccacca

SEQ ID NO: 1180299 - RNA, 24 nt, Human
gaauauaggcaugagccaccaugc

SEQ ID NO: 1180300 - RNA, 21 nt, Human
gacucugaauuuuuucuuuuu

SEQ ID NO: 1180301 - RNA, 20 nt, Human
gagcuaguucuuauaguggc

SEQ ID NO: 1180302 - RNA, 25 nt, Human
gagguggguggaucaccugagguca

SEQ ID NO: 1180303 - RNA, 22 nt, Human
gagguugcagugagcugagauc

SEQ ID NO: 1180304 - RNA, 21 nt, Human
gaucaccugaggucaggaguu

SEQ ID NO: 1180305 - RNA, 24 nt, Human
gaucaccugaggucaggaguucga

SEQ ID NO: 1180306 - RNA, 21 nt, Human
gcagugggcucugggcagcau

SEQ ID NO: 1180307 - RNA, 25 nt, Human
gccaacacuggugaaaccccgucuc

SEQ ID NO: 1180308 - RNA, 25 nt, Human
gccacugcacuccagcccugggcaa

SEQ ID NO: 1180309 - RNA, 22 nt, Human
gccgggcacggugguucaugcc

SEQ ID NO: 1180310 - RNA, 18 nt, Human
gccugcuuuacuccucag

SEQ ID NO: 1180311 - RNA, 19 nt, Human
gcuaguccugaacuccugg

SEQ ID NO: 1180312 - RNA, 20 nt, Human
gcugagaucaugccacugca

SEQ ID NO: 1180313 - RNA, 22 nt, Human
ggaauauaggcaugagccacca

SEQ ID NO: 1180314 - RNA, 24 nt, Human
ggaauauaggcaugagccaccaug

SEQ ID NO: 1180315 - RNA, 24 nt, Human
ggacagguuguucggcaacgaccc

SEQ ID NO: 1180316 - RNA, 31 nt, Human
ggaccaaggcccagaccacaaugcaggggaa

SEQ ID NO: 1180317 - RNA, 21 nt, Human
ggagacaggucgagaguaagg

SEQ ID NO: 1180318 - RNA, 18 nt, Human
ggagaggaaaaggcggca

SEQ ID NO: 1180319 - RNA, 18 nt, Human
ggagguugcagugagcug

SEQ ID NO: 1180320 - RNA, 22 nt, Human
ggagguugcagugagcugagau

SEQ ID NO: 1180321 - RNA, 23 nt, Human
ggagguugcagugagcugagauc

SEQ ID NO: 1180322 - RNA, 24 nt, Human
ggagguugcagugagcugagauca

SEQ ID NO: 1180323 - RNA, 23 nt, Human
ggccgggcacggugguucaugcc

SEQ ID NO: 1180324 - RNA, 24 nt, Human
ggcugaggaagaacugcuugaacc

SEQ ID NO: 1180325 - RNA, 24 nt, Human
gggcacggugguucaugccuguaa

SEQ ID NO: 1180326 - RNA, 24 nt, Human
gggcgugguggcgcacgccuguaa

SEQ ID NO: 1180327 - RNA, 21 nt, Human
gggcucaagugauucucccac

SEQ ID NO: 1180328 - RNA, 19 nt, Human
ggggcugggacuaugggag

SEQ ID NO: 1180329 - RNA, 19 nt, Human
ggguccuuaggaaaugacu

SEQ ID NO: 1180330 - RNA, 19 nt, Human
gguggagguugcagugagc

SEQ ID NO: 1180331 - RNA, 19 nt, Human
gguggagguugcagugagc

SEQ ID NO: 1180332 - RNA, 23 nt, Human
gguggagguugcagugagcugag

SEQ ID NO: 1180333 - RNA, 21 nt, Human
gguggaucaccugaggucagg

SEQ ID NO: 1180334 - RNA, 24 nt, Human
gguggcgcacgccuguaaucccag

SEQ ID NO: 1180335 - RNA, 23 nt, Human
ggugguucaugccuguaauccca

SEQ ID NO: 1180336 - RNA, 24 nt, Human
ggugguucaugccuguaaucccag

SEQ ID NO: 1180337 - RNA, 18 nt, Human
guagaggugggaucuugc

SEQ ID NO: 1180338 - RNA, 19 nt, Human
guccagggaaggaaacugu

SEQ ID NO: 1180339 - RNA, 20 nt, Human
guggagguugcagugagcug

SEQ ID NO: 1180340 - RNA, 24 nt, Human
guugcagugagcugagaucaugcc

SEQ ID NO: 1180341 - RNA, 22 nt, Human
uaaagaaaugacaaguaagcca

SEQ ID NO: 1180342 - RNA, 22 nt, Human
uaagaaacacuggauuugccau

SEQ ID NO: 1180343 - RNA, 28 nt, Human
uaagaacaauguucuggccccucccucc

SEQ ID NO: 1180344 - RNA, 19 nt, Human
uaagcauugccauguacca

SEQ ID NO: 1180345 - RNA, 24 nt, Human
uaagcauugccauguaccaggccc

SEQ ID NO: 1180346 - RNA, 20 nt, Human
uaaggagaugaagggacauu

SEQ ID NO: 1180347 - RNA, 22 nt, Human
uagaggugggaucuugcuaugu

SEQ ID NO: 1180348 - RNA, 24 nt, Human
uagcagaaaguacggugguacacu

SEQ ID NO: 1180349 - RNA, 23 nt, Human
uauacaaugccauuuauuguaau

SEQ ID NO: 1180350 - RNA, 20 nt, Human
uaugacacaaccagacuaca

SEQ ID NO: 1180351 - RNA, 21 nt, Human
uaugcuuugucgaaugagagg

SEQ ID NO: 1180352 - RNA, 23 nt, Human
uauguugcccaggcuaguccuga

SEQ ID NO: 1180353 - RNA, 24 nt, Human
uauguugcccaggcuaguccugaa

SEQ ID NO: 1180354 - RNA, 24 nt, Human
ucaaaaaaaaaaaaaaaaaaagaa

SEQ ID NO: 1180355 - RNA, 24 nt, Human
ucaaagugcugggaauauaggcau

SEQ ID NO: 1180356 - RNA, 20 nt, Human
ucaccugaggucaggaguuc

SEQ ID NO: 1180357 - RNA, 18 nt, Human
ucagaauccugcugcaga

SEQ ID NO: 1180358 - RNA, 23 nt, Human
ucaugccacugcacuccagcccu

SEQ ID NO: 1180359 - RNA, 22 nt, Human
ucaugccuguaaucccagcacu

SEQ ID NO: 1180360 - RNA, 23 nt, Human
ucaugccuguaaucccagcacuu

SEQ ID NO: 1180361 - RNA, 23 nt, Human
uccaaaaggucuuucaguaacuc

SEQ ID NO: 1180362 - RNA, 24 nt, Human
uccccaccauggaccagaauacaa

SEQ ID NO: 1180363 - RNA, 22 nt, Human
ucccuuggguagcgggggacag

SEQ ID NO: 1180364 - RNA, 18 nt, Human
uccugaacuccugggcuc

SEQ ID NO: 1180365 - RNA, 23 nt, Human
uccugaacuccugggcucaagug

SEQ ID NO: 1180366 - RNA, 24 nt, Human
uccugcugcagagcugagggcugg

SEQ ID NO: 1180367 - RNA, 21 nt, Human
uccugggcucaagugauucuc

SEQ ID NO: 1180368 - RNA, 22 nt, Human
uccugggcucaagugauucucc

SEQ ID NO: 1180369 - RNA, 23 nt, Human
uccugggcucaagugauucuccc

SEQ ID NO: 1180370 - RNA, 24 nt, Human
uccugggcucaagugauucuccca

SEQ ID NO: 1180371 - RNA, 23 nt, Human
uccuucaugcugucuuuuggggu

SEQ ID NO: 1180372 - RNA, 24 nt, Human
ucucaaagugcugggaauauaggc

SEQ ID NO: 1180373 - RNA, 23 nt, Human
ucucacuguaaauagcauaagaa

SEQ ID NO: 1180374 - RNA, 23 nt, Human
ucugucucaaaaaaaaaaaaaaa

SEQ ID NO: 1180375 - RNA, 18 nt, Human
ucuugcuauguugcccag

SEQ ID NO: 1180376 - RNA, 19 nt, Human
ucuugcuauguugcccagg

SEQ ID NO: 1180377 - RNA, 24 nt, Human
ugaaccugggggguggagguugca

SEQ ID NO: 1180378 - RNA, 24 nt, Human
ugagacucugaauuuuuucuuuuu

SEQ ID NO: 1180379 - RNA, 20 nt, Human
ugagaggaauaaaacuggac

SEQ ID NO: 1180380 - RNA, 24 nt, Human
ugagaucaugccacugcacuccag

SEQ ID NO: 1180381 - RNA, 22 nt, Human
ugagcugagaucaugccacugc

SEQ ID NO: 1180382 - RNA, 21 nt, Human
ugaggaagaacugcuugaacc

SEQ ID NO: 1180383 - RNA, 21 nt, Human
ugaggaagaacugcuugaacc

SEQ ID NO: 1180384 - RNA, 22 nt, Human
ugaguggaaaggaggggcacag

SEQ ID NO: 1180385 - RNA, 23 nt, Human
ugcacauccagacuucacauccc

SEQ ID NO: 1180386 - RNA, 22 nt, Human
ugccaucuaucaagaugcucca

SEQ ID NO: 1180387 - RNA, 24 nt, Human
ugcccaggcuaguccugaacuccu

SEQ ID NO: 1180388 - RNA, 28 nt, Human
ugcccaggcuaguccugaacuccugggc

SEQ ID NO: 1180389 - RNA, 19 nt, Human
ugcccugggauggcugagg

SEQ ID NO: 1180390 - RNA, 23 nt, Human
ugccuguaaucccagcacuuugg

SEQ ID NO: 1180391 - RNA, 23 nt, Human
ugccuguaaucccagcacuuugg

SEQ ID NO: 1180392 - RNA, 20 nt, Human
ugcuauguugcccaggcuag

SEQ ID NO: 1180393 - RNA, 22 nt, Human
ugcuauguugcccaggcuaguc

SEQ ID NO: 1180394 - RNA, 27 nt, Human
ugcuauguugcccaggcuaguccugaa

SEQ ID NO: 1180395 - RNA, 20 nt, Human
ugcugcagagcugagggcug

SEQ ID NO: 1180396 - RNA, 23 nt, Human
ugcuugaaccugggggguggagg

SEQ ID NO: 1180397 - RNA, 21 nt, Human
uggaauggacaaggcauagca

SEQ ID NO: 1180398 - RNA, 23 nt, Human
uggacaaguuuaagaaacacugg

SEQ ID NO: 1180399 - RNA, 18 nt, Human
uggaccaaggcccagacc

SEQ ID NO: 1180400 - RNA, 18 nt, Human
uggagguugcagugagcu

SEQ ID NO: 1180401 - RNA, 24 nt, Human
uggaucaccugaggucaggaguuc

SEQ ID NO: 1180402 - RNA, 27 nt, Human
uggaucaccugaggucaggaguucgag

SEQ ID NO: 1180403 - RNA, 22 nt, Human
uggccaugaggcagauuaagca

SEQ ID NO: 1180404 - RNA, 21 nt, Human
uggcgcacgccuguaauccca

SEQ ID NO: 1180405 - RNA, 22 nt, Human
uggcgcacgccuguaaucccag

SEQ ID NO: 1180406 - RNA, 18 nt, Human
ugggaauauaggcaugag

SEQ ID NO: 1180407 - RNA, 24 nt, Human
ugggaauauaggcaugagccacca

SEQ ID NO: 1180408 - RNA, 23 nt, Human
ugggaggccgagguggguggauc

SEQ ID NO: 1180409 - RNA, 24 nt, Human
ugggaggccgagguggguggauca

SEQ ID NO: 1180410 - RNA, 24 nt, Human
ugggaucuugcuauguugcccagg

SEQ ID NO: 1180411 - RNA, 18 nt, Human
ugggaugacacuguggca

SEQ ID NO: 1180412 - RNA, 21 nt, Human
ugggaugacacuguggcagug

SEQ ID NO: 1180413 - RNA, 18 nt, Human
ugggcucaagugauucuc

SEQ ID NO: 1180414 - RNA, 24 nt, Human
ugggggguggagguugcagugagc

SEQ ID NO: 1180415 - RNA, 19 nt, Human
ugggucacaugaauaugaa

SEQ ID NO: 1180416 - RNA, 24 nt, Human
uggguggaucaccugaggucagga

SEQ ID NO: 1180417 - RNA, 19 nt, Human
uggguuucuugcacaucca

SEQ ID NO: 1180418 - RNA, 24 nt, Human
ugguggcgcacgccuguaauccca

SEQ ID NO: 1180419 - RNA, 22 nt, Human
ugguucaugccuguaaucccag

SEQ ID NO: 1180420 - RNA, 24 nt, Human
ugguucaugccuguaaucccagca

SEQ ID NO: 1180421 - RNA, 19 nt, Human
uguaccaggcccaggggcu

SEQ ID NO: 1180422 - RNA, 19 nt, Human
uguuagguguuguggggua

SEQ ID NO: 1180423 - RNA, 18 nt, Human
uuaguggggcgugguggc

SEQ ID NO: 1180424 - RNA, 20 nt, Human
uuaguggggcgugguggcgc

SEQ ID NO: 1180425 - RNA, 24 nt, Human
uuaguggggcgugguggcgcacgc

SEQ ID NO: 1180426 - RNA, 22 nt, Human
uucaaccaugauaugacacaac

SEQ ID NO: 1180427 - RNA, 19 nt, Human
uucacaagcccagcuaggc

SEQ ID NO: 1180428 - RNA, 18 nt, Human
uucucuggcaacugaugg

SEQ ID NO: 1180429 - RNA, 18 nt, Human
uucuggccccucccucca

SEQ ID NO: 1180430 - RNA, 19 nt, Human
uucuuuuuuuguagaggug

SEQ ID NO: 1180431 - RNA, 24 nt, Human
uugaaccugggggguggagguugc

SEQ ID NO: 1180432 - RNA, 20 nt, Human
uugcagugagcugagaucau

SEQ ID NO: 1180433 - RNA, 21 nt, Human
uugcagugagcugagaucaug

SEQ ID NO: 1180434 - RNA, 25 nt, Human
uugggaggccgagguggguggauca

SEQ ID NO: 1180435 - RNA, 18 nt, Human
uuuguagaggugggaucu

SEQ ID NO: 1180436 - RNA, 24 nt, Human
uuuuuuguagaggugggaucuugc

SEQ ID NO: 1180437 - RNA, 21 nt, Human
aaaagaccuccucguuccccc

SEQ ID NO: 1180438 - RNA, 21 nt, Human
aaagcacugcaggccaagggc

SEQ ID NO: 1180439 - RNA, 21 nt, Human
aaagcagaacacaccgugcuu

SEQ ID NO: 1180440 - RNA, 28 nt, Human
aaauaucccccugguccuuaugacaucc

SEQ ID NO: 1180441 - RNA, 23 nt, Human
aacaucccccaggcugcaccccc

SEQ ID NO: 1180442 - RNA, 19 nt, Human
aagaaccccaagacgggac

SEQ ID NO: 1180443 - RNA, 21 nt, Human
aagaaccccaagacgggacag

SEQ ID NO: 1180444 - RNA, 21 nt, Human
aagacgggacagaaccggcca

SEQ ID NO: 1180445 - RNA, 24 nt, Human
aagcccacggcccacaagacgugg

SEQ ID NO: 1180446 - RNA, 25 nt, Human
aagccggaggcacggagacagaaaa

SEQ ID NO: 1180447 - RNA, 20 nt, Human
aagcugcacccccucagccc

SEQ ID NO: 1180448 - RNA, 19 nt, Human
aaggaagcccaagguggag

SEQ ID NO: 1180449 - RNA, 22 nt, Human
acacacacagacaccaccccac

SEQ ID NO: 1180450 - RNA, 21 nt, Human
acaccagcaagcugcaccccc

SEQ ID NO: 1180451 - RNA, 22 nt, Human
acaggggagaccucacgacgug

SEQ ID NO: 1180452 - RNA, 24 nt, Human
acccgccgcgcccucuggagugcc

SEQ ID NO: 1180453 - RNA, 19 nt, Human
accuccacauccaugucca

SEQ ID NO: 1180454 - RNA, 18 nt, Human
acggagcugccgacacac

SEQ ID NO: 1180455 - RNA, 24 nt, Human
acgggacagaaccggccacccgcu

SEQ ID NO: 1180456 - RNA, 23 nt, Human
acgggacagcuggaaggacggag

SEQ ID NO: 1180457 - RNA, 22 nt, Human
agaaaauucuuuauugcaaagg

SEQ ID NO: 1180458 - RNA, 27 nt, Human
agacagaaaacaaacccacgugacaaa

SEQ ID NO: 1180459 - RNA, 20 nt, Human
agacguggacaccaagaacc

SEQ ID NO: 1180460 - RNA, 23 nt, Human
agcacaaaaaauaaauaaugaaa

SEQ ID NO: 1180461 - RNA, 21 nt, Human
agcccguggcugugcuccugg

SEQ ID NO: 1180462 - RNA, 26 nt, Human
agcccguggcugugcuccugggggug

SEQ ID NO: 1180463 - RNA, 21 nt, Human
agcucugggcggugacagcgg

SEQ ID NO: 1180464 - RNA, 23 nt, Human
aggaaaaggaagcccaaggugga

SEQ ID NO: 1180465 - RNA, 24 nt, Human
auccauguccaccaacauccccca

SEQ ID NO: 1180466 - RNA, 19 nt, Human
caaaagaccuccucguucc

SEQ ID NO: 1180467 - RNA, 22 nt, Human
caaaagaccuccucguuccccc

SEQ ID NO: 1180468 - RNA, 21 nt, Human
caacaucccccaggcugcacc

SEQ ID NO: 1180469 - RNA, 25 nt, Human
caagacgggacagaaccggccaccc

SEQ ID NO: 1180470 - RNA, 23 nt, Human
caagguggagugccaagcccacu

SEQ ID NO: 1180471 - RNA, 20 nt, Human
cacacacacagacaccaccc

SEQ ID NO: 1180472 - RNA, 21 nt, Human
cacacagccugaguccugcuc

SEQ ID NO: 1180473 - RNA, 23 nt, Human
cacacagccugaguccugcucac

SEQ ID NO: 1180474 - RNA, 24 nt, Human
cacacagccugaguccugcucacc

SEQ ID NO: 1180475 - RNA, 22 nt, Human
cacaccgugcccacucacgcag

SEQ ID NO: 1180476 - RNA, 22 nt, Human
caccaagaaccccaagacggga

SEQ ID NO: 1180477 - RNA, 23 nt, Human
caccaagaaccccaagacgggac

SEQ ID NO: 1180478 - RNA, 21 nt, Human
caccagagcacaggggagacc

SEQ ID NO: 1180479 - RNA, 22 nt, Human
cacccccucucccuagacugca

SEQ ID NO: 1180480 - RNA, 18 nt, Human
cacccgccgcgcccucug

SEQ ID NO: 1180481 - RNA, 20 nt, Human
caccugcucucgcacacggc

SEQ ID NO: 1180482 - RNA, 21 nt, Human
cacgcccuggaaacgcaaaga

SEQ ID NO: 1180483 - RNA, 23 nt, Human
cagaaaacaaacccacgugacaa

SEQ ID NO: 1180484 - RNA, 21 nt, Human
cagcacaaaaaauaaauaaug

SEQ ID NO: 1180485 - RNA, 26 nt, Human
cagcagcccuuccccucgccaggccc

SEQ ID NO: 1180486 - RNA, 18 nt, Human
cagcccguggcugugcuc

SEQ ID NO: 1180487 - RNA, 21 nt, Human
cagcugccugguacaguccgu

SEQ ID NO: 1180488 - RNA, 19 nt, Human
caggcaaaggcuccgggug

SEQ ID NO: 1180489 - RNA, 24 nt, Human
caggccaagggcagguagaagccc

SEQ ID NO: 1180490 - RNA, 20 nt, Human
cagggagucccuucuccagc

SEQ ID NO: 1180491 - RNA, 18 nt, Human
caguagacacagaaccaa

SEQ ID NO: 1180492 - RNA, 18 nt, Human
cagugaacaccagcaagc

SEQ ID NO: 1180493 - RNA, 19 nt, Human
cagugguccuggcgggccu

SEQ ID NO: 1180494 - RNA, 19 nt, Human
ccaaaagaccuccucguuc

SEQ ID NO: 1180495 - RNA, 18 nt, Human
ccaagaaccccaagacgg

SEQ ID NO: 1180496 - RNA, 22 nt, Human
ccaagacgggacagaaccggcc

SEQ ID NO: 1180497 - RNA, 23 nt, Human
ccaagacgggacagaaccggcca

SEQ ID NO: 1180498 - RNA, 21 nt, Human
ccacauccauguccaccaaca

SEQ ID NO: 1180499 - RNA, 18 nt, Human
ccaccugugcccgugccc

SEQ ID NO: 1180500 - RNA, 18 nt, Human
ccacgaagcucuccugga

SEQ ID NO: 1180501 - RNA, 18 nt, Human
ccacgcaacguccuccuc

SEQ ID NO: 1180502 - RNA, 22 nt, Human
cccaaaagaccuccucguuccc

SEQ ID NO: 1180503 - RNA, 24 nt, Human
cccaaaagaccuccucguuccccc

SEQ ID NO: 1180504 - RNA, 22 nt, Human
cccacaagacguggacaccaag

SEQ ID NO: 1180505 - RNA, 22 nt, Human
cccacccgccgcgcccucugga

SEQ ID NO: 1180506 - RNA, 20 nt, Human
ccccaagacgggacagaacc

SEQ ID NO: 1180507 - RNA, 23 nt, Human
ccccacccgccgcgcccucugga

SEQ ID NO: 1180508 - RNA, 18 nt, Human
cccccaggcugcaccccc

SEQ ID NO: 1180509 - RNA, 24 nt, Human
cccccgcggcucucgcugcagaga

SEQ ID NO: 1180510 - RNA, 20 nt, Human
ccccucgccaggcccccaaa

SEQ ID NO: 1180511 - RNA, 24 nt, Human
ccccucgccaggcccccaaaagac

SEQ ID NO: 1180512 - RNA, 19 nt, Human
cccgugcccccggcucugc

SEQ ID NO: 1180513 - RNA, 19 nt, Human
cccuagacugcagcagccc

SEQ ID NO: 1180514 - RNA, 23 nt, Human
cccucccagcguggcuggcaccc

SEQ ID NO: 1180515 - RNA, 22 nt, Human
ccgcgcccucuggagugccagg

SEQ ID NO: 1180516 - RNA, 23 nt, Human
ccggggcugucuguccucugccc

SEQ ID NO: 1180517 - RNA, 19 nt, Human
ccuaccacggccacggggg

SEQ ID NO: 1180518 - RNA, 27 nt, Human
ccuccucccaccacuccacgcaacguc

SEQ ID NO: 1180519 - RNA, 28 nt, Human
ccuccucccaccacuccacgcaacgucc

SEQ ID NO: 1180520 - RNA, 18 nt, Human
ccuccuccuuccaccucc

SEQ ID NO: 1180521 - RNA, 21 nt, Human
ccuccucguucccccugcacu

SEQ ID NO: 1180522 - RNA, 18 nt, Human
ccugcagcccguggcugu

SEQ ID NO: 1180523 - RNA, 18 nt, Human
ccugcagcuucccacuca

SEQ ID NO: 1180524 - RNA, 21 nt, Human
ccugcagcuucccacucaacu

SEQ ID NO: 1180525 - RNA, 19 nt, Human
ccugcugccuccccacccg

SEQ ID NO: 1180526 - RNA, 19 nt, Human
ccuuccaccuccacaucca

SEQ ID NO: 1180527 - RNA, 20 nt, Human
cgacacaccauccaugcucc

SEQ ID NO: 1180528 - RNA, 23 nt, Human
cgaccucccacaccgugcccacu

SEQ ID NO: 1180529 - RNA, 24 nt, Human
cgcaacguccuccuccuuccaccu

SEQ ID NO: 1180530 - RNA, 21 nt, Human
cgcaggccccugcuaaggcag

SEQ ID NO: 1180531 - RNA, 23 nt, Human
cgcaggcgaccucccacaccgug

SEQ ID NO: 1180532 - RNA, 25 nt, Human
cgcccuggaaacgcaaagaccugga

SEQ ID NO: 1180533 - RNA, 18 nt, Human
cgcuccugccuguguccg

SEQ ID NO: 1180534 - RNA, 19 nt, Human
cggcauagggggccggggu

SEQ ID NO: 1180535 - RNA, 21 nt, Human
cgggacagaaccggccacccg

SEQ ID NO: 1180536 - RNA, 23 nt, Human
cguccuccuccuuccaccuccac

SEQ ID NO: 1180537 - RNA, 19 nt, Human
cuccaggaaaaggaagccc

SEQ ID NO: 1180538 - RNA, 21 nt, Human
cuccaggaaaaggaagcccaa

SEQ ID NO: 1180539 - RNA, 20 nt, Human
cucccaccugugcccgugcc

SEQ ID NO: 1180540 - RNA, 23 nt, Human
cucccgccuccucccaccacucc

SEQ ID NO: 1180541 - RNA, 19 nt, Human
cucccuagacugcagcagc

SEQ ID NO: 1180542 - RNA, 23 nt, Human
cuccuccuuccaccuccacaucc

SEQ ID NO: 1180543 - RNA, 20 nt, Human
cuccucgggucaccagagca

SEQ ID NO: 1180544 - RNA, 23 nt, Human
cuccugggggugugcgcgcagga

SEQ ID NO: 1180545 - RNA, 22 nt, Human
cucguucccccugcacugacca

SEQ ID NO: 1180546 - RNA, 18 nt, Human
cucuuugggaagccggag

SEQ ID NO: 1180547 - RNA, 22 nt, Human
cugaaaccagaaaauucuuuau

SEQ ID NO: 1180548 - RNA, 20 nt, Human
cugcacccccucagcccugc

SEQ ID NO: 1180549 - RNA, 22 nt, Human
cuggcacccgccugggcucugu

SEQ ID NO: 1180550 - RNA, 22 nt, Human
gaaaauucuuuauugcaaaggu

SEQ ID NO: 1180551 - RNA, 20 nt, Human
gacagcuggaaggacggagc

SEQ ID NO: 1180552 - RNA, 18 nt, Human
gacuggugccugcugccu

SEQ ID NO: 1180553 - RNA, 21 nt, Human
gagcugccgacacaccaucca

SEQ ID NO: 1180554 - RNA, 21 nt, Human
gaggagcaggcaaaggcuccg

SEQ ID NO: 1180555 - RNA, 22 nt, Human
gcaagcugcacccccucagccc

SEQ ID NO: 1180556 - RNA, 23 nt, Human
gcacggagacagaaaacaaaccc

SEQ ID NO: 1180557 - RNA, 22 nt, Human
gcagaacacaccgugcuucccc

SEQ ID NO: 1180558 - RNA, 18 nt, Human
gcagggacggggcagggc

SEQ ID NO: 1180559 - RNA, 18 nt, Human
gcccacucacgcaggccc

SEQ ID NO: 1180560 - RNA, 19 nt, Human
gcccguggcugugcuccug

SEQ ID NO: 1180561 - RNA, 21 nt, Human
gccucagugcucuuggaagga

SEQ ID NO: 1180562 - RNA, 22 nt, Human
gccugaguccugcucaccguca

SEQ ID NO: 1180563 - RNA, 19 nt, Human
gccugcugccuccccaccc

SEQ ID NO: 1180564 - RNA, 22 nt, Human
gcucccaacucccaccugugcc

SEQ ID NO: 1180565 - RNA, 18 nt, Human
gcuuugcucccaacuccc

SEQ ID NO: 1180566 - RNA, 18 nt, Human
ggaaacgcaaagaccugg

SEQ ID NO: 1180567 - RNA, 20 nt, Human
ggcggcggcggccagacacg

SEQ ID NO: 1180568 - RNA, 22 nt, Human
ggcucucgcugcagagacccca

SEQ ID NO: 1180569 - RNA, 21 nt, Human
gggcagguagaagcccacggc

SEQ ID NO: 1180570 - RNA, 24 nt, Human
gggcucuguagcuggugggggcug

SEQ ID NO: 1180571 - RNA, 18 nt, Human
ggggcagggcggcggcgg

SEQ ID NO: 1180572 - RNA, 21 nt, Human
ggggcugucuguccucugccc

SEQ ID NO: 1180573 - RNA, 23 nt, Human
gggugugcgcgcaggagccacgu

SEQ ID NO: 1180574 - RNA, 23 nt, Human
gguagaagcccacggcccacaag

SEQ ID NO: 1180575 - RNA, 18 nt, Human
ggugguggccgcagggac

SEQ ID NO: 1180576 - RNA, 22 nt, Human
guccaccaacaucccccaggcu

SEQ ID NO: 1180577 - RNA, 20 nt, Human
gugccaagcccacuggugcc

SEQ ID NO: 1180578 - RNA, 24 nt, Human
uaaaaagcagcacaaaaaauaaau

SEQ ID NO: 1180579 - RNA, 19 nt, Human
uaacaguagacacagaacc

SEQ ID NO: 1180580 - RNA, 21 nt, Human
uaucaaacuggaaaagaaaga

SEQ ID NO: 1180581 - RNA, 21 nt, Human
uaucaugauaaaaagcagcac

SEQ ID NO: 1180582 - RNA, 21 nt, Human
uccaccaacaucccccaggcu

SEQ ID NO: 1180583 - RNA, 19 nt, Human
ucccccaggcaggggcucc

SEQ ID NO: 1180584 - RNA, 22 nt, Human
ucccccaggcugcacccccucu

SEQ ID NO: 1180585 - RNA, 21 nt, Human
ucccgugggcaggggcuucug

SEQ ID NO: 1180586 - RNA, 23 nt, Human
ucccucgucuuuuucuuaaauaa

SEQ ID NO: 1180587 - RNA, 23 nt, Human
uccgcugagauccgggacggccu

SEQ ID NO: 1180588 - RNA, 23 nt, Human
uccucccaccacuccacgcaacg

SEQ ID NO: 1180589 - RNA, 23 nt, Human
uccuggacuggugccugcugccu

SEQ ID NO: 1180590 - RNA, 21 nt, Human
ucgcacacggcucccgccucc

SEQ ID NO: 1180591 - RNA, 22 nt, Human
ucgcacacggcucccgccuccu

SEQ ID NO: 1180592 - RNA, 22 nt, Human
ucgccaggcccccaaaagaccu

SEQ ID NO: 1180593 - RNA, 21 nt, Human
ugaggccagccacaccugcag

SEQ ID NO: 1180594 - RNA, 21 nt, Human
ugauagauuuacaguaucaaa

SEQ ID NO: 1180595 - RNA, 18 nt, Human
ugcaacgggacagcugga

SEQ ID NO: 1180596 - RNA, 22 nt, Human
ugcacacacacagacaccaccc

SEQ ID NO: 1180597 - RNA, 19 nt, Human
ugcacccccucucccuaga

SEQ ID NO: 1180598 - RNA, 22 nt, Human
ugcacccccucucccuagacug

SEQ ID NO: 1180599 - RNA, 19 nt, Human
ugccaagcccacuggugcc

SEQ ID NO: 1180600 - RNA, 21 nt, Human
ugcccacaggcccucccccag

SEQ ID NO: 1180601 - RNA, 24 nt, Human
ugcccgugcccccggcucugcucu

SEQ ID NO: 1180602 - RNA, 20 nt, Human
ugccugguacaguccguggg

SEQ ID NO: 1180603 - RNA, 22 nt, Human
ugcgcugugcugcacgaccucc

SEQ ID NO: 1180604 - RNA, 24 nt, Human
uggagugccaagcccacuggugcc

SEQ ID NO: 1180605 - RNA, 22 nt, Human
uggccgcagggacggggcaggg

SEQ ID NO: 1180606 - RNA, 23 nt, Human
uggcggcauagggggccgggguc

SEQ ID NO: 1180607 - RNA, 24 nt, Human
uggcugugcuccugggggugugcg

SEQ ID NO: 1180608 - RNA, 24 nt, Human
ugugaauauaauuuuauaucucua

SEQ ID NO: 1180609 - RNA, 18 nt, Human
ugugcccacaggcccucc

SEQ ID NO: 1180610 - RNA, 24 nt, Human
ugugcccgugcccccggcucugcu

SEQ ID NO: 1180611 - RNA, 18 nt, Human
uuaggugguggccgcagg

SEQ ID NO: 1180612 - RNA, 19 nt, Human
uuccccggcccagcucugg

SEQ ID NO: 1180613 - RNA, 20 nt, Human
uucuccagcaaagcacugca

SEQ ID NO: 1180614 - RNA, 21 nt, Human
uugcucccaacucccaccugu

SEQ ID NO: 1180615 - RNA, 22 nt, Human
uuuaaauaucccccugguccuu

SEQ ID NO: 1180616 - RNA, 20 nt, Human
uuucuuaaauaaaaaaaucc

SEQ ID NO: 1180617 - RNA, 21 nt, Human
uuugcucccaacucccaccug

SEQ ID NO: 1180618 - RNA, 25 nt, Human
aaacaacagaaguuuauuucuccca

SEQ ID NO: 1180619 - RNA, 19 nt, Human
aaacaucauauucccagag

SEQ ID NO: 1180620 - RNA, 18 nt, Human
aaaccagaguucaagucu

SEQ ID NO: 1180621 - RNA, 21 nt, Human
aaaggaucugaugccagagac

SEQ ID NO: 1180622 - RNA, 20 nt, Human
aaauggagcugccaagaacc

SEQ ID NO: 1180623 - RNA, 18 nt, Human
aacaagucuuccggauca

SEQ ID NO: 1180624 - RNA, 22 nt, Human
aaccauaucacuuaccaaggcc

SEQ ID NO: 1180625 - RNA, 19 nt, Human
aaccccagggcccaggcau

SEQ ID NO: 1180626 - RNA, 20 nt, Human
aaccccagggcccaggcauc

SEQ ID NO: 1180627 - RNA, 25 nt, Human
aagaaaaagaaggaugccaugaaga

SEQ ID NO: 1180628 - RNA, 21 nt, Human
aagaccacaggaagaccacca

SEQ ID NO: 1180629 - RNA, 24 nt, Human
aagagaaagagauucaugcaagag

SEQ ID NO: 1180630 - RNA, 19 nt, Human
aauucaagaugagauuugg

SEQ ID NO: 1180631 - RNA, 21 nt, Human
accauggaauguauauggcac

SEQ ID NO: 1180632 - RNA, 24 nt, Human
accgaccucucuaacccuuccccu

SEQ ID NO: 1180633 - RNA, 20 nt, Human
accuugcaaaccucauaguc

SEQ ID NO: 1180634 - RNA, 22 nt, Human
acugggucccucccacaacagu

SEQ ID NO: 1180635 - RNA, 21 nt, Human
acuuagaaauguuuguggaau

SEQ ID NO: 1180636 - RNA, 21 nt, Human
agaaauuacugaagauggugu

SEQ ID NO: 1180637 - RNA, 24 nt, Human
agaacagcagcaugggguaaucac

SEQ ID NO: 1180638 - RNA, 24 nt, Human
agacauuuaagaucauugacaaug

SEQ ID NO: 1180639 - RNA, 18 nt, Human
agagccagugauggcaga

SEQ ID NO: 1180640 - RNA, 20 nt, Human
agaguuuuguacuugugcug

SEQ ID NO: 1180641 - RNA, 19 nt, Human
agcacgugcugcaggcagg

SEQ ID NO: 1180642 - RNA, 19 nt, Human
agccccuggcuucauccag

SEQ ID NO: 1180643 - RNA, 22 nt, Human
agccccuggcuucauccagccu

SEQ ID NO: 1180644 - RNA, 20 nt, Human
aggcaagagagaagugccga

SEQ ID NO: 1180645 - RNA, 21 nt, Human
agugauggcagaagggaggaa

SEQ ID NO: 1180646 - RNA, 23 nt, Human
aguggaggggaagggaagaccac

SEQ ID NO: 1180647 - RNA, 24 nt, Human
aucuccagcuucccggaauccugg

SEQ ID NO: 1180648 - RNA, 26 nt, Human
augcugcccuggaguagacuagcugg

SEQ ID NO: 1180649 - RNA, 21 nt, Human
auuuggguggggacacagcca

SEQ ID NO: 1180650 - RNA, 30 nt, Human
auuuugucuaaaauagcccuucccucucaa

SEQ ID NO: 1180651 - RNA, 19 nt, Human
caagaagcaaucuccaaac

SEQ ID NO: 1180652 - RNA, 22 nt, Human
caagaucaaagugucagcaugg

SEQ ID NO: 1180653 - RNA, 21 nt, Human
caagguaccaagggucagcca

SEQ ID NO: 1180654 - RNA, 20 nt, Human
caaugaucuucaguccuucu

SEQ ID NO: 1180655 - RNA, 22 nt, Human
caccagcuggaugcugcccugg

SEQ ID NO: 1180656 - RNA, 19 nt, Human
cacugcccucucaggucac

SEQ ID NO: 1180657 - RNA, 21 nt, Human
cagcaugggguaaucaccccc

SEQ ID NO: 1180658 - RNA, 21 nt, Human
cagcauuguagaggguguuac

SEQ ID NO: 1180659 - RNA, 27 nt, Human
cagccaagaagcaaucuccaaacuuau

SEQ ID NO: 1180660 - RNA, 20 nt, Human
cagcuggaugcugcccugga

SEQ ID NO: 1180661 - RNA, 21 nt, Human
caguauacucugcccaccaac

SEQ ID NO: 1180662 - RNA, 19 nt, Human
cauaguguugggucugggc

SEQ ID NO: 1180663 - RNA, 22 nt, Human
caucccauccagauaucauccc

SEQ ID NO: 1180664 - RNA, 18 nt, Human
caucucucucucucugcu

SEQ ID NO: 1180665 - RNA, 19 nt, Human
caugcaaacaacagaaguu

SEQ ID NO: 1180666 - RNA, 21 nt, Human
caugcaaacaacagaaguuua

SEQ ID NO: 1180667 - RNA, 22 nt, Human
cauggagacuggugcgccacug

SEQ ID NO: 1180668 - RNA, 18 nt, Human
caugucuuagagcuggaa

SEQ ID NO: 1180669 - RNA, 22 nt, Human
cauuaccucccaauggcuuuac

SEQ ID NO: 1180670 - RNA, 25 nt, Human
cauuaccucccaauggcuuuaccuc

SEQ ID NO: 1180671 - RNA, 21 nt, Human
cauugcacugaguauuuuugc

SEQ ID NO: 1180672 - RNA, 19 nt, Human
ccaagaucaaagugucagc

SEQ ID NO: 1180673 - RNA, 21 nt, Human
ccaauggaaaaagaaaaagaa

SEQ ID NO: 1180674 - RNA, 22 nt, Human
ccauagccccuggcuucaucca

SEQ ID NO: 1180675 - RNA, 20 nt, Human
ccauugcacugaguauuuuu

SEQ ID NO: 1180676 - RNA, 20 nt, Human
cccagagcuaugggaacgug

SEQ ID NO: 1180677 - RNA, 21 nt, Human
cccauccuucagacucaucca

SEQ ID NO: 1180678 - RNA, 21 nt, Human
ccccagggcccaggcauccca

SEQ ID NO: 1180679 - RNA, 24 nt, Human
ccccuggcuucauccagccucacc

SEQ ID NO: 1180680 - RNA, 20 nt, Human
ccccuguaggagcacuuacu

SEQ ID NO: 1180681 - RNA, 22 nt, Human
cccggaauccugggccccucua

SEQ ID NO: 1180682 - RNA, 23 nt, Human
ccuaauccuaacacauaguagau

SEQ ID NO: 1180683 - RNA, 22 nt, Human
ccucacaaucauggcagaagga

SEQ ID NO: 1180684 - RNA, 19 nt, Human
ccucucuaacccuuccccu

SEQ ID NO: 1180685 - RNA, 22 nt, Human
ccucugcucuggagauaaaggc

SEQ ID NO: 1180686 - RNA, 21 nt, Human
ccugcuauaucccuaacacca

SEQ ID NO: 1180687 - RNA, 23 nt, Human
ccuucagacucauccagguucau

SEQ ID NO: 1180688 - RNA, 19 nt, Human
cuaaaauagcccuucccuc

SEQ ID NO: 1180689 - RNA, 23 nt, Human
cuaccgaccucucuaacccuucc

SEQ ID NO: 1180690 - RNA, 23 nt, Human
cuauaugugcuaucucuuuuccu

SEQ ID NO: 1180691 - RNA, 19 nt, Human
cucagcauuguagagggug

SEQ ID NO: 1180692 - RNA, 18 nt, Human
cuccaaaaaauggagaag

SEQ ID NO: 1180693 - RNA, 20 nt, Human
cuccuucuucuuugaacucc

SEQ ID NO: 1180694 - RNA, 19 nt, Human
cucuggaacccugaaguuc

SEQ ID NO: 1180695 - RNA, 18 nt, Human
cugaugccagagacugac

SEQ ID NO: 1180696 - RNA, 19 nt, Human
cuggaacccugaaguuccc

SEQ ID NO: 1180697 - RNA, 23 nt, Human
cuuagagcuggaaucuccagcuu

SEQ ID NO: 1180698 - RNA, 25 nt, Human
cuucagacucauccagguucauucc

SEQ ID NO: 1180699 - RNA, 22 nt, Human
cuucccauugcuuucaaaggga

SEQ ID NO: 1180700 - RNA, 26 nt, Human
cuuccccuauuaacccuucuccaaaa

SEQ ID NO: 1180701 - RNA, 23 nt, Human
cuuugcagucacucucuccuuca

SEQ ID NO: 1180702 - RNA, 20 nt, Human
gaccucucuaacccuucccc

SEQ ID NO: 1180703 - RNA, 19 nt, Human
gacuggugcgccacugccc

SEQ ID NO: 1180704 - RNA, 22 nt, Human
gcaugagcuggcugcaguugca

SEQ ID NO: 1180705 - RNA, 19 nt, Human
gcccuagaaacuuuggucu

SEQ ID NO: 1180706 - RNA, 20 nt, Human
gcucaagucuucacucccaa

SEQ ID NO: 1180707 - RNA, 21 nt, Human
ggaauccugggccccucuacc

SEQ ID NO: 1180708 - RNA, 20 nt, Human
ggacgcagccaaauggagcu

SEQ ID NO: 1180709 - RNA, 21 nt, Human
ggagaucagcacgugcugcag

SEQ ID NO: 1180710 - RNA, 19 nt, Human
gggaagaccacaggaagac

SEQ ID NO: 1180711 - RNA, 22 nt, Human
gggaagaccacaggaagaccac

SEQ ID NO: 1180712 - RNA, 24 nt, Human
gugaaaacucgcucacugucauga

SEQ ID NO: 1180713 - RNA, 24 nt, Human
uaaacaucauauucccagagcuaa

SEQ ID NO: 1180714 - RNA, 21 nt, Human
uaaagacagcaagggagaggc

SEQ ID NO: 1180715 - RNA, 23 nt, Human
uaaagagaggacaagagccagug

SEQ ID NO: 1180716 - RNA, 19 nt, Human
uaaguugaaggcacagcau

SEQ ID NO: 1180717 - RNA, 18 nt, Human
uacaauagcaugucuuag

SEQ ID NO: 1180718 - RNA, 19 nt, Human
uaccaaggccuuacaugau

SEQ ID NO: 1180719 - RNA, 26 nt, Human
uacccaguauacucugcccaccaaca

SEQ ID NO: 1180720 - RNA, 20 nt, Human
uagaacaagguaccaagggu

SEQ ID NO: 1180721 - RNA, 21 nt, Human
uagaacaagguaccaaggguc

SEQ ID NO: 1180722 - RNA, 22 nt, Human
uagagcuggaaucuccagcuuc

SEQ ID NO: 1180723 - RNA, 20 nt, Human
uagccccuggcuucauccag

SEQ ID NO: 1180724 - RNA, 23 nt, Human
uauaaaaccaucagaucucguga

SEQ ID NO: 1180725 - RNA, 24 nt, Human
uaucacuuaccaaggccuuacaug

SEQ ID NO: 1180726 - RNA, 18 nt, Human
uauuccugagaacuccac

SEQ ID NO: 1180727 - RNA, 20 nt, Human
ucaagggcuugguggagagu

SEQ ID NO: 1180728 - RNA, 23 nt, Human
ucaaucagauuagaccaauggaa

SEQ ID NO: 1180729 - RNA, 20 nt, Human
ucacaguucuacaugggugg

SEQ ID NO: 1180730 - RNA, 24 nt, Human
ucacccccaugauucaauuaucuc

SEQ ID NO: 1180731 - RNA, 23 nt, Human
ucacuaagguuucagacccucug

SEQ ID NO: 1180732 - RNA, 21 nt, Human
ucagaucucuguuuaaacauc

SEQ ID NO: 1180733 - RNA, 20 nt, Human
ucaugagaacagcagcaugg

SEQ ID NO: 1180734 - RNA, 18 nt, Human
uccaaaaaauggagaagc

SEQ ID NO: 1180735 - RNA, 21 nt, Human
uccaaccuggccacuacuucu

SEQ ID NO: 1180736 - RNA, 19 nt, Human
uccacccucauuaccuccc

SEQ ID NO: 1180737 - RNA, 21 nt, Human
uccauuucugcuccuucuucu

SEQ ID NO: 1180738 - RNA, 19 nt, Human
uccccaguugcagauaucu

SEQ ID NO: 1180739 - RNA, 25 nt, Human
uccccuauuaacccuucuccaaaaa

SEQ ID NO: 1180740 - RNA, 18 nt, Human
ucccggaauccugggccc

SEQ ID NO: 1180741 - RNA, 20 nt, Human
uccuaacacauaguagauua

SEQ ID NO: 1180742 - RNA, 21 nt, Human
uccuauuccugagaacuccac

SEQ ID NO: 1180743 - RNA, 23 nt, Human
uccugggccccucuaccgaccuc

SEQ ID NO: 1180744 - RNA, 19 nt, Human
uccuugagcauuuugucua

SEQ ID NO: 1180745 - RNA, 22 nt, Human
ucucaggucaccagcuggaugc

SEQ ID NO: 1180746 - RNA, 18 nt, Human
ucucucaucucucucucu

SEQ ID NO: 1180747 - RNA, 19 nt, Human
ucucugcucacucucuccu

SEQ ID NO: 1180748 - RNA, 19 nt, Human
ucucuguuuaaacaucaua

SEQ ID NO: 1180749 - RNA, 21 nt, Human
ucuggaacccugaaguuccca

SEQ ID NO: 1180750 - RNA, 21 nt, Human
ucugucucgacgucuuucucc

SEQ ID NO: 1180751 - RNA, 24 nt, Human
ucugucuugaggcuacaauagcau

SEQ ID NO: 1180752 - RNA, 21 nt, Human
ucuuauucaccucuuugcuca

SEQ ID NO: 1180753 - RNA, 19 nt, Human
ugaaggagcaguuagacuu

SEQ ID NO: 1180754 - RNA, 18 nt, Human
ugaaggcaugagcuggcu

SEQ ID NO: 1180755 - RNA, 18 nt, Human
ugacagugaacuucaccu

SEQ ID NO: 1180756 - RNA, 19 nt, Human
ugacucaaugagugaacaa

SEQ ID NO: 1180757 - RNA, 22 nt, Human
ugagauuuggguggggacacag

SEQ ID NO: 1180758 - RNA, 23 nt, Human
ugagcuggugaaggagcaguuag

SEQ ID NO: 1180759 - RNA, 18 nt, Human
ugaguauuuuugcuucuu

SEQ ID NO: 1180760 - RNA, 18 nt, Human
ugccaagaaccagagaaa

SEQ ID NO: 1180761 - RNA, 23 nt, Human
ugcuaagaaagacauaucugaga

SEQ ID NO: 1180762 - RNA, 19 nt, Human
uggaaaaagaaaaagaagg

SEQ ID NO: 1180763 - RNA, 23 nt, Human
uggaaaggaucugaugccagaga

SEQ ID NO: 1180764 - RNA, 19 nt, Human
uggaauguauauggcacuu

SEQ ID NO: 1180765 - RNA, 24 nt, Human
uggagaagcuaaguugaaggcaca

SEQ ID NO: 1180766 - RNA, 24 nt, Human
uggaggggaagggaagaccacagg

SEQ ID NO: 1180767 - RNA, 19 nt, Human
uggcaugcuggcuucuucu

SEQ ID NO: 1180768 - RNA, 18 nt, Human
uggcuucccauugcuuuc

SEQ ID NO: 1180769 - RNA, 24 nt, Human
ugggucccucccacaacaguggga

SEQ ID NO: 1180770 - RNA, 20 nt, Human
ugggucugggcuggguugca

SEQ ID NO: 1180771 - RNA, 22 nt, Human
ugggugagcuggugaaggagca

SEQ ID NO: 1180772 - RNA, 19 nt, Human
uuagaaauguuuguggaau

SEQ ID NO: 1180773 - RNA, 22 nt, Human
uucaaagggaagggcaaauguc

SEQ ID NO: 1180774 - RNA, 24 nt, Human
uucaagaugagauuugggugggga

SEQ ID NO: 1180775 - RNA, 22 nt, Human
uucccagagcuaugggaacgug

SEQ ID NO: 1180776 - RNA, 20 nt, Human
uucccauugcuuucaaaggg

SEQ ID NO: 1180777 - RNA, 20 nt, Human
aaaaccugagauugugaaga

SEQ ID NO: 1180778 - RNA, 24 nt, Human
aaaggagaaauguugaacagagag

SEQ ID NO: 1180779 - RNA, 24 nt, Human
aaagugcugggauuacagguguga

SEQ ID NO: 1180780 - RNA, 27 nt, Human
aaccucuuuaagacucugucuuuguca

SEQ ID NO: 1180781 - RNA, 21 nt, Human
aagaaugauccagccccaaau

SEQ ID NO: 1180782 - RNA, 23 nt, Human
aagcagucuucccgucucagacu

SEQ ID NO: 1180783 - RNA, 25 nt, Human
aagugauccucccaccucagccucc

SEQ ID NO: 1180784 - RNA, 18 nt, Human
aagugcugggauuacagg

SEQ ID NO: 1180785 - RNA, 19 nt, Human
aagugcugggauuacaggu

SEQ ID NO: 1180786 - RNA, 22 nt, Human
aauagugcugaaagugagagac

SEQ ID NO: 1180787 - RNA, 18 nt, Human
accacaccuggcuaauuu

SEQ ID NO: 1180788 - RNA, 24 nt, Human
acccugauuccaucuuagagauca

SEQ ID NO: 1180789 - RNA, 23 nt, Human
accucagccucccgaguagcuga

SEQ ID NO: 1180790 - RNA, 19 nt, Human
acggagcaguaaguacaga

SEQ ID NO: 1180791 - RNA, 24 nt, Human
acucuauccagccucaacuguuuu

SEQ ID NO: 1180792 - RNA, 18 nt, Human
acugcagccucuaccucc

SEQ ID NO: 1180793 - RNA, 22 nt, Human
agcaucuguugcucuaggcaac

SEQ ID NO: 1180794 - RNA, 18 nt, Human
aggcaaggucuugcuacg

SEQ ID NO: 1180795 - RNA, 23 nt, Human
aggcaaggucuugcuacguugcc

SEQ ID NO: 1180796 - RNA, 22 nt, Human
aguacagaguucuggagaggga

SEQ ID NO: 1180797 - RNA, 23 nt, Human
aguagcugagaccacaggcaugu

SEQ ID NO: 1180798 - RNA, 20 nt, Human
agugcaguggugcgaucccg

SEQ ID NO: 1180799 - RNA, 23 nt, Human
agugcaguggugcgaucccggcu

SEQ ID NO: 1180800 - RNA, 24 nt, Human
agugcaguggugcgaucccggcuc

SEQ ID NO: 1180801 - RNA, 20 nt, Human
agugcugggauuacaggugu

SEQ ID NO: 1180802 - RNA, 24 nt, Human
aucacuuugcaauaaaaccugagg

SEQ ID NO: 1180803 - RNA, 24 nt, Human
caaagugcugggauuacaggugug

SEQ ID NO: 1180804 - RNA, 24 nt, Human
caaggucuugcuacguugcccagg

SEQ ID NO: 1180805 - RNA, 20 nt, Human
caagugauccucccaccuca

SEQ ID NO: 1180806 - RNA, 27 nt, Human
caagugauccucccaccucagccuccc

SEQ ID NO: 1180807 - RNA, 19 nt, Human
caaucucugguuucuuugc

SEQ ID NO: 1180808 - RNA, 20 nt, Human
cacauauuuaugaaaaugcc

SEQ ID NO: 1180809 - RNA, 26 nt, Human
caccuguagcugucaccucugugcca

SEQ ID NO: 1180810 - RNA, 23 nt, Human
cacugcagccucuaccuccuggg

SEQ ID NO: 1180811 - RNA, 21 nt, Human
cacuuugcaauaaaaccugag

SEQ ID NO: 1180812 - RNA, 20 nt, Human
cagccucuaccuccuggguu

SEQ ID NO: 1180813 - RNA, 23 nt, Human
cagccucuaccuccuggguucaa

SEQ ID NO: 1180814 - RNA, 19 nt, Human
cagggcuuuucagccaggg

SEQ ID NO: 1180815 - RNA, 18 nt, Human
cagugcaccuguguuugg

SEQ ID NO: 1180816 - RNA, 19 nt, Human
cagugcaccuguguuuggg

SEQ ID NO: 1180817 - RNA, 20 nt, Human
cauccaagcacacuuggcca

SEQ ID NO: 1180818 - RNA, 21 nt, Human
caugaagaaaaggcagacuca

SEQ ID NO: 1180819 - RNA, 24 nt, Human
cauuuucaauugauucauuggggg

SEQ ID NO: 1180820 - RNA, 21 nt, Human
ccaaagugcugggauuacagg

SEQ ID NO: 1180821 - RNA, 21 nt, Human
ccaaagugcugggauuacagg

SEQ ID NO: 1180822 - RNA, 24 nt, Human
ccaaagugcugggauuacaggugu

SEQ ID NO: 1180823 - RNA, 23 nt, Human
ccaccucagccucccgaguagcu

SEQ ID NO: 1180824 - RNA, 23 nt, Human
cccaccucagccucccgaguagc

SEQ ID NO: 1180825 - RNA, 19 nt, Human
cccaggcuggagugcagug

SEQ ID NO: 1180826 - RNA, 21 nt, Human
cccccagagaacacguggcca

SEQ ID NO: 1180827 - RNA, 22 nt, Human
cccccagagaacacguggccau

SEQ ID NO: 1180828 - RNA, 20 nt, Human
ccccccagagaacacguggc

SEQ ID NO: 1180829 - RNA, 18 nt, Human
cccuggagagcaggaugg

SEQ ID NO: 1180830 - RNA, 21 nt, Human
ccuacaaugccccggacaacu

SEQ ID NO: 1180831 - RNA, 24 nt, Human
ccuccuggguucaagugauccucc

SEQ ID NO: 1180832 - RNA, 22 nt, Human
ccucuaccuccuggguucaagu

SEQ ID NO: 1180833 - RNA, 21 nt, Human
ccucugugcuauaguacugcu

SEQ ID NO: 1180834 - RNA, 22 nt, Human
ccuggguucaagugauccuccc

SEQ ID NO: 1180835 - RNA, 19 nt, Human
cggcuggaggagguggugc

SEQ ID NO: 1180836 - RNA, 23 nt, Human
cuaagcauccuacaaugccccuc

SEQ ID NO: 1180837 - RNA, 24 nt, Human
cucacugcagccucuaccuccugg

SEQ ID NO: 1180838 - RNA, 19 nt, Human
cucagcaucuuuuaacuca

SEQ ID NO: 1180839 - RNA, 20 nt, Human
cucugugcuauaguacugcu

SEQ ID NO: 1180840 - RNA, 18 nt, Human
cugcccggaacauggcgg

SEQ ID NO: 1180841 - RNA, 25 nt, Human
cuucagggcuuuucagccagggggu

SEQ ID NO: 1180842 - RNA, 21 nt, Human
gaagaaaaggcagacucauua

SEQ ID NO: 1180843 - RNA, 24 nt, Human
gagaggaccucauuuuuauaacuc

SEQ ID NO: 1180844 - RNA, 19 nt, Human
gaguaaucccaaagugcug

SEQ ID NO: 1180845 - RNA, 27 nt, Human
gaguagcugagaccacaggcauguauu

SEQ ID NO: 1180846 - RNA, 18 nt, Human
gauuacaggugugaguca

SEQ ID NO: 1180847 - RNA, 20 nt, Human
gauuacaggugugagucacu

SEQ ID NO: 1180848 - RNA, 23 nt, Human
gauuacaggugugagucacucua

SEQ ID NO: 1180849 - RNA, 20 nt, Human
gauuuugccccccagagaac

SEQ ID NO: 1180850 - RNA, 18 nt, Human
gcaacaucgaugggaguu

SEQ ID NO: 1180851 - RNA, 19 nt, Human
gcccaggcuggagugcagu

SEQ ID NO: 1180852 - RNA, 20 nt, Human
gcccaggcuggagugcagug

SEQ ID NO: 1180853 - RNA, 23 nt, Human
gcccaggcuggagugcaguggug

SEQ ID NO: 1180854 - RNA, 21 nt, Human
gcuaauuuuuucccuuuuucu

SEQ ID NO: 1180855 - RNA, 24 nt, Human
gcuacguugcccaggcuggucuug

SEQ ID NO: 1180856 - RNA, 21 nt, Human
gcucacugcagccucuaccuc

SEQ ID NO: 1180857 - RNA, 23 nt, Human
gcuggaggagguggugcuacugg

SEQ ID NO: 1180858 - RNA, 20 nt, Human
ggaaauguguagucuuugag

SEQ ID NO: 1180859 - RNA, 22 nt, Human
ggaggaacuuuauuucuggcca

SEQ ID NO: 1180860 - RNA, 21 nt, Human
ggcaaggucuugcuacguugc

SEQ ID NO: 1180861 - RNA, 20 nt, Human
ggcuggucuugaacuccuga

SEQ ID NO: 1180862 - RNA, 19 nt, Human
gucucaaucucugguuucu

SEQ ID NO: 1180863 - RNA, 24 nt, Human
gugauccucccaccucagccuccc

SEQ ID NO: 1180864 - RNA, 22 nt, Human
uaagacaaaagaaugauccagc

SEQ ID NO: 1180865 - RNA, 18 nt, Human
uaaucccaaagugcuggg

SEQ ID NO: 1180866 - RNA, 21 nt, Human
uacagaguucuggagagggaa

SEQ ID NO: 1180867 - RNA, 22 nt, Human
uaccauuugugcaaguugugca

SEQ ID NO: 1180868 - RNA, 24 nt, Human
uaccuccuggguucaagugauccu

SEQ ID NO: 1180869 - RNA, 23 nt, Human
uacguugcccaggcuggucuuga

SEQ ID NO: 1180870 - RNA, 24 nt, Human
uacguugcccaggcuggucuugaa

SEQ ID NO: 1180871 - RNA, 21 nt, Human
uagagaucauccaagcacacu

SEQ ID NO: 1180872 - RNA, 22 nt, Human
uagaggcaaggucuugcuacgu

SEQ ID NO: 1180873 - RNA, 18 nt, Human
uagcccaggcuggagugc

SEQ ID NO: 1180874 - RNA, 23 nt, Human
uaguacugcuuuuuuuuuuccuu

SEQ ID NO: 1180875 - RNA, 18 nt, Human
uaugucuuuacuucaggg

SEQ ID NO: 1180876 - RNA, 23 nt, Human
ucaagaaaggagaaauguugaaa

SEQ ID NO: 1180877 - RNA, 24 nt, Human
ucacugcagccucuaccuccuggg

SEQ ID NO: 1180878 - RNA, 25 nt, Human
ucacugcagccucuaccuccugggu

SEQ ID NO: 1180879 - RNA, 18 nt, Human
ucagcagcguugucccug

SEQ ID NO: 1180880 - RNA, 26 nt, Human
ucagugcaccuguguuuggggcuuug

SEQ ID NO: 1180881 - RNA, 23 nt, Human
ucccaaagugcugggauuacagg

SEQ ID NO: 1180882 - RNA, 24 nt, Human
ucccaugaagaaaaggcagacuca

SEQ ID NO: 1180883 - RNA, 24 nt, Human
ucccgaguagcugagaccacaggc

SEQ ID NO: 1180884 - RNA, 19 nt, Human
ucccuggagagcaggaugg

SEQ ID NO: 1180885 - RNA, 26 nt, Human
uccucccaccucagccucccgaguag

SEQ ID NO: 1180886 - RNA, 20 nt, Human
uccugaguucaagcagucuu

SEQ ID NO: 1180887 - RNA, 21 nt, Human
uccuggguucaagugauccuc

SEQ ID NO: 1180888 - RNA, 24 nt, Human
uccuggguucaagugauccuccca

SEQ ID NO: 1180889 - RNA, 23 nt, Human
ucucugguuucuuugcucagugc

SEQ ID NO: 1180890 - RNA, 19 nt, Human
ucuguagcccaggcuggag

SEQ ID NO: 1180891 - RNA, 20 nt, Human
ucuguagcccaggcuggagu

SEQ ID NO: 1180892 - RNA, 24 nt, Human
ucuguagcccaggcuggagugcag

SEQ ID NO: 1180893 - RNA, 24 nt, Human
ucuugaacuccugaguucaagcag

SEQ ID NO: 1180894 - RNA, 23 nt, Human
ucuugcuacguugcccaggcugg

SEQ ID NO: 1180895 - RNA, 24 nt, Human
ucuugcuacguugcccaggcuggu

SEQ ID NO: 1180896 - RNA, 19 nt, Human
ugaacagagaggaccucau

SEQ ID NO: 1180897 - RNA, 24 nt, Human
ugaacuccugaguucaagcagucu

SEQ ID NO: 1180898 - RNA, 20 nt, Human
ugaagaaaaggcagacucau

SEQ ID NO: 1180899 - RNA, 23 nt, Human
ugacgggauuucuuuaguuucug

SEQ ID NO: 1180900 - RNA, 24 nt, Human
ugagaccacaggcauguauuacca

SEQ ID NO: 1180901 - RNA, 23 nt, Human
ugagggaaugucauuuugucuca

SEQ ID NO: 1180902 - RNA, 21 nt, Human
ugaguucaagcagucuucccg

SEQ ID NO: 1180903 - RNA, 19 nt, Human
ugccaccccgggaguugca

SEQ ID NO: 1180904 - RNA, 24 nt, Human
ugcccaggcuggucuugaacuccu

SEQ ID NO: 1180905 - RNA, 27 nt, Human
ugcccaggcuggucuugaacuccugag

SEQ ID NO: 1180906 - RNA, 18 nt, Human
ugccccggacaacuccca

SEQ ID NO: 1180907 - RNA, 22 nt, Human
ugcccggaacauggcgguaaga

SEQ ID NO: 1180908 - RNA, 24 nt, Human
ugcuacguugcccaggcuggucuu

SEQ ID NO: 1180909 - RNA, 27 nt, Human
ugcuacguugcccaggcuggucuugaa

SEQ ID NO: 1180910 - RNA, 24 nt, Human
ugcugggauuacaggugugaguca

SEQ ID NO: 1180911 - RNA, 18 nt, Human
uggagacaauuuuggugg

SEQ ID NO: 1180912 - RNA, 24 nt, Human
uggagugcaguggugcgaucccgg

SEQ ID NO: 1180913 - RNA, 22 nt, Human
uggcaacaucgaugggaguuuu

SEQ ID NO: 1180914 - RNA, 23 nt, Human
uggcuaauuuuuucccuuuuucu

SEQ ID NO: 1180915 - RNA, 18 nt, Human
ugggauuacaggugugag

SEQ ID NO: 1180916 - RNA, 18 nt, Human
ugggauuacaggugugag

SEQ ID NO: 1180917 - RNA, 21 nt, Human
ugggauuacaggugugaguca

SEQ ID NO: 1180918 - RNA, 22 nt, Human
ugggauuacaggugugagucac

SEQ ID NO: 1180919 - RNA, 22 nt, Human
ugggauuacaggugugagucac

SEQ ID NO: 1180920 - RNA, 23 nt, Human
ugggauuacaggugugagucacu

SEQ ID NO: 1180921 - RNA, 25 nt, Human
ugggauuacaggugugagucacucu

SEQ ID NO: 1180922 - RNA, 23 nt, Human
uggguucaagugauccucccacc

SEQ ID NO: 1180923 - RNA, 24 nt, Human
uggguucaagugauccucccaccu

SEQ ID NO: 1180924 - RNA, 24 nt, Human
uggugcgaucccggcucacugcag

SEQ ID NO: 1180925 - RNA, 19 nt, Human
ugguugcggcuggaggagg

SEQ ID NO: 1180926 - RNA, 18 nt, Human
ugucccuggagagcagga

SEQ ID NO: 1180927 - RNA, 23 nt, Human
uucaagugauccucccaccucag

SEQ ID NO: 1180928 - RNA, 24 nt, Human
uucaagugauccucccaccucagc

SEQ ID NO: 1180929 - RNA, 18 nt, Human
uucauugucauuaccagu

SEQ ID NO: 1180930 - RNA, 21 nt, Human
uuggaaauguguagucuuuga

SEQ ID NO: 1180931 - RNA, 23 nt, Human
uuggugguugcggcuggaggagg

SEQ ID NO: 1180932 - RNA, 19 nt, Human
uugucccuggagagcagga

SEQ ID NO: 1180933 - RNA, 21 nt, Human
uuuccuuucucuuucuccacc

SEQ ID NO: 1180934 - RNA, 24 nt, Human
uuuucagccagggggugauuuugc

SEQ ID NO: 1180935 - RNA, 23 nt, Human
uuuuucagcagcguugucccugg

SEQ ID NO: 1180936 - RNA, 20 nt, Human
aaggagccccugccaccugc

SEQ ID NO: 1180937 - RNA, 24 nt, Human
acagaagcgccacagccggggagc

SEQ ID NO: 1180938 - RNA, 26 nt, Human
agagucccugcaucugcucccugccu

SEQ ID NO: 1180939 - RNA, 20 nt, Human
agcuccagcgucuguuuucu

SEQ ID NO: 1180940 - RNA, 18 nt, Human
agcuguguguggcggcug

SEQ ID NO: 1180941 - RNA, 18 nt, Human
aggaggaggaaaccugaa

SEQ ID NO: 1180942 - RNA, 19 nt, Human
aggcagagucccugcaucu

SEQ ID NO: 1180943 - RNA, 22 nt, Human
aggcagagucccugcaucugcu

SEQ ID NO: 1180944 - RNA, 22 nt, Human
aggguucccuaacuuuucccuu

SEQ ID NO: 1180945 - RNA, 21 nt, Human
agucaucuagagagcaaauac

SEQ ID NO: 1180946 - RNA, 22 nt, Human
auccacagaagcgccacagccg

SEQ ID NO: 1180947 - RNA, 18 nt, Human
auccaucuucagaguuuc

SEQ ID NO: 1180948 - RNA, 25 nt, Human
augaggcagagucccugcaucugcu

SEQ ID NO: 1180949 - RNA, 23 nt, Human
augauccaucuucagaguuucuc

SEQ ID NO: 1180950 - RNA, 23 nt, Human
caacacaccuguuuacaaaggca

SEQ ID NO: 1180951 - RNA, 18 nt, Human
cacugcaggucagaaucg

SEQ ID NO: 1180952 - RNA, 22 nt, Human
cagacuucucugacacaugagg

SEQ ID NO: 1180953 - RNA, 20 nt, Human
cagagcccaguuuucgaggc

SEQ ID NO: 1180954 - RNA, 23 nt, Human
cagcccgaggccagcuggcugca

SEQ ID NO: 1180955 - RNA, 27 nt, Human
cagggugcacacaucccugcaggucuc

SEQ ID NO: 1180956 - RNA, 20 nt, Human
caucauggcuggccgcuggg

SEQ ID NO: 1180957 - RNA, 19 nt, Human
cauguuugcagcccgaggc

SEQ ID NO: 1180958 - RNA, 19 nt, Human
ccacaguccccuccaaguc

SEQ ID NO: 1180959 - RNA, 26 nt, Human
ccaccgucaauuggaccgcacccgcc

SEQ ID NO: 1180960 - RNA, 21 nt, Human
cccacauccacagaagcgcca

SEQ ID NO: 1180961 - RNA, 20 nt, Human
ccccagcucaccucccugga

SEQ ID NO: 1180962 - RNA, 24 nt, Human
cccgccauguuugcagcccgaggc

SEQ ID NO: 1180963 - RNA, 21 nt, Human
ccggaagagcacucugagagg

SEQ ID NO: 1180964 - RNA, 18 nt, Human
ccugaaucggagccuggg

SEQ ID NO: 1180965 - RNA, 18 nt, Human
ccuggucugaagcugaga

SEQ ID NO: 1180966 - RNA, 23 nt, Human
cgccauguuugcagcccgaggcc

SEQ ID NO: 1180967 - RNA, 22 nt, Human
cgggagcuggaggccaaggagc

SEQ ID NO: 1180968 - RNA, 21 nt, Human
cuccagggcccccagcucacc

SEQ ID NO: 1180969 - RNA, 22 nt, Human
cuccagggcccccagcucaccu

SEQ ID NO: 1180970 - RNA, 26 nt, Human
cuccagggcccccagcucaccucccu

SEQ ID NO: 1180971 - RNA, 18 nt, Human
cuccucagucccacaguc

SEQ ID NO: 1180972 - RNA, 20 nt, Human
cucucugcucugcgcuccuc

SEQ ID NO: 1180973 - RNA, 19 nt, Human
cucugagcgaggaagacuc

SEQ ID NO: 1180974 - RNA, 22 nt, Human
cucuuggcuccuggucugaagc

SEQ ID NO: 1180975 - RNA, 23 nt, Human
cugaggaggaggaaaccugaagg

SEQ ID NO: 1180976 - RNA, 18 nt, Human
cugcucccugccuggccu

SEQ ID NO: 1180977 - RNA, 20 nt, Human
cuggucugaagcugagauug

SEQ ID NO: 1180978 - RNA, 21 nt, Human
gaaucucuggcacggaagcuu

SEQ ID NO: 1180979 - RNA, 18 nt, Human
gaccauauuuacucuacc

SEQ ID NO: 1180980 - RNA, 21 nt, Human
gacgccgggcaccugggcggg

SEQ ID NO: 1180981 - RNA, 22 nt, Human
gagcaaauacacaguaauuccc

SEQ ID NO: 1180982 - RNA, 20 nt, Human
gagcacucugagaggcuggg

SEQ ID NO: 1180983 - RNA, 21 nt, Human
gaggcugaggaaagaccccga

SEQ ID NO: 1180984 - RNA, 22 nt, Human
gcagugggcaggcaaggucugc

SEQ ID NO: 1180985 - RNA, 19 nt, Human
gcggcuggugggccgggcu

SEQ ID NO: 1180986 - RNA, 18 nt, Human
gcucaccucccuggaugg

SEQ ID NO: 1180987 - RNA, 22 nt, Human
ggccaccuuuuaauuggaccau

SEQ ID NO: 1180988 - RNA, 20 nt, Human
gggcacagcggaagggcugc

SEQ ID NO: 1180989 - RNA, 19 nt, Human
gggcaggucucuuggcucc

SEQ ID NO: 1180990 - RNA, 23 nt, Human
gguuuugugaccgccuuuuucag

SEQ ID NO: 1180991 - RNA, 18 nt, Human
gucauggccaugauccau

SEQ ID NO: 1180992 - RNA, 24 nt, Human
gucccugcaucugcucccugccug

SEQ ID NO: 1180993 - RNA, 25 nt, Human
guucggugggacacgaacacagggg

SEQ ID NO: 1180994 - RNA, 21 nt, Human
uccagcgucuguuuucuaguc

SEQ ID NO: 1180995 - RNA, 19 nt, Human
ucccacaguccccuccaag

SEQ ID NO: 1180996 - RNA, 21 nt, Human
uccccuccaagucacgggagc

SEQ ID NO: 1180997 - RNA, 23 nt, Human
ucccucaccagaauucaaugagg

SEQ ID NO: 1180998 - RNA, 24 nt, Human
ucccugcaggucucggggcuccug

SEQ ID NO: 1180999 - RNA, 19 nt, Human
uccggaagagcacucugag

SEQ ID NO: 1181000 - RNA, 22 nt, Human
uccuggggguuuugugaccgcc

SEQ ID NO: 1181001 - RNA, 19 nt, Human
ucuccagggcccccagcuc

SEQ ID NO: 1181002 - RNA, 19 nt, Human
ucugaagcugagauuggag

SEQ ID NO: 1181003 - RNA, 19 nt, Human
ucugcucccugccuggccu

SEQ ID NO: 1181004 - RNA, 21 nt, Human
ucuucagaguuucucuuucuu

SEQ ID NO: 1181005 - RNA, 20 nt, Human
ugaccacacccucauguguu

SEQ ID NO: 1181006 - RNA, 23 nt, Human
ugaccacacccucauguguuuuc

SEQ ID NO: 1181007 - RNA, 19 nt, Human
ugagaggcugggccccauc

SEQ ID NO: 1181008 - RNA, 21 nt, Human
ugaggaaagaccccgagagcg

SEQ ID NO: 1181009 - RNA, 19 nt, Human
ugaggaggaggaaaccuga

SEQ ID NO: 1181010 - RNA, 22 nt, Human
ugcaccucucaggguucccuaa

SEQ ID NO: 1181011 - RNA, 18 nt, Human
ugcaggucucggggcucc

SEQ ID NO: 1181012 - RNA, 18 nt, Human
ugccuggccugggcuccc

SEQ ID NO: 1181013 - RNA, 22 nt, Human
ugcggaggcugccggucgacgc

SEQ ID NO: 1181014 - RNA, 22 nt, Human
ugcucugcgcuccucaguccca

SEQ ID NO: 1181015 - RNA, 18 nt, Human
uggaagggacccagucuc

SEQ ID NO: 1181016 - RNA, 23 nt, Human
uggauggcgcuuucggggaucug

SEQ ID NO: 1181017 - RNA, 19 nt, Human
uggcggagguuggagauuc

SEQ ID NO: 1181018 - RNA, 21 nt, Human
uggcugcaggugcaggacuag

SEQ ID NO: 1181019 - RNA, 23 nt, Human
ugggcagugggcaggcaaggucu

SEQ ID NO: 1181020 - RNA, 21 nt, Human
uucaacacaccuguuuacaaa

SEQ ID NO: 1181021 - RNA, 18 nt, Human
uucggagucaccgcacag

SEQ ID NO: 1181022 - RNA, 23 nt, Human
uucucaggagagugaaaugaggg

SEQ ID NO: 1181023 - RNA, 24 nt, Human
uucucugacacaugagggcucuga

SEQ ID NO: 1181024 - RNA, 19 nt, Human
uugugaccgccuuuuucag

SEQ ID NO: 1181025 - RNA, 23 nt, Human
uuuacaaaggcauuccagagccc

SEQ ID NO: 1181026 - RNA, 18 nt, Human
uuucucuuucuuccccac

SEQ ID NO: 1181027 - RNA, 20 nt, Human
uuuuccuggcgcguuuccgg

SEQ ID NO: 1181028 - RNA, 23 nt, Human
uuuuucagggguugacuguuggg

SEQ ID NO: 1181029 - RNA, 21 nt, Human
aaauaacaauuugacaaaagg

SEQ ID NO: 1181030 - RNA, 20 nt, Human
aaggggcagcgacggugcag

SEQ ID NO: 1181031 - RNA, 18 nt, Human
aaggguuaggcagggaag

SEQ ID NO: 1181032 - RNA, 23 nt, Human
acuuagugcagagaggagacgag

SEQ ID NO: 1181033 - RNA, 23 nt, Human
agacaggaaaggguuaggcaggg

SEQ ID NO: 1181034 - RNA, 20 nt, Human
aggcagggaaggggcagcga

SEQ ID NO: 1181035 - RNA, 25 nt, Human
aggcagggaaggggcagcgacggug

SEQ ID NO: 1181036 - RNA, 18 nt, Human
agguacuggcagcaaagc

SEQ ID NO: 1181037 - RNA, 22 nt, Human
cagcgacggugcaggcuggggc

SEQ ID NO: 1181038 - RNA, 19 nt, Human
caugacucaaccaaaaaaa

SEQ ID NO: 1181039 - RNA, 23 nt, Human
caugacucaaccaaaaaaaauuu

SEQ ID NO: 1181040 - RNA, 22 nt, Human
ccagccgggccuggcucuucuu

SEQ ID NO: 1181041 - RNA, 24 nt, Human
ccagguaucccagucaucuguacc

SEQ ID NO: 1181042 - RNA, 21 nt, Human
gaaaacagggaggaccgguac

SEQ ID NO: 1181043 - RNA, 19 nt, Human
gacuuagugcagagaggag

SEQ ID NO: 1181044 - RNA, 21 nt, Human
gaguguggacgggcaacagca

SEQ ID NO: 1181045 - RNA, 19 nt, Human
gcagggaaggggcagcgac

SEQ ID NO: 1181046 - RNA, 19 nt, Human
gugccgcccggcuucugcu

SEQ ID NO: 1181047 - RNA, 26 nt, Human
uagugcagagaggagacgagugugga

SEQ ID NO: 1181048 - RNA, 26 nt, Human
uauauauauuuauauauuuuacaucc

SEQ ID NO: 1181049 - RNA, 19 nt, Human
uccaccgccuucuccgcaa

SEQ ID NO: 1181050 - RNA, 21 nt, Human
uccagguaucccagucaucug

SEQ ID NO: 1181051 - RNA, 21 nt, Human
uccgcagacgccagguacugg

SEQ ID NO: 1181052 - RNA, 22 nt, Human
ucuucuucugcugcagguuugg

SEQ ID NO: 1181053 - RNA, 21 nt, Human
ugcauggaacuggaaaugugu

SEQ ID NO: 1181054 - RNA, 22 nt, Human
ugcgguacugggaagcagacac

SEQ ID NO: 1181055 - RNA, 22 nt, Human
uggggcuuggcucacagaagcu

SEQ ID NO: 1181056 - RNA, 19 nt, Human
uucccagggagacaugggu

SEQ ID NO: 1181057 - RNA, 21 nt, Human
uucuucugcugcagguuuggg

SEQ ID NO: 1181058 - RNA, 19 nt, Human
uucuuuuuuuuuuuucuuu

SEQ ID NO: 1181059 - RNA, 20 nt, Human
uugacaaaagggugaagaaa

SEQ ID NO: 1181060 - RNA, 18 nt, Human
uuuuacauccagguaucc

SEQ ID NO: 1181061 - RNA, 27 nt, Human
uuuucuucuuuuuuuuuuuucuuuaaa

SEQ ID NO: 1181062 - RNA, 18 nt, Human
aagcgugacuccugggaa

SEQ ID NO: 1181063 - RNA, 24 nt, Human
aagugauccacccgccucagccuc

SEQ ID NO: 1181064 - RNA, 19 nt, Human
acaggcaguaucggccaac

SEQ ID NO: 1181065 - RNA, 19 nt, Human
accaaaaucacaauccagu

SEQ ID NO: 1181066 - RNA, 23 nt, Human
accaaaaucacaauccaguuuua

SEQ ID NO: 1181067 - RNA, 25 nt, Human
acccgccucagccucccagagagcu

SEQ ID NO: 1181068 - RNA, 19 nt, Human
acugcagagaaagaccaug

SEQ ID NO: 1181069 - RNA, 20 nt, Human
agaaauguugguuucacagu

SEQ ID NO: 1181070 - RNA, 21 nt, Human
agagcaaaacuuaaaauuuug

SEQ ID NO: 1181071 - RNA, 24 nt, Human
agagcugguauuacagaugugagc

SEQ ID NO: 1181072 - RNA, 19 nt, Human
agauuacaggugugugcca

SEQ ID NO: 1181073 - RNA, 24 nt, Human
agauuacaggugugugccaucaug

SEQ ID NO: 1181074 - RNA, 20 nt, Human
aguaaauguauacaguugug

SEQ ID NO: 1181075 - RNA, 21 nt, Human
aguaacugagauuacaggugu

SEQ ID NO: 1181076 - RNA, 23 nt, Human
aguaacugagauuacaggugugu

SEQ ID NO: 1181077 - RNA, 21 nt, Human
aguggguagaagcaggcucag

SEQ ID NO: 1181078 - RNA, 18 nt, Human
aguuaguuuuuauuuauu

SEQ ID NO: 1181079 - RNA, 22 nt, Human
aguucuuuacauggucugggua

SEQ ID NO: 1181080 - RNA, 21 nt, Human
auuuuguuuaucuacuuuuca

SEQ ID NO: 1181081 - RNA, 24 nt, Human
caagguuucaccaaguuggccagg

SEQ ID NO: 1181082 - RNA, 21 nt, Human
caccaaguuggccaggcuggu

SEQ ID NO: 1181083 - RNA, 23 nt, Human
caccaaguuggccaggcuggucu

SEQ ID NO: 1181084 - RNA, 20 nt, Human
cacccgccucagccucccag

SEQ ID NO: 1181085 - RNA, 18 nt, Human
cacuuauguuucugaggc

SEQ ID NO: 1181086 - RNA, 27 nt, Human
cacuuuuguucuagguuucacugaaga

SEQ ID NO: 1181087 - RNA, 20 nt, Human
cagccuccugaguaacugag

SEQ ID NO: 1181088 - RNA, 25 nt, Human
caggugugugccaucaugccuggcu

SEQ ID NO: 1181089 - RNA, 26 nt, Human
ccacccgccucagccucccagagagc

SEQ ID NO: 1181090 - RNA, 24 nt, Human
ccagagagcugguauuacagaugu

SEQ ID NO: 1181091 - RNA, 20 nt, Human
cccuggggcugccauguagc

SEQ ID NO: 1181092 - RNA, 22 nt, Human
ccugaguaacugagauuacagg

SEQ ID NO: 1181093 - RNA, 24 nt, Human
ccugaguaacugagauuacaggug

SEQ ID NO: 1181094 - RNA, 24 nt, Human
cgccucagccucccagagagcugg

SEQ ID NO: 1181095 - RNA, 19 nt, Human
cgugccucuacaguuuugc

SEQ ID NO: 1181096 - RNA, 18 nt, Human
cuaaauggaaucuuacaa

SEQ ID NO: 1181097 - RNA, 20 nt, Human
cuccacagggaguucuaggg

SEQ ID NO: 1181098 - RNA, 23 nt, Human
cucucucucucuuuuuuuuaaaa

SEQ ID NO: 1181099 - RNA, 20 nt, Human
cucucucuuuuuuuuaaaaa

SEQ ID NO: 1181100 - RNA, 21 nt, Human
cugaguaacugagauuacagg

SEQ ID NO: 1181101 - RNA, 24 nt, Human
cugaguaacugagauuacaggugu

SEQ ID NO: 1181102 - RNA, 23 nt, Human
cugcuucagccuccugaguaacu

SEQ ID NO: 1181103 - RNA, 21 nt, Human
cuguaucauuuugcacucaug

SEQ ID NO: 1181104 - RNA, 20 nt, Human
cugucugauggguccucugg

SEQ ID NO: 1181105 - RNA, 19 nt, Human
cugugcccacguauuggcu

SEQ ID NO: 1181106 - RNA, 20 nt, Human
cuuagaccacauugcagguc

SEQ ID NO: 1181107 - RNA, 18 nt, Human
gaccaugaaucuguuucg

SEQ ID NO: 1181108 - RNA, 18 nt, Human
gaccauggccuuaacuug

SEQ ID NO: 1181109 - RNA, 24 nt, Human
gacuucaagugauccacccgccuc

SEQ ID NO: 1181110 - RNA, 20 nt, Human
gagaucugagagcuauugcc

SEQ ID NO: 1181111 - RNA, 19 nt, Human
gaguaacugagauuacagg

SEQ ID NO: 1181112 - RNA, 26 nt, Human
gaguaacugagauuacaggugugugc

SEQ ID NO: 1181113 - RNA, 21 nt, Human
gaugacuaagcgugacuccug

SEQ ID NO: 1181114 - RNA, 18 nt, Human
gauuacaggugugugcca

SEQ ID NO: 1181115 - RNA, 24 nt, Human
gauuacaggugugugccaucaugc

SEQ ID NO: 1181116 - RNA, 19 nt, Human
gcucucuguucccacuccc

SEQ ID NO: 1181117 - RNA, 18 nt, Human
gcugauacagacauggag

SEQ ID NO: 1181118 - RNA, 22 nt, Human
gcugcagcagaccaugaaucug

SEQ ID NO: 1181119 - RNA, 21 nt, Human
ggccaacuccacagggaguuc

SEQ ID NO: 1181120 - RNA, 20 nt, Human
guauacaguuguguaaccaa

SEQ ID NO: 1181121 - RNA, 24 nt, Human
gugauccacccgccucagccuccc

SEQ ID NO: 1181122 - RNA, 22 nt, Human
guugcuuuuuagaaguuugcug

SEQ ID NO: 1181123 - RNA, 21 nt, Human
uaaauccuccaacuuugcucu

SEQ ID NO: 1181124 - RNA, 21 nt, Human
uaaaugaacuaccagaugcag

SEQ ID NO: 1181125 - RNA, 24 nt, Human
uaauuuuuuguauuucuaguagag

SEQ ID NO: 1181126 - RNA, 25 nt, Human
uaauuuuuuguauuucuaguagaga

SEQ ID NO: 1181127 - RNA, 22 nt, Human
uacagaugugagccacggcacc

SEQ ID NO: 1181128 - RNA, 18 nt, Human
uagaagcaggcucaggua

SEQ ID NO: 1181129 - RNA, 20 nt, Human
uagaccacauugcaggucac

SEQ ID NO: 1181130 - RNA, 26 nt, Human
uaguagagacaagguuucaccaaguu

SEQ ID NO: 1181131 - RNA, 18 nt, Human
uauacaagaccuugugca

SEQ ID NO: 1181132 - RNA, 23 nt, Human
uauacugacuugccucgucaccu

SEQ ID NO: 1181133 - RNA, 25 nt, Human
uaucuaagaaagcuuugccuaaccu

SEQ ID NO: 1181134 - RNA, 21 nt, Human
uaugccaaugugauacuuuug

SEQ ID NO: 1181135 - RNA, 20 nt, Human
uauggaaaaccuucuggcca

SEQ ID NO: 1181136 - RNA, 18 nt, Human
uauuacagaugugagcca

SEQ ID NO: 1181137 - RNA, 19 nt, Human
ucagguucuauaaauccuc

SEQ ID NO: 1181138 - RNA, 20 nt, Human
ucaguguuagcuaccugcac

SEQ ID NO: 1181139 - RNA, 21 nt, Human
uccacccgccucagccuccca

SEQ ID NO: 1181140 - RNA, 22 nt, Human
uccacccgccucagccucccag

SEQ ID NO: 1181141 - RNA, 23 nt, Human
uccaucaucccaaaauguuugcu

SEQ ID NO: 1181142 - RNA, 18 nt, Human
ucccacucccauccccag

SEQ ID NO: 1181143 - RNA, 24 nt, Human
uccugaguaacugagauuacaggu

SEQ ID NO: 1181144 - RNA, 22 nt, Human
ucuauaaauccuccaacuuugc

SEQ ID NO: 1181145 - RNA, 22 nt, Human
ucugauggguccucuggguagc

SEQ ID NO: 1181146 - RNA, 20 nt, Human
ucuuggucagauguuggaau

SEQ ID NO: 1181147 - RNA, 19 nt, Human
ugacagcuuagaccacauu

SEQ ID NO: 1181148 - RNA, 19 nt, Human
ugagagugaaauugcuggg

SEQ ID NO: 1181149 - RNA, 19 nt, Human
ugagauuacaggugugugc

SEQ ID NO: 1181150 - RNA, 21 nt, Human
ugagauuacaggugugugcca

SEQ ID NO: 1181151 - RNA, 21 nt, Human
ugagauuacaggugugugcca

SEQ ID NO: 1181152 - RNA, 22 nt, Human
ugagauuacaggugugugccau

SEQ ID NO: 1181153 - RNA, 24 nt, Human
ugagauuacaggugugugccauca

SEQ ID NO: 1181154 - RNA, 19 nt, Human
ugauuugcaaguauuuuuu

SEQ ID NO: 1181155 - RNA, 21 nt, Human
ugcauauuacuuucugucuga

SEQ ID NO: 1181156 - RNA, 25 nt, Human
ugcaugaauugucuucagcuuuuuc

SEQ ID NO: 1181157 - RNA, 22 nt, Human
ugcccuggggcugccauguagc

SEQ ID NO: 1181158 - RNA, 20 nt, Human
ugcccugugccuuucugugg

SEQ ID NO: 1181159 - RNA, 20 nt, Human
ugccucgucaccuuuguuca

SEQ ID NO: 1181160 - RNA, 24 nt, Human
ugcuucagccuccugaguaacuga

SEQ ID NO: 1181161 - RNA, 21 nt, Human
uggagccucauguugggcuga

SEQ ID NO: 1181162 - RNA, 21 nt, Human
uggccaggcuggucuuaaacu

SEQ ID NO: 1181163 - RNA, 21 nt, Human
uggcuggggacugcagagaaa

SEQ ID NO: 1181164 - RNA, 18 nt, Human
uggcuguaucauuuugca

SEQ ID NO: 1181165 - RNA, 22 nt, Human
uggggacugcagagaaagacca

SEQ ID NO: 1181166 - RNA, 21 nt, Human
ugguauuacagaugugagcca

SEQ ID NO: 1181167 - RNA, 22 nt, Human
ugguauuacagaugugagccac

SEQ ID NO: 1181168 - RNA, 23 nt, Human
ugguauuacagaugugagccacg

SEQ ID NO: 1181169 - RNA, 27 nt, Human
ugguauuacagaugugagccacggcac

SEQ ID NO: 1181170 - RNA, 24 nt, Human
uggucaguguuagcuaccugcacu

SEQ ID NO: 1181171 - RNA, 22 nt, Human
uguagaaaugguaucuaaaugg

SEQ ID NO: 1181172 - RNA, 22 nt, Human
uguaggagaguucuaguuucuc

SEQ ID NO: 1181173 - RNA, 19 nt, Human
uguauacaagaccuugugc

SEQ ID NO: 1181174 - RNA, 19 nt, Human
ugugugccaucaugccugg

SEQ ID NO: 1181175 - RNA, 19 nt, Human
uguugcacguguuuaguag

SEQ ID NO: 1181176 - RNA, 21 nt, Human
uuaaaaguguucuguucauug

SEQ ID NO: 1181177 - RNA, 23 nt, Human
uuaguuuuuauuuauuccacuuu

SEQ ID NO: 1181178 - RNA, 23 nt, Human
uucaagugauccacccgccucag

SEQ ID NO: 1181179 - RNA, 21 nt, Human
uucauagucuguggcuugucu

SEQ ID NO: 1181180 - RNA, 18 nt, Human
uucccacucccaucccca

SEQ ID NO: 1181181 - RNA, 21 nt, Human
uuucaccaaguuggccaggcu

SEQ ID NO: 1181182 - RNA, 21 nt, Human
uuuccaucaucccaaaauguu

SEQ ID NO: 1181183 - RNA, 24 nt, Human
uuucuaguagagacaagguuucac

SEQ ID NO: 1181184 - RNA, 24 nt, Human
uuuugugucugaccucuuucacuu

SEQ ID NO: 1181185 - RNA, 21 nt, Human
uuuuuguauuucuaguagaga

SEQ ID NO: 1181186 - RNA, 18 nt, Human
uuuuuuguauuucuagua

SEQ ID NO: 1181187 - RNA, 22 nt, Human
uuuuuuguauuucuaguagaga

SEQ ID NO: 1181188 - RNA, 24 nt, Human
uuuuuuguauuucuaguagagaca

SEQ ID NO: 1181189 - RNA, 23 nt, Human
aagcaccucucaugucagguucc

SEQ ID NO: 1181190 - RNA, 22 nt, Human
aagcaggucucagcuaaagcuc

SEQ ID NO: 1181191 - RNA, 18 nt, Human
agcaaggggagcucacca

SEQ ID NO: 1181192 - RNA, 24 nt, Human
caacucccaaguauucuguuuauu

SEQ ID NO: 1181193 - RNA, 19 nt, Human
caggucucagcuaaagcuc

SEQ ID NO: 1181194 - RNA, 18 nt, Human
caugaggagagaauauga

SEQ ID NO: 1181195 - RNA, 24 nt, Human
cccccaaugcuguugaagcuucau

SEQ ID NO: 1181196 - RNA, 24 nt, Human
ccuacuacagacaaagauguaagc

SEQ ID NO: 1181197 - RNA, 21 nt, Human
cgaaucuccaaaacaaaagca

SEQ ID NO: 1181198 - RNA, 27 nt, Human
cuagaaaacaucuugaaugacacucca

SEQ ID NO: 1181199 - RNA, 23 nt, Human
cuccaccgaucguaagcauuacc

SEQ ID NO: 1181200 - RNA, 18 nt, Human
cucucaugucagguucca

SEQ ID NO: 1181201 - RNA, 19 nt, Human
cugcucacugcuguuauga

SEQ ID NO: 1181202 - RNA, 21 nt, Human
cuugaaugacacuccagguaa

SEQ ID NO: 1181203 - RNA, 18 nt, Human
gaaaugauaaagcuauaa

SEQ ID NO: 1181204 - RNA, 20 nt, Human
gaccugcucccucaaagcca

SEQ ID NO: 1181205 - RNA, 19 nt, Human
gaguaaucucucaguaagc

SEQ ID NO: 1181206 - RNA, 19 nt, Human
gauuuguaacacauuccuu

SEQ ID NO: 1181207 - RNA, 22 nt, Human
uaacuauacaaauucaagcaaa

SEQ ID NO: 1181208 - RNA, 20 nt, Human
uaagcauuaccaaagaccug

SEQ ID NO: 1181209 - RNA, 18 nt, Human
uaccaaagaccugcuccc

SEQ ID NO: 1181210 - RNA, 21 nt, Human
uaccaaagaccugcucccuca

SEQ ID NO: 1181211 - RNA, 21 nt, Human
uagaacugggauuuguaacac

SEQ ID NO: 1181212 - RNA, 18 nt, Human
uauucuguuuauucucuc

SEQ ID NO: 1181213 - RNA, 23 nt, Human
uccaaaacaaaagcaccucucau

SEQ ID NO: 1181214 - RNA, 22 nt, Human
uccacccgagccuccguccccc

SEQ ID NO: 1181215 - RNA, 18 nt, Human
ucccuacuacagacaaag

SEQ ID NO: 1181216 - RNA, 20 nt, Human
ucccuacuacagacaaagau

SEQ ID NO: 1181217 - RNA, 19 nt, Human
uccuagaaaacaucuugaa

SEQ ID NO: 1181218 - RNA, 23 nt, Human
ucgaaucuccaaaacaaaagcac

SEQ ID NO: 1181219 - RNA, 24 nt, Human
ucucaugucagguuccacccgagc

SEQ ID NO: 1181220 - RNA, 21 nt, Human
ucuccaaaacaaaagcaccuc

SEQ ID NO: 1181221 - RNA, 23 nt, Human
ugaaauggugaggucuguaaaag

SEQ ID NO: 1181222 - RNA, 24 nt, Human
ugaaauggugaggucuguaaaagc

SEQ ID NO: 1181223 - RNA, 21 nt, Human
uggugaggucuguaaaagcag

SEQ ID NO: 1181224 - RNA, 23 nt, Human
uguggaucagggcucugcauaga

SEQ ID NO: 1181225 - RNA, 24 nt, Human
uguuuagaaaacaugaggagagaa

SEQ ID NO: 1181226 - RNA, 20 nt, Human
uucugaaauggugaggucug

SEQ ID NO: 1181227 - RNA, 21 nt, Human
uugaaugacacuccagguaac

SEQ ID NO: 1181228 - RNA, 21 nt, Human
uuguaacacauuccuugcucc

SEQ ID NO: 1181229 - RNA, 18 nt, Human
uuuaucccucuuuaccuu

SEQ ID NO: 1181230 - RNA, 18 nt, Human
aaauccccgaccccgccc

SEQ ID NO: 1181231 - RNA, 24 nt, Human
aaggcccgccaggcagacaggcuu

SEQ ID NO: 1181232 - RNA, 22 nt, Human
aaucacuccgccaccucccccu

SEQ ID NO: 1181233 - RNA, 20 nt, Human
accgauucaaauccccgacc

SEQ ID NO: 1181234 - RNA, 22 nt, Human
accgauucaaauccccgacccc

SEQ ID NO: 1181235 - RNA, 20 nt, Human
agaaacuuauuuauuucuac

SEQ ID NO: 1181236 - RNA, 18 nt, Human
agcccgaggucccgacgg

SEQ ID NO: 1181237 - RNA, 20 nt, Human
agcugcagucaacccgagga

SEQ ID NO: 1181238 - RNA, 21 nt, Human
aggaacuuuugaaacacugag

SEQ ID NO: 1181239 - RNA, 20 nt, Human
aggacuacagacaccugcca

SEQ ID NO: 1181240 - RNA, 25 nt, Human
caaauccccgaccccgccccucggu

SEQ ID NO: 1181241 - RNA, 19 nt, Human
caccucccccuucuccagu

SEQ ID NO: 1181242 - RNA, 20 nt, Human
cacuccgccaccucccccuu

SEQ ID NO: 1181243 - RNA, 18 nt, Human
cagaccccggcuccucug

SEQ ID NO: 1181244 - RNA, 19 nt, Human
cauuucagcauagaugguu

SEQ ID NO: 1181245 - RNA, 19 nt, Human
ccccgccccucgguaccga

SEQ ID NO: 1181246 - RNA, 28 nt, Human
ccccggcuccucuguccggaagggcucc

SEQ ID NO: 1181247 - RNA, 19 nt, Human
cccggcagccuccuccacc

SEQ ID NO: 1181248 - RNA, 20 nt, Human
ccgccaccucccccuucucc

SEQ ID NO: 1181249 - RNA, 26 nt, Human
ccggcagccuccuccacccgccuccu

SEQ ID NO: 1181250 - RNA, 25 nt, Human
ccuccacccgccuccuccgcccgcc

SEQ ID NO: 1181251 - RNA, 18 nt, Human
cgcugauccuggccugcg

SEQ ID NO: 1181252 - RNA, 21 nt, Human
cggcagccuccuccacccgcc

SEQ ID NO: 1181253 - RNA, 21 nt, Human
cuccgccaccucccccuucuc

SEQ ID NO: 1181254 - RNA, 24 nt, Human
cuccgccaccucccccuucuccag

SEQ ID NO: 1181255 - RNA, 23 nt, Human
cucuacgaaucacuccgccaccu

SEQ ID NO: 1181256 - RNA, 20 nt, Human
cucugcccggcagccuccuc

SEQ ID NO: 1181257 - RNA, 21 nt, Human
cucuugcuacagacucugcag

SEQ ID NO: 1181258 - RNA, 20 nt, Human
cuggaguggcuuccugggcu

SEQ ID NO: 1181259 - RNA, 21 nt, Human
cuggccugcgcucugcccggc

SEQ ID NO: 1181260 - RNA, 21 nt, Human
gagguugaacagagaauggga

SEQ ID NO: 1181261 - RNA, 18 nt, Human
gcgucgcgucggccgcuc

SEQ ID NO: 1181262 - RNA, 23 nt, Human
gcucugcccggcagccuccucca

SEQ ID NO: 1181263 - RNA, 24 nt, Human
gcucugcccggcagccuccuccac

SEQ ID NO: 1181264 - RNA, 24 nt, Human
gcugauccuggccugcgcucugcc

SEQ ID NO: 1181265 - RNA, 21 nt, Human
guagguucaacucaaaugagu

SEQ ID NO: 1181266 - RNA, 23 nt, Human
uaaaaguagguucaacucaaaug

SEQ ID NO: 1181267 - RNA, 23 nt, Human
uacagacucugcaggaaauguca

SEQ ID NO: 1181268 - RNA, 19 nt, Human
ucaaauccccgaccccgcc

SEQ ID NO: 1181269 - RNA, 19 nt, Human
uccacccgccuccuccgcc

SEQ ID NO: 1181270 - RNA, 18 nt, Human
uccccgaccccgccccuc

SEQ ID NO: 1181271 - RNA, 18 nt, Human
uccgcgcacacuccgagc

SEQ ID NO: 1181272 - RNA, 19 nt, Human
uccgcgcacacuccgagcg

SEQ ID NO: 1181273 - RNA, 25 nt, Human
uccucuguccggaagggcucuccug

SEQ ID NO: 1181274 - RNA, 18 nt, Human
ucuugcuacagacucugc

SEQ ID NO: 1181275 - RNA, 19 nt, Human
ugccuugugaccucgggga

SEQ ID NO: 1181276 - RNA, 22 nt, Human
aaaagcaccauucccaaucaca

SEQ ID NO: 1181277 - RNA, 22 nt, Human
aaagcaccauucccaaucacaa

SEQ ID NO: 1181278 - RNA, 23 nt, Human
aacccuugccuuuaagaggcaaa

SEQ ID NO: 1181279 - RNA, 25 nt, Human
aagacaauccuaaauuauaaccuag

SEQ ID NO: 1181280 - RNA, 23 nt, Human
aaugaacacaaaacacaggugaa

SEQ ID NO: 1181281 - RNA, 22 nt, Human
aauucucuuuuuagucgcuggc

SEQ ID NO: 1181282 - RNA, 24 nt, Human
accacacuaaaaugccuuucaaua

SEQ ID NO: 1181283 - RNA, 22 nt, Human
agccagucuuaguuuuaaauca

SEQ ID NO: 1181284 - RNA, 24 nt, Human
aggcaaaugaacacaaaacacagg

SEQ ID NO: 1181285 - RNA, 18 nt, Human
auucccaaucacaaauac

SEQ ID NO: 1181286 - RNA, 21 nt, Human
caugagacauuucuguuuugu

SEQ ID NO: 1181287 - RNA, 20 nt, Human
cauuuaaccacaagccaguc

SEQ ID NO: 1181288 - RNA, 18 nt, Human
gucaugagacauuucugu

SEQ ID NO: 1181289 - RNA, 25 nt, Human
uaacuugcuacuauuuuaaaagcau

SEQ ID NO: 1181290 - RNA, 20 nt, Human
uaagaggcaaaugaacacaa

SEQ ID NO: 1181291 - RNA, 21 nt, Human
uagaagggguaaacagugaua

SEQ ID NO: 1181292 - RNA, 26 nt, Human
ucacacauaauuuuaaaauuugugua

SEQ ID NO: 1181293 - RNA, 19 nt, Human
ucuuuagaagggguaaaca

SEQ ID NO: 1181294 - RNA, 19 nt, Human
uggcaaaagcaccauuccc

SEQ ID NO: 1181295 - RNA, 19 nt, Human
uggcuguuuaaagacaauc

SEQ ID NO: 1181296 - RNA, 23 nt, Human
uuacuaacgaagucuaaucauau

SEQ ID NO: 1181297 - RNA, 19 nt, Human
uucaugaucugaauucugg

SEQ ID NO: 1181298 - RNA, 21 nt, Human
aaaaugcucgcacaagggaca

SEQ ID NO: 1181299 - RNA, 21 nt, Human
aaacagccccagagccccugg

SEQ ID NO: 1181300 - RNA, 20 nt, Human
aacaacuuucucauuuaugu

SEQ ID NO: 1181301 - RNA, 21 nt, Human
aagacagcacucgagucagaa

SEQ ID NO: 1181302 - RNA, 20 nt, Human
aaggagggaggggaggcagc

SEQ ID NO: 1181303 - RNA, 22 nt, Human
aaggaggugcgagccggggaac

SEQ ID NO: 1181304 - RNA, 24 nt, Human
acacaggcacaaacacuaaaaacc

SEQ ID NO: 1181305 - RNA, 21 nt, Human
acagaccgaacagccuugaca

SEQ ID NO: 1181306 - RNA, 20 nt, Human
acaggcacaaacacuaaaaa

SEQ ID NO: 1181307 - RNA, 30 nt, Human
acaucucagcgccccaaauggggaccaauu

SEQ ID NO: 1181308 - RNA, 18 nt, Human
accagcgcaacggcccac

SEQ ID NO: 1181309 - RNA, 24 nt, Human
acuggaguagagaggcugagagca

SEQ ID NO: 1181310 - RNA, 21 nt, Human
agaacacagaagccagcaagc

SEQ ID NO: 1181311 - RNA, 19 nt, Human
agaagggagagggggucag

SEQ ID NO: 1181312 - RNA, 23 nt, Human
agaagggagagggggucaguggc

SEQ ID NO: 1181313 - RNA, 19 nt, Human
agacagcagcguuaggccc

SEQ ID NO: 1181314 - RNA, 19 nt, Human
agagcccugcccugagcgg

SEQ ID NO: 1181315 - RNA, 19 nt, Human
agaggaaacagaggcccag

SEQ ID NO: 1181316 - RNA, 20 nt, Human
agagggccuggagaagggcu

SEQ ID NO: 1181317 - RNA, 21 nt, Human
agaggugcgggcgcgggcagg

SEQ ID NO: 1181318 - RNA, 20 nt, Human
agcaagcaguaggcaaggga

SEQ ID NO: 1181319 - RNA, 23 nt, Human
agcacggggcugcccuccucaca

SEQ ID NO: 1181320 - RNA, 19 nt, Human
agcacuuccuagaccacac

SEQ ID NO: 1181321 - RNA, 23 nt, Human
agcaggaaggagggaggggaggc

SEQ ID NO: 1181322 - RNA, 21 nt, Human
agccaacaggccuaagucgcu

SEQ ID NO: 1181323 - RNA, 24 nt, Human
agccagugcugcugggguuggggu

SEQ ID NO: 1181324 - RNA, 24 nt, Human
aggaaagaaacgaucacaucucag

SEQ ID NO: 1181325 - RNA, 18 nt, Human
aggagggaggggaggcag

SEQ ID NO: 1181326 - RNA, 26 nt, Human
aggagggaggggaggcagcagaaggg

SEQ ID NO: 1181327 - RNA, 22 nt, Human
aggagggguuccagcccaaaca

SEQ ID NO: 1181328 - RNA, 20 nt, Human
aggcacaaacacuaaaaacc

SEQ ID NO: 1181329 - RNA, 21 nt, Human
aggcacaaacacuaaaaaccc

SEQ ID NO: 1181330 - RNA, 24 nt, Human
aggcagcgaccagccaggguccug

SEQ ID NO: 1181331 - RNA, 18 nt, Human
aggcaggaggggcgcagg

SEQ ID NO: 1181332 - RNA, 20 nt, Human
aggcaggaggggcgcagggg

SEQ ID NO: 1181333 - RNA, 25 nt, Human
aggcauccagccucaccaggaaaca

SEQ ID NO: 1181334 - RNA, 21 nt, Human
aggcguucaggaaccccgggg

SEQ ID NO: 1181335 - RNA, 21 nt, Human
agggagagggggucaguggcu

SEQ ID NO: 1181336 - RNA, 22 nt, Human
agggaggggaggcagcagaagg

SEQ ID NO: 1181337 - RNA, 20 nt, Human
aggggcugccggagacaggc

SEQ ID NO: 1181338 - RNA, 19 nt, Human
aggggcugccggagacggg

SEQ ID NO: 1181339 - RNA, 19 nt, Human
aggggcugccggagacggg

SEQ ID NO: 1181340 - RNA, 20 nt, Human
aggggcugccggagacgggc

SEQ ID NO: 1181341 - RNA, 20 nt, Human
aggggcugccggagacgggc

SEQ ID NO: 1181342 - RNA, 21 nt, Human
aggggugcgggugcgggcagg

SEQ ID NO: 1181343 - RNA, 21 nt, Human
aggggugcgggugcgggcagg

SEQ ID NO: 1181344 - RNA, 18 nt, Human
aggggugcgggugggggc

SEQ ID NO: 1181345 - RNA, 21 nt, Human
aggggugcgggugugggcagg

SEQ ID NO: 1181346 - RNA, 21 nt, Human
agucggcccacagccagcccc

SEQ ID NO: 1181347 - RNA, 20 nt, Human
agugcagagagcucaaugaa

SEQ ID NO: 1181348 - RNA, 23 nt, Human
aucacaucucagcgccccaaaug

SEQ ID NO: 1181349 - RNA, 20 nt, Human
aucggccccucccugcuucc

SEQ ID NO: 1181350 - RNA, 23 nt, Human
caacacgagaggccaagaccaca

SEQ ID NO: 1181351 - RNA, 19 nt, Human
caacagaaaguaacuggga

SEQ ID NO: 1181352 - RNA, 19 nt, Human
caaggugggggccgucugc

SEQ ID NO: 1181353 - RNA, 23 nt, Human
caagucacagaaagcgcagcuga

SEQ ID NO: 1181354 - RNA, 19 nt, Human
cacaaacacuaaaaacccu

SEQ ID NO: 1181355 - RNA, 19 nt, Human
cacagaaagcgcagcugaa

SEQ ID NO: 1181356 - RNA, 22 nt, Human
cacagaagccagcaagcaguag

SEQ ID NO: 1181357 - RNA, 21 nt, Human
cacagccagcccccccagccu

SEQ ID NO: 1181358 - RNA, 23 nt, Human
cacaugcaugccuggggaaugug

SEQ ID NO: 1181359 - RNA, 21 nt, Human
caccaggaaacaggcacacgg

SEQ ID NO: 1181360 - RNA, 23 nt, Human
cacuaggccaccuaaugaacccu

SEQ ID NO: 1181361 - RNA, 18 nt, Human
cacugcggggcacagggg

SEQ ID NO: 1181362 - RNA, 18 nt, Human
cagaaagcgcagcugaaa

SEQ ID NO: 1181363 - RNA, 25 nt, Human
cagaagggagagggggucaguggcc

SEQ ID NO: 1181364 - RNA, 25 nt, Human
cagagaacacagaagccagcaagca

SEQ ID NO: 1181365 - RNA, 18 nt, Human
cagcagagcaaagucaca

SEQ ID NO: 1181366 - RNA, 19 nt, Human
caggaaagaaacgaucaca

SEQ ID NO: 1181367 - RNA, 24 nt, Human
caggaaagaaacgaucacaucuca

SEQ ID NO: 1181368 - RNA, 21 nt, Human
cagggagggagggaggagagc

SEQ ID NO: 1181369 - RNA, 21 nt, Human
cagggaugggaccugcaggga

SEQ ID NO: 1181370 - RNA, 21 nt, Human
cagggcagcccucugggucag

SEQ ID NO: 1181371 - RNA, 19 nt, Human
cagggcagcugaguggggc

SEQ ID NO: 1181372 - RNA, 20 nt, Human
caggggugcgggugggggca

SEQ ID NO: 1181373 - RNA, 18 nt, Human
caguccccugcacgugac

SEQ ID NO: 1181374 - RNA, 23 nt, Human
caugccaggcauccagccucacc

SEQ ID NO: 1181375 - RNA, 21 nt, Human
cauugugaguuagugaacaac

SEQ ID NO: 1181376 - RNA, 19 nt, Human
ccaccgccacgcacgaccc

SEQ ID NO: 1181377 - RNA, 18 nt, Human
ccagcccaaacagcccca

SEQ ID NO: 1181378 - RNA, 25 nt, Human
ccagcccaaacagccccagagcccc

SEQ ID NO: 1181379 - RNA, 19 nt, Human
cccacagccagccccccca

SEQ ID NO: 1181380 - RNA, 24 nt, Human
cccagaaacgcagguggaccccac

SEQ ID NO: 1181381 - RNA, 25 nt, Human
cccaucuuccuccccagcauguuuu

SEQ ID NO: 1181382 - RNA, 22 nt, Human
ccccaccacagccaacaggccu

SEQ ID NO: 1181383 - RNA, 23 nt, Human
ccccaccgccacgcacgacccug

SEQ ID NO: 1181384 - RNA, 21 nt, Human
ccccagaaacgcagguggacc

SEQ ID NO: 1181385 - RNA, 23 nt, Human
ccccagggcccaucuuccucccc

SEQ ID NO: 1181386 - RNA, 19 nt, Human
ccccaggggcagaaguacc

SEQ ID NO: 1181387 - RNA, 19 nt, Human
ccccaggguccgugggcuc

SEQ ID NO: 1181388 - RNA, 22 nt, Human
ccccaggguccgugggcucccc

SEQ ID NO: 1181389 - RNA, 19 nt, Human
ccccggggccuccucuggg

SEQ ID NO: 1181390 - RNA, 18 nt, Human
cccgcuggucagggcagc

SEQ ID NO: 1181391 - RNA, 19 nt, Human
cccgcuggucagggcagcc

SEQ ID NO: 1181392 - RNA, 27 nt, Human
cccugcccugccccggcuucucaggag

SEQ ID NO: 1181393 - RNA, 21 nt, Human
cccuuccugcucuccugagaa

SEQ ID NO: 1181394 - RNA, 24 nt, Human
ccgaacagccuugacaccuccacu

SEQ ID NO: 1181395 - RNA, 24 nt, Human
ccggcucagaggcguguccaggaa

SEQ ID NO: 1181396 - RNA, 23 nt, Human
ccggcuucucaggagcccugccc

SEQ ID NO: 1181397 - RNA, 18 nt, Human
ccggggcuggcugggagc

SEQ ID NO: 1181398 - RNA, 21 nt, Human
ccucacagaccugcaccuggg

SEQ ID NO: 1181399 - RNA, 25 nt, Human
ccucaccaggaaacaggcacacggg

SEQ ID NO: 1181400 - RNA, 20 nt, Human
ccucagagacacccugcccu

SEQ ID NO: 1181401 - RNA, 21 nt, Human
ccugcaccugggccccagggc

SEQ ID NO: 1181402 - RNA, 21 nt, Human
ccugcucccuuccugcucucc

SEQ ID NO: 1181403 - RNA, 25 nt, Human
ccugugggaaccuucaaagcuuccc

SEQ ID NO: 1181404 - RNA, 21 nt, Human
cgagacagcagcguuaggccc

SEQ ID NO: 1181405 - RNA, 24 nt, Human
cgagccacuggaguagagaggcug

SEQ ID NO: 1181406 - RNA, 18 nt, Human
cgagccggggaacagagg

SEQ ID NO: 1181407 - RNA, 19 nt, Human
cgcaggggcagaggucuga

SEQ ID NO: 1181408 - RNA, 24 nt, Human
cgggcagugcccuugucucuaggg

SEQ ID NO: 1181409 - RNA, 20 nt, Human
cgugggaggugcagaggugc

SEQ ID NO: 1181410 - RNA, 25 nt, Human
cuccccagcauguuuuuaccucagc

SEQ ID NO: 1181411 - RNA, 24 nt, Human
cucccugcucccuuccugcucucc

SEQ ID NO: 1181412 - RNA, 22 nt, Human
cuccucacagaccugcaccuuu

SEQ ID NO: 1181413 - RNA, 19 nt, Human
cuccugugagucuggcuaa

SEQ ID NO: 1181414 - RNA, 26 nt, Human
cucuaaggggcagcaucagagagaga

SEQ ID NO: 1181415 - RNA, 18 nt, Human
cugcccaccaccgccuca

SEQ ID NO: 1181416 - RNA, 19 nt, Human
cugcuccagccagugcugc

SEQ ID NO: 1181417 - RNA, 24 nt, Human
cugcucccuuccugcucuccugag

SEQ ID NO: 1181418 - RNA, 18 nt, Human
cuggagacgggcguggaa

SEQ ID NO: 1181419 - RNA, 20 nt, Human
cugggucagggugacugagc

SEQ ID NO: 1181420 - RNA, 22 nt, Human
cugguuccggggcuggcuggga

SEQ ID NO: 1181421 - RNA, 24 nt, Human
cugguuccggggcuggcugggagc

SEQ ID NO: 1181422 - RNA, 23 nt, Human
cugguugagagcaacugcccuga

SEQ ID NO: 1181423 - RNA, 19 nt, Human
cuuguggagacccaucacc

SEQ ID NO: 1181424 - RNA, 22 nt, Human
gaaacgcagguggaccccacca

SEQ ID NO: 1181425 - RNA, 23 nt, Human
gagaggcaggaggggcgcagggg

SEQ ID NO: 1181426 - RNA, 19 nt, Human
gagcaagucacagaaagcg

SEQ ID NO: 1181427 - RNA, 19 nt, Human
gagugaggcugggaggaug

SEQ ID NO: 1181428 - RNA, 22 nt, Human
gcaacugcccugacgaaggagg

SEQ ID NO: 1181429 - RNA, 22 nt, Human
gcacaaacacuaaaaacccucg

SEQ ID NO: 1181430 - RNA, 23 nt, Human
gcacuuccuagaccacaccugga

SEQ ID NO: 1181431 - RNA, 22 nt, Human
gcagagcaagucacagaaagcg

SEQ ID NO: 1181432 - RNA, 21 nt, Human
gcaggggcugccggagacggg

SEQ ID NO: 1181433 - RNA, 21 nt, Human
gcaggggcugccggagacggg

SEQ ID NO: 1181434 - RNA, 22 nt, Human
gcaggggcugccggagacgggc

SEQ ID NO: 1181435 - RNA, 18 nt, Human
gccacgggagcacggggc

SEQ ID NO: 1181436 - RNA, 24 nt, Human
gccagcccccccagccuguugucu

SEQ ID NO: 1181437 - RNA, 21 nt, Human
gcccacagccagcccccccag

SEQ ID NO: 1181438 - RNA, 20 nt, Human
gcccacagccagcccccccg

SEQ ID NO: 1181439 - RNA, 19 nt, Human
gccccagagccccuggucc

SEQ ID NO: 1181440 - RNA, 23 nt, Human
gcccugcccaccaccgccucagc

SEQ ID NO: 1181441 - RNA, 19 nt, Human
gccugaaggaguugccugg

SEQ ID NO: 1181442 - RNA, 20 nt, Human
gcggcggcugcacaugcaug

SEQ ID NO: 1181443 - RNA, 18 nt, Human
gcugcaguccccugcacg

SEQ ID NO: 1181444 - RNA, 19 nt, Human
gcugcaguccccugcacgu

SEQ ID NO: 1181445 - RNA, 26 nt, Human
gcugcugggguuggggucggcucguc

SEQ ID NO: 1181446 - RNA, 18 nt, Human
ggaagcagcaccugcacu

SEQ ID NO: 1181447 - RNA, 19 nt, Human
ggagagggggucaguggcu

SEQ ID NO: 1181448 - RNA, 22 nt, Human
ggagcccugcccaccaccgccu

SEQ ID NO: 1181449 - RNA, 18 nt, Human
ggaggacagaacgggaug

SEQ ID NO: 1181450 - RNA, 18 nt, Human
ggagggagggaggagagc

SEQ ID NO: 1181451 - RNA, 22 nt, Human
ggaguagagaggcugagagcac

SEQ ID NO: 1181452 - RNA, 26 nt, Human
ggcaagacgggcgugggaggugcagg

SEQ ID NO: 1181453 - RNA, 24 nt, Human
ggcacaggggucugcagggaggga

SEQ ID NO: 1181454 - RNA, 27 nt, Human
ggcagcccucugggucagggugacuga

SEQ ID NO: 1181455 - RNA, 20 nt, Human
ggcaggggcugccggagacg

SEQ ID NO: 1181456 - RNA, 19 nt, Human
ggcaggggcugcuggagac

SEQ ID NO: 1181457 - RNA, 21 nt, Human
ggccgagugaggcugggagga

SEQ ID NO: 1181458 - RNA, 21 nt, Human
ggccugaagaaggcguucagg

SEQ ID NO: 1181459 - RNA, 18 nt, Human
ggccugcaggggugacug

SEQ ID NO: 1181460 - RNA, 21 nt, Human
ggcugagcgguggccacggga

SEQ ID NO: 1181461 - RNA, 27 nt, Human
ggcugggaggauggugcccgcugguca

SEQ ID NO: 1181462 - RNA, 19 nt, Human
gggaugggaccugcaggga

SEQ ID NO: 1181463 - RNA, 21 nt, Human
gggcagcugaguggggcuggg

SEQ ID NO: 1181464 - RNA, 20 nt, Human
gggcaggggcugcuggagac

SEQ ID NO: 1181465 - RNA, 21 nt, Human
gggcgugggaggugcaggggu

SEQ ID NO: 1181466 - RNA, 18 nt, Human
ggggacacaggcacaaac

SEQ ID NO: 1181467 - RNA, 24 nt, Human
ggggcugugggguagagaagagca

SEQ ID NO: 1181468 - RNA, 23 nt, Human
ggggugcgggugggggcaggggc

SEQ ID NO: 1181469 - RNA, 20 nt, Human
gggugcaggcaggggcugcc

SEQ ID NO: 1181470 - RNA, 19 nt, Human
ggucugaugccugaaggag

SEQ ID NO: 1181471 - RNA, 22 nt, Human
ggugcccgcuggucagggcagc

SEQ ID NO: 1181472 - RNA, 22 nt, Human
ggugcccgcuggucagggcagc

SEQ ID NO: 1181473 - RNA, 19 nt, Human
gguggcggcggcggcugca

SEQ ID NO: 1181474 - RNA, 22 nt, Human
ggugggggcaggggcugcugga

SEQ ID NO: 1181475 - RNA, 21 nt, Human
guccugugguccugggaagca

SEQ ID NO: 1181476 - RNA, 28 nt, Human
gugcugcugggguuggggucggcucguc

SEQ ID NO: 1181477 - RNA, 22 nt, Human
gugcugcugggguuggggugag

SEQ ID NO: 1181478 - RNA, 24 nt, Human
guggcggcggcggcugcacaugca

SEQ ID NO: 1181479 - RNA, 19 nt, Human
gugggguagagaagagcag

SEQ ID NO: 1181480 - RNA, 18 nt, Human
guuccggggcuggcuggg

SEQ ID NO: 1181481 - RNA, 24 nt, Human
guuggagcaggaaggagggagggg

SEQ ID NO: 1181482 - RNA, 18 nt, Human
uaucccagaugcacagga

SEQ ID NO: 1181483 - RNA, 21 nt, Human
ucaaugaagacagcacucgag

SEQ ID NO: 1181484 - RNA, 23 nt, Human
ucaccccauccuuccugcguccc

SEQ ID NO: 1181485 - RNA, 20 nt, Human
ucagcgccacaguacauggg

SEQ ID NO: 1181486 - RNA, 22 nt, Human
ucagcgccacaguacaugggug

SEQ ID NO: 1181487 - RNA, 18 nt, Human
ucaggccagagcccugcc

SEQ ID NO: 1181488 - RNA, 22 nt, Human
ucagggaugggaccugcaggga

SEQ ID NO: 1181489 - RNA, 21 nt, Human
ucagggcacugcggggcacag

SEQ ID NO: 1181490 - RNA, 23 nt, Human
ucagggcacugcggggcacaggg

SEQ ID NO: 1181491 - RNA, 23 nt, Human
uccaggaacccccgucaggccag

SEQ ID NO: 1181492 - RNA, 21 nt, Human
uccauuuggcugagcgguggc

SEQ ID NO: 1181493 - RNA, 21 nt, Human
uccccagagugcagagagcuc

SEQ ID NO: 1181494 - RNA, 23 nt, Human
ucccugggaggaagccgguagcc

SEQ ID NO: 1181495 - RNA, 22 nt, Human
ucgcccccaccgccacgcacga

SEQ ID NO: 1181496 - RNA, 19 nt, Human
ucggagccagcagccaguc

SEQ ID NO: 1181497 - RNA, 24 nt, Human
ucuaggggucccugugggaaccuu

SEQ ID NO: 1181498 - RNA, 18 nt, Human
ucucugcacucugaggcc

SEQ ID NO: 1181499 - RNA, 23 nt, Human
ucugguuccggggcuggcuggga

SEQ ID NO: 1181500 - RNA, 19 nt, Human
ugaaacccagguacacccc

SEQ ID NO: 1181501 - RNA, 20 nt, Human
ugaaacccagguacacccca

SEQ ID NO: 1181502 - RNA, 19 nt, Human
ugaacccuuagcuucccag

SEQ ID NO: 1181503 - RNA, 20 nt, Human
ugaagucgcccccaccgcca

SEQ ID NO: 1181504 - RNA, 21 nt, Human
ugacacagcuggcagaagucc

SEQ ID NO: 1181505 - RNA, 22 nt, Human
ugagaucggggaauccagugcc

SEQ ID NO: 1181506 - RNA, 19 nt, Human
ugagcaaggcuggaaggau

SEQ ID NO: 1181507 - RNA, 19 nt, Human
ugaggcugggaggguggug

SEQ ID NO: 1181508 - RNA, 23 nt, Human
ugagucuggcuaauggggagugg

SEQ ID NO: 1181509 - RNA, 22 nt, Human
ugagugcaggcacuaggccacc

SEQ ID NO: 1181510 - RNA, 22 nt, Human
ugaguggggcugggaggauggu

SEQ ID NO: 1181511 - RNA, 20 nt, Human
ugagugugucgggcaggcug

SEQ ID NO: 1181512 - RNA, 20 nt, Human
ugcacucugaggccuacaga

SEQ ID NO: 1181513 - RNA, 20 nt, Human
ugcagagaacacagaagcca

SEQ ID NO: 1181514 - RNA, 18 nt, Human
ugcagagagcucaaugaa

SEQ ID NO: 1181515 - RNA, 22 nt, Human
ugcagagagcucaaugaagaca

SEQ ID NO: 1181516 - RNA, 21 nt, Human
ugcaugccuggggaaugugag

SEQ ID NO: 1181517 - RNA, 19 nt, Human
ugccccggcuucucaggag

SEQ ID NO: 1181518 - RNA, 21 nt, Human
ugcccuugucucuaggggucc

SEQ ID NO: 1181519 - RNA, 21 nt, Human
ugccgagugggccccaggggc

SEQ ID NO: 1181520 - RNA, 22 nt, Human
ugccugaaggaguugccugggg

SEQ ID NO: 1181521 - RNA, 18 nt, Human
ugccuggggcuguggggu

SEQ ID NO: 1181522 - RNA, 21 nt, Human
ugccugggguucgaguuugga

SEQ ID NO: 1181523 - RNA, 21 nt, Human
ugcggaggaagccaggagagu

SEQ ID NO: 1181524 - RNA, 21 nt, Human
ugcugggguuggggugagggu

SEQ ID NO: 1181525 - RNA, 22 nt, Human
ugcuggucaggguggccgcgug

SEQ ID NO: 1181526 - RNA, 21 nt, Human
uggaagaccaggcaggggagu

SEQ ID NO: 1181527 - RNA, 23 nt, Human
uggcaggacaguuaaacuuuugg

SEQ ID NO: 1181528 - RNA, 24 nt, Human
uggcaggacaguuaaacuuuugga

SEQ ID NO: 1181529 - RNA, 20 nt, Human
uggcaggagggcuggucaga

SEQ ID NO: 1181530 - RNA, 21 nt, Human
uggcggcggcggcugcacaug

SEQ ID NO: 1181531 - RNA, 21 nt, Human
ugggaggguggugcccgcugg

SEQ ID NO: 1181532 - RNA, 23 nt, Human
ugggaggguggugcccgcuggag

SEQ ID NO: 1181533 - RNA, 19 nt, Human
ugggaggugcagaggugcg

SEQ ID NO: 1181534 - RNA, 19 nt, Human
ugggaggugcaggggugcg

SEQ ID NO: 1181535 - RNA, 22 nt, Human
uggggauucugucaaggugggg

SEQ ID NO: 1181536 - RNA, 18 nt, Human
ugggucagggugacugag

SEQ ID NO: 1181537 - RNA, 19 nt, Human
ugugggguagagaagagca

SEQ ID NO: 1181538 - RNA, 23 nt, Human
ugugggguagagaagagcaggac

SEQ ID NO: 1181539 - RNA, 24 nt, Human
uuaaacuuuuggacaacagaaagu

SEQ ID NO: 1181540 - RNA, 21 nt, Human
uuacaggaggggucagcgcca

SEQ ID NO: 1181541 - RNA, 19 nt, Human
uuaggcccggucucggcug

SEQ ID NO: 1181542 - RNA, 19 nt, Human
uucucugcacucugaggcc

SEQ ID NO: 1181543 - RNA, 21 nt, Human
uuggaagaccaggcaggggag

SEQ ID NO: 1181544 - RNA, 22 nt, Human
uuuuguugagaucggggaaucc

SEQ ID NO: 1181545 - RNA, 19 nt, Human
accugccgcccaaagccag

SEQ ID NO: 1181546 - RNA, 23 nt, Human
aggacauuuccaggcaggcaucc

SEQ ID NO: 1181547 - RNA, 18 nt, Human
aggaggaggcugugaagg

SEQ ID NO: 1181548 - RNA, 22 nt, Human
aggaggccacgaaugcaaggac

SEQ ID NO: 1181549 - RNA, 21 nt, Human
agucugggcaaguggucccag

SEQ ID NO: 1181550 - RNA, 28 nt, Human
aucaguagcucccagagcagccucuucc

SEQ ID NO: 1181551 - RNA, 18 nt, Human
cagcaucaguagcuccca

SEQ ID NO: 1181552 - RNA, 23 nt, Human
cagggaccugccgcccaaagcca

SEQ ID NO: 1181553 - RNA, 23 nt, Human
cugugccugaggggccccagucu

SEQ ID NO: 1181554 - RNA, 23 nt, Human
gaggaggaggcugugaaggaggc

SEQ ID NO: 1181555 - RNA, 20 nt, Human
gcagggaccugccgcccaaa

SEQ ID NO: 1181556 - RNA, 18 nt, Human
gcucccagagcagccucu

SEQ ID NO: 1181557 - RNA, 18 nt, Human
gguggugggugccugaag

SEQ ID NO: 1181558 - RNA, 23 nt, Human
gucugggcaaguggucccagccc

SEQ ID NO: 1181559 - RNA, 21 nt, Human
gugccugaagaggggucacgg

SEQ ID NO: 1181560 - RNA, 20 nt, Human
gugggagcuggggagacagg

SEQ ID NO: 1181561 - RNA, 18 nt, Human
uagaugcuuucugugugg

SEQ ID NO: 1181562 - RNA, 22 nt, Human
ucugggcaaguggucccagccc

SEQ ID NO: 1181563 - RNA, 23 nt, Human
ugaggaggaggcugugaaggagg

SEQ ID NO: 1181564 - RNA, 22 nt, Human
ugccugaagaggggucacgggg

SEQ ID NO: 1181565 - RNA, 19 nt, Human
ugggagcuggggagacagg

SEQ ID NO: 1181566 - RNA, 24 nt, Human
uggggagacaggucaguaggaccc

SEQ ID NO: 1181567 - RNA, 23 nt, Human
uggugggugccugaagagggguc

SEQ ID NO: 1181568 - RNA, 21 nt, Human
uuucugugugggagcugggga

SEQ ID NO: 1181569 - RNA, 20 nt, Human
aaauaccgaguggagguacg

SEQ ID NO: 1181570 - RNA, 23 nt, Human
aacuguacccagccuccagcuaa

SEQ ID NO: 1181571 - RNA, 25 nt, Human
agaagcacaaauauauuaaguaaaa

SEQ ID NO: 1181572 - RNA, 18 nt, Human
agcuaauuccagguccua

SEQ ID NO: 1181573 - RNA, 21 nt, Human
agguuccuccuucugggcugc

SEQ ID NO: 1181574 - RNA, 20 nt, Human
agucuacacacuucuucagg

SEQ ID NO: 1181575 - RNA, 19 nt, Human
augagauguuuuaggguuu

SEQ ID NO: 1181576 - RNA, 26 nt, Human
auuaaguaaaacaguaguuccaggaa

SEQ ID NO: 1181577 - RNA, 22 nt, Human
auuugcagugucugcucuccuu

SEQ ID NO: 1181578 - RNA, 23 nt, Human
caaauauauuaaguaaaacagua

SEQ ID NO: 1181579 - RNA, 20 nt, Human
caaccugcaacuguacccag

SEQ ID NO: 1181580 - RNA, 21 nt, Human
caacuguacccagccuccagc

SEQ ID NO: 1181581 - RNA, 18 nt, Human
cagccuccagcuaauucc

SEQ ID NO: 1181582 - RNA, 21 nt, Human
caggaagccugccuaaagcuu

SEQ ID NO: 1181583 - RNA, 21 nt, Human
caguaguuccaggaagccugc

SEQ ID NO: 1181584 - RNA, 18 nt, Human
ccaacccuaagucaagcc

SEQ ID NO: 1181585 - RNA, 19 nt, Human
ccaccagacaucacccaga

SEQ ID NO: 1181586 - RNA, 24 nt, Human
ccccaccuccucgcaguacuccug

SEQ ID NO: 1181587 - RNA, 22 nt, Human
ccucaugagguugcagaagcug

SEQ ID NO: 1181588 - RNA, 18 nt, Human
ccugcagcuucauuaccu

SEQ ID NO: 1181589 - RNA, 20 nt, Human
ccugccuaaagcuuccccac

SEQ ID NO: 1181590 - RNA, 22 nt, Human
ccugccuaaagcuuccccaccu

SEQ ID NO: 1181591 - RNA, 23 nt, Human
ccuggcccaacccuaagucaagc

SEQ ID NO: 1181592 - RNA, 19 nt, Human
cgguagguuccuccuucuu

SEQ ID NO: 1181593 - RNA, 22 nt, Human
cgucagucuacacacuucuuca

SEQ ID NO: 1181594 - RNA, 26 nt, Human
cucgcaguacuccugacagccccugu

SEQ ID NO: 1181595 - RNA, 22 nt, Human
cucuccuuuuucugagcuuucu

SEQ ID NO: 1181596 - RNA, 25 nt, Human
cugcagcuucauuaccuuaagccua

SEQ ID NO: 1181597 - RNA, 20 nt, Human
cuggcccaacccuaagucaa

SEQ ID NO: 1181598 - RNA, 19 nt, Human
cuuuccauuucccuuccag

SEQ ID NO: 1181599 - RNA, 25 nt, Human
gagguugcagaagcacaaauauauu

SEQ ID NO: 1181600 - RNA, 23 nt, Human
gcaauuaaaauuggaucugguuu

SEQ ID NO: 1181601 - RNA, 21 nt, Human
gcagcuucauuaccuuaagcc

SEQ ID NO: 1181602 - RNA, 20 nt, Human
ggcaauuaaaauuggaucug

SEQ ID NO: 1181603 - RNA, 24 nt, Human
gguagguuccuccuucugggcugc

SEQ ID NO: 1181604 - RNA, 22 nt, Human
uaaaacaguaguuccaggaagc

SEQ ID NO: 1181605 - RNA, 18 nt, Human
uaauggcuuuuccuggcc

SEQ ID NO: 1181606 - RNA, 23 nt, Human
uacagaacgucagucuacacacu

SEQ ID NO: 1181607 - RNA, 21 nt, Human
uauggagaaauucagcugaca

SEQ ID NO: 1181608 - RNA, 23 nt, Human
uauggagaaauucagcugacauu

SEQ ID NO: 1181609 - RNA, 21 nt, Human
ucacccagaucuacccgguuc

SEQ ID NO: 1181610 - RNA, 23 nt, Human
uccaugcuuuuuggagacaggag

SEQ ID NO: 1181611 - RNA, 22 nt, Human
ucccacccguugagccaccaga

SEQ ID NO: 1181612 - RNA, 22 nt, Human
ucccuuugcugucccauugcuu

SEQ ID NO: 1181613 - RNA, 18 nt, Human
ucucucuugcuuguugcu

SEQ ID NO: 1181614 - RNA, 21 nt, Human
ucuugcuuccugcugagcugg

SEQ ID NO: 1181615 - RNA, 18 nt, Human
ugaaaagaaauggauggg

SEQ ID NO: 1181616 - RNA, 21 nt, Human
ugagcaaauaccgaguggagg

SEQ ID NO: 1181617 - RNA, 22 nt, Human
ugccaggcaguauugggcauug

SEQ ID NO: 1181618 - RNA, 19 nt, Human
ugcuuuccauuucccuucc

SEQ ID NO: 1181619 - RNA, 25 nt, Human
uggcugaaaagaaauggauggguau

SEQ ID NO: 1181620 - RNA, 21 nt, Human
ugggcugguguauccugcagc

SEQ ID NO: 1181621 - RNA, 18 nt, Human
ugggucaaggucaggagg

SEQ ID NO: 1181622 - RNA, 21 nt, Human
uugggucaaggucaggaggga

SEQ ID NO: 1181623 - RNA, 19 nt, Human
uuucucagccuuucugugu

SEQ ID NO: 1181624 - RNA, 20 nt, Human
uuuuccuggcccaacccuaa

SEQ ID NO: 1181625 - RNA, 22 nt, Human
aaaaagccaaacccuaugaaag

SEQ ID NO: 1181626 - RNA, 27 nt, Human
aaaagcauuucaacaauauacacaaaa

SEQ ID NO: 1181627 - RNA, 22 nt, Human
aagcaaaccccaagucaauaca

SEQ ID NO: 1181628 - RNA, 23 nt, Human
aauacaguacaucaaugacacuu

SEQ ID NO: 1181629 - RNA, 22 nt, Human
aaugcuuucaugcauguacaca

SEQ ID NO: 1181630 - RNA, 20 nt, Human
auacacaaaaugauacuaaa

SEQ ID NO: 1181631 - RNA, 21 nt, Human
auguuaaguaacaaauaagca

SEQ ID NO: 1181632 - RNA, 24 nt, Human
auguucccaaaaagaggguaaaaa

SEQ ID NO: 1181633 - RNA, 19 nt, Human
auuauuauaaauguuuacu

SEQ ID NO: 1181634 - RNA, 22 nt, Human
caaauaagcaaaccccaaguca

SEQ ID NO: 1181635 - RNA, 23 nt, Human
cauuauccaaaaagccaaacccu

SEQ ID NO: 1181636 - RNA, 26 nt, Human
gggaacaacgaaaaaugcuuucaugc

SEQ ID NO: 1181637 - RNA, 19 nt, Human
uaacaguacaaaauugaug

SEQ ID NO: 1181638 - RNA, 18 nt, Human
uaacauuaugaauauaaa

SEQ ID NO: 1181639 - RNA, 21 nt, Human
uacugcauaacaguacaaaau

SEQ ID NO: 1181640 - RNA, 23 nt, Human
uccaaaaagccaaacccuaugaa

SEQ ID NO: 1181641 - RNA, 19 nt, Human
uuauccaaaaagccaaacc

SEQ ID NO: 1181642 - RNA, 23 nt, Human
uucccaaaaagaggguaaaaaaa

SEQ ID NO: 1181643 - RNA, 21 nt, Human
aaccacggcuccugugacuug

SEQ ID NO: 1181644 - RNA, 18 nt, Human
aaccagugucccgacagg

SEQ ID NO: 1181645 - RNA, 21 nt, Human
aauuuauuuccucgcuuucca

SEQ ID NO: 1181646 - RNA, 24 nt, Human
accuccauaauucucuguaccucu

SEQ ID NO: 1181647 - RNA, 18 nt, Human
agaaagaggcaaacugac

SEQ ID NO: 1181648 - RNA, 19 nt, Human
agccagaaagagaaucuga

SEQ ID NO: 1181649 - RNA, 22 nt, Human
aggcagaagcugcaaggacuuc

SEQ ID NO: 1181650 - RNA, 23 nt, Human
aggcagaagcugcaaggacuucu

SEQ ID NO: 1181651 - RNA, 19 nt, Human
agugcucagacuuuuaaga

SEQ ID NO: 1181652 - RNA, 22 nt, Human
aucuggcuuggugucauugucu

SEQ ID NO: 1181653 - RNA, 19 nt, Human
auuuacuugccugcccucc

SEQ ID NO: 1181654 - RNA, 20 nt, Human
caagacgaauccagagcucu

SEQ ID NO: 1181655 - RNA, 18 nt, Human
cacagggccucaugggcu

SEQ ID NO: 1181656 - RNA, 23 nt, Human
cagaaaccaguucuccaaacucc

SEQ ID NO: 1181657 - RNA, 23 nt, Human
cagaauuaaagaacuggucacau

SEQ ID NO: 1181658 - RNA, 20 nt, Human
cagaguuagagaaggauuag

SEQ ID NO: 1181659 - RNA, 19 nt, Human
cagugucccgacagggacc

SEQ ID NO: 1181660 - RNA, 23 nt, Human
caucaugugauaucccagcuuug

SEQ ID NO: 1181661 - RNA, 22 nt, Human
cccugcccaguauaccuucccc

SEQ ID NO: 1181662 - RNA, 27 nt, Human
ccuccagaaggugugcacacucaaucu

SEQ ID NO: 1181663 - RNA, 18 nt, Human
ccucuagucccugucacu

SEQ ID NO: 1181664 - RNA, 23 nt, Human
ccugcccucccaucagaugagaa

SEQ ID NO: 1181665 - RNA, 21 nt, Human
cucaagacgaauccagagcuc

SEQ ID NO: 1181666 - RNA, 18 nt, Human
cugaagcagacagacuug

SEQ ID NO: 1181667 - RNA, 20 nt, Human
cuguaccucucucuccucuc

SEQ ID NO: 1181668 - RNA, 19 nt, Human
gaccacccuuacugauuua

SEQ ID NO: 1181669 - RNA, 21 nt, Human
ggucacagaguuagagaagga

SEQ ID NO: 1181670 - RNA, 20 nt, Human
guaccucucucuccucucug

SEQ ID NO: 1181671 - RNA, 20 nt, Human
gucgcaggcagaagcugcaa

SEQ ID NO: 1181672 - RNA, 19 nt, Human
uaaaagaugcuuagugaau

SEQ ID NO: 1181673 - RNA, 31 nt, Human
uaacaaauccaaaaacauagugguuaaaaaa

SEQ ID NO: 1181674 - RNA, 19 nt, Human
uacagaauuaaagaacugg

SEQ ID NO: 1181675 - RNA, 22 nt, Human
uaccuccagagacuuagcucaa

SEQ ID NO: 1181676 - RNA, 22 nt, Human
uagaaggucuagaauauuuagg

SEQ ID NO: 1181677 - RNA, 19 nt, Human
uagagaaggauuagacaga

SEQ ID NO: 1181678 - RNA, 28 nt, Human
uaguaguauucuuuaaauugcuuguggu

SEQ ID NO: 1181679 - RNA, 18 nt, Human
uagugaaugaaugacugc

SEQ ID NO: 1181680 - RNA, 19 nt, Human
uauaacaaauccaaaaaca

SEQ ID NO: 1181681 - RNA, 19 nt, Human
uauaacaaauccaaaaaca

SEQ ID NO: 1181682 - RNA, 18 nt, Human
uaucuauaaacuuauaac

SEQ ID NO: 1181683 - RNA, 21 nt, Human
uauuaucauucacagggccuc

SEQ ID NO: 1181684 - RNA, 21 nt, Human
ucaaagcaugagaagaaaacc

SEQ ID NO: 1181685 - RNA, 21 nt, Human
ucacagaguuagagaaggauu

SEQ ID NO: 1181686 - RNA, 23 nt, Human
ucagagugcucagacuuuuaaga

SEQ ID NO: 1181687 - RNA, 23 nt, Human
ucaugugauaucccagcuuugcc

SEQ ID NO: 1181688 - RNA, 24 nt, Human
uccaaaaacauagugguuaaaaac

SEQ ID NO: 1181689 - RNA, 19 nt, Human
uccauaauucucuguaccu

SEQ ID NO: 1181690 - RNA, 18 nt, Human
ucuccucucugguacucu

SEQ ID NO: 1181691 - RNA, 18 nt, Human
ucuggcuuggugucauug

SEQ ID NO: 1181692 - RNA, 19 nt, Human
ucugugucuguuuuuuccc

SEQ ID NO: 1181693 - RNA, 18 nt, Human
ucuuucucugucauccag

SEQ ID NO: 1181694 - RNA, 20 nt, Human
ugaagcagacagacuugggg

SEQ ID NO: 1181695 - RNA, 22 nt, Human
ugaagcagacagacuuggggug

SEQ ID NO: 1181696 - RNA, 23 nt, Human
ugagaaacuuucuaaagucagaa

SEQ ID NO: 1181697 - RNA, 22 nt, Human
ugagaagaaaaccagauugggu

SEQ ID NO: 1181698 - RNA, 24 nt, Human
ugaggcaguucuuaauuagagugu

SEQ ID NO: 1181699 - RNA, 22 nt, Human
ugauaaccaucuggcuuggugu

SEQ ID NO: 1181700 - RNA, 18 nt, Human
ugccagaggagagugagu

SEQ ID NO: 1181701 - RNA, 23 nt, Human
ugccuggcaugugaccuccuaaa

SEQ ID NO: 1181702 - RNA, 18 nt, Human
ugcuguggugaaugauua

SEQ ID NO: 1181703 - RNA, 21 nt, Human
uggcagagaugaggcugcaga

SEQ ID NO: 1181704 - RNA, 20 nt, Human
ugguuaaaaacaauuuauua

SEQ ID NO: 1181705 - RNA, 23 nt, Human
ugugguauucacaccauaguucu

SEQ ID NO: 1181706 - RNA, 18 nt, Human
uguuaaaauacucaauca

SEQ ID NO: 1181707 - RNA, 22 nt, Human
uguucuaagagucgcaggcaga

SEQ ID NO: 1181708 - RNA, 24 nt, Human
uuaaaaaauuccaguuuccucauc

SEQ ID NO: 1181709 - RNA, 19 nt, Human
uuaucuauaaacuuauaac

SEQ ID NO: 1181710 - RNA, 25 nt, Human
uucaaagcaugagaagaaaaccaga

SEQ ID NO: 1181711 - RNA, 21 nt, Human
uucagagugcucagacuuuua

SEQ ID NO: 1181712 - RNA, 23 nt, Human
uuccucacagcaugaugguuuca

SEQ ID NO: 1181713 - RNA, 25 nt, Human
uuccuggguauuucucaaccagugu

SEQ ID NO: 1181714 - RNA, 21 nt, Human
uucuccuuguagcugacaccu

SEQ ID NO: 1181715 - RNA, 18 nt, Human
uugccugcccucccauca

SEQ ID NO: 1181716 - RNA, 19 nt, Human
uuuaagacagcaucuggca

SEQ ID NO: 1181717 - RNA, 21 nt, Human
uuugcucucacccacuucugu

SEQ ID NO: 1181718 - RNA, 18 nt, Human
aaacaugaucaugucgug

SEQ ID NO: 1181719 - RNA, 21 nt, Human
aaccagaucugagacgacccc

SEQ ID NO: 1181720 - RNA, 23 nt, Human
aacuaccucuguaaggacccuau

SEQ ID NO: 1181721 - RNA, 18 nt, Human
aagaagaaaaugcaggaa

SEQ ID NO: 1181722 - RNA, 21 nt, Human
aagauggcaggguucagagug

SEQ ID NO: 1181723 - RNA, 19 nt, Human
aaggagggggugauauuuc

SEQ ID NO: 1181724 - RNA, 18 nt, Human
aagggagaaauggacuuu

SEQ ID NO: 1181725 - RNA, 19 nt, Human
acagaguacacugccaaaa

SEQ ID NO: 1181726 - RNA, 22 nt, Human
acauccaggcccagcacugaaa

SEQ ID NO: 1181727 - RNA, 20 nt, Human
acccuaaugacccugcuuua

SEQ ID NO: 1181728 - RNA, 21 nt, Human
acuacgcugcccagcaccccu

SEQ ID NO: 1181729 - RNA, 21 nt, Human
acuacgcugcccagcaccccu

SEQ ID NO: 1181730 - RNA, 23 nt, Human
aggcaacuccaacuuggcaagag

SEQ ID NO: 1181731 - RNA, 23 nt, Human
aggcugggacauagggagaaaga

SEQ ID NO: 1181732 - RNA, 24 nt, Human
agucccugagggacaacgcacugc

SEQ ID NO: 1181733 - RNA, 22 nt, Human
augagcucaucuuucugggcug

SEQ ID NO: 1181734 - RNA, 24 nt, Human
caacuuggcaagaguaagccgaag

SEQ ID NO: 1181735 - RNA, 21 nt, Human
cacaguuaugcacgacagggc

SEQ ID NO: 1181736 - RNA, 19 nt, Human
cacauccaggcccagcacu

SEQ ID NO: 1181737 - RNA, 19 nt, Human
caccuaaccagauacucac

SEQ ID NO: 1181738 - RNA, 24 nt, Human
caccugccucugcucccucuccug

SEQ ID NO: 1181739 - RNA, 22 nt, Human
cacgacagggcucucugauacc

SEQ ID NO: 1181740 - RNA, 25 nt, Human
cagaguaccuuagggcccacccuaa

SEQ ID NO: 1181741 - RNA, 23 nt, Human
cagauaagacaagggggccucuu

SEQ ID NO: 1181742 - RNA, 23 nt, Human
cagaugacuguacuucguggccc

SEQ ID NO: 1181743 - RNA, 19 nt, Human
cagcagaaagccugggacc

SEQ ID NO: 1181744 - RNA, 19 nt, Human
cagcagagacccugcagac

SEQ ID NO: 1181745 - RNA, 22 nt, Human
cagccugagucccugagggaca

SEQ ID NO: 1181746 - RNA, 21 nt, Human
caggaagcgaggcuggcagug

SEQ ID NO: 1181747 - RNA, 22 nt, Human
caguguccaggguuccaccaca

SEQ ID NO: 1181748 - RNA, 23 nt, Human
caguguccaggguuccaccacau

SEQ ID NO: 1181749 - RNA, 18 nt, Human
caguugccuucuucucgu

SEQ ID NO: 1181750 - RNA, 24 nt, Human
cauaagaagcuggcagaaaugaug

SEQ ID NO: 1181751 - RNA, 18 nt, Human
cauagcucgagcacaacc

SEQ ID NO: 1181752 - RNA, 19 nt, Human
ccaaguccagaugacugua

SEQ ID NO: 1181753 - RNA, 18 nt, Human
ccacauaucccgcacauc

SEQ ID NO: 1181754 - RNA, 18 nt, Human
ccagacccaccuaaccag

SEQ ID NO: 1181755 - RNA, 19 nt, Human
ccaggagcaagauggcagg

SEQ ID NO: 1181756 - RNA, 27 nt, Human
ccaggcccagcacugaaaagccucugc

SEQ ID NO: 1181757 - RNA, 20 nt, Human
cccaaauuaaagcaaugagc

SEQ ID NO: 1181758 - RNA, 18 nt, Human
cccgcacaucucucuccu

SEQ ID NO: 1181759 - RNA, 24 nt, Human
cccuccggauguggcccuggucau

SEQ ID NO: 1181760 - RNA, 19 nt, Human
ccuuaacugaguucuaagg

SEQ ID NO: 1181761 - RNA, 25 nt, Human
cuacacaguuaugcacgacagggcu

SEQ ID NO: 1181762 - RNA, 25 nt, Human
cucacagaauucuggcagaagaugc

SEQ ID NO: 1181763 - RNA, 19 nt, Human
cuccugaaucugguuucug

SEQ ID NO: 1181764 - RNA, 23 nt, Human
cucugcucaaccccuugccugga

SEQ ID NO: 1181765 - RNA, 20 nt, Human
cugaaucugguuucugaggc

SEQ ID NO: 1181766 - RNA, 21 nt, Human
cugcagcccgggaacaccugc

SEQ ID NO: 1181767 - RNA, 19 nt, Human
cugcucccucuccugaucu

SEQ ID NO: 1181768 - RNA, 24 nt, Human
cugggaccguagaaggccuuaacu

SEQ ID NO: 1181769 - RNA, 19 nt, Human
cuuggaagaaggaaggagg

SEQ ID NO: 1181770 - RNA, 18 nt, Human
cuuuccauccuuguauuc

SEQ ID NO: 1181771 - RNA, 19 nt, Human
gaagcugcuccuguccaca

SEQ ID NO: 1181772 - RNA, 22 nt, Human
gaaggagggggugauauuucug

SEQ ID NO: 1181773 - RNA, 23 nt, Human
gagaacaaaggagaugagacagc

SEQ ID NO: 1181774 - RNA, 23 nt, Human
gagcacaaccagaucugagacga

SEQ ID NO: 1181775 - RNA, 24 nt, Human
gcccgggaacaccugccucugcuc

SEQ ID NO: 1181776 - RNA, 20 nt, Human
gcuccuguccacauauagcu

SEQ ID NO: 1181777 - RNA, 19 nt, Human
ggagaucgcugcagcccgg

SEQ ID NO: 1181778 - RNA, 22 nt, Human
gggauccucagccagcaauguc

SEQ ID NO: 1181779 - RNA, 21 nt, Human
gggcacaguucagcccacagc

SEQ ID NO: 1181780 - RNA, 20 nt, Human
ggggugauauuucugaguau

SEQ ID NO: 1181781 - RNA, 24 nt, Human
guggagggcacaguucagcccaca

SEQ ID NO: 1181782 - RNA, 18 nt, Human
gugggguggagggcacag

SEQ ID NO: 1181783 - RNA, 19 nt, Human
guuaugcuagggauccuca

SEQ ID NO: 1181784 - RNA, 18 nt, Human
uaaaaacaccagucagag

SEQ ID NO: 1181785 - RNA, 22 nt, Human
uaaaaacaccagucagaguacc

SEQ ID NO: 1181786 - RNA, 18 nt, Human
uaacuucauacuucagca

SEQ ID NO: 1181787 - RNA, 21 nt, Human
uaagccgaagaagaaaaugca

SEQ ID NO: 1181788 - RNA, 24 nt, Human
uaauagauagguccucgcaucucc

SEQ ID NO: 1181789 - RNA, 18 nt, Human
uacagagaacaaaggaga

SEQ ID NO: 1181790 - RNA, 21 nt, Human
uaccuugaucuccuucccugg

SEQ ID NO: 1181791 - RNA, 23 nt, Human
uagaugaaagucuguugcccccu

SEQ ID NO: 1181792 - RNA, 18 nt, Human
uagcucgagcacaaccag

SEQ ID NO: 1181793 - RNA, 23 nt, Human
uaguagaucagugguugaaaagg

SEQ ID NO: 1181794 - RNA, 24 nt, Human
uauaagauuuccugccuggagauu

SEQ ID NO: 1181795 - RNA, 24 nt, Human
uauagcuuccagucuacugaugcc

SEQ ID NO: 1181796 - RNA, 23 nt, Human
uaucccgcacaucucucuccuug

SEQ ID NO: 1181797 - RNA, 23 nt, Human
uaucuuggaagaaggaaggaggg

SEQ ID NO: 1181798 - RNA, 21 nt, Human
uauuccagacccaccuaacca

SEQ ID NO: 1181799 - RNA, 27 nt, Human
ucacuuaucuuggaagaaggaaggagg

SEQ ID NO: 1181800 - RNA, 18 nt, Human
ucagcccacagcagugca

SEQ ID NO: 1181801 - RNA, 21 nt, Human
ucccuggccucuggagucucu

SEQ ID NO: 1181802 - RNA, 22 nt, Human
ucccuggccucuggagucucug

SEQ ID NO: 1181803 - RNA, 21 nt, Human
ucccuguaaguccuaaucucc

SEQ ID NO: 1181804 - RNA, 23 nt, Human
ucccuguaaguccuaaucuccuc

SEQ ID NO: 1181805 - RNA, 23 nt, Human
uccugaucuguggaugacuacgc

SEQ ID NO: 1181806 - RNA, 22 nt, Human
ucgagcacaaccagaucugaga

SEQ ID NO: 1181807 - RNA, 23 nt, Human
ucgcugcagcccgggaacaccug

SEQ ID NO: 1181808 - RNA, 23 nt, Human
ucugggcugaagugccuuggagc

SEQ ID NO: 1181809 - RNA, 21 nt, Human
ucugguuucugaggcggcugu

SEQ ID NO: 1181810 - RNA, 21 nt, Human
ucuuggaagaaggaaggaggg

SEQ ID NO: 1181811 - RNA, 23 nt, Human
ugaaaagccucugcucaaccccu

SEQ ID NO: 1181812 - RNA, 19 nt, Human
ugaaaagggcugauagaug

SEQ ID NO: 1181813 - RNA, 24 nt, Human
ugaaagucuguugcccccuccgga

SEQ ID NO: 1181814 - RNA, 22 nt, Human
ugacuacgcugcccagcacccc

SEQ ID NO: 1181815 - RNA, 18 nt, Human
ugagaaaaaaaaaagagc

SEQ ID NO: 1181816 - RNA, 18 nt, Human
ugagacgacccccgcuug

SEQ ID NO: 1181817 - RNA, 22 nt, Human
ugagacgacccccgcuugacua

SEQ ID NO: 1181818 - RNA, 20 nt, Human
ugaucuccuucccuggccuc

SEQ ID NO: 1181819 - RNA, 24 nt, Human
ugcaggaagcgaggcuggcagugg

SEQ ID NO: 1181820 - RNA, 18 nt, Human
ugcaguaaagaaaccuau

SEQ ID NO: 1181821 - RNA, 21 nt, Human
ugcccccuccggauguggccc

SEQ ID NO: 1181822 - RNA, 21 nt, Human
ugcccccuccggauguggccc

SEQ ID NO: 1181823 - RNA, 25 nt, Human
ugccucugcucccucuccugaucug

SEQ ID NO: 1181824 - RNA, 18 nt, Human
uggaagaaggaaggaggg

SEQ ID NO: 1181825 - RNA, 19 nt, Human
uggaagaaggaaggagggg

SEQ ID NO: 1181826 - RNA, 19 nt, Human
uggacagaguacacugcca

SEQ ID NO: 1181827 - RNA, 19 nt, Human
uggagugagaaaaaaaaaa

SEQ ID NO: 1181828 - RNA, 20 nt, Human
uggcagcauauaagcuuggu

SEQ ID NO: 1181829 - RNA, 23 nt, Human
uggccucuggagucucugauccu

SEQ ID NO: 1181830 - RNA, 21 nt, Human
ugggaauggacagaguacacu

SEQ ID NO: 1181831 - RNA, 19 nt, Human
ugggaguggacugaacuac

SEQ ID NO: 1181832 - RNA, 19 nt, Human
ugucacauccaggcccagc

SEQ ID NO: 1181833 - RNA, 19 nt, Human
ugugcagaggagguggcca

SEQ ID NO: 1181834 - RNA, 22 nt, Human
ugugcagaggagguggccagau

SEQ ID NO: 1181835 - RNA, 19 nt, Human
uucagcccacagcagugca

SEQ ID NO: 1181836 - RNA, 26 nt, Human
uuccagacccaccuaaccagauacuc

SEQ ID NO: 1181837 - RNA, 18 nt, Human
uucucugugugcucacau

SEQ ID NO: 1181838 - RNA, 19 nt, Human
uugcaguuuuccucucuca

SEQ ID NO: 1181839 - RNA, 22 nt, Human
uugcccccuccggauguggccc

SEQ ID NO: 1181840 - RNA, 23 nt, Human
uuguucugaccacaaggcuguga

SEQ ID NO: 1181841 - RNA, 19 nt, Human
uuuaacuuuuuuaaacuca

SEQ ID NO: 1181842 - RNA, 19 nt, Human
uuuccucucucaugacugu

SEQ ID NO: 1181843 - RNA, 26 nt, Human
aaaagcaccugcugcaccauaagccc

SEQ ID NO: 1181844 - RNA, 24 nt, Human
aaaguuuuauccgcuuucccauau

SEQ ID NO: 1181845 - RNA, 22 nt, Human
aaccgaauguguccagggaugu

SEQ ID NO: 1181846 - RNA, 21 nt, Human
aaguccaagugagggagcuag

SEQ ID NO: 1181847 - RNA, 26 nt, Human
accaguuccggaagaaccugcgggac

SEQ ID NO: 1181848 - RNA, 22 nt, Human
accccagggccccugcuguccu

SEQ ID NO: 1181849 - RNA, 24 nt, Human
accugggaugggguggggacaggc

SEQ ID NO: 1181850 - RNA, 18 nt, Human
agacugugcucccuuugg

SEQ ID NO: 1181851 - RNA, 19 nt, Human
agcugggugcagacugugc

SEQ ID NO: 1181852 - RNA, 23 nt, Human
agggauguggcagcugccgcggg

SEQ ID NO: 1181853 - RNA, 24 nt, Human
auuuggucuccaggugucaccuuu

SEQ ID NO: 1181854 - RNA, 26 nt, Human
caccauaagcccagggauguggcagc

SEQ ID NO: 1181855 - RNA, 21 nt, Human
cagcgccucccaguggccaga

SEQ ID NO: 1181856 - RNA, 21 nt, Human
ccaagugagggagcuagggac

SEQ ID NO: 1181857 - RNA, 18 nt, Human
ccccagggccccugcugu

SEQ ID NO: 1181858 - RNA, 18 nt, Human
cccguuggagucguguau

SEQ ID NO: 1181859 - RNA, 21 nt, Human
ccugaaggcaagcuaaaccag

SEQ ID NO: 1181860 - RNA, 24 nt, Human
ccugcauuuggucuccagguguca

SEQ ID NO: 1181861 - RNA, 19 nt, Human
cuaaaaccccagggccccu

SEQ ID NO: 1181862 - RNA, 24 nt, Human
cugauuuggaauuuaacauucucc

SEQ ID NO: 1181863 - RNA, 23 nt, Human
cuuccugucuucuucuguucuuc

SEQ ID NO: 1181864 - RNA, 22 nt, Human
cuuuccugauccugaaggcaag

SEQ ID NO: 1181865 - RNA, 18 nt, Human
cuuuucucaaacuuuccu

SEQ ID NO: 1181866 - RNA, 18 nt, Human
gaaccgaauguguccagg

SEQ ID NO: 1181867 - RNA, 18 nt, Human
gaaccgaguguguccagg

SEQ ID NO: 1181868 - RNA, 18 nt, Human
gaagggucucaaguccaa

SEQ ID NO: 1181869 - RNA, 22 nt, Human
gagcuuggcuuugugaggaacc

SEQ ID NO: 1181870 - RNA, 23 nt, Human
gagggagcuagggacuugggagg

SEQ ID NO: 1181871 - RNA, 21 nt, Human
gcacccacaugcuuagauagc

SEQ ID NO: 1181872 - RNA, 18 nt, Human
gcagcugcagcgagcuug

SEQ ID NO: 1181873 - RNA, 18 nt, Human
gcagcugcagcgggcuug

SEQ ID NO: 1181874 - RNA, 18 nt, Human
gcagcugccgcgggcuug

SEQ ID NO: 1181875 - RNA, 20 nt, Human
gcagcugccgcgggcuuggc

SEQ ID NO: 1181876 - RNA, 19 nt, Human
gcuaaaaccccagggcccc

SEQ ID NO: 1181877 - RNA, 22 nt, Human
ggaauuuaacauucuccaaaca

SEQ ID NO: 1181878 - RNA, 22 nt, Human
ggagcuagggacuugggagggg

SEQ ID NO: 1181879 - RNA, 20 nt, Human
ggccagaggcuaaaacccca

SEQ ID NO: 1181880 - RNA, 19 nt, Human
gggaugggguggggacagg

SEQ ID NO: 1181881 - RNA, 20 nt, Human
gggaugggguggggacaggc

SEQ ID NO: 1181882 - RNA, 21 nt, Human
ggugcagacugugcuccccgg

SEQ ID NO: 1181883 - RNA, 22 nt, Human
ggugugaagggucucaagucca

SEQ ID NO: 1181884 - RNA, 18 nt, Human
gucaccuuucugccaugu

SEQ ID NO: 1181885 - RNA, 22 nt, Human
gucuucuucuguucuucacgcc

SEQ ID NO: 1181886 - RNA, 22 nt, Human
guucugugacuucccugugacc

SEQ ID NO: 1181887 - RNA, 21 nt, Human
guuggcccugauuucuucuuu

SEQ ID NO: 1181888 - RNA, 21 nt, Human
uauuagagggcagauuguggu

SEQ ID NO: 1181889 - RNA, 19 nt, Human
uccaagugagggagcuagg

SEQ ID NO: 1181890 - RNA, 19 nt, Human
uccaagugagggagcuagg

SEQ ID NO: 1181891 - RNA, 23 nt, Human
ucucaaguccaagugagggagcu

SEQ ID NO: 1181892 - RNA, 19 nt, Human
ucucagaaaugcuuccugu

SEQ ID NO: 1181893 - RNA, 21 nt, Human
ucuucuguucuucacgcccca

SEQ ID NO: 1181894 - RNA, 22 nt, Human
ucuucuucuguucuucacgccc

SEQ ID NO: 1181895 - RNA, 22 nt, Human
ugaagggucucaaguccaagug

SEQ ID NO: 1181896 - RNA, 21 nt, Human
ugaaugacccgggaagcugug

SEQ ID NO: 1181897 - RNA, 19 nt, Human
ugaccucugcaguacuccu

SEQ ID NO: 1181898 - RNA, 18 nt, Human
ugacuucccugugaccuc

SEQ ID NO: 1181899 - RNA, 18 nt, Human
ugagggagcuagggacuu

SEQ ID NO: 1181900 - RNA, 18 nt, Human
ugaugggaugagagcugg

SEQ ID NO: 1181901 - RNA, 19 nt, Human
ugaugggaugagagcuggg

SEQ ID NO: 1181902 - RNA, 20 nt, Human
ugcauuuggucuccaggugu

SEQ ID NO: 1181903 - RNA, 22 nt, Human
ugcugcaccauaagcccaggga

SEQ ID NO: 1181904 - RNA, 19 nt, Human
uggcagcugcagcgagcuu

SEQ ID NO: 1181905 - RNA, 19 nt, Human
uggcagcugccgcgggcuu

SEQ ID NO: 1181906 - RNA, 20 nt, Human
ugggaugagagcugggugca

SEQ ID NO: 1181907 - RNA, 18 nt, Human
ugggaugggguggggaca

SEQ ID NO: 1181908 - RNA, 19 nt, Human
ugggguggggacaggcaau

SEQ ID NO: 1181909 - RNA, 24 nt, Human
ugggguggggacaggcaaugaggu

SEQ ID NO: 1181910 - RNA, 18 nt, Human
ugggucggggagcugggg

SEQ ID NO: 1181911 - RNA, 24 nt, Human
ugggugcagacugugcucccuuug

SEQ ID NO: 1181912 - RNA, 23 nt, Human
uggugaccugggauggggugggg

SEQ ID NO: 1181913 - RNA, 20 nt, Human
ugugaagggucucaagucca

SEQ ID NO: 1181914 - RNA, 22 nt, Human
ugugaggaaccgaaugugucca

SEQ ID NO: 1181915 - RNA, 24 nt, Human
uguggcagcugcagcgggcuuggc

SEQ ID NO: 1181916 - RNA, 26 nt, Human
ugugguuggcccugauuucuucuuug

SEQ ID NO: 1181917 - RNA, 23 nt, Human
uuccaguccaaugaaaguuuuau

SEQ ID NO: 1181918 - RNA, 24 nt, Human
uucccauauaaaaauucuucccac

SEQ ID NO: 1181919 - RNA, 19 nt, Human
uuccggaagaaccugcggg

SEQ ID NO: 1181920 - RNA, 20 nt, Human
uucuucuguucuucacgccc

SEQ ID NO: 1181921 - RNA, 23 nt, Human
uuuauccgcuuucccauauaaaa

SEQ ID NO: 1181922 - RNA, 19 nt, Human
uuuuuuuggaguuucaggg

SEQ ID NO: 1181923 - RNA, 24 nt, Human
aaagucccaaagaaagaaagcagg

SEQ ID NO: 1181924 - RNA, 24 nt, Human
aaagugcugggauuacaggcguga

SEQ ID NO: 1181925 - RNA, 20 nt, Human
aaccuccaccucccuggcuc

SEQ ID NO: 1181926 - RNA, 22 nt, Human
aagaagaaccaucauagagcac

SEQ ID NO: 1181927 - RNA, 30 nt, Human
aagcaggaaauaauaauucuauaauccaag

SEQ ID NO: 1181928 - RNA, 22 nt, Human
aaguaaaaaacauaaugcagga

SEQ ID NO: 1181929 - RNA, 19 nt, Human
aagugcugggauuacaggc

SEQ ID NO: 1181930 - RNA, 19 nt, Human
aagugcugggauuacaggc

SEQ ID NO: 1181931 - RNA, 26 nt, Human
aagugcugggauuacaggcgugagcc

SEQ ID NO: 1181932 - RNA, 21 nt, Human
aaguggcauuucagagcacag

SEQ ID NO: 1181933 - RNA, 24 nt, Human
acacaccuguaucuccuucauaca

SEQ ID NO: 1181934 - RNA, 24 nt, Human
acagggucucgcccguugcccagg

SEQ ID NO: 1181935 - RNA, 18 nt, Human
accccagguccuagcagc

SEQ ID NO: 1181936 - RNA, 18 nt, Human
acgggguuuugccauguu

SEQ ID NO: 1181937 - RNA, 23 nt, Human
acgggguuuugccauguuggcca

SEQ ID NO: 1181938 - RNA, 24 nt, Human
acgggguuuugccauguuggccag

SEQ ID NO: 1181939 - RNA, 20 nt, Human
acugaguccucagggacagu

SEQ ID NO: 1181940 - RNA, 22 nt, Human
agacagggucucgcccguugcc

SEQ ID NO: 1181941 - RNA, 23 nt, Human
agcaccacucuccccagggcacu

SEQ ID NO: 1181942 - RNA, 22 nt, Human
agcagcagcagaagccaggcac

SEQ ID NO: 1181943 - RNA, 24 nt, Human
agcgauucuugugccucagccucc

SEQ ID NO: 1181944 - RNA, 20 nt, Human
aggcacccuugagucaauug

SEQ ID NO: 1181945 - RNA, 18 nt, Human
agugcugggauuacaggc

SEQ ID NO: 1181946 - RNA, 24 nt, Human
auaauaauucuauaauccaaaaac

SEQ ID NO: 1181947 - RNA, 23 nt, Human
auauggacugagucacacacccc

SEQ ID NO: 1181948 - RNA, 26 nt, Human
auccuugugaacacugcagaucucua

SEQ ID NO: 1181949 - RNA, 23 nt, Human
auggaccuuccucccucugcccc

SEQ ID NO: 1181950 - RNA, 19 nt, Human
augugcacacacaccugua

SEQ ID NO: 1181951 - RNA, 25 nt, Human
augugcacacacaccuguaucuccu

SEQ ID NO: 1181952 - RNA, 25 nt, Human
auuucuguauuuuuuaguagagacg

SEQ ID NO: 1181953 - RNA, 24 nt, Human
caaagugcugggauuacaggcgug

SEQ ID NO: 1181954 - RNA, 19 nt, Human
caaauauauacauguaccu

SEQ ID NO: 1181955 - RNA, 28 nt, Human
caagcgauucuugugccucagccucccg

SEQ ID NO: 1181956 - RNA, 22 nt, Human
caagugauucacccgccucagc

SEQ ID NO: 1181957 - RNA, 22 nt, Human
caccccagguccuagcagcaga

SEQ ID NO: 1181958 - RNA, 23 nt, Human
cacccgccucagccucccaaagu

SEQ ID NO: 1181959 - RNA, 20 nt, Human
caccgcguccagccauacau

SEQ ID NO: 1181960 - RNA, 22 nt, Human
cagcagacaucuccaaaccaac

SEQ ID NO: 1181961 - RNA, 18 nt, Human
cagcagcagaagccaggc

SEQ ID NO: 1181962 - RNA, 28 nt, Human
cagcagcagaagccaggcacccuugagu

SEQ ID NO: 1181963 - RNA, 19 nt, Human
cagcagcagcagaagccag

SEQ ID NO: 1181964 - RNA, 21 nt, Human
cagcucuccaauggaagaaga

SEQ ID NO: 1181965 - RNA, 23 nt, Human
cagcugucugccaccacacccag

SEQ ID NO: 1181966 - RNA, 23 nt, Human
cagggucucgcccguugcccagg

SEQ ID NO: 1181967 - RNA, 24 nt, Human
cauguuggccaggcuggucucgaa

SEQ ID NO: 1181968 - RNA, 27 nt, Human
ccaaagaaauucaaaagucccaaagaa

SEQ ID NO: 1181969 - RNA, 22 nt, Human
ccaaagugcugggauuacaggc

SEQ ID NO: 1181970 - RNA, 22 nt, Human
ccaaagugcugggauuacaggc

SEQ ID NO: 1181971 - RNA, 24 nt, Human
ccaaagugcugggauuacaggcgu

SEQ ID NO: 1181972 - RNA, 19 nt, Human
ccauguuggccaggcuggu

SEQ ID NO: 1181973 - RNA, 20 nt, Human
cccagauaaccccuccccca

SEQ ID NO: 1181974 - RNA, 25 nt, Human
cccagcagcagcagaagccaggcac

SEQ ID NO: 1181975 - RNA, 19 nt, Human
cccccaaaacugaguccuc

SEQ ID NO: 1181976 - RNA, 19 nt, Human
cccguugcccaggcuggag

SEQ ID NO: 1181977 - RNA, 24 nt, Human
cccguugcccaggcuggagugcaa

SEQ ID NO: 1181978 - RNA, 20 nt, Human
cccuggcucaagcgauucuu

SEQ ID NO: 1181979 - RNA, 23 nt, Human
ccgccucagccucccaaagugcu

SEQ ID NO: 1181980 - RNA, 22 nt, Human
ccuucaguuggaggaagagggc

SEQ ID NO: 1181981 - RNA, 18 nt, Human
ccuuccucccucugcccc

SEQ ID NO: 1181982 - RNA, 20 nt, Human
cgauucuugugccucagccu

SEQ ID NO: 1181983 - RNA, 23 nt, Human
cgcccguugcccaggcuggagug

SEQ ID NO: 1181984 - RNA, 24 nt, Human
cgccucagccucccaaagugcugg

SEQ ID NO: 1181985 - RNA, 20 nt, Human
cgcguccagccauacaugua

SEQ ID NO: 1181986 - RNA, 24 nt, Human
cgggguuuugccauguuggccagg

SEQ ID NO: 1181987 - RNA, 20 nt, Human
cguugcccaggcuggagugc

SEQ ID NO: 1181988 - RNA, 23 nt, Human
cucaagcgauucuugugccucag

SEQ ID NO: 1181989 - RNA, 25 nt, Human
cucacugcaaccuccaccucccugg

SEQ ID NO: 1181990 - RNA, 24 nt, Human
cuccugaccucaaucaagugauuc

SEQ ID NO: 1181991 - RNA, 24 nt, Human
cucgcccguugcccaggcuggagu

SEQ ID NO: 1181992 - RNA, 18 nt, Human
cugcaaccuccaccuccc

SEQ ID NO: 1181993 - RNA, 24 nt, Human
cuggagugcaaugaugugaucuca

SEQ ID NO: 1181994 - RNA, 26 nt, Human
cuucucccagauaaccccucccccaa

SEQ ID NO: 1181995 - RNA, 23 nt, Human
cuugugccucagccucccgagca

SEQ ID NO: 1181996 - RNA, 22 nt, Human
gaagaaccaucauagagcacca

SEQ ID NO: 1181997 - RNA, 28 nt, Human
gaccucaaucaagugauucacccgccuc

SEQ ID NO: 1181998 - RNA, 24 nt, Human
gagacgggguuuugccauguuggc

SEQ ID NO: 1181999 - RNA, 26 nt, Human
gagcagcugagauuacagcugucugc

SEQ ID NO: 1182000 - RNA, 18 nt, Human
gaggaagagggcgucagu

SEQ ID NO: 1182001 - RNA, 18 nt, Human
gauuacaggcgugagcca

SEQ ID NO: 1182002 - RNA, 22 nt, Human
gauuacaggcgugagccaccgc

SEQ ID NO: 1182003 - RNA, 22 nt, Human
gauuacaggcgugagccaccgc

SEQ ID NO: 1182004 - RNA, 21 nt, Human
gauucacccgccucagccucc

SEQ ID NO: 1182005 - RNA, 19 nt, Human
gcaugugcacacacaccug

SEQ ID NO: 1182006 - RNA, 20 nt, Human
gccauguuggccaggcuggu

SEQ ID NO: 1182007 - RNA, 24 nt, Human
gccauguuggccaggcuggucucg

SEQ ID NO: 1182008 - RNA, 19 nt, Human
gcccaggcuggagugcaau

SEQ ID NO: 1182009 - RNA, 21 nt, Human
gccucccgagcagcugagauu

SEQ ID NO: 1182010 - RNA, 24 nt, Human
gcgauucuugugccucagccuccc

SEQ ID NO: 1182011 - RNA, 23 nt, Human
gcuggucucgaacuccugaccuc

SEQ ID NO: 1182012 - RNA, 24 nt, Human
ggcuggucucgaacuccugaccuc

SEQ ID NO: 1182013 - RNA, 28 nt, Human
gggcacuuggacuaucacaguaaaaaua

SEQ ID NO: 1182014 - RNA, 23 nt, Human
gggguuuugccauguuggccagg

SEQ ID NO: 1182015 - RNA, 19 nt, Human
ggucucgaacuccugaccu

SEQ ID NO: 1182016 - RNA, 23 nt, Human
guagagacgggguuuugccaugu

SEQ ID NO: 1182017 - RNA, 24 nt, Human
gucucgcccguugcccaggcugga

SEQ ID NO: 1182018 - RNA, 24 nt, Human
gugauucacccgccucagccuccc

SEQ ID NO: 1182019 - RNA, 22 nt, Human
gugcaggaaugcuauaaacuga

SEQ ID NO: 1182020 - RNA, 22 nt, Human
gugccucagccucccgagcagc

SEQ ID NO: 1182021 - RNA, 23 nt, Human
gugccucagccucccgagcagcu

SEQ ID NO: 1182022 - RNA, 18 nt, Human
gugggagggaggauggug

SEQ ID NO: 1182023 - RNA, 19 nt, Human
guguuguaggaaauguugg

SEQ ID NO: 1182024 - RNA, 18 nt, Human
uaaccccucccccaaaac

SEQ ID NO: 1182025 - RNA, 26 nt, Human
uaaguagcucacacaguagauaugga

SEQ ID NO: 1182026 - RNA, 21 nt, Human
uaaguucuccaccuaaggcaa

SEQ ID NO: 1182027 - RNA, 25 nt, Human
uaauuucuguauuuuuuaguagaga

SEQ ID NO: 1182028 - RNA, 24 nt, Human
uacagcugucugccaccacaccca

SEQ ID NO: 1182029 - RNA, 24 nt, Human
uacaggcgugagccaccgcgucca

SEQ ID NO: 1182030 - RNA, 20 nt, Human
uacaguauguggcugagcau

SEQ ID NO: 1182031 - RNA, 22 nt, Human
uaccggcaugugcacacacacc

SEQ ID NO: 1182032 - RNA, 22 nt, Human
uagagacgggguuuugccaugu

SEQ ID NO: 1182033 - RNA, 20 nt, Human
uagcaaaacugagaagcaca

SEQ ID NO: 1182034 - RNA, 19 nt, Human
uaggauucuccagugcucc

SEQ ID NO: 1182035 - RNA, 24 nt, Human
uaguagagacgggguuuugccaug

SEQ ID NO: 1182036 - RNA, 21 nt, Human
uauauacauguaccuuuucuu

SEQ ID NO: 1182037 - RNA, 21 nt, Human
uaucaaguaaaaaacauaaug

SEQ ID NO: 1182038 - RNA, 22 nt, Human
ucaagugauucacccgccucag

SEQ ID NO: 1182039 - RNA, 18 nt, Human
ucaauuguccuucauuga

SEQ ID NO: 1182040 - RNA, 19 nt, Human
ucacugcaaccuccaccuc

SEQ ID NO: 1182041 - RNA, 24 nt, Human
ucacugcaaccuccaccucccugg

SEQ ID NO: 1182042 - RNA, 25 nt, Human
ucacugcaaccuccaccucccuggc

SEQ ID NO: 1182043 - RNA, 27 nt, Human
ucacugcaaccuccaccucccuggcuc

SEQ ID NO: 1182044 - RNA, 24 nt, Human
ucauggaccuuccucccucugccc

SEQ ID NO: 1182045 - RNA, 20 nt, Human
uccagguuaucuacuuuggg

SEQ ID NO: 1182046 - RNA, 24 nt, Human
ucccaaagugcugggauuacaggc

SEQ ID NO: 1182047 - RNA, 20 nt, Human
ucccagauaaccccuccccc

SEQ ID NO: 1182048 - RNA, 23 nt, Human
ucccucugccccguugagcuccc

SEQ ID NO: 1182049 - RNA, 20 nt, Human
ucccuggcucaagcgauucu

SEQ ID NO: 1182050 - RNA, 24 nt, Human
uccuccacccagaugucccucuca

SEQ ID NO: 1182051 - RNA, 19 nt, Human
ucgggguccacagcuguuc

SEQ ID NO: 1182052 - RNA, 20 nt, Human
ucucccagauaaccccuccc

SEQ ID NO: 1182053 - RNA, 19 nt, Human
ucucgaacuccugaccuca

SEQ ID NO: 1182054 - RNA, 21 nt, Human
ucucgcccguugcccaggcug

SEQ ID NO: 1182055 - RNA, 22 nt, Human
ucucgcccguugcccaggcugg

SEQ ID NO: 1182056 - RNA, 23 nt, Human
ucucgcccguugcccaggcugga

SEQ ID NO: 1182057 - RNA, 21 nt, Human
ucuuucuuucuuuuuuuugaa

SEQ ID NO: 1182058 - RNA, 22 nt, Human
ucuuuuuuuugagacagggucu

SEQ ID NO: 1182059 - RNA, 21 nt, Human
ugagacagggucucgcccguu

SEQ ID NO: 1182060 - RNA, 24 nt, Human
ugagauuacagcugucugccacca

SEQ ID NO: 1182061 - RNA, 23 nt, Human
ugcaaugaugugaucucagcucc

SEQ ID NO: 1182062 - RNA, 24 nt, Human
ugccauguuggccaggcuggucuc

SEQ ID NO: 1182063 - RNA, 27 nt, Human
ugccauguuggccaggcuggucucgaa

SEQ ID NO: 1182064 - RNA, 18 nt, Human
ugcccaggcuggagugca

SEQ ID NO: 1182065 - RNA, 21 nt, Human
ugcccaggcuggagugcaaug

SEQ ID NO: 1182066 - RNA, 22 nt, Human
ugcccaggcuggagugcaauga

SEQ ID NO: 1182067 - RNA, 24 nt, Human
ugcccaggcuggagugcaaugaug

SEQ ID NO: 1182068 - RNA, 24 nt, Human
ugccucagccucccgagcagcuga

SEQ ID NO: 1182069 - RNA, 24 nt, Human
ugcugggauuacaggcgugagcca

SEQ ID NO: 1182070 - RNA, 22 nt, Human
uggaagaagaaccaucauagag

SEQ ID NO: 1182071 - RNA, 23 nt, Human
uggaggaagagggcgucaguuaa

SEQ ID NO: 1182072 - RNA, 19 nt, Human
uggagugcaaugaugugau

SEQ ID NO: 1182073 - RNA, 21 nt, Human
uggcaaagggcagacuuacuc

SEQ ID NO: 1182074 - RNA, 24 nt, Human
uggccaggcuggucucgaacuccu

SEQ ID NO: 1182075 - RNA, 24 nt, Human
uggcugagcaucauggaccuuccu

SEQ ID NO: 1182076 - RNA, 18 nt, Human
ugggaggugcaggaaugc

SEQ ID NO: 1182077 - RNA, 25 nt, Human
ugggaggugcaggaaugcuauaaac

SEQ ID NO: 1182078 - RNA, 18 nt, Human
ugggauuacaggcgugag

SEQ ID NO: 1182079 - RNA, 19 nt, Human
ugggauuacaggcgugagc

SEQ ID NO: 1182080 - RNA, 21 nt, Human
ugggauuacaggcgugagcca

SEQ ID NO: 1182081 - RNA, 22 nt, Human
ugggauuacaggcgugagccac

SEQ ID NO: 1182082 - RNA, 23 nt, Human
ugggauuacaggcgugagccacc

SEQ ID NO: 1182083 - RNA, 24 nt, Human
ugggauuacaggcgugagccaccg

SEQ ID NO: 1182084 - RNA, 21 nt, Human
uguaccuuuucuuucuuucuu

SEQ ID NO: 1182085 - RNA, 18 nt, Human
uguuguaggaaauguugg

SEQ ID NO: 1182086 - RNA, 18 nt, Human
uuagcaaaacugagaagc

SEQ ID NO: 1182087 - RNA, 18 nt, Human
uuaguagagacgggguuu

SEQ ID NO: 1182088 - RNA, 22 nt, Human
uuaguagagacgggguuuugcc

SEQ ID NO: 1182089 - RNA, 24 nt, Human
uuaguagagacgggguuuugccau

SEQ ID NO: 1182090 - RNA, 24 nt, Human
uuaguaguucuagaaaaagaaaaa

SEQ ID NO: 1182091 - RNA, 21 nt, Human
uucaaaagucccaaagaaaga

SEQ ID NO: 1182092 - RNA, 21 nt, Human
uucacccgccucagccuccca

SEQ ID NO: 1182093 - RNA, 19 nt, Human
uucauuguccagagcuacc

SEQ ID NO: 1182094 - RNA, 20 nt, Human
uucuuuuuuuugagacaggg

SEQ ID NO: 1182095 - RNA, 21 nt, Human
uugagacagggucucgcccgu

SEQ ID NO: 1182096 - RNA, 24 nt, Human
uugccauguuggccaggcuggucu

SEQ ID NO: 1182097 - RNA, 18 nt, Human
uugcccaggcuggagugc

SEQ ID NO: 1182098 - RNA, 21 nt, Human
uuucuguauuuuuuaguagag

SEQ ID NO: 1182099 - RNA, 21 nt, Human
uuucuuuuuuuugagacaggg

SEQ ID NO: 1182100 - RNA, 25 nt, Human
uuucuuuuuuuugagacagggucuc

SEQ ID NO: 1182101 - RNA, 23 nt, Human
uuuugccauguuggccaggcugg

SEQ ID NO: 1182102 - RNA, 24 nt, Human
uuuuuaguagagacgggguuuugc

SEQ ID NO: 1182103 - RNA, 22 nt, Human
uuuuuuaguagagacgggguuu

SEQ ID NO: 1182104 - RNA, 23 nt, Human
acauaaaucuggaacuaccacca

SEQ ID NO: 1182105 - RNA, 18 nt, Human
agguagggcccuggccug

SEQ ID NO: 1182106 - RNA, 21 nt, Human
cagaggcugaaucccauuugu

SEQ ID NO: 1182107 - RNA, 21 nt, Human
cauaaaucuggaacuaccacc

SEQ ID NO: 1182108 - RNA, 20 nt, Human
ccacauaaaucuggaacuac

SEQ ID NO: 1182109 - RNA, 23 nt, Human
cucgugguccucuggcgcccucu

SEQ ID NO: 1182110 - RNA, 22 nt, Human
gaaaaacaaaguaacauccaca

SEQ ID NO: 1182111 - RNA, 24 nt, Human
ggcgcccucugcuggccgcucgcg

SEQ ID NO: 1182112 - RNA, 25 nt, Human
gggaaaaacaaaguaacauccacau

SEQ ID NO: 1182113 - RNA, 22 nt, Human
uaaauaauauauuuuauaggga

SEQ ID NO: 1182114 - RNA, 23 nt, Human
uggaacuaccaccacuuuccaga

SEQ ID NO: 1182115 - RNA, 21 nt, Human
acuuucuucucucuguuuucc

SEQ ID NO: 1182116 - RNA, 18 nt, Human
cacaaggucaaucuugga

SEQ ID NO: 1182117 - RNA, 20 nt, Human
caucugaagaguaacuagcc

SEQ ID NO: 1182118 - RNA, 18 nt, Human
cccaagucacacgcaaga

SEQ ID NO: 1182119 - RNA, 21 nt, Human
ccuuucuucuuucucuuuucc

SEQ ID NO: 1182120 - RNA, 18 nt, Human
cuucaauaauuaccaaca

SEQ ID NO: 1182121 - RNA, 24 nt, Human
cuuccccuuucuucuuucucuuuu

SEQ ID NO: 1182122 - RNA, 23 nt, Human
uaacauaggauaaacggcuuccc

SEQ ID NO: 1182123 - RNA, 22 nt, Human
uagcauggacuuuuucaaauau

SEQ ID NO: 1182124 - RNA, 19 nt, Human
ucagaaugaugguguguuu

SEQ ID NO: 1182125 - RNA, 23 nt, Human
ucaucugaagaguaacuagccau

SEQ ID NO: 1182126 - RNA, 18 nt, Human
uccccuuucuucuuucuc

SEQ ID NO: 1182127 - RNA, 20 nt, Human
uccggggcccgcaggggagc

SEQ ID NO: 1182128 - RNA, 21 nt, Human
uuuccugaauuuuucuuuuuu

SEQ ID NO: 1182129 - RNA, 19 nt, Human
uuucuuucuuccccuuucu

SEQ ID NO: 1182130 - RNA, 22 nt, Human
uuuuucagaaugaugguguguu

SEQ ID NO: 1182131 - RNA, 22 nt, Human
aaacaaaauuaaguacaaccuc

SEQ ID NO: 1182132 - RNA, 23 nt, Human
aacagaccaaaauaacuauggua

SEQ ID NO: 1182133 - RNA, 20 nt, Human
aagcacaagaacugccaaga

SEQ ID NO: 1182134 - RNA, 26 nt, Human
aagcagaaacuauuuaguagaggcaa

SEQ ID NO: 1182135 - RNA, 22 nt, Human
acaaaacaaaaaaauugaacag

SEQ ID NO: 1182136 - RNA, 18 nt, Human
acaccguucccuacgcac

SEQ ID NO: 1182137 - RNA, 26 nt, Human
acuagaaacuccaauccaaacugcaa

SEQ ID NO: 1182138 - RNA, 23 nt, Human
acuuacuuaacagaccaaaauaa

SEQ ID NO: 1182139 - RNA, 23 nt, Human
agaacugccaagaugaucauuca

SEQ ID NO: 1182140 - RNA, 19 nt, Human
agcaaaaaggauauucugc

SEQ ID NO: 1182141 - RNA, 20 nt, Human
auaaaacaacaguagcugag

SEQ ID NO: 1182142 - RNA, 22 nt, Human
augaggauuuuacccaaaacca

SEQ ID NO: 1182143 - RNA, 20 nt, Human
auggucucuuucugcgcucu

SEQ ID NO: 1182144 - RNA, 21 nt, Human
caaaaccaaccuuagaaacaa

SEQ ID NO: 1182145 - RNA, 25 nt, Human
caaaaccaaccuuagaaacaaacaa

SEQ ID NO: 1182146 - RNA, 20 nt, Human
caaaggguuguccagcucua

SEQ ID NO: 1182147 - RNA, 24 nt, Human
caaaggguuguccagcucuaacac

SEQ ID NO: 1182148 - RNA, 20 nt, Human
caaaguaaaagcacaagaac

SEQ ID NO: 1182149 - RNA, 23 nt, Human
caagaaaaaccauguaaccaagg

SEQ ID NO: 1182150 - RNA, 24 nt, Human
caccguucccuacgcacacucgug

SEQ ID NO: 1182151 - RNA, 20 nt, Human
cacugugcucauacuggggg

SEQ ID NO: 1182152 - RNA, 21 nt, Human
cacugugcucauacuggggga

SEQ ID NO: 1182153 - RNA, 26 nt, Human
cagagauagauuuaaaacaaaacaaa

SEQ ID NO: 1182154 - RNA, 20 nt, Human
caggccccuacaucuagucc

SEQ ID NO: 1182155 - RNA, 22 nt, Human
caucgacucucccuaggcuauu

SEQ ID NO: 1182156 - RNA, 20 nt, Human
ccauuugggagcagguuuau

SEQ ID NO: 1182157 - RNA, 21 nt, Human
cccaaaaccaaccuuagaaac

SEQ ID NO: 1182158 - RNA, 20 nt, Human
ccccaccugugaaucugccc

SEQ ID NO: 1182159 - RNA, 23 nt, Human
ccccacuauuuuccucccauccu

SEQ ID NO: 1182160 - RNA, 22 nt, Human
ccucccgcgaauaaagacacac

SEQ ID NO: 1182161 - RNA, 25 nt, Human
ccuugaaaagaggcugaagucuccu

SEQ ID NO: 1182162 - RNA, 23 nt, Human
cuaacacacuucaauucuguuuu

SEQ ID NO: 1182163 - RNA, 19 nt, Human
cuacaccguucccuacgca

SEQ ID NO: 1182164 - RNA, 20 nt, Human
cuaguccaaauaggcaacac

SEQ ID NO: 1182165 - RNA, 21 nt, Human
cucguggggucucucggaccu

SEQ ID NO: 1182166 - RNA, 24 nt, Human
cugcugcauuucugguugggggag

SEQ ID NO: 1182167 - RNA, 23 nt, Human
cuuccauuugcuguucaccugcc

SEQ ID NO: 1182168 - RNA, 22 nt, Human
cuugucuuuucaucuguuuggu

SEQ ID NO: 1182169 - RNA, 23 nt, Human
cuuuccacuucauuucaucacaa

SEQ ID NO: 1182170 - RNA, 22 nt, Human
gaaucugccacuuccuucuucc

SEQ ID NO: 1182171 - RNA, 20 nt, Human
gacaacaggggacugagaaa

SEQ ID NO: 1182172 - RNA, 20 nt, Human
gccucccgcgaauaaagacu

SEQ ID NO: 1182173 - RNA, 21 nt, Human
gccugcugacaguggccuccc

SEQ ID NO: 1182174 - RNA, 19 nt, Human
gccuugaaaagaggcugaa

SEQ ID NO: 1182175 - RNA, 21 nt, Human
gcgcucuuuaccaaagaaagg

SEQ ID NO: 1182176 - RNA, 19 nt, Human
gcuaaagggauguuuggau

SEQ ID NO: 1182177 - RNA, 19 nt, Human
gcuguucaccugccaccug

SEQ ID NO: 1182178 - RNA, 23 nt, Human
ggaaagccuugaaaagaggcuga

SEQ ID NO: 1182179 - RNA, 21 nt, Human
ggaaggaaacaaauuuaauaa

SEQ ID NO: 1182180 - RNA, 18 nt, Human
ggaaggaugauuuugcuc

SEQ ID NO: 1182181 - RNA, 23 nt, Human
ggagggggaagcacaggaauggg

SEQ ID NO: 1182182 - RNA, 22 nt, Human
ggcacugggggucacugccugc

SEQ ID NO: 1182183 - RNA, 19 nt, Human
gggaaaggagcacaaaaug

SEQ ID NO: 1182184 - RNA, 26 nt, Human
uaaaacaacaguagcugagguaguua

SEQ ID NO: 1182185 - RNA, 20 nt, Human
uaaaagcacaagaacugcca

SEQ ID NO: 1182186 - RNA, 24 nt, Human
uaaaauaacuggagaauuaagaac

SEQ ID NO: 1182187 - RNA, 20 nt, Human
uaauuaucauuacuagaaac

SEQ ID NO: 1182188 - RNA, 23 nt, Human
uacaucaaauacuccacacacug

SEQ ID NO: 1182189 - RNA, 18 nt, Human
uacaucagaauauuagug

SEQ ID NO: 1182190 - RNA, 23 nt, Human
uacccaaaaccaaccuuagaaac

SEQ ID NO: 1182191 - RNA, 30 nt, Human
uacccaaaaccaaccuuagaaacaaacaag

SEQ ID NO: 1182192 - RNA, 21 nt, Human
uacuccacacacugugcuuca

SEQ ID NO: 1182193 - RNA, 26 nt, Human
uagaaacaaacaaacaaaauuaagua

SEQ ID NO: 1182194 - RNA, 22 nt, Human
uaggaaggaugauuuugcucuu

SEQ ID NO: 1182195 - RNA, 20 nt, Human
uaguacagacgaaguuugua

SEQ ID NO: 1182196 - RNA, 20 nt, Human
uaguagaggcaagguucuca

SEQ ID NO: 1182197 - RNA, 22 nt, Human
uccccaugacauacucgcccca

SEQ ID NO: 1182198 - RNA, 23 nt, Human
ucuaaauaaaacaacaguagcug

SEQ ID NO: 1182199 - RNA, 23 nt, Human
ucuccuuucuuccagugaugaga

SEQ ID NO: 1182200 - RNA, 22 nt, Human
ucucuacuugucuuuucaucug

SEQ ID NO: 1182201 - RNA, 22 nt, Human
ucucuuucugcgcucuuuacca

SEQ ID NO: 1182202 - RNA, 22 nt, Human
ugagaaaagaauccauaggaag

SEQ ID NO: 1182203 - RNA, 24 nt, Human
ugagaaaagaauccauaggaaggg

SEQ ID NO: 1182204 - RNA, 18 nt, Human
ugagaaugggaaaaaugu

SEQ ID NO: 1182205 - RNA, 21 nt, Human
uggaaaugaggauuuuaccca

SEQ ID NO: 1182206 - RNA, 24 nt, Human
uggagggggaagcacaggaauggc

SEQ ID NO: 1182207 - RNA, 24 nt, Human
uggcagcacaaacuuuaaaaaaaa

SEQ ID NO: 1182208 - RNA, 20 nt, Human
ugggcaggggaaaaaggaca

SEQ ID NO: 1182209 - RNA, 21 nt, Human
ugggcaggggaaaaaggacag

SEQ ID NO: 1182210 - RNA, 21 nt, Human
ugucauagcccuaaauucagc

SEQ ID NO: 1182211 - RNA, 19 nt, Human
uguuuuguaucuuuguggc

SEQ ID NO: 1182212 - RNA, 21 nt, Human
uuaaguaaacacugagaaaag

SEQ ID NO: 1182213 - RNA, 22 nt, Human
uuaguagaggcaagguucucau

SEQ ID NO: 1182214 - RNA, 18 nt, Human
uucagagauagauuuaaa

SEQ ID NO: 1182215 - RNA, 18 nt, Human
uucuuccaggccccuaca

SEQ ID NO: 1182216 - RNA, 22 nt, Human
uugaauauauauauuuacagga

SEQ ID NO: 1182217 - RNA, 23 nt, Human
uuugcuguucaccugccaccugu

SEQ ID NO: 1182218 - RNA, 20 nt, Human
uuuguggcaaaaucucccca

SEQ ID NO: 1182219 - RNA, 23 nt, Human
aaaaaaaaaaauucaacuaauac

SEQ ID NO: 1182220 - RNA, 24 nt, Human
aaaaaaauacuguaaaaaugucau

SEQ ID NO: 1182221 - RNA, 18 nt, Human
aaaauuagcugggcgugg

SEQ ID NO: 1182222 - RNA, 24 nt, Human
aaacaacacaaguuuagaauccau

SEQ ID NO: 1182223 - RNA, 24 nt, Human
aaacauuggccacuauuuaaacaa

SEQ ID NO: 1182224 - RNA, 21 nt, Human
aaagaaacaacacaaguuuag

SEQ ID NO: 1182225 - RNA, 22 nt, Human
aaagagcuaaacauacaaacac

SEQ ID NO: 1182226 - RNA, 21 nt, Human
aacacaaguuuagaauccaua

SEQ ID NO: 1182227 - RNA, 22 nt, Human
aacauacaaacaccaugaaaaa

SEQ ID NO: 1182228 - RNA, 19 nt, Human
aacauggugaaaccccguc

SEQ ID NO: 1182229 - RNA, 20 nt, Human
aacauggugaaaccccgucu

SEQ ID NO: 1182230 - RNA, 21 nt, Human
aacauggugaaaccccgucuc

SEQ ID NO: 1182231 - RNA, 31 nt, Human
aagaaaugaaacacagcaacuuccugaggaa

SEQ ID NO: 1182232 - RNA, 24 nt, Human
aaucacuugaaacugggaggcaga

SEQ ID NO: 1182233 - RNA, 24 nt, Human
acaacacaaguuuagaauccauaa

SEQ ID NO: 1182234 - RNA, 26 nt, Human
acacauauaccaaauucaaggcacaa

SEQ ID NO: 1182235 - RNA, 22 nt, Human
acagagcgagacuccaucaaaa

SEQ ID NO: 1182236 - RNA, 23 nt, Human
acagagcucuuccucaaguccug

SEQ ID NO: 1182237 - RNA, 24 nt, Human
acagugcagauuugaucuguggug

SEQ ID NO: 1182238 - RNA, 24 nt, Human
acauauaacagagcucuuccucaa

SEQ ID NO: 1182239 - RNA, 24 nt, Human
accaacauggugaaaccccgucuc

SEQ ID NO: 1182240 - RNA, 24 nt, Human
accccgucucuacuaaaaauacaa

SEQ ID NO: 1182241 - RNA, 21 nt, Human
acugcacuccagccuggugac

SEQ ID NO: 1182242 - RNA, 23 nt, Human
acugcacuccagccuggugacag

SEQ ID NO: 1182243 - RNA, 25 nt, Human
acugcacuccagccuggugacagag

SEQ ID NO: 1182244 - RNA, 23 nt, Human
agacagcagaaucacuugaaacu

SEQ ID NO: 1182245 - RNA, 19 nt, Human
agacuccaucaaaaaaaaa

SEQ ID NO: 1182246 - RNA, 24 nt, Human
agagauugcagugagccgugauug

SEQ ID NO: 1182247 - RNA, 24 nt, Human
agcacuuugggaggccgaggcagg

SEQ ID NO: 1182248 - RNA, 21 nt, Human
agccuggugacagagcgagac

SEQ ID NO: 1182249 - RNA, 23 nt, Human
agccuggugacagagcgagacuc

SEQ ID NO: 1182250 - RNA, 23 nt, Human
agcugggcgugguggcgcaugcc

SEQ ID NO: 1182251 - RNA, 21 nt, Human
aggcagagauugcagugagcc

SEQ ID NO: 1182252 - RNA, 22 nt, Human
aggcagagauugcagugagccg

SEQ ID NO: 1182253 - RNA, 24 nt, Human
aggcagguggaucacaaugucaag

SEQ ID NO: 1182254 - RNA, 21 nt, Human
aggccgaggcagguggaucac

SEQ ID NO: 1182255 - RNA, 18 nt, Human
aggcucgcugggaggcaa

SEQ ID NO: 1182256 - RNA, 22 nt, Human
aggcugggugcaguggcucaug

SEQ ID NO: 1182257 - RNA, 19 nt, Human
agguggaucacaaugucaa

SEQ ID NO: 1182258 - RNA, 21 nt, Human
aguccauccaaagaaaugaaa

SEQ ID NO: 1182259 - RNA, 23 nt, Human
aguggcucaugccuguaauccca

SEQ ID NO: 1182260 - RNA, 24 nt, Human
aguggcucaugccuguaaucccag

SEQ ID NO: 1182261 - RNA, 19 nt, Human
augccuguaaucccagcac

SEQ ID NO: 1182262 - RNA, 24 nt, Human
auugcagugagccgugauugugcu

SEQ ID NO: 1182263 - RNA, 24 nt, Human
auugugcuacugcacuccagccug

SEQ ID NO: 1182264 - RNA, 19 nt, Human
caaaagagcuaaacauaca

SEQ ID NO: 1182265 - RNA, 25 nt, Human
caaaagagcuaaacauacaaacacc

SEQ ID NO: 1182266 - RNA, 25 nt, Human
caaaauuccuuuucaaaagagcuaa

SEQ ID NO: 1182267 - RNA, 21 nt, Human
caacacugcugauaacuaaua

SEQ ID NO: 1182268 - RNA, 24 nt, Human
caacauggugaaaccccgucucua

SEQ ID NO: 1182269 - RNA, 22 nt, Human
caagcccuuaaucaagucucua

SEQ ID NO: 1182270 - RNA, 22 nt, Human
caaggcugggugcaguggcuca

SEQ ID NO: 1182271 - RNA, 18 nt, Human
cacaaugucaagagaugg

SEQ ID NO: 1182272 - RNA, 23 nt, Human
cacauauaccaaauucaaggcac

SEQ ID NO: 1182273 - RNA, 19 nt, Human
caccaggaccuuuccuaua

SEQ ID NO: 1182274 - RNA, 22 nt, Human
caccaugaaaaagucaccuagg

SEQ ID NO: 1182275 - RNA, 23 nt, Human
cacuccagccuggugacagagcg

SEQ ID NO: 1182276 - RNA, 22 nt, Human
cagagcucuuccucaaguccug

SEQ ID NO: 1182277 - RNA, 24 nt, Human
cagcacuuugggaggccgaggcag

SEQ ID NO: 1182278 - RNA, 26 nt, Human
cagcacuuugggaggccgaggcaggu

SEQ ID NO: 1182279 - RNA, 22 nt, Human
cagguggaucacaaugucaaga

SEQ ID NO: 1182280 - RNA, 23 nt, Human
cauauaacagagcucuuccucaa

SEQ ID NO: 1182281 - RNA, 20 nt, Human
caugccuguaaucccagcac

SEQ ID NO: 1182282 - RNA, 22 nt, Human
ccacuauuuaaacaagacauuc

SEQ ID NO: 1182283 - RNA, 21 nt, Human
cccggggccccgcacgagccc

SEQ ID NO: 1182284 - RNA, 22 nt, Human
ccugaccaacauggugaaaccc

SEQ ID NO: 1182285 - RNA, 23 nt, Human
ccugaccaacauggugaaacccc

SEQ ID NO: 1182286 - RNA, 24 nt, Human
ccugaccaacauggugaaaccccg

SEQ ID NO: 1182287 - RNA, 21 nt, Human
ccuggugacagagcgagacuc

SEQ ID NO: 1182288 - RNA, 20 nt, Human
ccuguaaucccagcacuuug

SEQ ID NO: 1182289 - RNA, 22 nt, Human
ccuguaaucccagcacuuuggg

SEQ ID NO: 1182290 - RNA, 18 nt, Human
ccuguagucccagcuacu

SEQ ID NO: 1182291 - RNA, 21 nt, Human
ccuguagucccagcuacuugg

SEQ ID NO: 1182292 - RNA, 20 nt, Human
ccuuaaacauuggccacuau

SEQ ID NO: 1182293 - RNA, 21 nt, Human
ccuuccauacauaugccauag

SEQ ID NO: 1182294 - RNA, 24 nt, Human
cgaggcagguggaucacaauguca

SEQ ID NO: 1182295 - RNA, 19 nt, Human
cgcccggggccccgcacga

SEQ ID NO: 1182296 - RNA, 23 nt, Human
cgcccggggccccgcacgagccc

SEQ ID NO: 1182297 - RNA, 19 nt, Human
cuacugcacuccagccugg

SEQ ID NO: 1182298 - RNA, 20 nt, Human
cuacugcacuccagccuggu

SEQ ID NO: 1182299 - RNA, 23 nt, Human
cuacugcacuccagccuggugac

SEQ ID NO: 1182300 - RNA, 24 nt, Human
cucaugccuguaaucccagcacuu

SEQ ID NO: 1182301 - RNA, 24 nt, Human
cuccagccuggugacagagcgaga

SEQ ID NO: 1182302 - RNA, 22 nt, Human
cuccaucaaaaaaaaaaaaaaa

SEQ ID NO: 1182303 - RNA, 23 nt, Human
cucuaaucuagggacaguaacau

SEQ ID NO: 1182304 - RNA, 21 nt, Human
cucugaguauaucugucccca

SEQ ID NO: 1182305 - RNA, 18 nt, Human
cuuugauaaagagaaaug

SEQ ID NO: 1182306 - RNA, 24 nt, Human
gaaacaacacaaguuuagaaucca

SEQ ID NO: 1182307 - RNA, 20 nt, Human
gagcuaaacauacaaacacc

SEQ ID NO: 1182308 - RNA, 21 nt, Human
gauugugcuacugcacuccag

SEQ ID NO: 1182309 - RNA, 23 nt, Human
gcacuccagccuggugacagagc

SEQ ID NO: 1182310 - RNA, 24 nt, Human
ggagaccauccugaccaacauggu

SEQ ID NO: 1182311 - RNA, 19 nt, Human
ggcauuguuuccccacuuu

SEQ ID NO: 1182312 - RNA, 23 nt, Human
ggcugggugcaguggcucaugcc

SEQ ID NO: 1182313 - RNA, 24 nt, Human
gggugcaguggcucaugccuguaa

SEQ ID NO: 1182314 - RNA, 20 nt, Human
gguucugccuaaaaggaccc

SEQ ID NO: 1182315 - RNA, 25 nt, Human
guuaaugucuguuucccaacacuau

SEQ ID NO: 1182316 - RNA, 21 nt, Human
uaaaaaaaaaagcaaucacau

SEQ ID NO: 1182317 - RNA, 18 nt, Human
uaaaaaugucauuugcug

SEQ ID NO: 1182318 - RNA, 18 nt, Human
uaaaacacaggucauggc

SEQ ID NO: 1182319 - RNA, 22 nt, Human
uaaaaggacccuguuggcaaca

SEQ ID NO: 1182320 - RNA, 25 nt, Human
uaacaagaaugaguaaacucuggga

SEQ ID NO: 1182321 - RNA, 22 nt, Human
uaacaucggcuauuugagugca

SEQ ID NO: 1182322 - RNA, 19 nt, Human
uaagaguccauccaaagaa

SEQ ID NO: 1182323 - RNA, 26 nt, Human
uaagggcaauaacaaacaaaaauaga

SEQ ID NO: 1182324 - RNA, 23 nt, Human
uacacccuuccauacauaugcca

SEQ ID NO: 1182325 - RNA, 22 nt, Human
uaccuaaagugggauaaugauc

SEQ ID NO: 1182326 - RNA, 20 nt, Human
uacugcacuccagccuggug

SEQ ID NO: 1182327 - RNA, 22 nt, Human
uacugcacuccagccuggugac

SEQ ID NO: 1182328 - RNA, 23 nt, Human
uacugcacuccagccuggugaca

SEQ ID NO: 1182329 - RNA, 24 nt, Human
uacugcacuccagccuggugacag

SEQ ID NO: 1182330 - RNA, 18 nt, Human
uacuuuagucauugugac

SEQ ID NO: 1182331 - RNA, 24 nt, Human
uagaaaacgugagaaaauacagca

SEQ ID NO: 1182332 - RNA, 20 nt, Human
uaguuugcuuuacaaaaaaa

SEQ ID NO: 1182333 - RNA, 21 nt, Human
ucaaaaaaaaaaaaaaaaaaa

SEQ ID NO: 1182334 - RNA, 22 nt, Human
ucaaaagagcuaaacauacaaa

SEQ ID NO: 1182335 - RNA, 24 nt, Human
ucacuugaaacugggaggcagagg

SEQ ID NO: 1182336 - RNA, 22 nt, Human
ucaugccuguaaucccagcacu

SEQ ID NO: 1182337 - RNA, 22 nt, Human
uccagccuggugacagagcgag

SEQ ID NO: 1182338 - RNA, 25 nt, Human
uccaucaaaaaaaaaaaaaaaaaaa

SEQ ID NO: 1182339 - RNA, 23 nt, Human
uccaugauugaaaauuaagaggc

SEQ ID NO: 1182340 - RNA, 23 nt, Human
uccccacuuuugguacaaacaag

SEQ ID NO: 1182341 - RNA, 22 nt, Human
ucuaaucuagggacaguaacau

SEQ ID NO: 1182342 - RNA, 23 nt, Human
ucucuacuaaaaauacaaaaauu

SEQ ID NO: 1182343 - RNA, 22 nt, Human
ugaaaaaucacacacaugaaac

SEQ ID NO: 1182344 - RNA, 23 nt, Human
ugaaaaaucacacacaugaaaca

SEQ ID NO: 1182345 - RNA, 18 nt, Human
ugaagaugucacacugcu

SEQ ID NO: 1182346 - RNA, 24 nt, Human
ugaccaacauggugaaaccccguc

SEQ ID NO: 1182347 - RNA, 18 nt, Human
ugacugguuucuggguuc

SEQ ID NO: 1182348 - RNA, 20 nt, Human
ugagacagcagaaucacuug

SEQ ID NO: 1182349 - RNA, 23 nt, Human
ugagacagcagaaucacuugaaa

SEQ ID NO: 1182350 - RNA, 25 nt, Human
ugaguaaacucugggaauucugaaa

SEQ ID NO: 1182351 - RNA, 21 nt, Human
ugcagccaaacuaaaacacag

SEQ ID NO: 1182352 - RNA, 21 nt, Human
ugccuaaaaggacccuguugg

SEQ ID NO: 1182353 - RNA, 23 nt, Human
ugccuguaaucccagcacuuugg

SEQ ID NO: 1182354 - RNA, 24 nt, Human
ugccuguagucccagcuacuuggg

SEQ ID NO: 1182355 - RNA, 23 nt, Human
uggcuagaguuuaauaacaagaa

SEQ ID NO: 1182356 - RNA, 24 nt, Human
uggcucaugccuguaaucccagca

SEQ ID NO: 1182357 - RNA, 23 nt, Human
ugggaggcagagauugcaguggc

SEQ ID NO: 1182358 - RNA, 24 nt, Human
ugggaggccgaggcagguggauca

SEQ ID NO: 1182359 - RNA, 18 nt, Human
ugggaggcugagacagca

SEQ ID NO: 1182360 - RNA, 24 nt, Human
ugggaggcugagacagcagaauca

SEQ ID NO: 1182361 - RNA, 26 nt, Human
ugggauaaugaucauaaaaaaaaaaa

SEQ ID NO: 1182362 - RNA, 21 nt, Human
ugguacaaacaagcccuuaau

SEQ ID NO: 1182363 - RNA, 24 nt, Human
ugguggcgcaugccuguaguccca

SEQ ID NO: 1182364 - RNA, 19 nt, Human
ugguuucuggguucugccu

SEQ ID NO: 1182365 - RNA, 22 nt, Human
ugucaagagauggagaccaucc

SEQ ID NO: 1182366 - RNA, 18 nt, Human
uuagcugggcgugguggc

SEQ ID NO: 1182367 - RNA, 20 nt, Human
uuagcugggcgugguggcgc

SEQ ID NO: 1182368 - RNA, 24 nt, Human
uuagcugggcgugguggcgcaugc

SEQ ID NO: 1182369 - RNA, 22 nt, Human
uugcagugagccgugauugugc

SEQ ID NO: 1182370 - RNA, 25 nt, Human
uugggaggccgaggcagguggauca

SEQ ID NO: 1182371 - RNA, 25 nt, Human
uugggaggcugagacagcagaauca

SEQ ID NO: 1182372 - RNA, 23 nt, Human
uugugcuacugcacuccagccug

SEQ ID NO: 1182373 - RNA, 23 nt, Human
aaaacaccacaugaaucaaaaua

SEQ ID NO: 1182374 - RNA, 19 nt, Human
aaaauaccucauaaaaaua

SEQ ID NO: 1182375 - RNA, 21 nt, Human
aaaaugucaccagaugaaaug

SEQ ID NO: 1182376 - RNA, 19 nt, Human
aaaguugugaccaaaaacu

SEQ ID NO: 1182377 - RNA, 23 nt, Human
aagaaucacuugaacccaggagg

SEQ ID NO: 1182378 - RNA, 25 nt, Human
aagcagaagaaucacuugaacccag

SEQ ID NO: 1182379 - RNA, 24 nt, Human
aaucacuugaacccaggaggcgga

SEQ ID NO: 1182380 - RNA, 18 nt, Human
aaugucuuccuuuauccu

SEQ ID NO: 1182381 - RNA, 20 nt, Human
acaaaauacaaaggaaccca

SEQ ID NO: 1182382 - RNA, 22 nt, Human
acaaaauacaaaggaacccaac

SEQ ID NO: 1182383 - RNA, 19 nt, Human
acaggaagagagucucugg

SEQ ID NO: 1182384 - RNA, 21 nt, Human
accucauacaaauggcuuuau

SEQ ID NO: 1182385 - RNA, 22 nt, Human
acuuuuuuuuuauucuccuuuu

SEQ ID NO: 1182386 - RNA, 20 nt, Human
agcacacauacacagcugug

SEQ ID NO: 1182387 - RNA, 20 nt, Human
agcacuuugggaggcugaag

SEQ ID NO: 1182388 - RNA, 19 nt, Human
aggcggacguugcagugag

SEQ ID NO: 1182389 - RNA, 20 nt, Human
aguaugaagugugcaugccc

SEQ ID NO: 1182390 - RNA, 23 nt, Human
auaaccacugggaucggggacac

SEQ ID NO: 1182391 - RNA, 21 nt, Human
auaguaugaagugugcaugcc

SEQ ID NO: 1182392 - RNA, 23 nt, Human
aucaugccacugcacuccagcag

SEQ ID NO: 1182393 - RNA, 18 nt, Human
auccaugguuuaaucuuu

SEQ ID NO: 1182394 - RNA, 19 nt, Human
augccuguaaucccagcac

SEQ ID NO: 1182395 - RNA, 24 nt, Human
auuuuucaaaucuuuuucuuauug

SEQ ID NO: 1182396 - RNA, 25 nt, Human
caaaaguaauucacaaaauacaaag

SEQ ID NO: 1182397 - RNA, 22 nt, Human
caaaauacaaaggaacccaaca

SEQ ID NO: 1182398 - RNA, 20 nt, Human
caaaaugucaccagaugaaa

SEQ ID NO: 1182399 - RNA, 19 nt, Human
caaagcugaaaagugacaa

SEQ ID NO: 1182400 - RNA, 18 nt, Human
caagaugaaaaauggccc

SEQ ID NO: 1182401 - RNA, 20 nt, Human
cacacaaaguucaugaguag

SEQ ID NO: 1182402 - RNA, 23 nt, Human
caccagugcucauccuguuacag

SEQ ID NO: 1182403 - RNA, 22 nt, Human
caccauagucacauauuuuugu

SEQ ID NO: 1182404 - RNA, 22 nt, Human
cacugcacuccagcaguuccac

SEQ ID NO: 1182405 - RNA, 22 nt, Human
cagaagccuggucagggguccc

SEQ ID NO: 1182406 - RNA, 19 nt, Human
cagauccuccacacuuuuc

SEQ ID NO: 1182407 - RNA, 24 nt, Human
cagcacuuugggaggcugaagcag

SEQ ID NO: 1182408 - RNA, 24 nt, Human
caggggagacccauguuuaauuuu

SEQ ID NO: 1182409 - RNA, 20 nt, Human
caugccuguaaucccagcac

SEQ ID NO: 1182410 - RNA, 24 nt, Human
caugccuguaaucccagcacuuug

SEQ ID NO: 1182411 - RNA, 22 nt, Human
cauuaaucugacaagcuaaaau

SEQ ID NO: 1182412 - RNA, 19 nt, Human
ccacugcacuccagcagga

SEQ ID NO: 1182413 - RNA, 18 nt, Human
ccacugcacuccagcagu

SEQ ID NO: 1182414 - RNA, 22 nt, Human
cccaagaaacaaauaguaugaa

SEQ ID NO: 1182415 - RNA, 22 nt, Human
ccuguaaucccagcacuuuggg

SEQ ID NO: 1182416 - RNA, 25 nt, Human
ccuuaucugcaaacuaucagagcug

SEQ ID NO: 1182417 - RNA, 21 nt, Human
ccuuugcugcggcauuaggga

SEQ ID NO: 1182418 - RNA, 24 nt, Human
cgacaucaugccacugcacuccag

SEQ ID NO: 1182419 - RNA, 24 nt, Human
cuaaaaaaugaaaaaaaauuccua

SEQ ID NO: 1182420 - RNA, 18 nt, Human
cucaagaugaaaaauggc

SEQ ID NO: 1182421 - RNA, 20 nt, Human
cucaagaugaaaaauggccc

SEQ ID NO: 1182422 - RNA, 23 nt, Human
cucaugccuguaaucccagcacu

SEQ ID NO: 1182423 - RNA, 24 nt, Human
cucaugccuguaaucccagcacuu

SEQ ID NO: 1182424 - RNA, 20 nt, Human
cuccagcaguuccacauggc

SEQ ID NO: 1182425 - RNA, 23 nt, Human
cucgggcacaccagcuucugccc

SEQ ID NO: 1182426 - RNA, 22 nt, Human
cugcaaacuaucagagcugcag

SEQ ID NO: 1182427 - RNA, 23 nt, Human
cugcuccugaccucauacaaaug

SEQ ID NO: 1182428 - RNA, 23 nt, Human
cuggacacuuggauauuauauuc

SEQ ID NO: 1182429 - RNA, 21 nt, Human
cuggccaccauacgaagggaa

SEQ ID NO: 1182430 - RNA, 21 nt, Human
cuuagcugguagcuggggguc

SEQ ID NO: 1182431 - RNA, 21 nt, Human
cuuucaaugcuugcuggacac

SEQ ID NO: 1182432 - RNA, 22 nt, Human
gaaagucuugcuucuguaaggg

SEQ ID NO: 1182433 - RNA, 18 nt, Human
gaugccuccaaaugcuag

SEQ ID NO: 1182434 - RNA, 24 nt, Human
gcaguuccacauggcugggaggcc

SEQ ID NO: 1182435 - RNA, 18 nt, Human
ggacguugcagugagccg

SEQ ID NO: 1182436 - RNA, 24 nt, Human
ggacguugcagugagccgacauca

SEQ ID NO: 1182437 - RNA, 21 nt, Human
ggcucaugccuguaaucccag

SEQ ID NO: 1182438 - RNA, 23 nt, Human
ggcuggguuugguggcucaugcc

SEQ ID NO: 1182439 - RNA, 23 nt, Human
gguuugguggcucaugccuguaa

SEQ ID NO: 1182440 - RNA, 19 nt, Human
guaugaagugugcaugccc

SEQ ID NO: 1182441 - RNA, 23 nt, Human
guggcucaugccuguaaucccag

SEQ ID NO: 1182442 - RNA, 24 nt, Human
guugcagugagccgacaucaugcc

SEQ ID NO: 1182443 - RNA, 20 nt, Human
uaaaauacaacuucugggcu

SEQ ID NO: 1182444 - RNA, 22 nt, Human
uaauuuuuugaaugucuuccuu

SEQ ID NO: 1182445 - RNA, 21 nt, Human
uacacagcugugaaaacacca

SEQ ID NO: 1182446 - RNA, 22 nt, Human
uacacagcugugaaaacaccac

SEQ ID NO: 1182447 - RNA, 25 nt, Human
uacagaacauguccagcacucucaa

SEQ ID NO: 1182448 - RNA, 21 nt, Human
uaguugccuccucuucuuuuu

SEQ ID NO: 1182449 - RNA, 22 nt, Human
uaucaacauuaaucugacaagc

SEQ ID NO: 1182450 - RNA, 19 nt, Human
uaugcacacaaaguucaug

SEQ ID NO: 1182451 - RNA, 23 nt, Human
uauuucgaccucuaacucucagc

SEQ ID NO: 1182452 - RNA, 22 nt, Human
ucaugucccucagcucucucag

SEQ ID NO: 1182453 - RNA, 18 nt, Human
uccaugguuuaaucuuuc

SEQ ID NO: 1182454 - RNA, 21 nt, Human
ucucaggucgugcccgaugcu

SEQ ID NO: 1182455 - RNA, 21 nt, Human
ucugcaaacuaucagagcugc

SEQ ID NO: 1182456 - RNA, 18 nt, Human
ucugcauuuaaauuuugu

SEQ ID NO: 1182457 - RNA, 21 nt, Human
ucuuccagucacugacucuag

SEQ ID NO: 1182458 - RNA, 18 nt, Human
ugaaaaauggcccagcau

SEQ ID NO: 1182459 - RNA, 19 nt, Human
ugaaaagugacaaacagug

SEQ ID NO: 1182460 - RNA, 24 nt, Human
ugaaaagugacaaacagugcuuua

SEQ ID NO: 1182461 - RNA, 20 nt, Human
ugaagcagaagaaucacuug

SEQ ID NO: 1182462 - RNA, 24 nt, Human
ugaagcagaagaaucacuugaacc

SEQ ID NO: 1182463 - RNA, 20 nt, Human
ugaaugucuuccuuuauccu

SEQ ID NO: 1182464 - RNA, 22 nt, Human
ugaccaaaaacuuuuuuaugau

SEQ ID NO: 1182465 - RNA, 19 nt, Human
ugagacuuacucacuacca

SEQ ID NO: 1182466 - RNA, 20 nt, Human
ugaggaaagugauuugaucc

SEQ ID NO: 1182467 - RNA, 22 nt, Human
ugauuugauccaucaucuguca

SEQ ID NO: 1182468 - RNA, 24 nt, Human
ugccuccaaaugcuaggcaauccu

SEQ ID NO: 1182469 - RNA, 23 nt, Human
ugccuguaaucccagcacuuugg

SEQ ID NO: 1182470 - RNA, 23 nt, Human
ugccuguaaucccagcacuuugg

SEQ ID NO: 1182471 - RNA, 22 nt, Human
uggcucaugccuguaaucccag

SEQ ID NO: 1182472 - RNA, 24 nt, Human
uggcucaugccuguaaucccagca

SEQ ID NO: 1182473 - RNA, 24 nt, Human
ugggaggcugaagcagaagaauca

SEQ ID NO: 1182474 - RNA, 21 nt, Human
ugggcuggguuugguggcuca

SEQ ID NO: 1182475 - RNA, 24 nt, Human
ugguggcucaugccuguaauccca

SEQ ID NO: 1182476 - RNA, 20 nt, Human
uuaaaguugugaccaaaaac

SEQ ID NO: 1182477 - RNA, 24 nt, Human
uuaaccacuauuucgaccucuaac

SEQ ID NO: 1182478 - RNA, 21 nt, Human
uucugggcuggguuugguggc

SEQ ID NO: 1182479 - RNA, 22 nt, Human
uucuuccagucacugacucuag

SEQ ID NO: 1182480 - RNA, 20 nt, Human
uugagcacacauacacagcu

SEQ ID NO: 1182481 - RNA, 21 nt, Human
uugauccaucaucugucaaaa

SEQ ID NO: 1182482 - RNA, 25 nt, Human
uugggaggcugaagcagaagaauca

SEQ ID NO: 1182483 - RNA, 24 nt, Human
uugguuggauagcuuguuccaaga

SEQ ID NO: 1182484 - RNA, 26 nt, Human
uuguguccauccaugguuuaaucuuu

SEQ ID NO: 1182485 - RNA, 23 nt, Human
uuguuccaaguguagccguucuc

SEQ ID NO: 1182486 - RNA, 19 nt, Human
uuucugcugcaugcacaca

SEQ ID NO: 1182487 - RNA, 24 nt, Human
uuuuuuauucuccuuuugaugggg

SEQ ID NO: 1182488 - RNA, 24 nt, Human
uuuuuuuuuauucuccuuuugaug

SEQ ID NO: 1182489 - RNA, 26 nt, Human
aaaaacaccaacacccaaacacacaa

SEQ ID NO: 1182490 - RNA, 20 nt, Human
aaaacaccaacacccaaaca

SEQ ID NO: 1182491 - RNA, 23 nt, Human
aaaacaccaacacccaaacacac

SEQ ID NO: 1182492 - RNA, 19 nt, Human
aacaccaacacccaaacac

SEQ ID NO: 1182493 - RNA, 24 nt, Human
aagaagcugagugaugaggcuggg

SEQ ID NO: 1182494 - RNA, 20 nt, Human
aagcgauugugcaggaggaa

SEQ ID NO: 1182495 - RNA, 22 nt, Human
auagaaagcaaauuuaaaaaca

SEQ ID NO: 1182496 - RNA, 21 nt, Human
caaacacacaagacugcacac

SEQ ID NO: 1182497 - RNA, 26 nt, Human
cacacaagaaaaagugcucaagaaac

SEQ ID NO: 1182498 - RNA, 20 nt, Human
cacccaaacacacaagacuu

SEQ ID NO: 1182499 - RNA, 21 nt, Human
cagcucaggacguacaaccga

SEQ ID NO: 1182500 - RNA, 23 nt, Human
cagcucaggacguacaaccgaug

SEQ ID NO: 1182501 - RNA, 21 nt, Human
caggcuaggguuaaagcugac

SEQ ID NO: 1182502 - RNA, 21 nt, Human
caguuuuguacuaggaagaag

SEQ ID NO: 1182503 - RNA, 24 nt, Human
caucccaaccagugcucagcugcu

SEQ ID NO: 1182504 - RNA, 23 nt, Human
ccaacacccaaacacacaagacu

SEQ ID NO: 1182505 - RNA, 22 nt, Human
cccacauccccucugaaggcca

SEQ ID NO: 1182506 - RNA, 22 nt, Human
cccagcccaaucaggcccuggc

SEQ ID NO: 1182507 - RNA, 22 nt, Human
cugaaggccaguguugucgcgc

SEQ ID NO: 1182508 - RNA, 21 nt, Human
gaagcugagugaugaggcugg

SEQ ID NO: 1182509 - RNA, 24 nt, Human
gaggcugggugaugggaucgcuug

SEQ ID NO: 1182510 - RNA, 23 nt, Human
gaugggaucgcuugacgggcugc

SEQ ID NO: 1182511 - RNA, 21 nt, Human
gcaaauuuaaaaacaccaaca

SEQ ID NO: 1182512 - RNA, 20 nt, Human
gcagcugagguucagagaac

SEQ ID NO: 1182513 - RNA, 20 nt, Human
gcugagugaugaggcugggu

SEQ ID NO: 1182514 - RNA, 19 nt, Human
gcugcaauguggccuugau

SEQ ID NO: 1182515 - RNA, 23 nt, Human
ggccaaggugaauucacucagca

SEQ ID NO: 1182516 - RNA, 22 nt, Human
gggaagaaacccacgaucaccc

SEQ ID NO: 1182517 - RNA, 18 nt, Human
ggugaugggaucgcuuga

SEQ ID NO: 1182518 - RNA, 20 nt, Human
guaacgacauggagagaggc

SEQ ID NO: 1182519 - RNA, 22 nt, Human
uaaaaacaccaacacccaaaca

SEQ ID NO: 1182520 - RNA, 22 nt, Human
uaaaaacaccaacacccaaaca

SEQ ID NO: 1182521 - RNA, 22 nt, Human
uagaaagcaaauuuaaaaacac

SEQ ID NO: 1182522 - RNA, 22 nt, Human
uaggaagaagcugagugaugag

SEQ ID NO: 1182523 - RNA, 26 nt, Human
uaggaagaagcugagugaugaggcug

SEQ ID NO: 1182524 - RNA, 18 nt, Human
ucacucagcaaacguuca

SEQ ID NO: 1182525 - RNA, 21 nt, Human
ucccugggugugcccgucucu

SEQ ID NO: 1182526 - RNA, 22 nt, Human
ucccugggugugcccgucucug

SEQ ID NO: 1182527 - RNA, 19 nt, Human
ugagugaugaggcugggug

SEQ ID NO: 1182528 - RNA, 20 nt, Human
ugagugaugaggcuggguga

SEQ ID NO: 1182529 - RNA, 18 nt, Human
ugaugaggcugggugaug

SEQ ID NO: 1182530 - RNA, 24 nt, Human
ugaugggaucgcuugacgggcugc

SEQ ID NO: 1182531 - RNA, 20 nt, Human
ugcacacaagaaaaagugcu

SEQ ID NO: 1182532 - RNA, 21 nt, Human
ugccaacuuuggaccaaacuc

SEQ ID NO: 1182533 - RNA, 18 nt, Human
uguacuaggaagaagcug

SEQ ID NO: 1182534 - RNA, 21 nt, Human
uuuacucccacauccccucug

SEQ ID NO: 1182535 - RNA, 18 nt, Human
aaaguucuucaaagccac

SEQ ID NO: 1182536 - RNA, 19 nt, Human
accaaauuucuuuauuuga

SEQ ID NO: 1182537 - RNA, 23 nt, Human
accaaggaaggcaccccacggcu

SEQ ID NO: 1182538 - RNA, 19 nt, Human
aucaucgcggucaaaguau

SEQ ID NO: 1182539 - RNA, 21 nt, Human
auguucccucuccucaugaga

SEQ ID NO: 1182540 - RNA, 19 nt, Human
cagcauguucccucuccuc

SEQ ID NO: 1182541 - RNA, 31 nt, Human
cccacggcuauggggaaauuagccugagacc

SEQ ID NO: 1182542 - RNA, 20 nt, Human
ccucugaguccugguuguag

SEQ ID NO: 1182543 - RNA, 19 nt, Human
cgcggucaaaguauaagac

SEQ ID NO: 1182544 - RNA, 27 nt, Human
cucagcauguucccucuccucaugaga

SEQ ID NO: 1182545 - RNA, 22 nt, Human
gaaggcaccccacggcuauggg

SEQ ID NO: 1182546 - RNA, 20 nt, Human
uacaaaucaaagaacuuaag

SEQ ID NO: 1182547 - RNA, 24 nt, Human
uacaacuuauagaaaagguaaagg

SEQ ID NO: 1182548 - RNA, 19 nt, Human
ucaaagccacaucaucgcg

SEQ ID NO: 1182549 - RNA, 24 nt, Human
ucagcauguucccucuccucauga

SEQ ID NO: 1182550 - RNA, 22 nt, Human
uccagguugauguggcgguuga

SEQ ID NO: 1182551 - RNA, 23 nt, Human
ugaccaaggaaggcaccccacgg

SEQ ID NO: 1182552 - RNA, 23 nt, Human
ugauggcggccucugaguccugg

SEQ ID NO: 1182553 - RNA, 19 nt, Human
uguggcgguugauggcggc

SEQ ID NO: 1182554 - RNA, 20 nt, Human
uuggcaaaguucuucaaagc

SEQ ID NO: 1182555 - RNA, 22 nt, Human
uuuggcaaaguucuucaaagcc

SEQ ID NO: 1182556 - RNA, 18 nt, Human
aaaaacuuaaaguuugga

SEQ ID NO: 1182557 - RNA, 21 nt, Human
aaaagaaaaacaaacaaaaag

SEQ ID NO: 1182558 - RNA, 29 nt, Human
aaaagaaaaacaaacaaaaagccauagaa

SEQ ID NO: 1182559 - RNA, 23 nt, Human
aaacaaaaagccauagaaaagau

SEQ ID NO: 1182560 - RNA, 21 nt, Human
aaagcauaaaaccuauaaaag

SEQ ID NO: 1182561 - RNA, 19 nt, Human
aagaaaaacaaacaaaaag

SEQ ID NO: 1182562 - RNA, 18 nt, Human
acaugcuaaagcauaaaa

SEQ ID NO: 1182563 - RNA, 19 nt, Human
auaaaaccuauaaaagugc

SEQ ID NO: 1182564 - RNA, 23 nt, Human
auaaaaccuauaaaagugcacuc

SEQ ID NO: 1182565 - RNA, 22 nt, Human
caaacaaaaagccauagaaaag

SEQ ID NO: 1182566 - RNA, 24 nt, Human
cacauaauguuuauauuguuaauu

SEQ ID NO: 1182567 - RNA, 26 nt, Human
cuuaaaagaaaaacaaacaaaaagcc

SEQ ID NO: 1182568 - RNA, 19 nt, Human
gaaaaacaaacaaaaagcc

SEQ ID NO: 1182569 - RNA, 22 nt, Human
gaaaaacuuaaaguuuggaccu

SEQ ID NO: 1182570 - RNA, 18 nt, Human
gccaugugggcugugcuc

SEQ ID NO: 1182571 - RNA, 21 nt, Human
gguagggccaugugggcugug

SEQ ID NO: 1182572 - RNA, 19 nt, Human
uaaaugaauagcuccaaua

SEQ ID NO: 1182573 - RNA, 24 nt, Human
ucccuuuugagcaaauucuuaaau

SEQ ID NO: 1182574 - RNA, 21 nt, Human
uggaagugguuuguugaucua

SEQ ID NO: 1182575 - RNA, 22 nt, Human
ugugcucuguugucuaaagcaa

SEQ ID NO: 1182576 - RNA, 28 nt, Human
uucaguguggggccauucuuaaaagaaa

SEQ ID NO: 1182577 - RNA, 23 nt, Human
uuggaguucucuaccucuucuga

SEQ ID NO: 1182578 - RNA, 23 nt, Human
ucccuuuaaguuacgacgggaau

SEQ ID NO: 1182579 - RNA, 23 nt, Human
aaaagcuaacauuuauguagcag

SEQ ID NO: 1182580 - RNA, 23 nt, Human
aaacauccaaggcugcugcagcu

SEQ ID NO: 1182581 - RNA, 22 nt, Human
aaagcaauagaucaccuggaac

SEQ ID NO: 1182582 - RNA, 23 nt, Human
aaccacgcagcauccugaacccc

SEQ ID NO: 1182583 - RNA, 20 nt, Human
aacccccucucugggcaagg

SEQ ID NO: 1182584 - RNA, 21 nt, Human
aacccccucucugggcaaggc

SEQ ID NO: 1182585 - RNA, 19 nt, Human
aaccccgcaaaacugguca

SEQ ID NO: 1182586 - RNA, 21 nt, Human
aagaauccagaacagguggug

SEQ ID NO: 1182587 - RNA, 21 nt, Human
aagcaauagaucaccuggaac

SEQ ID NO: 1182588 - RNA, 19 nt, Human
acagagcaccccuccaggg

SEQ ID NO: 1182589 - RNA, 22 nt, Human
acaggcaacaccugguuucugc

SEQ ID NO: 1182590 - RNA, 21 nt, Human
acaguccucucuccuccacuc

SEQ ID NO: 1182591 - RNA, 24 nt, Human
accccgcaaaacuggucagggagu

SEQ ID NO: 1182592 - RNA, 25 nt, Human
acccucacaaccacacuagggggua

SEQ ID NO: 1182593 - RNA, 19 nt, Human
acgcagcauccugaacccc

SEQ ID NO: 1182594 - RNA, 19 nt, Human
acgcagcauccugaacccc

SEQ ID NO: 1182595 - RNA, 23 nt, Human
acuccagugacuaauaaaagcua

SEQ ID NO: 1182596 - RNA, 23 nt, Human
acugaagccaggauuuaaaucca

SEQ ID NO: 1182597 - RNA, 18 nt, Human
agagagagcauuuucugu

SEQ ID NO: 1182598 - RNA, 21 nt, Human
agagaggaacugaaauagaua

SEQ ID NO: 1182599 - RNA, 23 nt, Human
agaucaccuggaaccacgcagca

SEQ ID NO: 1182600 - RNA, 25 nt, Human
agcaagacaaaaagagugggggcaa

SEQ ID NO: 1182601 - RNA, 19 nt, Human
agccagaauccauaaugug

SEQ ID NO: 1182602 - RNA, 20 nt, Human
agcuaacauuuauguagcac

SEQ ID NO: 1182603 - RNA, 22 nt, Human
agcucagacuugcguaggccaa

SEQ ID NO: 1182604 - RNA, 21 nt, Human
agcugcuuacgucacaguccg

SEQ ID NO: 1182605 - RNA, 23 nt, Human
aggauaaaucccaaauuccuguu

SEQ ID NO: 1182606 - RNA, 18 nt, Human
aguccggguggagagccu

SEQ ID NO: 1182607 - RNA, 19 nt, Human
aguccucucuccuccacuc

SEQ ID NO: 1182608 - RNA, 22 nt, Human
auccagaaacauccaaggcugc

SEQ ID NO: 1182609 - RNA, 19 nt, Human
auucccgggauccaguugu

SEQ ID NO: 1182610 - RNA, 20 nt, Human
caaaguuagcacccaaaagc

SEQ ID NO: 1182611 - RNA, 24 nt, Human
caaccagaaccagagcuccgugcc

SEQ ID NO: 1182612 - RNA, 18 nt, Human
caacccucacaaccacac

SEQ ID NO: 1182613 - RNA, 20 nt, Human
caacgucauccauaaacacu

SEQ ID NO: 1182614 - RNA, 22 nt, Human
cacagagcaccccuccaggucc

SEQ ID NO: 1182615 - RNA, 24 nt, Human
caccccuuccagcugugguacuuc

SEQ ID NO: 1182616 - RNA, 18 nt, Human
caccuggaaccacgcagc

SEQ ID NO: 1182617 - RNA, 23 nt, Human
caccuuuaacucaugaagauuuu

SEQ ID NO: 1182618 - RNA, 22 nt, Human
cagaaaaaaaggaaaagcagau

SEQ ID NO: 1182619 - RNA, 20 nt, Human
cagaaccagagcuccgugcc

SEQ ID NO: 1182620 - RNA, 19 nt, Human
cagaauccauaauguggaa

SEQ ID NO: 1182621 - RNA, 22 nt, Human
cagcugcauuuugaaccuagag

SEQ ID NO: 1182622 - RNA, 24 nt, Human
caggacucuucaaccagaaccaga

SEQ ID NO: 1182623 - RNA, 23 nt, Human
caggagccuuggagugcagggcu

SEQ ID NO: 1182624 - RNA, 22 nt, Human
caggcuucccaggauggggaca

SEQ ID NO: 1182625 - RNA, 21 nt, Human
caguccucucuccuccacucc

SEQ ID NO: 1182626 - RNA, 21 nt, Human
cagugacuaauaaaagcuaac

SEQ ID NO: 1182627 - RNA, 19 nt, Human
caucacaaugccagucucc

SEQ ID NO: 1182628 - RNA, 24 nt, Human
cauccucauugauccacaaauugu

SEQ ID NO: 1182629 - RNA, 19 nt, Human
caugcugagcgcagcaccc

SEQ ID NO: 1182630 - RNA, 24 nt, Human
ccaggauggggacauugacaagga

SEQ ID NO: 1182631 - RNA, 20 nt, Human
ccagguccucgaucuuggcu

SEQ ID NO: 1182632 - RNA, 21 nt, Human
ccagugacuaauaaaagcuaa

SEQ ID NO: 1182633 - RNA, 21 nt, Human
ccccucuccuuuccuccuucc

SEQ ID NO: 1182634 - RNA, 24 nt, Human
cccuccagguccucgaucuuggcu

SEQ ID NO: 1182635 - RNA, 21 nt, Human
cccucuccuuuccuccuuccu

SEQ ID NO: 1182636 - RNA, 20 nt, Human
ccuagagcucagacuugcgu

SEQ ID NO: 1182637 - RNA, 22 nt, Human
ccucaugcugagcgcagcaccc

SEQ ID NO: 1182638 - RNA, 25 nt, Human
ccucaugcugagcgcagcacccguu

SEQ ID NO: 1182639 - RNA, 24 nt, Human
ccuccuuccuuccaccucuggcca

SEQ ID NO: 1182640 - RNA, 24 nt, Human
ccucucugggcaaggcuuggaggc

SEQ ID NO: 1182641 - RNA, 24 nt, Human
ccuuuccuccuuccuuccaccucu

SEQ ID NO: 1182642 - RNA, 23 nt, Human
cuaaggcagagcuggaggagugg

SEQ ID NO: 1182643 - RNA, 23 nt, Human
cuccaaaagcuuccacuaccucc

SEQ ID NO: 1182644 - RNA, 22 nt, Human
cuccuuccuuccaccucuggcc

SEQ ID NO: 1182645 - RNA, 26 nt, Human
cucuccuuuccuccuuccuuccaccu

SEQ ID NO: 1182646 - RNA, 21 nt, Human
cugaagccaggauuuaaaucc

SEQ ID NO: 1182647 - RNA, 22 nt, Human
cugacaauguccuuaaaguccu

SEQ ID NO: 1182648 - RNA, 23 nt, Human
cuggaaguauggaggccccucuc

SEQ ID NO: 1182649 - RNA, 18 nt, Human
cugguguacgaugccagg

SEQ ID NO: 1182650 - RNA, 22 nt, Human
cuguaaaaauacaauccgauga

SEQ ID NO: 1182651 - RNA, 20 nt, Human
cuuuccuccuuccuuccacc

SEQ ID NO: 1182652 - RNA, 23 nt, Human
gaacagucagagccuaugccugu

SEQ ID NO: 1182653 - RNA, 19 nt, Human
gacuugcguaggccaauga

SEQ ID NO: 1182654 - RNA, 24 nt, Human
gagcgcagcacccguucgcacccc

SEQ ID NO: 1182655 - RNA, 22 nt, Human
gagcuccgugcccacccucuga

SEQ ID NO: 1182656 - RNA, 18 nt, Human
gagcuggaggaguggaac

SEQ ID NO: 1182657 - RNA, 20 nt, Human
gcaauagaucaccuggaacc

SEQ ID NO: 1182658 - RNA, 20 nt, Human
gccuccucugcaggcuuugc

SEQ ID NO: 1182659 - RNA, 21 nt, Human
gcgacuggggggcuugguggg

SEQ ID NO: 1182660 - RNA, 22 nt, Human
ggacucuucaaccagaaccaga

SEQ ID NO: 1182661 - RNA, 18 nt, Human
ggagcaaagauucaugga

SEQ ID NO: 1182662 - RNA, 24 nt, Human
ggaguauugccacuaagacuuaag

SEQ ID NO: 1182663 - RNA, 24 nt, Human
ggcauccucagagcaagacaaaaa

SEQ ID NO: 1182664 - RNA, 22 nt, Human
ggcugaugcuuuuggcagaaaa

SEQ ID NO: 1182665 - RNA, 22 nt, Human
gucccuucaagcccaggguggc

SEQ ID NO: 1182666 - RNA, 25 nt, Human
gucuauaugacagcgaaguccacca

SEQ ID NO: 1182667 - RNA, 23 nt, Human
uaacccccaguggggcucuggaa

SEQ ID NO: 1182668 - RNA, 23 nt, Human
uaauaagcacuuugaacauagau

SEQ ID NO: 1182669 - RNA, 22 nt, Human
uaccuguuccaagaauccagaa

SEQ ID NO: 1182670 - RNA, 24 nt, Human
uacgaugccaggagccuuggagug

SEQ ID NO: 1182671 - RNA, 22 nt, Human
uagaagggcaccuuuucugaua

SEQ ID NO: 1182672 - RNA, 21 nt, Human
uagauagaauagauuuuggcu

SEQ ID NO: 1182673 - RNA, 27 nt, Human
uagaucaccuggaaccacgcagcaucc

SEQ ID NO: 1182674 - RNA, 22 nt, Human
uaggcagugucacuuacacccc

SEQ ID NO: 1182675 - RNA, 21 nt, Human
uauggaggccccucuccuuuc

SEQ ID NO: 1182676 - RNA, 20 nt, Human
ucagaaaaaaaggaaaagca

SEQ ID NO: 1182677 - RNA, 23 nt, Human
ucagagauuuucauauagcacaa

SEQ ID NO: 1182678 - RNA, 22 nt, Human
uccaaaagcuuccacuaccucc

SEQ ID NO: 1182679 - RNA, 24 nt, Human
uccaagaauccagaacagcggacc

SEQ ID NO: 1182680 - RNA, 23 nt, Human
uccauaaacacugaagccaggau

SEQ ID NO: 1182681 - RNA, 22 nt, Human
uccguaaugagaacucugagac

SEQ ID NO: 1182682 - RNA, 23 nt, Human
ucugaacuuuaaacucgagaaag

SEQ ID NO: 1182683 - RNA, 21 nt, Human
ugaacauagaugaucucaacc

SEQ ID NO: 1182684 - RNA, 18 nt, Human
ugaagagcagugugagaa

SEQ ID NO: 1182685 - RNA, 21 nt, Human
ugaaggacgaucccauugcag

SEQ ID NO: 1182686 - RNA, 23 nt, Human
ugagcgcagcacccguucgcacc

SEQ ID NO: 1182687 - RNA, 21 nt, Human
ugauuuggggaggcaggagua

SEQ ID NO: 1182688 - RNA, 21 nt, Human
ugcaggcuuugcuucuccuuu

SEQ ID NO: 1182689 - RNA, 24 nt, Human
ugccaggagccuuggagugcaggg

SEQ ID NO: 1182690 - RNA, 23 nt, Human
ugcugcagcugcuuacgucacag

SEQ ID NO: 1182691 - RNA, 26 nt, Human
uggaaccacgcagcauccugaacccc

SEQ ID NO: 1182692 - RNA, 21 nt, Human
uggccaccuguuacaaaagca

SEQ ID NO: 1182693 - RNA, 23 nt, Human
uggccagcgaggcagaacucaca

SEQ ID NO: 1182694 - RNA, 23 nt, Human
uggccuccucugcaggcuuugcu

SEQ ID NO: 1182695 - RNA, 18 nt, Human
uggggaggcaggaguagg

SEQ ID NO: 1182696 - RNA, 19 nt, Human
uggggggcuuggugggggg

SEQ ID NO: 1182697 - RNA, 22 nt, Human
ugguguacgaugccaggagccu

SEQ ID NO: 1182698 - RNA, 20 nt, Human
ugguuaagaccuccaaaagc

SEQ ID NO: 1182699 - RNA, 19 nt, Human
ugugagaaucagcaaucac

SEQ ID NO: 1182700 - RNA, 19 nt, Human
uguuccaagaauccagaac

SEQ ID NO: 1182701 - RNA, 18 nt, Human
uuacauguccccgucucu

SEQ ID NO: 1182702 - RNA, 18 nt, Human
uucagaaaaaaaggaaaa

SEQ ID NO: 1182703 - RNA, 25 nt, Human
uucagaccuagagcucagacuugcc

SEQ ID NO: 1182704 - RNA, 26 nt, Human
uucaugauccucugaacuuuaaacuc

SEQ ID NO: 1182705 - RNA, 18 nt, Human
uucccaggauggggacau

SEQ ID NO: 1182706 - RNA, 20 nt, Human
uugcuggugcugguguacga

SEQ ID NO: 1182707 - RNA, 19 nt, Human
uugcuucuccuuuugagau

SEQ ID NO: 1182708 - RNA, 22 nt, Human
uuuaaagcaguuuccacagagc

SEQ ID NO: 1182709 - RNA, 22 nt, Human
uuuacuaagaccuaugguucca

SEQ ID NO: 1182710 - RNA, 18 nt, Human
uuuccacagagcaccccu

SEQ ID NO: 1182711 - RNA, 18 nt, Human
uuuggcugaugcuuuugg

SEQ ID NO: 1182712 - RNA, 19 nt, Human
uuuucauauagcacaaagc

SEQ ID NO: 1182713 - RNA, 18 nt, Human
aaagcccuuugaccugcc

SEQ ID NO: 1182714 - RNA, 19 nt, Human
aaagugcuuggauuacaga

SEQ ID NO: 1182715 - RNA, 24 nt, Human
aaagugcuuggauuacagauguga

SEQ ID NO: 1182716 - RNA, 20 nt, Human
aacaguuuuagcuggguuug

SEQ ID NO: 1182717 - RNA, 24 nt, Human
aaccacaccgccauugaggcuuaa

SEQ ID NO: 1182718 - RNA, 22 nt, Human
aagagauggggucucacuaugu

SEQ ID NO: 1182719 - RNA, 21 nt, Human
aagagcuucuccauccucuga

SEQ ID NO: 1182720 - RNA, 18 nt, Human
aaugaagaaagaugauuc

SEQ ID NO: 1182721 - RNA, 27 nt, Human
acuauguugcccaggcuggagugaggu

SEQ ID NO: 1182722 - RNA, 21 nt, Human
agagacaaggucuugcuuucu

SEQ ID NO: 1182723 - RNA, 19 nt, Human
agcuggucucaaacuccug

SEQ ID NO: 1182724 - RNA, 24 nt, Human
agcuggucucaaacuccuggcuuc

SEQ ID NO: 1182725 - RNA, 18 nt, Human
aguagcugggacuauagg

SEQ ID NO: 1182726 - RNA, 18 nt, Human
auggggucucacuauguu

SEQ ID NO: 1182727 - RNA, 19 nt, Human
auggggucucacuauguug

SEQ ID NO: 1182728 - RNA, 21 nt, Human
caaacuccuggcuucaagcua

SEQ ID NO: 1182729 - RNA, 24 nt, Human
caaagugcuuggauuacagaugug

SEQ ID NO: 1182730 - RNA, 24 nt, Human
caacuccugugcucaagugauccu

SEQ ID NO: 1182731 - RNA, 20 nt, Human
caagugauccuuccaccuca

SEQ ID NO: 1182732 - RNA, 27 nt, Human
caagugauccuuccaccucagccuccu

SEQ ID NO: 1182733 - RNA, 20 nt, Human
cacacauaaaucuagacagc

SEQ ID NO: 1182734 - RNA, 22 nt, Human
cacauagaauucuuucucuuug

SEQ ID NO: 1182735 - RNA, 24 nt, Human
cacauagaauucuuucucuuugug

SEQ ID NO: 1182736 - RNA, 21 nt, Human
caccccaccuacaaccacacc

SEQ ID NO: 1182737 - RNA, 18 nt, Human
cacccccaccccaccuac

SEQ ID NO: 1182738 - RNA, 24 nt, Human
caccucagccuccugaguagcugg

SEQ ID NO: 1182739 - RNA, 18 nt, Human
cacuauguugcccaggcu

SEQ ID NO: 1182740 - RNA, 22 nt, Human
cacuauguugcccaggcuggag

SEQ ID NO: 1182741 - RNA, 24 nt, Human
cacuauguugcccaggcuggagug

SEQ ID NO: 1182742 - RNA, 20 nt, Human
cagccuccugaguagcuggg

SEQ ID NO: 1182743 - RNA, 25 nt, Human
cagccucgaccucccaaagugcuug

SEQ ID NO: 1182744 - RNA, 23 nt, Human
cagcucccucuucuagagcguuu

SEQ ID NO: 1182745 - RNA, 22 nt, Human
cauccucugaauccaaagcccu

SEQ ID NO: 1182746 - RNA, 21 nt, Human
cauggcucacuguauccucca

SEQ ID NO: 1182747 - RNA, 24 nt, Human
cauucugcaaauauuucaccagcc

SEQ ID NO: 1182748 - RNA, 22 nt, Human
ccaaagugcuuggauuacagau

SEQ ID NO: 1182749 - RNA, 24 nt, Human
ccaaagugcuuggauuacagaugu

SEQ ID NO: 1182750 - RNA, 24 nt, Human
ccacccccaccccaccuacaacca

SEQ ID NO: 1182751 - RNA, 30 nt, Human
ccacccccaccccaccuacaaccacacugu

SEQ ID NO: 1182752 - RNA, 23 nt, Human
ccaccucagccuccugaguagcu

SEQ ID NO: 1182753 - RNA, 25 nt, Human
cccaccccaccuacaaccacaccgc

SEQ ID NO: 1182754 - RNA, 19 nt, Human
cccaggcuggagugaggug

SEQ ID NO: 1182755 - RNA, 20 nt, Human
cccaggcuggagugaggugg

SEQ ID NO: 1182756 - RNA, 22 nt, Human
cccccaccccaccuacaaccac

SEQ ID NO: 1182757 - RNA, 18 nt, Human
ccuacaaccacaccgcca

SEQ ID NO: 1182758 - RNA, 24 nt, Human
ccuacaaccacaccgccauugagg

SEQ ID NO: 1182759 - RNA, 25 nt, Human
ccuacaaccacaccgccauugaggc

SEQ ID NO: 1182760 - RNA, 19 nt, Human
ccugaguagcugggacuau

SEQ ID NO: 1182761 - RNA, 24 nt, Human
ccugaguagcugggacuauaggug

SEQ ID NO: 1182762 - RNA, 21 nt, Human
ccuguaccucaccuccacuua

SEQ ID NO: 1182763 - RNA, 20 nt, Human
ccugugcucaagugauccuu

SEQ ID NO: 1182764 - RNA, 24 nt, Human
ccuuccaccucagccuccugagua

SEQ ID NO: 1182765 - RNA, 24 nt, Human
cucaagugauccuuccaccucagc

SEQ ID NO: 1182766 - RNA, 21 nt, Human
cucacuguauccuccaacucc

SEQ ID NO: 1182767 - RNA, 24 nt, Human
cucagccuccugaguagcugggac

SEQ ID NO: 1182768 - RNA, 18 nt, Human
cugcuggguguggccaug

SEQ ID NO: 1182769 - RNA, 19 nt, Human
gagaugaugagaacuggag

SEQ ID NO: 1182770 - RNA, 26 nt, Human
gaguagcugggacuauaggugcacac

SEQ ID NO: 1182771 - RNA, 18 nt, Human
gauuacagaugugaguca

SEQ ID NO: 1182772 - RNA, 22 nt, Human
gauuacagaugugagucacugc

SEQ ID NO: 1182773 - RNA, 23 nt, Human
gauuacagaugugagucacugca

SEQ ID NO: 1182774 - RNA, 19 nt, Human
gcaccuggccuggcuaugu

SEQ ID NO: 1182775 - RNA, 19 nt, Human
gccuccacccccaccccac

SEQ ID NO: 1182776 - RNA, 21 nt, Human
gccucuuguguuuggccucac

SEQ ID NO: 1182777 - RNA, 22 nt, Human
gcucaagugauccuuccaccuc

SEQ ID NO: 1182778 - RNA, 22 nt, Human
ggagaugaugagaacuggagcg

SEQ ID NO: 1182779 - RNA, 20 nt, Human
ggauuacagaugugagucac

SEQ ID NO: 1182780 - RNA, 22 nt, Human
ggcuggagugagguggugugau

SEQ ID NO: 1182781 - RNA, 22 nt, Human
ggggucucacuauguugcccag

SEQ ID NO: 1182782 - RNA, 22 nt, Human
gggucucacuauguugcccagg

SEQ ID NO: 1182783 - RNA, 22 nt, Human
ggguguggccaugugacuaagc

SEQ ID NO: 1182784 - RNA, 22 nt, Human
gguggugugaucauggcucacu

SEQ ID NO: 1182785 - RNA, 20 nt, Human
guaucaacaacuucaaugaa

SEQ ID NO: 1182786 - RNA, 24 nt, Human
gugauccuuccaccucagccuccu

SEQ ID NO: 1182787 - RNA, 23 nt, Human
uaaagagauggggucucacuaug

SEQ ID NO: 1182788 - RNA, 18 nt, Human
uaacaaaauuagaagcua

SEQ ID NO: 1182789 - RNA, 21 nt, Human
uaagcaacuuccuggugaugu

SEQ ID NO: 1182790 - RNA, 26 nt, Human
uacaaggggaagccuuguguugagga

SEQ ID NO: 1182791 - RNA, 21 nt, Human
uacacaaaacauuucuuguca

SEQ ID NO: 1182792 - RNA, 21 nt, Human
uacacaaugccuagcauauug

SEQ ID NO: 1182793 - RNA, 19 nt, Human
uagaagacauguaagcaac

SEQ ID NO: 1182794 - RNA, 18 nt, Human
uagagacaaggucuugcu

SEQ ID NO: 1182795 - RNA, 22 nt, Human
uagcuggguuugggguuaccua

SEQ ID NO: 1182796 - RNA, 23 nt, Human
uaggugcacaccaccacacaugg

SEQ ID NO: 1182797 - RNA, 18 nt, Human
uauguugcccaggcugga

SEQ ID NO: 1182798 - RNA, 22 nt, Human
uauguugcccaggcuggaguga

SEQ ID NO: 1182799 - RNA, 23 nt, Human
uauuacacaaugccuagcauauu

SEQ ID NO: 1182800 - RNA, 18 nt, Human
ucacugcaccuggccugg

SEQ ID NO: 1182801 - RNA, 18 nt, Human
ucacugcaccuggccugg

SEQ ID NO: 1182802 - RNA, 19 nt, Human
ucacugcaccuggccuggc

SEQ ID NO: 1182803 - RNA, 22 nt, Human
ucacugcaccuggccuggcuau

SEQ ID NO: 1182804 - RNA, 23 nt, Human
ucagccuccugaguagcugggac

SEQ ID NO: 1182805 - RNA, 21 nt, Human
ucauaacauccucucggcuga

SEQ ID NO: 1182806 - RNA, 24 nt, Human
uccaaagcccuuugaccugccucu

SEQ ID NO: 1182807 - RNA, 18 nt, Human
ucccaaagugcuuggauu

SEQ ID NO: 1182808 - RNA, 19 nt, Human
uccuccagccucgaccucc

SEQ ID NO: 1182809 - RNA, 24 nt, Human
uccugaguagcugggacuauaggu

SEQ ID NO: 1182810 - RNA, 22 nt, Human
ucucacuauguugcccaggcug

SEQ ID NO: 1182811 - RNA, 23 nt, Human
ucucacuauguugcccaggcugg

SEQ ID NO: 1182812 - RNA, 24 nt, Human
ucucacuauguugcccaggcugga

SEQ ID NO: 1182813 - RNA, 26 nt, Human
ucucacuauguugcccaggcuggagu

SEQ ID NO: 1182814 - RNA, 23 nt, Human
ucuugcuuucuuauccaagcugg

SEQ ID NO: 1182815 - RNA, 19 nt, Human
ucuuucugcuggguguggc

SEQ ID NO: 1182816 - RNA, 27 nt, Human
ucuuugcaggccaaagaggacaggggu

SEQ ID NO: 1182817 - RNA, 24 nt, Human
ugaaauaccuuuggugaacuguga

SEQ ID NO: 1182818 - RNA, 27 nt, Human
ugagaaaaauuaacugcauugugguag

SEQ ID NO: 1182819 - RNA, 22 nt, Human
ugcacaccaccacacaugguua

SEQ ID NO: 1182820 - RNA, 21 nt, Human
ugcccaggcuggagugaggug

SEQ ID NO: 1182821 - RNA, 24 nt, Human
ugcccaggcuggagugagguggug

SEQ ID NO: 1182822 - RNA, 21 nt, Human
ugcuggguguggccaugugac

SEQ ID NO: 1182823 - RNA, 23 nt, Human
uggacucuuucuuacagcagcuu

SEQ ID NO: 1182824 - RNA, 18 nt, Human
uggauuacagaugugagu

SEQ ID NO: 1182825 - RNA, 20 nt, Human
uggauuacagaugugaguca

SEQ ID NO: 1182826 - RNA, 23 nt, Human
uggauuacagaugugagucacug

SEQ ID NO: 1182827 - RNA, 24 nt, Human
uggcucacuguauccuccaacucc

SEQ ID NO: 1182828 - RNA, 20 nt, Human
uggcuucaagcuauccucca

SEQ ID NO: 1182829 - RNA, 24 nt, Human
ugggacuauaggugcacaccacca

SEQ ID NO: 1182830 - RNA, 24 nt, Human
uggggucucacuauguugcccagg

SEQ ID NO: 1182831 - RNA, 23 nt, Human
uggugugaucauggcucacugua

SEQ ID NO: 1182832 - RNA, 21 nt, Human
uguauacaugaaugaauuaua

SEQ ID NO: 1182833 - RNA, 22 nt, Human
uuaaauaaccauaucuaaaaac

SEQ ID NO: 1182834 - RNA, 18 nt, Human
uucccaauaaauguguug

SEQ ID NO: 1182835 - RNA, 21 nt, Human
uugcccaggcuggagugaggu

SEQ ID NO: 1182836 - RNA, 22 nt, Human
uuggauuacagaugugagucac

SEQ ID NO: 1182837 - RNA, 24 nt, Human
uuggauuacagaugugagucacug

SEQ ID NO: 1182838 - RNA, 23 nt, Human
uuguuuuguuuuuuaaagagaug

SEQ ID NO: 1182839 - RNA, 23 nt, Human
uuuccuagaguucuuucugcugg

SEQ ID NO: 1182840 - RNA, 21 nt, Human
uuucuuacagcagcuuagccc

SEQ ID NO: 1182841 - RNA, 20 nt, Human
uuuguagagacaaggucuug

SEQ ID NO: 1182842 - RNA, 19 nt, Human
uuuucagaagcggaggaca

SEQ ID NO: 1182843 - RNA, 26 nt, Human
uuuuguuuuuuaaagagauggggucu

SEQ ID NO: 1182844 - RNA, 25 nt, Human
aaaaaacaaaaccauuaguucuuuc

SEQ ID NO: 1182845 - RNA, 19 nt, Human
aaaaaugcaaaaagaacau

SEQ ID NO: 1182846 - RNA, 23 nt, Human
aaaacaaaaccaccaacaaaaac

SEQ ID NO: 1182847 - RNA, 22 nt, Human
aaaacaaauaaauauaagauca

SEQ ID NO: 1182848 - RNA, 20 nt, Human
aaaagaggccuucaaacaua

SEQ ID NO: 1182849 - RNA, 23 nt, Human
aaacaaauaaauauaagaucaaa

SEQ ID NO: 1182850 - RNA, 19 nt, Human
aaaccaccaacaaaaacua

SEQ ID NO: 1182851 - RNA, 18 nt, Human
aaaccucagagagaacga

SEQ ID NO: 1182852 - RNA, 19 nt, Human
aaauagaugcuaacaauac

SEQ ID NO: 1182853 - RNA, 21 nt, Human
aacaaaaccaccaacaaaaac

SEQ ID NO: 1182854 - RNA, 20 nt, Human
aacugugcgcuccugcaagc

SEQ ID NO: 1182855 - RNA, 20 nt, Human
aagaagcaaaaagaaucaca

SEQ ID NO: 1182856 - RNA, 28 nt, Human
aagagaaaauaccaagaagcaaaaagaa

SEQ ID NO: 1182857 - RNA, 23 nt, Human
aagcaaagcaguuuacaaaaaga

SEQ ID NO: 1182858 - RNA, 20 nt, Human
aagcaagacucugcaagcug

SEQ ID NO: 1182859 - RNA, 21 nt, Human
aagcacacgccgcgaaagcac

SEQ ID NO: 1182860 - RNA, 22 nt, Human
aagccacaugaaagagcaagcc

SEQ ID NO: 1182861 - RNA, 20 nt, Human
aagcugcaauauaguuugag

SEQ ID NO: 1182862 - RNA, 20 nt, Human
aaggacuuccuagcuucuuc

SEQ ID NO: 1182863 - RNA, 20 nt, Human
aaguuuucuucugaauauac

SEQ ID NO: 1182864 - RNA, 18 nt, Human
aauacuaaaauaagccaa

SEQ ID NO: 1182865 - RNA, 22 nt, Human
aaugaaaacaaaaccaccaaca

SEQ ID NO: 1182866 - RNA, 19 nt, Human
acacacagaccgcgaagaa

SEQ ID NO: 1182867 - RNA, 20 nt, Human
acacagaccgcgaagaagcc

SEQ ID NO: 1182868 - RNA, 22 nt, Human
acacagaccgcgaagaagccau

SEQ ID NO: 1182869 - RNA, 19 nt, Human
accaccaacaaaaacuaau

SEQ ID NO: 1182870 - RNA, 22 nt, Human
accgcgaagaagccaucacgga

SEQ ID NO: 1182871 - RNA, 21 nt, Human
accuaaaagcaagacucugca

SEQ ID NO: 1182872 - RNA, 22 nt, Human
acuacaauuuccugacuuuacc

SEQ ID NO: 1182873 - RNA, 24 nt, Human
acuacaauuuccugacuuuaccca

SEQ ID NO: 1182874 - RNA, 24 nt, Human
agaaaugcuccauccauucuugcc

SEQ ID NO: 1182875 - RNA, 23 nt, Human
agaacaaacauuggaagccagga

SEQ ID NO: 1182876 - RNA, 23 nt, Human
agaacccucgcaggccucugccc

SEQ ID NO: 1182877 - RNA, 26 nt, Human
agagcucacucacaccccaacagcuu

SEQ ID NO: 1182878 - RNA, 22 nt, Human
agggccccggccaggccuacug

SEQ ID NO: 1182879 - RNA, 19 nt, Human
agguacuguugggaaaacc

SEQ ID NO: 1182880 - RNA, 22 nt, Human
agguacuguugggaaaaccuca

SEQ ID NO: 1182881 - RNA, 22 nt, Human
auaagauacuguuuuucuuuuu

SEQ ID NO: 1182882 - RNA, 22 nt, Human
auagauacaagagaaaauacca

SEQ ID NO: 1182883 - RNA, 24 nt, Human
augaaaacaaaaccaccaacaaaa

SEQ ID NO: 1182884 - RNA, 18 nt, Human
augugccauucuggagag

SEQ ID NO: 1182885 - RNA, 24 nt, Human
caaaaauaaaugaaaacaaaacca

SEQ ID NO: 1182886 - RNA, 24 nt, Human
caaaaauuauccuaaaaacaaaua

SEQ ID NO: 1182887 - RNA, 22 nt, Human
caaaaccaccaacaaaaacuaa

SEQ ID NO: 1182888 - RNA, 28 nt, Human
caaaaccaccaacaaaaacuggagaccc

SEQ ID NO: 1182889 - RNA, 24 nt, Human
caagaagcaaaaagaaucacagaa

SEQ ID NO: 1182890 - RNA, 22 nt, Human
caagcgcaaacgagaacccucg

SEQ ID NO: 1182891 - RNA, 18 nt, Human
cacagaccgcgaagaagc

SEQ ID NO: 1182892 - RNA, 22 nt, Human
cacggacccgcggucgcuuccu

SEQ ID NO: 1182893 - RNA, 24 nt, Human
cacuguuaacucagaaaugcucca

SEQ ID NO: 1182894 - RNA, 20 nt, Human
cagagaauuacagauaugga

SEQ ID NO: 1182895 - RNA, 19 nt, Human
caggccccgggccaaguac

SEQ ID NO: 1182896 - RNA, 23 nt, Human
caggccuacuggaccuccagugc

SEQ ID NO: 1182897 - RNA, 18 nt, Human
cagggccccggccaggcc

SEQ ID NO: 1182898 - RNA, 18 nt, Human
cagggccccggccaggcc

SEQ ID NO: 1182899 - RNA, 21 nt, Human
caguagaaaaaggauuuucug

SEQ ID NO: 1182900 - RNA, 25 nt, Human
cauaaaaggaaccauuaaucuuuaa

SEQ ID NO: 1182901 - RNA, 19 nt, Human
caugugccauucuggagag

SEQ ID NO: 1182902 - RNA, 24 nt, Human
ccaaauagaugcuaacaauacuaa

SEQ ID NO: 1182903 - RNA, 22 nt, Human
ccccggaccacagcccuaaccc

SEQ ID NO: 1182904 - RNA, 25 nt, Human
ccccggccaggccuacuggaccucc

SEQ ID NO: 1182905 - RNA, 22 nt, Human
cccgcaagcgcaaacgagaacc

SEQ ID NO: 1182906 - RNA, 18 nt, Human
cccggaccacagcccuaa

SEQ ID NO: 1182907 - RNA, 20 nt, Human
cccggaccacagcccuaacc

SEQ ID NO: 1182908 - RNA, 21 nt, Human
cccggaccacagcccuaaccc

SEQ ID NO: 1182909 - RNA, 20 nt, Human
cccggagccaugugccauuc

SEQ ID NO: 1182910 - RNA, 23 nt, Human
cccgggcacccucgccccucagg

SEQ ID NO: 1182911 - RNA, 20 nt, Human
cccucgugaacacacagacc

SEQ ID NO: 1182912 - RNA, 21 nt, Human
ccgcggucgcuuccucggccc

SEQ ID NO: 1182913 - RNA, 24 nt, Human
ccuaacccgcaagcgcaaacgaga

SEQ ID NO: 1182914 - RNA, 23 nt, Human
ccucagggccccggccaggccua

SEQ ID NO: 1182915 - RNA, 23 nt, Human
ccucgcaggccucugcccggccc

SEQ ID NO: 1182916 - RNA, 22 nt, Human
ccucgccccucagggccccggc

SEQ ID NO: 1182917 - RNA, 21 nt, Human
ccugcaagcacacgccgcgaa

SEQ ID NO: 1182918 - RNA, 22 nt, Human
cgccugaacugugcgcuccugc

SEQ ID NO: 1182919 - RNA, 19 nt, Human
cgcugcccagggguucccc

SEQ ID NO: 1182920 - RNA, 26 nt, Human
cuaauucuagcagcaauucaauuagc

SEQ ID NO: 1182921 - RNA, 19 nt, Human
cucacaccccaacagcuug

SEQ ID NO: 1182922 - RNA, 18 nt, Human
cugauccugaagcagcca

SEQ ID NO: 1182923 - RNA, 18 nt, Human
cugcaagcugauccugaa

SEQ ID NO: 1182924 - RNA, 20 nt, Human
cugcaagcugauccugaagc

SEQ ID NO: 1182925 - RNA, 23 nt, Human
cugcggcguggcuuccgcgcucc

SEQ ID NO: 1182926 - RNA, 20 nt, Human
cuuaucccuagagaaaguaa

SEQ ID NO: 1182927 - RNA, 18 nt, Human
gaagcagccaguuacucg

SEQ ID NO: 1182928 - RNA, 19 nt, Human
gacccgcggucgcuuccuc

SEQ ID NO: 1182929 - RNA, 19 nt, Human
gagaacccucgcaggccuc

SEQ ID NO: 1182930 - RNA, 20 nt, Human
gagcaagccucaauacuagg

SEQ ID NO: 1182931 - RNA, 19 nt, Human
gaucuuuucguucaguggu

SEQ ID NO: 1182932 - RNA, 23 nt, Human
gcaaaaagaacauguacugcccu

SEQ ID NO: 1182933 - RNA, 18 nt, Human
gccgcggaagguguggga

SEQ ID NO: 1182934 - RNA, 18 nt, Human
gcuccugcaagcacacgc

SEQ ID NO: 1182935 - RNA, 27 nt, Human
gcuccugcaagcacacgccgcgaaagc

SEQ ID NO: 1182936 - RNA, 20 nt, Human
gggaagcccgggcacccucg

SEQ ID NO: 1182937 - RNA, 18 nt, Human
guaggcuuuccuacaaag

SEQ ID NO: 1182938 - RNA, 20 nt, Human
guggcuuccgcgcuccaccc

SEQ ID NO: 1182939 - RNA, 24 nt, Human
uaaaaauacuaaaauaagccaguc

SEQ ID NO: 1182940 - RNA, 23 nt, Human
uaaaauaagccaaauagaugcua

SEQ ID NO: 1182941 - RNA, 21 nt, Human
uaaagccacaugaaagagcaa

SEQ ID NO: 1182942 - RNA, 20 nt, Human
uaaauaauuaucaagccuuc

SEQ ID NO: 1182943 - RNA, 23 nt, Human
uaacaaaagaggccuucaaacau

SEQ ID NO: 1182944 - RNA, 20 nt, Human
uaacccgcaagcgcaaacga

SEQ ID NO: 1182945 - RNA, 23 nt, Human
uaauuaaaaaugcaaaaagaaca

SEQ ID NO: 1182946 - RNA, 23 nt, Human
uacaauaauuaaaaaugcaaaaa

SEQ ID NO: 1182947 - RNA, 21 nt, Human
uaccaagaagcaaaaagaauc

SEQ ID NO: 1182948 - RNA, 25 nt, Human
uaccaagaagcaaaaagaaucacag

SEQ ID NO: 1182949 - RNA, 18 nt, Human
uacccgagcccuaagugg

SEQ ID NO: 1182950 - RNA, 27 nt, Human
uagccaauuccgaauaccguggaacgu

SEQ ID NO: 1182951 - RNA, 21 nt, Human
uagcccaggcgcugcccacag

SEQ ID NO: 1182952 - RNA, 20 nt, Human
uaguguucuccauuccaaag

SEQ ID NO: 1182953 - RNA, 21 nt, Human
uaucaagccuucauauucuuu

SEQ ID NO: 1182954 - RNA, 23 nt, Human
ucaaaaauuauccuaaaaacaaa

SEQ ID NO: 1182955 - RNA, 25 nt, Human
ucaaaugaacacaucauuaucuaaa

SEQ ID NO: 1182956 - RNA, 23 nt, Human
ucagagguagcguuaggaugcaa

SEQ ID NO: 1182957 - RNA, 25 nt, Human
ucaguggucacucagcaguuucucu

SEQ ID NO: 1182958 - RNA, 24 nt, Human
uccauccauucuugccaucagaga

SEQ ID NO: 1182959 - RNA, 18 nt, Human
uccccggaccacagcccu

SEQ ID NO: 1182960 - RNA, 24 nt, Human
uccccggaccacagcccuaacccu

SEQ ID NO: 1182961 - RNA, 23 nt, Human
ucggcccggcucccuccagucgc

SEQ ID NO: 1182962 - RNA, 24 nt, Human
ucucgccccggccgagcagcugga

SEQ ID NO: 1182963 - RNA, 20 nt, Human
ucucugaauucucaagaagg

SEQ ID NO: 1182964 - RNA, 21 nt, Human
ucugcaagcugauccugaagc

SEQ ID NO: 1182965 - RNA, 26 nt, Human
ugaaaacaaaaccaccaacaaaaacu

SEQ ID NO: 1182966 - RNA, 21 nt, Human
ugaacacacagaccgcgaaga

SEQ ID NO: 1182967 - RNA, 18 nt, Human
ugacuguaauucugauga

SEQ ID NO: 1182968 - RNA, 20 nt, Human
ugagaaacugagaacaaaca

SEQ ID NO: 1182969 - RNA, 21 nt, Human
ugagaacaaacauuggaagcc

SEQ ID NO: 1182970 - RNA, 22 nt, Human
ugcaaaaagaacauguacugcc

SEQ ID NO: 1182971 - RNA, 22 nt, Human
ugcaaaaauaaaugaaaacaaa

SEQ ID NO: 1182972 - RNA, 23 nt, Human
ugcccagggguuccccggaccac

SEQ ID NO: 1182973 - RNA, 22 nt, Human
ugcccggcccucgugaacacac

SEQ ID NO: 1182974 - RNA, 23 nt, Human
ugccuuuauuccaaaaaacaaaa

SEQ ID NO: 1182975 - RNA, 25 nt, Human
ugcuaacuauucaguagaaaaagga

SEQ ID NO: 1182976 - RNA, 24 nt, Human
ugcuuuuuagcacugcaagccaau

SEQ ID NO: 1182977 - RNA, 21 nt, Human
uggcuuccgcgcuccaccccc

SEQ ID NO: 1182978 - RNA, 22 nt, Human
ugucccggcgccugaacugugc

SEQ ID NO: 1182979 - RNA, 23 nt, Human
uuaaaaauacuaaaauaagccaa

SEQ ID NO: 1182980 - RNA, 23 nt, Human
uuaaccacucaagaacauaauuc

SEQ ID NO: 1182981 - RNA, 22 nt, Human
uuacucaggaauuuuacaacag

SEQ ID NO: 1182982 - RNA, 23 nt, Human
uucaguagaaaaaggauuuucug

SEQ ID NO: 1182983 - RNA, 24 nt, Human
uuccaaaaaacaaaaccauuaguu

SEQ ID NO: 1182984 - RNA, 22 nt, Human
uuggaagccaggaaacaggcaa

SEQ ID NO: 1182985 - RNA, 20 nt, Human
uuuucugacuguaauucuga

SEQ ID NO: 1182986 - RNA, 18 nt, Human
uuuuguuugguuugugac

SEQ ID NO: 1182987 - RNA, 23 nt, Human
acugaagaugcacugaagauugg

SEQ ID NO: 1182988 - RNA, 18 nt, Human
auaugugugugugcgugu

SEQ ID NO: 1182989 - RNA, 29 nt, Human
auaugugugugugcgugugugugugugug

SEQ ID NO: 1182990 - RNA, 22 nt, Human
augugugugugcgugugugugu

SEQ ID NO: 1182991 - RNA, 23 nt, Human
cacccaaagauuuuuccuuugaa

SEQ ID NO: 1182992 - RNA, 24 nt, Human
ccaaagauuuuuccuuugaauccc

SEQ ID NO: 1182993 - RNA, 22 nt, Human
ccacagaaaacuguucuucacc

SEQ ID NO: 1182994 - RNA, 25 nt, Human
cccaaagauuuuuccuuugaauccu

SEQ ID NO: 1182995 - RNA, 24 nt, Human
cucuuugaacuuauccagauagua

SEQ ID NO: 1182996 - RNA, 22 nt, Human
cuuuuugaauugacugaagaug

SEQ ID NO: 1182997 - RNA, 24 nt, Human
gagugcuaaucagggaaucaccca

SEQ ID NO: 1182998 - RNA, 21 nt, Human
gauaugugugugugcgugugu

SEQ ID NO: 1182999 - RNA, 22 nt, Human
uaaaagaccaggucacauuucu

SEQ ID NO: 1183000 - RNA, 18 nt, Human
uacaaaguuucauaauua

SEQ ID NO: 1183001 - RNA, 20 nt, Human
uagauaauccuggucuaaga

SEQ ID NO: 1183002 - RNA, 18 nt, Human
uaugugugugugcgugug

SEQ ID NO: 1183003 - RNA, 24 nt, Human
ucacccaaagauuuuuccuuugaa

SEQ ID NO: 1183004 - RNA, 26 nt, Human
ucaccuaaagaucuuuuugaauugac

SEQ ID NO: 1183005 - RNA, 22 nt, Human
uccucugaagaaaaagccucau

SEQ ID NO: 1183006 - RNA, 25 nt, Human
uccuuugaauccccagauaauuuuc

SEQ ID NO: 1183007 - RNA, 23 nt, Human
ucuagagaaaaaucacuuuguau

SEQ ID NO: 1183008 - RNA, 18 nt, Human
ucugaagaaaaagccuca

SEQ ID NO: 1183009 - RNA, 23 nt, Human
ugaagaaaaagccucauuuuuau

SEQ ID NO: 1183010 - RNA, 21 nt, Human
ugcgugugugugugugugugu

SEQ ID NO: 1183011 - RNA, 23 nt, Human
ugcguguguguguguguguguaa

SEQ ID NO: 1183012 - RNA, 21 nt, Human
ugugauaugugugugugcgug

SEQ ID NO: 1183013 - RNA, 21 nt, Human
ugugcgugugugugugugugu

SEQ ID NO: 1183014 - RNA, 19 nt, Human
ugugugcgugugugugugu

SEQ ID NO: 1183015 - RNA, 25 nt, Human
ugugugugcgugugugugugugugu

SEQ ID NO: 1183016 - RNA, 25 nt, Human
ugugugugugcgugugugugugugu

SEQ ID NO: 1183017 - RNA, 19 nt, Human
uguguguguguaugagugu

SEQ ID NO: 1183018 - RNA, 21 nt, Human
uguguguguguguaugagugu

SEQ ID NO: 1183019 - RNA, 20 nt, Human
uguguguguguguguguaug

SEQ ID NO: 1183020 - RNA, 25 nt, Human
uguguguguguguguguaugagugu

SEQ ID NO: 1183021 - RNA, 18 nt, Human
uugccuguuugcuucuga

SEQ ID NO: 1183022 - RNA, 23 nt, Human
uuucuagagaaaaaucacuuugu

SEQ ID NO: 1183023 - RNA, 19 nt, Human
uuugccuguuugcuucuga

SEQ ID NO: 1183024 - RNA, 26 nt, Human
aaagucuuuccauguucaguccacuu

SEQ ID NO: 1183025 - RNA, 24 nt, Human
accacaauaaguacuuaagcugaa

SEQ ID NO: 1183026 - RNA, 23 nt, Human
cacuaccacaauaaguacuuaag

SEQ ID NO: 1183027 - RNA, 24 nt, Human
guucaguccacuuuggcucuggaa

SEQ ID NO: 1183028 - RNA, 23 nt, Human
uccacugugcaaagcaucuuguc

SEQ ID NO: 1183029 - RNA, 24 nt, Human
uccacuuuggcucuggaaccugga

SEQ ID NO: 1183030 - RNA, 24 nt, Human
ucccucuucaagccucaagcgcug

SEQ ID NO: 1183031 - RNA, 20 nt, Human
ucuccgacucccuccagucc

SEQ ID NO: 1183032 - RNA, 21 nt, Human
ugucucccucuucaagccuca

SEQ ID NO: 1183033 - RNA, 20 nt, Human
uucaagccucaagcgcugac

SEQ ID NO: 1183034 - RNA, 22 nt, Human
aucacagaaucaaagucacuuc

SEQ ID NO: 1183035 - RNA, 20 nt, Human
auggaaagacacauauggua

SEQ ID NO: 1183036 - RNA, 24 nt, Human
caagucauuagagucuuuggauuu

SEQ ID NO: 1183037 - RNA, 18 nt, Human
gagaagcaagagugaauc

SEQ ID NO: 1183038 - RNA, 19 nt, Human
uagagucuuuacaagucau

SEQ ID NO: 1183039 - RNA, 32 nt, Human
aagagcuccuggauggcugugcuauugccccc

SEQ ID NO: 1183040 - RNA, 27 nt, Human
acagcagccacggugaggucgggcuuc

SEQ ID NO: 1183041 - RNA, 23 nt, Human
augcgccccagaggcuggagcag

SEQ ID NO: 1183042 - RNA, 21 nt, Human
cagcgaggugcaaacgcgacg

SEQ ID NO: 1183043 - RNA, 23 nt, Human
ccagaggcuggagcagcgaggug

SEQ ID NO: 1183044 - RNA, 19 nt, Human
ccccagaggcuggagcagc

SEQ ID NO: 1183045 - RNA, 24 nt, Human
ccccagaggcuggagcagcgaggu

SEQ ID NO: 1183046 - RNA, 19 nt, Human
gacauuguuggggauccau

SEQ ID NO: 1183047 - RNA, 21 nt, Human
gccccagaggcuggagcagcg

SEQ ID NO: 1183048 - RNA, 20 nt, Human
gcgccccagaggcuggagca

SEQ ID NO: 1183049 - RNA, 19 nt, Human
ggccguggcgggggucaca

SEQ ID NO: 1183050 - RNA, 23 nt, Human
gugcuauugccaaugaaggugac

SEQ ID NO: 1183051 - RNA, 22 nt, Human
uaagcaucugcucaucgaccuc

SEQ ID NO: 1183052 - RNA, 21 nt, Human
ucugcucaucgaccuccuuca

SEQ ID NO: 1183053 - RNA, 21 nt, Human
ugagguaucggccguggcggg

SEQ ID NO: 1183054 - RNA, 19 nt, Human
uggaaugcgccccagaggc

SEQ ID NO: 1183055 - RNA, 18 nt, Human
ugucacagacggcugucu

SEQ ID NO: 1183056 - RNA, 32 nt, Human; identical to SEQ ID NO: 1183039

SEQ ID NO: 1183057 - RNA, 22 nt, Human
agggagaaaggagaggggaggg

SEQ ID NO: 1183058 - RNA, 23 nt, Human
augcgccccagaggcuggagcag

SEQ ID NO: 1183059 - RNA, 21 nt, Human
cagcgaggugcaaacgcgacg

SEQ ID NO: 1183060 - RNA, 23 nt, Human
ccagaggcuggagcagcgaggug

SEQ ID NO: 1183061 - RNA, 19 nt, Human
ccccagaggcuggagcagc

SEQ ID NO: 1183062 - RNA, 24 nt, Human
ccccagaggcuggagcagcgaggu

SEQ ID NO: 1183063 - RNA, 20 nt, Human
ccggggcugggaggcgggag

SEQ ID NO: 1183064 - RNA, 21 nt, Human
cggggcugggaggcgggagaa

SEQ ID NO: 1183065 - RNA, 24 nt, Human
cucucagccucggugaacuccauc

SEQ ID NO: 1183066 - RNA, 19 nt, Human
gacauuguuggggauccau

SEQ ID NO: 1183067 - RNA, 18 nt, Human
gagggcgcggagggaaag

SEQ ID NO: 1183068 - RNA, 21 nt, Human
gccccagaggcuggagcagcg

SEQ ID NO: 1183069 - RNA, 20 nt, Human
gcgccccagaggcuggagca

SEQ ID NO: 1183070 - RNA, 21 nt, Human
gcgccggggcugggaggcggg

SEQ ID NO: 1183071 - RNA, 19 nt, Human
ggagaaaggagaggggagg

SEQ ID NO: 1183072 - RNA, 23 nt, Human
ggagaggggagggcgcggaggga

SEQ ID NO: 1183073 - RNA, 22 nt, Human
ggcaggaagguucugagaggga

SEQ ID NO: 1183074 - RNA, 23 nt, Human
gugcuauugccaaugaaggugac

SEQ ID NO: 1183075 - RNA, 22 nt, Human
uaagcaucugcucaucgaccuc

SEQ ID NO: 1183076 - RNA, 21 nt, Human
ucauguugcucucagccucgg

SEQ ID NO: 1183077 - RNA, 19 nt, Human
uggaaugcgccccagaggc

SEQ ID NO: 1183078 - RNA, 27 nt, Human
ugggcggggcgcgcgugcgccggggcu

SEQ ID NO: 1183079 - RNA, 18 nt, Human
ugucacagacggcugucu

SEQ ID NO: 1183080 - RNA, 23 nt, Human
agcaucucuucaaauauagcucc

SEQ ID NO: 1183081 - RNA, 19 nt, Human
aucacaguucucuaaauca

SEQ ID NO: 1183082 - RNA, 22 nt, Human
aucacaguucucuaaaucagug

SEQ ID NO: 1183083 - RNA, 18 nt, Human
auuuucuacaucuuccuc

SEQ ID NO: 1183084 - RNA, 21 nt, Human
cagccccuaaaauucucaucu

SEQ ID NO: 1183085 - RNA, 19 nt, Human
caggaggcuuagaaucugc

SEQ ID NO: 1183086 - RNA, 18 nt, Human
uaauggugucagcaucuc

SEQ ID NO: 1183087 - RNA, 21 nt, Human
uacaguguuguuucuucuaga

SEQ ID NO: 1183088 - RNA, 27 nt, Human
ucagcaucucuucaaauauagcucccu

SEQ ID NO: 1183089 - RNA, 18 nt, Human
ucagugccugccagaguu

SEQ ID NO: 1183090 - RNA, 19 nt, Human
ucagugccugccagaguug

SEQ ID NO: 1183091 - RNA, 21 nt, Human
ugauaaggaaaacauuuucau

SEQ ID NO: 1183092 - RNA, 21 nt, Human
uuccuccagccccuaaaauuc

SEQ ID NO: 1183093 - RNA, 25 nt, Human
accauguugcccaagcuggucucaa

SEQ ID NO: 1183094 - RNA, 23 nt, Human
accucagccucccaaagugaugg

SEQ ID NO: 1183095 - RNA, 20 nt, Human
accucccaccucagccuccc

SEQ ID NO: 1183096 - RNA, 20 nt, Human
agcuggucucaaacuccugg

SEQ ID NO: 1183097 - RNA, 20 nt, Human
caacaagaaagccugagguc

SEQ ID NO: 1183098 - RNA, 24 nt, Human
caccauguugcccaagcuggucuc

SEQ ID NO: 1183099 - RNA, 27 nt, Human
caccauguugcccaagcuggucucaaa

SEQ ID NO: 1183100 - RNA, 21 nt, Human
caccugcagaaucaaggcccc

SEQ ID NO: 1183101 - RNA, 24 nt, Human
cauguugcccaagcuggucucaaa

SEQ ID NO: 1183102 - RNA, 25 nt, Human
ccaccugcagaaucaaggcccccgg

SEQ ID NO: 1183103 - RNA, 20 nt, Human
ccgccgagacagcgcgggga

SEQ ID NO: 1183104 - RNA, 23 nt, Human
ccucccaccucagccucccaaag

SEQ ID NO: 1183105 - RNA, 21 nt, Human
ccugggcuuaagcaaaccucc

SEQ ID NO: 1183106 - RNA, 24 nt, Human
ccugggcuuaagcaaaccucccac

SEQ ID NO: 1183107 - RNA, 19 nt, Human
cugguuuggcaacaagaaa

SEQ ID NO: 1183108 - RNA, 20 nt, Human
guccaggcaucgggagugcc

SEQ ID NO: 1183109 - RNA, 20 nt, Human
guggaggagcagaugcuaca

SEQ ID NO: 1183110 - RNA, 20 nt, Human
uccugggccgccgagacagc

SEQ ID NO: 1183111 - RNA, 21 nt, Human
uccugggcuuaagcaaaccuc

SEQ ID NO: 1183112 - RNA, 23 nt, Human
ucucaaacuccugggcuuaagca

SEQ ID NO: 1183113 - RNA, 18 nt, Human
uggaaucugugcacaggc

SEQ ID NO: 1183114 - RNA, 19 nt, Human
uuccagggucccucugugg

SEQ ID NO: 1183115 - RNA, 21 nt, Human
uuggccacgcucuguucagcc

SEQ ID NO: 1183116 - RNA, 21 nt, Human
aaggaggacaaacccaggcca

SEQ ID NO: 1183117 - RNA, 22 nt, Human
aauccccauccccuacacccac

SEQ ID NO: 1183118 - RNA, 22 nt, Human
aauccccauccccuacacccac

SEQ ID NO: 1183119 - RNA, 21 nt, Human
aauucccuccacauccacucc

SEQ ID NO: 1183120 - RNA, 19 nt, Human
acaaacccaggccaccaca

SEQ ID NO: 1183121 - RNA, 23 nt, Human
acacacacacacacacacacaca

SEQ ID NO: 1183122 - RNA, 23 nt, Human
acacacacacacacacacacaca

SEQ ID NO: 1183123 - RNA, 23 nt, Human
acacacacacacacacacacaca

SEQ ID NO: 1183124 - RNA, 25 nt, Human
acacacacacacacacacacacaac

SEQ ID NO: 1183125 - RNA, 31 nt, Human
acacacacacacacacacacacaacaugcag

SEQ ID NO: 1183126 - RNA, 19 nt, Human
acaugcaaggaggacaaac

SEQ ID NO: 1183127 - RNA, 20 nt, Human
accacuaucacuacuaucuc

SEQ ID NO: 1183128 - RNA, 20 nt, Human
agaacugaccuacagacacu

SEQ ID NO: 1183129 - RNA, 24 nt, Human
aggaaagaaagaggguaccugcag

SEQ ID NO: 1183130 - RNA, 20 nt, Human
aggcaggacgcgggcaugug

SEQ ID NO: 1183131 - RNA, 21 nt, Human
agugucucuuggggaccaugg

SEQ ID NO: 1183132 - RNA, 21 nt, Human
auaaaauguacuaucuuagcc

SEQ ID NO: 1183133 - RNA, 23 nt, Human
auagugucucuuggggaccaugg

SEQ ID NO: 1183134 - RNA, 19 nt, Human
caacugcccaucccccagc

SEQ ID NO: 1183135 - RNA, 19 nt, Human
caagcaauccccauccccu

SEQ ID NO: 1183136 - RNA, 26 nt, Human
caagcaauccccauccccuacaccca

SEQ ID NO: 1183137 - RNA, 19 nt, Human
caaggaggacaaacccagg

SEQ ID NO: 1183138 - RNA, 26 nt, Human
cacaaucaaauacuugcuuauaauuu

SEQ ID NO: 1183139 - RNA, 28 nt, Human
cacacacacacacaacaugcagguuuaa

SEQ ID NO: 1183140 - RNA, 29 nt, Human
cacacacacacacacaacaugcagguuua

SEQ ID NO: 1183141 - RNA, 20 nt, Human
cacacacacacacacacaca

SEQ ID NO: 1183142 - RNA, 20 nt, Human
cacacacacacacacacaca

SEQ ID NO: 1183143 - RNA, 20 nt, Human
cacacacacacacacacaca

SEQ ID NO: 1183144 - RNA, 20 nt, Human
cacacacacacacacacaca

SEQ ID NO: 1183145 - RNA, 20 nt, Human
cacacacacacacacacaca

SEQ ID NO: 1183146 - RNA, 22 nt, Human
cacacacacacacacacacaca

SEQ ID NO: 1183147 - RNA, 27 nt, Human
cacacacacacacacacacacaacaug

SEQ ID NO: 1183148 - RNA, 26 nt, Human
cacacacacacacacacacacacaca

SEQ ID NO: 1183149 - RNA, 26 nt, Human
cacacacacacacacacacacacaca

SEQ ID NO: 1183150 - RNA, 31 nt, Human
cacagacacacacacacacacacacacacag

SEQ ID NO: 1183151 - RNA, 21 nt, Human
cauuaugucuucuccaagcaa

SEQ ID NO: 1183152 - RNA, 22 nt, Human
cauuuccaucacaguuugaagg

SEQ ID NO: 1183153 - RNA, 21 nt, Human
cauuucgcccucuagcggcaa

SEQ ID NO: 1183154 - RNA, 19 nt, Human
cauuuugugaucacuuuuu

SEQ ID NO: 1183155 - RNA, 22 nt, Human
ccacugcaacugcccauccccc

SEQ ID NO: 1183156 - RNA, 22 nt, Human
cccagauaaacucacaaucaaa

SEQ ID NO: 1183157 - RNA, 19 nt, Human
cccccagcagucgccaggc

SEQ ID NO: 1183158 - RNA, 21 nt, Human
cccccagcagucgccaggcac

SEQ ID NO: 1183159 - RNA, 18 nt, Human
ccccuccagagucaccac

SEQ ID NO: 1183160 - RNA, 20 nt, Human
ccugcaguucaaaccucauu

SEQ ID NO: 1183161 - RNA, 22 nt, Human
cgccaggcacagggcuccggaa

SEQ ID NO: 1183162 - RNA, 18 nt, Human
cgggcauguggauucuag

SEQ ID NO: 1183163 - RNA, 22 nt, Human
cuaaagggaaagucacaggaaa

SEQ ID NO: 1183164 - RNA, 23 nt, Human
cuagaaguccuuagaagaacuga

SEQ ID NO: 1183165 - RNA, 21 nt, Human
cuccaagcaauccccaucccc

SEQ ID NO: 1183166 - RNA, 22 nt, Human
cucuacccagauaaacucacaa

SEQ ID NO: 1183167 - RNA, 18 nt, Human
cugcacggagaccacuuc

SEQ ID NO: 1183168 - RNA, 23 nt, Human
cuucaauucccuccacauccacu

SEQ ID NO: 1183169 - RNA, 20 nt, Human
gaaaaaaguauuacuagaaa

SEQ ID NO: 1183170 - RNA, 19 nt, Human
gagcugccccuccagaguc

SEQ ID NO: 1183171 - RNA, 22 nt, Human
gcgugugcacacguggguguac

SEQ ID NO: 1183172 - RNA, 23 nt, Human
ggaauggcugugcuugcuaaagg

SEQ ID NO: 1183173 - RNA, 21 nt, Human
ggacaaacccaggccaccaca

SEQ ID NO: 1183174 - RNA, 19 nt, Human
ggcaggcagauccacucag

SEQ ID NO: 1183175 - RNA, 28 nt, Human
gguguacacagacacacacacacacaca

SEQ ID NO: 1183176 - RNA, 33 nt, Human
guacacagacacacacacacacacacacacagu

SEQ ID NO: 1183177 - RNA, 22 nt, Human
gucucuuggggaccauggauuc

SEQ ID NO: 1183178 - RNA, 24 nt, Human
guguacacagacacacacacacac

SEQ ID NO: 1183179 - RNA, 27 nt, Human
guguacacagacacacacacacacaca

SEQ ID NO: 1183180 - RNA, 19 nt, Human
uaaguaccuucacuuuguu

SEQ ID NO: 1183181 - RNA, 23 nt, Human
uacaaggcacuucacuugguucu

SEQ ID NO: 1183182 - RNA, 20 nt, Human
uacuagaaaggaaccugaac

SEQ ID NO: 1183183 - RNA, 23 nt, Human
uagaaaggaaccugaacguacaa

SEQ ID NO: 1183184 - RNA, 25 nt, Human
uagaaaggaaccugaacguacaaua

SEQ ID NO: 1183185 - RNA, 19 nt, Human
uagaagaacugaccuacag

SEQ ID NO: 1183186 - RNA, 19 nt, Human
uagguuuucauguaauuau

SEQ ID NO: 1183187 - RNA, 24 nt, Human
uaugucuucuccaagcaaucccca

SEQ ID NO: 1183188 - RNA, 24 nt, Human
ucaaucaaaacuuuaaaaaaaaaa

SEQ ID NO: 1183189 - RNA, 21 nt, Human
ucaauucccuccacauccacu

SEQ ID NO: 1183190 - RNA, 23 nt, Human
uccaagcaauccccauccccuac

SEQ ID NO: 1183191 - RNA, 24 nt, Human
uccacauccacuccaucaaauucc

SEQ ID NO: 1183192 - RNA, 22 nt, Human
ucccccagcagucgccaggccg

SEQ ID NO: 1183193 - RNA, 22 nt, Human
ucccccuucugcacggagacca

SEQ ID NO: 1183194 - RNA, 19 nt, Human
ucccuccacauccacucca

SEQ ID NO: 1183195 - RNA, 20 nt, Human
ugaaugcuuuggacacucua

SEQ ID NO: 1183196 - RNA, 21 nt, Human
ugcuugucuugcgugugcaca

SEQ ID NO: 1183197 - RNA, 24 nt, Human
uggauucuagacucauuucgcccu

SEQ ID NO: 1183198 - RNA, 22 nt, Human
uguaccacuaucacuacuaucu

SEQ ID NO: 1183199 - RNA, 23 nt, Human
uguccgggagccagcacagcugc

SEQ ID NO: 1183200 - RNA, 24 nt, Human
ugugaaaugacugggauggcuuuu

SEQ ID NO: 1183201 - RNA, 19 nt, Human
uuagaagaacugaccuaca

SEQ ID NO: 1183202 - RNA, 21 nt, Human
uuaugucuucuccaagcaauc

SEQ ID NO: 1183203 - RNA, 24 nt, Human
uucacuuuguuguaccacuaucac

SEQ ID NO: 1183204 - RNA, 19 nt, Human
uugaaggcccuuguggcaa

SEQ ID NO: 1183205 - RNA, 23 nt, Human
uuuuaguccauagggagcacagg

SEQ ID NO: 1183206 - RNA, 21 nt, Human
aauucccuccacauccacucc

SEQ ID NO: 1183207 - RNA, 19 nt, Human
acaaacccaggccaccaca

SEQ ID NO: 1183208 - RNA, 26 nt, Human
acacacacacacaacaugcagguuua

SEQ ID NO: 1183209 - RNA, 22 nt, Human
acacacacacacacacaacaug

SEQ ID NO: 1183210 - RNA, 27 nt, Human
acacacacacacacacacaacaugcag

SEQ ID NO: 1183211 - RNA, 23 nt, Human
acacacacacacacacacacaca

SEQ ID NO: 1183212 - RNA, 23 nt, Human
acacacacacacacacacacaca

SEQ ID NO: 1183213 - RNA, 23 nt, Human
acacacacacacacacacacaca

SEQ ID NO: 1183214 - RNA, 23 nt, Human
acacacacacacacacacacaca

SEQ ID NO: 1183215 - RNA, 23 nt, Human
acacacacacacacacacacaca

SEQ ID NO: 1183216 - RNA, 23 nt, Human
acacacacacacacacacacaca

SEQ ID NO: 1183217 - RNA, 23 nt, Human
acacacacacacacacacacaca

SEQ ID NO: 1183218 - RNA, 19 nt, Human
acaugcaaggaggacaaac

SEQ ID NO: 1183219 - RNA, 24 nt, Human
acuucaauucccuccacauccacu

SEQ ID NO: 1183220 - RNA, 19 nt, Human
caaggaggacaaacccagg

SEQ ID NO: 1183221 - RNA, 22 nt, Human
caaggaggacaaacccaggcca

SEQ ID NO: 1183222 - RNA, 28 nt, Human
cacacacacacacaacaugcagguuuaa

SEQ ID NO: 1183223 - RNA, 20 nt, Human
cacacacacacacacacaca

SEQ ID NO: 1183224 - RNA, 20 nt, Human
cacacacacacacacacaca

SEQ ID NO: 1183225 - RNA, 20 nt, Human
cacacacacacacacacaca

SEQ ID NO: 1183226 - RNA, 20 nt, Human
cacacacacacacacacaca

SEQ ID NO: 1183227 - RNA, 20 nt, Human
cacacacacacacacacaca

SEQ ID NO: 1183228 - RNA, 20 nt, Human
cacacacacacacacacaca

SEQ ID NO: 1183229 - RNA, 20 nt, Human
cacacacacacacacacaca

SEQ ID NO: 1183230 - RNA, 20 nt, Human
cacacacacacacacacaca

SEQ ID NO: 1183231 - RNA, 22 nt, Human
cacacacacacacacacacaca

SEQ ID NO: 1183232 - RNA, 22 nt, Human
cacacacacacacacacacaca

SEQ ID NO: 1183233 - RNA, 27 nt, Human
cacacacacacacacacacacacaaca

SEQ ID NO: 1183234 - RNA, 26 nt, Human
cacacacacacacacacacacacaca

SEQ ID NO: 1183235 - RNA, 26 nt, Human
cacacacacacacacacacacacaca

SEQ ID NO: 1183236 - RNA, 26 nt, Human
cacacacacacacacacacacacaca

SEQ ID NO: 1183237 - RNA, 30 nt, Human
cguggguguacacacacacacacacacaca

SEQ ID NO: 1183238 - RNA, 22 nt, Human
gcgugugcacacguggguguac

SEQ ID NO: 1183239 - RNA, 21 nt, Human
ggacaaacccaggccaccaca

SEQ ID NO: 1183240 - RNA, 25 nt, Human
guguacacacacacacacacacagu

SEQ ID NO: 1183241 - RNA, 26 nt, Human
gugugcacacguggguguacacacac

SEQ ID NO: 1183242 - RNA, 20 nt, Human
uacacacacacacacacaca

SEQ ID NO: 1183243 - RNA, 25 nt, Human
uacacacacacacacacacacacac

SEQ ID NO: 1183244 - RNA, 24 nt, Human
ucaaucaaaacuuuaaaaaaaaaa

SEQ ID NO: 1183245 - RNA, 21 nt, Human
ucaauucccuccacauccacu

SEQ ID NO: 1183246 - RNA, 24 nt, Human
uccacauccacuccaucaaauucc

SEQ ID NO: 1183247 - RNA, 19 nt, Human
ucccuccacauccacucca

SEQ ID NO: 1183248 - RNA, 21 nt, Human
ugcuugucuugcgugugcaca

SEQ ID NO: 1183249 - RNA, 25 nt, Human
uguacacacacacacacacacacac

SEQ ID NO: 1183250 - RNA, 24 nt, Human
ugugaaaugacugggauggcuuuu

SEQ ID NO: 1183251 - RNA, 23 nt, Human
uuuuaguccauagggagcacagg

SEQ ID NO: 1183252 - RNA, 22 nt, Human
aaacucaggcugacaaaugcaa

SEQ ID NO: 1183253 - RNA, 23 nt, Human
aaacugcccucaugauucaauug

SEQ ID NO: 1183254 - RNA, 19 nt, Human
aaaguuucacaauucacag

SEQ ID NO: 1183255 - RNA, 23 nt, Human
aacaaucauggcggaaggcacca

SEQ ID NO: 1183256 - RNA, 21 nt, Human
aacuuugccuuccuguaccac

SEQ ID NO: 1183257 - RNA, 22 nt, Human
aaggcaccagggcagcaggaga

SEQ ID NO: 1183258 - RNA, 19 nt, Human
aagugaacuuguccugggu

SEQ ID NO: 1183259 - RNA, 20 nt, Human
aauauggugaaacuccaucu

SEQ ID NO: 1183260 - RNA, 21 nt, Human
aauauggugaaacuccaucuc

SEQ ID NO: 1183261 - RNA, 22 nt, Human
acugaguaaucuguaaagaaga

SEQ ID NO: 1183262 - RNA, 18 nt, Human
acuugcagagaauguugg

SEQ ID NO: 1183263 - RNA, 20 nt, Human
acuugcagagaauguugucc

SEQ ID NO: 1183264 - RNA, 24 nt, Human
agaaaacuuaaaaacaaguccuga

SEQ ID NO: 1183265 - RNA, 18 nt, Human
agacaggaggaucacuug

SEQ ID NO: 1183266 - RNA, 23 nt, Human
agacaggaggaucacuugagccc

SEQ ID NO: 1183267 - RNA, 24 nt, Human
agacaggaggaucacuugagccca

SEQ ID NO: 1183268 - RNA, 21 nt, Human
agauaaugggugccaagugaa

SEQ ID NO: 1183269 - RNA, 21 nt, Human
agccagguguggugguacgug

SEQ ID NO: 1183270 - RNA, 19 nt, Human
agccugggcaauaugguga

SEQ ID NO: 1183271 - RNA, 22 nt, Human
agccugggcaauauggugaaac

SEQ ID NO: 1183272 - RNA, 23 nt, Human
agccugggcaauauggugaaacu

SEQ ID NO: 1183273 - RNA, 24 nt, Human
agccugggcaauauggugaaacuc

SEQ ID NO: 1183274 - RNA, 24 nt, Human
aggaucacuugagcccaggaguuu

SEQ ID NO: 1183275 - RNA, 24 nt, Human
aggcacaguggcucaugcuuguaa

SEQ ID NO: 1183276 - RNA, 21 nt, Human
aggcagaugguccugagucca

SEQ ID NO: 1183277 - RNA, 22 nt, Human
aggugagauuuggguggggaca

SEQ ID NO: 1183278 - RNA, 22 nt, Human
agucuccauucacccucugagc

SEQ ID NO: 1183279 - RNA, 23 nt, Human
aguggcucaugcuuguaauucca

SEQ ID NO: 1183280 - RNA, 24 nt, Human
aguggcucaugcuuguaauuccag

SEQ ID NO: 1183281 - RNA, 21 nt, Human
auggcaguauggguggugggu

SEQ ID NO: 1183282 - RNA, 19 nt, Human
auggugaaacuccaucucu

SEQ ID NO: 1183283 - RNA, 32 nt, Human
auuacaacacaaggugagauuuggguggggaa

SEQ ID NO: 1183284 - RNA, 21 nt, Human
auuuggguggggacacagcca

SEQ ID NO: 1183285 - RNA, 18 nt, Human
caaguccugaaagaacua

SEQ ID NO: 1183286 - RNA, 24 nt, Human
caauauggugaaacuccaucucug

SEQ ID NO: 1183287 - RNA, 23 nt, Human
cacagaguaaaacucaggaauac

SEQ ID NO: 1183288 - RNA, 19 nt, Human
cacagcccaaacuguccga

SEQ ID NO: 1183289 - RNA, 22 nt, Human
cagaguaaaacucaggaauacc

SEQ ID NO: 1183290 - RNA, 18 nt, Human
cagcacucugggaggccg

SEQ ID NO: 1183291 - RNA, 20 nt, Human
cagcacucugggaggccgag

SEQ ID NO: 1183292 - RNA, 24 nt, Human
cagcuuuauuuggaagcucaccca

SEQ ID NO: 1183293 - RNA, 18 nt, Human
caggagagauaaugggug

SEQ ID NO: 1183294 - RNA, 24 nt, Human
caggagagauaaugggugccaagu

SEQ ID NO: 1183295 - RNA, 25 nt, Human
caguaugggugguggguaaguuccu

SEQ ID NO: 1183296 - RNA, 21 nt, Human
cauagccaauaugcucucccc

SEQ ID NO: 1183297 - RNA, 24 nt, Human
caugcuuguaauuccagcacucug

SEQ ID NO: 1183298 - RNA, 21 nt, Human
ccccacccacaugcaagauug

SEQ ID NO: 1183299 - RNA, 22 nt, Human
cccuguuccuccuuuuucucuu

SEQ ID NO: 1183300 - RNA, 25 nt, Human
ccgaucaaaucagacgguuacccaa

SEQ ID NO: 1183301 - RNA, 18 nt, Human
ccugaaagaacuaaaugg

SEQ ID NO: 1183302 - RNA, 26 nt, Human
ccugaaagaacuaaaugguuuccaag

SEQ ID NO: 1183303 - RNA, 24 nt, Human
ccugggcaauauggugaaacucca

SEQ ID NO: 1183304 - RNA, 26 nt, Human
ccuguaccacuuccuccacauagcca

SEQ ID NO: 1183305 - RNA, 20 nt, Human
cgagacaggaggaucacuug

SEQ ID NO: 1183306 - RNA, 24 nt, Human
cgagacaggaggaucacuugagcc

SEQ ID NO: 1183307 - RNA, 23 nt, Human
cguuagaacucacucacuaucac

SEQ ID NO: 1183308 - RNA, 25 nt, Human
cucacagccuuccugcaaggcaguu

SEQ ID NO: 1183309 - RNA, 23 nt, Human
cucaccccacuaugaagaaauac

SEQ ID NO: 1183310 - RNA, 21 nt, Human
cucauagccaauaugcucucc

SEQ ID NO: 1183311 - RNA, 23 nt, Human
cucaugcuuguaauuccagcacu

SEQ ID NO: 1183312 - RNA, 19 nt, Human
cucccccacccacaugcaa

SEQ ID NO: 1183313 - RNA, 20 nt, Human
cugaaagaacuaaaugguuu

SEQ ID NO: 1183314 - RNA, 23 nt, Human
cugcucugcacuccacccacacc

SEQ ID NO: 1183315 - RNA, 25 nt, Human
cuguaccacuuccuccacauagcca

SEQ ID NO: 1183316 - RNA, 18 nt, Human
gaauucucacagccuucc

SEQ ID NO: 1183317 - RNA, 20 nt, Human
gacaaggauccuaucacagc

SEQ ID NO: 1183318 - RNA, 19 nt, Human
gacucuaauacgccccucu

SEQ ID NO: 1183319 - RNA, 28 nt, Human
gagaacagcaugggggaaaccgguaccc

SEQ ID NO: 1183320 - RNA, 20 nt, Human
gagauugagggucaggcaca

SEQ ID NO: 1183321 - RNA, 24 nt, Human
gaucacuugagcccaggaguuuaa

SEQ ID NO: 1183322 - RNA, 22 nt, Human
gcccaggaguuuaagaccagcc

SEQ ID NO: 1183323 - RNA, 18 nt, Human
ggaagcucacccaauuac

SEQ ID NO: 1183324 - RNA, 22 nt, Human
ggaucacuugagcccaggaguu

SEQ ID NO: 1183325 - RNA, 23 nt, Human
ggaucacuugagcccaggaguuu

SEQ ID NO: 1183326 - RNA, 22 nt, Human
gggucaggcacaguggcucaug

SEQ ID NO: 1183327 - RNA, 21 nt, Human
gggugguggguaaguuccugu

SEQ ID NO: 1183328 - RNA, 20 nt, Human
ggucaaacccagagcccaag

SEQ ID NO: 1183329 - RNA, 22 nt, Human
guaggcccuaggcacugugccu

SEQ ID NO: 1183330 - RNA, 28 nt, Human
guccugaaagaacuaaaugguuuccaag

SEQ ID NO: 1183331 - RNA, 18 nt, Human
uaacaggacaaggauccu

SEQ ID NO: 1183332 - RNA, 26 nt, Human
uaaguggccccaaggauguaucccag

SEQ ID NO: 1183333 - RNA, 21 nt, Human
uacaccguuucauuacuaucu

SEQ ID NO: 1183334 - RNA, 18 nt, Human
uagaguagagugcuucuc

SEQ ID NO: 1183335 - RNA, 22 nt, Human
uagccacguuuuccaauuauau

SEQ ID NO: 1183336 - RNA, 25 nt, Human
uaggcacugugccuauccccugaag

SEQ ID NO: 1183337 - RNA, 19 nt, Human
uaggcccuaggcacugugc

SEQ ID NO: 1183338 - RNA, 19 nt, Human
uaggggucaaacccagagc

SEQ ID NO: 1183339 - RNA, 21 nt, Human
uaucaugagaacagcaugggg

SEQ ID NO: 1183340 - RNA, 24 nt, Human
ucacagaguaaaacucaggaauac

SEQ ID NO: 1183341 - RNA, 23 nt, Human
ucacuugagcccaggaguuuaag

SEQ ID NO: 1183342 - RNA, 21 nt, Human
ucaggcacaguggcucaugcu

SEQ ID NO: 1183343 - RNA, 22 nt, Human
ucaugcuuguaauuccagcacu

SEQ ID NO: 1183344 - RNA, 18 nt, Human
ucucucuggccacccugu

SEQ ID NO: 1183345 - RNA, 22 nt, Human
ucucugcaaaaauauacaaaaa

SEQ ID NO: 1183346 - RNA, 20 nt, Human
ucuuugacuuuuuuuccaau

SEQ ID NO: 1183347 - RNA, 18 nt, Human
ugaaacauuguuuuccag

SEQ ID NO: 1183348 - RNA, 25 nt, Human
ugaaagaacuaaaugguuuccaagu

SEQ ID NO: 1183349 - RNA, 27 nt, Human
ugaaaguacuguaggcccuaggcacug

SEQ ID NO: 1183350 - RNA, 22 nt, Human
ugagauuuggguggggacacag

SEQ ID NO: 1183351 - RNA, 23 nt, Human
ugagcccaggaguuuaagaccag

SEQ ID NO: 1183352 - RNA, 21 nt, Human
ugccaagugaaggaggaagcc

SEQ ID NO: 1183353 - RNA, 24 nt, Human
ugccaagugaaggaggaagccccc

SEQ ID NO: 1183354 - RNA, 18 nt, Human
ugcccugcucugcacucc

SEQ ID NO: 1183355 - RNA, 21 nt, Human
ugccuuugacaccuugauuuu

SEQ ID NO: 1183356 - RNA, 21 nt, Human
ugcucugcacuccacccacac

SEQ ID NO: 1183357 - RNA, 22 nt, Human
uggaaauuuuccaccacccuga

SEQ ID NO: 1183358 - RNA, 20 nt, Human
uggacugauacucagcagca

SEQ ID NO: 1183359 - RNA, 24 nt, Human
ugggaggccgagacaggaggauca

SEQ ID NO: 1183360 - RNA, 21 nt, Human
ugggccccagucaacuuugcc

SEQ ID NO: 1183361 - RNA, 24 nt, Human
uggugguacgugucuguaguccca

SEQ ID NO: 1183362 - RNA, 22 nt, Human
ugguuuccaaguaacuuaaaug

SEQ ID NO: 1183363 - RNA, 21 nt, Human
uuaagugcccugcucugcacu

SEQ ID NO: 1183364 - RNA, 24 nt, Human
uuagaacucacucacuaucaccgc

SEQ ID NO: 1183365 - RNA, 24 nt, Human
uucacagugcuucugaugccuuug

SEQ ID NO: 1183366 - RNA, 21 nt, Human
uucaugagccccugaaaguac

SEQ ID NO: 1183367 - RNA, 21 nt, Human
uucauggcaguauggguggug

SEQ ID NO: 1183368 - RNA, 22 nt, Human
uugagcccaggaguuuaagacc

SEQ ID NO: 1183369 - RNA, 24 nt, Human
uugcauuauguuucugugggcccc

SEQ ID NO: 1183370 - RNA, 19 nt, Human
uuucccaagaaaccagcuu

SEQ ID NO: 1183371 - RNA, 23 nt, Human
aaagucuuucauuagaagugcuu

SEQ ID NO: 1183372 - RNA, 18 nt, Human
aaaucuuccccaacacac

SEQ ID NO: 1183373 - RNA, 18 nt, Human
aacaauacuccucuccuc

SEQ ID NO: 1183374 - RNA, 21 nt, Human
aacccaggacguaugagucuu

SEQ ID NO: 1183375 - RNA, 18 nt, Human
aagcaucuuaagaggccu

SEQ ID NO: 1183376 - RNA, 19 nt, Human
aagccaguuccacauuuga

SEQ ID NO: 1183377 - RNA, 24 nt, Human
aaugagauccuuccaaugucuccc

SEQ ID NO: 1183378 - RNA, 22 nt, Human
accacguaaaagugaguuacag

SEQ ID NO: 1183379 - RNA, 21 nt, Human
acccuagagccuuuuggugga

SEQ ID NO: 1183380 - RNA, 19 nt, Human
acucuaucagccaagguga

SEQ ID NO: 1183381 - RNA, 21 nt, Human
agaaacaauacuccucuccuc

SEQ ID NO: 1183382 - RNA, 24 nt, Human
agacaggagcuccugagaaggcaa

SEQ ID NO: 1183383 - RNA, 22 nt, Human
agcagagagccacucuccccca

SEQ ID NO: 1183384 - RNA, 23 nt, Human
aggaagaaaaaguucaaaacuaa

SEQ ID NO: 1183385 - RNA, 23 nt, Human
aggcaggaacuuaacccuggagc

SEQ ID NO: 1183386 - RNA, 19 nt, Human
aggcaugaacuccaaagcc

SEQ ID NO: 1183387 - RNA, 21 nt, Human
agguacugggagucacaggcu

SEQ ID NO: 1183388 - RNA, 24 nt, Human
aguggguggcccugcugaaggcag

SEQ ID NO: 1183389 - RNA, 26 nt, Human
aucacacagaugcacuaaaugcauaa

SEQ ID NO: 1183390 - RNA, 20 nt, Human
augacuuugggugggaauuu

SEQ ID NO: 1183391 - RNA, 24 nt, Human
auguugcacacagaacaauaugug

SEQ ID NO: 1183392 - RNA, 23 nt, Human
caaaacuaagaaaacccacaaaa

SEQ ID NO: 1183393 - RNA, 24 nt, Human
caaaacuaagaaaacccacaaaac

SEQ ID NO: 1183394 - RNA, 19 nt, Human
caagaaacaauacuccucu

SEQ ID NO: 1183395 - RNA, 22 nt, Human
caagugacugcuguauaaaucc

SEQ ID NO: 1183396 - RNA, 21 nt, Human
caccccuaaaacccaggacgu

SEQ ID NO: 1183397 - RNA, 20 nt, Human
cagagccugagagggcaugg

SEQ ID NO: 1183398 - RNA, 22 nt, Human
cagcagagagccacucuccccc

SEQ ID NO: 1183399 - RNA, 24 nt, Human
cagcagagagccacucucccccac

SEQ ID NO: 1183400 - RNA, 23 nt, Human
ccaaugucucaaguaugcucucc

SEQ ID NO: 1183401 - RNA, 26 nt, Human
ccccacuagaggguggacuccuccca

SEQ ID NO: 1183402 - RNA, 24 nt, Human
cccuaagucccaagcacaagucuc

SEQ ID NO: 1183403 - RNA, 23 nt, Human
ccuggagcuacagagccugagag

SEQ ID NO: 1183404 - RNA, 23 nt, Human
cgcccaaaugaauaucuuccaaa

SEQ ID NO: 1183405 - RNA, 19 nt, Human
cggcaaggggcccugucuc

SEQ ID NO: 1183406 - RNA, 20 nt, Human
cggcaaggggcccugucucc

SEQ ID NO: 1183407 - RNA, 18 nt, Human
cuacaaugagauccuucc

SEQ ID NO: 1183408 - RNA, 21 nt, Human
cucauaacugcuaaggcaguc

SEQ ID NO: 1183409 - RNA, 24 nt, Human
cuccaagaaacaauacuccucucc

SEQ ID NO: 1183410 - RNA, 22 nt, Human
cugacccagacaguacaucccu

SEQ ID NO: 1183411 - RNA, 21 nt, Human
cuggcuugcaccccuaaaacc

SEQ ID NO: 1183412 - RNA, 23 nt, Human
gaaagaaaagacuuagaacccua

SEQ ID NO: 1183413 - RNA, 20 nt, Human
gaauccauguugcacacaga

SEQ ID NO: 1183414 - RNA, 19 nt, Human
gagcuacagagccugagag

SEQ ID NO: 1183415 - RNA, 24 nt, Human
gcaaaaaggauguaauaccaaaag

SEQ ID NO: 1183416 - RNA, 18 nt, Human
gcacuaaaugcauaagca

SEQ ID NO: 1183417 - RNA, 18 nt, Human
gccugagagggcauggaa

SEQ ID NO: 1183418 - RNA, 23 nt, Human
gcugaaggcaggaacuuaacccu

SEQ ID NO: 1183419 - RNA, 21 nt, Human
gcuuaugguaugacuuugggu

SEQ ID NO: 1183420 - RNA, 23 nt, Human
gguaaaaugcaaggacuggcuug

SEQ ID NO: 1183421 - RNA, 23 nt, Human
gugaguuacagccaaaaauaaug

SEQ ID NO: 1183422 - RNA, 20 nt, Human
uaaaacaaauaaguuaggaa

SEQ ID NO: 1183423 - RNA, 18 nt, Human
uaacccuggagcuacaga

SEQ ID NO: 1183424 - RNA, 28 nt, Human
uaagucccaagcacaagucucccaagga

SEQ ID NO: 1183425 - RNA, 24 nt, Human
uaccaaaagcccagaauugugccu

SEQ ID NO: 1183426 - RNA, 22 nt, Human
uacugggagaaugcaaagggaa

SEQ ID NO: 1183427 - RNA, 18 nt, Human
uacugggagucacaggcu

SEQ ID NO: 1183428 - RNA, 18 nt, Human
ucaaaacuaagaaaaccc

SEQ ID NO: 1183429 - RNA, 21 nt, Human
ucacugagcuuggcuaaaucu

SEQ ID NO: 1183430 - RNA, 23 nt, Human
ucacugagcuuggcuaaaucuuu

SEQ ID NO: 1183431 - RNA, 25 nt, Human
ucauuagaagugcuuucuguguuuu

SEQ ID NO: 1183432 - RNA, 22 nt, Human
uccaaugucucccagaaaaauc

SEQ ID NO: 1183433 - RNA, 22 nt, Human
ucccaagcacaagucucccaag

SEQ ID NO: 1183434 - RNA, 21 nt, Human
ucccugucgcccaaaugaaua

SEQ ID NO: 1183435 - RNA, 20 nt, Human
ucccuuuaagagauaaaggu

SEQ ID NO: 1183436 - RNA, 24 nt, Human
ucuaucagccaaggugaggcuguu

SEQ ID NO: 1183437 - RNA, 23 nt, Human
ucucugguaauuaugucuccaag

SEQ ID NO: 1183438 - RNA, 19 nt, Human
ugacucauaacugcuaagg

SEQ ID NO: 1183439 - RNA, 19 nt, Human
ugcacacagaacaauaugu

SEQ ID NO: 1183440 - RNA, 18 nt, Human
ugcaccccuaaaacccag

SEQ ID NO: 1183441 - RNA, 19 nt, Human
uggaaacgggccaccaaug

SEQ ID NO: 1183442 - RNA, 25 nt, Human
uggaagacaacgguaaggaagaaaa

SEQ ID NO: 1183443 - RNA, 21 nt, Human
uggagcuacagagccugagag

SEQ ID NO: 1183444 - RNA, 23 nt, Human
uggaguggcaggcaugaacucca

SEQ ID NO: 1183445 - RNA, 21 nt, Human
uggguggcccugcugaaggca

SEQ ID NO: 1183446 - RNA, 20 nt, Human
ugugccugcuuuggggcugg

SEQ ID NO: 1183447 - RNA, 24 nt, Human
uguuguguuguguuuuugggagac

SEQ ID NO: 1183448 - RNA, 20 nt, Human
uguuguguuuuugggagacc

SEQ ID NO: 1183449 - RNA, 21 nt, Human
uguuucaguggguggcccugc

SEQ ID NO: 1183450 - RNA, 23 nt, Human
uuaaaggaugacaguacgauguc

SEQ ID NO: 1183451 - RNA, 18 nt, Human
uucaaaacuaagaaaacc

SEQ ID NO: 1183452 - RNA, 19 nt, Human
uugcuggggggcucuggga

SEQ ID NO: 1183453 - RNA, 21 nt, Human
uugugccugcuuuggggcugg

SEQ ID NO: 1183454 - RNA, 19 nt, Human
uuucugauuuaguggcugu

SEQ ID NO: 1183455 - RNA, 19 nt, Human
uuuugggagacaggagcuc

SEQ ID NO: 1183456 - RNA, 18 nt, Human
uuuuuacauuacaaaagu

SEQ ID NO: 1183457 - RNA, 23 nt, Human
uuuuugggagacaggagcuccug

SEQ ID NO: 1183458 - RNA, 19 nt, Human
aaaccacccacagaguaga

SEQ ID NO: 1183459 - RNA, 22 nt, Human
aacacacauaccaccagcacaa

SEQ ID NO: 1183460 - RNA, 23 nt, Human
aaccguguccuacuuuuucuuaa

SEQ ID NO: 1183461 - RNA, 19 nt, Human
aagagaaaauguuuucucu

SEQ ID NO: 1183462 - RNA, 21 nt, Human
aagcagcauagauggauggac

SEQ ID NO: 1183463 - RNA, 23 nt, Human
aagcagcauagauggauggacuu

SEQ ID NO: 1183464 - RNA, 22 nt, Human
accuggcaggcgucagccaugg

SEQ ID NO: 1183465 - RNA, 20 nt, Human
accuuugccucugcuagaag

SEQ ID NO: 1183466 - RNA, 21 nt, Human
agcacaacuccucauguugac

SEQ ID NO: 1183467 - RNA, 22 nt, Human
agccagcccagccuccaacaca

SEQ ID NO: 1183468 - RNA, 23 nt, Human
aggaauuacggggaagcaguuac

SEQ ID NO: 1183469 - RNA, 22 nt, Human
aggcaaaugcccacacccaugc

SEQ ID NO: 1183470 - RNA, 23 nt, Human
agggagaacgcuuugcagcugcc

SEQ ID NO: 1183471 - RNA, 20 nt, Human
auacauucacaaaagccgcc

SEQ ID NO: 1183472 - RNA, 25 nt, Human
aucugaaaggggcauuacgugggag

SEQ ID NO: 1183473 - RNA, 21 nt, Human
augaaguaaaaaauaugcccc

SEQ ID NO: 1183474 - RNA, 19 nt, Human
auggggacugugauggcag

SEQ ID NO: 1183475 - RNA, 22 nt, Human
auucacaaaagccgccccccuc

SEQ ID NO: 1183476 - RNA, 24 nt, Human
caaaugcccacacccaugcgcaca

SEQ ID NO: 1183477 - RNA, 24 nt, Human
caacacacauaccaccagcacaac

SEQ ID NO: 1183478 - RNA, 19 nt, Human
cacacauaccaccagcaca

SEQ ID NO: 1183479 - RNA, 22 nt, Human
cacagaccuaauagacccagaa

SEQ ID NO: 1183480 - RNA, 20 nt, Human
cacagaguagaugaggaaag

SEQ ID NO: 1183481 - RNA, 19 nt, Human
cacccaugcgcacagaccu

SEQ ID NO: 1183482 - RNA, 22 nt, Human
cagcacaucagcgaaggguaca

SEQ ID NO: 1183483 - RNA, 19 nt, Human
cagcagaaaccuggcaggc

SEQ ID NO: 1183484 - RNA, 18 nt, Human
cauaaauaggccccaaau

SEQ ID NO: 1183485 - RNA, 19 nt, Human
cauagauuaucugcagcag

SEQ ID NO: 1183486 - RNA, 24 nt, Human
ccaacacacauaccaccagcacaa

SEQ ID NO: 1183487 - RNA, 26 nt, Human
ccagaacacucccacacacauuaaag

SEQ ID NO: 1183488 - RNA, 24 nt, Human
ccaugcgcacagaccuaauagacc

SEQ ID NO: 1183489 - RNA, 22 nt, Human
cccaaauacagaagggaagggc

SEQ ID NO: 1183490 - RNA, 21 nt, Human
cccacagaguagaugaggaaa

SEQ ID NO: 1183491 - RNA, 26 nt, Human
ccgaauaucucucuggcaaaagcucc

SEQ ID NO: 1183492 - RNA, 18 nt, Human
ccgccccccucccuuugg

SEQ ID NO: 1183493 - RNA, 22 nt, Human
ccucauacauucacaaaagccg

SEQ ID NO: 1183494 - RNA, 20 nt, Human
cucgugggcccugaaaccac

SEQ ID NO: 1183495 - RNA, 23 nt, Human
cugcagcagaaaccuggcaggcg

SEQ ID NO: 1183496 - RNA, 19 nt, Human
cugcccccagaagacucca

SEQ ID NO: 1183497 - RNA, 19 nt, Human
gcccagccuccaacacaca

SEQ ID NO: 1183498 - RNA, 21 nt, Human
gcuagaggggcucaaauaggu

SEQ ID NO: 1183499 - RNA, 18 nt, Human
gggaaggcaucuggaggu

SEQ ID NO: 1183500 - RNA, 18 nt, Human
gggaggcuccaucugucc

SEQ ID NO: 1183501 - RNA, 24 nt, Human
gguaacagaaguaacuuacaggaa

SEQ ID NO: 1183502 - RNA, 24 nt, Human
uaaagcuuucuggaacaagaguuu

SEQ ID NO: 1183503 - RNA, 22 nt, Human
uaaaugccuuccucuaaaugcu

SEQ ID NO: 1183504 - RNA, 23 nt, Human
uaagcucucagcuuaaagcaucu

SEQ ID NO: 1183505 - RNA, 25 nt, Human
uaaguaaugaaguaaaaaauaugcc

SEQ ID NO: 1183506 - RNA, 24 nt, Human
uacuaaagaguuaaaugcacucaa

SEQ ID NO: 1183507 - RNA, 23 nt, Human
uaggccccaaauacagaagggaa

SEQ ID NO: 1183508 - RNA, 23 nt, Human
ucacucggacaccucauuugagc

SEQ ID NO: 1183509 - RNA, 20 nt, Human
ucccuuugguaacagaaguu

SEQ ID NO: 1183510 - RNA, 20 nt, Human
uccucuaaaugcuagcauug

SEQ ID NO: 1183511 - RNA, 23 nt, Human
ucugcagcagaaaccuggcaggc

SEQ ID NO: 1183512 - RNA, 23 nt, Human
ugaaguaaaaaauaugccccucc

SEQ ID NO: 1183513 - RNA, 24 nt, Human
ugaaguaaaaaauaugccccuccc

SEQ ID NO: 1183514 - RNA, 20 nt, Human
ugaccuucacucggacaccu

SEQ ID NO: 1183515 - RNA, 21 nt, Human
ugacucgugggcccugaaacc

SEQ ID NO: 1183516 - RNA, 26 nt, Human
ugacucgugggcccugaaaccacccu

SEQ ID NO: 1183517 - RNA, 20 nt, Human
ugcccacacccaugcgcaca

SEQ ID NO: 1183518 - RNA, 22 nt, Human
ugccucaaccguguccuacuuu

SEQ ID NO: 1183519 - RNA, 18 nt, Human
ugcuagaaggucaaucuc

SEQ ID NO: 1183520 - RNA, 18 nt, Human
uggaacaagaguuuacau

SEQ ID NO: 1183521 - RNA, 18 nt, Human
uggcaggcgucagccaug

SEQ ID NO: 1183522 - RNA, 25 nt, Human
uggcaggcgucagccaugguaccug

SEQ ID NO: 1183523 - RNA, 22 nt, Human
uggcauaaauaggccccaaaua

SEQ ID NO: 1183524 - RNA, 23 nt, Human
uggcauaaauaggccccaaauac

SEQ ID NO: 1183525 - RNA, 21 nt, Human
ugggcacaccccuccuccgaa

SEQ ID NO: 1183526 - RNA, 19 nt, Human
ugugugcauaugggcacac

SEQ ID NO: 1183527 - RNA, 18 nt, Human
uuugccauuuucagccau

SEQ ID NO: 1183528 - RNA, 18 nt, Human
aaagggagcagcggcugc

SEQ ID NO: 1183529 - RNA, 23 nt, Human
aagcccaggauaggaagcaacgg

SEQ ID NO: 1183530 - RNA, 19 nt, Human
aagggcccaggaaucccag

SEQ ID NO: 1183531 - RNA, 22 nt, Human
acgcugcggacacacguucacc

SEQ ID NO: 1183532 - RNA, 23 nt, Human
acuccgaacuuucccccaacccc

SEQ ID NO: 1183533 - RNA, 22 nt, Human
agacgccccccacccccaacua

SEQ ID NO: 1183534 - RNA, 22 nt, Human
agaggaagacagacagggggcc

SEQ ID NO: 1183535 - RNA, 19 nt, Human
agcaacaagcaccggagcu

SEQ ID NO: 1183536 - RNA, 20 nt, Human
agcaccggagcuggagggac

SEQ ID NO: 1183537 - RNA, 23 nt, Human
aggaagacagacagggggccaga

SEQ ID NO: 1183538 - RNA, 23 nt, Human
aggaagagagggagaaagggagc

SEQ ID NO: 1183539 - RNA, 22 nt, Human
aggauucuuccaagcccaggau

SEQ ID NO: 1183540 - RNA, 20 nt, Human
agggagaaagggagcagcgg

SEQ ID NO: 1183541 - RNA, 21 nt, Human
agggggccagagggagacgcc

SEQ ID NO: 1183542 - RNA, 18 nt, Human
caacucuuuuccaaaggg

SEQ ID NO: 1183543 - RNA, 18 nt, Human
cagacaguggcaaaagag

SEQ ID NO: 1183544 - RNA, 18 nt, Human
cagccucgcagccuggcg

SEQ ID NO: 1183545 - RNA, 18 nt, Human
cagcgaggcugggcagag

SEQ ID NO: 1183546 - RNA, 21 nt, Human
cagcuggggcugcugccccuc

SEQ ID NO: 1183547 - RNA, 20 nt, Human
cauuucaccaacucuuuucc

SEQ ID NO: 1183548 - RNA, 22 nt, Human
cccccgcggcugcguagcgccc

SEQ ID NO: 1183549 - RNA, 18 nt, Human
cccucuguccccuuccuc

SEQ ID NO: 1183550 - RNA, 19 nt, Human
cccucuguccccuuccucc

SEQ ID NO: 1183551 - RNA, 22 nt, Human
ccgccagcuggggcugcugccc

SEQ ID NO: 1183552 - RNA, 22 nt, Human
ccgcgcuuccucccgccagcug

SEQ ID NO: 1183553 - RNA, 26 nt, Human
ccucagccagcucucgggggaggugg

SEQ ID NO: 1183554 - RNA, 21 nt, Human
ccuccucccccguccacagcc

SEQ ID NO: 1183555 - RNA, 22 nt, Human
ccucuguccccuuccuccuccc

SEQ ID NO: 1183556 - RNA, 20 nt, Human
ccuggcggcaacagcucccg

SEQ ID NO: 1183557 - RNA, 19 nt, Human
cgaacuuucccccaacccc

SEQ ID NO: 1183558 - RNA, 22 nt, Human
cgccccgagacuucuagggcga

SEQ ID NO: 1183559 - RNA, 22 nt, Human
cgccccgauacuugaaggcggg

SEQ ID NO: 1183560 - RNA, 21 nt, Human
cgcuugggccgggcgagcaac

SEQ ID NO: 1183561 - RNA, 18 nt, Human
cuaaaguguuuccuaccu

SEQ ID NO: 1183562 - RNA, 18 nt, Human
cucccgcuugggccgggc

SEQ ID NO: 1183563 - RNA, 19 nt, Human
cucugcgcucagcucgccc

SEQ ID NO: 1183564 - RNA, 21 nt, Human
cugcucccucuguccccuucc

SEQ ID NO: 1183565 - RNA, 18 nt, Human
cugcugccccuccucagc

SEQ ID NO: 1183566 - RNA, 20 nt, Human
gagacgccccccacccccaa

SEQ ID NO: 1183567 - RNA, 22 nt, Human
gagcaacaagcaccggagcugg

SEQ ID NO: 1183568 - RNA, 21 nt, Human
gaggaagagagggagaaaggg

SEQ ID NO: 1183569 - RNA, 18 nt, Human
gaggaggagaggacggca

SEQ ID NO: 1183570 - RNA, 21 nt, Human
gaggaggagaggacggcagcc

SEQ ID NO: 1183571 - RNA, 18 nt, Human
gagggcagcgcagcgggc

SEQ ID NO: 1183572 - RNA, 19 nt, Human
gagggcagcgcagcgggca

SEQ ID NO: 1183573 - RNA, 20 nt, Human
gcaacggcaggaauggguac

SEQ ID NO: 1183574 - RNA, 23 nt, Human
gccaggcaaguccacaguuugcu

SEQ ID NO: 1183575 - RNA, 19 nt, Human
gccccgagacuucuagggc

SEQ ID NO: 1183576 - RNA, 19 nt, Human
gcgagcaacaagcaccgga

SEQ ID NO: 1183577 - RNA, 23 nt, Human
gcucggcagucccuccucucccg

SEQ ID NO: 1183578 - RNA, 19 nt, Human
ggagaggugaaggccgugg

SEQ ID NO: 1183579 - RNA, 20 nt, Human
ggagcagcggcugcuacugc

SEQ ID NO: 1183580 - RNA, 22 nt, Human
ggagggacgggauuguagaucc

SEQ ID NO: 1183581 - RNA, 21 nt, Human
ggcaaaagagggaggaagaga

SEQ ID NO: 1183582 - RNA, 19 nt, Human
ggcagccucgcagccuggc

SEQ ID NO: 1183583 - RNA, 23 nt, Human
ggcggcagcgaggcugggcagag

SEQ ID NO: 1183584 - RNA, 20 nt, Human
gggagacgccccccaccccc

SEQ ID NO: 1183585 - RNA, 22 nt, Human
gggcagagggcagcgcagcggg

SEQ ID NO: 1183586 - RNA, 22 nt, Human
gggcccagacaguggcaaaaga

SEQ ID NO: 1183587 - RNA, 26 nt, Human
gggcugaggcuacccgcggagaggug

SEQ ID NO: 1183588 - RNA, 18 nt, Human
ggugaaggccguggggcc

SEQ ID NO: 1183589 - RNA, 22 nt, Human
ggugaaggccguggggccuggg

SEQ ID NO: 1183590 - RNA, 25 nt, Human
uacuugaaggcggggggcaaucccu

SEQ ID NO: 1183591 - RNA, 26 nt, Human
uacuugaaggcggggggcaaucccug

SEQ ID NO: 1183592 - RNA, 20 nt, Human
uccacaguuugcuccaccgc

SEQ ID NO: 1183593 - RNA, 20 nt, Human
ucccccaaccccacgugcuu

SEQ ID NO: 1183594 - RNA, 18 nt, Human
ucccucuguccccuuccu

SEQ ID NO: 1183595 - RNA, 21 nt, Human
ucccucuguccccuuccuccu

SEQ ID NO: 1183596 - RNA, 19 nt, Human
uccgggcucccgggcggga

SEQ ID NO: 1183597 - RNA, 21 nt, Human
ucgcagccuggcggcaacagc

SEQ ID NO: 1183598 - RNA, 18 nt, Human
ugaaggccguggggccug

SEQ ID NO: 1183599 - RNA, 22 nt, Human
ugaggcuacccgcggagaggug

SEQ ID NO: 1183600 - RNA, 20 nt, Human
ugggcagagggcagcgcagc

SEQ ID NO: 1183601 - RNA, 21 nt, Human
uggggccuggggaagggcucc

SEQ ID NO: 1183602 - RNA, 22 nt, Human
uggggcugcugccccuccucag

SEQ ID NO: 1183603 - RNA, 22 nt, Human
uguaggcucggcagucccuccu

SEQ ID NO: 1183604 - RNA, 18 nt, Human
uguuuccuaccugcuccc

SEQ ID NO: 1183605 - RNA, 21 nt, Human
uucccccaaccccacgugcuu

SEQ ID NO: 1183606 - RNA, 21 nt, Human
uugaagguguaggcucggcag

SEQ ID NO: 1183607 - RNA, 20 nt, Human
uugggccgggcgagcaacaa

SEQ ID NO: 1183608 - RNA, 18 nt, Human
aagaaggcaaaccaugaa

SEQ ID NO: 1183609 - RNA, 23 nt, Human
aagaaggcaaaccaugaaaagaa

SEQ ID NO: 1183610 - RNA, 25 nt, Human
aauaagaaggcaaaccaugaaaaga

SEQ ID NO: 1183611 - RNA, 20 nt, Human
accaugaaaagaaaagagga

SEQ ID NO: 1183612 - RNA, 21 nt, Human
accaugaaaagaaaagaggag

SEQ ID NO: 1183613 - RNA, 22 nt, Human
agaaaagaucacacacaaggcu

SEQ ID NO: 1183614 - RNA, 20 nt, Human
aggugcuccucacuucccag

SEQ ID NO: 1183615 - RNA, 18 nt, Human
aucccaaccugcaccugu

SEQ ID NO: 1183616 - RNA, 21 nt, Human
cacacacaaggcugucacuuc

SEQ ID NO: 1183617 - RNA, 25 nt, Human
caccuguggcgacuuugagacuuuc

SEQ ID NO: 1183618 - RNA, 23 nt, Human
cacugaaucaggggcauguuucc

SEQ ID NO: 1183619 - RNA, 25 nt, Human
cagaaaagaucacacacaaggcugg

SEQ ID NO: 1183620 - RNA, 21 nt, Human
cagaggcgcuccucacuuccc

SEQ ID NO: 1183621 - RNA, 21 nt, Human
cagaggcgcuccucacuuccc

SEQ ID NO: 1183622 - RNA, 21 nt, Human
cagaggugcuccucacuuccc

SEQ ID NO: 1183623 - RNA, 20 nt, Human
caucccaaccugcaccugug

SEQ ID NO: 1183624 - RNA, 27 nt, Human
ccucccaucccaaccugcaccuguggc

SEQ ID NO: 1183625 - RNA, 18 nt, Human
ggcggccgggcagaggcg

SEQ ID NO: 1183626 - RNA, 18 nt, Human
ggcggccgggcagaggcg

SEQ ID NO: 1183627 - RNA, 19 nt, Human
gggaagacagaaaagauca

SEQ ID NO: 1183628 - RNA, 20 nt, Human
guggggcggccgggcagagg

SEQ ID NO: 1183629 - RNA, 21 nt, Human
uaaaagguaaacuuuaauguu

SEQ ID NO: 1183630 - RNA, 27 nt, Human
uaagaaggcaaaccaugaaaagaaaaa

SEQ ID NO: 1183631 - RNA, 21 nt, Human
ucagggcuuuaaaccaguugg

SEQ ID NO: 1183632 - RNA, 19 nt, Human
uggggcggccgggcagagg

SEQ ID NO: 1183633 - RNA, 22 nt, Human
uguccuuuuucuggaaaacugu

SEQ ID NO: 1183634 - RNA, 18 nt, Human
ugugguaagagaaaaagu

SEQ ID NO: 1183635 - RNA, 21 nt, Human
aaaaaaaccuccccaagaacc

SEQ ID NO: 1183636 - RNA, 21 nt, Human
aaaaaucaauacaaagcugac

SEQ ID NO: 1183637 - RNA, 25 nt, Human
aaacacacacacgcacacacaaaca

SEQ ID NO: 1183638 - RNA, 21 nt, Human
aaaccuccccaagaaccccaa

SEQ ID NO: 1183639 - RNA, 19 nt, Human
aaaggguguggcaggcucc

SEQ ID NO: 1183640 - RNA, 24 nt, Human
aaccuccccaagaaccccaauucu

SEQ ID NO: 1183641 - RNA, 24 nt, Human
aacuccuuccuaaauccuuuucug

SEQ ID NO: 1183642 - RNA, 23 nt, Human
aagccaccugaacccaagucacc

SEQ ID NO: 1183643 - RNA, 23 nt, Human
aaggaaaagcauuggaugcagug

SEQ ID NO: 1183644 - RNA, 24 nt, Human
aaguagcccucagucccuagccca

SEQ ID NO: 1183645 - RNA, 23 nt, Human
aaugaggaagaagucagaaggaa

SEQ ID NO: 1183646 - RNA, 23 nt, Human
aauggaguccugcagagccgccu

SEQ ID NO: 1183647 - RNA, 21 nt, Human
acaaaaagaaaugcagaaucc

SEQ ID NO: 1183648 - RNA, 22 nt, Human
acacacaaacauacacacagga

SEQ ID NO: 1183649 - RNA, 25 nt, Human
acacacacacacacacacacagaga

SEQ ID NO: 1183650 - RNA, 29 nt, Human
acacacacacacacacacacagagacuca

SEQ ID NO: 1183651 - RNA, 27 nt, Human
acacacacacacacacacagagacuca

SEQ ID NO: 1183652 - RNA, 22 nt, Human
acacacacacauaugcaucucu

SEQ ID NO: 1183653 - RNA, 21 nt, Human
acacacacauagauacacaca

SEQ ID NO: 1183654 - RNA, 27 nt, Human
acacacaugcacaccggcacacacaca

SEQ ID NO: 1183655 - RNA, 30 nt, Human
accucaccauccuccuucugagccuccaag

SEQ ID NO: 1183656 - RNA, 20 nt, Human
accucaguucuuuucauagu

SEQ ID NO: 1183657 - RNA, 18 nt, Human
accugcacugccccuccc

SEQ ID NO: 1183658 - RNA, 21 nt, Human
acugggcccgugcagauuuuc

SEQ ID NO: 1183659 - RNA, 20 nt, Human
agaaaucuacauugugaaga

SEQ ID NO: 1183660 - RNA, 22 nt, Human
agaaccccaauucuguuccugc

SEQ ID NO: 1183661 - RNA, 22 nt, Human
agagccgccuccccguccaccu

SEQ ID NO: 1183662 - RNA, 20 nt, Human
agagcugugggagaaaugga

SEQ ID NO: 1183663 - RNA, 20 nt, Human
agccaccugaacccaaguca

SEQ ID NO: 1183664 - RNA, 20 nt, Human
agccuccaaucgcuggcucc

SEQ ID NO: 1183665 - RNA, 18 nt, Human
agcuaagaaggaaaagca

SEQ ID NO: 1183666 - RNA, 23 nt, Human
aggaagagcaaguuuggagugaa

SEQ ID NO: 1183667 - RNA, 26 nt, Human
aggagcaccaacgguggccaagaagu

SEQ ID NO: 1183668 - RNA, 21 nt, Human
agggacacccuugguuuugug

SEQ ID NO: 1183669 - RNA, 21 nt, Human
agggguugcagaaaaggaugg

SEQ ID NO: 1183670 - RNA, 22 nt, Human
aguguagaggaaaggacagggu

SEQ ID NO: 1183671 - RNA, 24 nt, Human
auggacacacacacacacacacac

SEQ ID NO: 1183672 - RNA, 19 nt, Human
auggacuggcugcuguggg

SEQ ID NO: 1183673 - RNA, 22 nt, Human
caaagcugacagaucaaaagug

SEQ ID NO: 1183674 - RNA, 27 nt, Human
caaagcugacagaucaaaagugaguca

SEQ ID NO: 1183675 - RNA, 20 nt, Human
caaauuacaauaacagcuaa

SEQ ID NO: 1183676 - RNA, 22 nt, Human
caaccugaagggccaagaacac

SEQ ID NO: 1183677 - RNA, 20 nt, Human
caagaacacugugguuccau

SEQ ID NO: 1183678 - RNA, 21 nt, Human
caagauaccgaggaaagugug

SEQ ID NO: 1183679 - RNA, 18 nt, Human
cacacaaacauacacaca

SEQ ID NO: 1183680 - RNA, 20 nt, Human
cacacacacacacacacaca

SEQ ID NO: 1183681 - RNA, 20 nt, Human
cacacacacacacacacaca

SEQ ID NO: 1183682 - RNA, 22 nt, Human
cacacacacacacacacacaca

SEQ ID NO: 1183683 - RNA, 28 nt, Human
cacacacacacacacagagacucacaca

SEQ ID NO: 1183684 - RNA, 22 nt, Human
cacacacacacauaugcaucuc

SEQ ID NO: 1183685 - RNA, 18 nt, Human
cacacacacgcacacaca

SEQ ID NO: 1183686 - RNA, 20 nt, Human
cacaggaaaguugaggggag

SEQ ID NO: 1183687 - RNA, 22 nt, Human
caccaacgguggccaagaaguc

SEQ ID NO: 1183688 - RNA, 26 nt, Human
caccugaacccaagucaccugggagc

SEQ ID NO: 1183689 - RNA, 22 nt, Human
cagaaaaaucaauacaaagcug

SEQ ID NO: 1183690 - RNA, 22 nt, Human
cagagacucacacagagaccca

SEQ ID NO: 1183691 - RNA, 19 nt, Human
cagcacagggccuggcaaa

SEQ ID NO: 1183692 - RNA, 20 nt, Human
cagucccucuuuccaaaagu

SEQ ID NO: 1183693 - RNA, 18 nt, Human
ccaaaaguagcccucagu

SEQ ID NO: 1183694 - RNA, 25 nt, Human
ccaauucuguuccugccacacauac

SEQ ID NO: 1183695 - RNA, 18 nt, Human
ccaggcccuuugugcugc

SEQ ID NO: 1183696 - RNA, 24 nt, Human
cccaagaaccccaauucuguuccu

SEQ ID NO: 1183697 - RNA, 27 nt, Human
cccacauacacacacauagauacacac

SEQ ID NO: 1183698 - RNA, 21 nt, Human
ccccaagaaccccaauucugg

SEQ ID NO: 1183699 - RNA, 22 nt, Human
ccccagccugcccgcucaugcc

SEQ ID NO: 1183700 - RNA, 25 nt, Human
cccccagccugcccgcucaugccgu

SEQ ID NO: 1183701 - RNA, 18 nt, Human
ccccuccuccccacccca

SEQ ID NO: 1183702 - RNA, 22 nt, Human
cccucagucccuagcccaggac

SEQ ID NO: 1183703 - RNA, 19 nt, Human
ccggcacacacacacauau

SEQ ID NO: 1183704 - RNA, 21 nt, Human
ccuccccaagaaccccaauuc

SEQ ID NO: 1183705 - RNA, 19 nt, Human
ccugaggggcugucugagg

SEQ ID NO: 1183706 - RNA, 24 nt, Human
ccugcacugccccuccuccccacc

SEQ ID NO: 1183707 - RNA, 24 nt, Human
ccugugugugaggggaguggaggg

SEQ ID NO: 1183708 - RNA, 22 nt, Human
cgcaguggguuacaacguagcc

SEQ ID NO: 1183709 - RNA, 25 nt, Human
cggcacacacacacauaugcaucuc

SEQ ID NO: 1183710 - RNA, 20 nt, Human
cuccuccccaccccacuccc

SEQ ID NO: 1183711 - RNA, 21 nt, Human
cuccugaggggcugucugagg

SEQ ID NO: 1183712 - RNA, 18 nt, Human
cugcacugccccuccucc

SEQ ID NO: 1183713 - RNA, 21 nt, Human
cugcacugccccuccucccca

SEQ ID NO: 1183714 - RNA, 18 nt, Human
cugccaacucuguguguc

SEQ ID NO: 1183715 - RNA, 24 nt, Human
cugguggagucaacccugggcaga

SEQ ID NO: 1183716 - RNA, 19 nt, Human
cugugugucccuuguuaca

SEQ ID NO: 1183717 - RNA, 21 nt, Human
cuuugugcugccaacucugug

SEQ ID NO: 1183718 - RNA, 22 nt, Human
gaaaaaaaccuccccaagaacc

SEQ ID NO: 1183719 - RNA, 18 nt, Human
gaaaggacaggguggaaa

SEQ ID NO: 1183720 - RNA, 22 nt, Human
gagcugccuggcuucccuucag

SEQ ID NO: 1183721 - RNA, 20 nt, Human
gaggggaguggagggguugc

SEQ ID NO: 1183722 - RNA, 21 nt, Human
gauguggguguggggcucggg

SEQ ID NO: 1183723 - RNA, 22 nt, Human
gauuuauuucccuugcaucuaa

SEQ ID NO: 1183724 - RNA, 21 nt, Human
gccacacauacccccagccug

SEQ ID NO: 1183725 - RNA, 24 nt, Human
gccucugggccucugucagcuccc

SEQ ID NO: 1183726 - RNA, 25 nt, Human
gcgucgggcaggagacacagggguc

SEQ ID NO: 1183727 - RNA, 26 nt, Human
gcuuuaaacacacacacgcacacaca

SEQ ID NO: 1183728 - RNA, 19 nt, Human
ggacacccuugguuuugug

SEQ ID NO: 1183729 - RNA, 19 nt, Human
ggacagaagcggggugaga

SEQ ID NO: 1183730 - RNA, 18 nt, Human
ggagcuuccagacuagcg

SEQ ID NO: 1183731 - RNA, 18 nt, Human
ggaggauucaaagaugac

SEQ ID NO: 1183732 - RNA, 23 nt, Human
gggcacuggagauaaaauauccc

SEQ ID NO: 1183733 - RNA, 25 nt, Human
gggcacuggagauaaaauaucccug

SEQ ID NO: 1183734 - RNA, 22 nt, Human
gggcgucgggcaggagacacag

SEQ ID NO: 1183735 - RNA, 21 nt, Human
gggugcaggugaggagacaga

SEQ ID NO: 1183736 - RNA, 22 nt, Human
gucuaagacacuggaaagagaa

SEQ ID NO: 1183737 - RNA, 18 nt, Human
gucucuucugccugugcc

SEQ ID NO: 1183738 - RNA, 21 nt, Human
gugacaccugguccggugggu

SEQ ID NO: 1183739 - RNA, 18 nt, Human
gugagacaacacgaggga

SEQ ID NO: 1183740 - RNA, 18 nt, Human
guggaaaaaaaccucccc

SEQ ID NO: 1183741 - RNA, 21 nt, Human
guggaaaugguuugccucugg

SEQ ID NO: 1183742 - RNA, 23 nt, Human
gugggagaaauggaguccugcag

SEQ ID NO: 1183743 - RNA, 19 nt, Human
gugugucccuuguuacaaa

SEQ ID NO: 1183744 - RNA, 24 nt, Human
guuucaccucaagagucugaauuu

SEQ ID NO: 1183745 - RNA, 23 nt, Human
uaaacacacacacgcacacacaa

SEQ ID NO: 1183746 - RNA, 26 nt, Human
uaaacacacacacgcacacacaaaca

SEQ ID NO: 1183747 - RNA, 21 nt, Human
uaaaggguguggcaggcuccu

SEQ ID NO: 1183748 - RNA, 25 nt, Human
uaacacggacagaagcggggugaga

SEQ ID NO: 1183749 - RNA, 33 nt, Human
uacacacaugcacaccggcacacacacacagug

SEQ ID NO: 1183750 - RNA, 21 nt, Human
uacuuggcaauuacucagcug

SEQ ID NO: 1183751 - RNA, 21 nt, Human
uagagccuuacugggcccgug

SEQ ID NO: 1183752 - RNA, 18 nt, Human
uagcccaggacaggcaug

SEQ ID NO: 1183753 - RNA, 19 nt, Human
uagcccaggacaggcaugg

SEQ ID NO: 1183754 - RNA, 21 nt, Human
uagcucagaaaucuuuaaaug

SEQ ID NO: 1183755 - RNA, 21 nt, Human
uaggauaucucaguuugacug

SEQ ID NO: 1183756 - RNA, 18 nt, Human
uagggcagccagcacagg

SEQ ID NO: 1183757 - RNA, 21 nt, Human
uagggcagccagcacagggcc

SEQ ID NO: 1183758 - RNA, 23 nt, Human
uauggacauuguggcuguggaca

SEQ ID NO: 1183759 - RNA, 24 nt, Human
ucaagagucugaauuuguagaugg

SEQ ID NO: 1183760 - RNA, 21 nt, Human
ucacacagagacccacauaca

SEQ ID NO: 1183761 - RNA, 24 nt, Human
ucacccaauaaauaaaaaugacaa

SEQ ID NO: 1183762 - RNA, 24 nt, Human
ucaccugggagccuuuaacugcag

SEQ ID NO: 1183763 - RNA, 22 nt, Human
ucaggaacaaugggaaggucgg

SEQ ID NO: 1183764 - RNA, 18 nt, Human
ucaguucuuuucauagua

SEQ ID NO: 1183765 - RNA, 19 nt, Human
ucaguucuuuucauaguaa

SEQ ID NO: 1183766 - RNA, 21 nt, Human
ucaguuugacugaaaaggcuu

SEQ ID NO: 1183767 - RNA, 26 nt, Human
uccauggagcuuccagacuagcgggg

SEQ ID NO: 1183768 - RNA, 23 nt, Human
uccccaugaguggucugaaagcc

SEQ ID NO: 1183769 - RNA, 23 nt, Human
ucccuguauccauggagcuucca

SEQ ID NO: 1183770 - RNA, 18 nt, Human
uccucagacucgggagcu

SEQ ID NO: 1183771 - RNA, 18 nt, Human
uccuccccaccccacucc

SEQ ID NO: 1183772 - RNA, 19 nt, Human
uccugggugcccagggacu

SEQ ID NO: 1183773 - RNA, 18 nt, Human
ucgcuggcuccccgguuc

SEQ ID NO: 1183774 - RNA, 20 nt, Human
ucuccucccacauucccaca

SEQ ID NO: 1183775 - RNA, 21 nt, Human
ucuccuggcauuguuugcuga

SEQ ID NO: 1183776 - RNA, 26 nt, Human
ucucucagugacaugucaaaccugcu

SEQ ID NO: 1183777 - RNA, 23 nt, Human
ucugggccucugucagcucccau

SEQ ID NO: 1183778 - RNA, 22 nt, Human
ucugucagcucccaucaguccc

SEQ ID NO: 1183779 - RNA, 23 nt, Human
ucugugccaggcauuguauuggg

SEQ ID NO: 1183780 - RNA, 18 nt, Human
ucuugguucuucuccugg

SEQ ID NO: 1183781 - RNA, 22 nt, Human
ugaagugggaaauuccauuuua

SEQ ID NO: 1183782 - RNA, 20 nt, Human
ugaauaaucagugaucucau

SEQ ID NO: 1183783 - RNA, 18 nt, Human
ugacgugguuccaccucu

SEQ ID NO: 1183784 - RNA, 21 nt, Human
ugagggcacccacaggaaagu

SEQ ID NO: 1183785 - RNA, 18 nt, Human
ugaggggaggcacugagg

SEQ ID NO: 1183786 - RNA, 21 nt, Human
ugagucaugccaguucuccuc

SEQ ID NO: 1183787 - RNA, 19 nt, Human
ugauagaaaugaggaagaa

SEQ ID NO: 1183788 - RNA, 19 nt, Human
ugauguggguguggggcuc

SEQ ID NO: 1183789 - RNA, 19 nt, Human
ugcacaccggcacacacac

SEQ ID NO: 1183790 - RNA, 19 nt, Human
ugccccuccuccccacccc

SEQ ID NO: 1183791 - RNA, 24 nt, Human
ugccguguaggcugcauuccuggg

SEQ ID NO: 1183792 - RNA, 23 nt, Human
uggaaaaaaaccuccccaagaac

SEQ ID NO: 1183793 - RNA, 27 nt, Human
uggaaaaaaaccuccccaagaacccca

SEQ ID NO: 1183794 - RNA, 22 nt, Human
uggaaagagaaagauuagccug

SEQ ID NO: 1183795 - RNA, 20 nt, Human
uggaaaugguuugccucugg

SEQ ID NO: 1183796 - RNA, 22 nt, Human
uggagauaaaauaucccuguau

SEQ ID NO: 1183797 - RNA, 23 nt, Human
uggaguccugcagagccgccucc

SEQ ID NO: 1183798 - RNA, 23 nt, Human
uggcauuguuugcugaggccagc

SEQ ID NO: 1183799 - RNA, 19 nt, Human
uggcuccccgguucccagu

SEQ ID NO: 1183800 - RNA, 23 nt, Human
ugggaaggucgguaggauaucuc

SEQ ID NO: 1183801 - RNA, 20 nt, Human
ugggagccuuuaacugcaga

SEQ ID NO: 1183802 - RNA, 21 nt, Human
ugggagccuuuaacugcagau

SEQ ID NO: 1183803 - RNA, 21 nt, Human
ugggcagauggacuggcugcu

SEQ ID NO: 1183804 - RNA, 23 nt, Human
ugggugcccagggacugcugggc

SEQ ID NO: 1183805 - RNA, 21 nt, Human
uggguguggggcucgggagug

SEQ ID NO: 1183806 - RNA, 22 nt, Human
ugguggccuuuguaaugacuga

SEQ ID NO: 1183807 - RNA, 26 nt, Human
ugugaagagcuccccagaggauucug

SEQ ID NO: 1183808 - RNA, 18 nt, Human
uguggggcucgggaguga

SEQ ID NO: 1183809 - RNA, 24 nt, Human
ugugggugacaccugguccggugg

SEQ ID NO: 1183810 - RNA, 25 nt, Human
ugugugucccuuguuacaaagcucu

SEQ ID NO: 1183811 - RNA, 24 nt, Human
uuacaauaacagcuaagaaggaaa

SEQ ID NO: 1183812 - RNA, 23 nt, Human
uugacugaaaaggcuuuaaacac

SEQ ID NO: 1183813 - RNA, 22 nt, Human
uugaggcugcaguuggauaaag

SEQ ID NO: 1183814 - RNA, 20 nt, Human
uuguugggggagagccuagg

SEQ ID NO: 1183815 - RNA, 19 nt, Human
aaaagugugaggauuggcc

SEQ ID NO: 1183816 - RNA, 21 nt, Human
aaaauaccuguaacuacuucu

SEQ ID NO: 1183817 - RNA, 24 nt, Human
aaagugcugggauuacaggcguga

SEQ ID NO: 1183818 - RNA, 22 nt, Human
aacuccauaaucaaaccucuau

SEQ ID NO: 1183819 - RNA, 19 nt, Human
aagugcugggauuacaggc

SEQ ID NO: 1183820 - RNA, 19 nt, Human
aagugcugggauuacaggc

SEQ ID NO: 1183821 - RNA, 26 nt, Human
aagugcugggauuacaggcgugagcu

SEQ ID NO: 1183822 - RNA, 22 nt, Human
acagggaaugguauugcuaggg

SEQ ID NO: 1183823 - RNA, 19 nt, Human
acuccauaaucaaaccucu

SEQ ID NO: 1183824 - RNA, 18 nt, Human
agacagagucucacugug

SEQ ID NO: 1183825 - RNA, 25 nt, Human
agcagggaguuuguggcagauugga

SEQ ID NO: 1183826 - RNA, 20 nt, Human
agcgcaguggcgcgaccuug

SEQ ID NO: 1183827 - RNA, 24 nt, Human
agcgcaguggcgcgaccuuggcuc

SEQ ID NO: 1183828 - RNA, 22 nt, Human
aggaaggagcccaacagguuac

SEQ ID NO: 1183829 - RNA, 20 nt, Human
aggcaugcaccaccgcgccc

SEQ ID NO: 1183830 - RNA, 19 nt, Human
agggaaugguauugcuagg

SEQ ID NO: 1183831 - RNA, 18 nt, Human
aguagagaugguguuuua

SEQ ID NO: 1183832 - RNA, 21 nt, Human
aguaguugggauuacaggcau

SEQ ID NO: 1183833 - RNA, 24 nt, Human
agucucacuguguuguccaggcug

SEQ ID NO: 1183834 - RNA, 18 nt, Human
agugcugggauuacaggc

SEQ ID NO: 1183835 - RNA, 18 nt, Human
aucaauaaaauucacugc

SEQ ID NO: 1183836 - RNA, 24 nt, Human
aucauguuggccaggcuggucuug

SEQ ID NO: 1183837 - RNA, 19 nt, Human
aucugacuggaagaagugu

SEQ ID NO: 1183838 - RNA, 23 nt, Human
aucuuuggcaacaaaagaucuga

SEQ ID NO: 1183839 - RNA, 19 nt, Human
augcaccaccgcgcccagc

SEQ ID NO: 1183840 - RNA, 19 nt, Human
augguguuuuaucauguug

SEQ ID NO: 1183841 - RNA, 24 nt, Human
augguguuuuaucauguuggccag

SEQ ID NO: 1183842 - RNA, 24 nt, Human
auuuuuguauuuuuaguagagaug

SEQ ID NO: 1183843 - RNA, 20 nt, Human
caaaagagggaaaaauaagc

SEQ ID NO: 1183844 - RNA, 24 nt, Human
caaaauagaaaauaacuuuugaua

SEQ ID NO: 1183845 - RNA, 24 nt, Human
caaagugcugggauuacaggcgug

SEQ ID NO: 1183846 - RNA, 19 nt, Human
caacaauaaccuguaugua

SEQ ID NO: 1183847 - RNA, 19 nt, Human
caaccugauccuaccagag

SEQ ID NO: 1183848 - RNA, 22 nt, Human
caauaaauuuuccugccucggc

SEQ ID NO: 1183849 - RNA, 22 nt, Human
caccaccgcgcccagcuaauuu

SEQ ID NO: 1183850 - RNA, 24 nt, Human
caccgcgcccagcuaauuuuugua

SEQ ID NO: 1183851 - RNA, 21 nt, Human
cacuacaaccucugccuccca

SEQ ID NO: 1183852 - RNA, 21 nt, Human
cacugccuuuucccacaggga

SEQ ID NO: 1183853 - RNA, 18 nt, Human
cacuguguuguccaggcu

SEQ ID NO: 1183854 - RNA, 25 nt, Human
cacuuuaacugcuacaaguugggga

SEQ ID NO: 1183855 - RNA, 28 nt, Human
caggaaggagcccaacagguuaccuguu

SEQ ID NO: 1183856 - RNA, 20 nt, Human
caugcaccaccgcgcccagc

SEQ ID NO: 1183857 - RNA, 23 nt, Human
caugcaccaccgcgcccagcuaa

SEQ ID NO: 1183858 - RNA, 18 nt, Human
cauguuggccaggcuggu

SEQ ID NO: 1183859 - RNA, 24 nt, Human
cauguuggccaggcuggucuugaa

SEQ ID NO: 1183860 - RNA, 22 nt, Human
ccaaagugcugggauuacaggc

SEQ ID NO: 1183861 - RNA, 22 nt, Human
ccaaagugcugggauuacaggc

SEQ ID NO: 1183862 - RNA, 24 nt, Human
ccaaagugcugggauuacaggcgu

SEQ ID NO: 1183863 - RNA, 23 nt, Human
ccacugaucaccugguuucugcc

SEQ ID NO: 1183864 - RNA, 23 nt, Human
cccagguucaauaaauuuuccug

SEQ ID NO: 1183865 - RNA, 23 nt, Human
cccgaguaguugggauuacaggc

SEQ ID NO: 1183866 - RNA, 24 nt, Human
cccgaguaguugggauuacaggca

SEQ ID NO: 1183867 - RNA, 24 nt, Human
ccgaguaguugggauuacaggcau

SEQ ID NO: 1183868 - RNA, 24 nt, Human
ccucccagguucaauaaauuuucc

SEQ ID NO: 1183869 - RNA, 23 nt, Human
ccugaccucagcugaucugccug

SEQ ID NO: 1183870 - RNA, 22 nt, Human
ccuucaguaggguggcuggaau

SEQ ID NO: 1183871 - RNA, 21 nt, Human
cuaaugaucagaucuuccucc

SEQ ID NO: 1183872 - RNA, 23 nt, Human
cuacaaccucugccucccagguu

SEQ ID NO: 1183873 - RNA, 24 nt, Human
cuacaaccucugccucccagguuc

SEQ ID NO: 1183874 - RNA, 24 nt, Human
cucacuacaaccucugccucccag

SEQ ID NO: 1183875 - RNA, 18 nt, Human
cucccagguucaauaaau

SEQ ID NO: 1183876 - RNA, 26 nt, Human
cuccugaccucagcugaucugccugc

SEQ ID NO: 1183877 - RNA, 23 nt, Human
cugaucugccugccucagccucc

SEQ ID NO: 1183878 - RNA, 23 nt, Human
cugccucagccucccaaagugcu

SEQ ID NO: 1183879 - RNA, 24 nt, Human
cugccucagccucccaaagugcug

SEQ ID NO: 1183880 - RNA, 21 nt, Human
cugccucggccucccgaguag

SEQ ID NO: 1183881 - RNA, 21 nt, Human
cuugaacuccugaccucagcc

SEQ ID NO: 1183882 - RNA, 20 nt, Human
cuugcuguuuacuucccuug

SEQ ID NO: 1183883 - RNA, 24 nt, Human
cuuuguuucaauuauucccuuuca

SEQ ID NO: 1183884 - RNA, 24 nt, Human
gaccucagcugaucugccugccuc

SEQ ID NO: 1183885 - RNA, 19 nt, Human
gaccuuggcucacuacaac

SEQ ID NO: 1183886 - RNA, 24 nt, Human
gaguaguugggauuacaggcaugc

SEQ ID NO: 1183887 - RNA, 18 nt, Human
gauuacaggcgugagcua

SEQ ID NO: 1183888 - RNA, 21 nt, Human
gauuacaggcgugagcuacca

SEQ ID NO: 1183889 - RNA, 24 nt, Human
gauuacaggcgugagcuaccaugc

SEQ ID NO: 1183890 - RNA, 19 nt, Human
gcaguggcgcgaccuuggc

SEQ ID NO: 1183891 - RNA, 22 nt, Human
gcccagcuaauuuuuguauuuu

SEQ ID NO: 1183892 - RNA, 21 nt, Human
gcucacuacaaccucugccuc

SEQ ID NO: 1183893 - RNA, 19 nt, Human
gcuggagcgcaguggcgcg

SEQ ID NO: 1183894 - RNA, 23 nt, Human
gcuggucuugaacuccugaccuc

SEQ ID NO: 1183895 - RNA, 23 nt, Human
ggaaagcucccaaaaucucucaa

SEQ ID NO: 1183896 - RNA, 24 nt, Human
ggcuggucuugaacuccugaccuc

SEQ ID NO: 1183897 - RNA, 19 nt, Human
ggucuugaacuccugaccu

SEQ ID NO: 1183898 - RNA, 22 nt, Human
gguguuuuaucauguuggccag

SEQ ID NO: 1183899 - RNA, 18 nt, Human
guaguugggauuacaggc

SEQ ID NO: 1183900 - RNA, 20 nt, Human
guaguugggauuacaggcau

SEQ ID NO: 1183901 - RNA, 19 nt, Human
uaagugaaacauccaugua

SEQ ID NO: 1183902 - RNA, 25 nt, Human
uaagugaaacauccauguaucagga

SEQ ID NO: 1183903 - RNA, 24 nt, Human
uaaugaucagaucuuccucccuuc

SEQ ID NO: 1183904 - RNA, 24 nt, Human
uaauuuuuguauuuuuaguagaga

SEQ ID NO: 1183905 - RNA, 24 nt, Human
uacaggcaugcaccaccgcgccca

SEQ ID NO: 1183906 - RNA, 21 nt, Human
uaccuguaacuacuucugaac

SEQ ID NO: 1183907 - RNA, 19 nt, Human
uagcagggaguuuguggca

SEQ ID NO: 1183908 - RNA, 22 nt, Human
uaggauuuuugugauuuuggag

SEQ ID NO: 1183909 - RNA, 24 nt, Human
uaguagagaugguguuuuaucaug

SEQ ID NO: 1183910 - RNA, 18 nt, Human
uaguugggauuacaggca

SEQ ID NO: 1183911 - RNA, 18 nt, Human
uaucaggaauaauuccaa

SEQ ID NO: 1183912 - RNA, 24 nt, Human
uaucauguuggccaggcuggucuu

SEQ ID NO: 1183913 - RNA, 27 nt, Human
uaucauguuggccaggcuggucuugaa

SEQ ID NO: 1183914 - RNA, 23 nt, Human
ucaaaauagaaaauaacuuuuga

SEQ ID NO: 1183915 - RNA, 24 nt, Human
ucaaaccucuauuaaacagaagac

SEQ ID NO: 1183916 - RNA, 19 nt, Human
ucacuacaaccucugccuc

SEQ ID NO: 1183917 - RNA, 24 nt, Human
ucacuacaaccucugccucccagg

SEQ ID NO: 1183918 - RNA, 25 nt, Human
ucacuacaaccucugccucccaggu

SEQ ID NO: 1183919 - RNA, 24 nt, Human
uccaaauuaugaucuuuggcaaca

SEQ ID NO: 1183920 - RNA, 23 nt, Human
uccauguaucaggaauaauucca

SEQ ID NO: 1183921 - RNA, 24 nt, Human
ucccaaagugcugggauuacaggc

SEQ ID NO: 1183922 - RNA, 18 nt, Human
ucccagguucaauaaauu

SEQ ID NO: 1183923 - RNA, 24 nt, Human
ucccagguucaauaaauuuuccug

SEQ ID NO: 1183924 - RNA, 24 nt, Human
ucccgaguaguugggauuacaggc

SEQ ID NO: 1183925 - RNA, 19 nt, Human
ucccuugauggaguuuuag

SEQ ID NO: 1183926 - RNA, 23 nt, Human
ucggccucccgaguaguugggau

SEQ ID NO: 1183927 - RNA, 22 nt, Human
ucuaaugaucagaucuuccucc

SEQ ID NO: 1183928 - RNA, 23 nt, Human
ucucacuguguuguccaggcugg

SEQ ID NO: 1183929 - RNA, 24 nt, Human
ucucacuguguuguccaggcugga

SEQ ID NO: 1183930 - RNA, 18 nt, Human
ucugacuggaagaagugu

SEQ ID NO: 1183931 - RNA, 24 nt, Human
ugaaaaacuagauauuuguaugga

SEQ ID NO: 1183932 - RNA, 18 nt, Human
ugaccucagcugaucugc

SEQ ID NO: 1183933 - RNA, 19 nt, Human
ugaccucagcugaucugcc

SEQ ID NO: 1183934 - RNA, 20 nt, Human
ugagguaagaucagcuauga

SEQ ID NO: 1183935 - RNA, 21 nt, Human
ugaucugccugccucagccuc

SEQ ID NO: 1183936 - RNA, 23 nt, Human
ugaucugccugccucagccuccc

SEQ ID NO: 1183937 - RNA, 24 nt, Human
ugccucagccucccaaagugcugg

SEQ ID NO: 1183938 - RNA, 20 nt, Human
ugccucggccucccgaguag

SEQ ID NO: 1183939 - RNA, 20 nt, Human
ugcugggauuacaggcguga

SEQ ID NO: 1183940 - RNA, 18 nt, Human
uggaaagcucccaaaauc

SEQ ID NO: 1183941 - RNA, 22 nt, Human
uggaacuccauaaucaaaccuc

SEQ ID NO: 1183942 - RNA, 19 nt, Human
uggaagaaguguuguagac

SEQ ID NO: 1183943 - RNA, 24 nt, Human
uggagcgcaguggcgcgaccuugg

SEQ ID NO: 1183944 - RNA, 24 nt, Human
uggccaggcuggucuugaacuccu

SEQ ID NO: 1183945 - RNA, 24 nt, Human
uggcgcgaccuuggcucacuacaa

SEQ ID NO: 1183946 - RNA, 22 nt, Human
ugggagcuagaaauuuugaggg

SEQ ID NO: 1183947 - RNA, 23 nt, Human
ugggagcuagaaauuuugaggga

SEQ ID NO: 1183948 - RNA, 21 nt, Human
ugggauuacaggcaugcacca

SEQ ID NO: 1183949 - RNA, 24 nt, Human
ugggauuacaggcaugcaccaccg

SEQ ID NO: 1183950 - RNA, 18 nt, Human
ugggauuacaggcgugag

SEQ ID NO: 1183951 - RNA, 22 nt, Human
ugggauuacaggcgugagcuac

SEQ ID NO: 1183952 - RNA, 23 nt, Human
ugggauuacaggcgugagcuacc

SEQ ID NO: 1183953 - RNA, 24 nt, Human
ugggauuacaggcgugagcuacca

SEQ ID NO: 1183954 - RNA, 25 nt, Human
ugggauuacaggcgugagcuaccau

SEQ ID NO: 1183955 - RNA, 24 nt, Human
ugguguuuuaucauguuggccagg

SEQ ID NO: 1183956 - RNA, 21 nt, Human
uguaacuacuucugaacaccc

SEQ ID NO: 1183957 - RNA, 21 nt, Human
ugucauggcuaggaaaaggag

SEQ ID NO: 1183958 - RNA, 24 nt, Human
uguccaggcuggagcgcaguggcg

SEQ ID NO: 1183959 - RNA, 22 nt, Human
uguccgaaugugcagucugcau

SEQ ID NO: 1183960 - RNA, 24 nt, Human
uguguuguccaggcuggagcgcag

SEQ ID NO: 1183961 - RNA, 19 nt, Human
uuaaaugaacaaaagaggg

SEQ ID NO: 1183962 - RNA, 22 nt, Human
uuacuacaauaaauuuuacaag

SEQ ID NO: 1183963 - RNA, 18 nt, Human
uuaguagagaugguguuu

SEQ ID NO: 1183964 - RNA, 18 nt, Human
uuaguagagaugguguuu

SEQ ID NO: 1183965 - RNA, 18 nt, Human
uuaguagagaugguguuu

SEQ ID NO: 1183966 - RNA, 24 nt, Human
uuaguagagaugguguuuuaucau

SEQ ID NO: 1183967 - RNA, 23 nt, Human
uuccucccuucaguaggguggcu

SEQ ID NO: 1183968 - RNA, 25 nt, Human
uuccugaaugugcugcuauuguagg

SEQ ID NO: 1183969 - RNA, 24 nt, Human
uuuuuaguagagaugguguuuuau

SEQ ID NO: 1183970 - RNA, 20 nt, Human
uuuuuguauuuuuaguagag

SEQ ID NO: 1183971 - RNA, 29 nt, Human
aaaacaacagaaucucaacguuuugagaa

SEQ ID NO: 1183972 - RNA, 19 nt, Human
aaacaacagaaucucaacg

SEQ ID NO: 1183973 - RNA, 22 nt, Human
aaacaggaagaaggcaagucug

SEQ ID NO: 1183974 - RNA, 25 nt, Human
aaacaggaagaaggcaagucugugu

SEQ ID NO: 1183975 - RNA, 21 nt, Human
aaagaccuagaaagaacaggc

SEQ ID NO: 1183976 - RNA, 24 nt, Human
aaagugcugggauuacaggcguga

SEQ ID NO: 1183977 - RNA, 23 nt, Human
aacaacaacaaaauccucauccu

SEQ ID NO: 1183978 - RNA, 20 nt, Human
aacaacaacaacaacaaaau

SEQ ID NO: 1183979 - RNA, 21 nt, Human
aacguuuugagaauuuuaggu

SEQ ID NO: 1183980 - RNA, 22 nt, Human
aagacacucucuugcccaacca

SEQ ID NO: 1183981 - RNA, 21 nt, Human
aagcacccaccucuggaacuc

SEQ ID NO: 1183982 - RNA, 24 nt, Human
aaggcauaaacuaaacaggaagaa

SEQ ID NO: 1183983 - RNA, 19 nt, Human
aagugcugggauuacaggc

SEQ ID NO: 1183984 - RNA, 19 nt, Human
aagugcugggauuacaggc

SEQ ID NO: 1183985 - RNA, 26 nt, Human
aagugcugggauuacaggcgugagcc

SEQ ID NO: 1183986 - RNA, 22 nt, Human
aaugagcacauacucuuuaaac

SEQ ID NO: 1183987 - RNA, 20 nt, Human
aauuaaaaaaaaaaaaaaaa

SEQ ID NO: 1183988 - RNA, 23 nt, Human
aauuaaaaaaaaaaaaaaaauca

SEQ ID NO: 1183989 - RNA, 20 nt, Human
aauuaccuguagacucccau

SEQ ID NO: 1183990 - RNA, 24 nt, Human
acaacaacaacaacaaaauccuca

SEQ ID NO: 1183991 - RNA, 19 nt, Human
acaacaacaacaacaacaa

SEQ ID NO: 1183992 - RNA, 19 nt, Human
acaacaacaacaacaacaa

SEQ ID NO: 1183993 - RNA, 20 nt, Human
acaacaacaacaacaacaaa

SEQ ID NO: 1183994 - RNA, 22 nt, Human
acaacaacaacaacaacaacaa

SEQ ID NO: 1183995 - RNA, 24 nt, Human
acaacaacaacaacaacaacaaaa

SEQ ID NO: 1183996 - RNA, 20 nt, Human
acauauauuuugucugaacc

SEQ ID NO: 1183997 - RNA, 24 nt, Human
accauguuggucaggcuggucucg

SEQ ID NO: 1183998 - RNA, 21 nt, Human
acgggguuucaccauguuggu

SEQ ID NO: 1183999 - RNA, 23 nt, Human
acgggguuucaccauguugguca

SEQ ID NO: 1184000 - RNA, 24 nt, Human
acgggguuucaccauguuggucag

SEQ ID NO: 1184001 - RNA, 20 nt, Human
acuccaaagaccuagaaaga

SEQ ID NO: 1184002 - RNA, 19 nt, Human
acuccgcacucugaaguuc

SEQ ID NO: 1184003 - RNA, 20 nt, Human
acucucuugcccaaccacag

SEQ ID NO: 1184004 - RNA, 27 nt, Human
acucuguugcccacgcuggagugcaau

SEQ ID NO: 1184005 - RNA, 22 nt, Human
agaagacaaagaucugcaaaaa

SEQ ID NO: 1184006 - RNA, 22 nt, Human
agaucucggcucacugcaaccc

SEQ ID NO: 1184007 - RNA, 18 nt, Human
agaugguggugauagaca

SEQ ID NO: 1184008 - RNA, 18 nt, Human
agcagcugggauuacagg

SEQ ID NO: 1184009 - RNA, 24 nt, Human
aggaagaaggcaagucugugugaa

SEQ ID NO: 1184010 - RNA, 20 nt, Human
agguugcaaauucuuuuugu

SEQ ID NO: 1184011 - RNA, 22 nt, Human
aguagagacgggguuucaccau

SEQ ID NO: 1184012 - RNA, 24 nt, Human
agugcaauggccagaucucggcuc

SEQ ID NO: 1184013 - RNA, 24 nt, Human
caaagugcugggauuacaggcgug

SEQ ID NO: 1184014 - RNA, 20 nt, Human
caacaacaaaauccucaucc

SEQ ID NO: 1184015 - RNA, 24 nt, Human
caacaacaacaaaauccucauccu

SEQ ID NO: 1184016 - RNA, 22 nt, Human
caacaacaacaacaaaauccuc

SEQ ID NO: 1184017 - RNA, 18 nt, Human
caacaacaacaacaacaa

SEQ ID NO: 1184018 - RNA, 23 nt, Human
caaccccuccaccacauuuuacc

SEQ ID NO: 1184019 - RNA, 20 nt, Human
caagcgauucuccugccuca

SEQ ID NO: 1184020 - RNA, 22 nt, Human
caagcgauucuccugccucagc

SEQ ID NO: 1184021 - RNA, 21 nt, Human
caccauguuggucaggcuggu

SEQ ID NO: 1184022 - RNA, 24 nt, Human
caccauguuggucaggcuggucuc

SEQ ID NO: 1184023 - RNA, 24 nt, Human
caccccgcccggcuaauuuuugug

SEQ ID NO: 1184024 - RNA, 19 nt, Human
caccccugcagugaugacc

SEQ ID NO: 1184025 - RNA, 24 nt, Human
cacucuguugcccacgcuggagug

SEQ ID NO: 1184026 - RNA, 22 nt, Human
cacugcaaccccccgccuccca

SEQ ID NO: 1184027 - RNA, 18 nt, Human
cagaagacaaagaucugc

SEQ ID NO: 1184028 - RNA, 20 nt, Human
ccaaagugcugggauuacag

SEQ ID NO: 1184029 - RNA, 22 nt, Human
ccaaagugcugggauuacaggc

SEQ ID NO: 1184030 - RNA, 22 nt, Human
ccaaagugcugggauuacaggc

SEQ ID NO: 1184031 - RNA, 24 nt, Human
ccaaagugcugggauuacaggcgu

SEQ ID NO: 1184032 - RNA, 23 nt, Human
ccaacaaagacacucucuugccc

SEQ ID NO: 1184033 - RNA, 22 nt, Human
ccaaccacaguaauauuacaac

SEQ ID NO: 1184034 - RNA, 25 nt, Human
cccacgcuggagugcaauggccaga

SEQ ID NO: 1184035 - RNA, 23 nt, Human
cccagguucaagcgauucuccug

SEQ ID NO: 1184036 - RNA, 23 nt, Human
ccccugcagugaugaccuaugcc

SEQ ID NO: 1184037 - RNA, 19 nt, Human
cccgagcagcugggauuac

SEQ ID NO: 1184038 - RNA, 24 nt, Human
cccgagcagcugggauuacaggug

SEQ ID NO: 1184039 - RNA, 21 nt, Human
ccgagcagcugggauuacagg

SEQ ID NO: 1184040 - RNA, 23 nt, Human
ccgagcagcugggauuacaggug

SEQ ID NO: 1184041 - RNA, 21 nt, Human
ccgcccggcuaauuuuugugu

SEQ ID NO: 1184042 - RNA, 24 nt, Human
ccgccucccagguucaagcgauuc

SEQ ID NO: 1184043 - RNA, 24 nt, Human
ccucccagguucaagcgauucucc

SEQ ID NO: 1184044 - RNA, 22 nt, Human
ccucuggaacucaagcagugga

SEQ ID NO: 1184045 - RNA, 24 nt, Human
ccugaccucgugauccgccucggc

SEQ ID NO: 1184046 - RNA, 24 nt, Human
ccugccucagccucccgagcagcu

SEQ ID NO: 1184047 - RNA, 22 nt, Human
ccuuuuuuuuugagauggaguc

SEQ ID NO: 1184048 - RNA, 24 nt, Human
cgggguuucaccauguuggucagg

SEQ ID NO: 1184049 - RNA, 21 nt, Human
cgugauccgccucggccuccc

SEQ ID NO: 1184050 - RNA, 24 nt, Human
cucacugcaaccccccgccuccca

SEQ ID NO: 1184051 - RNA, 25 nt, Human
cucacugcaaccccccgccucccag

SEQ ID NO: 1184052 - RNA, 26 nt, Human
cucacugcaaccccccgccucccagg

SEQ ID NO: 1184053 - RNA, 22 nt, Human
cucccauuuugacaaucucacc

SEQ ID NO: 1184054 - RNA, 22 nt, Human
cuccugaccucgugauccgccu

SEQ ID NO: 1184055 - RNA, 22 nt, Human
cugcaaccccccgccucccagg

SEQ ID NO: 1184056 - RNA, 24 nt, Human
cugcaaccccccgccucccagguu

SEQ ID NO: 1184057 - RNA, 25 nt, Human
cugcaaccccccgccucccagguuc

SEQ ID NO: 1184058 - RNA, 20 nt, Human
gaaagaacaggcggggccgg

SEQ ID NO: 1184059 - RNA, 18 nt, Human
gaccucgugauccgccuc

SEQ ID NO: 1184060 - RNA, 24 nt, Human
gaccucgugauccgccucggccuc

SEQ ID NO: 1184061 - RNA, 24 nt, Human
gagaacaacaacaacaacaacaac

SEQ ID NO: 1184062 - RNA, 23 nt, Human
gagacgggguuucaccauguugg

SEQ ID NO: 1184063 - RNA, 24 nt, Human
gagacgggguuucaccauguuggu

SEQ ID NO: 1184064 - RNA, 24 nt, Human
gagcagcugggauuacaggugcgc

SEQ ID NO: 1184065 - RNA, 18 nt, Human
gauuacaggcgugagcca

SEQ ID NO: 1184066 - RNA, 22 nt, Human
gauuacaggcgugagccaccgc

SEQ ID NO: 1184067 - RNA, 22 nt, Human
gauuacaggcgugagccaccgc

SEQ ID NO: 1184068 - RNA, 18 nt, Human
gauuacaggugcgcgcca

SEQ ID NO: 1184069 - RNA, 21 nt, Human
gauucuccugccucagccucc

SEQ ID NO: 1184070 - RNA, 18 nt, Human
gcagcugggauuacaggu

SEQ ID NO: 1184071 - RNA, 21 nt, Human
gccucccgagcagcugggauu

SEQ ID NO: 1184072 - RNA, 23 nt, Human
gccucggccucccaaagugcugg

SEQ ID NO: 1184073 - RNA, 24 nt, Human
gcgauucuccugccucagccuccc

SEQ ID NO: 1184074 - RNA, 18 nt, Human
gcuggagugcaauggcca

SEQ ID NO: 1184075 - RNA, 23 nt, Human
gcuggucucgaacuccugaccuc

SEQ ID NO: 1184076 - RNA, 24 nt, Human
ggcuggucucgaacuccugaccuc

SEQ ID NO: 1184077 - RNA, 23 nt, Human
gggguuucaccauguuggucagg

SEQ ID NO: 1184078 - RNA, 19 nt, Human
ggucucgaacuccugaccu

SEQ ID NO: 1184079 - RNA, 23 nt, Human
guagagacgggguuucaccaugu

SEQ ID NO: 1184080 - RNA, 26 nt, Human
guuuugagaauuuuaggugugguccu

SEQ ID NO: 1184081 - RNA, 23 nt, Human
uaaaaaaaaaaaaaaaaucagaa

SEQ ID NO: 1184082 - RNA, 22 nt, Human
uaaguuacagacaugauuccuc

SEQ ID NO: 1184083 - RNA, 21 nt, Human
uaaucugcaaaaguucuucuu

SEQ ID NO: 1184084 - RNA, 24 nt, Human
uaauuuuuguguuuuuaguagaga

SEQ ID NO: 1184085 - RNA, 23 nt, Human
uacaggcgugagccaccgcgccc

SEQ ID NO: 1184086 - RNA, 22 nt, Human
uagagacgggguuucaccaugu

SEQ ID NO: 1184087 - RNA, 24 nt, Human
uaguagagacgggguuucaccaug

SEQ ID NO: 1184088 - RNA, 26 nt, Human
uaguagagacgggguuucaccauguu

SEQ ID NO: 1184089 - RNA, 22 nt, Human
uaguuggaaagauuaaccuuuu

SEQ ID NO: 1184090 - RNA, 21 nt, Human
uaucauucccuuuacauauau

SEQ ID NO: 1184091 - RNA, 27 nt, Human
uauccaaacgggcuacacaaaugauuu

SEQ ID NO: 1184092 - RNA, 19 nt, Human
uauuccaaccccuccacca

SEQ ID NO: 1184093 - RNA, 22 nt, Human
ucacugcaaccccccgccuccc

SEQ ID NO: 1184094 - RNA, 25 nt, Human
ucacugcaaccccccgccucccagg

SEQ ID NO: 1184095 - RNA, 24 nt, Human
uccaaacuccaaagaccuagaaag

SEQ ID NO: 1184096 - RNA, 21 nt, Human
uccaaagaccuagaaagaaca

SEQ ID NO: 1184097 - RNA, 26 nt, Human
uccaccaacaaagacacucucuugcc

SEQ ID NO: 1184098 - RNA, 24 nt, Human
ucccaaagugcugggauuacaggc

SEQ ID NO: 1184099 - RNA, 21 nt, Human
ucccagguucaagcgauucuc

SEQ ID NO: 1184100 - RNA, 24 nt, Human
ucccagguucaagcgauucuccug

SEQ ID NO: 1184101 - RNA, 23 nt, Human
ucccgagcagcugggauuacagg

SEQ ID NO: 1184102 - RNA, 24 nt, Human
ucccgagcagcugggauuacaggu

SEQ ID NO: 1184103 - RNA, 18 nt, Human
uccucaacuugggucucu

SEQ ID NO: 1184104 - RNA, 27 nt, Human
uccugagccaauacuuaaauaagccuc

SEQ ID NO: 1184105 - RNA, 18 nt, Human
ucggccucccaaagugcu

SEQ ID NO: 1184106 - RNA, 23 nt, Human
ucucacucuguugcccacgcugg

SEQ ID NO: 1184107 - RNA, 24 nt, Human
ucucacucuguugcccacgcugga

SEQ ID NO: 1184108 - RNA, 18 nt, Human
ucucgaacuccugaccuc

SEQ ID NO: 1184109 - RNA, 24 nt, Human
ucuguugcccacgcuggagugcaa

SEQ ID NO: 1184110 - RNA, 25 nt, Human
ugaagaaugagcacauacucuuuaa

SEQ ID NO: 1184111 - RNA, 19 nt, Human
ugaccuaugcccuaggcuc

SEQ ID NO: 1184112 - RNA, 27 nt, Human
ugagaacaacaacaacaacuggagacc

SEQ ID NO: 1184113 - RNA, 22 nt, Human
ugagauggagucucacucuguu

SEQ ID NO: 1184114 - RNA, 22 nt, Human
ugagugccuaguauaugucagg

SEQ ID NO: 1184115 - RNA, 21 nt, Human
ugcaaccccccgccucccagg

SEQ ID NO: 1184116 - RNA, 24 nt, Human
ugccucagccucccgagcagcugg

SEQ ID NO: 1184117 - RNA, 24 nt, Human
ugcugggauuacaggcgugagcca

SEQ ID NO: 1184118 - RNA, 23 nt, Human
uggagugcaauggccagaucucg

SEQ ID NO: 1184119 - RNA, 24 nt, Human
uggagugcaauggccagaucucgg

SEQ ID NO: 1184120 - RNA, 22 nt, Human
uggcuuucauguauguaagagu

SEQ ID NO: 1184121 - RNA, 18 nt, Human
ugggaauacauuugagaa

SEQ ID NO: 1184122 - RNA, 19 nt, Human
ugggacccuggccuucgcc

SEQ ID NO: 1184123 - RNA, 18 nt, Human
ugggauuacaggcgugag

SEQ ID NO: 1184124 - RNA, 19 nt, Human
ugggauuacaggcgugagc

SEQ ID NO: 1184125 - RNA, 21 nt, Human
ugggauuacaggcgugagcca

SEQ ID NO: 1184126 - RNA, 22 nt, Human
ugggauuacaggcgugagccac

SEQ ID NO: 1184127 - RNA, 23 nt, Human
ugggauuacaggcgugagccacc

SEQ ID NO: 1184128 - RNA, 24 nt, Human
ugggauuacaggcgugagccaccg

SEQ ID NO: 1184129 - RNA, 18 nt, Human
ugggauuacaggugcgcg

SEQ ID NO: 1184130 - RNA, 21 nt, Human
ugggauuacaggugcgcgcca

SEQ ID NO: 1184131 - RNA, 22 nt, Human
ugggauuacaggugcgcgccac

SEQ ID NO: 1184132 - RNA, 24 nt, Human
uggucaggcuggucucgaacuccu

SEQ ID NO: 1184133 - RNA, 18 nt, Human
uguaaacaacucccacaa

SEQ ID NO: 1184134 - RNA, 21 nt, Human
uguguuuuuaguagagacggg

SEQ ID NO: 1184135 - RNA, 21 nt, Human
uguuaaacgcgcugauuuaau

SEQ ID NO: 1184136 - RNA, 27 nt, Human
uuaaaaacaaaacaacagaaucucaac

SEQ ID NO: 1184137 - RNA, 18 nt, Human
uuaguagagacgggguuu

SEQ ID NO: 1184138 - RNA, 22 nt, Human
uuaguagagacgggguuucacc

SEQ ID NO: 1184139 - RNA, 24 nt, Human
uuaguagagacgggguuucaccau

SEQ ID NO: 1184140 - RNA, 21 nt, Human
uucaacuccaagacucaagau

SEQ ID NO: 1184141 - RNA, 21 nt, Human
uucaagcgauucuccugccuc

SEQ ID NO: 1184142 - RNA, 23 nt, Human
uucaagcgauucuccugccucag

SEQ ID NO: 1184143 - RNA, 24 nt, Human
uucaagcgauucuccugccucagc

SEQ ID NO: 1184144 - RNA, 19 nt, Human
uucaggacagggaagcacc

SEQ ID NO: 1184145 - RNA, 22 nt, Human
uuccaaccccuccaccacauuu

SEQ ID NO: 1184146 - RNA, 19 nt, Human
uuccaccaacaaagacacu

SEQ ID NO: 1184147 - RNA, 18 nt, Human
uugcccacgcuggagugc

SEQ ID NO: 1184148 - RNA, 19 nt, Human
uugcuuuaucauucccuuu

SEQ ID NO: 1184149 - RNA, 23 nt, Human
uuguguuuuuaguagagacgggg

SEQ ID NO: 1184150 - RNA, 18 nt, Human
uuuagacuuacagaaaag

SEQ ID NO: 1184151 - RNA, 24 nt, Human
uuucaccauguuggucaggcuggu

SEQ ID NO: 1184152 - RNA, 19 nt, Human
uuucugguucaggaucaug

SEQ ID NO: 1184153 - RNA, 20 nt, Human
uuucugguucaggaucaugu

SEQ ID NO: 1184154 - RNA, 21 nt, Human
uuuuguguuuuuaguagagac

SEQ ID NO: 1184155 - RNA, 24 nt, Human
uuuuuaguagagacgggguuucac

SEQ ID NO: 1184156 - RNA, 20 nt, Human
uuuuuguguuuuuaguagag

SEQ ID NO: 1184157 - RNA, 20 nt, Human
aaaaaaaacacacaaauaaa

SEQ ID NO: 1184158 - RNA, 22 nt, Human
aaaaacacacaaauaaaaacaa

SEQ ID NO: 1184159 - RNA, 22 nt, Human
aaaacaccucaaaaaauaaaca

SEQ ID NO: 1184160 - RNA, 24 nt, Human
aaaauaaauguauaugaauaaugc

SEQ ID NO: 1184161 - RNA, 19 nt, Human
aaaaugcccagucaaaaca

SEQ ID NO: 1184162 - RNA, 18 nt, Human
aaauauauaguacagccu

SEQ ID NO: 1184163 - RNA, 21 nt, Human
aaauauauguucucauguaca

SEQ ID NO: 1184164 - RNA, 21 nt, Human
aacaaauucugcagccaauag

SEQ ID NO: 1184165 - RNA, 23 nt, Human
aacaucuaguucauauccccaaa

SEQ ID NO: 1184166 - RNA, 23 nt, Human
aaucggguggauaacggaguaua

SEQ ID NO: 1184167 - RNA, 22 nt, Human
acaaccaauuacaauaaaauca

SEQ ID NO: 1184168 - RNA, 24 nt, Human
acacaaauaaaaacaaaaacaccu

SEQ ID NO: 1184169 - RNA, 24 nt, Human
acagcaagauacuugcuuuuggcc

SEQ ID NO: 1184170 - RNA, 24 nt, Human
acagccuuaacagugaugcuagaa

SEQ ID NO: 1184171 - RNA, 20 nt, Human
accaauuuuauauucccugu

SEQ ID NO: 1184172 - RNA, 22 nt, Human
acuguuucuucacuuuaaccaa

SEQ ID NO: 1184173 - RNA, 19 nt, Human
acuuaaaaaaaaaaaaaca

SEQ ID NO: 1184174 - RNA, 23 nt, Human
agaaaggugugaacaguacuguu

SEQ ID NO: 1184175 - RNA, 20 nt, Human
agaauaagugaugacaauau

SEQ ID NO: 1184176 - RNA, 21 nt, Human
agcaucaggcaugcacaguag

SEQ ID NO: 1184177 - RNA, 19 nt, Human
agccaacaccagaaacuua

SEQ ID NO: 1184178 - RNA, 22 nt, Human
agccuuaacagugaugcuagaa

SEQ ID NO: 1184179 - RNA, 18 nt, Human
aggugugaacaguacugu

SEQ ID NO: 1184180 - RNA, 24 nt, Human
auauauguucucauguacacugga

SEQ ID NO: 1184181 - RNA, 21 nt, Human
aucaugaccacaggaaaccaa

SEQ ID NO: 1184182 - RNA, 21 nt, Human
auuuagucauuuuaaacccaa

SEQ ID NO: 1184183 - RNA, 23 nt, Human
caaauaaaaacaaaaacaccuca

SEQ ID NO: 1184184 - RNA, 22 nt, Human
caagacaccugugauaaagaag

SEQ ID NO: 1184185 - RNA, 23 nt, Human
cacaacccaucaguagccaacac

SEQ ID NO: 1184186 - RNA, 25 nt, Human
cacagcaagauacuugcuuuuggcc

SEQ ID NO: 1184187 - RNA, 20 nt, Human
caccguacaacagugacaac

SEQ ID NO: 1184188 - RNA, 20 nt, Human
cagccuuucccucucccaaa

SEQ ID NO: 1184189 - RNA, 20 nt, Human
cauauccccaaaaaaugugg

SEQ ID NO: 1184190 - RNA, 24 nt, Human
ccacacacuuacggcaugccaagc

SEQ ID NO: 1184191 - RNA, 19 nt, Human
ccacuuuaggcuaaaauaa

SEQ ID NO: 1184192 - RNA, 21 nt, Human
cccagucaaaacauuuagaaa

SEQ ID NO: 1184193 - RNA, 20 nt, Human
ccugacccugccacccugcu

SEQ ID NO: 1184194 - RNA, 24 nt, Human
ccugacccugccacccugcugcaa

SEQ ID NO: 1184195 - RNA, 25 nt, Human
cuaaacacccaaguuauuacacaau

SEQ ID NO: 1184196 - RNA, 19 nt, Human
cuacacacagcaagauacu

SEQ ID NO: 1184197 - RNA, 23 nt, Human
cucccaaauacuacccaggaaaa

SEQ ID NO: 1184198 - RNA, 24 nt, Human
cuccuaaacacccaaguuauuaca

SEQ ID NO: 1184199 - RNA, 18 nt, Human
cucucccaaauacuaccc

SEQ ID NO: 1184200 - RNA, 23 nt, Human
cuuaaaaaaaaaaaaacacacaa

SEQ ID NO: 1184201 - RNA, 19 nt, Human
cuuacggcaugccaagccu

SEQ ID NO: 1184202 - RNA, 23 nt, Human
gaaaaaaguuccaagcugacuua

SEQ ID NO: 1184203 - RNA, 20 nt, Human
gaaaaacagaaacuuccucc

SEQ ID NO: 1184204 - RNA, 19 nt, Human
gaaguacgauuccccggca

SEQ ID NO: 1184205 - RNA, 22 nt, Human
gaagugacuugcuucaagugcc

SEQ ID NO: 1184206 - RNA, 21 nt, Human
gaggugugugauaauuaggag

SEQ ID NO: 1184207 - RNA, 21 nt, Human
gaucagucucuucuuuuuauu

SEQ ID NO: 1184208 - RNA, 23 nt, Human
ggaguauaguuauuccacuuaag

SEQ ID NO: 1184209 - RNA, 22 nt, Human
gugaauaucaaacauaaucaca

SEQ ID NO: 1184210 - RNA, 20 nt, Human
uaaaaacaaaaacaccucaa

SEQ ID NO: 1184211 - RNA, 26 nt, Human
uaaaaacaaaaacaccucaaaaaaua

SEQ ID NO: 1184212 - RNA, 18 nt, Human
uaaccaagagacuacaca

SEQ ID NO: 1184213 - RNA, 23 nt, Human
uaagcuacaauauguuuaaagca

SEQ ID NO: 1184214 - RNA, 19 nt, Human
uacacaaugggaagcugau

SEQ ID NO: 1184215 - RNA, 23 nt, Human
uacuacccaggaaaaaaguucca

SEQ ID NO: 1184216 - RNA, 21 nt, Human
uauuaaaccuuacuccccaaa

SEQ ID NO: 1184217 - RNA, 21 nt, Human
uauuagaagggacugaauaua

SEQ ID NO: 1184218 - RNA, 21 nt, Human
uauuugccaggucauccuaau

SEQ ID NO: 1184219 - RNA, 24 nt, Human
ucaauacccgauggcaauauuaaa

SEQ ID NO: 1184220 - RNA, 22 nt, Human
ucagauugcuuggaucuugguc

SEQ ID NO: 1184221 - RNA, 22 nt, Human
ucaguggugguguucaagaaua

SEQ ID NO: 1184222 - RNA, 22 nt, Human
uccaagcugacuuaaaaaaaaa

SEQ ID NO: 1184223 - RNA, 18 nt, Human
ucccaaauacuacccagg

SEQ ID NO: 1184224 - RNA, 19 nt, Human
uccccaaaaaaugugaaaa

SEQ ID NO: 1184225 - RNA, 19 nt, Human
uccccggcagcagucuacc

SEQ ID NO: 1184226 - RNA, 19 nt, Human
ucggugguaaguuaccucu

SEQ ID NO: 1184227 - RNA, 22 nt, Human
ucuaguucauauccccaaaaaa

SEQ ID NO: 1184228 - RNA, 18 nt, Human
ucuccugacccugccacc

SEQ ID NO: 1184229 - RNA, 22 nt, Human
ucugcagccaauaguacacuga

SEQ ID NO: 1184230 - RNA, 18 nt, Human
ucuuuaauucuagacacc

SEQ ID NO: 1184231 - RNA, 19 nt, Human
ugaaaagacuccuaaacac

SEQ ID NO: 1184232 - RNA, 20 nt, Human
ugaauauaauuauggagacu

SEQ ID NO: 1184233 - RNA, 24 nt, Human
ugaccuaugucuaaauggagaaaa

SEQ ID NO: 1184234 - RNA, 18 nt, Human
ugacuuaaaaaaaaaaaa

SEQ ID NO: 1184235 - RNA, 22 nt, Human
ugauucaguauccacaguccag

SEQ ID NO: 1184236 - RNA, 25 nt, Human
uguauauaucuuaacacauauaucu

SEQ ID NO: 1184237 - RNA, 27 nt, Human
uguauuaaaauccaggugaauaucaaa

SEQ ID NO: 1184238 - RNA, 18 nt, Human
ugugcacagcuguauaca

SEQ ID NO: 1184239 - RNA, 18 nt, Human
uuaaaagaaaaaugccca

SEQ ID NO: 1184240 - RNA, 22 nt, Human
uucaaauaguagcugaaaauag

SEQ ID NO: 1184241 - RNA, 25 nt, Human
uucaaauaguagcugaaaauagggu

SEQ ID NO: 1184242 - RNA, 28 nt, Human
uucaaauaguagcugaaaauaggguuug

SEQ ID NO: 1184243 - RNA, 23 nt, Human
uucaugcugcauuuucauuucua

SEQ ID NO: 1184244 - RNA, 20 nt, Human
uucauuucuauagagcagac

SEQ ID NO: 1184245 - RNA, 19 nt, Human
uuccacuuaagaagcauuc

SEQ ID NO: 1184246 - RNA, 20 nt, Human
uugccaggucauccuaauuu

SEQ ID NO: 1184247 - RNA, 24 nt, Human
aggcacaguggcuugggccuccaa

SEQ ID NO: 1184248 - RNA, 24 nt, Human
uggcuugggccuccaaucccggca

SEQ ID NO: 1184249 - RNA, 24 nt, Human
aaacauguccuguauuuacugucu

SEQ ID NO: 1184250 - RNA, 21 nt, Human
aaaggaaauacguggguaacc

SEQ ID NO: 1184251 - RNA, 18 nt, Human
aaaugccaggaaccaugg

SEQ ID NO: 1184252 - RNA, 19 nt, Human
aacagccuuuucucuaguu

SEQ ID NO: 1184253 - RNA, 22 nt, Human
aaggagaagccaguuuacaaug

SEQ ID NO: 1184254 - RNA, 20 nt, Human
aaggccaggaguucaagacc

SEQ ID NO: 1184255 - RNA, 21 nt, Human
aauaauaaaaauaaaaugaac

SEQ ID NO: 1184256 - RNA, 27 nt, Human
acagccuuuucucuaguuuuguuuccc

SEQ ID NO: 1184257 - RNA, 19 nt, Human
acccuugcaauagcucaua

SEQ ID NO: 1184258 - RNA, 21 nt, Human
acuccagcugccucuaaucuc

SEQ ID NO: 1184259 - RNA, 19 nt, Human
acuuggucuguccucuuuc

SEQ ID NO: 1184260 - RNA, 21 nt, Human
agaauaaaaaguucuaaaagg

SEQ ID NO: 1184261 - RNA, 24 nt, Human
agacaaaaccacacucaaguuauc

SEQ ID NO: 1184262 - RNA, 18 nt, Human
agaggguagauuuugcau

SEQ ID NO: 1184263 - RNA, 23 nt, Human
agcacuuugggaggccgaggcgg

SEQ ID NO: 1184264 - RNA, 19 nt, Human
agccaccuuucucccacuc

SEQ ID NO: 1184265 - RNA, 22 nt, Human
agccaguuaaacaaugagccuc

SEQ ID NO: 1184266 - RNA, 24 nt, Human
aggaguucaagaccagccucugua

SEQ ID NO: 1184267 - RNA, 22 nt, Human
aggcagcacauugcauggaauu

SEQ ID NO: 1184268 - RNA, 24 nt, Human
aguggcucacacuuauagucccag

SEQ ID NO: 1184269 - RNA, 23 nt, Human
auucaauuaucaugcuuuugauu

SEQ ID NO: 1184270 - RNA, 23 nt, Human
caaccuuucaauccaaggacgau

SEQ ID NO: 1184271 - RNA, 24 nt, Human
cacacuuauagucccagcacuuug

SEQ ID NO: 1184272 - RNA, 20 nt, Human
cacuccagcugccucuaauc

SEQ ID NO: 1184273 - RNA, 21 nt, Human
cacugagucugcaggcuuucc

SEQ ID NO: 1184274 - RNA, 25 nt, Human
cacuucacccuugcaauagcucaua

SEQ ID NO: 1184275 - RNA, 24 nt, Human
cagcacuuugggaggccgaggcgg

SEQ ID NO: 1184276 - RNA, 23 nt, Human
cagccugggcuuucuuuccuaaa

SEQ ID NO: 1184277 - RNA, 21 nt, Human
caggaaccauggcagagcuaa

SEQ ID NO: 1184278 - RNA, 23 nt, Human
caggcuuucccccacucuuaucu

SEQ ID NO: 1184279 - RNA, 19 nt, Human
caguggcucacacuuauag

SEQ ID NO: 1184280 - RNA, 22 nt, Human
cauaggaguggcccugcagaga

SEQ ID NO: 1184281 - RNA, 25 nt, Human
cauccuuagccuuuccuaguggccc

SEQ ID NO: 1184282 - RNA, 25 nt, Human
cauggcaagacccccgccucuaaaa

SEQ ID NO: 1184283 - RNA, 28 nt, Human
cauggcaagacccccgccucuaaaaaaa

SEQ ID NO: 1184284 - RNA, 19 nt, Human
ccacaacagaaggcagcac

SEQ ID NO: 1184285 - RNA, 21 nt, Human
ccagccaccugguagaaugau

SEQ ID NO: 1184286 - RNA, 22 nt, Human
ccucuaaaaaaaauaauaaaaa

SEQ ID NO: 1184287 - RNA, 19 nt, Human
ccucuaaaacacaagcgga

SEQ ID NO: 1184288 - RNA, 19 nt, Human
ccuguauuuacugucuuug

SEQ ID NO: 1184289 - RNA, 19 nt, Human
cgaggcggauugcuuaagg

SEQ ID NO: 1184290 - RNA, 22 nt, Human
cgaggcggauugcuuaaggcca

SEQ ID NO: 1184291 - RNA, 24 nt, Human
cggauugcuuaaggccaggaguuc

SEQ ID NO: 1184292 - RNA, 20 nt, Human
cucaaugcucuccaagcacu

SEQ ID NO: 1184293 - RNA, 24 nt, Human
cucacacuuauagucccagcacuu

SEQ ID NO: 1184294 - RNA, 21 nt, Human
cucacgggacccuguuuucca

SEQ ID NO: 1184295 - RNA, 18 nt, Human
cuuauagacauacuacuu

SEQ ID NO: 1184296 - RNA, 23 nt, Human
gaccagcuucagaaccaaacugg

SEQ ID NO: 1184297 - RNA, 24 nt, Human
gagggccagaugcaguggcucaca

SEQ ID NO: 1184298 - RNA, 24 nt, Human
gauugcuuaaggccaggaguucaa

SEQ ID NO: 1184299 - RNA, 28 nt, Human
ggagaagccaguuuacaaugaacuuaga

SEQ ID NO: 1184300 - RNA, 18 nt, Human
ggcaggaaauccacaaca

SEQ ID NO: 1184301 - RNA, 21 nt, Human
ggcaggaaauccacaacagaa

SEQ ID NO: 1184302 - RNA, 24 nt, Human
gggccagaugcaguggcucacacu

SEQ ID NO: 1184303 - RNA, 24 nt, Human
guccgagccaccuuucucccacuc

SEQ ID NO: 1184304 - RNA, 24 nt, Human
guggcucacacuuauagucccagc

SEQ ID NO: 1184305 - RNA, 18 nt, Human
guggguaaccagagcugc

SEQ ID NO: 1184306 - RNA, 24 nt, Human
guucucacccuugcuguguaugua

SEQ ID NO: 1184307 - RNA, 18 nt, Human
uaaaacacaagcggagac

SEQ ID NO: 1184308 - RNA, 24 nt, Human
uaaaaggguaccagccaccuggua

SEQ ID NO: 1184309 - RNA, 23 nt, Human
uaaaaugaacaugaauuuagagg

SEQ ID NO: 1184310 - RNA, 19 nt, Human
uaacacaucucagaauaaa

SEQ ID NO: 1184311 - RNA, 18 nt, Human
uaaccagagcugcaaugg

SEQ ID NO: 1184312 - RNA, 20 nt, Human
uaccagccugggcuuucuuu

SEQ ID NO: 1184313 - RNA, 18 nt, Human
uagaaagaggguagauuu

SEQ ID NO: 1184314 - RNA, 22 nt, Human
uauguaaccuugggaaaauuac

SEQ ID NO: 1184315 - RNA, 22 nt, Human
ucacgggacccuguuuuccaua

SEQ ID NO: 1184316 - RNA, 18 nt, Human
uccauagugauuaacuag

SEQ ID NO: 1184317 - RNA, 22 nt, Human
ucccacuccagcugccucuaau

SEQ ID NO: 1184318 - RNA, 20 nt, Human
ucccauugccuuuuccuuug

SEQ ID NO: 1184319 - RNA, 21 nt, Human
uccuguauuuacugucuuugc

SEQ ID NO: 1184320 - RNA, 20 nt, Human
uccuugaugcuuaccuagca

SEQ ID NO: 1184321 - RNA, 21 nt, Human
ucuaucacuucacccuugcaa

SEQ ID NO: 1184322 - RNA, 21 nt, Human
ucugcaggcuuucccccacuc

SEQ ID NO: 1184323 - RNA, 18 nt, Human
ugagagaagucuuuugua

SEQ ID NO: 1184324 - RNA, 20 nt, Human
ugagucugcaggcuuucccc

SEQ ID NO: 1184325 - RNA, 25 nt, Human
ugcauaaaauucuuuucucacggga

SEQ ID NO: 1184326 - RNA, 24 nt, Human
ugccuuuuccuuugguagacucua

SEQ ID NO: 1184327 - RNA, 24 nt, Human
ugcucugcccuuauagacauacua

SEQ ID NO: 1184328 - RNA, 23 nt, Human
uggcccuggaaaaaucucaauuu

SEQ ID NO: 1184329 - RNA, 24 nt, Human
uggcucacacuuauagucccagca

SEQ ID NO: 1184330 - RNA, 18 nt, Human
ugggaggccgaggcggau

SEQ ID NO: 1184331 - RNA, 20 nt, Human
ugggaggccgaggcggauug

SEQ ID NO: 1184332 - RNA, 18 nt, Human
uguaaagaguggcuuaua

SEQ ID NO: 1184333 - RNA, 18 nt, Human
ugugagauaaaauugaag

SEQ ID NO: 1184334 - RNA, 21 nt, Human
uguuucccuuuuucuuccaag

SEQ ID NO: 1184335 - RNA, 25 nt, Human
uguuucccuuuuucuuccaaggaga

SEQ ID NO: 1184336 - RNA, 24 nt, Human
uguuugcuacuuggucuguccucu

SEQ ID NO: 1184337 - RNA, 19 nt, Human
uuaccuagcagugucuggc

SEQ ID NO: 1184338 - RNA, 25 nt, Human
uuccaaggcauccuuagccuuuccu

SEQ ID NO: 1184339 - RNA, 25 nt, Human
uugaaaaaaguguucacuaaucauu

SEQ ID NO: 1184340 - RNA, 23 nt, Human
uugcuuaaggccaggaguucaag

SEQ ID NO: 1184341 - RNA, 18 nt, Human
uugggaggccgaggcgga

SEQ ID NO: 1184342 - RNA, 19 nt, Human
uuguauaaaggagaagcca

SEQ ID NO: 1184343 - RNA, 22 nt, Human
uuguauaaaggagaagccaguu

SEQ ID NO: 1184344 - RNA, 22 nt, Human
uuuacugucuuugcauccuuga

SEQ ID NO: 1184345 - RNA, 23 nt, Human
acuuggcuggugcugucaaugag

SEQ ID NO: 1184346 - RNA, 21 nt, Human
cagccacagucagcucaaggg

SEQ ID NO: 1184347 - RNA, 23 nt, Human
ccuccgacagccacagucagcuc

SEQ ID NO: 1184348 - RNA, 21 nt, Human
ccugcccaccacuuccagcug

SEQ ID NO: 1184349 - RNA, 23 nt, Human
cuggugcugcugcagugggaagc

SEQ ID NO: 1184350 - RNA, 19 nt, Human
gcccaccacuuccagcugu

SEQ ID NO: 1184351 - RNA, 22 nt, Human
gcucaaggggagggaugcccag

SEQ ID NO: 1184352 - RNA, 23 nt, Human
guccuccgacagccacagucagc

SEQ ID NO: 1184353 - RNA, 25 nt, Human
gugcugcugcagugggaagcuggca

SEQ ID NO: 1184354 - RNA, 21 nt, Human
uauucugauagcuccuuccug

SEQ ID NO: 1184355 - RNA, 21 nt, Human
ucaaggggagggaugcccaga

SEQ ID NO: 1184356 - RNA, 19 nt, Human
uccuuuguucuccccagac

SEQ ID NO: 1184357 - RNA, 18 nt, Human
ucuguuaucuuuauucug

SEQ ID NO: 1184358 - RNA, 21 nt, Human
uuuauucugauagcuccuucc

SEQ ID NO: 1184359 - RNA, 21 nt, Human
aaacagccaucggcagacuuc

SEQ ID NO: 1184360 - RNA, 24 nt, Human
aacaagcaacaugguggaaucuua

SEQ ID NO: 1184361 - RNA, 22 nt, Human
acauugucucacuucaccaucc

SEQ ID NO: 1184362 - RNA, 20 nt, Human
agaaagaaacauuucaagga

SEQ ID NO: 1184363 - RNA, 22 nt, Human
agacaagugcaaacgugucccu

SEQ ID NO: 1184364 - RNA, 21 nt, Human
auaaauuugagagaaagaaac

SEQ ID NO: 1184365 - RNA, 23 nt, Human
cacauugucucacuucaccaucc

SEQ ID NO: 1184366 - RNA, 23 nt, Human
cacugagccucacaaaacacucc

SEQ ID NO: 1184367 - RNA, 18 nt, Human
cagcggcuucugccugga

SEQ ID NO: 1184368 - RNA, 21 nt, Human
cucacaaaacacuccauucac

SEQ ID NO: 1184369 - RNA, 21 nt, Human
gagaaagaaacauuucaagga

SEQ ID NO: 1184370 - RNA, 22 nt, Human
gcagcacugagccucacaaaac

SEQ ID NO: 1184371 - RNA, 23 nt, Human
gcagcacugagccucacaaaaca

SEQ ID NO: 1184372 - RNA, 19 nt, Human
gcauuuuuaauuuuuagaa

SEQ ID NO: 1184373 - RNA, 21 nt, Human
gccuagaaaaucucuugcgaa

SEQ ID NO: 1184374 - RNA, 18 nt, Human
uaaacaagcaacauggug

SEQ ID NO: 1184375 - RNA, 20 nt, Human
uaugcagcacugagccucac

SEQ ID NO: 1184376 - RNA, 24 nt, Human
uccuccagcagacucuccccguca

SEQ ID NO: 1184377 - RNA, 23 nt, Human
ugaacuaaacaagcaacauggug

SEQ ID NO: 1184378 - RNA, 18 nt, Human
ugacuuccuccagcagac

SEQ ID NO: 1184379 - RNA, 20 nt, Human
ugacuuccuccagcagacuc

SEQ ID NO: 1184380 - RNA, 23 nt, Human
ugguugaacuaaacaagcaacau

SEQ ID NO: 1184381 - RNA, 25 nt, Human
aaaaaaaaguagaugauugacagaa

SEQ ID NO: 1184382 - RNA, 24 nt, Human
aaaagaugaacaugcauuuuaaga

SEQ ID NO: 1184383 - RNA, 23 nt, Human
aaagaaaaauauaccuuuucuuu

SEQ ID NO: 1184384 - RNA, 19 nt, Human
aacuugcucccugaaccug

SEQ ID NO: 1184385 - RNA, 21 nt, Human
aaguuuuggaggcucccaacc

SEQ ID NO: 1184386 - RNA, 20 nt, Human
aauaaagggaccgauuuaga

SEQ ID NO: 1184387 - RNA, 22 nt, Human
acaguaagcagacagaaaaaga

SEQ ID NO: 1184388 - RNA, 30 nt, Human
accugaaaucccagcacuuuaggaagccaa

SEQ ID NO: 1184389 - RNA, 22 nt, Human
acgcagccccccucacuccgcc

SEQ ID NO: 1184390 - RNA, 20 nt, Human
acgcggaaaagacucaacaa

SEQ ID NO: 1184391 - RNA, 19 nt, Human
agaaaaagaacgcgagaga

SEQ ID NO: 1184392 - RNA, 23 nt, Human
agaaaaccuccacaacuucacca

SEQ ID NO: 1184393 - RNA, 19 nt, Human
agacagaaaaagaacgcga

SEQ ID NO: 1184394 - RNA, 19 nt, Human
agacagaaaaagaacgcga

SEQ ID NO: 1184395 - RNA, 22 nt, Human
agacagaaaaagaacgcgagag

SEQ ID NO: 1184396 - RNA, 21 nt, Human
agagaagacagacauagagga

SEQ ID NO: 1184397 - RNA, 19 nt, Human
agauuucuucucugccuuc

SEQ ID NO: 1184398 - RNA, 27 nt, Human
aggaacaaacggaaggaaccgguaccc

SEQ ID NO: 1184399 - RNA, 21 nt, Human
aggaucacauugucaaggaca

SEQ ID NO: 1184400 - RNA, 20 nt, Human
aggcucccaaccuucaauuu

SEQ ID NO: 1184401 - RNA, 18 nt, Human
agguuuuauuuuacuuuu

SEQ ID NO: 1184402 - RNA, 25 nt, Human
aucaacugacuaaaauugauccaua

SEQ ID NO: 1184403 - RNA, 27 nt, Human
auugcuguuuuuugcauaacagaugac

SEQ ID NO: 1184404 - RNA, 18 nt, Human
auugucccaaaauccaga

SEQ ID NO: 1184405 - RNA, 20 nt, Human
caaaaaagaaccacuguuac

SEQ ID NO: 1184406 - RNA, 23 nt, Human
caagaacaaacauaugagccuaa

SEQ ID NO: 1184407 - RNA, 24 nt, Human
caagaagcuauuccucccucagca

SEQ ID NO: 1184408 - RNA, 22 nt, Human
caaggacaguaagcagacagaa

SEQ ID NO: 1184409 - RNA, 23 nt, Human
cacccacgguguccucaggguca

SEQ ID NO: 1184410 - RNA, 18 nt, Human
cacugcaguguguucugc

SEQ ID NO: 1184411 - RNA, 18 nt, Human
cagaucaaguaaaccugu

SEQ ID NO: 1184412 - RNA, 22 nt, Human
cagccccccucacuccgccucc

SEQ ID NO: 1184413 - RNA, 24 nt, Human
cauccacaugcaugaaacagcaca

SEQ ID NO: 1184414 - RNA, 19 nt, Human
ccaccuggagcuguuggca

SEQ ID NO: 1184415 - RNA, 19 nt, Human
cccccucacuccgccuccu

SEQ ID NO: 1184416 - RNA, 22 nt, Human
ccgccuccuccgggcuaucugu

SEQ ID NO: 1184417 - RNA, 19 nt, Human
ccgcgcgcaggcuccaccu

SEQ ID NO: 1184418 - RNA, 22 nt, Human
ccugaaccugaaaucccagcac

SEQ ID NO: 1184419 - RNA, 22 nt, Human
cgcagccccccucacuccgccu

SEQ ID NO: 1184420 - RNA, 24 nt, Human
cgcggaaaagacucaacaacuaca

SEQ ID NO: 1184421 - RNA, 23 nt, Human
cggaaaagacucaacaacuacau

SEQ ID NO: 1184422 - RNA, 28 nt, Human
cggaaaagacucaacaacuacaugguag

SEQ ID NO: 1184423 - RNA, 21 nt, Human
cuaaaugaaauuaucaacuga

SEQ ID NO: 1184424 - RNA, 22 nt, Human
cuccacaacuucaccauuucaa

SEQ ID NO: 1184425 - RNA, 22 nt, Human
cucccucagcaaaagaugaaca

SEQ ID NO: 1184426 - RNA, 20 nt, Human
cugaaccugaaaucccagca

SEQ ID NO: 1184427 - RNA, 19 nt, Human
cugccgcgcgcaggcucca

SEQ ID NO: 1184428 - RNA, 26 nt, Human
cuuaacucucuauaaugagcaagaca

SEQ ID NO: 1184429 - RNA, 19 nt, Human
cuuagaauuugucaacuua

SEQ ID NO: 1184430 - RNA, 19 nt, Human
cuucuuacagaucuaacac

SEQ ID NO: 1184431 - RNA, 23 nt, Human
gaaaaaacacagcuucuuacaga

SEQ ID NO: 1184432 - RNA, 24 nt, Human
gagaagacagacauagaggacagg

SEQ ID NO: 1184433 - RNA, 21 nt, Human
gcagccccccucacuccgccu

SEQ ID NO: 1184434 - RNA, 19 nt, Human
gccgcgcgcaggcuccacc

SEQ ID NO: 1184435 - RNA, 24 nt, Human
gccugaccaggauggguggccacc

SEQ ID NO: 1184436 - RNA, 21 nt, Human
ggaaaagacucaacaacuaca

SEQ ID NO: 1184437 - RNA, 21 nt, Human
ggaacaaagaaaaccuccaca

SEQ ID NO: 1184438 - RNA, 23 nt, Human
ggaacauccacaugcaugaaaca

SEQ ID NO: 1184439 - RNA, 19 nt, Human
ggacaggugaauagauacg

SEQ ID NO: 1184440 - RNA, 22 nt, Human
ggacaggugaauagauacggau

SEQ ID NO: 1184441 - RNA, 20 nt, Human
ggccaggcugguguacuugg

SEQ ID NO: 1184442 - RNA, 22 nt, Human
uaaaaggccaccaugucggggc

SEQ ID NO: 1184443 - RNA, 23 nt, Human
uaaaaggccaccaugucggggca

SEQ ID NO: 1184444 - RNA, 24 nt, Human
uaaaaggccaccaugucggggcac

SEQ ID NO: 1184445 - RNA, 24 nt, Human
uaaaauuccaaaaaagaaccacug

SEQ ID NO: 1184446 - RNA, 23 nt, Human
uaacacugcaguguguucugcca

SEQ ID NO: 1184447 - RNA, 23 nt, Human
uaacgcggaaaagacucaacaac

SEQ ID NO: 1184448 - RNA, 24 nt, Human
uaacucucuauaaugagcaagaca

SEQ ID NO: 1184449 - RNA, 19 nt, Human
uaagagauaucugcaggac

SEQ ID NO: 1184450 - RNA, 22 nt, Human
uaagauacauuuuacucccaaa

SEQ ID NO: 1184451 - RNA, 21 nt, Human
uaagugauugacacagauuau

SEQ ID NO: 1184452 - RNA, 21 nt, Human
uauggaacaaagaaaaccucc

SEQ ID NO: 1184453 - RNA, 22 nt, Human
uauggaacaaagaaaaccucca

SEQ ID NO: 1184454 - RNA, 18 nt, Human
ucaccauuucaagguucu

SEQ ID NO: 1184455 - RNA, 19 nt, Human
uccaaaaaagaaccacugu

SEQ ID NO: 1184456 - RNA, 21 nt, Human
uccaaauaucaaauauaggca

SEQ ID NO: 1184457 - RNA, 20 nt, Human
uccacaacuucaccauuuca

SEQ ID NO: 1184458 - RNA, 22 nt, Human
uccacaugcaugaaacagcaca

SEQ ID NO: 1184459 - RNA, 26 nt, Human
uccagauuucuucucugccuucaacu

SEQ ID NO: 1184460 - RNA, 18 nt, Human
ugaaacagcacaggagug

SEQ ID NO: 1184461 - RNA, 19 nt, Human
ugagagaagacagacauag

SEQ ID NO: 1184462 - RNA, 24 nt, Human
ugagagaagacagacauagagggg

SEQ ID NO: 1184463 - RNA, 26 nt, Human
ugagccuaauaaaaaagaggcacuuc

SEQ ID NO: 1184464 - RNA, 23 nt, Human
ugauaagagccaaccuuccaggg

SEQ ID NO: 1184465 - RNA, 20 nt, Human
ugauugacagaaggcuagau

SEQ ID NO: 1184466 - RNA, 31 nt, Human
ugccgucggaugcucaccagccucccugccc

SEQ ID NO: 1184467 - RNA, 23 nt, Human
ugcuuuuccaguauuuguuuacg

SEQ ID NO: 1184468 - RNA, 18 nt, Human
uggcgucauccucccagc

SEQ ID NO: 1184469 - RNA, 19 nt, Human
uguaaacaaaaaagagagc

SEQ ID NO: 1184470 - RNA, 22 nt, Human
uguacuuggucgagcccuuggc

SEQ ID NO: 1184471 - RNA, 21 nt, Human
ugucuuguuuuuacgugaggg

SEQ ID NO: 1184472 - RNA, 19 nt, Human
uuaaaaaaaaaaguagaug

SEQ ID NO: 1184473 - RNA, 21 nt, Human
uuggaggcucccaaccuucaa

SEQ ID NO: 1184474 - RNA, 27 nt, Human
uugucuuguuuuuacgugaggggaaug

SEQ ID NO: 1184475 - RNA, 22 nt, Human
uuuggaggcucccaaccuucaa

SEQ ID NO: 1184476 - RNA, 18 nt, Human
aaaagucacugcugaacc

SEQ ID NO: 1184477 - RNA, 21 nt, Human
aaagcauucuuaaagcagaga

SEQ ID NO: 1184478 - RNA, 18 nt, Human
aacugacaccagcagccu

SEQ ID NO: 1184479 - RNA, 19 nt, Human
aagcaaacgcagaaugaga

SEQ ID NO: 1184480 - RNA, 21 nt, Human
aagcaaacgcagaaugagaug

SEQ ID NO: 1184481 - RNA, 20 nt, Human
aaguccucugggcuccaccu

SEQ ID NO: 1184482 - RNA, 18 nt, Human
acaaugucauucgcagag

SEQ ID NO: 1184483 - RNA, 20 nt, Human
accaugacagcaucguacag

SEQ ID NO: 1184484 - RNA, 22 nt, Human
acccagaaagcauucuuaaagc

SEQ ID NO: 1184485 - RNA, 20 nt, Human
accccaauuucucaucugaa

SEQ ID NO: 1184486 - RNA, 21 nt, Human
agaaacagaaucaaguuuuau

SEQ ID NO: 1184487 - RNA, 25 nt, Human
aggccccugggcuccaccugcuccu

SEQ ID NO: 1184488 - RNA, 19 nt, Human
augaggauccugaucuucu

SEQ ID NO: 1184489 - RNA, 27 nt, Human
auuugguguuguuaguguucuggauuu

SEQ ID NO: 1184490 - RNA, 21 nt, Human
caauguguagccuuuucagau

SEQ ID NO: 1184491 - RNA, 19 nt, Human
caccugcuccucccagucc

SEQ ID NO: 1184492 - RNA, 19 nt, Human
caccugcuccucccagucc

SEQ ID NO: 1184493 - RNA, 19 nt, Human
caccugcuccucccagucc

SEQ ID NO: 1184494 - RNA, 19 nt, Human
caccugcuccucccagucc

SEQ ID NO: 1184495 - RNA, 19 nt, Human
caccugcuccuuccagucc

SEQ ID NO: 1184496 - RNA, 19 nt, Human
cagcugcugggcuccggcc

SEQ ID NO: 1184497 - RNA, 21 nt, Human
cauaacugcuggauccuacag

SEQ ID NO: 1184498 - RNA, 23 nt, Human
cauuuaaggucccaucaugucuu

SEQ ID NO: 1184499 - RNA, 25 nt, Human
cccagagaacuaacucuaagcccau

SEQ ID NO: 1184500 - RNA, 18 nt, Human
cccaucugcagugaugag

SEQ ID NO: 1184501 - RNA, 22 nt, Human
cccugggcuccaccugcuccuc

SEQ ID NO: 1184502 - RNA, 27 nt, Human
ccgucgugcaaauccucugggcuccac

SEQ ID NO: 1184503 - RNA, 20 nt, Human
ccuguaacagacucugcugu

SEQ ID NO: 1184504 - RNA, 21 nt, Human
cggccaacaggggacguagcc

SEQ ID NO: 1184505 - RNA, 27 nt, Human
cgugcaaauccucugggcuccaccugc

SEQ ID NO: 1184506 - RNA, 23 nt, Human
cuagaacauuuuaauacccagaa

SEQ ID NO: 1184507 - RNA, 19 nt, Human
cucguacauccugugaguu

SEQ ID NO: 1184508 - RNA, 18 nt, Human
cucuaauucugcuuguuc

SEQ ID NO: 1184509 - RNA, 22 nt, Human
cucugggcuccaccugcuccuc

SEQ ID NO: 1184510 - RNA, 22 nt, Human
cucugggcuccaccugcuccuc

SEQ ID NO: 1184511 - RNA, 22 nt, Human
cucugggcuccaccugcuccuc

SEQ ID NO: 1184512 - RNA, 21 nt, Human
cugacaccagcagccuuugcu

SEQ ID NO: 1184513 - RNA, 20 nt, Human
cugcuguuucucuaauucug

SEQ ID NO: 1184514 - RNA, 23 nt, Human
cuucaaacauuuugaguaacagu

SEQ ID NO: 1184515 - RNA, 22 nt, Human
gcaaguccucugggcuccaccu

SEQ ID NO: 1184516 - RNA, 22 nt, Human
gcaaguccucugggcuccaccu

SEQ ID NO: 1184517 - RNA, 20 nt, Human
gcaauguguagccuuuucag

SEQ ID NO: 1184518 - RNA, 22 nt, Human
gcagguuuauugacguuuucca

SEQ ID NO: 1184519 - RNA, 21 nt, Human
gcccaccaggaacaaacacgu

SEQ ID NO: 1184520 - RNA, 25 nt, Human
ggacguagcccucaggaggcccggc

SEQ ID NO: 1184521 - RNA, 21 nt, Human
uaacugcuggauccuacaggu

SEQ ID NO: 1184522 - RNA, 21 nt, Human
uaagaaacuaccaaacugucu

SEQ ID NO: 1184523 - RNA, 18 nt, Human
uagcuaaaaagucacugc

SEQ ID NO: 1184524 - RNA, 25 nt, Human
uauugggauuuuuaaauuuuuucuu

SEQ ID NO: 1184525 - RNA, 24 nt, Human
ucacugaucuuuuuggggucuccu

SEQ ID NO: 1184526 - RNA, 24 nt, Human
ucacugcugaacccgagggcaccu

SEQ ID NO: 1184527 - RNA, 19 nt, Human
ucagagccagugugcugac

SEQ ID NO: 1184528 - RNA, 18 nt, Human
ucagauggcaucuugccc

SEQ ID NO: 1184529 - RNA, 23 nt, Human
ucccagagaacuaacucuaagcc

SEQ ID NO: 1184530 - RNA, 21 nt, Human
ucucggggcucccacagcugc

SEQ ID NO: 1184531 - RNA, 19 nt, Human
ucucuaauucugcuuguuc

SEQ ID NO: 1184532 - RNA, 24 nt, Human
ucugcaguuuacauugcgguucac

SEQ ID NO: 1184533 - RNA, 21 nt, Human
ucuuucaaguucccagagaac

SEQ ID NO: 1184534 - RNA, 18 nt, Human
ugacacacguugccaccc

SEQ ID NO: 1184535 - RNA, 21 nt, Human
ugacaccagcagccuuugcug

SEQ ID NO: 1184536 - RNA, 19 nt, Human
ugacagcaucguacagggc

SEQ ID NO: 1184537 - RNA, 20 nt, Human
ugacaguucauuucuuuuua

SEQ ID NO: 1184538 - RNA, 19 nt, Human
ugagaugcgcccaccauga

SEQ ID NO: 1184539 - RNA, 19 nt, Human
ugcaauguguagccuuuuc

SEQ ID NO: 1184540 - RNA, 20 nt, Human
ugccucccaaguaaucuucu

SEQ ID NO: 1184541 - RNA, 21 nt, Human
ugcuauaaacauccaugugca

SEQ ID NO: 1184542 - RNA, 18 nt, Human
ugcugucgcugagauuuc

SEQ ID NO: 1184543 - RNA, 20 nt, Human
uggauguaccacaauuugcu

SEQ ID NO: 1184544 - RNA, 19 nt, Human
ugggauuuuuaaauuuuuu

SEQ ID NO: 1184545 - RNA, 21 nt, Human
ugugugcugucgcugagauuu

SEQ ID NO: 1184546 - RNA, 19 nt, Human
uguuaaagaggagcuguuc

SEQ ID NO: 1184547 - RNA, 24 nt, Human
uguuguagcuaaaaagucacugcu

SEQ ID NO: 1184548 - RNA, 22 nt, Human
uuaaagaggagcuguucuuaaa

SEQ ID NO: 1184549 - RNA, 27 nt, Human
uuauuugccaucuacauauuuuccuug

SEQ ID NO: 1184550 - RNA, 25 nt, Human
uucaaacuauacauuuaacuuaaca

SEQ ID NO: 1184551 - RNA, 21 nt, Human
uuccaaguuucggcaguuaug

SEQ ID NO: 1184552 - RNA, 21 nt, Human
uugcccaccaggaacaaacac

SEQ ID NO: 1184553 - RNA, 21 nt, Human
uuggugagguccacaucuuug

SEQ ID NO: 1184554 - RNA, 18 nt, Human
uuguuaguguucuggauu

SEQ ID NO: 1184555 - RNA, 25 nt, Human
uuucaaguucccagagaacuaacuc

SEQ ID NO: 1184556 - RNA, 19 nt, Human
uuuguuaaagaggagcugu

SEQ ID NO: 1184557 - RNA, 21 nt, Human
uuuguuaaagaggagcuguuc

SEQ ID NO: 1184558 - RNA, 22 nt, Human
uuuucuuugauuuaugcuuccu

SEQ ID NO: 1184559 - RNA, 20 nt, Human
gcagcacaaaagcccuacug

SEQ ID NO: 1184560 - RNA, 22 nt, Human
gcagcacaaaagcccuacuggg

SEQ ID NO: 1184561 - RNA, 20 nt, Human
ucugagcagcacaaaagccc

SEQ ID NO: 1184562 - RNA, 22 nt, Human
ugagcagcacaaaagcccuacu

SEQ ID NO: 1184563 - RNA, 19 nt, Human
ugguaacaucugagcagca

SEQ ID NO: 1184564 - RNA, 20 nt, Human
aaacccagcaaaaagagcac

SEQ ID NO: 1184565 - RNA, 18 nt, Human
aaacucuggcguggaaac

SEQ ID NO: 1184566 - RNA, 24 nt, Human
aaauaaacccagcaaaaagagcac

SEQ ID NO: 1184567 - RNA, 30 nt, Human
aaccagugcugccaagaagcgccaacacgg

SEQ ID NO: 1184568 - RNA, 24 nt, Human
acgauggaccagcacaaauaaacc

SEQ ID NO: 1184569 - RNA, 25 nt, Human
aggaacagcaaggcagacuucuuac

SEQ ID NO: 1184570 - RNA, 24 nt, Human
aucacagaccaauaucuacuccaa

SEQ ID NO: 1184571 - RNA, 22 nt, Human
caaaaagagcacuucauacuua

SEQ ID NO: 1184572 - RNA, 20 nt, Human
caaacucaugcaaaccagug

SEQ ID NO: 1184573 - RNA, 23 nt, Human
caugcaaaccagugcugccaaga

SEQ ID NO: 1184574 - RNA, 22 nt, Human
ccacaaaaacucuggcguggaa

SEQ ID NO: 1184575 - RNA, 21 nt, Human
cccaggaacagcaaggcagac

SEQ ID NO: 1184576 - RNA, 19 nt, Human
ccgcccacaaaaacucugg

SEQ ID NO: 1184577 - RNA, 19 nt, Human
cgccaacacguguguucuc

SEQ ID NO: 1184578 - RNA, 25 nt, Human
gcacaaauaaacccagcaaaaagag

SEQ ID NO: 1184579 - RNA, 18 nt, Human
uccaaacauccaguaaca

SEQ ID NO: 1184580 - RNA, 23 nt, Human
ucuacuccaaacauccaguaaca

SEQ ID NO: 1184581 - RNA, 21 nt, Human
ucuguggugcacaugcggccg

SEQ ID NO: 1184582 - RNA, 18 nt, Human
acaaggaaaugcuuuguu

SEQ ID NO: 1184583 - RNA, 19 nt, Human
accacugaaaacaaggaaa

SEQ ID NO: 1184584 - RNA, 20 nt, Human
agaauaagaaaaauaccaua

SEQ ID NO: 1184585 - RNA, 19 nt, Human
agacagacauguggaaaca

SEQ ID NO: 1184586 - RNA, 20 nt, Human
caaacaagaauaagaaaaaa

SEQ ID NO: 1184587 - RNA, 22 nt, Human
caagcaaucuaucaggugauag

SEQ ID NO: 1184588 - RNA, 20 nt, Human
cagacauguggaaacaagau

SEQ ID NO: 1184589 - RNA, 23 nt, Human
ccccugaagauuugcacuagccu

SEQ ID NO: 1184590 - RNA, 22 nt, Human
guaguccuggacggccccugaa

SEQ ID NO: 1184591 - RNA, 18 nt, Human
uaacaugaucaaacaaga

SEQ ID NO: 1184592 - RNA, 24 nt, Human
uucaauaacuuccuuuuaacauuu

SEQ ID NO: 1184593 - RNA, 20 nt, Human
uuuauaauuuucuacauuug

SEQ ID NO: 1184594 - RNA, 26 nt, Human
uuuuauuuucuucaauaacuuccuuu

SEQ ID NO: 1184595 - RNA, 19 nt, Human
acagggcagccccaucccc

SEQ ID NO: 1184596 - RNA, 24 nt, Human
aggcccucgcacugcuugcaaucc

SEQ ID NO: 1184597 - RNA, 19 nt, Human
caggaggaggccuggggca

SEQ ID NO: 1184598 - RNA, 18 nt, Human
ccccggaucccgcugcuc

SEQ ID NO: 1184599 - RNA, 23 nt, Human
cccggaucccgcugcuccccagg

SEQ ID NO: 1184600 - RNA, 20 nt, Human
ccgcugcuccccaggcgcag

SEQ ID NO: 1184601 - RNA, 20 nt, Human
cuagagcauuaggcagggug

SEQ ID NO: 1184602 - RNA, 19 nt, Human
cuccccaggcgcaguuggc

SEQ ID NO: 1184603 - RNA, 19 nt, Human
ggacaggaggaggccuggg

SEQ ID NO: 1184604 - RNA, 22 nt, Human
ggacaggaggaggccuggggca

SEQ ID NO: 1184605 - RNA, 21 nt, Human
gggcaggucaggcaggugagc

SEQ ID NO: 1184606 - RNA, 21 nt, Human
gggcugagaccagggccgaga

SEQ ID NO: 1184607 - RNA, 19 nt, Human
uagagcauuaggcagggug

SEQ ID NO: 1184608 - RNA, 21 nt, Human
uagagcauuaggcaggguggg

SEQ ID NO: 1184609 - RNA, 24 nt, Human
uaggcagggugggacaggaggagg

SEQ ID NO: 1184610 - RNA, 18 nt, Human
uccccggaucccgcugcu

SEQ ID NO: 1184611 - RNA, 24 nt, Human
ugagcacacagggcagccccaucc

SEQ ID NO: 1184612 - RNA, 21 nt, Human
ugggacaggaggaggccuggg

SEQ ID NO: 1184613 - RNA, 21 nt, Human
uuaggcagggugggacaggag

SEQ ID NO: 1184614 - RNA, 18 nt, Human
aaacaaaaagaacgcaca

SEQ ID NO: 1184615 - RNA, 22 nt, Human
acaaagccucccuuauacguaa

SEQ ID NO: 1184616 - RNA, 26 nt, Human
accccgaagagauacugaggacaaag

SEQ ID NO: 1184617 - RNA, 19 nt, Human
acuuugaguaauggaaaga

SEQ ID NO: 1184618 - RNA, 20 nt, Human
agaaaccaaggugcagagga

SEQ ID NO: 1184619 - RNA, 18 nt, Human
agaccggaaacccugaug

SEQ ID NO: 1184620 - RNA, 27 nt, Human
agaccggaaacccugaugggcagggga

SEQ ID NO: 1184621 - RNA, 19 nt, Human
agacugaugaacacuggug

SEQ ID NO: 1184622 - RNA, 24 nt, Human
agccaggagauccagguuccaggg

SEQ ID NO: 1184623 - RNA, 24 nt, Human
agccaggagauccagguuccaggg

SEQ ID NO: 1184624 - RNA, 25 nt, Human
aggcuggagugcaguggcgugaucu

SEQ ID NO: 1184625 - RNA, 19 nt, Human
aggcuuuggaggcaggagu

SEQ ID NO: 1184626 - RNA, 20 nt, Human
aguaauggaaagagcccuga

SEQ ID NO: 1184627 - RNA, 25 nt, Human
agugcagggugcgguucuaucucug

SEQ ID NO: 1184628 - RNA, 19 nt, Human
agugcaguggcgugaucuc

SEQ ID NO: 1184629 - RNA, 20 nt, Human
agugcaguggcgugaucucg

SEQ ID NO: 1184630 - RNA, 23 nt, Human
agugcaguggcgugaucucggcu

SEQ ID NO: 1184631 - RNA, 24 nt, Human
agugcaguggcgugaucucggcuc

SEQ ID NO: 1184632 - RNA, 18 nt, Human
caacagaagaccggaaac

SEQ ID NO: 1184633 - RNA, 23 nt, Human
caacagaagaccggaaacccuga

SEQ ID NO: 1184634 - RNA, 24 nt, Human
caaggucucucucuguugcccagg

SEQ ID NO: 1184635 - RNA, 22 nt, Human
cacaccuucuuucccaucccca

SEQ ID NO: 1184636 - RNA, 22 nt, Human
cacuaacaacagaagaccggaa

SEQ ID NO: 1184637 - RNA, 23 nt, Human
cacugcaaccuccgucuccuggg

SEQ ID NO: 1184638 - RNA, 25 nt, Human
cacugccacguagauguucaaacaa

SEQ ID NO: 1184639 - RNA, 22 nt, Human
cagugcugggggggauuuuugg

SEQ ID NO: 1184640 - RNA, 18 nt, Human
cauacagggaugaucauu

SEQ ID NO: 1184641 - RNA, 21 nt, Human
cauccccauccuggccaggga

SEQ ID NO: 1184642 - RNA, 22 nt, Human
ccaggagauccagguuccaggg

SEQ ID NO: 1184643 - RNA, 19 nt, Human
cccauccccauccuggcca

SEQ ID NO: 1184644 - RNA, 24 nt, Human
ccccgaagagauacugaggacaaa

SEQ ID NO: 1184645 - RNA, 26 nt, Human
ccucccuuauacguaacuucucuccu

SEQ ID NO: 1184646 - RNA, 23 nt, Human
ccuccgucuccuggguucuagcg

SEQ ID NO: 1184647 - RNA, 21 nt, Human
ccuuauacguaacuucucucc

SEQ ID NO: 1184648 - RNA, 20 nt, Human
ccuugcugucaggcugcuuu

SEQ ID NO: 1184649 - RNA, 24 nt, Human
cucacugcaaccuccgucuccugg

SEQ ID NO: 1184650 - RNA, 21 nt, Human
cuccuggguucuagcgauucu

SEQ ID NO: 1184651 - RNA, 21 nt, Human
cucuccuaaaaucaacucuaa

SEQ ID NO: 1184652 - RNA, 24 nt, Human
cucucucuguugcccaggcuggag

SEQ ID NO: 1184653 - RNA, 24 nt, Human
cucucuguugcccaggcuggagug

SEQ ID NO: 1184654 - RNA, 23 nt, Human
cucuguugcccaggcuggagugc

SEQ ID NO: 1184655 - RNA, 23 nt, Human
cugcaaccuccgucuccuggguu

SEQ ID NO: 1184656 - RNA, 24 nt, Human
cugcaaccuccgucuccuggguuc

SEQ ID NO: 1184657 - RNA, 22 nt, Human
cuuuucaacaacuguaccccga

SEQ ID NO: 1184658 - RNA, 21 nt, Human
gagacaaggucucucucuguu

SEQ ID NO: 1184659 - RNA, 23 nt, Human
gaguaggagccaggagauccagg

SEQ ID NO: 1184660 - RNA, 23 nt, Human
gaugauaccuugagaaaccaagg

SEQ ID NO: 1184661 - RNA, 24 nt, Human
gcaccagaaaugucaccacuaaca

SEQ ID NO: 1184662 - RNA, 22 nt, Human
gcagaggacagacugaugaaca

SEQ ID NO: 1184663 - RNA, 23 nt, Human
gcagaggacagacugaugaacac

SEQ ID NO: 1184664 - RNA, 24 nt, Human
gcccaggcuggagugcaguggcgu

SEQ ID NO: 1184665 - RNA, 22 nt, Human
gcgauucuugcaugcacagcau

SEQ ID NO: 1184666 - RNA, 19 nt, Human
gcuggagugcaguggcgug

SEQ ID NO: 1184667 - RNA, 20 nt, Human
ggaugaucauucugucauca

SEQ ID NO: 1184668 - RNA, 22 nt, Human
ggcuggagugcaguggcgugau

SEQ ID NO: 1184669 - RNA, 21 nt, Human
ggggaggaaguguacgcagug

SEQ ID NO: 1184670 - RNA, 25 nt, Human
ggggaggaaguguacgcagugcagg

SEQ ID NO: 1184671 - RNA, 19 nt, Human
guagauguucaaacaaaaa

SEQ ID NO: 1184672 - RNA, 22 nt, Human
gugcugggggggauuuuugggg

SEQ ID NO: 1184673 - RNA, 18 nt, Human
uaaaaucaacucuaaccc

SEQ ID NO: 1184674 - RNA, 25 nt, Human
uaaaaucaacucuaacccacugcca

SEQ ID NO: 1184675 - RNA, 23 nt, Human
uaagcaguccucucacccaguga

SEQ ID NO: 1184676 - RNA, 20 nt, Human
ucaaacaaaaagaacgcaca

SEQ ID NO: 1184677 - RNA, 24 nt, Human
ucacugcaaccuccgucuccuggg

SEQ ID NO: 1184678 - RNA, 25 nt, Human
ucacugcaaccuccgucuccugggu

SEQ ID NO: 1184679 - RNA, 19 nt, Human
ucauucaccagugcugggg

SEQ ID NO: 1184680 - RNA, 22 nt, Human
ucccuuauacguaacuucucuc

SEQ ID NO: 1184681 - RNA, 21 nt, Human
uccuggguucuagcgauucuu

SEQ ID NO: 1184682 - RNA, 22 nt, Human
ucuccuggguucuagcgauucu

SEQ ID NO: 1184683 - RNA, 23 nt, Human
ucucucucuguugcccaggcugg

SEQ ID NO: 1184684 - RNA, 24 nt, Human
ucucucucuguugcccaggcugga

SEQ ID NO: 1184685 - RNA, 20 nt, Human
ucucucuguugcccaggcug

SEQ ID NO: 1184686 - RNA, 24 nt, Human
ucucucuguugcccaggcuggagu

SEQ ID NO: 1184687 - RNA, 18 nt, Human
ucucuguugcccaggcug

SEQ ID NO: 1184688 - RNA, 23 nt, Human
ucucuguugcccaggcuggagug

SEQ ID NO: 1184689 - RNA, 24 nt, Human
ucuguugcccaggcuggagugcag

SEQ ID NO: 1184690 - RNA, 23 nt, Human
ugaggacaaagccucccuuauac

SEQ ID NO: 1184691 - RNA, 23 nt, Human
ugaucauucugucaucaggaagg

SEQ ID NO: 1184692 - RNA, 20 nt, Human
ugaugggcaggggagagccu

SEQ ID NO: 1184693 - RNA, 21 nt, Human
ugcacagcauuugaagggcac

SEQ ID NO: 1184694 - RNA, 19 nt, Human
ugcaugcacagcauuugaa

SEQ ID NO: 1184695 - RNA, 18 nt, Human
ugcccaggcuggagugca

SEQ ID NO: 1184696 - RNA, 21 nt, Human
ugcccaggcuggagugcagug

SEQ ID NO: 1184697 - RNA, 22 nt, Human
ugcccaggcuggagugcagugg

SEQ ID NO: 1184698 - RNA, 24 nt, Human
ugcccaggcuggagugcaguggcg

SEQ ID NO: 1184699 - RNA, 22 nt, Human
uggaggcaggagugaaacaagg

SEQ ID NO: 1184700 - RNA, 19 nt, Human
uggagugcaguggcgugau

SEQ ID NO: 1184701 - RNA, 23 nt, Human
uggagugcaguggcgugaucucg

SEQ ID NO: 1184702 - RNA, 24 nt, Human
uggagugcaguggcgugaucucgg

SEQ ID NO: 1184703 - RNA, 20 nt, Human
uggcgugaucucggcucacu

SEQ ID NO: 1184704 - RNA, 19 nt, Human
ugggcucuuaauauucaac

SEQ ID NO: 1184705 - RNA, 19 nt, Human
uuauacguaacuucucucc

SEQ ID NO: 1184706 - RNA, 24 nt, Human
uugcauacagggaugaucauucug

SEQ ID NO: 1184707 - RNA, 24 nt, Human
uugcccaggcuggagugcaguggc

SEQ ID NO: 1184708 - RNA, 21 nt, Human
uuugguuggauggcuuucuuu

SEQ ID NO: 1184709 - RNA, 21 nt, Human
accaggacacaggagcuccuc

SEQ ID NO: 1184710 - RNA, 24 nt, Human
accaggacacaggagcuccucuuc

SEQ ID NO: 1184711 - RNA, 20 nt, Human
agcaacgccacacacaaaca

SEQ ID NO: 1184712 - RNA, 18 nt, Human
agcuuucacuaauccagu

SEQ ID NO: 1184713 - RNA, 23 nt, Human
caacgccacacacaaacauguga

SEQ ID NO: 1184714 - RNA, 22 nt, Human
cagcuccucgggugugaagcuc

SEQ ID NO: 1184715 - RNA, 24 nt, Human
caucccagcaacgccacacacaaa

SEQ ID NO: 1184716 - RNA, 18 nt, Human
ccaggccaucuaucuugc

SEQ ID NO: 1184717 - RNA, 19 nt, Human
cuccaggccaucuaucuug

SEQ ID NO: 1184718 - RNA, 24 nt, Human
cuccugggccagcuccucgggugu

SEQ ID NO: 1184719 - RNA, 21 nt, Human
gcagaaaacuaauaaccaccg

SEQ ID NO: 1184720 - RNA, 18 nt, Human
gccacacacaaacaugug

SEQ ID NO: 1184721 - RNA, 22 nt, Human
ggaauuccggcacgugcuugag

SEQ ID NO: 1184722 - RNA, 18 nt, Human
uaaccaccgguagccuug

SEQ ID NO: 1184723 - RNA, 22 nt, Human
uaguaaguguccaaagcacugc

SEQ ID NO: 1184724 - RNA, 22 nt, Human
uccacguuguaugugaucugga

SEQ ID NO: 1184725 - RNA, 22 nt, Human
ucuuccagauucuuucaguugg

SEQ ID NO: 1184726 - RNA, 22 nt, Human
ugagcagaaaacuaauaaccac

SEQ ID NO: 1184727 - RNA, 27 nt, Human
uggaaagggacucagcuggggccucca

SEQ ID NO: 1184728 - RNA, 20 nt, Human
uggaauuccggcacgugcuu

SEQ ID NO: 1184729 - RNA, 23 nt, Human
uggcgaacggcauccacguugua

SEQ ID NO: 1184730 - RNA, 27 nt, Human
ugugaagcucauggcgcugacauugua

SEQ ID NO: 1184731 - RNA, 18 nt, Human
uuccacccccaguccuuc

SEQ ID NO: 1184732 - RNA, 21 nt, Human
acaaguguuggaugagcugau

SEQ ID NO: 1184733 - RNA, 27 nt, Human
acuugcucuucugugcacugcauguac

SEQ ID NO: 1184734 - RNA, 19 nt, Human
agcccaacggcagcggcgg

SEQ ID NO: 1184735 - RNA, 23 nt, Human
aguagccacuuccgcuaggaguc

SEQ ID NO: 1184736 - RNA, 23 nt, Human
auggacaaguguuggaugagcug

SEQ ID NO: 1184737 - RNA, 19 nt, Human
caaaaucaaaagcauggac

SEQ ID NO: 1184738 - RNA, 23 nt, Human
caagugacuugcucuucugugcc

SEQ ID NO: 1184739 - RNA, 21 nt, Human
caccacuugauccuguccucc

SEQ ID NO: 1184740 - RNA, 21 nt, Human
cacccaugcgcuggguuucac

SEQ ID NO: 1184741 - RNA, 22 nt, Human
cacgggccagccccgcgccggg

SEQ ID NO: 1184742 - RNA, 23 nt, Human
cagacugaaguccaggcucugcu

SEQ ID NO: 1184743 - RNA, 22 nt, Human
cagccccugucuccccgcggcc

SEQ ID NO: 1184744 - RNA, 20 nt, Human
cccagccccugucuccccgc

SEQ ID NO: 1184745 - RNA, 19 nt, Human
cccgccccgccccacgggc

SEQ ID NO: 1184746 - RNA, 20 nt, Human
ccgccagcaagucaagugag

SEQ ID NO: 1184747 - RNA, 23 nt, Human
ccuuucuacccggcugucgaggg

SEQ ID NO: 1184748 - RNA, 18 nt, Human
cgccgcgcccacccagcc

SEQ ID NO: 1184749 - RNA, 18 nt, Human
cgccgcgcccacccagcc

SEQ ID NO: 1184750 - RNA, 20 nt, Human
cggccagggcguggaagcgg

SEQ ID NO: 1184751 - RNA, 18 nt, Human
cggguggacaauguggug

SEQ ID NO: 1184752 - RNA, 21 nt, Human
cguccagccccagccccuguc

SEQ ID NO: 1184753 - RNA, 24 nt, Human
cuacugcccuccgcuugccaacgc

SEQ ID NO: 1184754 - RNA, 22 nt, Human
cuccggccgcgggggagcaugg

SEQ ID NO: 1184755 - RNA, 19 nt, Human
cucguccagccccagcccc

SEQ ID NO: 1184756 - RNA, 23 nt, Human
cugcugcagauuaacgggguggc

SEQ ID NO: 1184757 - RNA, 19 nt, Human
cugugccugacgggccacc

SEQ ID NO: 1184758 - RNA, 24 nt, Human
cugugccugacgggccaccacuug

SEQ ID NO: 1184759 - RNA, 23 nt, Human
cuugggccucguccagccccagc

SEQ ID NO: 1184760 - RNA, 18 nt, Human
gacggggaggcugugcgg

SEQ ID NO: 1184761 - RNA, 22 nt, Human
gauccuguccucccggcaggac

SEQ ID NO: 1184762 - RNA, 23 nt, Human
gauccuguccucccggcaggaca

SEQ ID NO: 1184763 - RNA, 18 nt, Human
gccccgccccacgggcca

SEQ ID NO: 1184764 - RNA, 20 nt, Human
gccccgccccacgggccagc

SEQ ID NO: 1184765 - RNA, 21 nt, Human
ggacccggagcccaacggcag

SEQ ID NO: 1184766 - RNA, 18 nt, Human
ggauuuaaaaggucaaug

SEQ ID NO: 1184767 - RNA, 18 nt, Human
ggcaggacaauacggagg

SEQ ID NO: 1184768 - RNA, 18 nt, Human
ggccggugccggcggcug

SEQ ID NO: 1184769 - RNA, 18 nt, Human
gggccuguggagaggggu

SEQ ID NO: 1184770 - RNA, 23 nt, Human
gugggugucugacggggaggcug

SEQ ID NO: 1184771 - RNA, 22 nt, Human
uaagaaggacaaaaucaaaagc

SEQ ID NO: 1184772 - RNA, 23 nt, Human
uaggccucgccgcgcccacccag

SEQ ID NO: 1184773 - RNA, 23 nt, Human
ucccugcggcgggguaaccgccu

SEQ ID NO: 1184774 - RNA, 22 nt, Human
uccuacuuuugaauaaaaaugu

SEQ ID NO: 1184775 - RNA, 19 nt, Human
ucgagggcacccugugccu

SEQ ID NO: 1184776 - RNA, 20 nt, Human
ucgccgcgcccacccagccu

SEQ ID NO: 1184777 - RNA, 19 nt, Human
ucuguggccgaguccuagg

SEQ ID NO: 1184778 - RNA, 27 nt, Human
ugagguuguggcaauuuacuuugugaa

SEQ ID NO: 1184779 - RNA, 23 nt, Human
ugcacugcauguacuuggguucc

SEQ ID NO: 1184780 - RNA, 18 nt, Human
ugccggcggcuguaggcc

SEQ ID NO: 1184781 - RNA, 20 nt, Human
ugccugacgggccaccacuu

SEQ ID NO: 1184782 - RNA, 23 nt, Human
ugcgggagaggcgcuugggccuc

SEQ ID NO: 1184783 - RNA, 25 nt, Human
uggaagcggauucugaggcggcuuu

SEQ ID NO: 1184784 - RNA, 19 nt, Human
ugggcggugggaaaggaac

SEQ ID NO: 1184785 - RNA, 24 nt, Human
uggggcgggcccagccucaccgcc

SEQ ID NO: 1184786 - RNA, 20 nt, Human
ugugcacugcauguacuuga

SEQ ID NO: 1184787 - RNA, 18 nt, Human
uuaaaaggucaaugaagu

SEQ ID NO: 1184788 - RNA, 24 nt, Human
uugcggagcugauuaagaccccgc

SEQ ID NO: 1184789 - RNA, 18 nt, Human
uuuccucuuucuugcucc

SEQ ID NO: 1184790 - RNA, 21 nt, Human
aaauagaagacacauagagaa

SEQ ID NO: 1184791 - RNA, 23 nt, Human
aacacugugguuuaaauucacau

SEQ ID NO: 1184792 - RNA, 24 nt, Human
aaccaguaugauggcaaaaucaca

SEQ ID NO: 1184793 - RNA, 24 nt, Human
aacuucaaaauauucaaacuaaaa

SEQ ID NO: 1184794 - RNA, 24 nt, Human
aagcacaccagagccaaucaugac

SEQ ID NO: 1184795 - RNA, 25 nt, Human
aauagaagacacauagagaacaaaa

SEQ ID NO: 1184796 - RNA, 19 nt, Human
acaggaauaauuucaaaca

SEQ ID NO: 1184797 - RNA, 18 nt, Human
acccuggcuaauaucugg

SEQ ID NO: 1184798 - RNA, 23 nt, Human
acuguugcuaccaugagggaagu

SEQ ID NO: 1184799 - RNA, 19 nt, Human
agacugggucauuagaaau

SEQ ID NO: 1184800 - RNA, 24 nt, Human
agucagacaucccccagcagcuuc

SEQ ID NO: 1184801 - RNA, 20 nt, Human
caccuaguguccaaagaaua

SEQ ID NO: 1184802 - RNA, 18 nt, Human
cagagccaaucaugacuc

SEQ ID NO: 1184803 - RNA, 24 nt, Human
cagcagacuucaagagcacagaua

SEQ ID NO: 1184804 - RNA, 25 nt, Human
cauccucaaacuucaaaauauucaa

SEQ ID NO: 1184805 - RNA, 24 nt, Human
ccagcagcuuccggaaagucuucu

SEQ ID NO: 1184806 - RNA, 21 nt, Human
cccaaaagucuagcugcaauu

SEQ ID NO: 1184807 - RNA, 27 nt, Human
cccaaacagcaauaacaagaggaguuc

SEQ ID NO: 1184808 - RNA, 21 nt, Human
ccucugcacgccgcucggcuc

SEQ ID NO: 1184809 - RNA, 18 nt, Human
ccucuugcugcuggugug

SEQ ID NO: 1184810 - RNA, 24 nt, Human
ccucuugcugcuggugugagaacc

SEQ ID NO: 1184811 - RNA, 22 nt, Human
ccugcgaggcacaguccccaaa

SEQ ID NO: 1184812 - RNA, 21 nt, Human
cgaggcacaguccccaaaagu

SEQ ID NO: 1184813 - RNA, 21 nt, Human
cuccagcaccgcgcgcucucc

SEQ ID NO: 1184814 - RNA, 21 nt, Human
cuuaguucuuuuucacaaagu

SEQ ID NO: 1184815 - RNA, 22 nt, Human
cuucauuuuaaaaaagagccug

SEQ ID NO: 1184816 - RNA, 21 nt, Human
cuuguagccucugcacgccgc

SEQ ID NO: 1184817 - RNA, 21 nt, Human
gacacauagagaacaaaaaca

SEQ ID NO: 1184818 - RNA, 25 nt, Human
gagaacaaaaacacuuacuggcugu

SEQ ID NO: 1184819 - RNA, 20 nt, Human
gcacgccgcucggcuccgcc

SEQ ID NO: 1184820 - RNA, 23 nt, Human
gcagacuucaagagcacagauaa

SEQ ID NO: 1184821 - RNA, 18 nt, Human
gcucguugcuuggccuac

SEQ ID NO: 1184822 - RNA, 18 nt, Human
ggaaagcccaacauccuc

SEQ ID NO: 1184823 - RNA, 22 nt, Human
ggagaaagucccccaaucacca

SEQ ID NO: 1184824 - RNA, 28 nt, Human
ggauagguguggcugguugacgaccucg

SEQ ID NO: 1184825 - RNA, 22 nt, Human
uaaaaaagagccugugacccug

SEQ ID NO: 1184826 - RNA, 23 nt, Human
uaaaaaagagccugugacccugg

SEQ ID NO: 1184827 - RNA, 22 nt, Human
uaaaaugucucaugccuugccu

SEQ ID NO: 1184828 - RNA, 18 nt, Human
uaaggaaagcccaacauc

SEQ ID NO: 1184829 - RNA, 27 nt, Human
uacaauaaggaaagcccaacauccuca

SEQ ID NO: 1184830 - RNA, 24 nt, Human
uacggcacuuguagccucugcacg

SEQ ID NO: 1184831 - RNA, 22 nt, Human
uagaaguucuuggccauuacag

SEQ ID NO: 1184832 - RNA, 19 nt, Human
uaugauggcaaaaucacaa

SEQ ID NO: 1184833 - RNA, 21 nt, Human
ucauuagaaauauuuuucuau

SEQ ID NO: 1184834 - RNA, 23 nt, Human
ucggccacccggugcggcuccag

SEQ ID NO: 1184835 - RNA, 20 nt, Human
ucucccggcacgguucccgg

SEQ ID NO: 1184836 - RNA, 20 nt, Human
ugagaaccagcagacuucaa

SEQ ID NO: 1184837 - RNA, 22 nt, Human
ugcuuaguucuuuuucacaaag

SEQ ID NO: 1184838 - RNA, 18 nt, Human
uggccuacagcaagugau

SEQ ID NO: 1184839 - RNA, 24 nt, Human
ugugagaaccagcagacuucaaga

SEQ ID NO: 1184840 - RNA, 18 nt, Human
uguguaaaagaaauaauu

SEQ ID NO: 1184841 - RNA, 19 nt, Human
uguguaaaagaaauaauuu

SEQ ID NO: 1184842 - RNA, 21 nt, Human
uuagccuucagcucuucagaa

SEQ ID NO: 1184843 - RNA, 22 nt, Human
uuaguguuuagccaaauuacaa

SEQ ID NO: 1184844 - RNA, 26 nt, Human
uucaaaauauucaaacuaaaaauucc

SEQ ID NO: 1184845 - RNA, 19 nt, Human
uucaagagcacagauaacc

SEQ ID NO: 1184846 - RNA, 21 nt, Human
uucacauuggucuuacaauga

SEQ ID NO: 1184847 - RNA, 22 nt, Human
uugccaggcaaauaaauugcac

SEQ ID NO: 1184848 - RNA, 23 nt, Human
aacauccuggcccaaacuaccaa

SEQ ID NO: 1184849 - RNA, 18 nt, Human
aagacuggcucaggaacc

SEQ ID NO: 1184850 - RNA, 19 nt, Human
accaucaacauccuggccc

SEQ ID NO: 1184851 - RNA, 18 nt, Human
aguccucaaaucugugaa

SEQ ID NO: 1184852 - RNA, 20 nt, Human
ccagaggagcugaaugagcu

SEQ ID NO: 1184853 - RNA, 23 nt, Human
cugaagccucuacauccaaucca

SEQ ID NO: 1184854 - RNA, 21 nt, Human
cuuugcccagguuaagacugg

SEQ ID NO: 1184855 - RNA, 24 nt, Human
gaaugagcuggaagucuguaccuc

SEQ ID NO: 1184856 - RNA, 18 nt, Human
gaccccuccgggaaugga

SEQ ID NO: 1184857 - RNA, 18 nt, Human
gagcugaccccuccggga

SEQ ID NO: 1184858 - RNA, 28 nt, Human
gagcugaccccuccgggaauggaucuca

SEQ ID NO: 1184859 - RNA, 20 nt, Human
gcagauggccaucacaaugc

SEQ ID NO: 1184860 - RNA, 21 nt, Human
gcugaccccuccgggaaugga

SEQ ID NO: 1184861 - RNA, 18 nt, Human
ggaacccgucaggagcug

SEQ ID NO: 1184862 - RNA, 19 nt, Human
gucugcuuuucccucucca

SEQ ID NO: 1184863 - RNA, 23 nt, Human
gucugcuuuucccucuccaguuu

SEQ ID NO: 1184864 - RNA, 21 nt, Human
uaaaggcaucucucucugaag

SEQ ID NO: 1184865 - RNA, 24 nt, Human
uaaaggcaucucucucugaagccu

SEQ ID NO: 1184866 - RNA, 23 nt, Human
uaagacuggcucaggaacccguc

SEQ ID NO: 1184867 - RNA, 18 nt, Human
uacaacuaaaggcaucuc

SEQ ID NO: 1184868 - RNA, 23 nt, Human
uacacaacaaagacaucuaucca

SEQ ID NO: 1184869 - RNA, 22 nt, Human
uacuuugcuucuguaccaucaa

SEQ ID NO: 1184870 - RNA, 19 nt, Human
uagaguucuucaaagucuc

SEQ ID NO: 1184871 - RNA, 23 nt, Human
ucaaacaucuacuauuuauuaau

SEQ ID NO: 1184872 - RNA, 23 nt, Human
ucaaagucucagucucaucagaa

SEQ ID NO: 1184873 - RNA, 21 nt, Human
ucagaaagguuugcaagagca

SEQ ID NO: 1184874 - RNA, 18 nt, Human
uccaaaagcucagauugu

SEQ ID NO: 1184875 - RNA, 19 nt, Human
uccagaggagcugaaugag

SEQ ID NO: 1184876 - RNA, 21 nt, Human
ucccucuccaguuugcuccca

SEQ ID NO: 1184877 - RNA, 19 nt, Human
uccucaucuccuuugccca

SEQ ID NO: 1184878 - RNA, 20 nt, Human
uccuuguuccaagcuuggag

SEQ ID NO: 1184879 - RNA, 24 nt, Human
ucggguacaguacaacuaaaggca

SEQ ID NO: 1184880 - RNA, 19 nt, Human
ucucaaugccaucagcucu

SEQ ID NO: 1184881 - RNA, 18 nt, Human
ucucucucugaagccucu

SEQ ID NO: 1184882 - RNA, 22 nt, Human
ucucuuggaauuuuguaaaagu

SEQ ID NO: 1184883 - RNA, 23 nt, Human
ucucuuggaauuuuguaaaaguu

SEQ ID NO: 1184884 - RNA, 18 nt, Human
ucugaagccucuacaucc

SEQ ID NO: 1184885 - RNA, 24 nt, Human
ugaagccucuacauccaauccaag

SEQ ID NO: 1184886 - RNA, 27 nt, Human
ugcccagguuaagacuggcucaggaac

SEQ ID NO: 1184887 - RNA, 19 nt, Human
uggcucaggaacccgucag

SEQ ID NO: 1184888 - RNA, 23 nt, Human
ugggcagauggccaucacaaugc

SEQ ID NO: 1184889 - RNA, 28 nt, Human
uuaaaguagauucuguucaaaaguucau

SEQ ID NO: 1184890 - RNA, 19 nt, Human
uucaaaguuagagucuuug

SEQ ID NO: 1184891 - RNA, 23 nt, Human
aucaauugucuuuuccaguuuug

SEQ ID NO: 1184892 - RNA, 21 nt, Human
cagcacgggucucagccucuu

SEQ ID NO: 1184893 - RNA, 22 nt, Human
ucacuuugucagacagaaguug

SEQ ID NO: 1184894 - RNA, 22 nt, Human
ucagaauacuuuucagaugcag

SEQ ID NO: 1184895 - RNA, 24 nt, Human
ucagcacgggucucagccucuuuc

SEQ ID NO: 1184896 - RNA, 22 nt, Human
uuuccaguuuugcaaccguucu

SEQ ID NO: 1184897 - RNA, 20 nt, Human
aucugugagggcgcccccuu

SEQ ID NO: 1184898 - RNA, 23 nt, Human
ccggugggcagugagucugcagg

SEQ ID NO: 1184899 - RNA, 18 nt, Human
ccuugaaauuucuuuuuc

SEQ ID NO: 1184900 - RNA, 26 nt, Human
cuugaaauuucuuuuucauugcaucc

SEQ ID NO: 1184901 - RNA, 19 nt, Human
gcagugagucugcagggca

SEQ ID NO: 1184902 - RNA, 20 nt, Human
gggaugcgggggagggagcc

SEQ ID NO: 1184903 - RNA, 18 nt, Human
ucgccucugggguugcag

SEQ ID NO: 1184904 - RNA, 18 nt, Human
ugggcagugagucugcag

SEQ ID NO: 1184905 - RNA, 20 nt, Human
aaacuaacaacaauucacag

SEQ ID NO: 1184906 - RNA, 19 nt, Human
aaagaagaaagcaucaaga

SEQ ID NO: 1184907 - RNA, 22 nt, Human
aaagacauuaaaaggccccaaa

SEQ ID NO: 1184908 - RNA, 22 nt, Human
aaagagaaagaagaaagcauca

SEQ ID NO: 1184909 - RNA, 19 nt, Human
aacaaggugaaaccccguc

SEQ ID NO: 1184910 - RNA, 20 nt, Human
aacaaggugaaaccccgucu

SEQ ID NO: 1184911 - RNA, 21 nt, Human
aacaaggugaaaccccgucuc

SEQ ID NO: 1184912 - RNA, 23 nt, Human
aacuguacacuuuuugcagccuu

SEQ ID NO: 1184913 - RNA, 19 nt, Human
aagaagauaauaaacugaa

SEQ ID NO: 1184914 - RNA, 19 nt, Human
aagacauuaaaaggcccca

SEQ ID NO: 1184915 - RNA, 24 nt, Human
aagagaaagaagaaagcaucaaga

SEQ ID NO: 1184916 - RNA, 21 nt, Human
aagcaccaagcugacucaaaa

SEQ ID NO: 1184917 - RNA, 18 nt, Human
aauacaaaaauuagcugg

SEQ ID NO: 1184918 - RNA, 24 nt, Human
aauagcuugaaccugggaggcgga

SEQ ID NO: 1184919 - RNA, 19 nt, Human
acacagcaagacuccgucu

SEQ ID NO: 1184920 - RNA, 20 nt, Human
acacagcaagacuccgucuc

SEQ ID NO: 1184921 - RNA, 24 nt, Human
acacagcaagacuccgucucaaaa

SEQ ID NO: 1184922 - RNA, 21 nt, Human
acauauaaacacauacauaua

SEQ ID NO: 1184923 - RNA, 24 nt, Human
accccgucucuacuaaaaauacaa

SEQ ID NO: 1184924 - RNA, 24 nt, Human
acuaaaaugcaagguggauuacua

SEQ ID NO: 1184925 - RNA, 18 nt, Human
agcaggaaguuaugaaga

SEQ ID NO: 1184926 - RNA, 20 nt, Human
agcauucugaauuacacaga

SEQ ID NO: 1184927 - RNA, 21 nt, Human
agccuggugacacagcaagac

SEQ ID NO: 1184928 - RNA, 23 nt, Human
agccuggugacacagcaagacuc

SEQ ID NO: 1184929 - RNA, 23 nt, Human
agcuggaugugguggcaugugcc

SEQ ID NO: 1184930 - RNA, 22 nt, Human
aggcaggagaauagcuugaacc

SEQ ID NO: 1184931 - RNA, 24 nt, Human
aggcaggagaauagcuugaaccug

SEQ ID NO: 1184932 - RNA, 19 nt, Human
aggccaaugcgggcagauc

SEQ ID NO: 1184933 - RNA, 19 nt, Human
aggcggagguugcagugag

SEQ ID NO: 1184934 - RNA, 24 nt, Human
aggcggagguugcagugaggcgag

SEQ ID NO: 1184935 - RNA, 24 nt, Human
aggcugaggcaggagaauagcuug

SEQ ID NO: 1184936 - RNA, 24 nt, Human
agucccuuauuuccauuaaaaaau

SEQ ID NO: 1184937 - RNA, 23 nt, Human
aguggcucaugccuguaauccca

SEQ ID NO: 1184938 - RNA, 24 nt, Human
aguggcucaugccuguaaucccag

SEQ ID NO: 1184939 - RNA, 23 nt, Human
auauacauauacauauauuauau

SEQ ID NO: 1184940 - RNA, 24 nt, Human
auauacauauacauauauuauaug

SEQ ID NO: 1184941 - RNA, 25 nt, Human
aucacgagaucaagagaucgagauc

SEQ ID NO: 1184942 - RNA, 19 nt, Human
augccuguaaucccagcac

SEQ ID NO: 1184943 - RNA, 24 nt, Human
augcgggcagaucacgagaucaag

SEQ ID NO: 1184944 - RNA, 24 nt, Human
caacaaggugaaaccccgucucua

SEQ ID NO: 1184945 - RNA, 18 nt, Human
caagaagauaauaaacug

SEQ ID NO: 1184946 - RNA, 20 nt, Human
caagauaagccuagaaauua

SEQ ID NO: 1184947 - RNA, 20 nt, Human
caccaagcugacucaaaagg

SEQ ID NO: 1184948 - RNA, 18 nt, Human
cagaaccuguaaacagca

SEQ ID NO: 1184949 - RNA, 21 nt, Human
cagaaccuguaaacagcaaag

SEQ ID NO: 1184950 - RNA, 19 nt, Human
cagaucacgagaucaagag

SEQ ID NO: 1184951 - RNA, 23 nt, Human
cagaucacgagaucaagagaucg

SEQ ID NO: 1184952 - RNA, 24 nt, Human
caguuacuugggaggcugaggcag

SEQ ID NO: 1184953 - RNA, 20 nt, Human
caugaaaacugcaaaacaag

SEQ ID NO: 1184954 - RNA, 24 nt, Human
caugaaaacugcaaaacaagauaa

SEQ ID NO: 1184955 - RNA, 20 nt, Human
caugccuguaaucccagcac

SEQ ID NO: 1184956 - RNA, 23 nt, Human
caugccuguaaucccagcacuuc

SEQ ID NO: 1184957 - RNA, 25 nt, Human
cauuugaauuauaaauaacuaaggc

SEQ ID NO: 1184958 - RNA, 21 nt, Human
ccugcagucccaguuacuugg

SEQ ID NO: 1184959 - RNA, 23 nt, Human
ccuggccaacaaggugaaacccc

SEQ ID NO: 1184960 - RNA, 24 nt, Human
ccuggccaacaaggugaaaccccg

SEQ ID NO: 1184961 - RNA, 19 nt, Human
ccugggaggcggagguugc

SEQ ID NO: 1184962 - RNA, 22 nt, Human
ccuggugacacagcaagacucc

SEQ ID NO: 1184963 - RNA, 21 nt, Human
ccuguaaacagcaaaguucau

SEQ ID NO: 1184964 - RNA, 24 nt, Human
cgagaucauccuggccaacaaggu

SEQ ID NO: 1184965 - RNA, 24 nt, Human
cgagaucgugccacugcuccagcc

SEQ ID NO: 1184966 - RNA, 22 nt, Human
cgggcagaucacgagaucaaga

SEQ ID NO: 1184967 - RNA, 18 nt, Human
cgugccacugcuccagcc

SEQ ID NO: 1184968 - RNA, 23 nt, Human
cuaaaguaggucaccaagaagau

SEQ ID NO: 1184969 - RNA, 24 nt, Human
cucaugccuguaaucccagcacuu

SEQ ID NO: 1184970 - RNA, 22 nt, Human
cuccaauguacuaagguuucau

SEQ ID NO: 1184971 - RNA, 19 nt, Human
cuccagccuggugacacag

SEQ ID NO: 1184972 - RNA, 21 nt, Human
cugcuggaucaagucuguugc

SEQ ID NO: 1184973 - RNA, 22 nt, Human
cuguacuugaacuacaauaaga

SEQ ID NO: 1184974 - RNA, 18 nt, Human
cuugaaccugggaggcgg

SEQ ID NO: 1184975 - RNA, 24 nt, Human
gacacagcaagacuccgucucaaa

SEQ ID NO: 1184976 - RNA, 18 nt, Human
gacacugcuggaucaagu

SEQ ID NO: 1184977 - RNA, 24 nt, Human
gccaacaaggugaaaccccgucuc

SEQ ID NO: 1184978 - RNA, 20 nt, Human
gcgggcagaucacgagauca

SEQ ID NO: 1184979 - RNA, 22 nt, Human
ggaauucgacacugcuggauca

SEQ ID NO: 1184980 - RNA, 20 nt, Human
ggagguugcagugaggcgag

SEQ ID NO: 1184981 - RNA, 24 nt, Human
ggagguugcagugaggcgagaucg

SEQ ID NO: 1184982 - RNA, 18 nt, Human
ggcagaucacgagaucaa

SEQ ID NO: 1184983 - RNA, 24 nt, Human
ggccaaugcgggcagaucacgaga

SEQ ID NO: 1184984 - RNA, 23 nt, Human
ggccgggcgcaguggcucaugcc

SEQ ID NO: 1184985 - RNA, 24 nt, Human
gggcgcaguggcucaugccuguaa

SEQ ID NO: 1184986 - RNA, 21 nt, Human
guaaacagcaaaguucaugac

SEQ ID NO: 1184987 - RNA, 19 nt, Human
guacuaagguuucauccag

SEQ ID NO: 1184988 - RNA, 21 nt, Human
uaaaaggccccaaaucacuga

SEQ ID NO: 1184989 - RNA, 26 nt, Human
uaaacugaagucacaccaaucaacgg

SEQ ID NO: 1184990 - RNA, 21 nt, Human
uaaauguuuucauuagcuaag

SEQ ID NO: 1184991 - RNA, 23 nt, Human
uaagaauauaccuagcaauaucc

SEQ ID NO: 1184992 - RNA, 23 nt, Human
uacagaacacauacuaaaguagg

SEQ ID NO: 1184993 - RNA, 22 nt, Human
uacauauaaacacauacauaua

SEQ ID NO: 1184994 - RNA, 18 nt, Human
uacuaagguuucauccag

SEQ ID NO: 1184995 - RNA, 19 nt, Human
uagauccauuuaguuaugu

SEQ ID NO: 1184996 - RNA, 22 nt, Human
uagcuggaugugguggcaugug

SEQ ID NO: 1184997 - RNA, 24 nt, Human
uagcuugaaccugggaggcggagg

SEQ ID NO: 1184998 - RNA, 18 nt, Human
uauacauauacauauauu

SEQ ID NO: 1184999 - RNA, 32 nt, Human
uauaugcauacauauaaacacauacauauagu

SEQ ID NO: 1185000 - RNA, 19 nt, Human
ucaagauuuccuaacaaaa

SEQ ID NO: 1185001 - RNA, 22 nt, Human
ucaugccuguaaucccagcacu

SEQ ID NO: 1185002 - RNA, 19 nt, Human
ucucaaaaauaaauaaaua

SEQ ID NO: 1185003 - RNA, 21 nt, Human
ucucuacuaaaaauacaaaaa

SEQ ID NO: 1185004 - RNA, 21 nt, Human
ugaaaacauuuuuguacuuga

SEQ ID NO: 1185005 - RNA, 24 nt, Human
ugaaccugggaggcggagguugca

SEQ ID NO: 1185006 - RNA, 28 nt, Human
ugaauuacacagaaccuguaaacagcaa

SEQ ID NO: 1185007 - RNA, 19 nt, Human
ugacaaagaaugaaauucu

SEQ ID NO: 1185008 - RNA, 24 nt, Human
ugacaaagaaugaaauucugaaaa

SEQ ID NO: 1185009 - RNA, 24 nt, Human
ugaggcaggagaauagcuugaacc

SEQ ID NO: 1185010 - RNA, 25 nt, Human
ugaggcaggagaauagcuugaaccu

SEQ ID NO: 1185011 - RNA, 22 nt, Human
ugaggcgagaucgugccacugc

SEQ ID NO: 1185012 - RNA, 19 nt, Human
ugcaaagacuaaaaugcaa

SEQ ID NO: 1185013 - RNA, 24 nt, Human
ugccugcagucccaguuacuuggg

SEQ ID NO: 1185014 - RNA, 18 nt, Human
ugccuguaaucccagcac

SEQ ID NO: 1185015 - RNA, 22 nt, Human
ugccuguaaucccagcacuuca

SEQ ID NO: 1185016 - RNA, 24 nt, Human
ugccuguaaucccagcacuucagg

SEQ ID NO: 1185017 - RNA, 21 nt, Human
ugcuccagccuggugacacag

SEQ ID NO: 1185018 - RNA, 22 nt, Human
ugcuccagccuggugacacagc

SEQ ID NO: 1185019 - RNA, 18 nt, Human
uggaugugguggcaugug

SEQ ID NO: 1185020 - RNA, 24 nt, Human
uggcaugugccugcagucccaguu

SEQ ID NO: 1185021 - RNA, 22 nt, Human
uggcucaugccuguaaucccag

SEQ ID NO: 1185022 - RNA, 24 nt, Human
uggcucaugccuguaaucccagca

SEQ ID NO: 1185023 - RNA, 28 nt, Human
ugggaaaauauaguuugaccaaaucuua

SEQ ID NO: 1185024 - RNA, 20 nt, Human
ugggaggcggagguugcagu

SEQ ID NO: 1185025 - RNA, 29 nt, Human
ugggaggcggagguugcagugacaacggu

SEQ ID NO: 1185026 - RNA, 18 nt, Human
ugggaggcugaggcagga

SEQ ID NO: 1185027 - RNA, 19 nt, Human
ugggaggcugaggcaggag

SEQ ID NO: 1185028 - RNA, 24 nt, Human
ugguggcaugugccugcaguccca

SEQ ID NO: 1185029 - RNA, 23 nt, Human
uguacuaagguuucauccagcuc

SEQ ID NO: 1185030 - RNA, 19 nt, Human
uuagcuggaugugguggca

SEQ ID NO: 1185031 - RNA, 24 nt, Human
uuagcuggaugugguggcaugugc

SEQ ID NO: 1185032 - RNA, 23 nt, Human
uuauaugcauacauauaaacaca

SEQ ID NO: 1185033 - RNA, 23 nt, Human
uucaggaggccaaugcgggcaga

SEQ ID NO: 1185034 - RNA, 19 nt, Human
uucauaauacaagauaaua

SEQ ID NO: 1185035 - RNA, 24 nt, Human
uugaaccugggaggcggagguugc

SEQ ID NO: 1185036 - RNA, 22 nt, Human
uugcagugaggcgagaucgugc

SEQ ID NO: 1185037 - RNA, 19 nt, Human
uugcuugauuacaaaaauu

SEQ ID NO: 1185038 - RNA, 24 nt, Human
uugggccgggcgcaguggcucaug

SEQ ID NO: 1185039 - RNA, 18 nt, Human
aaacagaagcaaaacuga

SEQ ID NO: 1185040 - RNA, 23 nt, Human
aaacagaagcaaaacugaggcca

SEQ ID NO: 1185041 - RNA, 20 nt, Human
aaaugccuugcaucauccuc

SEQ ID NO: 1185042 - RNA, 23 nt, Human
aagcaucucucaagucuuugucc

SEQ ID NO: 1185043 - RNA, 19 nt, Human
acuaccaggcugccccgga

SEQ ID NO: 1185044 - RNA, 20 nt, Human
acugcagggguucaggagug

SEQ ID NO: 1185045 - RNA, 19 nt, Human
agggguucaggaguggagg

SEQ ID NO: 1185046 - RNA, 23 nt, Human
aucauccuccaguccccucacug

SEQ ID NO: 1185047 - RNA, 24 nt, Human
caaaacagaagcaaaacugaggcc

SEQ ID NO: 1185048 - RNA, 21 nt, Human
cagaagcaaaacugaggccau

SEQ ID NO: 1185049 - RNA, 20 nt, Human
cauccuccaguccccucacu

SEQ ID NO: 1185050 - RNA, 25 nt, Human
ccaaaacagaagcaaaacugaggcc

SEQ ID NO: 1185051 - RNA, 27 nt, Human
ccaaaacagaagcaaaacugaggccau

SEQ ID NO: 1185052 - RNA, 21 nt, Human
ccagugugcaggagcauuggg

SEQ ID NO: 1185053 - RNA, 22 nt, Human
ccgauggcuggugacagucacu

SEQ ID NO: 1185054 - RNA, 21 nt, Human
ccuugcaucauccuccagucc

SEQ ID NO: 1185055 - RNA, 24 nt, Human
cuauucuggcagguucgggcucag

SEQ ID NO: 1185056 - RNA, 24 nt, Human
cugaaacuguggcccauucaacag

SEQ ID NO: 1185057 - RNA, 22 nt, Human
gaaaaaaaaagcaucucucaag

SEQ ID NO: 1185058 - RNA, 20 nt, Human
gauggucugcugaaacugug

SEQ ID NO: 1185059 - RNA, 18 nt, Human
ggaacagacaaauagagg

SEQ ID NO: 1185060 - RNA, 19 nt, Human
ggcuggugacagucacugc

SEQ ID NO: 1185061 - RNA, 20 nt, Human
ggugguguucauccaaaaca

SEQ ID NO: 1185062 - RNA, 21 nt, Human
gucaagcagaacacacguguc

SEQ ID NO: 1185063 - RNA, 21 nt, Human
gugcaugugcuuccugggugg

SEQ ID NO: 1185064 - RNA, 23 nt, Human
gugguguucauccaaaacagaag

SEQ ID NO: 1185065 - RNA, 28 nt, Human
uagagggucuucuuucacauucaggccc

SEQ ID NO: 1185066 - RNA, 25 nt, Human
uaugaaaggagggagaaucuuuuuu

SEQ ID NO: 1185067 - RNA, 27 nt, Human
ucacugcagggguucaggaguggagga

SEQ ID NO: 1185068 - RNA, 20 nt, Human
ucagauuucucuagaaagcu

SEQ ID NO: 1185069 - RNA, 26 nt, Human
uccaaaacagaagcaaaacugaggcc

SEQ ID NO: 1185070 - RNA, 23 nt, Human
ucugcagguguccucgcugcuga

SEQ ID NO: 1185071 - RNA, 24 nt, Human
ugaaugagagcucgggcuccacaa

SEQ ID NO: 1185072 - RNA, 28 nt, Human
ugccuugcaucauccuccaguccccuca

SEQ ID NO: 1185073 - RNA, 29 nt, Human
uggcugauaccacugaaggccagugugcc

SEQ ID NO: 1185074 - RNA, 25 nt, Human
uuuuuucaauuuacuacaauaaaua

SEQ ID NO: 1185075 - RNA, 22 nt, Human
agcgcggcugugagucugaagc

SEQ ID NO: 1185076 - RNA, 18 nt, Human
cuuucccucuuucuuucu

SEQ ID NO: 1185077 - RNA, 21 nt, Human
cuuucuuucuucuucuaaggu

SEQ ID NO: 1185078 - RNA, 24 nt, Human
cuuucuuucuucuucuaagguaga

SEQ ID NO: 1185079 - RNA, 21 nt, Human
ggggaaguuggucagcauggg

SEQ ID NO: 1185080 - RNA, 23 nt, Human
ugaaaacagcugucugaacaagu

SEQ ID NO: 1185081 - RNA, 19 nt, Human
ugaaauggggaaguugguc

SEQ ID NO: 1185082 - RNA, 18 nt, Human
agacugaaagagcaggug

SEQ ID NO: 1185083 - RNA, 22 nt, Human
agauccuugugaagacauacaa

SEQ ID NO: 1185084 - RNA, 22 nt, Human
auacaaguuguuuucguugcca

SEQ ID NO: 1185085 - RNA, 19 nt, Human
auccuugugaagacauaca

SEQ ID NO: 1185086 - RNA, 21 nt, Human
aucuguaaagcccauuuccuc

SEQ ID NO: 1185087 - RNA, 22 nt, Human
cggcggcgggaaggccggaggg

SEQ ID NO: 1185088 - RNA, 23 nt, Human
cuuguuuucugggcccacaucug

SEQ ID NO: 1185089 - RNA, 19 nt, Human
ucagagaguggcucucugu

SEQ ID NO: 1185090 - RNA, 18 nt, Human
uccaguuugcagcgccug

SEQ ID NO: 1185091 - RNA, 18 nt, Human
ugaaagagcaggugccgc

SEQ ID NO: 1185092 - RNA, 24 nt, Human
ugaagcggcuguaucagcccggcc

SEQ ID NO: 1185093 - RNA, 18 nt, Human
uggucccggcuacggcgg

SEQ ID NO: 1185094 - RNA, 21 nt, Human
uuuucugggcccacaucugua

SEQ ID NO: 1185095 - RNA, 20 nt, Human
aaagccagugaggaugggca

SEQ ID NO: 1185096 - RNA, 21 nt, Human
acccagccggaggggcugucc

SEQ ID NO: 1185097 - RNA, 20 nt, Human
acccuguuggccagcguccc

SEQ ID NO: 1185098 - RNA, 19 nt, Human
agaaaggaggccaggggga

SEQ ID NO: 1185099 - RNA, 25 nt, Human
agccaggaucccgggccuggacggc

SEQ ID NO: 1185100 - RNA, 22 nt, Human
aggagcguggggaaggggaggg

SEQ ID NO: 1185101 - RNA, 22 nt, Human
agggggauuuccgcagcucagg

SEQ ID NO: 1185102 - RNA, 20 nt, Human
aggggugccguucugggguc

SEQ ID NO: 1185103 - RNA, 24 nt, Human
auaucagcaccaaaugaugcccag

SEQ ID NO: 1185104 - RNA, 22 nt, Human
aucacccgggugaaaaauacca

SEQ ID NO: 1185105 - RNA, 30 nt, Human
caaagaaagacucagucccugcgcccccag

SEQ ID NO: 1185106 - RNA, 21 nt, Human
caacagcuggaucacaguggc

SEQ ID NO: 1185107 - RNA, 24 nt, Human
cacccccuaccugccagcagcuca

SEQ ID NO: 1185108 - RNA, 19 nt, Human
cacccgccucccccagccc

SEQ ID NO: 1185109 - RNA, 21 nt, Human
cacccgggugaaaaauaccac

SEQ ID NO: 1185110 - RNA, 19 nt, Human
caccguccccgccuccccu

SEQ ID NO: 1185111 - RNA, 26 nt, Human
cacgcgccccucauccaaagaaagac

SEQ ID NO: 1185112 - RNA, 19 nt, Human
cagcccacccccuaccugc

SEQ ID NO: 1185113 - RNA, 21 nt, Human
cagcccucacccgccuccccc

SEQ ID NO: 1185114 - RNA, 22 nt, Human
cagcccucacccgccuccccca

SEQ ID NO: 1185115 - RNA, 21 nt, Human
cagcccuuccuuuccucccca

SEQ ID NO: 1185116 - RNA, 19 nt, Human
caggaucccgggccuggac

SEQ ID NO: 1185117 - RNA, 23 nt, Human
caggccgcaaggcgaucugagga

SEQ ID NO: 1185118 - RNA, 24 nt, Human
caggccgugguucagccccuuccu

SEQ ID NO: 1185119 - RNA, 21 nt, Human
cauccuccacccagccggagg

SEQ ID NO: 1185120 - RNA, 22 nt, Human
cauccugcagugucaggggcau

SEQ ID NO: 1185121 - RNA, 18 nt, Human
ccacccagccggaggggc

SEQ ID NO: 1185122 - RNA, 21 nt, Human
ccacccagccggaggggcugu

SEQ ID NO: 1185123 - RNA, 20 nt, Human
cccacuccccccgccccaac

SEQ ID NO: 1185124 - RNA, 24 nt, Human
cccagcccacccccuaccugccag

SEQ ID NO: 1185125 - RNA, 20 nt, Human
cccagcccuuccuuuccucc

SEQ ID NO: 1185126 - RNA, 21 nt, Human
ccccccgcaggcugcagccag

SEQ ID NO: 1185127 - RNA, 27 nt, Human
ccccccgccccaacagccggguccuuc

SEQ ID NO: 1185128 - RNA, 19 nt, Human
cccccgcaggcugcagcca

SEQ ID NO: 1185129 - RNA, 22 nt, Human
cccccgccccaacagcuggauc

SEQ ID NO: 1185130 - RNA, 18 nt, Human
ccccgccccaacagcugg

SEQ ID NO: 1185131 - RNA, 19 nt, Human
ccccgccuccccucucccu

SEQ ID NO: 1185132 - RNA, 18 nt, Human
ccccuuucccuccuuuuc

SEQ ID NO: 1185133 - RNA, 19 nt, Human
cccucacccgccuccccca

SEQ ID NO: 1185134 - RNA, 19 nt, Human
ccgggccuggacggcgggc

SEQ ID NO: 1185135 - RNA, 20 nt, Human
ccucacccgccucccccagc

SEQ ID NO: 1185136 - RNA, 24 nt, Human
ccuccccucucccugcacccuccc

SEQ ID NO: 1185137 - RNA, 24 nt, Human
ccucccugggaaguccugcccacu

SEQ ID NO: 1185138 - RNA, 21 nt, Human
ccuccuuuuccuccuccucca

SEQ ID NO: 1185139 - RNA, 20 nt, Human
ccugcacccuccccuuuucc

SEQ ID NO: 1185140 - RNA, 19 nt, Human
ccugcccacuccccccgcc

SEQ ID NO: 1185141 - RNA, 21 nt, Human
cgccucccccagcccaccccc

SEQ ID NO: 1185142 - RNA, 25 nt, Human
cgccuccccucucccugcacccucc

SEQ ID NO: 1185143 - RNA, 24 nt, Human
cggaggggcuguccuucucccuuc

SEQ ID NO: 1185144 - RNA, 21 nt, Human
cggcguccccccgcaggcugc

SEQ ID NO: 1185145 - RNA, 18 nt, Human
cuaagaccagcccucacc

SEQ ID NO: 1185146 - RNA, 22 nt, Human
cuccccagccagcugccucccu

SEQ ID NO: 1185147 - RNA, 23 nt, Human
cucccccagcccacccccuaccu

SEQ ID NO: 1185148 - RNA, 20 nt, Human
cucccuccuggccuccuccu

SEQ ID NO: 1185149 - RNA, 20 nt, Human
cuccuuuuccuccuccucca

SEQ ID NO: 1185150 - RNA, 23 nt, Human
cugcccacuccccccgccccaac

SEQ ID NO: 1185151 - RNA, 25 nt, Human
cugcccacuccccccgccccaacag

SEQ ID NO: 1185152 - RNA, 20 nt, Human
cuggcauccuccacccagcc

SEQ ID NO: 1185153 - RNA, 25 nt, Human
cuggccccuccagugggacccuucc

SEQ ID NO: 1185154 - RNA, 19 nt, Human
cuguuggccagcgucccug

SEQ ID NO: 1185155 - RNA, 23 nt, Human
cuuccuggcauccuccacccagc

SEQ ID NO: 1185156 - RNA, 25 nt, Human
gaaguccugcccacuccccccgccc

SEQ ID NO: 1185157 - RNA, 23 nt, Human
gcagcuggcuuggggcccaagac

SEQ ID NO: 1185158 - RNA, 21 nt, Human
gccccucauccaaagaaagac

SEQ ID NO: 1185159 - RNA, 22 nt, Human
gcgccccucauccaaagaaaga

SEQ ID NO: 1185160 - RNA, 21 nt, Human
gcugucaggaugaggagggca

SEQ ID NO: 1185161 - RNA, 19 nt, Human
ggaccccacagccaguuuc

SEQ ID NO: 1185162 - RNA, 18 nt, Human
ggagugcugugccucccu

SEQ ID NO: 1185163 - RNA, 19 nt, Human
ggagugcugugccucccuc

SEQ ID NO: 1185164 - RNA, 24 nt, Human
ggcauccuccacccagccggaggg

SEQ ID NO: 1185165 - RNA, 19 nt, Human
ggcugucaggaugaggagg

SEQ ID NO: 1185166 - RNA, 24 nt, Human
gggcagcggcuuccaggucucagg

SEQ ID NO: 1185167 - RNA, 19 nt, Human
ggggaaggggaggggaagg

SEQ ID NO: 1185168 - RNA, 19 nt, Human
ggggaaggggaggggaagg

SEQ ID NO: 1185169 - RNA, 23 nt, Human
gucugggaccccacagccaguuu

SEQ ID NO: 1185170 - RNA, 21 nt, Human
gugguucagccccuuccuggc

SEQ ID NO: 1185171 - RNA, 23 nt, Human
uaagaccagcccucacccgccuc

SEQ ID NO: 1185172 - RNA, 21 nt, Human
uagcuaggaugccuguccccu

SEQ ID NO: 1185173 - RNA, 18 nt, Human
uaggugcucagcucuggc

SEQ ID NO: 1185174 - RNA, 20 nt, Human
ucacccgccucccccagccc

SEQ ID NO: 1185175 - RNA, 25 nt, Human
ucacccgccucccccagcccacccc

SEQ ID NO: 1185176 - RNA, 22 nt, Human
ucagcaccaaaugaugcccagg

SEQ ID NO: 1185177 - RNA, 20 nt, Human
ucagcaccagcuccagugcc

SEQ ID NO: 1185178 - RNA, 21 nt, Human
ucauccugcagugucaggggc

SEQ ID NO: 1185179 - RNA, 20 nt, Human
uccaaagaaagacucagucc

SEQ ID NO: 1185180 - RNA, 23 nt, Human
uccacgcgccccucauccaaaga

SEQ ID NO: 1185181 - RNA, 20 nt, Human
uccccagccagcugccuccc

SEQ ID NO: 1185182 - RNA, 19 nt, Human
ucccccagcccacccccua

SEQ ID NO: 1185183 - RNA, 22 nt, Human
ucccccagcccacccccuaccu

SEQ ID NO: 1185184 - RNA, 19 nt, Human
uccccgccuccccucuccc

SEQ ID NO: 1185185 - RNA, 22 nt, Human
uccccgccuccccucucccugc

SEQ ID NO: 1185186 - RNA, 23 nt, Human
uccccgccuccccucucccugca

SEQ ID NO: 1185187 - RNA, 20 nt, Human
uccccuuucccuccuuuucc

SEQ ID NO: 1185188 - RNA, 22 nt, Human
ucccugucagcaccagcuccag

SEQ ID NO: 1185189 - RNA, 18 nt, Human
uccugcagugucaggggc

SEQ ID NO: 1185190 - RNA, 19 nt, Human
uccuggccuccuccucccu

SEQ ID NO: 1185191 - RNA, 18 nt, Human
ucugaggagugcaccugg

SEQ ID NO: 1185192 - RNA, 26 nt, Human
ucugcagccagcagcuggcuuggggc

SEQ ID NO: 1185193 - RNA, 22 nt, Human
ucugggcugcauuccuaucuaa

SEQ ID NO: 1185194 - RNA, 20 nt, Human
ucuguccacuugugaaucug

SEQ ID NO: 1185195 - RNA, 19 nt, Human
ugaaucugcagaacuggca

SEQ ID NO: 1185196 - RNA, 24 nt, Human
ugacuccccagccagcugccuccc

SEQ ID NO: 1185197 - RNA, 22 nt, Human
ugaggguaaaucggagaaagga

SEQ ID NO: 1185198 - RNA, 18 nt, Human
ugaugcccaggugggugg

SEQ ID NO: 1185199 - RNA, 24 nt, Human
ugcauuccuaucuaagaccagccc

SEQ ID NO: 1185200 - RNA, 19 nt, Human
ugcccagguggguggcccu

SEQ ID NO: 1185201 - RNA, 24 nt, Human
ugcccagguggguggcccuugggc

SEQ ID NO: 1185202 - RNA, 27 nt, Human
ugccucccucccugggaaguccugccc

SEQ ID NO: 1185203 - RNA, 24 nt, Human
ugccuguccccuuucccuccuuuu

SEQ ID NO: 1185204 - RNA, 21 nt, Human
ugcucagcucuggccccucca

SEQ ID NO: 1185205 - RNA, 22 nt, Human
ugcugugccucccuccuggccu

SEQ ID NO: 1185206 - RNA, 22 nt, Human
uggaggggugccguucuggggu

SEQ ID NO: 1185207 - RNA, 23 nt, Human
uggcaggcgaggcccgaggaggu

SEQ ID NO: 1185208 - RNA, 22 nt, Human
ugggaaguccugcccacucccc

SEQ ID NO: 1185209 - RNA, 19 nt, Human
uggggaaggggaggggaag

SEQ ID NO: 1185210 - RNA, 19 nt, Human
ugucccacuuccccuccug

SEQ ID NO: 1185211 - RNA, 21 nt, Human
ugucccacuuccccuccugga

SEQ ID NO: 1185212 - RNA, 18 nt, Human
ugucugggaccccacagc

SEQ ID NO: 1185213 - RNA, 21 nt, Human
ugucugggaccccacagccag

SEQ ID NO: 1185214 - RNA, 20 nt, Human
ugucuuuucuucugcagcca

SEQ ID NO: 1185215 - RNA, 24 nt, Human
uucagccccuuccuggcauccucc

SEQ ID NO: 1185216 - RNA, 22 nt, Human
uuccugcagccuggguuaggug

SEQ ID NO: 1185217 - RNA, 20 nt, Human
uuccugugcacaggucugag

SEQ ID NO: 1185218 - RNA, 20 nt, Human
aaacaaaaacgccaggaggc

SEQ ID NO: 1185219 - RNA, 23 nt, Human
aaacagccagagcaacuugacaa

SEQ ID NO: 1185220 - RNA, 22 nt, Human
aaaccaacacagcaccugagac

SEQ ID NO: 1185221 - RNA, 19 nt, Human
aaaccagcaaucaagccag

SEQ ID NO: 1185222 - RNA, 23 nt, Human
aaagaaaacgaugccacucugca

SEQ ID NO: 1185223 - RNA, 18 nt, Human
aaccagcaaucaagccag

SEQ ID NO: 1185224 - RNA, 22 nt, Human
aacucagcucccucugaaaguu

SEQ ID NO: 1185225 - RNA, 19 nt, Human
aagaaaacugggugaccac

SEQ ID NO: 1185226 - RNA, 21 nt, Human
aagaaagaaaccagcaaucaa

SEQ ID NO: 1185227 - RNA, 28 nt, Human
aagaacagagaaaggggugccgguaccc

SEQ ID NO: 1185228 - RNA, 22 nt, Human
aagauccuauauuccacaaaaa

SEQ ID NO: 1185229 - RNA, 19 nt, Human
aagccagaaacagaaaacg

SEQ ID NO: 1185230 - RNA, 27 nt, Human
aagccagaaacagaaaacgagggaccc

SEQ ID NO: 1185231 - RNA, 22 nt, Human
aaggaagaagagaaaguggggg

SEQ ID NO: 1185232 - RNA, 24 nt, Human
aaggacuaucuggcuggacaaccc

SEQ ID NO: 1185233 - RNA, 20 nt, Human
aagggcccauguuguagcuc

SEQ ID NO: 1185234 - RNA, 26 nt, Human
aagugggcagaucaccagaggucagg

SEQ ID NO: 1185235 - RNA, 24 nt, Human
aaucacuugaaaccgggaggcaga

SEQ ID NO: 1185236 - RNA, 22 nt, Human
acaaaacaaaaacgccaggagg

SEQ ID NO: 1185237 - RNA, 26 nt, Human
acaaaacaaaaacgccaggaggcccc

SEQ ID NO: 1185238 - RNA, 20 nt, Human
acagagugagauuccgucuc

SEQ ID NO: 1185239 - RNA, 25 nt, Human
acagagugagauuccgucuccaaaa

SEQ ID NO: 1185240 - RNA, 19 nt, Human
acauagugaaacccugucu

SEQ ID NO: 1185241 - RNA, 20 nt, Human
acauagugaaacccugucuc

SEQ ID NO: 1185242 - RNA, 22 nt, Human
acauagugaaacccugucucua

SEQ ID NO: 1185243 - RNA, 24 nt, Human
accagaggucaggaguuugagacc

SEQ ID NO: 1185244 - RNA, 18 nt, Human
accagggcucccccuccu

SEQ ID NO: 1185245 - RNA, 19 nt, Human
acccauagccccaaucugc

SEQ ID NO: 1185246 - RNA, 19 nt, Human
accccauccgucagcacca

SEQ ID NO: 1185247 - RNA, 21 nt, Human
accuauccccugcccuccccu

SEQ ID NO: 1185248 - RNA, 23 nt, Human
acugaaacgcaaggagagccugg

SEQ ID NO: 1185249 - RNA, 22 nt, Human
acuguguuugcccuucaagguu

SEQ ID NO: 1185250 - RNA, 21 nt, Human
agaaagaaaccagcaaucaag

SEQ ID NO: 1185251 - RNA, 18 nt, Human
agaaaguggggguggaga

SEQ ID NO: 1185252 - RNA, 21 nt, Human
agaaccacagccaauccacag

SEQ ID NO: 1185253 - RNA, 24 nt, Human
agaagagaaaguggggguggagag

SEQ ID NO: 1185254 - RNA, 21 nt, Human
agaauaauuugcccucuaccc

SEQ ID NO: 1185255 - RNA, 19 nt, Human
agagagugggcuguccaca

SEQ ID NO: 1185256 - RNA, 20 nt, Human
agaggucaggaguuugagac

SEQ ID NO: 1185257 - RNA, 18 nt, Human
agagguugcagugagcca

SEQ ID NO: 1185258 - RNA, 23 nt, Human
agagguugcagugagccaugauc

SEQ ID NO: 1185259 - RNA, 24 nt, Human
agagguugcagugagccaugaucg

SEQ ID NO: 1185260 - RNA, 24 nt, Human
agcacuuugagaggccgaaguggg

SEQ ID NO: 1185261 - RNA, 21 nt, Human
agccuaguaagaaagaaacca

SEQ ID NO: 1185262 - RNA, 22 nt, Human
aggcagagguugcagugagcca

SEQ ID NO: 1185263 - RNA, 24 nt, Human
aggcagagguugcagugagccaug

SEQ ID NO: 1185264 - RNA, 27 nt, Human
aggcagagguugcagugagccaugauc

SEQ ID NO: 1185265 - RNA, 25 nt, Human
aggcagcuggagcuucagacuucug

SEQ ID NO: 1185266 - RNA, 18 nt, Human
aggcaggagaaucacuug

SEQ ID NO: 1185267 - RNA, 24 nt, Human
aggcaggagaaucacuugaaaccg

SEQ ID NO: 1185268 - RNA, 21 nt, Human
aggccgaagugggcagaucac

SEQ ID NO: 1185269 - RNA, 19 nt, Human
aggccuggcagggagaaag

SEQ ID NO: 1185270 - RNA, 19 nt, Human
aggcggaggcaggagaauc

SEQ ID NO: 1185271 - RNA, 24 nt, Human
aggcggaggcaggagaaucacuug

SEQ ID NO: 1185272 - RNA, 18 nt, Human
aggcuucucguacacacc

SEQ ID NO: 1185273 - RNA, 19 nt, Human
agggagaaaggaggcacag

SEQ ID NO: 1185274 - RNA, 25 nt, Human
auagaauuccacccaggcuuguccc

SEQ ID NO: 1185275 - RNA, 26 nt, Human
auagaauuccacccaggcuuguccca

SEQ ID NO: 1185276 - RNA, 19 nt, Human
aucaacaaauuauacuccu

SEQ ID NO: 1185277 - RNA, 24 nt, Human
aucaccagaggucaggaguuugag

SEQ ID NO: 1185278 - RNA, 19 nt, Human
augaagcaugagguaaccc

SEQ ID NO: 1185279 - RNA, 19 nt, Human
augccuguaaucccagcac

SEQ ID NO: 1185280 - RNA, 19 nt, Human
auggaagagcaggaaccag

SEQ ID NO: 1185281 - RNA, 24 nt, Human
caaaacaaaaacgccaggaggccc

SEQ ID NO: 1185282 - RNA, 21 nt, Human
caacacagcaccugagacugu

SEQ ID NO: 1185283 - RNA, 21 nt, Human
caacuucagaugaaccaacac

SEQ ID NO: 1185284 - RNA, 22 nt, Human
caagccagaaacagaaaacgau

SEQ ID NO: 1185285 - RNA, 22 nt, Human
cacagagcaaaggaaaaggcag

SEQ ID NO: 1185286 - RNA, 23 nt, Human
cacagcaccugagacuguaugaa

SEQ ID NO: 1185287 - RNA, 20 nt, Human
cacauagugaaacccugucu

SEQ ID NO: 1185288 - RNA, 18 nt, Human
caccccauccgucagcac

SEQ ID NO: 1185289 - RNA, 19 nt, Human
cacuguguuugcccuucaa

SEQ ID NO: 1185290 - RNA, 23 nt, Human
cacuucaaccaggugacagagug

SEQ ID NO: 1185291 - RNA, 24 nt, Human
cagaucaccagaggucaggaguuu

SEQ ID NO: 1185292 - RNA, 23 nt, Human
cagcacuggggccaugcuggacc

SEQ ID NO: 1185293 - RNA, 24 nt, Human
cagcacuuugagaggccgaagugg

SEQ ID NO: 1185294 - RNA, 23 nt, Human
cagcccagggauagcuucagaug

SEQ ID NO: 1185295 - RNA, 21 nt, Human
cagcggcccuggcagacucuc

SEQ ID NO: 1185296 - RNA, 22 nt, Human
cagcggcccuggcagacucuca

SEQ ID NO: 1185297 - RNA, 24 nt, Human
caugccuguaaucccagcacuuug

SEQ ID NO: 1185298 - RNA, 20 nt, Human
cauggagcaucuuuugcucc

SEQ ID NO: 1185299 - RNA, 22 nt, Human
ccaauccacagagcaaaggaaa

SEQ ID NO: 1185300 - RNA, 19 nt, Human
ccacaaaaaaguugguugc

SEQ ID NO: 1185301 - RNA, 22 nt, Human
ccagaaaagaaaaaugaguccc

SEQ ID NO: 1185302 - RNA, 23 nt, Human
ccagaaaagaaaaaugagucccg

SEQ ID NO: 1185303 - RNA, 18 nt, Human
ccagcaaucaagccagaa

SEQ ID NO: 1185304 - RNA, 22 nt, Human
ccagcccacauagugaaacccc

SEQ ID NO: 1185305 - RNA, 20 nt, Human
ccaggaggccccugggcaag

SEQ ID NO: 1185306 - RNA, 23 nt, Human
ccagggcucccccuccuccccca

SEQ ID NO: 1185307 - RNA, 21 nt, Human
ccaggugacagagugagauuc

SEQ ID NO: 1185308 - RNA, 21 nt, Human
cccaacucugcuugcuaccuc

SEQ ID NO: 1185309 - RNA, 21 nt, Human
cccaggcuuguaagggcccau

SEQ ID NO: 1185310 - RNA, 23 nt, Human
ccccaccgugcuggcuccuuccu

SEQ ID NO: 1185311 - RNA, 20 nt, Human
ccccagcagugggagccuca

SEQ ID NO: 1185312 - RNA, 18 nt, Human
ccccauccgucagcacca

SEQ ID NO: 1185313 - RNA, 18 nt, Human
cccccuccucccccaacu

SEQ ID NO: 1185314 - RNA, 18 nt, Human
ccccucuccuucccuuuc

SEQ ID NO: 1185315 - RNA, 23 nt, Human
ccccugcccuccccucuccuucc

SEQ ID NO: 1185316 - RNA, 21 nt, Human
cccucacuguguuugcccuuc

SEQ ID NO: 1185317 - RNA, 22 nt, Human
cccucuacccugcagauccccu

SEQ ID NO: 1185318 - RNA, 22 nt, Human
cccugcccuccccucuccuucc

SEQ ID NO: 1185319 - RNA, 22 nt, Human
ccuacucaggccauuagucacu

SEQ ID NO: 1185320 - RNA, 24 nt, Human
ccuccccucuccuucccuuucccc

SEQ ID NO: 1185321 - RNA, 18 nt, Human
ccucucaugccuccuccc

SEQ ID NO: 1185322 - RNA, 21 nt, Human
ccucuccuucccuuuccucuc

SEQ ID NO: 1185323 - RNA, 19 nt, Human
ccugaagaacacccuccuu

SEQ ID NO: 1185324 - RNA, 22 nt, Human
ccugcccuccccucuccuuccc

SEQ ID NO: 1185325 - RNA, 23 nt, Human
ccuggcgcgccuuuaaccucaac

SEQ ID NO: 1185326 - RNA, 21 nt, Human
ccuguaaucccagcuacucgg

SEQ ID NO: 1185327 - RNA, 22 nt, Human
ccuguaaucccagcuacucggg

SEQ ID NO: 1185328 - RNA, 21 nt, Human
ccuucccuuuccucuccucuc

SEQ ID NO: 1185329 - RNA, 26 nt, Human
cgaagugggcagaucaccagagguca

SEQ ID NO: 1185330 - RNA, 23 nt, Human
cgcugucacagaucagacagcgg

SEQ ID NO: 1185331 - RNA, 24 nt, Human
cgggaggcagagguugcagugagc

SEQ ID NO: 1185332 - RNA, 19 nt, Human
cgggaggcggaggcaggag

SEQ ID NO: 1185333 - RNA, 24 nt, Human
cgggaggcggaggcaggagaauca

SEQ ID NO: 1185334 - RNA, 18 nt, Human
cuacacccugccuucugc

SEQ ID NO: 1185335 - RNA, 24 nt, Human
cucaugccuguaaucccagcacuu

SEQ ID NO: 1185336 - RNA, 19 nt, Human
cuccccuggugaaacagcu

SEQ ID NO: 1185337 - RNA, 21 nt, Human
cuccccuggugaaacagcucc

SEQ ID NO: 1185338 - RNA, 22 nt, Human
cucuaccuauccccugcccucc

SEQ ID NO: 1185339 - RNA, 19 nt, Human
cugcacugaaacgcaagga

SEQ ID NO: 1185340 - RNA, 20 nt, Human
cugcacuucaaccaggugac

SEQ ID NO: 1185341 - RNA, 18 nt, Human
cuggaucaggguuagggg

SEQ ID NO: 1185342 - RNA, 21 nt, Human
cugugcgcaugacuguguaug

SEQ ID NO: 1185343 - RNA, 24 nt, Human
cuucaaccaggugacagagugaga

SEQ ID NO: 1185344 - RNA, 25 nt, Human
cuucuaaguugggucacaaucacac

SEQ ID NO: 1185345 - RNA, 24 nt, Human
cuucuccagcucagcuuccucagu

SEQ ID NO: 1185346 - RNA, 26 nt, Human
cuucugggacccaaagaggcuucgcu

SEQ ID NO: 1185347 - RNA, 19 nt, Human
gaaagacuaaaucuaagag

SEQ ID NO: 1185348 - RNA, 23 nt, Human
gaacacaaaacaaaaacgccagg

SEQ ID NO: 1185349 - RNA, 22 nt, Human
gacaccuccggagacacaacug

SEQ ID NO: 1185350 - RNA, 25 nt, Human
gacagagugagauuccgucuccaaa

SEQ ID NO: 1185351 - RNA, 18 nt, Human
gagaaaguggggguggag

SEQ ID NO: 1185352 - RNA, 20 nt, Human
gagaacacaaaacaaaaacg

SEQ ID NO: 1185353 - RNA, 23 nt, Human
gagaaucacuugaaaccgggagg

SEQ ID NO: 1185354 - RNA, 24 nt, Human
gaggcaggagaaucacuugaaacc

SEQ ID NO: 1185355 - RNA, 23 nt, Human
gaguccguuugacucagagcugg

SEQ ID NO: 1185356 - RNA, 18 nt, Human
gagugguucacaagaaug

SEQ ID NO: 1185357 - RNA, 24 nt, Human
gaucaccagaggucaggaguuuga

SEQ ID NO: 1185358 - RNA, 26 nt, Human
gaucaccagaggucaggaguuugaga

SEQ ID NO: 1185359 - RNA, 19 nt, Human
gaugaggacacuaagcugg

SEQ ID NO: 1185360 - RNA, 27 nt, Human
gcaaagucuggacaccuccggagacag

SEQ ID NO: 1185361 - RNA, 19 nt, Human
gcaacuugacauccgagug

SEQ ID NO: 1185362 - RNA, 18 nt, Human
gcaggagaaucacuugaa

SEQ ID NO: 1185363 - RNA, 21 nt, Human
gccacgcugucacagaucaga

SEQ ID NO: 1185364 - RNA, 24 nt, Human
gcccacauagugaaacccugucuc

SEQ ID NO: 1185365 - RNA, 21 nt, Human
gcuaauagcucauuucugauu

SEQ ID NO: 1185366 - RNA, 21 nt, Human
gcuugcuaccuccacaacucc

SEQ ID NO: 1185367 - RNA, 22 nt, Human
ggaaaucccccuuccucaugcc

SEQ ID NO: 1185368 - RNA, 18 nt, Human
ggacuagcuuggcuaaua

SEQ ID NO: 1185369 - RNA, 20 nt, Human
ggaggcaggagaaucacuug

SEQ ID NO: 1185370 - RNA, 18 nt, Human
ggcccuggcagacucuca

SEQ ID NO: 1185371 - RNA, 20 nt, Human
ggcucaugccuguaauccca

SEQ ID NO: 1185372 - RNA, 19 nt, Human
gggaggcggaggcaggaga

SEQ ID NO: 1185373 - RNA, 26 nt, Human
gggcagaucaccagaggucaggaguu

SEQ ID NO: 1185374 - RNA, 24 nt, Human
gggcucaugccuguaaucccagca

SEQ ID NO: 1185375 - RNA, 21 nt, Human
ggggccaugcuggacccagag

SEQ ID NO: 1185376 - RNA, 23 nt, Human
gggggcucaugccuguaauccca

SEQ ID NO: 1185377 - RNA, 24 nt, Human
gggggcucaugccuguaaucccag

SEQ ID NO: 1185378 - RNA, 24 nt, Human
gggugcgggggcucaugccuguaa

SEQ ID NO: 1185379 - RNA, 20 nt, Human
gggugguggucucucaggag

SEQ ID NO: 1185380 - RNA, 18 nt, Human
gguauggaaacaaagaga

SEQ ID NO: 1185381 - RNA, 23 nt, Human
gguggcacaugccuguaauccca

SEQ ID NO: 1185382 - RNA, 24 nt, Human
gguggcacaugccuguaaucccag

SEQ ID NO: 1185383 - RNA, 19 nt, Human
gguugcaaccgggugcggg

SEQ ID NO: 1185384 - RNA, 23 nt, Human
gucacaaucacaccccauccguc

SEQ ID NO: 1185385 - RNA, 21 nt, Human
guccuuuuuccccagagcucc

SEQ ID NO: 1185386 - RNA, 22 nt, Human
gugacucccugaaacuucuaag

SEQ ID NO: 1185387 - RNA, 18 nt, Human
guggguggcacaugccug

SEQ ID NO: 1185388 - RNA, 18 nt, Human
gugucaggaauaccuggc

SEQ ID NO: 1185389 - RNA, 22 nt, Human
guugcaaccgggugcgggggcu

SEQ ID NO: 1185390 - RNA, 21 nt, Human
uaaaaccaacacagcaccuga

SEQ ID NO: 1185391 - RNA, 19 nt, Human
uaaaaggagaauggcccau

SEQ ID NO: 1185392 - RNA, 20 nt, Human
uaaagugaagauaaaucaac

SEQ ID NO: 1185393 - RNA, 22 nt, Human
uaacuccucaauauagaauucc

SEQ ID NO: 1185394 - RNA, 21 nt, Human
uaagaaagaaaccagcaauca

SEQ ID NO: 1185395 - RNA, 21 nt, Human
uaaggaaaucccccuuccuca

SEQ ID NO: 1185396 - RNA, 24 nt, Human
uaccacaccacaugccacgcuguc

SEQ ID NO: 1185397 - RNA, 19 nt, Human
uacucaggccauuagucac

SEQ ID NO: 1185398 - RNA, 19 nt, Human
uagcaucagacgcagguca

SEQ ID NO: 1185399 - RNA, 20 nt, Human
uauggaaacaaagagaggag

SEQ ID NO: 1185400 - RNA, 21 nt, Human
ucaagccagaaacagaaaacg

SEQ ID NO: 1185401 - RNA, 19 nt, Human
ucaaggaaacuccuuccuc

SEQ ID NO: 1185402 - RNA, 21 nt, Human
ucagagagccccucauuuaac

SEQ ID NO: 1185403 - RNA, 19 nt, Human
ucagcucccucugaaaguu

SEQ ID NO: 1185404 - RNA, 22 nt, Human
ucaugccuguaaucccagcacu

SEQ ID NO: 1185405 - RNA, 19 nt, Human
uccacacagcaagucagag

SEQ ID NO: 1185406 - RNA, 20 nt, Human
uccacugccaagauccugcu

SEQ ID NO: 1185407 - RNA, 18 nt, Human
uccagcucagcuuccuca

SEQ ID NO: 1185408 - RNA, 19 nt, Human
uccccagcagugggagccu

SEQ ID NO: 1185409 - RNA, 23 nt, Human
ucccccaacucugcuugcuaccu

SEQ ID NO: 1185410 - RNA, 18 nt, Human
uccccugcccuccccucu

SEQ ID NO: 1185411 - RNA, 22 nt, Human
uccccuguaucuaauuaucugu

SEQ ID NO: 1185412 - RNA, 21 nt, Human
ucccucaucccuucugguuua

SEQ ID NO: 1185413 - RNA, 20 nt, Human
ucccugagcuaugacuugcu

SEQ ID NO: 1185414 - RNA, 21 nt, Human
uccuagguccaaagaacaguu

SEQ ID NO: 1185415 - RNA, 19 nt, Human
uccucaguuuuucagcucu

SEQ ID NO: 1185416 - RNA, 20 nt, Human
uccucaguuuuucagcucuu

SEQ ID NO: 1185417 - RNA, 21 nt, Human
uccucucuccucucucccuca

SEQ ID NO: 1185418 - RNA, 21 nt, Human
ucuaauuaucugucaaccuga

SEQ ID NO: 1185419 - RNA, 23 nt, Human
ucucagagagccccucauuuaac

SEQ ID NO: 1185420 - RNA, 24 nt, Human
ucugaaaugcaaucuaaguuuaca

SEQ ID NO: 1185421 - RNA, 21 nt, Human
ucugcacugaaacgcaaggag

SEQ ID NO: 1185422 - RNA, 21 nt, Human
ucugcacugaaacgcaaggag

SEQ ID NO: 1185423 - RNA, 22 nt, Human
ucugcagucuucaauaucaccu

SEQ ID NO: 1185424 - RNA, 23 nt, Human
ucugcagucuucaauaucaccuc

SEQ ID NO: 1185425 - RNA, 23 nt, Human
ugaagaaaacugggugaccacau

SEQ ID NO: 1185426 - RNA, 25 nt, Human
ugaagaacacccuccuuuucccuga

SEQ ID NO: 1185427 - RNA, 19 nt, Human
ugagaccagcccagcccac

SEQ ID NO: 1185428 - RNA, 20 nt, Human
ugagaggccgaagugggcag

SEQ ID NO: 1185429 - RNA, 24 nt, Human
ugagaggccgaagugggcagauca

SEQ ID NO: 1185430 - RNA, 26 nt, Human
ugagauauaaggaaaucccccuuccc

SEQ ID NO: 1185431 - RNA, 21 nt, Human
ugagcuggaggcauggagggu

SEQ ID NO: 1185432 - RNA, 22 nt, Human
ugaggcaaggagggugucucug

SEQ ID NO: 1185433 - RNA, 21 nt, Human
ugccacucugcacugaaacgc

SEQ ID NO: 1185434 - RNA, 22 nt, Human
ugcccucuacccugcagauccc

SEQ ID NO: 1185435 - RNA, 23 nt, Human
ugccuguaaucccagcacuuuga

SEQ ID NO: 1185436 - RNA, 23 nt, Human
ugccuguaaucccagcuacucgg

SEQ ID NO: 1185437 - RNA, 24 nt, Human
ugccuguaaucccagcuacucggg

SEQ ID NO: 1185438 - RNA, 19 nt, Human
uggagcaucuuuugcuccu

SEQ ID NO: 1185439 - RNA, 18 nt, Human
uggaugucucugcagucu

SEQ ID NO: 1185440 - RNA, 21 nt, Human
uggcacaugccuguaauccca

SEQ ID NO: 1185441 - RNA, 19 nt, Human
uggcagacucucagagagc

SEQ ID NO: 1185442 - RNA, 20 nt, Human
uggcuuccagcucccagccc

SEQ ID NO: 1185443 - RNA, 19 nt, Human
ugggaagguuggugaggca

SEQ ID NO: 1185444 - RNA, 20 nt, Human
ugggaagguuggugaggcaa

SEQ ID NO: 1185445 - RNA, 21 nt, Human
ugggcagaucaccagagguca

SEQ ID NO: 1185446 - RNA, 24 nt, Human
ugggcagaucaccagaggucagga

SEQ ID NO: 1185447 - RNA, 19 nt, Human
uggggccaugcuggaccca

SEQ ID NO: 1185448 - RNA, 21 nt, Human
uggggccaugcuggacccaga

SEQ ID NO: 1185449 - RNA, 20 nt, Human
uggggguggagagggagaac

SEQ ID NO: 1185450 - RNA, 23 nt, Human
ugguauggaaacaaagagaggag

SEQ ID NO: 1185451 - RNA, 18 nt, Human
ugucacagaucagacagc

SEQ ID NO: 1185452 - RNA, 23 nt, Human
uguguaugggaagguuggugagg

SEQ ID NO: 1185453 - RNA, 21 nt, Human
uuaaugcugucaaggguuuaa

SEQ ID NO: 1185454 - RNA, 18 nt, Human
uuccucaguuuuucagcu

SEQ ID NO: 1185455 - RNA, 23 nt, Human
uuccucccaaacagccagagcaa

SEQ ID NO: 1185456 - RNA, 23 nt, Human
uucucguacacaccuuguuccau

SEQ ID NO: 1185457 - RNA, 19 nt, Human
uucuugugagacaauaggu

SEQ ID NO: 1185458 - RNA, 24 nt, Human
uugacucagagcugggcaugagcu

SEQ ID NO: 1185459 - RNA, 21 nt, Human
uugaugauuuucauucaacga

SEQ ID NO: 1185460 - RNA, 22 nt, Human
uugcagugagccaugaucgcgc

SEQ ID NO: 1185461 - RNA, 20 nt, Human
uuucugauuuaacaucacau

SEQ ID NO: 1185462 - RNA, 24 nt, Human
uuuuccaaaucggccucucggcug

SEQ ID NO: 1185463 - RNA, 22 nt, Human
aaaaagacacccuaauaaaccu

SEQ ID NO: 1185464 - RNA, 20 nt, Human
aaaacucaaagaucagcccc

SEQ ID NO: 1185465 - RNA, 20 nt, Human
aaacccuucaaccuuccagg

SEQ ID NO: 1185466 - RNA, 24 nt, Human
aagcaacuucugccauggggaggu

SEQ ID NO: 1185467 - RNA, 20 nt, Human
aaggaucuucucaaagcaag

SEQ ID NO: 1185468 - RNA, 22 nt, Human
acaaaaccccgcagucaugggc

SEQ ID NO: 1185469 - RNA, 24 nt, Human
acagagagagauuuaugaccugga

SEQ ID NO: 1185470 - RNA, 29 nt, Human
acauccaucuaaaaagacacccuaauaaa

SEQ ID NO: 1185471 - RNA, 18 nt, Human
accaugugggauggcagg

SEQ ID NO: 1185472 - RNA, 21 nt, Human
acccuaauaaaccugcagcua

SEQ ID NO: 1185473 - RNA, 20 nt, Human
accuggauagcuuugauccc

SEQ ID NO: 1185474 - RNA, 18 nt, Human
acugccaucugcccuugc

SEQ ID NO: 1185475 - RNA, 18 nt, Human
acuuccugggaaucccag

SEQ ID NO: 1185476 - RNA, 20 nt, Human
agagagauuccugcuccucc

SEQ ID NO: 1185477 - RNA, 18 nt, Human
agcuuuuucccguccccu

SEQ ID NO: 1185478 - RNA, 21 nt, Human
aggaaccccccaucaccagga

SEQ ID NO: 1185479 - RNA, 20 nt, Human
aggaaggaagccugcccagu

SEQ ID NO: 1185480 - RNA, 22 nt, Human
aggaggaaggaagccugcccag

SEQ ID NO: 1185481 - RNA, 22 nt, Human
aggaggaaggaagccugcccag

SEQ ID NO: 1185482 - RNA, 25 nt, Human
aggaggaaggaagccugcccaguaa

SEQ ID NO: 1185483 - RNA, 23 nt, Human
aggccaggcuuccucucccccag

SEQ ID NO: 1185484 - RNA, 19 nt, Human
agggacacagcuggguggc

SEQ ID NO: 1185485 - RNA, 18 nt, Human
agggggugcccagggacu

SEQ ID NO: 1185486 - RNA, 21 nt, Human
auccauaaaacuguuccccuc

SEQ ID NO: 1185487 - RNA, 24 nt, Human
caaaaccccgcagucaugggcucc

SEQ ID NO: 1185488 - RNA, 19 nt, Human
caaauugggucuaaugacc

SEQ ID NO: 1185489 - RNA, 20 nt, Human
caacaagagagauuccugcu

SEQ ID NO: 1185490 - RNA, 23 nt, Human
caagaaaccagccuguggcccac

SEQ ID NO: 1185491 - RNA, 18 nt, Human
caaggugaaggaggggcc

SEQ ID NO: 1185492 - RNA, 26 nt, Human
cacaaggaaaaggcacacaagguccc

SEQ ID NO: 1185493 - RNA, 19 nt, Human
cacacaaggucccccagcc

SEQ ID NO: 1185494 - RNA, 18 nt, Human
cacagcuggguggcugag

SEQ ID NO: 1185495 - RNA, 20 nt, Human
caccccucccucaaggccag

SEQ ID NO: 1185496 - RNA, 21 nt, Human
caccugcaccccucccucaag

SEQ ID NO: 1185497 - RNA, 30 nt, Human
cacucccaacagcccaccagcuccugcgcu

SEQ ID NO: 1185498 - RNA, 20 nt, Human
cagcagcuccccagaaugga

SEQ ID NO: 1185499 - RNA, 22 nt, Human
cagccauggcuucucagaggac

SEQ ID NO: 1185500 - RNA, 24 nt, Human
cagcuccugcgcccagaugccccu

SEQ ID NO: 1185501 - RNA, 23 nt, Human
cagcuucuuggcagagcugggag

SEQ ID NO: 1185502 - RNA, 24 nt, Human
caggaggaaggaagccugcccagu

SEQ ID NO: 1185503 - RNA, 19 nt, Human
caggcuuccucuccccccu

SEQ ID NO: 1185504 - RNA, 23 nt, Human
cauacauccaucuaaaaagacac

SEQ ID NO: 1185505 - RNA, 21 nt, Human
caucaacagacccacugccau

SEQ ID NO: 1185506 - RNA, 21 nt, Human
caucuaaaaagacacccuaau

SEQ ID NO: 1185507 - RNA, 19 nt, Human
cauugcacccaagaaacca

SEQ ID NO: 1185508 - RNA, 26 nt, Human
cauuucacagccacaaggaaaaggca

SEQ ID NO: 1185509 - RNA, 22 nt, Human
ccacaccugcaccccucccuca

SEQ ID NO: 1185510 - RNA, 22 nt, Human
ccacgcaugcaggaauaaacac

SEQ ID NO: 1185511 - RNA, 25 nt, Human
cccaagaaaccagccuguggcccac

SEQ ID NO: 1185512 - RNA, 21 nt, Human
cccacacacacaggagccaca

SEQ ID NO: 1185513 - RNA, 23 nt, Human
cccaccagcuccugcgcccagau

SEQ ID NO: 1185514 - RNA, 23 nt, Human
cccacgcaugcaggaauaaacac

SEQ ID NO: 1185515 - RNA, 20 nt, Human
ccccagcacacgcaaguucu

SEQ ID NO: 1185516 - RNA, 20 nt, Human
ccccuccaccccuucacuuu

SEQ ID NO: 1185517 - RNA, 21 nt, Human
cccguccccuccacuugacca

SEQ ID NO: 1185518 - RNA, 20 nt, Human
cccuaaaccccgaggagaag

SEQ ID NO: 1185519 - RNA, 25 nt, Human
cccuucaaccuuccaggcacaguuu

SEQ ID NO: 1185520 - RNA, 18 nt, Human
ccggucccuucccuuccc

SEQ ID NO: 1185521 - RNA, 22 nt, Human
ccggucccuucccuucccuggg

SEQ ID NO: 1185522 - RNA, 23 nt, Human
ccucaaggccaggcuuccucucc

SEQ ID NO: 1185523 - RNA, 22 nt, Human
ccuccagccccuccaccccuuc

SEQ ID NO: 1185524 - RNA, 23 nt, Human
ccuccagccccuccaccccuuca

SEQ ID NO: 1185525 - RNA, 18 nt, Human
ccuggagaaaacgagccc

SEQ ID NO: 1185526 - RNA, 20 nt, Human
ccuggggccuuguggcugag

SEQ ID NO: 1185527 - RNA, 19 nt, Human
ccuguggcccacgcaugca

SEQ ID NO: 1185528 - RNA, 22 nt, Human
cgagcccaggagggggugccca

SEQ ID NO: 1185529 - RNA, 22 nt, Human
cgcccagaugccccugaaaucc

SEQ ID NO: 1185530 - RNA, 18 nt, Human
cgggcuggacuuccuggg

SEQ ID NO: 1185531 - RNA, 19 nt, Human
cuaaaaagacacccuaaua

SEQ ID NO: 1185532 - RNA, 19 nt, Human
cuaaacgucucugcacccc

SEQ ID NO: 1185533 - RNA, 20 nt, Human
cucagauggguugccucaag

SEQ ID NO: 1185534 - RNA, 19 nt, Human
cucccuuccacgaccgguc

SEQ ID NO: 1185535 - RNA, 21 nt, Human
cugaggcccuggggccuugug

SEQ ID NO: 1185536 - RNA, 18 nt, Human
cugcaccccucccucaag

SEQ ID NO: 1185537 - RNA, 20 nt, Human
cugcccuggggcccaacagc

SEQ ID NO: 1185538 - RNA, 23 nt, Human
cugggaagcccugacgaagagag

SEQ ID NO: 1185539 - RNA, 21 nt, Human
gaaaaggcacacaaggucccc

SEQ ID NO: 1185540 - RNA, 18 nt, Human
gaaacagcacuacaucca

SEQ ID NO: 1185541 - RNA, 21 nt, Human
gaacauccccuguuuugcuga

SEQ ID NO: 1185542 - RNA, 23 nt, Human
gacaggcagagucuucacucucc

SEQ ID NO: 1185543 - RNA, 20 nt, Human
gaggcccuggggccuugugg

SEQ ID NO: 1185544 - RNA, 20 nt, Human
gagggacacagcuggguggc

SEQ ID NO: 1185545 - RNA, 23 nt, Human
gagggacacagcuggguggcuga

SEQ ID NO: 1185546 - RNA, 21 nt, Human
gcacucccaacagcccaccag

SEQ ID NO: 1185547 - RNA, 22 nt, Human
gccacagagagagauuuaugac

SEQ ID NO: 1185548 - RNA, 23 nt, Human
gccccgaagcguccaugaauccu

SEQ ID NO: 1185549 - RNA, 21 nt, Human
ggaacaaacccuucaaccuuc

SEQ ID NO: 1185550 - RNA, 18 nt, Human
ggagggggugcccaggga

SEQ ID NO: 1185551 - RNA, 25 nt, Human
ggaguagagcacauuuuuuccuuug

SEQ ID NO: 1185552 - RNA, 20 nt, Human
ggcagagcugggagugggug

SEQ ID NO: 1185553 - RNA, 19 nt, Human
gggcuggacuuccugggaa

SEQ ID NO: 1185554 - RNA, 26 nt, Human
uaaaccccgaggagaagguuuaugga

SEQ ID NO: 1185555 - RNA, 24 nt, Human
uaaacgucucugcaccccaugcuu

SEQ ID NO: 1185556 - RNA, 22 nt, Human
uaaggucucagccacauccaua

SEQ ID NO: 1185557 - RNA, 18 nt, Human
uagcaagguuugcaugca

SEQ ID NO: 1185558 - RNA, 24 nt, Human
ucagggucucuuucugcugauggc

SEQ ID NO: 1185559 - RNA, 18 nt, Human
uccaugaauccugggaca

SEQ ID NO: 1185560 - RNA, 18 nt, Human
uccauggugucucgaugg

SEQ ID NO: 1185561 - RNA, 20 nt, Human
ucccugggcuucaauuucca

SEQ ID NO: 1185562 - RNA, 19 nt, Human
uccgggguccggaguguuc

SEQ ID NO: 1185563 - RNA, 18 nt, Human
uccuccagccccuccacc

SEQ ID NO: 1185564 - RNA, 20 nt, Human
uccugaggcccuggggccuu

SEQ ID NO: 1185565 - RNA, 18 nt, Human
ucuucagcugcccugggg

SEQ ID NO: 1185566 - RNA, 18 nt, Human
ucuucuguaaaaugagag

SEQ ID NO: 1185567 - RNA, 18 nt, Human
ugaaaagagauccuagaa

SEQ ID NO: 1185568 - RNA, 20 nt, Human
ugaccaugugggauggcagg

SEQ ID NO: 1185569 - RNA, 22 nt, Human
ugaccuggauagcuuugauccc

SEQ ID NO: 1185570 - RNA, 20 nt, Human
ugagaggguugggugcaagu

SEQ ID NO: 1185571 - RNA, 19 nt, Human
ugagguccaaagggcuguc

SEQ ID NO: 1185572 - RNA, 19 nt, Human
ugaggugucuacaaaaccc

SEQ ID NO: 1185573 - RNA, 21 nt, Human
ugauugaaaagagauccuaau

SEQ ID NO: 1185574 - RNA, 19 nt, Human
ugcccuggggcccaacagc

SEQ ID NO: 1185575 - RNA, 18 nt, Human
ugcuccuccagccccucc

SEQ ID NO: 1185576 - RNA, 28 nt, Human
uggaaaugguuuccuggucccgaccacg

SEQ ID NO: 1185577 - RNA, 19 nt, Human
uggaacggcccagccaugg

SEQ ID NO: 1185578 - RNA, 26 nt, Human
uggagaaaacgagcccaggagggggu

SEQ ID NO: 1185579 - RNA, 19 nt, Human
uggcagagcugggaguggg

SEQ ID NO: 1185580 - RNA, 19 nt, Human
uggcaguuuggaaaugguu

SEQ ID NO: 1185581 - RNA, 23 nt, Human
uucacucuccgggguccggagug

SEQ ID NO: 1185582 - RNA, 19 nt, Human
uuccugaggcccuggggcc

SEQ ID NO: 1185583 - RNA, 23 nt, Human
uuccugcuccuccagccccucca

SEQ ID NO: 1185584 - RNA, 18 nt, Human
uuccugggaagcccugac

SEQ ID NO: 1185585 - RNA, 18 nt, Human
uuccuggucuggcugucc

SEQ ID NO: 1185586 - RNA, 24 nt, Human
uucugcugauggcucucccuucca

SEQ ID NO: 1185587 - RNA, 20 nt, Human
uugcugauugaaaagagauc

SEQ ID NO: 1185588 - RNA, 24 nt, Human
uuggaacauccccuguuuugcuga

SEQ ID NO: 1185589 - RNA, 21 nt, Human
uuuugugcugaggaacccccc

SEQ ID NO: 1185590 - RNA, 24 nt, Human
uuuugugcugaggaaccccccauc

SEQ ID NO: 1185591 - RNA, 19 nt, Human
uuuuucccguccccuccac

SEQ ID NO: 1185592 - RNA, 19 nt, Human
aggcuguggcaagaacagg

SEQ ID NO: 1185593 - RNA, 21 nt, Human
caaagaggacccaggccugga

SEQ ID NO: 1185594 - RNA, 22 nt, Human
cagccugucaaagaggacccag

SEQ ID NO: 1185595 - RNA, 20 nt, Human
gaggacccaggccuggacug

SEQ ID NO: 1185596 - RNA, 22 nt, Human
ggccuggacugaguuggggugg

SEQ ID NO: 1185597 - RNA, 21 nt, Human
ugaguugggguggugggaggc

SEQ ID NO: 1185598 - RNA, 23 nt, Human
ugggaggcuguggcaagaacagg

SEQ ID NO: 1185599 - RNA, 19 nt, Human
ugggguggugggaggcugu

SEQ ID NO: 1185600 - RNA, 23 nt, Human
uucacugaacucuuuguucacca

SEQ ID NO: 1185601 - RNA, 19 nt, Human
aaaaagacuuagaacauaa

SEQ ID NO: 1185602 - RNA, 24 nt, Human
aaaagagcaaccaaaaaagggggc

SEQ ID NO: 1185603 - RNA, 23 nt, Human
aaagagcaaccaaaaaagggggc

SEQ ID NO: 1185604 - RNA, 21 nt, Human
aaagcagaaaaagagcaacca

SEQ ID NO: 1185605 - RNA, 22 nt, Human
aacacugaauaauauuccauug

SEQ ID NO: 1185606 - RNA, 20 nt, Human
aacauagcaagaccccaugu

SEQ ID NO: 1185607 - RNA, 26 nt, Human
aacauuccuccaugucuucauggcuu

SEQ ID NO: 1185608 - RNA, 26 nt, Human
aaccuugaaagcagaaaaagagcaac

SEQ ID NO: 1185609 - RNA, 19 nt, Human
aagcagaaaaagagcaacc

SEQ ID NO: 1185610 - RNA, 23 nt, Human
aagcagaaaaagagcaaccaaaa

SEQ ID NO: 1185611 - RNA, 18 nt, Human
aaggcacaucuaagucaa

SEQ ID NO: 1185612 - RNA, 18 nt, Human
aaugaaugacaguuucug

SEQ ID NO: 1185613 - RNA, 27 nt, Human
acacagcccuuucaaauuggcuuuuuu

SEQ ID NO: 1185614 - RNA, 23 nt, Human
acaccuauaauccuaccacuuug

SEQ ID NO: 1185615 - RNA, 19 nt, Human
acauaacacuuucaagccc

SEQ ID NO: 1185616 - RNA, 20 nt, Human
accuugaaagcagaaaaaga

SEQ ID NO: 1185617 - RNA, 22 nt, Human
accuugaaagcagaaaaagagc

SEQ ID NO: 1185618 - RNA, 21 nt, Human
agaacuuuccccacuucguau

SEQ ID NO: 1185619 - RNA, 24 nt, Human
aggauugcuugaagccaggaguuu

SEQ ID NO: 1185620 - RNA, 21 nt, Human
aggccaagguggaaggauugc

SEQ ID NO: 1185621 - RNA, 22 nt, Human
auagcaagaccccaugucuaca

SEQ ID NO: 1185622 - RNA, 18 nt, Human
auuauuuucuuccucugc

SEQ ID NO: 1185623 - RNA, 24 nt, Human
auugcuugaagccaggaguuuaag

SEQ ID NO: 1185624 - RNA, 22 nt, Human
caaccuuaacuuuucauggccc

SEQ ID NO: 1185625 - RNA, 21 nt, Human
caagcuaauauaaaccuugaa

SEQ ID NO: 1185626 - RNA, 25 nt, Human
caagcuaauauaaaccuugaaagca

SEQ ID NO: 1185627 - RNA, 26 nt, Human
caagguggaaggauugcuugaagcca

SEQ ID NO: 1185628 - RNA, 19 nt, Human
caaugaaugacaguuucug

SEQ ID NO: 1185629 - RNA, 24 nt, Human
cacauccuuaccagcauuuggugu

SEQ ID NO: 1185630 - RNA, 19 nt, Human
caccuauaauccuaccacu

SEQ ID NO: 1185631 - RNA, 23 nt, Human
caccuauaauccuaccacuuugg

SEQ ID NO: 1185632 - RNA, 24 nt, Human
caccuauaauccuaccacuuuggg

SEQ ID NO: 1185633 - RNA, 21 nt, Human
cagaaaaagagcaaccaaaaa

SEQ ID NO: 1185634 - RNA, 22 nt, Human
cauaacacuuucaagcccuugc

SEQ ID NO: 1185635 - RNA, 28 nt, Human
cauaaugaacaaaaucucagagacuugg

SEQ ID NO: 1185636 - RNA, 25 nt, Human
cauagcaagaccccaugucuacaaa

SEQ ID NO: 1185637 - RNA, 22 nt, Human
cauuuugcuauugcugagugaa

SEQ ID NO: 1185638 - RNA, 23 nt, Human
ccuauaauccuaccacuuuggga

SEQ ID NO: 1185639 - RNA, 19 nt, Human
cuacaaaaccuccuaaaac

SEQ ID NO: 1185640 - RNA, 20 nt, Human
cuuuacagcuauucugcacu

SEQ ID NO: 1185641 - RNA, 18 nt, Human
gagagcuacaaaaccucc

SEQ ID NO: 1185642 - RNA, 21 nt, Human
gagcuuacaccuauaauccua

SEQ ID NO: 1185643 - RNA, 21 nt, Human
gaguaacagaguggaaaaaga

SEQ ID NO: 1185644 - RNA, 24 nt, Human
gauugcuugaagccaggaguuuaa

SEQ ID NO: 1185645 - RNA, 23 nt, Human
gcaggguuuuguguggacauaag

SEQ ID NO: 1185646 - RNA, 22 nt, Human
ggauugcuugaagccaggaguu

SEQ ID NO: 1185647 - RNA, 20 nt, Human
gucugcugauuuuuuguugg

SEQ ID NO: 1185648 - RNA, 20 nt, Human
uaaccaaacacuucccagcc

SEQ ID NO: 1185649 - RNA, 25 nt, Human
uaaguuuucagcucauuuggguaau

SEQ ID NO: 1185650 - RNA, 21 nt, Human
uaauaaccaaacacuucccag

SEQ ID NO: 1185651 - RNA, 24 nt, Human
uaccacuuugggaggccaaggugg

SEQ ID NO: 1185652 - RNA, 19 nt, Human
uagcaagaccccaugucua

SEQ ID NO: 1185653 - RNA, 22 nt, Human
uaggcaacauagcaagacccca

SEQ ID NO: 1185654 - RNA, 24 nt, Human
uagugguaucucauuguuguuuua

SEQ ID NO: 1185655 - RNA, 21 nt, Human
ucagagaacaaacuauuugau

SEQ ID NO: 1185656 - RNA, 23 nt, Human
ucagggcaaaauauuuucaaucu

SEQ ID NO: 1185657 - RNA, 25 nt, Human
ucuaaagugcccuucuuuaucuuuu

SEQ ID NO: 1185658 - RNA, 20 nt, Human
ucuaucaacuucugagagac

SEQ ID NO: 1185659 - RNA, 21 nt, Human
ucuuccucugcuugcuuugag

SEQ ID NO: 1185660 - RNA, 23 nt, Human
ugaaaaguauaauuucuuaagua

SEQ ID NO: 1185661 - RNA, 18 nt, Human
ugaaagcagaaaaagagc

SEQ ID NO: 1185662 - RNA, 19 nt, Human
ugaaagcagaaaaagagca

SEQ ID NO: 1185663 - RNA, 22 nt, Human
ugaaagcagaaaaagagcaacc

SEQ ID NO: 1185664 - RNA, 20 nt, Human
ugaaugacaguuucuguugg

SEQ ID NO: 1185665 - RNA, 19 nt, Human
ugauuuaagaacuuucccc

SEQ ID NO: 1185666 - RNA, 19 nt, Human
ugauuuagucuuuagccca

SEQ ID NO: 1185667 - RNA, 21 nt, Human
ugcuauaaacauccaugugca

SEQ ID NO: 1185668 - RNA, 20 nt, Human
uggaaaaagacuuagaacau

SEQ ID NO: 1185669 - RNA, 24 nt, Human
uggaaaaagacuuagaacauaaug

SEQ ID NO: 1185670 - RNA, 22 nt, Human
ugggaggccaagguggaaggau

SEQ ID NO: 1185671 - RNA, 24 nt, Human
ugggaggccaagguggaaggauug

SEQ ID NO: 1185672 - RNA, 21 nt, Human
uguguagugguaucucauugu

SEQ ID NO: 1185673 - RNA, 26 nt, Human
uuaucuuauuguuuuugguuuccaau

SEQ ID NO: 1185674 - RNA, 19 nt, Human
uucaaauuggcuuuuuuca

SEQ ID NO: 1185675 - RNA, 20 nt, Human
uucaaccuuuuuaauauuua

SEQ ID NO: 1185676 - RNA, 21 nt, Human
uuccaaaugcuugggguuuuc

SEQ ID NO: 1185677 - RNA, 22 nt, Human
uugaagccaggaguuuaagacc

SEQ ID NO: 1185678 - RNA, 24 nt, Human
uugucuccucugacauuuguuucu

SEQ ID NO: 1185679 - RNA, 23 nt, Human
uuucaaauuggcuuuuuucaguu

SEQ ID NO: 1185680 - RNA, 18 nt, Human
uuucauggcccauuuaca

SEQ ID NO: 1185681 - RNA, 20 nt, Human
uuucuugugcuuacuauuua

SEQ ID NO: 1185682 - RNA, 21 nt, Human
aaacuugaagcuggacucuga

SEQ ID NO: 1185683 - RNA, 22 nt, Human
aacuaaacuugaagcuggacuc

SEQ ID NO: 1185684 - RNA, 22 nt, Human
aagaacauaaaaccacaagagc

SEQ ID NO: 1185685 - RNA, 18 nt, Human
aagagcuuuuugaguggg

SEQ ID NO: 1185686 - RNA, 21 nt, Human
acacaccauccaccccaaaca

SEQ ID NO: 1185687 - RNA, 22 nt, Human
acagacauguauucugugucuc

SEQ ID NO: 1185688 - RNA, 21 nt, Human
accaguguggagacguagcuu

SEQ ID NO: 1185689 - RNA, 21 nt, Human
aggcuuuaagccuuggaaaua

SEQ ID NO: 1185690 - RNA, 23 nt, Human
aggucaagaacauaaaaccacaa

SEQ ID NO: 1185691 - RNA, 24 nt, Human
auaaaaccacaagagcuuuuugag

SEQ ID NO: 1185692 - RNA, 21 nt, Human
aucaacuaaacuugaagcugg

SEQ ID NO: 1185693 - RNA, 18 nt, Human
cacaguguuuggcaaagu

SEQ ID NO: 1185694 - RNA, 21 nt, Human
caccauccaccccaaacauua

SEQ ID NO: 1185695 - RNA, 23 nt, Human
cagaaugcuuacuaaaauuuuaa

SEQ ID NO: 1185696 - RNA, 22 nt, Human
cagaauuuauggaauauuaaau

SEQ ID NO: 1185697 - RNA, 26 nt, Human
caucaacuaaacuugaagcuggacuc

SEQ ID NO: 1185698 - RNA, 24 nt, Human
ccagcacaguguuuggcaaaguca

SEQ ID NO: 1185699 - RNA, 24 nt, Human
ccgacacaccauccaccccaaaca

SEQ ID NO: 1185700 - RNA, 23 nt, Human
ccuuaaacaugccauuuugccuc

SEQ ID NO: 1185701 - RNA, 23 nt, Human
cuggccccuaaauuuucuuucuc

SEQ ID NO: 1185702 - RNA, 22 nt, Human
cuuccauaaccgacacaccauc

SEQ ID NO: 1185703 - RNA, 23 nt, Human
gaccaagaaauacguauuuuagu

SEQ ID NO: 1185704 - RNA, 21 nt, Human
gauccccuuaaaugacacuuc

SEQ ID NO: 1185705 - RNA, 24 nt, Human
ggcuuuaagccuuggaaauaaucu

SEQ ID NO: 1185706 - RNA, 20 nt, Human
guagagugugcauaccugua

SEQ ID NO: 1185707 - RNA, 21 nt, Human
gugugcauaccuguauacaug

SEQ ID NO: 1185708 - RNA, 21 nt, Human
uaaaauagacugcaagguuca

SEQ ID NO: 1185709 - RNA, 20 nt, Human
uaauuugcccuguggaaaaa

SEQ ID NO: 1185710 - RNA, 24 nt, Human
uacagaaugcuuacuaaaauuuua

SEQ ID NO: 1185711 - RNA, 18 nt, Human
uagaaaaugcaugcggua

SEQ ID NO: 1185712 - RNA, 20 nt, Human
uauaaaauagacugcaaggu

SEQ ID NO: 1185713 - RNA, 19 nt, Human
uauggaaauauauguguag

SEQ ID NO: 1185714 - RNA, 21 nt, Human
uauggaauauuaaauauaugg

SEQ ID NO: 1185715 - RNA, 20 nt, Human
ucacaaaugaaaggggcuua

SEQ ID NO: 1185716 - RNA, 23 nt, Human
uccaccccaaacauuagaaaaug

SEQ ID NO: 1185717 - RNA, 18 nt, Human
ucccauugaccuacaaug

SEQ ID NO: 1185718 - RNA, 24 nt, Human
ucuaugccuuccauaaccgacaca

SEQ ID NO: 1185719 - RNA, 23 nt, Human
ugaaagauuauuuuauucagcuu

SEQ ID NO: 1185720 - RNA, 24 nt, Human
ugaaugagaggacuccaguugaaa

SEQ ID NO: 1185721 - RNA, 24 nt, Human
ugaccuacaaugagcauuugaucc

SEQ ID NO: 1185722 - RNA, 20 nt, Human
uggugguagaauuuucagaa

SEQ ID NO: 1185723 - RNA, 26 nt, Human
uguagagugugcauaccuguauacau

SEQ ID NO: 1185724 - RNA, 19 nt, Human
uguggagacguagcuuguc

SEQ ID NO: 1185725 - RNA, 19 nt, Human
uguguagaccaguguggag

SEQ ID NO: 1185726 - RNA, 21 nt, Human
uugaaaccaaagaaaucucau

SEQ ID NO: 1185727 - RNA, 20 nt, Human
uuuauucagcuucaggcuuu

SEQ ID NO: 1185728 - RNA, 22 nt, Human
uuucauggaguucugguugagg

SEQ ID NO: 1185729 - RNA, 20 nt, Human
uuuuccacaaaaacaacuuu

SEQ ID NO: 1185730 - RNA, 22 nt, Human
aaaaaaaauaggagcagcaaau

SEQ ID NO: 1185731 - RNA, 25 nt, Human
aaaaaaaauaggagcagccgguacc

SEQ ID NO: 1185732 - RNA, 27 nt, Human
aaacagaaaaaaaaauaggagcagggu

SEQ ID NO: 1185733 - RNA, 18 nt, Human
aauacauuuucucuagac

SEQ ID NO: 1185734 - RNA, 18 nt, Human
agaagaauucuuaugaga

SEQ ID NO: 1185735 - RNA, 18 nt, Human
cacugacugcuggugugu

SEQ ID NO: 1185736 - RNA, 20 nt, Human
cagaaaaaaaaauaggagca

SEQ ID NO: 1185737 - RNA, 23 nt, Human
cagaaggugccaaacagguuuca

SEQ ID NO: 1185738 - RNA, 23 nt, Human
cagaaugccuuaucuucuuuuaa

SEQ ID NO: 1185739 - RNA, 24 nt, Human
gugaggugccuucugaagaagaga

SEQ ID NO: 1185740 - RNA, 20 nt, Human
guuuaguuuuugguguuuag

SEQ ID NO: 1185741 - RNA, 20 nt, Human
uaaaaagguauaauauggua

SEQ ID NO: 1185742 - RNA, 19 nt, Human
uagagacccaagaaagcaa

SEQ ID NO: 1185743 - RNA, 20 nt, Human
uagagacccaagaaagcaac

SEQ ID NO: 1185744 - RNA, 24 nt, Human
uagagacccaagaaagcaacucaa

SEQ ID NO: 1185745 - RNA, 22 nt, Human
uauggaagagcaguuuguaaua

SEQ ID NO: 1185746 - RNA, 20 nt, Human
ucaaaguuuuccucacugac

SEQ ID NO: 1185747 - RNA, 27 nt, Human
ucuucuuuuucuuuuuuuuuuucuuuu

SEQ ID NO: 1185748 - RNA, 20 nt, Human
ucuuucuucuuuuucuuuuu

SEQ ID NO: 1185749 - RNA, 24 nt, Human
ucuuuuucuuuuuuuuuuucuuuu

SEQ ID NO: 1185750 - RNA, 22 nt, Human
uuccagaaggugccaaacaggu

SEQ ID NO: 1185751 - RNA, 29 nt, Human
uucuuuuucuuuuuuuuuuucuuuuuuuc

SEQ ID NO: 1185752 - RNA, 26 nt, Human
uugugucuuucuucuuuuucuuuuuu

SEQ ID NO: 1185753 - RNA, 18 nt, Human
uuguucaaaguuuuccuc

SEQ ID NO: 1185754 - RNA, 20 nt, Human
uuuagagacucccuuccucu

SEQ ID NO: 1185755 - RNA, 18 nt, Human
uuucaacaucauauuaau

SEQ ID NO: 1185756 - RNA, 24 nt, Human
uuuguuugcacucagaaugccuua

SEQ ID NO: 1185757 - RNA, 23 nt, Human
uuuuucuuuuuuuuuuucuuuuu

SEQ ID NO: 1185758 - RNA, 26 nt, Human
uuuuuuuuuuucuuuuuuacaauagg

SEQ ID NO: 1185759 - RNA, 20 nt, Human
aaaacaaacaaacacgaaaa

SEQ ID NO: 1185760 - RNA, 24 nt, Human
aaaacaagacagaauucaaguacc

SEQ ID NO: 1185761 - RNA, 23 nt, Human
aaacaaaagggagggacaccugg

SEQ ID NO: 1185762 - RNA, 20 nt, Human
aaacaaacaaacacgaaaaa

SEQ ID NO: 1185763 - RNA, 22 nt, Human
aaacaaacacgaaaaaccuuug

SEQ ID NO: 1185764 - RNA, 24 nt, Human
aaagaaacaaaacaaacaaacacg

SEQ ID NO: 1185765 - RNA, 21 nt, Human
aaggacacaggccuccaaaac

SEQ ID NO: 1185766 - RNA, 22 nt, Human
aaggccccucugagcccgggcc

SEQ ID NO: 1185767 - RNA, 18 nt, Human
aaucacaaucguguacga

SEQ ID NO: 1185768 - RNA, 19 nt, Human
acaaugcggaaaacaagac

SEQ ID NO: 1185769 - RNA, 22 nt, Human
acaauggaagcgacugaucgga

SEQ ID NO: 1185770 - RNA, 23 nt, Human
acacacaugcacagacgcgcaca

SEQ ID NO: 1185771 - RNA, 27 nt, Human
acacacaugcacagacgcgcacacaca

SEQ ID NO: 1185772 - RNA, 21 nt, Human
acacacgcgugcacacauaca

SEQ ID NO: 1185773 - RNA, 33 nt, Human
acacgcacacacacacagacacgcgcacacggu

SEQ ID NO: 1185774 - RNA, 19 nt, Human
acagcagguccgcucagca

SEQ ID NO: 1185775 - RNA, 22 nt, Human
acagcagucaggcguccucugu

SEQ ID NO: 1185776 - RNA, 19 nt, Human
acccagcugccuccugggc

SEQ ID NO: 1185777 - RNA, 24 nt, Human
accugugcccaagacaggggagga

SEQ ID NO: 1185778 - RNA, 31 nt, Human
acgcacacacacacagacacgcgcacacgca

SEQ ID NO: 1185779 - RNA, 33 nt, Human
acgcgugcacacauacacagacacgcgugcagu

SEQ ID NO: 1185780 - RNA, 27 nt, Human
acgcgugcagagacacgcacgugcaca

SEQ ID NO: 1185781 - RNA, 30 nt, Human
acgugcacacacagacacgcacacacacag

SEQ ID NO: 1185782 - RNA, 19 nt, Human
agaacucggguggacagac

SEQ ID NO: 1185783 - RNA, 24 nt, Human
agacacgcgcacacgcacacucuc

SEQ ID NO: 1185784 - RNA, 19 nt, Human
agaggaaggcagggcagga

SEQ ID NO: 1185785 - RNA, 22 nt, Human
agaggaaggcagggcaggagag

SEQ ID NO: 1185786 - RNA, 22 nt, Human
agaugaaggaaacuccagaggg

SEQ ID NO: 1185787 - RNA, 21 nt, Human
agcaacagacauuucaagucu

SEQ ID NO: 1185788 - RNA, 21 nt, Human
agccacgcacguccacagaca

SEQ ID NO: 1185789 - RNA, 22 nt, Human
aggaaggcagggcaggagaggc

SEQ ID NO: 1185790 - RNA, 21 nt, Human
aggacaaccccggauucuaga

SEQ ID NO: 1185791 - RNA, 21 nt, Human
aggacacaggccuccaaaaca

SEQ ID NO: 1185792 - RNA, 18 nt, Human
aggcaguacacggcuggg

SEQ ID NO: 1185793 - RNA, 22 nt, Human
aggcaguacacggcuggguggg

SEQ ID NO: 1185794 - RNA, 23 nt, Human
aggccuccaaaacaaaagggagg

SEQ ID NO: 1185795 - RNA, 21 nt, Human
agggagggacaccuggguagg

SEQ ID NO: 1185796 - RNA, 24 nt, Human
agggggaccagcccucccucccua

SEQ ID NO: 1185797 - RNA, 21 nt, Human
agggucuggaugagucagggu

SEQ ID NO: 1185798 - RNA, 21 nt, Human
agguggccacaccagcacuuc

SEQ ID NO: 1185799 - RNA, 18 nt, Human
auaaaggugcagacaucu

SEQ ID NO: 1185800 - RNA, 22 nt, Human
aucuauagcucuugccuuccuu

SEQ ID NO: 1185801 - RNA, 23 nt, Human
caaaacaaacaaacacgaaaaac

SEQ ID NO: 1185802 - RNA, 24 nt, Human
caaacaaacacgaaaaaccuuugc

SEQ ID NO: 1185803 - RNA, 21 nt, Human
caaaguacaacaaccaaaucc

SEQ ID NO: 1185804 - RNA, 20 nt, Human
caagacagaauucaaguacc

SEQ ID NO: 1185805 - RNA, 21 nt, Human
caagacaggggaggaagaggc

SEQ ID NO: 1185806 - RNA, 20 nt, Human
cacaaugcggaaaacaagac

SEQ ID NO: 1185807 - RNA, 31 nt, Human
cacacacacgcgcacacagacgcacacacag

SEQ ID NO: 1185808 - RNA, 24 nt, Human
cacacacagacacgcacacacaca

SEQ ID NO: 1185809 - RNA, 28 nt, Human
cacacacagacgcacagacgugcacaca

SEQ ID NO: 1185810 - RNA, 30 nt, Human
cacacacgcgcacacagacgcacacacaca

SEQ ID NO: 1185811 - RNA, 31 nt, Human
cacacgcgugcacacauacacagacacgcgg

SEQ ID NO: 1185812 - RNA, 19 nt, Human
cacauacacagacacgcgu

SEQ ID NO: 1185813 - RNA, 29 nt, Human
cacauacacagacacgcgugcagagacac

SEQ ID NO: 1185814 - RNA, 21 nt, Human
caccagcacuucacacaggac

SEQ ID NO: 1185815 - RNA, 22 nt, Human
cacccacggagcuggcuggcug

SEQ ID NO: 1185816 - RNA, 24 nt, Human
cacgcacacacacacagacacgcg

SEQ ID NO: 1185817 - RNA, 30 nt, Human
cacgcacgugcacacagacgcgcgugcaca

SEQ ID NO: 1185818 - RNA, 22 nt, Human
cacucuggaaggccccucugag

SEQ ID NO: 1185819 - RNA, 23 nt, Human
cagacacaaugcggaaaacaaga

SEQ ID NO: 1185820 - RNA, 29 nt, Human
cagacacacgcgugcacacauacagugug

SEQ ID NO: 1185821 - RNA, 21 nt, Human
cagacacucccgacucacgcc

SEQ ID NO: 1185822 - RNA, 29 nt, Human
cagacgcacacacgcacagacacacacag

SEQ ID NO: 1185823 - RNA, 20 nt, Human
cagagaacucggguggacag

SEQ ID NO: 1185824 - RNA, 18 nt, Human
cagagagagcccuucugu

SEQ ID NO: 1185825 - RNA, 23 nt, Human
cagcccucccucccuaccuuccg

SEQ ID NO: 1185826 - RNA, 21 nt, Human
cagcggcucccucccuguccu

SEQ ID NO: 1185827 - RNA, 18 nt, Human
cagcugccuccugggccc

SEQ ID NO: 1185828 - RNA, 22 nt, Human
cagggagagcucagaacccauu

SEQ ID NO: 1185829 - RNA, 25 nt, Human
caggggaggaagaggcagagaaagg

SEQ ID NO: 1185830 - RNA, 27 nt, Human
cauacacagacacgcgugcagagacac

SEQ ID NO: 1185831 - RNA, 22 nt, Human
caugcaacccagcugccuccug

SEQ ID NO: 1185832 - RNA, 21 nt, Human
ccaaaacaaaagggagggaca

SEQ ID NO: 1185833 - RNA, 24 nt, Human
ccaaaacaaaagggagggacaaca

SEQ ID NO: 1185834 - RNA, 22 nt, Human
ccaaagaaacaaaacaaacaaa

SEQ ID NO: 1185835 - RNA, 23 nt, Human
ccaagacaggggaggaagaggca

SEQ ID NO: 1185836 - RNA, 24 nt, Human
ccaccugccaggcggcagcuccaa

SEQ ID NO: 1185837 - RNA, 19 nt, Human
ccagcccucccucccuacc

SEQ ID NO: 1185838 - RNA, 22 nt, Human
ccagcgggccccaugggggcuc

SEQ ID NO: 1185839 - RNA, 26 nt, Human
ccagcugccuccugggcccauccccu

SEQ ID NO: 1185840 - RNA, 19 nt, Human
ccaggcccccagggauggu

SEQ ID NO: 1185841 - RNA, 31 nt, Human
cccagccaggcgcggcccgccgggcucacag

SEQ ID NO: 1185842 - RNA, 21 nt, Human
cccagcugccuccugggccca

SEQ ID NO: 1185843 - RNA, 24 nt, Human
ccccugcuccaccccgcggcuucc

SEQ ID NO: 1185844 - RNA, 26 nt, Human
ccccuggacaaggacacaggccucca

SEQ ID NO: 1185845 - RNA, 19 nt, Human
cccgcagucaccaacgccg

SEQ ID NO: 1185846 - RNA, 23 nt, Human
cccgccccacgguacauucagga

SEQ ID NO: 1185847 - RNA, 21 nt, Human
cccggggcgcagggagagcuc

SEQ ID NO: 1185848 - RNA, 23 nt, Human
cccuggacaaggacacaggccuc

SEQ ID NO: 1185849 - RNA, 18 nt, Human
cccuuggggaagaggaag

SEQ ID NO: 1185850 - RNA, 22 nt, Human
ccgcccccgccccacgguacau

SEQ ID NO: 1185851 - RNA, 18 nt, Human
ccgcccggggcgcaggga

SEQ ID NO: 1185852 - RNA, 24 nt, Human
ccgggcucacaguaucugucacac

SEQ ID NO: 1185853 - RNA, 22 nt, Human
ccuaccugccccugcuccaccc

SEQ ID NO: 1185854 - RNA, 18 nt, Human
ccuccggucccuccugga

SEQ ID NO: 1185855 - RNA, 19 nt, Human
ccucugagcccgggccgcc

SEQ ID NO: 1185856 - RNA, 23 nt, Human
ccucugagcccgggccgccgccc

SEQ ID NO: 1185857 - RNA, 19 nt, Human
ccucugugcagccaccacc

SEQ ID NO: 1185858 - RNA, 20 nt, Human
ccucugugcagccaccaccu

SEQ ID NO: 1185859 - RNA, 21 nt, Human
ccugccccugcuccaccccgc

SEQ ID NO: 1185860 - RNA, 19 nt, Human
ccuggaggagaaaggaggc

SEQ ID NO: 1185861 - RNA, 18 nt, Human
ccugugcccaagacaggg

SEQ ID NO: 1185862 - RNA, 19 nt, Human
ccugugugcacaccggagg

SEQ ID NO: 1185863 - RNA, 20 nt, Human
cgcacacacacacagacacg

SEQ ID NO: 1185864 - RNA, 25 nt, Human
cgcacacacacgcgcacacagacgc

SEQ ID NO: 1185865 - RNA, 22 nt, Human
cgcacacagacgcacacacaca

SEQ ID NO: 1185866 - RNA, 28 nt, Human
cgcgcacacacagacgcacagacgugca

SEQ ID NO: 1185867 - RNA, 24 nt, Human
cggcuccuauguucuaggagcccc

SEQ ID NO: 1185868 - RNA, 23 nt, Human
cggcuuccucccaucuccgagga

SEQ ID NO: 1185869 - RNA, 19 nt, Human
cgugcacacagacgcgcgu

SEQ ID NO: 1185870 - RNA, 19 nt, Human
cuccaaccccaccugugcc

SEQ ID NO: 1185871 - RNA, 24 nt, Human
cuccuggcucuaaacacaaaugcc

SEQ ID NO: 1185872 - RNA, 22 nt, Human
cucuccaugcaacccagcugcc

SEQ ID NO: 1185873 - RNA, 20 nt, Human
cugccccugcuccaccccgc

SEQ ID NO: 1185874 - RNA, 18 nt, Human
cuggccaagggugggggg

SEQ ID NO: 1185875 - RNA, 19 nt, Human
cuggccacaccugggaagg

SEQ ID NO: 1185876 - RNA, 22 nt, Human
cugggugggguggggggacugg

SEQ ID NO: 1185877 - RNA, 23 nt, Human
gaaacaaaacaaacaaacacgaa

SEQ ID NO: 1185878 - RNA, 25 nt, Human
gaacaaaacagacggcgauuacaaa

SEQ ID NO: 1185879 - RNA, 19 nt, Human
gaagccgaguucuggaggg

SEQ ID NO: 1185880 - RNA, 22 nt, Human
gacaaaaguaugcagcagcaac

SEQ ID NO: 1185881 - RNA, 28 nt, Human
gacacgcacacacacacagacacgcgca

SEQ ID NO: 1185882 - RNA, 28 nt, Human
gacgcacacacacagacgcacacacgca

SEQ ID NO: 1185883 - RNA, 28 nt, Human
gacgugcacacacagacacgcacacaca

SEQ ID NO: 1185884 - RNA, 18 nt, Human
gacucacgcccaccgugg

SEQ ID NO: 1185885 - RNA, 20 nt, Human
gagguugggggaguggggug

SEQ ID NO: 1185886 - RNA, 22 nt, Human
gaugaaggaaacuccagaggga

SEQ ID NO: 1185887 - RNA, 20 nt, Human
gauucugcaugauuuuccuu

SEQ ID NO: 1185888 - RNA, 23 nt, Human
gcacacacacagacgcacacacg

SEQ ID NO: 1185889 - RNA, 29 nt, Human
gcacacacgcacagacacacacaugcaca

SEQ ID NO: 1185890 - RNA, 28 nt, Human
gcacacacgcacagacacacacaugcag

SEQ ID NO: 1185891 - RNA, 21 nt, Human
gcacccccaggcggguccugc

SEQ ID NO: 1185892 - RNA, 28 nt, Human
gcacuagagcccccucagagggggacca

SEQ ID NO: 1185893 - RNA, 19 nt, Human
gcacuuguuuugcaaguga

SEQ ID NO: 1185894 - RNA, 21 nt, Human
gcagagagagcccuucuguca

SEQ ID NO: 1185895 - RNA, 21 nt, Human
gcagaggcagacagaggguuc

SEQ ID NO: 1185896 - RNA, 20 nt, Human
gcagggcugcacuuguuuug

SEQ ID NO: 1185897 - RNA, 22 nt, Human
gccaagauguuuccauaaaaau

SEQ ID NO: 1185898 - RNA, 20 nt, Human
gccaccgcucacuggccugu

SEQ ID NO: 1185899 - RNA, 24 nt, Human
gccacgcacguccacagacacucc

SEQ ID NO: 1185900 - RNA, 21 nt, Human
gcccauccccuuggggaagag

SEQ ID NO: 1185901 - RNA, 20 nt, Human
gccuccaaaacaaaagggag

SEQ ID NO: 1185902 - RNA, 21 nt, Human
gccugugugcacaccggaggg

SEQ ID NO: 1185903 - RNA, 25 nt, Human
gcgcacacacacgcgcacacagacg

SEQ ID NO: 1185904 - RNA, 31 nt, Human
gcgcgugcacacacacagacacacgcgugca

SEQ ID NO: 1185905 - RNA, 31 nt, Human
gcgcgugcacacauacacacagacgcgcaca

SEQ ID NO: 1185906 - RNA, 27 nt, Human
gcgugcacacacacagacacacgcggg

SEQ ID NO: 1185907 - RNA, 31 nt, Human
gcgugcacacacacagacacacgcgugcaca

SEQ ID NO: 1185908 - RNA, 18 nt, Human
gcugaugggcgcagggcu

SEQ ID NO: 1185909 - RNA, 25 nt, Human
ggaaaacaagacagaauucaaguac

SEQ ID NO: 1185910 - RNA, 18 nt, Human
ggagguugggggaguggg

SEQ ID NO: 1185911 - RNA, 26 nt, Human
ggcugggugggguggggggacugggc

SEQ ID NO: 1185912 - RNA, 20 nt, Human
gggaacucaagugcagcuca

SEQ ID NO: 1185913 - RNA, 21 nt, Human
gggaagaggaaggcagggcag

SEQ ID NO: 1185914 - RNA, 23 nt, Human
gggaccagcccucccucccuacc

SEQ ID NO: 1185915 - RNA, 20 nt, Human
gggccccaugggggcuccaa

SEQ ID NO: 1185916 - RNA, 23 nt, Human
ggggaguggggugcgcuggucgg

SEQ ID NO: 1185917 - RNA, 24 nt, Human
gucaggcacuagagcccccucaga

SEQ ID NO: 1185918 - RNA, 18 nt, Human
gucagggucacacucaca

SEQ ID NO: 1185919 - RNA, 29 nt, Human
gugcacacacacagacacacgcgugcaca

SEQ ID NO: 1185920 - RNA, 23 nt, Human
gugcacacauacacagacacgcg

SEQ ID NO: 1185921 - RNA, 19 nt, Human
uacacggcuggguggggug

SEQ ID NO: 1185922 - RNA, 19 nt, Human
uaccaaacccuaaaugcuc

SEQ ID NO: 1185923 - RNA, 20 nt, Human
uaccaaacccuaaaugcucc

SEQ ID NO: 1185924 - RNA, 19 nt, Human
uacgagccggucguccagu

SEQ ID NO: 1185925 - RNA, 21 nt, Human
uacgaugcuaacaauggaagc

SEQ ID NO: 1185926 - RNA, 21 nt, Human
uagaucccaggcccaccaccu

SEQ ID NO: 1185927 - RNA, 22 nt, Human
ucaggacguggagggagcacaa

SEQ ID NO: 1185928 - RNA, 18 nt, Human
ucccagcgggccccaugg

SEQ ID NO: 1185929 - RNA, 18 nt, Human
ucccaggcccaccaccug

SEQ ID NO: 1185930 - RNA, 23 nt, Human
uccccuagcggaggcggccuccg

SEQ ID NO: 1185931 - RNA, 21 nt, Human
uccgccuuccuccuggcucua

SEQ ID NO: 1185932 - RNA, 18 nt, Human
uccuggaccucuccaugc

SEQ ID NO: 1185933 - RNA, 22 nt, Human
uccuggccaagggugggggggc

SEQ ID NO: 1185934 - RNA, 24 nt, Human
ucggccaccgcucacuggccugug

SEQ ID NO: 1185935 - RNA, 21 nt, Human
ucuaaacacaaaugccaaaga

SEQ ID NO: 1185936 - RNA, 19 nt, Human
ucuaggagccccgacccgc

SEQ ID NO: 1185937 - RNA, 22 nt, Human
ucuccaugcaacccagcugccu

SEQ ID NO: 1185938 - RNA, 21 nt, Human
ucuccgaggaaggcuuggucc

SEQ ID NO: 1185939 - RNA, 22 nt, Human
ucuggaaggccccucugagccc

SEQ ID NO: 1185940 - RNA, 19 nt, Human
ucuggccacaccugggaag

SEQ ID NO: 1185941 - RNA, 22 nt, Human
ucugugagcccuaccacuuaaa

SEQ ID NO: 1185942 - RNA, 26 nt, Human
ucuuguaccaaacccuaaaugcuccc

SEQ ID NO: 1185943 - RNA, 26 nt, Human
ugaaacaguaguuacagcugaggaca

SEQ ID NO: 1185944 - RNA, 20 nt, Human
ugacaugacaaaaguaugca

SEQ ID NO: 1185945 - RNA, 25 nt, Human
ugacgugcacgcgcgugcacacaca

SEQ ID NO: 1185946 - RNA, 18 nt, Human
ugaggaaggggcacggga

SEQ ID NO: 1185947 - RNA, 19 nt, Human
ugauggguuguggagguug

SEQ ID NO: 1185948 - RNA, 19 nt, Human
ugcacacacagacacgcac

SEQ ID NO: 1185949 - RNA, 24 nt, Human
ugcacacauacacacagacgcgca

SEQ ID NO: 1185950 - RNA, 26 nt, Human
ugcacacauacacacagacgcgcaca

SEQ ID NO: 1185951 - RNA, 18 nt, Human
ugcagcucaaccucaccu

SEQ ID NO: 1185952 - RNA, 21 nt, Human
ugccuccugggcccauccccu

SEQ ID NO: 1185953 - RNA, 19 nt, Human
ugccuuccuuacccagaac

SEQ ID NO: 1185954 - RNA, 20 nt, Human
uggcagaggcagacagaggg

SEQ ID NO: 1185955 - RNA, 22 nt, Human
uggcagaggcagacagaggguu

SEQ ID NO: 1185956 - RNA, 23 nt, Human
uggcagaggcagacagaggguuc

SEQ ID NO: 1185957 - RNA, 20 nt, Human
ugggacacauuagugcaaaa

SEQ ID NO: 1185958 - RNA, 20 nt, Human
ugggaugggggguucuucug

SEQ ID NO: 1185959 - RNA, 22 nt, Human
uggggaagccgaguucuggagg

SEQ ID NO: 1185960 - RNA, 20 nt, Human
ugggggaguggggugcgcug

SEQ ID NO: 1185961 - RNA, 18 nt, Human
ugggguggggggacuggg

SEQ ID NO: 1185962 - RNA, 19 nt, Human
ugggguggggggacugggc

SEQ ID NO: 1185963 - RNA, 24 nt, Human
uggugacgugcacgcgcgugcaca

SEQ ID NO: 1185964 - RNA, 19 nt, Human
uguccuggccaaggguggg

SEQ ID NO: 1185965 - RNA, 24 nt, Human
ugugcacaccggagggggugcuga

SEQ ID NO: 1185966 - RNA, 21 nt, Human
uuaaagugcaaauuugggugu

SEQ ID NO: 1185967 - RNA, 26 nt, Human
uuacccagaacaaaacagacggcgag

SEQ ID NO: 1185968 - RNA, 23 nt, Human
uuccaaagaaacaaaacaaacaa

SEQ ID NO: 1185969 - RNA, 25 nt, Human
uuccaaagaaacaaaacaaacaaac

SEQ ID NO: 1185970 - RNA, 23 nt, Human
uucuucuggccacaccugggaag

SEQ ID NO: 1185971 - RNA, 20 nt, Human
uuggguguggggcagaugaa

SEQ ID NO: 1185972 - RNA, 22 nt, Human
uuguggagguugggggaguggg

SEQ ID NO: 1185973 - RNA, 21 nt, Human
uuuaucuauagcucuugccuu

SEQ ID NO: 1185974 - RNA, 20 nt, Human
aaaaaaagacaaaaaaaaaa

SEQ ID NO: 1185975 - RNA, 24 nt, Human
aaaaagacaaaaaaaaaaagcuag

SEQ ID NO: 1185976 - RNA, 24 nt, Human
aaaacaagacagaauucaaguacc

SEQ ID NO: 1185977 - RNA, 23 nt, Human
aaacaaaacaaaggcuuccuccu

SEQ ID NO: 1185978 - RNA, 25 nt, Human
aaagacaaaaaaaaaaagcuaagca

SEQ ID NO: 1185979 - RNA, 20 nt, Human
aaaguacaacaaccaaaucc

SEQ ID NO: 1185980 - RNA, 33 nt, Human; identical to SEQ ID NO: 1185773

SEQ ID NO: 1185981 - RNA, 22 nt, Human
acagagaacucggguggacaga

SEQ ID NO: 1185982 - RNA, 19 nt, Human
acccagcugccuccugggc

SEQ ID NO: 1185983 - RNA, 23 nt, Human
accuccggucccuccuggaccuu

SEQ ID NO: 1185984 - RNA, 31 nt, Human; identical to SEQ ID NO: 1185778

SEQ ID NO: 1185985 - RNA, 30 nt, Human; identical to SEQ ID NO: 1185781

SEQ ID NO: 1185986 - RNA, 19 nt, Human
agaacucggguggacagac

SEQ ID NO: 1185987 - RNA, 24 nt, Human
agacacgcgcacacgcacacucuc

SEQ ID NO: 1185988 - RNA, 19 nt, Human
agaggaaggcagggcagga

SEQ ID NO: 1185989 - RNA, 22 nt, Human
agaggaaggcagggcaggagag

SEQ ID NO: 1185990 - RNA, 28 nt, Human
agccaggcgcggcccgccgggcucacag

SEQ ID NO: 1185991 - RNA, 22 nt, Human
aggaaggcagggcaggagaggc

SEQ ID NO: 1185992 - RNA, 24 nt, Human
aggagaggcggcuagaucccaggc

SEQ ID NO: 1185993 - RNA, 18 nt, Human
aggcaguacacggcuggg

SEQ ID NO: 1185994 - RNA, 22 nt, Human
aggcaguacacggcuggguggg

SEQ ID NO: 1185995 - RNA, 24 nt, Human
agggggaccagcccucccucccua

SEQ ID NO: 1185996 - RNA, 23 nt, Human
agugagggcucaggaaaacaaaa

SEQ ID NO: 1185997 - RNA, 18 nt, Human
caaaaaaaaaaagcuaag

SEQ ID NO: 1185998 - RNA, 19 nt, Human
caaaacaaaggcuuccucc

SEQ ID NO: 1185999 - RNA, 24 nt, Human
caacaaccaaauccaaugcaaagu

SEQ ID NO: 1186000 - RNA, 20 nt, Human
caagacagaauucaaguacc

SEQ ID NO: 1186001 - RNA, 20 nt, Human
cacaaugcggaaaacaagac

SEQ ID NO: 1186002 - RNA, 24 nt, Human
cacacacagacacgcacacacaca

SEQ ID NO: 1186003 - RNA, 28 nt, Human
cacacacagacgcacagacgugcacaca

SEQ ID NO: 1186004 - RNA, 29 nt, Human
cacagacacgcacacacacacagacacgg

SEQ ID NO: 1186005 - RNA, 22 nt, Human
cacccacggagcuggcuggcug

SEQ ID NO: 1186006 - RNA, 22 nt, Human
caccugccaggcggcagcucca

SEQ ID NO: 1186007 - RNA, 23 nt, Human
cagacacaaugcggaaaacaaga

SEQ ID NO: 1186008 - RNA, 23 nt, Human
cagacucuuuaaaacaaccgucu

SEQ ID NO: 1186009 - RNA, 20 nt, Human
cagcacaggaaaauuuauuu

SEQ ID NO: 1186010 - RNA, 23 nt, Human
cagcccucccucccuaccuuccg

SEQ ID NO: 1186011 - RNA, 18 nt, Human
cagcugccuccugggccc

SEQ ID NO: 1186012 - RNA, 22 nt, Human
caugcaacccagcugccuccug

SEQ ID NO: 1186013 - RNA, 24 nt, Human
ccaccugccaggcggcagcuccaa

SEQ ID NO: 1186014 - RNA, 19 nt, Human
ccagcccucccucccuacc

SEQ ID NO: 1186015 - RNA, 26 nt, Human
ccagcugccuccugggcccauccccu

SEQ ID NO: 1186016 - RNA, 21 nt, Human
cccagcugccuccugggccca

SEQ ID NO: 1186017 - RNA, 19 nt, Human
cccgcagucaccaacgccg

SEQ ID NO: 1186018 - RNA, 18 nt, Human
cccuuggggaagaggaag

SEQ ID NO: 1186019 - RNA, 24 nt, Human
ccgggcucacaguaucugucacac

SEQ ID NO: 1186020 - RNA, 18 nt, Human
ccuccggucccuccugga

SEQ ID NO: 1186021 - RNA, 22 nt, Human
ccuccucaaaagguguggagau

SEQ ID NO: 1186022 - RNA, 19 nt, Human
ccuuaaaaaaaagacaaaa

SEQ ID NO: 1186023 - RNA, 20 nt, Human
cgcgcacacacagacgcaca

SEQ ID NO: 1186024 - RNA, 28 nt, Human
cgcgcacacacagacgcacagacgugca

SEQ ID NO: 1186025 - RNA, 24 nt, Human
cggcuccuauguucuaggagcccc

SEQ ID NO: 1186026 - RNA, 19 nt, Human
cucaggaaaacaaaacaaa

SEQ ID NO: 1186027 - RNA, 24 nt, Human
cuccuggcucuaaacacaaaugcc

SEQ ID NO: 1186028 - RNA, 22 nt, Human
cucuccaugcaacccagcugcc

SEQ ID NO: 1186029 - RNA, 22 nt, Human
cugggugggguggggggacugg

SEQ ID NO: 1186030 - RNA, 23 nt, Human
gaacugacuuuauuauuuuguaa

SEQ ID NO: 1186031 - RNA, 22 nt, Human
gacaaaaguaugcagcagcaac

SEQ ID NO: 1186032 - RNA, 21 nt, Human
gacacaaugcggaaaacaaga

SEQ ID NO: 1186033 - RNA, 28 nt, Human
gacacgcacacacacacagacacgcgca

SEQ ID NO: 1186034 - RNA, 21 nt, Human
gcacacacacacagacacgcg

SEQ ID NO: 1186035 - RNA, 21 nt, Human
gcacccccaggcggguccugc

SEQ ID NO: 1186036 - RNA, 28 nt, Human
gcacuagagcccccucagagggggacca

SEQ ID NO: 1186037 - RNA, 21 nt, Human
gcagaggcagacagaggguuc

SEQ ID NO: 1186038 - RNA, 20 nt, Human
gcaguacacggcuggguggg

SEQ ID NO: 1186039 - RNA, 22 nt, Human
gccaagauguuuccauaaaaau

SEQ ID NO: 1186040 - RNA, 21 nt, Human
gcccauccccuuggggaagag

SEQ ID NO: 1186041 - RNA, 18 nt, Human
gcuaagcaucuguggcug

SEQ ID NO: 1186042 - RNA, 27 nt, Human
ggaaaacaaaacaaaggcuuccucccu

SEQ ID NO: 1186043 - RNA, 25 nt, Human
ggaaaacaagacagaauucaaguac

SEQ ID NO: 1186044 - RNA, 26 nt, Human
ggcugggugggguggggggacugggc

SEQ ID NO: 1186045 - RNA, 21 nt, Human
gggaagaggaaggcagggcag

SEQ ID NO: 1186046 - RNA, 23 nt, Human
gggaccagcccucccucccuacc

SEQ ID NO: 1186047 - RNA, 20 nt, Human
gguacugugaaaccuuccuu

SEQ ID NO: 1186048 - RNA, 24 nt, Human
gugcacacacagacacgcacacac

SEQ ID NO: 1186049 - RNA, 24 nt, Human
guucgcuuuugaauguuucaguuu

SEQ ID NO: 1186050 - RNA, 22 nt, Human
uaacagcacaaaaacagaguga

SEQ ID NO: 1186051 - RNA, 27 nt, Human
uaaccccuaaacagacucuuuaaaaca

SEQ ID NO: 1186052 - RNA, 18 nt, Human
uacaaagcgcuuuacaau

SEQ ID NO: 1186053 - RNA, 21 nt, Human
uacaaagcgcuuuacaauuaa

SEQ ID NO: 1186054 - RNA, 19 nt, Human
uacacggcuggguggggug

SEQ ID NO: 1186055 - RNA, 23 nt, Human
uaccgaguaacagcacaaaaaca

SEQ ID NO: 1186056 - RNA, 21 nt, Human
uagaucccaggcccaccaccu

SEQ ID NO: 1186057 - RNA, 23 nt, Human
ucaggcacuagagcccccucaga

SEQ ID NO: 1186058 - RNA, 24 nt, Human
ucagugguacugugaaaccuuccu

SEQ ID NO: 1186059 - RNA, 18 nt, Human
ucccaggcccaccaccug

SEQ ID NO: 1186060 - RNA, 21 nt, Human
uccgccuuccuccuggcucua

SEQ ID NO: 1186061 - RNA, 24 nt, Human
uccuccuuaaaaaaaagacaaaaa

SEQ ID NO: 1186062 - RNA, 18 nt, Human
uccuggaccucuccaugc

SEQ ID NO: 1186063 - RNA, 21 nt, Human
ucuaaacacaaaugccaaaga

SEQ ID NO: 1186064 - RNA, 19 nt, Human
ucuaggagccccgacccgc

SEQ ID NO: 1186065 - RNA, 22 nt, Human
ucuccaugcaacccagcugccu

SEQ ID NO: 1186066 - RNA, 26 nt, Human
ugaaacaguaguuacagcugaggaca

SEQ ID NO: 1186067 - RNA, 23 nt, Human
ugaaaucuaacucagugguacug

SEQ ID NO: 1186068 - RNA, 20 nt, Human
ugacaugacaaaaguaugca

SEQ ID NO: 1186069 - RNA, 19 nt, Human
ugcacacacagacacgcac

SEQ ID NO: 1186070 - RNA, 21 nt, Human
ugccuccugggcccauccccu

SEQ ID NO: 1186071 - RNA, 20 nt, Human
uggcagaggcagacagaggg

SEQ ID NO: 1186072 - RNA, 22 nt, Human
uggcagaggcagacagaggguu

SEQ ID NO: 1186073 - RNA, 18 nt, Human
ugggguggggggacuggg

SEQ ID NO: 1186074 - RNA, 19 nt, Human
ugggguggggggacugggc

SEQ ID NO: 1186075 - RNA, 25 nt, Human
ugucauggauuuccacugucugaaa

SEQ ID NO: 1186076 - RNA, 20 nt, Human
uuacagcugaggacagcuac

SEQ ID NO: 1186077 - RNA, 21 nt, Human
uuccuggaggagaaaggaggc

SEQ ID NO: 1186078 - RNA, 22 nt, Human
uuuaguuauugauacaauguca

SEQ ID NO: 1186079 - RNA, 25 nt, Human
aaacaauaaauaaggaccccguggc

SEQ ID NO: 1186080 - RNA, 22 nt, Human
aaauaacugcaaauaaccacuu

SEQ ID NO: 1186081 - RNA, 22 nt, Human
aacaaaacaaaaguauccaucu

SEQ ID NO: 1186082 - RNA, 21 nt, Human
aagaaagcaaaguggaucacg

SEQ ID NO: 1186083 - RNA, 22 nt, Human
aagggccagaggcccaccacag

SEQ ID NO: 1186084 - RNA, 24 nt, Human
aaggggaauaagaccuauaauucc

SEQ ID NO: 1186085 - RNA, 19 nt, Human
acccaaagccauccacuua

SEQ ID NO: 1186086 - RNA, 23 nt, Human
accuucccucggugucuucaucg

SEQ ID NO: 1186087 - RNA, 18 nt, Human
acucccccauccucaccc

SEQ ID NO: 1186088 - RNA, 21 nt, Human
acucccccauccucacccugc

SEQ ID NO: 1186089 - RNA, 19 nt, Human
acugucagcuuaagugcau

SEQ ID NO: 1186090 - RNA, 19 nt, Human
agaaaccucuuugcaaaag

SEQ ID NO: 1186091 - RNA, 18 nt, Human
agacaggacaagccguga

SEQ ID NO: 1186092 - RNA, 23 nt, Human
agacaggacaagccgugaccuaa

SEQ ID NO: 1186093 - RNA, 24 nt, Human
agacguuguucuagcggaagacag

SEQ ID NO: 1186094 - RNA, 21 nt, Human
agagagcggcugugucgaaca

SEQ ID NO: 1186095 - RNA, 19 nt, Human
agagcacuacccaaaacuu

SEQ ID NO: 1186096 - RNA, 20 nt, Human
agcagcaagggauaagaauu

SEQ ID NO: 1186097 - RNA, 19 nt, Human
aggcagaaagaacccaaag

SEQ ID NO: 1186098 - RNA, 25 nt, Human
aguauccaucuacaggggaaacggc

SEQ ID NO: 1186099 - RNA, 20 nt, Human
auuagagcacuacccaaaag

SEQ ID NO: 1186100 - RNA, 26 nt, Human
caaaacaaaaguauccaucuacaggg

SEQ ID NO: 1186101 - RNA, 30 nt, Human
caaccaauaaauaucauacaauuucucaaa

SEQ ID NO: 1186102 - RNA, 23 nt, Human
caagauugagccucagucccaua

SEQ ID NO: 1186103 - RNA, 19 nt, Human
caagccaagauugagccuc

SEQ ID NO: 1186104 - RNA, 24 nt, Human
caaggcagaaagaacccaaagcca

SEQ ID NO: 1186105 - RNA, 25 nt, Human
caaguaacacucccaagaaaauaug

SEQ ID NO: 1186106 - RNA, 26 nt, Human
caauaaauaucauacaauuucucaaa

SEQ ID NO: 1186107 - RNA, 19 nt, Human
cacagcagugcgagccacu

SEQ ID NO: 1186108 - RNA, 19 nt, Human
cacugaagggacugucagc

SEQ ID NO: 1186109 - RNA, 23 nt, Human
cagaaagaacccaaagccaucca

SEQ ID NO: 1186110 - RNA, 25 nt, Human
cagaaagaacccaaagccauccacu

SEQ ID NO: 1186111 - RNA, 22 nt, Human
cagaagcaucaacaccauuggg

SEQ ID NO: 1186112 - RNA, 23 nt, Human
cagagagcggcugugucgaacac

SEQ ID NO: 1186113 - RNA, 20 nt, Human
cagcuccuagugccauuccc

SEQ ID NO: 1186114 - RNA, 19 nt, Human
caguggccacagcagugcg

SEQ ID NO: 1186115 - RNA, 20 nt, Human
ccaaggcagaaagaacccaa

SEQ ID NO: 1186116 - RNA, 25 nt, Human
ccaaggcagaaagaacccaaagcca

SEQ ID NO: 1186117 - RNA, 22 nt, Human
ccacagaccucuccugcgguuu

SEQ ID NO: 1186118 - RNA, 20 nt, Human
cccaccacagaccucuccug

SEQ ID NO: 1186119 - RNA, 20 nt, Human
cccacgugugaaaguauggu

SEQ ID NO: 1186120 - RNA, 22 nt, Human
ccccaagccaagauugagccuc

SEQ ID NO: 1186121 - RNA, 19 nt, Human
ccguggauggucccugggg

SEQ ID NO: 1186122 - RNA, 23 nt, Human
cgcuccacagaagcaucaacacc

SEQ ID NO: 1186123 - RNA, 24 nt, Human
cuccacagaagcaucaacaccauu

SEQ ID NO: 1186124 - RNA, 18 nt, Human
cuggcagccauggcuggc

SEQ ID NO: 1186125 - RNA, 22 nt, Human
gaaaaagauuucccauuaugaa

SEQ ID NO: 1186126 - RNA, 21 nt, Human
gaaaacaauaaauaaggaccg

SEQ ID NO: 1186127 - RNA, 22 nt, Human
gaaacggcacgcuccucugaga

SEQ ID NO: 1186128 - RNA, 18 nt, Human
gaagaagccauccgugga

SEQ ID NO: 1186129 - RNA, 24 nt, Human
gacaagccgugaccuaacaaaacc

SEQ ID NO: 1186130 - RNA, 23 nt, Human
gaccuauaauuccuucuagccuu

SEQ ID NO: 1186131 - RNA, 20 nt, Human
gagauuacagcuggccaaua

SEQ ID NO: 1186132 - RNA, 22 nt, Human
gcaaacaucagcuccuagugcc

SEQ ID NO: 1186133 - RNA, 21 nt, Human
gccaagauugagccucagucc

SEQ ID NO: 1186134 - RNA, 19 nt, Human
gccaagggccagaggccca

SEQ ID NO: 1186135 - RNA, 18 nt, Human
gcggaagacaggcuuugc

SEQ ID NO: 1186136 - RNA, 20 nt, Human
gcugcaguuggcucggcuug

SEQ ID NO: 1186137 - RNA, 20 nt, Human
ggaagaagccauccguggau

SEQ ID NO: 1186138 - RNA, 18 nt, Human
ggaagacaggcuuugcag

SEQ ID NO: 1186139 - RNA, 26 nt, Human
ggauggucccugggggaacggaucga

SEQ ID NO: 1186140 - RNA, 21 nt, Human
ggcagaaagaacccaaagcca

SEQ ID NO: 1186141 - RNA, 19 nt, Human
ggcaucauuuacgagucug

SEQ ID NO: 1186142 - RNA, 23 nt, Human
ggccacagcagugcgagccacug

SEQ ID NO: 1186143 - RNA, 18 nt, Human
ggcucggcuugccuacuu

SEQ ID NO: 1186144 - RNA, 21 nt, Human
gugagaagcaagaaagcaaag

SEQ ID NO: 1186145 - RNA, 20 nt, Human
uaacaaaaccacugaaggga

SEQ ID NO: 1186146 - RNA, 23 nt, Human
uaacagaaagcucacucaggacu

SEQ ID NO: 1186147 - RNA, 21 nt, Human
uaacaguuaaauuugucucuu

SEQ ID NO: 1186148 - RNA, 19 nt, Human
uaaggaccccguggcaccc

SEQ ID NO: 1186149 - RNA, 24 nt, Human
uaagggagcuccguggcccgggac

SEQ ID NO: 1186150 - RNA, 24 nt, Human
uaagugcaucaccuuuugggacaa

SEQ ID NO: 1186151 - RNA, 22 nt, Human
uacagugagaaauaaagcccac

SEQ ID NO: 1186152 - RNA, 22 nt, Human
uacaugaaggaagaagccaucc

SEQ ID NO: 1186153 - RNA, 19 nt, Human
uacuuggaguucugaaaua

SEQ ID NO: 1186154 - RNA, 20 nt, Human
ucaaaggacugaggaaaggg

SEQ ID NO: 1186155 - RNA, 25 nt, Human
ucaacaccauugggaccaaggcaga

SEQ ID NO: 1186156 - RNA, 22 nt, Human
uccacagaagcaucaacaccau

SEQ ID NO: 1186157 - RNA, 23 nt, Human
uccaucuacaggggaaacggcac

SEQ ID NO: 1186158 - RNA, 20 nt, Human
ucccuccuuauguacacgac

SEQ ID NO: 1186159 - RNA, 20 nt, Human
uccguaaacuuuuucugagc

SEQ ID NO: 1186160 - RNA, 21 nt, Human
ucuuuugauuuuuucugcagu

SEQ ID NO: 1186161 - RNA, 22 nt, Human
ugaacaacuaacauauaaccuu

SEQ ID NO: 1186162 - RNA, 25 nt, Human
ugaacaacuaacauauaaccuuccc

SEQ ID NO: 1186163 - RNA, 18 nt, Human
ugagaagcaagaaagcaa

SEQ ID NO: 1186164 - RNA, 19 nt, Human
ugagagagggguuuucuuc

SEQ ID NO: 1186165 - RNA, 19 nt, Human
ugcgagccacugcaaaagc

SEQ ID NO: 1186166 - RNA, 22 nt, Human
ugcucggcuuccucuaugucca

SEQ ID NO: 1186167 - RNA, 22 nt, Human
uggcugugaacacccuccgcug

SEQ ID NO: 1186168 - RNA, 19 nt, Human
uuacuuggaguucugaaau

SEQ ID NO: 1186169 - RNA, 21 nt, Human
uuaguggcuccagaaucuucc

SEQ ID NO: 1186170 - RNA, 22 nt, Human
uucacauuuguagacguuguuc

SEQ ID NO: 1186171 - RNA, 20 nt, Human
uucuguaccauguucccucc

SEQ ID NO: 1186172 - RNA, 19 nt, Human
uuucagaaaucuuagaauu

SEQ ID NO: 1186173 - RNA, 23 nt, Human
uuugaacaacuaacauauaaccu

SEQ ID NO: 1186174 - RNA, 23 nt, Human
aagaggccaacggagaugaugag

SEQ ID NO: 1186175 - RNA, 21 nt, Human
acgacaucaucgaccuggaac

SEQ ID NO: 1186176 - RNA, 24 nt, Human
agccacgcaccuccagcuggccuu

SEQ ID NO: 1186177 - RNA, 22 nt, Human
agccagggugggccugagggcc

SEQ ID NO: 1186178 - RNA, 23 nt, Human
caagagcccccagaagaggccaa

SEQ ID NO: 1186179 - RNA, 25 nt, Human
cacccuggagaugaaccccaagagc

SEQ ID NO: 1186180 - RNA, 24 nt, Human
cagaagaggccaacggagaugaug

SEQ ID NO: 1186181 - RNA, 21 nt, Human
cagccacgcaccuccagcugg

SEQ ID NO: 1186182 - RNA, 27 nt, Human
cagccacgcaccuccagcuggccuugg

SEQ ID NO: 1186183 - RNA, 21 nt, Human
cauccuugacucugccaggag

SEQ ID NO: 1186184 - RNA, 19 nt, Human
ccaggaguggggagagggg

SEQ ID NO: 1186185 - RNA, 21 nt, Human
ccauuagagguggccuucucu

SEQ ID NO: 1186186 - RNA, 19 nt, Human
ccccccggcccuuuccucc

SEQ ID NO: 1186187 - RNA, 22 nt, Human
ccuccaaguuuuccacccugga

SEQ ID NO: 1186188 - RNA, 29 nt, Human
ccuccaaguuuuccacccuggagaugaag

SEQ ID NO: 1186189 - RNA, 18 nt, Human
ccugaggcuggggaaggg

SEQ ID NO: 1186190 - RNA, 21 nt, Human
cggagaugaugagagugccug

SEQ ID NO: 1186191 - RNA, 20 nt, Human
cggcaguucucguacucagc

SEQ ID NO: 1186192 - RNA, 20 nt, Human
cggggaguggaaagagccag

SEQ ID NO: 1186193 - RNA, 20 nt, Human
cuugacucugccaggagggg

SEQ ID NO: 1186194 - RNA, 23 nt, Human
gaacagacagccacgcaccucca

SEQ ID NO: 1186195 - RNA, 20 nt, Human
gagaggggccccccggcccu

SEQ ID NO: 1186196 - RNA, 19 nt, Human
ggaaagagccagcucccag

SEQ ID NO: 1186197 - RNA, 18 nt, Human
ggacagccagggugggcc

SEQ ID NO: 1186198 - RNA, 18 nt, Human
ucagaggggcucugggug

SEQ ID NO: 1186199 - RNA, 21 nt, Human
uccacccuggagaugaacccc

SEQ ID NO: 1186200 - RNA, 23 nt, Human
uccagcuggccuugaacuucacc

SEQ ID NO: 1186201 - RNA, 22 nt, Human
ucucgcugaccccauccuugac

SEQ ID NO: 1186202 - RNA, 21 nt, Human
ucugccaggaggggcccucca

SEQ ID NO: 1186203 - RNA, 20 nt, Human
ugaaacaaagguugagggcu

SEQ ID NO: 1186204 - RNA, 25 nt, Human
ugaaacaaagguugagggcugaggg

SEQ ID NO: 1186205 - RNA, 20 nt, Human
ugaaccccaagagcccccag

SEQ ID NO: 1186206 - RNA, 23 nt, Human
ugaaccccaagagcccccagaag

SEQ ID NO: 1186207 - RNA, 19 nt, Human
ugagggcugaggggauggg

SEQ ID NO: 1186208 - RNA, 24 nt, Human
ugaugagagugccugaggcugggg

SEQ ID NO: 1186209 - RNA, 21 nt, Human
ugccugaggcuggggaagggc

SEQ ID NO: 1186210 - RNA, 24 nt, Human
ugccugaggcuggggaagggcaac

SEQ ID NO: 1186211 - RNA, 19 nt, Human
uggaaagagccagcuccca

SEQ ID NO: 1186212 - RNA, 24 nt, Human
uggagaugaaccccaagagccccc

SEQ ID NO: 1186213 - RNA, 23 nt, Human
uggggagaggggccccccggccc

SEQ ID NO: 1186214 - RNA, 19 nt, Human
uguggcaaggcugugccug

SEQ ID NO: 1186215 - RNA, 23 nt, Human
uguggccacaaugccugcaggcc

SEQ ID NO: 1186216 - RNA, 18 nt, Human
uucaccgcccacauggcc

SEQ ID NO: 1186217 - RNA, 27 nt, Human
uuuuccacccuggagaugaaccccaag

SEQ ID NO: 1186218 - RNA, 23 nt, Human
acaauagccucucuguguggccc

SEQ ID NO: 1186219 - RNA, 24 nt, Human
agccacaagccugacucugagccc

SEQ ID NO: 1186220 - RNA, 18 nt, Human
aggcgaagccacaagccu

SEQ ID NO: 1186221 - RNA, 22 nt, Human
cacacaauagccucucugugug

SEQ ID NO: 1186222 - RNA, 19 nt, Human
cacacugccacucagcccu

SEQ ID NO: 1186223 - RNA, 19 nt, Human
cacuggaucccagggucuc

SEQ ID NO: 1186224 - RNA, 18 nt, Human
cagcaagugacacacaau

SEQ ID NO: 1186225 - RNA, 19 nt, Human
ccuaacccagcaagugaca

SEQ ID NO: 1186226 - RNA, 25 nt, Human
cucucuguguggcccugcaucaucc

SEQ ID NO: 1186227 - RNA, 21 nt, Human
ggaaucccccaucccacaggg

SEQ ID NO: 1186228 - RNA, 18 nt, Human
ggugcccacacugccacu

SEQ ID NO: 1186229 - RNA, 18 nt, Human
ucccgggccgcggugccc

SEQ ID NO: 1186230 - RNA, 21 nt, Human
ugccacggaaucccccauccc

SEQ ID NO: 1186231 - RNA, 23 nt, Human
ugccacggaaucccccaucccac

SEQ ID NO: 1186232 - RNA, 27 nt, Human
ugccacggaaucccccaucccacaggg

SEQ ID NO: 1186233 - RNA, 23 nt, Human
ugccacucagcccuggcuggaga

SEQ ID NO: 1186234 - RNA, 20 nt, Human
aagaagccuuggcguccacc

SEQ ID NO: 1186235 - RNA, 19 nt, Human
aagcuaagguggguaugaa

SEQ ID NO: 1186236 - RNA, 22 nt, Human
aauugggaagcuaaggugggua

SEQ ID NO: 1186237 - RNA, 19 nt, Human
accaaagccucgcccgccc

SEQ ID NO: 1186238 - RNA, 22 nt, Human
acccuuacacccacaccugcag

SEQ ID NO: 1186239 - RNA, 21 nt, Human
acucuagagagaugccuggga

SEQ ID NO: 1186240 - RNA, 18 nt, Human
acugcaauaaaguuacaa

SEQ ID NO: 1186241 - RNA, 19 nt, Human
agaaaggaguagaccucac

SEQ ID NO: 1186242 - RNA, 18 nt, Human
agaaggagaugccuacag

SEQ ID NO: 1186243 - RNA, 19 nt, Human
agagauggaagaggaaagg

SEQ ID NO: 1186244 - RNA, 18 nt, Human
agaggaaaggagggaagg

SEQ ID NO: 1186245 - RNA, 19 nt, Human
agaggaaaggagggaaggu

SEQ ID NO: 1186246 - RNA, 20 nt, Human
agagggccuggcgcgcacuu

SEQ ID NO: 1186247 - RNA, 22 nt, Human
agccggccuugccucuggcccc

SEQ ID NO: 1186248 - RNA, 20 nt, Human
agcucuucaucagcagggaa

SEQ ID NO: 1186249 - RNA, 19 nt, Human
agcuucccaaagauugaga

SEQ ID NO: 1186250 - RNA, 20 nt, Human
aggaccaguaagaagccuug

SEQ ID NO: 1186251 - RNA, 18 nt, Human
aggauggacucacgccac

SEQ ID NO: 1186252 - RNA, 18 nt, Human
auccuugcgggcgugaga

SEQ ID NO: 1186253 - RNA, 20 nt, Human
caaagcuccgcuugcacuuc

SEQ ID NO: 1186254 - RNA, 20 nt, Human
caccacgucagacucacacc

SEQ ID NO: 1186255 - RNA, 19 nt, Human
cacuucuuggcuguacugc

SEQ ID NO: 1186256 - RNA, 22 nt, Human
cagagcucucgcguucacuuuc

SEQ ID NO: 1186257 - RNA, 21 nt, Human
cagcaacucugggacccuggu

SEQ ID NO: 1186258 - RNA, 22 nt, Human
cagcacucugagccuggggcag

SEQ ID NO: 1186259 - RNA, 20 nt, Human
cagcuaaagcaaagcuccgg

SEQ ID NO: 1186260 - RNA, 19 nt, Human
cagcugcauugaggcccag

SEQ ID NO: 1186261 - RNA, 23 nt, Human
cagggugaggggggucgucccuc

SEQ ID NO: 1186262 - RNA, 21 nt, Human
cauccuucccaggauggacuc

SEQ ID NO: 1186263 - RNA, 18 nt, Human
caugaggcuugcugcguc

SEQ ID NO: 1186264 - RNA, 18 nt, Human
caugcaagcauggccccc

SEQ ID NO: 1186265 - RNA, 21 nt, Human
ccaggccgugagaaagugacc

SEQ ID NO: 1186266 - RNA, 20 nt, Human
cccacaccugcagcugggcu

SEQ ID NO: 1186267 - RNA, 18 nt, Human
cccaggagacuaagauga

SEQ ID NO: 1186268 - RNA, 24 nt, Human
cccuaaguucucuccuccagcccc

SEQ ID NO: 1186269 - RNA, 23 nt, Human
cgcagggugaugggggauggugg

SEQ ID NO: 1186270 - RNA, 20 nt, Human
cggagggcaccaaagccucg

SEQ ID NO: 1186271 - RNA, 23 nt, Human
cggagggcaccaaagccucgccc

SEQ ID NO: 1186272 - RNA, 21 nt, Human
cuaggcugggaggacagccag

SEQ ID NO: 1186273 - RNA, 25 nt, Human
cucagcacucugagccuggggcaga

SEQ ID NO: 1186274 - RNA, 18 nt, Human
cucccuguuccugcugug

SEQ ID NO: 1186275 - RNA, 20 nt, Human
cucguccacacacgcacagg

SEQ ID NO: 1186276 - RNA, 20 nt, Human
cugcaaaguccacuuagucu

SEQ ID NO: 1186277 - RNA, 19 nt, Human
cugcccugaagaaaggagu

SEQ ID NO: 1186278 - RNA, 23 nt, Human
cugcucagauucugguggugcug

SEQ ID NO: 1186279 - RNA, 18 nt, Human
cugcugggcaauuccuau

SEQ ID NO: 1186280 - RNA, 22 nt, Human
cuguccccuaugcagguggccc

SEQ ID NO: 1186281 - RNA, 23 nt, Human
cuguccccuaugcagguggcccu

SEQ ID NO: 1186282 - RNA, 19 nt, Human
cugugccacugccccaagu

SEQ ID NO: 1186283 - RNA, 27 nt, Human
cuucccaggauggacucacgccacccu

SEQ ID NO: 1186284 - RNA, 20 nt, Human
gaacgugggugggucggcac

SEQ ID NO: 1186285 - RNA, 19 nt, Human
gacacguccagagcuaugg

SEQ ID NO: 1186286 - RNA, 25 nt, Human
gagacuauuuuuuggcaauuuugua

SEQ ID NO: 1186287 - RNA, 25 nt, Human
gagaggugggagggaggugacagag

SEQ ID NO: 1186288 - RNA, 18 nt, Human
gagggccuggcgcgcacu

SEQ ID NO: 1186289 - RNA, 23 nt, Human
gaggguggcaaacauggcaggag

SEQ ID NO: 1186290 - RNA, 19 nt, Human
gcagaaggagaugccuaca

SEQ ID NO: 1186291 - RNA, 23 nt, Human
gcguucacuuucucguccacaca

SEQ ID NO: 1186292 - RNA, 23 nt, Human
ggacagccaggggaauugggaag

SEQ ID NO: 1186293 - RNA, 21 nt, Human
ggucccaucagggcccuuccc

SEQ ID NO: 1186294 - RNA, 21 nt, Human
ggugacagagagauggaagag

SEQ ID NO: 1186295 - RNA, 21 nt, Human
gguggugucuaggagcugagc

SEQ ID NO: 1186296 - RNA, 24 nt, Human
uaagcuguguuccaagaccuuuga

SEQ ID NO: 1186297 - RNA, 21 nt, Human
uaauuaaaaguuuggggcugu

SEQ ID NO: 1186298 - RNA, 20 nt, Human
uagaccccgcgagaugccag

SEQ ID NO: 1186299 - RNA, 20 nt, Human
uagaccucacucugacccaa

SEQ ID NO: 1186300 - RNA, 19 nt, Human
ucagaccuggucuaaccaa

SEQ ID NO: 1186301 - RNA, 23 nt, Human
ucagccggccuugccucuggccc

SEQ ID NO: 1186302 - RNA, 19 nt, Human
ucauggcaggccugggagc

SEQ ID NO: 1186303 - RNA, 21 nt, Human
ucccaagggguggcuuagacc

SEQ ID NO: 1186304 - RNA, 25 nt, Human
ucccggagggcaccaaagccucgcc

SEQ ID NO: 1186305 - RNA, 19 nt, Human
ucccuccugcuuuagccca

SEQ ID NO: 1186306 - RNA, 24 nt, Human
uccugcccuaaguucucuccucca

SEQ ID NO: 1186307 - RNA, 22 nt, Human
uccuuuuauuuuguucaagccu

SEQ ID NO: 1186308 - RNA, 19 nt, Human
ucuaagcagccauuggcaa

SEQ ID NO: 1186309 - RNA, 23 nt, Human
ucuaauacuguuugcgaugaauu

SEQ ID NO: 1186310 - RNA, 19 nt, Human
ucuggccccaccucugcug

SEQ ID NO: 1186311 - RNA, 18 nt, Human
ugaaggagcagagcagac

SEQ ID NO: 1186312 - RNA, 23 nt, Human
ugacccaaggcugauccucgcga

SEQ ID NO: 1186313 - RNA, 23 nt, Human
ugaggggggucgucccuccugcu

SEQ ID NO: 1186314 - RNA, 18 nt, Human
ugauccugcccaugucuc

SEQ ID NO: 1186315 - RNA, 19 nt, Human
ugcagcaacucugggaccc

SEQ ID NO: 1186316 - RNA, 18 nt, Human
ugccugggacacguccag

SEQ ID NO: 1186317 - RNA, 18 nt, Human
ugccuuugccaggcugcu

SEQ ID NO: 1186318 - RNA, 21 nt, Human
ugcuggggauaagggcuuccc

SEQ ID NO: 1186319 - RNA, 22 nt, Human
uggaagaggaaaggagggaagg

SEQ ID NO: 1186320 - RNA, 26 nt, Human
uggaagaggaaaggagggaagguucc

SEQ ID NO: 1186321 - RNA, 25 nt, Human
uggcaaaaugacagcuaaagcaaag

SEQ ID NO: 1186322 - RNA, 20 nt, Human
uggcagaggaaagggggcug

SEQ ID NO: 1186323 - RNA, 19 nt, Human
uggcaggccugggagcgga

SEQ ID NO: 1186324 - RNA, 18 nt, Human
ugggaaugccagcccugc

SEQ ID NO: 1186325 - RNA, 23 nt, Human
ugggacacguccagagcuaugga

SEQ ID NO: 1186326 - RNA, 21 nt, Human
ugggacccuggugcaugguau

SEQ ID NO: 1186327 - RNA, 18 nt, Human
ugggagggaggugacaga

SEQ ID NO: 1186328 - RNA, 22 nt, Human
ugggagggaggugacagagaga

SEQ ID NO: 1186329 - RNA, 24 nt, Human
ugggagggaggugacagagagaug

SEQ ID NO: 1186330 - RNA, 19 nt, Human
ugggcaauuccuaugggcc

SEQ ID NO: 1186331 - RNA, 23 nt, Human
uggggucagccggccuugccucc

SEQ ID NO: 1186332 - RNA, 18 nt, Human
uggguaugaaguuuugcc

SEQ ID NO: 1186333 - RNA, 18 nt, Human
ugguauugcaccugugag

SEQ ID NO: 1186334 - RNA, 22 nt, Human
ugguggcaagugggggagggug

SEQ ID NO: 1186335 - RNA, 24 nt, Human
uguaccuuuugagagcacuucuug

SEQ ID NO: 1186336 - RNA, 21 nt, Human
ugucuccugcccuaaguucuc

SEQ ID NO: 1186337 - RNA, 18 nt, Human
ugugguggcuugccaggg

SEQ ID NO: 1186338 - RNA, 26 nt, Human
uguuggggggaaggagaggugggagg

SEQ ID NO: 1186339 - RNA, 27 nt, Human
uguuggggggaaggagaggugggaggg

SEQ ID NO: 1186340 - RNA, 24 nt, Human
uuacacccacaccugcagcugggc

SEQ ID NO: 1186341 - RNA, 18 nt, Human
uugagagguggugucuag

SEQ ID NO: 1186342 - RNA, 26 nt, Human
uugcagcaacucugggacccuggugc

SEQ ID NO: 1186343 - RNA, 18 nt, Human
uuggagacgcugugccac

SEQ ID NO: 1186344 - RNA, 20 nt, Human
uuggagccuaacacagcaug

SEQ ID NO: 1186345 - RNA, 21 nt, Human
uuuguuggggggaaggagagg

SEQ ID NO: 1186346 - RNA, 24 nt, Human
cucaaccuauccaaauccucgaga

SEQ ID NO: 1186347 - RNA, 18 nt, Human
gcccaauaaaggcucaac

SEQ ID NO: 1186348 - RNA, 21 nt, Human
gcccaauaaaggcucaaccua

SEQ ID NO: 1186349 - RNA, 20 nt, Human
aaaaggaaagaauucaggca

SEQ ID NO: 1186350 - RNA, 21 nt, Human
aauaaagugugugcuucuuuc

SEQ ID NO: 1186351 - RNA, 18 nt, Human
acccaaagacagggagcc

SEQ ID NO: 1186352 - RNA, 24 nt, Human
acgcagcagcuucagcagguacag

SEQ ID NO: 1186353 - RNA, 18 nt, Human
acucacauggcugaaaca

SEQ ID NO: 1186354 - RNA, 24 nt, Human
acuggcuucucagucuggcucuuu

SEQ ID NO: 1186355 - RNA, 18 nt, Human
agaacuagagaaagguga

SEQ ID NO: 1186356 - RNA, 20 nt, Human
agagaaaggugaguguagug

SEQ ID NO: 1186357 - RNA, 21 nt, Human
auggcugaaacagcagggagc

SEQ ID NO: 1186358 - RNA, 22 nt, Human
caaagacagggagccuggaaga

SEQ ID NO: 1186359 - RNA, 19 nt, Human
caagaccagaacuagagaa

SEQ ID NO: 1186360 - RNA, 19 nt, Human
cagcagcuucagcagguac

SEQ ID NO: 1186361 - RNA, 21 nt, Human
cagcagguacaggaagauuuc

SEQ ID NO: 1186362 - RNA, 21 nt, Human
cauaacaaaccaucucaaaac

SEQ ID NO: 1186363 - RNA, 20 nt, Human
caucucaucaacaucucccu

SEQ ID NO: 1186364 - RNA, 20 nt, Human
ccagaacuagagaaagguga

SEQ ID NO: 1186365 - RNA, 21 nt, Human
ccagaacuagagaaaggugag

SEQ ID NO: 1186366 - RNA, 22 nt, Human
cccaaagacagggagccuggaa

SEQ ID NO: 1186367 - RNA, 21 nt, Human
ccuccggcugugacuuuugcc

SEQ ID NO: 1186368 - RNA, 25 nt, Human
ccuccggcugugacuuuugccauuu

SEQ ID NO: 1186369 - RNA, 22 nt, Human
ccucugaggaacgcagcagcuu

SEQ ID NO: 1186370 - RNA, 23 nt, Human
cuaauaaagugugugcuucuuuc

SEQ ID NO: 1186371 - RNA, 23 nt, Human
cuagcaucuuucaccuaagcaau

SEQ ID NO: 1186372 - RNA, 23 nt, Human
cuccggcugugacuuuugccauu

SEQ ID NO: 1186373 - RNA, 22 nt, Human
cucuggauucuccccuuccccu

SEQ ID NO: 1186374 - RNA, 23 nt, Human
cuggagucaccugaagguucagc

SEQ ID NO: 1186375 - RNA, 19 nt, Human
cuggauucuccccuucccc

SEQ ID NO: 1186376 - RNA, 20 nt, Human
cuucacgcugaucuugaccc

SEQ ID NO: 1186377 - RNA, 20 nt, Human
gacaggaagaaaaguucuaa

SEQ ID NO: 1186378 - RNA, 20 nt, Human
gaccagaacuagagaaaggu

SEQ ID NO: 1186379 - RNA, 19 nt, Human
gacccaaagacagggagcc

SEQ ID NO: 1186380 - RNA, 18 nt, Human
gaggcaagaccagaacua

SEQ ID NO: 1186381 - RNA, 22 nt, Human
gaggcaagaccagaacuagaga

SEQ ID NO: 1186382 - RNA, 24 nt, Human
gcagggagcuggccaggcaucucu

SEQ ID NO: 1186383 - RNA, 20 nt, Human
gccuagcuggggcugggggg

SEQ ID NO: 1186384 - RNA, 21 nt, Human
gcugaaacagcagggagcugg

SEQ ID NO: 1186385 - RNA, 22 nt, Human
gggcugggggguggcgggcggg

SEQ ID NO: 1186386 - RNA, 18 nt, Human
guaauugcucgacauucc

SEQ ID NO: 1186387 - RNA, 23 nt, Human
guuucagucucacauuuuaucuc

SEQ ID NO: 1186388 - RNA, 22 nt, Human
uaacaaaccaucucaaaacuga

SEQ ID NO: 1186389 - RNA, 24 nt, Human
uaagcucugcucuucuugcuugag

SEQ ID NO: 1186390 - RNA, 22 nt, Human
uaagguuugauuuugguuuugg

SEQ ID NO: 1186391 - RNA, 21 nt, Human
uacguggugacuggcuucuca

SEQ ID NO: 1186392 - RNA, 23 nt, Human
uagcaucuuucaccuaagcaauu

SEQ ID NO: 1186393 - RNA, 25 nt, Human
uagcaucuuucaccuaagcaauugg

SEQ ID NO: 1186394 - RNA, 22 nt, Human
uaguaagcaugggcuuccuucu

SEQ ID NO: 1186395 - RNA, 18 nt, Human
uaucucuggauucucccc

SEQ ID NO: 1186396 - RNA, 21 nt, Human
ucuccuagugcugggccuccg

SEQ ID NO: 1186397 - RNA, 20 nt, Human
ucugcucuucuugcuugagg

SEQ ID NO: 1186398 - RNA, 19 nt, Human
ugcaccaaaaugccucacu

SEQ ID NO: 1186399 - RNA, 21 nt, Human
uggauuucggucuugcaauuu

SEQ ID NO: 1186400 - RNA, 23 nt, Human
uggccuagcuggggcuggggggu

SEQ ID NO: 1186401 - RNA, 18 nt, Human
ugggccuccggcugugac

SEQ ID NO: 1186402 - RNA, 24 nt, Human
ugguuuuggggacugcagaggugc

SEQ ID NO: 1186403 - RNA, 23 nt, Human
uucagcagguacaggaagauuuc

SEQ ID NO: 1186404 - RNA, 24 nt, Human
uucuuucuuguaugcuucuuuaaa

SEQ ID NO: 1186405 - RNA, 19 nt, Human
uucuuuggguugacugagc

SEQ ID NO: 1186406 - RNA, 18 nt, Human
aaguccuucaaaguccac

SEQ ID NO: 1186407 - RNA, 22 nt, Human
cagugaaaauuuucugagaucu

SEQ ID NO: 1186408 - RNA, 20 nt, Human
cuucaaaguccacuggcucc

SEQ ID NO: 1186409 - RNA, 21 nt, Human
gcaaugcuggcaaacaggggc

SEQ ID NO: 1186410 - RNA, 24 nt, Human
uaacaucguagagggcaaugcugg

SEQ ID NO: 1186411 - RNA, 21 nt, Human
ucagaguucaggucacaguga

SEQ ID NO: 1186412 - RNA, 18 nt, Human
ucuuuuuccuuucuuuaa

SEQ ID NO: 1186413 - RNA, 20 nt, Human
ugacuugaugcggccacuga

SEQ ID NO: 1186414 - RNA, 19 nt, Human
uucaggucacagugaaaau

SEQ ID NO: 1186415 - RNA, 24 nt, Human
aaagugcugggaucacaggcguga

SEQ ID NO: 1186416 - RNA, 21 nt, Human
aagcgaacacgggcuccucca

SEQ ID NO: 1186417 - RNA, 19 nt, Human
aaguagcugggacuaaggc

SEQ ID NO: 1186418 - RNA, 25 nt, Human
aagugauuccccugccucagccucc

SEQ ID NO: 1186419 - RNA, 26 nt, Human
aagugcugggaucacaggcgugagcc

SEQ ID NO: 1186420 - RNA, 26 nt, Human
acagaacuccagcaaaaagggaacgc

SEQ ID NO: 1186421 - RNA, 18 nt, Human
acgggguuucaccacguu

SEQ ID NO: 1186422 - RNA, 20 nt, Human
acgggguuucaccacguugg

SEQ ID NO: 1186423 - RNA, 24 nt, Human
acgggguuucaccacguuggccag

SEQ ID NO: 1186424 - RNA, 20 nt, Human
acugcaagcuccgccucccg

SEQ ID NO: 1186425 - RNA, 23 nt, Human
acuugcucugucgccaggcugga

SEQ ID NO: 1186426 - RNA, 22 nt, Human
agaaagagcuuggcuccuggug

SEQ ID NO: 1186427 - RNA, 22 nt, Human
agccuucugucguccugagcaa

SEQ ID NO: 1186428 - RNA, 20 nt, Human
aggaaggaugaugggcauau

SEQ ID NO: 1186429 - RNA, 24 nt, Human
aggcuggagugcaguggcagaucu

SEQ ID NO: 1186430 - RNA, 24 nt, Human
agugauuccccugccucagccucc

SEQ ID NO: 1186431 - RNA, 22 nt, Human
agugcaguggcagaucucgguu

SEQ ID NO: 1186432 - RNA, 23 nt, Human
agugcaguggcagaucucgguuc

SEQ ID NO: 1186433 - RNA, 18 nt, Human
augaaguggaaaaaguga

SEQ ID NO: 1186434 - RNA, 24 nt, Human
auuuuuuguauuuuaguagagacg

SEQ ID NO: 1186435 - RNA, 23 nt, Human
caaaaguugauuugaauccugau

SEQ ID NO: 1186436 - RNA, 22 nt, Human
caaaguaucauuuaacaugcaa

SEQ ID NO: 1186437 - RNA, 24 nt, Human
caaagugcugggaucacaggcgug

SEQ ID NO: 1186438 - RNA, 20 nt, Human
caacaugaaaaucauuaaca

SEQ ID NO: 1186439 - RNA, 22 nt, Human
caagugauuccccugccucagc

SEQ ID NO: 1186440 - RNA, 25 nt, Human
caauucagacuaaccauaaugccga

SEQ ID NO: 1186441 - RNA, 23 nt, Human
cacaggcgugagccaccgcgccc

SEQ ID NO: 1186442 - RNA, 18 nt, Human
caccacguuggccaggau

SEQ ID NO: 1186443 - RNA, 22 nt, Human
caccacguuggccaggaugguc

SEQ ID NO: 1186444 - RNA, 24 nt, Human
caccacguuggccaggauggucuc

SEQ ID NO: 1186445 - RNA, 22 nt, Human
caccauccaauuccuaaucaaa

SEQ ID NO: 1186446 - RNA, 19 nt, Human
cacgauguuuucugcgcug

SEQ ID NO: 1186447 - RNA, 19 nt, Human
cagaaagagcuuggcuccu

SEQ ID NO: 1186448 - RNA, 19 nt, Human
ccaaaggagccaugaagug

SEQ ID NO: 1186449 - RNA, 22 nt, Human
ccaaagugcugggaucacaggc

SEQ ID NO: 1186450 - RNA, 24 nt, Human
ccaaagugcugggaucacaggcgu

SEQ ID NO: 1186451 - RNA, 24 nt, Human
ccaacucaccauccaauuccuaau

SEQ ID NO: 1186452 - RNA, 21 nt, Human
ccaaguagcugggacuaaggc

SEQ ID NO: 1186453 - RNA, 20 nt, Human
ccaccacgcccggcuaauuu

SEQ ID NO: 1186454 - RNA, 18 nt, Human
ccaccgcgcccggccugc

SEQ ID NO: 1186455 - RNA, 18 nt, Human
ccaccgcgcccggccugc

SEQ ID NO: 1186456 - RNA, 20 nt, Human
ccaccgcgcccggccugcuu

SEQ ID NO: 1186457 - RNA, 24 nt, Human
ccagcaaaaagcuaaggacugggg

SEQ ID NO: 1186458 - RNA, 19 nt, Human
cccaaguagcugggacuaa

SEQ ID NO: 1186459 - RNA, 21 nt, Human
cccggguucaagugauucccc

SEQ ID NO: 1186460 - RNA, 23 nt, Human
cccggguucaagugauuccccug

SEQ ID NO: 1186461 - RNA, 24 nt, Human
ccgccucccggguucaagugauuc

SEQ ID NO: 1186462 - RNA, 19 nt, Human
ccgcgcccggccugcuuug

SEQ ID NO: 1186463 - RNA, 21 nt, Human
ccucccggguucaagugauuc

SEQ ID NO: 1186464 - RNA, 22 nt, Human
ccucccggguucaagugauucc

SEQ ID NO: 1186465 - RNA, 23 nt, Human
ccugccucagccucccaaguagc

SEQ ID NO: 1186466 - RNA, 24 nt, Human
ccugccucagccucccaaguagcu

SEQ ID NO: 1186467 - RNA, 24 nt, Human
cgccucggccucccaaagugcugg

SEQ ID NO: 1186468 - RNA, 24 nt, Human
cgggguuucaccacguuggccagg

SEQ ID NO: 1186469 - RNA, 24 nt, Human
cucagccucccaaguagcugggac

SEQ ID NO: 1186470 - RNA, 22 nt, Human
cucagucugaaacugaaauaaa

SEQ ID NO: 1186471 - RNA, 24 nt, Human
cuccugaccucgugaugcgcccgc

SEQ ID NO: 1186472 - RNA, 19 nt, Human
cucugucgccaggcuggag

SEQ ID NO: 1186473 - RNA, 23 nt, Human
cugcaagccuucugucguccuga

SEQ ID NO: 1186474 - RNA, 22 nt, Human
cuugcucugucgccaggcugga

SEQ ID NO: 1186475 - RNA, 18 nt, Human
gaaaacauuuuuugagaa

SEQ ID NO: 1186476 - RNA, 19 nt, Human
gaauccugauagauuccac

SEQ ID NO: 1186477 - RNA, 24 nt, Human
gagacgggguuucaccacguuggc

SEQ ID NO: 1186478 - RNA, 18 nt, Human
gaucacaggcgugagcca

SEQ ID NO: 1186479 - RNA, 21 nt, Human
gaucacaggcgugagccaccg

SEQ ID NO: 1186480 - RNA, 23 nt, Human
gcccggcuaauuuuuuguauuuu

SEQ ID NO: 1186481 - RNA, 24 nt, Human
gccugcuuugguauuuuuuaagag

SEQ ID NO: 1186482 - RNA, 19 nt, Human
gcucugucgccaggcugga

SEQ ID NO: 1186483 - RNA, 20 nt, Human
ggaugaauccauuauauuua

SEQ ID NO: 1186484 - RNA, 22 nt, Human
ggcuccguccucgccugcuuca

SEQ ID NO: 1186485 - RNA, 24 nt, Human
gggcuucuuagcagaccucagucu

SEQ ID NO: 1186486 - RNA, 23 nt, Human
gggguuucaccacguuggccagg

SEQ ID NO: 1186487 - RNA, 20 nt, Human
ggucucgaucuccugaccuc

SEQ ID NO: 1186488 - RNA, 24 nt, Human
gugaugcgcccgccucggccuccc

SEQ ID NO: 1186489 - RNA, 24 nt, Human
gugauuccccugccucagccuccc

SEQ ID NO: 1186490 - RNA, 23 nt, Human
gugcaguggcagaucucgguuca

SEQ ID NO: 1186491 - RNA, 26 nt, Human
uaaauaaaccaaaagaaauggccugu

SEQ ID NO: 1186492 - RNA, 24 nt, Human
uaaggacugggggaucccaacuca

SEQ ID NO: 1186493 - RNA, 22 nt, Human
uaaggcgugcgccaccacgccc

SEQ ID NO: 1186494 - RNA, 23 nt, Human
uaauuuuuuguauuuuaguagag

SEQ ID NO: 1186495 - RNA, 24 nt, Human
uaauuuuuuguauuuuaguagaga

SEQ ID NO: 1186496 - RNA, 20 nt, Human
uacagaacuccagcaaaagg

SEQ ID NO: 1186497 - RNA, 20 nt, Human
uacccugguccaaaggagcc

SEQ ID NO: 1186498 - RNA, 22 nt, Human
uagagacgggguuucaccacgu

SEQ ID NO: 1186499 - RNA, 22 nt, Human
uagagcagcacgccggcaccuu

SEQ ID NO: 1186500 - RNA, 24 nt, Human
uaguagagacgggguuucaccacg

SEQ ID NO: 1186501 - RNA, 26 nt, Human
uaguagagacgggguuucaccacguu

SEQ ID NO: 1186502 - RNA, 24 nt, Human
ucaccacguuggccaggauggucu

SEQ ID NO: 1186503 - RNA, 18 nt, Human
ucacugcaagcuccgccu

SEQ ID NO: 1186504 - RNA, 19 nt, Human
ucacugcaagcuccgccuc

SEQ ID NO: 1186505 - RNA, 24 nt, Human
ucacugcaagcuccgccucccggg

SEQ ID NO: 1186506 - RNA, 18 nt, Human
ucagccucccaaguagcu

SEQ ID NO: 1186507 - RNA, 20 nt, Human
ucagccucccaaguagcugg

SEQ ID NO: 1186508 - RNA, 20 nt, Human
uccacuaacuuuuuugucuu

SEQ ID NO: 1186509 - RNA, 24 nt, Human
ucccaaagugcugggaucacaggc

SEQ ID NO: 1186510 - RNA, 23 nt, Human
ucccaaguagcugggacuaaggc

SEQ ID NO: 1186511 - RNA, 26 nt, Human
uccccugccucagccucccaaguagc

SEQ ID NO: 1186512 - RNA, 19 nt, Human
ucccggguucaagugauuc

SEQ ID NO: 1186513 - RNA, 24 nt, Human
ucccggguucaagugauuccccug

SEQ ID NO: 1186514 - RNA, 19 nt, Human
uccuuggaugaauccauua

SEQ ID NO: 1186515 - RNA, 18 nt, Human
ucugucgccaggcuggag

SEQ ID NO: 1186516 - RNA, 21 nt, Human
ucugucgccaggcuggagugc

SEQ ID NO: 1186517 - RNA, 23 nt, Human
ucugucgccaggcuggagugcag

SEQ ID NO: 1186518 - RNA, 20 nt, Human
ugaaacugaaauaaaccugg

SEQ ID NO: 1186519 - RNA, 23 nt, Human
ugaaacugaaauaaaccuggacg

SEQ ID NO: 1186520 - RNA, 22 nt, Human
ugaagcgaacacgggcuccucc

SEQ ID NO: 1186521 - RNA, 21 nt, Human
ugacauuuugagauuuacaga

SEQ ID NO: 1186522 - RNA, 19 nt, Human
ugaugggcauauugcuugc

SEQ ID NO: 1186523 - RNA, 24 nt, Human
ugccucagccucccaaguagcugg

SEQ ID NO: 1186524 - RNA, 22 nt, Human
ugcgcugucuuuaaauuccagu

SEQ ID NO: 1186525 - RNA, 24 nt, Human
ugcugggaucacaggcgugagcca

SEQ ID NO: 1186526 - RNA, 21 nt, Human
ugcuucauuauuccagaaaga

SEQ ID NO: 1186527 - RNA, 21 nt, Human
uggagugcaguggcagaucuc

SEQ ID NO: 1186528 - RNA, 23 nt, Human
uggagugcaguggcagaucucgg

SEQ ID NO: 1186529 - RNA, 25 nt, Human
uggcaucgcuauuuuuauacccuuc

SEQ ID NO: 1186530 - RNA, 24 nt, Human
uggccaggauggucucgaucuccu

SEQ ID NO: 1186531 - RNA, 23 nt, Human
ugggacuaaggcgugcgccacca

SEQ ID NO: 1186532 - RNA, 19 nt, Human
ugggaucacaggcgugagc

SEQ ID NO: 1186533 - RNA, 21 nt, Human
ugggaucacaggcgugagcca

SEQ ID NO: 1186534 - RNA, 22 nt, Human
ugggaucacaggcgugagccac

SEQ ID NO: 1186535 - RNA, 23 nt, Human
ugggaucacaggcgugagccacc

SEQ ID NO: 1186536 - RNA, 24 nt, Human
ugggaucacaggcgugagccaccg

SEQ ID NO: 1186537 - RNA, 24 nt, Human
ugguaaauggaggcauuauaugga

SEQ ID NO: 1186538 - RNA, 22 nt, Human
ugguuguuuuuuuuuuuuucuu

SEQ ID NO: 1186539 - RNA, 18 nt, Human
uuaguagagacgggguuu

SEQ ID NO: 1186540 - RNA, 22 nt, Human
uuaguagagacgggguuucacc

SEQ ID NO: 1186541 - RNA, 24 nt, Human
uuaguagagacgggguuucaccac

SEQ ID NO: 1186542 - RNA, 25 nt, Human
uuaguagagacgggguuucaccacg

SEQ ID NO: 1186543 - RNA, 21 nt, Human
uucaagugauuccccugccuc

SEQ ID NO: 1186544 - RNA, 23 nt, Human
uucaagugauuccccugccucag

SEQ ID NO: 1186545 - RNA, 24 nt, Human
uucaagugauuccccugccucagc

SEQ ID NO: 1186546 - RNA, 21 nt, Human
uuccagaaagagcuuggcucc

SEQ ID NO: 1186547 - RNA, 19 nt, Human
uuccccugccucagccucc

SEQ ID NO: 1186548 - RNA, 22 nt, Human
uuccuuggaugaauccauuaua

SEQ ID NO: 1186549 - RNA, 24 nt, Human
uugucuuuuuuuuuggcugccuuc

SEQ ID NO: 1186550 - RNA, 19 nt, Human
uuucaccacguuggccagg

SEQ ID NO: 1186551 - RNA, 23 nt, Human
uuuuaguagagacgggguuucac

SEQ ID NO: 1186552 - RNA, 20 nt, Human
uuuuuguauuuuaguagaga

SEQ ID NO: 1186553 - RNA, 18 nt, Human
acuuugaagggaaaggaa

SEQ ID NO: 1186554 - RNA, 19 nt, Human
aggaagggaggagaaaaga

SEQ ID NO: 1186555 - RNA, 18 nt, Human
ggaggaauaacgaagaaa

SEQ ID NO: 1186556 - RNA, 22 nt, Human
uacuuugaagggaaaggaaggg

SEQ ID NO: 1186557 - RNA, 21 nt, Human
uauggaggaauaacgaagaaa

SEQ ID NO: 1186558 - RNA, 23 nt, Human
aaaaaacaaaaucaaaacaaaaa

SEQ ID NO: 1186559 - RNA, 23 nt, Human
aaaaaagacgaacauacuugauc

SEQ ID NO: 1186560 - RNA, 21 nt, Human
aaaaacaaaaauaucaccgaa

SEQ ID NO: 1186561 - RNA, 20 nt, Human
aaaaagacgaacauacuuga

SEQ ID NO: 1186562 - RNA, 21 nt, Human
aaaacaaaaucaaaacaaaaa

SEQ ID NO: 1186563 - RNA, 18 nt, Human
aaaagacaggagcaaaug

SEQ ID NO: 1186564 - RNA, 28 nt, Human
aaaauaaaaaugguauggggaauccacu

SEQ ID NO: 1186565 - RNA, 24 nt, Human
aaaauacauuagauuuuaugccaa

SEQ ID NO: 1186566 - RNA, 24 nt, Human
aaacaaaaacucuuuuuccuuaau

SEQ ID NO: 1186567 - RNA, 23 nt, Human
aaacaaacaauaacaacaacaac

SEQ ID NO: 1186568 - RNA, 22 nt, Human
aaacaaccacaacuagaauuca

SEQ ID NO: 1186569 - RNA, 19 nt, Human
aaagagcuagacauacucu

SEQ ID NO: 1186570 - RNA, 18 nt, Human
aaagcaaaagacaggagc

SEQ ID NO: 1186571 - RNA, 26 nt, Human
aaagcauaaaaauucagcaaggaaau

SEQ ID NO: 1186572 - RNA, 21 nt, Human
aaauccaacacauagucaaaa

SEQ ID NO: 1186573 - RNA, 25 nt, Human
aacaacaacaaaaaacaaaaucaaa

SEQ ID NO: 1186574 - RNA, 18 nt, Human
aacaaccaccaccaccac

SEQ ID NO: 1186575 - RNA, 19 nt, Human
aacauagcgagaccccauc

SEQ ID NO: 1186576 - RNA, 20 nt, Human
aacauagcgagaccccaucu

SEQ ID NO: 1186577 - RNA, 21 nt, Human
aacauagcgagaccccaucuc

SEQ ID NO: 1186578 - RNA, 19 nt, Human
aacauggugaaacuccguc

SEQ ID NO: 1186579 - RNA, 20 nt, Human
aacauggugaaacuccgucu

SEQ ID NO: 1186580 - RNA, 21 nt, Human
aacauggugaaacuccgucuc

SEQ ID NO: 1186581 - RNA, 19 nt, Human
aacuacagauaucaaaagg

SEQ ID NO: 1186582 - RNA, 23 nt, Human
aagaaucaaugagagucgguaga

SEQ ID NO: 1186583 - RNA, 18 nt, Human
aagagcuagacauacucu

SEQ ID NO: 1186584 - RNA, 27 nt, Human
aagcaaauaauaguaucaugcugagau

SEQ ID NO: 1186585 - RNA, 19 nt, Human
aagcagaaauacacaaaca

SEQ ID NO: 1186586 - RNA, 20 nt, Human
aagcagaaauacacaaacac

SEQ ID NO: 1186587 - RNA, 21 nt, Human
aagcuguuugaaucaguagaa

SEQ ID NO: 1186588 - RNA, 18 nt, Human
aagguaugaaacuugaaa

SEQ ID NO: 1186589 - RNA, 21 nt, Human
aauaacaacaacaacaaaaaa

SEQ ID NO: 1186590 - RNA, 31 nt, Human
aauacacaaacacacacacacacacacggug

SEQ ID NO: 1186591 - RNA, 27 nt, Human
aauaggacaauuaaagcaaaagacagg

SEQ ID NO: 1186592 - RNA, 21 nt, Human
aaugccacccuaacaugucaa

SEQ ID NO: 1186593 - RNA, 22 nt, Human
aaugugaguaucccuuaaugua

SEQ ID NO: 1186594 - RNA, 22 nt, Human
acaacaacaacaaaaaacaaaa

SEQ ID NO: 1186595 - RNA, 21 nt, Human
acaagagugaaacucuaucuc

SEQ ID NO: 1186596 - RNA, 26 nt, Human
acaauaacaacaacaacaaaaaacaa

SEQ ID NO: 1186597 - RNA, 21 nt, Human
acacaacccuaauuuuuuaag

SEQ ID NO: 1186598 - RNA, 23 nt, Human
acacacacacacacguauauagg

SEQ ID NO: 1186599 - RNA, 25 nt, Human
acacaccccaaauuaaaaaaaacaa

SEQ ID NO: 1186600 - RNA, 19 nt, Human
acacagcgaagaaauagcc

SEQ ID NO: 1186601 - RNA, 18 nt, Human
acacauagucaaaaggag

SEQ ID NO: 1186602 - RNA, 18 nt, Human
acaccacuacacuccagc

SEQ ID NO: 1186603 - RNA, 23 nt, Human
acaccccaaauuaaaaaaaacaa

SEQ ID NO: 1186604 - RNA, 23 nt, Human
acagaaaaccauuaugcuaaaac

SEQ ID NO: 1186605 - RNA, 24 nt, Human
acauagcgagaccccaucucaaaa

SEQ ID NO: 1186606 - RNA, 19 nt, Human
acauggugaaacuccgucu

SEQ ID NO: 1186607 - RNA, 29 nt, Human
accaccaccacacacacacacaccccaaa

SEQ ID NO: 1186608 - RNA, 21 nt, Human
accaccaccaccacacacaca

SEQ ID NO: 1186609 - RNA, 23 nt, Human
accaccaccaccaccacacacuu

SEQ ID NO: 1186610 - RNA, 24 nt, Human
accacuacacuccagccuggguga

SEQ ID NO: 1186611 - RNA, 21 nt, Human
accccaaaaauuaccaaaagu

SEQ ID NO: 1186612 - RNA, 18 nt, Human
accccaucucaaaaaaaa

SEQ ID NO: 1186613 - RNA, 20 nt, Human
accugccucccauccccacc

SEQ ID NO: 1186614 - RNA, 21 nt, Human
acgaaaucuaaucuugcuccu

SEQ ID NO: 1186615 - RNA, 18 nt, Human
acuacacuccagccuggg

SEQ ID NO: 1186616 - RNA, 25 nt, Human
acuccagccugggugacaagaguga

SEQ ID NO: 1186617 - RNA, 18 nt, Human
acuccggaggcugaggca

SEQ ID NO: 1186618 - RNA, 24 nt, Human
acuccgucucuacuaaaaauacaa

SEQ ID NO: 1186619 - RNA, 19 nt, Human
agaaaaaucuggaucagcu

SEQ ID NO: 1186620 - RNA, 19 nt, Human
agaaaaauuuggaucagcu

SEQ ID NO: 1186621 - RNA, 23 nt, Human
agaaaaccauuaugcuaaaacca

SEQ ID NO: 1186622 - RNA, 19 nt, Human
agaaacgagcaugagaaaa

SEQ ID NO: 1186623 - RNA, 24 nt, Human
agaaagcauuaaaaugacaaaaaa

SEQ ID NO: 1186624 - RNA, 26 nt, Human
agauaugugcacucuugauauccuuc

SEQ ID NO: 1186625 - RNA, 19 nt, Human
agccaggggugguggcagg

SEQ ID NO: 1186626 - RNA, 23 nt, Human
agccaggggugguggcaggcgcc

SEQ ID NO: 1186627 - RNA, 24 nt, Human
agcccuuugggaggcugaaauagg

SEQ ID NO: 1186628 - RNA, 22 nt, Human
agccuggcuaacauggugaaac

SEQ ID NO: 1186629 - RNA, 24 nt, Human
agccuggcuaacauggugaaacuc

SEQ ID NO: 1186630 - RNA, 24 nt, Human
agccuggucaacauagcgagaccc

SEQ ID NO: 1186631 - RNA, 26 nt, Human
aggaaaaagcaaguauuggguaugaa

SEQ ID NO: 1186632 - RNA, 21 nt, Human
aggaaagaaacgagcaugaga

SEQ ID NO: 1186633 - RNA, 24 nt, Human
aggaaagaaacgagcaugagaaaa

SEQ ID NO: 1186634 - RNA, 28 nt, Human
aggaaaugaagauauucaaaaagugguu

SEQ ID NO: 1186635 - RNA, 23 nt, Human
aggaggcacuauuaagagaucac

SEQ ID NO: 1186636 - RNA, 24 nt, Human
aggaucacuggagaccaggaguuc

SEQ ID NO: 1186637 - RNA, 23 nt, Human
aggcaaaaaaugauaaacuucca

SEQ ID NO: 1186638 - RNA, 21 nt, Human
aggcaggagaaucgcuugaac

SEQ ID NO: 1186639 - RNA, 23 nt, Human
aggcaggagaaucgcuugaacug

SEQ ID NO: 1186640 - RNA, 22 nt, Human
aggcggagauugcagugagcca

SEQ ID NO: 1186641 - RNA, 22 nt, Human
aggcggagauugcagugagcca

SEQ ID NO: 1186642 - RNA, 24 nt, Human
aggcggagauugcagugagccagg

SEQ ID NO: 1186643 - RNA, 20 nt, Human
aggcugaggcaggagaaucg

SEQ ID NO: 1186644 - RNA, 24 nt, Human
aggcugaggcaggagaaucgcuug

SEQ ID NO: 1186645 - RNA, 24 nt, Human
aggggugguggcaggcgccuguaa

SEQ ID NO: 1186646 - RNA, 24 nt, Human
aguggcucacaccuguaauucuag

SEQ ID NO: 1186647 - RNA, 24 nt, Human
aguugcaguggcucacaccuguaa

SEQ ID NO: 1186648 - RNA, 33 nt, Human
auacacaaacacacacacacacacacguauagu

SEQ ID NO: 1186649 - RNA, 23 nt, Human
aucacaaagcuauagagcuauag

SEQ ID NO: 1186650 - RNA, 24 nt, Human
aucacaccacuacacuccagccug

SEQ ID NO: 1186651 - RNA, 20 nt, Human
aucuugcuccuucaguucua

SEQ ID NO: 1186652 - RNA, 20 nt, Human
augccagcuggggcugcagu

SEQ ID NO: 1186653 - RNA, 22 nt, Human
caaaagcuguuuuacaucaaac

SEQ ID NO: 1186654 - RNA, 20 nt, Human
caaaaguuuuuaauauucac

SEQ ID NO: 1186655 - RNA, 24 nt, Human
caaacacauguauaugcuuaugca

SEQ ID NO: 1186656 - RNA, 20 nt, Human
caaauuaaaaaaaacaaaaa

SEQ ID NO: 1186657 - RNA, 24 nt, Human
caaauuaaaaaaaacaaaaauauc

SEQ ID NO: 1186658 - RNA, 21 nt, Human
caacaaaaaacaaaaucaaaa

SEQ ID NO: 1186659 - RNA, 21 nt, Human
caacaacaaaaaacaaaauca

SEQ ID NO: 1186660 - RNA, 23 nt, Human
caacaacaacaaaaaacaaaauc

SEQ ID NO: 1186661 - RNA, 18 nt, Human
caacauaaaauacuggga

SEQ ID NO: 1186662 - RNA, 20 nt, Human
caacauacaaaaaagacgaa

SEQ ID NO: 1186663 - RNA, 18 nt, Human
caaccaccaccaccacca

SEQ ID NO: 1186664 - RNA, 18 nt, Human
caagaacagccuggucaa

SEQ ID NO: 1186665 - RNA, 21 nt, Human
caagcaguaaaugccacccua

SEQ ID NO: 1186666 - RNA, 20 nt, Human
caauaaauuugacuaaauaa

SEQ ID NO: 1186667 - RNA, 19 nt, Human
caauggaucuccuugaucu

SEQ ID NO: 1186668 - RNA, 21 nt, Human
caauugaauacuagaggaugc

SEQ ID NO: 1186669 - RNA, 27 nt, Human
cacacacacacacacacguauauauca

SEQ ID NO: 1186670 - RNA, 25 nt, Human
cacacacacacacguauauaucaaa

SEQ ID NO: 1186671 - RNA, 23 nt, Human
cacacaccccaaauuaaaaaaaa

SEQ ID NO: 1186672 - RNA, 25 nt, Human
cacaccccaaauuaaaaaaaacaaa

SEQ ID NO: 1186673 - RNA, 24 nt, Human
cacaccuguaauucuagcccuuug

SEQ ID NO: 1186674 - RNA, 28 nt, Human
cacauguauaugcuuaugcauaugugug

SEQ ID NO: 1186675 - RNA, 20 nt, Human
caccacacacacacacaccc

SEQ ID NO: 1186676 - RNA, 22 nt, Human
caccaccacacacacacacacc

SEQ ID NO: 1186677 - RNA, 27 nt, Human
caccaccaccaccacacacacacacac

SEQ ID NO: 1186678 - RNA, 26 nt, Human
caccacuacacuccagccugggugac

SEQ ID NO: 1186679 - RNA, 24 nt, Human
caccuguaauucuagcccuuuggg

SEQ ID NO: 1186680 - RNA, 23 nt, Human
cacuccagccugggugacaagag

SEQ ID NO: 1186681 - RNA, 24 nt, Human
cacuccagccugggugacaagagu

SEQ ID NO: 1186682 - RNA, 25 nt, Human
cacuccagccugggugacaagagug

SEQ ID NO: 1186683 - RNA, 20 nt, Human
caguacuauauaacaaccac

SEQ ID NO: 1186684 - RNA, 24 nt, Human
caguagaaguuagaccugccuccc

SEQ ID NO: 1186685 - RNA, 20 nt, Human
cauacccaaaugagcaaacc

SEQ ID NO: 1186686 - RNA, 21 nt, Human
cauacccaaaugagcaaacca

SEQ ID NO: 1186687 - RNA, 23 nt, Human
cauagcgagaccccaucucaaaa

SEQ ID NO: 1186688 - RNA, 18 nt, Human
cauccccaccacauacaa

SEQ ID NO: 1186689 - RNA, 19 nt, Human
cauccccaccacauacaaa

SEQ ID NO: 1186690 - RNA, 25 nt, Human
caucuuguucuaagauugcacgaaa

SEQ ID NO: 1186691 - RNA, 27 nt, Human
cauucuuacuguucacauagucaagaa

SEQ ID NO: 1186692 - RNA, 21 nt, Human
ccaaaaauuaccaaaaguuuu

SEQ ID NO: 1186693 - RNA, 23 nt, Human
ccacacacacacacaccccaaau

SEQ ID NO: 1186694 - RNA, 21 nt, Human
ccaccaccacacacacacaca

SEQ ID NO: 1186695 - RNA, 31 nt, Human
ccaccaccaccacacacacacacaccccaag

SEQ ID NO: 1186696 - RNA, 20 nt, Human
ccacuacacuccagccuggg

SEQ ID NO: 1186697 - RNA, 21 nt, Human
ccacuacacuccagccugggu

SEQ ID NO: 1186698 - RNA, 24 nt, Human
ccacuacacuccagccugggugac

SEQ ID NO: 1186699 - RNA, 25 nt, Human
ccacuacacuccagccugggugaca

SEQ ID NO: 1186700 - RNA, 22 nt, Human
ccaguagauggcagaauaacau

SEQ ID NO: 1186701 - RNA, 19 nt, Human
ccucauacccaaaugagca

SEQ ID NO: 1186702 - RNA, 24 nt, Human
ccucccauccccaccacauacaaa

SEQ ID NO: 1186703 - RNA, 23 nt, Human
ccuggcuaacauggugaaacucc

SEQ ID NO: 1186704 - RNA, 24 nt, Human
ccuggucaacauagcgagacccca

SEQ ID NO: 1186705 - RNA, 23 nt, Human
ccuguaaugccaguuacuccgga

SEQ ID NO: 1186706 - RNA, 24 nt, Human
cgagaccagccuggcuaacauggu

SEQ ID NO: 1186707 - RNA, 23 nt, Human
cgagaccccaucucaaaaaaaaa

SEQ ID NO: 1186708 - RNA, 24 nt, Human
cgccuguaaugccaguuacuccgg

SEQ ID NO: 1186709 - RNA, 21 nt, Human
cuaaaacuagaauuaccccua

SEQ ID NO: 1186710 - RNA, 24 nt, Human
cuaucucaaaaaacaaacaauaac

SEQ ID NO: 1186711 - RNA, 24 nt, Human
cucacaccuguaauucuagcccuu

SEQ ID NO: 1186712 - RNA, 21 nt, Human
cucuuuggacuuacaauugga

SEQ ID NO: 1186713 - RNA, 22 nt, Human
cugaggucaggaguucgagacc

SEQ ID NO: 1186714 - RNA, 24 nt, Human
cuggcacuugggugaaaugaggca

SEQ ID NO: 1186715 - RNA, 22 nt, Human
cuugcuguaaauagagaauaaa

SEQ ID NO: 1186716 - RNA, 21 nt, Human
gaaagcaguugcucugagacu

SEQ ID NO: 1186717 - RNA, 21 nt, Human
gaaauauacuuacuguccaaa

SEQ ID NO: 1186718 - RNA, 19 nt, Human
gaccugccucccaucccca

SEQ ID NO: 1186719 - RNA, 23 nt, Human
gagaaucgcuugaacuggggagg

SEQ ID NO: 1186720 - RNA, 22 nt, Human
gagauugcagugagccaggauc

SEQ ID NO: 1186721 - RNA, 21 nt, Human
gaggaucacuggagaccagga

SEQ ID NO: 1186722 - RNA, 24 nt, Human
gaucacuggagaccaggaguucaa

SEQ ID NO: 1186723 - RNA, 19 nt, Human
gccaggaucacaccacuac

SEQ ID NO: 1186724 - RNA, 19 nt, Human
gccaguugcaguggcucac

SEQ ID NO: 1186725 - RNA, 24 nt, Human
gcuaacauggugaaacuccgucuc

SEQ ID NO: 1186726 - RNA, 18 nt, Human
ggagauugcagugagcca

SEQ ID NO: 1186727 - RNA, 19 nt, Human
ggagauugcagugagccag

SEQ ID NO: 1186728 - RNA, 24 nt, Human
ggagauugcagugagccaggauca

SEQ ID NO: 1186729 - RNA, 18 nt, Human
gggaaucacuaaauccaa

SEQ ID NO: 1186730 - RNA, 25 nt, Human
gggcugcaguugucugaagguucug

SEQ ID NO: 1186731 - RNA, 18 nt, Human
gguuuuguuauuacuguu

SEQ ID NO: 1186732 - RNA, 23 nt, Human
guauguguauauacauauaugaa

SEQ ID NO: 1186733 - RNA, 21 nt, Human
gugaaacuccgucucuacuaa

SEQ ID NO: 1186734 - RNA, 24 nt, Human
gugcuauaaaaauuucuggguuuu

SEQ ID NO: 1186735 - RNA, 27 nt, Human
uaaaaaaaacaaaaauaucaccgaaag

SEQ ID NO: 1186736 - RNA, 21 nt, Human
uaaaaauacaaaaauuagcca

SEQ ID NO: 1186737 - RNA, 28 nt, Human
uaaaacaaccacaacuagaaggucaucc

SEQ ID NO: 1186738 - RNA, 19 nt, Human
uaaaauaaaggucauagcu

SEQ ID NO: 1186739 - RNA, 21 nt, Human
uaaaauacugggauaauuaug

SEQ ID NO: 1186740 - RNA, 22 nt, Human
uaaaaugacaaaaaaacuaauu

SEQ ID NO: 1186741 - RNA, 23 nt, Human
uaaacaaagacuuuuaauuuuaa

SEQ ID NO: 1186742 - RNA, 23 nt, Human
uaaaccaauugacaaugcacuca

SEQ ID NO: 1186743 - RNA, 19 nt, Human
uaaagcaaaagacaggagc

SEQ ID NO: 1186744 - RNA, 21 nt, Human
uaaagcauaaaaauucagcaa

SEQ ID NO: 1186745 - RNA, 23 nt, Human
uaaauccaacacauagucaaaag

SEQ ID NO: 1186746 - RNA, 23 nt, Human
uaacaaaggaauccuaaaacuag

SEQ ID NO: 1186747 - RNA, 24 nt, Human
uaacaacaacaacaaaaaacaaaa

SEQ ID NO: 1186748 - RNA, 22 nt, Human
uaacauggugaaacuccgucuc

SEQ ID NO: 1186749 - RNA, 24 nt, Human
uaacauggugaaacuccgucucua

SEQ ID NO: 1186750 - RNA, 21 nt, Human
uaacgaaaucccauucaaagc

SEQ ID NO: 1186751 - RNA, 24 nt, Human
uaacuagaaagaaaagcuacuuga

SEQ ID NO: 1186752 - RNA, 19 nt, Human
uaagaguccuuucuaaccc

SEQ ID NO: 1186753 - RNA, 26 nt, Human
uaaggugaaaauaugagaauugaccc

SEQ ID NO: 1186754 - RNA, 21 nt, Human
uaauaugaaauuggcuuuuau

SEQ ID NO: 1186755 - RNA, 21 nt, Human
uacaaaggaaaaacacuugau

SEQ ID NO: 1186756 - RNA, 22 nt, Human
uaccccaaaaauuaccaaaagu

SEQ ID NO: 1186757 - RNA, 19 nt, Human
uagaaauauacuuacuguc

SEQ ID NO: 1186758 - RNA, 21 nt, Human
uagaaguuagaccugccuccc

SEQ ID NO: 1186759 - RNA, 24 nt, Human
uagacaacgaaacuucugaaguuu

SEQ ID NO: 1186760 - RNA, 24 nt, Human
uagcccuuugggaggcugaaauag

SEQ ID NO: 1186761 - RNA, 18 nt, Human
uagcgagaccccaucuca

SEQ ID NO: 1186762 - RNA, 18 nt, Human
uaguugaugccauucuua

SEQ ID NO: 1186763 - RNA, 19 nt, Human
uauaugcucaacaauugaa

SEQ ID NO: 1186764 - RNA, 22 nt, Human
uaucaaaaggaaagugacuuug

SEQ ID NO: 1186765 - RNA, 19 nt, Human
uaucuggagaaagauggag

SEQ ID NO: 1186766 - RNA, 20 nt, Human
uaugccaccuaaugauaaaa

SEQ ID NO: 1186767 - RNA, 21 nt, Human
uauggggaauccacucaaagg

SEQ ID NO: 1186768 - RNA, 19 nt, Human
uauguguauauacauauau

SEQ ID NO: 1186769 - RNA, 20 nt, Human
uauguguauauacauauaug

SEQ ID NO: 1186770 - RNA, 21 nt, Human
ucaaagcagaaauacacaaac

SEQ ID NO: 1186771 - RNA, 23 nt, Human
ucacuggagaccaggaguucaag

SEQ ID NO: 1186772 - RNA, 22 nt, Human
ucauacccaaaugagcaaacca

SEQ ID NO: 1186773 - RNA, 19 nt, Human
ucauagcuauuuaaaucug

SEQ ID NO: 1186774 - RNA, 22 nt, Human
ucauucucauuuuaacuagaaa

SEQ ID NO: 1186775 - RNA, 20 nt, Human
uccagaugaaauguugcaga

SEQ ID NO: 1186776 - RNA, 19 nt, Human
uccagccugggugacaaga

SEQ ID NO: 1186777 - RNA, 21 nt, Human
uccuaauuaaugaggaacuuc

SEQ ID NO: 1186778 - RNA, 23 nt, Human
ucuaccguaccccaaaaauuacc

SEQ ID NO: 1186779 - RNA, 21 nt, Human
ucucuacuaaaaauacaaaaa

SEQ ID NO: 1186780 - RNA, 21 nt, Human
ucuggccuauuuucugucacu

SEQ ID NO: 1186781 - RNA, 23 nt, Human
ucuggccuauuuucugucacuuc

SEQ ID NO: 1186782 - RNA, 23 nt, Human
ucuuugagcccauggguggcacu

SEQ ID NO: 1186783 - RNA, 19 nt, Human
ugaaaaaagaucauuggaa

SEQ ID NO: 1186784 - RNA, 22 nt, Human
ugaaaauaugagaauugaccca

SEQ ID NO: 1186785 - RNA, 18 nt, Human
ugaaacuacagauaucaa

SEQ ID NO: 1186786 - RNA, 26 nt, Human
ugaaauaggaggaucacuggagacca

SEQ ID NO: 1186787 - RNA, 18 nt, Human
ugaacuuucacaugugcu

SEQ ID NO: 1186788 - RNA, 18 nt, Human
ugaagguucuguuugggc

SEQ ID NO: 1186789 - RNA, 20 nt, Human
ugaauuagaaauaaguuuua

SEQ ID NO: 1186790 - RNA, 18 nt, Human
ugacagaugaugaaacua

SEQ ID NO: 1186791 - RNA, 19 nt, Human
ugacagaugaugaaacuac

SEQ ID NO: 1186792 - RNA, 18 nt, Human
ugacuuuggauuuggggg

SEQ ID NO: 1186793 - RNA, 25 nt, Human
ugacuuuggauuugggggcugaguu

SEQ ID NO: 1186794 - RNA, 18 nt, Human
ugagaaaauuugugaaua

SEQ ID NO: 1186795 - RNA, 20 nt, Human
ugaggcaaaaaaugauaaac

SEQ ID NO: 1186796 - RNA, 20 nt, Human
ugaggcaggagaaucgcuug

SEQ ID NO: 1186797 - RNA, 23 nt, Human
ugaggcaggagaaucgcuugaac

SEQ ID NO: 1186798 - RNA, 23 nt, Human
ugaggcaggagaaucgcuugaac

SEQ ID NO: 1186799 - RNA, 20 nt, Human
ugagggaaaaaaugcuuggu

SEQ ID NO: 1186800 - RNA, 20 nt, Human
ugauuugauccucauaccca

SEQ ID NO: 1186801 - RNA, 25 nt, Human
ugcauucuaaacugucuggcuaacc

SEQ ID NO: 1186802 - RNA, 23 nt, Human
ugcuaaaaccacauauuuccuac

SEQ ID NO: 1186803 - RNA, 19 nt, Human
ugcuauaaaaauuucuggg

SEQ ID NO: 1186804 - RNA, 20 nt, Human
uggaaagcaguugcucugag

SEQ ID NO: 1186805 - RNA, 26 nt, Human
uggagaaugaggaaauggguaguuga

SEQ ID NO: 1186806 - RNA, 24 nt, Human
uggcucagguacacaauucaacag

SEQ ID NO: 1186807 - RNA, 23 nt, Human
uggcuuguacuagaggaagugau

SEQ ID NO: 1186808 - RNA, 25 nt, Human
ugggaagaaucuuuaaaaauccauu

SEQ ID NO: 1186809 - RNA, 19 nt, Human
ugggaggcugaaauaggag

SEQ ID NO: 1186810 - RNA, 24 nt, Human
ugggaggcugaaauaggaggauca

SEQ ID NO: 1186811 - RNA, 18 nt, Human
uguguauauacauauaug

SEQ ID NO: 1186812 - RNA, 20 nt, Human
uuaaagcaaaagacaggagc

SEQ ID NO: 1186813 - RNA, 23 nt, Human
uuaaagcaaaagacaggagcaaa

SEQ ID NO: 1186814 - RNA, 19 nt, Human
uuaagagaucacuuguugu

SEQ ID NO: 1186815 - RNA, 18 nt, Human
uucaaaaagugguuaugg

SEQ ID NO: 1186816 - RNA, 23 nt, Human
uucaaagcagaaauacacaaaca

SEQ ID NO: 1186817 - RNA, 22 nt, Human
uucaggaggcacuauuaagaga

SEQ ID NO: 1186818 - RNA, 21 nt, Human
uuccuggcuggaagaauguuu

SEQ ID NO: 1186819 - RNA, 19 nt, Human
uucuuugagcccaugggug

SEQ ID NO: 1186820 - RNA, 23 nt, Human
uugaaguaaacacugcuuaguau

SEQ ID NO: 1186821 - RNA, 21 nt, Human
uugacuaaauaaaugaagaaa

SEQ ID NO: 1186822 - RNA, 21 nt, Human
uugacuggcacuugggugaaa

SEQ ID NO: 1186823 - RNA, 22 nt, Human
uugagcccauggguggcacuaa

SEQ ID NO: 1186824 - RNA, 20 nt, Human
uugcagugagccaggaucac

SEQ ID NO: 1186825 - RNA, 24 nt, Human
uugccaaauugcauucuaaacugu

SEQ ID NO: 1186826 - RNA, 25 nt, Human
uugggaggcugaaauaggaggauca

SEQ ID NO: 1186827 - RNA, 23 nt, Human
uuuacaucaaacacauguauaug

SEQ ID NO: 1186828 - RNA, 21 nt, Human
uuuggcucagguacacaauuc

SEQ ID NO: 1186829 - RNA, 20 nt, Human
auguggccaaaaggguuaua

SEQ ID NO: 1186830 - RNA, 24 nt, Human
auuacugagauccccagaacgcca

SEQ ID NO: 1186831 - RNA, 20 nt, Human
auucuguuuuucucacuuca

SEQ ID NO: 1186832 - RNA, 23 nt, Human
caacgcaaacacuuaguauccca

SEQ ID NO: 1186833 - RNA, 24 nt, Human
cacuccuguuccucucauuugaga

SEQ ID NO: 1186834 - RNA, 25 nt, Human
cacuccuguuccucucauuugagag

SEQ ID NO: 1186835 - RNA, 18 nt, Human
cagcaucucucagagucc

SEQ ID NO: 1186836 - RNA, 20 nt, Human
ccaauauuugcaacgcaaaa

SEQ ID NO: 1186837 - RNA, 30 nt, Human
cuccugcuuccauagacccugcuuuugauu

SEQ ID NO: 1186838 - RNA, 23 nt, Human
cucucuuagcucuuucucuucca

SEQ ID NO: 1186839 - RNA, 22 nt, Human
cucuuccacaacgaacauguug

SEQ ID NO: 1186840 - RNA, 25 nt, Human
cugcauucuguuuuucucacuucac

SEQ ID NO: 1186841 - RNA, 18 nt, Human
cugcuuuugauacagggg

SEQ ID NO: 1186842 - RNA, 18 nt, Human
cugggugaaauccaagcu

SEQ ID NO: 1186843 - RNA, 18 nt, Human
ggagagucuccauuggaa

SEQ ID NO: 1186844 - RNA, 18 nt, Human
uagaaaaugcugaauaau

SEQ ID NO: 1186845 - RNA, 20 nt, Human
uagaaaaugcugaauaauug

SEQ ID NO: 1186846 - RNA, 19 nt, Human
uagagucuccgagcauuuc

SEQ ID NO: 1186847 - RNA, 19 nt, Human
uauuguuaauuauccuccu

SEQ ID NO: 1186848 - RNA, 20 nt, Human
ucagagucccacaagccaac

SEQ ID NO: 1186849 - RNA, 18 nt, Human
uccaagcuggguaguuga

SEQ ID NO: 1186850 - RNA, 27 nt, Human
uccaggcucaugugauuaaaaauccac

SEQ ID NO: 1186851 - RNA, 20 nt, Human
uccauagacccugcuuuuga

SEQ ID NO: 1186852 - RNA, 20 nt, Human
uccuugauucuacccguuug

SEQ ID NO: 1186853 - RNA, 21 nt, Human
ucucagagucccacaagccaa

SEQ ID NO: 1186854 - RNA, 19 nt, Human
ucuccauuggaaguccucc

SEQ ID NO: 1186855 - RNA, 21 nt, Human
ucucccacacaaagcucuugg

SEQ ID NO: 1186856 - RNA, 27 nt, Human
ucucuuagcucuuucucuucgggccgc

SEQ ID NO: 1186857 - RNA, 18 nt, Human
ucuugcuuuuuugcaugu

SEQ ID NO: 1186858 - RNA, 18 nt, Human
ugagagcacacuccuuga

SEQ ID NO: 1186859 - RNA, 18 nt, Human
ugagccaaauauucaggu

SEQ ID NO: 1186860 - RNA, 24 nt, Human
ugcaacgcaaacacuuaguauccc

SEQ ID NO: 1186861 - RNA, 23 nt, Human
ugcuugaaacgaaccuugaaagc

SEQ ID NO: 1186862 - RNA, 19 nt, Human
ugggugaaauccaagcugg

SEQ ID NO: 1186863 - RNA, 21 nt, Human
ugugugaagggcucugacaca

SEQ ID NO: 1186864 - RNA, 19 nt, Human
uugaaagcugcauucuguu

SEQ ID NO: 1186865 - RNA, 20 nt, Human
uugcagugguagaaaaugcu

SEQ ID NO: 1186866 - RNA, 23 nt, Human
uuggaaguccuccugcuuccaua

SEQ ID NO: 1186867 - RNA, 26 nt, Human
uuucggugcucugcucugagcuucuc

SEQ ID NO: 1186868 - RNA, 21 nt, Human
aaccccacuuuccuuuccagc

SEQ ID NO: 1186869 - RNA, 24 nt, Human
accacguuuucuuuauccauucau

SEQ ID NO: 1186870 - RNA, 19 nt, Human
accagagaccccagauacc

SEQ ID NO: 1186871 - RNA, 21 nt, Human
accauucccaccuuccuccca

SEQ ID NO: 1186872 - RNA, 21 nt, Human
acuguugugcuaucaaauauu

SEQ ID NO: 1186873 - RNA, 18 nt, Human
agcacauuguuaaugagc

SEQ ID NO: 1186874 - RNA, 21 nt, Human
agugcugcaauaaacaugggg

SEQ ID NO: 1186875 - RNA, 20 nt, Human
augaucaccugcggggaggc

SEQ ID NO: 1186876 - RNA, 20 nt, Human
caacugcgccccgcccacag

SEQ ID NO: 1186877 - RNA, 19 nt, Human
caauggcuguagucccaga

SEQ ID NO: 1186878 - RNA, 24 nt, Human
cacagcaauggcuguagucccaga

SEQ ID NO: 1186879 - RNA, 27 nt, Human
cacagcaauggcuguagucccagaugc

SEQ ID NO: 1186880 - RNA, 27 nt, Human
caccagagaccccagauaccugggcga

SEQ ID NO: 1186881 - RNA, 20 nt, Human
cacccgccucugggagcggg

SEQ ID NO: 1186882 - RNA, 22 nt, Human
caccugagacccgaggacaccu

SEQ ID NO: 1186883 - RNA, 24 nt, Human
cagccaccugagacccgaggacac

SEQ ID NO: 1186884 - RNA, 23 nt, Human
cagccaggcaaccucaagcccuc

SEQ ID NO: 1186885 - RNA, 18 nt, Human
ccaggccucgccuguggc

SEQ ID NO: 1186886 - RNA, 22 nt, Human
ccauucccaccuuccucccaac

SEQ ID NO: 1186887 - RNA, 19 nt, Human
ccccacuuuccuuuccagc

SEQ ID NO: 1186888 - RNA, 18 nt, Human
ccuuggccaggccucgcc

SEQ ID NO: 1186889 - RNA, 19 nt, Human
cgaggacaccugcaggagg

SEQ ID NO: 1186890 - RNA, 20 nt, Human
cuacucucuauguccaagag

SEQ ID NO: 1186891 - RNA, 19 nt, Human
cucaggucucugcacccuc

SEQ ID NO: 1186892 - RNA, 21 nt, Human
cucauuuuuuuaauggcugaa

SEQ ID NO: 1186893 - RNA, 18 nt, Human
cucucaagaccugcccua

SEQ ID NO: 1186894 - RNA, 20 nt, Human
cugcacccucccccaacugc

SEQ ID NO: 1186895 - RNA, 21 nt, Human
cuuuccuuuccagcuucuggu

SEQ ID NO: 1186896 - RNA, 20 nt, Human
gccccgccucuguccgcacc

SEQ ID NO: 1186897 - RNA, 23 nt, Human
gccccgccucuguccgcaccacc

SEQ ID NO: 1186898 - RNA, 20 nt, Human
gcuggaccucucaagaccug

SEQ ID NO: 1186899 - RNA, 22 nt, Human
ggauggugcggggggagaacag

SEQ ID NO: 1186900 - RNA, 20 nt, Human
guugugcuaucaaauauuag

SEQ ID NO: 1186901 - RNA, 19 nt, Human
uaagugagaacaugugaug

SEQ ID NO: 1186902 - RNA, 23 nt, Human
uagaucccacaaauaagugagaa

SEQ ID NO: 1186903 - RNA, 18 nt, Human
uccaagaguucaauuguu

SEQ ID NO: 1186904 - RNA, 22 nt, Human
ucccaaccccacuuuccuuucc

SEQ ID NO: 1186905 - RNA, 23 nt, Human
ucccaccuuccucccaaccccac

SEQ ID NO: 1186906 - RNA, 23 nt, Human
ucccccaacugcgccccgcccac

SEQ ID NO: 1186907 - RNA, 21 nt, Human
uccucccaaccccacuuuccu

SEQ ID NO: 1186908 - RNA, 24 nt, Human
ucuuggcuguugugaacagugcug

SEQ ID NO: 1186909 - RNA, 21 nt, Human
ugacaguagucacacuguugu

SEQ ID NO: 1186910 - RNA, 20 nt, Human
ugcccuagaugcgcccacac

SEQ ID NO: 1186911 - RNA, 22 nt, Human
ugcggggggagaacagcugcac

SEQ ID NO: 1186912 - RNA, 20 nt, Human
uggcugaagaguacuccauu

SEQ ID NO: 1186913 - RNA, 22 nt, Human
uguaccuauuaaccauucccac

SEQ ID NO: 1186914 - RNA, 18 nt, Human
uguccaagaguucaauug

SEQ ID NO: 1186915 - RNA, 24 nt, Human
uguugugaacagugcugcaauaaa

SEQ ID NO: 1186916 - RNA, 24 nt, Human
uucugugccuggcuuauuucacuu

SEQ ID NO: 1186917 - RNA, 19 nt, Human
uuguaccuauuaaccauuc

SEQ ID NO: 1186918 - RNA, 21 nt, Human
uuugucuuucugugccuggcu

SEQ ID NO: 1186919 - RNA, 21 nt, Human
aaaagcagcaaagccccacca

SEQ ID NO: 1186920 - RNA, 22 nt, Human
aacgaaaaaagacugggagaaa

SEQ ID NO: 1186921 - RNA, 21 nt, Human
aaucccaucucuucucacauc

SEQ ID NO: 1186922 - RNA, 18 nt, Human
aauggagaaaccagcgga

SEQ ID NO: 1186923 - RNA, 19 nt, Human
acacagcgucucaggggcc

SEQ ID NO: 1186924 - RNA, 20 nt, Human
accccuaggagccaacagaa

SEQ ID NO: 1186925 - RNA, 20 nt, Human
acccgccucaccccuccgcu

SEQ ID NO: 1186926 - RNA, 18 nt, Human
acccuagagggucgagcc

SEQ ID NO: 1186927 - RNA, 22 nt, Human
acucagagcccagcucagucuc

SEQ ID NO: 1186928 - RNA, 26 nt, Human
agaaagacagccgcgcccccugcagg

SEQ ID NO: 1186929 - RNA, 18 nt, Human
agaaagagccagcguaaa

SEQ ID NO: 1186930 - RNA, 22 nt, Human
agacugggagaaagagccagcg

SEQ ID NO: 1186931 - RNA, 21 nt, Human
agcacuggguggaggccucug

SEQ ID NO: 1186932 - RNA, 24 nt, Human
agcuggggacaaggguggcuccca

SEQ ID NO: 1186933 - RNA, 25 nt, Human
aggagcagcagaggaaggccgcggc

SEQ ID NO: 1186934 - RNA, 18 nt, Human
aggcaaaagcagcaaagc

SEQ ID NO: 1186935 - RNA, 22 nt, Human
aggcaaaagcagcaaagcccca

SEQ ID NO: 1186936 - RNA, 24 nt, Human
aggcaaaagcagcaaagccccacc

SEQ ID NO: 1186937 - RNA, 18 nt, Human
agugcccaccccgguggg

SEQ ID NO: 1186938 - RNA, 20 nt, Human
agugcccaccuguucccugc

SEQ ID NO: 1186939 - RNA, 22 nt, Human
auaucacccccucccucaccag

SEQ ID NO: 1186940 - RNA, 21 nt, Human
caaaaggcgagccccacgccu

SEQ ID NO: 1186941 - RNA, 20 nt, Human
caacggaagaaugcgaggaa

SEQ ID NO: 1186942 - RNA, 24 nt, Human
cacagcaagcaccagcggcccccg

SEQ ID NO: 1186943 - RNA, 20 nt, Human
caccacggcgccugcccucu

SEQ ID NO: 1186944 - RNA, 19 nt, Human
caccagccgccggcccagc

SEQ ID NO: 1186945 - RNA, 18 nt, Human
cacccagggaggaccuca

SEQ ID NO: 1186946 - RNA, 19 nt, Human
cacccccucccucaccagc

SEQ ID NO: 1186947 - RNA, 21 nt, Human
caccccuaggagccaacagaa

SEQ ID NO: 1186948 - RNA, 20 nt, Human
caccuccuuccgcggagggu

SEQ ID NO: 1186949 - RNA, 26 nt, Human
caccucugcaucccccucuuuggaaa

SEQ ID NO: 1186950 - RNA, 23 nt, Human
caccuguucccugcgaucuuccg

SEQ ID NO: 1186951 - RNA, 21 nt, Human
cacgcugugaccaaggcugug

SEQ ID NO: 1186952 - RNA, 24 nt, Human
cacgcugugaccaaggcuguggug

SEQ ID NO: 1186953 - RNA, 22 nt, Human
cagccgccggcccagcugggga

SEQ ID NO: 1186954 - RNA, 23 nt, Human
cagcgucucaggggcaggcuggg

SEQ ID NO: 1186955 - RNA, 22 nt, Human
caggauuagggagaagaggggg

SEQ ID NO: 1186956 - RNA, 23 nt, Human
caucccugcccugagguccagag

SEQ ID NO: 1186957 - RNA, 24 nt, Human
ccaccacggcgccugcccucugga

SEQ ID NO: 1186958 - RNA, 24 nt, Human
ccacccagggaggaccucagccgc

SEQ ID NO: 1186959 - RNA, 24 nt, Human
ccacgucagccggacugaagcucu

SEQ ID NO: 1186960 - RNA, 18 nt, Human
ccacugggaagaagcaga

SEQ ID NO: 1186961 - RNA, 23 nt, Human
ccagcacuggguggaggccucug

SEQ ID NO: 1186962 - RNA, 19 nt, Human
ccagccgccggcccagcug

SEQ ID NO: 1186963 - RNA, 26 nt, Human
ccccaccaggaauagugauggccacc

SEQ ID NO: 1186964 - RNA, 23 nt, Human
cccccgugcuggacagcauggcu

SEQ ID NO: 1186965 - RNA, 21 nt, Human
cccugcaccgccugcggcccu

SEQ ID NO: 1186966 - RNA, 19 nt, Human
ccgccgccgccugcccucc

SEQ ID NO: 1186967 - RNA, 21 nt, Human
ccgcugggucgcucuggccgc

SEQ ID NO: 1186968 - RNA, 23 nt, Human
ccucaaccgcucagccucccucg

SEQ ID NO: 1186969 - RNA, 23 nt, Human
ccuccgaaaaaugagggcacaga

SEQ ID NO: 1186970 - RNA, 19 nt, Human
ccugcccugagguccagag

SEQ ID NO: 1186971 - RNA, 18 nt, Human
ccuggaggugcaccagcc

SEQ ID NO: 1186972 - RNA, 22 nt, Human
cgagcggcaaaaggcgagcccc

SEQ ID NO: 1186973 - RNA, 21 nt, Human
cggcucuucccugcccuugcc

SEQ ID NO: 1186974 - RNA, 23 nt, Human
cgggcacccccaccacggcgccu

SEQ ID NO: 1186975 - RNA, 23 nt, Human
cguggcacggauaucacccccuc

SEQ ID NO: 1186976 - RNA, 23 nt, Human
cuccacuccacaucaggcuacaa

SEQ ID NO: 1186977 - RNA, 19 nt, Human
cuccuggcucuuggguucu

SEQ ID NO: 1186978 - RNA, 21 nt, Human
cugcagacugauuucccgcca

SEQ ID NO: 1186979 - RNA, 22 nt, Human
cuggcacagccuggaggugcac

SEQ ID NO: 1186980 - RNA, 26 nt, Human
cuuaaaacgaaaaaagacugggagaa

SEQ ID NO: 1186981 - RNA, 20 nt, Human
cuuguuguccuggcaacccc

SEQ ID NO: 1186982 - RNA, 23 nt, Human
gaagccgcugucuaacaucccug

SEQ ID NO: 1186983 - RNA, 21 nt, Human
gaagcucucccugcaccgccu

SEQ ID NO: 1186984 - RNA, 18 nt, Human
gacagcauggcuaauggg

SEQ ID NO: 1186985 - RNA, 19 nt, Human
gagcagcagaggaaggccg

SEQ ID NO: 1186986 - RNA, 20 nt, Human
gaugggggcagcggggcugg

SEQ ID NO: 1186987 - RNA, 24 nt, Human
gcaaaaggcgagccccacgccuga

SEQ ID NO: 1186988 - RNA, 21 nt, Human
gcaaacaaugacaccuccuuc

SEQ ID NO: 1186989 - RNA, 24 nt, Human
gcaagcaccagcggcccccgugcu

SEQ ID NO: 1186990 - RNA, 21 nt, Human
gcauuuuaugccuagggcagg

SEQ ID NO: 1186991 - RNA, 23 nt, Human
gccgccgccugcccuccagccuc

SEQ ID NO: 1186992 - RNA, 24 nt, Human
gccuucaacggaagggucuauggc

SEQ ID NO: 1186993 - RNA, 21 nt, Human
ggacaaggguggcucccaccc

SEQ ID NO: 1186994 - RNA, 18 nt, Human
ggcucccacccagggagg

SEQ ID NO: 1186995 - RNA, 21 nt, Human
gggcacagaggauagugccca

SEQ ID NO: 1186996 - RNA, 22 nt, Human
gggcagcggggcuggggcuggg

SEQ ID NO: 1186997 - RNA, 19 nt, Human
gggcucggguguagggugc

SEQ ID NO: 1186998 - RNA, 20 nt, Human
gggggcagcggggcuggggc

SEQ ID NO: 1186999 - RNA, 21 nt, Human
ggguggaggccucugcuggcu

SEQ ID NO: 1187000 - RNA, 20 nt, Human
gugcaggugagugggcccgg

SEQ ID NO: 1187001 - RNA, 21 nt, Human
uaaugugguacagcagugguc

SEQ ID NO: 1187002 - RNA, 29 nt, Human
uacacucagagcccagcucagucucacaa

SEQ ID NO: 1187003 - RNA, 18 nt, Human
uacagcaguggucacaga

SEQ ID NO: 1187004 - RNA, 20 nt, Human
uacagcaguggucacagagc

SEQ ID NO: 1187005 - RNA, 22 nt, Human
uaccacgugcucccuaacucug

SEQ ID NO: 1187006 - RNA, 19 nt, Human
uagugcccaccccgguggg

SEQ ID NO: 1187007 - RNA, 24 nt, Human
uaugcaauaaaaaaugauugauuc

SEQ ID NO: 1187008 - RNA, 21 nt, Human
ucaaacaggucaggaaucuga

SEQ ID NO: 1187009 - RNA, 24 nt, Human
ucacagcaagcaccagcggccccc

SEQ ID NO: 1187010 - RNA, 19 nt, Human
ucacccccucccucaccag

SEQ ID NO: 1187011 - RNA, 22 nt, Human
ucagagcccagcucagucucac

SEQ ID NO: 1187012 - RNA, 19 nt, Human
ucagccucccucggcuccc

SEQ ID NO: 1187013 - RNA, 21 nt, Human
ucaggauuagggagaagaggg

SEQ ID NO: 1187014 - RNA, 19 nt, Human
ucagggaaguggugacacu

SEQ ID NO: 1187015 - RNA, 20 nt, Human
uccacuccacaucaggcuac

SEQ ID NO: 1187016 - RNA, 21 nt, Human
ucccagcccaacggaagaaug

SEQ ID NO: 1187017 - RNA, 19 nt, Human
ucccugcaccgccugcggc

SEQ ID NO: 1187018 - RNA, 23 nt, Human
ucccugcaccgccugcggcccug

SEQ ID NO: 1187019 - RNA, 20 nt, Human
ucccugcgaucuuccgcggg

SEQ ID NO: 1187020 - RNA, 22 nt, Human
ucgagcccugggcuccuggcuc

SEQ ID NO: 1187021 - RNA, 19 nt, Human
ucugcagcuauggucucuc

SEQ ID NO: 1187022 - RNA, 18 nt, Human
ugacacuuguguccagcc

SEQ ID NO: 1187023 - RNA, 24 nt, Human
ugagguccagagaccuugcauuuu

SEQ ID NO: 1187024 - RNA, 20 nt, Human
ugauuccagcccaccuaggg

SEQ ID NO: 1187025 - RNA, 25 nt, Human
ugcaccagccuguccugugugcucu

SEQ ID NO: 1187026 - RNA, 19 nt, Human
ugcaggugagugggcccgg

SEQ ID NO: 1187027 - RNA, 20 nt, Human
ugccuagggcaggguugguu

SEQ ID NO: 1187028 - RNA, 21 nt, Human
ugccuagggcaggguugguuu

SEQ ID NO: 1187029 - RNA, 18 nt, Human
ugccuggccuggccgugg

SEQ ID NO: 1187030 - RNA, 18 nt, Human
ugcgugagccugcuggca

SEQ ID NO: 1187031 - RNA, 23 nt, Human
uggagaaaccagcggaugcugca

SEQ ID NO: 1187032 - RNA, 23 nt, Human
uggcaucgguccugcagacugau

SEQ ID NO: 1187033 - RNA, 18 nt, Human
ugggaagaagcagauggg

SEQ ID NO: 1187034 - RNA, 21 nt, Human
ugggaggagcugacccgucgg

SEQ ID NO: 1187035 - RNA, 18 nt, Human
ugggggcagcggggcugg

SEQ ID NO: 1187036 - RNA, 20 nt, Human
ugggggcagcggggcugggg

SEQ ID NO: 1187037 - RNA, 20 nt, Human
ugugagcaggggcagagacu

SEQ ID NO: 1187038 - RNA, 22 nt, Human
uucagggaaguggugacacuug

SEQ ID NO: 1187039 - RNA, 19 nt, Human
uuccuggcacagccuggag

SEQ ID NO: 1187040 - RNA, 18 nt, Human
uuuccuggcacagccugg

SEQ ID NO: 1187041 - RNA, 20 nt, Human
aaaguggccuuggccugugg

SEQ ID NO: 1187042 - RNA, 18 nt, Human
acccaggcgguccccagc

SEQ ID NO: 1187043 - RNA, 23 nt, Human
accccuggcucuccugggcugag

SEQ ID NO: 1187044 - RNA, 21 nt, Human
acccgggccucagcgccuagc

SEQ ID NO: 1187045 - RNA, 21 nt, Human
acuggaccccuggcucuccug

SEQ ID NO: 1187046 - RNA, 22 nt, Human
agaagaccagccugugcacugu

SEQ ID NO: 1187047 - RNA, 19 nt, Human
agaagggccaaggaggggu

SEQ ID NO: 1187048 - RNA, 24 nt, Human
agacaggaagugcccagcagcagc

SEQ ID NO: 1187049 - RNA, 21 nt, Human
agacaggaugaggucguccag

SEQ ID NO: 1187050 - RNA, 24 nt, Human
agcagccaggugcuguccggugcc

SEQ ID NO: 1187051 - RNA, 19 nt, Human
agcagugcggccacacagg

SEQ ID NO: 1187052 - RNA, 21 nt, Human
agccacagcgccccugugggu

SEQ ID NO: 1187053 - RNA, 25 nt, Human
agccaggugcuguccggugccagau

SEQ ID NO: 1187054 - RNA, 22 nt, Human
aggaagccaaggacagaguuca

SEQ ID NO: 1187055 - RNA, 24 nt, Human
aggaagcggggccuugucuggggu

SEQ ID NO: 1187056 - RNA, 25 nt, Human
aggaggcugccucucgcaggguugg

SEQ ID NO: 1187057 - RNA, 21 nt, Human
aggcuguggaggaucacgccg

SEQ ID NO: 1187058 - RNA, 26 nt, Human
agggagcaaggaggguauugggacag

SEQ ID NO: 1187059 - RNA, 18 nt, Human
aggggcuggggggcuggg

SEQ ID NO: 1187060 - RNA, 19 nt, Human
aggggcuggggggcugggg

SEQ ID NO: 1187061 - RNA, 23 nt, Human
agggucccugcuuuaguuagggu

SEQ ID NO: 1187062 - RNA, 19 nt, Human
auagaagaccagccugugc

SEQ ID NO: 1187063 - RNA, 18 nt, Human
cacacacgaaguugcaca

SEQ ID NO: 1187064 - RNA, 18 nt, Human
cacagggucagggucucu

SEQ ID NO: 1187065 - RNA, 19 nt, Human
cacgccgccacugcagccg

SEQ ID NO: 1187066 - RNA, 18 nt, Human
cacggccuggccagggcu

SEQ ID NO: 1187067 - RNA, 18 nt, Human
cacgugaggaagcggggc

SEQ ID NO: 1187068 - RNA, 20 nt, Human
cacuccgugggugcugcugg

SEQ ID NO: 1187069 - RNA, 19 nt, Human
cagacccacgacgcccccc

SEQ ID NO: 1187070 - RNA, 30 nt, Human
cagagccucagcuugcaagaggaggcugcu

SEQ ID NO: 1187071 - RNA, 22 nt, Human
cagagucccaaucuggggccca

SEQ ID NO: 1187072 - RNA, 21 nt, Human
cagcaggaaccucugucucuc

SEQ ID NO: 1187073 - RNA, 20 nt, Human
cagcgcggugguuccgggac

SEQ ID NO: 1187074 - RNA, 19 nt, Human
cagcucccugcuggucagg

SEQ ID NO: 1187075 - RNA, 20 nt, Human
cagcugcccacccgcccucc

SEQ ID NO: 1187076 - RNA, 21 nt, Human
cagcugcccacccgcccuccc

SEQ ID NO: 1187077 - RNA, 22 nt, Human
caggaagccaaggacagaguuc

SEQ ID NO: 1187078 - RNA, 20 nt, Human
caggaggcagcggcugcagg

SEQ ID NO: 1187079 - RNA, 22 nt, Human
caggcgguccccagcuccccuc

SEQ ID NO: 1187080 - RNA, 18 nt, Human
caggggucccagggcagc

SEQ ID NO: 1187081 - RNA, 18 nt, Human
caggugggagugaggaug

SEQ ID NO: 1187082 - RNA, 24 nt, Human
caggugggcacuguggccccaggc

SEQ ID NO: 1187083 - RNA, 26 nt, Human
caguucagccacaucugaccccuugg

SEQ ID NO: 1187084 - RNA, 20 nt, Human
caucuagagccacagcgccc

SEQ ID NO: 1187085 - RNA, 26 nt, Human
ccaaaccgacaaacuccagcucgggg

SEQ ID NO: 1187086 - RNA, 18 nt, Human
ccaaggccugguggacag

SEQ ID NO: 1187087 - RNA, 19 nt, Human
ccaccaaaccgacaaacuc

SEQ ID NO: 1187088 - RNA, 23 nt, Human
ccacgagccuuggggguccaggg

SEQ ID NO: 1187089 - RNA, 20 nt, Human
ccagacccacgacgcccccc

SEQ ID NO: 1187090 - RNA, 24 nt, Human
ccagccucgggggacucaaagucu

SEQ ID NO: 1187091 - RNA, 21 nt, Human
ccagcugcccacccgcccucc

SEQ ID NO: 1187092 - RNA, 22 nt, Human
ccaggccagggggucugugggg

SEQ ID NO: 1187093 - RNA, 19 nt, Human
ccaggcuagccugucucca

SEQ ID NO: 1187094 - RNA, 20 nt, Human
ccaguguguggucugaguga

SEQ ID NO: 1187095 - RNA, 23 nt, Human
cccagcccccagccucgggggac

SEQ ID NO: 1187096 - RNA, 23 nt, Human
cccaggaacaggaccaaggcggg

SEQ ID NO: 1187097 - RNA, 21 nt, Human
ccccacgcuggcguccuccca

SEQ ID NO: 1187098 - RNA, 26 nt, Human
ccccagagucugcaggaacagcugga

SEQ ID NO: 1187099 - RNA, 23 nt, Human
ccccagcugcccacccgcccucc

SEQ ID NO: 1187100 - RNA, 22 nt, Human
ccccagggcccugugcucugcc

SEQ ID NO: 1187101 - RNA, 22 nt, Human
ccccuggcucuccugggcugag

SEQ ID NO: 1187102 - RNA, 18 nt, Human
cccgcccuccccuugggc

SEQ ID NO: 1187103 - RNA, 19 nt, Human
cccgggccucagcgccuag

SEQ ID NO: 1187104 - RNA, 23 nt, Human
cccggggggcgccgggccccaga

SEQ ID NO: 1187105 - RNA, 20 nt, Human
cccucgguggguuccaacgg

SEQ ID NO: 1187106 - RNA, 18 nt, Human
cccugcuuuaguuagggu

SEQ ID NO: 1187107 - RNA, 23 nt, Human
cccugcuuuaguuagggucuggg

SEQ ID NO: 1187108 - RNA, 18 nt, Human
ccggggucccuggaggag

SEQ ID NO: 1187109 - RNA, 25 nt, Human
ccgugggugcugcuggcaccugggg

SEQ ID NO: 1187110 - RNA, 20 nt, Human
ccuccgagacuggucugcag

SEQ ID NO: 1187111 - RNA, 23 nt, Human
ccugccagccagggccccagggc

SEQ ID NO: 1187112 - RNA, 24 nt, Human
ccuugggcaccccccacgagccuu

SEQ ID NO: 1187113 - RNA, 22 nt, Human
cgccccccgggccugucugccc

SEQ ID NO: 1187114 - RNA, 26 nt, Human
cgucgcacagcugcuggggcuccacg

SEQ ID NO: 1187115 - RNA, 19 nt, Human
cuagagccacagcgccccu

SEQ ID NO: 1187116 - RNA, 20 nt, Human
cuccugccagccagggcccc

SEQ ID NO: 1187117 - RNA, 19 nt, Human
cucuaggucaucuagagcc

SEQ ID NO: 1187118 - RNA, 22 nt, Human
cucugcgccaugggucagcucc

SEQ ID NO: 1187119 - RNA, 19 nt, Human
cugagugaggcccaggacc

SEQ ID NO: 1187120 - RNA, 25 nt, Human
cugcggcccugcuuguccccagcug

SEQ ID NO: 1187121 - RNA, 20 nt, Human
cugcucgaagucacaggcga

SEQ ID NO: 1187122 - RNA, 18 nt, Human
cuggaccccuggcucucc

SEQ ID NO: 1187123 - RNA, 25 nt, Human
gagccacagcgccccuguggguggc

SEQ ID NO: 1187124 - RNA, 19 nt, Human
gagcgguuccaugggccca

SEQ ID NO: 1187125 - RNA, 21 nt, Human
gagcugggcggcaggggcugg

SEQ ID NO: 1187126 - RNA, 18 nt, Human
gcaacagagucagcacag

SEQ ID NO: 1187127 - RNA, 19 nt, Human
gcaggggcuggggggcugg

SEQ ID NO: 1187128 - RNA, 21 nt, Human
gcaggguggacaccuccgaga

SEQ ID NO: 1187129 - RNA, 22 nt, Human
gcagugcggccacacagggugc

SEQ ID NO: 1187130 - RNA, 24 nt, Human
gccaaggaggggugugaggacccg

SEQ ID NO: 1187131 - RNA, 18 nt, Human
gccacugcagccgcccca

SEQ ID NO: 1187132 - RNA, 19 nt, Human
gccacugcagccgccccac

SEQ ID NO: 1187133 - RNA, 18 nt, Human
gccaggaggaucuggaag

SEQ ID NO: 1187134 - RNA, 19 nt, Human
gccaugggucagcuccacc

SEQ ID NO: 1187135 - RNA, 18 nt, Human
gccccagggcccugugcu

SEQ ID NO: 1187136 - RNA, 22 nt, Human
gcccuccccuugggcacccccc

SEQ ID NO: 1187137 - RNA, 18 nt, Human
gcccugcuuguccccagc

SEQ ID NO: 1187138 - RNA, 23 nt, Human
gccucagcauauccugagaccug

SEQ ID NO: 1187139 - RNA, 21 nt, Human
gccuggguaccagcugcaugu

SEQ ID NO: 1187140 - RNA, 21 nt, Human
gccugugguguggucgugguc

SEQ ID NO: 1187141 - RNA, 19 nt, Human
gcggcaggggcuggggggc

SEQ ID NO: 1187142 - RNA, 23 nt, Human
gcuaggcgcagagucccaaucug

SEQ ID NO: 1187143 - RNA, 18 nt, Human
gcucaggaccaccagcgc

SEQ ID NO: 1187144 - RNA, 25 nt, Human
gcucuguaaauaauaagccaggugg

SEQ ID NO: 1187145 - RNA, 21 nt, Human
gcugccucucgcaggguuggc

SEQ ID NO: 1187146 - RNA, 20 nt, Human
gcuggcguccucccagcccc

SEQ ID NO: 1187147 - RNA, 18 nt, Human
gcuggggggcuggggccc

SEQ ID NO: 1187148 - RNA, 26 nt, Human
ggaccaaggcgggcagcagguggcug

SEQ ID NO: 1187149 - RNA, 21 nt, Human
ggacccgggccucagcgccua

SEQ ID NO: 1187150 - RNA, 18 nt, Human
ggaggaguguaaggggag

SEQ ID NO: 1187151 - RNA, 19 nt, Human
ggcagggagcaaggagggu

SEQ ID NO: 1187152 - RNA, 22 nt, Human
ggccagguggcgucacacaccu

SEQ ID NO: 1187153 - RNA, 21 nt, Human
ggcccggggggcgccgggccc

SEQ ID NO: 1187154 - RNA, 23 nt, Human
ggccuggagagcaggugggcacu

SEQ ID NO: 1187155 - RNA, 22 nt, Human
ggccuggguaccagcugcaugu

SEQ ID NO: 1187156 - RNA, 20 nt, Human
ggcgcaggugagaggucagg

SEQ ID NO: 1187157 - RNA, 20 nt, Human
ggcggcaggggcuggggggc

SEQ ID NO: 1187158 - RNA, 18 nt, Human
ggcuggggcccggggccc

SEQ ID NO: 1187159 - RNA, 22 nt, Human
gggacaggggcgcacagagaag

SEQ ID NO: 1187160 - RNA, 18 nt, Human
gggcccaggaggcagcgg

SEQ ID NO: 1187161 - RNA, 24 nt, Human
gggcuggggggcuggggcccgggg

SEQ ID NO: 1187162 - RNA, 23 nt, Human
ggggcccggggggcgccgggccc

SEQ ID NO: 1187163 - RNA, 21 nt, Human
gguaccagaagcugagacacu

SEQ ID NO: 1187164 - RNA, 21 nt, Human
ggucacuguggggcuacaguc

SEQ ID NO: 1187165 - RNA, 22 nt, Human
ggugggcagaccacagucccag

SEQ ID NO: 1187166 - RNA, 19 nt, Human
gugcugcuggcaccugggg

SEQ ID NO: 1187167 - RNA, 24 nt, Human
gugcugcuggcaccuggggccugg

SEQ ID NO: 1187168 - RNA, 19 nt, Human
uaccagaagcugagacacu

SEQ ID NO: 1187169 - RNA, 21 nt, Human
uaccagaagcugagacacucc

SEQ ID NO: 1187170 - RNA, 22 nt, Human
ucacugccaacuccugccagcc

SEQ ID NO: 1187171 - RNA, 19 nt, Human
uccaaggccugguggacag

SEQ ID NO: 1187172 - RNA, 22 nt, Human
uccaaguccaccaaaccgacaa

SEQ ID NO: 1187173 - RNA, 18 nt, Human
uccacgcagaccuuguuc

SEQ ID NO: 1187174 - RNA, 18 nt, Human
uccaugggcccaggccug

SEQ ID NO: 1187175 - RNA, 25 nt, Human
ucccagcccccagccucgggggacu

SEQ ID NO: 1187176 - RNA, 24 nt, Human
uccccagcuccccucggcgccucc

SEQ ID NO: 1187177 - RNA, 18 nt, Human
uccccgcaguugucuucc

SEQ ID NO: 1187178 - RNA, 25 nt, Human
ucccgggggacaguuggccuggggg

SEQ ID NO: 1187179 - RNA, 18 nt, Human
uccgcagcaggacggggg

SEQ ID NO: 1187180 - RNA, 19 nt, Human
uccggggucccuggaggag

SEQ ID NO: 1187181 - RNA, 21 nt, Human
uccuggagccgcgagcugggc

SEQ ID NO: 1187182 - RNA, 25 nt, Human
uccuggagccgcgagcugggcggca

SEQ ID NO: 1187183 - RNA, 23 nt, Human
ucggagccagcuguagccugagg

SEQ ID NO: 1187184 - RNA, 22 nt, Human
ucgguggguuccaacggccaug

SEQ ID NO: 1187185 - RNA, 21 nt, Human
ucuccccucccccuccagagc

SEQ ID NO: 1187186 - RNA, 19 nt, Human
ucucggacccaggcggucc

SEQ ID NO: 1187187 - RNA, 20 nt, Human
ucugcaggaacagcuggagg

SEQ ID NO: 1187188 - RNA, 22 nt, Human
ugagaagguggaagcuccgggg

SEQ ID NO: 1187189 - RNA, 24 nt, Human
ugagaagguggaagcuccgggguc

SEQ ID NO: 1187190 - RNA, 23 nt, Human
ugagacacgccgccacugcagcc

SEQ ID NO: 1187191 - RNA, 19 nt, Human
ugagagguggccuggguac

SEQ ID NO: 1187192 - RNA, 27 nt, Human
ugaggaagcggggccuugucuggggug

SEQ ID NO: 1187193 - RNA, 19 nt, Human
ugaggcccaggacccucca

SEQ ID NO: 1187194 - RNA, 19 nt, Human
ugaggcccaggacccuccc

SEQ ID NO: 1187195 - RNA, 18 nt, Human
ugcggccacacagggugc

SEQ ID NO: 1187196 - RNA, 23 nt, Human
ugcuggcaccuggggccuggaga

SEQ ID NO: 1187197 - RNA, 22 nt, Human
uggaagggguaggcgcucugga

SEQ ID NO: 1187198 - RNA, 20 nt, Human
uggacagaggcaugguuggg

SEQ ID NO: 1187199 - RNA, 19 nt, Human
uggacagcacgucaccaga

SEQ ID NO: 1187200 - RNA, 18 nt, Human
uggaccccuggcucuccu

SEQ ID NO: 1187201 - RNA, 20 nt, Human
uggaguucacagcuggggcc

SEQ ID NO: 1187202 - RNA, 23 nt, Human
uggaugccucuuucccucggugg

SEQ ID NO: 1187203 - RNA, 20 nt, Human
uggcagagaaggucacucgg

SEQ ID NO: 1187204 - RNA, 23 nt, Human
uggcagagaaggucacucggaaa

SEQ ID NO: 1187205 - RNA, 22 nt, Human
uggccaggcuagccugucucca

SEQ ID NO: 1187206 - RNA, 22 nt, Human
uggcucuguaaauaauaagcca

SEQ ID NO: 1187207 - RNA, 18 nt, Human
ugggagugaggaugggca

SEQ ID NO: 1187208 - RNA, 21 nt, Human
ugggcagaccacagucccaga

SEQ ID NO: 1187209 - RNA, 18 nt, Human
ugggcggcaggggcuggg

SEQ ID NO: 1187210 - RNA, 18 nt, Human
uggggcccauggaggugg

SEQ ID NO: 1187211 - RNA, 18 nt, Human
uggggggcuggggcccgg

SEQ ID NO: 1187212 - RNA, 21 nt, Human
uggggggugggcagaccacag

SEQ ID NO: 1187213 - RNA, 24 nt, Human
ugggugcugcuggcaccuggggcc

SEQ ID NO: 1187214 - RNA, 22 nt, Human
ugguguggucguggucagggcc

SEQ ID NO: 1187215 - RNA, 26 nt, Human
ugucccagccugggcggggcaggugu

SEQ ID NO: 1187216 - RNA, 21 nt, Human
ugugggguccaggagcacaaa

SEQ ID NO: 1187217 - RNA, 18 nt, Human
uucacagcuggggccaga

SEQ ID NO: 1187218 - RNA, 24 nt, Human
uucguccugagcagccaggugcug

SEQ ID NO: 1187219 - RNA, 22 nt, Human
uugggcaccccccacgagccuu

SEQ ID NO: 1187220 - RNA, 22 nt, Human
uugucuuccccgucgcacagcu

SEQ ID NO: 1187221 - RNA, 20 nt, Human
uuucggguggcagagaaggu

SEQ ID NO: 1187222 - RNA, 19 nt, Human
aaccacacggccugggccc

SEQ ID NO: 1187223 - RNA, 18 nt, Human
aagcacguaccagggccc

SEQ ID NO: 1187224 - RNA, 22 nt, Human
aaggaucuugugagcacaggug

SEQ ID NO: 1187225 - RNA, 19 nt, Human
acaggacccugugggcgcc

SEQ ID NO: 1187226 - RNA, 20 nt, Human
acgcagcacucacagaagga

SEQ ID NO: 1187227 - RNA, 24 nt, Human
cacacggccugggcccugggcacc

SEQ ID NO: 1187228 - RNA, 18 nt, Human
ccccgggagccgcugagc

SEQ ID NO: 1187229 - RNA, 25 nt, Human
ccgggagccgcugagcgaggugggu

SEQ ID NO: 1187230 - RNA, 19 nt, Human
ccugggcccugggcaccga

SEQ ID NO: 1187231 - RNA, 26 nt, Human
cgagguggguggacacuggccgaggu

SEQ ID NO: 1187232 - RNA, 27 nt, Human
gagguggguggacacuggccgagguca

SEQ ID NO: 1187233 - RNA, 24 nt, Human
ggcgccaucccuacuggggacgca

SEQ ID NO: 1187234 - RNA, 22 nt, Human
ggugcugggccccgggagccgc

SEQ ID NO: 1187235 - RNA, 22 nt, Human
ucccaaccacacggccugggcc

SEQ ID NO: 1187236 - RNA, 27 nt, Human
ucccaaccacacggccugggcccuggg

SEQ ID NO: 1187237 - RNA, 18 nt, Human
ucuucccaaccacacggc

SEQ ID NO: 1187238 - RNA, 21 nt, Human
uggguggacacuggccgaggu

SEQ ID NO: 1187239 - RNA, 22 nt, Human
uucugagcuggugcugggcccc

SEQ ID NO: 1187240 - RNA, 22 nt, Human
uucugagcuggugcugggcccc

SEQ ID NO: 1187241 - RNA, 23 nt, Human
aacugacuuaacacccaccaccc

SEQ ID NO: 1187242 - RNA, 21 nt, Human
aaugccacuucccccaggaag

SEQ ID NO: 1187243 - RNA, 22 nt, Human
accaaacaccucucaacaagcc

SEQ ID NO: 1187244 - RNA, 22 nt, Human
accccugcuccuccagccccac

SEQ ID NO: 1187245 - RNA, 21 nt, Human
acccuucccaggucagcccaa

SEQ ID NO: 1187246 - RNA, 20 nt, Human
accgcagccuucgaggugcc

SEQ ID NO: 1187247 - RNA, 18 nt, Human
agccucaggccagaagcc

SEQ ID NO: 1187248 - RNA, 22 nt, Human
agccucaggccagaagccugga

SEQ ID NO: 1187249 - RNA, 18 nt, Human
augaauuccuucagacuc

SEQ ID NO: 1187250 - RNA, 27 nt, Human
augucuuuucagaagucacauccuguu

SEQ ID NO: 1187251 - RNA, 19 nt, Human
caaacaccucucaacaagc

SEQ ID NO: 1187252 - RNA, 19 nt, Human
caaacugacuuaacaccca

SEQ ID NO: 1187253 - RNA, 21 nt, Human
caaccucccgucaucaccccu

SEQ ID NO: 1187254 - RNA, 19 nt, Human
cacccaccacccuucccag

SEQ ID NO: 1187255 - RNA, 19 nt, Human
caccccugcuccuccagcc

SEQ ID NO: 1187256 - RNA, 24 nt, Human
caccccugcuccuccagccccacc

SEQ ID NO: 1187257 - RNA, 22 nt, Human
cacuugacaucuggaacaacgc

SEQ ID NO: 1187258 - RNA, 19 nt, Human
cacuuuguucaccuuuacc

SEQ ID NO: 1187259 - RNA, 19 nt, Human
cagaagccuggaacagaca

SEQ ID NO: 1187260 - RNA, 24 nt, Human
cagcagggcagcccuucugacagg

SEQ ID NO: 1187261 - RNA, 23 nt, Human
ccacccaaacugacuuaacaccc

SEQ ID NO: 1187262 - RNA, 21 nt, Human
ccagaagaagguccauucauu

SEQ ID NO: 1187263 - RNA, 19 nt, Human
cccaaaugccacuuccccc

SEQ ID NO: 1187264 - RNA, 18 nt, Human
ccguggucuggugggccc

SEQ ID NO: 1187265 - RNA, 19 nt, Human
ccuaucgucugaaggcgag

SEQ ID NO: 1187266 - RNA, 18 nt, Human
ccuccagccccacccaaa

SEQ ID NO: 1187267 - RNA, 20 nt, Human
ccugcuccuccagccccacc

SEQ ID NO: 1187268 - RNA, 25 nt, Human
cgcagccuucgaggugccguggucu

SEQ ID NO: 1187269 - RNA, 21 nt, Human
cggguucaggguuucuuuggg

SEQ ID NO: 1187270 - RNA, 18 nt, Human
cuagagucaccaaacacc

SEQ ID NO: 1187271 - RNA, 22 nt, Human
cuccccgccgccauucugauac

SEQ ID NO: 1187272 - RNA, 25 nt, Human
cucugaucucuucucgggccagaag

SEQ ID NO: 1187273 - RNA, 18 nt, Human
cuggaacaacgcuccucg

SEQ ID NO: 1187274 - RNA, 20 nt, Human
cuggaacagacacuuggagg

SEQ ID NO: 1187275 - RNA, 18 nt, Human
cuggggaugcaccccugc

SEQ ID NO: 1187276 - RNA, 20 nt, Human
cuuaacacccaccacccuuc

SEQ ID NO: 1187277 - RNA, 23 nt, Human
cuuaacacccaccacccuuccca

SEQ ID NO: 1187278 - RNA, 22 nt, Human
cuucaccgcagccuucgaggug

SEQ ID NO: 1187279 - RNA, 21 nt, Human
cuuggagagccccagaauguc

SEQ ID NO: 1187280 - RNA, 25 nt, Human
gaaccaaucucugaucucuucucgg

SEQ ID NO: 1187281 - RNA, 22 nt, Human
gaagcucucccugaugcugccc

SEQ ID NO: 1187282 - RNA, 27 nt, Human
gacaggcuaggaagcguagccucaggc

SEQ ID NO: 1187283 - RNA, 19 nt, Human
gaggugccguggucuggug

SEQ ID NO: 1187284 - RNA, 22 nt, Human
gcaaauucuccauggacugccc

SEQ ID NO: 1187285 - RNA, 18 nt, Human
gccagaaggaggggcuga

SEQ ID NO: 1187286 - RNA, 18 nt, Human
gcugaaguuggcuucucc

SEQ ID NO: 1187287 - RNA, 20 nt, Human
gcuguuguggggcccuggcc

SEQ ID NO: 1187288 - RNA, 22 nt, Human
gggaagagcagaggacgcuggc

SEQ ID NO: 1187289 - RNA, 21 nt, Human
gggagggacagaggggacagg

SEQ ID NO: 1187290 - RNA, 26 nt, Human
guucaccuuuaccacggacgccccca

SEQ ID NO: 1187291 - RNA, 23 nt, Human
uaacacccaccacccuucccagg

SEQ ID NO: 1187292 - RNA, 18 nt, Human
uaagagauugcagccagc

SEQ ID NO: 1187293 - RNA, 21 nt, Human
uagagucaccaaacaccucuc

SEQ ID NO: 1187294 - RNA, 19 nt, Human
uagccucaggccagaagcc

SEQ ID NO: 1187295 - RNA, 23 nt, Human
uauacucgaguauccaggugacc

SEQ ID NO: 1187296 - RNA, 21 nt, Human
ucacacugucaaugaccuaga

SEQ ID NO: 1187297 - RNA, 22 nt, Human
ucaccccuugagugagaccuaa

SEQ ID NO: 1187298 - RNA, 22 nt, Human
ucagcccaaaugccacuucccc

SEQ ID NO: 1187299 - RNA, 24 nt, Human
ucagcccaaaugccacuuccccca

SEQ ID NO: 1187300 - RNA, 21 nt, Human
ucaggaggagucaugaauauu

SEQ ID NO: 1187301 - RNA, 23 nt, Human
ucccaggucagcccaaaugccac

SEQ ID NO: 1187302 - RNA, 24 nt, Human
uccccaaucuccuugagaaaccau

SEQ ID NO: 1187303 - RNA, 19 nt, Human
ucccccaggaagcucuccc

SEQ ID NO: 1187304 - RNA, 18 nt, Human
ucccugaugcugcccugg

SEQ ID NO: 1187305 - RNA, 23 nt, Human
ucccuggccggcaagaaucccug

SEQ ID NO: 1187306 - RNA, 19 nt, Human
ucccuugagccacuugauu

SEQ ID NO: 1187307 - RNA, 21 nt, Human
ucuccccgccgccauucugau

SEQ ID NO: 1187308 - RNA, 18 nt, Human
ucuccuugagaaaccauu

SEQ ID NO: 1187309 - RNA, 21 nt, Human
ucugauacuggcguccccaau

SEQ ID NO: 1187310 - RNA, 21 nt, Human
ucuggaacaacgcuccucggg

SEQ ID NO: 1187311 - RNA, 22 nt, Human
ucuuucgggaggaugacggcgg

SEQ ID NO: 1187312 - RNA, 18 nt, Human
ugagcaaauucuccaugg

SEQ ID NO: 1187313 - RNA, 21 nt, Human
ugcccagaaccaaucucugau

SEQ ID NO: 1187314 - RNA, 21 nt, Human
ugcuccuccagccccacccaa

SEQ ID NO: 1187315 - RNA, 19 nt, Human
uggaaugagucagaccugc

SEQ ID NO: 1187316 - RNA, 21 nt, Human
uggacugcccagaaccaaucu

SEQ ID NO: 1187317 - RNA, 19 nt, Human
uggagagccccagaauguc

SEQ ID NO: 1187318 - RNA, 21 nt, Human
uggaggggagggacagagggg

SEQ ID NO: 1187319 - RNA, 19 nt, Human
uggggcccuggccgcgccu

SEQ ID NO: 1187320 - RNA, 23 nt, Human
ugucacaagcguccaugaauucc

SEQ ID NO: 1187321 - RNA, 19 nt, Human
uguggggcccuggccgcgc

SEQ ID NO: 1187322 - RNA, 23 nt, Human
uucaccuuuaccacggacgcccc

SEQ ID NO: 1187323 - RNA, 21 nt, Human
uucaggguuucuuugggaucc

SEQ ID NO: 1187324 - RNA, 21 nt, Human
uugcagccagcagggcagccc

SEQ ID NO: 1187325 - RNA, 18 nt, Human
cagcaggcuuuauuggcu

SEQ ID NO: 1187326 - RNA, 24 nt, Human
caggaaaaacacccuauaaggaaa

SEQ ID NO: 1187327 - RNA, 21 nt, Human
ccuggggcagcgcuccuggcu

SEQ ID NO: 1187328 - RNA, 20 nt, Human
gaggcuggggggcugggggc

SEQ ID NO: 1187329 - RNA, 19 nt, Human
gcuggggggcugggggcag

SEQ ID NO: 1187330 - RNA, 20 nt, Human
ggcuggggggcugggggcag

SEQ ID NO: 1187331 - RNA, 19 nt, Human
gggggcugggggcagggga

SEQ ID NO: 1187332 - RNA, 20 nt, Human
ucccuggggcagcgcuccug

SEQ ID NO: 1187333 - RNA, 23 nt, Human
ucccuggggcagcgcuccuggcu

SEQ ID NO: 1187334 - RNA, 24 nt, Human
ucccuggggcagcgcuccuggcuc

SEQ ID NO: 1187335 - RNA, 18 nt, Human
uggggcagcgcuccuggc

SEQ ID NO: 1187336 - RNA, 22 nt, Human
uggggggcugggggcaggggau

SEQ ID NO: 1187337 - RNA, 26 nt, Human
uucaggaaaaacacccuauaaggaaa

SEQ ID NO: 1187338 - RNA, 25 nt, Human
aaagcgacccaaagguggauagucu

SEQ ID NO: 1187339 - RNA, 23 nt, Human
aagcgacccaaagguggauaguc

SEQ ID NO: 1187340 - RNA, 24 nt, Human
aagcgacccaaagguggauagucu

SEQ ID NO: 1187341 - RNA, 23 nt, Human
aagcucucaacacacaugggcuu

SEQ ID NO: 1187342 - RNA, 23 nt, Human
accauaucaacaauggcagcauc

SEQ ID NO: 1187343 - RNA, 24 nt, Human
acccaaagguggauagucugagaa

SEQ ID NO: 1187344 - RNA, 23 nt, Human
acgaacagcaaagcgacccaaag

SEQ ID NO: 1187345 - RNA, 20 nt, Human
agaagcucucaacacacaug

SEQ ID NO: 1187346 - RNA, 19 nt, Human
aggaaccauaucaacaaug

SEQ ID NO: 1187347 - RNA, 19 nt, Human
cacaugggcuugccaggaa

SEQ ID NO: 1187348 - RNA, 18 nt, Human
cacgaacagcaaagcgac

SEQ ID NO: 1187349 - RNA, 24 nt, Human
ccagaacggcgaucaaucuuuucc

SEQ ID NO: 1187350 - RNA, 24 nt, Human
cgaacagcaaagcgacccaaaggu

SEQ ID NO: 1187351 - RNA, 22 nt, Human
ggcgaucaaucuuuuccuucag

SEQ ID NO: 1187352 - RNA, 24 nt, Human
uaucacgaacagcaaagcgaccca

SEQ ID NO: 1187353 - RNA, 19 nt, Human
ucaacacacaugggcuugc

SEQ ID NO: 1187354 - RNA, 18 nt, Human
ucucaacacacaugggcu

SEQ ID NO: 1187355 - RNA, 26 nt, Human
ucucauaucacgaacagcaaagcgac

SEQ ID NO: 1187356 - RNA, 19 nt, Human
ugccaggaaccauaucaac

SEQ ID NO: 1187357 - RNA, 25 nt, Human
aaaccccucccugaaucaggguacc

SEQ ID NO: 1187358 - RNA, 22 nt, Human
aaccaaaccccucccugaauca

SEQ ID NO: 1187359 - RNA, 21 nt, Human
aacucuuggcuuucccuagag

SEQ ID NO: 1187360 - RNA, 22 nt, Human
aacuggaagauguaaggaacaa

SEQ ID NO: 1187361 - RNA, 19 nt, Human
aaucuuagucuucuugcuc

SEQ ID NO: 1187362 - RNA, 23 nt, Human
acagcagcaagaaaaccaaaccc

SEQ ID NO: 1187363 - RNA, 19 nt, Human
acaggugccugccaccacg

SEQ ID NO: 1187364 - RNA, 19 nt, Human
accguguuaggauggucuc

SEQ ID NO: 1187365 - RNA, 20 nt, Human
acgggauuucaccguguuag

SEQ ID NO: 1187366 - RNA, 20 nt, Human
acgggauuucaccguguuag

SEQ ID NO: 1187367 - RNA, 19 nt, Human
acuacaggugccugccacc

SEQ ID NO: 1187368 - RNA, 20 nt, Human
acugcaagcuccgccucccg

SEQ ID NO: 1187369 - RNA, 20 nt, Human
acugcugccagcugggccug

SEQ ID NO: 1187370 - RNA, 18 nt, Human
agcaagaaaaccaaaccc

SEQ ID NO: 1187371 - RNA, 25 nt, Human
aggcuggagugcaguggcgcgaucu

SEQ ID NO: 1187372 - RNA, 20 nt, Human
aggugccugccaccacgccc

SEQ ID NO: 1187373 - RNA, 18 nt, Human
aguagcugggacuacagg

SEQ ID NO: 1187374 - RNA, 23 nt, Human
agugcaguggcgcgaucuuggcu

SEQ ID NO: 1187375 - RNA, 24 nt, Human
agugcaguggcgcgaucuuggcuc

SEQ ID NO: 1187376 - RNA, 20 nt, Human
caccguguuaggauggucuc

SEQ ID NO: 1187377 - RNA, 24 nt, Human
caccucggccucccauagugcuga

SEQ ID NO: 1187378 - RNA, 22 nt, Human
cacgcccuucuccugccucagc

SEQ ID NO: 1187379 - RNA, 22 nt, Human
cagcaagaaaaccaaaccccuc

SEQ ID NO: 1187380 - RNA, 20 nt, Human
cagccuccugaguagcuggg

SEQ ID NO: 1187381 - RNA, 19 nt, Human
caggugccugccaccacgc

SEQ ID NO: 1187382 - RNA, 23 nt, Human
caggugccugccaccacgcccgg

SEQ ID NO: 1187383 - RNA, 19 nt, Human
caguggcgcgaucuuggcu

SEQ ID NO: 1187384 - RNA, 21 nt, Human
cauacagcucgugaccuuggu

SEQ ID NO: 1187385 - RNA, 20 nt, Human
ccaccacgcccggcuaauuu

SEQ ID NO: 1187386 - RNA, 18 nt, Human
cccucuuccaucucuuuu

SEQ ID NO: 1187387 - RNA, 20 nt, Human
ccggccccaaucugguagac

SEQ ID NO: 1187388 - RNA, 19 nt, Human
ccuacagcagcaagaaaac

SEQ ID NO: 1187389 - RNA, 22 nt, Human
ccuccaugcuucucugcugccu

SEQ ID NO: 1187390 - RNA, 24 nt, Human
ccucccggguucacgcccuucucc

SEQ ID NO: 1187391 - RNA, 19 nt, Human
ccucccucuuccaucucuu

SEQ ID NO: 1187392 - RNA, 22 nt, Human
ccugaccucgugauccacccac

SEQ ID NO: 1187393 - RNA, 22 nt, Human
ccugaguagcugggacuacagg

SEQ ID NO: 1187394 - RNA, 23 nt, Human
ccugaguagcugggacuacaggu

SEQ ID NO: 1187395 - RNA, 23 nt, Human
ccugccucagccuccugaguagc

SEQ ID NO: 1187396 - RNA, 24 nt, Human
ccuguuuuccuccaugcuucucug

SEQ ID NO: 1187397 - RNA, 21 nt, Human
cgccucccggguucacgcccu

SEQ ID NO: 1187398 - RNA, 20 nt, Human
cgggauuucaccguguuagg

SEQ ID NO: 1187399 - RNA, 18 nt, Human
cuacagcagcaagaaaac

SEQ ID NO: 1187400 - RNA, 25 nt, Human
cuacagcagcaagaaaaccaaaccc

SEQ ID NO: 1187401 - RNA, 24 nt, Human
cucagccuccugaguagcugggac

SEQ ID NO: 1187402 - RNA, 18 nt, Human
cuccaaacuggcugggca

SEQ ID NO: 1187403 - RNA, 18 nt, Human
cucccggguucacgcccu

SEQ ID NO: 1187404 - RNA, 18 nt, Human
cuccugaccucgugaucc

SEQ ID NO: 1187405 - RNA, 25 nt, Human
cuccugaccucgugauccacccacc

SEQ ID NO: 1187406 - RNA, 19 nt, Human
cucgcccggccccaaucug

SEQ ID NO: 1187407 - RNA, 26 nt, Human
cucucauguuccucccucuuccaucu

SEQ ID NO: 1187408 - RNA, 19 nt, Human
cugagacaccucgcccggc

SEQ ID NO: 1187409 - RNA, 23 nt, Human
cugccucagccuccugaguagcu

SEQ ID NO: 1187410 - RNA, 25 nt, Human
cuggcugggcauugggaacaguggg

SEQ ID NO: 1187411 - RNA, 22 nt, Human
cuuccaucucuuuucucugaac

SEQ ID NO: 1187412 - RNA, 21 nt, Human
cuucuggccuccgaucccacu

SEQ ID NO: 1187413 - RNA, 22 nt, Human
cuucuugcucuucugaugacua

SEQ ID NO: 1187414 - RNA, 18 nt, Human
gaccaguucuccaaacug

SEQ ID NO: 1187415 - RNA, 22 nt, Human
gaccucgugauccacccaccuc

SEQ ID NO: 1187416 - RNA, 22 nt, Human
gaccucgugauccacccaccuc

SEQ ID NO: 1187417 - RNA, 24 nt, Human
gaccucgugauccacccaccucgg

SEQ ID NO: 1187418 - RNA, 24 nt, Human
gaccucgugauccacccaccucgg

SEQ ID NO: 1187419 - RNA, 21 nt, Human
gagacgaagucuugcucuguc

SEQ ID NO: 1187420 - RNA, 18 nt, Human
gcaugccaaaucacacug

SEQ ID NO: 1187421 - RNA, 24 nt, Human
gccaaaucacacugguucucaaaa

SEQ ID NO: 1187422 - RNA, 23 nt, Human
gcccggcuaauuuuuuguauuuu

SEQ ID NO: 1187423 - RNA, 19 nt, Human
gcuggagugcaguggcgcg

SEQ ID NO: 1187424 - RNA, 24 nt, Human
ggauggucucgaucuccugaccuc

SEQ ID NO: 1187425 - RNA, 20 nt, Human
ggcauugggaacagugggga

SEQ ID NO: 1187426 - RNA, 18 nt, Human
gggauuucaccguguuag

SEQ ID NO: 1187427 - RNA, 21 nt, Human
ggguuaccauagaauugggcu

SEQ ID NO: 1187428 - RNA, 24 nt, Human
gucuugcucugucgccaggcugga

SEQ ID NO: 1187429 - RNA, 24 nt, Human
gugauccacccaccucggccuccc

SEQ ID NO: 1187430 - RNA, 21 nt, Human
uaauagagacgggauuucacc

SEQ ID NO: 1187431 - RNA, 24 nt, Human
uaauagagacgggauuucaccgug

SEQ ID NO: 1187432 - RNA, 26 nt, Human
uaauagagacgggauuucaccguguu

SEQ ID NO: 1187433 - RNA, 24 nt, Human
uaauuuuuuguauuuuuaauagag

SEQ ID NO: 1187434 - RNA, 25 nt, Human
uaauuuuuuguauuuuuaauagaga

SEQ ID NO: 1187435 - RNA, 23 nt, Human
uacaggugccugccaccacgccc

SEQ ID NO: 1187436 - RNA, 19 nt, Human
ucaccguguuaggaugguc

SEQ ID NO: 1187437 - RNA, 20 nt, Human
ucacgcccuucuccugccuc

SEQ ID NO: 1187438 - RNA, 22 nt, Human
ucacuagguuaccaccaaauau

SEQ ID NO: 1187439 - RNA, 18 nt, Human
ucacugcaagcuccgccu

SEQ ID NO: 1187440 - RNA, 19 nt, Human
ucacugcaagcuccgccuc

SEQ ID NO: 1187441 - RNA, 24 nt, Human
ucacugcaagcuccgccucccggg

SEQ ID NO: 1187442 - RNA, 22 nt, Human
ucacuggacauaaucuuagucu

SEQ ID NO: 1187443 - RNA, 23 nt, Human
ucagccuccugaguagcugggac

SEQ ID NO: 1187444 - RNA, 24 nt, Human
ucccauagugcugagauuauaggc

SEQ ID NO: 1187445 - RNA, 23 nt, Human
ucccggaccugagaaggcugugg

SEQ ID NO: 1187446 - RNA, 24 nt, Human
ucccggguucacgcccuucuccug

SEQ ID NO: 1187447 - RNA, 19 nt, Human
ucccucuuccaucucuuuu

SEQ ID NO: 1187448 - RNA, 18 nt, Human
ucccugaaucaggguacc

SEQ ID NO: 1187449 - RNA, 23 nt, Human
uccgccucccggguucacgcccu

SEQ ID NO: 1187450 - RNA, 24 nt, Human
uccugaguagcugggacuacaggu

SEQ ID NO: 1187451 - RNA, 24 nt, Human
ucgccaggcuggagugcaguggcg

SEQ ID NO: 1187452 - RNA, 22 nt, Human
ucucauguuccucccucuucca

SEQ ID NO: 1187453 - RNA, 24 nt, Human
ucuccugccucagccuccugagua

SEQ ID NO: 1187454 - RNA, 18 nt, Human
ucugucgccaggcuggag

SEQ ID NO: 1187455 - RNA, 21 nt, Human
ucugucgccaggcuggagugc

SEQ ID NO: 1187456 - RNA, 23 nt, Human
ucugucgccaggcuggagugcag

SEQ ID NO: 1187457 - RNA, 21 nt, Human
ucuugcucugucgccaggcug

SEQ ID NO: 1187458 - RNA, 22 nt, Human
ucuugcucugucgccaggcugg

SEQ ID NO: 1187459 - RNA, 23 nt, Human
ucuugcucugucgccaggcugga

SEQ ID NO: 1187460 - RNA, 24 nt, Human
ugauccacccaccucggccuccca

SEQ ID NO: 1187461 - RNA, 22 nt, Human
ugcaguggcgcgaucuuggcuc

SEQ ID NO: 1187462 - RNA, 24 nt, Human
ugccucagccuccugaguagcugg

SEQ ID NO: 1187463 - RNA, 23 nt, Human
ugcucugucgccaggcuggagug

SEQ ID NO: 1187464 - RNA, 23 nt, Human
uggagugcaguggcgcgaucuug

SEQ ID NO: 1187465 - RNA, 24 nt, Human
uggagugcaguggcgcgaucuugg

SEQ ID NO: 1187466 - RNA, 21 nt, Human
uggccuccgaucccacuuugg

SEQ ID NO: 1187467 - RNA, 18 nt, Human
uggcucacugcaagcucc

SEQ ID NO: 1187468 - RNA, 21 nt, Human
ugggacuacaggugccugcca

SEQ ID NO: 1187469 - RNA, 22 nt, Human
ugggacuacaggugccugccac

SEQ ID NO: 1187470 - RNA, 24 nt, Human
ugggacuacaggugccugccacca

SEQ ID NO: 1187471 - RNA, 24 nt, Human
uguuccucccucuuccaucucuuu

SEQ ID NO: 1187472 - RNA, 24 nt, Human
uuaauagagacgggauuucaccgu

SEQ ID NO: 1187473 - RNA, 24 nt, Human
uuccucccucuuccaucucuuuuc

SEQ ID NO: 1187474 - RNA, 18 nt, Human
uucuucagcucucauguu

SEQ ID NO: 1187475 - RNA, 21 nt, Human
uuuuuguauuuuuaauagaga

SEQ ID NO: 1187476 - RNA, 24 nt, Human
uuuuuuguauuuuuaauagagacg

SEQ ID NO: 1187477 - RNA, 21 nt, Human
aagggccgggcuggggcuggg

SEQ ID NO: 1187478 - RNA, 25 nt, Human
acccagccccagccucagcuuucuu

SEQ ID NO: 1187479 - RNA, 24 nt, Human
agccucagcuuucuugccggcacc

SEQ ID NO: 1187480 - RNA, 19 nt, Human
cagcugcaagggccgggcu

SEQ ID NO: 1187481 - RNA, 18 nt, Human
caugaccaaauccgccuc

SEQ ID NO: 1187482 - RNA, 26 nt, Human
cccagccccagccucagcuuucuugc

SEQ ID NO: 1187483 - RNA, 18 nt, Human
cucuccaauuuuacugag

SEQ ID NO: 1187484 - RNA, 23 nt, Human
cucugcagcugcaagggccgggc

SEQ ID NO: 1187485 - RNA, 18 nt, Human
cugacccagccccagccu

SEQ ID NO: 1187486 - RNA, 19 nt, Human
gccggcaccagguggcaca

SEQ ID NO: 1187487 - RNA, 19 nt, Human
gguggcugaccacguccau

SEQ ID NO: 1187488 - RNA, 26 nt, Human
guugcugacccagccccagccucagc

SEQ ID NO: 1187489 - RNA, 22 nt, Human
uaaggauuuuuggcuguaaguu

SEQ ID NO: 1187490 - RNA, 19 nt, Human
ugagguggcugaccacguc

SEQ ID NO: 1187491 - RNA, 20 nt, Human
ugcaagggccgggcugggga

SEQ ID NO: 1187492 - RNA, 23 nt, Human
ugcugacccagccccagccucag

SEQ ID NO: 1187493 - RNA, 21 nt, Human
uggcugaccacguccaugacc

SEQ ID NO: 1187494 - RNA, 26 nt, Human
uucgguugcugacccagccccagccu

SEQ ID NO: 1187495 - RNA, 23 nt, Human
aaaaggucagaggcaauucgaga

SEQ ID NO: 1187496 - RNA, 20 nt, Human
aggcggcggccugggugcuu

SEQ ID NO: 1187497 - RNA, 21 nt, Human
ccagaaguucucggggacuag

SEQ ID NO: 1187498 - RNA, 18 nt, Human
ccccugaguggcucuuga

SEQ ID NO: 1187499 - RNA, 24 nt, Human
cguggggcaggcggcggccugggu

SEQ ID NO: 1187500 - RNA, 20 nt, Human
cuggaaauucucccccagca

SEQ ID NO: 1187501 - RNA, 19 nt, Human
cuuuuaauccugaacauuc

SEQ ID NO: 1187502 - RNA, 19 nt, Human
gaacauucuugaagcacga

SEQ ID NO: 1187503 - RNA, 24 nt, Human
gaccuucuggaaauucucccccag

SEQ ID NO: 1187504 - RNA, 18 nt, Human
ggaaauucucccccagca

SEQ ID NO: 1187505 - RNA, 20 nt, Human
ggcaacucuuguaauacugg

SEQ ID NO: 1187506 - RNA, 20 nt, Human
ucccagauucagcuugucuc

SEQ ID NO: 1187507 - RNA, 20 nt, Human
ucuggaaauucucccccagc

SEQ ID NO: 1187508 - RNA, 21 nt, Human
ucuugaacucgcugaagcggg

SEQ ID NO: 1187509 - RNA, 25 nt, Human
ucuugaacucgcugaagcgggccuc

SEQ ID NO: 1187510 - RNA, 26 nt, Human
uuaauccugaacauucuugaagcacg

SEQ ID NO: 1187511 - RNA, 23 nt, Human
aaaaggucagaggcaauucgaga

SEQ ID NO: 1187512 - RNA, 18 nt, Human
acacggcaguccaggccc

SEQ ID NO: 1187513 - RNA, 23 nt, Human
gcagguggggcacacacggcagu

SEQ ID NO: 1187514 - RNA, 20 nt, Human
ucccagauucagcuugucuc

SEQ ID NO: 1187515 - RNA, 25 nt, Human
aggcuaaaaaggaauuugugacuga

SEQ ID NO: 1187516 - RNA, 19 nt, Human
agugaauuuuuucuuggug

SEQ ID NO: 1187517 - RNA, 18 nt, Human
cgccuggagccuugaaac

SEQ ID NO: 1187518 - RNA, 21 nt, Human
ggugacuuguuuuucucuagg

SEQ ID NO: 1187519 - RNA, 19 nt, Human
ucccugaaaaagacagugc

SEQ ID NO: 1187520 - RNA, 22 nt, Human
ucccugaaaaagacagugccuu

SEQ ID NO: 1187521 - RNA, 21 nt, Human
ugaccaaauuagauaccuccc

SEQ ID NO: 1187522 - RNA, 24 nt, Human
ugagagaaaauacuuuuccucuac

SEQ ID NO: 1187523 - RNA, 21 nt, Human
aagcaagucucaaauagccag

SEQ ID NO: 1187524 - RNA, 23 nt, Human
ccccacugcacacgugaaaagca

SEQ ID NO: 1187525 - RNA, 21 nt, Human
cgugaaaagcaagucucaaau

SEQ ID NO: 1187526 - RNA, 26 nt, Human
cuccaggauagcaucauucuccccac

SEQ ID NO: 1187527 - RNA, 21 nt, Human
uccaggauagcaucauucucc

SEQ ID NO: 1187528 - RNA, 19 nt, Human
ucucaaauagccagagcuu

SEQ ID NO: 1187529 - RNA, 24 nt, Human
ugguaauuaucaccugucuguuuu

SEQ ID NO: 1187530 - RNA, 20 nt, Human
uuccugacaucaggcuccug

SEQ ID NO: 1187531 - RNA, 22 nt, Human
aaaaaacaaaaaaaugcagaag

SEQ ID NO: 1187532 - RNA, 19 nt, Human
aaaacaaaaaaaugcagaa

SEQ ID NO: 1187533 - RNA, 21 nt, Human
aaaauaauaaaguucaaaaac

SEQ ID NO: 1187534 - RNA, 24 nt, Human
aaaauuugcauaauaaauuuuaaa

SEQ ID NO: 1187535 - RNA, 25 nt, Human
aaacaaaaggugaauaggagggacc

SEQ ID NO: 1187536 - RNA, 24 nt, Human
aaacaaacauaaaugcacaaguca

SEQ ID NO: 1187537 - RNA, 19 nt, Human
aaacuugcaguugagccag

SEQ ID NO: 1187538 - RNA, 21 nt, Human
aaaugcagaagaccauuagcu

SEQ ID NO: 1187539 - RNA, 20 nt, Human
aaccacaggaaaauuaaaug

SEQ ID NO: 1187540 - RNA, 19 nt, Human
aagaaagaaaacaguccac

SEQ ID NO: 1187541 - RNA, 28 nt, Human
aagaaagaaaacaguccacuuaaagaaa

SEQ ID NO: 1187542 - RNA, 21 nt, Human
aagccauauucccaaauacga

SEQ ID NO: 1187543 - RNA, 26 nt, Human
aagcugaccucaagccuucaugacau

SEQ ID NO: 1187544 - RNA, 18 nt, Human
aaguccuccucugcccuc

SEQ ID NO: 1187545 - RNA, 23 nt, Human
aauacccuuuccacuugagcagc

SEQ ID NO: 1187546 - RNA, 24 nt, Human
acuaaaaaauaaaaggaaagaaaa

SEQ ID NO: 1187547 - RNA, 18 nt, Human
acuacaguuacugaagcc

SEQ ID NO: 1187548 - RNA, 21 nt, Human
agaaagcaugugccaacugau

SEQ ID NO: 1187549 - RNA, 22 nt, Human
aggaaagaaaauuuugagaaga

SEQ ID NO: 1187550 - RNA, 18 nt, Human
aggugaauaggaaucaga

SEQ ID NO: 1187551 - RNA, 23 nt, Human
aguaagagggauggaggccccuu

SEQ ID NO: 1187552 - RNA, 24 nt, Human
auaaaguucaaaaacaacuuaaaa

SEQ ID NO: 1187553 - RNA, 22 nt, Human
auaacaaaauaauaaaguucaa

SEQ ID NO: 1187554 - RNA, 19 nt, Human
auagcagccauuuuauaag

SEQ ID NO: 1187555 - RNA, 21 nt, Human
augcucacaagacuacaguua

SEQ ID NO: 1187556 - RNA, 23 nt, Human
auuaguuuuauuauguauuuucu

SEQ ID NO: 1187557 - RNA, 23 nt, Human
caaauccugccagcagccuguag

SEQ ID NO: 1187558 - RNA, 21 nt, Human
caaggccccuuauuccuaacu

SEQ ID NO: 1187559 - RNA, 22 nt, Human
cauaaaugcacaagucaagcuu

SEQ ID NO: 1187560 - RNA, 24 nt, Human
ccaccuuuugaacagcagagauuu

SEQ ID NO: 1187561 - RNA, 21 nt, Human
cugugugcuagacuuagucuc

SEQ ID NO: 1187562 - RNA, 22 nt, Human
cuuccaggauuugcuggcccaa

SEQ ID NO: 1187563 - RNA, 23 nt, Human
cuugcaguugagccagacaguuu

SEQ ID NO: 1187564 - RNA, 23 nt, Human
gaaacauccuuuuagcaauaccc

SEQ ID NO: 1187565 - RNA, 21 nt, Human
gaacagcagagauuucuagag

SEQ ID NO: 1187566 - RNA, 23 nt, Human
ggaaacauccuuuuagcaauacc

SEQ ID NO: 1187567 - RNA, 18 nt, Human
ggacuugaaugacaaaua

SEQ ID NO: 1187568 - RNA, 21 nt, Human
ggcaguucuuucuaguuuucu

SEQ ID NO: 1187569 - RNA, 23 nt, Human
gucacagaggggagggaaacuug

SEQ ID NO: 1187570 - RNA, 26 nt, Human
gugcugccaccuuuugaacagcagag

SEQ ID NO: 1187571 - RNA, 25 nt, Human
uaaaaaaacaaaaaaaugcagaaga

SEQ ID NO: 1187572 - RNA, 22 nt, Human
uaaaauuaaaagcauaugaaac

SEQ ID NO: 1187573 - RNA, 23 nt, Human
uaaagugcuaccaagaucugcca

SEQ ID NO: 1187574 - RNA, 19 nt, Human
uaacaucaucugcauuauu

SEQ ID NO: 1187575 - RNA, 23 nt, Human
uaacaucaucugcauuauuauuu

SEQ ID NO: 1187576 - RNA, 22 nt, Human
uaacaucaugauuguacaacca

SEQ ID NO: 1187577 - RNA, 22 nt, Human
uaaugcagugucuuaaaacaaa

SEQ ID NO: 1187578 - RNA, 24 nt, Human
uacaagauuuuuggaaacauccuu

SEQ ID NO: 1187579 - RNA, 22 nt, Human
uacaguauuaucaucaaucacu

SEQ ID NO: 1187580 - RNA, 19 nt, Human
uacauaguuuuaaaauaug

SEQ ID NO: 1187581 - RNA, 20 nt, Human
uagccuuuucauauaagccu

SEQ ID NO: 1187582 - RNA, 24 nt, Human
uagcuaacaaaguccuugaaucag

SEQ ID NO: 1187583 - RNA, 19 nt, Human
uaggucaaccacaggaaaa

SEQ ID NO: 1187584 - RNA, 24 nt, Human
uaugaacagauagucugcuaggca

SEQ ID NO: 1187585 - RNA, 21 nt, Human
uccacuugagcagcauuagaa

SEQ ID NO: 1187586 - RNA, 18 nt, Human
ucuaacaggaaaacaacu

SEQ ID NO: 1187587 - RNA, 23 nt, Human
ucuguaagcugaccucaagccuu

SEQ ID NO: 1187588 - RNA, 23 nt, Human
ugaacagauagucugcuaggcac

SEQ ID NO: 1187589 - RNA, 19 nt, Human
ugacuuauacuaccaggaa

SEQ ID NO: 1187590 - RNA, 23 nt, Human
ugaggaagggcaguucuuucuag

SEQ ID NO: 1187591 - RNA, 19 nt, Human
ugcagaagaccauuagcua

SEQ ID NO: 1187592 - RNA, 24 nt, Human
ugcuguaaccauaggaaaaaagca

SEQ ID NO: 1187593 - RNA, 21 nt, Human
ugggaagaacauuauuaaaag

SEQ ID NO: 1187594 - RNA, 24 nt, Human
uguaacuggagcaaauuuuauuuu

SEQ ID NO: 1187595 - RNA, 18 nt, Human
ugugggaagaacauuauu

SEQ ID NO: 1187596 - RNA, 20 nt, Human
uguguagucauguuuuaccc

SEQ ID NO: 1187597 - RNA, 22 nt, Human
uuacuaaaucugauuuuugugu

SEQ ID NO: 1187598 - RNA, 19 nt, Human
uuaguuuuauuauguauuu

SEQ ID NO: 1187599 - RNA, 21 nt, Human
uugaccuuagguguaucaaaa

SEQ ID NO: 1187600 - RNA, 18 nt, Human
uuguguacaaauguaaag

SEQ ID NO: 1187601 - RNA, 21 nt, Human
aaaaagaaauucaauagaaag

SEQ ID NO: 1187602 - RNA, 22 nt, Human
aaacaauacagaacagaccagg

SEQ ID NO: 1187603 - RNA, 22 nt, Human
aaacaggaagugagaaaauggg

SEQ ID NO: 1187604 - RNA, 18 nt, Human
aagaacuggcaaggacuc

SEQ ID NO: 1187605 - RNA, 20 nt, Human
aagaagauacuucaauaccu

SEQ ID NO: 1187606 - RNA, 23 nt, Human
aagagcaacauggaggucugcac

SEQ ID NO: 1187607 - RNA, 21 nt, Human
aagagcuccccauccccaaag

SEQ ID NO: 1187608 - RNA, 28 nt, Human
aagagcuccccauccccaaagaacuggg

SEQ ID NO: 1187609 - RNA, 19 nt, Human
aagaucaaugggacagaau

SEQ ID NO: 1187610 - RNA, 21 nt, Human
acaaacauggcucccugaagc

SEQ ID NO: 1187611 - RNA, 26 nt, Human
acagagcacuccaccagguauuaaag

SEQ ID NO: 1187612 - RNA, 19 nt, Human
acauauccaaugccugcug

SEQ ID NO: 1187613 - RNA, 18 nt, Human
accccaccuccucccagg

SEQ ID NO: 1187614 - RNA, 20 nt, Human
accccagcccugaccccacc

SEQ ID NO: 1187615 - RNA, 21 nt, Human
acucgccugcccagggccccu

SEQ ID NO: 1187616 - RNA, 20 nt, Human
agagcuccccauccccaaag

SEQ ID NO: 1187617 - RNA, 20 nt, Human
agcaucuuacacaaggauuc

SEQ ID NO: 1187618 - RNA, 21 nt, Human
agcccugaccccaccuccucc

SEQ ID NO: 1187619 - RNA, 23 nt, Human
aggaagcuuccucaagcccaacu

SEQ ID NO: 1187620 - RNA, 18 nt, Human
auccucuauucuuggaga

SEQ ID NO: 1187621 - RNA, 23 nt, Human
cacacggcuuucaagugccagag

SEQ ID NO: 1187622 - RNA, 21 nt, Human
cacacuccccagagacucgcc

SEQ ID NO: 1187623 - RNA, 21 nt, Human
caccacacuccccagagacuc

SEQ ID NO: 1187624 - RNA, 24 nt, Human
caccacacuccccagagacucgcc

SEQ ID NO: 1187625 - RNA, 25 nt, Human
caccaccuaucauauggaaaaagaa

SEQ ID NO: 1187626 - RNA, 22 nt, Human
caccuuccagucaccacuacac

SEQ ID NO: 1187627 - RNA, 19 nt, Human
cagagcccccaaucuaacc

SEQ ID NO: 1187628 - RNA, 21 nt, Human
cagagcccccaaucuaaccuc

SEQ ID NO: 1187629 - RNA, 24 nt, Human
caggucagaucgguugaaaaaaua

SEQ ID NO: 1187630 - RNA, 18 nt, Human
cauauggaaaaagaaauu

SEQ ID NO: 1187631 - RNA, 20 nt, Human
ccacauaugucuucuccagg

SEQ ID NO: 1187632 - RNA, 21 nt, Human
ccacauaugucuucuccaggc

SEQ ID NO: 1187633 - RNA, 22 nt, Human
ccaccacgccacauaugucuuc

SEQ ID NO: 1187634 - RNA, 26 nt, Human
ccaccuagaaacauggagagcaguca

SEQ ID NO: 1187635 - RNA, 22 nt, Human
ccacggaccccagcccugaccc

SEQ ID NO: 1187636 - RNA, 20 nt, Human
ccauguaagugaguuucaga

SEQ ID NO: 1187637 - RNA, 23 nt, Human
cccaacccgucggcccacggacc

SEQ ID NO: 1187638 - RNA, 23 nt, Human
cccagcccugaccccaccuccuc

SEQ ID NO: 1187639 - RNA, 25 nt, Human
cccagcccugaccccaccuccuccc

SEQ ID NO: 1187640 - RNA, 23 nt, Human
ccccagagacucgccugcccagg

SEQ ID NO: 1187641 - RNA, 18 nt, Human
cccccaacccgucggccc

SEQ ID NO: 1187642 - RNA, 24 nt, Human
cccccaacccgucggcccacggac

SEQ ID NO: 1187643 - RNA, 21 nt, Human
ccuccauagcaugcaaagcuc

SEQ ID NO: 1187644 - RNA, 21 nt, Human
ccugagauggggucugacuca

SEQ ID NO: 1187645 - RNA, 19 nt, Human
cgaccucuccuacuaccua

SEQ ID NO: 1187646 - RNA, 24 nt, Human
cgccacauaugucuucuccaggca

SEQ ID NO: 1187647 - RNA, 19 nt, Human
cgcccugugaugucagaac

SEQ ID NO: 1187648 - RNA, 23 nt, Human
cggcuaauguuugacuguagcac

SEQ ID NO: 1187649 - RNA, 24 nt, Human
cgguugggacaaguaccggggucc

SEQ ID NO: 1187650 - RNA, 27 nt, Human
cgucggcccacggaccccagcccugac

SEQ ID NO: 1187651 - RNA, 21 nt, Human
cuaaguaucuuaaccaagguc

SEQ ID NO: 1187652 - RNA, 18 nt, Human
cuagaaacauggagagca

SEQ ID NO: 1187653 - RNA, 22 nt, Human
cucuuacaacuacguccacuuc

SEQ ID NO: 1187654 - RNA, 25 nt, Human
gaagcuuccucaagcccaacuauac

SEQ ID NO: 1187655 - RNA, 23 nt, Human
gccagagccaggacucagaucua

SEQ ID NO: 1187656 - RNA, 22 nt, Human
gcccuuauuucuccauuuggca

SEQ ID NO: 1187657 - RNA, 27 nt, Human
gccugcccagggccccucucuaacccc

SEQ ID NO: 1187658 - RNA, 25 nt, Human
gcuccagagcccccaaucuaaccuc

SEQ ID NO: 1187659 - RNA, 25 nt, Human
ggaagaacagagacagucauggaaa

SEQ ID NO: 1187660 - RNA, 19 nt, Human
ggaccccagcccugacccc

SEQ ID NO: 1187661 - RNA, 23 nt, Human
ggagcacacuuguaaguaaauau

SEQ ID NO: 1187662 - RNA, 19 nt, Human
gguugaaaaaauaaaacua

SEQ ID NO: 1187663 - RNA, 23 nt, Human
gugcagggcccugagaugggguc

SEQ ID NO: 1187664 - RNA, 21 nt, Human
uaaaacaauacagaacagacc

SEQ ID NO: 1187665 - RNA, 21 nt, Human
uaaaacuaacaaauuuuuaca

SEQ ID NO: 1187666 - RNA, 22 nt, Human
uaaagaccaccaggagcacacu

SEQ ID NO: 1187667 - RNA, 21 nt, Human
uacaacccuguguuaauauua

SEQ ID NO: 1187668 - RNA, 18 nt, Human
uagaaaauccauaguaac

SEQ ID NO: 1187669 - RNA, 20 nt, Human
uagaaaauccauaguaacau

SEQ ID NO: 1187670 - RNA, 19 nt, Human
uagcacaugugagaggccc

SEQ ID NO: 1187671 - RNA, 19 nt, Human
uaggugcccuuauuucucc

SEQ ID NO: 1187672 - RNA, 25 nt, Human
uaugcagaaauaaguaaacagagca

SEQ ID NO: 1187673 - RNA, 19 nt, Human
ucaauagaaaguuauaugg

SEQ ID NO: 1187674 - RNA, 24 nt, Human
ucaccugccaccauaaugugaauu

SEQ ID NO: 1187675 - RNA, 23 nt, Human
uccagagcccccaaucuaaccuc

SEQ ID NO: 1187676 - RNA, 19 nt, Human
uccagucaccacuacaccu

SEQ ID NO: 1187677 - RNA, 24 nt, Human
uccauuccaccacgccacauaugu

SEQ ID NO: 1187678 - RNA, 20 nt, Human
uccccagagacucgccugcc

SEQ ID NO: 1187679 - RNA, 19 nt, Human
ucccugaagccgcucaggc

SEQ ID NO: 1187680 - RNA, 21 nt, Human
ucccugaagccgcucaggcuc

SEQ ID NO: 1187681 - RNA, 21 nt, Human
ucccugacgcuggccaucccc

SEQ ID NO: 1187682 - RNA, 25 nt, Human
ucgcccgucaagacgggccagggcu

SEQ ID NO: 1187683 - RNA, 24 nt, Human
ucuagaacaguucuuagaacacag

SEQ ID NO: 1187684 - RNA, 21 nt, Human
ucucaccacacuccccagaga

SEQ ID NO: 1187685 - RNA, 24 nt, Human
ucucaucacuuagaaacccuacag

SEQ ID NO: 1187686 - RNA, 20 nt, Human
ucuccauuuggcagagaggg

SEQ ID NO: 1187687 - RNA, 23 nt, Human
ucucuuuguauugucugucaccu

SEQ ID NO: 1187688 - RNA, 19 nt, Human
ucuuggagaucuggaugcc

SEQ ID NO: 1187689 - RNA, 20 nt, Human
ugaaguguauuaacuugugu

SEQ ID NO: 1187690 - RNA, 23 nt, Human
ugacacaaaucgauaauuaacug

SEQ ID NO: 1187691 - RNA, 22 nt, Human
ugaccccaccuccucccagcau

SEQ ID NO: 1187692 - RNA, 20 nt, Human
ugagaggcgaauaacauugc

SEQ ID NO: 1187693 - RNA, 20 nt, Human
ugaggaagcuuccucaagcc

SEQ ID NO: 1187694 - RNA, 22 nt, Human
ugaggacauaggugguggaguc

SEQ ID NO: 1187695 - RNA, 21 nt, Human
ugaggucaaagggcggucuca

SEQ ID NO: 1187696 - RNA, 23 nt, Human
ugaucccugacgcuggccauccc

SEQ ID NO: 1187697 - RNA, 19 nt, Human
ugcacaugcucagugaggu

SEQ ID NO: 1187698 - RNA, 25 nt, Human
ugcccuucaguuaaagaccaccagg

SEQ ID NO: 1187699 - RNA, 24 nt, Human
ugccugcugcugaccacagggauu

SEQ ID NO: 1187700 - RNA, 19 nt, Human
ugcuaaacucaugaauacu

SEQ ID NO: 1187701 - RNA, 20 nt, Human
uggcuccuuuuagcacuccu

SEQ ID NO: 1187702 - RNA, 19 nt, Human
uguaaucacacaacuaccc

SEQ ID NO: 1187703 - RNA, 22 nt, Human
uguaauuaaaacaauacagaac

SEQ ID NO: 1187704 - RNA, 23 nt, Human
uguaauuaaaacaauacagaaca

SEQ ID NO: 1187705 - RNA, 21 nt, Human
uguagaaugaggaagcuuccu

SEQ ID NO: 1187706 - RNA, 21 nt, Human
uguauugucugucaccugcca

SEQ ID NO: 1187707 - RNA, 22 nt, Human
ugucacagaucucaucacuuag

SEQ ID NO: 1187708 - RNA, 22 nt, Human
ugugcagggcccugagaugggg

SEQ ID NO: 1187709 - RNA, 24 nt, Human
uucaccagugacccagucagugcc

SEQ ID NO: 1187710 - RNA, 22 nt, Human
uuccuccugggaagcucuuucu

SEQ ID NO: 1187711 - RNA, 26 nt, Human
uugacacacaaacaggaagugagaaa

SEQ ID NO: 1187712 - RNA, 19 nt, Human
uuucuccauuuggcagaga

SEQ ID NO: 1187713 - RNA, 18 nt, Human
uuugaaaauccaaggcua

SEQ ID NO: 1187714 - RNA, 24 nt, Human
acacuccguuggugaccugcaggc

SEQ ID NO: 1187715 - RNA, 23 nt, Human
agaacuucacggggccugugugg

SEQ ID NO: 1187716 - RNA, 21 nt, Human
agaaggcagcagagggcagga

SEQ ID NO: 1187717 - RNA, 21 nt, Human
agcaagcguccugcccaccac

SEQ ID NO: 1187718 - RNA, 24 nt, Human
agcacagucacuuugcgucugugg

SEQ ID NO: 1187719 - RNA, 21 nt, Human
aggaagccuggagaggcggcu

SEQ ID NO: 1187720 - RNA, 21 nt, Human
aggcagcagagggcagccggc

SEQ ID NO: 1187721 - RNA, 24 nt, Human
aggcggcuguggccaggugggggc

SEQ ID NO: 1187722 - RNA, 21 nt, Human
aguggaggguuugagcuggaa

SEQ ID NO: 1187723 - RNA, 21 nt, Human
augccagcacagucacuuugc

SEQ ID NO: 1187724 - RNA, 19 nt, Human
caaggaagccuggagaggc

SEQ ID NO: 1187725 - RNA, 21 nt, Human
cacccuucaggacccgcagac

SEQ ID NO: 1187726 - RNA, 22 nt, Human
cacucacccuucaggacccgca

SEQ ID NO: 1187727 - RNA, 21 nt, Human
cagaaggcagcagagggcagc

SEQ ID NO: 1187728 - RNA, 20 nt, Human
cagcaccaucugaaagggaa

SEQ ID NO: 1187729 - RNA, 18 nt, Human
cagcagagggcagccggc

SEQ ID NO: 1187730 - RNA, 21 nt, Human
cagcugcccacuccgggucuc

SEQ ID NO: 1187731 - RNA, 22 nt, Human
ccacugauuggguggagguggg

SEQ ID NO: 1187732 - RNA, 25 nt, Human
ccagcucacucacccuucaggaccc

SEQ ID NO: 1187733 - RNA, 18 nt, Human
ccaggaaagggggaccuc

SEQ ID NO: 1187734 - RNA, 18 nt, Human
ccaguggaggguuugagc

SEQ ID NO: 1187735 - RNA, 26 nt, Human
ccuccacagcagcugcccacuccggg

SEQ ID NO: 1187736 - RNA, 27 nt, Human
ccugcugugggcaugggccaugggaac

SEQ ID NO: 1187737 - RNA, 18 nt, Human
ccuguguggccacccagc

SEQ ID NO: 1187738 - RNA, 21 nt, Human
ccuucaggacccgcagacacu

SEQ ID NO: 1187739 - RNA, 24 nt, Human
ccuugaaucccagacugguggccc

SEQ ID NO: 1187740 - RNA, 18 nt, Human
ccuugguugccugcugug

SEQ ID NO: 1187741 - RNA, 19 nt, Human
cugcucugguggggccugg

SEQ ID NO: 1187742 - RNA, 20 nt, Human
gacccgcagacacuucgcuc

SEQ ID NO: 1187743 - RNA, 21 nt, Human
gagagagcccugagcugcaga

SEQ ID NO: 1187744 - RNA, 19 nt, Human
gagagcccugagcugcaga

SEQ ID NO: 1187745 - RNA, 19 nt, Human
gaggugggugggucugguu

SEQ ID NO: 1187746 - RNA, 20 nt, Human
gcccggggucggggaaggug

SEQ ID NO: 1187747 - RNA, 19 nt, Human
gccggcuaccuggccuuga

SEQ ID NO: 1187748 - RNA, 21 nt, Human
gcuguggccaggugggggcag

SEQ ID NO: 1187749 - RNA, 19 nt, Human
ggcagccuugguugccugc

SEQ ID NO: 1187750 - RNA, 23 nt, Human
ggcaugggccaugggaaccagug

SEQ ID NO: 1187751 - RNA, 20 nt, Human
gggaagguggaaaggugacg

SEQ ID NO: 1187752 - RNA, 19 nt, Human
guccaggaaagggggaccu

SEQ ID NO: 1187753 - RNA, 19 nt, Human
gugacacaggacacagcac

SEQ ID NO: 1187754 - RNA, 19 nt, Human
uaccuggccuugacagucc

SEQ ID NO: 1187755 - RNA, 20 nt, Human
uaccuggccuugacaguccc

SEQ ID NO: 1187756 - RNA, 18 nt, Human
uccaggaaagggggaccu

SEQ ID NO: 1187757 - RNA, 24 nt, Human
ucccagacugguggccccagcccc

SEQ ID NO: 1187758 - RNA, 20 nt, Human
ucccagcucacucacccuuc

SEQ ID NO: 1187759 - RNA, 22 nt, Human
ucugcucugguggggccuggag

SEQ ID NO: 1187760 - RNA, 18 nt, Human
ucuguggggagaagcggc

SEQ ID NO: 1187761 - RNA, 18 nt, Human
ugaaagggaacgcuggcc

SEQ ID NO: 1187762 - RNA, 21 nt, Human
ugaaagggaacgcuggccugg

SEQ ID NO: 1187763 - RNA, 20 nt, Human
ugacgugacacaggacacag

SEQ ID NO: 1187764 - RNA, 19 nt, Human
ugcaaaaagccugagggcu

SEQ ID NO: 1187765 - RNA, 24 nt, Human
ugcuuggcucccagcucacucacc

SEQ ID NO: 1187766 - RNA, 21 nt, Human
uggaaaggugacgugacacag

SEQ ID NO: 1187767 - RNA, 21 nt, Human
uggaggugggugggucugguu

SEQ ID NO: 1187768 - RNA, 23 nt, Human
uggccaggugggggcagccuugg

SEQ ID NO: 1187769 - RNA, 21 nt, Human
uggcucccagcucacucaccc

SEQ ID NO: 1187770 - RNA, 21 nt, Human
ugggcaugggccaugggaacc

SEQ ID NO: 1187771 - RNA, 24 nt, Human
ugggggcagccuugguugccugcu

SEQ ID NO: 1187772 - RNA, 19 nt, Human
ugguggccccagccccuca

SEQ ID NO: 1187773 - RNA, 21 nt, Human
ugguggggccuggagaguccu

SEQ ID NO: 1187774 - RNA, 20 nt, Human
ugucccagccaccugaugcc

SEQ ID NO: 1187775 - RNA, 19 nt, Human
uguggccaggugggggcag

SEQ ID NO: 1187776 - RNA, 18 nt, Human
uuggguggaggugggugg

SEQ ID NO: 1187777 - RNA, 23 nt, Human
uugucugcucugguggggccugg

SEQ ID NO: 1187778 - RNA, 20 nt, Human
aagcagaugaaguaauaaau

SEQ ID NO: 1187779 - RNA, 23 nt, Human
aaguuucuugcucauuuauaugc

SEQ ID NO: 1187780 - RNA, 19 nt, Human
acaaaauauaucuguaucc

SEQ ID NO: 1187781 - RNA, 20 nt, Human
acgcaaucaaucuugcauac

SEQ ID NO: 1187782 - RNA, 20 nt, Human
acuccuuuguuuuuccuuug

SEQ ID NO: 1187783 - RNA, 18 nt, Human
auacucuucucucugaca

SEQ ID NO: 1187784 - RNA, 19 nt, Human
auauaucuguauccaagga

SEQ ID NO: 1187785 - RNA, 20 nt, Human
augauucugauuguuucuuc

SEQ ID NO: 1187786 - RNA, 20 nt, Human
auuuggcuagaauuuuccuu

SEQ ID NO: 1187787 - RNA, 23 nt, Human
caagagucugaaaugcaaaacca

SEQ ID NO: 1187788 - RNA, 26 nt, Human
caccucuaccaagcagaugaaguaau

SEQ ID NO: 1187789 - RNA, 20 nt, Human
cacuaaagccaccucuacca

SEQ ID NO: 1187790 - RNA, 22 nt, Human
cagugauuuugguuucaccaca

SEQ ID NO: 1187791 - RNA, 19 nt, Human
cauaaaggucaaaagccuu

SEQ ID NO: 1187792 - RNA, 24 nt, Human
cucuucucucugacaguuuuucuu

SEQ ID NO: 1187793 - RNA, 19 nt, Human
cuuggauuucugccucuuc

SEQ ID NO: 1187794 - RNA, 24 nt, Human
gagggugucugagaauuauuagcu

SEQ ID NO: 1187795 - RNA, 26 nt, Human
uaaauaucuuucauuuaacauugggu

SEQ ID NO: 1187796 - RNA, 21 nt, Human
uagaauuuuccuuugccuuuc

SEQ ID NO: 1187797 - RNA, 21 nt, Human
uagcuucacagaagcauagcu

SEQ ID NO: 1187798 - RNA, 24 nt, Human
uaguaguuuucuuuuuucucaucu

SEQ ID NO: 1187799 - RNA, 23 nt, Human
uauacacuucacuaaagccaccu

SEQ ID NO: 1187800 - RNA, 19 nt, Human
ucaauaucuucccuuugcu

SEQ ID NO: 1187801 - RNA, 18 nt, Human
ucauuccaucugcaccau

SEQ ID NO: 1187802 - RNA, 22 nt, Human
uccccuggaugauucugauugu

SEQ ID NO: 1187803 - RNA, 23 nt, Human
uccccuggaugauucugauuguu

SEQ ID NO: 1187804 - RNA, 22 nt, Human
ucuaccaaaaggauguuuccug

SEQ ID NO: 1187805 - RNA, 24 nt, Human
ucuauacugcaggcauguuuguag

SEQ ID NO: 1187806 - RNA, 19 nt, Human
ucugccucuucuuuucuga

SEQ ID NO: 1187807 - RNA, 22 nt, Human
ucugcuuuucucuaucuucccc

SEQ ID NO: 1187808 - RNA, 24 nt, Human
ugacuccuuuguuuuuccuuuguu

SEQ ID NO: 1187809 - RNA, 20 nt, Human
ugacucuuuccaaacguuca

SEQ ID NO: 1187810 - RNA, 19 nt, Human
ugagaauuauuagcugugg

SEQ ID NO: 1187811 - RNA, 24 nt, Human
ugugggagguuugcauuuggcuag

SEQ ID NO: 1187812 - RNA, 19 nt, Human
uucaaguucugcuuggauu

SEQ ID NO: 1187813 - RNA, 26 nt, Human
uuccuuuguuuugguucagaauuggu

SEQ ID NO: 1187814 - RNA, 23 nt, Human
uuguuuauucuucucagcucacg

SEQ ID NO: 1187815 - RNA, 23 nt, Human
uuguuuuuccuuuguuuugguuc

SEQ ID NO: 1187816 - RNA, 21 nt, Human
uuugaacauuucuuccuguuc

SEQ ID NO: 1187817 - RNA, 23 nt, Human
uuugguucagaauugguagaggg

SEQ ID NO: 1187818 - RNA, 20 nt, Human
uuucuggcaauuucaucuga

SEQ ID NO: 1187819 - RNA, 18 nt, Human
aacacccaagcccacagc

SEQ ID NO: 1187820 - RNA, 18 nt, Human
aacacuguccccuccucu

SEQ ID NO: 1187821 - RNA, 18 nt, Human
aagcuuggaaguugggcc

SEQ ID NO: 1187822 - RNA, 21 nt, Human
acagaaagcuuggaaguuggg

SEQ ID NO: 1187823 - RNA, 23 nt, Human
acagaaagcuuggaaguugggcc

SEQ ID NO: 1187824 - RNA, 22 nt, Human
agcaaacagaaagcuuggaagu

SEQ ID NO: 1187825 - RNA, 26 nt, Human
caccaccaacacuguccccuccucug

SEQ ID NO: 1187826 - RNA, 21 nt, Human
cacccaagcccacagcaccac

SEQ ID NO: 1187827 - RNA, 20 nt, Human
ccaagcccacagcaccacca

SEQ ID NO: 1187828 - RNA, 20 nt, Human
ccacagcaccaccaacacug

SEQ ID NO: 1187829 - RNA, 19 nt, Human
ccaccaacacuguccccuc

SEQ ID NO: 1187830 - RNA, 19 nt, Human
cccacagcaccaccaacac

SEQ ID NO: 1187831 - RNA, 20 nt, Human
ccccuccucuggccauccca

SEQ ID NO: 1187832 - RNA, 23 nt, Human
cugcucugcucagaguaauuuua

SEQ ID NO: 1187833 - RNA, 20 nt, Human
uccucuggccaucccacccc

SEQ ID NO: 1187834 - RNA, 22 nt, Human
uccucuggccaucccaccccga

SEQ ID NO: 1187835 - RNA, 23 nt, Human
uguccccuccucuggccauccca

SEQ ID NO: 1187836 - RNA, 18 nt, Human
gaaaaagaaagcuucuac

SEQ ID NO: 1187837 - RNA, 21 nt, Human
ucugagccaggaaaaagaaag

SEQ ID NO: 1187838 - RNA, 24 nt, Human
acaguggugaugguggcuggaggc

SEQ ID NO: 1187839 - RNA, 19 nt, Human
acauuuucuccuccagcau

SEQ ID NO: 1187840 - RNA, 25 nt, Human
aggcuaaaaaagaauuugugacuga

SEQ ID NO: 1187841 - RNA, 21 nt, Human
aguagaaggggugccuguggu

SEQ ID NO: 1187842 - RNA, 20 nt, Human
agugaauuuuuucuugggga

SEQ ID NO: 1187843 - RNA, 19 nt, Human
augucacaggccccauugc

SEQ ID NO: 1187844 - RNA, 20 nt, Human
auuuuuggcccaugcugagg

SEQ ID NO: 1187845 - RNA, 18 nt, Human
caaauuagauaccucccc

SEQ ID NO: 1187846 - RNA, 21 nt, Human
caagggcugcugaucucugcu

SEQ ID NO: 1187847 - RNA, 21 nt, Human
caccagguauuuuuggcccau

SEQ ID NO: 1187848 - RNA, 24 nt, Human
caccagguauuuuuggcccaugcu

SEQ ID NO: 1187849 - RNA, 20 nt, Human
cacuuuucaagggcugcuga

SEQ ID NO: 1187850 - RNA, 23 nt, Human
cauggcacucacggcaaagugac

SEQ ID NO: 1187851 - RNA, 22 nt, Human
ccagguauuuuuggcccaugcu

SEQ ID NO: 1187852 - RNA, 22 nt, Human
cccacagacuggggcuugaaac

SEQ ID NO: 1187853 - RNA, 19 nt, Human
ccugugguugcagggaaac

SEQ ID NO: 1187854 - RNA, 23 nt, Human
cuccccgaagaagacagugccuu

SEQ ID NO: 1187855 - RNA, 23 nt, Human
cugaccaaauuagauaccucccc

SEQ ID NO: 1187856 - RNA, 22 nt, Human
gaagaagacagugccuuggaca

SEQ ID NO: 1187857 - RNA, 18 nt, Human
gagcaagaguuggggaug

SEQ ID NO: 1187858 - RNA, 20 nt, Human
ggacaguggugaugguggcc

SEQ ID NO: 1187859 - RNA, 26 nt, Human
gggaaacccacagacuggggcuugaa

SEQ ID NO: 1187860 - RNA, 21 nt, Human
ggggagcaagaguuggggaug

SEQ ID NO: 1187861 - RNA, 22 nt, Human
uaaaaaaccauauauauugugg

SEQ ID NO: 1187862 - RNA, 19 nt, Human
uagaaggggugccuguggu

SEQ ID NO: 1187863 - RNA, 18 nt, Human
ucacaggccccauugcuc

SEQ ID NO: 1187864 - RNA, 20 nt, Human
ucacaggccccauugcucau

SEQ ID NO: 1187865 - RNA, 28 nt, Human
ucauuguugcaccggacacuuuucaacu

SEQ ID NO: 1187866 - RNA, 23 nt, Human
ucuggcucuugggaguggcuugu

SEQ ID NO: 1187867 - RNA, 21 nt, Human
ugagggggacugacuggggau

SEQ ID NO: 1187868 - RNA, 22 nt, Human
ugaguagaaggggugccugugg

SEQ ID NO: 1187869 - RNA, 24 nt, Human
ugcaccggacacuuuucaagggcu

SEQ ID NO: 1187870 - RNA, 23 nt, Human
ugccuuggacaguggugauggug

SEQ ID NO: 1187871 - RNA, 20 nt, Human
ugcugagggggacugacugg

SEQ ID NO: 1187872 - RNA, 19 nt, Human
ugcuguguucugaguagaa

SEQ ID NO: 1187873 - RNA, 22 nt, Human
uggccccuggagccucgaaacc

SEQ ID NO: 1187874 - RNA, 21 nt, Human
ugugguugcagggaaacccac

SEQ ID NO: 1187875 - RNA, 20 nt, Human
uucaagggcugcugaucucu

SEQ ID NO: 1187876 - RNA, 19 nt, Human
uugcaccggacacuuuuca

SEQ ID NO: 1187877 - RNA, 24 nt, Human
uuggacaguggugaugguggcuuu

SEQ ID NO: 1187878 - RNA, 20 nt, Human
aaacaaauauaaagagacac

SEQ ID NO: 1187879 - RNA, 22 nt, Human
aaacaaauauaaagagacacuu

SEQ ID NO: 1187880 - RNA, 27 nt, Human
aaacaccgugaacagaaaaaagauugc

SEQ ID NO: 1187881 - RNA, 20 nt, Human
aaaguuuucccaugccacau

SEQ ID NO: 1187882 - RNA, 21 nt, Human
aaauaugaaaauaaaucuuua

SEQ ID NO: 1187883 - RNA, 19 nt, Human
aacaccaaauucaagcagu

SEQ ID NO: 1187884 - RNA, 21 nt, Human
aacaccgugaacagaaaaaag

SEQ ID NO: 1187885 - RNA, 22 nt, Human
aacagccauggcaaaaguuuuc

SEQ ID NO: 1187886 - RNA, 19 nt, Human
aagaugccacuaagacaaa

SEQ ID NO: 1187887 - RNA, 19 nt, Human
aagcaagguaaauuagaau

SEQ ID NO: 1187888 - RNA, 27 nt, Human
aagcagcaagugaaaaaaagggacccc

SEQ ID NO: 1187889 - RNA, 22 nt, Human
aaggacaugacuagucuauuua

SEQ ID NO: 1187890 - RNA, 20 nt, Human
aagguucuaucacaaacacc

SEQ ID NO: 1187891 - RNA, 18 nt, Human
aaucacucacugagacaa

SEQ ID NO: 1187892 - RNA, 22 nt, Human
acaaaacaaagaagagccaaag

SEQ ID NO: 1187893 - RNA, 24 nt, Human
acaaagaagagccaaaguuccaga

SEQ ID NO: 1187894 - RNA, 18 nt, Human
acaauaaauaacagcuac

SEQ ID NO: 1187895 - RNA, 22 nt, Human
acaauaaaugcccacaaaaacc

SEQ ID NO: 1187896 - RNA, 24 nt, Human
acagaaaaaagauugcuacaugga

SEQ ID NO: 1187897 - RNA, 19 nt, Human
acagcaaagcuaggaugag

SEQ ID NO: 1187898 - RNA, 21 nt, Human
acaggccaaggauguuuggga

SEQ ID NO: 1187899 - RNA, 21 nt, Human
acuauucugagauuaugaaau

SEQ ID NO: 1187900 - RNA, 21 nt, Human
acucucuguccuacugcuucc

SEQ ID NO: 1187901 - RNA, 21 nt, Human
agaaucccuucuuacuagaac

SEQ ID NO: 1187902 - RNA, 23 nt, Human
agaaucccuucuuacuagaacuu

SEQ ID NO: 1187903 - RNA, 23 nt, Human
agccaaaguuccagagggaccug

SEQ ID NO: 1187904 - RNA, 20 nt, Human
agccccuggcaaccacuccc

SEQ ID NO: 1187905 - RNA, 18 nt, Human
agggaccugagagcuggg

SEQ ID NO: 1187906 - RNA, 19 nt, Human
agggaccugagagcugggu

SEQ ID NO: 1187907 - RNA, 24 nt, Human
auaaaacaauuauucaauacucag

SEQ ID NO: 1187908 - RNA, 21 nt, Human
auaguaauaugcaaauguauc

SEQ ID NO: 1187909 - RNA, 18 nt, Human
auauaucagcaucuacau

SEQ ID NO: 1187910 - RNA, 22 nt, Human
augaaucucccagcauacagag

SEQ ID NO: 1187911 - RNA, 22 nt, Human
auucuggaaaugaagacuucac

SEQ ID NO: 1187912 - RNA, 22 nt, Human
caaaaaccaucacugaagccga

SEQ ID NO: 1187913 - RNA, 23 nt, Human
caaaggaagcaagcuuuauugaa

SEQ ID NO: 1187914 - RNA, 20 nt, Human
caaaugucacauaugucaua

SEQ ID NO: 1187915 - RNA, 25 nt, Human
caacacaguaacauauaaacuaaca

SEQ ID NO: 1187916 - RNA, 20 nt, Human
caaggccuuugagggcaagc

SEQ ID NO: 1187917 - RNA, 21 nt, Human
caaggccuuugagggcaagcu

SEQ ID NO: 1187918 - RNA, 18 nt, Human
cacacaauaaaugcccac

SEQ ID NO: 1187919 - RNA, 19 nt, Human
cacacacaauaaaugccca

SEQ ID NO: 1187920 - RNA, 24 nt, Human
cacugaagccgaucacuguacaaa

SEQ ID NO: 1187921 - RNA, 19 nt, Human
cacuguacaaauaugaaaa

SEQ ID NO: 1187922 - RNA, 19 nt, Human
cagccccuggcaaccacuc

SEQ ID NO: 1187923 - RNA, 18 nt, Human
caggaauucauggcagag

SEQ ID NO: 1187924 - RNA, 23 nt, Human
caucaucgcccaaagaaaccaca

SEQ ID NO: 1187925 - RNA, 24 nt, Human
cauggaauuguuucgauucaacaa

SEQ ID NO: 1187926 - RNA, 25 nt, Human
ccaaaaccuaaacaugugucccaua

SEQ ID NO: 1187927 - RNA, 20 nt, Human
ccacucuguuaagagccaaa

SEQ ID NO: 1187928 - RNA, 21 nt, Human
ccagaacauucucaucaucgc

SEQ ID NO: 1187929 - RNA, 24 nt, Human
ccagaacauucucaucaucgccca

SEQ ID NO: 1187930 - RNA, 27 nt, Human
ccagaacauucucaucaucgcccaaag

SEQ ID NO: 1187931 - RNA, 19 nt, Human
cccacaaaaaccaucacug

SEQ ID NO: 1187932 - RNA, 24 nt, Human
cccacaaaaaccaucacugaagcc

SEQ ID NO: 1187933 - RNA, 22 nt, Human
cccacacaaugaaaauguaaac

SEQ ID NO: 1187934 - RNA, 21 nt, Human
cccacagaaucugaggugcca

SEQ ID NO: 1187935 - RNA, 22 nt, Human
cccaugccacauaaauaauacc

SEQ ID NO: 1187936 - RNA, 26 nt, Human
ccgugaacagaaaaaagauugcuaca

SEQ ID NO: 1187937 - RNA, 23 nt, Human
ccuaggcucaaguguugacuccu

SEQ ID NO: 1187938 - RNA, 20 nt, Human
ccuauuagcagucacucccc

SEQ ID NO: 1187939 - RNA, 20 nt, Human
ccuucuuacuagaacuuuag

SEQ ID NO: 1187940 - RNA, 18 nt, Human
cuaaaaguuaacagugaa

SEQ ID NO: 1187941 - RNA, 23 nt, Human
cuaccacaugaaucuaauuaugu

SEQ ID NO: 1187942 - RNA, 20 nt, Human
cucaccuuuccuaaugguga

SEQ ID NO: 1187943 - RNA, 21 nt, Human
cuccccauccucccuuucuca

SEQ ID NO: 1187944 - RNA, 27 nt, Human
gaauaaauaaaggcaacacaguaacau

SEQ ID NO: 1187945 - RNA, 25 nt, Human
gagacaaaacaaagaagagccaaag

SEQ ID NO: 1187946 - RNA, 22 nt, Human
ggcaucucaguggggaggucug

SEQ ID NO: 1187947 - RNA, 22 nt, Human
gguaaagacuaugaaaauacuu

SEQ ID NO: 1187948 - RNA, 23 nt, Human
guaaaccauauaaaucaaaauca

SEQ ID NO: 1187949 - RNA, 20 nt, Human
guaggaugugccacucuguu

SEQ ID NO: 1187950 - RNA, 23 nt, Human
guaguuccuuagacauuugcauu

SEQ ID NO: 1187951 - RNA, 22 nt, Human
guaucaagucuaagauaaaaac

SEQ ID NO: 1187952 - RNA, 18 nt, Human
gugcaacugcaccaaaac

SEQ ID NO: 1187953 - RNA, 25 nt, Human
uaaaacaaauauaaagagacacuuu

SEQ ID NO: 1187954 - RNA, 22 nt, Human
uaaacgaaauauggcccacaca

SEQ ID NO: 1187955 - RNA, 21 nt, Human
uaaagagacacuuuggagaga

SEQ ID NO: 1187956 - RNA, 21 nt, Human
uaacagcaaagcuaggaugag

SEQ ID NO: 1187957 - RNA, 21 nt, Human
uaacagugaaaaauaucuccu

SEQ ID NO: 1187958 - RNA, 22 nt, Human
uaaccuaauucagcuaccacau

SEQ ID NO: 1187959 - RNA, 22 nt, Human
uaacucuccauaggacaguguc

SEQ ID NO: 1187960 - RNA, 23 nt, Human
uaaguuccuucagcaagcuacuu

SEQ ID NO: 1187961 - RNA, 26 nt, Human
uaauaaucaugaaucucccagcauac

SEQ ID NO: 1187962 - RNA, 21 nt, Human
uacaacuaucaccacuauucc

SEQ ID NO: 1187963 - RNA, 22 nt, Human
uacaacuaucaccacuauuccu

SEQ ID NO: 1187964 - RNA, 22 nt, Human
uagugagauaauucacaaccau

SEQ ID NO: 1187965 - RNA, 22 nt, Human
uauaaacgaaauauggcccaca

SEQ ID NO: 1187966 - RNA, 18 nt, Human
uauacucuuucacagauu

SEQ ID NO: 1187967 - RNA, 22 nt, Human
uaugcaagacauucuuuaugau

SEQ ID NO: 1187968 - RNA, 24 nt, Human
ucaauacucagaggccuacuuaau

SEQ ID NO: 1187969 - RNA, 20 nt, Human
ucacauaugucauauaaagc

SEQ ID NO: 1187970 - RNA, 22 nt, Human
ucacugaagccgaucacuguac

SEQ ID NO: 1187971 - RNA, 19 nt, Human
uccacaaugaaauuaaaau

SEQ ID NO: 1187972 - RNA, 19 nt, Human
ucuuuuuuuuuaccauuuu

SEQ ID NO: 1187973 - RNA, 20 nt, Human
ugaaaucagcagggauacga

SEQ ID NO: 1187974 - RNA, 18 nt, Human
ugaaauuucuuacacaca

SEQ ID NO: 1187975 - RNA, 19 nt, Human
ugaagaaacagauccgaca

SEQ ID NO: 1187976 - RNA, 22 nt, Human
ugaauaacuuccauaguaauau

SEQ ID NO: 1187977 - RNA, 21 nt, Human
ugacaggacaauccagaggua

SEQ ID NO: 1187978 - RNA, 24 nt, Human
ugagaaaaaucaauacuccaauau

SEQ ID NO: 1187979 - RNA, 25 nt, Human
ugagacaaaacaaagaagagccaaa

SEQ ID NO: 1187980 - RNA, 21 nt, Human
ugccacuaagacaaacagcca

SEQ ID NO: 1187981 - RNA, 22 nt, Human
ugccacucuguuaagagccaaa

SEQ ID NO: 1187982 - RNA, 20 nt, Human
uggaaccaggaaacaggaau

SEQ ID NO: 1187983 - RNA, 19 nt, Human
uggaaggagaguaggccca

SEQ ID NO: 1187984 - RNA, 21 nt, Human
ugggaagguuugaaaucagca

SEQ ID NO: 1187985 - RNA, 20 nt, Human
ugguaauaaucaugaaucuc

SEQ ID NO: 1187986 - RNA, 23 nt, Human
uguaaaccauauaaaucaaaauc

SEQ ID NO: 1187987 - RNA, 22 nt, Human
ugucucaaacauguuucuuuau

SEQ ID NO: 1187988 - RNA, 21 nt, Human
ugugcaacuuggguuuaugca

SEQ ID NO: 1187989 - RNA, 18 nt, Human
ugugccacucuguuaaga

SEQ ID NO: 1187990 - RNA, 21 nt, Human
ugugggccaccacacucucug

SEQ ID NO: 1187991 - RNA, 23 nt, Human
ugugggccaccacacucucuguu

SEQ ID NO: 1187992 - RNA, 20 nt, Human
uguuacaucacucuaaguac

SEQ ID NO: 1187993 - RNA, 25 nt, Human
uuaaaaagcaggaauaaccauaguu

SEQ ID NO: 1187994 - RNA, 24 nt, Human
uuaagguucuaucacaaacaccgu

SEQ ID NO: 1187995 - RNA, 23 nt, Human
uuagcagucacuccccauccucc

SEQ ID NO: 1187996 - RNA, 23 nt, Human
uucaaaaaacugaugcuugcgga

SEQ ID NO: 1187997 - RNA, 23 nt, Human
uucaacaaaaauaaauguuuuua

SEQ ID NO: 1187998 - RNA, 18 nt, Human
uucagugguuccuaguac

SEQ ID NO: 1187999 - RNA, 24 nt, Human
uucucagccccuggcaaccacucc

SEQ ID NO: 1188000 - RNA, 27 nt, Human
uuuucccaugccacauaaauaauaccc

SEQ ID NO: 1188001 - RNA, 18 nt, Human
aacagacaggacccucag

SEQ ID NO: 1188002 - RNA, 25 nt, Human
acggugcgcgcacacacuggccugc

SEQ ID NO: 1188003 - RNA, 21 nt, Human
agacagggacacuuaagucug

SEQ ID NO: 1188004 - RNA, 22 nt, Human
aucuccaucugcgugcugggag

SEQ ID NO: 1188005 - RNA, 21 nt, Human
cacacacuggccugcgcccac

SEQ ID NO: 1188006 - RNA, 18 nt, Human
cacgcugggagcuguaga

SEQ ID NO: 1188007 - RNA, 27 nt, Human
cacuggccugcgcccacugucucgcac

SEQ ID NO: 1188008 - RNA, 24 nt, Human
cagcccccaacaggucccgggagc

SEQ ID NO: 1188009 - RNA, 19 nt, Human
cagccucguugccgccuug

SEQ ID NO: 1188010 - RNA, 19 nt, Human
cagcugcaggucuguugga

SEQ ID NO: 1188011 - RNA, 23 nt, Human
cagggacacuuaagucugcagag

SEQ ID NO: 1188012 - RNA, 19 nt, Human
cagggcccucccuggaagg

SEQ ID NO: 1188013 - RNA, 18 nt, Human
caggucccgggagcggug

SEQ ID NO: 1188014 - RNA, 20 nt, Human
ccacccaguucgagcuucca

SEQ ID NO: 1188015 - RNA, 24 nt, Human
ccagagguggagccuacagaggca

SEQ ID NO: 1188016 - RNA, 22 nt, Human
ccagcccccaacaggucccggg

SEQ ID NO: 1188017 - RNA, 20 nt, Human
ccaguucgagcuuccaggcu

SEQ ID NO: 1188018 - RNA, 22 nt, Human
ccccagagguggagccuacaga

SEQ ID NO: 1188019 - RNA, 22 nt, Human
ccucccuggaaggacggggcca

SEQ ID NO: 1188020 - RNA, 20 nt, Human
ccugcgacugagcgcccaag

SEQ ID NO: 1188021 - RNA, 22 nt, Human
cgggcgccccucccccagccuc

SEQ ID NO: 1188022 - RNA, 21 nt, Human
cggggccaccugcugccgccg

SEQ ID NO: 1188023 - RNA, 18 nt, Human
cgggugggagugacccga

SEQ ID NO: 1188024 - RNA, 23 nt, Human
cguagugagaugaacccgguacc

SEQ ID NO: 1188025 - RNA, 21 nt, Human
cgugcugggagaaccacugcu

SEQ ID NO: 1188026 - RNA, 23 nt, Human
cucgcgcacggugcgcgcacaca

SEQ ID NO: 1188027 - RNA, 23 nt, Human
cugcuugggggucaggggucagg

SEQ ID NO: 1188028 - RNA, 22 nt, Human
gcaggucuguuggaauacccug

SEQ ID NO: 1188029 - RNA, 20 nt, Human
gcccugcccccagaggugga

SEQ ID NO: 1188030 - RNA, 19 nt, Human
gccuccaucccgccuggcg

SEQ ID NO: 1188031 - RNA, 18 nt, Human
gccugggcaauggcgggc

SEQ ID NO: 1188032 - RNA, 18 nt, Human
ggaacgucgggcggggcg

SEQ ID NO: 1188033 - RNA, 19 nt, Human
ggcgccccucccccagccu

SEQ ID NO: 1188034 - RNA, 25 nt, Human
gggcggggcgaggaacgucgggggu

SEQ ID NO: 1188035 - RNA, 18 nt, Human
gggcuccaggcaccgcca

SEQ ID NO: 1188036 - RNA, 19 nt, Human
guggccgagcggcucccuu

SEQ ID NO: 1188037 - RNA, 24 nt, Human
gugucagugugccccuguuggggg

SEQ ID NO: 1188038 - RNA, 23 nt, Human
guugccgccuugcaguuugaucu

SEQ ID NO: 1188039 - RNA, 19 nt, Human
uaacagacaggacccucag

SEQ ID NO: 1188040 - RNA, 21 nt, Human
uaacagacaggacccucagcu

SEQ ID NO: 1188041 - RNA, 18 nt, Human
ucagauggaaaugcagaa

SEQ ID NO: 1188042 - RNA, 18 nt, Human
ucccccagccucguugcc

SEQ ID NO: 1188043 - RNA, 18 nt, Human
ucugagccagguguggga

SEQ ID NO: 1188044 - RNA, 21 nt, Human
ucugugcccugcccccagagg

SEQ ID NO: 1188045 - RNA, 22 nt, Human
ucuguuggaauacccugccgug

SEQ ID NO: 1188046 - RNA, 22 nt, Human
ugaggcaaugccucgcccugcu

SEQ ID NO: 1188047 - RNA, 19 nt, Human
ugauguacagauggguuuu

SEQ ID NO: 1188048 - RNA, 18 nt, Human
ugcccugcccccagaggu

SEQ ID NO: 1188049 - RNA, 23 nt, Human
ugcccugcccccagagguggagc

SEQ ID NO: 1188050 - RNA, 22 nt, Human
ugcgacugagcgcccaagcgcc

SEQ ID NO: 1188051 - RNA, 20 nt, Human
ugcgcccgggcuccaggcac

SEQ ID NO: 1188052 - RNA, 22 nt, Human
ugcgcgcacacacuggccugcg

SEQ ID NO: 1188053 - RNA, 24 nt, Human
ugcuuuguuuaccuaagcaagccu

SEQ ID NO: 1188054 - RNA, 20 nt, Human
ugucagugugccccuguugg

SEQ ID NO: 1188055 - RNA, 22 nt, Human
uguggugcgccguuucuuaagc

SEQ ID NO: 1188056 - RNA, 19 nt, Human
uguggugggcuccacccag

SEQ ID NO: 1188057 - RNA, 20 nt, Human
uucccaggugaggcaaugcc

SEQ ID NO: 1188058 - RNA, 26 nt, Human
uugggggucaggggucagggacccac

SEQ ID NO: 1188059 - RNA, 21 nt, Human
uuugugguuuuaucuacuuuu

SEQ ID NO: 1188060 - RNA, 19 nt, Human
aaagugcuggaauuauagg

SEQ ID NO: 1188061 - RNA, 24 nt, Human
aaagugcuggaauuauaggcauga

SEQ ID NO: 1188062 - RNA, 20 nt, Human
aaccuccgccucccagccuc

SEQ ID NO: 1188063 - RNA, 24 nt, Human
aagugauccuucugccuuggccuc

SEQ ID NO: 1188064 - RNA, 26 nt, Human
aagugcuggaauuauaggcaugagcc

SEQ ID NO: 1188065 - RNA, 21 nt, Human
aauagugacccuaaugugcuu

SEQ ID NO: 1188066 - RNA, 21 nt, Human
aauuauaggcaugagccacug

SEQ ID NO: 1188067 - RNA, 18 nt, Human
accagagcuucuguucca

SEQ ID NO: 1188068 - RNA, 24 nt, Human
acuauguuucucaggcuggucucg

SEQ ID NO: 1188069 - RNA, 21 nt, Human
agaagguaugcaauguuccag

SEQ ID NO: 1188070 - RNA, 18 nt, Human
agagauccccccaccuca

SEQ ID NO: 1188071 - RNA, 19 nt, Human
agauccccccaccucaucc

SEQ ID NO: 1188072 - RNA, 18 nt, Human
aggcaugagccacugagc

SEQ ID NO: 1188073 - RNA, 19 nt, Human
aggcaugagccacugagcc

SEQ ID NO: 1188074 - RNA, 21 nt, Human
aggcaugagccacugagccug

SEQ ID NO: 1188075 - RNA, 25 nt, Human
aggcuggagugcaguggcacaaucu

SEQ ID NO: 1188076 - RNA, 21 nt, Human
aggcuggucucgaacuccugg

SEQ ID NO: 1188077 - RNA, 21 nt, Human
agugcaguggcacaaucucag

SEQ ID NO: 1188078 - RNA, 24 nt, Human
agugcaguggcacaaucucagcuc

SEQ ID NO: 1188079 - RNA, 19 nt, Human
auaccagagcuucuguucc

SEQ ID NO: 1188080 - RNA, 24 nt, Human
caaagugcuggaauuauaggcaug

SEQ ID NO: 1188081 - RNA, 19 nt, Human
caagagauccccccaccuc

SEQ ID NO: 1188082 - RNA, 19 nt, Human
caagagauccccccaccuc

SEQ ID NO: 1188083 - RNA, 22 nt, Human
caagugauccuucugccuuggc

SEQ ID NO: 1188084 - RNA, 27 nt, Human
caagugauccuucugccuuggccuccc

SEQ ID NO: 1188085 - RNA, 27 nt, Human
caagugauccuucugccuuggccuccc

SEQ ID NO: 1188086 - RNA, 20 nt, Human
caccucauccuccugaguag

SEQ ID NO: 1188087 - RNA, 28 nt, Human
caccucauccuccugaguaguugggacu

SEQ ID NO: 1188088 - RNA, 24 nt, Human
cacuauguuucucaggcuggucuc

SEQ ID NO: 1188089 - RNA, 21 nt, Human
cacugcaaccuccgccuccca

SEQ ID NO: 1188090 - RNA, 20 nt, Human
cagaagguaugcaauguucc

SEQ ID NO: 1188091 - RNA, 19 nt, Human
cagccucaagagauccccc

SEQ ID NO: 1188092 - RNA, 23 nt, Human
cagccucaagagauccccccacc

SEQ ID NO: 1188093 - RNA, 22 nt, Human
cagggucucgcugucacccagg

SEQ ID NO: 1188094 - RNA, 22 nt, Human
caugccaccacacccagcuauu

SEQ ID NO: 1188095 - RNA, 21 nt, Human
ccaaagccagugguggcacuc

SEQ ID NO: 1188096 - RNA, 24 nt, Human
ccaaagugcuggaauuauaggcau

SEQ ID NO: 1188097 - RNA, 18 nt, Human
ccacugagccuggccuga

SEQ ID NO: 1188098 - RNA, 18 nt, Human
ccccccaccucauccucc

SEQ ID NO: 1188099 - RNA, 23 nt, Human
cccuaaugugcuuuuccaguucc

SEQ ID NO: 1188100 - RNA, 25 nt, Human
ccucccagccucaagagaucccccc

SEQ ID NO: 1188101 - RNA, 21 nt, Human
ccugaguaguugggacuacau

SEQ ID NO: 1188102 - RNA, 24 nt, Human
ccugaguaguugggacuacaugcg

SEQ ID NO: 1188103 - RNA, 18 nt, Human
ccuggucucaagugaucc

SEQ ID NO: 1188104 - RNA, 20 nt, Human
ccuggucucaagugauccuu

SEQ ID NO: 1188105 - RNA, 22 nt, Human
ccuggucucaagugauccuucu

SEQ ID NO: 1188106 - RNA, 20 nt, Human
cgcaugccaccacacccagc

SEQ ID NO: 1188107 - RNA, 19 nt, Human
cucaagagauccccccacc

SEQ ID NO: 1188108 - RNA, 23 nt, Human
cucaagagauccccccaccucau

SEQ ID NO: 1188109 - RNA, 25 nt, Human
cucaagagauccccccaccucaucc

SEQ ID NO: 1188110 - RNA, 20 nt, Human
cucaagugauccuucugccu

SEQ ID NO: 1188111 - RNA, 20 nt, Human
cucaagugauccuucugccu

SEQ ID NO: 1188112 - RNA, 24 nt, Human
cucaagugauccuucugccuuggc

SEQ ID NO: 1188113 - RNA, 24 nt, Human
cucacugcaaccuccgccucccag

SEQ ID NO: 1188114 - RNA, 24 nt, Human
cugcaaccuccgccucccagccuc

SEQ ID NO: 1188115 - RNA, 23 nt, Human
cugccuuggccucccaaagugcu

SEQ ID NO: 1188116 - RNA, 20 nt, Human
gacagggucucgcugucacc

SEQ ID NO: 1188117 - RNA, 26 nt, Human
gaguaguugggacuacaugcgcaugc

SEQ ID NO: 1188118 - RNA, 19 nt, Human
gcaugccaccacacccagc

SEQ ID NO: 1188119 - RNA, 22 nt, Human
gccuuggccucccaaagugcug

SEQ ID NO: 1188120 - RNA, 19 nt, Human
gcuggagugcaguggcaca

SEQ ID NO: 1188121 - RNA, 22 nt, Human
gcuggucucgaacuccuggucu

SEQ ID NO: 1188122 - RNA, 24 nt, Human
gcugucacccaggcuggagugcag

SEQ ID NO: 1188123 - RNA, 24 nt, Human
ggcuggucucgaacuccuggucuc

SEQ ID NO: 1188124 - RNA, 23 nt, Human
gucucgcugucacccaggcugga

SEQ ID NO: 1188125 - RNA, 21 nt, Human
gugucauugucagcucuggcu

SEQ ID NO: 1188126 - RNA, 24 nt, Human
uacaugcgcaugccaccacaccca

SEQ ID NO: 1188127 - RNA, 22 nt, Human
uagagacaagggcucacuaugu

SEQ ID NO: 1188128 - RNA, 24 nt, Human
uauguuucucaggcuggucucgaa

SEQ ID NO: 1188129 - RNA, 24 nt, Human
ucacccaggcuggagugcaguggc

SEQ ID NO: 1188130 - RNA, 19 nt, Human
ucacugcaaccuccgccuc

SEQ ID NO: 1188131 - RNA, 23 nt, Human
ucacugcaaccuccgccucccag

SEQ ID NO: 1188132 - RNA, 24 nt, Human
ucacugcaaccuccgccucccagc

SEQ ID NO: 1188133 - RNA, 26 nt, Human
ucacugcaaccuccgccucccagccu

SEQ ID NO: 1188134 - RNA, 25 nt, Human
ucagauauuugaucagaggauugac

SEQ ID NO: 1188135 - RNA, 27 nt, Human
ucagcucacugcaaccuccgccuccca

SEQ ID NO: 1188136 - RNA, 24 nt, Human
ucccaaagugcuggaauuauaggc

SEQ ID NO: 1188137 - RNA, 19 nt, Human
uccccccaccucauccucc

SEQ ID NO: 1188138 - RNA, 22 nt, Human
uccccccaccucauccuccuga

SEQ ID NO: 1188139 - RNA, 18 nt, Human
uccugaguaguugggacu

SEQ ID NO: 1188140 - RNA, 23 nt, Human
ucgcugucacccaggcuggagug

SEQ ID NO: 1188141 - RNA, 21 nt, Human
ucucgaacuccuggucucaag

SEQ ID NO: 1188142 - RNA, 21 nt, Human
ucucgcugucacccaggcugg

SEQ ID NO: 1188143 - RNA, 21 nt, Human
ucucgcugucacccaggcugg

SEQ ID NO: 1188144 - RNA, 22 nt, Human
ucucgcugucacccaggcugga

SEQ ID NO: 1188145 - RNA, 24 nt, Human
ucucgcugucacccaggcuggagu

SEQ ID NO: 1188146 - RNA, 19 nt, Human
ugccaccacacccagcuau

SEQ ID NO: 1188147 - RNA, 21 nt, Human
uggaauuauaggcaugagcca

SEQ ID NO: 1188148 - RNA, 22 nt, Human
uggaauuauaggcaugagccac

SEQ ID NO: 1188149 - RNA, 22 nt, Human
uggaauuauaggcaugagccac

SEQ ID NO: 1188150 - RNA, 23 nt, Human
uggaauuauaggcaugagccacu

SEQ ID NO: 1188151 - RNA, 24 nt, Human
uggaauuauaggcaugagccacug

SEQ ID NO: 1188152 - RNA, 18 nt, Human
uggagugcaguggcacaa

SEQ ID NO: 1188153 - RNA, 23 nt, Human
uggagugcaguggcacaaucuca

SEQ ID NO: 1188154 - RNA, 24 nt, Human
uggagugcaguggcacaaucucag

SEQ ID NO: 1188155 - RNA, 24 nt, Human
uggcacaaucucagcucacugcaa

SEQ ID NO: 1188156 - RNA, 24 nt, Human
ugggacuacaugcgcaugccacca

SEQ ID NO: 1188157 - RNA, 20 nt, Human
uggucucaagugauccuucu

SEQ ID NO: 1188158 - RNA, 23 nt, Human
uggucucaagugauccuucugcc

SEQ ID NO: 1188159 - RNA, 24 nt, Human
uggucucaagugauccuucugccu

SEQ ID NO: 1188160 - RNA, 24 nt, Human
uuccagagugucauugucagcucu

SEQ ID NO: 1188161 - RNA, 24 nt, Human
uucucaggcuggucucgaacuccu

SEQ ID NO: 1188162 - RNA, 20 nt, Human
uugagacagggucucgcugu

SEQ ID NO: 1188163 - RNA, 21 nt, Human
uugauaaaauuuuucagcagu

SEQ ID NO: 1188164 - RNA, 18 nt, Human
uuggccucccaaagugcu

SEQ ID NO: 1188165 - RNA, 25 nt, Human
uugguggaaaagccauaccagagcu

SEQ ID NO: 1188166 - RNA, 23 nt, Human
uuugaucagaggauugacagauu

SEQ ID NO: 1188167 - RNA, 21 nt, Human
aaaaggcacaagcaccccaga

SEQ ID NO: 1188168 - RNA, 19 nt, Human
aacccuacgagcgccccuc

SEQ ID NO: 1188169 - RNA, 19 nt, Human
aagcaccccagacauucag

SEQ ID NO: 1188170 - RNA, 22 nt, Human
acccuacgagcgccccucugcc

SEQ ID NO: 1188171 - RNA, 26 nt, Human
aggaagcccuuauuuagcaaugcaga

SEQ ID NO: 1188172 - RNA, 20 nt, Human
agggaaggggaagcaugaua

SEQ ID NO: 1188173 - RNA, 22 nt, Human
caaggucaaucuauaucaaccc

SEQ ID NO: 1188174 - RNA, 26 nt, Human
cacaagcaccccagacauucaggccc

SEQ ID NO: 1188175 - RNA, 21 nt, Human
cagaacuuggcagaggcccca

SEQ ID NO: 1188176 - RNA, 22 nt, Human
cauuccaagacagccuuggccg

SEQ ID NO: 1188177 - RNA, 23 nt, Human
cauuccaagacagccuuggccgu

SEQ ID NO: 1188178 - RNA, 20 nt, Human
cccaacccuacgagcgcccc

SEQ ID NO: 1188179 - RNA, 19 nt, Human
ccgcugcagccaagccaca

SEQ ID NO: 1188180 - RNA, 20 nt, Human
ccggccgcugcagccaagcc

SEQ ID NO: 1188181 - RNA, 21 nt, Human
ccuacgagcgccccucugccc

SEQ ID NO: 1188182 - RNA, 20 nt, Human
cgacucggagggcugcucag

SEQ ID NO: 1188183 - RNA, 20 nt, Human
cugcagccaagccacaggcc

SEQ ID NO: 1188184 - RNA, 23 nt, Human
cugcucaggacauuccaagacag

SEQ ID NO: 1188185 - RNA, 26 nt, Human
cuucucagaaaaggcacaagcacccc

SEQ ID NO: 1188186 - RNA, 20 nt, Human
cuugauggggauguugagca

SEQ ID NO: 1188187 - RNA, 26 nt, Human
gccaagccacaggcgucccccaaccc

SEQ ID NO: 1188188 - RNA, 22 nt, Human
gccacaggcgucccccaacccu

SEQ ID NO: 1188189 - RNA, 25 nt, Human
gggcagaggcucgacucggagggcu

SEQ ID NO: 1188190 - RNA, 21 nt, Human
ucacagcagucccuucccaca

SEQ ID NO: 1188191 - RNA, 21 nt, Human
uccauagccacggucucuucc

SEQ ID NO: 1188192 - RNA, 24 nt, Human
ucccccaacccuacgagcgccccu

SEQ ID NO: 1188193 - RNA, 26 nt, Human
ucgcugcccacaaggucaaucuaguu

SEQ ID NO: 1188194 - RNA, 18 nt, Human
ucucgcugcccacaaggu

SEQ ID NO: 1188195 - RNA, 19 nt, Human
ucugugacucucgcugccc

SEQ ID NO: 1188196 - RNA, 19 nt, Human
ugcuugcugucuugucugu

SEQ ID NO: 1188197 - RNA, 21 nt, Human
uggcagaggccccacaucugu

SEQ ID NO: 1188198 - RNA, 21 nt, Human
uuccaagacagccuuggccgu

SEQ ID NO: 1188199 - RNA, 20 nt, Human
uugccggccgcugcagccaa

SEQ ID NO: 1188200 - RNA, 23 nt, Human
uugcugucuugucugugacucuc

SEQ ID NO: 1188201 - RNA, 18 nt, Human
uuuuguggacucaaaccu

SEQ ID NO: 1188202 - RNA, 18 nt, Human
accucggucgccaaggcc

SEQ ID NO: 1188203 - RNA, 20 nt, Human
aggagcugcuguggcugcag

SEQ ID NO: 1188204 - RNA, 18 nt, Human
caggccggcgcuguguuc

SEQ ID NO: 1188205 - RNA, 18 nt, Human
ccaaggccaccgccagga

SEQ ID NO: 1188206 - RNA, 19 nt, Human
ccgccaggaggcagaaggc

SEQ ID NO: 1188207 - RNA, 18 nt, Human
cgcuguguucggccagcg

SEQ ID NO: 1188208 - RNA, 20 nt, Human
gagcugcuguggcugcaggu

SEQ ID NO: 1188209 - RNA, 20 nt, Human
ggcucagcuucucugcggug

SEQ ID NO: 1188210 - RNA, 19 nt, Human
ucggccagcguggcugccu

SEQ ID NO: 1188211 - RNA, 19 nt, Human
ugccaggagcugcuguggc

SEQ ID NO: 1188212 - RNA, 19 nt, Human
acagacagaagagugcucu

SEQ ID NO: 1188213 - RNA, 21 nt, Human
agacaggccacaggggucccc

SEQ ID NO: 1188214 - RNA, 19 nt, Human
agagccgcugagacaucua

SEQ ID NO: 1188215 - RNA, 28 nt, Human
aggcugggguaaucauggggggagcacc

SEQ ID NO: 1188216 - RNA, 21 nt, Human
agguuuauuacuagcaaaacc

SEQ ID NO: 1188217 - RNA, 21 nt, Human
agguuuccagucuugggcucu

SEQ ID NO: 1188218 - RNA, 19 nt, Human
agugcucugcaucaggaac

SEQ ID NO: 1188219 - RNA, 18 nt, Human
cagaagagugcucuggug

SEQ ID NO: 1188220 - RNA, 18 nt, Human
cagcagauucugaagguu

SEQ ID NO: 1188221 - RNA, 18 nt, Human
caugcccagccccacacc

SEQ ID NO: 1188222 - RNA, 20 nt, Human
ccccacaccugaaaugggac

SEQ ID NO: 1188223 - RNA, 19 nt, Human
ccccagggaggguuggggg

SEQ ID NO: 1188224 - RNA, 19 nt, Human
cuaaaaccaggccucuccu

SEQ ID NO: 1188225 - RNA, 19 nt, Human
cugaagguuuccagucuug

SEQ ID NO: 1188226 - RNA, 18 nt, Human
gacaguauagcuugcugc

SEQ ID NO: 1188227 - RNA, 18 nt, Human
ggcugggguaaucauggg

SEQ ID NO: 1188228 - RNA, 22 nt, Human
gggaggguugggggccagcaga

SEQ ID NO: 1188229 - RNA, 25 nt, Human
gggcucugugguuccucaaagaggu

SEQ ID NO: 1188230 - RNA, 18 nt, Human
gggcucugugguuccucc

SEQ ID NO: 1188231 - RNA, 22 nt, Human
gggguccccagggaggguuggg

SEQ ID NO: 1188232 - RNA, 28 nt, Human
uccagcaggagugaccaugcccagcccu

SEQ ID NO: 1188233 - RNA, 22 nt, Human
ucuacagacagaagagugcucu

SEQ ID NO: 1188234 - RNA, 24 nt, Human
ucuggugagacaggccacaggggu

SEQ ID NO: 1188235 - RNA, 24 nt, Human
ugaaaugggacucccuuguagagc

SEQ ID NO: 1188236 - RNA, 22 nt, Human
ugagacaggccacagggguccc

SEQ ID NO: 1188237 - RNA, 28 nt, Human
ugcccagccccacaccugaaaugggacu

SEQ ID NO: 1188238 - RNA, 21 nt, Human
ugggagggagggcucuggaca

SEQ ID NO: 1188239 - RNA, 19 nt, Human
uggggcugggagggagggc

SEQ ID NO: 1188240 - RNA, 21 nt, Human
ugggguaaucauggggcuggg

SEQ ID NO: 1188241 - RNA, 21 nt, Human
uugaaagaguggaugagugcu

SEQ ID NO: 1188242 - RNA, 20 nt, Human
aaaaaaaaaaaaaaaagcca

SEQ ID NO: 1188243 - RNA, 23 nt, Human
aaaaaaccuagcuucggagucac

SEQ ID NO: 1188244 - RNA, 23 nt, Human
aaaaaagccauacuacucccaaa

SEQ ID NO: 1188245 - RNA, 23 nt, Human
aaaaauauauacuuaacggcucc

SEQ ID NO: 1188246 - RNA, 19 nt, Human
aaacaaccucagaccaggg

SEQ ID NO: 1188247 - RNA, 20 nt, Human
aaacaacuggugaagaagau

SEQ ID NO: 1188248 - RNA, 23 nt, Human
aaacaugcuaaaugaaauaagcc

SEQ ID NO: 1188249 - RNA, 24 nt, Human
aaagugcugggauuacaggcuuga

SEQ ID NO: 1188250 - RNA, 23 nt, Human
aacaaagccuaugaaacagagcc

SEQ ID NO: 1188251 - RNA, 27 nt, Human
aacagagccuaugaaaaaacauuaacc

SEQ ID NO: 1188252 - RNA, 23 nt, Human
aagaacacuaaaagaaagucaua

SEQ ID NO: 1188253 - RNA, 22 nt, Human
aagcagccauauuuaauucuca

SEQ ID NO: 1188254 - RNA, 19 nt, Human
aaggucaucauccacaaaa

SEQ ID NO: 1188255 - RNA, 22 nt, Human
aagguugaaagccaccaacacu

SEQ ID NO: 1188256 - RNA, 19 nt, Human
aagugacagcaaagacuga

SEQ ID NO: 1188257 - RNA, 19 nt, Human
aagugcugggauuacaggc

SEQ ID NO: 1188258 - RNA, 19 nt, Human
aagugcugggauuacaggc

SEQ ID NO: 1188259 - RNA, 26 nt, Human
aagugcugggauuacaggcuugagcc

SEQ ID NO: 1188260 - RNA, 23 nt, Human
aaugagggagagccuaugaaaaa

SEQ ID NO: 1188261 - RNA, 24 nt, Human
aauuuuguauccuuaguagagaca

SEQ ID NO: 1188262 - RNA, 22 nt, Human
acagcaaagacugacauccaga

SEQ ID NO: 1188263 - RNA, 24 nt, Human
acagggugucaccauguuggccag

SEQ ID NO: 1188264 - RNA, 21 nt, Human
accaaggucaucauccacaaa

SEQ ID NO: 1188265 - RNA, 22 nt, Human
accacuuggaacagaauaccac

SEQ ID NO: 1188266 - RNA, 24 nt, Human
accauguuggccaggguggucuug

SEQ ID NO: 1188267 - RNA, 33 nt, Human
accauuugcuguuaaaaaaaaaaaaaaaaaaaa

SEQ ID NO: 1188268 - RNA, 19 nt, Human
acccaggcuggagugcagu

SEQ ID NO: 1188269 - RNA, 21 nt, Human
acuacaggcgugugccaccau

SEQ ID NO: 1188270 - RNA, 22 nt, Human
agaaaaaaaaccuagcuucgga

SEQ ID NO: 1188271 - RNA, 19 nt, Human
agaaacugauagguuuguc

SEQ ID NO: 1188272 - RNA, 24 nt, Human
agagaaaaaaaaccuagcuucgga

SEQ ID NO: 1188273 - RNA, 20 nt, Human
agauuuucaacuuagcguuu

SEQ ID NO: 1188274 - RNA, 22 nt, Human
agcguuuacauguucacccagu

SEQ ID NO: 1188275 - RNA, 20 nt, Human
agcuauucuccugccucagc

SEQ ID NO: 1188276 - RNA, 23 nt, Human
aggcaagagagaaaaaaaaccua

SEQ ID NO: 1188277 - RNA, 24 nt, Human
aggcaagagagaaaaaaaaccuag

SEQ ID NO: 1188278 - RNA, 26 nt, Human
aggcaagagagaaaaaaaagggaccc

SEQ ID NO: 1188279 - RNA, 25 nt, Human
aggcuggagugcaguggcacagucu

SEQ ID NO: 1188280 - RNA, 23 nt, Human
aggcuugagccaccgugcccggc

SEQ ID NO: 1188281 - RNA, 25 nt, Human
aguaccaaaggcugaggggaaggga

SEQ ID NO: 1188282 - RNA, 21 nt, Human
agugcaguggcacagucucag

SEQ ID NO: 1188283 - RNA, 24 nt, Human
agugcauuauuuuauuuaaaaaga

SEQ ID NO: 1188284 - RNA, 24 nt, Human
agugcugggauuacaggcuugagc

SEQ ID NO: 1188285 - RNA, 18 nt, Human
auaaugggcagcccuugc

SEQ ID NO: 1188286 - RNA, 19 nt, Human
augaaccuuuaaaacaugc

SEQ ID NO: 1188287 - RNA, 23 nt, Human
augaaccuuuaaaacaugcuaaa

SEQ ID NO: 1188288 - RNA, 22 nt, Human
augaagcuguaaaagcacagug

SEQ ID NO: 1188289 - RNA, 19 nt, Human
augugcauuugcgcacccu

SEQ ID NO: 1188290 - RNA, 27 nt, Human
caaaccuaaagauugaggaggaacuga

SEQ ID NO: 1188291 - RNA, 23 nt, Human
caaagugcugggauuacaggcuu

SEQ ID NO: 1188292 - RNA, 22 nt, Human
caagccaaaagaagugacagca

SEQ ID NO: 1188293 - RNA, 23 nt, Human
cacaagccaaaagaagugacagc

SEQ ID NO: 1188294 - RNA, 22 nt, Human
caccaacacugacacauggauu

SEQ ID NO: 1188295 - RNA, 21 nt, Human
caccaccaauuucugauucug

SEQ ID NO: 1188296 - RNA, 18 nt, Human
caccauguuggccagggu

SEQ ID NO: 1188297 - RNA, 22 nt, Human
caccauguuggccagggugguc

SEQ ID NO: 1188298 - RNA, 24 nt, Human
caccauguuggccaggguggucuu

SEQ ID NO: 1188299 - RNA, 22 nt, Human
cacccaccucggccucccaaag

SEQ ID NO: 1188300 - RNA, 23 nt, Human
cacccaccucggccucccaaagu

SEQ ID NO: 1188301 - RNA, 24 nt, Human
caccucggccucccaaagugcugg

SEQ ID NO: 1188302 - RNA, 21 nt, Human
cacugcaaccucugccucccg

SEQ ID NO: 1188303 - RNA, 23 nt, Human
cacugcaaccucugccucccggg

SEQ ID NO: 1188304 - RNA, 19 nt, Human
cagaaacaguaccaaaggc

SEQ ID NO: 1188305 - RNA, 23 nt, Human
cagaauccucuaauucaguucuc

SEQ ID NO: 1188306 - RNA, 19 nt, Human
cagaggccguuagugguag

SEQ ID NO: 1188307 - RNA, 24 nt, Human
cagggugucaccauguuggccagg

SEQ ID NO: 1188308 - RNA, 19 nt, Human
caggucccacccuccaggg

SEQ ID NO: 1188309 - RNA, 20 nt, Human
cauccagaauccucuaauuc

SEQ ID NO: 1188310 - RNA, 20 nt, Human
caugcugaaaaaaaacaacu

SEQ ID NO: 1188311 - RNA, 24 nt, Human
ccaaaagaagugacagcaaagacu

SEQ ID NO: 1188312 - RNA, 19 nt, Human
ccaaagugcugggauuaca

SEQ ID NO: 1188313 - RNA, 22 nt, Human
ccaaagugcugggauuacaggc

SEQ ID NO: 1188314 - RNA, 23 nt, Human
ccaaagugcugggauuacaggcu

SEQ ID NO: 1188315 - RNA, 24 nt, Human
ccaacacugacacauggauuuaau

SEQ ID NO: 1188316 - RNA, 18 nt, Human
ccaagguugaaagccacc

SEQ ID NO: 1188317 - RNA, 24 nt, Human
ccagcuauucuccugccucagccu

SEQ ID NO: 1188318 - RNA, 24 nt, Human
cccaaagugcugggauuacaggcu

SEQ ID NO: 1188319 - RNA, 23 nt, Human
ccuagguagcugggacuacaggc

SEQ ID NO: 1188320 - RNA, 24 nt, Human
ccuagguagcugggacuacaggcg

SEQ ID NO: 1188321 - RNA, 24 nt, Human
ccucccggguuccagcuauucucc

SEQ ID NO: 1188322 - RNA, 24 nt, Human
ccucccggguuccagcuccgaccc

SEQ ID NO: 1188323 - RNA, 24 nt, Human
ccuccuagguagcugggacuacag

SEQ ID NO: 1188324 - RNA, 22 nt, Human
ccugaccucgugauccacccac

SEQ ID NO: 1188325 - RNA, 24 nt, Human
ccugccucagccuccuagguagcu

SEQ ID NO: 1188326 - RNA, 27 nt, Human
cguaaauaaugccacugaauugcacaa

SEQ ID NO: 1188327 - RNA, 24 nt, Human
cuaacucugcuuucucugugaugc

SEQ ID NO: 1188328 - RNA, 24 nt, Human
cucacugcaaccucugccucccgg

SEQ ID NO: 1188329 - RNA, 24 nt, Human
cucagccuccuagguagcugggac

SEQ ID NO: 1188330 - RNA, 21 nt, Human
cucccggguuccagcuauucu

SEQ ID NO: 1188331 - RNA, 18 nt, Human
cuccugaccucgugaucc

SEQ ID NO: 1188332 - RNA, 25 nt, Human
cuccugaccucgugauccacccacc

SEQ ID NO: 1188333 - RNA, 22 nt, Human
cucucaaauuugagcacgcuug

SEQ ID NO: 1188334 - RNA, 19 nt, Human
cucuuggaacaguggcaaa

SEQ ID NO: 1188335 - RNA, 19 nt, Human
cugcaaccucugccucccg

SEQ ID NO: 1188336 - RNA, 23 nt, Human
cugcaaccucugccucccggguu

SEQ ID NO: 1188337 - RNA, 24 nt, Human
cugcaaccucugccucccggguuc

SEQ ID NO: 1188338 - RNA, 18 nt, Human
cugucacccaggcuggag

SEQ ID NO: 1188339 - RNA, 21 nt, Human
cuugcucugucacccaggcug

SEQ ID NO: 1188340 - RNA, 25 nt, Human
gaaaaaaaacaacuggugaagaaga

SEQ ID NO: 1188341 - RNA, 22 nt, Human
gaccucgugauccacccaccuc

SEQ ID NO: 1188342 - RNA, 22 nt, Human
gaccucgugauccacccaccuc

SEQ ID NO: 1188343 - RNA, 24 nt, Human
gaccucgugauccacccaccucgg

SEQ ID NO: 1188344 - RNA, 24 nt, Human
gacuacaggcgugugccaccaugc

SEQ ID NO: 1188345 - RNA, 18 nt, Human
gauuacaggcuugagcca

SEQ ID NO: 1188346 - RNA, 21 nt, Human
gauuacaggcuugagccaccg

SEQ ID NO: 1188347 - RNA, 24 nt, Human
gauuacaggcuugagccaccgugc

SEQ ID NO: 1188348 - RNA, 20 nt, Human
gcaaggaagggcucaacaga

SEQ ID NO: 1188349 - RNA, 19 nt, Human
gccaagguugaaagccacc

SEQ ID NO: 1188350 - RNA, 21 nt, Human
gcgcagccaagguugaaagcc

SEQ ID NO: 1188351 - RNA, 22 nt, Human
gcgugugccaccaugcccggcu

SEQ ID NO: 1188352 - RNA, 25 nt, Human
gcucugucacccaggcuggagugca

SEQ ID NO: 1188353 - RNA, 19 nt, Human
gcuggagugcaguggcaca

SEQ ID NO: 1188354 - RNA, 24 nt, Human
ggacuacaggcgugugccaccaug

SEQ ID NO: 1188355 - RNA, 18 nt, Human
ggccccaccaccaauuuc

SEQ ID NO: 1188356 - RNA, 23 nt, Human
gggaaacauuaaaacacucauca

SEQ ID NO: 1188357 - RNA, 22 nt, Human
gggugucaccauguuggccagg

SEQ ID NO: 1188358 - RNA, 23 nt, Human
gguggucuugaacuccugaccuc

SEQ ID NO: 1188359 - RNA, 22 nt, Human
guagcugggacuacaggcgugu

SEQ ID NO: 1188360 - RNA, 20 nt, Human
guauuguauaauuucacuua

SEQ ID NO: 1188361 - RNA, 21 nt, Human
gucaucauccacaaaaauaca

SEQ ID NO: 1188362 - RNA, 24 nt, Human
gugauccacccaccucggccuccc

SEQ ID NO: 1188363 - RNA, 24 nt, Human
uaaaacacucaucaggucccaccc

SEQ ID NO: 1188364 - RNA, 23 nt, Human
uaaaagcacagugaaugagaaca

SEQ ID NO: 1188365 - RNA, 19 nt, Human
uaacaucguaaauaaugcc

SEQ ID NO: 1188366 - RNA, 22 nt, Human
uaaccaaggucaucauccacaa

SEQ ID NO: 1188367 - RNA, 21 nt, Human
uaacucggcuggguguagccu

SEQ ID NO: 1188368 - RNA, 23 nt, Human
uaauuuuguauccuuaguagaga

SEQ ID NO: 1188369 - RNA, 23 nt, Human
uacaggcuugagccaccgugccc

SEQ ID NO: 1188370 - RNA, 23 nt, Human
uaccugggaaaggcagauuuuca

SEQ ID NO: 1188371 - RNA, 21 nt, Human
uagacaaaugcauugaggcag

SEQ ID NO: 1188372 - RNA, 22 nt, Human
uagagacagggugucaccaugu

SEQ ID NO: 1188373 - RNA, 24 nt, Human
uaguagagacagggugucaccaug

SEQ ID NO: 1188374 - RNA, 19 nt, Human
uaugaaaaaacaaagccua

SEQ ID NO: 1188375 - RNA, 20 nt, Human
uaugaaacagagccuaugaa

SEQ ID NO: 1188376 - RNA, 25 nt, Human
uaugaaacagagccuaugaaaaaac

SEQ ID NO: 1188377 - RNA, 19 nt, Human
uauucuccugccucagccu

SEQ ID NO: 1188378 - RNA, 24 nt, Human
ucaccauguuggccaggguggucu

SEQ ID NO: 1188379 - RNA, 22 nt, Human
ucacccaggcuggagugcagug

SEQ ID NO: 1188380 - RNA, 24 nt, Human
ucacugcaaccucugccucccggg

SEQ ID NO: 1188381 - RNA, 25 nt, Human
ucacugcaaccucugccucccgggu

SEQ ID NO: 1188382 - RNA, 18 nt, Human
uccagaauccucuaauuc

SEQ ID NO: 1188383 - RNA, 24 nt, Human
ucccaaagugcugggauuacaggc

SEQ ID NO: 1188384 - RNA, 19 nt, Human
ucccaaauaccuccgcgca

SEQ ID NO: 1188385 - RNA, 21 nt, Human
ucccggguuccagcuauucuc

SEQ ID NO: 1188386 - RNA, 24 nt, Human
ucccggguuccagcuauucuccug

SEQ ID NO: 1188387 - RNA, 24 nt, Human
uccuagguagcugggacuacaggc

SEQ ID NO: 1188388 - RNA, 18 nt, Human
ucggccucccaaagugcu

SEQ ID NO: 1188389 - RNA, 24 nt, Human
ucuccugccucagccuccuaggua

SEQ ID NO: 1188390 - RNA, 23 nt, Human
ucucucuacucaucucacuaccu

SEQ ID NO: 1188391 - RNA, 24 nt, Human
ucugucacccaggcuggagugcag

SEQ ID NO: 1188392 - RNA, 19 nt, Human
ucuugaacuccugaccucg

SEQ ID NO: 1188393 - RNA, 22 nt, Human
ucuugcucugucacccaggcug

SEQ ID NO: 1188394 - RNA, 23 nt, Human
ucuugcucugucacccaggcugg

SEQ ID NO: 1188395 - RNA, 24 nt, Human
ucuugcucugucacccaggcugga

SEQ ID NO: 1188396 - RNA, 18 nt, Human
ugaaaaaaaacaacuggu

SEQ ID NO: 1188397 - RNA, 20 nt, Human
ugaaaaaacauuaaccaagg

SEQ ID NO: 1188398 - RNA, 23 nt, Human
ugaaacagagccuaugaaaaaac

SEQ ID NO: 1188399 - RNA, 19 nt, Human
ugaaacuucugagacugac

SEQ ID NO: 1188400 - RNA, 19 nt, Human
ugacaauguuacagggcuu

SEQ ID NO: 1188401 - RNA, 20 nt, Human
ugacacuuguaagaaccacu

SEQ ID NO: 1188402 - RNA, 24 nt, Human
ugacagcaaagacugacauccaga

SEQ ID NO: 1188403 - RNA, 21 nt, Human
ugacagcaagaauuaaaacac

SEQ ID NO: 1188404 - RNA, 22 nt, Human
ugacagcaauauugagagugag

SEQ ID NO: 1188405 - RNA, 19 nt, Human
ugagaacacuagcaagcua

SEQ ID NO: 1188406 - RNA, 18 nt, Human
ugagagugaggcaagaga

SEQ ID NO: 1188407 - RNA, 23 nt, Human
ugaggcaagagagaaaaaaaacc

SEQ ID NO: 1188408 - RNA, 18 nt, Human
ugaggcagaaacaguacc

SEQ ID NO: 1188409 - RNA, 24 nt, Human
ugauccacccaccucggccuccca

SEQ ID NO: 1188410 - RNA, 22 nt, Human
ugcaguggcacagucucagcuc

SEQ ID NO: 1188411 - RNA, 24 nt, Human
ugccucagccuccuagguagcugg

SEQ ID NO: 1188412 - RNA, 28 nt, Human
ugccucccggguuccagcuauucuccuu

SEQ ID NO: 1188413 - RNA, 24 nt, Human
ugcucugucacccaggcuggagug

SEQ ID NO: 1188414 - RNA, 21 nt, Human
uggaaaccuguuucuucaugu

SEQ ID NO: 1188415 - RNA, 23 nt, Human
uggaacaguggcaaauuuucugu

SEQ ID NO: 1188416 - RNA, 23 nt, Human
uggagugcaguggcacagucuca

SEQ ID NO: 1188417 - RNA, 24 nt, Human
uggagugcaguggcacagucucag

SEQ ID NO: 1188418 - RNA, 24 nt, Human
uggcacagucucagcucacugcaa

SEQ ID NO: 1188419 - RNA, 24 nt, Human
uggccaggguggucuugaacuccu

SEQ ID NO: 1188420 - RNA, 18 nt, Human
ugggaaaggcagauuuuc

SEQ ID NO: 1188421 - RNA, 18 nt, Human
ugggacuacaggcgugug

SEQ ID NO: 1188422 - RNA, 21 nt, Human
ugggacuacaggcgugugcca

SEQ ID NO: 1188423 - RNA, 22 nt, Human
ugggacuacaggcgugugccac

SEQ ID NO: 1188424 - RNA, 24 nt, Human
ugggacuacaggcgugugccacca

SEQ ID NO: 1188425 - RNA, 25 nt, Human
ugggacuacaggcgugugccaccau

SEQ ID NO: 1188426 - RNA, 18 nt, Human
ugggauuacaggcuugag

SEQ ID NO: 1188427 - RNA, 21 nt, Human
ugggauuacaggcuugagcca

SEQ ID NO: 1188428 - RNA, 22 nt, Human
ugggauuacaggcuugagccac

SEQ ID NO: 1188429 - RNA, 23 nt, Human
ugggauuacaggcuugagccacc

SEQ ID NO: 1188430 - RNA, 23 nt, Human
ugggauuacaggcuugagccacc

SEQ ID NO: 1188431 - RNA, 24 nt, Human
ugggauuacaggcuugagccaccg

SEQ ID NO: 1188432 - RNA, 25 nt, Human
uguaaaagcacagugaaugagaaca

SEQ ID NO: 1188433 - RNA, 24 nt, Human
uguagaaagauuaacaaggguuac

SEQ ID NO: 1188434 - RNA, 18 nt, Human
ugugauuuuaagagucag

SEQ ID NO: 1188435 - RNA, 23 nt, Human
uguuacagggcuucuguuuaggg

SEQ ID NO: 1188436 - RNA, 20 nt, Human
uuaaaaaaaaaaaaaaaaaa

SEQ ID NO: 1188437 - RNA, 19 nt, Human
uuaaaacacucaucagguc

SEQ ID NO: 1188438 - RNA, 23 nt, Human
uuaaccaaggucaucauccacaa

SEQ ID NO: 1188439 - RNA, 25 nt, Human
uuaacggcuccuaauccagcucucu

SEQ ID NO: 1188440 - RNA, 22 nt, Human
uuacuaccacuaacagccucug

SEQ ID NO: 1188441 - RNA, 19 nt, Human
uuaggaaaauuuguuacau

SEQ ID NO: 1188442 - RNA, 24 nt, Human
uuaguagagacagggugucaccau

SEQ ID NO: 1188443 - RNA, 21 nt, Human
uuccagcuauucuccugccuc

SEQ ID NO: 1188444 - RNA, 22 nt, Human
uugaaagccaccaacacugaca

SEQ ID NO: 1188445 - RNA, 24 nt, Human
uugcucugucacccaggcuggagu

SEQ ID NO: 1188446 - RNA, 19 nt, Human
uuuuguauccuuaguagag

SEQ ID NO: 1188447 - RNA, 20 nt, Human
uuuuguauccuuaguagaga

SEQ ID NO: 1188448 - RNA, 19 nt, Human
aaaccacccuuccuucccc

SEQ ID NO: 1188449 - RNA, 20 nt, Human
aaagccaugacuucacgaaa

SEQ ID NO: 1188450 - RNA, 25 nt, Human
aaaggcagagcccagcgcauccacu

SEQ ID NO: 1188451 - RNA, 24 nt, Human
aaagugcugggauuacaggcguga

SEQ ID NO: 1188452 - RNA, 24 nt, Human
aaaguggagaauggccgcugcgga

SEQ ID NO: 1188453 - RNA, 19 nt, Human
aaauaagaagaccaaggcc

SEQ ID NO: 1188454 - RNA, 24 nt, Human
aaccacaggaggcccccaggaagu

SEQ ID NO: 1188455 - RNA, 24 nt, Human
aaccucaccucaccguguccccac

SEQ ID NO: 1188456 - RNA, 20 nt, Human
aaccucugcaccugcuuccc

SEQ ID NO: 1188457 - RNA, 23 nt, Human
aacucagacucagcauguccaug

SEQ ID NO: 1188458 - RNA, 20 nt, Human
aacucagggaagggaagaac

SEQ ID NO: 1188459 - RNA, 22 nt, Human
aagaaaaaaaaaaucuagaaga

SEQ ID NO: 1188460 - RNA, 25 nt, Human
aagaggagcccaaccccuuaacagc

SEQ ID NO: 1188461 - RNA, 21 nt, Human
aagaucacacacauuuugcca

SEQ ID NO: 1188462 - RNA, 19 nt, Human
aagugcugggauuacaggc

SEQ ID NO: 1188463 - RNA, 19 nt, Human
aagugcugggauuacaggc

SEQ ID NO: 1188464 - RNA, 24 nt, Human
aaugcagugaugcaaucuuggcuc

SEQ ID NO: 1188465 - RNA, 18 nt, Human
acaggguuucaccauguu

SEQ ID NO: 1188466 - RNA, 21 nt, Human
acaggguuucaccauguuggc

SEQ ID NO: 1188467 - RNA, 24 nt, Human
acaggguuucaccauguuggccag

SEQ ID NO: 1188468 - RNA, 24 nt, Human
accauguuggccaggauggucucg

SEQ ID NO: 1188469 - RNA, 18 nt, Human
acccaccaccaguucucc

SEQ ID NO: 1188470 - RNA, 19 nt, Human
acccagggcccuggucagc

SEQ ID NO: 1188471 - RNA, 21 nt, Human
accccacccaaccucugcacc

SEQ ID NO: 1188472 - RNA, 24 nt, Human
accucauucaggaagccccgccag

SEQ ID NO: 1188473 - RNA, 24 nt, Human
accucgugauccacccgccuuggc

SEQ ID NO: 1188474 - RNA, 19 nt, Human
acgccacagaauccuccaa

SEQ ID NO: 1188475 - RNA, 19 nt, Human
acuacaggugugugccaca

SEQ ID NO: 1188476 - RNA, 18 nt, Human
acucacuccugcucccca

SEQ ID NO: 1188477 - RNA, 24 nt, Human
acugauucuuaaaaggggagguga

SEQ ID NO: 1188478 - RNA, 22 nt, Human
acuggcacccaccaccaguucu

SEQ ID NO: 1188479 - RNA, 25 nt, Human
agaacgaagcccagccuccucugcc

SEQ ID NO: 1188480 - RNA, 22 nt, Human
agaagaauacuagggaaggaac

SEQ ID NO: 1188481 - RNA, 24 nt, Human
agcaguucucccgccucaaccucc

SEQ ID NO: 1188482 - RNA, 22 nt, Human
agccccacagccuccaagccuc

SEQ ID NO: 1188483 - RNA, 23 nt, Human
aggaaacacccccaacccagggc

SEQ ID NO: 1188484 - RNA, 23 nt, Human
aggaagaagaaagaggagcccaa

SEQ ID NO: 1188485 - RNA, 22 nt, Human
aggacaggaaccaugggugaug

SEQ ID NO: 1188486 - RNA, 19 nt, Human
aggagucauccccaggcua

SEQ ID NO: 1188487 - RNA, 19 nt, Human
aggcagggccugcacacag

SEQ ID NO: 1188488 - RNA, 22 nt, Human
aggcccaagcuggaaaccggaa

SEQ ID NO: 1188489 - RNA, 19 nt, Human
aggcgugaaccaccacgcc

SEQ ID NO: 1188490 - RNA, 20 nt, Human
agggcucacagagacggggg

SEQ ID NO: 1188491 - RNA, 19 nt, Human
aggggaggugaaaaaaaaa

SEQ ID NO: 1188492 - RNA, 23 nt, Human
aguagcugggacuacaggugugu

SEQ ID NO: 1188493 - RNA, 19 nt, Human
agugauuccugccuggccc

SEQ ID NO: 1188494 - RNA, 24 nt, Human
agugcagcucccacccccaaaaag

SEQ ID NO: 1188495 - RNA, 24 nt, Human
auaaagcacagaacauauacagaa

SEQ ID NO: 1188496 - RNA, 19 nt, Human
auccacccgccuuggccuc

SEQ ID NO: 1188497 - RNA, 22 nt, Human
auccuacacacugcggcucagg

SEQ ID NO: 1188498 - RNA, 21 nt, Human
aucuauaacaagcauucucaa

SEQ ID NO: 1188499 - RNA, 23 nt, Human
augguggagccaaugaagaccag

SEQ ID NO: 1188500 - RNA, 26 nt, Human
auuaaacugcaacccucaaaggcaga

SEQ ID NO: 1188501 - RNA, 21 nt, Human
auuuugccaccccccauucca

SEQ ID NO: 1188502 - RNA, 24 nt, Human
auuuuuguauuuuuaguagagaca

SEQ ID NO: 1188503 - RNA, 24 nt, Human
caaagugcugggauuacaggcgug

SEQ ID NO: 1188504 - RNA, 19 nt, Human
caaccacaggaggccccca

SEQ ID NO: 1188505 - RNA, 22 nt, Human
caacccagggcccuggucagcc

SEQ ID NO: 1188506 - RNA, 21 nt, Human
caaccucugcaccugcuuccc

SEQ ID NO: 1188507 - RNA, 21 nt, Human
caacuaagccccaccgggguc

SEQ ID NO: 1188508 - RNA, 20 nt, Human
caagccucccacucugcacu

SEQ ID NO: 1188509 - RNA, 22 nt, Human
caagucccauaggcaacucaga

SEQ ID NO: 1188510 - RNA, 25 nt, Human
caccaggaagaagaaagaggagccc

SEQ ID NO: 1188511 - RNA, 18 nt, Human
caccauguuggccaggau

SEQ ID NO: 1188512 - RNA, 22 nt, Human
caccauguuggccaggaugguc

SEQ ID NO: 1188513 - RNA, 24 nt, Human
caccauguuggccaggauggucuc

SEQ ID NO: 1188514 - RNA, 19 nt, Human
caccccacccaaccucugc

SEQ ID NO: 1188515 - RNA, 22 nt, Human
caccccacccaaccucugcacc

SEQ ID NO: 1188516 - RNA, 22 nt, Human
caccccaguucccagggcauga

SEQ ID NO: 1188517 - RNA, 24 nt, Human
caccccccaccaccauacccugcu

SEQ ID NO: 1188518 - RNA, 23 nt, Human
cacccgccuuggccucccaaagu

SEQ ID NO: 1188519 - RNA, 24 nt, Human
cacccgccuuggccucccaaagug

SEQ ID NO: 1188520 - RNA, 25 nt, Human
caccucgggccaagacagguugagc

SEQ ID NO: 1188521 - RNA, 21 nt, Human
cacugcaaccuccgccuccca

SEQ ID NO: 1188522 - RNA, 18 nt, Human
cagaacucagggaaggga

SEQ ID NO: 1188523 - RNA, 22 nt, Human
cagagcccagcgcauccacugc

SEQ ID NO: 1188524 - RNA, 21 nt, Human
cagaggcuggaugugagcucc

SEQ ID NO: 1188525 - RNA, 21 nt, Human
cagcauccuacacacugcggc

SEQ ID NO: 1188526 - RNA, 21 nt, Human
cagccuccaagccucccacuc

SEQ ID NO: 1188527 - RNA, 21 nt, Human
caggagggaagcccaaccaca

SEQ ID NO: 1188528 - RNA, 24 nt, Human
caggcccaagcuggaaaccggaag

SEQ ID NO: 1188529 - RNA, 24 nt, Human
caggguuucaccauguuggccagg

SEQ ID NO: 1188530 - RNA, 18 nt, Human
caugagaucccaucuugg

SEQ ID NO: 1188531 - RNA, 23 nt, Human
cauugcugcaggcaagaggcaga

SEQ ID NO: 1188532 - RNA, 20 nt, Human
cauuuugccaccccccauuc

SEQ ID NO: 1188533 - RNA, 21 nt, Human
cauuuugccaccccccauucc

SEQ ID NO: 1188534 - RNA, 25 nt, Human
ccaaaccauuuccucacuugugccc

SEQ ID NO: 1188535 - RNA, 22 nt, Human
ccaaagugcugggauuacaggc

SEQ ID NO: 1188536 - RNA, 22 nt, Human
ccaaagugcugggauuacaggc

SEQ ID NO: 1188537 - RNA, 24 nt, Human
ccaaagugcugggauuacaggcgu

SEQ ID NO: 1188538 - RNA, 18 nt, Human
ccaauccccaggcccaag

SEQ ID NO: 1188539 - RNA, 20 nt, Human
ccacaaugucaugugaucag

SEQ ID NO: 1188540 - RNA, 26 nt, Human
ccacccgaaaaguggagaauggccgc

SEQ ID NO: 1188541 - RNA, 19 nt, Human
ccaccuccagaacgaagcc

SEQ ID NO: 1188542 - RNA, 23 nt, Human
ccaccuccagaacgaagcccagc

SEQ ID NO: 1188543 - RNA, 25 nt, Human
ccagcgcauccacugcgcaucccca

SEQ ID NO: 1188544 - RNA, 20 nt, Human
cccaaaaaggacacccccca

SEQ ID NO: 1188545 - RNA, 21 nt, Human
cccaaaaaggacaccccccac

SEQ ID NO: 1188546 - RNA, 22 nt, Human
cccaaaaaggacaccccccacc

SEQ ID NO: 1188547 - RNA, 21 nt, Human
cccaagcuggaaaccggaagc

SEQ ID NO: 1188548 - RNA, 20 nt, Human
cccacagccuccaagccucc

SEQ ID NO: 1188549 - RNA, 24 nt, Human
cccaccaccauacccugcucuguc

SEQ ID NO: 1188550 - RNA, 22 nt, Human
cccacccaaccucugcaccugc

SEQ ID NO: 1188551 - RNA, 19 nt, Human
cccaccuccagaacgaagc

SEQ ID NO: 1188552 - RNA, 24 nt, Human
cccacuccauccaaauggaaccca

SEQ ID NO: 1188553 - RNA, 21 nt, Human
cccauaggcaacucagacuca

SEQ ID NO: 1188554 - RNA, 25 nt, Human
cccaucuccaccauuuccagcaucc

SEQ ID NO: 1188555 - RNA, 24 nt, Human
cccauuguuaggugcccggcugcu

SEQ ID NO: 1188556 - RNA, 20 nt, Human
ccccaaaaaggacacccccc

SEQ ID NO: 1188557 - RNA, 23 nt, Human
ccccaaaaaggacaccccccacc

SEQ ID NO: 1188558 - RNA, 23 nt, Human
ccccaacccuccugucauuacuc

SEQ ID NO: 1188559 - RNA, 23 nt, Human
ccccaccaccauacccugcucug

SEQ ID NO: 1188560 - RNA, 21 nt, Human
ccccauuaaacugcaacccuc

SEQ ID NO: 1188561 - RNA, 27 nt, Human
ccccauucucccccuggggcaccccag

SEQ ID NO: 1188562 - RNA, 25 nt, Human
cccccauuaaacugcaacccucaaa

SEQ ID NO: 1188563 - RNA, 27 nt, Human
ccccccaccaccauacccugcucuguc

SEQ ID NO: 1188564 - RNA, 18 nt, Human
ccccgagccccacagccu

SEQ ID NO: 1188565 - RNA, 19 nt, Human
ccccgagccccacagccuc

SEQ ID NO: 1188566 - RNA, 25 nt, Human
ccccgagccccacagccuccaagga

SEQ ID NO: 1188567 - RNA, 24 nt, Human
ccccgcucucgucuccacgcccag

SEQ ID NO: 1188568 - RNA, 19 nt, Human
ccccuggggcaccccaguu

SEQ ID NO: 1188569 - RNA, 23 nt, Human
cccgaguagcugggacuacaggu

SEQ ID NO: 1188570 - RNA, 24 nt, Human
cccgaguagcugggacuacaggug

SEQ ID NO: 1188571 - RNA, 23 nt, Human
cccgccucaaccucccgaguagc

SEQ ID NO: 1188572 - RNA, 25 nt, Human
cccuaccccgagccccacagccucc

SEQ ID NO: 1188573 - RNA, 18 nt, Human
cccucacccacuccaucc

SEQ ID NO: 1188574 - RNA, 21 nt, Human
cccuggagcccuuggagcccu

SEQ ID NO: 1188575 - RNA, 27 nt, Human
cccuuaacagccuucaaucuauaacaa

SEQ ID NO: 1188576 - RNA, 20 nt, Human
ccgcuucugagcuccagacc

SEQ ID NO: 1188577 - RNA, 18 nt, Human
ccgugccugaaaaucccu

SEQ ID NO: 1188578 - RNA, 19 nt, Human
ccuaccuugugccaugccc

SEQ ID NO: 1188579 - RNA, 22 nt, Human
ccuccagaacgaagcccagccu

SEQ ID NO: 1188580 - RNA, 24 nt, Human
ccucccagguucaagcaguucucc

SEQ ID NO: 1188581 - RNA, 23 nt, Human
ccuccugucauuacuccacaauc

SEQ ID NO: 1188582 - RNA, 22 nt, Human
ccucugggaagccuccuggccu

SEQ ID NO: 1188583 - RNA, 21 nt, Human
ccuggccuuggcccagaggcc

SEQ ID NO: 1188584 - RNA, 22 nt, Human
ccuucccccgugccugaaaauc

SEQ ID NO: 1188585 - RNA, 18 nt, Human
ccuuccuucccccgugcc

SEQ ID NO: 1188586 - RNA, 25 nt, Human
ccuugugccaugcccccaacccucc

SEQ ID NO: 1188587 - RNA, 19 nt, Human
cgccacaaugucaugugau

SEQ ID NO: 1188588 - RNA, 23 nt, Human
cucaagaucacacacauuuugcc

SEQ ID NO: 1188589 - RNA, 19 nt, Human
cucaccucaccgugucccc

SEQ ID NO: 1188590 - RNA, 24 nt, Human
cucacugcaaccuccgccucccag

SEQ ID NO: 1188591 - RNA, 20 nt, Human
cuccaagccucccacucugc

SEQ ID NO: 1188592 - RNA, 22 nt, Human
cuccaauccccaggcccaagcu

SEQ ID NO: 1188593 - RNA, 22 nt, Human
cucccacccccaaaaaggacac

SEQ ID NO: 1188594 - RNA, 19 nt, Human
cuccccuaccccgagcccc

SEQ ID NO: 1188595 - RNA, 23 nt, Human
cuccccuaccccgagccccacag

SEQ ID NO: 1188596 - RNA, 20 nt, Human
cuccuggccuuggcccagag

SEQ ID NO: 1188597 - RNA, 21 nt, Human
cucugcuuagaagugcucuag

SEQ ID NO: 1188598 - RNA, 24 nt, Human
cucuugaccucgugauccacccgc

SEQ ID NO: 1188599 - RNA, 23 nt, Human
cugcaaccuccgccucccagguu

SEQ ID NO: 1188600 - RNA, 24 nt, Human
cugcaaccuccgccucccagguuc

SEQ ID NO: 1188601 - RNA, 19 nt, Human
cugcuccugggucaucacu

SEQ ID NO: 1188602 - RNA, 21 nt, Human
cuguaucuguacuggccuggg

SEQ ID NO: 1188603 - RNA, 18 nt, Human
cuugggcuaagacauagc

SEQ ID NO: 1188604 - RNA, 19 nt, Human
gaaaaucccucauucuguc

SEQ ID NO: 1188605 - RNA, 18 nt, Human
gaaacccugucuuccgcu

SEQ ID NO: 1188606 - RNA, 19 nt, Human
gaacauauacagaacauaa

SEQ ID NO: 1188607 - RNA, 20 nt, Human
gaacccaggagggaagccca

SEQ ID NO: 1188608 - RNA, 21 nt, Human
gaagcccagccuccucugccc

SEQ ID NO: 1188609 - RNA, 21 nt, Human
gaccucgugauccacccgccu

SEQ ID NO: 1188610 - RNA, 21 nt, Human
gaccucgugauccacccgccu

SEQ ID NO: 1188611 - RNA, 24 nt, Human
gaccucgugauccacccgccuugg

SEQ ID NO: 1188612 - RNA, 24 nt, Human
gagccccacagccuccaagccucc

SEQ ID NO: 1188613 - RNA, 22 nt, Human
gagggugggggaucuccaaggg

SEQ ID NO: 1188614 - RNA, 26 nt, Human
gaguagcugggacuacaggugugugc

SEQ ID NO: 1188615 - RNA, 20 nt, Human
gagugauuccugccuggccc

SEQ ID NO: 1188616 - RNA, 21 nt, Human
gauccuggccccucaccccac

SEQ ID NO: 1188617 - RNA, 21 nt, Human
gauuacaggcgugaaccacca

SEQ ID NO: 1188618 - RNA, 23 nt, Human
gcacccagaaguggugccaccac

SEQ ID NO: 1188619 - RNA, 23 nt, Human
gccucaaccucccgaguagcugg

SEQ ID NO: 1188620 - RNA, 18 nt, Human
gccuccucugcccauccc

SEQ ID NO: 1188621 - RNA, 22 nt, Human
gccuuggccucccaaagugcug

SEQ ID NO: 1188622 - RNA, 24 nt, Human
gcucaagaucacacacauuuugcc

SEQ ID NO: 1188623 - RNA, 19 nt, Human
gcucagcaggacccuccug

SEQ ID NO: 1188624 - RNA, 21 nt, Human
ggaaggaacuaaugaaaaaaa

SEQ ID NO: 1188625 - RNA, 21 nt, Human
ggacaccccccaccaccauac

SEQ ID NO: 1188626 - RNA, 19 nt, Human
ggagccaaugaagaccagg

SEQ ID NO: 1188627 - RNA, 19 nt, Human
ggauuacaggcgugaacca

SEQ ID NO: 1188628 - RNA, 19 nt, Human
ggcaccccaguucccaggg

SEQ ID NO: 1188629 - RNA, 23 nt, Human
ggcccaagcuggaaaccggaagc

SEQ ID NO: 1188630 - RNA, 19 nt, Human
ggccccucaccccacccaa

SEQ ID NO: 1188631 - RNA, 20 nt, Human
ggccccucaccccacccaac

SEQ ID NO: 1188632 - RNA, 18 nt, Human
gggaagcccaaccacagg

SEQ ID NO: 1188633 - RNA, 25 nt, Human
gggccaagacagguugagcagagga

SEQ ID NO: 1188634 - RNA, 19 nt, Human
gggcccuggucagccucag

SEQ ID NO: 1188635 - RNA, 22 nt, Human
gggcugaugcccaggacagcac

SEQ ID NO: 1188636 - RNA, 23 nt, Human
ggggcucagcaggacccuccugu

SEQ ID NO: 1188637 - RNA, 22 nt, Human
ggguuucaccauguuggccagg

SEQ ID NO: 1188638 - RNA, 24 nt, Human
gguuucaccauguuggccaggaug

SEQ ID NO: 1188639 - RNA, 21 nt, Human
guaaagugcagcucccacccc

SEQ ID NO: 1188640 - RNA, 24 nt, Human
gugauccacccgccuuggccuccc

SEQ ID NO: 1188641 - RNA, 25 nt, Human
uaaaaaauucugaucuacauucuug

SEQ ID NO: 1188642 - RNA, 23 nt, Human
uaaagcacagaacauauacagaa

SEQ ID NO: 1188643 - RNA, 25 nt, Human
uaagaacccaggagggaagcccaac

SEQ ID NO: 1188644 - RNA, 19 nt, Human
uaagaagaccaaggcccag

SEQ ID NO: 1188645 - RNA, 22 nt, Human
uaagaagaccaaggcccagaag

SEQ ID NO: 1188646 - RNA, 20 nt, Human
uaauuuuugcuauuguagag

SEQ ID NO: 1188647 - RNA, 24 nt, Human
uaauuuuuguauuuuuaguagaga

SEQ ID NO: 1188648 - RNA, 23 nt, Human
uacaggcgugaaccaccacgccc

SEQ ID NO: 1188649 - RNA, 21 nt, Human
uaccccaggaaacacccccaa

SEQ ID NO: 1188650 - RNA, 18 nt, Human
uaccccgagccccacagc

SEQ ID NO: 1188651 - RNA, 22 nt, Human
uagagacaggguuucaccaugu

SEQ ID NO: 1188652 - RNA, 27 nt, Human
uagaugaugccaccuagauaggcaccc

SEQ ID NO: 1188653 - RNA, 18 nt, Human
uaggugcccggcugcugc

SEQ ID NO: 1188654 - RNA, 24 nt, Human
uaguagagacaggguuucaccaug

SEQ ID NO: 1188655 - RNA, 27 nt, Human
uauacagaacauaaacagauauauagu

SEQ ID NO: 1188656 - RNA, 27 nt, Human
ucaauccccgcucucgucuccacgcug

SEQ ID NO: 1188657 - RNA, 24 nt, Human
ucaccauguuggccaggauggucu

SEQ ID NO: 1188658 - RNA, 18 nt, Human
ucacccacuccauccaaa

SEQ ID NO: 1188659 - RNA, 19 nt, Human
ucacugcaaccuccgccuc

SEQ ID NO: 1188660 - RNA, 24 nt, Human
ucacugcaaccuccgccucccagg

SEQ ID NO: 1188661 - RNA, 25 nt, Human
ucacugcaaccuccgccucccaggu

SEQ ID NO: 1188662 - RNA, 27 nt, Human
ucacugcaaccuccgccucccagguuc

SEQ ID NO: 1188663 - RNA, 24 nt, Human
ucaggauccccucaaaguauuucc

SEQ ID NO: 1188664 - RNA, 19 nt, Human
ucaggggcucccgugggau

SEQ ID NO: 1188665 - RNA, 23 nt, Human
uccaccauuuccagcauccuaca

SEQ ID NO: 1188666 - RNA, 22 nt, Human
uccaggcagggccugcacacag

SEQ ID NO: 1188667 - RNA, 21 nt, Human
uccagugucucuugaccaccu

SEQ ID NO: 1188668 - RNA, 24 nt, Human
ucccaaagugcugggauuacaggc

SEQ ID NO: 1188669 - RNA, 20 nt, Human
ucccacucugcacucaccuu

SEQ ID NO: 1188670 - RNA, 19 nt, Human
ucccagggcaugaaagacu

SEQ ID NO: 1188671 - RNA, 21 nt, Human
ucccagguucaagcaguucuc

SEQ ID NO: 1188672 - RNA, 24 nt, Human
ucccagguucaagcaguucucccg

SEQ ID NO: 1188673 - RNA, 18 nt, Human
uccccaggcccaagcugg

SEQ ID NO: 1188674 - RNA, 21 nt, Human
uccccaggcccaagcuggaaa

SEQ ID NO: 1188675 - RNA, 24 nt, Human
uccccaggcccaagcuggaaaccg

SEQ ID NO: 1188676 - RNA, 22 nt, Human
uccccaggcuaccugggggcuc

SEQ ID NO: 1188677 - RNA, 19 nt, Human
uccccauucucccccuggg

SEQ ID NO: 1188678 - RNA, 23 nt, Human
ucccgaguagcugggacuacagg

SEQ ID NO: 1188679 - RNA, 24 nt, Human
ucccgaguagcugggacuacaggu

SEQ ID NO: 1188680 - RNA, 23 nt, Human
uccuggccccucaccccacccaa

SEQ ID NO: 1188681 - RNA, 21 nt, Human
ucgaccacugaccucauucag

SEQ ID NO: 1188682 - RNA, 23 nt, Human
ucuagcucugucgccaggcugga

SEQ ID NO: 1188683 - RNA, 23 nt, Human
ucuccaaaccauuuccucacuug

SEQ ID NO: 1188684 - RNA, 24 nt, Human
ucucccgccucaaccucccgagua

SEQ ID NO: 1188685 - RNA, 19 nt, Human
ucugacuccucccucuccc

SEQ ID NO: 1188686 - RNA, 22 nt, Human
ucugcaccugcuucccuggagc

SEQ ID NO: 1188687 - RNA, 19 nt, Human
ucugggaagccuccuggcc

SEQ ID NO: 1188688 - RNA, 23 nt, Human
ucuguaucuguacuggccugggg

SEQ ID NO: 1188689 - RNA, 21 nt, Human
ucugucgccaggcuggaaugc

SEQ ID NO: 1188690 - RNA, 24 nt, Human
ucugucuccuccucugggaagccu

SEQ ID NO: 1188691 - RNA, 25 nt, Human
ugaaaaucccucauucugucguucu

SEQ ID NO: 1188692 - RNA, 18 nt, Human
ugaccucgugauccaccc

SEQ ID NO: 1188693 - RNA, 23 nt, Human
ugacuccucccucucccucaccc

SEQ ID NO: 1188694 - RNA, 22 nt, Human
ugacuucacgaaacccugucuu

SEQ ID NO: 1188695 - RNA, 20 nt, Human
ugagccagaaaugauucuca

SEQ ID NO: 1188696 - RNA, 20 nt, Human
ugauguaacuuaucuuccuc

SEQ ID NO: 1188697 - RNA, 22 nt, Human
ugcagugaugcaaucuuggcuc

SEQ ID NO: 1188698 - RNA, 26 nt, Human
ugccucaccucuacaccuugggcuaa

SEQ ID NO: 1188699 - RNA, 22 nt, Human
ugccuggccccagggucagugg

SEQ ID NO: 1188700 - RNA, 19 nt, Human
ugccuucugagccccaggc

SEQ ID NO: 1188701 - RNA, 23 nt, Human
ugcugggauuacaggcgugaacc

SEQ ID NO: 1188702 - RNA, 24 nt, Human
uggaaugcagugaugcaaucuugg

SEQ ID NO: 1188703 - RNA, 19 nt, Human
uggagccaaugaagaccag

SEQ ID NO: 1188704 - RNA, 19 nt, Human
uggauccuggccccucacc

SEQ ID NO: 1188705 - RNA, 22 nt, Human
uggccaggauggucucgaucuc

SEQ ID NO: 1188706 - RNA, 24 nt, Human
uggccccucaccccacccaaccuc

SEQ ID NO: 1188707 - RNA, 21 nt, Human
ugggacuacaggugugugcca

SEQ ID NO: 1188708 - RNA, 22 nt, Human
ugggacuacaggugugugccac

SEQ ID NO: 1188709 - RNA, 19 nt, Human
ugggauuacaggcgugaac

SEQ ID NO: 1188710 - RNA, 22 nt, Human
ugggauuacaggcgugaaccac

SEQ ID NO: 1188711 - RNA, 23 nt, Human
ugggauuacaggcgugaaccacc

SEQ ID NO: 1188712 - RNA, 24 nt, Human
ugggauuacaggcgugaaccacca

SEQ ID NO: 1188713 - RNA, 24 nt, Human
ugggauuacaggcgugaaccacca

SEQ ID NO: 1188714 - RNA, 23 nt, Human
uguccacccgaaaaguggagaau

SEQ ID NO: 1188715 - RNA, 22 nt, Human
ugucguucuuucaucucacccu

SEQ ID NO: 1188716 - RNA, 22 nt, Human
ugugccaugcccccaacccucc

SEQ ID NO: 1188717 - RNA, 18 nt, Human
uguggauggacauuuggg

SEQ ID NO: 1188718 - RNA, 19 nt, Human
uuaauauucacagcaacac

SEQ ID NO: 1188719 - RNA, 19 nt, Human
uuaauauucacagcaacac

SEQ ID NO: 1188720 - RNA, 24 nt, Human
uuaguagagacaggguuucaccau

SEQ ID NO: 1188721 - RNA, 22 nt, Human
uuccaagucccauaggcaacuc

SEQ ID NO: 1188722 - RNA, 18 nt, Human
uuccucuccaaaccauuu

SEQ ID NO: 1188723 - RNA, 20 nt, Human
uucuaaaccucaccucaccg

SEQ ID NO: 1188724 - RNA, 23 nt, Human
uucugacuccucccucucccuca

SEQ ID NO: 1188725 - RNA, 18 nt, Human
uuggccucccaaagugcu

SEQ ID NO: 1188726 - RNA, 24 nt, Human
uuuacaaauaagaagaccaaggcc

SEQ ID NO: 1188727 - RNA, 19 nt, Human
uuucaccauguuggccagg

SEQ ID NO: 1188728 - RNA, 20 nt, Human
uuucaccauguuggccagga

SEQ ID NO: 1188729 - RNA, 18 nt, Human
uuuccuauuccuucaugu

SEQ ID NO: 1188730 - RNA, 24 nt, Human
uuuuuaguagagacaggguuucac

SEQ ID NO: 1188731 - RNA, 20 nt, Human
uuuuuguauuuuuaguagag

SEQ ID NO: 1188732 - RNA, 27 nt, Human
ugccuucagucuuuaagaacucagcuc

SEQ ID NO: 1188733 - RNA, 24 nt, Human
aagcaaauaacauccaaugucaga

SEQ ID NO: 1188734 - RNA, 21 nt, Human
cagggacccacacggccucca

SEQ ID NO: 1188735 - RNA, 24 nt, Human
ccuccaaucucugcacggcuuugc

SEQ ID NO: 1188736 - RNA, 25 nt, Human
cucugagaguauauauaaaaaagaa

SEQ ID NO: 1188737 - RNA, 19 nt, Human
cuuuaaaaauuaagaggaa

SEQ ID NO: 1188738 - RNA, 18 nt, Human
uaaaaaagaaauuaaagg

SEQ ID NO: 1188739 - RNA, 19 nt, Human
uaagcaaauaacauccaau

SEQ ID NO: 1188740 - RNA, 21 nt, Human
ucaccagcaucuuuaaaaauu

SEQ ID NO: 1188741 - RNA, 23 nt, Human
ugagaguauauauaaaaaagaaa

SEQ ID NO: 1188742 - RNA, 24 nt, Human
uuugcgcgcggugcucagccuggg

SEQ ID NO: 1188743 - RNA, 22 nt, Human
aaaaauuccuaaaauaugacac

SEQ ID NO: 1188744 - RNA, 21 nt, Human
aaaacaacacgagugagccau

SEQ ID NO: 1188745 - RNA, 19 nt, Human
aaaagacuucuucgccccc

SEQ ID NO: 1188746 - RNA, 21 nt, Human
aacaaauccaaaauuggcuca

SEQ ID NO: 1188747 - RNA, 18 nt, Human
aacuaaaggacuaagcaa

SEQ ID NO: 1188748 - RNA, 25 nt, Human
aacuaaaggacuaagcaagguccag

SEQ ID NO: 1188749 - RNA, 20 nt, Human
aagaaaauguggugacacac

SEQ ID NO: 1188750 - RNA, 18 nt, Human
acacagggcacaguggac

SEQ ID NO: 1188751 - RNA, 24 nt, Human
agaaaggucucuucaacccaugaa

SEQ ID NO: 1188752 - RNA, 21 nt, Human
agacuucuucgcccccuaauu

SEQ ID NO: 1188753 - RNA, 23 nt, Human
agauacacagggguuuugaauuu

SEQ ID NO: 1188754 - RNA, 20 nt, Human
agauuagaaaacuaggucuu

SEQ ID NO: 1188755 - RNA, 19 nt, Human
auaaaacugaaaaagaccu

SEQ ID NO: 1188756 - RNA, 21 nt, Human
augcauuuuugaaauacuucu

SEQ ID NO: 1188757 - RNA, 27 nt, Human
caaaagacuucuucgcccccuaauuca

SEQ ID NO: 1188758 - RNA, 18 nt, Human
caacacauacaugugggg

SEQ ID NO: 1188759 - RNA, 19 nt, Human
caacaucuuaaguguaaaa

SEQ ID NO: 1188760 - RNA, 25 nt, Human
caacucuauucgggcaugauaaaac

SEQ ID NO: 1188761 - RNA, 20 nt, Human
cacagugcuagagagauuag

SEQ ID NO: 1188762 - RNA, 21 nt, Human
caccaccuuuaaucaaaugaa

SEQ ID NO: 1188763 - RNA, 22 nt, Human
cacucuggaugccacaacacau

SEQ ID NO: 1188764 - RNA, 22 nt, Human
cagaaccaggaccauauggagu

SEQ ID NO: 1188765 - RNA, 19 nt, Human
cagcaggaaauuuacuucc

SEQ ID NO: 1188766 - RNA, 18 nt, Human
cagggcacaguggacucc

SEQ ID NO: 1188767 - RNA, 22 nt, Human
cagugcuagagagauuagaaaa

SEQ ID NO: 1188768 - RNA, 21 nt, Human
cuaagcaagguccagauuauc

SEQ ID NO: 1188769 - RNA, 22 nt, Human
cugaaguuuaacuacccaacaa

SEQ ID NO: 1188770 - RNA, 20 nt, Human
cuggaugccacaacacauac

SEQ ID NO: 1188771 - RNA, 24 nt, Human
cuguuuccauucuucuugaacuga

SEQ ID NO: 1188772 - RNA, 25 nt, Human
cuucaagauucccuuucagcaacuc

SEQ ID NO: 1188773 - RNA, 22 nt, Human
gaaaauguggugacacacaggg

SEQ ID NO: 1188774 - RNA, 19 nt, Human
gcagagauggugaaacugu

SEQ ID NO: 1188775 - RNA, 21 nt, Human
gcaucugcaagucuuucaaaa

SEQ ID NO: 1188776 - RNA, 23 nt, Human
gggcaaugaugaugauugaaaaa

SEQ ID NO: 1188777 - RNA, 26 nt, Human
ggguagcagaaccaggaccauaugga

SEQ ID NO: 1188778 - RNA, 21 nt, Human
uaauaugaaauucuuuugggg

SEQ ID NO: 1188779 - RNA, 26 nt, Human
uacauagacucacaguuauaaaacug

SEQ ID NO: 1188780 - RNA, 21 nt, Human
uagaagaaaaauaauccaugu

SEQ ID NO: 1188781 - RNA, 18 nt, Human
uagcagaaccaggaccau

SEQ ID NO: 1188782 - RNA, 18 nt, Human
uagcagagauggugaaac

SEQ ID NO: 1188783 - RNA, 23 nt, Human
ucccuuuagauacacagggguug

SEQ ID NO: 1188784 - RNA, 26 nt, Human
ugaaaaauaaaacacuccaaguggga

SEQ ID NO: 1188785 - RNA, 22 nt, Human
ugaaauacuucuugugccucuu

SEQ ID NO: 1188786 - RNA, 22 nt, Human
ugaaguacauuauaucgauccg

SEQ ID NO: 1188787 - RNA, 21 nt, Human
ugccauuccauaggaaaaaaa

SEQ ID NO: 1188788 - RNA, 23 nt, Human
ugccucuucaagauucccuuuca

SEQ ID NO: 1188789 - RNA, 19 nt, Human
ugcuggaggaagggugcca

SEQ ID NO: 1188790 - RNA, 25 nt, Human
uggaugccacaacacauacaugugg

SEQ ID NO: 1188791 - RNA, 24 nt, Human
uggcucaacuuguaagcuauuugc

SEQ ID NO: 1188792 - RNA, 18 nt, Human
uuagacuauugcaucugc

SEQ ID NO: 1188793 - RNA, 24 nt, Human
uucaagauucccuuucagcaacuc

SEQ ID NO: 1188794 - RNA, 23 nt, Human
uucacaagaucauuuuuccacuu

SEQ ID NO: 1188795 - RNA, 19 nt, Human
uucacagaagaaaaugugg

SEQ ID NO: 1188796 - RNA, 19 nt, Human
uucgcccccuaauucaaau

SEQ ID NO: 1188797 - RNA, 30 nt, Human
uugaaaaauaaaacacuccaagugggaauu

SEQ ID NO: 1188798 - RNA, 30 nt, Human
uugaaaauaaauaccuaauacauagacucc

SEQ ID NO: 1188799 - RNA, 18 nt, Human
uugaaagucaucuguucu

SEQ ID NO: 1188800 - RNA, 23 nt, Human
uuuauuuaucuucugaaauuuaa

SEQ ID NO: 1188801 - RNA, 24 nt, Human
acaacacagcgccagcuucccagc

SEQ ID NO: 1188802 - RNA, 23 nt, Human
agcccgggaggaagcgagcagcu

SEQ ID NO: 1188803 - RNA, 23 nt, Human
agcuggcgggggaaacaacacag

SEQ ID NO: 1188804 - RNA, 24 nt, Human
auuuccauuucaaacaagugaaag

SEQ ID NO: 1188805 - RNA, 23 nt, Human
caagugaaagcaguuugcacucc

SEQ ID NO: 1188806 - RNA, 21 nt, Human
cagcaagccuccgcggggccu

SEQ ID NO: 1188807 - RNA, 20 nt, Human
ccugguccuggcuggugcgc

SEQ ID NO: 1188808 - RNA, 23 nt, Human
cgggaggaagcgagcagcuggcg

SEQ ID NO: 1188809 - RNA, 23 nt, Human
cggggccugguccuggcuggugc

SEQ ID NO: 1188810 - RNA, 19 nt, Human
cucucguggccacuuuugu

SEQ ID NO: 1188811 - RNA, 18 nt, Human
gagcccgggaggaagcga

SEQ ID NO: 1188812 - RNA, 18 nt, Human
gaggcggacgauggugaa

SEQ ID NO: 1188813 - RNA, 21 nt, Human
gcgccagcuucccagcaagcc

SEQ ID NO: 1188814 - RNA, 21 nt, Human
gcggggccugguccuggcugg

SEQ ID NO: 1188815 - RNA, 18 nt, Human
ggggcugguccggggcug

SEQ ID NO: 1188816 - RNA, 18 nt, Human
uccucguggcaccuccag

SEQ ID NO: 1188817 - RNA, 20 nt, Human
ugcacuccagugagcccggg

SEQ ID NO: 1188818 - RNA, 21 nt, Human
ugcgcggguguggcccggggg

SEQ ID NO: 1188819 - RNA, 19 nt, Human
ugcugggcuccgccugagc

SEQ ID NO: 1188820 - RNA, 20 nt, Human
ugguccggggcugucucuug

SEQ ID NO: 1188821 - RNA, 24 nt, Human
ugguccuggcuggugcgcgggugu

SEQ ID NO: 1188822 - RNA, 25 nt, Human
uuccaagucaguuugcuccauccac

SEQ ID NO: 1188823 - RNA, 23 nt, Human
uuucugaggcggacgauggugaa

SEQ ID NO: 1188824 - RNA, 18 nt, Human
cgggauccugagcccugc

SEQ ID NO: 1188825 - RNA, 20 nt, Human
ggcgggcucucaggccaggu

SEQ ID NO: 1188826 - RNA, 19 nt, Human
gggcagggccuggcgggcu

SEQ ID NO: 1188827 - RNA, 19 nt, Human
uggcugcagagggccacug

SEQ ID NO: 1188828 - RNA, 26 nt, Human
aaaaaaaaaacaaacccaaaacaaaa

SEQ ID NO: 1188829 - RNA, 22 nt, Human
aaaaaaaacaaacccaaaacaa

SEQ ID NO: 1188830 - RNA, 30 nt, Human
aaaaaaacaaacccaaaacaaaaaccaagg

SEQ ID NO: 1188831 - RNA, 23 nt, Human
aaaaacaaacccaaaacaaaaac

SEQ ID NO: 1188832 - RNA, 25 nt, Human
aaaacaaaaaccaaaccaaagccag

SEQ ID NO: 1188833 - RNA, 21 nt, Human
aaaacaaacccaaaacaaaaa

SEQ ID NO: 1188834 - RNA, 19 nt, Human
aaaaccaaaccaaagccag

SEQ ID NO: 1188835 - RNA, 23 nt, Human
aaacaaacccaaaacaaaaacca

SEQ ID NO: 1188836 - RNA, 24 nt, Human
aaacaaacccaaaacaaaaaccaa

SEQ ID NO: 1188837 - RNA, 20 nt, Human
aaacaugaauacaggcugac

SEQ ID NO: 1188838 - RNA, 18 nt, Human
aaauucuuuucagcagcu

SEQ ID NO: 1188839 - RNA, 18 nt, Human
aacaugaauacaggcuga

SEQ ID NO: 1188840 - RNA, 20 nt, Human
aacccaaaacaaaaaccaaa

SEQ ID NO: 1188841 - RNA, 23 nt, Human
aacccaaaacaaaaaccaaacca

SEQ ID NO: 1188842 - RNA, 20 nt, Human
aagaagggagacacagaaaa

SEQ ID NO: 1188843 - RNA, 21 nt, Human
aagccuccuuucuuucugugg

SEQ ID NO: 1188844 - RNA, 21 nt, Human
aagggaaaaaaauucuuuuca

SEQ ID NO: 1188845 - RNA, 25 nt, Human
aauaauaaagccagcaaagaaggga

SEQ ID NO: 1188846 - RNA, 22 nt, Human
acaaacccaaaacaaaaaccaa

SEQ ID NO: 1188847 - RNA, 23 nt, Human
acagccccaaggaggggggaacc

SEQ ID NO: 1188848 - RNA, 20 nt, Human
accaaacgccagccugcucu

SEQ ID NO: 1188849 - RNA, 23 nt, Human
acccaaaacaaaaaccaaaccaa

SEQ ID NO: 1188850 - RNA, 19 nt, Human
accccuuuccugggaacgc

SEQ ID NO: 1188851 - RNA, 22 nt, Human
accuaccuucccacucccccaa

SEQ ID NO: 1188852 - RNA, 18 nt, Human
acucccccaaaggaaagc

SEQ ID NO: 1188853 - RNA, 24 nt, Human
agacaguuggcuggacagcugccu

SEQ ID NO: 1188854 - RNA, 18 nt, Human
agaggaagaagagggaga

SEQ ID NO: 1188855 - RNA, 20 nt, Human
agaggaagaagagggagagg

SEQ ID NO: 1188856 - RNA, 22 nt, Human
agagggugucagccugggccau

SEQ ID NO: 1188857 - RNA, 18 nt, Human
agaugaaaaaaaaaaaaa

SEQ ID NO: 1188858 - RNA, 23 nt, Human
aggagggagguggaaagggggac

SEQ ID NO: 1188859 - RNA, 20 nt, Human
agggagguggaaaggccaag

SEQ ID NO: 1188860 - RNA, 20 nt, Human
agguucauaaaauuaaggga

SEQ ID NO: 1188861 - RNA, 18 nt, Human
auguccaagaaaacauga

SEQ ID NO: 1188862 - RNA, 23 nt, Human
caaaacaaaaaccaaaccaaagc

SEQ ID NO: 1188863 - RNA, 26 nt, Human
caaaacaaaaaccaaaccaaagccag

SEQ ID NO: 1188864 - RNA, 25 nt, Human
caaaccaaagccaguaaccugaaug

SEQ ID NO: 1188865 - RNA, 24 nt, Human
caaggggcaccuguguuccaggac

SEQ ID NO: 1188866 - RNA, 23 nt, Human
caccuguguuccaggaccaaggg

SEQ ID NO: 1188867 - RNA, 19 nt, Human
cacucccucuggauggcuu

SEQ ID NO: 1188868 - RNA, 21 nt, Human
cagaaacagccgcuagugcug

SEQ ID NO: 1188869 - RNA, 20 nt, Human
cagcaaagaagggagacaca

SEQ ID NO: 1188870 - RNA, 22 nt, Human
cagcaguagguggcugguuuaa

SEQ ID NO: 1188871 - RNA, 21 nt, Human
cagcgucuggggagcuaccgg

SEQ ID NO: 1188872 - RNA, 21 nt, Human
caggccacagaggggccccgg

SEQ ID NO: 1188873 - RNA, 19 nt, Human
cauuauacagugugucaca

SEQ ID NO: 1188874 - RNA, 21 nt, Human
ccaaaccaaagccaguaaccc

SEQ ID NO: 1188875 - RNA, 22 nt, Human
ccaaacgccagccugcucugcu

SEQ ID NO: 1188876 - RNA, 25 nt, Human
ccaccuaccuucccacucccccaaa

SEQ ID NO: 1188877 - RNA, 23 nt, Human
cccaaaacaaaaaccaaaccaaa

SEQ ID NO: 1188878 - RNA, 26 nt, Human
cccaaaacaaaaaccaaaccaaagcc

SEQ ID NO: 1188879 - RNA, 23 nt, Human
cccacagccgcccugugaggaca

SEQ ID NO: 1188880 - RNA, 24 nt, Human
cccacucccccaaaggaaagcacg

SEQ ID NO: 1188881 - RNA, 21 nt, Human
ccccuacaaagccuccuuucu

SEQ ID NO: 1188882 - RNA, 21 nt, Human
cgcucaaggacagaguugcuc

SEQ ID NO: 1188883 - RNA, 19 nt, Human
cgcugugagccucucucca

SEQ ID NO: 1188884 - RNA, 24 nt, Human
cuccugcucacucucaggccacag

SEQ ID NO: 1188885 - RNA, 21 nt, Human
cuggucacuaaaggcggguca

SEQ ID NO: 1188886 - RNA, 24 nt, Human
cugugaggacagggccugccuccu

SEQ ID NO: 1188887 - RNA, 22 nt, Human
gaaaaaaaaaaaaaacaaaccc

SEQ ID NO: 1188888 - RNA, 20 nt, Human
gaaaaaaauucuuuucagca

SEQ ID NO: 1188889 - RNA, 20 nt, Human
gaaagcacgaaucguuccag

SEQ ID NO: 1188890 - RNA, 19 nt, Human
gagacacagaaacagccgc

SEQ ID NO: 1188891 - RNA, 22 nt, Human
gcagaugaaaaaaaaaaaaaac

SEQ ID NO: 1188892 - RNA, 23 nt, Human
gcaggagguugggccucccaggg

SEQ ID NO: 1188893 - RNA, 20 nt, Human
gcuccucugcuggccucugu

SEQ ID NO: 1188894 - RNA, 22 nt, Human
ggauguuuuaggaaaugccaaa

SEQ ID NO: 1188895 - RNA, 24 nt, Human
ggcaggagguugggccucccaggg

SEQ ID NO: 1188896 - RNA, 22 nt, Human
ggcugggccacguggacgugcc

SEQ ID NO: 1188897 - RNA, 24 nt, Human
ggcugggccacguggacgugccag

SEQ ID NO: 1188898 - RNA, 21 nt, Human
ggcugguuuaaggcuccuggc

SEQ ID NO: 1188899 - RNA, 22 nt, Human
gggagguggaaaggccaagggg

SEQ ID NO: 1188900 - RNA, 25 nt, Human
gggcugggccacguggacgugccag

SEQ ID NO: 1188901 - RNA, 21 nt, Human
gucacaauuagaggaagaaga

SEQ ID NO: 1188902 - RNA, 23 nt, Human
gucacaauuagaggaagaagagg

SEQ ID NO: 1188903 - RNA, 23 nt, Human
guuccagggugucccugccuucc

SEQ ID NO: 1188904 - RNA, 21 nt, Human
uaaaggcgggucaccaagggc

SEQ ID NO: 1188905 - RNA, 20 nt, Human
uaggaaaugccaaacaggca

SEQ ID NO: 1188906 - RNA, 24 nt, Human
uaugagggcugggccacguggacg

SEQ ID NO: 1188907 - RNA, 18 nt, Human
ucaaugauaucaccacuu

SEQ ID NO: 1188908 - RNA, 19 nt, Human
ucacauagauuuggaaugu

SEQ ID NO: 1188909 - RNA, 19 nt, Human
ucacuaaaggcgggucacc

SEQ ID NO: 1188910 - RNA, 21 nt, Human
ucccaccuaccuucccacucc

SEQ ID NO: 1188911 - RNA, 25 nt, Human
ucccaccuaccuucccacuccccca

SEQ ID NO: 1188912 - RNA, 18 nt, Human
ucccugagaggggcagga

SEQ ID NO: 1188913 - RNA, 18 nt, Human
ucccugagaggggcagga

SEQ ID NO: 1188914 - RNA, 22 nt, Human
ucucaggccacagaggggcccc

SEQ ID NO: 1188915 - RNA, 26 nt, Human
ugaaaaaaaaaaaaaacaaacccaaa

SEQ ID NO: 1188916 - RNA, 19 nt, Human
ugaccggacgccuugcggg

SEQ ID NO: 1188917 - RNA, 20 nt, Human
ugagaggggcaggagguugg

SEQ ID NO: 1188918 - RNA, 24 nt, Human
ugaucaccaauucuggaagggugg

SEQ ID NO: 1188919 - RNA, 24 nt, Human
ugccgguccuugccaggcccuugg

SEQ ID NO: 1188920 - RNA, 18 nt, Human
ugccugauucggccauga

SEQ ID NO: 1188921 - RNA, 21 nt, Human
ugcuucagguuucccuccugc

SEQ ID NO: 1188922 - RNA, 23 nt, Human
uggaaaggccaaggggcaccugu

SEQ ID NO: 1188923 - RNA, 20 nt, Human
uggcaggcgguggggcccuc

SEQ ID NO: 1188924 - RNA, 19 nt, Human
uggcagggaugcaaacagc

SEQ ID NO: 1188925 - RNA, 26 nt, Human
uggcuggacagcugccugauucggcc

SEQ ID NO: 1188926 - RNA, 21 nt, Human
uggcugguuuaaggcuccugg

SEQ ID NO: 1188927 - RNA, 21 nt, Human
ugucccugccuuccucccuca

SEQ ID NO: 1188928 - RNA, 19 nt, Human
uucccacucccccaaagga

SEQ ID NO: 1188929 - RNA, 18 nt, Human
uuccccaauuaauuggca

SEQ ID NO: 1188930 - RNA, 21 nt, Human
uucgcugaucaccaauucugg

SEQ ID NO: 1188931 - RNA, 24 nt, Human
uuggcagcagaugaaaaaaaaaaa

SEQ ID NO: 1188932 - RNA, 22 nt, Human
uuuucuuuucucucaaagaaau

SEQ ID NO: 1188933 - RNA, 27 nt, Human
aaaaaacacccaaaagacaaaaagaaa

SEQ ID NO: 1188934 - RNA, 22 nt, Human
aaaaacacccaaaagacaaaaa

SEQ ID NO: 1188935 - RNA, 19 nt, Human
aaaaagaaaaccaaagaaa

SEQ ID NO: 1188936 - RNA, 20 nt, Human
aaaaagaaaaccaaagaaau

SEQ ID NO: 1188937 - RNA, 26 nt, Human
aaaaagaaguaaauaagaacccaagu

SEQ ID NO: 1188938 - RNA, 23 nt, Human
aaaacacccaaaagacaaaaaga

SEQ ID NO: 1188939 - RNA, 24 nt, Human
aaaauacugugauuacaggcguga

SEQ ID NO: 1188940 - RNA, 19 nt, Human
aaacacccaaaagacaaaa

SEQ ID NO: 1188941 - RNA, 24 nt, Human
aaacacccaaaagacaaaaagaaa

SEQ ID NO: 1188942 - RNA, 20 nt, Human
aaagaaaaccaaagaaaucc

SEQ ID NO: 1188943 - RNA, 20 nt, Human
aaagacaaaaagaaaaccaa

SEQ ID NO: 1188944 - RNA, 19 nt, Human
aaccuauuuccuugccucu

SEQ ID NO: 1188945 - RNA, 22 nt, Human
aagacaaaaagaaaaccaaaga

SEQ ID NO: 1188946 - RNA, 21 nt, Human
aagcaggcucucugcugcugc

SEQ ID NO: 1188947 - RNA, 27 nt, Human
aagcaguaaaugaggcaaaggggaccc

SEQ ID NO: 1188948 - RNA, 24 nt, Human
aagcauuguuccaagaacugaaaa

SEQ ID NO: 1188949 - RNA, 25 nt, Human
aagugauccucccaccuuagccucu

SEQ ID NO: 1188950 - RNA, 25 nt, Human
aauagauucccugcugccacacaga

SEQ ID NO: 1188951 - RNA, 21 nt, Human
aauuaccuaguuguggguauu

SEQ ID NO: 1188952 - RNA, 22 nt, Human
acaaaaagaaaaccaaagaaau

SEQ ID NO: 1188953 - RNA, 28 nt, Human
acaaaaagaaaaccaaagaaaucccacu

SEQ ID NO: 1188954 - RNA, 23 nt, Human
acaauuuccagagaaaaaaauca

SEQ ID NO: 1188955 - RNA, 20 nt, Human
accaaaaaacacccaaaaga

SEQ ID NO: 1188956 - RNA, 23 nt, Human
accaaaaaacacccaaaagacaa

SEQ ID NO: 1188957 - RNA, 24 nt, Human
acucauucucucuccugccacccc

SEQ ID NO: 1188958 - RNA, 19 nt, Human
agaaggaggcaagucccau

SEQ ID NO: 1188959 - RNA, 20 nt, Human
agacaaaaagaaaaccaaag

SEQ ID NO: 1188960 - RNA, 28 nt, Human
agacaaaaagaaaaccaaagaaauccca

SEQ ID NO: 1188961 - RNA, 27 nt, Human
agacagacaauaaacgaaaagggaccc

SEQ ID NO: 1188962 - RNA, 19 nt, Human
aggaaguggcaacagggga

SEQ ID NO: 1188963 - RNA, 18 nt, Human
agggaugaaccacgggaa

SEQ ID NO: 1188964 - RNA, 19 nt, Human
aguaaaugaggcaaagucc

SEQ ID NO: 1188965 - RNA, 23 nt, Human
aguacaguggcaggaucauagcu

SEQ ID NO: 1188966 - RNA, 19 nt, Human
aguggaucugugagggggc

SEQ ID NO: 1188967 - RNA, 23 nt, Human
aguggcaacaggggaacgcuuug

SEQ ID NO: 1188968 - RNA, 24 nt, Human
auaaucacccucaucauuaucugg

SEQ ID NO: 1188969 - RNA, 18 nt, Human
auagcucacugcagccuc

SEQ ID NO: 1188970 - RNA, 24 nt, Human
aucugcacuugggagcuguguggu

SEQ ID NO: 1188971 - RNA, 25 nt, Human
caaaaagaaaaccaaagaaauccca

SEQ ID NO: 1188972 - RNA, 22 nt, Human
caaaagacaaaaagaaaaccaa

SEQ ID NO: 1188973 - RNA, 24 nt, Human
caaaauacugugauuacaggcgug

SEQ ID NO: 1188974 - RNA, 20 nt, Human
caagugauccucccaccuua

SEQ ID NO: 1188975 - RNA, 22 nt, Human
caagugauccucccaccuuagc

SEQ ID NO: 1188976 - RNA, 18 nt, Human
cacaggaagugcugaguu

SEQ ID NO: 1188977 - RNA, 20 nt, Human
cacucuccuaaccucccacu

SEQ ID NO: 1188978 - RNA, 23 nt, Human
cacugcuuugcacuaugcccaga

SEQ ID NO: 1188979 - RNA, 23 nt, Human
cagaacaaagauaugucuaccaa

SEQ ID NO: 1188980 - RNA, 24 nt, Human
cagaguuucuguguagcacucucc

SEQ ID NO: 1188981 - RNA, 21 nt, Human
cagcaugagaacagacuaaua

SEQ ID NO: 1188982 - RNA, 22 nt, Human
cagccucgaacuccuggccaca

SEQ ID NO: 1188983 - RNA, 26 nt, Human
caguaaaugaggcaaagucccuucuu

SEQ ID NO: 1188984 - RNA, 21 nt, Human
ccaaaaaacacccaaaagacu

SEQ ID NO: 1188985 - RNA, 21 nt, Human
ccaaagaaaucccacaauuca

SEQ ID NO: 1188986 - RNA, 20 nt, Human
ccaagcauuguuccaagaac

SEQ ID NO: 1188987 - RNA, 20 nt, Human
ccaccccgugaagaggugcc

SEQ ID NO: 1188988 - RNA, 22 nt, Human
cccaaaagacaaaaagaaaacc

SEQ ID NO: 1188989 - RNA, 19 nt, Human
cccaggcuggaguacagug

SEQ ID NO: 1188990 - RNA, 24 nt, Human
ccccgugaagaggugccuucugcc

SEQ ID NO: 1188991 - RNA, 25 nt, Human
ccccugaguaaaauguaagcuccug

SEQ ID NO: 1188992 - RNA, 23 nt, Human
cccugcugccacacagaucccug

SEQ ID NO: 1188993 - RNA, 25 nt, Human
ccucccaccuuagccucucaaaaua

SEQ ID NO: 1188994 - RNA, 24 nt, Human
ccuggccacaagugauccucccac

SEQ ID NO: 1188995 - RNA, 19 nt, Human
ccuguggacccagagcgcc

SEQ ID NO: 1188996 - RNA, 22 nt, Human
ccuguggacccagagcgccagg

SEQ ID NO: 1188997 - RNA, 20 nt, Human
ccuugugagucagugggaau

SEQ ID NO: 1188998 - RNA, 21 nt, Human
cucacugcagccucgaacucc

SEQ ID NO: 1188999 - RNA, 24 nt, Human
cucacugcagccucgaacuccugg

SEQ ID NO: 1189000 - RNA, 22 nt, Human
cucccaccuuagccucucaaaa

SEQ ID NO: 1189001 - RNA, 19 nt, Human
cuccugaagggcagaaacu

SEQ ID NO: 1189002 - RNA, 27 nt, Human
cucucugcugcugccucgcccugugac

SEQ ID NO: 1189003 - RNA, 24 nt, Human
cucucuguguugcccaggcuggag

SEQ ID NO: 1189004 - RNA, 20 nt, Human
cucuguguugcccaggcugg

SEQ ID NO: 1189005 - RNA, 23 nt, Human
cugccucgcccugugacuucagc

SEQ ID NO: 1189006 - RNA, 21 nt, Human
cugcuuugcacuaugcccaga

SEQ ID NO: 1189007 - RNA, 20 nt, Human
cuuggucgcucacaaauucu

SEQ ID NO: 1189008 - RNA, 22 nt, Human
gaaacacaccuguggacccaga

SEQ ID NO: 1189009 - RNA, 23 nt, Human
gaacuccuggccacaagugaucc

SEQ ID NO: 1189010 - RNA, 19 nt, Human
gaucauagcucacugcagc

SEQ ID NO: 1189011 - RNA, 21 nt, Human
gaucugugagggggcagaggg

SEQ ID NO: 1189012 - RNA, 21 nt, Human
gauuacaggcgugaguuacca

SEQ ID NO: 1189013 - RNA, 22 nt, Human
gauuacaggcgugaguuaccau

SEQ ID NO: 1189014 - RNA, 24 nt, Human
gauuacaggcgugaguuaccaugc

SEQ ID NO: 1189015 - RNA, 21 nt, Human
gcaguaaaugaggcaaagucc

SEQ ID NO: 1189016 - RNA, 18 nt, Human
gccucgaacuccuggccc

SEQ ID NO: 1189017 - RNA, 23 nt, Human
gcuggaguacaguggcaggauca

SEQ ID NO: 1189018 - RNA, 19 nt, Human
ggaguacaguggcaggauc

SEQ ID NO: 1189019 - RNA, 19 nt, Human
gggaaacacaccuguggac

SEQ ID NO: 1189020 - RNA, 18 nt, Human
gggaaucagauaaagacc

SEQ ID NO: 1189021 - RNA, 19 nt, Human
ggugacagagccugggcac

SEQ ID NO: 1189022 - RNA, 21 nt, Human
guaagcuccugaagggcagaa

SEQ ID NO: 1189023 - RNA, 24 nt, Human
guggacccagagcgccaggugaca

SEQ ID NO: 1189024 - RNA, 24 nt, Human
uaacagcagcaugagaacagacuu

SEQ ID NO: 1189025 - RNA, 23 nt, Human
uaacauaaaugcuaugaagagaa

SEQ ID NO: 1189026 - RNA, 22 nt, Human
uaaucacccucaucauuaucug

SEQ ID NO: 1189027 - RNA, 20 nt, Human
uaccaaaaaacacccaaaag

SEQ ID NO: 1189028 - RNA, 18 nt, Human
uagcaccuugugagucag

SEQ ID NO: 1189029 - RNA, 22 nt, Human
uagcaggugcucaacaaucauu

SEQ ID NO: 1189030 - RNA, 24 nt, Human
uagcucacugcagccucgaacucc

SEQ ID NO: 1189031 - RNA, 25 nt, Human
uauaaagugaagcccuugcuuuggc

SEQ ID NO: 1189032 - RNA, 24 nt, Human
ucaaaauacugugauuacaggcgu

SEQ ID NO: 1189033 - RNA, 23 nt, Human
ucacugcagccucgaacuccugg

SEQ ID NO: 1189034 - RNA, 24 nt, Human
ucacugcagccucgaacuccuggc

SEQ ID NO: 1189035 - RNA, 20 nt, Human
uccccacccaaaaucucauc

SEQ ID NO: 1189036 - RNA, 21 nt, Human
uccccauaauccccauguguc

SEQ ID NO: 1189037 - RNA, 20 nt, Human
ucccuaccuucagagacaga

SEQ ID NO: 1189038 - RNA, 22 nt, Human
ucuaccaaaaaacacccaaaag

SEQ ID NO: 1189039 - RNA, 24 nt, Human
ucucaaaauacugugauuacaggc

SEQ ID NO: 1189040 - RNA, 20 nt, Human
ucuccuaaccucccacugga

SEQ ID NO: 1189041 - RNA, 23 nt, Human
ucucucuguguugcccaggcugg

SEQ ID NO: 1189042 - RNA, 24 nt, Human
ucucucuguguugcccaggcugga

SEQ ID NO: 1189043 - RNA, 22 nt, Human
ucucugcugcugccucgcccug

SEQ ID NO: 1189044 - RNA, 20 nt, Human
ucucuguguugcccaggcug

SEQ ID NO: 1189045 - RNA, 23 nt, Human
ucucuguguugcccaggcuggag

SEQ ID NO: 1189046 - RNA, 24 nt, Human
ucucuguguugcccaggcuggagu

SEQ ID NO: 1189047 - RNA, 18 nt, Human
ucugaggccuccccagcc

SEQ ID NO: 1189048 - RNA, 21 nt, Human
ucugcugcugccucgcccugu

SEQ ID NO: 1189049 - RNA, 18 nt, Human
ucuguguugcccaggcug

SEQ ID NO: 1189050 - RNA, 22 nt, Human
ugaaaagcaguaaaugaggcaa

SEQ ID NO: 1189051 - RNA, 21 nt, Human
ugagaacagacuaauacagua

SEQ ID NO: 1189052 - RNA, 22 nt, Human
ugagggggcagaggggacacag

SEQ ID NO: 1189053 - RNA, 24 nt, Human
ugaggucucucuguguugcccagg

SEQ ID NO: 1189054 - RNA, 26 nt, Human
ugaggucucucuguguugcccaggcc

SEQ ID NO: 1189055 - RNA, 21 nt, Human
ugcccaggcuggaguacagug

SEQ ID NO: 1189056 - RNA, 24 nt, Human
ugcccaggcuggaguacaguggca

SEQ ID NO: 1189057 - RNA, 22 nt, Human
ugccucgcccugugacuucagc

SEQ ID NO: 1189058 - RNA, 18 nt, Human
ugccuggcgcauagcagg

SEQ ID NO: 1189059 - RNA, 22 nt, Human
ugcuuuggcucccuguaagcuc

SEQ ID NO: 1189060 - RNA, 19 nt, Human
uggcaacaggggaacgcuu

SEQ ID NO: 1189061 - RNA, 24 nt, Human
uggcaggaucauagcucacugcag

SEQ ID NO: 1189062 - RNA, 24 nt, Human
ugggagagaaggaggcaaguccca

SEQ ID NO: 1189063 - RNA, 21 nt, Human
ugggccaccugguguccccag

SEQ ID NO: 1189064 - RNA, 24 nt, Human
ugguguccccagccucagugggag

SEQ ID NO: 1189065 - RNA, 18 nt, Human
ugugauuacaggcgugag

SEQ ID NO: 1189066 - RNA, 23 nt, Human
ugugauuacaggcgugaguuacc

SEQ ID NO: 1189067 - RNA, 21 nt, Human
uguggugggaggaaguggcaa

SEQ ID NO: 1189068 - RNA, 21 nt, Human
ugugucaggggugugaccaag

SEQ ID NO: 1189069 - RNA, 18 nt, Human
uguguugcccaggcugga

SEQ ID NO: 1189070 - RNA, 24 nt, Human
uguguugcccaggcuggaguacag

SEQ ID NO: 1189071 - RNA, 23 nt, Human
uugcacucauucucucuccugcc

SEQ ID NO: 1189072 - RNA, 24 nt, Human
uugcccaggcuggaguacaguggc

SEQ ID NO: 1189073 - RNA, 24 nt, Human
uuucugaggccuccccagccaugc

SEQ ID NO: 1189074 - RNA, 22 nt, Human
uuuggcuguguccccacccaaa

SEQ ID NO: 1189075 - RNA, 19 nt, Human
aaaauccugaccaaaagcu

SEQ ID NO: 1189076 - RNA, 23 nt, Human
aacacaguuccuuagaacucaga

SEQ ID NO: 1189077 - RNA, 22 nt, Human
accaggcgccacguaucagacu

SEQ ID NO: 1189078 - RNA, 23 nt, Human
acccgggcugugauccucguugc

SEQ ID NO: 1189079 - RNA, 24 nt, Human
acccugagagggagcagagaaagg

SEQ ID NO: 1189080 - RNA, 22 nt, Human
accugggcagcagcugcagccc

SEQ ID NO: 1189081 - RNA, 25 nt, Human
accuuagcuccucugagcacccauc

SEQ ID NO: 1189082 - RNA, 20 nt, Human
accuucugcccauugugggc

SEQ ID NO: 1189083 - RNA, 24 nt, Human
agagaaaggccacugaggcccaga

SEQ ID NO: 1189084 - RNA, 21 nt, Human
aggcacagaguggggaggcuu

SEQ ID NO: 1189085 - RNA, 18 nt, Human
agggggagggggaggggc

SEQ ID NO: 1189086 - RNA, 22 nt, Human
agggggagggggaggggcggag

SEQ ID NO: 1189087 - RNA, 19 nt, Human
auggugcugucgcccuugg

SEQ ID NO: 1189088 - RNA, 23 nt, Human
caaggcagaaagugcucaguacc

SEQ ID NO: 1189089 - RNA, 18 nt, Human
cacacagucagaaguggc

SEQ ID NO: 1189090 - RNA, 23 nt, Human
caggagaugcuguuguuggccac

SEQ ID NO: 1189091 - RNA, 24 nt, Human
caggcaauggacccagauagcucc

SEQ ID NO: 1189092 - RNA, 23 nt, Human
ccacaguaaugccucugucccca

SEQ ID NO: 1189093 - RNA, 18 nt, Human
ccagagggggaaagaggg

SEQ ID NO: 1189094 - RNA, 24 nt, Human
ccaggacaaggcagaaagugcuca

SEQ ID NO: 1189095 - RNA, 22 nt, Human
cccagguacccucaucugaaca

SEQ ID NO: 1189096 - RNA, 20 nt, Human
ccgguugcaggagaugcugu

SEQ ID NO: 1189097 - RNA, 21 nt, Human
ccucugagcacccauccaggc

SEQ ID NO: 1189098 - RNA, 28 nt, Human
ccucugagcacccauccaggcuuggccc

SEQ ID NO: 1189099 - RNA, 21 nt, Human
cgaggacacggagauggggga

SEQ ID NO: 1189100 - RNA, 18 nt, Human
cucaaccuugaccccacu

SEQ ID NO: 1189101 - RNA, 24 nt, Human
cucaguacccugagagggagcaga

SEQ ID NO: 1189102 - RNA, 23 nt, Human
cuccacuuugcacugggccucaa

SEQ ID NO: 1189103 - RNA, 24 nt, Human
cuccucugagcacccauccaggcu

SEQ ID NO: 1189104 - RNA, 25 nt, Human
cucucuggggauggaguagagccuu

SEQ ID NO: 1189105 - RNA, 19 nt, Human
cugcauuugggagcucucu

SEQ ID NO: 1189106 - RNA, 23 nt, Human
cuggagguaccguguuuuggagg

SEQ ID NO: 1189107 - RNA, 26 nt, Human
cugggccucaaccuugaccccacuuu

SEQ ID NO: 1189108 - RNA, 25 nt, Human
cuuugcacugggccucaaccuugac

SEQ ID NO: 1189109 - RNA, 22 nt, Human
gagccaaggcacagagugggga

SEQ ID NO: 1189110 - RNA, 26 nt, Human
gcagagaaaggccacugaggcccaga

SEQ ID NO: 1189111 - RNA, 22 nt, Human
gcccacuuucuucuugcuaugg

SEQ ID NO: 1189112 - RNA, 22 nt, Human
ggcgaugccguaggcccggaac

SEQ ID NO: 1189113 - RNA, 22 nt, Human
ggcggcuggugugggcacgcuc

SEQ ID NO: 1189114 - RNA, 18 nt, Human
gggagcagagaaaggcca

SEQ ID NO: 1189115 - RNA, 18 nt, Human
gggaggcuugggaggguc

SEQ ID NO: 1189116 - RNA, 18 nt, Human
ggggaggcuugggagggu

SEQ ID NO: 1189117 - RNA, 18 nt, Human
gucuuacugguuuugccc

SEQ ID NO: 1189118 - RNA, 20 nt, Human
gugcucaguacccugagagg

SEQ ID NO: 1189119 - RNA, 19 nt, Human
guggagcugaaguguucug

SEQ ID NO: 1189120 - RNA, 19 nt, Human
guggagcugaaguguucug

SEQ ID NO: 1189121 - RNA, 19 nt, Human
guuugguguguguaaaaca

SEQ ID NO: 1189122 - RNA, 21 nt, Human
guuuuggaggcccgggaccca

SEQ ID NO: 1189123 - RNA, 19 nt, Human
uaaaacacaguuccuuaga

SEQ ID NO: 1189124 - RNA, 21 nt, Human
uagauaccauugccccggagc

SEQ ID NO: 1189125 - RNA, 22 nt, Human
uagugucggaccugggcagcag

SEQ ID NO: 1189126 - RNA, 20 nt, Human
ucccugaaaaacauugccca

SEQ ID NO: 1189127 - RNA, 24 nt, Human
uccucugagcacccauccaggcuu

SEQ ID NO: 1189128 - RNA, 20 nt, Human
uccugagaagagucuggguu

SEQ ID NO: 1189129 - RNA, 18 nt, Human
ucgagggggagggggagg

SEQ ID NO: 1189130 - RNA, 22 nt, Human
ugagaagagucuggguuuggug

SEQ ID NO: 1189131 - RNA, 18 nt, Human
ugcacugggccucaaccu

SEQ ID NO: 1189132 - RNA, 23 nt, Human
ugccccggagcuccacuuugcac

SEQ ID NO: 1189133 - RNA, 22 nt, Human
ugccgguugcaggagaugcugu

SEQ ID NO: 1189134 - RNA, 23 nt, Human
ugccguaggcccggaacgagugg

SEQ ID NO: 1189135 - RNA, 19 nt, Human
ugcucaggaggggcggcug

SEQ ID NO: 1189136 - RNA, 21 nt, Human
ugcugugguaaccaccuucca

SEQ ID NO: 1189137 - RNA, 19 nt, Human
uggcacggccccgcacggc

SEQ ID NO: 1189138 - RNA, 19 nt, Human
ugggcuguggagcugaagu

SEQ ID NO: 1189139 - RNA, 18 nt, Human
uuccugagaagagucugg

SEQ ID NO: 1189140 - RNA, 21 nt, Human
uucugcauuugggagcucucu

SEQ ID NO: 1189141 - RNA, 19 nt, Human
uugcaugaugcauucucgg

SEQ ID NO: 1189142 - RNA, 19 nt, Human
uuggcccugaagcaggucu

SEQ ID NO: 1189143 - RNA, 23 nt, Human
aaaccaagagggcauuuccacag

SEQ ID NO: 1189144 - RNA, 20 nt, Human
aaaugcaucucaaaccaaga

SEQ ID NO: 1189145 - RNA, 23 nt, Human
aagaaaagcgauaaggaaaacau

SEQ ID NO: 1189146 - RNA, 24 nt, Human
aagagggcauuuccacaucaugcc

SEQ ID NO: 1189147 - RNA, 21 nt, Human
aagcaaauacaauagauacua

SEQ ID NO: 1189148 - RNA, 18 nt, Human
aaucuugcuucuucuaac

SEQ ID NO: 1189149 - RNA, 19 nt, Human
agaaagaaaagcgauaagg

SEQ ID NO: 1189150 - RNA, 20 nt, Human
agaauucuuuauugccacuu

SEQ ID NO: 1189151 - RNA, 18 nt, Human
agcaaagauuugcaugug

SEQ ID NO: 1189152 - RNA, 21 nt, Human
agucaauaccaaaaaaucuug

SEQ ID NO: 1189153 - RNA, 22 nt, Human
aguguuauuucuucuagacaac

SEQ ID NO: 1189154 - RNA, 20 nt, Human
auaaaaccagguaaacuccc

SEQ ID NO: 1189155 - RNA, 23 nt, Human
auaaaaccagguaaacuccccua

SEQ ID NO: 1189156 - RNA, 18 nt, Human
aucuuccuucagccccua

SEQ ID NO: 1189157 - RNA, 18 nt, Human
aucuugcacaucuuccuu

SEQ ID NO: 1189158 - RNA, 23 nt, Human
auuaaaauccucaaaugcaucuc

SEQ ID NO: 1189159 - RNA, 21 nt, Human
ccuggagauuugcacagucaa

SEQ ID NO: 1189160 - RNA, 21 nt, Human
cuauuuauaaaccugagcaac

SEQ ID NO: 1189161 - RNA, 20 nt, Human
cucaaaugcaucucaaacca

SEQ ID NO: 1189162 - RNA, 27 nt, Human
cucaaucaguaagaacuggauauuacu

SEQ ID NO: 1189163 - RNA, 20 nt, Human
cuccccuaccccauucaaaa

SEQ ID NO: 1189164 - RNA, 19 nt, Human
cugaaaacaagcauaaucc

SEQ ID NO: 1189165 - RNA, 19 nt, Human
ggagucugaucucaccaua

SEQ ID NO: 1189166 - RNA, 27 nt, Human
guaaguucuuccuccaucuggaguucu

SEQ ID NO: 1189167 - RNA, 21 nt, Human
uaaaauccucaaaugcaucuc

SEQ ID NO: 1189168 - RNA, 26 nt, Human
uaaaauccucaaaugcaucucaaacc

SEQ ID NO: 1189169 - RNA, 27 nt, Human
uaaacuccccuaccccauucaaaaggc

SEQ ID NO: 1189170 - RNA, 24 nt, Human
uaacacacccaauaaaucaaugcc

SEQ ID NO: 1189171 - RNA, 24 nt, Human
ucaaaccaagagggcauuuccaca

SEQ ID NO: 1189172 - RNA, 24 nt, Human
ucccuagaaugaaauucugagaaa

SEQ ID NO: 1189173 - RNA, 23 nt, Human
ucuggaguuccgcuguaccuuug

SEQ ID NO: 1189174 - RNA, 21 nt, Human
ugacucccuggagauuugcac

SEQ ID NO: 1189175 - RNA, 25 nt, Human
ugacuugguuggaguugcuagcaag

SEQ ID NO: 1189176 - RNA, 19 nt, Human
ugagaaaguucagcaccac

SEQ ID NO: 1189177 - RNA, 24 nt, Human
ugagaauucuuuauugccacuuuu

SEQ ID NO: 1189178 - RNA, 18 nt, Human
ugagugcuuuugcguuaa

SEQ ID NO: 1189179 - RNA, 19 nt, Human
ugaguggguggagaaagaa

SEQ ID NO: 1189180 - RNA, 25 nt, Human
ugcuagcaaacaucggacaaauucc

SEQ ID NO: 1189181 - RNA, 20 nt, Human
uguaccuuuggaaugacggu

SEQ ID NO: 1189182 - RNA, 21 nt, Human
uguugugcuuuccauaaauua

SEQ ID NO: 1189183 - RNA, 20 nt, Human
uuacaaguguuguagugaua

SEQ ID NO: 1189184 - RNA, 21 nt, Human
uucccuagaaugaaauucuga

SEQ ID NO: 1189185 - RNA, 19 nt, Human
uugguuggaguugcuagca

SEQ ID NO: 1189186 - RNA, 25 nt, Human
uuuaaaauuugcugacaguguuauu

SEQ ID NO: 1189187 - RNA, 24 nt, Human
aauuaagcccauuuugucuuucca

SEQ ID NO: 1189188 - RNA, 19 nt, Human
acuuggagaacuuuucugu

SEQ ID NO: 1189189 - RNA, 18 nt, Human
agaguuggaaaagaggca

SEQ ID NO: 1189190 - RNA, 23 nt, Human
agcccauuuugucuuuccaagug

SEQ ID NO: 1189191 - RNA, 25 nt, Human
caacaagcaaggcuaaaagcucucu

SEQ ID NO: 1189192 - RNA, 21 nt, Human
caaggcuaaaagcucucuaag

SEQ ID NO: 1189193 - RNA, 18 nt, Human
caccaucagcaagaaggc

SEQ ID NO: 1189194 - RNA, 19 nt, Human
caucagcaagaaggcucuc

SEQ ID NO: 1189195 - RNA, 21 nt, Human
ccaccaucagcaagaaggcuc

SEQ ID NO: 1189196 - RNA, 20 nt, Human
cccucccuccaaucauuucc

SEQ ID NO: 1189197 - RNA, 23 nt, Human
ccuugaucuuggacuucucagcc

SEQ ID NO: 1189198 - RNA, 19 nt, Human
cguugccaccuucaguugg

SEQ ID NO: 1189199 - RNA, 19 nt, Human
ggucgaguggggacuugga

SEQ ID NO: 1189200 - RNA, 19 nt, Human
uaucuaauaauuaagccca

SEQ ID NO: 1189201 - RNA, 19 nt, Human
ucaguuggaaacguauccu

SEQ ID NO: 1189202 - RNA, 21 nt, Human
uccaagugggagagucaugcu

SEQ ID NO: 1189203 - RNA, 18 nt, Human
ucuuggacuucucagccu

SEQ ID NO: 1189204 - RNA, 25 nt, Human
ugagaggcgaagccagcuggacuuc

SEQ ID NO: 1189205 - RNA, 19 nt, Human
ugaucuuggacuucucagc

SEQ ID NO: 1189206 - RNA, 18 nt, Human
uggaaauuuaaggagaaa

SEQ ID NO: 1189207 - RNA, 25 nt, Human
ugggagagucaugcugacacuguuu

SEQ ID NO: 1189208 - RNA, 20 nt, Human
uguguuggaagaagaguugg

SEQ ID NO: 1189209 - RNA, 22 nt, Human
uuaaggagaaauuuguguuuau

SEQ ID NO: 1189210 - RNA, 25 nt, Human
uucaauuuuaauacccaugaaggcc

SEQ ID NO: 1189211 - RNA, 18 nt, Human
aaaaggcuguccaagagg

SEQ ID NO: 1189212 - RNA, 19 nt, Human
aauucucuuaccugaaaau

SEQ ID NO: 1189213 - RNA, 25 nt, Human
acuguaaaaggcuguccaagaggag

SEQ ID NO: 1189214 - RNA, 19 nt, Human
aggaagcaucauuauugcc

SEQ ID NO: 1189215 - RNA, 20 nt, Human
cuuuaucugugcugcucucc

SEQ ID NO: 1189216 - RNA, 25 nt, Human
uaaaaggcuguccaagaggaggaag

SEQ ID NO: 1189217 - RNA, 24 nt, Human
ucagaccuaccuucucugaaguuc

SEQ ID NO: 1189218 - RNA, 22 nt, Human
uccauggccagaacuguaaaag

SEQ ID NO: 1189219 - RNA, 24 nt, Human
uccauggccagaacuguaaaaggc

SEQ ID NO: 1189220 - RNA, 20 nt, Human
ucccagggauccacugcugu

SEQ ID NO: 1189221 - RNA, 19 nt, Human
ucuccuguuuccccccaaa

SEQ ID NO: 1189222 - RNA, 21 nt, Human
ucugugcugcucucccaggga

SEQ ID NO: 1189223 - RNA, 22 nt, Human
uguaaaaggcuguccaagagga

SEQ ID NO: 1189224 - RNA, 23 nt, Human
ugugcugcucucccagggaucca

SEQ ID NO: 1189225 - RNA, 21 nt, Human
uguuuccccccaaaucagacc

SEQ ID NO: 1189226 - RNA, 18 nt, Human
aacagaaucuucagacaa

SEQ ID NO: 1189227 - RNA, 20 nt, Human
aaccacggccagccccacaa

SEQ ID NO: 1189228 - RNA, 22 nt, Human
aaccucaguaucauggccuuuc

SEQ ID NO: 1189229 - RNA, 20 nt, Human
aaccuggggagcaggaaggc

SEQ ID NO: 1189230 - RNA, 20 nt, Human
aagagagagcagauggaaaa

SEQ ID NO: 1189231 - RNA, 24 nt, Human
aaggaaaacagaaacagccauugg

SEQ ID NO: 1189232 - RNA, 20 nt, Human
aagggagggaauguggucuc

SEQ ID NO: 1189233 - RNA, 22 nt, Human
aaggggccccgcaaggucagac

SEQ ID NO: 1189234 - RNA, 19 nt, Human
aaggugaagggccccaggg

SEQ ID NO: 1189235 - RNA, 19 nt, Human
aagguucuugaacaaagga

SEQ ID NO: 1189236 - RNA, 24 nt, Human
aauagaaaccagcuguggcccaga

SEQ ID NO: 1189237 - RNA, 24 nt, Human
acagcugccaagggugguugggga

SEQ ID NO: 1189238 - RNA, 18 nt, Human
acaugagguacccagaua

SEQ ID NO: 1189239 - RNA, 27 nt, Human
acccaguguuucuggagccucugagug

SEQ ID NO: 1189240 - RNA, 19 nt, Human
acuucugacucugcugugu

SEQ ID NO: 1189241 - RNA, 23 nt, Human
agaaaccagcuguggcccagaac

SEQ ID NO: 1189242 - RNA, 21 nt, Human
agacaauugaaaaccagccau

SEQ ID NO: 1189243 - RNA, 19 nt, Human
agagagcagauggaaaauu

SEQ ID NO: 1189244 - RNA, 21 nt, Human
agccugaggcuaccuccucug

SEQ ID NO: 1189245 - RNA, 23 nt, Human
aggagaucuggcuucuacuucug

SEQ ID NO: 1189246 - RNA, 19 nt, Human
aggaggugaccuucagaug

SEQ ID NO: 1189247 - RNA, 21 nt, Human
aggauggaaggcaaagguggg

SEQ ID NO: 1189248 - RNA, 18 nt, Human
aggcggaagggggacucc

SEQ ID NO: 1189249 - RNA, 18 nt, Human
agggcagacacuuggagg

SEQ ID NO: 1189250 - RNA, 18 nt, Human
agggccccaggagucacu

SEQ ID NO: 1189251 - RNA, 22 nt, Human
aggggagggagaggccauguuu

SEQ ID NO: 1189252 - RNA, 19 nt, Human
agguaggcacuuccuggca

SEQ ID NO: 1189253 - RNA, 24 nt, Human
auagacuguccuucccaggccucu

SEQ ID NO: 1189254 - RNA, 19 nt, Human
caacagaaucuucagacaa

SEQ ID NO: 1189255 - RNA, 21 nt, Human
caaccacggccagccccacaa

SEQ ID NO: 1189256 - RNA, 20 nt, Human
caagcccucaucuuggguca

SEQ ID NO: 1189257 - RNA, 21 nt, Human
caauugaaaaccagccauuca

SEQ ID NO: 1189258 - RNA, 24 nt, Human
cacaugccugagguugugugugug

SEQ ID NO: 1189259 - RNA, 24 nt, Human
caccucuggccuggaauugugucc

SEQ ID NO: 1189260 - RNA, 23 nt, Human
cagaaacagccauuggaggcggg

SEQ ID NO: 1189261 - RNA, 20 nt, Human
caggcccagccucuagccac

SEQ ID NO: 1189262 - RNA, 18 nt, Human
cagugggagauugggcug

SEQ ID NO: 1189263 - RNA, 22 nt, Human
cauucaaagaugcaucaaacac

SEQ ID NO: 1189264 - RNA, 22 nt, Human
cauuccucccaacagaaucuuc

SEQ ID NO: 1189265 - RNA, 19 nt, Human
cauugcuggaggguucguu

SEQ ID NO: 1189266 - RNA, 18 nt, Human
ccaacagaaucuucagac

SEQ ID NO: 1189267 - RNA, 19 nt, Human
ccaaccacggccagcccca

SEQ ID NO: 1189268 - RNA, 23 nt, Human
ccacggccagccccacaagguga

SEQ ID NO: 1189269 - RNA, 19 nt, Human
ccagcgcccccugcccucc

SEQ ID NO: 1189270 - RNA, 22 nt, Human
ccaggccgggccgguggcucca

SEQ ID NO: 1189271 - RNA, 18 nt, Human
ccagggcucuggagugcg

SEQ ID NO: 1189272 - RNA, 21 nt, Human
ccauguuuaaccuggggagca

SEQ ID NO: 1189273 - RNA, 20 nt, Human
cccagaacgcccccgcagcc

SEQ ID NO: 1189274 - RNA, 22 nt, Human
cccagaacgcccccgcagccac

SEQ ID NO: 1189275 - RNA, 23 nt, Human
cccagccucuagccaccucuggc

SEQ ID NO: 1189276 - RNA, 20 nt, Human
cccagguauuuccccaucuc

SEQ ID NO: 1189277 - RNA, 20 nt, Human
ccccaggagucacuuagccc

SEQ ID NO: 1189278 - RNA, 20 nt, Human
ccccaggagucacuuagccc

SEQ ID NO: 1189279 - RNA, 19 nt, Human
ccccgcaaggucagaccag

SEQ ID NO: 1189280 - RNA, 21 nt, Human
cccgcagccacugcccaggga

SEQ ID NO: 1189281 - RNA, 22 nt, Human
cccggccagcuccacccagaag

SEQ ID NO: 1189282 - RNA, 20 nt, Human
cccucuugcuccuucacugu

SEQ ID NO: 1189283 - RNA, 23 nt, Human
ccucugaguggugcccgcugccu

SEQ ID NO: 1189284 - RNA, 18 nt, Human
cgcagccacugcccaggg

SEQ ID NO: 1189285 - RNA, 19 nt, Human
cggaagggggacuccagac

SEQ ID NO: 1189286 - RNA, 20 nt, Human
cuccagacuggggaagggac

SEQ ID NO: 1189287 - RNA, 23 nt, Human
cuccaggcccagccucuagccac

SEQ ID NO: 1189288 - RNA, 20 nt, Human
cugcuacagcugccaagggu

SEQ ID NO: 1189289 - RNA, 25 nt, Human
cugcugcuuccuggaccaagugaca

SEQ ID NO: 1189290 - RNA, 19 nt, Human
cuggaccaacucuuccaug

SEQ ID NO: 1189291 - RNA, 20 nt, Human
cuggaccaacucuuccaugg

SEQ ID NO: 1189292 - RNA, 22 nt, Human
cuggagccucugaguggugccc

SEQ ID NO: 1189293 - RNA, 23 nt, Human
cuggagccucugaguggugcccg

SEQ ID NO: 1189294 - RNA, 18 nt, Human
cugggcauguagugggag

SEQ ID NO: 1189295 - RNA, 20 nt, Human
cugggugagauguucacugg

SEQ ID NO: 1189296 - RNA, 22 nt, Human
cuuaaaggaaggagcagggaaa

SEQ ID NO: 1189297 - RNA, 19 nt, Human
cuugcuccuucacuguucu

SEQ ID NO: 1189298 - RNA, 22 nt, Human
gaaaacagaaacagccauugga

SEQ ID NO: 1189299 - RNA, 24 nt, Human
gaaacuucccggccagcuccaccc

SEQ ID NO: 1189300 - RNA, 21 nt, Human
gaagaagccacaccuucugag

SEQ ID NO: 1189301 - RNA, 22 nt, Human
gaaggcaaaggugggggaauga

SEQ ID NO: 1189302 - RNA, 19 nt, Human
gacggaggcggaaggggga

SEQ ID NO: 1189303 - RNA, 20 nt, Human
gagcaggaaggcuuccugga

SEQ ID NO: 1189304 - RNA, 22 nt, Human
gagcgggagccgcuggagagga

SEQ ID NO: 1189305 - RNA, 23 nt, Human
gagcucacaaaccgccauccuga

SEQ ID NO: 1189306 - RNA, 21 nt, Human
gccccuggagguaggcacuuc

SEQ ID NO: 1189307 - RNA, 19 nt, Human
ggaaaacagaaacagccau

SEQ ID NO: 1189308 - RNA, 22 nt, Human
ggaauguggucucccucccucc

SEQ ID NO: 1189309 - RNA, 26 nt, Human
ggaccagaaucagaaaggccaggaga

SEQ ID NO: 1189310 - RNA, 23 nt, Human
ggagaggccauguuuaaccuggg

SEQ ID NO: 1189311 - RNA, 18 nt, Human
ggagcccagaggagaggc

SEQ ID NO: 1189312 - RNA, 21 nt, Human
ggagcccagaggagaggcuga

SEQ ID NO: 1189313 - RNA, 25 nt, Human
ggagucacuuagcccuuccucuuuc

SEQ ID NO: 1189314 - RNA, 18 nt, Human
ggauuuggagucaggaga

SEQ ID NO: 1189315 - RNA, 23 nt, Human
ggcauguggcucuccucuccaca

SEQ ID NO: 1189316 - RNA, 26 nt, Human
ggccugcugcuuccuggaccaacucu

SEQ ID NO: 1189317 - RNA, 23 nt, Human
gggaccagaaucagaaaggccag

SEQ ID NO: 1189318 - RNA, 20 nt, Human
ggggaugcugguuaccucau

SEQ ID NO: 1189319 - RNA, 25 nt, Human
ggugaagggccccagggcagacacc

SEQ ID NO: 1189320 - RNA, 21 nt, Human
gugaccaggauggaaggcaaa

SEQ ID NO: 1189321 - RNA, 19 nt, Human
uacuauguggugaccagga

SEQ ID NO: 1189322 - RNA, 20 nt, Human
uacuauguggugaccaggau

SEQ ID NO: 1189323 - RNA, 19 nt, Human
uauuuccccaucucguggg

SEQ ID NO: 1189324 - RNA, 22 nt, Human
ucacuuagcccuuccucuuuca

SEQ ID NO: 1189325 - RNA, 25 nt, Human
ucacuuagcccuuccucuuucaauu

SEQ ID NO: 1189326 - RNA, 23 nt, Human
ucagauggucuuaaaggaaggag

SEQ ID NO: 1189327 - RNA, 22 nt, Human
ucauggccuuucaccaucuucc

SEQ ID NO: 1189328 - RNA, 22 nt, Human
ucauuggagcugagagcuuugu

SEQ ID NO: 1189329 - RNA, 20 nt, Human
uccagucccagaugugccca

SEQ ID NO: 1189330 - RNA, 20 nt, Human
ucccaaaugggcaccaaaca

SEQ ID NO: 1189331 - RNA, 23 nt, Human
ucccggccagcuccacccagaag

SEQ ID NO: 1189332 - RNA, 18 nt, Human
ucccugauggccagcgcc

SEQ ID NO: 1189333 - RNA, 19 nt, Human
ucccugauggccagcgccc

SEQ ID NO: 1189334 - RNA, 23 nt, Human
uccguaguugccucagaccaggg

SEQ ID NO: 1189335 - RNA, 21 nt, Human
ucgugggggagacagaugggc

SEQ ID NO: 1189336 - RNA, 20 nt, Human
ucuccacaucacaugccuga

SEQ ID NO: 1189337 - RNA, 21 nt, Human
ugaauagacuguccuucccag

SEQ ID NO: 1189338 - RNA, 23 nt, Human
ugagaagaugacaagaagugggc

SEQ ID NO: 1189339 - RNA, 19 nt, Human
ugagauguucacuggguga

SEQ ID NO: 1189340 - RNA, 20 nt, Human
ugagguugugugugugugug

SEQ ID NO: 1189341 - RNA, 19 nt, Human
ugcaagaagggaucaugag

SEQ ID NO: 1189342 - RNA, 22 nt, Human
ugcaagaagggaucaugagggc

SEQ ID NO: 1189343 - RNA, 19 nt, Human
ugccucagaccagggagcc

SEQ ID NO: 1189344 - RNA, 18 nt, Human
ugcuggaggguucguugg

SEQ ID NO: 1189345 - RNA, 24 nt, Human
uggacggaggcggaagggggacuc

SEQ ID NO: 1189346 - RNA, 21 nt, Human
uggagaggaagguugggaccc

SEQ ID NO: 1189347 - RNA, 18 nt, Human
uggagucaggagaucugg

SEQ ID NO: 1189348 - RNA, 21 nt, Human
uggaugcugggugagauguuc

SEQ ID NO: 1189349 - RNA, 21 nt, Human
uggcccagaacgcccccgcag

SEQ ID NO: 1189350 - RNA, 18 nt, Human
uggcccugggugucaccc

SEQ ID NO: 1189351 - RNA, 24 nt, Human
uggcuccaagucccucuugcuccu

SEQ ID NO: 1189352 - RNA, 19 nt, Human
uggcucuccucuccacauc

SEQ ID NO: 1189353 - RNA, 21 nt, Human
ugggagauugggcuggagcca

SEQ ID NO: 1189354 - RNA, 24 nt, Human
ugggggaaugagcgggagccgcug

SEQ ID NO: 1189355 - RNA, 23 nt, Human
ugguggcuccaagucccucuugc

SEQ ID NO: 1189356 - RNA, 19 nt, Human
ugucaaggagucccuuaga

SEQ ID NO: 1189357 - RNA, 21 nt, Human
uguccagcgccugagcucugc

SEQ ID NO: 1189358 - RNA, 19 nt, Human
uguggcucuccucuccaca

SEQ ID NO: 1189359 - RNA, 24 nt, Human
uguggcucuccucuccacaucaca

SEQ ID NO: 1189360 - RNA, 20 nt, Human
uguggugaccaggauggaag

SEQ ID NO: 1189361 - RNA, 24 nt, Human
ugugugcacauuuguguuuguaug

SEQ ID NO: 1189362 - RNA, 20 nt, Human
ugugugugugcacauuugug

SEQ ID NO: 1189363 - RNA, 22 nt, Human
ugugugugugugcacauuugug

SEQ ID NO: 1189364 - RNA, 18 nt, Human
ugugugugugugugcaca

SEQ ID NO: 1189365 - RNA, 19 nt, Human
ugugugugugugugcacau

SEQ ID NO: 1189366 - RNA, 20 nt, Human
uuacuauguggugaccagga

SEQ ID NO: 1189367 - RNA, 25 nt, Human
uuccagucccagaugugcccagguc

SEQ ID NO: 1189368 - RNA, 21 nt, Human
uuccagugggagauugggcug

SEQ ID NO: 1189369 - RNA, 22 nt, Human
uuccauggcccugggugucacc

SEQ ID NO: 1189370 - RNA, 25 nt, Human
uuccucccaacagaaucuucagaca

SEQ ID NO: 1189371 - RNA, 21 nt, Human
uucuguauuccagucccagau

SEQ ID NO: 1189372 - RNA, 19 nt, Human
uucuuacucaggcaugugg

SEQ ID NO: 1189373 - RNA, 23 nt, Human
uuuaaccuggggagcaggaaggc

SEQ ID NO: 1189374 - RNA, 22 nt, Human
uuuuccggaaugucauugcugg

SEQ ID NO: 1189375 - RNA, 24 nt, Human
uuuuggaauggaugccuggccuac

SEQ ID NO: 1189376 - RNA, 18 nt, Human
uuuuuuggaauggaugcc

SEQ ID NO: 1189377 - RNA, 21 nt, Human
uuuuuuggaauggaugccugg

SEQ ID NO: 1189378 - RNA, 18 nt, Human
aaacaaaugugaauuucu

SEQ ID NO: 1189379 - RNA, 28 nt, Human
aaacaaaugugaauuucuaaacugagac

SEQ ID NO: 1189380 - RNA, 23 nt, Human
aaacaggaggagggggaauccua

SEQ ID NO: 1189381 - RNA, 26 nt, Human
aacaauacaagcaaacaaaugugaau

SEQ ID NO: 1189382 - RNA, 18 nt, Human
aacccuggcugggcacug

SEQ ID NO: 1189383 - RNA, 22 nt, Human
accaccagggaugugaacuacc

SEQ ID NO: 1189384 - RNA, 23 nt, Human
accacuccccuuuguaccuccug

SEQ ID NO: 1189385 - RNA, 18 nt, Human
accccaauuccccgcugc

SEQ ID NO: 1189386 - RNA, 18 nt, Human
accucagcuuuuucccuc

SEQ ID NO: 1189387 - RNA, 24 nt, Human
accuccacugucuggcuagggagc

SEQ ID NO: 1189388 - RNA, 19 nt, Human
acuguagucagcucacuug

SEQ ID NO: 1189389 - RNA, 21 nt, Human
agacagaaaaugacuugccca

SEQ ID NO: 1189390 - RNA, 27 nt, Human
agacuugggggccauccugguaaagac

SEQ ID NO: 1189391 - RNA, 24 nt, Human
agaggcaaguaagcugagguucag

SEQ ID NO: 1189392 - RNA, 18 nt, Human
aggaaacaggaggagggg

SEQ ID NO: 1189393 - RNA, 18 nt, Human
aggcagaagacccuaaac

SEQ ID NO: 1189394 - RNA, 20 nt, Human
agguggaugggguggggaga

SEQ ID NO: 1189395 - RNA, 18 nt, Human
aucugaaccaaucuagaa

SEQ ID NO: 1189396 - RNA, 26 nt, Human
cacacaguuccccauaaauauguaca

SEQ ID NO: 1189397 - RNA, 25 nt, Human
cacagcaccgaugagcugguuccaa

SEQ ID NO: 1189398 - RNA, 22 nt, Human
cacagccuuggaucaggacaga

SEQ ID NO: 1189399 - RNA, 18 nt, Human
caccucccccuucgcucu

SEQ ID NO: 1189400 - RNA, 21 nt, Human
caccucccccuucgcucuguc

SEQ ID NO: 1189401 - RNA, 19 nt, Human
caccugagaugaccaccag

SEQ ID NO: 1189402 - RNA, 23 nt, Human
cacuugauccacagccuggcacc

SEQ ID NO: 1189403 - RNA, 18 nt, Human
cagaagacccuaaacagg

SEQ ID NO: 1189404 - RNA, 23 nt, Human
ccaacagccaagcuccacagggc

SEQ ID NO: 1189405 - RNA, 24 nt, Human
ccaacagccaagcuccacagggcc

SEQ ID NO: 1189406 - RNA, 21 nt, Human
ccaauuccccgcugccuucua

SEQ ID NO: 1189407 - RNA, 23 nt, Human
ccaccugagaugaccaccaggga

SEQ ID NO: 1189408 - RNA, 21 nt, Human
cccauccccagccccaggauc

SEQ ID NO: 1189409 - RNA, 23 nt, Human
ccccuuuguaccuccugucccaa

SEQ ID NO: 1189410 - RNA, 18 nt, Human
cccugaguuuaacccugg

SEQ ID NO: 1189411 - RNA, 18 nt, Human
cccuggugggaagagccc

SEQ ID NO: 1189412 - RNA, 18 nt, Human
ccggaagaccucccaccc

SEQ ID NO: 1189413 - RNA, 20 nt, Human
ccuccaacccgacaugugua

SEQ ID NO: 1189414 - RNA, 19 nt, Human
ccucccagccaugcuuccu

SEQ ID NO: 1189415 - RNA, 23 nt, Human
ccucccagccaugcuuccucuga

SEQ ID NO: 1189416 - RNA, 19 nt, Human
ccucccaggugcuguuucu

SEQ ID NO: 1189417 - RNA, 19 nt, Human
ccuccugccccauccccag

SEQ ID NO: 1189418 - RNA, 21 nt, Human
ccuccugccccauccccagcc

SEQ ID NO: 1189419 - RNA, 22 nt, Human
ccuccugucccaacagccaagc

SEQ ID NO: 1189420 - RNA, 22 nt, Human
ccucuccccggaagaccuccca

SEQ ID NO: 1189421 - RNA, 23 nt, Human
ccugcccugaguuuaacccuggc

SEQ ID NO: 1189422 - RNA, 23 nt, Human
cugcuucucccucaccccaauuc

SEQ ID NO: 1189423 - RNA, 24 nt, Human
cugcuucucccucaccccaauucc

SEQ ID NO: 1189424 - RNA, 26 nt, Human
cuguaaggccuuucuccucccaauug

SEQ ID NO: 1189425 - RNA, 26 nt, Human
gaaggagaggaaacaggaggaggggg

SEQ ID NO: 1189426 - RNA, 24 nt, Human
gaagggacuugcuuccucuuugcc

SEQ ID NO: 1189427 - RNA, 24 nt, Human
gacuugcuuccucuuugccuucca

SEQ ID NO: 1189428 - RNA, 25 nt, Human
gagacagaaaaugacuugcccaaga

SEQ ID NO: 1189429 - RNA, 19 nt, Human
gagaggaaacaggaggagg

SEQ ID NO: 1189430 - RNA, 19 nt, Human
gagcuccuuaacacuuuuc

SEQ ID NO: 1189431 - RNA, 24 nt, Human
gaggcccugauguccuggggucua

SEQ ID NO: 1189432 - RNA, 21 nt, Human
gaugacaggcaccgagugcug

SEQ ID NO: 1189433 - RNA, 24 nt, Human
gcaccuccacugucuggcuaggga

SEQ ID NO: 1189434 - RNA, 22 nt, Human
gccccauccccagccccaggau

SEQ ID NO: 1189435 - RNA, 22 nt, Human
gcccucuccccggaagaccucc

SEQ ID NO: 1189436 - RNA, 24 nt, Human
ggagaggaaacaggaggaggggga

SEQ ID NO: 1189437 - RNA, 22 nt, Human
ggaggagggggaauccuagcag

SEQ ID NO: 1189438 - RNA, 19 nt, Human
ggauaagugugagccacug

SEQ ID NO: 1189439 - RNA, 22 nt, Human
ggcaccacuccccuuuguaccu

SEQ ID NO: 1189440 - RNA, 18 nt, Human
ggcagaaaaguugggccu

SEQ ID NO: 1189441 - RNA, 20 nt, Human
ggcgaaaaucugggaaggcu

SEQ ID NO: 1189442 - RNA, 23 nt, Human
gggcgaaaaucugggaaggcuuc

SEQ ID NO: 1189443 - RNA, 23 nt, Human
ggggagaguucaggcauguggug

SEQ ID NO: 1189444 - RNA, 18 nt, Human
gguggaugggguggggag

SEQ ID NO: 1189445 - RNA, 21 nt, Human
uaaaaaaaaauccuuuucugu

SEQ ID NO: 1189446 - RNA, 23 nt, Human
uaaaaguguguagcaccuccccc

SEQ ID NO: 1189447 - RNA, 20 nt, Human
uaacccuggcugggcacugg

SEQ ID NO: 1189448 - RNA, 22 nt, Human
uaagacgcugucccugguggga

SEQ ID NO: 1189449 - RNA, 19 nt, Human
uacaagguggauggggugg

SEQ ID NO: 1189450 - RNA, 19 nt, Human
uagaaagaugaggagcaua

SEQ ID NO: 1189451 - RNA, 19 nt, Human
uagcaaugugagaacagac

SEQ ID NO: 1189452 - RNA, 19 nt, Human
uaggauaagugugagccac

SEQ ID NO: 1189453 - RNA, 20 nt, Human
uaggauaagugugagccacu

SEQ ID NO: 1189454 - RNA, 21 nt, Human
uaggauaagugugagccacug

SEQ ID NO: 1189455 - RNA, 22 nt, Human
uauagcaaugugagaacagaca

SEQ ID NO: 1189456 - RNA, 23 nt, Human
uauauacaugcaguacuuccaug

SEQ ID NO: 1189457 - RNA, 23 nt, Human
ucaggagcugcagcauaagggcc

SEQ ID NO: 1189458 - RNA, 25 nt, Human
uccaccaccucaaacauuuaccauu

SEQ ID NO: 1189459 - RNA, 23 nt, Human
uccaugacuauucaaagaaaaac

SEQ ID NO: 1189460 - RNA, 24 nt, Human
uccaugacuauucaaagaaaaaca

SEQ ID NO: 1189461 - RNA, 18 nt, Human
ucccaggugcuguuucuc

SEQ ID NO: 1189462 - RNA, 19 nt, Human
uccccagccccaggauccu

SEQ ID NO: 1189463 - RNA, 24 nt, Human
ucuaaacugagacuacuguaaggc

SEQ ID NO: 1189464 - RNA, 23 nt, Human
ucuaaugguuuagccccaccucc

SEQ ID NO: 1189465 - RNA, 24 nt, Human
ucuccccggaagaccucccacccu

SEQ ID NO: 1189466 - RNA, 18 nt, Human
ucuggcuagggagccucg

SEQ ID NO: 1189467 - RNA, 18 nt, Human
ucuguguacaauguguga

SEQ ID NO: 1189468 - RNA, 21 nt, Human
ucuguguuuggaacagcuaag

SEQ ID NO: 1189469 - RNA, 19 nt, Human
ugagaacagacaaauacaa

SEQ ID NO: 1189470 - RNA, 25 nt, Human
ugagaacagacaaauacaaggugga

SEQ ID NO: 1189471 - RNA, 22 nt, Human
ugcaguacuuccaugacuauuc

SEQ ID NO: 1189472 - RNA, 20 nt, Human
ugcaucaauaaagcuucugu

SEQ ID NO: 1189473 - RNA, 18 nt, Human
ugccucugcuucucccuc

SEQ ID NO: 1189474 - RNA, 18 nt, Human
ugcuuccucugaagccug

SEQ ID NO: 1189475 - RNA, 20 nt, Human
ugggaagacauuuucuucug

SEQ ID NO: 1189476 - RNA, 22 nt, Human
ugugaaaucacagcaccgauga

SEQ ID NO: 1189477 - RNA, 21 nt, Human
ugugaagaagggacuugcuuc

SEQ ID NO: 1189478 - RNA, 19 nt, Human
uguggagcccugaggugga

SEQ ID NO: 1189479 - RNA, 19 nt, Human
uguguugguguggcccugu

SEQ ID NO: 1189480 - RNA, 20 nt, Human
uuauagcaaugugagaacag

SEQ ID NO: 1189481 - RNA, 21 nt, Human
uucagagacagaaaaugacuu

SEQ ID NO: 1189482 - RNA, 22 nt, Human
uucagagacagaaaaugacuug

SEQ ID NO: 1189483 - RNA, 18 nt, Human
uucauucauucugaagcc

SEQ ID NO: 1189484 - RNA, 19 nt, Human
uuccaccaccucaaacauu

SEQ ID NO: 1189485 - RNA, 23 nt, Human
uuccugaggccucccagccaugc

SEQ ID NO: 1189486 - RNA, 20 nt, Human
uucucccucaccccaauucc

SEQ ID NO: 1189487 - RNA, 18 nt, Human
uucuccuaauagcaagau

SEQ ID NO: 1189488 - RNA, 20 nt, Human
uucugaagccugcccugagu

SEQ ID NO: 1189489 - RNA, 21 nt, Human
uucugcagggcgaaaaucugg

SEQ ID NO: 1189490 - RNA, 26 nt, Human
uucugcugcaagcaaggaaaugagag

SEQ ID NO: 1189491 - RNA, 20 nt, Human
uugcuuccucuuugccuucc

SEQ ID NO: 1189492 - RNA, 21 nt, Human
uuuaaaacaauacaagcaaac

SEQ ID NO: 1189493 - RNA, 22 nt, Human
uuuagccccaccucccaggugc

SEQ ID NO: 1189494 - RNA, 18 nt, Human
uuucugcugcaagcaagg

SEQ ID NO: 1189495 - RNA, 20 nt, Human
acccucauacugaacucugg

SEQ ID NO: 1189496 - RNA, 21 nt, Human
acccucauacugaacucuggc

SEQ ID NO: 1189497 - RNA, 25 nt, Human
cacacacacgaccaguaccuuauac

SEQ ID NO: 1189498 - RNA, 23 nt, Human
ccagaaagaaccacuaacggggc

SEQ ID NO: 1189499 - RNA, 18 nt, Human
ccucaaagcuauccugga

SEQ ID NO: 1189500 - RNA, 22 nt, Human
ccucauacugaacucuggcuuc

SEQ ID NO: 1189501 - RNA, 24 nt, Human
ccucauacugaacucuggcuucau

SEQ ID NO: 1189502 - RNA, 23 nt, Human
ccugaccaggugucuuucucacc

SEQ ID NO: 1189503 - RNA, 24 nt, Human
cgcagcuuauccucaaagcuaucc

SEQ ID NO: 1189504 - RNA, 21 nt, Human
uccacuaacacacacacgacc

SEQ ID NO: 1189505 - RNA, 21 nt, Human
uccagaaagaaccacuauuac

SEQ ID NO: 1189506 - RNA, 22 nt, Human
uccagaaagaaccacuauuacc

SEQ ID NO: 1189507 - RNA, 19 nt, Human
ucgcaugaagacaauaucg

SEQ ID NO: 1189508 - RNA, 22 nt, Human
ucucacccacugguuucaacaa

SEQ ID NO: 1189509 - RNA, 18 nt, Human
ucuuuagucugacaccau

SEQ ID NO: 1189510 - RNA, 18 nt, Human
ugacaccaugggcgagcc

SEQ ID NO: 1189511 - RNA, 22 nt, Human
ugucugugugacucccugucug

SEQ ID NO: 1189512 - RNA, 21 nt, Human
uugaucuucaaauucuacgug

SEQ ID NO: 1189513 - RNA, 22 nt, Human
uugucuuuagucugacaccaug

SEQ ID NO: 1189514 - RNA, 26 nt, Human
aggagaccauuuuggagccacgggug

SEQ ID NO: 1189515 - RNA, 18 nt, Human
cacggaccaggagaccau

SEQ ID NO: 1189516 - RNA, 26 nt, Human
cacggaccaggagaccauuuuggagc

SEQ ID NO: 1189517 - RNA, 21 nt, Human
ccuguguccccaguccagagc

SEQ ID NO: 1189518 - RNA, 21 nt, Human
cucagccucugccuugggggc

SEQ ID NO: 1189519 - RNA, 22 nt, Human
cucgcaucauauuuccuggauc

SEQ ID NO: 1189520 - RNA, 22 nt, Human
cucuggcucagcuuccaccccc

SEQ ID NO: 1189521 - RNA, 22 nt, Human
cugucucuggcucagcuuccac

SEQ ID NO: 1189522 - RNA, 22 nt, Human
cuuccacccccagcuggggcuc

SEQ ID NO: 1189523 - RNA, 25 nt, Human
cuucugauucucagccucugccuug

SEQ ID NO: 1189524 - RNA, 21 nt, Human
gcuuccacccccagcuggggc

SEQ ID NO: 1189525 - RNA, 19 nt, Human
ucaucuuccucgcaucaua

SEQ ID NO: 1189526 - RNA, 18 nt, Human
uccucucaucuuccucgc

SEQ ID NO: 1189527 - RNA, 19 nt, Human
uggcucagcuuccaccccc

SEQ ID NO: 1189528 - RNA, 25 nt, Human
uggcucagcuuccacccccagcugg

SEQ ID NO: 1189529 - RNA, 19 nt, Human
ugugcccagaugcuugaac

SEQ ID NO: 1189530 - RNA, 22 nt, Human
uguuccucugugacugucucug

SEQ ID NO: 1189531 - RNA, 22 nt, Human
uguuuuguccuucagauuugua

SEQ ID NO: 1189532 - RNA, 24 nt, Human
aaguguucaacacagcaacaauuc

SEQ ID NO: 1189533 - RNA, 23 nt, Human
agacaccacagugugucucuaac

SEQ ID NO: 1189534 - RNA, 20 nt, Human
agggcucgccugugcuuccu

SEQ ID NO: 1189535 - RNA, 19 nt, Human
caacacagaggcgauggga

SEQ ID NO: 1189536 - RNA, 20 nt, Human
cacaaccacuacuccuucug

SEQ ID NO: 1189537 - RNA, 19 nt, Human
cacagcaacaauucucuuu

SEQ ID NO: 1189538 - RNA, 18 nt, Human
caccucugcuucuaagaa

SEQ ID NO: 1189539 - RNA, 21 nt, Human
caccucugcuucuaagaaaaa

SEQ ID NO: 1189540 - RNA, 26 nt, Human
cacgcagagccacucagacaccaccg

SEQ ID NO: 1189541 - RNA, 22 nt, Human
cagugacauuguggggugacac

SEQ ID NO: 1189542 - RNA, 18 nt, Human
cauuccauggcaguggau

SEQ ID NO: 1189543 - RNA, 20 nt, Human
ccaguggagacucuaacguc

SEQ ID NO: 1189544 - RNA, 21 nt, Human
ccuucuguuuucucucucuca

SEQ ID NO: 1189545 - RNA, 19 nt, Human
cucaguggcuccaccucug

SEQ ID NO: 1189546 - RNA, 27 nt, Human
cucugcuucuaagaaaaaucacucauu

SEQ ID NO: 1189547 - RNA, 18 nt, Human
cuucacgcagagccacuc

SEQ ID NO: 1189548 - RNA, 22 nt, Human
gaaaaaucacucauuccauggc

SEQ ID NO: 1189549 - RNA, 20 nt, Human
gcagagccacucagacacca

SEQ ID NO: 1189550 - RNA, 19 nt, Human
gggaccagugagcacgugc

SEQ ID NO: 1189551 - RNA, 20 nt, Human
uaaguagacgggagcaagug

SEQ ID NO: 1189552 - RNA, 26 nt, Human
ucacgcagagccacucagacaccaca

SEQ ID NO: 1189553 - RNA, 24 nt, Human
ugccucucaccuagaaaacggucc

SEQ ID NO: 1189554 - RNA, 21 nt, Human
ugcuggggagggcucgccugu

SEQ ID NO: 1189555 - RNA, 22 nt, Human
aaggggcugugcagccaggagg

SEQ ID NO: 1189556 - RNA, 19 nt, Human
acgaagaccaugaagcacc

SEQ ID NO: 1189557 - RNA, 21 nt, Human
aggggcugugcagccaggagg

SEQ ID NO: 1189558 - RNA, 22 nt, Human
caagggguccugggugagaccu

SEQ ID NO: 1189559 - RNA, 24 nt, Human
caagggguccugggugagaccucg

SEQ ID NO: 1189560 - RNA, 20 nt, Human
cacacggccaugggcagucc

SEQ ID NO: 1189561 - RNA, 19 nt, Human
cacauguccacgaagacca

SEQ ID NO: 1189562 - RNA, 19 nt, Human
cacgcagaaggggcugugc

SEQ ID NO: 1189563 - RNA, 21 nt, Human
cacggccaugggcaguccacc

SEQ ID NO: 1189564 - RNA, 20 nt, Human
cagccaggagggccccccuc

SEQ ID NO: 1189565 - RNA, 19 nt, Human
cagcgugagauaagaucuc

SEQ ID NO: 1189566 - RNA, 21 nt, Human
caggccgggacgauacaucaa

SEQ ID NO: 1189567 - RNA, 24 nt, Human
ccaucauuugggccccccagacac

SEQ ID NO: 1189568 - RNA, 21 nt, Human
cccaugguggccacccucccu

SEQ ID NO: 1189569 - RNA, 20 nt, Human
cccuccggaauugcuccugg

SEQ ID NO: 1189570 - RNA, 20 nt, Human
ccugggugagaccucggccc

SEQ ID NO: 1189571 - RNA, 22 nt, Human
cucuguguccaggggccuccca

SEQ ID NO: 1189572 - RNA, 18 nt, Human
cuggaggacagcgugaga

SEQ ID NO: 1189573 - RNA, 22 nt, Human
gagcagagcaagggguccuggg

SEQ ID NO: 1189574 - RNA, 21 nt, Human
gcccaugguggccacccuccc

SEQ ID NO: 1189575 - RNA, 23 nt, Human
gggccagggcacgcagaaggggc

SEQ ID NO: 1189576 - RNA, 21 nt, Human
gggcugugcagccaggagggc

SEQ ID NO: 1189577 - RNA, 22 nt, Human
ggguccugggugagaccucggc

SEQ ID NO: 1189578 - RNA, 20 nt, Human
ugaacacaggcaucugcgcc

SEQ ID NO: 1189579 - RNA, 24 nt, Human
ugagauaagaucucagcauauacc

SEQ ID NO: 1189580 - RNA, 23 nt, Human
ugcaaggcugaggagcagagcaa

SEQ ID NO: 1189581 - RNA, 24 nt, Human
aaagugcugugauuacaggcguga

SEQ ID NO: 1189582 - RNA, 20 nt, Human
aagacaaaaaaugaagacag

SEQ ID NO: 1189583 - RNA, 24 nt, Human
aagugaucccccugccuuggccuc

SEQ ID NO: 1189584 - RNA, 25 nt, Human
aagugaucccccugccuuggccucc

SEQ ID NO: 1189585 - RNA, 18 nt, Human
aaugacaggugugagcca

SEQ ID NO: 1189586 - RNA, 23 nt, Human
acaggugugagccaccacgccca

SEQ ID NO: 1189587 - RNA, 20 nt, Human
accggccuaugaaccacuuu

SEQ ID NO: 1189588 - RNA, 24 nt, Human
accuugagaucugcccaccuuggc

SEQ ID NO: 1189589 - RNA, 18 nt, Human
acgggguuucacuguguu

SEQ ID NO: 1189590 - RNA, 19 nt, Human
acgggguuucacuguguua

SEQ ID NO: 1189591 - RNA, 20 nt, Human
acgggguuucacuguguuag

SEQ ID NO: 1189592 - RNA, 24 nt, Human
acgggguuucacuguguuagccag

SEQ ID NO: 1189593 - RNA, 25 nt, Human
acuauguugcccaggcuggucucaa

SEQ ID NO: 1189594 - RNA, 18 nt, Human
acucagccugggggacug

SEQ ID NO: 1189595 - RNA, 22 nt, Human
agacaaaaaaugaagacaggca

SEQ ID NO: 1189596 - RNA, 23 nt, Human
agcuggagucaggggacugcagg

SEQ ID NO: 1189597 - RNA, 18 nt, Human
aggcaucaagaugcuauu

SEQ ID NO: 1189598 - RNA, 20 nt, Human
aggcgugagccaccaugacc

SEQ ID NO: 1189599 - RNA, 25 nt, Human
agggaggacacgggaaacccacagc

SEQ ID NO: 1189600 - RNA, 24 nt, Human
aggggccucacuauguugcccagg

SEQ ID NO: 1189601 - RNA, 25 nt, Human
agugaucccccugccuuggccuccc

SEQ ID NO: 1189602 - RNA, 19 nt, Human
aucucaauagcuaaacgug

SEQ ID NO: 1189603 - RNA, 24 nt, Human
caaagugcugugauuacaggcgug

SEQ ID NO: 1189604 - RNA, 22 nt, Human
caagugaucccccugccuuggc

SEQ ID NO: 1189605 - RNA, 21 nt, Human
caccugacccuguuuagcagc

SEQ ID NO: 1189606 - RNA, 19 nt, Human
cacuauguugcccaggcug

SEQ ID NO: 1189607 - RNA, 24 nt, Human
cacuauguugcccaggcuggucuc

SEQ ID NO: 1189608 - RNA, 18 nt, Human
cacuguguuagccaggau

SEQ ID NO: 1189609 - RNA, 19 nt, Human
cacuguguuagccaggaug

SEQ ID NO: 1189610 - RNA, 24 nt, Human
cacuguguuagccaggauggucuu

SEQ ID NO: 1189611 - RNA, 22 nt, Human
cacuuuugacucagccuggggg

SEQ ID NO: 1189612 - RNA, 19 nt, Human
cagcagaagcuucaaggcc

SEQ ID NO: 1189613 - RNA, 18 nt, Human
cagccaggucgcccaggc

SEQ ID NO: 1189614 - RNA, 20 nt, Human
ccaaagugcugugauuacag

SEQ ID NO: 1189615 - RNA, 22 nt, Human
ccaaagugcugugauuacaggc

SEQ ID NO: 1189616 - RNA, 24 nt, Human
ccaaagugcugugauuacaggcgu

SEQ ID NO: 1189617 - RNA, 19 nt, Human
ccaccagaugggccaggug

SEQ ID NO: 1189618 - RNA, 20 nt, Human
cccacagcaaggagcggggc

SEQ ID NO: 1189619 - RNA, 24 nt, Human
cccccugccuuggccucccaaagc

SEQ ID NO: 1189620 - RNA, 26 nt, Human
ccucacuauguugcccaggcuggucu

SEQ ID NO: 1189621 - RNA, 24 nt, Human
ccucccauggcacagccaccagau

SEQ ID NO: 1189622 - RNA, 21 nt, Human
ccugccuuggccucccaaagc

SEQ ID NO: 1189623 - RNA, 22 nt, Human
cggaaugacaggugugagccac

SEQ ID NO: 1189624 - RNA, 24 nt, Human
cgggguuucacuguguuagccagg

SEQ ID NO: 1189625 - RNA, 24 nt, Human
cgugagccaccaugaccggccuau

SEQ ID NO: 1189626 - RNA, 22 nt, Human
cuccugaccuugagaucugccc

SEQ ID NO: 1189627 - RNA, 25 nt, Human
cuccugaccuugagaucugcccacc

SEQ ID NO: 1189628 - RNA, 19 nt, Human
cugacccuguuuagcagca

SEQ ID NO: 1189629 - RNA, 19 nt, Human
cugucuucugggcacagcu

SEQ ID NO: 1189630 - RNA, 21 nt, Human
cuuaaaacuccugggcacaag

SEQ ID NO: 1189631 - RNA, 22 nt, Human
cuuaucucaauagcuaaacgug

SEQ ID NO: 1189632 - RNA, 18 nt, Human
gauuacaggcgugagcca

SEQ ID NO: 1189633 - RNA, 21 nt, Human
gauuacaggcgugagccacca

SEQ ID NO: 1189634 - RNA, 22 nt, Human
gauuacaggcgugagccaccau

SEQ ID NO: 1189635 - RNA, 23 nt, Human
gauuacaggcgugagccaccaug

SEQ ID NO: 1189636 - RNA, 20 nt, Human
gcuagucuuaaaacuccugg

SEQ ID NO: 1189637 - RNA, 18 nt, Human
gcuggagucaggggacug

SEQ ID NO: 1189638 - RNA, 22 nt, Human
gcuucaaggccuguuccuaauu

SEQ ID NO: 1189639 - RNA, 21 nt, Human
ggaaugacaggcgugaacuag

SEQ ID NO: 1189640 - RNA, 23 nt, Human
ggaaugacaggugugagccacca

SEQ ID NO: 1189641 - RNA, 18 nt, Human
ggagaggcagagagguga

SEQ ID NO: 1189642 - RNA, 24 nt, Human
ggauggucuugaucuccugaccuu

SEQ ID NO: 1189643 - RNA, 20 nt, Human
gggacugcagggcagggagg

SEQ ID NO: 1189644 - RNA, 20 nt, Human
gggcuguggcucugcuccuu

SEQ ID NO: 1189645 - RNA, 23 nt, Human
gggguuucacuguguuagccagg

SEQ ID NO: 1189646 - RNA, 18 nt, Human
gguagcagcgugggggca

SEQ ID NO: 1189647 - RNA, 23 nt, Human
guagagacgggguuucacugugu

SEQ ID NO: 1189648 - RNA, 21 nt, Human
gucgcccaggcuagucuuaaa

SEQ ID NO: 1189649 - RNA, 23 nt, Human
gugcacagugggaagcagggggu

SEQ ID NO: 1189650 - RNA, 20 nt, Human
gugggggcaagugcaggcac

SEQ ID NO: 1189651 - RNA, 22 nt, Human
uaaaacuccugggcacaagaga

SEQ ID NO: 1189652 - RNA, 23 nt, Human
uacaggcgugagccaccaugacc

SEQ ID NO: 1189653 - RNA, 20 nt, Human
uacccagagcaggguagcag

SEQ ID NO: 1189654 - RNA, 23 nt, Human
uagagacaggggccucacuaugu

SEQ ID NO: 1189655 - RNA, 20 nt, Human
uaguagagacgggguuucac

SEQ ID NO: 1189656 - RNA, 24 nt, Human
uaguagagacgggguuucacugug

SEQ ID NO: 1189657 - RNA, 23 nt, Human
uauguugcccaggcuggucucaa

SEQ ID NO: 1189658 - RNA, 24 nt, Human
uauguugcccaggcuggucucaaa

SEQ ID NO: 1189659 - RNA, 24 nt, Human
ucacuguguuagccaggauggucu

SEQ ID NO: 1189660 - RNA, 22 nt, Human
uccagagcuggagucaggggac

SEQ ID NO: 1189661 - RNA, 24 nt, Human
ucccaaagugcugugauuacaggc

SEQ ID NO: 1189662 - RNA, 20 nt, Human
ucccagcacgagccacaugg

SEQ ID NO: 1189663 - RNA, 21 nt, Human
ucccauggcacagccaccaga

SEQ ID NO: 1189664 - RNA, 19 nt, Human
ucccccugccuuggccucc

SEQ ID NO: 1189665 - RNA, 20 nt, Human
ucccuuaaaccacagaagcu

SEQ ID NO: 1189666 - RNA, 20 nt, Human
uccucccauggcacagccac

SEQ ID NO: 1189667 - RNA, 26 nt, Human
ucucugggcgggugcacagugggaag

SEQ ID NO: 1189668 - RNA, 20 nt, Human
ucuggagaggcagagaggug

SEQ ID NO: 1189669 - RNA, 23 nt, Human
ugaagacaggcaucaagaugcua

SEQ ID NO: 1189670 - RNA, 18 nt, Human
ugacucagccugggggac

SEQ ID NO: 1189671 - RNA, 22 nt, Human
ugagaucugcccaccuuggccu

SEQ ID NO: 1189672 - RNA, 26 nt, Human
ugaggccggaaugacaggugugagcc

SEQ ID NO: 1189673 - RNA, 24 nt, Human
ugauccauggacaugcgaccaccc

SEQ ID NO: 1189674 - RNA, 27 nt, Human
ugauccauggacaugcgaccacccucu

SEQ ID NO: 1189675 - RNA, 24 nt, Human
ugauuacaggcgugagccaccaug

SEQ ID NO: 1189676 - RNA, 20 nt, Human
ugcacagugggaagcagggg

SEQ ID NO: 1189677 - RNA, 21 nt, Human
ugcacagugggaagcaggggg

SEQ ID NO: 1189678 - RNA, 24 nt, Human
ugcccaggcuggucucaaacuucu

SEQ ID NO: 1189679 - RNA, 19 nt, Human
uggaaugacaggcgugaac

SEQ ID NO: 1189680 - RNA, 25 nt, Human
uggcaguggguucaccugacccugu

SEQ ID NO: 1189681 - RNA, 25 nt, Human
uguagagacaggggccucacuaugu

SEQ ID NO: 1189682 - RNA, 21 nt, Human
uguccuugguacccagagcag

SEQ ID NO: 1189683 - RNA, 18 nt, Human
ugugauuacaggcgugag

SEQ ID NO: 1189684 - RNA, 22 nt, Human
ugugauuacaggcgugagccac

SEQ ID NO: 1189685 - RNA, 23 nt, Human
ugugauuacaggcgugagccacc

SEQ ID NO: 1189686 - RNA, 24 nt, Human
ugugauuacaggcgugagccacca

SEQ ID NO: 1189687 - RNA, 23 nt, Human
uuaaaacagaagacaaaaaauga

SEQ ID NO: 1189688 - RNA, 18 nt, Human
uuaguagagacgggguuu

SEQ ID NO: 1189689 - RNA, 21 nt, Human
uuaguagagacgggguuucac

SEQ ID NO: 1189690 - RNA, 21 nt, Human
uuaguagagacgggguuucac

SEQ ID NO: 1189691 - RNA, 24 nt, Human
uuaguagagacgggguuucacugu

SEQ ID NO: 1189692 - RNA, 23 nt, Human
uucaccugacccuguuuagcagc

SEQ ID NO: 1189693 - RNA, 21 nt, Human
uucacuguguuagccaggaug

SEQ ID NO: 1189694 - RNA, 18 nt, Human
uuggccucccaaagugcu

SEQ ID NO: 1189695 - RNA, 19 nt, Human
uuucacuguguuagccagg

SEQ ID NO: 1189696 - RNA, 25 nt, Human
uuuguagagacaggggccucacuau

SEQ ID NO: 1189697 - RNA, 24 nt, Human
uuuuuaguagagacgggguuucac

SEQ ID NO: 1189698 - RNA, 23 nt, Human
uuuuuuaguagagacgggguuuc

SEQ ID NO: 1189699 - RNA, 19 nt, Human
aaacagucacugagugaag

SEQ ID NO: 1189700 - RNA, 24 nt, Human
aaagugcugggauuacaggcauga

SEQ ID NO: 1189701 - RNA, 19 nt, Human
aaaguguuaggauuacagg

SEQ ID NO: 1189702 - RNA, 18 nt, Human
aaggacccugccaggccc

SEQ ID NO: 1189703 - RNA, 19 nt, Human
aagugcugggauuacaggc

SEQ ID NO: 1189704 - RNA, 21 nt, Human
aagugcugggauuacaggcau

SEQ ID NO: 1189705 - RNA, 26 nt, Human
aaguguuaggauuacaggccugagcc

SEQ ID NO: 1189706 - RNA, 24 nt, Human
aaugcaguuugccuuuucuuuuuu

SEQ ID NO: 1189707 - RNA, 19 nt, Human
acacccaccucccaggcac

SEQ ID NO: 1189708 - RNA, 21 nt, Human
accacagauauugcugugcca

SEQ ID NO: 1189709 - RNA, 19 nt, Human
accacccccacacccaccu

SEQ ID NO: 1189710 - RNA, 23 nt, Human
accacccccacacccaccuccca

SEQ ID NO: 1189711 - RNA, 21 nt, Human
accuggacuucaucaccacua

SEQ ID NO: 1189712 - RNA, 24 nt, Human
accuugugauccgcccgccuuggc

SEQ ID NO: 1189713 - RNA, 18 nt, Human
acgggguuucaccguguu

SEQ ID NO: 1189714 - RNA, 19 nt, Human
acgggguuucaccguguua

SEQ ID NO: 1189715 - RNA, 20 nt, Human
acgggguuucaccguguuag

SEQ ID NO: 1189716 - RNA, 24 nt, Human
acgggguuucaccguguuagccag

SEQ ID NO: 1189717 - RNA, 20 nt, Human
acugcaagcuccgccucccg

SEQ ID NO: 1189718 - RNA, 25 nt, Human
acuggcuccuuggagggcugcauac

SEQ ID NO: 1189719 - RNA, 25 nt, Human
agacaccacagauauugcugugcca

SEQ ID NO: 1189720 - RNA, 19 nt, Human
agagacgggguuucaccgu

SEQ ID NO: 1189721 - RNA, 22 nt, Human
agcaggcacaggagccuuaugc

SEQ ID NO: 1189722 - RNA, 19 nt, Human
aggagauucugcacagugc

SEQ ID NO: 1189723 - RNA, 19 nt, Human
aggcacccuccuuccagaa

SEQ ID NO: 1189724 - RNA, 23 nt, Human
aggccugagccaccgugcccggc

SEQ ID NO: 1189725 - RNA, 25 nt, Human
aggcuggagugcaguggcgcgaucu

SEQ ID NO: 1189726 - RNA, 20 nt, Human
aguaaacaguaguacaaugg

SEQ ID NO: 1189727 - RNA, 20 nt, Human
aguagagacgggguuucacc

SEQ ID NO: 1189728 - RNA, 18 nt, Human
aguagcugggacuacagg

SEQ ID NO: 1189729 - RNA, 19 nt, Human
aguagcugggacuacaggc

SEQ ID NO: 1189730 - RNA, 20 nt, Human
agugcaguggcgcgaucucg

SEQ ID NO: 1189731 - RNA, 23 nt, Human
agugcaguggcgcgaucucggcu

SEQ ID NO: 1189732 - RNA, 24 nt, Human
agugcaguggcgcgaucucggcuc

SEQ ID NO: 1189733 - RNA, 18 nt, Human
agugcugggauuacaggc

SEQ ID NO: 1189734 - RNA, 29 nt, Human
aguuugccuuuucuuuuuuuuuuuuuuuu

SEQ ID NO: 1189735 - RNA, 19 nt, Human
aucauucuccugccucggc

SEQ ID NO: 1189736 - RNA, 19 nt, Human
auccgcccgccuuggccuc

SEQ ID NO: 1189737 - RNA, 19 nt, Human
augcaucacaaugaaaaag

SEQ ID NO: 1189738 - RNA, 24 nt, Human
auuuuuguauuuuuaguagagaug

SEQ ID NO: 1189739 - RNA, 19 nt, Human
caaaacagucacugaguga

SEQ ID NO: 1189740 - RNA, 24 nt, Human
caaagugcugggauuacaggcaug

SEQ ID NO: 1189741 - RNA, 18 nt, Human
caaaguguuaggauuaca

SEQ ID NO: 1189742 - RNA, 21 nt, Human
caaggcagccaagccacagcc

SEQ ID NO: 1189743 - RNA, 20 nt, Human
caagugauucuucugccuca

SEQ ID NO: 1189744 - RNA, 22 nt, Human
caagugauucuucugccucagc

SEQ ID NO: 1189745 - RNA, 21 nt, Human
cacaccuggcuaauuuuugua

SEQ ID NO: 1189746 - RNA, 19 nt, Human
caccacagauauugcugug

SEQ ID NO: 1189747 - RNA, 22 nt, Human
caccacagauauugcugugcca

SEQ ID NO: 1189748 - RNA, 19 nt, Human
caccacccccacacccacc

SEQ ID NO: 1189749 - RNA, 24 nt, Human
caccaggcuggcuaauuuuuugua

SEQ ID NO: 1189750 - RNA, 23 nt, Human
cacccaccacccccacacccacc

SEQ ID NO: 1189751 - RNA, 25 nt, Human
cacccaccacccccacacccaccuc

SEQ ID NO: 1189752 - RNA, 20 nt, Human
cacccuccuuccagaauuca

SEQ ID NO: 1189753 - RNA, 24 nt, Human
cacccuccuuccagaauucaccuc

SEQ ID NO: 1189754 - RNA, 18 nt, Human
caccguguuagccaggau

SEQ ID NO: 1189755 - RNA, 24 nt, Human
caccguguuagccaggauggucuc

SEQ ID NO: 1189756 - RNA, 24 nt, Human
caccuggacuucaucaccacuaga

SEQ ID NO: 1189757 - RNA, 23 nt, Human
caccugucucggccucccaaagu

SEQ ID NO: 1189758 - RNA, 24 nt, Human
caccugucucggccucccaaagug

SEQ ID NO: 1189759 - RNA, 21 nt, Human
cacugcaaccuccgccuccug

SEQ ID NO: 1189760 - RNA, 23 nt, Human
cacugcaaccuccgccuccuggg

SEQ ID NO: 1189761 - RNA, 23 nt, Human
cacuggcagggaaaacaccagug

SEQ ID NO: 1189762 - RNA, 18 nt, Human
cagagaccucagccccuc

SEQ ID NO: 1189763 - RNA, 22 nt, Human
cagcauccaaccagacuuccag

SEQ ID NO: 1189764 - RNA, 24 nt, Human
cagcauguuggcuaggcuggucuc

SEQ ID NO: 1189765 - RNA, 20 nt, Human
cagccuccugaguagcuggg

SEQ ID NO: 1189766 - RNA, 22 nt, Human
cagcgcugccugccuaucucaa

SEQ ID NO: 1189767 - RNA, 19 nt, Human
cagcgugccagcugggccc

SEQ ID NO: 1189768 - RNA, 22 nt, Human
cagcugggagcagggauggcac

SEQ ID NO: 1189769 - RNA, 18 nt, Human
cagcuucaauucucugaa

SEQ ID NO: 1189770 - RNA, 22 nt, Human
caggauggucuccaucuccuga

SEQ ID NO: 1189771 - RNA, 23 nt, Human
caggcacccuccuuccagaauuc

SEQ ID NO: 1189772 - RNA, 19 nt, Human
cagucccggguucucuccu

SEQ ID NO: 1189773 - RNA, 22 nt, Human
cagucccggguucucuccuccu

SEQ ID NO: 1189774 - RNA, 22 nt, Human
cauaguaaugcaguuugccuuu

SEQ ID NO: 1189775 - RNA, 21 nt, Human
caucaccuggggccaguccaa

SEQ ID NO: 1189776 - RNA, 18 nt, Human
cauguuggcuaggcuggu

SEQ ID NO: 1189777 - RNA, 23 nt, Human
ccaaagugcugggauuacaggca

SEQ ID NO: 1189778 - RNA, 24 nt, Human
ccaaagugcugggauuacaggcau

SEQ ID NO: 1189779 - RNA, 19 nt, Human
ccaaaguguuaggauuaca

SEQ ID NO: 1189780 - RNA, 19 nt, Human
ccacacccaccucccaggc

SEQ ID NO: 1189781 - RNA, 27 nt, Human
ccaccacccccacacccaccucccagg

SEQ ID NO: 1189782 - RNA, 26 nt, Human
ccaccaggcuggcuaauuuuuuguau

SEQ ID NO: 1189783 - RNA, 18 nt, Human
ccaccgugcccggccgca

SEQ ID NO: 1189784 - RNA, 23 nt, Human
ccaccuagcagcccuccagggcc

SEQ ID NO: 1189785 - RNA, 22 nt, Human
ccaggcugaacagcuucaauuc

SEQ ID NO: 1189786 - RNA, 24 nt, Human
cccaaagugcugggauuacaggca

SEQ ID NO: 1189787 - RNA, 21 nt, Human
cccacacccaccucccaggca

SEQ ID NO: 1189788 - RNA, 25 nt, Human
cccacacccaccucccaggcacccu

SEQ ID NO: 1189789 - RNA, 19 nt, Human
cccacacccuagccuggcc

SEQ ID NO: 1189790 - RNA, 23 nt, Human
cccaccacccccacacccaccuc

SEQ ID NO: 1189791 - RNA, 24 nt, Human
cccaccacccccacacccaccucc

SEQ ID NO: 1189792 - RNA, 22 nt, Human
cccagagaccucagccccucau

SEQ ID NO: 1189793 - RNA, 20 nt, Human
cccaggcuggagugcaguga

SEQ ID NO: 1189794 - RNA, 24 nt, Human
cccaugcaucacaaugaaaaagca

SEQ ID NO: 1189795 - RNA, 20 nt, Human
ccccaagccucagccgcaga

SEQ ID NO: 1189796 - RNA, 23 nt, Human
ccccaagccucagccgcagaauc

SEQ ID NO: 1189797 - RNA, 27 nt, Human
ccccacacccuagccuggccagcaggc

SEQ ID NO: 1189798 - RNA, 20 nt, Human
ccccagagaccucagccccu

SEQ ID NO: 1189799 - RNA, 20 nt, Human
ccccagagaccucagccccu

SEQ ID NO: 1189800 - RNA, 22 nt, Human
cccccacacccaccucccaggc

SEQ ID NO: 1189801 - RNA, 22 nt, Human
cccgccuuggccucccaaagug

SEQ ID NO: 1189802 - RNA, 20 nt, Human
cccggguucccaucauucuc

SEQ ID NO: 1189803 - RNA, 24 nt, Human
ccgccuccuggguucaagugauuc

SEQ ID NO: 1189804 - RNA, 20 nt, Human
ccggcugauggagcagcgcu

SEQ ID NO: 1189805 - RNA, 18 nt, Human
ccggguucucuccuccuc

SEQ ID NO: 1189806 - RNA, 18 nt, Human
ccgugugaucagcagggu

SEQ ID NO: 1189807 - RNA, 20 nt, Human
ccuaagugugagaaacgagg

SEQ ID NO: 1189808 - RNA, 18 nt, Human
ccucacccacuagacgcg

SEQ ID NO: 1189809 - RNA, 21 nt, Human
ccucccaggcacccuccuucc

SEQ ID NO: 1189810 - RNA, 24 nt, Human
ccucccaggcacccuccuuccaga

SEQ ID NO: 1189811 - RNA, 18 nt, Human
ccucccagucccggguuc

SEQ ID NO: 1189812 - RNA, 20 nt, Human
ccucccagucccggguucuc

SEQ ID NO: 1189813 - RNA, 22 nt, Human
ccucccagucccggguucucuc

SEQ ID NO: 1189814 - RNA, 24 nt, Human
ccucccggguucccaucauucucc

SEQ ID NO: 1189815 - RNA, 22 nt, Human
ccuccgccuccuggguucaagu

SEQ ID NO: 1189816 - RNA, 21 nt, Human
ccuccuggguucaagugauuc

SEQ ID NO: 1189817 - RNA, 19 nt, Human
ccucuggcugugggguggc

SEQ ID NO: 1189818 - RNA, 19 nt, Human
ccugaccucgugauccacc

SEQ ID NO: 1189819 - RNA, 21 nt, Human
ccugaccucgugauccaccug

SEQ ID NO: 1189820 - RNA, 23 nt, Human
ccugaguagcugggauuacacgu

SEQ ID NO: 1189821 - RNA, 23 nt, Human
ccugccucggccuucugaguagc

SEQ ID NO: 1189822 - RNA, 24 nt, Human
ccugccucggccuucugaguagcu

SEQ ID NO: 1189823 - RNA, 23 nt, Human
ccuggguucaagugauucuucug

SEQ ID NO: 1189824 - RNA, 24 nt, Human
cgcccaggcuggagugcaguggcg

SEQ ID NO: 1189825 - RNA, 24 nt, Human
cgcuaggaaaaggccccaagccuc

SEQ ID NO: 1189826 - RNA, 24 nt, Human
cgcucugucgcccaggcuggagug

SEQ ID NO: 1189827 - RNA, 22 nt, Human
cgugcuucaggcuucacugcug

SEQ ID NO: 1189828 - RNA, 23 nt, Human
cuaauuuuuguauuuuuaguaga

SEQ ID NO: 1189829 - RNA, 24 nt, Human
cucacugcaaccuccgccuccugg

SEQ ID NO: 1189830 - RNA, 24 nt, Human
cucagccuccugaguagcugggau

SEQ ID NO: 1189831 - RNA, 21 nt, Human
cucccggguucccaucauucu

SEQ ID NO: 1189832 - RNA, 24 nt, Human
cuccugaccucgugauccaccugu

SEQ ID NO: 1189833 - RNA, 24 nt, Human
cuccugaccuugugauccgcccgc

SEQ ID NO: 1189834 - RNA, 21 nt, Human
cuccuggguucaagugauucu

SEQ ID NO: 1189835 - RNA, 24 nt, Human
cucgcucugucgcccaggcuggag

SEQ ID NO: 1189836 - RNA, 24 nt, Human
cucggccuucugaguagcugggac

SEQ ID NO: 1189837 - RNA, 23 nt, Human
cucugucgcccaggcuggagugc

SEQ ID NO: 1189838 - RNA, 23 nt, Human
cucuguugcccaggcuggagugc

SEQ ID NO: 1189839 - RNA, 23 nt, Human
cugcaaccuccgccuccuggguu

SEQ ID NO: 1189840 - RNA, 24 nt, Human
cugcaaccuccgccuccuggguuc

SEQ ID NO: 1189841 - RNA, 23 nt, Human
cugccucagccuccugaguagcu

SEQ ID NO: 1189842 - RNA, 21 nt, Human
cugcucagaaccaccuagcag

SEQ ID NO: 1189843 - RNA, 18 nt, Human
cuggcuaauuuuuuguau

SEQ ID NO: 1189844 - RNA, 23 nt, Human
cugucucggccucccaaagugcu

SEQ ID NO: 1189845 - RNA, 21 nt, Human
cugugggguggcaggucugag

SEQ ID NO: 1189846 - RNA, 19 nt, Human
cuguugcccaggcuggagu

SEQ ID NO: 1189847 - RNA, 23 nt, Human
cuuaaaauuguuucugauagccc

SEQ ID NO: 1189848 - RNA, 22 nt, Human
gaccauaguaaugcaguuugcc

SEQ ID NO: 1189849 - RNA, 22 nt, Human
gaccucgugauccaccugucuc

SEQ ID NO: 1189850 - RNA, 22 nt, Human
gaccucgugauccaccugucuc

SEQ ID NO: 1189851 - RNA, 24 nt, Human
gaccucgugauccaccugucucgg

SEQ ID NO: 1189852 - RNA, 21 nt, Human
gaccuugugauccgcccgccu

SEQ ID NO: 1189853 - RNA, 24 nt, Human
gaccuugugauccgcccgccuugg

SEQ ID NO: 1189854 - RNA, 24 nt, Human
gagacgggguuucaccguguuagc

SEQ ID NO: 1189855 - RNA, 25 nt, Human
gaguagcugggacuacaggcagccc

SEQ ID NO: 1189856 - RNA, 24 nt, Human
gaguagcugggauuacacgugugc

SEQ ID NO: 1189857 - RNA, 22 nt, Human
gauggcacggugcuaggaacau

SEQ ID NO: 1189858 - RNA, 18 nt, Human
gauuacaggcaugaguca

SEQ ID NO: 1189859 - RNA, 20 nt, Human
gauuacaggcaugagucacc

SEQ ID NO: 1189860 - RNA, 22 nt, Human
gauuacaggcaugagucaccgc

SEQ ID NO: 1189861 - RNA, 18 nt, Human
gauuacaggccugagcca

SEQ ID NO: 1189862 - RNA, 21 nt, Human
gauuacaggccugagccaccg

SEQ ID NO: 1189863 - RNA, 24 nt, Human
gauuacaggccugagccaccgugc

SEQ ID NO: 1189864 - RNA, 21 nt, Human
gauucuucugccucagccucc

SEQ ID NO: 1189865 - RNA, 20 nt, Human
gcaaacucagcucacugcaa

SEQ ID NO: 1189866 - RNA, 21 nt, Human
gcacagcgugccagcugggcc

SEQ ID NO: 1189867 - RNA, 19 nt, Human
gcccaggcuggagugcagu

SEQ ID NO: 1189868 - RNA, 20 nt, Human
gcccaggcuggagugcagug

SEQ ID NO: 1189869 - RNA, 18 nt, Human
gccuccuccaagccucag

SEQ ID NO: 1189870 - RNA, 21 nt, Human
gccucggccuucugaguagcu

SEQ ID NO: 1189871 - RNA, 19 nt, Human
gcuggagugcaguggcgcg

SEQ ID NO: 1189872 - RNA, 21 nt, Human
gcuugaagucacccaccaccc

SEQ ID NO: 1189873 - RNA, 20 nt, Human
gcuugacuuccugaaagcag

SEQ ID NO: 1189874 - RNA, 20 nt, Human
ggaaaaggccccaagccuca

SEQ ID NO: 1189875 - RNA, 23 nt, Human
ggacccugccaggccucuccuag

SEQ ID NO: 1189876 - RNA, 22 nt, Human
ggacuuaaaauuguuucugaua

SEQ ID NO: 1189877 - RNA, 19 nt, Human
ggaguuucagcauguuggc

SEQ ID NO: 1189878 - RNA, 24 nt, Human
ggauggucuccaucuccugaccuc

SEQ ID NO: 1189879 - RNA, 22 nt, Human
ggauuacaggcaugagucaccg

SEQ ID NO: 1189880 - RNA, 22 nt, Human
ggauuacaggccugagccaccg

SEQ ID NO: 1189881 - RNA, 22 nt, Human
ggccgcuaggaaaaggccccaa

SEQ ID NO: 1189882 - RNA, 23 nt, Human
ggcuggucucaaacuccugaccu

SEQ ID NO: 1189883 - RNA, 20 nt, Human
gggcugcauaccccccacuc

SEQ ID NO: 1189884 - RNA, 23 nt, Human
gggguuucaccguguuagccagg

SEQ ID NO: 1189885 - RNA, 22 nt, Human
ggguuucaccguguuagccagg

SEQ ID NO: 1189886 - RNA, 20 nt, Human
ggucucaaacuccugaccuu

SEQ ID NO: 1189887 - RNA, 23 nt, Human
guagagacgggguuucaccgugu

SEQ ID NO: 1189888 - RNA, 19 nt, Human
guaggccuccuccaagccu

SEQ ID NO: 1189889 - RNA, 22 nt, Human
guaggccuccuccaagccucag

SEQ ID NO: 1189890 - RNA, 24 nt, Human
guccagaggucuagggagaauuug

SEQ ID NO: 1189891 - RNA, 26 nt, Human
guccagaggucuagggagaauuuggg

SEQ ID NO: 1189892 - RNA, 24 nt, Human
gugauccaccugucucggccuccc

SEQ ID NO: 1189893 - RNA, 23 nt, Human
gugaugcaaacucagcucacugc

SEQ ID NO: 1189894 - RNA, 23 nt, Human
gugauucuucugccucagccucc

SEQ ID NO: 1189895 - RNA, 21 nt, Human
uaagguccccacacccuagcc

SEQ ID NO: 1189896 - RNA, 24 nt, Human
uaauuuuuguauuuuuaguagaga

SEQ ID NO: 1189897 - RNA, 24 nt, Human
uaauuuuuuguauuuuuaguagag

SEQ ID NO: 1189898 - RNA, 24 nt, Human
uacaggcaugagucaccgcgccca

SEQ ID NO: 1189899 - RNA, 23 nt, Human
uacaggccugagccaccgugccc

SEQ ID NO: 1189900 - RNA, 22 nt, Human
uagacaccacagauauugcugu

SEQ ID NO: 1189901 - RNA, 24 nt, Human
uagccaggauggucuccaucuccu

SEQ ID NO: 1189902 - RNA, 27 nt, Human
uagccuggccagcaggcacaggagccc

SEQ ID NO: 1189903 - RNA, 21 nt, Human
uagcugaccccagcauccaac

SEQ ID NO: 1189904 - RNA, 19 nt, Human
uaggauuacaggccugagc

SEQ ID NO: 1189905 - RNA, 21 nt, Human
uaggauuacaggccugagcca

SEQ ID NO: 1189906 - RNA, 22 nt, Human
uaggauuacaggccugagccac

SEQ ID NO: 1189907 - RNA, 23 nt, Human
uaggauuacaggccugagccacc

SEQ ID NO: 1189908 - RNA, 24 nt, Human
uaggauuacaggccugagccaccg

SEQ ID NO: 1189909 - RNA, 21 nt, Human
uaguagagacgggguuucacc

SEQ ID NO: 1189910 - RNA, 24 nt, Human
uaguagagacgggguuucaccgug

SEQ ID NO: 1189911 - RNA, 26 nt, Human
uaguagagacgggguuucaccguguu

SEQ ID NO: 1189912 - RNA, 26 nt, Human
uaguagagacgggguuucaccguugg

SEQ ID NO: 1189913 - RNA, 24 nt, Human
uaguagagauggaguuucagcaug

SEQ ID NO: 1189914 - RNA, 19 nt, Human
ucaagugauucuucugccu

SEQ ID NO: 1189915 - RNA, 23 nt, Human
ucacccaccacccccacacccac

SEQ ID NO: 1189916 - RNA, 24 nt, Human
ucaccguguuagccaggauggucu

SEQ ID NO: 1189917 - RNA, 23 nt, Human
ucacugcaaccuccgccuccugg

SEQ ID NO: 1189918 - RNA, 24 nt, Human
ucacugcaaccuccgccuccuggg

SEQ ID NO: 1189919 - RNA, 25 nt, Human
ucacugcaaccuccgccuccugggu

SEQ ID NO: 1189920 - RNA, 27 nt, Human
ucacugcaaccuccgccuccuggguuc

SEQ ID NO: 1189921 - RNA, 18 nt, Human
ucacugcaagcuccgccu

SEQ ID NO: 1189922 - RNA, 19 nt, Human
ucacugcaagcuccgccuc

SEQ ID NO: 1189923 - RNA, 24 nt, Human
ucacugcaagcuccgccucccggg

SEQ ID NO: 1189924 - RNA, 22 nt, Human
ucacugcugcugcacagcgugc

SEQ ID NO: 1189925 - RNA, 22 nt, Human
ucagccucacccacuagacgcg

SEQ ID NO: 1189926 - RNA, 20 nt, Human
ucagccuccugaguagcugg

SEQ ID NO: 1189927 - RNA, 19 nt, Human
ucagcugggagcagggaug

SEQ ID NO: 1189928 - RNA, 21 nt, Human
uccaggacucuggggccccga

SEQ ID NO: 1189929 - RNA, 25 nt, Human
uccagggccgcuaggaaaaggcccc

SEQ ID NO: 1189930 - RNA, 22 nt, Human
uccagggugauauugcgccuca

SEQ ID NO: 1189931 - RNA, 24 nt, Human
ucccaaagugcugggauuacaggc

SEQ ID NO: 1189932 - RNA, 24 nt, Human
ucccaaaguguuaggauuacaggc

SEQ ID NO: 1189933 - RNA, 22 nt, Human
ucccaggcacccuccuuccaga

SEQ ID NO: 1189934 - RNA, 21 nt, Human
ucccggguucccaucauucuc

SEQ ID NO: 1189935 - RNA, 24 nt, Human
ucccggguucccaucauucuccug

SEQ ID NO: 1189936 - RNA, 21 nt, Human
ucccucuggucuuuggaggcu

SEQ ID NO: 1189937 - RNA, 23 nt, Human
uccucuggguucuaucacacagg

SEQ ID NO: 1189938 - RNA, 18 nt, Human
uccugaguagcugggauu

SEQ ID NO: 1189939 - RNA, 21 nt, Human
uccuggguucaagugauucuu

SEQ ID NO: 1189940 - RNA, 24 nt, Human
uccuggguucaagugauucuucug

SEQ ID NO: 1189941 - RNA, 26 nt, Human
uccuuugggcagaugaagcuuccagu

SEQ ID NO: 1189942 - RNA, 24 nt, Human
ucgcccaggcuggagugcaguggc

SEQ ID NO: 1189943 - RNA, 24 nt, Human
ucgcucugucgcccaggcuggagu

SEQ ID NO: 1189944 - RNA, 23 nt, Human
ucggccuucugaguagcugggac

SEQ ID NO: 1189945 - RNA, 19 nt, Human
ucucgcucugucgcccagg

SEQ ID NO: 1189946 - RNA, 23 nt, Human
ucucgcucugucgcccaggcugg

SEQ ID NO: 1189947 - RNA, 24 nt, Human
ucucgcucugucgcccaggcugga

SEQ ID NO: 1189948 - RNA, 26 nt, Human
ucucgcucugucgcccaggcuggagu

SEQ ID NO: 1189949 - RNA, 27 nt, Human
ucucgcucugucgcccaggcuggagug

SEQ ID NO: 1189950 - RNA, 20 nt, Human
ucucggccucccaaagugcu

SEQ ID NO: 1189951 - RNA, 23 nt, Human
ucugaguagcugggacuacaggc

SEQ ID NO: 1189952 - RNA, 24 nt, Human
ucugaguagcugggacuacaggca

SEQ ID NO: 1189953 - RNA, 22 nt, Human
ucugcacagugcacuuccagga

SEQ ID NO: 1189954 - RNA, 22 nt, Human
ucuggcugugggguggcagguc

SEQ ID NO: 1189955 - RNA, 18 nt, Human
ucuguugcccaggcugga

SEQ ID NO: 1189956 - RNA, 22 nt, Human
ucuugcucuguugcccaggcug

SEQ ID NO: 1189957 - RNA, 22 nt, Human
ucuugcucuguugcccaggcug

SEQ ID NO: 1189958 - RNA, 23 nt, Human
ucuugcucuguugcccaggcugg

SEQ ID NO: 1189959 - RNA, 24 nt, Human
ucuugcucuguugcccaggcugga

SEQ ID NO: 1189960 - RNA, 25 nt, Human
ugaagucacccaccacccccacacc

SEQ ID NO: 1189961 - RNA, 18 nt, Human
ugacuuccugaaagcagg

SEQ ID NO: 1189962 - RNA, 22 nt, Human
ugagaccgagucuugcucuguu

SEQ ID NO: 1189963 - RNA, 22 nt, Human
ugagauggagucucgcucuguc

SEQ ID NO: 1189964 - RNA, 23 nt, Human
ugccagcugggcccggauauucu

SEQ ID NO: 1189965 - RNA, 18 nt, Human
ugcccaggcuggagugca

SEQ ID NO: 1189966 - RNA, 22 nt, Human
ugcccaggcuggagugcaguga

SEQ ID NO: 1189967 - RNA, 24 nt, Human
ugcccaggcuggagugcagugaug

SEQ ID NO: 1189968 - RNA, 24 nt, Human
ugccucagccuccugaguagcugg

SEQ ID NO: 1189969 - RNA, 18 nt, Human
ugcgccgccaucacaccu

SEQ ID NO: 1189970 - RNA, 24 nt, Human
ugcucuguugcccaggcuggagug

SEQ ID NO: 1189971 - RNA, 24 nt, Human
ugcugggauuacaggcaugaguca

SEQ ID NO: 1189972 - RNA, 24 nt, Human
uggagucucgcucugucgcccagg

SEQ ID NO: 1189973 - RNA, 18 nt, Human
uggagugcagugaugcaa

SEQ ID NO: 1189974 - RNA, 23 nt, Human
uggagugcaguggcgcgaucucg

SEQ ID NO: 1189975 - RNA, 24 nt, Human
uggagugcaguggcgcgaucucgg

SEQ ID NO: 1189976 - RNA, 24 nt, Human
uggaguuucagcauguuggcuagg

SEQ ID NO: 1189977 - RNA, 20 nt, Human
uggcagggaaaacaccagug

SEQ ID NO: 1189978 - RNA, 18 nt, Human
uggccuggggccagaaac

SEQ ID NO: 1189979 - RNA, 24 nt, Human
uggcuaggcuggucucaaacuccu

SEQ ID NO: 1189980 - RNA, 19 nt, Human
ugggacuacaggcagcccu

SEQ ID NO: 1189981 - RNA, 23 nt, Human
ugggacuacaggcagcccugcca

SEQ ID NO: 1189982 - RNA, 26 nt, Human
ugggacuacaggcagcccugccacca

SEQ ID NO: 1189983 - RNA, 18 nt, Human
ugggagcagggauggcac

SEQ ID NO: 1189984 - RNA, 22 nt, Human
ugggauggaaaggacccugcca

SEQ ID NO: 1189985 - RNA, 20 nt, Human
ugggauuacacgugugcgcc

SEQ ID NO: 1189986 - RNA, 21 nt, Human
ugggauuacacgugugcgccg

SEQ ID NO: 1189987 - RNA, 22 nt, Human
ugggauuacacgugugcgccgc

SEQ ID NO: 1189988 - RNA, 24 nt, Human
ugggauuacacgugugcgccgcca

SEQ ID NO: 1189989 - RNA, 18 nt, Human
ugggauuacaggcaugag

SEQ ID NO: 1189990 - RNA, 18 nt, Human
ugggauuacaggcaugag

SEQ ID NO: 1189991 - RNA, 21 nt, Human
ugggauuacaggcaugaguca

SEQ ID NO: 1189992 - RNA, 22 nt, Human
ugggauuacaggcaugagucac

SEQ ID NO: 1189993 - RNA, 23 nt, Human
ugggauuacaggcaugagucacc

SEQ ID NO: 1189994 - RNA, 24 nt, Human
ugggauuacaggcaugagucaccg

SEQ ID NO: 1189995 - RNA, 25 nt, Human
uggguccagaggucuagggagaauu

SEQ ID NO: 1189996 - RNA, 20 nt, Human
uggguucaagugauucuucu

SEQ ID NO: 1189997 - RNA, 23 nt, Human
uggguucaagugauucuucugcc

SEQ ID NO: 1189998 - RNA, 24 nt, Human
uggguucaagugauucuucugccu

SEQ ID NO: 1189999 - RNA, 21 nt, Human
ugucgcccaggcuggagugca

SEQ ID NO: 1190000 - RNA, 20 nt, Human
ugugggguggcaggucugag

SEQ ID NO: 1190001 - RNA, 21 nt, Human
uguugcccaggcuggagugca

SEQ ID NO: 1190002 - RNA, 18 nt, Human
uuaguagagacgggguuu

SEQ ID NO: 1190003 - RNA, 22 nt, Human
uuaguagagacgggguuucacc

SEQ ID NO: 1190004 - RNA, 24 nt, Human
uuaguagagacgggguuucaccgu

SEQ ID NO: 1190005 - RNA, 18 nt, Human
uuaguagagauggaguuu

SEQ ID NO: 1190006 - RNA, 24 nt, Human
uuaguagagauggaguuucagcau

SEQ ID NO: 1190007 - RNA, 23 nt, Human
uucaagugauucuucugccucag

SEQ ID NO: 1190008 - RNA, 24 nt, Human
uucaagugauucuucugccucagc

SEQ ID NO: 1190009 - RNA, 21 nt, Human
uucaucugcugcucagaacca

SEQ ID NO: 1190010 - RNA, 24 nt, Human
uucugaguagcugggacuacaggc

SEQ ID NO: 1190011 - RNA, 24 nt, Human
uugcccaggcuggagugcagugau

SEQ ID NO: 1190012 - RNA, 20 nt, Human
uuggccucccaaaguguuag

SEQ ID NO: 1190013 - RNA, 23 nt, Human
uuguauuuuuaguagagacgggg

SEQ ID NO: 1190014 - RNA, 23 nt, Human
uuguauuuuuaguagagauggag

SEQ ID NO: 1190015 - RNA, 19 nt, Human
uuucaccguguuagccagg

SEQ ID NO: 1190016 - RNA, 24 nt, Human
uuucagcauguuggcuaggcuggu

SEQ ID NO: 1190017 - RNA, 22 nt, Human
uuugggcagaugaagcuuccag

SEQ ID NO: 1190018 - RNA, 24 nt, Human
uuuuuaguagagacgggguuucac

SEQ ID NO: 1190019 - RNA, 19 nt, Human
uuuuuaguagagauggagu

SEQ ID NO: 1190020 - RNA, 20 nt, Human
uuuuuguauuuuuaguagag

SEQ ID NO: 1190021 - RNA, 21 nt, Human
uuuuuguauuuuuaguagaga

SEQ ID NO: 1190022 - RNA, 24 nt, Human
uuuuuuguauuuuuaguagagacg

SEQ ID NO: 1190023 - RNA, 22 nt, Human
aaaaaaacaaaccaagcaacaa

SEQ ID NO: 1190024 - RNA, 23 nt, Human
aaaaaaacaaaccaagcaacaaa

SEQ ID NO: 1190025 - RNA, 24 nt, Human
aaaaacaaaccaagcaacaaaaac

SEQ ID NO: 1190026 - RNA, 24 nt, Human
aaaaaccacaaccgagagcccgaa

SEQ ID NO: 1190027 - RNA, 22 nt, Human
aaaaagcaggcagugcuguguu

SEQ ID NO: 1190028 - RNA, 19 nt, Human
aaacaaaccaagcaacaaa

SEQ ID NO: 1190029 - RNA, 23 nt, Human
aaacaaaccaagcaacaaaaaca

SEQ ID NO: 1190030 - RNA, 19 nt, Human
aaaccacaaccgagagccc

SEQ ID NO: 1190031 - RNA, 23 nt, Human
aaaccagaagcagaagcugagga

SEQ ID NO: 1190032 - RNA, 21 nt, Human
aacggccucuggccuccaggc

SEQ ID NO: 1190033 - RNA, 18 nt, Human
aagaaaaaaacaaaccaa

SEQ ID NO: 1190034 - RNA, 23 nt, Human
aagaagccaggcgcggccggcca

SEQ ID NO: 1190035 - RNA, 20 nt, Human
aagcaacaaaaacaaaaagc

SEQ ID NO: 1190036 - RNA, 21 nt, Human
aagcaacaaaaacaaaaagca

SEQ ID NO: 1190037 - RNA, 18 nt, Human
aagccucuuggaguugcc

SEQ ID NO: 1190038 - RNA, 24 nt, Human
aaguaaaagauaaaaacucuaaga

SEQ ID NO: 1190039 - RNA, 18 nt, Human
aaguaucuauuugucuau

SEQ ID NO: 1190040 - RNA, 20 nt, Human
acaaaccaagcaacaaaaac

SEQ ID NO: 1190041 - RNA, 22 nt, Human
acaaaccaagcaacaaaaacaa

SEQ ID NO: 1190042 - RNA, 25 nt, Human
acaaaccaagcaacaaaaacaaaaa

SEQ ID NO: 1190043 - RNA, 18 nt, Human
acagacacaugggugugg

SEQ ID NO: 1190044 - RNA, 20 nt, Human
acucugaaaccagaagcaga

SEQ ID NO: 1190045 - RNA, 26 nt, Human
agaaaaaaacaaaccaagcaacaaaa

SEQ ID NO: 1190046 - RNA, 18 nt, Human
agcaguaucccuacugac

SEQ ID NO: 1190047 - RNA, 22 nt, Human
agcggcggccgaccggccugag

SEQ ID NO: 1190048 - RNA, 18 nt, Human
agcuggccaaugcccagu

SEQ ID NO: 1190049 - RNA, 19 nt, Human
agcuuuaaaacacccucca

SEQ ID NO: 1190050 - RNA, 19 nt, Human
agguguaaaaaccacaacc

SEQ ID NO: 1190051 - RNA, 26 nt, Human
agguguaaaaaccacaaccgagagcc

SEQ ID NO: 1190052 - RNA, 19 nt, Human
auagagagaacucugaaac

SEQ ID NO: 1190053 - RNA, 23 nt, Human
auccccuuuuccucuuuuuuucu

SEQ ID NO: 1190054 - RNA, 24 nt, Human
aucccgcucucccggaccccgcag

SEQ ID NO: 1190055 - RNA, 21 nt, Human
aucugaaggcccuccaugaga

SEQ ID NO: 1190056 - RNA, 19 nt, Human
caacuccgggccuccgccu

SEQ ID NO: 1190057 - RNA, 18 nt, Human
caacugaguacugucuuu

SEQ ID NO: 1190058 - RNA, 22 nt, Human
caagcaacaaaaacaaaaagca

SEQ ID NO: 1190059 - RNA, 19 nt, Human
cacaaccgagagcccgaag

SEQ ID NO: 1190060 - RNA, 20 nt, Human
cagaagcagaagcugaggaa

SEQ ID NO: 1190061 - RNA, 23 nt, Human
caggcgagcucuuccccaggacc

SEQ ID NO: 1190062 - RNA, 24 nt, Human
caucccgcucucccggaccccgca

SEQ ID NO: 1190063 - RNA, 25 nt, Human
ccaagcaacaaaaacaaaaagcagg

SEQ ID NO: 1190064 - RNA, 22 nt, Human
ccaaugcccaguauacaccagg

SEQ ID NO: 1190065 - RNA, 21 nt, Human
ccacaaccgagagcccgaagc

SEQ ID NO: 1190066 - RNA, 22 nt, Human
cccaguagcuggccaaugccca

SEQ ID NO: 1190067 - RNA, 18 nt, Human
ccccuuuuccucuuuuuu

SEQ ID NO: 1190068 - RNA, 25 nt, Human
ccccuuuuccucuuuuuuucuaugc

SEQ ID NO: 1190069 - RNA, 21 nt, Human
cccgucccggcccaacuccgg

SEQ ID NO: 1190070 - RNA, 20 nt, Human
ccgccuccgccgccgccucc

SEQ ID NO: 1190071 - RNA, 21 nt, Human
ccgccuccgccgccgccuccg

SEQ ID NO: 1190072 - RNA, 26 nt, Human
ccgggccuccgccuccgccgccgccu

SEQ ID NO: 1190073 - RNA, 20 nt, Human
ccgucccggcccaacuccgg

SEQ ID NO: 1190074 - RNA, 18 nt, Human
ccuagagagucuauagca

SEQ ID NO: 1190075 - RNA, 19 nt, Human
ccucaggagcaggcgagcu

SEQ ID NO: 1190076 - RNA, 22 nt, Human
ccuccaggcgcugccugcuccg

SEQ ID NO: 1190077 - RNA, 22 nt, Human
ccucccggaucccgucccggcc

SEQ ID NO: 1190078 - RNA, 18 nt, Human
ccuccgccgccgccuccg

SEQ ID NO: 1190079 - RNA, 19 nt, Human
ccucuuggaguugccuaga

SEQ ID NO: 1190080 - RNA, 18 nt, Human
ccugucaguuuguccauu

SEQ ID NO: 1190081 - RNA, 21 nt, Human
ccuuccugcucuuuccaagaa

SEQ ID NO: 1190082 - RNA, 20 nt, Human
ccuuugguguucugcuggug

SEQ ID NO: 1190083 - RNA, 21 nt, Human
cgcaggggaggggagcggcgg

SEQ ID NO: 1190084 - RNA, 20 nt, Human
cggccgaccggccugaggcg

SEQ ID NO: 1190085 - RNA, 20 nt, Human
cgguaagaaaaaaacaaacc

SEQ ID NO: 1190086 - RNA, 18 nt, Human
cuccuuccugcucuuucc

SEQ ID NO: 1190087 - RNA, 23 nt, Human
gagaacaacucuucucuuccaca

SEQ ID NO: 1190088 - RNA, 19 nt, Human
gagcaccugccgcggaacu

SEQ ID NO: 1190089 - RNA, 22 nt, Human
gagcaggcgagcucuuccccag

SEQ ID NO: 1190090 - RNA, 23 nt, Human
gcaacaaaaacaaaaagcaggca

SEQ ID NO: 1190091 - RNA, 21 nt, Human
gccuccgccuccgccgccgcc

SEQ ID NO: 1190092 - RNA, 21 nt, Human
ggaccccgcagucaggacccu

SEQ ID NO: 1190093 - RNA, 18 nt, Human
ggccagcaucccgcucuc

SEQ ID NO: 1190094 - RNA, 20 nt, Human
ggcccagaguggugcgagcc

SEQ ID NO: 1190095 - RNA, 19 nt, Human
ggccggccagcaucccgcu

SEQ ID NO: 1190096 - RNA, 21 nt, Human
ggcgcaggggaggggagcggc

SEQ ID NO: 1190097 - RNA, 22 nt, Human
ggcggccucucuggcccugccg

SEQ ID NO: 1190098 - RNA, 19 nt, Human
gguacuuaguuacacaggu

SEQ ID NO: 1190099 - RNA, 22 nt, Human
uaaaauauaguuuacuucaaaa

SEQ ID NO: 1190100 - RNA, 26 nt, Human
uaagaaaaaaacaaaccaagcaacaa

SEQ ID NO: 1190101 - RNA, 19 nt, Human
uaagaaccuaugaagcgcc

SEQ ID NO: 1190102 - RNA, 22 nt, Human
uacagucaggaccgacagacac

SEQ ID NO: 1190103 - RNA, 24 nt, Human
uaccuguggaauucagaugggauu

SEQ ID NO: 1190104 - RNA, 19 nt, Human
uagcagcucucacugccca

SEQ ID NO: 1190105 - RNA, 23 nt, Human
ucaggagcaggcgagcucuuccc

SEQ ID NO: 1190106 - RNA, 24 nt, Human
ucaucugaaggcccuccaugagaa

SEQ ID NO: 1190107 - RNA, 22 nt, Human
uccauagcagcucucacugccc

SEQ ID NO: 1190108 - RNA, 21 nt, Human
ucccggaucccgucccggccc

SEQ ID NO: 1190109 - RNA, 22 nt, Human
ucccggcccaacuccgggccuc

SEQ ID NO: 1190110 - RNA, 20 nt, Human
ucccgucccggcccaacucc

SEQ ID NO: 1190111 - RNA, 20 nt, Human
ucccucaggagcaggcgagc

SEQ ID NO: 1190112 - RNA, 22 nt, Human
uccuuugguguucugcuggugc

SEQ ID NO: 1190113 - RNA, 19 nt, Human
ucuaagaaccuaugaagcg

SEQ ID NO: 1190114 - RNA, 21 nt, Human
ucuccauauccccaguagcug

SEQ ID NO: 1190115 - RNA, 22 nt, Human
ucucuuccacauagauauuuuu

SEQ ID NO: 1190116 - RNA, 21 nt, Human
ucugaaaccagaagcagaagc

SEQ ID NO: 1190117 - RNA, 20 nt, Human
ugaaaccagaagcagaagcu

SEQ ID NO: 1190118 - RNA, 22 nt, Human
ugaaaccagaagcagaagcuga

SEQ ID NO: 1190119 - RNA, 23 nt, Human
ugaaaccagaagcagaagcugag

SEQ ID NO: 1190120 - RNA, 19 nt, Human
ugagaacaacucuucucuu

SEQ ID NO: 1190121 - RNA, 19 nt, Human
ugcucuuuccaagaagcca

SEQ ID NO: 1190122 - RNA, 19 nt, Human
uggcccugccgggaacagg

SEQ ID NO: 1190123 - RNA, 19 nt, Human
uggccuccaggcgcugccu

SEQ ID NO: 1190124 - RNA, 22 nt, Human
ugggaugagcaccugccgcgga

SEQ ID NO: 1190125 - RNA, 19 nt, Human
ugguacagucaggaccgac

SEQ ID NO: 1190126 - RNA, 25 nt, Human
uguuuucuucaucuccauaucccca

SEQ ID NO: 1190127 - RNA, 23 nt, Human
uuagacugaaaguaaaagauaaa

SEQ ID NO: 1190128 - RNA, 28 nt, Human
uugacucuacucugacuuaggacauauu

SEQ ID NO: 1190129 - RNA, 18 nt, Human
aaacaggcagaaugccau

SEQ ID NO: 1190130 - RNA, 22 nt, Human
aaaggacaaggacuggggggca

SEQ ID NO: 1190131 - RNA, 23 nt, Human
aagauauauccucagacaaagaa

SEQ ID NO: 1190132 - RNA, 18 nt, Human
aaguguuggaagcagcac

SEQ ID NO: 1190133 - RNA, 19 nt, Human
acccaucuuaucuccccca

SEQ ID NO: 1190134 - RNA, 20 nt, Human
acuucaggaacagagagagg

SEQ ID NO: 1190135 - RNA, 25 nt, Human
agaaacaggcagaaugccauaccug

SEQ ID NO: 1190136 - RNA, 18 nt, Human
agagaggaagagaggaag

SEQ ID NO: 1190137 - RNA, 18 nt, Human
agagcacauguccaaaca

SEQ ID NO: 1190138 - RNA, 22 nt, Human
agaggaagagaggaagcaagag

SEQ ID NO: 1190139 - RNA, 19 nt, Human
agccacgucugaagaaauc

SEQ ID NO: 1190140 - RNA, 18 nt, Human
agcugccugcuugugaag

SEQ ID NO: 1190141 - RNA, 23 nt, Human
aucucccccagaccccugucuac

SEQ ID NO: 1190142 - RNA, 23 nt, Human
aucuuaucucccccagaccccug

SEQ ID NO: 1190143 - RNA, 23 nt, Human
cacacuucaggaacagagagagg

SEQ ID NO: 1190144 - RNA, 22 nt, Human
caccacccaucuuaucuccccc

SEQ ID NO: 1190145 - RNA, 27 nt, Human
cacccaucuuaucucccccagaccccu

SEQ ID NO: 1190146 - RNA, 18 nt, Human
cacugcuaaaggacaagg

SEQ ID NO: 1190147 - RNA, 19 nt, Human
cacuucaggaacagagaga

SEQ ID NO: 1190148 - RNA, 18 nt, Human
cagaaugccauaccugac

SEQ ID NO: 1190149 - RNA, 19 nt, Human
cagaccccugucuaccccu

SEQ ID NO: 1190150 - RNA, 19 nt, Human
cagcugccugcuugugaag

SEQ ID NO: 1190151 - RNA, 23 nt, Human
ccacccaucuuaucucccccaga

SEQ ID NO: 1190152 - RNA, 22 nt, Human
cccaccaacacaacuuccuaca

SEQ ID NO: 1190153 - RNA, 23 nt, Human
ccgcaugauagcuacuggcuucu

SEQ ID NO: 1190154 - RNA, 22 nt, Human
ccuugugauucaccuuacucuc

SEQ ID NO: 1190155 - RNA, 25 nt, Human
gccuugugauucaccuuacucucgg

SEQ ID NO: 1190156 - RNA, 25 nt, Human
gcuaaaggacaaggacuggggggca

SEQ ID NO: 1190157 - RNA, 25 nt, Human
ggcacuguuuugcggucuaaauggg

SEQ ID NO: 1190158 - RNA, 19 nt, Human
ggggaaguguuggaagcag

SEQ ID NO: 1190159 - RNA, 21 nt, Human
uaaccugaucaaacacaucaa

SEQ ID NO: 1190160 - RNA, 22 nt, Human
uaagaaauaaacgaaaacugcc

SEQ ID NO: 1190161 - RNA, 21 nt, Human
uaagcuucagaaacaggcaga

SEQ ID NO: 1190162 - RNA, 25 nt, Human
uacacuaccugggagacagguugaa

SEQ ID NO: 1190163 - RNA, 23 nt, Human
uacugccaagauauauccucaga

SEQ ID NO: 1190164 - RNA, 22 nt, Human
uaucucccccagaccccugucu

SEQ ID NO: 1190165 - RNA, 19 nt, Human
ucaaugccaaauagagaga

SEQ ID NO: 1190166 - RNA, 21 nt, Human
uccaaacagaggaaugacaca

SEQ ID NO: 1190167 - RNA, 24 nt, Human
ucccccagaccccugucuaccccc

SEQ ID NO: 1190168 - RNA, 25 nt, Human
uccuguacugccaagauauauccuc

SEQ ID NO: 1190169 - RNA, 21 nt, Human
ucucccccagaccccugucua

SEQ ID NO: 1190170 - RNA, 18 nt, Human
ugaaaaagugauggcuag

SEQ ID NO: 1190171 - RNA, 20 nt, Human
ugacagguacacuaccuggg

SEQ ID NO: 1190172 - RNA, 25 nt, Human
ugacagguacacuaccugggagaca

SEQ ID NO: 1190173 - RNA, 19 nt, Human
ugcuguuggucaucuucac

SEQ ID NO: 1190174 - RNA, 21 nt, Human
ugcuugugaagcccaccaaca

SEQ ID NO: 1190175 - RNA, 19 nt, Human
uuccugaaaaagugauggc

SEQ ID NO: 1190176 - RNA, 24 nt, Human
aaaaguacuguguaauuucuaaau

SEQ ID NO: 1190177 - RNA, 18 nt, Human
acccugcacgccaccgcc

SEQ ID NO: 1190178 - RNA, 18 nt, Human
caccuggagcggcugacu

SEQ ID NO: 1190179 - RNA, 18 nt, Human
cacgcgcgccagcccggg

SEQ ID NO: 1190180 - RNA, 20 nt, Human
ccagcccgggagaccucacc

SEQ ID NO: 1190181 - RNA, 20 nt, Human
cccugcacgccaccgccccg

SEQ ID NO: 1190182 - RNA, 23 nt, Human
cgacuccuagaccccaaccaccu

SEQ ID NO: 1190183 - RNA, 19 nt, Human
cuccuagaccccaaccacc

SEQ ID NO: 1190184 - RNA, 25 nt, Human
cucuggaaguggugaagguuuuuug

SEQ ID NO: 1190185 - RNA, 20 nt, Human
cuggaaguggugaagguuuu

SEQ ID NO: 1190186 - RNA, 22 nt, Human
cuggaaguggugaagguuuuuu

SEQ ID NO: 1190187 - RNA, 18 nt, Human
cuguugcccuccuggagc

SEQ ID NO: 1190188 - RNA, 18 nt, Human
gaaguggugaagguuuuu

SEQ ID NO: 1190189 - RNA, 21 nt, Human
ggaaguggugaagguuuuuug

SEQ ID NO: 1190190 - RNA, 19 nt, Human
uagcgcgagguagcagcag

SEQ ID NO: 1190191 - RNA, 23 nt, Human
ucagagcaucgccagcugcagcc

SEQ ID NO: 1190192 - RNA, 30 nt, Human
uccgcaguccagacuuaagcaccuggagcc

SEQ ID NO: 1190193 - RNA, 18 nt, Human
uccugucgucuguugccc

SEQ ID NO: 1190194 - RNA, 19 nt, Human
ugacugggccccaggaagc

SEQ ID NO: 1190195 - RNA, 27 nt, Human
ugcacgccaccgccccggccuccgcag

SEQ ID NO: 1190196 - RNA, 25 nt, Human
ugggccccaggaagcugcggggucc

SEQ ID NO: 1190197 - RNA, 18 nt, Human
aagagaaaggcaggggcg

SEQ ID NO: 1190198 - RNA, 22 nt, Human
acagggccugauggaggaagag

SEQ ID NO: 1190199 - RNA, 19 nt, Human
aggcaggggcgggcacagg

SEQ ID NO: 1190200 - RNA, 19 nt, Human
aggcaggggcgggcacagg

SEQ ID NO: 1190201 - RNA, 21 nt, Human
aggcaggggcgggcacagggu

SEQ ID NO: 1190202 - RNA, 22 nt, Human
aggcaggggcgggcacagggug

SEQ ID NO: 1190203 - RNA, 22 nt, Human
agguugccagcauacagggccu

SEQ ID NO: 1190204 - RNA, 19 nt, Human
aucucucuggaaagcaggu

SEQ ID NO: 1190205 - RNA, 20 nt, Human
cagaagacgucucuggucug

SEQ ID NO: 1190206 - RNA, 21 nt, Human
cagaagacgucucuggucugu

SEQ ID NO: 1190207 - RNA, 21 nt, Human
caggguggaauugacaaccgu

SEQ ID NO: 1190208 - RNA, 18 nt, Human
cccacaugugagacuaca

SEQ ID NO: 1190209 - RNA, 23 nt, Human
cccacaugugagacuacauggac

SEQ ID NO: 1190210 - RNA, 21 nt, Human
cuguaggccgaccccacaugu

SEQ ID NO: 1190211 - RNA, 18 nt, Human
guggauggccgcccgggc

SEQ ID NO: 1190212 - RNA, 22 nt, Human
ucucuggaaagcagguggcugc

SEQ ID NO: 1190213 - RNA, 27 nt, Human
ucucuggaaagcagguggcugcagaag

SEQ ID NO: 1190214 - RNA, 18 nt, Human
uggaggaagagaaaggca

SEQ ID NO: 1190215 - RNA, 24 nt, Human
uggcugcagaagacgucucugguc

SEQ ID NO: 1190216 - RNA, 23 nt, Human
aaacaccacugcuucaacaaucc

SEQ ID NO: 1190217 - RNA, 18 nt, Human
aaagaaacagaacuauca

SEQ ID NO: 1190218 - RNA, 22 nt, Human
aaccacagguuuggaaaguucu

SEQ ID NO: 1190219 - RNA, 23 nt, Human
aagugggggcgggacggcagcgc

SEQ ID NO: 1190220 - RNA, 22 nt, Human
aaguuuaccaucagcauacagu

SEQ ID NO: 1190221 - RNA, 19 nt, Human
acacgccagcaagcagagu

SEQ ID NO: 1190222 - RNA, 23 nt, Human
acauuccguucuugcccaaugca

SEQ ID NO: 1190223 - RNA, 22 nt, Human
accgcccccgccgccgucgccg

SEQ ID NO: 1190224 - RNA, 21 nt, Human
acuguaacacgccagcaagca

SEQ ID NO: 1190225 - RNA, 19 nt, Human
agagcacuguaacacgcca

SEQ ID NO: 1190226 - RNA, 19 nt, Human
agauaguauggaccuccag

SEQ ID NO: 1190227 - RNA, 20 nt, Human
agauuucuaacauuccguuc

SEQ ID NO: 1190228 - RNA, 20 nt, Human
aguaagauggauacucacua

SEQ ID NO: 1190229 - RNA, 21 nt, Human
caacaaggugacugucacaca

SEQ ID NO: 1190230 - RNA, 24 nt, Human
caagagaagcggaaugucuucuca

SEQ ID NO: 1190231 - RNA, 23 nt, Human
cagucaauggugcauuucagagc

SEQ ID NO: 1190232 - RNA, 23 nt, Human
cauuaccgcccccgccgccgucg

SEQ ID NO: 1190233 - RNA, 19 nt, Human
ccaagaauaugaguucaac

SEQ ID NO: 1190234 - RNA, 18 nt, Human
ccagauacccaaaugaga

SEQ ID NO: 1190235 - RNA, 19 nt, Human
ccccgccgccgucgccgcc

SEQ ID NO: 1190236 - RNA, 27 nt, Human
ccgcccccgccgccgucgccgccgccg

SEQ ID NO: 1190237 - RNA, 25 nt, Human
ccgccgacgccgccgacgccgccgc

SEQ ID NO: 1190238 - RNA, 27 nt, Human
ccgccgacgccgccgacgccgccgcuc

SEQ ID NO: 1190239 - RNA, 18 nt, Human
ccgccgccgucgccgccg

SEQ ID NO: 1190240 - RNA, 24 nt, Human
ccgccgccgucgccgccgccgccg

SEQ ID NO: 1190241 - RNA, 22 nt, Human
ccgccgucgccgccgccgccga

SEQ ID NO: 1190242 - RNA, 23 nt, Human
ccgccgucgccgccgccgccgac

SEQ ID NO: 1190243 - RNA, 19 nt, Human
ccucccgcuccgcuugggg

SEQ ID NO: 1190244 - RNA, 23 nt, Human
ccucuuacacgguccuuaacaaa

SEQ ID NO: 1190245 - RNA, 22 nt, Human
ccuucgaccgaucggaaguggg

SEQ ID NO: 1190246 - RNA, 22 nt, Human
ccuucugcaaacugaggaucug

SEQ ID NO: 1190247 - RNA, 23 nt, Human
ccuucugcaaacugaggaucuga

SEQ ID NO: 1190248 - RNA, 26 nt, Human
cgaagcccucggccuucauccccaca

SEQ ID NO: 1190249 - RNA, 25 nt, Human
cgccgccgccgacgccgccgacgcc

SEQ ID NO: 1190250 - RNA, 22 nt, Human
cggcuccccgguccggccuccc

SEQ ID NO: 1190251 - RNA, 22 nt, Human
cgucgccgccgccgccgacgcc

SEQ ID NO: 1190252 - RNA, 22 nt, Human
cuacaggccuucugcaaacuga

SEQ ID NO: 1190253 - RNA, 23 nt, Human
cucggcuccccgguccggccucc

SEQ ID NO: 1190254 - RNA, 18 nt, Human
cuggagcagguuguccaa

SEQ ID NO: 1190255 - RNA, 23 nt, Human
cuggagcagguuguccaagaaua

SEQ ID NO: 1190256 - RNA, 18 nt, Human
cuuacagcccugucucca

SEQ ID NO: 1190257 - RNA, 20 nt, Human
cuuccggcggaagggaaagc

SEQ ID NO: 1190258 - RNA, 20 nt, Human
cuuucugccggacccggugc

SEQ ID NO: 1190259 - RNA, 21 nt, Human
gaaggggagcuggguggcaug

SEQ ID NO: 1190260 - RNA, 22 nt, Human
gaccauaucuucaagcgcccga

SEQ ID NO: 1190261 - RNA, 21 nt, Human
gaggaugggccaccgccacuu

SEQ ID NO: 1190262 - RNA, 23 nt, Human
gagucgcgucugcggggcggggu

SEQ ID NO: 1190263 - RNA, 24 nt, Human
gccgccgccgacgccgccgacgcc

SEQ ID NO: 1190264 - RNA, 19 nt, Human
ggugaugcccccaggagag

SEQ ID NO: 1190265 - RNA, 20 nt, Human
gugggggcgggacggcagcg

SEQ ID NO: 1190266 - RNA, 22 nt, Human
guuugcaugaggaugggccacc

SEQ ID NO: 1190267 - RNA, 22 nt, Human
uaaacaccacugcuucaacaau

SEQ ID NO: 1190268 - RNA, 25 nt, Human
uaaaguaacaauucaucagauaaaa

SEQ ID NO: 1190269 - RNA, 18 nt, Human
uaacacgccagcaagcag

SEQ ID NO: 1190270 - RNA, 21 nt, Human
uaacacgccagcaagcagagu

SEQ ID NO: 1190271 - RNA, 19 nt, Human
uaagauggauacucacuac

SEQ ID NO: 1190272 - RNA, 23 nt, Human
uacaauaaaccuaaaauuaccca

SEQ ID NO: 1190273 - RNA, 24 nt, Human
uacaauaaaccuaaaauuacccac

SEQ ID NO: 1190274 - RNA, 20 nt, Human
uacccaaaugagauccuuac

SEQ ID NO: 1190275 - RNA, 22 nt, Human
uaguaaacaccacugcuucaac

SEQ ID NO: 1190276 - RNA, 22 nt, Human
uaguaguaaacaccacugcuuc

SEQ ID NO: 1190277 - RNA, 24 nt, Human
uauacaauaaaccuaaaauuaccc

SEQ ID NO: 1190278 - RNA, 24 nt, Human
uauuaguagccagugagaaacaag

SEQ ID NO: 1190279 - RNA, 18 nt, Human
ucaaaauucacuuuaugu

SEQ ID NO: 1190280 - RNA, 24 nt, Human
ucacaucucuguaacaugcugugu

SEQ ID NO: 1190281 - RNA, 23 nt, Human
ucccgcuccgcuuggggacccgu

SEQ ID NO: 1190282 - RNA, 21 nt, Human
ucgccgccgccgccgacgccg

SEQ ID NO: 1190283 - RNA, 24 nt, Human
ucgccgccgccgccgacgccgccg

SEQ ID NO: 1190284 - RNA, 21 nt, Human
ucuauauacaauaaaccuaaa

SEQ ID NO: 1190285 - RNA, 20 nt, Human
ucuccauugggcuuauuacu

SEQ ID NO: 1190286 - RNA, 18 nt, Human
ugaaaagccagcguggug

SEQ ID NO: 1190287 - RNA, 19 nt, Human
ugaaaagccagcguggugu

SEQ ID NO: 1190288 - RNA, 24 nt, Human
ugcccaaugcaaaucuauauacaa

SEQ ID NO: 1190289 - RNA, 19 nt, Human
ugccggacccggugcaggg

SEQ ID NO: 1190290 - RNA, 19 nt, Human
uggaaagagauguaaagac

SEQ ID NO: 1190291 - RNA, 22 nt, Human
uggaaaguucugggauccaaua

SEQ ID NO: 1190292 - RNA, 21 nt, Human
uggaaggggagcuggguggca

SEQ ID NO: 1190293 - RNA, 23 nt, Human
uggaccuccagcuguuaacauuc

SEQ ID NO: 1190294 - RNA, 19 nt, Human
uggcucaagagaagcggaa

SEQ ID NO: 1190295 - RNA, 22 nt, Human
uggugcauuucagagcugagaa

SEQ ID NO: 1190296 - RNA, 19 nt, Human
ugguggaaggggagcuggg

SEQ ID NO: 1190297 - RNA, 21 nt, Human
ugguggaaggggagcugggug

SEQ ID NO: 1190298 - RNA, 19 nt, Human
uguaacaugcuguguauau

SEQ ID NO: 1190299 - RNA, 19 nt, Human
ugucuggugaugcccccag

SEQ ID NO: 1190300 - RNA, 21 nt, Human
uguguauauaacaaagaaaca

SEQ ID NO: 1190301 - RNA, 19 nt, Human
uuaguucuguuuaaugggg

SEQ ID NO: 1190302 - RNA, 18 nt, Human
uuccgccugggguugucu

SEQ ID NO: 1190303 - RNA, 26 nt, Human
uuuuagguggaaccacagguuuggaa

SEQ ID NO: 1190304 - RNA, 25 nt, Human
aaaaaaccuaaaugaucaacagaug

SEQ ID NO: 1190305 - RNA, 20 nt, Human
aaaggaacagacgagccacg

SEQ ID NO: 1190306 - RNA, 20 nt, Human
aagaacaaggcagacagagc

SEQ ID NO: 1190307 - RNA, 18 nt, Human
aagacugauucccacaac

SEQ ID NO: 1190308 - RNA, 19 nt, Human
aagagaccccaccucuauc

SEQ ID NO: 1190309 - RNA, 18 nt, Human
aagaugcuccccagaauc

SEQ ID NO: 1190310 - RNA, 21 nt, Human
aagcacaguuagacccugcug

SEQ ID NO: 1190311 - RNA, 21 nt, Human
aagcgccccacaagccuugcc

SEQ ID NO: 1190312 - RNA, 24 nt, Human
aaggacucaaagugacaugguggu

SEQ ID NO: 1190313 - RNA, 19 nt, Human
aaggcagacagagcugugg

SEQ ID NO: 1190314 - RNA, 26 nt, Human
acccgcccgggccccccaaaggaaca

SEQ ID NO: 1190315 - RNA, 19 nt, Human
acccugagggaccauucgg

SEQ ID NO: 1190316 - RNA, 22 nt, Human
aggaggauggaaacagcaucug

SEQ ID NO: 1190317 - RNA, 21 nt, Human
aggcugcagcauggcacuggc

SEQ ID NO: 1190318 - RNA, 22 nt, Human
caacccgcccgggccccccaaa

SEQ ID NO: 1190319 - RNA, 20 nt, Human
caagcccaagaacaaggcag

SEQ ID NO: 1190320 - RNA, 21 nt, Human
cacaacccgcccgggcccccc

SEQ ID NO: 1190321 - RNA, 23 nt, Human
cacaacccgcccgggccccccaa

SEQ ID NO: 1190322 - RNA, 24 nt, Human
cacaacccgcccgggccccccaaa

SEQ ID NO: 1190323 - RNA, 19 nt, Human
cacagggggcugccugcca

SEQ ID NO: 1190324 - RNA, 19 nt, Human
caccaagggcucccaguga

SEQ ID NO: 1190325 - RNA, 22 nt, Human
cacccgaccacagacacgguuc

SEQ ID NO: 1190326 - RNA, 24 nt, Human
caccucuauccagcucaagcccaa

SEQ ID NO: 1190327 - RNA, 21 nt, Human
cagaacaccaagggcucccag

SEQ ID NO: 1190328 - RNA, 23 nt, Human
cagaacaccaagggcucccagug

SEQ ID NO: 1190329 - RNA, 21 nt, Human
cagacacgguucugccugcug

SEQ ID NO: 1190330 - RNA, 18 nt, Human
cagcauggcacuggcauu

SEQ ID NO: 1190331 - RNA, 20 nt, Human
cagcucaagcccaagaacaa

SEQ ID NO: 1190332 - RNA, 19 nt, Human
caggcuuagggggcacagg

SEQ ID NO: 1190333 - RNA, 18 nt, Human
cagggucuguucugaauu

SEQ ID NO: 1190334 - RNA, 22 nt, Human
caggucagacauggugugugcc

SEQ ID NO: 1190335 - RNA, 19 nt, Human
ccaaaggaacagacgagcc

SEQ ID NO: 1190336 - RNA, 23 nt, Human
ccacaccccgacaccugcaggug

SEQ ID NO: 1190337 - RNA, 19 nt, Human
ccacggaaccaggcggcac

SEQ ID NO: 1190338 - RNA, 19 nt, Human
ccagcucaagcccaagaac

SEQ ID NO: 1190339 - RNA, 20 nt, Human
ccagggccaggcuuaggggg

SEQ ID NO: 1190340 - RNA, 21 nt, Human
ccaugaaggacucaaagugac

SEQ ID NO: 1190341 - RNA, 20 nt, Human
cccaaaggaacagacgagcc

SEQ ID NO: 1190342 - RNA, 23 nt, Human
cccacaacccgcccgggcccccc

SEQ ID NO: 1190343 - RNA, 25 nt, Human
cccaccucuauccagcucaagccca

SEQ ID NO: 1190344 - RNA, 18 nt, Human
ccccacaagccuugccca

SEQ ID NO: 1190345 - RNA, 20 nt, Human
ccccacaagccuugcccaga

SEQ ID NO: 1190346 - RNA, 18 nt, Human
ccccagaaucggguucag

SEQ ID NO: 1190347 - RNA, 24 nt, Human
cccccaaaggaacagacgagccac

SEQ ID NO: 1190348 - RNA, 20 nt, Human
cccccccacaccccgacacc

SEQ ID NO: 1190349 - RNA, 21 nt, Human
cccccccacaccccgacaccu

SEQ ID NO: 1190350 - RNA, 19 nt, Human
cccgcagcgcccugccugc

SEQ ID NO: 1190351 - RNA, 24 nt, Human
cccgcagcgcccugccugcaggcu

SEQ ID NO: 1190352 - RNA, 18 nt, Human
cccgggccccccaaagga

SEQ ID NO: 1190353 - RNA, 26 nt, Human
ccgacaccugcaggugaggacugacc

SEQ ID NO: 1190354 - RNA, 22 nt, Human
ccucagggaugcccuucccucc

SEQ ID NO: 1190355 - RNA, 24 nt, Human
ccugggcacacuggggccaggcac

SEQ ID NO: 1190356 - RNA, 20 nt, Human
cgcccgggccccccaaagga

SEQ ID NO: 1190357 - RNA, 22 nt, Human
cgggccccccaaaggaacagaa

SEQ ID NO: 1190358 - RNA, 20 nt, Human
cugaauucagggaaggugaa

SEQ ID NO: 1190359 - RNA, 20 nt, Human
cugcacccugagggaccauu

SEQ ID NO: 1190360 - RNA, 23 nt, Human
cugcagcugcugccuuaggaggc

SEQ ID NO: 1190361 - RNA, 21 nt, Human
cugcaggcucaugcuggaggc

SEQ ID NO: 1190362 - RNA, 23 nt, Human
cuguggacagcacccgaccacag

SEQ ID NO: 1190363 - RNA, 19 nt, Human
gacgagccacggccaggcc

SEQ ID NO: 1190364 - RNA, 20 nt, Human
gcaauaaccagggccaggcu

SEQ ID NO: 1190365 - RNA, 19 nt, Human
gcacacuggggccaggcac

SEQ ID NO: 1190366 - RNA, 23 nt, Human
gcguggggagaguggggagaggg

SEQ ID NO: 1190367 - RNA, 22 nt, Human
gcuggaggccacggaaccaggc

SEQ ID NO: 1190368 - RNA, 25 nt, Human
gcuggagugagaggccugguuucug

SEQ ID NO: 1190369 - RNA, 18 nt, Human
gcuugcugcagcugcugc

SEQ ID NO: 1190370 - RNA, 18 nt, Human
ggagagggugcgcuugcu

SEQ ID NO: 1190371 - RNA, 25 nt, Human
ggccacggaaccaggcggcacaggg

SEQ ID NO: 1190372 - RNA, 19 nt, Human
ggccugguuucugaggcug

SEQ ID NO: 1190373 - RNA, 24 nt, Human
gggccggagcgggaagaugcuccc

SEQ ID NO: 1190374 - RNA, 18 nt, Human
guccucacgcagggagcc

SEQ ID NO: 1190375 - RNA, 18 nt, Human
gugccucagggaugcccu

SEQ ID NO: 1190376 - RNA, 22 nt, Human
uaggaggcuccucuguggccag

SEQ ID NO: 1190377 - RNA, 19 nt, Human
uagggggcacagggggcug

SEQ ID NO: 1190378 - RNA, 20 nt, Human
uauauauuacaauguaaccc

SEQ ID NO: 1190379 - RNA, 27 nt, Human
ucccacaacccgcccgggccccccaaa

SEQ ID NO: 1190380 - RNA, 20 nt, Human
uccuugcccccccacacccc

SEQ ID NO: 1190381 - RNA, 20 nt, Human
ucgggugccucagggaugcc

SEQ ID NO: 1190382 - RNA, 24 nt, Human
ucuggaagccgcucuggcgugggg

SEQ ID NO: 1190383 - RNA, 24 nt, Human
ugagcacagagcucagcaauaacc

SEQ ID NO: 1190384 - RNA, 19 nt, Human
ugccucagggaugcccuuc

SEQ ID NO: 1190385 - RNA, 25 nt, Human
ugccugggcacacuggggccaggcc

SEQ ID NO: 1190386 - RNA, 19 nt, Human
ugcuggaggccacggaacc

SEQ ID NO: 1190387 - RNA, 22 nt, Human
ugcuggagugagaggccugguu

SEQ ID NO: 1190388 - RNA, 25 nt, Human
uggcguggggagaguggggagaggg

SEQ ID NO: 1190389 - RNA, 24 nt, Human
ugggcagcuuucaucuguguuuau

SEQ ID NO: 1190390 - RNA, 19 nt, Human
uggggagaguggggagagg

SEQ ID NO: 1190391 - RNA, 19 nt, Human
ugugaagacugauucccac

SEQ ID NO: 1190392 - RNA, 28 nt, Human
uguggccaggcuucugccucccugcacc

SEQ ID NO: 1190393 - RNA, 24 nt, Human
uguucaaaaacccaugaaggacuc

SEQ ID NO: 1190394 - RNA, 24 nt, Human
uguucugaauucagggaaggugaa

SEQ ID NO: 1190395 - RNA, 19 nt, Human
uucccacaacccgcccggg

SEQ ID NO: 1190396 - RNA, 20 nt, Human
uugccugugcuacagauggg

SEQ ID NO: 1190397 - RNA, 26 nt, Human
uugcugcagcugcugccuuaggaggc

SEQ ID NO: 1190398 - RNA, 19 nt, Human
uuucugaggcugcagcaug

SEQ ID NO: 1190399 - RNA, 24 nt, Human
aaagacacaagacaucacuacaua

SEQ ID NO: 1190400 - RNA, 19 nt, Human
aacacgcuacaccugacau

SEQ ID NO: 1190401 - RNA, 20 nt, Human
aacauugugaaacccugucu

SEQ ID NO: 1190402 - RNA, 21 nt, Human
aacauugugaaacccugucuc

SEQ ID NO: 1190403 - RNA, 21 nt, Human
aacccaacacgcuacaccuga

SEQ ID NO: 1190404 - RNA, 24 nt, Human
aagacacgcagagacauuuugcuu

SEQ ID NO: 1190405 - RNA, 24 nt, Human
aagcauguuuccaggccuuggacc

SEQ ID NO: 1190406 - RNA, 21 nt, Human
aaggacuggaagaaaauacuu

SEQ ID NO: 1190407 - RNA, 20 nt, Human
aaggucaggaguucgagacc

SEQ ID NO: 1190408 - RNA, 25 nt, Human
aagguggguggaucacuuaagguca

SEQ ID NO: 1190409 - RNA, 23 nt, Human
aagguugcagugagcugagacug

SEQ ID NO: 1190410 - RNA, 18 nt, Human
aagugcugggauuacagg

SEQ ID NO: 1190411 - RNA, 18 nt, Human
aagugcugggauuacagg

SEQ ID NO: 1190412 - RNA, 18 nt, Human
aagugcugggauuacagg

SEQ ID NO: 1190413 - RNA, 19 nt, Human
aagugcugggauuacaggu

SEQ ID NO: 1190414 - RNA, 23 nt, Human
aagugcugggauuacagguguga

SEQ ID NO: 1190415 - RNA, 26 nt, Human
aagugcugggauuacaggugugagcc

SEQ ID NO: 1190416 - RNA, 19 nt, Human
acagaguaagacucugucu

SEQ ID NO: 1190417 - RNA, 24 nt, Human
acagaguaagacucugucuugaaa

SEQ ID NO: 1190418 - RNA, 22 nt, Human
accacugcacuccagccugggc

SEQ ID NO: 1190419 - RNA, 23 nt, Human
accacugcacuccagccugggcg

SEQ ID NO: 1190420 - RNA, 25 nt, Human
accacugcacuccagccugggcgac

SEQ ID NO: 1190421 - RNA, 26 nt, Human
accugacaucaaggcaugagccauaa

SEQ ID NO: 1190422 - RNA, 24 nt, Human
acuauguugcccaggcuggucucg

SEQ ID NO: 1190423 - RNA, 25 nt, Human
acuauguugcccaggcuggucucga

SEQ ID NO: 1190424 - RNA, 24 nt, Human
acugcacuccagccugggcgacag

SEQ ID NO: 1190425 - RNA, 26 nt, Human
acugcacuccagccugggcgacagag

SEQ ID NO: 1190426 - RNA, 25 nt, Human
acugcacuccagccugggcgacagg

SEQ ID NO: 1190427 - RNA, 22 nt, Human
agaaucgcuugaacacgggagg

SEQ ID NO: 1190428 - RNA, 24 nt, Human
agcacuuugggaggccaagguggg

SEQ ID NO: 1190429 - RNA, 23 nt, Human
agcagggugugguggugcaugcc

SEQ ID NO: 1190430 - RNA, 24 nt, Human
agccugggcgacagaguaagacuc

SEQ ID NO: 1190431 - RNA, 20 nt, Human
agccuggucaacauugugaa

SEQ ID NO: 1190432 - RNA, 24 nt, Human
agccuggucaacauugugaaaccc

SEQ ID NO: 1190433 - RNA, 26 nt, Human
aggaaaaggcaagccaaggacuggaa

SEQ ID NO: 1190434 - RNA, 25 nt, Human
aggagcauaccagaaaccggggccc

SEQ ID NO: 1190435 - RNA, 22 nt, Human
aggaggaggaaaaggcaagcca

SEQ ID NO: 1190436 - RNA, 22 nt, Human
aggaguucgagaccagccuggu

SEQ ID NO: 1190437 - RNA, 24 nt, Human
aggcaggagaaucgcuugaacacg

SEQ ID NO: 1190438 - RNA, 21 nt, Human
aggccaagguggguggaucac

SEQ ID NO: 1190439 - RNA, 20 nt, Human
aggccaagguugcagugagc

SEQ ID NO: 1190440 - RNA, 24 nt, Human
aggccaagguugcagugagcugag

SEQ ID NO: 1190441 - RNA, 20 nt, Human
aggcugaggcaggagaaucg

SEQ ID NO: 1190442 - RNA, 24 nt, Human
aggcugaggcaggagaaucgcuug

SEQ ID NO: 1190443 - RNA, 20 nt, Human
agggaaaauggguaaacugg

SEQ ID NO: 1190444 - RNA, 22 nt, Human
aggucucacuauguugcccagg

SEQ ID NO: 1190445 - RNA, 24 nt, Human
aguggcuuaugcugguaaucccag

SEQ ID NO: 1190446 - RNA, 20 nt, Human
auaaaggcacagaaaugaaa

SEQ ID NO: 1190447 - RNA, 24 nt, Human
aucacuuaaggucaggaguucgag

SEQ ID NO: 1190448 - RNA, 21 nt, Human
auccacacuuucgccugcgca

SEQ ID NO: 1190449 - RNA, 27 nt, Human
auuccagucggcagauauuuauugagc

SEQ ID NO: 1190450 - RNA, 20 nt, Human
caaaagacacgcagagacau

SEQ ID NO: 1190451 - RNA, 20 nt, Human
caacauugugaaacccuguc

SEQ ID NO: 1190452 - RNA, 22 nt, Human
caacauugugaaacccugucuc

SEQ ID NO: 1190453 - RNA, 24 nt, Human
caacauugugaaacccugucucua

SEQ ID NO: 1190454 - RNA, 24 nt, Human
caagguggguggaucacuuaaggu

SEQ ID NO: 1190455 - RNA, 21 nt, Human
caaguuacuggcccaaggcca

SEQ ID NO: 1190456 - RNA, 24 nt, Human
caccacucaccacucacugaaccc

SEQ ID NO: 1190457 - RNA, 20 nt, Human
caccacugcacuccagccug

SEQ ID NO: 1190458 - RNA, 26 nt, Human
caccacugcacuccagccugggcgac

SEQ ID NO: 1190459 - RNA, 19 nt, Human
caccagaugguaaauaagc

SEQ ID NO: 1190460 - RNA, 22 nt, Human
caccaugaccugggccuggggc

SEQ ID NO: 1190461 - RNA, 20 nt, Human
cacuacauaccuaucagaau

SEQ ID NO: 1190462 - RNA, 19 nt, Human
cacuauguugcccaggcug

SEQ ID NO: 1190463 - RNA, 24 nt, Human
cacuauguugcccaggcuggucuc

SEQ ID NO: 1190464 - RNA, 19 nt, Human
cacuccauuccagucggca

SEQ ID NO: 1190465 - RNA, 19 nt, Human
cacugcacuccagccuggg

SEQ ID NO: 1190466 - RNA, 20 nt, Human
cacugcacuccagccugggc

SEQ ID NO: 1190467 - RNA, 22 nt, Human
cacugcacuccagccugggcga

SEQ ID NO: 1190468 - RNA, 23 nt, Human
cacugcacuccagccugggcgac

SEQ ID NO: 1190469 - RNA, 24 nt, Human
cacugcacuccagccugggcgaca

SEQ ID NO: 1190470 - RNA, 26 nt, Human
cacugcacuccagccugggcgacaga

SEQ ID NO: 1190471 - RNA, 20 nt, Human
cacugcacuccagccugggg

SEQ ID NO: 1190472 - RNA, 23 nt, Human
cacuuaaggucaggaguucgaga

SEQ ID NO: 1190473 - RNA, 18 nt, Human
cagaaaccugagccuggc

SEQ ID NO: 1190474 - RNA, 24 nt, Human
cagcacuuugggaggccaaggugg

SEQ ID NO: 1190475 - RNA, 24 nt, Human
cagcuacuuggaaggcugaggcag

SEQ ID NO: 1190476 - RNA, 18 nt, Human
cagggugugguggugcag

SEQ ID NO: 1190477 - RNA, 19 nt, Human
caugagccauaaaagggaa

SEQ ID NO: 1190478 - RNA, 21 nt, Human
ccacacccaagggcuagacuc

SEQ ID NO: 1190479 - RNA, 20 nt, Human
ccacugcacuccagccuggg

SEQ ID NO: 1190480 - RNA, 21 nt, Human
ccacugcacuccagccugggc

SEQ ID NO: 1190481 - RNA, 19 nt, Human
ccacuguacccagcuugga

SEQ ID NO: 1190482 - RNA, 20 nt, Human
ccaugaccugggccuggggc

SEQ ID NO: 1190483 - RNA, 20 nt, Human
ccauggccucucuaagugcu

SEQ ID NO: 1190484 - RNA, 19 nt, Human
cccugcagaagcugacacu

SEQ ID NO: 1190485 - RNA, 24 nt, Human
ccucuaagcaccaugaccugggcc

SEQ ID NO: 1190486 - RNA, 19 nt, Human
ccugacaucaaggcaugag

SEQ ID NO: 1190487 - RNA, 22 nt, Human
ccugggcgacagaguaagacuc

SEQ ID NO: 1190488 - RNA, 22 nt, Human
ccuggucaacauugugaaaccc

SEQ ID NO: 1190489 - RNA, 24 nt, Human
ccuggucaacauugugaaacccug

SEQ ID NO: 1190490 - RNA, 21 nt, Human
ccuguagucccagcuacuugg

SEQ ID NO: 1190491 - RNA, 21 nt, Human
cgagaccagccuggucaacau

SEQ ID NO: 1190492 - RNA, 21 nt, Human
cgggaggccaagguugcagug

SEQ ID NO: 1190493 - RNA, 24 nt, Human
cgggaggccaagguugcagugagc

SEQ ID NO: 1190494 - RNA, 23 nt, Human
cgugaaugagcaccucccuacag

SEQ ID NO: 1190495 - RNA, 20 nt, Human
cuaagugcugggauuacagg

SEQ ID NO: 1190496 - RNA, 24 nt, Human
cuaagugcugggauuacaggugug

SEQ ID NO: 1190497 - RNA, 19 nt, Human
cucaagagauucucccacc

SEQ ID NO: 1190498 - RNA, 24 nt, Human
cucaagagauucucccaccauggc

SEQ ID NO: 1190499 - RNA, 20 nt, Human
cucacuccauuccagucggc

SEQ ID NO: 1190500 - RNA, 27 nt, Human
cucagaguaagaagggaggcaugagaa

SEQ ID NO: 1190501 - RNA, 19 nt, Human
cucccuacagcauccacac

SEQ ID NO: 1190502 - RNA, 19 nt, Human
cugcaacccuggcaccuag

SEQ ID NO: 1190503 - RNA, 31 nt, Human
cugcaccacugcacuccagccugggcgacaa

SEQ ID NO: 1190504 - RNA, 25 nt, Human
cuggaccuugucagaaccgaacaca

SEQ ID NO: 1190505 - RNA, 18 nt, Human
cuggggccgggcugugga

SEQ ID NO: 1190506 - RNA, 23 nt, Human
cuuccaguagaacaccacucacc

SEQ ID NO: 1190507 - RNA, 19 nt, Human
cuugaaaaaaaaaauggca

SEQ ID NO: 1190508 - RNA, 19 nt, Human
gaaaaaaaaaauggcaaaa

SEQ ID NO: 1190509 - RNA, 23 nt, Human
gacacgugaacugcaacccuggc

SEQ ID NO: 1190510 - RNA, 22 nt, Human
gaccuugucagaaccgaacaca

SEQ ID NO: 1190511 - RNA, 23 nt, Human
gagacugcaccacugcacuccag

SEQ ID NO: 1190512 - RNA, 21 nt, Human
gagcaccucccuacagcaucc

SEQ ID NO: 1190513 - RNA, 20 nt, Human
gaggaggaggaaaaggcaag

SEQ ID NO: 1190514 - RNA, 18 nt, Human
gaucacuuaaggucagga

SEQ ID NO: 1190515 - RNA, 24 nt, Human
gaucacuuaaggucaggaguucga

SEQ ID NO: 1190516 - RNA, 18 nt, Human
gauuacaggugugagcca

SEQ ID NO: 1190517 - RNA, 21 nt, Human
gauuacaggugugagccacug

SEQ ID NO: 1190518 - RNA, 24 nt, Human
gauuacaggugugagccacuguac

SEQ ID NO: 1190519 - RNA, 24 nt, Human
gcacuccagccugggcgacagagu

SEQ ID NO: 1190520 - RNA, 18 nt, Human
gccauaaaagggaaaaug

SEQ ID NO: 1190521 - RNA, 19 nt, Human
gcugguaaucccagcacuu

SEQ ID NO: 1190522 - RNA, 22 nt, Human
ggaaaccaaccugcugccgcca

SEQ ID NO: 1190523 - RNA, 22 nt, Human
ggaucacuuaaggucaggaguu

SEQ ID NO: 1190524 - RNA, 23 nt, Human
ggcgcaguggcuuaugcugguaa

SEQ ID NO: 1190525 - RNA, 21 nt, Human
gguggaucacuuaaggucagg

SEQ ID NO: 1190526 - RNA, 19 nt, Human
gguggcggggaggagagag

SEQ ID NO: 1190527 - RNA, 26 nt, Human
gucccacgugaaugagcaccucccua

SEQ ID NO: 1190528 - RNA, 19 nt, Human
guugcagugagcugagacu

SEQ ID NO: 1190529 - RNA, 22 nt, Human
guuugguucuggccuucaugcu

SEQ ID NO: 1190530 - RNA, 24 nt, Human
uaaaagacacaagacaucacuaca

SEQ ID NO: 1190531 - RNA, 24 nt, Human
uaaacuggaccuugucagaaccga

SEQ ID NO: 1190532 - RNA, 22 nt, Human
uaaaggcacagaaaugaaacug

SEQ ID NO: 1190533 - RNA, 23 nt, Human
uaaaggcacagaaaugaaacuga

SEQ ID NO: 1190534 - RNA, 24 nt, Human
uaagugcugggauuacagguguga

SEQ ID NO: 1190535 - RNA, 22 nt, Human
uacacauuugguguucaggacu

SEQ ID NO: 1190536 - RNA, 19 nt, Human
uacaggugugagccacugu

SEQ ID NO: 1190537 - RNA, 24 nt, Human
uacaggugugagccacuguaccca

SEQ ID NO: 1190538 - RNA, 22 nt, Human
uagagaugaggucucacuaugu

SEQ ID NO: 1190539 - RNA, 18 nt, Human
uagcagggugugguggug

SEQ ID NO: 1190540 - RNA, 21 nt, Human
uaucucaaauaugggaagggc

SEQ ID NO: 1190541 - RNA, 24 nt, Human
uaugcugguaaucccagcacuuug

SEQ ID NO: 1190542 - RNA, 19 nt, Human
uauguugcccaggcugguc

SEQ ID NO: 1190543 - RNA, 23 nt, Human
uauguugcccaggcuggucucga

SEQ ID NO: 1190544 - RNA, 24 nt, Human
uauguugcccaggcuggucucgaa

SEQ ID NO: 1190545 - RNA, 23 nt, Human
ucaaaggcuuauauauaaaggca

SEQ ID NO: 1190546 - RNA, 23 nt, Human
ucaccauaaaaaaaucaauuaga

SEQ ID NO: 1190547 - RNA, 30 nt, Human
ucacucacacugcuggcaggaauggaaauu

SEQ ID NO: 1190548 - RNA, 19 nt, Human
ucacuccauuccagucggc

SEQ ID NO: 1190549 - RNA, 19 nt, Human
uccacacccaagggcuaga

SEQ ID NO: 1190550 - RNA, 24 nt, Human
uccagccugggcgacagaguaaga

SEQ ID NO: 1190551 - RNA, 18 nt, Human
ucccuacagcauccacac

SEQ ID NO: 1190552 - RNA, 20 nt, Human
ucccugcugagugcgugggg

SEQ ID NO: 1190553 - RNA, 19 nt, Human
ucccuguuccacggaagau

SEQ ID NO: 1190554 - RNA, 20 nt, Human
uccugggcucaagagauucu

SEQ ID NO: 1190555 - RNA, 21 nt, Human
uccugggcucaagagauucuc

SEQ ID NO: 1190556 - RNA, 22 nt, Human
ucuaagugcugggauuacaggu

SEQ ID NO: 1190557 - RNA, 24 nt, Human
ucuaagugcugggauuacaggugu

SEQ ID NO: 1190558 - RNA, 21 nt, Human
ucucaaauaugggaagggcuc

SEQ ID NO: 1190559 - RNA, 18 nt, Human
ucucacuauguugcccag

SEQ ID NO: 1190560 - RNA, 19 nt, Human
ucucacuauguugcccagg

SEQ ID NO: 1190561 - RNA, 23 nt, Human
ucucacuauguugcccaggcugg

SEQ ID NO: 1190562 - RNA, 24 nt, Human
ucucacuauguugcccaggcuggu

SEQ ID NO: 1190563 - RNA, 26 nt, Human
ucucacuauguugcccaggcuggucu

SEQ ID NO: 1190564 - RNA, 27 nt, Human
ucucacuauguugcccaggcuggucuc

SEQ ID NO: 1190565 - RNA, 24 nt, Human
ucucacuccauuccagucggcaga

SEQ ID NO: 1190566 - RNA, 23 nt, Human
ucucuaagugcugggauuacagg

SEQ ID NO: 1190567 - RNA, 22 nt, Human
ucucuauuaaaaauacaaaaaa

SEQ ID NO: 1190568 - RNA, 20 nt, Human
ugacaaaggacuuguaucuc

SEQ ID NO: 1190569 - RNA, 21 nt, Human
ugacacgugaacugcaacccu

SEQ ID NO: 1190570 - RNA, 20 nt, Human
ugacaucaaggcaugagcca

SEQ ID NO: 1190571 - RNA, 24 nt, Human
ugaggaggaggaaaaggcaagcca

SEQ ID NO: 1190572 - RNA, 20 nt, Human
ugaggcaggagaaucgcuug

SEQ ID NO: 1190573 - RNA, 23 nt, Human
ugaggcaggagaaucgcuugaac

SEQ ID NO: 1190574 - RNA, 24 nt, Human
ugaggucucacuauguugcccagg

SEQ ID NO: 1190575 - RNA, 24 nt, Human
ugagugcgugggguggcggggagg

SEQ ID NO: 1190576 - RNA, 21 nt, Human
ugcaccacugcacuccagccu

SEQ ID NO: 1190577 - RNA, 27 nt, Human
ugcaccacugcacuccagccugggcga

SEQ ID NO: 1190578 - RNA, 24 nt, Human
ugcccaggcuggucucgaauuccu

SEQ ID NO: 1190579 - RNA, 21 nt, Human
ugcccugcagaagcugacacu

SEQ ID NO: 1190580 - RNA, 23 nt, Human
ugccuguagucccagcuacuugg

SEQ ID NO: 1190581 - RNA, 24 nt, Human
ugcugggauuacaggugugagcca

SEQ ID NO: 1190582 - RNA, 23 nt, Human
ugcugguaaucccagcacuuugg

SEQ ID NO: 1190583 - RNA, 24 nt, Human
ugcugguaaucccagcacuuuggg

SEQ ID NO: 1190584 - RNA, 23 nt, Human
ugcugugugugagggccuagagc

SEQ ID NO: 1190585 - RNA, 24 nt, Human
uggaagaaaauacuugcaaaucac

SEQ ID NO: 1190586 - RNA, 20 nt, Human
uggaaggcugaggcaggaga

SEQ ID NO: 1190587 - RNA, 23 nt, Human
uggaaggcugaggcaggagaauc

SEQ ID NO: 1190588 - RNA, 24 nt, Human
uggaucacuuaaggucaggaguuc

SEQ ID NO: 1190589 - RNA, 27 nt, Human
uggaucacuuaaggucaggaguucgag

SEQ ID NO: 1190590 - RNA, 18 nt, Human
uggcaggaauggaaauga

SEQ ID NO: 1190591 - RNA, 23 nt, Human
uggccgggcgcaguggcuuaugc

SEQ ID NO: 1190592 - RNA, 24 nt, Human
uggcuuaugcugguaaucccagca

SEQ ID NO: 1190593 - RNA, 23 nt, Human
ugggaggccaagguggguggauc

SEQ ID NO: 1190594 - RNA, 24 nt, Human
ugggaggccaagguggguggauca

SEQ ID NO: 1190595 - RNA, 18 nt, Human
ugggauuacaggugugag

SEQ ID NO: 1190596 - RNA, 21 nt, Human
ugggauuacaggugugagcca

SEQ ID NO: 1190597 - RNA, 22 nt, Human
ugggauuacaggugugagccac

SEQ ID NO: 1190598 - RNA, 22 nt, Human
ugggauuacaggugugagccac

SEQ ID NO: 1190599 - RNA, 22 nt, Human
ugggauuacaggugugagccac

SEQ ID NO: 1190600 - RNA, 24 nt, Human
ugggauuacaggugugagccacug

SEQ ID NO: 1190601 - RNA, 23 nt, Human
ugggguggcggggaggagagagc

SEQ ID NO: 1190602 - RNA, 24 nt, Human
uggguggaucacuuaaggucagga

SEQ ID NO: 1190603 - RNA, 18 nt, Human
uggugcaugccuguaguc

SEQ ID NO: 1190604 - RNA, 24 nt, Human
ugguggugcaugccuguaguccca

SEQ ID NO: 1190605 - RNA, 21 nt, Human
uguuuucuuucacucaccugu

SEQ ID NO: 1190606 - RNA, 19 nt, Human
uuagcagggugugguggug

SEQ ID NO: 1190607 - RNA, 24 nt, Human
uuagcagggugugguggugcaugc

SEQ ID NO: 1190608 - RNA, 22 nt, Human
uuaggagcauaccagaaaccug

SEQ ID NO: 1190609 - RNA, 23 nt, Human
uuccugggcucaagagauucucc

SEQ ID NO: 1190610 - RNA, 25 nt, Human
uuccugggcucaagagauucuccca

SEQ ID NO: 1190611 - RNA, 19 nt, Human
uugcagugagcugagacug

SEQ ID NO: 1190612 - RNA, 20 nt, Human
uugcagugagcugagacugc

SEQ ID NO: 1190613 - RNA, 22 nt, Human
uugcagugagcugagacugcac

SEQ ID NO: 1190614 - RNA, 24 nt, Human
uuggaaggcugaggcaggagaauc

SEQ ID NO: 1190615 - RNA, 22 nt, Human
aaaaagccaagugaugagcacc

SEQ ID NO: 1190616 - RNA, 27 nt, Human
aaaaagccaagugaugagcagugggca

SEQ ID NO: 1190617 - RNA, 23 nt, Human
aagcaaagucacacuggagucca

SEQ ID NO: 1190618 - RNA, 19 nt, Human
aaggcaggacaugcagaag

SEQ ID NO: 1190619 - RNA, 21 nt, Human
acacugaugaaauaggagugg

SEQ ID NO: 1190620 - RNA, 23 nt, Human
acacugaugaaauaggagugguc

SEQ ID NO: 1190621 - RNA, 23 nt, Human
accacgggagcucaccaaggcca

SEQ ID NO: 1190622 - RNA, 24 nt, Human
accucacuagcaaugaacacacca

SEQ ID NO: 1190623 - RNA, 19 nt, Human
agagaacaaccgcagcaca

SEQ ID NO: 1190624 - RNA, 23 nt, Human
agagcagucggcagacagcauga

SEQ ID NO: 1190625 - RNA, 24 nt, Human
agaguacagcauggagagggggac

SEQ ID NO: 1190626 - RNA, 18 nt, Human
agauccucaacacccagc

SEQ ID NO: 1190627 - RNA, 22 nt, Human
agccggcgcucggggaggcgca

SEQ ID NO: 1190628 - RNA, 20 nt, Human
agccucuuucugcuuguucu

SEQ ID NO: 1190629 - RNA, 20 nt, Human
agcugguccuggaauacccc

SEQ ID NO: 1190630 - RNA, 18 nt, Human
aggcauguucaaccucuu

SEQ ID NO: 1190631 - RNA, 19 nt, Human
augcagaagauaagccagg

SEQ ID NO: 1190632 - RNA, 22 nt, Human
caaaaagccaagugaugagcac

SEQ ID NO: 1190633 - RNA, 22 nt, Human
caagcucaagagcagucggcag

SEQ ID NO: 1190634 - RNA, 24 nt, Human
caaugaacacaccagugcccagau

SEQ ID NO: 1190635 - RNA, 23 nt, Human
cacaacccauaccccuaaguguc

SEQ ID NO: 1190636 - RNA, 21 nt, Human
caccucagccucugucucugc

SEQ ID NO: 1190637 - RNA, 20 nt, Human
cagagagccucuuucugcuu

SEQ ID NO: 1190638 - RNA, 22 nt, Human
cagcauggagagggggacuuca

SEQ ID NO: 1190639 - RNA, 20 nt, Human
cagcccaagcucaagagcag

SEQ ID NO: 1190640 - RNA, 22 nt, Human
caggaaaagaagcaaagucaca

SEQ ID NO: 1190641 - RNA, 19 nt, Human
caggacauuucccagucac

SEQ ID NO: 1190642 - RNA, 18 nt, Human
cagguugacaauaacacu

SEQ ID NO: 1190643 - RNA, 19 nt, Human
caguggcagggggccgggc

SEQ ID NO: 1190644 - RNA, 21 nt, Human
caguggcagggggccgggcag

SEQ ID NO: 1190645 - RNA, 25 nt, Human
caucuuuaguagcagaaauuaagga

SEQ ID NO: 1190646 - RNA, 23 nt, Human
ccaaccucgaagaagcugagcag

SEQ ID NO: 1190647 - RNA, 23 nt, Human
ccagagcuucuuggagaauugac

SEQ ID NO: 1190648 - RNA, 24 nt, Human
ccagcugguccuggaauacccccc

SEQ ID NO: 1190649 - RNA, 24 nt, Human
cccaaaaagccaagugaugagcac

SEQ ID NO: 1190650 - RNA, 24 nt, Human
cccaaccuuugccccccuaccagc

SEQ ID NO: 1190651 - RNA, 23 nt, Human
ccccaggcucguuugugaacccu

SEQ ID NO: 1190652 - RNA, 24 nt, Human
ccccccaggacauuucccagucac

SEQ ID NO: 1190653 - RNA, 24 nt, Human
ccucacuagcaaugaacacaccag

SEQ ID NO: 1190654 - RNA, 24 nt, Human
ccucagccucugucucugcacccc

SEQ ID NO: 1190655 - RNA, 18 nt, Human
ccuccccaggcugcugug

SEQ ID NO: 1190656 - RNA, 18 nt, Human
ccucugucucugcacccc

SEQ ID NO: 1190657 - RNA, 23 nt, Human
ccucugucucugcacccccaggc

SEQ ID NO: 1190658 - RNA, 18 nt, Human
ccucuuucugcuuguucu

SEQ ID NO: 1190659 - RNA, 22 nt, Human
cgacuacagccaccacugucag

SEQ ID NO: 1190660 - RNA, 21 nt, Human
cuagaagcaacaacaccucac

SEQ ID NO: 1190661 - RNA, 20 nt, Human
cucaagauccucaacacccu

SEQ ID NO: 1190662 - RNA, 18 nt, Human
cucaccagcacuacccua

SEQ ID NO: 1190663 - RNA, 20 nt, Human
cucaccagcacuacccuaga

SEQ ID NO: 1190664 - RNA, 20 nt, Human
cuccuccucggaaguggagc

SEQ ID NO: 1190665 - RNA, 22 nt, Human
cucuggaagccgccuccccagg

SEQ ID NO: 1190666 - RNA, 20 nt, Human
cuggcaguggcagggggccu

SEQ ID NO: 1190667 - RNA, 19 nt, Human
cuguaucuucaggagacca

SEQ ID NO: 1190668 - RNA, 22 nt, Human
gagcucaccaaggccaaccucg

SEQ ID NO: 1190669 - RNA, 21 nt, Human
gcaggacaugcagaagauaag

SEQ ID NO: 1190670 - RNA, 20 nt, Human
gccaaccucgaagaagcuga

SEQ ID NO: 1190671 - RNA, 20 nt, Human
gcccagaucccaggguggcc

SEQ ID NO: 1190672 - RNA, 23 nt, Human
gcccuagugccaucucaagaguc

SEQ ID NO: 1190673 - RNA, 20 nt, Human
gcugcugugggucuuugcug

SEQ ID NO: 1190674 - RNA, 21 nt, Human
gcuggggggcgcagccggcgc

SEQ ID NO: 1190675 - RNA, 19 nt, Human
gcugugggucuuugcuggg

SEQ ID NO: 1190676 - RNA, 18 nt, Human
ggcaggcgguaggccccg

SEQ ID NO: 1190677 - RNA, 19 nt, Human
gggcaaaggcaggacaugc

SEQ ID NO: 1190678 - RNA, 22 nt, Human
gggcaggcgguaggccccgggc

SEQ ID NO: 1190679 - RNA, 23 nt, Human
gguuuuguuuuuguaaacuuuca

SEQ ID NO: 1190680 - RNA, 20 nt, Human
gucgcagcacucuggaagcc

SEQ ID NO: 1190681 - RNA, 21 nt, Human
guggagcacaacccauacccc

SEQ ID NO: 1190682 - RNA, 24 nt, Human
guuaucuccucaccagcacuaccc

SEQ ID NO: 1190683 - RNA, 18 nt, Human
uaaagguuugccacuacu

SEQ ID NO: 1190684 - RNA, 23 nt, Human
uacuuuaagaaugugaauggggu

SEQ ID NO: 1190685 - RNA, 18 nt, Human
uagcuacuucuccuccuc

SEQ ID NO: 1190686 - RNA, 19 nt, Human
ucaacacccagcuuggggc

SEQ ID NO: 1190687 - RNA, 23 nt, Human
ucaagagucuguuaucuccucac

SEQ ID NO: 1190688 - RNA, 20 nt, Human
ucagagagccucuuucugcu

SEQ ID NO: 1190689 - RNA, 20 nt, Human
uccccaggcugcuguggguc

SEQ ID NO: 1190690 - RNA, 24 nt, Human
uccccauaguucaugacccaaccu

SEQ ID NO: 1190691 - RNA, 25 nt, Human
ucccugacccugccagguauucauc

SEQ ID NO: 1190692 - RNA, 22 nt, Human
uccucaccagcacuacccuaga

SEQ ID NO: 1190693 - RNA, 22 nt, Human
ucuagaagcaacaacaccucac

SEQ ID NO: 1190694 - RNA, 18 nt, Human
ucuguuaucuccucacca

SEQ ID NO: 1190695 - RNA, 21 nt, Human
ucuuucugcuuguucuucagg

SEQ ID NO: 1190696 - RNA, 23 nt, Human
ucuuugcugggucccacuagugu

SEQ ID NO: 1190697 - RNA, 23 nt, Human
ugaaauaggagugguccagagaa

SEQ ID NO: 1190698 - RNA, 18 nt, Human
ugaauuuucuucuccccu

SEQ ID NO: 1190699 - RNA, 18 nt, Human
ugacaauaacacugauga

SEQ ID NO: 1190700 - RNA, 21 nt, Human
ugagagagucuagaagcaaca

SEQ ID NO: 1190701 - RNA, 21 nt, Human
ugagcaccugucagaggcaca

SEQ ID NO: 1190702 - RNA, 24 nt, Human
ugaguaucccccccaggacauuuc

SEQ ID NO: 1190703 - RNA, 23 nt, Human
ugcugggucccacuaguguccag

SEQ ID NO: 1190704 - RNA, 22 nt, Human
uggaauagguaagccgucaggg

SEQ ID NO: 1190705 - RNA, 20 nt, Human
ugucucugcacccccaggca

SEQ ID NO: 1190706 - RNA, 23 nt, Human
ugugaaugggguuuuguuuuugu

SEQ ID NO: 1190707 - RNA, 26 nt, Human
uucaugacccaaccuuugccccccua

SEQ ID NO: 1190708 - RNA, 19 nt, Human
uuuguaaacuuucaauuac

SEQ ID NO: 1190709 - RNA, 18 nt, Human
aaagggccaaacagggug

SEQ ID NO: 1190710 - RNA, 21 nt, Human
aacacacugcagacgaggaca

SEQ ID NO: 1190711 - RNA, 19 nt, Human
aagaugaacacacugcaga

SEQ ID NO: 1190712 - RNA, 22 nt, Human
accaugacuggccuugucuucc

SEQ ID NO: 1190713 - RNA, 22 nt, Human
agaccagcggacccacgucaga

SEQ ID NO: 1190714 - RNA, 19 nt, Human
agcauggaaucccucccuc

SEQ ID NO: 1190715 - RNA, 22 nt, Human
agcucuuugucccgcaggagac

SEQ ID NO: 1190716 - RNA, 21 nt, Human
aggaaacccgacgcagagucc

SEQ ID NO: 1190717 - RNA, 22 nt, Human
caagagucacaaagggccaaac

SEQ ID NO: 1190718 - RNA, 18 nt, Human
cacacugcagacgaggaa

SEQ ID NO: 1190719 - RNA, 21 nt, Human
cauucgugucucaggcaggga

SEQ ID NO: 1190720 - RNA, 20 nt, Human
ccaaaagucgugacgcggug

SEQ ID NO: 1190721 - RNA, 28 nt, Human
ccucucgcugacgcccaaugucuucaac

SEQ ID NO: 1190722 - RNA, 24 nt, Human
ccucucuggacgguguuggugggg

SEQ ID NO: 1190723 - RNA, 20 nt, Human
cgagauccgugucgugauug

SEQ ID NO: 1190724 - RNA, 22 nt, Human
cgaggacacgagccccacagga

SEQ ID NO: 1190725 - RNA, 22 nt, Human
cgcccaaugucuucaacaaaga

SEQ ID NO: 1190726 - RNA, 22 nt, Human
cucaaugccucucgcugacgcc

SEQ ID NO: 1190727 - RNA, 24 nt, Human
cugagaaaugaagccacaccacaa

SEQ ID NO: 1190728 - RNA, 20 nt, Human
gaaagcagaaccccacagcc

SEQ ID NO: 1190729 - RNA, 23 nt, Human
gaacacacugcagacgaggacac

SEQ ID NO: 1190730 - RNA, 20 nt, Human
gaacagccucuuuucuagga

SEQ ID NO: 1190731 - RNA, 19 nt, Human
gacacgagccccacaggag

SEQ ID NO: 1190732 - RNA, 20 nt, Human
gauuguuucucucuccaaac

SEQ ID NO: 1190733 - RNA, 18 nt, Human
gcagaguccggagaaggc

SEQ ID NO: 1190734 - RNA, 21 nt, Human
gcccaaugucuucaacaaaga

SEQ ID NO: 1190735 - RNA, 18 nt, Human
ggcaggucgcaugaccug

SEQ ID NO: 1190736 - RNA, 20 nt, Human
gucgaaagcagaaccccaca

SEQ ID NO: 1190737 - RNA, 22 nt, Human
uagaaugagcgcuaggcgacca

SEQ ID NO: 1190738 - RNA, 20 nt, Human
ucccucaggccucucuggac

SEQ ID NO: 1190739 - RNA, 21 nt, Human
ucucucuccaaacguguuucu

SEQ ID NO: 1190740 - RNA, 19 nt, Human
ucugcuugauugggcaggu

SEQ ID NO: 1190741 - RNA, 20 nt, Human
ucuggacgguguuggugggg

SEQ ID NO: 1190742 - RNA, 23 nt, Human
ugagaaaugaagccacaccacaa

SEQ ID NO: 1190743 - RNA, 18 nt, Human
ugccaagagucacaaagg

SEQ ID NO: 1190744 - RNA, 26 nt, Human
ugccaagagucacaaagggccaaaca

SEQ ID NO: 1190745 - RNA, 18 nt, Human
uggguggguggauugccu

SEQ ID NO: 1190746 - RNA, 21 nt, Human
ugucuucaacaaagaugacuu

SEQ ID NO: 1190747 - RNA, 24 nt, Human
uucucgucgaaagcagaaccccac

SEQ ID NO: 1190748 - RNA, 21 nt, Human
uuggugggggugagucucccc

SEQ ID NO: 1190749 - RNA, 22 nt, Human
uuuucuaggaucaagaugaaca

SEQ ID NO: 1190750 - RNA, 19 nt, Human
aacagcaucugcaaaagau

SEQ ID NO: 1190751 - RNA, 19 nt, Human
aacuuucuucuaugaaggc

SEQ ID NO: 1190752 - RNA, 24 nt, Human
aaguagccaagcuauauuaaaaua

SEQ ID NO: 1190753 - RNA, 23 nt, Human
aauacuccuccuuuuuccaacua

SEQ ID NO: 1190754 - RNA, 19 nt, Human
aauuaaaauccauacaugc

SEQ ID NO: 1190755 - RNA, 20 nt, Human
acaugagagcuuugcagaaa

SEQ ID NO: 1190756 - RNA, 18 nt, Human
agacaugagagcuuugca

SEQ ID NO: 1190757 - RNA, 20 nt, Human
aggaagauauggggagggag

SEQ ID NO: 1190758 - RNA, 19 nt, Human
aggcacuuguauagagagc

SEQ ID NO: 1190759 - RNA, 18 nt, Human
caacuugugaaaagugcu

SEQ ID NO: 1190760 - RNA, 20 nt, Human
cagacuucuccagauacuuc

SEQ ID NO: 1190761 - RNA, 18 nt, Human
cccugcagaacauggaga

SEQ ID NO: 1190762 - RNA, 19 nt, Human
cuucugggaaagucaggga

SEQ ID NO: 1190763 - RNA, 24 nt, Human
cuuuuuauucauuguugcagaaau

SEQ ID NO: 1190764 - RNA, 19 nt, Human
gcagaacauggagaaggaa

SEQ ID NO: 1190765 - RNA, 22 nt, Human
ggaaagugucccuccaggaagu

SEQ ID NO: 1190766 - RNA, 19 nt, Human
ggaagauauggggagggag

SEQ ID NO: 1190767 - RNA, 23 nt, Human
guggaacagcaucugcaaaagau

SEQ ID NO: 1190768 - RNA, 21 nt, Human
uccaggaagauauggggaggg

SEQ ID NO: 1190769 - RNA, 25 nt, Human
ucuucuaugaaggcagacaugagag

SEQ ID NO: 1190770 - RNA, 19 nt, Human
uggaacagcaucugcaaaa

SEQ ID NO: 1190771 - RNA, 21 nt, Human
uggaacagcaucugcaaaaga

SEQ ID NO: 1190772 - RNA, 22 nt, Human
ugugaaaagugcuucaauuauc

SEQ ID NO: 1190773 - RNA, 24 nt, Human
agccauuaugcugucagcaaccuu

SEQ ID NO: 1190774 - RNA, 21 nt, Human
cacugcaucaugggagaaagc

SEQ ID NO: 1190775 - RNA, 21 nt, Human
caggaggaacugcaaccucac

SEQ ID NO: 1190776 - RNA, 21 nt, Human
ccuaaucaagaaaacaucagc

SEQ ID NO: 1190777 - RNA, 28 nt, Human
ccuaaucaagaaaacaucagcgguggcu

SEQ ID NO: 1190778 - RNA, 19 nt, Human
cgcaggcagucgauucucc

SEQ ID NO: 1190779 - RNA, 25 nt, Human
uaagacaccuaaucaagaaaacauc

SEQ ID NO: 1190780 - RNA, 18 nt, Human
uagauccagacgccagac

SEQ ID NO: 1190781 - RNA, 21 nt, Human
uaggccaauccuuaucacacu

SEQ ID NO: 1190782 - RNA, 19 nt, Human
ucgcaggcagucgauucuc

SEQ ID NO: 1190783 - RNA, 22 nt, Human
uggaagauaagacaccuaauca

SEQ ID NO: 1190784 - RNA, 19 nt, Human
aaaaaaacgacacaagcaa

SEQ ID NO: 1190785 - RNA, 23 nt, Human
aaaaaaacgacacaagcaaguca

SEQ ID NO: 1190786 - RNA, 19 nt, Human
aaaaggaaguggacuucaa

SEQ ID NO: 1190787 - RNA, 21 nt, Human
aaaaggaaguggacuucaagg

SEQ ID NO: 1190788 - RNA, 22 nt, Human
aaacaacaacgacaaaaauaag

SEQ ID NO: 1190789 - RNA, 20 nt, Human
aaacaacuaaaucacaauga

SEQ ID NO: 1190790 - RNA, 21 nt, Human
aaacaccgaguaacuggugug

SEQ ID NO: 1190791 - RNA, 26 nt, Human
aacaaacaaccaggacauguaccaaa

SEQ ID NO: 1190792 - RNA, 25 nt, Human
aacaaccaggacauguaccaaaaaa

SEQ ID NO: 1190793 - RNA, 18 nt, Human
aacuggugugagguuauu

SEQ ID NO: 1190794 - RNA, 23 nt, Human
aagcaccacagagugcuuggguc

SEQ ID NO: 1190795 - RNA, 18 nt, Human
aagggaacaaacaaccag

SEQ ID NO: 1190796 - RNA, 27 nt, Human
acaaccaggacauguaccaaaaaacaa

SEQ ID NO: 1190797 - RNA, 19 nt, Human
acaagcaagucaguuagaa

SEQ ID NO: 1190798 - RNA, 18 nt, Human
acagaucagauaauccca

SEQ ID NO: 1190799 - RNA, 22 nt, Human
acuuauuauuuucucuuccccc

SEQ ID NO: 1190800 - RNA, 19 nt, Human
aggaagagucuacagauca

SEQ ID NO: 1190801 - RNA, 18 nt, Human
aguagcugccccgccuuu

SEQ ID NO: 1190802 - RNA, 18 nt, Human
augaugucacaggucucu

SEQ ID NO: 1190803 - RNA, 24 nt, Human
augucauuuuuuugacaggugaug

SEQ ID NO: 1190804 - RNA, 22 nt, Human
caaaacauucacaggccauuga

SEQ ID NO: 1190805 - RNA, 24 nt, Human
caaaaugaacugaacaaagggaac

SEQ ID NO: 1190806 - RNA, 21 nt, Human
caacuaaaucacaaugacucu

SEQ ID NO: 1190807 - RNA, 19 nt, Human
caccaaacaacuaaaucac

SEQ ID NO: 1190808 - RNA, 22 nt, Human
caccacucuaugccaaaaccug

SEQ ID NO: 1190809 - RNA, 18 nt, Human
cagcugcugcacucugcu

SEQ ID NO: 1190810 - RNA, 21 nt, Human
cauuucagucuuaaugaaguc

SEQ ID NO: 1190811 - RNA, 21 nt, Human
ccaacaucugaauaagaaacu

SEQ ID NO: 1190812 - RNA, 22 nt, Human
ccacucuaugccaaaaccugga

SEQ ID NO: 1190813 - RNA, 18 nt, Human
ccagcagauaaugccuuc

SEQ ID NO: 1190814 - RNA, 20 nt, Human
ccaucaauuaaaaauagagu

SEQ ID NO: 1190815 - RNA, 21 nt, Human
ccauuccuguggccauuugau

SEQ ID NO: 1190816 - RNA, 21 nt, Human
cccaccgugggagcgcugggc

SEQ ID NO: 1190817 - RNA, 21 nt, Human
ccucccgggagagaguaaaca

SEQ ID NO: 1190818 - RNA, 19 nt, Human
ccuugcagcaugaaacugu

SEQ ID NO: 1190819 - RNA, 21 nt, Human
cgggagagaguaaacagcuuc

SEQ ID NO: 1190820 - RNA, 23 nt, Human
cuacuguuggggaaaaaaacgac

SEQ ID NO: 1190821 - RNA, 20 nt, Human
cuacuuagucucucaggcuu

SEQ ID NO: 1190822 - RNA, 21 nt, Human
cuagagugccauuuaaaaauu

SEQ ID NO: 1190823 - RNA, 21 nt, Human
cucacacaaguaggugcugaa

SEQ ID NO: 1190824 - RNA, 22 nt, Human
cugccccgccuuuccucacugu

SEQ ID NO: 1190825 - RNA, 19 nt, Human
cugggcacgucaguucaca

SEQ ID NO: 1190826 - RNA, 23 nt, Human
cuggucaccacucuaugccaaaa

SEQ ID NO: 1190827 - RNA, 19 nt, Human
cuugaaaugaggaaucuug

SEQ ID NO: 1190828 - RNA, 23 nt, Human
cuuggcaaaaugaacugaacaaa

SEQ ID NO: 1190829 - RNA, 18 nt, Human
cuugggucuugaucuuuc

SEQ ID NO: 1190830 - RNA, 18 nt, Human
cuuuccucuuuuccucuu

SEQ ID NO: 1190831 - RNA, 18 nt, Human
gaaagaauacaaagguua

SEQ ID NO: 1190832 - RNA, 18 nt, Human
gaaucucggguuuugcug

SEQ ID NO: 1190833 - RNA, 20 nt, Human
gagaucuccuaaaggucuga

SEQ ID NO: 1190834 - RNA, 20 nt, Human
gaggaaucuugaaggagaaa

SEQ ID NO: 1190835 - RNA, 20 nt, Human
gagugcuugggucuugaucu

SEQ ID NO: 1190836 - RNA, 19 nt, Human
gccauugaacuacuguugg

SEQ ID NO: 1190837 - RNA, 19 nt, Human
gccccgccuuuccucacug

SEQ ID NO: 1190838 - RNA, 18 nt, Human
guucuguaaacacuuggc

SEQ ID NO: 1190839 - RNA, 23 nt, Human
uaaaaggaaguggacuucaaggu

SEQ ID NO: 1190840 - RNA, 21 nt, Human
uaagaaaaaaaugcagucgga

SEQ ID NO: 1190841 - RNA, 23 nt, Human
uaauaugcaauacccaugccuug

SEQ ID NO: 1190842 - RNA, 18 nt, Human
uacagaucagauaauccc

SEQ ID NO: 1190843 - RNA, 20 nt, Human
uaccaaaaaacaacaacgac

SEQ ID NO: 1190844 - RNA, 21 nt, Human
uaccaaaaaacaacaacgaca

SEQ ID NO: 1190845 - RNA, 24 nt, Human
uaccaaaaaacaacaacgacaaaa

SEQ ID NO: 1190846 - RNA, 19 nt, Human
uaccaggagcuccaggcac

SEQ ID NO: 1190847 - RNA, 23 nt, Human
uaccaggagcuccaggcacagag

SEQ ID NO: 1190848 - RNA, 25 nt, Human
uagaacguguugaucugguugauaa

SEQ ID NO: 1190849 - RNA, 24 nt, Human
uagagugccauuuaaaaauugaaa

SEQ ID NO: 1190850 - RNA, 21 nt, Human
uaggaagagucuacagaucag

SEQ ID NO: 1190851 - RNA, 18 nt, Human
uaggagaaacugauuccu

SEQ ID NO: 1190852 - RNA, 19 nt, Human
uaguagcugccccgccuuu

SEQ ID NO: 1190853 - RNA, 25 nt, Human
uaucucacacaaguaggugcugaau

SEQ ID NO: 1190854 - RNA, 26 nt, Human
uauuauuuucucuuccccccaugagc

SEQ ID NO: 1190855 - RNA, 23 nt, Human
uauuuugccauuccuguggccau

SEQ ID NO: 1190856 - RNA, 21 nt, Human
ucacaggccauugaacuacca

SEQ ID NO: 1190857 - RNA, 20 nt, Human
ucauaaucuuucuaauggau

SEQ ID NO: 1190858 - RNA, 22 nt, Human
uccaaagagauguggauguccu

SEQ ID NO: 1190859 - RNA, 23 nt, Human
uccauuaccaggagcuccaggca

SEQ ID NO: 1190860 - RNA, 21 nt, Human
ucccgggagagaguaaacagc

SEQ ID NO: 1190861 - RNA, 20 nt, Human
uccucuucacuuccccuccu

SEQ ID NO: 1190862 - RNA, 19 nt, Human
ucuaagaaaaaaaugcagu

SEQ ID NO: 1190863 - RNA, 22 nt, Human
ucuaugccaaaaccuggaagag

SEQ ID NO: 1190864 - RNA, 19 nt, Human
ucuccagauucaaacaccg

SEQ ID NO: 1190865 - RNA, 19 nt, Human
ucuguaaacacuuggcaaa

SEQ ID NO: 1190866 - RNA, 18 nt, Human
ucuguauuuuagggagaa

SEQ ID NO: 1190867 - RNA, 22 nt, Human
ugaaacugugugguuccuucug

SEQ ID NO: 1190868 - RNA, 23 nt, Human
ugaacaaagggaacaaacaacca

SEQ ID NO: 1190869 - RNA, 25 nt, Human
ugaaggagaaaauauucuuaacagc

SEQ ID NO: 1190870 - RNA, 22 nt, Human
ugacuugagagggaaaaaaaaa

SEQ ID NO: 1190871 - RNA, 22 nt, Human
ugagcaauucaccaaacaacua

SEQ ID NO: 1190872 - RNA, 21 nt, Human
ugagcauggaagcaccacaga

SEQ ID NO: 1190873 - RNA, 20 nt, Human
ugcaauacccaugccuugau

SEQ ID NO: 1190874 - RNA, 21 nt, Human
uggaaucucggguuuugcugu

SEQ ID NO: 1190875 - RNA, 22 nt, Human
uggacuucaagguguaagucac

SEQ ID NO: 1190876 - RNA, 20 nt, Human
ugggucaguaauaugugacu

SEQ ID NO: 1190877 - RNA, 19 nt, Human
ugggucuugaucuuuccug

SEQ ID NO: 1190878 - RNA, 19 nt, Human
uggguguucuguaaacacu

SEQ ID NO: 1190879 - RNA, 21 nt, Human
uuaguaccuguccaacaucug

SEQ ID NO: 1190880 - RNA, 26 nt, Human
uucaccaaacaacuaaaucacaauga

SEQ ID NO: 1190881 - RNA, 24 nt, Human
uucaucauauuuaugacuaguuga

SEQ ID NO: 1190882 - RNA, 21 nt, Human
agcccguagccucuuaggcac

SEQ ID NO: 1190883 - RNA, 21 nt, Human
aggcagcugcugcgaggcuug

SEQ ID NO: 1190884 - RNA, 27 nt, Human
caacgcgacucacugcgccgggcucua

SEQ ID NO: 1190885 - RNA, 20 nt, Human
ccagcccguugagaguuugc

SEQ ID NO: 1190886 - RNA, 18 nt, Human
cuggguggaggaaugagc

SEQ ID NO: 1190887 - RNA, 19 nt, Human
gcagcugcugcgaggcuug

SEQ ID NO: 1190888 - RNA, 21 nt, Human
uagcugccagcccguagccuc

SEQ ID NO: 1190889 - RNA, 25 nt, Human
ugccagcccguagccucuuaggcac

SEQ ID NO: 1190890 - RNA, 24 nt, Human
uggguggaggaaugagcagggggc

SEQ ID NO: 1190891 - RNA, 21 nt, Human
aaacagauaagguaaguagac

SEQ ID NO: 1190892 - RNA, 20 nt, Human
aagcagcugggacuacaggc

SEQ ID NO: 1190893 - RNA, 25 nt, Human
aagcagcugggacuacaggcaccug

SEQ ID NO: 1190894 - RNA, 21 nt, Human
aaguaaauauauuuauaugga

SEQ ID NO: 1190895 - RNA, 21 nt, Human
aaugcaguggcgcaaucucag

SEQ ID NO: 1190896 - RNA, 22 nt, Human
aauuacuuggugcucagugucu

SEQ ID NO: 1190897 - RNA, 21 nt, Human
acaggcaccugccaccaugcc

SEQ ID NO: 1190898 - RNA, 19 nt, Human
acaggguuucaccguguca

SEQ ID NO: 1190899 - RNA, 20 nt, Human
acaggguuucaccgugucag

SEQ ID NO: 1190900 - RNA, 24 nt, Human
acaggguuucaccgugucagccag

SEQ ID NO: 1190901 - RNA, 19 nt, Human
acauauauacuccauuccu

SEQ ID NO: 1190902 - RNA, 26 nt, Human
acuacaggcaccugccaccaugccag

SEQ ID NO: 1190903 - RNA, 18 nt, Human
agacaggguuucaccgug

SEQ ID NO: 1190904 - RNA, 20 nt, Human
aguagagacaggguuucacc

SEQ ID NO: 1190905 - RNA, 22 nt, Human
agucauuuugucauuucuuugu

SEQ ID NO: 1190906 - RNA, 23 nt, Human
auccucucugaaggaaauuguug

SEQ ID NO: 1190907 - RNA, 20 nt, Human
caaagugcuaggauaccaug

SEQ ID NO: 1190908 - RNA, 18 nt, Human
caccgugucagccaggau

SEQ ID NO: 1190909 - RNA, 24 nt, Human
caccgugucagccaggauggucuc

SEQ ID NO: 1190910 - RNA, 27 nt, Human
cagcugggacuacaggcaccugccaac

SEQ ID NO: 1190911 - RNA, 24 nt, Human
caggguuucaccgugucagccagg

SEQ ID NO: 1190912 - RNA, 20 nt, Human
ccaaagugcuaggauaccau

SEQ ID NO: 1190913 - RNA, 23 nt, Human
ccaccuagucauuuugucauuuc

SEQ ID NO: 1190914 - RNA, 21 nt, Human
cccaaagugcuaggauaccau

SEQ ID NO: 1190915 - RNA, 24 nt, Human
cccaagcagcugggacuacaggca

SEQ ID NO: 1190916 - RNA, 22 nt, Human
ccucagccucccaagcagcugg

SEQ ID NO: 1190917 - RNA, 22 nt, Human
cuaaaacaagugcuguaagaac

SEQ ID NO: 1190918 - RNA, 23 nt, Human
cuaacauauauacuccauuccua

SEQ ID NO: 1190919 - RNA, 19 nt, Human
cuccuuccucagccuccca

SEQ ID NO: 1190920 - RNA, 20 nt, Human
cucugucacccaggcuggaa

SEQ ID NO: 1190921 - RNA, 24 nt, Human
cucuugaccucgugaucugcccgc

SEQ ID NO: 1190922 - RNA, 21 nt, Human
cuugaaagauagagauggugg

SEQ ID NO: 1190923 - RNA, 20 nt, Human
cuuuguuuacuuccugccuc

SEQ ID NO: 1190924 - RNA, 22 nt, Human
gaccucgugaucugcccgccuc

SEQ ID NO: 1190925 - RNA, 24 nt, Human
gaccucgugaucugcccgccucgg

SEQ ID NO: 1190926 - RNA, 24 nt, Human
gacuacaggcaccugccaccaugc

SEQ ID NO: 1190927 - RNA, 22 nt, Human
gaugguguuuuccuaaggagua

SEQ ID NO: 1190928 - RNA, 19 nt, Human
gauucaagccauucuccuu

SEQ ID NO: 1190929 - RNA, 21 nt, Human
gccucccaagcagcugggacu

SEQ ID NO: 1190930 - RNA, 23 nt, Human
gccucggccucccaaagugcuag

SEQ ID NO: 1190931 - RNA, 25 nt, Human
gcucugucacccaggcuggaaugca

SEQ ID NO: 1190932 - RNA, 19 nt, Human
gcuggaaugcaguggcgca

SEQ ID NO: 1190933 - RNA, 21 nt, Human
gucucuuuguuuacuuccugg

SEQ ID NO: 1190934 - RNA, 24 nt, Human
gugaucugcccgccucggccuccc

SEQ ID NO: 1190935 - RNA, 19 nt, Human
guguuuuauaaaggcuguu

SEQ ID NO: 1190936 - RNA, 22 nt, Human
uaaaaacagauaagguaaguag

SEQ ID NO: 1190937 - RNA, 27 nt, Human
uaauuuuuuuuguauuuuuaguagaga

SEQ ID NO: 1190938 - RNA, 22 nt, Human
uagagacaggguuucaccgugu

SEQ ID NO: 1190939 - RNA, 21 nt, Human
uaguagagacaggguuucacc

SEQ ID NO: 1190940 - RNA, 24 nt, Human
uaguagagacaggguuucaccgug

SEQ ID NO: 1190941 - RNA, 25 nt, Human
uaguagagacaggguuucaccgugu

SEQ ID NO: 1190942 - RNA, 20 nt, Human
uauaaaaacagauaagguaa

SEQ ID NO: 1190943 - RNA, 23 nt, Human
uauauacuccauuccuacucagg

SEQ ID NO: 1190944 - RNA, 19 nt, Human
uaucuaaccucaugaaaca

SEQ ID NO: 1190945 - RNA, 19 nt, Human
uaucuaaccucaugaaaca

SEQ ID NO: 1190946 - RNA, 25 nt, Human
ucaagccauucuccuuccucagccu

SEQ ID NO: 1190947 - RNA, 19 nt, Human
ucacccaggcuggaaugca

SEQ ID NO: 1190948 - RNA, 24 nt, Human
ucaccgugucagccaggauggucu

SEQ ID NO: 1190949 - RNA, 18 nt, Human
ucacugcaagcucugccg

SEQ ID NO: 1190950 - RNA, 21 nt, Human
ucacugcaagcucugccgccc

SEQ ID NO: 1190951 - RNA, 23 nt, Human
ucacugcaagcucugccgcccgg

SEQ ID NO: 1190952 - RNA, 18 nt, Human
ucagccucccaagcagcu

SEQ ID NO: 1190953 - RNA, 20 nt, Human
ucagccucccaagcagcugg

SEQ ID NO: 1190954 - RNA, 25 nt, Human
ucagcuaaaacaagugcuguaagaa

SEQ ID NO: 1190955 - RNA, 23 nt, Human
ucagugucucuuuguuuacuucc

SEQ ID NO: 1190956 - RNA, 21 nt, Human
uccaaagauacucaagcccac

SEQ ID NO: 1190957 - RNA, 23 nt, Human
ucccaaagugcuaggauaccaug

SEQ ID NO: 1190958 - RNA, 25 nt, Human
ucccaaagugcuaggauaccauggc

SEQ ID NO: 1190959 - RNA, 22 nt, Human
ucccaaagugcuaggauaccuc

SEQ ID NO: 1190960 - RNA, 24 nt, Human
ucccaagcagcugggacuacaggc

SEQ ID NO: 1190961 - RNA, 18 nt, Human
ucggccucccaaagugcu

SEQ ID NO: 1190962 - RNA, 19 nt, Human
ucucgcucugucacccagg

SEQ ID NO: 1190963 - RNA, 23 nt, Human
ucucgcucugucacccaggcugg

SEQ ID NO: 1190964 - RNA, 24 nt, Human
ucucgcucugucacccaggcugga

SEQ ID NO: 1190965 - RNA, 26 nt, Human
ucucgcucugucacccaggcuggaau

SEQ ID NO: 1190966 - RNA, 27 nt, Human
ucucgcucugucacccaggcuggaaug

SEQ ID NO: 1190967 - RNA, 21 nt, Human
ucugccgcccggauucaagcc

SEQ ID NO: 1190968 - RNA, 24 nt, Human
ucugucacccaggcuggaaugcag

SEQ ID NO: 1190969 - RNA, 19 nt, Human
ucuuuguuuacuuccugcc

SEQ ID NO: 1190970 - RNA, 22 nt, Human
ugagaugaauaauuaagucuug

SEQ ID NO: 1190971 - RNA, 22 nt, Human
ugagauggagucucgcucuguc

SEQ ID NO: 1190972 - RNA, 22 nt, Human
ugcaguggcgcaaucucagcuc

SEQ ID NO: 1190973 - RNA, 23 nt, Human
ugcaguggcgcaaucucagcuca

SEQ ID NO: 1190974 - RNA, 23 nt, Human
ugccaggcuaauuuuuuuuguau

SEQ ID NO: 1190975 - RNA, 25 nt, Human
ugcucagugucucuuuggucugagg

SEQ ID NO: 1190976 - RNA, 20 nt, Human
ugcuguaagaaccauguugg

SEQ ID NO: 1190977 - RNA, 18 nt, Human
uggaaugcaguggcgcaa

SEQ ID NO: 1190978 - RNA, 19 nt, Human
uggaaugcaguggcgcaau

SEQ ID NO: 1190979 - RNA, 20 nt, Human
uggacaguaucuaaccucau

SEQ ID NO: 1190980 - RNA, 24 nt, Human
uggcgcaaucucagcucacugcaa

SEQ ID NO: 1190981 - RNA, 21 nt, Human
ugggacuacaggcaccugcca

SEQ ID NO: 1190982 - RNA, 22 nt, Human
ugggacuacaggcaccugccac

SEQ ID NO: 1190983 - RNA, 24 nt, Human
ugggacuacaggcaccugccacca

SEQ ID NO: 1190984 - RNA, 25 nt, Human
ugggacuacaggcaccugccaccau

SEQ ID NO: 1190985 - RNA, 26 nt, Human
ugggcucuauaaaaacagauaaggua

SEQ ID NO: 1190986 - RNA, 22 nt, Human
ugugauaacucaguggucaagg

SEQ ID NO: 1190987 - RNA, 19 nt, Human
uguguaauuauaaaaaauu

SEQ ID NO: 1190988 - RNA, 22 nt, Human
uuaguagagacaggguuucacc

SEQ ID NO: 1190989 - RNA, 24 nt, Human
uuaguagagacaggguuucaccgu

SEQ ID NO: 1190990 - RNA, 22 nt, Human
uuuuguauuuuuaguagagaca

SEQ ID NO: 1190991 - RNA, 30 nt, Human
uuuuguuuauuagaaguguuuuaauuuuuu

SEQ ID NO: 1190992 - RNA, 24 nt, Human
uuuuuaguagagacaggguuucac

SEQ ID NO: 1190993 - RNA, 21 nt, Human
uuuuuguauuuuuaguagaga

SEQ ID NO: 1190994 - RNA, 21 nt, Human
uuuuuuguauuuuuaguagag

SEQ ID NO: 1190995 - RNA, 18 nt, Human
acauuuuugccagaugac

SEQ ID NO: 1190996 - RNA, 19 nt, Human
agccacucuccucucagcc

SEQ ID NO: 1190997 - RNA, 21 nt, Human
auaggagccuugaauacagcg

SEQ ID NO: 1190998 - RNA, 24 nt, Human
caaaagcacccuggccggagcggu

SEQ ID NO: 1190999 - RNA, 20 nt, Human
cacagcucugccaguacccc

SEQ ID NO: 1191000 - RNA, 21 nt, Human
cacagcucugccaguacccca

SEQ ID NO: 1191001 - RNA, 21 nt, Human
cccggcugcugcccccaggaa

SEQ ID NO: 1191002 - RNA, 22 nt, Human
ccucucagcccggcugcugccc

SEQ ID NO: 1191003 - RNA, 21 nt, Human
ccugcuaauucacuggcagcg

SEQ ID NO: 1191004 - RNA, 23 nt, Human
cgagccacagcucugccaguacc

SEQ ID NO: 1191005 - RNA, 21 nt, Human
cuggcagcguagggcugucug

SEQ ID NO: 1191006 - RNA, 25 nt, Human
gaauaggagccuugaauacagcggg

SEQ ID NO: 1191007 - RNA, 18 nt, Human
gacauuuuugccagauga

SEQ ID NO: 1191008 - RNA, 18 nt, Human
gaguagacagccacucuc

SEQ ID NO: 1191009 - RNA, 24 nt, Human
gccauggcggagagaguagacagc

SEQ ID NO: 1191010 - RNA, 19 nt, Human
gcugucuguuguuuuugcg

SEQ ID NO: 1191011 - RNA, 20 nt, Human
ggaguacagcgacaucagug

SEQ ID NO: 1191012 - RNA, 18 nt, Human
ggccggagcggugagucc

SEQ ID NO: 1191013 - RNA, 19 nt, Human
gugcugguccgaugaccug

SEQ ID NO: 1191014 - RNA, 25 nt, Human
uacagcgacaucagugggcggacac

SEQ ID NO: 1191015 - RNA, 20 nt, Human
ucacugccuguauaaucagg

SEQ ID NO: 1191016 - RNA, 21 nt, Human
uccaaaagcacccuggccgga

SEQ ID NO: 1191017 - RNA, 22 nt, Human
ugccaguaccccaagacucagu

SEQ ID NO: 1191018 - RNA, 19 nt, Human
acaaacaaucccacagcau

SEQ ID NO: 1191019 - RNA, 19 nt, Human
acgucuaaaaacaaacugu

SEQ ID NO: 1191020 - RNA, 23 nt, Human
auaaauguucauauuggacaaag

SEQ ID NO: 1191021 - RNA, 21 nt, Human
auacaaacaaucccacagcau

SEQ ID NO: 1191022 - RNA, 22 nt, Human
caaaggacgucuaaaaacaaag

SEQ ID NO: 1191023 - RNA, 21 nt, Human
cucaacaauuucucacuucau

SEQ ID NO: 1191024 - RNA, 24 nt, Human
gacgucuaaaaacaaacuguaucc

SEQ ID NO: 1191025 - RNA, 24 nt, Human
uaaaaacaaacuguauccuucuca

SEQ ID NO: 1191026 - RNA, 25 nt, Human
uaaaaacaaacuguauccuucucaa

SEQ ID NO: 1191027 - RNA, 18 nt, Human
uaaaaacauaaguguaau

SEQ ID NO: 1191028 - RNA, 25 nt, Human
uaaaaacauaaguguaaucaaaaca

SEQ ID NO: 1191029 - RNA, 19 nt, Human
uaaguguaaucaaaacaau

SEQ ID NO: 1191030 - RNA, 22 nt, Human
uggaauuucacaaagagcacac

SEQ ID NO: 1191031 - RNA, 21 nt, Human
acacauacacaaaaauuugua

SEQ ID NO: 1191032 - RNA, 29 nt, Human
acacgcacauacacacauacacaaaaauu

SEQ ID NO: 1191033 - RNA, 20 nt, Human
acauacacacauacacaaaa

SEQ ID NO: 1191034 - RNA, 23 nt, Human
accuuaaaaaaaaacacacauua

SEQ ID NO: 1191035 - RNA, 20 nt, Human
acuccaugaaugugaagaau

SEQ ID NO: 1191036 - RNA, 22 nt, Human
aucacacgcacauacacacaua

SEQ ID NO: 1191037 - RNA, 21 nt, Human
auugcacuccaugaaugugaa

SEQ ID NO: 1191038 - RNA, 20 nt, Human
caacagauuuaacagacauc

SEQ ID NO: 1191039 - RNA, 19 nt, Human
cacaacagauuuaacagac

SEQ ID NO: 1191040 - RNA, 24 nt, Human
cacacauacacaaaaauuuguaga

SEQ ID NO: 1191041 - RNA, 18 nt, Human
cacccagauuggccgagg

SEQ ID NO: 1191042 - RNA, 19 nt, Human
cacgccacccagauuggcc

SEQ ID NO: 1191043 - RNA, 21 nt, Human
cagcacggaaaagcuaucuug

SEQ ID NO: 1191044 - RNA, 22 nt, Human
caguugguuuuuuuaguaguuc

SEQ ID NO: 1191045 - RNA, 24 nt, Human
cauugagguuuuccaagagguaca

SEQ ID NO: 1191046 - RNA, 19 nt, Human
cccauaaucuugcaucugc

SEQ ID NO: 1191047 - RNA, 19 nt, Human
ccccauaaucuugcaucug

SEQ ID NO: 1191048 - RNA, 21 nt, Human
ccccauaaucuugcaucugcu

SEQ ID NO: 1191049 - RNA, 18 nt, Human
cccccauaaucuugcauc

SEQ ID NO: 1191050 - RNA, 28 nt, Human
cggaccaucacagacaccgguuaaagag

SEQ ID NO: 1191051 - RNA, 22 nt, Human
cuauacaguauuauugcacucc

SEQ ID NO: 1191052 - RNA, 23 nt, Human
gaauuuuaaacuauaaaaaacaa

SEQ ID NO: 1191053 - RNA, 21 nt, Human
gacuaaggaaaaaaguuacaa

SEQ ID NO: 1191054 - RNA, 21 nt, Human
gcacaacagauuuaacagaca

SEQ ID NO: 1191055 - RNA, 22 nt, Human
gcacaacagauuuaacagacau

SEQ ID NO: 1191056 - RNA, 24 nt, Human
gcacauacacacauacacaaaaau

SEQ ID NO: 1191057 - RNA, 19 nt, Human
gcaucugcuguauuuugua

SEQ ID NO: 1191058 - RNA, 22 nt, Human
gccucgcuccggaccaucacag

SEQ ID NO: 1191059 - RNA, 24 nt, Human
gcuccggaccaucacagacaccgc

SEQ ID NO: 1191060 - RNA, 22 nt, Human
uaacagacaucuuuggaaaaaa

SEQ ID NO: 1191061 - RNA, 24 nt, Human
uacacacauacacaaaaauuugua

SEQ ID NO: 1191062 - RNA, 23 nt, Human
uauaaaguauuugggaacuucaa

SEQ ID NO: 1191063 - RNA, 24 nt, Human
uauacaguauuauugcacuccaug

SEQ ID NO: 1191064 - RNA, 20 nt, Human
uauauaaacuggacauggcc

SEQ ID NO: 1191065 - RNA, 21 nt, Human
uauugcacuccaugaauguga

SEQ ID NO: 1191066 - RNA, 25 nt, Human
ucacacgcacauacacacauacaca

SEQ ID NO: 1191067 - RNA, 18 nt, Human
ucgcugggcacgccaccc

SEQ ID NO: 1191068 - RNA, 18 nt, Human
ugaacuacacaauaggau

SEQ ID NO: 1191069 - RNA, 24 nt, Human
uggaaugaucccuuaaugcaaaag

SEQ ID NO: 1191070 - RNA, 19 nt, Human
uggggaaagcuauacagua

SEQ ID NO: 1191071 - RNA, 23 nt, Human
ugguaaucacacgcacauacaca

SEQ ID NO: 1191072 - RNA, 19 nt, Human
ugugggggguggggaaagc

SEQ ID NO: 1191073 - RNA, 23 nt, Human
uugcauugagguuuuccaagagg

SEQ ID NO: 1191074 - RNA, 19 nt, Human
uugggaacuucaacuggau

SEQ ID NO: 1191075 - RNA, 19 nt, Human
aagaagaaagacagaaugg

SEQ ID NO: 1191076 - RNA, 21 nt, Human
agaaagacagaauggugucag

SEQ ID NO: 1191077 - RNA, 22 nt, Human
aggggguggaugauaagaagaa

SEQ ID NO: 1191078 - RNA, 19 nt, Human
gaagaaagacagaauggug

SEQ ID NO: 1191079 - RNA, 20 nt, Human
ggggauugggauaauuggag

SEQ ID NO: 1191080 - RNA, 22 nt, Human
uagauuuuugacuuucuagucu

SEQ ID NO: 1191081 - RNA, 20 nt, Human
uggaugauaagaagaaagac

SEQ ID NO: 1191082 - RNA, 21 nt, Human
ugggauggaauuuuguuuuuu

SEQ ID NO: 1191083 - RNA, 21 nt, Human
uuuguuuuuuugagaggggau

SEQ ID NO: 1191084 - RNA, 20 nt, Human
aaacaggaugcuauugcugg

SEQ ID NO: 1191085 - RNA, 22 nt, Human
aaagacaggcgauauaaaauca

SEQ ID NO: 1191086 - RNA, 25 nt, Human
acagcacaaugucacuuuucaaaac

SEQ ID NO: 1191087 - RNA, 18 nt, Human
acagguaacuaagaugaa

SEQ ID NO: 1191088 - RNA, 26 nt, Human
agaaagacaggcgauauaaaaucaga

SEQ ID NO: 1191089 - RNA, 22 nt, Human
agacaggcgauauaaaaucaga

SEQ ID NO: 1191090 - RNA, 18 nt, Human
agagaaagacaggcgaua

SEQ ID NO: 1191091 - RNA, 20 nt, Human
agagcaucugaaauccacga

SEQ ID NO: 1191092 - RNA, 18 nt, Human
agcagagcagaggcaugc

SEQ ID NO: 1191093 - RNA, 19 nt, Human
aucagaguuuagagccugg

SEQ ID NO: 1191094 - RNA, 24 nt, Human
aucaucaggccaaagucaggaaaa

SEQ ID NO: 1191095 - RNA, 23 nt, Human
caucugaaauccacgacagguaa

SEQ ID NO: 1191096 - RNA, 20 nt, Human
cauuucuuucuccaugggcu

SEQ ID NO: 1191097 - RNA, 20 nt, Human
ccuaugagaaugagagcaaa

SEQ ID NO: 1191098 - RNA, 20 nt, Human
cuaagaugaaaagcaacagc

SEQ ID NO: 1191099 - RNA, 18 nt, Human
cucaagggacugccagcu

SEQ ID NO: 1191100 - RNA, 21 nt, Human
cucaagggacugccagcuucu

SEQ ID NO: 1191101 - RNA, 19 nt, Human
cucugugcuggaccgcaac

SEQ ID NO: 1191102 - RNA, 22 nt, Human
gagaaagacaggcgauauaaaa

SEQ ID NO: 1191103 - RNA, 19 nt, Human
gccuaagccugguguagaa

SEQ ID NO: 1191104 - RNA, 23 nt, Human
gccuugaaggacggagaggaugu

SEQ ID NO: 1191105 - RNA, 21 nt, Human
ggaagcauaaauacuaccaga

SEQ ID NO: 1191106 - RNA, 19 nt, Human
ggauaccauuugguugaaa

SEQ ID NO: 1191107 - RNA, 20 nt, Human
gguagaggaagcauaaauac

SEQ ID NO: 1191108 - RNA, 23 nt, Human
gucaugaaagccuaagccuggug

SEQ ID NO: 1191109 - RNA, 19 nt, Human
uaccagagaaagacaggcg

SEQ ID NO: 1191110 - RNA, 21 nt, Human
uaccagagaaagacaggcgau

SEQ ID NO: 1191111 - RNA, 23 nt, Human
uagagcccuggccaaugaaaaaa

SEQ ID NO: 1191112 - RNA, 30 nt, Human
uagagccuggagagaugacaucagcugggg

SEQ ID NO: 1191113 - RNA, 20 nt, Human
uagaggcaagucaugaaagg

SEQ ID NO: 1191114 - RNA, 23 nt, Human
uagugaaaguauguuuuauucac

SEQ ID NO: 1191115 - RNA, 19 nt, Human
ucagcugggggaucaggaa

SEQ ID NO: 1191116 - RNA, 21 nt, Human
ugaaaaaaccagcaacuugag

SEQ ID NO: 1191117 - RNA, 21 nt, Human
ugaaaagcaacagcacaaugu

SEQ ID NO: 1191118 - RNA, 18 nt, Human
ugccuaucaagugugaaa

SEQ ID NO: 1191119 - RNA, 19 nt, Human
uguagaacagagcaucuga

SEQ ID NO: 1191120 - RNA, 25 nt, Human
aaaaagaauugccucuuucuguaga

SEQ ID NO: 1191121 - RNA, 19 nt, Human
aaaaagaccaggacaugaa

SEQ ID NO: 1191122 - RNA, 25 nt, Human
aaaagaccaggacaugaaagggaau

SEQ ID NO: 1191123 - RNA, 23 nt, Human
aaacuacauuuucauaugcacau

SEQ ID NO: 1191124 - RNA, 21 nt, Human
aaagacucucgaaucuaagca

SEQ ID NO: 1191125 - RNA, 20 nt, Human
aaaugucccucuggggcucc

SEQ ID NO: 1191126 - RNA, 18 nt, Human
aaccuuugcuaacugcaa

SEQ ID NO: 1191127 - RNA, 21 nt, Human
aacugucaccucuaccuuccc

SEQ ID NO: 1191128 - RNA, 18 nt, Human
aagagaaaagggaaaccc

SEQ ID NO: 1191129 - RNA, 21 nt, Human
aagagaaacacugagaagcaa

SEQ ID NO: 1191130 - RNA, 24 nt, Human
aaggggaaugacaaucucuguuug

SEQ ID NO: 1191131 - RNA, 22 nt, Human
aauggcauuguuucacuuuugu

SEQ ID NO: 1191132 - RNA, 20 nt, Human
acccagggaguuucuaagag

SEQ ID NO: 1191133 - RNA, 19 nt, Human
acuggaaggaccugucagu

SEQ ID NO: 1191134 - RNA, 27 nt, Human
agaaacacugagaagcaaccgguaccc

SEQ ID NO: 1191135 - RNA, 18 nt, Human
agaacugucaccucuacc

SEQ ID NO: 1191136 - RNA, 19 nt, Human
agaccaggacaugaaaggg

SEQ ID NO: 1191137 - RNA, 22 nt, Human
agagucauccccaaacuacauu

SEQ ID NO: 1191138 - RNA, 19 nt, Human
agccaggaaguaacaggua

SEQ ID NO: 1191139 - RNA, 20 nt, Human
aggaagacuggagccugguu

SEQ ID NO: 1191140 - RNA, 22 nt, Human
aggguaagagggaugcaaaaag

SEQ ID NO: 1191141 - RNA, 18 nt, Human
agguaagaaaggggcagg

SEQ ID NO: 1191142 - RNA, 21 nt, Human
agguuccagcuacaggacugu

SEQ ID NO: 1191143 - RNA, 18 nt, Human
aguaaaaucugagcacug

SEQ ID NO: 1191144 - RNA, 22 nt, Human
aguauacaaacugucacagaau

SEQ ID NO: 1191145 - RNA, 18 nt, Human
agucaggaagaggguaag

SEQ ID NO: 1191146 - RNA, 21 nt, Human
agugugaaaguaagcaaggga

SEQ ID NO: 1191147 - RNA, 21 nt, Human
aguuugauaaauggcauuguu

SEQ ID NO: 1191148 - RNA, 22 nt, Human
auguagaggugucacagaaaau

SEQ ID NO: 1191149 - RNA, 18 nt, Human
auguggcuaagagaaaag

SEQ ID NO: 1191150 - RNA, 22 nt, Human
auucuacugcauguuggaauga

SEQ ID NO: 1191151 - RNA, 24 nt, Human
caauaauaaugauuuccauccaaa

SEQ ID NO: 1191152 - RNA, 20 nt, Human
cacggugcgggaagcagggc

SEQ ID NO: 1191153 - RNA, 20 nt, Human
cacugagaagcaacugguua

SEQ ID NO: 1191154 - RNA, 18 nt, Human
caggaaagacccacggug

SEQ ID NO: 1191155 - RNA, 23 nt, Human
cauguggcuaagagaaaagggaa

SEQ ID NO: 1191156 - RNA, 23 nt, Human
ccacauugauuuccugcugagga

SEQ ID NO: 1191157 - RNA, 18 nt, Human
ccagaguggaggcaaugg

SEQ ID NO: 1191158 - RNA, 22 nt, Human
ccucauucuacugcauguugga

SEQ ID NO: 1191159 - RNA, 24 nt, Human
ccucuauugcuuacgcccucuuua

SEQ ID NO: 1191160 - RNA, 21 nt, Human
ccuguggccagcaugcucucu

SEQ ID NO: 1191161 - RNA, 19 nt, Human
cguuaguaaaaucugagca

SEQ ID NO: 1191162 - RNA, 19 nt, Human
cucagaaaaagaauugccu

SEQ ID NO: 1191163 - RNA, 23 nt, Human
cucagguaaccuuugcuaacugc

SEQ ID NO: 1191164 - RNA, 21 nt, Human
cucuggggcuccacauugauu

SEQ ID NO: 1191165 - RNA, 24 nt, Human
cugcagugugaaaguaagcaaggg

SEQ ID NO: 1191166 - RNA, 23 nt, Human
cugguucacaagcagcuccucuc

SEQ ID NO: 1191167 - RNA, 22 nt, Human
cuuucuguagacuuuucgagaa

SEQ ID NO: 1191168 - RNA, 23 nt, Human
gaacugucaccucuaccuuccca

SEQ ID NO: 1191169 - RNA, 18 nt, Human
gaagagaaacacugagaa

SEQ ID NO: 1191170 - RNA, 20 nt, Human
gaagagacagacagaugagu

SEQ ID NO: 1191171 - RNA, 24 nt, Human
gaaguaacagguauccaggagagu

SEQ ID NO: 1191172 - RNA, 26 nt, Human
gagcacuggaagucaaguaucacuuc

SEQ ID NO: 1191173 - RNA, 20 nt, Human
gaugcaaaaagaggguggag

SEQ ID NO: 1191174 - RNA, 21 nt, Human
gcagaaccacagcugugcaaa

SEQ ID NO: 1191175 - RNA, 19 nt, Human
gcaucaggagcagcaaggg

SEQ ID NO: 1191176 - RNA, 19 nt, Human
gcgggaagcagggcugcac

SEQ ID NO: 1191177 - RNA, 20 nt, Human
ggaagcagggcugcacuggg

SEQ ID NO: 1191178 - RNA, 19 nt, Human
gggcaggguuacugugaga

SEQ ID NO: 1191179 - RNA, 21 nt, Human
gguaagagggaugcaaaaaga

SEQ ID NO: 1191180 - RNA, 19 nt, Human
guagagucauccccaaacu

SEQ ID NO: 1191181 - RNA, 20 nt, Human
guagagucauccccaaacua

SEQ ID NO: 1191182 - RNA, 28 nt, Human
gugcccacuccauuucccucagguaacc

SEQ ID NO: 1191183 - RNA, 18 nt, Human
gugcgggaagcagggcug

SEQ ID NO: 1191184 - RNA, 19 nt, Human
guguguguagucuggaagg

SEQ ID NO: 1191185 - RNA, 21 nt, Human
guucacaagcagcuccucuca

SEQ ID NO: 1191186 - RNA, 19 nt, Human
uaaaaugcaaaaacaagga

SEQ ID NO: 1191187 - RNA, 19 nt, Human
uaacagguauccaggagag

SEQ ID NO: 1191188 - RNA, 18 nt, Human
uaacaugcuagagguggg

SEQ ID NO: 1191189 - RNA, 22 nt, Human
uaagagggaugcaaaaagaggg

SEQ ID NO: 1191190 - RNA, 23 nt, Human
uaagaguugagaccacacuaugc

SEQ ID NO: 1191191 - RNA, 18 nt, Human
uaagucuuuaaaaugcaa

SEQ ID NO: 1191192 - RNA, 23 nt, Human
uacaggacuguuggugcgggagg

SEQ ID NO: 1191193 - RNA, 18 nt, Human
uacugugucuuugggacu

SEQ ID NO: 1191194 - RNA, 20 nt, Human
uacugugucuuugggacugg

SEQ ID NO: 1191195 - RNA, 23 nt, Human
uaggcugcuggcauauaaaaccu

SEQ ID NO: 1191196 - RNA, 20 nt, Human
uauagcugaugcccuaggac

SEQ ID NO: 1191197 - RNA, 23 nt, Human
uccaggccuucaaacuggaacuc

SEQ ID NO: 1191198 - RNA, 26 nt, Human
ucccucuugccccugucaggggggcc

SEQ ID NO: 1191199 - RNA, 21 nt, Human
ucuacgugaaagcuuuucuua

SEQ ID NO: 1191200 - RNA, 21 nt, Human
ucucaguuugauaaauggcau

SEQ ID NO: 1191201 - RNA, 19 nt, Human
ucugucuuguccuccuucc

SEQ ID NO: 1191202 - RNA, 24 nt, Human
ucuuuaaaaugcaaaaacaaggau

SEQ ID NO: 1191203 - RNA, 19 nt, Human
ucuuugggacuggccaauu

SEQ ID NO: 1191204 - RNA, 21 nt, Human
ugaaagggaaugauuuuuuug

SEQ ID NO: 1191205 - RNA, 20 nt, Human
ugaaaguaagcaagggacaa

SEQ ID NO: 1191206 - RNA, 21 nt, Human
ugaaaguaagcaagggacaaa

SEQ ID NO: 1191207 - RNA, 23 nt, Human
ugaaauaugauaguaccagaaug

SEQ ID NO: 1191208 - RNA, 24 nt, Human
ugaccaagugcacugugaaaacaa

SEQ ID NO: 1191209 - RNA, 27 nt, Human
ugagaaaaaauacuugaaauaugauag

SEQ ID NO: 1191210 - RNA, 21 nt, Human
ugagauaaaaugucccucugg

SEQ ID NO: 1191211 - RNA, 23 nt, Human
ugagauaaaaugucccucugggg

SEQ ID NO: 1191212 - RNA, 19 nt, Human
ugaguggauauccugaaaa

SEQ ID NO: 1191213 - RNA, 21 nt, Human
ugcacugugaaaacaaaaccc

SEQ ID NO: 1191214 - RNA, 19 nt, Human
ugcuaacugcaaaacuaac

SEQ ID NO: 1191215 - RNA, 18 nt, Human
uggaguuuucagguagag

SEQ ID NO: 1191216 - RNA, 19 nt, Human
ugggacuguggagggagac

SEQ ID NO: 1191217 - RNA, 22 nt, Human
ugguuucuaaaguugagcuucu

SEQ ID NO: 1191218 - RNA, 22 nt, Human
uguagggaagagacagacagau

SEQ ID NO: 1191219 - RNA, 20 nt, Human
ugucacagaaaaugacuucc

SEQ ID NO: 1191220 - RNA, 21 nt, Human
ugucccaguucucacaucugg

SEQ ID NO: 1191221 - RNA, 26 nt, Human
uguccuauccugaggcugcaaucuca

SEQ ID NO: 1191222 - RNA, 24 nt, Human
ugucuuguccuccuucccccuuuc

SEQ ID NO: 1191223 - RNA, 19 nt, Human
ugugaaaauuccaggccuu

SEQ ID NO: 1191224 - RNA, 21 nt, Human
ugugaaaauuccaggccuuca

SEQ ID NO: 1191225 - RNA, 18 nt, Human
ugugagguaagaaagggg

SEQ ID NO: 1191226 - RNA, 18 nt, Human
uguuggaaugaacucugg

SEQ ID NO: 1191227 - RNA, 22 nt, Human
uguuuggaguuuucagguagag

SEQ ID NO: 1191228 - RNA, 23 nt, Human
uuccagcuacaggacuguuggug

SEQ ID NO: 1191229 - RNA, 20 nt, Human
uucccuguuuggaguuuuca

SEQ ID NO: 1191230 - RNA, 21 nt, Human
uucccuguuuggaguuuucag

SEQ ID NO: 1191231 - RNA, 19 nt, Human
uuuagagucccucuugccc

SEQ ID NO: 1191232 - RNA, 19 nt, Human
uuugaaguuuccacuugua

SEQ ID NO: 1191233 - RNA, 21 nt, Human
uuugcagacuuugacgucuac

SEQ ID NO: 1191234 - RNA, 18 nt, Human
uuuguucagaaaaacauu

SEQ ID NO: 1191235 - RNA, 20 nt, Human
aacaacaucaaacuccacag

SEQ ID NO: 1191236 - RNA, 23 nt, Human
acacugcgaagguacuuccuggg

SEQ ID NO: 1191237 - RNA, 19 nt, Human
agacgucuuuagguaaaaa

SEQ ID NO: 1191238 - RNA, 20 nt, Human
agcggcgggcggcugcuggg

SEQ ID NO: 1191239 - RNA, 19 nt, Human
aggccggcggcggaggugg

SEQ ID NO: 1191240 - RNA, 21 nt, Human
aguucuauuuaucuggucaac

SEQ ID NO: 1191241 - RNA, 25 nt, Human
aucuuccuuggugucauuccuguug

SEQ ID NO: 1191242 - RNA, 21 nt, Human
caacgggcaaaaagcaagcac

SEQ ID NO: 1191243 - RNA, 18 nt, Human
cacccuuuucuccuucaa

SEQ ID NO: 1191244 - RNA, 22 nt, Human
cacccuuuucuccuucaacaac

SEQ ID NO: 1191245 - RNA, 22 nt, Human
cacugaaccauuuuacuguucc

SEQ ID NO: 1191246 - RNA, 25 nt, Human
cacugaaccauuuuacuguucccaa

SEQ ID NO: 1191247 - RNA, 22 nt, Human
cacuuaaggucuucagcuccaa

SEQ ID NO: 1191248 - RNA, 22 nt, Human
cauuugcugccuccgcacccuu

SEQ ID NO: 1191249 - RNA, 21 nt, Human
cccagggcucucuggggucag

SEQ ID NO: 1191250 - RNA, 20 nt, Human
cccuguaacauuugcugccu

SEQ ID NO: 1191251 - RNA, 20 nt, Human
ccgcuuccugcgccgcugcc

SEQ ID NO: 1191252 - RNA, 23 nt, Human
cgccgcugccugcagugcugggg

SEQ ID NO: 1191253 - RNA, 23 nt, Human
cgcuaccgauugaacucuccuug

SEQ ID NO: 1191254 - RNA, 19 nt, Human
cggcggcgcugagggcggg

SEQ ID NO: 1191255 - RNA, 18 nt, Human
cggcggcggagguggggc

SEQ ID NO: 1191256 - RNA, 21 nt, Human
cggcugcggcagcugcggcuu

SEQ ID NO: 1191257 - RNA, 18 nt, Human
cguuguugggcuuggccu

SEQ ID NO: 1191258 - RNA, 20 nt, Human
cuuccugcgccgcugccugc

SEQ ID NO: 1191259 - RNA, 20 nt, Human
cuucguugcgaugaccuucu

SEQ ID NO: 1191260 - RNA, 23 nt, Human
gcccagggcucucuggggucagc

SEQ ID NO: 1191261 - RNA, 19 nt, Human
gcccgggccaccgcuuccu

SEQ ID NO: 1191262 - RNA, 18 nt, Human
gcgggggcggcguggggg

SEQ ID NO: 1191263 - RNA, 24 nt, Human
gcugccuccgcacccuuuucuccu

SEQ ID NO: 1191264 - RNA, 19 nt, Human
ggcggcgugggggagcggc

SEQ ID NO: 1191265 - RNA, 20 nt, Human
gggcggcgugggggagcggg

SEQ ID NO: 1191266 - RNA, 20 nt, Human
gguauuuuuggcgugacuau

SEQ ID NO: 1191267 - RNA, 19 nt, Human
ggugauggugacuggggcc

SEQ ID NO: 1191268 - RNA, 24 nt, Human
guuauucuucuuucuggcagucug

SEQ ID NO: 1191269 - RNA, 20 nt, Human
uacacugcgaagguacuucc

SEQ ID NO: 1191270 - RNA, 23 nt, Human
uacacugcgaagguacuuccugg

SEQ ID NO: 1191271 - RNA, 22 nt, Human
uauuaccaaaaagagacgucuu

SEQ ID NO: 1191272 - RNA, 22 nt, Human
uccuguugaugaaaccauaucc

SEQ ID NO: 1191273 - RNA, 18 nt, Human
ucuccuacacugcgaagg

SEQ ID NO: 1191274 - RNA, 22 nt, Human
ucucuggggucagcucuccgcu

SEQ ID NO: 1191275 - RNA, 18 nt, Human
ucuuuuguucauuucuua

SEQ ID NO: 1191276 - RNA, 23 nt, Human
ugaacuggaacaccaccaggccc

SEQ ID NO: 1191277 - RNA, 23 nt, Human
ugaugguagagaugguaagcugg

SEQ ID NO: 1191278 - RNA, 21 nt, Human
ugcuggggugggugucggcgg

SEQ ID NO: 1191279 - RNA, 25 nt, Human
ugcuggggugggugucggcggcgcu

SEQ ID NO: 1191280 - RNA, 18 nt, Human
uggaacaccaccaggccc

SEQ ID NO: 1191281 - RNA, 22 nt, Human
uggaacaccaccaggcccugua

SEQ ID NO: 1191282 - RNA, 19 nt, Human
uggggucagcucuccgcuc

SEQ ID NO: 1191283 - RNA, 22 nt, Human
uggugacuggggccggcugcgg

SEQ ID NO: 1191284 - RNA, 19 nt, Human
uguccccgccggcaggcgc

SEQ ID NO: 1191285 - RNA, 26 nt, Human
uuaaaaaacacguuuguuauuaccaa

SEQ ID NO: 1191286 - RNA, 26 nt, Human
uuacggucugcugcauauguacugcc

SEQ ID NO: 1191287 - RNA, 19 nt, Human
uuccuuggugucauuccug

SEQ ID NO: 1191288 - RNA, 24 nt, Human
uuccuuggugucauuccuguugau

SEQ ID NO: 1191289 - RNA, 20 nt, Human
uuguccccgccggcaggcgc

SEQ ID NO: 1191290 - RNA, 20 nt, Human
aaacaagagcuuugaaugua

SEQ ID NO: 1191291 - RNA, 19 nt, Human
aacagaaccagcaucauag

SEQ ID NO: 1191292 - RNA, 19 nt, Human
aagagcuuugaauguaaca

SEQ ID NO: 1191293 - RNA, 21 nt, Human
aagcugcggccaggacccccc

SEQ ID NO: 1191294 - RNA, 24 nt, Human
aagcugcggccaggaccccccuga

SEQ ID NO: 1191295 - RNA, 21 nt, Human
acagcugaagcagcagaggac

SEQ ID NO: 1191296 - RNA, 22 nt, Human
acgaacagcaccaccaccaccc

SEQ ID NO: 1191297 - RNA, 19 nt, Human
agagagaagcuuccuggcg

SEQ ID NO: 1191298 - RNA, 19 nt, Human
agagcuguggucagcucca

SEQ ID NO: 1191299 - RNA, 22 nt, Human
agauucccuggugcugcagccu

SEQ ID NO: 1191300 - RNA, 21 nt, Human
agucaccacgaacagcaccac

SEQ ID NO: 1191301 - RNA, 20 nt, Human
caaguaagaagcgguuucua

SEQ ID NO: 1191302 - RNA, 22 nt, Human
cacaccguuuacaauaaauucc

SEQ ID NO: 1191303 - RNA, 23 nt, Human
caccgugaagcugcggccaggac

SEQ ID NO: 1191304 - RNA, 21 nt, Human
caccguuuacaauaaauucca

SEQ ID NO: 1191305 - RNA, 22 nt, Human
cacggcguuccucccugggugc

SEQ ID NO: 1191306 - RNA, 21 nt, Human
cacuugagggugcugcgugcc

SEQ ID NO: 1191307 - RNA, 25 nt, Human
cagagccggcccaccgugcacuccu

SEQ ID NO: 1191308 - RNA, 21 nt, Human
cagcaccaccaccaccccaau

SEQ ID NO: 1191309 - RNA, 18 nt, Human
cagcagaggacgcaggug

SEQ ID NO: 1191310 - RNA, 22 nt, Human
caggaccccccugaggauccug

SEQ ID NO: 1191311 - RNA, 21 nt, Human
caggccccgugaagagagaag

SEQ ID NO: 1191312 - RNA, 20 nt, Human
cauggcccacugagcaaccu

SEQ ID NO: 1191313 - RNA, 20 nt, Human
ccacgaacagcaccaccacc

SEQ ID NO: 1191314 - RNA, 22 nt, Human
ccacgaacagcaccaccaccac

SEQ ID NO: 1191315 - RNA, 21 nt, Human
ccacugagcaaccuuaggucc

SEQ ID NO: 1191316 - RNA, 19 nt, Human
ccaggaccccccugaggau

SEQ ID NO: 1191317 - RNA, 20 nt, Human
ccauggcccacugagcaacc

SEQ ID NO: 1191318 - RNA, 22 nt, Human
cccacugcugaaaucucagaug

SEQ ID NO: 1191319 - RNA, 25 nt, Human
cccagggaccacggcguuccucccu

SEQ ID NO: 1191320 - RNA, 25 nt, Human
ccccugaggauccugggcccuugag

SEQ ID NO: 1191321 - RNA, 25 nt, Human
ccgugcuccuccggcggcucuccuu

SEQ ID NO: 1191322 - RNA, 23 nt, Human
ccuccaagagcuguggucagcuc

SEQ ID NO: 1191323 - RNA, 19 nt, Human
ccuuaaauauagcauggca

SEQ ID NO: 1191324 - RNA, 23 nt, Human
cgaacagcaccaccaccacccca

SEQ ID NO: 1191325 - RNA, 18 nt, Human
cggcucuccuuccgucuc

SEQ ID NO: 1191326 - RNA, 23 nt, Human
cuccaagagcuguggucagcucc

SEQ ID NO: 1191327 - RNA, 22 nt, Human
cugcgugcccagguggcaacag

SEQ ID NO: 1191328 - RNA, 22 nt, Human
cugggugcugcagccucugucc

SEQ ID NO: 1191329 - RNA, 23 nt, Human
gaacagcaccaccaccaccccaa

SEQ ID NO: 1191330 - RNA, 24 nt, Human
gagcaggccucgagguuggguucu

SEQ ID NO: 1191331 - RNA, 22 nt, Human
gccacagucaccacgaacagca

SEQ ID NO: 1191332 - RNA, 19 nt, Human
gcccacugagcaaccuuag

SEQ ID NO: 1191333 - RNA, 20 nt, Human
gcggcucuccuuccgucucc

SEQ ID NO: 1191334 - RNA, 18 nt, Human
gcugcagccuccuggccu

SEQ ID NO: 1191335 - RNA, 19 nt, Human
ggccugguggccgucccag

SEQ ID NO: 1191336 - RNA, 21 nt, Human
uaaaacauauuguacuuucug

SEQ ID NO: 1191337 - RNA, 19 nt, Human
uaaaauaucuuauuucugg

SEQ ID NO: 1191338 - RNA, 20 nt, Human
uaaaauaucuuauuucuggc

SEQ ID NO: 1191339 - RNA, 21 nt, Human
uaagccucaggccaugccucc

SEQ ID NO: 1191340 - RNA, 21 nt, Human
uagaucagcagagccggccca

SEQ ID NO: 1191341 - RNA, 19 nt, Human
ucacagcugaagcagcaga

SEQ ID NO: 1191342 - RNA, 23 nt, Human
ucacagcugaagcagcagaggac

SEQ ID NO: 1191343 - RNA, 24 nt, Human
ucagaugaucucugucuauuuucu

SEQ ID NO: 1191344 - RNA, 20 nt, Human
uccaagagcuguggucagcu

SEQ ID NO: 1191345 - RNA, 18 nt, Human
ucccugggugcugcagcc

SEQ ID NO: 1191346 - RNA, 22 nt, Human
ucccugggugcugcagccucug

SEQ ID NO: 1191347 - RNA, 18 nt, Human
ucgcaggugccccgugcu

SEQ ID NO: 1191348 - RNA, 19 nt, Human
ucgcuccugcuccaggccu

SEQ ID NO: 1191349 - RNA, 22 nt, Human
ucgggcgcugccacguggcccc

SEQ ID NO: 1191350 - RNA, 18 nt, Human
ucuaagccucaggccaug

SEQ ID NO: 1191351 - RNA, 22 nt, Human
ucuagaagaagcacuguccugg

SEQ ID NO: 1191352 - RNA, 21 nt, Human
ucugucuauuuucuaagccuc

SEQ ID NO: 1191353 - RNA, 23 nt, Human
ugaagcugcggccaggacccccc

SEQ ID NO: 1191354 - RNA, 22 nt, Human
ugaauguaacauaacauuuuaa

SEQ ID NO: 1191355 - RNA, 24 nt, Human
ugaggauccugggcccuugaguca

SEQ ID NO: 1191356 - RNA, 22 nt, Human
ugaugaaaacaagagcuuugaa

SEQ ID NO: 1191357 - RNA, 24 nt, Human
ugcaaugugcaaaaguaaucaauu

SEQ ID NO: 1191358 - RNA, 26 nt, Human
ugcccagguggcaacagaaccagcau

SEQ ID NO: 1191359 - RNA, 21 nt, Human
ugccguuuccauggcccacug

SEQ ID NO: 1191360 - RNA, 21 nt, Human
ugcucugagucccugggucgc

SEQ ID NO: 1191361 - RNA, 23 nt, Human
uggcagggagcaggccucgaggu

SEQ ID NO: 1191362 - RNA, 25 nt, Human
uggcagggagcaggccucgagguug

SEQ ID NO: 1191363 - RNA, 21 nt, Human
uggccacagucaccacgaaca

SEQ ID NO: 1191364 - RNA, 19 nt, Human
uggcccacugagcaaccuu

SEQ ID NO: 1191365 - RNA, 20 nt, Human
uggccugguggccgucccag

SEQ ID NO: 1191366 - RNA, 24 nt, Human
uggccugguggccgucccagggac

SEQ ID NO: 1191367 - RNA, 20 nt, Human
uggugcugcagccuccuggc

SEQ ID NO: 1191368 - RNA, 26 nt, Human
uuccugguguagaucagcagagccgg

SEQ ID NO: 1191369 - RNA, 25 nt, Human
uucgcucccauccagaacaggaggc

SEQ ID NO: 1191370 - RNA, 23 nt, Human
uuucagaauuucagggcugauuu

SEQ ID NO: 1191371 - RNA, 23 nt, Human
uuuccauggcccacugagcaacc

SEQ ID NO: 1191372 - RNA, 23 nt, Human
uuugugaugaaaacaagagcuuu

SEQ ID NO: 1191373 - RNA, 24 nt, Human
agcugggccucgugggcccaggag

SEQ ID NO: 1191374 - RNA, 23 nt, Human
aggaggggccacugucagcagca

SEQ ID NO: 1191375 - RNA, 20 nt, Human
cagcuaugcaucaacgagca

SEQ ID NO: 1191376 - RNA, 19 nt, Human
gaggagcugggccucgugg

SEQ ID NO: 1191377 - RNA, 18 nt, Human
gccugugaccagccaggc

SEQ ID NO: 1191378 - RNA, 21 nt, Human
gggucccaucuggagcccggg

SEQ ID NO: 1191379 - RNA, 21 nt, Human
ucuggagcccgggcccggggc

SEQ ID NO: 1191380 - RNA, 20 nt, Human
ugaccacggggucccaucug

SEQ ID NO: 1191381 - RNA, 21 nt, Human
ugcccccucgugccaagacug

SEQ ID NO: 1191382 - RNA, 18 nt, Human
ugggccucgugggcccag

SEQ ID NO: 1191383 - RNA, 21 nt, Human
uccaaugacuccucuuuuauu

SEQ ID NO: 1191384 - RNA, 22 nt, Human
uccaaugacuccucuuuuauug

SEQ ID NO: 1191385 - RNA, 20 nt, Human
ugacuccucuuuuauugcug

SEQ ID NO: 1191386 - RNA, 18 nt, Human
ugucaggaucuaaagccu

SEQ ID NO: 1191387 - RNA, 24 nt, Human
uuccaaugacuccucuuuuauugc

SEQ ID NO: 1191388 - RNA, 20 nt, Human
aaaagagaaaucgugcugca

SEQ ID NO: 1191389 - RNA, 24 nt, Human
aaaagagaaaucgugcugcaaaga

SEQ ID NO: 1191390 - RNA, 25 nt, Human
aaaagagaaaucgugcugcaaagaa

SEQ ID NO: 1191391 - RNA, 26 nt, Human
aaaagagaaaucgugcugcaaagaaa

SEQ ID NO: 1191392 - RNA, 19 nt, Human
aaagacuggugaauaaaca

SEQ ID NO: 1191393 - RNA, 19 nt, Human
aaauacagcacaauuacuu

SEQ ID NO: 1191394 - RNA, 24 nt, Human
aaucacaguccaccaaaauuucug

SEQ ID NO: 1191395 - RNA, 22 nt, Human
aaugaaaaaacagaagcagccc

SEQ ID NO: 1191396 - RNA, 21 nt, Human
acaccaacaaaaccuccacaa

SEQ ID NO: 1191397 - RNA, 22 nt, Human
acaccaacaaaaccuccacaaa

SEQ ID NO: 1191398 - RNA, 24 nt, Human
acaccaacaaaaccuccacaauuu

SEQ ID NO: 1191399 - RNA, 18 nt, Human
accaacaaaaccuccaca

SEQ ID NO: 1191400 - RNA, 19 nt, Human
agaucugaguaacagugua

SEQ ID NO: 1191401 - RNA, 19 nt, Human
agcacacacucucgugaca

SEQ ID NO: 1191402 - RNA, 30 nt, Human
aucacaguccaccaaaauuucugcacguuu

SEQ ID NO: 1191403 - RNA, 23 nt, Human
aucugaguaacaguguacaccac

SEQ ID NO: 1191404 - RNA, 21 nt, Human
aucuuuuggaucuucucgcca

SEQ ID NO: 1191405 - RNA, 21 nt, Human
augacuagggaaaaaaaaacc

SEQ ID NO: 1191406 - RNA, 22 nt, Human
auugcaauggaaauaaauguuc

SEQ ID NO: 1191407 - RNA, 23 nt, Human
caaaaaaaaguuuaaacacacaa

SEQ ID NO: 1191408 - RNA, 22 nt, Human
caaaacaaaaucaaaacaaaaa

SEQ ID NO: 1191409 - RNA, 28 nt, Human
caaaacaaaaucaaaacaaaaaucuauu

SEQ ID NO: 1191410 - RNA, 21 nt, Human
caaaaccuccacaauuuucug

SEQ ID NO: 1191411 - RNA, 23 nt, Human
caaagggcauuaucaaaagagaa

SEQ ID NO: 1191412 - RNA, 19 nt, Human
caccucagauuaacuucac

SEQ ID NO: 1191413 - RNA, 18 nt, Human
cagaagcagccauaauga

SEQ ID NO: 1191414 - RNA, 25 nt, Human
cagccacagaaauugcaauggaaau

SEQ ID NO: 1191415 - RNA, 18 nt, Human
ccacagaaauugcaaugg

SEQ ID NO: 1191416 - RNA, 25 nt, Human
ccccaaagggcauuaucaaaagaga

SEQ ID NO: 1191417 - RNA, 25 nt, Human
cguauacacacaaacccaugaacau

SEQ ID NO: 1191418 - RNA, 22 nt, Human
cucaagucaauuuuuaguuugc

SEQ ID NO: 1191419 - RNA, 26 nt, Human
cucaucagcacacacucucgugacaa

SEQ ID NO: 1191420 - RNA, 25 nt, Human
cucucgugacaaaugauucagacau

SEQ ID NO: 1191421 - RNA, 24 nt, Human
cuucauaucguauacacacaaacc

SEQ ID NO: 1191422 - RNA, 21 nt, Human
cuucccucgcucaaaaaaaag

SEQ ID NO: 1191423 - RNA, 21 nt, Human
cuucucgccaacaacuacugg

SEQ ID NO: 1191424 - RNA, 22 nt, Human
gaaaaaacagaagcagccauaa

SEQ ID NO: 1191425 - RNA, 19 nt, Human
guauacacacaaacccaug

SEQ ID NO: 1191426 - RNA, 24 nt, Human
uaaaagcccucugcacucaacuaa

SEQ ID NO: 1191427 - RNA, 23 nt, Human
uacuggauuuucuuuucugauuu

SEQ ID NO: 1191428 - RNA, 18 nt, Human
uagaaucucaucagcaca

SEQ ID NO: 1191429 - RNA, 18 nt, Human
ucauuuucaaaacaaaau

SEQ ID NO: 1191430 - RNA, 23 nt, Human
ucuuuuggaucuucucgccaaca

SEQ ID NO: 1191431 - RNA, 23 nt, Human
ugagaaaauaaacugcaagauua

SEQ ID NO: 1191432 - RNA, 22 nt, Human
ugcaauggaaauaaauguucag

SEQ ID NO: 1191433 - RNA, 23 nt, Human
ugcacaccaacaaaaccuccaca

SEQ ID NO: 1191434 - RNA, 19 nt, Human
uuaccgauaacuaguugug

SEQ ID NO: 1191435 - RNA, 20 nt, Human
uuccuccauugcacaccaac

SEQ ID NO: 1191436 - RNA, 19 nt, Human
uucucagccacagaaauug

SEQ ID NO: 1191437 - RNA, 21 nt, Human
uuuaauacuggaaaaaucaca

SEQ ID NO: 1191438 - RNA, 22 nt, Human
uuuaguuugcagaugaucaaga

SEQ ID NO: 1191439 - RNA, 22 nt, Human
uuuucuguuugcuucaccucag

SEQ ID NO: 1191440 - RNA, 23 nt, Human
aaacuccuggccucaagcaaucc

SEQ ID NO: 1191441 - RNA, 18 nt, Human
aaaguguugugauuacag

SEQ ID NO: 1191442 - RNA, 20 nt, Human
aacacuaaauaaacuaaggc

SEQ ID NO: 1191443 - RNA, 19 nt, Human
aacuacaggcacacacuac

SEQ ID NO: 1191444 - RNA, 22 nt, Human
aagcauuuucaggagaggaauc

SEQ ID NO: 1191445 - RNA, 25 nt, Human
aagcgauccucccaccucagccucc

SEQ ID NO: 1191446 - RNA, 25 nt, Human
aaguagcugagacuacaggcgcaca

SEQ ID NO: 1191447 - RNA, 21 nt, Human
aagucugcaggcacccagaau

SEQ ID NO: 1191448 - RNA, 21 nt, Human
aaucuuuguagcuaucuucuu

SEQ ID NO: 1191449 - RNA, 23 nt, Human
accaugugaucucugcacaugcc

SEQ ID NO: 1191450 - RNA, 20 nt, Human
accucagcccccugaguagc

SEQ ID NO: 1191451 - RNA, 23 nt, Human
accucagcccccugaguagcuga

SEQ ID NO: 1191452 - RNA, 24 nt, Human
accugucucauuauguugcccagg

SEQ ID NO: 1191453 - RNA, 25 nt, Human
acuauguugcccaggcugguaacaa

SEQ ID NO: 1191454 - RNA, 23 nt, Human
agagugcugggacuauaggugug

SEQ ID NO: 1191455 - RNA, 24 nt, Human
agagugcugggacuauagguguga

SEQ ID NO: 1191456 - RNA, 19 nt, Human
agaugcugcagaaccauga

SEQ ID NO: 1191457 - RNA, 22 nt, Human
agaugcugcagaaccaugagcc

SEQ ID NO: 1191458 - RNA, 22 nt, Human
agcauuuucaggagaggaaucc

SEQ ID NO: 1191459 - RNA, 21 nt, Human
aggagauuguuuuggaacuuu

SEQ ID NO: 1191460 - RNA, 19 nt, Human
aggcaauggggaaaagucc

SEQ ID NO: 1191461 - RNA, 19 nt, Human
aggcaauggggaaaagucc

SEQ ID NO: 1191462 - RNA, 19 nt, Human
agggugcuguggagcaacc

SEQ ID NO: 1191463 - RNA, 21 nt, Human
aggugugagccacugcuccca

SEQ ID NO: 1191464 - RNA, 23 nt, Human
aguccaguggcaccauuauagcu

SEQ ID NO: 1191465 - RNA, 22 nt, Human
agugcugggacuauagguguga

SEQ ID NO: 1191466 - RNA, 21 nt, Human
aucccagccacucuggcucca

SEQ ID NO: 1191467 - RNA, 19 nt, Human
auccuuccuuccuuccucu

SEQ ID NO: 1191468 - RNA, 19 nt, Human
auguaauagaaaaggaaaa

SEQ ID NO: 1191469 - RNA, 22 nt, Human
auuugcauaagguccauuacac

SEQ ID NO: 1191470 - RNA, 20 nt, Human
auuuuuuuuguagauacagg

SEQ ID NO: 1191471 - RNA, 20 nt, Human
caaaggcacuucagaagaua

SEQ ID NO: 1191472 - RNA, 24 nt, Human
caaauuccugagcucaagcaaucc

SEQ ID NO: 1191473 - RNA, 24 nt, Human
caacacuaaauaaacuaaggcaga

SEQ ID NO: 1191474 - RNA, 27 nt, Human
caacacuaaauaaacuaaggcagacau

SEQ ID NO: 1191475 - RNA, 19 nt, Human
caagagagcaugacuaaaa

SEQ ID NO: 1191476 - RNA, 26 nt, Human
caagcaauccucccaccucauucucc

SEQ ID NO: 1191477 - RNA, 27 nt, Human
caagcgauccucccaccucagccuccc

SEQ ID NO: 1191478 - RNA, 27 nt, Human
caagcgauccucccaccucagccuccc

SEQ ID NO: 1191479 - RNA, 26 nt, Human
caccagaagcagaugcugcagaacca

SEQ ID NO: 1191480 - RNA, 21 nt, Human
caccucauucuccuaaguagc

SEQ ID NO: 1191481 - RNA, 28 nt, Human
caccucauucuccuaaguagcugagacu

SEQ ID NO: 1191482 - RNA, 19 nt, Human
cacuaaauaaacuaaggca

SEQ ID NO: 1191483 - RNA, 18 nt, Human
cacuauguugcccaggcu

SEQ ID NO: 1191484 - RNA, 19 nt, Human
cacuauguugcccaggcug

SEQ ID NO: 1191485 - RNA, 23 nt, Human
cacuauguugcccaggcugguaa

SEQ ID NO: 1191486 - RNA, 31 nt, Human
cacuauguugcccaggcugguaacaaacucc

SEQ ID NO: 1191487 - RNA, 23 nt, Human
cacucuggcuccagccacagcuc

SEQ ID NO: 1191488 - RNA, 25 nt, Human
cagaaccaugagccaaauaaaccuc

SEQ ID NO: 1191489 - RNA, 20 nt, Human
cagagugcugggacuauagg

SEQ ID NO: 1191490 - RNA, 24 nt, Human
cagagugcugggacuauaggugug

SEQ ID NO: 1191491 - RNA, 21 nt, Human
caggcacccagaaugcaagag

SEQ ID NO: 1191492 - RNA, 21 nt, Human
caggcgcacaccaccacaccc

SEQ ID NO: 1191493 - RNA, 25 nt, Human
caggcuggaguccaguggcaccauu

SEQ ID NO: 1191494 - RNA, 24 nt, Human
cagggucucacuauguugcccagg

SEQ ID NO: 1191495 - RNA, 27 nt, Human
cauuacacacacacaccuauauauaua

SEQ ID NO: 1191496 - RNA, 24 nt, Human
cauuauguugcccaggcaugucuc

SEQ ID NO: 1191497 - RNA, 22 nt, Human
cauucugucucccaggcuggag

SEQ ID NO: 1191498 - RNA, 24 nt, Human
ccaaaguguugugauuacaguugu

SEQ ID NO: 1191499 - RNA, 23 nt, Human
ccacaguggaagcagccugaagc

SEQ ID NO: 1191500 - RNA, 23 nt, Human
ccaccucauucuccuaaguagcu

SEQ ID NO: 1191501 - RNA, 24 nt, Human
ccagaaugcaagagugguggagaa

SEQ ID NO: 1191502 - RNA, 19 nt, Human
ccagugugccuaggaugca

SEQ ID NO: 1191503 - RNA, 24 nt, Human
ccaucacaagcuaagagguccagg

SEQ ID NO: 1191504 - RNA, 21 nt, Human
cccaggcaugucuccaacucc

SEQ ID NO: 1191505 - RNA, 22 nt, Human
cccaggcuggaguccaguggca

SEQ ID NO: 1191506 - RNA, 23 nt, Human
cccccugaguagcugaacuacag

SEQ ID NO: 1191507 - RNA, 19 nt, Human
ccccguugcuuccucucuc

SEQ ID NO: 1191508 - RNA, 23 nt, Human
ccuaaguagcugagacuacaggc

SEQ ID NO: 1191509 - RNA, 22 nt, Human
ccucaagcgauccucccaccuc

SEQ ID NO: 1191510 - RNA, 24 nt, Human
ccucccaccucagcccccugagua

SEQ ID NO: 1191511 - RNA, 23 nt, Human
ccucccaccucagccucccaaag

SEQ ID NO: 1191512 - RNA, 20 nt, Human
ccugagcucaagcaauccuc

SEQ ID NO: 1191513 - RNA, 23 nt, Human
ccugagcucaagcaauccuccca

SEQ ID NO: 1191514 - RNA, 23 nt, Human
ccugaguagcugaacuacaggca

SEQ ID NO: 1191515 - RNA, 18 nt, Human
ccuggccucaagcaaucc

SEQ ID NO: 1191516 - RNA, 21 nt, Human
ccugggccuguuacgccuuuc

SEQ ID NO: 1191517 - RNA, 23 nt, Human
ccugugcugccuagagaugcugc

SEQ ID NO: 1191518 - RNA, 20 nt, Human
ccuuccuuccuuccucucuc

SEQ ID NO: 1191519 - RNA, 20 nt, Human
ccuugccucaagcgauccuc

SEQ ID NO: 1191520 - RNA, 18 nt, Human
cgcacaccaccacaccca

SEQ ID NO: 1191521 - RNA, 23 nt, Human
cgcacaccaccacacccagcuaa

SEQ ID NO: 1191522 - RNA, 19 nt, Human
cuagagaugcugcucccac

SEQ ID NO: 1191523 - RNA, 25 nt, Human
cucaagcaauccucccaccucauuc

SEQ ID NO: 1191524 - RNA, 24 nt, Human
cucaagcgauccucccaccucagc

SEQ ID NO: 1191525 - RNA, 23 nt, Human
cucccaccucagcccccugagua

SEQ ID NO: 1191526 - RNA, 21 nt, Human
cucccaggcuggaguccagug

SEQ ID NO: 1191527 - RNA, 20 nt, Human
cucccaucacaagcuaagag

SEQ ID NO: 1191528 - RNA, 26 nt, Human
cucccaucacaagcuaagagguccag

SEQ ID NO: 1191529 - RNA, 21 nt, Human
cuccuaaguagcugagacuac

SEQ ID NO: 1191530 - RNA, 20 nt, Human
cucucucuuuuuuucuuuga

SEQ ID NO: 1191531 - RNA, 21 nt, Human
cucugcacaugccagcuccac

SEQ ID NO: 1191532 - RNA, 23 nt, Human
cugcucugcuggguucuggauuu

SEQ ID NO: 1191533 - RNA, 18 nt, Human
cuggccucaagcaauccu

SEQ ID NO: 1191534 - RNA, 22 nt, Human
cuguuuggauccuggaggcaga

SEQ ID NO: 1191535 - RNA, 21 nt, Human
cuuccuuccuuccucucucuu

SEQ ID NO: 1191536 - RNA, 23 nt, Human
gaacauccuuuacccaaaccuca

SEQ ID NO: 1191537 - RNA, 19 nt, Human
gaacuacaggcacacacua

SEQ ID NO: 1191538 - RNA, 22 nt, Human
gaacuacaggcacacacuacca

SEQ ID NO: 1191539 - RNA, 25 nt, Human
gaaugggaacauguuuucuacuugg

SEQ ID NO: 1191540 - RNA, 18 nt, Human
gacagggucuugcuaugu

SEQ ID NO: 1191541 - RNA, 18 nt, Human
gacuauaggugugagcca

SEQ ID NO: 1191542 - RNA, 21 nt, Human
gacuauaggugugagccacug

SEQ ID NO: 1191543 - RNA, 22 nt, Human
gacuauaggugugagccacugc

SEQ ID NO: 1191544 - RNA, 25 nt, Human
gagcaugacuaaaaguuaaucaugc

SEQ ID NO: 1191545 - RNA, 19 nt, Human
gagugcugggacuauaggu

SEQ ID NO: 1191546 - RNA, 19 nt, Human
gauuuuuagucagcagucc

SEQ ID NO: 1191547 - RNA, 21 nt, Human
gcacacacuaccacaccugga

SEQ ID NO: 1191548 - RNA, 19 nt, Human
gcaggcacccagaaugcaa

SEQ ID NO: 1191549 - RNA, 19 nt, Human
gcgcacaccaccacaccca

SEQ ID NO: 1191550 - RNA, 23 nt, Human
gcugguaacaaacuccuggccuc

SEQ ID NO: 1191551 - RNA, 21 nt, Human
ggaaaaagcauuuucaggaga

SEQ ID NO: 1191552 - RNA, 24 nt, Human
ggcugguaacaaacuccuggccuc

SEQ ID NO: 1191553 - RNA, 23 nt, Human
ggugcaguagcacgaucauaguu

SEQ ID NO: 1191554 - RNA, 20 nt, Human
gguucuggauuugcauaagg

SEQ ID NO: 1191555 - RNA, 19 nt, Human
gguuuuuggaggacaggcu

SEQ ID NO: 1191556 - RNA, 21 nt, Human
guagucucucccaucacaagc

SEQ ID NO: 1191557 - RNA, 20 nt, Human
uaaauaaacuaaggcagaca

SEQ ID NO: 1191558 - RNA, 22 nt, Human
uaacuguuuggauccuggaggc

SEQ ID NO: 1191559 - RNA, 21 nt, Human
uacaaacaaaaugagaggcag

SEQ ID NO: 1191560 - RNA, 19 nt, Human
uacccagccucagguauuc

SEQ ID NO: 1191561 - RNA, 22 nt, Human
uagauacagggucucacuaugu

SEQ ID NO: 1191562 - RNA, 23 nt, Human
uagcuaucuucuuuacaaacaaa

SEQ ID NO: 1191563 - RNA, 20 nt, Human
uauaggugugagccacugcu

SEQ ID NO: 1191564 - RNA, 21 nt, Human
uauguugcccaggcaugucuc

SEQ ID NO: 1191565 - RNA, 24 nt, Human
uauguugcccaggcaugucuccaa

SEQ ID NO: 1191566 - RNA, 20 nt, Human
uauguugcccaggcugguaa

SEQ ID NO: 1191567 - RNA, 23 nt, Human
uauguugcccaggcugguaacaa

SEQ ID NO: 1191568 - RNA, 24 nt, Human
uauguugcccaggcugguaacaaa

SEQ ID NO: 1191569 - RNA, 18 nt, Human
ucaccaauggcuuggugc

SEQ ID NO: 1191570 - RNA, 23 nt, Human
ucagaagauagguagucucuccc

SEQ ID NO: 1191571 - RNA, 21 nt, Human
ucagagugcugggacuauagg

SEQ ID NO: 1191572 - RNA, 24 nt, Human
ucagagugcugggacuauaggugu

SEQ ID NO: 1191573 - RNA, 18 nt, Human
ucagcccccugaguagcu

SEQ ID NO: 1191574 - RNA, 21 nt, Human
ucagggcucugugcccugugc

SEQ ID NO: 1191575 - RNA, 23 nt, Human
ucauaguucauucugucucccag

SEQ ID NO: 1191576 - RNA, 24 nt, Human
ucauguugaaauuugauccccagu

SEQ ID NO: 1191577 - RNA, 20 nt, Human
ucauucugucucccaggcug

SEQ ID NO: 1191578 - RNA, 22 nt, Human
ucauucugucucccaggcugga

SEQ ID NO: 1191579 - RNA, 19 nt, Human
uccacuucaucuuccacca

SEQ ID NO: 1191580 - RNA, 18 nt, Human
uccagccacagcucaaag

SEQ ID NO: 1191581 - RNA, 19 nt, Human
ucccaaacauccaaaucug

SEQ ID NO: 1191582 - RNA, 22 nt, Human
ucccaaaguguugugauuacag

SEQ ID NO: 1191583 - RNA, 23 nt, Human
ucccaucacaagcuaagagguug

SEQ ID NO: 1191584 - RNA, 22 nt, Human
ucccccguugcuuccucucuca

SEQ ID NO: 1191585 - RNA, 24 nt, Human
uccuaaguagcugagacuacaggc

SEQ ID NO: 1191586 - RNA, 20 nt, Human
uccucccaccucagccuccc

SEQ ID NO: 1191587 - RNA, 23 nt, Human
uccuuauaaauacccagccucag

SEQ ID NO: 1191588 - RNA, 18 nt, Human
ucucacuauguugcccag

SEQ ID NO: 1191589 - RNA, 19 nt, Human
ucucacuauguugcccagg

SEQ ID NO: 1191590 - RNA, 23 nt, Human
ucucacuauguugcccaggcugg

SEQ ID NO: 1191591 - RNA, 24 nt, Human
ucucacuauguugcccaggcuggu

SEQ ID NO: 1191592 - RNA, 24 nt, Human
ucucacuauguugcccaggcuggu

SEQ ID NO: 1191593 - RNA, 25 nt, Human
ucucacuauguugcccaggcuggua

SEQ ID NO: 1191594 - RNA, 23 nt, Human
ucucagagugcugggacuauagg

SEQ ID NO: 1191595 - RNA, 24 nt, Human
ucucagagugcugggacuauaggu

SEQ ID NO: 1191596 - RNA, 19 nt, Human
ucucagagugcugggacuu

SEQ ID NO: 1191597 - RNA, 18 nt, Human
ucucauuauguugcccag

SEQ ID NO: 1191598 - RNA, 21 nt, Human
ucucccuuuuggaaugggaac

SEQ ID NO: 1191599 - RNA, 21 nt, Human
ucugcucugcuggguucugga

SEQ ID NO: 1191600 - RNA, 23 nt, Human
ucuuuacaaacaaaaugagaggc

SEQ ID NO: 1191601 - RNA, 19 nt, Human
ucuuuuuuucuuugacagg

SEQ ID NO: 1191602 - RNA, 23 nt, Human
ugaacuacaggcacacacuacca

SEQ ID NO: 1191603 - RNA, 19 nt, Human
ugaaguaacacaacuuacu

SEQ ID NO: 1191604 - RNA, 21 nt, Human
ugaagucaaaggagauuguuu

SEQ ID NO: 1191605 - RNA, 24 nt, Human
ugagacuacaggcgcacaccacca

SEQ ID NO: 1191606 - RNA, 20 nt, Human
ugagaggcagguuuuccuga

SEQ ID NO: 1191607 - RNA, 18 nt, Human
ugcagauauaaaaauuug

SEQ ID NO: 1191608 - RNA, 24 nt, Human
ugcccaggcugguaacaaacuccu

SEQ ID NO: 1191609 - RNA, 19 nt, Human
uggccucaagcaauccucu

SEQ ID NO: 1191610 - RNA, 20 nt, Human
uggccucaagcaauccucug

SEQ ID NO: 1191611 - RNA, 19 nt, Human
ugggacuauaggugugagc

SEQ ID NO: 1191612 - RNA, 21 nt, Human
ugggacuauaggugugagcca

SEQ ID NO: 1191613 - RNA, 22 nt, Human
ugggacuauaggugugagccac

SEQ ID NO: 1191614 - RNA, 22 nt, Human
ugggacuauaggugugagccac

SEQ ID NO: 1191615 - RNA, 24 nt, Human
ugggacuauaggugugagccacug

SEQ ID NO: 1191616 - RNA, 18 nt, Human
ugggccaauuucucccuu

SEQ ID NO: 1191617 - RNA, 19 nt, Human
ugggccuguuacgccuuuc

SEQ ID NO: 1191618 - RNA, 18 nt, Human
uggugccauccuugaagu

SEQ ID NO: 1191619 - RNA, 18 nt, Human
uguauggaaggacaugag

SEQ ID NO: 1191620 - RNA, 19 nt, Human
uguauggaaggacaugaga

SEQ ID NO: 1191621 - RNA, 23 nt, Human
ugucccaaacauccaaaucuguc

SEQ ID NO: 1191622 - RNA, 21 nt, Human
ugugcugccuagagaugcugc

SEQ ID NO: 1191623 - RNA, 23 nt, Human
uuaaaaagagcuuggcaccucac

SEQ ID NO: 1191624 - RNA, 22 nt, Human
uuaaaauguuuguagagaccug

SEQ ID NO: 1191625 - RNA, 18 nt, Human
uuaaugucugcucugcug

SEQ ID NO: 1191626 - RNA, 22 nt, Human
uuacuacaucaucaaauucccu

SEQ ID NO: 1191627 - RNA, 25 nt, Human
uucaucuuccaccacaguggaagca

SEQ ID NO: 1191628 - RNA, 18 nt, Human
uucauucugucucccagg

SEQ ID NO: 1191629 - RNA, 24 nt, Human
uucauucugucucccaggcuggag

SEQ ID NO: 1191630 - RNA, 21 nt, Human
uucugucucccaggcuggagu

SEQ ID NO: 1191631 - RNA, 18 nt, Human
uugauccccaguguugga

SEQ ID NO: 1191632 - RNA, 18 nt, Human
uugauuuuuagucagcag

SEQ ID NO: 1191633 - RNA, 23 nt, Human
uugggccaauuucucccuuuugg

SEQ ID NO: 1191634 - RNA, 23 nt, Human
uuuacuggaacauccuuuaccca

SEQ ID NO: 1191635 - RNA, 24 nt, Human
uuucaggagaggaauccaagggug

SEQ ID NO: 1191636 - RNA, 20 nt, Human
uuuccugacacaguuccuag

SEQ ID NO: 1191637 - RNA, 27 nt, Human
uuuuggaggacaggcucagggcucugu

SEQ ID NO: 1191638 - RNA, 21 nt, Human
uuuuuuucuuugacagggucu

SEQ ID NO: 1191639 - RNA, 24 nt, Human
aaaaggaaacaaagucacuuuaaa

SEQ ID NO: 1191640 - RNA, 21 nt, Human
aaagaaacuugcuuuccauug

SEQ ID NO: 1191641 - RNA, 21 nt, Human
aaagcuuccaaaguuucuuga

SEQ ID NO: 1191642 - RNA, 20 nt, Human
aaaucuucuuucacaaaagc

SEQ ID NO: 1191643 - RNA, 23 nt, Human
aacauuuuucuaaacaacugaca

SEQ ID NO: 1191644 - RNA, 23 nt, Human
aaucauuuauaaaaggaaacaaa

SEQ ID NO: 1191645 - RNA, 21 nt, Human
acuucauuguaguccaugugg

SEQ ID NO: 1191646 - RNA, 19 nt, Human
agagagaaacauucuggaa

SEQ ID NO: 1191647 - RNA, 24 nt, Human
caauaagaaaacuugacggcucau

SEQ ID NO: 1191648 - RNA, 23 nt, Human
cccggaacugaaacagcugagac

SEQ ID NO: 1191649 - RNA, 20 nt, Human
ccuccacaaagaaacuugcu

SEQ ID NO: 1191650 - RNA, 18 nt, Human
ccuccugcaucucuuccu

SEQ ID NO: 1191651 - RNA, 21 nt, Human
ccugcaucucuuccuggggua

SEQ ID NO: 1191652 - RNA, 20 nt, Human
cuacucaagagaguaggcaa

SEQ ID NO: 1191653 - RNA, 22 nt, Human
cuagagaaauccaaagucauaa

SEQ ID NO: 1191654 - RNA, 25 nt, Human
cucaaggaaauccuccacaaagaaa

SEQ ID NO: 1191655 - RNA, 22 nt, Human
cugaccuccucuacuucaauuu

SEQ ID NO: 1191656 - RNA, 18 nt, Human
ggaaauccuccacaaaga

SEQ ID NO: 1191657 - RNA, 23 nt, Human
ggaaauccuccacaaagaaacuu

SEQ ID NO: 1191658 - RNA, 23 nt, Human
uaaaaggaaacaaagucacuuua

SEQ ID NO: 1191659 - RNA, 20 nt, Human
uaaauuucaaccugagguaa

SEQ ID NO: 1191660 - RNA, 23 nt, Human
uagaauuuuaggacauaacaaga

SEQ ID NO: 1191661 - RNA, 23 nt, Human
uagaggaaauccagaaucuaaca

SEQ ID NO: 1191662 - RNA, 19 nt, Human
uaggccaaugugaacggaa

SEQ ID NO: 1191663 - RNA, 22 nt, Human
uaucugucauucccggaacuga

SEQ ID NO: 1191664 - RNA, 23 nt, Human
ucaaagcaguguaaauuucaacc

SEQ ID NO: 1191665 - RNA, 22 nt, Human
ucaaccugagguaaaaaucgcc

SEQ ID NO: 1191666 - RNA, 22 nt, Human
uccauguggguguauaaacuga

SEQ ID NO: 1191667 - RNA, 19 nt, Human
uccuccacaaagaaacuug

SEQ ID NO: 1191668 - RNA, 19 nt, Human
uccuuuaccaaaaacaguu

SEQ ID NO: 1191669 - RNA, 18 nt, Human
ucgaagcaauaaagcauc

SEQ ID NO: 1191670 - RNA, 18 nt, Human
ucuaaacaacugacaggg

SEQ ID NO: 1191671 - RNA, 18 nt, Human
ucuggcagagccagggcc

SEQ ID NO: 1191672 - RNA, 24 nt, Human
ucuguaaaacuucuuucuaaccac

SEQ ID NO: 1191673 - RNA, 28 nt, Human
ucuguaaaacuucuuucuaaccacauuc

SEQ ID NO: 1191674 - RNA, 18 nt, Human
ugaaaacauaucuucuuu

SEQ ID NO: 1191675 - RNA, 20 nt, Human
ugaaacagcugagacucucg

SEQ ID NO: 1191676 - RNA, 19 nt, Human
ugauggaauaucaauuucu

SEQ ID NO: 1191677 - RNA, 23 nt, Human
ugcaugauauuucaaugcugaaa

SEQ ID NO: 1191678 - RNA, 24 nt, Human
uggaaaaauuagcuucugugaaga

SEQ ID NO: 1191679 - RNA, 23 nt, Human
ugggagucuggauuugaacuugg

SEQ ID NO: 1191680 - RNA, 23 nt, Human
uucacaaaagcuuccaaaguuuc

SEQ ID NO: 1191681 - RNA, 24 nt, Human
uucauacucaauaagaaaacuuga

SEQ ID NO: 1191682 - RNA, 21 nt, Human
uucaucauuuuuucaagaaaa

SEQ ID NO: 1191683 - RNA, 23 nt, Human
uucaucauuuuuucaagaaaaug

SEQ ID NO: 1191684 - RNA, 19 nt, Human
uucucauauaaauagucua

SEQ ID NO: 1191685 - RNA, 24 nt, Human
uucucauauaaauagucuauugca

SEQ ID NO: 1191686 - RNA, 18 nt, Human
uugguucugguuuugaag

SEQ ID NO: 1191687 - RNA, 19 nt, Human
uuucuggcacuggguuuaa

SEQ ID NO: 1191688 - RNA, 19 nt, Human
uuucugguuugaggcuugg

SEQ ID NO: 1191689 - RNA, 24 nt, Human
aaaaagaagcaagcuccauuucca

SEQ ID NO: 1191690 - RNA, 23 nt, Human
aaaacaacccaaguucccucuga

SEQ ID NO: 1191691 - RNA, 22 nt, Human
aaacaaaaagaagcaagcucca

SEQ ID NO: 1191692 - RNA, 18 nt, Human
aaacuacaggugguacca

SEQ ID NO: 1191693 - RNA, 24 nt, Human
aaagcacagagcuaacccuucagg

SEQ ID NO: 1191694 - RNA, 20 nt, Human
aaagcacuccugcacuuuca

SEQ ID NO: 1191695 - RNA, 20 nt, Human
aacaaaaaccuauuuuaaag

SEQ ID NO: 1191696 - RNA, 19 nt, Human
aacacggugaaaccccccu

SEQ ID NO: 1191697 - RNA, 20 nt, Human
aacacggugaaaccccccuc

SEQ ID NO: 1191698 - RNA, 18 nt, Human
aagcagggaggcagaggu

SEQ ID NO: 1191699 - RNA, 22 nt, Human
aagcagggaggcagagguuaca

SEQ ID NO: 1191700 - RNA, 19 nt, Human
aagcccaccaagacucaag

SEQ ID NO: 1191701 - RNA, 21 nt, Human
aagcucuccaagcuagaucuc

SEQ ID NO: 1191702 - RNA, 19 nt, Human
aaggcugacagcccccuac

SEQ ID NO: 1191703 - RNA, 24 nt, Human
aauauguaucucuccaauaaaggc

SEQ ID NO: 1191704 - RNA, 18 nt, Human
aauccugcuaaccccaag

SEQ ID NO: 1191705 - RNA, 22 nt, Human
aaugaccuuguaaguuauaaac

SEQ ID NO: 1191706 - RNA, 24 nt, Human
acacaaucaacugcccagagcugu

SEQ ID NO: 1191707 - RNA, 24 nt, Human
acagagugagaccuugucucaaaa

SEQ ID NO: 1191708 - RNA, 24 nt, Human
acuccagccugggcaacagaguga

SEQ ID NO: 1191709 - RNA, 18 nt, Human
acucgggaggaugaggug

SEQ ID NO: 1191710 - RNA, 24 nt, Human
acugcacuccagccugggcaacag

SEQ ID NO: 1191711 - RNA, 24 nt, Human
acugcacuccagccugggcaacag

SEQ ID NO: 1191712 - RNA, 18 nt, Human
acugccucauucccucca

SEQ ID NO: 1191713 - RNA, 21 nt, Human
agaauacucaggccagccucg

SEQ ID NO: 1191714 - RNA, 20 nt, Human
agaauaugacuuguguccuc

SEQ ID NO: 1191715 - RNA, 19 nt, Human
agagcuauaggugccccuc

SEQ ID NO: 1191716 - RNA, 23 nt, Human
agagguuacagugagcugagauc

SEQ ID NO: 1191717 - RNA, 24 nt, Human
agagguuacagugagcugagauca

SEQ ID NO: 1191718 - RNA, 19 nt, Human
agcaaaagcacuccugcac

SEQ ID NO: 1191719 - RNA, 24 nt, Human
agcacuuugggaggcggagacggg

SEQ ID NO: 1191720 - RNA, 22 nt, Human
agccagccagaguggugguggg

SEQ ID NO: 1191721 - RNA, 24 nt, Human
agccuggccaacacggugaaaccc

SEQ ID NO: 1191722 - RNA, 20 nt, Human
agccugggcaacagagugac

SEQ ID NO: 1191723 - RNA, 23 nt, Human
agcuccacccccaucugaguagc

SEQ ID NO: 1191724 - RNA, 20 nt, Human
aggaagccaagucagauuca

SEQ ID NO: 1191725 - RNA, 24 nt, Human
aggcaaaacaaaaagaagcaagcu

SEQ ID NO: 1191726 - RNA, 23 nt, Human
aggcagaaggcggcauuguagag

SEQ ID NO: 1191727 - RNA, 24 nt, Human
aggcagacugccucauucccucca

SEQ ID NO: 1191728 - RNA, 20 nt, Human
aggcagagguuacagugagc

SEQ ID NO: 1191729 - RNA, 24 nt, Human
aggcagagguuacagugagcugag

SEQ ID NO: 1191730 - RNA, 19 nt, Human
aguugcaggcagggacuga

SEQ ID NO: 1191731 - RNA, 18 nt, Human
aucaucagcagagcaaaa

SEQ ID NO: 1191732 - RNA, 18 nt, Human
aucaucuccucgauaggg

SEQ ID NO: 1191733 - RNA, 24 nt, Human
aucaugccacugcacuccagccug

SEQ ID NO: 1191734 - RNA, 24 nt, Human
augccacugcacuccagccugggc

SEQ ID NO: 1191735 - RNA, 19 nt, Human
augggggccaagaaggacc

SEQ ID NO: 1191736 - RNA, 19 nt, Human
caaaaaaggccgacuggca

SEQ ID NO: 1191737 - RNA, 22 nt, Human
caaaacaacccaaguucccucu

SEQ ID NO: 1191738 - RNA, 23 nt, Human
caaacuacaggugguaccaacca

SEQ ID NO: 1191739 - RNA, 21 nt, Human
caacacggugaaaccccccuc

SEQ ID NO: 1191740 - RNA, 23 nt, Human
caacagagugacagagugagacc

SEQ ID NO: 1191741 - RNA, 19 nt, Human
caagaaggaccuuuguacu

SEQ ID NO: 1191742 - RNA, 25 nt, Human
caagauggccacucccagggacuaa

SEQ ID NO: 1191743 - RNA, 22 nt, Human
caagcacaacaacauauacaua

SEQ ID NO: 1191744 - RNA, 22 nt, Human
caagugaaugcaucuggucaga

SEQ ID NO: 1191745 - RNA, 24 nt, Human
caaguucuuggcuuggaaggguca

SEQ ID NO: 1191746 - RNA, 23 nt, Human
caauacagaccaucacaggucaa

SEQ ID NO: 1191747 - RNA, 18 nt, Human
caccacgugguagagggu

SEQ ID NO: 1191748 - RNA, 18 nt, Human
caccacgugguagagggu

SEQ ID NO: 1191749 - RNA, 21 nt, Human
caccacgugguagagggucca

SEQ ID NO: 1191750 - RNA, 22 nt, Human
cacuccagccugggcaacagag

SEQ ID NO: 1191751 - RNA, 24 nt, Human
cacuccagccugggcaacagagug

SEQ ID NO: 1191752 - RNA, 19 nt, Human
cacugcacuccagccuggg

SEQ ID NO: 1191753 - RNA, 21 nt, Human
cacugcacuccagccugggca

SEQ ID NO: 1191754 - RNA, 22 nt, Human
cacugcacuccagccugggcaa

SEQ ID NO: 1191755 - RNA, 23 nt, Human
cacugcacuccagccugggcaac

SEQ ID NO: 1191756 - RNA, 24 nt, Human
cacugcacuccagccugggcaaca

SEQ ID NO: 1191757 - RNA, 21 nt, Human
cagagcaaaacccaugcaaac

SEQ ID NO: 1191758 - RNA, 18 nt, Human
cagaucacaggaagccaa

SEQ ID NO: 1191759 - RNA, 18 nt, Human
cagcacuuugggaggcgg

SEQ ID NO: 1191760 - RNA, 21 nt, Human
cagcagagcaaaacccaugca

SEQ ID NO: 1191761 - RNA, 26 nt, Human
cagcuccccuuuugugggcacugccu

SEQ ID NO: 1191762 - RNA, 24 nt, Human
caggcaaaacaaaaagaagcaagc

SEQ ID NO: 1191763 - RNA, 18 nt, Human
cagggacuaaagcacaga

SEQ ID NO: 1191764 - RNA, 22 nt, Human
cauaaauucugaauccugcuaa

SEQ ID NO: 1191765 - RNA, 20 nt, Human
cauaacucauggcuaagagc

SEQ ID NO: 1191766 - RNA, 19 nt, Human
caucccaagccacagucau

SEQ ID NO: 1191767 - RNA, 24 nt, Human
caugccaguaauuccagcacuuug

SEQ ID NO: 1191768 - RNA, 23 nt, Human
cauggcuaagagcuauaggugcc

SEQ ID NO: 1191769 - RNA, 25 nt, Human
ccaaaacaacccaaguucccucuga

SEQ ID NO: 1191770 - RNA, 22 nt, Human
ccaacacggugaaaccccccuc

SEQ ID NO: 1191771 - RNA, 20 nt, Human
ccacugcacuccagccuggg

SEQ ID NO: 1191772 - RNA, 20 nt, Human
ccacugcacuccagccuggg

SEQ ID NO: 1191773 - RNA, 21 nt, Human
ccacugcacuccagccugggc

SEQ ID NO: 1191774 - RNA, 23 nt, Human
ccacugcacuccagccugggcaa

SEQ ID NO: 1191775 - RNA, 24 nt, Human
ccacugcacuccagccugggcaac

SEQ ID NO: 1191776 - RNA, 21 nt, Human
cccaaagaaacagugcccuuu

SEQ ID NO: 1191777 - RNA, 26 nt, Human
cccaagccacagucauuaucccaaaa

SEQ ID NO: 1191778 - RNA, 21 nt, Human
cccaaggcuaggggaugggac

SEQ ID NO: 1191779 - RNA, 19 nt, Human
cccccaaaucucugugccg

SEQ ID NO: 1191780 - RNA, 18 nt, Human
ccccucaccuccucuccc

SEQ ID NO: 1191781 - RNA, 20 nt, Human
ccccucaccuccucucccua

SEQ ID NO: 1191782 - RNA, 25 nt, Human
cccucuguuuggcaugccaaaaauc

SEQ ID NO: 1191783 - RNA, 22 nt, Human
cccuuggauggagggagucaua

SEQ ID NO: 1191784 - RNA, 21 nt, Human
ccuccagaaguggcuuuucau

SEQ ID NO: 1191785 - RNA, 18 nt, Human
ccuggccaacacggugaa

SEQ ID NO: 1191786 - RNA, 27 nt, Human
ccugggcaacagagugacagagugaga

SEQ ID NO: 1191787 - RNA, 19 nt, Human
ccuugggucucccuuggau

SEQ ID NO: 1191788 - RNA, 24 nt, Human
ccuugucucaaaaaaaaaaaaaaa

SEQ ID NO: 1191789 - RNA, 19 nt, Human
ccuuuugugggcacugccu

SEQ ID NO: 1191790 - RNA, 24 nt, Human
cgagacuagccuggccaacacggu

SEQ ID NO: 1191791 - RNA, 20 nt, Human
cgauagggcuacaugcagug

SEQ ID NO: 1191792 - RNA, 20 nt, Human
cuagagucuccaaggcugac

SEQ ID NO: 1191793 - RNA, 22 nt, Human
cuauaggugccccucaccuccu

SEQ ID NO: 1191794 - RNA, 23 nt, Human
cuauaggugccccucaccuccuc

SEQ ID NO: 1191795 - RNA, 18 nt, Human
cucaaaaaaaaaaaaaaa

SEQ ID NO: 1191796 - RNA, 18 nt, Human
cucaagauggccacuccc

SEQ ID NO: 1191797 - RNA, 21 nt, Human
cucauaaauucugaauccugc

SEQ ID NO: 1191798 - RNA, 24 nt, Human
cucaugccaguaauuccagcacuu

SEQ ID NO: 1191799 - RNA, 20 nt, Human
cuccaaggcugacagccccc

SEQ ID NO: 1191800 - RNA, 22 nt, Human
cucccuaucucugcuucucaca

SEQ ID NO: 1191801 - RNA, 18 nt, Human
cucuaacagguaagaaaa

SEQ ID NO: 1191802 - RNA, 21 nt, Human
cucugcaucuagcuccacccc

SEQ ID NO: 1191803 - RNA, 23 nt, Human
cucugcaucuagcuccaccccca

SEQ ID NO: 1191804 - RNA, 19 nt, Human
cucugcuucucacagcuac

SEQ ID NO: 1191805 - RNA, 25 nt, Human
cugagauagaggccaagaguucaga

SEQ ID NO: 1191806 - RNA, 20 nt, Human
cugcaucuagcuccaccccc

SEQ ID NO: 1191807 - RNA, 21 nt, Human
cugcccagagcuguucaacaa

SEQ ID NO: 1191808 - RNA, 19 nt, Human
cuggagcucaucuguugcc

SEQ ID NO: 1191809 - RNA, 18 nt, Human
cuggccaacacggugaaa

SEQ ID NO: 1191810 - RNA, 21 nt, Human
cuguagucccaguuacucggg

SEQ ID NO: 1191811 - RNA, 23 nt, Human
gaaaacccucuguuuggcaugcc

SEQ ID NO: 1191812 - RNA, 20 nt, Human
gaaaaguguuuauuugaguu

SEQ ID NO: 1191813 - RNA, 19 nt, Human
gaagcagggaggcagaggu

SEQ ID NO: 1191814 - RNA, 23 nt, Human
gagaucaugccacugcacuccag

SEQ ID NO: 1191815 - RNA, 24 nt, Human
gaucacgugaggucacgagcucga

SEQ ID NO: 1191816 - RNA, 25 nt, Human
gcacaacaacauauacauaugaaug

SEQ ID NO: 1191817 - RNA, 24 nt, Human
gcacuccagccugggcaacagagu

SEQ ID NO: 1191818 - RNA, 21 nt, Human
gcaggcaaaacaaaaagaagc

SEQ ID NO: 1191819 - RNA, 23 nt, Human
gccaacacggugaaaccccccuc

SEQ ID NO: 1191820 - RNA, 22 nt, Human
gccacugcacuccagccugggc

SEQ ID NO: 1191821 - RNA, 24 nt, Human
gccacugcacuccagccugggcaa

SEQ ID NO: 1191822 - RNA, 20 nt, Human
gccccaggauugagggcaaa

SEQ ID NO: 1191823 - RNA, 21 nt, Human
gccucacugcugucccugacc

SEQ ID NO: 1191824 - RNA, 20 nt, Human
gccucauucccuccagaagu

SEQ ID NO: 1191825 - RNA, 23 nt, Human
gcugacagcccccuacaucaucu

SEQ ID NO: 1191826 - RNA, 20 nt, Human
gcugagaucaugccacugca

SEQ ID NO: 1191827 - RNA, 23 nt, Human
ggacacaagcccacggacccagc

SEQ ID NO: 1191828 - RNA, 18 nt, Human
ggacccaaagaaacagug

SEQ ID NO: 1191829 - RNA, 24 nt, Human
ggagccagcagugacggcaggaaa

SEQ ID NO: 1191830 - RNA, 21 nt, Human
ggaggcagagguuacagugag

SEQ ID NO: 1191831 - RNA, 22 nt, Human
ggugaaaccccccucucuacua

SEQ ID NO: 1191832 - RNA, 23 nt, Human
gguggcucaugccaguaauucca

SEQ ID NO: 1191833 - RNA, 24 nt, Human
gguggcucaugccaguaauuccag

SEQ ID NO: 1191834 - RNA, 18 nt, Human
uaaaauagcuagacaagc

SEQ ID NO: 1191835 - RNA, 22 nt, Human
uaacaaaauauaaaauagcuag

SEQ ID NO: 1191836 - RNA, 23 nt, Human
uaacaugcaacagcaaacuacag

SEQ ID NO: 1191837 - RNA, 18 nt, Human
uaaccccaaggcuagggg

SEQ ID NO: 1191838 - RNA, 20 nt, Human
uaagaaaacugaagucugug

SEQ ID NO: 1191839 - RNA, 21 nt, Human
uaagaaacccaagggucaaga

SEQ ID NO: 1191840 - RNA, 22 nt, Human
uacaaucaauacagaccaucac

SEQ ID NO: 1191841 - RNA, 21 nt, Human
uagaauacucaggccagccuc

SEQ ID NO: 1191842 - RNA, 24 nt, Human
uagacaagcacaacaacauauaca

SEQ ID NO: 1191843 - RNA, 24 nt, Human
uagccuggccaacacggugaaacc

SEQ ID NO: 1191844 - RNA, 22 nt, Human
uaggaaguaauugugcuggaaa

SEQ ID NO: 1191845 - RNA, 24 nt, Human
uaggcuagagucuccaaggcugac

SEQ ID NO: 1191846 - RNA, 20 nt, Human
uaggugccccucaccuccuc

SEQ ID NO: 1191847 - RNA, 21 nt, Human
uaggugguauuggcacagaaa

SEQ ID NO: 1191848 - RNA, 19 nt, Human
ucaaaaaaaaaaaaaaaaa

SEQ ID NO: 1191849 - RNA, 24 nt, Human
ucaggccagccucgguggcucaug

SEQ ID NO: 1191850 - RNA, 22 nt, Human
ucaguacaagccuggaaagagg

SEQ ID NO: 1191851 - RNA, 23 nt, Human
ucaugccacugcacuccagccug

SEQ ID NO: 1191852 - RNA, 22 nt, Human
ucaugccaguaauuccagcacu

SEQ ID NO: 1191853 - RNA, 23 nt, Human
ucauucuaugccuagcucuccua

SEQ ID NO: 1191854 - RNA, 24 nt, Human
ucccagggacuaaagcacagagcu

SEQ ID NO: 1191855 - RNA, 19 nt, Human
ucucaaaaaaaaaaaaaaa

SEQ ID NO: 1191856 - RNA, 24 nt, Human
ucuccgugacaucccaagccacag

SEQ ID NO: 1191857 - RNA, 22 nt, Human
ucuccuagguggguuucagcuc

SEQ ID NO: 1191858 - RNA, 19 nt, Human
ucucuacuaaaaauauaaa

SEQ ID NO: 1191859 - RNA, 21 nt, Human
ucuguagucccaguuacucgg

SEQ ID NO: 1191860 - RNA, 24 nt, Human
ucuguggcuggagccagcagugac

SEQ ID NO: 1191861 - RNA, 20 nt, Human
ugaaaaguguuuauuugagu

SEQ ID NO: 1191862 - RNA, 21 nt, Human
ugaaaccccccucucuacuaa

SEQ ID NO: 1191863 - RNA, 25 nt, Human
ugacagagugagaccuugucucaaa

SEQ ID NO: 1191864 - RNA, 21 nt, Human
ugacaucccaagccacaguca

SEQ ID NO: 1191865 - RNA, 20 nt, Human
ugagauagaggccaagaguu

SEQ ID NO: 1191866 - RNA, 22 nt, Human
ugagcugagaucaugccacugc

SEQ ID NO: 1191867 - RNA, 24 nt, Human
ugcaggaguugcacugcccagccg

SEQ ID NO: 1191868 - RNA, 21 nt, Human
ugccaaguucuuggcuuggaa

SEQ ID NO: 1191869 - RNA, 24 nt, Human
ugccacugcacuccagccugggca

SEQ ID NO: 1191870 - RNA, 24 nt, Human
ugccaguaauuccagcacuuuggg

SEQ ID NO: 1191871 - RNA, 21 nt, Human
uggaagggucaugggggccaa

SEQ ID NO: 1191872 - RNA, 23 nt, Human
uggagggagucauaacucauggc

SEQ ID NO: 1191873 - RNA, 19 nt, Human
uggcagagcaaaagcacuc

SEQ ID NO: 1191874 - RNA, 21 nt, Human
uggcaggcaaaacaaaaagaa

SEQ ID NO: 1191875 - RNA, 22 nt, Human
uggcaggcaaaacaaaaagaag

SEQ ID NO: 1191876 - RNA, 31 nt, Human
uggcaggcaaaacaaaaagaagcaagcuccc

SEQ ID NO: 1191877 - RNA, 19 nt, Human
uggcuaagagcuauaggug

SEQ ID NO: 1191878 - RNA, 22 nt, Human
ugggaaauuagugaggccccag

SEQ ID NO: 1191879 - RNA, 19 nt, Human
ugggaggcggagacgggag

SEQ ID NO: 1191880 - RNA, 24 nt, Human
ugggaggcggagacgggaggauca

SEQ ID NO: 1191881 - RNA, 21 nt, Human
ugguauaaacaaaaaccuauu

SEQ ID NO: 1191882 - RNA, 28 nt, Human
ugguauaaacaaaaaccuauuuuaaagu

SEQ ID NO: 1191883 - RNA, 20 nt, Human
uuacagugagcugagaucau

SEQ ID NO: 1191884 - RNA, 21 nt, Human
uuacagugagcugagaucaug

SEQ ID NO: 1191885 - RNA, 20 nt, Human
uucugaauccugcuaacccc

SEQ ID NO: 1191886 - RNA, 22 nt, Human
aaaaaccaaccuuucauuacca

SEQ ID NO: 1191887 - RNA, 19 nt, Human
aaaccaaaccaacagaaaa

SEQ ID NO: 1191888 - RNA, 23 nt, Human
aaaccaccccaagaugauuacac

SEQ ID NO: 1191889 - RNA, 21 nt, Human
aacgaaaccaaaccaacagaa

SEQ ID NO: 1191890 - RNA, 18 nt, Human
aagcaggagguaagccca

SEQ ID NO: 1191891 - RNA, 21 nt, Human
aagccacugaacucugccagg

SEQ ID NO: 1191892 - RNA, 20 nt, Human
aaguggcuuguuuuaggagg

SEQ ID NO: 1191893 - RNA, 19 nt, Human
aauacaguauuggcagggg

SEQ ID NO: 1191894 - RNA, 21 nt, Human
acagaaagggcauaugcugug

SEQ ID NO: 1191895 - RNA, 18 nt, Human
acuugaguaugcauuggg

SEQ ID NO: 1191896 - RNA, 21 nt, Human
agaacuccagagcacugagca

SEQ ID NO: 1191897 - RNA, 24 nt, Human
agagagaacauuuaaaagcucaga

SEQ ID NO: 1191898 - RNA, 20 nt, Human
agaggcuggugaugaaaagg

SEQ ID NO: 1191899 - RNA, 20 nt, Human
agauagacagacugaagcca

SEQ ID NO: 1191900 - RNA, 19 nt, Human
agcuugcagauuccccucg

SEQ ID NO: 1191901 - RNA, 21 nt, Human
aggaaaaaaaccaauggugaa

SEQ ID NO: 1191902 - RNA, 21 nt, Human
aggcggggccagggccucagc

SEQ ID NO: 1191903 - RNA, 24 nt, Human
aggcugcacauggcccaggagugg

SEQ ID NO: 1191904 - RNA, 22 nt, Human
aggcuggugaugaaaaggugaa

SEQ ID NO: 1191905 - RNA, 21 nt, Human
aucauucuuuauuaacccucc

SEQ ID NO: 1191906 - RNA, 18 nt, Human
auguguuucuuggaaccu

SEQ ID NO: 1191907 - RNA, 24 nt, Human
caaaagcaggagguaagcccaaug

SEQ ID NO: 1191908 - RNA, 26 nt, Human
caacagaaaaugaagaagggggaccc

SEQ ID NO: 1191909 - RNA, 22 nt, Human
caacgugacuccuccccucccg

SEQ ID NO: 1191910 - RNA, 21 nt, Human
caagaugauuacacugaaaug

SEQ ID NO: 1191911 - RNA, 27 nt, Human
caagcagacacgucauggcuaugugga

SEQ ID NO: 1191912 - RNA, 20 nt, Human
cacagcuugcagauuccccu

SEQ ID NO: 1191913 - RNA, 18 nt, Human
cacagugggcaaauggcu

SEQ ID NO: 1191914 - RNA, 22 nt, Human
cacauggcccaggaguggcacc

SEQ ID NO: 1191915 - RNA, 23 nt, Human
caccauggcagugcuggaugacc

SEQ ID NO: 1191916 - RNA, 23 nt, Human
cacuggccagaagacugggcagc

SEQ ID NO: 1191917 - RNA, 20 nt, Human
cagaacagauagacagacug

SEQ ID NO: 1191918 - RNA, 21 nt, Human
cagaagacugggcagccacca

SEQ ID NO: 1191919 - RNA, 21 nt, Human
cagaccacauagugucuguug

SEQ ID NO: 1191920 - RNA, 21 nt, Human
cagauagacagacugaagcca

SEQ ID NO: 1191921 - RNA, 18 nt, Human
cagcgcuauggaagagug

SEQ ID NO: 1191922 - RNA, 18 nt, Human
cagcuugcagauuccccu

SEQ ID NO: 1191923 - RNA, 23 nt, Human
caggcucaggcucuaucccucag

SEQ ID NO: 1191924 - RNA, 21 nt, Human
cagguaagugguagacaacgu

SEQ ID NO: 1191925 - RNA, 18 nt, Human
cagugccaguuaaacuaa

SEQ ID NO: 1191926 - RNA, 23 nt, Human
cauagaaacgaaaccaaaccaac

SEQ ID NO: 1191927 - RNA, 21 nt, Human
cauuaccaaucccaggcaaca

SEQ ID NO: 1191928 - RNA, 22 nt, Human
cauuaccaaucccaggcaacaa

SEQ ID NO: 1191929 - RNA, 21 nt, Human
ccaaauacuuuugaaaacacc

SEQ ID NO: 1191930 - RNA, 25 nt, Human
ccaccauggcagugcuggaugaccu

SEQ ID NO: 1191931 - RNA, 19 nt, Human
ccacugugggacuugagua

SEQ ID NO: 1191932 - RNA, 26 nt, Human
ccagagagaacauuuaaaagcucaga

SEQ ID NO: 1191933 - RNA, 24 nt, Human
ccagagcacugagcagagaggcug

SEQ ID NO: 1191934 - RNA, 23 nt, Human
cccuccuuggaauuuugaaaacc

SEQ ID NO: 1191935 - RNA, 24 nt, Human
ccuacuuuuaccgagggccuggga

SEQ ID NO: 1191936 - RNA, 22 nt, Human
cuaacagccccagcugcaugga

SEQ ID NO: 1191937 - RNA, 22 nt, Human
cuacuaacagccccagcugcau

SEQ ID NO: 1191938 - RNA, 23 nt, Human
cucucauagaaacgaaaccaaac

SEQ ID NO: 1191939 - RNA, 20 nt, Human
cugaggcugcacauggcccc

SEQ ID NO: 1191940 - RNA, 28 nt, Human
cugcguacauggagggcuggucagagga

SEQ ID NO: 1191941 - RNA, 24 nt, Human
cugcguauguguuucuuggaaccu

SEQ ID NO: 1191942 - RNA, 20 nt, Human
cuggcaaacuuuucuguaaa

SEQ ID NO: 1191943 - RNA, 19 nt, Human
cugggaaaaugccaaaggu

SEQ ID NO: 1191944 - RNA, 20 nt, Human
cuuccacauaaagucuggua

SEQ ID NO: 1191945 - RNA, 21 nt, Human
cuuuugcuggauaugcagaaa

SEQ ID NO: 1191946 - RNA, 22 nt, Human
cuuuugggaguuauuuucauua

SEQ ID NO: 1191947 - RNA, 25 nt, Human
gaaacgaaaccaaaccaacagaaaa

SEQ ID NO: 1191948 - RNA, 19 nt, Human
gaacagauagacagacuga

SEQ ID NO: 1191949 - RNA, 23 nt, Human
gaacagauagacagacugaagcc

SEQ ID NO: 1191950 - RNA, 19 nt, Human
gacccuugaacaauauggg

SEQ ID NO: 1191951 - RNA, 20 nt, Human
gauuccuucugcagcaauuc

SEQ ID NO: 1191952 - RNA, 21 nt, Human
gcacucuuuuaaaggguucuu

SEQ ID NO: 1191953 - RNA, 20 nt, Human
gcagauuccccucaggcgag

SEQ ID NO: 1191954 - RNA, 20 nt, Human
gcagccaccauggcagugcu

SEQ ID NO: 1191955 - RNA, 23 nt, Human
gccaauuugcuuccaccaacugu

SEQ ID NO: 1191956 - RNA, 19 nt, Human
gccacuuaucagcucauca

SEQ ID NO: 1191957 - RNA, 18 nt, Human
gcuggggaaagcagagcu

SEQ ID NO: 1191958 - RNA, 19 nt, Human
ggauccagcaaaaguguua

SEQ ID NO: 1191959 - RNA, 18 nt, Human
ggaucccaugcagcucac

SEQ ID NO: 1191960 - RNA, 24 nt, Human
ggcacucuuuuaaaggguucuuuu

SEQ ID NO: 1191961 - RNA, 18 nt, Human
ggcagccaccauggcagu

SEQ ID NO: 1191962 - RNA, 23 nt, Human
gggaaauccuggccaaaccaccc

SEQ ID NO: 1191963 - RNA, 23 nt, Human
guggguucuguagggcccacugu

SEQ ID NO: 1191964 - RNA, 18 nt, Human
uaaaaacuguggcucaaa

SEQ ID NO: 1191965 - RNA, 18 nt, Human
uaaaacacuuuguuacaa

SEQ ID NO: 1191966 - RNA, 23 nt, Human
uaaagcagcuuauaucagggagc

SEQ ID NO: 1191967 - RNA, 19 nt, Human
uaaggccaccucugccucu

SEQ ID NO: 1191968 - RNA, 25 nt, Human
uaaguggcuuguuuuaggaggccac

SEQ ID NO: 1191969 - RNA, 23 nt, Human
uaccacagugccaguuaaacuaa

SEQ ID NO: 1191970 - RNA, 22 nt, Human
uaccgagggccugggaaaaugc

SEQ ID NO: 1191971 - RNA, 26 nt, Human
uacggccaaauacuuuugaaaacacc

SEQ ID NO: 1191972 - RNA, 23 nt, Human
uaggaaaaaaaccaauggugaaa

SEQ ID NO: 1191973 - RNA, 22 nt, Human
uauaaaacacuuuguuacaaau

SEQ ID NO: 1191974 - RNA, 20 nt, Human
uauagucaccccaaaccuac

SEQ ID NO: 1191975 - RNA, 20 nt, Human
uauauggauuuuuuucaacc

SEQ ID NO: 1191976 - RNA, 18 nt, Human
uauguguuucuuggaacc

SEQ ID NO: 1191977 - RNA, 24 nt, Human
ucagaacagauagacagacugaag

SEQ ID NO: 1191978 - RNA, 24 nt, Human
ucagcagcuuugggaucccaugca

SEQ ID NO: 1191979 - RNA, 22 nt, Human
ucauagaaacgaaaccaaacca

SEQ ID NO: 1191980 - RNA, 22 nt, Human
ucauccaaaucagaaugucuca

SEQ ID NO: 1191981 - RNA, 22 nt, Human
uccaaaucagaaugucucaggu

SEQ ID NO: 1191982 - RNA, 22 nt, Human
ucuaugcauggcugcguaugug

SEQ ID NO: 1191983 - RNA, 23 nt, Human
ucucauagaaacgaaaccaaacc

SEQ ID NO: 1191984 - RNA, 22 nt, Human
ucugcagucuugccaugcuuuc

SEQ ID NO: 1191985 - RNA, 23 nt, Human
ucugcagucuugccaugcuuucu

SEQ ID NO: 1191986 - RNA, 22 nt, Human
ugaaaacaccuuucuauauugc

SEQ ID NO: 1191987 - RNA, 21 nt, Human
ugaacugcauggcugcacuua

SEQ ID NO: 1191988 - RNA, 21 nt, Human
ugaagcucccagagagaacau

SEQ ID NO: 1191989 - RNA, 21 nt, Human
ugacacagagcugucugccag

SEQ ID NO: 1191990 - RNA, 23 nt, Human
ugcagaaaugauaggaaaaaaac

SEQ ID NO: 1191991 - RNA, 19 nt, Human
ugccaggagucaacaugag

SEQ ID NO: 1191992 - RNA, 21 nt, Human
uggaugugaaaaucuacggcc

SEQ ID NO: 1191993 - RNA, 20 nt, Human
uggcagggggcgaaaccugc

SEQ ID NO: 1191994 - RNA, 23 nt, Human
uggcagugcuggaugaccucagu

SEQ ID NO: 1191995 - RNA, 22 nt, Human
ugggacuugaguaugcauuggg

SEQ ID NO: 1191996 - RNA, 24 nt, Human
ugugagguaagacacuagagggau

SEQ ID NO: 1191997 - RNA, 18 nt, Human
ugugaggugcaggugcug

SEQ ID NO: 1191998 - RNA, 19 nt, Human
uguugcagggacaaccauc

SEQ ID NO: 1191999 - RNA, 22 nt, Human
uuagcuauuagcaaauaaaacu

SEQ ID NO: 1192000 - RNA, 18 nt, Human
uucauuaccaaucccagg

SEQ ID NO: 1192001 - RNA, 19 nt, Human
uuccagaucaacauggcua

SEQ ID NO: 1192002 - RNA, 22 nt, Human
uuuaucacauacguggguucug

SEQ ID NO: 1192003 - RNA, 20 nt, Human
uuugggaucccaugcagcuc

SEQ ID NO: 1192004 - RNA, 21 nt, Human
aaagaauuucucauauuucca

SEQ ID NO: 1192005 - RNA, 25 nt, Human
aaagcucucucacacucagugcauu

SEQ ID NO: 1192006 - RNA, 22 nt, Human
aacaagaaagacucaagaccau

SEQ ID NO: 1192007 - RNA, 23 nt, Human
aagaguugaucauugacaagcac

SEQ ID NO: 1192008 - RNA, 19 nt, Human
aagcacucuucauucagac

SEQ ID NO: 1192009 - RNA, 21 nt, Human
aagcucucucacacucagugc

SEQ ID NO: 1192010 - RNA, 18 nt, Human
aaggcauuuaaaaaguug

SEQ ID NO: 1192011 - RNA, 26 nt, Human
aaguuuccagcaucauauauguuaau

SEQ ID NO: 1192012 - RNA, 24 nt, Human
acccacccuagcuucucccagaac

SEQ ID NO: 1192013 - RNA, 21 nt, Human
acuugcuggggcuucucccca

SEQ ID NO: 1192014 - RNA, 19 nt, Human
agaauccagauggaagaaa

SEQ ID NO: 1192015 - RNA, 24 nt, Human
agauuucucguuggagugaggaug

SEQ ID NO: 1192016 - RNA, 22 nt, Human
agugaucaaauuugagcucaga

SEQ ID NO: 1192017 - RNA, 23 nt, Human
caaaaccucugggcaucuguaga

SEQ ID NO: 1192018 - RNA, 18 nt, Human
caagaaagacucaagacc

SEQ ID NO: 1192019 - RNA, 20 nt, Human
caagaaagacucaagaccau

SEQ ID NO: 1192020 - RNA, 21 nt, Human
caauuuuucaccaguauggcu

SEQ ID NO: 1192021 - RNA, 18 nt, Human
cacccuagcuucucccag

SEQ ID NO: 1192022 - RNA, 20 nt, Human
cacucuucauucagacacuu

SEQ ID NO: 1192023 - RNA, 18 nt, Human
cagugcauuucuaagguu

SEQ ID NO: 1192024 - RNA, 23 nt, Human
cauuucuaagguuucccacuugu

SEQ ID NO: 1192025 - RNA, 22 nt, Human
ccaaagguuuucucagacucaa

SEQ ID NO: 1192026 - RNA, 19 nt, Human
cccacccuagcuucuccca

SEQ ID NO: 1192027 - RNA, 22 nt, Human
cccacccuagcuucucccagaa

SEQ ID NO: 1192028 - RNA, 23 nt, Human
ccggcgccgccccuaggccuggg

SEQ ID NO: 1192029 - RNA, 20 nt, Human
cggugugaauucucuuacaa

SEQ ID NO: 1192030 - RNA, 19 nt, Human
cucauacauauuauaugua

SEQ ID NO: 1192031 - RNA, 21 nt, Human
cuccggugugaauucucuuac

SEQ ID NO: 1192032 - RNA, 25 nt, Human
cucucugguccccacugaauucuga

SEQ ID NO: 1192033 - RNA, 18 nt, Human
cugucugcagcacaacug

SEQ ID NO: 1192034 - RNA, 21 nt, Human
gaaaacauacauuccugaucc

SEQ ID NO: 1192035 - RNA, 20 nt, Human
gaaggcauuuaaaaaguugu

SEQ ID NO: 1192036 - RNA, 27 nt, Human
gacccaucguugcccucacagucauuu

SEQ ID NO: 1192037 - RNA, 20 nt, Human
gacucaagaccaucuuccuu

SEQ ID NO: 1192038 - RNA, 21 nt, Human
gagaagggcugagcauuagua

SEQ ID NO: 1192039 - RNA, 23 nt, Human
gcacaacugacacugaaggcauu

SEQ ID NO: 1192040 - RNA, 22 nt, Human
gccccuaggccuggggacagca

SEQ ID NO: 1192041 - RNA, 21 nt, Human
ggagcuucuaccaaagguuuu

SEQ ID NO: 1192042 - RNA, 19 nt, Human
ggagugaggaugaaguguu

SEQ ID NO: 1192043 - RNA, 20 nt, Human
ggcuucuccccagggugggu

SEQ ID NO: 1192044 - RNA, 22 nt, Human
gggcaaagaauuucucauauuu

SEQ ID NO: 1192045 - RNA, 19 nt, Human
ggggccugauaagacagga

SEQ ID NO: 1192046 - RNA, 19 nt, Human
uaaaagaaaagcaucuuua

SEQ ID NO: 1192047 - RNA, 21 nt, Human
uacucugacccacccuagcuu

SEQ ID NO: 1192048 - RNA, 25 nt, Human
uagaaagcucucucacacucagugc

SEQ ID NO: 1192049 - RNA, 21 nt, Human
uagggaguuuuccgcuggucu

SEQ ID NO: 1192050 - RNA, 26 nt, Human
uagggaguuuuccgcuggucuucuug

SEQ ID NO: 1192051 - RNA, 18 nt, Human
uauuauauguacauagau

SEQ ID NO: 1192052 - RNA, 19 nt, Human
ucaaaaccucugggcaucu

SEQ ID NO: 1192053 - RNA, 25 nt, Human
ucaagguaaguauggguuuuuucac

SEQ ID NO: 1192054 - RNA, 24 nt, Human
ucacugcagaacagguuuuuuggg

SEQ ID NO: 1192055 - RNA, 24 nt, Human
ucagacacuugcagucuuuccuca

SEQ ID NO: 1192056 - RNA, 21 nt, Human
ucucacacucagugcauuucu

SEQ ID NO: 1192057 - RNA, 21 nt, Human
ucucccagaacaagcuucugg

SEQ ID NO: 1192058 - RNA, 23 nt, Human
ucucccagaacaagcuucugggu

SEQ ID NO: 1192059 - RNA, 19 nt, Human
ucugagcucugagcaaagu

SEQ ID NO: 1192060 - RNA, 18 nt, Human
ugacccaucguugcccuc

SEQ ID NO: 1192061 - RNA, 18 nt, Human
ugagauguucauacuguc

SEQ ID NO: 1192062 - RNA, 24 nt, Human
ugcuggggcuucuccccagggugg

SEQ ID NO: 1192063 - RNA, 23 nt, Human
uggaagauacaucuguuucaggc

SEQ ID NO: 1192064 - RNA, 21 nt, Human
uucccugauguaccacaagag

SEQ ID NO: 1192065 - RNA, 18 nt, Human
uuccugauccugacaauu

SEQ ID NO: 1192066 - RNA, 23 nt, Human
uuccugauccugacaauuugacu

SEQ ID NO: 1192067 - RNA, 22 nt, Human
uucguaacaagaaagacucaag

SEQ ID NO: 1192068 - RNA, 26 nt, Human
uuucauguaaaguccucucuaccaua

SEQ ID NO: 1192069 - RNA, 19 nt, Human
uuucucguuggagugagga

SEQ ID NO: 1192070 - RNA, 21 nt, Human
uuugggugcaaacccaaguaa

SEQ ID NO: 1192071 - RNA, 26 nt, Human
aaacuugcaacaaauguuugccuuga

SEQ ID NO: 1192072 - RNA, 22 nt, Human
aaggcaucauucuugcacgaaa

SEQ ID NO: 1192073 - RNA, 20 nt, Human
aauacugaugagccauuugu

SEQ ID NO: 1192074 - RNA, 21 nt, Human
agccgacccccgagcuuccca

SEQ ID NO: 1192075 - RNA, 22 nt, Human
agccuuuucaagaaaagcuuuu

SEQ ID NO: 1192076 - RNA, 20 nt, Human
caagugugaauucauagagc

SEQ ID NO: 1192077 - RNA, 19 nt, Human
cagccuuuucaagaaaagc

SEQ ID NO: 1192078 - RNA, 25 nt, Human
cagcugcgcccccucuacuuuccga

SEQ ID NO: 1192079 - RNA, 23 nt, Human
cauuauauucaaaaucuugcccc

SEQ ID NO: 1192080 - RNA, 22 nt, Human
ccaaaucaagugugaauucaua

SEQ ID NO: 1192081 - RNA, 23 nt, Human
ccauuugucacaaacauuacgcu

SEQ ID NO: 1192082 - RNA, 25 nt, Human
cccacaaacuucccgcuuccucucc

SEQ ID NO: 1192083 - RNA, 18 nt, Human
ccccagcugcgcccccuc

SEQ ID NO: 1192084 - RNA, 19 nt, Human
ccgacccccgagcuucccu

SEQ ID NO: 1192085 - RNA, 19 nt, Human
ccuuuuggguggguacugu

SEQ ID NO: 1192086 - RNA, 21 nt, Human
cucccgcuuccgggcacaaac

SEQ ID NO: 1192087 - RNA, 21 nt, Human
cuccuuguuccaaugugaaga

SEQ ID NO: 1192088 - RNA, 20 nt, Human
gaaacuuuuuccauauucaa

SEQ ID NO: 1192089 - RNA, 18 nt, Human
gacccccgagcuucccaa

SEQ ID NO: 1192090 - RNA, 21 nt, Human
gagccgacccccgagcuuccc

SEQ ID NO: 1192091 - RNA, 18 nt, Human
gagcuucccaaaccgcuu

SEQ ID NO: 1192092 - RNA, 19 nt, Human
guaaagcaguagccugaaa

SEQ ID NO: 1192093 - RNA, 21 nt, Human
gugugacuuuuggcugaagga

SEQ ID NO: 1192094 - RNA, 23 nt, Human
uaaagcuuucaaaagaaucagaa

SEQ ID NO: 1192095 - RNA, 26 nt, Human
uaacaagggcagccuuuucaagaaaa

SEQ ID NO: 1192096 - RNA, 21 nt, Human
uagaaauccuuucucuuucuc

SEQ ID NO: 1192097 - RNA, 22 nt, Human
uagccacggaaaacccuucaug

SEQ ID NO: 1192098 - RNA, 18 nt, Human
ucacugaaccuuucaugc

SEQ ID NO: 1192099 - RNA, 19 nt, Human
ucacugaaccuuucaugcc

SEQ ID NO: 1192100 - RNA, 19 nt, Human
ucagaaguagauagccacg

SEQ ID NO: 1192101 - RNA, 21 nt, Human
ucagguugggagucuucuggg

SEQ ID NO: 1192102 - RNA, 18 nt, Human
ucauuuucuguggcucuu

SEQ ID NO: 1192103 - RNA, 20 nt, Human
uccugaaauuucuugcucug

SEQ ID NO: 1192104 - RNA, 22 nt, Human
uccuuguuccaaugugaagauc

SEQ ID NO: 1192105 - RNA, 21 nt, Human
ucucccgcuuccgggcacaaa

SEQ ID NO: 1192106 - RNA, 21 nt, Human
ucucugagauuucaucagguu

SEQ ID NO: 1192107 - RNA, 18 nt, Human
ucuugggagaguauagag

SEQ ID NO: 1192108 - RNA, 19 nt, Human
ugagauuucaucagguugg

SEQ ID NO: 1192109 - RNA, 18 nt, Human
ugagccccuggcaagcag

SEQ ID NO: 1192110 - RNA, 19 nt, Human
ugauguacacugaaaguug

SEQ ID NO: 1192111 - RNA, 24 nt, Human
ugauuuaucauauuuguuuucccc

SEQ ID NO: 1192112 - RNA, 19 nt, Human
ugcccaaugucuuuaaagc

SEQ ID NO: 1192113 - RNA, 18 nt, Human
uggcaagcagaccccgca

SEQ ID NO: 1192114 - RNA, 25 nt, Human
uggcugaaggauuucccuccugugg

SEQ ID NO: 1192115 - RNA, 22 nt, Human
uguaaagccucagcugugaaag

SEQ ID NO: 1192116 - RNA, 27 nt, Human
uguaacaagggcagccuuuucaagaaa

SEQ ID NO: 1192117 - RNA, 22 nt, Human
uguccucccgccccagcugcgc

SEQ ID NO: 1192118 - RNA, 19 nt, Human
uguuuuccuccuggcucua

SEQ ID NO: 1192119 - RNA, 22 nt, Human
uuccauauucaaaggguuucac

SEQ ID NO: 1192120 - RNA, 21 nt, Human
uuccgagccgacccccgagcu

SEQ ID NO: 1192121 - RNA, 23 nt, Human
uucucuggauucauguucugagg

SEQ ID NO: 1192122 - RNA, 20 nt, Human
uucuugcucuguagucaaua

SEQ ID NO: 1192123 - RNA, 18 nt, Human
aaacagagucugcagaug

SEQ ID NO: 1192124 - RNA, 25 nt, Human
aaacuagccucucccaauugcccuu

SEQ ID NO: 1192125 - RNA, 21 nt, Human
aaacugaucuuauucugagua

SEQ ID NO: 1192126 - RNA, 19 nt, Human
aaagugcugagauuacagg

SEQ ID NO: 1192127 - RNA, 23 nt, Human
aaagugcugagauuacaggcaca

SEQ ID NO: 1192128 - RNA, 24 nt, Human
aaagugcugagauuacaggcacac

SEQ ID NO: 1192129 - RNA, 21 nt, Human
aagaaguggucuuguuucaaa

SEQ ID NO: 1192130 - RNA, 24 nt, Human
aagugcugagauuacaggcacacu

SEQ ID NO: 1192131 - RNA, 24 nt, Human
acagacagacacauagugaggagg

SEQ ID NO: 1192132 - RNA, 25 nt, Human
acagauucaccucuucuaccaaauu

SEQ ID NO: 1192133 - RNA, 23 nt, Human
acuucagagagaguauggcacug

SEQ ID NO: 1192134 - RNA, 25 nt, Human
acuuugucacccaggcuagagcaca

SEQ ID NO: 1192135 - RNA, 25 nt, Human
agaaaagagcauauuauuaagaaaa

SEQ ID NO: 1192136 - RNA, 22 nt, Human
agaaacuggacauuuuagauaa

SEQ ID NO: 1192137 - RNA, 19 nt, Human
agaaggagccucacugaua

SEQ ID NO: 1192138 - RNA, 24 nt, Human
agccacggauugcuggaaaccacc

SEQ ID NO: 1192139 - RNA, 18 nt, Human
agcuggagcaggaggccc

SEQ ID NO: 1192140 - RNA, 19 nt, Human
agcuggaggacaauucauc

SEQ ID NO: 1192141 - RNA, 21 nt, Human
aggaaaauguaaacacagaca

SEQ ID NO: 1192142 - RNA, 24 nt, Human
aggacacugccauccuacuccucc

SEQ ID NO: 1192143 - RNA, 21 nt, Human
aggaggcccucugugcuggga

SEQ ID NO: 1192144 - RNA, 21 nt, Human
aggcauugcaucuggucucca

SEQ ID NO: 1192145 - RNA, 18 nt, Human
agguguugaaguccuaac

SEQ ID NO: 1192146 - RNA, 21 nt, Human
aguuucuuucucugcuuuuuu

SEQ ID NO: 1192147 - RNA, 19 nt, Human
auaaagaucuuuauccaca

SEQ ID NO: 1192148 - RNA, 24 nt, Human
caaagugcagggaugacagaugug

SEQ ID NO: 1192149 - RNA, 23 nt, Human
caaagugcugagauuacaggcac

SEQ ID NO: 1192150 - RNA, 24 nt, Human
caaagugcugagauuacaggcaca

SEQ ID NO: 1192151 - RNA, 19 nt, Human
caacaagacgcucaguacc

SEQ ID NO: 1192152 - RNA, 23 nt, Human
caauugcccuucaccacaaccuc

SEQ ID NO: 1192153 - RNA, 26 nt, Human
caauugcccuucaccacaaccuccac

SEQ ID NO: 1192154 - RNA, 18 nt, Human
cacacucagccuaugucu

SEQ ID NO: 1192155 - RNA, 25 nt, Human
caccacaaccuccacuguguuuuca

SEQ ID NO: 1192156 - RNA, 24 nt, Human
caccucaaccccucaaagugcuga

SEQ ID NO: 1192157 - RNA, 23 nt, Human
cacgcaguucaaaccuguguugu

SEQ ID NO: 1192158 - RNA, 20 nt, Human
cacggauugcuggaaaccac

SEQ ID NO: 1192159 - RNA, 21 nt, Human
cacucugcuguccuguccuuc

SEQ ID NO: 1192160 - RNA, 19 nt, Human
cacugccauccuacuccuc

SEQ ID NO: 1192161 - RNA, 22 nt, Human
cacuuugucacccaggcuagag

SEQ ID NO: 1192162 - RNA, 19 nt, Human
cagaaggagccucacugau

SEQ ID NO: 1192163 - RNA, 23 nt, Human
cagcaacagggagcugggggcag

SEQ ID NO: 1192164 - RNA, 20 nt, Human
caggaugaaggacacugcca

SEQ ID NO: 1192165 - RNA, 21 nt, Human
caggcacacucagccuauguc

SEQ ID NO: 1192166 - RNA, 18 nt, Human
caggcauugcaucugguc

SEQ ID NO: 1192167 - RNA, 20 nt, Human
cagguguauggaucauauua

SEQ ID NO: 1192168 - RNA, 21 nt, Human
cagugguuuugcuagggcucu

SEQ ID NO: 1192169 - RNA, 21 nt, Human
caguucaaaccuguguugucc

SEQ ID NO: 1192170 - RNA, 18 nt, Human
cauccuacuccucccugg

SEQ ID NO: 1192171 - RNA, 20 nt, Human
ccacaaccuccacuguguuu

SEQ ID NO: 1192172 - RNA, 20 nt, Human
ccagaacucucaaagugcag

SEQ ID NO: 1192173 - RNA, 22 nt, Human
ccauccuacuccucccuggaag

SEQ ID NO: 1192174 - RNA, 18 nt, Human
cccaauugcccuucacca

SEQ ID NO: 1192175 - RNA, 21 nt, Human
cccaauugcccuucaccacaa

SEQ ID NO: 1192176 - RNA, 23 nt, Human
cccaccucaaccccucaaagugc

SEQ ID NO: 1192177 - RNA, 22 nt, Human
ccccauuaaacuguggcuccuu

SEQ ID NO: 1192178 - RNA, 20 nt, Human
cccuggaaggaggcccucug

SEQ ID NO: 1192179 - RNA, 22 nt, Human
ccuaaccccaguacccaugaac

SEQ ID NO: 1192180 - RNA, 24 nt, Human
ccucaaagugcugagauuacaggc

SEQ ID NO: 1192181 - RNA, 26 nt, Human
ccucccaccucaaccccucaaagugc

SEQ ID NO: 1192182 - RNA, 18 nt, Human
ccuccuucaggacuuguu

SEQ ID NO: 1192183 - RNA, 22 nt, Human
ccugcaggcuuugacccagggc

SEQ ID NO: 1192184 - RNA, 20 nt, Human
ccugggcucaagcaauccuc

SEQ ID NO: 1192185 - RNA, 23 nt, Human
ccuucaccacaaccuccacugug

SEQ ID NO: 1192186 - RNA, 21 nt, Human
cgaguccaacuuucagucucc

SEQ ID NO: 1192187 - RNA, 21 nt, Human
cucaaccccucaaagugcuga

SEQ ID NO: 1192188 - RNA, 21 nt, Human
cucaagcaauccucccaccuc

SEQ ID NO: 1192189 - RNA, 24 nt, Human
cucaagcaauccucccaccucaac

SEQ ID NO: 1192190 - RNA, 18 nt, Human
cucccaccucaaccccuc

SEQ ID NO: 1192191 - RNA, 19 nt, Human
cucucuggcacuucccuaa

SEQ ID NO: 1192192 - RNA, 21 nt, Human
cuggaaaccaccagaaacugg

SEQ ID NO: 1192193 - RNA, 21 nt, Human
cuguggcuccuuugaaagaau

SEQ ID NO: 1192194 - RNA, 19 nt, Human
cuucccuaaccacauccag

SEQ ID NO: 1192195 - RNA, 27 nt, Human
cuucccuaaccacauccagcuguuaag

SEQ ID NO: 1192196 - RNA, 24 nt, Human
cuucgccugcaggcuuugacccag

SEQ ID NO: 1192197 - RNA, 23 nt, Human
gaaguccuaaccccaguacccau

SEQ ID NO: 1192198 - RNA, 27 nt, Human
gagacagccucagcaacagggagcugg

SEQ ID NO: 1192199 - RNA, 21 nt, Human
gaggaaagaaguggucuuguu

SEQ ID NO: 1192200 - RNA, 21 nt, Human
gagggagaagaauagggguca

SEQ ID NO: 1192201 - RNA, 18 nt, Human
gaugacagaugugagcca

SEQ ID NO: 1192202 - RNA, 21 nt, Human
gaugccaucaagcgaagaaga

SEQ ID NO: 1192203 - RNA, 18 nt, Human
gcaugccuuguaauuuuu

SEQ ID NO: 1192204 - RNA, 21 nt, Human
ggaggagugggucaggcggcu

SEQ ID NO: 1192205 - RNA, 23 nt, Human
gggaugacagaugugagccauca

SEQ ID NO: 1192206 - RNA, 19 nt, Human
guuuucaacaauauccugg

SEQ ID NO: 1192207 - RNA, 21 nt, Human
uaaacacagacagacacauag

SEQ ID NO: 1192208 - RNA, 24 nt, Human
uaaaguguuccacaaacuaacccc

SEQ ID NO: 1192209 - RNA, 23 nt, Human
uaccuacgaguccaacuuucagu

SEQ ID NO: 1192210 - RNA, 22 nt, Human
uaccuggaggagugggucaggc

SEQ ID NO: 1192211 - RNA, 26 nt, Human
uaccuggaggagugggucaggcggcu

SEQ ID NO: 1192212 - RNA, 22 nt, Human
uagccucacucuccugggcuca

SEQ ID NO: 1192213 - RNA, 19 nt, Human
uagcuuucuagcauagcuu

SEQ ID NO: 1192214 - RNA, 26 nt, Human
uaguacauuuucuugaauacagguuc

SEQ ID NO: 1192215 - RNA, 21 nt, Human
uagugaggaggccgcaugaug

SEQ ID NO: 1192216 - RNA, 24 nt, Human
ucaaagugcagggaugacagaugu

SEQ ID NO: 1192217 - RNA, 23 nt, Human
ucaaagugcugagauuacaggca

SEQ ID NO: 1192218 - RNA, 23 nt, Human
ucaccacaaccuccacuggggcc

SEQ ID NO: 1192219 - RNA, 25 nt, Human
ucaguaaaauaaguuacagaaaaga

SEQ ID NO: 1192220 - RNA, 19 nt, Human
uccagaagccuuaaauggc

SEQ ID NO: 1192221 - RNA, 22 nt, Human
ucccuaaccacauccagcuguu

SEQ ID NO: 1192222 - RNA, 18 nt, Human
uccucccaccucaacccc

SEQ ID NO: 1192223 - RNA, 18 nt, Human
uccugggcucaagcaauc

SEQ ID NO: 1192224 - RNA, 24 nt, Human
uccugggcucaagcaauccuccca

SEQ ID NO: 1192225 - RNA, 22 nt, Human
uccuugggacuauuuccagaag

SEQ ID NO: 1192226 - RNA, 20 nt, Human
ucucaaagugcagggaugac

SEQ ID NO: 1192227 - RNA, 19 nt, Human
ucucacuuugucacccagg

SEQ ID NO: 1192228 - RNA, 22 nt, Human
ucucacuuugucacccaggcua

SEQ ID NO: 1192229 - RNA, 24 nt, Human
ucucacuuugucacccaggcuaga

SEQ ID NO: 1192230 - RNA, 19 nt, Human
ucuccacaacaagacgcuc

SEQ ID NO: 1192231 - RNA, 24 nt, Human
ucuccugggcucaagcaauccucc

SEQ ID NO: 1192232 - RNA, 23 nt, Human
ucugugcugggaggagaggagac

SEQ ID NO: 1192233 - RNA, 19 nt, Human
ugaacaaaguagggguuau

SEQ ID NO: 1192234 - RNA, 22 nt, Human
ugacagugguuuugcuagggcu

SEQ ID NO: 1192235 - RNA, 22 nt, Human
ugacccccagaaggguuccuuc

SEQ ID NO: 1192236 - RNA, 21 nt, Human
ugagaagaggaaaauguaaac

SEQ ID NO: 1192237 - RNA, 25 nt, Human
ugagauuacaggcacacucagccua

SEQ ID NO: 1192238 - RNA, 24 nt, Human
ugaguaaguagcuauuaucaauac

SEQ ID NO: 1192239 - RNA, 25 nt, Human
ugauagaugccuagccucacucucc

SEQ ID NO: 1192240 - RNA, 18 nt, Human
ugccaucaagcgaagaag

SEQ ID NO: 1192241 - RNA, 22 nt, Human
ugccuuguaauuuuuugugaga

SEQ ID NO: 1192242 - RNA, 23 nt, Human
ugcugagauuacaggcacacuca

SEQ ID NO: 1192243 - RNA, 23 nt, Human
ugcugggaggagaggagaccugu

SEQ ID NO: 1192244 - RNA, 21 nt, Human
uggaaacagagucugcagaug

SEQ ID NO: 1192245 - RNA, 19 nt, Human
uggagggaaauugccaccg

SEQ ID NO: 1192246 - RNA, 19 nt, Human
ugggaguggggaggaaaga

SEQ ID NO: 1192247 - RNA, 20 nt, Human
ugggaguggggaggaaagaa

SEQ ID NO: 1192248 - RNA, 23 nt, Human
ugggaguggggaggaaagaagug

SEQ ID NO: 1192249 - RNA, 24 nt, Human
ugguggccaauugcccuauuguuu

SEQ ID NO: 1192250 - RNA, 22 nt, Human
uguagaguaugcugcagaggag

SEQ ID NO: 1192251 - RNA, 22 nt, Human
ugucacccaggcuagagcacag

SEQ ID NO: 1192252 - RNA, 18 nt, Human
ugugauagaugccuagcc

SEQ ID NO: 1192253 - RNA, 21 nt, Human
ugugauagaugccuagccuca

SEQ ID NO: 1192254 - RNA, 21 nt, Human
uguuccacaaacuaaccccau

SEQ ID NO: 1192255 - RNA, 18 nt, Human
uguuugauauuuguucug

SEQ ID NO: 1192256 - RNA, 21 nt, Human
uucagcaguagcugucuggag

SEQ ID NO: 1192257 - RNA, 18 nt, Human
uugaaguccuaaccccag

SEQ ID NO: 1192258 - RNA, 21 nt, Human
uugcaugccuuguaauuuuuu

SEQ ID NO: 1192259 - RNA, 19 nt, Human
uugcuggaaaccaccagaa

SEQ ID NO: 1192260 - RNA, 23 nt, Human
uugcuguuuuuccuugggacuaa

SEQ ID NO: 1192261 - RNA, 20 nt, Human
uuucacacuuguggccucca

SEQ ID NO: 1192262 - RNA, 21 nt, Human
aaaaggcucagcuagaccuuu

SEQ ID NO: 1192263 - RNA, 19 nt, Human
aagggcuccugguugccca

SEQ ID NO: 1192264 - RNA, 24 nt, Human
aagugaaagcaaguuuauugagaa

SEQ ID NO: 1192265 - RNA, 19 nt, Human
accuaccuucuuccccuug

SEQ ID NO: 1192266 - RNA, 18 nt, Human
accucuauucucccaaca

SEQ ID NO: 1192267 - RNA, 25 nt, Human
accuucuuccccuuguuuuccuccu

SEQ ID NO: 1192268 - RNA, 21 nt, Human
acucccucuuccucuccacug

SEQ ID NO: 1192269 - RNA, 19 nt, Human
agauaggagagggggcugc

SEQ ID NO: 1192270 - RNA, 18 nt, Human
aggaauaaaagaauggcc

SEQ ID NO: 1192271 - RNA, 24 nt, Human
aggagcugguuguauugauggggg

SEQ ID NO: 1192272 - RNA, 20 nt, Human
agucauggugcugaggccug

SEQ ID NO: 1192273 - RNA, 19 nt, Human
auccacugggacuagaaua

SEQ ID NO: 1192274 - RNA, 24 nt, Human
caacuaugugcaaagucccuauaa

SEQ ID NO: 1192275 - RNA, 23 nt, Human
cacccucugccacagaaccugcc

SEQ ID NO: 1192276 - RNA, 18 nt, Human
cacucaagaugauuuggg

SEQ ID NO: 1192277 - RNA, 21 nt, Human
cacucccucuuccucuccacu

SEQ ID NO: 1192278 - RNA, 24 nt, Human
cacuguuccuuucugggcaccgcg

SEQ ID NO: 1192279 - RNA, 19 nt, Human
cagccccuauacaagagag

SEQ ID NO: 1192280 - RNA, 25 nt, Human
caggagcugguuguauugauggggg

SEQ ID NO: 1192281 - RNA, 19 nt, Human
cagugcagaggcuccugcc

SEQ ID NO: 1192282 - RNA, 18 nt, Human
cccaacauccucaugccc

SEQ ID NO: 1192283 - RNA, 22 nt, Human
ccccaagggcuccugguugccc

SEQ ID NO: 1192284 - RNA, 22 nt, Human
ccggcuucuuuacugcaaccug

SEQ ID NO: 1192285 - RNA, 22 nt, Human
ccuaccuucuuccccuuguuuu

SEQ ID NO: 1192286 - RNA, 21 nt, Human
ccuccuaucucauccugugac

SEQ ID NO: 1192287 - RNA, 21 nt, Human
ccucugcuguguccacagggc

SEQ ID NO: 1192288 - RNA, 21 nt, Human
cgggaugcucuuuuccaggcc

SEQ ID NO: 1192289 - RNA, 21 nt, Human
cucacucccucuuccucucca

SEQ ID NO: 1192290 - RNA, 18 nt, Human
cucauuuuacccagcccc

SEQ ID NO: 1192291 - RNA, 23 nt, Human
cuccuauucuguuauucuuuuuc

SEQ ID NO: 1192292 - RNA, 23 nt, Human
cuccugccggcuuccuugcuugg

SEQ ID NO: 1192293 - RNA, 19 nt, Human
cuucucagaggagccaccu

SEQ ID NO: 1192294 - RNA, 19 nt, Human
gaggagccaccucuauucu

SEQ ID NO: 1192295 - RNA, 22 nt, Human
gagucaaucugguuuaaacacc

SEQ ID NO: 1192296 - RNA, 21 nt, Human
gccauauuagaaauaaaagga

SEQ ID NO: 1192297 - RNA, 20 nt, Human
gccuuccuuucuuuccaaag

SEQ ID NO: 1192298 - RNA, 22 nt, Human
gcuggcaaaccagacccccgcg

SEQ ID NO: 1192299 - RNA, 19 nt, Human
ggagcugguuguauugaug

SEQ ID NO: 1192300 - RNA, 24 nt, Human
ggagcugguuguauugaugggggc

SEQ ID NO: 1192301 - RNA, 19 nt, Human
ggcaggccaaccugcagca

SEQ ID NO: 1192302 - RNA, 20 nt, Human
ggcuccugguugcccauuuu

SEQ ID NO: 1192303 - RNA, 19 nt, Human
gguggguuuuggccggcuu

SEQ ID NO: 1192304 - RNA, 22 nt, Human
gucccaccuaccuucuuccccu

SEQ ID NO: 1192305 - RNA, 21 nt, Human
guuagcuuggcugaaggagca

SEQ ID NO: 1192306 - RNA, 22 nt, Human
guuccuuucugggcaccgcggc

SEQ ID NO: 1192307 - RNA, 20 nt, Human
uaaagugaaagcaaguuuaa

SEQ ID NO: 1192308 - RNA, 19 nt, Human
uagcuuggcugaaggagca

SEQ ID NO: 1192309 - RNA, 21 nt, Human
uagucauggugcugaggccug

SEQ ID NO: 1192310 - RNA, 21 nt, Human
ucacccucugccacagaaccu

SEQ ID NO: 1192311 - RNA, 20 nt, Human
ucacucccucuuccucucca

SEQ ID NO: 1192312 - RNA, 22 nt, Human
ucagcuagaccuuuccaggguc

SEQ ID NO: 1192313 - RNA, 21 nt, Human
uccaccuuagccauauuagaa

SEQ ID NO: 1192314 - RNA, 21 nt, Human
uccagaugcucuagggcuucc

SEQ ID NO: 1192315 - RNA, 22 nt, Human
uccagggucccagugagcaccc

SEQ ID NO: 1192316 - RNA, 20 nt, Human
ucuuuacugcaaccuguuuu

SEQ ID NO: 1192317 - RNA, 24 nt, Human
ugaaggagcaggaacuaagcugca

SEQ ID NO: 1192318 - RNA, 20 nt, Human
ugagaaugcagcccaguagg

SEQ ID NO: 1192319 - RNA, 23 nt, Human
ugagauaggagagggggcugcuu

SEQ ID NO: 1192320 - RNA, 26 nt, Human
ugagauaggagagggggcugcuuuaa

SEQ ID NO: 1192321 - RNA, 20 nt, Human
ugccugaagagaguucugag

SEQ ID NO: 1192322 - RNA, 23 nt, Human
ugcucuagggcuuccgcguuagc

SEQ ID NO: 1192323 - RNA, 28 nt, Human
uggcaaaccagacccccgcgucguuucu

SEQ ID NO: 1192324 - RNA, 18 nt, Human
uguagcagugaggacgac

SEQ ID NO: 1192325 - RNA, 18 nt, Human
ugucauggcgcugauggg

SEQ ID NO: 1192326 - RNA, 18 nt, Human
uguggauuccucugcugu

SEQ ID NO: 1192327 - RNA, 21 nt, Human
uuaaagugaaagcaaguuuau

SEQ ID NO: 1192328 - RNA, 19 nt, Human
uuacccagccccuauacaa

SEQ ID NO: 1192329 - RNA, 18 nt, Human
uuccagggucccagugag

SEQ ID NO: 1192330 - RNA, 19 nt, Human
uuccagggucccagugagc

SEQ ID NO: 1192331 - RNA, 18 nt, Human
uugguggguuuuggccgg

SEQ ID NO: 1192332 - RNA, 21 nt, Human
uuuccaggcccaagucccguu

SEQ ID NO: 1192333 - RNA, 25 nt, Human
uuuuuuuuuuaaagugaaagcaagu

SEQ ID NO: 1192334 - RNA, 21 nt, Human
uuuuuuuuuuuuuuuuuaaag

SEQ ID NO: 1192335 - RNA, 19 nt, Human
aaaggccacuuccaaacug

SEQ ID NO: 1192336 - RNA, 24 nt, Human
aacccguuccuccgaaucaggcug

SEQ ID NO: 1192337 - RNA, 18 nt, Human
aggccgccgggggcccag

SEQ ID NO: 1192338 - RNA, 24 nt, Human
cacaacucgagcugggagccgccc

SEQ ID NO: 1192339 - RNA, 23 nt, Human
cacccgcggcggggcccacaacu

SEQ ID NO: 1192340 - RNA, 20 nt, Human
cagaugauggaaugcccucc

SEQ ID NO: 1192341 - RNA, 19 nt, Human
caggcaccuggagccggga

SEQ ID NO: 1192342 - RNA, 21 nt, Human
caggucucaagaagcuuagaa

SEQ ID NO: 1192343 - RNA, 19 nt, Human
cagugggcggguggcgugg

SEQ ID NO: 1192344 - RNA, 29 nt, Human
ccaauggcgggaacaagcaaggcuuccuu

SEQ ID NO: 1192345 - RNA, 21 nt, Human
cccacaacucgagcugggagc

SEQ ID NO: 1192346 - RNA, 22 nt, Human
ccgggaggguccgcucccuucc

SEQ ID NO: 1192347 - RNA, 21 nt, Human
ccucccaauggcgggaacaag

SEQ ID NO: 1192348 - RNA, 21 nt, Human
ccuccgcaggccgccgggggc

SEQ ID NO: 1192349 - RNA, 29 nt, Human
cgaggccagugggcggguggcguggggcg

SEQ ID NO: 1192350 - RNA, 22 nt, Human
gaagcuuagaauguccccuagg

SEQ ID NO: 1192351 - RNA, 22 nt, Human
gcaaggcuuccgcagcucaaaa

SEQ ID NO: 1192352 - RNA, 23 nt, Human
gccccaagcaacccguuccuccg

SEQ ID NO: 1192353 - RNA, 25 nt, Human
gcgcuggaguccucagaaaaggcca

SEQ ID NO: 1192354 - RNA, 18 nt, Human
ggaaccccgcgggccaag

SEQ ID NO: 1192355 - RNA, 24 nt, Human
ggggcccacaacucgagcugggag

SEQ ID NO: 1192356 - RNA, 24 nt, Human
uagaauguccccuagguggacgcu

SEQ ID NO: 1192357 - RNA, 21 nt, Human
ucaggcgucccggggaacccc

SEQ ID NO: 1192358 - RNA, 19 nt, Human
uccaaacuguggggauggg

SEQ ID NO: 1192359 - RNA, 20 nt, Human
ucccgcgcgcgucgcgccga

SEQ ID NO: 1192360 - RNA, 20 nt, Human
ucccgcgcgcgucgcgccgg

SEQ ID NO: 1192361 - RNA, 24 nt, Human
uccgaagggcacccgcggcggggc

SEQ ID NO: 1192362 - RNA, 22 nt, Human
uccgcagcucaaaaggagaaac

SEQ ID NO: 1192363 - RNA, 19 nt, Human
ugcagaugauggaaugccc

SEQ ID NO: 1192364 - RNA, 18 nt, Human
uggaaugcccucccaaug

SEQ ID NO: 1192365 - RNA, 22 nt, Human
uggcgggaacaagcaaggcuuc

SEQ ID NO: 1192366 - RNA, 19 nt, Human
aagaagaaaauaaguuaaa

SEQ ID NO: 1192367 - RNA, 23 nt, Human
acacuccugaaaaucuaaaguga

SEQ ID NO: 1192368 - RNA, 24 nt, Human
acucuauucuucuuggaucacaaa

SEQ ID NO: 1192369 - RNA, 18 nt, Human
agcagaauaacuuaauca

SEQ ID NO: 1192370 - RNA, 19 nt, Human
aggaggccuccagccaaca

SEQ ID NO: 1192371 - RNA, 20 nt, Human
aggccuccagccaacagcuc

SEQ ID NO: 1192372 - RNA, 24 nt, Human
cacaaacuaggcacacacuccuga

SEQ ID NO: 1192373 - RNA, 23 nt, Human
ugucaaggaagcaaaggaggccu

SEQ ID NO: 1192374 - RNA, 23 nt, Human
aaaaggaaaauguuauaaaagaa

SEQ ID NO: 1192375 - RNA, 18 nt, Human
aaacaaaacaaaacaaaa

SEQ ID NO: 1192376 - RNA, 19 nt, Human
aaacaaaacaaaacaggcc

SEQ ID NO: 1192377 - RNA, 22 nt, Human
aaacaaaacaaaacaggccaga

SEQ ID NO: 1192378 - RNA, 19 nt, Human
aaacaaaacaggccagagc

SEQ ID NO: 1192379 - RNA, 23 nt, Human
aaagaggauggacuauuuagcca

SEQ ID NO: 1192380 - RNA, 19 nt, Human
aacaaaacaaaacaaaaca

SEQ ID NO: 1192381 - RNA, 20 nt, Human
aagcaaaacaaaagaacaaa

SEQ ID NO: 1192382 - RNA, 21 nt, Human
aagcaaaacaaaagaacaaag

SEQ ID NO: 1192383 - RNA, 24 nt, Human
aauaaaaaauagaaaauauuugga

SEQ ID NO: 1192384 - RNA, 22 nt, Human
acaaaacaggccagagccucau

SEQ ID NO: 1192385 - RNA, 24 nt, Human
acaaagcugaacuaagaugacccu

SEQ ID NO: 1192386 - RNA, 18 nt, Human
acagcuucucacagaugu

SEQ ID NO: 1192387 - RNA, 19 nt, Human
acauggguugggccuuuca

SEQ ID NO: 1192388 - RNA, 23 nt, Human
accaaaagcaaaacaaaagaaca

SEQ ID NO: 1192389 - RNA, 21 nt, Human
agagcacauaccaaggggcua

SEQ ID NO: 1192390 - RNA, 21 nt, Human
agagcacuuggaaacaaaaca

SEQ ID NO: 1192391 - RNA, 24 nt, Human
agccagagcacauaccaaggggcu

SEQ ID NO: 1192392 - RNA, 20 nt, Human
agcccuggguccccagaagc

SEQ ID NO: 1192393 - RNA, 21 nt, Human
agccucaucaacuuugagcag

SEQ ID NO: 1192394 - RNA, 25 nt, Human
aggaaaaaaagaaaaaugaaaagga

SEQ ID NO: 1192395 - RNA, 26 nt, Human
aggaaaaaaagaaaaaugaaaaggag

SEQ ID NO: 1192396 - RNA, 24 nt, Human
aguagaaaaagcaguagaugcaug

SEQ ID NO: 1192397 - RNA, 19 nt, Human
auaccaaggggcuaggccc

SEQ ID NO: 1192398 - RNA, 21 nt, Human
auagcuuggguauggggaagc

SEQ ID NO: 1192399 - RNA, 21 nt, Human
caaaacaaaacaaaacaggcc

SEQ ID NO: 1192400 - RNA, 25 nt, Human
caaaacaaaacaaaacaggccagag

SEQ ID NO: 1192401 - RNA, 21 nt, Human
caaaacaaaacaggccagagc

SEQ ID NO: 1192402 - RNA, 21 nt, Human
caagacaauucuucuucuucc

SEQ ID NO: 1192403 - RNA, 24 nt, Human
cacaaugggcuugaagucuaccag

SEQ ID NO: 1192404 - RNA, 20 nt, Human
cagaagccauguccuuaaaa

SEQ ID NO: 1192405 - RNA, 30 nt, Human
cagagcacuuggaaacaaaacaaaacaaag

SEQ ID NO: 1192406 - RNA, 23 nt, Human
caggaaacgaggaaaaaaagaaa

SEQ ID NO: 1192407 - RNA, 25 nt, Human
caguaaagauguagccuagggcaau

SEQ ID NO: 1192408 - RNA, 21 nt, Human
ccaacacuuacuuuggguuua

SEQ ID NO: 1192409 - RNA, 20 nt, Human
ccagagcacauaccaagggg

SEQ ID NO: 1192410 - RNA, 22 nt, Human
ccagggaagccaaaagauugaa

SEQ ID NO: 1192411 - RNA, 19 nt, Human
ccaguguuaggaauaaaaa

SEQ ID NO: 1192412 - RNA, 21 nt, Human
ccauauccuugacacaugucc

SEQ ID NO: 1192413 - RNA, 24 nt, Human
cccaggauggcuuugaauguggcc

SEQ ID NO: 1192414 - RNA, 19 nt, Human
cccuggguccccagaagcc

SEQ ID NO: 1192415 - RNA, 22 nt, Human
cuaaaguucuacauuucaguag

SEQ ID NO: 1192416 - RNA, 21 nt, Human
cugcuuuugguuuuccaaaag

SEQ ID NO: 1192417 - RNA, 25 nt, Human
cuuuggguuuaucugcccaaauuuu

SEQ ID NO: 1192418 - RNA, 22 nt, Human
gaaaaaauaaauguaugcuacu

SEQ ID NO: 1192419 - RNA, 26 nt, Human
gaggaaaaaaagaaaaaugaaaagga

SEQ ID NO: 1192420 - RNA, 25 nt, Human
gauaaccaaaagcaaaacaaaagaa

SEQ ID NO: 1192421 - RNA, 22 nt, Human
gcagcccaggauggcuuugaau

SEQ ID NO: 1192422 - RNA, 22 nt, Human
gcccaacacaaauucauaaacc

SEQ ID NO: 1192423 - RNA, 21 nt, Human
ggaaaguacaacuuccacaaa

SEQ ID NO: 1192424 - RNA, 24 nt, Human
ggacauaguuuuuuguuaaaaaug

SEQ ID NO: 1192425 - RNA, 20 nt, Human
ggcccacaagccacaugcag

SEQ ID NO: 1192426 - RNA, 25 nt, Human
guaaagcaauauagagacuagccuc

SEQ ID NO: 1192427 - RNA, 23 nt, Human
guucauuaggacaugccaguaca

SEQ ID NO: 1192428 - RNA, 23 nt, Human
uaagcccuggguccccagaagcc

SEQ ID NO: 1192429 - RNA, 26 nt, Human
uagaaaaagcaguagaugcaugaaga

SEQ ID NO: 1192430 - RNA, 19 nt, Human
uagaaaauauuuggaaaaa

SEQ ID NO: 1192431 - RNA, 20 nt, Human
ucaaaagccuguucucaaaa

SEQ ID NO: 1192432 - RNA, 18 nt, Human
uccccagaagccaugucc

SEQ ID NO: 1192433 - RNA, 22 nt, Human
ucugcccaaauuuucccucuca

SEQ ID NO: 1192434 - RNA, 21 nt, Human
ugaaaaggaguagaaaaagca

SEQ ID NO: 1192435 - RNA, 22 nt, Human
ugaaaaucagaagccagaacag

SEQ ID NO: 1192436 - RNA, 19 nt, Human
ugaacaguaaagauguagc

SEQ ID NO: 1192437 - RNA, 19 nt, Human
ugagauaccacaucuaugu

SEQ ID NO: 1192438 - RNA, 21 nt, Human
ugaguuuaucaaaagccuguu

SEQ ID NO: 1192439 - RNA, 24 nt, Human
ugauaaaaggaaaauguuauaaaa

SEQ ID NO: 1192440 - RNA, 21 nt, Human
ugcccaaauuuucccucucaa

SEQ ID NO: 1192441 - RNA, 19 nt, Human
uggaaaaaauaaauguaug

SEQ ID NO: 1192442 - RNA, 23 nt, Human
uggaaacaaaacaaaacaaaaca

SEQ ID NO: 1192443 - RNA, 22 nt, Human
uggacaaagcugaacuaagaug

SEQ ID NO: 1192444 - RNA, 18 nt, Human
uggcaaaaucuauggcuc

SEQ ID NO: 1192445 - RNA, 26 nt, Human
uggcaaaaucuauggcucuguaaaga

SEQ ID NO: 1192446 - RNA, 23 nt, Human
uggcaagcuugucuagcucauca

SEQ ID NO: 1192447 - RNA, 20 nt, Human
ugggccaugugaacaugucu

SEQ ID NO: 1192448 - RNA, 21 nt, Human
uguaguagguuucuuugucag

SEQ ID NO: 1192449 - RNA, 18 nt, Human
uguuccugagaaccacau

SEQ ID NO: 1192450 - RNA, 23 nt, Human
uuaaaaauguugaacaguaaaga

SEQ ID NO: 1192451 - RNA, 21 nt, Human
uucauaaaccuucuuaaaaca

SEQ ID NO: 1192452 - RNA, 23 nt, Human
uuuccaggauacuggaauuaggc

SEQ ID NO: 1192453 - RNA, 18 nt, Human
uuucuugaagagaggaaa

SEQ ID NO: 1192454 - RNA, 22 nt, Human
uuugggugagcuuuuaauauuu

SEQ ID NO: 1192455 - RNA, 23 nt, Human
aaacagguuaaauauacacccac

SEQ ID NO: 1192456 - RNA, 23 nt, Human
aaauauacacccacaucugagug

SEQ ID NO: 1192457 - RNA, 22 nt, Human
acucggaggggcgcaguggaag

SEQ ID NO: 1192458 - RNA, 20 nt, Human
agggguuuggaacccgggua

SEQ ID NO: 1192459 - RNA, 21 nt, Human
auauuccaagucaaauguauc

SEQ ID NO: 1192460 - RNA, 23 nt, Human
caaauaauaaccugccacuauau

SEQ ID NO: 1192461 - RNA, 21 nt, Human
cacagaaaauauggaagugaa

SEQ ID NO: 1192462 - RNA, 19 nt, Human
cccgggaaaguggcccgcc

SEQ ID NO: 1192463 - RNA, 21 nt, Human
cgacugcucccuccccucgug

SEQ ID NO: 1192464 - RNA, 24 nt, Human
cgacugcucccuccccucgugccc

SEQ ID NO: 1192465 - RNA, 20 nt, Human
cguggcuagggguuuggaac

SEQ ID NO: 1192466 - RNA, 23 nt, Human
cucagacugcaauugugggaaau

SEQ ID NO: 1192467 - RNA, 24 nt, Human
cuuagcauaguguuuucacccaaa

SEQ ID NO: 1192468 - RNA, 22 nt, Human
gucaaauguaucacaaagaagc

SEQ ID NO: 1192469 - RNA, 25 nt, Human
uacacagaaaauauggaagugaacc

SEQ ID NO: 1192470 - RNA, 23 nt, Human
uaucauggacuuauccaauggag

SEQ ID NO: 1192471 - RNA, 24 nt, Human
ucguggcuagggguuuggaacccg

SEQ ID NO: 1192472 - RNA, 19 nt, Human
uuuuuuuuuuuuuuuuuaa

SEQ ID NO: 1192473 - RNA, 23 nt, Human
ucccuuuaaguuacgacgggaau

SEQ ID NO: 1192474 - RNA, 21 nt, Human
aaaaaaaccaaaaaccuucag

SEQ ID NO: 1192475 - RNA, 22 nt, Human
aaaaaggcacuuuaauucaacu

SEQ ID NO: 1192476 - RNA, 23 nt, Human
aaaaggaaacaacaacaaaaaaa

SEQ ID NO: 1192477 - RNA, 28 nt, Human
aaaaggaaacaacaacaaaaaaacaaaa

SEQ ID NO: 1192478 - RNA, 26 nt, Human
aaacaaaaaaaccaaaaaccuucagu

SEQ ID NO: 1192479 - RNA, 29 nt, Human
aaacaaacaaaaaaaccaaaaaccuucag

SEQ ID NO: 1192480 - RNA, 27 nt, Human
aaacaacaacaaaaaaacaaaaaacaa

SEQ ID NO: 1192481 - RNA, 21 nt, Human
aaacuucuuggucuguguucc

SEQ ID NO: 1192482 - RNA, 22 nt, Human
aaaggcacuuuaauucaacuga

SEQ ID NO: 1192483 - RNA, 22 nt, Human
aaaguaaggggucuuggaagcu

SEQ ID NO: 1192484 - RNA, 24 nt, Human
aacaaacaaaaaaaccaaaaaccu

SEQ ID NO: 1192485 - RNA, 20 nt, Human
aacagagcaagacuccaucu

SEQ ID NO: 1192486 - RNA, 23 nt, Human
aacaugggcggaucaccuggggu

SEQ ID NO: 1192487 - RNA, 25 nt, Human
aacaugggcggaucaccugggguca

SEQ ID NO: 1192488 - RNA, 20 nt, Human
aacauggugaaacccugucu

SEQ ID NO: 1192489 - RNA, 21 nt, Human
aacauggugaaacccugucuc

SEQ ID NO: 1192490 - RNA, 20 nt, Human
aacccugucucuaccaaaua

SEQ ID NO: 1192491 - RNA, 18 nt, Human
aagcagauguggcugcuc

SEQ ID NO: 1192492 - RNA, 22 nt, Human
aagcauacacccagcuuuauaa

SEQ ID NO: 1192493 - RNA, 21 nt, Human
aagcuuuuguugaaacuuaau

SEQ ID NO: 1192494 - RNA, 23 nt, Human
aaggaaacaacaacaaaaaaaca

SEQ ID NO: 1192495 - RNA, 27 nt, Human
aaguacacugcauacaacugaaaacac

SEQ ID NO: 1192496 - RNA, 20 nt, Human
aaguccacuucuugucaauu

SEQ ID NO: 1192497 - RNA, 21 nt, Human
aauauggugaaacccugucuc

SEQ ID NO: 1192498 - RNA, 24 nt, Human
aauauucaaauuagauaacacuuc

SEQ ID NO: 1192499 - RNA, 23 nt, Human
aaucacaacagcugccugaccca

SEQ ID NO: 1192500 - RNA, 20 nt, Human
aauugcuugaauccaguagg

SEQ ID NO: 1192501 - RNA, 23 nt, Human
acaacaaaaaaacaaaaaacaaa

SEQ ID NO: 1192502 - RNA, 28 nt, Human
acaacaacaaaaaaacaaaaaacaaaaa

SEQ ID NO: 1192503 - RNA, 24 nt, Human
acagagcaagacuccaucucaaaa

SEQ ID NO: 1192504 - RNA, 19 nt, Human
acagagcaagacucugucu

SEQ ID NO: 1192505 - RNA, 24 nt, Human
accaacauggugaaacccugucuc

SEQ ID NO: 1192506 - RNA, 19 nt, Human
acccagccaccacauacau

SEQ ID NO: 1192507 - RNA, 23 nt, Human
acccugucucuacaaaaauacaa

SEQ ID NO: 1192508 - RNA, 24 nt, Human
acccugucucuaccaaauauacaa

SEQ ID NO: 1192509 - RNA, 24 nt, Human
accuggggucaggaguucaagacc

SEQ ID NO: 1192510 - RNA, 24 nt, Human
acugcacucaagcuggggcaacag

SEQ ID NO: 1192511 - RNA, 24 nt, Human
acugcacuccagccugggcgacag

SEQ ID NO: 1192512 - RNA, 26 nt, Human
acugcacuccagccugggcgacagag

SEQ ID NO: 1192513 - RNA, 18 nt, Human
agacugaccucccucccc

SEQ ID NO: 1192514 - RNA, 18 nt, Human
agaucaggaguucgagac

SEQ ID NO: 1192515 - RNA, 26 nt, Human
agaucaggaguucgagaccagccuga

SEQ ID NO: 1192516 - RNA, 24 nt, Human
agcacuuugggaggccaacauggg

SEQ ID NO: 1192517 - RNA, 24 nt, Human
agcacuuugggaggccgaggcagg

SEQ ID NO: 1192518 - RNA, 20 nt, Human
agcagaaaauuugucccagc

SEQ ID NO: 1192519 - RNA, 23 nt, Human
agccaggcgcgguggugggcgcc

SEQ ID NO: 1192520 - RNA, 24 nt, Human
agccugaccaacauggugaaaccc

SEQ ID NO: 1192521 - RNA, 22 nt, Human
agccuggccaauauggugaaac

SEQ ID NO: 1192522 - RNA, 24 nt, Human
agccuggccaauauggugaaaccc

SEQ ID NO: 1192523 - RNA, 24 nt, Human
agccuggccaauauggugaaaccc

SEQ ID NO: 1192524 - RNA, 24 nt, Human
agccugggcgacagagcaagacuc

SEQ ID NO: 1192525 - RNA, 24 nt, Human
agcuggggcaacagagcaagacuc

SEQ ID NO: 1192526 - RNA, 18 nt, Human
agcuguugccaauggccu

SEQ ID NO: 1192527 - RNA, 20 nt, Human
aggaaaaaaggcacuuuaau

SEQ ID NO: 1192528 - RNA, 21 nt, Human
aggcaauaacauacuuuuugc

SEQ ID NO: 1192529 - RNA, 26 nt, Human
aggcagaucacuucagaucaggaguu

SEQ ID NO: 1192530 - RNA, 23 nt, Human
aggcaggagaauugcuugaaucc

SEQ ID NO: 1192531 - RNA, 24 nt, Human
aggcaggagaauugcuugaaucca

SEQ ID NO: 1192532 - RNA, 26 nt, Human
aggcaggcagaucacuucagaucagg

SEQ ID NO: 1192533 - RNA, 24 nt, Human
aggcgcgguggugggcgccuguag

SEQ ID NO: 1192534 - RNA, 21 nt, Human
aggcugaggcaggagaauugc

SEQ ID NO: 1192535 - RNA, 24 nt, Human
aggcugaggcaggagaauugcuug

SEQ ID NO: 1192536 - RNA, 24 nt, Human
aggcugaugcaggagaaucgcuug

SEQ ID NO: 1192537 - RNA, 23 nt, Human
agggggcggagguugcagugagc

SEQ ID NO: 1192538 - RNA, 23 nt, Human
agucgggugugguggcaggcauc

SEQ ID NO: 1192539 - RNA, 22 nt, Human
agugauagacaaccuaagucuc

SEQ ID NO: 1192540 - RNA, 18 nt, Human
auaauggaguccaaugag

SEQ ID NO: 1192541 - RNA, 24 nt, Human
aucaccuggggucaggaguucaag

SEQ ID NO: 1192542 - RNA, 23 nt, Human
aucacgccacugcacucaagcug

SEQ ID NO: 1192543 - RNA, 18 nt, Human
augcaggagaaucgcuug

SEQ ID NO: 1192544 - RNA, 19 nt, Human
augccuguaaucccagcac

SEQ ID NO: 1192545 - RNA, 27 nt, Human
auggcagcuauccuuuuggagguaaac

SEQ ID NO: 1192546 - RNA, 21 nt, Human
auggcucuggccaauacuccc

SEQ ID NO: 1192547 - RNA, 19 nt, Human
augggcggaucaccugggg

SEQ ID NO: 1192548 - RNA, 20 nt, Human
auggugaaacccugucucua

SEQ ID NO: 1192549 - RNA, 24 nt, Human
auggugccacugcacuccagccug

SEQ ID NO: 1192550 - RNA, 22 nt, Human
auuugccuucucuguucucuau

SEQ ID NO: 1192551 - RNA, 30 nt, Human
caaaaaaacaaaaaacaaaaaacaaaacuu

SEQ ID NO: 1192552 - RNA, 21 nt, Human
caaaaaaaccaaaaaccuuca

SEQ ID NO: 1192553 - RNA, 21 nt, Human
caaaaauacaaaaauuagcca

SEQ ID NO: 1192554 - RNA, 24 nt, Human
caaaaggaaacaacaacaaaaaaa

SEQ ID NO: 1192555 - RNA, 21 nt, Human
caaacaaaaaaaccaaaaacc

SEQ ID NO: 1192556 - RNA, 24 nt, Human
caacauggugaaacccugucucua

SEQ ID NO: 1192557 - RNA, 22 nt, Human
caacuccacugcauaaagcaau

SEQ ID NO: 1192558 - RNA, 24 nt, Human
caagaccagccuggccaauauggu

SEQ ID NO: 1192559 - RNA, 23 nt, Human
caagacuccaucucaaaaggaaa

SEQ ID NO: 1192560 - RNA, 22 nt, Human
caaguacacugcauacaacuga

SEQ ID NO: 1192561 - RNA, 24 nt, Human
caauauggugaaacccugucucua

SEQ ID NO: 1192562 - RNA, 19 nt, Human
caauuacuagaacucaagg

SEQ ID NO: 1192563 - RNA, 19 nt, Human
cacaacagcugccugaccc

SEQ ID NO: 1192564 - RNA, 25 nt, Human
caccaaaguaaggggucuuggaagc

SEQ ID NO: 1192565 - RNA, 24 nt, Human
cacccagcuuuauaacugcaguca

SEQ ID NO: 1192566 - RNA, 23 nt, Human
caccuggggucaggaguucaaga

SEQ ID NO: 1192567 - RNA, 24 nt, Human
cacgucugcaauuccagcacuuug

SEQ ID NO: 1192568 - RNA, 23 nt, Human
cacuccagccugggcgacagagc

SEQ ID NO: 1192569 - RNA, 30 nt, Human
cacugagacucacauacacgucuccccuag

SEQ ID NO: 1192570 - RNA, 24 nt, Human
cacugcacucaagcuggggcaaca

SEQ ID NO: 1192571 - RNA, 19 nt, Human
cacugcacuccagccuggg

SEQ ID NO: 1192572 - RNA, 21 nt, Human
cacugcacuccagccugggcg

SEQ ID NO: 1192573 - RNA, 22 nt, Human
cacugcacuccagccugggcga

SEQ ID NO: 1192574 - RNA, 23 nt, Human
cacugcacuccagccugggcgac

SEQ ID NO: 1192575 - RNA, 24 nt, Human
cacugcacuccagccugggcgaca

SEQ ID NO: 1192576 - RNA, 27 nt, Human
cacugcacuccagccugggcgacagag

SEQ ID NO: 1192577 - RNA, 20 nt, Human
cacugcauacaacugaaaac

SEQ ID NO: 1192578 - RNA, 19 nt, Human
cacuucacacaaugaaaua

SEQ ID NO: 1192579 - RNA, 24 nt, Human
cagaucacuucagaucaggaguuc

SEQ ID NO: 1192580 - RNA, 28 nt, Human
cagcacuuugggaggccaacaugggcgg

SEQ ID NO: 1192581 - RNA, 24 nt, Human
cagcacuuugggaggccgaggcag

SEQ ID NO: 1192582 - RNA, 25 nt, Human
cagcacuuugggaggccgaggcagg

SEQ ID NO: 1192583 - RNA, 23 nt, Human
cagcagcagaaaauuugucccag

SEQ ID NO: 1192584 - RNA, 19 nt, Human
cagcagugcucagguacug

SEQ ID NO: 1192585 - RNA, 24 nt, Human
cagcuacucaggaggcugaggcag

SEQ ID NO: 1192586 - RNA, 24 nt, Human
caggcagaucacuucagaucagga

SEQ ID NO: 1192587 - RNA, 20 nt, Human
cagggagagcugagcaggca

SEQ ID NO: 1192588 - RNA, 19 nt, Human
cagugggucaccaccacau

SEQ ID NO: 1192589 - RNA, 24 nt, Human
caucuaugaucccagcuacucagg

SEQ ID NO: 1192590 - RNA, 24 nt, Human
caugaaaucauauagacugucaga

SEQ ID NO: 1192591 - RNA, 24 nt, Human
caugccuguaaucccagcacuuug

SEQ ID NO: 1192592 - RNA, 19 nt, Human
ccacugcacucaagcuggg

SEQ ID NO: 1192593 - RNA, 20 nt, Human
ccacugcacucaagcugggg

SEQ ID NO: 1192594 - RNA, 21 nt, Human
ccacugcacucaagcuggggc

SEQ ID NO: 1192595 - RNA, 24 nt, Human
ccacugcacucaagcuggggcaac

SEQ ID NO: 1192596 - RNA, 20 nt, Human
ccacugcacuccagccuggg

SEQ ID NO: 1192597 - RNA, 20 nt, Human
ccacugcacuccagccuggg

SEQ ID NO: 1192598 - RNA, 21 nt, Human
ccacugcacuccagccugggc

SEQ ID NO: 1192599 - RNA, 21 nt, Human
ccacugcacuccagccugggc

SEQ ID NO: 1192600 - RNA, 23 nt, Human
ccacugcacuccagccugggcga

SEQ ID NO: 1192601 - RNA, 24 nt, Human
ccacugcacuccagccugggcgac

SEQ ID NO: 1192602 - RNA, 20 nt, Human
ccaguauaaguaauauaggc

SEQ ID NO: 1192603 - RNA, 21 nt, Human
ccuaagucuccugacgagauc

SEQ ID NO: 1192604 - RNA, 18 nt, Human
ccuaucccagcccccaag

SEQ ID NO: 1192605 - RNA, 22 nt, Human
ccugaccaacauggugaaaccc

SEQ ID NO: 1192606 - RNA, 24 nt, Human
ccugaccaacauggugaaacccug

SEQ ID NO: 1192607 - RNA, 23 nt, Human
ccugacccagccaccacauacau

SEQ ID NO: 1192608 - RNA, 22 nt, Human
ccuggccaauauggugaaaccc

SEQ ID NO: 1192609 - RNA, 24 nt, Human
ccuggccaauauggugaaacccug

SEQ ID NO: 1192610 - RNA, 22 nt, Human
ccugggcgacagagcaagacuc

SEQ ID NO: 1192611 - RNA, 22 nt, Human
ccuguaaucccagcacuuuggg

SEQ ID NO: 1192612 - RNA, 20 nt, Human
ccuguagucccagcuacuug

SEQ ID NO: 1192613 - RNA, 22 nt, Human
ccuguagucccagcuacuugag

SEQ ID NO: 1192614 - RNA, 21 nt, Human
ccuucagugggucaccaccac

SEQ ID NO: 1192615 - RNA, 24 nt, Human
cgagaccagccugaccaacauggu

SEQ ID NO: 1192616 - RNA, 19 nt, Human
cgagaucaaucaaaaacuu

SEQ ID NO: 1192617 - RNA, 21 nt, Human
cgagaucaaucaaaaacuuca

SEQ ID NO: 1192618 - RNA, 26 nt, Human
cgaggcaggcagaucacuucagauca

SEQ ID NO: 1192619 - RNA, 22 nt, Human
cgccuguagucccagcuacuug

SEQ ID NO: 1192620 - RNA, 23 nt, Human
cgccuguagucccagcuacuuga

SEQ ID NO: 1192621 - RNA, 24 nt, Human
cggaucaccuggggucaggaguuc

SEQ ID NO: 1192622 - RNA, 26 nt, Human
cggcacagacugaccucccuccccag

SEQ ID NO: 1192623 - RNA, 23 nt, Human
cuaaaacuauguccauaagucca

SEQ ID NO: 1192624 - RNA, 25 nt, Human
cuaaaagaacaauguacauacuuaa

SEQ ID NO: 1192625 - RNA, 20 nt, Human
cucaaaaauaaugucaccau

SEQ ID NO: 1192626 - RNA, 24 nt, Human
cucaaaaggaaacaacaacaaaaa

SEQ ID NO: 1192627 - RNA, 26 nt, Human
cucaaaaggaaacaacaacaaaaaaa

SEQ ID NO: 1192628 - RNA, 25 nt, Human
cucaauacuaacaaucacaacagcu

SEQ ID NO: 1192629 - RNA, 24 nt, Human
cucacgucugcaauuccagcacuu

SEQ ID NO: 1192630 - RNA, 23 nt, Human
cucaugccuguaaucccagcacu

SEQ ID NO: 1192631 - RNA, 24 nt, Human
cucaugccuguaaucccagcacuu

SEQ ID NO: 1192632 - RNA, 25 nt, Human
cucauggcucuggccaauacucucc

SEQ ID NO: 1192633 - RNA, 24 nt, Human
cugaccaacauggugaaacccugu

SEQ ID NO: 1192634 - RNA, 22 nt, Human
cugcugcuguucagcuucagug

SEQ ID NO: 1192635 - RNA, 24 nt, Human
cuggccaauauggugaaacccugu

SEQ ID NO: 1192636 - RNA, 26 nt, Human
cuucaauggggggggcgggcguggug

SEQ ID NO: 1192637 - RNA, 24 nt, Human
gacagagcaagacucugucuugaa

SEQ ID NO: 1192638 - RNA, 22 nt, Human
gacucacauacacgucuccccu

SEQ ID NO: 1192639 - RNA, 23 nt, Human
gacucaguuccagaccaucauga

SEQ ID NO: 1192640 - RNA, 19 nt, Human
gacugucagauuaaaaaca

SEQ ID NO: 1192641 - RNA, 23 nt, Human
gagaaucgcuugaacccaggggg

SEQ ID NO: 1192642 - RNA, 18 nt, Human
gaggagcugcugcugcug

SEQ ID NO: 1192643 - RNA, 22 nt, Human
gaggagcuggaccccucaaaaa

SEQ ID NO: 1192644 - RNA, 21 nt, Human
gagguugcagugagcugagau

SEQ ID NO: 1192645 - RNA, 20 nt, Human
gauagacaaccuaagucucc

SEQ ID NO: 1192646 - RNA, 23 nt, Human
gaucaccuggggucaggaguuca

SEQ ID NO: 1192647 - RNA, 24 nt, Human
gaucaccuggggucaggaguucaa

SEQ ID NO: 1192648 - RNA, 24 nt, Human
gaucacuucagaucaggaguucga

SEQ ID NO: 1192649 - RNA, 23 nt, Human
gaugucgaaggcagcagcagaaa

SEQ ID NO: 1192650 - RNA, 19 nt, Human
gauugcaaaaaaaugcuga

SEQ ID NO: 1192651 - RNA, 21 nt, Human
gcaaaaaaaugcugacacaga

SEQ ID NO: 1192652 - RNA, 24 nt, Human
gcacuccagccugggcgacagagc

SEQ ID NO: 1192653 - RNA, 22 nt, Human
gcaggagaaucgcuugaaccca

SEQ ID NO: 1192654 - RNA, 24 nt, Human
gccaauauggugaaacccugucuc

SEQ ID NO: 1192655 - RNA, 22 nt, Human
gccacugcacuccagccugggc

SEQ ID NO: 1192656 - RNA, 24 nt, Human
gccacugcacuccagccugggcga

SEQ ID NO: 1192657 - RNA, 20 nt, Human
gcugggcaugguggcucacg

SEQ ID NO: 1192658 - RNA, 18 nt, Human
ggaagaaguagcagcagu

SEQ ID NO: 1192659 - RNA, 20 nt, Human
ggacagggcuuggagugggg

SEQ ID NO: 1192660 - RNA, 18 nt, Human
ggagcuguugccaauggc

SEQ ID NO: 1192661 - RNA, 22 nt, Human
ggagguugcagugagcugagau

SEQ ID NO: 1192662 - RNA, 23 nt, Human
ggagguugcagugagcugagaug

SEQ ID NO: 1192663 - RNA, 24 nt, Human
ggagguugcagugagcugagaugg

SEQ ID NO: 1192664 - RNA, 22 nt, Human
ggaucaccuggggucaggaguu

SEQ ID NO: 1192665 - RNA, 23 nt, Human
ggaucaccuggggucaggaguuc

SEQ ID NO: 1192666 - RNA, 19 nt, Human
ggcggagguugcagugagc

SEQ ID NO: 1192667 - RNA, 23 nt, Human
ggcggagguugcagugagcugag

SEQ ID NO: 1192668 - RNA, 24 nt, Human
gggcaugguggcucacgucugcaa

SEQ ID NO: 1192669 - RNA, 24 nt, Human
gggcgugguggcucaugccuguaa

SEQ ID NO: 1192670 - RNA, 22 nt, Human
ggggcgggcgugguggcucaug

SEQ ID NO: 1192671 - RNA, 22 nt, Human
gggggaagaaguagcagcagug

SEQ ID NO: 1192672 - RNA, 24 nt, Human
ggggggggcgggcgugguggcuca

SEQ ID NO: 1192673 - RNA, 21 nt, Human
ggugauuacagugaguccaga

SEQ ID NO: 1192674 - RNA, 24 nt, Human
gguggcucacgucugcaauuccag

SEQ ID NO: 1192675 - RNA, 24 nt, Human
gguggcucaugccuguaaucccag

SEQ ID NO: 1192676 - RNA, 23 nt, Human
gguggugggcgccuguaguccca

SEQ ID NO: 1192677 - RNA, 24 nt, Human
gguggugggcgccuguagucccag

SEQ ID NO: 1192678 - RNA, 18 nt, Human
gguuucuagguauuccuu

SEQ ID NO: 1192679 - RNA, 24 nt, Human
guugcagugagcugagauggugcc

SEQ ID NO: 1192680 - RNA, 20 nt, Human
uaaaagaacaauguacauac

SEQ ID NO: 1192681 - RNA, 19 nt, Human
uaaacuucuuggucugugu

SEQ ID NO: 1192682 - RNA, 27 nt, Human
uaaauauauagaagcauacacccagcu

SEQ ID NO: 1192683 - RNA, 21 nt, Human
uaaauccaaaagcagaugugg

SEQ ID NO: 1192684 - RNA, 21 nt, Human
uaaguaaaugaauauucaaau

SEQ ID NO: 1192685 - RNA, 20 nt, Human
uaauuugccuucucuguucc

SEQ ID NO: 1192686 - RNA, 19 nt, Human
uacaaugaaacauaaugga

SEQ ID NO: 1192687 - RNA, 22 nt, Human
uacacugcauacaacugaaaac

SEQ ID NO: 1192688 - RNA, 25 nt, Human
uacauacaugcauaaugcuuacaca

SEQ ID NO: 1192689 - RNA, 18 nt, Human
uacucagagaggcaacag

SEQ ID NO: 1192690 - RNA, 27 nt, Human
uagaacucaaggcaguccucauggcuc

SEQ ID NO: 1192691 - RNA, 20 nt, Human
uagacugucagauuaaaaac

SEQ ID NO: 1192692 - RNA, 23 nt, Human
uagacugucagauuaaaaacacu

SEQ ID NO: 1192693 - RNA, 22 nt, Human
uagagaacacuguguagaccac

SEQ ID NO: 1192694 - RNA, 20 nt, Human
uagagacaauaacaagguaa

SEQ ID NO: 1192695 - RNA, 23 nt, Human
uagcagcagugcucagguacuga

SEQ ID NO: 1192696 - RNA, 28 nt, Human
uaguagagacaauaacaagguaauagua

SEQ ID NO: 1192697 - RNA, 23 nt, Human
uaucucauuccaucucacuuuca

SEQ ID NO: 1192698 - RNA, 20 nt, Human
ucaaagcuuuaaucacuuac

SEQ ID NO: 1192699 - RNA, 19 nt, Human
ucaauacuaacaaucacaa

SEQ ID NO: 1192700 - RNA, 21 nt, Human
ucaauggggggggcgggcgug

SEQ ID NO: 1192701 - RNA, 18 nt, Human
ucacacacauuuugaggu

SEQ ID NO: 1192702 - RNA, 20 nt, Human
ucaccaccacauacacauua

SEQ ID NO: 1192703 - RNA, 22 nt, Human
ucacgucugcaauuccagcacu

SEQ ID NO: 1192704 - RNA, 20 nt, Human
ucacuucagaucaggaguuc

SEQ ID NO: 1192705 - RNA, 23 nt, Human
uccacuucuugucaauuuggcac

SEQ ID NO: 1192706 - RNA, 24 nt, Human
uccagccugggcgacagagcaaga

SEQ ID NO: 1192707 - RNA, 20 nt, Human
ucccauugguucaauggggc

SEQ ID NO: 1192708 - RNA, 18 nt, Human
uccccuaaauuucugggu

SEQ ID NO: 1192709 - RNA, 21 nt, Human
uccuacaugaaaaaauggcag

SEQ ID NO: 1192710 - RNA, 24 nt, Human
ucgcuugaacccagggggcggagg

SEQ ID NO: 1192711 - RNA, 19 nt, Human
ucuagguauuccuuaaucc

SEQ ID NO: 1192712 - RNA, 22 nt, Human
ucuaugaucccagcuacucagg

SEQ ID NO: 1192713 - RNA, 22 nt, Human
ucuguucucuauaggccccugg

SEQ ID NO: 1192714 - RNA, 23 nt, Human
ugaaaaaacaaacaaaaaaacca

SEQ ID NO: 1192715 - RNA, 22 nt, Human
ugaaaaagcuaaauauauagaa

SEQ ID NO: 1192716 - RNA, 25 nt, Human
ugaaaaagcuaaauauauagaagca

SEQ ID NO: 1192717 - RNA, 25 nt, Human
ugaaaauaaugccuuacuagguuuc

SEQ ID NO: 1192718 - RNA, 20 nt, Human
ugaaaucauauagacuguca

SEQ ID NO: 1192719 - RNA, 20 nt, Human
ugaauccccuuaaacuguaa

SEQ ID NO: 1192720 - RNA, 19 nt, Human
ugacaggguuuggacaggg

SEQ ID NO: 1192721 - RNA, 18 nt, Human
ugacaugagcacaugcug

SEQ ID NO: 1192722 - RNA, 19 nt, Human
ugacaugagcacaugcugu

SEQ ID NO: 1192723 - RNA, 24 nt, Human
ugaccaacauggugaaacccuguc

SEQ ID NO: 1192724 - RNA, 18 nt, Human
ugacccagccaccacaua

SEQ ID NO: 1192725 - RNA, 24 nt, Human
ugagaaacauaaaaacacuagaga

SEQ ID NO: 1192726 - RNA, 24 nt, Human
ugagauggugccacugcacuccag

SEQ ID NO: 1192727 - RNA, 19 nt, Human
ugagcagauaaacuguauu

SEQ ID NO: 1192728 - RNA, 22 nt, Human
ugagcugagauggugccacugc

SEQ ID NO: 1192729 - RNA, 24 nt, Human
ugaggcaggagaauugcuugaauc

SEQ ID NO: 1192730 - RNA, 25 nt, Human
ugaggcaggagaauugcuugaaucc

SEQ ID NO: 1192731 - RNA, 24 nt, Human
ugaugcaggagaaucgcuugaacc

SEQ ID NO: 1192732 - RNA, 23 nt, Human
ugccuguaaucccagcacuuugg

SEQ ID NO: 1192733 - RNA, 22 nt, Human
ugcugcugcuguucagcuucag

SEQ ID NO: 1192734 - RNA, 25 nt, Human
ugcugugauaauguaguuuguggug

SEQ ID NO: 1192735 - RNA, 24 nt, Human
uggccaauauggugaaacccuguc

SEQ ID NO: 1192736 - RNA, 22 nt, Human
uggcucacgucugcaauuccag

SEQ ID NO: 1192737 - RNA, 24 nt, Human
uggcucacgucugcaauuccagca

SEQ ID NO: 1192738 - RNA, 24 nt, Human
uggcucaugccuguaaucccagca

SEQ ID NO: 1192739 - RNA, 21 nt, Human
uggcugccugaguacucagag

SEQ ID NO: 1192740 - RNA, 18 nt, Human
uggcugggcaugguggcu

SEQ ID NO: 1192741 - RNA, 24 nt, Human
ugggaggccaacaugggcggauca

SEQ ID NO: 1192742 - RNA, 20 nt, Human
ugggaggccgaggcaggcag

SEQ ID NO: 1192743 - RNA, 24 nt, Human
ugggaggccgaggcaggcagauca

SEQ ID NO: 1192744 - RNA, 24 nt, Human
ugggcggaucaccuggggucagga

SEQ ID NO: 1192745 - RNA, 22 nt, Human
ugggggaagaaguagcagcagu

SEQ ID NO: 1192746 - RNA, 24 nt, Human
ugggugaaaaagcuaaauauauag

SEQ ID NO: 1192747 - RNA, 24 nt, Human
ugguggcucacgucugcaauucca

SEQ ID NO: 1192748 - RNA, 24 nt, Human
ugguggcucaugccuguaauccca

SEQ ID NO: 1192749 - RNA, 19 nt, Human
ugucccagcucugagaggg

SEQ ID NO: 1192750 - RNA, 19 nt, Human
ugugguggcaggcaucuau

SEQ ID NO: 1192751 - RNA, 19 nt, Human
uguuccuacaggaaaaaag

SEQ ID NO: 1192752 - RNA, 23 nt, Human
uguugaaacuuaaugugacuuaa

SEQ ID NO: 1192753 - RNA, 20 nt, Human
uuaaacuagagaaagugcca

SEQ ID NO: 1192754 - RNA, 22 nt, Human
uuacauacaugcauaaugcuua

SEQ ID NO: 1192755 - RNA, 22 nt, Human
uuagccaggcgcgguggugggc

SEQ ID NO: 1192756 - RNA, 21 nt, Human
uuagcccaaagagccaagauu

SEQ ID NO: 1192757 - RNA, 18 nt, Human
uuagucgggugugguggc

SEQ ID NO: 1192758 - RNA, 24 nt, Human
uuagucgggugugguggcaggcau

SEQ ID NO: 1192759 - RNA, 22 nt, Human
uucagaucaggaguucgagacc

SEQ ID NO: 1192760 - RNA, 20 nt, Human
uucuuggucuauaucucauu

SEQ ID NO: 1192761 - RNA, 20 nt, Human
uucuuggucuguguuccuac

SEQ ID NO: 1192762 - RNA, 24 nt, Human
uugaacccagggggcggagguugc

SEQ ID NO: 1192763 - RNA, 25 nt, Human
uugacaaaugcagauguacaaagag

SEQ ID NO: 1192764 - RNA, 25 nt, Human
uugagaggcugaugcaggagaaucg

SEQ ID NO: 1192765 - RNA, 18 nt, Human
uugcagugagcugagaug

SEQ ID NO: 1192766 - RNA, 22 nt, Human
uugcagugagcugagauggugc

SEQ ID NO: 1192767 - RNA, 25 nt, Human
uuggacggcuccugccaacacugaa

SEQ ID NO: 1192768 - RNA, 22 nt, Human
uuggaguggggaaggaaaacug

SEQ ID NO: 1192769 - RNA, 22 nt, Human
uuggaugcuggagauagauggg

SEQ ID NO: 1192770 - RNA, 18 nt, Human
uuggcugggcaugguggc

SEQ ID NO: 1192771 - RNA, 23 nt, Human
uuggcugggcaugguggcucacg

SEQ ID NO: 1192772 - RNA, 25 nt, Human
uugggaggccgaggcaggcagauca

SEQ ID NO: 1192773 - RNA, 19 nt, Human
uuguggugucaaauuucug

SEQ ID NO: 1192774 - RNA, 22 nt, Human
uuuuaugccugcacuucuuggu

SEQ ID NO: 1192775 - RNA, 22 nt, Human
uuuuggagguaaacuguacggc

SEQ ID NO: 1192776 - RNA, 27 nt, Human
aaaaagcaccugcugcaccauaagccc

SEQ ID NO: 1192777 - RNA, 20 nt, Human
aaacucugcagcaagaguuc

SEQ ID NO: 1192778 - RNA, 24 nt, Human
aaaguuuuauccgcuuucccauau

SEQ ID NO: 1192779 - RNA, 25 nt, Human
aaguuggaggcagagcgcugcuggg

SEQ ID NO: 1192780 - RNA, 20 nt, Human
acaaacacaggcugugggcu

SEQ ID NO: 1192781 - RNA, 19 nt, Human
acacaggcugugggcugga

SEQ ID NO: 1192782 - RNA, 19 nt, Human
acacuuccucucuucuucu

SEQ ID NO: 1192783 - RNA, 26 nt, Human
accaguuccggaagaaccugcgggac

SEQ ID NO: 1192784 - RNA, 22 nt, Human
accccgggaccccugcuguccu

SEQ ID NO: 1192785 - RNA, 18 nt, Human
agacugugcucccuuugg

SEQ ID NO: 1192786 - RNA, 21 nt, Human
agaggccaggaggugcuccag

SEQ ID NO: 1192787 - RNA, 22 nt, Human
agcacccacaagcuuagauagc

SEQ ID NO: 1192788 - RNA, 19 nt, Human
agccagguggugacauggg

SEQ ID NO: 1192789 - RNA, 19 nt, Human
agcugggugcagacugugc

SEQ ID NO: 1192790 - RNA, 19 nt, Human
aggcugaaaagaacaccga

SEQ ID NO: 1192791 - RNA, 22 nt, Human
auggcaguagugccaccuggug

SEQ ID NO: 1192792 - RNA, 26 nt, Human
caccauaagcccagggauguggcagc

SEQ ID NO: 1192793 - RNA, 24 nt, Human
cagcaucucaugugaccaggccug

SEQ ID NO: 1192794 - RNA, 18 nt, Human
caggggaaggaacgcagu

SEQ ID NO: 1192795 - RNA, 19 nt, Human
caguaaagguccaggucag

SEQ ID NO: 1192796 - RNA, 23 nt, Human
ccacugccaagcucuaggacagu

SEQ ID NO: 1192797 - RNA, 18 nt, Human
ccauauaaaaacucuucc

SEQ ID NO: 1192798 - RNA, 21 nt, Human
ccccgggaccccugcuguccu

SEQ ID NO: 1192799 - RNA, 19 nt, Human
cccgggaccccugcugucc

SEQ ID NO: 1192800 - RNA, 19 nt, Human
ccucgggcaccaagacggg

SEQ ID NO: 1192801 - RNA, 18 nt, Human
ccuggggucagccaggug

SEQ ID NO: 1192802 - RNA, 21 nt, Human
ccuucccacagcuucuucuca

SEQ ID NO: 1192803 - RNA, 22 nt, Human
ccuuucgagcagcgccucccag

SEQ ID NO: 1192804 - RNA, 21 nt, Human
cgagcagcgccucccaguggc

SEQ ID NO: 1192805 - RNA, 18 nt, Human
cgaugggauuagagcugg

SEQ ID NO: 1192806 - RNA, 19 nt, Human
cuaaaaccccgggaccccu

SEQ ID NO: 1192807 - RNA, 22 nt, Human
cuaaaaccccgggaccccugcu

SEQ ID NO: 1192808 - RNA, 19 nt, Human
cugccaggggaaggaacgc

SEQ ID NO: 1192809 - RNA, 18 nt, Human
cuuccucucuucuucugu

SEQ ID NO: 1192810 - RNA, 18 nt, Human
cuuggcucugauuucuuu

SEQ ID NO: 1192811 - RNA, 18 nt, Human
cuuuucucaaacuuuccu

SEQ ID NO: 1192812 - RNA, 21 nt, Human
gagcagcgccucccaguggcc

SEQ ID NO: 1192813 - RNA, 21 nt, Human
gauccuugauucagacaguuu

SEQ ID NO: 1192814 - RNA, 19 nt, Human
gcaaaauaucccgcagaag

SEQ ID NO: 1192815 - RNA, 20 nt, Human
gcagaaagggagcacccaca

SEQ ID NO: 1192816 - RNA, 22 nt, Human
gcagcgccucccaguggccaga

SEQ ID NO: 1192817 - RNA, 18 nt, Human
gcagcugcagcgggcuug

SEQ ID NO: 1192818 - RNA, 18 nt, Human
gcagcugcagcgggcuug

SEQ ID NO: 1192819 - RNA, 18 nt, Human
gcagcugcagcgggcuug

SEQ ID NO: 1192820 - RNA, 21 nt, Human
gcagcugcagcgggcuuggcu

SEQ ID NO: 1192821 - RNA, 18 nt, Human
gcgcgccgccaggaagcg

SEQ ID NO: 1192822 - RNA, 20 nt, Human
gcuuuguucgaauaaaacuu

SEQ ID NO: 1192823 - RNA, 23 nt, Human
ggaccuggggucagccagguggu

SEQ ID NO: 1192824 - RNA, 24 nt, Human
ggaccuggggucagccagguggug

SEQ ID NO: 1192825 - RNA, 18 nt, Human
ggcagcaucucaugugac

SEQ ID NO: 1192826 - RNA, 19 nt, Human
ggccaggaggugcuccagg

SEQ ID NO: 1192827 - RNA, 19 nt, Human
gggaccuggggucagccag

SEQ ID NO: 1192828 - RNA, 20 nt, Human
gggaugggguggggacaggc

SEQ ID NO: 1192829 - RNA, 25 nt, Human
gggcaguuugugguuccugauuugg

SEQ ID NO: 1192830 - RNA, 24 nt, Human
ggggaacauacagcauguagaggc

SEQ ID NO: 1192831 - RNA, 21 nt, Human
ggugcagacugugcuccccgg

SEQ ID NO: 1192832 - RNA, 18 nt, Human
gucaccuuucugccgugu

SEQ ID NO: 1192833 - RNA, 20 nt, Human
gugaccucugcaguacuccu

SEQ ID NO: 1192834 - RNA, 22 nt, Human
guucugugacuucccugugacc

SEQ ID NO: 1192835 - RNA, 24 nt, Human
guuuggucuccaggugucaccuuu

SEQ ID NO: 1192836 - RNA, 20 nt, Human
uccuaugagagaaggcugcc

SEQ ID NO: 1192837 - RNA, 21 nt, Human
ucuucuguucuucacgcccca

SEQ ID NO: 1192838 - RNA, 22 nt, Human
ucuucuucuguucuucacgccc

SEQ ID NO: 1192839 - RNA, 25 nt, Human
ugaaaagaacaccgacacccccuug

SEQ ID NO: 1192840 - RNA, 19 nt, Human
ugacugagccucccgaggg

SEQ ID NO: 1192841 - RNA, 18 nt, Human
ugacuucccugugaccuc

SEQ ID NO: 1192842 - RNA, 19 nt, Human
ugagagaaggcugccgggu

SEQ ID NO: 1192843 - RNA, 23 nt, Human
ugagagaaggcugccggguucuc

SEQ ID NO: 1192844 - RNA, 20 nt, Human
ugcguuuggucuccaggugu

SEQ ID NO: 1192845 - RNA, 22 nt, Human
ugcugcaccauaagcccaggga

SEQ ID NO: 1192846 - RNA, 24 nt, Human
ugcuggggcaugaagagucucgag

SEQ ID NO: 1192847 - RNA, 25 nt, Human
ugcuggggcaugaagagucucgagu

SEQ ID NO: 1192848 - RNA, 22 nt, Human
uggagccagaguuuucaugucu

SEQ ID NO: 1192849 - RNA, 22 nt, Human
uggaggcagagcgcugcugggg

SEQ ID NO: 1192850 - RNA, 18 nt, Human
ugggaugggguggggaca

SEQ ID NO: 1192851 - RNA, 20 nt, Human
ugggaugggguggggacagg

SEQ ID NO: 1192852 - RNA, 20 nt, Human
uggggggaacaucauacuug

SEQ ID NO: 1192853 - RNA, 21 nt, Human
uggggucagccagguggugac

SEQ ID NO: 1192854 - RNA, 23 nt, Human
uggggucagccagguggugacau

SEQ ID NO: 1192855 - RNA, 19 nt, Human
ugggguggggacaggcaau

SEQ ID NO: 1192856 - RNA, 24 nt, Human
ugggguggggacaggcaaugaggu

SEQ ID NO: 1192857 - RNA, 24 nt, Human
ugggugcagacugugcucccuuug

SEQ ID NO: 1192858 - RNA, 24 nt, Human
uguggcagcugcagcgggcuuggc

SEQ ID NO: 1192859 - RNA, 24 nt, Human
uguggcagcugcagcgggcuuggc

SEQ ID NO: 1192860 - RNA, 24 nt, Human
uguggcagcugcagcgggcuuggc

SEQ ID NO: 1192861 - RNA, 19 nt, Human
uuacaaacacaggcugugg

SEQ ID NO: 1192862 - RNA, 23 nt, Human
uuccaguccaaugaaaguuuuau

SEQ ID NO: 1192863 - RNA, 24 nt, Human
uucccauauaaaaacucuucccac

SEQ ID NO: 1192864 - RNA, 25 nt, Human
uucccauauaaaaacucuucccacg

SEQ ID NO: 1192865 - RNA, 19 nt, Human
uuccggaagaaccugcggg

SEQ ID NO: 1192866 - RNA, 20 nt, Human
uucuucuguucuucacgccc

SEQ ID NO: 1192867 - RNA, 27 nt, Human
uugaaaaaagcaccugcugcaccauaa

SEQ ID NO: 1192868 - RNA, 24 nt, Human
uuggcucugauuucuuuucuggag

SEQ ID NO: 1192869 - RNA, 22 nt, Human
uuggguaggggaccugggguca

SEQ ID NO: 1192870 - RNA, 18 nt, Human
uugguucugugacccggg

SEQ ID NO: 1192871 - RNA, 23 nt, Human
uuuauccgcuuucccauauaaaa

SEQ ID NO: 1192872 - RNA, 23 nt, Human
uuucuggaggcucggaaacacuu

SEQ ID NO: 1192873 - RNA, 23 nt, Human
aaaaggaaaauguuauaaaagaa

SEQ ID NO: 1192874 - RNA, 18 nt, Human
aaacaaaacaaaacaaaa

SEQ ID NO: 1192875 - RNA, 19 nt, Human
aaacaaaacaaaacaggcc

SEQ ID NO: 1192876 - RNA, 22 nt, Human
aaacaaaacaaaacaggccaga

SEQ ID NO: 1192877 - RNA, 19 nt, Human
aaacaaaacaggccagagc

SEQ ID NO: 1192878 - RNA, 19 nt, Human
aacaaaacaaaacaaaaca

SEQ ID NO: 1192879 - RNA, 19 nt, Human
aagcaaaacaaaagaacaa

SEQ ID NO: 1192880 - RNA, 21 nt, Human
aagcaaaacaaaagaacaaag

SEQ ID NO: 1192881 - RNA, 24 nt, Human
aauaaaaaauagaaaauauuugga

SEQ ID NO: 1192882 - RNA, 22 nt, Human
acaaaacaggccagagccucau

SEQ ID NO: 1192883 - RNA, 24 nt, Human
acaaagcugaacuaagaugacccu

SEQ ID NO: 1192884 - RNA, 18 nt, Human
acagcuucucacagaugu

SEQ ID NO: 1192885 - RNA, 19 nt, Human
acauggguugggccuuuca

SEQ ID NO: 1192886 - RNA, 23 nt, Human
accaaaagcaaaacaaaagaaca

SEQ ID NO: 1192887 - RNA, 21 nt, Human
agagcacauaccaaggggcua

SEQ ID NO: 1192888 - RNA, 21 nt, Human
agagcacuuggaaacaaaaca

SEQ ID NO: 1192889 - RNA, 24 nt, Human
agccagagcacauaccaaggggcu

SEQ ID NO: 1192890 - RNA, 20 nt, Human
agcccuggguccccagaagc

SEQ ID NO: 1192891 - RNA, 21 nt, Human
agccucaucaacuuugagcag

SEQ ID NO: 1192892 - RNA, 25 nt, Human
aggaaaaaaagaaaaaugaaaagga

SEQ ID NO: 1192893 - RNA, 24 nt, Human
aguagaaaaagcaguagaugcaug

SEQ ID NO: 1192894 - RNA, 21 nt, Human
auagcuuggguauggggaagc

SEQ ID NO: 1192895 - RNA, 23 nt, Human
auguugaacaguaaagauguagc

SEQ ID NO: 1192896 - RNA, 21 nt, Human
caaaacaaaacaaaacaggcc

SEQ ID NO: 1192897 - RNA, 25 nt, Human
caaaacaaaacaaaacaggccagag

SEQ ID NO: 1192898 - RNA, 21 nt, Human
caaaacaaaacaggccagagc

SEQ ID NO: 1192899 - RNA, 24 nt, Human
caaagaggauggacuauuuagcca

SEQ ID NO: 1192900 - RNA, 21 nt, Human
caagacaauucuucuucuucc

SEQ ID NO: 1192901 - RNA, 24 nt, Human
cacaaugggcuugaagucuaccag

SEQ ID NO: 1192902 - RNA, 20 nt, Human
cagaagccauguccuuaaaa

SEQ ID NO: 1192903 - RNA, 30 nt, Human; identical to SEQ ID NO: 1192405

SEQ ID NO: 1192904 - RNA, 23 nt, Human
caggaaacgaggaaaaaaagaaa

SEQ ID NO: 1192905 - RNA, 22 nt, Human
cauaccaaggggcuaggcccca

SEQ ID NO: 1192906 - RNA, 20 nt, Human
cauuaggacaugccaguaca

SEQ ID NO: 1192907 - RNA, 21 nt, Human
ccaacacuuacuuuggguuua

SEQ ID NO: 1192908 - RNA, 20 nt, Human
ccagagcacauaccaagggg

SEQ ID NO: 1192909 - RNA, 19 nt, Human
ccaguguuaggaauaaaaa

SEQ ID NO: 1192910 - RNA, 21 nt, Human
ccauauccuugacacaugucc

SEQ ID NO: 1192911 - RNA, 24 nt, Human
cccaggauggcuuugaauguggcc

SEQ ID NO: 1192912 - RNA, 22 nt, Human
cuaaaguucuacauuucaguag

SEQ ID NO: 1192913 - RNA, 21 nt, Human
cugcuuuugguuuuccaaaag

SEQ ID NO: 1192914 - RNA, 25 nt, Human
cuuuggguuuaucugcccaaauuuu

SEQ ID NO: 1192915 - RNA, 21 nt, Human
gaaaaaaagaaaaaugaaaag

SEQ ID NO: 1192916 - RNA, 26 nt, Human
gaggaaaaaaagaaaaaugaaaagga

SEQ ID NO: 1192917 - RNA, 25 nt, Human
gaguagaaaaagcaguagaugcaug

SEQ ID NO: 1192918 - RNA, 25 nt, Human
gauaaccaaaagcaaaacaaaagaa

SEQ ID NO: 1192919 - RNA, 22 nt, Human
gcagcccaggauggcuuugaau

SEQ ID NO: 1192920 - RNA, 22 nt, Human
gcccaacacaaauucauaaacc

SEQ ID NO: 1192921 - RNA, 21 nt, Human
ggaaaguacaacuuccacaaa

SEQ ID NO: 1192922 - RNA, 24 nt, Human
ggacauaguuuuuuguuaaaaaug

SEQ ID NO: 1192923 - RNA, 20 nt, Human
ggcccacaagccacaugcag

SEQ ID NO: 1192924 - RNA, 25 nt, Human
guaaagcaauauagagacuagccuc

SEQ ID NO: 1192925 - RNA, 23 nt, Human
uaagcccuggguccccagaagcc

SEQ ID NO: 1192926 - RNA, 26 nt, Human
uagaaaaagcaguagaugcaugaaga

SEQ ID NO: 1192927 - RNA, 19 nt, Human
uagaaaauauuuggaaaaa

SEQ ID NO: 1192928 - RNA, 20 nt, Human
ucaaaagccuguucucaaaa

SEQ ID NO: 1192929 - RNA, 18 nt, Human
uccccagaagccaugucc

SEQ ID NO: 1192930 - RNA, 18 nt, Human
ucuccuggcaaaaucuau

SEQ ID NO: 1192931 - RNA, 22 nt, Human
ucugcccaaauuuucccucuca

SEQ ID NO: 1192932 - RNA, 21 nt, Human
ugaaaaggaguagaaaaagca

SEQ ID NO: 1192933 - RNA, 22 nt, Human
ugaaaaucagaagccagaacag

SEQ ID NO: 1192934 - RNA, 19 nt, Human
ugagauaccacaucuaugu

SEQ ID NO: 1192935 - RNA, 21 nt, Human
ugaguuuaucaaaagccuguu

SEQ ID NO: 1192936 - RNA, 24 nt, Human
ugauaaaaggaaaauguuauaaaa

SEQ ID NO: 1192937 - RNA, 21 nt, Human
ugcccaaauuuucccucucaa

SEQ ID NO: 1192938 - RNA, 19 nt, Human
uggaaaaaauaaauguaug

SEQ ID NO: 1192939 - RNA, 23 nt, Human
uggaaacaaaacaaaacaaaaca

SEQ ID NO: 1192940 - RNA, 22 nt, Human
uggacaaagcugaacuaagaug

SEQ ID NO: 1192941 - RNA, 18 nt, Human
uggcaaaaucuauggcuc

SEQ ID NO: 1192942 - RNA, 26 nt, Human
uggcaaaaucuauggcucuguaaaga

SEQ ID NO: 1192943 - RNA, 23 nt, Human
uggcaagcuugucuagcucauca

SEQ ID NO: 1192944 - RNA, 20 nt, Human
ugggccaugugaacaugucu

SEQ ID NO: 1192945 - RNA, 21 nt, Human
uguaguagguuucuuugucag

SEQ ID NO: 1192946 - RNA, 18 nt, Human
uguuccugagaaccacau

SEQ ID NO: 1192947 - RNA, 23 nt, Human
uuaaaaauguugaacaguaaaga

SEQ ID NO: 1192948 - RNA, 21 nt, Human
uucauaaaccuucuuaaaaca

SEQ ID NO: 1192949 - RNA, 23 nt, Human
uuuccaggauacuggaauuaggc

SEQ ID NO: 1192950 - RNA, 18 nt, Human
uuucuugaagagaggaaa

SEQ ID NO: 1192951 - RNA, 22 nt, Human
uuugggugagcuuuuaauauuu

SEQ ID NO: 1192952 - RNA, 22 nt, Human
aacaacuccaacaggaaacaaa

SEQ ID NO: 1192953 - RNA, 21 nt, Human
aaccauccguuaaaaggaaca

SEQ ID NO: 1192954 - RNA, 21 nt, Human
aaccuugccuccucaccgagc

SEQ ID NO: 1192955 - RNA, 24 nt, Human
aauaaucucaaagucauccaacag

SEQ ID NO: 1192956 - RNA, 27 nt, Human
agaacagaaacccacuacuaagaaugc

SEQ ID NO: 1192957 - RNA, 21 nt, Human
agaagucaaggaaauccuggu

SEQ ID NO: 1192958 - RNA, 23 nt, Human
agaauagauugagguacaaggca

SEQ ID NO: 1192959 - RNA, 18 nt, Human
agcacuaugugugacuac

SEQ ID NO: 1192960 - RNA, 19 nt, Human
aggaaauccugguuugcau

SEQ ID NO: 1192961 - RNA, 18 nt, Human
agggauggggccccggaa

SEQ ID NO: 1192962 - RNA, 18 nt, Human
auccaacagaacagaaac

SEQ ID NO: 1192963 - RNA, 24 nt, Human
caacaggaaacaaagaauaaucuc

SEQ ID NO: 1192964 - RNA, 23 nt, Human
caacuccaacaggaaacaaagaa

SEQ ID NO: 1192965 - RNA, 27 nt, Human
caacuccaacaggaaacaaagaauaau

SEQ ID NO: 1192966 - RNA, 23 nt, Human
cacaauucacaaaauggaaugga

SEQ ID NO: 1192967 - RNA, 23 nt, Human
cacuggcccaaacccccucccac

SEQ ID NO: 1192968 - RNA, 20 nt, Human
cagaauagauugagguacaa

SEQ ID NO: 1192969 - RNA, 19 nt, Human
ccaaacccccucccacugg

SEQ ID NO: 1192970 - RNA, 21 nt, Human
ccaaacccccucccacuggcc

SEQ ID NO: 1192971 - RNA, 20 nt, Human
ccaacagaacagaaacccac

SEQ ID NO: 1192972 - RNA, 22 nt, Human
ccaaucugaauaaaaaacaaga

SEQ ID NO: 1192973 - RNA, 18 nt, Human
ccacuggcccuggcugca

SEQ ID NO: 1192974 - RNA, 19 nt, Human
ccccggaaggugcacuggc

SEQ ID NO: 1192975 - RNA, 24 nt, Human
cccucagaaccuugccuccucacc

SEQ ID NO: 1192976 - RNA, 19 nt, Human
ccuccgggggccucugguc

SEQ ID NO: 1192977 - RNA, 21 nt, Human
cuaaacuauauaaacagcacu

SEQ ID NO: 1192978 - RNA, 18 nt, Human
cuggcagaucuucuccuu

SEQ ID NO: 1192979 - RNA, 22 nt, Human
cuggcccaaacccccucccacc

SEQ ID NO: 1192980 - RNA, 18 nt, Human
cugggcaauggagaccca

SEQ ID NO: 1192981 - RNA, 21 nt, Human
cuugccuccucaccgagccug

SEQ ID NO: 1192982 - RNA, 21 nt, Human
cuuuuuccacugcuauuauua

SEQ ID NO: 1192983 - RNA, 22 nt, Human
gcauucucaaagaagucaagga

SEQ ID NO: 1192984 - RNA, 20 nt, Human
gcgggagugugggcaggagc

SEQ ID NO: 1192985 - RNA, 21 nt, Human
ggcgggagugugggcaggagc

SEQ ID NO: 1192986 - RNA, 20 nt, Human
gggcaauggagacccacugg

SEQ ID NO: 1192987 - RNA, 20 nt, Human
gggcaggagcugggcaaugg

SEQ ID NO: 1192988 - RNA, 22 nt, Human
uaaaaaacaagacucuuacucc

SEQ ID NO: 1192989 - RNA, 25 nt, Human
uaaaaaacaagacucuuacuccuaa

SEQ ID NO: 1192990 - RNA, 19 nt, Human
uacuaagaaugcugacugc

SEQ ID NO: 1192991 - RNA, 21 nt, Human
uacuaagaaugcugacugcuc

SEQ ID NO: 1192992 - RNA, 20 nt, Human
uauaaacagcacuaugugug

SEQ ID NO: 1192993 - RNA, 18 nt, Human
ucaaagaagucaaggaaa

SEQ ID NO: 1192994 - RNA, 18 nt, Human
ucaccgagccugggccgg

SEQ ID NO: 1192995 - RNA, 23 nt, Human
ucagugcuccuccgggggccucu

SEQ ID NO: 1192996 - RNA, 23 nt, Human
uccccucagaaccuugccuccuc

SEQ ID NO: 1192997 - RNA, 24 nt, Human
ucgcucguugcucagggcgagaau

SEQ ID NO: 1192998 - RNA, 24 nt, Human
ucucaaagucauccaacagaacag

SEQ ID NO: 1192999 - RNA, 21 nt, Human
ugggcaggagcugggcaaugg

SEQ ID NO: 1193000 - RNA, 19 nt, Human
uggucagggcaacaggcgg

SEQ ID NO: 1193001 - RNA, 24 nt, Human
ugguccuccaggucagccuguccc

SEQ ID NO: 1193002 - RNA, 21 nt, Human
uucuccuucagugcuccuccg

SEQ ID NO: 1193003 - RNA, 23 nt, Human
uuugaacaacuccaacaggaaac

SEQ ID NO: 1193004 - RNA, 24 nt, Human
uuugauuucuugaguuaucucaug

SEQ ID NO: 1193005 - RNA, 26 nt, Human
uuuuccacugcuauuauuaugucaca

SEQ ID NO: 1193006 - RNA, 21 nt, Human
accaggugccccuggccucgc

SEQ ID NO: 1193007 - RNA, 19 nt, Human
agcgggauggacagcgggg

SEQ ID NO: 1193008 - RNA, 22 nt, Human
augguggugauaguggcgggac

SEQ ID NO: 1193009 - RNA, 19 nt, Human
ccagcagcgggauggacag

SEQ ID NO: 1193010 - RNA, 20 nt, Human
ccuuuagcauccccuucagc

SEQ ID NO: 1193011 - RNA, 20 nt, Human
cgcaccaggugccccuggcc

SEQ ID NO: 1193012 - RNA, 21 nt, Human
cucgccagccagaggaccagu

SEQ ID NO: 1193013 - RNA, 19 nt, Human
gaugguggugauaguggcg

SEQ ID NO: 1193014 - RNA, 23 nt, Human
uaucuccuuuagcauccccuuca

SEQ ID NO: 1193015 - RNA, 19 nt, Human
uccuugggguggugugcgu

SEQ ID NO: 1193016 - RNA, 22 nt, Human
ugagugccuggggcaucuccug

SEQ ID NO: 1193017 - RNA, 20 nt, Human
ugccuggggcaucuccugca

SEQ ID NO: 1193018 - RNA, 18 nt, Human
uggcacccgcaccaggug

SEQ ID NO: 1193019 - RNA, 19 nt, Human
uggccggagggccucaggu

SEQ ID NO: 1193020 - RNA, 20 nt, Human
uuggggaugguggugauagu

SEQ ID NO: 1193021 - RNA, 27 nt, Human
aaagauuuucuuuuuuuucuucugaga

SEQ ID NO: 1193022 - RNA, 22 nt, Human
cauggcugagacaguccccucu

SEQ ID NO: 1193023 - RNA, 22 nt, Human
cucaagcaaacacuuuggucuc

SEQ ID NO: 1193024 - RNA, 21 nt, Human
gaaucaauuuuuaacuuucca

SEQ ID NO: 1193025 - RNA, 22 nt, Human
ugaaaugaagcccaagaaaguu

SEQ ID NO: 1193026 - RNA, 24 nt, Human
ugacaaaaauaagaaucaauuuuu

SEQ ID NO: 1193027 - RNA, 21 nt, Human
ugagacaguccccucugcucu

SEQ ID NO: 1193028 - RNA, 22 nt, Human
ugagguuugcauggcugagaca

SEQ ID NO: 1193029 - RNA, 21 nt, Human
aaacugguguuuuaucuuuaa

SEQ ID NO: 1193030 - RNA, 19 nt, Human
cauugcugaggugaucagc

SEQ ID NO: 1193031 - RNA, 22 nt, Human
cucuuccuuucuuccugcaaac

SEQ ID NO: 1193032 - RNA, 20 nt, Human
cugaggugaucagcuuucuu

SEQ ID NO: 1193033 - RNA, 24 nt, Human
gcuggugugugagaccauuugggu

SEQ ID NO: 1193034 - RNA, 22 nt, Human
guucucugucauuccauaagaa

SEQ ID NO: 1193035 - RNA, 18 nt, Human
uaagaaagcugaacagug

SEQ ID NO: 1193036 - RNA, 21 nt, Human
ucaaugauaaacuccacuggu

SEQ ID NO: 1193037 - RNA, 21 nt, Human
uccacugguuuauaccuccug

SEQ ID NO: 1193038 - RNA, 22 nt, Human
uccacugguuuauaccuccugg

SEQ ID NO: 1193039 - RNA, 18 nt, Human
ugaaaucauucauugcug

SEQ ID NO: 1193040 - RNA, 23 nt, Human
uggaaaacaguuauucagaaaca

SEQ ID NO: 1193041 - RNA, 30 nt, Human
ugguguuuuaucuuuacaaguucucugucc

SEQ ID NO: 1193042 - RNA, 25 nt, Human
uuacaaguucucugucauuccauaa

SEQ ID NO: 1193043 - RNA, 21 nt, Human
aaaauagcaaaauauagagag

SEQ ID NO: 1193044 - RNA, 18 nt, Human
aaaaugguuuccugggcu

SEQ ID NO: 1193045 - RNA, 23 nt, Human
aacugccaaaagcugugggagcc

SEQ ID NO: 1193046 - RNA, 22 nt, Human
aagauuggaggcauuuugcccc

SEQ ID NO: 1193047 - RNA, 22 nt, Human
aagcccagaggccuaggaggga

SEQ ID NO: 1193048 - RNA, 18 nt, Human
acaugacugacuccaucu

SEQ ID NO: 1193049 - RNA, 25 nt, Human
acugguuaguggagcugugagaaga

SEQ ID NO: 1193050 - RNA, 18 nt, Human
agaagaacagcauaaaag

SEQ ID NO: 1193051 - RNA, 20 nt, Human
agagaagaacagcauaaaag

SEQ ID NO: 1193052 - RNA, 21 nt, Human
agccagcugaagaaaucugca

SEQ ID NO: 1193053 - RNA, 23 nt, Human
agugcggaagaaaaauguggggu

SEQ ID NO: 1193054 - RNA, 24 nt, Human
agugcggaagaaaaaugugggguu

SEQ ID NO: 1193055 - RNA, 25 nt, Human
agugcggaagaaaaaugugggguuu

SEQ ID NO: 1193056 - RNA, 18 nt, Human
augcauucacaaagagaa

SEQ ID NO: 1193057 - RNA, 19 nt, Human
augucagagaucuucaugg

SEQ ID NO: 1193058 - RNA, 21 nt, Human
caaaaugcugagagugauacg

SEQ ID NO: 1193059 - RNA, 21 nt, Human
cacacagaguccccacugggg

SEQ ID NO: 1193060 - RNA, 25 nt, Human
cagaacuauaagucaauuaaaccuc

SEQ ID NO: 1193061 - RNA, 25 nt, Human
ccaagacaauggggaaaacgucuca

SEQ ID NO: 1193062 - RNA, 20 nt, Human
ccagaggccuaggagggaaa

SEQ ID NO: 1193063 - RNA, 28 nt, Human
ccagucucagggaaguucuuccgagagg

SEQ ID NO: 1193064 - RNA, 21 nt, Human
ccaguuuuauuuuggacccca

SEQ ID NO: 1193065 - RNA, 19 nt, Human
ccauguaaggcauuccugc

SEQ ID NO: 1193066 - RNA, 18 nt, Human
cccccacacagagucccc

SEQ ID NO: 1193067 - RNA, 22 nt, Human
ccccugcucugugcagccuugg

SEQ ID NO: 1193068 - RNA, 20 nt, Human
ccuggaugugagauguggag

SEQ ID NO: 1193069 - RNA, 19 nt, Human
cggacuaauucaaaaaacu

SEQ ID NO: 1193070 - RNA, 25 nt, Human
cuagccucaacaaauguauucagag

SEQ ID NO: 1193071 - RNA, 23 nt, Human
cuauguaguugaaaagaaaaacc

SEQ ID NO: 1193072 - RNA, 22 nt, Human
cugaaaguguucaguuauaugc

SEQ ID NO: 1193073 - RNA, 18 nt, Human
cuucauggcagccccugc

SEQ ID NO: 1193074 - RNA, 20 nt, Human
cuucuuggcaacugaagcaa

SEQ ID NO: 1193075 - RNA, 21 nt, Human
gaaaacgucucagcaccaugu

SEQ ID NO: 1193076 - RNA, 24 nt, Human
gaaauacagccucgauuuagaaag

SEQ ID NO: 1193077 - RNA, 20 nt, Human
gaagaugugggaaaguuugg

SEQ ID NO: 1193078 - RNA, 18 nt, Human
gaaguccaggaugaggug

SEQ ID NO: 1193079 - RNA, 24 nt, Human
gaauguggaagguacuuuggaacu

SEQ ID NO: 1193080 - RNA, 23 nt, Human
gaggaacuucuuggcaacugaag

SEQ ID NO: 1193081 - RNA, 21 nt, Human
ggaagaaaaaugugggguugg

SEQ ID NO: 1193082 - RNA, 20 nt, Human
gggaagagggaugguguaga

SEQ ID NO: 1193083 - RNA, 21 nt, Human
gggaugguguagacagugagu

SEQ ID NO: 1193084 - RNA, 25 nt, Human
gggcagaaguuggaacacuuuggaa

SEQ ID NO: 1193085 - RNA, 22 nt, Human
gggcagugcggaagaaaaaugu

SEQ ID NO: 1193086 - RNA, 22 nt, Human
gguuuccugggcugggccaagg

SEQ ID NO: 1193087 - RNA, 23 nt, Human
guagugcuggguuugagggugca

SEQ ID NO: 1193088 - RNA, 21 nt, Human
gugcacuuugaagagcaacag

SEQ ID NO: 1193089 - RNA, 21 nt, Human
gugcggaagaaaaaugugggg

SEQ ID NO: 1193090 - RNA, 21 nt, Human
gugcggaagaaaaaugugggg

SEQ ID NO: 1193091 - RNA, 21 nt, Human
uaaguaaugaggagcacaugg

SEQ ID NO: 1193092 - RNA, 24 nt, Human
uaccugagaauguggaagguacuu

SEQ ID NO: 1193093 - RNA, 19 nt, Human
uagagagaacacuucagag

SEQ ID NO: 1193094 - RNA, 23 nt, Human
uagugaagauggcauuuuuuuaa

SEQ ID NO: 1193095 - RNA, 18 nt, Human
uauucaagacaugaccug

SEQ ID NO: 1193096 - RNA, 20 nt, Human
ucaaaaaacugguacugagg

SEQ ID NO: 1193097 - RNA, 19 nt, Human
ucaccauuuugcacugaag

SEQ ID NO: 1193098 - RNA, 24 nt, Human
ucccccugcucugugcagccuugg

SEQ ID NO: 1193099 - RNA, 19 nt, Human
uccuucacacacucucucu

SEQ ID NO: 1193100 - RNA, 26 nt, Human
ucucagcaccaugucagagaucuuca

SEQ ID NO: 1193101 - RNA, 21 nt, Human
ucucagggaaguucuuuauag

SEQ ID NO: 1193102 - RNA, 21 nt, Human
ucugcauaaguaaugaggagc

SEQ ID NO: 1193103 - RNA, 23 nt, Human
ugaaaagaaaaacccauuuucug

SEQ ID NO: 1193104 - RNA, 19 nt, Human
ugaaacagcaagggugggu

SEQ ID NO: 1193105 - RNA, 24 nt, Human
ugagauguggagucaaaggagauc

SEQ ID NO: 1193106 - RNA, 20 nt, Human
ugaggaacuucuuggcaacu

SEQ ID NO: 1193107 - RNA, 24 nt, Human
ugaggguaguggggcauugcuaug

SEQ ID NO: 1193108 - RNA, 23 nt, Human
ugcacagaaguaaaaaauugaag

SEQ ID NO: 1193109 - RNA, 22 nt, Human
ugcagaaccucugcuagggcag

SEQ ID NO: 1193110 - RNA, 22 nt, Human
ugcagccuugggacauggugcc

SEQ ID NO: 1193111 - RNA, 21 nt, Human
ugccauguaaggcauuccugc

SEQ ID NO: 1193112 - RNA, 22 nt, Human
ugcccuugcccuagagaucugu

SEQ ID NO: 1193113 - RNA, 26 nt, Human
ugcccuugcccuagagaucuguggaa

SEQ ID NO: 1193114 - RNA, 18 nt, Human
ugcuagggcagugcggaa

SEQ ID NO: 1193115 - RNA, 21 nt, Human
ugcugcagaaguggaaacuuc

SEQ ID NO: 1193116 - RNA, 20 nt, Human
uggaacuggguaaugggcag

SEQ ID NO: 1193117 - RNA, 20 nt, Human
uggaagacaggaagaugugg

SEQ ID NO: 1193118 - RNA, 19 nt, Human
uggagcugugagaagaggg

SEQ ID NO: 1193119 - RNA, 22 nt, Human
ugggccaagggucccccugcuc

SEQ ID NO: 1193120 - RNA, 25 nt, Human
uggggcacugguuaguggagcugug

SEQ ID NO: 1193121 - RNA, 23 nt, Human
uguauucagagacuuuuuuucac

SEQ ID NO: 1193122 - RNA, 23 nt, Human
uguguuugacaguuccuccuuca

SEQ ID NO: 1193123 - RNA, 26 nt, Human
uuaaaacuuuauugauaauucagcaa

SEQ ID NO: 1193124 - RNA, 23 nt, Human
uuaaaccucuuuccuuuauaagu

SEQ ID NO: 1193125 - RNA, 24 nt, Human
uuccugaggcuuccccagccaugc

SEQ ID NO: 1193126 - RNA, 20 nt, Human
uuccugcuuccgcucacacc

SEQ ID NO: 1193127 - RNA, 23 nt, Human
uucuaagccaggcuccuccucac

SEQ ID NO: 1193128 - RNA, 24 nt, Human
uuucacuugucauuucaggcugag

SEQ ID NO: 1193129 - RNA, 21 nt, Human
aaauuccuuuuuaccauaggc

SEQ ID NO: 1193130 - RNA, 21 nt, Human
cacgaagcccucuucccauuc

SEQ ID NO: 1193131 - RNA, 25 nt, Human
cacucugcucucaaucuuccaucuc

SEQ ID NO: 1193132 - RNA, 21 nt, Human
ccaucuccuccucucaaauuc

SEQ ID NO: 1193133 - RNA, 19 nt, Human
cucugcucucaaucuucca

SEQ ID NO: 1193134 - RNA, 21 nt, Human
cuuccaucuccuccucucaaa

SEQ ID NO: 1193135 - RNA, 19 nt, Human
cuucccauucuugcacucu

SEQ ID NO: 1193136 - RNA, 28 nt, Human
cuucccauucuugcacucugcucucaau

SEQ ID NO: 1193137 - RNA, 23 nt, Human
gcccucuucccauucuugcacuc

SEQ ID NO: 1193138 - RNA, 24 nt, Human
ucaaucuuccaucuccuccucuca

SEQ ID NO: 1193139 - RNA, 19 nt, Human
ugugggagugauucuaggu

SEQ ID NO: 1193140 - RNA, 24 nt, Human
uucuaggugcugugacuuuuauga

SEQ ID NO: 1193141 - RNA, 18 nt, Human
aaugcacaagagaaagaa

SEQ ID NO: 1193142 - RNA, 22 nt, Human
ugaaaggaagauaaaaucuguc

SEQ ID NO: 1193143 - RNA, 18 nt, Human
aaaaaauggcaagggaca

SEQ ID NO: 1193144 - RNA, 23 nt, Human
aaaaaccauugaauuguacacuu

SEQ ID NO: 1193145 - RNA, 23 nt, Human
aaaaauucucuuuuaaaaauguc

SEQ ID NO: 1193146 - RNA, 24 nt, Human
aaaaauucucuuuuaaaaauguca

SEQ ID NO: 1193147 - RNA, 24 nt, Human
aaaacaggcaaaaucacagagaca

SEQ ID NO: 1193148 - RNA, 19 nt, Human
aaaaggccacaaauuauug

SEQ ID NO: 1193149 - RNA, 21 nt, Human
aaaaguaaccuauuuuacaug

SEQ ID NO: 1193150 - RNA, 20 nt, Human
aaaaucacagagacagaaag

SEQ ID NO: 1193151 - RNA, 25 nt, Human
aaacaauuauguuuugauccccccg

SEQ ID NO: 1193152 - RNA, 25 nt, Human
aaacaggcaaaaucacagagacaga

SEQ ID NO: 1193153 - RNA, 25 nt, Human
aaacaugauuauuacaacauguggc

SEQ ID NO: 1193154 - RNA, 18 nt, Human
aaaguaaccuauuuuaca

SEQ ID NO: 1193155 - RNA, 22 nt, Human
aaauagaaaauguagcaaagaa

SEQ ID NO: 1193156 - RNA, 24 nt, Human
aaauagaaaauguagcaaagaaaa

SEQ ID NO: 1193157 - RNA, 24 nt, Human
aaauggguucucaaucauaaaggu

SEQ ID NO: 1193158 - RNA, 20 nt, Human
aacacggugaaaccccuauc

SEQ ID NO: 1193159 - RNA, 21 nt, Human
aacacggugaaaccccuaucu

SEQ ID NO: 1193160 - RNA, 22 nt, Human
aacacggugaaaccccuaucuc

SEQ ID NO: 1193161 - RNA, 26 nt, Human
aacacuuucagccauuacugaaaaua

SEQ ID NO: 1193162 - RNA, 21 nt, Human
aagagcaucaugguaucacag

SEQ ID NO: 1193163 - RNA, 21 nt, Human
aagcauuucagaauggaaaua

SEQ ID NO: 1193164 - RNA, 21 nt, Human
aaggaacugguuccuggaggc

SEQ ID NO: 1193165 - RNA, 20 nt, Human
aaggagggaguaggggaggg

SEQ ID NO: 1193166 - RNA, 21 nt, Human
aauuacaagaaaaaauggcaa

SEQ ID NO: 1193167 - RNA, 20 nt, Human
aauugcuugaacccaggagg

SEQ ID NO: 1193168 - RNA, 24 nt, Human
aauugcuugaacccaggaggcgga

SEQ ID NO: 1193169 - RNA, 19 nt, Human
acaggcaaaaucacagaga

SEQ ID NO: 1193170 - RNA, 23 nt, Human
acaugaucaacaaaaaaaggaaa

SEQ ID NO: 1193171 - RNA, 18 nt, Human
acuccagccugggagaca

SEQ ID NO: 1193172 - RNA, 18 nt, Human
acugcacuccagccuggg

SEQ ID NO: 1193173 - RNA, 18 nt, Human
acugcacuccagccuggg

SEQ ID NO: 1193174 - RNA, 27 nt, Human
acugcacuccagccugggagacaacag

SEQ ID NO: 1193175 - RNA, 20 nt, Human
agaaaaaauggcaagggaca

SEQ ID NO: 1193176 - RNA, 20 nt, Human
agaaaauguagcaaagaaaa

SEQ ID NO: 1193177 - RNA, 22 nt, Human
agccaaauaauaaauuaaaaca

SEQ ID NO: 1193178 - RNA, 23 nt, Human
agccaggcgugguggugcacgcc

SEQ ID NO: 1193179 - RNA, 25 nt, Human
agccugggagacaacagcgagacuu

SEQ ID NO: 1193180 - RNA, 23 nt, Human
agcggugaugcuugcacaacauu

SEQ ID NO: 1193181 - RNA, 21 nt, Human
aggaaggaaggaaggaaagga

SEQ ID NO: 1193182 - RNA, 18 nt, Human
aggaaggagaauugcuug

SEQ ID NO: 1193183 - RNA, 18 nt, Human
aggagaauaagaaauggg

SEQ ID NO: 1193184 - RNA, 20 nt, Human
aggagaauugcuugaaccca

SEQ ID NO: 1193185 - RNA, 18 nt, Human
aggagggaguaggggagg

SEQ ID NO: 1193186 - RNA, 24 nt, Human
aggcagguggaucaccaggucagg

SEQ ID NO: 1193187 - RNA, 21 nt, Human
aggccgaggcagguggaucac

SEQ ID NO: 1193188 - RNA, 21 nt, Human
aggcggaggucacagugagcc

SEQ ID NO: 1193189 - RNA, 24 nt, Human
aggcggaggucacagugagccgag

SEQ ID NO: 1193190 - RNA, 24 nt, Human
aggcgugguggugcacgccuguag

SEQ ID NO: 1193191 - RNA, 24 nt, Human
aggcugaggaaggagaauugcuug

SEQ ID NO: 1193192 - RNA, 18 nt, Human
agggaguaggggagggag

SEQ ID NO: 1193193 - RNA, 22 nt, Human
agggaguaggggagggaggcuu

SEQ ID NO: 1193194 - RNA, 19 nt, Human
agguggaucaccaggucag

SEQ ID NO: 1193195 - RNA, 24 nt, Human
aucgcgccacugcacuccagccug

SEQ ID NO: 1193196 - RNA, 24 nt, Human
auuuaaggucacauuaaaggauaa

SEQ ID NO: 1193197 - RNA, 24 nt, Human
caaaacaggcaaaaucacagagac

SEQ ID NO: 1193198 - RNA, 18 nt, Human
caaaaguauaggaguuca

SEQ ID NO: 1193199 - RNA, 20 nt, Human
caaacacaaaaggccacaaa

SEQ ID NO: 1193200 - RNA, 21 nt, Human
caaagcuccuacagcuguaga

SEQ ID NO: 1193201 - RNA, 19 nt, Human
caaauggcccucuucauuc

SEQ ID NO: 1193202 - RNA, 24 nt, Human
caacaaaaaaaggaaaaugacauc

SEQ ID NO: 1193203 - RNA, 27 nt, Human
caacaaaaaaaggaaaaugacaucaca

SEQ ID NO: 1193204 - RNA, 24 nt, Human
caacaaguuaaaauacaguaaugc

SEQ ID NO: 1193205 - RNA, 24 nt, Human
caacacuuugggaggccgaggcag

SEQ ID NO: 1193206 - RNA, 25 nt, Human
caacacuuugggaggccgaggcagg

SEQ ID NO: 1193207 - RNA, 23 nt, Human
cacacucauacaaugaaacauca

SEQ ID NO: 1193208 - RNA, 22 nt, Human
cacaguauggccauuaggagaa

SEQ ID NO: 1193209 - RNA, 18 nt, Human
cacgccuguagucccagc

SEQ ID NO: 1193210 - RNA, 24 nt, Human
cacgcuuauaaucccaacacuuug

SEQ ID NO: 1193211 - RNA, 18 nt, Human
cacugcacuccagccugg

SEQ ID NO: 1193212 - RNA, 19 nt, Human
cacugcacuccagccuggg

SEQ ID NO: 1193213 - RNA, 22 nt, Human
cacugcacuccagccugggaga

SEQ ID NO: 1193214 - RNA, 25 nt, Human
cacugcacuccagccugggagacaa

SEQ ID NO: 1193215 - RNA, 26 nt, Human
cacugcacuccagccugggagacaac

SEQ ID NO: 1193216 - RNA, 24 nt, Human
cacuuuaaaaauggcaaguuugag

SEQ ID NO: 1193217 - RNA, 18 nt, Human
cagcauucuguucacacc

SEQ ID NO: 1193218 - RNA, 23 nt, Human
caggggccgaggaagggaagaac

SEQ ID NO: 1193219 - RNA, 20 nt, Human
caguccgaucucaccugaaa

SEQ ID NO: 1193220 - RNA, 24 nt, Human
caucacauuuuucacaaggacaca

SEQ ID NO: 1193221 - RNA, 20 nt, Human
ccaaaacaggcaaaaucaca

SEQ ID NO: 1193222 - RNA, 19 nt, Human
ccacugcacuccagccugg

SEQ ID NO: 1193223 - RNA, 20 nt, Human
ccacugcacuccagccuggg

SEQ ID NO: 1193224 - RNA, 22 nt, Human
ccacugcacuccagccugggag

SEQ ID NO: 1193225 - RNA, 24 nt, Human
ccacugcacuccagccugggagac

SEQ ID NO: 1193226 - RNA, 18 nt, Human
ccaguaaugucaaaagua

SEQ ID NO: 1193227 - RNA, 21 nt, Human
ccuggaggcgauuuccucucc

SEQ ID NO: 1193228 - RNA, 23 nt, Human
ccuggcuaacacggugaaacccc

SEQ ID NO: 1193229 - RNA, 25 nt, Human
ccuggcuaacacggugaaaccccua

SEQ ID NO: 1193230 - RNA, 19 nt, Human
ccuguagucccagcuacuc

SEQ ID NO: 1193231 - RNA, 21 nt, Human
ccuguagucccagcuacucag

SEQ ID NO: 1193232 - RNA, 24 nt, Human
cgagaccauccuggcuaacacggu

SEQ ID NO: 1193233 - RNA, 24 nt, Human
cgagaucgcgccacugcacuccag

SEQ ID NO: 1193234 - RNA, 24 nt, Human
cgaggcagguggaucaccagguca

SEQ ID NO: 1193235 - RNA, 26 nt, Human
cgccacugcacuccagccugggagac

SEQ ID NO: 1193236 - RNA, 24 nt, Human
cgccuguagucccagcuacucagg

SEQ ID NO: 1193237 - RNA, 23 nt, Human
cgcuuauaaucccaacacuuugg

SEQ ID NO: 1193238 - RNA, 24 nt, Human
cgcuuauaaucccaacacuuuggg

SEQ ID NO: 1193239 - RNA, 18 nt, Human
cuaaaaguauggaacagu

SEQ ID NO: 1193240 - RNA, 19 nt, Human
cuaagugaaagccaaacac

SEQ ID NO: 1193241 - RNA, 22 nt, Human
cucacgcuuauaaucccaacac

SEQ ID NO: 1193242 - RNA, 24 nt, Human
cucacgcuuauaaucccaacacuu

SEQ ID NO: 1193243 - RNA, 20 nt, Human
cugaauggauaaauaaaaug

SEQ ID NO: 1193244 - RNA, 24 nt, Human
cuggcuaacacggugaaaccccua

SEQ ID NO: 1193245 - RNA, 22 nt, Human
cuuuauguauugacauuuuuca

SEQ ID NO: 1193246 - RNA, 19 nt, Human
gaaauaaaaacugaaccca

SEQ ID NO: 1193247 - RNA, 19 nt, Human
gaaggaaaggagggaguag

SEQ ID NO: 1193248 - RNA, 20 nt, Human
gaaggaaggaaaggagggag

SEQ ID NO: 1193249 - RNA, 22 nt, Human
gacacauuuaaggucacauuaa

SEQ ID NO: 1193250 - RNA, 24 nt, Human
gaggaaggagaauugcuugaaccc

SEQ ID NO: 1193251 - RNA, 18 nt, Human
gaggcugaggaaggagaa

SEQ ID NO: 1193252 - RNA, 24 nt, Human
gaucaccaggucaggagaucgaga

SEQ ID NO: 1193253 - RNA, 21 nt, Human
gaucucaccugaaagaaacaa

SEQ ID NO: 1193254 - RNA, 21 nt, Human
gcaauaaagcagguaacugaa

SEQ ID NO: 1193255 - RNA, 20 nt, Human
gcccucuucauucuuaauuc

SEQ ID NO: 1193256 - RNA, 20 nt, Human
gccgagaucgcgccacugca

SEQ ID NO: 1193257 - RNA, 23 nt, Human
gccuguagucccagcuacucagg

SEQ ID NO: 1193258 - RNA, 25 nt, Human
gcuaacacggugaaaccccuaucuc

SEQ ID NO: 1193259 - RNA, 24 nt, Human
ggaaaggagggaguaggggaggga

SEQ ID NO: 1193260 - RNA, 18 nt, Human
ggagaugcaaauggcccu

SEQ ID NO: 1193261 - RNA, 21 nt, Human
ggaggcggaggucacagugag

SEQ ID NO: 1193262 - RNA, 18 nt, Human
ggagggaguaggggaggg

SEQ ID NO: 1193263 - RNA, 24 nt, Human
ggaggucacagugagccgagaucg

SEQ ID NO: 1193264 - RNA, 19 nt, Human
ggccgaggaagggaagaac

SEQ ID NO: 1193265 - RNA, 24 nt, Human
gguggugcacgccuguagucccag

SEQ ID NO: 1193266 - RNA, 22 nt, Human
gucuccaaaagaaaaaaaaaaa

SEQ ID NO: 1193267 - RNA, 21 nt, Human
uaaaaauacaaaaauuagcca

SEQ ID NO: 1193268 - RNA, 23 nt, Human
uaaaaauugcuuuaaaaauauau

SEQ ID NO: 1193269 - RNA, 19 nt, Human
uaaaauuuuuacuagaagc

SEQ ID NO: 1193270 - RNA, 19 nt, Human
uaacacggugaaaccccua

SEQ ID NO: 1193271 - RNA, 23 nt, Human
uaacacggugaaaccccuaucuc

SEQ ID NO: 1193272 - RNA, 18 nt, Human
uaagagcaucaugguauc

SEQ ID NO: 1193273 - RNA, 20 nt, Human
uacaugaucaacaaaaaaag

SEQ ID NO: 1193274 - RNA, 22 nt, Human
uagaagccaaaauccucaagca

SEQ ID NO: 1193275 - RNA, 20 nt, Human
ucaaacaauaaaaaggaagc

SEQ ID NO: 1193276 - RNA, 18 nt, Human
ucaccaggucaggagauc

SEQ ID NO: 1193277 - RNA, 24 nt, Human
ucaccaggucaggagaucgagacc

SEQ ID NO: 1193278 - RNA, 19 nt, Human
uccaaaacaggcaaaauca

SEQ ID NO: 1193279 - RNA, 24 nt, Human
uccaaaacaggcaaaaucacagag

SEQ ID NO: 1193280 - RNA, 23 nt, Human
uccaaaagaaaaaaaaaaaagug

SEQ ID NO: 1193281 - RNA, 20 nt, Human
uccacauggagcaauaaagc

SEQ ID NO: 1193282 - RNA, 22 nt, Human
uccaggggccgaggaagggaag

SEQ ID NO: 1193283 - RNA, 23 nt, Human
ucgcgccacugcacuccagccug

SEQ ID NO: 1193284 - RNA, 21 nt, Human
ucucuacuaaaaauacaaaaa

SEQ ID NO: 1193285 - RNA, 23 nt, Human
ugaaacaucauuuagccauaaaa

SEQ ID NO: 1193286 - RNA, 19 nt, Human
ugaaaguucagcaauacaa

SEQ ID NO: 1193287 - RNA, 23 nt, Human
ugaaauguccaaaacaggcaaaa

SEQ ID NO: 1193288 - RNA, 24 nt, Human
ugaauggauaaauaaaauguggua

SEQ ID NO: 1193289 - RNA, 22 nt, Human
ugagccgagaucgcgccacugc

SEQ ID NO: 1193290 - RNA, 24 nt, Human
ugaggaaggagaauugcuugaacc

SEQ ID NO: 1193291 - RNA, 24 nt, Human
ugaggccaggcgucauggcucacg

SEQ ID NO: 1193292 - RNA, 22 nt, Human
ugagguaaaaucaaaaggguuu

SEQ ID NO: 1193293 - RNA, 25 nt, Human
uggaaauaaaaacugaacccaggca

SEQ ID NO: 1193294 - RNA, 20 nt, Human
uggcaagggacaagugaucg

SEQ ID NO: 1193295 - RNA, 21 nt, Human
uggcaagggacaagugaucgc

SEQ ID NO: 1193296 - RNA, 20 nt, Human
uggcaaguuugaggccaggc

SEQ ID NO: 1193297 - RNA, 21 nt, Human
uggcucacgcuuauaauccca

SEQ ID NO: 1193298 - RNA, 24 nt, Human
ugggaggccgaggcagguggauca

SEQ ID NO: 1193299 - RNA, 18 nt, Human
uggugcacgccuguaguc

SEQ ID NO: 1193300 - RNA, 21 nt, Human
uggugcacgccuguaguccca

SEQ ID NO: 1193301 - RNA, 24 nt, Human
ugguggugcacgccuguaguccca

SEQ ID NO: 1193302 - RNA, 22 nt, Human
uguacauguacuauauaaaaug

SEQ ID NO: 1193303 - RNA, 19 nt, Human
uguccaaaacaggcaaaau

SEQ ID NO: 1193304 - RNA, 28 nt, Human
uguccaaaacaggcaaaaucacagaggg

SEQ ID NO: 1193305 - RNA, 18 nt, Human
ugugcuaaaaguauggaa

SEQ ID NO: 1193306 - RNA, 24 nt, Human
uguuauaugaauuuuaucucaauu

SEQ ID NO: 1193307 - RNA, 23 nt, Human
uuaaaaugagguaaaaucaaaag

SEQ ID NO: 1193308 - RNA, 21 nt, Human
uuacugaaaauaaacauguag

SEQ ID NO: 1193309 - RNA, 24 nt, Human
uuagccaggcgugguggugcacgc

SEQ ID NO: 1193310 - RNA, 21 nt, Human
uucaaacaauaaaaaggaagc

SEQ ID NO: 1193311 - RNA, 24 nt, Human
uucagaauggaaauaaaaacugaa

SEQ ID NO: 1193312 - RNA, 24 nt, Human
uugaacuuacaauuuaauacuuaa

SEQ ID NO: 1193313 - RNA, 24 nt, Human
uugcuugaacccaggaggcggagg

SEQ ID NO: 1193314 - RNA, 25 nt, Human
uugggaggccgaggcagguggauca

SEQ ID NO: 1193315 - RNA, 26 nt, Human
aaaaggccaaacuuuaggcaguggga

SEQ ID NO: 1193316 - RNA, 20 nt, Human
aaagagcuuacuacagagaa

SEQ ID NO: 1193317 - RNA, 24 nt, Human
aaaugaaugggcagagguaagaac

SEQ ID NO: 1193318 - RNA, 20 nt, Human
aacaugccuauaauaaaaga

SEQ ID NO: 1193319 - RNA, 26 nt, Human
aacaugccuauaauaaaagaaagaga

SEQ ID NO: 1193320 - RNA, 20 nt, Human
aagagaaaucugaauucagc

SEQ ID NO: 1193321 - RNA, 19 nt, Human
aagggcuagcaacacucag

SEQ ID NO: 1193322 - RNA, 26 nt, Human
aauccucucccucccacaaaguccac

SEQ ID NO: 1193323 - RNA, 20 nt, Human
acaaaauauuaaacacauca

SEQ ID NO: 1193324 - RNA, 18 nt, Human
acaugacaucacuguccc

SEQ ID NO: 1193325 - RNA, 23 nt, Human
agacaaugagacagacagcaagg

SEQ ID NO: 1193326 - RNA, 19 nt, Human
agagaggcagagaucuuuu

SEQ ID NO: 1193327 - RNA, 21 nt, Human
agcagugagccauagcucugg

SEQ ID NO: 1193328 - RNA, 26 nt, Human
agcuucaaaagaguuuaagagaacaa

SEQ ID NO: 1193329 - RNA, 18 nt, Human
aggcagagagaagagagg

SEQ ID NO: 1193330 - RNA, 22 nt, Human
auccccauuuugcagaugggaa

SEQ ID NO: 1193331 - RNA, 20 nt, Human
augaagaagagucacccaca

SEQ ID NO: 1193332 - RNA, 24 nt, Human
caauggcgaccuggguuuaagcca

SEQ ID NO: 1193333 - RNA, 22 nt, Human
cacaacaacccugugagguagg

SEQ ID NO: 1193334 - RNA, 22 nt, Human
cacagagcgguuaagaucucga

SEQ ID NO: 1193335 - RNA, 20 nt, Human
cagaacaauccucucccucc

SEQ ID NO: 1193336 - RNA, 20 nt, Human
cagagagaagagaggcagag

SEQ ID NO: 1193337 - RNA, 19 nt, Human
cagagcgguuaagaucucg

SEQ ID NO: 1193338 - RNA, 23 nt, Human
cagaggagcaaagcccuguuggu

SEQ ID NO: 1193339 - RNA, 19 nt, Human
cauucaauaagugugcacc

SEQ ID NO: 1193340 - RNA, 19 nt, Human
ccauccaagaaaugcaaac

SEQ ID NO: 1193341 - RNA, 23 nt, Human
ccauccaagaaaugcaaacucca

SEQ ID NO: 1193342 - RNA, 23 nt, Human
cccacaaaguccacauucaaaac

SEQ ID NO: 1193343 - RNA, 22 nt, Human
cccacaugacaucacugucccc

SEQ ID NO: 1193344 - RNA, 20 nt, Human
cccagccccucugaucuucc

SEQ ID NO: 1193345 - RNA, 23 nt, Human
cccauagccagaaaugaaugggc

SEQ ID NO: 1193346 - RNA, 22 nt, Human
cccaugggccggaacccagccc

SEQ ID NO: 1193347 - RNA, 18 nt, Human
ccccaguccacaucuucc

SEQ ID NO: 1193348 - RNA, 25 nt, Human
cccuacaaagagcuuacuacagaga

SEQ ID NO: 1193349 - RNA, 23 nt, Human
ccucucccucccacaaaguccac

SEQ ID NO: 1193350 - RNA, 19 nt, Human
cuaaagcccucaucacccc

SEQ ID NO: 1193351 - RNA, 18 nt, Human
cucacagaggagcaaagc

SEQ ID NO: 1193352 - RNA, 23 nt, Human
cucagcaccaaacuuccugcgga

SEQ ID NO: 1193353 - RNA, 25 nt, Human
cugaaggcccuuuggcaggaacuaa

SEQ ID NO: 1193354 - RNA, 21 nt, Human
cuguuuuucuucaaaaggcca

SEQ ID NO: 1193355 - RNA, 25 nt, Human
cuuccuggccucauuggggagagau

SEQ ID NO: 1193356 - RNA, 22 nt, Human
gaaagacaaugagacagacagc

SEQ ID NO: 1193357 - RNA, 19 nt, Human
gcaaagcauucauucaaua

SEQ ID NO: 1193358 - RNA, 21 nt, Human
gcaaagcauucauucaauaag

SEQ ID NO: 1193359 - RNA, 21 nt, Human
gcagagagaagagaggcagag

SEQ ID NO: 1193360 - RNA, 22 nt, Human
gcagagagaagagaggcagaga

SEQ ID NO: 1193361 - RNA, 20 nt, Human
gcauaauuacaaaucugugc

SEQ ID NO: 1193362 - RNA, 21 nt, Human
gcccucacagaggagcaaagc

SEQ ID NO: 1193363 - RNA, 20 nt, Human
gcuaaagcccucaucacccc

SEQ ID NO: 1193364 - RNA, 20 nt, Human
gggacgaggcagagagaaga

SEQ ID NO: 1193365 - RNA, 22 nt, Human
gggacgaggcagagagaagaga

SEQ ID NO: 1193366 - RNA, 22 nt, Human
guaagaacaggaggcuggccuu

SEQ ID NO: 1193367 - RNA, 23 nt, Human
uaaagcgagcagugagccauagc

SEQ ID NO: 1193368 - RNA, 24 nt, Human
uaacuccccaguccacaucuuccu

SEQ ID NO: 1193369 - RNA, 24 nt, Human
uaagccacacagagaaagggcugg

SEQ ID NO: 1193370 - RNA, 21 nt, Human
uaagugugcacacagaggcug

SEQ ID NO: 1193371 - RNA, 19 nt, Human
uagcagcauagcuucaaaa

SEQ ID NO: 1193372 - RNA, 20 nt, Human
uagcagcauagcuucaaaag

SEQ ID NO: 1193373 - RNA, 20 nt, Human
uagcugacgugagcaaggua

SEQ ID NO: 1193374 - RNA, 19 nt, Human
uaguagaagcauagggaau

SEQ ID NO: 1193375 - RNA, 24 nt, Human
ucaaaagaguuuaagagaacaaaa

SEQ ID NO: 1193376 - RNA, 19 nt, Human
ucacagaggagcaaagccc

SEQ ID NO: 1193377 - RNA, 23 nt, Human
ucaguuuauccucacaacaaccc

SEQ ID NO: 1193378 - RNA, 21 nt, Human
ucccacaaaguccacauucaa

SEQ ID NO: 1193379 - RNA, 21 nt, Human
uccccaguccacaucuuccuu

SEQ ID NO: 1193380 - RNA, 22 nt, Human
uccccauuuugcagaugggaac

SEQ ID NO: 1193381 - RNA, 25 nt, Human
ucuuacaauuugcauagcacuuacu

SEQ ID NO: 1193382 - RNA, 21 nt, Human
ucuuagacugccccugaauuc

SEQ ID NO: 1193383 - RNA, 22 nt, Human
ugagaugcuaaagcccucauca

SEQ ID NO: 1193384 - RNA, 22 nt, Human
ugaggggagagaaagacaaugg

SEQ ID NO: 1193385 - RNA, 19 nt, Human
ugccuugagaugcuaaagc

SEQ ID NO: 1193386 - RNA, 18 nt, Human
ugcucuggacagcucagc

SEQ ID NO: 1193387 - RNA, 19 nt, Human
uggcaggaacuaagaggua

SEQ ID NO: 1193388 - RNA, 22 nt, Human
uggcaggaacuaagagguagga

SEQ ID NO: 1193389 - RNA, 21 nt, Human
uggcccucacagaggagcaaa

SEQ ID NO: 1193390 - RNA, 18 nt, Human
ugggcucuauuagcuuug

SEQ ID NO: 1193391 - RNA, 18 nt, Human
ugggugauuuggcaaaau

SEQ ID NO: 1193392 - RNA, 19 nt, Human
ugguuagcagcauagcuuc

SEQ ID NO: 1193393 - RNA, 22 nt, Human
uguccauuccauugcuuuuaac

SEQ ID NO: 1193394 - RNA, 18 nt, Human
ugucuagacauuagcuuc

SEQ ID NO: 1193395 - RNA, 20 nt, Human
ugugcacacagaggcugaag

SEQ ID NO: 1193396 - RNA, 21 nt, Human
uucaaauaguggcccaugggc

SEQ ID NO: 1193397 - RNA, 20 nt, Human
uucuguucucagaacaaucc

SEQ ID NO: 1193398 - RNA, 19 nt, Human
uuugcagaugggaacacug

SEQ ID NO: 1193399 - RNA, 21 nt, Human
uuuuuuuuuuuuaaacucuca

SEQ ID NO: 1193400 - RNA, 19 nt, Human
aagcaagagcugacucagg

SEQ ID NO: 1193401 - RNA, 22 nt, Human
aagcagccucuggggcccuagu

SEQ ID NO: 1193402 - RNA, 22 nt, Human
aaggguagggcccagggcaacc

SEQ ID NO: 1193403 - RNA, 22 nt, Human
aaucuucaaugguagacagucc

SEQ ID NO: 1193404 - RNA, 22 nt, Human
aaugguagacagucccagguac

SEQ ID NO: 1193405 - RNA, 21 nt, Human
agaauaaacauuuguugagug

SEQ ID NO: 1193406 - RNA, 22 nt, Human
agagcugacucaggaaggguag

SEQ ID NO: 1193407 - RNA, 20 nt, Human
agaguauccuccacccccuc

SEQ ID NO: 1193408 - RNA, 21 nt, Human
agccccuuggcacagggguuc

SEQ ID NO: 1193409 - RNA, 21 nt, Human
aggaaucuguaauuuuaacac

SEQ ID NO: 1193410 - RNA, 24 nt, Human
aggaaucuguaauuuuaacacgcu

SEQ ID NO: 1193411 - RNA, 22 nt, Human
aggcagcacagccacacaagcc

SEQ ID NO: 1193412 - RNA, 20 nt, Human
aggcuacagccagccaccac

SEQ ID NO: 1193413 - RNA, 27 nt, Human
aguauccuccacccccucauccaugac

SEQ ID NO: 1193414 - RNA, 20 nt, Human
caacaaguuaccauggcuaa

SEQ ID NO: 1193415 - RNA, 19 nt, Human
caagccagacagcgugcac

SEQ ID NO: 1193416 - RNA, 25 nt, Human
caagggcuccugauuccugaggccc

SEQ ID NO: 1193417 - RNA, 19 nt, Human
cagcagcagcagcaggauu

SEQ ID NO: 1193418 - RNA, 19 nt, Human
cagccagccaccaccagga

SEQ ID NO: 1193419 - RNA, 21 nt, Human
caggaaggguagggcccaggg

SEQ ID NO: 1193420 - RNA, 19 nt, Human
caggaaguugaucacuaag

SEQ ID NO: 1193421 - RNA, 18 nt, Human
cagggguucccagaggcc

SEQ ID NO: 1193422 - RNA, 20 nt, Human
cagguuccggaguaccuccc

SEQ ID NO: 1193423 - RNA, 27 nt, Human
ccacacaagccagacagcgugcacuag

SEQ ID NO: 1193424 - RNA, 18 nt, Human
ccaccugcugccccccuc

SEQ ID NO: 1193425 - RNA, 22 nt, Human
ccccuuggcacagggguuccca

SEQ ID NO: 1193426 - RNA, 18 nt, Human
cccucgagccaugaccca

SEQ ID NO: 1193427 - RNA, 20 nt, Human
ccugcugccccccucccccg

SEQ ID NO: 1193428 - RNA, 24 nt, Human
ccuucgagauucugauucaguagg

SEQ ID NO: 1193429 - RNA, 24 nt, Human
ccuuuuggggaagccaucccugau

SEQ ID NO: 1193430 - RNA, 20 nt, Human
cuacuccuguccugaugccu

SEQ ID NO: 1193431 - RNA, 19 nt, Human
cuccccauccccucccuag

SEQ ID NO: 1193432 - RNA, 18 nt, Human
cuccuccuacuccugucc

SEQ ID NO: 1193433 - RNA, 23 nt, Human
cucucagccucauguccgacucc

SEQ ID NO: 1193434 - RNA, 21 nt, Human
cucucccugcuggcagcucca

SEQ ID NO: 1193435 - RNA, 25 nt, Human
cucuuucuccuccuacuccuguccu

SEQ ID NO: 1193436 - RNA, 18 nt, Human
cugccccccucccccggg

SEQ ID NO: 1193437 - RNA, 21 nt, Human
cugcugcccagugccagcagc

SEQ ID NO: 1193438 - RNA, 19 nt, Human
cuuccaccugcugcccccc

SEQ ID NO: 1193439 - RNA, 24 nt, Human
cuuuuggggaagccaucccugauu

SEQ ID NO: 1193440 - RNA, 19 nt, Human
gagaguauccuccaccccc

SEQ ID NO: 1193441 - RNA, 22 nt, Human
gauuccugaggcccaacuccug

SEQ ID NO: 1193442 - RNA, 21 nt, Human
gauuccuucagugagugugcu

SEQ ID NO: 1193443 - RNA, 19 nt, Human
gcccagugccagcagcccc

SEQ ID NO: 1193444 - RNA, 25 nt, Human
gccugggcagaguccagguggaccu

SEQ ID NO: 1193445 - RNA, 22 nt, Human
gcugcacucucugggaccagca

SEQ ID NO: 1193446 - RNA, 19 nt, Human
ggaaccacgcauccuccuu

SEQ ID NO: 1193447 - RNA, 19 nt, Human
ggcccagggcaacccucag

SEQ ID NO: 1193448 - RNA, 23 nt, Human
ggcugcacucucugggaccagca

SEQ ID NO: 1193449 - RNA, 21 nt, Human
ggggaagccaucccugauuuc

SEQ ID NO: 1193450 - RNA, 22 nt, Human
gggugcugcugcccagugccag

SEQ ID NO: 1193451 - RNA, 18 nt, Human
uaacacgcuccccacgug

SEQ ID NO: 1193452 - RNA, 19 nt, Human
uaacccuaggaggccuccc

SEQ ID NO: 1193453 - RNA, 20 nt, Human
uaacccuaggaggccucccc

SEQ ID NO: 1193454 - RNA, 20 nt, Human
uagagauacagguuccggag

SEQ ID NO: 1193455 - RNA, 22 nt, Human
uagcagcagcagcagcagcagg

SEQ ID NO: 1193456 - RNA, 24 nt, Human
uaggccugcggguggagccaagga

SEQ ID NO: 1193457 - RNA, 19 nt, Human
uaggcuacagccagccacc

SEQ ID NO: 1193458 - RNA, 20 nt, Human
uagugugccuuuuggggaag

SEQ ID NO: 1193459 - RNA, 20 nt, Human
ucaagggcuccugauuccug

SEQ ID NO: 1193460 - RNA, 18 nt, Human
ucaggcagcacagccaca

SEQ ID NO: 1193461 - RNA, 18 nt, Human
ucaguaggccugcgggug

SEQ ID NO: 1193462 - RNA, 19 nt, Human
ucauccaugaccucgguug

SEQ ID NO: 1193463 - RNA, 21 nt, Human
ucccugcuggcagcuccacag

SEQ ID NO: 1193464 - RNA, 18 nt, Human
uccucgugggcucugggg

SEQ ID NO: 1193465 - RNA, 18 nt, Human
ucuuucuccuccuacucc

SEQ ID NO: 1193466 - RNA, 19 nt, Human
ugagcaaggagaauguugc

SEQ ID NO: 1193467 - RNA, 19 nt, Human
ugcaggccacaaagggcag

SEQ ID NO: 1193468 - RNA, 20 nt, Human
ugcucugggcacacuccucg

SEQ ID NO: 1193469 - RNA, 18 nt, Human
ugcugccccccucccccg

SEQ ID NO: 1193470 - RNA, 23 nt, Human
ugcuggggugcuucaaggaauug

SEQ ID NO: 1193471 - RNA, 18 nt, Human
ugggaugagaguauccuc

SEQ ID NO: 1193472 - RNA, 30 nt, Human
ugggcacacuccucgugggcucuggggugg

SEQ ID NO: 1193473 - RNA, 21 nt, Human
ugggcagaguccagguggacc

SEQ ID NO: 1193474 - RNA, 20 nt, Human
uguccgacucccucucccug

SEQ ID NO: 1193475 - RNA, 19 nt, Human
uguugagugaauggugaca

SEQ ID NO: 1193476 - RNA, 19 nt, Human
uucaguaggccugcgggug

SEQ ID NO: 1193477 - RNA, 22 nt, Human
uuccucugguugcaggccacaa

SEQ ID NO: 1193478 - RNA, 18 nt, Human
uuccugaggcccaacucc

SEQ ID NO: 1193479 - RNA, 20 nt, Human
uuccugaggcccaacuccuu

SEQ ID NO: 1193480 - RNA, 19 nt, Human
uucucgugaacaagcaagu

SEQ ID NO: 1193481 - RNA, 24 nt, Human
uugaagcaagagcugacucaggaa

SEQ ID NO: 1193482 - RNA, 19 nt, Human
uugcaguuccucugguugc

SEQ ID NO: 1193483 - RNA, 22 nt, Human
uuucaagggcuccugauuccug

SEQ ID NO: 1193484 - RNA, 21 nt, Human
aaaaaaaacaaaaaaaaaccu

SEQ ID NO: 1193485 - RNA, 24 nt, Human
aaaaaaaacaaaaaaaaaccucag

SEQ ID NO: 1193486 - RNA, 22 nt, Human
aaaaaaacaaaaaaaaaccuca

SEQ ID NO: 1193487 - RNA, 21 nt, Human
aaacaaaaaaaaaccucagga

SEQ ID NO: 1193488 - RNA, 18 nt, Human
aaacagaccacugaaucu

SEQ ID NO: 1193489 - RNA, 18 nt, Human
acaaaaaaaaaccucagg

SEQ ID NO: 1193490 - RNA, 22 nt, Human
accacugaaucugaagucccag

SEQ ID NO: 1193491 - RNA, 20 nt, Human
agaaaaaaaaaaaacaaaaa

SEQ ID NO: 1193492 - RNA, 21 nt, Human
agaaaaaaaaaaaacaaaaaa

SEQ ID NO: 1193493 - RNA, 19 nt, Human
agaaaaaccaaagcuagag

SEQ ID NO: 1193494 - RNA, 23 nt, Human
agagaaaaaaaaaaaacaaaaaa

SEQ ID NO: 1193495 - RNA, 19 nt, Human
aggcagggaaggggaaaag

SEQ ID NO: 1193496 - RNA, 23 nt, Human
cacaauaggacaucccaccaaaa

SEQ ID NO: 1193497 - RNA, 18 nt, Human
cacugaaucugaaguccc

SEQ ID NO: 1193498 - RNA, 24 nt, Human
cacugaaucugaagucccagaaac

SEQ ID NO: 1193499 - RNA, 22 nt, Human
cacuucauagagaaaaaaaaaa

SEQ ID NO: 1193500 - RNA, 22 nt, Human
cagaacuucuccagaaacagac

SEQ ID NO: 1193501 - RNA, 22 nt, Human
cagaccacugaaucugaagucc

SEQ ID NO: 1193502 - RNA, 26 nt, Human
ccaccaaaauccuggagaaaucuagg

SEQ ID NO: 1193503 - RNA, 22 nt, Human
cccagaaacaggcagggaaggg

SEQ ID NO: 1193504 - RNA, 24 nt, Human
ccucaggaggccacagcugucccc

SEQ ID NO: 1193505 - RNA, 19 nt, Human
ccugguuuggugaagccau

SEQ ID NO: 1193506 - RNA, 23 nt, Human
cuagcuugggccuaaaaucagaa

SEQ ID NO: 1193507 - RNA, 22 nt, Human
cugaagucccagaaacaggcag

SEQ ID NO: 1193508 - RNA, 19 nt, Human
gaaaagauggacacaauag

SEQ ID NO: 1193509 - RNA, 22 nt, Human
gaccagaacuucuccagaaaca

SEQ ID NO: 1193510 - RNA, 25 nt, Human
gcagggaaggggaaaagauggacac

SEQ ID NO: 1193511 - RNA, 22 nt, Human
ggccacagcuguccccacaacc

SEQ ID NO: 1193512 - RNA, 21 nt, Human
ggggaaaagauggacacaaua

SEQ ID NO: 1193513 - RNA, 26 nt, Human
uagagaaaaaaaaaaaacaaaaaaaa

SEQ ID NO: 1193514 - RNA, 22 nt, Human
uagauaccacuucauagagaaa

SEQ ID NO: 1193515 - RNA, 18 nt, Human
uagguuuaucauauaagu

SEQ ID NO: 1193516 - RNA, 19 nt, Human
ucagaaaaaccaaagcuag

SEQ ID NO: 1193517 - RNA, 20 nt, Human
ucccagaaacaggcagggaa

SEQ ID NO: 1193518 - RNA, 21 nt, Human
uccccacaaccucauagguuu

SEQ ID NO: 1193519 - RNA, 23 nt, Human
ucuuacugccauucaucuuugac

SEQ ID NO: 1193520 - RNA, 22 nt, Human
ugaccagaacuucuccagaaac

SEQ ID NO: 1193521 - RNA, 27 nt, Human
ugaccagaacuucuccagaaacagacc

SEQ ID NO: 1193522 - RNA, 22 nt, Human
uggaaggagugaagaagaggua

SEQ ID NO: 1193523 - RNA, 22 nt, Human
uucauagagaaaaaaaaaaaac

SEQ ID NO: 1193524 - RNA, 22 nt, Human
caccggagaaaacugacgaccc

SEQ ID NO: 1193525 - RNA, 24 nt, Human
cagugaacucuuuuggugacaucc

SEQ ID NO: 1193526 - RNA, 26 nt, Human
cauccuguucuuguuguauaacuuua

SEQ ID NO: 1193527 - RNA, 18 nt, Human
cugcuuuuucuggugucc

SEQ ID NO: 1193528 - RNA, 19 nt, Human
gcccuggaucauggugaac

SEQ ID NO: 1193529 - RNA, 23 nt, Human
uaaucagcgcgauuucacuuccu

SEQ ID NO: 1193530 - RNA, 26 nt, Human
uaaucagcgcgauuucacuuccugaa

SEQ ID NO: 1193531 - RNA, 23 nt, Human
ugagauuuaaggccaugcccugg

SEQ ID NO: 1193532 - RNA, 19 nt, Human
uuguaagaccucugagauu

SEQ ID NO: 1193533 - RNA, 20 nt, Human
uuugccagggcccaccggag

SEQ ID NO: 1193534 - RNA, 24 nt, Human
aaacaccaccacacgaacacaaac

SEQ ID NO: 1193535 - RNA, 20 nt, Human
aaauuccccaguuguuucuc

SEQ ID NO: 1193536 - RNA, 19 nt, Human
aacaaagccaguccaaugg

SEQ ID NO: 1193537 - RNA, 19 nt, Human
aagcaagaagcaaauauua

SEQ ID NO: 1193538 - RNA, 23 nt, Human
acagaggacugacauguuuccca

SEQ ID NO: 1193539 - RNA, 21 nt, Human
acaguuagagaaggaaauaaa

SEQ ID NO: 1193540 - RNA, 24 nt, Human
accacacgaacacaaacacacaca

SEQ ID NO: 1193541 - RNA, 26 nt, Human
accacacgaacacaaacacacacaca

SEQ ID NO: 1193542 - RNA, 23 nt, Human
acccaggcaccauuugaucaacu

SEQ ID NO: 1193543 - RNA, 22 nt, Human
acgaacacaaacacacacacac

SEQ ID NO: 1193544 - RNA, 21 nt, Human
aguuguuucucugcuugucug

SEQ ID NO: 1193545 - RNA, 24 nt, Human
auaaaagcaagaagcaaauauuac

SEQ ID NO: 1193546 - RNA, 21 nt, Human
auagaaacaccaccacacgaa

SEQ ID NO: 1193547 - RNA, 30 nt, Human
cacaaacacacacacacauuaaccuugcag

SEQ ID NO: 1193548 - RNA, 22 nt, Human
cacacgaacacaaacacacacc

SEQ ID NO: 1193549 - RNA, 20 nt, Human
caccaccacacgaacacaaa

SEQ ID NO: 1193550 - RNA, 25 nt, Human
caguaacauaaaagcaagaagcaaa

SEQ ID NO: 1193551 - RNA, 20 nt, Human
cauggucaccaagcaaaucu

SEQ ID NO: 1193552 - RNA, 22 nt, Human
ccaccacacgaacacaaacaca

SEQ ID NO: 1193553 - RNA, 22 nt, Human
ccaggcaccauuugaucaacuc

SEQ ID NO: 1193554 - RNA, 18 nt, Human
cugagcuuuucuuccaac

SEQ ID NO: 1193555 - RNA, 19 nt, Human
cuuuacgcaggcuuucuuc

SEQ ID NO: 1193556 - RNA, 18 nt, Human
guauuucucauugcuaua

SEQ ID NO: 1193557 - RNA, 22 nt, Human
uaaaagcaagaagcaaauauua

SEQ ID NO: 1193558 - RNA, 24 nt, Human
uacgcaggcuuucuuccacugccu

SEQ ID NO: 1193559 - RNA, 20 nt, Human
uagaaagaauaacuaaaugg

SEQ ID NO: 1193560 - RNA, 23 nt, Human
uagagaaggaaauaaaaguagaa

SEQ ID NO: 1193561 - RNA, 23 nt, Human
uauugcacuuauccauuuacaug

SEQ ID NO: 1193562 - RNA, 20 nt, Human
uuucucauugcuauaucuga

SEQ ID NO: 1193563 - RNA, 19 nt, Human
agagguggugaagguccag

SEQ ID NO: 1193564 - RNA, 21 nt, Human
agguggugaagguccagccuc

SEQ ID NO: 1193565 - RNA, 22 nt, Human
caaaaagaaaugacugcacuua

SEQ ID NO: 1193566 - RNA, 19 nt, Human
ccaaaaagaaaugacugca

SEQ ID NO: 1193567 - RNA, 21 nt, Human
ccucugccgggcagccaaagg

SEQ ID NO: 1193568 - RNA, 21 nt, Human
gaagcucuugccacagcccuu

SEQ ID NO: 1193569 - RNA, 20 nt, Human
gcucuugccacagcccucug

SEQ ID NO: 1193570 - RNA, 22 nt, Human
ggugaagcucuugccacagccc

SEQ ID NO: 1193571 - RNA, 27 nt, Human
uccaaacucaagaucagaauuuaaauc

SEQ ID NO: 1193572 - RNA, 22 nt, Human
uccagccgcagccacccagggg

SEQ ID NO: 1193573 - RNA, 24 nt, Human
ugacuguaauaaaaguaagccaca

SEQ ID NO: 1193574 - RNA, 20 nt, Human
aaaagacucugaugagagaa

SEQ ID NO: 1193575 - RNA, 18 nt, Human
aaaagcccagagcauugu

SEQ ID NO: 1193576 - RNA, 24 nt, Human
aaaagcccagagcauuguuuaaua

SEQ ID NO: 1193577 - RNA, 24 nt, Human
aaaaugaagaagauuaacuagaug

SEQ ID NO: 1193578 - RNA, 25 nt, Human
aaagguugagcucuaauucaaauaa

SEQ ID NO: 1193579 - RNA, 19 nt, Human
aaaugcuggggccaugcuu

SEQ ID NO: 1193580 - RNA, 20 nt, Human
aacauagcaaaacccugucu

SEQ ID NO: 1193581 - RNA, 20 nt, Human
aacauagcaaaacccugucu

SEQ ID NO: 1193582 - RNA, 21 nt, Human
aacauagcaaaacccugucuu

SEQ ID NO: 1193583 - RNA, 21 nt, Human
aagagcuaaaugagagggaaa

SEQ ID NO: 1193584 - RNA, 25 nt, Human
aaguuacucccccauuuacucucca

SEQ ID NO: 1193585 - RNA, 18 nt, Human
aaugaaagaacagccuaa

SEQ ID NO: 1193586 - RNA, 20 nt, Human
aaugaagaagauuaacuaga

SEQ ID NO: 1193587 - RNA, 18 nt, Human
acacacacacacacauau

SEQ ID NO: 1193588 - RNA, 22 nt, Human
acacacacacacauauauacau

SEQ ID NO: 1193589 - RNA, 20 nt, Human
acacuaauaaugccuuccuc

SEQ ID NO: 1193590 - RNA, 21 nt, Human
acagaagauauucucaaaggu

SEQ ID NO: 1193591 - RNA, 21 nt, Human
accugccagugaccaaaaaau

SEQ ID NO: 1193592 - RNA, 19 nt, Human
acuauuuauccugugacga

SEQ ID NO: 1193593 - RNA, 22 nt, Human
agauuuuuuuuuagcuacucau

SEQ ID NO: 1193594 - RNA, 24 nt, Human
aggcugaugcaggagcaucacuug

SEQ ID NO: 1193595 - RNA, 26 nt, Human
aguuaucuaaaauaaaagcccagagc

SEQ ID NO: 1193596 - RNA, 20 nt, Human
auagcaaugaaagaacagcc

SEQ ID NO: 1193597 - RNA, 19 nt, Human
auauauauauauauauaua

SEQ ID NO: 1193598 - RNA, 19 nt, Human
auauauauauauauauaua

SEQ ID NO: 1193599 - RNA, 19 nt, Human
auauauauauauauauaua

SEQ ID NO: 1193600 - RNA, 24 nt, Human
aucacagucacuuguaaaucucaa

SEQ ID NO: 1193601 - RNA, 24 nt, Human
aucacuugagcccaggaguuuggg

SEQ ID NO: 1193602 - RNA, 18 nt, Human
auccauguuuuccugggu

SEQ ID NO: 1193603 - RNA, 21 nt, Human
augaaagaacagccuaauaca

SEQ ID NO: 1193604 - RNA, 20 nt, Human
auuuaucaauuguauucuuu

SEQ ID NO: 1193605 - RNA, 24 nt, Human
caaauaaacaaauuaucuauagaa

SEQ ID NO: 1193606 - RNA, 22 nt, Human
cacacacacauauauacauaua

SEQ ID NO: 1193607 - RNA, 23 nt, Human
cacacacauauauacauauacaa

SEQ ID NO: 1193608 - RNA, 23 nt, Human
cacaguaucugacauauaguaag

SEQ ID NO: 1193609 - RNA, 22 nt, Human
cagagcauuguuuaauaccucu

SEQ ID NO: 1193610 - RNA, 23 nt, Human
cagccugcaaaacugucagccaa

SEQ ID NO: 1193611 - RNA, 24 nt, Human
caucacuugagcccaggaguuugg

SEQ ID NO: 1193612 - RNA, 21 nt, Human
ccaugcauccauaaucccaac

SEQ ID NO: 1193613 - RNA, 23 nt, Human
cccagaagcugagcaaaugcugg

SEQ ID NO: 1193614 - RNA, 22 nt, Human
ccccagaagcugagcaaaugcu

SEQ ID NO: 1193615 - RNA, 24 nt, Human
cccuuacuauuuauccugugacga

SEQ ID NO: 1193616 - RNA, 21 nt, Human
ccuagugguuaaaaaagacuc

SEQ ID NO: 1193617 - RNA, 23 nt, Human
cuauuaucucucgugaccuuagu

SEQ ID NO: 1193618 - RNA, 24 nt, Human
cucaacuauaacauccaggcucac

SEQ ID NO: 1193619 - RNA, 24 nt, Human
cugcugaaguaaacagggccauau

SEQ ID NO: 1193620 - RNA, 20 nt, Human
cuuuauauauauauauauau

SEQ ID NO: 1193621 - RNA, 24 nt, Human
gaaaauuggaacacuaauaaugcc

SEQ ID NO: 1193622 - RNA, 19 nt, Human
gcagaaagaguggaaacac

SEQ ID NO: 1193623 - RNA, 22 nt, Human
gcaggagcaucacuugagccca

SEQ ID NO: 1193624 - RNA, 20 nt, Human
gcauccauaaucccaacucu

SEQ ID NO: 1193625 - RNA, 20 nt, Human
ggagcagagacagaggaagg

SEQ ID NO: 1193626 - RNA, 19 nt, Human
ggagcaucacuugagccca

SEQ ID NO: 1193627 - RNA, 23 nt, Human
gggaaagaaaauauauaaaguac

SEQ ID NO: 1193628 - RNA, 23 nt, Human
gggcagaaagaguggaaacacug

SEQ ID NO: 1193629 - RNA, 18 nt, Human
ggugugccuucucccacu

SEQ ID NO: 1193630 - RNA, 26 nt, Human
guaaaaucucccugaggccuccccag

SEQ ID NO: 1193631 - RNA, 27 nt, Human
guaaaaucucccugaggccuccccaga

SEQ ID NO: 1193632 - RNA, 19 nt, Human
guauauguauauauacaca

SEQ ID NO: 1193633 - RNA, 22 nt, Human
gucacaguaucugacauauagu

SEQ ID NO: 1193634 - RNA, 19 nt, Human
uaaaauaaaagcccagagc

SEQ ID NO: 1193635 - RNA, 22 nt, Human
uaaaauaaaagcccagagcauu

SEQ ID NO: 1193636 - RNA, 20 nt, Human
uaaaccucagucaaacacag

SEQ ID NO: 1193637 - RNA, 20 nt, Human
uaaaugagagggaaagaaaa

SEQ ID NO: 1193638 - RNA, 21 nt, Human
uaacauagcaaaacccugucu

SEQ ID NO: 1193639 - RNA, 21 nt, Human
uaacauagcaaaacccugucu

SEQ ID NO: 1193640 - RNA, 20 nt, Human
uaacauccaggcucacuccu

SEQ ID NO: 1193641 - RNA, 21 nt, Human
uaaguugcaucugguauauau

SEQ ID NO: 1193642 - RNA, 19 nt, Human
uaauaaugccuuccucaua

SEQ ID NO: 1193643 - RNA, 26 nt, Human
uaauauagacaaaauaagucuaaaau

SEQ ID NO: 1193644 - RNA, 25 nt, Human
uacacacacacacacauauauacau

SEQ ID NO: 1193645 - RNA, 18 nt, Human
uacacuuuggugaugauu

SEQ ID NO: 1193646 - RNA, 24 nt, Human
uacauauacaaaaaacauauauau

SEQ ID NO: 1193647 - RNA, 24 nt, Human
uacauauacaaaaaacauauauau

SEQ ID NO: 1193648 - RNA, 22 nt, Human
uaccacaaaaguauauuaauac

SEQ ID NO: 1193649 - RNA, 19 nt, Human
uacccagucucagguauuc

SEQ ID NO: 1193650 - RNA, 24 nt, Human
uacucuccauuucuucauccgaaa

SEQ ID NO: 1193651 - RNA, 22 nt, Human
uacugaaauucucucuccuccc

SEQ ID NO: 1193652 - RNA, 20 nt, Human
uaggccaaaaaugcaaucaa

SEQ ID NO: 1193653 - RNA, 18 nt, Human
uagguaacauagcaaaac

SEQ ID NO: 1193654 - RNA, 22 nt, Human
uauacacacacacacacauaua

SEQ ID NO: 1193655 - RNA, 25 nt, Human
uauacacacacacacacauauauac

SEQ ID NO: 1193656 - RNA, 26 nt, Human
uauauacacacacacacacauauaua

SEQ ID NO: 1193657 - RNA, 25 nt, Human
uauauacauauacaaaaaacauaua

SEQ ID NO: 1193658 - RNA, 30 nt, Human
uauauacauauacaaaaaacauauauaugg

SEQ ID NO: 1193659 - RNA, 19 nt, Human
uauauauauauauauauau

SEQ ID NO: 1193660 - RNA, 19 nt, Human
uauauauauauauauauau

SEQ ID NO: 1193661 - RNA, 19 nt, Human
uauauauauauauauauau

SEQ ID NO: 1193662 - RNA, 24 nt, Human
uauauauauauauauguauaugua

SEQ ID NO: 1193663 - RNA, 20 nt, Human
uauauauauguauauguaua

SEQ ID NO: 1193664 - RNA, 21 nt, Human
uauauauauguauauguauau

SEQ ID NO: 1193665 - RNA, 24 nt, Human
uauauauauguauauguauaugua

SEQ ID NO: 1193666 - RNA, 18 nt, Human
uauauguauauauacaca

SEQ ID NO: 1193667 - RNA, 24 nt, Human
uaucugacauauaguaagugauau

SEQ ID NO: 1193668 - RNA, 31 nt, Human
uauguauauauacacacacacacacauauag

SEQ ID NO: 1193669 - RNA, 19 nt, Human
uauguauauguauauguau

SEQ ID NO: 1193670 - RNA, 22 nt, Human
uauguauauguauauguauaua

SEQ ID NO: 1193671 - RNA, 22 nt, Human
ucacugcauucauauaaggcau

SEQ ID NO: 1193672 - RNA, 27 nt, Human
ucauacauacuauuauaucauauuaua

SEQ ID NO: 1193673 - RNA, 19 nt, Human
ucauuuaucaauuguauuc

SEQ ID NO: 1193674 - RNA, 22 nt, Human
uccagagaauuaucacagucac

SEQ ID NO: 1193675 - RNA, 21 nt, Human
uccauaaucccaacucuucca

SEQ ID NO: 1193676 - RNA, 22 nt, Human
uccccagaagcugagcaaaugc

SEQ ID NO: 1193677 - RNA, 22 nt, Human
ucccugaggccuccccagaagc

SEQ ID NO: 1193678 - RNA, 24 nt, Human
uccucauaagguugcuauaagagc

SEQ ID NO: 1193679 - RNA, 19 nt, Human
ugagagaaauaaagaaaua

SEQ ID NO: 1193680 - RNA, 20 nt, Human
ugagagacaccuaccucuca

SEQ ID NO: 1193681 - RNA, 23 nt, Human
ugagcccaggaguuuggggcuag

SEQ ID NO: 1193682 - RNA, 23 nt, Human
ugauaaacaauuauaacauuuuc

SEQ ID NO: 1193683 - RNA, 23 nt, Human
ugccagugaccaaaaaauggaac

SEQ ID NO: 1193684 - RNA, 21 nt, Human
ugcuauaagagcuaaaugaga

SEQ ID NO: 1193685 - RNA, 24 nt, Human
ugcuaugcuucuuuuaaaaauaua

SEQ ID NO: 1193686 - RNA, 18 nt, Human
ugcuuuuuaugcuucauc

SEQ ID NO: 1193687 - RNA, 24 nt, Human
uggaacacuaauaaugccuuccuc

SEQ ID NO: 1193688 - RNA, 23 nt, Human
uggaacaucugcugaaguaaaca

SEQ ID NO: 1193689 - RNA, 21 nt, Human
uggcaguaaugguuugccuuu

SEQ ID NO: 1193690 - RNA, 19 nt, Human
ugguauagggugcaguucc

SEQ ID NO: 1193691 - RNA, 22 nt, Human
ugguauguauuggcuauuuuga

SEQ ID NO: 1193692 - RNA, 20 nt, Human
ugguuugccuuuaaaaaaau

SEQ ID NO: 1193693 - RNA, 20 nt, Human
uguauauguauauguauaua

SEQ ID NO: 1193694 - RNA, 20 nt, Human
uguauauguauauguauaua

SEQ ID NO: 1193695 - RNA, 22 nt, Human
uguauauguauauguauauaua

SEQ ID NO: 1193696 - RNA, 20 nt, Human
ugucacaguaucugacauau

SEQ ID NO: 1193697 - RNA, 23 nt, Human
ugucaccuagugguuaaaaaaga

SEQ ID NO: 1193698 - RNA, 18 nt, Human
uuaugauuauuuuaugaa

SEQ ID NO: 1193699 - RNA, 23 nt, Human
uucuguacugaaauucucucucc

SEQ ID NO: 1193700 - RNA, 19 nt, Human
uuuauauauauauauauau

SEQ ID NO: 1193701 - RNA, 19 nt, Human
uuuauauauauauauauau

SEQ ID NO: 1193702 - RNA, 28 nt, Human
uuuauauauauauauauauauauaugua

SEQ ID NO: 1193703 - RNA, 19 nt, Human
uuuguggcuuucaacaacu

SEQ ID NO: 1193704 - RNA, 22 nt, Human
aaaaaaaccuagauugcucaaa

SEQ ID NO: 1193705 - RNA, 22 nt, Human
aaaaagcaacaacaacuagauc

SEQ ID NO: 1193706 - RNA, 24 nt, Human
aaaaagcaacaacaacuagaucau

SEQ ID NO: 1193707 - RNA, 27 nt, Human
aaaagaaaaaaaaaaaaacuugaagag

SEQ ID NO: 1193708 - RNA, 21 nt, Human
aaacacagauccccaaucccc

SEQ ID NO: 1193709 - RNA, 23 nt, Human
aaacacagauccccaauccccca

SEQ ID NO: 1193710 - RNA, 21 nt, Human
aaacagaacccacaccggccc

SEQ ID NO: 1193711 - RNA, 28 nt, Human
aaaccaguccagacccucuggaaaccaa

SEQ ID NO: 1193712 - RNA, 19 nt, Human
aaacuugaagagaccaaua

SEQ ID NO: 1193713 - RNA, 21 nt, Human
aagagacuucuccagggaaau

SEQ ID NO: 1193714 - RNA, 18 nt, Human
aagccagaaggaggugcg

SEQ ID NO: 1193715 - RNA, 19 nt, Human
aagggugccaggagcacag

SEQ ID NO: 1193716 - RNA, 25 nt, Human
aagugggaaaggagugacucggaug

SEQ ID NO: 1193717 - RNA, 25 nt, Human
acaacaacuagaucauuuuuggcau

SEQ ID NO: 1193718 - RNA, 20 nt, Human
accaauaauuaacuuuccca

SEQ ID NO: 1193719 - RNA, 18 nt, Human
acuaagccucuuucaaau

SEQ ID NO: 1193720 - RNA, 23 nt, Human
agaaaaagugggaaaggagugac

SEQ ID NO: 1193721 - RNA, 20 nt, Human
agaaagaaaaaaaaaaaccu

SEQ ID NO: 1193722 - RNA, 24 nt, Human
agacccucuggaaaccaagagccc

SEQ ID NO: 1193723 - RNA, 23 nt, Human
agcuugagucagagauggugguu

SEQ ID NO: 1193724 - RNA, 26 nt, Human
aggaagaaagaaaaaaaaaaaccuag

SEQ ID NO: 1193725 - RNA, 22 nt, Human
aggcagccaaggggagaaacag

SEQ ID NO: 1193726 - RNA, 21 nt, Human
agggaaaaaagcaacaacaac

SEQ ID NO: 1193727 - RNA, 26 nt, Human
agucccaucucccccauaagcaccac

SEQ ID NO: 1193728 - RNA, 19 nt, Human
agucuccucccacagggcc

SEQ ID NO: 1193729 - RNA, 21 nt, Human
aucacaaccuccucuuugauu

SEQ ID NO: 1193730 - RNA, 19 nt, Human
auccgaguccagcuccgcc

SEQ ID NO: 1193731 - RNA, 22 nt, Human
caaaggcugggaccucgggugg

SEQ ID NO: 1193732 - RNA, 19 nt, Human
caacuagaucauuuuuggc

SEQ ID NO: 1193733 - RNA, 23 nt, Human
caauagcaaaagaaaaaaaaaaa

SEQ ID NO: 1193734 - RNA, 26 nt, Human
cacaccggcccaggccgaucugcaag

SEQ ID NO: 1193735 - RNA, 19 nt, Human
cacagauccccaauccccc

SEQ ID NO: 1193736 - RNA, 20 nt, Human
caccacugaacuaaauaucu

SEQ ID NO: 1193737 - RNA, 18 nt, Human
caccaggcgggacacggc

SEQ ID NO: 1193738 - RNA, 22 nt, Human
cacuaaaccaggcaccuucgac

SEQ ID NO: 1193739 - RNA, 21 nt, Human
cagaagcuucuccccuggacu

SEQ ID NO: 1193740 - RNA, 21 nt, Human
cagauacugcuacaugcccuc

SEQ ID NO: 1193741 - RNA, 22 nt, Human
cagccggacaacuguguaccuu

SEQ ID NO: 1193742 - RNA, 20 nt, Human
caggagaggaagaaagaaaa

SEQ ID NO: 1193743 - RNA, 21 nt, Human
caguccagacccucuggaaac

SEQ ID NO: 1193744 - RNA, 24 nt, Human
caguccagacccucuggaaaccaa

SEQ ID NO: 1193745 - RNA, 24 nt, Human
cauccacccaagucucacacuuaa

SEQ ID NO: 1193746 - RNA, 23 nt, Human
ccagacccucuggaaaccaagag

SEQ ID NO: 1193747 - RNA, 27 nt, Human
ccagucagaugcccgcagggucgcgcc

SEQ ID NO: 1193748 - RNA, 20 nt, Human
cccaaaccaguccagacccu

SEQ ID NO: 1193749 - RNA, 20 nt, Human
cccacaacuccuuguuuuaa

SEQ ID NO: 1193750 - RNA, 21 nt, Human
cccacagggccuugggacugg

SEQ ID NO: 1193751 - RNA, 23 nt, Human
cccauaagcaccacugaacuaaa

SEQ ID NO: 1193752 - RNA, 23 nt, Human
cccauaagcaccacugaacuaaa

SEQ ID NO: 1193753 - RNA, 24 nt, Human
cccauaagcaccacugaacuaaau

SEQ ID NO: 1193754 - RNA, 19 nt, Human
ccccaaucccccaccaggc

SEQ ID NO: 1193755 - RNA, 21 nt, Human
cccgcagggucgcgccaagca

SEQ ID NO: 1193756 - RNA, 28 nt, Human
cccucuggaaaccaagagccccagccac

SEQ ID NO: 1193757 - RNA, 22 nt, Human
ccgcagggucgcgccaagcacg

SEQ ID NO: 1193758 - RNA, 22 nt, Human
ccgcccagggcggcuccugcaa

SEQ ID NO: 1193759 - RNA, 19 nt, Human
ccgggcgagaggaggguuc

SEQ ID NO: 1193760 - RNA, 20 nt, Human
ccucucggugaccacgacuc

SEQ ID NO: 1193761 - RNA, 20 nt, Human
ccucuggaaaccaagagccc

SEQ ID NO: 1193762 - RNA, 24 nt, Human
cgacugggguggaaaauagggaaa

SEQ ID NO: 1193763 - RNA, 20 nt, Human
cggcccaggccgaucugcaa

SEQ ID NO: 1193764 - RNA, 22 nt, Human
cucuggaaaccaagagccccag

SEQ ID NO: 1193765 - RNA, 23 nt, Human
cugaguaaauggcgauuccucuu

SEQ ID NO: 1193766 - RNA, 19 nt, Human
cugcugccgguuccuguaa

SEQ ID NO: 1193767 - RNA, 22 nt, Human
cugcugccgguuccuguaaggg

SEQ ID NO: 1193768 - RNA, 23 nt, Human
cuucacacuaagccucuuucaaa

SEQ ID NO: 1193769 - RNA, 20 nt, Human
cuuggguccgggcgagagga

SEQ ID NO: 1193770 - RNA, 20 nt, Human
cuuggguccgggcgagagga

SEQ ID NO: 1193771 - RNA, 22 nt, Human
gaaaaagugggaaaggagugac

SEQ ID NO: 1193772 - RNA, 24 nt, Human
gaaaauagggaaaaaagcaacaac

SEQ ID NO: 1193773 - RNA, 22 nt, Human
gacagugacaagugguaacaau

SEQ ID NO: 1193774 - RNA, 18 nt, Human
gacccucuggaaaccaag

SEQ ID NO: 1193775 - RNA, 19 nt, Human
gcgugacacccuuccccca

SEQ ID NO: 1193776 - RNA, 21 nt, Human
gcuugagucagagaugguggu

SEQ ID NO: 1193777 - RNA, 24 nt, Human
ggacagauacugcuacaugcccuc

SEQ ID NO: 1193778 - RNA, 23 nt, Human
gggaguguauucaggagaggaag

SEQ ID NO: 1193779 - RNA, 18 nt, Human
gggguggaaaauagggaa

SEQ ID NO: 1193780 - RNA, 23 nt, Human
gguaacaauagcaaaagaaaaaa

SEQ ID NO: 1193781 - RNA, 21 nt, Human
guggaaaauagggaaaaaagc

SEQ ID NO: 1193782 - RNA, 20 nt, Human
uaaaccaggcaccuucgacc

SEQ ID NO: 1193783 - RNA, 27 nt, Human
uaaagcacccaaaccaguccagacccu

SEQ ID NO: 1193784 - RNA, 26 nt, Human
uaacaauagcaaaagaaaaaaaaaaa

SEQ ID NO: 1193785 - RNA, 20 nt, Human
uaaccuauuaggaagcccau

SEQ ID NO: 1193786 - RNA, 18 nt, Human
uaagcaccacugaacuaa

SEQ ID NO: 1193787 - RNA, 23 nt, Human
uaagcaccacugaacuaaauauc

SEQ ID NO: 1193788 - RNA, 21 nt, Human
uaaggagcgacugggguggaa

SEQ ID NO: 1193789 - RNA, 23 nt, Human
uagauauaaauggcuaaacacag

SEQ ID NO: 1193790 - RNA, 18 nt, Human
ucaggagaggaagaaaga

SEQ ID NO: 1193791 - RNA, 19 nt, Human
ucaggagaggaagaaagaa

SEQ ID NO: 1193792 - RNA, 27 nt, Human
uccaagaaauauauauauaaaaaaaua

SEQ ID NO: 1193793 - RNA, 20 nt, Human
uccagucccugggcuagggu

SEQ ID NO: 1193794 - RNA, 25 nt, Human
ucccccacaacuccuuguuuuaaag

SEQ ID NO: 1193795 - RNA, 21 nt, Human
ucccccauaagcaccacugaa

SEQ ID NO: 1193796 - RNA, 21 nt, Human
ucccccauaagcaccacugaa

SEQ ID NO: 1193797 - RNA, 23 nt, Human
uccccuggacuacugauugaaca

SEQ ID NO: 1193798 - RNA, 23 nt, Human
ucccugggcuaggguucuagaag

SEQ ID NO: 1193799 - RNA, 18 nt, Human
ucgaccaaaucacaaccu

SEQ ID NO: 1193800 - RNA, 21 nt, Human
ucggugaccacgacucaaagg

SEQ ID NO: 1193801 - RNA, 19 nt, Human
ucugggcugcauuccagga

SEQ ID NO: 1193802 - RNA, 19 nt, Human
ucuuggguccgggcgagag

SEQ ID NO: 1193803 - RNA, 19 nt, Human
ugaaguagcagaagcuucu

SEQ ID NO: 1193804 - RNA, 21 nt, Human
ugagucagagauggugguuau

SEQ ID NO: 1193805 - RNA, 24 nt, Human
uggaagcuugagucagagauggug

SEQ ID NO: 1193806 - RNA, 20 nt, Human
uggagacagugacaaguggu

SEQ ID NO: 1193807 - RNA, 21 nt, Human
uggcuaaacacagauccccaa

SEQ ID NO: 1193808 - RNA, 20 nt, Human
ugguaacaauagcaaaagaa

SEQ ID NO: 1193809 - RNA, 20 nt, Human
ugguaacaauagcaaaagaa

SEQ ID NO: 1193810 - RNA, 25 nt, Human
ugguaacaauagcaaaagaaaaaaa

SEQ ID NO: 1193811 - RNA, 19 nt, Human
ugucugggcugcauuccag

SEQ ID NO: 1193812 - RNA, 22 nt, Human
uucaggagaggaagaaagaaaa

SEQ ID NO: 1193813 - RNA, 23 nt, Human
uucccagccggacaacuguguac

SEQ ID NO: 1193814 - RNA, 22 nt, Human
uucccauccacccaagucucac

SEQ ID NO: 1193815 - RNA, 19 nt, Human
uuggauggaggccggcggg

SEQ ID NO: 1193816 - RNA, 22 nt, Human
uuuaaagcacccaaaccagucc

SEQ ID NO: 1193817 - RNA, 22 nt, Human
aaacuucagcacggcccucugg

SEQ ID NO: 1193818 - RNA, 20 nt, Human
aacuuaaggacauccuccuc

SEQ ID NO: 1193819 - RNA, 19 nt, Human
acuguuccaucuggaaguc

SEQ ID NO: 1193820 - RNA, 23 nt, Human
agcagaagcuucucccagguccg

SEQ ID NO: 1193821 - RNA, 19 nt, Human
agguuccugcugcaaggaa

SEQ ID NO: 1193822 - RNA, 21 nt, Human
aguggcagcagcaaacuucag

SEQ ID NO: 1193823 - RNA, 27 nt, Human
auccagaacaacgccauauggaccccu

SEQ ID NO: 1193824 - RNA, 24 nt, Human
aucuggaagucaagauuggugcca

SEQ ID NO: 1193825 - RNA, 24 nt, Human
auggcaacaauggcacgagcugcc

SEQ ID NO: 1193826 - RNA, 19 nt, Human
cagaagcuucucccagguc

SEQ ID NO: 1193827 - RNA, 24 nt, Human
cagcaauuggaguggcuccagugg

SEQ ID NO: 1193828 - RNA, 19 nt, Human
cagcccuggggucaguaac

SEQ ID NO: 1193829 - RNA, 20 nt, Human
cagcccuggggucaguaacc

SEQ ID NO: 1193830 - RNA, 20 nt, Human
ccaccuaaauagguuccugc

SEQ ID NO: 1193831 - RNA, 24 nt, Human
ccagcagaagcuucucccaggucc

SEQ ID NO: 1193832 - RNA, 21 nt, Human
ccgugggucccagaaggcugc

SEQ ID NO: 1193833 - RNA, 22 nt, Human
cgaugggaauccagaacaacgc

SEQ ID NO: 1193834 - RNA, 22 nt, Human
gaacuuaaggacauccuccucc

SEQ ID NO: 1193835 - RNA, 18 nt, Human
gauguagaugccaucacu

SEQ ID NO: 1193836 - RNA, 18 nt, Human
gcccuggggucaguaacc

SEQ ID NO: 1193837 - RNA, 23 nt, Human
ggcugguggucagcccugggguc

SEQ ID NO: 1193838 - RNA, 19 nt, Human
uaagagcccaugcaagaac

SEQ ID NO: 1193839 - RNA, 20 nt, Human
uaaggacauccuccuccuuc

SEQ ID NO: 1193840 - RNA, 22 nt, Human
ucaauggcaacaauggcacgag

SEQ ID NO: 1193841 - RNA, 20 nt, Human
ucagcaggguuuucaauggc

SEQ ID NO: 1193842 - RNA, 23 nt, Human
ucccuuuaaguuacgaugggaau

SEQ ID NO: 1193843 - RNA, 18 nt, Human
ugccagcagaagcuucuc

SEQ ID NO: 1193844 - RNA, 20 nt, Human
ugccagcagaagcuucuccc

SEQ ID NO: 1193845 - RNA, 20 nt, Human
ugcuuaagagcccaugcaag

SEQ ID NO: 1193846 - RNA, 31 nt, Human
uggcaacaauggcacgagcugccagcagaag

SEQ ID NO: 1193847 - RNA, 21 nt, Human
uggcacgagcugccagcagaa

SEQ ID NO: 1193848 - RNA, 20 nt, Human
uggcagcagcaaacuucagc

SEQ ID NO: 1193849 - RNA, 23 nt, Human
uggcuccaguggcagcagcaaac

SEQ ID NO: 1193850 - RNA, 19 nt, Human
uucucccagguccgcuuca

SEQ ID NO: 1193851 - RNA, 23 nt, Human
uuuuccuuuuauagauguacugu

SEQ ID NO: 1193852 - RNA, 22 nt, Human
acagccccuggagcgcuuggug

SEQ ID NO: 1193853 - RNA, 19 nt, Human
caacaaauaucuuuuucac

SEQ ID NO: 1193854 - RNA, 20 nt, Human
cccacagccccuggagcgcu

SEQ ID NO: 1193855 - RNA, 20 nt, Human
ccuggagcgcuugguguuug

SEQ ID NO: 1193856 - RNA, 19 nt, Human
cguggcugcauccaccucc

SEQ ID NO: 1193857 - RNA, 21 nt, Human
cguggcugcauccaccuccuc

SEQ ID NO: 1193858 - RNA, 26 nt, Human
cuccacaguggcguaugugacaaacc

SEQ ID NO: 1193859 - RNA, 20 nt, Human
uccaccuccuccacaguggc

SEQ ID NO: 1193860 - RNA, 30 nt, Human
ucuuugguuccacaacuuuuccauccaccu

SEQ ID NO: 1193861 - RNA, 22 nt, Human
ugacaaacccacagccccugga

SEQ ID NO: 1193862 - RNA, 22 nt, Human
ugagacaguucucuuugguucc

SEQ ID NO: 1193863 - RNA, 18 nt, Human
ugcauccaccuccuccac

SEQ ID NO: 1193864 - RNA, 19 nt, Human
uggagcgcuugguguuugg

SEQ ID NO: 1193865 - RNA, 25 nt, Human
uuuuccauccaccuuguguggccuu

SEQ ID NO: 1193866 - RNA, 26 nt, Human
aaaaaaaaaagacauuuauucagcgu

SEQ ID NO: 1193867 - RNA, 23 nt, Human
aacaacaugggugcaaggaaaaa

SEQ ID NO: 1193868 - RNA, 19 nt, Human
aacaucuucugccacugcc

SEQ ID NO: 1193869 - RNA, 21 nt, Human
aacaugggugcaaggaaaaaa

SEQ ID NO: 1193870 - RNA, 21 nt, Human
aacccuuuguugaaaugcuuu

SEQ ID NO: 1193871 - RNA, 22 nt, Human
aagaaccuggcaucacccugaa

SEQ ID NO: 1193872 - RNA, 25 nt, Human
aauacaguccucaaguuuuuugccc

SEQ ID NO: 1193873 - RNA, 21 nt, Human
acauuaaaaaaaaaaagacau

SEQ ID NO: 1193874 - RNA, 25 nt, Human
agcuucauucccaucuauaauuuua

SEQ ID NO: 1193875 - RNA, 24 nt, Human
aucuucugccacugccauagcuac

SEQ ID NO: 1193876 - RNA, 22 nt, Human
caacaacaugggugcaaggaaa

SEQ ID NO: 1193877 - RNA, 22 nt, Human
cacauuaaaaaaaaaaagacau

SEQ ID NO: 1193878 - RNA, 22 nt, Human
cagcacauuaaaaaaaaaaaga

SEQ ID NO: 1193879 - RNA, 18 nt, Human
ccaacaaagaaccuggca

SEQ ID NO: 1193880 - RNA, 19 nt, Human
ccauagcuacugcugcuac

SEQ ID NO: 1193881 - RNA, 18 nt, Human
ccccaaaguuuccucccu

SEQ ID NO: 1193882 - RNA, 30 nt, Human
ccuuuucuugccacugccucagucaugauu

SEQ ID NO: 1193883 - RNA, 21 nt, Human
cuuuccacagaacagaaacua

SEQ ID NO: 1193884 - RNA, 19 nt, Human
uacacaagcuucauuccca

SEQ ID NO: 1193885 - RNA, 20 nt, Human
ucucuggcucuccucuccug

SEQ ID NO: 1193886 - RNA, 22 nt, Human
ucucuuagcugauguuuuucag

SEQ ID NO: 1193887 - RNA, 21 nt, Human
ucugccacugccauagcuacu

SEQ ID NO: 1193888 - RNA, 20 nt, Human
ugcaaggaaaaaaaucuaca

SEQ ID NO: 1193889 - RNA, 23 nt, Human
ugccauagcuacugcugcuacug

SEQ ID NO: 1193890 - RNA, 19 nt, Human
ugccccaaaguuuccuccc

SEQ ID NO: 1193891 - RNA, 19 nt, Human
uggaaccaccauagccacu

SEQ ID NO: 1193892 - RNA, 23 nt, Human
uguaaacugcagcuucccuguca

SEQ ID NO: 1193893 - RNA, 18 nt, Human
uguuguaaacugcagcuu

SEQ ID NO: 1193894 - RNA, 20 nt, Human
uucagaguagacuaacuuua

SEQ ID NO: 1193895 - RNA, 21 nt, Human
uucaguguuuucuuuaaugcc

SEQ ID NO: 1193896 - RNA, 18 nt, Human
aaacaaaaugcagugauc

SEQ ID NO: 1193897 - RNA, 22 nt, Human
aaacaaaaugcagugaucaaaa

SEQ ID NO: 1193898 - RNA, 21 nt, Human
aaccuacagacacaaaauagg

SEQ ID NO: 1193899 - RNA, 22 nt, Human
aaggacuucuguuauucaauca

SEQ ID NO: 1193900 - RNA, 24 nt, Human
aaucgcuugaacccgggaggcaga

SEQ ID NO: 1193901 - RNA, 19 nt, Human
aauggguuacguuacaggg

SEQ ID NO: 1193902 - RNA, 21 nt, Human
acagacacaaaauagguuaac

SEQ ID NO: 1193903 - RNA, 21 nt, Human
acagagagaagcucugucuua

SEQ ID NO: 1193904 - RNA, 24 nt, Human
acagagagaagcucugucuuaaaa

SEQ ID NO: 1193905 - RNA, 24 nt, Human
accagcauggugaaaccccaccuc

SEQ ID NO: 1193906 - RNA, 18 nt, Human
agagguugcagugagcug

SEQ ID NO: 1193907 - RNA, 22 nt, Human
agagguugcagugagcugaaau

SEQ ID NO: 1193908 - RNA, 24 nt, Human
agagguugcagugagcugaaauug

SEQ ID NO: 1193909 - RNA, 19 nt, Human
agcaaagagagaggcagag

SEQ ID NO: 1193910 - RNA, 24 nt, Human
agcacuuugggaggccaagguggg

SEQ ID NO: 1193911 - RNA, 18 nt, Human
agcauggugaaaccccac

SEQ ID NO: 1193912 - RNA, 20 nt, Human
agcauggugaaaccccaccu

SEQ ID NO: 1193913 - RNA, 21 nt, Human
agcauggugaaaccccaccuc

SEQ ID NO: 1193914 - RNA, 21 nt, Human
agccacggccucggccucggc

SEQ ID NO: 1193915 - RNA, 24 nt, Human
agccugggcaacagagagaagcuc

SEQ ID NO: 1193916 - RNA, 20 nt, Human
aggcagagguugcagugagc

SEQ ID NO: 1193917 - RNA, 24 nt, Human
aggcaggagaaucgcuugaacccg

SEQ ID NO: 1193918 - RNA, 20 nt, Human
aggccaagguggguggauca

SEQ ID NO: 1193919 - RNA, 20 nt, Human
aggcugaggcaggagaaucg

SEQ ID NO: 1193920 - RNA, 24 nt, Human
aggcugaggcaggagaaucgcuug

SEQ ID NO: 1193921 - RNA, 23 nt, Human
agguauguaugaccuuguuuauu

SEQ ID NO: 1193922 - RNA, 24 nt, Human
agguggguggaucaugaagucagg

SEQ ID NO: 1193923 - RNA, 24 nt, Human
aguggcucacaucuguaaucucag

SEQ ID NO: 1193924 - RNA, 23 nt, Human
aguuccuggcauucgaacagcuc

SEQ ID NO: 1193925 - RNA, 25 nt, Human
aucuccuaucaaaggacuucuguua

SEQ ID NO: 1193926 - RNA, 23 nt, Human
auggugucugccuguaaucccag

SEQ ID NO: 1193927 - RNA, 24 nt, Human
auugcacuccagccugggcaacag

SEQ ID NO: 1193928 - RNA, 24 nt, Human
auugugccauugcacuccagccug

SEQ ID NO: 1193929 - RNA, 24 nt, Human
auuuuugucaaaguuuaaacacug

SEQ ID NO: 1193930 - RNA, 23 nt, Human
caaaaacugacauauguauaucg

SEQ ID NO: 1193931 - RNA, 18 nt, Human
caaaaugauucuugcuaa

SEQ ID NO: 1193932 - RNA, 24 nt, Human
caaggguuuuuccugcugcaauuc

SEQ ID NO: 1193933 - RNA, 22 nt, Human
caagguggguggaucaugaagu

SEQ ID NO: 1193934 - RNA, 24 nt, Human
caagguggguggaucaugaaguca

SEQ ID NO: 1193935 - RNA, 20 nt, Human
caaguuucaaacaaaaugca

SEQ ID NO: 1193936 - RNA, 22 nt, Human
cacaaaaugauucuugcuaaua

SEQ ID NO: 1193937 - RNA, 24 nt, Human
cacaucuguaaucucagcacuuug

SEQ ID NO: 1193938 - RNA, 23 nt, Human
caccucuacuaaaaauacaaaaa

SEQ ID NO: 1193939 - RNA, 24 nt, Human
cagcacuuugggaggccaaggugg

SEQ ID NO: 1193940 - RNA, 20 nt, Human
cagcauggugaaaccccacc

SEQ ID NO: 1193941 - RNA, 22 nt, Human
cagccugggcaacagagagaag

SEQ ID NO: 1193942 - RNA, 24 nt, Human
cagcuacucaggaggcugaggcag

SEQ ID NO: 1193943 - RNA, 21 nt, Human
caucuccuccucgguaggguc

SEQ ID NO: 1193944 - RNA, 23 nt, Human
caucuguaaucucagcacuuugg

SEQ ID NO: 1193945 - RNA, 24 nt, Human
caucuguaaucucagcacuuuggg

SEQ ID NO: 1193946 - RNA, 18 nt, Human
cauggugaaaccccaccu

SEQ ID NO: 1193947 - RNA, 19 nt, Human
cauggugaaaccccaccuc

SEQ ID NO: 1193948 - RNA, 21 nt, Human
cauggugaaaccccaccucua

SEQ ID NO: 1193949 - RNA, 18 nt, Human
cauugcacuccagccugg

SEQ ID NO: 1193950 - RNA, 19 nt, Human
cauugcacuccagccuggg

SEQ ID NO: 1193951 - RNA, 21 nt, Human
cauugcacuccagccugggca

SEQ ID NO: 1193952 - RNA, 24 nt, Human
cauugcacuccagccugggcaaca

SEQ ID NO: 1193953 - RNA, 27 nt, Human
ccacggccucggccucggccacuaggc

SEQ ID NO: 1193954 - RNA, 22 nt, Human
ccacuaggcccucguccuccuc

SEQ ID NO: 1193955 - RNA, 20 nt, Human
ccauugcacuccagccuggg

SEQ ID NO: 1193956 - RNA, 21 nt, Human
ccauugcacuccagccugggc

SEQ ID NO: 1193957 - RNA, 23 nt, Human
ccauugcacuccagccugggcaa

SEQ ID NO: 1193958 - RNA, 24 nt, Human
ccauugcacuccagccugggcaac

SEQ ID NO: 1193959 - RNA, 19 nt, Human
cccagugucuauuauuccc

SEQ ID NO: 1193960 - RNA, 18 nt, Human
ccccacccuaccucccca

SEQ ID NO: 1193961 - RNA, 18 nt, Human
cccuaccuccccaguguc

SEQ ID NO: 1193962 - RNA, 27 nt, Human
ccuccgagcggccaucgcggaaagcuc

SEQ ID NO: 1193963 - RNA, 22 nt, Human
ccugaccagcauggugaaaccc

SEQ ID NO: 1193964 - RNA, 24 nt, Human
ccugaccagcauggugaaacccca

SEQ ID NO: 1193965 - RNA, 21 nt, Human
ccuguaaucccagcuacucag

SEQ ID NO: 1193966 - RNA, 22 nt, Human
cgcuccccacccuaccucccca

SEQ ID NO: 1193967 - RNA, 24 nt, Human
cggccacuaggcccucguccuccu

SEQ ID NO: 1193968 - RNA, 26 nt, Human
cggccucggccucggccacuaggccc

SEQ ID NO: 1193969 - RNA, 24 nt, Human
cgggaggcagagguugcagugagc

SEQ ID NO: 1193970 - RNA, 24 nt, Human
cucacaucuguaaucucagcacuu

SEQ ID NO: 1193971 - RNA, 21 nt, Human
cucagcaaagagagaggcaga

SEQ ID NO: 1193972 - RNA, 20 nt, Human
cuccccacccuaccucccca

SEQ ID NO: 1193973 - RNA, 22 nt, Human
cucuccguuucugccaucuccu

SEQ ID NO: 1193974 - RNA, 21 nt, Human
gaaaauucauuuuaggcagga

SEQ ID NO: 1193975 - RNA, 23 nt, Human
gaaauugugccauugcacuccag

SEQ ID NO: 1193976 - RNA, 21 nt, Human
gaauuugguuuuuuuuuuuuc

SEQ ID NO: 1193977 - RNA, 23 nt, Human
gacgcaguggcucacaucuguaa

SEQ ID NO: 1193978 - RNA, 23 nt, Human
gagaaucgcuugaacccgggagg

SEQ ID NO: 1193979 - RNA, 18 nt, Human
gauacuaaauguggcagg

SEQ ID NO: 1193980 - RNA, 22 nt, Human
gaucauaguuaauaccaauuua

SEQ ID NO: 1193981 - RNA, 24 nt, Human
gaucaugaagucaggaguuggaga

SEQ ID NO: 1193982 - RNA, 24 nt, Human
gauggugucugccuguaaucccag

SEQ ID NO: 1193983 - RNA, 22 nt, Human
gauuuggggguggggauacuaa

SEQ ID NO: 1193984 - RNA, 20 nt, Human
gcacuuugggaggccaaggu

SEQ ID NO: 1193985 - RNA, 19 nt, Human
gccaagguggguggaucau

SEQ ID NO: 1193986 - RNA, 22 nt, Human
gccauugcacuccagccugggc

SEQ ID NO: 1193987 - RNA, 24 nt, Human
gccauugcacuccagccugggcaa

SEQ ID NO: 1193988 - RNA, 20 nt, Human
gcggguccugcggaaguccu

SEQ ID NO: 1193989 - RNA, 21 nt, Human
ggaaguccuccgagcggccau

SEQ ID NO: 1193990 - RNA, 24 nt, Human
ggagaccauccugaccagcauggu

SEQ ID NO: 1193991 - RNA, 23 nt, Human
ggcgugauggugucugccuguaa

SEQ ID NO: 1193992 - RNA, 20 nt, Human
gggaacacaugggcagguuu

SEQ ID NO: 1193993 - RNA, 24 nt, Human
ggguggaucaugaagucaggaguu

SEQ ID NO: 1193994 - RNA, 21 nt, Human
gguggaucaugaagucaggag

SEQ ID NO: 1193995 - RNA, 19 nt, Human
gucacagaaaaauacugua

SEQ ID NO: 1193996 - RNA, 21 nt, Human
guggggauacuaaauguggca

SEQ ID NO: 1193997 - RNA, 24 nt, Human
guugcagugagcugaaauugugcc

SEQ ID NO: 1193998 - RNA, 22 nt, Human
uaauaguacaaauuuuguccca

SEQ ID NO: 1193999 - RNA, 19 nt, Human
uacaugaaacuacugaaag

SEQ ID NO: 1194000 - RNA, 24 nt, Human
ucaaacaaaaugcagugaucaaaa

SEQ ID NO: 1194001 - RNA, 22 nt, Human
ucaaaggacuucuguuauucaa

SEQ ID NO: 1194002 - RNA, 24 nt, Human
ucaugaagucaggaguuggagacc

SEQ ID NO: 1194003 - RNA, 19 nt, Human
ucaugcuuauagguuacuc

SEQ ID NO: 1194004 - RNA, 21 nt, Human
uccaaggguguaauucguuca

SEQ ID NO: 1194005 - RNA, 21 nt, Human
uccccagugucuauuauuccc

SEQ ID NO: 1194006 - RNA, 18 nt, Human
ucgcuugaacccgggagg

SEQ ID NO: 1194007 - RNA, 19 nt, Human
ucucccgcuccccacccua

SEQ ID NO: 1194008 - RNA, 19 nt, Human
ugaaaccccaccucuacua

SEQ ID NO: 1194009 - RNA, 26 nt, Human
ugaaccccaaaucaucaggacccguc

SEQ ID NO: 1194010 - RNA, 18 nt, Human
ugaauaauagccucugcg

SEQ ID NO: 1194011 - RNA, 18 nt, Human
ugaccagcauggugaaac

SEQ ID NO: 1194012 - RNA, 23 nt, Human
ugagcagaguccccaguagguag

SEQ ID NO: 1194013 - RNA, 20 nt, Human
ugaggcaggagaaucgcuug

SEQ ID NO: 1194014 - RNA, 24 nt, Human
ugaggcaggagaaucgcuugaacc

SEQ ID NO: 1194015 - RNA, 25 nt, Human
ugaggcaggagaaucgcuugaaccc

SEQ ID NO: 1194016 - RNA, 24 nt, Human
ugauggugucugccuguaauccca

SEQ ID NO: 1194017 - RNA, 22 nt, Human
ugcacuccagccugggcaacag

SEQ ID NO: 1194018 - RNA, 24 nt, Human
ugccauugcacuccagccugggca

SEQ ID NO: 1194019 - RNA, 24 nt, Human
ugccuguaaucccagcuacucagg

SEQ ID NO: 1194020 - RNA, 18 nt, Human
uggcaucagguuauaaag

SEQ ID NO: 1194021 - RNA, 21 nt, Human
uggcucacaucuguaaucuca

SEQ ID NO: 1194022 - RNA, 24 nt, Human
uggcucacaucuguaaucucagca

SEQ ID NO: 1194023 - RNA, 23 nt, Human
ugggaggccaagguggguggauc

SEQ ID NO: 1194024 - RNA, 24 nt, Human
ugggaggccaagguggguggauca

SEQ ID NO: 1194025 - RNA, 24 nt, Human
uggugucugccuguaaucccagcu

SEQ ID NO: 1194026 - RNA, 21 nt, Human
ugucaaaguuuaaacacugga

SEQ ID NO: 1194027 - RNA, 23 nt, Human
uguuugauguugagguuuggggu

SEQ ID NO: 1194028 - RNA, 19 nt, Human
uuagcugggcgugauggug

SEQ ID NO: 1194029 - RNA, 20 nt, Human
uuagcugggcgugauggugu

SEQ ID NO: 1194030 - RNA, 24 nt, Human
uuaggcaggacgcaguggcucaca

SEQ ID NO: 1194031 - RNA, 22 nt, Human
uugcagugagcugaaauugugc

SEQ ID NO: 1194032 - RNA, 23 nt, Human
uugugccauugcacuccagccug

SEQ ID NO: 1194033 - RNA, 18 nt, Human
uuucaaacaaaaugcagu

SEQ ID NO: 1194034 - RNA, 21 nt, Human
uuucuucaugaaguuugucau

SEQ ID NO: 1194035 - RNA, 18 nt, Human
uuugauucagggaacaca

SEQ ID NO: 1194036 - RNA, 21 nt, Human
uuuggggguggggauacuaaa

SEQ ID NO: 1194037 - RNA, 24 nt, Human
uuugguuuuuuuuuuuucguauca

SEQ ID NO: 1194038 - RNA, 22 nt, Human
uuuugauucagggaacacaugg

SEQ ID NO: 1194039 - RNA, 18 nt, Human
uuuuucuuuuuuaaaaaa

SEQ ID NO: 1194040 - RNA, 20 nt, Human
uuuuucuuuuuuaaaaaaau

SEQ ID NO: 1194041 - RNA, 24 nt, Human
acccugaaauuccuccucggucac

SEQ ID NO: 1194042 - RNA, 19 nt, Human
agaacuucccaagccagca

SEQ ID NO: 1194043 - RNA, 20 nt, Human
agaacuucccaagccagcau

SEQ ID NO: 1194044 - RNA, 18 nt, Human
cacaccuucagaccaguc

SEQ ID NO: 1194045 - RNA, 26 nt, Human
cagagggcaccugcacaccuucagac

SEQ ID NO: 1194046 - RNA, 22 nt, Human
cagcagcagccuacucuucuuu

SEQ ID NO: 1194047 - RNA, 18 nt, Human
ccuccucggucacugccu

SEQ ID NO: 1194048 - RNA, 19 nt, Human
ccuccucggucacugccuu

SEQ ID NO: 1194049 - RNA, 21 nt, Human
cgggaaauggugccaugcaug

SEQ ID NO: 1194050 - RNA, 20 nt, Human
cuggagcaguccauucaccc

SEQ ID NO: 1194051 - RNA, 22 nt, Human
cuggagcaguccauucacccug

SEQ ID NO: 1194052 - RNA, 24 nt, Human
gaaauuccuccucggucacugccu

SEQ ID NO: 1194053 - RNA, 20 nt, Human
gaacucaggagcuggagcag

SEQ ID NO: 1194054 - RNA, 18 nt, Human
gaaguagagaucaggcau

SEQ ID NO: 1194055 - RNA, 23 nt, Human
ucaggccgaguagcagugaacuc

SEQ ID NO: 1194056 - RNA, 24 nt, Human
ucaggccgaguagcagugaacuca

SEQ ID NO: 1194057 - RNA, 20 nt, Human
ucccaagccagcauccacca

SEQ ID NO: 1194058 - RNA, 23 nt, Human
ucccuuuaaguuaugacgggaau

SEQ ID NO: 1194059 - RNA, 24 nt, Human
ucucuccaggaucucuguagaagu

SEQ ID NO: 1194060 - RNA, 25 nt, Human
ucugcaaccucaggccgaguagcag

SEQ ID NO: 1194061 - RNA, 21 nt, Human
ugaacucaggagcuggagcag

SEQ ID NO: 1194062 - RNA, 19 nt, Human
ugcgcagaacuucccaagc

SEQ ID NO: 1194063 - RNA, 21 nt, Human
uuccuccucggucacugccuu

SEQ ID NO: 1194064 - RNA, 23 nt, Human
uuccuccucggucacugccuuuu

SEQ ID NO: 1194065 - RNA, 22 nt, Human
uuuucaaucucuccaggaucuc

SEQ ID NO: 1194066 - RNA, 24 nt, Human
aaaauuuuguauuuuuaguagaga

SEQ ID NO: 1194067 - RNA, 19 nt, Human
aaagugcugggauuacagg

SEQ ID NO: 1194068 - RNA, 21 nt, Human
aaagugcugggauuacaggca

SEQ ID NO: 1194069 - RNA, 22 nt, Human
aaagugcugggauuacaggcag

SEQ ID NO: 1194070 - RNA, 20 nt, Human
aaccuccgccucccugguuc

SEQ ID NO: 1194071 - RNA, 19 nt, Human
aaguagcugggauuacagg

SEQ ID NO: 1194072 - RNA, 18 nt, Human
aagugcugggauuacagg

SEQ ID NO: 1194073 - RNA, 19 nt, Human
aagugcugggauuacaggc

SEQ ID NO: 1194074 - RNA, 23 nt, Human
aagugcugggauuacaggcagcc

SEQ ID NO: 1194075 - RNA, 24 nt, Human
aauuuuguauuuuuaguagagaca

SEQ ID NO: 1194076 - RNA, 18 nt, Human
acagcccccuuuuuuuuu

SEQ ID NO: 1194077 - RNA, 24 nt, Human
acaggguacaauaauggaccacaa

SEQ ID NO: 1194078 - RNA, 18 nt, Human
acaggguuucgccauguu

SEQ ID NO: 1194079 - RNA, 23 nt, Human
acaggguuucgccauguuggcca

SEQ ID NO: 1194080 - RNA, 24 nt, Human
acaggguuucgccauguuggccag

SEQ ID NO: 1194081 - RNA, 19 nt, Human
acccaggcuggagugcagu

SEQ ID NO: 1194082 - RNA, 23 nt, Human
accucagcuucccaaagugcugg

SEQ ID NO: 1194083 - RNA, 25 nt, Human
acugcaauuguauucagacucaauc

SEQ ID NO: 1194084 - RNA, 18 nt, Human
agacaggguuucgccaug

SEQ ID NO: 1194085 - RNA, 18 nt, Human
agacaggguuucgccaug

SEQ ID NO: 1194086 - RNA, 25 nt, Human
aggcuggagugcaguggcaaaaucu

SEQ ID NO: 1194087 - RNA, 22 nt, Human
aguagagacaggguuucgccau

SEQ ID NO: 1194088 - RNA, 19 nt, Human
agugaucuacccaccucag

SEQ ID NO: 1194089 - RNA, 24 nt, Human
agugcaguggcaaaaucuuggcuc

SEQ ID NO: 1194090 - RNA, 18 nt, Human
agugcugggauuacaggc

SEQ ID NO: 1194091 - RNA, 18 nt, Human
auugagugcauaugcccc

SEQ ID NO: 1194092 - RNA, 21 nt, Human
caaaguagcugggauuacagg

SEQ ID NO: 1194093 - RNA, 27 nt, Human
caaagugcugggauuacaggcagcccu

SEQ ID NO: 1194094 - RNA, 19 nt, Human
caagugaucuacccaccuc

SEQ ID NO: 1194095 - RNA, 27 nt, Human
cagcccccuuuuuuuuuuuuugugaga

SEQ ID NO: 1194096 - RNA, 24 nt, Human
caggguuucgccauguuggccagg

SEQ ID NO: 1194097 - RNA, 21 nt, Human
caggugcccaccauaacaccc

SEQ ID NO: 1194098 - RNA, 24 nt, Human
cauguuggccaggcuggucucgaa

SEQ ID NO: 1194099 - RNA, 19 nt, Human
ccaaagugcugggauuaca

SEQ ID NO: 1194100 - RNA, 23 nt, Human
ccaaagugcugggauuacaggca

SEQ ID NO: 1194101 - RNA, 19 nt, Human
ccauguuggccaggcuggu

SEQ ID NO: 1194102 - RNA, 22 nt, Human
ccauguuggccaggcuggucuc

SEQ ID NO: 1194103 - RNA, 23 nt, Human
ccauguuggccaggcuggucucg

SEQ ID NO: 1194104 - RNA, 24 nt, Human
cccaaagugcugggauuacaggca

SEQ ID NO: 1194105 - RNA, 23 nt, Human
cccuuuuuuuuuuuuugugagac

SEQ ID NO: 1194106 - RNA, 24 nt, Human
ccugaccucaagugaucuacccac

SEQ ID NO: 1194107 - RNA, 27 nt, Human
cgccauguuggccaggcuggucucgaa

SEQ ID NO: 1194108 - RNA, 24 nt, Human
cucaagugaucuacccaccucagc

SEQ ID NO: 1194109 - RNA, 24 nt, Human
cugcaaccuccgccucccugguuc

SEQ ID NO: 1194110 - RNA, 21 nt, Human
cugcaauuguauucagacuca

SEQ ID NO: 1194111 - RNA, 19 nt, Human
cugucacccaggcuggagu

SEQ ID NO: 1194112 - RNA, 21 nt, Human
cuugcucugucacccaggcug

SEQ ID NO: 1194113 - RNA, 24 nt, Human
cuugcucugucacccaggcuggag

SEQ ID NO: 1194114 - RNA, 24 nt, Human
gaccucaagugaucuacccaccuc

SEQ ID NO: 1194115 - RNA, 22 nt, Human
gcaaccuccgccucccugguuc

SEQ ID NO: 1194116 - RNA, 25 nt, Human
gcucugucacccaggcuggagugca

SEQ ID NO: 1194117 - RNA, 23 nt, Human
gcugcauucaagcggcuuuaacu

SEQ ID NO: 1194118 - RNA, 23 nt, Human
gcuggucucgaacuccugaccuc

SEQ ID NO: 1194119 - RNA, 24 nt, Human
ggcuggucucgaacuccugaccuc

SEQ ID NO: 1194120 - RNA, 22 nt, Human
ggguuucgccauguuggccagg

SEQ ID NO: 1194121 - RNA, 19 nt, Human
ggucucgaacuccugaccu

SEQ ID NO: 1194122 - RNA, 18 nt, Human
guagcugggauuacaggu

SEQ ID NO: 1194123 - RNA, 24 nt, Human
gucuugcucugucacccaggcugg

SEQ ID NO: 1194124 - RNA, 24 nt, Human
gugaucuacccaccucagcuuccc

SEQ ID NO: 1194125 - RNA, 24 nt, Human
uaaaauuuuguauuuuuaguagag

SEQ ID NO: 1194126 - RNA, 19 nt, Human
uaaaguagaccaucagagc

SEQ ID NO: 1194127 - RNA, 20 nt, Human
uaauggaccacaaacugugg

SEQ ID NO: 1194128 - RNA, 22 nt, Human
uacagcccccuuuuuuuuuuuu

SEQ ID NO: 1194129 - RNA, 23 nt, Human
uacccaccucagcuucccaaagu

SEQ ID NO: 1194130 - RNA, 22 nt, Human
uagagacaggguuucgccaugu

SEQ ID NO: 1194131 - RNA, 24 nt, Human
uaguagagacaggguuucgccaug

SEQ ID NO: 1194132 - RNA, 22 nt, Human
uauucuaggccuacccugauug

SEQ ID NO: 1194133 - RNA, 19 nt, Human
ucaaaguagcugggauuac

SEQ ID NO: 1194134 - RNA, 22 nt, Human
ucaaaguagcugggauuacagg

SEQ ID NO: 1194135 - RNA, 24 nt, Human
ucaaaguagcugggauuacaggug

SEQ ID NO: 1194136 - RNA, 24 nt, Human
ucacccaggcuggagugcaguggc

SEQ ID NO: 1194137 - RNA, 19 nt, Human
ucacugcaaccuccgccuc

SEQ ID NO: 1194138 - RNA, 24 nt, Human
ucacugcaaccuccgccucccugg

SEQ ID NO: 1194139 - RNA, 24 nt, Human
ucacugcaaccuccgccucccugg

SEQ ID NO: 1194140 - RNA, 25 nt, Human
ucacugcaaccuccgccucccuggu

SEQ ID NO: 1194141 - RNA, 28 nt, Human
ucacugcaaccuccgccucccugguuca

SEQ ID NO: 1194142 - RNA, 24 nt, Human
ucacugcagcuuaguuugcugccu

SEQ ID NO: 1194143 - RNA, 24 nt, Human
ucccaaagugcugggauuacaggc

SEQ ID NO: 1194144 - RNA, 19 nt, Human
ucccugguucaagugaguc

SEQ ID NO: 1194145 - RNA, 21 nt, Human
ucccugguucaagugagucug

SEQ ID NO: 1194146 - RNA, 22 nt, Human
ucgccauguuggccaggcuggu

SEQ ID NO: 1194147 - RNA, 24 nt, Human
ucgccauguuggccaggcuggucu

SEQ ID NO: 1194148 - RNA, 21 nt, Human
ucuacccaccucagcuuccca

SEQ ID NO: 1194149 - RNA, 21 nt, Human
ucucgaacuccugaccucaag

SEQ ID NO: 1194150 - RNA, 24 nt, Human
ucugucacccaggcuggagugcag

SEQ ID NO: 1194151 - RNA, 23 nt, Human
ucuugcucugucacccaggcugg

SEQ ID NO: 1194152 - RNA, 24 nt, Human
ucuugcucugucacccaggcugga

SEQ ID NO: 1194153 - RNA, 20 nt, Human
ugaccucaagugaucuaccc

SEQ ID NO: 1194154 - RNA, 18 nt, Human
ugagacagagucuugcuc

SEQ ID NO: 1194155 - RNA, 22 nt, Human
ugagacagagucuugcucuguc

SEQ ID NO: 1194156 - RNA, 23 nt, Human
ugaucuacccaccucagcuuccc

SEQ ID NO: 1194157 - RNA, 22 nt, Human
ugcaguggcaaaaucuuggcuc

SEQ ID NO: 1194158 - RNA, 24 nt, Human
ugcucugucacccaggcuggagug

SEQ ID NO: 1194159 - RNA, 23 nt, Human
ugcugggauuacaggcagcccua

SEQ ID NO: 1194160 - RNA, 18 nt, Human
uggagugcaguggcaaaa

SEQ ID NO: 1194161 - RNA, 23 nt, Human
uggagugcaguggcaaaaucuug

SEQ ID NO: 1194162 - RNA, 24 nt, Human
uggagugcaguggcaaaaucuugg

SEQ ID NO: 1194163 - RNA, 24 nt, Human
uggccaggcuggucucgaacuccu

SEQ ID NO: 1194164 - RNA, 19 nt, Human
ugggauuacaggcagcccu

SEQ ID NO: 1194165 - RNA, 21 nt, Human
ugggauuacaggugcccacca

SEQ ID NO: 1194166 - RNA, 22 nt, Human
ugggauuacaggugcccaccau

SEQ ID NO: 1194167 - RNA, 21 nt, Human
uguacagcccccuuuuuuuuu

SEQ ID NO: 1194168 - RNA, 21 nt, Human
uuacugcaauuguauucagac

SEQ ID NO: 1194169 - RNA, 24 nt, Human
uuaguagagacaggguuucgccau

SEQ ID NO: 1194170 - RNA, 24 nt, Human
uucaaaguagcugggauuacaggu

SEQ ID NO: 1194171 - RNA, 24 nt, Human
uuucgccauguuggccaggcuggu

SEQ ID NO: 1194172 - RNA, 20 nt, Human
uuuuguauuuuuaguagaga

SEQ ID NO: 1194173 - RNA, 22 nt, Human
uuuuuaguagagacaggguuuc

SEQ ID NO: 1194174 - RNA, 23 nt, Human
uuuuuaguagagacaggguuucg

SEQ ID NO: 1194175 - RNA, 18 nt, Human
uuuuuauguaguguauau

SEQ ID NO: 1194176 - RNA, 22 nt, Human
uuuuuugugagacagagucuug

SEQ ID NO: 1194177 - RNA, 26 nt, Human
uuuuuuuuuuuugugagacagagucu

SEQ ID NO: 1194178 - RNA, 24 nt, Human
acccugaaauuccuccuuggucac

SEQ ID NO: 1194179 - RNA, 19 nt, Human
agaacuucccgagccagca

SEQ ID NO: 1194180 - RNA, 20 nt, Human
agaacuucccgagccagcau

SEQ ID NO: 1194181 - RNA, 27 nt, Human
auccagaacaacgccauauggaccccu

SEQ ID NO: 1194182 - RNA, 26 nt, Human
cagagggcaccuguacaccuucagac

SEQ ID NO: 1194183 - RNA, 22 nt, Human
cagcagcagccugcucuucuuu

SEQ ID NO: 1194184 - RNA, 23 nt, Human
cagcagcagccugcucuucuuuu

SEQ ID NO: 1194185 - RNA, 20 nt, Human
caggagcaggagcaguccau

SEQ ID NO: 1194186 - RNA, 18 nt, Human
ccuccuuggucacugccu

SEQ ID NO: 1194187 - RNA, 22 nt, Human
cgaugggaauccagaacaacgc

SEQ ID NO: 1194188 - RNA, 21 nt, Human
cugagcagugggagcugcaga

SEQ ID NO: 1194189 - RNA, 24 nt, Human
gaaauuccuccuuggucacugccu

SEQ ID NO: 1194190 - RNA, 20 nt, Human
gaacucaggagcaggagcag

SEQ ID NO: 1194191 - RNA, 18 nt, Human
gaaguagagaucaggcau

SEQ ID NO: 1194192 - RNA, 25 nt, Human
uacaccuucagacaagucugcaacc

SEQ ID NO: 1194193 - RNA, 20 nt, Human
ucccgagccagcauccacca

SEQ ID NO: 1194194 - RNA, 23 nt, Human
ucccuuuaaguuacgaugggaau

SEQ ID NO: 1194195 - RNA, 24 nt, Human
ucucuucaggaucucuguagaagu

SEQ ID NO: 1194196 - RNA, 25 nt, Human
ucugcaaccucaggcugaguggcag

SEQ ID NO: 1194197 - RNA, 24 nt, Human
ugaauaggcacagagggcaccugu

SEQ ID NO: 1194198 - RNA, 25 nt, Human
ugaauaggcacagagggcaccugua

SEQ ID NO: 1194199 - RNA, 20 nt, Human
ugagcagugggagcugcaga

SEQ ID NO: 1194200 - RNA, 24 nt, Human
ugagcagugggagcugcagaccag

SEQ ID NO: 1194201 - RNA, 20 nt, Human
uggcaggcugagugcuccag

SEQ ID NO: 1194202 - RNA, 19 nt, Human
ugggagcugcagaccaguu

SEQ ID NO: 1194203 - RNA, 20 nt, Human
ugggagcugcagaccaguuu

SEQ ID NO: 1194204 - RNA, 18 nt, Human
uggugccacgcaugcgca

SEQ ID NO: 1194205 - RNA, 24 nt, Human
uuccuccuuggucacugccuuuuc

SEQ ID NO: 1194206 - RNA, 19 nt, Human
aaaauacccauuccaaaug

SEQ ID NO: 1194207 - RNA, 20 nt, Human
aaacuauggcacaucucuac

SEQ ID NO: 1194208 - RNA, 23 nt, Human
aaaugccagaugcuuauaaaacc

SEQ ID NO: 1194209 - RNA, 22 nt, Human
aacagguuuguauaugauacag

SEQ ID NO: 1194210 - RNA, 33 nt, Human
acacacacacacauacaaauuaguguauguagu

SEQ ID NO: 1194211 - RNA, 27 nt, Human
acacacacacauacaaauuaguguagu

SEQ ID NO: 1194212 - RNA, 33 nt, Human
acacauaaacgugcacgcacacacacacacagu

SEQ ID NO: 1194213 - RNA, 20 nt, Human
acaggguggcaggagagaga

SEQ ID NO: 1194214 - RNA, 18 nt, Human
acauuaacccagaagucc

SEQ ID NO: 1194215 - RNA, 23 nt, Human
acgcacacacacacacacauaca

SEQ ID NO: 1194216 - RNA, 29 nt, Human
acgcacacacacacacacauacaaauuag

SEQ ID NO: 1194217 - RNA, 24 nt, Human
acgcauuugucaauacacaugaau

SEQ ID NO: 1194218 - RNA, 21 nt, Human
acucugugggggagcuccaac

SEQ ID NO: 1194219 - RNA, 20 nt, Human
acugaaagaaaccccagugg

SEQ ID NO: 1194220 - RNA, 20 nt, Human
acugauauacacaacaguuu

SEQ ID NO: 1194221 - RNA, 19 nt, Human
agaaagaacacaaauguug

SEQ ID NO: 1194222 - RNA, 22 nt, Human
agaaguccaaguccaaagucuc

SEQ ID NO: 1194223 - RNA, 18 nt, Human
agcuauugguggaucuac

SEQ ID NO: 1194224 - RNA, 21 nt, Human
aggaaaaaaaaauuguuucag

SEQ ID NO: 1194225 - RNA, 21 nt, Human
aguugauaccacuagaggaac

SEQ ID NO: 1194226 - RNA, 21 nt, Human
auaaagaaauacccaagacua

SEQ ID NO: 1194227 - RNA, 23 nt, Human
auucaaggagagauuuggguggg

SEQ ID NO: 1194228 - RNA, 23 nt, Human
caaaaccaaaccauaucauucug

SEQ ID NO: 1194229 - RNA, 19 nt, Human
caaauauacacauguggua

SEQ ID NO: 1194230 - RNA, 21 nt, Human
caaccccacauuucccuucug

SEQ ID NO: 1194231 - RNA, 23 nt, Human
caagaaauauagaaauauuaaac

SEQ ID NO: 1194232 - RNA, 20 nt, Human
caaguccaaagucucaucug

SEQ ID NO: 1194233 - RNA, 24 nt, Human
caagucccuuccaccuauaagccu

SEQ ID NO: 1194234 - RNA, 26 nt, Human
cacaaaaccaaaccauaucauucuga

SEQ ID NO: 1194235 - RNA, 19 nt, Human
cacacacacacacacauac

SEQ ID NO: 1194236 - RNA, 31 nt, Human
cacacacacacacauacaaauuaguguaugg

SEQ ID NO: 1194237 - RNA, 26 nt, Human
cacacacacauacaaauuaguguaug

SEQ ID NO: 1194238 - RNA, 25 nt, Human
caggaugcagccacccucacagcuc

SEQ ID NO: 1194239 - RNA, 22 nt, Human
caucugagacaaagcaaguccc

SEQ ID NO: 1194240 - RNA, 23 nt, Human
cauucugacccuaguuccuccca

SEQ ID NO: 1194241 - RNA, 25 nt, Human
cauucugacccuaguuccucccaaa

SEQ ID NO: 1194242 - RNA, 26 nt, Human
cauuucucccccaagaaauauagaaa

SEQ ID NO: 1194243 - RNA, 24 nt, Human
ccaaaacaaaggggcuauaggccc

SEQ ID NO: 1194244 - RNA, 22 nt, Human
ccaaaccauaucauucugaccc

SEQ ID NO: 1194245 - RNA, 22 nt, Human
ccaagauacaauggggguacag

SEQ ID NO: 1194246 - RNA, 24 nt, Human
ccacauuucccuucugcacugccc

SEQ ID NO: 1194247 - RNA, 18 nt, Human
ccaccuggucccaccccu

SEQ ID NO: 1194248 - RNA, 18 nt, Human
ccaguggacccacuugag

SEQ ID NO: 1194249 - RNA, 19 nt, Human
ccaguggcuuuuccaggug

SEQ ID NO: 1194250 - RNA, 24 nt, Human
cccaaaaguagaaagaacacaaau

SEQ ID NO: 1194251 - RNA, 18 nt, Human
cccacagccuugggcagc

SEQ ID NO: 1194252 - RNA, 18 nt, Human
ccccaugauucaguccuc

SEQ ID NO: 1194253 - RNA, 20 nt, Human
cgcacacacacacacacaua

SEQ ID NO: 1194254 - RNA, 21 nt, Human
cuauaagccuguaaaaucuaa

SEQ ID NO: 1194255 - RNA, 18 nt, Human
cuauggcacaucucuacc

SEQ ID NO: 1194256 - RNA, 18 nt, Human
cuucucagagcuccacua

SEQ ID NO: 1194257 - RNA, 22 nt, Human
cuugaucauuguagugguuacc

SEQ ID NO: 1194258 - RNA, 19 nt, Human
gaaacugaaagaaacccca

SEQ ID NO: 1194259 - RNA, 18 nt, Human
gagaagucugaguaaugu

SEQ ID NO: 1194260 - RNA, 28 nt, Human
gagaauagcaugagggaaaccgguaccc

SEQ ID NO: 1194261 - RNA, 22 nt, Human
gauauacacaacaguuuggaug

SEQ ID NO: 1194262 - RNA, 25 nt, Human
gcacacacacacacacauacaaauu

SEQ ID NO: 1194263 - RNA, 23 nt, Human
gcauagaccuacacacauaaacg

SEQ ID NO: 1194264 - RNA, 25 nt, Human
gccacccucacagcucuuuucaugg

SEQ ID NO: 1194265 - RNA, 21 nt, Human
gggaacaguugaaauauuggc

SEQ ID NO: 1194266 - RNA, 18 nt, Human
guggaucuaccauucugg

SEQ ID NO: 1194267 - RNA, 31 nt, Human
uaaacgugcacgcacacacacacacacauag

SEQ ID NO: 1194268 - RNA, 22 nt, Human
uaaacucuacuuccugauaugc

SEQ ID NO: 1194269 - RNA, 19 nt, Human
uaaagaaauacccaagacu

SEQ ID NO: 1194270 - RNA, 18 nt, Human
uaaaucacuaucaugaga

SEQ ID NO: 1194271 - RNA, 18 nt, Human
uaacagguuuguauauga

SEQ ID NO: 1194272 - RNA, 20 nt, Human
uaacagguuuguauaugaua

SEQ ID NO: 1194273 - RNA, 22 nt, Human
uaacccagaaguccaaguccaa

SEQ ID NO: 1194274 - RNA, 23 nt, Human
uaauagcccaaaaguagaaagaa

SEQ ID NO: 1194275 - RNA, 23 nt, Human
uacacacauaaacgugcacgcac

SEQ ID NO: 1194276 - RNA, 19 nt, Human
uacacaugaauugauauac

SEQ ID NO: 1194277 - RNA, 22 nt, Human
uaccauggaauacuacacagaa

SEQ ID NO: 1194278 - RNA, 25 nt, Human
uagaaagaacacaaauguuguucaa

SEQ ID NO: 1194279 - RNA, 20 nt, Human
uagcaacuuuauuuguaaua

SEQ ID NO: 1194280 - RNA, 21 nt, Human
uagcagagguucucccugaga

SEQ ID NO: 1194281 - RNA, 23 nt, Human
uagcccaaaaguagaaagaacac

SEQ ID NO: 1194282 - RNA, 25 nt, Human
uagcccaaaaguagaaagaacacaa

SEQ ID NO: 1194283 - RNA, 24 nt, Human
uauagaaauauuaaacucuacuuc

SEQ ID NO: 1194284 - RNA, 18 nt, Human
uauagcacuucccuauac

SEQ ID NO: 1194285 - RNA, 18 nt, Human
uauaugauacugcaguua

SEQ ID NO: 1194286 - RNA, 21 nt, Human
uaucaugagaauagcaugagg

SEQ ID NO: 1194287 - RNA, 18 nt, Human
uauccaggucacaaugau

SEQ ID NO: 1194288 - RNA, 20 nt, Human
uaugaagauaagguauaggg

SEQ ID NO: 1194289 - RNA, 21 nt, Human
uccgcauggcuucggaggccu

SEQ ID NO: 1194290 - RNA, 23 nt, Human
ucucauguucucacauuucaaaa

SEQ ID NO: 1194291 - RNA, 21 nt, Human
ucuuccccuguggcuuugcag

SEQ ID NO: 1194292 - RNA, 22 nt, Human
ugaaagaaaccccaguggaccc

SEQ ID NO: 1194293 - RNA, 25 nt, Human
ugaaaggaguuucuguuacauggug

SEQ ID NO: 1194294 - RNA, 21 nt, Human
ugagacaaagcaagucccuuc

SEQ ID NO: 1194295 - RNA, 24 nt, Human
ugauauacacaacaguuuggaugc

SEQ ID NO: 1194296 - RNA, 22 nt, Human
ugauucaguccuccaccugguc

SEQ ID NO: 1194297 - RNA, 25 nt, Human
ugcacgcacacacacacacacauac

SEQ ID NO: 1194298 - RNA, 22 nt, Human
ugcauagaccuacacacauaaa

SEQ ID NO: 1194299 - RNA, 20 nt, Human
ugccagaugcuuauaaaacc

SEQ ID NO: 1194300 - RNA, 21 nt, Human
ugccaguggcuuuuccaggug

SEQ ID NO: 1194301 - RNA, 23 nt, Human
uggcaggaaaaaaaaauuguuuc

SEQ ID NO: 1194302 - RNA, 26 nt, Human
uggcaggaaaaaaaaauuguuucaga

SEQ ID NO: 1194303 - RNA, 22 nt, Human
ugggaaacugaaagaaacccca

SEQ ID NO: 1194304 - RNA, 19 nt, Human
ugggaacacaaaaccaaac

SEQ ID NO: 1194305 - RNA, 21 nt, Human
ugggaacacaaaaccaaacca

SEQ ID NO: 1194306 - RNA, 28 nt, Human
uggugcacgcauuugucaauacacaugg

SEQ ID NO: 1194307 - RNA, 23 nt, Human
ugguggaucuaccauucuggggu

SEQ ID NO: 1194308 - RNA, 21 nt, Human
uguaaaacuagagaagucuga

SEQ ID NO: 1194309 - RNA, 23 nt, Human
uuaaacuauggcacaucucuacc

SEQ ID NO: 1194310 - RNA, 21 nt, Human
uuaaaguuccaaaaugaucuc

SEQ ID NO: 1194311 - RNA, 19 nt, Human
uuauaaggaugaagaacag

SEQ ID NO: 1194312 - RNA, 24 nt, Human
uucaaggagagauuugggugggaa

SEQ ID NO: 1194313 - RNA, 22 nt, Human
uuccaggugcauggugcaagcu

SEQ ID NO: 1194314 - RNA, 23 nt, Human
uugcauagaccuacacacauaaa

SEQ ID NO: 1194315 - RNA, 19 nt, Human
uugcauuuguauguuuguu

SEQ ID NO: 1194316 - RNA, 21 nt, Human
uuggaugcaucucaagggaau

SEQ ID NO: 1194317 - RNA, 24 nt, Human
uuuguuuuuaaauuuuuacccugu

SEQ ID NO: 1194318 - RNA, 21 nt, Human
aaaauagacagaugauaggua

SEQ ID NO: 1194319 - RNA, 20 nt, Human
aauaacagauagguagauac

SEQ ID NO: 1194320 - RNA, 20 nt, Human
agaacacagagucuacaagc

SEQ ID NO: 1194321 - RNA, 18 nt, Human
agagagcugagccacaau

SEQ ID NO: 1194322 - RNA, 23 nt, Human
agcaaaggcauauaccuucucca

SEQ ID NO: 1194323 - RNA, 24 nt, Human
agcacuuugggaggcugaggcggg

SEQ ID NO: 1194324 - RNA, 22 nt, Human
agcuguugaagagagcugagcc

SEQ ID NO: 1194325 - RNA, 20 nt, Human
aggaggaaccagcccugccc

SEQ ID NO: 1194326 - RNA, 24 nt, Human
aggcauuauuugguuauaacgucu

SEQ ID NO: 1194327 - RNA, 21 nt, Human
aggcauugcauggauuuacug

SEQ ID NO: 1194328 - RNA, 23 nt, Human
agggcugcugcuaccagcugcug

SEQ ID NO: 1194329 - RNA, 22 nt, Human
agucaaguguaucaagaucaaa

SEQ ID NO: 1194330 - RNA, 21 nt, Human
auaacagguacuuugcccaca

SEQ ID NO: 1194331 - RNA, 23 nt, Human
aucaccagccaaccagaaacaca

SEQ ID NO: 1194332 - RNA, 22 nt, Human
caauacaaagagagaagauaau

SEQ ID NO: 1194333 - RNA, 24 nt, Human
caccucauaagaagagaugaggac

SEQ ID NO: 1194334 - RNA, 24 nt, Human
cacgccuguaaucccagcacuuug

SEQ ID NO: 1194335 - RNA, 23 nt, Human
cacucuuuccuuguguccucuga

SEQ ID NO: 1194336 - RNA, 24 nt, Human
cagcacuuugggaggcugaggcgg

SEQ ID NO: 1194337 - RNA, 19 nt, Human
cagggcugcugcuaccagc

SEQ ID NO: 1194338 - RNA, 18 nt, Human
cauaacagguacuuugcc

SEQ ID NO: 1194339 - RNA, 24 nt, Human
cauauaccuucuccauccccucuc

SEQ ID NO: 1194340 - RNA, 23 nt, Human
caugcagcucuacaaucuuguac

SEQ ID NO: 1194341 - RNA, 18 nt, Human
cauggcccuaacuaacaa

SEQ ID NO: 1194342 - RNA, 23 nt, Human
cauugcauggauuuacugguacc

SEQ ID NO: 1194343 - RNA, 25 nt, Human
ccagaaacacacacuuugggcuuaa

SEQ ID NO: 1194344 - RNA, 20 nt, Human
ccagccaaccagaaacacac

SEQ ID NO: 1194345 - RNA, 24 nt, Human
cccacaccuugaucucagacuucc

SEQ ID NO: 1194346 - RNA, 23 nt, Human
ccuccaggauuguaaggaaauaa

SEQ ID NO: 1194347 - RNA, 22 nt, Human
ccuguaaucccagcacuuuggg

SEQ ID NO: 1194348 - RNA, 19 nt, Human
ccuuguguccucugagagu

SEQ ID NO: 1194349 - RNA, 23 nt, Human
cgccuguaaucccagcacuuugg

SEQ ID NO: 1194350 - RNA, 22 nt, Human
cucacgccuguaaucccagcac

SEQ ID NO: 1194351 - RNA, 24 nt, Human
cucacgccuguaaucccagcacuu

SEQ ID NO: 1194352 - RNA, 20 nt, Human
cucagucuacaguccuuugu

SEQ ID NO: 1194353 - RNA, 18 nt, Human
cuccaagacaaugggaga

SEQ ID NO: 1194354 - RNA, 20 nt, Human
cuguuauagcagcuugaaau

SEQ ID NO: 1194355 - RNA, 24 nt, Human
gacacagacacacacagagagacg

SEQ ID NO: 1194356 - RNA, 21 nt, Human
gaggacacagacacacacaga

SEQ ID NO: 1194357 - RNA, 20 nt, Human
gaugaugugcuacaccuuug

SEQ ID NO: 1194358 - RNA, 20 nt, Human
gcgguggcucacgccuguaa

SEQ ID NO: 1194359 - RNA, 19 nt, Human
gcugggugcgguggcucac

SEQ ID NO: 1194360 - RNA, 19 nt, Human
ggagaacacagagucuaca

SEQ ID NO: 1194361 - RNA, 22 nt, Human
ggaggaaccagcccugcccaca

SEQ ID NO: 1194362 - RNA, 21 nt, Human
ggcucacgccuguaaucccag

SEQ ID NO: 1194363 - RNA, 19 nt, Human
ggcugggugcgguggcuca

SEQ ID NO: 1194364 - RNA, 22 nt, Human
gggagaacacagagucuacaag

SEQ ID NO: 1194365 - RNA, 19 nt, Human
gguauuuguuagaaaaaaa

SEQ ID NO: 1194366 - RNA, 23 nt, Human
gguggcucacgccuguaauccca

SEQ ID NO: 1194367 - RNA, 24 nt, Human
gguggcucacgccuguaaucccag

SEQ ID NO: 1194368 - RNA, 23 nt, Human
guaugaggacaaagggagaacac

SEQ ID NO: 1194369 - RNA, 21 nt, Human
gugaugaugauacacaaauac

SEQ ID NO: 1194370 - RNA, 22 nt, Human
uaagaaagguguugagagcuag

SEQ ID NO: 1194371 - RNA, 22 nt, Human
uaagaagagaugaggacacaga

SEQ ID NO: 1194372 - RNA, 22 nt, Human
uaagaagcaugcagcucuacaa

SEQ ID NO: 1194373 - RNA, 20 nt, Human
uaagcagcuuaucauggccc

SEQ ID NO: 1194374 - RNA, 21 nt, Human
uacacagaugauagauagaug

SEQ ID NO: 1194375 - RNA, 21 nt, Human
uagaagaaaaaaaguguaaua

SEQ ID NO: 1194376 - RNA, 19 nt, Human
uaggaguagagauauagaa

SEQ ID NO: 1194377 - RNA, 24 nt, Human
uaguuuguaaguggaggcuacuuu

SEQ ID NO: 1194378 - RNA, 19 nt, Human
ucauuguuuuuuuuuuuuu

SEQ ID NO: 1194379 - RNA, 19 nt, Human
uccaagacaaugggagaau

SEQ ID NO: 1194380 - RNA, 24 nt, Human
uccuuguguccucugagagucuac

SEQ ID NO: 1194381 - RNA, 21 nt, Human
uccuuuguuauggcagcucua

SEQ ID NO: 1194382 - RNA, 23 nt, Human
ucuacaagccaaggagagaggcc

SEQ ID NO: 1194383 - RNA, 18 nt, Human
ucuacaaucuuguacagu

SEQ ID NO: 1194384 - RNA, 20 nt, Human
ucuacagcauuuuuucccau

SEQ ID NO: 1194385 - RNA, 22 nt, Human
ugaaauggacuaagacaccuca

SEQ ID NO: 1194386 - RNA, 20 nt, Human
ugaagagagcugagccacaa

SEQ ID NO: 1194387 - RNA, 22 nt, Human
ugaagagagcugagccacaaug

SEQ ID NO: 1194388 - RNA, 25 nt, Human
ugaccaaaauaacagauagguagau

SEQ ID NO: 1194389 - RNA, 21 nt, Human
ugaggacaaagggagaacaca

SEQ ID NO: 1194390 - RNA, 18 nt, Human
ugauguggaaaaacagca

SEQ ID NO: 1194391 - RNA, 24 nt, Human
ugcaaaacuagagaacggcucuga

SEQ ID NO: 1194392 - RNA, 18 nt, Human
ugcugcuaccagcugcug

SEQ ID NO: 1194393 - RNA, 18 nt, Human
uggagaacaaaaucugua

SEQ ID NO: 1194394 - RNA, 24 nt, Human
uggcucacgccuguaaucccagca

SEQ ID NO: 1194395 - RNA, 19 nt, Human
ugggaggcugaggcgggcg

SEQ ID NO: 1194396 - RNA, 20 nt, Human
ugggaggcugaggcgggcgg

SEQ ID NO: 1194397 - RNA, 20 nt, Human
uggucauagccuugguguuc

SEQ ID NO: 1194398 - RNA, 22 nt, Human
ugguguucuguuauagcagcuu

SEQ ID NO: 1194399 - RNA, 19 nt, Human
uguaaggaaauaaauuucu

SEQ ID NO: 1194400 - RNA, 22 nt, Human
uguacagugaaacguugggcac

SEQ ID NO: 1194401 - RNA, 22 nt, Human
uguuauggcagcucuagcaaag

SEQ ID NO: 1194402 - RNA, 23 nt, Human
uuccgaccuccaggauuguaagg

SEQ ID NO: 1194403 - RNA, 24 nt, Human
uugcauggauuuacugguaccuaa

SEQ ID NO: 1194404 - RNA, 18 nt, Human
uuguaaguggaggcuacu

SEQ ID NO: 1194405 - RNA, 19 nt, Human
uuugcccacagucaagugu

SEQ ID NO: 1194406 - RNA, 23 nt, Human
uuuuauauuauguauauuugacc

SEQ ID NO: 1194407 - RNA, 20 nt, Human
uuuuccaggcauuauuuggu

SEQ ID NO: 1194408 - RNA, 20 nt, Human
aaaaucuucuccaccaagug

SEQ ID NO: 1194409 - RNA, 19 nt, Human
aaagaucagcauguuucuu

SEQ ID NO: 1194410 - RNA, 21 nt, Human
aagagcagcaaaucuugaaca

SEQ ID NO: 1194411 - RNA, 19 nt, Human
aagcaccaccagagggagg

SEQ ID NO: 1194412 - RNA, 19 nt, Human
aagcagguugucguccuug

SEQ ID NO: 1194413 - RNA, 19 nt, Human
aaguacauugagaccagca

SEQ ID NO: 1194414 - RNA, 25 nt, Human
acacccacacaagaguauguggugc

SEQ ID NO: 1194415 - RNA, 22 nt, Human
acagcauugguaacagucuucc

SEQ ID NO: 1194416 - RNA, 21 nt, Human
accacagcauugguaacaguc

SEQ ID NO: 1194417 - RNA, 22 nt, Human
acccugagagcugcaggcaagc

SEQ ID NO: 1194418 - RNA, 18 nt, Human
agacuggacaacagcauc

SEQ ID NO: 1194419 - RNA, 19 nt, Human
agccggcacugugaccaca

SEQ ID NO: 1194420 - RNA, 21 nt, Human
aggaacccugagagcugcagg

SEQ ID NO: 1194421 - RNA, 24 nt, Human
auuuucuuuauuuuuucuaagaac

SEQ ID NO: 1194422 - RNA, 24 nt, Human
caaacagacguuuggcaucaaaaa

SEQ ID NO: 1194423 - RNA, 20 nt, Human
caccagagggaggagcucca

SEQ ID NO: 1194424 - RNA, 22 nt, Human
cagacuggacaacagcaucauc

SEQ ID NO: 1194425 - RNA, 21 nt, Human
cagagggaggagcuccaccac

SEQ ID NO: 1194426 - RNA, 19 nt, Human
cagcugcaccauaagcaac

SEQ ID NO: 1194427 - RNA, 23 nt, Human
cauauucaagcauuaggaaugcc

SEQ ID NO: 1194428 - RNA, 25 nt, Human
ccacacaagaguauguggugccaag

SEQ ID NO: 1194429 - RNA, 25 nt, Human
ccagggaaucccccaggcauuccuc

SEQ ID NO: 1194430 - RNA, 20 nt, Human
cccacacaagaguauguggu

SEQ ID NO: 1194431 - RNA, 24 nt, Human
ccucuggauagaagcuuuuggucu

SEQ ID NO: 1194432 - RNA, 21 nt, Human
cucaaagauuccauccucaau

SEQ ID NO: 1194433 - RNA, 24 nt, Human
cuccaacgaugaagaaagucacag

SEQ ID NO: 1194434 - RNA, 18 nt, Human
gaacccugagagcugcag

SEQ ID NO: 1194435 - RNA, 20 nt, Human
gaugaagaaagucacaggaa

SEQ ID NO: 1194436 - RNA, 23 nt, Human
gcagacuggacaacagcaucauc

SEQ ID NO: 1194437 - RNA, 23 nt, Human
gcugcaggcaagcucaaugagcu

SEQ ID NO: 1194438 - RNA, 20 nt, Human
ggauugacacaucaaaaaug

SEQ ID NO: 1194439 - RNA, 27 nt, Human
guaacagucuucccaagguaggcuucu

SEQ ID NO: 1194440 - RNA, 20 nt, Human
gugggcccugaggaagcacc

SEQ ID NO: 1194441 - RNA, 22 nt, Human
uaccaagggaaagaggagugac

SEQ ID NO: 1194442 - RNA, 23 nt, Human
uaccaagggaaagaggagugaca

SEQ ID NO: 1194443 - RNA, 19 nt, Human
uacugggcuaugcauuuuc

SEQ ID NO: 1194444 - RNA, 19 nt, Human
uacugggcuaugcauuuuc

SEQ ID NO: 1194445 - RNA, 21 nt, Human
uacugggcuaugcauuuucuu

SEQ ID NO: 1194446 - RNA, 19 nt, Human
uagcagcagcaguuggcuc

SEQ ID NO: 1194447 - RNA, 26 nt, Human
uccaccaccagggaaucccccaggca

SEQ ID NO: 1194448 - RNA, 19 nt, Human
ucccccaggcauuccuccu

SEQ ID NO: 1194449 - RNA, 23 nt, Human
uccucuggauagaagcuuuuggu

SEQ ID NO: 1194450 - RNA, 24 nt, Human
uccucuggauagaagcuuuugguc

SEQ ID NO: 1194451 - RNA, 21 nt, Human
ucguucaguguccauaaaggu

SEQ ID NO: 1194452 - RNA, 25 nt, Human
ugaacuuuuaaaaacugccacagaa

SEQ ID NO: 1194453 - RNA, 19 nt, Human
ugacauccaagagcagcaa

SEQ ID NO: 1194454 - RNA, 26 nt, Human
ugaccacagcauugguaacagucuuc

SEQ ID NO: 1194455 - RNA, 19 nt, Human
ugacucuaccagcaguuuc

SEQ ID NO: 1194456 - RNA, 19 nt, Human
ugagagcugcaggcaagcu

SEQ ID NO: 1194457 - RNA, 21 nt, Human
ugaggcaucacugaucaaucg

SEQ ID NO: 1194458 - RNA, 18 nt, Human
ugcaccauaagcaacagc

SEQ ID NO: 1194459 - RNA, 21 nt, Human
ugccacagaauuugcuacaaa

SEQ ID NO: 1194460 - RNA, 18 nt, Human
ugccugugaguucaaacu

SEQ ID NO: 1194461 - RNA, 22 nt, Human
ugcuucauagcagacuggacaa

SEQ ID NO: 1194462 - RNA, 25 nt, Human
ugcuuuauucauuuuuuugcuuuca

SEQ ID NO: 1194463 - RNA, 23 nt, Human
uggaaaacacccacacaagagua

SEQ ID NO: 1194464 - RNA, 24 nt, Human
uggaccuuaggccugccagcauca

SEQ ID NO: 1194465 - RNA, 26 nt, Human
ugguaacagucuucccaagguaggcu

SEQ ID NO: 1194466 - RNA, 20 nt, Human
uuaaaguaagccggcacugu

SEQ ID NO: 1194467 - RNA, 21 nt, Human
uuauauccuuccccugugcau

SEQ ID NO: 1194468 - RNA, 21 nt, Human
uucucucuucuuuucuagguu

SEQ ID NO: 1194469 - RNA, 20 nt, Human
uucugcucuaaccuuuuugu

SEQ ID NO: 1194470 - RNA, 18 nt, Human
uucuuugaggcaucacug

SEQ ID NO: 1194471 - RNA, 23 nt, Human
uuuccauguacaauaguguuuau

SEQ ID NO: 1194472 - RNA, 26 nt, Human
uuucuaauugaacuuauuugaaucuu

SEQ ID NO: 1194473 - RNA, 18 nt, Human
uuucuagguuaaucuagu

SEQ ID NO: 1194474 - RNA, 19 nt, Human
uuuggccucaaagauucca

SEQ ID NO: 1194475 - RNA, 21 nt, Human
aaaaaagaaaccaaauagagc

SEQ ID NO: 1194476 - RNA, 21 nt, Human
aaaaagaaaccaaauagagca

SEQ ID NO: 1194477 - RNA, 20 nt, Human
aaagaagcuuuaugaccuuu

SEQ ID NO: 1194478 - RNA, 21 nt, Human
aacuaguuugacuggaaauug

SEQ ID NO: 1194479 - RNA, 23 nt, Human
aagaaaagcuucccucaaccucc

SEQ ID NO: 1194480 - RNA, 20 nt, Human
aagaaaccaaauagagcagu

SEQ ID NO: 1194481 - RNA, 22 nt, Human
aagauaagguagacacugaaaa

SEQ ID NO: 1194482 - RNA, 20 nt, Human
acugaccccugcaaaugugc

SEQ ID NO: 1194483 - RNA, 21 nt, Human
acuugagcaaagacacaaagg

SEQ ID NO: 1194484 - RNA, 20 nt, Human
agaaaagcuucccucaaccu

SEQ ID NO: 1194485 - RNA, 20 nt, Human
agaacagccucacaucuaga

SEQ ID NO: 1194486 - RNA, 18 nt, Human
agacacaaaggauaggag

SEQ ID NO: 1194487 - RNA, 22 nt, Human
aggauccugcagccccaggcau

SEQ ID NO: 1194488 - RNA, 22 nt, Human
aggcugacaccaguagccccag

SEQ ID NO: 1194489 - RNA, 18 nt, Human
agggaaaucaggagagcu

SEQ ID NO: 1194490 - RNA, 27 nt, Human
agguagcucagaagcuacacugacccc

SEQ ID NO: 1194491 - RNA, 18 nt, Human
aggugcaccgagcaaggg

SEQ ID NO: 1194492 - RNA, 19 nt, Human
aguguuuauuguauguuag

SEQ ID NO: 1194493 - RNA, 25 nt, Human
auacauacauaugcauaugcauaca

SEQ ID NO: 1194494 - RNA, 22 nt, Human
caauuaagaaaagcuucccuca

SEQ ID NO: 1194495 - RNA, 18 nt, Human
cacaauuaagaaaagcuu

SEQ ID NO: 1194496 - RNA, 18 nt, Human
cagaaaaaauuuccaaga

SEQ ID NO: 1194497 - RNA, 21 nt, Human
cagaaugugauaaaggucuua

SEQ ID NO: 1194498 - RNA, 23 nt, Human
cagcaaguuuucuucccacagcu

SEQ ID NO: 1194499 - RNA, 25 nt, Human
cagcaaguuuucuucccacagcugu

SEQ ID NO: 1194500 - RNA, 24 nt, Human
caggaaccaacuaggauccugcag

SEQ ID NO: 1194501 - RNA, 22 nt, Human
caggcaucagaugagcugcacu

SEQ ID NO: 1194502 - RNA, 18 nt, Human
caucuagaaaagacacag

SEQ ID NO: 1194503 - RNA, 23 nt, Human
ccaacuaggauccugcagcccca

SEQ ID NO: 1194504 - RNA, 22 nt, Human
ccaccaggcugacaccaguagc

SEQ ID NO: 1194505 - RNA, 21 nt, Human
cccaggcucaguauaccaaaa

SEQ ID NO: 1194506 - RNA, 20 nt, Human
cccaguacugggcaggcccc

SEQ ID NO: 1194507 - RNA, 21 nt, Human
ccccagacuccaggcuuuacc

SEQ ID NO: 1194508 - RNA, 22 nt, Human
ccccugcaaaugugccaagaac

SEQ ID NO: 1194509 - RNA, 18 nt, Human
cccuaugaccccagacuc

SEQ ID NO: 1194510 - RNA, 21 nt, Human
ccuaugaccccagacuccagg

SEQ ID NO: 1194511 - RNA, 20 nt, Human
ccuggaguugacauucuacu

SEQ ID NO: 1194512 - RNA, 19 nt, Human
cuagcauguuacaacugau

SEQ ID NO: 1194513 - RNA, 22 nt, Human
cucagaagcuacacugaccccu

SEQ ID NO: 1194514 - RNA, 20 nt, Human
cuggaaaauuaaauacagca

SEQ ID NO: 1194515 - RNA, 24 nt, Human
gaaaauuauaauuuuucuccaaua

SEQ ID NO: 1194516 - RNA, 19 nt, Human
gaagcuacacugaccccug

SEQ ID NO: 1194517 - RNA, 19 nt, Human
gaccccugcaaaugugcca

SEQ ID NO: 1194518 - RNA, 20 nt, Human
gauaggagaaagacagacac

SEQ ID NO: 1194519 - RNA, 20 nt, Human
gggaagaagagggaagugag

SEQ ID NO: 1194520 - RNA, 23 nt, Human
ggggaggugggacuugagcaaag

SEQ ID NO: 1194521 - RNA, 19 nt, Human
guccaacacuggacgugcc

SEQ ID NO: 1194522 - RNA, 19 nt, Human
gugccaagaacagccucac

SEQ ID NO: 1194523 - RNA, 22 nt, Human
uaaaaacagcaaguuuucuucc

SEQ ID NO: 1194524 - RNA, 22 nt, Human
uaaaaguuucaacuaguuugac

SEQ ID NO: 1194525 - RNA, 21 nt, Human
uaaauaaaugaucuagcaugu

SEQ ID NO: 1194526 - RNA, 27 nt, Human
uaacauuuacuaaagaagcuuuaugac

SEQ ID NO: 1194527 - RNA, 22 nt, Human
uaagaaaagcuucccucaaccc

SEQ ID NO: 1194528 - RNA, 20 nt, Human
uacacaauacucuuguguaa

SEQ ID NO: 1194529 - RNA, 22 nt, Human
uacggacuucauuaacaaacau

SEQ ID NO: 1194530 - RNA, 25 nt, Human
uagagcagaguuagggaaaucagga

SEQ ID NO: 1194531 - RNA, 23 nt, Human
uaggauccugcagccccaggcau

SEQ ID NO: 1194532 - RNA, 19 nt, Human
uaugaccccagacuccagg

SEQ ID NO: 1194533 - RNA, 18 nt, Human
uaugcauaugcauacaua

SEQ ID NO: 1194534 - RNA, 27 nt, Human
uaugcauaugcauacauauacacuuuu

SEQ ID NO: 1194535 - RNA, 24 nt, Human
uauuauggacucaaaguuaaauuu

SEQ ID NO: 1194536 - RNA, 23 nt, Human
uauucuaaaaguuucaacuaguu

SEQ ID NO: 1194537 - RNA, 21 nt, Human
uccaagauuuauuauggacuc

SEQ ID NO: 1194538 - RNA, 24 nt, Human
ucccaaggucugucacaggaaccc

SEQ ID NO: 1194539 - RNA, 26 nt, Human
ucuauacauacauaugcauaugcaua

SEQ ID NO: 1194540 - RNA, 23 nt, Human
ucuuuuaugcuguacaauuuccu

SEQ ID NO: 1194541 - RNA, 21 nt, Human
ugaagcagaggcucuaaaaac

SEQ ID NO: 1194542 - RNA, 19 nt, Human
ugagggaagaagagggaag

SEQ ID NO: 1194543 - RNA, 21 nt, Human
ugcaaaugugccaagaacagc

SEQ ID NO: 1194544 - RNA, 20 nt, Human
ugcccuggggauuugaaauu

SEQ ID NO: 1194545 - RNA, 18 nt, Human
ugcugugagguccaacac

SEQ ID NO: 1194546 - RNA, 23 nt, Human
uggaaaggguacagaaugugaua

SEQ ID NO: 1194547 - RNA, 19 nt, Human
uggagggagaaacuuucug

SEQ ID NO: 1194548 - RNA, 18 nt, Human
ugggacuugagcaaagac

SEQ ID NO: 1194549 - RNA, 18 nt, Human
ugggauauaucagugaaa

SEQ ID NO: 1194550 - RNA, 19 nt, Human
ugggcaggccccuaugacc

SEQ ID NO: 1194551 - RNA, 21 nt, Human
ugugccaagaacagccucaca

SEQ ID NO: 1194552 - RNA, 28 nt, Human
uuagaaaauucugacuuugcaauuuuca

SEQ ID NO: 1194553 - RNA, 25 nt, Human
uuagcaguggucagauauuaugaga

SEQ ID NO: 1194554 - RNA, 25 nt, Human
uucccacagcuguuagcagugguca

SEQ ID NO: 1194555 - RNA, 22 nt, Human
uugcuguaguaaaaaaaagaaa

SEQ ID NO: 1194556 - RNA, 20 nt, Human
uuuaugcuguacaauuuccu

SEQ ID NO: 1194557 - RNA, 22 nt, Human
aaacagauuccugauggauucu

SEQ ID NO: 1194558 - RNA, 21 nt, Human
caagaaauacccaauugagua

SEQ ID NO: 1194559 - RNA, 21 nt, Human
cagcucccaggucuccagccc

SEQ ID NO: 1194560 - RNA, 22 nt, Human
caguucauuaagaaauauugau

SEQ ID NO: 1194561 - RNA, 23 nt, Human
cuuuacuuucuuaaacuuuuggu

SEQ ID NO: 1194562 - RNA, 20 nt, Human
ugaauuuacagauguugcca

SEQ ID NO: 1194563 - RNA, 21 nt, Human
ugauggauucuucaucagcuc

SEQ ID NO: 1194564 - RNA, 26 nt, Human
ugcuguacuucagcucugaggaacac

SEQ ID NO: 1194565 - RNA, 21 nt, Human
aacauaaagacuaacaaggaa

SEQ ID NO: 1194566 - RNA, 24 nt, Human
accaagaaauauuuuggaaaaaaa

SEQ ID NO: 1194567 - RNA, 24 nt, Human
agacauuuagcuuuauuagcaacg

SEQ ID NO: 1194568 - RNA, 19 nt, Human
augcauauuucaaaauaug

SEQ ID NO: 1194569 - RNA, 20 nt, Human
cacaaauauacaccugcacu

SEQ ID NO: 1194570 - RNA, 23 nt, Human
cagaaauauuccaaaagaugaaa

SEQ ID NO: 1194571 - RNA, 25 nt, Human
ccucagaaauauuccaaaagaugaa

SEQ ID NO: 1194572 - RNA, 26 nt, Human
gaaccaauuccaauguucgcaaccaa

SEQ ID NO: 1194573 - RNA, 25 nt, Human
uauacaauguuuaguugucaauuaa

SEQ ID NO: 1194574 - RNA, 24 nt, Human
uauguuguauaccauaaauauaua

SEQ ID NO: 1194575 - RNA, 23 nt, Human
ucaaaauauguuguauaccauaa

SEQ ID NO: 1194576 - RNA, 24 nt, Human
ucaaaguucuaccugagaccaaga

SEQ ID NO: 1194577 - RNA, 22 nt, Human
uccaaaagaugaaauaauaguc

SEQ ID NO: 1194578 - RNA, 23 nt, Human
uccaaaagaugaaauaauagucc

SEQ ID NO: 1194579 - RNA, 24 nt, Human
ucgcaaccaaaaaacauucauaac

SEQ ID NO: 1194580 - RNA, 21 nt, Human
uguauaccauaaauauauaca

SEQ ID NO: 1194581 - RNA, 20 nt, Human
uuaaaacauaaagacuaaca

SEQ ID NO: 1194582 - RNA, 23 nt, Human
acucugcugugaaugaagaaucu

SEQ ID NO: 1194583 - RNA, 20 nt, Human
cacagauuaggaaacucugc

SEQ ID NO: 1194584 - RNA, 18 nt, Human
ccuuugaaaauauuacug

SEQ ID NO: 1194585 - RNA, 20 nt, Human
cgaccgaguaucucaucacc

SEQ ID NO: 1194586 - RNA, 26 nt, Human
cgaguaucucaucacccggcaguccc

SEQ ID NO: 1194587 - RNA, 23 nt, Human
cgccgaccgaguaucucaucacc

SEQ ID NO: 1194588 - RNA, 18 nt, Human
uucugguguuuaugauga

SEQ ID NO: 1194589 - RNA, 21 nt, Human
uucugguguuuaugaugacug

SEQ ID NO: 1194590 - RNA, 19 nt, Human
ucagaaaaaugugagagca

SEQ ID NO: 1194591 - RNA, 23 nt, Human
agccaccgcgguuccccauccca

SEQ ID NO: 1194592 - RNA, 21 nt, Human
cacuccuuauccucggccuug

SEQ ID NO: 1194593 - RNA, 19 nt, Human
ccacugccgaaaccuccgc

SEQ ID NO: 1194594 - RNA, 19 nt, Human
cccagggccaccagggccu

SEQ ID NO: 1194595 - RNA, 20 nt, Human
ccuccggacccuccucgcug

SEQ ID NO: 1194596 - RNA, 19 nt, Human
cgccggaugccacugccga

SEQ ID NO: 1194597 - RNA, 19 nt, Human
cggaugccacugccgaaac

SEQ ID NO: 1194598 - RNA, 23 nt, Human
ucccagggccaccagggccuccg

SEQ ID NO: 1194599 - RNA, 25 nt, Human
uccgcggaagccaccgcgguucccc

SEQ ID NO: 1194600 - RNA, 19 nt, Human
ucuuucuuucuuuccuuuu

SEQ ID NO: 1194601 - RNA, 18 nt, Human
ucuuucuuucuuucuuuc

SEQ ID NO: 1194602 - RNA, 23 nt, Human
ucuuucuuucuuucuuuccuuuu

SEQ ID NO: 1194603 - RNA, 19 nt, Human
aacagcacuacucauuacc

SEQ ID NO: 1194604 - RNA, 19 nt, Human
aagcaggcaugauuguaau

SEQ ID NO: 1194605 - RNA, 25 nt, Human
aaugcaaauaugcuauagaacuaaa

SEQ ID NO: 1194606 - RNA, 19 nt, Human
acacaaagcuaaaccugua

SEQ ID NO: 1194607 - RNA, 20 nt, Human
augcaaauaugcuauagaac

SEQ ID NO: 1194608 - RNA, 18 nt, Human
cauucaaacggccuguca

SEQ ID NO: 1194609 - RNA, 18 nt, Human
ccaaagaaggaaacugga

SEQ ID NO: 1194610 - RNA, 22 nt, Human
ccucagaaauggugugguccau

SEQ ID NO: 1194611 - RNA, 21 nt, Human
ccucuguaaaaccaggauaag

SEQ ID NO: 1194612 - RNA, 22 nt, Human
cuaaaguaauaugaacagcacu

SEQ ID NO: 1194613 - RNA, 20 nt, Human
cuacaacuauuuggaaaucu

SEQ ID NO: 1194614 - RNA, 21 nt, Human
cucuccaaaauucuguuugag

SEQ ID NO: 1194615 - RNA, 25 nt, Human
cuuaauaauauguucaaagauaaaa

SEQ ID NO: 1194616 - RNA, 18 nt, Human
ggaaagucaguaaaucuc

SEQ ID NO: 1194617 - RNA, 19 nt, Human
gugaauuuuaaaccucaga

SEQ ID NO: 1194618 - RNA, 19 nt, Human
uaaaaaugcaaauaugcua

SEQ ID NO: 1194619 - RNA, 23 nt, Human
uaaaaccaacauguccagugcua

SEQ ID NO: 1194620 - RNA, 19 nt, Human
uaauaguaacuacaguccc

SEQ ID NO: 1194621 - RNA, 21 nt, Human
uagaaagguccucaugcagca

SEQ ID NO: 1194622 - RNA, 24 nt, Human
uauucuaggaaagucaguaaaucu

SEQ ID NO: 1194623 - RNA, 20 nt, Human
uauuuggaaaucugaacaag

SEQ ID NO: 1194624 - RNA, 19 nt, Human
ucacacaaagcuaaaccug

SEQ ID NO: 1194625 - RNA, 18 nt, Human
ucacagauguuauguucu

SEQ ID NO: 1194626 - RNA, 21 nt, Human
ucaugaauggucaugguaauc

SEQ ID NO: 1194627 - RNA, 23 nt, Human
ucaugguaaucucuccaaaauuc

SEQ ID NO: 1194628 - RNA, 21 nt, Human
ucccagauguugacaguaugu

SEQ ID NO: 1194629 - RNA, 24 nt, Human
ucgcuggcucugggaaagcuacau

SEQ ID NO: 1194630 - RNA, 21 nt, Human
ucugcaguuugagaguccuuc

SEQ ID NO: 1194631 - RNA, 19 nt, Human
ugagaagaccauuucuggc

SEQ ID NO: 1194632 - RNA, 25 nt, Human
ugcaguuugagaguccuucgauuca

SEQ ID NO: 1194633 - RNA, 20 nt, Human
ugccaaagaaggaaacugga

SEQ ID NO: 1194634 - RNA, 22 nt, Human
ugggaaagcuacaugugcauaa

SEQ ID NO: 1194635 - RNA, 24 nt, Human
uggugccaucugcuuaauaauaug

SEQ ID NO: 1194636 - RNA, 19 nt, Human
uggugugguccauuaggcu

SEQ ID NO: 1194637 - RNA, 22 nt, Human
uguccauugauuucacagaugu

SEQ ID NO: 1194638 - RNA, 20 nt, Human
uuaaaaaugcaaauaugcua

SEQ ID NO: 1194639 - RNA, 18 nt, Human
uuggugccaucugcuuaa

SEQ ID NO: 1194640 - RNA, 18 nt, Human
uuucacacaaagcuaaac

SEQ ID NO: 1194641 - RNA, 25 nt, Human
uuuguccauuuuuaaagauaaaacc

SEQ ID NO: 1194642 - RNA, 21 nt, Human
caucaaaacaaaacaagcuga

SEQ ID NO: 1194643 - RNA, 19 nt, Human
uccuggagaggguacacac

SEQ ID NO: 1194644 - RNA, 21 nt, Human
uuauugacaucaaaacaaaac

SEQ ID NO: 1194645 - RNA, 18 nt, Human
uugacaucaaaacaaaac

SEQ ID NO: 1194646 - RNA, 21 nt, Human
uugacaucaaaacaaaacaag

SEQ ID NO: 1194647 - RNA, 23 nt, Human
agauggaauguuugcaagugcua

SEQ ID NO: 1194648 - RNA, 20 nt, Human
agcuucucuucagccgaaga

SEQ ID NO: 1194649 - RNA, 19 nt, Human
aggagcagugguagguggc

SEQ ID NO: 1194650 - RNA, 20 nt, Human
cagugguagguggcuggggg

SEQ ID NO: 1194651 - RNA, 21 nt, Human
cccuaugauaugccagucacu

SEQ ID NO: 1194652 - RNA, 22 nt, Human
ccggagugagcagaucuucuuu

SEQ ID NO: 1194653 - RNA, 18 nt, Human
cggagugagcagaucuuc

SEQ ID NO: 1194654 - RNA, 21 nt, Human
cugguauguauugggcauccc

SEQ ID NO: 1194655 - RNA, 22 nt, Human
cuucucuucagccgaagaugag

SEQ ID NO: 1194656 - RNA, 20 nt, Human
gagugagcagaucuucuuug

SEQ ID NO: 1194657 - RNA, 22 nt, Human
gaugagaaaaacaauccuaaga

SEQ ID NO: 1194658 - RNA, 18 nt, Human
gggaugucucaggauucu

SEQ ID NO: 1194659 - RNA, 25 nt, Human
ggggaugucucaggauucucucagu

SEQ ID NO: 1194660 - RNA, 25 nt, Human
gguagguggcuggggaugucucagg

SEQ ID NO: 1194661 - RNA, 23 nt, Human
uacagggccaugccaggaagaac

SEQ ID NO: 1194662 - RNA, 26 nt, Human
ucaggauucucucaguagcuucucuc

SEQ ID NO: 1194663 - RNA, 21 nt, Human
ucuuugcuuggaacaggagcu

SEQ ID NO: 1194664 - RNA, 18 nt, Human
ugccaggaagaacagugg

SEQ ID NO: 1194665 - RNA, 18 nt, Human
ugguauguauugggcauc

SEQ ID NO: 1194666 - RNA, 22 nt, Human
uuugcaagugcuagcuucucuu

SEQ ID NO: 1194667 - RNA, 22 nt, Human
aaaacccagcccgcgcaaccgc

SEQ ID NO: 1194668 - RNA, 18 nt, Human
aaacaugcugaauuguuu

SEQ ID NO: 1194669 - RNA, 20 nt, Human
aaacccagcccgcgcaaccg

SEQ ID NO: 1194670 - RNA, 24 nt, Human
aauaaaaauuaaaggaaaaaaucu

SEQ ID NO: 1194671 - RNA, 21 nt, Human
caaaaacccagcccgcgcaac

SEQ ID NO: 1194672 - RNA, 19 nt, Human
cccgcgcaaccgcugggag

SEQ ID NO: 1194673 - RNA, 21 nt, Human
cccgcgcaaccgcugggagca

SEQ ID NO: 1194674 - RNA, 21 nt, Human
ccucagcaguauccguugccu

SEQ ID NO: 1194675 - RNA, 20 nt, Human
cuccaaaaacccagcccgcg

SEQ ID NO: 1194676 - RNA, 22 nt, Human
cuucuuguguuuucuuuuugau

SEQ ID NO: 1194677 - RNA, 24 nt, Human
cuuuuccauaauaaaaauuaaagg

SEQ ID NO: 1194678 - RNA, 18 nt, Human
gagcaaaggaaaccaugg

SEQ ID NO: 1194679 - RNA, 18 nt, Human
uaaaugacauuauaccug

SEQ ID NO: 1194680 - RNA, 22 nt, Human
ucuuucuuccuuucuuggaccu

SEQ ID NO: 1194681 - RNA, 25 nt, Human
ugccuuugcuccaaaaacccagccc

SEQ ID NO: 1194682 - RNA, 22 nt, Human
uggcaauuucccacaaguuguu

SEQ ID NO: 1194683 - RNA, 18 nt, Human
ugugucuucaucacugga

SEQ ID NO: 1194684 - RNA, 19 nt, Human
uguuucagaaucagaguca

SEQ ID NO: 1194685 - RNA, 21 nt, Human
uuuccuuuuucuuagcugucu

SEQ ID NO: 1194686 - RNA, 25 nt, Human
uuuuucuuagcugucuuugcucuca

SEQ ID NO: 1194687 - RNA, 25 nt, Human
aaauggacucuuucuucucaaacuu

SEQ ID NO: 1194688 - RNA, 18 nt, Human
agaagaucugggacgccu

SEQ ID NO: 1194689 - RNA, 18 nt, Human
agacuaggaaggcuggca

SEQ ID NO: 1194690 - RNA, 23 nt, Human
aggaguguggguaggaagacuag

SEQ ID NO: 1194691 - RNA, 19 nt, Human
caaaggccaccaccaaaug

SEQ ID NO: 1194692 - RNA, 23 nt, Human
caacgccaaaggccaccaccaaa

SEQ ID NO: 1194693 - RNA, 20 nt, Human
caccaagacagcugagaaga

SEQ ID NO: 1194694 - RNA, 22 nt, Human
caccaagacagcugagaagauc

SEQ ID NO: 1194695 - RNA, 20 nt, Human
cagcugagaagaucugggac

SEQ ID NO: 1194696 - RNA, 23 nt, Human
caucuuugcuuaagcgcuuaaaa

SEQ ID NO: 1194697 - RNA, 19 nt, Human
cgccaaaggccaccaccaa

SEQ ID NO: 1194698 - RNA, 20 nt, Human
cgccaaaggccaccaccaaa

SEQ ID NO: 1194699 - RNA, 20 nt, Human
gacagcagguaggagugugg

SEQ ID NO: 1194700 - RNA, 18 nt, Human
uagcuugcugacaagggu

SEQ ID NO: 1194701 - RNA, 18 nt, Human
uaggaagacuaggaaggc

SEQ ID NO: 1194702 - RNA, 21 nt, Human
uaggaguguggguaggaagac

SEQ ID NO: 1194703 - RNA, 27 nt, Human
ugacaaggguguaggacucgccgcugg

SEQ ID NO: 1194704 - RNA, 18 nt, Human
ugacagcacuuuucaggc

SEQ ID NO: 1194705 - RNA, 18 nt, Human
ugacagcagguaggagug

SEQ ID NO: 1194706 - RNA, 20 nt, Human
ugcacgccuucuucuuuaca

SEQ ID NO: 1194707 - RNA, 19 nt, Human
ugcugacaaggguguagga

SEQ ID NO: 1194708 - RNA, 19 nt, Human
uggaauccauuucuuucaa

SEQ ID NO: 1194709 - RNA, 19 nt, Human
uuaaaaaugauggcuuucu

SEQ ID NO: 1194710 - RNA, 23 nt, Human
uucaaaauggacucuuucuucuc

SEQ ID NO: 1194711 - RNA, 23 nt, Human
uucacugacuguaugauugauga

SEQ ID NO: 1194712 - RNA, 23 nt, Human
uucacugacuguaugauugauga

SEQ ID NO: 1194713 - RNA, 24 nt, Human
ccucucugguucuaggaugggggu

SEQ ID NO: 1194714 - RNA, 18 nt, Human
cgcuccugggaaacccgg

SEQ ID NO: 1194715 - RNA, 21 nt, Human
cgcuccugggaaacccgggaa

SEQ ID NO: 1194716 - RNA, 19 nt, Human
cuaucccaucuggcuuagu

SEQ ID NO: 1194717 - RNA, 21 nt, Human
cucacuguccaccacagucca

SEQ ID NO: 1194718 - RNA, 26 nt, Human
gcuucguguuggguuacugcggucuc

SEQ ID NO: 1194719 - RNA, 22 nt, Human
ggaaucaagaucauuguccucu

SEQ ID NO: 1194720 - RNA, 23 nt, Human
gggaaucaagaucauuguccucu

SEQ ID NO: 1194721 - RNA, 21 nt, Human
gggccaagacgcuccugggaa

SEQ ID NO: 1194722 - RNA, 22 nt, Human
guagaucugggcuggggcugua

SEQ ID NO: 1194723 - RNA, 18 nt, Human
uaggauggggguccacag

SEQ ID NO: 1194724 - RNA, 20 nt, Human
ucacagagaugcucuugaag

SEQ ID NO: 1194725 - RNA, 21 nt, Human
ucgcagaaaggggaaaccugc

SEQ ID NO: 1194726 - RNA, 18 nt, Human
ucucugguucuaggaugg

SEQ ID NO: 1194727 - RNA, 21 nt, Human
ucugggcuggggcuguagaac

SEQ ID NO: 1194728 - RNA, 20 nt, Human
aaaaaaccuaucacacagga

SEQ ID NO: 1194729 - RNA, 20 nt, Human
aaagaaacagcucauaagag

SEQ ID NO: 1194730 - RNA, 24 nt, Human
aaagugcugggauuacaggcguga

SEQ ID NO: 1194731 - RNA, 24 nt, Human
aaagugcugggauuacagguguga

SEQ ID NO: 1194732 - RNA, 20 nt, Human
aacaaauucaguucaaaacc

SEQ ID NO: 1194733 - RNA, 20 nt, Human
aacaugaugacagcaacaac

SEQ ID NO: 1194734 - RNA, 22 nt, Human
aagaagcugggauuacaggcau

SEQ ID NO: 1194735 - RNA, 24 nt, Human
aagaagcugggauuacaggcaugc

SEQ ID NO: 1194736 - RNA, 20 nt, Human
aagauggcaaugggaguggg

SEQ ID NO: 1194737 - RNA, 24 nt, Human
aagcgauucuugugccuuggccuc

SEQ ID NO: 1194738 - RNA, 25 nt, Human
aagcgauucuugugccuuggccucc

SEQ ID NO: 1194739 - RNA, 19 nt, Human
aaguagcugggauuacagg

SEQ ID NO: 1194740 - RNA, 25 nt, Human
aaguagcugggauuacaggcgccca

SEQ ID NO: 1194741 - RNA, 18 nt, Human
aagugcugggauuacagg

SEQ ID NO: 1194742 - RNA, 19 nt, Human
aagugcugggauuacaggc

SEQ ID NO: 1194743 - RNA, 19 nt, Human
aagugcugggauuacaggc

SEQ ID NO: 1194744 - RNA, 19 nt, Human
aagugcugggauuacaggu

SEQ ID NO: 1194745 - RNA, 26 nt, Human
aagugcugggauuacaggugugagcc

SEQ ID NO: 1194746 - RNA, 24 nt, Human
acagaaaaaaaccuaucacacagg

SEQ ID NO: 1194747 - RNA, 23 nt, Human
acaggcgcccaccaccacgcccg

SEQ ID NO: 1194748 - RNA, 19 nt, Human
acaggggaggaaagaggag

SEQ ID NO: 1194749 - RNA, 22 nt, Human
accaucuuggccaggcuggucu

SEQ ID NO: 1194750 - RNA, 22 nt, Human
accauguuggccaggcuggucu

SEQ ID NO: 1194751 - RNA, 19 nt, Human
acccaggcuggagugcagu

SEQ ID NO: 1194752 - RNA, 25 nt, Human
acccgccucagccucccaaagugcu

SEQ ID NO: 1194753 - RNA, 20 nt, Human
acgggauuucaccaucuugg

SEQ ID NO: 1194754 - RNA, 24 nt, Human
acgggauuucaccaucuuggccag

SEQ ID NO: 1194755 - RNA, 18 nt, Human
acgggguuucaccauguu

SEQ ID NO: 1194756 - RNA, 23 nt, Human
acgggguuucaccauguuggcca

SEQ ID NO: 1194757 - RNA, 24 nt, Human
acgggguuucaccauguuggccag

SEQ ID NO: 1194758 - RNA, 21 nt, Human
acuuuauguuucaguuuacua

SEQ ID NO: 1194759 - RNA, 24 nt, Human
acuuuuguauuuuuaguagagacg

SEQ ID NO: 1194760 - RNA, 23 nt, Human
agaaaaaaaccuaucacacagga

SEQ ID NO: 1194761 - RNA, 24 nt, Human
agagucacaaaaaccucagccucc

SEQ ID NO: 1194762 - RNA, 21 nt, Human
agauuggggaggggucugugu

SEQ ID NO: 1194763 - RNA, 22 nt, Human
agcaaaauagagauguuuuuga

SEQ ID NO: 1194764 - RNA, 21 nt, Human
aggaaaagauacagaaaaaaa

SEQ ID NO: 1194765 - RNA, 23 nt, Human
aggaaaagauacagaaaaaaacc

SEQ ID NO: 1194766 - RNA, 25 nt, Human
aggaaaaugaauauuuauucaaugu

SEQ ID NO: 1194767 - RNA, 22 nt, Human
aggagggagguagggauaggcc

SEQ ID NO: 1194768 - RNA, 22 nt, Human
aggaugaagaacagcaaagaaa

SEQ ID NO: 1194769 - RNA, 23 nt, Human
aggaugaagaacagcaaagaaaa

SEQ ID NO: 1194770 - RNA, 18 nt, Human
aggcaagggaaagguggg

SEQ ID NO: 1194771 - RNA, 18 nt, Human
aggcagcaagagagcagg

SEQ ID NO: 1194772 - RNA, 20 nt, Human
aggcaugcaccaccacaccc

SEQ ID NO: 1194773 - RNA, 25 nt, Human
aggcuggagugcaguggcacgaucu

SEQ ID NO: 1194774 - RNA, 21 nt, Human
aggggaggaaagaggaggggu

SEQ ID NO: 1194775 - RNA, 22 nt, Human
aguaaagguaaagaacugugga

SEQ ID NO: 1194776 - RNA, 20 nt, Human
agugcaguggcacgaucuug

SEQ ID NO: 1194777 - RNA, 23 nt, Human
agugcaguggcacgaucuuggcu

SEQ ID NO: 1194778 - RNA, 24 nt, Human
agugcaguggcacgaucuuggcuc

SEQ ID NO: 1194779 - RNA, 18 nt, Human
agugcugggauuacaggc

SEQ ID NO: 1194780 - RNA, 22 nt, Human
auaaagccaaaugcacugaacu

SEQ ID NO: 1194781 - RNA, 19 nt, Human
auccuaagggaauaaucug

SEQ ID NO: 1194782 - RNA, 24 nt, Human
augacagcaacaacgaggaugaag

SEQ ID NO: 1194783 - RNA, 22 nt, Human
augcaggauaaagaaacagcuc

SEQ ID NO: 1194784 - RNA, 19 nt, Human
auggucaugaaugaauggg

SEQ ID NO: 1194785 - RNA, 18 nt, Human
auuaccaucagguugcuu

SEQ ID NO: 1194786 - RNA, 24 nt, Human
auuuuuguauuuuuaguagagacg

SEQ ID NO: 1194787 - RNA, 24 nt, Human
caaaaaccucagccuccuucggga

SEQ ID NO: 1194788 - RNA, 24 nt, Human
caaagugcugggauuacaggcgug

SEQ ID NO: 1194789 - RNA, 24 nt, Human
caaagugcugggauuacaggugug

SEQ ID NO: 1194790 - RNA, 24 nt, Human
caacaaauucaguucaaaaccaca

SEQ ID NO: 1194791 - RNA, 26 nt, Human
caagcaauucucugccucagccuccc

SEQ ID NO: 1194792 - RNA, 20 nt, Human
caauacugaaaaucuggaaa

SEQ ID NO: 1194793 - RNA, 24 nt, Human
caccacgcccggcuaauuuuugua

SEQ ID NO: 1194794 - RNA, 21 nt, Human
caccaucuuggccaggcuggu

SEQ ID NO: 1194795 - RNA, 23 nt, Human
caccaucuuggccaggcuggucu

SEQ ID NO: 1194796 - RNA, 24 nt, Human
caccaucuuggccaggcuggucuu

SEQ ID NO: 1194797 - RNA, 21 nt, Human
caccauguuggccaggcuggu

SEQ ID NO: 1194798 - RNA, 23 nt, Human
caccauguuggccaggcuggucu

SEQ ID NO: 1194799 - RNA, 24 nt, Human
caccauguuggccaggcuggucuu

SEQ ID NO: 1194800 - RNA, 27 nt, Human
caccauguuggccaggcuggucuugaa

SEQ ID NO: 1194801 - RNA, 23 nt, Human
cacccgccucagccucccaaagu

SEQ ID NO: 1194802 - RNA, 21 nt, Human
cacugcaaccuccgccuccug

SEQ ID NO: 1194803 - RNA, 23 nt, Human
cacugcaaccuccgccuccuggg

SEQ ID NO: 1194804 - RNA, 21 nt, Human
caggcgcccaccaccacgccc

SEQ ID NO: 1194805 - RNA, 22 nt, Human
caguaguaggcacugacggugu

SEQ ID NO: 1194806 - RNA, 19 nt, Human
caguggcacgaucuuggcu

SEQ ID NO: 1194807 - RNA, 24 nt, Human
cauguuggccaggcuggucuugaa

SEQ ID NO: 1194808 - RNA, 20 nt, Human
ccaaagugcugggauuacag

SEQ ID NO: 1194809 - RNA, 21 nt, Human
ccaaagugcugggauuacagg

SEQ ID NO: 1194810 - RNA, 21 nt, Human
ccaaagugcugggauuacagg

SEQ ID NO: 1194811 - RNA, 22 nt, Human
ccaaagugcugggauuacaggc

SEQ ID NO: 1194812 - RNA, 22 nt, Human
ccaaagugcugggauuacaggc

SEQ ID NO: 1194813 - RNA, 24 nt, Human
ccaaagugcugggauuacaggcgu

SEQ ID NO: 1194814 - RNA, 24 nt, Human
ccaaagugcugggauuacaggugu

SEQ ID NO: 1194815 - RNA, 24 nt, Human
ccaagaagcugggauuacaggcau

SEQ ID NO: 1194816 - RNA, 22 nt, Human
ccaaguagcugggauuacaggc

SEQ ID NO: 1194817 - RNA, 26 nt, Human
ccacccgccucagccucccaaagugc

SEQ ID NO: 1194818 - RNA, 20 nt, Human
ccaccgcauccgacuucuaa

SEQ ID NO: 1194819 - RNA, 19 nt, Human
cccaagaagcugggauuac

SEQ ID NO: 1194820 - RNA, 24 nt, Human
cccaagaagcugggauuacaggca

SEQ ID NO: 1194821 - RNA, 23 nt, Human
cccaaguagcugggauuacaggc

SEQ ID NO: 1194822 - RNA, 24 nt, Human
cccaaguagcugggauuacaggcg

SEQ ID NO: 1194823 - RNA, 22 nt, Human
cccacaauagagucuagagagu

SEQ ID NO: 1194824 - RNA, 22 nt, Human
cccccuaaggcagcaagagagc

SEQ ID NO: 1194825 - RNA, 24 nt, Human
ccccuaaggcagcaagagagcagg

SEQ ID NO: 1194826 - RNA, 24 nt, Human
ccgccucagccucccaaagugcug

SEQ ID NO: 1194827 - RNA, 26 nt, Human
ccgccuccuggguucaagcaauucuu

SEQ ID NO: 1194828 - RNA, 18 nt, Human
ccuaaccucaagugaucc

SEQ ID NO: 1194829 - RNA, 23 nt, Human
ccuaaccucaagugauccgccug

SEQ ID NO: 1194830 - RNA, 23 nt, Human
ccuaagggaauaaucugaaauac

SEQ ID NO: 1194831 - RNA, 19 nt, Human
ccuccgccuccuggguuca

SEQ ID NO: 1194832 - RNA, 24 nt, Human
ccuccuggguucaagcaauucucu

SEQ ID NO: 1194833 - RNA, 20 nt, Human
ccugaccucgugauccaccc

SEQ ID NO: 1194834 - RNA, 20 nt, Human
ccuggguucaagcaauucuc

SEQ ID NO: 1194835 - RNA, 24 nt, Human
cgccucagccucccaaagugcugg

SEQ ID NO: 1194836 - RNA, 24 nt, Human
cgcucugucacccaggcuggagug

SEQ ID NO: 1194837 - RNA, 24 nt, Human
cguacaaagagaaccaugaucaag

SEQ ID NO: 1194838 - RNA, 24 nt, Human
cgugauccacccgccucagccucc

SEQ ID NO: 1194839 - RNA, 26 nt, Human
cuaacgcacuggguuuuaacaagccc

SEQ ID NO: 1194840 - RNA, 24 nt, Human
cucacugcaaccuccgccuccugg

SEQ ID NO: 1194841 - RNA, 24 nt, Human
cucagccucccaaguagcugggau

SEQ ID NO: 1194842 - RNA, 26 nt, Human
cuccuaaccucaagugauccgccugc

SEQ ID NO: 1194843 - RNA, 24 nt, Human
cuccugaccucgugauccacccgc

SEQ ID NO: 1194844 - RNA, 21 nt, Human
cuccuggguucaagcaauucu

SEQ ID NO: 1194845 - RNA, 24 nt, Human
cucgcucugucacccaggcuggag

SEQ ID NO: 1194846 - RNA, 22 nt, Human
cucuaagccaaguaaagguaaa

SEQ ID NO: 1194847 - RNA, 20 nt, Human
cucugacugcucaacagagg

SEQ ID NO: 1194848 - RNA, 24 nt, Human
cucugccucagccucccaaguagc

SEQ ID NO: 1194849 - RNA, 23 nt, Human
cugcaaccuccgccuccuggguu

SEQ ID NO: 1194850 - RNA, 24 nt, Human
cugcaaccuccgccuccuggguuc

SEQ ID NO: 1194851 - RNA, 23 nt, Human
cugccucagccucccaaguagcu

SEQ ID NO: 1194852 - RNA, 22 nt, Human
cuggaaauagccuaaauuucua

SEQ ID NO: 1194853 - RNA, 21 nt, Human
cugggccucccaaagugcugg

SEQ ID NO: 1194854 - RNA, 19 nt, Human
cuggucagccaaggaaagg

SEQ ID NO: 1194855 - RNA, 22 nt, Human
cuggucagccaaggaaaggggc

SEQ ID NO: 1194856 - RNA, 19 nt, Human
cugucacccaggcuggagu

SEQ ID NO: 1194857 - RNA, 21 nt, Human
cugucagcuaaaccacaugaa

SEQ ID NO: 1194858 - RNA, 18 nt, Human
cuuagugggguuggggaa

SEQ ID NO: 1194859 - RNA, 24 nt, Human
cuuggccucccaagaagcugggau

SEQ ID NO: 1194860 - RNA, 25 nt, Human
cuugugccuuggccucccaagaagc

SEQ ID NO: 1194861 - RNA, 20 nt, Human
cuuuuguauuuuuaguagag

SEQ ID NO: 1194862 - RNA, 23 nt, Human
gaaagaaccccugcucaugugaa

SEQ ID NO: 1194863 - RNA, 18 nt, Human
gaacaugaugacagcaac

SEQ ID NO: 1194864 - RNA, 18 nt, Human
gaagcugggauuacaggc

SEQ ID NO: 1194865 - RNA, 26 nt, Human
gacaggggaggaaagaggaggggugg

SEQ ID NO: 1194866 - RNA, 22 nt, Human
gaccucgugauccacccgccuc

SEQ ID NO: 1194867 - RNA, 24 nt, Human
gaccucgugauccacccgccucag

SEQ ID NO: 1194868 - RNA, 22 nt, Human
gagaaggacugagaagauggca

SEQ ID NO: 1194869 - RNA, 24 nt, Human
gagacgggguuucaccauguuggc

SEQ ID NO: 1194870 - RNA, 19 nt, Human
gagcaggcaauaaagccaa

SEQ ID NO: 1194871 - RNA, 21 nt, Human
gaguggggaggaaggggcuga

SEQ ID NO: 1194872 - RNA, 22 nt, Human
gauaaagaaacagcucauaaga

SEQ ID NO: 1194873 - RNA, 20 nt, Human
gaugacagcaacaacgagga

SEQ ID NO: 1194874 - RNA, 21 nt, Human
gauuacaggcgugagcaccgc

SEQ ID NO: 1194875 - RNA, 18 nt, Human
gauuacaggugugagcca

SEQ ID NO: 1194876 - RNA, 22 nt, Human
gauuacaggugugagccaccgc

SEQ ID NO: 1194877 - RNA, 23 nt, Human
gauuacaggugugagccaccgca

SEQ ID NO: 1194878 - RNA, 26 nt, Human
gcaagagagcaggaagauaagcaaaa

SEQ ID NO: 1194879 - RNA, 20 nt, Human
gcaccaccacacccggcuaa

SEQ ID NO: 1194880 - RNA, 20 nt, Human
gcaggauaaagaaacagcuc

SEQ ID NO: 1194881 - RNA, 22 nt, Human
gcccggcuaauuuuuguauuuu

SEQ ID NO: 1194882 - RNA, 25 nt, Human
gcucugucacccaggcuggagugca

SEQ ID NO: 1194883 - RNA, 19 nt, Human
gcuggagugcaguggcacg

SEQ ID NO: 1194884 - RNA, 23 nt, Human
gcuggucuugaacuccuaaccuc

SEQ ID NO: 1194885 - RNA, 23 nt, Human
gcuggucuugaacuccugaccuc

SEQ ID NO: 1194886 - RNA, 22 nt, Human
ggaggaaagaggaggggugggu

SEQ ID NO: 1194887 - RNA, 22 nt, Human
ggauuucaccaucuuggccagg

SEQ ID NO: 1194888 - RNA, 21 nt, Human
ggcaaugggaguggggaggaa

SEQ ID NO: 1194889 - RNA, 24 nt, Human
ggcuggucuugaacuccuaaccuc

SEQ ID NO: 1194890 - RNA, 24 nt, Human
ggcuggucuugaacuccugaccuc

SEQ ID NO: 1194891 - RNA, 23 nt, Human
gggauuucaccaucuuggccagg

SEQ ID NO: 1194892 - RNA, 23 nt, Human
gggguggguaaacuacuuggaaa

SEQ ID NO: 1194893 - RNA, 23 nt, Human
gggguuucaccauguuggccagg

SEQ ID NO: 1194894 - RNA, 22 nt, Human
ggguuucaccauguuggccagg

SEQ ID NO: 1194895 - RNA, 19 nt, Human
gguaaagaacuguggagca

SEQ ID NO: 1194896 - RNA, 19 nt, Human
ggucuugaacuccugaccu

SEQ ID NO: 1194897 - RNA, 23 nt, Human
guagagacgggguuucaccaugu

SEQ ID NO: 1194898 - RNA, 18 nt, Human
guagcugggauuacaggc

SEQ ID NO: 1194899 - RNA, 18 nt, Human
guaggagggagguaggga

SEQ ID NO: 1194900 - RNA, 20 nt, Human
gugaaagagagauuucuaca

SEQ ID NO: 1194901 - RNA, 24 nt, Human
gugauccacccgccucagccuccc

SEQ ID NO: 1194902 - RNA, 23 nt, Human
gugccuuggccucccaagaagcu

SEQ ID NO: 1194903 - RNA, 22 nt, Human
guuuuugacaacuuggcacuga

SEQ ID NO: 1194904 - RNA, 23 nt, Human
uaaaagccacagugaacaugaug

SEQ ID NO: 1194905 - RNA, 20 nt, Human
uaacaagcaaagaauuuuaa

SEQ ID NO: 1194906 - RNA, 25 nt, Human
uaacaggaaaagauacagaaaaaaa

SEQ ID NO: 1194907 - RNA, 18 nt, Human
uaaccucaagugauccgc

SEQ ID NO: 1194908 - RNA, 24 nt, Human
uaacuuuuguauuuuuaguagaga

SEQ ID NO: 1194909 - RNA, 22 nt, Human
uaaggcagcaagagagcaggaa

SEQ ID NO: 1194910 - RNA, 24 nt, Human
uaauuuuuguauuuuuaguagaga

SEQ ID NO: 1194911 - RNA, 23 nt, Human
uacaggcaugcaccaccacaccc

SEQ ID NO: 1194912 - RNA, 23 nt, Human
uacaggugugagccaccgcaucc

SEQ ID NO: 1194913 - RNA, 22 nt, Human
uagagacgggguuucaccaugu

SEQ ID NO: 1194914 - RNA, 23 nt, Human
uaguagagacgggauuucaccau

SEQ ID NO: 1194915 - RNA, 26 nt, Human
uaguagagacgggauuucaccaucuu

SEQ ID NO: 1194916 - RNA, 24 nt, Human
uaguagagacgggguuucaccaug

SEQ ID NO: 1194917 - RNA, 26 nt, Human
uaguagagacgggguuucaccauguu

SEQ ID NO: 1194918 - RNA, 24 nt, Human
ucacccaggcuggagugcaguggc

SEQ ID NO: 1194919 - RNA, 23 nt, Human
ucacugaaaccuccgucuccugg

SEQ ID NO: 1194920 - RNA, 24 nt, Human
ucacugaaaccuccgucuccuggu

SEQ ID NO: 1194921 - RNA, 23 nt, Human
ucacugcaaccuccgccuccugg

SEQ ID NO: 1194922 - RNA, 24 nt, Human
ucacugcaaccuccgccuccuggg

SEQ ID NO: 1194923 - RNA, 25 nt, Human
ucacugcaaccuccgccuccugggu

SEQ ID NO: 1194924 - RNA, 27 nt, Human
ucacugcaaccuccgccuccuggguuc

SEQ ID NO: 1194925 - RNA, 20 nt, Human
ucagccucccaaguagcugg

SEQ ID NO: 1194926 - RNA, 21 nt, Human
uccacccgccucagccuccca

SEQ ID NO: 1194927 - RNA, 23 nt, Human
ucccaaagugcugggauuacagg

SEQ ID NO: 1194928 - RNA, 24 nt, Human
ucccaaagugcugggauuacaggc

SEQ ID NO: 1194929 - RNA, 24 nt, Human
ucccaagaagcugggauuacaggc

SEQ ID NO: 1194930 - RNA, 24 nt, Human
ucccaaguagcugggauuacaggc

SEQ ID NO: 1194931 - RNA, 24 nt, Human
uccgccuccuggguucaagcaauu

SEQ ID NO: 1194932 - RNA, 24 nt, Human
uccugcuguguugccgaggcugga

SEQ ID NO: 1194933 - RNA, 21 nt, Human
uccuggguucaagcaauucuc

SEQ ID NO: 1194934 - RNA, 23 nt, Human
uccuggguucaagcaauucucug

SEQ ID NO: 1194935 - RNA, 19 nt, Human
uccugguucaagcgauucu

SEQ ID NO: 1194936 - RNA, 21 nt, Human
uccugguucaagcgauucuug

SEQ ID NO: 1194937 - RNA, 22 nt, Human
ucguacaaagagaaccaugauc

SEQ ID NO: 1194938 - RNA, 21 nt, Human
ucuaagccaaguaaagguaaa

SEQ ID NO: 1194939 - RNA, 19 nt, Human
ucucgcucugucacccagg

SEQ ID NO: 1194940 - RNA, 23 nt, Human
ucucgcucugucacccaggcugg

SEQ ID NO: 1194941 - RNA, 24 nt, Human
ucucgcucugucacccaggcugga

SEQ ID NO: 1194942 - RNA, 26 nt, Human
ucucgcucugucacccaggcuggagu

SEQ ID NO: 1194943 - RNA, 27 nt, Human
ucucgcucugucacccaggcuggagug

SEQ ID NO: 1194944 - RNA, 18 nt, Human
ucugaaauacauaaaaac

SEQ ID NO: 1194945 - RNA, 24 nt, Human
ucugucacccaggcuggagugcag

SEQ ID NO: 1194946 - RNA, 19 nt, Human
ucuugaacuccugaccucg

SEQ ID NO: 1194947 - RNA, 22 nt, Human
ucuuggccaggcuggucuugaa

SEQ ID NO: 1194948 - RNA, 23 nt, Human
ugaagcaacaaagauacaguuuc

SEQ ID NO: 1194949 - RNA, 22 nt, Human
ugaaugaaugggugaagagagg

SEQ ID NO: 1194950 - RNA, 18 nt, Human
ugaccucacuaccaaaca

SEQ ID NO: 1194951 - RNA, 20 nt, Human
ugaccucacuaccaaacaua

SEQ ID NO: 1194952 - RNA, 23 nt, Human
ugaccucgugauccacccgccuc

SEQ ID NO: 1194953 - RNA, 26 nt, Human
ugagaagauggcaaugggagugggga

SEQ ID NO: 1194954 - RNA, 22 nt, Human
ugagacggagucucgcucuguc

SEQ ID NO: 1194955 - RNA, 18 nt, Human
ugaugacagcaacaacga

SEQ ID NO: 1194956 - RNA, 22 nt, Human
ugcacugaacuaugucauaagg

SEQ ID NO: 1194957 - RNA, 22 nt, Human
ugcaguggcacgaucuuggcuc

SEQ ID NO: 1194958 - RNA, 24 nt, Human
ugccucagccucccaaguagcugg

SEQ ID NO: 1194959 - RNA, 21 nt, Human
ugccugggccucccaaagugc

SEQ ID NO: 1194960 - RNA, 23 nt, Human
ugcugggauuacaggcgugagca

SEQ ID NO: 1194961 - RNA, 24 nt, Human
ugcugggauuacaggugugagcca

SEQ ID NO: 1194962 - RNA, 22 nt, Human
uggaaauacagaugcccaacua

SEQ ID NO: 1194963 - RNA, 23 nt, Human
uggagucagggaagacucugacu

SEQ ID NO: 1194964 - RNA, 23 nt, Human
uggagugcaguggcacgaucuug

SEQ ID NO: 1194965 - RNA, 24 nt, Human
uggagugcaguggcacgaucuugg

SEQ ID NO: 1194966 - RNA, 24 nt, Human
uggccaggcuggucuugaacuccu

SEQ ID NO: 1194967 - RNA, 24 nt, Human
uggccaggcuggucuugaacuccu

SEQ ID NO: 1194968 - RNA, 21 nt, Human
ugggauuacaggcaugcacca

SEQ ID NO: 1194969 - RNA, 24 nt, Human
ugggauuacaggcaugcaccacca

SEQ ID NO: 1194970 - RNA, 21 nt, Human
ugggauuacaggcgcccacca

SEQ ID NO: 1194971 - RNA, 24 nt, Human
ugggauuacaggcgcccaccacca

SEQ ID NO: 1194972 - RNA, 18 nt, Human
ugggauuacaggcgugag

SEQ ID NO: 1194973 - RNA, 19 nt, Human
ugggauuacaggcgugagc

SEQ ID NO: 1194974 - RNA, 20 nt, Human
ugggauuacaggcgugagca

SEQ ID NO: 1194975 - RNA, 22 nt, Human
ugggauuacaggcgugagcacc

SEQ ID NO: 1194976 - RNA, 23 nt, Human
ugggauuacaggcgugagcaccg

SEQ ID NO: 1194977 - RNA, 18 nt, Human
ugggauuacaggugugag

SEQ ID NO: 1194978 - RNA, 19 nt, Human
ugggauuacaggugugagc

SEQ ID NO: 1194979 - RNA, 21 nt, Human
ugggauuacaggugugagcca

SEQ ID NO: 1194980 - RNA, 22 nt, Human
ugggauuacaggugugagccac

SEQ ID NO: 1194981 - RNA, 23 nt, Human
ugggauuacaggugugagccacc

SEQ ID NO: 1194982 - RNA, 24 nt, Human
ugggauuacaggugugagccaccg

SEQ ID NO: 1194983 - RNA, 22 nt, Human
uggggaggaaggggcugauugc

SEQ ID NO: 1194984 - RNA, 21 nt, Human
uguauuuuuaguagagacggg

SEQ ID NO: 1194985 - RNA, 19 nt, Human
ugucuagaaucacuaguuc

SEQ ID NO: 1194986 - RNA, 22 nt, Human
ugugaccucacuaccaaacaua

SEQ ID NO: 1194987 - RNA, 22 nt, Human
uguggagucagggaagacucug

SEQ ID NO: 1194988 - RNA, 19 nt, Human
uuacaggcgugagcaccgc

SEQ ID NO: 1194989 - RNA, 18 nt, Human
uuaccaucagguugcuua

SEQ ID NO: 1194990 - RNA, 18 nt, Human
uuaguagagacgggauuu

SEQ ID NO: 1194991 - RNA, 24 nt, Human
uuaguagagacgggauuucaccau

SEQ ID NO: 1194992 - RNA, 18 nt, Human
uuaguagagacgggguuu

SEQ ID NO: 1194993 - RNA, 22 nt, Human
uuaguagagacgggguuucacc

SEQ ID NO: 1194994 - RNA, 24 nt, Human
uuaguagagacgggguuucaccau

SEQ ID NO: 1194995 - RNA, 20 nt, Human
uucaagcgauucuugugccu

SEQ ID NO: 1194996 - RNA, 26 nt, Human
uucacugaaaccuccgucuccugguu

SEQ ID NO: 1194997 - RNA, 21 nt, Human
uuggaaagaaagggagaagga

SEQ ID NO: 1194998 - RNA, 23 nt, Human
uuguauuuuuaguagagacgggg

SEQ ID NO: 1194999 - RNA, 25 nt, Human
uuuaacaggaaaagauacagaaaaa

SEQ ID NO: 1195000 - RNA, 24 nt, Human
uuucaccaucuuggccaggcuggu

SEQ ID NO: 1195001 - RNA, 24 nt, Human
uuucaccauguuggccaggcuggu

SEQ ID NO: 1195002 - RNA, 24 nt, Human
uuuuuaguagagacgggauuucac

SEQ ID NO: 1195003 - RNA, 24 nt, Human
uuuuuaguagagacgggguuucac

SEQ ID NO: 1195004 - RNA, 20 nt, Human
uuuuuguauuuuuaguagag

SEQ ID NO: 1195005 - RNA, 19 nt, Human
aaugcagaggaagagagga

SEQ ID NO: 1195006 - RNA, 23 nt, Human
agaggaagagaggaagcccuggc

SEQ ID NO: 1195007 - RNA, 22 nt, Human
augagaacgacuuuauuucaaa

SEQ ID NO: 1195008 - RNA, 27 nt, Human
cugaacaggauauggagggaacccgcu

SEQ ID NO: 1195009 - RNA, 20 nt, Human
gagcuccaaagguggcagcu

SEQ ID NO: 1195010 - RNA, 22 nt, Human
gcaaaugcagaggaagagagga

SEQ ID NO: 1195011 - RNA, 19 nt, Human
ggaagaugcuggcuccaac

SEQ ID NO: 1195012 - RNA, 19 nt, Human
ggagguggccggcccuggg

SEQ ID NO: 1195013 - RNA, 24 nt, Human
ggcugggagguggccggcccuggg

SEQ ID NO: 1195014 - RNA, 26 nt, Human
uaggaagaugcuggcuccaacuucaa

SEQ ID NO: 1195015 - RNA, 20 nt, Human
uggcugaacaggauauggag

SEQ ID NO: 1195016 - RNA, 18 nt, Human
uggcugcagcuccggagc

SEQ ID NO: 1195017 - RNA, 18 nt, Human
ugggagguggccggcccu

SEQ ID NO: 1195018 - RNA, 22 nt, Human
ugggagguggccggcccugggg

SEQ ID NO: 1195019 - RNA, 21 nt, Human
uucaucuuguaggaagaugcu

SEQ ID NO: 1195020 - RNA, 21 nt, Human
aaaaaaccaaggccagcucag

SEQ ID NO: 1195021 - RNA, 22 nt, Human
aaaagcaacagggaggaauggc

SEQ ID NO: 1195022 - RNA, 19 nt, Human
aaagcaacagggaggaaug

SEQ ID NO: 1195023 - RNA, 18 nt, Human
aaccacaacaacaaaagc

SEQ ID NO: 1195024 - RNA, 21 nt, Human
aaccacaacaacaaaagcaac

SEQ ID NO: 1195025 - RNA, 28 nt, Human
aagacaagaaccacaacaacaaaagcaa

SEQ ID NO: 1195026 - RNA, 19 nt, Human
acaacaacaaaagcaacag

SEQ ID NO: 1195027 - RNA, 22 nt, Human
accacaacaacaaaagcaacag

SEQ ID NO: 1195028 - RNA, 19 nt, Human
agacaagaaccacaacaac

SEQ ID NO: 1195029 - RNA, 28 nt, Human
agacaagaaccacaacaacaaaagcaac

SEQ ID NO: 1195030 - RNA, 19 nt, Human
aggaaggagguauguaaac

SEQ ID NO: 1195031 - RNA, 19 nt, Human
agggaggaauggcuccggg

SEQ ID NO: 1195032 - RNA, 23 nt, Human
aguaaaaaaccaaggccagcuca

SEQ ID NO: 1195033 - RNA, 20 nt, Human
auccugggggaggucagagg

SEQ ID NO: 1195034 - RNA, 25 nt, Human
caacaacaaaagcaacagggaggaa

SEQ ID NO: 1195035 - RNA, 20 nt, Human
caacagggaggaauggcucc

SEQ ID NO: 1195036 - RNA, 27 nt, Human
cauuuuuaaucuuuucaaaaucagagg

SEQ ID NO: 1195037 - RNA, 20 nt, Human
ccagcucauccugggggagg

SEQ ID NO: 1195038 - RNA, 22 nt, Human
cucaaguaacuacuucuuuugc

SEQ ID NO: 1195039 - RNA, 23 nt, Human
gacaaacacacaagccaccucuu

SEQ ID NO: 1195040 - RNA, 20 nt, Human
gacaaugaaaaagacaagaa

SEQ ID NO: 1195041 - RNA, 27 nt, Human
gccaccucuucauuuacuguaaaaucc

SEQ ID NO: 1195042 - RNA, 18 nt, Human
ggucagagguugcaggag

SEQ ID NO: 1195043 - RNA, 19 nt, Human
uaaaaaaccaaggccagcu

SEQ ID NO: 1195044 - RNA, 21 nt, Human
uaaaaaaccaaggccagcuca

SEQ ID NO: 1195045 - RNA, 19 nt, Human
uaaagcuguuauuagacaa

SEQ ID NO: 1195046 - RNA, 23 nt, Human
uaaaucccaauaaagcuguuauu

SEQ ID NO: 1195047 - RNA, 25 nt, Human
uacagugauuuccucauuugcagcu

SEQ ID NO: 1195048 - RNA, 22 nt, Human
ucauccugggggaggucagagg

SEQ ID NO: 1195049 - RNA, 24 nt, Human
ugacaaacacacaagccaccucuu

SEQ ID NO: 1195050 - RNA, 22 nt, Human
uggcuccggggcuggcucugcg

SEQ ID NO: 1195051 - RNA, 23 nt, Human
uggcuccggggcuggcucugcgg

SEQ ID NO: 1195052 - RNA, 19 nt, Human
uuccucauuugcagcuuca

SEQ ID NO: 1195053 - RNA, 20 nt, Human
uugacaaacacacaagccac

SEQ ID NO: 1195054 - RNA, 19 nt, Human
uugcagcuucagcuacuca

SEQ ID NO: 1195055 - RNA, 22 nt, Human
gccucacucuucacaaagugcc

SEQ ID NO: 1195056 - RNA, 24 nt, Human
ucgccucacucuucacaaagugcc

SEQ ID NO: 1195057 - RNA, 20 nt, Human
acuccugugcuccugggcau

SEQ ID NO: 1195058 - RNA, 21 nt, Human
aguggcagaugagucucuucu

SEQ ID NO: 1195059 - RNA, 18 nt, Human
uggcagaugagucucuuc

SEQ ID NO: 1195060 - RNA, 21 nt, Human
uggcagaugagucucuucuuc

SEQ ID NO: 1195061 - RNA, 27 nt, Human
uugguuaguggcagaugagucucuucu

SEQ ID NO: 1195062 - RNA, 21 nt, Human
aaaaacacuuuauggaagcuc

SEQ ID NO: 1195063 - RNA, 24 nt, Human
aaaaacacuuuauggaagcucagg

SEQ ID NO: 1195064 - RNA, 24 nt, Human
aaacagaguaguuggugcacacgg

SEQ ID NO: 1195065 - RNA, 23 nt, Human
aaagacagcagaaaagcagaagc

SEQ ID NO: 1195066 - RNA, 19 nt, Human
aacggccuuugagguaagc

SEQ ID NO: 1195067 - RNA, 18 nt, Human
aagaagaaaggaggcuca

SEQ ID NO: 1195068 - RNA, 20 nt, Human
aagaagaaaggaggcucaga

SEQ ID NO: 1195069 - RNA, 20 nt, Human
aagaaguaacaaagacagca

SEQ ID NO: 1195070 - RNA, 20 nt, Human
aagacagcagaaaagcagaa

SEQ ID NO: 1195071 - RNA, 18 nt, Human
aagagucugagagacuug

SEQ ID NO: 1195072 - RNA, 22 nt, Human
aagucacauggcuugaaguugg

SEQ ID NO: 1195073 - RNA, 21 nt, Human
acaagaaguaacaaagacagc

SEQ ID NO: 1195074 - RNA, 27 nt, Human
agaaaagagcuuccagccagggugaag

SEQ ID NO: 1195075 - RNA, 19 nt, Human
agaagaaaggaggcucaga

SEQ ID NO: 1195076 - RNA, 24 nt, Human
agaagaaaggaggcucagagguga

SEQ ID NO: 1195077 - RNA, 23 nt, Human
agaagaagaaaggaggcucagag

SEQ ID NO: 1195078 - RNA, 19 nt, Human
agacagcagaaaagcagaa

SEQ ID NO: 1195079 - RNA, 18 nt, Human
agacaugcaucccagagc

SEQ ID NO: 1195080 - RNA, 20 nt, Human
agaccaagagucugagagac

SEQ ID NO: 1195081 - RNA, 24 nt, Human
agagacaugcaucccagagccuuc

SEQ ID NO: 1195082 - RNA, 24 nt, Human
agcagaaaagcagaagcaugucuu

SEQ ID NO: 1195083 - RNA, 22 nt, Human
agcaugucuuuggccacuguau

SEQ ID NO: 1195084 - RNA, 24 nt, Human
agccaggcgccucauuuucauccu

SEQ ID NO: 1195085 - RNA, 22 nt, Human
aggaaauggguaaaaugguugg

SEQ ID NO: 1195086 - RNA, 21 nt, Human
aggccccaguccuacuccugu

SEQ ID NO: 1195087 - RNA, 26 nt, Human
aguaacaaagacagcagaaaagcaga

SEQ ID NO: 1195088 - RNA, 18 nt, Human
aguggccaaaccauccau

SEQ ID NO: 1195089 - RNA, 19 nt, Human
auaaaguucaaucacaucc

SEQ ID NO: 1195090 - RNA, 23 nt, Human
aucccagagccuucaaaacagag

SEQ ID NO: 1195091 - RNA, 24 nt, Human
augcagguaaaucacuggaccaaa

SEQ ID NO: 1195092 - RNA, 19 nt, Human
caagagucugagagacuug

SEQ ID NO: 1195093 - RNA, 21 nt, Human
cacccaggauagaggcagcag

SEQ ID NO: 1195094 - RNA, 21 nt, Human
cagaaaagagcuuccagccag

SEQ ID NO: 1195095 - RNA, 21 nt, Human
cagccauuagaccaagagucu

SEQ ID NO: 1195096 - RNA, 18 nt, Human
caggcacccaggauagag

SEQ ID NO: 1195097 - RNA, 19 nt, Human
cauuuucauccugagcagg

SEQ ID NO: 1195098 - RNA, 23 nt, Human
ccaaaccauccaugggcaaagag

SEQ ID NO: 1195099 - RNA, 21 nt, Human
ccaguccuacuccuguaggaa

SEQ ID NO: 1195100 - RNA, 22 nt, Human
cccaggauagaggcagcagcuc

SEQ ID NO: 1195101 - RNA, 18 nt, Human
ccccaaagucacauggcu

SEQ ID NO: 1195102 - RNA, 23 nt, Human
ccugucauugcaacagccauuag

SEQ ID NO: 1195103 - RNA, 23 nt, Human
cucaaagcccacuggcucucaag

SEQ ID NO: 1195104 - RNA, 21 nt, Human
cucaaggccccaguccuacuc

SEQ ID NO: 1195105 - RNA, 24 nt, Human
cucaaggccccaguccuacuccug

SEQ ID NO: 1195106 - RNA, 18 nt, Human
cuggcacaagaaguaaca

SEQ ID NO: 1195107 - RNA, 23 nt, Human
gaccaaauggcacccacccaaga

SEQ ID NO: 1195108 - RNA, 24 nt, Human
gagaaggagagacaugcaucccag

SEQ ID NO: 1195109 - RNA, 19 nt, Human
gccccaguccuacuccugu

SEQ ID NO: 1195110 - RNA, 22 nt, Human
gcucagaggugacugauugccc

SEQ ID NO: 1195111 - RNA, 22 nt, Human
gcugacucucaaacaaaggcca

SEQ ID NO: 1195112 - RNA, 18 nt, Human
ggcaaaguggccaaacca

SEQ ID NO: 1195113 - RNA, 22 nt, Human
ggcacaagaaguaacaaagaca

SEQ ID NO: 1195114 - RNA, 18 nt, Human
ggcagaaaagagcuuccg

SEQ ID NO: 1195115 - RNA, 23 nt, Human
gggaaugacagagaaaauuaggc

SEQ ID NO: 1195116 - RNA, 21 nt, Human
gggcagaugucaugagucuuc

SEQ ID NO: 1195117 - RNA, 22 nt, Human
gggcguuguuugcucagggaca

SEQ ID NO: 1195118 - RNA, 19 nt, Human
uaacaaagacagcagaaaa

SEQ ID NO: 1195119 - RNA, 23 nt, Human
uacaaaucaucacaugaggcagg

SEQ ID NO: 1195120 - RNA, 21 nt, Human
uagcugcaaagaaagggcaga

SEQ ID NO: 1195121 - RNA, 18 nt, Human
uaucucaccaguagcugc

SEQ ID NO: 1195122 - RNA, 24 nt, Human
ucaaaacagaguaguuggugcaca

SEQ ID NO: 1195123 - RNA, 22 nt, Human
ucaaugcuggcaccaaagugcc

SEQ ID NO: 1195124 - RNA, 20 nt, Human
ucagaagcuugagagggaaa

SEQ ID NO: 1195125 - RNA, 19 nt, Human
ucaugagucuucagaagcu

SEQ ID NO: 1195126 - RNA, 20 nt, Human
uccccuaggcucuucccuga

SEQ ID NO: 1195127 - RNA, 20 nt, Human
uccugagcaggcuggcugac

SEQ ID NO: 1195128 - RNA, 21 nt, Human
ucuugggacuaucucaccagu
